United States Patent 11,332,783 (SAMPLE ANALYSIS, PRESENCE DETERMINATION OF A TARGET SEQUENCE) - sequence listing, part 6

SEQ ID NO: 102111 - DNA, 75 bp, Artificial Sequence
  Synthetic
catgtgattaaattagatgcagatccagtagaatctcagtcaactttggaaatagcaggactggttaggaagaac

SEQ ID NO: 102112 - DNA, 75 bp, Artificial Sequence
  Synthetic
acttctccatccaatgtggcttcccatgttagagtcaatgtttatctttcagcaattaatttggaatgttttgca

SEQ ID NO: 102113 - DNA, 75 bp, Artificial Sequence
  Synthetic
agtttttccaatcttttccatctggtgaaccatcaaattccaaattatctagttttttccaatctgtcactaatc

SEQ ID NO: 102114 - DNA, 75 bp, Artificial Sequence
  Synthetic
caacacaggttggagatgattctgggggattttcaaccacagtttcaacagagcagaatgttcctgatccacagg

SEQ ID NO: 102115 - DNA, 75 bp, Artificial Sequence
  Synthetic
gggattttcaaccacagtttcaacagagcagaatgttcctgatccacaggttggcataacaactatgagagattt

SEQ ID NO: 102116 - DNA, 75 bp, Artificial Sequence
  Synthetic
ataaatttgagaaagattatgaaatgatggagttttattttaatagaggtggaacttactattcaatttcagctg

SEQ ID NO: 102117 - DNA, 75 bp, Artificial Sequence
  Synthetic
atggatgtttcaggagtgcaggcccctgtgggtgcaattacaactattgaggatcctgttttagcaaagaaagtg

SEQ ID NO: 102118 - DNA, 75 bp, Artificial Sequence
  Synthetic
ctgtgggtgcaattacaactattgaggatcctgttttagcaaagaaagtgcctgagactttcccagaactgaaac

SEQ ID NO: 102119 - DNA, 75 bp, Artificial Sequence
  Synthetic
atactgccataggaaagttgattgtttattgttacaatagactgacttctccctccaatgtggcttctcatgtta

SEQ ID NO: 102120 - DNA, 75 bp, Artificial Sequence
  Synthetic
ttagagatattactcagcattttattaagaaaggggatgtgcctagagctttgaatcgcctggcaacattagtga

SEQ ID NO: 102121 - DNA, 75 bp, Artificial Sequence
  Synthetic
tcatatgtctatttataagttcatggggaggtctcattttttgtgtacttttacttttaattcaaacaacaagga

SEQ ID NO: 102122 - DNA, 75 bp, Artificial Sequence
  Synthetic
aaccatacaaagaattgagattggaggttggcaaacaaagactcaaatatgctcaggaagagttgtcaaatgaag

SEQ ID NO: 102123 - DNA, 75 bp, Artificial Sequence
  Synthetic
gggaggtctcattttttgtgtacttttacttttaattcaaacaacaaggagtatacatttccaattactctgtct

SEQ ID NO: 102124 - DNA, 75 bp, Artificial Sequence
  Synthetic
aatttctgagggcccactaaagatggaagagaaagctacttatgttcataagaaaaatgatggtacaacagttga

SEQ ID NO: 102125 - DNA, 75 bp, Artificial Sequence
  Synthetic
gatgtacctagagccttgaatcgcttggcaacattagtgacaactgttaatggaactcctatgttaatttctgag

SEQ ID NO: 102126 - DNA, 75 bp, Artificial Sequence
  Synthetic
acaacaattgaaccaagatgagcactcccacataattggtttgttgagagttatgaattatgcagatattggctg

SEQ ID NO: 102127 - DNA, 75 bp, Artificial Sequence
  Synthetic
aatgttccagaccctcaagttggtattacaacagtgaaagatcttaaaggtagagcaaaccaagggaaaatggat

SEQ ID NO: 102128 - DNA, 75 bp, Artificial Sequence
  Synthetic
tggatattgaaatggctataacaggggctcctgggatagatgcaatcaatatggattcttcccctggatatcctt

SEQ ID NO: 102129 - DNA, 75 bp, Artificial Sequence
  Synthetic
tgtgtggtggggccttggtttcatcgaatcaatctatacagaatgcaatcttgggcatccatgttgctggaggaa

SEQ ID NO: 102130 - DNA, 75 bp, Artificial Sequence
  Synthetic
tggaactcctatgttaatttctgagggaccattaaagatggaggaaaaagccacttatgttcataagaagaatga

SEQ ID NO: 102131 - DNA, 75 bp, Artificial Sequence
  Synthetic
gagctattactaccattgaagatccagttttggcaaagaaagtgcctgaaacctttccagaattgaagcctggag

SEQ ID NO: 102132 - DNA, 75 bp, Artificial Sequence
  Synthetic
ggccttatgtggtgtttgcctctgaggtactcaggggcatttaggtttttcctcattcttaaataataatgaata

SEQ ID NO: 102133 - DNA, 75 bp, Artificial Sequence
  Synthetic
tgccatcaacattgaggtggttttttaatttgttccagctatatagaggtccattagacttgacaattataatta

SEQ ID NO: 102134 - DNA, 75 bp, Artificial Sequence
  Synthetic
atacagaatgcaattttgggtattcatgttgctggaggaaattcaattcttgtggcaaagttggttactcaagaa

SEQ ID NO: 102135 - DNA, 75 bp, Artificial Sequence
  Synthetic
agtcaagacatacctctgatcatatgtctatttataaatttatgggcagatctcatttcttatgcacatttacat

SEQ ID NO: 102136 - DNA, 75 bp, Artificial Sequence
  Synthetic
gctgtagatacaccttgggtggaaaaggaatcagcattatcaatagattataaaactgctttgggagctgttagg

SEQ ID NO: 102137 - DNA, 75 bp, Artificial Sequence
  Synthetic
ttatctgtatgctgtttcaggagcattggatggcttgggagataagactgattcaacatttggattggtttccat

SEQ ID NO: 102138 - DNA, 75 bp, Artificial Sequence
  Synthetic
aggaatcagcattatcaatagattataaaactgctttgggagctgttaggtttaacacaagaagaacaggaaata

SEQ ID NO: 102139 - DNA, 75 bp, Artificial Sequence
  Synthetic
ttggatggcttgggagataagactgattcaacatttggattggtttccattcagattgctaattacaaccactct

SEQ ID NO: 102140 - DNA, 75 bp, Artificial Sequence
  Synthetic
atttatctgttactgagcagtcagagttttattttccaagagcccctttgaactctaatgctatgttgtctactg

SEQ ID NO: 102141 - DNA, 75 bp, Artificial Sequence
  Synthetic
gctcaagaatcttggatctataaatcaggccatggtgacaaggtgtgagccagttgtttgctatttatatggtaa

SEQ ID NO: 102142 - DNA, 75 bp, Artificial Sequence
  Synthetic
gttttattttccaagagcccctttgaactctaatgctatgttgtctactgagaccatgatgagcagaattgcagc

SEQ ID NO: 102143 - DNA, 75 bp, Artificial Sequence
  Synthetic
ttgatccaatggctgtgatgttgtccaaatattcattacctattgtggaagaaccagaggattacaaagaagctt

SEQ ID NO: 102144 - DNA, 75 bp, Artificial Sequence
  Synthetic
agttgatgattttctagatcttgatatggccattacaggggccccaggaattgatgctatcaacatggattcatc

SEQ ID NO: 102145 - DNA, 75 bp, Artificial Sequence
  Synthetic
gaaccagaggattacaaagaagcttcagttttttatcaaaacaaaatagtaggcaagactcagttagttgatgac

SEQ ID NO: 102146 - DNA, 75 bp, Artificial Sequence
  Synthetic
gatcctagatcagaagaagacaggagatttgaaagtcatattgagagcagaaagccatacaaggaattaaggctt

SEQ ID NO: 102147 - DNA, 75 bp, Artificial Sequence
  Synthetic
gatttgaaagtcatattgagagcagaaagccatacaaggaattaaggcttgaagttggaaagcagagattaaaat

SEQ ID NO: 102148 - DNA, 75 bp, Artificial Sequence
  Synthetic
acagttgatttaactgtggatcaggcatggagaggaaaaggcgaaggtcttcctggaatgtgtggtggggccttg

SEQ ID NO: 102149 - DNA, 75 bp, Artificial Sequence
  Synthetic
agtgcttccacctcctaggaaaatgaaaggattgttttctcaagcaaaaatttctttgttttacactgaggagca

SEQ ID NO: 102150 - DNA, 75 bp, Artificial Sequence
  Synthetic
ttatgctgtctcaggggcactggatgggcttggagacaaaacagattcaacttttggacttgtctccattcaaat

SEQ ID NO: 102151 - DNA, 75 bp, Artificial Sequence
  Synthetic
tgcaaattacaatcattcagatgaatatttgtcttttagttgttacttgtctgtgactgaacagtctgagtttta

SEQ ID NO: 102152 - DNA, 75 bp, Artificial Sequence
  Synthetic
aaaggattgttttctcaagcaaaaatttctttgttttacactgaggagcatgaaataatgaagttttcctggaga

SEQ ID NO: 102153 - DNA, 75 bp, Artificial Sequence
  Synthetic
attgggaatgacagctacttcagctgacaagtctgttcctcaattgaaaccagtttctgagttaacatttttaaa

SEQ ID NO: 102154 - DNA, 75 bp, Artificial Sequence
  Synthetic
tgaggaggtttggcttttctctggcagctggtaggagtgtttggactcttgaaatggatgctggggtgcttactg

SEQ ID NO: 102155 - DNA, 75 bp, Artificial Sequence
  Synthetic
tgatggatagaattgctcttggtgatcttgaatcctcagttgatgatcctcgatctgaagaggatcgtaaatttg

SEQ ID NO: 102156 - DNA, 75 bp, Artificial Sequence
  Synthetic
ttgtgccgaatgtattggggtccagctattagttattttcatttgaatccaggtttccatacaggtgttgctatt

SEQ ID NO: 102157 - DNA, 75 bp, Artificial Sequence
  Synthetic
aacaagagcaattgatgcttgtcctttggattatacaattctatgtcgaatgtattggggtccagctattagtta

SEQ ID NO: 102158 - DNA, 75 bp, Artificial Sequence
  Synthetic
aaaattgtctcattggttgaaaaatttacaagtaataaacattggtctaaagtaaattttccgcatggaatgtta

SEQ ID NO: 102159 - DNA, 75 bp, Artificial Sequence
  Synthetic
agctggtaggagtgtttggactcttgaaatggatgctggggtgcttactggtagattggttaggttgaatgatga

SEQ ID NO: 102160 - DNA, 75 bp, Artificial Sequence
  Synthetic
ttacaagtaataaacattggtctaaagtaaattttccgcatggaatgttagatcttgaggagattgctgctaatt

SEQ ID NO: 102161 - DNA, 75 bp, Artificial Sequence
  Synthetic
aggaagaattgtcaaatgaagtgttgcctcctcctcgtaaaattaagggtgtattttcacaagcaaaaatctcat

SEQ ID NO: 102162 - DNA, 75 bp, Artificial Sequence
  Synthetic
gatttctctgcttttgatgctagtcttagtccatttatgattagagaagcaggtagaatcatgagtgaactatct

SEQ ID NO: 102163 - DNA, 75 bp, Artificial Sequence
  Synthetic
aactgatttgtgtttcttgctgcattggcttaatcccaagaaaattaacctggctgataggatgcttggtttgtc

SEQ ID NO: 102164 - DNA, 75 bp, Artificial Sequence
  Synthetic
tggcttaatcccaagaaaattaacctggctgataggatgcttggtttgtcaggcgtccaagaaattaaagaacaa

SEQ ID NO: 102165 - DNA, 75 bp, Artificial Sequence
  Synthetic
gaactttcttggattcaataacaggttctctgaagtctatgatgtttggatttcatcattctgttactgttgaca

SEQ ID NO: 102166 - DNA, 75 bp, Artificial Sequence
  Synthetic
attttcacgctttctgtcttctttcttccagggctctccccttgccctaggctctggccgttgcgcccggcgggg

SEQ ID NO: 102167 - DNA, 75 bp, Artificial Sequence
  Synthetic
ttgtattatgtgttttccaagatatttggaaagtctccagttttcttttgtcaggctttgaagattctctgttat

SEQ ID NO: 102168 - DNA, 75 bp, Artificial Sequence
  Synthetic
ggtttgatatgtgccatggtgccaggagatcagagttatggatctatagcttccttaacagtttatcctcatggt

SEQ ID NO: 102169 - DNA, 75 bp, Artificial Sequence
  Synthetic
ctgtacaattgttgttatcatgtttgtggttcaatgccttctgggtctccttgtacagctttgttgaattcaatt

SEQ ID NO: 102170 - DNA, 75 bp, Artificial Sequence
  Synthetic
atacagcaattaaatcaggatgagcattctcatataattggtcttttgagagtgatgaattatgctgatattgga

SEQ ID NO: 102171 - DNA, 75 bp, Artificial Sequence
  Synthetic
ctcgagatgttcagattgataatcttgatttgattggacaaaaaattgtagatgagtttaagaaacttggcatga

SEQ ID NO: 102172 - DNA, 75 bp, Artificial Sequence
  Synthetic
tgatttgattggacaaaaaattgtagatgagtttaagaaacttggcatgacagctacttctgctgacaagaatgt

SEQ ID NO: 102173 - DNA, 75 bp, Artificial Sequence
  Synthetic
gagatcagagttatggatctatagcttccttaacagtttatcctcatggtttgttgaattgtaacattaataatg

SEQ ID NO: 102174 - DNA, 75 bp, Artificial Sequence
  Synthetic
ttctctgaagtctatgatgtttggatttcatcattctgttactgttgacattgtaaatattgtcctttgctttgt

SEQ ID NO: 102175 - DNA, 75 bp, Artificial Sequence
  Synthetic
ttttaattggcagatggattccagaatgatggagttgaggacacagagtttctccaattggcttagggacatttg

SEQ ID NO: 102176 - DNA, 75 bp, Artificial Sequence
  Synthetic
agttgactattagagtttggtctgagctaaacattggaactggtacctctgcttatacatcattgaatgtactgg

SEQ ID NO: 102177 - DNA, 75 bp, Artificial Sequence
  Synthetic
attctcatataattggtcttttgagagtgatgaattatgctgatattggatgttcagttatctcatgtggcaaag

SEQ ID NO: 102178 - DNA, 75 bp, Artificial Sequence
  Synthetic
ggattgattggcgagtgccgagcttttttagattctataactagcaccttaaagtcaatgatgtttggtttccat

SEQ ID NO: 102179 - DNA, 75 bp, Artificial Sequence
  Synthetic
aagccagtttcagaattgacttttcttaaaagatcttttaatttggtggaggatagaattagacctgcaatttca

SEQ ID NO: 102180 - DNA, 75 bp, Artificial Sequence
  Synthetic
tggattgacacccctgtctacacagatgatgagaaatgaattcagagttagtacaacagagaatgtagtcaattt

SEQ ID NO: 102181 - DNA, 75 bp, Artificial Sequence
  Synthetic
acacaaagttgaaagatttttatgacatgaattatggcaaaaagaaagatgttcttaatgttctcaaggacaatc

SEQ ID NO: 102182 - DNA, 75 bp, Artificial Sequence
  Synthetic
acgctgagtttgagcagaatttagaaaatgctcagtggtttgcttttatgcatggctatgagttttatcagaaat

SEQ ID NO: 102183 - DNA, 75 bp, Artificial Sequence
  Synthetic
atgatggagttgaggacacagagtttctccaattggcttagggacatttgttcaggaattacaatttttaaaagt

SEQ ID NO: 102184 - DNA, 75 bp, Artificial Sequence
  Synthetic
catgaattatggcaaaaagaaagatgttcttaatgttctcaaggacaatcagcaaagaattgagagggccattga

SEQ ID NO: 102185 - DNA, 75 bp, Artificial Sequence
  Synthetic
cagattcaggatgtggaaaagtttgaacaatttcagaaaggagttgatttgatacagaaattgaggactgttcat

SEQ ID NO: 102186 - DNA, 75 bp, Artificial Sequence
  Synthetic
tgagattttatgaccagtgtttcatttgtgacctttcatgatttgtttaaacgaattttcttaaaatttctgagg

SEQ ID NO: 102187 - DNA, 75 bp, Artificial Sequence
  Synthetic
ttgtgacctttcatgatttgtttaaacgaattttcttaaaatttctgaggtttgtttatttcttttatcagtaaa

SEQ ID NO: 102188 - DNA, 75 bp, Artificial Sequence
  Synthetic
aacaatttcagaaaggagttgatttgatacagaaattgaggactgttcattctatggctcaagttgattctagct

SEQ ID NO: 102189 - DNA, 75 bp, Artificial Sequence
  Synthetic
ttcaagaggggtctccggagatttcctgagtccctcttgggagtccatggtgaggggacttgatacctcaccgcc

SEQ ID NO: 102190 - DNA, 75 bp, Artificial Sequence
  Synthetic
agactgtattgctagagtccaccaaaaacttaaaaatcttggttccattaatcaggccatggtgacaagatgtga

SEQ ID NO: 102191 - DNA, 75 bp, Artificial Sequence
  Synthetic
aaacttaaaaatcttggttccattaatcaggccatggtgacaagatgtgaaccagtggtctgttatttatatggt

SEQ ID NO: 102192 - DNA, 75 bp, Artificial Sequence
  Synthetic
cttaaatcttatgattggtggagaatgagattttatgaccagtgtttcatttgtgacctttcatgatttgtttaa

SEQ ID NO: 102193 - DNA, 75 bp, Artificial Sequence
  Synthetic
tgtaagtattaattcctgcaggttcaggtctcttggatttgttccactttatggacactcatttcacgctttctg

SEQ ID NO: 102194 - DNA, 75 bp, Artificial Sequence
  Synthetic
catcaatagcattagcaacaaaaatttgtaaacattatggtgttgagccagagaagaatatctacaccaagcctg

SEQ ID NO: 102195 - DNA, 75 bp, Artificial Sequence
  Synthetic
gttttgttcctggaaatgaattgattgatgtttcccacataacattgaagcaagccactactgcgccatgtgctg

SEQ ID NO: 102196 - DNA, 75 bp, Artificial Sequence
  Synthetic
ttgtaaacattatggtgttgagccagagaagaatatctacaccaagcctgttgcctcagattattgggatggata

SEQ ID NO: 102197 - DNA, 75 bp, Artificial Sequence
  Synthetic
gatgacataggtcaaaatacaacagatgaagattggtctgatttttgtcaattagtttcagggtgtccaatgagg

SEQ ID NO: 102198 - DNA, 75 bp, Artificial Sequence
  Synthetic
gatttggagatgttggtcttgacttagatttttctgcctttgatgctagtcttagtccatttatgattagggagg

SEQ ID NO: 102199 - DNA, 75 bp, Artificial Sequence
  Synthetic
atgaagattggtctgatttttgtcaattagtttcagggtgtccaatgaggttgaacatggcatctcttgaggaga

SEQ ID NO: 102200 - DNA, 75 bp, Artificial Sequence
  Synthetic
gattgacttcaccctccaatgtggcttcccatgttagagttaatgtttatctttcagctattaatttagagtgtt

SEQ ID NO: 102201 - DNA, 75 bp, Artificial Sequence
  Synthetic
gatggcatggcctggtttactccagtaggccttgctgttgataccccttgggtggaaaaggagtcagctttgtct

SEQ ID NO: 102202 - DNA, 75 bp, Artificial Sequence
  Synthetic
cataattgcaacttcaaattggtcaaatcctagtccaaaaacagtttatgtcaaggaggctattgatcgtagact

SEQ ID NO: 102203 - DNA, 75 bp, Artificial Sequence
  Synthetic
ctttcagctattaatttagagtgttttgctcccctctatcatgctatggatgtcacaactcaggttggagatgat

SEQ ID NO: 102204 - DNA, 75 bp, Artificial Sequence
  Synthetic
tttggatagggtaacagcggcggatattggtgagttgtttgacaaaaaccattcaacgccggaggactggctctc

SEQ ID NO: 102205 - DNA, 75 bp, Artificial Sequence
  Synthetic
ctcctctttctacacagatgatgagaaatgaatttagagttagtactactgaaaatgttgtaaatttgtcaaatt

SEQ ID NO: 102206 - DNA, 75 bp, Artificial Sequence
  Synthetic
acattatggtgttgagcctgagaaaaatatatacacaaaacctgttgcatctgattattgggatggatatagtgg

SEQ ID NO: 102207 - DNA, 75 bp, Artificial Sequence
  Synthetic
atgatatgttgaatgttaatttagctaaaacaagtgatgcaattaaggacatgtcatgtgttgatttaatcatgg

SEQ ID NO: 102208 - DNA, 75 bp, Artificial Sequence
  Synthetic
tccagagatgttcaaattgataatcttgatttgattggacagaaaattgtggatgagtttaaaaaacttggcatg

SEQ ID NO: 102209 - DNA, 75 bp, Artificial Sequence
  Synthetic
ttgaatgctggacatttctttggggccttatgttttgtttgcctctgaggtactcaggggcatttaggtttttcc

SEQ ID NO: 102210 - DNA, 75 bp, Artificial Sequence
  Synthetic
gttgaaattagaaaacagaatatgactgaattcatggagttgtggtctcaagggatctcagatgatgatagtgca

SEQ ID NO: 102211 - DNA, 75 bp, Artificial Sequence
  Synthetic
gtccttgatagcttggcagagaagcaacgctgagtttgagcagaatttggaaaatgctcagtggtttgcttttat

SEQ ID NO: 102212 - DNA, 75 bp, Artificial Sequence
  Synthetic
atggcttctttggaagaaaagggtcgtcatttttcttcaccctttataattgcaacatccaactggtctaaccca

SEQ ID NO: 102213 - DNA, 75 bp, Artificial Sequence
  Synthetic
gatcttaaaggtagggcaaatcaagggaaaatggacatttcaggtgttcaggctcctgtgggagctatcactacc

SEQ ID NO: 102214 - DNA, 75 bp, Artificial Sequence
  Synthetic
taaaacaagtgatgcaattaaggacatgtcatgtgttgatttaatcatggatggccataatatttcactgatgga

SEQ ID NO: 102215 - DNA, 75 bp, Artificial Sequence
  Synthetic
attgtcaggttttttccagtcagttaccaatcacaaatgggttgctgtgggggctgctgtaggcattcttggtgt

SEQ ID NO: 102216 - DNA, 75 bp, Artificial Sequence
  Synthetic
ctgaattcatggagttgtggtctcaagggatctcagatgatgatagtgcagtggcagaattttttcagtcctttc

SEQ ID NO: 102217 - DNA, 75 bp, Artificial Sequence
  Synthetic
caaagttgaggtgaaacctgcctcattctttaagaatcctcataatgatatgttaaatgtcaatctggcaaaaac

SEQ ID NO: 102218 - DNA, 75 bp, Artificial Sequence
  Synthetic
accaatcacaaatgggttgctgtgggggctgctgtaggcattcttggtgtgcttgtgggaggctggtttgtctac

SEQ ID NO: 102219 - DNA, 75 bp, Artificial Sequence
  Synthetic
aaccaattcctactgagggagtgtaccatggtgtgacaaagcctaaacaggtgattaagctggatgctgatccag

SEQ ID NO: 102220 - DNA, 75 bp, Artificial Sequence
  Synthetic
agctggcttggttagaaagaatcttgttcaattcggtgttggagagaaaaatggatgtgtgagatgggttatgaa

SEQ ID NO: 102221 - DNA, 75 bp, Artificial Sequence
  Synthetic
tgagaaggagtctgctctttccattgactataaaacagctcttggcgctgttaggttcaatactagaagaacagg

SEQ ID NO: 102222 - DNA, 75 bp, Artificial Sequence
  Synthetic
ggaattttattttaatagaggtggtacttattattctatatctgctggcaatgttgtaatacaatctttagatgt

SEQ ID NO: 102223 - DNA, 75 bp, Artificial Sequence
  Synthetic
gggctgctgtgggagtacttggtgttttggttggaggttggtatgtctataagcattttacaaagaagcaagaag

SEQ ID NO: 102224 - DNA, 75 bp, Artificial Sequence
  Synthetic
ggagatcagagctatggatccatagcttctttgacagtttatcctcatggtttgttgaattgtaatattaataat

SEQ ID NO: 102225 - DNA, 75 bp, Artificial Sequence
  Synthetic
aaagttccaacaattcctaaatttagagacattacggagcatttcatcaagaaaggtgatgtgcctcgtgctttg

SEQ ID NO: 102226 - DNA, 75 bp, Artificial Sequence
  Synthetic
tggtccaaagtgaactttccacatggaatgttggaccttgaagaaattgctgccaattctaaagattttccaaac

SEQ ID NO: 102227 - DNA, 75 bp, Artificial Sequence
  Synthetic
ccttgaatactaatgctatgatgtcatcagaaacaatgatggacagaattgctcttggtgatctcgaatcttcag

SEQ ID NO: 102228 - DNA, 75 bp, Artificial Sequence
  Synthetic
gagacattacggagcatttcatcaagaaaggtgatgtgcctcgtgctttgaatcgtctagcgactttggtgacaa

SEQ ID NO: 102229 - DNA, 75 bp, Artificial Sequence
  Synthetic
ttctgagggtcctctcaaaatggaggaaaaggccacctatgtgcacaaaaagaatgatggtactactgttgactt

SEQ ID NO: 102230 - DNA, 75 bp, Artificial Sequence
  Synthetic
ttgatgatcctcgatctgaagaggatcgtaaatttgagagtcatattgaaaagaggaagccctataaagagttaa

SEQ ID NO: 102231 - DNA, 75 bp, Artificial Sequence
  Synthetic
gaaaaggccacctatgtgcacaaaaagaatgatggtactactgttgacttaacagtggatcaagcctggagagga

SEQ ID NO: 102232 - DNA, 75 bp, Artificial Sequence
  Synthetic
gatgatgagaaatgaatttagagtcagtacaacagaaaatgtagttaatttgtccaattatgaagatgctagagc

SEQ ID NO: 102233 - DNA, 75 bp, Artificial Sequence
  Synthetic
agtttgaaaaagattatgaaatgatggaattttattttaatagaggtggtacttattactcaatttcagcaggaa

SEQ ID NO: 102234 - DNA, 75 bp, Artificial Sequence
  Synthetic
gtggtggcgccttgatttcatcaaatcagtccatacagaatgcaatcttgggcatacatgtggctggaggtaatt

SEQ ID NO: 102235 - DNA, 75 bp, Artificial Sequence
  Synthetic
aaagtgcccacaattccaaaatttagagatataacagaacattttattaaaaagagtgatgtacctagagctttg

SEQ ID NO: 102236 - DNA, 75 bp, Artificial Sequence
  Synthetic
agctttgaggagatttggcttttcactggctgctggcaggagtgtgtggacattggaaatggatgctggagtttt

SEQ ID NO: 102237 - DNA, 75 bp, Artificial Sequence
  Synthetic
ttttacaacttggacatcaattcccactttggctgctcagtttccatttaatgcttctgattcagttggacagca

SEQ ID NO: 102238 - DNA, 75 bp, Artificial Sequence
  Synthetic
gactggaaggttggtgagggttaatgatgagaaatggacagaaataaaagatgacaaaatagcttctttggtgga

SEQ ID NO: 102239 - DNA, 75 bp, Artificial Sequence
  Synthetic
tcctgcagcgatgcctttttcaagagcagaaattgacccgatggctgtgatgctttcaaagtattccttgcctat

SEQ ID NO: 102240 - DNA, 75 bp, Artificial Sequence
  Synthetic
ttggttatatacaaaattgaaggatttttatgaagtaaattatggcaagaaaaaggatgttcttaatattcttaa

SEQ ID NO: 102241 - DNA, 75 bp, Artificial Sequence
  Synthetic
gatgtttcaattttctttcagaataaaattatggggaagagcattttggttgatgattttttggatcttgacatg

SEQ ID NO: 102242 - DNA, 75 bp, Artificial Sequence
  Synthetic
atatcactcagggagattattattttgttttgttcctggaaatgaattgattgatgtttcccatataacactgaa

SEQ ID NO: 102243 - DNA, 75 bp, Artificial Sequence
  Synthetic
aaattatggggaagagcattttggttgatgattttttggatcttgacatggctattactgggactcctggaatag

SEQ ID NO: 102244 - DNA, 75 bp, Artificial Sequence
  Synthetic
aaatttggcagataggatgttgggtctatcagggatacaggaaattaaagaaaaaggagtgggactgattggtga

SEQ ID NO: 102245 - DNA, 75 bp, Artificial Sequence
  Synthetic
caactttgagatttcgtgttccttggatttcagatactccttatagagttaatagatacaccaaatcgtcacatc

SEQ ID NO: 102246 - DNA, 75 bp, Artificial Sequence
  Synthetic
cggatttccctatgttcaggaaaaattaactaaaagagacttgatttggttgcatgaaaatggattgctattagg

SEQ ID NO: 102247 - DNA, 75 bp, Artificial Sequence
  Synthetic
ttaactaaaagagacttgatttggttgcatgaaaatggattgctattaggcatacatccaagattagcccagaga

SEQ ID NO: 102248 - DNA, 75 bp, Artificial Sequence
  Synthetic
actagtaccttaaagtcaatgatgtttggctttcatcactctgtcacagttgaaatcattaacactgttttatgt

SEQ ID NO: 102249 - DNA, 75 bp, Artificial Sequence
  Synthetic
ctgtccattcaatggctcaagttgaccctaacttgggggttcacttgtctcctctcagagattgcatagcaagag

SEQ ID NO: 102250 - DNA, 75 bp, Artificial Sequence
  Synthetic
atcacattgataaaaacatgattaattttcctgctgtgatgcccttttctagggcagaaattgatcccatggcag

SEQ ID NO: 102251 - DNA, 75 bp, Artificial Sequence
  Synthetic
agaattgttcagatctggatgtggtttttacaacttgtccaaaagatgagttaaggccattggacaaagtgttag

SEQ ID NO: 102252 - DNA, 75 bp, Artificial Sequence
  Synthetic
agactgacttctccctccaatgtggcctctcatgttagagttaatgtttacctctcagctattaatttagaatgt

SEQ ID NO: 102253 - DNA, 75 bp, Artificial Sequence
  Synthetic
agatgtgagcctgttgtttgctatttgtatggtaaaagagggggaggaaaaagtttgacctcaattgcattggca

SEQ ID NO: 102254 - DNA, 75 bp, Artificial Sequence
  Synthetic
ttttacaacttgtccaaaagatgagttaaggccattggacaaagtgttagagtctaaaacaagagccattgatgc

SEQ ID NO: 102255 - DNA, 75 bp, Artificial Sequence
  Synthetic
tgtcggatgtattggggtccggctataagttattttcatttgaatcctggatttcatactggtgtagccattgga

SEQ ID NO: 102256 - DNA, 75 bp, Artificial Sequence
  Synthetic
gggaaaatggatatttcgggtgtccaagctcctgtaggagctattactaccattgaagatccagttttggcaaag

SEQ ID NO: 102257 - DNA, 75 bp, Artificial Sequence
  Synthetic
aatgcttggattgtctggagttcaggaaattaaagaacaaggtgttggattaatagcagagtgtagaactttctt

SEQ ID NO: 102258 - DNA, 75 bp, Artificial Sequence
  Synthetic
ctcttttttatactgaggagcatgaaataatgaaattttcttggagaggagtgactgctgatactagggctttga

SEQ ID NO: 102259 - DNA, 75 bp, Artificial Sequence
  Synthetic
gctttatacaaaaatcagagaatattatgatctgaattatggcagtaaaaaggatgttctcaatattctgaaaga

SEQ ID NO: 102260 - DNA, 75 bp, Artificial Sequence
  Synthetic
ttttctgcttttgatgctagtcttagtccatttatgatcagagaggcaggtagaattatgtcagaaatttcagga

SEQ ID NO: 102261 - DNA, 75 bp, Artificial Sequence
  Synthetic
tggtagaagtgtgtggactcttgagatggatgctggagttcttactggaagattgatcagattgaatgatgagaa

SEQ ID NO: 102262 - DNA, 75 bp, Artificial Sequence
  Synthetic
tctccttttataatagcaacttcaaattggtcaaatccaagtccaaaaacagtttatgttaaggaagcaattgat

SEQ ID NO: 102263 - DNA, 75 bp, Artificial Sequence
  Synthetic
tcattaatacaattatttactcaaaacatttgttgtacaattgttgttatcatgtgtatggatcaatgccatcag

SEQ ID NO: 102264 - DNA, 75 bp, Artificial Sequence
  Synthetic
caaagagtacacttttcctattactttgtcatcaacttctaatcctcctcatggactgccttcaactctgagatg

SEQ ID NO: 102265 - DNA, 75 bp, Artificial Sequence
  Synthetic
tgagattcaagttcagataaaccctacaccctttcagcaagggggattaatttgtgccatggttcctggtgacca

SEQ ID NO: 102266 - DNA, 75 bp, Artificial Sequence
  Synthetic
ttaaacctgcttcattttttaaaaatcctcacaatgatatgttgaatgttaatttggctaaaacaaatgatgcaa

SEQ ID NO: 102267 - DNA, 75 bp, Artificial Sequence
  Synthetic
acatttgttgtacaattgttgttatcatgtgtatggatcaatgccatcagggtctccttgtacagctttgcttaa

SEQ ID NO: 102268 - DNA, 75 bp, Artificial Sequence
  Synthetic
tattatgtctttgccaagatttttaggaagtctcctgtgtttttcagtcaagctgtgaggatcttgtgttatgga

SEQ ID NO: 102269 - DNA, 75 bp, Artificial Sequence
  Synthetic
ggaagtctcctgtgtttttcagtcaagctgtgaggatcttgtgttatggagatgatgttttggtggttttttcta

SEQ ID NO: 102270 - DNA, 75 bp, Artificial Sequence
  Synthetic
gcacatttacattcaattctaataacaaagagtacacttttcctattactttgtcatcaacttctaatcctcctc

SEQ ID NO: 102271 - DNA, 75 bp, Artificial Sequence
  Synthetic
gggttggcagtagacaccccatgggttgagaaggagtctgctctttccattgattataaaacagctcttggtgct

SEQ ID NO: 102272 - DNA, 75 bp, Artificial Sequence
  Synthetic
gaggggagatcttgtttttgattttcaggtttttccaactaaatatcattcaggtagattattgttttgttttgt

SEQ ID NO: 102273 - DNA, 75 bp, Artificial Sequence
  Synthetic
tcaaattggacagaaaattgtgcatgaatttaaagagctgggaatgacagctacttctgctgacaagactgtgcc

SEQ ID NO: 102274 - DNA, 75 bp, Artificial Sequence
  Synthetic
tgagtccattcatgataagggaagctggaagaatcctcactgagatgtctggagcccctgttcattttggagagg

SEQ ID NO: 102275 - DNA, 75 bp, Artificial Sequence
  Synthetic
acagttgaagccagtttcagaattgacttttcttaagaggtcttttaatttagtagaggacagaattagaccagc

SEQ ID NO: 102276 - DNA, 75 bp, Artificial Sequence
  Synthetic
agaaaagggtcgtcatttttcctcacctttcataattgcaacatcgaactggtctaatccaagtcccaaaacagt

SEQ ID NO: 102277 - DNA, 75 bp, Artificial Sequence
  Synthetic
ttttccaatctgtcactaatcacaagtgggttgctgtgggagctgcagttggcattcttggagtgcttgtgggag

SEQ ID NO: 102278 - DNA, 75 bp, Artificial Sequence
  Synthetic
aaacagattcaacttttggacttgtttccattcaaattgcaaattacaatcattcagatgaatatttgtctttta

SEQ ID NO: 102279 - DNA, 75 bp, Artificial Sequence
  Synthetic
aagacatgtcatgtgttgatcttgttatggataatcacaatgtttcattgtctgaattgcttagttcactggtga

SEQ ID NO: 102280 - DNA, 75 bp, Artificial Sequence
  Synthetic
ggattctattggacaaagaattgttgatgagtttaagaaattgggaatgacagctacttcagctgacaagtctgt

SEQ ID NO: 102281 - DNA, 75 bp, Artificial Sequence
  Synthetic
ggttttatgatcagtgctttgtttgtgacctttcatgatttgtttaaacaaattttcttaaaatttctgaggttt

SEQ ID NO: 102282 - DNA, 75 bp, Artificial Sequence
  Synthetic
aaggatgccatatattggttatatacaaaattgaaggatttttatgatgtaaactatggcaagaaaaaggatgtt

SEQ ID NO: 102283 - DNA, 75 bp, Artificial Sequence
  Synthetic
atcgtaaatttgaaagtcatattgaaaagaggaaaccttacaaagagttaagattggaggtaggtaagcaaaggc

SEQ ID NO: 102284 - DNA, 75 bp, Artificial Sequence
  Synthetic
tcacagggattatcagatgatgacaatgatagtgcagttgctgaatttttccagtcctttccttctggtgaacca

SEQ ID NO: 102285 - DNA, 75 bp, Artificial Sequence
  Synthetic
tgacctttcatgatttgtttaaacaaattttcttaaaatttctgaggtttgtttatttctgaggtttgtttattt

SEQ ID NO: 102286 - DNA, 75 bp, Artificial Sequence
  Synthetic
tccaatccgtgaccaatcacaagtgggttgcagttggggctgctgtgggagttcttggtgttttggttggtggtt

SEQ ID NO: 102287 - DNA, 75 bp, Artificial Sequence
  Synthetic
tggaaaggaattactgctgatactagagctttgaggagatttggcttttcactggctgctggtaggagtgtgtgg

SEQ ID NO: 102288 - DNA, 75 bp, Artificial Sequence
  Synthetic
gttcttggtgttttggttggtggttggtatgtttacaagcattttacaaagaagcgagaagagtccattccaagt

SEQ ID NO: 102289 - DNA, 75 bp, Artificial Sequence
  Synthetic
cttaaatcatatgattggtggagaatgaagtttaatgatcagtgctttgtttgtgacctttcatgatttgtttaa

SEQ ID NO: 102290 - DNA, 75 bp, Artificial Sequence
  Synthetic
agaaatttactagtaataaacactggtccaaaattaattttcctcatggaatgctagatctagaagagatagctg

SEQ ID NO: 102291 - DNA, 75 bp, Artificial Sequence
  Synthetic
ttgcattggctgaatcccaagaagataaacttagcagatagaatgttgggtttgtcaggaatacaggagataaaa

SEQ ID NO: 102292 - DNA, 75 bp, Artificial Sequence
  Synthetic
agtgccgagctttcctggattctataactagtactttaaagtcaatgatgttcggtttccatcactctgtcacag

SEQ ID NO: 102293 - DNA, 75 bp, Artificial Sequence
  Synthetic
ttcggtttccatcactctgtcacagttgaaattattaatactgttttatgttttgttaaaagtggcattctgcta

SEQ ID NO: 102294 - DNA, 75 bp, Artificial Sequence
  Synthetic
catttcatcaaaaagagtgatgtacccagagctttgaatagactggcaacacttgtgacaacggttaacgggact

SEQ ID NO: 102295 - DNA, 75 bp, Artificial Sequence
  Synthetic
tttactcagtgttcaatgaatgtggtctccaaaacgctttttaggaagagtcccattcatcatcacattgataga

SEQ ID NO: 102296 - DNA, 75 bp, Artificial Sequence
  Synthetic
tgcctttttccaaggctgaaattgatccaatggctatgatgttgtctaaatattcattacctatagtggaagaac

SEQ ID NO: 102297 - DNA, 75 bp, Artificial Sequence
  Synthetic
aactgtttttaattggcagatggattcgagaatgatggagctcagaactcagagtatttcaaattggcttagaga

SEQ ID NO: 102298 - DNA, 75 bp, Artificial Sequence
  Synthetic
ggctccaggcattgatgctattaatatggactcctcccctgggtttccttatgtccaagaaaaattgactaaaag

SEQ ID NO: 102299 - DNA, 75 bp, Artificial Sequence
  Synthetic
aaaagttttaaggatgcaatttattggctttacacaaaaatcagagaatattatgatctgaattatggtaataaa

SEQ ID NO: 102300 - DNA, 75 bp, Artificial Sequence
  Synthetic
ggctttacacaaaaatcagagaatattatgatctgaattatggtaataaaaaggatgttcttaatattttgaaag

SEQ ID NO: 102301 - DNA, 75 bp, Artificial Sequence
  Synthetic
tggtggaaattcaattttggttgctaagttagtgacccaagagatgtttcaaaatatagataagaaaatagttga

SEQ ID NO: 102302 - DNA, 75 bp, Artificial Sequence
  Synthetic
aattgaggaggctgataatttttgtgttcttcagattcaggatgttgaaaaatttgaacagtaccaaaaaggggt

SEQ ID NO: 102303 - DNA, 75 bp, Artificial Sequence
  Synthetic
gttcttcagattcaggatgttgaaaaatttgaacagtaccaaaaaggggtagatttgattcaaaaattgagaact

SEQ ID NO: 102304 - DNA, 75 bp, Artificial Sequence
  Synthetic
catcaaaaattaaagaatttgggttcaattaaccaggcaatggtgacaagatgtgagccagtcgtctgctacctt

SEQ ID NO: 102305 - DNA, 75 bp, Artificial Sequence
  Synthetic
acaatgataagatttggagatgttggtcttgatttagatttttctgcttttgatgctagtcttagtccatttatg

SEQ ID NO: 102306 - DNA, 75 bp, Artificial Sequence
  Synthetic
gtctgacttcaattgctttggccacaaaaatttgtaaacattatggtgttgagcctgagaaaaatatatacacaa

SEQ ID NO: 102307 - DNA, 75 bp, Artificial Sequence
  Synthetic
tggatatagtggacaactagtgtgtattattgatgatattggtcaaaatacaactgatgaggattggtctgattt

SEQ ID NO: 102308 - DNA, 75 bp, Artificial Sequence
  Synthetic
tacaacaatgatggaaaattgctcagatttggatgttgttttcactacttgtcctaaggatgagctaagacctct

SEQ ID NO: 102309 - DNA, 75 bp, Artificial Sequence
  Synthetic
aagaaaagggtcgtcatttttcttcaccctttataattgcaacatctaactggtctaacccaagtcctaaaacag

SEQ ID NO: 102310 - DNA, 75 bp, Artificial Sequence
  Synthetic
tggaattaaaatcactcattttactacttggacatccattccaaccttagctgcccagtttccatttaatgcttc

SEQ ID NO: 102311 - DNA, 75 bp, Artificial Sequence
  Synthetic
ttaaatcgcttggcaacattagtgacaactgttaatggaactcccatgctaatttctgagggaccattaaagatg

SEQ ID NO: 102312 - DNA, 75 bp, Artificial Sequence
  Synthetic
ttctttgttatggagatgatgttttgatagttttttccagagatgttcaaattgacaatcttgacttgattggac

SEQ ID NO: 102313 - DNA, 75 bp, Artificial Sequence
  Synthetic
agaaaattgtggatgagttcaaaaaacttggcatgacagctacttcagctgataaaaatgtgcctcaactgaagc

SEQ ID NO: 102314 - DNA, 75 bp, Artificial Sequence
  Synthetic
tctggcaaaaactaatgatgctattaaagacatgtcatgtgttgatcttgttatggataatcacaatgtttcatt

SEQ ID NO: 102315 - DNA, 75 bp, Artificial Sequence
  Synthetic
ttatggataatcacaatgtttcattatctgaattgcttagctcactggtgatgacagttgaaattagaaaacaaa

SEQ ID NO: 102316 - DNA, 75 bp, Artificial Sequence
  Synthetic
ataattgttgttaccatgtatgtgggtcaatgccttctgggtccccttgtacagctttgttaaattcaattataa

SEQ ID NO: 102317 - DNA, 75 bp, Artificial Sequence
  Synthetic
gatatgttaaatgttaatttggctaaaacaaatgatgcaattaaggacatgtcttgtgttgatctagtaatggat

SEQ ID NO: 102318 - DNA, 75 bp, Artificial Sequence
  Synthetic
tgatgttgtccaaatattcattacctattgtagaagaaccagaggattataaagaagcttcggttttttatcaaa

SEQ ID NO: 102319 - DNA, 75 bp, Artificial Sequence
  Synthetic
gagatcttttaatttggttgaagatagaattaggcctgctattgctgagaaaaccatatggtcattagttgcatg

SEQ ID NO: 102320 - DNA, 75 bp, Artificial Sequence
  Synthetic
tacttagttctttagtgatgacagttgaaattaggaagcaaaatatgagtgaattcatggagttgtggtcccagg

SEQ ID NO: 102321 - DNA, 75 bp, Artificial Sequence
  Synthetic
ggtttttcaacaacagtttctacggaacagaatgtccctgatccccaagttggcataacaaccatgagggactta

SEQ ID NO: 102322 - DNA, 75 bp, Artificial Sequence
  Synthetic
atgggtcatgaatgctttaggaattaaggatgattggctattagtaccctctcatgcttacaagtttgaaaaaga

SEQ ID NO: 102323 - DNA, 75 bp, Artificial Sequence
  Synthetic
acaggtgattaaattggatgcagatccagtagagtctcagtcaactttagaaatagcaggattagttaggaaaaa

SEQ ID NO: 102324 - DNA, 75 bp, Artificial Sequence
  Synthetic
aacagaggtggtacttattactcaatttcagcaggaaatgttgtgattcaatctttagatgttggttttcaggat

SEQ ID NO: 102325 - DNA, 75 bp, Artificial Sequence
  Synthetic
aagttgggaaacaaagactcaagtatgctcaggaagaattgtcaaatgaagtacttccaccccctaggaaaatga

SEQ ID NO: 102326 - DNA, 75 bp, Artificial Sequence
  Synthetic
cattggatttgacaattattatcacaggagccactgatgtggatggtatggcctggttcactccagtaggccttg

SEQ ID NO: 102327 - DNA, 75 bp, Artificial Sequence
  Synthetic
aatgaaggttcctacaattcccaagtttagagatattactcaacattttattaagaaaggagatgtacctagagc

SEQ ID NO: 102328 - DNA, 75 bp, Artificial Sequence
  Synthetic
ttacacaagaggagcttatcactttaaggaccctcaatatcccgtttgggagttgactattagagtttggtctga

SEQ ID NO: 102329 - DNA, 75 bp, Artificial Sequence
  Synthetic
taagttagtgactcaagagatgtttcaaaatatagataagaaaatagttgaaagtcagagaataatgaaagtgga

SEQ ID NO: 102330 - DNA, 75 bp, Artificial Sequence
  Synthetic
aaggaccctcaatatcccgtttgggagttgactattagagtttggtctgagttaaacattggaactggtacctcc

SEQ ID NO: 102331 - DNA, 75 bp, Artificial Sequence
  Synthetic
gtctccaaaacgctttttagaaagagtccaattcatcatcacattgataaaaacatgattaattttcctgctgtg

SEQ ID NO: 102332 - DNA, 75 bp, Artificial Sequence
  Synthetic
aagattggaaatctgatgcctctcaagggggaggaattaaaattacacattttacaacttggacatcaattccca

SEQ ID NO: 102333 - DNA, 75 bp, Artificial Sequence
  Synthetic
ctggatattgaaatggctataacaggggctcctgggatagatgcaattaatatggattcttcccctggatatcct

SEQ ID NO: 102334 - DNA, 75 bp, Artificial Sequence
  Synthetic
attgatgctattaatatggattcatctcctgggtttccttatgttcaagaaaaattgactaaaagagatttaatt

SEQ ID NO: 102335 - DNA, 75 bp, Artificial Sequence
  Synthetic
agattgcaaattacaatcattctgatgaatatttgtcctttagttgttatttgtctgtcacagaacaatcagagt

SEQ ID NO: 102336 - DNA, 75 bp, Artificial Sequence
  Synthetic
tggacaaagtgttggaatctaaaactagggctattgattcttgtcctcttgactatacaattttgtgtagaatgt

SEQ ID NO: 102337 - DNA, 75 bp, Artificial Sequence
  Synthetic
gactatacaattttgtgtagaatgtactggggtccagccattagttatttccatttaaatcctggttttcacact

SEQ ID NO: 102338 - DNA, 75 bp, Artificial Sequence
  Synthetic
tccctttgttttgcttgtaaatattaattcctgcaggttcagggttctttaatctgtttctctataagaacactc

SEQ ID NO: 102339 - DNA, 75 bp, Artificial Sequence
  Synthetic
aatggacagaaatgaaggatgataaaattgtttcattaatcgaaaaattcacaagtaacaaatattggtctaaag

SEQ ID NO: 102340 - DNA, 75 bp, Artificial Sequence
  Synthetic
gatcttaaaggtagagcaaaccaagggaaaatggatatctcaggtgtccaagctcctgtgggagccattactact

SEQ ID NO: 102341 - DNA, 75 bp, Artificial Sequence
  Synthetic
aagtgcctgaaaccttcccagaattgaagcctggagagtcaagacatacttctgatcatatgtctatttataaat

SEQ ID NO: 102342 - DNA, 75 bp, Artificial Sequence
  Synthetic
tttggaaagtctccagttttcttttgtcaagctctgaggatcctttgttatggagatgatgttttgatagttttt

SEQ ID NO: 102343 - DNA, 75 bp, Artificial Sequence
  Synthetic
tacatttacatttaattctaacaacaaagagtacacttttcctatcactttgtcatcaacttctaatcctcctca

SEQ ID NO: 102344 - DNA, 75 bp, Artificial Sequence
  Synthetic
tgtcatcaacttctaatcctcctcatggattgccttcaactctgagatggttctttaacctttttcagctttata

SEQ ID NO: 102345 - DNA, 75 bp, Artificial Sequence
  Synthetic
tataactggggctactgatgttgatggaatggcttggtttactcccgttgggttggcagtagacaccccatgggt

SEQ ID NO: 102346 - DNA, 75 bp, Artificial Sequence
  Synthetic
gaagcagacaatttttgcattttgcaaattcaagatgtagagaaatttgatcagtatcagaaaggggttgattta

SEQ ID NO: 102347 - DNA, 75 bp, Artificial Sequence
  Synthetic
atacaaaagctgagaactgtccattcaatggctcaagttgaccctaacctgggggttcatttgtcacctcttaga

SEQ ID NO: 102348 - DNA, 75 bp, Artificial Sequence
  Synthetic
aatctgtttctctataagaacactcaaatttcacgctttctgtcttctttcttccatggctctccccttgcccta

SEQ ID NO: 102349 - DNA, 75 bp, Artificial Sequence
  Synthetic
tgaggggacttgatacctcaccgccgtttgcctaggctataggctaaatttccctttccctgtccttcccctatt

SEQ ID NO: 102350 - DNA, 75 bp, Artificial Sequence
  Synthetic
gtatatcatggtgtaactaagcccaagcaagtgattaaattagatgcagatccagtagaatctcagtcaactttg

SEQ ID NO: 102351 - DNA, 75 bp, Artificial Sequence
  Synthetic
tccctttccctgtccttcccctatttccttttgttttgtttgtaaatattaattcctgcaggttcagggttcttt

SEQ ID NO: 102352 - DNA, 75 bp, Artificial Sequence
  Synthetic
tccaaagttaattttcctcatggaatgctagatttggaagaaattgctgcaaatgcaaaagaatttccgaatatg

SEQ ID NO: 102353 - DNA, 75 bp, Artificial Sequence
  Synthetic
tgctagatttggaagaaattgctgcaaatgcaaaagaatttccgaatatgtcagaaactgatttgtgtttcttgt

SEQ ID NO: 102354 - DNA, 75 bp, Artificial Sequence
  Synthetic
aaacttggcagacagaatgttgggtctgtcagggatacaggagataaaagaaaaaggggtgggattgattggtga

SEQ ID NO: 102355 - DNA, 75 bp, Artificial Sequence
  Synthetic
tgaaatcattaatactgttttatgttttgttaaaagtggcattttgctgtatgtgattcaacaattaaatcaaga

SEQ ID NO: 102356 - DNA, 75 bp, Artificial Sequence
  Synthetic
attaaaattactcattttactacttggacatccattccaaccttggctgctcagtttccatttaatgcttcagat

SEQ ID NO: 102357 - DNA, 75 bp, Artificial Sequence
  Synthetic
tgtgatgttatctaagtattcattacctattgtagaagaaccagaggattataaagaggcttcaattttttatca

SEQ ID NO: 102358 - DNA, 75 bp, Artificial Sequence
  Synthetic
aatttgtttctctataagaacactcattttcacgctttctgtcttctttcttccagggctctccccttgccctag

SEQ ID NO: 102359 - DNA, 75 bp, Artificial Sequence
  Synthetic
tattggaacaggaacttcagcttatacttcacttaatgttttggctaggtttacagatttggagttgcatgggtt

SEQ ID NO: 102360 - DNA, 75 bp, Artificial Sequence
  Synthetic
agattctacatttggattggtttctattcagattgcaaattacaatcattctgatgaatatttgtcttttagttg

SEQ ID NO: 102361 - DNA, 75 bp, Artificial Sequence
  Synthetic
tctgggtcaaggttgtcacagtttttccaatcagttaccaatcacaagtgggttgcagttggggctgctgtggga

SEQ ID NO: 102362 - DNA, 75 bp, Artificial Sequence
  Synthetic
tccaatcagttaccaatcacaagtgggttgcagttggggctgctgtgggagtacttggtgttttggttggaggtt

SEQ ID NO: 102363 - DNA, 75 bp, Artificial Sequence
  Synthetic
aaattttttctgattcattctgcagattggcttactacacatgctcttttccatgaagttgcaaaattggatgtg

SEQ ID NO: 102364 - DNA, 75 bp, Artificial Sequence
  Synthetic
gagaattttatttaatactgtcatgatggaaaattgttctgacctagatgttgtttttacaacttgtccaaaaga

SEQ ID NO: 102365 - DNA, 75 bp, Artificial Sequence
  Synthetic
tctatttgtcagatgttttgcttttggaggggagatcttgtttttgattttcaggtttttccaaccaaatatcat

SEQ ID NO: 102366 - DNA, 75 bp, Artificial Sequence
  Synthetic
actactgccccttgtgcagtaatggacattacaggagtgcaatcaaccttgagatttcgtgttccttggatttct

SEQ ID NO: 102367 - DNA, 75 bp, Artificial Sequence
  Synthetic
gagatttcgtgttccttggatttctgatacaccctatcgagtaaataggtacacgaagtcagcacatcaaaaagg

SEQ ID NO: 102368 - DNA, 75 bp, Artificial Sequence
  Synthetic
tgagtacactgccattggaaagcttattgtgtattgttataatagactgacttctccttctaatgttgcttctca

SEQ ID NO: 102369 - DNA, 75 bp, Artificial Sequence
  Synthetic
actttaaggatgccatatattggctatatacaaaattacaggatttttatgaagtaaattatggcaagaaaaagg

SEQ ID NO: 102370 - DNA, 75 bp, Artificial Sequence
  Synthetic
aaagggaaagccaataggggaaagatggatgtttcaggagtgcaagcacctgtgggagctattacaacaattgag

SEQ ID NO: 102371 - DNA, 75 bp, Artificial Sequence
  Synthetic
cttggaagtccatggtgaggggacttgatacctcaccgccgtttgcctaggctataggctaaattttccctttcc

SEQ ID NO: 102372 - DNA, 75 bp, Artificial Sequence
  Synthetic
cagattgcaaattacaatcattctgatgaatatttgtcttttagttgttatttgtctgtcacagaacaatcagag

SEQ ID NO: 102373 - DNA, 75 bp, Artificial Sequence
  Synthetic
acaacaattgaaccaagatgagcattcccacataattggtttgttgagagtcatgaattatgcagatattggctg

SEQ ID NO: 102374 - DNA, 75 bp, Artificial Sequence
  Synthetic
tttgtctgtcacagaacaatcagagttttattttcctagagctccattaaattcaaatgctatgttgtccactga

SEQ ID NO: 102375 - DNA, 75 bp, Artificial Sequence
  Synthetic
ttaattggcaaatggactccagaatgatggagctgagaactcagagcttttctaattggttaagggacatttgtt

SEQ ID NO: 102376 - DNA, 75 bp, Artificial Sequence
  Synthetic
ttcagattcagttgggcaacagatcaaagttattccagttgacccatactttttccagatgacaaacactaatcc

SEQ ID NO: 102377 - DNA, 75 bp, Artificial Sequence
  Synthetic
accaattccagctgaaggggtttatcatggcgtgactaagcccaaacaggtgattaaattggatgcagatccagt

SEQ ID NO: 102378 - DNA, 75 bp, Artificial Sequence
  Synthetic
catggcgtgactaagcccaaacaggtgattaaattggatgcagatccagtagagtctcagtcaactttggaaata

SEQ ID NO: 102379 - DNA, 75 bp, Artificial Sequence
  Synthetic
tacaaaagctgagaactgtccattcaatggctcaagttgaccctaaccttggggttcatttgtcacctcttagag

SEQ ID NO: 102380 - DNA, 75 bp, Artificial Sequence
  Synthetic
tgttagtaccttctcatgcttataaatttgaaaaggattatgaaatgatggagttttatttcaatagaggtggaa

SEQ ID NO: 102381 - DNA, 75 bp, Artificial Sequence
  Synthetic
ggtacacgaagtcagcacatcaaaaaggtgagtacactgccattggaaagcttattgtgtattgttataatagac

SEQ ID NO: 102382 - DNA, 75 bp, Artificial Sequence
  Synthetic
gagttttatttcaatagaggtggaacttactattcaatttcggctggtaatgttgttattcaatctttagatgtg

SEQ ID NO: 102383 - DNA, 75 bp, Artificial Sequence
  Synthetic
taaagattttccaaatatgtctgagacagatttgtgtttcctgttgcattggctgaatccaaagaaaattaactt

SEQ ID NO: 102384 - DNA, 75 bp, Artificial Sequence
  Synthetic
gagcattggatggacttggagacaaaactgattcaacttttggacttgtttccattcaaattgcaaattacaatc

SEQ ID NO: 102385 - DNA, 75 bp, Artificial Sequence
  Synthetic
aaaagctcaagaatcttggatctataaatcaggctatggtgacaagatgtgagccagttgtttgctatttgtatg

SEQ ID NO: 102386 - DNA, 75 bp, Artificial Sequence
  Synthetic
agcagatagaatgcttggattgtctggagtgcaggaaattaaagaacagggtgttggattgatagcagagtgtag

SEQ ID NO: 102387 - DNA, 75 bp, Artificial Sequence
  Synthetic
ttcatcattctgtgactgttgaaattataaatactgtactttgttttgtcaagagtggaatcctgctttatgtta

SEQ ID NO: 102388 - DNA, 75 bp, Artificial Sequence
  Synthetic
gaaagtggaatttactcagtgttcaatgaatgtagtctccaaaacgctttttagaaagagtcccattcatcatca

SEQ ID NO: 102389 - DNA, 75 bp, Artificial Sequence
  Synthetic
ttaaggatgccatatattggctatatacaaaattgaaggatttttatgaagtaaattatggtaagaagaaggata

SEQ ID NO: 102390 - DNA, 75 bp, Artificial Sequence
  Synthetic
aagcttcagttttttatcaaaataaaatagtaggcaagactcagttagttgatgactttttagatcttgatatgg

SEQ ID NO: 102391 - DNA, 75 bp, Artificial Sequence
  Synthetic
ccagtagagtctcagtcaactttagaaatagcaggattagttaggaagaatttggttcagtttggagttggggag

SEQ ID NO: 102392 - DNA, 75 bp, Artificial Sequence
  Synthetic
tttacaacttgtccaaaagatgaattgagaccattagagaaagttttggaatcaaaaacaagagctattgatgct

SEQ ID NO: 102393 - DNA, 75 bp, Artificial Sequence
  Synthetic
atgatattggccaaaacacaacagatgaagattggtcagatttttgtcaattagtgtcaggatgcccaatgagat

SEQ ID NO: 102394 - DNA, 75 bp, Artificial Sequence
  Synthetic
aaagtgaattttccacatggaatgttggatcttgaagaaattgctgccaactctaaagattttccaaatatgtct

SEQ ID NO: 102395 - DNA, 75 bp, Artificial Sequence
  Synthetic
gaagtccatggtgaggggacttgatacctcaccgccgtttgcctaggctataggctaaaccttcctttccctgcc

SEQ ID NO: 102396 - DNA, 75 bp, Artificial Sequence
  Synthetic
ttgtaaatattaattcctgcaggttcagggttctttaatctgtttctctataagaacactcaattttcacgcttt

SEQ ID NO: 102397 - DNA, 75 bp, Artificial Sequence
  Synthetic
tcagggatacaggagataaaagaaaaaggagtgggattgattggtgagtgtcgagcttttctagattccataact

SEQ ID NO: 102398 - DNA, 75 bp, Artificial Sequence
  Synthetic
ttacttagttccttagtgatgacagttgaaattaggaaacaaaatatgagtgaattcatggagttgtggtctcag

SEQ ID NO: 102399 - DNA, 75 bp, Artificial Sequence
  Synthetic
agagttatgaattatgcagatattggctgctcagttatctcatgtggcaaagttttttccaaaatgttagaaaca

SEQ ID NO: 102400 - DNA, 75 bp, Artificial Sequence
  Synthetic
tgaattgagaccattagagaaagttttggaatcaaaaacaagagcaattgacgcttgtcctttggattatacaat

SEQ ID NO: 102401 - DNA, 75 bp, Artificial Sequence
  Synthetic
tccaaattatctagttttttccaatctgttactaatcacaagtgggttgctgtgggagctgcagttggtattctt

SEQ ID NO: 102402 - DNA, 75 bp, Artificial Sequence
  Synthetic
gaatgatggagctgagaactcagagcttttccaattggttaagagacatttgttcaggaattactatttttaaaa

SEQ ID NO: 102403 - DNA, 75 bp, Artificial Sequence
  Synthetic
accattcaacgccggaggactggctctcatccagtggatgcattgagtggattgactgtcagggctgtctctagg

SEQ ID NO: 102404 - DNA, 75 bp, Artificial Sequence
  Synthetic
ttgattcaaaaattgagaactgttcactcaatggcacaggttgatccaggtttaactgttcatttagcccctctt

SEQ ID NO: 102405 - DNA, 75 bp, Artificial Sequence
  Synthetic
cttagtccatttatgattagggaggcgggtagaatcatgagtgaattatctggaacaccatctcattttggaaca

SEQ ID NO: 102406 - DNA, 75 bp, Artificial Sequence
  Synthetic
tggaacaccatctcattttggaacagctcttatcaatactatcatttattctaaacatttgctgtacaattgttg

SEQ ID NO: 102407 - DNA, 75 bp, Artificial Sequence
  Synthetic
gaaaaatggatgtgtgagatgggttatgaatgccttaggagtgaaagatgattggttgttagtaccttctcatgc

SEQ ID NO: 102408 - DNA, 75 bp, Artificial Sequence
  Synthetic
gaggaaaaggtgaaggtcttcctggaatgtgtggtggggccctggtgtcatcaaatcagtccatacagaatgcaa

SEQ ID NO: 102409 - DNA, 75 bp, Artificial Sequence
  Synthetic
aataatgaaagtggaatttactcagtgttcaatgaatgtagtctccaaaacgctttttagaaagagtcccattca

SEQ ID NO: 102410 - DNA, 75 bp, Artificial Sequence
  Synthetic
cagacagtgggaccaactttttaaaacaatgattagatttggagatgttggtttagatttggatttttctgcttt

SEQ ID NO: 102411 - DNA, 75 bp, Artificial Sequence
  Synthetic
atgtagatattggttgttcagttatttcatgtggcaaagttttttccaaaatgctggaaacagtctttaattggc

SEQ ID NO: 102412 - DNA, 75 bp, Artificial Sequence
  Synthetic
taataaagagtacacatttccaataactttgtcttcaacttctaatcctcctcatggtttaccatcaacattaag

SEQ ID NO: 102413 - DNA, 75 bp, Artificial Sequence
  Synthetic
ctcatggtttaccatcaacattaaggtggtttttcaatttgtttcagttgtatagaggaccattggatttgacaa

SEQ ID NO: 102414 - DNA, 75 bp, Artificial Sequence
  Synthetic
ccggttctaagaagactcagggggagaagtttttcttgattcattctgctgactggctcactacacatgctcttt

SEQ ID NO: 102415 - DNA, 75 bp, Artificial Sequence
  Synthetic
ggtgaaattattgtataatgagcagttcgctgtccaaggcttgttgagataccatacatatgcaagatttggtat

SEQ ID NO: 102416 - DNA, 75 bp, Artificial Sequence
  Synthetic
tcaatactatcatttattctaagcatctgctgtacaactgttgttatcatgtttatggttcaatgccttctgggt

SEQ ID NO: 102417 - DNA, 75 bp, Artificial Sequence
  Synthetic
tgagattcaagttcagataaaccccacaccctttcagcaagggggactaatttgtgccatggttcctggtgacca

SEQ ID NO: 102418 - DNA, 75 bp, Artificial Sequence
  Synthetic
tattgattataaaactgcccttggagctgttagatttaatacaagaagaacagggaacattcagattagattgcc

SEQ ID NO: 102419 - DNA, 75 bp, Artificial Sequence
  Synthetic
gtaaataggtacacaaagtctgcacatcaaaaaggtgagtacactgccattggaaagcttattgtgtactgttat

SEQ ID NO: 102420 - DNA, 75 bp, Artificial Sequence
  Synthetic
caagagttcatcagaaacttaaaaaccttggatctataaatcaggcaatggtaacgagatgtgagccagttgttt

SEQ ID NO: 102421 - DNA, 75 bp, Artificial Sequence
  Synthetic
aatagactgacttctccttctaatgttgcttctcatgttagagttaatgtttatctttcagcaattaatttggaa

SEQ ID NO: 102422 - DNA, 75 bp, Artificial Sequence
  Synthetic
tctaagcatttgctgtacaattgttgttatcatgtttgtggttcaatgccttctgggtctccttgtacagctttg

SEQ ID NO: 102423 - DNA, 75 bp, Artificial Sequence
  Synthetic
tgttttgctcctctttatcatgctatggatgttaccacacaggttggagatgattcaggaggtttttcaacaaca

SEQ ID NO: 102424 - DNA, 75 bp, Artificial Sequence
  Synthetic
ttgaattcaattattaacaacatcaatttgtattatgtgttttctaaaatatttggaaagtctccagttttcttt

SEQ ID NO: 102425 - DNA, 75 bp, Artificial Sequence
  Synthetic
gtgcctcaattgaagccagtttcagaattgacttttcttaaaagatctttcaatctggtggaggataggattaga

SEQ ID NO: 102426 - DNA, 75 bp, Artificial Sequence
  Synthetic
tgagaggggatccctccattgacagctggactgttctttggggccttatgtggtgtttgcctctgaggtactcag

SEQ ID NO: 102427 - DNA, 75 bp, Artificial Sequence
  Synthetic
ctagagctttgagaagatttggattctctatggccgctggtagaagtgtgtggactcttgagatggatgctggag

SEQ ID NO: 102428 - DNA, 75 bp, Artificial Sequence
  Synthetic
cagattagattgccatggtattcttatttgtatgccgtgtctggagcactggatggtttgggagataagacagat

SEQ ID NO: 102429 - DNA, 75 bp, Artificial Sequence
  Synthetic
aaagatgataagattgtttcattaatcgagaagttcacaagcaataaatattggtctaaagtgaattttccacat

SEQ ID NO: 102430 - DNA, 75 bp, Artificial Sequence
  Synthetic
tcatcaacataagatagagagagcaattgaggaggctgataatttttgtgttcttcagattcaggatgttgaaaa

SEQ ID NO: 102431 - DNA, 75 bp, Artificial Sequence
  Synthetic
cacgaagtcagcacatcaaaaaggtgagtacactgccattggaaagcttattgtgtactgttataatagactgac

SEQ ID NO: 102432 - DNA, 75 bp, Artificial Sequence
  Synthetic
cggagcctctcttggaagtccatggtgaggggacttgatacctcaccgccgtttgcctaggctataggctaaatt

SEQ ID NO: 102433 - DNA, 75 bp, Artificial Sequence
  Synthetic
gtttgcctaggctataggctaaatttccctttccctgtccttcccctatttccctttgttttgtttgtaaatatt

SEQ ID NO: 102434 - DNA, 75 bp, Artificial Sequence
  Synthetic
tcacaagtgggttgctgtgggagctgcagttggcattcttggagtgctcgttggaggatggtttgtgtataagca

SEQ ID NO: 102435 - DNA, 75 bp, Artificial Sequence
  Synthetic
aattttcacgctttctgtcttctttcttccagggctctccccttgccctaggctctggccgttgcgcccggcggg

SEQ ID NO: 102436 - DNA, 75 bp, Artificial Sequence
  Synthetic
tgtccactgagtccatgatgagtagaattgcagctggagacttggagtcatcggtggatgatcctagatcagagg

SEQ ID NO: 102437 - DNA, 75 bp, Artificial Sequence
  Synthetic
ggagccactgatgtagacggtatggcctggttcactccagtaggccttgctgttgacactccttgggtggaaaag

SEQ ID NO: 102438 - DNA, 75 bp, Artificial Sequence
  Synthetic
aactttgagattccgtgttccttggatttcagatactccttatagagttaatagatacaccaagtcgtcacatca

SEQ ID NO: 102439 - DNA, 75 bp, Artificial Sequence
  Synthetic
ggacataatatttcattgatggatttacttagttccttagtgatgacagttgaaattaggaagcaaaatatgagt

SEQ ID NO: 102440 - DNA, 75 bp, Artificial Sequence
  Synthetic
tgtcacaactcaggttggagatgactctggaggcttctctaccactgtttcaacaaaacagaatgttccagaccc

SEQ ID NO: 102441 - DNA, 75 bp, Artificial Sequence
  Synthetic
tgaaattaggaagcaaaatatgagtgaattcatggagttgtggtctcagggaatctcagatgatgacaatgatag

SEQ ID NO: 102442 - DNA, 75 bp, Artificial Sequence
  Synthetic
aaccatacaaagaactgaggctggaggtcggtaaacaaagactcaaatatgctcaggaagagttgtcaaatgaag

SEQ ID NO: 102443 - DNA, 75 bp, Artificial Sequence
  Synthetic
tggaccaatcttcagttcacactgctgaggttggctcacatcaaattgaacctttgaaaacctctgttgacaaac

SEQ ID NO: 102444 - DNA, 75 bp, Artificial Sequence
  Synthetic
ttcatgaagttgcaaaattggatgtggtgaaattgctgtataatgagcagtttgctgtccaaggcttgttgagat

SEQ ID NO: 102445 - DNA, 75 bp, Artificial Sequence
  Synthetic
atcctcacaatgatatgttgaatgttaatttggctaaaacaagtgatgcaattaaggacatgtcttgtgttgatc

SEQ ID NO: 102446 - DNA, 75 bp, Artificial Sequence
  Synthetic
aataaaggttccatttatttatactagaggtgcttatcattttaaagatccacagtacccagtttgggaattaac

SEQ ID NO: 102447 - DNA, 75 bp, Artificial Sequence
  Synthetic
tatgaagatgcaagggcaaaaatgtcttttgctttggatcaggaagattggaagtctgatccctctcaaggtggt

SEQ ID NO: 102448 - DNA, 75 bp, Artificial Sequence
  Synthetic
ggaaaggaattactgctgacactagagctttgaggagatttggcttttcattggctgctggtaggagtgtgtgga

SEQ ID NO: 102449 - DNA, 75 bp, Artificial Sequence
  Synthetic
cttggacatccattccaaccttagctgcccagtttccgtttaatgcttcagattcggttgggcaacaaattaaag

SEQ ID NO: 102450 - DNA, 75 bp, Artificial Sequence
  Synthetic
ttattccagtggacccatattttttccagatgacaaacactaatcctgaccaaaaatgtataactgccctggctt

SEQ ID NO: 102451 - DNA, 75 bp, Artificial Sequence
  Synthetic
tcagaaactgatttgtgtttcttgttgcattggctgaatcccaaaaagataaacttggcagatagaatgttgggt

SEQ ID NO: 102452 - DNA, 75 bp, Artificial Sequence
  Synthetic
tgcattattgatgatattggccaaaacacaacagatgaagattggtcagatttttgtcaattagtgtcaggatgc

SEQ ID NO: 102453 - DNA, 75 bp, Artificial Sequence
  Synthetic
ggggttcatttgtcacctctcagagattgcatagccagagtccaccaaaagctcaagaatcttggatctataaat

SEQ ID NO: 102454 - DNA, 75 bp, Artificial Sequence
  Synthetic
actggaattacattaaagcaggcaactactgctccttgtgcagtaatggacattacaggagtgcaatcaaccttg

SEQ ID NO: 102455 - DNA, 75 bp, Artificial Sequence
  Synthetic
aaggtctcattttttgtgtacttttactttcaattcaaataataaagagtacacatttccaataactctgtcttc

SEQ ID NO: 102456 - DNA, 75 bp, Artificial Sequence
  Synthetic
ctcctaggaaaatgaaggggttattttcacaagctaatatttctcttttttgtacagaggaccatgaaataatga

SEQ ID NO: 102457 - DNA, 75 bp, Artificial Sequence
  Synthetic
ggtataacaaccatgagggacctaaaagggaaagccaatagaggaaagatggatgtttcaggagtgcaagcacct

SEQ ID NO: 102458 - DNA, 75 bp, Artificial Sequence
  Synthetic
tgtcaattggtgtctggatgtccaatgaggttaaacatggcttctttggaagaaaagggtcgtcatttttcttca

SEQ ID NO: 102459 - DNA, 75 bp, Artificial Sequence
  Synthetic
agtggtttgcttttatgcatggctatgagttttatcagaaattttattattttgttcagtcctgtttggagaaag

SEQ ID NO: 102460 - DNA, 75 bp, Artificial Sequence
  Synthetic
ccctttataattgcaacatccaactggtctaatccaagtcctaaaacggtctatgttaaggaagccatagaccgt

SEQ ID NO: 102461 - DNA, 75 bp, Artificial Sequence
  Synthetic
acacatttccaataactctgtcttcgacttctaatcctcctcatggtttaccatcaacattaaggtggtttttca

SEQ ID NO: 102462 - DNA, 75 bp, Artificial Sequence
  Synthetic
tcaatctttagatgtggggtttcaagatgttgttctaatgaaggttcctacaattcccaagtttagagatattac

SEQ ID NO: 102463 - DNA, 75 bp, Artificial Sequence
  Synthetic
cagattagattgccatggtattcttatttgtatgccgtgtctggagcactggatggcctgggagataaaacagat

SEQ ID NO: 102464 - DNA, 75 bp, Artificial Sequence
  Synthetic
tggtgagaagaatgggtgtgttagatgggtcatgaatgctttaggaattaaggatgattggctattagtgccctc

SEQ ID NO: 102465 - DNA, 75 bp, Artificial Sequence
  Synthetic
gctaaatccaaagaaaattaatttagcagatagaatgcttggattgtctggagtgcaggaaattaaagaacaggg

SEQ ID NO: 102466 - DNA, 75 bp, Artificial Sequence
  Synthetic
tgatggaaaattgttctgacctagatgttgtttttacaacttgtccaaaagatgaattgagaccattagagaaag

SEQ ID NO: 102467 - DNA, 75 bp, Artificial Sequence
  Synthetic
actcctatgttaatttctgagggacctttaaaaatggaagaaaaagccacttatgttcataagaagaatgatggt

SEQ ID NO: 102468 - DNA, 75 bp, Artificial Sequence
  Synthetic
gctttgtttcatgaagttgcaaaattggatgtggtcaaactgttgtacaatgagcaatttgctgttcagggtttg

SEQ ID NO: 102469 - DNA, 75 bp, Artificial Sequence
  Synthetic
ttggggtccagctattagttattttcatttgaatccagggtttcatacaggtgttgctattggcatagatcctga

SEQ ID NO: 102470 - DNA, 75 bp, Artificial Sequence
  Synthetic
acaactgttaatggaactcctatgttaatttcagagggaccattaaaaatggaggaaaaagccacttatgttcat

SEQ ID NO: 102471 - DNA, 75 bp, Artificial Sequence
  Synthetic
aagaagaatgatggtactacagttgatttgactgtggatcaggcatggagaggaaaaggtgaaggtcttcctgga

SEQ ID NO: 102472 - DNA, 75 bp, Artificial Sequence
  Synthetic
tttgagagtcatatagaatgtaggaaaccatacaaagacttgagattggaggttggcaaacaaagactcaagtat

SEQ ID NO: 102473 - DNA, 75 bp, Artificial Sequence
  Synthetic
ggcaaagttggttactcaagaaatgtttcaaaatattgataagaaaattgaaagtcagagaataatgaaagtgga

SEQ ID NO: 102474 - DNA, 75 bp, Artificial Sequence
  Synthetic
gctcaggaagaattgtcaaatgaagtgcttccacctcctaggaaaatgaaggggctattttcacaagctaaaatt

SEQ ID NO: 102475 - DNA, 75 bp, Artificial Sequence
  Synthetic
ctagatttactgatttggaactccatgggctaacacccctatctacacagatgatgagaaatgaatttagagtca

SEQ ID NO: 102476 - DNA, 75 bp, Artificial Sequence
  Synthetic
aatttgtattatgtgttttctaaaatatttggaaagtctccagtcttcttttgtcaagctttgaggatcctttgt

SEQ ID NO: 102477 - DNA, 75 bp, Artificial Sequence
  Synthetic
ggctggctcaaagaattttatttaatacaacaatgatggaaaattgctcagatttggatgttgttttcactacct

SEQ ID NO: 102478 - DNA, 75 bp, Artificial Sequence
  Synthetic
tagagaaagttttggaatcaaaaacaagagcaattgatgcttgtcccttggattatacaattctatgtcgaatgt

SEQ ID NO: 102479 - DNA, 75 bp, Artificial Sequence
  Synthetic
ctaaagctgaaattgatccaatggctatgatgttgtccaaatattcattacctattgtagaagaaccagaggatt

SEQ ID NO: 102480 - DNA, 75 bp, Artificial Sequence
  Synthetic
aagttaattgtttattgttacaatagactgacttctccctctaatgtggcctctcatgttagagttaatgtttac

SEQ ID NO: 102481 - DNA, 75 bp, Artificial Sequence
  Synthetic
ttcaagaggggtctccggagttttccggagcccctcttggaagtccatggtgaggggacttgatacctcaccgcc

SEQ ID NO: 102482 - DNA, 75 bp, Artificial Sequence
  Synthetic
ctctcagctattaatttagaatgttttgctccactctatcatgctatggatgtcacaactcaggttggagatgat

SEQ ID NO: 102483 - DNA, 75 bp, Artificial Sequence
  Synthetic
gtacttggtgttttggttggaggttggtatgtctacaagcattttacaaagaagcaagaagaatccattccaagt

SEQ ID NO: 102484 - DNA, 75 bp, Artificial Sequence
  Synthetic
tggaacaccatctcattttggaacagctcttatcaatactattatttattctaaacatttgctgtacaattgttg

SEQ ID NO: 102485 - DNA, 75 bp, Artificial Sequence
  Synthetic
gacagctacttcagctgataaaagtgtgcctcaattgaagccagtttcagaattgacttttcttaaaagatcttt

SEQ ID NO: 102486 - DNA, 75 bp, Artificial Sequence
  Synthetic
gtgcctcaattgaagccagtttcagaattgacttttcttaaaagatctttcaatttggtggaggatagaattaga

SEQ ID NO: 102487 - DNA, 75 bp, Artificial Sequence
  Synthetic
agcatggagctgtaggagtctaaattggggacgcagatgtttgggacgtcgccttgcagtgttaacttggctctc

SEQ ID NO: 102488 - DNA, 75 bp, Artificial Sequence
  Synthetic
gttaacttggctcttcataaacctctttgatcttccacaagaagtacgctacgggtgaaacctcttaggctaata

SEQ ID NO: 102489 - DNA, 75 bp, Artificial Sequence
  Synthetic
ggtctctggtagcttggcagagaagtaacgctgagttcgagcagaatttggaaaatgctcagtggtttgctttca

SEQ ID NO: 102490 - DNA, 75 bp, Artificial Sequence
  Synthetic
ttatgggcagatctcatttcttatgtacatttacattcaattctaataacaaagagtacacttttcctattactt

SEQ ID NO: 102491 - DNA, 75 bp, Artificial Sequence
  Synthetic
aatggctcaagttgaccctaaccttggggttcatttgtcacctcttagagattgcatagccagagtccaccaaaa

SEQ ID NO: 102492 - DNA, 75 bp, Artificial Sequence
  Synthetic
ggggttcatttgtcacctcttagagattgcatagccagagtccaccaaaagctcaagaatcttggatctataaat

SEQ ID NO: 102493 - DNA, 75 bp, Artificial Sequence
  Synthetic
tcatccagtggatgcattgagtgaattgattgtcagggctgtctctaggtttaatctcagacctctctgtgctta

SEQ ID NO: 102494 - DNA, 75 bp, Artificial Sequence
  Synthetic
tagaattagacctgcaatttcagaaaagacaatttggtctttgatagcttggcagagaagcaacgctgagtttga

SEQ ID NO: 102495 - DNA, 75 bp, Artificial Sequence
  Synthetic
ttcaagaggggcctccgggattcccggagtccctcttgggagtccatggtgaggggacttgatacctcaccgccg

SEQ ID NO: 102496 - DNA, 75 bp, Artificial Sequence
  Synthetic
tgatattggccaaaatacaacagatgaagattggtcagatttttgtcaattagtgtcaggatgtccaatgagatt

SEQ ID NO: 102497 - DNA, 75 bp, Artificial Sequence
  Synthetic
tcccttttccctttccctttattattgtaaatattaattcctgcaggttcagggctcttggatttgttccactat

SEQ ID NO: 102498 - DNA, 75 bp, Artificial Sequence
  Synthetic
taccatacatatgcaagatttggcattgagattcaagttcagataaatcccacaccctttcagcaagggggacta

SEQ ID NO: 102499 - DNA, 75 bp, Artificial Sequence
  Synthetic
ctgtttctctataagaacactcaattttcacgctttctgtcttctttcttccagggctctccccttgccctaggc

SEQ ID NO: 102500 - DNA, 75 bp, Artificial Sequence
  Synthetic
gagtgcttgtgggaggatggttcgtgtacaagcatttctcccgcaaagaggaagaaccaattccagctgaagggg

SEQ ID NO: 102501 - DNA, 75 bp, Artificial Sequence
  Synthetic
ccctcttggaagtccatggtgaggggacctgatacctcaccgccgtttgcctaggctataggctatttctcccct

SEQ ID NO: 102502 - DNA, 75 bp, Artificial Sequence
  Synthetic
tgataagccaggctctaagaggacacagggagagaaatttttccttattcattctgctgactggttgacaacaca

SEQ ID NO: 102503 - DNA, 75 bp, Artificial Sequence
  Synthetic
ctgcccagtttccattcaatgcttcagattcggttgggcaacaaattaaagttattccagtggacccatattttt

SEQ ID NO: 102504 - DNA, 75 bp, Artificial Sequence
  Synthetic
tttggttcagtttggagttggggagaaaaatggatgtgtgagatgggttatgaatgccttaggagtgaaggatga

SEQ ID NO: 102505 - DNA, 75 bp, Artificial Sequence
  Synthetic
actttggctgctcaatttccattcaatgcctctgattcagttgggcaacagattaaggttattccagttgatcca

SEQ ID NO: 102506 - DNA, 75 bp, Artificial Sequence
  Synthetic
attggcttcaatatgtcaaatgttttgtttttggagaggagacttggtttttgacttccaggtttttcctacaaa

SEQ ID NO: 102507 - DNA, 75 bp, Artificial Sequence
  Synthetic
cttctttgacagtttaccctcatggtttattgaattgtaatattaacaatgtagtcagaattaaagttcctttta

SEQ ID NO: 102508 - DNA, 75 bp, Artificial Sequence
  Synthetic
ttcctgggaatgagttaatagatgttactggaattacattaaagcaggcaactactgctccttgtgcagtaatgg

SEQ ID NO: 102509 - DNA, 75 bp, Artificial Sequence
  Synthetic
cttgaatcgcttggcaacattagtgacaactgttaatggaactcctatgttaatttctgagggaccattaaagat

SEQ ID NO: 102510 - DNA, 75 bp, Artificial Sequence
  Synthetic
cttgaccacatcctgtctctggcagatattgaggaagaacaaatgattcagtccgttgataggactgcagtgact

SEQ ID NO: 102511 - DNA, 75 bp, Artificial Sequence
  Synthetic
aagaagaatgatggtaccacagttgatttgactgttgatcaggcatggagaggaaaaggtgaaggtcttcctgga

SEQ ID NO: 102512 - DNA, 75 bp, Artificial Sequence
  Synthetic
cacaagtaacaaatattggtctaaagtgaattttccacatggaatgttagatcttgaagaaattgctgccaactc

SEQ ID NO: 102513 - DNA, 75 bp, Artificial Sequence
  Synthetic
cacacaggttggagatgattcaggaggtttttcaacaacagtttctacagagcagaatgttcctgatccccaagt

SEQ ID NO: 102514 - DNA, 75 bp, Artificial Sequence
  Synthetic
tggctcactacacatgctctttttcatgaagttgcaaaattggatgtggtgaaattactgtataatgagcagttt

SEQ ID NO: 102515 - DNA, 75 bp, Artificial Sequence
  Synthetic
caaaaatgtataactgccttggcctctatttgtcagatgttctgcttttggaggggagatcttgtttttgatttt

SEQ ID NO: 102516 - DNA, 75 bp, Artificial Sequence
  Synthetic
gatcaaggttattccagttgatccatattttttccaaatgactaacacaaatcctgagcaaaaatgtataactgc

SEQ ID NO: 102517 - DNA, 75 bp, Artificial Sequence
  Synthetic
catcacattgataaaaccatgattaattttcctgcagctatgcctttttctaaagctgaaattgatccaatggct

SEQ ID NO: 102518 - DNA, 75 bp, Artificial Sequence
  Synthetic
tggagagtccagacatacatcagatcatatgtctatttataaatttatgggaaggtctcattttttgtgtacttt

SEQ ID NO: 102519 - DNA, 75 bp, Artificial Sequence
  Synthetic
attggcttcaatatgtcagatgttttgtttttggagaggggacttggtttttgatttccaggtttttcctacaaa

SEQ ID NO: 102520 - DNA, 75 bp, Artificial Sequence
  Synthetic
ctactgctccttgtgcagtgatggacattacaggagtgcagtcaaccttgagatttcgtgttccttggatttctg

SEQ ID NO: 102521 - DNA, 75 bp, Artificial Sequence
  Synthetic
ttctgatcatatgtctatctataaatttatgggcagatctcatttcttgtgtacatttacatttaattctaacaa

SEQ ID NO: 102522 - DNA, 75 bp, Artificial Sequence
  Synthetic
taaagctgaaattgatccaatggctgtgatgttgtctaaatattcattacctatagtggaagagccagaggacta

SEQ ID NO: 102523 - DNA, 75 bp, Artificial Sequence
  Synthetic
cgacttctaatcctcctcatggtttaccatcaacattaaggtggtttttcaatctgtttcagttgtatagaggac

SEQ ID NO: 102524 - DNA, 75 bp, Artificial Sequence
  Synthetic
agaaaagggtcgtcatttttcttcaccctttataattgcaacatctaactggtctaatccaagtcctaaaacagt

SEQ ID NO: 102525 - DNA, 75 bp, Artificial Sequence
  Synthetic
gatttcagatactccttatagagttaatagatataccaagtcagcacatcagaaaggagagtatactgccatagg

SEQ ID NO: 102526 - DNA, 75 bp, Artificial Sequence
  Synthetic
gggataacaaccatgagggatttaaaaggaaaagccaataggggaaagatggatgtttcaggagtgcaagcacct

SEQ ID NO: 102527 - DNA, 75 bp, Artificial Sequence
  Synthetic
ttgtttttacaacttgtccaaaagatgagttgagaccattagagaaagttttggaatcaaaaataagagcaattg

SEQ ID NO: 102528 - DNA, 75 bp, Artificial Sequence
  Synthetic
gtactcctatctttatgctgtttcaggggcactggatgggcttggagataaaacagattcaacttttgggcttgt

SEQ ID NO: 102529 - DNA, 75 bp, Artificial Sequence
  Synthetic
tcaacaaaacagaatgttccagacccccaagttggtattacaacagtgaaggatcttaaaggtagagcaaatcag

SEQ ID NO: 102530 - DNA, 75 bp, Artificial Sequence
  Synthetic
cactcagatgaatatttgtcttttagttgttacttgtctgtgactgaacagtctgagttttattttcctagagca

SEQ ID NO: 102531 - DNA, 75 bp, Artificial Sequence
  Synthetic
caatcagagttctattttcctagagctccattaaattcaaatgctatgttgtccactgagtccatgatgagtaga

SEQ ID NO: 102532 - DNA, 75 bp, Artificial Sequence
  Synthetic
agagttaatgtttatctttcagcaattaatttggaatgttttgctcctctttatcatgctatggatgttactaca

SEQ ID NO: 102533 - DNA, 75 bp, Artificial Sequence
  Synthetic
aggggtcccttggatttgacaataattataactggggctactgatgttgatggaatggcttggttcactcccgtt

SEQ ID NO: 102534 - DNA, 75 bp, Artificial Sequence
  Synthetic
tgaattcaattgttaacaacattaacttgtattatgtgttttctaaaatatttggaaagtctccagttttctttt

SEQ ID NO: 102535 - DNA, 75 bp, Artificial Sequence
  Synthetic
gagaagatttggattctctatggctgctggtagaagtgtgtggactcttgagatggatgctggagttcttactgg

SEQ ID NO: 102536 - DNA, 75 bp, Artificial Sequence
  Synthetic
gtactcctatctttatgctgtctcaggggcactggatgggcttggagacaagacagattcaacttttgggcttgt

SEQ ID NO: 102537 - DNA, 75 bp, Artificial Sequence
  Synthetic
ttccattcaaattgcaaattacaatcattcagatgaatatttgtcttttagttgttatttgtctgtgactgaaca

SEQ ID NO: 102538 - DNA, 75 bp, Artificial Sequence
  Synthetic
cgaaaagttcacaagcaacaaatattggtctaaagtgaattttccacatggaatgttggatcttgaagaaattgc

SEQ ID NO: 102539 - DNA, 75 bp, Artificial Sequence
  Synthetic
gtcagaaactgatttgtgtttcttgttgcactggctgaaccccaaaaagataaacttggcagatagaatgttggg

SEQ ID NO: 102540 - DNA, 75 bp, Artificial Sequence
  Synthetic
tgtacaagcatttctcccgcaaagaagaggaaccaattccagctgaaggggtttatcatggtgtgactaagccta

SEQ ID NO: 102541 - DNA, 75 bp, Artificial Sequence
  Synthetic
gttgatgatcctcgatctgaagaagatcgtaaatttgagagccatattgaaaagaggaagccttataaagagcta

SEQ ID NO: 102542 - DNA, 75 bp, Artificial Sequence
  Synthetic
taaagtatgctcaggaagaactgtcaaatgaagtactacctcctcctcgtaaaatcaagggcgtattttcacaag

SEQ ID NO: 102543 - DNA, 75 bp, Artificial Sequence
  Synthetic
tacaacaactgaaccaagatgagcattcccacataattggcttgttgagaattatgaattatgcagatattggct

SEQ ID NO: 102544 - DNA, 75 bp, Artificial Sequence
  Synthetic
tatagggagatacctcaccgccgtttgcctaggctataggctaaattttccctttccccttccccttccttgttt

SEQ ID NO: 102545 - DNA, 75 bp, Artificial Sequence
  Synthetic
tgcctaggctataggctaaattttccctttccccttccccttccttgttttgattgtaaatataaattcctgcag

SEQ ID NO: 102546 - DNA, 75 bp, Artificial Sequence
  Synthetic
caaaaatttcattgttctatacagaagatcatgagattatgaaattttcttggaaaggaattactgctgatacta

SEQ ID NO: 102547 - DNA, 75 bp, Artificial Sequence
  Synthetic
tttgtgacctttcatgatttgtttaaacaaattttcttaaaatttctgaggtttgtttatttcttttatcagtaa

SEQ ID NO: 102548 - DNA, 75 bp, Artificial Sequence
  Synthetic
attggctgctggcaggagtgtgtggacattggaaatggatgctggagttttgactggaaggctggtgagggttaa

SEQ ID NO: 102549 - DNA, 75 bp, Artificial Sequence
  Synthetic
gatgacaaaatagtttctttggtggagaagtttactagtaataaacattggtcaaaagttaatttccctcatgga

SEQ ID NO: 102550 - DNA, 75 bp, Artificial Sequence
  Synthetic
agaagtttactagtaataaacattggtcaaaagttaatttccctcatggaatgctagatttggaagagattgctg

SEQ ID NO: 102551 - DNA, 75 bp, Artificial Sequence
  Synthetic
cgggtgaaacctcttaggctaatacttctatgaagagatgctttggatagggtaacagcggcggatattggtgag

SEQ ID NO: 102552 - DNA, 75 bp, Artificial Sequence
  Synthetic
actttcttggattctattgctgggactttgaaatctatgatgtttgggtttcatcattctgtgactgttgaaatt

SEQ ID NO: 102553 - DNA, 75 bp, Artificial Sequence
  Synthetic
tagatcagaggaggacagaagatttgagagtcatatagaatgtaggaaaccatacaaggaattgagattggaggt

SEQ ID NO: 102554 - DNA, 75 bp, Artificial Sequence
  Synthetic
tcatcattctgtgactgttgaaattataaatactgtgctttgttttgttaagagtggaatcctgctttatgtcat

SEQ ID NO: 102555 - DNA, 75 bp, Artificial Sequence
  Synthetic
gtcccaaggatgaattaagacctctggacaaagtattggaatctaaaactagggctattgattcttgtcctcttg

SEQ ID NO: 102556 - DNA, 75 bp, Artificial Sequence
  Synthetic
agtgccgagctttcctggactctataactagcaccttaaagtcaatgatgtttggttttcatcactctgtcacag

SEQ ID NO: 102557 - DNA, 75 bp, Artificial Sequence
  Synthetic
acaacaattgaaccaagatgaacactctcacataattggtttgttgagagttatgaattatgcagatattggctg

SEQ ID NO: 102558 - DNA, 75 bp, Artificial Sequence
  Synthetic
ccagttgtttgctatttatatggcaaaagagggggagggaaaagtttgacttcaattgcattggcaaccaaaatt

SEQ ID NO: 102559 - DNA, 75 bp, Artificial Sequence
  Synthetic
agggctattgattcttgtcctcttgactatacgattttgtgtagaatgtactggggtccagccattagttatttc

SEQ ID NO: 102560 - DNA, 75 bp, Artificial Sequence
  Synthetic
ttcaattgcattggcaaccaaaatttgtaaacactatggtgttgaacctgagaaaaatatttacactaaacctgt

SEQ ID NO: 102561 - DNA, 75 bp, Artificial Sequence
  Synthetic
ttccacctcctaggaaaatgaaggggctattttcacaagctaagatttctcttttttatactgaggagcatgaaa

SEQ ID NO: 102562 - DNA, 75 bp, Artificial Sequence
  Synthetic
aactagcaccttaaagtcaatgatgtttggttttcatcactctgtcacagttgaaatcattaatactgttttatg

SEQ ID NO: 102563 - DNA, 75 bp, Artificial Sequence
  Synthetic
tctcctgggtttccttatgttcaagaaaaattgaccaaaagagatttaatttggttggatgaaaatggtttgctg

SEQ ID NO: 102564 - DNA, 75 bp, Artificial Sequence
  Synthetic
aactgtttttaattggcagatggattcgagaatgatggagcttagaactcagagcatctcaaactggcttagaga

SEQ ID NO: 102565 - DNA, 75 bp, Artificial Sequence
  Synthetic
tggatcaatcttcagttcatactgctgaggttggatcacatcaggttgaacctttgagaacctctgttgataaac

SEQ ID NO: 102566 - DNA, 75 bp, Artificial Sequence
  Synthetic
agaatcaggcctgctattgctgagaaaaccatatggtcattagttgcatggcaaaggaacaatgctgaatttgaa

SEQ ID NO: 102567 - DNA, 75 bp, Artificial Sequence
  Synthetic
ggggttcatttgtcacctctcagagattgcatagcaagagtccaccaaaagctcaagaatcttggatctataaat

SEQ ID NO: 102568 - DNA, 75 bp, Artificial Sequence
  Synthetic
aaagacatgtcatgtgttgatcttgttatggataatcacaatgtttcattgtctgaattgcttagctcactggtg

SEQ ID NO: 102569 - DNA, 75 bp, Artificial Sequence
  Synthetic
catgatttgtttaaacaaattttcttaaaatttctgaggtttgtttattttatcttttcagtaaataaaaaaaaa

SEQ ID NO: 102570 - DNA, 75 bp, Artificial Sequence
  Synthetic
gttcttcaaattcaggatgttgaaaaatttgaacagtaccaaaaaggggttgatttaattcagaaattgagaact

SEQ ID NO: 102571 - DNA, 75 bp, Artificial Sequence
  Synthetic
aaaacaaatgatgcaattaaggacatgtcttgtgttgatttaataatggatggacacaatatttcattgatggat

SEQ ID NO: 102572 - DNA, 75 bp, Artificial Sequence
  Synthetic
atcatcaacaaaagatagagagagcaattgaagaggctgataatttttgtgttcttcaaattcaggatgttgaaa

SEQ ID NO: 102573 - DNA, 75 bp, Artificial Sequence
  Synthetic
cacataattggtttgttgagagttatgaattatgcagatattggctgctcagttatttcatgtggcaaagttttt

SEQ ID NO: 102574 - DNA, 75 bp, Artificial Sequence
  Synthetic
gaattactatttttaaaagttttaaggatgccatatattggctatatacaaaattgaaggatttttatgaagtaa

SEQ ID NO: 102575 - DNA, 75 bp, Artificial Sequence
  Synthetic
gtgggttgctgtgggagctgcagttggtattcttggagtgcttgtggggggatggtttgtgtataagcatttctc

SEQ ID NO: 102576 - DNA, 75 bp, Artificial Sequence
  Synthetic
ccacaaagaggaagaaccaattccagctgaaggggtttaccatggcgtgaccaagcccaaacaggtgattaaatt

SEQ ID NO: 102577 - DNA, 75 bp, Artificial Sequence
  Synthetic
aaaatagaaaaagccattgaagaagcagacaatttttgcattttgcaaattcaagatgtagagaaatttgatcag

SEQ ID NO: 102578 - DNA, 75 bp, Artificial Sequence
  Synthetic
gaaaaatggatgtgtgagatgggttatgaatgccttaggagtgaaggatgattggttgttagtaccttctcatgc

SEQ ID NO: 102579 - DNA, 75 bp, Artificial Sequence
  Synthetic
aagaaaagggtcgccacttttcctcgcccttcataattgcaacatccaactggtctaatccaagtcctaaaacag

SEQ ID NO: 102580 - DNA, 75 bp, Artificial Sequence
  Synthetic
taggttgcatttcaaagttgaggtgaaacctgcctcattctttaaaaatcctcacaatgatatgttaaatgttaa

SEQ ID NO: 102581 - DNA, 75 bp, Artificial Sequence
  Synthetic
ttaggaagaacttggttcaatttggagttggggagaaaaatggatgtgtgagatgggttatgaatgccttaggag

SEQ ID NO: 102582 - DNA, 75 bp, Artificial Sequence
  Synthetic
gagtgcttgtgggaggatggtttgtgtataagcatttttcccgcaaagaggaagaaccaattccagctgaagggg

SEQ ID NO: 102583 - DNA, 75 bp, Artificial Sequence
  Synthetic
gtggttctaatgaaagtgcccacaattccaaaatttagagatataacagaacattttattaaaaagagtgatgta

SEQ ID NO: 102584 - DNA, 75 bp, Artificial Sequence
  Synthetic
tgactggtgcttcctattttacatctgttgatcagtcttcagtccatactgcagaggttggttcacatcaaattg

SEQ ID NO: 102585 - DNA, 75 bp, Artificial Sequence
  Synthetic
cttcttattttacttctgtggatcaatcttcagttcatactgctgaggttggatcacatcaggttgaacctttga

SEQ ID NO: 102586 - DNA, 75 bp, Artificial Sequence
  Synthetic
caggttttcccgaccaaatatcattcaggtagattattattttgttttgttcctggtaatgagctaatagatgtt

SEQ ID NO: 102587 - DNA, 75 bp, Artificial Sequence
  Synthetic
aattcccaagtttagagatattactcagcattttattaagaaaggagatgtacctagagccctgaatcgcttggc

SEQ ID NO: 102588 - DNA, 75 bp, Artificial Sequence
  Synthetic
aatgccatattaggaatccacgttgctggtggaaattcaattttggttgctaagttagtgactcaagagatgttt

SEQ ID NO: 102589 - DNA, 75 bp, Artificial Sequence
  Synthetic
ttcaaggtttgttgagataccatacatatgcaagatttggcattgaaattcaagttcagataaaccctacacctt

SEQ ID NO: 102590 - DNA, 75 bp, Artificial Sequence
  Synthetic
gaagttcttcttgattcattctgctgattggcttacaacacatgctctttttcatgaagttgctaaattggatgt

SEQ ID NO: 102591 - DNA, 75 bp, Artificial Sequence
  Synthetic
atgctgatcctgtagagtcacaatcaaccttagaaattgctggtttggtgagaaagaatcttgttcagtttgggg

SEQ ID NO: 102592 - DNA, 75 bp, Artificial Sequence
  Synthetic
gttccatttatttacacaagaggtgcttaccattttaaagatccacaatacccagtctgggaattgacaattaga

SEQ ID NO: 102593 - DNA, 75 bp, Artificial Sequence
  Synthetic
actgtttatcctcatggtctgttaaattgtaacatcaacaatgtagttagaataaaggttccatttatttatact

SEQ ID NO: 102594 - DNA, 75 bp, Artificial Sequence
  Synthetic
atgggtcatgaatgctttgggaatcaaggatgattggctattagtgccctctcacgcttacaagtttgaaaaaga

SEQ ID NO: 102595 - DNA, 75 bp, Artificial Sequence
  Synthetic
gcagaatgttccagatccccaagttggtataacaaccatgaaggatttaaaaggtaaagctaataggggaaaaat

SEQ ID NO: 102596 - DNA, 75 bp, Artificial Sequence
  Synthetic
gtagttttaatgaaagtgcccacaattccaaaatttagagatataacagaacattttatcaaaaagagtgatgta

SEQ ID NO: 102597 - DNA, 75 bp, Artificial Sequence
  Synthetic
atatgtctatttacaagtttatgggaaggtctcattttttgtgcacttttacttttaattcaaacaataaagagt

SEQ ID NO: 102598 - DNA, 75 bp, Artificial Sequence
  Synthetic
aaggtctcattttttgtgcacttttacttttaattcaaacaataaagagtacacatttcctataaccttgtcttc

SEQ ID NO: 102599 - DNA, 75 bp, Artificial Sequence
  Synthetic
ccatttaaatcctggttttcatactggtgttgcaattggaattgatcctgatagacagtgggaccaactttttaa

SEQ ID NO: 102600 - DNA, 75 bp, Artificial Sequence
  Synthetic
tccaatgttaatttcagagggaccccttaaaatggaggagaaggctacttatgttcataaaaagaatgatggaac

SEQ ID NO: 102601 - DNA, 75 bp, Artificial Sequence
  Synthetic
atttgtttcaattgtatagaggacctttagatctgacaattatcatcactggagcaactgatgtagatggcatgg

SEQ ID NO: 102602 - DNA, 75 bp, Artificial Sequence
  Synthetic
tcagatgttttgtttttggagaggagatcttgtctttgattttcaggtttttccgaccaaatatcattcaggtag

SEQ ID NO: 102603 - DNA, 75 bp, Artificial Sequence
  Synthetic
gtgttgctattggcatagatcctgatagacagtgggatgaattatttaaaacaatgataagatttggagatgtcg

SEQ ID NO: 102604 - DNA, 75 bp, Artificial Sequence
  Synthetic
gggctcctgggatagatgcaattaatatggattcttctcctggatatccttatgttcaagaaaaattaaccaaaa

SEQ ID NO: 102605 - DNA, 75 bp, Artificial Sequence
  Synthetic
tatggattcttctcctggatatccttatgttcaagaaaaattaaccaaaagagacttgatttggcttgatgataa

SEQ ID NO: 102606 - DNA, 75 bp, Artificial Sequence
  Synthetic
aaccctataaagaattgagattggaagttgggaaacaaagactcaagtatgctcaggaagaattgtcaaatgaag

SEQ ID NO: 102607 - DNA, 75 bp, Artificial Sequence
  Synthetic
cttcagctgataaaaatgtgcctcaactgaagccagtttcagaattgacttttcttaaaagatcttttaatttgg

SEQ ID NO: 102608 - DNA, 75 bp, Artificial Sequence
  Synthetic
acagctttgttgaattcaattattaacaacattaatttgtattatgtgttttctaaaatatttggaaagtctcca

SEQ ID NO: 102609 - DNA, 75 bp, Artificial Sequence
  Synthetic
atacaacaatgatggaaaattgctcagatttggatgttgttttcactacctgtcccaaagatgagttaagacctc

SEQ ID NO: 102610 - DNA, 75 bp, Artificial Sequence
  Synthetic
tagggctattgattcttgtcctcttgactacacgattttgtgtagaatgtactggggtccagctattagttattt

SEQ ID NO: 102611 - DNA, 75 bp, Artificial Sequence
  Synthetic
taactgtttatcctcatggtttgttgaattgtaacatcaataatgtcgtgaggataaaggtgccatttatttaca

SEQ ID NO: 102612 - DNA, 75 bp, Artificial Sequence
  Synthetic
cagtgtttcatttgtgacctttcatgatttgtttaaacaaattttcttaaaatttctgaggtttgtttatttctt

SEQ ID NO: 102613 - DNA, 75 bp, Artificial Sequence
  Synthetic
tttgtgacctttcatgatttgtttaaacaaattttcttactctttctgaggtttgtttatttcttttgtccgcta

SEQ ID NO: 102614 - DNA, 75 bp, Artificial Sequence
  Synthetic
ttcaagaggggtgtccggagttttccgagcctctcttggaagtccatggtgaggggacttgatacctcaccgccg

SEQ ID NO: 102615 - DNA, 75 bp, Artificial Sequence
  Synthetic
ttcagttatttcatgtggcaaagttttctccaaaatgctggaatcagtctttaattggcagatggactctagaat

SEQ ID NO: 102616 - DNA, 75 bp, Artificial Sequence
  Synthetic
tccaactggttaagagatatctgttcagggatcactatttttaaaaacttcaaggatgcaatttattggctctat

SEQ ID NO: 102617 - DNA, 75 bp, Artificial Sequence
  Synthetic
tgaattatggtaagaagaaggatattttaaatatccttaaagacaaccaacaaaaaatagagaaagccattgagg

SEQ ID NO: 102618 - DNA, 75 bp, Artificial Sequence
  Synthetic
ttcaagaggggcctccgggttttccggagcccctcttgggagtccatggtgaggggacttgatacctcaccgccg

SEQ ID NO: 102619 - DNA, 75 bp, Artificial Sequence
  Synthetic
acagagctatggttctatggcatcattgactgtttatcctcatggtttgctgaattgcaatatcaacaatgtggt

SEQ ID NO: 102620 - DNA, 75 bp, Artificial Sequence
  Synthetic
cccttttccctttccctgtgttattgtaaatattaattcctgcaggttcagggttcttgaatttgttctgctgta

SEQ ID NO: 102621 - DNA, 75 bp, Artificial Sequence
  Synthetic
ggactgttctttggggccttatgtggtgtttgcctctgaggtactcaggggcatttaggtttttcctcattctta

SEQ ID NO: 102622 - DNA, 75 bp, Artificial Sequence
  Synthetic
actcaaaaaccttggatctataaatcaggcaatggtaacaagatgtgagccagttgtttgctatttgtatggcaa

SEQ ID NO: 102623 - DNA, 75 bp, Artificial Sequence
  Synthetic
cttttgctttggatcaggaagattggaagtctgatccttctcaaggtggtggaattaaaattactcattttacta

SEQ ID NO: 102624 - DNA, 75 bp, Artificial Sequence
  Synthetic
tcaattgcattggcaactaaaatttgtaaacattatggtgttgtacctgagaagaacatctatactaaacctgtg

SEQ ID NO: 102625 - DNA, 75 bp, Artificial Sequence
  Synthetic
gtaaacattatggtgttgtacctgagaagaacatctatactaaacctgtggcttcagattattgggatgggtata

SEQ ID NO: 102626 - DNA, 75 bp, Artificial Sequence
  Synthetic
tgatatcggtcaaaatacaacagatgaggattggtcagacttttgtcagttggtgtcaggatgcccaatgagatt

SEQ ID NO: 102627 - DNA, 75 bp, Artificial Sequence
  Synthetic
actgtcagggctgtctttaggcttaattcctgacctctctgtgcttagggcaaacaaaatttggccttaaatgag

SEQ ID NO: 102628 - DNA, 75 bp, Artificial Sequence
  Synthetic
ctacttggacatctatcccaactttggctgctcagtttccatttaatgcttcagattcagttggtcagcaaatta

SEQ ID NO: 102629 - DNA, 75 bp, Artificial Sequence
  Synthetic
tgatggatattactggagtacagtcaactttgagatttcgtgttccttggatttcagatactccttatagagtta

SEQ ID NO: 102630 - DNA, 75 bp, Artificial Sequence
  Synthetic
atctatgatgtttggatttcatcattctgtgactgttgaaattataaatactgtgctttgttttgttaagagtgg

SEQ ID NO: 102631 - DNA, 75 bp, Artificial Sequence
  Synthetic
gtgggagctgcagttggcattcttggagtgcttgtggggggatggtttgtgtataagcatttctcccgcaaagag

SEQ ID NO: 102632 - DNA, 75 bp, Artificial Sequence
  Synthetic
ttcattttttaaaaatcctcacaatgatatgttgaatgtcaatttagctaaaacaagtgatgcaatcaaggatat

SEQ ID NO: 102633 - DNA, 75 bp, Artificial Sequence
  Synthetic
ttgtgccatggttcctggtgaccaaagttatggttcaatagcatccttgactgtttatcctcatggtttgttaaa

SEQ ID NO: 102634 - DNA, 75 bp, Artificial Sequence
  Synthetic
acttctgtggatcaatcttctgttcatacagctgaagttggtgcacatcagtctgaacctttaaaaacttctgtt

SEQ ID NO: 102635 - DNA, 75 bp, Artificial Sequence
  Synthetic
caactactgctccttgtgcagtgatggacattacaggagtgcagtcaactttgagatttcgtgttccctggattt

SEQ ID NO: 102636 - DNA, 75 bp, Artificial Sequence
  Synthetic
atacagctgaagttggtgcacatcagtctgaacctttaaaaacttctgttgataagccaggctccaaaagaacac

SEQ ID NO: 102637 - DNA, 75 bp, Artificial Sequence
  Synthetic
acagtacccagtttgggaattaacaatcagagtttggtcagagttgaatattggaacaggaacttcagcttacac

SEQ ID NO: 102638 - DNA, 75 bp, Artificial Sequence
  Synthetic
gaatttatggagttgtggtctcagggaatttcagatgatgatagtgcagtggcagagtttttccagtcttttcca

SEQ ID NO: 102639 - DNA, 75 bp, Artificial Sequence
  Synthetic
ttctgctgattggttgacaacacatgctttgtttcatgaagttgcaaaattggatgtggttaaattattatacaa

SEQ ID NO: 102640 - DNA, 75 bp, Artificial Sequence
  Synthetic
ggcagagtttttccagtcttttccatctggtgaaccatcgaattccaaattatctggctttttccaatctgttag

SEQ ID NO: 102641 - DNA, 75 bp, Artificial Sequence
  Synthetic
gctttgtttcatgaagttgcaaaattggatgtggttaaattattatacaatgaacagtttgctgtccagggcttg

SEQ ID NO: 102642 - DNA, 75 bp, Artificial Sequence
  Synthetic
ttggaattgaaatacaagttcaaattaatcccactccattccaacaaggtggattaatatgtgctatggttcctg

SEQ ID NO: 102643 - DNA, 75 bp, Artificial Sequence
  Synthetic
gagatcagagctatggatccatagcttctctgacagtgtatcctcatggtttgttgaattgcaacataaacaatg

SEQ ID NO: 102644 - DNA, 75 bp, Artificial Sequence
  Synthetic
tggttaggattaaagttcctttcatttatacgaggggggcttaccattttaaagatcctcaatatcctgtttggg

SEQ ID NO: 102645 - DNA, 75 bp, Artificial Sequence
  Synthetic
ttatacgaggggggcttaccattttaaagatcctcaatatcctgtttgggaattgactattagagtgtggtcaga

SEQ ID NO: 102646 - DNA, 75 bp, Artificial Sequence
  Synthetic
cctgtcggagctatcacaacaattgaggatcctgttttagcaaagaaagtacctgagacattccctgaattgaaa

SEQ ID NO: 102647 - DNA, 75 bp, Artificial Sequence
  Synthetic
gcttacacctcattaaatgtgttggctagatttactgacttagaactccatggattaacacctttatctacacaa

SEQ ID NO: 102648 - DNA, 75 bp, Artificial Sequence
  Synthetic
ctagatttactgacttagaactccatggattaacacctttatctacacaaatgatgagaaatgaatttagagtca

SEQ ID NO: 102649 - DNA, 75 bp, Artificial Sequence
  Synthetic
taggagttcatccaagattggcccagagaattttatttaatactgtcatgatggaaaattgttctgacctagatg

SEQ ID NO: 102650 - DNA, 75 bp, Artificial Sequence
  Synthetic
atcgaattatgaggatgctagagcaaaaatgtcttttgctttggatcaggaggactggaaatccgatgcttctca

SEQ ID NO: 102651 - DNA, 75 bp, Artificial Sequence
  Synthetic
ttaccatcaacattaaggtggtttttcaatttgtttcagttgtatagaggacctttagatctgacaattatcatc

SEQ ID NO: 102652 - DNA, 75 bp, Artificial Sequence
  Synthetic
gatattacccaacattttattaagaagggagatgtgcctagagctttgaatcgtctggcaacattagtgacaact

SEQ ID NO: 102653 - DNA, 75 bp, Artificial Sequence
  Synthetic
aaaatgtcttttgctttggatcaggaggactggaaatccgatgcttctcaaggaggaggaattaaaattacacac

SEQ ID NO: 102654 - DNA, 75 bp, Artificial Sequence
  Synthetic
ctttggctgctcagtttccatttaatgcttctgactctgttgggcaacaaattaaggttattccagttgatccat

SEQ ID NO: 102655 - DNA, 75 bp, Artificial Sequence
  Synthetic
tgccgttgatactccctgggtagaaaaggagtcagctttgtctattgactacaaaactgctcttggagctgtcag

SEQ ID NO: 102656 - DNA, 75 bp, Artificial Sequence
  Synthetic
attaaggttattccagttgatccatactttttccagatgactaacacaaatcctgaacaaaagtgtattactgca

SEQ ID NO: 102657 - DNA, 75 bp, Artificial Sequence
  Synthetic
ggcataacaaccatgagggacttaaaagggaaagccaataggggaaagatggatgtttcaggagtgcaagcacct

SEQ ID NO: 102658 - DNA, 75 bp, Artificial Sequence
  Synthetic
cttagtccatttatgatcagggaggcgggtagagtcatgagtgaattgtctggaacaccatctcactttggaacg

SEQ ID NO: 102659 - DNA, 75 bp, Artificial Sequence
  Synthetic
gtttctggagaggagacctagtttttgattttcaggtttttccaacaaaataccattcaggaaggctgttgtttt

SEQ ID NO: 102660 - DNA, 75 bp, Artificial Sequence
  Synthetic
tgattttcaggtttttccaacaaaataccattcaggaaggctgttgttttgttttgtacctgggaatgaattgat

SEQ ID NO: 102661 - DNA, 75 bp, Artificial Sequence
  Synthetic
ctaaacatttgctgtacaattgttgttatcatgtctgtggttcaatgccttctgggtctccttgtacagctttgt

SEQ ID NO: 102662 - DNA, 75 bp, Artificial Sequence
  Synthetic
taaattatggcaagaagaaggatgttcttaatattctcaaagacaaccagcaaaagatagaaaaagccattgagg

SEQ ID NO: 102663 - DNA, 75 bp, Artificial Sequence
  Synthetic
ttccctagttatgacagttgaaatcaggaaacaaaacatgactgcatttatggagttgtggtctcagggaatttc

SEQ ID NO: 102664 - DNA, 75 bp, Artificial Sequence
  Synthetic
caagcaaccactgcaccttgtgctgtgatggatattactggtgttcagtcaactttgagatttcgtgtgccctgg

SEQ ID NO: 102665 - DNA, 75 bp, Artificial Sequence
  Synthetic
cattggaaatggatgctggagttttgactggcaggttggtgagggtcaatgatgaaaaatggacagaaatgaaag

SEQ ID NO: 102666 - DNA, 75 bp, Artificial Sequence
  Synthetic
tgatggatattactggtgttcagtcaactttgagatttcgtgtgccctggatttcagatactccttatagggtta

SEQ ID NO: 102667 - DNA, 75 bp, Artificial Sequence
  Synthetic
gaaatttactagtaataaacactggtccaaagttaattttcctcatggaatgttggatttggaagaaattgctgc

SEQ ID NO: 102668 - DNA, 75 bp, Artificial Sequence
  Synthetic
gaagggagagtatactgctataggaaagttgattgtctattgttataatagattaacctctccttctaatgtggc

SEQ ID NO: 102669 - DNA, 75 bp, Artificial Sequence
  Synthetic
aagttgattgtctattgttataatagattaacctctccttctaatgtggcctctcatgttagagttaatgtttat

SEQ ID NO: 102670 - DNA, 75 bp, Artificial Sequence
  Synthetic
ttatccaagtattcattacccattgtagaagagccagaagattataaagaagcttcaattttttatcaaaataaa

SEQ ID NO: 102671 - DNA, 75 bp, Artificial Sequence
  Synthetic
aaatttggcggataggatgttgggtctgtcagggatacaggaaataaaagaaaaaggggtgggattgattggcga

SEQ ID NO: 102672 - DNA, 75 bp, Artificial Sequence
  Synthetic
ttgctccactctatcatgctatggatgttacaactcaggttggagatgattctggaggtttttctaccacagttt

SEQ ID NO: 102673 - DNA, 75 bp, Artificial Sequence
  Synthetic
tgttacaactcaggttggagatgattctggaggtttttctaccacagtttctacaaagcagaatgttccagaccc

SEQ ID NO: 102674 - DNA, 75 bp, Artificial Sequence
  Synthetic
gatctcaaaggtaaggcaaatcagggaaaaatggacgtgtcaggtgtccaagctcctgtaggtgctattacaacc

SEQ ID NO: 102675 - DNA, 75 bp, Artificial Sequence
  Synthetic
gaaaaatggacgtgtcaggtgtccaagctcctgtaggtgctattacaaccattgaagatccagttttggcaaaga

SEQ ID NO: 102676 - DNA, 75 bp, Artificial Sequence
  Synthetic
ctgctggcagaagtgtgtggactcttgaaatggatgctggggttctaactgggagattgattagactgaatgatg

SEQ ID NO: 102677 - DNA, 75 bp, Artificial Sequence
  Synthetic
ttgagagtgatgaattatgctgatattgggtgttctgtcatttcatgtggtaaagtgttttcaaaaatgttagaa

SEQ ID NO: 102678 - DNA, 75 bp, Artificial Sequence
  Synthetic
aatacaagaagaacaggaaacattcagattagattgccatggtattcttatttgtatgccgtgtctggagcactg

SEQ ID NO: 102679 - DNA, 75 bp, Artificial Sequence
  Synthetic
gaagcctggtgagtcaagacatacatctgatcacatgtctatttacaaatttatgggtagatctcatttcttgtg

SEQ ID NO: 102680 - DNA, 75 bp, Artificial Sequence
  Synthetic
aaagttttaaggatgcgatttattggctttacacaaaaattagagaatactatgatctgaattatggtaataaga

SEQ ID NO: 102681 - DNA, 75 bp, Artificial Sequence
  Synthetic
aaggagtacacttttcctattaccttgtcatctacttctaatcccccacatggattgccctcaacattgagatgg

SEQ ID NO: 102682 - DNA, 75 bp, Artificial Sequence
  Synthetic
gaggtcctctggacttaacaataattattactggagccactgatgttgatggaatggcatggtttactcctgttg

SEQ ID NO: 102683 - DNA, 75 bp, Artificial Sequence
  Synthetic
tattactggagccactgatgttgatggaatggcatggtttactcctgttggattggcagtggataccccttgggt

SEQ ID NO: 102684 - DNA, 75 bp, Artificial Sequence
  Synthetic
gaagttcttcctgattcattctgctgattggctcactacacatgctctctttcatgaagttgcaaaattggatgt

SEQ ID NO: 102685 - DNA, 75 bp, Artificial Sequence
  Synthetic
gactacaaaacagctcttggtgctgttagatttaataccagaagaacaggaaatattcagattagactgccttgg

SEQ ID NO: 102686 - DNA, 75 bp, Artificial Sequence
  Synthetic
atcaaaaattgaaaaatttgggttcaattaaccaggcaatggtgacaagatgtgagccagtcgtctgctacctct

SEQ ID NO: 102687 - DNA, 75 bp, Artificial Sequence
  Synthetic
tctattcaaattgcaaattacaatcattctgatgagtatttgtcttttagttgttatttgtctgtgactgaacag

SEQ ID NO: 102688 - DNA, 75 bp, Artificial Sequence
  Synthetic
catggctatgagttttatcagaaattttattattttgttcagtcctgtttggagaaagagatgatagaatacaga

SEQ ID NO: 102689 - DNA, 75 bp, Artificial Sequence
  Synthetic
ttgatgatcctcggtctgaagaagatcgaaaatttgaaagtcacattgagaagagaaaaccctataaggaattga

SEQ ID NO: 102690 - DNA, 75 bp, Artificial Sequence
  Synthetic
agctgaagccagtttcagaattgacttttctcaagagatctttcaatttggtagaagataggatcagacctgcaa

SEQ ID NO: 102691 - DNA, 75 bp, Artificial Sequence
  Synthetic
tgcctcaattaaagccagtttcagaattgactttccttaaaagatcctttaatttggtagaggacagaattagac

SEQ ID NO: 102692 - DNA, 75 bp, Artificial Sequence
  Synthetic
cttgaagaaattgctgccaactctaaagattttccaaatatgtctgagacagatttgtgtttcctgttgcattgg

SEQ ID NO: 102693 - DNA, 75 bp, Artificial Sequence
  Synthetic
tcgaaaatttgaaagtcacattgagaagagaaaaccctataaggaattgagattggaggttggcaaacaaagatt

SEQ ID NO: 102694 - DNA, 75 bp, Artificial Sequence
  Synthetic
aatgaagtgttgcctccccctcggaaaattaagggtgtgttctcacaagcaaaaatttcactgttttatacagag

SEQ ID NO: 102695 - DNA, 75 bp, Artificial Sequence
  Synthetic
gaacagtatcagaaaggggttgacttgatacaaaaattgaggactgttcattcaatggctcaggttgatcctaat

SEQ ID NO: 102696 - DNA, 75 bp, Artificial Sequence
  Synthetic
ggaagggaattactgctgacactagagctctgaggagatttgggttttccttggctgctggcagaagtgtgtgga

SEQ ID NO: 102697 - DNA, 75 bp, Artificial Sequence
  Synthetic
cattagaaatggatgctggtgttttaactgggagattggtgagagttaatgatgagaaatggacagaaatgaagg

SEQ ID NO: 102698 - DNA, 75 bp, Artificial Sequence
  Synthetic
aactgggagattggtgagagttaatgatgagaaatggacagaaatgaaggatgataaaattgtttctctggtgga

SEQ ID NO: 102699 - DNA, 75 bp, Artificial Sequence
  Synthetic
acctttcatgatttgtttaaacgaattttcttaaaatttctgaggtttgtttatttctttttatcagtaaataaa

SEQ ID NO: 102700 - DNA, 75 bp, Artificial Sequence
  Synthetic
tctaagattaattttcctcacggaatgctagatttagaagagattgctgcaaattcaaaggagtttccaaatatg

SEQ ID NO: 102701 - DNA, 75 bp, Artificial Sequence
  Synthetic
agccaaaacaagtaattaaattggatgctgatcctgtagagtcacaatcaactttagaaattgctggtttggtga

SEQ ID NO: 102702 - DNA, 75 bp, Artificial Sequence
  Synthetic
tgctagatttagaagagattgctgcaaattcaaaggagtttccaaatatgtcagagactgacttgtgttttctgt

SEQ ID NO: 102703 - DNA, 75 bp, Artificial Sequence
  Synthetic
actttagaaattgctggtttggtgagaaagaatcttgttcagtttggagttggtgagaagaatgggtgtgttaga

SEQ ID NO: 102704 - DNA, 75 bp, Artificial Sequence
  Synthetic
aaatttagcagatagaatgttaggtatgtcaggaatacaagagatcaaagaaaaaggagtaggattaattggtga

SEQ ID NO: 102705 - DNA, 75 bp, Artificial Sequence
  Synthetic
atgtcaggaatacaagagatcaaagaaaaaggagtaggattaattggtgagtgtagagctttccttgattcaata

SEQ ID NO: 102706 - DNA, 75 bp, Artificial Sequence
  Synthetic
aattatgagtgaattgtctggaactccatcccattttggaacagctctcatgaatactatcatttattctaagca

SEQ ID NO: 102707 - DNA, 75 bp, Artificial Sequence
  Synthetic
ttggctttcatcattctgttactgttgagattatcaacactgttttgtgttttgttaaaagtgggattttgctgt

SEQ ID NO: 102708 - DNA, 75 bp, Artificial Sequence
  Synthetic
cagtgttaacttggctctcatgaacctctttgatcttccacaaggggtaggctacgggtgaaacctcttaggcta

SEQ ID NO: 102709 - DNA, 75 bp, Artificial Sequence
  Synthetic
ctaaaacaagtgatgcaatcaaggatatgtcttgtgttgatctgataatggatggacataatgtttcattgatgg

SEQ ID NO: 102710 - DNA, 75 bp, Artificial Sequence
  Synthetic
ggaacattcacacataattggcttgttgagagtaatgaattatgctgacattggttgctctgttatttcatgtgg

SEQ ID NO: 102711 - DNA, 75 bp, Artificial Sequence
  Synthetic
aattatcaataatgtcaatttgtattatgtgttttccaagatatttggaaagtctccagttttcttttgtcaggc

SEQ ID NO: 102712 - DNA, 75 bp, Artificial Sequence
  Synthetic
agtggatgcattgagtggattgattgtcagggctgtctctaggtttaatctcagacctctctgtgcttagggcaa

SEQ ID NO: 102713 - DNA, 75 bp, Artificial Sequence
  Synthetic
actgtttttaattggcagatggattcaagaatgatggaattgaggactcagagcatttcaaattggcttagagac

SEQ ID NO: 102714 - DNA, 75 bp, Artificial Sequence
  Synthetic
ctcaagaatcttggatctataaatcaggccatggtgacaaggtgtgagccagttgtttgctatttatatggcaaa

SEQ ID NO: 102715 - DNA, 75 bp, Artificial Sequence
  Synthetic
caagaatgatggaattgaggactcagagcatttcaaattggcttagagacatttgttcaggcataacaattttta

SEQ ID NO: 102716 - DNA, 75 bp, Artificial Sequence
  Synthetic
gctttatacaagaatcagagaatattatgatgtcaactatggcaataagaaggatgttcttaatattcttaaaga

SEQ ID NO: 102717 - DNA, 75 bp, Artificial Sequence
  Synthetic
caggggcatttaggtttttcctcattcttaaacaataatgaacatgtccaaacaaggaattttccagactgttgg

SEQ ID NO: 102718 - DNA, 75 bp, Artificial Sequence
  Synthetic
tatgatgtcaactatggcaataagaaggatgttcttaatattcttaaagataaccaacagaaaattgagagggct

SEQ ID NO: 102719 - DNA, 75 bp, Artificial Sequence
  Synthetic
ttttacagattcaggatgttgagaagtttgaacagtatcagaaaggagtggatttaattcaaaagctgagaactg

SEQ ID NO: 102720 - DNA, 75 bp, Artificial Sequence
  Synthetic
ctgctgaggttggctcacatcaaattgaacctttgaaaacctctgttgataaacctggttctaagaagactcagg

SEQ ID NO: 102721 - DNA, 75 bp, Artificial Sequence
  Synthetic
ctcagagattgtattgctagggtccatcagaaattaaaaaatttaggttctatcaaccaagccatggtgacaaga

SEQ ID NO: 102722 - DNA, 75 bp, Artificial Sequence
  Synthetic
tctatgaccagtgcttcatttgtgacctttcataatttgtttaatcaaattttcttaaaatctctgaggtttgtc

SEQ ID NO: 102723 - DNA, 75 bp, Artificial Sequence
  Synthetic
tatcaaccaagccatggtgacaagatgtgaaccagttgtttgctatctttatggaaagaggggtggaggaaagag

SEQ ID NO: 102724 - DNA, 75 bp, Artificial Sequence
  Synthetic
acctttcataatttgtttaatcaaattttcttaaaatctctgaggtttgtctatttctgttattagtaaataaaa

SEQ ID NO: 102725 - DNA, 75 bp, Artificial Sequence
  Synthetic
aaaatttgtaagcattatggtgttgagcctgagaaaaacatttacacaaaacctgttgcctctgattattgggat

SEQ ID NO: 102726 - DNA, 75 bp, Artificial Sequence
  Synthetic
gcagtttgctgtccaaggtttgttgagataccatacatatgcaagatttggcattgagattcaagttcagataaa

SEQ ID NO: 102727 - DNA, 75 bp, Artificial Sequence
  Synthetic
gattagcatggagctgtaggagtctaaattggggacgcagatgtttgggacgtcaccttgcagtgttaacttggc

SEQ ID NO: 102728 - DNA, 75 bp, Artificial Sequence
  Synthetic
agcctgagaaaaacatttacacaaaacctgttgcctctgattattgggatggatatagtgggcaactggtatgca

SEQ ID NO: 102729 - DNA, 75 bp, Artificial Sequence
  Synthetic
aactgatgaagactggtctgatttttgtcaactggtgtctggatgtccgatgaggttgaatatggcctctttgga

SEQ ID NO: 102730 - DNA, 75 bp, Artificial Sequence
  Synthetic
tgtcaactggtgtctggatgtccgatgaggttgaatatggcctctttggaagagaaaggccgacatttttcatca

SEQ ID NO: 102731 - DNA, 75 bp, Artificial Sequence
  Synthetic
attatttattctaaacatttgctttataattgctgttatcatgtatgtgggtcaatgccttctgggtctccttgt

SEQ ID NO: 102732 - DNA, 75 bp, Artificial Sequence
  Synthetic
ggtccaatcctagccctaaaacagtctatgttaaagaagcaatagaccgcagattgcattttaaagttgaagtga

SEQ ID NO: 102733 - DNA, 75 bp, Artificial Sequence
  Synthetic
cggatattggtgagttgttaagacaaaaaccattcaacgccggaggactggctctcatccagtggatgcattgag

SEQ ID NO: 102734 - DNA, 75 bp, Artificial Sequence
  Synthetic
aagaaccaattccagctgaaggggtttatcatggtgtgactaagcccaaacaggtgattaaattggatgcagatc

SEQ ID NO: 102735 - DNA, 75 bp, Artificial Sequence
  Synthetic
ctatgttaaagaagcaatagaccgcagattgcattttaaagttgaagtgaagccagcttcattttttaaaaatcc

SEQ ID NO: 102736 - DNA, 75 bp, Artificial Sequence
  Synthetic
ggtttacagatttggagttgcatggattaactcctctttctacacagatgatgagaaatgaatttagagttagta

SEQ ID NO: 102737 - DNA, 75 bp, Artificial Sequence
  Synthetic
ctagcaaaaactaatgatgctatcaaggatatgtcatgtgttgacttggtcatggatagccataacatctcacta

SEQ ID NO: 102738 - DNA, 75 bp, Artificial Sequence
  Synthetic
aggatatgtcatgtgttgacttggtcatggatagccataacatctcactatcagaattacttagttcactagtga

SEQ ID NO: 102739 - DNA, 75 bp, Artificial Sequence
  Synthetic
tatgtcagaatttatggaactttggtcacaaggaatgtcagatgatgataatgatagtgcagttgctgagttttt

SEQ ID NO: 102740 - DNA, 75 bp, Artificial Sequence
  Synthetic
tcacaaggaatgtcagatgatgataatgatagtgcagttgctgagtttttccagtcctttccttctggtgagcca

SEQ ID NO: 102741 - DNA, 75 bp, Artificial Sequence
  Synthetic
ttcaagagaggtctccgggaattccggagtccctcttggaagtccatggtgaggggacttgatacctcaccgccg

SEQ ID NO: 102742 - DNA, 75 bp, Artificial Sequence
  Synthetic
aaagttattccagtggacccatattttttccagatgacaaacactaatcctgatcaaaaatgtataactgccttg

SEQ ID NO: 102743 - DNA, 75 bp, Artificial Sequence
  Synthetic
tccaatcagtcactaatcataaatgggttgcagttggggctgctgtgggggttcttggtgttttggttgggggct

SEQ ID NO: 102744 - DNA, 75 bp, Artificial Sequence
  Synthetic
ggttgcagttggggctgctgtgggggttcttggtgttttggttgggggctggtatgtctataagcattttataaa

SEQ ID NO: 102745 - DNA, 75 bp, Artificial Sequence
  Synthetic
tttgcctaggctataggctaaattttccctttcccttttccctttcctattccctttgttttgtttgtaaatgtt

SEQ ID NO: 102746 - DNA, 75 bp, Artificial Sequence
  Synthetic
ggttcagggttcttagatctgtttctctataagaacactcattttcacgctttctgtcttctttcttccagggct

SEQ ID NO: 102747 - DNA, 75 bp, Artificial Sequence
  Synthetic
gagggagtttatcatggtgtgactaaacctaaacaagtgattaaattagatgctgaccctgtagaatcacaatca

SEQ ID NO: 102748 - DNA, 75 bp, Artificial Sequence
  Synthetic
aacctaaacaagtgattaaattagatgctgaccctgtagaatcacaatcaactttggaaattgctggtttggtga

SEQ ID NO: 102749 - DNA, 75 bp, Artificial Sequence
  Synthetic
tggtgagaagaatggatgtgttagatgggtcatgaatgccttaggtattaaagatgattggctgttggtgccatc

SEQ ID NO: 102750 - DNA, 75 bp, Artificial Sequence
  Synthetic
ttgagattcaagttcagataaaccctacaccctttcagcaagggggactaatttgtgccatggttcctggtgacc

SEQ ID NO: 102751 - DNA, 75 bp, Artificial Sequence
  Synthetic
cttgagatttcgtgttccttggatttctgatacaccctatcgagtgaataggtacacgaagtcagcacatcaaaa

SEQ ID NO: 102752 - DNA, 75 bp, Artificial Sequence
  Synthetic
tgggtcatgaatgccttaggtattaaagatgattggctgttggtgccatcccatgcttataagtttgaaaaggat

SEQ ID NO: 102753 - DNA, 75 bp, Artificial Sequence
  Synthetic
aaagctgaaattgatccaatggctgtgatgttgtctaaatattcattacctattgtggaagaaccagaggattac

SEQ ID NO: 102754 - DNA, 75 bp, Artificial Sequence
  Synthetic
atagaggtggcacttactattcaatttctgcaggaaatgttgtgatacagtctctggatgttgggttccaggatg

SEQ ID NO: 102755 - DNA, 75 bp, Artificial Sequence
  Synthetic
ttctgcaggaaatgttgtgatacagtctctggatgttgggttccaggatgtagttttaatgaaggtgccaacaat

SEQ ID NO: 102756 - DNA, 75 bp, Artificial Sequence
  Synthetic
actctcatccagtggatgcattgagtggattgactgtcagggctgtctttaggcttaattccagacctctctgtg

SEQ ID NO: 102757 - DNA, 75 bp, Artificial Sequence
  Synthetic
aaagaagcttcagttttttatcaaaataaaatagtaggcaagactcagttagttgatgactttctagatcttgat

SEQ ID NO: 102758 - DNA, 75 bp, Artificial Sequence
  Synthetic
cattttattaaaaagagtgatgtacctagagccttgaataggttggcaacacttgtaaccactgttaatggaaca

SEQ ID NO: 102759 - DNA, 75 bp, Artificial Sequence
  Synthetic
ctagagccttgaataggttggcaacacttgtaaccactgttaatggaacaccaatgttaatttcagaggggcctc

SEQ ID NO: 102760 - DNA, 75 bp, Artificial Sequence
  Synthetic
tgttcataaaaagaatgatggcactactatagatttgactgttgaccaagcctggagaggtaaaggagagggtct

SEQ ID NO: 102761 - DNA, 75 bp, Artificial Sequence
  Synthetic
actatagatttgactgttgaccaagcctggagaggtaaaggagagggtcttccagggatgtgtggtggtgctttg

SEQ ID NO: 102762 - DNA, 75 bp, Artificial Sequence
  Synthetic
ggttggatgaaaatggtttgctgctaggagttcatccaagattggcccagagaattttatttaatactgttatga

SEQ ID NO: 102763 - DNA, 75 bp, Artificial Sequence
  Synthetic
cagtaggtcttgccgttgatactccttgggtagagaaggagtcagctttgtctattgactacaaaactgctcttg

SEQ ID NO: 102764 - DNA, 75 bp, Artificial Sequence
  Synthetic
tgcccttttctagggcagaaattgatccaatggcagttatgttatcaaagtattctctccctattgtggatgagc

SEQ ID NO: 102765 - DNA, 75 bp, Artificial Sequence
  Synthetic
tatgcaagatttggcattgaaattcaagttcagataaaccctacacctttccaacaggggggattgatctgtgct

SEQ ID NO: 102766 - DNA, 75 bp, Artificial Sequence
  Synthetic
ctttttccaaaataaaattttagggaagagtcccttggttgatgattttctagatattgaaatggctataaccgg

SEQ ID NO: 102767 - DNA, 75 bp, Artificial Sequence
  Synthetic
aagagtcccttggttgatgattttctagatattgaaatggctataaccggggctcctggaatagatgcaatcaat

SEQ ID NO: 102768 - DNA, 75 bp, Artificial Sequence
  Synthetic
atgttcaggagaagctgacaaaaagggatttgatttggcttgatgataatggaatgtttttgggtgtgcacccta

SEQ ID NO: 102769 - DNA, 75 bp, Artificial Sequence
  Synthetic
tacaacaatgatggaaaattgttctgatttagatgttgttttcactacttgtcctaaagatgaactgagaccttt

SEQ ID NO: 102770 - DNA, 75 bp, Artificial Sequence
  Synthetic
caacagtttctacagagcagaatgttcctgatccccaagttggcataacaaccatgagggatttaaaagggaaag

SEQ ID NO: 102771 - DNA, 75 bp, Artificial Sequence
  Synthetic
tggatgtttcaggagtgcaagcacctgtgggagctattacaacaattgaggatccagttttagcaaagaaagtac

SEQ ID NO: 102772 - DNA, 75 bp, Artificial Sequence
  Synthetic
gcctcaactgaagccagtttcagaattgacttttctcaaaagatcttttaatttggtggaggatagaattaggcc

SEQ ID NO: 102773 - DNA, 75 bp, Artificial Sequence
  Synthetic
tggtgaatctgtcaaattatgaagatgcaagagcaaagatgtcttttgctttggatcaggaagattggaaatctg

SEQ ID NO: 102774 - DNA, 75 bp, Artificial Sequence
  Synthetic
cgccgtttgcctaggctataggctaaatttccctttccctgtcctttccctatttccctttgttttgtttgtaaa

SEQ ID NO: 102775 - DNA, 75 bp, Artificial Sequence
  Synthetic
attatacaattttgtgtagaatgtattggggccctgctattagttattttcacttgaaccctggatttcatactg

SEQ ID NO: 102776 - DNA, 75 bp, Artificial Sequence
  Synthetic
taatttgttccagctatatagaggtccattagacttgacaattataattactggagctacagatgtggatggaat

SEQ ID NO: 102777 - DNA, 75 bp, Artificial Sequence
  Synthetic
tggaggttgggaaacaaagactcaaatatgctcaggaagagttgtcaaatgaagtgcttccacctcctaggaaaa

SEQ ID NO: 102778 - DNA, 75 bp, Artificial Sequence
  Synthetic
attagagaagctggaagaatactgactgagatgtctggagcacccaatcattttggggaagctctgataaataca

SEQ ID NO: 102779 - DNA, 75 bp, Artificial Sequence
  Synthetic
tcaaacaataaagagtacacatttccaataactctgtcttcgacttctaatcctcctcatggtttaccatcaaca

SEQ ID NO: 102780 - DNA, 75 bp, Artificial Sequence
  Synthetic
gcctaggctataggctaaatttccctttcccctttccctttattgctgtagatattaattcctgcaggttcaggt

SEQ ID NO: 102781 - DNA, 75 bp, Artificial Sequence
  Synthetic
ctgagatgtctggagcacccaatcattttggggaagctctgataaatacaatcatctattctaaacatttgctct

SEQ ID NO: 102782 - DNA, 75 bp, Artificial Sequence
  Synthetic
ttgagatggatgctggagttcttactggaaggttggtcagattgaatgatgagaaatggacagaaatgaaagatg

SEQ ID NO: 102783 - DNA, 75 bp, Artificial Sequence
  Synthetic
ttcaatgccttctgggtctccatgcactgctttattaaattcaattattaataatgtcaacttgtattacgtttt

SEQ ID NO: 102784 - DNA, 75 bp, Artificial Sequence
  Synthetic
gacaattataatcacaggagccactgatgtggatggtatggcctggtttactccagtgggccttgctgtcgacac

SEQ ID NO: 102785 - DNA, 75 bp, Artificial Sequence
  Synthetic
ttccaaaatttttaaaaagtcccccgttttcttttgtgatgccataagaattctttgttatggggatgatgttct

SEQ ID NO: 102786 - DNA, 75 bp, Artificial Sequence
  Synthetic
ttggagctgttagatttaatacaagaagaacagggaacattcagattagattgccatggtattcttatttgtatg

SEQ ID NO: 102787 - DNA, 75 bp, Artificial Sequence
  Synthetic
attgacaatctggactctatcggacaacgtattgttgatgagtttaggaagttaggaatgacagctacatcagct

SEQ ID NO: 102788 - DNA, 75 bp, Artificial Sequence
  Synthetic
aacgtattgttgatgagtttaggaagttaggaatgacagctacatcagctaataagtctgttccccaattgaaac

SEQ ID NO: 102789 - DNA, 75 bp, Artificial Sequence
  Synthetic
aagatcttttaatttggttgatgatagaatcaggcctgccattgctgagaaaaccatatggtcactggttgcctg

SEQ ID NO: 102790 - DNA, 75 bp, Artificial Sequence
  Synthetic
agaatcaggcctgccattgctgagaaaaccatatggtcactggttgcctggcaaagaagcaatgctgaatttgaa

SEQ ID NO: 102791 - DNA, 75 bp, Artificial Sequence
  Synthetic
tggagatgattctggaggtttttcaacaacagtttctacagaacagaatgttccagatccccaagttggtataac

SEQ ID NO: 102792 - DNA, 75 bp, Artificial Sequence
  Synthetic
tgctgattggcttactacacatgctctttttcatgaagttgcaaaattggatgtggtgaaattattgtataatga

SEQ ID NO: 102793 - DNA, 75 bp, Artificial Sequence
  Synthetic
gtttttaattggcaaatggactccagaatgatggagctgagaactcagagcttttccaattggttaagagacatt

SEQ ID NO: 102794 - DNA, 75 bp, Artificial Sequence
  Synthetic
gtgcttccacctcctaggaaaatgaaggggatattttcacaagccaaaatttctcttttttatactgaggagcat

SEQ ID NO: 102795 - DNA, 75 bp, Artificial Sequence
  Synthetic
gatttgtttaaacaaatcttcttaaaatttctgaggtttgtttattttattgttcagtaaataaaaaaaaaaaaa

SEQ ID NO: 102796 - DNA, 75 bp, Artificial Sequence
  Synthetic
tggatttctgacacaccctatcgggtgaataggtacacgaagtcagcacatcaaaaaggtgagtatactgctatt

SEQ ID NO: 102797 - DNA, 75 bp, Artificial Sequence
  Synthetic
taaagataaccaacaaaaaatagagaaagccattgaggaagccgataaattttgcattttgcaaatccaagatgt

SEQ ID NO: 102798 - DNA, 75 bp, Artificial Sequence
  Synthetic
tcggcaaaaaatagaaaaagccattgaagaggcagacaatctttgcattttgcaaattcaagatgtagagaaatt

SEQ ID NO: 102799 - DNA, 75 bp, Artificial Sequence
  Synthetic
ggtttacagatttggagttgcatgggttaactcctctttctacacagatgatgagaaatgaatttagagttagta

SEQ ID NO: 102800 - DNA, 75 bp, Artificial Sequence
  Synthetic
gcaaaagagggggaggaaagagtttgacttcaattgcattggcaaccaaaatttgtaaacattatggtgttgaac

SEQ ID NO: 102801 - DNA, 75 bp, Artificial Sequence
  Synthetic
atttgtaaacattatggtgttgaacctgagaaaaatatttacactaaacctgtggcctcagattattgggatggt

SEQ ID NO: 102802 - DNA, 75 bp, Artificial Sequence
  Synthetic
ttcagattcggttgggcaacaaattaaagttattccagtggacccatattttttccagatgacaaatactaatcc

SEQ ID NO: 102803 - DNA, 75 bp, Artificial Sequence
  Synthetic
tacaaaattgaaggatttttatgatgtaaactatggcaagaagaaggacgttcttaatattcttaaagataacca

SEQ ID NO: 102804 - DNA, 75 bp, Artificial Sequence
  Synthetic
gggacttgatacctcaccgccgtttgcctaggctataggctaaattttccctttcccttttccctttcctattcc

SEQ ID NO: 102805 - DNA, 75 bp, Artificial Sequence
  Synthetic
ctctgattcagttgggcagcagatcaaggttattccagttgatccatattttttccagatgactaacacaaatcc

SEQ ID NO: 102806 - DNA, 75 bp, Artificial Sequence
  Synthetic
ctttgttttgcttgtaaatattgatttgtaaatattgattcctgcaggttcagggttcttaaatctgtttctcta

SEQ ID NO: 102807 - DNA, 75 bp, Artificial Sequence
  Synthetic
tcttggatctataaatcaggccatggtaacaagatgtgagccagttgtttgctatttgtatggcaaaagaggggg

SEQ ID NO: 102808 - DNA, 75 bp, Artificial Sequence
  Synthetic
gatcatatgtctatttataaattcatgggaaggtctcattttctgtgtacttttacttttaactcaaataataaa

SEQ ID NO: 102809 - DNA, 75 bp, Artificial Sequence
  Synthetic
aaatgattcagtctgtggatcgtaccgcagttactggggcttcatattttacttctgtggatcaatcttctgttc

SEQ ID NO: 102810 - DNA, 75 bp, Artificial Sequence
  Synthetic
atggtgttgaacctgagaaaaatatttacaccaaacctgtggcctcagattattgggatggatatagtggacaat

SEQ ID NO: 102811 - DNA, 75 bp, Artificial Sequence
  Synthetic
tgaagattggtcagatttttgtcaattagtgtcaggatgtccaatgagattgaatatggcttctcttgaggagaa

SEQ ID NO: 102812 - DNA, 75 bp, Artificial Sequence
  Synthetic
tgacttctccctccaatgtggcttctcatgttagagttaatgtttatctctcagctattaatctagaatgttttg

SEQ ID NO: 102813 - DNA, 75 bp, Artificial Sequence
  Synthetic
aaaacaaatgatgcaattaaggacatgtcttgtgttgatttaataatggatggacataatatttcattgatggat

SEQ ID NO: 102814 - DNA, 75 bp, Artificial Sequence
  Synthetic
caatctttggatgtgggattccaggatgttgttctgatgaaggttcctacaattcctaagtttagagatattact

SEQ ID NO: 102815 - DNA, 75 bp, Artificial Sequence
  Synthetic
atggcctggttcactccagtaggccttgctgtcgacaccccttgggtggaaaaggagtcagctttgtctattgat

SEQ ID NO: 102816 - DNA, 75 bp, Artificial Sequence
  Synthetic
ggaatttcagatgatgacaatgatagtgcagtagctgagtttttccagtcttttccatctggtgaaccatcaaat

SEQ ID NO: 102817 - DNA, 75 bp, Artificial Sequence
  Synthetic
caaaacagaatgttccagaccctcaagttggtattacaacagtgaaggatcttaaaggtagagcaaaccaaggga

SEQ ID NO: 102818 - DNA, 75 bp, Artificial Sequence
  Synthetic
ttttccatctggtgaaccatcaaattccaaattatctagttttttccaatctgtcactaatcacaagtgggttgc

SEQ ID NO: 102819 - DNA, 75 bp, Artificial Sequence
  Synthetic
tcctgtgggagctatcactaccattgaagatccagttttagcaaagaaagtgcctgaaaccttcccagaattaaa

SEQ ID NO: 102820 - DNA, 75 bp, Artificial Sequence
  Synthetic
ttagatgtgggatttcaagatgttgttttaatgaaggttcctacaattccaaagtttagagacattactcagcat

SEQ ID NO: 102821 - DNA, 75 bp, Artificial Sequence
  Synthetic
gcctggagagtcaagacatacttctgatcatatgtctatttataaatttatgggcagatctcatttcttgtgtac

SEQ ID NO: 102822 - DNA, 75 bp, Artificial Sequence
  Synthetic
attcagattgcaaattacaatcattctgatgaatatttgtcttttagttgctatttgtctgtcacagaacaatca

SEQ ID NO: 102823 - DNA, 75 bp, Artificial Sequence
  Synthetic
tcataagaagaatgatggtactacagttgacttgactgtagatcaggcatggagaggaaaaggtgagggtcttcc

SEQ ID NO: 102824 - DNA, 75 bp, Artificial Sequence
  Synthetic
ccttagtgatgacagttgaaattaggaaacagaatatgagtgaatccatggagttgtggtctcagggaatttcag

SEQ ID NO: 102825 - DNA, 75 bp, Artificial Sequence
  Synthetic
ggggattgatctgtgctatggttcctggtgaccagagctatggttctatagcatcattgactgtttatcctcatg

SEQ ID NO: 102826 - DNA, 75 bp, Artificial Sequence
  Synthetic
cattcagattaggttgccctggtactcctatctttatgctgtctcaggggcactggatgggcttggagacaaaac

SEQ ID NO: 102827 - DNA, 75 bp, Artificial Sequence
  Synthetic
ttacttgtctgtgactgaacagtctgagttttattttcctagagcacctttgaataccaatgctatgatgtcatc

SEQ ID NO: 102828 - DNA, 75 bp, Artificial Sequence
  Synthetic
attttactacttggacatctattccaactttggctgctcagtttccatttaatgcttcagactcagttggtcaac

SEQ ID NO: 102829 - DNA, 75 bp, Artificial Sequence
  Synthetic
gtatgctcaggaagaattgtcaaatgaagtgctgcctcctcctcgtaaaattaagggtgtgttttcacaagcaaa

SEQ ID NO: 102830 - DNA, 75 bp, Artificial Sequence
  Synthetic
gaagtgctgcctcctcctcgtaaaattaagggtgtgttttcacaagcaaaaatctcattattctacacagaagat

SEQ ID NO: 102831 - DNA, 75 bp, Artificial Sequence
  Synthetic
gatgatgataatgcagtagctgagtttttccagtcttttccatctggtgaaccatcgaactctaaattatctggc

SEQ ID NO: 102832 - DNA, 75 bp, Artificial Sequence
  Synthetic
ataagatttggagatgttggtcttgacttggatttttctgcctttgatgctagtcttagtccatttatgattaga

SEQ ID NO: 102833 - DNA, 75 bp, Artificial Sequence
  Synthetic
tgtcatcaacctctaatcctcctcatggattgccttcaaccctgagatggttttttaatctttttcagctttata

SEQ ID NO: 102834 - DNA, 75 bp, Artificial Sequence
  Synthetic
tattctaaacatttgctgtacaattgttgttatcacgtttatggttcaatgccttctgggtctccttgcacagct

SEQ ID NO: 102835 - DNA, 75 bp, Artificial Sequence
  Synthetic
tctccaaaacgctttttagaaagagtcccattcatcaccacattgataaaaccatgattaattttcctgcagcta

SEQ ID NO: 102836 - DNA, 75 bp, Artificial Sequence
  Synthetic
aaggagtgggattgattggtgagtgtcgagcttttctagattccataactagtaccttaaagtcaatgatgtttg

SEQ ID NO: 102837 - DNA, 75 bp, Artificial Sequence
  Synthetic
aagatctttcaatttggtagaggatagaattagacctgcaatttcggaaaaaacaatttggtctttaatagcatg

SEQ ID NO: 102838 - DNA, 75 bp, Artificial Sequence
  Synthetic
tttcaatttggtggaggatagaattagacctgcaatttcagaaaagacaatttggtctttgatagcttggcagag

SEQ ID NO: 102839 - DNA, 75 bp, Artificial Sequence
  Synthetic
agtgttttcaaaaatgttagaaactgtttttaattggcagatggattcgagaatgatggagcttagaactcagag

SEQ ID NO: 102840 - DNA, 75 bp, Artificial Sequence
  Synthetic
tgttcaggtataacaatttttaaaagttttaaggatgcaatttattggctttatacaaaaatcagagaatattat

SEQ ID NO: 102841 - DNA, 75 bp, Artificial Sequence
  Synthetic
atagacttaaatcttatgattggtggagaatgagattttatgaccagtgtttcatttgtgacctttcatgatttg

SEQ ID NO: 102842 - DNA, 75 bp, Artificial Sequence
  Synthetic
ttggggtccagctattagttattttcatttgaatccagggtttcacacaggtgttgctattggcatagatcctga

SEQ ID NO: 102843 - DNA, 75 bp, Artificial Sequence
  Synthetic
ccgccgtttgcctaggctataggctaaatttcccttccctgtccttcccctatttccctttgttttgcttgtaaa

SEQ ID NO: 102844 - DNA, 75 bp, Artificial Sequence
  Synthetic
gaggggacttgatacctcaccgccgtttgcctaggctataggctaaacttccctttcccctttccctttattgtt

SEQ ID NO: 102845 - DNA, 75 bp, Artificial Sequence
  Synthetic
atgtgattcaacaattaaatcaagaggaacattcccatataattggtctgttgagagtgatgaattatgctgata

SEQ ID NO: 102846 - DNA, 75 bp, Artificial Sequence
  Synthetic
catggagctgtaggagtctaaattggggacacagatgttgggaacgtcaccttgcagtgttaacttggctttcat

SEQ ID NO: 102847 - DNA, 75 bp, Artificial Sequence
  Synthetic
gatagttttttccagagatgttcaaattgataatcttgacttgattggacagaaaattgtggatgagttcaaaaa

SEQ ID NO: 102848 - DNA, 75 bp, Artificial Sequence
  Synthetic
atactgtcatgatggaaaattgttctgatttggatgttgtttttacaacttgtccaaaagatgaattgagaccat

SEQ ID NO: 102849 - DNA, 75 bp, Artificial Sequence
  Synthetic
ctgcatttcaaagttgaggtgaaacctgcctcatttttcaagaatcctcataatgatatgttaaatgtcaatctg

SEQ ID NO: 102850 - DNA, 75 bp, Artificial Sequence
  Synthetic
agatccagtagagtctcagtcaactttagaaatagcaggattagttaggaaaaatttggttcagtttggagttgg

SEQ ID NO: 102851 - DNA, 75 bp, Artificial Sequence
  Synthetic
atgattcagtccgttgataggactgcagtgactggtgcttcttattttacttctgtggaccaatcttcagttcat

SEQ ID NO: 102852 - DNA, 75 bp, Artificial Sequence
  Synthetic
tggtattcttatttgtatgccgtgtctggagcactggatggcttgggagataagacagattctacatttggattg

SEQ ID NO: 102853 - DNA, 75 bp, Artificial Sequence
  Synthetic
gtcagaatttatggaactttggtcacagggattatcagatgatgacaatgatagtgcagttgctgaatttttcca

SEQ ID NO: 102854 - DNA, 75 bp, Artificial Sequence
  Synthetic
ggcagttactggggcttcatatttcacttctgtggatcaatcttctgttcatacagctgaagttggctcacacca

SEQ ID NO: 102855 - DNA, 75 bp, Artificial Sequence
  Synthetic
acttctgtggatcaatcttctgttcatacagctgaagttggctcacaccaacctgaacctttgaaaacctctgtt

SEQ ID NO: 102856 - DNA, 75 bp, Artificial Sequence
  Synthetic
gctttgtttcatgaagttgcaaaattggatgtggtcaaactgttgtataatgagcaatttgcagttcagggtctg

SEQ ID NO: 102857 - DNA, 75 bp, Artificial Sequence
  Synthetic
gtttggatttcatcattctgtgactgttgaaattataaacactgtgctctgttttgttaagagtggaattttgct

SEQ ID NO: 102858 - DNA, 75 bp, Artificial Sequence
  Synthetic
ggcagagaagtaacgctgagtttgagcagaatttagaaaatgctcagtggtttgcttttatgcatggctatgagt

SEQ ID NO: 102859 - DNA, 75 bp, Artificial Sequence
  Synthetic
ctagatttactgatttggaactccatggactaacacctctgtccacacagatgatgagaaatgaatttagagtca

SEQ ID NO: 102860 - DNA, 75 bp, Artificial Sequence
  Synthetic
cagttagttgatgactttctagatcttgatatggccattacaggggctccaggcattgatgctattaatatggat

SEQ ID NO: 102861 - DNA, 75 bp, Artificial Sequence
  Synthetic
ggagaggtaaaggagaaggtcttccagggatgtgtggtggggccttgatttcttccaatcagtccattcagaatg

SEQ ID NO: 102862 - DNA, 75 bp, Artificial Sequence
  Synthetic
aagaaaaattgaccaaaagagatttaatttggttggatgaaaatggtttgctgctaggagttcatccaagattgg

SEQ ID NO: 102863 - DNA, 75 bp, Artificial Sequence
  Synthetic
acctgatacctcaccgccgtttgcctaggctttaggctatttttccctttccctttcccctgttttgtgtaaata

SEQ ID NO: 102864 - DNA, 75 bp, Artificial Sequence
  Synthetic
atcaaggttattccagttgatccatatttcttccaaatgactaacacaaatcctgaacaaaaatgtataactgca

SEQ ID NO: 102865 - DNA, 75 bp, Artificial Sequence
  Synthetic
atttcttccaaatgactaacacaaatcctgaacaaaaatgtataactgcattggcttcaatatgtcaaatgtttt

SEQ ID NO: 102866 - DNA, 75 bp, Artificial Sequence
  Synthetic
ccctcttggaagtccactgtgagggacctgatacctcaccgccgtttgcctaggctttaggctatttttcccttt

SEQ ID NO: 102867 - DNA, 75 bp, Artificial Sequence
  Synthetic
atggtttgttgaattgtaatattaacaatgtggtcagaattaaggttccttttatttacacaagaggagcttatc

SEQ ID NO: 102868 - DNA, 75 bp, Artificial Sequence
  Synthetic
catcattgatgatattggccaaaacacaacagatgaggactggtcagatttttgtcagttagtgtcaggatgtcc

SEQ ID NO: 102869 - DNA, 75 bp, Artificial Sequence
  Synthetic
tctcttcctattgttgatgagccagatgattataaagatgtttctgtctttttccaaaataaaattttgggtaag

SEQ ID NO: 102870 - DNA, 75 bp, Artificial Sequence
  Synthetic
agatttgatttggcttgatgataatggaatgtttttgggtctgcatcccaggctggctcaaagaattttatttaa

SEQ ID NO: 102871 - DNA, 75 bp, Artificial Sequence
  Synthetic
aagttgattgtttattgttacaacagactaacttctccctccaatgtggcttctcatgttagagttaatgtttat

SEQ ID NO: 102872 - DNA, 75 bp, Artificial Sequence
  Synthetic
agggctgtctctaggcttaatctcagacctctctgtgcttagggcaaacactacttggccttaaatgggattctg

SEQ ID NO: 102873 - DNA, 75 bp, Artificial Sequence
  Synthetic
ctggacttttctttggggccttaggtagagtttgcctctgaggtactcaggggcatttaggtttttcctcatttt

SEQ ID NO: 102874 - DNA, 75 bp, Artificial Sequence
  Synthetic
ataatggatggacataatgtttcattgatggatttgctcagttctttagtcatgacagttgatattagaaaacaa

SEQ ID NO: 102875 - DNA, 75 bp, Artificial Sequence
  Synthetic
tatataactatgaatatgtctagacagggtattttccaaactgttgggagtggtcttgaccacatcctgtctttg

SEQ ID NO: 102876 - DNA, 75 bp, Artificial Sequence
  Synthetic
gatcttaaaggtagagcaaaccaagggaaaatggatatttcaggtgtccaagctcctgtgggagctattactacc

SEQ ID NO: 102877 - DNA, 75 bp, Artificial Sequence
  Synthetic
ttcaatcagttgatagaactgctgtgactggtgcttcttattttacatctgttgatcagtcttcagttcatactg

SEQ ID NO: 102878 - DNA, 75 bp, Artificial Sequence
  Synthetic
gactggtgcttcttattttacatctgttgatcagtcttcagttcatactgcagaggttggttcacatcaagttga

SEQ ID NO: 102879 - DNA, 75 bp, Artificial Sequence
  Synthetic
cctggctcaaagaagacacaaggagaaaaatttttcctgattcattctgcggactggttaacgacacatgccttg

SEQ ID NO: 102880 - DNA, 75 bp, Artificial Sequence
  Synthetic
tagatttggatttttctgcttttgacgctagtttgagcccattcatgataagggaagctggaagaatactcactg

SEQ ID NO: 102881 - DNA, 75 bp, Artificial Sequence
  Synthetic
cgctagtttgagcccattcatgataagggaagctggaagaatactcactgaaatgtctggagcccctgttcactt

SEQ ID NO: 102882 - DNA, 75 bp, Artificial Sequence
  Synthetic
aaaaatttttcctgattcattctgcggactggttaacgacacatgccttgtttcatgaggtagcaaaattggatg

SEQ ID NO: 102883 - DNA, 75 bp, Artificial Sequence
  Synthetic
gtttgctgtccagggtttactgagatatcatacatatgcaagatttggcattgagattcaagttcaaataaatcc

SEQ ID NO: 102884 - DNA, 75 bp, Artificial Sequence
  Synthetic
tatcatacatatgcaagatttggcattgagattcaagttcaaataaatcccactccttttcagcaaggaggactg

SEQ ID NO: 102885 - DNA, 75 bp, Artificial Sequence
  Synthetic
ttcaagaggggtctccgggtttttccggagcccctcttgggagtccatggtgaggggacttgatacctcaccgcc

SEQ ID NO: 102886 - DNA, 75 bp, Artificial Sequence
  Synthetic
tgagaaggagtctgctctttccattgattacaagacagctcttggtgctgttaggtttaataccagaagaacagg

SEQ ID NO: 102887 - DNA, 75 bp, Artificial Sequence
  Synthetic
gagctatcacaacaattgaggatccagttttagcaaagaaagtacctgagacatttcctgaattgaaacctggag

SEQ ID NO: 102888 - DNA, 75 bp, Artificial Sequence
  Synthetic
agagttatggctctattgcttctttgactgtttatccccatggcttgctgaattgtaacatcaataatgtggtga

SEQ ID NO: 102889 - DNA, 75 bp, Artificial Sequence
  Synthetic
gactgtttatccccatggcttgctgaattgtaacatcaataatgtggtgagaataaaggtgccatttatttacac

SEQ ID NO: 102890 - DNA, 75 bp, Artificial Sequence
  Synthetic
ccacaatatcctgtttgggagttgacaattagagtttggtctgaattgaatattgggacaggaacctcagcttat

SEQ ID NO: 102891 - DNA, 75 bp, Artificial Sequence
  Synthetic
tgaaggatctcaaaggtagagcaaatcaagggaaaatggatatctcgggtgtccaagctcctgtgggagccatca

SEQ ID NO: 102892 - DNA, 75 bp, Artificial Sequence
  Synthetic
agctggagatttggagtcatcagtagatgatcctagatcagaggaggacagaagatttgagagtcatatagaatg

SEQ ID NO: 102893 - DNA, 75 bp, Artificial Sequence
  Synthetic
gatgatcctagatcagaggaggacagaagatttgagagtcatatagaatgtaggaaaccatacaaagaattgaga

SEQ ID NO: 102894 - DNA, 75 bp, Artificial Sequence
  Synthetic
caattagagtttggtctgaattgaatattgggacaggaacctcagcttatacttctcttaatgttctggcaagat

SEQ ID NO: 102895 - DNA, 75 bp, Artificial Sequence
  Synthetic
gactcctttatccacacaaatgatgagaaatgaatttagagtcagcactacagaaaatgtggtgaatttatctaa

SEQ ID NO: 102896 - DNA, 75 bp, Artificial Sequence
  Synthetic
agaaatgaatttagagtcagcactacagaaaatgtggtgaatttatctaattatgaggatgccagagccaaaatg

SEQ ID NO: 102897 - DNA, 75 bp, Artificial Sequence
  Synthetic
ggaagtctgatccttctcagggtgggagaattaagataacccattttacaacttggacatctattccaaccctgg

SEQ ID NO: 102898 - DNA, 75 bp, Artificial Sequence
  Synthetic
gagaattaagataacccattttacaacttggacatctattccaaccctggcggcacagtttccatttaatgcttc

SEQ ID NO: 102899 - DNA, 75 bp, Artificial Sequence
  Synthetic
aatgaagtgttgcctcctcctcgtaaaattaagggtatattttcacaagcaaaaatctcattgttctacacagaa

SEQ ID NO: 102900 - DNA, 75 bp, Artificial Sequence
  Synthetic
gtcattccagttgacccttattttttccaaatgacaaattcaaatcctgatcaaaaatgtataactgctttggct

SEQ ID NO: 102901 - DNA, 75 bp, Artificial Sequence
  Synthetic
aattggttactcaagaaatgttccaaaatattgataagaaaattgaaagtcagagaattatgaaagtggagttta

SEQ ID NO: 102902 - DNA, 75 bp, Artificial Sequence
  Synthetic
tccaaatgacaaattcaaatcctgatcaaaaatgtataactgctttggcttctatctgtcaaatgttttgctttt

SEQ ID NO: 102903 - DNA, 75 bp, Artificial Sequence
  Synthetic
aattcacaagcaacaaatattggtccaaagtgaactttccacatggaatgttggaccttgaagaaattgctgcca

SEQ ID NO: 102904 - DNA, 75 bp, Artificial Sequence
  Synthetic
tcaggttttccctacaaagtatcattctggtaggttgttgttttgttttgtgcctggtaatgagttaattgatgt

SEQ ID NO: 102905 - DNA, 75 bp, Artificial Sequence
  Synthetic
tgctgttagatttaataccagaagaacagggaacatccagattagggtgccctgggcctcctatccttatgctgt

SEQ ID NO: 102906 - DNA, 75 bp, Artificial Sequence
  Synthetic
tctggtaggttgttgttttgttttgtgcctggtaatgagttaattgatgtttctgggattaccttaaaacaggct

SEQ ID NO: 102907 - DNA, 75 bp, Artificial Sequence
  Synthetic
tgattcctgcaggttcagggttctttaatcatgtttccctataagaacactcaattttcacgctttctgtcttct

SEQ ID NO: 102908 - DNA, 75 bp, Artificial Sequence
  Synthetic
acatcacaggagtacagtccaccttgagatttcgtgttccctggatttctgacacaccttatagagtgaacagat

SEQ ID NO: 102909 - DNA, 75 bp, Artificial Sequence
  Synthetic
gagatttcgtgttccctggatttctgacacaccttatagagtgaacagatatacgaaatctgcacaccagaaagg

SEQ ID NO: 102910 - DNA, 75 bp, Artificial Sequence
  Synthetic
tgcattggctgaatcccaaaaagataaacttggcagacagaatgttgggtctatcaggaatacaggagataaaag

SEQ ID NO: 102911 - DNA, 75 bp, Artificial Sequence
  Synthetic
attgtttattgttataatagattgacttccccatccaatgtggcttcacatgttagagttaatgtttacctttct

SEQ ID NO: 102912 - DNA, 75 bp, Artificial Sequence
  Synthetic
cttccccatccaatgtggcttcacatgttagagttaatgtttacctttctgcaatcaatttggagtgttttgcac

SEQ ID NO: 102913 - DNA, 75 bp, Artificial Sequence
  Synthetic
aaacttggcagacagaatgttgggtctatcaggaatacaggagataaaagaaaaaggggtgggtttgattggcga

SEQ ID NO: 102914 - DNA, 75 bp, Artificial Sequence
  Synthetic
actagtaccttaaagtcaatgatgtttggttttcatcattctgtcacagttgaaatcattaatactgttttatgt

SEQ ID NO: 102915 - DNA, 75 bp, Artificial Sequence
  Synthetic
aacgcaggttggagatgattcaggaggattttctactacagtttcaacagaacagaatgtccctgatccacaggt

SEQ ID NO: 102916 - DNA, 75 bp, Artificial Sequence
  Synthetic
ggattttctactacagtttcaacagaacagaatgtccctgatccacaggttggcataacaacgatgagagatttg

SEQ ID NO: 102917 - DNA, 75 bp, Artificial Sequence
  Synthetic
cagggctgtctctaggtttaatctcaagacctctctgtgcttagggcaaacaccatttggccttaaatgggatcc

SEQ ID NO: 102918 - DNA, 75 bp, Artificial Sequence
  Synthetic
tggatgtttcaggagtacaggcccctgtgggtgcaattacaaccatagaagatcctgttctggctaagaaagtgc

SEQ ID NO: 102919 - DNA, 75 bp, Artificial Sequence
  Synthetic
ttgggtgttctgtcatttcatgtggtaaagtgttttcaaaaatgttagaaactgtttttaattggcagatggatt

SEQ ID NO: 102920 - DNA, 75 bp, Artificial Sequence
  Synthetic
ttgagagtgatgaattatgctgacattgggtgttctgtcatttcatgtggtaaagtgttttcaaaaatgttagaa

SEQ ID NO: 102921 - DNA, 75 bp, Artificial Sequence
  Synthetic
tgtgggtgcaattacaaccatagaagatcctgttctggctaagaaagtgcctgaaacttttccagaactgaaacc

SEQ ID NO: 102922 - DNA, 75 bp, Artificial Sequence
  Synthetic
tttgtgtttcttgctgcattggttaaatccaaagaaaattaatttagcagatagaatgcttggattgtctggagt

SEQ ID NO: 102923 - DNA, 75 bp, Artificial Sequence
  Synthetic
catatgtctatttacaaattcatggggagatctcattttctgtgtacatttacttttaattcaaataacaaggag

SEQ ID NO: 102924 - DNA, 75 bp, Artificial Sequence
  Synthetic
ggagatctcattttctgtgtacatttacttttaattcaaataacaaggagtatacattcccaattactttgtctt

SEQ ID NO: 102925 - DNA, 75 bp, Artificial Sequence
  Synthetic
gccatcaacattaagatggtttttcaatttgtttcagttatatagaggtccattagacttgacaatcataataac

SEQ ID NO: 102926 - DNA, 75 bp, Artificial Sequence
  Synthetic
ggcacagctcttatcaatactatcatttattccaagcatttgctgtataactgttgttaccatgtctgtggttca

SEQ ID NO: 102927 - DNA, 75 bp, Artificial Sequence
  Synthetic
aatttgtttcagttatatagaggtccattagacttgacaatcataataactggagctactgatgtggatgggatg

SEQ ID NO: 102928 - DNA, 75 bp, Artificial Sequence
  Synthetic
ctgttgacacaccttgggtggagaaggaatcagcattgtcaatagattacaaaacagccttaggagctgttaggt

SEQ ID NO: 102929 - DNA, 75 bp, Artificial Sequence
  Synthetic
ggaatcagcattgtcaatagattacaaaacagccttaggagctgttaggttcaacacaagaagaacagggaacat

SEQ ID NO: 102930 - DNA, 75 bp, Artificial Sequence
  Synthetic
aggtttaactgttcatttagcccctcttagagactgtattgctagagttcatcaaaaattaaaaaatttgggttc

SEQ ID NO: 102931 - DNA, 75 bp, Artificial Sequence
  Synthetic
gttatttcatgtgccaaagttttttccaaaatgctggaaacagtctttaattggcaaatggactccagaatgatg

SEQ ID NO: 102932 - DNA, 75 bp, Artificial Sequence
  Synthetic
gatgtttggtttccaccattctgtcacagttgaaattattaatactgttttatgttttgttaaaagtggcatttt

SEQ ID NO: 102933 - DNA, 75 bp, Artificial Sequence
  Synthetic
tacctgtatgctgtttcaggtgcactggatggtttaggagataaaactgactcaacatttggattggtttctatt

SEQ ID NO: 102934 - DNA, 75 bp, Artificial Sequence
  Synthetic
tggatggtttaggagataaaactgactcaacatttggattggtttctattcagattgccaattataaccattctg

SEQ ID NO: 102935 - DNA, 75 bp, Artificial Sequence
  Synthetic
caagaggaacattctcacataattggtctgttgagagtgatgaattatgctgacattgggtgttctgtcatttca

SEQ ID NO: 102936 - DNA, 75 bp, Artificial Sequence
  Synthetic
tctatctgttactgagcagtcagagttttattttccaagggcccccttgaactctaatgctatgctgtccactga

SEQ ID NO: 102937 - DNA, 75 bp, Artificial Sequence
  Synthetic
ttttattttccaagggcccccttgaactctaatgctatgctgtccactgaaactatgatgagcagaattgcagct

SEQ ID NO: 102938 - DNA, 75 bp, Artificial Sequence
  Synthetic
aactgatgaggattggtctgatttctgtcaattggtgtctggatgtccaatgaggttaaatatggcttctttgga

SEQ ID NO: 102939 - DNA, 75 bp, Artificial Sequence
  Synthetic
atcccagatcagaagaagataggagatttgaaagtcatattgagagcagaaaaccatacaaagaattaagacttg

SEQ ID NO: 102940 - DNA, 75 bp, Artificial Sequence
  Synthetic
atttgaaagtcatattgagagcagaaaaccatacaaagaattaagacttgaggttgggaagcagagactaaagta

SEQ ID NO: 102941 - DNA, 75 bp, Artificial Sequence
  Synthetic
ctactgaaaatgttgtaaatttgtcaaattatgaagatgcaagggcaaaaatgtcttttgctttggatcaggaag

SEQ ID NO: 102942 - DNA, 75 bp, Artificial Sequence
  Synthetic
gtgcttccacctcctaggaaaatgaaaggtctgttttcacaggcaaaaatttctttgttttatactgaagatcat

SEQ ID NO: 102943 - DNA, 75 bp, Artificial Sequence
  Synthetic
aggctataggctaaatttccctttccctgttcctttccctatctccctttgttttgcttgtaaatattaattcct

SEQ ID NO: 102944 - DNA, 75 bp, Artificial Sequence
  Synthetic
aaggtctgttttcacaggcaaaaatttctttgttttatactgaagatcatgaaataatgaagttttcatggagag

SEQ ID NO: 102945 - DNA, 75 bp, Artificial Sequence
  Synthetic
tagctgctcagtttccatttaatgcttcagattcagttgggcaacaaattaaagttataccagtggacccatact

SEQ ID NO: 102946 - DNA, 75 bp, Artificial Sequence
  Synthetic
gagaagatttggcttttctctagcagccggcaggagtgtgtggacccttgaaatggatgctggagtgcttactgg

SEQ ID NO: 102947 - DNA, 75 bp, Artificial Sequence
  Synthetic
gccggcaggagtgtgtggacccttgaaatggatgctggagtgcttactggtagattggtcaggttgaatgatgag

SEQ ID NO: 102948 - DNA, 75 bp, Artificial Sequence
  Synthetic
aaattgtttcattggttgaaaaatttacaagtaacaaacattggtctaaagtaaattttccacatggcatgttgg

SEQ ID NO: 102949 - DNA, 75 bp, Artificial Sequence
  Synthetic
tacaagtaacaaacattggtctaaagtaaattttccacatggcatgttggaccttgaagaaattgctgctaattc

SEQ ID NO: 102950 - DNA, 75 bp, Artificial Sequence
  Synthetic
ggttgcagttggggctgctgtgggagtacttggtgttttggttggaggttggtatgtctacaagcattttacaaa

SEQ ID NO: 102951 - DNA, 75 bp, Artificial Sequence
  Synthetic
actgatttgtgttttctgttacattggttgaaccccaagaaaattaatttggctgatagaatgcttggcttgtct

SEQ ID NO: 102952 - DNA, 75 bp, Artificial Sequence
  Synthetic
ggttgaaccccaagaaaattaatttggctgatagaatgcttggcttgtctggtgttcaagaaattaaagaacaag

SEQ ID NO: 102953 - DNA, 75 bp, Artificial Sequence
  Synthetic
aacctttttagattccatagctggcaccttaaagtctatgatgtttgggttccatcattctgttactgttgagat

SEQ ID NO: 102954 - DNA, 75 bp, Artificial Sequence
  Synthetic
tgtgcttagggcaaacaccatttggccttaaatgggatcctgtgagagggggtccctccattgacagctggactg

SEQ ID NO: 102955 - DNA, 75 bp, Artificial Sequence
  Synthetic
accttaaagtctatgatgtttgggttccatcattctgttactgttgagattataaatactgttctttgctttgtt

SEQ ID NO: 102956 - DNA, 75 bp, Artificial Sequence
  Synthetic
tacagcagttgaatcaagatgagcactctcacataataggtcttttgagggtaatgaattatgctgacattggat

SEQ ID NO: 102957 - DNA, 75 bp, Artificial Sequence
  Synthetic
accgtaggctgcattttaaagttgaagtgaaacctgcctcattcttcaaaaatcctcataatgatatgttaaatg

SEQ ID NO: 102958 - DNA, 75 bp, Artificial Sequence
  Synthetic
ctctcacataataggtcttttgagggtaatgaattatgctgacattggatgttcggttatatcctgtggtaaagt

SEQ ID NO: 102959 - DNA, 75 bp, Artificial Sequence
  Synthetic
tgcaggcacctgtgggagctattacaacaattgaggatccagttttagcaaagaaagtacctgagacatttcctg

SEQ ID NO: 102960 - DNA, 75 bp, Artificial Sequence
  Synthetic
tttaattggcagatggactctagaatgatggagctcagaacccaaagtttttctaattggcttagggatatctgt

SEQ ID NO: 102961 - DNA, 75 bp, Artificial Sequence
  Synthetic
gtctgagttttattttcctagggcacctttgaacaccaatgctatgatgtcatctgaaacaatgctagatagaat

SEQ ID NO: 102962 - DNA, 75 bp, Artificial Sequence
  Synthetic
tgatggagctcagaacccaaagtttttctaattggcttagggatatctgttcaggaattacaatttttaaaagtt

SEQ ID NO: 102963 - DNA, 75 bp, Artificial Sequence
  Synthetic
tttggtcccagggattatcagatgatgacaatgatagtgcagttgctgaatttttccaatcttttccctctggtg

SEQ ID NO: 102964 - DNA, 75 bp, Artificial Sequence
  Synthetic
cacaaagttgaaggatttctatgatgtgaattatggtaaaaagaaagatgttcttaatgttcttaaggacaacca

SEQ ID NO: 102965 - DNA, 75 bp, Artificial Sequence
  Synthetic
ctagagctttgaacaggttggcaacacttgtggcaacggttaatgggactccaatgttaatttcagagggacctc

SEQ ID NO: 102966 - DNA, 75 bp, Artificial Sequence
  Synthetic
gtgaattatggtaaaaagaaagatgttcttaatgttcttaaggacaaccagcaaaagattgagagagcaatagaa

SEQ ID NO: 102967 - DNA, 75 bp, Artificial Sequence
  Synthetic
tgttcataaaaagaatgatggaaccaccatagatttgactgttgatcaagcctggagaggtaaaggagaaggtct

SEQ ID NO: 102968 - DNA, 75 bp, Artificial Sequence
  Synthetic
gttcagtttggagttggagagaagaatggatgtgtgagatgggttatgaatgccttgggagtgaaagatgattgg

SEQ ID NO: 102969 - DNA, 75 bp, Artificial Sequence
  Synthetic
agattcaggatgtggaaaaatttgaacagtatcaaaaaggagttgatctaatacaaaaattgagaacagttcact

SEQ ID NO: 102970 - DNA, 75 bp, Artificial Sequence
  Synthetic
ggggttcatttgtcacctcttagagattgtatagctagagtccaccaaaagctcaagaatcttggatctataaac

SEQ ID NO: 102971 - DNA, 75 bp, Artificial Sequence
  Synthetic
acagtatcaaaaaggagttgatctaatacaaaaattgagaacagttcactctatggcccaagttgatcctagctt

SEQ ID NO: 102972 - DNA, 75 bp, Artificial Sequence
  Synthetic
gacaaagccaaaacaagtaattaaactggatgctgatcctgtagagtcacaatcaactttagaaattgctggttt

SEQ ID NO: 102973 - DNA, 75 bp, Artificial Sequence
  Synthetic
gattgcattgctagagtgcatcagaagctcaaaaatcttggttccattaatcaagccatggtgacaagatgtgaa

SEQ ID NO: 102974 - DNA, 75 bp, Artificial Sequence
  Synthetic
ggttcaatagcatccttgactgtttatcctcatggtctgttaaattgcaatattaataatgtagttagaataaag

SEQ ID NO: 102975 - DNA, 75 bp, Artificial Sequence
  Synthetic
agctcaaaaatcttggttccattaatcaagccatggtgacaagatgtgaaccagtggtttgttatttatatggca

SEQ ID NO: 102976 - DNA, 75 bp, Artificial Sequence
  Synthetic
aagtcagagaataatgaaagtggaatttactcagtgttcaatgaatgtggtctccaaaacgctttttagaaagag

SEQ ID NO: 102977 - DNA, 75 bp, Artificial Sequence
  Synthetic
tccagggatgtgtggtggggccttgatttcttctaatcagtccatccagaatgccatattaggaatccacgttgc

SEQ ID NO: 102978 - DNA, 75 bp, Artificial Sequence
  Synthetic
atcaatagcattagcaacaaaaatttgcaaacactatggtgttgagccagagaaaaatatttacaccaagcccgt

SEQ ID NO: 102979 - DNA, 75 bp, Artificial Sequence
  Synthetic
tgcaaacactatggtgttgagccagagaaaaatatttacaccaagcccgttgcttcagattattgggatggatac

SEQ ID NO: 102980 - DNA, 75 bp, Artificial Sequence
  Synthetic
atcaaaataaaatagtaggcaaaactcagttagttgatgactttttagatcttgatatggccattacaggggctc

SEQ ID NO: 102981 - DNA, 75 bp, Artificial Sequence
  Synthetic
caggaacttcagcttacacttcactcaatgttttagctaggtttacagatttggagttgcatggattaactcctc

SEQ ID NO: 102982 - DNA, 75 bp, Artificial Sequence
  Synthetic
atgacataggccaaaataccacagatgaagactggtctgatttttgtcaattggtttcaggatgtccaatgaggc

SEQ ID NO: 102983 - DNA, 75 bp, Artificial Sequence
  Synthetic
tgaagactggtctgatttttgtcaattggtttcaggatgtccaatgaggctgaatatggcatctcttgaagagaa

SEQ ID NO: 102984 - DNA, 75 bp, Artificial Sequence
  Synthetic
gcaacacttgtgacaacagttaatgggactccaatgttaatttcagagggaccccttaaaatggaggagaaggct

SEQ ID NO: 102985 - DNA, 75 bp, Artificial Sequence
  Synthetic
ataattgcaacttcaaattggtcaaatcctagtccgaaaacagtttatgttaaagaagccattgatcgtagactt

SEQ ID NO: 102986 - DNA, 75 bp, Artificial Sequence
  Synthetic
atcctagtccgaaaacagtttatgttaaagaagccattgatcgtagacttcattttaaaattgaagtgaaacctg

SEQ ID NO: 102987 - DNA, 75 bp, Artificial Sequence
  Synthetic
gtccattccaactttagctgctcagtttccatttaatgcttcagattcagttgggcaacaaattaaagttattcc

SEQ ID NO: 102988 - DNA, 75 bp, Artificial Sequence
  Synthetic
tttccatttaatgcttcagattcagttgggcaacaaattaaagttattccagtggacccatattttttccagatg

SEQ ID NO: 102989 - DNA, 75 bp, Artificial Sequence
  Synthetic
ggaatgtttttgggtctgcatcccaggctggctcaaagaattctatttaatacaacaatgatggaaaattgctca

SEQ ID NO: 102990 - DNA, 75 bp, Artificial Sequence
  Synthetic
tgacatgctaaatgtcaatttagctaagacaaatgatgccattaaggatatgtcatgtgttgatttaatcatgga

SEQ ID NO: 102991 - DNA, 75 bp, Artificial Sequence
  Synthetic
aagacaaatgatgccattaaggatatgtcatgtgttgatttaatcatggatggtcataatgtttcattaatggat

SEQ ID NO: 102992 - DNA, 75 bp, Artificial Sequence
  Synthetic
aatcctagtccaaaaacagtttatgtcaaggaggctattgatcgtagactccattttaaaattgaggtgaagcct

SEQ ID NO: 102993 - DNA, 75 bp, Artificial Sequence
  Synthetic
ttgaaattagaaaacaaaatatgactgaatttatggaattatggtctcaaggtatttcagatgatgataatgata

SEQ ID NO: 102994 - DNA, 75 bp, Artificial Sequence
  Synthetic
tgaatttatggaattatggtctcaaggtatttcagatgatgataatgatagtgcagtggcagaatttttccaatc

SEQ ID NO: 102995 - DNA, 75 bp, Artificial Sequence
  Synthetic
gtgttgcaattggaattgatcctgatagacagtgggaccaactttttaaaacaatgattagatttggagatgttg

SEQ ID NO: 102996 - DNA, 75 bp, Artificial Sequence
  Synthetic
tctaaattatccagttttttccagtcagtgactaatcataagtgggtcgctgtgggggctgctgttggtattctt

SEQ ID NO: 102997 - DNA, 75 bp, Artificial Sequence
  Synthetic
cagtgactaatcataagtgggtcgctgtgggggctgctgttggtattcttggtgtgcttgtgggaggatggtttg

SEQ ID NO: 102998 - DNA, 75 bp, Artificial Sequence
  Synthetic
ttgaccaaaagagatttaatttggttggatgaaaatggtttattgctgggagttcatccaagattggctcagaga

SEQ ID NO: 102999 - DNA, 75 bp, Artificial Sequence
  Synthetic
ggaagagccaattcctactgaaggagtgtaccatggtgtaacgaagcccaaacaagtgatcaaactggatgctga

SEQ ID NO: 103000 - DNA, 75 bp, Artificial Sequence
  Synthetic
gctggtggctccagttcagagacacagaaccctgctccgactattgcctctctcacatcatcaatcttcttgaag

SEQ ID NO: 103001 - DNA, 75 bp, Artificial Sequence
  Synthetic
atttacatactctgtggaaggctggcattttatataagagagaaactacacgcagcgcctcattttgtgggtcac

SEQ ID NO: 103002 - DNA, 75 bp, Artificial Sequence
  Synthetic
ggagctacaaaagacagcctcatctctatatcgtgaagtcttaaagtcacctgagcattgctcacctcaccatac

SEQ ID NO: 103003 - DNA, 75 bp, Artificial Sequence
  Synthetic
gattgggacttcaaccccaacaaggatcactggccagaggcaaatcaggtaggagcgggagcattcgggccaggg

SEQ ID NO: 103004 - DNA, 75 bp, Artificial Sequence
  Synthetic
tccagcatccagggatatagtagtcaattatgtcaatactcacatggggctggaaatcaggcaattattgtggct

SEQ ID NO: 103005 - DNA, 75 bp, Artificial Sequence
  Synthetic
cccgatcaccagttggaccctgcattcggagccaactcaaacaatccagattgggacttcaaccccaacaaggat

SEQ ID NO: 103006 - DNA, 75 bp, Artificial Sequence
  Synthetic
tccttcttttccaaatatccatttgcatcaagacattataactaaatgtgaacaatttgtgggccctctcacagt

SEQ ID NO: 103007 - DNA, 75 bp, Artificial Sequence
  Synthetic
gaaactttactgggctttattcttctactgtacctgtctttaatcctgagtggcaaactccttcttttcctgata

SEQ ID NO: 103008 - DNA, 75 bp, Artificial Sequence
  Synthetic
cacgactcctgctcaaggaacctctatgtatccctcctgttgctgtacaaaaccttcggacggaaattgcacctg

SEQ ID NO: 103009 - DNA, 75 bp, Artificial Sequence
  Synthetic
agggccctgtactttcctgctggtggctccagttcaggaacagtgagccctgctcagaatactgtctctgccata

SEQ ID NO: 103010 - DNA, 75 bp, Artificial Sequence
  Synthetic
gtattgggggcaaagtctgtacaacatcttgagaccctttttaccgctgttactaattttcttttgtctttgggt

SEQ ID NO: 103011 - DNA, 75 bp, Artificial Sequence
  Synthetic
gtattgggggcaaagtctgtacaacatcttgagtccctttttaccgctgttactaattttcttttgtctttgggt

SEQ ID NO: 103012 - DNA, 75 bp, Artificial Sequence
  Synthetic
gtattgggggcaaagtctgtacaacatcttgagcccctttttaccgctgttactaattttcttttgtctttgggt

SEQ ID NO: 103013 - DNA, 75 bp, Artificial Sequence
  Synthetic
gtattgggggcaaagtctgtacaacatcttgaggccctttttaccgctgttactaattttcttttgtctttgggt

SEQ ID NO: 103014 - DNA, 75 bp, Artificial Sequence
  Synthetic
gtattgggggctaagtctgtacaacatcttgagaccctttttaccgctgttactaattttcttttgtctttgggt

SEQ ID NO: 103015 - DNA, 75 bp, Artificial Sequence
  Synthetic
gtattgggggctaagtctgtacaacatcttgagtccctttttaccgctgttactaattttcttttgtctttgggt

SEQ ID NO: 103016 - DNA, 75 bp, Artificial Sequence
  Synthetic
gtattgggggctaagtctgtacaacatcttgagcccctttttaccgctgttactaattttcttttgtctttgggt

SEQ ID NO: 103017 - DNA, 75 bp, Artificial Sequence
  Synthetic
gtattgggggctaagtctgtacaacatcttgaggccctttttaccgctgttactaattttcttttgtctttgggt

SEQ ID NO: 103018 - DNA, 75 bp, Artificial Sequence
  Synthetic
gtattgggggccaagtctgtacaacatcttgagaccctttttaccgctgttactaattttcttttgtctttgggt

SEQ ID NO: 103019 - DNA, 75 bp, Artificial Sequence
  Synthetic
gtattgggggccaagtctgtacaacatcttgagtccctttttaccgctgttactaattttcttttgtctttgggt

SEQ ID NO: 103020 - DNA, 75 bp, Artificial Sequence
  Synthetic
gtattgggggccaagtctgtacaacatcttgagcccctttttaccgctgttactaattttcttttgtctttgggt

SEQ ID NO: 103021 - DNA, 75 bp, Artificial Sequence
  Synthetic
gtattgggggccaagtctgtacaacatcttgaggccctttttaccgctgttactaattttcttttgtctttgggt

SEQ ID NO: 103022 - DNA, 75 bp, Artificial Sequence
  Synthetic
gtattgggggcgaagtctgtacaacatcttgagaccctttttaccgctgttactaattttcttttgtctttgggt

SEQ ID NO: 103023 - DNA, 75 bp, Artificial Sequence
  Synthetic
gtattgggggcgaagtctgtacaacatcttgagtccctttttaccgctgttactaattttcttttgtctttgggt

SEQ ID NO: 103024 - DNA, 75 bp, Artificial Sequence
  Synthetic
gtattgggggcgaagtctgtacaacatcttgagcccctttttaccgctgttactaattttcttttgtctttgggt

SEQ ID NO: 103025 - DNA, 75 bp, Artificial Sequence
  Synthetic
gtattgggggcgaagtctgtacaacatcttgaggccctttttaccgctgttactaattttcttttgtctttgggt

SEQ ID NO: 103026 - DNA, 75 bp, Artificial Sequence
  Synthetic
gttttgggggcaaagtctgtacaacatcttgagaccctttttaccgctgttactaattttcttttgtctttgggt

SEQ ID NO: 103027 - DNA, 75 bp, Artificial Sequence
  Synthetic
gttttgggggcaaagtctgtacaacatcttgagtccctttttaccgctgttactaattttcttttgtctttgggt

SEQ ID NO: 103028 - DNA, 75 bp, Artificial Sequence
  Synthetic
gttttgggggcaaagtctgtacaacatcttgagcccctttttaccgctgttactaattttcttttgtctttgggt

SEQ ID NO: 103029 - DNA, 75 bp, Artificial Sequence
  Synthetic
gttttgggggcaaagtctgtacaacatcttgaggccctttttaccgctgttactaattttcttttgtctttgggt

SEQ ID NO: 103030 - DNA, 75 bp, Artificial Sequence
  Synthetic
gttttgggggctaagtctgtacaacatcttgagaccctttttaccgctgttactaattttcttttgtctttgggt

SEQ ID NO: 103031 - DNA, 75 bp, Artificial Sequence
  Synthetic
gttttgggggctaagtctgtacaacatcttgagtccctttttaccgctgttactaattttcttttgtctttgggt

SEQ ID NO: 103032 - DNA, 75 bp, Artificial Sequence
  Synthetic
gttttgggggctaagtctgtacaacatcttgagcccctttttaccgctgttactaattttcttttgtctttgggt

SEQ ID NO: 103033 - DNA, 75 bp, Artificial Sequence
  Synthetic
gttttgggggctaagtctgtacaacatcttgaggccctttttaccgctgttactaattttcttttgtctttgggt

SEQ ID NO: 103034 - DNA, 75 bp, Artificial Sequence
  Synthetic
gttttgggggccaagtctgtacaacatcttgagaccctttttaccgctgttactaattttcttttgtctttgggt

SEQ ID NO: 103035 - DNA, 75 bp, Artificial Sequence
  Synthetic
gttttgggggccaagtctgtacaacatcttgagtccctttttaccgctgttactaattttcttttgtctttgggt

SEQ ID NO: 103036 - DNA, 75 bp, Artificial Sequence
  Synthetic
gttttgggggccaagtctgtacaacatcttgagcccctttttaccgctgttactaattttcttttgtctttgggt

SEQ ID NO: 103037 - DNA, 75 bp, Artificial Sequence
  Synthetic
gttttgggggccaagtctgtacaacatcttgaggccctttttaccgctgttactaattttcttttgtctttgggt

SEQ ID NO: 103038 - DNA, 75 bp, Artificial Sequence
  Synthetic
gttttgggggcgaagtctgtacaacatcttgagaccctttttaccgctgttactaattttcttttgtctttgggt

SEQ ID NO: 103039 - DNA, 75 bp, Artificial Sequence
  Synthetic
gttttgggggcgaagtctgtacaacatcttgagtccctttttaccgctgttactaattttcttttgtctttgggt

SEQ ID NO: 103040 - DNA, 75 bp, Artificial Sequence
  Synthetic
gttttgggggcgaagtctgtacaacatcttgagcccctttttaccgctgttactaattttcttttgtctttgggt

SEQ ID NO: 103041 - DNA, 75 bp, Artificial Sequence
  Synthetic
gttttgggggcgaagtctgtacaacatcttgaggccctttttaccgctgttactaattttcttttgtctttgggt

SEQ ID NO: 103042 - DNA, 75 bp, Artificial Sequence
  Synthetic
gtcttgggggcaaagtctgtacaacatcttgagaccctttttaccgctgttactaattttcttttgtctttgggt

SEQ ID NO: 103043 - DNA, 75 bp, Artificial Sequence
  Synthetic
gtcttgggggcaaagtctgtacaacatcttgagtccctttttaccgctgttactaattttcttttgtctttgggt

SEQ ID NO: 103044 - DNA, 75 bp, Artificial Sequence
  Synthetic
gtcttgggggcaaagtctgtacaacatcttgagcccctttttaccgctgttactaattttcttttgtctttgggt

SEQ ID NO: 103045 - DNA, 75 bp, Artificial Sequence
  Synthetic
gtcttgggggcaaagtctgtacaacatcttgaggccctttttaccgctgttactaattttcttttgtctttgggt

SEQ ID NO: 103046 - DNA, 75 bp, Artificial Sequence
  Synthetic
gtcttgggggctaagtctgtacaacatcttgagaccctttttaccgctgttactaattttcttttgtctttgggt

SEQ ID NO: 103047 - DNA, 75 bp, Artificial Sequence
  Synthetic
gtcttgggggctaagtctgtacaacatcttgagtccctttttaccgctgttactaattttcttttgtctttgggt

SEQ ID NO: 103048 - DNA, 75 bp, Artificial Sequence
  Synthetic
gtcttgggggctaagtctgtacaacatcttgagcccctttttaccgctgttactaattttcttttgtctttgggt

SEQ ID NO: 103049 - DNA, 75 bp, Artificial Sequence
  Synthetic
gtcttgggggctaagtctgtacaacatcttgaggccctttttaccgctgttactaattttcttttgtctttgggt

SEQ ID NO: 103050 - DNA, 75 bp, Artificial Sequence
  Synthetic
gtcttgggggccaagtctgtacaacatcttgagaccctttttaccgctgttactaattttcttttgtctttgggt

SEQ ID NO: 103051 - DNA, 75 bp, Artificial Sequence
  Synthetic
gtcttgggggccaagtctgtacaacatcttgagtccctttttaccgctgttactaattttcttttgtctttgggt

SEQ ID NO: 103052 - DNA, 75 bp, Artificial Sequence
  Synthetic
gtcttgggggccaagtctgtacaacatcttgagcccctttttaccgctgttactaattttcttttgtctttgggt

SEQ ID NO: 103053 - DNA, 75 bp, Artificial Sequence
  Synthetic
gtcttgggggccaagtctgtacaacatcttgaggccctttttaccgctgttactaattttcttttgtctttgggt

SEQ ID NO: 103054 - DNA, 75 bp, Artificial Sequence
  Synthetic
gtcttgggggcgaagtctgtacaacatcttgagaccctttttaccgctgttactaattttcttttgtctttgggt

SEQ ID NO: 103055 - DNA, 75 bp, Artificial Sequence
  Synthetic
gtcttgggggcgaagtctgtacaacatcttgagtccctttttaccgctgttactaattttcttttgtctttgggt

SEQ ID NO: 103056 - DNA, 75 bp, Artificial Sequence
  Synthetic
gtcttgggggcgaagtctgtacaacatcttgagcccctttttaccgctgttactaattttcttttgtctttgggt

SEQ ID NO: 103057 - DNA, 75 bp, Artificial Sequence
  Synthetic
gtcttgggggcgaagtctgtacaacatcttgaggccctttttaccgctgttactaattttcttttgtctttgggt

SEQ ID NO: 103058 - DNA, 75 bp, Artificial Sequence
  Synthetic
gtgttgggggcaaagtctgtacaacatcttgagaccctttttaccgctgttactaattttcttttgtctttgggt

SEQ ID NO: 103059 - DNA, 75 bp, Artificial Sequence
  Synthetic
gtgttgggggcaaagtctgtacaacatcttgagtccctttttaccgctgttactaattttcttttgtctttgggt

SEQ ID NO: 103060 - DNA, 75 bp, Artificial Sequence
  Synthetic
gtgttgggggcaaagtctgtacaacatcttgagcccctttttaccgctgttactaattttcttttgtctttgggt

SEQ ID NO: 103061 - DNA, 75 bp, Artificial Sequence
  Synthetic
gtgttgggggcaaagtctgtacaacatcttgaggccctttttaccgctgttactaattttcttttgtctttgggt

SEQ ID NO: 103062 - DNA, 75 bp, Artificial Sequence
  Synthetic
gtgttgggggctaagtctgtacaacatcttgagaccctttttaccgctgttactaattttcttttgtctttgggt

SEQ ID NO: 103063 - DNA, 75 bp, Artificial Sequence
  Synthetic
gtgttgggggctaagtctgtacaacatcttgagtccctttttaccgctgttactaattttcttttgtctttgggt

SEQ ID NO: 103064 - DNA, 75 bp, Artificial Sequence
  Synthetic
gtgttgggggctaagtctgtacaacatcttgagcccctttttaccgctgttactaattttcttttgtctttgggt

SEQ ID NO: 103065 - DNA, 75 bp, Artificial Sequence
  Synthetic
gtgttgggggctaagtctgtacaacatcttgaggccctttttaccgctgttactaattttcttttgtctttgggt

SEQ ID NO: 103066 - DNA, 75 bp, Artificial Sequence
  Synthetic
gtgttgggggccaagtctgtacaacatcttgagaccctttttaccgctgttactaattttcttttgtctttgggt

SEQ ID NO: 103067 - DNA, 75 bp, Artificial Sequence
  Synthetic
gtgttgggggccaagtctgtacaacatcttgagtccctttttaccgctgttactaattttcttttgtctttgggt

SEQ ID NO: 103068 - DNA, 75 bp, Artificial Sequence
  Synthetic
gtgttgggggccaagtctgtacaacatcttgagcccctttttaccgctgttactaattttcttttgtctttgggt

SEQ ID NO: 103069 - DNA, 75 bp, Artificial Sequence
  Synthetic
gtgttgggggccaagtctgtacaacatcttgaggccctttttaccgctgttactaattttcttttgtctttgggt

SEQ ID NO: 103070 - DNA, 75 bp, Artificial Sequence
  Synthetic
gtgttgggggcgaagtctgtacaacatcttgagaccctttttaccgctgttactaattttcttttgtctttgggt

SEQ ID NO: 103071 - DNA, 75 bp, Artificial Sequence
  Synthetic
gtgttgggggcgaagtctgtacaacatcttgagtccctttttaccgctgttactaattttcttttgtctttgggt

SEQ ID NO: 103072 - DNA, 75 bp, Artificial Sequence
  Synthetic
gtgttgggggcgaagtctgtacaacatcttgagcccctttttaccgctgttactaattttcttttgtctttgggt

SEQ ID NO: 103073 - DNA, 75 bp, Artificial Sequence
  Synthetic
gtgttgggggcgaagtctgtacaacatcttgaggccctttttaccgctgttactaattttcttttgtctttgggt

SEQ ID NO: 103074 - DNA, 75 bp, Artificial Sequence
  Synthetic
atacatttaaaccctaacaaaacaaaaagatggggttactctttacatttcatgggctatgtcattggatgttat

SEQ ID NO: 103075 - DNA, 75 bp, Artificial Sequence
  Synthetic
aatgtggttatcctgctctcatgcctctgtatgcctgtataactgctaaacaggcttttgtcttttcgccaactt

SEQ ID NO: 103076 - DNA, 75 bp, Artificial Sequence
  Synthetic
tatgggcctgaaaattagacaactgttgtggtttcacatttcctgtcttacttttggaagagaaacagttcttga

SEQ ID NO: 103077 - DNA, 75 bp, Artificial Sequence
  Synthetic
gaactcctagccgcttgttttgctcgcagcaggtctggagcaaacattctcgggacggataactctgttgttctc

SEQ ID NO: 103078 - DNA, 75 bp, Artificial Sequence
  Synthetic
ataccgctgttaccaattttcttttgtctttgggtatacatttaaaccctcacaaaacaaaaagatggggatatt

SEQ ID NO: 103079 - DNA, 75 bp, Artificial Sequence
  Synthetic
ctgccgtttcgaccgaccacggggcgcacctctctttacgcggactccccgtctgtgccttctcatctgccggac

SEQ ID NO: 103080 - DNA, 75 bp, Artificial Sequence
  Synthetic
ctccactcagttccaccaggctctgttagatccgagggtaagggctcctgctggtggctccagttcagagacaca

SEQ ID NO: 103081 - DNA, 75 bp, Artificial Sequence
  Synthetic
caaagactgtgtatttaaggactgggaggagctgggggaggagattaggttaatgatctttgtattaggaggctg

SEQ ID NO: 103082 - DNA, 75 bp, Artificial Sequence
  Synthetic
tacataagaggactcttggactctctgtaatgtcaacgaccgaccttgaggcatacttcaaagactgtttgttta

SEQ ID NO: 103083 - DNA, 75 bp, Artificial Sequence
  Synthetic
tggccagaggcaaatcaggtatgagctcccatctctccacctctaagagacagtcatcctcaggccatgcagtgg

SEQ ID NO: 103084 - DNA, 75 bp, Artificial Sequence
  Synthetic
gctgtgccttgggtggctttagggcatggacattgatccttataaagaatttggagcttctgtggagttactctc

SEQ ID NO: 103085 - DNA, 75 bp, Artificial Sequence
  Synthetic
taaagggtctgtactttcctgatggtggctccagatccggggcagtaaaccctgttccgagtactgtctctccca

SEQ ID NO: 103086 - DNA, 75 bp, Artificial Sequence
  Synthetic
taaagggtctgtactttcctgatggtggctccagttccggggcagtaaaccctgttccgagtactgtctctccca

SEQ ID NO: 103087 - DNA, 75 bp, Artificial Sequence
  Synthetic
taaagggtctgtactttcctgatggtggctccagctccggggcagtaaaccctgttccgagtactgtctctccca

SEQ ID NO: 103088 - DNA, 75 bp, Artificial Sequence
  Synthetic
taaagggtctgtactttcctgatggtggctccaggtccggggcagtaaaccctgttccgagtactgtctctccca

SEQ ID NO: 103089 - DNA, 75 bp, Artificial Sequence
  Synthetic
taaagggtctgtactttcctgttggtggctccagatccggggcagtaaaccctgttccgagtactgtctctccca

SEQ ID NO: 103090 - DNA, 75 bp, Artificial Sequence
  Synthetic
taaagggtctgtactttcctgttggtggctccagttccggggcagtaaaccctgttccgagtactgtctctccca

SEQ ID NO: 103091 - DNA, 75 bp, Artificial Sequence
  Synthetic
taaagggtctgtactttcctgttggtggctccagctccggggcagtaaaccctgttccgagtactgtctctccca

SEQ ID NO: 103092 - DNA, 75 bp, Artificial Sequence
  Synthetic
taaagggtctgtactttcctgttggtggctccaggtccggggcagtaaaccctgttccgagtactgtctctccca

SEQ ID NO: 103093 - DNA, 75 bp, Artificial Sequence
  Synthetic
taaagggtctgtactttcctgctggtggctccagatccggggcagtaaaccctgttccgagtactgtctctccca

SEQ ID NO: 103094 - DNA, 75 bp, Artificial Sequence
  Synthetic
taaagggtctgtactttcctgctggtggctccagttccggggcagtaaaccctgttccgagtactgtctctccca

SEQ ID NO: 103095 - DNA, 75 bp, Artificial Sequence
  Synthetic
taaagggtctgtactttcctgctggtggctccagctccggggcagtaaaccctgttccgagtactgtctctccca

SEQ ID NO: 103096 - DNA, 75 bp, Artificial Sequence
  Synthetic
taaagggtctgtactttcctgctggtggctccaggtccggggcagtaaaccctgttccgagtactgtctctccca

SEQ ID NO: 103097 - DNA, 75 bp, Artificial Sequence
  Synthetic
taaagggtctgtactttcctggtggtggctccagatccggggcagtaaaccctgttccgagtactgtctctccca

SEQ ID NO: 103098 - DNA, 75 bp, Artificial Sequence
  Synthetic
taaagggtctgtactttcctggtggtggctccagttccggggcagtaaaccctgttccgagtactgtctctccca

SEQ ID NO: 103099 - DNA, 75 bp, Artificial Sequence
  Synthetic
taaagggtctgtactttcctggtggtggctccagctccggggcagtaaaccctgttccgagtactgtctctccca

SEQ ID NO: 103100 - DNA, 75 bp, Artificial Sequence
  Synthetic
taaagggtctgtactttcctggtggtggctccaggtccggggcagtaaaccctgttccgagtactgtctctccca

SEQ ID NO: 103101 - DNA, 75 bp, Artificial Sequence
  Synthetic
taatgggtctgtactttcctgatggtggctccagatccggggcagtaaaccctgttccgagtactgtctctccca

SEQ ID NO: 103102 - DNA, 75 bp, Artificial Sequence
  Synthetic
taatgggtctgtactttcctgatggtggctccagttccggggcagtaaaccctgttccgagtactgtctctccca

SEQ ID NO: 103103 - DNA, 75 bp, Artificial Sequence
  Synthetic
taatgggtctgtactttcctgatggtggctccagctccggggcagtaaaccctgttccgagtactgtctctccca

SEQ ID NO: 103104 - DNA, 75 bp, Artificial Sequence
  Synthetic
taatgggtctgtactttcctgatggtggctccaggtccggggcagtaaaccctgttccgagtactgtctctccca

SEQ ID NO: 103105 - DNA, 75 bp, Artificial Sequence
  Synthetic
taatgggtctgtactttcctgttggtggctccagatccggggcagtaaaccctgttccgagtactgtctctccca

SEQ ID NO: 103106 - DNA, 75 bp, Artificial Sequence
  Synthetic
taatgggtctgtactttcctgttggtggctccagttccggggcagtaaaccctgttccgagtactgtctctccca

SEQ ID NO: 103107 - DNA, 75 bp, Artificial Sequence
  Synthetic
taatgggtctgtactttcctgttggtggctccagctccggggcagtaaaccctgttccgagtactgtctctccca

SEQ ID NO: 103108 - DNA, 75 bp, Artificial Sequence
  Synthetic
taatgggtctgtactttcctgttggtggctccaggtccggggcagtaaaccctgttccgagtactgtctctccca

SEQ ID NO: 103109 - DNA, 75 bp, Artificial Sequence
  Synthetic
taatgggtctgtactttcctgctggtggctccagatccggggcagtaaaccctgttccgagtactgtctctccca

SEQ ID NO: 103110 - DNA, 75 bp, Artificial Sequence
  Synthetic
taatgggtctgtactttcctgctggtggctccagttccggggcagtaaaccctgttccgagtactgtctctccca

SEQ ID NO: 103111 - DNA, 75 bp, Artificial Sequence
  Synthetic
taatgggtctgtactttcctgctggtggctccagctccggggcagtaaaccctgttccgagtactgtctctccca

SEQ ID NO: 103112 - DNA, 75 bp, Artificial Sequence
  Synthetic
taatgggtctgtactttcctgctggtggctccaggtccggggcagtaaaccctgttccgagtactgtctctccca

SEQ ID NO: 103113 - DNA, 75 bp, Artificial Sequence
  Synthetic
taatgggtctgtactttcctggtggtggctccagatccggggcagtaaaccctgttccgagtactgtctctccca

SEQ ID NO: 103114 - DNA, 75 bp, Artificial Sequence
  Synthetic
taatgggtctgtactttcctggtggtggctccagttccggggcagtaaaccctgttccgagtactgtctctccca

SEQ ID NO: 103115 - DNA, 75 bp, Artificial Sequence
  Synthetic
taatgggtctgtactttcctggtggtggctccagctccggggcagtaaaccctgttccgagtactgtctctccca

SEQ ID NO: 103116 - DNA, 75 bp, Artificial Sequence
  Synthetic
taatgggtctgtactttcctggtggtggctccaggtccggggcagtaaaccctgttccgagtactgtctctccca

SEQ ID NO: 103117 - DNA, 75 bp, Artificial Sequence
  Synthetic
taacgggtctgtactttcctgatggtggctccagatccggggcagtaaaccctgttccgagtactgtctctccca

SEQ ID NO: 103118 - DNA, 75 bp, Artificial Sequence
  Synthetic
taacgggtctgtactttcctgatggtggctccagttccggggcagtaaaccctgttccgagtactgtctctccca

SEQ ID NO: 103119 - DNA, 75 bp, Artificial Sequence
  Synthetic
taacgggtctgtactttcctgatggtggctccagctccggggcagtaaaccctgttccgagtactgtctctccca

SEQ ID NO: 103120 - DNA, 75 bp, Artificial Sequence
  Synthetic
taacgggtctgtactttcctgatggtggctccaggtccggggcagtaaaccctgttccgagtactgtctctccca

SEQ ID NO: 103121 - DNA, 75 bp, Artificial Sequence
  Synthetic
taacgggtctgtactttcctgttggtggctccagatccggggcagtaaaccctgttccgagtactgtctctccca

SEQ ID NO: 103122 - DNA, 75 bp, Artificial Sequence
  Synthetic
taacgggtctgtactttcctgttggtggctccagttccggggcagtaaaccctgttccgagtactgtctctccca

SEQ ID NO: 103123 - DNA, 75 bp, Artificial Sequence
  Synthetic
taacgggtctgtactttcctgttggtggctccagctccggggcagtaaaccctgttccgagtactgtctctccca

SEQ ID NO: 103124 - DNA, 75 bp, Artificial Sequence
  Synthetic
taacgggtctgtactttcctgttggtggctccaggtccggggcagtaaaccctgttccgagtactgtctctccca

SEQ ID NO: 103125 - DNA, 75 bp, Artificial Sequence
  Synthetic
taacgggtctgtactttcctgctggtggctccagatccggggcagtaaaccctgttccgagtactgtctctccca

SEQ ID NO: 103126 - DNA, 75 bp, Artificial Sequence
  Synthetic
taacgggtctgtactttcctgctggtggctccagttccggggcagtaaaccctgttccgagtactgtctctccca

SEQ ID NO: 103127 - DNA, 75 bp, Artificial Sequence
  Synthetic
taacgggtctgtactttcctgctggtggctccagctccggggcagtaaaccctgttccgagtactgtctctccca

SEQ ID NO: 103128 - DNA, 75 bp, Artificial Sequence
  Synthetic
taacgggtctgtactttcctgctggtggctccaggtccggggcagtaaaccctgttccgagtactgtctctccca

SEQ ID NO: 103129 - DNA, 75 bp, Artificial Sequence
  Synthetic
taacgggtctgtactttcctggtggtggctccagatccggggcagtaaaccctgttccgagtactgtctctccca

SEQ ID NO: 103130 - DNA, 75 bp, Artificial Sequence
  Synthetic
taacgggtctgtactttcctggtggtggctccagttccggggcagtaaaccctgttccgagtactgtctctccca

SEQ ID NO: 103131 - DNA, 75 bp, Artificial Sequence
  Synthetic
taacgggtctgtactttcctggtggtggctccagctccggggcagtaaaccctgttccgagtactgtctctccca

SEQ ID NO: 103132 - DNA, 75 bp, Artificial Sequence
  Synthetic
taacgggtctgtactttcctggtggtggctccaggtccggggcagtaaaccctgttccgagtactgtctctccca

SEQ ID NO: 103133 - DNA, 75 bp, Artificial Sequence
  Synthetic
taaggggtctgtactttcctgatggtggctccagatccggggcagtaaaccctgttccgagtactgtctctccca

SEQ ID NO: 103134 - DNA, 75 bp, Artificial Sequence
  Synthetic
taaggggtctgtactttcctgatggtggctccagttccggggcagtaaaccctgttccgagtactgtctctccca

SEQ ID NO: 103135 - DNA, 75 bp, Artificial Sequence
  Synthetic
taaggggtctgtactttcctgatggtggctccagctccggggcagtaaaccctgttccgagtactgtctctccca

SEQ ID NO: 103136 - DNA, 75 bp, Artificial Sequence
  Synthetic
taaggggtctgtactttcctgatggtggctccaggtccggggcagtaaaccctgttccgagtactgtctctccca

SEQ ID NO: 103137 - DNA, 75 bp, Artificial Sequence
  Synthetic
taaggggtctgtactttcctgttggtggctccagatccggggcagtaaaccctgttccgagtactgtctctccca

SEQ ID NO: 103138 - DNA, 75 bp, Artificial Sequence
  Synthetic
taaggggtctgtactttcctgttggtggctccagttccggggcagtaaaccctgttccgagtactgtctctccca

SEQ ID NO: 103139 - DNA, 75 bp, Artificial Sequence
  Synthetic
taaggggtctgtactttcctgttggtggctccagctccggggcagtaaaccctgttccgagtactgtctctccca

SEQ ID NO: 103140 - DNA, 75 bp, Artificial Sequence
  Synthetic
taaggggtctgtactttcctgttggtggctccaggtccggggcagtaaaccctgttccgagtactgtctctccca

SEQ ID NO: 103141 - DNA, 75 bp, Artificial Sequence
  Synthetic
taaggggtctgtactttcctgctggtggctccagatccggggcagtaaaccctgttccgagtactgtctctccca

SEQ ID NO: 103142 - DNA, 75 bp, Artificial Sequence
  Synthetic
taaggggtctgtactttcctgctggtggctccagttccggggcagtaaaccctgttccgagtactgtctctccca

SEQ ID NO: 103143 - DNA, 75 bp, Artificial Sequence
  Synthetic
taaggggtctgtactttcctgctggtggctccagctccggggcagtaaaccctgttccgagtactgtctctccca

SEQ ID NO: 103144 - DNA, 75 bp, Artificial Sequence
  Synthetic
taaggggtctgtactttcctgctggtggctccaggtccggggcagtaaaccctgttccgagtactgtctctccca

SEQ ID NO: 103145 - DNA, 75 bp, Artificial Sequence
  Synthetic
taaggggtctgtactttcctggtggtggctccagatccggggcagtaaaccctgttccgagtactgtctctccca

SEQ ID NO: 103146 - DNA, 75 bp, Artificial Sequence
  Synthetic
taaggggtctgtactttcctggtggtggctccagttccggggcagtaaaccctgttccgagtactgtctctccca

SEQ ID NO: 103147 - DNA, 75 bp, Artificial Sequence
  Synthetic
taaggggtctgtactttcctggtggtggctccagctccggggcagtaaaccctgttccgagtactgtctctccca

SEQ ID NO: 103148 - DNA, 75 bp, Artificial Sequence
  Synthetic
taaggggtctgtactttcctggtggtggctccaggtccggggcagtaaaccctgttccgagtactgtctctccca

SEQ ID NO: 103149 - DNA, 75 bp, Artificial Sequence
  Synthetic
ttgagtatttggtgtcttttggagtgtggattcgcactcctcctgcttatagaccaccaaatgcccctatcttat

SEQ ID NO: 103150 - DNA, 75 bp, Artificial Sequence
  Synthetic
ttccacagctttccaccaagctctgcaagatgttagaaacagggccctgaatcttcctgctggtggctccagttc

SEQ ID NO: 103151 - DNA, 75 bp, Artificial Sequence
  Synthetic
gtatttggtgtctttcggagtgtggattcgcactcctccagcttatagaccaccaaatgcccctatcttatcaac

SEQ ID NO: 103152 - DNA, 75 bp, Artificial Sequence
  Synthetic
tcaccatacagcaatcaggcaagcaattctgtgttggggagagttaatgaatctggccacctgggtgggaagtaa

SEQ ID NO: 103153 - DNA, 75 bp, Artificial Sequence
  Synthetic
tcaccatacagcaatcaggcaagcaattctgtgttggggagagttaatgaatctggccacctgggtgggatgtaa

SEQ ID NO: 103154 - DNA, 75 bp, Artificial Sequence
  Synthetic
tcaccatacagcaatcaggcaagcaattctgtgttggggagagttaatgaatctggccacctgggtgggacgtaa

SEQ ID NO: 103155 - DNA, 75 bp, Artificial Sequence
  Synthetic
tcaccatacagcaatcaggcaagcaattctgtgttggggagagttaatgaatctggccacctgggtgggaggtaa

SEQ ID NO: 103156 - DNA, 75 bp, Artificial Sequence
  Synthetic
tcaccatacagcaatcaggcaagcaattctgtgttggggtgagttaatgaatctggccacctgggtgggaagtaa

SEQ ID NO: 103157 - DNA, 75 bp, Artificial Sequence
  Synthetic
tcaccatacagcaatcaggcaagcaattctgtgttggggtgagttaatgaatctggccacctgggtgggatgtaa

SEQ ID NO: 103158 - DNA, 75 bp, Artificial Sequence
  Synthetic
tcaccatacagcaatcaggcaagcaattctgtgttggggtgagttaatgaatctggccacctgggtgggacgtaa

SEQ ID NO: 103159 - DNA, 75 bp, Artificial Sequence
  Synthetic
tcaccatacagcaatcaggcaagcaattctgtgttggggtgagttaatgaatctggccacctgggtgggaggtaa

SEQ ID NO: 103160 - DNA, 75 bp, Artificial Sequence
  Synthetic
tcaccatacagcaatcaggcaagcaattctgtgttggggcgagttaatgaatctggccacctgggtgggaagtaa

SEQ ID NO: 103161 - DNA, 75 bp, Artificial Sequence
  Synthetic
tcaccatacagcaatcaggcaagcaattctgtgttggggcgagttaatgaatctggccacctgggtgggatgtaa

SEQ ID NO: 103162 - DNA, 75 bp, Artificial Sequence
  Synthetic
tcaccatacagcaatcaggcaagcaattctgtgttggggcgagttaatgaatctggccacctgggtgggacgtaa

SEQ ID NO: 103163 - DNA, 75 bp, Artificial Sequence
  Synthetic
tcaccatacagcaatcaggcaagcaattctgtgttggggcgagttaatgaatctggccacctgggtgggaggtaa

SEQ ID NO: 103164 - DNA, 75 bp, Artificial Sequence
  Synthetic
tcaccatacagcaatcaggcaagcaattctgtgttggggggagttaatgaatctggccacctgggtgggaagtaa

SEQ ID NO: 103165 - DNA, 75 bp, Artificial Sequence
  Synthetic
tcaccatacagcaatcaggcaagcaattctgtgttggggggagttaatgaatctggccacctgggtgggatgtaa

SEQ ID NO: 103166 - DNA, 75 bp, Artificial Sequence
  Synthetic
tcaccatacagcaatcaggcaagcaattctgtgttggggggagttaatgaatctggccacctgggtgggacgtaa

SEQ ID NO: 103167 - DNA, 75 bp, Artificial Sequence
  Synthetic
tcaccatacagcaatcaggcaagcaattctgtgttggggggagttaatgaatctggccacctgggtgggaggtaa

SEQ ID NO: 103168 - DNA, 75 bp, Artificial Sequence
  Synthetic
tcaccatacagcaatcaggcaagctattctgtgttggggagagttaatgaatctggccacctgggtgggaagtaa

SEQ ID NO: 103169 - DNA, 75 bp, Artificial Sequence
  Synthetic
tcaccatacagcaatcaggcaagctattctgtgttggggagagttaatgaatctggccacctgggtgggatgtaa

SEQ ID NO: 103170 - DNA, 75 bp, Artificial Sequence
  Synthetic
tcaccatacagcaatcaggcaagctattctgtgttggggagagttaatgaatctggccacctgggtgggacgtaa

SEQ ID NO: 103171 - DNA, 75 bp, Artificial Sequence
  Synthetic
tcaccatacagcaatcaggcaagctattctgtgttggggagagttaatgaatctggccacctgggtgggaggtaa

SEQ ID NO: 103172 - DNA, 75 bp, Artificial Sequence
  Synthetic
tcaccatacagcaatcaggcaagctattctgtgttggggtgagttaatgaatctggccacctgggtgggaagtaa

SEQ ID NO: 103173 - DNA, 75 bp, Artificial Sequence
  Synthetic
tcaccatacagcaatcaggcaagctattctgtgttggggtgagttaatgaatctggccacctgggtgggatgtaa

SEQ ID NO: 103174 - DNA, 75 bp, Artificial Sequence
  Synthetic
tcaccatacagcaatcaggcaagctattctgtgttggggtgagttaatgaatctggccacctgggtgggacgtaa

SEQ ID NO: 103175 - DNA, 75 bp, Artificial Sequence
  Synthetic
tcaccatacagcaatcaggcaagctattctgtgttggggtgagttaatgaatctggccacctgggtgggaggtaa

SEQ ID NO: 103176 - DNA, 75 bp, Artificial Sequence
  Synthetic
tcaccatacagcaatcaggcaagctattctgtgttggggcgagttaatgaatctggccacctgggtgggaagtaa

SEQ ID NO: 103177 - DNA, 75 bp, Artificial Sequence
  Synthetic
tcaccatacagcaatcaggcaagctattctgtgttggggcgagttaatgaatctggccacctgggtgggatgtaa

SEQ ID NO: 103178 - DNA, 75 bp, Artificial Sequence
  Synthetic
tcaccatacagcaatcaggcaagctattctgtgttggggcgagttaatgaatctggccacctgggtgggacgtaa

SEQ ID NO: 103179 - DNA, 75 bp, Artificial Sequence
  Synthetic
tcaccatacagcaatcaggcaagctattctgtgttggggcgagttaatgaatctggccacctgggtgggaggtaa

SEQ ID NO: 103180 - DNA, 75 bp, Artificial Sequence
  Synthetic
tcaccatacagcaatcaggcaagctattctgtgttggggggagttaatgaatctggccacctgggtgggaagtaa

SEQ ID NO: 103181 - DNA, 75 bp, Artificial Sequence
  Synthetic
tcaccatacagcaatcaggcaagctattctgtgttggggggagttaatgaatctggccacctgggtgggatgtaa

SEQ ID NO: 103182 - DNA, 75 bp, Artificial Sequence
  Synthetic
tcaccatacagcaatcaggcaagctattctgtgttggggggagttaatgaatctggccacctgggtgggacgtaa

SEQ ID NO: 103183 - DNA, 75 bp, Artificial Sequence
  Synthetic
tcaccatacagcaatcaggcaagctattctgtgttggggggagttaatgaatctggccacctgggtgggaggtaa

SEQ ID NO: 103184 - DNA, 75 bp, Artificial Sequence
  Synthetic
tcaccatacagcaatcaggcaagccattctgtgttggggagagttaatgaatctggccacctgggtgggaagtaa

SEQ ID NO: 103185 - DNA, 75 bp, Artificial Sequence
  Synthetic
tcaccatacagcaatcaggcaagccattctgtgttggggagagttaatgaatctggccacctgggtgggatgtaa

SEQ ID NO: 103186 - DNA, 75 bp, Artificial Sequence
  Synthetic
tcaccatacagcaatcaggcaagccattctgtgttggggagagttaatgaatctggccacctgggtgggacgtaa

SEQ ID NO: 103187 - DNA, 75 bp, Artificial Sequence
  Synthetic
tcaccatacagcaatcaggcaagccattctgtgttggggagagttaatgaatctggccacctgggtgggaggtaa

SEQ ID NO: 103188 - DNA, 75 bp, Artificial Sequence
  Synthetic
tcaccatacagcaatcaggcaagccattctgtgttggggtgagttaatgaatctggccacctgggtgggaagtaa

SEQ ID NO: 103189 - DNA, 75 bp, Artificial Sequence
  Synthetic
tcaccatacagcaatcaggcaagccattctgtgttggggtgagttaatgaatctggccacctgggtgggatgtaa

SEQ ID NO: 103190 - DNA, 75 bp, Artificial Sequence
  Synthetic
tcaccatacagcaatcaggcaagccattctgtgttggggtgagttaatgaatctggccacctgggtgggacgtaa

SEQ ID NO: 103191 - DNA, 75 bp, Artificial Sequence
  Synthetic
tcaccatacagcaatcaggcaagccattctgtgttggggtgagttaatgaatctggccacctgggtgggaggtaa

SEQ ID NO: 103192 - DNA, 75 bp, Artificial Sequence
  Synthetic
tcaccatacagcaatcaggcaagccattctgtgttggggcgagttaatgaatctggccacctgggtgggaagtaa

SEQ ID NO: 103193 - DNA, 75 bp, Artificial Sequence
  Synthetic
tcaccatacagcaatcaggcaagccattctgtgttggggcgagttaatgaatctggccacctgggtgggatgtaa

SEQ ID NO: 103194 - DNA, 75 bp, Artificial Sequence
  Synthetic
tcaccatacagcaatcaggcaagccattctgtgttggggcgagttaatgaatctggccacctgggtgggacgtaa

SEQ ID NO: 103195 - DNA, 75 bp, Artificial Sequence
  Synthetic
tcaccatacagcaatcaggcaagccattctgtgttggggcgagttaatgaatctggccacctgggtgggaggtaa

SEQ ID NO: 103196 - DNA, 75 bp, Artificial Sequence
  Synthetic
tcaccatacagcaatcaggcaagccattctgtgttggggggagttaatgaatctggccacctgggtgggaagtaa

SEQ ID NO: 103197 - DNA, 75 bp, Artificial Sequence
  Synthetic
tcaccatacagcaatcaggcaagccattctgtgttggggggagttaatgaatctggccacctgggtgggatgtaa

SEQ ID NO: 103198 - DNA, 75 bp, Artificial Sequence
  Synthetic
tcaccatacagcaatcaggcaagccattctgtgttggggggagttaatgaatctggccacctgggtgggacgtaa

SEQ ID NO: 103199 - DNA, 75 bp, Artificial Sequence
  Synthetic
tcaccatacagcaatcaggcaagccattctgtgttggggggagttaatgaatctggccacctgggtgggaggtaa

SEQ ID NO: 103200 - DNA, 75 bp, Artificial Sequence
  Synthetic
tcaccatacagcaatcaggcaagcgattctgtgttggggagagttaatgaatctggccacctgggtgggaagtaa

SEQ ID NO: 103201 - DNA, 75 bp, Artificial Sequence
  Synthetic
tcaccatacagcaatcaggcaagcgattctgtgttggggagagttaatgaatctggccacctgggtgggatgtaa

SEQ ID NO: 103202 - DNA, 75 bp, Artificial Sequence
  Synthetic
tcaccatacagcaatcaggcaagcgattctgtgttggggagagttaatgaatctggccacctgggtgggacgtaa

SEQ ID NO: 103203 - DNA, 75 bp, Artificial Sequence
  Synthetic
tcaccatacagcaatcaggcaagcgattctgtgttggggagagttaatgaatctggccacctgggtgggaggtaa

SEQ ID NO: 103204 - DNA, 75 bp, Artificial Sequence
  Synthetic
tcaccatacagcaatcaggcaagcgattctgtgttggggtgagttaatgaatctggccacctgggtgggaagtaa

SEQ ID NO: 103205 - DNA, 75 bp, Artificial Sequence
  Synthetic
tcaccatacagcaatcaggcaagcgattctgtgttggggtgagttaatgaatctggccacctgggtgggatgtaa

SEQ ID NO: 103206 - DNA, 75 bp, Artificial Sequence
  Synthetic
tcaccatacagcaatcaggcaagcgattctgtgttggggtgagttaatgaatctggccacctgggtgggacgtaa

SEQ ID NO: 103207 - DNA, 75 bp, Artificial Sequence
  Synthetic
tcaccatacagcaatcaggcaagcgattctgtgttggggtgagttaatgaatctggccacctgggtgggaggtaa

SEQ ID NO: 103208 - DNA, 75 bp, Artificial Sequence
  Synthetic
tcaccatacagcaatcaggcaagcgattctgtgttggggcgagttaatgaatctggccacctgggtgggaagtaa

SEQ ID NO: 103209 - DNA, 75 bp, Artificial Sequence
  Synthetic
tcaccatacagcaatcaggcaagcgattctgtgttggggcgagttaatgaatctggccacctgggtgggatgtaa

SEQ ID NO: 103210 - DNA, 75 bp, Artificial Sequence
  Synthetic
tcaccatacagcaatcaggcaagcgattctgtgttggggcgagttaatgaatctggccacctgggtgggacgtaa

SEQ ID NO: 103211 - DNA, 75 bp, Artificial Sequence
  Synthetic
tcaccatacagcaatcaggcaagcgattctgtgttggggcgagttaatgaatctggccacctgggtgggaggtaa

SEQ ID NO: 103212 - DNA, 75 bp, Artificial Sequence
  Synthetic
tcaccatacagcaatcaggcaagcgattctgtgttggggggagttaatgaatctggccacctgggtgggaagtaa

SEQ ID NO: 103213 - DNA, 75 bp, Artificial Sequence
  Synthetic
tcaccatacagcaatcaggcaagcgattctgtgttggggggagttaatgaatctggccacctgggtgggatgtaa

SEQ ID NO: 103214 - DNA, 75 bp, Artificial Sequence
  Synthetic
tcaccatacagcaatcaggcaagcgattctgtgttggggggagttaatgaatctggccacctgggtgggacgtaa

SEQ ID NO: 103215 - DNA, 75 bp, Artificial Sequence
  Synthetic
tcaccatacagcaatcaggcaagcgattctgtgttggggggagttaatgaatctggccacctgggtgggaggtaa

SEQ ID NO: 103216 - DNA, 75 bp, Artificial Sequence
  Synthetic
agtctccggaacattgttcacctcaccatacggcactcaggcaagctattctgtgttggggtgagttgatgaatc

SEQ ID NO: 103217 - DNA, 75 bp, Artificial Sequence
  Synthetic
cctgctggtggctccagttcagaaacacagaaccctgctctgactattgtctctctcacatcatcaatcttctcg

SEQ ID NO: 103218 - DNA, 75 bp, Artificial Sequence
  Synthetic
tctcccgcaaatatacatcgtttccatggctgctaggctgtgctgccaactggatcctgcgagggacgtcctttg

SEQ ID NO: 103219 - DNA, 75 bp, Artificial Sequence
  Synthetic
gtatacatttaaaccctaacaaaacaaaaagatggggttactctctgaatttcatgggctatgtcattggatgtt

SEQ ID NO: 103220 - DNA, 75 bp, Artificial Sequence
  Synthetic
tactcccttaacttcatgggatatgtaattggaagttggggtaccttaccacaggaacatattgtacacaaaatc

SEQ ID NO: 103221 - DNA, 75 bp, Artificial Sequence
  Synthetic
agagtctccagaacattgttcacatcaccatacggcactcaggcaagctattctgtgttgggtagagttaatgaa

SEQ ID NO: 103222 - DNA, 75 bp, Artificial Sequence
  Synthetic
agagtctccagaacattgttcacatcaccatacggcactcaggcaagctattctgtgttgggttgagttaatgaa

SEQ ID NO: 103223 - DNA, 75 bp, Artificial Sequence
  Synthetic
agagtctccagaacattgttcacatcaccatacggcactcaggcaagctattctgtgttgggtcgagttaatgaa

SEQ ID NO: 103224 - DNA, 75 bp, Artificial Sequence
  Synthetic
agagtctccagaacattgttcacatcaccatacggcactcaggcaagctattctgtgttgggtggagttaatgaa

SEQ ID NO: 103225 - DNA, 75 bp, Artificial Sequence
  Synthetic
agagtctccagaacattgttcacatcaccatacggctctcaggcaagctattctgtgttgggtagagttaatgaa

SEQ ID NO: 103226 - DNA, 75 bp, Artificial Sequence
  Synthetic
agagtctccagaacattgttcacatcaccatacggctctcaggcaagctattctgtgttgggttgagttaatgaa

SEQ ID NO: 103227 - DNA, 75 bp, Artificial Sequence
  Synthetic
agagtctccagaacattgttcacatcaccatacggctctcaggcaagctattctgtgttgggtcgagttaatgaa

SEQ ID NO: 103228 - DNA, 75 bp, Artificial Sequence
  Synthetic
agagtctccagaacattgttcacatcaccatacggctctcaggcaagctattctgtgttgggtggagttaatgaa

SEQ ID NO: 103229 - DNA, 75 bp, Artificial Sequence
  Synthetic
agagtctccagaacattgttcacatcaccatacggccctcaggcaagctattctgtgttgggtagagttaatgaa

SEQ ID NO: 103230 - DNA, 75 bp, Artificial Sequence
  Synthetic
agagtctccagaacattgttcacatcaccatacggccctcaggcaagctattctgtgttgggttgagttaatgaa

SEQ ID NO: 103231 - DNA, 75 bp, Artificial Sequence
  Synthetic
agagtctccagaacattgttcacatcaccatacggccctcaggcaagctattctgtgttgggtcgagttaatgaa

SEQ ID NO: 103232 - DNA, 75 bp, Artificial Sequence
  Synthetic
agagtctccagaacattgttcacatcaccatacggccctcaggcaagctattctgtgttgggtggagttaatgaa

SEQ ID NO: 103233 - DNA, 75 bp, Artificial Sequence
  Synthetic
agagtctccagaacattgttcacatcaccatacggcgctcaggcaagctattctgtgttgggtagagttaatgaa

SEQ ID NO: 103234 - DNA, 75 bp, Artificial Sequence
  Synthetic
agagtctccagaacattgttcacatcaccatacggcgctcaggcaagctattctgtgttgggttgagttaatgaa

SEQ ID NO: 103235 - DNA, 75 bp, Artificial Sequence
  Synthetic
agagtctccagaacattgttcacatcaccatacggcgctcaggcaagctattctgtgttgggtcgagttaatgaa

SEQ ID NO: 103236 - DNA, 75 bp, Artificial Sequence
  Synthetic
agagtctccagaacattgttcacatcaccatacggcgctcaggcaagctattctgtgttgggtggagttaatgaa

SEQ ID NO: 103237 - DNA, 75 bp, Artificial Sequence
  Synthetic
agagtctcctgaacattgttcacatcaccatacggcactcaggcaagctattctgtgttgggtagagttaatgaa

SEQ ID NO: 103238 - DNA, 75 bp, Artificial Sequence
  Synthetic
agagtctcctgaacattgttcacatcaccatacggcactcaggcaagctattctgtgttgggttgagttaatgaa

SEQ ID NO: 103239 - DNA, 75 bp, Artificial Sequence
  Synthetic
agagtctcctgaacattgttcacatcaccatacggcactcaggcaagctattctgtgttgggtcgagttaatgaa

SEQ ID NO: 103240 - DNA, 75 bp, Artificial Sequence
  Synthetic
agagtctcctgaacattgttcacatcaccatacggcactcaggcaagctattctgtgttgggtggagttaatgaa

SEQ ID NO: 103241 - DNA, 75 bp, Artificial Sequence
  Synthetic
agagtctcctgaacattgttcacatcaccatacggctctcaggcaagctattctgtgttgggtagagttaatgaa

SEQ ID NO: 103242 - DNA, 75 bp, Artificial Sequence
  Synthetic
agagtctcctgaacattgttcacatcaccatacggctctcaggcaagctattctgtgttgggttgagttaatgaa

SEQ ID NO: 103243 - DNA, 75 bp, Artificial Sequence
  Synthetic
agagtctcctgaacattgttcacatcaccatacggctctcaggcaagctattctgtgttgggtcgagttaatgaa

SEQ ID NO: 103244 - DNA, 75 bp, Artificial Sequence
  Synthetic
agagtctcctgaacattgttcacatcaccatacggctctcaggcaagctattctgtgttgggtggagttaatgaa

SEQ ID NO: 103245 - DNA, 75 bp, Artificial Sequence
  Synthetic
agagtctcctgaacattgttcacatcaccatacggccctcaggcaagctattctgtgttgggtagagttaatgaa

SEQ ID NO: 103246 - DNA, 75 bp, Artificial Sequence
  Synthetic
agagtctcctgaacattgttcacatcaccatacggccctcaggcaagctattctgtgttgggttgagttaatgaa

SEQ ID NO: 103247 - DNA, 75 bp, Artificial Sequence
  Synthetic
agagtctcctgaacattgttcacatcaccatacggccctcaggcaagctattctgtgttgggtcgagttaatgaa

SEQ ID NO: 103248 - DNA, 75 bp, Artificial Sequence
  Synthetic
agagtctcctgaacattgttcacatcaccatacggccctcaggcaagctattctgtgttgggtggagttaatgaa

SEQ ID NO: 103249 - DNA, 75 bp, Artificial Sequence
  Synthetic
agagtctcctgaacattgttcacatcaccatacggcgctcaggcaagctattctgtgttgggtagagttaatgaa

SEQ ID NO: 103250 - DNA, 75 bp, Artificial Sequence
  Synthetic
agagtctcctgaacattgttcacatcaccatacggcgctcaggcaagctattctgtgttgggttgagttaatgaa

SEQ ID NO: 103251 - DNA, 75 bp, Artificial Sequence
  Synthetic
agagtctcctgaacattgttcacatcaccatacggcgctcaggcaagctattctgtgttgggtcgagttaatgaa

SEQ ID NO: 103252 - DNA, 75 bp, Artificial Sequence
  Synthetic
agagtctcctgaacattgttcacatcaccatacggcgctcaggcaagctattctgtgttgggtggagttaatgaa

SEQ ID NO: 103253 - DNA, 75 bp, Artificial Sequence
  Synthetic
agagtctcccgaacattgttcacatcaccatacggcactcaggcaagctattctgtgttgggtagagttaatgaa

SEQ ID NO: 103254 - DNA, 75 bp, Artificial Sequence
  Synthetic
agagtctcccgaacattgttcacatcaccatacggcactcaggcaagctattctgtgttgggttgagttaatgaa

SEQ ID NO: 103255 - DNA, 75 bp, Artificial Sequence
  Synthetic
agagtctcccgaacattgttcacatcaccatacggcactcaggcaagctattctgtgttgggtcgagttaatgaa

SEQ ID NO: 103256 - DNA, 75 bp, Artificial Sequence
  Synthetic
agagtctcccgaacattgttcacatcaccatacggcactcaggcaagctattctgtgttgggtggagttaatgaa

SEQ ID NO: 103257 - DNA, 75 bp, Artificial Sequence
  Synthetic
agagtctcccgaacattgttcacatcaccatacggctctcaggcaagctattctgtgttgggtagagttaatgaa

SEQ ID NO: 103258 - DNA, 75 bp, Artificial Sequence
  Synthetic
agagtctcccgaacattgttcacatcaccatacggctctcaggcaagctattctgtgttgggttgagttaatgaa

SEQ ID NO: 103259 - DNA, 75 bp, Artificial Sequence
  Synthetic
agagtctcccgaacattgttcacatcaccatacggctctcaggcaagctattctgtgttgggtcgagttaatgaa

SEQ ID NO: 103260 - DNA, 75 bp, Artificial Sequence
  Synthetic
agagtctcccgaacattgttcacatcaccatacggctctcaggcaagctattctgtgttgggtggagttaatgaa

SEQ ID NO: 103261 - DNA, 75 bp, Artificial Sequence
  Synthetic
agagtctcccgaacattgttcacatcaccatacggccctcaggcaagctattctgtgttgggtagagttaatgaa

SEQ ID NO: 103262 - DNA, 75 bp, Artificial Sequence
  Synthetic
agagtctcccgaacattgttcacatcaccatacggccctcaggcaagctattctgtgttgggttgagttaatgaa

SEQ ID NO: 103263 - DNA, 75 bp, Artificial Sequence
  Synthetic
agagtctcccgaacattgttcacatcaccatacggccctcaggcaagctattctgtgttgggtcgagttaatgaa

SEQ ID NO: 103264 - DNA, 75 bp, Artificial Sequence
  Synthetic
agagtctcccgaacattgttcacatcaccatacggccctcaggcaagctattctgtgttgggtggagttaatgaa

SEQ ID NO: 103265 - DNA, 75 bp, Artificial Sequence
  Synthetic
agagtctcccgaacattgttcacatcaccatacggcgctcaggcaagctattctgtgttgggtagagttaatgaa

SEQ ID NO: 103266 - DNA, 75 bp, Artificial Sequence
  Synthetic
agagtctcccgaacattgttcacatcaccatacggcgctcaggcaagctattctgtgttgggttgagttaatgaa

SEQ ID NO: 103267 - DNA, 75 bp, Artificial Sequence
  Synthetic
agagtctcccgaacattgttcacatcaccatacggcgctcaggcaagctattctgtgttgggtcgagttaatgaa

SEQ ID NO: 103268 - DNA, 75 bp, Artificial Sequence
  Synthetic
agagtctcccgaacattgttcacatcaccatacggcgctcaggcaagctattctgtgttgggtggagttaatgaa

SEQ ID NO: 103269 - DNA, 75 bp, Artificial Sequence
  Synthetic
agagtctccggaacattgttcacatcaccatacggcactcaggcaagctattctgtgttgggtagagttaatgaa

SEQ ID NO: 103270 - DNA, 75 bp, Artificial Sequence
  Synthetic
agagtctccggaacattgttcacatcaccatacggcactcaggcaagctattctgtgttgggttgagttaatgaa

SEQ ID NO: 103271 - DNA, 75 bp, Artificial Sequence
  Synthetic
agagtctccggaacattgttcacatcaccatacggcactcaggcaagctattctgtgttgggtcgagttaatgaa

SEQ ID NO: 103272 - DNA, 75 bp, Artificial Sequence
  Synthetic
agagtctccggaacattgttcacatcaccatacggcactcaggcaagctattctgtgttgggtggagttaatgaa

SEQ ID NO: 103273 - DNA, 75 bp, Artificial Sequence
  Synthetic
agagtctccggaacattgttcacatcaccatacggctctcaggcaagctattctgtgttgggtagagttaatgaa

SEQ ID NO: 103274 - DNA, 75 bp, Artificial Sequence
  Synthetic
agagtctccggaacattgttcacatcaccatacggctctcaggcaagctattctgtgttgggttgagttaatgaa

SEQ ID NO: 103275 - DNA, 75 bp, Artificial Sequence
  Synthetic
agagtctccggaacattgttcacatcaccatacggctctcaggcaagctattctgtgttgggtcgagttaatgaa

SEQ ID NO: 103276 - DNA, 75 bp, Artificial Sequence
  Synthetic
agagtctccggaacattgttcacatcaccatacggctctcaggcaagctattctgtgttgggtggagttaatgaa

SEQ ID NO: 103277 - DNA, 75 bp, Artificial Sequence
  Synthetic
agagtctccggaacattgttcacatcaccatacggccctcaggcaagctattctgtgttgggtagagttaatgaa

SEQ ID NO: 103278 - DNA, 75 bp, Artificial Sequence
  Synthetic
agagtctccggaacattgttcacatcaccatacggccctcaggcaagctattctgtgttgggttgagttaatgaa

SEQ ID NO: 103279 - DNA, 75 bp, Artificial Sequence
  Synthetic
agagtctccggaacattgttcacatcaccatacggccctcaggcaagctattctgtgttgggtcgagttaatgaa

SEQ ID NO: 103280 - DNA, 75 bp, Artificial Sequence
  Synthetic
agagtctccggaacattgttcacatcaccatacggccctcaggcaagctattctgtgttgggtggagttaatgaa

SEQ ID NO: 103281 - DNA, 75 bp, Artificial Sequence
  Synthetic
agagtctccggaacattgttcacatcaccatacggcgctcaggcaagctattctgtgttgggtagagttaatgaa

SEQ ID NO: 103282 - DNA, 75 bp, Artificial Sequence
  Synthetic
agagtctccggaacattgttcacatcaccatacggcgctcaggcaagctattctgtgttgggttgagttaatgaa

SEQ ID NO: 103283 - DNA, 75 bp, Artificial Sequence
  Synthetic
agagtctccggaacattgttcacatcaccatacggcgctcaggcaagctattctgtgttgggtcgagttaatgaa

SEQ ID NO: 103284 - DNA, 75 bp, Artificial Sequence
  Synthetic
agagtctccggaacattgttcacatcaccatacggcgctcaggcaagctattctgtgttgggtggagttaatgaa

SEQ ID NO: 103285 - DNA, 75 bp, Artificial Sequence
  Synthetic
aacatggagaacatcacatcaggattcctaggacccctgctcgtgttacaggcggggtttttcttgttgacaaga

SEQ ID NO: 103286 - DNA, 75 bp, Artificial Sequence
  Synthetic
tggaaggcgggtattctatataagagagaaacatcccgtagcgcttcattttgtgggtcaccatatacttgggaa

SEQ ID NO: 103287 - DNA, 75 bp, Artificial Sequence
  Synthetic
gttgtgccttgggtggctttagggcaaggaccttgacccttataaagaatttggagctagtgtgactttactctc

SEQ ID NO: 103288 - DNA, 75 bp, Artificial Sequence
  Synthetic
tggccagaggcgaatcaggtaggagtgggagcattcgggcccatctctccacctctaagagacagtcatcctcag

SEQ ID NO: 103289 - DNA, 75 bp, Artificial Sequence
  Synthetic
gtattgggggccaagtctgtacaacatcttgagtccctttttacctctattaccaattttcttttgtctttgggt

SEQ ID NO: 103290 - DNA, 75 bp, Artificial Sequence
  Synthetic
ctgtgtgtttaaagactgggaggagttgggggaggagattaggttaaaggtctttgtactaggaggctgtaggca

SEQ ID NO: 103291 - DNA, 75 bp, Artificial Sequence
  Synthetic
aggccttttggggtggagccctcagtctcagggcacactaacaactttgccagcagatccgcctcctgcctccac

SEQ ID NO: 103292 - DNA, 75 bp, Artificial Sequence
  Synthetic
tagatgtcaacaatatgtgggccctcttacagttaatgaaaaaagaagattaaaattaattatgcctgctaggtt

SEQ ID NO: 103293 - DNA, 75 bp, Artificial Sequence
  Synthetic
gaatctagccacctgggtgggaagtaatttggaagatccagcatccagggaattagtagtcagctatgtcaacgt

SEQ ID NO: 103294 - DNA, 75 bp, Artificial Sequence
  Synthetic
ctctacagcattccaccaagctctacaaaatcccaaagtcaggggcctgtatcttcctgctggtggctccagttc

SEQ ID NO: 103295 - DNA, 75 bp, Artificial Sequence
  Synthetic
ggatcattgccacaagatcacatcatacacaaaatcaaagaatgtttcagaaaactccctgttaacaggcctatt

SEQ ID NO: 103296 - DNA, 75 bp, Artificial Sequence
  Synthetic
atctaaatcgccgtgtcgcagaagatctcaatctcgggacgcccaatgctagtattccttggactcataaggtgg

SEQ ID NO: 103297 - DNA, 75 bp, Artificial Sequence
  Synthetic
gagccaactcaaacaatccagattgggacttcaaccccaacaaggatcattggccagaggcaaatcaggtaggag

SEQ ID NO: 103298 - DNA, 75 bp, Artificial Sequence
  Synthetic
tgtggtttcacatttcctgtcttacttttggaagagaaactgttcttgagtatttggtgtcttttggagtgtgga

SEQ ID NO: 103299 - DNA, 75 bp, Artificial Sequence
  Synthetic
gggtggagccctcaggctcagggcatactcacaactgtgccagcagctcctcctcctgcctccaccaatcggcag

SEQ ID NO: 103300 - DNA, 75 bp, Artificial Sequence
  Synthetic
taagattcatttacatgaggacattattaatagatgtcaacaatttgtgggccctctcactgtaaatgaaaaaag

SEQ ID NO: 103301 - DNA, 75 bp, Artificial Sequence
  Synthetic
ccagagtcaggggtctgcccgctggtggctccagttcaggaacagtaaaccctgctccgaatattgcctctcaca

SEQ ID NO: 103302 - DNA, 75 bp, Artificial Sequence
  Synthetic
tttagccacctgggtgggtggtaatttggaagatccaacatccagagacctagtagtcagttatgttaacactaa

SEQ ID NO: 103303 - DNA, 75 bp, Artificial Sequence
  Synthetic
atacatttaaaccctaataaaaccaagcgatggggatattcccttaatttcatgggatatgtaattggaagttgg

SEQ ID NO: 103304 - DNA, 75 bp, Artificial Sequence
  Synthetic
cttccgaaaactactgttgttagacgacgaggcaggtcccctagaagaagaactccctcgcctcgcagacgaagg

SEQ ID NO: 103305 - DNA, 75 bp, Artificial Sequence
  Synthetic
tgctgctatgcctcatcttcttattggttcttctggattatcaaggtatgttgcccgtttgtcctctaattccag

SEQ ID NO: 103306 - DNA, 75 bp, Artificial Sequence
  Synthetic
atacatttaaaccctagcaaaacaaaacgatggggctattcccttcatttcatggggtatgtgattggaagttgg

SEQ ID NO: 103307 - DNA, 75 bp, Artificial Sequence
  Synthetic
ggaaccttgccacaagaccatattgtacagaaaatcaaacaatgttttcgcaaacttcctgtaaatcgccccatt

SEQ ID NO: 103308 - DNA, 75 bp, Artificial Sequence
  Synthetic
ttccacaaccttccaccaacctctgcaagatcccaaagtaagtgaccaatatttccctgctggtggctccagttc

SEQ ID NO: 103309 - DNA, 75 bp, Artificial Sequence
  Synthetic
gtaggagtgggagcattcgggccagggttcaccccacctcacggcggtcttttggggtggagccctcaggctcag

SEQ ID NO: 103310 - DNA, 75 bp, Artificial Sequence
  Synthetic
tcggcagtcaggaagacagcctactcccatctctccacctctaagagacagtcatcctcaggccatgcagtggaa

SEQ ID NO: 103311 - DNA, 75 bp, Artificial Sequence
  Synthetic
ttttttgccttctgatttctttccgtctattcgagatctcctcgacaccgcctcagctttgtaccgggaggcctt

SEQ ID NO: 103312 - DNA, 75 bp, Artificial Sequence
  Synthetic
tatgggcctaaagttcaggcaactattgtggtttcacatttcttgtctcacttttggaagagaaacagttctaga

SEQ ID NO: 103313 - DNA, 75 bp, Artificial Sequence
  Synthetic
tactgccaactggatccttcgcgggacgtcctttgtttacgtcccgtcggcgctgaatcccgcggacgacccctc

SEQ ID NO: 103314 - DNA, 75 bp, Artificial Sequence
  Synthetic
tattcccatcccatcatcttgggctttcggaaaattcctatgggagtgggcctcagcccgtttctcctggctcag

SEQ ID NO: 103315 - DNA, 75 bp, Artificial Sequence
  Synthetic
tgttaacactaatatgggcctaaagttcaggcaactattgtggtttcacatttcttgtctcacttttggaagaga

SEQ ID NO: 103316 - DNA, 75 bp, Artificial Sequence
  Synthetic
ttcatttgcatcaggacattattgataagtgtcagcaatttgttggtccacttacagtaaatgaaaaacgaagat

SEQ ID NO: 103317 - DNA, 75 bp, Artificial Sequence
  Synthetic
ctccagcacattccaccaagctctgctagatcccagagtgaggggcctatactttcctgctggtggctcaagttc

SEQ ID NO: 103318 - DNA, 75 bp, Artificial Sequence
  Synthetic
gggcagaatctttctgtcagcaacccgctgggattttttcccgagcaccagttggaccctctgttcagagccaac

SEQ ID NO: 103319 - DNA, 75 bp, Artificial Sequence
  Synthetic
gctgtgccttgggtggctttggggcatggacattgatccttataaagaatttggagctactgtggagttactctc

SEQ ID NO: 103320 - DNA, 75 bp, Artificial Sequence
  Synthetic
ttgccaacaaatccgcctcctgcctctaccaatcgccagtcaggaagacagcctacccctccaactctacctttg

SEQ ID NO: 103321 - DNA, 75 bp, Artificial Sequence
  Synthetic
ctccacaaccttccaccaaactctgcaagatcccagggtgaaaggcctgtatttccctgctggtggctccagttc

SEQ ID NO: 103322 - DNA, 75 bp, Artificial Sequence
  Synthetic
ctcaacacagttccaccaagcactgttggatccgagagtaaggggtctgtatcctgctggtggctccagttcaga

SEQ ID NO: 103323 - DNA, 75 bp, Artificial Sequence
  Synthetic
ccccaaagtgaggggcctatactttcctgctggtggctccagttccggaacagtaaaccctgttccgactactgc

SEQ ID NO: 103324 - DNA, 75 bp, Artificial Sequence
  Synthetic
aggaacagtgaaccctgttcagaacactgcctctcccatatcgtcaatcttatcgaagactggggaccctgtgcc

SEQ ID NO: 103325 - DNA, 75 bp, Artificial Sequence
  Synthetic
tagagtcaccggaacattgcacccccaatcataccgctctcaggcaagctattttgtgttggggtgagttaatga

SEQ ID NO: 103326 - DNA, 75 bp, Artificial Sequence
  Synthetic
ttgccagcaaatccgcctcctgcctctaccaatcgccagtcaggaaggcagcctacccctctgtctccacctttg

SEQ ID NO: 103327 - DNA, 75 bp, Artificial Sequence
  Synthetic
ctccacaaccttccaccaaactctacaagatcccagagtgaggggcctgtaccttgctggtggctccagttcagg

SEQ ID NO: 103328 - DNA, 75 bp, Artificial Sequence
  Synthetic
cctgcgcgggacgtcctttgtttacgtcccgtcggcgctgaatcccgcggacgacccctcccggggccgcttggg

SEQ ID NO: 103329 - DNA, 75 bp, Artificial Sequence
  Synthetic
ttcatttgcgggaggacattatcaataggtgtcaacaatatgtgggccctctaacagttaatgagaaaagaagat

SEQ ID NO: 103330 - DNA, 75 bp, Artificial Sequence
  Synthetic
ttcctgctggtggctccagttcaggaacagtgagccctgctcagaatactgtctctgccatatcgtcaatctcat

SEQ ID NO: 103331 - DNA, 75 bp, Artificial Sequence
  Synthetic
tattatcctgagcatacagttaatcattactttaaaaccagacattatttgcatactttatggaaggcgggaatt

SEQ ID NO: 103332 - DNA, 75 bp, Artificial Sequence
  Synthetic
ttgttcacctcaccatacagcactcaggcaagctattttgtgttggggtgagttgatgaatctggccacctgggt

SEQ ID NO: 103333 - DNA, 75 bp, Artificial Sequence
  Synthetic
ttcagtggttcgtagggctttcccccactgtctggctttcagttatatggatgatgtggtattgggggccaagtc

SEQ ID NO: 103334 - DNA, 75 bp, Artificial Sequence
  Synthetic
ggcacattgccacaggaacatattgtacaaaaaatcaaaatgtgttttaggaaacttcctgtaaacaggcctatt

SEQ ID NO: 103335 - DNA, 75 bp, Artificial Sequence
  Synthetic
ggaattttacggggctttattcttctactttaccttcttttaatcccaactggcaaactccttctttccctgata

SEQ ID NO: 103336 - DNA, 75 bp, Artificial Sequence
  Synthetic
aaacagtatctgaacctttaccccgttgctcggcaacggcctggtctgtgccaagtgtttgctgacgcaaccccc

SEQ ID NO: 103337 - DNA, 75 bp, Artificial Sequence
  Synthetic
aaacctcgacaaggcatggggacgaatctttctgttcccaatcctctgggattctttcccgatcaccagttggac

SEQ ID NO: 103338 - DNA, 75 bp, Artificial Sequence
  Synthetic
taaaattgattatgcctgctaggttctatcctaaccttaccaaatatttgcccttagataaaggtattaaacctt

SEQ ID NO: 103339 - DNA, 75 bp, Artificial Sequence
  Synthetic
accgcaggaacatattgtacaaaaactcaagcaatgttttcggaaattgcctgtaaatagacctattgattggaa

SEQ ID NO: 103340 - DNA, 75 bp, Artificial Sequence
  Synthetic
actggttggggcttggccataggccatcagcgcatgcgtggaacctttgtggctcctctgccgatccatactgcg

SEQ ID NO: 103341 - DNA, 75 bp, Artificial Sequence
  Synthetic
ttaatcctaactggaaaactccatcttttcctgatattcatttgcaccaggacattattaacaaatgtgaacaat

SEQ ID NO: 103342 - DNA, 75 bp, Artificial Sequence
  Synthetic
gatccagcctcagctctgtatcgggaagccttcgagtctcctgagcattgctcacctcaccatacagcactcagg

SEQ ID NO: 103343 - DNA, 75 bp, Artificial Sequence
  Synthetic
tcggcaggtaggaaggcagcctactcccctgtctccacctctaagagacactcatcctcaggccatgcagtggaa

SEQ ID NO: 103344 - DNA, 75 bp, Artificial Sequence
  Synthetic
ctccagcacattccaccaagctctgctagatcccagagtgaggggtcctgctggtggctcaagttccggaacagt

SEQ ID NO: 103345 - DNA, 75 bp, Artificial Sequence
  Synthetic
tgaggcctacttcaaagactgtgtgtttaaagactgggaggagttgggggaggagattaggttaaaggtctttgt

SEQ ID NO: 103346 - DNA, 75 bp, Artificial Sequence
  Synthetic
acattcatttgcaggaggacattgttgatagatgtaagcaatttgtgggaccccttacagtaaatgaaaacagga

SEQ ID NO: 103347 - DNA, 75 bp, Artificial Sequence
  Synthetic
tctctcggaaatacacctcctttccatggctgctagggtgtgctgccaactggatcctgcgcgggacgtcctttg

SEQ ID NO: 103348 - DNA, 75 bp, Artificial Sequence
  Synthetic
taaaaatcagacaactattgtggtttcacatttcctgtcttacttttggaagagaaactgttcttgagtatttgg

SEQ ID NO: 103349 - DNA, 75 bp, Artificial Sequence
  Synthetic
cgacattatttacatactctttggaaggctgggattctatataagagggaaactacacgtagcgcctcattttgc

SEQ ID NO: 103350 - DNA, 75 bp, Artificial Sequence
  Synthetic
cccatgaaatccacgtcctttccatggctggtccaatggggtcccgaccggaacctccgcggggtcggccctgta

SEQ ID NO: 103351 - DNA, 75 bp, Artificial Sequence
  Synthetic
tcttgggaacaagagctacagcaaacctcgacaaggcatggggacgaatctttctgttcccaaccctctgggatt

SEQ ID NO: 103352 - DNA, 75 bp, Artificial Sequence
  Synthetic
tacgtcgaatcggcggtgaaacccgcggagggcccgtttcgggcccgtccggccctttcccgtcccgctgtccct

SEQ ID NO: 103353 - DNA, 75 bp, Artificial Sequence
  Synthetic
aacaatatctgaacctttaccccgttgctcggcaacggccaggtctgtgccaagtgtttgctgacgcaaccccca

SEQ ID NO: 103354 - DNA, 75 bp, Artificial Sequence
  Synthetic
cgtgtacccttcgcttcacccacgcagaccgcccggagaccgccgtgaacccccaccaggtcttcccccaagttg

SEQ ID NO: 103355 - DNA, 75 bp, Artificial Sequence
  Synthetic
aatactgcaaagactggttgtatgagaccagataagagatctttgaactacgaggatgcaggcataatttgttct

SEQ ID NO: 103356 - DNA, 75 bp, Artificial Sequence
  Synthetic
attggacgggggcagccgaggaacccctggagcatgtgtggcacctctgtgggtcctactccgagcaatcctggg

SEQ ID NO: 103357 - DNA, 75 bp, Artificial Sequence
  Synthetic
tggggttactctttacatttcatgggctatgtcattggatgttatgggtcattgccacaagatcacatcatacaa

SEQ ID NO: 103358 - DNA, 75 bp, Artificial Sequence
  Synthetic
gggagcttaccacaagaacacattatacaaaaaatacaccaatgtttcagaaaactacccgtaaataggcctatt

SEQ ID NO: 103359 - DNA, 75 bp, Artificial Sequence
  Synthetic
ctctcccatatcgtcaatcttctcgaggactggggaccctgcaccgaacatggagaacacaacatcaggattcct

SEQ ID NO: 103360 - DNA, 75 bp, Artificial Sequence
  Synthetic
gaactcctagcagcttgtttcgctcgcagccggtctggagcgaaactcatcggaaccgacaactctgttgtcctc

SEQ ID NO: 103361 - DNA, 75 bp, Artificial Sequence
  Synthetic
tatttggtgtcttttggagtgtggattcgcactcctccagcttatagaccaccaaatgcccctatcttatcaaca

SEQ ID NO: 103362 - DNA, 75 bp, Artificial Sequence
  Synthetic
tgcaaaagaggaccacaggaggatcagcggcgtcaaagacagaccttcaagcataccgcccgaccttgaaggtta

SEQ ID NO: 103363 - DNA, 75 bp, Artificial Sequence
  Synthetic
ttcatttacatcaagacctgatatctaaatgtgaacaatttgtgggcccacttactaaaaatgaattaagaagat

SEQ ID NO: 103364 - DNA, 75 bp, Artificial Sequence
  Synthetic
ttcatttacatcaagacctgatatctaaatgtgaacaatttgtgggcccacttactaaaaatgaattaagaagtt

SEQ ID NO: 103365 - DNA, 75 bp, Artificial Sequence
  Synthetic
ttcatttacatcaagacctgatatctaaatgtgaacaatttgtgggcccacttactaaaaatgaattaagaagct

SEQ ID NO: 103366 - DNA, 75 bp, Artificial Sequence
  Synthetic
ttcatttacatcaagacctgatatctaaatgtgaacaatttgtgggcccacttactaaaaatgaattaagaaggt

SEQ ID NO: 103367 - DNA, 75 bp, Artificial Sequence
  Synthetic
ttcatttacatcaagacctgatatctaaatgtgaacaatttgtgggcccacttactaaaaatgaattaagtagat

SEQ ID NO: 103368 - DNA, 75 bp, Artificial Sequence
  Synthetic
ttcatttacatcaagacctgatatctaaatgtgaacaatttgtgggcccacttactaaaaatgaattaagtagtt

SEQ ID NO: 103369 - DNA, 75 bp, Artificial Sequence
  Synthetic
ttcatttacatcaagacctgatatctaaatgtgaacaatttgtgggcccacttactaaaaatgaattaagtagct

SEQ ID NO: 103370 - DNA, 75 bp, Artificial Sequence
  Synthetic
ttcatttacatcaagacctgatatctaaatgtgaacaatttgtgggcccacttactaaaaatgaattaagtaggt

SEQ ID NO: 103371 - DNA, 75 bp, Artificial Sequence
  Synthetic
ttcatttacatcaagacctgatatctaaatgtgaacaatttgtgggcccacttactaaaaatgaattaagcagat

SEQ ID NO: 103372 - DNA, 75 bp, Artificial Sequence
  Synthetic
ttcatttacatcaagacctgatatctaaatgtgaacaatttgtgggcccacttactaaaaatgaattaagcagtt

SEQ ID NO: 103373 - DNA, 75 bp, Artificial Sequence
  Synthetic
ttcatttacatcaagacctgatatctaaatgtgaacaatttgtgggcccacttactaaaaatgaattaagcagct

SEQ ID NO: 103374 - DNA, 75 bp, Artificial Sequence
  Synthetic
ttcatttacatcaagacctgatatctaaatgtgaacaatttgtgggcccacttactaaaaatgaattaagcaggt

SEQ ID NO: 103375 - DNA, 75 bp, Artificial Sequence
  Synthetic
ttcatttacatcaagacctgatatctaaatgtgaacaatttgtgggcccacttactaaaaatgaattaaggagat

SEQ ID NO: 103376 - DNA, 75 bp, Artificial Sequence
  Synthetic
ttcatttacatcaagacctgatatctaaatgtgaacaatttgtgggcccacttactaaaaatgaattaaggagtt

SEQ ID NO: 103377 - DNA, 75 bp, Artificial Sequence
  Synthetic
ttcatttacatcaagacctgatatctaaatgtgaacaatttgtgggcccacttactaaaaatgaattaaggagct

SEQ ID NO: 103378 - DNA, 75 bp, Artificial Sequence
  Synthetic
ttcatttacatcaagacctgatatctaaatgtgaacaatttgtgggcccacttactaaaaatgaattaaggaggt

SEQ ID NO: 103379 - DNA, 75 bp, Artificial Sequence
  Synthetic
tttttcacctctgcctagtcatctcttgttcatgtcctactgtgtactggagggagctgtgccttgggtggcttt

SEQ ID NO: 103380 - DNA, 75 bp, Artificial Sequence
  Synthetic
aagatctcaatctcgggaatctcaatgttagtattccttggactcataaggtgggaaactttacggggctttatt

SEQ ID NO: 103381 - DNA, 75 bp, Artificial Sequence
  Synthetic
ctcaacccagttccactcaacccagttggatccgagggtaagggctctgtatattcctgctggtggctccagttc

SEQ ID NO: 103382 - DNA, 75 bp, Artificial Sequence
  Synthetic
ctcaacccagttccactcaacccagttggatccgagggtaagggctctgtattttcctgctggtggctccagttc

SEQ ID NO: 103383 - DNA, 75 bp, Artificial Sequence
  Synthetic
ctcaacccagttccactcaacccagttggatccgagggtaagggctctgtatcttcctgctggtggctccagttc

SEQ ID NO: 103384 - DNA, 75 bp, Artificial Sequence
  Synthetic
ctcaacccagttccactcaacccagttggatccgagggtaagggctctgtatgttcctgctggtggctccagttc

SEQ ID NO: 103385 - DNA, 75 bp, Artificial Sequence
  Synthetic
tattcccttaacttcatgggatatgtaattgggagttggggcacattgccacaggaacatattgtacaaaaaatc

SEQ ID NO: 103386 - DNA, 75 bp, Artificial Sequence
  Synthetic
ctccaccactttccaccaaactcttcaagatcccagagtcagggctctgtactttcctgctggtggctccagttc

SEQ ID NO: 103387 - DNA, 75 bp, Artificial Sequence
  Synthetic
ttaatgcctttgtatgcatgtatacaagctaagcaggctttcactttctcgccaacttacaaggcctttctaagt

SEQ ID NO: 103388 - DNA, 75 bp, Artificial Sequence
  Synthetic
taaagttaatcatgcctgctagattctatcctaactctaccaaatatttgccactggataaaggtatcaaacctt

SEQ ID NO: 103389 - DNA, 75 bp, Artificial Sequence
  Synthetic
gggcagaatcattctgtcaccaatcctctgggattcttccccgagcatcagttggaccctctgttcagagccaac

SEQ ID NO: 103390 - DNA, 75 bp, Artificial Sequence
  Synthetic
tcgccagtcaggaaggcaacctacccctctgtctccacctttgagaaacacccatcctcaggccatgcagtggaa

SEQ ID NO: 103391 - DNA, 75 bp, Artificial Sequence
  Synthetic
aggaacagtaagccctgctcagaatactgtctcagccatatcgtcaatcttatcgaagactggggaccctgtgcc

SEQ ID NO: 103392 - DNA, 75 bp, Artificial Sequence
  Synthetic
ctctgccatatcgtcaatcttatcgaagactggggaccctgtaccgaacatggagaacatcgcatcaggactcct

SEQ ID NO: 103393 - DNA, 75 bp, Artificial Sequence
  Synthetic
cgcctcttgcctccaccaatcggcagtcaagaaggcagcctaccccactcactccacctgctggtggctccagtt

SEQ ID NO: 103394 - DNA, 75 bp, Artificial Sequence
  Synthetic
actctagctacctgggtgggtggtaatttggaagatccaacatccagggacctagtagtcagttatgtcaacact

SEQ ID NO: 103395 - DNA, 75 bp, Artificial Sequence
  Synthetic
cctgctggtggctccagttccggaacagtaaaccctgttccgactactgcctcacccatatcgtcaatcttctcg

SEQ ID NO: 103396 - DNA, 75 bp, Artificial Sequence
  Synthetic
ggattcgcactcctccagcctatagaccaccaaatgcccctatcttatcaacacttccggaaactactgttgtta

SEQ ID NO: 103397 - DNA, 75 bp, Artificial Sequence
  Synthetic
actctttggaaggctggtattctatataagagggaaaccacacgtagcgcatcattttgcgggtcaccatattct

SEQ ID NO: 103398 - DNA, 75 bp, Artificial Sequence
  Synthetic
ttactctcttttttgccttctgacttctttccttctgttcgagatctcctcgacaccgcctcagctctgtatcgg

SEQ ID NO: 103399 - DNA, 75 bp, Artificial Sequence
  Synthetic
aatttgtggggccccttacagtaaatgaaaacaggagactaaaattaattatgcctgctaggttttatcccaatg

SEQ ID NO: 103400 - DNA, 75 bp, Artificial Sequence
  Synthetic
atccacaacattccaccaagctctgctagatcccagagtgaggggccctgctggtggctccagttccggaacagt

SEQ ID NO: 103401 - DNA, 75 bp, Artificial Sequence
  Synthetic
aggcctgtctttccctgctggtggctccagttcaggagcagtaaaccctgttccgactactgcctctcccttatc

SEQ ID NO: 103402 - DNA, 75 bp, Artificial Sequence
  Synthetic
tctagctacctgggtgggtgttaatttggaagatccagcatctagggacctagtagtcagttatgtcaacactaa

SEQ ID NO: 103403 - DNA, 75 bp, Artificial Sequence
  Synthetic
ctccacaaccttccaccaaactctgcaagatcccggagtgagaggcctccctgctggtggctccagttcaggaac

SEQ ID NO: 103404 - DNA, 75 bp, Artificial Sequence
  Synthetic
acagcatgggaggttggtcttccaaacctcgaaaaggcatggggacgaatctttctgttcccaatcctctgggat

SEQ ID NO: 103405 - DNA, 75 bp, Artificial Sequence
  Synthetic
atacatttaaaccctaacaaaacgaaacggtggggttattcccttcactttatgggatatgtgattggaagttgg

SEQ ID NO: 103406 - DNA, 75 bp, Artificial Sequence
  Synthetic
tcctgctcaaggaacctctatgtatccctcctgttgctgtacaaaaccttcggacggaaattgcacctgtattcc

SEQ ID NO: 103407 - DNA, 75 bp, Artificial Sequence
  Synthetic
caccacacggcactcaggcaagccattctttgctagaggaaactaatgactctagctacctaggtaagtgtaaat

SEQ ID NO: 103408 - DNA, 75 bp, Artificial Sequence
  Synthetic
tgcaattaattatgcctgctaggttttatccaaatgttaccaaatatttgccattagataagggtattaaacctt

SEQ ID NO: 103409 - DNA, 75 bp, Artificial Sequence
  Synthetic
tcgccagtcaggaaggcagcctaccccgctgtctccacctttgagaaacactcatcctcaggccatgcagtggaa

SEQ ID NO: 103410 - DNA, 75 bp, Artificial Sequence
  Synthetic
taaaattgatcatgcctgctaggttctatcctaatgttactaaatatttgcccttagataaaggaattaaacctt

SEQ ID NO: 103411 - DNA, 75 bp, Artificial Sequence
  Synthetic
tatttgcccctagagaaaggtataaaaccttattatccagataatgtagttaatcattacttccaaaccagacac

SEQ ID NO: 103412 - DNA, 75 bp, Artificial Sequence
  Synthetic
ctccacaacattccaccaagctctgctagaccccagagtgaggggcctatactttcctgctggtggctccagttc

SEQ ID NO: 103413 - DNA, 75 bp, Artificial Sequence
  Synthetic
ttggttcttctggactaccaaggtatgttgcccgtttgtcctctacttccaggaacatcaactaccagcacggga

SEQ ID NO: 103414 - DNA, 75 bp, Artificial Sequence
  Synthetic
aggaacatcaactaccagcacgggaccatgcaagacctgcacgattcctgctcaaggaacctctatgtttccctc

SEQ ID NO: 103415 - DNA, 75 bp, Artificial Sequence
  Synthetic
ctctgtggaaggctggtattctatataagagagaaactacacgcagcgcctcattttgtgggtcaccatattctt

SEQ ID NO: 103416 - DNA, 75 bp, Artificial Sequence
  Synthetic
ggtgggagctaatttggaagatccagcatctagggacctagttgttagttatgtcaacactaatatgggcttaaa

SEQ ID NO: 103417 - DNA, 75 bp, Artificial Sequence
  Synthetic
tcactcccccacacagaggccttttaaagtgaagccctcaggcttaaggcatgctaaaaacattgccaacagatc

SEQ ID NO: 103418 - DNA, 75 bp, Artificial Sequence
  Synthetic
ttggggtgagttgatgaatctggccacctgggtgggaagtaatttggaagacccagcatccagggaattagtagt

SEQ ID NO: 103419 - DNA, 75 bp, Artificial Sequence
  Synthetic
ccatacagcactcaggcaagctattctgtgttggggtgagttaatgaatctggccacctgggtgggaagtaattt

SEQ ID NO: 103420 - DNA, 75 bp, Artificial Sequence
  Synthetic
ttcaaaactaggcattatttacatactctgtggaaggctggtattctatataagagagaaactacacgcagcgcc

SEQ ID NO: 103421 - DNA, 75 bp, Artificial Sequence
  Synthetic
atacatttaaaccctaacaaaacaaaaagatggggttattccctaaacttcatgggatacataattggaagttgg

SEQ ID NO: 103422 - DNA, 75 bp, Artificial Sequence
  Synthetic
ttactgggctttattcttctactgtacctgtctttaatcctgagtggcaaactccctcttttcctaacattcatt

SEQ ID NO: 103423 - DNA, 75 bp, Artificial Sequence
  Synthetic
aagactgggaggagctgggggaggagattaggggctgggggcataaattgggctgctctccagccaccatgcaac

SEQ ID NO: 103424 - DNA, 75 bp, Artificial Sequence
  Synthetic
gatgtgtgtgcggcgttttatcatattcctcttcatcctgctgctatgcctcatcttcttgttggttcttctgga

SEQ ID NO: 103425 - DNA, 75 bp, Artificial Sequence
  Synthetic
atacatttaaaccctaacaagacaaaaagatggggttattctctacatttcatggggtatgtcattgattgttgg

SEQ ID NO: 103426 - DNA, 75 bp, Artificial Sequence
  Synthetic
gagcaccacatcaggattcctaggacccctgctcgtgttacaggcggggtttttcttgttgacaagaatcctcac

SEQ ID NO: 103427 - DNA, 75 bp, Artificial Sequence
  Synthetic
ctccacctttgagaaacacgcatcctcaggccatgcagtggaattccacaacctcccaccaaactgctggtggct

SEQ ID NO: 103428 - DNA, 75 bp, Artificial Sequence
  Synthetic
ctccacaacattccaccaagctctactagatcccagagtgaggggcctatatcttcctgctggtggctccagttc

SEQ ID NO: 103429 - DNA, 75 bp, Artificial Sequence
  Synthetic
ctccagcacattccaccaagctctgttagatcccagagtgaggggccttgctggtggctcaagttcaggaacagt

SEQ ID NO: 103430 - DNA, 75 bp, Artificial Sequence
  Synthetic
actcgacaccgcttcagccctctaccgggatgctttagaatcaccagaacattgcacacctaaccataccgctct

SEQ ID NO: 103431 - DNA, 75 bp, Artificial Sequence
  Synthetic
caggcaagctatattgtgctggggtgagttaatgactttggcttcctgggtgggcaataacttggaagatcctgc

SEQ ID NO: 103432 - DNA, 75 bp, Artificial Sequence
  Synthetic
tgcaattgattatgcctgctaggttttaccctaacgttaccaaatatttacccttagataagggtattaaacctt

SEQ ID NO: 103433 - DNA, 75 bp, Artificial Sequence
  Synthetic
gcagatccgcctcctgcctccaccaatcgtcagtcagggaggcagcctactcccatctctccaccactaagagac

SEQ ID NO: 103434 - DNA, 75 bp, Artificial Sequence
  Synthetic
tacatttacaccaagacatcatcaacaaatgtgaacagtttgtaggccctcttactgtcaatgagaaacgaagat

SEQ ID NO: 103435 - DNA, 75 bp, Artificial Sequence
  Synthetic
aaggtcttacataagaggactcttggactctcagcaatgtcaacgaccgaccttgaggcatacttcaaagactgt

SEQ ID NO: 103436 - DNA, 75 bp, Artificial Sequence
  Synthetic
ctgccttaatgcctttgtatgcatgtatacaagcaaaacaggcttttactttctcgccaacttacaaggcctttc

SEQ ID NO: 103437 - DNA, 75 bp, Artificial Sequence
  Synthetic
ttgccagcaaatccgcctcctgcatctaccaatcgccagtcaggaaggcagccgaccccgctgtctccacctttg

SEQ ID NO: 103438 - DNA, 75 bp, Artificial Sequence
  Synthetic
tcccagagtgaggggcctgtattttcctgctggtggctccagttcaggaacaataaaccctgttccgaatactgc

SEQ ID NO: 103439 - DNA, 75 bp, Artificial Sequence
  Synthetic
taaaattaattatgcctgctagattttatcccaatgttaccaaatacttgcccttagataaaggaatcaaaccct

SEQ ID NO: 103440 - DNA, 75 bp, Artificial Sequence
  Synthetic
ccagattgggacttcaatcccaaaaaggacaattggccagaggccaacaaggtaggagtgggagcatatggtccc

SEQ ID NO: 103441 - DNA, 75 bp, Artificial Sequence
  Synthetic
aaccctattatcctgataacgtggttaatcattattttaagaccagacactatttgcatactttatggaaagcag

SEQ ID NO: 103442 - DNA, 75 bp, Artificial Sequence
  Synthetic
ggaggttggtcttccaaacctcgacaaggcatggggacgaatctttccgttcccaatcctctgggattctttccc

SEQ ID NO: 103443 - DNA, 75 bp, Artificial Sequence
  Synthetic
gacaattggccaatggcaaacaaggtaggagtgggaggatacggtcctgggttcacacccccacacggtggcctg

SEQ ID NO: 103444 - DNA, 75 bp, Artificial Sequence
  Synthetic
tcctccaatttgtcctggctatcgctggatgtgtctgcggcgttttatcatattcctcttcatcctgctgctatg

SEQ ID NO: 103445 - DNA, 75 bp, Artificial Sequence
  Synthetic
gtcttttggagtgtggattcgcactcctcccgcttacagaccaccaaatgcccctatcttatcaacacttccgga

SEQ ID NO: 103446 - DNA, 75 bp, Artificial Sequence
  Synthetic
agagtctagactcgtggtggacttctctcaattttctagggggaacacccgtgtgtcttggccaaaattcgcagt

SEQ ID NO: 103447 - DNA, 75 bp, Artificial Sequence
  Synthetic
aaaatcaagcaatgttttcgcaaacttcctgtaaatagacctattgattggaaagtatgtcaaagaattgtgggt

SEQ ID NO: 103448 - DNA, 75 bp, Artificial Sequence
  Synthetic
tcgccagtcaggaaggcagcctaccccgctgtctccacctctgagagacactcatcctcaggccatgcagtggaa

SEQ ID NO: 103449 - DNA, 75 bp, Artificial Sequence
  Synthetic
cttctgggctttgctgccccttttacacaatgtggctatcctgccttaatgcctttgtatgcatgtatacaagct

SEQ ID NO: 103450 - DNA, 75 bp, Artificial Sequence
  Synthetic
gaacctctatgtttccctcatgttgctgtacaaaacctacggacggaaactgcacctgtattcccatcccatcat

SEQ ID NO: 103451 - DNA, 75 bp, Artificial Sequence
  Synthetic
tcttgagtccctttataccgctgttaccaattttcttttgtctttgggtatacatttaaaccctcacaaaacaaa

SEQ ID NO: 103452 - DNA, 75 bp, Artificial Sequence
  Synthetic
ttttctagggggagcacccacgtgtcctggccaaaattcgcagtccccaacctccaatcactcaccaacctcttg

SEQ ID NO: 103453 - DNA, 75 bp, Artificial Sequence
  Synthetic
tgggggaggagaataggttaatcattactttgtattaggaggctgtaggcataaattggtctgcgcaccagcacc

SEQ ID NO: 103454 - DNA, 75 bp, Artificial Sequence
  Synthetic
aactattgtggtttcacatttcctgtcttacttttggaagagaaactgttctagagtatttggtgtcttttggag

SEQ ID NO: 103455 - DNA, 75 bp, Artificial Sequence
  Synthetic
aatgtaaatgaaaaaaggagattaaagttaattatgcccgctagattttttcctaaccttaccaaatatttgccc

SEQ ID NO: 103456 - DNA, 75 bp, Artificial Sequence
  Synthetic
gcatgtatacaatctaagcaggctttcactttctcgccaacttacaaggcctttctgtgtaaacaatatctgaac

SEQ ID NO: 103457 - DNA, 75 bp, Artificial Sequence
  Synthetic
gattgggacttcaaccccatcaaggaccactggccacaagccaaccaggtaggagtgggagcattcgggccaggg

SEQ ID NO: 103458 - DNA, 75 bp, Artificial Sequence
  Synthetic
cctcctcctgcctccaccaatcggcagtcaggaaggcagcctactcccatctctccacctctaagagacagtcat

SEQ ID NO: 103459 - DNA, 75 bp, Artificial Sequence
  Synthetic
gagtcaggggcctgtattttcctgctggtggctccagttcaggaacactcaaccctgttccaactattgcctctc

SEQ ID NO: 103460 - DNA, 75 bp, Artificial Sequence
  Synthetic
cgcctctgctctgtatcgggaggccttagagtctccggaacattgttcacctcaccatacagcactcaggcaagc

SEQ ID NO: 103461 - DNA, 75 bp, Artificial Sequence
  Synthetic
attagtagtcagctatgtcaacgttaatatgggcctaaaaatcagacaactattgtggtttcacatttcctgtct

SEQ ID NO: 103462 - DNA, 75 bp, Artificial Sequence
  Synthetic
tgttagtattccttggactcataaggtgggaaactttactgggctttattcttctactgtacctgtctttaatcc

SEQ ID NO: 103463 - DNA, 75 bp, Artificial Sequence
  Synthetic
aatctttctgttcccaatcctctgggattctttcccgatcatcagttggaccctgcattcggagccaactcaaac

SEQ ID NO: 103464 - DNA, 75 bp, Artificial Sequence
  Synthetic
agtgagaggcctgtatttccctgctggtggctccagttcaggaacagtaaaccctgttccgactactgtctctcc

SEQ ID NO: 103465 - DNA, 75 bp, Artificial Sequence
  Synthetic
gtatccctcctgttgctgtaccaaaccttcggacggaaattgcacctgtattcccatcccatcatcctgggcttt

SEQ ID NO: 103466 - DNA, 75 bp, Artificial Sequence
  Synthetic
tgcccttggataaaggcattaaaccttattatcctgaacatgcagttaatcattacttcaaaactaggcattatt

SEQ ID NO: 103467 - DNA, 75 bp, Artificial Sequence
  Synthetic
atacatttaaaccctcataaaacaaaacgttggggttactcccttaacttcatgggatatgtaattggaagttgg

SEQ ID NO: 103468 - DNA, 75 bp, Artificial Sequence
  Synthetic
gcctcagtccgtttctcttggctcagtttactagtgccatttgttcagtggttcgcagggctttcccccactgtt

SEQ ID NO: 103469 - DNA, 75 bp, Artificial Sequence
  Synthetic
gattggaaagtgtgccaaagaattgtaggtcttttgggctttgttgccccttttacacaatgtggatatcctgcc

SEQ ID NO: 103470 - DNA, 75 bp, Artificial Sequence
  Synthetic
gttcccaatcctctgggattctttcccgatcaccagttggaccctgcattcggagccaactcaaacaatccagat

SEQ ID NO: 103471 - DNA, 75 bp, Artificial Sequence
  Synthetic
cagcgcatgcgtggaacctttctggctcctctgccgatccatactgcggaactcctagccgcttgctttgctcgc

SEQ ID NO: 103472 - DNA, 75 bp, Artificial Sequence
  Synthetic
aaggaatgttttagaaaacttcctgttaacagacctattgattggaaagtctgtcaacgtattgtgggtcttttg

SEQ ID NO: 103473 - DNA, 75 bp, Artificial Sequence
  Synthetic
tctcggaaatacacctcctttccatggctgctaggatgtgctgccaactggatcctgcgcgggacgtcctttgtt

SEQ ID NO: 103474 - DNA, 75 bp, Artificial Sequence
  Synthetic
caatgtcaacgaccgaccttgaggcatacttcaaagactgtttgtttaaggactgggaggagttgggggaggaga

SEQ ID NO: 103475 - DNA, 75 bp, Artificial Sequence
  Synthetic
aatttggagcttctgtggagttactctctttttgccttctgacttctttccttctattcgagatctcctcgacac

SEQ ID NO: 103476 - DNA, 75 bp, Artificial Sequence
  Synthetic
ttagattaatgatctttgtactaggaggctgtaggcataaattggtctgcgcaccagcaccatgcaactttttca

SEQ ID NO: 103477 - DNA, 75 bp, Artificial Sequence
  Synthetic
gtggtttcacatttcttgtctcacttttggaagagatacagtcatagagtatttggtgtctttcggagtgtggat

SEQ ID NO: 103478 - DNA, 75 bp, Artificial Sequence
  Synthetic
ggtacattgccacaggatcatattatacaaaaaatcaaacactgttttaggaaacttcctgtcaatcgacctatt

SEQ ID NO: 103479 - DNA, 75 bp, Artificial Sequence
  Synthetic
tttttcacctctgcctagtcatctcttgttcatgtcctactgttcatactaggaagctgtgccttgggtggcttt

SEQ ID NO: 103480 - DNA, 75 bp, Artificial Sequence
  Synthetic
ccccatggaactttttcacctcttcctaatcctctcttggtcctgtcctactggtccaacctcccagctgtgcct

SEQ ID NO: 103481 - DNA, 75 bp, Artificial Sequence
  Synthetic
taaggactgggaggagttgggggaggagattaggttaatgatctttgtattaggaggctgtaggcataaattggt

SEQ ID NO: 103482 - DNA, 75 bp, Artificial Sequence
  Synthetic
ggggagcattaccccaagatcatattgtacacaaaatcaaagaatgttttagaaaacttcctgtaaatcgtccaa

SEQ ID NO: 103483 - DNA, 75 bp, Artificial Sequence
  Synthetic
tatgggcctcaagttcagacaactcttgtggtttcacgtttcttgtctcatgtttggacgagatttagttttaga

SEQ ID NO: 103484 - DNA, 75 bp, Artificial Sequence
  Synthetic
ctccacaacattccagcaagctctgctcgatccgagagtaaggggtctgtatttccctgctggtggctccagttc

SEQ ID NO: 103485 - DNA, 75 bp, Artificial Sequence
  Synthetic
catgggcctaaaaattagacaactattgtggtttcacatttcctgtcttacttttggaagagaaactgttcttga

SEQ ID NO: 103486 - DNA, 75 bp, Artificial Sequence
  Synthetic
ttcatttgcatcaagacctgatttctaaatgtgaacaatttgtaggcccacttactaaaaatgaattgcgaagat

SEQ ID NO: 103487 - DNA, 75 bp, Artificial Sequence
  Synthetic
gaccactggccacaagccaaccaggtaggagtgggagcattcggcccagggttcactcccccacacggaggtgtt

SEQ ID NO: 103488 - DNA, 75 bp, Artificial Sequence
  Synthetic
cttcttgttggttcttctggactatcaaggtatgttgcccgtatgtcctctaattccaggatcatcaaccaccag

SEQ ID NO: 103489 - DNA, 75 bp, Artificial Sequence
  Synthetic
cttcttgttggttcttctggactatcaaggtatgttgcccgtatgtcctctaattccaggatcttcaaccaccag

SEQ ID NO: 103490 - DNA, 75 bp, Artificial Sequence
  Synthetic
cttcttgttggttcttctggactatcaaggtatgttgcccgtatgtcctctaattccaggatcctcaaccaccag

SEQ ID NO: 103491 - DNA, 75 bp, Artificial Sequence
  Synthetic
cttcttgttggttcttctggactatcaaggtatgttgcccgtatgtcctctaattccaggatcgtcaaccaccag

SEQ ID NO: 103492 - DNA, 75 bp, Artificial Sequence
  Synthetic
cttcttgttggttcttctggactatcaaggtatgttgcccgtttgtcctctaattccaggatcatcaaccaccag

SEQ ID NO: 103493 - DNA, 75 bp, Artificial Sequence
  Synthetic
cttcttgttggttcttctggactatcaaggtatgttgcccgtttgtcctctaattccaggatcttcaaccaccag

SEQ ID NO: 103494 - DNA, 75 bp, Artificial Sequence
  Synthetic
cttcttgttggttcttctggactatcaaggtatgttgcccgtttgtcctctaattccaggatcctcaaccaccag

SEQ ID NO: 103495 - DNA, 75 bp, Artificial Sequence
  Synthetic
cttcttgttggttcttctggactatcaaggtatgttgcccgtttgtcctctaattccaggatcgtcaaccaccag

SEQ ID NO: 103496 - DNA, 75 bp, Artificial Sequence
  Synthetic
cttcttgttggttcttctggactatcaaggtatgttgcccgtctgtcctctaattccaggatcatcaaccaccag

SEQ ID NO: 103497 - DNA, 75 bp, Artificial Sequence
  Synthetic
cttcttgttggttcttctggactatcaaggtatgttgcccgtctgtcctctaattccaggatcttcaaccaccag

SEQ ID NO: 103498 - DNA, 75 bp, Artificial Sequence
  Synthetic
cttcttgttggttcttctggactatcaaggtatgttgcccgtctgtcctctaattccaggatcctcaaccaccag

SEQ ID NO: 103499 - DNA, 75 bp, Artificial Sequence
  Synthetic
cttcttgttggttcttctggactatcaaggtatgttgcccgtctgtcctctaattccaggatcgtcaaccaccag

SEQ ID NO: 103500 - DNA, 75 bp, Artificial Sequence
  Synthetic
cttcttgttggttcttctggactatcaaggtatgttgcccgtgtgtcctctaattccaggatcatcaaccaccag

SEQ ID NO: 103501 - DNA, 75 bp, Artificial Sequence
  Synthetic
cttcttgttggttcttctggactatcaaggtatgttgcccgtgtgtcctctaattccaggatcttcaaccaccag

SEQ ID NO: 103502 - DNA, 75 bp, Artificial Sequence
  Synthetic
cttcttgttggttcttctggactatcaaggtatgttgcccgtgtgtcctctaattccaggatcctcaaccaccag

SEQ ID NO: 103503 - DNA, 75 bp, Artificial Sequence
  Synthetic
cttcttgttggttcttctggactatcaaggtatgttgcccgtgtgtcctctaattccaggatcgtcaaccaccag

SEQ ID NO: 103504 - DNA, 75 bp, Artificial Sequence
  Synthetic
cttcttgttggttcttctggactttcaaggtatgttgcccgtatgtcctctaattccaggatcatcaaccaccag

SEQ ID NO: 103505 - DNA, 75 bp, Artificial Sequence
  Synthetic
cttcttgttggttcttctggactttcaaggtatgttgcccgtatgtcctctaattccaggatcttcaaccaccag

SEQ ID NO: 103506 - DNA, 75 bp, Artificial Sequence
  Synthetic
cttcttgttggttcttctggactttcaaggtatgttgcccgtatgtcctctaattccaggatcctcaaccaccag

SEQ ID NO: 103507 - DNA, 75 bp, Artificial Sequence
  Synthetic
cttcttgttggttcttctggactttcaaggtatgttgcccgtatgtcctctaattccaggatcgtcaaccaccag

SEQ ID NO: 103508 - DNA, 75 bp, Artificial Sequence
  Synthetic
cttcttgttggttcttctggactttcaaggtatgttgcccgtttgtcctctaattccaggatcatcaaccaccag

SEQ ID NO: 103509 - DNA, 75 bp, Artificial Sequence
  Synthetic
cttcttgttggttcttctggactttcaaggtatgttgcccgtttgtcctctaattccaggatcttcaaccaccag

SEQ ID NO: 103510 - DNA, 75 bp, Artificial Sequence
  Synthetic
cttcttgttggttcttctggactttcaaggtatgttgcccgtttgtcctctaattccaggatcctcaaccaccag

SEQ ID NO: 103511 - DNA, 75 bp, Artificial Sequence
  Synthetic
cttcttgttggttcttctggactttcaaggtatgttgcccgtttgtcctctaattccaggatcgtcaaccaccag

SEQ ID NO: 103512 - DNA, 75 bp, Artificial Sequence
  Synthetic
cttcttgttggttcttctggactttcaaggtatgttgcccgtctgtcctctaattccaggatcatcaaccaccag

SEQ ID NO: 103513 - DNA, 75 bp, Artificial Sequence
  Synthetic
cttcttgttggttcttctggactttcaaggtatgttgcccgtctgtcctctaattccaggatcttcaaccaccag

SEQ ID NO: 103514 - DNA, 75 bp, Artificial Sequence
  Synthetic
cttcttgttggttcttctggactttcaaggtatgttgcccgtctgtcctctaattccaggatcctcaaccaccag

SEQ ID NO: 103515 - DNA, 75 bp, Artificial Sequence
  Synthetic
cttcttgttggttcttctggactttcaaggtatgttgcccgtctgtcctctaattccaggatcgtcaaccaccag

SEQ ID NO: 103516 - DNA, 75 bp, Artificial Sequence
  Synthetic
cttcttgttggttcttctggactttcaaggtatgttgcccgtgtgtcctctaattccaggatcatcaaccaccag

SEQ ID NO: 103517 - DNA, 75 bp, Artificial Sequence
  Synthetic
cttcttgttggttcttctggactttcaaggtatgttgcccgtgtgtcctctaattccaggatcttcaaccaccag

SEQ ID NO: 103518 - DNA, 75 bp, Artificial Sequence
  Synthetic
cttcttgttggttcttctggactttcaaggtatgttgcccgtgtgtcctctaattccaggatcctcaaccaccag

SEQ ID NO: 103519 - DNA, 75 bp, Artificial Sequence
  Synthetic
cttcttgttggttcttctggactttcaaggtatgttgcccgtgtgtcctctaattccaggatcgtcaaccaccag

SEQ ID NO: 103520 - DNA, 75 bp, Artificial Sequence
  Synthetic
cttcttgttggttcttctggactctcaaggtatgttgcccgtatgtcctctaattccaggatcatcaaccaccag

SEQ ID NO: 103521 - DNA, 75 bp, Artificial Sequence
  Synthetic
cttcttgttggttcttctggactctcaaggtatgttgcccgtatgtcctctaattccaggatcttcaaccaccag

SEQ ID NO: 103522 - DNA, 75 bp, Artificial Sequence
  Synthetic
cttcttgttggttcttctggactctcaaggtatgttgcccgtatgtcctctaattccaggatcctcaaccaccag

SEQ ID NO: 103523 - DNA, 75 bp, Artificial Sequence
  Synthetic
cttcttgttggttcttctggactctcaaggtatgttgcccgtatgtcctctaattccaggatcgtcaaccaccag

SEQ ID NO: 103524 - DNA, 75 bp, Artificial Sequence
  Synthetic
cttcttgttggttcttctggactctcaaggtatgttgcccgtttgtcctctaattccaggatcatcaaccaccag

SEQ ID NO: 103525 - DNA, 75 bp, Artificial Sequence
  Synthetic
cttcttgttggttcttctggactctcaaggtatgttgcccgtttgtcctctaattccaggatcttcaaccaccag

SEQ ID NO: 103526 - DNA, 75 bp, Artificial Sequence
  Synthetic
cttcttgttggttcttctggactctcaaggtatgttgcccgtttgtcctctaattccaggatcctcaaccaccag

SEQ ID NO: 103527 - DNA, 75 bp, Artificial Sequence
  Synthetic
cttcttgttggttcttctggactctcaaggtatgttgcccgtttgtcctctaattccaggatcgtcaaccaccag

SEQ ID NO: 103528 - DNA, 75 bp, Artificial Sequence
  Synthetic
cttcttgttggttcttctggactctcaaggtatgttgcccgtctgtcctctaattccaggatcatcaaccaccag

SEQ ID NO: 103529 - DNA, 75 bp, Artificial Sequence
  Synthetic
cttcttgttggttcttctggactctcaaggtatgttgcccgtctgtcctctaattccaggatcttcaaccaccag

SEQ ID NO: 103530 - DNA, 75 bp, Artificial Sequence
  Synthetic
cttcttgttggttcttctggactctcaaggtatgttgcccgtctgtcctctaattccaggatcctcaaccaccag

SEQ ID NO: 103531 - DNA, 75 bp, Artificial Sequence
  Synthetic
cttcttgttggttcttctggactctcaaggtatgttgcccgtctgtcctctaattccaggatcgtcaaccaccag

SEQ ID NO: 103532 - DNA, 75 bp, Artificial Sequence
  Synthetic
cttcttgttggttcttctggactctcaaggtatgttgcccgtgtgtcctctaattccaggatcatcaaccaccag

SEQ ID NO: 103533 - DNA, 75 bp, Artificial Sequence
  Synthetic
cttcttgttggttcttctggactctcaaggtatgttgcccgtgtgtcctctaattccaggatcttcaaccaccag

SEQ ID NO: 103534 - DNA, 75 bp, Artificial Sequence
  Synthetic
cttcttgttggttcttctggactctcaaggtatgttgcccgtgtgtcctctaattccaggatcctcaaccaccag

SEQ ID NO: 103535 - DNA, 75 bp, Artificial Sequence
  Synthetic
cttcttgttggttcttctggactctcaaggtatgttgcccgtgtgtcctctaattccaggatcgtcaaccaccag

SEQ ID NO: 103536 - DNA, 75 bp, Artificial Sequence
  Synthetic
cttcttgttggttcttctggactgtcaaggtatgttgcccgtatgtcctctaattccaggatcatcaaccaccag

SEQ ID NO: 103537 - DNA, 75 bp, Artificial Sequence
  Synthetic
cttcttgttggttcttctggactgtcaaggtatgttgcccgtatgtcctctaattccaggatcttcaaccaccag

SEQ ID NO: 103538 - DNA, 75 bp, Artificial Sequence
  Synthetic
cttcttgttggttcttctggactgtcaaggtatgttgcccgtatgtcctctaattccaggatcctcaaccaccag

SEQ ID NO: 103539 - DNA, 75 bp, Artificial Sequence
  Synthetic
cttcttgttggttcttctggactgtcaaggtatgttgcccgtatgtcctctaattccaggatcgtcaaccaccag

SEQ ID NO: 103540 - DNA, 75 bp, Artificial Sequence
  Synthetic
cttcttgttggttcttctggactgtcaaggtatgttgcccgtttgtcctctaattccaggatcatcaaccaccag

SEQ ID NO: 103541 - DNA, 75 bp, Artificial Sequence
  Synthetic
cttcttgttggttcttctggactgtcaaggtatgttgcccgtttgtcctctaattccaggatcttcaaccaccag

SEQ ID NO: 103542 - DNA, 75 bp, Artificial Sequence
  Synthetic
cttcttgttggttcttctggactgtcaaggtatgttgcccgtttgtcctctaattccaggatcctcaaccaccag

SEQ ID NO: 103543 - DNA, 75 bp, Artificial Sequence
  Synthetic
cttcttgttggttcttctggactgtcaaggtatgttgcccgtttgtcctctaattccaggatcgtcaaccaccag

SEQ ID NO: 103544 - DNA, 75 bp, Artificial Sequence
  Synthetic
cttcttgttggttcttctggactgtcaaggtatgttgcccgtctgtcctctaattccaggatcatcaaccaccag

SEQ ID NO: 103545 - DNA, 75 bp, Artificial Sequence
  Synthetic
cttcttgttggttcttctggactgtcaaggtatgttgcccgtctgtcctctaattccaggatcttcaaccaccag

SEQ ID NO: 103546 - DNA, 75 bp, Artificial Sequence
  Synthetic
cttcttgttggttcttctggactgtcaaggtatgttgcccgtctgtcctctaattccaggatcctcaaccaccag

SEQ ID NO: 103547 - DNA, 75 bp, Artificial Sequence
  Synthetic
cttcttgttggttcttctggactgtcaaggtatgttgcccgtctgtcctctaattccaggatcgtcaaccaccag

SEQ ID NO: 103548 - DNA, 75 bp, Artificial Sequence
  Synthetic
cttcttgttggttcttctggactgtcaaggtatgttgcccgtgtgtcctctaattccaggatcatcaaccaccag

SEQ ID NO: 103549 - DNA, 75 bp, Artificial Sequence
  Synthetic
cttcttgttggttcttctggactgtcaaggtatgttgcccgtgtgtcctctaattccaggatcttcaaccaccag

SEQ ID NO: 103550 - DNA, 75 bp, Artificial Sequence
  Synthetic
cttcttgttggttcttctggactgtcaaggtatgttgcccgtgtgtcctctaattccaggatcctcaaccaccag

SEQ ID NO: 103551 - DNA, 75 bp, Artificial Sequence
  Synthetic
cttcttgttggttcttctggactgtcaaggtatgttgcccgtgtgtcctctaattccaggatcgtcaaccaccag

SEQ ID NO: 103552 - DNA, 75 bp, Artificial Sequence
  Synthetic
gatgaggttaggttaaaggtcttgtatctaggaggctgtaggcataaattggtctgttcaccagcaccatgcaac

SEQ ID NO: 103553 - DNA, 75 bp, Artificial Sequence
  Synthetic
tccttcagtaagagatcttctagataccgcctcagctctgtatcgggatgccttagaatctcctgagcattgctc

SEQ ID NO: 103554 - DNA, 75 bp, Artificial Sequence
  Synthetic
tcttttttgccttctgatttcttcccgtcggttcgggacctactcgacaccgcttcagctctctacagggatgct

SEQ ID NO: 103555 - DNA, 75 bp, Artificial Sequence
  Synthetic
aaacttggaagatccagcatccagggacctagtagtcagttatgtcaatactaatatgggcctaaagttcaggca

SEQ ID NO: 103556 - DNA, 75 bp, Artificial Sequence
  Synthetic
actggctggggcttggccataggccatcagcgcatgcgtggaacctttgtgtctcctctgccgatccatactgcg

SEQ ID NO: 103557 - DNA, 75 bp, Artificial Sequence
  Synthetic
ttcctattaacaggcctattgattggaaagtatgtcaacgcattgtgggtcttttgggttttgctgccccattta

SEQ ID NO: 103558 - DNA, 75 bp, Artificial Sequence
  Synthetic
tattcatttgcatcaagacctgatatctaaatgtgaacaatttgtaggcccacttaccaaaaatgaattgagaag

SEQ ID NO: 103559 - DNA, 75 bp, Artificial Sequence
  Synthetic
tttactagtgccatttgttcagtggttcgtagggctttcccccactgtctggcttttagttatatggatgatgtg

SEQ ID NO: 103560 - DNA, 75 bp, Artificial Sequence
  Synthetic
tcggcagtcaggaagacaacccactcccatctcaccacctctaagagacactcatcctcaggccatgcagtggaa

SEQ ID NO: 103561 - DNA, 75 bp, Artificial Sequence
  Synthetic
atacatttaaaccctaacaaaacaaagagatggggttattctctaaatttcatgggctatgtcattggatgttgg

SEQ ID NO: 103562 - DNA, 75 bp, Artificial Sequence
  Synthetic
cgtagcgcctcattttgcgggtcaccatattcttgggaacaagagctacagcatgggaggttggtcttccaaacc

SEQ ID NO: 103563 - DNA, 75 bp, Artificial Sequence
  Synthetic
ttgattggaaagtatgtcaacgaattgtgggtcttttggggtttgccgcccctttcacgcaatgtggatatcctg

SEQ ID NO: 103564 - DNA, 75 bp, Artificial Sequence
  Synthetic
tccacacggaggtgttttggggtggagccctcaggctcagggcatattggccacagtgccagcagtgcctcctcc

SEQ ID NO: 103565 - DNA, 75 bp, Artificial Sequence
  Synthetic
tacatttacatcaagacattatcaaaaaatgtgaacaatttgtaggtccactcacagtcaatgagaaaagaagac

SEQ ID NO: 103566 - DNA, 75 bp, Artificial Sequence
  Synthetic
ctaaaattcatttacatgaagacattactaataggtgtcagcaatttgtaggccctctcactgtaaatgaaaaga

SEQ ID NO: 103567 - DNA, 75 bp, Artificial Sequence
  Synthetic
ctccacaacattccaccaagctctgctagatcccagagtgaggggcctacctgctggtggctccagttccggaac

SEQ ID NO: 103568 - DNA, 75 bp, Artificial Sequence
  Synthetic
actggatgggggttggccataggccatcggcgcatgcgtggaacctttgtggctcctctgccgatccatactgcg

SEQ ID NO: 103569 - DNA, 75 bp, Artificial Sequence
  Synthetic
actggatggggctggcccataggccatcagcgcatgcgtggaaccttggaggctccttggctcctccatagttcc

SEQ ID NO: 103570 - DNA, 75 bp, Artificial Sequence
  Synthetic
atacatttgaatcctgataaaacgaaaagatgggggtattcccttcatttcatgggttacgtgatcggaagttgg

SEQ ID NO: 103571 - DNA, 75 bp, Artificial Sequence
  Synthetic
tcttggaatttcacatcctctccatggttgcaagggtgtgctgccaagtggaccattggagggacgtcgggagtt

SEQ ID NO: 103572 - DNA, 75 bp, Artificial Sequence
  Synthetic
tacgtgccgtcggcccggaatcccgcggacgaccggtctcgccgccgtggggccgtttgcggtccccttgttcct

SEQ ID NO: 103573 - DNA, 75 bp, Artificial Sequence
  Synthetic
tccctgcccttcggctcacctctgcaccttgcatggaaaccaccgtgaagaccccccgagcccccccccaagccc

SEQ ID NO: 103574 - DNA, 75 bp, Artificial Sequence
  Synthetic
gaactcctagccggttgttttgcttgcagccggtttgggacaaaccttattggtaccgacaaatttgttgttctt

SEQ ID NO: 103575 - DNA, 75 bp, Artificial Sequence
  Synthetic
tttcggaaatacacctcctttccatgggtggtagggtgtgctgccaaacggatccttcgggggacgtcctttgtt

SEQ ID NO: 103576 - DNA, 75 bp, Artificial Sequence
  Synthetic
ttcatttacaggaggacattatcaatagatgtcaacaatatgtaggccctcttacagttaatgaaaaaaggagat

SEQ ID NO: 103577 - DNA, 75 bp, Artificial Sequence
  Synthetic
ctggcggtccggccccccccggggcgcccccctctttacgcggtcttcccgtttgcgccttttcattcgccggac

SEQ ID NO: 103578 - DNA, 75 bp, Artificial Sequence
  Synthetic
aaacaatatctaaacctttaccccgttgcccggcaacggtcaggttttcgaccagtgtttggtggcgcaaccccc

SEQ ID NO: 103579 - DNA, 75 bp, Artificial Sequence
  Synthetic
ttaatgcctttatatgcatgtatacacgctaagcaggcttttactttttcccacacttacaaggcctttctacgc

SEQ ID NO: 103580 - DNA, 75 bp, Artificial Sequence
  Synthetic
caaatgcccctatcttatcaacacttccggaaactactgttgttagacgacgaggcaggtcccctagaagaagaa

SEQ ID NO: 103581 - DNA, 75 bp, Artificial Sequence
  Synthetic
tggctccagttcaggaacagtgagcctgctcagaatactttttgccatatcgtcatctatcgagactgggacctg

SEQ ID NO: 103582 - DNA, 75 bp, Artificial Sequence
  Synthetic
cagttggaccctgcgttcggagccaactcaaacaatccagattgggacttcaaccccaacaaggatcactggcca

SEQ ID NO: 103583 - DNA, 75 bp, Artificial Sequence
  Synthetic
tggccaaaattcgcagtccccaacctccaatcactcaccaacctcttgtcctccaacttgtcctggctatcgctg

SEQ ID NO: 103584 - DNA, 75 bp, Artificial Sequence
  Synthetic
gaaactttacggggctttattcttctacggtacctggctttaatcctgaatggcaaactccttcttttcctgaca

SEQ ID NO: 103585 - DNA, 75 bp, Artificial Sequence
  Synthetic
accaattttcttttgtctttgggtatacatttaaaccctaacaaaacaaaaagatggggttattccctgaatttc

SEQ ID NO: 103586 - DNA, 75 bp, Artificial Sequence
  Synthetic
cacgactcctgctcaaggcaactctatgtctcccccctgctgctgtagaagagctacggatcgaaattgcatctg

SEQ ID NO: 103587 - DNA, 75 bp, Artificial Sequence
  Synthetic
tttcgcttcctgggtgggcaataatttgcaagacgctgcagccagggatttagtagtcgactatgttaacactca

SEQ ID NO: 103588 - DNA, 75 bp, Artificial Sequence
  Synthetic
tgccagcaaatccacctcctgcctccaccaatcgccagtcaggaaggcagcctaccccgctgtctccacctttga

SEQ ID NO: 103589 - DNA, 75 bp, Artificial Sequence
  Synthetic
gaactcctagcggcttgttttgctcgcagccggtctggagcaaaacttatcggaaccgacaactctgttgtcctc

SEQ ID NO: 103590 - DNA, 75 bp, Artificial Sequence
  Synthetic
ctcaacacagttccaccaagcactgttggatccgagagtaaggggtctgtattttcctgctggtggctccagttc

SEQ ID NO: 103591 - DNA, 75 bp, Artificial Sequence
  Synthetic
agagtctcctgaacattgttcacctcaccatactgcactcaggcaagcaattctttgctggggagaactaatgac

SEQ ID NO: 103592 - DNA, 75 bp, Artificial Sequence
  Synthetic
ttcatttgcaggaggatattgttgataggtgtaaacaatttgtgggacccctcacagtaaatgaaaacaggagac

SEQ ID NO: 103593 - DNA, 75 bp, Artificial Sequence
  Synthetic
aaacaatatctgaacctttaccccgttccccaaaaacggtcaggtctctgcgaagtgttaagagacgcaaccccc

SEQ ID NO: 103594 - DNA, 75 bp, Artificial Sequence
  Synthetic
gaactccaagcagcttgttttgctaacagccggtctggagggaaacttatcggaaccaacaactctgttgtcctc

SEQ ID NO: 103595 - DNA, 75 bp, Artificial Sequence
  Synthetic
tctagctacctgggtgggtgtaaatttggaagatccagcatccagggatctagtagtcagttatgtcaatactaa

SEQ ID NO: 103596 - DNA, 75 bp, Artificial Sequence
  Synthetic
ctccacaacattccaccaagctctgttagaccccagagtgaggggccttcctgctggtggctccagttccggaac

SEQ ID NO: 103597 - DNA, 75 bp, Artificial Sequence
  Synthetic
gattggaaagtatgtcagagaattgtgggtcttttgggcttcgctgccccttttacacaatgtggctatcctgcc

SEQ ID NO: 103598 - DNA, 75 bp, Artificial Sequence
  Synthetic
tggccggacgccaacaaggtgggagtgggagcattcgggccagggttcacccctccacatgggggactgttgggg

SEQ ID NO: 103599 - DNA, 75 bp, Artificial Sequence
  Synthetic
tgagtgggaggagttgggggaggaggttaggttaatgatctttgtactaggaggctgtaggcataaattggtgtg

SEQ ID NO: 103600 - DNA, 75 bp, Artificial Sequence
  Synthetic
tgggcctaaaaatcagacaactattgtggtttcacatttcctgtcttacttttggaagagaaactgttcttgaat

SEQ ID NO: 103601 - DNA, 75 bp, Artificial Sequence
  Synthetic
tttcttgccttctgacttctttccgtcggttcgggatctcctagacaccgccactgctttgtatcgagaagcctt

SEQ ID NO: 103602 - DNA, 75 bp, Artificial Sequence
  Synthetic
aactttacggggctttattcttctacggtacctcgctttaatcctaattggcaaactccttcttttcctgacatt

SEQ ID NO: 103603 - DNA, 75 bp, Artificial Sequence
  Synthetic
cccggcaacggtcaggtctctgccaagtgtttgctgacgcaacccccactggatggggcttggcaataggccatc

SEQ ID NO: 103604 - DNA, 75 bp, Artificial Sequence
  Synthetic
cccggcaacggtcaggtctctgccaagtgtttgctgacgcaacccccactggatggggcttggcaattggccatc

SEQ ID NO: 103605 - DNA, 75 bp, Artificial Sequence
  Synthetic
cccggcaacggtcaggtctctgccaagtgtttgctgacgcaacccccactggatggggcttggcaatcggccatc

SEQ ID NO: 103606 - DNA, 75 bp, Artificial Sequence
  Synthetic
cccggcaacggtcaggtctctgccaagtgtttgctgacgcaacccccactggatggggcttggcaatgggccatc

SEQ ID NO: 103607 - DNA, 75 bp, Artificial Sequence
  Synthetic
cccggcaacggtcaggtctctgccaagtgtttgctgacgcaacccccactggatggggcttggctataggccatc

SEQ ID NO: 103608 - DNA, 75 bp, Artificial Sequence
  Synthetic
cccggcaacggtcaggtctctgccaagtgtttgctgacgcaacccccactggatggggcttggctattggccatc

SEQ ID NO: 103609 - DNA, 75 bp, Artificial Sequence
  Synthetic
cccggcaacggtcaggtctctgccaagtgtttgctgacgcaacccccactggatggggcttggctatcggccatc

SEQ ID NO: 103610 - DNA, 75 bp, Artificial Sequence
  Synthetic
cccggcaacggtcaggtctctgccaagtgtttgctgacgcaacccccactggatggggcttggctatgggccatc

SEQ ID NO: 103611 - DNA, 75 bp, Artificial Sequence
  Synthetic
cccggcaacggtcaggtctctgccaagtgtttgctgacgcaacccccactggatggggcttggccataggccatc

SEQ ID NO: 103612 - DNA, 75 bp, Artificial Sequence
  Synthetic
cccggcaacggtcaggtctctgccaagtgtttgctgacgcaacccccactggatggggcttggccattggccatc

SEQ ID NO: 103613 - DNA, 75 bp, Artificial Sequence
  Synthetic
cccggcaacggtcaggtctctgccaagtgtttgctgacgcaacccccactggatggggcttggccatcggccatc

SEQ ID NO: 103614 - DNA, 75 bp, Artificial Sequence
  Synthetic
cccggcaacggtcaggtctctgccaagtgtttgctgacgcaacccccactggatggggcttggccatgggccatc

SEQ ID NO: 103615 - DNA, 75 bp, Artificial Sequence
  Synthetic
cccggcaacggtcaggtctctgccaagtgtttgctgacgcaacccccactggatggggcttggcgataggccatc

SEQ ID NO: 103616 - DNA, 75 bp, Artificial Sequence
  Synthetic
cccggcaacggtcaggtctctgccaagtgtttgctgacgcaacccccactggatggggcttggcgattggccatc

SEQ ID NO: 103617 - DNA, 75 bp, Artificial Sequence
  Synthetic
cccggcaacggtcaggtctctgccaagtgtttgctgacgcaacccccactggatggggcttggcgatcggccatc

SEQ ID NO: 103618 - DNA, 75 bp, Artificial Sequence
  Synthetic
cccggcaacggtcaggtctctgccaagtgtttgctgacgcaacccccactggatggggcttggcgatgggccatc

SEQ ID NO: 103619 - DNA, 75 bp, Artificial Sequence
  Synthetic
cccggcaacggtcaggtctctgccaagtgtttgctgacgcaacccccactggttggggcttggcaataggccatc

SEQ ID NO: 103620 - DNA, 75 bp, Artificial Sequence
  Synthetic
cccggcaacggtcaggtctctgccaagtgtttgctgacgcaacccccactggttggggcttggcaattggccatc

SEQ ID NO: 103621 - DNA, 75 bp, Artificial Sequence
  Synthetic
cccggcaacggtcaggtctctgccaagtgtttgctgacgcaacccccactggttggggcttggcaatcggccatc

SEQ ID NO: 103622 - DNA, 75 bp, Artificial Sequence
  Synthetic
cccggcaacggtcaggtctctgccaagtgtttgctgacgcaacccccactggttggggcttggcaatgggccatc

SEQ ID NO: 103623 - DNA, 75 bp, Artificial Sequence
  Synthetic
cccggcaacggtcaggtctctgccaagtgtttgctgacgcaacccccactggttggggcttggctataggccatc

SEQ ID NO: 103624 - DNA, 75 bp, Artificial Sequence
  Synthetic
cccggcaacggtcaggtctctgccaagtgtttgctgacgcaacccccactggttggggcttggctattggccatc

SEQ ID NO: 103625 - DNA, 75 bp, Artificial Sequence
  Synthetic
cccggcaacggtcaggtctctgccaagtgtttgctgacgcaacccccactggttggggcttggctatcggccatc

SEQ ID NO: 103626 - DNA, 75 bp, Artificial Sequence
  Synthetic
cccggcaacggtcaggtctctgccaagtgtttgctgacgcaacccccactggttggggcttggctatgggccatc

SEQ ID NO: 103627 - DNA, 75 bp, Artificial Sequence
  Synthetic
cccggcaacggtcaggtctctgccaagtgtttgctgacgcaacccccactggttggggcttggccataggccatc

SEQ ID NO: 103628 - DNA, 75 bp, Artificial Sequence
  Synthetic
cccggcaacggtcaggtctctgccaagtgtttgctgacgcaacccccactggttggggcttggccattggccatc

SEQ ID NO: 103629 - DNA, 75 bp, Artificial Sequence
  Synthetic
cccggcaacggtcaggtctctgccaagtgtttgctgacgcaacccccactggttggggcttggccatcggccatc

SEQ ID NO: 103630 - DNA, 75 bp, Artificial Sequence
  Synthetic
cccggcaacggtcaggtctctgccaagtgtttgctgacgcaacccccactggttggggcttggccatgggccatc

SEQ ID NO: 103631 - DNA, 75 bp, Artificial Sequence
  Synthetic
cccggcaacggtcaggtctctgccaagtgtttgctgacgcaacccccactggttggggcttggcgataggccatc

SEQ ID NO: 103632 - DNA, 75 bp, Artificial Sequence
  Synthetic
cccggcaacggtcaggtctctgccaagtgtttgctgacgcaacccccactggttggggcttggcgattggccatc

SEQ ID NO: 103633 - DNA, 75 bp, Artificial Sequence
  Synthetic
cccggcaacggtcaggtctctgccaagtgtttgctgacgcaacccccactggttggggcttggcgatcggccatc

SEQ ID NO: 103634 - DNA, 75 bp, Artificial Sequence
  Synthetic
cccggcaacggtcaggtctctgccaagtgtttgctgacgcaacccccactggttggggcttggcgatgggccatc

SEQ ID NO: 103635 - DNA, 75 bp, Artificial Sequence
  Synthetic
cccggcaacggtcaggtctctgccaagtgtttgctgacgcaacccccactggctggggcttggcaataggccatc

SEQ ID NO: 103636 - DNA, 75 bp, Artificial Sequence
  Synthetic
cccggcaacggtcaggtctctgccaagtgtttgctgacgcaacccccactggctggggcttggcaattggccatc

SEQ ID NO: 103637 - DNA, 75 bp, Artificial Sequence
  Synthetic
cccggcaacggtcaggtctctgccaagtgtttgctgacgcaacccccactggctggggcttggcaatcggccatc

SEQ ID NO: 103638 - DNA, 75 bp, Artificial Sequence
  Synthetic
cccggcaacggtcaggtctctgccaagtgtttgctgacgcaacccccactggctggggcttggcaatgggccatc

SEQ ID NO: 103639 - DNA, 75 bp, Artificial Sequence
  Synthetic
cccggcaacggtcaggtctctgccaagtgtttgctgacgcaacccccactggctggggcttggctataggccatc

SEQ ID NO: 103640 - DNA, 75 bp, Artificial Sequence
  Synthetic
cccggcaacggtcaggtctctgccaagtgtttgctgacgcaacccccactggctggggcttggctattggccatc

SEQ ID NO: 103641 - DNA, 75 bp, Artificial Sequence
  Synthetic
cccggcaacggtcaggtctctgccaagtgtttgctgacgcaacccccactggctggggcttggctatcggccatc

SEQ ID NO: 103642 - DNA, 75 bp, Artificial Sequence
  Synthetic
cccggcaacggtcaggtctctgccaagtgtttgctgacgcaacccccactggctggggcttggctatgggccatc

SEQ ID NO: 103643 - DNA, 75 bp, Artificial Sequence
  Synthetic
cccggcaacggtcaggtctctgccaagtgtttgctgacgcaacccccactggctggggcttggccataggccatc

SEQ ID NO: 103644 - DNA, 75 bp, Artificial Sequence
  Synthetic
cccggcaacggtcaggtctctgccaagtgtttgctgacgcaacccccactggctggggcttggccattggccatc

SEQ ID NO: 103645 - DNA, 75 bp, Artificial Sequence
  Synthetic
cccggcaacggtcaggtctctgccaagtgtttgctgacgcaacccccactggctggggcttggccatcggccatc

SEQ ID NO: 103646 - DNA, 75 bp, Artificial Sequence
  Synthetic
cccggcaacggtcaggtctctgccaagtgtttgctgacgcaacccccactggctggggcttggccatgggccatc

SEQ ID NO: 103647 - DNA, 75 bp, Artificial Sequence
  Synthetic
cccggcaacggtcaggtctctgccaagtgtttgctgacgcaacccccactggctggggcttggcgataggccatc

SEQ ID NO: 103648 - DNA, 75 bp, Artificial Sequence
  Synthetic
cccggcaacggtcaggtctctgccaagtgtttgctgacgcaacccccactggctggggcttggcgattggccatc

SEQ ID NO: 103649 - DNA, 75 bp, Artificial Sequence
  Synthetic
cccggcaacggtcaggtctctgccaagtgtttgctgacgcaacccccactggctggggcttggcgatcggccatc

SEQ ID NO: 103650 - DNA, 75 bp, Artificial Sequence
  Synthetic
cccggcaacggtcaggtctctgccaagtgtttgctgacgcaacccccactggctggggcttggcgatgggccatc

SEQ ID NO: 103651 - DNA, 75 bp, Artificial Sequence
  Synthetic
cccggcaacggtcaggtctctgccaagtgtttgctgacgcaacccccactgggtggggcttggcaataggccatc

SEQ ID NO: 103652 - DNA, 75 bp, Artificial Sequence
  Synthetic
cccggcaacggtcaggtctctgccaagtgtttgctgacgcaacccccactgggtggggcttggcaattggccatc

SEQ ID NO: 103653 - DNA, 75 bp, Artificial Sequence
  Synthetic
cccggcaacggtcaggtctctgccaagtgtttgctgacgcaacccccactgggtggggcttggcaatcggccatc

SEQ ID NO: 103654 - DNA, 75 bp, Artificial Sequence
  Synthetic
cccggcaacggtcaggtctctgccaagtgtttgctgacgcaacccccactgggtggggcttggcaatgggccatc

SEQ ID NO: 103655 - DNA, 75 bp, Artificial Sequence
  Synthetic
cccggcaacggtcaggtctctgccaagtgtttgctgacgcaacccccactgggtggggcttggctataggccatc

SEQ ID NO: 103656 - DNA, 75 bp, Artificial Sequence
  Synthetic
cccggcaacggtcaggtctctgccaagtgtttgctgacgcaacccccactgggtggggcttggctattggccatc

SEQ ID NO: 103657 - DNA, 75 bp, Artificial Sequence
  Synthetic
cccggcaacggtcaggtctctgccaagtgtttgctgacgcaacccccactgggtggggcttggctatcggccatc

SEQ ID NO: 103658 - DNA, 75 bp, Artificial Sequence
  Synthetic
cccggcaacggtcaggtctctgccaagtgtttgctgacgcaacccccactgggtggggcttggctatgggccatc

SEQ ID NO: 103659 - DNA, 75 bp, Artificial Sequence
  Synthetic
cccggcaacggtcaggtctctgccaagtgtttgctgacgcaacccccactgggtggggcttggccataggccatc

SEQ ID NO: 103660 - DNA, 75 bp, Artificial Sequence
  Synthetic
cccggcaacggtcaggtctctgccaagtgtttgctgacgcaacccccactgggtggggcttggccattggccatc

SEQ ID NO: 103661 - DNA, 75 bp, Artificial Sequence
  Synthetic
cccggcaacggtcaggtctctgccaagtgtttgctgacgcaacccccactgggtggggcttggccatcggccatc

SEQ ID NO: 103662 - DNA, 75 bp, Artificial Sequence
  Synthetic
cccggcaacggtcaggtctctgccaagtgtttgctgacgcaacccccactgggtggggcttggccatgggccatc

SEQ ID NO: 103663 - DNA, 75 bp, Artificial Sequence
  Synthetic
cccggcaacggtcaggtctctgccaagtgtttgctgacgcaacccccactgggtggggcttggcgataggccatc

SEQ ID NO: 103664 - DNA, 75 bp, Artificial Sequence
  Synthetic
cccggcaacggtcaggtctctgccaagtgtttgctgacgcaacccccactgggtggggcttggcgattggccatc

SEQ ID NO: 103665 - DNA, 75 bp, Artificial Sequence
  Synthetic
cccggcaacggtcaggtctctgccaagtgtttgctgacgcaacccccactgggtggggcttggcgatcggccatc

SEQ ID NO: 103666 - DNA, 75 bp, Artificial Sequence
  Synthetic
cccggcaacggtcaggtctctgccaagtgtttgctgacgcaacccccactgggtggggcttggcgatgggccatc

SEQ ID NO: 103667 - DNA, 75 bp, Artificial Sequence
  Synthetic
cgcatgcgtggaacctttgtgactcctctgccgatccatactgcggaactcctagcagcttgttttgctcgcagc

SEQ ID NO: 103668 - DNA, 75 bp, Artificial Sequence
  Synthetic
cgcatgcgtggaacctttgtgactcctctgccgatccatactgcggaactcctagctgcttgttttgctcgcagc

SEQ ID NO: 103669 - DNA, 75 bp, Artificial Sequence
  Synthetic
cgcatgcgtggaacctttgtgactcctctgccgatccatactgcggaactcctagccgcttgttttgctcgcagc

SEQ ID NO: 103670 - DNA, 75 bp, Artificial Sequence
  Synthetic
cgcatgcgtggaacctttgtgactcctctgccgatccatactgcggaactcctagcggcttgttttgctcgcagc

SEQ ID NO: 103671 - DNA, 75 bp, Artificial Sequence
  Synthetic
cgcatgcgtggaacctttgtgtctcctctgccgatccatactgcggaactcctagcagcttgttttgctcgcagc

SEQ ID NO: 103672 - DNA, 75 bp, Artificial Sequence
  Synthetic
cgcatgcgtggaacctttgtgtctcctctgccgatccatactgcggaactcctagctgcttgttttgctcgcagc

SEQ ID NO: 103673 - DNA, 75 bp, Artificial Sequence
  Synthetic
cgcatgcgtggaacctttgtgtctcctctgccgatccatactgcggaactcctagccgcttgttttgctcgcagc

SEQ ID NO: 103674 - DNA, 75 bp, Artificial Sequence
  Synthetic
cgcatgcgtggaacctttgtgtctcctctgccgatccatactgcggaactcctagcggcttgttttgctcgcagc

SEQ ID NO: 103675 - DNA, 75 bp, Artificial Sequence
  Synthetic
cgcatgcgtggaacctttgtgcctcctctgccgatccatactgcggaactcctagcagcttgttttgctcgcagc

SEQ ID NO: 103676 - DNA, 75 bp, Artificial Sequence
  Synthetic
cgcatgcgtggaacctttgtgcctcctctgccgatccatactgcggaactcctagctgcttgttttgctcgcagc

SEQ ID NO: 103677 - DNA, 75 bp, Artificial Sequence
  Synthetic
cgcatgcgtggaacctttgtgcctcctctgccgatccatactgcggaactcctagccgcttgttttgctcgcagc

SEQ ID NO: 103678 - DNA, 75 bp, Artificial Sequence
  Synthetic
cgcatgcgtggaacctttgtgcctcctctgccgatccatactgcggaactcctagcggcttgttttgctcgcagc

SEQ ID NO: 103679 - DNA, 75 bp, Artificial Sequence
  Synthetic
cgcatgcgtggaacctttgtggctcctctgccgatccatactgcggaactcctagcagcttgttttgctcgcagc

SEQ ID NO: 103680 - DNA, 75 bp, Artificial Sequence
  Synthetic
cgcatgcgtggaacctttgtggctcctctgccgatccatactgcggaactcctagctgcttgttttgctcgcagc

SEQ ID NO: 103681 - DNA, 75 bp, Artificial Sequence
  Synthetic
cgcatgcgtggaacctttgtggctcctctgccgatccatactgcggaactcctagccgcttgttttgctcgcagc

SEQ ID NO: 103682 - DNA, 75 bp, Artificial Sequence
  Synthetic
cgcatgcgtggaacctttgtggctcctctgccgatccatactgcggaactcctagcggcttgttttgctcgcagc

SEQ ID NO: 103683 - DNA, 75 bp, Artificial Sequence
  Synthetic
gggaggagttgggggaggagattaggttaatgatctttgtactaggaggctgtaggcataaattggtctgttcac

SEQ ID NO: 103684 - DNA, 75 bp, Artificial Sequence
  Synthetic
tcgggaagccttagaatctcctgaacatgtctcacctcaccacacagctctcaggcaagctgttttgtgctgggg

SEQ ID NO: 103685 - DNA, 75 bp, Artificial Sequence
  Synthetic
tattgattggaaagtatgtcaaagaattgtgggtcttttgggctttgctgccccttttacacaatgtggctatcc

SEQ ID NO: 103686 - DNA, 75 bp, Artificial Sequence
  Synthetic
tagggtgtgctgccaactggatcctgcgcgggacgtcctttgtctacgtcccgtcggcgctgaatcccgcggacg

SEQ ID NO: 103687 - DNA, 75 bp, Artificial Sequence
  Synthetic
gtaagcaatttgtgggaccccttacagtaaatgaaaacaggagactaaaattaattatgcctgctaggttttatc

SEQ ID NO: 103688 - DNA, 75 bp, Artificial Sequence
  Synthetic
tctagctacctgggtgggaagtaatttggaagaccctgcctccagggatttagtagtcagctatgtcaatgttaa

SEQ ID NO: 103689 - DNA, 75 bp, Artificial Sequence
  Synthetic
gagatcttctagataccgcctcagctctgtatcgggaagccttagagtctcctgagcattgttcacctcaccata

SEQ ID NO: 103690 - DNA, 75 bp, Artificial Sequence
  Synthetic
ttgtacaaaaaatcaaacaatgttttcggaaacttcctataaatagacctattgattggaaagtatgtcaaagaa

SEQ ID NO: 103691 - DNA, 75 bp, Artificial Sequence
  Synthetic
tcggcagtcaggaaggaagcctactcccttatctccacctctaagggacactcatcctcaggccatgcagtggaa

SEQ ID NO: 103692 - DNA, 75 bp, Artificial Sequence
  Synthetic
actctttggaaggcgggtatcttatataaaagagagtccacacgtagcgcctcattttgcgggtcaccatattct

SEQ ID NO: 103693 - DNA, 75 bp, Artificial Sequence
  Synthetic
tctcaatctcgggaacctcaatgttagtattccttggactcataaggtgggaaactttacggggctttattcttc

SEQ ID NO: 103694 - DNA, 75 bp, Artificial Sequence
  Synthetic
ttcacatttcctgtcttacttttggaagagaaactgttcttgagtatttggtgtcttttggagtgtggattcgca

SEQ ID NO: 103695 - DNA, 75 bp, Artificial Sequence
  Synthetic
ttcatttacatcaagacattaccaacaagtgtcaacaatttgttggtcctcttacagtacatgaaaaaaggagat

SEQ ID NO: 103696 - DNA, 75 bp, Artificial Sequence
  Synthetic
tctggccccctgggggggaagtaatttgaaaaacccaccttccagggaattattattcacctttgtcaatgttaa

SEQ ID NO: 103697 - DNA, 75 bp, Artificial Sequence
  Synthetic
ttatttggggtcttttgaagtggggattccccctcctcctgcttacgaaccacaaaatgcccctatcttatcaac

SEQ ID NO: 103698 - DNA, 75 bp, Artificial Sequence
  Synthetic
ggagccctcaggctcagggcatactacaaaccttgccagcaaatccgcctcctgcctctaccaatcgccagtcag

SEQ ID NO: 103699 - DNA, 75 bp, Artificial Sequence
  Synthetic
ggtaccttgccacaagatcatattatacagaaaatcaaacaatgttttagaaaactccctgttaacaggcccatt

SEQ ID NO: 103700 - DNA, 75 bp, Artificial Sequence
  Synthetic
ttggatgttatgggtccctgccacaagaacacatcatacaaaaaatcaaagaatgttttagaaaacttcctatta

SEQ ID NO: 103701 - DNA, 75 bp, Artificial Sequence
  Synthetic
ttgccagcagttcctcctcctgcctccaccaatcggcagtcaggaaggcagcctactcccatctctccaccgttg

SEQ ID NO: 103702 - DNA, 75 bp, Artificial Sequence
  Synthetic
atccagggacctagtagtcagttatgtcaacactaatgtgggcctaaagttcaggcaactattgtggtttcacat

SEQ ID NO: 103703 - DNA, 75 bp, Artificial Sequence
  Synthetic
ttgccagaaaatccgactcctgcctctaccaatcgccagtcagggaggcagcctaccccgctgtctccaccattg

SEQ ID NO: 103704 - DNA, 75 bp, Artificial Sequence
  Synthetic
ttgccagaaaatccgactcctgcctctaccaatcgccagtcagggaggcagcctaccccgctgtctccacctttg

SEQ ID NO: 103705 - DNA, 75 bp, Artificial Sequence
  Synthetic
ttgccagaaaatccgactcctgcctctaccaatcgccagtcagggaggcagcctaccccgctgtctccacccttg

SEQ ID NO: 103706 - DNA, 75 bp, Artificial Sequence
  Synthetic
ttgccagaaaatccgactcctgcctctaccaatcgccagtcagggaggcagcctaccccgctgtctccaccgttg

SEQ ID NO: 103707 - DNA, 75 bp, Artificial Sequence
  Synthetic
ttgccagaaaatccgtctcctgcctctaccaatcgccagtcagggaggcagcctaccccgctgtctccaccattg

SEQ ID NO: 103708 - DNA, 75 bp, Artificial Sequence
  Synthetic
ttgccagaaaatccgtctcctgcctctaccaatcgccagtcagggaggcagcctaccccgctgtctccacctttg

SEQ ID NO: 103709 - DNA, 75 bp, Artificial Sequence
  Synthetic
ttgccagaaaatccgtctcctgcctctaccaatcgccagtcagggaggcagcctaccccgctgtctccacccttg

SEQ ID NO: 103710 - DNA, 75 bp, Artificial Sequence
  Synthetic
ttgccagaaaatccgtctcctgcctctaccaatcgccagtcagggaggcagcctaccccgctgtctccaccgttg

SEQ ID NO: 103711 - DNA, 75 bp, Artificial Sequence
  Synthetic
ttgccagaaaatccgcctcctgcctctaccaatcgccagtcagggaggcagcctaccccgctgtctccaccattg

SEQ ID NO: 103712 - DNA, 75 bp, Artificial Sequence
  Synthetic
ttgccagaaaatccgcctcctgcctctaccaatcgccagtcagggaggcagcctaccccgctgtctccacctttg

SEQ ID NO: 103713 - DNA, 75 bp, Artificial Sequence
  Synthetic
ttgccagaaaatccgcctcctgcctctaccaatcgccagtcagggaggcagcctaccccgctgtctccacccttg

SEQ ID NO: 103714 - DNA, 75 bp, Artificial Sequence
  Synthetic
ttgccagaaaatccgcctcctgcctctaccaatcgccagtcagggaggcagcctaccccgctgtctccaccgttg

SEQ ID NO: 103715 - DNA, 75 bp, Artificial Sequence
  Synthetic
ttgccagaaaatccggctcctgcctctaccaatcgccagtcagggaggcagcctaccccgctgtctccaccattg

SEQ ID NO: 103716 - DNA, 75 bp, Artificial Sequence
  Synthetic
ttgccagaaaatccggctcctgcctctaccaatcgccagtcagggaggcagcctaccccgctgtctccacctttg

SEQ ID NO: 103717 - DNA, 75 bp, Artificial Sequence
  Synthetic
ttgccagaaaatccggctcctgcctctaccaatcgccagtcagggaggcagcctaccccgctgtctccacccttg

SEQ ID NO: 103718 - DNA, 75 bp, Artificial Sequence
  Synthetic
ttgccagaaaatccggctcctgcctctaccaatcgccagtcagggaggcagcctaccccgctgtctccaccgttg

SEQ ID NO: 103719 - DNA, 75 bp, Artificial Sequence
  Synthetic
ctccagcacattccaccaagctctgctagaccccagcccctctcctgctggtggctccagttccggaacagaaaa

SEQ ID NO: 103720 - DNA, 75 bp, Artificial Sequence
  Synthetic
ttccacaacattccaccaagctctgcaggatcccagagtaagaggcctgtattctcctgctggtggctccagttc

SEQ ID NO: 103721 - DNA, 75 bp, Artificial Sequence
  Synthetic
catgtgcacttcgcttcacctctgcaagtaatatggaaactacggtgaacgcttacttggtgttgcccatggttt

SEQ ID NO: 103722 - DNA, 75 bp, Artificial Sequence
  Synthetic
ttccacaacttcccaccaagctctgcaagatcccagggtcaggggccctgctggtggctccaattcaggaacagt

SEQ ID NO: 103723 - DNA, 75 bp, Artificial Sequence
  Synthetic
ttccacaacctttcaccaaactctgcaagatcccagagtgagaggcctgtatctccctgctggtggctccagttc

SEQ ID NO: 103724 - DNA, 75 bp, Artificial Sequence
  Synthetic
tatgcatgtattcaatctaagcaggctttcactttctcgccaacttacaaggcctttctgtgtaaacaatacctg

SEQ ID NO: 103725 - DNA, 75 bp, Artificial Sequence
  Synthetic
tgccaagtgtttgctgacgcaacccccactggctggggcttggccataggccatcagcgcatgcgtggaaccttt

SEQ ID NO: 103726 - DNA, 75 bp, Artificial Sequence
  Synthetic
gtggctcctctgccgatccatactgcggaactcctagcagcttgttttgctcgcagccggtctggagcgaaactc

SEQ ID NO: 103727 - DNA, 75 bp, Artificial Sequence
  Synthetic
gtttttgcctgctgacttctttccttcggtacgagatcttctagataccgccacagctctatttcggcaagactt

SEQ ID NO: 103728 - DNA, 75 bp, Artificial Sequence
  Synthetic
tctagccacctgggtgggtggtaatttggatgatccaacatccagggaccaagtagtcagttatgttaacactaa

SEQ ID NO: 103729 - DNA, 75 bp, Artificial Sequence
  Synthetic
gattggaaagtttgtcaacgcattgtgggtcttttgggctttgcggcccctttcacccaatgtggttatcctgct

SEQ ID NO: 103730 - DNA, 75 bp, Artificial Sequence
  Synthetic
attatcctgaacaggtagttaatcattacttcaaaactaggcattatttacatactctgtggaaagctggcattc

SEQ ID NO: 103731 - DNA, 75 bp, Artificial Sequence
  Synthetic
tcatctcatgttcatgtcctactgttcaagcctccaagctgtgccttgggtggctttggggcatggacattgacc

SEQ ID NO: 103732 - DNA, 75 bp, Artificial Sequence
  Synthetic
attagtagtaagctatgtcaatgttaatatgggcctaaaaatcagacaactattgtggtttcacatttcctgtct

SEQ ID NO: 103733 - DNA, 75 bp, Artificial Sequence
  Synthetic
ttctgacttctttccttccgtccgagatctgcttgacactgcctcagcgctgtatcgggaagccttagagtctcc

SEQ ID NO: 103734 - DNA, 75 bp, Artificial Sequence
  Synthetic
tatgggcctaaagatcaggcaattattgtggtttcacatttcttgtcttacttttggaagagaaactgttcttga

SEQ ID NO: 103735 - DNA, 75 bp, Artificial Sequence
  Synthetic
ctgggtgggcaataatttgcaagacccagcttccagggatttagtggtcaattatgtcaacactaacatgggctt

SEQ ID NO: 103736 - DNA, 75 bp, Artificial Sequence
  Synthetic
ggatgccttagaatctcctgagcattgttcacctcaccatactgcactcaggcaagccattctttgctgggggga

SEQ ID NO: 103737 - DNA, 75 bp, Artificial Sequence
  Synthetic
taccgcctcagctctgtatcgggatgccttagagtctcctgagcattgttcacctcaccatactgcactcaggca

SEQ ID NO: 103738 - DNA, 75 bp, Artificial Sequence
  Synthetic
atgcctgctaggttctatcctaaccttaccaaatatttgcccttagataaaggcattaaaccttattatcctgaa

SEQ ID NO: 103739 - DNA, 75 bp, Artificial Sequence
  Synthetic
ttgtaggccctctcactgtaaatgaaaaaagaagactgaaattaattatgcctgctaggttctatcctaacagta

SEQ ID NO: 103740 - DNA, 75 bp, Artificial Sequence
  Synthetic
agatccagcatccagggaccaagtagtcacttatgtgaatactaatatgggcacaaagttcaggcaattattgtg

SEQ ID NO: 103741 - DNA, 75 bp, Artificial Sequence
  Synthetic
tcaaacaatccagattgggacttcaatccccacaaggacaactggccagaagccaccaaggtaggagtgggagca

SEQ ID NO: 103742 - DNA, 75 bp, Artificial Sequence
  Synthetic
caagtgtttgctgacgcaacccccactggatggggcttggccataggccatcggcgcatgcgtggaacctttgtg

SEQ ID NO: 103743 - DNA, 75 bp, Artificial Sequence
  Synthetic
aggactgggaggagtcgggggaggagttgaggttaatgatctttgtattaggaggctgtaggcataaattggtct

SEQ ID NO: 103744 - DNA, 75 bp, Artificial Sequence
  Synthetic
caccgcaccatactgcactcaggcaagccattctttgctggggggaactaatgactctagctacctgggtgggtg

SEQ ID NO: 103745 - DNA, 75 bp, Artificial Sequence
  Synthetic
ttccacaactttccaccaagctctgcaagatcccagagtcaggggcctgtattttcctgctggtggctccagttc

SEQ ID NO: 103746 - DNA, 75 bp, Artificial Sequence
  Synthetic
ttcatttgcgtcaagacattatagataagtgtcaacaatttgtgggccctcttacagtaaatgaaaaacgaagat

SEQ ID NO: 103747 - DNA, 75 bp, Artificial Sequence
  Synthetic
ctcttttttgccttctgatttcttcccgtcagttcgggacctactcgacaccgcttcagccctttaccgggatgc

SEQ ID NO: 103748 - DNA, 75 bp, Artificial Sequence
  Synthetic
ttctttccgtcggtgcgagacctcctagataccgcggctgctctgtatcgggaagccttagaatctcctgaacat

SEQ ID NO: 103749 - DNA, 75 bp, Artificial Sequence
  Synthetic
attaaaattaattatgcctgctaggttttatcctaaccttaccaaatatttgcccttggacaaaggcattaaacc

SEQ ID NO: 103750 - DNA, 75 bp, Artificial Sequence
  Synthetic
caccacccagttccaccaggctcttcaagatcccagagtcagggccctgttgagtcctgctggtggctccagttc

SEQ ID NO: 103751 - DNA, 75 bp, Artificial Sequence
  Synthetic
gccacaggatcatattgtacaaaaaatcaaatgctgttttagaaaacttcctgtcaatagacctatcgattggaa

SEQ ID NO: 103752 - DNA, 75 bp, Artificial Sequence
  Synthetic
atacatttgaaccctaataaaaccaagcgttggggctactcccttaatttcatgggatatgtaattggatgttgg

SEQ ID NO: 103753 - DNA, 75 bp, Artificial Sequence
  Synthetic
ttttaacacatgtacaaaattgaaacaggctaacactttctgccctataaacaaggcctttctaagtaaataatt

SEQ ID NO: 103754 - DNA, 75 bp, Artificial Sequence
  Synthetic
attggatgttatgggtccttgccacaagaacacatcatacaaaaaatcaaagaatgttttagaaaacttcctatt

SEQ ID NO: 103755 - DNA, 75 bp, Artificial Sequence
  Synthetic
cccaacaaaacaaaaagatggggatattccctacatttcatgggttatgtaattggaagttgggggtcattacca

SEQ ID NO: 103756 - DNA, 75 bp, Artificial Sequence
  Synthetic
agccctttgttttactcgcagcaggtctggaaaagaaatcatcgggacggacaacccccccgtccccccccccaa

SEQ ID NO: 103757 - DNA, 75 bp, Artificial Sequence
  Synthetic
atacatttgaaccctaataaaaccaagcgatggggctactcccttaacttcatgggatatgtaattggaagttgg

SEQ ID NO: 103758 - DNA, 75 bp, Artificial Sequence
  Synthetic
aggtcccctagaagaagaactccctcgcctcgcagacgaaggtctcaatcgccgcgtcgcagaagatctcaatct

SEQ ID NO: 103759 - DNA, 75 bp, Artificial Sequence
  Synthetic
cccggcgctgaatccgggggacgacccctcggcggctcgcttgggactctatcgccccctcttccgtctgccgaa

SEQ ID NO: 103760 - DNA, 75 bp, Artificial Sequence
  Synthetic
agaatctcctgaacattgctcacctcaccacacagcactcaggcaagctattctgtgctggggggaattaatgac

SEQ ID NO: 103761 - DNA, 75 bp, Artificial Sequence
  Synthetic
ccccaacctttcccccgttaaccggcaaaggccccgtctgtgccaagtgtttgctgacgcaacccccaagggcgg

SEQ ID NO: 103762 - DNA, 75 bp, Artificial Sequence
  Synthetic
caatcggcggtccgggagaaaaccaaccccagtctctccacctctaagggacactcatccccaggccatgcagtg

SEQ ID NO: 103763 - DNA, 75 bp, Artificial Sequence
  Synthetic
ctccacggtattccaccgaaccttacaagatcccagagtgaggggcctgtattttcctgctggtggctccagttc

SEQ ID NO: 103764 - DNA, 75 bp, Artificial Sequence
  Synthetic
gctgtgccttgggtggctttagggcatggacatagacccttataaagaatttggagcttctttagaattgctctc

SEQ ID NO: 103765 - DNA, 75 bp, Artificial Sequence
  Synthetic
gctgtgccttgggtggctttagggcatggacatagacccttataaagaatttggtgcttctttagaattgctctc

SEQ ID NO: 103766 - DNA, 75 bp, Artificial Sequence
  Synthetic
gctgtgccttgggtggctttagggcatggacatagacccttataaagaatttggcgcttctttagaattgctctc

SEQ ID NO: 103767 - DNA, 75 bp, Artificial Sequence
  Synthetic
gctgtgccttgggtggctttagggcatggacatagacccttataaagaatttggggcttctttagaattgctctc

SEQ ID NO: 103768 - DNA, 75 bp, Artificial Sequence
  Synthetic
gctgtgccttgggtggctttagggcatggacattgacccttataaagaatttggagcttctttagaattgctctc

SEQ ID NO: 103769 - DNA, 75 bp, Artificial Sequence
  Synthetic
gctgtgccttgggtggctttagggcatggacattgacccttataaagaatttggtgcttctttagaattgctctc

SEQ ID NO: 103770 - DNA, 75 bp, Artificial Sequence
  Synthetic
gctgtgccttgggtggctttagggcatggacattgacccttataaagaatttggcgcttctttagaattgctctc

SEQ ID NO: 103771 - DNA, 75 bp, Artificial Sequence
  Synthetic
gctgtgccttgggtggctttagggcatggacattgacccttataaagaatttggggcttctttagaattgctctc

SEQ ID NO: 103772 - DNA, 75 bp, Artificial Sequence
  Synthetic
gctgtgccttgggtggctttagggcatggacatcgacccttataaagaatttggagcttctttagaattgctctc

SEQ ID NO: 103773 - DNA, 75 bp, Artificial Sequence
  Synthetic
gctgtgccttgggtggctttagggcatggacatcgacccttataaagaatttggtgcttctttagaattgctctc

SEQ ID NO: 103774 - DNA, 75 bp, Artificial Sequence
  Synthetic
gctgtgccttgggtggctttagggcatggacatcgacccttataaagaatttggcgcttctttagaattgctctc

SEQ ID NO: 103775 - DNA, 75 bp, Artificial Sequence
  Synthetic
gctgtgccttgggtggctttagggcatggacatcgacccttataaagaatttggggcttctttagaattgctctc

SEQ ID NO: 103776 - DNA, 75 bp, Artificial Sequence
  Synthetic
gctgtgccttgggtggctttagggcatggacatggacccttataaagaatttggagcttctttagaattgctctc

SEQ ID NO: 103777 - DNA, 75 bp, Artificial Sequence
  Synthetic
gctgtgccttgggtggctttagggcatggacatggacccttataaagaatttggtgcttctttagaattgctctc

SEQ ID NO: 103778 - DNA, 75 bp, Artificial Sequence
  Synthetic
gctgtgccttgggtggctttagggcatggacatggacccttataaagaatttggcgcttctttagaattgctctc

SEQ ID NO: 103779 - DNA, 75 bp, Artificial Sequence
  Synthetic
gctgtgccttgggtggctttagggcatggacatggacccttataaagaatttggggcttctttagaattgctctc

SEQ ID NO: 103780 - DNA, 75 bp, Artificial Sequence
  Synthetic
gctgtgccttgggtggcttttgggcatggacatagacccttataaagaatttggagcttctttagaattgctctc

SEQ ID NO: 103781 - DNA, 75 bp, Artificial Sequence
  Synthetic
gctgtgccttgggtggcttttgggcatggacatagacccttataaagaatttggtgcttctttagaattgctctc

SEQ ID NO: 103782 - DNA, 75 bp, Artificial Sequence
  Synthetic
gctgtgccttgggtggcttttgggcatggacatagacccttataaagaatttggcgcttctttagaattgctctc

SEQ ID NO: 103783 - DNA, 75 bp, Artificial Sequence
  Synthetic
gctgtgccttgggtggcttttgggcatggacatagacccttataaagaatttggggcttctttagaattgctctc

SEQ ID NO: 103784 - DNA, 75 bp, Artificial Sequence
  Synthetic
gctgtgccttgggtggcttttgggcatggacattgacccttataaagaatttggagcttctttagaattgctctc

SEQ ID NO: 103785 - DNA, 75 bp, Artificial Sequence
  Synthetic
gctgtgccttgggtggcttttgggcatggacattgacccttataaagaatttggtgcttctttagaattgctctc

SEQ ID NO: 103786 - DNA, 75 bp, Artificial Sequence
  Synthetic
gctgtgccttgggtggcttttgggcatggacattgacccttataaagaatttggcgcttctttagaattgctctc

SEQ ID NO: 103787 - DNA, 75 bp, Artificial Sequence
  Synthetic
gctgtgccttgggtggcttttgggcatggacattgacccttataaagaatttggggcttctttagaattgctctc

SEQ ID NO: 103788 - DNA, 75 bp, Artificial Sequence
  Synthetic
gctgtgccttgggtggcttttgggcatggacatcgacccttataaagaatttggagcttctttagaattgctctc

SEQ ID NO: 103789 - DNA, 75 bp, Artificial Sequence
  Synthetic
gctgtgccttgggtggcttttgggcatggacatcgacccttataaagaatttggtgcttctttagaattgctctc

SEQ ID NO: 103790 - DNA, 75 bp, Artificial Sequence
  Synthetic
gctgtgccttgggtggcttttgggcatggacatcgacccttataaagaatttggcgcttctttagaattgctctc

SEQ ID NO: 103791 - DNA, 75 bp, Artificial Sequence
  Synthetic
gctgtgccttgggtggcttttgggcatggacatcgacccttataaagaatttggggcttctttagaattgctctc

SEQ ID NO: 103792 - DNA, 75 bp, Artificial Sequence
  Synthetic
gctgtgccttgggtggcttttgggcatggacatggacccttataaagaatttggagcttctttagaattgctctc

SEQ ID NO: 103793 - DNA, 75 bp, Artificial Sequence
  Synthetic
gctgtgccttgggtggcttttgggcatggacatggacccttataaagaatttggtgcttctttagaattgctctc

SEQ ID NO: 103794 - DNA, 75 bp, Artificial Sequence
  Synthetic
gctgtgccttgggtggcttttgggcatggacatggacccttataaagaatttggcgcttctttagaattgctctc

SEQ ID NO: 103795 - DNA, 75 bp, Artificial Sequence
  Synthetic
gctgtgccttgggtggcttttgggcatggacatggacccttataaagaatttggggcttctttagaattgctctc

SEQ ID NO: 103796 - DNA, 75 bp, Artificial Sequence
  Synthetic
gctgtgccttgggtggctttcgggcatggacatagacccttataaagaatttggagcttctttagaattgctctc

SEQ ID NO: 103797 - DNA, 75 bp, Artificial Sequence
  Synthetic
gctgtgccttgggtggctttcgggcatggacatagacccttataaagaatttggtgcttctttagaattgctctc

SEQ ID NO: 103798 - DNA, 75 bp, Artificial Sequence
  Synthetic
gctgtgccttgggtggctttcgggcatggacatagacccttataaagaatttggcgcttctttagaattgctctc

SEQ ID NO: 103799 - DNA, 75 bp, Artificial Sequence
  Synthetic
gctgtgccttgggtggctttcgggcatggacatagacccttataaagaatttggggcttctttagaattgctctc

SEQ ID NO: 103800 - DNA, 75 bp, Artificial Sequence
  Synthetic
gctgtgccttgggtggctttcgggcatggacattgacccttataaagaatttggagcttctttagaattgctctc

SEQ ID NO: 103801 - DNA, 75 bp, Artificial Sequence
  Synthetic
gctgtgccttgggtggctttcgggcatggacattgacccttataaagaatttggtgcttctttagaattgctctc

SEQ ID NO: 103802 - DNA, 75 bp, Artificial Sequence
  Synthetic
gctgtgccttgggtggctttcgggcatggacattgacccttataaagaatttggcgcttctttagaattgctctc

SEQ ID NO: 103803 - DNA, 75 bp, Artificial Sequence
  Synthetic
gctgtgccttgggtggctttcgggcatggacattgacccttataaagaatttggggcttctttagaattgctctc

SEQ ID NO: 103804 - DNA, 75 bp, Artificial Sequence
  Synthetic
gctgtgccttgggtggctttcgggcatggacatcgacccttataaagaatttggagcttctttagaattgctctc

SEQ ID NO: 103805 - DNA, 75 bp, Artificial Sequence
  Synthetic
gctgtgccttgggtggctttcgggcatggacatcgacccttataaagaatttggtgcttctttagaattgctctc

SEQ ID NO: 103806 - DNA, 75 bp, Artificial Sequence
  Synthetic
gctgtgccttgggtggctttcgggcatggacatcgacccttataaagaatttggcgcttctttagaattgctctc

SEQ ID NO: 103807 - DNA, 75 bp, Artificial Sequence
  Synthetic
gctgtgccttgggtggctttcgggcatggacatcgacccttataaagaatttggggcttctttagaattgctctc

SEQ ID NO: 103808 - DNA, 75 bp, Artificial Sequence
  Synthetic
gctgtgccttgggtggctttcgggcatggacatggacccttataaagaatttggagcttctttagaattgctctc

SEQ ID NO: 103809 - DNA, 75 bp, Artificial Sequence
  Synthetic
gctgtgccttgggtggctttcgggcatggacatggacccttataaagaatttggtgcttctttagaattgctctc

SEQ ID NO: 103810 - DNA, 75 bp, Artificial Sequence
  Synthetic
gctgtgccttgggtggctttcgggcatggacatggacccttataaagaatttggcgcttctttagaattgctctc

SEQ ID NO: 103811 - DNA, 75 bp, Artificial Sequence
  Synthetic
gctgtgccttgggtggctttcgggcatggacatggacccttataaagaatttggggcttctttagaattgctctc

SEQ ID NO: 103812 - DNA, 75 bp, Artificial Sequence
  Synthetic
gctgtgccttgggtggctttggggcatggacatagacccttataaagaatttggagcttctttagaattgctctc

SEQ ID NO: 103813 - DNA, 75 bp, Artificial Sequence
  Synthetic
gctgtgccttgggtggctttggggcatggacatagacccttataaagaatttggtgcttctttagaattgctctc

SEQ ID NO: 103814 - DNA, 75 bp, Artificial Sequence
  Synthetic
gctgtgccttgggtggctttggggcatggacatagacccttataaagaatttggcgcttctttagaattgctctc

SEQ ID NO: 103815 - DNA, 75 bp, Artificial Sequence
  Synthetic
gctgtgccttgggtggctttggggcatggacatagacccttataaagaatttggggcttctttagaattgctctc

SEQ ID NO: 103816 - DNA, 75 bp, Artificial Sequence
  Synthetic
gctgtgccttgggtggctttggggcatggacattgacccttataaagaatttggagcttctttagaattgctctc

SEQ ID NO: 103817 - DNA, 75 bp, Artificial Sequence
  Synthetic
gctgtgccttgggtggctttggggcatggacattgacccttataaagaatttggtgcttctttagaattgctctc

SEQ ID NO: 103818 - DNA, 75 bp, Artificial Sequence
  Synthetic
gctgtgccttgggtggctttggggcatggacattgacccttataaagaatttggcgcttctttagaattgctctc

SEQ ID NO: 103819 - DNA, 75 bp, Artificial Sequence
  Synthetic
gctgtgccttgggtggctttggggcatggacattgacccttataaagaatttggggcttctttagaattgctctc

SEQ ID NO: 103820 - DNA, 75 bp, Artificial Sequence
  Synthetic
gctgtgccttgggtggctttggggcatggacatcgacccttataaagaatttggagcttctttagaattgctctc

SEQ ID NO: 103821 - DNA, 75 bp, Artificial Sequence
  Synthetic
gctgtgccttgggtggctttggggcatggacatcgacccttataaagaatttggtgcttctttagaattgctctc

SEQ ID NO: 103822 - DNA, 75 bp, Artificial Sequence
  Synthetic
gctgtgccttgggtggctttggggcatggacatcgacccttataaagaatttggcgcttctttagaattgctctc

SEQ ID NO: 103823 - DNA, 75 bp, Artificial Sequence
  Synthetic
gctgtgccttgggtggctttggggcatggacatcgacccttataaagaatttggggcttctttagaattgctctc

SEQ ID NO: 103824 - DNA, 75 bp, Artificial Sequence
  Synthetic
gctgtgccttgggtggctttggggcatggacatggacccttataaagaatttggagcttctttagaattgctctc

SEQ ID NO: 103825 - DNA, 75 bp, Artificial Sequence
  Synthetic
gctgtgccttgggtggctttggggcatggacatggacccttataaagaatttggtgcttctttagaattgctctc

SEQ ID NO: 103826 - DNA, 75 bp, Artificial Sequence
  Synthetic
gctgtgccttgggtggctttggggcatggacatggacccttataaagaatttggcgcttctttagaattgctctc

SEQ ID NO: 103827 - DNA, 75 bp, Artificial Sequence
  Synthetic
gctgtgccttgggtggctttggggcatggacatggacccttataaagaatttggggcttctttagaattgctctc

SEQ ID NO: 103828 - DNA, 75 bp, Artificial Sequence
  Synthetic
actaatatgggcctaaagttcaggcaactattgtggtttcacatttcttgtctcacttttggaagagacacagtt

SEQ ID NO: 103829 - DNA, 75 bp, Artificial Sequence
  Synthetic
aggacattattaacaaatgtgaacaatttgtaggtcctctaacagtaaatgaaaaacgaagattaaacttagtca

SEQ ID NO: 103830 - DNA, 75 bp, Artificial Sequence
  Synthetic
accttattatccagaacatctagttaatcattacttccaaaccagacattatttccacactctatggaaggcggg

SEQ ID NO: 103831 - DNA, 75 bp, Artificial Sequence
  Synthetic
tccttctggtggctccagttcaggaacactcaaccctgttccaactattgcctctcacatctcgtcaatctcctc

SEQ ID NO: 103832 - DNA, 75 bp, Artificial Sequence
  Synthetic
tcccagagtcagggctctgtactttcctgctggtggctccagttcaggaacagtaagccctgctcagaatactgc

SEQ ID NO: 103833 - DNA, 75 bp, Artificial Sequence
  Synthetic
gattggaaagtatgtcaacgcattgtggttcttttgggctttgccgccccttttacacaatgtgggcatccagcc

SEQ ID NO: 103834 - DNA, 75 bp, Artificial Sequence
  Synthetic
tacgtcccgtcggcgctgaatcccgcggacgacccctctcggggccgcttgggactctaccgtccccttcttcgt

SEQ ID NO: 103835 - DNA, 75 bp, Artificial Sequence
  Synthetic
gattggaaagtgtgtcaacgaattgtaggtcttttaggcttcgctgctccttttacacaatgtggatatcctgcc

SEQ ID NO: 103836 - DNA, 75 bp, Artificial Sequence
  Synthetic
tttgggccggggttcactcccccacacggaggccttttggggtggagccctcaggctcaaggcatgcaaaaaaca

SEQ ID NO: 103837 - DNA, 75 bp, Artificial Sequence
  Synthetic
tcgccagtcaagaaggcagcctaccccgctgtctccacctttgagaaacactcatcctcaggccatgcagtggaa

SEQ ID NO: 103838 - DNA, 75 bp, Artificial Sequence
  Synthetic
cccactgtttggctttcagttatatggatgatgtggtattgggggccaagtctgtacaacatcttgagtcccttt

SEQ ID NO: 103839 - DNA, 75 bp, Artificial Sequence
  Synthetic
tctcgcttcctgggtgtgcaataatttagaagacccagcatctagggaactggtagtcaattatgttaataacaa

SEQ ID NO: 103840 - DNA, 75 bp, Artificial Sequence
  Synthetic
ctccacaacattccaccaagctctgatacatgccggagtgaggggtctatattttcctgctggtggctccacttc

SEQ ID NO: 103841 - DNA, 75 bp, Artificial Sequence
  Synthetic
aggacattattaacagatgtcaacaatatgtaggccctcttacagtcaatgagaaaagaagattatccttaatta

SEQ ID NO: 103842 - DNA, 75 bp, Artificial Sequence
  Synthetic
gattggaaagtatgtcaacgaattgtgggtcttttagggttcgctgccccttttacacaatgtggatatcctgct

SEQ ID NO: 103843 - DNA, 75 bp, Artificial Sequence
  Synthetic
gaaactttacggggctttattcttctactacgcctgtttttaatcctaagtggaaaactccttcttttcctaaca

SEQ ID NO: 103844 - DNA, 75 bp, Artificial Sequence
  Synthetic
tgaaattaattatgccttctagattctatcctaactctaccaaatatttgcccctagataaaggaattaaacctt

SEQ ID NO: 103845 - DNA, 75 bp, Artificial Sequence
  Synthetic
gcacagggtgtgcttacaacattgccagcagatccgcctcctgcttccaccaatcggcggtccgggagaaaacca

SEQ ID NO: 103846 - DNA, 75 bp, Artificial Sequence
  Synthetic
ttcgggccagggttcaccccgccacacggaggtcttctggggtggagccctcaggctcagggaataacaacaaca

SEQ ID NO: 103847 - DNA, 75 bp, Artificial Sequence
  Synthetic
caatatctgaacctttaccccgttgcccggcaacggtcaggtctctgccaagtgtttgctgacgcaacccccact

SEQ ID NO: 103848 - DNA, 75 bp, Artificial Sequence
  Synthetic
ggttcttctggactatcaaggtatgttgcccgtttgtcctctaattccaggatcctcaaccaccagcacgggacc

SEQ ID NO: 103849 - DNA, 75 bp, Artificial Sequence
  Synthetic
ttctatataagagagaatccacccgtagcgcctcattttgtgggtcaccatattcttgggaacaagagctacagc

SEQ ID NO: 103850 - DNA, 75 bp, Artificial Sequence
  Synthetic
tggagccctcaggctcagggcatactgacaacagtgccagcagcgcctcctcctgccaccaccaatcggcagtca

SEQ ID NO: 103851 - DNA, 75 bp, Artificial Sequence
  Synthetic
cacctgtattcccatcccatcatcctgggctttcgcaaaattcctatgggagtgggcctcagcccgtttctcctg

SEQ ID NO: 103852 - DNA, 75 bp, Artificial Sequence
  Synthetic
acacaatatctgaccctttaccccgttgctcggcaacgaccgggactgtgccaagtgtttgctgacgcaaccccc

SEQ ID NO: 103853 - DNA, 75 bp, Artificial Sequence
  Synthetic
tcggcattctcgaatacatcctactcccatctctccacctctaaaagacatgcatccgcaggccatgcagtggaa

SEQ ID NO: 103854 - DNA, 75 bp, Artificial Sequence
  Synthetic
aacaggcctattgattggaaagtatgtcaacgaattgtgggtcttttgggttttgctgccccttttacacaatgt

SEQ ID NO: 103855 - DNA, 75 bp, Artificial Sequence
  Synthetic
ctactgttcaagcctccaagctgtgccttgggtggctttggggcatggacattgacccttataaagaatttggag

SEQ ID NO: 103856 - DNA, 75 bp, Artificial Sequence
  Synthetic
ttttttgcctgctgacttctttccttcggtacgagatcttctagataccgccacagctctgtatcgggaagcctt

SEQ ID NO: 103857 - DNA, 75 bp, Artificial Sequence
  Synthetic
gaaactttacggggctttattcttctaccgcacctgtctttaatcctaactggcaaactccttcttttcctgaca

SEQ ID NO: 103858 - DNA, 75 bp, Artificial Sequence
  Synthetic
aggggatggggcttggccataggccatcggggcatgcgtggaacttttgtggctcttctgccgatccatattgcg

SEQ ID NO: 103859 - DNA, 75 bp, Artificial Sequence
  Synthetic
tcagggcctactcacaactgtgccagcagctcctcctccttaaagggacactcatcctcaggccatgcagtggaa

SEQ ID NO: 103860 - DNA, 75 bp, Artificial Sequence
  Synthetic
ttcatttacaccaggatatcattaacaagtgtgaacaattagttggtccacttacggtaaatgaaaaaaggagat

SEQ ID NO: 103861 - DNA, 75 bp, Artificial Sequence
  Synthetic
tacgtccggtgggcggtgaatcccgcggacgacccttcccgggcccgtttgggtttctccgttccccttcttcat

SEQ ID NO: 103862 - DNA, 75 bp, Artificial Sequence
  Synthetic
gtttttgccttttgacttctttccttccgtacgagattttttagattccgccttagctttgtatcgggattcctt

SEQ ID NO: 103863 - DNA, 75 bp, Artificial Sequence
  Synthetic
gtttttgccttttgacttctttccttccgttcgagattttttagattccgccttagctttgtatcgggattcctt

SEQ ID NO: 103864 - DNA, 75 bp, Artificial Sequence
  Synthetic
gtttttgccttttgacttctttccttccgtccgagattttttagattccgccttagctttgtatcgggattcctt

SEQ ID NO: 103865 - DNA, 75 bp, Artificial Sequence
  Synthetic
gtttttgccttttgacttctttccttccgtgcgagattttttagattccgccttagctttgtatcgggattcctt

SEQ ID NO: 103866 - DNA, 75 bp, Artificial Sequence
  Synthetic
gatatttgtattaggaggctgtaggcataaattggtctgcgcaccagcaccatgcaactttttcacctctgccta

SEQ ID NO: 103867 - DNA, 75 bp, Artificial Sequence
  Synthetic
gatatttgtattaggaggctgtaggcataaattggtctgcgcaccagcaccatgcaactttttctcctctgccta

SEQ ID NO: 103868 - DNA, 75 bp, Artificial Sequence
  Synthetic
gatatttgtattaggaggctgtaggcataaattggtctgcgcaccagcaccatgcaactttttcccctctgccta

SEQ ID NO: 103869 - DNA, 75 bp, Artificial Sequence
  Synthetic
gatatttgtattaggaggctgtaggcataaattggtctgcgcaccagcaccatgcaactttttcgcctctgccta

SEQ ID NO: 103870 - DNA, 75 bp, Artificial Sequence
  Synthetic
gatttttgtattaggaggctgtaggcataaattggtctgcgcaccagcaccatgcaactttttcacctctgccta

SEQ ID NO: 103871 - DNA, 75 bp, Artificial Sequence
  Synthetic
gatttttgtattaggaggctgtaggcataaattggtctgcgcaccagcaccatgcaactttttctcctctgccta

SEQ ID NO: 103872 - DNA, 75 bp, Artificial Sequence
  Synthetic
gatttttgtattaggaggctgtaggcataaattggtctgcgcaccagcaccatgcaactttttcccctctgccta

SEQ ID NO: 103873 - DNA, 75 bp, Artificial Sequence
  Synthetic
gatttttgtattaggaggctgtaggcataaattggtctgcgcaccagcaccatgcaactttttcgcctctgccta

SEQ ID NO: 103874 - DNA, 75 bp, Artificial Sequence
  Synthetic
gatctttgtattaggaggctgtaggcataaattggtctgcgcaccagcaccatgcaactttttcacctctgccta

SEQ ID NO: 103875 - DNA, 75 bp, Artificial Sequence
  Synthetic
gatctttgtattaggaggctgtaggcataaattggtctgcgcaccagcaccatgcaactttttctcctctgccta

SEQ ID NO: 103876 - DNA, 75 bp, Artificial Sequence
  Synthetic
gatctttgtattaggaggctgtaggcataaattggtctgcgcaccagcaccatgcaactttttcccctctgccta

SEQ ID NO: 103877 - DNA, 75 bp, Artificial Sequence
  Synthetic
gatctttgtattaggaggctgtaggcataaattggtctgcgcaccagcaccatgcaactttttcgcctctgccta

SEQ ID NO: 103878 - DNA, 75 bp, Artificial Sequence
  Synthetic
gatgtttgtattaggaggctgtaggcataaattggtctgcgcaccagcaccatgcaactttttcacctctgccta

SEQ ID NO: 103879 - DNA, 75 bp, Artificial Sequence
  Synthetic
gatgtttgtattaggaggctgtaggcataaattggtctgcgcaccagcaccatgcaactttttctcctctgccta

SEQ ID NO: 103880 - DNA, 75 bp, Artificial Sequence
  Synthetic
gatgtttgtattaggaggctgtaggcataaattggtctgcgcaccagcaccatgcaactttttcccctctgccta

SEQ ID NO: 103881 - DNA, 75 bp, Artificial Sequence
  Synthetic
gatgtttgtattaggaggctgtaggcataaattggtctgcgcaccagcaccatgcaactttttcgcctctgccta

SEQ ID NO: 103882 - DNA, 75 bp, Artificial Sequence
  Synthetic
ctccacccagttccaccaagctctacaaaatcccaaagtcaggggcctgtattttcctgctggtggctccagttc

SEQ ID NO: 103883 - DNA, 75 bp, Artificial Sequence
  Synthetic
tgcctgctaggttttatcccaatgttactaaatatttgcccttagataaagggatcaaaccttattatccagagc

SEQ ID NO: 103884 - DNA, 75 bp, Artificial Sequence
  Synthetic
aatacacctcctttccatggctgctaggatgtgctgccaactggatcctgcgcgggacgtcctttgtctacgtcc

SEQ ID NO: 103885 - DNA, 75 bp, Artificial Sequence
  Synthetic
ggtactttgccacaggaacacatcgcacagaaaattaagcaatgttttgggaaactacctgttaacaggccaatt

SEQ ID NO: 103886 - DNA, 75 bp, Artificial Sequence
  Synthetic
atacatttaaaccctcacaaaacaaaaagatggggatattcccttaatttcatgggatatgtaattgggggttgg

SEQ ID NO: 103887 - DNA, 75 bp, Artificial Sequence
  Synthetic
ggaggagttgggggaggagattaggttaaaggtctttgtactaggaggctgtaggcataaattggtctgttcacc

SEQ ID NO: 103888 - DNA, 75 bp, Artificial Sequence
  Synthetic
tctcggaaatatacctcctttccatggctgctaggctgtgctgccatatcgaccctttcagggacgtcctttgtt

SEQ ID NO: 103889 - DNA, 75 bp, Artificial Sequence
  Synthetic
agaatctcctgaacattgctcacctcatcacacagcaatcaggcaagctattctgtgctggggggaattaatgac

SEQ ID NO: 103890 - DNA, 75 bp, Artificial Sequence
  Synthetic
ctcaacaatcttccaccaaactctgcaagatcccagagtgaaccctgctggtggctccagttcaggaacagtaaa

SEQ ID NO: 103891 - DNA, 75 bp, Artificial Sequence
  Synthetic
tctagctacctgggtgggtgcaaatttggaagatccagcatccagggacctagtagtcagttatgtcaatactaa

SEQ ID NO: 103892 - DNA, 75 bp, Artificial Sequence
  Synthetic
agtgtgccttggggggctttggggcatgggccttgacccgtataaagaatttggagcttttggggagttactttt

SEQ ID NO: 103893 - DNA, 75 bp, Artificial Sequence
  Synthetic
agttggaccctgcattcaaagccaactcgttggggtagagtcctcaggctcagggcctactcacaactgtgccag

SEQ ID NO: 103894 - DNA, 75 bp, Artificial Sequence
  Synthetic
cagctcctcctcctgcctccaccaatcggcagtcaggaaggcagcctactcccttatctccacctctaagagaca

SEQ ID NO: 103895 - DNA, 75 bp, Artificial Sequence
  Synthetic
ctccacgacatttcaccaagctctgcaggatcccagagtaaggggtctgtattttcctgttggtggctccagttc

SEQ ID NO: 103896 - DNA, 75 bp, Artificial Sequence
  Synthetic
aggaacagtgaaccctgttccgaatactgcctctcacatctcgtcaatcttctcgaggactggggaccctgcacc

SEQ ID NO: 103897 - DNA, 75 bp, Artificial Sequence
  Synthetic
gaaactttacggggctttattcttctacggtacctaactttaatcctgattggcaaactccctcttttcctgaca

SEQ ID NO: 103898 - DNA, 75 bp, Artificial Sequence
  Synthetic
ctccacaacatcccaccaagctctgctagaccccagagtgagtcctgctggtggctccagttccggaacagtaaa

SEQ ID NO: 103899 - DNA, 75 bp, Artificial Sequence
  Synthetic
ttgttcatgtcccactgttcaagcctccaagctgtgccttgggtggctttggggcatggacattgacccttataa

SEQ ID NO: 103900 - DNA, 75 bp, Artificial Sequence
  Synthetic
ctccacaacgttccaccaaactcttcaagatccccaagtcagggttcatgtatcttcctgctggtggctccagtt

SEQ ID NO: 103901 - DNA, 75 bp, Artificial Sequence
  Synthetic
ctgcacgactcctgctcaaggaacctctatgtttccctcatgttgctgtacaaaacctacggacggaaactgcac

SEQ ID NO: 103902 - DNA, 75 bp, Artificial Sequence
  Synthetic
gtaaacaatatctgaacctttaccccgttgcccggcaacggccaggtctctgccaagtgtttgctgacgcaaccc

SEQ ID NO: 103903 - DNA, 75 bp, Artificial Sequence
  Synthetic
catggctgctaggctgtgctgccaactggatcctacgcgggacgtcctttgtttacgtcccgtcggcgctgaatc

SEQ ID NO: 103904 - DNA, 75 bp, Artificial Sequence
  Synthetic
ccttacttttggaagagagactgtacttgaatatttggtctctttcggagtgtggattcgcactcctccagccta

SEQ ID NO: 103905 - DNA, 75 bp, Artificial Sequence
  Synthetic
ctcatgcccttgtatgcctgtattaccgctaagcaggcttttgttttctcgccaacttacaaggcctttctctgt

SEQ ID NO: 103906 - DNA, 75 bp, Artificial Sequence
  Synthetic
tacgtcccgtcggcgctgaatcccgcggacgacccgtctcggggccgtttgggcctctaccgtccccttctgcat

SEQ ID NO: 103907 - DNA, 75 bp, Artificial Sequence
  Synthetic
attgattggaaagtgtgtcaacgaattgtgggtcttttgggatttgctgctcctttcacacaatgtggttatcct

SEQ ID NO: 103908 - DNA, 75 bp, Artificial Sequence
  Synthetic
ctaaatatttgcccttagacaaaggaattaaaccttattatccagatcaggtagttaatcattacttccaaacca

SEQ ID NO: 103909 - DNA, 75 bp, Artificial Sequence
  Synthetic
gcctttctgggtaaacaatccttgaacctttacccggttgcccggcaacggccaggtctgggccaagggtttgct

SEQ ID NO: 103910 - DNA, 75 bp, Artificial Sequence
  Synthetic
ttttttgcctgctgacttctttccttcggtccgtgatcttctcgacaccgcttcagctttgtaccgggaagcctt

SEQ ID NO: 103911 - DNA, 75 bp, Artificial Sequence
  Synthetic
tacgtcccgtcggcgctgaatcctgcggacgacccctctcgtggtcgcttggggctctaccgccctcttctccgc

SEQ ID NO: 103912 - DNA, 75 bp, Artificial Sequence
  Synthetic
tagaccaccaaatgcccctatcttatcaacacttccggaaactactgttgttagacgacgggaccgaggcaggtc

SEQ ID NO: 103913 - DNA, 75 bp, Artificial Sequence
  Synthetic
tcttgttggttcttctggactatcaaggtatgttgcccgtttgtcctctacttccaggatcatcaaccaccagca

SEQ ID NO: 103914 - DNA, 75 bp, Artificial Sequence
  Synthetic
tcttgcataagaggactcttggactttcagcaatgtcaacgaccgaccttgaggcatacttcaaagactgtgtgt

SEQ ID NO: 103915 - DNA, 75 bp, Artificial Sequence
  Synthetic
accaacaatccagattgggacttcaaccccaacaaggacaactggccagaggccaacaaggtaggagctggagcg

SEQ ID NO: 103916 - DNA, 75 bp, Artificial Sequence
  Synthetic
caagctgtgccttgggtggctttggggcatggacattgacccttataaagaatttggagcttctgtggagttact

SEQ ID NO: 103917 - DNA, 75 bp, Artificial Sequence
  Synthetic
ttgccaataaatccgcctcctgcctccaccaatcggcagtcaggcaggcagcctaccccacattcaccaccactg

SEQ ID NO: 103918 - DNA, 75 bp, Artificial Sequence
  Synthetic
tgggaaactttaccggtctttactcctctactatacctgttttcaatcctgactggttaactccttcttttcctg

SEQ ID NO: 103919 - DNA, 75 bp, Artificial Sequence
  Synthetic
ggcaccttgccacaagatcatataatacagaaaattaaacaatgcttcagaaaactccctgttaataggcccatt

SEQ ID NO: 103920 - DNA, 75 bp, Artificial Sequence
  Synthetic
gattgaaactaattatgccagctaggttttatcccaaagttactaaatacttccctttggataaaggtattaagc

SEQ ID NO: 103921 - DNA, 75 bp, Artificial Sequence
  Synthetic
tgggaaactttacggggctttattcttctacggtacctagctttaatcctaaatggcaaactccttcttttcctg

SEQ ID NO: 103922 - DNA, 75 bp, Artificial Sequence
  Synthetic
ggtactttaccacaggaacatattgtacaaaaaatcaagcaatgttttcgaaaactgcctgtaaatagacctatt

SEQ ID NO: 103923 - DNA, 75 bp, Artificial Sequence
  Synthetic
ttaccaattttcttttgtctctgggtatacatttaaaccctaacaaaacaaaaagatggggttattccctaaact

SEQ ID NO: 103924 - DNA, 75 bp, Artificial Sequence
  Synthetic
atacatctaaaccctaacaaaacaaaaaggtggggttattccctgcacttcatgggttatgtgattggaagttgg

SEQ ID NO: 103925 - DNA, 75 bp, Artificial Sequence
  Synthetic
aaaatcaaacaatgttttagaaaacttcctgtaaacaggcctattgattggaaagtatgtcaacgaattgtaggt

SEQ ID NO: 103926 - DNA, 75 bp, Artificial Sequence
  Synthetic
cccgatcaccagttggaccctgcattcaaagccaactccgacaatcccgattgggacctcaacccacacaaggac

SEQ ID NO: 103927 - DNA, 75 bp, Artificial Sequence
  Synthetic
caatcggaggtcaggaaggaaaccaaccccagtctctccacctctaagggacacacatccacaggccatgcagtg

SEQ ID NO: 103928 - DNA, 75 bp, Artificial Sequence
  Synthetic
ggatccttcgcgggacgtcctttgtttacgtcccgtcggcgctgaatcccgcggacgacccctctcggggccgct

SEQ ID NO: 103929 - DNA, 75 bp, Artificial Sequence
  Synthetic
gaaccctgctccgactattgcctctctcacatcatcaatcttcttgaagactgggggccctgctatgaacatgga

SEQ ID NO: 103930 - DNA, 75 bp, Artificial Sequence
  Synthetic
gaactcaagtcagttccaccaggctctgttagatccgagggtgaggcctgctggtggctccagttcagagacaca

SEQ ID NO: 103931 - DNA, 75 bp, Artificial Sequence
  Synthetic
acaaagggattaaaccttattatcctgatcaggtagttaatcattactttcaaacccgacattatttacatactc

SEQ ID NO: 103932 - DNA, 75 bp, Artificial Sequence
  Synthetic
cctctgggattctttcccgatcatcagttggaccctgcattcggagccaattcaaacaatccagattgggacttc

SEQ ID NO: 103933 - DNA, 75 bp, Artificial Sequence
  Synthetic
taaaattaattatgcctgccagattttatcctaaagttaccaaatatttgcccttagataaagggatcaaacctt

SEQ ID NO: 103934 - DNA, 75 bp, Artificial Sequence
  Synthetic
tcaagcctccaagctgtgccttgggtggctttagggcatggacatcgacccttataaagaatttggagcttctgt

SEQ ID NO: 103935 - DNA, 75 bp, Artificial Sequence
  Synthetic
aactccgacaatcccgattgggacctcaacccacacaaggacaactggccagacgccaacaaggtgggagtggga

SEQ ID NO: 103936 - DNA, 75 bp, Artificial Sequence
  Synthetic
ttcacctcaccatactgcactcaggcaagcaattctttgctggggggacctaatgaatttagccacctgggtggg

SEQ ID NO: 103937 - DNA, 75 bp, Artificial Sequence
  Synthetic
actgtgccaacagctcctcctcctgcctccaccaatcggcaggtaggaaggcagcctactcccctgtctccacct

SEQ ID NO: 103938 - DNA, 75 bp, Artificial Sequence
  Synthetic
ctttgtggctcctctgccgatccatactgcggaactcctagccgcttgttttgctcgcagccggtctggagcgaa

SEQ ID NO: 103939 - DNA, 75 bp, Artificial Sequence
  Synthetic
cacctcaccatactgcactcaggcaagcaattctttgctggggggaactaatgactctagctacctgggtgggtg

SEQ ID NO: 103940 - DNA, 75 bp, Artificial Sequence
  Synthetic
ttcaacaacattccaccaaactctgcagaatcccagagtaacaggcctgtatcctcctgctggtggctccagttc

SEQ ID NO: 103941 - DNA, 75 bp, Artificial Sequence
  Synthetic
taaaattaattatgcccgccagattctatccaaactccaccaaatatttgcccctagataaaggaataaaacctt

SEQ ID NO: 103942 - DNA, 75 bp, Artificial Sequence
  Synthetic
taaaattaattatgcccgccagattctatccaaactccaccaaatatttgcccctagataaaggaattaaacctt

SEQ ID NO: 103943 - DNA, 75 bp, Artificial Sequence
  Synthetic
taaaattaattatgcccgccagattctatccaaactccaccaaatatttgcccctagataaaggaatcaaacctt

SEQ ID NO: 103944 - DNA, 75 bp, Artificial Sequence
  Synthetic
taaaattaattatgcccgccagattctatccaaactccaccaaatatttgcccctagataaaggaatgaaacctt

SEQ ID NO: 103945 - DNA, 75 bp, Artificial Sequence
  Synthetic
taaaattaattatgcccgccagattctatccaaactccaccaaatatttgcccctagataaaggtataaaacctt

SEQ ID NO: 103946 - DNA, 75 bp, Artificial Sequence
  Synthetic
taaaattaattatgcccgccagattctatccaaactccaccaaatatttgcccctagataaaggtattaaacctt

SEQ ID NO: 103947 - DNA, 75 bp, Artificial Sequence
  Synthetic
taaaattaattatgcccgccagattctatccaaactccaccaaatatttgcccctagataaaggtatcaaacctt

SEQ ID NO: 103948 - DNA, 75 bp, Artificial Sequence
  Synthetic
taaaattaattatgcccgccagattctatccaaactccaccaaatatttgcccctagataaaggtatgaaacctt

SEQ ID NO: 103949 - DNA, 75 bp, Artificial Sequence
  Synthetic
taaaattaattatgcccgccagattctatccaaactccaccaaatatttgcccctagataaaggcataaaacctt

SEQ ID NO: 103950 - DNA, 75 bp, Artificial Sequence
  Synthetic
taaaattaattatgcccgccagattctatccaaactccaccaaatatttgcccctagataaaggcattaaacctt

SEQ ID NO: 103951 - DNA, 75 bp, Artificial Sequence
  Synthetic
taaaattaattatgcccgccagattctatccaaactccaccaaatatttgcccctagataaaggcatcaaacctt

SEQ ID NO: 103952 - DNA, 75 bp, Artificial Sequence
  Synthetic
taaaattaattatgcccgccagattctatccaaactccaccaaatatttgcccctagataaaggcatgaaacctt

SEQ ID NO: 103953 - DNA, 75 bp, Artificial Sequence
  Synthetic
taaaattaattatgcccgccagattctatccaaactccaccaaatatttgcccctagataaagggataaaacctt

SEQ ID NO: 103954 - DNA, 75 bp, Artificial Sequence
  Synthetic
taaaattaattatgcccgccagattctatccaaactccaccaaatatttgcccctagataaagggattaaacctt

SEQ ID NO: 103955 - DNA, 75 bp, Artificial Sequence
  Synthetic
taaaattaattatgcccgccagattctatccaaactccaccaaatatttgcccctagataaagggatcaaacctt

SEQ ID NO: 103956 - DNA, 75 bp, Artificial Sequence
  Synthetic
taaaattaattatgcccgccagattctatccaaactccaccaaatatttgcccctagataaagggatgaaacctt

SEQ ID NO: 103957 - DNA, 75 bp, Artificial Sequence
  Synthetic
taacaaaaaatgaattgagaagattaaaattggttatgccatccagattttttcctaaggttaccaaatattttc

SEQ ID NO: 103958 - DNA, 75 bp, Artificial Sequence
  Synthetic
acgggaccctgcagaacctgcacgactcttgctcaaggaacctctatgtttccctcatgttgctgttcaaaacct

SEQ ID NO: 103959 - DNA, 75 bp, Artificial Sequence
  Synthetic
acaaacaacccagattgggacttcaaccccaacaaggaccactggccagaagccaacaaggtaggagtgggagca

SEQ ID NO: 103960 - DNA, 75 bp, Artificial Sequence
  Synthetic
acaacatcaggattcctaggacccctgctcgtgttacaggcggggtttttcttgttgacaagaatcctcacaata

SEQ ID NO: 103961 - DNA, 75 bp, Artificial Sequence
  Synthetic
ttccacaacattccaccaagctctgcaggatcccagagtaaaaggccctgctggtggctccagttccggaacagt

SEQ ID NO: 103962 - DNA, 75 bp, Artificial Sequence
  Synthetic
tctggccacctgggtgggaagtaatttggaagacccagcatccagggaattagtagtcagttatgtcaatgttaa

SEQ ID NO: 103963 - DNA, 75 bp, Artificial Sequence
  Synthetic
tctatcgtccccttctccgtctgccgttccggccgaccacggggcgcacctctctttacgcggtctccccgtctg

SEQ ID NO: 103964 - DNA, 75 bp, Artificial Sequence
  Synthetic
tgttttgctcgcagccggtctggagcgaaacttatcggaaccgacaactctgttgtcctctctcggaaatacacc

SEQ ID NO: 103965 - DNA, 75 bp, Artificial Sequence
  Synthetic
ctccacggcattccaccaagctctacaagatcccagagtgaagggcctgtatcatcctgctggtggctccagttc

SEQ ID NO: 103966 - DNA, 75 bp, Artificial Sequence
  Synthetic
tcaaggaacctctatgtttccctcttgttgctgtacaaaaccttcggacggaaactgcacttgtattcccatccc

SEQ ID NO: 103967 - DNA, 75 bp, Artificial Sequence
  Synthetic
tggttatcgctggatgtgtctgcggcgttttatcatcttcctcttcatcctgctgctatgcctcatcttcttgtt

SEQ ID NO: 103968 - DNA, 75 bp, Artificial Sequence
  Synthetic
tgctggggggaactaatgactctagctacctgggtgggtgtaaatttggaagatccagcatccagggacctagta

SEQ ID NO: 103969 - DNA, 75 bp, Artificial Sequence
  Synthetic
attgggacttcaacccacacaaggacaactggcccgacgccacaaaggtaggagtgggagcattcgggccagggt

SEQ ID NO: 103970 - DNA, 75 bp, Artificial Sequence
  Synthetic
gacaacacgtagcgcctccttctgtgggtcaccatattcttgggaacaagagctacagcatggggcagaatcatt

SEQ ID NO: 103971 - DNA, 75 bp, Artificial Sequence
  Synthetic
ttacacaacattccaccaagctctgcaggatcccaaagtaagacctgctggtggctccagttccggaacagtgaa

SEQ ID NO: 103972 - DNA, 75 bp, Artificial Sequence
  Synthetic
tgctttaatcctaatggcaaactccttctttcctgacattcattgcaggaggacatgtgatagatgtaagcaatt

SEQ ID NO: 103973 - DNA, 75 bp, Artificial Sequence
  Synthetic
gagatctactagacaccgcctcagctctgtatcgggatgccttagagtctccagatcattgatcacctcaccata

SEQ ID NO: 103974 - DNA, 75 bp, Artificial Sequence
  Synthetic
gagatctactagacaccgcctcagctctgtatcgggatgccttagagtctcctgatcattgatcacctcaccata

SEQ ID NO: 103975 - DNA, 75 bp, Artificial Sequence
  Synthetic
gagatctactagacaccgcctcagctctgtatcgggatgccttagagtctcccgatcattgatcacctcaccata

SEQ ID NO: 103976 - DNA, 75 bp, Artificial Sequence
  Synthetic
gagatctactagacaccgcctcagctctgtatcgggatgccttagagtctccggatcattgatcacctcaccata

SEQ ID NO: 103977 - DNA, 75 bp, Artificial Sequence
  Synthetic
gagatctacttgacaccgcctcagctctgtatcgggatgccttagagtctccagatcattgatcacctcaccata

SEQ ID NO: 103978 - DNA, 75 bp, Artificial Sequence
  Synthetic
gagatctacttgacaccgcctcagctctgtatcgggatgccttagagtctcctgatcattgatcacctcaccata

SEQ ID NO: 103979 - DNA, 75 bp, Artificial Sequence
  Synthetic
gagatctacttgacaccgcctcagctctgtatcgggatgccttagagtctcccgatcattgatcacctcaccata

SEQ ID NO: 103980 - DNA, 75 bp, Artificial Sequence
  Synthetic
gagatctacttgacaccgcctcagctctgtatcgggatgccttagagtctccggatcattgatcacctcaccata

SEQ ID NO: 103981 - DNA, 75 bp, Artificial Sequence
  Synthetic
gagatctactcgacaccgcctcagctctgtatcgggatgccttagagtctccagatcattgatcacctcaccata

SEQ ID NO: 103982 - DNA, 75 bp, Artificial Sequence
  Synthetic
gagatctactcgacaccgcctcagctctgtatcgggatgccttagagtctcctgatcattgatcacctcaccata

SEQ ID NO: 103983 - DNA, 75 bp, Artificial Sequence
  Synthetic
gagatctactcgacaccgcctcagctctgtatcgggatgccttagagtctcccgatcattgatcacctcaccata

SEQ ID NO: 103984 - DNA, 75 bp, Artificial Sequence
  Synthetic
gagatctactcgacaccgcctcagctctgtatcgggatgccttagagtctccggatcattgatcacctcaccata

SEQ ID NO: 103985 - DNA, 75 bp, Artificial Sequence
  Synthetic
gagatctactggacaccgcctcagctctgtatcgggatgccttagagtctccagatcattgatcacctcaccata

SEQ ID NO: 103986 - DNA, 75 bp, Artificial Sequence
  Synthetic
gagatctactggacaccgcctcagctctgtatcgggatgccttagagtctcctgatcattgatcacctcaccata

SEQ ID NO: 103987 - DNA, 75 bp, Artificial Sequence
  Synthetic
gagatctactggacaccgcctcagctctgtatcgggatgccttagagtctcccgatcattgatcacctcaccata

SEQ ID NO: 103988 - DNA, 75 bp, Artificial Sequence
  Synthetic
gagatctactggacaccgcctcagctctgtatcgggatgccttagagtctccggatcattgatcacctcaccata

SEQ ID NO: 103989 - DNA, 75 bp, Artificial Sequence
  Synthetic
gagatcttctagacaccgcctcagctctgtatcgggatgccttagagtctccagatcattgatcacctcaccata

SEQ ID NO: 103990 - DNA, 75 bp, Artificial Sequence
  Synthetic
gagatcttctagacaccgcctcagctctgtatcgggatgccttagagtctcctgatcattgatcacctcaccata

SEQ ID NO: 103991 - DNA, 75 bp, Artificial Sequence
  Synthetic
gagatcttctagacaccgcctcagctctgtatcgggatgccttagagtctcccgatcattgatcacctcaccata

SEQ ID NO: 103992 - DNA, 75 bp, Artificial Sequence
  Synthetic
gagatcttctagacaccgcctcagctctgtatcgggatgccttagagtctccggatcattgatcacctcaccata

SEQ ID NO: 103993 - DNA, 75 bp, Artificial Sequence
  Synthetic
gagatcttcttgacaccgcctcagctctgtatcgggatgccttagagtctccagatcattgatcacctcaccata

SEQ ID NO: 103994 - DNA, 75 bp, Artificial Sequence
  Synthetic
gagatcttcttgacaccgcctcagctctgtatcgggatgccttagagtctcctgatcattgatcacctcaccata

SEQ ID NO: 103995 - DNA, 75 bp, Artificial Sequence
  Synthetic
gagatcttcttgacaccgcctcagctctgtatcgggatgccttagagtctcccgatcattgatcacctcaccata

SEQ ID NO: 103996 - DNA, 75 bp, Artificial Sequence
  Synthetic
gagatcttcttgacaccgcctcagctctgtatcgggatgccttagagtctccggatcattgatcacctcaccata

SEQ ID NO: 103997 - DNA, 75 bp, Artificial Sequence
  Synthetic
gagatcttctcgacaccgcctcagctctgtatcgggatgccttagagtctccagatcattgatcacctcaccata

SEQ ID NO: 103998 - DNA, 75 bp, Artificial Sequence
  Synthetic
gagatcttctcgacaccgcctcagctctgtatcgggatgccttagagtctcctgatcattgatcacctcaccata

SEQ ID NO: 103999 - DNA, 75 bp, Artificial Sequence
  Synthetic
gagatcttctcgacaccgcctcagctctgtatcgggatgccttagagtctcccgatcattgatcacctcaccata

SEQ ID NO: 104000 - DNA, 75 bp, Artificial Sequence
  Synthetic
gagatcttctcgacaccgcctcagctctgtatcgggatgccttagagtctccggatcattgatcacctcaccata

SEQ ID NO: 104001 - DNA, 75 bp, Artificial Sequence
  Synthetic
gagatcttctggacaccgcctcagctctgtatcgggatgccttagagtctccagatcattgatcacctcaccata

SEQ ID NO: 104002 - DNA, 75 bp, Artificial Sequence
  Synthetic
gagatcttctggacaccgcctcagctctgtatcgggatgccttagagtctcctgatcattgatcacctcaccata

SEQ ID NO: 104003 - DNA, 75 bp, Artificial Sequence
  Synthetic
gagatcttctggacaccgcctcagctctgtatcgggatgccttagagtctcccgatcattgatcacctcaccata

SEQ ID NO: 104004 - DNA, 75 bp, Artificial Sequence
  Synthetic
gagatcttctggacaccgcctcagctctgtatcgggatgccttagagtctccggatcattgatcacctcaccata

SEQ ID NO: 104005 - DNA, 75 bp, Artificial Sequence
  Synthetic
gagatctcctagacaccgcctcagctctgtatcgggatgccttagagtctccagatcattgatcacctcaccata

SEQ ID NO: 104006 - DNA, 75 bp, Artificial Sequence
  Synthetic
gagatctcctagacaccgcctcagctctgtatcgggatgccttagagtctcctgatcattgatcacctcaccata

SEQ ID NO: 104007 - DNA, 75 bp, Artificial Sequence
  Synthetic
gagatctcctagacaccgcctcagctctgtatcgggatgccttagagtctcccgatcattgatcacctcaccata

SEQ ID NO: 104008 - DNA, 75 bp, Artificial Sequence
  Synthetic
gagatctcctagacaccgcctcagctctgtatcgggatgccttagagtctccggatcattgatcacctcaccata

SEQ ID NO: 104009 - DNA, 75 bp, Artificial Sequence
  Synthetic
gagatctccttgacaccgcctcagctctgtatcgggatgccttagagtctccagatcattgatcacctcaccata

SEQ ID NO: 104010 - DNA, 75 bp, Artificial Sequence
  Synthetic
gagatctccttgacaccgcctcagctctgtatcgggatgccttagagtctcctgatcattgatcacctcaccata

SEQ ID NO: 104011 - DNA, 75 bp, Artificial Sequence
  Synthetic
gagatctccttgacaccgcctcagctctgtatcgggatgccttagagtctcccgatcattgatcacctcaccata

SEQ ID NO: 104012 - DNA, 75 bp, Artificial Sequence
  Synthetic
gagatctccttgacaccgcctcagctctgtatcgggatgccttagagtctccggatcattgatcacctcaccata

SEQ ID NO: 104013 - DNA, 75 bp, Artificial Sequence
  Synthetic
gagatctcctcgacaccgcctcagctctgtatcgggatgccttagagtctccagatcattgatcacctcaccata

SEQ ID NO: 104014 - DNA, 75 bp, Artificial Sequence
  Synthetic
gagatctcctcgacaccgcctcagctctgtatcgggatgccttagagtctcctgatcattgatcacctcaccata

SEQ ID NO: 104015 - DNA, 75 bp, Artificial Sequence
  Synthetic
gagatctcctcgacaccgcctcagctctgtatcgggatgccttagagtctcccgatcattgatcacctcaccata

SEQ ID NO: 104016 - DNA, 75 bp, Artificial Sequence
  Synthetic
gagatctcctcgacaccgcctcagctctgtatcgggatgccttagagtctccggatcattgatcacctcaccata

SEQ ID NO: 104017 - DNA, 75 bp, Artificial Sequence
  Synthetic
gagatctcctggacaccgcctcagctctgtatcgggatgccttagagtctccagatcattgatcacctcaccata

SEQ ID NO: 104018 - DNA, 75 bp, Artificial Sequence
  Synthetic
gagatctcctggacaccgcctcagctctgtatcgggatgccttagagtctcctgatcattgatcacctcaccata

SEQ ID NO: 104019 - DNA, 75 bp, Artificial Sequence
  Synthetic
gagatctcctggacaccgcctcagctctgtatcgggatgccttagagtctcccgatcattgatcacctcaccata

SEQ ID NO: 104020 - DNA, 75 bp, Artificial Sequence
  Synthetic
gagatctcctggacaccgcctcagctctgtatcgggatgccttagagtctccggatcattgatcacctcaccata

SEQ ID NO: 104021 - DNA, 75 bp, Artificial Sequence
  Synthetic
gagatctgctagacaccgcctcagctctgtatcgggatgccttagagtctccagatcattgatcacctcaccata

SEQ ID NO: 104022 - DNA, 75 bp, Artificial Sequence
  Synthetic
gagatctgctagacaccgcctcagctctgtatcgggatgccttagagtctcctgatcattgatcacctcaccata

SEQ ID NO: 104023 - DNA, 75 bp, Artificial Sequence
  Synthetic
gagatctgctagacaccgcctcagctctgtatcgggatgccttagagtctcccgatcattgatcacctcaccata

SEQ ID NO: 104024 - DNA, 75 bp, Artificial Sequence
  Synthetic
gagatctgctagacaccgcctcagctctgtatcgggatgccttagagtctccggatcattgatcacctcaccata

SEQ ID NO: 104025 - DNA, 75 bp, Artificial Sequence
  Synthetic
gagatctgcttgacaccgcctcagctctgtatcgggatgccttagagtctccagatcattgatcacctcaccata

SEQ ID NO: 104026 - DNA, 75 bp, Artificial Sequence
  Synthetic
gagatctgcttgacaccgcctcagctctgtatcgggatgccttagagtctcctgatcattgatcacctcaccata

SEQ ID NO: 104027 - DNA, 75 bp, Artificial Sequence
  Synthetic
gagatctgcttgacaccgcctcagctctgtatcgggatgccttagagtctcccgatcattgatcacctcaccata

SEQ ID NO: 104028 - DNA, 75 bp, Artificial Sequence
  Synthetic
gagatctgcttgacaccgcctcagctctgtatcgggatgccttagagtctccggatcattgatcacctcaccata

SEQ ID NO: 104029 - DNA, 75 bp, Artificial Sequence
  Synthetic
gagatctgctcgacaccgcctcagctctgtatcgggatgccttagagtctccagatcattgatcacctcaccata

SEQ ID NO: 104030 - DNA, 75 bp, Artificial Sequence
  Synthetic
gagatctgctcgacaccgcctcagctctgtatcgggatgccttagagtctcctgatcattgatcacctcaccata

SEQ ID NO: 104031 - DNA, 75 bp, Artificial Sequence
  Synthetic
gagatctgctcgacaccgcctcagctctgtatcgggatgccttagagtctcccgatcattgatcacctcaccata

SEQ ID NO: 104032 - DNA, 75 bp, Artificial Sequence
  Synthetic
gagatctgctcgacaccgcctcagctctgtatcgggatgccttagagtctccggatcattgatcacctcaccata

SEQ ID NO: 104033 - DNA, 75 bp, Artificial Sequence
  Synthetic
gagatctgctggacaccgcctcagctctgtatcgggatgccttagagtctccagatcattgatcacctcaccata

SEQ ID NO: 104034 - DNA, 75 bp, Artificial Sequence
  Synthetic
gagatctgctggacaccgcctcagctctgtatcgggatgccttagagtctcctgatcattgatcacctcaccata

SEQ ID NO: 104035 - DNA, 75 bp, Artificial Sequence
  Synthetic
gagatctgctggacaccgcctcagctctgtatcgggatgccttagagtctcccgatcattgatcacctcaccata

SEQ ID NO: 104036 - DNA, 75 bp, Artificial Sequence
  Synthetic
gagatctgctggacaccgcctcagctctgtatcgggatgccttagagtctccggatcattgatcacctcaccata

SEQ ID NO: 104037 - DNA, 75 bp, Artificial Sequence
  Synthetic
tccctcttgttgctgtacaaaaccttcggacggaaattgcacttgtattcccatcccatcatcttgggctttcgc

SEQ ID NO: 104038 - DNA, 75 bp, Artificial Sequence
  Synthetic
cattctatgttggggtgacttgatgattctagcaacctgggtgggtaataatttggaagacccagcatccaggga

SEQ ID NO: 104039 - DNA, 75 bp, Artificial Sequence
  Synthetic
cattctatgttggggtgacttgatgattctagcaacctgggtgggtattaatttggaagacccagcatccaggga

SEQ ID NO: 104040 - DNA, 75 bp, Artificial Sequence
  Synthetic
cattctatgttggggtgacttgatgattctagcaacctgggtgggtactaatttggaagacccagcatccaggga

SEQ ID NO: 104041 - DNA, 75 bp, Artificial Sequence
  Synthetic
cattctatgttggggtgacttgatgattctagcaacctgggtgggtagtaatttggaagacccagcatccaggga

SEQ ID NO: 104042 - DNA, 75 bp, Artificial Sequence
  Synthetic
cattctatgttggggtgacttgatgattctagctacctgggtgggtaataatttggaagacccagcatccaggga

SEQ ID NO: 104043 - DNA, 75 bp, Artificial Sequence
  Synthetic
cattctatgttggggtgacttgatgattctagctacctgggtgggtattaatttggaagacccagcatccaggga

SEQ ID NO: 104044 - DNA, 75 bp, Artificial Sequence
  Synthetic
cattctatgttggggtgacttgatgattctagctacctgggtgggtactaatttggaagacccagcatccaggga

SEQ ID NO: 104045 - DNA, 75 bp, Artificial Sequence
  Synthetic
cattctatgttggggtgacttgatgattctagctacctgggtgggtagtaatttggaagacccagcatccaggga

SEQ ID NO: 104046 - DNA, 75 bp, Artificial Sequence
  Synthetic
cattctatgttggggtgacttgatgattctagccacctgggtgggtaataatttggaagacccagcatccaggga

SEQ ID NO: 104047 - DNA, 75 bp, Artificial Sequence
  Synthetic
cattctatgttggggtgacttgatgattctagccacctgggtgggtattaatttggaagacccagcatccaggga

SEQ ID NO: 104048 - DNA, 75 bp, Artificial Sequence
  Synthetic
cattctatgttggggtgacttgatgattctagccacctgggtgggtactaatttggaagacccagcatccaggga

SEQ ID NO: 104049 - DNA, 75 bp, Artificial Sequence
  Synthetic
cattctatgttggggtgacttgatgattctagccacctgggtgggtagtaatttggaagacccagcatccaggga

SEQ ID NO: 104050 - DNA, 75 bp, Artificial Sequence
  Synthetic
cattctatgttggggtgacttgatgattctagcgacctgggtgggtaataatttggaagacccagcatccaggga

SEQ ID NO: 104051 - DNA, 75 bp, Artificial Sequence
  Synthetic
cattctatgttggggtgacttgatgattctagcgacctgggtgggtattaatttggaagacccagcatccaggga

SEQ ID NO: 104052 - DNA, 75 bp, Artificial Sequence
  Synthetic
cattctatgttggggtgacttgatgattctagcgacctgggtgggtactaatttggaagacccagcatccaggga

SEQ ID NO: 104053 - DNA, 75 bp, Artificial Sequence
  Synthetic
cattctatgttggggtgacttgatgattctagcgacctgggtgggtagtaatttggaagacccagcatccaggga

SEQ ID NO: 104054 - DNA, 75 bp, Artificial Sequence
  Synthetic
cattctttgttggggtgacttgatgattctagcaacctgggtgggtaataatttggaagacccagcatccaggga

SEQ ID NO: 104055 - DNA, 75 bp, Artificial Sequence
  Synthetic
cattctttgttggggtgacttgatgattctagcaacctgggtgggtattaatttggaagacccagcatccaggga

SEQ ID NO: 104056 - DNA, 75 bp, Artificial Sequence
  Synthetic
cattctttgttggggtgacttgatgattctagcaacctgggtgggtactaatttggaagacccagcatccaggga

SEQ ID NO: 104057 - DNA, 75 bp, Artificial Sequence
  Synthetic
cattctttgttggggtgacttgatgattctagcaacctgggtgggtagtaatttggaagacccagcatccaggga

SEQ ID NO: 104058 - DNA, 75 bp, Artificial Sequence
  Synthetic
cattctttgttggggtgacttgatgattctagctacctgggtgggtaataatttggaagacccagcatccaggga

SEQ ID NO: 104059 - DNA, 75 bp, Artificial Sequence
  Synthetic
cattctttgttggggtgacttgatgattctagctacctgggtgggtattaatttggaagacccagcatccaggga

SEQ ID NO: 104060 - DNA, 75 bp, Artificial Sequence
  Synthetic
cattctttgttggggtgacttgatgattctagctacctgggtgggtactaatttggaagacccagcatccaggga

SEQ ID NO: 104061 - DNA, 75 bp, Artificial Sequence
  Synthetic
cattctttgttggggtgacttgatgattctagctacctgggtgggtagtaatttggaagacccagcatccaggga

SEQ ID NO: 104062 - DNA, 75 bp, Artificial Sequence
  Synthetic
cattctttgttggggtgacttgatgattctagccacctgggtgggtaataatttggaagacccagcatccaggga

SEQ ID NO: 104063 - DNA, 75 bp, Artificial Sequence
  Synthetic
cattctttgttggggtgacttgatgattctagccacctgggtgggtattaatttggaagacccagcatccaggga

SEQ ID NO: 104064 - DNA, 75 bp, Artificial Sequence
  Synthetic
cattctttgttggggtgacttgatgattctagccacctgggtgggtactaatttggaagacccagcatccaggga

SEQ ID NO: 104065 - DNA, 75 bp, Artificial Sequence
  Synthetic
cattctttgttggggtgacttgatgattctagccacctgggtgggtagtaatttggaagacccagcatccaggga

SEQ ID NO: 104066 - DNA, 75 bp, Artificial Sequence
  Synthetic
cattctttgttggggtgacttgatgattctagcgacctgggtgggtaataatttggaagacccagcatccaggga

SEQ ID NO: 104067 - DNA, 75 bp, Artificial Sequence
  Synthetic
cattctttgttggggtgacttgatgattctagcgacctgggtgggtattaatttggaagacccagcatccaggga

SEQ ID NO: 104068 - DNA, 75 bp, Artificial Sequence
  Synthetic
cattctttgttggggtgacttgatgattctagcgacctgggtgggtactaatttggaagacccagcatccaggga

SEQ ID NO: 104069 - DNA, 75 bp, Artificial Sequence
  Synthetic
cattctttgttggggtgacttgatgattctagcgacctgggtgggtagtaatttggaagacccagcatccaggga

SEQ ID NO: 104070 - DNA, 75 bp, Artificial Sequence
  Synthetic
cattctctgttggggtgacttgatgattctagcaacctgggtgggtaataatttggaagacccagcatccaggga

SEQ ID NO: 104071 - DNA, 75 bp, Artificial Sequence
  Synthetic
cattctctgttggggtgacttgatgattctagcaacctgggtgggtattaatttggaagacccagcatccaggga

SEQ ID NO: 104072 - DNA, 75 bp, Artificial Sequence
  Synthetic
cattctctgttggggtgacttgatgattctagcaacctgggtgggtactaatttggaagacccagcatccaggga

SEQ ID NO: 104073 - DNA, 75 bp, Artificial Sequence
  Synthetic
cattctctgttggggtgacttgatgattctagcaacctgggtgggtagtaatttggaagacccagcatccaggga

SEQ ID NO: 104074 - DNA, 75 bp, Artificial Sequence
  Synthetic
cattctctgttggggtgacttgatgattctagctacctgggtgggtaataatttggaagacccagcatccaggga

SEQ ID NO: 104075 - DNA, 75 bp, Artificial Sequence
  Synthetic
cattctctgttggggtgacttgatgattctagctacctgggtgggtattaatttggaagacccagcatccaggga

SEQ ID NO: 104076 - DNA, 75 bp, Artificial Sequence
  Synthetic
cattctctgttggggtgacttgatgattctagctacctgggtgggtactaatttggaagacccagcatccaggga

SEQ ID NO: 104077 - DNA, 75 bp, Artificial Sequence
  Synthetic
cattctctgttggggtgacttgatgattctagctacctgggtgggtagtaatttggaagacccagcatccaggga

SEQ ID NO: 104078 - DNA, 75 bp, Artificial Sequence
  Synthetic
cattctctgttggggtgacttgatgattctagccacctgggtgggtaataatttggaagacccagcatccaggga

SEQ ID NO: 104079 - DNA, 75 bp, Artificial Sequence
  Synthetic
cattctctgttggggtgacttgatgattctagccacctgggtgggtattaatttggaagacccagcatccaggga

SEQ ID NO: 104080 - DNA, 75 bp, Artificial Sequence
  Synthetic
cattctctgttggggtgacttgatgattctagccacctgggtgggtactaatttggaagacccagcatccaggga

SEQ ID NO: 104081 - DNA, 75 bp, Artificial Sequence
  Synthetic
cattctctgttggggtgacttgatgattctagccacctgggtgggtagtaatttggaagacccagcatccaggga

SEQ ID NO: 104082 - DNA, 75 bp, Artificial Sequence
  Synthetic
cattctctgttggggtgacttgatgattctagcgacctgggtgggtaataatttggaagacccagcatccaggga

SEQ ID NO: 104083 - DNA, 75 bp, Artificial Sequence
  Synthetic
cattctctgttggggtgacttgatgattctagcgacctgggtgggtattaatttggaagacccagcatccaggga

SEQ ID NO: 104084 - DNA, 75 bp, Artificial Sequence
  Synthetic
cattctctgttggggtgacttgatgattctagcgacctgggtgggtactaatttggaagacccagcatccaggga

SEQ ID NO: 104085 - DNA, 75 bp, Artificial Sequence
  Synthetic
cattctctgttggggtgacttgatgattctagcgacctgggtgggtagtaatttggaagacccagcatccaggga

SEQ ID NO: 104086 - DNA, 75 bp, Artificial Sequence
  Synthetic
cattctgtgttggggtgacttgatgattctagcaacctgggtgggtaataatttggaagacccagcatccaggga

SEQ ID NO: 104087 - DNA, 75 bp, Artificial Sequence
  Synthetic
cattctgtgttggggtgacttgatgattctagcaacctgggtgggtattaatttggaagacccagcatccaggga

SEQ ID NO: 104088 - DNA, 75 bp, Artificial Sequence
  Synthetic
cattctgtgttggggtgacttgatgattctagcaacctgggtgggtactaatttggaagacccagcatccaggga

SEQ ID NO: 104089 - DNA, 75 bp, Artificial Sequence
  Synthetic
cattctgtgttggggtgacttgatgattctagcaacctgggtgggtagtaatttggaagacccagcatccaggga

SEQ ID NO: 104090 - DNA, 75 bp, Artificial Sequence
  Synthetic
cattctgtgttggggtgacttgatgattctagctacctgggtgggtaataatttggaagacccagcatccaggga

SEQ ID NO: 104091 - DNA, 75 bp, Artificial Sequence
  Synthetic
cattctgtgttggggtgacttgatgattctagctacctgggtgggtattaatttggaagacccagcatccaggga

SEQ ID NO: 104092 - DNA, 75 bp, Artificial Sequence
  Synthetic
cattctgtgttggggtgacttgatgattctagctacctgggtgggtactaatttggaagacccagcatccaggga

SEQ ID NO: 104093 - DNA, 75 bp, Artificial Sequence
  Synthetic
cattctgtgttggggtgacttgatgattctagctacctgggtgggtagtaatttggaagacccagcatccaggga

SEQ ID NO: 104094 - DNA, 75 bp, Artificial Sequence
  Synthetic
cattctgtgttggggtgacttgatgattctagccacctgggtgggtaataatttggaagacccagcatccaggga

SEQ ID NO: 104095 - DNA, 75 bp, Artificial Sequence
  Synthetic
cattctgtgttggggtgacttgatgattctagccacctgggtgggtattaatttggaagacccagcatccaggga

SEQ ID NO: 104096 - DNA, 75 bp, Artificial Sequence
  Synthetic
cattctgtgttggggtgacttgatgattctagccacctgggtgggtactaatttggaagacccagcatccaggga

SEQ ID NO: 104097 - DNA, 75 bp, Artificial Sequence
  Synthetic
cattctgtgttggggtgacttgatgattctagccacctgggtgggtagtaatttggaagacccagcatccaggga

SEQ ID NO: 104098 - DNA, 75 bp, Artificial Sequence
  Synthetic
cattctgtgttggggtgacttgatgattctagcgacctgggtgggtaataatttggaagacccagcatccaggga

SEQ ID NO: 104099 - DNA, 75 bp, Artificial Sequence
  Synthetic
cattctgtgttggggtgacttgatgattctagcgacctgggtgggtattaatttggaagacccagcatccaggga

SEQ ID NO: 104100 - DNA, 75 bp, Artificial Sequence
  Synthetic
cattctgtgttggggtgacttgatgattctagcgacctgggtgggtactaatttggaagacccagcatccaggga

SEQ ID NO: 104101 - DNA, 75 bp, Artificial Sequence
  Synthetic
cattctgtgttggggtgacttgatgattctagcgacctgggtgggtagtaatttggaagacccagcatccaggga

SEQ ID NO: 104102 - DNA, 75 bp, Artificial Sequence
  Synthetic
tccagattgggacctcaacccgcacaaggacaactggccggacgccaacaaggtgggagtgggagcattcgggcc

SEQ ID NO: 104103 - DNA, 75 bp, Artificial Sequence
  Synthetic
ctctacagtattccaccaaactctgcaagatcccagagtaaggggcctatactttcctgttggtggctccagttt

SEQ ID NO: 104104 - DNA, 75 bp, Artificial Sequence
  Synthetic
atcccaacaaagaccactggacagaagccaacaaggtaggagtgggagcattcgggccggggttcactcccccac

SEQ ID NO: 104105 - DNA, 75 bp, Artificial Sequence
  Synthetic
gggctttcttggacggtccctctcgaatgggggaagaatcattccaccaccaatcctctgggattttttcccgac

SEQ ID NO: 104106 - DNA, 75 bp, Artificial Sequence
  Synthetic
caagaacacatcagaatgaaaatcaaagactgttttagaaaactccctgttaaccggcctattgattggaaagta

SEQ ID NO: 104107 - DNA, 75 bp, Artificial Sequence
  Synthetic
tggacattgacccgtataaagaatttggagcttctgtggagttactctcttttttgccttctgacttttttcctt

SEQ ID NO: 104108 - DNA, 75 bp, Artificial Sequence
  Synthetic
tcggcagtcaggaaggcagcctacaccaatcactccacctttgagagacactcatcctcaggccatgcagtggaa

SEQ ID NO: 104109 - DNA, 75 bp, Artificial Sequence
  Synthetic
ctcaacacagttccaccaagcactgctggatccgagagtaaggggtcctgctggtggctccagttcagaaacaca

SEQ ID NO: 104110 - DNA, 75 bp, Artificial Sequence
  Synthetic
ctccacaacattccaccaagctctgcaggatcccagagtaagaggcctgtattttcctgctggtggctccagttc

SEQ ID NO: 104111 - DNA, 75 bp, Artificial Sequence
  Synthetic
attatccagataatgtagttaatcattacttccaaaccagacactatttacataccctatggaaggcgggcatct

SEQ ID NO: 104112 - DNA, 75 bp, Artificial Sequence
  Synthetic
gagattttactgggctttattcttctactgtacctgtttttaatcctaaatggcaaacaccctcttttccagata

SEQ ID NO: 104113 - DNA, 75 bp, Artificial Sequence
  Synthetic
ctccactcagttccaccagactctgttagatccgagggtaagggctctgtattttcctgctggtggctccagttc

SEQ ID NO: 104114 - DNA, 75 bp, Artificial Sequence
  Synthetic
taaaactaattatgcctgctaggttctttccgaatgctaccaaatattttcccccagataaaggtataaaacctt

SEQ ID NO: 104115 - DNA, 75 bp, Artificial Sequence
  Synthetic
aacacagctaaaacaaaatggtggggttataccttacactttatgggttatagaattgggagttgggggaccttg

SEQ ID NO: 104116 - DNA, 75 bp, Artificial Sequence
  Synthetic
ctatcaaggtatgttgcccgtttgtcctctacttccaggatccacgaccaccagcacgggaccatgcaaaacctg

SEQ ID NO: 104117 - DNA, 75 bp, Artificial Sequence
  Synthetic
ggggcaaacctctctgtccccaatccgctgggattcttcccagagcatcagttggaccccgcattccgagccaac

SEQ ID NO: 104118 - DNA, 75 bp, Artificial Sequence
  Synthetic
ttcgggccagggttcaccccaccacatggaggcattctggggtggagccctcaggctcagggactaacaacattc

SEQ ID NO: 104119 - DNA, 75 bp, Artificial Sequence
  Synthetic
ctgccagcagctcctcctcttgcctccaccaatcggcaagcaagaaggcaacctacacccatatcgccaccactg

SEQ ID NO: 104120 - DNA, 75 bp, Artificial Sequence
  Synthetic
tcagtcgtaccaagctacggacggaacgcacgtatcccatccatcatctgggctccaaatactatggagtggctc

SEQ ID NO: 104121 - DNA, 75 bp, Artificial Sequence
  Synthetic
tttggcttcctgggtgggcaataatttagaagacccagcatctaaagaattactagttaactatgtcaatactaa

SEQ ID NO: 104122 - DNA, 75 bp, Artificial Sequence
  Synthetic
ggacctagtagtcagttatgtcaacactaatatgggcctaaagttcaggcaattattgtggtttcacatttcttg

SEQ ID NO: 104123 - DNA, 75 bp, Artificial Sequence
  Synthetic
accacgatatttcaccaagctctgcaagatcccagagtgagtgggctgtattcccctgctggtggctccagttca

SEQ ID NO: 104124 - DNA, 75 bp, Artificial Sequence
  Synthetic
ctgccgttccagccaacgacgggtcgcacctctctttacgcggcctccccgtctgttccttctcatctgccggac

SEQ ID NO: 104125 - DNA, 75 bp, Artificial Sequence
  Synthetic
tgacgcaacccccactggatggggcttggccataggccatcggcgcatgcgtggaacctttgtggctcctctgcc

SEQ ID NO: 104126 - DNA, 75 bp, Artificial Sequence
  Synthetic
tcgcactcctcccgcttacagacctccaaatgcccctatcttatcaacacttccggaaactactgttgttagacg

SEQ ID NO: 104127 - DNA, 75 bp, Artificial Sequence
  Synthetic
tatataagagagaaacaacacatagcgcctcattttgtgggtcaccatattcctgggaacaagagctacagcatg

SEQ ID NO: 104128 - DNA, 75 bp, Artificial Sequence
  Synthetic
ctgggtgggcaataatttagaggatcctgcagcaagagatctagtagttaattatgtcaatactaacatgggcct

SEQ ID NO: 104129 - DNA, 75 bp, Artificial Sequence
  Synthetic
aaggtaggagtgggagcattcgggccggggttcactcccccacacggaggccttttggggtggagccctcaggct

SEQ ID NO: 104130 - DNA, 75 bp, Artificial Sequence
  Synthetic
ccagcaaatccgcctcctgcctctaccaatcgccagtcaggaaggcagcctaccccgctgtctccacctttgaga

SEQ ID NO: 104131 - DNA, 75 bp, Artificial Sequence
  Synthetic
aaattttactgggctttattcttctactctacctatctttaatcccaattggcaaactccttctttccctgatat

SEQ ID NO: 104132 - DNA, 75 bp, Artificial Sequence
  Synthetic
taaaattgatcatgcctgctaggttttatcctaatactactaaatatttgcccttggataaaggaattaaacctt

SEQ ID NO: 104133 - DNA, 75 bp, Artificial Sequence
  Synthetic
ttccacaacattccaccaacctctgcagaatcccagagtaagaggtcaggattttcctgctggtggctccagttc

SEQ ID NO: 104134 - DNA, 75 bp, Artificial Sequence
  Synthetic
tcggcagttaggaaggcagcctactccacctgtctcccctctaagagactctcatcctcaggccatgcagtggaa

SEQ ID NO: 104135 - DNA, 75 bp, Artificial Sequence
  Synthetic
tatataagagagaaactacgcgtagcgcctcattttgtgggtcaccctattcttgggaacaagagctacatcatg

SEQ ID NO: 104136 - DNA, 75 bp, Artificial Sequence
  Synthetic
gaggggcctatattttcctgctggtggctccagttccggaacagtaaaccctgttccgactactgcctcacccat

SEQ ID NO: 104137 - DNA, 75 bp, Artificial Sequence
  Synthetic
tctagctacctgggtgggtaataatttacaagatccagcatccagagacctagtagtcaattatgttaacactaa

SEQ ID NO: 104138 - DNA, 75 bp, Artificial Sequence
  Synthetic
ttcatttacatcaagatttgatacacaaatgtgaacaatttgtaggccctctcacaaaaaatgaattgagaagat

SEQ ID NO: 104139 - DNA, 75 bp, Artificial Sequence
  Synthetic
caggcacagggcattctgacaacctcgccaccagatccacctcctgcttccaccaatcggaggtcaggaagaaag

SEQ ID NO: 104140 - DNA, 75 bp, Artificial Sequence
  Synthetic
atacatttgaaccctaataagaccaaaagatggggctattcccttaacttcatgggctatgtaattggaagttgg

SEQ ID NO: 104141 - DNA, 75 bp, Artificial Sequence
  Synthetic
gggattctccccgatcatcagttggaccctgcattcaaagccaactcagaaaatccagattgggacctcaacccc

SEQ ID NO: 104142 - DNA, 75 bp, Artificial Sequence
  Synthetic
ttaatgcctttatatgcatgtatacaagctaagcaggctttcactttctcgccaacttacaaggcctttctgtgt

SEQ ID NO: 104143 - DNA, 75 bp, Artificial Sequence
  Synthetic
tcggcaggtaggaaggccgcctactcccctgtctccacctctaagggacactcatcctcaggccatgcagtggaa

SEQ ID NO: 104144 - DNA, 75 bp, Artificial Sequence
  Synthetic
tttccatggctgctaggctgtgctgccaactggatcctgcgagggacgtcctttgtctacgtcccgtcagcgctg

SEQ ID NO: 104145 - DNA, 75 bp, Artificial Sequence
  Synthetic
agttatataagaggactcttggactgtttgttatgtcaacaaccggggtggagaaatacttcaaggactgtgttt

SEQ ID NO: 104146 - DNA, 75 bp, Artificial Sequence
  Synthetic
ctccacaacattccaccaagctctgctagatcccagagtgaggggcctatactttcctgctggtggctccagttc

SEQ ID NO: 104147 - DNA, 75 bp, Artificial Sequence
  Synthetic
cagctatgtcaatgttaatatgggcctaaaaatcagacaactattgtggtttcacatttcctgtcttacttttgg

SEQ ID NO: 104148 - DNA, 75 bp, Artificial Sequence
  Synthetic
aaagaaaatcaaatattgttttagaaaactacctattaacaggcctattgattggaaagtatgtcaacgaattgt

SEQ ID NO: 104149 - DNA, 75 bp, Artificial Sequence
  Synthetic
aaagaaaatcaaatattgttttagaaaactacctattaactggcctattgattggaaagtatgtcaacgaattgt

SEQ ID NO: 104150 - DNA, 75 bp, Artificial Sequence
  Synthetic
aaagaaaatcaaatattgttttagaaaactacctattaaccggcctattgattggaaagtatgtcaacgaattgt

SEQ ID NO: 104151 - DNA, 75 bp, Artificial Sequence
  Synthetic
aaagaaaatcaaatattgttttagaaaactacctattaacgggcctattgattggaaagtatgtcaacgaattgt

SEQ ID NO: 104152 - DNA, 75 bp, Artificial Sequence
  Synthetic
aaagaaaatcaaatattgttttagaaaactaccttttaacaggcctattgattggaaagtatgtcaacgaattgt

SEQ ID NO: 104153 - DNA, 75 bp, Artificial Sequence
  Synthetic
aaagaaaatcaaatattgttttagaaaactaccttttaactggcctattgattggaaagtatgtcaacgaattgt

SEQ ID NO: 104154 - DNA, 75 bp, Artificial Sequence
  Synthetic
aaagaaaatcaaatattgttttagaaaactaccttttaaccggcctattgattggaaagtatgtcaacgaattgt

SEQ ID NO: 104155 - DNA, 75 bp, Artificial Sequence
  Synthetic
aaagaaaatcaaatattgttttagaaaactaccttttaacgggcctattgattggaaagtatgtcaacgaattgt

SEQ ID NO: 104156 - DNA, 75 bp, Artificial Sequence
  Synthetic
aaagaaaatcaaatattgttttagaaaactacctcttaacaggcctattgattggaaagtatgtcaacgaattgt

SEQ ID NO: 104157 - DNA, 75 bp, Artificial Sequence
  Synthetic
aaagaaaatcaaatattgttttagaaaactacctcttaactggcctattgattggaaagtatgtcaacgaattgt

SEQ ID NO: 104158 - DNA, 75 bp, Artificial Sequence
  Synthetic
aaagaaaatcaaatattgttttagaaaactacctcttaaccggcctattgattggaaagtatgtcaacgaattgt

SEQ ID NO: 104159 - DNA, 75 bp, Artificial Sequence
  Synthetic
aaagaaaatcaaatattgttttagaaaactacctcttaacgggcctattgattggaaagtatgtcaacgaattgt

SEQ ID NO: 104160 - DNA, 75 bp, Artificial Sequence
  Synthetic
aaagaaaatcaaatattgttttagaaaactacctgttaacaggcctattgattggaaagtatgtcaacgaattgt

SEQ ID NO: 104161 - DNA, 75 bp, Artificial Sequence
  Synthetic
aaagaaaatcaaatattgttttagaaaactacctgttaactggcctattgattggaaagtatgtcaacgaattgt

SEQ ID NO: 104162 - DNA, 75 bp, Artificial Sequence
  Synthetic
aaagaaaatcaaatattgttttagaaaactacctgttaaccggcctattgattggaaagtatgtcaacgaattgt

SEQ ID NO: 104163 - DNA, 75 bp, Artificial Sequence
  Synthetic
aaagaaaatcaaatattgttttagaaaactacctgttaacgggcctattgattggaaagtatgtcaacgaattgt

SEQ ID NO: 104164 - DNA, 75 bp, Artificial Sequence
  Synthetic
aaagaaaatcaaatattgttttagaaaacttcctattaacaggcctattgattggaaagtatgtcaacgaattgt

SEQ ID NO: 104165 - DNA, 75 bp, Artificial Sequence
  Synthetic
aaagaaaatcaaatattgttttagaaaacttcctattaactggcctattgattggaaagtatgtcaacgaattgt

SEQ ID NO: 104166 - DNA, 75 bp, Artificial Sequence
  Synthetic
aaagaaaatcaaatattgttttagaaaacttcctattaaccggcctattgattggaaagtatgtcaacgaattgt

SEQ ID NO: 104167 - DNA, 75 bp, Artificial Sequence
  Synthetic
aaagaaaatcaaatattgttttagaaaacttcctattaacgggcctattgattggaaagtatgtcaacgaattgt

SEQ ID NO: 104168 - DNA, 75 bp, Artificial Sequence
  Synthetic
aaagaaaatcaaatattgttttagaaaacttccttttaacaggcctattgattggaaagtatgtcaacgaattgt

SEQ ID NO: 104169 - DNA, 75 bp, Artificial Sequence
  Synthetic
aaagaaaatcaaatattgttttagaaaacttccttttaactggcctattgattggaaagtatgtcaacgaattgt

SEQ ID NO: 104170 - DNA, 75 bp, Artificial Sequence
  Synthetic
aaagaaaatcaaatattgttttagaaaacttccttttaaccggcctattgattggaaagtatgtcaacgaattgt

SEQ ID NO: 104171 - DNA, 75 bp, Artificial Sequence
  Synthetic
aaagaaaatcaaatattgttttagaaaacttccttttaacgggcctattgattggaaagtatgtcaacgaattgt

SEQ ID NO: 104172 - DNA, 75 bp, Artificial Sequence
  Synthetic
aaagaaaatcaaatattgttttagaaaacttcctcttaacaggcctattgattggaaagtatgtcaacgaattgt

SEQ ID NO: 104173 - DNA, 75 bp, Artificial Sequence
  Synthetic
aaagaaaatcaaatattgttttagaaaacttcctcttaactggcctattgattggaaagtatgtcaacgaattgt

SEQ ID NO: 104174 - DNA, 75 bp, Artificial Sequence
  Synthetic
aaagaaaatcaaatattgttttagaaaacttcctcttaaccggcctattgattggaaagtatgtcaacgaattgt

SEQ ID NO: 104175 - DNA, 75 bp, Artificial Sequence
  Synthetic
aaagaaaatcaaatattgttttagaaaacttcctcttaacgggcctattgattggaaagtatgtcaacgaattgt

SEQ ID NO: 104176 - DNA, 75 bp, Artificial Sequence
  Synthetic
aaagaaaatcaaatattgttttagaaaacttcctgttaacaggcctattgattggaaagtatgtcaacgaattgt

SEQ ID NO: 104177 - DNA, 75 bp, Artificial Sequence
  Synthetic
aaagaaaatcaaatattgttttagaaaacttcctgttaactggcctattgattggaaagtatgtcaacgaattgt

SEQ ID NO: 104178 - DNA, 75 bp, Artificial Sequence
  Synthetic
aaagaaaatcaaatattgttttagaaaacttcctgttaaccggcctattgattggaaagtatgtcaacgaattgt

SEQ ID NO: 104179 - DNA, 75 bp, Artificial Sequence
  Synthetic
aaagaaaatcaaatattgttttagaaaacttcctgttaacgggcctattgattggaaagtatgtcaacgaattgt

SEQ ID NO: 104180 - DNA, 75 bp, Artificial Sequence
  Synthetic
aaagaaaatcaaatattgttttagaaaactccctattaacaggcctattgattggaaagtatgtcaacgaattgt

SEQ ID NO: 104181 - DNA, 75 bp, Artificial Sequence
  Synthetic
aaagaaaatcaaatattgttttagaaaactccctattaactggcctattgattggaaagtatgtcaacgaattgt

SEQ ID NO: 104182 - DNA, 75 bp, Artificial Sequence
  Synthetic
aaagaaaatcaaatattgttttagaaaactccctattaaccggcctattgattggaaagtatgtcaacgaattgt

SEQ ID NO: 104183 - DNA, 75 bp, Artificial Sequence
  Synthetic
aaagaaaatcaaatattgttttagaaaactccctattaacgggcctattgattggaaagtatgtcaacgaattgt

SEQ ID NO: 104184 - DNA, 75 bp, Artificial Sequence
  Synthetic
aaagaaaatcaaatattgttttagaaaactcccttttaacaggcctattgattggaaagtatgtcaacgaattgt

SEQ ID NO: 104185 - DNA, 75 bp, Artificial Sequence
  Synthetic
aaagaaaatcaaatattgttttagaaaactcccttttaactggcctattgattggaaagtatgtcaacgaattgt

SEQ ID NO: 104186 - DNA, 75 bp, Artificial Sequence
  Synthetic
aaagaaaatcaaatattgttttagaaaactcccttttaaccggcctattgattggaaagtatgtcaacgaattgt

SEQ ID NO: 104187 - DNA, 75 bp, Artificial Sequence
  Synthetic
aaagaaaatcaaatattgttttagaaaactcccttttaacgggcctattgattggaaagtatgtcaacgaattgt

SEQ ID NO: 104188 - DNA, 75 bp, Artificial Sequence
  Synthetic
aaagaaaatcaaatattgttttagaaaactccctcttaacaggcctattgattggaaagtatgtcaacgaattgt

SEQ ID NO: 104189 - DNA, 75 bp, Artificial Sequence
  Synthetic
aaagaaaatcaaatattgttttagaaaactccctcttaactggcctattgattggaaagtatgtcaacgaattgt

SEQ ID NO: 104190 - DNA, 75 bp, Artificial Sequence
  Synthetic
aaagaaaatcaaatattgttttagaaaactccctcttaaccggcctattgattggaaagtatgtcaacgaattgt

SEQ ID NO: 104191 - DNA, 75 bp, Artificial Sequence
  Synthetic
aaagaaaatcaaatattgttttagaaaactccctcttaacgggcctattgattggaaagtatgtcaacgaattgt

SEQ ID NO: 104192 - DNA, 75 bp, Artificial Sequence
  Synthetic
aaagaaaatcaaatattgttttagaaaactccctgttaacaggcctattgattggaaagtatgtcaacgaattgt

SEQ ID NO: 104193 - DNA, 75 bp, Artificial Sequence
  Synthetic
aaagaaaatcaaatattgttttagaaaactccctgttaactggcctattgattggaaagtatgtcaacgaattgt

SEQ ID NO: 104194 - DNA, 75 bp, Artificial Sequence
  Synthetic
aaagaaaatcaaatattgttttagaaaactccctgttaaccggcctattgattggaaagtatgtcaacgaattgt

SEQ ID NO: 104195 - DNA, 75 bp, Artificial Sequence
  Synthetic
aaagaaaatcaaatattgttttagaaaactccctgttaacgggcctattgattggaaagtatgtcaacgaattgt

SEQ ID NO: 104196 - DNA, 75 bp, Artificial Sequence
  Synthetic
aaagaaaatcaaatattgttttagaaaactgcctattaacaggcctattgattggaaagtatgtcaacgaattgt

SEQ ID NO: 104197 - DNA, 75 bp, Artificial Sequence
  Synthetic
aaagaaaatcaaatattgttttagaaaactgcctattaactggcctattgattggaaagtatgtcaacgaattgt

SEQ ID NO: 104198 - DNA, 75 bp, Artificial Sequence
  Synthetic
aaagaaaatcaaatattgttttagaaaactgcctattaaccggcctattgattggaaagtatgtcaacgaattgt

SEQ ID NO: 104199 - DNA, 75 bp, Artificial Sequence
  Synthetic
aaagaaaatcaaatattgttttagaaaactgcctattaacgggcctattgattggaaagtatgtcaacgaattgt

SEQ ID NO: 104200 - DNA, 75 bp, Artificial Sequence
  Synthetic
aaagaaaatcaaatattgttttagaaaactgccttttaacaggcctattgattggaaagtatgtcaacgaattgt

SEQ ID NO: 104201 - DNA, 75 bp, Artificial Sequence
  Synthetic
aaagaaaatcaaatattgttttagaaaactgccttttaactggcctattgattggaaagtatgtcaacgaattgt

SEQ ID NO: 104202 - DNA, 75 bp, Artificial Sequence
  Synthetic
aaagaaaatcaaatattgttttagaaaactgccttttaaccggcctattgattggaaagtatgtcaacgaattgt

SEQ ID NO: 104203 - DNA, 75 bp, Artificial Sequence
  Synthetic
aaagaaaatcaaatattgttttagaaaactgccttttaacgggcctattgattggaaagtatgtcaacgaattgt

SEQ ID NO: 104204 - DNA, 75 bp, Artificial Sequence
  Synthetic
aaagaaaatcaaatattgttttagaaaactgcctcttaacaggcctattgattggaaagtatgtcaacgaattgt

SEQ ID NO: 104205 - DNA, 75 bp, Artificial Sequence
  Synthetic
aaagaaaatcaaatattgttttagaaaactgcctcttaactggcctattgattggaaagtatgtcaacgaattgt

SEQ ID NO: 104206 - DNA, 75 bp, Artificial Sequence
  Synthetic
aaagaaaatcaaatattgttttagaaaactgcctcttaaccggcctattgattggaaagtatgtcaacgaattgt

SEQ ID NO: 104207 - DNA, 75 bp, Artificial Sequence
  Synthetic
aaagaaaatcaaatattgttttagaaaactgcctcttaacgggcctattgattggaaagtatgtcaacgaattgt

SEQ ID NO: 104208 - DNA, 75 bp, Artificial Sequence
  Synthetic
aaagaaaatcaaatattgttttagaaaactgcctgttaacaggcctattgattggaaagtatgtcaacgaattgt

SEQ ID NO: 104209 - DNA, 75 bp, Artificial Sequence
  Synthetic
aaagaaaatcaaatattgttttagaaaactgcctgttaactggcctattgattggaaagtatgtcaacgaattgt

SEQ ID NO: 104210 - DNA, 75 bp, Artificial Sequence
  Synthetic
aaagaaaatcaaatattgttttagaaaactgcctgttaaccggcctattgattggaaagtatgtcaacgaattgt

SEQ ID NO: 104211 - DNA, 75 bp, Artificial Sequence
  Synthetic
aaagaaaatcaaatattgttttagaaaactgcctgttaacgggcctattgattggaaagtatgtcaacgaattgt

SEQ ID NO: 104212 - DNA, 75 bp, Artificial Sequence
  Synthetic
gattggaaggtgtgtcaaagaattgtgggtcttttgggatttgctgccccttttacacaatgtggctatcctgcc

SEQ ID NO: 104213 - DNA, 75 bp, Artificial Sequence
  Synthetic
cagaagatctcaatctccagcttcccaatgttagtattccttggactcacaaggtgggaaattttacggggcttt

SEQ ID NO: 104214 - DNA, 75 bp, Artificial Sequence
  Synthetic
tacatttgcaggaggacattgttaatagatgtcaacaattaaaaggccctgtaactgcaaatgaaaaaaggagat

SEQ ID NO: 104215 - DNA, 75 bp, Artificial Sequence
  Synthetic
ggacattattaatagatgtcaacaatatgtaggccctcttacagttaatgaaaaaaggagattaaaattaattat

SEQ ID NO: 104216 - DNA, 75 bp, Artificial Sequence
  Synthetic
aaacaatatctgaacctttaccccgttgcccggcaacggccaggtctctcccaagtgtttgatgacgcaaccccc

SEQ ID NO: 104217 - DNA, 75 bp, Artificial Sequence
  Synthetic
aggagactaggttaatgatctttgtattaggaggctgtaggcataaattggtctgcgcaccagcaccatgcaact

SEQ ID NO: 104218 - DNA, 75 bp, Artificial Sequence
  Synthetic
ccctgctggtggctccaattcaggaacagtaaaccctgttccgaatactgcctctcacatctcatcaatctcctc

SEQ ID NO: 104219 - DNA, 75 bp, Artificial Sequence
  Synthetic
aatctcgggaatctcaatgttagtattccttggacacataaggtgggaaactttacggggctttattcttctacg

SEQ ID NO: 104220 - DNA, 75 bp, Artificial Sequence
  Synthetic
ctccaccacgttccaccaaactcttcaagatccccgagtcagggctctgtactttcctgctggtggctccagttc

SEQ ID NO: 104221 - DNA, 75 bp, Artificial Sequence
  Synthetic
aacaatttgtgggccctctcactgtaaatgaaaagagaagattgaaattaattatgcctgctagattttatccta

SEQ ID NO: 104222 - DNA, 75 bp, Artificial Sequence
  Synthetic
ttccactgccttccaccaagctctgcaggatcccagagtcaggggtctgtattttcctgctggtggctccagttc

SEQ ID NO: 104223 - DNA, 75 bp, Artificial Sequence
  Synthetic
cattttgtgggtcaccatattcttgggaacaagagctacagcatgggaggttggtattccaaacctcgacaaggc

SEQ ID NO: 104224 - DNA, 75 bp, Artificial Sequence
  Synthetic
ctatcaaggtatgttgcccgtttgtcctctaattccaggatcaacaacaaccagcaccggaccatgcaaaacctg

SEQ ID NO: 104225 - DNA, 75 bp, Artificial Sequence
  Synthetic
tgatttcttcccgtcggttcgggacctactcgacaccgcttcagccctctacagggatgctttagagtcaccgga

SEQ ID NO: 104226 - DNA, 75 bp, Artificial Sequence
  Synthetic
ttggactctctgtaatgtcaacgaccgaccttgaggcatacttcaaagactgtttgtttaaagactgggaggagt

SEQ ID NO: 104227 - DNA, 75 bp, Artificial Sequence
  Synthetic
cctgctggtggctccagttcaggaacagtaaaccctgttccgactactgcctctcacatatcgtcaatcttctcg

SEQ ID NO: 104228 - DNA, 75 bp, Artificial Sequence
  Synthetic
ccctcaggctcagggcatattggcaacagtgccagcagcacctcctcctgcctccaccaatcggcagtcaggaag

SEQ ID NO: 104229 - DNA, 75 bp, Artificial Sequence
  Synthetic
aaaatcaaaatatgttttaggaaacttcctgtaaacaggcctattgattggaaagtatgtcaacgaattgtgggt

SEQ ID NO: 104230 - DNA, 75 bp, Artificial Sequence
  Synthetic
attttcttttgtctttgggtatacatttaaaccctaacaaaacaaagagatggggttattctctaaatttcatgg

SEQ ID NO: 104231 - DNA, 75 bp, Artificial Sequence
  Synthetic
acggtccctctcgagtggggaaagaacctttccaccagcaatcctctaggattccttcccgatcaccagttggac

SEQ ID NO: 104232 - DNA, 75 bp, Artificial Sequence
  Synthetic
tcagcagtcaggaagacagcctactcccatctctccacctctaagagacagtcatcctcaggccatgcagtggaa

SEQ ID NO: 104233 - DNA, 75 bp, Artificial Sequence
  Synthetic
tgccttctcatctgccggtccgtgtgcacttcgcttcacctctgcacgtcgcatggagaccaccgtgaacgccca

SEQ ID NO: 104234 - DNA, 75 bp, Artificial Sequence
  Synthetic
tatgggcctaaaaatcagacaactattgtggtttcatatttcctgtcttacttttgggagagaaactgttcttga

SEQ ID NO: 104235 - DNA, 75 bp, Artificial Sequence
  Synthetic
catactcacaactgtgccagcagcacctcctcctgcctccaccaatcggcagtcaggaaggcagcctactccctt

SEQ ID NO: 104236 - DNA, 75 bp, Artificial Sequence
  Synthetic
gcgggacgtcctttgtctacgtcccgtcggcgctgaatcccgcggacgacccgtctcggggccgtttgggactct

SEQ ID NO: 104237 - DNA, 75 bp, Artificial Sequence
  Synthetic
gtatacatttaaaccctaacaaaactaaaagatggggttactctttaaatttcatgggctatgtcattggatgtt

SEQ ID NO: 104238 - DNA, 75 bp, Artificial Sequence
  Synthetic
attatccagaacatctagttaatcattacttccaaaccagacactatttacacactctatggaaggcgggtatat

SEQ ID NO: 104239 - DNA, 75 bp, Artificial Sequence
  Synthetic
aagactgggaggagttgggggaggagattaggttaaatattaggaggctgtaggcataaattggtctgcgcacca

SEQ ID NO: 104240 - DNA, 75 bp, Artificial Sequence
  Synthetic
actgttcaagcctccaagctgtgccttgggtggctttggagcatggacattgacccgtataaagaatttggagct

SEQ ID NO: 104241 - DNA, 75 bp, Artificial Sequence
  Synthetic
ctccaccactttccaccaaactcttcaagatcccagagtcagggctctgtaccttcctgctggtggctccagttc

SEQ ID NO: 104242 - DNA, 75 bp, Artificial Sequence
  Synthetic
attgacaacagtgccagtagcacctcctcctgcctccaccaatcggcagtcaggaagacagcctactcccatctc

SEQ ID NO: 104243 - DNA, 75 bp, Artificial Sequence
  Synthetic
taaagatcaggcaactattgtggtttcatatttcttgccttacttttggaagagaaactgtccttgagtatttgg

SEQ ID NO: 104244 - DNA, 75 bp, Artificial Sequence
  Synthetic
tggtggctccagttcaggaacactcaaccctgttccaaatattgcctctcacatctcgtcaatctcctcgaggac

SEQ ID NO: 104245 - DNA, 75 bp, Artificial Sequence
  Synthetic
tggggaccctgcaccgaacatggagaacatcacatcaggattcctaggacccctgctcgtgttacaggcggggtt

SEQ ID NO: 104246 - DNA, 75 bp, Artificial Sequence
  Synthetic
aatttcactgggctttattcttctactgtccctatctttaatcctgaatggcaaactccttcttttcctaaaatt

SEQ ID NO: 104247 - DNA, 75 bp, Artificial Sequence
  Synthetic
ccaccgtgaacgcccaccaggtcttgcccaaggtcttacataagaggactcttggactcccagcaatgtcaacga

SEQ ID NO: 104248 - DNA, 75 bp, Artificial Sequence
  Synthetic
aaattaattatgcctgctagattttatcctaacagcactaaatatttgcctctagacaaagggattaaaccttat

SEQ ID NO: 104249 - DNA, 75 bp, Artificial Sequence
  Synthetic
caggcaagctattctgtgttggggtgagttgatgaatctggccacctgggtgggaagtaatttggaagatccagc

SEQ ID NO: 104250 - DNA, 75 bp, Artificial Sequence
  Synthetic
accctgcaaaacctgcacgactcctgctcaaggcaactctatgtttccctcatgttgctgtacaaaacctacgga

SEQ ID NO: 104251 - DNA, 75 bp, Artificial Sequence
  Synthetic
ttagagtctcctgagcattgttcacctcaccatactgcactcaggcaagcaattctttgctggggggacttaatg

SEQ ID NO: 104252 - DNA, 75 bp, Artificial Sequence
  Synthetic
gaactcctagccgcttgttttgctcgcagccggtctggagcaaaactcatcgggactgacaattctgtcgtgctc

SEQ ID NO: 104253 - DNA, 75 bp, Artificial Sequence
  Synthetic
tcgccagtcaggaaggcagcctaccccgctgactccacctttgagagacactcatcctcaggccatgcagtggaa

SEQ ID NO: 104254 - DNA, 75 bp, Artificial Sequence
  Synthetic
gtaattggaagttggggtacattgccacaggatcatattgtacaaaaaatcaaacactgttttagaaaacttcct

SEQ ID NO: 104255 - DNA, 75 bp, Artificial Sequence
  Synthetic
gtcaatagacctattgattggaaagtatgtcagagaattgtgggtcttttgggctttgccgctccatttacacaa

SEQ ID NO: 104256 - DNA, 75 bp, Artificial Sequence
  Synthetic
gggcgcacctctctttacgcggtctccccgtctgtgccttctcatctgccggaccgtgtgcacttcgcttcacct

SEQ ID NO: 104257 - DNA, 75 bp, Artificial Sequence
  Synthetic
caccactcttgctcaaggaacctctatgtttccctcctgttgctgtaccaaaccttcggacggaaattgcacctg

SEQ ID NO: 104258 - DNA, 75 bp, Artificial Sequence
  Synthetic
tctatataagagagaaactacccgcagcgcctcattttgtgggtcaccatattcttgggaacaagagctacagca

SEQ ID NO: 104259 - DNA, 75 bp, Artificial Sequence
  Synthetic
attatcctaaccatgcagttaatcattacttcaaaactaggcattatttacatactctgtggaaggctggcattc

SEQ ID NO: 104260 - DNA, 75 bp, Artificial Sequence
  Synthetic
actggctggggcttggccataggccatcagcgcatgcgtggaacctttgtggctcctctgccgatccatactgcg

SEQ ID NO: 104261 - DNA, 75 bp, Artificial Sequence
  Synthetic
tctagcttcctgggtgggtaataatttacaagatccagcgtccagggatctagtagtcaattatgttaacactaa

SEQ ID NO: 104262 - DNA, 75 bp, Artificial Sequence
  Synthetic
cagctctgtatcgggaagccttagagtctcctgagcattgctcacctcaccatacagcactcaggcaagccattc

SEQ ID NO: 104263 - DNA, 75 bp, Artificial Sequence
  Synthetic
ttgattggaaagtatgtcaacgaattgtgggtcttttgggctttgctgccccttttacacaatgtggatatcctg

SEQ ID NO: 104264 - DNA, 75 bp, Artificial Sequence
  Synthetic
tggggcttggccataggccatcagcgcatgcgtggaacctttgtggctcctctgccgatccatactgcggaactc

SEQ ID NO: 104265 - DNA, 75 bp, Artificial Sequence
  Synthetic
gttagtattccttggactcataaggtgggaaattttactgggctttattcttctactgtccctatctttaatcct

SEQ ID NO: 104266 - DNA, 75 bp, Artificial Sequence
  Synthetic
tcggcggtcgggaaggaaaccccgaccctgaactcaaagtctaagagacactcatccacaggccatgcagaggaa

SEQ ID NO: 104267 - DNA, 75 bp, Artificial Sequence
  Synthetic
aggtatgttgcccgtttgtcctctaattccaggatcaacaacaaccagtacgggaccatgcaaaacctgcacgac

SEQ ID NO: 104268 - DNA, 75 bp, Artificial Sequence
  Synthetic
gggaggagctgggggaggagattaggttaaaggtctttgtattagttaatcattaggaggctgtaggcataaatt

SEQ ID NO: 104269 - DNA, 75 bp, Artificial Sequence
  Synthetic
ttgccaacgaatcatcctcctgcctctaccagtcgtcactcaggaagggagccgacccctctgtctccacctttg

SEQ ID NO: 104270 - DNA, 75 bp, Artificial Sequence
  Synthetic
cttttggggtttgctgccccttttacacaatgtggatatcctgctttgatgcctttatatgcatgtatacaagca

SEQ ID NO: 104271 - DNA, 75 bp, Artificial Sequence
  Synthetic
tctactcaccatacagcaatcaggcaagccattctttgctggggggaagtaatgactctagccacctgggtgggt

SEQ ID NO: 104272 - DNA, 75 bp, Artificial Sequence
  Synthetic
tctactcaccatacagcaatcaggcaagccattctttgctggggggatgtaatgactctagccacctgggtgggt

SEQ ID NO: 104273 - DNA, 75 bp, Artificial Sequence
  Synthetic
tctactcaccatacagcaatcaggcaagccattctttgctggggggacgtaatgactctagccacctgggtgggt

SEQ ID NO: 104274 - DNA, 75 bp, Artificial Sequence
  Synthetic
tctactcaccatacagcaatcaggcaagccattctttgctggggggaggtaatgactctagccacctgggtgggt

SEQ ID NO: 104275 - DNA, 75 bp, Artificial Sequence
  Synthetic
tctactcaccatacagcattcaggcaagccattctttgctggggggaagtaatgactctagccacctgggtgggt

SEQ ID NO: 104276 - DNA, 75 bp, Artificial Sequence
  Synthetic
tctactcaccatacagcattcaggcaagccattctttgctggggggatgtaatgactctagccacctgggtgggt

SEQ ID NO: 104277 - DNA, 75 bp, Artificial Sequence
  Synthetic
tctactcaccatacagcattcaggcaagccattctttgctggggggacgtaatgactctagccacctgggtgggt

SEQ ID NO: 104278 - DNA, 75 bp, Artificial Sequence
  Synthetic
tctactcaccatacagcattcaggcaagccattctttgctggggggaggtaatgactctagccacctgggtgggt

SEQ ID NO: 104279 - DNA, 75 bp, Artificial Sequence
  Synthetic
tctactcaccatacagcactcaggcaagccattctttgctggggggaagtaatgactctagccacctgggtgggt

SEQ ID NO: 104280 - DNA, 75 bp, Artificial Sequence
  Synthetic
tctactcaccatacagcactcaggcaagccattctttgctggggggatgtaatgactctagccacctgggtgggt

SEQ ID NO: 104281 - DNA, 75 bp, Artificial Sequence
  Synthetic
tctactcaccatacagcactcaggcaagccattctttgctggggggacgtaatgactctagccacctgggtgggt

SEQ ID NO: 104282 - DNA, 75 bp, Artificial Sequence
  Synthetic
tctactcaccatacagcactcaggcaagccattctttgctggggggaggtaatgactctagccacctgggtgggt

SEQ ID NO: 104283 - DNA, 75 bp, Artificial Sequence
  Synthetic
tctactcaccatacagcagtcaggcaagccattctttgctggggggaagtaatgactctagccacctgggtgggt

SEQ ID NO: 104284 - DNA, 75 bp, Artificial Sequence
  Synthetic
tctactcaccatacagcagtcaggcaagccattctttgctggggggatgtaatgactctagccacctgggtgggt

SEQ ID NO: 104285 - DNA, 75 bp, Artificial Sequence
  Synthetic
tctactcaccatacagcagtcaggcaagccattctttgctggggggacgtaatgactctagccacctgggtgggt

SEQ ID NO: 104286 - DNA, 75 bp, Artificial Sequence
  Synthetic
tctactcaccatacagcagtcaggcaagccattctttgctggggggaggtaatgactctagccacctgggtgggt

SEQ ID NO: 104287 - DNA, 75 bp, Artificial Sequence
  Synthetic
tcttctcaccatacagcaatcaggcaagccattctttgctggggggaagtaatgactctagccacctgggtgggt

SEQ ID NO: 104288 - DNA, 75 bp, Artificial Sequence
  Synthetic
tcttctcaccatacagcaatcaggcaagccattctttgctggggggatgtaatgactctagccacctgggtgggt

SEQ ID NO: 104289 - DNA, 75 bp, Artificial Sequence
  Synthetic
tcttctcaccatacagcaatcaggcaagccattctttgctggggggacgtaatgactctagccacctgggtgggt

SEQ ID NO: 104290 - DNA, 75 bp, Artificial Sequence
  Synthetic
tcttctcaccatacagcaatcaggcaagccattctttgctggggggaggtaatgactctagccacctgggtgggt

SEQ ID NO: 104291 - DNA, 75 bp, Artificial Sequence
  Synthetic
tcttctcaccatacagcattcaggcaagccattctttgctggggggaagtaatgactctagccacctgggtgggt

SEQ ID NO: 104292 - DNA, 75 bp, Artificial Sequence
  Synthetic
tcttctcaccatacagcattcaggcaagccattctttgctggggggatgtaatgactctagccacctgggtgggt

SEQ ID NO: 104293 - DNA, 75 bp, Artificial Sequence
  Synthetic
tcttctcaccatacagcattcaggcaagccattctttgctggggggacgtaatgactctagccacctgggtgggt

SEQ ID NO: 104294 - DNA, 75 bp, Artificial Sequence
  Synthetic
tcttctcaccatacagcattcaggcaagccattctttgctggggggaggtaatgactctagccacctgggtgggt

SEQ ID NO: 104295 - DNA, 75 bp, Artificial Sequence
  Synthetic
tcttctcaccatacagcactcaggcaagccattctttgctggggggaagtaatgactctagccacctgggtgggt

SEQ ID NO: 104296 - DNA, 75 bp, Artificial Sequence
  Synthetic
tcttctcaccatacagcactcaggcaagccattctttgctggggggatgtaatgactctagccacctgggtgggt

SEQ ID NO: 104297 - DNA, 75 bp, Artificial Sequence
  Synthetic
tcttctcaccatacagcactcaggcaagccattctttgctggggggacgtaatgactctagccacctgggtgggt

SEQ ID NO: 104298 - DNA, 75 bp, Artificial Sequence
  Synthetic
tcttctcaccatacagcactcaggcaagccattctttgctggggggaggtaatgactctagccacctgggtgggt

SEQ ID NO: 104299 - DNA, 75 bp, Artificial Sequence
  Synthetic
tcttctcaccatacagcagtcaggcaagccattctttgctggggggaagtaatgactctagccacctgggtgggt

SEQ ID NO: 104300 - DNA, 75 bp, Artificial Sequence
  Synthetic
tcttctcaccatacagcagtcaggcaagccattctttgctggggggatgtaatgactctagccacctgggtgggt

SEQ ID NO: 104301 - DNA, 75 bp, Artificial Sequence
  Synthetic
tcttctcaccatacagcagtcaggcaagccattctttgctggggggacgtaatgactctagccacctgggtgggt

SEQ ID NO: 104302 - DNA, 75 bp, Artificial Sequence
  Synthetic
tcttctcaccatacagcagtcaggcaagccattctttgctggggggaggtaatgactctagccacctgggtgggt

SEQ ID NO: 104303 - DNA, 75 bp, Artificial Sequence
  Synthetic
tctcctcaccatacagcaatcaggcaagccattctttgctggggggaagtaatgactctagccacctgggtgggt

SEQ ID NO: 104304 - DNA, 75 bp, Artificial Sequence
  Synthetic
tctcctcaccatacagcaatcaggcaagccattctttgctggggggatgtaatgactctagccacctgggtgggt

SEQ ID NO: 104305 - DNA, 75 bp, Artificial Sequence
  Synthetic
tctcctcaccatacagcaatcaggcaagccattctttgctggggggacgtaatgactctagccacctgggtgggt

SEQ ID NO: 104306 - DNA, 75 bp, Artificial Sequence
  Synthetic
tctcctcaccatacagcaatcaggcaagccattctttgctggggggaggtaatgactctagccacctgggtgggt

SEQ ID NO: 104307 - DNA, 75 bp, Artificial Sequence
  Synthetic
tctcctcaccatacagcattcaggcaagccattctttgctggggggaagtaatgactctagccacctgggtgggt

SEQ ID NO: 104308 - DNA, 75 bp, Artificial Sequence
  Synthetic
tctcctcaccatacagcattcaggcaagccattctttgctggggggatgtaatgactctagccacctgggtgggt

SEQ ID NO: 104309 - DNA, 75 bp, Artificial Sequence
  Synthetic
tctcctcaccatacagcattcaggcaagccattctttgctggggggacgtaatgactctagccacctgggtgggt

SEQ ID NO: 104310 - DNA, 75 bp, Artificial Sequence
  Synthetic
tctcctcaccatacagcattcaggcaagccattctttgctggggggaggtaatgactctagccacctgggtgggt

SEQ ID NO: 104311 - DNA, 75 bp, Artificial Sequence
  Synthetic
tctcctcaccatacagcactcaggcaagccattctttgctggggggaagtaatgactctagccacctgggtgggt

SEQ ID NO: 104312 - DNA, 75 bp, Artificial Sequence
  Synthetic
tctcctcaccatacagcactcaggcaagccattctttgctggggggatgtaatgactctagccacctgggtgggt

SEQ ID NO: 104313 - DNA, 75 bp, Artificial Sequence
  Synthetic
tctcctcaccatacagcactcaggcaagccattctttgctggggggacgtaatgactctagccacctgggtgggt

SEQ ID NO: 104314 - DNA, 75 bp, Artificial Sequence
  Synthetic
tctcctcaccatacagcactcaggcaagccattctttgctggggggaggtaatgactctagccacctgggtgggt

SEQ ID NO: 104315 - DNA, 75 bp, Artificial Sequence
  Synthetic
tctcctcaccatacagcagtcaggcaagccattctttgctggggggaagtaatgactctagccacctgggtgggt

SEQ ID NO: 104316 - DNA, 75 bp, Artificial Sequence
  Synthetic
tctcctcaccatacagcagtcaggcaagccattctttgctggggggatgtaatgactctagccacctgggtgggt

SEQ ID NO: 104317 - DNA, 75 bp, Artificial Sequence
  Synthetic
tctcctcaccatacagcagtcaggcaagccattctttgctggggggacgtaatgactctagccacctgggtgggt

SEQ ID NO: 104318 - DNA, 75 bp, Artificial Sequence
  Synthetic
tctcctcaccatacagcagtcaggcaagccattctttgctggggggaggtaatgactctagccacctgggtgggt

SEQ ID NO: 104319 - DNA, 75 bp, Artificial Sequence
  Synthetic
tctgctcaccatacagcaatcaggcaagccattctttgctggggggaagtaatgactctagccacctgggtgggt

SEQ ID NO: 104320 - DNA, 75 bp, Artificial Sequence
  Synthetic
tctgctcaccatacagcaatcaggcaagccattctttgctggggggatgtaatgactctagccacctgggtgggt

SEQ ID NO: 104321 - DNA, 75 bp, Artificial Sequence
  Synthetic
tctgctcaccatacagcaatcaggcaagccattctttgctggggggacgtaatgactctagccacctgggtgggt

SEQ ID NO: 104322 - DNA, 75 bp, Artificial Sequence
  Synthetic
tctgctcaccatacagcaatcaggcaagccattctttgctggggggaggtaatgactctagccacctgggtgggt

SEQ ID NO: 104323 - DNA, 75 bp, Artificial Sequence
  Synthetic
tctgctcaccatacagcattcaggcaagccattctttgctggggggaagtaatgactctagccacctgggtgggt

SEQ ID NO: 104324 - DNA, 75 bp, Artificial Sequence
  Synthetic
tctgctcaccatacagcattcaggcaagccattctttgctggggggatgtaatgactctagccacctgggtgggt

SEQ ID NO: 104325 - DNA, 75 bp, Artificial Sequence
  Synthetic
tctgctcaccatacagcattcaggcaagccattctttgctggggggacgtaatgactctagccacctgggtgggt

SEQ ID NO: 104326 - DNA, 75 bp, Artificial Sequence
  Synthetic
tctgctcaccatacagcattcaggcaagccattctttgctggggggaggtaatgactctagccacctgggtgggt

SEQ ID NO: 104327 - DNA, 75 bp, Artificial Sequence
  Synthetic
tctgctcaccatacagcactcaggcaagccattctttgctggggggaagtaatgactctagccacctgggtgggt

SEQ ID NO: 104328 - DNA, 75 bp, Artificial Sequence
  Synthetic
tctgctcaccatacagcactcaggcaagccattctttgctggggggatgtaatgactctagccacctgggtgggt

SEQ ID NO: 104329 - DNA, 75 bp, Artificial Sequence
  Synthetic
tctgctcaccatacagcactcaggcaagccattctttgctggggggacgtaatgactctagccacctgggtgggt

SEQ ID NO: 104330 - DNA, 75 bp, Artificial Sequence
  Synthetic
tctgctcaccatacagcactcaggcaagccattctttgctggggggaggtaatgactctagccacctgggtgggt

SEQ ID NO: 104331 - DNA, 75 bp, Artificial Sequence
  Synthetic
tctgctcaccatacagcagtcaggcaagccattctttgctggggggaagtaatgactctagccacctgggtgggt

SEQ ID NO: 104332 - DNA, 75 bp, Artificial Sequence
  Synthetic
tctgctcaccatacagcagtcaggcaagccattctttgctggggggatgtaatgactctagccacctgggtgggt

SEQ ID NO: 104333 - DNA, 75 bp, Artificial Sequence
  Synthetic
tctgctcaccatacagcagtcaggcaagccattctttgctggggggacgtaatgactctagccacctgggtgggt

SEQ ID NO: 104334 - DNA, 75 bp, Artificial Sequence
  Synthetic
tctgctcaccatacagcagtcaggcaagccattctttgctggggggaggtaatgactctagccacctgggtgggt

SEQ ID NO: 104335 - DNA, 75 bp, Artificial Sequence
  Synthetic
taggtgtcaacaatttgtgggccctctcacagtaaatgaaaaaagaagattgaaattaattatgcctgctagatt

SEQ ID NO: 104336 - DNA, 75 bp, Artificial Sequence
  Synthetic
aactccctcctttcctcacattcatttacaggaggacattattaatagatgtcaacaatatgtgggccctcttac

SEQ ID NO: 104337 - DNA, 75 bp, Artificial Sequence
  Synthetic
ctggggtggagccctcaggctcagggcatattgactacagtgccagcaattcctcctcctgcctccaccaatcgg

SEQ ID NO: 104338 - DNA, 75 bp, Artificial Sequence
  Synthetic
ctctacagcattccaccaagctctacaaaatcccaaagtcagtcctgctggtggctccagttcagggatagtgaa

SEQ ID NO: 104339 - DNA, 75 bp, Artificial Sequence
  Synthetic
ccctgctccgaatattgcctctcacatctcgtcaatctccgcgaggactggggaccctgtgacgaacatggagaa

SEQ ID NO: 104340 - DNA, 75 bp, Artificial Sequence
  Synthetic
ttccactgccacccaccaagctctgcaggatcccaaagtcgatcctgctggtggctccagttcaggaacagtaaa

SEQ ID NO: 104341 - DNA, 75 bp, Artificial Sequence
  Synthetic
ttccactgcctcccaccaagctctgcaggatcccaaagtcgatcctgctggtggctccagttcaggaacagtaaa

SEQ ID NO: 104342 - DNA, 75 bp, Artificial Sequence
  Synthetic
ttccactgccccccaccaagctctgcaggatcccaaagtcgatcctgctggtggctccagttcaggaacagtaaa

SEQ ID NO: 104343 - DNA, 75 bp, Artificial Sequence
  Synthetic
ttccactgccgcccaccaagctctgcaggatcccaaagtcgatcctgctggtggctccagttcaggaacagtaaa

SEQ ID NO: 104344 - DNA, 75 bp, Artificial Sequence
  Synthetic
gctgccaactggatcctgcgcgggacgtcctttgtctacgtcccgtcagcgctgaatcccgcggacgacccgtct

SEQ ID NO: 104345 - DNA, 75 bp, Artificial Sequence
  Synthetic
caagaacacatcacacagaaaattaagcaatgttttcggaaactccctgttaacaggccaattgattggaaagtc

SEQ ID NO: 104346 - DNA, 75 bp, Artificial Sequence
  Synthetic
actctcatttttgccttctgactttttcccgtctgttcgtgaacttctcgacaccgcttcagctatataccggga

SEQ ID NO: 104347 - DNA, 75 bp, Artificial Sequence
  Synthetic
actctcatttttgccttctgactttttcccgtctgttcgtgaacttctcgacaccgcttcagctatttaccggga

SEQ ID NO: 104348 - DNA, 75 bp, Artificial Sequence
  Synthetic
actctcatttttgccttctgactttttcccgtctgttcgtgaacttctcgacaccgcttcagctatctaccggga

SEQ ID NO: 104349 - DNA, 75 bp, Artificial Sequence
  Synthetic
actctcatttttgccttctgactttttcccgtctgttcgtgaacttctcgacaccgcttcagctatgtaccggga

SEQ ID NO: 104350 - DNA, 75 bp, Artificial Sequence
  Synthetic
actctcatttttgccttctgactttttcccgtctgttcgtgaacttctcgacaccgcttcagctttataccggga

SEQ ID NO: 104351 - DNA, 75 bp, Artificial Sequence
  Synthetic
actctcatttttgccttctgactttttcccgtctgttcgtgaacttctcgacaccgcttcagctttttaccggga

SEQ ID NO: 104352 - DNA, 75 bp, Artificial Sequence
  Synthetic
actctcatttttgccttctgactttttcccgtctgttcgtgaacttctcgacaccgcttcagctttctaccggga

SEQ ID NO: 104353 - DNA, 75 bp, Artificial Sequence
  Synthetic
actctcatttttgccttctgactttttcccgtctgttcgtgaacttctcgacaccgcttcagctttgtaccggga

SEQ ID NO: 104354 - DNA, 75 bp, Artificial Sequence
  Synthetic
actctcatttttgccttctgactttttcccgtctgttcgtgaacttctcgacaccgcttcagctctataccggga

SEQ ID NO: 104355 - DNA, 75 bp, Artificial Sequence
  Synthetic
actctcatttttgccttctgactttttcccgtctgttcgtgaacttctcgacaccgcttcagctctttaccggga

SEQ ID NO: 104356 - DNA, 75 bp, Artificial Sequence
  Synthetic
actctcatttttgccttctgactttttcccgtctgttcgtgaacttctcgacaccgcttcagctctctaccggga

SEQ ID NO: 104357 - DNA, 75 bp, Artificial Sequence
  Synthetic
actctcatttttgccttctgactttttcccgtctgttcgtgaacttctcgacaccgcttcagctctgtaccggga

SEQ ID NO: 104358 - DNA, 75 bp, Artificial Sequence
  Synthetic
actctcatttttgccttctgactttttcccgtctgttcgtgaacttctcgacaccgcttcagctgtataccggga

SEQ ID NO: 104359 - DNA, 75 bp, Artificial Sequence
  Synthetic
actctcatttttgccttctgactttttcccgtctgttcgtgaacttctcgacaccgcttcagctgtttaccggga

SEQ ID NO: 104360 - DNA, 75 bp, Artificial Sequence
  Synthetic
actctcatttttgccttctgactttttcccgtctgttcgtgaacttctcgacaccgcttcagctgtctaccggga

SEQ ID NO: 104361 - DNA, 75 bp, Artificial Sequence
  Synthetic
actctcatttttgccttctgactttttcccgtctgttcgtgaacttctcgacaccgcttcagctgtgtaccggga

SEQ ID NO: 104362 - DNA, 75 bp, Artificial Sequence
  Synthetic
actctcatttttgccttctgactttttcccgtctgttcgtgatcttctcgacaccgcttcagctatataccggga

SEQ ID NO: 104363 - DNA, 75 bp, Artificial Sequence
  Synthetic
actctcatttttgccttctgactttttcccgtctgttcgtgatcttctcgacaccgcttcagctatttaccggga

SEQ ID NO: 104364 - DNA, 75 bp, Artificial Sequence
  Synthetic
actctcatttttgccttctgactttttcccgtctgttcgtgatcttctcgacaccgcttcagctatctaccggga

SEQ ID NO: 104365 - DNA, 75 bp, Artificial Sequence
  Synthetic
actctcatttttgccttctgactttttcccgtctgttcgtgatcttctcgacaccgcttcagctatgtaccggga

SEQ ID NO: 104366 - DNA, 75 bp, Artificial Sequence
  Synthetic
actctcatttttgccttctgactttttcccgtctgttcgtgatcttctcgacaccgcttcagctttataccggga

SEQ ID NO: 104367 - DNA, 75 bp, Artificial Sequence
  Synthetic
actctcatttttgccttctgactttttcccgtctgttcgtgatcttctcgacaccgcttcagctttttaccggga

SEQ ID NO: 104368 - DNA, 75 bp, Artificial Sequence
  Synthetic
actctcatttttgccttctgactttttcccgtctgttcgtgatcttctcgacaccgcttcagctttctaccggga

SEQ ID NO: 104369 - DNA, 75 bp, Artificial Sequence
  Synthetic
actctcatttttgccttctgactttttcccgtctgttcgtgatcttctcgacaccgcttcagctttgtaccggga

SEQ ID NO: 104370 - DNA, 75 bp, Artificial Sequence
  Synthetic
actctcatttttgccttctgactttttcccgtctgttcgtgatcttctcgacaccgcttcagctctataccggga

SEQ ID NO: 104371 - DNA, 75 bp, Artificial Sequence
  Synthetic
actctcatttttgccttctgactttttcccgtctgttcgtgatcttctcgacaccgcttcagctctttaccggga

SEQ ID NO: 104372 - DNA, 75 bp, Artificial Sequence
  Synthetic
actctcatttttgccttctgactttttcccgtctgttcgtgatcttctcgacaccgcttcagctctctaccggga

SEQ ID NO: 104373 - DNA, 75 bp, Artificial Sequence
  Synthetic
actctcatttttgccttctgactttttcccgtctgttcgtgatcttctcgacaccgcttcagctctgtaccggga

SEQ ID NO: 104374 - DNA, 75 bp, Artificial Sequence
  Synthetic
actctcatttttgccttctgactttttcccgtctgttcgtgatcttctcgacaccgcttcagctgtataccggga

SEQ ID NO: 104375 - DNA, 75 bp, Artificial Sequence
  Synthetic
actctcatttttgccttctgactttttcccgtctgttcgtgatcttctcgacaccgcttcagctgtttaccggga

SEQ ID NO: 104376 - DNA, 75 bp, Artificial Sequence
  Synthetic
actctcatttttgccttctgactttttcccgtctgttcgtgatcttctcgacaccgcttcagctgtctaccggga

SEQ ID NO: 104377 - DNA, 75 bp, Artificial Sequence
  Synthetic
actctcatttttgccttctgactttttcccgtctgttcgtgatcttctcgacaccgcttcagctgtgtaccggga

SEQ ID NO: 104378 - DNA, 75 bp, Artificial Sequence
  Synthetic
actctcatttttgccttctgactttttcccgtctgttcgtgaccttctcgacaccgcttcagctatataccggga

SEQ ID NO: 104379 - DNA, 75 bp, Artificial Sequence
  Synthetic
actctcatttttgccttctgactttttcccgtctgttcgtgaccttctcgacaccgcttcagctatttaccggga

SEQ ID NO: 104380 - DNA, 75 bp, Artificial Sequence
  Synthetic
actctcatttttgccttctgactttttcccgtctgttcgtgaccttctcgacaccgcttcagctatctaccggga

SEQ ID NO: 104381 - DNA, 75 bp, Artificial Sequence
  Synthetic
actctcatttttgccttctgactttttcccgtctgttcgtgaccttctcgacaccgcttcagctatgtaccggga

SEQ ID NO: 104382 - DNA, 75 bp, Artificial Sequence
  Synthetic
actctcatttttgccttctgactttttcccgtctgttcgtgaccttctcgacaccgcttcagctttataccggga

SEQ ID NO: 104383 - DNA, 75 bp, Artificial Sequence
  Synthetic
actctcatttttgccttctgactttttcccgtctgttcgtgaccttctcgacaccgcttcagctttttaccggga

SEQ ID NO: 104384 - DNA, 75 bp, Artificial Sequence
  Synthetic
actctcatttttgccttctgactttttcccgtctgttcgtgaccttctcgacaccgcttcagctttctaccggga

SEQ ID NO: 104385 - DNA, 75 bp, Artificial Sequence
  Synthetic
actctcatttttgccttctgactttttcccgtctgttcgtgaccttctcgacaccgcttcagctttgtaccggga

SEQ ID NO: 104386 - DNA, 75 bp, Artificial Sequence
  Synthetic
actctcatttttgccttctgactttttcccgtctgttcgtgaccttctcgacaccgcttcagctctataccggga

SEQ ID NO: 104387 - DNA, 75 bp, Artificial Sequence
  Synthetic
actctcatttttgccttctgactttttcccgtctgttcgtgaccttctcgacaccgcttcagctctttaccggga

SEQ ID NO: 104388 - DNA, 75 bp, Artificial Sequence
  Synthetic
actctcatttttgccttctgactttttcccgtctgttcgtgaccttctcgacaccgcttcagctctctaccggga

SEQ ID NO: 104389 - DNA, 75 bp, Artificial Sequence
  Synthetic
actctcatttttgccttctgactttttcccgtctgttcgtgaccttctcgacaccgcttcagctctgtaccggga

SEQ ID NO: 104390 - DNA, 75 bp, Artificial Sequence
  Synthetic
actctcatttttgccttctgactttttcccgtctgttcgtgaccttctcgacaccgcttcagctgtataccggga

SEQ ID NO: 104391 - DNA, 75 bp, Artificial Sequence
  Synthetic
actctcatttttgccttctgactttttcccgtctgttcgtgaccttctcgacaccgcttcagctgtttaccggga

SEQ ID NO: 104392 - DNA, 75 bp, Artificial Sequence
  Synthetic
actctcatttttgccttctgactttttcccgtctgttcgtgaccttctcgacaccgcttcagctgtctaccggga

SEQ ID NO: 104393 - DNA, 75 bp, Artificial Sequence
  Synthetic
actctcatttttgccttctgactttttcccgtctgttcgtgaccttctcgacaccgcttcagctgtgtaccggga

SEQ ID NO: 104394 - DNA, 75 bp, Artificial Sequence
  Synthetic
actctcatttttgccttctgactttttcccgtctgttcgtgagcttctcgacaccgcttcagctatataccggga

SEQ ID NO: 104395 - DNA, 75 bp, Artificial Sequence
  Synthetic
actctcatttttgccttctgactttttcccgtctgttcgtgagcttctcgacaccgcttcagctatttaccggga

SEQ ID NO: 104396 - DNA, 75 bp, Artificial Sequence
  Synthetic
actctcatttttgccttctgactttttcccgtctgttcgtgagcttctcgacaccgcttcagctatctaccggga

SEQ ID NO: 104397 - DNA, 75 bp, Artificial Sequence
  Synthetic
actctcatttttgccttctgactttttcccgtctgttcgtgagcttctcgacaccgcttcagctatgtaccggga

SEQ ID NO: 104398 - DNA, 75 bp, Artificial Sequence
  Synthetic
actctcatttttgccttctgactttttcccgtctgttcgtgagcttctcgacaccgcttcagctttataccggga

SEQ ID NO: 104399 - DNA, 75 bp, Artificial Sequence
  Synthetic
actctcatttttgccttctgactttttcccgtctgttcgtgagcttctcgacaccgcttcagctttttaccggga

SEQ ID NO: 104400 - DNA, 75 bp, Artificial Sequence
  Synthetic
actctcatttttgccttctgactttttcccgtctgttcgtgagcttctcgacaccgcttcagctttctaccggga

SEQ ID NO: 104401 - DNA, 75 bp, Artificial Sequence
  Synthetic
actctcatttttgccttctgactttttcccgtctgttcgtgagcttctcgacaccgcttcagctttgtaccggga

SEQ ID NO: 104402 - DNA, 75 bp, Artificial Sequence
  Synthetic
actctcatttttgccttctgactttttcccgtctgttcgtgagcttctcgacaccgcttcagctctataccggga

SEQ ID NO: 104403 - DNA, 75 bp, Artificial Sequence
  Synthetic
actctcatttttgccttctgactttttcccgtctgttcgtgagcttctcgacaccgcttcagctctttaccggga

SEQ ID NO: 104404 - DNA, 75 bp, Artificial Sequence
  Synthetic
actctcatttttgccttctgactttttcccgtctgttcgtgagcttctcgacaccgcttcagctctctaccggga

SEQ ID NO: 104405 - DNA, 75 bp, Artificial Sequence
  Synthetic
actctcatttttgccttctgactttttcccgtctgttcgtgagcttctcgacaccgcttcagctctgtaccggga

SEQ ID NO: 104406 - DNA, 75 bp, Artificial Sequence
  Synthetic
actctcatttttgccttctgactttttcccgtctgttcgtgagcttctcgacaccgcttcagctgtataccggga

SEQ ID NO: 104407 - DNA, 75 bp, Artificial Sequence
  Synthetic
actctcatttttgccttctgactttttcccgtctgttcgtgagcttctcgacaccgcttcagctgtttaccggga

SEQ ID NO: 104408 - DNA, 75 bp, Artificial Sequence
  Synthetic
actctcatttttgccttctgactttttcccgtctgttcgtgagcttctcgacaccgcttcagctgtctaccggga

SEQ ID NO: 104409 - DNA, 75 bp, Artificial Sequence
  Synthetic
actctcatttttgccttctgactttttcccgtctgttcgtgagcttctcgacaccgcttcagctgtgtaccggga

SEQ ID NO: 104410 - DNA, 75 bp, Artificial Sequence
  Synthetic
tagctacctgggtgggaaataatttggacgatccagcacccagagatatggtggtcaattatgtcaatactaata

SEQ ID NO: 104411 - DNA, 75 bp, Artificial Sequence
  Synthetic
tagctacctgggtgggaaataatttggacgatccagcacccagagatttggtggtcaattatgtcaatactaata

SEQ ID NO: 104412 - DNA, 75 bp, Artificial Sequence
  Synthetic
tagctacctgggtgggaaataatttggacgatccagcacccagagatctggtggtcaattatgtcaatactaata

SEQ ID NO: 104413 - DNA, 75 bp, Artificial Sequence
  Synthetic
tagctacctgggtgggaaataatttggacgatccagcacccagagatgtggtggtcaattatgtcaatactaata

SEQ ID NO: 104414 - DNA, 75 bp, Artificial Sequence
  Synthetic
tagctacctgggtgggtaataatttggacgatccagcacccagagatatggtggtcaattatgtcaatactaata

SEQ ID NO: 104415 - DNA, 75 bp, Artificial Sequence
  Synthetic
tagctacctgggtgggtaataatttggacgatccagcacccagagatttggtggtcaattatgtcaatactaata

SEQ ID NO: 104416 - DNA, 75 bp, Artificial Sequence
  Synthetic
tagctacctgggtgggtaataatttggacgatccagcacccagagatctggtggtcaattatgtcaatactaata

SEQ ID NO: 104417 - DNA, 75 bp, Artificial Sequence
  Synthetic
tagctacctgggtgggtaataatttggacgatccagcacccagagatgtggtggtcaattatgtcaatactaata

SEQ ID NO: 104418 - DNA, 75 bp, Artificial Sequence
  Synthetic
tagctacctgggtgggcaataatttggacgatccagcacccagagatatggtggtcaattatgtcaatactaata

SEQ ID NO: 104419 - DNA, 75 bp, Artificial Sequence
  Synthetic
tagctacctgggtgggcaataatttggacgatccagcacccagagatttggtggtcaattatgtcaatactaata

SEQ ID NO: 104420 - DNA, 75 bp, Artificial Sequence
  Synthetic
tagctacctgggtgggcaataatttggacgatccagcacccagagatctggtggtcaattatgtcaatactaata

SEQ ID NO: 104421 - DNA, 75 bp, Artificial Sequence
  Synthetic
tagctacctgggtgggcaataatttggacgatccagcacccagagatgtggtggtcaattatgtcaatactaata

SEQ ID NO: 104422 - DNA, 75 bp, Artificial Sequence
  Synthetic
tagctacctgggtggggaataatttggacgatccagcacccagagatatggtggtcaattatgtcaatactaata

SEQ ID NO: 104423 - DNA, 75 bp, Artificial Sequence
  Synthetic
tagctacctgggtggggaataatttggacgatccagcacccagagatttggtggtcaattatgtcaatactaata

SEQ ID NO: 104424 - DNA, 75 bp, Artificial Sequence
  Synthetic
tagctacctgggtggggaataatttggacgatccagcacccagagatctggtggtcaattatgtcaatactaata

SEQ ID NO: 104425 - DNA, 75 bp, Artificial Sequence
  Synthetic
tagctacctgggtggggaataatttggacgatccagcacccagagatgtggtggtcaattatgtcaatactaata

SEQ ID NO: 104426 - DNA, 75 bp, Artificial Sequence
  Synthetic
ttgctacctgggtgggaaataatttggacgatccagcacccagagatatggtggtcaattatgtcaatactaata

SEQ ID NO: 104427 - DNA, 75 bp, Artificial Sequence
  Synthetic
ttgctacctgggtgggaaataatttggacgatccagcacccagagatttggtggtcaattatgtcaatactaata

SEQ ID NO: 104428 - DNA, 75 bp, Artificial Sequence
  Synthetic
ttgctacctgggtgggaaataatttggacgatccagcacccagagatctggtggtcaattatgtcaatactaata

SEQ ID NO: 104429 - DNA, 75 bp, Artificial Sequence
  Synthetic
ttgctacctgggtgggaaataatttggacgatccagcacccagagatgtggtggtcaattatgtcaatactaata

SEQ ID NO: 104430 - DNA, 75 bp, Artificial Sequence
  Synthetic
ttgctacctgggtgggtaataatttggacgatccagcacccagagatatggtggtcaattatgtcaatactaata

SEQ ID NO: 104431 - DNA, 75 bp, Artificial Sequence
  Synthetic
ttgctacctgggtgggtaataatttggacgatccagcacccagagatttggtggtcaattatgtcaatactaata

SEQ ID NO: 104432 - DNA, 75 bp, Artificial Sequence
  Synthetic
ttgctacctgggtgggtaataatttggacgatccagcacccagagatctggtggtcaattatgtcaatactaata

SEQ ID NO: 104433 - DNA, 75 bp, Artificial Sequence
  Synthetic
ttgctacctgggtgggtaataatttggacgatccagcacccagagatgtggtggtcaattatgtcaatactaata

SEQ ID NO: 104434 - DNA, 75 bp, Artificial Sequence
  Synthetic
ttgctacctgggtgggcaataatttggacgatccagcacccagagatatggtggtcaattatgtcaatactaata

SEQ ID NO: 104435 - DNA, 75 bp, Artificial Sequence
  Synthetic
ttgctacctgggtgggcaataatttggacgatccagcacccagagatttggtggtcaattatgtcaatactaata

SEQ ID NO: 104436 - DNA, 75 bp, Artificial Sequence
  Synthetic
ttgctacctgggtgggcaataatttggacgatccagcacccagagatctggtggtcaattatgtcaatactaata

SEQ ID NO: 104437 - DNA, 75 bp, Artificial Sequence
  Synthetic
ttgctacctgggtgggcaataatttggacgatccagcacccagagatgtggtggtcaattatgtcaatactaata

SEQ ID NO: 104438 - DNA, 75 bp, Artificial Sequence
  Synthetic
ttgctacctgggtggggaataatttggacgatccagcacccagagatatggtggtcaattatgtcaatactaata

SEQ ID NO: 104439 - DNA, 75 bp, Artificial Sequence
  Synthetic
ttgctacctgggtggggaataatttggacgatccagcacccagagatttggtggtcaattatgtcaatactaata

SEQ ID NO: 104440 - DNA, 75 bp, Artificial Sequence
  Synthetic
ttgctacctgggtggggaataatttggacgatccagcacccagagatctggtggtcaattatgtcaatactaata

SEQ ID NO: 104441 - DNA, 75 bp, Artificial Sequence
  Synthetic
ttgctacctgggtggggaataatttggacgatccagcacccagagatgtggtggtcaattatgtcaatactaata

SEQ ID NO: 104442 - DNA, 75 bp, Artificial Sequence
  Synthetic
tcgctacctgggtgggaaataatttggacgatccagcacccagagatatggtggtcaattatgtcaatactaata

SEQ ID NO: 104443 - DNA, 75 bp, Artificial Sequence
  Synthetic
tcgctacctgggtgggaaataatttggacgatccagcacccagagatttggtggtcaattatgtcaatactaata

SEQ ID NO: 104444 - DNA, 75 bp, Artificial Sequence
  Synthetic
tcgctacctgggtgggaaataatttggacgatccagcacccagagatctggtggtcaattatgtcaatactaata

SEQ ID NO: 104445 - DNA, 75 bp, Artificial Sequence
  Synthetic
tcgctacctgggtgggaaataatttggacgatccagcacccagagatgtggtggtcaattatgtcaatactaata

SEQ ID NO: 104446 - DNA, 75 bp, Artificial Sequence
  Synthetic
tcgctacctgggtgggtaataatttggacgatccagcacccagagatatggtggtcaattatgtcaatactaata

SEQ ID NO: 104447 - DNA, 75 bp, Artificial Sequence
  Synthetic
tcgctacctgggtgggtaataatttggacgatccagcacccagagatttggtggtcaattatgtcaatactaata

SEQ ID NO: 104448 - DNA, 75 bp, Artificial Sequence
  Synthetic
tcgctacctgggtgggtaataatttggacgatccagcacccagagatctggtggtcaattatgtcaatactaata

SEQ ID NO: 104449 - DNA, 75 bp, Artificial Sequence
  Synthetic
tcgctacctgggtgggtaataatttggacgatccagcacccagagatgtggtggtcaattatgtcaatactaata

SEQ ID NO: 104450 - DNA, 75 bp, Artificial Sequence
  Synthetic
tcgctacctgggtgggcaataatttggacgatccagcacccagagatatggtggtcaattatgtcaatactaata

SEQ ID NO: 104451 - DNA, 75 bp, Artificial Sequence
  Synthetic
tcgctacctgggtgggcaataatttggacgatccagcacccagagatttggtggtcaattatgtcaatactaata

SEQ ID NO: 104452 - DNA, 75 bp, Artificial Sequence
  Synthetic
tcgctacctgggtgggcaataatttggacgatccagcacccagagatctggtggtcaattatgtcaatactaata

SEQ ID NO: 104453 - DNA, 75 bp, Artificial Sequence
  Synthetic
tcgctacctgggtgggcaataatttggacgatccagcacccagagatgtggtggtcaattatgtcaatactaata

SEQ ID NO: 104454 - DNA, 75 bp, Artificial Sequence
  Synthetic
tcgctacctgggtggggaataatttggacgatccagcacccagagatatggtggtcaattatgtcaatactaata

SEQ ID NO: 104455 - DNA, 75 bp, Artificial Sequence
  Synthetic
tcgctacctgggtggggaataatttggacgatccagcacccagagatttggtggtcaattatgtcaatactaata

SEQ ID NO: 104456 - DNA, 75 bp, Artificial Sequence
  Synthetic
tcgctacctgggtggggaataatttggacgatccagcacccagagatctggtggtcaattatgtcaatactaata

SEQ ID NO: 104457 - DNA, 75 bp, Artificial Sequence
  Synthetic
tcgctacctgggtggggaataatttggacgatccagcacccagagatgtggtggtcaattatgtcaatactaata

SEQ ID NO: 104458 - DNA, 75 bp, Artificial Sequence
  Synthetic
tggctacctgggtgggaaataatttggacgatccagcacccagagatatggtggtcaattatgtcaatactaata

SEQ ID NO: 104459 - DNA, 75 bp, Artificial Sequence
  Synthetic
tggctacctgggtgggaaataatttggacgatccagcacccagagatttggtggtcaattatgtcaatactaata

SEQ ID NO: 104460 - DNA, 75 bp, Artificial Sequence
  Synthetic
tggctacctgggtgggaaataatttggacgatccagcacccagagatctggtggtcaattatgtcaatactaata

SEQ ID NO: 104461 - DNA, 75 bp, Artificial Sequence
  Synthetic
tggctacctgggtgggaaataatttggacgatccagcacccagagatgtggtggtcaattatgtcaatactaata

SEQ ID NO: 104462 - DNA, 75 bp, Artificial Sequence
  Synthetic
tggctacctgggtgggtaataatttggacgatccagcacccagagatatggtggtcaattatgtcaatactaata

SEQ ID NO: 104463 - DNA, 75 bp, Artificial Sequence
  Synthetic
tggctacctgggtgggtaataatttggacgatccagcacccagagatttggtggtcaattatgtcaatactaata

SEQ ID NO: 104464 - DNA, 75 bp, Artificial Sequence
  Synthetic
tggctacctgggtgggtaataatttggacgatccagcacccagagatctggtggtcaattatgtcaatactaata

SEQ ID NO: 104465 - DNA, 75 bp, Artificial Sequence
  Synthetic
tggctacctgggtgggtaataatttggacgatccagcacccagagatgtggtggtcaattatgtcaatactaata

SEQ ID NO: 104466 - DNA, 75 bp, Artificial Sequence
  Synthetic
tggctacctgggtgggcaataatttggacgatccagcacccagagatatggtggtcaattatgtcaatactaata

SEQ ID NO: 104467 - DNA, 75 bp, Artificial Sequence
  Synthetic
tggctacctgggtgggcaataatttggacgatccagcacccagagatttggtggtcaattatgtcaatactaata

SEQ ID NO: 104468 - DNA, 75 bp, Artificial Sequence
  Synthetic
tggctacctgggtgggcaataatttggacgatccagcacccagagatctggtggtcaattatgtcaatactaata

SEQ ID NO: 104469 - DNA, 75 bp, Artificial Sequence
  Synthetic
tggctacctgggtgggcaataatttggacgatccagcacccagagatgtggtggtcaattatgtcaatactaata

SEQ ID NO: 104470 - DNA, 75 bp, Artificial Sequence
  Synthetic
tggctacctgggtggggaataatttggacgatccagcacccagagatatggtggtcaattatgtcaatactaata

SEQ ID NO: 104471 - DNA, 75 bp, Artificial Sequence
  Synthetic
tggctacctgggtggggaataatttggacgatccagcacccagagatttggtggtcaattatgtcaatactaata

SEQ ID NO: 104472 - DNA, 75 bp, Artificial Sequence
  Synthetic
tggctacctgggtggggaataatttggacgatccagcacccagagatctggtggtcaattatgtcaatactaata

SEQ ID NO: 104473 - DNA, 75 bp, Artificial Sequence
  Synthetic
tggctacctgggtggggaataatttggacgatccagcacccagagatgtggtggtcaattatgtcaatactaata

SEQ ID NO: 104474 - DNA, 75 bp, Artificial Sequence
  Synthetic
tgaaattgatcatgcctgctaggttttatcctaagtttaccaaatatttgcccttggataagggtattaaacctt

SEQ ID NO: 104475 - DNA, 75 bp, Artificial Sequence
  Synthetic
tcctctgccgatccatactgcggaactcctagccgcttgttttgctcgcagcaggtctggagcaaaccttatcgg

SEQ ID NO: 104476 - DNA, 75 bp, Artificial Sequence
  Synthetic
ggaggttggtcttccaaacctcaacaatgtgtggggacaaatctttcagctcctcatcatctgggattctttccc

SEQ ID NO: 104477 - DNA, 75 bp, Artificial Sequence
  Synthetic
ggccagagggaaatttcgtacgagggggagcattcccacacagggttcattccgccacggagccgtcttgtgggg

SEQ ID NO: 104478 - DNA, 75 bp, Artificial Sequence
  Synthetic
ctcaacccagttccaacagagccctgctggtggctccagttcaaaaacacaaaaccctgctccgactattgtctc

SEQ ID NO: 104479 - DNA, 75 bp, Artificial Sequence
  Synthetic
tcggcatcccagaacaccgcctactcccatctctccacctctaacagacagtcgtacctccgccatgttccggaa

SEQ ID NO: 104480 - DNA, 75 bp, Artificial Sequence
  Synthetic
gctcctctgccgatccatactgcggaactcctagcagcttgttttgctcgcagccggtctggagcaaaacttatc

SEQ ID NO: 104481 - DNA, 75 bp, Artificial Sequence
  Synthetic
gtggctttagggcatggatagaacaactttgccatatggcctttttggcttagacattgacccttataaagaatt

SEQ ID NO: 104482 - DNA, 75 bp, Artificial Sequence
  Synthetic
aactccctcgcctcgcagacgaaggtctcaatcgccgcgtcgcagaagatctaaatctcgggaatctcaatgtta

SEQ ID NO: 104483 - DNA, 75 bp, Artificial Sequence
  Synthetic
gtctcaatcgccgcgtcgcagaagatctcaatctcgggaatctcaatgttagtattccttggacgcataaggtgg

SEQ ID NO: 104484 - DNA, 75 bp, Artificial Sequence
  Synthetic
catttacatgaagacatttctaataggtgtcagcaatttgtaggccctctcactgtaaatgaaaaaagaagactg

SEQ ID NO: 104485 - DNA, 75 bp, Artificial Sequence
  Synthetic
cttccgtcagagatctcctagacaccgcctcagctctgtatcgagaagccttagagtctcctgagcattgctcac

SEQ ID NO: 104486 - DNA, 75 bp, Artificial Sequence
  Synthetic
aggtgggaaactttactgggctttattcttctactgtacctgtctttaatcctgactggcaaactccctcttttc

SEQ ID NO: 104487 - DNA, 75 bp, Artificial Sequence
  Synthetic
tcggcaggtaggaaggaagcctactcccctgtctccacctctaagagacactcatcctcaggccatgcagtggaa

SEQ ID NO: 104488 - DNA, 75 bp, Artificial Sequence
  Synthetic
tggagcttctgtggagttactctcttttttgccttctgacttctttccttctattcgagatctcctcgacaccgc

SEQ ID NO: 104489 - DNA, 75 bp, Artificial Sequence
  Synthetic
tggccggactccaacaaggtgggagtgggagcattcgggccgggattcactccaccccacgggggactgttgggg

SEQ ID NO: 104490 - DNA, 75 bp, Artificial Sequence
  Synthetic
tcacagtaaatgagaaacgaagattaaaactagttatgcctgccagatttttcccaaactctactaaatatttac

SEQ ID NO: 104491 - DNA, 75 bp, Artificial Sequence
  Synthetic
ggaggatatggttgacaggtgtaaacactttgtgggacccctcacagtaaaggaaaacaggagactaaaattgat

SEQ ID NO: 104492 - DNA, 75 bp, Artificial Sequence
  Synthetic
ctcgacaaggcatggggacaaatctttctgtacccaatcccctgggattcttacccgatcaacagttggacccgg

SEQ ID NO: 104493 - DNA, 75 bp, Artificial Sequence
  Synthetic
ctcgacaaggcatggggacaaatctttctgtacccaatcccctgggattcttacccgatcatcagttggacccgg

SEQ ID NO: 104494 - DNA, 75 bp, Artificial Sequence
  Synthetic
ctcgacaaggcatggggacaaatctttctgtacccaatcccctgggattcttacccgatcaccagttggacccgg

SEQ ID NO: 104495 - DNA, 75 bp, Artificial Sequence
  Synthetic
ctcgacaaggcatggggacaaatctttctgtacccaatcccctgggattcttacccgatcagcagttggacccgg

SEQ ID NO: 104496 - DNA, 75 bp, Artificial Sequence
  Synthetic
ctcgacaaggcatggggacaaatctttctgtacccaatcccctgggattctttcccgatcaacagttggacccgg

SEQ ID NO: 104497 - DNA, 75 bp, Artificial Sequence
  Synthetic
ctcgacaaggcatggggacaaatctttctgtacccaatcccctgggattctttcccgatcatcagttggacccgg

SEQ ID NO: 104498 - DNA, 75 bp, Artificial Sequence
  Synthetic
ctcgacaaggcatggggacaaatctttctgtacccaatcccctgggattctttcccgatcaccagttggacccgg

SEQ ID NO: 104499 - DNA, 75 bp, Artificial Sequence
  Synthetic
ctcgacaaggcatggggacaaatctttctgtacccaatcccctgggattctttcccgatcagcagttggacccgg

SEQ ID NO: 104500 - DNA, 75 bp, Artificial Sequence
  Synthetic
ctcgacaaggcatggggacaaatctttctgtacccaatcccctgggattcttccccgatcaacagttggacccgg

SEQ ID NO: 104501 - DNA, 75 bp, Artificial Sequence
  Synthetic
ctcgacaaggcatggggacaaatctttctgtacccaatcccctgggattcttccccgatcatcagttggacccgg

SEQ ID NO: 104502 - DNA, 75 bp, Artificial Sequence
  Synthetic
ctcgacaaggcatggggacaaatctttctgtacccaatcccctgggattcttccccgatcaccagttggacccgg

SEQ ID NO: 104503 - DNA, 75 bp, Artificial Sequence
  Synthetic
ctcgacaaggcatggggacaaatctttctgtacccaatcccctgggattcttccccgatcagcagttggacccgg

SEQ ID NO: 104504 - DNA, 75 bp, Artificial Sequence
  Synthetic
ctcgacaaggcatggggacaaatctttctgtacccaatcccctgggattcttgcccgatcaacagttggacccgg

SEQ ID NO: 104505 - DNA, 75 bp, Artificial Sequence
  Synthetic
ctcgacaaggcatggggacaaatctttctgtacccaatcccctgggattcttgcccgatcatcagttggacccgg

SEQ ID NO: 104506 - DNA, 75 bp, Artificial Sequence
  Synthetic
ctcgacaaggcatggggacaaatctttctgtacccaatcccctgggattcttgcccgatcaccagttggacccgg

SEQ ID NO: 104507 - DNA, 75 bp, Artificial Sequence
  Synthetic
ctcgacaaggcatggggacaaatctttctgtacccaatcccctgggattcttgcccgatcagcagttggacccgg

SEQ ID NO: 104508 - DNA, 75 bp, Artificial Sequence
  Synthetic
ctcgacaaggcatggggacaaatctttctgttcccaatcccctgggattcttacccgatcaacagttggacccgg

SEQ ID NO: 104509 - DNA, 75 bp, Artificial Sequence
  Synthetic
ctcgacaaggcatggggacaaatctttctgttcccaatcccctgggattcttacccgatcatcagttggacccgg

SEQ ID NO: 104510 - DNA, 75 bp, Artificial Sequence
  Synthetic
ctcgacaaggcatggggacaaatctttctgttcccaatcccctgggattcttacccgatcaccagttggacccgg

SEQ ID NO: 104511 - DNA, 75 bp, Artificial Sequence
  Synthetic
ctcgacaaggcatggggacaaatctttctgttcccaatcccctgggattcttacccgatcagcagttggacccgg

SEQ ID NO: 104512 - DNA, 75 bp, Artificial Sequence
  Synthetic
ctcgacaaggcatggggacaaatctttctgttcccaatcccctgggattctttcccgatcaacagttggacccgg

SEQ ID NO: 104513 - DNA, 75 bp, Artificial Sequence
  Synthetic
ctcgacaaggcatggggacaaatctttctgttcccaatcccctgggattctttcccgatcatcagttggacccgg

SEQ ID NO: 104514 - DNA, 75 bp, Artificial Sequence
  Synthetic
ctcgacaaggcatggggacaaatctttctgttcccaatcccctgggattctttcccgatcaccagttggacccgg

SEQ ID NO: 104515 - DNA, 75 bp, Artificial Sequence
  Synthetic
ctcgacaaggcatggggacaaatctttctgttcccaatcccctgggattctttcccgatcagcagttggacccgg

SEQ ID NO: 104516 - DNA, 75 bp, Artificial Sequence
  Synthetic
ctcgacaaggcatggggacaaatctttctgttcccaatcccctgggattcttccccgatcaacagttggacccgg

SEQ ID NO: 104517 - DNA, 75 bp, Artificial Sequence
  Synthetic
ctcgacaaggcatggggacaaatctttctgttcccaatcccctgggattcttccccgatcatcagttggacccgg

SEQ ID NO: 104518 - DNA, 75 bp, Artificial Sequence
  Synthetic
ctcgacaaggcatggggacaaatctttctgttcccaatcccctgggattcttccccgatcaccagttggacccgg

SEQ ID NO: 104519 - DNA, 75 bp, Artificial Sequence
  Synthetic
ctcgacaaggcatggggacaaatctttctgttcccaatcccctgggattcttccccgatcagcagttggacccgg

SEQ ID NO: 104520 - DNA, 75 bp, Artificial Sequence
  Synthetic
ctcgacaaggcatggggacaaatctttctgttcccaatcccctgggattcttgcccgatcaacagttggacccgg

SEQ ID NO: 104521 - DNA, 75 bp, Artificial Sequence
  Synthetic
ctcgacaaggcatggggacaaatctttctgttcccaatcccctgggattcttgcccgatcatcagttggacccgg

SEQ ID NO: 104522 - DNA, 75 bp, Artificial Sequence
  Synthetic
ctcgacaaggcatggggacaaatctttctgttcccaatcccctgggattcttgcccgatcaccagttggacccgg

SEQ ID NO: 104523 - DNA, 75 bp, Artificial Sequence
  Synthetic
ctcgacaaggcatggggacaaatctttctgttcccaatcccctgggattcttgcccgatcagcagttggacccgg

SEQ ID NO: 104524 - DNA, 75 bp, Artificial Sequence
  Synthetic
ctcgacaaggcatggggacaaatctttctgtccccaatcccctgggattcttacccgatcaacagttggacccgg

SEQ ID NO: 104525 - DNA, 75 bp, Artificial Sequence
  Synthetic
ctcgacaaggcatggggacaaatctttctgtccccaatcccctgggattcttacccgatcatcagttggacccgg

SEQ ID NO: 104526 - DNA, 75 bp, Artificial Sequence
  Synthetic
ctcgacaaggcatggggacaaatctttctgtccccaatcccctgggattcttacccgatcaccagttggacccgg

SEQ ID NO: 104527 - DNA, 75 bp, Artificial Sequence
  Synthetic
ctcgacaaggcatggggacaaatctttctgtccccaatcccctgggattcttacccgatcagcagttggacccgg

SEQ ID NO: 104528 - DNA, 75 bp, Artificial Sequence
  Synthetic
ctcgacaaggcatggggacaaatctttctgtccccaatcccctgggattctttcccgatcaacagttggacccgg

SEQ ID NO: 104529 - DNA, 75 bp, Artificial Sequence
  Synthetic
ctcgacaaggcatggggacaaatctttctgtccccaatcccctgggattctttcccgatcatcagttggacccgg

SEQ ID NO: 104530 - DNA, 75 bp, Artificial Sequence
  Synthetic
ctcgacaaggcatggggacaaatctttctgtccccaatcccctgggattctttcccgatcaccagttggacccgg

SEQ ID NO: 104531 - DNA, 75 bp, Artificial Sequence
  Synthetic
ctcgacaaggcatggggacaaatctttctgtccccaatcccctgggattctttcccgatcagcagttggacccgg

SEQ ID NO: 104532 - DNA, 75 bp, Artificial Sequence
  Synthetic
ctcgacaaggcatggggacaaatctttctgtccccaatcccctgggattcttccccgatcaacagttggacccgg

SEQ ID NO: 104533 - DNA, 75 bp, Artificial Sequence
  Synthetic
ctcgacaaggcatggggacaaatctttctgtccccaatcccctgggattcttccccgatcatcagttggacccgg

SEQ ID NO: 104534 - DNA, 75 bp, Artificial Sequence
  Synthetic
ctcgacaaggcatggggacaaatctttctgtccccaatcccctgggattcttccccgatcaccagttggacccgg

SEQ ID NO: 104535 - DNA, 75 bp, Artificial Sequence
  Synthetic
ctcgacaaggcatggggacaaatctttctgtccccaatcccctgggattcttccccgatcagcagttggacccgg

SEQ ID NO: 104536 - DNA, 75 bp, Artificial Sequence
  Synthetic
ctcgacaaggcatggggacaaatctttctgtccccaatcccctgggattcttgcccgatcaacagttggacccgg

SEQ ID NO: 104537 - DNA, 75 bp, Artificial Sequence
  Synthetic
ctcgacaaggcatggggacaaatctttctgtccccaatcccctgggattcttgcccgatcatcagttggacccgg

SEQ ID NO: 104538 - DNA, 75 bp, Artificial Sequence
  Synthetic
ctcgacaaggcatggggacaaatctttctgtccccaatcccctgggattcttgcccgatcaccagttggacccgg

SEQ ID NO: 104539 - DNA, 75 bp, Artificial Sequence
  Synthetic
ctcgacaaggcatggggacaaatctttctgtccccaatcccctgggattcttgcccgatcagcagttggacccgg

SEQ ID NO: 104540 - DNA, 75 bp, Artificial Sequence
  Synthetic
ctcgacaaggcatggggacaaatctttctgtgcccaatcccctgggattcttacccgatcaacagttggacccgg

SEQ ID NO: 104541 - DNA, 75 bp, Artificial Sequence
  Synthetic
ctcgacaaggcatggggacaaatctttctgtgcccaatcccctgggattcttacccgatcatcagttggacccgg

SEQ ID NO: 104542 - DNA, 75 bp, Artificial Sequence
  Synthetic
ctcgacaaggcatggggacaaatctttctgtgcccaatcccctgggattcttacccgatcaccagttggacccgg

SEQ ID NO: 104543 - DNA, 75 bp, Artificial Sequence
  Synthetic
ctcgacaaggcatggggacaaatctttctgtgcccaatcccctgggattcttacccgatcagcagttggacccgg

SEQ ID NO: 104544 - DNA, 75 bp, Artificial Sequence
  Synthetic
ctcgacaaggcatggggacaaatctttctgtgcccaatcccctgggattctttcccgatcaacagttggacccgg

SEQ ID NO: 104545 - DNA, 75 bp, Artificial Sequence
  Synthetic
ctcgacaaggcatggggacaaatctttctgtgcccaatcccctgggattctttcccgatcatcagttggacccgg

SEQ ID NO: 104546 - DNA, 75 bp, Artificial Sequence
  Synthetic
ctcgacaaggcatggggacaaatctttctgtgcccaatcccctgggattctttcccgatcaccagttggacccgg

SEQ ID NO: 104547 - DNA, 75 bp, Artificial Sequence
  Synthetic
ctcgacaaggcatggggacaaatctttctgtgcccaatcccctgggattctttcccgatcagcagttggacccgg

SEQ ID NO: 104548 - DNA, 75 bp, Artificial Sequence
  Synthetic
ctcgacaaggcatggggacaaatctttctgtgcccaatcccctgggattcttccccgatcaacagttggacccgg

SEQ ID NO: 104549 - DNA, 75 bp, Artificial Sequence
  Synthetic
ctcgacaaggcatggggacaaatctttctgtgcccaatcccctgggattcttccccgatcatcagttggacccgg

SEQ ID NO: 104550 - DNA, 75 bp, Artificial Sequence
  Synthetic
ctcgacaaggcatggggacaaatctttctgtgcccaatcccctgggattcttccccgatcaccagttggacccgg

SEQ ID NO: 104551 - DNA, 75 bp, Artificial Sequence
  Synthetic
ctcgacaaggcatggggacaaatctttctgtgcccaatcccctgggattcttccccgatcagcagttggacccgg

SEQ ID NO: 104552 - DNA, 75 bp, Artificial Sequence
  Synthetic
ctcgacaaggcatggggacaaatctttctgtgcccaatcccctgggattcttgcccgatcaacagttggacccgg

SEQ ID NO: 104553 - DNA, 75 bp, Artificial Sequence
  Synthetic
ctcgacaaggcatggggacaaatctttctgtgcccaatcccctgggattcttgcccgatcatcagttggacccgg

SEQ ID NO: 104554 - DNA, 75 bp, Artificial Sequence
  Synthetic
ctcgacaaggcatggggacaaatctttctgtgcccaatcccctgggattcttgcccgatcaccagttggacccgg

SEQ ID NO: 104555 - DNA, 75 bp, Artificial Sequence
  Synthetic
ctcgacaaggcatggggacaaatctttctgtgcccaatcccctgggattcttgcccgatcagcagttggacccgg

SEQ ID NO: 104556 - DNA, 75 bp, Artificial Sequence
  Synthetic
tggccaaaattcgcagtccccaacctccaatcactcaccaacctcttgtcctccaatttgtcctggttatcgctg

SEQ ID NO: 104557 - DNA, 75 bp, Artificial Sequence
  Synthetic
cagttggaccctgcattcggagccaactcaaacaatcccgattgggacttcaaccccatcaaggaccactggcca

SEQ ID NO: 104558 - DNA, 75 bp, Artificial Sequence
  Synthetic
cctcctcctgcctccaccaatcactcccttatctcctcctctaagggacactcatcctcaggccatgcagtggaa

SEQ ID NO: 104559 - DNA, 75 bp, Artificial Sequence
  Synthetic
tcggcagtttggtgggggggctactcccttatctccacctctaacggacaataatcctcacgccatacaatggaa

SEQ ID NO: 104560 - DNA, 75 bp, Artificial Sequence
  Synthetic
tctagccacctgggtgggaagtaatttggaagatcccgaatcttgggaaatagtaggcacctatgtcaatggtag

SEQ ID NO: 104561 - DNA, 75 bp, Artificial Sequence
  Synthetic
ggtcttttgggctttgccgctccatttacacaatgtggatatcctgccttaatgcctttgtatgcatgtatacaa

SEQ ID NO: 104562 - DNA, 75 bp, Artificial Sequence
  Synthetic
tctagctacctgggtgggtactaatttggaagatcaagcatctagggacctagtagtcagttatgtcaacactaa

SEQ ID NO: 104563 - DNA, 75 bp, Artificial Sequence
  Synthetic
aggggcctatactttcctgctggtggctccagttccggaacagtaaaccctgttccgactactgcctctcccata

SEQ ID NO: 104564 - DNA, 75 bp, Artificial Sequence
  Synthetic
atattgggggtcttttggaatgcgggttcccactcctactgaatatcgaccacccaaggccaatatcttatcaac

SEQ ID NO: 104565 - DNA, 75 bp, Artificial Sequence
  Synthetic
ggtaccttgccacaagatcatattatacaaaaaatcaaacaatgttttagaaaactccctgttaacaggcccatt

SEQ ID NO: 104566 - DNA, 75 bp, Artificial Sequence
  Synthetic
gggccagtggcaaacttcggaggagtgggatcattcgggccagggttcactccgcctcggagccctcttttgggg

SEQ ID NO: 104567 - DNA, 75 bp, Artificial Sequence
  Synthetic
tcaacaatatgtgggccctcttacagttaatgaaaaaaggagattaaaattaattatgcctgctaggttctatcc

SEQ ID NO: 104568 - DNA, 75 bp, Artificial Sequence
  Synthetic
tcggactcccggaagaccgcctactcccatctctccacctctaagagacagtcgtcctcccgccatgttctggaa

SEQ ID NO: 104569 - DNA, 75 bp, Artificial Sequence
  Synthetic
acttccggaaaataccgctgttagacgaatatgcaggtcccctataagaagaactccctcgcctcgcagactaag

SEQ ID NO: 104570 - DNA, 75 bp, Artificial Sequence
  Synthetic
acttttggaagagaaactgttcttgagtatttggtgtcttttggagtgtggattcgcactcctcccgcttacaga

SEQ ID NO: 104571 - DNA, 75 bp, Artificial Sequence
  Synthetic
tttggaagagaaacggtcattgagtatttggtgtctttcggagtgtggattcgcactcctccagcttatagacca

SEQ ID NO: 104572 - DNA, 75 bp, Artificial Sequence
  Synthetic
tcggcaggtaggaaggcagcctactcccatttctccacctctaagagacactcatcctcaagccatgcagtggaa

SEQ ID NO: 104573 - DNA, 75 bp, Artificial Sequence
  Synthetic
tctcggaaatacacctcctttccatggctgctaggctgtgctgccaactggatcctgcgcgggacgtcctttgtc

SEQ ID NO: 104574 - DNA, 75 bp, Artificial Sequence
  Synthetic
tcttacagttaatgaaaaaaggagattaaaattaattatgcctgctaggttctatcctaaccttaccaaatattt

SEQ ID NO: 104575 - DNA, 75 bp, Artificial Sequence
  Synthetic
aatgactctagccacctgggtgggtggtaatttggaagatccaacatccagggacctagtagtcagttatgttaa

SEQ ID NO: 104576 - DNA, 75 bp, Artificial Sequence
  Synthetic
aaccccaacaaagacaattggccagaagccaccaaggtaggagtgggagcattcgggccagggttcacccctcca

SEQ ID NO: 104577 - DNA, 75 bp, Artificial Sequence
  Synthetic
tgggaggagctgggggaggagattaggttaaaggtcttgtttgtattaggaggctgtaggcataaattggtctgc

SEQ ID NO: 104578 - DNA, 75 bp, Artificial Sequence
  Synthetic
ctccacgctattccaccaagttctgcgagatcccttagttgcgggtggatattttcctgctggaggatccagttc

SEQ ID NO: 104579 - DNA, 75 bp, Artificial Sequence
  Synthetic
ccaacaaggtaggagctggagcattcgggctgggattcaccccaccgcacggaggccttttggggtggagccctc

SEQ ID NO: 104580 - DNA, 75 bp, Artificial Sequence
  Synthetic
gtttttcttgttgacaaaaatcctcacaataccacagagtctagactcgtggtggacttctctcaattttctagg

SEQ ID NO: 104581 - DNA, 75 bp, Artificial Sequence
  Synthetic
tggagccctcaggctcagggcatattgacaacagtaccagcagcgcctactcccatctctccacctctaagagac

SEQ ID NO: 104582 - DNA, 75 bp, Artificial Sequence
  Synthetic
gattggaaagtgtgtcaaagaattgtgggtcttttgggctttgctgccccttttacacaatgtggctatcctgcc

SEQ ID NO: 104583 - DNA, 75 bp, Artificial Sequence
  Synthetic
atcaaagaatgttttagaaaacttcctgttaacaggcctattgattggaaagtctgtcaacgtattgtgggtctt

SEQ ID NO: 104584 - DNA, 75 bp, Artificial Sequence
  Synthetic
gcaaacaccgcaaatccagattgggacttcaatcccaacaaggacacctggccagacgccaacaaggtaggagcg

SEQ ID NO: 104585 - DNA, 75 bp, Artificial Sequence
  Synthetic
gattggaaagtatgtcaacgaattgtgggtcttttgggttttgctgccccttttacacaatgtggttatcctgca

SEQ ID NO: 104586 - DNA, 75 bp, Artificial Sequence
  Synthetic
ctctgggtatacatttaaaccctaacaaaacgaaaagatggggttattcccttaacttcatggggtatgtaattg

SEQ ID NO: 104587 - DNA, 75 bp, Artificial Sequence
  Synthetic
ttccacaaccttccaccaaactctgcaagatcccagactgataggcctggatgtctctgctggaggctcaagttc

SEQ ID NO: 104588 - DNA, 75 bp, Artificial Sequence
  Synthetic
tggagccctcaggctcaggggacattgacacctccggcagccgcccctcctcctgcctccagaaaacctccttca

SEQ ID NO: 104589 - DNA, 75 bp, Artificial Sequence
  Synthetic
aggaacagtaaaccctgttcccactacagcgtctcccttatcgtcgatcgtctcgaggattgtgaaccctgcgat

SEQ ID NO: 104590 - DNA, 75 bp, Artificial Sequence
  Synthetic
ttctccgtactcaatatctctccctttaccccgttgctcggcaacggccaggtatgtgccaagtgtttgctgacg

SEQ ID NO: 104591 - DNA, 75 bp, Artificial Sequence
  Synthetic
acctccttcaggttctccacctactctaatttctcttcctctaagagacagtcatcccaacgccatacactgcca

SEQ ID NO: 104592 - DNA, 75 bp, Artificial Sequence
  Synthetic
ctccacaaccttccaccaaactctgcaagatcccaggcctctccctgctggtggctccagttcaggaacagtaaa

SEQ ID NO: 104593 - DNA, 75 bp, Artificial Sequence
  Synthetic
gtttccctcatgttgctgtacaaaacctacggacggaaactgcacctgtattcccatcccatcatcttgggcttt

SEQ ID NO: 104594 - DNA, 75 bp, Artificial Sequence
  Synthetic
aatttactagtgccatttgttcagtggttcgtaaggctttcccccactgtttggctttcagttatatggatgatg

SEQ ID NO: 104595 - DNA, 75 bp, Artificial Sequence
  Synthetic
cctaatcatctcttgttcatgtcctactgttcaagcctccaagctgtgccttgggtggctttagggcatggacat

SEQ ID NO: 104596 - DNA, 75 bp, Artificial Sequence
  Synthetic
tcggcagacacgaagacagcccacgaccatctctccacctctaatagacagtcatcctcaggccatgcagtggaa

SEQ ID NO: 104597 - DNA, 75 bp, Artificial Sequence
  Synthetic
agatctcctcgacaccgcctcagctctgtatcgggaggccttagagtctccggaacattgttcacctcaccatac

SEQ ID NO: 104598 - DNA, 75 bp, Artificial Sequence
  Synthetic
ggaacattgcctcaagaacatattgtacaaaaaatcaaagaatgctttagaaaactgcctgtaaacaggcctatt

SEQ ID NO: 104599 - DNA, 75 bp, Artificial Sequence
  Synthetic
ttaatgccattgtatgcatgtatacacgcgaaacgggcttttactttttccccaacttataaaacctttctccgc

SEQ ID NO: 104600 - DNA, 75 bp, Artificial Sequence
  Synthetic
ttactctcttttttgccttctgttgtggttacatgtctcttgtctaacatcgggaacagaaactgttcttgagta

SEQ ID NO: 104601 - DNA, 75 bp, Artificial Sequence
  Synthetic
ttactctcttttttgccttctgttgtggttacatgtctcttgtctaacttcgggaacagaaactgttcttgagta

SEQ ID NO: 104602 - DNA, 75 bp, Artificial Sequence
  Synthetic
ttactctcttttttgccttctgttgtggttacatgtctcttgtctaacctcgggaacagaaactgttcttgagta

SEQ ID NO: 104603 - DNA, 75 bp, Artificial Sequence
  Synthetic
ttactctcttttttgccttctgttgtggttacatgtctcttgtctaacgtcgggaacagaaactgttcttgagta

SEQ ID NO: 104604 - DNA, 75 bp, Artificial Sequence
  Synthetic
ttactctcttttttgccttctgttgtggttacatgtctcttgtcttacatcgggaacagaaactgttcttgagta

SEQ ID NO: 104605 - DNA, 75 bp, Artificial Sequence
  Synthetic
ttactctcttttttgccttctgttgtggttacatgtctcttgtcttacttcgggaacagaaactgttcttgagta

SEQ ID NO: 104606 - DNA, 75 bp, Artificial Sequence
  Synthetic
ttactctcttttttgccttctgttgtggttacatgtctcttgtcttacctcgggaacagaaactgttcttgagta

SEQ ID NO: 104607 - DNA, 75 bp, Artificial Sequence
  Synthetic
ttactctcttttttgccttctgttgtggttacatgtctcttgtcttacgtcgggaacagaaactgttcttgagta

SEQ ID NO: 104608 - DNA, 75 bp, Artificial Sequence
  Synthetic
ttactctcttttttgccttctgttgtggttacatgtctcttgtctcacatcgggaacagaaactgttcttgagta

SEQ ID NO: 104609 - DNA, 75 bp, Artificial Sequence
  Synthetic
ttactctcttttttgccttctgttgtggttacatgtctcttgtctcacttcgggaacagaaactgttcttgagta

SEQ ID NO: 104610 - DNA, 75 bp, Artificial Sequence
  Synthetic
ttactctcttttttgccttctgttgtggttacatgtctcttgtctcacctcgggaacagaaactgttcttgagta

SEQ ID NO: 104611 - DNA, 75 bp, Artificial Sequence
  Synthetic
ttactctcttttttgccttctgttgtggttacatgtctcttgtctcacgtcgggaacagaaactgttcttgagta

SEQ ID NO: 104612 - DNA, 75 bp, Artificial Sequence
  Synthetic
ttactctcttttttgccttctgttgtggttacatgtctcttgtctgacatcgggaacagaaactgttcttgagta

SEQ ID NO: 104613 - DNA, 75 bp, Artificial Sequence
  Synthetic
ttactctcttttttgccttctgttgtggttacatgtctcttgtctgacttcgggaacagaaactgttcttgagta

SEQ ID NO: 104614 - DNA, 75 bp, Artificial Sequence
  Synthetic
ttactctcttttttgccttctgttgtggttacatgtctcttgtctgacctcgggaacagaaactgttcttgagta

SEQ ID NO: 104615 - DNA, 75 bp, Artificial Sequence
  Synthetic
ttactctcttttttgccttctgttgtggttacatgtctcttgtctgacgtcgggaacagaaactgttcttgagta

SEQ ID NO: 104616 - DNA, 75 bp, Artificial Sequence
  Synthetic
ttactctcttttttgccttctgttgtggtttcatgtctcttgtctaacatcgggaacagaaactgttcttgagta

SEQ ID NO: 104617 - DNA, 75 bp, Artificial Sequence
  Synthetic
ttactctcttttttgccttctgttgtggtttcatgtctcttgtctaacttcgggaacagaaactgttcttgagta

SEQ ID NO: 104618 - DNA, 75 bp, Artificial Sequence
  Synthetic
ttactctcttttttgccttctgttgtggtttcatgtctcttgtctaacctcgggaacagaaactgttcttgagta

SEQ ID NO: 104619 - DNA, 75 bp, Artificial Sequence
  Synthetic
ttactctcttttttgccttctgttgtggtttcatgtctcttgtctaacgtcgggaacagaaactgttcttgagta

SEQ ID NO: 104620 - DNA, 75 bp, Artificial Sequence
  Synthetic
ttactctcttttttgccttctgttgtggtttcatgtctcttgtcttacatcgggaacagaaactgttcttgagta

SEQ ID NO: 104621 - DNA, 75 bp, Artificial Sequence
  Synthetic
ttactctcttttttgccttctgttgtggtttcatgtctcttgtcttacttcgggaacagaaactgttcttgagta

SEQ ID NO: 104622 - DNA, 75 bp, Artificial Sequence
  Synthetic
ttactctcttttttgccttctgttgtggtttcatgtctcttgtcttacctcgggaacagaaactgttcttgagta

SEQ ID NO: 104623 - DNA, 75 bp, Artificial Sequence
  Synthetic
ttactctcttttttgccttctgttgtggtttcatgtctcttgtcttacgtcgggaacagaaactgttcttgagta

SEQ ID NO: 104624 - DNA, 75 bp, Artificial Sequence
  Synthetic
ttactctcttttttgccttctgttgtggtttcatgtctcttgtctcacatcgggaacagaaactgttcttgagta

SEQ ID NO: 104625 - DNA, 75 bp, Artificial Sequence
  Synthetic
ttactctcttttttgccttctgttgtggtttcatgtctcttgtctcacttcgggaacagaaactgttcttgagta

SEQ ID NO: 104626 - DNA, 75 bp, Artificial Sequence
  Synthetic
ttactctcttttttgccttctgttgtggtttcatgtctcttgtctcacctcgggaacagaaactgttcttgagta

SEQ ID NO: 104627 - DNA, 75 bp, Artificial Sequence
  Synthetic
ttactctcttttttgccttctgttgtggtttcatgtctcttgtctcacgtcgggaacagaaactgttcttgagta

SEQ ID NO: 104628 - DNA, 75 bp, Artificial Sequence
  Synthetic
ttactctcttttttgccttctgttgtggtttcatgtctcttgtctgacatcgggaacagaaactgttcttgagta

SEQ ID NO: 104629 - DNA, 75 bp, Artificial Sequence
  Synthetic
ttactctcttttttgccttctgttgtggtttcatgtctcttgtctgacttcgggaacagaaactgttcttgagta

SEQ ID NO: 104630 - DNA, 75 bp, Artificial Sequence
  Synthetic
ttactctcttttttgccttctgttgtggtttcatgtctcttgtctgacctcgggaacagaaactgttcttgagta

SEQ ID NO: 104631 - DNA, 75 bp, Artificial Sequence
  Synthetic
ttactctcttttttgccttctgttgtggtttcatgtctcttgtctgacgtcgggaacagaaactgttcttgagta

SEQ ID NO: 104632 - DNA, 75 bp, Artificial Sequence
  Synthetic
ttactctcttttttgccttctgttgtggttccatgtctcttgtctaacatcgggaacagaaactgttcttgagta

SEQ ID NO: 104633 - DNA, 75 bp, Artificial Sequence
  Synthetic
ttactctcttttttgccttctgttgtggttccatgtctcttgtctaacttcgggaacagaaactgttcttgagta

SEQ ID NO: 104634 - DNA, 75 bp, Artificial Sequence
  Synthetic
ttactctcttttttgccttctgttgtggttccatgtctcttgtctaacctcgggaacagaaactgttcttgagta

SEQ ID NO: 104635 - DNA, 75 bp, Artificial Sequence
  Synthetic
ttactctcttttttgccttctgttgtggttccatgtctcttgtctaacgtcgggaacagaaactgttcttgagta

SEQ ID NO: 104636 - DNA, 75 bp, Artificial Sequence
  Synthetic
ttactctcttttttgccttctgttgtggttccatgtctcttgtcttacatcgggaacagaaactgttcttgagta

SEQ ID NO: 104637 - DNA, 75 bp, Artificial Sequence
  Synthetic
ttactctcttttttgccttctgttgtggttccatgtctcttgtcttacttcgggaacagaaactgttcttgagta

SEQ ID NO: 104638 - DNA, 75 bp, Artificial Sequence
  Synthetic
ttactctcttttttgccttctgttgtggttccatgtctcttgtcttacctcgggaacagaaactgttcttgagta

SEQ ID NO: 104639 - DNA, 75 bp, Artificial Sequence
  Synthetic
ttactctcttttttgccttctgttgtggttccatgtctcttgtcttacgtcgggaacagaaactgttcttgagta

SEQ ID NO: 104640 - DNA, 75 bp, Artificial Sequence
  Synthetic
ttactctcttttttgccttctgttgtggttccatgtctcttgtctcacatcgggaacagaaactgttcttgagta

SEQ ID NO: 104641 - DNA, 75 bp, Artificial Sequence
  Synthetic
ttactctcttttttgccttctgttgtggttccatgtctcttgtctcacttcgggaacagaaactgttcttgagta

SEQ ID NO: 104642 - DNA, 75 bp, Artificial Sequence
  Synthetic
ttactctcttttttgccttctgttgtggttccatgtctcttgtctcacctcgggaacagaaactgttcttgagta

SEQ ID NO: 104643 - DNA, 75 bp, Artificial Sequence
  Synthetic
ttactctcttttttgccttctgttgtggttccatgtctcttgtctcacgtcgggaacagaaactgttcttgagta

SEQ ID NO: 104644 - DNA, 75 bp, Artificial Sequence
  Synthetic
ttactctcttttttgccttctgttgtggttccatgtctcttgtctgacatcgggaacagaaactgttcttgagta

SEQ ID NO: 104645 - DNA, 75 bp, Artificial Sequence
  Synthetic
ttactctcttttttgccttctgttgtggttccatgtctcttgtctgacttcgggaacagaaactgttcttgagta

SEQ ID NO: 104646 - DNA, 75 bp, Artificial Sequence
  Synthetic
ttactctcttttttgccttctgttgtggttccatgtctcttgtctgacctcgggaacagaaactgttcttgagta

SEQ ID NO: 104647 - DNA, 75 bp, Artificial Sequence
  Synthetic
ttactctcttttttgccttctgttgtggttccatgtctcttgtctgacgtcgggaacagaaactgttcttgagta

SEQ ID NO: 104648 - DNA, 75 bp, Artificial Sequence
  Synthetic
ttactctcttttttgccttctgttgtggttgcatgtctcttgtctaacatcgggaacagaaactgttcttgagta

SEQ ID NO: 104649 - DNA, 75 bp, Artificial Sequence
  Synthetic
ttactctcttttttgccttctgttgtggttgcatgtctcttgtctaacttcgggaacagaaactgttcttgagta

SEQ ID NO: 104650 - DNA, 75 bp, Artificial Sequence
  Synthetic
ttactctcttttttgccttctgttgtggttgcatgtctcttgtctaacctcgggaacagaaactgttcttgagta

SEQ ID NO: 104651 - DNA, 75 bp, Artificial Sequence
  Synthetic
ttactctcttttttgccttctgttgtggttgcatgtctcttgtctaacgtcgggaacagaaactgttcttgagta

SEQ ID NO: 104652 - DNA, 75 bp, Artificial Sequence
  Synthetic
ttactctcttttttgccttctgttgtggttgcatgtctcttgtcttacatcgggaacagaaactgttcttgagta

SEQ ID NO: 104653 - DNA, 75 bp, Artificial Sequence
  Synthetic
ttactctcttttttgccttctgttgtggttgcatgtctcttgtcttacttcgggaacagaaactgttcttgagta

SEQ ID NO: 104654 - DNA, 75 bp, Artificial Sequence
  Synthetic
ttactctcttttttgccttctgttgtggttgcatgtctcttgtcttacctcgggaacagaaactgttcttgagta

SEQ ID NO: 104655 - DNA, 75 bp, Artificial Sequence
  Synthetic
ttactctcttttttgccttctgttgtggttgcatgtctcttgtcttacgtcgggaacagaaactgttcttgagta

SEQ ID NO: 104656 - DNA, 75 bp, Artificial Sequence
  Synthetic
ttactctcttttttgccttctgttgtggttgcatgtctcttgtctcacatcgggaacagaaactgttcttgagta

SEQ ID NO: 104657 - DNA, 75 bp, Artificial Sequence
  Synthetic
ttactctcttttttgccttctgttgtggttgcatgtctcttgtctcacttcgggaacagaaactgttcttgagta

SEQ ID NO: 104658 - DNA, 75 bp, Artificial Sequence
  Synthetic
ttactctcttttttgccttctgttgtggttgcatgtctcttgtctcacctcgggaacagaaactgttcttgagta

SEQ ID NO: 104659 - DNA, 75 bp, Artificial Sequence
  Synthetic
ttactctcttttttgccttctgttgtggttgcatgtctcttgtctcacgtcgggaacagaaactgttcttgagta

SEQ ID NO: 104660 - DNA, 75 bp, Artificial Sequence
  Synthetic
ttactctcttttttgccttctgttgtggttgcatgtctcttgtctgacatcgggaacagaaactgttcttgagta

SEQ ID NO: 104661 - DNA, 75 bp, Artificial Sequence
  Synthetic
ttactctcttttttgccttctgttgtggttgcatgtctcttgtctgacttcgggaacagaaactgttcttgagta

SEQ ID NO: 104662 - DNA, 75 bp, Artificial Sequence
  Synthetic
ttactctcttttttgccttctgttgtggttgcatgtctcttgtctgacctcgggaacagaaactgttcttgagta

SEQ ID NO: 104663 - DNA, 75 bp, Artificial Sequence
  Synthetic
ttactctcttttttgccttctgttgtggttgcatgtctcttgtctgacgtcgggaacagaaactgttcttgagta

SEQ ID NO: 104664 - DNA, 75 bp, Artificial Sequence
  Synthetic
catgcaactttttcacctctgcctaatcatctcttgttcatgtcctacttttcaagcctccaagctgtgccttgg

SEQ ID NO: 104665 - DNA, 75 bp, Artificial Sequence
  Synthetic
tctgtatcgggaagccttagaatctcctgaacattgctcacctcaccacacagcactcaggcaagctattctgtg

SEQ ID NO: 104666 - DNA, 75 bp, Artificial Sequence
  Synthetic
ccacacagcggtcttttggggtgaagccctcagactcaaagcatattaacaacaatgccagcaacacctcctcct

SEQ ID NO: 104667 - DNA, 75 bp, Artificial Sequence
  Synthetic
caattatgttaacactaacatgggcctaaagatcaggcaattattgtggtttcacatttcctgtattacttttgg

SEQ ID NO: 104668 - DNA, 75 bp, Artificial Sequence
  Synthetic
attggccagaggcaaatcaggtaggagcgggacagggcacattgacaacagtgccagtagcacctcctcctgcct

SEQ ID NO: 104669 - DNA, 75 bp, Artificial Sequence
  Synthetic
tgtgggtcttttgggcttcgctgccccttttacacaatgtggctatcctgccttaatgcctttatatgcatgtat

SEQ ID NO: 104670 - DNA, 75 bp, Artificial Sequence
  Synthetic
caattccggaaacaacggttgttagaagagcaagccggtcccctagaagaagaactccctcgcctcgcagacgaa

SEQ ID NO: 104671 - DNA, 75 bp, Artificial Sequence
  Synthetic
caattccggaaacaacggttgttagatgagcaagccggtcccctagaagaagaactccctcgcctcgcagacgaa

SEQ ID NO: 104672 - DNA, 75 bp, Artificial Sequence
  Synthetic
caattccggaaacaacggttgttagacgagcaagccggtcccctagaagaagaactccctcgcctcgcagacgaa

SEQ ID NO: 104673 - DNA, 75 bp, Artificial Sequence
  Synthetic
caattccggaaacaacggttgttagaggagcaagccggtcccctagaagaagaactccctcgcctcgcagacgaa

SEQ ID NO: 104674 - DNA, 75 bp, Artificial Sequence
  Synthetic
caattccggaaactacggttgttagaagagcaagccggtcccctagaagaagaactccctcgcctcgcagacgaa

SEQ ID NO: 104675 - DNA, 75 bp, Artificial Sequence
  Synthetic
caattccggaaactacggttgttagatgagcaagccggtcccctagaagaagaactccctcgcctcgcagacgaa

SEQ ID NO: 104676 - DNA, 75 bp, Artificial Sequence
  Synthetic
caattccggaaactacggttgttagacgagcaagccggtcccctagaagaagaactccctcgcctcgcagacgaa

SEQ ID NO: 104677 - DNA, 75 bp, Artificial Sequence
  Synthetic
caattccggaaactacggttgttagaggagcaagccggtcccctagaagaagaactccctcgcctcgcagacgaa

SEQ ID NO: 104678 - DNA, 75 bp, Artificial Sequence
  Synthetic
caattccggaaaccacggttgttagaagagcaagccggtcccctagaagaagaactccctcgcctcgcagacgaa

SEQ ID NO: 104679 - DNA, 75 bp, Artificial Sequence
  Synthetic
caattccggaaaccacggttgttagatgagcaagccggtcccctagaagaagaactccctcgcctcgcagacgaa

SEQ ID NO: 104680 - DNA, 75 bp, Artificial Sequence
  Synthetic
caattccggaaaccacggttgttagacgagcaagccggtcccctagaagaagaactccctcgcctcgcagacgaa

SEQ ID NO: 104681 - DNA, 75 bp, Artificial Sequence
  Synthetic
caattccggaaaccacggttgttagaggagcaagccggtcccctagaagaagaactccctcgcctcgcagacgaa

SEQ ID NO: 104682 - DNA, 75 bp, Artificial Sequence
  Synthetic
caattccggaaacgacggttgttagaagagcaagccggtcccctagaagaagaactccctcgcctcgcagacgaa

SEQ ID NO: 104683 - DNA, 75 bp, Artificial Sequence
  Synthetic
caattccggaaacgacggttgttagatgagcaagccggtcccctagaagaagaactccctcgcctcgcagacgaa

SEQ ID NO: 104684 - DNA, 75 bp, Artificial Sequence
  Synthetic
caattccggaaacgacggttgttagacgagcaagccggtcccctagaagaagaactccctcgcctcgcagacgaa

SEQ ID NO: 104685 - DNA, 75 bp, Artificial Sequence
  Synthetic
caattccggaaacgacggttgttagaggagcaagccggtcccctagaagaagaactccctcgcctcgcagacgaa

SEQ ID NO: 104686 - DNA, 75 bp, Artificial Sequence
  Synthetic
ctattccggaaacaacggttgttagaagagcaagccggtcccctagaagaagaactccctcgcctcgcagacgaa

SEQ ID NO: 104687 - DNA, 75 bp, Artificial Sequence
  Synthetic
ctattccggaaacaacggttgttagatgagcaagccggtcccctagaagaagaactccctcgcctcgcagacgaa

SEQ ID NO: 104688 - DNA, 75 bp, Artificial Sequence
  Synthetic
ctattccggaaacaacggttgttagacgagcaagccggtcccctagaagaagaactccctcgcctcgcagacgaa

SEQ ID NO: 104689 - DNA, 75 bp, Artificial Sequence
  Synthetic
ctattccggaaacaacggttgttagaggagcaagccggtcccctagaagaagaactccctcgcctcgcagacgaa

SEQ ID NO: 104690 - DNA, 75 bp, Artificial Sequence
  Synthetic
ctattccggaaactacggttgttagaagagcaagccggtcccctagaagaagaactccctcgcctcgcagacgaa

SEQ ID NO: 104691 - DNA, 75 bp, Artificial Sequence
  Synthetic
ctattccggaaactacggttgttagatgagcaagccggtcccctagaagaagaactccctcgcctcgcagacgaa

SEQ ID NO: 104692 - DNA, 75 bp, Artificial Sequence
  Synthetic
ctattccggaaactacggttgttagacgagcaagccggtcccctagaagaagaactccctcgcctcgcagacgaa

SEQ ID NO: 104693 - DNA, 75 bp, Artificial Sequence
  Synthetic
ctattccggaaactacggttgttagaggagcaagccggtcccctagaagaagaactccctcgcctcgcagacgaa

SEQ ID NO: 104694 - DNA, 75 bp, Artificial Sequence
  Synthetic
ctattccggaaaccacggttgttagaagagcaagccggtcccctagaagaagaactccctcgcctcgcagacgaa

SEQ ID NO: 104695 - DNA, 75 bp, Artificial Sequence
  Synthetic
ctattccggaaaccacggttgttagatgagcaagccggtcccctagaagaagaactccctcgcctcgcagacgaa

SEQ ID NO: 104696 - DNA, 75 bp, Artificial Sequence
  Synthetic
ctattccggaaaccacggttgttagacgagcaagccggtcccctagaagaagaactccctcgcctcgcagacgaa

SEQ ID NO: 104697 - DNA, 75 bp, Artificial Sequence
  Synthetic
ctattccggaaaccacggttgttagaggagcaagccggtcccctagaagaagaactccctcgcctcgcagacgaa

SEQ ID NO: 104698 - DNA, 75 bp, Artificial Sequence
  Synthetic
ctattccggaaacgacggttgttagaagagcaagccggtcccctagaagaagaactccctcgcctcgcagacgaa

SEQ ID NO: 104699 - DNA, 75 bp, Artificial Sequence
  Synthetic
ctattccggaaacgacggttgttagatgagcaagccggtcccctagaagaagaactccctcgcctcgcagacgaa

SEQ ID NO: 104700 - DNA, 75 bp, Artificial Sequence
  Synthetic
ctattccggaaacgacggttgttagacgagcaagccggtcccctagaagaagaactccctcgcctcgcagacgaa

SEQ ID NO: 104701 - DNA, 75 bp, Artificial Sequence
  Synthetic
ctattccggaaacgacggttgttagaggagcaagccggtcccctagaagaagaactccctcgcctcgcagacgaa

SEQ ID NO: 104702 - DNA, 75 bp, Artificial Sequence
  Synthetic
ccattccggaaacaacggttgttagaagagcaagccggtcccctagaagaagaactccctcgcctcgcagacgaa

SEQ ID NO: 104703 - DNA, 75 bp, Artificial Sequence
  Synthetic
ccattccggaaacaacggttgttagatgagcaagccggtcccctagaagaagaactccctcgcctcgcagacgaa

SEQ ID NO: 104704 - DNA, 75 bp, Artificial Sequence
  Synthetic
ccattccggaaacaacggttgttagacgagcaagccggtcccctagaagaagaactccctcgcctcgcagacgaa

SEQ ID NO: 104705 - DNA, 75 bp, Artificial Sequence
  Synthetic
ccattccggaaacaacggttgttagaggagcaagccggtcccctagaagaagaactccctcgcctcgcagacgaa

SEQ ID NO: 104706 - DNA, 75 bp, Artificial Sequence
  Synthetic
ccattccggaaactacggttgttagaagagcaagccggtcccctagaagaagaactccctcgcctcgcagacgaa

SEQ ID NO: 104707 - DNA, 75 bp, Artificial Sequence
  Synthetic
ccattccggaaactacggttgttagatgagcaagccggtcccctagaagaagaactccctcgcctcgcagacgaa

SEQ ID NO: 104708 - DNA, 75 bp, Artificial Sequence
  Synthetic
ccattccggaaactacggttgttagacgagcaagccggtcccctagaagaagaactccctcgcctcgcagacgaa

SEQ ID NO: 104709 - DNA, 75 bp, Artificial Sequence
  Synthetic
ccattccggaaactacggttgttagaggagcaagccggtcccctagaagaagaactccctcgcctcgcagacgaa

SEQ ID NO: 104710 - DNA, 75 bp, Artificial Sequence
  Synthetic
ccattccggaaaccacggttgttagaagagcaagccggtcccctagaagaagaactccctcgcctcgcagacgaa

SEQ ID NO: 104711 - DNA, 75 bp, Artificial Sequence
  Synthetic
ccattccggaaaccacggttgttagatgagcaagccggtcccctagaagaagaactccctcgcctcgcagacgaa

SEQ ID NO: 104712 - DNA, 75 bp, Artificial Sequence
  Synthetic
ccattccggaaaccacggttgttagacgagcaagccggtcccctagaagaagaactccctcgcctcgcagacgaa

SEQ ID NO: 104713 - DNA, 75 bp, Artificial Sequence
  Synthetic
ccattccggaaaccacggttgttagaggagcaagccggtcccctagaagaagaactccctcgcctcgcagacgaa

SEQ ID NO: 104714 - DNA, 75 bp, Artificial Sequence
  Synthetic
ccattccggaaacgacggttgttagaagagcaagccggtcccctagaagaagaactccctcgcctcgcagacgaa

SEQ ID NO: 104715 - DNA, 75 bp, Artificial Sequence
  Synthetic
ccattccggaaacgacggttgttagatgagcaagccggtcccctagaagaagaactccctcgcctcgcagacgaa

SEQ ID NO: 104716 - DNA, 75 bp, Artificial Sequence
  Synthetic
ccattccggaaacgacggttgttagacgagcaagccggtcccctagaagaagaactccctcgcctcgcagacgaa

SEQ ID NO: 104717 - DNA, 75 bp, Artificial Sequence
  Synthetic
ccattccggaaacgacggttgttagaggagcaagccggtcccctagaagaagaactccctcgcctcgcagacgaa

SEQ ID NO: 104718 - DNA, 75 bp, Artificial Sequence
  Synthetic
cgattccggaaacaacggttgttagaagagcaagccggtcccctagaagaagaactccctcgcctcgcagacgaa

SEQ ID NO: 104719 - DNA, 75 bp, Artificial Sequence
  Synthetic
cgattccggaaacaacggttgttagatgagcaagccggtcccctagaagaagaactccctcgcctcgcagacgaa

SEQ ID NO: 104720 - DNA, 75 bp, Artificial Sequence
  Synthetic
cgattccggaaacaacggttgttagacgagcaagccggtcccctagaagaagaactccctcgcctcgcagacgaa

SEQ ID NO: 104721 - DNA, 75 bp, Artificial Sequence
  Synthetic
cgattccggaaacaacggttgttagaggagcaagccggtcccctagaagaagaactccctcgcctcgcagacgaa

SEQ ID NO: 104722 - DNA, 75 bp, Artificial Sequence
  Synthetic
cgattccggaaactacggttgttagaagagcaagccggtcccctagaagaagaactccctcgcctcgcagacgaa

SEQ ID NO: 104723 - DNA, 75 bp, Artificial Sequence
  Synthetic
cgattccggaaactacggttgttagatgagcaagccggtcccctagaagaagaactccctcgcctcgcagacgaa

SEQ ID NO: 104724 - DNA, 75 bp, Artificial Sequence
  Synthetic
cgattccggaaactacggttgttagacgagcaagccggtcccctagaagaagaactccctcgcctcgcagacgaa

SEQ ID NO: 104725 - DNA, 75 bp, Artificial Sequence
  Synthetic
cgattccggaaactacggttgttagaggagcaagccggtcccctagaagaagaactccctcgcctcgcagacgaa

SEQ ID NO: 104726 - DNA, 75 bp, Artificial Sequence
  Synthetic
cgattccggaaaccacggttgttagaagagcaagccggtcccctagaagaagaactccctcgcctcgcagacgaa

SEQ ID NO: 104727 - DNA, 75 bp, Artificial Sequence
  Synthetic
cgattccggaaaccacggttgttagatgagcaagccggtcccctagaagaagaactccctcgcctcgcagacgaa

SEQ ID NO: 104728 - DNA, 75 bp, Artificial Sequence
  Synthetic
cgattccggaaaccacggttgttagacgagcaagccggtcccctagaagaagaactccctcgcctcgcagacgaa

SEQ ID NO: 104729 - DNA, 75 bp, Artificial Sequence
  Synthetic
cgattccggaaaccacggttgttagaggagcaagccggtcccctagaagaagaactccctcgcctcgcagacgaa

SEQ ID NO: 104730 - DNA, 75 bp, Artificial Sequence
  Synthetic
cgattccggaaacgacggttgttagaagagcaagccggtcccctagaagaagaactccctcgcctcgcagacgaa

SEQ ID NO: 104731 - DNA, 75 bp, Artificial Sequence
  Synthetic
cgattccggaaacgacggttgttagatgagcaagccggtcccctagaagaagaactccctcgcctcgcagacgaa

SEQ ID NO: 104732 - DNA, 75 bp, Artificial Sequence
  Synthetic
cgattccggaaacgacggttgttagacgagcaagccggtcccctagaagaagaactccctcgcctcgcagacgaa

SEQ ID NO: 104733 - DNA, 75 bp, Artificial Sequence
  Synthetic
cgattccggaaacgacggttgttagaggagcaagccggtcccctagaagaagaactccctcgcctcgcagacgaa

SEQ ID NO: 104734 - DNA, 75 bp, Artificial Sequence
  Synthetic
ttcatttacatgaggacattgttaataggtgtcaacaatttgtgggtcctctcacagtaaatgaaaaaagaagat

SEQ ID NO: 104735 - DNA, 75 bp, Artificial Sequence
  Synthetic
ccatacggcactcaggcaagctattgtgtgttggggtgagttgatgaatctagccacctgggtgggaagtaattt

SEQ ID NO: 104736 - DNA, 75 bp, Artificial Sequence
  Synthetic
ttaatgcctttatataaatgcatacagaatcgtcaggcttttactttctcgccaacttacaaggcctttctgcgt

SEQ ID NO: 104737 - DNA, 75 bp, Artificial Sequence
  Synthetic
ctcaactcacttccaccaagctctgttggatcccagggtaggggaaccctgctccgactattgcctctctcacat

SEQ ID NO: 104738 - DNA, 75 bp, Artificial Sequence
  Synthetic
gaaactttactgggctctattcttctactgcacctgtctttaatccgaactggcaaactccttcttttcctaaca

SEQ ID NO: 104739 - DNA, 75 bp, Artificial Sequence
  Synthetic
tctggcttcctgggtgggtaataatttggaagacccagcatctagggaactagtagttaactatgtcaataataa

SEQ ID NO: 104740 - DNA, 75 bp, Artificial Sequence
  Synthetic
taaaattaattatgcccgctagattctatcctaactctaccaaatatctgcccctagataagggtattaaaccct

SEQ ID NO: 104741 - DNA, 75 bp, Artificial Sequence
  Synthetic
tgctatgcctcatcttcttgttggttcttctggactatcaaggtatgttgcccgtttgtcctctacttccaggat

SEQ ID NO: 104742 - DNA, 75 bp, Artificial Sequence
  Synthetic
tctagccacctgggtgggtggtaatttggaagatccaacatctagggacctagtagtcagttatgttaacactaa

SEQ ID NO: 104743 - DNA, 75 bp, Artificial Sequence
  Synthetic
ttttagaaaacttcctgttaataggcctattgattggaaagtatgtcaaaaaattgtgggtctgttgggctttgc

SEQ ID NO: 104744 - DNA, 75 bp, Artificial Sequence
  Synthetic
ttttagaaaacttcctgttaataggcctattgattggaaagtatgtcaaataattgtgggtctgttgggctttgc

SEQ ID NO: 104745 - DNA, 75 bp, Artificial Sequence
  Synthetic
ttttagaaaacttcctgttaataggcctattgattggaaagtatgtcaaacaattgtgggtctgttgggctttgc

SEQ ID NO: 104746 - DNA, 75 bp, Artificial Sequence
  Synthetic
ttttagaaaacttcctgttaataggcctattgattggaaagtatgtcaaagaattgtgggtctgttgggctttgc

SEQ ID NO: 104747 - DNA, 75 bp, Artificial Sequence
  Synthetic
agaatctcctgagcattgttcacctcaccatactgcactcaggcaagcaattctttgctggggggacctaatgac

SEQ ID NO: 104748 - DNA, 75 bp, Artificial Sequence
  Synthetic
ggtaccttaccacaggaacatattgtacttaaaatcaagcagtgttttcgaaaacttcctgtaaatagacctatt

SEQ ID NO: 104749 - DNA, 75 bp, Artificial Sequence
  Synthetic
tcaaacaatccagattgggacttcaaccccaacaaagacaactggccagcagccaccaaggtaggagtgggagca

SEQ ID NO: 104750 - DNA, 75 bp, Artificial Sequence
  Synthetic
ggcctccccgtctgttccttctcatctgccggaccgtgtgcacttcgcttcacctctgcacgtcgcatggagacc

SEQ ID NO: 104751 - DNA, 75 bp, Artificial Sequence
  Synthetic
ttgatgcctttatatgcatgtatacaatctaagcaagctttcactttctcgccaacttacaaggcctttctgtgt

SEQ ID NO: 104752 - DNA, 75 bp, Artificial Sequence
  Synthetic
tctggctacctgggtgggaagtaatttagaagacccagcatccagggaattaagtaggtcagttatgtcaatgtt

SEQ ID NO: 104753 - DNA, 75 bp, Artificial Sequence
  Synthetic
ctccacggtattccaccaaactctgcaagatcccagagtaaggggcctgtattttcctgctggtggctccagttc

SEQ ID NO: 104754 - DNA, 75 bp, Artificial Sequence
  Synthetic
ctctgttaaatcctagggtaagggctctgtaattacctgctggtggctccagttcagagacacagaaccctgctc

SEQ ID NO: 104755 - DNA, 75 bp, Artificial Sequence
  Synthetic
ctctgttaaatcctagggtaagggctctgtaattacctgctggtggctccagttcagtgacacagaaccctgctc

SEQ ID NO: 104756 - DNA, 75 bp, Artificial Sequence
  Synthetic
ctctgttaaatcctagggtaagggctctgtaattacctgctggtggctccagttcagcgacacagaaccctgctc

SEQ ID NO: 104757 - DNA, 75 bp, Artificial Sequence
  Synthetic
ctctgttaaatcctagggtaagggctctgtaattacctgctggtggctccagttcagggacacagaaccctgctc

SEQ ID NO: 104758 - DNA, 75 bp, Artificial Sequence
  Synthetic
ctctgttaaatcctagggtaagggctctgtaatttcctgctggtggctccagttcagagacacagaaccctgctc

SEQ ID NO: 104759 - DNA, 75 bp, Artificial Sequence
  Synthetic
ctctgttaaatcctagggtaagggctctgtaatttcctgctggtggctccagttcagtgacacagaaccctgctc

SEQ ID NO: 104760 - DNA, 75 bp, Artificial Sequence
  Synthetic
ctctgttaaatcctagggtaagggctctgtaatttcctgctggtggctccagttcagcgacacagaaccctgctc

SEQ ID NO: 104761 - DNA, 75 bp, Artificial Sequence
  Synthetic
ctctgttaaatcctagggtaagggctctgtaatttcctgctggtggctccagttcagggacacagaaccctgctc

SEQ ID NO: 104762 - DNA, 75 bp, Artificial Sequence
  Synthetic
ctctgttaaatcctagggtaagggctctgtaattccctgctggtggctccagttcagagacacagaaccctgctc

SEQ ID NO: 104763 - DNA, 75 bp, Artificial Sequence
  Synthetic
ctctgttaaatcctagggtaagggctctgtaattccctgctggtggctccagttcagtgacacagaaccctgctc

SEQ ID NO: 104764 - DNA, 75 bp, Artificial Sequence
  Synthetic
ctctgttaaatcctagggtaagggctctgtaattccctgctggtggctccagttcagcgacacagaaccctgctc

SEQ ID NO: 104765 - DNA, 75 bp, Artificial Sequence
  Synthetic
ctctgttaaatcctagggtaagggctctgtaattccctgctggtggctccagttcagggacacagaaccctgctc

SEQ ID NO: 104766 - DNA, 75 bp, Artificial Sequence
  Synthetic
ctctgttaaatcctagggtaagggctctgtaattgcctgctggtggctccagttcagagacacagaaccctgctc

SEQ ID NO: 104767 - DNA, 75 bp, Artificial Sequence
  Synthetic
ctctgttaaatcctagggtaagggctctgtaattgcctgctggtggctccagttcagtgacacagaaccctgctc

SEQ ID NO: 104768 - DNA, 75 bp, Artificial Sequence
  Synthetic
ctctgttaaatcctagggtaagggctctgtaattgcctgctggtggctccagttcagcgacacagaaccctgctc

SEQ ID NO: 104769 - DNA, 75 bp, Artificial Sequence
  Synthetic
ctctgttaaatcctagggtaagggctctgtaattgcctgctggtggctccagttcagggacacagaaccctgctc

SEQ ID NO: 104770 - DNA, 75 bp, Artificial Sequence
  Synthetic
ctctgttaaatcctagggtaagggctctgtatttacctgctggtggctccagttcagagacacagaaccctgctc

SEQ ID NO: 104771 - DNA, 75 bp, Artificial Sequence
  Synthetic
ctctgttaaatcctagggtaagggctctgtatttacctgctggtggctccagttcagtgacacagaaccctgctc

SEQ ID NO: 104772 - DNA, 75 bp, Artificial Sequence
  Synthetic
ctctgttaaatcctagggtaagggctctgtatttacctgctggtggctccagttcagcgacacagaaccctgctc

SEQ ID NO: 104773 - DNA, 75 bp, Artificial Sequence
  Synthetic
ctctgttaaatcctagggtaagggctctgtatttacctgctggtggctccagttcagggacacagaaccctgctc

SEQ ID NO: 104774 - DNA, 75 bp, Artificial Sequence
  Synthetic
ctctgttaaatcctagggtaagggctctgtattttcctgctggtggctccagttcagagacacagaaccctgctc

SEQ ID NO: 104775 - DNA, 75 bp, Artificial Sequence
  Synthetic
ctctgttaaatcctagggtaagggctctgtattttcctgctggtggctccagttcagtgacacagaaccctgctc

SEQ ID NO: 104776 - DNA, 75 bp, Artificial Sequence
  Synthetic
ctctgttaaatcctagggtaagggctctgtattttcctgctggtggctccagttcagcgacacagaaccctgctc

SEQ ID NO: 104777 - DNA, 75 bp, Artificial Sequence
  Synthetic
ctctgttaaatcctagggtaagggctctgtattttcctgctggtggctccagttcagggacacagaaccctgctc

SEQ ID NO: 104778 - DNA, 75 bp, Artificial Sequence
  Synthetic
ctctgttaaatcctagggtaagggctctgtatttccctgctggtggctccagttcagagacacagaaccctgctc

SEQ ID NO: 104779 - DNA, 75 bp, Artificial Sequence
  Synthetic
ctctgttaaatcctagggtaagggctctgtatttccctgctggtggctccagttcagtgacacagaaccctgctc

SEQ ID NO: 104780 - DNA, 75 bp, Artificial Sequence
  Synthetic
ctctgttaaatcctagggtaagggctctgtatttccctgctggtggctccagttcagcgacacagaaccctgctc

SEQ ID NO: 104781 - DNA, 75 bp, Artificial Sequence
  Synthetic
ctctgttaaatcctagggtaagggctctgtatttccctgctggtggctccagttcagggacacagaaccctgctc

SEQ ID NO: 104782 - DNA, 75 bp, Artificial Sequence
  Synthetic
ctctgttaaatcctagggtaagggctctgtatttgcctgctggtggctccagttcagagacacagaaccctgctc

SEQ ID NO: 104783 - DNA, 75 bp, Artificial Sequence
  Synthetic
ctctgttaaatcctagggtaagggctctgtatttgcctgctggtggctccagttcagtgacacagaaccctgctc

SEQ ID NO: 104784 - DNA, 75 bp, Artificial Sequence
  Synthetic
ctctgttaaatcctagggtaagggctctgtatttgcctgctggtggctccagttcagcgacacagaaccctgctc

SEQ ID NO: 104785 - DNA, 75 bp, Artificial Sequence
  Synthetic
ctctgttaaatcctagggtaagggctctgtatttgcctgctggtggctccagttcagggacacagaaccctgctc

SEQ ID NO: 104786 - DNA, 75 bp, Artificial Sequence
  Synthetic
ctctgttaaatcctagggtaagggctctgtacttacctgctggtggctccagttcagagacacagaaccctgctc

SEQ ID NO: 104787 - DNA, 75 bp, Artificial Sequence
  Synthetic
ctctgttaaatcctagggtaagggctctgtacttacctgctggtggctccagttcagtgacacagaaccctgctc

SEQ ID NO: 104788 - DNA, 75 bp, Artificial Sequence
  Synthetic
ctctgttaaatcctagggtaagggctctgtacttacctgctggtggctccagttcagcgacacagaaccctgctc

SEQ ID NO: 104789 - DNA, 75 bp, Artificial Sequence
  Synthetic
ctctgttaaatcctagggtaagggctctgtacttacctgctggtggctccagttcagggacacagaaccctgctc

SEQ ID NO: 104790 - DNA, 75 bp, Artificial Sequence
  Synthetic
ctctgttaaatcctagggtaagggctctgtactttcctgctggtggctccagttcagagacacagaaccctgctc

SEQ ID NO: 104791 - DNA, 75 bp, Artificial Sequence
  Synthetic
ctctgttaaatcctagggtaagggctctgtactttcctgctggtggctccagttcagtgacacagaaccctgctc

SEQ ID NO: 104792 - DNA, 75 bp, Artificial Sequence
  Synthetic
ctctgttaaatcctagggtaagggctctgtactttcctgctggtggctccagttcagcgacacagaaccctgctc

SEQ ID NO: 104793 - DNA, 75 bp, Artificial Sequence
  Synthetic
ctctgttaaatcctagggtaagggctctgtactttcctgctggtggctccagttcagggacacagaaccctgctc

SEQ ID NO: 104794 - DNA, 75 bp, Artificial Sequence
  Synthetic
ctctgttaaatcctagggtaagggctctgtacttccctgctggtggctccagttcagagacacagaaccctgctc

SEQ ID NO: 104795 - DNA, 75 bp, Artificial Sequence
  Synthetic
ctctgttaaatcctagggtaagggctctgtacttccctgctggtggctccagttcagtgacacagaaccctgctc

SEQ ID NO: 104796 - DNA, 75 bp, Artificial Sequence
  Synthetic
ctctgttaaatcctagggtaagggctctgtacttccctgctggtggctccagttcagcgacacagaaccctgctc

SEQ ID NO: 104797 - DNA, 75 bp, Artificial Sequence
  Synthetic
ctctgttaaatcctagggtaagggctctgtacttccctgctggtggctccagttcagggacacagaaccctgctc

SEQ ID NO: 104798 - DNA, 75 bp, Artificial Sequence
  Synthetic
ctctgttaaatcctagggtaagggctctgtacttgcctgctggtggctccagttcagagacacagaaccctgctc

SEQ ID NO: 104799 - DNA, 75 bp, Artificial Sequence
  Synthetic
ctctgttaaatcctagggtaagggctctgtacttgcctgctggtggctccagttcagtgacacagaaccctgctc

SEQ ID NO: 104800 - DNA, 75 bp, Artificial Sequence
  Synthetic
ctctgttaaatcctagggtaagggctctgtacttgcctgctggtggctccagttcagcgacacagaaccctgctc

SEQ ID NO: 104801 - DNA, 75 bp, Artificial Sequence
  Synthetic
ctctgttaaatcctagggtaagggctctgtacttgcctgctggtggctccagttcagggacacagaaccctgctc

SEQ ID NO: 104802 - DNA, 75 bp, Artificial Sequence
  Synthetic
ctctgttaaatcctagggtaagggctctgtagttacctgctggtggctccagttcagagacacagaaccctgctc

SEQ ID NO: 104803 - DNA, 75 bp, Artificial Sequence
  Synthetic
ctctgttaaatcctagggtaagggctctgtagttacctgctggtggctccagttcagtgacacagaaccctgctc

SEQ ID NO: 104804 - DNA, 75 bp, Artificial Sequence
  Synthetic
ctctgttaaatcctagggtaagggctctgtagttacctgctggtggctccagttcagcgacacagaaccctgctc

SEQ ID NO: 104805 - DNA, 75 bp, Artificial Sequence
  Synthetic
ctctgttaaatcctagggtaagggctctgtagttacctgctggtggctccagttcagggacacagaaccctgctc

SEQ ID NO: 104806 - DNA, 75 bp, Artificial Sequence
  Synthetic
ctctgttaaatcctagggtaagggctctgtagtttcctgctggtggctccagttcagagacacagaaccctgctc

SEQ ID NO: 104807 - DNA, 75 bp, Artificial Sequence
  Synthetic
ctctgttaaatcctagggtaagggctctgtagtttcctgctggtggctccagttcagtgacacagaaccctgctc

SEQ ID NO: 104808 - DNA, 75 bp, Artificial Sequence
  Synthetic
ctctgttaaatcctagggtaagggctctgtagtttcctgctggtggctccagttcagcgacacagaaccctgctc

SEQ ID NO: 104809 - DNA, 75 bp, Artificial Sequence
  Synthetic
ctctgttaaatcctagggtaagggctctgtagtttcctgctggtggctccagttcagggacacagaaccctgctc

SEQ ID NO: 104810 - DNA, 75 bp, Artificial Sequence
  Synthetic
ctctgttaaatcctagggtaagggctctgtagttccctgctggtggctccagttcagagacacagaaccctgctc

SEQ ID NO: 104811 - DNA, 75 bp, Artificial Sequence
  Synthetic
ctctgttaaatcctagggtaagggctctgtagttccctgctggtggctccagttcagtgacacagaaccctgctc

SEQ ID NO: 104812 - DNA, 75 bp, Artificial Sequence
  Synthetic
ctctgttaaatcctagggtaagggctctgtagttccctgctggtggctccagttcagcgacacagaaccctgctc

SEQ ID NO: 104813 - DNA, 75 bp, Artificial Sequence
  Synthetic
ctctgttaaatcctagggtaagggctctgtagttccctgctggtggctccagttcagggacacagaaccctgctc

SEQ ID NO: 104814 - DNA, 75 bp, Artificial Sequence
  Synthetic
ctctgttaaatcctagggtaagggctctgtagttgcctgctggtggctccagttcagagacacagaaccctgctc

SEQ ID NO: 104815 - DNA, 75 bp, Artificial Sequence
  Synthetic
ctctgttaaatcctagggtaagggctctgtagttgcctgctggtggctccagttcagtgacacagaaccctgctc

SEQ ID NO: 104816 - DNA, 75 bp, Artificial Sequence
  Synthetic
ctctgttaaatcctagggtaagggctctgtagttgcctgctggtggctccagttcagcgacacagaaccctgctc

SEQ ID NO: 104817 - DNA, 75 bp, Artificial Sequence
  Synthetic
ctctgttaaatcctagggtaagggctctgtagttgcctgctggtggctccagttcagggacacagaaccctgctc

SEQ ID NO: 104818 - DNA, 75 bp, Artificial Sequence
  Synthetic
agagtctcctgagcattgttcacctcatcatactgcactcaggcaagctatcctttgctggggggagctaatgac

SEQ ID NO: 104819 - DNA, 75 bp, Artificial Sequence
  Synthetic
tcttgcccaaggtcttacataagaggactcttggactctcagcaatgtcaacgaccgaccttgaggcatacttca

SEQ ID NO: 104820 - DNA, 75 bp, Artificial Sequence
  Synthetic
aggaacagtaaaccctgttcagaacactgcctcttccatatcgtcaatcttatcgacgactggggaccctgtgcc

SEQ ID NO: 104821 - DNA, 75 bp, Artificial Sequence
  Synthetic
ttcttgttgacaaaaatcctcacaataccacagagtctagactcgtggtggacttctctcaattttctaggggga

SEQ ID NO: 104822 - DNA, 75 bp, Artificial Sequence
  Synthetic
catgggtctaaaaatcaggcaactgttgtggtttcatatctcttgtcttacttttggaagagaaactgttcttga

SEQ ID NO: 104823 - DNA, 75 bp, Artificial Sequence
  Synthetic
tacatttacaccaagacatcatcgacaaatgtgaacaatttgtaggcccgctaacagtcaatgaaaaaagaaggc

SEQ ID NO: 104824 - DNA, 75 bp, Artificial Sequence
  Synthetic
aggaacactcaaccctgttccaaatattgcctctcacatctcgtcaatctcctcgaggattggggaccctgcgcc

SEQ ID NO: 104825 - DNA, 75 bp, Artificial Sequence
  Synthetic
acgtagcgcctcattttgcgggtcaccatattcttgggaacaagatctacagcatgggaggttggtcttccaaac

SEQ ID NO: 104826 - DNA, 75 bp, Artificial Sequence
  Synthetic
cggagccaattcaaacaatccagattgggacttcaaccccaacaaggatcaatggccagcggcaaaccaggtagg

SEQ ID NO: 104827 - DNA, 75 bp, Artificial Sequence
  Synthetic
cctttaccccgttgctcggcaacggtcaggtctttgccaagtgtttgctgacgcaacccccactggttggggctt

SEQ ID NO: 104828 - DNA, 75 bp, Artificial Sequence
  Synthetic
gctttattcttctactacacctgtctttaaccctaactggcaaactccttctttcccggacattcatttgcgtca

SEQ ID NO: 104829 - DNA, 75 bp, Artificial Sequence
  Synthetic
ctccacaaccttccaccaaactctgcaagatcccagagtgagaggcctgtatcctgctggtggctccagttcagg

SEQ ID NO: 104830 - DNA, 75 bp, Artificial Sequence
  Synthetic
gcctgctaggttttatcctaactctaccaaatatttgcccctagataaaggtattaaaccttattatccagagca

SEQ ID NO: 104831 - DNA, 75 bp, Artificial Sequence
  Synthetic
aatcggcagtcaggaaggcagcctactcccatctctccacctctaagagacagtcatcctcaggccatgcagtgg

SEQ ID NO: 104832 - DNA, 75 bp, Artificial Sequence
  Synthetic
ggaacattaccacaagatcatattatacataagatcaaagaatgttttcgaaaacttcctgtaaaccgtccaatt

SEQ ID NO: 104833 - DNA, 75 bp, Artificial Sequence
  Synthetic
ttgccagcaaatccgcctcctgcttctaccaatcgccagtcaggacgacagcctaccccgctgtctccacctctg

SEQ ID NO: 104834 - DNA, 75 bp, Artificial Sequence
  Synthetic
ttccacaaccttccaccaagctcttcaagatcccagagtcaggggtcctgctggtggctccagttcaggaacagt

SEQ ID NO: 104835 - DNA, 75 bp, Artificial Sequence
  Synthetic
tatataaaagagagacaacacgtagcgcctcattttgcgggtcaccatattcttgggaacaagagctacagcatg

SEQ ID NO: 104836 - DNA, 75 bp, Artificial Sequence
  Synthetic
ttcaggaacagtaaaccctgttccgactactgcctctcccatatcgtcaatcttctcgaggattggggaccctgc

SEQ ID NO: 104837 - DNA, 75 bp, Artificial Sequence
  Synthetic
agagtcaccggaacattgcaccccccatcataccgctctaagacaaattattttgtgttggggtgagttaacgaa

SEQ ID NO: 104838 - DNA, 75 bp, Artificial Sequence
  Synthetic
agagtcaccggaacattgcaccccccatcataccgctctaagacaatttattttgtgttggggtgagttaacgaa

SEQ ID NO: 104839 - DNA, 75 bp, Artificial Sequence
  Synthetic
agagtcaccggaacattgcaccccccatcataccgctctaagacaacttattttgtgttggggtgagttaacgaa

SEQ ID NO: 104840 - DNA, 75 bp, Artificial Sequence
  Synthetic
agagtcaccggaacattgcaccccccatcataccgctctaagacaagttattttgtgttggggtgagttaacgaa

SEQ ID NO: 104841 - DNA, 75 bp, Artificial Sequence
  Synthetic
agagtcaccggaacattgcaccccccatcataccgctctaagtcaaattattttgtgttggggtgagttaacgaa

SEQ ID NO: 104842 - DNA, 75 bp, Artificial Sequence
  Synthetic
agagtcaccggaacattgcaccccccatcataccgctctaagtcaatttattttgtgttggggtgagttaacgaa

SEQ ID NO: 104843 - DNA, 75 bp, Artificial Sequence
  Synthetic
agagtcaccggaacattgcaccccccatcataccgctctaagtcaacttattttgtgttggggtgagttaacgaa

SEQ ID NO: 104844 - DNA, 75 bp, Artificial Sequence
  Synthetic
agagtcaccggaacattgcaccccccatcataccgctctaagtcaagttattttgtgttggggtgagttaacgaa

SEQ ID NO: 104845 - DNA, 75 bp, Artificial Sequence
  Synthetic
agagtcaccggaacattgcaccccccatcataccgctctaagccaaattattttgtgttggggtgagttaacgaa

SEQ ID NO: 104846 - DNA, 75 bp, Artificial Sequence
  Synthetic
agagtcaccggaacattgcaccccccatcataccgctctaagccaatttattttgtgttggggtgagttaacgaa

SEQ ID NO: 104847 - DNA, 75 bp, Artificial Sequence
  Synthetic
agagtcaccggaacattgcaccccccatcataccgctctaagccaacttattttgtgttggggtgagttaacgaa

SEQ ID NO: 104848 - DNA, 75 bp, Artificial Sequence
  Synthetic
agagtcaccggaacattgcaccccccatcataccgctctaagccaagttattttgtgttggggtgagttaacgaa

SEQ ID NO: 104849 - DNA, 75 bp, Artificial Sequence
  Synthetic
agagtcaccggaacattgcaccccccatcataccgctctaaggcaaattattttgtgttggggtgagttaacgaa

SEQ ID NO: 104850 - DNA, 75 bp, Artificial Sequence
  Synthetic
agagtcaccggaacattgcaccccccatcataccgctctaaggcaatttattttgtgttggggtgagttaacgaa

SEQ ID NO: 104851 - DNA, 75 bp, Artificial Sequence
  Synthetic
agagtcaccggaacattgcaccccccatcataccgctctaaggcaacttattttgtgttggggtgagttaacgaa

SEQ ID NO: 104852 - DNA, 75 bp, Artificial Sequence
  Synthetic
agagtcaccggaacattgcaccccccatcataccgctctaaggcaagttattttgtgttggggtgagttaacgaa

SEQ ID NO: 104853 - DNA, 75 bp, Artificial Sequence
  Synthetic
agagtcaccggaacattgcaccccccatcataccgctcttagacaaattattttgtgttggggtgagttaacgaa

SEQ ID NO: 104854 - DNA, 75 bp, Artificial Sequence
  Synthetic
agagtcaccggaacattgcaccccccatcataccgctcttagacaatttattttgtgttggggtgagttaacgaa

SEQ ID NO: 104855 - DNA, 75 bp, Artificial Sequence
  Synthetic
agagtcaccggaacattgcaccccccatcataccgctcttagacaacttattttgtgttggggtgagttaacgaa

SEQ ID NO: 104856 - DNA, 75 bp, Artificial Sequence
  Synthetic
agagtcaccggaacattgcaccccccatcataccgctcttagacaagttattttgtgttggggtgagttaacgaa

SEQ ID NO: 104857 - DNA, 75 bp, Artificial Sequence
  Synthetic
agagtcaccggaacattgcaccccccatcataccgctcttagtcaaattattttgtgttggggtgagttaacgaa

SEQ ID NO: 104858 - DNA, 75 bp, Artificial Sequence
  Synthetic
agagtcaccggaacattgcaccccccatcataccgctcttagtcaatttattttgtgttggggtgagttaacgaa

SEQ ID NO: 104859 - DNA, 75 bp, Artificial Sequence
  Synthetic
agagtcaccggaacattgcaccccccatcataccgctcttagtcaacttattttgtgttggggtgagttaacgaa

SEQ ID NO: 104860 - DNA, 75 bp, Artificial Sequence
  Synthetic
agagtcaccggaacattgcaccccccatcataccgctcttagtcaagttattttgtgttggggtgagttaacgaa

SEQ ID NO: 104861 - DNA, 75 bp, Artificial Sequence
  Synthetic
agagtcaccggaacattgcaccccccatcataccgctcttagccaaattattttgtgttggggtgagttaacgaa

SEQ ID NO: 104862 - DNA, 75 bp, Artificial Sequence
  Synthetic
agagtcaccggaacattgcaccccccatcataccgctcttagccaatttattttgtgttggggtgagttaacgaa

SEQ ID NO: 104863 - DNA, 75 bp, Artificial Sequence
  Synthetic
agagtcaccggaacattgcaccccccatcataccgctcttagccaacttattttgtgttggggtgagttaacgaa

SEQ ID NO: 104864 - DNA, 75 bp, Artificial Sequence
  Synthetic
agagtcaccggaacattgcaccccccatcataccgctcttagccaagttattttgtgttggggtgagttaacgaa

SEQ ID NO: 104865 - DNA, 75 bp, Artificial Sequence
  Synthetic
agagtcaccggaacattgcaccccccatcataccgctcttaggcaaattattttgtgttggggtgagttaacgaa

SEQ ID NO: 104866 - DNA, 75 bp, Artificial Sequence
  Synthetic
agagtcaccggaacattgcaccccccatcataccgctcttaggcaatttattttgtgttggggtgagttaacgaa

SEQ ID NO: 104867 - DNA, 75 bp, Artificial Sequence
  Synthetic
agagtcaccggaacattgcaccccccatcataccgctcttaggcaacttattttgtgttggggtgagttaacgaa

SEQ ID NO: 104868 - DNA, 75 bp, Artificial Sequence
  Synthetic
agagtcaccggaacattgcaccccccatcataccgctcttaggcaagttattttgtgttggggtgagttaacgaa

SEQ ID NO: 104869 - DNA, 75 bp, Artificial Sequence
  Synthetic
agagtcaccggaacattgcaccccccatcataccgctctcagacaaattattttgtgttggggtgagttaacgaa

SEQ ID NO: 104870 - DNA, 75 bp, Artificial Sequence
  Synthetic
agagtcaccggaacattgcaccccccatcataccgctctcagacaatttattttgtgttggggtgagttaacgaa

SEQ ID NO: 104871 - DNA, 75 bp, Artificial Sequence
  Synthetic
agagtcaccggaacattgcaccccccatcataccgctctcagacaacttattttgtgttggggtgagttaacgaa

SEQ ID NO: 104872 - DNA, 75 bp, Artificial Sequence
  Synthetic
agagtcaccggaacattgcaccccccatcataccgctctcagacaagttattttgtgttggggtgagttaacgaa

SEQ ID NO: 104873 - DNA, 75 bp, Artificial Sequence
  Synthetic
agagtcaccggaacattgcaccccccatcataccgctctcagtcaaattattttgtgttggggtgagttaacgaa

SEQ ID NO: 104874 - DNA, 75 bp, Artificial Sequence
  Synthetic
agagtcaccggaacattgcaccccccatcataccgctctcagtcaatttattttgtgttggggtgagttaacgaa

SEQ ID NO: 104875 - DNA, 75 bp, Artificial Sequence
  Synthetic
agagtcaccggaacattgcaccccccatcataccgctctcagtcaacttattttgtgttggggtgagttaacgaa

SEQ ID NO: 104876 - DNA, 75 bp, Artificial Sequence
  Synthetic
agagtcaccggaacattgcaccccccatcataccgctctcagtcaagttattttgtgttggggtgagttaacgaa

SEQ ID NO: 104877 - DNA, 75 bp, Artificial Sequence
  Synthetic
agagtcaccggaacattgcaccccccatcataccgctctcagccaaattattttgtgttggggtgagttaacgaa

SEQ ID NO: 104878 - DNA, 75 bp, Artificial Sequence
  Synthetic
agagtcaccggaacattgcaccccccatcataccgctctcagccaatttattttgtgttggggtgagttaacgaa

SEQ ID NO: 104879 - DNA, 75 bp, Artificial Sequence
  Synthetic
agagtcaccggaacattgcaccccccatcataccgctctcagccaacttattttgtgttggggtgagttaacgaa

SEQ ID NO: 104880 - DNA, 75 bp, Artificial Sequence
  Synthetic
agagtcaccggaacattgcaccccccatcataccgctctcagccaagttattttgtgttggggtgagttaacgaa

SEQ ID NO: 104881 - DNA, 75 bp, Artificial Sequence
  Synthetic
agagtcaccggaacattgcaccccccatcataccgctctcaggcaaattattttgtgttggggtgagttaacgaa

SEQ ID NO: 104882 - DNA, 75 bp, Artificial Sequence
  Synthetic
agagtcaccggaacattgcaccccccatcataccgctctcaggcaatttattttgtgttggggtgagttaacgaa

SEQ ID NO: 104883 - DNA, 75 bp, Artificial Sequence
  Synthetic
agagtcaccggaacattgcaccccccatcataccgctctcaggcaacttattttgtgttggggtgagttaacgaa

SEQ ID NO: 104884 - DNA, 75 bp, Artificial Sequence
  Synthetic
agagtcaccggaacattgcaccccccatcataccgctctcaggcaagttattttgtgttggggtgagttaacgaa

SEQ ID NO: 104885 - DNA, 75 bp, Artificial Sequence
  Synthetic
agagtcaccggaacattgcaccccccatcataccgctctgagacaaattattttgtgttggggtgagttaacgaa

SEQ ID NO: 104886 - DNA, 75 bp, Artificial Sequence
  Synthetic
agagtcaccggaacattgcaccccccatcataccgctctgagacaatttattttgtgttggggtgagttaacgaa

SEQ ID NO: 104887 - DNA, 75 bp, Artificial Sequence
  Synthetic
agagtcaccggaacattgcaccccccatcataccgctctgagacaacttattttgtgttggggtgagttaacgaa

SEQ ID NO: 104888 - DNA, 75 bp, Artificial Sequence
  Synthetic
agagtcaccggaacattgcaccccccatcataccgctctgagacaagttattttgtgttggggtgagttaacgaa

SEQ ID NO: 104889 - DNA, 75 bp, Artificial Sequence
  Synthetic
agagtcaccggaacattgcaccccccatcataccgctctgagtcaaattattttgtgttggggtgagttaacgaa

SEQ ID NO: 104890 - DNA, 75 bp, Artificial Sequence
  Synthetic
agagtcaccggaacattgcaccccccatcataccgctctgagtcaatttattttgtgttggggtgagttaacgaa

SEQ ID NO: 104891 - DNA, 75 bp, Artificial Sequence
  Synthetic
agagtcaccggaacattgcaccccccatcataccgctctgagtcaacttattttgtgttggggtgagttaacgaa

SEQ ID NO: 104892 - DNA, 75 bp, Artificial Sequence
  Synthetic
agagtcaccggaacattgcaccccccatcataccgctctgagtcaagttattttgtgttggggtgagttaacgaa

SEQ ID NO: 104893 - DNA, 75 bp, Artificial Sequence
  Synthetic
agagtcaccggaacattgcaccccccatcataccgctctgagccaaattattttgtgttggggtgagttaacgaa

SEQ ID NO: 104894 - DNA, 75 bp, Artificial Sequence
  Synthetic
agagtcaccggaacattgcaccccccatcataccgctctgagccaatttattttgtgttggggtgagttaacgaa

SEQ ID NO: 104895 - DNA, 75 bp, Artificial Sequence
  Synthetic
agagtcaccggaacattgcaccccccatcataccgctctgagccaacttattttgtgttggggtgagttaacgaa

SEQ ID NO: 104896 - DNA, 75 bp, Artificial Sequence
  Synthetic
agagtcaccggaacattgcaccccccatcataccgctctgagccaagttattttgtgttggggtgagttaacgaa

SEQ ID NO: 104897 - DNA, 75 bp, Artificial Sequence
  Synthetic
agagtcaccggaacattgcaccccccatcataccgctctgaggcaaattattttgtgttggggtgagttaacgaa

SEQ ID NO: 104898 - DNA, 75 bp, Artificial Sequence
  Synthetic
agagtcaccggaacattgcaccccccatcataccgctctgaggcaatttattttgtgttggggtgagttaacgaa

SEQ ID NO: 104899 - DNA, 75 bp, Artificial Sequence
  Synthetic
agagtcaccggaacattgcaccccccatcataccgctctgaggcaacttattttgtgttggggtgagttaacgaa

SEQ ID NO: 104900 - DNA, 75 bp, Artificial Sequence
  Synthetic
agagtcaccggaacattgcaccccccatcataccgctctgaggcaagttattttgtgttggggtgagttaacgaa

SEQ ID NO: 104901 - DNA, 75 bp, Artificial Sequence
  Synthetic
tcctgtcaacaggcctattgactggaaagtgtgtcaaaggattgtgggtcttttgggttttgctgccccttttac

SEQ ID NO: 104902 - DNA, 75 bp, Artificial Sequence
  Synthetic
gaaattttacggggctctattctgctactgtacctactttcaatcctaactggttgactccgtcttttcctgata

SEQ ID NO: 104903 - DNA, 75 bp, Artificial Sequence
  Synthetic
gattggaaagtatgtcaacgcattgtgggtcttttgggctttgccgctccatttacacaatgtggttaccctgct

SEQ ID NO: 104904 - DNA, 75 bp, Artificial Sequence
  Synthetic
tacatttaaatcctaccaaaacaaaaagatggggttattccctacatttcatgggttatgtaattggaagttggg

SEQ ID NO: 104905 - DNA, 75 bp, Artificial Sequence
  Synthetic
tgaaattggttatgcctgctagattttttcctaaggttaccaaatattttcctatggaaaaaggtattaaacctt

SEQ ID NO: 104906 - DNA, 75 bp, Artificial Sequence
  Synthetic
tatacatcgtttccatggctgctaggctgtgctgccaactggatcctgcgcgggacgtcctttgtttacgtcccg

SEQ ID NO: 104907 - DNA, 75 bp, Artificial Sequence
  Synthetic
atcgggaggccttagagtctccggaacattgttcacctcaccatacggcactcaggcaagctattttgtgttggg

SEQ ID NO: 104908 - DNA, 75 bp, Artificial Sequence
  Synthetic
ctccaccactttccaccaaactcttcaagatcccagagtcagggccctgtacttccctgctggtggctccagttc

SEQ ID NO: 104909 - DNA, 75 bp, Artificial Sequence
  Synthetic
attggaaagtatgtcagagaattgtgggtcttttaggctttgctgctccttttacgcaatgtggttaccctgcat

SEQ ID NO: 104910 - DNA, 75 bp, Artificial Sequence
  Synthetic
aactattgtggtttcacatctcctgtcttacttttggaagagaaactgttcttgagtatttggtgtcttttggag

SEQ ID NO: 104911 - DNA, 75 bp, Artificial Sequence
  Synthetic
atttttgccttctgacttctttccttccgtccgggatctacttgatacagcctcagctctgtatcgggaagcctt

SEQ ID NO: 104912 - DNA, 75 bp, Artificial Sequence
  Synthetic
gagtctccagagcattgttcacctaaccatacagcactcaggcaagctattctgtgctggggtgagttgatgact

SEQ ID NO: 104913 - DNA, 75 bp, Artificial Sequence
  Synthetic
ctggcctcctgggtgggaagtaatttggaagatccagcatccagggaacaagtagttaattatgttaatactaat

SEQ ID NO: 104914 - DNA, 75 bp, Artificial Sequence
  Synthetic
ggtggctccagttcaggaacagtgaaccctgttcagagcactgcctcttccatatcgtcaatcttatcgaagact

SEQ ID NO: 104915 - DNA, 75 bp, Artificial Sequence
  Synthetic
tcatttgcaccaggatattattaacaaatgtgagcaatttgtgggccctcttacggttaatgaaagacgaagatt

SEQ ID NO: 104916 - DNA, 75 bp, Artificial Sequence
  Synthetic
ggcaccttaccccaggaacatattgtgttgaaaatcaaacaatgttttaggaaacttcctgtaaacaggcctatt

SEQ ID NO: 104917 - DNA, 75 bp, Artificial Sequence
  Synthetic
gattggaaggtgtgtcaacgaattgtgggtcttttgggatttgctgctcctttcacacaatgtggttatcctgct

SEQ ID NO: 104918 - DNA, 75 bp, Artificial Sequence
  Synthetic
acagtttgtaggcccgctcacagtaaatgagaaaagaaggttgaaattgattatgcctgctaggttttatcctaa

SEQ ID NO: 104919 - DNA, 75 bp, Artificial Sequence
  Synthetic
aaaattagttatgcctgctagattttttcctacatctactaagtatttgcccctagaaaaaggtatcaaacctta

SEQ ID NO: 104920 - DNA, 75 bp, Artificial Sequence
  Synthetic
ccaacaatccagattgggacttcaaccccaaaaaggacaactggccaaaagccaacgaggtaggagctggagcgt

SEQ ID NO: 104921 - DNA, 75 bp, Artificial Sequence
  Synthetic
ggcagaatctttcaaccagcaatccactaggattttttcccgagcaccagttggaccctgccttcaaagcaaaca

SEQ ID NO: 104922 - DNA, 75 bp, Artificial Sequence
  Synthetic
ggcaccttgccacaagatcatattgtacagaaaatcagaaaatgttttagaaaactccctgttaataggcccgtt

SEQ ID NO: 104923 - DNA, 75 bp, Artificial Sequence
  Synthetic
ctttataccgctgttaccaattttcttttgtctttgggtatacatttaaaccctaacaaaacaaaaagatggggt

SEQ ID NO: 104924 - DNA, 75 bp, Artificial Sequence
  Synthetic
ttaatgcctttgtatgcatgtatacaagccaaacaggctttcactttctcgccaacttacaaggcctttctatgt

SEQ ID NO: 104925 - DNA, 75 bp, Artificial Sequence
  Synthetic
aaccttattatccagaacatctagttaatcattacttccaaaccagacattatttacacactctatggaaggcgg

SEQ ID NO: 104926 - DNA, 75 bp, Artificial Sequence
  Synthetic
ttatctggtaacttttgcagcgtggatacgaactcctccagcttaccgaccaccaaatgcccctatcttatcatc

SEQ ID NO: 104927 - DNA, 75 bp, Artificial Sequence
  Synthetic
tgccaataaatccgcctcccgctttcaccaatcggcagtcgggaaggcagcctactcccccttctccacctctga

SEQ ID NO: 104928 - DNA, 75 bp, Artificial Sequence
  Synthetic
ctccacaacgttccaccaagctctgctagatccccgagtgaggggcttatattttcctgctggtggctccagttc

SEQ ID NO: 104929 - DNA, 75 bp, Artificial Sequence
  Synthetic
tacgtcccgtcggcgctgaatcccgcggacgacccgtctcggggccgtttggggctctaccgtccccttcttcat

SEQ ID NO: 104930 - DNA, 75 bp, Artificial Sequence
  Synthetic
ccgacgcctttatatgtatgtatacaaacaaagaaggctttcattttctcgccaacttacaaggcccccccgaga

SEQ ID NO: 104931 - DNA, 75 bp, Artificial Sequence
  Synthetic
cgaccgaccttgaggcctacttcaaagactgtgtgtttaaagactgggaggagttgggggaggagattaggttaa

SEQ ID NO: 104932 - DNA, 75 bp, Artificial Sequence
  Synthetic
tatgggcctaaagattagacaactattgtggtttcacatttcatgtcttacttttggaagagaaacggttcttga

SEQ ID NO: 104933 - DNA, 75 bp, Artificial Sequence
  Synthetic
tcttttttgcctcctgacttctttccgtcggtccgtgatctccttgacacagcttcagctctttaccgggaagcc

SEQ ID NO: 104934 - DNA, 75 bp, Artificial Sequence
  Synthetic
ctcaacccagttccaccaggctctgttggatccgaagggtaaggctttgtattttcctgctggtggctccagttc

SEQ ID NO: 104935 - DNA, 75 bp, Artificial Sequence
  Synthetic
acttttgcatcctgggtgggcaataatttgcaagatccagcatccagggatcaagtagttaattatgttaatact

SEQ ID NO: 104936 - DNA, 75 bp, Artificial Sequence
  Synthetic
accaacctcttgtcctccaatttgtcctggttatcgctggatgtgtctgcggcgttttatcatcttcctcttcat

SEQ ID NO: 104937 - DNA, 75 bp, Artificial Sequence
  Synthetic
catcttgagtccctttttaccgctgttaccaattttcttttgtctttgggtatacatttaaaccctaacaaaaca

SEQ ID NO: 104938 - DNA, 75 bp, Artificial Sequence
  Synthetic
ttaatgcctttatatgcatgtatacaatttaagcacgccctccactttctcgccaacttacaaggacatttatgt

SEQ ID NO: 104939 - DNA, 75 bp, Artificial Sequence
  Synthetic
ccggtccgtgtgcacttcgcttcacctctgcacgttgcatggagaccccctgaacgcccatcaaatactgcccaa

SEQ ID NO: 104940 - DNA, 75 bp, Artificial Sequence
  Synthetic
ccggtccgtgtgcacttcgcttcacctctgcacgttgcatggagaccccctgaacgcccatcaaattctgcccaa

SEQ ID NO: 104941 - DNA, 75 bp, Artificial Sequence
  Synthetic
ccggtccgtgtgcacttcgcttcacctctgcacgttgcatggagaccccctgaacgcccatcaaatcctgcccaa

SEQ ID NO: 104942 - DNA, 75 bp, Artificial Sequence
  Synthetic
ccggtccgtgtgcacttcgcttcacctctgcacgttgcatggagaccccctgaacgcccatcaaatgctgcccaa

SEQ ID NO: 104943 - DNA, 75 bp, Artificial Sequence
  Synthetic
gtgggtcttttgggttttgctgcccctttcacacaatgtggttatcctgctttaatgcccttgtatgcatgtatt

SEQ ID NO: 104944 - DNA, 75 bp, Artificial Sequence
  Synthetic
gttactctcgtttttgccttctgacttctttccttcagtacgagatcttctagataccgcctcagctctgtatcg

SEQ ID NO: 104945 - DNA, 75 bp, Artificial Sequence
  Synthetic
tatataagagagaatcaacacatagcgcctcattttgtgggtcaccatattcttgggaacaagagctacatcatg

SEQ ID NO: 104946 - DNA, 75 bp, Artificial Sequence
  Synthetic
atccatttaaatacctctaaaacaaaaagatggggttactccctacattttatgggttatgtcattggtagttgg

SEQ ID NO: 104947 - DNA, 75 bp, Artificial Sequence
  Synthetic
ggctttgccgctccctttacacaatgtggttacccagcattaatgcctttgtatgcatgtatacaagctaagcag

SEQ ID NO: 104948 - DNA, 75 bp, Artificial Sequence
  Synthetic
gctttcactttctcgccaacttacaaggcctttctgtgtaaacaatatctgaacctttaccccgttgctcggcaa

SEQ ID NO: 104949 - DNA, 75 bp, Artificial Sequence
  Synthetic
ggatcattaccccaagatcacattgtacacaaaatcaaggaatgctttcggaaactgcctgtaaatcgtccaatt

SEQ ID NO: 104950 - DNA, 75 bp, Artificial Sequence
  Synthetic
ggaagattaccacaagatcatattctgcaaaaaatgaaacaatgttttagaaaaatgcctgttaataggcctatt

SEQ ID NO: 104951 - DNA, 75 bp, Artificial Sequence
  Synthetic
ggaagattaccacaagatcatattctgcaaaaaatgaaacaatgttttagaaaattgcctgttaataggcctatt

SEQ ID NO: 104952 - DNA, 75 bp, Artificial Sequence
  Synthetic
ggaagattaccacaagatcatattctgcaaaaaatgaaacaatgttttagaaaactgcctgttaataggcctatt

SEQ ID NO: 104953 - DNA, 75 bp, Artificial Sequence
  Synthetic
ggaagattaccacaagatcatattctgcaaaaaatgaaacaatgttttagaaaagtgcctgttaataggcctatt

SEQ ID NO: 104954 - DNA, 75 bp, Artificial Sequence
  Synthetic
ggaagattaccacaagatcatattctgcaaaaaatgaaacattgttttagaaaaatgcctgttaataggcctatt

SEQ ID NO: 104955 - DNA, 75 bp, Artificial Sequence
  Synthetic
ggaagattaccacaagatcatattctgcaaaaaatgaaacattgttttagaaaattgcctgttaataggcctatt

SEQ ID NO: 104956 - DNA, 75 bp, Artificial Sequence
  Synthetic
ggaagattaccacaagatcatattctgcaaaaaatgaaacattgttttagaaaactgcctgttaataggcctatt

SEQ ID NO: 104957 - DNA, 75 bp, Artificial Sequence
  Synthetic
ggaagattaccacaagatcatattctgcaaaaaatgaaacattgttttagaaaagtgcctgttaataggcctatt

SEQ ID NO: 104958 - DNA, 75 bp, Artificial Sequence
  Synthetic
ggaagattaccacaagatcatattctgcaaaaaatgaaacactgttttagaaaaatgcctgttaataggcctatt

SEQ ID NO: 104959 - DNA, 75 bp, Artificial Sequence
  Synthetic
ggaagattaccacaagatcatattctgcaaaaaatgaaacactgttttagaaaattgcctgttaataggcctatt

SEQ ID NO: 104960 - DNA, 75 bp, Artificial Sequence
  Synthetic
ggaagattaccacaagatcatattctgcaaaaaatgaaacactgttttagaaaactgcctgttaataggcctatt

SEQ ID NO: 104961 - DNA, 75 bp, Artificial Sequence
  Synthetic
ggaagattaccacaagatcatattctgcaaaaaatgaaacactgttttagaaaagtgcctgttaataggcctatt

SEQ ID NO: 104962 - DNA, 75 bp, Artificial Sequence
  Synthetic
ggaagattaccacaagatcatattctgcaaaaaatgaaacagtgttttagaaaaatgcctgttaataggcctatt

SEQ ID NO: 104963 - DNA, 75 bp, Artificial Sequence
  Synthetic
ggaagattaccacaagatcatattctgcaaaaaatgaaacagtgttttagaaaattgcctgttaataggcctatt

SEQ ID NO: 104964 - DNA, 75 bp, Artificial Sequence
  Synthetic
ggaagattaccacaagatcatattctgcaaaaaatgaaacagtgttttagaaaactgcctgttaataggcctatt

SEQ ID NO: 104965 - DNA, 75 bp, Artificial Sequence
  Synthetic
ggaagattaccacaagatcatattctgcaaaaaatgaaacagtgttttagaaaagtgcctgttaataggcctatt

SEQ ID NO: 104966 - DNA, 75 bp, Artificial Sequence
  Synthetic
ggtagattaccacaagatcatattctgcaaaaaatgaaacaatgttttagaaaaatgcctgttaataggcctatt

SEQ ID NO: 104967 - DNA, 75 bp, Artificial Sequence
  Synthetic
ggtagattaccacaagatcatattctgcaaaaaatgaaacaatgttttagaaaattgcctgttaataggcctatt

SEQ ID NO: 104968 - DNA, 75 bp, Artificial Sequence
  Synthetic
ggtagattaccacaagatcatattctgcaaaaaatgaaacaatgttttagaaaactgcctgttaataggcctatt

SEQ ID NO: 104969 - DNA, 75 bp, Artificial Sequence
  Synthetic
ggtagattaccacaagatcatattctgcaaaaaatgaaacaatgttttagaaaagtgcctgttaataggcctatt

SEQ ID NO: 104970 - DNA, 75 bp, Artificial Sequence
  Synthetic
ggtagattaccacaagatcatattctgcaaaaaatgaaacattgttttagaaaaatgcctgttaataggcctatt

SEQ ID NO: 104971 - DNA, 75 bp, Artificial Sequence
  Synthetic
ggtagattaccacaagatcatattctgcaaaaaatgaaacattgttttagaaaattgcctgttaataggcctatt

SEQ ID NO: 104972 - DNA, 75 bp, Artificial Sequence
  Synthetic
ggtagattaccacaagatcatattctgcaaaaaatgaaacattgttttagaaaactgcctgttaataggcctatt

SEQ ID NO: 104973 - DNA, 75 bp, Artificial Sequence
  Synthetic
ggtagattaccacaagatcatattctgcaaaaaatgaaacattgttttagaaaagtgcctgttaataggcctatt

SEQ ID NO: 104974 - DNA, 75 bp, Artificial Sequence
  Synthetic
ggtagattaccacaagatcatattctgcaaaaaatgaaacactgttttagaaaaatgcctgttaataggcctatt

SEQ ID NO: 104975 - DNA, 75 bp, Artificial Sequence
  Synthetic
ggtagattaccacaagatcatattctgcaaaaaatgaaacactgttttagaaaattgcctgttaataggcctatt

SEQ ID NO: 104976 - DNA, 75 bp, Artificial Sequence
  Synthetic
ggtagattaccacaagatcatattctgcaaaaaatgaaacactgttttagaaaactgcctgttaataggcctatt

SEQ ID NO: 104977 - DNA, 75 bp, Artificial Sequence
  Synthetic
ggtagattaccacaagatcatattctgcaaaaaatgaaacactgttttagaaaagtgcctgttaataggcctatt

SEQ ID NO: 104978 - DNA, 75 bp, Artificial Sequence
  Synthetic
ggtagattaccacaagatcatattctgcaaaaaatgaaacagtgttttagaaaaatgcctgttaataggcctatt

SEQ ID NO: 104979 - DNA, 75 bp, Artificial Sequence
  Synthetic
ggtagattaccacaagatcatattctgcaaaaaatgaaacagtgttttagaaaattgcctgttaataggcctatt

SEQ ID NO: 104980 - DNA, 75 bp, Artificial Sequence
  Synthetic
ggtagattaccacaagatcatattctgcaaaaaatgaaacagtgttttagaaaactgcctgttaataggcctatt

SEQ ID NO: 104981 - DNA, 75 bp, Artificial Sequence
  Synthetic
ggtagattaccacaagatcatattctgcaaaaaatgaaacagtgttttagaaaagtgcctgttaataggcctatt

SEQ ID NO: 104982 - DNA, 75 bp, Artificial Sequence
  Synthetic
ggcagattaccacaagatcatattctgcaaaaaatgaaacaatgttttagaaaaatgcctgttaataggcctatt

SEQ ID NO: 104983 - DNA, 75 bp, Artificial Sequence
  Synthetic
ggcagattaccacaagatcatattctgcaaaaaatgaaacaatgttttagaaaattgcctgttaataggcctatt

SEQ ID NO: 104984 - DNA, 75 bp, Artificial Sequence
  Synthetic
ggcagattaccacaagatcatattctgcaaaaaatgaaacaatgttttagaaaactgcctgttaataggcctatt

SEQ ID NO: 104985 - DNA, 75 bp, Artificial Sequence
  Synthetic
ggcagattaccacaagatcatattctgcaaaaaatgaaacaatgttttagaaaagtgcctgttaataggcctatt

SEQ ID NO: 104986 - DNA, 75 bp, Artificial Sequence
  Synthetic
ggcagattaccacaagatcatattctgcaaaaaatgaaacattgttttagaaaaatgcctgttaataggcctatt

SEQ ID NO: 104987 - DNA, 75 bp, Artificial Sequence
  Synthetic
ggcagattaccacaagatcatattctgcaaaaaatgaaacattgttttagaaaattgcctgttaataggcctatt

SEQ ID NO: 104988 - DNA, 75 bp, Artificial Sequence
  Synthetic
ggcagattaccacaagatcatattctgcaaaaaatgaaacattgttttagaaaactgcctgttaataggcctatt

SEQ ID NO: 104989 - DNA, 75 bp, Artificial Sequence
  Synthetic
ggcagattaccacaagatcatattctgcaaaaaatgaaacattgttttagaaaagtgcctgttaataggcctatt

SEQ ID NO: 104990 - DNA, 75 bp, Artificial Sequence
  Synthetic
ggcagattaccacaagatcatattctgcaaaaaatgaaacactgttttagaaaaatgcctgttaataggcctatt

SEQ ID NO: 104991 - DNA, 75 bp, Artificial Sequence
  Synthetic
ggcagattaccacaagatcatattctgcaaaaaatgaaacactgttttagaaaattgcctgttaataggcctatt

SEQ ID NO: 104992 - DNA, 75 bp, Artificial Sequence
  Synthetic
ggcagattaccacaagatcatattctgcaaaaaatgaaacactgttttagaaaactgcctgttaataggcctatt

SEQ ID NO: 104993 - DNA, 75 bp, Artificial Sequence
  Synthetic
ggcagattaccacaagatcatattctgcaaaaaatgaaacactgttttagaaaagtgcctgttaataggcctatt

SEQ ID NO: 104994 - DNA, 75 bp, Artificial Sequence
  Synthetic
ggcagattaccacaagatcatattctgcaaaaaatgaaacagtgttttagaaaaatgcctgttaataggcctatt

SEQ ID NO: 104995 - DNA, 75 bp, Artificial Sequence
  Synthetic
ggcagattaccacaagatcatattctgcaaaaaatgaaacagtgttttagaaaattgcctgttaataggcctatt

SEQ ID NO: 104996 - DNA, 75 bp, Artificial Sequence
  Synthetic
ggcagattaccacaagatcatattctgcaaaaaatgaaacagtgttttagaaaactgcctgttaataggcctatt

SEQ ID NO: 104997 - DNA, 75 bp, Artificial Sequence
  Synthetic
ggcagattaccacaagatcatattctgcaaaaaatgaaacagtgttttagaaaagtgcctgttaataggcctatt

SEQ ID NO: 104998 - DNA, 75 bp, Artificial Sequence
  Synthetic
gggagattaccacaagatcatattctgcaaaaaatgaaacaatgttttagaaaaatgcctgttaataggcctatt

SEQ ID NO: 104999 - DNA, 75 bp, Artificial Sequence
  Synthetic
gggagattaccacaagatcatattctgcaaaaaatgaaacaatgttttagaaaattgcctgttaataggcctatt

SEQ ID NO: 105000 - DNA, 75 bp, Artificial Sequence
  Synthetic
gggagattaccacaagatcatattctgcaaaaaatgaaacaatgttttagaaaactgcctgttaataggcctatt

SEQ ID NO: 105001 - DNA, 75 bp, Artificial Sequence
  Synthetic
gggagattaccacaagatcatattctgcaaaaaatgaaacaatgttttagaaaagtgcctgttaataggcctatt

SEQ ID NO: 105002 - DNA, 75 bp, Artificial Sequence
  Synthetic
gggagattaccacaagatcatattctgcaaaaaatgaaacattgttttagaaaaatgcctgttaataggcctatt

SEQ ID NO: 105003 - DNA, 75 bp, Artificial Sequence
  Synthetic
gggagattaccacaagatcatattctgcaaaaaatgaaacattgttttagaaaattgcctgttaataggcctatt

SEQ ID NO: 105004 - DNA, 75 bp, Artificial Sequence
  Synthetic
gggagattaccacaagatcatattctgcaaaaaatgaaacattgttttagaaaactgcctgttaataggcctatt

SEQ ID NO: 105005 - DNA, 75 bp, Artificial Sequence
  Synthetic
gggagattaccacaagatcatattctgcaaaaaatgaaacattgttttagaaaagtgcctgttaataggcctatt

SEQ ID NO: 105006 - DNA, 75 bp, Artificial Sequence
  Synthetic
gggagattaccacaagatcatattctgcaaaaaatgaaacactgttttagaaaaatgcctgttaataggcctatt

SEQ ID NO: 105007 - DNA, 75 bp, Artificial Sequence
  Synthetic
gggagattaccacaagatcatattctgcaaaaaatgaaacactgttttagaaaattgcctgttaataggcctatt

SEQ ID NO: 105008 - DNA, 75 bp, Artificial Sequence
  Synthetic
gggagattaccacaagatcatattctgcaaaaaatgaaacactgttttagaaaactgcctgttaataggcctatt

SEQ ID NO: 105009 - DNA, 75 bp, Artificial Sequence
  Synthetic
gggagattaccacaagatcatattctgcaaaaaatgaaacactgttttagaaaagtgcctgttaataggcctatt

SEQ ID NO: 105010 - DNA, 75 bp, Artificial Sequence
  Synthetic
gggagattaccacaagatcatattctgcaaaaaatgaaacagtgttttagaaaaatgcctgttaataggcctatt

SEQ ID NO: 105011 - DNA, 75 bp, Artificial Sequence
  Synthetic
gggagattaccacaagatcatattctgcaaaaaatgaaacagtgttttagaaaattgcctgttaataggcctatt

SEQ ID NO: 105012 - DNA, 75 bp, Artificial Sequence
  Synthetic
gggagattaccacaagatcatattctgcaaaaaatgaaacagtgttttagaaaactgcctgttaataggcctatt

SEQ ID NO: 105013 - DNA, 75 bp, Artificial Sequence
  Synthetic
gggagattaccacaagatcatattctgcaaaaaatgaaacagtgttttagaaaagtgcctgttaataggcctatt

SEQ ID NO: 105014 - DNA, 75 bp, Artificial Sequence
  Synthetic
cagtgccagcaaatccgcctcctgcctccaccaatcggcagtcaggaaggcaacctactcccccttctccacctc

SEQ ID NO: 105015 - DNA, 75 bp, Artificial Sequence
  Synthetic
gtcagcaatttgtaggccctctcaatgtaaatgaaaagagaagattaaaattaattatgcctgctagattttatc

SEQ ID NO: 105016 - DNA, 75 bp, Artificial Sequence
  Synthetic
atacatttaaaccctaacaaaacgaaaagatggggttattcccttcacttcatggggtatgtgattggaagttgg

SEQ ID NO: 105017 - DNA, 75 bp, Artificial Sequence
  Synthetic
cgtgtgcacttcgcttcacctctgcacgtcgcatggagaccaccgtgaacgccccctggagtttgccaacagtct

SEQ ID NO: 105018 - DNA, 75 bp, Artificial Sequence
  Synthetic
ggtactttgccacaagaacatattacacagaaaattaagcaatgttttaggaaacttcccgttaacaggccaatt

SEQ ID NO: 105019 - DNA, 75 bp, Artificial Sequence
  Synthetic
ctactgtacctgtctttaaccctcattggaaaacaccctcttttcctaatatacatttacaccaagacattatca

SEQ ID NO: 105020 - DNA, 75 bp, Artificial Sequence
  Synthetic
gtttttgccttctgatttcttcccatcggttcgggacctactcgacaccgcttcagctctttaccgggatgcttt

SEQ ID NO: 105021 - DNA, 75 bp, Artificial Sequence
  Synthetic
tctgcaagatcccagagtcaggggcctgtattttcctgctggtggctccagttcaggaacagtaaaccctgctcc

SEQ ID NO: 105022 - DNA, 75 bp, Artificial Sequence
  Synthetic
aaccttattatcctgatcatgtagttaatcattacttccaaacccgacattatttacatactctttggaaggctg

SEQ ID NO: 105023 - DNA, 75 bp, Artificial Sequence
  Synthetic
aattttcttttgtctttgggtatacatttgaaccctaataaaaccaaacgatggggctactcccttaacttcatg

SEQ ID NO: 105024 - DNA, 75 bp, Artificial Sequence
  Synthetic
ttaatcctgactggttaactccttcttttcctgacattcatttacatcaagatttgatacacaaatgtgaacaat

SEQ ID NO: 105025 - DNA, 75 bp, Artificial Sequence
  Synthetic
ttcatttgcatcaagacctgatttctaaatgtgaacaatttgtaggcccacttactaaaaatgaattacgaagat

SEQ ID NO: 105026 - DNA, 75 bp, Artificial Sequence
  Synthetic
tccatttacatcaggacattattactaaatgtgaacaatttgtgggtcctcttacagtaaatgagaaacgaagat

SEQ ID NO: 105027 - DNA, 75 bp, Artificial Sequence
  Synthetic
gccttctgactttttcccgtcagttcgggaactactcgacaccgcttcagccttgtaccgggaaactttagagtc

SEQ ID NO: 105028 - DNA, 75 bp, Artificial Sequence
  Synthetic
gccttctgactttttcccgtcagttcgggaactactcgacaccgcttcagccttgtaccgggaatctttagagtc

SEQ ID NO: 105029 - DNA, 75 bp, Artificial Sequence
  Synthetic
gccttctgactttttcccgtcagttcgggaactactcgacaccgcttcagccttgtaccgggaacctttagagtc

SEQ ID NO: 105030 - DNA, 75 bp, Artificial Sequence
  Synthetic
gccttctgactttttcccgtcagttcgggaactactcgacaccgcttcagccttgtaccgggaagctttagagtc

SEQ ID NO: 105031 - DNA, 75 bp, Artificial Sequence
  Synthetic
gccttctgactttttcccgtcagttcgggatctactcgacaccgcttcagccttgtaccgggaaactttagagtc

SEQ ID NO: 105032 - DNA, 75 bp, Artificial Sequence
  Synthetic
gccttctgactttttcccgtcagttcgggatctactcgacaccgcttcagccttgtaccgggaatctttagagtc

SEQ ID NO: 105033 - DNA, 75 bp, Artificial Sequence
  Synthetic
gccttctgactttttcccgtcagttcgggatctactcgacaccgcttcagccttgtaccgggaacctttagagtc

SEQ ID NO: 105034 - DNA, 75 bp, Artificial Sequence
  Synthetic
gccttctgactttttcccgtcagttcgggatctactcgacaccgcttcagccttgtaccgggaagctttagagtc

SEQ ID NO: 105035 - DNA, 75 bp, Artificial Sequence
  Synthetic
gccttctgactttttcccgtcagttcgggacctactcgacaccgcttcagccttgtaccgggaaactttagagtc

SEQ ID NO: 105036 - DNA, 75 bp, Artificial Sequence
  Synthetic
gccttctgactttttcccgtcagttcgggacctactcgacaccgcttcagccttgtaccgggaatctttagagtc

SEQ ID NO: 105037 - DNA, 75 bp, Artificial Sequence
  Synthetic
gccttctgactttttcccgtcagttcgggacctactcgacaccgcttcagccttgtaccgggaacctttagagtc

SEQ ID NO: 105038 - DNA, 75 bp, Artificial Sequence
  Synthetic
gccttctgactttttcccgtcagttcgggacctactcgacaccgcttcagccttgtaccgggaagctttagagtc

SEQ ID NO: 105039 - DNA, 75 bp, Artificial Sequence
  Synthetic
gccttctgactttttcccgtcagttcgggagctactcgacaccgcttcagccttgtaccgggaaactttagagtc

SEQ ID NO: 105040 - DNA, 75 bp, Artificial Sequence
  Synthetic
gccttctgactttttcccgtcagttcgggagctactcgacaccgcttcagccttgtaccgggaatctttagagtc

SEQ ID NO: 105041 - DNA, 75 bp, Artificial Sequence
  Synthetic
gccttctgactttttcccgtcagttcgggagctactcgacaccgcttcagccttgtaccgggaacctttagagtc

SEQ ID NO: 105042 - DNA, 75 bp, Artificial Sequence
  Synthetic
gccttctgactttttcccgtcagttcgggagctactcgacaccgcttcagccttgtaccgggaagctttagagtc

SEQ ID NO: 105043 - DNA, 75 bp, Artificial Sequence
  Synthetic
gccttctgactttttcccgtctgttcgggaactactcgacaccgcttcagccttgtaccgggaaactttagagtc

SEQ ID NO: 105044 - DNA, 75 bp, Artificial Sequence
  Synthetic
gccttctgactttttcccgtctgttcgggaactactcgacaccgcttcagccttgtaccgggaatctttagagtc

SEQ ID NO: 105045 - DNA, 75 bp, Artificial Sequence
  Synthetic
gccttctgactttttcccgtctgttcgggaactactcgacaccgcttcagccttgtaccgggaacctttagagtc

SEQ ID NO: 105046 - DNA, 75 bp, Artificial Sequence
  Synthetic
gccttctgactttttcccgtctgttcgggaactactcgacaccgcttcagccttgtaccgggaagctttagagtc

SEQ ID NO: 105047 - DNA, 75 bp, Artificial Sequence
  Synthetic
gccttctgactttttcccgtctgttcgggatctactcgacaccgcttcagccttgtaccgggaaactttagagtc

SEQ ID NO: 105048 - DNA, 75 bp, Artificial Sequence
  Synthetic
gccttctgactttttcccgtctgttcgggatctactcgacaccgcttcagccttgtaccgggaatctttagagtc

SEQ ID NO: 105049 - DNA, 75 bp, Artificial Sequence
  Synthetic
gccttctgactttttcccgtctgttcgggatctactcgacaccgcttcagccttgtaccgggaacctttagagtc

SEQ ID NO: 105050 - DNA, 75 bp, Artificial Sequence
  Synthetic
gccttctgactttttcccgtctgttcgggatctactcgacaccgcttcagccttgtaccgggaagctttagagtc

SEQ ID NO: 105051 - DNA, 75 bp, Artificial Sequence
  Synthetic
gccttctgactttttcccgtctgttcgggacctactcgacaccgcttcagccttgtaccgggaaactttagagtc

SEQ ID NO: 105052 - DNA, 75 bp, Artificial Sequence
  Synthetic
gccttctgactttttcccgtctgttcgggacctactcgacaccgcttcagccttgtaccgggaatctttagagtc

SEQ ID NO: 105053 - DNA, 75 bp, Artificial Sequence
  Synthetic
gccttctgactttttcccgtctgttcgggacctactcgacaccgcttcagccttgtaccgggaacctttagagtc

SEQ ID NO: 105054 - DNA, 75 bp, Artificial Sequence
  Synthetic
gccttctgactttttcccgtctgttcgggacctactcgacaccgcttcagccttgtaccgggaagctttagagtc

SEQ ID NO: 105055 - DNA, 75 bp, Artificial Sequence
  Synthetic
gccttctgactttttcccgtctgttcgggagctactcgacaccgcttcagccttgtaccgggaaactttagagtc

SEQ ID NO: 105056 - DNA, 75 bp, Artificial Sequence
  Synthetic
gccttctgactttttcccgtctgttcgggagctactcgacaccgcttcagccttgtaccgggaatctttagagtc

SEQ ID NO: 105057 - DNA, 75 bp, Artificial Sequence
  Synthetic
gccttctgactttttcccgtctgttcgggagctactcgacaccgcttcagccttgtaccgggaacctttagagtc

SEQ ID NO: 105058 - DNA, 75 bp, Artificial Sequence
  Synthetic
gccttctgactttttcccgtctgttcgggagctactcgacaccgcttcagccttgtaccgggaagctttagagtc

SEQ ID NO: 105059 - DNA, 75 bp, Artificial Sequence
  Synthetic
gccttctgactttttcccgtccgttcgggaactactcgacaccgcttcagccttgtaccgggaaactttagagtc

SEQ ID NO: 105060 - DNA, 75 bp, Artificial Sequence
  Synthetic
gccttctgactttttcccgtccgttcgggaactactcgacaccgcttcagccttgtaccgggaatctttagagtc

SEQ ID NO: 105061 - DNA, 75 bp, Artificial Sequence
  Synthetic
gccttctgactttttcccgtccgttcgggaactactcgacaccgcttcagccttgtaccgggaacctttagagtc

SEQ ID NO: 105062 - DNA, 75 bp, Artificial Sequence
  Synthetic
gccttctgactttttcccgtccgttcgggaactactcgacaccgcttcagccttgtaccgggaagctttagagtc

SEQ ID NO: 105063 - DNA, 75 bp, Artificial Sequence
  Synthetic
gccttctgactttttcccgtccgttcgggatctactcgacaccgcttcagccttgtaccgggaaactttagagtc

SEQ ID NO: 105064 - DNA, 75 bp, Artificial Sequence
  Synthetic
gccttctgactttttcccgtccgttcgggatctactcgacaccgcttcagccttgtaccgggaatctttagagtc

SEQ ID NO: 105065 - DNA, 75 bp, Artificial Sequence
  Synthetic
gccttctgactttttcccgtccgttcgggatctactcgacaccgcttcagccttgtaccgggaacctttagagtc

SEQ ID NO: 105066 - DNA, 75 bp, Artificial Sequence
  Synthetic
gccttctgactttttcccgtccgttcgggatctactcgacaccgcttcagccttgtaccgggaagctttagagtc

SEQ ID NO: 105067 - DNA, 75 bp, Artificial Sequence
  Synthetic
gccttctgactttttcccgtccgttcgggacctactcgacaccgcttcagccttgtaccgggaaactttagagtc

SEQ ID NO: 105068 - DNA, 75 bp, Artificial Sequence
  Synthetic
gccttctgactttttcccgtccgttcgggacctactcgacaccgcttcagccttgtaccgggaatctttagagtc

SEQ ID NO: 105069 - DNA, 75 bp, Artificial Sequence
  Synthetic
gccttctgactttttcccgtccgttcgggacctactcgacaccgcttcagccttgtaccgggaacctttagagtc

SEQ ID NO: 105070 - DNA, 75 bp, Artificial Sequence
  Synthetic
gccttctgactttttcccgtccgttcgggacctactcgacaccgcttcagccttgtaccgggaagctttagagtc

SEQ ID NO: 105071 - DNA, 75 bp, Artificial Sequence
  Synthetic
gccttctgactttttcccgtccgttcgggagctactcgacaccgcttcagccttgtaccgggaaactttagagtc

SEQ ID NO: 105072 - DNA, 75 bp, Artificial Sequence
  Synthetic
gccttctgactttttcccgtccgttcgggagctactcgacaccgcttcagccttgtaccgggaatctttagagtc

SEQ ID NO: 105073 - DNA, 75 bp, Artificial Sequence
  Synthetic
gccttctgactttttcccgtccgttcgggagctactcgacaccgcttcagccttgtaccgggaacctttagagtc

SEQ ID NO: 105074 - DNA, 75 bp, Artificial Sequence
  Synthetic
gccttctgactttttcccgtccgttcgggagctactcgacaccgcttcagccttgtaccgggaagctttagagtc

SEQ ID NO: 105075 - DNA, 75 bp, Artificial Sequence
  Synthetic
gccttctgactttttcccgtcggttcgggaactactcgacaccgcttcagccttgtaccgggaaactttagagtc

SEQ ID NO: 105076 - DNA, 75 bp, Artificial Sequence
  Synthetic
gccttctgactttttcccgtcggttcgggaactactcgacaccgcttcagccttgtaccgggaatctttagagtc

SEQ ID NO: 105077 - DNA, 75 bp, Artificial Sequence
  Synthetic
gccttctgactttttcccgtcggttcgggaactactcgacaccgcttcagccttgtaccgggaacctttagagtc

SEQ ID NO: 105078 - DNA, 75 bp, Artificial Sequence
  Synthetic
gccttctgactttttcccgtcggttcgggaactactcgacaccgcttcagccttgtaccgggaagctttagagtc

SEQ ID NO: 105079 - DNA, 75 bp, Artificial Sequence
  Synthetic
gccttctgactttttcccgtcggttcgggatctactcgacaccgcttcagccttgtaccgggaaactttagagtc

SEQ ID NO: 105080 - DNA, 75 bp, Artificial Sequence
  Synthetic
gccttctgactttttcccgtcggttcgggatctactcgacaccgcttcagccttgtaccgggaatctttagagtc

SEQ ID NO: 105081 - DNA, 75 bp, Artificial Sequence
  Synthetic
gccttctgactttttcccgtcggttcgggatctactcgacaccgcttcagccttgtaccgggaacctttagagtc

SEQ ID NO: 105082 - DNA, 75 bp, Artificial Sequence
  Synthetic
gccttctgactttttcccgtcggttcgggatctactcgacaccgcttcagccttgtaccgggaagctttagagtc

SEQ ID NO: 105083 - DNA, 75 bp, Artificial Sequence
  Synthetic
gccttctgactttttcccgtcggttcgggacctactcgacaccgcttcagccttgtaccgggaaactttagagtc

SEQ ID NO: 105084 - DNA, 75 bp, Artificial Sequence
  Synthetic
gccttctgactttttcccgtcggttcgggacctactcgacaccgcttcagccttgtaccgggaatctttagagtc

SEQ ID NO: 105085 - DNA, 75 bp, Artificial Sequence
  Synthetic
gccttctgactttttcccgtcggttcgggacctactcgacaccgcttcagccttgtaccgggaacctttagagtc

SEQ ID NO: 105086 - DNA, 75 bp, Artificial Sequence
  Synthetic
gccttctgactttttcccgtcggttcgggacctactcgacaccgcttcagccttgtaccgggaagctttagagtc

SEQ ID NO: 105087 - DNA, 75 bp, Artificial Sequence
  Synthetic
gccttctgactttttcccgtcggttcgggagctactcgacaccgcttcagccttgtaccgggaaactttagagtc

SEQ ID NO: 105088 - DNA, 75 bp, Artificial Sequence
  Synthetic
gccttctgactttttcccgtcggttcgggagctactcgacaccgcttcagccttgtaccgggaatctttagagtc

SEQ ID NO: 105089 - DNA, 75 bp, Artificial Sequence
  Synthetic
gccttctgactttttcccgtcggttcgggagctactcgacaccgcttcagccttgtaccgggaacctttagagtc

SEQ ID NO: 105090 - DNA, 75 bp, Artificial Sequence
  Synthetic
gccttctgactttttcccgtcggttcgggagctactcgacaccgcttcagccttgtaccgggaagctttagagtc

SEQ ID NO: 105091 - DNA, 75 bp, Artificial Sequence
  Synthetic
tggagccctcaagcacaaggtgtgttaacaaccttgccagcagatccgcctcctgcttccaccaatcggcggtcc

SEQ ID NO: 105092 - DNA, 75 bp, Artificial Sequence
  Synthetic
tgtgctggggtgagttaatgactttggctacctgggtgggtaataaattggaagatccagcttccagagaattgg

SEQ ID NO: 105093 - DNA, 75 bp, Artificial Sequence
  Synthetic
tgtgctggggtgagttaatgactttggctacctgggtgggtaataaattggaagatccagcttccagtgaattgg

SEQ ID NO: 105094 - DNA, 75 bp, Artificial Sequence
  Synthetic
tgtgctggggtgagttaatgactttggctacctgggtgggtaataaattggaagatccagcttccagcgaattgg

SEQ ID NO: 105095 - DNA, 75 bp, Artificial Sequence
  Synthetic
tgtgctggggtgagttaatgactttggctacctgggtgggtaataaattggaagatccagcttccagggaattgg

SEQ ID NO: 105096 - DNA, 75 bp, Artificial Sequence
  Synthetic
tgtgctggggtgagttaatgactttggctacctgggtgggtaataaattggaagatcctgcttccagagaattgg

SEQ ID NO: 105097 - DNA, 75 bp, Artificial Sequence
  Synthetic
tgtgctggggtgagttaatgactttggctacctgggtgggtaataaattggaagatcctgcttccagtgaattgg

SEQ ID NO: 105098 - DNA, 75 bp, Artificial Sequence
  Synthetic
tgtgctggggtgagttaatgactttggctacctgggtgggtaataaattggaagatcctgcttccagcgaattgg

SEQ ID NO: 105099 - DNA, 75 bp, Artificial Sequence
  Synthetic
tgtgctggggtgagttaatgactttggctacctgggtgggtaataaattggaagatcctgcttccagggaattgg

SEQ ID NO: 105100 - DNA, 75 bp, Artificial Sequence
  Synthetic
tgtgctggggtgagttaatgactttggctacctgggtgggtaataaattggaagatcccgcttccagagaattgg

SEQ ID NO: 105101 - DNA, 75 bp, Artificial Sequence
  Synthetic
tgtgctggggtgagttaatgactttggctacctgggtgggtaataaattggaagatcccgcttccagtgaattgg

SEQ ID NO: 105102 - DNA, 75 bp, Artificial Sequence
  Synthetic
tgtgctggggtgagttaatgactttggctacctgggtgggtaataaattggaagatcccgcttccagcgaattgg

SEQ ID NO: 105103 - DNA, 75 bp, Artificial Sequence
  Synthetic
tgtgctggggtgagttaatgactttggctacctgggtgggtaataaattggaagatcccgcttccagggaattgg

SEQ ID NO: 105104 - DNA, 75 bp, Artificial Sequence
  Synthetic
tgtgctggggtgagttaatgactttggctacctgggtgggtaataaattggaagatccggcttccagagaattgg

SEQ ID NO: 105105 - DNA, 75 bp, Artificial Sequence
  Synthetic
tgtgctggggtgagttaatgactttggctacctgggtgggtaataaattggaagatccggcttccagtgaattgg

SEQ ID NO: 105106 - DNA, 75 bp, Artificial Sequence
  Synthetic
tgtgctggggtgagttaatgactttggctacctgggtgggtaataaattggaagatccggcttccagcgaattgg

SEQ ID NO: 105107 - DNA, 75 bp, Artificial Sequence
  Synthetic
tgtgctggggtgagttaatgactttggctacctgggtgggtaataaattggaagatccggcttccagggaattgg

SEQ ID NO: 105108 - DNA, 75 bp, Artificial Sequence
  Synthetic
tgtgctggggtgagtttatgactttggctacctgggtgggtaataaattggaagatccagcttccagagaattgg

SEQ ID NO: 105109 - DNA, 75 bp, Artificial Sequence
  Synthetic
tgtgctggggtgagtttatgactttggctacctgggtgggtaataaattggaagatccagcttccagtgaattgg

SEQ ID NO: 105110 - DNA, 75 bp, Artificial Sequence
  Synthetic
tgtgctggggtgagtttatgactttggctacctgggtgggtaataaattggaagatccagcttccagcgaattgg

SEQ ID NO: 105111 - DNA, 75 bp, Artificial Sequence
  Synthetic
tgtgctggggtgagtttatgactttggctacctgggtgggtaataaattggaagatccagcttccagggaattgg

SEQ ID NO: 105112 - DNA, 75 bp, Artificial Sequence
  Synthetic
tgtgctggggtgagtttatgactttggctacctgggtgggtaataaattggaagatcctgcttccagagaattgg

SEQ ID NO: 105113 - DNA, 75 bp, Artificial Sequence
  Synthetic
tgtgctggggtgagtttatgactttggctacctgggtgggtaataaattggaagatcctgcttccagtgaattgg

SEQ ID NO: 105114 - DNA, 75 bp, Artificial Sequence
  Synthetic
tgtgctggggtgagtttatgactttggctacctgggtgggtaataaattggaagatcctgcttccagcgaattgg

SEQ ID NO: 105115 - DNA, 75 bp, Artificial Sequence
  Synthetic
tgtgctggggtgagtttatgactttggctacctgggtgggtaataaattggaagatcctgcttccagggaattgg

SEQ ID NO: 105116 - DNA, 75 bp, Artificial Sequence
  Synthetic
tgtgctggggtgagtttatgactttggctacctgggtgggtaataaattggaagatcccgcttccagagaattgg

SEQ ID NO: 105117 - DNA, 75 bp, Artificial Sequence
  Synthetic
tgtgctggggtgagtttatgactttggctacctgggtgggtaataaattggaagatcccgcttccagtgaattgg

SEQ ID NO: 105118 - DNA, 75 bp, Artificial Sequence
  Synthetic
tgtgctggggtgagtttatgactttggctacctgggtgggtaataaattggaagatcccgcttccagcgaattgg

SEQ ID NO: 105119 - DNA, 75 bp, Artificial Sequence
  Synthetic
tgtgctggggtgagtttatgactttggctacctgggtgggtaataaattggaagatcccgcttccagggaattgg

SEQ ID NO: 105120 - DNA, 75 bp, Artificial Sequence
  Synthetic
tgtgctggggtgagtttatgactttggctacctgggtgggtaataaattggaagatccggcttccagagaattgg

SEQ ID NO: 105121 - DNA, 75 bp, Artificial Sequence
  Synthetic
tgtgctggggtgagtttatgactttggctacctgggtgggtaataaattggaagatccggcttccagtgaattgg

SEQ ID NO: 105122 - DNA, 75 bp, Artificial Sequence
  Synthetic
tgtgctggggtgagtttatgactttggctacctgggtgggtaataaattggaagatccggcttccagcgaattgg

SEQ ID NO: 105123 - DNA, 75 bp, Artificial Sequence
  Synthetic
tgtgctggggtgagtttatgactttggctacctgggtgggtaataaattggaagatccggcttccagggaattgg

SEQ ID NO: 105124 - DNA, 75 bp, Artificial Sequence
  Synthetic
tgtgctggggtgagttcatgactttggctacctgggtgggtaataaattggaagatccagcttccagagaattgg

SEQ ID NO: 105125 - DNA, 75 bp, Artificial Sequence
  Synthetic
tgtgctggggtgagttcatgactttggctacctgggtgggtaataaattggaagatccagcttccagtgaattgg

SEQ ID NO: 105126 - DNA, 75 bp, Artificial Sequence
  Synthetic
tgtgctggggtgagttcatgactttggctacctgggtgggtaataaattggaagatccagcttccagcgaattgg

SEQ ID NO: 105127 - DNA, 75 bp, Artificial Sequence
  Synthetic
tgtgctggggtgagttcatgactttggctacctgggtgggtaataaattggaagatccagcttccagggaattgg

SEQ ID NO: 105128 - DNA, 75 bp, Artificial Sequence
  Synthetic
tgtgctggggtgagttcatgactttggctacctgggtgggtaataaattggaagatcctgcttccagagaattgg

SEQ ID NO: 105129 - DNA, 75 bp, Artificial Sequence
  Synthetic
tgtgctggggtgagttcatgactttggctacctgggtgggtaataaattggaagatcctgcttccagtgaattgg

SEQ ID NO: 105130 - DNA, 75 bp, Artificial Sequence
  Synthetic
tgtgctggggtgagttcatgactttggctacctgggtgggtaataaattggaagatcctgcttccagcgaattgg

SEQ ID NO: 105131 - DNA, 75 bp, Artificial Sequence
  Synthetic
tgtgctggggtgagttcatgactttggctacctgggtgggtaataaattggaagatcctgcttccagggaattgg

SEQ ID NO: 105132 - DNA, 75 bp, Artificial Sequence
  Synthetic
tgtgctggggtgagttcatgactttggctacctgggtgggtaataaattggaagatcccgcttccagagaattgg

SEQ ID NO: 105133 - DNA, 75 bp, Artificial Sequence
  Synthetic
tgtgctggggtgagttcatgactttggctacctgggtgggtaataaattggaagatcccgcttccagtgaattgg

SEQ ID NO: 105134 - DNA, 75 bp, Artificial Sequence
  Synthetic
tgtgctggggtgagttcatgactttggctacctgggtgggtaataaattggaagatcccgcttccagcgaattgg

SEQ ID NO: 105135 - DNA, 75 bp, Artificial Sequence
  Synthetic
tgtgctggggtgagttcatgactttggctacctgggtgggtaataaattggaagatcccgcttccagggaattgg

SEQ ID NO: 105136 - DNA, 75 bp, Artificial Sequence
  Synthetic
tgtgctggggtgagttcatgactttggctacctgggtgggtaataaattggaagatccggcttccagagaattgg

SEQ ID NO: 105137 - DNA, 75 bp, Artificial Sequence
  Synthetic
tgtgctggggtgagttcatgactttggctacctgggtgggtaataaattggaagatccggcttccagtgaattgg

SEQ ID NO: 105138 - DNA, 75 bp, Artificial Sequence
  Synthetic
tgtgctggggtgagttcatgactttggctacctgggtgggtaataaattggaagatccggcttccagcgaattgg

SEQ ID NO: 105139 - DNA, 75 bp, Artificial Sequence
  Synthetic
tgtgctggggtgagttcatgactttggctacctgggtgggtaataaattggaagatccggcttccagggaattgg

SEQ ID NO: 105140 - DNA, 75 bp, Artificial Sequence
  Synthetic
tgtgctggggtgagttgatgactttggctacctgggtgggtaataaattggaagatccagcttccagagaattgg

SEQ ID NO: 105141 - DNA, 75 bp, Artificial Sequence
  Synthetic
tgtgctggggtgagttgatgactttggctacctgggtgggtaataaattggaagatccagcttccagtgaattgg

SEQ ID NO: 105142 - DNA, 75 bp, Artificial Sequence
  Synthetic
tgtgctggggtgagttgatgactttggctacctgggtgggtaataaattggaagatccagcttccagcgaattgg

SEQ ID NO: 105143 - DNA, 75 bp, Artificial Sequence
  Synthetic
tgtgctggggtgagttgatgactttggctacctgggtgggtaataaattggaagatccagcttccagggaattgg

SEQ ID NO: 105144 - DNA, 75 bp, Artificial Sequence
  Synthetic
tgtgctggggtgagttgatgactttggctacctgggtgggtaataaattggaagatcctgcttccagagaattgg

SEQ ID NO: 105145 - DNA, 75 bp, Artificial Sequence
  Synthetic
tgtgctggggtgagttgatgactttggctacctgggtgggtaataaattggaagatcctgcttccagtgaattgg

SEQ ID NO: 105146 - DNA, 75 bp, Artificial Sequence
  Synthetic
tgtgctggggtgagttgatgactttggctacctgggtgggtaataaattggaagatcctgcttccagcgaattgg

SEQ ID NO: 105147 - DNA, 75 bp, Artificial Sequence
  Synthetic
tgtgctggggtgagttgatgactttggctacctgggtgggtaataaattggaagatcctgcttccagggaattgg

SEQ ID NO: 105148 - DNA, 75 bp, Artificial Sequence
  Synthetic
tgtgctggggtgagttgatgactttggctacctgggtgggtaataaattggaagatcccgcttccagagaattgg

SEQ ID NO: 105149 - DNA, 75 bp, Artificial Sequence
  Synthetic
tgtgctggggtgagttgatgactttggctacctgggtgggtaataaattggaagatcccgcttccagtgaattgg

SEQ ID NO: 105150 - DNA, 75 bp, Artificial Sequence
  Synthetic
tgtgctggggtgagttgatgactttggctacctgggtgggtaataaattggaagatcccgcttccagcgaattgg

SEQ ID NO: 105151 - DNA, 75 bp, Artificial Sequence
  Synthetic
tgtgctggggtgagttgatgactttggctacctgggtgggtaataaattggaagatcccgcttccagggaattgg

SEQ ID NO: 105152 - DNA, 75 bp, Artificial Sequence
  Synthetic
tgtgctggggtgagttgatgactttggctacctgggtgggtaataaattggaagatccggcttccagagaattgg

SEQ ID NO: 105153 - DNA, 75 bp, Artificial Sequence
  Synthetic
tgtgctggggtgagttgatgactttggctacctgggtgggtaataaattggaagatccggcttccagtgaattgg

SEQ ID NO: 105154 - DNA, 75 bp, Artificial Sequence
  Synthetic
tgtgctggggtgagttgatgactttggctacctgggtgggtaataaattggaagatccggcttccagcgaattgg

SEQ ID NO: 105155 - DNA, 75 bp, Artificial Sequence
  Synthetic
tgtgctggggtgagttgatgactttggctacctgggtgggtaataaattggaagatccggcttccagggaattgg

SEQ ID NO: 105156 - DNA, 75 bp, Artificial Sequence
  Synthetic
cagggcatactacaaaccttgccagcaaatccgcctcctgcctctaccaatcgccagtcaggaaggcagcctacc

SEQ ID NO: 105157 - DNA, 75 bp, Artificial Sequence
  Synthetic
ttccaccacattccaccaagctctgcaggatcccagagtaagaggcctgtatcctgctggtggctccagttccgg

SEQ ID NO: 105158 - DNA, 75 bp, Artificial Sequence
  Synthetic
aaacttcctgttaacaggcctattgattggaaagtctgtcaacgtattgtgggtcttttgggttttgctgcccct

SEQ ID NO: 105159 - DNA, 75 bp, Artificial Sequence
  Synthetic
caagtgtttgctgacgcaacccccactggctggggcttggtcatgggccatcagcgcatgcgtggaacctttctg

SEQ ID NO: 105160 - DNA, 75 bp, Artificial Sequence
  Synthetic
actggccagaggcaaatcaggtaggagcgggagcattcgggcctactcccatctctccacctctaagagacagtc

SEQ ID NO: 105161 - DNA, 75 bp, Artificial Sequence
  Synthetic
cattgttcacctaaccatacagcactcaggcaagctgttctgtgctggggtgagttgatgactctggcttcctgg

SEQ ID NO: 105162 - DNA, 75 bp, Artificial Sequence
  Synthetic
gaggctgtaggcataaattggtctgcgcaccagcaccatgcaactttttcacctctgcctaatcatctcttgttc

SEQ ID NO: 105163 - DNA, 75 bp, Artificial Sequence
  Synthetic
cgtgtgcacttcgcttcacctctgcacgttacatggaaaccgccatgaacacctctcatcatctgccaaggcagt

SEQ ID NO: 105164 - DNA, 75 bp, Artificial Sequence
  Synthetic
tgacattcatttgcaggaggacattgttgatagatgtgagcaatttgtggggccccttacagtaaatgaaaaaag

SEQ ID NO: 105165 - DNA, 75 bp, Artificial Sequence
  Synthetic
accttattatccagagcatgtagttaatcattacttccagacgagacattatttacacactctttggaaggcggg

SEQ ID NO: 105166 - DNA, 75 bp, Artificial Sequence
  Synthetic
ttcaagcctccaagctgtgccttgggtggctttggggcatggacattgacccgtataaagaatttggagcttctg

SEQ ID NO: 105167 - DNA, 75 bp, Artificial Sequence
  Synthetic
agagtctcctgaacattgctcgcctcaccatacagcaatcaggcaagctattttgtgctggggggaattaatgac

SEQ ID NO: 105168 - DNA, 75 bp, Artificial Sequence
  Synthetic
ggaaaacaccctcttttcctaatatacatttacaccaagacattatcaaaaaatgtgaacaatttgtaggcccac

SEQ ID NO: 105169 - DNA, 75 bp, Artificial Sequence
  Synthetic
ttgattggaaagtatgtcaaagaattgtgggtcttttgggctttgctgccccttttacacaatgtggttatcctg

SEQ ID NO: 105170 - DNA, 75 bp, Artificial Sequence
  Synthetic
ctcctactgcctccaccaatcggcagtcaggaaggaaacctactccaatctctccacctttgagagacactcatc

SEQ ID NO: 105171 - DNA, 75 bp, Artificial Sequence
  Synthetic
ctgggtgggaagtaatttggaagatccagcatccagggaattagtagtcggctatgtcaacgttaatatgggcct

SEQ ID NO: 105172 - DNA, 75 bp, Artificial Sequence
  Synthetic
ctgctggtggctccagttcaggaacagtgaaccctgttccgactactgcctctcacatctcgtcaaccttctcga

SEQ ID NO: 105173 - DNA, 75 bp, Artificial Sequence
  Synthetic
tctagcttcctgggtgggtaataatttacaagatccagcatccagagacctagtagtcaattatgttaacactaa

SEQ ID NO: 105174 - DNA, 75 bp, Artificial Sequence
  Synthetic
caggctcagggcatactacaaaccttgccagcaaatccgcctcctgcctctaccaatcgccagtcaggaaggcag

SEQ ID NO: 105175 - DNA, 75 bp, Artificial Sequence
  Synthetic
tgggcctaaagttcaggcaattattgtggtttcacatttcttgtctcacttttggaagagaaaccgtcatagagt

SEQ ID NO: 105176 - DNA, 75 bp, Artificial Sequence
  Synthetic
ctgttcaccagcaccatgcaactttttcacctctgcctaatcatctcatgttcatgtcctactgttcaagcctcc

SEQ ID NO: 105177 - DNA, 75 bp, Artificial Sequence
  Synthetic
gtatgtgattggaagttggggatccttgccacaagaacatattgtatacaaaatcaaacaatgttttaagaagct

SEQ ID NO: 105178 - DNA, 75 bp, Artificial Sequence
  Synthetic
ttccacagctttccaccaagctctgcaagatcccagagtcaggggcctgtattttcctgctggtggctccagttc

SEQ ID NO: 105179 - DNA, 75 bp, Artificial Sequence
  Synthetic
agttaatcattacttcaaaactaggcattatttacatactctgtggaaggctggtattctatataagagagaaac

SEQ ID NO: 105180 - DNA, 75 bp, Artificial Sequence
  Synthetic
ttcaaagactgtgtgtttaaggactgggaggagttaggggaggagatcaggttaaaggtctttgtactaggaggc

SEQ ID NO: 105181 - DNA, 75 bp, Artificial Sequence
  Synthetic
taaggtgggaaactttacggggctttattcctctacagtacctatctttaatcctgaatggcaaactccttcctt

SEQ ID NO: 105182 - DNA, 75 bp, Artificial Sequence
  Synthetic
ctcattggaaaacaccatcttttcctaatatacatttacaccaagacattatcaaaaaatgtgaacagtttgtag

SEQ ID NO: 105183 - DNA, 75 bp, Artificial Sequence
  Synthetic
taggagcgggagcattcgggccagggttcaccccacctcacggaggtcttttggggtggagccctcaggctcagg

SEQ ID NO: 105184 - DNA, 75 bp, Artificial Sequence
  Synthetic
ttagagtctccggaacattgttcacctcaccatacagcactcaggcaagctattctgtgttggggtgagttaatg

SEQ ID NO: 105185 - DNA, 75 bp, Artificial Sequence
  Synthetic
ttttttgccttctgacttctttccttccgtccgagatctcctagataccgcctcagctctgtatcgggaagcatt

SEQ ID NO: 105186 - DNA, 75 bp, Artificial Sequence
  Synthetic
taaaattaattatgcctgctaggttttatcctaacattaccaaatatttgcccttagataaaggcattaaacctt

SEQ ID NO: 105187 - DNA, 75 bp, Artificial Sequence
  Synthetic
ctctacagcattccaccaagctctacaaaatcccaaagtcagggttcctgctggtggctccagttcagggatagt

SEQ ID NO: 105188 - DNA, 75 bp, Artificial Sequence
  Synthetic
ctccacagcattccaccaagctctgcaggatcccagagtaaggggtctgtattttcctgctggtggctccagttc

SEQ ID NO: 105189 - DNA, 75 bp, Artificial Sequence
  Synthetic
accagttggatccagccttcagagcaaacaccagaaatccagattgggacttcaatcccaacaaggacacctggc

SEQ ID NO: 105190 - DNA, 75 bp, Artificial Sequence
  Synthetic
atcatgggaggttggtcatcaaaacctcgcaaaggcatggggacgaatctttctgttcccaaccctctgggattc

SEQ ID NO: 105191 - DNA, 75 bp, Artificial Sequence
  Synthetic
ggagttactctcatttttgccttctgatttctttccttccgtccgggatctacttgatacagcctcagctctgta

SEQ ID NO: 105192 - DNA, 75 bp, Artificial Sequence
  Synthetic
ggagttactctcttttttgccttctgatttctttccttccgtccgggatctacttgatacagcctcagctctgta

SEQ ID NO: 105193 - DNA, 75 bp, Artificial Sequence
  Synthetic
ggagttactctcctttttgccttctgatttctttccttccgtccgggatctacttgatacagcctcagctctgta

SEQ ID NO: 105194 - DNA, 75 bp, Artificial Sequence
  Synthetic
ggagttactctcgtttttgccttctgatttctttccttccgtccgggatctacttgatacagcctcagctctgta

SEQ ID NO: 105195 - DNA, 75 bp, Artificial Sequence
  Synthetic
ggagtttctctcatttttgccttctgatttctttccttccgtccgggatctacttgatacagcctcagctctgta

SEQ ID NO: 105196 - DNA, 75 bp, Artificial Sequence
  Synthetic
ggagtttctctcttttttgccttctgatttctttccttccgtccgggatctacttgatacagcctcagctctgta

SEQ ID NO: 105197 - DNA, 75 bp, Artificial Sequence
  Synthetic
ggagtttctctcctttttgccttctgatttctttccttccgtccgggatctacttgatacagcctcagctctgta

SEQ ID NO: 105198 - DNA, 75 bp, Artificial Sequence
  Synthetic
ggagtttctctcgtttttgccttctgatttctttccttccgtccgggatctacttgatacagcctcagctctgta

SEQ ID NO: 105199 - DNA, 75 bp, Artificial Sequence
  Synthetic
ggagttcctctcatttttgccttctgatttctttccttccgtccgggatctacttgatacagcctcagctctgta

SEQ ID NO: 105200 - DNA, 75 bp, Artificial Sequence
  Synthetic
ggagttcctctcttttttgccttctgatttctttccttccgtccgggatctacttgatacagcctcagctctgta

SEQ ID NO: 105201 - DNA, 75 bp, Artificial Sequence
  Synthetic
ggagttcctctcctttttgccttctgatttctttccttccgtccgggatctacttgatacagcctcagctctgta

SEQ ID NO: 105202 - DNA, 75 bp, Artificial Sequence
  Synthetic
ggagttcctctcgtttttgccttctgatttctttccttccgtccgggatctacttgatacagcctcagctctgta

SEQ ID NO: 105203 - DNA, 75 bp, Artificial Sequence
  Synthetic
ggagttgctctcatttttgccttctgatttctttccttccgtccgggatctacttgatacagcctcagctctgta

SEQ ID NO: 105204 - DNA, 75 bp, Artificial Sequence
  Synthetic
ggagttgctctcttttttgccttctgatttctttccttccgtccgggatctacttgatacagcctcagctctgta

SEQ ID NO: 105205 - DNA, 75 bp, Artificial Sequence
  Synthetic
ggagttgctctcctttttgccttctgatttctttccttccgtccgggatctacttgatacagcctcagctctgta

SEQ ID NO: 105206 - DNA, 75 bp, Artificial Sequence
  Synthetic
ggagttgctctcgtttttgccttctgatttctttccttccgtccgggatctacttgatacagcctcagctctgta

SEQ ID NO: 105207 - DNA, 75 bp, Artificial Sequence
  Synthetic
ggaagcttaccgcaagagcatattgtacacaaactcaaacactgttttagaaaacttcctgttaataggcccatt

SEQ ID NO: 105208 - DNA, 75 bp, Artificial Sequence
  Synthetic
agagaaacaacacgtagcgcctcattttgtgggtcaccatattcttgggaacaagagctacagcatggggcagaa

SEQ ID NO: 105209 - DNA, 75 bp, Artificial Sequence
  Synthetic
ctttttcacctctgcctaatcatctcttgttcatgtcctactgttcaagcctccaagctgtgccttgggtggctt

SEQ ID NO: 105210 - DNA, 75 bp, Artificial Sequence
  Synthetic
gaactcctagccgcttgtttcgctggcagccggtctggagggaaagttatcggtaccgacaaatctgttgtcctc

SEQ ID NO: 105211 - DNA, 75 bp, Artificial Sequence
  Synthetic
gttaatttggaagatccagcatctagagacctagtagtcagttatgtcaacactaatatgggcctaaagttcagg

SEQ ID NO: 105212 - DNA, 75 bp, Artificial Sequence
  Synthetic
cacggggccatgcaagacctgcacgactcctgctcaaggaacctctatgtttccctcttgttgctgtacaaaacc

SEQ ID NO: 105213 - DNA, 75 bp, Artificial Sequence
  Synthetic
ttcatttgcaggaggacattattgatagatgtcaacaatttgtgggccctcttacagttaatgaaaaaaggagat

SEQ ID NO: 105214 - DNA, 75 bp, Artificial Sequence
  Synthetic
gctttattcttccactgtacctgtctttaatcctaagtggcaaactccttcctttcctgacatccatttgcacca

SEQ ID NO: 105215 - DNA, 75 bp, Artificial Sequence
  Synthetic
cttctgacttctttccgtcggtgcgagacctcctagataccgctgctgctctgtatcgggaagccttagaatctc

SEQ ID NO: 105216 - DNA, 75 bp, Artificial Sequence
  Synthetic
gatctacttgatacattttatcatattcctcttcatcctgctgctatgccttagctctgtatcggttcttctgaa

SEQ ID NO: 105217 - DNA, 75 bp, Artificial Sequence
  Synthetic
ctgaacattgctcacctcaccacacagcactcaggcaagatatcctgtgctggggggaattaatgactctagcta

SEQ ID NO: 105218 - DNA, 75 bp, Artificial Sequence
  Synthetic
accgaccacggggcgcacctctctttacgcggactccccgtctgtgccttctcatctgccggaccgtgtgcactt

SEQ ID NO: 105219 - DNA, 75 bp, Artificial Sequence
  Synthetic
cgtgtgcactttgtttcccctctgcccgtcgaatggagacccccgtaaacgccccccggaatttcccaaaggttt

SEQ ID NO: 105220 - DNA, 75 bp, Artificial Sequence
  Synthetic
catggacattgacccttataaagaatttggagctactgtggagttactctcttttttgccttctgacttctttcc

SEQ ID NO: 105221 - DNA, 75 bp, Artificial Sequence
  Synthetic
gtgtttgctgacgcaacccccactggatggggcttggccataggccaccagcgcctgcgtggaacctttgtggct

SEQ ID NO: 105222 - DNA, 75 bp, Artificial Sequence
  Synthetic
ttggaaaacaccatcttttcctaatatacatttacaccaagatattatcaaaaaatgtgaacagtttgtaggccc

SEQ ID NO: 105223 - DNA, 75 bp, Artificial Sequence
  Synthetic
aaagatcaaacactgttttagaaaacttcctgttaacaggcctattgattggaaagtatgtcaaagaattgtggg

SEQ ID NO: 105224 - DNA, 75 bp, Artificial Sequence
  Synthetic
gttggaccctgcattcaaagccaactcagaaaatccagattgggacctcaacccacacaaggacaactggccgga

SEQ ID NO: 105225 - DNA, 75 bp, Artificial Sequence
  Synthetic
attatccagataatgcagttaatcattacttccaaactagacactatttacatactctatggcaggcaggcattt

SEQ ID NO: 105226 - DNA, 75 bp, Artificial Sequence
  Synthetic
caatacctgaacctttaccccgttgcccggcaacggcccggtctgtgccaagtgtttgctgacgcaacccccact

SEQ ID NO: 105227 - DNA, 75 bp, Artificial Sequence
  Synthetic
accaacaatccagattgggacttcaaccccaaaaaggactactggccagaggccaacaaggtaggagctggagcg

SEQ ID NO: 105228 - DNA, 75 bp, Artificial Sequence
  Synthetic
gaggaggttaggttaaaggtctgtgtactaggaggctgctgctatgaacgggtctgttcaccagcaccatgcaac

SEQ ID NO: 105229 - DNA, 75 bp, Artificial Sequence
  Synthetic
ttgccagcaaatccgcctcctgcctccaccaatcgccaatcaagaaggcagcctaccccgccttcactacctttg

SEQ ID NO: 105230 - DNA, 75 bp, Artificial Sequence
  Synthetic
tcccgtaaacaggcctattgattggaaagtgtgtcaaagaattgtgggtcttttgggcttcgctgccccttttac

SEQ ID NO: 105231 - DNA, 75 bp, Artificial Sequence
  Synthetic
ttccactgccttccaccaagctctgcaggatcccaaagtcagggatcctgctggtggctccagttcaggaacagt

SEQ ID NO: 105232 - DNA, 75 bp, Artificial Sequence
  Synthetic
gtttgctgatgcaacacccactggttggggcttggccatcggccaccagcgcatgcgcggaacctttgtggctcc

SEQ ID NO: 105233 - DNA, 75 bp, Artificial Sequence
  Synthetic
aaccttattatcctgaacatgcagttaatcattacttcaaaactaggcattatttacatactctgtggaaggctg

SEQ ID NO: 105234 - DNA, 75 bp, Artificial Sequence
  Synthetic
ctccacaacgttccatcggactctgcaagatccccgagtgcggggcctgtatttccctgctggtggctccagttc

SEQ ID NO: 105235 - DNA, 75 bp, Artificial Sequence
  Synthetic
ttttggggtggagccctcaggctcagggcatattgacaacagtgccagtagcacctcctcctgcctccaccaatc

SEQ ID NO: 105236 - DNA, 75 bp, Artificial Sequence
  Synthetic
acaactgtgccagcagctcctcctcctgcctccaccaatcggcagtcaggaaggcagcctactcccttatctcca

SEQ ID NO: 105237 - DNA, 75 bp, Artificial Sequence
  Synthetic
ttcaaagacagtgtgtttaaggactgggaggagttaggggaggagacgaggttaaaggtctttgtactaggaggc

SEQ ID NO: 105238 - DNA, 75 bp, Artificial Sequence
  Synthetic
ttgccagcaaatccgcctcctgcctctaccaatcgccagtcaggaaggcagccaacccctctgtctccacctttg

SEQ ID NO: 105239 - DNA, 75 bp, Artificial Sequence
  Synthetic
atgttagtattccttggactcacaaggtgggaaactttacggggctgtattcttctactatacctgtctttaatc

SEQ ID NO: 105240 - DNA, 75 bp, Artificial Sequence
  Synthetic
aactggatcctgcgggggacgtcctttgtctacgtcccgtcggcgctgaatcccgcggacgacccgtctcggggc

SEQ ID NO: 105241 - DNA, 75 bp, Artificial Sequence
  Synthetic
atacatctaaaccctaacaaaacaaaaagatggggttattcccttcactttatgggttatgtaatcggaagttgg

SEQ ID NO: 105242 - DNA, 75 bp, Artificial Sequence
  Synthetic
gattggaaggtatgtcagagaattgttggccttttaggctttgctgccccttttacgcaatgtggataccctgca

SEQ ID NO: 105243 - DNA, 75 bp, Artificial Sequence
  Synthetic
acacagtatctgaccctttaccccgttgttaggcaacggtcgggtgtgtgccaagtgtttgctgatgcaaccccc

SEQ ID NO: 105244 - DNA, 75 bp, Artificial Sequence
  Synthetic
tcgcggaagtatacgtcctttccatggctgctaggttgtgctgccaactggatactgcgcgggacgtcctttgtt

SEQ ID NO: 105245 - DNA, 75 bp, Artificial Sequence
  Synthetic
aattttcttttgtctttgggtatacatttaaaccctaacaaaacaaaaagatggggttattccctaaacttcatg

SEQ ID NO: 105246 - DNA, 75 bp, Artificial Sequence
  Synthetic
gctggtggctccagttcagggatagtgaaccctgttccgactattgcctctcacatctcgtcaatcttctccagg

SEQ ID NO: 105247 - DNA, 75 bp, Artificial Sequence
  Synthetic
tcgtttttgccttctgacttctttccttcagtacgagatcttctagataccgcctcagctctgtatcgggatgcc

SEQ ID NO: 105248 - DNA, 75 bp, Artificial Sequence
  Synthetic
cgtgttacaggcggggtttttcttgttgacaagaatcctcacaataccacagagtctagactcgtggtggacttc

SEQ ID NO: 105249 - DNA, 75 bp, Artificial Sequence
  Synthetic
cggagccctccagttcacggcatattgacaacactgccagtatcacctcctcctgcctacaccaatctcctctcg

SEQ ID NO: 105250 - DNA, 75 bp, Artificial Sequence
  Synthetic
gaaactttacggggctctattcttctactgtaccggtctttaatcctcagtggcaaactccttccttttctgaca

SEQ ID NO: 105251 - DNA, 75 bp, Artificial Sequence
  Synthetic
tctcctctcgggatgacaggctactcccatctctccacctctaatatacagtccccctcaggccatgcactggaa

SEQ ID NO: 105252 - DNA, 75 bp, Artificial Sequence
  Synthetic
tggagccctcaggctcagggcatattgacaacagtgccagcagcacctcctcctgcctccaccaatcggcagtca

SEQ ID NO: 105253 - DNA, 75 bp, Artificial Sequence
  Synthetic
taaaattaattatgcctgctagattttatcccagatctaccaaatatttgccgctagataaaggaatcaaatctt

SEQ ID NO: 105254 - DNA, 75 bp, Artificial Sequence
  Synthetic
ttttggcttagacattgacccttataaagaatttggagctactgtggagttgctctcgtttttgccttctgactt

SEQ ID NO: 105255 - DNA, 75 bp, Artificial Sequence
  Synthetic
ttccacaacattccaccaagctcaacaggatcccagagtaagaggcctgtatattcctgctggtggctccagttc

SEQ ID NO: 105256 - DNA, 75 bp, Artificial Sequence
  Synthetic
ttccacaacattccaccaagctcaacaggatcccagagtaagaggcctgtattttcctgctggtggctccagttc

SEQ ID NO: 105257 - DNA, 75 bp, Artificial Sequence
  Synthetic
ttccacaacattccaccaagctcaacaggatcccagagtaagaggcctgtatcttcctgctggtggctccagttc

SEQ ID NO: 105258 - DNA, 75 bp, Artificial Sequence
  Synthetic
ttccacaacattccaccaagctcaacaggatcccagagtaagaggcctgtatgttcctgctggtggctccagttc

SEQ ID NO: 105259 - DNA, 75 bp, Artificial Sequence
  Synthetic
ttccacaacattccaccaagctcaacaggatcccagagtaagtggcctgtatattcctgctggtggctccagttc

SEQ ID NO: 105260 - DNA, 75 bp, Artificial Sequence
  Synthetic
ttccacaacattccaccaagctcaacaggatcccagagtaagtggcctgtattttcctgctggtggctccagttc

SEQ ID NO: 105261 - DNA, 75 bp, Artificial Sequence
  Synthetic
ttccacaacattccaccaagctcaacaggatcccagagtaagtggcctgtatcttcctgctggtggctccagttc

SEQ ID NO: 105262 - DNA, 75 bp, Artificial Sequence
  Synthetic
ttccacaacattccaccaagctcaacaggatcccagagtaagtggcctgtatgttcctgctggtggctccagttc

SEQ ID NO: 105263 - DNA, 75 bp, Artificial Sequence
  Synthetic
ttccacaacattccaccaagctcaacaggatcccagagtaagcggcctgtatattcctgctggtggctccagttc

SEQ ID NO: 105264 - DNA, 75 bp, Artificial Sequence
  Synthetic
ttccacaacattccaccaagctcaacaggatcccagagtaagcggcctgtattttcctgctggtggctccagttc

SEQ ID NO: 105265 - DNA, 75 bp, Artificial Sequence
  Synthetic
ttccacaacattccaccaagctcaacaggatcccagagtaagcggcctgtatcttcctgctggtggctccagttc

SEQ ID NO: 105266 - DNA, 75 bp, Artificial Sequence
  Synthetic
ttccacaacattccaccaagctcaacaggatcccagagtaagcggcctgtatgttcctgctggtggctccagttc

SEQ ID NO: 105267 - DNA, 75 bp, Artificial Sequence
  Synthetic
ttccacaacattccaccaagctcaacaggatcccagagtaaggggcctgtatattcctgctggtggctccagttc

SEQ ID NO: 105268 - DNA, 75 bp, Artificial Sequence
  Synthetic
ttccacaacattccaccaagctcaacaggatcccagagtaaggggcctgtattttcctgctggtggctccagttc

SEQ ID NO: 105269 - DNA, 75 bp, Artificial Sequence
  Synthetic
ttccacaacattccaccaagctcaacaggatcccagagtaaggggcctgtatcttcctgctggtggctccagttc

SEQ ID NO: 105270 - DNA, 75 bp, Artificial Sequence
  Synthetic
ttccacaacattccaccaagctcaacaggatcccagagtaaggggcctgtatgttcctgctggtggctccagttc

SEQ ID NO: 105271 - DNA, 75 bp, Artificial Sequence
  Synthetic
ttccacaacattccaccaagctcatcaggatcccagagtaagaggcctgtatattcctgctggtggctccagttc

SEQ ID NO: 105272 - DNA, 75 bp, Artificial Sequence
  Synthetic
ttccacaacattccaccaagctcatcaggatcccagagtaagaggcctgtattttcctgctggtggctccagttc

SEQ ID NO: 105273 - DNA, 75 bp, Artificial Sequence
  Synthetic
ttccacaacattccaccaagctcatcaggatcccagagtaagaggcctgtatcttcctgctggtggctccagttc

SEQ ID NO: 105274 - DNA, 75 bp, Artificial Sequence
  Synthetic
ttccacaacattccaccaagctcatcaggatcccagagtaagaggcctgtatgttcctgctggtggctccagttc

SEQ ID NO: 105275 - DNA, 75 bp, Artificial Sequence
  Synthetic
ttccacaacattccaccaagctcatcaggatcccagagtaagtggcctgtatattcctgctggtggctccagttc

SEQ ID NO: 105276 - DNA, 75 bp, Artificial Sequence
  Synthetic
ttccacaacattccaccaagctcatcaggatcccagagtaagtggcctgtattttcctgctggtggctccagttc

SEQ ID NO: 105277 - DNA, 75 bp, Artificial Sequence
  Synthetic
ttccacaacattccaccaagctcatcaggatcccagagtaagtggcctgtatcttcctgctggtggctccagttc

SEQ ID NO: 105278 - DNA, 75 bp, Artificial Sequence
  Synthetic
ttccacaacattccaccaagctcatcaggatcccagagtaagtggcctgtatgttcctgctggtggctccagttc

SEQ ID NO: 105279 - DNA, 75 bp, Artificial Sequence
  Synthetic
ttccacaacattccaccaagctcatcaggatcccagagtaagcggcctgtatattcctgctggtggctccagttc

SEQ ID NO: 105280 - DNA, 75 bp, Artificial Sequence
  Synthetic
ttccacaacattccaccaagctcatcaggatcccagagtaagcggcctgtattttcctgctggtggctccagttc

SEQ ID NO: 105281 - DNA, 75 bp, Artificial Sequence
  Synthetic
ttccacaacattccaccaagctcatcaggatcccagagtaagcggcctgtatcttcctgctggtggctccagttc

SEQ ID NO: 105282 - DNA, 75 bp, Artificial Sequence
  Synthetic
ttccacaacattccaccaagctcatcaggatcccagagtaagcggcctgtatgttcctgctggtggctccagttc

SEQ ID NO: 105283 - DNA, 75 bp, Artificial Sequence
  Synthetic
ttccacaacattccaccaagctcatcaggatcccagagtaaggggcctgtatattcctgctggtggctccagttc

SEQ ID NO: 105284 - DNA, 75 bp, Artificial Sequence
  Synthetic
ttccacaacattccaccaagctcatcaggatcccagagtaaggggcctgtattttcctgctggtggctccagttc

SEQ ID NO: 105285 - DNA, 75 bp, Artificial Sequence
  Synthetic
ttccacaacattccaccaagctcatcaggatcccagagtaaggggcctgtatcttcctgctggtggctccagttc

SEQ ID NO: 105286 - DNA, 75 bp, Artificial Sequence
  Synthetic
ttccacaacattccaccaagctcatcaggatcccagagtaaggggcctgtatgttcctgctggtggctccagttc

SEQ ID NO: 105287 - DNA, 75 bp, Artificial Sequence
  Synthetic
ttccacaacattccaccaagctcaccaggatcccagagtaagaggcctgtatattcctgctggtggctccagttc

SEQ ID NO: 105288 - DNA, 75 bp, Artificial Sequence
  Synthetic
ttccacaacattccaccaagctcaccaggatcccagagtaagaggcctgtattttcctgctggtggctccagttc

SEQ ID NO: 105289 - DNA, 75 bp, Artificial Sequence
  Synthetic
ttccacaacattccaccaagctcaccaggatcccagagtaagaggcctgtatcttcctgctggtggctccagttc

SEQ ID NO: 105290 - DNA, 75 bp, Artificial Sequence
  Synthetic
ttccacaacattccaccaagctcaccaggatcccagagtaagaggcctgtatgttcctgctggtggctccagttc

SEQ ID NO: 105291 - DNA, 75 bp, Artificial Sequence
  Synthetic
ttccacaacattccaccaagctcaccaggatcccagagtaagtggcctgtatattcctgctggtggctccagttc

SEQ ID NO: 105292 - DNA, 75 bp, Artificial Sequence
  Synthetic
ttccacaacattccaccaagctcaccaggatcccagagtaagtggcctgtattttcctgctggtggctccagttc

SEQ ID NO: 105293 - DNA, 75 bp, Artificial Sequence
  Synthetic
ttccacaacattccaccaagctcaccaggatcccagagtaagtggcctgtatcttcctgctggtggctccagttc

SEQ ID NO: 105294 - DNA, 75 bp, Artificial Sequence
  Synthetic
ttccacaacattccaccaagctcaccaggatcccagagtaagtggcctgtatgttcctgctggtggctccagttc

SEQ ID NO: 105295 - DNA, 75 bp, Artificial Sequence
  Synthetic
ttccacaacattccaccaagctcaccaggatcccagagtaagcggcctgtatattcctgctggtggctccagttc

SEQ ID NO: 105296 - DNA, 75 bp, Artificial Sequence
  Synthetic
ttccacaacattccaccaagctcaccaggatcccagagtaagcggcctgtattttcctgctggtggctccagttc

SEQ ID NO: 105297 - DNA, 75 bp, Artificial Sequence
  Synthetic
ttccacaacattccaccaagctcaccaggatcccagagtaagcggcctgtatcttcctgctggtggctccagttc

SEQ ID NO: 105298 - DNA, 75 bp, Artificial Sequence
  Synthetic
ttccacaacattccaccaagctcaccaggatcccagagtaagcggcctgtatgttcctgctggtggctccagttc

SEQ ID NO: 105299 - DNA, 75 bp, Artificial Sequence
  Synthetic
ttccacaacattccaccaagctcaccaggatcccagagtaaggggcctgtatattcctgctggtggctccagttc

SEQ ID NO: 105300 - DNA, 75 bp, Artificial Sequence
  Synthetic
ttccacaacattccaccaagctcaccaggatcccagagtaaggggcctgtattttcctgctggtggctccagttc

SEQ ID NO: 105301 - DNA, 75 bp, Artificial Sequence
  Synthetic
ttccacaacattccaccaagctcaccaggatcccagagtaaggggcctgtatcttcctgctggtggctccagttc

SEQ ID NO: 105302 - DNA, 75 bp, Artificial Sequence
  Synthetic
ttccacaacattccaccaagctcaccaggatcccagagtaaggggcctgtatgttcctgctggtggctccagttc

SEQ ID NO: 105303 - DNA, 75 bp, Artificial Sequence
  Synthetic
ttccacaacattccaccaagctcagcaggatcccagagtaagaggcctgtatattcctgctggtggctccagttc

SEQ ID NO: 105304 - DNA, 75 bp, Artificial Sequence
  Synthetic
ttccacaacattccaccaagctcagcaggatcccagagtaagaggcctgtattttcctgctggtggctccagttc

SEQ ID NO: 105305 - DNA, 75 bp, Artificial Sequence
  Synthetic
ttccacaacattccaccaagctcagcaggatcccagagtaagaggcctgtatcttcctgctggtggctccagttc

SEQ ID NO: 105306 - DNA, 75 bp, Artificial Sequence
  Synthetic
ttccacaacattccaccaagctcagcaggatcccagagtaagaggcctgtatgttcctgctggtggctccagttc

SEQ ID NO: 105307 - DNA, 75 bp, Artificial Sequence
  Synthetic
ttccacaacattccaccaagctcagcaggatcccagagtaagtggcctgtatattcctgctggtggctccagttc

SEQ ID NO: 105308 - DNA, 75 bp, Artificial Sequence
  Synthetic
ttccacaacattccaccaagctcagcaggatcccagagtaagtggcctgtattttcctgctggtggctccagttc

SEQ ID NO: 105309 - DNA, 75 bp, Artificial Sequence
  Synthetic
ttccacaacattccaccaagctcagcaggatcccagagtaagtggcctgtatcttcctgctggtggctccagttc

SEQ ID NO: 105310 - DNA, 75 bp, Artificial Sequence
  Synthetic
ttccacaacattccaccaagctcagcaggatcccagagtaagtggcctgtatgttcctgctggtggctccagttc

SEQ ID NO: 105311 - DNA, 75 bp, Artificial Sequence
  Synthetic
ttccacaacattccaccaagctcagcaggatcccagagtaagcggcctgtatattcctgctggtggctccagttc

SEQ ID NO: 105312 - DNA, 75 bp, Artificial Sequence
  Synthetic
ttccacaacattccaccaagctcagcaggatcccagagtaagcggcctgtattttcctgctggtggctccagttc

SEQ ID NO: 105313 - DNA, 75 bp, Artificial Sequence
  Synthetic
ttccacaacattccaccaagctcagcaggatcccagagtaagcggcctgtatcttcctgctggtggctccagttc

SEQ ID NO: 105314 - DNA, 75 bp, Artificial Sequence
  Synthetic
ttccacaacattccaccaagctcagcaggatcccagagtaagcggcctgtatgttcctgctggtggctccagttc

SEQ ID NO: 105315 - DNA, 75 bp, Artificial Sequence
  Synthetic
ttccacaacattccaccaagctcagcaggatcccagagtaaggggcctgtatattcctgctggtggctccagttc

SEQ ID NO: 105316 - DNA, 75 bp, Artificial Sequence
  Synthetic
ttccacaacattccaccaagctcagcaggatcccagagtaaggggcctgtattttcctgctggtggctccagttc

SEQ ID NO: 105317 - DNA, 75 bp, Artificial Sequence
  Synthetic
ttccacaacattccaccaagctcagcaggatcccagagtaaggggcctgtatcttcctgctggtggctccagttc

SEQ ID NO: 105318 - DNA, 75 bp, Artificial Sequence
  Synthetic
ttccacaacattccaccaagctcagcaggatcccagagtaaggggcctgtatgttcctgctggtggctccagttc

SEQ ID NO: 105319 - DNA, 75 bp, Artificial Sequence
  Synthetic
ttcgcctcaccatacagcactcaggcaagcaattctgtgctggggtgagttgatgactctagctacctgggtggg

SEQ ID NO: 105320 - DNA, 75 bp, Artificial Sequence
  Synthetic
agagtctccggaacattgaacacctcaccatacggcactcaggcaagctattatgtggtggggtgagttaatgaa

SEQ ID NO: 105321 - DNA, 75 bp, Artificial Sequence
  Synthetic
agagtctccggaacattgaacacctcaccatacggcactcaggcaagctattttgtggtggggtgagttaatgaa

SEQ ID NO: 105322 - DNA, 75 bp, Artificial Sequence
  Synthetic
agagtctccggaacattgaacacctcaccatacggcactcaggcaagctattctgtggtggggtgagttaatgaa

SEQ ID NO: 105323 - DNA, 75 bp, Artificial Sequence
  Synthetic
agagtctccggaacattgaacacctcaccatacggcactcaggcaagctattgtgtggtggggtgagttaatgaa

SEQ ID NO: 105324 - DNA, 75 bp, Artificial Sequence
  Synthetic
agagtctccggaacattgaactcctcaccatacggcactcaggcaagctattatgtggtggggtgagttaatgaa

SEQ ID NO: 105325 - DNA, 75 bp, Artificial Sequence
  Synthetic
agagtctccggaacattgaactcctcaccatacggcactcaggcaagctattttgtggtggggtgagttaatgaa

SEQ ID NO: 105326 - DNA, 75 bp, Artificial Sequence
  Synthetic
agagtctccggaacattgaactcctcaccatacggcactcaggcaagctattctgtggtggggtgagttaatgaa

SEQ ID NO: 105327 - DNA, 75 bp, Artificial Sequence
  Synthetic
agagtctccggaacattgaactcctcaccatacggcactcaggcaagctattgtgtggtggggtgagttaatgaa

SEQ ID NO: 105328 - DNA, 75 bp, Artificial Sequence
  Synthetic
agagtctccggaacattgaacccctcaccatacggcactcaggcaagctattatgtggtggggtgagttaatgaa

SEQ ID NO: 105329 - DNA, 75 bp, Artificial Sequence
  Synthetic
agagtctccggaacattgaacccctcaccatacggcactcaggcaagctattttgtggtggggtgagttaatgaa

SEQ ID NO: 105330 - DNA, 75 bp, Artificial Sequence
  Synthetic
agagtctccggaacattgaacccctcaccatacggcactcaggcaagctattctgtggtggggtgagttaatgaa

SEQ ID NO: 105331 - DNA, 75 bp, Artificial Sequence
  Synthetic
agagtctccggaacattgaacccctcaccatacggcactcaggcaagctattgtgtggtggggtgagttaatgaa

SEQ ID NO: 105332 - DNA, 75 bp, Artificial Sequence
  Synthetic
agagtctccggaacattgaacgcctcaccatacggcactcaggcaagctattatgtggtggggtgagttaatgaa

SEQ ID NO: 105333 - DNA, 75 bp, Artificial Sequence
  Synthetic
agagtctccggaacattgaacgcctcaccatacggcactcaggcaagctattttgtggtggggtgagttaatgaa

SEQ ID NO: 105334 - DNA, 75 bp, Artificial Sequence
  Synthetic
agagtctccggaacattgaacgcctcaccatacggcactcaggcaagctattctgtggtggggtgagttaatgaa

SEQ ID NO: 105335 - DNA, 75 bp, Artificial Sequence
  Synthetic
agagtctccggaacattgaacgcctcaccatacggcactcaggcaagctattgtgtggtggggtgagttaatgaa

SEQ ID NO: 105336 - DNA, 75 bp, Artificial Sequence
  Synthetic
agagtctccggaacattgtacacctcaccatacggcactcaggcaagctattatgtggtggggtgagttaatgaa

SEQ ID NO: 105337 - DNA, 75 bp, Artificial Sequence
  Synthetic
agagtctccggaacattgtacacctcaccatacggcactcaggcaagctattttgtggtggggtgagttaatgaa

SEQ ID NO: 105338 - DNA, 75 bp, Artificial Sequence
  Synthetic
agagtctccggaacattgtacacctcaccatacggcactcaggcaagctattctgtggtggggtgagttaatgaa

SEQ ID NO: 105339 - DNA, 75 bp, Artificial Sequence
  Synthetic
agagtctccggaacattgtacacctcaccatacggcactcaggcaagctattgtgtggtggggtgagttaatgaa

SEQ ID NO: 105340 - DNA, 75 bp, Artificial Sequence
  Synthetic
agagtctccggaacattgtactcctcaccatacggcactcaggcaagctattatgtggtggggtgagttaatgaa

SEQ ID NO: 105341 - DNA, 75 bp, Artificial Sequence
  Synthetic
agagtctccggaacattgtactcctcaccatacggcactcaggcaagctattttgtggtggggtgagttaatgaa

SEQ ID NO: 105342 - DNA, 75 bp, Artificial Sequence
  Synthetic
agagtctccggaacattgtactcctcaccatacggcactcaggcaagctattctgtggtggggtgagttaatgaa

SEQ ID NO: 105343 - DNA, 75 bp, Artificial Sequence
  Synthetic
agagtctccggaacattgtactcctcaccatacggcactcaggcaagctattgtgtggtggggtgagttaatgaa

SEQ ID NO: 105344 - DNA, 75 bp, Artificial Sequence
  Synthetic
agagtctccggaacattgtacccctcaccatacggcactcaggcaagctattatgtggtggggtgagttaatgaa

SEQ ID NO: 105345 - DNA, 75 bp, Artificial Sequence
  Synthetic
agagtctccggaacattgtacccctcaccatacggcactcaggcaagctattttgtggtggggtgagttaatgaa

SEQ ID NO: 105346 - DNA, 75 bp, Artificial Sequence
  Synthetic
agagtctccggaacattgtacccctcaccatacggcactcaggcaagctattctgtggtggggtgagttaatgaa

SEQ ID NO: 105347 - DNA, 75 bp, Artificial Sequence
  Synthetic
agagtctccggaacattgtacccctcaccatacggcactcaggcaagctattgtgtggtggggtgagttaatgaa

SEQ ID NO: 105348 - DNA, 75 bp, Artificial Sequence
  Synthetic
agagtctccggaacattgtacgcctcaccatacggcactcaggcaagctattatgtggtggggtgagttaatgaa

SEQ ID NO: 105349 - DNA, 75 bp, Artificial Sequence
  Synthetic
agagtctccggaacattgtacgcctcaccatacggcactcaggcaagctattttgtggtggggtgagttaatgaa

SEQ ID NO: 105350 - DNA, 75 bp, Artificial Sequence
  Synthetic
agagtctccggaacattgtacgcctcaccatacggcactcaggcaagctattctgtggtggggtgagttaatgaa

SEQ ID NO: 105351 - DNA, 75 bp, Artificial Sequence
  Synthetic
agagtctccggaacattgtacgcctcaccatacggcactcaggcaagctattgtgtggtggggtgagttaatgaa

SEQ ID NO: 105352 - DNA, 75 bp, Artificial Sequence
  Synthetic
agagtctccggaacattgcacacctcaccatacggcactcaggcaagctattatgtggtggggtgagttaatgaa

SEQ ID NO: 105353 - DNA, 75 bp, Artificial Sequence
  Synthetic
agagtctccggaacattgcacacctcaccatacggcactcaggcaagctattttgtggtggggtgagttaatgaa

SEQ ID NO: 105354 - DNA, 75 bp, Artificial Sequence
  Synthetic
agagtctccggaacattgcacacctcaccatacggcactcaggcaagctattctgtggtggggtgagttaatgaa

SEQ ID NO: 105355 - DNA, 75 bp, Artificial Sequence
  Synthetic
agagtctccggaacattgcacacctcaccatacggcactcaggcaagctattgtgtggtggggtgagttaatgaa

SEQ ID NO: 105356 - DNA, 75 bp, Artificial Sequence
  Synthetic
agagtctccggaacattgcactcctcaccatacggcactcaggcaagctattatgtggtggggtgagttaatgaa

SEQ ID NO: 105357 - DNA, 75 bp, Artificial Sequence
  Synthetic
agagtctccggaacattgcactcctcaccatacggcactcaggcaagctattttgtggtggggtgagttaatgaa

SEQ ID NO: 105358 - DNA, 75 bp, Artificial Sequence
  Synthetic
agagtctccggaacattgcactcctcaccatacggcactcaggcaagctattctgtggtggggtgagttaatgaa

SEQ ID NO: 105359 - DNA, 75 bp, Artificial Sequence
  Synthetic
agagtctccggaacattgcactcctcaccatacggcactcaggcaagctattgtgtggtggggtgagttaatgaa

SEQ ID NO: 105360 - DNA, 75 bp, Artificial Sequence
  Synthetic
agagtctccggaacattgcacccctcaccatacggcactcaggcaagctattatgtggtggggtgagttaatgaa

SEQ ID NO: 105361 - DNA, 75 bp, Artificial Sequence
  Synthetic
agagtctccggaacattgcacccctcaccatacggcactcaggcaagctattttgtggtggggtgagttaatgaa

SEQ ID NO: 105362 - DNA, 75 bp, Artificial Sequence
  Synthetic
agagtctccggaacattgcacccctcaccatacggcactcaggcaagctattctgtggtggggtgagttaatgaa

SEQ ID NO: 105363 - DNA, 75 bp, Artificial Sequence
  Synthetic
agagtctccggaacattgcacccctcaccatacggcactcaggcaagctattgtgtggtggggtgagttaatgaa

SEQ ID NO: 105364 - DNA, 75 bp, Artificial Sequence
  Synthetic
agagtctccggaacattgcacgcctcaccatacggcactcaggcaagctattatgtggtggggtgagttaatgaa

SEQ ID NO: 105365 - DNA, 75 bp, Artificial Sequence
  Synthetic
agagtctccggaacattgcacgcctcaccatacggcactcaggcaagctattttgtggtggggtgagttaatgaa

SEQ ID NO: 105366 - DNA, 75 bp, Artificial Sequence
  Synthetic
agagtctccggaacattgcacgcctcaccatacggcactcaggcaagctattctgtggtggggtgagttaatgaa

SEQ ID NO: 105367 - DNA, 75 bp, Artificial Sequence
  Synthetic
agagtctccggaacattgcacgcctcaccatacggcactcaggcaagctattgtgtggtggggtgagttaatgaa

SEQ ID NO: 105368 - DNA, 75 bp, Artificial Sequence
  Synthetic
agagtctccggaacattggacacctcaccatacggcactcaggcaagctattatgtggtggggtgagttaatgaa

SEQ ID NO: 105369 - DNA, 75 bp, Artificial Sequence
  Synthetic
agagtctccggaacattggacacctcaccatacggcactcaggcaagctattttgtggtggggtgagttaatgaa

SEQ ID NO: 105370 - DNA, 75 bp, Artificial Sequence
  Synthetic
agagtctccggaacattggacacctcaccatacggcactcaggcaagctattctgtggtggggtgagttaatgaa

SEQ ID NO: 105371 - DNA, 75 bp, Artificial Sequence
  Synthetic
agagtctccggaacattggacacctcaccatacggcactcaggcaagctattgtgtggtggggtgagttaatgaa

SEQ ID NO: 105372 - DNA, 75 bp, Artificial Sequence
  Synthetic
agagtctccggaacattggactcctcaccatacggcactcaggcaagctattatgtggtggggtgagttaatgaa

SEQ ID NO: 105373 - DNA, 75 bp, Artificial Sequence
  Synthetic
agagtctccggaacattggactcctcaccatacggcactcaggcaagctattttgtggtggggtgagttaatgaa

SEQ ID NO: 105374 - DNA, 75 bp, Artificial Sequence
  Synthetic
agagtctccggaacattggactcctcaccatacggcactcaggcaagctattctgtggtggggtgagttaatgaa

SEQ ID NO: 105375 - DNA, 75 bp, Artificial Sequence
  Synthetic
agagtctccggaacattggactcctcaccatacggcactcaggcaagctattgtgtggtggggtgagttaatgaa

SEQ ID NO: 105376 - DNA, 75 bp, Artificial Sequence
  Synthetic
agagtctccggaacattggacccctcaccatacggcactcaggcaagctattatgtggtggggtgagttaatgaa

SEQ ID NO: 105377 - DNA, 75 bp, Artificial Sequence
  Synthetic
agagtctccggaacattggacccctcaccatacggcactcaggcaagctattttgtggtggggtgagttaatgaa

SEQ ID NO: 105378 - DNA, 75 bp, Artificial Sequence
  Synthetic
agagtctccggaacattggacccctcaccatacggcactcaggcaagctattctgtggtggggtgagttaatgaa

SEQ ID NO: 105379 - DNA, 75 bp, Artificial Sequence
  Synthetic
agagtctccggaacattggacccctcaccatacggcactcaggcaagctattgtgtggtggggtgagttaatgaa

SEQ ID NO: 105380 - DNA, 75 bp, Artificial Sequence
  Synthetic
agagtctccggaacattggacgcctcaccatacggcactcaggcaagctattatgtggtggggtgagttaatgaa

SEQ ID NO: 105381 - DNA, 75 bp, Artificial Sequence
  Synthetic
agagtctccggaacattggacgcctcaccatacggcactcaggcaagctattttgtggtggggtgagttaatgaa

SEQ ID NO: 105382 - DNA, 75 bp, Artificial Sequence
  Synthetic
agagtctccggaacattggacgcctcaccatacggcactcaggcaagctattctgtggtggggtgagttaatgaa

SEQ ID NO: 105383 - DNA, 75 bp, Artificial Sequence
  Synthetic
agagtctccggaacattggacgcctcaccatacggcactcaggcaagctattgtgtggtggggtgagttaatgaa

SEQ ID NO: 105384 - DNA, 75 bp, Artificial Sequence
  Synthetic
gtgccagcagtccctcctcctgcctccaccaatcggcactcagggaggcagcctactcccatttctcccccgttg

SEQ ID NO: 105385 - DNA, 75 bp, Artificial Sequence
  Synthetic
ggaagccttagagtctcctgagcattgctcacctcaccatactgcactcaggcaagcaattctgtgctgggggga

SEQ ID NO: 105386 - DNA, 75 bp, Artificial Sequence
  Synthetic
acctttgtggctcctctgccgatccatactgcggaactcctagcagcttgttttgctcgcagccggtctggagcg

SEQ ID NO: 105387 - DNA, 75 bp, Artificial Sequence
  Synthetic
tagttaatcattacttccaaaccagacattatttacatactctttggaaggctggtattctatataagagggaaa

SEQ ID NO: 105388 - DNA, 75 bp, Artificial Sequence
  Synthetic
agcactcaggcaagccatatggtgttgggaagactttatatctttggcttcatgggtgggcaatgaattggaaga

SEQ ID NO: 105389 - DNA, 75 bp, Artificial Sequence
  Synthetic
ttttttgccttctgacttctttcctaatattcgagatctcctcgacaccgcctctgctctgtatcgggaggcctt

SEQ ID NO: 105390 - DNA, 75 bp, Artificial Sequence
  Synthetic
aacaatttgtgggtcctcttacagtaaatgagaaaagaagattaaatctcattatgcctgccaggttctatccca

SEQ ID NO: 105391 - DNA, 75 bp, Artificial Sequence
  Synthetic
atacatttaaaccctcacaaaacaaaaagatggggctactcccttaacttcatggggtatgtaattggaagttgg

SEQ ID NO: 105392 - DNA, 75 bp, Artificial Sequence
  Synthetic
ggacattattaatagatgtcaacaatttgtgggccctcttactgtaaatgaaaaaaggagattaaaattaattat

SEQ ID NO: 105393 - DNA, 75 bp, Artificial Sequence
  Synthetic
acaatgccagcaaatccccctcctgcctccaacaagcggcagtcagggagacagcctacccctctctctccacct

SEQ ID NO: 105394 - DNA, 75 bp, Artificial Sequence
  Synthetic
tattcccatcccatcatcctgggctttcgcaagattcctatgggagtgggcctcagtccgttcctcctggctcag

SEQ ID NO: 105395 - DNA, 75 bp, Artificial Sequence
  Synthetic
tcggcaggtaggaaggcagcctactcccctttctccacctctaagagacactcatcctcaagccatgcaatggaa

SEQ ID NO: 105396 - DNA, 75 bp, Artificial Sequence
  Synthetic
ctccacaactttccatcaagctctgctagatccccgagtaaggggcctttatcttcctgctggtggctccagttc

SEQ ID NO: 105397 - DNA, 75 bp, Artificial Sequence
  Synthetic
cagggatgacttagagtcaccggaacattgcaccgcccatcataccgctctcaggcaagctattgtgtgttgggg

SEQ ID NO: 105398 - DNA, 75 bp, Artificial Sequence
  Synthetic
agtggcaaactccctcttttcctgacattcatttgcgggaagacattatcgataggtgtcaacaatatgtgggac

SEQ ID NO: 105399 - DNA, 75 bp, Artificial Sequence
  Synthetic
tacagcatgggaggttggtcttccaaacctcgaaaaggcatggggacaaatctttctgtccccaatcccctggga

SEQ ID NO: 105400 - DNA, 75 bp, Artificial Sequence
  Synthetic
ggatcattgccgcaagatcatatcagacacaaaatcaaagaatgtttcagaaaactccctgttaacaggcccatt

SEQ ID NO: 105401 - DNA, 75 bp, Artificial Sequence
  Synthetic
attcgtgggaacaagatctacatcatggggctttcgtggacggtccctctcgagtggggaaagaatctttctacc

SEQ ID NO: 105402 - DNA, 75 bp, Artificial Sequence
  Synthetic
actggctggggcttggccataggccatcagcgcatgcggggaacctttgtggctcctctgccgatccatactgcg

SEQ ID NO: 105403 - DNA, 75 bp, Artificial Sequence
  Synthetic
taaaattaatcatgcctgctagattctatcctaattctaccaaatatttgcccccagacaaaggtattaaacctt

SEQ ID NO: 105404 - DNA, 75 bp, Artificial Sequence
  Synthetic
ggaggccttagagtctccggaacattgttcacctcaccatacagcactcaggcaagctattctgtgttggggtga

SEQ ID NO: 105405 - DNA, 75 bp, Artificial Sequence
  Synthetic
gaccatcagctggatcctctattcagggcaaattccagcagtcccgattgggacttcaacaaaaacaaggacaat

SEQ ID NO: 105406 - DNA, 75 bp, Artificial Sequence
  Synthetic
cacaaccttccaccaaactctgcaagatcccagagtgagaggcctgtatttccctgctggtggctccagttcagg

SEQ ID NO: 105407 - DNA, 75 bp, Artificial Sequence
  Synthetic
ttgccagcaaatccgcctcctgcctccaccaatcgccagtcaggaaggcagcctaccccgctgtctccacctttg

SEQ ID NO: 105408 - DNA, 75 bp, Artificial Sequence
  Synthetic
gcgccagcagttcctcctcctgtctctaccaatcgtcagaacaggagcagcccactcctatctctccacctttta

SEQ ID NO: 105409 - DNA, 75 bp, Artificial Sequence
  Synthetic
ttccaccacgttccaccaaactcttcaagattccacagtcaggactctgaaccttcctgctggtggctccagttc

SEQ ID NO: 105410 - DNA, 75 bp, Artificial Sequence
  Synthetic
tgcacaagaggactcttggactttcagtactgtcaacatccggaattgagacatacttcaaagactgtgtattta

SEQ ID NO: 105411 - DNA, 75 bp, Artificial Sequence
  Synthetic
tcctgccttgatgcctttgtatgcatgtatacaagctaaacaggctttcactttctcgccaacttacaaggcctt

SEQ ID NO: 105412 - DNA, 75 bp, Artificial Sequence
  Synthetic
tggccaggagcaaatcaggtaggaacaggagcatttgggccagggttcaccccaccacacggaggtttgttgggg

SEQ ID NO: 105413 - DNA, 75 bp, Artificial Sequence
  Synthetic
tctggcttcctgggtgggcaataatttggaggacccagcatctagggaattagtggtcaattatgtcaataccaa

SEQ ID NO: 105414 - DNA, 75 bp, Artificial Sequence
  Synthetic
taaaaattagacaattactgtggtttcacatttcctgccttacttttggaagagaaacagttcttgagtatttgg

SEQ ID NO: 105415 - DNA, 75 bp, Artificial Sequence
  Synthetic
tccggaacagtgaaccctgttccgactactgcctcacccatatcgtcaatcttctcgaggactggggaccctgca

SEQ ID NO: 105416 - DNA, 75 bp, Artificial Sequence
  Synthetic
ttcacttgcaccaagatgttattaacaagtgtgaacaatttgtgggtcctctcacagtaaatgaaaagcgtaggt

SEQ ID NO: 105417 - DNA, 75 bp, Artificial Sequence
  Synthetic
attatccagagcacgtggttaatcattatttccaaaccagacactatttgcatactttgtggaaggcgggaatct

SEQ ID NO: 105418 - DNA, 75 bp, Artificial Sequence
  Synthetic
gtggtggacttctctcaattttctagggggaacacccgtgtgtcttggccaaaattcgcagtcccaaatctccag

SEQ ID NO: 105419 - DNA, 75 bp, Artificial Sequence
  Synthetic
cctcctcctgccactaccaatcggcagtcagggagaaagcctactcccatatctccacctctgagagacagtcat

SEQ ID NO: 105420 - DNA, 75 bp, Artificial Sequence
  Synthetic
tttcttgcctgctgacttctatccgtcggttcgagatctcctagataccgccgctgctttgtatcgggaagcctt

SEQ ID NO: 105421 - DNA, 75 bp, Artificial Sequence
  Synthetic
ttccacaacattccaccaagctctgcaggatcccagagtaagaggcctgcctgctggtggctccagttccggaac

SEQ ID NO: 105422 - DNA, 75 bp, Artificial Sequence
  Synthetic
gattggaaggtgtgtcaacgaattgtgggtcttttgggctttgctgccccttttacacaatgtgggtatcctgct

SEQ ID NO: 105423 - DNA, 75 bp, Artificial Sequence
  Synthetic
tcggcagtcaggaaggaagcctactccaatctctccacctttgagagacactcatcctcaggccatgaggtggaa

SEQ ID NO: 105424 - DNA, 75 bp, Artificial Sequence
  Synthetic
tactgcctctcccatatcgtcaatcttctcgaggactggggaccctgcaccgaacatggagagcacaacatcagg

SEQ ID NO: 105425 - DNA, 75 bp, Artificial Sequence
  Synthetic
gaactcctagccgcttgttttgctcgcagccggtctggggcaaacattatcgggactgataactctgttgttctc

SEQ ID NO: 105426 - DNA, 75 bp, Artificial Sequence
  Synthetic
tgcctccaccaatcggcagtaggaagacagcctactcccatctctccacctctgagagacagttatcctcaggcc

SEQ ID NO: 105427 - DNA, 75 bp, Artificial Sequence
  Synthetic
cgggaggccttagagtctccggaacattgttcacctcaccatacagcactcaggcaagctattctgtgttggggt

SEQ ID NO: 105428 - DNA, 75 bp, Artificial Sequence
  Synthetic
gcatggagaccaccgtgaacgcccacaggaacctgcccaaggtcttgcataagaggactcttggactttcagcaa

SEQ ID NO: 105429 - DNA, 75 bp, Artificial Sequence
  Synthetic
aactatgtcaacgttaatatgggcataaaaatcagacaactattgtggtttcacatttcctgtcttacttttggg

SEQ ID NO: 105430 - DNA, 75 bp, Artificial Sequence
  Synthetic
aactatgtcaacgttaatatgggcttaaaaatcagacaactattgtggtttcacatttcctgtcttacttttggg

SEQ ID NO: 105431 - DNA, 75 bp, Artificial Sequence
  Synthetic
aactatgtcaacgttaatatgggcctaaaaatcagacaactattgtggtttcacatttcctgtcttacttttggg

SEQ ID NO: 105432 - DNA, 75 bp, Artificial Sequence
  Synthetic
aactatgtcaacgttaatatgggcgtaaaaatcagacaactattgtggtttcacatttcctgtcttacttttggg

SEQ ID NO: 105433 - DNA, 75 bp, Artificial Sequence
  Synthetic
tattttcctgctggtggctccagttccggaacagtaaaccctgttccgactactgcctcacccatatcgtcaatc

SEQ ID NO: 105434 - DNA, 75 bp, Artificial Sequence
  Synthetic
ttccacaactttccaccaagctctacaagatcccagggtcaggggcctgtatttccctgctggtggctccaattc

SEQ ID NO: 105435 - DNA, 75 bp, Artificial Sequence
  Synthetic
ctccactcagttccaccagactctgttagatccgagagtaagggctgctggtggctccagttcagagacacagaa

SEQ ID NO: 105436 - DNA, 75 bp, Artificial Sequence
  Synthetic
cctctctttacgcggtctccccgtctgtgccttctcatctgccggtccgtgtgcacttcgcttcacctctgcacg

SEQ ID NO: 105437 - DNA, 75 bp, Artificial Sequence
  Synthetic
agtggatgggggttggccataggccatcggcgcaggcgaggaacctttgtggctcctctggagatccatagtgtg

SEQ ID NO: 105438 - DNA, 75 bp, Artificial Sequence
  Synthetic
aaattaattatgcctgctaggttttatcctaaccttaccaaatatttgcccttggataaaggcattaaaccttat

SEQ ID NO: 105439 - DNA, 75 bp, Artificial Sequence
  Synthetic
aaatctgtgcagcatcttgagtccctttataccgctgttaccaattttctgttatctgtgggtatccatttaaat

SEQ ID NO: 105440 - DNA, 75 bp, Artificial Sequence
  Synthetic
catctgccgttccggccgaccacggggcgcacctctctttacgcggtctccccgtctgtgccttctcatctgccg

SEQ ID NO: 105441 - DNA, 75 bp, Artificial Sequence
  Synthetic
tcgcggaaatatacatcctttccatggctgctaggctgtactgccaactggattcttcgcgggacgtcctttgtt

SEQ ID NO: 105442 - DNA, 75 bp, Artificial Sequence
  Synthetic
ttctttccttcagtacgagatcttctagataccgcctcagctctatatcgggaagccttagagtctcctgagcat

SEQ ID NO: 105443 - DNA, 75 bp, Artificial Sequence
  Synthetic
tacgtccggtcgccgttgtatcccgccggtggcccatgtcggggccggttgggtcttttcggtccccttcttctt

SEQ ID NO: 105444 - DNA, 75 bp, Artificial Sequence
  Synthetic
ggacccggcgttcggagccaactcaaacaatccagattgggacttcaaccccaacaaggatcactggccagaggc

SEQ ID NO: 105445 - DNA, 75 bp, Artificial Sequence
  Synthetic
aacctttaccccgttgctcggcaacggccaggcctgtgccaagtgtttgctgacgcaacccccactggttggggc

SEQ ID NO: 105446 - DNA, 75 bp, Artificial Sequence
  Synthetic
gtatttggtgtctttcggagtgtggattcgcactcctccagcttatagaccagcaaatgcccctatcttatcaac

SEQ ID NO: 105447 - DNA, 75 bp, Artificial Sequence
  Synthetic
catgggcctaaaaatcaggcaactattgtggtttcatatttcttgtctcacttttggaagacaaactgtacttga

SEQ ID NO: 105448 - DNA, 75 bp, Artificial Sequence
  Synthetic
tttgtactaggaggctgtaggcataaattggtctgcgcaccagcaccatgcaactttttcacctctgcctaatca

SEQ ID NO: 105449 - DNA, 75 bp, Artificial Sequence
  Synthetic
ctcctgcctctaccaatcgccagtcaggaaggcagcctacccctctgtctccacctttgagaaacactcatcctc

SEQ ID NO: 105450 - DNA, 75 bp, Artificial Sequence
  Synthetic
caccaaactctgcaagatcccagagtgagaggcctgtatttccctgctggtggctccagttcaggaacagtaaac

SEQ ID NO: 105451 - DNA, 75 bp, Artificial Sequence
  Synthetic
taaggtgggaaactttactgggctttattcttctactgtacctgtctttaaccctgagtggcaaactccctcctt

SEQ ID NO: 105452 - DNA, 75 bp, Artificial Sequence
  Synthetic
atacatttgaatccccacaaaacaaaaagatggggttattccctcaacttcatgggatatgtcattgggagctgg

SEQ ID NO: 105453 - DNA, 75 bp, Artificial Sequence
  Synthetic
ttcatttgcaccaggatattattaaaaagtgtgaacaatttgtaggccctcttacaattaacgaaaaaagaagat

SEQ ID NO: 105454 - DNA, 75 bp, Artificial Sequence
  Synthetic
gcacctcctcctgcctccaccaatcggcagtcaggaagacagcctactcccatctctccacctctaagagacagt

SEQ ID NO: 105455 - DNA, 75 bp, Artificial Sequence
  Synthetic
taatcattacttccaaaccagacactatttacataccctatggaaggcgggcatcttatataagagagaaactac

SEQ ID NO: 105456 - DNA, 75 bp, Artificial Sequence
  Synthetic
tatataagagagaaactacacgtagcgcctcattttgtgggtcaccatattcttgggaacaagagctacagcatg

SEQ ID NO: 105457 - DNA, 75 bp, Artificial Sequence
  Synthetic
ttaaggactgggaggagctgggggaggagattaggttaaaggtctttgtattaggaggctgtaggcataaattgg

SEQ ID NO: 105458 - DNA, 75 bp, Artificial Sequence
  Synthetic
cgtgtgcacttcgcttcacctctgcacgtcgcatggagaccaccgtgaacgcccctcggagcttgccaacaacct

SEQ ID NO: 105459 - DNA, 75 bp, Artificial Sequence
  Synthetic
gactctagctacctgggtgggtaataatttggaagatccagcatccagggatctagtagtcaattatgttaatac

SEQ ID NO: 105460 - DNA, 75 bp, Artificial Sequence
  Synthetic
tgtggctcctctgccgatccatactgcggaactcctagcagcttgttttgctcgcagcaggtctggagcgaacct

SEQ ID NO: 105461 - DNA, 75 bp, Artificial Sequence
  Synthetic
cttcctgggtgggcaataatttggaagatcctgctgctagggacctagtggttaactatgtcaatactaacatgg

SEQ ID NO: 105462 - DNA, 75 bp, Artificial Sequence
  Synthetic
cctgggtgggaagtaatttggaagacccagcatccagggaattagtagtcagctatgtcaatgttaatatgggcc

SEQ ID NO: 105463 - DNA, 75 bp, Artificial Sequence
  Synthetic
ttagacgacgaggcaggtcccctagaagaagaactccctcgcctcgcagacgaagatctcaatcgccgcgtcgca

SEQ ID NO: 105464 - DNA, 75 bp, Artificial Sequence
  Synthetic
aaaatcaagcaatgttttcggaaactgcctgtaaatagacctattgattggaaagtatgtcaaagaattgtgggt

SEQ ID NO: 105465 - DNA, 75 bp, Artificial Sequence
  Synthetic
tcggaagtcaggaaggcagcctactcccttatctccacctctaagggacactcatcctcaggccatgcagtggaa

SEQ ID NO: 105466 - DNA, 75 bp, Artificial Sequence
  Synthetic
ttccaaaacattccaccaagctctacaggaccccagagtaagaggcctgtatcttcctgctggtggctccagttc

SEQ ID NO: 105467 - DNA, 75 bp, Artificial Sequence
  Synthetic
gccagggttcaccccaccacacggcaatcttttggggtggagccctcaggctcagggcatattgacaacagtgcc

SEQ ID NO: 105468 - DNA, 75 bp, Artificial Sequence
  Synthetic
tcggcagttaggaaggaagcctactcccctgtctccaccactaagagacactcatcctcaagccatgcagtggaa

SEQ ID NO: 105469 - DNA, 75 bp, Artificial Sequence
  Synthetic
tcggcagttaggaaggaagcctactcccctgtctccaccactaagagacactcatcctcatgccatgcagtggaa

SEQ ID NO: 105470 - DNA, 75 bp, Artificial Sequence
  Synthetic
tcggcagttaggaaggaagcctactcccctgtctccaccactaagagacactcatcctcacgccatgcagtggaa

SEQ ID NO: 105471 - DNA, 75 bp, Artificial Sequence
  Synthetic
tcggcagttaggaaggaagcctactcccctgtctccaccactaagagacactcatcctcaggccatgcagtggaa

SEQ ID NO: 105472 - DNA, 75 bp, Artificial Sequence
  Synthetic
tcggcagttaggaaggaagcctactcccctgtctccaccacttagagacactcatcctcaagccatgcagtggaa

SEQ ID NO: 105473 - DNA, 75 bp, Artificial Sequence
  Synthetic
tcggcagttaggaaggaagcctactcccctgtctccaccacttagagacactcatcctcatgccatgcagtggaa

SEQ ID NO: 105474 - DNA, 75 bp, Artificial Sequence
  Synthetic
tcggcagttaggaaggaagcctactcccctgtctccaccacttagagacactcatcctcacgccatgcagtggaa

SEQ ID NO: 105475 - DNA, 75 bp, Artificial Sequence
  Synthetic
tcggcagttaggaaggaagcctactcccctgtctccaccacttagagacactcatcctcaggccatgcagtggaa

SEQ ID NO: 105476 - DNA, 75 bp, Artificial Sequence
  Synthetic
tcggcagttaggaaggaagcctactcccctgtctccaccactcagagacactcatcctcaagccatgcagtggaa

SEQ ID NO: 105477 - DNA, 75 bp, Artificial Sequence
  Synthetic
tcggcagttaggaaggaagcctactcccctgtctccaccactcagagacactcatcctcatgccatgcagtggaa

SEQ ID NO: 105478 - DNA, 75 bp, Artificial Sequence
  Synthetic
tcggcagttaggaaggaagcctactcccctgtctccaccactcagagacactcatcctcacgccatgcagtggaa

SEQ ID NO: 105479 - DNA, 75 bp, Artificial Sequence
  Synthetic
tcggcagttaggaaggaagcctactcccctgtctccaccactcagagacactcatcctcaggccatgcagtggaa

SEQ ID NO: 105480 - DNA, 75 bp, Artificial Sequence
  Synthetic
tcggcagttaggaaggaagcctactcccctgtctccaccactgagagacactcatcctcaagccatgcagtggaa

SEQ ID NO: 105481 - DNA, 75 bp, Artificial Sequence
  Synthetic
tcggcagttaggaaggaagcctactcccctgtctccaccactgagagacactcatcctcatgccatgcagtggaa

SEQ ID NO: 105482 - DNA, 75 bp, Artificial Sequence
  Synthetic
tcggcagttaggaaggaagcctactcccctgtctccaccactgagagacactcatcctcacgccatgcagtggaa

SEQ ID NO: 105483 - DNA, 75 bp, Artificial Sequence
  Synthetic
tcggcagttaggaaggaagcctactcccctgtctccaccactgagagacactcatcctcaggccatgcagtggaa

SEQ ID NO: 105484 - DNA, 75 bp, Artificial Sequence
  Synthetic
tcggcagttaggaaggaagcctactcccctgtctccacctctaagagacactcatcctcaagccatgcagtggaa

SEQ ID NO: 105485 - DNA, 75 bp, Artificial Sequence
  Synthetic
tcggcagttaggaaggaagcctactcccctgtctccacctctaagagacactcatcctcatgccatgcagtggaa

SEQ ID NO: 105486 - DNA, 75 bp, Artificial Sequence
  Synthetic
tcggcagttaggaaggaagcctactcccctgtctccacctctaagagacactcatcctcacgccatgcagtggaa

SEQ ID NO: 105487 - DNA, 75 bp, Artificial Sequence
  Synthetic
tcggcagttaggaaggaagcctactcccctgtctccacctctaagagacactcatcctcaggccatgcagtggaa

SEQ ID NO: 105488 - DNA, 75 bp, Artificial Sequence
  Synthetic
tcggcagttaggaaggaagcctactcccctgtctccacctcttagagacactcatcctcaagccatgcagtggaa

SEQ ID NO: 105489 - DNA, 75 bp, Artificial Sequence
  Synthetic
tcggcagttaggaaggaagcctactcccctgtctccacctcttagagacactcatcctcatgccatgcagtggaa

SEQ ID NO: 105490 - DNA, 75 bp, Artificial Sequence
  Synthetic
tcggcagttaggaaggaagcctactcccctgtctccacctcttagagacactcatcctcacgccatgcagtggaa

SEQ ID NO: 105491 - DNA, 75 bp, Artificial Sequence
  Synthetic
tcggcagttaggaaggaagcctactcccctgtctccacctcttagagacactcatcctcaggccatgcagtggaa

SEQ ID NO: 105492 - DNA, 75 bp, Artificial Sequence
  Synthetic
tcggcagttaggaaggaagcctactcccctgtctccacctctcagagacactcatcctcaagccatgcagtggaa

SEQ ID NO: 105493 - DNA, 75 bp, Artificial Sequence
  Synthetic
tcggcagttaggaaggaagcctactcccctgtctccacctctcagagacactcatcctcatgccatgcagtggaa

SEQ ID NO: 105494 - DNA, 75 bp, Artificial Sequence
  Synthetic
tcggcagttaggaaggaagcctactcccctgtctccacctctcagagacactcatcctcacgccatgcagtggaa

SEQ ID NO: 105495 - DNA, 75 bp, Artificial Sequence
  Synthetic
tcggcagttaggaaggaagcctactcccctgtctccacctctcagagacactcatcctcaggccatgcagtggaa

SEQ ID NO: 105496 - DNA, 75 bp, Artificial Sequence
  Synthetic
tcggcagttaggaaggaagcctactcccctgtctccacctctgagagacactcatcctcaagccatgcagtggaa

SEQ ID NO: 105497 - DNA, 75 bp, Artificial Sequence
  Synthetic
tcggcagttaggaaggaagcctactcccctgtctccacctctgagagacactcatcctcatgccatgcagtggaa

SEQ ID NO: 105498 - DNA, 75 bp, Artificial Sequence
  Synthetic
tcggcagttaggaaggaagcctactcccctgtctccacctctgagagacactcatcctcacgccatgcagtggaa

SEQ ID NO: 105499 - DNA, 75 bp, Artificial Sequence
  Synthetic
tcggcagttaggaaggaagcctactcccctgtctccacctctgagagacactcatcctcaggccatgcagtggaa

SEQ ID NO: 105500 - DNA, 75 bp, Artificial Sequence
  Synthetic
tcggcagttaggaaggaagcctactcccctgtctccacccctaagagacactcatcctcaagccatgcagtggaa

SEQ ID NO: 105501 - DNA, 75 bp, Artificial Sequence
  Synthetic
tcggcagttaggaaggaagcctactcccctgtctccacccctaagagacactcatcctcatgccatgcagtggaa

SEQ ID NO: 105502 - DNA, 75 bp, Artificial Sequence
  Synthetic
tcggcagttaggaaggaagcctactcccctgtctccacccctaagagacactcatcctcacgccatgcagtggaa

SEQ ID NO: 105503 - DNA, 75 bp, Artificial Sequence
  Synthetic
tcggcagttaggaaggaagcctactcccctgtctccacccctaagagacactcatcctcaggccatgcagtggaa

SEQ ID NO: 105504 - DNA, 75 bp, Artificial Sequence
  Synthetic
tcggcagttaggaaggaagcctactcccctgtctccaccccttagagacactcatcctcaagccatgcagtggaa

SEQ ID NO: 105505 - DNA, 75 bp, Artificial Sequence
  Synthetic
tcggcagttaggaaggaagcctactcccctgtctccaccccttagagacactcatcctcatgccatgcagtggaa

SEQ ID NO: 105506 - DNA, 75 bp, Artificial Sequence
  Synthetic
tcggcagttaggaaggaagcctactcccctgtctccaccccttagagacactcatcctcacgccatgcagtggaa

SEQ ID NO: 105507 - DNA, 75 bp, Artificial Sequence
  Synthetic
tcggcagttaggaaggaagcctactcccctgtctccaccccttagagacactcatcctcaggccatgcagtggaa

SEQ ID NO: 105508 - DNA, 75 bp, Artificial Sequence
  Synthetic
tcggcagttaggaaggaagcctactcccctgtctccacccctcagagacactcatcctcaagccatgcagtggaa

SEQ ID NO: 105509 - DNA, 75 bp, Artificial Sequence
  Synthetic
tcggcagttaggaaggaagcctactcccctgtctccacccctcagagacactcatcctcatgccatgcagtggaa

SEQ ID NO: 105510 - DNA, 75 bp, Artificial Sequence
  Synthetic
tcggcagttaggaaggaagcctactcccctgtctccacccctcagagacactcatcctcacgccatgcagtggaa

SEQ ID NO: 105511 - DNA, 75 bp, Artificial Sequence
  Synthetic
tcggcagttaggaaggaagcctactcccctgtctccacccctcagagacactcatcctcaggccatgcagtggaa

SEQ ID NO: 105512 - DNA, 75 bp, Artificial Sequence
  Synthetic
tcggcagttaggaaggaagcctactcccctgtctccacccctgagagacactcatcctcaagccatgcagtggaa

SEQ ID NO: 105513 - DNA, 75 bp, Artificial Sequence
  Synthetic
tcggcagttaggaaggaagcctactcccctgtctccacccctgagagacactcatcctcatgccatgcagtggaa

SEQ ID NO: 105514 - DNA, 75 bp, Artificial Sequence
  Synthetic
tcggcagttaggaaggaagcctactcccctgtctccacccctgagagacactcatcctcacgccatgcagtggaa

SEQ ID NO: 105515 - DNA, 75 bp, Artificial Sequence
  Synthetic
tcggcagttaggaaggaagcctactcccctgtctccacccctgagagacactcatcctcaggccatgcagtggaa

SEQ ID NO: 105516 - DNA, 75 bp, Artificial Sequence
  Synthetic
tcggcagttaggaaggaagcctactcccctgtctccaccgctaagagacactcatcctcaagccatgcagtggaa

SEQ ID NO: 105517 - DNA, 75 bp, Artificial Sequence
  Synthetic
tcggcagttaggaaggaagcctactcccctgtctccaccgctaagagacactcatcctcatgccatgcagtggaa

SEQ ID NO: 105518 - DNA, 75 bp, Artificial Sequence
  Synthetic
tcggcagttaggaaggaagcctactcccctgtctccaccgctaagagacactcatcctcacgccatgcagtggaa

SEQ ID NO: 105519 - DNA, 75 bp, Artificial Sequence
  Synthetic
tcggcagttaggaaggaagcctactcccctgtctccaccgctaagagacactcatcctcaggccatgcagtggaa

SEQ ID NO: 105520 - DNA, 75 bp, Artificial Sequence
  Synthetic
tcggcagttaggaaggaagcctactcccctgtctccaccgcttagagacactcatcctcaagccatgcagtggaa

SEQ ID NO: 105521 - DNA, 75 bp, Artificial Sequence
  Synthetic
tcggcagttaggaaggaagcctactcccctgtctccaccgcttagagacactcatcctcatgccatgcagtggaa

SEQ ID NO: 105522 - DNA, 75 bp, Artificial Sequence
  Synthetic
tcggcagttaggaaggaagcctactcccctgtctccaccgcttagagacactcatcctcacgccatgcagtggaa

SEQ ID NO: 105523 - DNA, 75 bp, Artificial Sequence
  Synthetic
tcggcagttaggaaggaagcctactcccctgtctccaccgcttagagacactcatcctcaggccatgcagtggaa

SEQ ID NO: 105524 - DNA, 75 bp, Artificial Sequence
  Synthetic
tcggcagttaggaaggaagcctactcccctgtctccaccgctcagagacactcatcctcaagccatgcagtggaa

SEQ ID NO: 105525 - DNA, 75 bp, Artificial Sequence
  Synthetic
tcggcagttaggaaggaagcctactcccctgtctccaccgctcagagacactcatcctcatgccatgcagtggaa

SEQ ID NO: 105526 - DNA, 75 bp, Artificial Sequence
  Synthetic
tcggcagttaggaaggaagcctactcccctgtctccaccgctcagagacactcatcctcacgccatgcagtggaa

SEQ ID NO: 105527 - DNA, 75 bp, Artificial Sequence
  Synthetic
tcggcagttaggaaggaagcctactcccctgtctccaccgctcagagacactcatcctcaggccatgcagtggaa

SEQ ID NO: 105528 - DNA, 75 bp, Artificial Sequence
  Synthetic
tcggcagttaggaaggaagcctactcccctgtctccaccgctgagagacactcatcctcaagccatgcagtggaa

SEQ ID NO: 105529 - DNA, 75 bp, Artificial Sequence
  Synthetic
tcggcagttaggaaggaagcctactcccctgtctccaccgctgagagacactcatcctcatgccatgcagtggaa

SEQ ID NO: 105530 - DNA, 75 bp, Artificial Sequence
  Synthetic
tcggcagttaggaaggaagcctactcccctgtctccaccgctgagagacactcatcctcacgccatgcagtggaa

SEQ ID NO: 105531 - DNA, 75 bp, Artificial Sequence
  Synthetic
tcggcagttaggaaggaagcctactcccctgtctccaccgctgagagacactcatcctcaggccatgcagtggaa

SEQ ID NO: 105532 - DNA, 75 bp, Artificial Sequence
  Synthetic
gggagcattcgggccagggttcaccccaccacacggcggtcttttggggtggagccctcaggctcagggcatatt

SEQ ID NO: 105533 - DNA, 75 bp, Artificial Sequence
  Synthetic
cccacaggcacagggtgtgcttacaacattgccagcagatccgcctcctgctcccaccaatcggcggtccgggag

SEQ ID NO: 105534 - DNA, 75 bp, Artificial Sequence
  Synthetic
ctccagcacattccaccaagctctgctagatcccagagtgctagatcctgctggtggctccagttccggaacagt

SEQ ID NO: 105535 - DNA, 75 bp, Artificial Sequence
  Synthetic
atccacaaccttccaccaaactctgcaagatcccagagtgagaggcctgtatttccctgctggtggctccagttc

SEQ ID NO: 105536 - DNA, 75 bp, Artificial Sequence
  Synthetic
atccacaaccttccaccaaactctgcaagatcccagagtgagtggcctgtatttccctgctggtggctccagttc

SEQ ID NO: 105537 - DNA, 75 bp, Artificial Sequence
  Synthetic
atccacaaccttccaccaaactctgcaagatcccagagtgagcggcctgtatttccctgctggtggctccagttc

SEQ ID NO: 105538 - DNA, 75 bp, Artificial Sequence
  Synthetic
atccacaaccttccaccaaactctgcaagatcccagagtgaggggcctgtatttccctgctggtggctccagttc

SEQ ID NO: 105539 - DNA, 75 bp, Artificial Sequence
  Synthetic
ttccacaaccttccaccaaactctgcaagatcccagagtgagaggcctgtatttccctgctggtggctccagttc

SEQ ID NO: 105540 - DNA, 75 bp, Artificial Sequence
  Synthetic
ttccacaaccttccaccaaactctgcaagatcccagagtgagtggcctgtatttccctgctggtggctccagttc

SEQ ID NO: 105541 - DNA, 75 bp, Artificial Sequence
  Synthetic
ttccacaaccttccaccaaactctgcaagatcccagagtgagcggcctgtatttccctgctggtggctccagttc

SEQ ID NO: 105542 - DNA, 75 bp, Artificial Sequence
  Synthetic
ttccacaaccttccaccaaactctgcaagatcccagagtgaggggcctgtatttccctgctggtggctccagttc

SEQ ID NO: 105543 - DNA, 75 bp, Artificial Sequence
  Synthetic
ctccacaaccttccaccaaactctgcaagatcccagagtgagaggcctgtatttccctgctggtggctccagttc

SEQ ID NO: 105544 - DNA, 75 bp, Artificial Sequence
  Synthetic
ctccacaaccttccaccaaactctgcaagatcccagagtgagtggcctgtatttccctgctggtggctccagttc

SEQ ID NO: 105545 - DNA, 75 bp, Artificial Sequence
  Synthetic
ctccacaaccttccaccaaactctgcaagatcccagagtgagcggcctgtatttccctgctggtggctccagttc

SEQ ID NO: 105546 - DNA, 75 bp, Artificial Sequence
  Synthetic
ctccacaaccttccaccaaactctgcaagatcccagagtgaggggcctgtatttccctgctggtggctccagttc

SEQ ID NO: 105547 - DNA, 75 bp, Artificial Sequence
  Synthetic
gtccacaaccttccaccaaactctgcaagatcccagagtgagaggcctgtatttccctgctggtggctccagttc

SEQ ID NO: 105548 - DNA, 75 bp, Artificial Sequence
  Synthetic
gtccacaaccttccaccaaactctgcaagatcccagagtgagtggcctgtatttccctgctggtggctccagttc

SEQ ID NO: 105549 - DNA, 75 bp, Artificial Sequence
  Synthetic
gtccacaaccttccaccaaactctgcaagatcccagagtgagcggcctgtatttccctgctggtggctccagttc

SEQ ID NO: 105550 - DNA, 75 bp, Artificial Sequence
  Synthetic
gtccacaaccttccaccaaactctgcaagatcccagagtgaggggcctgtatttccctgctggtggctccagttc

SEQ ID NO: 105551 - DNA, 75 bp, Artificial Sequence
  Synthetic
ctaatgcctttgtatgcatgtatacaagcgaaacagggttttacttttttgccaacttacaaagccttttttcgc

SEQ ID NO: 105552 - DNA, 75 bp, Artificial Sequence
  Synthetic
ttttttgccttctgatttcttcccgtcagttcgggacctactcgacaccgcttcagccctttaccgggatgcttt

SEQ ID NO: 105553 - DNA, 75 bp, Artificial Sequence
  Synthetic
cacatcaggattcctaggacccctgctcgtgttacaggcggggtttttcttgttgacaaaaatcctcacaatacc

SEQ ID NO: 105554 - DNA, 75 bp, Artificial Sequence
  Synthetic
caccgcctctgctctgtaccgggaggccttagagtctccggaacattgttcacctcaccatacagcactcaggca

SEQ ID NO: 105555 - DNA, 75 bp, Artificial Sequence
  Synthetic
agctgttctgtgttggggtgagttaatgaatctggccacctgggtgggaagtaatttggaagacccagcatccag

SEQ ID NO: 105556 - DNA, 75 bp, Artificial Sequence
  Synthetic
tatgggcctaaagttcagacaactattgtggtttcacatttcttgtctcacttttggaagagaaacggttctaga

SEQ ID NO: 105557 - DNA, 75 bp, Artificial Sequence
  Synthetic
taaagttaattatgcctgctagattttttcctaaccttaccaaatatttgcccttagataaaggcattaaacctt

SEQ ID NO: 105558 - DNA, 75 bp, Artificial Sequence
  Synthetic
tggttatcctgcgttaatgcctttgtatgcatgtattcaatctaagcaggctttcactttctcgccaacttacaa

SEQ ID NO: 105559 - DNA, 75 bp, Artificial Sequence
  Synthetic
gattggaaagtgtgtcaaaggattgtgggtcttttgggctttgctgccccttttacacaatgtggctatcctgcc

SEQ ID NO: 105560 - DNA, 75 bp, Artificial Sequence
  Synthetic
gaaactttacggggctttattcttccactgtacctgtctttaatcctaagtggcaaactccttcctttcctgaca

SEQ ID NO: 105561 - DNA, 75 bp, Artificial Sequence
  Synthetic
ccagattgggacttcaaccccaacaaggatcaatggccagaggcaaatcaggtaggagcgggagcattcgggcca

SEQ ID NO: 105562 - DNA, 75 bp, Artificial Sequence
  Synthetic
actttccaccaaactcttcaagatcccagagtcagggccctgtactttcctgctggtggctccagttcaggaaca

SEQ ID NO: 105563 - DNA, 75 bp, Artificial Sequence
  Synthetic
gaagattgaaattaattatgcctgctaggttctatcctaccagcactaaatatttgcccctagacaaagggatta

SEQ ID NO: 105564 - DNA, 75 bp, Artificial Sequence
  Synthetic
tttcctgctggtggctccagttccggaacagtaaaccctgttccgactactgcctctcccatatcgtcaatcttc

SEQ ID NO: 105565 - DNA, 75 bp, Artificial Sequence
  Synthetic
tcggcaggcaagaagacggactactcccatctctccacctctaatagacagtcatcctcaggccatccaatggaa

SEQ ID NO: 105566 - DNA, 75 bp, Artificial Sequence
  Synthetic
atacatttaaatcctaccaaaacaaaaagatggggatattccctcaatttcatgggatatgtgattggtagttgg

SEQ ID NO: 105567 - DNA, 75 bp, Artificial Sequence
  Synthetic
tcaggaacagtaaaccctgttctgaatactgcctctcacatctcgtcaatcttctcgaggactggggaccctgca

SEQ ID NO: 105568 - DNA, 75 bp, Artificial Sequence
  Synthetic
atacatttaaaccctaacaaaacaaaacgttggggctactctctcaactttatgggctatgtaattgggagttgg

SEQ ID NO: 105569 - DNA, 75 bp, Artificial Sequence
  Synthetic
tgggatatgtaattggaagttggggtaccttaccacaagaacatattgtactaaaaatcaaacaatgttttcgaa

SEQ ID NO: 105570 - DNA, 75 bp, Artificial Sequence
  Synthetic
aacttcctgtaaatagacctattgattggaaggtatgtcaaagaattgtgggtcttttgggctttgctgcccctt

SEQ ID NO: 105571 - DNA, 75 bp, Artificial Sequence
  Synthetic
ggggaacgttgcctcaaaaccatattgtacaaaaaatcaaacaatgtttcagaaaactacctgttaataggccta

SEQ ID NO: 105572 - DNA, 75 bp, Artificial Sequence
  Synthetic
ttccacaactttccaccaaactctgcaagatcccagagtgagaggcctgtatttccctgctggtggctccagttc

SEQ ID NO: 105573 - DNA, 75 bp, Artificial Sequence
  Synthetic
ctcaactcacttccaccaggctctgttggatccgagggtaagggcactgtattttcctgctggtggctccagttc

SEQ ID NO: 105574 - DNA, 75 bp, Artificial Sequence
  Synthetic
ctccactcagttccaccaggctctgttagatccgagggtaagggctctgtctgctggtggctccagttcagagac

SEQ ID NO: 105575 - DNA, 75 bp, Artificial Sequence
  Synthetic
ctcatgcctctgtataactgtatcactgcgaaacaggcttttgtcttttcgccaacttacaaggcctttctctgt

SEQ ID NO: 105576 - DNA, 75 bp, Artificial Sequence
  Synthetic
ttcgggcccgggttcacccccccacacgggggtcttctgggggggagccctcaggctcagggcataataacaaca

SEQ ID NO: 105577 - DNA, 75 bp, Artificial Sequence
  Synthetic
gtctcaatcaccgcgtcgcagaagatctcaatctccagcttcccaatgttagtattccttggactcataaggtgg

SEQ ID NO: 105578 - DNA, 75 bp, Artificial Sequence
  Synthetic
atcccagagtgaggggcctatattttcctgctggtggctccagttccggaacagtaaaccctgttccgactactg

SEQ ID NO: 105579 - DNA, 75 bp, Artificial Sequence
  Synthetic
tggtttcacatttcctgtcttacttttgggagagaaactgttcttgaatatttggtgtcttttggagtgtggatt

SEQ ID NO: 105580 - DNA, 75 bp, Artificial Sequence
  Synthetic
taaagttagttatgcctgctagattttatcctacctctaccaagtatttgcccttagagaaaggtataaaacctt

SEQ ID NO: 105581 - DNA, 75 bp, Artificial Sequence
  Synthetic
ctccacgacaattacccaagctcctgctggtggctccggttcagaaacagtaaaccctgttccgactattgcctc

SEQ ID NO: 105582 - DNA, 75 bp, Artificial Sequence
  Synthetic
tacataagaggactcttggactcccagcaatgtcaacgaccgaccctgaggcatacttcaaagactgtttgttta

SEQ ID NO: 105583 - DNA, 75 bp, Artificial Sequence
  Synthetic
ttaccacaagatcacattgtacaaaaaatcaaagattgttttcgtaaacttcctgtaaatcgccctattgattgg

SEQ ID NO: 105584 - DNA, 75 bp, Artificial Sequence
  Synthetic
ctccagcacattccaccaagctctgctagatcccagagtgagaggcctatatccttccctgctggtggctcaagt

SEQ ID NO: 105585 - DNA, 75 bp, Artificial Sequence
  Synthetic
gtgccagcgaatccgcctcctgcctccaccaatcggcagtcaggcaggaagcctactcccatttctccacctctg

SEQ ID NO: 105586 - DNA, 75 bp, Artificial Sequence
  Synthetic
tatataagagagaaactacacgcagcgcctcattttgtgggtcaccatactcttgggaacaagagctacagcatg

SEQ ID NO: 105587 - DNA, 75 bp, Artificial Sequence
  Synthetic
aatcggcagtcaggcaggcagcctaccccacattcaccaccaatgagagacactcatcctcaggcaatgcattgg

SEQ ID NO: 105588 - DNA, 75 bp, Artificial Sequence
  Synthetic
ctctctttacgcggtctccccgtctgtgccttctcatctgccggaccgtgtgcacttcgcttcacctctgcacgt

SEQ ID NO: 105589 - DNA, 75 bp, Artificial Sequence
  Synthetic
tgacccttataaagaatttggagctaccgtggagttactctcgtttttgccttctgacttctttccttcagcacg

SEQ ID NO: 105590 - DNA, 75 bp, Artificial Sequence
  Synthetic
caacgaccgaccttgaggcatacttcaaagactgtgtgtttaaagactgggaggagttgggggaggagattaggt

SEQ ID NO: 105591 - DNA, 75 bp, Artificial Sequence
  Synthetic
ttcctgccttacttttggaagagaaacagttcttgagtatttggtgtcctttggagtgtggattcgcactcctcc

SEQ ID NO: 105592 - DNA, 75 bp, Artificial Sequence
  Synthetic
ctcaacccagttccaccaggccctgttggatccgagggtaaaggctctgtattttcctgctggtggctccagttc

SEQ ID NO: 105593 - DNA, 75 bp, Artificial Sequence
  Synthetic
aaattgaaacaatgttttcgaaaacttcctataaatagacctattgattggaaagtatgtcaaagaattgtgggt

SEQ ID NO: 105594 - DNA, 75 bp, Artificial Sequence
  Synthetic
tcaatcctcactggttaactccttcttttcctgatattcatttgcatcaagacctgatatctaaatgtgaacaat

SEQ ID NO: 105595 - DNA, 75 bp, Artificial Sequence
  Synthetic
agagtctccagaacattgttcacctaaccatacagcactcaggcaagctattttgtgctggggtgagttaatgag

SEQ ID NO: 105596 - DNA, 75 bp, Artificial Sequence
  Synthetic
atcgccgcgtcgcagaagatctcaatctccagcttcccaatgttagtattccttggactcataaggtgggaaact

SEQ ID NO: 105597 - DNA, 75 bp, Artificial Sequence
  Synthetic
gatcactggccagaggcaaatcaggtaggagtgggagcattcgggccagggttcaccccaccacacggcggtctt

SEQ ID NO: 105598 - DNA, 75 bp, Artificial Sequence
  Synthetic
ggtcaccatattcctgggaacaagagctacagcatgggagcacctctctcaacgacaagaaggggcatgggacag

SEQ ID NO: 105599 - DNA, 75 bp, Artificial Sequence
  Synthetic
ttttttgccttctgacttttttccgtcggttagagatctcctcgacaccgcctcagctctgtatcgggaagcctt

SEQ ID NO: 105600 - DNA, 75 bp, Artificial Sequence
  Synthetic
ctccacagtattccaccaactcctgcaagatcccagagtaaggggcctgtattaccctgctggtggctccagttc

SEQ ID NO: 105601 - DNA, 75 bp, Artificial Sequence
  Synthetic
ctccacagtattccaccagactctgcaagatcccagagtaaggggcctgtattaccctgctggtggctccagttc

SEQ ID NO: 105602 - DNA, 75 bp, Artificial Sequence
  Synthetic
ctaaccttaccaaatatttgcccttagacaaaggcattaaaccttattatcctgaacatacagttaatcattact

SEQ ID NO: 105603 - DNA, 75 bp, Artificial Sequence
  Synthetic
ttgccagcggcacctcctcctgcctccaccaatcggcagtcaggaaggcaggccactccaatctctccaccgttg

SEQ ID NO: 105604 - DNA, 75 bp, Artificial Sequence
  Synthetic
tatataagagagaatccaccgagcccgcctcattttgtgggtcaccatattcctgggaacaagagctacagcatg

SEQ ID NO: 105605 - DNA, 75 bp, Artificial Sequence
  Synthetic
ggatcattaccacaagatcacattgtacataaaatcaaagagtgctttcgaaaactgcctgtaaatcgtccaatt

SEQ ID NO: 105606 - DNA, 75 bp, Artificial Sequence
  Synthetic
ggatcattaccacaagatcacattgtacataaaatcaaagagtgctttcgaaaactgcctgtaaatcgtcctatt

SEQ ID NO: 105607 - DNA, 75 bp, Artificial Sequence
  Synthetic
ggatcattaccacaagatcacattgtacataaaatcaaagagtgctttcgaaaactgcctgtaaatcgtcccatt

SEQ ID NO: 105608 - DNA, 75 bp, Artificial Sequence
  Synthetic
ggatcattaccacaagatcacattgtacataaaatcaaagagtgctttcgaaaactgcctgtaaatcgtccgatt

SEQ ID NO: 105609 - DNA, 75 bp, Artificial Sequence
  Synthetic
ggatcattaccacaagatcacattgtacataaaatcaaagagtgctttcgtaaactgcctgtaaatcgtccaatt

SEQ ID NO: 105610 - DNA, 75 bp, Artificial Sequence
  Synthetic
ggatcattaccacaagatcacattgtacataaaatcaaagagtgctttcgtaaactgcctgtaaatcgtcctatt

SEQ ID NO: 105611 - DNA, 75 bp, Artificial Sequence
  Synthetic
ggatcattaccacaagatcacattgtacataaaatcaaagagtgctttcgtaaactgcctgtaaatcgtcccatt

SEQ ID NO: 105612 - DNA, 75 bp, Artificial Sequence
  Synthetic
ggatcattaccacaagatcacattgtacataaaatcaaagagtgctttcgtaaactgcctgtaaatcgtccgatt

SEQ ID NO: 105613 - DNA, 75 bp, Artificial Sequence
  Synthetic
ggatcattaccacaagatcacattgtacataaaatcaaagagtgctttcgcaaactgcctgtaaatcgtccaatt

SEQ ID NO: 105614 - DNA, 75 bp, Artificial Sequence
  Synthetic
ggatcattaccacaagatcacattgtacataaaatcaaagagtgctttcgcaaactgcctgtaaatcgtcctatt

SEQ ID NO: 105615 - DNA, 75 bp, Artificial Sequence
  Synthetic
ggatcattaccacaagatcacattgtacataaaatcaaagagtgctttcgcaaactgcctgtaaatcgtcccatt

SEQ ID NO: 105616 - DNA, 75 bp, Artificial Sequence
  Synthetic
ggatcattaccacaagatcacattgtacataaaatcaaagagtgctttcgcaaactgcctgtaaatcgtccgatt

SEQ ID NO: 105617 - DNA, 75 bp, Artificial Sequence
  Synthetic
ggatcattaccacaagatcacattgtacataaaatcaaagagtgctttcggaaactgcctgtaaatcgtccaatt

SEQ ID NO: 105618 - DNA, 75 bp, Artificial Sequence
  Synthetic
ggatcattaccacaagatcacattgtacataaaatcaaagagtgctttcggaaactgcctgtaaatcgtcctatt

SEQ ID NO: 105619 - DNA, 75 bp, Artificial Sequence
  Synthetic
ggatcattaccacaagatcacattgtacataaaatcaaagagtgctttcggaaactgcctgtaaatcgtcccatt

SEQ ID NO: 105620 - DNA, 75 bp, Artificial Sequence
  Synthetic
ggatcattaccacaagatcacattgtacataaaatcaaagagtgctttcggaaactgcctgtaaatcgtccgatt

SEQ ID NO: 105621 - DNA, 75 bp, Artificial Sequence
  Synthetic
ggatcattacctcaagatcacattgtacataaaatcaaagagtgctttcgaaaactgcctgtaaatcgtccaatt

SEQ ID NO: 105622 - DNA, 75 bp, Artificial Sequence
  Synthetic
ggatcattacctcaagatcacattgtacataaaatcaaagagtgctttcgaaaactgcctgtaaatcgtcctatt

SEQ ID NO: 105623 - DNA, 75 bp, Artificial Sequence
  Synthetic
ggatcattacctcaagatcacattgtacataaaatcaaagagtgctttcgaaaactgcctgtaaatcgtcccatt

SEQ ID NO: 105624 - DNA, 75 bp, Artificial Sequence
  Synthetic
ggatcattacctcaagatcacattgtacataaaatcaaagagtgctttcgaaaactgcctgtaaatcgtccgatt

SEQ ID NO: 105625 - DNA, 75 bp, Artificial Sequence
  Synthetic
ggatcattacctcaagatcacattgtacataaaatcaaagagtgctttcgtaaactgcctgtaaatcgtccaatt

SEQ ID NO: 105626 - DNA, 75 bp, Artificial Sequence
  Synthetic
ggatcattacctcaagatcacattgtacataaaatcaaagagtgctttcgtaaactgcctgtaaatcgtcctatt

SEQ ID NO: 105627 - DNA, 75 bp, Artificial Sequence
  Synthetic
ggatcattacctcaagatcacattgtacataaaatcaaagagtgctttcgtaaactgcctgtaaatcgtcccatt

SEQ ID NO: 105628 - DNA, 75 bp, Artificial Sequence
  Synthetic
ggatcattacctcaagatcacattgtacataaaatcaaagagtgctttcgtaaactgcctgtaaatcgtccgatt

SEQ ID NO: 105629 - DNA, 75 bp, Artificial Sequence
  Synthetic
ggatcattacctcaagatcacattgtacataaaatcaaagagtgctttcgcaaactgcctgtaaatcgtccaatt

SEQ ID NO: 105630 - DNA, 75 bp, Artificial Sequence
  Synthetic
ggatcattacctcaagatcacattgtacataaaatcaaagagtgctttcgcaaactgcctgtaaatcgtcctatt

SEQ ID NO: 105631 - DNA, 75 bp, Artificial Sequence
  Synthetic
ggatcattacctcaagatcacattgtacataaaatcaaagagtgctttcgcaaactgcctgtaaatcgtcccatt

SEQ ID NO: 105632 - DNA, 75 bp, Artificial Sequence
  Synthetic
ggatcattacctcaagatcacattgtacataaaatcaaagagtgctttcgcaaactgcctgtaaatcgtccgatt

SEQ ID NO: 105633 - DNA, 75 bp, Artificial Sequence
  Synthetic
ggatcattacctcaagatcacattgtacataaaatcaaagagtgctttcggaaactgcctgtaaatcgtccaatt

SEQ ID NO: 105634 - DNA, 75 bp, Artificial Sequence
  Synthetic
ggatcattacctcaagatcacattgtacataaaatcaaagagtgctttcggaaactgcctgtaaatcgtcctatt

SEQ ID NO: 105635 - DNA, 75 bp, Artificial Sequence
  Synthetic
ggatcattacctcaagatcacattgtacataaaatcaaagagtgctttcggaaactgcctgtaaatcgtcccatt

SEQ ID NO: 105636 - DNA, 75 bp, Artificial Sequence
  Synthetic
ggatcattacctcaagatcacattgtacataaaatcaaagagtgctttcggaaactgcctgtaaatcgtccgatt

SEQ ID NO: 105637 - DNA, 75 bp, Artificial Sequence
  Synthetic
ggatcattaccccaagatcacattgtacataaaatcaaagagtgctttcgaaaactgcctgtaaatcgtccaatt

SEQ ID NO: 105638 - DNA, 75 bp, Artificial Sequence
  Synthetic
ggatcattaccccaagatcacattgtacataaaatcaaagagtgctttcgaaaactgcctgtaaatcgtcctatt

SEQ ID NO: 105639 - DNA, 75 bp, Artificial Sequence
  Synthetic
ggatcattaccccaagatcacattgtacataaaatcaaagagtgctttcgaaaactgcctgtaaatcgtcccatt

SEQ ID NO: 105640 - DNA, 75 bp, Artificial Sequence
  Synthetic
ggatcattaccccaagatcacattgtacataaaatcaaagagtgctttcgaaaactgcctgtaaatcgtccgatt

SEQ ID NO: 105641 - DNA, 75 bp, Artificial Sequence
  Synthetic
ggatcattaccccaagatcacattgtacataaaatcaaagagtgctttcgtaaactgcctgtaaatcgtccaatt

SEQ ID NO: 105642 - DNA, 75 bp, Artificial Sequence
  Synthetic
ggatcattaccccaagatcacattgtacataaaatcaaagagtgctttcgtaaactgcctgtaaatcgtcctatt

SEQ ID NO: 105643 - DNA, 75 bp, Artificial Sequence
  Synthetic
ggatcattaccccaagatcacattgtacataaaatcaaagagtgctttcgtaaactgcctgtaaatcgtcccatt

SEQ ID NO: 105644 - DNA, 75 bp, Artificial Sequence
  Synthetic
ggatcattaccccaagatcacattgtacataaaatcaaagagtgctttcgtaaactgcctgtaaatcgtccgatt

SEQ ID NO: 105645 - DNA, 75 bp, Artificial Sequence
  Synthetic
ggatcattaccccaagatcacattgtacataaaatcaaagagtgctttcgcaaactgcctgtaaatcgtccaatt

SEQ ID NO: 105646 - DNA, 75 bp, Artificial Sequence
  Synthetic
ggatcattaccccaagatcacattgtacataaaatcaaagagtgctttcgcaaactgcctgtaaatcgtcctatt

SEQ ID NO: 105647 - DNA, 75 bp, Artificial Sequence
  Synthetic
ggatcattaccccaagatcacattgtacataaaatcaaagagtgctttcgcaaactgcctgtaaatcgtcccatt

SEQ ID NO: 105648 - DNA, 75 bp, Artificial Sequence
  Synthetic
ggatcattaccccaagatcacattgtacataaaatcaaagagtgctttcgcaaactgcctgtaaatcgtccgatt

SEQ ID NO: 105649 - DNA, 75 bp, Artificial Sequence
  Synthetic
ggatcattaccccaagatcacattgtacataaaatcaaagagtgctttcggaaactgcctgtaaatcgtccaatt

SEQ ID NO: 105650 - DNA, 75 bp, Artificial Sequence
  Synthetic
ggatcattaccccaagatcacattgtacataaaatcaaagagtgctttcggaaactgcctgtaaatcgtcctatt

SEQ ID NO: 105651 - DNA, 75 bp, Artificial Sequence
  Synthetic
ggatcattaccccaagatcacattgtacataaaatcaaagagtgctttcggaaactgcctgtaaatcgtcccatt

SEQ ID NO: 105652 - DNA, 75 bp, Artificial Sequence
  Synthetic
ggatcattaccccaagatcacattgtacataaaatcaaagagtgctttcggaaactgcctgtaaatcgtccgatt

SEQ ID NO: 105653 - DNA, 75 bp, Artificial Sequence
  Synthetic
ggatcattaccgcaagatcacattgtacataaaatcaaagagtgctttcgaaaactgcctgtaaatcgtccaatt

SEQ ID NO: 105654 - DNA, 75 bp, Artificial Sequence
  Synthetic
ggatcattaccgcaagatcacattgtacataaaatcaaagagtgctttcgaaaactgcctgtaaatcgtcctatt

SEQ ID NO: 105655 - DNA, 75 bp, Artificial Sequence
  Synthetic
ggatcattaccgcaagatcacattgtacataaaatcaaagagtgctttcgaaaactgcctgtaaatcgtcccatt

SEQ ID NO: 105656 - DNA, 75 bp, Artificial Sequence
  Synthetic
ggatcattaccgcaagatcacattgtacataaaatcaaagagtgctttcgaaaactgcctgtaaatcgtccgatt

SEQ ID NO: 105657 - DNA, 75 bp, Artificial Sequence
  Synthetic
ggatcattaccgcaagatcacattgtacataaaatcaaagagtgctttcgtaaactgcctgtaaatcgtccaatt

SEQ ID NO: 105658 - DNA, 75 bp, Artificial Sequence
  Synthetic
ggatcattaccgcaagatcacattgtacataaaatcaaagagtgctttcgtaaactgcctgtaaatcgtcctatt

SEQ ID NO: 105659 - DNA, 75 bp, Artificial Sequence
  Synthetic
ggatcattaccgcaagatcacattgtacataaaatcaaagagtgctttcgtaaactgcctgtaaatcgtcccatt

SEQ ID NO: 105660 - DNA, 75 bp, Artificial Sequence
  Synthetic
ggatcattaccgcaagatcacattgtacataaaatcaaagagtgctttcgtaaactgcctgtaaatcgtccgatt

SEQ ID NO: 105661 - DNA, 75 bp, Artificial Sequence
  Synthetic
ggatcattaccgcaagatcacattgtacataaaatcaaagagtgctttcgcaaactgcctgtaaatcgtccaatt

SEQ ID NO: 105662 - DNA, 75 bp, Artificial Sequence
  Synthetic
ggatcattaccgcaagatcacattgtacataaaatcaaagagtgctttcgcaaactgcctgtaaatcgtcctatt

SEQ ID NO: 105663 - DNA, 75 bp, Artificial Sequence
  Synthetic
ggatcattaccgcaagatcacattgtacataaaatcaaagagtgctttcgcaaactgcctgtaaatcgtcccatt

SEQ ID NO: 105664 - DNA, 75 bp, Artificial Sequence
  Synthetic
ggatcattaccgcaagatcacattgtacataaaatcaaagagtgctttcgcaaactgcctgtaaatcgtccgatt

SEQ ID NO: 105665 - DNA, 75 bp, Artificial Sequence
  Synthetic
ggatcattaccgcaagatcacattgtacataaaatcaaagagtgctttcggaaactgcctgtaaatcgtccaatt

SEQ ID NO: 105666 - DNA, 75 bp, Artificial Sequence
  Synthetic
ggatcattaccgcaagatcacattgtacataaaatcaaagagtgctttcggaaactgcctgtaaatcgtcctatt

SEQ ID NO: 105667 - DNA, 75 bp, Artificial Sequence
  Synthetic
ggatcattaccgcaagatcacattgtacataaaatcaaagagtgctttcggaaactgcctgtaaatcgtcccatt

SEQ ID NO: 105668 - DNA, 75 bp, Artificial Sequence
  Synthetic
ggatcattaccgcaagatcacattgtacataaaatcaaagagtgctttcggaaactgcctgtaaatcgtccgatt

SEQ ID NO: 105669 - DNA, 75 bp, Artificial Sequence
  Synthetic
ggaacgttaccacaggaacacattgttcagaaaatcaaacaatgctttaggaaactgcctgtcaacaggcctatt

SEQ ID NO: 105670 - DNA, 75 bp, Artificial Sequence
  Synthetic
ctaatgcctttgtatgcatgtatccaagccaagcaagcttttaccttttcgcccgcatacaaaacctttctccgc

SEQ ID NO: 105671 - DNA, 75 bp, Artificial Sequence
  Synthetic
tatgtcccgtcagcccctaatccagcggacgacccctcccgggcccctgggggggtctgtggcccccttctccgt

SEQ ID NO: 105672 - DNA, 75 bp, Artificial Sequence
  Synthetic
ttcatttgcatgaggacattatcaataggtgtcaacaatttgtgggccctcttacagttaatgaaaagcggagat

SEQ ID NO: 105673 - DNA, 75 bp, Artificial Sequence
  Synthetic
tctcggaagtacacctccttaccatggctgctcggatgtgctgcaaactggatcctgcgcgggacgtcctttgtt

SEQ ID NO: 105674 - DNA, 75 bp, Artificial Sequence
  Synthetic
tctcggaagtacacctccttaccatggctgctcggatgtgctgctaactggatcctgcgcgggacgtcctttgtt

SEQ ID NO: 105675 - DNA, 75 bp, Artificial Sequence
  Synthetic
tctcggaagtacacctccttaccatggctgctcggatgtgctgccaactggatcctgcgcgggacgtcctttgtt

SEQ ID NO: 105676 - DNA, 75 bp, Artificial Sequence
  Synthetic
tctcggaagtacacctccttaccatggctgctcggatgtgctgcgaactggatcctgcgcgggacgtcctttgtt

SEQ ID NO: 105677 - DNA, 75 bp, Artificial Sequence
  Synthetic
tctcggaagtacacctccttaccatggctgctcggttgtgctgcaaactggatcctgcgcgggacgtcctttgtt

SEQ ID NO: 105678 - DNA, 75 bp, Artificial Sequence
  Synthetic
tctcggaagtacacctccttaccatggctgctcggttgtgctgctaactggatcctgcgcgggacgtcctttgtt

SEQ ID NO: 105679 - DNA, 75 bp, Artificial Sequence
  Synthetic
tctcggaagtacacctccttaccatggctgctcggttgtgctgccaactggatcctgcgcgggacgtcctttgtt

SEQ ID NO: 105680 - DNA, 75 bp, Artificial Sequence
  Synthetic
tctcggaagtacacctccttaccatggctgctcggttgtgctgcgaactggatcctgcgcgggacgtcctttgtt

SEQ ID NO: 105681 - DNA, 75 bp, Artificial Sequence
  Synthetic
tctcggaagtacacctccttaccatggctgctcggctgtgctgcaaactggatcctgcgcgggacgtcctttgtt

SEQ ID NO: 105682 - DNA, 75 bp, Artificial Sequence
  Synthetic
tctcggaagtacacctccttaccatggctgctcggctgtgctgctaactggatcctgcgcgggacgtcctttgtt

SEQ ID NO: 105683 - DNA, 75 bp, Artificial Sequence
  Synthetic
tctcggaagtacacctccttaccatggctgctcggctgtgctgccaactggatcctgcgcgggacgtcctttgtt

SEQ ID NO: 105684 - DNA, 75 bp, Artificial Sequence
  Synthetic
tctcggaagtacacctccttaccatggctgctcggctgtgctgcgaactggatcctgcgcgggacgtcctttgtt

SEQ ID NO: 105685 - DNA, 75 bp, Artificial Sequence
  Synthetic
tctcggaagtacacctccttaccatggctgctcgggtgtgctgcaaactggatcctgcgcgggacgtcctttgtt

SEQ ID NO: 105686 - DNA, 75 bp, Artificial Sequence
  Synthetic
tctcggaagtacacctccttaccatggctgctcgggtgtgctgctaactggatcctgcgcgggacgtcctttgtt

SEQ ID NO: 105687 - DNA, 75 bp, Artificial Sequence
  Synthetic
tctcggaagtacacctccttaccatggctgctcgggtgtgctgccaactggatcctgcgcgggacgtcctttgtt

SEQ ID NO: 105688 - DNA, 75 bp, Artificial Sequence
  Synthetic
tctcggaagtacacctccttaccatggctgctcgggtgtgctgcgaactggatcctgcgcgggacgtcctttgtt

SEQ ID NO: 105689 - DNA, 75 bp, Artificial Sequence
  Synthetic
tctcggaagtacacctcctttccatggctgctcggatgtgctgcaaactggatcctgcgcgggacgtcctttgtt

SEQ ID NO: 105690 - DNA, 75 bp, Artificial Sequence
  Synthetic
tctcggaagtacacctcctttccatggctgctcggatgtgctgctaactggatcctgcgcgggacgtcctttgtt

SEQ ID NO: 105691 - DNA, 75 bp, Artificial Sequence
  Synthetic
tctcggaagtacacctcctttccatggctgctcggatgtgctgccaactggatcctgcgcgggacgtcctttgtt

SEQ ID NO: 105692 - DNA, 75 bp, Artificial Sequence
  Synthetic
tctcggaagtacacctcctttccatggctgctcggatgtgctgcgaactggatcctgcgcgggacgtcctttgtt

SEQ ID NO: 105693 - DNA, 75 bp, Artificial Sequence
  Synthetic
tctcggaagtacacctcctttccatggctgctcggttgtgctgcaaactggatcctgcgcgggacgtcctttgtt

SEQ ID NO: 105694 - DNA, 75 bp, Artificial Sequence
  Synthetic
tctcggaagtacacctcctttccatggctgctcggttgtgctgctaactggatcctgcgcgggacgtcctttgtt

SEQ ID NO: 105695 - DNA, 75 bp, Artificial Sequence
  Synthetic
tctcggaagtacacctcctttccatggctgctcggttgtgctgccaactggatcctgcgcgggacgtcctttgtt

SEQ ID NO: 105696 - DNA, 75 bp, Artificial Sequence
  Synthetic
tctcggaagtacacctcctttccatggctgctcggttgtgctgcgaactggatcctgcgcgggacgtcctttgtt

SEQ ID NO: 105697 - DNA, 75 bp, Artificial Sequence
  Synthetic
tctcggaagtacacctcctttccatggctgctcggctgtgctgcaaactggatcctgcgcgggacgtcctttgtt

SEQ ID NO: 105698 - DNA, 75 bp, Artificial Sequence
  Synthetic
tctcggaagtacacctcctttccatggctgctcggctgtgctgctaactggatcctgcgcgggacgtcctttgtt

SEQ ID NO: 105699 - DNA, 75 bp, Artificial Sequence
  Synthetic
tctcggaagtacacctcctttccatggctgctcggctgtgctgccaactggatcctgcgcgggacgtcctttgtt

SEQ ID NO: 105700 - DNA, 75 bp, Artificial Sequence
  Synthetic
tctcggaagtacacctcctttccatggctgctcggctgtgctgcgaactggatcctgcgcgggacgtcctttgtt

SEQ ID NO: 105701 - DNA, 75 bp, Artificial Sequence
  Synthetic
tctcggaagtacacctcctttccatggctgctcgggtgtgctgcaaactggatcctgcgcgggacgtcctttgtt

SEQ ID NO: 105702 - DNA, 75 bp, Artificial Sequence
  Synthetic
tctcggaagtacacctcctttccatggctgctcgggtgtgctgctaactggatcctgcgcgggacgtcctttgtt

SEQ ID NO: 105703 - DNA, 75 bp, Artificial Sequence
  Synthetic
tctcggaagtacacctcctttccatggctgctcgggtgtgctgccaactggatcctgcgcgggacgtcctttgtt

SEQ ID NO: 105704 - DNA, 75 bp, Artificial Sequence
  Synthetic
tctcggaagtacacctcctttccatggctgctcgggtgtgctgcgaactggatcctgcgcgggacgtcctttgtt

SEQ ID NO: 105705 - DNA, 75 bp, Artificial Sequence
  Synthetic
tctcggaagtacacctccttcccatggctgctcggatgtgctgcaaactggatcctgcgcgggacgtcctttgtt

SEQ ID NO: 105706 - DNA, 75 bp, Artificial Sequence
  Synthetic
tctcggaagtacacctccttcccatggctgctcggatgtgctgctaactggatcctgcgcgggacgtcctttgtt

SEQ ID NO: 105707 - DNA, 75 bp, Artificial Sequence
  Synthetic
tctcggaagtacacctccttcccatggctgctcggatgtgctgccaactggatcctgcgcgggacgtcctttgtt

SEQ ID NO: 105708 - DNA, 75 bp, Artificial Sequence
  Synthetic
tctcggaagtacacctccttcccatggctgctcggatgtgctgcgaactggatcctgcgcgggacgtcctttgtt

SEQ ID NO: 105709 - DNA, 75 bp, Artificial Sequence
  Synthetic
tctcggaagtacacctccttcccatggctgctcggttgtgctgcaaactggatcctgcgcgggacgtcctttgtt

SEQ ID NO: 105710 - DNA, 75 bp, Artificial Sequence
  Synthetic
tctcggaagtacacctccttcccatggctgctcggttgtgctgctaactggatcctgcgcgggacgtcctttgtt

SEQ ID NO: 105711 - DNA, 75 bp, Artificial Sequence
  Synthetic
tctcggaagtacacctccttcccatggctgctcggttgtgctgccaactggatcctgcgcgggacgtcctttgtt

SEQ ID NO: 105712 - DNA, 75 bp, Artificial Sequence
  Synthetic
tctcggaagtacacctccttcccatggctgctcggttgtgctgcgaactggatcctgcgcgggacgtcctttgtt

SEQ ID NO: 105713 - DNA, 75 bp, Artificial Sequence
  Synthetic
tctcggaagtacacctccttcccatggctgctcggctgtgctgcaaactggatcctgcgcgggacgtcctttgtt

SEQ ID NO: 105714 - DNA, 75 bp, Artificial Sequence
  Synthetic
tctcggaagtacacctccttcccatggctgctcggctgtgctgctaactggatcctgcgcgggacgtcctttgtt

SEQ ID NO: 105715 - DNA, 75 bp, Artificial Sequence
  Synthetic
tctcggaagtacacctccttcccatggctgctcggctgtgctgccaactggatcctgcgcgggacgtcctttgtt

SEQ ID NO: 105716 - DNA, 75 bp, Artificial Sequence
  Synthetic
tctcggaagtacacctccttcccatggctgctcggctgtgctgcgaactggatcctgcgcgggacgtcctttgtt

SEQ ID NO: 105717 - DNA, 75 bp, Artificial Sequence
  Synthetic
tctcggaagtacacctccttcccatggctgctcgggtgtgctgcaaactggatcctgcgcgggacgtcctttgtt

SEQ ID NO: 105718 - DNA, 75 bp, Artificial Sequence
  Synthetic
tctcggaagtacacctccttcccatggctgctcgggtgtgctgctaactggatcctgcgcgggacgtcctttgtt

SEQ ID NO: 105719 - DNA, 75 bp, Artificial Sequence
  Synthetic
tctcggaagtacacctccttcccatggctgctcgggtgtgctgccaactggatcctgcgcgggacgtcctttgtt

SEQ ID NO: 105720 - DNA, 75 bp, Artificial Sequence
  Synthetic
tctcggaagtacacctccttcccatggctgctcgggtgtgctgcgaactggatcctgcgcgggacgtcctttgtt

SEQ ID NO: 105721 - DNA, 75 bp, Artificial Sequence
  Synthetic
tctcggaagtacacctccttgccatggctgctcggatgtgctgcaaactggatcctgcgcgggacgtcctttgtt

SEQ ID NO: 105722 - DNA, 75 bp, Artificial Sequence
  Synthetic
tctcggaagtacacctccttgccatggctgctcggatgtgctgctaactggatcctgcgcgggacgtcctttgtt

SEQ ID NO: 105723 - DNA, 75 bp, Artificial Sequence
  Synthetic
tctcggaagtacacctccttgccatggctgctcggatgtgctgccaactggatcctgcgcgggacgtcctttgtt

SEQ ID NO: 105724 - DNA, 75 bp, Artificial Sequence
  Synthetic
tctcggaagtacacctccttgccatggctgctcggatgtgctgcgaactggatcctgcgcgggacgtcctttgtt

SEQ ID NO: 105725 - DNA, 75 bp, Artificial Sequence
  Synthetic
tctcggaagtacacctccttgccatggctgctcggttgtgctgcaaactggatcctgcgcgggacgtcctttgtt

SEQ ID NO: 105726 - DNA, 75 bp, Artificial Sequence
  Synthetic
tctcggaagtacacctccttgccatggctgctcggttgtgctgctaactggatcctgcgcgggacgtcctttgtt

SEQ ID NO: 105727 - DNA, 75 bp, Artificial Sequence
  Synthetic
tctcggaagtacacctccttgccatggctgctcggttgtgctgccaactggatcctgcgcgggacgtcctttgtt

SEQ ID NO: 105728 - DNA, 75 bp, Artificial Sequence
  Synthetic
tctcggaagtacacctccttgccatggctgctcggttgtgctgcgaactggatcctgcgcgggacgtcctttgtt

SEQ ID NO: 105729 - DNA, 75 bp, Artificial Sequence
  Synthetic
tctcggaagtacacctccttgccatggctgctcggctgtgctgcaaactggatcctgcgcgggacgtcctttgtt

SEQ ID NO: 105730 - DNA, 75 bp, Artificial Sequence
  Synthetic
tctcggaagtacacctccttgccatggctgctcggctgtgctgctaactggatcctgcgcgggacgtcctttgtt

SEQ ID NO: 105731 - DNA, 75 bp, Artificial Sequence
  Synthetic
tctcggaagtacacctccttgccatggctgctcggctgtgctgccaactggatcctgcgcgggacgtcctttgtt

SEQ ID NO: 105732 - DNA, 75 bp, Artificial Sequence
  Synthetic
tctcggaagtacacctccttgccatggctgctcggctgtgctgcgaactggatcctgcgcgggacgtcctttgtt

SEQ ID NO: 105733 - DNA, 75 bp, Artificial Sequence
  Synthetic
tctcggaagtacacctccttgccatggctgctcgggtgtgctgcaaactggatcctgcgcgggacgtcctttgtt

SEQ ID NO: 105734 - DNA, 75 bp, Artificial Sequence
  Synthetic
tctcggaagtacacctccttgccatggctgctcgggtgtgctgctaactggatcctgcgcgggacgtcctttgtt

SEQ ID NO: 105735 - DNA, 75 bp, Artificial Sequence
  Synthetic
tctcggaagtacacctccttgccatggctgctcgggtgtgctgccaactggatcctgcgcgggacgtcctttgtt

SEQ ID NO: 105736 - DNA, 75 bp, Artificial Sequence
  Synthetic
tctcggaagtacacctccttgccatggctgctcgggtgtgctgcgaactggatcctgcgcgggacgtcctttgtt

SEQ ID NO: 105737 - DNA, 75 bp, Artificial Sequence
  Synthetic
ttcttgtctcacttttggaagagaaacagtcatagagtatttggtgtctttcggagtgtggattcgcactcctcc

SEQ ID NO: 105738 - DNA, 75 bp, Artificial Sequence
  Synthetic
atttttgcctactgatttcttcccgtcagttcgggacctactcgacaccgcttcagcactataccgggatgcttt

SEQ ID NO: 105739 - DNA, 75 bp, Artificial Sequence
  Synthetic
atttttgcctactgatttcttcccgtcagttcgggacctactcgacaccgcttcagcactttaccgggatgcttt

SEQ ID NO: 105740 - DNA, 75 bp, Artificial Sequence
  Synthetic
atttttgcctactgatttcttcccgtcagttcgggacctactcgacaccgcttcagcactctaccgggatgcttt

SEQ ID NO: 105741 - DNA, 75 bp, Artificial Sequence
  Synthetic
atttttgcctactgatttcttcccgtcagttcgggacctactcgacaccgcttcagcactgtaccgggatgcttt

SEQ ID NO: 105742 - DNA, 75 bp, Artificial Sequence
  Synthetic
atttttgcctactgatttcttcccgtctgttcgggacctactcgacaccgcttcagcactataccgggatgcttt

SEQ ID NO: 105743 - DNA, 75 bp, Artificial Sequence
  Synthetic
atttttgcctactgatttcttcccgtctgttcgggacctactcgacaccgcttcagcactttaccgggatgcttt

SEQ ID NO: 105744 - DNA, 75 bp, Artificial Sequence
  Synthetic
atttttgcctactgatttcttcccgtctgttcgggacctactcgacaccgcttcagcactctaccgggatgcttt

SEQ ID NO: 105745 - DNA, 75 bp, Artificial Sequence
  Synthetic
atttttgcctactgatttcttcccgtctgttcgggacctactcgacaccgcttcagcactgtaccgggatgcttt

SEQ ID NO: 105746 - DNA, 75 bp, Artificial Sequence
  Synthetic
atttttgcctactgatttcttcccgtccgttcgggacctactcgacaccgcttcagcactataccgggatgcttt

SEQ ID NO: 105747 - DNA, 75 bp, Artificial Sequence
  Synthetic
atttttgcctactgatttcttcccgtccgttcgggacctactcgacaccgcttcagcactttaccgggatgcttt

SEQ ID NO: 105748 - DNA, 75 bp, Artificial Sequence
  Synthetic
atttttgcctactgatttcttcccgtccgttcgggacctactcgacaccgcttcagcactctaccgggatgcttt

SEQ ID NO: 105749 - DNA, 75 bp, Artificial Sequence
  Synthetic
atttttgcctactgatttcttcccgtccgttcgggacctactcgacaccgcttcagcactgtaccgggatgcttt

SEQ ID NO: 105750 - DNA, 75 bp, Artificial Sequence
  Synthetic
atttttgcctactgatttcttcccgtcggttcgggacctactcgacaccgcttcagcactataccgggatgcttt

SEQ ID NO: 105751 - DNA, 75 bp, Artificial Sequence
  Synthetic
atttttgcctactgatttcttcccgtcggttcgggacctactcgacaccgcttcagcactttaccgggatgcttt

SEQ ID NO: 105752 - DNA, 75 bp, Artificial Sequence
  Synthetic
atttttgcctactgatttcttcccgtcggttcgggacctactcgacaccgcttcagcactctaccgggatgcttt

SEQ ID NO: 105753 - DNA, 75 bp, Artificial Sequence
  Synthetic
atttttgcctactgatttcttcccgtcggttcgggacctactcgacaccgcttcagcactgtaccgggatgcttt

SEQ ID NO: 105754 - DNA, 75 bp, Artificial Sequence
  Synthetic
atttttgccttctgatttcttcccgtcagttcgggacctactcgacaccgcttcagcactataccgggatgcttt

SEQ ID NO: 105755 - DNA, 75 bp, Artificial Sequence
  Synthetic
atttttgccttctgatttcttcccgtcagttcgggacctactcgacaccgcttcagcactttaccgggatgcttt

SEQ ID NO: 105756 - DNA, 75 bp, Artificial Sequence
  Synthetic
atttttgccttctgatttcttcccgtcagttcgggacctactcgacaccgcttcagcactctaccgggatgcttt

SEQ ID NO: 105757 - DNA, 75 bp, Artificial Sequence
  Synthetic
atttttgccttctgatttcttcccgtcagttcgggacctactcgacaccgcttcagcactgtaccgggatgcttt

SEQ ID NO: 105758 - DNA, 75 bp, Artificial Sequence
  Synthetic
atttttgccttctgatttcttcccgtctgttcgggacctactcgacaccgcttcagcactataccgggatgcttt

SEQ ID NO: 105759 - DNA, 75 bp, Artificial Sequence
  Synthetic
atttttgccttctgatttcttcccgtctgttcgggacctactcgacaccgcttcagcactttaccgggatgcttt

SEQ ID NO: 105760 - DNA, 75 bp, Artificial Sequence
  Synthetic
atttttgccttctgatttcttcccgtctgttcgggacctactcgacaccgcttcagcactctaccgggatgcttt

SEQ ID NO: 105761 - DNA, 75 bp, Artificial Sequence
  Synthetic
atttttgccttctgatttcttcccgtctgttcgggacctactcgacaccgcttcagcactgtaccgggatgcttt

SEQ ID NO: 105762 - DNA, 75 bp, Artificial Sequence
  Synthetic
atttttgccttctgatttcttcccgtccgttcgggacctactcgacaccgcttcagcactataccgggatgcttt

SEQ ID NO: 105763 - DNA, 75 bp, Artificial Sequence
  Synthetic
atttttgccttctgatttcttcccgtccgttcgggacctactcgacaccgcttcagcactttaccgggatgcttt

SEQ ID NO: 105764 - DNA, 75 bp, Artificial Sequence
  Synthetic
atttttgccttctgatttcttcccgtccgttcgggacctactcgacaccgcttcagcactctaccgggatgcttt

SEQ ID NO: 105765 - DNA, 75 bp, Artificial Sequence
  Synthetic
atttttgccttctgatttcttcccgtccgttcgggacctactcgacaccgcttcagcactgtaccgggatgcttt

SEQ ID NO: 105766 - DNA, 75 bp, Artificial Sequence
  Synthetic
atttttgccttctgatttcttcccgtcggttcgggacctactcgacaccgcttcagcactataccgggatgcttt

SEQ ID NO: 105767 - DNA, 75 bp, Artificial Sequence
  Synthetic
atttttgccttctgatttcttcccgtcggttcgggacctactcgacaccgcttcagcactttaccgggatgcttt

SEQ ID NO: 105768 - DNA, 75 bp, Artificial Sequence
  Synthetic
atttttgccttctgatttcttcccgtcggttcgggacctactcgacaccgcttcagcactctaccgggatgcttt

SEQ ID NO: 105769 - DNA, 75 bp, Artificial Sequence
  Synthetic
atttttgccttctgatttcttcccgtcggttcgggacctactcgacaccgcttcagcactgtaccgggatgcttt

SEQ ID NO: 105770 - DNA, 75 bp, Artificial Sequence
  Synthetic
atttttgcctcctgatttcttcccgtcagttcgggacctactcgacaccgcttcagcactataccgggatgcttt

SEQ ID NO: 105771 - DNA, 75 bp, Artificial Sequence
  Synthetic
atttttgcctcctgatttcttcccgtcagttcgggacctactcgacaccgcttcagcactttaccgggatgcttt

SEQ ID NO: 105772 - DNA, 75 bp, Artificial Sequence
  Synthetic
atttttgcctcctgatttcttcccgtcagttcgggacctactcgacaccgcttcagcactctaccgggatgcttt

SEQ ID NO: 105773 - DNA, 75 bp, Artificial Sequence
  Synthetic
atttttgcctcctgatttcttcccgtcagttcgggacctactcgacaccgcttcagcactgtaccgggatgcttt

SEQ ID NO: 105774 - DNA, 75 bp, Artificial Sequence
  Synthetic
atttttgcctcctgatttcttcccgtctgttcgggacctactcgacaccgcttcagcactataccgggatgcttt

SEQ ID NO: 105775 - DNA, 75 bp, Artificial Sequence
  Synthetic
atttttgcctcctgatttcttcccgtctgttcgggacctactcgacaccgcttcagcactttaccgggatgcttt

SEQ ID NO: 105776 - DNA, 75 bp, Artificial Sequence
  Synthetic
atttttgcctcctgatttcttcccgtctgttcgggacctactcgacaccgcttcagcactctaccgggatgcttt

SEQ ID NO: 105777 - DNA, 75 bp, Artificial Sequence
  Synthetic
atttttgcctcctgatttcttcccgtctgttcgggacctactcgacaccgcttcagcactgtaccgggatgcttt

SEQ ID NO: 105778 - DNA, 75 bp, Artificial Sequence
  Synthetic
atttttgcctcctgatttcttcccgtccgttcgggacctactcgacaccgcttcagcactataccgggatgcttt

SEQ ID NO: 105779 - DNA, 75 bp, Artificial Sequence
  Synthetic
atttttgcctcctgatttcttcccgtccgttcgggacctactcgacaccgcttcagcactttaccgggatgcttt

SEQ ID NO: 105780 - DNA, 75 bp, Artificial Sequence
  Synthetic
atttttgcctcctgatttcttcccgtccgttcgggacctactcgacaccgcttcagcactctaccgggatgcttt

SEQ ID NO: 105781 - DNA, 75 bp, Artificial Sequence
  Synthetic
atttttgcctcctgatttcttcccgtccgttcgggacctactcgacaccgcttcagcactgtaccgggatgcttt

SEQ ID NO: 105782 - DNA, 75 bp, Artificial Sequence
  Synthetic
atttttgcctcctgatttcttcccgtcggttcgggacctactcgacaccgcttcagcactataccgggatgcttt

SEQ ID NO: 105783 - DNA, 75 bp, Artificial Sequence
  Synthetic
atttttgcctcctgatttcttcccgtcggttcgggacctactcgacaccgcttcagcactttaccgggatgcttt

SEQ ID NO: 105784 - DNA, 75 bp, Artificial Sequence
  Synthetic
atttttgcctcctgatttcttcccgtcggttcgggacctactcgacaccgcttcagcactctaccgggatgcttt

SEQ ID NO: 105785 - DNA, 75 bp, Artificial Sequence
  Synthetic
atttttgcctcctgatttcttcccgtcggttcgggacctactcgacaccgcttcagcactgtaccgggatgcttt

SEQ ID NO: 105786 - DNA, 75 bp, Artificial Sequence
  Synthetic
atttttgcctgctgatttcttcccgtcagttcgggacctactcgacaccgcttcagcactataccgggatgcttt

SEQ ID NO: 105787 - DNA, 75 bp, Artificial Sequence
  Synthetic
atttttgcctgctgatttcttcccgtcagttcgggacctactcgacaccgcttcagcactttaccgggatgcttt

SEQ ID NO: 105788 - DNA, 75 bp, Artificial Sequence
  Synthetic
atttttgcctgctgatttcttcccgtcagttcgggacctactcgacaccgcttcagcactctaccgggatgcttt

SEQ ID NO: 105789 - DNA, 75 bp, Artificial Sequence
  Synthetic
atttttgcctgctgatttcttcccgtcagttcgggacctactcgacaccgcttcagcactgtaccgggatgcttt

SEQ ID NO: 105790 - DNA, 75 bp, Artificial Sequence
  Synthetic
atttttgcctgctgatttcttcccgtctgttcgggacctactcgacaccgcttcagcactataccgggatgcttt

SEQ ID NO: 105791 - DNA, 75 bp, Artificial Sequence
  Synthetic
atttttgcctgctgatttcttcccgtctgttcgggacctactcgacaccgcttcagcactttaccgggatgcttt

SEQ ID NO: 105792 - DNA, 75 bp, Artificial Sequence
  Synthetic
atttttgcctgctgatttcttcccgtctgttcgggacctactcgacaccgcttcagcactctaccgggatgcttt

SEQ ID NO: 105793 - DNA, 75 bp, Artificial Sequence
  Synthetic
atttttgcctgctgatttcttcccgtctgttcgggacctactcgacaccgcttcagcactgtaccgggatgcttt

SEQ ID NO: 105794 - DNA, 75 bp, Artificial Sequence
  Synthetic
atttttgcctgctgatttcttcccgtccgttcgggacctactcgacaccgcttcagcactataccgggatgcttt

SEQ ID NO: 105795 - DNA, 75 bp, Artificial Sequence
  Synthetic
atttttgcctgctgatttcttcccgtccgttcgggacctactcgacaccgcttcagcactttaccgggatgcttt

SEQ ID NO: 105796 - DNA, 75 bp, Artificial Sequence
  Synthetic
atttttgcctgctgatttcttcccgtccgttcgggacctactcgacaccgcttcagcactctaccgggatgcttt

SEQ ID NO: 105797 - DNA, 75 bp, Artificial Sequence
  Synthetic
atttttgcctgctgatttcttcccgtccgttcgggacctactcgacaccgcttcagcactgtaccgggatgcttt

SEQ ID NO: 105798 - DNA, 75 bp, Artificial Sequence
  Synthetic
atttttgcctgctgatttcttcccgtcggttcgggacctactcgacaccgcttcagcactataccgggatgcttt

SEQ ID NO: 105799 - DNA, 75 bp, Artificial Sequence
  Synthetic
atttttgcctgctgatttcttcccgtcggttcgggacctactcgacaccgcttcagcactttaccgggatgcttt

SEQ ID NO: 105800 - DNA, 75 bp, Artificial Sequence
  Synthetic
atttttgcctgctgatttcttcccgtcggttcgggacctactcgacaccgcttcagcactctaccgggatgcttt

SEQ ID NO: 105801 - DNA, 75 bp, Artificial Sequence
  Synthetic
atttttgcctgctgatttcttcccgtcggttcgggacctactcgacaccgcttcagcactgtaccgggatgcttt

SEQ ID NO: 105802 - DNA, 75 bp, Artificial Sequence
  Synthetic
ccaaatatttgccattggataagggtattaaaccttattatccagaacatctagttaatcattacttccaaacca

SEQ ID NO: 105803 - DNA, 75 bp, Artificial Sequence
  Synthetic
atggctgctaggctgtgctgccaactggatcctgcgcgggacgtcctttgtttacgtcccgtcggcgctgaatcc

SEQ ID NO: 105804 - DNA, 75 bp, Artificial Sequence
  Synthetic
agagtctccagaacattgttcacctaaccatacagcactcaggcaagctgttctgtgttggggtgagttaatgaa

SEQ ID NO: 105805 - DNA, 75 bp, Artificial Sequence
  Synthetic
catgggtctaaaaatcaggcaattgttgtggtttcacatttcctgtcttacttttggaagagaaactgttcttga

SEQ ID NO: 105806 - DNA, 75 bp, Artificial Sequence
  Synthetic
tccacctacatcaggatattattaataagtgtcagcaatttgtaggccctcttacagtaaatgaaaaacgaaggt

SEQ ID NO: 105807 - DNA, 75 bp, Artificial Sequence
  Synthetic
catgggcctaaaaatcagacaactattgtggtttcacatttcctgtcttacctttggaagagaaactgttcttga

SEQ ID NO: 105808 - DNA, 75 bp, Artificial Sequence
  Synthetic
tcagcaatgtcaacgaccgaccttgaggcatacttcaaagactgtgtgtttactgagtgggaggagttgggggag

SEQ ID NO: 105809 - DNA, 75 bp, Artificial Sequence
  Synthetic
ttataccgctgttaccaattttctgttatctgtgggtatccatttaaatacctctaaaacaaaaagatggggtta

SEQ ID NO: 105810 - DNA, 75 bp, Artificial Sequence
  Synthetic
ttcatttgcatcaggatatcattaaagggtgtcaacaatttgtaggcccccttacagtaaatgaaaaaagaagat

SEQ ID NO: 105811 - DNA, 75 bp, Artificial Sequence
  Synthetic
atatttggtctcttttggagtgtggatacgcactcctcctgcatatagaccacaaaatgcccctatcttatcaac

SEQ ID NO: 105812 - DNA, 75 bp, Artificial Sequence
  Synthetic
atatttggtctcttttggagtgtggatacgcactcctcctgcatatagaccacaaaatgcccctatcttatctac

SEQ ID NO: 105813 - DNA, 75 bp, Artificial Sequence
  Synthetic
atatttggtctcttttggagtgtggatacgcactcctcctgcatatagaccacaaaatgcccctatcttatccac

SEQ ID NO: 105814 - DNA, 75 bp, Artificial Sequence
  Synthetic
atatttggtctcttttggagtgtggatacgcactcctcctgcatatagaccacaaaatgcccctatcttatcgac

SEQ ID NO: 105815 - DNA, 75 bp, Artificial Sequence
  Synthetic
atatttggtctcttttggagtgtggatacgcactcctcctgcatatagtccacaaaatgcccctatcttatcaac

SEQ ID NO: 105816 - DNA, 75 bp, Artificial Sequence
  Synthetic
atatttggtctcttttggagtgtggatacgcactcctcctgcatatagtccacaaaatgcccctatcttatctac

SEQ ID NO: 105817 - DNA, 75 bp, Artificial Sequence
  Synthetic
atatttggtctcttttggagtgtggatacgcactcctcctgcatatagtccacaaaatgcccctatcttatccac

SEQ ID NO: 105818 - DNA, 75 bp, Artificial Sequence
  Synthetic
atatttggtctcttttggagtgtggatacgcactcctcctgcatatagtccacaaaatgcccctatcttatcgac

SEQ ID NO: 105819 - DNA, 75 bp, Artificial Sequence
  Synthetic
atatttggtctcttttggagtgtggatacgcactcctcctgcatatagcccacaaaatgcccctatcttatcaac

SEQ ID NO: 105820 - DNA, 75 bp, Artificial Sequence
  Synthetic
atatttggtctcttttggagtgtggatacgcactcctcctgcatatagcccacaaaatgcccctatcttatctac

SEQ ID NO: 105821 - DNA, 75 bp, Artificial Sequence
  Synthetic
atatttggtctcttttggagtgtggatacgcactcctcctgcatatagcccacaaaatgcccctatcttatccac

SEQ ID NO: 105822 - DNA, 75 bp, Artificial Sequence
  Synthetic
atatttggtctcttttggagtgtggatacgcactcctcctgcatatagcccacaaaatgcccctatcttatcgac

SEQ ID NO: 105823 - DNA, 75 bp, Artificial Sequence
  Synthetic
atatttggtctcttttggagtgtggatacgcactcctcctgcatataggccacaaaatgcccctatcttatcaac

SEQ ID NO: 105824 - DNA, 75 bp, Artificial Sequence
  Synthetic
atatttggtctcttttggagtgtggatacgcactcctcctgcatataggccacaaaatgcccctatcttatctac

SEQ ID NO: 105825 - DNA, 75 bp, Artificial Sequence
  Synthetic
atatttggtctcttttggagtgtggatacgcactcctcctgcatataggccacaaaatgcccctatcttatccac

SEQ ID NO: 105826 - DNA, 75 bp, Artificial Sequence
  Synthetic
atatttggtctcttttggagtgtggatacgcactcctcctgcatataggccacaaaatgcccctatcttatcgac

SEQ ID NO: 105827 - DNA, 75 bp, Artificial Sequence
  Synthetic
atatttggtctcttttggagtgtggattcgcactcctcctgcatatagaccacaaaatgcccctatcttatcaac

SEQ ID NO: 105828 - DNA, 75 bp, Artificial Sequence
  Synthetic
atatttggtctcttttggagtgtggattcgcactcctcctgcatatagaccacaaaatgcccctatcttatctac

SEQ ID NO: 105829 - DNA, 75 bp, Artificial Sequence
  Synthetic
atatttggtctcttttggagtgtggattcgcactcctcctgcatatagaccacaaaatgcccctatcttatccac

SEQ ID NO: 105830 - DNA, 75 bp, Artificial Sequence
  Synthetic
atatttggtctcttttggagtgtggattcgcactcctcctgcatatagaccacaaaatgcccctatcttatcgac

SEQ ID NO: 105831 - DNA, 75 bp, Artificial Sequence
  Synthetic
atatttggtctcttttggagtgtggattcgcactcctcctgcatatagtccacaaaatgcccctatcttatcaac

SEQ ID NO: 105832 - DNA, 75 bp, Artificial Sequence
  Synthetic
atatttggtctcttttggagtgtggattcgcactcctcctgcatatagtccacaaaatgcccctatcttatctac

SEQ ID NO: 105833 - DNA, 75 bp, Artificial Sequence
  Synthetic
atatttggtctcttttggagtgtggattcgcactcctcctgcatatagtccacaaaatgcccctatcttatccac

SEQ ID NO: 105834 - DNA, 75 bp, Artificial Sequence
  Synthetic
atatttggtctcttttggagtgtggattcgcactcctcctgcatatagtccacaaaatgcccctatcttatcgac

SEQ ID NO: 105835 - DNA, 75 bp, Artificial Sequence
  Synthetic
atatttggtctcttttggagtgtggattcgcactcctcctgcatatagcccacaaaatgcccctatcttatcaac

SEQ ID NO: 105836 - DNA, 75 bp, Artificial Sequence
  Synthetic
atatttggtctcttttggagtgtggattcgcactcctcctgcatatagcccacaaaatgcccctatcttatctac

SEQ ID NO: 105837 - DNA, 75 bp, Artificial Sequence
  Synthetic
atatttggtctcttttggagtgtggattcgcactcctcctgcatatagcccacaaaatgcccctatcttatccac

SEQ ID NO: 105838 - DNA, 75 bp, Artificial Sequence
  Synthetic
atatttggtctcttttggagtgtggattcgcactcctcctgcatatagcccacaaaatgcccctatcttatcgac

SEQ ID NO: 105839 - DNA, 75 bp, Artificial Sequence
  Synthetic
atatttggtctcttttggagtgtggattcgcactcctcctgcatataggccacaaaatgcccctatcttatcaac

SEQ ID NO: 105840 - DNA, 75 bp, Artificial Sequence
  Synthetic
atatttggtctcttttggagtgtggattcgcactcctcctgcatataggccacaaaatgcccctatcttatctac

SEQ ID NO: 105841 - DNA, 75 bp, Artificial Sequence
  Synthetic
atatttggtctcttttggagtgtggattcgcactcctcctgcatataggccacaaaatgcccctatcttatccac

SEQ ID NO: 105842 - DNA, 75 bp, Artificial Sequence
  Synthetic
atatttggtctcttttggagtgtggattcgcactcctcctgcatataggccacaaaatgcccctatcttatcgac

SEQ ID NO: 105843 - DNA, 75 bp, Artificial Sequence
  Synthetic
atatttggtctcttttggagtgtggatccgcactcctcctgcatatagaccacaaaatgcccctatcttatcaac

SEQ ID NO: 105844 - DNA, 75 bp, Artificial Sequence
  Synthetic
atatttggtctcttttggagtgtggatccgcactcctcctgcatatagaccacaaaatgcccctatcttatctac

SEQ ID NO: 105845 - DNA, 75 bp, Artificial Sequence
  Synthetic
atatttggtctcttttggagtgtggatccgcactcctcctgcatatagaccacaaaatgcccctatcttatccac

SEQ ID NO: 105846 - DNA, 75 bp, Artificial Sequence
  Synthetic
atatttggtctcttttggagtgtggatccgcactcctcctgcatatagaccacaaaatgcccctatcttatcgac

SEQ ID NO: 105847 - DNA, 75 bp, Artificial Sequence
  Synthetic
atatttggtctcttttggagtgtggatccgcactcctcctgcatatagtccacaaaatgcccctatcttatcaac

SEQ ID NO: 105848 - DNA, 75 bp, Artificial Sequence
  Synthetic
atatttggtctcttttggagtgtggatccgcactcctcctgcatatagtccacaaaatgcccctatcttatctac

SEQ ID NO: 105849 - DNA, 75 bp, Artificial Sequence
  Synthetic
atatttggtctcttttggagtgtggatccgcactcctcctgcatatagtccacaaaatgcccctatcttatccac

SEQ ID NO: 105850 - DNA, 75 bp, Artificial Sequence
  Synthetic
atatttggtctcttttggagtgtggatccgcactcctcctgcatatagtccacaaaatgcccctatcttatcgac

SEQ ID NO: 105851 - DNA, 75 bp, Artificial Sequence
  Synthetic
atatttggtctcttttggagtgtggatccgcactcctcctgcatatagcccacaaaatgcccctatcttatcaac

SEQ ID NO: 105852 - DNA, 75 bp, Artificial Sequence
  Synthetic
atatttggtctcttttggagtgtggatccgcactcctcctgcatatagcccacaaaatgcccctatcttatctac

SEQ ID NO: 105853 - DNA, 75 bp, Artificial Sequence
  Synthetic
atatttggtctcttttggagtgtggatccgcactcctcctgcatatagcccacaaaatgcccctatcttatccac

SEQ ID NO: 105854 - DNA, 75 bp, Artificial Sequence
  Synthetic
atatttggtctcttttggagtgtggatccgcactcctcctgcatatagcccacaaaatgcccctatcttatcgac

SEQ ID NO: 105855 - DNA, 75 bp, Artificial Sequence
  Synthetic
atatttggtctcttttggagtgtggatccgcactcctcctgcatataggccacaaaatgcccctatcttatcaac

SEQ ID NO: 105856 - DNA, 75 bp, Artificial Sequence
  Synthetic
atatttggtctcttttggagtgtggatccgcactcctcctgcatataggccacaaaatgcccctatcttatctac

SEQ ID NO: 105857 - DNA, 75 bp, Artificial Sequence
  Synthetic
atatttggtctcttttggagtgtggatccgcactcctcctgcatataggccacaaaatgcccctatcttatccac

SEQ ID NO: 105858 - DNA, 75 bp, Artificial Sequence
  Synthetic
atatttggtctcttttggagtgtggatccgcactcctcctgcatataggccacaaaatgcccctatcttatcgac

SEQ ID NO: 105859 - DNA, 75 bp, Artificial Sequence
  Synthetic
atatttggtctcttttggagtgtggatgcgcactcctcctgcatatagaccacaaaatgcccctatcttatcaac

SEQ ID NO: 105860 - DNA, 75 bp, Artificial Sequence
  Synthetic
atatttggtctcttttggagtgtggatgcgcactcctcctgcatatagaccacaaaatgcccctatcttatctac

SEQ ID NO: 105861 - DNA, 75 bp, Artificial Sequence
  Synthetic
atatttggtctcttttggagtgtggatgcgcactcctcctgcatatagaccacaaaatgcccctatcttatccac

SEQ ID NO: 105862 - DNA, 75 bp, Artificial Sequence
  Synthetic
atatttggtctcttttggagtgtggatgcgcactcctcctgcatatagaccacaaaatgcccctatcttatcgac

SEQ ID NO: 105863 - DNA, 75 bp, Artificial Sequence
  Synthetic
atatttggtctcttttggagtgtggatgcgcactcctcctgcatatagtccacaaaatgcccctatcttatcaac

SEQ ID NO: 105864 - DNA, 75 bp, Artificial Sequence
  Synthetic
atatttggtctcttttggagtgtggatgcgcactcctcctgcatatagtccacaaaatgcccctatcttatctac

SEQ ID NO: 105865 - DNA, 75 bp, Artificial Sequence
  Synthetic
atatttggtctcttttggagtgtggatgcgcactcctcctgcatatagtccacaaaatgcccctatcttatccac

SEQ ID NO: 105866 - DNA, 75 bp, Artificial Sequence
  Synthetic
atatttggtctcttttggagtgtggatgcgcactcctcctgcatatagtccacaaaatgcccctatcttatcgac

SEQ ID NO: 105867 - DNA, 75 bp, Artificial Sequence
  Synthetic
atatttggtctcttttggagtgtggatgcgcactcctcctgcatatagcccacaaaatgcccctatcttatcaac

SEQ ID NO: 105868 - DNA, 75 bp, Artificial Sequence
  Synthetic
atatttggtctcttttggagtgtggatgcgcactcctcctgcatatagcccacaaaatgcccctatcttatctac

SEQ ID NO: 105869 - DNA, 75 bp, Artificial Sequence
  Synthetic
atatttggtctcttttggagtgtggatgcgcactcctcctgcatatagcccacaaaatgcccctatcttatccac

SEQ ID NO: 105870 - DNA, 75 bp, Artificial Sequence
  Synthetic
atatttggtctcttttggagtgtggatgcgcactcctcctgcatatagcccacaaaatgcccctatcttatcgac

SEQ ID NO: 105871 - DNA, 75 bp, Artificial Sequence
  Synthetic
atatttggtctcttttggagtgtggatgcgcactcctcctgcatataggccacaaaatgcccctatcttatcaac

SEQ ID NO: 105872 - DNA, 75 bp, Artificial Sequence
  Synthetic
atatttggtctcttttggagtgtggatgcgcactcctcctgcatataggccacaaaatgcccctatcttatctac

SEQ ID NO: 105873 - DNA, 75 bp, Artificial Sequence
  Synthetic
atatttggtctcttttggagtgtggatgcgcactcctcctgcatataggccacaaaatgcccctatcttatccac

SEQ ID NO: 105874 - DNA, 75 bp, Artificial Sequence
  Synthetic
atatttggtctcttttggagtgtggatgcgcactcctcctgcatataggccacaaaatgcccctatcttatcgac

SEQ ID NO: 105875 - DNA, 75 bp, Artificial Sequence
  Synthetic
agacctagtagtcagttatgtcaacactaatatgggcctaaagttcaggcaactcttgtggtttcacatttcttg

SEQ ID NO: 105876 - DNA, 75 bp, Artificial Sequence
  Synthetic
tcaggcaagctatcttgtgatggggtgagttaatgactttggcttcctgggtgggcaataatttggaagaacctg

SEQ ID NO: 105877 - DNA, 75 bp, Artificial Sequence
  Synthetic
tcaggcaagctatcttgtgatggggtgagttaatgactttggcttcctgggtgggcaataatttggaagatcctg

SEQ ID NO: 105878 - DNA, 75 bp, Artificial Sequence
  Synthetic
tcaggcaagctatcttgtgatggggtgagttaatgactttggcttcctgggtgggcaataatttggaagaccctg

SEQ ID NO: 105879 - DNA, 75 bp, Artificial Sequence
  Synthetic
tcaggcaagctatcttgtgatggggtgagttaatgactttggcttcctgggtgggcaataatttggaagagcctg

SEQ ID NO: 105880 - DNA, 75 bp, Artificial Sequence
  Synthetic
tcaggcaagctatcttgtgatggggtgagttaatgactttggcttcctgggtgggcaataatttggatgaacctg

SEQ ID NO: 105881 - DNA, 75 bp, Artificial Sequence
  Synthetic
tcaggcaagctatcttgtgatggggtgagttaatgactttggcttcctgggtgggcaataatttggatgatcctg

SEQ ID NO: 105882 - DNA, 75 bp, Artificial Sequence
  Synthetic
tcaggcaagctatcttgtgatggggtgagttaatgactttggcttcctgggtgggcaataatttggatgaccctg

SEQ ID NO: 105883 - DNA, 75 bp, Artificial Sequence
  Synthetic
tcaggcaagctatcttgtgatggggtgagttaatgactttggcttcctgggtgggcaataatttggatgagcctg

SEQ ID NO: 105884 - DNA, 75 bp, Artificial Sequence
  Synthetic
tcaggcaagctatcttgtgatggggtgagttaatgactttggcttcctgggtgggcaataatttggacgaacctg

SEQ ID NO: 105885 - DNA, 75 bp, Artificial Sequence
  Synthetic
tcaggcaagctatcttgtgatggggtgagttaatgactttggcttcctgggtgggcaataatttggacgatcctg

SEQ ID NO: 105886 - DNA, 75 bp, Artificial Sequence
  Synthetic
tcaggcaagctatcttgtgatggggtgagttaatgactttggcttcctgggtgggcaataatttggacgaccctg

SEQ ID NO: 105887 - DNA, 75 bp, Artificial Sequence
  Synthetic
tcaggcaagctatcttgtgatggggtgagttaatgactttggcttcctgggtgggcaataatttggacgagcctg

SEQ ID NO: 105888 - DNA, 75 bp, Artificial Sequence
  Synthetic
tcaggcaagctatcttgtgatggggtgagttaatgactttggcttcctgggtgggcaataatttggaggaacctg

SEQ ID NO: 105889 - DNA, 75 bp, Artificial Sequence
  Synthetic
tcaggcaagctatcttgtgatggggtgagttaatgactttggcttcctgggtgggcaataatttggaggatcctg

SEQ ID NO: 105890 - DNA, 75 bp, Artificial Sequence
  Synthetic
tcaggcaagctatcttgtgatggggtgagttaatgactttggcttcctgggtgggcaataatttggaggaccctg

SEQ ID NO: 105891 - DNA, 75 bp, Artificial Sequence
  Synthetic
tcaggcaagctatcttgtgatggggtgagttaatgactttggcttcctgggtgggcaataatttggaggagcctg

SEQ ID NO: 105892 - DNA, 75 bp, Artificial Sequence
  Synthetic
tcaggcaagctatcttgtgttggggtgagttaatgactttggcttcctgggtgggcaataatttggaagaacctg

SEQ ID NO: 105893 - DNA, 75 bp, Artificial Sequence
  Synthetic
tcaggcaagctatcttgtgttggggtgagttaatgactttggcttcctgggtgggcaataatttggaagatcctg

SEQ ID NO: 105894 - DNA, 75 bp, Artificial Sequence
  Synthetic
tcaggcaagctatcttgtgttggggtgagttaatgactttggcttcctgggtgggcaataatttggaagaccctg

SEQ ID NO: 105895 - DNA, 75 bp, Artificial Sequence
  Synthetic
tcaggcaagctatcttgtgttggggtgagttaatgactttggcttcctgggtgggcaataatttggaagagcctg

SEQ ID NO: 105896 - DNA, 75 bp, Artificial Sequence
  Synthetic
tcaggcaagctatcttgtgttggggtgagttaatgactttggcttcctgggtgggcaataatttggatgaacctg

SEQ ID NO: 105897 - DNA, 75 bp, Artificial Sequence
  Synthetic
tcaggcaagctatcttgtgttggggtgagttaatgactttggcttcctgggtgggcaataatttggatgatcctg

SEQ ID NO: 105898 - DNA, 75 bp, Artificial Sequence
  Synthetic
tcaggcaagctatcttgtgttggggtgagttaatgactttggcttcctgggtgggcaataatttggatgaccctg

SEQ ID NO: 105899 - DNA, 75 bp, Artificial Sequence
  Synthetic
tcaggcaagctatcttgtgttggggtgagttaatgactttggcttcctgggtgggcaataatttggatgagcctg

SEQ ID NO: 105900 - DNA, 75 bp, Artificial Sequence
  Synthetic
tcaggcaagctatcttgtgttggggtgagttaatgactttggcttcctgggtgggcaataatttggacgaacctg

SEQ ID NO: 105901 - DNA, 75 bp, Artificial Sequence
  Synthetic
tcaggcaagctatcttgtgttggggtgagttaatgactttggcttcctgggtgggcaataatttggacgatcctg

SEQ ID NO: 105902 - DNA, 75 bp, Artificial Sequence
  Synthetic
tcaggcaagctatcttgtgttggggtgagttaatgactttggcttcctgggtgggcaataatttggacgaccctg

SEQ ID NO: 105903 - DNA, 75 bp, Artificial Sequence
  Synthetic
tcaggcaagctatcttgtgttggggtgagttaatgactttggcttcctgggtgggcaataatttggacgagcctg

SEQ ID NO: 105904 - DNA, 75 bp, Artificial Sequence
  Synthetic
tcaggcaagctatcttgtgttggggtgagttaatgactttggcttcctgggtgggcaataatttggaggaacctg

SEQ ID NO: 105905 - DNA, 75 bp, Artificial Sequence
  Synthetic
tcaggcaagctatcttgtgttggggtgagttaatgactttggcttcctgggtgggcaataatttggaggatcctg

SEQ ID NO: 105906 - DNA, 75 bp, Artificial Sequence
  Synthetic
tcaggcaagctatcttgtgttggggtgagttaatgactttggcttcctgggtgggcaataatttggaggaccctg

SEQ ID NO: 105907 - DNA, 75 bp, Artificial Sequence
  Synthetic
tcaggcaagctatcttgtgttggggtgagttaatgactttggcttcctgggtgggcaataatttggaggagcctg

SEQ ID NO: 105908 - DNA, 75 bp, Artificial Sequence
  Synthetic
tcaggcaagctatcttgtgctggggtgagttaatgactttggcttcctgggtgggcaataatttggaagaacctg

SEQ ID NO: 105909 - DNA, 75 bp, Artificial Sequence
  Synthetic
tcaggcaagctatcttgtgctggggtgagttaatgactttggcttcctgggtgggcaataatttggaagatcctg

SEQ ID NO: 105910 - DNA, 75 bp, Artificial Sequence
  Synthetic
tcaggcaagctatcttgtgctggggtgagttaatgactttggcttcctgggtgggcaataatttggaagaccctg

SEQ ID NO: 105911 - DNA, 75 bp, Artificial Sequence
  Synthetic
tcaggcaagctatcttgtgctggggtgagttaatgactttggcttcctgggtgggcaataatttggaagagcctg

SEQ ID NO: 105912 - DNA, 75 bp, Artificial Sequence
  Synthetic
tcaggcaagctatcttgtgctggggtgagttaatgactttggcttcctgggtgggcaataatttggatgaacctg

SEQ ID NO: 105913 - DNA, 75 bp, Artificial Sequence
  Synthetic
tcaggcaagctatcttgtgctggggtgagttaatgactttggcttcctgggtgggcaataatttggatgatcctg

SEQ ID NO: 105914 - DNA, 75 bp, Artificial Sequence
  Synthetic
tcaggcaagctatcttgtgctggggtgagttaatgactttggcttcctgggtgggcaataatttggatgaccctg

SEQ ID NO: 105915 - DNA, 75 bp, Artificial Sequence
  Synthetic
tcaggcaagctatcttgtgctggggtgagttaatgactttggcttcctgggtgggcaataatttggatgagcctg

SEQ ID NO: 105916 - DNA, 75 bp, Artificial Sequence
  Synthetic
tcaggcaagctatcttgtgctggggtgagttaatgactttggcttcctgggtgggcaataatttggacgaacctg

SEQ ID NO: 105917 - DNA, 75 bp, Artificial Sequence
  Synthetic
tcaggcaagctatcttgtgctggggtgagttaatgactttggcttcctgggtgggcaataatttggacgatcctg

SEQ ID NO: 105918 - DNA, 75 bp, Artificial Sequence
  Synthetic
tcaggcaagctatcttgtgctggggtgagttaatgactttggcttcctgggtgggcaataatttggacgaccctg

SEQ ID NO: 105919 - DNA, 75 bp, Artificial Sequence
  Synthetic
tcaggcaagctatcttgtgctggggtgagttaatgactttggcttcctgggtgggcaataatttggacgagcctg

SEQ ID NO: 105920 - DNA, 75 bp, Artificial Sequence
  Synthetic
tcaggcaagctatcttgtgctggggtgagttaatgactttggcttcctgggtgggcaataatttggaggaacctg

SEQ ID NO: 105921 - DNA, 75 bp, Artificial Sequence
  Synthetic
tcaggcaagctatcttgtgctggggtgagttaatgactttggcttcctgggtgggcaataatttggaggatcctg

SEQ ID NO: 105922 - DNA, 75 bp, Artificial Sequence
  Synthetic
tcaggcaagctatcttgtgctggggtgagttaatgactttggcttcctgggtgggcaataatttggaggaccctg

SEQ ID NO: 105923 - DNA, 75 bp, Artificial Sequence
  Synthetic
tcaggcaagctatcttgtgctggggtgagttaatgactttggcttcctgggtgggcaataatttggaggagcctg

SEQ ID NO: 105924 - DNA, 75 bp, Artificial Sequence
  Synthetic
tcaggcaagctatcttgtggtggggtgagttaatgactttggcttcctgggtgggcaataatttggaagaacctg

SEQ ID NO: 105925 - DNA, 75 bp, Artificial Sequence
  Synthetic
tcaggcaagctatcttgtggtggggtgagttaatgactttggcttcctgggtgggcaataatttggaagatcctg

SEQ ID NO: 105926 - DNA, 75 bp, Artificial Sequence
  Synthetic
tcaggcaagctatcttgtggtggggtgagttaatgactttggcttcctgggtgggcaataatttggaagaccctg

SEQ ID NO: 105927 - DNA, 75 bp, Artificial Sequence
  Synthetic
tcaggcaagctatcttgtggtggggtgagttaatgactttggcttcctgggtgggcaataatttggaagagcctg

SEQ ID NO: 105928 - DNA, 75 bp, Artificial Sequence
  Synthetic
tcaggcaagctatcttgtggtggggtgagttaatgactttggcttcctgggtgggcaataatttggatgaacctg

SEQ ID NO: 105929 - DNA, 75 bp, Artificial Sequence
  Synthetic
tcaggcaagctatcttgtggtggggtgagttaatgactttggcttcctgggtgggcaataatttggatgatcctg

SEQ ID NO: 105930 - DNA, 75 bp, Artificial Sequence
  Synthetic
tcaggcaagctatcttgtggtggggtgagttaatgactttggcttcctgggtgggcaataatttggatgaccctg

SEQ ID NO: 105931 - DNA, 75 bp, Artificial Sequence
  Synthetic
tcaggcaagctatcttgtggtggggtgagttaatgactttggcttcctgggtgggcaataatttggatgagcctg

SEQ ID NO: 105932 - DNA, 75 bp, Artificial Sequence
  Synthetic
tcaggcaagctatcttgtggtggggtgagttaatgactttggcttcctgggtgggcaataatttggacgaacctg

SEQ ID NO: 105933 - DNA, 75 bp, Artificial Sequence
  Synthetic
tcaggcaagctatcttgtggtggggtgagttaatgactttggcttcctgggtgggcaataatttggacgatcctg

SEQ ID NO: 105934 - DNA, 75 bp, Artificial Sequence
  Synthetic
tcaggcaagctatcttgtggtggggtgagttaatgactttggcttcctgggtgggcaataatttggacgaccctg

SEQ ID NO: 105935 - DNA, 75 bp, Artificial Sequence
  Synthetic
tcaggcaagctatcttgtggtggggtgagttaatgactttggcttcctgggtgggcaataatttggacgagcctg

SEQ ID NO: 105936 - DNA, 75 bp, Artificial Sequence
  Synthetic
tcaggcaagctatcttgtggtggggtgagttaatgactttggcttcctgggtgggcaataatttggaggaacctg

SEQ ID NO: 105937 - DNA, 75 bp, Artificial Sequence
  Synthetic
tcaggcaagctatcttgtggtggggtgagttaatgactttggcttcctgggtgggcaataatttggaggatcctg

SEQ ID NO: 105938 - DNA, 75 bp, Artificial Sequence
  Synthetic
tcaggcaagctatcttgtggtggggtgagttaatgactttggcttcctgggtgggcaataatttggaggaccctg

SEQ ID NO: 105939 - DNA, 75 bp, Artificial Sequence
  Synthetic
tcaggcaagctatcttgtggtggggtgagttaatgactttggcttcctgggtgggcaataatttggaggagcctg

SEQ ID NO: 105940 - DNA, 75 bp, Artificial Sequence
  Synthetic
aggcaattattgtggtttcacatttcctgtcttacttttggaagagaaactgttcttgaatatttggtgtctttt

SEQ ID NO: 105941 - DNA, 75 bp, Artificial Sequence
  Synthetic
ttccttggactcataaggtgggtaactttacagggctatagtcctctactgtacctacttttaatccttactggt

SEQ ID NO: 105942 - DNA, 75 bp, Artificial Sequence
  Synthetic
ttccttggactcataaggtgggtaactttacagggctatagtcctctactgtaccttcttttaatccttactggt

SEQ ID NO: 105943 - DNA, 75 bp, Artificial Sequence
  Synthetic
ttccttggactcataaggtgggtaactttacagggctatagtcctctactgtacctccttttaatccttactggt

SEQ ID NO: 105944 - DNA, 75 bp, Artificial Sequence
  Synthetic
ttccttggactcataaggtgggtaactttacagggctatagtcctctactgtacctgcttttaatccttactggt

SEQ ID NO: 105945 - DNA, 75 bp, Artificial Sequence
  Synthetic
ttccttggactcataaggtgggtaactttactgggctatagtcctctactgtacctacttttaatccttactggt

SEQ ID NO: 105946 - DNA, 75 bp, Artificial Sequence
  Synthetic
ttccttggactcataaggtgggtaactttactgggctatagtcctctactgtaccttcttttaatccttactggt

SEQ ID NO: 105947 - DNA, 75 bp, Artificial Sequence
  Synthetic
ttccttggactcataaggtgggtaactttactgggctatagtcctctactgtacctccttttaatccttactggt

SEQ ID NO: 105948 - DNA, 75 bp, Artificial Sequence
  Synthetic
ttccttggactcataaggtgggtaactttactgggctatagtcctctactgtacctgcttttaatccttactggt

SEQ ID NO: 105949 - DNA, 75 bp, Artificial Sequence
  Synthetic
ttccttggactcataaggtgggtaactttaccgggctatagtcctctactgtacctacttttaatccttactggt

SEQ ID NO: 105950 - DNA, 75 bp, Artificial Sequence
  Synthetic
ttccttggactcataaggtgggtaactttaccgggctatagtcctctactgtaccttcttttaatccttactggt

SEQ ID NO: 105951 - DNA, 75 bp, Artificial Sequence
  Synthetic
ttccttggactcataaggtgggtaactttaccgggctatagtcctctactgtacctccttttaatccttactggt

SEQ ID NO: 105952 - DNA, 75 bp, Artificial Sequence
  Synthetic
ttccttggactcataaggtgggtaactttaccgggctatagtcctctactgtacctgcttttaatccttactggt

SEQ ID NO: 105953 - DNA, 75 bp, Artificial Sequence
  Synthetic
ttccttggactcataaggtgggtaactttacggggctatagtcctctactgtacctacttttaatccttactggt

SEQ ID NO: 105954 - DNA, 75 bp, Artificial Sequence
  Synthetic
ttccttggactcataaggtgggtaactttacggggctatagtcctctactgtaccttcttttaatccttactggt

SEQ ID NO: 105955 - DNA, 75 bp, Artificial Sequence
  Synthetic
ttccttggactcataaggtgggtaactttacggggctatagtcctctactgtacctccttttaatccttactggt

SEQ ID NO: 105956 - DNA, 75 bp, Artificial Sequence
  Synthetic
ttccttggactcataaggtgggtaactttacggggctatagtcctctactgtacctgcttttaatccttactggt

SEQ ID NO: 105957 - DNA, 75 bp, Artificial Sequence
  Synthetic
ttccttggactcatatggtgggtaactttacagggctatagtcctctactgtacctacttttaatccttactggt

SEQ ID NO: 105958 - DNA, 75 bp, Artificial Sequence
  Synthetic
ttccttggactcatatggtgggtaactttacagggctatagtcctctactgtaccttcttttaatccttactggt

SEQ ID NO: 105959 - DNA, 75 bp, Artificial Sequence
  Synthetic
ttccttggactcatatggtgggtaactttacagggctatagtcctctactgtacctccttttaatccttactggt

SEQ ID NO: 105960 - DNA, 75 bp, Artificial Sequence
  Synthetic
ttccttggactcatatggtgggtaactttacagggctatagtcctctactgtacctgcttttaatccttactggt

SEQ ID NO: 105961 - DNA, 75 bp, Artificial Sequence
  Synthetic
ttccttggactcatatggtgggtaactttactgggctatagtcctctactgtacctacttttaatccttactggt

SEQ ID NO: 105962 - DNA, 75 bp, Artificial Sequence
  Synthetic
ttccttggactcatatggtgggtaactttactgggctatagtcctctactgtaccttcttttaatccttactggt

SEQ ID NO: 105963 - DNA, 75 bp, Artificial Sequence
  Synthetic
ttccttggactcatatggtgggtaactttactgggctatagtcctctactgtacctccttttaatccttactggt

SEQ ID NO: 105964 - DNA, 75 bp, Artificial Sequence
  Synthetic
ttccttggactcatatggtgggtaactttactgggctatagtcctctactgtacctgcttttaatccttactggt

SEQ ID NO: 105965 - DNA, 75 bp, Artificial Sequence
  Synthetic
ttccttggactcatatggtgggtaactttaccgggctatagtcctctactgtacctacttttaatccttactggt

SEQ ID NO: 105966 - DNA, 75 bp, Artificial Sequence
  Synthetic
ttccttggactcatatggtgggtaactttaccgggctatagtcctctactgtaccttcttttaatccttactggt

SEQ ID NO: 105967 - DNA, 75 bp, Artificial Sequence
  Synthetic
ttccttggactcatatggtgggtaactttaccgggctatagtcctctactgtacctccttttaatccttactggt

SEQ ID NO: 105968 - DNA, 75 bp, Artificial Sequence
  Synthetic
ttccttggactcatatggtgggtaactttaccgggctatagtcctctactgtacctgcttttaatccttactggt

SEQ ID NO: 105969 - DNA, 75 bp, Artificial Sequence
  Synthetic
ttccttggactcatatggtgggtaactttacggggctatagtcctctactgtacctacttttaatccttactggt

SEQ ID NO: 105970 - DNA, 75 bp, Artificial Sequence
  Synthetic
ttccttggactcatatggtgggtaactttacggggctatagtcctctactgtaccttcttttaatccttactggt

SEQ ID NO: 105971 - DNA, 75 bp, Artificial Sequence
  Synthetic
ttccttggactcatatggtgggtaactttacggggctatagtcctctactgtacctccttttaatccttactggt

SEQ ID NO: 105972 - DNA, 75 bp, Artificial Sequence
  Synthetic
ttccttggactcatatggtgggtaactttacggggctatagtcctctactgtacctgcttttaatccttactggt

SEQ ID NO: 105973 - DNA, 75 bp, Artificial Sequence
  Synthetic
ttccttggactcatacggtgggtaactttacagggctatagtcctctactgtacctacttttaatccttactggt

SEQ ID NO: 105974 - DNA, 75 bp, Artificial Sequence
  Synthetic
ttccttggactcatacggtgggtaactttacagggctatagtcctctactgtaccttcttttaatccttactggt

SEQ ID NO: 105975 - DNA, 75 bp, Artificial Sequence
  Synthetic
ttccttggactcatacggtgggtaactttacagggctatagtcctctactgtacctccttttaatccttactggt

SEQ ID NO: 105976 - DNA, 75 bp, Artificial Sequence
  Synthetic
ttccttggactcatacggtgggtaactttacagggctatagtcctctactgtacctgcttttaatccttactggt

SEQ ID NO: 105977 - DNA, 75 bp, Artificial Sequence
  Synthetic
ttccttggactcatacggtgggtaactttactgggctatagtcctctactgtacctacttttaatccttactggt

SEQ ID NO: 105978 - DNA, 75 bp, Artificial Sequence
  Synthetic
ttccttggactcatacggtgggtaactttactgggctatagtcctctactgtaccttcttttaatccttactggt

SEQ ID NO: 105979 - DNA, 75 bp, Artificial Sequence
  Synthetic
ttccttggactcatacggtgggtaactttactgggctatagtcctctactgtacctccttttaatccttactggt

SEQ ID NO: 105980 - DNA, 75 bp, Artificial Sequence
  Synthetic
ttccttggactcatacggtgggtaactttactgggctatagtcctctactgtacctgcttttaatccttactggt

SEQ ID NO: 105981 - DNA, 75 bp, Artificial Sequence
  Synthetic
ttccttggactcatacggtgggtaactttaccgggctatagtcctctactgtacctacttttaatccttactggt

SEQ ID NO: 105982 - DNA, 75 bp, Artificial Sequence
  Synthetic
ttccttggactcatacggtgggtaactttaccgggctatagtcctctactgtaccttcttttaatccttactggt

SEQ ID NO: 105983 - DNA, 75 bp, Artificial Sequence
  Synthetic
ttccttggactcatacggtgggtaactttaccgggctatagtcctctactgtacctccttttaatccttactggt

SEQ ID NO: 105984 - DNA, 75 bp, Artificial Sequence
  Synthetic
ttccttggactcatacggtgggtaactttaccgggctatagtcctctactgtacctgcttttaatccttactggt

SEQ ID NO: 105985 - DNA, 75 bp, Artificial Sequence
  Synthetic
ttccttggactcatacggtgggtaactttacggggctatagtcctctactgtacctacttttaatccttactggt

SEQ ID NO: 105986 - DNA, 75 bp, Artificial Sequence
  Synthetic
ttccttggactcatacggtgggtaactttacggggctatagtcctctactgtaccttcttttaatccttactggt

SEQ ID NO: 105987 - DNA, 75 bp, Artificial Sequence
  Synthetic
ttccttggactcatacggtgggtaactttacggggctatagtcctctactgtacctccttttaatccttactggt

SEQ ID NO: 105988 - DNA, 75 bp, Artificial Sequence
  Synthetic
ttccttggactcatacggtgggtaactttacggggctatagtcctctactgtacctgcttttaatccttactggt

SEQ ID NO: 105989 - DNA, 75 bp, Artificial Sequence
  Synthetic
ttccttggactcatagggtgggtaactttacagggctatagtcctctactgtacctacttttaatccttactggt

SEQ ID NO: 105990 - DNA, 75 bp, Artificial Sequence
  Synthetic
ttccttggactcatagggtgggtaactttacagggctatagtcctctactgtaccttcttttaatccttactggt

SEQ ID NO: 105991 - DNA, 75 bp, Artificial Sequence
  Synthetic
ttccttggactcatagggtgggtaactttacagggctatagtcctctactgtacctccttttaatccttactggt

SEQ ID NO: 105992 - DNA, 75 bp, Artificial Sequence
  Synthetic
ttccttggactcatagggtgggtaactttacagggctatagtcctctactgtacctgcttttaatccttactggt

SEQ ID NO: 105993 - DNA, 75 bp, Artificial Sequence
  Synthetic
ttccttggactcatagggtgggtaactttactgggctatagtcctctactgtacctacttttaatccttactggt

SEQ ID NO: 105994 - DNA, 75 bp, Artificial Sequence
  Synthetic
ttccttggactcatagggtgggtaactttactgggctatagtcctctactgtaccttcttttaatccttactggt

SEQ ID NO: 105995 - DNA, 75 bp, Artificial Sequence
  Synthetic
ttccttggactcatagggtgggtaactttactgggctatagtcctctactgtacctccttttaatccttactggt

SEQ ID NO: 105996 - DNA, 75 bp, Artificial Sequence
  Synthetic
ttccttggactcatagggtgggtaactttactgggctatagtcctctactgtacctgcttttaatccttactggt

SEQ ID NO: 105997 - DNA, 75 bp, Artificial Sequence
  Synthetic
ttccttggactcatagggtgggtaactttaccgggctatagtcctctactgtacctacttttaatccttactggt

SEQ ID NO: 105998 - DNA, 75 bp, Artificial Sequence
  Synthetic
ttccttggactcatagggtgggtaactttaccgggctatagtcctctactgtaccttcttttaatccttactggt

SEQ ID NO: 105999 - DNA, 75 bp, Artificial Sequence
  Synthetic
ttccttggactcatagggtgggtaactttaccgggctatagtcctctactgtacctccttttaatccttactggt

SEQ ID NO: 106000 - DNA, 75 bp, Artificial Sequence
  Synthetic
ttccttggactcatagggtgggtaactttaccgggctatagtcctctactgtacctgcttttaatccttactggt

SEQ ID NO: 106001 - DNA, 75 bp, Artificial Sequence
  Synthetic
ttccttggactcatagggtgggtaactttacggggctatagtcctctactgtacctacttttaatccttactggt

SEQ ID NO: 106002 - DNA, 75 bp, Artificial Sequence
  Synthetic
ttccttggactcatagggtgggtaactttacggggctatagtcctctactgtaccttcttttaatccttactggt

SEQ ID NO: 106003 - DNA, 75 bp, Artificial Sequence
  Synthetic
ttccttggactcatagggtgggtaactttacggggctatagtcctctactgtacctccttttaatccttactggt

SEQ ID NO: 106004 - DNA, 75 bp, Artificial Sequence
  Synthetic
ttccttggactcatagggtgggtaactttacggggctatagtcctctactgtacctgcttttaatccttactggt

SEQ ID NO: 106005 - DNA, 75 bp, Artificial Sequence
  Synthetic
gaagattaaaattggtaatgccagctagattttctcctaaggttaccaaatattttccaatggataatggaataa

SEQ ID NO: 106006 - DNA, 75 bp, Artificial Sequence
  Synthetic
gaagattaaaattggtaatgccagctagattttctcctaaggttaccaaatattttccaatggataatggaatta

SEQ ID NO: 106007 - DNA, 75 bp, Artificial Sequence
  Synthetic
gaagattaaaattggtaatgccagctagattttctcctaaggttaccaaatattttccaatggataatggaatca

SEQ ID NO: 106008 - DNA, 75 bp, Artificial Sequence
  Synthetic
gaagattaaaattggtaatgccagctagattttctcctaaggttaccaaatattttccaatggataatggaatga

SEQ ID NO: 106009 - DNA, 75 bp, Artificial Sequence
  Synthetic
gaagattaaaattggtaatgccagctagattttctcctaaggttaccaaatattttcctatggataatggaataa

SEQ ID NO: 106010 - DNA, 75 bp, Artificial Sequence
  Synthetic
gaagattaaaattggtaatgccagctagattttctcctaaggttaccaaatattttcctatggataatggaatta

SEQ ID NO: 106011 - DNA, 75 bp, Artificial Sequence
  Synthetic
gaagattaaaattggtaatgccagctagattttctcctaaggttaccaaatattttcctatggataatggaatca

SEQ ID NO: 106012 - DNA, 75 bp, Artificial Sequence
  Synthetic
gaagattaaaattggtaatgccagctagattttctcctaaggttaccaaatattttcctatggataatggaatga

SEQ ID NO: 106013 - DNA, 75 bp, Artificial Sequence
  Synthetic
gaagattaaaattggtaatgccagctagattttctcctaaggttaccaaatattttcccatggataatggaataa

SEQ ID NO: 106014 - DNA, 75 bp, Artificial Sequence
  Synthetic
gaagattaaaattggtaatgccagctagattttctcctaaggttaccaaatattttcccatggataatggaatta

SEQ ID NO: 106015 - DNA, 75 bp, Artificial Sequence
  Synthetic
gaagattaaaattggtaatgccagctagattttctcctaaggttaccaaatattttcccatggataatggaatca

SEQ ID NO: 106016 - DNA, 75 bp, Artificial Sequence
  Synthetic
gaagattaaaattggtaatgccagctagattttctcctaaggttaccaaatattttcccatggataatggaatga

SEQ ID NO: 106017 - DNA, 75 bp, Artificial Sequence
  Synthetic
gaagattaaaattggtaatgccagctagattttctcctaaggttaccaaatattttccgatggataatggaataa

SEQ ID NO: 106018 - DNA, 75 bp, Artificial Sequence
  Synthetic
gaagattaaaattggtaatgccagctagattttctcctaaggttaccaaatattttccgatggataatggaatta

SEQ ID NO: 106019 - DNA, 75 bp, Artificial Sequence
  Synthetic
gaagattaaaattggtaatgccagctagattttctcctaaggttaccaaatattttccgatggataatggaatca

SEQ ID NO: 106020 - DNA, 75 bp, Artificial Sequence
  Synthetic
gaagattaaaattggtaatgccagctagattttctcctaaggttaccaaatattttccgatggataatggaatga

SEQ ID NO: 106021 - DNA, 75 bp, Artificial Sequence
  Synthetic
gaagattaaaattggttatgccagctagattttctcctaaggttaccaaatattttccaatggataatggaataa

SEQ ID NO: 106022 - DNA, 75 bp, Artificial Sequence
  Synthetic
gaagattaaaattggttatgccagctagattttctcctaaggttaccaaatattttccaatggataatggaatta

SEQ ID NO: 106023 - DNA, 75 bp, Artificial Sequence
  Synthetic
gaagattaaaattggttatgccagctagattttctcctaaggttaccaaatattttccaatggataatggaatca

SEQ ID NO: 106024 - DNA, 75 bp, Artificial Sequence
  Synthetic
gaagattaaaattggttatgccagctagattttctcctaaggttaccaaatattttccaatggataatggaatga

SEQ ID NO: 106025 - DNA, 75 bp, Artificial Sequence
  Synthetic
gaagattaaaattggttatgccagctagattttctcctaaggttaccaaatattttcctatggataatggaataa

SEQ ID NO: 106026 - DNA, 75 bp, Artificial Sequence
  Synthetic
gaagattaaaattggttatgccagctagattttctcctaaggttaccaaatattttcctatggataatggaatta

SEQ ID NO: 106027 - DNA, 75 bp, Artificial Sequence
  Synthetic
gaagattaaaattggttatgccagctagattttctcctaaggttaccaaatattttcctatggataatggaatca

SEQ ID NO: 106028 - DNA, 75 bp, Artificial Sequence
  Synthetic
gaagattaaaattggttatgccagctagattttctcctaaggttaccaaatattttcctatggataatggaatga

SEQ ID NO: 106029 - DNA, 75 bp, Artificial Sequence
  Synthetic
gaagattaaaattggttatgccagctagattttctcctaaggttaccaaatattttcccatggataatggaataa

SEQ ID NO: 106030 - DNA, 75 bp, Artificial Sequence
  Synthetic
gaagattaaaattggttatgccagctagattttctcctaaggttaccaaatattttcccatggataatggaatta

SEQ ID NO: 106031 - DNA, 75 bp, Artificial Sequence
  Synthetic
gaagattaaaattggttatgccagctagattttctcctaaggttaccaaatattttcccatggataatggaatca

SEQ ID NO: 106032 - DNA, 75 bp, Artificial Sequence
  Synthetic
gaagattaaaattggttatgccagctagattttctcctaaggttaccaaatattttcccatggataatggaatga

SEQ ID NO: 106033 - DNA, 75 bp, Artificial Sequence
  Synthetic
gaagattaaaattggttatgccagctagattttctcctaaggttaccaaatattttccgatggataatggaataa

SEQ ID NO: 106034 - DNA, 75 bp, Artificial Sequence
  Synthetic
gaagattaaaattggttatgccagctagattttctcctaaggttaccaaatattttccgatggataatggaatta

SEQ ID NO: 106035 - DNA, 75 bp, Artificial Sequence
  Synthetic
gaagattaaaattggttatgccagctagattttctcctaaggttaccaaatattttccgatggataatggaatca

SEQ ID NO: 106036 - DNA, 75 bp, Artificial Sequence
  Synthetic
gaagattaaaattggttatgccagctagattttctcctaaggttaccaaatattttccgatggataatggaatga

SEQ ID NO: 106037 - DNA, 75 bp, Artificial Sequence
  Synthetic
gaagattaaaattggtcatgccagctagattttctcctaaggttaccaaatattttccaatggataatggaataa

SEQ ID NO: 106038 - DNA, 75 bp, Artificial Sequence
  Synthetic
gaagattaaaattggtcatgccagctagattttctcctaaggttaccaaatattttccaatggataatggaatta

SEQ ID NO: 106039 - DNA, 75 bp, Artificial Sequence
  Synthetic
gaagattaaaattggtcatgccagctagattttctcctaaggttaccaaatattttccaatggataatggaatca

SEQ ID NO: 106040 - DNA, 75 bp, Artificial Sequence
  Synthetic
gaagattaaaattggtcatgccagctagattttctcctaaggttaccaaatattttccaatggataatggaatga

SEQ ID NO: 106041 - DNA, 75 bp, Artificial Sequence
  Synthetic
gaagattaaaattggtcatgccagctagattttctcctaaggttaccaaatattttcctatggataatggaataa

SEQ ID NO: 106042 - DNA, 75 bp, Artificial Sequence
  Synthetic
gaagattaaaattggtcatgccagctagattttctcctaaggttaccaaatattttcctatggataatggaatta

SEQ ID NO: 106043 - DNA, 75 bp, Artificial Sequence
  Synthetic
gaagattaaaattggtcatgccagctagattttctcctaaggttaccaaatattttcctatggataatggaatca

SEQ ID NO: 106044 - DNA, 75 bp, Artificial Sequence
  Synthetic
gaagattaaaattggtcatgccagctagattttctcctaaggttaccaaatattttcctatggataatggaatga

SEQ ID NO: 106045 - DNA, 75 bp, Artificial Sequence
  Synthetic
gaagattaaaattggtcatgccagctagattttctcctaaggttaccaaatattttcccatggataatggaataa

SEQ ID NO: 106046 - DNA, 75 bp, Artificial Sequence
  Synthetic
gaagattaaaattggtcatgccagctagattttctcctaaggttaccaaatattttcccatggataatggaatta

SEQ ID NO: 106047 - DNA, 75 bp, Artificial Sequence
  Synthetic
gaagattaaaattggtcatgccagctagattttctcctaaggttaccaaatattttcccatggataatggaatca

SEQ ID NO: 106048 - DNA, 75 bp, Artificial Sequence
  Synthetic
gaagattaaaattggtcatgccagctagattttctcctaaggttaccaaatattttcccatggataatggaatga

SEQ ID NO: 106049 - DNA, 75 bp, Artificial Sequence
  Synthetic
gaagattaaaattggtcatgccagctagattttctcctaaggttaccaaatattttccgatggataatggaataa

SEQ ID NO: 106050 - DNA, 75 bp, Artificial Sequence
  Synthetic
gaagattaaaattggtcatgccagctagattttctcctaaggttaccaaatattttccgatggataatggaatta

SEQ ID NO: 106051 - DNA, 75 bp, Artificial Sequence
  Synthetic
gaagattaaaattggtcatgccagctagattttctcctaaggttaccaaatattttccgatggataatggaatca

SEQ ID NO: 106052 - DNA, 75 bp, Artificial Sequence
  Synthetic
gaagattaaaattggtcatgccagctagattttctcctaaggttaccaaatattttccgatggataatggaatga

SEQ ID NO: 106053 - DNA, 75 bp, Artificial Sequence
  Synthetic
gaagattaaaattggtgatgccagctagattttctcctaaggttaccaaatattttccaatggataatggaataa

SEQ ID NO: 106054 - DNA, 75 bp, Artificial Sequence
  Synthetic
gaagattaaaattggtgatgccagctagattttctcctaaggttaccaaatattttccaatggataatggaatta

SEQ ID NO: 106055 - DNA, 75 bp, Artificial Sequence
  Synthetic
gaagattaaaattggtgatgccagctagattttctcctaaggttaccaaatattttccaatggataatggaatca

SEQ ID NO: 106056 - DNA, 75 bp, Artificial Sequence
  Synthetic
gaagattaaaattggtgatgccagctagattttctcctaaggttaccaaatattttccaatggataatggaatga

SEQ ID NO: 106057 - DNA, 75 bp, Artificial Sequence
  Synthetic
gaagattaaaattggtgatgccagctagattttctcctaaggttaccaaatattttcctatggataatggaataa

SEQ ID NO: 106058 - DNA, 75 bp, Artificial Sequence
  Synthetic
gaagattaaaattggtgatgccagctagattttctcctaaggttaccaaatattttcctatggataatggaatta

SEQ ID NO: 106059 - DNA, 75 bp, Artificial Sequence
  Synthetic
gaagattaaaattggtgatgccagctagattttctcctaaggttaccaaatattttcctatggataatggaatca

SEQ ID NO: 106060 - DNA, 75 bp, Artificial Sequence
  Synthetic
gaagattaaaattggtgatgccagctagattttctcctaaggttaccaaatattttcctatggataatggaatga

SEQ ID NO: 106061 - DNA, 75 bp, Artificial Sequence
  Synthetic
gaagattaaaattggtgatgccagctagattttctcctaaggttaccaaatattttcccatggataatggaataa

SEQ ID NO: 106062 - DNA, 75 bp, Artificial Sequence
  Synthetic
gaagattaaaattggtgatgccagctagattttctcctaaggttaccaaatattttcccatggataatggaatta

SEQ ID NO: 106063 - DNA, 75 bp, Artificial Sequence
  Synthetic
gaagattaaaattggtgatgccagctagattttctcctaaggttaccaaatattttcccatggataatggaatca

SEQ ID NO: 106064 - DNA, 75 bp, Artificial Sequence
  Synthetic
gaagattaaaattggtgatgccagctagattttctcctaaggttaccaaatattttcccatggataatggaatga

SEQ ID NO: 106065 - DNA, 75 bp, Artificial Sequence
  Synthetic
gaagattaaaattggtgatgccagctagattttctcctaaggttaccaaatattttccgatggataatggaataa

SEQ ID NO: 106066 - DNA, 75 bp, Artificial Sequence
  Synthetic
gaagattaaaattggtgatgccagctagattttctcctaaggttaccaaatattttccgatggataatggaatta

SEQ ID NO: 106067 - DNA, 75 bp, Artificial Sequence
  Synthetic
gaagattaaaattggtgatgccagctagattttctcctaaggttaccaaatattttccgatggataatggaatca

SEQ ID NO: 106068 - DNA, 75 bp, Artificial Sequence
  Synthetic
gaagattaaaattggtgatgccagctagattttctcctaaggttaccaaatattttccgatggataatggaatga

SEQ ID NO: 106069 - DNA, 75 bp, Artificial Sequence
  Synthetic
gactgcaattgattatgcctgctaggttttatccaaatgttaccaaatatttgccattggataagggtattaaac

SEQ ID NO: 106070 - DNA, 75 bp, Artificial Sequence
  Synthetic
tcggcagtcaggaaggcagcctactcccatctctccaccgttgagagacactcatcctcaggccatgcagtggaa

SEQ ID NO: 106071 - DNA, 75 bp, Artificial Sequence
  Synthetic
cctccccatgggggactgttggggtggagccctcaggctcagggcctactcacaactgtgccagcagctcctcct

SEQ ID NO: 106072 - DNA, 75 bp, Artificial Sequence
  Synthetic
ggaaagctggcattctatataagagagaaactacacgcagcgcctcattttgtgggtcaccatattcttgggaac

SEQ ID NO: 106073 - DNA, 75 bp, Artificial Sequence
  Synthetic
ggaagagaaactgttcttgagtatttggtgtcttttggagtgtggattcgcactcctcccgcttacagaccacca

SEQ ID NO: 106074 - DNA, 75 bp, Artificial Sequence
  Synthetic
ctccaccacgttccaccaaactcttcaggatcctcgagtcagggctctgtactttcctgctggtggctccagttc

SEQ ID NO: 106075 - DNA, 75 bp, Artificial Sequence
  Synthetic
aagaacacatcagacaaaaaatcaaagaatgttttagaaaacttcctattaacaggcctattgattggaaagtat

SEQ ID NO: 106076 - DNA, 75 bp, Artificial Sequence
  Synthetic
cggaacagtgaaccctgttccgactactgtctcactcatctcgtcaatcttctcgaggattggggaccctgcacc

SEQ ID NO: 106077 - DNA, 75 bp, Artificial Sequence
  Synthetic
cagcagcaccttcctcctgcctccaccaatcggcagagtcaggaagctacagccacctgctggtggctccagttc

SEQ ID NO: 106078 - DNA, 75 bp, Artificial Sequence
  Synthetic
ctgtctctgccatatcgtcaatcttatcgaagactggggaccctgtgccgaacatggagaacatcgcatcaggac

SEQ ID NO: 106079 - DNA, 75 bp, Artificial Sequence
  Synthetic
tcctaggacccctgctcgtgttacaggcggggtttttctcgttgacaaaaatcctcacaataccacagagtctag

SEQ ID NO: 106080 - DNA, 75 bp, Artificial Sequence
  Synthetic
ctggccggacgccaacaaggtgggagtgggagcattcgggccgggattcactccaccccatgggggactgttggg

SEQ ID NO: 106081 - DNA, 75 bp, Artificial Sequence
  Synthetic
ggatcattaccacaagagcacattatacacaagctgaaagaatgttttagaaaactccctgttaacaggcctatt

SEQ ID NO: 106082 - DNA, 75 bp, Artificial Sequence
  Synthetic
ctccacaaccttccaccaaactctgcaagatcccagagtgagaggccctgctggtggctccagttcaggaacagt

SEQ ID NO: 106083 - DNA, 75 bp, Artificial Sequence
  Synthetic
tcttgagtccctttatgccgctgttaccaattttcttttgtctttgggtatacatttaaaccctcacaaaacaaa

SEQ ID NO: 106084 - DNA, 75 bp, Artificial Sequence
  Synthetic
gctttcccccactgtctggctttcagttatatggatgatgtggttttgggggccaagtctgtacaacatcttgag

SEQ ID NO: 106085 - DNA, 75 bp, Artificial Sequence
  Synthetic
ctatcaaggtatgttgcccgtgtgtcctctaattccaggatcttcaaccaccagcacgggaccatgcagaacctg

SEQ ID NO: 106086 - DNA, 75 bp, Artificial Sequence
  Synthetic
caggcttttactttctcgccaacttacaaggcctttctaagtaaacagtatctgaacctttaccccgttgctcgg

SEQ ID NO: 106087 - DNA, 75 bp, Artificial Sequence
  Synthetic
atacatttaaatccaaacaaaacaaaacggtggggttattccctcaatttcatgggatatgtgattggtagttgg

SEQ ID NO: 106088 - DNA, 75 bp, Artificial Sequence
  Synthetic
caacggcctggtctgtgccaagtgtttgctgacgcaacccccactggttggggcttggccataggccatcagcgc

SEQ ID NO: 106089 - DNA, 75 bp, Artificial Sequence
  Synthetic
aaacaatatctgaccctttaccccgttgcacggcaacggccgggtctgtgccaagtgtttgctgatgcaacaccc

SEQ ID NO: 106090 - DNA, 75 bp, Artificial Sequence
  Synthetic
atcggcagtcaggaaaaagcctactcccatctctccacctctaagagacagtcatcctcaggccatgcagtggaa

SEQ ID NO: 106091 - DNA, 75 bp, Artificial Sequence
  Synthetic
ttccacaactttccaacaagctctgcaagatcccagggtcaggggtgctggtggctccaattcaggaacagtaaa

SEQ ID NO: 106092 - DNA, 75 bp, Artificial Sequence
  Synthetic
ctaatatacatttacaccaagacattatcaaaaaatgtgaacaatttgtaggcccactcacagttaatgagaaaa

SEQ ID NO: 106093 - DNA, 75 bp, Artificial Sequence
  Synthetic
gtactcctagcagcttgttttgattgcagccggtttggggcgaaagttatcggcacggacaaatatgttgtcctc

SEQ ID NO: 106094 - DNA, 75 bp, Artificial Sequence
  Synthetic
tcttaccaaatacttgcccttggacaaaggcattaaaccgtattatcctgaacatgcagttaatcattacttcaa

SEQ ID NO: 106095 - DNA, 75 bp, Artificial Sequence
  Synthetic
ttgccgttccgactgaccatggggcgcacctctctatccggggactccccgtttgtgccgtgtcatcccccggac

SEQ ID NO: 106096 - DNA, 75 bp, Artificial Sequence
  Synthetic
tgcacaagaggactcttggactttcagtattgtcaacatccggaatcgaaacatacttcaaagactgtgtattta

SEQ ID NO: 106097 - DNA, 75 bp, Artificial Sequence
  Synthetic
ccctgctggtggctccagttcaggaacagtaaaccctgttccgactactgtctctcccatatcgtcaatcttctc

SEQ ID NO: 106098 - DNA, 75 bp, Artificial Sequence
  Synthetic
taaaattggtcatgccagctagattttatcctaagcttaccaaatatttcctattggagaaagggattaaaccct

SEQ ID NO: 106099 - DNA, 75 bp, Artificial Sequence
  Synthetic
gtccctctcgaatgggggaagaatcattccaccaccaatcctctgggattttttcccgaccaccagttggatcca

SEQ ID NO: 106100 - DNA, 75 bp, Artificial Sequence
  Synthetic
ttcatttgcaccaggatattattaacaggtgtgagcaatttgtgggccctctcacagtaaatgaaaaacgaaggt

SEQ ID NO: 106101 - DNA, 75 bp, Artificial Sequence
  Synthetic
agaatttggagcttctgtggagttactctcgtttttgccttctgacttctttccttccgtacgagatcttctaga

SEQ ID NO: 106102 - DNA, 75 bp, Artificial Sequence
  Synthetic
tcggcggtccgggagaaagccaaccccagtctctccacctctaagagacacacatccacaggccatgcagtggaa

SEQ ID NO: 106103 - DNA, 75 bp, Artificial Sequence
  Synthetic
ttgtacgggcctgtactcttctactgtacctgctttcaatcctaactggttaactccttcttttcctgatattca

SEQ ID NO: 106104 - DNA, 75 bp, Artificial Sequence
  Synthetic
acacacaatccagactgggacttcaaccccaacaaagacaattggccagaggccacccaggtaggagcgggagca

SEQ ID NO: 106105 - DNA, 75 bp, Artificial Sequence
  Synthetic
acagtaaaccctgttccgactactgcctcacccatatcgtcaatcttctcgaggactggggaccctgcaccgaac

SEQ ID NO: 106106 - DNA, 75 bp, Artificial Sequence
  Synthetic
ctcaacccagttccaccaggccctgttggatccgagggtaagggctctgtatcttactgctggtggctccagttc

SEQ ID NO: 106107 - DNA, 75 bp, Artificial Sequence
  Synthetic
ctcaacccagttccaccaggccctgttggatccgagggtaagggctctgtatctttctgctggtggctccagttc

SEQ ID NO: 106108 - DNA, 75 bp, Artificial Sequence
  Synthetic
ctcaacccagttccaccaggccctgttggatccgagggtaagggctctgtatcttcctgctggtggctccagttc

SEQ ID NO: 106109 - DNA, 75 bp, Artificial Sequence
  Synthetic
ctcaacccagttccaccaggccctgttggatccgagggtaagggctctgtatcttgctgctggtggctccagttc

SEQ ID NO: 106110 - DNA, 75 bp, Artificial Sequence
  Synthetic
tgcctttatatgcatgtatacaagctaagcaggctttcactttctcgccaacttacaaggcctttctgtgtaaac

SEQ ID NO: 106111 - DNA, 75 bp, Artificial Sequence
  Synthetic
caatcgccagtcaggaaggcagcctaccccactgtctccacctttgagaaacactcatcctcaggccatgcagtg

SEQ ID NO: 106112 - DNA, 75 bp, Artificial Sequence
  Synthetic
tatataaaagagaatccacacgtagcgcctcattttgtgggtcaccatattcttgggaacaagatctacagcatg

SEQ ID NO: 106113 - DNA, 75 bp, Artificial Sequence
  Synthetic
tgaacctttaccccgttgcccggcaacggccaggtctgtgccaagtgtttgctgacgcaacccccactggctggg

SEQ ID NO: 106114 - DNA, 75 bp, Artificial Sequence
  Synthetic
tctggcctcctgggtgggcaataatttggaagatccagcatccagggaacaagtagttaattatgtcaataccaa

SEQ ID NO: 106115 - DNA, 75 bp, Artificial Sequence
  Synthetic
acttcctgaaactactgttgttagacgacgggaccgaggcaggtcccctagaagaagaactccctcgcctcgcag

SEQ ID NO: 106116 - DNA, 75 bp, Artificial Sequence
  Synthetic
catgggcctaaaaattagacaattattatggtttcacatttcctgccttacatttggaagagaaactgtgcttga

SEQ ID NO: 106117 - DNA, 75 bp, Artificial Sequence
  Synthetic
gaactcctagcagcttgttttgctcgcagccggtctggagcgaaacttatcggcactgacaactctgttgtcctt

SEQ ID NO: 106118 - DNA, 75 bp, Artificial Sequence
  Synthetic
aaccttattatcctgagcatgtagttaatcattacttccaggccagacattatttacatactctttggaaggcgg

SEQ ID NO: 106119 - DNA, 75 bp, Artificial Sequence
  Synthetic
ttcatttgcaccaagatattattaacaagtgtgaacaatttgtgggccctcttacggttaatgaaaaaagaagat

SEQ ID NO: 106120 - DNA, 75 bp, Artificial Sequence
  Synthetic
ccctgctggtggctcaagttccggaacagtaaaccctgttccgactactgcctctcccatatcgtcaatcttctc

SEQ ID NO: 106121 - DNA, 75 bp, Artificial Sequence
  Synthetic
ctccacagtgttccatcgggctctgcaggatcccagagtgagaggcctgtatttccctgctggtggctccaattc

SEQ ID NO: 106122 - DNA, 75 bp, Artificial Sequence
  Synthetic
ttgccagcaaatccgcctcctgcctctaccaatcgtcagtcaggaaggcagcctacccctctgtctccacctttg

SEQ ID NO: 106123 - DNA, 75 bp, Artificial Sequence
  Synthetic
caatcgccgcgtcgcagaagatctcaatctcgggaatctcaatgttagtatcccttggactcataaggtgggaaa

SEQ ID NO: 106124 - DNA, 75 bp, Artificial Sequence
  Synthetic
gcctactcccatctctccacctctaagagacagtcatcctcaggccatgcagtggaattccactgctggtggctc

SEQ ID NO: 106125 - DNA, 75 bp, Artificial Sequence
  Synthetic
acctctattaccaattttcttttgtctttgggtatacatttaaaccctaataaaaccaagcgttggggctactcc

SEQ ID NO: 106126 - DNA, 75 bp, Artificial Sequence
  Synthetic
tctggccacctgggtgggaagtaatttggaagacccagcatccagagaattagtagtcagctatgtcaatgttaa

SEQ ID NO: 106127 - DNA, 75 bp, Artificial Sequence
  Synthetic
attggaaagtatgtcaacgaattgtgggtcttttaggctttgctgctccttttacacaatgtggatatcctgcct

SEQ ID NO: 106128 - DNA, 75 bp, Artificial Sequence
  Synthetic
gaaactttactgggctctattctgctactgcgcctgtctttaatcctaactggaaaactccgtcttttccaaaca

SEQ ID NO: 106129 - DNA, 75 bp, Artificial Sequence
  Synthetic
gtgttggggtgagttgatgaatctggccacctgggtgggaagtaatttggaagatccagcatccagggaattagt

SEQ ID NO: 106130 - DNA, 75 bp, Artificial Sequence
  Synthetic
cgttggggctactcccttaacttcatgggatatgtaattggaagttggggtaccttgccacaggaacatattgta

SEQ ID NO: 106131 - DNA, 75 bp, Artificial Sequence
  Synthetic
gattggaaagtatgtcaaagaattgtgggtcttttgggctttgccgctccatttacacaatgtggataccctgct

SEQ ID NO: 106132 - DNA, 75 bp, Artificial Sequence
  Synthetic
atacatttaaaccctcacaaaacaaaaagatggggatactcccttaacttcatgggatatgtaattggaagttgg

SEQ ID NO: 106133 - DNA, 75 bp, Artificial Sequence
  Synthetic
aaactccctcttttcctcacattcatttgaaagaggatattatcaacagatgtcaacaatttgtaggccctctta

SEQ ID NO: 106134 - DNA, 75 bp, Artificial Sequence
  Synthetic
ttcgggccaggattcacccctcctcatggaggtctgttggggtggagtcctcaggctcaaggcataacaacaaag

SEQ ID NO: 106135 - DNA, 75 bp, Artificial Sequence
  Synthetic
aggaaccgtgagccctgctcaaaaaactgcctctgccatatcgacaaccttctagaagactggggaccctgtacc

SEQ ID NO: 106136 - DNA, 75 bp, Artificial Sequence
  Synthetic
aggaaccgtgagccctgctcaaaaaactgcctctgccatatcgacaaccttcttgaagactggggaccctgtacc

SEQ ID NO: 106137 - DNA, 75 bp, Artificial Sequence
  Synthetic
aggaaccgtgagccctgctcaaaaaactgcctctgccatatcgacaaccttctcgaagactggggaccctgtacc

SEQ ID NO: 106138 - DNA, 75 bp, Artificial Sequence
  Synthetic
aggaaccgtgagccctgctcaaaaaactgcctctgccatatcgacaaccttctggaagactggggaccctgtacc

SEQ ID NO: 106139 - DNA, 75 bp, Artificial Sequence
  Synthetic
aggaaccgtgagccctgctcaaaaaactgcctctgccatatcgtcaaccttctagaagactggggaccctgtacc

SEQ ID NO: 106140 - DNA, 75 bp, Artificial Sequence
  Synthetic
aggaaccgtgagccctgctcaaaaaactgcctctgccatatcgtcaaccttcttgaagactggggaccctgtacc

SEQ ID NO: 106141 - DNA, 75 bp, Artificial Sequence
  Synthetic
aggaaccgtgagccctgctcaaaaaactgcctctgccatatcgtcaaccttctcgaagactggggaccctgtacc

SEQ ID NO: 106142 - DNA, 75 bp, Artificial Sequence
  Synthetic
aggaaccgtgagccctgctcaaaaaactgcctctgccatatcgtcaaccttctggaagactggggaccctgtacc

SEQ ID NO: 106143 - DNA, 75 bp, Artificial Sequence
  Synthetic
aggaaccgtgagccctgctcaaaaaactgcctctgccatatcgccaaccttctagaagactggggaccctgtacc

SEQ ID NO: 106144 - DNA, 75 bp, Artificial Sequence
  Synthetic
aggaaccgtgagccctgctcaaaaaactgcctctgccatatcgccaaccttcttgaagactggggaccctgtacc

SEQ ID NO: 106145 - DNA, 75 bp, Artificial Sequence
  Synthetic
aggaaccgtgagccctgctcaaaaaactgcctctgccatatcgccaaccttctcgaagactggggaccctgtacc

SEQ ID NO: 106146 - DNA, 75 bp, Artificial Sequence
  Synthetic
aggaaccgtgagccctgctcaaaaaactgcctctgccatatcgccaaccttctggaagactggggaccctgtacc

SEQ ID NO: 106147 - DNA, 75 bp, Artificial Sequence
  Synthetic
aggaaccgtgagccctgctcaaaaaactgcctctgccatatcggcaaccttctagaagactggggaccctgtacc

SEQ ID NO: 106148 - DNA, 75 bp, Artificial Sequence
  Synthetic
aggaaccgtgagccctgctcaaaaaactgcctctgccatatcggcaaccttcttgaagactggggaccctgtacc

SEQ ID NO: 106149 - DNA, 75 bp, Artificial Sequence
  Synthetic
aggaaccgtgagccctgctcaaaaaactgcctctgccatatcggcaaccttctcgaagactggggaccctgtacc

SEQ ID NO: 106150 - DNA, 75 bp, Artificial Sequence
  Synthetic
aggaaccgtgagccctgctcaaaaaactgcctctgccatatcggcaaccttctggaagactggggaccctgtacc

SEQ ID NO: 106151 - DNA, 75 bp, Artificial Sequence
  Synthetic
aggaaccgtgagccctgctcataaaactgcctctgccatatcgacaaccttctagaagactggggaccctgtacc

SEQ ID NO: 106152 - DNA, 75 bp, Artificial Sequence
  Synthetic
aggaaccgtgagccctgctcataaaactgcctctgccatatcgacaaccttcttgaagactggggaccctgtacc

SEQ ID NO: 106153 - DNA, 75 bp, Artificial Sequence
  Synthetic
aggaaccgtgagccctgctcataaaactgcctctgccatatcgacaaccttctcgaagactggggaccctgtacc

SEQ ID NO: 106154 - DNA, 75 bp, Artificial Sequence
  Synthetic
aggaaccgtgagccctgctcataaaactgcctctgccatatcgacaaccttctggaagactggggaccctgtacc

SEQ ID NO: 106155 - DNA, 75 bp, Artificial Sequence
  Synthetic
aggaaccgtgagccctgctcataaaactgcctctgccatatcgtcaaccttctagaagactggggaccctgtacc

SEQ ID NO: 106156 - DNA, 75 bp, Artificial Sequence
  Synthetic
aggaaccgtgagccctgctcataaaactgcctctgccatatcgtcaaccttcttgaagactggggaccctgtacc

SEQ ID NO: 106157 - DNA, 75 bp, Artificial Sequence
  Synthetic
aggaaccgtgagccctgctcataaaactgcctctgccatatcgtcaaccttctcgaagactggggaccctgtacc

SEQ ID NO: 106158 - DNA, 75 bp, Artificial Sequence
  Synthetic
aggaaccgtgagccctgctcataaaactgcctctgccatatcgtcaaccttctggaagactggggaccctgtacc

SEQ ID NO: 106159 - DNA, 75 bp, Artificial Sequence
  Synthetic
aggaaccgtgagccctgctcataaaactgcctctgccatatcgccaaccttctagaagactggggaccctgtacc

SEQ ID NO: 106160 - DNA, 75 bp, Artificial Sequence
  Synthetic
aggaaccgtgagccctgctcataaaactgcctctgccatatcgccaaccttcttgaagactggggaccctgtacc

SEQ ID NO: 106161 - DNA, 75 bp, Artificial Sequence
  Synthetic
aggaaccgtgagccctgctcataaaactgcctctgccatatcgccaaccttctcgaagactggggaccctgtacc

SEQ ID NO: 106162 - DNA, 75 bp, Artificial Sequence
  Synthetic
aggaaccgtgagccctgctcataaaactgcctctgccatatcgccaaccttctggaagactggggaccctgtacc

SEQ ID NO: 106163 - DNA, 75 bp, Artificial Sequence
  Synthetic
aggaaccgtgagccctgctcataaaactgcctctgccatatcggcaaccttctagaagactggggaccctgtacc

SEQ ID NO: 106164 - DNA, 75 bp, Artificial Sequence
  Synthetic
aggaaccgtgagccctgctcataaaactgcctctgccatatcggcaaccttcttgaagactggggaccctgtacc

SEQ ID NO: 106165 - DNA, 75 bp, Artificial Sequence
  Synthetic
aggaaccgtgagccctgctcataaaactgcctctgccatatcggcaaccttctcgaagactggggaccctgtacc

SEQ ID NO: 106166 - DNA, 75 bp, Artificial Sequence
  Synthetic
aggaaccgtgagccctgctcataaaactgcctctgccatatcggcaaccttctggaagactggggaccctgtacc

SEQ ID NO: 106167 - DNA, 75 bp, Artificial Sequence
  Synthetic
aggaaccgtgagccctgctcacaaaactgcctctgccatatcgacaaccttctagaagactggggaccctgtacc

SEQ ID NO: 106168 - DNA, 75 bp, Artificial Sequence
  Synthetic
aggaaccgtgagccctgctcacaaaactgcctctgccatatcgacaaccttcttgaagactggggaccctgtacc

SEQ ID NO: 106169 - DNA, 75 bp, Artificial Sequence
  Synthetic
aggaaccgtgagccctgctcacaaaactgcctctgccatatcgacaaccttctcgaagactggggaccctgtacc

SEQ ID NO: 106170 - DNA, 75 bp, Artificial Sequence
  Synthetic
aggaaccgtgagccctgctcacaaaactgcctctgccatatcgacaaccttctggaagactggggaccctgtacc

SEQ ID NO: 106171 - DNA, 75 bp, Artificial Sequence
  Synthetic
aggaaccgtgagccctgctcacaaaactgcctctgccatatcgtcaaccttctagaagactggggaccctgtacc

SEQ ID NO: 106172 - DNA, 75 bp, Artificial Sequence
  Synthetic
aggaaccgtgagccctgctcacaaaactgcctctgccatatcgtcaaccttcttgaagactggggaccctgtacc

SEQ ID NO: 106173 - DNA, 75 bp, Artificial Sequence
  Synthetic
aggaaccgtgagccctgctcacaaaactgcctctgccatatcgtcaaccttctcgaagactggggaccctgtacc

SEQ ID NO: 106174 - DNA, 75 bp, Artificial Sequence
  Synthetic
aggaaccgtgagccctgctcacaaaactgcctctgccatatcgtcaaccttctggaagactggggaccctgtacc

SEQ ID NO: 106175 - DNA, 75 bp, Artificial Sequence
  Synthetic
aggaaccgtgagccctgctcacaaaactgcctctgccatatcgccaaccttctagaagactggggaccctgtacc

SEQ ID NO: 106176 - DNA, 75 bp, Artificial Sequence
  Synthetic
aggaaccgtgagccctgctcacaaaactgcctctgccatatcgccaaccttcttgaagactggggaccctgtacc

SEQ ID NO: 106177 - DNA, 75 bp, Artificial Sequence
  Synthetic
aggaaccgtgagccctgctcacaaaactgcctctgccatatcgccaaccttctcgaagactggggaccctgtacc

SEQ ID NO: 106178 - DNA, 75 bp, Artificial Sequence
  Synthetic
aggaaccgtgagccctgctcacaaaactgcctctgccatatcgccaaccttctggaagactggggaccctgtacc

SEQ ID NO: 106179 - DNA, 75 bp, Artificial Sequence
  Synthetic
aggaaccgtgagccctgctcacaaaactgcctctgccatatcggcaaccttctagaagactggggaccctgtacc

SEQ ID NO: 106180 - DNA, 75 bp, Artificial Sequence
  Synthetic
aggaaccgtgagccctgctcacaaaactgcctctgccatatcggcaaccttcttgaagactggggaccctgtacc

SEQ ID NO: 106181 - DNA, 75 bp, Artificial Sequence
  Synthetic
aggaaccgtgagccctgctcacaaaactgcctctgccatatcggcaaccttctcgaagactggggaccctgtacc

SEQ ID NO: 106182 - DNA, 75 bp, Artificial Sequence
  Synthetic
aggaaccgtgagccctgctcacaaaactgcctctgccatatcggcaaccttctggaagactggggaccctgtacc

SEQ ID NO: 106183 - DNA, 75 bp, Artificial Sequence
  Synthetic
aggaaccgtgagccctgctcagaaaactgcctctgccatatcgacaaccttctagaagactggggaccctgtacc

SEQ ID NO: 106184 - DNA, 75 bp, Artificial Sequence
  Synthetic
aggaaccgtgagccctgctcagaaaactgcctctgccatatcgacaaccttcttgaagactggggaccctgtacc

SEQ ID NO: 106185 - DNA, 75 bp, Artificial Sequence
  Synthetic
aggaaccgtgagccctgctcagaaaactgcctctgccatatcgacaaccttctcgaagactggggaccctgtacc

SEQ ID NO: 106186 - DNA, 75 bp, Artificial Sequence
  Synthetic
aggaaccgtgagccctgctcagaaaactgcctctgccatatcgacaaccttctggaagactggggaccctgtacc

SEQ ID NO: 106187 - DNA, 75 bp, Artificial Sequence
  Synthetic
aggaaccgtgagccctgctcagaaaactgcctctgccatatcgtcaaccttctagaagactggggaccctgtacc

SEQ ID NO: 106188 - DNA, 75 bp, Artificial Sequence
  Synthetic
aggaaccgtgagccctgctcagaaaactgcctctgccatatcgtcaaccttcttgaagactggggaccctgtacc

SEQ ID NO: 106189 - DNA, 75 bp, Artificial Sequence
  Synthetic
aggaaccgtgagccctgctcagaaaactgcctctgccatatcgtcaaccttctcgaagactggggaccctgtacc

SEQ ID NO: 106190 - DNA, 75 bp, Artificial Sequence
  Synthetic
aggaaccgtgagccctgctcagaaaactgcctctgccatatcgtcaaccttctggaagactggggaccctgtacc

SEQ ID NO: 106191 - DNA, 75 bp, Artificial Sequence
  Synthetic
aggaaccgtgagccctgctcagaaaactgcctctgccatatcgccaaccttctagaagactggggaccctgtacc

SEQ ID NO: 106192 - DNA, 75 bp, Artificial Sequence
  Synthetic
aggaaccgtgagccctgctcagaaaactgcctctgccatatcgccaaccttcttgaagactggggaccctgtacc

SEQ ID NO: 106193 - DNA, 75 bp, Artificial Sequence
  Synthetic
aggaaccgtgagccctgctcagaaaactgcctctgccatatcgccaaccttctcgaagactggggaccctgtacc

SEQ ID NO: 106194 - DNA, 75 bp, Artificial Sequence
  Synthetic
aggaaccgtgagccctgctcagaaaactgcctctgccatatcgccaaccttctggaagactggggaccctgtacc

SEQ ID NO: 106195 - DNA, 75 bp, Artificial Sequence
  Synthetic
aggaaccgtgagccctgctcagaaaactgcctctgccatatcggcaaccttctagaagactggggaccctgtacc

SEQ ID NO: 106196 - DNA, 75 bp, Artificial Sequence
  Synthetic
aggaaccgtgagccctgctcagaaaactgcctctgccatatcggcaaccttcttgaagactggggaccctgtacc

SEQ ID NO: 106197 - DNA, 75 bp, Artificial Sequence
  Synthetic
aggaaccgtgagccctgctcagaaaactgcctctgccatatcggcaaccttctcgaagactggggaccctgtacc

SEQ ID NO: 106198 - DNA, 75 bp, Artificial Sequence
  Synthetic
aggaaccgtgagccctgctcagaaaactgcctctgccatatcggcaaccttctggaagactggggaccctgtacc

SEQ ID NO: 106199 - DNA, 75 bp, Artificial Sequence
  Synthetic
agaatctccagagcattgttcacctaaccatacagcactcagacaagctatactgtgctggggtgagttaatgac

SEQ ID NO: 106200 - DNA, 75 bp, Artificial Sequence
  Synthetic
gctcagggcatattggctacagtgccagcagttcctcctcctgcctccaccaatcggcagtcaggaaggcagcct

SEQ ID NO: 106201 - DNA, 75 bp, Artificial Sequence
  Synthetic
tctagccacctgggtgggtaataatttgcaagatccggcatccagggatcaagtagtaaattatgttaatactaa

SEQ ID NO: 106202 - DNA, 75 bp, Artificial Sequence
  Synthetic
gggggacattaccacaagagcatattgtacaaaaaatcaaaaattgtttcagaaaacttcctgttaacagaccta

SEQ ID NO: 106203 - DNA, 75 bp, Artificial Sequence
  Synthetic
acctttaccccgttgctcggcaacggccaggtctgtgccaagtgtttgctgacgcaacccccactggctggggct

SEQ ID NO: 106204 - DNA, 75 bp, Artificial Sequence
  Synthetic
gaaactttacggggctttagtcttctacggcacctaacttcactcctgattgggaaactccctcttttccggaca

SEQ ID NO: 106205 - DNA, 75 bp, Artificial Sequence
  Synthetic
tacgtcccgtcggcgtcgaatcccgcggaagacccgtctcggggccgtttgggcatctaccgtccctttcctcat

SEQ ID NO: 106206 - DNA, 75 bp, Artificial Sequence
  Synthetic
cgtgtgcagttcgcttcacctttgcacgtcgcatggagaccgccgtgaacccccaccaggtcttccccaaggttt

SEQ ID NO: 106207 - DNA, 75 bp, Artificial Sequence
  Synthetic
tacaaaagaggactcttggactctcagaaaagtcaacgacagaccttgaggcatccttcaaagactgtgtgttta

SEQ ID NO: 106208 - DNA, 75 bp, Artificial Sequence
  Synthetic
tttttcccctggctcgggagcactgttggatccgagagtaaggggtctgtattttcctgctggtggctccagttc

SEQ ID NO: 106209 - DNA, 75 bp, Artificial Sequence
  Synthetic
cgtgtgcacttcgcttcacctctgcacgttgcatggagaccaccgtgaacgccccccggagcttgccaaaggtct

SEQ ID NO: 106210 - DNA, 75 bp, Artificial Sequence
  Synthetic
gaaactttactgggctttattcttctactgcacctgtctttaatcctgagtggcaaactccctcctttcctaaca

SEQ ID NO: 106211 - DNA, 75 bp, Artificial Sequence
  Synthetic
aggtaggagcgggagctttcgggccagggttcaccccaccacacggcggtcttttggggtggagccctcaggctc

SEQ ID NO: 106212 - DNA, 75 bp, Artificial Sequence
  Synthetic
cgtggtggacttctctcaattttctagggggatcacccgtgtgtcttggccaaaattcgcagtccccaacctcca

SEQ ID NO: 106213 - DNA, 75 bp, Artificial Sequence
  Synthetic
tcgcatggagaccaccgtgaacgcccaagaaggcttgccaacagtcttacataagcggactcttggactttaaag

SEQ ID NO: 106214 - DNA, 75 bp, Artificial Sequence
  Synthetic
tcgcatggagaccaccgtgaacgcccaagaaggcttgccaacagtcttacataagcggactcttggactttaatg

SEQ ID NO: 106215 - DNA, 75 bp, Artificial Sequence
  Synthetic
tcgcatggagaccaccgtgaacgcccaagaaggcttgccaacagtcttacataagcggactcttggactttaacg

SEQ ID NO: 106216 - DNA, 75 bp, Artificial Sequence
  Synthetic
tcgcatggagaccaccgtgaacgcccaagaaggcttgccaacagtcttacataagcggactcttggactttaagg

SEQ ID NO: 106217 - DNA, 75 bp, Artificial Sequence
  Synthetic
tcgcatggagaccaccgtgaacgcccaagaaggcttgccaacagtcttacataagcggactcttggacttttaag

SEQ ID NO: 106218 - DNA, 75 bp, Artificial Sequence
  Synthetic
tcgcatggagaccaccgtgaacgcccaagaaggcttgccaacagtcttacataagcggactcttggacttttatg

SEQ ID NO: 106219 - DNA, 75 bp, Artificial Sequence
  Synthetic
tcgcatggagaccaccgtgaacgcccaagaaggcttgccaacagtcttacataagcggactcttggacttttacg

SEQ ID NO: 106220 - DNA, 75 bp, Artificial Sequence
  Synthetic
tcgcatggagaccaccgtgaacgcccaagaaggcttgccaacagtcttacataagcggactcttggacttttagg

SEQ ID NO: 106221 - DNA, 75 bp, Artificial Sequence
  Synthetic
tcgcatggagaccaccgtgaacgcccaagaaggcttgccaacagtcttacataagcggactcttggactttcaag

SEQ ID NO: 106222 - DNA, 75 bp, Artificial Sequence
  Synthetic
tcgcatggagaccaccgtgaacgcccaagaaggcttgccaacagtcttacataagcggactcttggactttcatg

SEQ ID NO: 106223 - DNA, 75 bp, Artificial Sequence
  Synthetic
tcgcatggagaccaccgtgaacgcccaagaaggcttgccaacagtcttacataagcggactcttggactttcacg

SEQ ID NO: 106224 - DNA, 75 bp, Artificial Sequence
  Synthetic
tcgcatggagaccaccgtgaacgcccaagaaggcttgccaacagtcttacataagcggactcttggactttcagg

SEQ ID NO: 106225 - DNA, 75 bp, Artificial Sequence
  Synthetic
tcgcatggagaccaccgtgaacgcccaagaaggcttgccaacagtcttacataagcggactcttggactttgaag

SEQ ID NO: 106226 - DNA, 75 bp, Artificial Sequence
  Synthetic
tcgcatggagaccaccgtgaacgcccaagaaggcttgccaacagtcttacataagcggactcttggactttgatg

SEQ ID NO: 106227 - DNA, 75 bp, Artificial Sequence
  Synthetic
tcgcatggagaccaccgtgaacgcccaagaaggcttgccaacagtcttacataagcggactcttggactttgacg

SEQ ID NO: 106228 - DNA, 75 bp, Artificial Sequence
  Synthetic
tcgcatggagaccaccgtgaacgcccaagaaggcttgccaacagtcttacataagcggactcttggactttgagg

SEQ ID NO: 106229 - DNA, 75 bp, Artificial Sequence
  Synthetic
tcgcatggagaccaccgtgaacgccctagaaggcttgccaacagtcttacataagcggactcttggactttaaag

SEQ ID NO: 106230 - DNA, 75 bp, Artificial Sequence
  Synthetic
tcgcatggagaccaccgtgaacgccctagaaggcttgccaacagtcttacataagcggactcttggactttaatg

SEQ ID NO: 106231 - DNA, 75 bp, Artificial Sequence
  Synthetic
tcgcatggagaccaccgtgaacgccctagaaggcttgccaacagtcttacataagcggactcttggactttaacg

SEQ ID NO: 106232 - DNA, 75 bp, Artificial Sequence
  Synthetic
tcgcatggagaccaccgtgaacgccctagaaggcttgccaacagtcttacataagcggactcttggactttaagg

SEQ ID NO: 106233 - DNA, 75 bp, Artificial Sequence
  Synthetic
tcgcatggagaccaccgtgaacgccctagaaggcttgccaacagtcttacataagcggactcttggacttttaag

SEQ ID NO: 106234 - DNA, 75 bp, Artificial Sequence
  Synthetic
tcgcatggagaccaccgtgaacgccctagaaggcttgccaacagtcttacataagcggactcttggacttttatg

SEQ ID NO: 106235 - DNA, 75 bp, Artificial Sequence
  Synthetic
tcgcatggagaccaccgtgaacgccctagaaggcttgccaacagtcttacataagcggactcttggacttttacg

SEQ ID NO: 106236 - DNA, 75 bp, Artificial Sequence
  Synthetic
tcgcatggagaccaccgtgaacgccctagaaggcttgccaacagtcttacataagcggactcttggacttttagg

SEQ ID NO: 106237 - DNA, 75 bp, Artificial Sequence
  Synthetic
tcgcatggagaccaccgtgaacgccctagaaggcttgccaacagtcttacataagcggactcttggactttcaag

SEQ ID NO: 106238 - DNA, 75 bp, Artificial Sequence
  Synthetic
tcgcatggagaccaccgtgaacgccctagaaggcttgccaacagtcttacataagcggactcttggactttcatg

SEQ ID NO: 106239 - DNA, 75 bp, Artificial Sequence
  Synthetic
tcgcatggagaccaccgtgaacgccctagaaggcttgccaacagtcttacataagcggactcttggactttcacg

SEQ ID NO: 106240 - DNA, 75 bp, Artificial Sequence
  Synthetic
tcgcatggagaccaccgtgaacgccctagaaggcttgccaacagtcttacataagcggactcttggactttcagg

SEQ ID NO: 106241 - DNA, 75 bp, Artificial Sequence
  Synthetic
tcgcatggagaccaccgtgaacgccctagaaggcttgccaacagtcttacataagcggactcttggactttgaag

SEQ ID NO: 106242 - DNA, 75 bp, Artificial Sequence
  Synthetic
tcgcatggagaccaccgtgaacgccctagaaggcttgccaacagtcttacataagcggactcttggactttgatg

SEQ ID NO: 106243 - DNA, 75 bp, Artificial Sequence
  Synthetic
tcgcatggagaccaccgtgaacgccctagaaggcttgccaacagtcttacataagcggactcttggactttgacg

SEQ ID NO: 106244 - DNA, 75 bp, Artificial Sequence
  Synthetic
tcgcatggagaccaccgtgaacgccctagaaggcttgccaacagtcttacataagcggactcttggactttgagg

SEQ ID NO: 106245 - DNA, 75 bp, Artificial Sequence
  Synthetic
tcgcatggagaccaccgtgaacgccccagaaggcttgccaacagtcttacataagcggactcttggactttaaag

SEQ ID NO: 106246 - DNA, 75 bp, Artificial Sequence
  Synthetic
tcgcatggagaccaccgtgaacgccccagaaggcttgccaacagtcttacataagcggactcttggactttaatg

SEQ ID NO: 106247 - DNA, 75 bp, Artificial Sequence
  Synthetic
tcgcatggagaccaccgtgaacgccccagaaggcttgccaacagtcttacataagcggactcttggactttaacg

SEQ ID NO: 106248 - DNA, 75 bp, Artificial Sequence
  Synthetic
tcgcatggagaccaccgtgaacgccccagaaggcttgccaacagtcttacataagcggactcttggactttaagg

SEQ ID NO: 106249 - DNA, 75 bp, Artificial Sequence
  Synthetic
tcgcatggagaccaccgtgaacgccccagaaggcttgccaacagtcttacataagcggactcttggacttttaag

SEQ ID NO: 106250 - DNA, 75 bp, Artificial Sequence
  Synthetic
tcgcatggagaccaccgtgaacgccccagaaggcttgccaacagtcttacataagcggactcttggacttttatg

SEQ ID NO: 106251 - DNA, 75 bp, Artificial Sequence
  Synthetic
tcgcatggagaccaccgtgaacgccccagaaggcttgccaacagtcttacataagcggactcttggacttttacg

SEQ ID NO: 106252 - DNA, 75 bp, Artificial Sequence
  Synthetic
tcgcatggagaccaccgtgaacgccccagaaggcttgccaacagtcttacataagcggactcttggacttttagg

SEQ ID NO: 106253 - DNA, 75 bp, Artificial Sequence
  Synthetic
tcgcatggagaccaccgtgaacgccccagaaggcttgccaacagtcttacataagcggactcttggactttcaag

SEQ ID NO: 106254 - DNA, 75 bp, Artificial Sequence
  Synthetic
tcgcatggagaccaccgtgaacgccccagaaggcttgccaacagtcttacataagcggactcttggactttcatg

SEQ ID NO: 106255 - DNA, 75 bp, Artificial Sequence
  Synthetic
tcgcatggagaccaccgtgaacgccccagaaggcttgccaacagtcttacataagcggactcttggactttcacg

SEQ ID NO: 106256 - DNA, 75 bp, Artificial Sequence
  Synthetic
tcgcatggagaccaccgtgaacgccccagaaggcttgccaacagtcttacataagcggactcttggactttcagg

SEQ ID NO: 106257 - DNA, 75 bp, Artificial Sequence
  Synthetic
tcgcatggagaccaccgtgaacgccccagaaggcttgccaacagtcttacataagcggactcttggactttgaag

SEQ ID NO: 106258 - DNA, 75 bp, Artificial Sequence
  Synthetic
tcgcatggagaccaccgtgaacgccccagaaggcttgccaacagtcttacataagcggactcttggactttgatg

SEQ ID NO: 106259 - DNA, 75 bp, Artificial Sequence
  Synthetic
tcgcatggagaccaccgtgaacgccccagaaggcttgccaacagtcttacataagcggactcttggactttgacg

SEQ ID NO: 106260 - DNA, 75 bp, Artificial Sequence
  Synthetic
tcgcatggagaccaccgtgaacgccccagaaggcttgccaacagtcttacataagcggactcttggactttgagg

SEQ ID NO: 106261 - DNA, 75 bp, Artificial Sequence
  Synthetic
tcgcatggagaccaccgtgaacgcccgagaaggcttgccaacagtcttacataagcggactcttggactttaaag

SEQ ID NO: 106262 - DNA, 75 bp, Artificial Sequence
  Synthetic
tcgcatggagaccaccgtgaacgcccgagaaggcttgccaacagtcttacataagcggactcttggactttaatg

SEQ ID NO: 106263 - DNA, 75 bp, Artificial Sequence
  Synthetic
tcgcatggagaccaccgtgaacgcccgagaaggcttgccaacagtcttacataagcggactcttggactttaacg

SEQ ID NO: 106264 - DNA, 75 bp, Artificial Sequence
  Synthetic
tcgcatggagaccaccgtgaacgcccgagaaggcttgccaacagtcttacataagcggactcttggactttaagg

SEQ ID NO: 106265 - DNA, 75 bp, Artificial Sequence
  Synthetic
tcgcatggagaccaccgtgaacgcccgagaaggcttgccaacagtcttacataagcggactcttggacttttaag

SEQ ID NO: 106266 - DNA, 75 bp, Artificial Sequence
  Synthetic
tcgcatggagaccaccgtgaacgcccgagaaggcttgccaacagtcttacataagcggactcttggacttttatg

SEQ ID NO: 106267 - DNA, 75 bp, Artificial Sequence
  Synthetic
tcgcatggagaccaccgtgaacgcccgagaaggcttgccaacagtcttacataagcggactcttggacttttacg

SEQ ID NO: 106268 - DNA, 75 bp, Artificial Sequence
  Synthetic
tcgcatggagaccaccgtgaacgcccgagaaggcttgccaacagtcttacataagcggactcttggacttttagg

SEQ ID NO: 106269 - DNA, 75 bp, Artificial Sequence
  Synthetic
tcgcatggagaccaccgtgaacgcccgagaaggcttgccaacagtcttacataagcggactcttggactttcaag

SEQ ID NO: 106270 - DNA, 75 bp, Artificial Sequence
  Synthetic
tcgcatggagaccaccgtgaacgcccgagaaggcttgccaacagtcttacataagcggactcttggactttcatg

SEQ ID NO: 106271 - DNA, 75 bp, Artificial Sequence
  Synthetic
tcgcatggagaccaccgtgaacgcccgagaaggcttgccaacagtcttacataagcggactcttggactttcacg

SEQ ID NO: 106272 - DNA, 75 bp, Artificial Sequence
  Synthetic
tcgcatggagaccaccgtgaacgcccgagaaggcttgccaacagtcttacataagcggactcttggactttcagg

SEQ ID NO: 106273 - DNA, 75 bp, Artificial Sequence
  Synthetic
tcgcatggagaccaccgtgaacgcccgagaaggcttgccaacagtcttacataagcggactcttggactttgaag

SEQ ID NO: 106274 - DNA, 75 bp, Artificial Sequence
  Synthetic
tcgcatggagaccaccgtgaacgcccgagaaggcttgccaacagtcttacataagcggactcttggactttgatg

SEQ ID NO: 106275 - DNA, 75 bp, Artificial Sequence
  Synthetic
tcgcatggagaccaccgtgaacgcccgagaaggcttgccaacagtcttacataagcggactcttggactttgacg

SEQ ID NO: 106276 - DNA, 75 bp, Artificial Sequence
  Synthetic
tcgcatggagaccaccgtgaacgcccgagaaggcttgccaacagtcttacataagcggactcttggactttgagg

SEQ ID NO: 106277 - DNA, 75 bp, Artificial Sequence
  Synthetic
gattggaaagtctgtcaacgaattgtgggtcttttgggttttgctgcccctttcacacaatgtggttatcctgct

SEQ ID NO: 106278 - DNA, 75 bp, Artificial Sequence
  Synthetic
ctccaccaccttccaccaaactcttcaagattccagagtcagggccctgtactttcctgctggtggctccagttc

SEQ ID NO: 106279 - DNA, 75 bp, Artificial Sequence
  Synthetic
gacattgacccttataaagaatttggagcttctgtggagttactctcatttttgccttctgacttcttcccgtct

SEQ ID NO: 106280 - DNA, 75 bp, Artificial Sequence
  Synthetic
gtccgggacctactcgacaccgcttcagccctctaccgagatgccttagaatcacccgaacattgcacccccaac

SEQ ID NO: 106281 - DNA, 75 bp, Artificial Sequence
  Synthetic
cacactgctctcaggcaagctattttgtgctggggtgagttgatgaccttggcttcctgggtgggcaataattta

SEQ ID NO: 106282 - DNA, 75 bp, Artificial Sequence
  Synthetic
attgaagttagtaatgcctgccagattttatccaaattctaccaagtatttgcctctagagaaaggtataaaacc

SEQ ID NO: 106283 - DNA, 75 bp, Artificial Sequence
  Synthetic
accttcggacggaaattgcacctgtattcccatcccatcatcttgggctttcgcaagattcctatgggagtgggc

SEQ ID NO: 106284 - DNA, 75 bp, Artificial Sequence
  Synthetic
taaagttcaggcaactattgtggtttcacatttcttgtctcacttttggaagagaaacagtcatagagtatttgg

SEQ ID NO: 106285 - DNA, 75 bp, Artificial Sequence
  Synthetic
catttaaaccctaataaaaccaaacgttggggctactcccttaacttcatgggatatgtaattggaagttggggt

SEQ ID NO: 106286 - DNA, 75 bp, Artificial Sequence
  Synthetic
cgccgcgtcgcagaagatctcaatctcgggaatctcaatgttagtattccttggactcataaggtgggaaacttt

SEQ ID NO: 106287 - DNA, 75 bp, Artificial Sequence
  Synthetic
ccttgccagcaaatccgcctcctgcctccaccaatcgccagtcaggaaggcagcctaccccactttctccaccac

SEQ ID NO: 106288 - DNA, 75 bp, Artificial Sequence
  Synthetic
ggatatgtaattggaagttggggtactttaccacaggaacatattgtactaaaaatcaagcaatgttttcgaaaa

SEQ ID NO: 106289 - DNA, 75 bp, Artificial Sequence
  Synthetic
tcccaaagttactaaatacttccctttggataaaggtattaagccttactatccagagaatgtggttaatcatta

SEQ ID NO: 106290 - DNA, 75 bp, Artificial Sequence
  Synthetic
atgcctttatatgcatgtatacaatctaagcaggcttttactttctcgccaacttacaaggcctttctgtgtaaa

SEQ ID NO: 106291 - DNA, 75 bp, Artificial Sequence
  Synthetic
tctgtacaacatcttgagtccctttataccgctgttaccaattttcttttgtctttgggtatacatttaaaccct

SEQ ID NO: 106292 - DNA, 75 bp, Artificial Sequence
  Synthetic
gcatgggacagaatctttctgtgcccaatcctctgggattctttccagaccaccagttggatccactattcagag

SEQ ID NO: 106293 - DNA, 75 bp, Artificial Sequence
  Synthetic
caacctcgccaccagatccacctcctgcttccaccaatcggaggtcaggaagaaagccaaccccagtctctccac

SEQ ID NO: 106294 - DNA, 75 bp, Artificial Sequence
  Synthetic
ggggcctgtatcttcctgctggtggctccagttcaggaacagtaaaccctgttccgaatattgtctctcacatct

SEQ ID NO: 106295 - DNA, 75 bp, Artificial Sequence
  Synthetic
ttccacaacattccaccaagctctgcaggatcccagagtaagaggcctgtatcttcctgctggtggctccagttc

SEQ ID NO: 106296 - DNA, 75 bp, Artificial Sequence
  Synthetic
cctcattttgtgggtcaccatattcttgggaacaagagctacagcatgggaggttggtcttccacacctcgaaaa

SEQ ID NO: 106297 - DNA, 75 bp, Artificial Sequence
  Synthetic
ctcaacccagttccaccaggccttgttggatccgagggtaagggctctgtattttcctgctggtggctccagttc

SEQ ID NO: 106298 - DNA, 75 bp, Artificial Sequence
  Synthetic
atacatttaaaccctaacaaaacaaagagatggggttattccctaaattttatgggttatgtaattggaagttgg

SEQ ID NO: 106299 - DNA, 75 bp, Artificial Sequence
  Synthetic
caccgcctcagctctgtatcgggatgccttagagtctcctgaacattgttcacctcaccatactgcactcaggca

SEQ ID NO: 106300 - DNA, 75 bp, Artificial Sequence
  Synthetic
ctcaacccagttccaccaggctctgttggatcccagggtaagggctctgtatcttcctgctggtggctccagttc

SEQ ID NO: 106301 - DNA, 75 bp, Artificial Sequence
  Synthetic
caggaggacattattgatagatgtaaccaatttgtggggccacttacagtaaatgaaaaaaggagaataaaatta

SEQ ID NO: 106302 - DNA, 75 bp, Artificial Sequence
  Synthetic
caggaggacattattgatagatgtaaccaatttgtggggccacttacagtaaatgaaaaaaggagattaaaatta

SEQ ID NO: 106303 - DNA, 75 bp, Artificial Sequence
  Synthetic
caggaggacattattgatagatgtaaccaatttgtggggccacttacagtaaatgaaaaaaggagactaaaatta

SEQ ID NO: 106304 - DNA, 75 bp, Artificial Sequence
  Synthetic
caggaggacattattgatagatgtaaccaatttgtggggccacttacagtaaatgaaaaaaggagagtaaaatta

SEQ ID NO: 106305 - DNA, 75 bp, Artificial Sequence
  Synthetic
caggaggacattattgatagatgtaaccaatttgtggggcctcttacagtaaatgaaaaaaggagaataaaatta

SEQ ID NO: 106306 - DNA, 75 bp, Artificial Sequence
  Synthetic
caggaggacattattgatagatgtaaccaatttgtggggcctcttacagtaaatgaaaaaaggagattaaaatta

SEQ ID NO: 106307 - DNA, 75 bp, Artificial Sequence
  Synthetic
caggaggacattattgatagatgtaaccaatttgtggggcctcttacagtaaatgaaaaaaggagactaaaatta

SEQ ID NO: 106308 - DNA, 75 bp, Artificial Sequence
  Synthetic
caggaggacattattgatagatgtaaccaatttgtggggcctcttacagtaaatgaaaaaaggagagtaaaatta

SEQ ID NO: 106309 - DNA, 75 bp, Artificial Sequence
  Synthetic
caggaggacattattgatagatgtaaccaatttgtggggccccttacagtaaatgaaaaaaggagaataaaatta

SEQ ID NO: 106310 - DNA, 75 bp, Artificial Sequence
  Synthetic
caggaggacattattgatagatgtaaccaatttgtggggccccttacagtaaatgaaaaaaggagattaaaatta

SEQ ID NO: 106311 - DNA, 75 bp, Artificial Sequence
  Synthetic
caggaggacattattgatagatgtaaccaatttgtggggccccttacagtaaatgaaaaaaggagactaaaatta

SEQ ID NO: 106312 - DNA, 75 bp, Artificial Sequence
  Synthetic
caggaggacattattgatagatgtaaccaatttgtggggccccttacagtaaatgaaaaaaggagagtaaaatta

SEQ ID NO: 106313 - DNA, 75 bp, Artificial Sequence
  Synthetic
caggaggacattattgatagatgtaaccaatttgtggggccgcttacagtaaatgaaaaaaggagaataaaatta

SEQ ID NO: 106314 - DNA, 75 bp, Artificial Sequence
  Synthetic
caggaggacattattgatagatgtaaccaatttgtggggccgcttacagtaaatgaaaaaaggagattaaaatta

SEQ ID NO: 106315 - DNA, 75 bp, Artificial Sequence
  Synthetic
caggaggacattattgatagatgtaaccaatttgtggggccgcttacagtaaatgaaaaaaggagactaaaatta

SEQ ID NO: 106316 - DNA, 75 bp, Artificial Sequence
  Synthetic
caggaggacattattgatagatgtaaccaatttgtggggccgcttacagtaaatgaaaaaaggagagtaaaatta

SEQ ID NO: 106317 - DNA, 75 bp, Artificial Sequence
  Synthetic
caggaggacattattgatagatgttaccaatttgtggggccacttacagtaaatgaaaaaaggagaataaaatta

SEQ ID NO: 106318 - DNA, 75 bp, Artificial Sequence
  Synthetic
caggaggacattattgatagatgttaccaatttgtggggccacttacagtaaatgaaaaaaggagattaaaatta

SEQ ID NO: 106319 - DNA, 75 bp, Artificial Sequence
  Synthetic
caggaggacattattgatagatgttaccaatttgtggggccacttacagtaaatgaaaaaaggagactaaaatta

SEQ ID NO: 106320 - DNA, 75 bp, Artificial Sequence
  Synthetic
caggaggacattattgatagatgttaccaatttgtggggccacttacagtaaatgaaaaaaggagagtaaaatta

SEQ ID NO: 106321 - DNA, 75 bp, Artificial Sequence
  Synthetic
caggaggacattattgatagatgttaccaatttgtggggcctcttacagtaaatgaaaaaaggagaataaaatta

SEQ ID NO: 106322 - DNA, 75 bp, Artificial Sequence
  Synthetic
caggaggacattattgatagatgttaccaatttgtggggcctcttacagtaaatgaaaaaaggagattaaaatta

SEQ ID NO: 106323 - DNA, 75 bp, Artificial Sequence
  Synthetic
caggaggacattattgatagatgttaccaatttgtggggcctcttacagtaaatgaaaaaaggagactaaaatta

SEQ ID NO: 106324 - DNA, 75 bp, Artificial Sequence
  Synthetic
caggaggacattattgatagatgttaccaatttgtggggcctcttacagtaaatgaaaaaaggagagtaaaatta

SEQ ID NO: 106325 - DNA, 75 bp, Artificial Sequence
  Synthetic
caggaggacattattgatagatgttaccaatttgtggggccccttacagtaaatgaaaaaaggagaataaaatta

SEQ ID NO: 106326 - DNA, 75 bp, Artificial Sequence
  Synthetic
caggaggacattattgatagatgttaccaatttgtggggccccttacagtaaatgaaaaaaggagattaaaatta

SEQ ID NO: 106327 - DNA, 75 bp, Artificial Sequence
  Synthetic
caggaggacattattgatagatgttaccaatttgtggggccccttacagtaaatgaaaaaaggagactaaaatta

SEQ ID NO: 106328 - DNA, 75 bp, Artificial Sequence
  Synthetic
caggaggacattattgatagatgttaccaatttgtggggccccttacagtaaatgaaaaaaggagagtaaaatta

SEQ ID NO: 106329 - DNA, 75 bp, Artificial Sequence
  Synthetic
caggaggacattattgatagatgttaccaatttgtggggccgcttacagtaaatgaaaaaaggagaataaaatta

SEQ ID NO: 106330 - DNA, 75 bp, Artificial Sequence
  Synthetic
caggaggacattattgatagatgttaccaatttgtggggccgcttacagtaaatgaaaaaaggagattaaaatta

SEQ ID NO: 106331 - DNA, 75 bp, Artificial Sequence
  Synthetic
caggaggacattattgatagatgttaccaatttgtggggccgcttacagtaaatgaaaaaaggagactaaaatta

SEQ ID NO: 106332 - DNA, 75 bp, Artificial Sequence
  Synthetic
caggaggacattattgatagatgttaccaatttgtggggccgcttacagtaaatgaaaaaaggagagtaaaatta

SEQ ID NO: 106333 - DNA, 75 bp, Artificial Sequence
  Synthetic
caggaggacattattgatagatgtcaccaatttgtggggccacttacagtaaatgaaaaaaggagaataaaatta

SEQ ID NO: 106334 - DNA, 75 bp, Artificial Sequence
  Synthetic
caggaggacattattgatagatgtcaccaatttgtggggccacttacagtaaatgaaaaaaggagattaaaatta

SEQ ID NO: 106335 - DNA, 75 bp, Artificial Sequence
  Synthetic
caggaggacattattgatagatgtcaccaatttgtggggccacttacagtaaatgaaaaaaggagactaaaatta

SEQ ID NO: 106336 - DNA, 75 bp, Artificial Sequence
  Synthetic
caggaggacattattgatagatgtcaccaatttgtggggccacttacagtaaatgaaaaaaggagagtaaaatta

SEQ ID NO: 106337 - DNA, 75 bp, Artificial Sequence
  Synthetic
caggaggacattattgatagatgtcaccaatttgtggggcctcttacagtaaatgaaaaaaggagaataaaatta

SEQ ID NO: 106338 - DNA, 75 bp, Artificial Sequence
  Synthetic
caggaggacattattgatagatgtcaccaatttgtggggcctcttacagtaaatgaaaaaaggagattaaaatta

SEQ ID NO: 106339 - DNA, 75 bp, Artificial Sequence
  Synthetic
caggaggacattattgatagatgtcaccaatttgtggggcctcttacagtaaatgaaaaaaggagactaaaatta

SEQ ID NO: 106340 - DNA, 75 bp, Artificial Sequence
  Synthetic
caggaggacattattgatagatgtcaccaatttgtggggcctcttacagtaaatgaaaaaaggagagtaaaatta

SEQ ID NO: 106341 - DNA, 75 bp, Artificial Sequence
  Synthetic
caggaggacattattgatagatgtcaccaatttgtggggccccttacagtaaatgaaaaaaggagaataaaatta

SEQ ID NO: 106342 - DNA, 75 bp, Artificial Sequence
  Synthetic
caggaggacattattgatagatgtcaccaatttgtggggccccttacagtaaatgaaaaaaggagattaaaatta

SEQ ID NO: 106343 - DNA, 75 bp, Artificial Sequence
  Synthetic
caggaggacattattgatagatgtcaccaatttgtggggccccttacagtaaatgaaaaaaggagactaaaatta

SEQ ID NO: 106344 - DNA, 75 bp, Artificial Sequence
  Synthetic
caggaggacattattgatagatgtcaccaatttgtggggccccttacagtaaatgaaaaaaggagagtaaaatta

SEQ ID NO: 106345 - DNA, 75 bp, Artificial Sequence
  Synthetic
caggaggacattattgatagatgtcaccaatttgtggggccgcttacagtaaatgaaaaaaggagaataaaatta

SEQ ID NO: 106346 - DNA, 75 bp, Artificial Sequence
  Synthetic
caggaggacattattgatagatgtcaccaatttgtggggccgcttacagtaaatgaaaaaaggagattaaaatta

SEQ ID NO: 106347 - DNA, 75 bp, Artificial Sequence
  Synthetic
caggaggacattattgatagatgtcaccaatttgtggggccgcttacagtaaatgaaaaaaggagactaaaatta

SEQ ID NO: 106348 - DNA, 75 bp, Artificial Sequence
  Synthetic
caggaggacattattgatagatgtcaccaatttgtggggccgcttacagtaaatgaaaaaaggagagtaaaatta

SEQ ID NO: 106349 - DNA, 75 bp, Artificial Sequence
  Synthetic
caggaggacattattgatagatgtgaccaatttgtggggccacttacagtaaatgaaaaaaggagaataaaatta

SEQ ID NO: 106350 - DNA, 75 bp, Artificial Sequence
  Synthetic
caggaggacattattgatagatgtgaccaatttgtggggccacttacagtaaatgaaaaaaggagattaaaatta

SEQ ID NO: 106351 - DNA, 75 bp, Artificial Sequence
  Synthetic
caggaggacattattgatagatgtgaccaatttgtggggccacttacagtaaatgaaaaaaggagactaaaatta

SEQ ID NO: 106352 - DNA, 75 bp, Artificial Sequence
  Synthetic
caggaggacattattgatagatgtgaccaatttgtggggccacttacagtaaatgaaaaaaggagagtaaaatta

SEQ ID NO: 106353 - DNA, 75 bp, Artificial Sequence
  Synthetic
caggaggacattattgatagatgtgaccaatttgtggggcctcttacagtaaatgaaaaaaggagaataaaatta

SEQ ID NO: 106354 - DNA, 75 bp, Artificial Sequence
  Synthetic
caggaggacattattgatagatgtgaccaatttgtggggcctcttacagtaaatgaaaaaaggagattaaaatta

SEQ ID NO: 106355 - DNA, 75 bp, Artificial Sequence
  Synthetic
caggaggacattattgatagatgtgaccaatttgtggggcctcttacagtaaatgaaaaaaggagactaaaatta

SEQ ID NO: 106356 - DNA, 75 bp, Artificial Sequence
  Synthetic
caggaggacattattgatagatgtgaccaatttgtggggcctcttacagtaaatgaaaaaaggagagtaaaatta

SEQ ID NO: 106357 - DNA, 75 bp, Artificial Sequence
  Synthetic
caggaggacattattgatagatgtgaccaatttgtggggccccttacagtaaatgaaaaaaggagaataaaatta

SEQ ID NO: 106358 - DNA, 75 bp, Artificial Sequence
  Synthetic
caggaggacattattgatagatgtgaccaatttgtggggccccttacagtaaatgaaaaaaggagattaaaatta

SEQ ID NO: 106359 - DNA, 75 bp, Artificial Sequence
  Synthetic
caggaggacattattgatagatgtgaccaatttgtggggccccttacagtaaatgaaaaaaggagactaaaatta

SEQ ID NO: 106360 - DNA, 75 bp, Artificial Sequence
  Synthetic
caggaggacattattgatagatgtgaccaatttgtggggccccttacagtaaatgaaaaaaggagagtaaaatta

SEQ ID NO: 106361 - DNA, 75 bp, Artificial Sequence
  Synthetic
caggaggacattattgatagatgtgaccaatttgtggggccgcttacagtaaatgaaaaaaggagaataaaatta

SEQ ID NO: 106362 - DNA, 75 bp, Artificial Sequence
  Synthetic
caggaggacattattgatagatgtgaccaatttgtggggccgcttacagtaaatgaaaaaaggagattaaaatta

SEQ ID NO: 106363 - DNA, 75 bp, Artificial Sequence
  Synthetic
caggaggacattattgatagatgtgaccaatttgtggggccgcttacagtaaatgaaaaaaggagactaaaatta

SEQ ID NO: 106364 - DNA, 75 bp, Artificial Sequence
  Synthetic
caggaggacattattgatagatgtgaccaatttgtggggccgcttacagtaaatgaaaaaaggagagtaaaatta

SEQ ID NO: 106365 - DNA, 75 bp, Artificial Sequence
  Synthetic
gaagattaaaattgattatgcccgctagattttatcctaacagcactaaatatttgcctctagacaaagggatta

SEQ ID NO: 106366 - DNA, 75 bp, Artificial Sequence
  Synthetic
gggtaataatttgcaagatccagcatccagggatctagtagtcaattatgttaatactaacatgggcctaaagat

SEQ ID NO: 106367 - DNA, 75 bp, Artificial Sequence
  Synthetic
gcccactcacagttaatgagaaaagaagattgcaattgattatgcctgctaggttttatccaaatgttaccaaat

SEQ ID NO: 106368 - DNA, 75 bp, Artificial Sequence
  Synthetic
accgtccccttctccgtctgccgttccggccgaccacggggcgcacctctctttacgcggtctccccgtctgtgc

SEQ ID NO: 106369 - DNA, 75 bp, Artificial Sequence
  Synthetic
ctctgctagatccaagagtgaggggcctataatttcctgctggtggctccagttcaggaacagtcagccctggtc

SEQ ID NO: 106370 - DNA, 75 bp, Artificial Sequence
  Synthetic
ctctgctagatccaagagtgaggggcctataatttcctgctggtggctccagttctggaacagtcagccctggtc

SEQ ID NO: 106371 - DNA, 75 bp, Artificial Sequence
  Synthetic
ctctgctagatccaagagtgaggggcctataatttcctgctggtggctccagttccggaacagtcagccctggtc

SEQ ID NO: 106372 - DNA, 75 bp, Artificial Sequence
  Synthetic
ctctgctagatccaagagtgaggggcctataatttcctgctggtggctccagttcgggaacagtcagccctggtc

SEQ ID NO: 106373 - DNA, 75 bp, Artificial Sequence
  Synthetic
ctctgctagatccaagagtgaggggcctatattttcctgctggtggctccagttcaggaacagtcagccctggtc

SEQ ID NO: 106374 - DNA, 75 bp, Artificial Sequence
  Synthetic
ctctgctagatccaagagtgaggggcctatattttcctgctggtggctccagttctggaacagtcagccctggtc

SEQ ID NO: 106375 - DNA, 75 bp, Artificial Sequence
  Synthetic
ctctgctagatccaagagtgaggggcctatattttcctgctggtggctccagttccggaacagtcagccctggtc

SEQ ID NO: 106376 - DNA, 75 bp, Artificial Sequence
  Synthetic
ctctgctagatccaagagtgaggggcctatattttcctgctggtggctccagttcgggaacagtcagccctggtc

SEQ ID NO: 106377 - DNA, 75 bp, Artificial Sequence
  Synthetic
ctctgctagatccaagagtgaggggcctatactttcctgctggtggctccagttcaggaacagtcagccctggtc

SEQ ID NO: 106378 - DNA, 75 bp, Artificial Sequence
  Synthetic
ctctgctagatccaagagtgaggggcctatactttcctgctggtggctccagttctggaacagtcagccctggtc

SEQ ID NO: 106379 - DNA, 75 bp, Artificial Sequence
  Synthetic
ctctgctagatccaagagtgaggggcctatactttcctgctggtggctccagttccggaacagtcagccctggtc

SEQ ID NO: 106380 - DNA, 75 bp, Artificial Sequence
  Synthetic
ctctgctagatccaagagtgaggggcctatactttcctgctggtggctccagttcgggaacagtcagccctggtc

SEQ ID NO: 106381 - DNA, 75 bp, Artificial Sequence
  Synthetic
ctctgctagatccaagagtgaggggcctatagtttcctgctggtggctccagttcaggaacagtcagccctggtc

SEQ ID NO: 106382 - DNA, 75 bp, Artificial Sequence
  Synthetic
ctctgctagatccaagagtgaggggcctatagtttcctgctggtggctccagttctggaacagtcagccctggtc

SEQ ID NO: 106383 - DNA, 75 bp, Artificial Sequence
  Synthetic
ctctgctagatccaagagtgaggggcctatagtttcctgctggtggctccagttccggaacagtcagccctggtc

SEQ ID NO: 106384 - DNA, 75 bp, Artificial Sequence
  Synthetic
ctctgctagatccaagagtgaggggcctatagtttcctgctggtggctccagttcgggaacagtcagccctggtc

SEQ ID NO: 106385 - DNA, 75 bp, Artificial Sequence
  Synthetic
ctctgctagatcctagagtgaggggcctataatttcctgctggtggctccagttcaggaacagtcagccctggtc

SEQ ID NO: 106386 - DNA, 75 bp, Artificial Sequence
  Synthetic
ctctgctagatcctagagtgaggggcctataatttcctgctggtggctccagttctggaacagtcagccctggtc

SEQ ID NO: 106387 - DNA, 75 bp, Artificial Sequence
  Synthetic
ctctgctagatcctagagtgaggggcctataatttcctgctggtggctccagttccggaacagtcagccctggtc

SEQ ID NO: 106388 - DNA, 75 bp, Artificial Sequence
  Synthetic
ctctgctagatcctagagtgaggggcctataatttcctgctggtggctccagttcgggaacagtcagccctggtc

SEQ ID NO: 106389 - DNA, 75 bp, Artificial Sequence
  Synthetic
ctctgctagatcctagagtgaggggcctatattttcctgctggtggctccagttcaggaacagtcagccctggtc

SEQ ID NO: 106390 - DNA, 75 bp, Artificial Sequence
  Synthetic
ctctgctagatcctagagtgaggggcctatattttcctgctggtggctccagttctggaacagtcagccctggtc

SEQ ID NO: 106391 - DNA, 75 bp, Artificial Sequence
  Synthetic
ctctgctagatcctagagtgaggggcctatattttcctgctggtggctccagttccggaacagtcagccctggtc

SEQ ID NO: 106392 - DNA, 75 bp, Artificial Sequence
  Synthetic
ctctgctagatcctagagtgaggggcctatattttcctgctggtggctccagttcgggaacagtcagccctggtc

SEQ ID NO: 106393 - DNA, 75 bp, Artificial Sequence
  Synthetic
ctctgctagatcctagagtgaggggcctatactttcctgctggtggctccagttcaggaacagtcagccctggtc

SEQ ID NO: 106394 - DNA, 75 bp, Artificial Sequence
  Synthetic
ctctgctagatcctagagtgaggggcctatactttcctgctggtggctccagttctggaacagtcagccctggtc

SEQ ID NO: 106395 - DNA, 75 bp, Artificial Sequence
  Synthetic
ctctgctagatcctagagtgaggggcctatactttcctgctggtggctccagttccggaacagtcagccctggtc

SEQ ID NO: 106396 - DNA, 75 bp, Artificial Sequence
  Synthetic
ctctgctagatcctagagtgaggggcctatactttcctgctggtggctccagttcgggaacagtcagccctggtc

SEQ ID NO: 106397 - DNA, 75 bp, Artificial Sequence
  Synthetic
ctctgctagatcctagagtgaggggcctatagtttcctgctggtggctccagttcaggaacagtcagccctggtc

SEQ ID NO: 106398 - DNA, 75 bp, Artificial Sequence
  Synthetic
ctctgctagatcctagagtgaggggcctatagtttcctgctggtggctccagttctggaacagtcagccctggtc

SEQ ID NO: 106399 - DNA, 75 bp, Artificial Sequence
  Synthetic
ctctgctagatcctagagtgaggggcctatagtttcctgctggtggctccagttccggaacagtcagccctggtc

SEQ ID NO: 106400 - DNA, 75 bp, Artificial Sequence
  Synthetic
ctctgctagatcctagagtgaggggcctatagtttcctgctggtggctccagttcgggaacagtcagccctggtc

SEQ ID NO: 106401 - DNA, 75 bp, Artificial Sequence
  Synthetic
ctctgctagatcccagagtgaggggcctataatttcctgctggtggctccagttcaggaacagtcagccctggtc

SEQ ID NO: 106402 - DNA, 75 bp, Artificial Sequence
  Synthetic
ctctgctagatcccagagtgaggggcctataatttcctgctggtggctccagttctggaacagtcagccctggtc

SEQ ID NO: 106403 - DNA, 75 bp, Artificial Sequence
  Synthetic
ctctgctagatcccagagtgaggggcctataatttcctgctggtggctccagttccggaacagtcagccctggtc

SEQ ID NO: 106404 - DNA, 75 bp, Artificial Sequence
  Synthetic
ctctgctagatcccagagtgaggggcctataatttcctgctggtggctccagttcgggaacagtcagccctggtc

SEQ ID NO: 106405 - DNA, 75 bp, Artificial Sequence
  Synthetic
ctctgctagatcccagagtgaggggcctatattttcctgctggtggctccagttcaggaacagtcagccctggtc

SEQ ID NO: 106406 - DNA, 75 bp, Artificial Sequence
  Synthetic
ctctgctagatcccagagtgaggggcctatattttcctgctggtggctccagttctggaacagtcagccctggtc

SEQ ID NO: 106407 - DNA, 75 bp, Artificial Sequence
  Synthetic
ctctgctagatcccagagtgaggggcctatattttcctgctggtggctccagttccggaacagtcagccctggtc

SEQ ID NO: 106408 - DNA, 75 bp, Artificial Sequence
  Synthetic
ctctgctagatcccagagtgaggggcctatattttcctgctggtggctccagttcgggaacagtcagccctggtc

SEQ ID NO: 106409 - DNA, 75 bp, Artificial Sequence
  Synthetic
ctctgctagatcccagagtgaggggcctatactttcctgctggtggctccagttcaggaacagtcagccctggtc

SEQ ID NO: 106410 - DNA, 75 bp, Artificial Sequence
  Synthetic
ctctgctagatcccagagtgaggggcctatactttcctgctggtggctccagttctggaacagtcagccctggtc

SEQ ID NO: 106411 - DNA, 75 bp, Artificial Sequence
  Synthetic
ctctgctagatcccagagtgaggggcctatactttcctgctggtggctccagttccggaacagtcagccctggtc

SEQ ID NO: 106412 - DNA, 75 bp, Artificial Sequence
  Synthetic
ctctgctagatcccagagtgaggggcctatactttcctgctggtggctccagttcgggaacagtcagccctggtc

SEQ ID NO: 106413 - DNA, 75 bp, Artificial Sequence
  Synthetic
ctctgctagatcccagagtgaggggcctatagtttcctgctggtggctccagttcaggaacagtcagccctggtc

SEQ ID NO: 106414 - DNA, 75 bp, Artificial Sequence
  Synthetic
ctctgctagatcccagagtgaggggcctatagtttcctgctggtggctccagttctggaacagtcagccctggtc

SEQ ID NO: 106415 - DNA, 75 bp, Artificial Sequence
  Synthetic
ctctgctagatcccagagtgaggggcctatagtttcctgctggtggctccagttccggaacagtcagccctggtc

SEQ ID NO: 106416 - DNA, 75 bp, Artificial Sequence
  Synthetic
ctctgctagatcccagagtgaggggcctatagtttcctgctggtggctccagttcgggaacagtcagccctggtc

SEQ ID NO: 106417 - DNA, 75 bp, Artificial Sequence
  Synthetic
ctctgctagatccgagagtgaggggcctataatttcctgctggtggctccagttcaggaacagtcagccctggtc

SEQ ID NO: 106418 - DNA, 75 bp, Artificial Sequence
  Synthetic
ctctgctagatccgagagtgaggggcctataatttcctgctggtggctccagttctggaacagtcagccctggtc

SEQ ID NO: 106419 - DNA, 75 bp, Artificial Sequence
  Synthetic
ctctgctagatccgagagtgaggggcctataatttcctgctggtggctccagttccggaacagtcagccctggtc

SEQ ID NO: 106420 - DNA, 75 bp, Artificial Sequence
  Synthetic
ctctgctagatccgagagtgaggggcctataatttcctgctggtggctccagttcgggaacagtcagccctggtc

SEQ ID NO: 106421 - DNA, 75 bp, Artificial Sequence
  Synthetic
ctctgctagatccgagagtgaggggcctatattttcctgctggtggctccagttcaggaacagtcagccctggtc

SEQ ID NO: 106422 - DNA, 75 bp, Artificial Sequence
  Synthetic
ctctgctagatccgagagtgaggggcctatattttcctgctggtggctccagttctggaacagtcagccctggtc

SEQ ID NO: 106423 - DNA, 75 bp, Artificial Sequence
  Synthetic
ctctgctagatccgagagtgaggggcctatattttcctgctggtggctccagttccggaacagtcagccctggtc

SEQ ID NO: 106424 - DNA, 75 bp, Artificial Sequence
  Synthetic
ctctgctagatccgagagtgaggggcctatattttcctgctggtggctccagttcgggaacagtcagccctggtc

SEQ ID NO: 106425 - DNA, 75 bp, Artificial Sequence
  Synthetic
ctctgctagatccgagagtgaggggcctatactttcctgctggtggctccagttcaggaacagtcagccctggtc

SEQ ID NO: 106426 - DNA, 75 bp, Artificial Sequence
  Synthetic
ctctgctagatccgagagtgaggggcctatactttcctgctggtggctccagttctggaacagtcagccctggtc

SEQ ID NO: 106427 - DNA, 75 bp, Artificial Sequence
  Synthetic
ctctgctagatccgagagtgaggggcctatactttcctgctggtggctccagttccggaacagtcagccctggtc

SEQ ID NO: 106428 - DNA, 75 bp, Artificial Sequence
  Synthetic
ctctgctagatccgagagtgaggggcctatactttcctgctggtggctccagttcgggaacagtcagccctggtc

SEQ ID NO: 106429 - DNA, 75 bp, Artificial Sequence
  Synthetic
ctctgctagatccgagagtgaggggcctatagtttcctgctggtggctccagttcaggaacagtcagccctggtc

SEQ ID NO: 106430 - DNA, 75 bp, Artificial Sequence
  Synthetic
ctctgctagatccgagagtgaggggcctatagtttcctgctggtggctccagttctggaacagtcagccctggtc

SEQ ID NO: 106431 - DNA, 75 bp, Artificial Sequence
  Synthetic
ctctgctagatccgagagtgaggggcctatagtttcctgctggtggctccagttccggaacagtcagccctggtc

SEQ ID NO: 106432 - DNA, 75 bp, Artificial Sequence
  Synthetic
ctctgctagatccgagagtgaggggcctatagtttcctgctggtggctccagttcgggaacagtcagccctggtc

SEQ ID NO: 106433 - DNA, 75 bp, Artificial Sequence
  Synthetic
aaaccctgttccgactactgcctctcacacatcgttaatcttctcgaggattggggaccttgtgcggaacatgga

SEQ ID NO: 106434 - DNA, 75 bp, Artificial Sequence
  Synthetic
acttccggagactactgttgttagacgaagaggcaggtcccctagaagaagaactccctcgcctcgcagacgaag

SEQ ID NO: 106435 - DNA, 75 bp, Artificial Sequence
  Synthetic
ctccacagcattccatcaagctctgcaagatcccaaagtaaggggtcttcctgctggtggctccagttccggggc

SEQ ID NO: 106436 - DNA, 75 bp, Artificial Sequence
  Synthetic
gatggggataatcccttaacttcatgggatatgtaattggtagttggggaactttaccacaggaacatattgtac

SEQ ID NO: 106437 - DNA, 75 bp, Artificial Sequence
  Synthetic
gatggggataatcccttaacttcatgggatatgtaattggtagttggggaacttttccacaggaacatattgtac

SEQ ID NO: 106438 - DNA, 75 bp, Artificial Sequence
  Synthetic
gatggggataatcccttaacttcatgggatatgtaattggtagttggggaactttcccacaggaacatattgtac

SEQ ID NO: 106439 - DNA, 75 bp, Artificial Sequence
  Synthetic
gatggggataatcccttaacttcatgggatatgtaattggtagttggggaactttgccacaggaacatattgtac

SEQ ID NO: 106440 - DNA, 75 bp, Artificial Sequence
  Synthetic
gatggggataatcccttaacttcatgggatatgtaattggtagttggggtactttaccacaggaacatattgtac

SEQ ID NO: 106441 - DNA, 75 bp, Artificial Sequence
  Synthetic
gatggggataatcccttaacttcatgggatatgtaattggtagttggggtacttttccacaggaacatattgtac

SEQ ID NO: 106442 - DNA, 75 bp, Artificial Sequence
  Synthetic
gatggggataatcccttaacttcatgggatatgtaattggtagttggggtactttcccacaggaacatattgtac

SEQ ID NO: 106443 - DNA, 75 bp, Artificial Sequence
  Synthetic
gatggggataatcccttaacttcatgggatatgtaattggtagttggggtactttgccacaggaacatattgtac

SEQ ID NO: 106444 - DNA, 75 bp, Artificial Sequence
  Synthetic
gatggggataatcccttaacttcatgggatatgtaattggtagttggggcactttaccacaggaacatattgtac

SEQ ID NO: 106445 - DNA, 75 bp, Artificial Sequence
  Synthetic
gatggggataatcccttaacttcatgggatatgtaattggtagttggggcacttttccacaggaacatattgtac

SEQ ID NO: 106446 - DNA, 75 bp, Artificial Sequence
  Synthetic
gatggggataatcccttaacttcatgggatatgtaattggtagttggggcactttcccacaggaacatattgtac

SEQ ID NO: 106447 - DNA, 75 bp, Artificial Sequence
  Synthetic
gatggggataatcccttaacttcatgggatatgtaattggtagttggggcactttgccacaggaacatattgtac

SEQ ID NO: 106448 - DNA, 75 bp, Artificial Sequence
  Synthetic
gatggggataatcccttaacttcatgggatatgtaattggtagttgggggactttaccacaggaacatattgtac

SEQ ID NO: 106449 - DNA, 75 bp, Artificial Sequence
  Synthetic
gatggggataatcccttaacttcatgggatatgtaattggtagttgggggacttttccacaggaacatattgtac

SEQ ID NO: 106450 - DNA, 75 bp, Artificial Sequence
  Synthetic
gatggggataatcccttaacttcatgggatatgtaattggtagttgggggactttcccacaggaacatattgtac

SEQ ID NO: 106451 - DNA, 75 bp, Artificial Sequence
  Synthetic
gatggggataatcccttaacttcatgggatatgtaattggtagttgggggactttgccacaggaacatattgtac

SEQ ID NO: 106452 - DNA, 75 bp, Artificial Sequence
  Synthetic
gatggggatattcccttaacttcatgggatatgtaattggtagttggggaactttaccacaggaacatattgtac

SEQ ID NO: 106453 - DNA, 75 bp, Artificial Sequence
  Synthetic
gatggggatattcccttaacttcatgggatatgtaattggtagttggggaacttttccacaggaacatattgtac

SEQ ID NO: 106454 - DNA, 75 bp, Artificial Sequence
  Synthetic
gatggggatattcccttaacttcatgggatatgtaattggtagttggggaactttcccacaggaacatattgtac

SEQ ID NO: 106455 - DNA, 75 bp, Artificial Sequence
  Synthetic
gatggggatattcccttaacttcatgggatatgtaattggtagttggggaactttgccacaggaacatattgtac

SEQ ID NO: 106456 - DNA, 75 bp, Artificial Sequence
  Synthetic
gatggggatattcccttaacttcatgggatatgtaattggtagttggggtactttaccacaggaacatattgtac

SEQ ID NO: 106457 - DNA, 75 bp, Artificial Sequence
  Synthetic
gatggggatattcccttaacttcatgggatatgtaattggtagttggggtacttttccacaggaacatattgtac

SEQ ID NO: 106458 - DNA, 75 bp, Artificial Sequence
  Synthetic
gatggggatattcccttaacttcatgggatatgtaattggtagttggggtactttcccacaggaacatattgtac

SEQ ID NO: 106459 - DNA, 75 bp, Artificial Sequence
  Synthetic
gatggggatattcccttaacttcatgggatatgtaattggtagttggggtactttgccacaggaacatattgtac

SEQ ID NO: 106460 - DNA, 75 bp, Artificial Sequence
  Synthetic
gatggggatattcccttaacttcatgggatatgtaattggtagttggggcactttaccacaggaacatattgtac

SEQ ID NO: 106461 - DNA, 75 bp, Artificial Sequence
  Synthetic
gatggggatattcccttaacttcatgggatatgtaattggtagttggggcacttttccacaggaacatattgtac

SEQ ID NO: 106462 - DNA, 75 bp, Artificial Sequence
  Synthetic
gatggggatattcccttaacttcatgggatatgtaattggtagttggggcactttcccacaggaacatattgtac

SEQ ID NO: 106463 - DNA, 75 bp, Artificial Sequence
  Synthetic
gatggggatattcccttaacttcatgggatatgtaattggtagttggggcactttgccacaggaacatattgtac

SEQ ID NO: 106464 - DNA, 75 bp, Artificial Sequence
  Synthetic
gatggggatattcccttaacttcatgggatatgtaattggtagttgggggactttaccacaggaacatattgtac

SEQ ID NO: 106465 - DNA, 75 bp, Artificial Sequence
  Synthetic
gatggggatattcccttaacttcatgggatatgtaattggtagttgggggacttttccacaggaacatattgtac

SEQ ID NO: 106466 - DNA, 75 bp, Artificial Sequence
  Synthetic
gatggggatattcccttaacttcatgggatatgtaattggtagttgggggactttcccacaggaacatattgtac

SEQ ID NO: 106467 - DNA, 75 bp, Artificial Sequence
  Synthetic
gatggggatattcccttaacttcatgggatatgtaattggtagttgggggactttgccacaggaacatattgtac

SEQ ID NO: 106468 - DNA, 75 bp, Artificial Sequence
  Synthetic
gatggggatactcccttaacttcatgggatatgtaattggtagttggggaactttaccacaggaacatattgtac

SEQ ID NO: 106469 - DNA, 75 bp, Artificial Sequence
  Synthetic
gatggggatactcccttaacttcatgggatatgtaattggtagttggggaacttttccacaggaacatattgtac

SEQ ID NO: 106470 - DNA, 75 bp, Artificial Sequence
  Synthetic
gatggggatactcccttaacttcatgggatatgtaattggtagttggggaactttcccacaggaacatattgtac

SEQ ID NO: 106471 - DNA, 75 bp, Artificial Sequence
  Synthetic
gatggggatactcccttaacttcatgggatatgtaattggtagttggggaactttgccacaggaacatattgtac

SEQ ID NO: 106472 - DNA, 75 bp, Artificial Sequence
  Synthetic
gatggggatactcccttaacttcatgggatatgtaattggtagttggggtactttaccacaggaacatattgtac

SEQ ID NO: 106473 - DNA, 75 bp, Artificial Sequence
  Synthetic
gatggggatactcccttaacttcatgggatatgtaattggtagttggggtacttttccacaggaacatattgtac

SEQ ID NO: 106474 - DNA, 75 bp, Artificial Sequence
  Synthetic
gatggggatactcccttaacttcatgggatatgtaattggtagttggggtactttcccacaggaacatattgtac

SEQ ID NO: 106475 - DNA, 75 bp, Artificial Sequence
  Synthetic
gatggggatactcccttaacttcatgggatatgtaattggtagttggggtactttgccacaggaacatattgtac

SEQ ID NO: 106476 - DNA, 75 bp, Artificial Sequence
  Synthetic
gatggggatactcccttaacttcatgggatatgtaattggtagttggggcactttaccacaggaacatattgtac

SEQ ID NO: 106477 - DNA, 75 bp, Artificial Sequence
  Synthetic
gatggggatactcccttaacttcatgggatatgtaattggtagttggggcacttttccacaggaacatattgtac

SEQ ID NO: 106478 - DNA, 75 bp, Artificial Sequence
  Synthetic
gatggggatactcccttaacttcatgggatatgtaattggtagttggggcactttcccacaggaacatattgtac

SEQ ID NO: 106479 - DNA, 75 bp, Artificial Sequence
  Synthetic
gatggggatactcccttaacttcatgggatatgtaattggtagttggggcactttgccacaggaacatattgtac

SEQ ID NO: 106480 - DNA, 75 bp, Artificial Sequence
  Synthetic
gatggggatactcccttaacttcatgggatatgtaattggtagttgggggactttaccacaggaacatattgtac

SEQ ID NO: 106481 - DNA, 75 bp, Artificial Sequence
  Synthetic
gatggggatactcccttaacttcatgggatatgtaattggtagttgggggacttttccacaggaacatattgtac

SEQ ID NO: 106482 - DNA, 75 bp, Artificial Sequence
  Synthetic
gatggggatactcccttaacttcatgggatatgtaattggtagttgggggactttcccacaggaacatattgtac

SEQ ID NO: 106483 - DNA, 75 bp, Artificial Sequence
  Synthetic
gatggggatactcccttaacttcatgggatatgtaattggtagttgggggactttgccacaggaacatattgtac

SEQ ID NO: 106484 - DNA, 75 bp, Artificial Sequence
  Synthetic
gatggggatagtcccttaacttcatgggatatgtaattggtagttggggaactttaccacaggaacatattgtac

SEQ ID NO: 106485 - DNA, 75 bp, Artificial Sequence
  Synthetic
gatggggatagtcccttaacttcatgggatatgtaattggtagttggggaacttttccacaggaacatattgtac

SEQ ID NO: 106486 - DNA, 75 bp, Artificial Sequence
  Synthetic
gatggggatagtcccttaacttcatgggatatgtaattggtagttggggaactttcccacaggaacatattgtac

SEQ ID NO: 106487 - DNA, 75 bp, Artificial Sequence
  Synthetic
gatggggatagtcccttaacttcatgggatatgtaattggtagttggggaactttgccacaggaacatattgtac

SEQ ID NO: 106488 - DNA, 75 bp, Artificial Sequence
  Synthetic
gatggggatagtcccttaacttcatgggatatgtaattggtagttggggtactttaccacaggaacatattgtac

SEQ ID NO: 106489 - DNA, 75 bp, Artificial Sequence
  Synthetic
gatggggatagtcccttaacttcatgggatatgtaattggtagttggggtacttttccacaggaacatattgtac

SEQ ID NO: 106490 - DNA, 75 bp, Artificial Sequence
  Synthetic
gatggggatagtcccttaacttcatgggatatgtaattggtagttggggtactttcccacaggaacatattgtac

SEQ ID NO: 106491 - DNA, 75 bp, Artificial Sequence
  Synthetic
gatggggatagtcccttaacttcatgggatatgtaattggtagttggggtactttgccacaggaacatattgtac

SEQ ID NO: 106492 - DNA, 75 bp, Artificial Sequence
  Synthetic
gatggggatagtcccttaacttcatgggatatgtaattggtagttggggcactttaccacaggaacatattgtac

SEQ ID NO: 106493 - DNA, 75 bp, Artificial Sequence
  Synthetic
gatggggatagtcccttaacttcatgggatatgtaattggtagttggggcacttttccacaggaacatattgtac

SEQ ID NO: 106494 - DNA, 75 bp, Artificial Sequence
  Synthetic
gatggggatagtcccttaacttcatgggatatgtaattggtagttggggcactttcccacaggaacatattgtac

SEQ ID NO: 106495 - DNA, 75 bp, Artificial Sequence
  Synthetic
gatggggatagtcccttaacttcatgggatatgtaattggtagttggggcactttgccacaggaacatattgtac

SEQ ID NO: 106496 - DNA, 75 bp, Artificial Sequence
  Synthetic
gatggggatagtcccttaacttcatgggatatgtaattggtagttgggggactttaccacaggaacatattgtac

SEQ ID NO: 106497 - DNA, 75 bp, Artificial Sequence
  Synthetic
gatggggatagtcccttaacttcatgggatatgtaattggtagttgggggacttttccacaggaacatattgtac

SEQ ID NO: 106498 - DNA, 75 bp, Artificial Sequence
  Synthetic
gatggggatagtcccttaacttcatgggatatgtaattggtagttgggggactttcccacaggaacatattgtac

SEQ ID NO: 106499 - DNA, 75 bp, Artificial Sequence
  Synthetic
gatggggatagtcccttaacttcatgggatatgtaattggtagttgggggactttgccacaggaacatattgtac

SEQ ID NO: 106500 - DNA, 75 bp, Artificial Sequence
  Synthetic
tttggcttcctgggtgggcaataatttggaggaccctgcagccagggatttagtagttaactatgttaacactaa

SEQ ID NO: 106501 - DNA, 75 bp, Artificial Sequence
  Synthetic
tgttttagaaaactacctgtaaaaagccctattgattggaaagtatgtcaaagaattgtgggtcttttgggattt

SEQ ID NO: 106502 - DNA, 75 bp, Artificial Sequence
  Synthetic
tgttttagaaaactacctgtaaaaagccctattgattggaaagtatgtcaatgaattgtgggtcttttgggattt

SEQ ID NO: 106503 - DNA, 75 bp, Artificial Sequence
  Synthetic
tgttttagaaaactacctgtaaaaagccctattgattggaaagtatgtcaacgaattgtgggtcttttgggattt

SEQ ID NO: 106504 - DNA, 75 bp, Artificial Sequence
  Synthetic
tgttttagaaaactacctgtaaaaagccctattgattggaaagtatgtcaaggaattgtgggtcttttgggattt

SEQ ID NO: 106505 - DNA, 75 bp, Artificial Sequence
  Synthetic
tgttttagaaaactacctgtaaatagccctattgattggaaagtatgtcaaagaattgtgggtcttttgggattt

SEQ ID NO: 106506 - DNA, 75 bp, Artificial Sequence
  Synthetic
tgttttagaaaactacctgtaaatagccctattgattggaaagtatgtcaatgaattgtgggtcttttgggattt

SEQ ID NO: 106507 - DNA, 75 bp, Artificial Sequence
  Synthetic
tgttttagaaaactacctgtaaatagccctattgattggaaagtatgtcaacgaattgtgggtcttttgggattt

SEQ ID NO: 106508 - DNA, 75 bp, Artificial Sequence
  Synthetic
tgttttagaaaactacctgtaaatagccctattgattggaaagtatgtcaaggaattgtgggtcttttgggattt

SEQ ID NO: 106509 - DNA, 75 bp, Artificial Sequence
  Synthetic
tgttttagaaaactacctgtaaacagccctattgattggaaagtatgtcaaagaattgtgggtcttttgggattt

SEQ ID NO: 106510 - DNA, 75 bp, Artificial Sequence
  Synthetic
tgttttagaaaactacctgtaaacagccctattgattggaaagtatgtcaatgaattgtgggtcttttgggattt

SEQ ID NO: 106511 - DNA, 75 bp, Artificial Sequence
  Synthetic
tgttttagaaaactacctgtaaacagccctattgattggaaagtatgtcaacgaattgtgggtcttttgggattt

SEQ ID NO: 106512 - DNA, 75 bp, Artificial Sequence
  Synthetic
tgttttagaaaactacctgtaaacagccctattgattggaaagtatgtcaaggaattgtgggtcttttgggattt

SEQ ID NO: 106513 - DNA, 75 bp, Artificial Sequence
  Synthetic
tgttttagaaaactacctgtaaagagccctattgattggaaagtatgtcaaagaattgtgggtcttttgggattt

SEQ ID NO: 106514 - DNA, 75 bp, Artificial Sequence
  Synthetic
tgttttagaaaactacctgtaaagagccctattgattggaaagtatgtcaatgaattgtgggtcttttgggattt

SEQ ID NO: 106515 - DNA, 75 bp, Artificial Sequence
  Synthetic
tgttttagaaaactacctgtaaagagccctattgattggaaagtatgtcaacgaattgtgggtcttttgggattt

SEQ ID NO: 106516 - DNA, 75 bp, Artificial Sequence
  Synthetic
tgttttagaaaactacctgtaaagagccctattgattggaaagtatgtcaaggaattgtgggtcttttgggattt

SEQ ID NO: 106517 - DNA, 75 bp, Artificial Sequence
  Synthetic
tgttttagtaaactacctgtaaaaagccctattgattggaaagtatgtcaaagaattgtgggtcttttgggattt

SEQ ID NO: 106518 - DNA, 75 bp, Artificial Sequence
  Synthetic
tgttttagtaaactacctgtaaaaagccctattgattggaaagtatgtcaatgaattgtgggtcttttgggattt

SEQ ID NO: 106519 - DNA, 75 bp, Artificial Sequence
  Synthetic
tgttttagtaaactacctgtaaaaagccctattgattggaaagtatgtcaacgaattgtgggtcttttgggattt

SEQ ID NO: 106520 - DNA, 75 bp, Artificial Sequence
  Synthetic
tgttttagtaaactacctgtaaaaagccctattgattggaaagtatgtcaaggaattgtgggtcttttgggattt

SEQ ID NO: 106521 - DNA, 75 bp, Artificial Sequence
  Synthetic
tgttttagtaaactacctgtaaatagccctattgattggaaagtatgtcaaagaattgtgggtcttttgggattt

SEQ ID NO: 106522 - DNA, 75 bp, Artificial Sequence
  Synthetic
tgttttagtaaactacctgtaaatagccctattgattggaaagtatgtcaatgaattgtgggtcttttgggattt

SEQ ID NO: 106523 - DNA, 75 bp, Artificial Sequence
  Synthetic
tgttttagtaaactacctgtaaatagccctattgattggaaagtatgtcaacgaattgtgggtcttttgggattt

SEQ ID NO: 106524 - DNA, 75 bp, Artificial Sequence
  Synthetic
tgttttagtaaactacctgtaaatagccctattgattggaaagtatgtcaaggaattgtgggtcttttgggattt

SEQ ID NO: 106525 - DNA, 75 bp, Artificial Sequence
  Synthetic
tgttttagtaaactacctgtaaacagccctattgattggaaagtatgtcaaagaattgtgggtcttttgggattt

SEQ ID NO: 106526 - DNA, 75 bp, Artificial Sequence
  Synthetic
tgttttagtaaactacctgtaaacagccctattgattggaaagtatgtcaatgaattgtgggtcttttgggattt

SEQ ID NO: 106527 - DNA, 75 bp, Artificial Sequence
  Synthetic
tgttttagtaaactacctgtaaacagccctattgattggaaagtatgtcaacgaattgtgggtcttttgggattt

SEQ ID NO: 106528 - DNA, 75 bp, Artificial Sequence
  Synthetic
tgttttagtaaactacctgtaaacagccctattgattggaaagtatgtcaaggaattgtgggtcttttgggattt

SEQ ID NO: 106529 - DNA, 75 bp, Artificial Sequence
  Synthetic
tgttttagtaaactacctgtaaagagccctattgattggaaagtatgtcaaagaattgtgggtcttttgggattt

SEQ ID NO: 106530 - DNA, 75 bp, Artificial Sequence
  Synthetic
tgttttagtaaactacctgtaaagagccctattgattggaaagtatgtcaatgaattgtgggtcttttgggattt

SEQ ID NO: 106531 - DNA, 75 bp, Artificial Sequence
  Synthetic
tgttttagtaaactacctgtaaagagccctattgattggaaagtatgtcaacgaattgtgggtcttttgggattt

SEQ ID NO: 106532 - DNA, 75 bp, Artificial Sequence
  Synthetic
tgttttagtaaactacctgtaaagagccctattgattggaaagtatgtcaaggaattgtgggtcttttgggattt

SEQ ID NO: 106533 - DNA, 75 bp, Artificial Sequence
  Synthetic
tgttttagcaaactacctgtaaaaagccctattgattggaaagtatgtcaaagaattgtgggtcttttgggattt

SEQ ID NO: 106534 - DNA, 75 bp, Artificial Sequence
  Synthetic
tgttttagcaaactacctgtaaaaagccctattgattggaaagtatgtcaatgaattgtgggtcttttgggattt

SEQ ID NO: 106535 - DNA, 75 bp, Artificial Sequence
  Synthetic
tgttttagcaaactacctgtaaaaagccctattgattggaaagtatgtcaacgaattgtgggtcttttgggattt

SEQ ID NO: 106536 - DNA, 75 bp, Artificial Sequence
  Synthetic
tgttttagcaaactacctgtaaaaagccctattgattggaaagtatgtcaaggaattgtgggtcttttgggattt

SEQ ID NO: 106537 - DNA, 75 bp, Artificial Sequence
  Synthetic
tgttttagcaaactacctgtaaatagccctattgattggaaagtatgtcaaagaattgtgggtcttttgggattt

SEQ ID NO: 106538 - DNA, 75 bp, Artificial Sequence
  Synthetic
tgttttagcaaactacctgtaaatagccctattgattggaaagtatgtcaatgaattgtgggtcttttgggattt

SEQ ID NO: 106539 - DNA, 75 bp, Artificial Sequence
  Synthetic
tgttttagcaaactacctgtaaatagccctattgattggaaagtatgtcaacgaattgtgggtcttttgggattt

SEQ ID NO: 106540 - DNA, 75 bp, Artificial Sequence
  Synthetic
tgttttagcaaactacctgtaaatagccctattgattggaaagtatgtcaaggaattgtgggtcttttgggattt

SEQ ID NO: 106541 - DNA, 75 bp, Artificial Sequence
  Synthetic
tgttttagcaaactacctgtaaacagccctattgattggaaagtatgtcaaagaattgtgggtcttttgggattt

SEQ ID NO: 106542 - DNA, 75 bp, Artificial Sequence
  Synthetic
tgttttagcaaactacctgtaaacagccctattgattggaaagtatgtcaatgaattgtgggtcttttgggattt

SEQ ID NO: 106543 - DNA, 75 bp, Artificial Sequence
  Synthetic
tgttttagcaaactacctgtaaacagccctattgattggaaagtatgtcaacgaattgtgggtcttttgggattt

SEQ ID NO: 106544 - DNA, 75 bp, Artificial Sequence
  Synthetic
tgttttagcaaactacctgtaaacagccctattgattggaaagtatgtcaaggaattgtgggtcttttgggattt

SEQ ID NO: 106545 - DNA, 75 bp, Artificial Sequence
  Synthetic
tgttttagcaaactacctgtaaagagccctattgattggaaagtatgtcaaagaattgtgggtcttttgggattt

SEQ ID NO: 106546 - DNA, 75 bp, Artificial Sequence
  Synthetic
tgttttagcaaactacctgtaaagagccctattgattggaaagtatgtcaatgaattgtgggtcttttgggattt

SEQ ID NO: 106547 - DNA, 75 bp, Artificial Sequence
  Synthetic
tgttttagcaaactacctgtaaagagccctattgattggaaagtatgtcaacgaattgtgggtcttttgggattt

SEQ ID NO: 106548 - DNA, 75 bp, Artificial Sequence
  Synthetic
tgttttagcaaactacctgtaaagagccctattgattggaaagtatgtcaaggaattgtgggtcttttgggattt

SEQ ID NO: 106549 - DNA, 75 bp, Artificial Sequence
  Synthetic
tgttttaggaaactacctgtaaaaagccctattgattggaaagtatgtcaaagaattgtgggtcttttgggattt

SEQ ID NO: 106550 - DNA, 75 bp, Artificial Sequence
  Synthetic
tgttttaggaaactacctgtaaaaagccctattgattggaaagtatgtcaatgaattgtgggtcttttgggattt

SEQ ID NO: 106551 - DNA, 75 bp, Artificial Sequence
  Synthetic
tgttttaggaaactacctgtaaaaagccctattgattggaaagtatgtcaacgaattgtgggtcttttgggattt

SEQ ID NO: 106552 - DNA, 75 bp, Artificial Sequence
  Synthetic
tgttttaggaaactacctgtaaaaagccctattgattggaaagtatgtcaaggaattgtgggtcttttgggattt

SEQ ID NO: 106553 - DNA, 75 bp, Artificial Sequence
  Synthetic
tgttttaggaaactacctgtaaatagccctattgattggaaagtatgtcaaagaattgtgggtcttttgggattt

SEQ ID NO: 106554 - DNA, 75 bp, Artificial Sequence
  Synthetic
tgttttaggaaactacctgtaaatagccctattgattggaaagtatgtcaatgaattgtgggtcttttgggattt

SEQ ID NO: 106555 - DNA, 75 bp, Artificial Sequence
  Synthetic
tgttttaggaaactacctgtaaatagccctattgattggaaagtatgtcaacgaattgtgggtcttttgggattt

SEQ ID NO: 106556 - DNA, 75 bp, Artificial Sequence
  Synthetic
tgttttaggaaactacctgtaaatagccctattgattggaaagtatgtcaaggaattgtgggtcttttgggattt

SEQ ID NO: 106557 - DNA, 75 bp, Artificial Sequence
  Synthetic
tgttttaggaaactacctgtaaacagccctattgattggaaagtatgtcaaagaattgtgggtcttttgggattt

SEQ ID NO: 106558 - DNA, 75 bp, Artificial Sequence
  Synthetic
tgttttaggaaactacctgtaaacagccctattgattggaaagtatgtcaatgaattgtgggtcttttgggattt

SEQ ID NO: 106559 - DNA, 75 bp, Artificial Sequence
  Synthetic
tgttttaggaaactacctgtaaacagccctattgattggaaagtatgtcaacgaattgtgggtcttttgggattt

SEQ ID NO: 106560 - DNA, 75 bp, Artificial Sequence
  Synthetic
tgttttaggaaactacctgtaaacagccctattgattggaaagtatgtcaaggaattgtgggtcttttgggattt

SEQ ID NO: 106561 - DNA, 75 bp, Artificial Sequence
  Synthetic
tgttttaggaaactacctgtaaagagccctattgattggaaagtatgtcaaagaattgtgggtcttttgggattt

SEQ ID NO: 106562 - DNA, 75 bp, Artificial Sequence
  Synthetic
tgttttaggaaactacctgtaaagagccctattgattggaaagtatgtcaatgaattgtgggtcttttgggattt

SEQ ID NO: 106563 - DNA, 75 bp, Artificial Sequence
  Synthetic
tgttttaggaaactacctgtaaagagccctattgattggaaagtatgtcaacgaattgtgggtcttttgggattt

SEQ ID NO: 106564 - DNA, 75 bp, Artificial Sequence
  Synthetic
tgttttaggaaactacctgtaaagagccctattgattggaaagtatgtcaaggaattgtgggtcttttgggattt

SEQ ID NO: 106565 - DNA, 75 bp, Artificial Sequence
  Synthetic
taaaattaattatgcctgctaggttctatcctaaccttaccaaatatttgcccttagataaaggcatcaaacctt

SEQ ID NO: 106566 - DNA, 75 bp, Artificial Sequence
  Synthetic
ttccacaacattccaccaagctctgcaggatcccagagtaagaggcctgtattttcctgctggtggctccagttc

SEQ ID NO: 106567 - DNA, 75 bp, Artificial Sequence
  Synthetic
ttaccgcaagatcatattatccgaaaaatcaaacagtgttttagaaaacttcctgttaataggcctattgattgg

SEQ ID NO: 106568 - DNA, 75 bp, Artificial Sequence
  Synthetic
caatgaaaaaaggagattaaagctagttatgccagctagattttttccaaactctactaaatatttaccactgga

SEQ ID NO: 106569 - DNA, 75 bp, Artificial Sequence
  Synthetic
gaacatggggtacattgccacaggattcctaggacccctgctcatattataggcggggtttttcttgttgacaaa

SEQ ID NO: 106570 - DNA, 75 bp, Artificial Sequence
  Synthetic
tatctgaacctttaccccgttgcccggcaacgggccggtctctgccaagtgtttgctgacgcaacccccactggc

SEQ ID NO: 106571 - DNA, 75 bp, Artificial Sequence
  Synthetic
tattatccagaaaatgtagttaatcattacttccaaaccagacattatttacataccctttggaaggcaggtatt

SEQ ID NO: 106572 - DNA, 75 bp, Artificial Sequence
  Synthetic
aattccactgcatggcctgaggatgagtgtttctcaaaggtggagacagcggggtaggctgccttcctgactggc

SEQ ID NO: 106573 - DNA, 75 bp, Artificial Sequence
  Synthetic
gattggtggaggcaggaggcggatttgctggcaaagtttgtagtatgccctgagcctgagggctccaccccaaaa

SEQ ID NO: 106574 - DNA, 75 bp, Artificial Sequence
  Synthetic
gggccaagtctgtacaacatcttgagtccctttataccgctgttaccaattttcttttgtctttgggtatacatt

SEQ ID NO: 106575 - DNA, 75 bp, Artificial Sequence
  Synthetic
ggcctccgtgcggtggggtgaaacccagcccgaatgctccagctcctaccttgttggcgtctggccaggtgtcct

SEQ ID NO: 106576 - DNA, 75 bp, Artificial Sequence
  Synthetic
atcccagaggattgctggtggaaagattctgccccatgctgtagatcttgttcccaagaatatggtgacccacaa

SEQ ID NO: 106577 - DNA, 75 bp, Artificial Sequence
  Synthetic
ttaatcctgagtggcaaactccttcttttcctgatattcatttacgggaggacattatcaataggtgtcaacaat

SEQ ID NO: 106578 - DNA, 75 bp, Artificial Sequence
  Synthetic
aatgaggcgctatgtgttgtttctctcttatataatatacccgccttccatagagtgtgtaaatagtgtctagtt

SEQ ID NO: 106579 - DNA, 75 bp, Artificial Sequence
  Synthetic
tttggataaaacctggcaggcataatcaattgcaatcttcttttctcattaactgtgagtgggcctacaaactgt

SEQ ID NO: 106580 - DNA, 75 bp, Artificial Sequence
  Synthetic
tcacattttttgataatgtcttggtgtaaatgtatattaggaaaagatggtgttttccaatgaggattaaagaca

SEQ ID NO: 106581 - DNA, 75 bp, Artificial Sequence
  Synthetic
agaggactcttggactctctgcaatgtcaacgaccgaccttgaggcatacttcaaagactgtttgtttaaagact

SEQ ID NO: 106582 - DNA, 75 bp, Artificial Sequence
  Synthetic
agattgagatcttctgcgacgcggcgattgagaccttcgtctgcgaggcgagggagttcttcttctaggggacct

SEQ ID NO: 106583 - DNA, 75 bp, Artificial Sequence
  Synthetic
ggcaccttgccacaagatcatatcatacagaaaattaaacaatgttttagaaaactccctgttaataggcccatt

SEQ ID NO: 106584 - DNA, 75 bp, Artificial Sequence
  Synthetic
gcctcgtcgtctaacaacagtagtctccggaagtgttgataggataggggcatttggtggtctataagctggagg

SEQ ID NO: 106585 - DNA, 75 bp, Artificial Sequence
  Synthetic
aaaccacaagagttgcctgaactttaggcccatattagtgttgacataactgactactaggtctctagacgctgg

SEQ ID NO: 106586 - DNA, 75 bp, Artificial Sequence
  Synthetic
cagataatgtagttaatcattacttccaaaccagacactatttacataccctatgggaggcgggcatcttatata

SEQ ID NO: 106587 - DNA, 75 bp, Artificial Sequence
  Synthetic
gggacgttgcctcaggaacatattgtgcataaaatcaaagattgctttcgcaaacttcccgtaaatagacccatt

SEQ ID NO: 106588 - DNA, 75 bp, Artificial Sequence
  Synthetic
tcgtactgaaggaaagaagtcagaaggcaaaaacgagagtaactccacagtagctccaaattctttataagggtc

SEQ ID NO: 106589 - DNA, 75 bp, Artificial Sequence
  Synthetic
atcttccaaattaacacccacccaggtagctagagtcattagttccccccagcaaagaattgcttgcctgagtgc

SEQ ID NO: 106590 - DNA, 75 bp, Artificial Sequence
  Synthetic
gatgtccatgccccaaagccacccaaggcacagcttggaggcttgaacagtaggacatgaacaagagatgattag

SEQ ID NO: 106591 - DNA, 75 bp, Artificial Sequence
  Synthetic
aacctaatctcctcccccaactcctcccagtctttaaacaaacagtctttgaagtatgcctcaaggtcggtcgtt

SEQ ID NO: 106592 - DNA, 75 bp, Artificial Sequence
  Synthetic
gacattgctgagagtccaagagtcctcttatgtaagaccttgggcaatatttggtgggcgttcacggtggtctcc

SEQ ID NO: 106593 - DNA, 75 bp, Artificial Sequence
  Synthetic
actctagctacctgggtgggaagtaatttgcaagacgctgcctccagggatttagtagtcaactatgtcaatctt

SEQ ID NO: 106594 - DNA, 75 bp, Artificial Sequence
  Synthetic
gcgcatgcgtggaacctttgtggctcctctgccgatccatactgcggaactcctagccgcttgttttgctcgcag

SEQ ID NO: 106595 - DNA, 75 bp, Artificial Sequence
  Synthetic
ggaagcttaccacaagatcatattgtacaaaaaatcaaacactgttttagaaaacttcccgttaataggcctatt

SEQ ID NO: 106596 - DNA, 75 bp, Artificial Sequence
  Synthetic
gagaggtgcgccccgtggtcggtcggaacggcagacggagaaggggacgagagagtcccaagcgaccccgagaag

SEQ ID NO: 106597 - DNA, 75 bp, Artificial Sequence
  Synthetic
acctgctgcgagcaaaacaagcggctaggagttccgcagtatggatcggcagaggagccgaaaaggttccacgca

SEQ ID NO: 106598 - DNA, 75 bp, Artificial Sequence
  Synthetic
ggtcgtccgcaggattcagcgccgacgggacgtaaacaaaggacgtcccgcgcaggatccagttggcagcacagc

SEQ ID NO: 106599 - DNA, 75 bp, Artificial Sequence
  Synthetic
tgcgctgatggcccatgaccaagccccagccagtgggggttgcgtcagcaaacacttggcacagacctggccgtt

SEQ ID NO: 106600 - DNA, 75 bp, Artificial Sequence
  Synthetic
cccgatcatcagttggaccctgcgttcggagccaactcaaacaatccagattgggacttcaaccccaacaaggac

SEQ ID NO: 106601 - DNA, 75 bp, Artificial Sequence
  Synthetic
atgtcaacgaccgaccttgaggcctacttcaaagactgtgtgtttaaggactgggaggagctgggggaggagatt

SEQ ID NO: 106602 - DNA, 75 bp, Artificial Sequence
  Synthetic
gcttagattgaatacatgcatacaaaggcatcaacgcaggataaccacattgtgtaaaaggggcagcaaaaccca

SEQ ID NO: 106603 - DNA, 75 bp, Artificial Sequence
  Synthetic
tcttgaatatttggtgtcttttggagtgtggattcgcactcctcctgcatatagaccacaaaatgcccctatctt

SEQ ID NO: 106604 - DNA, 75 bp, Artificial Sequence
  Synthetic
cccatctctttgttttgttagggtttaaatgtatacccaaagacaaaagaaaattggtaacagcggtaaaaaggg

SEQ ID NO: 106605 - DNA, 75 bp, Artificial Sequence
  Synthetic
actggatggggcttggccataggccatcagggcatgcgtggaacctttgtggctcctctggcgatccatactgcg

SEQ ID NO: 106606 - DNA, 75 bp, Artificial Sequence
  Synthetic
tgggtggctttagggcatggacattgacccgtataaagaatttggagcttctgtggagttactctcttttttgcc

SEQ ID NO: 106607 - DNA, 75 bp, Artificial Sequence
  Synthetic
ttttccgaaagcccaggatgatgggatgggaatacaggtgcaatttccgtccgaaggtttggtacagcaacagga

SEQ ID NO: 106608 - DNA, 75 bp, Artificial Sequence
  Synthetic
ccgtcagagatatcctagacaccgcctcagctctgtatagagaacccttagagtatcatgagcattgctcacccc

SEQ ID NO: 106609 - DNA, 75 bp, Artificial Sequence
  Synthetic
ccgtcagagatatcctagacaccgcctcagctctgtatagagaacccttagagtatcttgagcattgctcacccc

SEQ ID NO: 106610 - DNA, 75 bp, Artificial Sequence
  Synthetic
ccgtcagagatatcctagacaccgcctcagctctgtatagagaacccttagagtatcctgagcattgctcacccc

SEQ ID NO: 106611 - DNA, 75 bp, Artificial Sequence
  Synthetic
ccgtcagagatatcctagacaccgcctcagctctgtatagagaacccttagagtatcgtgagcattgctcacccc

SEQ ID NO: 106612 - DNA, 75 bp, Artificial Sequence
  Synthetic
ccgtcagagatatcctagacaccgcctcagctctgtatagagaacccttagagtttcatgagcattgctcacccc

SEQ ID NO: 106613 - DNA, 75 bp, Artificial Sequence
  Synthetic
ccgtcagagatatcctagacaccgcctcagctctgtatagagaacccttagagtttcttgagcattgctcacccc

SEQ ID NO: 106614 - DNA, 75 bp, Artificial Sequence
  Synthetic
ccgtcagagatatcctagacaccgcctcagctctgtatagagaacccttagagtttcctgagcattgctcacccc

SEQ ID NO: 106615 - DNA, 75 bp, Artificial Sequence
  Synthetic
ccgtcagagatatcctagacaccgcctcagctctgtatagagaacccttagagtttcgtgagcattgctcacccc

SEQ ID NO: 106616 - DNA, 75 bp, Artificial Sequence
  Synthetic
ccgtcagagatatcctagacaccgcctcagctctgtatagagaacccttagagtctcatgagcattgctcacccc

SEQ ID NO: 106617 - DNA, 75 bp, Artificial Sequence
  Synthetic
ccgtcagagatatcctagacaccgcctcagctctgtatagagaacccttagagtctcttgagcattgctcacccc

SEQ ID NO: 106618 - DNA, 75 bp, Artificial Sequence
  Synthetic
ccgtcagagatatcctagacaccgcctcagctctgtatagagaacccttagagtctcctgagcattgctcacccc

SEQ ID NO: 106619 - DNA, 75 bp, Artificial Sequence
  Synthetic
ccgtcagagatatcctagacaccgcctcagctctgtatagagaacccttagagtctcgtgagcattgctcacccc

SEQ ID NO: 106620 - DNA, 75 bp, Artificial Sequence
  Synthetic
ccgtcagagatatcctagacaccgcctcagctctgtatagagaacccttagagtgtcatgagcattgctcacccc

SEQ ID NO: 106621 - DNA, 75 bp, Artificial Sequence
  Synthetic
ccgtcagagatatcctagacaccgcctcagctctgtatagagaacccttagagtgtcttgagcattgctcacccc

SEQ ID NO: 106622 - DNA, 75 bp, Artificial Sequence
  Synthetic
ccgtcagagatatcctagacaccgcctcagctctgtatagagaacccttagagtgtcctgagcattgctcacccc

SEQ ID NO: 106623 - DNA, 75 bp, Artificial Sequence
  Synthetic
ccgtcagagatatcctagacaccgcctcagctctgtatagagaacccttagagtgtcgtgagcattgctcacccc

SEQ ID NO: 106624 - DNA, 75 bp, Artificial Sequence
  Synthetic
ccgtcagagatttcctagacaccgcctcagctctgtatagagaacccttagagtatcatgagcattgctcacccc

SEQ ID NO: 106625 - DNA, 75 bp, Artificial Sequence
  Synthetic
ccgtcagagatttcctagacaccgcctcagctctgtatagagaacccttagagtatcttgagcattgctcacccc

SEQ ID NO: 106626 - DNA, 75 bp, Artificial Sequence
  Synthetic
ccgtcagagatttcctagacaccgcctcagctctgtatagagaacccttagagtatcctgagcattgctcacccc

SEQ ID NO: 106627 - DNA, 75 bp, Artificial Sequence
  Synthetic
ccgtcagagatttcctagacaccgcctcagctctgtatagagaacccttagagtatcgtgagcattgctcacccc

SEQ ID NO: 106628 - DNA, 75 bp, Artificial Sequence
  Synthetic
ccgtcagagatttcctagacaccgcctcagctctgtatagagaacccttagagtttcatgagcattgctcacccc

SEQ ID NO: 106629 - DNA, 75 bp, Artificial Sequence
  Synthetic
ccgtcagagatttcctagacaccgcctcagctctgtatagagaacccttagagtttcttgagcattgctcacccc

SEQ ID NO: 106630 - DNA, 75 bp, Artificial Sequence
  Synthetic
ccgtcagagatttcctagacaccgcctcagctctgtatagagaacccttagagtttcctgagcattgctcacccc

SEQ ID NO: 106631 - DNA, 75 bp, Artificial Sequence
  Synthetic
ccgtcagagatttcctagacaccgcctcagctctgtatagagaacccttagagtttcgtgagcattgctcacccc

SEQ ID NO: 106632 - DNA, 75 bp, Artificial Sequence
  Synthetic
ccgtcagagatttcctagacaccgcctcagctctgtatagagaacccttagagtctcatgagcattgctcacccc

SEQ ID NO: 106633 - DNA, 75 bp, Artificial Sequence
  Synthetic
ccgtcagagatttcctagacaccgcctcagctctgtatagagaacccttagagtctcttgagcattgctcacccc

SEQ ID NO: 106634 - DNA, 75 bp, Artificial Sequence
  Synthetic
ccgtcagagatttcctagacaccgcctcagctctgtatagagaacccttagagtctcctgagcattgctcacccc

SEQ ID NO: 106635 - DNA, 75 bp, Artificial Sequence
  Synthetic
ccgtcagagatttcctagacaccgcctcagctctgtatagagaacccttagagtctcgtgagcattgctcacccc

SEQ ID NO: 106636 - DNA, 75 bp, Artificial Sequence
  Synthetic
ccgtcagagatttcctagacaccgcctcagctctgtatagagaacccttagagtgtcatgagcattgctcacccc

SEQ ID NO: 106637 - DNA, 75 bp, Artificial Sequence
  Synthetic
ccgtcagagatttcctagacaccgcctcagctctgtatagagaacccttagagtgtcttgagcattgctcacccc

SEQ ID NO: 106638 - DNA, 75 bp, Artificial Sequence
  Synthetic
ccgtcagagatttcctagacaccgcctcagctctgtatagagaacccttagagtgtcctgagcattgctcacccc

SEQ ID NO: 106639 - DNA, 75 bp, Artificial Sequence
  Synthetic
ccgtcagagatttcctagacaccgcctcagctctgtatagagaacccttagagtgtcgtgagcattgctcacccc

SEQ ID NO: 106640 - DNA, 75 bp, Artificial Sequence
  Synthetic
ccgtcagagatctcctagacaccgcctcagctctgtatagagaacccttagagtatcatgagcattgctcacccc

SEQ ID NO: 106641 - DNA, 75 bp, Artificial Sequence
  Synthetic
ccgtcagagatctcctagacaccgcctcagctctgtatagagaacccttagagtatcttgagcattgctcacccc

SEQ ID NO: 106642 - DNA, 75 bp, Artificial Sequence
  Synthetic
ccgtcagagatctcctagacaccgcctcagctctgtatagagaacccttagagtatcctgagcattgctcacccc

SEQ ID NO: 106643 - DNA, 75 bp, Artificial Sequence
  Synthetic
ccgtcagagatctcctagacaccgcctcagctctgtatagagaacccttagagtatcgtgagcattgctcacccc

SEQ ID NO: 106644 - DNA, 75 bp, Artificial Sequence
  Synthetic
ccgtcagagatctcctagacaccgcctcagctctgtatagagaacccttagagtttcatgagcattgctcacccc

SEQ ID NO: 106645 - DNA, 75 bp, Artificial Sequence
  Synthetic
ccgtcagagatctcctagacaccgcctcagctctgtatagagaacccttagagtttcttgagcattgctcacccc

SEQ ID NO: 106646 - DNA, 75 bp, Artificial Sequence
  Synthetic
ccgtcagagatctcctagacaccgcctcagctctgtatagagaacccttagagtttcctgagcattgctcacccc

SEQ ID NO: 106647 - DNA, 75 bp, Artificial Sequence
  Synthetic
ccgtcagagatctcctagacaccgcctcagctctgtatagagaacccttagagtttcgtgagcattgctcacccc

SEQ ID NO: 106648 - DNA, 75 bp, Artificial Sequence
  Synthetic
ccgtcagagatctcctagacaccgcctcagctctgtatagagaacccttagagtctcatgagcattgctcacccc

SEQ ID NO: 106649 - DNA, 75 bp, Artificial Sequence
  Synthetic
ccgtcagagatctcctagacaccgcctcagctctgtatagagaacccttagagtctcttgagcattgctcacccc

SEQ ID NO: 106650 - DNA, 75 bp, Artificial Sequence
  Synthetic
ccgtcagagatctcctagacaccgcctcagctctgtatagagaacccttagagtctcctgagcattgctcacccc

SEQ ID NO: 106651 - DNA, 75 bp, Artificial Sequence
  Synthetic
ccgtcagagatctcctagacaccgcctcagctctgtatagagaacccttagagtctcgtgagcattgctcacccc

SEQ ID NO: 106652 - DNA, 75 bp, Artificial Sequence
  Synthetic
ccgtcagagatctcctagacaccgcctcagctctgtatagagaacccttagagtgtcatgagcattgctcacccc

SEQ ID NO: 106653 - DNA, 75 bp, Artificial Sequence
  Synthetic
ccgtcagagatctcctagacaccgcctcagctctgtatagagaacccttagagtgtcttgagcattgctcacccc

SEQ ID NO: 106654 - DNA, 75 bp, Artificial Sequence
  Synthetic
ccgtcagagatctcctagacaccgcctcagctctgtatagagaacccttagagtgtcctgagcattgctcacccc

SEQ ID NO: 106655 - DNA, 75 bp, Artificial Sequence
  Synthetic
ccgtcagagatctcctagacaccgcctcagctctgtatagagaacccttagagtgtcgtgagcattgctcacccc

SEQ ID NO: 106656 - DNA, 75 bp, Artificial Sequence
  Synthetic
ccgtcagagatgtcctagacaccgcctcagctctgtatagagaacccttagagtatcatgagcattgctcacccc

SEQ ID NO: 106657 - DNA, 75 bp, Artificial Sequence
  Synthetic
ccgtcagagatgtcctagacaccgcctcagctctgtatagagaacccttagagtatcttgagcattgctcacccc

SEQ ID NO: 106658 - DNA, 75 bp, Artificial Sequence
  Synthetic
ccgtcagagatgtcctagacaccgcctcagctctgtatagagaacccttagagtatcctgagcattgctcacccc

SEQ ID NO: 106659 - DNA, 75 bp, Artificial Sequence
  Synthetic
ccgtcagagatgtcctagacaccgcctcagctctgtatagagaacccttagagtatcgtgagcattgctcacccc

SEQ ID NO: 106660 - DNA, 75 bp, Artificial Sequence
  Synthetic
ccgtcagagatgtcctagacaccgcctcagctctgtatagagaacccttagagtttcatgagcattgctcacccc

SEQ ID NO: 106661 - DNA, 75 bp, Artificial Sequence
  Synthetic
ccgtcagagatgtcctagacaccgcctcagctctgtatagagaacccttagagtttcttgagcattgctcacccc

SEQ ID NO: 106662 - DNA, 75 bp, Artificial Sequence
  Synthetic
ccgtcagagatgtcctagacaccgcctcagctctgtatagagaacccttagagtttcctgagcattgctcacccc

SEQ ID NO: 106663 - DNA, 75 bp, Artificial Sequence
  Synthetic
ccgtcagagatgtcctagacaccgcctcagctctgtatagagaacccttagagtttcgtgagcattgctcacccc

SEQ ID NO: 106664 - DNA, 75 bp, Artificial Sequence
  Synthetic
ccgtcagagatgtcctagacaccgcctcagctctgtatagagaacccttagagtctcatgagcattgctcacccc

SEQ ID NO: 106665 - DNA, 75 bp, Artificial Sequence
  Synthetic
ccgtcagagatgtcctagacaccgcctcagctctgtatagagaacccttagagtctcttgagcattgctcacccc

SEQ ID NO: 106666 - DNA, 75 bp, Artificial Sequence
  Synthetic
ccgtcagagatgtcctagacaccgcctcagctctgtatagagaacccttagagtctcctgagcattgctcacccc

SEQ ID NO: 106667 - DNA, 75 bp, Artificial Sequence
  Synthetic
ccgtcagagatgtcctagacaccgcctcagctctgtatagagaacccttagagtctcgtgagcattgctcacccc

SEQ ID NO: 106668 - DNA, 75 bp, Artificial Sequence
  Synthetic
ccgtcagagatgtcctagacaccgcctcagctctgtatagagaacccttagagtgtcatgagcattgctcacccc

SEQ ID NO: 106669 - DNA, 75 bp, Artificial Sequence
  Synthetic
ccgtcagagatgtcctagacaccgcctcagctctgtatagagaacccttagagtgtcttgagcattgctcacccc

SEQ ID NO: 106670 - DNA, 75 bp, Artificial Sequence
  Synthetic
ccgtcagagatgtcctagacaccgcctcagctctgtatagagaacccttagagtgtcctgagcattgctcacccc

SEQ ID NO: 106671 - DNA, 75 bp, Artificial Sequence
  Synthetic
ccgtcagagatgtcctagacaccgcctcagctctgtatagagaacccttagagtgtcgtgagcattgctcacccc

SEQ ID NO: 106672 - DNA, 75 bp, Artificial Sequence
  Synthetic
gaagaggaagatgataaaacgccgcagacacatccagcgataaccaggacaagttggaggacaagaggttggtga

SEQ ID NO: 106673 - DNA, 75 bp, Artificial Sequence
  Synthetic
aaagacccacaattcgttgacatactttccaatcaataggcctgttaataggaagttttctaaaacattctttga

SEQ ID NO: 106674 - DNA, 75 bp, Artificial Sequence
  Synthetic
actcaagatgctgtacagacttggcccccaataccacatcatccatataactgaaagccaaacagtgggggaaag

SEQ ID NO: 106675 - DNA, 75 bp, Artificial Sequence
  Synthetic
gagtggcaaactccctcctttcctcacattcatttacaggaggacattattaatagatgtcaacaatttgtgggc

SEQ ID NO: 106676 - DNA, 75 bp, Artificial Sequence
  Synthetic
tcctaggaatcctgatgtgatgttctccatgttcagcgcagggtccccaatcctcgagaagattgacgataaggg

SEQ ID NO: 106677 - DNA, 75 bp, Artificial Sequence
  Synthetic
gtattgggggccaagtctgtacaacatcttgaatccctttataccgctgttaccaattttcttttgtctctgggt

SEQ ID NO: 106678 - DNA, 75 bp, Artificial Sequence
  Synthetic
aggagtgggagcattcgggccagggctcacccctccacacggcggtattttggggtggagccctcaggctcaggg

SEQ ID NO: 106679 - DNA, 75 bp, Artificial Sequence
  Synthetic
cggaacagtaaaccctgttccgaatactgtctctcacatctcatcaatcttcacgacgactggggaccctgcaac

SEQ ID NO: 106680 - DNA, 75 bp, Artificial Sequence
  Synthetic
catggggacaaatctttctgtccccaatcccctgggattcttccccgatcatcagttggaccctgcattcaaagc

SEQ ID NO: 106681 - DNA, 75 bp, Artificial Sequence
  Synthetic
gtgattggaggttggggactgcgaattttggccaagacacacggtagttccccctagaaaattgagagaagtcca

SEQ ID NO: 106682 - DNA, 75 bp, Artificial Sequence
  Synthetic
gaggctgtaggcataaattggtctgagcaccagcaccacgcaactttttcacctatacctaatcatctcttgttc

SEQ ID NO: 106683 - DNA, 75 bp, Artificial Sequence
  Synthetic
gaggctgtaggcataaattggtctgagcaccagcaccacgcaactttttcacctattcctaatcatctcttgttc

SEQ ID NO: 106684 - DNA, 75 bp, Artificial Sequence
  Synthetic
gaggctgtaggcataaattggtctgagcaccagcaccacgcaactttttcacctatccctaatcatctcttgttc

SEQ ID NO: 106685 - DNA, 75 bp, Artificial Sequence
  Synthetic
gaggctgtaggcataaattggtctgagcaccagcaccacgcaactttttcacctatgcctaatcatctcttgttc

SEQ ID NO: 106686 - DNA, 75 bp, Artificial Sequence
  Synthetic
gaggctgtaggcataaattggtctgagcaccagcaccacgcaactttttcacctttacctaatcatctcttgttc

SEQ ID NO: 106687 - DNA, 75 bp, Artificial Sequence
  Synthetic
gaggctgtaggcataaattggtctgagcaccagcaccacgcaactttttcaccttttcctaatcatctcttgttc

SEQ ID NO: 106688 - DNA, 75 bp, Artificial Sequence
  Synthetic
gaggctgtaggcataaattggtctgagcaccagcaccacgcaactttttcacctttccctaatcatctcttgttc

SEQ ID NO: 106689 - DNA, 75 bp, Artificial Sequence
  Synthetic
gaggctgtaggcataaattggtctgagcaccagcaccacgcaactttttcacctttgcctaatcatctcttgttc

SEQ ID NO: 106690 - DNA, 75 bp, Artificial Sequence
  Synthetic
gaggctgtaggcataaattggtctgagcaccagcaccacgcaactttttcacctctacctaatcatctcttgttc

SEQ ID NO: 106691 - DNA, 75 bp, Artificial Sequence
  Synthetic
gaggctgtaggcataaattggtctgagcaccagcaccacgcaactttttcacctcttcctaatcatctcttgttc

SEQ ID NO: 106692 - DNA, 75 bp, Artificial Sequence
  Synthetic
gaggctgtaggcataaattggtctgagcaccagcaccacgcaactttttcacctctccctaatcatctcttgttc

SEQ ID NO: 106693 - DNA, 75 bp, Artificial Sequence
  Synthetic
gaggctgtaggcataaattggtctgagcaccagcaccacgcaactttttcacctctgcctaatcatctcttgttc

SEQ ID NO: 106694 - DNA, 75 bp, Artificial Sequence
  Synthetic
gaggctgtaggcataaattggtctgagcaccagcaccacgcaactttttcacctgtacctaatcatctcttgttc

SEQ ID NO: 106695 - DNA, 75 bp, Artificial Sequence
  Synthetic
gaggctgtaggcataaattggtctgagcaccagcaccacgcaactttttcacctgttcctaatcatctcttgttc

SEQ ID NO: 106696 - DNA, 75 bp, Artificial Sequence
  Synthetic
gaggctgtaggcataaattggtctgagcaccagcaccacgcaactttttcacctgtccctaatcatctcttgttc

SEQ ID NO: 106697 - DNA, 75 bp, Artificial Sequence
  Synthetic
gaggctgtaggcataaattggtctgagcaccagcaccacgcaactttttcacctgtgcctaatcatctcttgttc

SEQ ID NO: 106698 - DNA, 75 bp, Artificial Sequence
  Synthetic
gaggctgtaggcataaattggtctgtgcaccagcaccacgcaactttttcacctatacctaatcatctcttgttc

SEQ ID NO: 106699 - DNA, 75 bp, Artificial Sequence
  Synthetic
gaggctgtaggcataaattggtctgtgcaccagcaccacgcaactttttcacctattcctaatcatctcttgttc

SEQ ID NO: 106700 - DNA, 75 bp, Artificial Sequence
  Synthetic
gaggctgtaggcataaattggtctgtgcaccagcaccacgcaactttttcacctatccctaatcatctcttgttc

SEQ ID NO: 106701 - DNA, 75 bp, Artificial Sequence
  Synthetic
gaggctgtaggcataaattggtctgtgcaccagcaccacgcaactttttcacctatgcctaatcatctcttgttc

SEQ ID NO: 106702 - DNA, 75 bp, Artificial Sequence
  Synthetic
gaggctgtaggcataaattggtctgtgcaccagcaccacgcaactttttcacctttacctaatcatctcttgttc

SEQ ID NO: 106703 - DNA, 75 bp, Artificial Sequence
  Synthetic
gaggctgtaggcataaattggtctgtgcaccagcaccacgcaactttttcaccttttcctaatcatctcttgttc

SEQ ID NO: 106704 - DNA, 75 bp, Artificial Sequence
  Synthetic
gaggctgtaggcataaattggtctgtgcaccagcaccacgcaactttttcacctttccctaatcatctcttgttc

SEQ ID NO: 106705 - DNA, 75 bp, Artificial Sequence
  Synthetic
gaggctgtaggcataaattggtctgtgcaccagcaccacgcaactttttcacctttgcctaatcatctcttgttc

SEQ ID NO: 106706 - DNA, 75 bp, Artificial Sequence
  Synthetic
gaggctgtaggcataaattggtctgtgcaccagcaccacgcaactttttcacctctacctaatcatctcttgttc

SEQ ID NO: 106707 - DNA, 75 bp, Artificial Sequence
  Synthetic
gaggctgtaggcataaattggtctgtgcaccagcaccacgcaactttttcacctcttcctaatcatctcttgttc

SEQ ID NO: 106708 - DNA, 75 bp, Artificial Sequence
  Synthetic
gaggctgtaggcataaattggtctgtgcaccagcaccacgcaactttttcacctctccctaatcatctcttgttc

SEQ ID NO: 106709 - DNA, 75 bp, Artificial Sequence
  Synthetic
gaggctgtaggcataaattggtctgtgcaccagcaccacgcaactttttcacctctgcctaatcatctcttgttc

SEQ ID NO: 106710 - DNA, 75 bp, Artificial Sequence
  Synthetic
gaggctgtaggcataaattggtctgtgcaccagcaccacgcaactttttcacctgtacctaatcatctcttgttc

SEQ ID NO: 106711 - DNA, 75 bp, Artificial Sequence
  Synthetic
gaggctgtaggcataaattggtctgtgcaccagcaccacgcaactttttcacctgttcctaatcatctcttgttc

SEQ ID NO: 106712 - DNA, 75 bp, Artificial Sequence
  Synthetic
gaggctgtaggcataaattggtctgtgcaccagcaccacgcaactttttcacctgtccctaatcatctcttgttc

SEQ ID NO: 106713 - DNA, 75 bp, Artificial Sequence
  Synthetic
gaggctgtaggcataaattggtctgtgcaccagcaccacgcaactttttcacctgtgcctaatcatctcttgttc

SEQ ID NO: 106714 - DNA, 75 bp, Artificial Sequence
  Synthetic
gaggctgtaggcataaattggtctgcgcaccagcaccacgcaactttttcacctatacctaatcatctcttgttc

SEQ ID NO: 106715 - DNA, 75 bp, Artificial Sequence
  Synthetic
gaggctgtaggcataaattggtctgcgcaccagcaccacgcaactttttcacctattcctaatcatctcttgttc

SEQ ID NO: 106716 - DNA, 75 bp, Artificial Sequence
  Synthetic
gaggctgtaggcataaattggtctgcgcaccagcaccacgcaactttttcacctatccctaatcatctcttgttc

SEQ ID NO: 106717 - DNA, 75 bp, Artificial Sequence
  Synthetic
gaggctgtaggcataaattggtctgcgcaccagcaccacgcaactttttcacctatgcctaatcatctcttgttc

SEQ ID NO: 106718 - DNA, 75 bp, Artificial Sequence
  Synthetic
gaggctgtaggcataaattggtctgcgcaccagcaccacgcaactttttcacctttacctaatcatctcttgttc

SEQ ID NO: 106719 - DNA, 75 bp, Artificial Sequence
  Synthetic
gaggctgtaggcataaattggtctgcgcaccagcaccacgcaactttttcaccttttcctaatcatctcttgttc

SEQ ID NO: 106720 - DNA, 75 bp, Artificial Sequence
  Synthetic
gaggctgtaggcataaattggtctgcgcaccagcaccacgcaactttttcacctttccctaatcatctcttgttc

SEQ ID NO: 106721 - DNA, 75 bp, Artificial Sequence
  Synthetic
gaggctgtaggcataaattggtctgcgcaccagcaccacgcaactttttcacctttgcctaatcatctcttgttc

SEQ ID NO: 106722 - DNA, 75 bp, Artificial Sequence
  Synthetic
gaggctgtaggcataaattggtctgcgcaccagcaccacgcaactttttcacctctacctaatcatctcttgttc

SEQ ID NO: 106723 - DNA, 75 bp, Artificial Sequence
  Synthetic
gaggctgtaggcataaattggtctgcgcaccagcaccacgcaactttttcacctcttcctaatcatctcttgttc

SEQ ID NO: 106724 - DNA, 75 bp, Artificial Sequence
  Synthetic
gaggctgtaggcataaattggtctgcgcaccagcaccacgcaactttttcacctctccctaatcatctcttgttc

SEQ ID NO: 106725 - DNA, 75 bp, Artificial Sequence
  Synthetic
gaggctgtaggcataaattggtctgcgcaccagcaccacgcaactttttcacctctgcctaatcatctcttgttc

SEQ ID NO: 106726 - DNA, 75 bp, Artificial Sequence
  Synthetic
gaggctgtaggcataaattggtctgcgcaccagcaccacgcaactttttcacctgtacctaatcatctcttgttc

SEQ ID NO: 106727 - DNA, 75 bp, Artificial Sequence
  Synthetic
gaggctgtaggcataaattggtctgcgcaccagcaccacgcaactttttcacctgttcctaatcatctcttgttc

SEQ ID NO: 106728 - DNA, 75 bp, Artificial Sequence
  Synthetic
gaggctgtaggcataaattggtctgcgcaccagcaccacgcaactttttcacctgtccctaatcatctcttgttc

SEQ ID NO: 106729 - DNA, 75 bp, Artificial Sequence
  Synthetic
gaggctgtaggcataaattggtctgcgcaccagcaccacgcaactttttcacctgtgcctaatcatctcttgttc

SEQ ID NO: 106730 - DNA, 75 bp, Artificial Sequence
  Synthetic
gaggctgtaggcataaattggtctgggcaccagcaccacgcaactttttcacctatacctaatcatctcttgttc

SEQ ID NO: 106731 - DNA, 75 bp, Artificial Sequence
  Synthetic
gaggctgtaggcataaattggtctgggcaccagcaccacgcaactttttcacctattcctaatcatctcttgttc

SEQ ID NO: 106732 - DNA, 75 bp, Artificial Sequence
  Synthetic
gaggctgtaggcataaattggtctgggcaccagcaccacgcaactttttcacctatccctaatcatctcttgttc

SEQ ID NO: 106733 - DNA, 75 bp, Artificial Sequence
  Synthetic
gaggctgtaggcataaattggtctgggcaccagcaccacgcaactttttcacctatgcctaatcatctcttgttc

SEQ ID NO: 106734 - DNA, 75 bp, Artificial Sequence
  Synthetic
gaggctgtaggcataaattggtctgggcaccagcaccacgcaactttttcacctttacctaatcatctcttgttc

SEQ ID NO: 106735 - DNA, 75 bp, Artificial Sequence
  Synthetic
gaggctgtaggcataaattggtctgggcaccagcaccacgcaactttttcaccttttcctaatcatctcttgttc

SEQ ID NO: 106736 - DNA, 75 bp, Artificial Sequence
  Synthetic
gaggctgtaggcataaattggtctgggcaccagcaccacgcaactttttcacctttccctaatcatctcttgttc

SEQ ID NO: 106737 - DNA, 75 bp, Artificial Sequence
  Synthetic
gaggctgtaggcataaattggtctgggcaccagcaccacgcaactttttcacctttgcctaatcatctcttgttc

SEQ ID NO: 106738 - DNA, 75 bp, Artificial Sequence
  Synthetic
gaggctgtaggcataaattggtctgggcaccagcaccacgcaactttttcacctctacctaatcatctcttgttc

SEQ ID NO: 106739 - DNA, 75 bp, Artificial Sequence
  Synthetic
gaggctgtaggcataaattggtctgggcaccagcaccacgcaactttttcacctcttcctaatcatctcttgttc

SEQ ID NO: 106740 - DNA, 75 bp, Artificial Sequence
  Synthetic
gaggctgtaggcataaattggtctgggcaccagcaccacgcaactttttcacctctccctaatcatctcttgttc

SEQ ID NO: 106741 - DNA, 75 bp, Artificial Sequence
  Synthetic
gaggctgtaggcataaattggtctgggcaccagcaccacgcaactttttcacctctgcctaatcatctcttgttc

SEQ ID NO: 106742 - DNA, 75 bp, Artificial Sequence
  Synthetic
gaggctgtaggcataaattggtctgggcaccagcaccacgcaactttttcacctgtacctaatcatctcttgttc

SEQ ID NO: 106743 - DNA, 75 bp, Artificial Sequence
  Synthetic
gaggctgtaggcataaattggtctgggcaccagcaccacgcaactttttcacctgttcctaatcatctcttgttc

SEQ ID NO: 106744 - DNA, 75 bp, Artificial Sequence
  Synthetic
gaggctgtaggcataaattggtctgggcaccagcaccacgcaactttttcacctgtccctaatcatctcttgttc

SEQ ID NO: 106745 - DNA, 75 bp, Artificial Sequence
  Synthetic
gaggctgtaggcataaattggtctgggcaccagcaccacgcaactttttcacctgtgcctaatcatctcttgttc

SEQ ID NO: 106746 - DNA, 75 bp, Artificial Sequence
  Synthetic
agaggcagtagtcagaacagggtttactgttcctgaactggagccaccagcagggaaatacaggcctctcactct

SEQ ID NO: 106747 - DNA, 75 bp, Artificial Sequence
  Synthetic
atacatttaagccctaacaaaacaaaacggtggggttattctcttcacttcatggggtatgtgattggaagttgg

SEQ ID NO: 106748 - DNA, 75 bp, Artificial Sequence
  Synthetic
tttcgcaaaattcctatgggagtgggcctcagtccgtttctcctggctcagtttactagtgccatttgttcagtg

SEQ ID NO: 106749 - DNA, 75 bp, Artificial Sequence
  Synthetic
gagtatttggtgtcttttggagtgtggattcgcactcctccagcttacagaccacaaaatgcccctatcttatca

SEQ ID NO: 106750 - DNA, 75 bp, Artificial Sequence
  Synthetic
ggggcatggacattggcccctataaaaaatttggagcctctgtggaagtactctcttttttggcgtctgaactct

SEQ ID NO: 106751 - DNA, 75 bp, Artificial Sequence
  Synthetic
ggaagcttaccacaagatcatattgtgcaaaaaatcaaacactgttttagaaaactccctgttaataggcctatt

SEQ ID NO: 106752 - DNA, 75 bp, Artificial Sequence
  Synthetic
agccattctctgctgggtggaattaatgactctagctacctgggtgggtaataatttggaagatccagcatccag

SEQ ID NO: 106753 - DNA, 75 bp, Artificial Sequence
  Synthetic
tttacacaatgtggttatcctgccttaatgcctttatatgcatgtatacaagctaaacaggctttcactttctcg

SEQ ID NO: 106754 - DNA, 75 bp, Artificial Sequence
  Synthetic
ttcctgctggtggctccagttcaggaacagtaaaccctgctccgaatattgcctctcacatctcgtcaatctccg

SEQ ID NO: 106755 - DNA, 75 bp, Artificial Sequence
  Synthetic
agagtctccggaacattgttcacctcaccatacagcactcaggcaagcagttttgtgttggggtgagttaatgac

SEQ ID NO: 106756 - DNA, 75 bp, Artificial Sequence
  Synthetic
ttcatttgcaccaggatattatagataagtgtgaacaatttgtgggcccccttacagtgaatgaaaaacgaagat

SEQ ID NO: 106757 - DNA, 75 bp, Artificial Sequence
  Synthetic
gggactgataattctgtcgtcctttctcggaaatatacatcctttccatggctgctaggttgtactgccaactgg

SEQ ID NO: 106758 - DNA, 75 bp, Artificial Sequence
  Synthetic
acgtcccgtcggcgctgaatcccgcggacgacccttcccggggccgcttggggctctaccgcccgcttctccgcc

SEQ ID NO: 106759 - DNA, 75 bp, Artificial Sequence
  Synthetic
ttccactgccctcagccaaattcctgctggtggctccagttcagaaacagtaaaccctgctccgattattgcatc

SEQ ID NO: 106760 - DNA, 75 bp, Artificial Sequence
  Synthetic
tttcttctactccagatttcctccacaccccccctgctttgtatcaggaggcctttgaatctccggaacattgtt

SEQ ID NO: 106761 - DNA, 75 bp, Artificial Sequence
  Synthetic
ttctgtggagttactctcttttttgccttctgatttctttccgtctattcgagacctcctcgacaccgcctcagc

SEQ ID NO: 106762 - DNA, 75 bp, Artificial Sequence
  Synthetic
tcggcagtcaggaaggcaacctactcccatctctccacctttgagagacactcatcctcaggccatgcagtggaa

SEQ ID NO: 106763 - DNA, 75 bp, Artificial Sequence
  Synthetic
ccagaccatcagctggatcctctattcagggcaaattccagcagtcccgactgggacttcaacaaaaacaaggac

SEQ ID NO: 106764 - DNA, 75 bp, Artificial Sequence
  Synthetic
ctcaccatacagcactcaggcaagccattctctgctggggggaattaatgactctagctacctgggtgggtaata

SEQ ID NO: 106765 - DNA, 75 bp, Artificial Sequence
  Synthetic
gtctcagaaatatacaacctttccatgggtgctaggttgtactgccaacaggattcttcgcgggaggtcgtttga

SEQ ID NO: 106766 - DNA, 75 bp, Artificial Sequence
  Synthetic
aggggcctgtattatcctgttggtggctccagttccggaacagtgaaccctgttccgaatactgtctctcacatc

SEQ ID NO: 106767 - DNA, 75 bp, Artificial Sequence
  Synthetic
aggggcctgtattttcctgttggtggctccagttccggaacagtgaaccctgttccgaatactgtctctcacatc

SEQ ID NO: 106768 - DNA, 75 bp, Artificial Sequence
  Synthetic
aggggcctgtattctcctgttggtggctccagttccggaacagtgaaccctgttccgaatactgtctctcacatc

SEQ ID NO: 106769 - DNA, 75 bp, Artificial Sequence
  Synthetic
aggggcctgtattgtcctgttggtggctccagttccggaacagtgaaccctgttccgaatactgtctctcacatc

SEQ ID NO: 106770 - DNA, 75 bp, Artificial Sequence
  Synthetic
aggggcctgttttatcctgttggtggctccagttccggaacagtgaaccctgttccgaatactgtctctcacatc

SEQ ID NO: 106771 - DNA, 75 bp, Artificial Sequence
  Synthetic
aggggcctgttttttcctgttggtggctccagttccggaacagtgaaccctgttccgaatactgtctctcacatc

SEQ ID NO: 106772 - DNA, 75 bp, Artificial Sequence
  Synthetic
aggggcctgttttctcctgttggtggctccagttccggaacagtgaaccctgttccgaatactgtctctcacatc

SEQ ID NO: 106773 - DNA, 75 bp, Artificial Sequence
  Synthetic
aggggcctgttttgtcctgttggtggctccagttccggaacagtgaaccctgttccgaatactgtctctcacatc

SEQ ID NO: 106774 - DNA, 75 bp, Artificial Sequence
  Synthetic
aggggcctgtcttatcctgttggtggctccagttccggaacagtgaaccctgttccgaatactgtctctcacatc

SEQ ID NO: 106775 - DNA, 75 bp, Artificial Sequence
  Synthetic
aggggcctgtcttttcctgttggtggctccagttccggaacagtgaaccctgttccgaatactgtctctcacatc

SEQ ID NO: 106776 - DNA, 75 bp, Artificial Sequence
  Synthetic
aggggcctgtcttctcctgttggtggctccagttccggaacagtgaaccctgttccgaatactgtctctcacatc

SEQ ID NO: 106777 - DNA, 75 bp, Artificial Sequence
  Synthetic
aggggcctgtcttgtcctgttggtggctccagttccggaacagtgaaccctgttccgaatactgtctctcacatc

SEQ ID NO: 106778 - DNA, 75 bp, Artificial Sequence
  Synthetic
aggggcctgtgttatcctgttggtggctccagttccggaacagtgaaccctgttccgaatactgtctctcacatc

SEQ ID NO: 106779 - DNA, 75 bp, Artificial Sequence
  Synthetic
aggggcctgtgttttcctgttggtggctccagttccggaacagtgaaccctgttccgaatactgtctctcacatc

SEQ ID NO: 106780 - DNA, 75 bp, Artificial Sequence
  Synthetic
aggggcctgtgttctcctgttggtggctccagttccggaacagtgaaccctgttccgaatactgtctctcacatc

SEQ ID NO: 106781 - DNA, 75 bp, Artificial Sequence
  Synthetic
aggggcctgtgttgtcctgttggtggctccagttccggaacagtgaaccctgttccgaatactgtctctcacatc

SEQ ID NO: 106782 - DNA, 75 bp, Artificial Sequence
  Synthetic
ttccacaacattccaccaagctctgctggatcccacagtaggaggcctgtcttctcctgctggtggctccagttc

SEQ ID NO: 106783 - DNA, 75 bp, Artificial Sequence
  Synthetic
attccagcagtcccgattgggacttcaacacaaacaaggacaattggccaatggcaaacaaggtaggagtgggag

SEQ ID NO: 106784 - DNA, 75 bp, Artificial Sequence
  Synthetic
taatcatctcttgttcatgtcctactgttcaagcctccaagctgtgccttgggtggctttaggacatggacattg

SEQ ID NO: 106785 - DNA, 75 bp, Artificial Sequence
  Synthetic
gtttttgccttctgacttctttccttcagtaagagatcttttggtaaccgctccggctcggaaccggaatgcctt

SEQ ID NO: 106786 - DNA, 75 bp, Artificial Sequence
  Synthetic
tcttttgtctttgggtatacatttaaaccctaataaaaccaaacgttggggctactcccttaactttatgggata

SEQ ID NO: 106787 - DNA, 75 bp, Artificial Sequence
  Synthetic
attatccagagcatgtggttaatcattatttccaaaccagacactatttacatactttgtggaaggcgggtatct

SEQ ID NO: 106788 - DNA, 75 bp, Artificial Sequence
  Synthetic
ctccacaacattccaccaggctctgctagggcccagagtgaggggcctaaaccctgttccgactactgcctcacc

SEQ ID NO: 106789 - DNA, 75 bp, Artificial Sequence
  Synthetic
ctcccctcaattccaccagggtctgttaaatcccagggtaaagggcctccggaattttcctggtgggtccagttc

SEQ ID NO: 106790 - DNA, 75 bp, Artificial Sequence
  Synthetic
aatggatgggggcagcccacaggccatgggggcaggcgaggaacctttgtggctcctgtggcgatccatagtgtg

SEQ ID NO: 106791 - DNA, 75 bp, Artificial Sequence
  Synthetic
tcggagtgggagcattcgggccagggttcaccccaccacaaggaggactcttggggtggagccctcaggctcagg

SEQ ID NO: 106792 - DNA, 75 bp, Artificial Sequence
  Synthetic
tcggagtgggagcattcgggccagggttcaccccaccacaaggaggtctcttggggtggagccctcaggctcagg

SEQ ID NO: 106793 - DNA, 75 bp, Artificial Sequence
  Synthetic
tcggagtgggagcattcgggccagggttcaccccaccacaaggaggcctcttggggtggagccctcaggctcagg

SEQ ID NO: 106794 - DNA, 75 bp, Artificial Sequence
  Synthetic
tcggagtgggagcattcgggccagggttcaccccaccacaaggagggctcttggggtggagccctcaggctcagg

SEQ ID NO: 106795 - DNA, 75 bp, Artificial Sequence
  Synthetic
tcggagtgggagcattcgggccagggttcaccccaccacaaggtggactcttggggtggagccctcaggctcagg

SEQ ID NO: 106796 - DNA, 75 bp, Artificial Sequence
  Synthetic
tcggagtgggagcattcgggccagggttcaccccaccacaaggtggtctcttggggtggagccctcaggctcagg

SEQ ID NO: 106797 - DNA, 75 bp, Artificial Sequence
  Synthetic
tcggagtgggagcattcgggccagggttcaccccaccacaaggtggcctcttggggtggagccctcaggctcagg

SEQ ID NO: 106798 - DNA, 75 bp, Artificial Sequence
  Synthetic
tcggagtgggagcattcgggccagggttcaccccaccacaaggtgggctcttggggtggagccctcaggctcagg

SEQ ID NO: 106799 - DNA, 75 bp, Artificial Sequence
  Synthetic
tcggagtgggagcattcgggccagggttcaccccaccacaaggcggactcttggggtggagccctcaggctcagg

SEQ ID NO: 106800 - DNA, 75 bp, Artificial Sequence
  Synthetic
tcggagtgggagcattcgggccagggttcaccccaccacaaggcggtctcttggggtggagccctcaggctcagg

SEQ ID NO: 106801 - DNA, 75 bp, Artificial Sequence
  Synthetic
tcggagtgggagcattcgggccagggttcaccccaccacaaggcggcctcttggggtggagccctcaggctcagg

SEQ ID NO: 106802 - DNA, 75 bp, Artificial Sequence
  Synthetic
tcggagtgggagcattcgggccagggttcaccccaccacaaggcgggctcttggggtggagccctcaggctcagg

SEQ ID NO: 106803 - DNA, 75 bp, Artificial Sequence
  Synthetic
tcggagtgggagcattcgggccagggttcaccccaccacaagggggactcttggggtggagccctcaggctcagg

SEQ ID NO: 106804 - DNA, 75 bp, Artificial Sequence
  Synthetic
tcggagtgggagcattcgggccagggttcaccccaccacaagggggtctcttggggtggagccctcaggctcagg

SEQ ID NO: 106805 - DNA, 75 bp, Artificial Sequence
  Synthetic
tcggagtgggagcattcgggccagggttcaccccaccacaagggggcctcttggggtggagccctcaggctcagg

SEQ ID NO: 106806 - DNA, 75 bp, Artificial Sequence
  Synthetic
tcggagtgggagcattcgggccagggttcaccccaccacaaggggggctcttggggtggagccctcaggctcagg

SEQ ID NO: 106807 - DNA, 75 bp, Artificial Sequence
  Synthetic
tcggagtgggagcattcgggccagggttcaccccaccacatggaggactcttggggtggagccctcaggctcagg

SEQ ID NO: 106808 - DNA, 75 bp, Artificial Sequence
  Synthetic
tcggagtgggagcattcgggccagggttcaccccaccacatggaggtctcttggggtggagccctcaggctcagg

SEQ ID NO: 106809 - DNA, 75 bp, Artificial Sequence
  Synthetic
tcggagtgggagcattcgggccagggttcaccccaccacatggaggcctcttggggtggagccctcaggctcagg

SEQ ID NO: 106810 - DNA, 75 bp, Artificial Sequence
  Synthetic
tcggagtgggagcattcgggccagggttcaccccaccacatggagggctcttggggtggagccctcaggctcagg

SEQ ID NO: 106811 - DNA, 75 bp, Artificial Sequence
  Synthetic
tcggagtgggagcattcgggccagggttcaccccaccacatggtggactcttggggtggagccctcaggctcagg

SEQ ID NO: 106812 - DNA, 75 bp, Artificial Sequence
  Synthetic
tcggagtgggagcattcgggccagggttcaccccaccacatggtggtctcttggggtggagccctcaggctcagg

SEQ ID NO: 106813 - DNA, 75 bp, Artificial Sequence
  Synthetic
tcggagtgggagcattcgggccagggttcaccccaccacatggtggcctcttggggtggagccctcaggctcagg

SEQ ID NO: 106814 - DNA, 75 bp, Artificial Sequence
  Synthetic
tcggagtgggagcattcgggccagggttcaccccaccacatggtgggctcttggggtggagccctcaggctcagg

SEQ ID NO: 106815 - DNA, 75 bp, Artificial Sequence
  Synthetic
tcggagtgggagcattcgggccagggttcaccccaccacatggcggactcttggggtggagccctcaggctcagg

SEQ ID NO: 106816 - DNA, 75 bp, Artificial Sequence
  Synthetic
tcggagtgggagcattcgggccagggttcaccccaccacatggcggtctcttggggtggagccctcaggctcagg

SEQ ID NO: 106817 - DNA, 75 bp, Artificial Sequence
  Synthetic
tcggagtgggagcattcgggccagggttcaccccaccacatggcggcctcttggggtggagccctcaggctcagg

SEQ ID NO: 106818 - DNA, 75 bp, Artificial Sequence
  Synthetic
tcggagtgggagcattcgggccagggttcaccccaccacatggcgggctcttggggtggagccctcaggctcagg

SEQ ID NO: 106819 - DNA, 75 bp, Artificial Sequence
  Synthetic
tcggagtgggagcattcgggccagggttcaccccaccacatgggggactcttggggtggagccctcaggctcagg

SEQ ID NO: 106820 - DNA, 75 bp, Artificial Sequence
  Synthetic
tcggagtgggagcattcgggccagggttcaccccaccacatgggggtctcttggggtggagccctcaggctcagg

SEQ ID NO: 106821 - DNA, 75 bp, Artificial Sequence
  Synthetic
tcggagtgggagcattcgggccagggttcaccccaccacatgggggcctcttggggtggagccctcaggctcagg

SEQ ID NO: 106822 - DNA, 75 bp, Artificial Sequence
  Synthetic
tcggagtgggagcattcgggccagggttcaccccaccacatggggggctcttggggtggagccctcaggctcagg

SEQ ID NO: 106823 - DNA, 75 bp, Artificial Sequence
  Synthetic
tcggagtgggagcattcgggccagggttcaccccaccacacggaggactcttggggtggagccctcaggctcagg

SEQ ID NO: 106824 - DNA, 75 bp, Artificial Sequence
  Synthetic
tcggagtgggagcattcgggccagggttcaccccaccacacggaggtctcttggggtggagccctcaggctcagg

SEQ ID NO: 106825 - DNA, 75 bp, Artificial Sequence
  Synthetic
tcggagtgggagcattcgggccagggttcaccccaccacacggaggcctcttggggtggagccctcaggctcagg

SEQ ID NO: 106826 - DNA, 75 bp, Artificial Sequence
  Synthetic
tcggagtgggagcattcgggccagggttcaccccaccacacggagggctcttggggtggagccctcaggctcagg

SEQ ID NO: 106827 - DNA, 75 bp, Artificial Sequence
  Synthetic
tcggagtgggagcattcgggccagggttcaccccaccacacggtggactcttggggtggagccctcaggctcagg

SEQ ID NO: 106828 - DNA, 75 bp, Artificial Sequence
  Synthetic
tcggagtgggagcattcgggccagggttcaccccaccacacggtggtctcttggggtggagccctcaggctcagg

SEQ ID NO: 106829 - DNA, 75 bp, Artificial Sequence
  Synthetic
tcggagtgggagcattcgggccagggttcaccccaccacacggtggcctcttggggtggagccctcaggctcagg

SEQ ID NO: 106830 - DNA, 75 bp, Artificial Sequence
  Synthetic
tcggagtgggagcattcgggccagggttcaccccaccacacggtgggctcttggggtggagccctcaggctcagg

SEQ ID NO: 106831 - DNA, 75 bp, Artificial Sequence
  Synthetic
tcggagtgggagcattcgggccagggttcaccccaccacacggcggactcttggggtggagccctcaggctcagg

SEQ ID NO: 106832 - DNA, 75 bp, Artificial Sequence
  Synthetic
tcggagtgggagcattcgggccagggttcaccccaccacacggcggtctcttggggtggagccctcaggctcagg

SEQ ID NO: 106833 - DNA, 75 bp, Artificial Sequence
  Synthetic
tcggagtgggagcattcgggccagggttcaccccaccacacggcggcctcttggggtggagccctcaggctcagg

SEQ ID NO: 106834 - DNA, 75 bp, Artificial Sequence
  Synthetic
tcggagtgggagcattcgggccagggttcaccccaccacacggcgggctcttggggtggagccctcaggctcagg

SEQ ID NO: 106835 - DNA, 75 bp, Artificial Sequence
  Synthetic
tcggagtgggagcattcgggccagggttcaccccaccacacgggggactcttggggtggagccctcaggctcagg

SEQ ID NO: 106836 - DNA, 75 bp, Artificial Sequence
  Synthetic
tcggagtgggagcattcgggccagggttcaccccaccacacgggggtctcttggggtggagccctcaggctcagg

SEQ ID NO: 106837 - DNA, 75 bp, Artificial Sequence
  Synthetic
tcggagtgggagcattcgggccagggttcaccccaccacacgggggcctcttggggtggagccctcaggctcagg

SEQ ID NO: 106838 - DNA, 75 bp, Artificial Sequence
  Synthetic
tcggagtgggagcattcgggccagggttcaccccaccacacggggggctcttggggtggagccctcaggctcagg

SEQ ID NO: 106839 - DNA, 75 bp, Artificial Sequence
  Synthetic
tcggagtgggagcattcgggccagggttcaccccaccacagggaggactcttggggtggagccctcaggctcagg

SEQ ID NO: 106840 - DNA, 75 bp, Artificial Sequence
  Synthetic
tcggagtgggagcattcgggccagggttcaccccaccacagggaggtctcttggggtggagccctcaggctcagg

SEQ ID NO: 106841 - DNA, 75 bp, Artificial Sequence
  Synthetic
tcggagtgggagcattcgggccagggttcaccccaccacagggaggcctcttggggtggagccctcaggctcagg

SEQ ID NO: 106842 - DNA, 75 bp, Artificial Sequence
  Synthetic
tcggagtgggagcattcgggccagggttcaccccaccacagggagggctcttggggtggagccctcaggctcagg

SEQ ID NO: 106843 - DNA, 75 bp, Artificial Sequence
  Synthetic
tcggagtgggagcattcgggccagggttcaccccaccacagggtggactcttggggtggagccctcaggctcagg

SEQ ID NO: 106844 - DNA, 75 bp, Artificial Sequence
  Synthetic
tcggagtgggagcattcgggccagggttcaccccaccacagggtggtctcttggggtggagccctcaggctcagg

SEQ ID NO: 106845 - DNA, 75 bp, Artificial Sequence
  Synthetic
tcggagtgggagcattcgggccagggttcaccccaccacagggtggcctcttggggtggagccctcaggctcagg

SEQ ID NO: 106846 - DNA, 75 bp, Artificial Sequence
  Synthetic
tcggagtgggagcattcgggccagggttcaccccaccacagggtgggctcttggggtggagccctcaggctcagg

SEQ ID NO: 106847 - DNA, 75 bp, Artificial Sequence
  Synthetic
tcggagtgggagcattcgggccagggttcaccccaccacagggcggactcttggggtggagccctcaggctcagg

SEQ ID NO: 106848 - DNA, 75 bp, Artificial Sequence
  Synthetic
tcggagtgggagcattcgggccagggttcaccccaccacagggcggtctcttggggtggagccctcaggctcagg

SEQ ID NO: 106849 - DNA, 75 bp, Artificial Sequence
  Synthetic
tcggagtgggagcattcgggccagggttcaccccaccacagggcggcctcttggggtggagccctcaggctcagg

SEQ ID NO: 106850 - DNA, 75 bp, Artificial Sequence
  Synthetic
tcggagtgggagcattcgggccagggttcaccccaccacagggcgggctcttggggtggagccctcaggctcagg

SEQ ID NO: 106851 - DNA, 75 bp, Artificial Sequence
  Synthetic
tcggagtgggagcattcgggccagggttcaccccaccacaggggggactcttggggtggagccctcaggctcagg

SEQ ID NO: 106852 - DNA, 75 bp, Artificial Sequence
  Synthetic
tcggagtgggagcattcgggccagggttcaccccaccacaggggggtctcttggggtggagccctcaggctcagg

SEQ ID NO: 106853 - DNA, 75 bp, Artificial Sequence
  Synthetic
tcggagtgggagcattcgggccagggttcaccccaccacaggggggcctcttggggtggagccctcaggctcagg

SEQ ID NO: 106854 - DNA, 75 bp, Artificial Sequence
  Synthetic
tcggagtgggagcattcgggccagggttcaccccaccacagggggggctcttggggtggagccctcaggctcagg

SEQ ID NO: 106855 - DNA, 75 bp, Artificial Sequence
  Synthetic
agagtctccggaacactgcactcctcaccatacagcactcagacaacaaattttgtgttggggtgagttgatgaa

SEQ ID NO: 106856 - DNA, 75 bp, Artificial Sequence
  Synthetic
aaactttacggggctttattcttctactgtacctgtctttaaccctcattggaaaacaccctcttttcctaatat

SEQ ID NO: 106857 - DNA, 75 bp, Artificial Sequence
  Synthetic
tcggcagtcaggaaggcagcctactcccatctctccacctctaagagacaatcatcctcaggccatgcagtggaa

SEQ ID NO: 106858 - DNA, 75 bp, Artificial Sequence
  Synthetic
tcggcagtcaggaaggcagcctactcccatctctccacctctaagagacattcatcctcaggccatgcagtggaa

SEQ ID NO: 106859 - DNA, 75 bp, Artificial Sequence
  Synthetic
tcggcagtcaggaaggcagcctactcccatctctccacctctaagagacactcatcctcaggccatgcagtggaa

SEQ ID NO: 106860 - DNA, 75 bp, Artificial Sequence
  Synthetic
tcggcagtcaggaaggcagcctactcccatctctccacctctaagagacagtcatcctcaggccatgcagtggaa

SEQ ID NO: 106861 - DNA, 75 bp, Artificial Sequence
  Synthetic
tcggcagtcaggaaggcagcctactcccatctctccacctctaagtgacaatcatcctcaggccatgcagtggaa

SEQ ID NO: 106862 - DNA, 75 bp, Artificial Sequence
  Synthetic
tcggcagtcaggaaggcagcctactcccatctctccacctctaagtgacattcatcctcaggccatgcagtggaa

SEQ ID NO: 106863 - DNA, 75 bp, Artificial Sequence
  Synthetic
tcggcagtcaggaaggcagcctactcccatctctccacctctaagtgacactcatcctcaggccatgcagtggaa

SEQ ID NO: 106864 - DNA, 75 bp, Artificial Sequence
  Synthetic
tcggcagtcaggaaggcagcctactcccatctctccacctctaagtgacagtcatcctcaggccatgcagtggaa

SEQ ID NO: 106865 - DNA, 75 bp, Artificial Sequence
  Synthetic
tcggcagtcaggaaggcagcctactcccatctctccacctctaagcgacaatcatcctcaggccatgcagtggaa

SEQ ID NO: 106866 - DNA, 75 bp, Artificial Sequence
  Synthetic
tcggcagtcaggaaggcagcctactcccatctctccacctctaagcgacattcatcctcaggccatgcagtggaa

SEQ ID NO: 106867 - DNA, 75 bp, Artificial Sequence
  Synthetic
tcggcagtcaggaaggcagcctactcccatctctccacctctaagcgacactcatcctcaggccatgcagtggaa

SEQ ID NO: 106868 - DNA, 75 bp, Artificial Sequence
  Synthetic
tcggcagtcaggaaggcagcctactcccatctctccacctctaagcgacagtcatcctcaggccatgcagtggaa

SEQ ID NO: 106869 - DNA, 75 bp, Artificial Sequence
  Synthetic
tcggcagtcaggaaggcagcctactcccatctctccacctctaagggacaatcatcctcaggccatgcagtggaa

SEQ ID NO: 106870 - DNA, 75 bp, Artificial Sequence
  Synthetic
tcggcagtcaggaaggcagcctactcccatctctccacctctaagggacattcatcctcaggccatgcagtggaa

SEQ ID NO: 106871 - DNA, 75 bp, Artificial Sequence
  Synthetic
tcggcagtcaggaaggcagcctactcccatctctccacctctaagggacactcatcctcaggccatgcagtggaa

SEQ ID NO: 106872 - DNA, 75 bp, Artificial Sequence
  Synthetic
tcggcagtcaggaaggcagcctactcccatctctccacctctaagggacagtcatcctcaggccatgcagtggaa

SEQ ID NO: 106873 - DNA, 75 bp, Artificial Sequence
  Synthetic
tcggcagtcaggaaggcagcctactcccttctctccacctctaagagacaatcatcctcaggccatgcagtggaa

SEQ ID NO: 106874 - DNA, 75 bp, Artificial Sequence
  Synthetic
tcggcagtcaggaaggcagcctactcccttctctccacctctaagagacattcatcctcaggccatgcagtggaa

SEQ ID NO: 106875 - DNA, 75 bp, Artificial Sequence
  Synthetic
tcggcagtcaggaaggcagcctactcccttctctccacctctaagagacactcatcctcaggccatgcagtggaa

SEQ ID NO: 106876 - DNA, 75 bp, Artificial Sequence
  Synthetic
tcggcagtcaggaaggcagcctactcccttctctccacctctaagagacagtcatcctcaggccatgcagtggaa

SEQ ID NO: 106877 - DNA, 75 bp, Artificial Sequence
  Synthetic
tcggcagtcaggaaggcagcctactcccttctctccacctctaagtgacaatcatcctcaggccatgcagtggaa

SEQ ID NO: 106878 - DNA, 75 bp, Artificial Sequence
  Synthetic
tcggcagtcaggaaggcagcctactcccttctctccacctctaagtgacattcatcctcaggccatgcagtggaa

SEQ ID NO: 106879 - DNA, 75 bp, Artificial Sequence
  Synthetic
tcggcagtcaggaaggcagcctactcccttctctccacctctaagtgacactcatcctcaggccatgcagtggaa

SEQ ID NO: 106880 - DNA, 75 bp, Artificial Sequence
  Synthetic
tcggcagtcaggaaggcagcctactcccttctctccacctctaagtgacagtcatcctcaggccatgcagtggaa

SEQ ID NO: 106881 - DNA, 75 bp, Artificial Sequence
  Synthetic
tcggcagtcaggaaggcagcctactcccttctctccacctctaagcgacaatcatcctcaggccatgcagtggaa

SEQ ID NO: 106882 - DNA, 75 bp, Artificial Sequence
  Synthetic
tcggcagtcaggaaggcagcctactcccttctctccacctctaagcgacattcatcctcaggccatgcagtggaa

SEQ ID NO: 106883 - DNA, 75 bp, Artificial Sequence
  Synthetic
tcggcagtcaggaaggcagcctactcccttctctccacctctaagcgacactcatcctcaggccatgcagtggaa

SEQ ID NO: 106884 - DNA, 75 bp, Artificial Sequence
  Synthetic
tcggcagtcaggaaggcagcctactcccttctctccacctctaagcgacagtcatcctcaggccatgcagtggaa

SEQ ID NO: 106885 - DNA, 75 bp, Artificial Sequence
  Synthetic
tcggcagtcaggaaggcagcctactcccttctctccacctctaagggacaatcatcctcaggccatgcagtggaa

SEQ ID NO: 106886 - DNA, 75 bp, Artificial Sequence
  Synthetic
tcggcagtcaggaaggcagcctactcccttctctccacctctaagggacattcatcctcaggccatgcagtggaa

SEQ ID NO: 106887 - DNA, 75 bp, Artificial Sequence
  Synthetic
tcggcagtcaggaaggcagcctactcccttctctccacctctaagggacactcatcctcaggccatgcagtggaa

SEQ ID NO: 106888 - DNA, 75 bp, Artificial Sequence
  Synthetic
tcggcagtcaggaaggcagcctactcccttctctccacctctaagggacagtcatcctcaggccatgcagtggaa

SEQ ID NO: 106889 - DNA, 75 bp, Artificial Sequence
  Synthetic
tcggcagtcaggaaggcagcctactcccctctctccacctctaagagacaatcatcctcaggccatgcagtggaa

SEQ ID NO: 106890 - DNA, 75 bp, Artificial Sequence
  Synthetic
tcggcagtcaggaaggcagcctactcccctctctccacctctaagagacattcatcctcaggccatgcagtggaa

SEQ ID NO: 106891 - DNA, 75 bp, Artificial Sequence
  Synthetic
tcggcagtcaggaaggcagcctactcccctctctccacctctaagagacactcatcctcaggccatgcagtggaa

SEQ ID NO: 106892 - DNA, 75 bp, Artificial Sequence
  Synthetic
tcggcagtcaggaaggcagcctactcccctctctccacctctaagagacagtcatcctcaggccatgcagtggaa

SEQ ID NO: 106893 - DNA, 75 bp, Artificial Sequence
  Synthetic
tcggcagtcaggaaggcagcctactcccctctctccacctctaagtgacaatcatcctcaggccatgcagtggaa

SEQ ID NO: 106894 - DNA, 75 bp, Artificial Sequence
  Synthetic
tcggcagtcaggaaggcagcctactcccctctctccacctctaagtgacattcatcctcaggccatgcagtggaa

SEQ ID NO: 106895 - DNA, 75 bp, Artificial Sequence
  Synthetic
tcggcagtcaggaaggcagcctactcccctctctccacctctaagtgacactcatcctcaggccatgcagtggaa

SEQ ID NO: 106896 - DNA, 75 bp, Artificial Sequence
  Synthetic
tcggcagtcaggaaggcagcctactcccctctctccacctctaagtgacagtcatcctcaggccatgcagtggaa

SEQ ID NO: 106897 - DNA, 75 bp, Artificial Sequence
  Synthetic
tcggcagtcaggaaggcagcctactcccctctctccacctctaagcgacaatcatcctcaggccatgcagtggaa

SEQ ID NO: 106898 - DNA, 75 bp, Artificial Sequence
  Synthetic
tcggcagtcaggaaggcagcctactcccctctctccacctctaagcgacattcatcctcaggccatgcagtggaa

SEQ ID NO: 106899 - DNA, 75 bp, Artificial Sequence
  Synthetic
tcggcagtcaggaaggcagcctactcccctctctccacctctaagcgacactcatcctcaggccatgcagtggaa

SEQ ID NO: 106900 - DNA, 75 bp, Artificial Sequence
  Synthetic
tcggcagtcaggaaggcagcctactcccctctctccacctctaagcgacagtcatcctcaggccatgcagtggaa

SEQ ID NO: 106901 - DNA, 75 bp, Artificial Sequence
  Synthetic
tcggcagtcaggaaggcagcctactcccctctctccacctctaagggacaatcatcctcaggccatgcagtggaa

SEQ ID NO: 106902 - DNA, 75 bp, Artificial Sequence
  Synthetic
tcggcagtcaggaaggcagcctactcccctctctccacctctaagggacattcatcctcaggccatgcagtggaa

SEQ ID NO: 106903 - DNA, 75 bp, Artificial Sequence
  Synthetic
tcggcagtcaggaaggcagcctactcccctctctccacctctaagggacactcatcctcaggccatgcagtggaa

SEQ ID NO: 106904 - DNA, 75 bp, Artificial Sequence
  Synthetic
tcggcagtcaggaaggcagcctactcccctctctccacctctaagggacagtcatcctcaggccatgcagtggaa

SEQ ID NO: 106905 - DNA, 75 bp, Artificial Sequence
  Synthetic
tcggcagtcaggaaggcagcctactcccgtctctccacctctaagagacaatcatcctcaggccatgcagtggaa

SEQ ID NO: 106906 - DNA, 75 bp, Artificial Sequence
  Synthetic
tcggcagtcaggaaggcagcctactcccgtctctccacctctaagagacattcatcctcaggccatgcagtggaa

SEQ ID NO: 106907 - DNA, 75 bp, Artificial Sequence
  Synthetic
tcggcagtcaggaaggcagcctactcccgtctctccacctctaagagacactcatcctcaggccatgcagtggaa

SEQ ID NO: 106908 - DNA, 75 bp, Artificial Sequence
  Synthetic
tcggcagtcaggaaggcagcctactcccgtctctccacctctaagagacagtcatcctcaggccatgcagtggaa

SEQ ID NO: 106909 - DNA, 75 bp, Artificial Sequence
  Synthetic
tcggcagtcaggaaggcagcctactcccgtctctccacctctaagtgacaatcatcctcaggccatgcagtggaa

SEQ ID NO: 106910 - DNA, 75 bp, Artificial Sequence
  Synthetic
tcggcagtcaggaaggcagcctactcccgtctctccacctctaagtgacattcatcctcaggccatgcagtggaa

SEQ ID NO: 106911 - DNA, 75 bp, Artificial Sequence
  Synthetic
tcggcagtcaggaaggcagcctactcccgtctctccacctctaagtgacactcatcctcaggccatgcagtggaa

SEQ ID NO: 106912 - DNA, 75 bp, Artificial Sequence
  Synthetic
tcggcagtcaggaaggcagcctactcccgtctctccacctctaagtgacagtcatcctcaggccatgcagtggaa

SEQ ID NO: 106913 - DNA, 75 bp, Artificial Sequence
  Synthetic
tcggcagtcaggaaggcagcctactcccgtctctccacctctaagcgacaatcatcctcaggccatgcagtggaa

SEQ ID NO: 106914 - DNA, 75 bp, Artificial Sequence
  Synthetic
tcggcagtcaggaaggcagcctactcccgtctctccacctctaagcgacattcatcctcaggccatgcagtggaa

SEQ ID NO: 106915 - DNA, 75 bp, Artificial Sequence
  Synthetic
tcggcagtcaggaaggcagcctactcccgtctctccacctctaagcgacactcatcctcaggccatgcagtggaa

SEQ ID NO: 106916 - DNA, 75 bp, Artificial Sequence
  Synthetic
tcggcagtcaggaaggcagcctactcccgtctctccacctctaagcgacagtcatcctcaggccatgcagtggaa

SEQ ID NO: 106917 - DNA, 75 bp, Artificial Sequence
  Synthetic
tcggcagtcaggaaggcagcctactcccgtctctccacctctaagggacaatcatcctcaggccatgcagtggaa

SEQ ID NO: 106918 - DNA, 75 bp, Artificial Sequence
  Synthetic
tcggcagtcaggaaggcagcctactcccgtctctccacctctaagggacattcatcctcaggccatgcagtggaa

SEQ ID NO: 106919 - DNA, 75 bp, Artificial Sequence
  Synthetic
tcggcagtcaggaaggcagcctactcccgtctctccacctctaagggacactcatcctcaggccatgcagtggaa

SEQ ID NO: 106920 - DNA, 75 bp, Artificial Sequence
  Synthetic
tcggcagtcaggaaggcagcctactcccgtctctccacctctaagggacagtcatcctcaggccatgcagtggaa

SEQ ID NO: 106921 - DNA, 75 bp, Artificial Sequence
  Synthetic
tacgtccggtggccgttgtatccggccgacgacccgtgtcggggccggatgggtcttttcggtcccgtttgtgtt

SEQ ID NO: 106922 - DNA, 75 bp, Artificial Sequence
  Synthetic
ccctttaccccgttgcccggcaacggccaggtctgtgccaagtgtttgctgacgcaacccccactggctggggct

SEQ ID NO: 106923 - DNA, 75 bp, Artificial Sequence
  Synthetic
actaggaggctgtaggcataaattggtctgttcaccagcaccatgcaactttttcacctctgcctaatcatctct

SEQ ID NO: 106924 - DNA, 75 bp, Artificial Sequence
  Synthetic
attatcctgagcatgcagttaatcattattttaaaacaagacattatttgcatactttatggaaggcgggaatct

SEQ ID NO: 106925 - DNA, 75 bp, Artificial Sequence
  Synthetic
cccataagaggactattggactctcagcaaggttaacgactctccttgaatcatacttcaaagcctgtttgctta

SEQ ID NO: 106926 - DNA, 75 bp, Artificial Sequence
  Synthetic
ctcaatccagttccaccaggccctgttggatcagagggtaaggactctgtgtcttcctgctggtggctccagttc

SEQ ID NO: 106927 - DNA, 75 bp, Artificial Sequence
  Synthetic
tggagccctcaggctcagggcatattaacaaacgtgccagtagttcctcctcctgcctccaccaatcggcagtca

SEQ ID NO: 106928 - DNA, 75 bp, Artificial Sequence
  Synthetic
gtctccttcgccgagacgaaaaagatctcaatctcgggaatctcggtgttaatatcgcttgcactcatagggcgg

SEQ ID NO: 106929 - DNA, 75 bp, Artificial Sequence
  Synthetic
ccccaagatcatattgtacacaaaatcaaagattgttttcggaaacttcctgtaaatcgtccaattgattggaaa

SEQ ID NO: 106930 - DNA, 75 bp, Artificial Sequence
  Synthetic
cttcggtgactgggtgggcaataatttacaggatcaggcagcaagagatctagtagttaattatgtcaatgctaa

SEQ ID NO: 106931 - DNA, 75 bp, Artificial Sequence
  Synthetic
ccgtgtgcacttcgcttcacctctgcacgtcgcatggagaccaccgtgaacgcccaccaggtcttgcccaaggtc

SEQ ID NO: 106932 - DNA, 75 bp, Artificial Sequence
  Synthetic
catattgacaacagtgccagcagcgcctcctcctgcctccaccaatcggcagtcaggaagacagcctactcccat

SEQ ID NO: 106933 - DNA, 75 bp, Artificial Sequence
  Synthetic
cagggcatactcacaactgtgccagcagctcctcctcctgcctccaccaatcggcagtcaggaaggcagcctact

SEQ ID NO: 106934 - DNA, 75 bp, Artificial Sequence
  Synthetic
ggactcttggactttcaggacggtcaatgacctggatcgaagaatacatcaaagactgtgtatttaaggactggg

SEQ ID NO: 106935 - DNA, 75 bp, Artificial Sequence
  Synthetic
ttaatcctgaatggcaaactccttcctttcctaagattcatttacatgaggacattattaataggtgtcaacaat

SEQ ID NO: 106936 - DNA, 75 bp, Artificial Sequence
  Synthetic
cgtctgtgccttctcatctgccggtccgtgtgcacttcgcttcacctctgcacgttgcatggcgaccaccgtgaa

SEQ ID NO: 106937 - DNA, 75 bp, Artificial Sequence
  Synthetic
tcggcagtcaggaagacagcccactcccatctctccacctctgagagacagtcatcctcaggccatgcagtggaa

SEQ ID NO: 106938 - DNA, 75 bp, Artificial Sequence
  Synthetic
acctcgaaaaggcatggggacgaatctttctgttcccaatcctctgggattctttcccgatcaccagttggaccc

SEQ ID NO: 106939 - DNA, 75 bp, Artificial Sequence
  Synthetic
gaaaacttcctgtaaacaggcctattgattggaaagtatgtcaaagaattgtgggtcttttgggctttgctgctc

SEQ ID NO: 106940 - DNA, 75 bp, Artificial Sequence
  Synthetic
ggaacattacctcaggatcatattgtgcaaaaaatcaaacaatgtttcagaaaactacctgttaacaggccgatt

SEQ ID NO: 106941 - DNA, 75 bp, Artificial Sequence
  Synthetic
tcgccagtcaggaaggcagcctaccccgctgtctccacctttgagaaacacgcatcctcaggccatgcagtggaa

SEQ ID NO: 106942 - DNA, 75 bp, Artificial Sequence
  Synthetic
tctacccacctgggtgggaagtaatttggaagacccagcatcatggaaattattagccacctgtcggaacgttaa

SEQ ID NO: 106943 - DNA, 75 bp, Artificial Sequence
  Synthetic
tgagtatttggtgtccttcggggtgtggattcgcacaccccccgcatataggccaccaaatgcccctatcttatc

SEQ ID NO: 106944 - DNA, 75 bp, Artificial Sequence
  Synthetic
tctgttgtcctctctcggaaatacacctcctttccatggctgctagggtgtgctgccaactggatcctgcgcggg

SEQ ID NO: 106945 - DNA, 75 bp, Artificial Sequence
  Synthetic
aaccttattatcctgatcatgtagttaatcattactttcaaacccgacattatttacatactctttggaaggctg

SEQ ID NO: 106946 - DNA, 75 bp, Artificial Sequence
  Synthetic
cactcccccacacggaggtgttttggggtggagccctcaggctcagggcatattggctacagtgccagcagttcc

SEQ ID NO: 106947 - DNA, 75 bp, Artificial Sequence
  Synthetic
cagttggacccggcgttcggagccaattcaaacaatccagattgggacttcaaccccaacaaggatcaatggcca

SEQ ID NO: 106948 - DNA, 75 bp, Artificial Sequence
  Synthetic
tctagcttcctgggtgggtagtaatttagacgatccagcatccagagacctagtagtcaattatgttaacattaa

SEQ ID NO: 106949 - DNA, 75 bp, Artificial Sequence
  Synthetic
caggcaactattgtggtttcacatttcttgtctcacttttggaagagatacggtcatagagtatttggtgtcttt

SEQ ID NO: 106950 - DNA, 75 bp, Artificial Sequence
  Synthetic
tacatttgcaggaggacattattaataggtgtcaacaatttgtgggacccctcacagtaaatgaaaaaaggagac

SEQ ID NO: 106951 - DNA, 75 bp, Artificial Sequence
  Synthetic
aaaaatcaaacactgttttagaaaacttcctgtcaatcggcctattgattggaaagtatgtcaaagaattgtggg

SEQ ID NO: 106952 - DNA, 75 bp, Artificial Sequence
  Synthetic
ctccacaaccttccaccaagctgtgcaagatcccagaatcaggggcgtgtattttcttgttggtggctccagttc

SEQ ID NO: 106953 - DNA, 75 bp, Artificial Sequence
  Synthetic
gcattaatgcctttgtatgcatgtatacaagctaagcaagctttcactttctcgccaacttacaaggcctttctg

SEQ ID NO: 106954 - DNA, 75 bp, Artificial Sequence
  Synthetic
ttccacaactttccaccaagctctacaagatcccagagtcaggggcctgtattttcctgctggtggctccagttc

SEQ ID NO: 106955 - DNA, 75 bp, Artificial Sequence
  Synthetic
gtcaacgaccgaccttgaggcatacttcaaagactgtgtgtttactgagtgggaggagttgggggaggaggttag

SEQ ID NO: 106956 - DNA, 75 bp, Artificial Sequence
  Synthetic
ttccaaaacattccaccaagctctgcaggatcccagagtaagaggccttcattattccgctggtggctccagttc

SEQ ID NO: 106957 - DNA, 75 bp, Artificial Sequence
  Synthetic
ttccaaaacattccaccaagctctgcaggatcccagagtaagaggccttcatttttccgctggtggctccagttc

SEQ ID NO: 106958 - DNA, 75 bp, Artificial Sequence
  Synthetic
ttccaaaacattccaccaagctctgcaggatcccagagtaagaggccttcattcttccgctggtggctccagttc

SEQ ID NO: 106959 - DNA, 75 bp, Artificial Sequence
  Synthetic
ttccaaaacattccaccaagctctgcaggatcccagagtaagaggccttcattgttccgctggtggctccagttc

SEQ ID NO: 106960 - DNA, 75 bp, Artificial Sequence
  Synthetic
atacatttaaacactaacaaaacaaaaagatggggttattccctacatttcatgggttatgtcattggatgttgg

SEQ ID NO: 106961 - DNA, 75 bp, Artificial Sequence
  Synthetic
accacgacatttcaccaagctctgcaagatcccagagtgaggggactgtatttcctggctggtggctccagttca

SEQ ID NO: 106962 - DNA, 75 bp, Artificial Sequence
  Synthetic
ttgaggcatacttcaaagactgtttgtttaaagattgggaggagttgggggaggagattaggttaaaggtctttg

SEQ ID NO: 106963 - DNA, 75 bp, Artificial Sequence
  Synthetic
ttgccagcaaatccgcctcctgcctccaccaatcgccagtcaggaaggcagcctacccctctgtctccacctttg

SEQ ID NO: 106964 - DNA, 75 bp, Artificial Sequence
  Synthetic
tctggcttcctgggtgggcaataatttggaagacccagcatctagggaattagtagtcaattatgtcaataccaa

SEQ ID NO: 106965 - DNA, 75 bp, Artificial Sequence
  Synthetic
acattgacccttataaagaatttggagctactgtggagttactctcgtttttgccttctgacttctttccttccg

SEQ ID NO: 106966 - DNA, 75 bp, Artificial Sequence
  Synthetic
ctccacagcattccatcggactctgcaagatcccagagtaaggggtctatatttccctgctggtggctccagttc

SEQ ID NO: 106967 - DNA, 75 bp, Artificial Sequence
  Synthetic
tgacaacagtgccagcagcgcctcctcctgcctccaccaatcggcagtcaggaagacagcctactcccatctctc

SEQ ID NO: 106968 - DNA, 75 bp, Artificial Sequence
  Synthetic
ttcgggccagggttcgccccaccacatggaggtcttctagggtggagccctcaggcccagggcgtaacaacaata

SEQ ID NO: 106969 - DNA, 75 bp, Artificial Sequence
  Synthetic
cttagagtctcctgagcattgtacacctcaccatactgcactcaggcaagcaattctgtgctggggggaattaat

SEQ ID NO: 106970 - DNA, 75 bp, Artificial Sequence
  Synthetic
ctttaatgcctttatatgcatgtatacaagctaaacaggcttttactttctcgccaacttacaaggcctttctaa

SEQ ID NO: 106971 - DNA, 75 bp, Artificial Sequence
  Synthetic
cttttggggtggagccctcaggctcagggcatactacaaaccttgccagcaaatccgcctcctgcctctaccaat

SEQ ID NO: 106972 - DNA, 75 bp, Artificial Sequence
  Synthetic
accgaccttgaggcctacttcaaagactgtgtgtttaaggactgggaggagctgggggaggagattaggttaaaa

SEQ ID NO: 106973 - DNA, 75 bp, Artificial Sequence
  Synthetic
accgaccttgaggcctacttcaaagactgtgtgtttaaggactgggaggagctgggggaggagattaggttaaat

SEQ ID NO: 106974 - DNA, 75 bp, Artificial Sequence
  Synthetic
accgaccttgaggcctacttcaaagactgtgtgtttaaggactgggaggagctgggggaggagattaggttaaac

SEQ ID NO: 106975 - DNA, 75 bp, Artificial Sequence
  Synthetic
accgaccttgaggcctacttcaaagactgtgtgtttaaggactgggaggagctgggggaggagattaggttaaag

SEQ ID NO: 106976 - DNA, 75 bp, Artificial Sequence
  Synthetic
tcatctattgtacatgtcccactgttcaagccttcaaactgtgccttgggtggctttggggcatggacattgacc

SEQ ID NO: 106977 - DNA, 75 bp, Artificial Sequence
  Synthetic
tcatctattgtacatgtcccactgttcaagccttcaatctgtgccttgggtggctttggggcatggacattgacc

SEQ ID NO: 106978 - DNA, 75 bp, Artificial Sequence
  Synthetic
tcatctattgtacatgtcccactgttcaagccttcaacctgtgccttgggtggctttggggcatggacattgacc

SEQ ID NO: 106979 - DNA, 75 bp, Artificial Sequence
  Synthetic
tcatctattgtacatgtcccactgttcaagccttcaagctgtgccttgggtggctttggggcatggacattgacc

SEQ ID NO: 106980 - DNA, 75 bp, Artificial Sequence
  Synthetic
tcatctattgtacatgtccctctgttcaagccttcaaactgtgccttgggtggctttggggcatggacattgacc

SEQ ID NO: 106981 - DNA, 75 bp, Artificial Sequence
  Synthetic
tcatctattgtacatgtccctctgttcaagccttcaatctgtgccttgggtggctttggggcatggacattgacc

SEQ ID NO: 106982 - DNA, 75 bp, Artificial Sequence
  Synthetic
tcatctattgtacatgtccctctgttcaagccttcaacctgtgccttgggtggctttggggcatggacattgacc

SEQ ID NO: 106983 - DNA, 75 bp, Artificial Sequence
  Synthetic
tcatctattgtacatgtccctctgttcaagccttcaagctgtgccttgggtggctttggggcatggacattgacc

SEQ ID NO: 106984 - DNA, 75 bp, Artificial Sequence
  Synthetic
tcatctattgtacatgtccccctgttcaagccttcaaactgtgccttgggtggctttggggcatggacattgacc

SEQ ID NO: 106985 - DNA, 75 bp, Artificial Sequence
  Synthetic
tcatctattgtacatgtccccctgttcaagccttcaatctgtgccttgggtggctttggggcatggacattgacc

SEQ ID NO: 106986 - DNA, 75 bp, Artificial Sequence
  Synthetic
tcatctattgtacatgtccccctgttcaagccttcaacctgtgccttgggtggctttggggcatggacattgacc

SEQ ID NO: 106987 - DNA, 75 bp, Artificial Sequence
  Synthetic
tcatctattgtacatgtccccctgttcaagccttcaagctgtgccttgggtggctttggggcatggacattgacc

SEQ ID NO: 106988 - DNA, 75 bp, Artificial Sequence
  Synthetic
tcatctattgtacatgtcccgctgttcaagccttcaaactgtgccttgggtggctttggggcatggacattgacc

SEQ ID NO: 106989 - DNA, 75 bp, Artificial Sequence
  Synthetic
tcatctattgtacatgtcccgctgttcaagccttcaatctgtgccttgggtggctttggggcatggacattgacc

SEQ ID NO: 106990 - DNA, 75 bp, Artificial Sequence
  Synthetic
tcatctattgtacatgtcccgctgttcaagccttcaacctgtgccttgggtggctttggggcatggacattgacc

SEQ ID NO: 106991 - DNA, 75 bp, Artificial Sequence
  Synthetic
tcatctattgtacatgtcccgctgttcaagccttcaagctgtgccttgggtggctttggggcatggacattgacc

SEQ ID NO: 106992 - DNA, 75 bp, Artificial Sequence
  Synthetic
tcatcttttgtacatgtcccactgttcaagccttcaaactgtgccttgggtggctttggggcatggacattgacc

SEQ ID NO: 106993 - DNA, 75 bp, Artificial Sequence
  Synthetic
tcatcttttgtacatgtcccactgttcaagccttcaatctgtgccttgggtggctttggggcatggacattgacc

SEQ ID NO: 106994 - DNA, 75 bp, Artificial Sequence
  Synthetic
tcatcttttgtacatgtcccactgttcaagccttcaacctgtgccttgggtggctttggggcatggacattgacc

SEQ ID NO: 106995 - DNA, 75 bp, Artificial Sequence
  Synthetic
tcatcttttgtacatgtcccactgttcaagccttcaagctgtgccttgggtggctttggggcatggacattgacc

SEQ ID NO: 106996 - DNA, 75 bp, Artificial Sequence
  Synthetic
tcatcttttgtacatgtccctctgttcaagccttcaaactgtgccttgggtggctttggggcatggacattgacc

SEQ ID NO: 106997 - DNA, 75 bp, Artificial Sequence
  Synthetic
tcatcttttgtacatgtccctctgttcaagccttcaatctgtgccttgggtggctttggggcatggacattgacc

SEQ ID NO: 106998 - DNA, 75 bp, Artificial Sequence
  Synthetic
tcatcttttgtacatgtccctctgttcaagccttcaacctgtgccttgggtggctttggggcatggacattgacc

SEQ ID NO: 106999 - DNA, 75 bp, Artificial Sequence
  Synthetic
tcatcttttgtacatgtccctctgttcaagccttcaagctgtgccttgggtggctttggggcatggacattgacc

SEQ ID NO: 107000 - DNA, 75 bp, Artificial Sequence
  Synthetic
tcatcttttgtacatgtccccctgttcaagccttcaaactgtgccttgggtggctttggggcatggacattgacc

SEQ ID NO: 107001 - DNA, 75 bp, Artificial Sequence
  Synthetic
tcatcttttgtacatgtccccctgttcaagccttcaatctgtgccttgggtggctttggggcatggacattgacc

SEQ ID NO: 107002 - DNA, 75 bp, Artificial Sequence
  Synthetic
tcatcttttgtacatgtccccctgttcaagccttcaacctgtgccttgggtggctttggggcatggacattgacc

SEQ ID NO: 107003 - DNA, 75 bp, Artificial Sequence
  Synthetic
tcatcttttgtacatgtccccctgttcaagccttcaagctgtgccttgggtggctttggggcatggacattgacc

SEQ ID NO: 107004 - DNA, 75 bp, Artificial Sequence
  Synthetic
tcatcttttgtacatgtcccgctgttcaagccttcaaactgtgccttgggtggctttggggcatggacattgacc

SEQ ID NO: 107005 - DNA, 75 bp, Artificial Sequence
  Synthetic
tcatcttttgtacatgtcccgctgttcaagccttcaatctgtgccttgggtggctttggggcatggacattgacc

SEQ ID NO: 107006 - DNA, 75 bp, Artificial Sequence
  Synthetic
tcatcttttgtacatgtcccgctgttcaagccttcaacctgtgccttgggtggctttggggcatggacattgacc

SEQ ID NO: 107007 - DNA, 75 bp, Artificial Sequence
  Synthetic
tcatcttttgtacatgtcccgctgttcaagccttcaagctgtgccttgggtggctttggggcatggacattgacc

SEQ ID NO: 107008 - DNA, 75 bp, Artificial Sequence
  Synthetic
tcatctcttgtacatgtcccactgttcaagccttcaaactgtgccttgggtggctttggggcatggacattgacc

SEQ ID NO: 107009 - DNA, 75 bp, Artificial Sequence
  Synthetic
tcatctcttgtacatgtcccactgttcaagccttcaatctgtgccttgggtggctttggggcatggacattgacc

SEQ ID NO: 107010 - DNA, 75 bp, Artificial Sequence
  Synthetic
tcatctcttgtacatgtcccactgttcaagccttcaacctgtgccttgggtggctttggggcatggacattgacc

SEQ ID NO: 107011 - DNA, 75 bp, Artificial Sequence
  Synthetic
tcatctcttgtacatgtcccactgttcaagccttcaagctgtgccttgggtggctttggggcatggacattgacc

SEQ ID NO: 107012 - DNA, 75 bp, Artificial Sequence
  Synthetic
tcatctcttgtacatgtccctctgttcaagccttcaaactgtgccttgggtggctttggggcatggacattgacc

SEQ ID NO: 107013 - DNA, 75 bp, Artificial Sequence
  Synthetic
tcatctcttgtacatgtccctctgttcaagccttcaatctgtgccttgggtggctttggggcatggacattgacc

SEQ ID NO: 107014 - DNA, 75 bp, Artificial Sequence
  Synthetic
tcatctcttgtacatgtccctctgttcaagccttcaacctgtgccttgggtggctttggggcatggacattgacc

SEQ ID NO: 107015 - DNA, 75 bp, Artificial Sequence
  Synthetic
tcatctcttgtacatgtccctctgttcaagccttcaagctgtgccttgggtggctttggggcatggacattgacc

SEQ ID NO: 107016 - DNA, 75 bp, Artificial Sequence
  Synthetic
tcatctcttgtacatgtccccctgttcaagccttcaaactgtgccttgggtggctttggggcatggacattgacc

SEQ ID NO: 107017 - DNA, 75 bp, Artificial Sequence
  Synthetic
tcatctcttgtacatgtccccctgttcaagccttcaatctgtgccttgggtggctttggggcatggacattgacc

SEQ ID NO: 107018 - DNA, 75 bp, Artificial Sequence
  Synthetic
tcatctcttgtacatgtccccctgttcaagccttcaacctgtgccttgggtggctttggggcatggacattgacc

SEQ ID NO: 107019 - DNA, 75 bp, Artificial Sequence
  Synthetic
tcatctcttgtacatgtccccctgttcaagccttcaagctgtgccttgggtggctttggggcatggacattgacc

SEQ ID NO: 107020 - DNA, 75 bp, Artificial Sequence
  Synthetic
tcatctcttgtacatgtcccgctgttcaagccttcaaactgtgccttgggtggctttggggcatggacattgacc

SEQ ID NO: 107021 - DNA, 75 bp, Artificial Sequence
  Synthetic
tcatctcttgtacatgtcccgctgttcaagccttcaatctgtgccttgggtggctttggggcatggacattgacc

SEQ ID NO: 107022 - DNA, 75 bp, Artificial Sequence
  Synthetic
tcatctcttgtacatgtcccgctgttcaagccttcaacctgtgccttgggtggctttggggcatggacattgacc

SEQ ID NO: 107023 - DNA, 75 bp, Artificial Sequence
  Synthetic
tcatctcttgtacatgtcccgctgttcaagccttcaagctgtgccttgggtggctttggggcatggacattgacc

SEQ ID NO: 107024 - DNA, 75 bp, Artificial Sequence
  Synthetic
tcatctgttgtacatgtcccactgttcaagccttcaaactgtgccttgggtggctttggggcatggacattgacc

SEQ ID NO: 107025 - DNA, 75 bp, Artificial Sequence
  Synthetic
tcatctgttgtacatgtcccactgttcaagccttcaatctgtgccttgggtggctttggggcatggacattgacc

SEQ ID NO: 107026 - DNA, 75 bp, Artificial Sequence
  Synthetic
tcatctgttgtacatgtcccactgttcaagccttcaacctgtgccttgggtggctttggggcatggacattgacc

SEQ ID NO: 107027 - DNA, 75 bp, Artificial Sequence
  Synthetic
tcatctgttgtacatgtcccactgttcaagccttcaagctgtgccttgggtggctttggggcatggacattgacc

SEQ ID NO: 107028 - DNA, 75 bp, Artificial Sequence
  Synthetic
tcatctgttgtacatgtccctctgttcaagccttcaaactgtgccttgggtggctttggggcatggacattgacc

SEQ ID NO: 107029 - DNA, 75 bp, Artificial Sequence
  Synthetic
tcatctgttgtacatgtccctctgttcaagccttcaatctgtgccttgggtggctttggggcatggacattgacc

SEQ ID NO: 107030 - DNA, 75 bp, Artificial Sequence
  Synthetic
tcatctgttgtacatgtccctctgttcaagccttcaacctgtgccttgggtggctttggggcatggacattgacc

SEQ ID NO: 107031 - DNA, 75 bp, Artificial Sequence
  Synthetic
tcatctgttgtacatgtccctctgttcaagccttcaagctgtgccttgggtggctttggggcatggacattgacc

SEQ ID NO: 107032 - DNA, 75 bp, Artificial Sequence
  Synthetic
tcatctgttgtacatgtccccctgttcaagccttcaaactgtgccttgggtggctttggggcatggacattgacc

SEQ ID NO: 107033 - DNA, 75 bp, Artificial Sequence
  Synthetic
tcatctgttgtacatgtccccctgttcaagccttcaatctgtgccttgggtggctttggggcatggacattgacc

SEQ ID NO: 107034 - DNA, 75 bp, Artificial Sequence
  Synthetic
tcatctgttgtacatgtccccctgttcaagccttcaacctgtgccttgggtggctttggggcatggacattgacc

SEQ ID NO: 107035 - DNA, 75 bp, Artificial Sequence
  Synthetic
tcatctgttgtacatgtccccctgttcaagccttcaagctgtgccttgggtggctttggggcatggacattgacc

SEQ ID NO: 107036 - DNA, 75 bp, Artificial Sequence
  Synthetic
tcatctgttgtacatgtcccgctgttcaagccttcaaactgtgccttgggtggctttggggcatggacattgacc

SEQ ID NO: 107037 - DNA, 75 bp, Artificial Sequence
  Synthetic
tcatctgttgtacatgtcccgctgttcaagccttcaatctgtgccttgggtggctttggggcatggacattgacc

SEQ ID NO: 107038 - DNA, 75 bp, Artificial Sequence
  Synthetic
tcatctgttgtacatgtcccgctgttcaagccttcaacctgtgccttgggtggctttggggcatggacattgacc

SEQ ID NO: 107039 - DNA, 75 bp, Artificial Sequence
  Synthetic
tcatctgttgtacatgtcccgctgttcaagccttcaagctgtgccttgggtggctttggggcatggacattgacc

SEQ ID NO: 107040 - DNA, 75 bp, Artificial Sequence
  Synthetic
tctagctacctgggtgggtactaatttggaagacccagcatccagggatctagtagtcaattatgttaatactaa

SEQ ID NO: 107041 - DNA, 75 bp, Artificial Sequence
  Synthetic
ttgccagcaaatccacctcctgcctcaaccaaacgccagtcaggaaggcagcctaccccgctgtctccacctctt

SEQ ID NO: 107042 - DNA, 75 bp, Artificial Sequence
  Synthetic
gttcaccagcaccatgcaactttttgggccgaaccagacatctcttgttcatgtcctactgttcaagcctccaag

SEQ ID NO: 107043 - DNA, 75 bp, Artificial Sequence
  Synthetic
ggtgtctttcggagtgtggattcgcactcctccagcttatagaccaccaaatgcccctatcttatcaacacttcc

SEQ ID NO: 107044 - DNA, 75 bp, Artificial Sequence
  Synthetic
gtattgggggccaaatctgtgcagcatcttgagtccctttataccgctgttaccaattttttgttatctgtgggt

SEQ ID NO: 107045 - DNA, 75 bp, Artificial Sequence
  Synthetic
tctcttctcacttctttagatctattcgaaatctcctcaatccgcctcagctctgtttagggaggccttaaattc

SEQ ID NO: 107046 - DNA, 75 bp, Artificial Sequence
  Synthetic
gtggaacactttccaccaggctctgttagatccgaaggtaagggctctgtattttcctgctggtggctccagttc

SEQ ID NO: 107047 - DNA, 75 bp, Artificial Sequence
  Synthetic
caagatctgatatctaaatgtgaacaatttgtaggcccgctcactaaaaatgaattgagaagattaaaattggtc

SEQ ID NO: 107048 - DNA, 75 bp, Artificial Sequence
  Synthetic
tgtattttcctgctggtggctccagttcaggaacagtaaaccctgctccgaatattgcctctcacatctcgtcaa

SEQ ID NO: 107049 - DNA, 75 bp, Artificial Sequence
  Synthetic
ctccacaacattccaccaagctctgctagaccccaaagtgaggggtcctgctggtggctccagttccggaacagt

SEQ ID NO: 107050 - DNA, 75 bp, Artificial Sequence
  Synthetic
acacacaacccagattgggacttcaaccccaacaaggacaactggccagaagccaaccaggtaggagtgggagca

SEQ ID NO: 107051 - DNA, 75 bp, Artificial Sequence
  Synthetic
gaagccttagagtctcctgagcattgctcacctcaccatactgcactcaggcaagccattctctgctggggggaa

SEQ ID NO: 107052 - DNA, 75 bp, Artificial Sequence
  Synthetic
gattggaaagtatgtcaaagaattgtgggactcttaggctttgccgctcctttcactcaatgtggctatcctgct

SEQ ID NO: 107053 - DNA, 75 bp, Artificial Sequence
  Synthetic
aatactaacatgggtttaaagatcaggcaactattgtggtttcatatatcttgccttacttttggaagagagact

SEQ ID NO: 107054 - DNA, 75 bp, Artificial Sequence
  Synthetic
taatcctaaatggcaaactccttcttttcctgacattcatttgcaggaggacattgttgatagatgtaagcaatt

SEQ ID NO: 107055 - DNA, 75 bp, Artificial Sequence
  Synthetic
tgaaattaattatgcctgctagattctatcctaacgctaccaaatatttgcccctagataaaggtattaaacctt

SEQ ID NO: 107056 - DNA, 75 bp, Artificial Sequence
  Synthetic
taaatatttgcccttagataaagggatcaaaccttattatccagagtatgtagttaatcattacttccagacgag

SEQ ID NO: 107057 - DNA, 75 bp, Artificial Sequence
  Synthetic
tccatttgcaccaggatatcataaacaagtgtgaacaatttgtgggccctctcacggtaaatgaaaaacgaagat

SEQ ID NO: 107058 - DNA, 75 bp, Artificial Sequence
  Synthetic
ccttacttttggaagagaaacagttcttgagtatttggtgtcttttggagtgtggattcgcactcctcctgctta

SEQ ID NO: 107059 - DNA, 75 bp, Artificial Sequence
  Synthetic
tagaaaacttcctgttaacaggcctattgattggaaagtatgtcaaagaattgtgggtcttttgggctttgctgc

SEQ ID NO: 107060 - DNA, 75 bp, Artificial Sequence
  Synthetic
tcctgctggtggctccagttccggaacagtgaaccctgttccgactactgcctcactcatctcgtcaatcttctc

SEQ ID NO: 107061 - DNA, 75 bp, Artificial Sequence
  Synthetic
gcagatccgcctcctgcttccaccaatcggcggtccgggagaaaaccaaccccagtctctccacctctaagagac

SEQ ID NO: 107062 - DNA, 75 bp, Artificial Sequence
  Synthetic
caatttgtgggacccctcacagtaaatgaaaacaggagactaaaattgatcatgcctgctaggttctatcctaat

SEQ ID NO: 107063 - DNA, 75 bp, Artificial Sequence
  Synthetic
ttctttccttctattcgagatcttctcgacaccgcctctgctctgtatcgggaggccttagagtctccggaacat

SEQ ID NO: 107064 - DNA, 75 bp, Artificial Sequence
  Synthetic
ggctttaatcctgaatggcaaactccttcttttcctgacattcatttgcaggaggatattgttgataggtgtaaa

SEQ ID NO: 107065 - DNA, 75 bp, Artificial Sequence
  Synthetic
tccaccaatcgtcggtcaaacaggcagcctaccccgctgtctcaacctttaagaaacactcatcctcaggccatg

SEQ ID NO: 107066 - DNA, 75 bp, Artificial Sequence
  Synthetic
ttcggacggaaattgcacttgtattcccatcccatcatcatgggctttcggaaaattcctatgggagtgggcctc

SEQ ID NO: 107067 - DNA, 75 bp, Artificial Sequence
  Synthetic
ttcgggccagggttcactcccccacacggaggtcttttagggtggagctctcaggctcagggcataatcacaaca

SEQ ID NO: 107068 - DNA, 75 bp, Artificial Sequence
  Synthetic
tcacctctgcacgtcgcatggagaccaccgtgaacgcccaccaggtcttgcccaaggtcttacataagaggactc

SEQ ID NO: 107069 - DNA, 75 bp, Artificial Sequence
  Synthetic
atacatttaaaccctaacaaaactaagagatggggttattccctaaactttatgggctatgtaattggaagttgg

SEQ ID NO: 107070 - DNA, 75 bp, Artificial Sequence
  Synthetic
caatcggcggtcgggaagacaacccctagtctctccacctctgagagacactcatccacaggccataaagtggaa

SEQ ID NO: 107071 - DNA, 75 bp, Artificial Sequence
  Synthetic
caatcggcggtcgggaagtcaacccctagtctctccacctctgagagacactcatccacaggccataaagtggaa

SEQ ID NO: 107072 - DNA, 75 bp, Artificial Sequence
  Synthetic
caatcggcggtcgggaagccaacccctagtctctccacctctgagagacactcatccacaggccataaagtggaa

SEQ ID NO: 107073 - DNA, 75 bp, Artificial Sequence
  Synthetic
caatcggcggtcgggaaggcaacccctagtctctccacctctgagagacactcatccacaggccataaagtggaa

SEQ ID NO: 107074 - DNA, 75 bp, Artificial Sequence
  Synthetic
ttgattggaaagtctgtcaacgtattgtgggtcttttgggttttgctgcccctttcacacaatgtggttatcctg

SEQ ID NO: 107075 - DNA, 75 bp, Artificial Sequence
  Synthetic
gggatacatagaggttccttgagcagtagtcatgcaggtccggcatggtcccgtgctggttgttgaggatcctgg

SEQ ID NO: 107076 - DNA, 75 bp, Artificial Sequence
  Synthetic
acagataattctgtcgttctctcccggaaatatacatcgtttccatggctgctaggctgtgctgccaactggatc

SEQ ID NO: 107077 - DNA, 75 bp, Artificial Sequence
  Synthetic
actgataattctgtcgttctctcccggaaatatacatcgtttccatggctgctaggctgtgctgccaactggatc

SEQ ID NO: 107078 - DNA, 75 bp, Artificial Sequence
  Synthetic
accgataattctgtcgttctctcccggaaatatacatcgtttccatggctgctaggctgtgctgccaactggatc

SEQ ID NO: 107079 - DNA, 75 bp, Artificial Sequence
  Synthetic
acggataattctgtcgttctctcccggaaatatacatcgtttccatggctgctaggctgtgctgccaactggatc

SEQ ID NO: 107080 - DNA, 75 bp, Artificial Sequence
  Synthetic
ctccacaacttccaccaaactcttcaagatcccagagtcagggccctgtacctttcctgctggtggctccagttc

SEQ ID NO: 107081 - DNA, 75 bp, Artificial Sequence
  Synthetic
ttcccatcccatcatcttgggcttcgcaaaatacctatgggagtgggctcagtccgtttctcatggctcagttta

SEQ ID NO: 107082 - DNA, 75 bp, Artificial Sequence
  Synthetic
gttcaccagaatcctgcaactttttaacctatgccttatcctctctcgttcatgtcctaatgcacaagcctctta

SEQ ID NO: 107083 - DNA, 75 bp, Artificial Sequence
  Synthetic
gagtccctttttacctctattaccaattttcttttgtctttgggtatacatttgaaccccaataaaaccaaacgt

SEQ ID NO: 107084 - DNA, 75 bp, Artificial Sequence
  Synthetic
agctctgtatcgggatgccttagaatctcctgagcattgttcacctcaccatactgcactcaggcaagccattct

SEQ ID NO: 107085 - DNA, 75 bp, Artificial Sequence
  Synthetic
tgatgtggtattgggggccaagtctgtacagcatcttgagtccctttttaccgctgttaccaattttcttttgtc

SEQ ID NO: 107086 - DNA, 75 bp, Artificial Sequence
  Synthetic
tcggcagtcaggaagacagcctactcccatctctccacctctaagagacagtcatcctcaggccgtgcggtggaa

SEQ ID NO: 107087 - DNA, 75 bp, Artificial Sequence
  Synthetic
ttagaatcaaatgaacattgctcagctcaccacactgctatcaggcaagctattgcgtgctggggtgagttgatg

SEQ ID NO: 107088 - DNA, 75 bp, Artificial Sequence
  Synthetic
ccaccaatcggcagtcaggaaggcagcctaccccaatcactccacctttgagagacactcatcctcaggccatgc

SEQ ID NO: 107089 - DNA, 75 bp, Artificial Sequence
  Synthetic
ctcccctcaattccaccagggtctgttaattcccagggtaaagggtctcctgctggttgctggtgggtccagttc

SEQ ID NO: 107090 - DNA, 75 bp, Artificial Sequence
  Synthetic
agaatctcctgagcattgttcacctcaccatactgcactcaggcaagccattctttgctggggggatgtaatgac

SEQ ID NO: 107091 - DNA, 75 bp, Artificial Sequence
  Synthetic
gggcagaatctttccaccagcaatcctctgggattttttcccgaccaccagttggatccagccttcagagcaaac

SEQ ID NO: 107092 - DNA, 75 bp, Artificial Sequence
  Synthetic
ctgtgtttttgctgagtgggaagaattaggcaatgagtccaggttaatgacctttgtattaggaggctgtaggca

SEQ ID NO: 107093 - DNA, 75 bp, Artificial Sequence
  Synthetic
ttcatttacatcaagacctaatttctaaatgtgaacaatttgtaggcccactcactaaaaatgaattaaggaggt

SEQ ID NO: 107094 - DNA, 75 bp, Artificial Sequence
  Synthetic
tcggcggtccgggagaaaaccaaccccaatttctccacctctaaaagacactcatccacagggcatggcgtggaa

SEQ ID NO: 107095 - DNA, 75 bp, Artificial Sequence
  Synthetic
aatagatgtcaacaatttgtaggccctctcaatgtaaatgaaaaaagaagattgaaattaattatgcctgctaga

SEQ ID NO: 107096 - DNA, 75 bp, Artificial Sequence
  Synthetic
aacttcatgggatatgtaattggaagttggggtactttaccgcaggaacatattgtacaaaaaatcaagcaatgt

SEQ ID NO: 107097 - DNA, 75 bp, Artificial Sequence
  Synthetic
tctcggaaatacacctcctttccatggctgctaggttgtgctgccaactggatcctgcgcgggacgtcctttgtc

SEQ ID NO: 107098 - DNA, 75 bp, Artificial Sequence
  Synthetic
ttctcatctgccggaccgtgtgcacttcgcttcacctctgcacgttgcatggagaccaccgtgaacgcccatcag

SEQ ID NO: 107099 - DNA, 75 bp, Artificial Sequence
  Synthetic
gaggagattaggttaaaggtctttgtactaggaggctgtaggcataaattggtctgttcaccagcaccatgcaac

SEQ ID NO: 107100 - DNA, 75 bp, Artificial Sequence
  Synthetic
aggattcctaggacccctgctcgtgttacaggcggggtttttcttgttgacaagaatcctcacaataccgcagag

SEQ ID NO: 107101 - DNA, 75 bp, Artificial Sequence
  Synthetic
ttccacagtttccaccaagctctgcaagatcccagagtcaggggtctgtatttgcctgctggtggctccagttca

SEQ ID NO: 107102 - DNA, 75 bp, Artificial Sequence
  Synthetic
ttcgggctaggattcacccctcctcatggaggtctgttggggtggagccctcaggctcagggcataacaacatca

SEQ ID NO: 107103 - DNA, 75 bp, Artificial Sequence
  Synthetic
tggccagaggcaaatcaggtaggagtgggatcattcgggccggggttcactccaccacacggcaatcttttgggg

SEQ ID NO: 107104 - DNA, 75 bp, Artificial Sequence
  Synthetic
gccccttttacacaatgtggctatcctgccttgatgcctttatatgcatgtatacactctaagcaggctttcact

SEQ ID NO: 107105 - DNA, 75 bp, Artificial Sequence
  Synthetic
ggtaccttaccacaggaacatattgtacaaaaaattaagcaatgtttccgaaaacttcctataaataggcctatc

SEQ ID NO: 107106 - DNA, 75 bp, Artificial Sequence
  Synthetic
gcctcatcttcttgttggttcttctggactatcaaggtatgttgcccgtttgtcctctaattccaggatcatcaa

SEQ ID NO: 107107 - DNA, 75 bp, Artificial Sequence
  Synthetic
cctcttcatcctgctgctatgcctcatcttcttgttggttcttctggactatcaaggtatgttgcccgtttgtcc

SEQ ID NO: 107108 - DNA, 75 bp, Artificial Sequence
  Synthetic
cagacaactattgtggtttcacatttcctgtcttacttttggaagagaaactgtccttgagtatttggtgtcttt

SEQ ID NO: 107109 - DNA, 75 bp, Artificial Sequence
  Synthetic
taaaattaattatgcctgctaggttctatcctaatcttaccaaatatttgcccttagataaaggcattaaacctt

SEQ ID NO: 107110 - DNA, 75 bp, Artificial Sequence
  Synthetic
cattgttcacccaaccatacagcactcaggcaagccattctgtgctggggtgagttaatgactctggcttcctgg

SEQ ID NO: 107111 - DNA, 75 bp, Artificial Sequence
  Synthetic
gtgggcaataatttggaagatccagcatctagggaactagtagttgattatgtcgttaatgacgtgggtctaaaa

SEQ ID NO: 107112 - DNA, 75 bp, Artificial Sequence
  Synthetic
gtgccgttccggccaacctcggggggcacctccctctacgcggtccccccgtctgtgccttgtcatccgccggac

SEQ ID NO: 107113 - DNA, 75 bp, Artificial Sequence
  Synthetic
cctgctggtggctccagttcagggacacagaaccctgctccgactattgcctctctcacatcatcaatcttctcg

SEQ ID NO: 107114 - DNA, 75 bp, Artificial Sequence
  Synthetic
ctgtatttacctgctggtggctccagttcagagacacagaaccctgctccgactattgcctctctcacatcatca

SEQ ID NO: 107115 - DNA, 75 bp, Artificial Sequence
  Synthetic
ctgtattttcctgctggtggctccagttcagagacacagaaccctgctccgactattgcctctctcacatcatca

SEQ ID NO: 107116 - DNA, 75 bp, Artificial Sequence
  Synthetic
ctgtatttccctgctggtggctccagttcagagacacagaaccctgctccgactattgcctctctcacatcatca

SEQ ID NO: 107117 - DNA, 75 bp, Artificial Sequence
  Synthetic
ctgtatttgcctgctggtggctccagttcagagacacagaaccctgctccgactattgcctctctcacatcatca

SEQ ID NO: 107118 - DNA, 75 bp, Artificial Sequence
  Synthetic
gcctgctagattctatcctaatactaccaaatatttgcccctagacaaaggtattaaaccttattatccagagca

SEQ ID NO: 107119 - DNA, 75 bp, Artificial Sequence
  Synthetic
gacatcgacccgtataaagaatttggagcttctgtggagttactctcttttttgccttctgacttctttccttct

SEQ ID NO: 107120 - DNA, 75 bp, Artificial Sequence
  Synthetic
tggtattgggggccaagtctgtacaacatcttgagtccctttttaccgctgttaccaattttcttttgtctttgg

SEQ ID NO: 107121 - DNA, 75 bp, Artificial Sequence
  Synthetic
ctccacaaccttccaccaaactctgcaagatcccagagtgagaggcctgtatctccctgctggtggctccagttc

SEQ ID NO: 107122 - DNA, 75 bp, Artificial Sequence
  Synthetic
atgccagtatatccgcctcctgcatctaccaatcgaaggtcaaaaaggcagcctaccccgctgtctccacctttg

SEQ ID NO: 107123 - DNA, 75 bp, Artificial Sequence
  Synthetic
aatccagattgggacttcaatcccaacaaggacacctggccagacgccaacaaggtaggagctggagcattcggg

SEQ ID NO: 107124 - DNA, 75 bp, Artificial Sequence
  Synthetic
gatcaccagttggacccagcattcagagcaaataccaacaatccagattgggacttcaatcccaaaaaggaccct

SEQ ID NO: 107125 - DNA, 75 bp, Artificial Sequence
  Synthetic
tcggacggaaactgcacctgtattcccatcccatcatcttgggctttaggaaaatacctatgggagtgggcctca

SEQ ID NO: 107126 - DNA, 75 bp, Artificial Sequence
  Synthetic
gcccgtttctcctggctcagtttactagtgccatttgttcagtggttcgtagggctttcccccactgtttggctt

SEQ ID NO: 107127 - DNA, 75 bp, Artificial Sequence
  Synthetic
gtggtttcacatttcttgtctcacttttggaagagaaaccgtcatagagtatttggtgtcttttggagtgtggat

SEQ ID NO: 107128 - DNA, 75 bp, Artificial Sequence
  Synthetic
ctgcaggatcccagagtcaggggtctgtattttcctgctggtggctccagttcaggaacagtaaaccctgctccg

SEQ ID NO: 107129 - DNA, 75 bp, Artificial Sequence
  Synthetic
ctcctactgcctccaccaatcggcagtcaggacggcaacctactcccatctctccaccgttgagaaacactcatc

SEQ ID NO: 107130 - DNA, 75 bp, Artificial Sequence
  Synthetic
ctcctactgcctccaccaatcggcagtcaggacggcaacctactcccatctctccaccgttgagatacactcatc

SEQ ID NO: 107131 - DNA, 75 bp, Artificial Sequence
  Synthetic
ctcctactgcctccaccaatcggcagtcaggacggcaacctactcccatctctccaccgttgagacacactcatc

SEQ ID NO: 107132 - DNA, 75 bp, Artificial Sequence
  Synthetic
ctcctactgcctccaccaatcggcagtcaggacggcaacctactcccatctctccaccgttgagagacactcatc

SEQ ID NO: 107133 - DNA, 75 bp, Artificial Sequence
  Synthetic
ttctcgccaacttacaaggcctttctgtgtaaacaatatctgaacctttaccccgttgcccggcaacggtcaggt

SEQ ID NO: 107134 - DNA, 75 bp, Artificial Sequence
  Synthetic
cccttacagtaaatgaaaacaggagactaaaattaattatgcctgctaggttttatcccaatgttactaaatatt

SEQ ID NO: 107135 - DNA, 75 bp, Artificial Sequence
  Synthetic
tcgcatctcctcaatctcctcaaggattggggaccctgtgccgaacatggcgaacatcacagcaggattcctagg

SEQ ID NO: 107136 - DNA, 75 bp, Artificial Sequence
  Synthetic
cagacaactctgttgtcctctctcggaagtacacctcctttccatggctgctcggttgtgctgccaactggatcc

SEQ ID NO: 107137 - DNA, 75 bp, Artificial Sequence
  Synthetic
acccctgctcgtgttaccggcgggattattcttgttgatgagactactaagaataccgcagagtcaaaactcgta

SEQ ID NO: 107138 - DNA, 75 bp, Artificial Sequence
  Synthetic
ctcactaacctcctgtcctccaattttccttggttaccggtggatgggtttggggggttttatcatattcctctt

SEQ ID NO: 107139 - DNA, 75 bp, Artificial Sequence
  Synthetic
cattctgctgctatccctcatcttcttattggtcttttcggattatcgaaggtatgttgcccgtttgtcctctaa

SEQ ID NO: 107140 - DNA, 75 bp, Artificial Sequence
  Synthetic
tacgtcccgtcggccctgaatcccgcggaccacccgtctcgcggccgttggggcctctatggtcccctttttcat

SEQ ID NO: 107141 - DNA, 75 bp, Artificial Sequence
  Synthetic
cctcatgttgctgtacaaaagtacggatggaaattgcacctgtattcccatcccatcatcttgggctttcgcaaa

SEQ ID NO: 107142 - DNA, 75 bp, Artificial Sequence
  Synthetic
ttatgtcattggaagttggggaaccttgccacaggaacatattgtgcagaaaatcaaacaatgttttagaaaact

SEQ ID NO: 107143 - DNA, 75 bp, Artificial Sequence
  Synthetic
ttccacagctttccaccaagctcctgctggtggctccagttcaggaacgctcaaccctgttccaactactgcctc

SEQ ID NO: 107144 - DNA, 75 bp, Artificial Sequence
  Synthetic
ctctacagcattccaccaagctctgcaaaatcccaaagtcaggggcctgtatcctgctggtggctccagttcagg

SEQ ID NO: 107145 - DNA, 75 bp, Artificial Sequence
  Synthetic
atacatttaaatccacacaaaacgaaaaggtggggttattctctccacttcatgggatatgtaattgggagctgg

SEQ ID NO: 107146 - DNA, 75 bp, Artificial Sequence
  Synthetic
ttaatgcccttatatgcatgtattcaagctaaacaggctttcactttctcgccaacttacaaggcctttctctgt

SEQ ID NO: 107147 - DNA, 75 bp, Artificial Sequence
  Synthetic
ctcaacccagttccaccaggctctgttagatccgagggtaagggctctgtattttcctgctggtggctccagttc

SEQ ID NO: 107148 - DNA, 75 bp, Artificial Sequence
  Synthetic
ttatttgcatactttatggaaggcgggaatcttatataagagagaatccacacgtagcgcctcattttgtgggtc

SEQ ID NO: 107149 - DNA, 75 bp, Artificial Sequence
  Synthetic
ggctatccccctcgaggtgatcaagggggggagacatctcattttctgtcactcaaagaagaagtgtgacgagct

SEQ ID NO: 107150 - DNA, 75 bp, Artificial Sequence
  Synthetic
ggcgtacgcctcacagggctacaaagtgcttgtgctcaatccatcggtggccgctacccttgggtttggcagcta

SEQ ID NO: 107151 - DNA, 75 bp, Artificial Sequence
  Synthetic
caagttcaacgcgtccggatgcccagagcgcatggccagctgccgccccattgacaagttcgctcaggggtgggg

SEQ ID NO: 107152 - DNA, 75 bp, Artificial Sequence
  Synthetic
tttgggcgtgcccccgcaagactgctagccgagtagcgttgggttgcgaaaggccttgtggtactgcctgatagg

SEQ ID NO: 107153 - DNA, 75 bp, Artificial Sequence
  Synthetic
tcttccatgccccccctggagggggagcctggggatccggatctcagcgacgggtcatggtcgacggtcagtagt

SEQ ID NO: 107154 - DNA, 75 bp, Artificial Sequence
  Synthetic
gctgatggggggtgttcggggggggcttatgacatcatcatatgtgacgagtgccattccacggatcctacgaca

SEQ ID NO: 107155 - DNA, 75 bp, Artificial Sequence
  Synthetic
ccccctggatcagtcaccgtcccccatccaaacatttcagaggtcgcactgcccaccactggggaaatccccttc

SEQ ID NO: 107156 - DNA, 75 bp, Artificial Sequence
  Synthetic
gcagaaatcctgcggaagtctcggagattcgccccggccctgcccatttgggcgcggccggactacaaccccccg

SEQ ID NO: 107157 - DNA, 75 bp, Artificial Sequence
  Synthetic
tggatgaatagcaccgggttcaccaagacgtgcgggggccccccgtgcaacatcgggggggtcggcaacaacacc

SEQ ID NO: 107158 - DNA, 75 bp, Artificial Sequence
  Synthetic
ctcagcatgtggcgctctaagaagacgcccatggggttttcctatgacaccagatgctttgactccacggtcaca

SEQ ID NO: 107159 - DNA, 75 bp, Artificial Sequence
  Synthetic
ggaacgagggttgcggatgggccggctggctcatgtccccgcgcggctctcgccctcattggggcccaaatgacc

SEQ ID NO: 107160 - DNA, 75 bp, Artificial Sequence
  Synthetic
gtcaggatgtatgtggggggcgtggagcacaggctcaacgccgcgtgcaactggactcggggagagcgctgtgac

SEQ ID NO: 107161 - DNA, 75 bp, Artificial Sequence
  Synthetic
ggtgtgagggcaatcgaggacgggattaattatgcgacagggaatcttcctggttgctctttttctattttcatc

SEQ ID NO: 107162 - DNA, 75 bp, Artificial Sequence
  Synthetic
cggatttggggcaaaggaggtgcgcagcttgtccaggagggccgtcaaccacatccagtccgtgtgggaggacct

SEQ ID NO: 107163 - DNA, 75 bp, Artificial Sequence
  Synthetic
actgtcccacaagacgctgtggccagaagccagcggcgcgggcgtacgggtagagggaagccaggaacatataga

SEQ ID NO: 107164 - DNA, 75 bp, Artificial Sequence
  Synthetic
tcgtgctggaggcggatagcatgatattgcatctgcccgggtgtgtgccgtgcataaaggagggtaacaactcga

SEQ ID NO: 107165 - DNA, 75 bp, Artificial Sequence
  Synthetic
taacatcatgctcctccaacgtctccgtggctcatgaccacactggacagagatattactacctcactcgtgacc

SEQ ID NO: 107166 - DNA, 75 bp, Artificial Sequence
  Synthetic
gcgccggcatgtgggcccaggagagggggctgtgcagtggatgaaccggctgatagcgttcgcttcgcggggtaa

SEQ ID NO: 107167 - DNA, 75 bp, Artificial Sequence
  Synthetic
ggggctgtgcagtggatgaaccggctgatagcgttcgcttcgcggggtaaccacgtctcccccacgcactatgtg

SEQ ID NO: 107168 - DNA, 75 bp, Artificial Sequence
  Synthetic
tgtctgctctgccatgtatatcggagacttgtgcggtggccttttcttggcgggacaacttttcacctggcgacc

SEQ ID NO: 107169 - DNA, 75 bp, Artificial Sequence
  Synthetic
catatgacacccgctgctttgactcaaccgtcacggagagggacataagaacagaagaatccatatatcaggctt

SEQ ID NO: 107170 - DNA, 75 bp, Artificial Sequence
  Synthetic
tacagactgggggccgtgcaaaatgagatcactactacacatccaattacaaaatatatcatgacctgcatgtca

SEQ ID NO: 107171 - DNA, 75 bp, Artificial Sequence
  Synthetic
acgaccaccttggtcctctcgagcgttcttaggatccccgaggttatcatggacatagtggtgggcggccactgg

SEQ ID NO: 107172 - DNA, 75 bp, Artificial Sequence
  Synthetic
agatcactactacacatccaattacaaaatatatcatgacctgcatgtcagctgacctagaggtgatcaccagta

SEQ ID NO: 107173 - DNA, 75 bp, Artificial Sequence
  Synthetic
tcggttctgcgattgcccatagcacccgaggctttactagcttcttttccgctgggccctctcagaagttgcagc

SEQ ID NO: 107174 - DNA, 75 bp, Artificial Sequence
  Synthetic
ttgtacgcgctcaagggctcattcgtgcatgcatgttggtgcggaaagtcgctgggggtcattatgtccaaatgg

SEQ ID NO: 107175 - DNA, 75 bp, Artificial Sequence
  Synthetic
aggcgacatgcactacccgtcatgactccccagacgctgacctcattgaggccaacctcctgtggcggcaggaga

SEQ ID NO: 107176 - DNA, 75 bp, Artificial Sequence
  Synthetic
gttcaactcctcggggtgtccggaacggttggcagcatgtaggtctctggcagatttcaaacaagggtggggccc

SEQ ID NO: 107177 - DNA, 75 bp, Artificial Sequence
  Synthetic
gttcaactcctcggggtgtccggaacggttggcagcatgtaggtctctggcagatttcaatcaagggtggggccc

SEQ ID NO: 107178 - DNA, 75 bp, Artificial Sequence
  Synthetic
gttcaactcctcggggtgtccggaacggttggcagcatgtaggtctctggcagatttcaaccaagggtggggccc

SEQ ID NO: 107179 - DNA, 75 bp, Artificial Sequence
  Synthetic
gttcaactcctcggggtgtccggaacggttggcagcatgtaggtctctggcagatttcaagcaagggtggggccc

SEQ ID NO: 107180 - DNA, 75 bp, Artificial Sequence
  Synthetic
ctctcaacttccaccacccttctccttaacatactaggagggtgggtggcctcccagatagcgccgccaacagcg

SEQ ID NO: 107181 - DNA, 75 bp, Artificial Sequence
  Synthetic
ttaacatactaggagggtgggtggcctcccagatagcgccgccaacagcgtcaacggcgtttgttgtgagcggta

SEQ ID NO: 107182 - DNA, 75 bp, Artificial Sequence
  Synthetic
ggccctgtctactgcttcacgcccactcctgtcgtcgtgggcacgactgataggaggggcaaccccacttacacc

SEQ ID NO: 107183 - DNA, 75 bp, Artificial Sequence
  Synthetic
cccctcccacattacagcggagacggctaggcgtaggctggccagggggtctcccccctccttggccagctcttc

SEQ ID NO: 107184 - DNA, 75 bp, Artificial Sequence
  Synthetic
atgagcacaaatcccaatcctcaaagaaaaaccaaaagaaacacaaaccgcctctcccaggaggacaagttcccg

SEQ ID NO: 107185 - DNA, 75 bp, Artificial Sequence
  Synthetic
tatccggtgcacttgtcgcatttaagatcatgagcggcgaggcccctgctttagaggacatggttaatctcctac

SEQ ID NO: 107186 - DNA, 75 bp, Artificial Sequence
  Synthetic
agacttgtggcggcccgccttgtcagataagtccgggcgactacaacagctcggccggtgagttgttatgcccca

SEQ ID NO: 107187 - DNA, 75 bp, Artificial Sequence
  Synthetic
gtccggatgcccggagcgcatggccagctgccgccccatcgacacgttcgctcaggggtggggtcccatcactta

SEQ ID NO: 107188 - DNA, 75 bp, Artificial Sequence
  Synthetic
agctgccgccccatcgacacgttcgctcaggggtggggtcccatcacttatgctaagccttcggcttcggaccag

SEQ ID NO: 107189 - DNA, 75 bp, Artificial Sequence
  Synthetic
gcactatccttgcaccattaattataccctacacagcgtccgcatgttcgtggggggtgttgaacacagattcac

SEQ ID NO: 107190 - DNA, 75 bp, Artificial Sequence
  Synthetic
gacaccatgcacctgcggcagctcggacctctacttggtcacgaggcatgccgatgtcattccggtgcgccggcg

SEQ ID NO: 107191 - DNA, 75 bp, Artificial Sequence
  Synthetic
gactccacaactggattaacggggattggacaacaccgtgtgccacaagttggttgagggacgtgtgggattggg

SEQ ID NO: 107192 - DNA, 75 bp, Artificial Sequence
  Synthetic
ttgccgtgctcttttactacgatgccagctttgtcaaccggccttattcatttacatcagaacattgtggacgtg

SEQ ID NO: 107193 - DNA, 75 bp, Artificial Sequence
  Synthetic
attgtgtacgagatggaggacatgattctccacctgccaggatgcgtaccctgtgttcgggaaggcaactcctcg

SEQ ID NO: 107194 - DNA, 75 bp, Artificial Sequence
  Synthetic
catgcctctggttaatgttgcttatcagcaccgtcgaagcggccgtggagaggcttgtcattcttaacgcagcta

SEQ ID NO: 107195 - DNA, 75 bp, Artificial Sequence
  Synthetic
catgcctctggttaatgttgcttatctgcaccgtcgaagcggccgtggagaggcttgtcattcttaacgcagcta

SEQ ID NO: 107196 - DNA, 75 bp, Artificial Sequence
  Synthetic
catgcctctggttaatgttgcttatccgcaccgtcgaagcggccgtggagaggcttgtcattcttaacgcagcta

SEQ ID NO: 107197 - DNA, 75 bp, Artificial Sequence
  Synthetic
catgcctctggttaatgttgcttatcggcaccgtcgaagcggccgtggagaggcttgtcattcttaacgcagcta

SEQ ID NO: 107198 - DNA, 75 bp, Artificial Sequence
  Synthetic
ccttagcggccagagacaccactgtccccatccagacgatcagggaccacgtcgacttgctggtcggggccgccg

SEQ ID NO: 107199 - DNA, 75 bp, Artificial Sequence
  Synthetic
agcgctcactcccacgctcgcggccaggaacgccagcatccccactacgacaatacgacgccacgtcgatttgct

SEQ ID NO: 107200 - DNA, 75 bp, Artificial Sequence
  Synthetic
tacgtggtgggggcaactgctgacaatcttaagtgcccgtgccaggtgccagcacccgagttcttcacggaggtt

SEQ ID NO: 107201 - DNA, 75 bp, Artificial Sequence
  Synthetic
ggggatgtggccgctcctactggtggtcctcatgctgcctcaaagggcttatgcgtgggacaatgaacagacagc

SEQ ID NO: 107202 - DNA, 75 bp, Artificial Sequence
  Synthetic
ggggatgtggccgctcctactggtggtcctcatgctgcctcaaagggcttatgcgtgggacaatgaacagactgc

SEQ ID NO: 107203 - DNA, 75 bp, Artificial Sequence
  Synthetic
ggggatgtggccgctcctactggtggtcctcatgctgcctcaaagggcttatgcgtgggacaatgaacagaccgc

SEQ ID NO: 107204 - DNA, 75 bp, Artificial Sequence
  Synthetic
ggggatgtggccgctcctactggtggtcctcatgctgcctcaaagggcttatgcgtgggacaatgaacagacggc

SEQ ID NO: 107205 - DNA, 75 bp, Artificial Sequence
  Synthetic
ggggatgtggccgctcctactggtggtcctcatgctgcctcaaagggcttatgcgtgggacaatgatcagacagc

SEQ ID NO: 107206 - DNA, 75 bp, Artificial Sequence
  Synthetic
ggggatgtggccgctcctactggtggtcctcatgctgcctcaaagggcttatgcgtgggacaatgatcagactgc

SEQ ID NO: 107207 - DNA, 75 bp, Artificial Sequence
  Synthetic
ggggatgtggccgctcctactggtggtcctcatgctgcctcaaagggcttatgcgtgggacaatgatcagaccgc

SEQ ID NO: 107208 - DNA, 75 bp, Artificial Sequence
  Synthetic
ggggatgtggccgctcctactggtggtcctcatgctgcctcaaagggcttatgcgtgggacaatgatcagacggc

SEQ ID NO: 107209 - DNA, 75 bp, Artificial Sequence
  Synthetic
ggggatgtggccgctcctactggtggtcctcatgctgcctcaaagggcttatgcgtgggacaatgaccagacagc

SEQ ID NO: 107210 - DNA, 75 bp, Artificial Sequence
  Synthetic
ggggatgtggccgctcctactggtggtcctcatgctgcctcaaagggcttatgcgtgggacaatgaccagactgc

SEQ ID NO: 107211 - DNA, 75 bp, Artificial Sequence
  Synthetic
ggggatgtggccgctcctactggtggtcctcatgctgcctcaaagggcttatgcgtgggacaatgaccagaccgc

SEQ ID NO: 107212 - DNA, 75 bp, Artificial Sequence
  Synthetic
ggggatgtggccgctcctactggtggtcctcatgctgcctcaaagggcttatgcgtgggacaatgaccagacggc

SEQ ID NO: 107213 - DNA, 75 bp, Artificial Sequence
  Synthetic
ggggatgtggccgctcctactggtggtcctcatgctgcctcaaagggcttatgcgtgggacaatgagcagacagc

SEQ ID NO: 107214 - DNA, 75 bp, Artificial Sequence
  Synthetic
ggggatgtggccgctcctactggtggtcctcatgctgcctcaaagggcttatgcgtgggacaatgagcagactgc

SEQ ID NO: 107215 - DNA, 75 bp, Artificial Sequence
  Synthetic
ggggatgtggccgctcctactggtggtcctcatgctgcctcaaagggcttatgcgtgggacaatgagcagaccgc

SEQ ID NO: 107216 - DNA, 75 bp, Artificial Sequence
  Synthetic
ggggatgtggccgctcctactggtggtcctcatgctgcctcaaagggcttatgcgtgggacaatgagcagacggc

SEQ ID NO: 107217 - DNA, 75 bp, Artificial Sequence
  Synthetic
agcacccgagttcttcacggaggttgatggagtaagactgcaaaggtacgcacctgcatgcagacctctcctgag

SEQ ID NO: 107218 - DNA, 75 bp, Artificial Sequence
  Synthetic
agcacccgagttcttcacggaggttgatggagtaagactgcaaaggtacgcacctgcttgcagacctctcctgag

SEQ ID NO: 107219 - DNA, 75 bp, Artificial Sequence
  Synthetic
agcacccgagttcttcacggaggttgatggagtaagactgcaaaggtacgcacctgcctgcagacctctcctgag

SEQ ID NO: 107220 - DNA, 75 bp, Artificial Sequence
  Synthetic
agcacccgagttcttcacggaggttgatggagtaagactgcaaaggtacgcacctgcgtgcagacctctcctgag

SEQ ID NO: 107221 - DNA, 75 bp, Artificial Sequence
  Synthetic
agcacccgagttcttcacggaggttgatggagtaagactgcataggtacgcacctgcatgcagacctctcctgag

SEQ ID NO: 107222 - DNA, 75 bp, Artificial Sequence
  Synthetic
agcacccgagttcttcacggaggttgatggagtaagactgcataggtacgcacctgcttgcagacctctcctgag

SEQ ID NO: 107223 - DNA, 75 bp, Artificial Sequence
  Synthetic
agcacccgagttcttcacggaggttgatggagtaagactgcataggtacgcacctgcctgcagacctctcctgag

SEQ ID NO: 107224 - DNA, 75 bp, Artificial Sequence
  Synthetic
agcacccgagttcttcacggaggttgatggagtaagactgcataggtacgcacctgcgtgcagacctctcctgag

SEQ ID NO: 107225 - DNA, 75 bp, Artificial Sequence
  Synthetic
agcacccgagttcttcacggaggttgatggagtaagactgcacaggtacgcacctgcatgcagacctctcctgag

SEQ ID NO: 107226 - DNA, 75 bp, Artificial Sequence
  Synthetic
agcacccgagttcttcacggaggttgatggagtaagactgcacaggtacgcacctgcttgcagacctctcctgag

SEQ ID NO: 107227 - DNA, 75 bp, Artificial Sequence
  Synthetic
agcacccgagttcttcacggaggttgatggagtaagactgcacaggtacgcacctgcctgcagacctctcctgag

SEQ ID NO: 107228 - DNA, 75 bp, Artificial Sequence
  Synthetic
agcacccgagttcttcacggaggttgatggagtaagactgcacaggtacgcacctgcgtgcagacctctcctgag

SEQ ID NO: 107229 - DNA, 75 bp, Artificial Sequence
  Synthetic
agcacccgagttcttcacggaggttgatggagtaagactgcagaggtacgcacctgcatgcagacctctcctgag

SEQ ID NO: 107230 - DNA, 75 bp, Artificial Sequence
  Synthetic
agcacccgagttcttcacggaggttgatggagtaagactgcagaggtacgcacctgcttgcagacctctcctgag

SEQ ID NO: 107231 - DNA, 75 bp, Artificial Sequence
  Synthetic
agcacccgagttcttcacggaggttgatggagtaagactgcagaggtacgcacctgcctgcagacctctcctgag

SEQ ID NO: 107232 - DNA, 75 bp, Artificial Sequence
  Synthetic
agcacccgagttcttcacggaggttgatggagtaagactgcagaggtacgcacctgcgtgcagacctctcctgag

SEQ ID NO: 107233 - DNA, 75 bp, Artificial Sequence
  Synthetic
atggcccgagccgaggccatcatacatgaatgggtgcctgatctgcgggtcaggggcggcagagatgccgtcatc

SEQ ID NO: 107234 - DNA, 75 bp, Artificial Sequence
  Synthetic
ttggcccgagccgaggccatcatacatgaatgggtgcctgatctgcgggtcaggggcggcagagatgccgtcatc

SEQ ID NO: 107235 - DNA, 75 bp, Artificial Sequence
  Synthetic
ctggcccgagccgaggccatcatacatgaatgggtgcctgatctgcgggtcaggggcggcagagatgccgtcatc

SEQ ID NO: 107236 - DNA, 75 bp, Artificial Sequence
  Synthetic
gtggcccgagccgaggccatcatacatgaatgggtgcctgatctgcgggtcaggggcggcagagatgccgtcatc

SEQ ID NO: 107237 - DNA, 75 bp, Artificial Sequence
  Synthetic
tctgacccagcacacataaccgcagaaacggcgggtcgacgcctcgggaggggctcccctccgtcgctggccagc

SEQ ID NO: 107238 - DNA, 75 bp, Artificial Sequence
  Synthetic
catccttaaaggcaacatgcaccattgccgcggaccaccctgacgctgagctgattgaggccaacctcctgtgga

SEQ ID NO: 107239 - DNA, 75 bp, Artificial Sequence
  Synthetic
agacaccttacttcgtgcgcgcccacatattgctgcgggcctgtatgttcttccgcaagcttgcttgcggtaggt

SEQ ID NO: 107240 - DNA, 75 bp, Artificial Sequence
  Synthetic
tagccagggtgctcagcagaggctccagcttgtgaacaccaacggcagttggcacctcaacaggacggccttgaa

SEQ ID NO: 107241 - DNA, 75 bp, Artificial Sequence
  Synthetic
ggatgctcagggggtgcttatgacatcatcatatgtgacgagtgccattctacggaccctaccacggtcctaggg

SEQ ID NO: 107242 - DNA, 75 bp, Artificial Sequence
  Synthetic
gctaggacggtttgcgggccggtctactgtttcactcccagccctgttgtcgtgggcaccactgacaagcagggc

SEQ ID NO: 107243 - DNA, 75 bp, Artificial Sequence
  Synthetic
aatatcagtggctgcggagtgtcacaggccgcccaggcccaagttcccacctgcactacctatatgggcgaggcc

SEQ ID NO: 107244 - DNA, 75 bp, Artificial Sequence
  Synthetic
tctggccattgctgtagagccaatcatcttctccccaatggagaagaagatcattacgtggggcgcggacactgc

SEQ ID NO: 107245 - DNA, 75 bp, Artificial Sequence
  Synthetic
cccatcacccactttgcccaggggtatgggcctatcacctatgcctcccattccagcagggttgcaaatgacagc

SEQ ID NO: 107246 - DNA, 75 bp, Artificial Sequence
  Synthetic
cgtcccagaaaatccagcttgtaaacaccaacggcagctggcacatcaacaggactgccctgaactgcaacgact

SEQ ID NO: 107247 - DNA, 75 bp, Artificial Sequence
  Synthetic
cccccgcctcgacggaagagggtcgtaaagctcgatgaatcagctgctgctgaggcgctcgccgagatggcccgg

SEQ ID NO: 107248 - DNA, 75 bp, Artificial Sequence
  Synthetic
ctcttggctcccatcacggcgtacgcacaacagacgcggggcctggtgagtactattgtgaccagcttgacaggc

SEQ ID NO: 107249 - DNA, 75 bp, Artificial Sequence
  Synthetic
taaagctcgatgaatcagctgctgctgaggcgctcgccgagatggcccggaaatcattcccattgaatccatcag

SEQ ID NO: 107250 - DNA, 75 bp, Artificial Sequence
  Synthetic
aaagtgccgtactttgtgcgcgctcaagggctcatccgtgcgtgtatgttggtgcggaaaaccgctgggggtcat

SEQ ID NO: 107251 - DNA, 75 bp, Artificial Sequence
  Synthetic
gcggcgcccccgcgtgtaacatcgggggcagcggcaataacatcctgcaatgccccactgactgcttccgaaaac

SEQ ID NO: 107252 - DNA, 75 bp, Artificial Sequence
  Synthetic
catgcccccccttgagggcgagcctggagaccccgacttaagttcgggatcatggtctacagtcagtgaggatgg

SEQ ID NO: 107253 - DNA, 75 bp, Artificial Sequence
  Synthetic
atggagcaggctccaaaacactggcaggccacaaggggccggtatgccagatgtacacaaatgtggatcaggact

SEQ ID NO: 107254 - DNA, 75 bp, Artificial Sequence
  Synthetic
atggagcaggctccaaaacactggcaggcctcaaggggccggtatgccagatgtacacaaatgtggatcaggact

SEQ ID NO: 107255 - DNA, 75 bp, Artificial Sequence
  Synthetic
atggagcaggctccaaaacactggcaggccccaaggggccggtatgccagatgtacacaaatgtggatcaggact

SEQ ID NO: 107256 - DNA, 75 bp, Artificial Sequence
  Synthetic
atggagcaggctccaaaacactggcaggccgcaaggggccggtatgccagatgtacacaaatgtggatcaggact

SEQ ID NO: 107257 - DNA, 75 bp, Artificial Sequence
  Synthetic
agacaggggtcaattgtctcccttgctacactccaccacggaatgggctattttaccctgctctttctcagacct

SEQ ID NO: 107258 - DNA, 75 bp, Artificial Sequence
  Synthetic
tccttcctcgtgttcttctgctttgcgtggtacctgaagggtaggtgggtgcccggagcggtctacgccctctac

SEQ ID NO: 107259 - DNA, 75 bp, Artificial Sequence
  Synthetic
cgtcttctctgacatggagaccaagatcatcacctggggggcagacaccgcggcgtgtggagacatcatctcggg

SEQ ID NO: 107260 - DNA, 75 bp, Artificial Sequence
  Synthetic
caactacactgtgaccaaggtccggatgtttgtgggggggatcgagcacaggtttgaagctgcctgcaattggac

SEQ ID NO: 107261 - DNA, 75 bp, Artificial Sequence
  Synthetic
tgcgaggcgcaagggcgacactcgagcggccctcctatcacctagacctataagcactctgaagggttcctcggg

SEQ ID NO: 107262 - DNA, 75 bp, Artificial Sequence
  Synthetic
gacaccacaacatggtgtactctaccaccactcgcagtgcaaccctccgccagaagaaagtgacttttgacagag

SEQ ID NO: 107263 - DNA, 75 bp, Artificial Sequence
  Synthetic
gcgtggcgacccctgcgccctggacgacagggacagggcagaattgagcccgctcctactgaccactacacaatg

SEQ ID NO: 107264 - DNA, 75 bp, Artificial Sequence
  Synthetic
tggtaggcggggtccttgcggctctggccgcatactgcctgacaacgggcagtgtggtcattgtgggcaggatca

SEQ ID NO: 107265 - DNA, 75 bp, Artificial Sequence
  Synthetic
aacatggagacgaccatgcggtctcccgtcttcagtgataactcttcgccgccagcggttccccagacctatcag

SEQ ID NO: 107266 - DNA, 75 bp, Artificial Sequence
  Synthetic
tttacagcggcctggtacttgaagggcagggtggtccctgtggccacgtactctgttctcggcttgtggtccttt

SEQ ID NO: 107267 - DNA, 75 bp, Artificial Sequence
  Synthetic
ctccgacgacggcgacgcaggatccgacgttgagtcgtactcctccatgcccccccttgagggggagccggggga

SEQ ID NO: 107268 - DNA, 75 bp, Artificial Sequence
  Synthetic
gggaatgcagctcgccgagcaattcaagcagaaggcgctcgggttgctgcagacagccaccaagcaagcggaggc

SEQ ID NO: 107269 - DNA, 75 bp, Artificial Sequence
  Synthetic
ctccaatggcagttggcacatcaataggacggctctgaactgtaatgacagcctcaacaccggctggctagcagg

SEQ ID NO: 107270 - DNA, 75 bp, Artificial Sequence
  Synthetic
ttgcagcaactctgagtttcggggtatacatgagcaaagctcacggtatagacccaaacatcaggacgggtgtta

SEQ ID NO: 107271 - DNA, 75 bp, Artificial Sequence
  Synthetic
tgctcatatcgcaggcggaagcagccttggagaacctgatcgtcctcaacgccgcgtctctcgctggggcgcacg

SEQ ID NO: 107272 - DNA, 75 bp, Artificial Sequence
  Synthetic
cacctattcctaccactattatggctaagaatgaagtgttctgcgtggacgcccggaaaggtggtcggaagccag

SEQ ID NO: 107273 - DNA, 75 bp, Artificial Sequence
  Synthetic
ctggctgatggggggtgctcaggaggagcatacgacattatcatctgtgacgaatgccactccacagaccctacg

SEQ ID NO: 107274 - DNA, 75 bp, Artificial Sequence
  Synthetic
cctgctcttgctagcgctgccccaacgggcatacgctatggatcgggagatggcggcatcctgtgggggcctagt

SEQ ID NO: 107275 - DNA, 75 bp, Artificial Sequence
  Synthetic
ccccggccgtaccgcagacattccaagtggcccatctacacgctcccaccggcagcggcaagagcactaaggtgc

SEQ ID NO: 107276 - DNA, 75 bp, Artificial Sequence
  Synthetic
cccatcctaacataacagagactgccctcccaactacgggagagataccattttatgggaaggccatccccctag

SEQ ID NO: 107277 - DNA, 75 bp, Artificial Sequence
  Synthetic
tggtggcttcagtattttctgaccagagtagaagcgcaattgcacgtgtgggtcccccccctcaacgtccgaggg

SEQ ID NO: 107278 - DNA, 75 bp, Artificial Sequence
  Synthetic
attttatagaggtgttgacgtagctgttatccccacctcaggcgatgtcgtcatttgcgcgacggacgccctcat

SEQ ID NO: 107279 - DNA, 75 bp, Artificial Sequence
  Synthetic
cagagctaatctttaccatcaccaaaatcttgctcgccatactcggtccgctcatggtgctccaggctggcttaa

SEQ ID NO: 107280 - DNA, 75 bp, Artificial Sequence
  Synthetic
tgctcctagcggacgccagggtttgcgcctgtatatggatgctcatcttgctgggccaagctgaggcagcactag

SEQ ID NO: 107281 - DNA, 75 bp, Artificial Sequence
  Synthetic
ggccagtacgcgcagatggtgctccttaaactgggggcggccaccggcacttatatctacaatcacctcactcca

SEQ ID NO: 107282 - DNA, 75 bp, Artificial Sequence
  Synthetic
accactgtcccccaagatgcagtctcgcgtagccaacggcgaggccgaactggaagagggaaaccaggggtgtat

SEQ ID NO: 107283 - DNA, 75 bp, Artificial Sequence
  Synthetic
accactgtcccccaagatgctgtctcgcgtagccaacggcgaggccgaactggaagagggaaaccaggggtgtat

SEQ ID NO: 107284 - DNA, 75 bp, Artificial Sequence
  Synthetic
accactgtcccccaagatgccgtctcgcgtagccaacggcgaggccgaactggaagagggaaaccaggggtgtat

SEQ ID NO: 107285 - DNA, 75 bp, Artificial Sequence
  Synthetic
accactgtcccccaagatgcggtctcgcgtagccaacggcgaggccgaactggaagagggaaaccaggggtgtat

SEQ ID NO: 107286 - DNA, 75 bp, Artificial Sequence
  Synthetic
acacggcggcgtgcggggacatcctcgaaggactgccggtctcagcccgtctggggagggaggtgctgttgggcc

SEQ ID NO: 107287 - DNA, 75 bp, Artificial Sequence
  Synthetic
ctgagacgaccgttaggctgcgagcctaccttaacacccctggccttcctgtctgtcaagatcaccttgagtttt

SEQ ID NO: 107288 - DNA, 75 bp, Artificial Sequence
  Synthetic
ctccatggttattctcccggtgaactcaatcgggtggcatccagcctcagattgcttggggcgccaccgttgaga

SEQ ID NO: 107289 - DNA, 75 bp, Artificial Sequence
  Synthetic
aacggtctgcgccagagctaaagctcccccgccgtcttgggacttgatgtggaagtgtctcatcaggcttaagcc

SEQ ID NO: 107290 - DNA, 75 bp, Artificial Sequence
  Synthetic
gtcacccagacagtcgacttcagcttagaccctactttcaccattgagacgacgaccgtgcctcaagacgcggtg

SEQ ID NO: 107291 - DNA, 75 bp, Artificial Sequence
  Synthetic
tctgcagacctggaggtcataactagcacatgggtaatagtgggcggcgttttagccgcattagcagcttattgc

SEQ ID NO: 107292 - DNA, 75 bp, Artificial Sequence
  Synthetic
ctccggacacgtcgtaggcctattcagggctgcggtgtgtacccgtggggtggcgaaagcagtagatttcgtgcc

SEQ ID NO: 107293 - DNA, 75 bp, Artificial Sequence
  Synthetic
tggaggagtgctcaaagcatatcccctatcttgccgaaggccggcagattgccgagcagtttaggcaaaaggccc

SEQ ID NO: 107294 - DNA, 75 bp, Artificial Sequence
  Synthetic
aatgagagcctcgagactggctggttagcagggctcttttaccaccacaaattcaactcttcaggttgctccgaa

SEQ ID NO: 107295 - DNA, 75 bp, Artificial Sequence
  Synthetic
gtcagagaataaggtagtaatcctagactcttttgacccgctccgagcggaggaggatgagagggaagtatccgt

SEQ ID NO: 107296 - DNA, 75 bp, Artificial Sequence
  Synthetic
gaacttcataagcgggatccagtacctagcaggtttgtccactttacccggaaatccagccgtagcatccatgat

SEQ ID NO: 107297 - DNA, 75 bp, Artificial Sequence
  Synthetic
gaacttcataagcgggatccagtacctagcaggtttgtccactttacccggtaatccagccgtagcatccatgat

SEQ ID NO: 107298 - DNA, 75 bp, Artificial Sequence
  Synthetic
gaacttcataagcgggatccagtacctagcaggtttgtccactttacccggcaatccagccgtagcatccatgat

SEQ ID NO: 107299 - DNA, 75 bp, Artificial Sequence
  Synthetic
gaacttcataagcgggatccagtacctagcaggtttgtccactttacccgggaatccagccgtagcatccatgat

SEQ ID NO: 107300 - DNA, 75 bp, Artificial Sequence
  Synthetic
cagccctccggggcatgggtgtcaatgccgttgcctactataggggtcttgacgtctccgttataccaactcaag

SEQ ID NO: 107301 - DNA, 75 bp, Artificial Sequence
  Synthetic
gcgtccacggctttcgtcgtgagcggcttagctggcgctgcggtcgcgagcattggacttgggagagtgttggtt

SEQ ID NO: 107302 - DNA, 75 bp, Artificial Sequence
  Synthetic
gcgtccacggctttcgtcgtgagcggcttagctggcgctgcggtcgcgagcattggtcttgggagagtgttggtt

SEQ ID NO: 107303 - DNA, 75 bp, Artificial Sequence
  Synthetic
gcgtccacggctttcgtcgtgagcggcttagctggcgctgcggtcgcgagcattggccttgggagagtgttggtt

SEQ ID NO: 107304 - DNA, 75 bp, Artificial Sequence
  Synthetic
gcgtccacggctttcgtcgtgagcggcttagctggcgctgcggtcgcgagcattgggcttgggagagtgttggtt

SEQ ID NO: 107305 - DNA, 75 bp, Artificial Sequence
  Synthetic
cttacatcgaacagggaatgcagctcgccgagcaattcaagcagaaggcgctcgggttgctgcaaacagccacca

SEQ ID NO: 107306 - DNA, 75 bp, Artificial Sequence
  Synthetic
tacccgctctgctgtcacctggcgcccttgtggtgggagtcgtatgcgctgccatcctgaggcgtcatgttgggc

SEQ ID NO: 107307 - DNA, 75 bp, Artificial Sequence
  Synthetic
aaattgaccggcctgggcctcaacgcagttgcctattaccgaggtcttgacgtttctgtcattccaacccaagga

SEQ ID NO: 107308 - DNA, 75 bp, Artificial Sequence
  Synthetic
cgcggccttgacgtgtccgtcatcccgaccagcggtgatgttgtcgtcgtggcaactgatgctctcatgaccggc

SEQ ID NO: 107309 - DNA, 75 bp, Artificial Sequence
  Synthetic
aaaaaaggtgacgcaaatattaagttcattgaccattaccagcctgcttcgcaggcttcatcagtggatcaacga

SEQ ID NO: 107310 - DNA, 75 bp, Artificial Sequence
  Synthetic
ctaccaggccacagtatgcgctagggcaaaggcccctcctccttcgtgggacgtgatgtggaagtgtctaactag

SEQ ID NO: 107311 - DNA, 75 bp, Artificial Sequence
  Synthetic
ttccctcgtctaccagggattccttttctatcttgccagcgcggctataggggaacctgggcaggggacggggtg

SEQ ID NO: 107312 - DNA, 75 bp, Artificial Sequence
  Synthetic
tgcgggcatacctgaataccccggggttgcccgtatgccaggaccacttagagttctgggagggggtttttaccg

SEQ ID NO: 107313 - DNA, 75 bp, Artificial Sequence
  Synthetic
ggacctttccaatcaatgctaccaccactggcccgagcgttccaataccagcccccaactataagcgtgctcttt

SEQ ID NO: 107314 - DNA, 75 bp, Artificial Sequence
  Synthetic
accaggcaactgtgtgcgccaaggccctggctccacctccatcatgggaccagcagtggaagtgtctaataaggc

SEQ ID NO: 107315 - DNA, 75 bp, Artificial Sequence
  Synthetic
tcctgcaccggagttcttcactgaggtggatggcgtgaggattcaccgttacgcgccaccttgcaagcccctgct

SEQ ID NO: 107316 - DNA, 75 bp, Artificial Sequence
  Synthetic
ctcactgacccctcacacatcactgcagagacggcagctcgacgcttaaagaggggatctcccccctccttggca

SEQ ID NO: 107317 - DNA, 75 bp, Artificial Sequence
  Synthetic
ggaggcaggagatgggggggaacatcactcgtgtggagtcagagaacaaagtggtcgtactcgattcttttgacc

SEQ ID NO: 107318 - DNA, 75 bp, Artificial Sequence
  Synthetic
agacaaggggcctcctggggtgcataatcaccagcctgaccggccgggacaaaaaccaagtggagggtgaggtcc

SEQ ID NO: 107319 - DNA, 75 bp, Artificial Sequence
  Synthetic
acctgactataatccccctctcctacagaagtggcaaatgcccgggtatgaaccccctatcgtgtctgggtgtgc

SEQ ID NO: 107320 - DNA, 75 bp, Artificial Sequence
  Synthetic
cgaccctaacatcagaactggggtaaggaccatcaccacgggcgcccccatcacgtactccacctatggcaagtt

SEQ ID NO: 107321 - DNA, 75 bp, Artificial Sequence
  Synthetic
gacaagctatttgtagagagccgcgatgactcggggtcgagctctggcttagggccgtctacgactcccccgccc

SEQ ID NO: 107322 - DNA, 75 bp, Artificial Sequence
  Synthetic
caggttcctggtccactgttagcgaagaggacgatgtcatctgctgttctatgtcctattcctggacgggggcct

SEQ ID NO: 107323 - DNA, 75 bp, Artificial Sequence
  Synthetic
ccaaaaccccctcctaattacaagaccgcaatttggagggtggcagcgtctgagtacgttgaggtcacgcagcat

SEQ ID NO: 107324 - DNA, 75 bp, Artificial Sequence
  Synthetic
acatggtgtactcaacatcatcacgcagcgctggtcttcgccagaagaaagtcacatttgatcggctccaagtag

SEQ ID NO: 107325 - DNA, 75 bp, Artificial Sequence
  Synthetic
accacctccacggagaaagaagacggttgttctgacagaatccactgtgtcttctgccttggccgaacttgctgt

SEQ ID NO: 107326 - DNA, 75 bp, Artificial Sequence
  Synthetic
tgggactgggtttgtgaagtgctgagcgactttaaaaggtggctcggtgccaagctcatgccccaaatgccaggg

SEQ ID NO: 107327 - DNA, 75 bp, Artificial Sequence
  Synthetic
agctcatagaggctaacctcctatggaggcaggagatgggcggtaacatcaccagggttgagtcagagaacaaag

SEQ ID NO: 107328 - DNA, 75 bp, Artificial Sequence
  Synthetic
accgcattcggcccgatcaaaatacgggtacggagcacgggacgtaaggagccatgccagcaaggccgttaacca

SEQ ID NO: 107329 - DNA, 75 bp, Artificial Sequence
  Synthetic
gggtacggagcacgggacgtaaggagccatgccagcaaggccgttaaccacatcaactccgtgtggaaggacttg

SEQ ID NO: 107330 - DNA, 75 bp, Artificial Sequence
  Synthetic
ctcctagggtgtataatcaccagcctgaccggccgggacaaaaaccaagtggagggtgaggtccagattgtgtca

SEQ ID NO: 107331 - DNA, 75 bp, Artificial Sequence
  Synthetic
caagggagtctggcggggagacggcatcatgcaaaccacctgcccatgtggagcacagatcaccggacatgtcaa

SEQ ID NO: 107332 - DNA, 75 bp, Artificial Sequence
  Synthetic
ggtggtcgcaaagccgctcgactgatagtctacccagacttgagtgtgcgggtttgcgaaaagatggcactgtat

SEQ ID NO: 107333 - DNA, 75 bp, Artificial Sequence
  Synthetic
caaagaagacaccaatgggtttttcctatgacacaaggtgttttgattcaactgtcactgagcgtgacattcgta

SEQ ID NO: 107334 - DNA, 75 bp, Artificial Sequence
  Synthetic
atcccccttgaggtaatcaagggggggagacatctcatcttttgccactcaaagaagaagtgcgacgagctcgcc

SEQ ID NO: 107335 - DNA, 75 bp, Artificial Sequence
  Synthetic
ctccaaaggagaatcttgtggttaccgcagatgccgcgccagcggagtgctccctaccagcatggggaacactat

SEQ ID NO: 107336 - DNA, 75 bp, Artificial Sequence
  Synthetic
cgacttggtggtcatctgcgaaagcgccggcgtacaggaggatgctgcagcgctgcgagctttcacggaagctat

SEQ ID NO: 107337 - DNA, 75 bp, Artificial Sequence
  Synthetic
ccaggccgcgtctggatttactagtctcttcacacaaggcgccaagcagaacgtccagctaattaacaccaatgg

SEQ ID NO: 107338 - DNA, 75 bp, Artificial Sequence
  Synthetic
tgtggcggcaggagatgggcggaaacatcacccgcgtggagtcagagaataaggtagtaattctggactctttcg

SEQ ID NO: 107339 - DNA, 75 bp, Artificial Sequence
  Synthetic
actggacagagatattactacctcaccagagactgtaccactccacttgcgcgagctgcttgggagacagctcgc

SEQ ID NO: 107340 - DNA, 75 bp, Artificial Sequence
  Synthetic
gcgagctgcttgggagacagctcgccatactcctgttaattcgtggttgggcaacataattatgtatgcccctgc

SEQ ID NO: 107341 - DNA, 75 bp, Artificial Sequence
  Synthetic
tccggtaccaccacctcggaggaagaagacaatcacacttacagattccaatgtctctagtgccctggcagagct

SEQ ID NO: 107342 - DNA, 75 bp, Artificial Sequence
  Synthetic
ccgagcccccaccctcggacgcacccccctgcgacgacgacactgggtccgacgctgggtcatggtcctcgatgc

SEQ ID NO: 107343 - DNA, 75 bp, Artificial Sequence
  Synthetic
cagcgatcattcaacgactccatggcatggcagcattttcactccatggatactctccaagcgaactcaataggg

SEQ ID NO: 107344 - DNA, 75 bp, Artificial Sequence
  Synthetic
tcctgatcttagcgaaggatcttggtcgaccgtgagcagagagagtgccggagaggatgtcgtgtgttgctctat

SEQ ID NO: 107345 - DNA, 75 bp, Artificial Sequence
  Synthetic
tcctgatcttagcgaaggatcttggtcgaccgtgagcagtgagagtgccggagaggatgtcgtgtgttgctctat

SEQ ID NO: 107346 - DNA, 75 bp, Artificial Sequence
  Synthetic
tcctgatcttagcgaaggatcttggtcgaccgtgagcagcgagagtgccggagaggatgtcgtgtgttgctctat

SEQ ID NO: 107347 - DNA, 75 bp, Artificial Sequence
  Synthetic
tcctgatcttagcgaaggatcttggtcgaccgtgagcagggagagtgccggagaggatgtcgtgtgttgctctat

SEQ ID NO: 107348 - DNA, 75 bp, Artificial Sequence
  Synthetic
cgccatatgtggcaagtacctctttaattgggctgtgaagaccaagctcacactcactccaatacccgacgcagc

SEQ ID NO: 107349 - DNA, 75 bp, Artificial Sequence
  Synthetic
aattgggctgtgaagaccaagctcacactcactccaatacccgacgcagccagattcgatttatcgaactggttt

SEQ ID NO: 107350 - DNA, 75 bp, Artificial Sequence
  Synthetic
ctacttgccgtaggggtaggcatatttttactccccgctcgataaacgagcggccctaaacaacactccataaca

SEQ ID NO: 107351 - DNA, 75 bp, Artificial Sequence
  Synthetic
gtaatactcaatgcagcatccctggccgggacgcacggtcttgtgtccttcctcgtgttcttctgctttgcatgg

SEQ ID NO: 107352 - DNA, 75 bp, Artificial Sequence
  Synthetic
attcctcgtgaaagcttggaaatcaaagaagactcctatggggttttcatatgacacccgctgctttgactccac

SEQ ID NO: 107353 - DNA, 75 bp, Artificial Sequence
  Synthetic
cggtcccagcccagaggtaggcgccaaccaatacccaaagcgcgccaccagacgggccgtacctgggcccagccc

SEQ ID NO: 107354 - DNA, 75 bp, Artificial Sequence
  Synthetic
ttgtccggctggttcacggctggctacagcgggggagacatttatcacagcgtgtctcgtgcccggccccgctgg

SEQ ID NO: 107355 - DNA, 75 bp, Artificial Sequence
  Synthetic
ttgagagccttcacggaggctatgaccaggtattcggccccccctggagaccccccgcggccagagtacgacctg

SEQ ID NO: 107356 - DNA, 75 bp, Artificial Sequence
  Synthetic
ccaggtattcggccccccctggagaccccccgcggccagagtacgacctggagcccataacatcgtgctccagta

SEQ ID NO: 107357 - DNA, 75 bp, Artificial Sequence
  Synthetic
ttgctctttctctatctttctcttggcacttctctcgtgccttacgacacctgcctccgcggcgcattataccaa

SEQ ID NO: 107358 - DNA, 75 bp, Artificial Sequence
  Synthetic
caagtctggcctgtaccatctcactaacgattgccccaacagcagcatcatttatgaggctgaaacgctgatctt

SEQ ID NO: 107359 - DNA, 75 bp, Artificial Sequence
  Synthetic
ttgtgtatgaggccgatgatgtcattctgcacacgccaggctgtataccttgtgttcagaacggcagtgaatcca

SEQ ID NO: 107360 - DNA, 75 bp, Artificial Sequence
  Synthetic
atcaccgggttccgcaaacatgtggatgtcatggtgggcgctgccgcgttctgctcagctatgtacgtgggagac

SEQ ID NO: 107361 - DNA, 75 bp, Artificial Sequence
  Synthetic
ctctcaaggcaacttgcactaccaaccatgactcccctgacgccgagctcatagaggctaacctcctgtggaggc

SEQ ID NO: 107362 - DNA, 75 bp, Artificial Sequence
  Synthetic
ctatgcggaagcctcttccttgttgggcagctcttcacgttcaggcctcggaagcatcaggttgtccaggattgc

SEQ ID NO: 107363 - DNA, 75 bp, Artificial Sequence
  Synthetic
ctatgcggaagcctcttccttgttgggcagctcttcacgttcaggcctcggatgcatcaggttgtccaggattgc

SEQ ID NO: 107364 - DNA, 75 bp, Artificial Sequence
  Synthetic
ctatgcggaagcctcttccttgttgggcagctcttcacgttcaggcctcggacgcatcaggttgtccaggattgc

SEQ ID NO: 107365 - DNA, 75 bp, Artificial Sequence
  Synthetic
ctatgcggaagcctcttccttgttgggcagctcttcacgttcaggcctcggaggcatcaggttgtccaggattgc

SEQ ID NO: 107366 - DNA, 75 bp, Artificial Sequence
  Synthetic
aactgctccatctacacagggcatatcactgggcaccgaatggcatgggatatgatgatgaactggtctccaacc

SEQ ID NO: 107367 - DNA, 75 bp, Artificial Sequence
  Synthetic
aactgctccatctacacagggcatatcactgggcaccgtatggcatgggatatgatgatgaactggtctccaacc

SEQ ID NO: 107368 - DNA, 75 bp, Artificial Sequence
  Synthetic
aactgctccatctacacagggcatatcactgggcaccgcatggcatgggatatgatgatgaactggtctccaacc

SEQ ID NO: 107369 - DNA, 75 bp, Artificial Sequence
  Synthetic
aactgctccatctacacagggcatatcactgggcaccggatggcatgggatatgatgatgaactggtctccaacc

SEQ ID NO: 107370 - DNA, 75 bp, Artificial Sequence
  Synthetic
ctcgcataccccaggtgatcgtcgatgtgttcaccggcggtcattggggagtgcttgcggggctgctatactata

SEQ ID NO: 107371 - DNA, 75 bp, Artificial Sequence
  Synthetic
ctcgcataccccaggtgatcgtcgatgtgttcaccggcggtcattggggtgtgcttgcggggctgctatactata

SEQ ID NO: 107372 - DNA, 75 bp, Artificial Sequence
  Synthetic
ctcgcataccccaggtgatcgtcgatgtgttcaccggcggtcattggggcgtgcttgcggggctgctatactata

SEQ ID NO: 107373 - DNA, 75 bp, Artificial Sequence
  Synthetic
ctcgcataccccaggtgatcgtcgatgtgttcaccggcggtcattggggggtgcttgcggggctgctatactata

SEQ ID NO: 107374 - DNA, 75 bp, Artificial Sequence
  Synthetic
gacgtccatgctcactgatccctcccatataacagcagaggcggctaggaggaggttggcaaggggatcgccccc

SEQ ID NO: 107375 - DNA, 75 bp, Artificial Sequence
  Synthetic
cccgctggttcttgttttgcctactcctactgtcagtaggggtaggcatctacttgctccccaaccgatgaaggg

SEQ ID NO: 107376 - DNA, 75 bp, Artificial Sequence
  Synthetic
cccgctggttcttgttttgcctactcctactgtctgtaggggtaggcatctacttgctccccaaccgatgaaggg

SEQ ID NO: 107377 - DNA, 75 bp, Artificial Sequence
  Synthetic
cccgctggttcttgttttgcctactcctactgtccgtaggggtaggcatctacttgctccccaaccgatgaaggg

SEQ ID NO: 107378 - DNA, 75 bp, Artificial Sequence
  Synthetic
cccgctggttcttgttttgcctactcctactgtcggtaggggtaggcatctacttgctccccaaccgatgaaggg

SEQ ID NO: 107379 - DNA, 75 bp, Artificial Sequence
  Synthetic
aaacggcttcacgtcgatcttttccacgggcgctatacagaacctccagcttatcaacagcaatgggagctggca

SEQ ID NO: 107380 - DNA, 75 bp, Artificial Sequence
  Synthetic
aaacggcttcacgtcgatcttttcctcgggcgctatacagaacctccagcttatcaacagcaatgggagctggca

SEQ ID NO: 107381 - DNA, 75 bp, Artificial Sequence
  Synthetic
aaacggcttcacgtcgatcttttccccgggcgctatacagaacctccagcttatcaacagcaatgggagctggca

SEQ ID NO: 107382 - DNA, 75 bp, Artificial Sequence
  Synthetic
aaacggcttcacgtcgatcttttccgcgggcgctatacagaacctccagcttatcaacagcaatgggagctggca

SEQ ID NO: 107383 - DNA, 75 bp, Artificial Sequence
  Synthetic
aaacggcttcacgtcgttcttttccacgggcgctatacagaacctccagcttatcaacagcaatgggagctggca

SEQ ID NO: 107384 - DNA, 75 bp, Artificial Sequence
  Synthetic
aaacggcttcacgtcgttcttttcctcgggcgctatacagaacctccagcttatcaacagcaatgggagctggca

SEQ ID NO: 107385 - DNA, 75 bp, Artificial Sequence
  Synthetic
aaacggcttcacgtcgttcttttccccgggcgctatacagaacctccagcttatcaacagcaatgggagctggca

SEQ ID NO: 107386 - DNA, 75 bp, Artificial Sequence
  Synthetic
aaacggcttcacgtcgttcttttccgcgggcgctatacagaacctccagcttatcaacagcaatgggagctggca

SEQ ID NO: 107387 - DNA, 75 bp, Artificial Sequence
  Synthetic
aaacggcttcacgtcgctcttttccacgggcgctatacagaacctccagcttatcaacagcaatgggagctggca

SEQ ID NO: 107388 - DNA, 75 bp, Artificial Sequence
  Synthetic
aaacggcttcacgtcgctcttttcctcgggcgctatacagaacctccagcttatcaacagcaatgggagctggca

SEQ ID NO: 107389 - DNA, 75 bp, Artificial Sequence
  Synthetic
aaacggcttcacgtcgctcttttccccgggcgctatacagaacctccagcttatcaacagcaatgggagctggca

SEQ ID NO: 107390 - DNA, 75 bp, Artificial Sequence
  Synthetic
aaacggcttcacgtcgctcttttccgcgggcgctatacagaacctccagcttatcaacagcaatgggagctggca

SEQ ID NO: 107391 - DNA, 75 bp, Artificial Sequence
  Synthetic
aaacggcttcacgtcggtcttttccacgggcgctatacagaacctccagcttatcaacagcaatgggagctggca

SEQ ID NO: 107392 - DNA, 75 bp, Artificial Sequence
  Synthetic
aaacggcttcacgtcggtcttttcctcgggcgctatacagaacctccagcttatcaacagcaatgggagctggca

SEQ ID NO: 107393 - DNA, 75 bp, Artificial Sequence
  Synthetic
aaacggcttcacgtcggtcttttccccgggcgctatacagaacctccagcttatcaacagcaatgggagctggca

SEQ ID NO: 107394 - DNA, 75 bp, Artificial Sequence
  Synthetic
aaacggcttcacgtcggtcttttccgcgggcgctatacagaacctccagcttatcaacagcaatgggagctggca

SEQ ID NO: 107395 - DNA, 75 bp, Artificial Sequence
  Synthetic
aatcggcttcacgtcgatcttttccacgggcgctatacagaacctccagcttatcaacagcaatgggagctggca

SEQ ID NO: 107396 - DNA, 75 bp, Artificial Sequence
  Synthetic
aatcggcttcacgtcgatcttttcctcgggcgctatacagaacctccagcttatcaacagcaatgggagctggca

SEQ ID NO: 107397 - DNA, 75 bp, Artificial Sequence
  Synthetic
aatcggcttcacgtcgatcttttccccgggcgctatacagaacctccagcttatcaacagcaatgggagctggca

SEQ ID NO: 107398 - DNA, 75 bp, Artificial Sequence
  Synthetic
aatcggcttcacgtcgatcttttccgcgggcgctatacagaacctccagcttatcaacagcaatgggagctggca

SEQ ID NO: 107399 - DNA, 75 bp, Artificial Sequence
  Synthetic
aatcggcttcacgtcgttcttttccacgggcgctatacagaacctccagcttatcaacagcaatgggagctggca

SEQ ID NO: 107400 - DNA, 75 bp, Artificial Sequence
  Synthetic
aatcggcttcacgtcgttcttttcctcgggcgctatacagaacctccagcttatcaacagcaatgggagctggca

SEQ ID NO: 107401 - DNA, 75 bp, Artificial Sequence
  Synthetic
aatcggcttcacgtcgttcttttccccgggcgctatacagaacctccagcttatcaacagcaatgggagctggca

SEQ ID NO: 107402 - DNA, 75 bp, Artificial Sequence
  Synthetic
aatcggcttcacgtcgttcttttccgcgggcgctatacagaacctccagcttatcaacagcaatgggagctggca

SEQ ID NO: 107403 - DNA, 75 bp, Artificial Sequence
  Synthetic
aatcggcttcacgtcgctcttttccacgggcgctatacagaacctccagcttatcaacagcaatgggagctggca

SEQ ID NO: 107404 - DNA, 75 bp, Artificial Sequence
  Synthetic
aatcggcttcacgtcgctcttttcctcgggcgctatacagaacctccagcttatcaacagcaatgggagctggca

SEQ ID NO: 107405 - DNA, 75 bp, Artificial Sequence
  Synthetic
aatcggcttcacgtcgctcttttccccgggcgctatacagaacctccagcttatcaacagcaatgggagctggca

SEQ ID NO: 107406 - DNA, 75 bp, Artificial Sequence
  Synthetic
aatcggcttcacgtcgctcttttccgcgggcgctatacagaacctccagcttatcaacagcaatgggagctggca

SEQ ID NO: 107407 - DNA, 75 bp, Artificial Sequence
  Synthetic
aatcggcttcacgtcggtcttttccacgggcgctatacagaacctccagcttatcaacagcaatgggagctggca

SEQ ID NO: 107408 - DNA, 75 bp, Artificial Sequence
  Synthetic
aatcggcttcacgtcggtcttttcctcgggcgctatacagaacctccagcttatcaacagcaatgggagctggca

SEQ ID NO: 107409 - DNA, 75 bp, Artificial Sequence
  Synthetic
aatcggcttcacgtcggtcttttccccgggcgctatacagaacctccagcttatcaacagcaatgggagctggca

SEQ ID NO: 107410 - DNA, 75 bp, Artificial Sequence
  Synthetic
aatcggcttcacgtcggtcttttccgcgggcgctatacagaacctccagcttatcaacagcaatgggagctggca

SEQ ID NO: 107411 - DNA, 75 bp, Artificial Sequence
  Synthetic
aaccggcttcacgtcgatcttttccacgggcgctatacagaacctccagcttatcaacagcaatgggagctggca

SEQ ID NO: 107412 - DNA, 75 bp, Artificial Sequence
  Synthetic
aaccggcttcacgtcgatcttttcctcgggcgctatacagaacctccagcttatcaacagcaatgggagctggca

SEQ ID NO: 107413 - DNA, 75 bp, Artificial Sequence
  Synthetic
aaccggcttcacgtcgatcttttccccgggcgctatacagaacctccagcttatcaacagcaatgggagctggca

SEQ ID NO: 107414 - DNA, 75 bp, Artificial Sequence
  Synthetic
aaccggcttcacgtcgatcttttccgcgggcgctatacagaacctccagcttatcaacagcaatgggagctggca

SEQ ID NO: 107415 - DNA, 75 bp, Artificial Sequence
  Synthetic
aaccggcttcacgtcgttcttttccacgggcgctatacagaacctccagcttatcaacagcaatgggagctggca

SEQ ID NO: 107416 - DNA, 75 bp, Artificial Sequence
  Synthetic
aaccggcttcacgtcgttcttttcctcgggcgctatacagaacctccagcttatcaacagcaatgggagctggca

SEQ ID NO: 107417 - DNA, 75 bp, Artificial Sequence
  Synthetic
aaccggcttcacgtcgttcttttccccgggcgctatacagaacctccagcttatcaacagcaatgggagctggca

SEQ ID NO: 107418 - DNA, 75 bp, Artificial Sequence
  Synthetic
aaccggcttcacgtcgttcttttccgcgggcgctatacagaacctccagcttatcaacagcaatgggagctggca

SEQ ID NO: 107419 - DNA, 75 bp, Artificial Sequence
  Synthetic
aaccggcttcacgtcgctcttttccacgggcgctatacagaacctccagcttatcaacagcaatgggagctggca

SEQ ID NO: 107420 - DNA, 75 bp, Artificial Sequence
  Synthetic
aaccggcttcacgtcgctcttttcctcgggcgctatacagaacctccagcttatcaacagcaatgggagctggca

SEQ ID NO: 107421 - DNA, 75 bp, Artificial Sequence
  Synthetic
aaccggcttcacgtcgctcttttccccgggcgctatacagaacctccagcttatcaacagcaatgggagctggca

SEQ ID NO: 107422 - DNA, 75 bp, Artificial Sequence
  Synthetic
aaccggcttcacgtcgctcttttccgcgggcgctatacagaacctccagcttatcaacagcaatgggagctggca

SEQ ID NO: 107423 - DNA, 75 bp, Artificial Sequence
  Synthetic
aaccggcttcacgtcggtcttttccacgggcgctatacagaacctccagcttatcaacagcaatgggagctggca

SEQ ID NO: 107424 - DNA, 75 bp, Artificial Sequence
  Synthetic
aaccggcttcacgtcggtcttttcctcgggcgctatacagaacctccagcttatcaacagcaatgggagctggca

SEQ ID NO: 107425 - DNA, 75 bp, Artificial Sequence
  Synthetic
aaccggcttcacgtcggtcttttccccgggcgctatacagaacctccagcttatcaacagcaatgggagctggca

SEQ ID NO: 107426 - DNA, 75 bp, Artificial Sequence
  Synthetic
aaccggcttcacgtcggtcttttccgcgggcgctatacagaacctccagcttatcaacagcaatgggagctggca

SEQ ID NO: 107427 - DNA, 75 bp, Artificial Sequence
  Synthetic
aagcggcttcacgtcgatcttttccacgggcgctatacagaacctccagcttatcaacagcaatgggagctggca

SEQ ID NO: 107428 - DNA, 75 bp, Artificial Sequence
  Synthetic
aagcggcttcacgtcgatcttttcctcgggcgctatacagaacctccagcttatcaacagcaatgggagctggca

SEQ ID NO: 107429 - DNA, 75 bp, Artificial Sequence
  Synthetic
aagcggcttcacgtcgatcttttccccgggcgctatacagaacctccagcttatcaacagcaatgggagctggca

SEQ ID NO: 107430 - DNA, 75 bp, Artificial Sequence
  Synthetic
aagcggcttcacgtcgatcttttccgcgggcgctatacagaacctccagcttatcaacagcaatgggagctggca

SEQ ID NO: 107431 - DNA, 75 bp, Artificial Sequence
  Synthetic
aagcggcttcacgtcgttcttttccacgggcgctatacagaacctccagcttatcaacagcaatgggagctggca

SEQ ID NO: 107432 - DNA, 75 bp, Artificial Sequence
  Synthetic
aagcggcttcacgtcgttcttttcctcgggcgctatacagaacctccagcttatcaacagcaatgggagctggca

SEQ ID NO: 107433 - DNA, 75 bp, Artificial Sequence
  Synthetic
aagcggcttcacgtcgttcttttccccgggcgctatacagaacctccagcttatcaacagcaatgggagctggca

SEQ ID NO: 107434 - DNA, 75 bp, Artificial Sequence
  Synthetic
aagcggcttcacgtcgttcttttccgcgggcgctatacagaacctccagcttatcaacagcaatgggagctggca

SEQ ID NO: 107435 - DNA, 75 bp, Artificial Sequence
  Synthetic
aagcggcttcacgtcgctcttttccacgggcgctatacagaacctccagcttatcaacagcaatgggagctggca

SEQ ID NO: 107436 - DNA, 75 bp, Artificial Sequence
  Synthetic
aagcggcttcacgtcgctcttttcctcgggcgctatacagaacctccagcttatcaacagcaatgggagctggca

SEQ ID NO: 107437 - DNA, 75 bp, Artificial Sequence
  Synthetic
aagcggcttcacgtcgctcttttccccgggcgctatacagaacctccagcttatcaacagcaatgggagctggca

SEQ ID NO: 107438 - DNA, 75 bp, Artificial Sequence
  Synthetic
aagcggcttcacgtcgctcttttccgcgggcgctatacagaacctccagcttatcaacagcaatgggagctggca

SEQ ID NO: 107439 - DNA, 75 bp, Artificial Sequence
  Synthetic
aagcggcttcacgtcggtcttttccacgggcgctatacagaacctccagcttatcaacagcaatgggagctggca

SEQ ID NO: 107440 - DNA, 75 bp, Artificial Sequence
  Synthetic
aagcggcttcacgtcggtcttttcctcgggcgctatacagaacctccagcttatcaacagcaatgggagctggca

SEQ ID NO: 107441 - DNA, 75 bp, Artificial Sequence
  Synthetic
aagcggcttcacgtcggtcttttccccgggcgctatacagaacctccagcttatcaacagcaatgggagctggca

SEQ ID NO: 107442 - DNA, 75 bp, Artificial Sequence
  Synthetic
aagcggcttcacgtcggtcttttccgcgggcgctatacagaacctccagcttatcaacagcaatgggagctggca

SEQ ID NO: 107443 - DNA, 75 bp, Artificial Sequence
  Synthetic
cacatcaacagaactgccttgaactgtaacgacaccctccagactgggtttcttgccgcgctgttctatacacac

SEQ ID NO: 107444 - DNA, 75 bp, Artificial Sequence
  Synthetic
aaatgtcggtcgcaccgtggacagctttactagactctttaatacgggccccaagcagaacgtccagctggtcaa

SEQ ID NO: 107445 - DNA, 75 bp, Artificial Sequence
  Synthetic
tcttgccgcgctgttctatacacacaggttcaacgcgtccggatgcccggaacgcatggccagctgccgccccat

SEQ ID NO: 107446 - DNA, 75 bp, Artificial Sequence
  Synthetic
cggctgaatgcctgcaagcccatcacacatttatctcaaggatggggcccaatctcatatgcgaacgtaagcggt

SEQ ID NO: 107447 - DNA, 75 bp, Artificial Sequence
  Synthetic
cggctgaatgcctgcaagcccatcacacatttatctcaaggttggggcccaatctcatatgcgaacgtaagcggt

SEQ ID NO: 107448 - DNA, 75 bp, Artificial Sequence
  Synthetic
cggctgaatgcctgcaagcccatcacacatttatctcaaggctggggcccaatctcatatgcgaacgtaagcggt

SEQ ID NO: 107449 - DNA, 75 bp, Artificial Sequence
  Synthetic
cggctgaatgcctgcaagcccatcacacatttatctcaagggtggggcccaatctcatatgcgaacgtaagcggt

SEQ ID NO: 107450 - DNA, 75 bp, Artificial Sequence
  Synthetic
cggctgaatgcctgcaagcccatcacacatttttctcaaggatggggcccaatctcatatgcgaacgtaagcggt

SEQ ID NO: 107451 - DNA, 75 bp, Artificial Sequence
  Synthetic
cggctgaatgcctgcaagcccatcacacatttttctcaaggttggggcccaatctcatatgcgaacgtaagcggt

SEQ ID NO: 107452 - DNA, 75 bp, Artificial Sequence
  Synthetic
cggctgaatgcctgcaagcccatcacacatttttctcaaggctggggcccaatctcatatgcgaacgtaagcggt

SEQ ID NO: 107453 - DNA, 75 bp, Artificial Sequence
  Synthetic
cggctgaatgcctgcaagcccatcacacatttttctcaagggtggggcccaatctcatatgcgaacgtaagcggt

SEQ ID NO: 107454 - DNA, 75 bp, Artificial Sequence
  Synthetic
cggctgaatgcctgcaagcccatcacacatttctctcaaggatggggcccaatctcatatgcgaacgtaagcggt

SEQ ID NO: 107455 - DNA, 75 bp, Artificial Sequence
  Synthetic
cggctgaatgcctgcaagcccatcacacatttctctcaaggttggggcccaatctcatatgcgaacgtaagcggt

SEQ ID NO: 107456 - DNA, 75 bp, Artificial Sequence
  Synthetic
cggctgaatgcctgcaagcccatcacacatttctctcaaggctggggcccaatctcatatgcgaacgtaagcggt

SEQ ID NO: 107457 - DNA, 75 bp, Artificial Sequence
  Synthetic
cggctgaatgcctgcaagcccatcacacatttctctcaagggtggggcccaatctcatatgcgaacgtaagcggt

SEQ ID NO: 107458 - DNA, 75 bp, Artificial Sequence
  Synthetic
cggctgaatgcctgcaagcccatcacacatttgtctcaaggatggggcccaatctcatatgcgaacgtaagcggt

SEQ ID NO: 107459 - DNA, 75 bp, Artificial Sequence
  Synthetic
cggctgaatgcctgcaagcccatcacacatttgtctcaaggttggggcccaatctcatatgcgaacgtaagcggt

SEQ ID NO: 107460 - DNA, 75 bp, Artificial Sequence
  Synthetic
cggctgaatgcctgcaagcccatcacacatttgtctcaaggctggggcccaatctcatatgcgaacgtaagcggt

SEQ ID NO: 107461 - DNA, 75 bp, Artificial Sequence
  Synthetic
cggctgaatgcctgcaagcccatcacacatttgtctcaagggtggggcccaatctcatatgcgaacgtaagcggt

SEQ ID NO: 107462 - DNA, 75 bp, Artificial Sequence
  Synthetic
cggctgattgcctgcaagcccatcacacatttatctcaaggatggggcccaatctcatatgcgaacgtaagcggt

SEQ ID NO: 107463 - DNA, 75 bp, Artificial Sequence
  Synthetic
cggctgattgcctgcaagcccatcacacatttatctcaaggttggggcccaatctcatatgcgaacgtaagcggt

SEQ ID NO: 107464 - DNA, 75 bp, Artificial Sequence
  Synthetic
cggctgattgcctgcaagcccatcacacatttatctcaaggctggggcccaatctcatatgcgaacgtaagcggt

SEQ ID NO: 107465 - DNA, 75 bp, Artificial Sequence
  Synthetic
cggctgattgcctgcaagcccatcacacatttatctcaagggtggggcccaatctcatatgcgaacgtaagcggt

SEQ ID NO: 107466 - DNA, 75 bp, Artificial Sequence
  Synthetic
cggctgattgcctgcaagcccatcacacatttttctcaaggatggggcccaatctcatatgcgaacgtaagcggt

SEQ ID NO: 107467 - DNA, 75 bp, Artificial Sequence
  Synthetic
cggctgattgcctgcaagcccatcacacatttttctcaaggttggggcccaatctcatatgcgaacgtaagcggt

SEQ ID NO: 107468 - DNA, 75 bp, Artificial Sequence
  Synthetic
cggctgattgcctgcaagcccatcacacatttttctcaaggctggggcccaatctcatatgcgaacgtaagcggt

SEQ ID NO: 107469 - DNA, 75 bp, Artificial Sequence
  Synthetic
cggctgattgcctgcaagcccatcacacatttttctcaagggtggggcccaatctcatatgcgaacgtaagcggt

SEQ ID NO: 107470 - DNA, 75 bp, Artificial Sequence
  Synthetic
cggctgattgcctgcaagcccatcacacatttctctcaaggatggggcccaatctcatatgcgaacgtaagcggt

SEQ ID NO: 107471 - DNA, 75 bp, Artificial Sequence
  Synthetic
cggctgattgcctgcaagcccatcacacatttctctcaaggttggggcccaatctcatatgcgaacgtaagcggt

SEQ ID NO: 107472 - DNA, 75 bp, Artificial Sequence
  Synthetic
cggctgattgcctgcaagcccatcacacatttctctcaaggctggggcccaatctcatatgcgaacgtaagcggt

SEQ ID NO: 107473 - DNA, 75 bp, Artificial Sequence
  Synthetic
cggctgattgcctgcaagcccatcacacatttctctcaagggtggggcccaatctcatatgcgaacgtaagcggt

SEQ ID NO: 107474 - DNA, 75 bp, Artificial Sequence
  Synthetic
cggctgattgcctgcaagcccatcacacatttgtctcaaggatggggcccaatctcatatgcgaacgtaagcggt

SEQ ID NO: 107475 - DNA, 75 bp, Artificial Sequence
  Synthetic
cggctgattgcctgcaagcccatcacacatttgtctcaaggttggggcccaatctcatatgcgaacgtaagcggt

SEQ ID NO: 107476 - DNA, 75 bp, Artificial Sequence
  Synthetic
cggctgattgcctgcaagcccatcacacatttgtctcaaggctggggcccaatctcatatgcgaacgtaagcggt

SEQ ID NO: 107477 - DNA, 75 bp, Artificial Sequence
  Synthetic
cggctgattgcctgcaagcccatcacacatttgtctcaagggtggggcccaatctcatatgcgaacgtaagcggt

SEQ ID NO: 107478 - DNA, 75 bp, Artificial Sequence
  Synthetic
cggctgactgcctgcaagcccatcacacatttatctcaaggatggggcccaatctcatatgcgaacgtaagcggt

SEQ ID NO: 107479 - DNA, 75 bp, Artificial Sequence
  Synthetic
cggctgactgcctgcaagcccatcacacatttatctcaaggttggggcccaatctcatatgcgaacgtaagcggt

SEQ ID NO: 107480 - DNA, 75 bp, Artificial Sequence
  Synthetic
cggctgactgcctgcaagcccatcacacatttatctcaaggctggggcccaatctcatatgcgaacgtaagcggt

SEQ ID NO: 107481 - DNA, 75 bp, Artificial Sequence
  Synthetic
cggctgactgcctgcaagcccatcacacatttatctcaagggtggggcccaatctcatatgcgaacgtaagcggt

SEQ ID NO: 107482 - DNA, 75 bp, Artificial Sequence
  Synthetic
cggctgactgcctgcaagcccatcacacatttttctcaaggatggggcccaatctcatatgcgaacgtaagcggt

SEQ ID NO: 107483 - DNA, 75 bp, Artificial Sequence
  Synthetic
cggctgactgcctgcaagcccatcacacatttttctcaaggttggggcccaatctcatatgcgaacgtaagcggt

SEQ ID NO: 107484 - DNA, 75 bp, Artificial Sequence
  Synthetic
cggctgactgcctgcaagcccatcacacatttttctcaaggctggggcccaatctcatatgcgaacgtaagcggt

SEQ ID NO: 107485 - DNA, 75 bp, Artificial Sequence
  Synthetic
cggctgactgcctgcaagcccatcacacatttttctcaagggtggggcccaatctcatatgcgaacgtaagcggt

SEQ ID NO: 107486 - DNA, 75 bp, Artificial Sequence
  Synthetic
cggctgactgcctgcaagcccatcacacatttctctcaaggatggggcccaatctcatatgcgaacgtaagcggt

SEQ ID NO: 107487 - DNA, 75 bp, Artificial Sequence
  Synthetic
cggctgactgcctgcaagcccatcacacatttctctcaaggttggggcccaatctcatatgcgaacgtaagcggt

SEQ ID NO: 107488 - DNA, 75 bp, Artificial Sequence
  Synthetic
cggctgactgcctgcaagcccatcacacatttctctcaaggctggggcccaatctcatatgcgaacgtaagcggt

SEQ ID NO: 107489 - DNA, 75 bp, Artificial Sequence
  Synthetic
cggctgactgcctgcaagcccatcacacatttctctcaagggtggggcccaatctcatatgcgaacgtaagcggt

SEQ ID NO: 107490 - DNA, 75 bp, Artificial Sequence
  Synthetic
cggctgactgcctgcaagcccatcacacatttgtctcaaggatggggcccaatctcatatgcgaacgtaagcggt

SEQ ID NO: 107491 - DNA, 75 bp, Artificial Sequence
  Synthetic
cggctgactgcctgcaagcccatcacacatttgtctcaaggttggggcccaatctcatatgcgaacgtaagcggt

SEQ ID NO: 107492 - DNA, 75 bp, Artificial Sequence
  Synthetic
cggctgactgcctgcaagcccatcacacatttgtctcaaggctggggcccaatctcatatgcgaacgtaagcggt

SEQ ID NO: 107493 - DNA, 75 bp, Artificial Sequence
  Synthetic
cggctgactgcctgcaagcccatcacacatttgtctcaagggtggggcccaatctcatatgcgaacgtaagcggt

SEQ ID NO: 107494 - DNA, 75 bp, Artificial Sequence
  Synthetic
cggctgagtgcctgcaagcccatcacacatttatctcaaggatggggcccaatctcatatgcgaacgtaagcggt

SEQ ID NO: 107495 - DNA, 75 bp, Artificial Sequence
  Synthetic
cggctgagtgcctgcaagcccatcacacatttatctcaaggttggggcccaatctcatatgcgaacgtaagcggt

SEQ ID NO: 107496 - DNA, 75 bp, Artificial Sequence
  Synthetic
cggctgagtgcctgcaagcccatcacacatttatctcaaggctggggcccaatctcatatgcgaacgtaagcggt

SEQ ID NO: 107497 - DNA, 75 bp, Artificial Sequence
  Synthetic
cggctgagtgcctgcaagcccatcacacatttatctcaagggtggggcccaatctcatatgcgaacgtaagcggt

SEQ ID NO: 107498 - DNA, 75 bp, Artificial Sequence
  Synthetic
cggctgagtgcctgcaagcccatcacacatttttctcaaggatggggcccaatctcatatgcgaacgtaagcggt

SEQ ID NO: 107499 - DNA, 75 bp, Artificial Sequence
  Synthetic
cggctgagtgcctgcaagcccatcacacatttttctcaaggttggggcccaatctcatatgcgaacgtaagcggt

SEQ ID NO: 107500 - DNA, 75 bp, Artificial Sequence
  Synthetic
cggctgagtgcctgcaagcccatcacacatttttctcaaggctggggcccaatctcatatgcgaacgtaagcggt

SEQ ID NO: 107501 - DNA, 75 bp, Artificial Sequence
  Synthetic
cggctgagtgcctgcaagcccatcacacatttttctcaagggtggggcccaatctcatatgcgaacgtaagcggt

SEQ ID NO: 107502 - DNA, 75 bp, Artificial Sequence
  Synthetic
cggctgagtgcctgcaagcccatcacacatttctctcaaggatggggcccaatctcatatgcgaacgtaagcggt

SEQ ID NO: 107503 - DNA, 75 bp, Artificial Sequence
  Synthetic
cggctgagtgcctgcaagcccatcacacatttctctcaaggttggggcccaatctcatatgcgaacgtaagcggt

SEQ ID NO: 107504 - DNA, 75 bp, Artificial Sequence
  Synthetic
cggctgagtgcctgcaagcccatcacacatttctctcaaggctggggcccaatctcatatgcgaacgtaagcggt

SEQ ID NO: 107505 - DNA, 75 bp, Artificial Sequence
  Synthetic
cggctgagtgcctgcaagcccatcacacatttctctcaagggtggggcccaatctcatatgcgaacgtaagcggt

SEQ ID NO: 107506 - DNA, 75 bp, Artificial Sequence
  Synthetic
cggctgagtgcctgcaagcccatcacacatttgtctcaaggatggggcccaatctcatatgcgaacgtaagcggt

SEQ ID NO: 107507 - DNA, 75 bp, Artificial Sequence
  Synthetic
cggctgagtgcctgcaagcccatcacacatttgtctcaaggttggggcccaatctcatatgcgaacgtaagcggt

SEQ ID NO: 107508 - DNA, 75 bp, Artificial Sequence
  Synthetic
cggctgagtgcctgcaagcccatcacacatttgtctcaaggctggggcccaatctcatatgcgaacgtaagcggt

SEQ ID NO: 107509 - DNA, 75 bp, Artificial Sequence
  Synthetic
cggctgagtgcctgcaagcccatcacacatttgtctcaagggtggggcccaatctcatatgcgaacgtaagcggt

SEQ ID NO: 107510 - DNA, 75 bp, Artificial Sequence
  Synthetic
gccctgtggtcgtaggtactaccgatcgtaggggtgtccccacttacccctggggcggaaatgattctgatgtgt

SEQ ID NO: 107511 - DNA, 75 bp, Artificial Sequence
  Synthetic
tcctgctggcaagcccgagaccccccgcagggtgttggtttggatgcacgtggatgaactccacggggtttgtca

SEQ ID NO: 107512 - DNA, 75 bp, Artificial Sequence
  Synthetic
tcctgctggcaagcccgagaccccccgcagggtgttggtttggttgcacgtggatgaactccacggggtttgtca

SEQ ID NO: 107513 - DNA, 75 bp, Artificial Sequence
  Synthetic
tcctgctggcaagcccgagaccccccgcagggtgttggtttggctgcacgtggatgaactccacggggtttgtca

SEQ ID NO: 107514 - DNA, 75 bp, Artificial Sequence
  Synthetic
tcctgctggcaagcccgagaccccccgcagggtgttggtttgggtgcacgtggatgaactccacggggtttgtca

SEQ ID NO: 107515 - DNA, 75 bp, Artificial Sequence
  Synthetic
acctatactttcagggatcatttctatagtgtgttactagagaagtttctctgaacgtgtagacactccgccatg

SEQ ID NO: 107516 - DNA, 75 bp, Artificial Sequence
  Synthetic
caagtgcggctcaggtccctggctcacgccaaggtgcctggtcgattacccgtataggctgtggcactacccctg

SEQ ID NO: 107517 - DNA, 75 bp, Artificial Sequence
  Synthetic
tactgtcaatttcaccttacacaaggtgcggatgtatctcggggggttggagcataggattgatgcggcctgtaa

SEQ ID NO: 107518 - DNA, 75 bp, Artificial Sequence
  Synthetic
tgttcgtggccggggttgaacaccggtttcatgccgcttgcaactggacccggggggagcgctgcaatatcgagg

SEQ ID NO: 107519 - DNA, 75 bp, Artificial Sequence
  Synthetic
catggcatgggacatgatgctaaactggtcaccaactcttaccatgatccttgcctacgctgctcgtgttcctga

SEQ ID NO: 107520 - DNA, 75 bp, Artificial Sequence
  Synthetic
atcaccactatgccggccctttccaccgggttgatacacctgcatcaaaacgtggtggacgtccaatacctgtat

SEQ ID NO: 107521 - DNA, 75 bp, Artificial Sequence
  Synthetic
ttcaccactatgccggccctttccaccgggttgatacacctgcatcaaaacgtggtggacgtccaatacctgtat

SEQ ID NO: 107522 - DNA, 75 bp, Artificial Sequence
  Synthetic
ctcaccactatgccggccctttccaccgggttgatacacctgcatcaaaacgtggtggacgtccaatacctgtat

SEQ ID NO: 107523 - DNA, 75 bp, Artificial Sequence
  Synthetic
gtcaccactatgccggccctttccaccgggttgatacacctgcatcaaaacgtggtggacgtccaatacctgtat

SEQ ID NO: 107524 - DNA, 75 bp, Artificial Sequence
  Synthetic
tagtcatcaagtgggagtatgttgtcctgatctttcttgtgctggctgatgcgcgcgtctgcgcgtgcttgtggc

SEQ ID NO: 107525 - DNA, 75 bp, Artificial Sequence
  Synthetic
gaaatgggagatcgtcatcctcgtcttcctcctcctggcagacgcacgtgtgtgcgtcgctttttggctgatgct

SEQ ID NO: 107526 - DNA, 75 bp, Artificial Sequence
  Synthetic
ttacatctgctgcgcctggtatatcaagggccgtctcgtgcccgcagccacatacgggctgttgcagctatggcc

SEQ ID NO: 107527 - DNA, 75 bp, Artificial Sequence
  Synthetic
tttactctgaccccacattacaaatggctgctcgtgaggctgatttggtggaaccagtatttcatagcccgagcg

SEQ ID NO: 107528 - DNA, 75 bp, Artificial Sequence
  Synthetic
tttactctgaccccacattacaaatggctgctcgtgaggctgatttggtggaaccagtatttcatagcccgtgcg

SEQ ID NO: 107529 - DNA, 75 bp, Artificial Sequence
  Synthetic
tttactctgaccccacattacaaatggctgctcgtgaggctgatttggtggaaccagtatttcatagcccgcgcg

SEQ ID NO: 107530 - DNA, 75 bp, Artificial Sequence
  Synthetic
tttactctgaccccacattacaaatggctgctcgtgaggctgatttggtggaaccagtatttcatagcccgggcg

SEQ ID NO: 107531 - DNA, 75 bp, Artificial Sequence
  Synthetic
ggctgctcgtgaggctgatttggtggaaccagtatttcatagcccgagcggaggccatgatacaacaatgggtcc

SEQ ID NO: 107532 - DNA, 75 bp, Artificial Sequence
  Synthetic
ggctgctcgtgaggctgatttggtggaaccagtatttcatagcccgagcggaggccatgatacatcaatgggtcc

SEQ ID NO: 107533 - DNA, 75 bp, Artificial Sequence
  Synthetic
ggctgctcgtgaggctgatttggtggaaccagtatttcatagcccgagcggaggccatgatacaccaatgggtcc

SEQ ID NO: 107534 - DNA, 75 bp, Artificial Sequence
  Synthetic
ggctgctcgtgaggctgatttggtggaaccagtatttcatagcccgagcggaggccatgatacagcaatgggtcc

SEQ ID NO: 107535 - DNA, 75 bp, Artificial Sequence
  Synthetic
ggctgctcgtgaggctgatttggtggaaccagtatttcatagcccgagcggaggccttgatacaacaatgggtcc

SEQ ID NO: 107536 - DNA, 75 bp, Artificial Sequence
  Synthetic
ggctgctcgtgaggctgatttggtggaaccagtatttcatagcccgagcggaggccttgatacatcaatgggtcc

SEQ ID NO: 107537 - DNA, 75 bp, Artificial Sequence
  Synthetic
ggctgctcgtgaggctgatttggtggaaccagtatttcatagcccgagcggaggccttgatacaccaatgggtcc

SEQ ID NO: 107538 - DNA, 75 bp, Artificial Sequence
  Synthetic
ggctgctcgtgaggctgatttggtggaaccagtatttcatagcccgagcggaggccttgatacagcaatgggtcc

SEQ ID NO: 107539 - DNA, 75 bp, Artificial Sequence
  Synthetic
ggctgctcgtgaggctgatttggtggaaccagtatttcatagcccgagcggaggccctgatacaacaatgggtcc

SEQ ID NO: 107540 - DNA, 75 bp, Artificial Sequence
  Synthetic
ggctgctcgtgaggctgatttggtggaaccagtatttcatagcccgagcggaggccctgatacatcaatgggtcc

SEQ ID NO: 107541 - DNA, 75 bp, Artificial Sequence
  Synthetic
ggctgctcgtgaggctgatttggtggaaccagtatttcatagcccgagcggaggccctgatacaccaatgggtcc

SEQ ID NO: 107542 - DNA, 75 bp, Artificial Sequence
  Synthetic
ggctgctcgtgaggctgatttggtggaaccagtatttcatagcccgagcggaggccctgatacagcaatgggtcc

SEQ ID NO: 107543 - DNA, 75 bp, Artificial Sequence
  Synthetic
ggctgctcgtgaggctgatttggtggaaccagtatttcatagcccgagcggaggccgtgatacaacaatgggtcc

SEQ ID NO: 107544 - DNA, 75 bp, Artificial Sequence
  Synthetic
ggctgctcgtgaggctgatttggtggaaccagtatttcatagcccgagcggaggccgtgatacatcaatgggtcc

SEQ ID NO: 107545 - DNA, 75 bp, Artificial Sequence
  Synthetic
ggctgctcgtgaggctgatttggtggaaccagtatttcatagcccgagcggaggccgtgatacaccaatgggtcc

SEQ ID NO: 107546 - DNA, 75 bp, Artificial Sequence
  Synthetic
ggctgctcgtgaggctgatttggtggaaccagtatttcatagcccgagcggaggccgtgatacagcaatgggtcc

SEQ ID NO: 107547 - DNA, 75 bp, Artificial Sequence
  Synthetic
ggctgctcgtgaggctgatttggtggaaccagtatttcatagcccgtgcggaggccatgatacaacaatgggtcc

SEQ ID NO: 107548 - DNA, 75 bp, Artificial Sequence
  Synthetic
ggctgctcgtgaggctgatttggtggaaccagtatttcatagcccgtgcggaggccatgatacatcaatgggtcc

SEQ ID NO: 107549 - DNA, 75 bp, Artificial Sequence
  Synthetic
ggctgctcgtgaggctgatttggtggaaccagtatttcatagcccgtgcggaggccatgatacaccaatgggtcc

SEQ ID NO: 107550 - DNA, 75 bp, Artificial Sequence
  Synthetic
ggctgctcgtgaggctgatttggtggaaccagtatttcatagcccgtgcggaggccatgatacagcaatgggtcc

SEQ ID NO: 107551 - DNA, 75 bp, Artificial Sequence
  Synthetic
ggctgctcgtgaggctgatttggtggaaccagtatttcatagcccgtgcggaggccttgatacaacaatgggtcc

SEQ ID NO: 107552 - DNA, 75 bp, Artificial Sequence
  Synthetic
ggctgctcgtgaggctgatttggtggaaccagtatttcatagcccgtgcggaggccttgatacatcaatgggtcc

SEQ ID NO: 107553 - DNA, 75 bp, Artificial Sequence
  Synthetic
ggctgctcgtgaggctgatttggtggaaccagtatttcatagcccgtgcggaggccttgatacaccaatgggtcc

SEQ ID NO: 107554 - DNA, 75 bp, Artificial Sequence
  Synthetic
ggctgctcgtgaggctgatttggtggaaccagtatttcatagcccgtgcggaggccttgatacagcaatgggtcc

SEQ ID NO: 107555 - DNA, 75 bp, Artificial Sequence
  Synthetic
ggctgctcgtgaggctgatttggtggaaccagtatttcatagcccgtgcggaggccctgatacaacaatgggtcc

SEQ ID NO: 107556 - DNA, 75 bp, Artificial Sequence
  Synthetic
ggctgctcgtgaggctgatttggtggaaccagtatttcatagcccgtgcggaggccctgatacatcaatgggtcc

SEQ ID NO: 107557 - DNA, 75 bp, Artificial Sequence
  Synthetic
ggctgctcgtgaggctgatttggtggaaccagtatttcatagcccgtgcggaggccctgatacaccaatgggtcc

SEQ ID NO: 107558 - DNA, 75 bp, Artificial Sequence
  Synthetic
ggctgctcgtgaggctgatttggtggaaccagtatttcatagcccgtgcggaggccctgatacagcaatgggtcc

SEQ ID NO: 107559 - DNA, 75 bp, Artificial Sequence
  Synthetic
ggctgctcgtgaggctgatttggtggaaccagtatttcatagcccgtgcggaggccgtgatacaacaatgggtcc

SEQ ID NO: 107560 - DNA, 75 bp, Artificial Sequence
  Synthetic
ggctgctcgtgaggctgatttggtggaaccagtatttcatagcccgtgcggaggccgtgatacatcaatgggtcc

SEQ ID NO: 107561 - DNA, 75 bp, Artificial Sequence
  Synthetic
ggctgctcgtgaggctgatttggtggaaccagtatttcatagcccgtgcggaggccgtgatacaccaatgggtcc

SEQ ID NO: 107562 - DNA, 75 bp, Artificial Sequence
  Synthetic
ggctgctcgtgaggctgatttggtggaaccagtatttcatagcccgtgcggaggccgtgatacagcaatgggtcc

SEQ ID NO: 107563 - DNA, 75 bp, Artificial Sequence
  Synthetic
ggctgctcgtgaggctgatttggtggaaccagtatttcatagcccgcgcggaggccatgatacaacaatgggtcc

SEQ ID NO: 107564 - DNA, 75 bp, Artificial Sequence
  Synthetic
ggctgctcgtgaggctgatttggtggaaccagtatttcatagcccgcgcggaggccatgatacatcaatgggtcc

SEQ ID NO: 107565 - DNA, 75 bp, Artificial Sequence
  Synthetic
ggctgctcgtgaggctgatttggtggaaccagtatttcatagcccgcgcggaggccatgatacaccaatgggtcc

SEQ ID NO: 107566 - DNA, 75 bp, Artificial Sequence
  Synthetic
ggctgctcgtgaggctgatttggtggaaccagtatttcatagcccgcgcggaggccatgatacagcaatgggtcc

SEQ ID NO: 107567 - DNA, 75 bp, Artificial Sequence
  Synthetic
ggctgctcgtgaggctgatttggtggaaccagtatttcatagcccgcgcggaggccttgatacaacaatgggtcc

SEQ ID NO: 107568 - DNA, 75 bp, Artificial Sequence
  Synthetic
ggctgctcgtgaggctgatttggtggaaccagtatttcatagcccgcgcggaggccttgatacatcaatgggtcc

SEQ ID NO: 107569 - DNA, 75 bp, Artificial Sequence
  Synthetic
ggctgctcgtgaggctgatttggtggaaccagtatttcatagcccgcgcggaggccttgatacaccaatgggtcc

SEQ ID NO: 107570 - DNA, 75 bp, Artificial Sequence
  Synthetic
ggctgctcgtgaggctgatttggtggaaccagtatttcatagcccgcgcggaggccttgatacagcaatgggtcc

SEQ ID NO: 107571 - DNA, 75 bp, Artificial Sequence
  Synthetic
ggctgctcgtgaggctgatttggtggaaccagtatttcatagcccgcgcggaggccctgatacaacaatgggtcc

SEQ ID NO: 107572 - DNA, 75 bp, Artificial Sequence
  Synthetic
ggctgctcgtgaggctgatttggtggaaccagtatttcatagcccgcgcggaggccctgatacatcaatgggtcc

SEQ ID NO: 107573 - DNA, 75 bp, Artificial Sequence
  Synthetic
ggctgctcgtgaggctgatttggtggaaccagtatttcatagcccgcgcggaggccctgatacaccaatgggtcc

SEQ ID NO: 107574 - DNA, 75 bp, Artificial Sequence
  Synthetic
ggctgctcgtgaggctgatttggtggaaccagtatttcatagcccgcgcggaggccctgatacagcaatgggtcc

SEQ ID NO: 107575 - DNA, 75 bp, Artificial Sequence
  Synthetic
ggctgctcgtgaggctgatttggtggaaccagtatttcatagcccgcgcggaggccgtgatacaacaatgggtcc

SEQ ID NO: 107576 - DNA, 75 bp, Artificial Sequence
  Synthetic
ggctgctcgtgaggctgatttggtggaaccagtatttcatagcccgcgcggaggccgtgatacatcaatgggtcc

SEQ ID NO: 107577 - DNA, 75 bp, Artificial Sequence
  Synthetic
ggctgctcgtgaggctgatttggtggaaccagtatttcatagcccgcgcggaggccgtgatacaccaatgggtcc

SEQ ID NO: 107578 - DNA, 75 bp, Artificial Sequence
  Synthetic
ggctgctcgtgaggctgatttggtggaaccagtatttcatagcccgcgcggaggccgtgatacagcaatgggtcc

SEQ ID NO: 107579 - DNA, 75 bp, Artificial Sequence
  Synthetic
ggctgctcgtgaggctgatttggtggaaccagtatttcatagcccgggcggaggccatgatacaacaatgggtcc

SEQ ID NO: 107580 - DNA, 75 bp, Artificial Sequence
  Synthetic
ggctgctcgtgaggctgatttggtggaaccagtatttcatagcccgggcggaggccatgatacatcaatgggtcc

SEQ ID NO: 107581 - DNA, 75 bp, Artificial Sequence
  Synthetic
ggctgctcgtgaggctgatttggtggaaccagtatttcatagcccgggcggaggccatgatacaccaatgggtcc

SEQ ID NO: 107582 - DNA, 75 bp, Artificial Sequence
  Synthetic
ggctgctcgtgaggctgatttggtggaaccagtatttcatagcccgggcggaggccatgatacagcaatgggtcc

SEQ ID NO: 107583 - DNA, 75 bp, Artificial Sequence
  Synthetic
ggctgctcgtgaggctgatttggtggaaccagtatttcatagcccgggcggaggccttgatacaacaatgggtcc

SEQ ID NO: 107584 - DNA, 75 bp, Artificial Sequence
  Synthetic
ggctgctcgtgaggctgatttggtggaaccagtatttcatagcccgggcggaggccttgatacatcaatgggtcc

SEQ ID NO: 107585 - DNA, 75 bp, Artificial Sequence
  Synthetic
ggctgctcgtgaggctgatttggtggaaccagtatttcatagcccgggcggaggccttgatacaccaatgggtcc

SEQ ID NO: 107586 - DNA, 75 bp, Artificial Sequence
  Synthetic
ggctgctcgtgaggctgatttggtggaaccagtatttcatagcccgggcggaggccttgatacagcaatgggtcc

SEQ ID NO: 107587 - DNA, 75 bp, Artificial Sequence
  Synthetic
ggctgctcgtgaggctgatttggtggaaccagtatttcatagcccgggcggaggccctgatacaacaatgggtcc

SEQ ID NO: 107588 - DNA, 75 bp, Artificial Sequence
  Synthetic
ggctgctcgtgaggctgatttggtggaaccagtatttcatagcccgggcggaggccctgatacatcaatgggtcc

SEQ ID NO: 107589 - DNA, 75 bp, Artificial Sequence
  Synthetic
ggctgctcgtgaggctgatttggtggaaccagtatttcatagcccgggcggaggccctgatacaccaatgggtcc

SEQ ID NO: 107590 - DNA, 75 bp, Artificial Sequence
  Synthetic
ggctgctcgtgaggctgatttggtggaaccagtatttcatagcccgggcggaggccctgatacagcaatgggtcc

SEQ ID NO: 107591 - DNA, 75 bp, Artificial Sequence
  Synthetic
ggctgctcgtgaggctgatttggtggaaccagtatttcatagcccgggcggaggccgtgatacaacaatgggtcc

SEQ ID NO: 107592 - DNA, 75 bp, Artificial Sequence
  Synthetic
ggctgctcgtgaggctgatttggtggaaccagtatttcatagcccgggcggaggccgtgatacatcaatgggtcc

SEQ ID NO: 107593 - DNA, 75 bp, Artificial Sequence
  Synthetic
ggctgctcgtgaggctgatttggtggaaccagtatttcatagcccgggcggaggccgtgatacaccaatgggtcc

SEQ ID NO: 107594 - DNA, 75 bp, Artificial Sequence
  Synthetic
ggctgctcgtgaggctgatttggtggaaccagtatttcatagcccgggcggaggccgtgatacagcaatgggtcc

SEQ ID NO: 107595 - DNA, 75 bp, Artificial Sequence
  Synthetic
ttggctctctttggtttttttaccttgtcaccttggtacaagcactggattagccgcttcatgtggtggaaccag

SEQ ID NO: 107596 - DNA, 75 bp, Artificial Sequence
  Synthetic
ttgtgtacgaggcgggcgatgccattctccacactccggggtgtgtgccttgcgttcgcgagggcaacgcctcga

SEQ ID NO: 107597 - DNA, 75 bp, Artificial Sequence
  Synthetic
ggtgtgtttggctgtccgcagagtggcttatggcaagtacatgcaggcatgcctcctcaagatcggcgcttggac

SEQ ID NO: 107598 - DNA, 75 bp, Artificial Sequence
  Synthetic
cctctgctccgccctttacgtgggggacctctgcggtggcgtcttccttgttggccagctgttcaccatcacacc

SEQ ID NO: 107599 - DNA, 75 bp, Artificial Sequence
  Synthetic
cctctgctccgccctttacgtgggggacctctgcggtggcgtcttccttgttggccagctgttcaccttcacacc

SEQ ID NO: 107600 - DNA, 75 bp, Artificial Sequence
  Synthetic
cctctgctccgccctttacgtgggggacctctgcggtggcgtcttccttgttggccagctgttcaccctcacacc

SEQ ID NO: 107601 - DNA, 75 bp, Artificial Sequence
  Synthetic
cctctgctccgccctttacgtgggggacctctgcggtggcgtcttccttgttggccagctgttcaccgtcacacc

SEQ ID NO: 107602 - DNA, 75 bp, Artificial Sequence
  Synthetic
atggagaagaagatcatcacatggggggccgacacagccgcttgcggcgacatacttcagggtctgccggtctcc

SEQ ID NO: 107603 - DNA, 75 bp, Artificial Sequence
  Synthetic
atggagaagaagatcatcacatggggggccgacactgccgcttgcggcgacatacttcagggtctgccggtctcc

SEQ ID NO: 107604 - DNA, 75 bp, Artificial Sequence
  Synthetic
atggagaagaagatcatcacatggggggccgacaccgccgcttgcggcgacatacttcagggtctgccggtctcc

SEQ ID NO: 107605 - DNA, 75 bp, Artificial Sequence
  Synthetic
atggagaagaagatcatcacatggggggccgacacggccgcttgcggcgacatacttcagggtctgccggtctcc

SEQ ID NO: 107606 - DNA, 75 bp, Artificial Sequence
  Synthetic
atggagaagatgatcatcacatggggggccgacacagccgcttgcggcgacatacttcagggtctgccggtctcc

SEQ ID NO: 107607 - DNA, 75 bp, Artificial Sequence
  Synthetic
atggagaagatgatcatcacatggggggccgacactgccgcttgcggcgacatacttcagggtctgccggtctcc

SEQ ID NO: 107608 - DNA, 75 bp, Artificial Sequence
  Synthetic
atggagaagatgatcatcacatggggggccgacaccgccgcttgcggcgacatacttcagggtctgccggtctcc

SEQ ID NO: 107609 - DNA, 75 bp, Artificial Sequence
  Synthetic
atggagaagatgatcatcacatggggggccgacacggccgcttgcggcgacatacttcagggtctgccggtctcc

SEQ ID NO: 107610 - DNA, 75 bp, Artificial Sequence
  Synthetic
atggagaagacgatcatcacatggggggccgacacagccgcttgcggcgacatacttcagggtctgccggtctcc

SEQ ID NO: 107611 - DNA, 75 bp, Artificial Sequence
  Synthetic
atggagaagacgatcatcacatggggggccgacactgccgcttgcggcgacatacttcagggtctgccggtctcc

SEQ ID NO: 107612 - DNA, 75 bp, Artificial Sequence
  Synthetic
atggagaagacgatcatcacatggggggccgacaccgccgcttgcggcgacatacttcagggtctgccggtctcc

SEQ ID NO: 107613 - DNA, 75 bp, Artificial Sequence
  Synthetic
atggagaagacgatcatcacatggggggccgacacggccgcttgcggcgacatacttcagggtctgccggtctcc

SEQ ID NO: 107614 - DNA, 75 bp, Artificial Sequence
  Synthetic
atggagaagaggatcatcacatggggggccgacacagccgcttgcggcgacatacttcagggtctgccggtctcc

SEQ ID NO: 107615 - DNA, 75 bp, Artificial Sequence
  Synthetic
atggagaagaggatcatcacatggggggccgacactgccgcttgcggcgacatacttcagggtctgccggtctcc

SEQ ID NO: 107616 - DNA, 75 bp, Artificial Sequence
  Synthetic
atggagaagaggatcatcacatggggggccgacaccgccgcttgcggcgacatacttcagggtctgccggtctcc

SEQ ID NO: 107617 - DNA, 75 bp, Artificial Sequence
  Synthetic
atggagaagaggatcatcacatggggggccgacacggccgcttgcggcgacatacttcagggtctgccggtctcc

SEQ ID NO: 107618 - DNA, 75 bp, Artificial Sequence
  Synthetic
atgctcgtacgctctgtgatggggggaaagtatttccagatggctatactgagcattggcagatggtttaacacc

SEQ ID NO: 107619 - DNA, 75 bp, Artificial Sequence
  Synthetic
ggaccccccccaaccagagtacgacttggagctcataacatcgtgctcctctaacgtgtcagtcgcccacgacgg

SEQ ID NO: 107620 - DNA, 75 bp, Artificial Sequence
  Synthetic
caaggggtggaaacttctcgcgcctattacggcctacgcccagcagactcgcggcctgtttgggacgatcgtcac

SEQ ID NO: 107621 - DNA, 75 bp, Artificial Sequence
  Synthetic
acaacggcgctcatagtgtcgcagctgctccggatcccacaagccgtcgtggacatgatagccggggcccactgg

SEQ ID NO: 107622 - DNA, 75 bp, Artificial Sequence
  Synthetic
caggggtggcggctccttgctcccatcactgcttatgcccagcaaacacgaggcctcctgggcgccatagtggtg

SEQ ID NO: 107623 - DNA, 75 bp, Artificial Sequence
  Synthetic
tggacagtgtaccacggcgctggctccaagactctggccggcccgaaagggcctgtgtgccagatgtacaccaat

SEQ ID NO: 107624 - DNA, 75 bp, Artificial Sequence
  Synthetic
cgtctgggcaagtggcggccgcgggcgcccaggggctttccaacctcttcacaatggggcctaaacagaagctcc

SEQ ID NO: 107625 - DNA, 75 bp, Artificial Sequence
  Synthetic
ggccactcagaccttcctaggcacaacagtgggaggcgtcatgtggaccgtttaccatggtgcagggtccaagac

SEQ ID NO: 107626 - DNA, 75 bp, Artificial Sequence
  Synthetic
caaagtcaacgactcaggttgccctgagaggttggccagctgtcagcccttaagcgggtttgcccagggctgggg

SEQ ID NO: 107627 - DNA, 75 bp, Artificial Sequence
  Synthetic
ctcttacgagctgctgtctgaacgcggggtgtcgccaaagcgattgactttgtgcccgtggaaagcatggagacc

SEQ ID NO: 107628 - DNA, 75 bp, Artificial Sequence
  Synthetic
ctcttacgagctgctgtctgaacgcggggtgtcgccaaagcgtttgactttgtgcccgtggaaagcatggagacc

SEQ ID NO: 107629 - DNA, 75 bp, Artificial Sequence
  Synthetic
ctcttacgagctgctgtctgaacgcggggtgtcgccaaagcgcttgactttgtgcccgtggaaagcatggagacc

SEQ ID NO: 107630 - DNA, 75 bp, Artificial Sequence
  Synthetic
ctcttacgagctgctgtctgaacgcggggtgtcgccaaagcggttgactttgtgcccgtggaaagcatggagacc

SEQ ID NO: 107631 - DNA, 75 bp, Artificial Sequence
  Synthetic
ctcttacgagctgctgtctgaacgcggggtgtcgccaatgcgattgactttgtgcccgtggaaagcatggagacc

SEQ ID NO: 107632 - DNA, 75 bp, Artificial Sequence
  Synthetic
ctcttacgagctgctgtctgaacgcggggtgtcgccaatgcgtttgactttgtgcccgtggaaagcatggagacc

SEQ ID NO: 107633 - DNA, 75 bp, Artificial Sequence
  Synthetic
ctcttacgagctgctgtctgaacgcggggtgtcgccaatgcgcttgactttgtgcccgtggaaagcatggagacc

SEQ ID NO: 107634 - DNA, 75 bp, Artificial Sequence
  Synthetic
ctcttacgagctgctgtctgaacgcggggtgtcgccaatgcggttgactttgtgcccgtggaaagcatggagacc

SEQ ID NO: 107635 - DNA, 75 bp, Artificial Sequence
  Synthetic
ctcttacgagctgctgtctgaacgcggggtgtcgccaacgcgattgactttgtgcccgtggaaagcatggagacc

SEQ ID NO: 107636 - DNA, 75 bp, Artificial Sequence
  Synthetic
ctcttacgagctgctgtctgaacgcggggtgtcgccaacgcgtttgactttgtgcccgtggaaagcatggagacc

SEQ ID NO: 107637 - DNA, 75 bp, Artificial Sequence
  Synthetic
ctcttacgagctgctgtctgaacgcggggtgtcgccaacgcgcttgactttgtgcccgtggaaagcatggagacc

SEQ ID NO: 107638 - DNA, 75 bp, Artificial Sequence
  Synthetic
ctcttacgagctgctgtctgaacgcggggtgtcgccaacgcggttgactttgtgcccgtggaaagcatggagacc

SEQ ID NO: 107639 - DNA, 75 bp, Artificial Sequence
  Synthetic
ctcttacgagctgctgtctgaacgcggggtgtcgccaaggcgattgactttgtgcccgtggaaagcatggagacc

SEQ ID NO: 107640 - DNA, 75 bp, Artificial Sequence
  Synthetic
ctcttacgagctgctgtctgaacgcggggtgtcgccaaggcgtttgactttgtgcccgtggaaagcatggagacc

SEQ ID NO: 107641 - DNA, 75 bp, Artificial Sequence
  Synthetic
ctcttacgagctgctgtctgaacgcggggtgtcgccaaggcgcttgactttgtgcccgtggaaagcatggagacc

SEQ ID NO: 107642 - DNA, 75 bp, Artificial Sequence
  Synthetic
ctcttacgagctgctgtctgaacgcggggtgtcgccaaggcggttgactttgtgcccgtggaaagcatggagacc

SEQ ID NO: 107643 - DNA, 75 bp, Artificial Sequence
  Synthetic
ctcttacgagctgctgtctgtacgcggggtgtcgccaaagcgattgactttgtgcccgtggaaagcatggagacc

SEQ ID NO: 107644 - DNA, 75 bp, Artificial Sequence
  Synthetic
ctcttacgagctgctgtctgtacgcggggtgtcgccaaagcgtttgactttgtgcccgtggaaagcatggagacc

SEQ ID NO: 107645 - DNA, 75 bp, Artificial Sequence
  Synthetic
ctcttacgagctgctgtctgtacgcggggtgtcgccaaagcgcttgactttgtgcccgtggaaagcatggagacc

SEQ ID NO: 107646 - DNA, 75 bp, Artificial Sequence
  Synthetic
ctcttacgagctgctgtctgtacgcggggtgtcgccaaagcggttgactttgtgcccgtggaaagcatggagacc

SEQ ID NO: 107647 - DNA, 75 bp, Artificial Sequence
  Synthetic
ctcttacgagctgctgtctgtacgcggggtgtcgccaatgcgattgactttgtgcccgtggaaagcatggagacc

SEQ ID NO: 107648 - DNA, 75 bp, Artificial Sequence
  Synthetic
ctcttacgagctgctgtctgtacgcggggtgtcgccaatgcgtttgactttgtgcccgtggaaagcatggagacc

SEQ ID NO: 107649 - DNA, 75 bp, Artificial Sequence
  Synthetic
ctcttacgagctgctgtctgtacgcggggtgtcgccaatgcgcttgactttgtgcccgtggaaagcatggagacc

SEQ ID NO: 107650 - DNA, 75 bp, Artificial Sequence
  Synthetic
ctcttacgagctgctgtctgtacgcggggtgtcgccaatgcggttgactttgtgcccgtggaaagcatggagacc

SEQ ID NO: 107651 - DNA, 75 bp, Artificial Sequence
  Synthetic
ctcttacgagctgctgtctgtacgcggggtgtcgccaacgcgattgactttgtgcccgtggaaagcatggagacc

SEQ ID NO: 107652 - DNA, 75 bp, Artificial Sequence
  Synthetic
ctcttacgagctgctgtctgtacgcggggtgtcgccaacgcgtttgactttgtgcccgtggaaagcatggagacc

SEQ ID NO: 107653 - DNA, 75 bp, Artificial Sequence
  Synthetic
ctcttacgagctgctgtctgtacgcggggtgtcgccaacgcgcttgactttgtgcccgtggaaagcatggagacc

SEQ ID NO: 107654 - DNA, 75 bp, Artificial Sequence
  Synthetic
ctcttacgagctgctgtctgtacgcggggtgtcgccaacgcggttgactttgtgcccgtggaaagcatggagacc

SEQ ID NO: 107655 - DNA, 75 bp, Artificial Sequence
  Synthetic
ctcttacgagctgctgtctgtacgcggggtgtcgccaaggcgattgactttgtgcccgtggaaagcatggagacc

SEQ ID NO: 107656 - DNA, 75 bp, Artificial Sequence
  Synthetic
ctcttacgagctgctgtctgtacgcggggtgtcgccaaggcgtttgactttgtgcccgtggaaagcatggagacc

SEQ ID NO: 107657 - DNA, 75 bp, Artificial Sequence
  Synthetic
ctcttacgagctgctgtctgtacgcggggtgtcgccaaggcgcttgactttgtgcccgtggaaagcatggagacc

SEQ ID NO: 107658 - DNA, 75 bp, Artificial Sequence
  Synthetic
ctcttacgagctgctgtctgtacgcggggtgtcgccaaggcggttgactttgtgcccgtggaaagcatggagacc

SEQ ID NO: 107659 - DNA, 75 bp, Artificial Sequence
  Synthetic
ctcttacgagctgctgtctgcacgcggggtgtcgccaaagcgattgactttgtgcccgtggaaagcatggagacc

SEQ ID NO: 107660 - DNA, 75 bp, Artificial Sequence
  Synthetic
ctcttacgagctgctgtctgcacgcggggtgtcgccaaagcgtttgactttgtgcccgtggaaagcatggagacc

SEQ ID NO: 107661 - DNA, 75 bp, Artificial Sequence
  Synthetic
ctcttacgagctgctgtctgcacgcggggtgtcgccaaagcgcttgactttgtgcccgtggaaagcatggagacc

SEQ ID NO: 107662 - DNA, 75 bp, Artificial Sequence
  Synthetic
ctcttacgagctgctgtctgcacgcggggtgtcgccaaagcggttgactttgtgcccgtggaaagcatggagacc

SEQ ID NO: 107663 - DNA, 75 bp, Artificial Sequence
  Synthetic
ctcttacgagctgctgtctgcacgcggggtgtcgccaatgcgattgactttgtgcccgtggaaagcatggagacc

SEQ ID NO: 107664 - DNA, 75 bp, Artificial Sequence
  Synthetic
ctcttacgagctgctgtctgcacgcggggtgtcgccaatgcgtttgactttgtgcccgtggaaagcatggagacc

SEQ ID NO: 107665 - DNA, 75 bp, Artificial Sequence
  Synthetic
ctcttacgagctgctgtctgcacgcggggtgtcgccaatgcgcttgactttgtgcccgtggaaagcatggagacc

SEQ ID NO: 107666 - DNA, 75 bp, Artificial Sequence
  Synthetic
ctcttacgagctgctgtctgcacgcggggtgtcgccaatgcggttgactttgtgcccgtggaaagcatggagacc

SEQ ID NO: 107667 - DNA, 75 bp, Artificial Sequence
  Synthetic
ctcttacgagctgctgtctgcacgcggggtgtcgccaacgcgattgactttgtgcccgtggaaagcatggagacc

SEQ ID NO: 107668 - DNA, 75 bp, Artificial Sequence
  Synthetic
ctcttacgagctgctgtctgcacgcggggtgtcgccaacgcgtttgactttgtgcccgtggaaagcatggagacc

SEQ ID NO: 107669 - DNA, 75 bp, Artificial Sequence
  Synthetic
ctcttacgagctgctgtctgcacgcggggtgtcgccaacgcgcttgactttgtgcccgtggaaagcatggagacc

SEQ ID NO: 107670 - DNA, 75 bp, Artificial Sequence
  Synthetic
ctcttacgagctgctgtctgcacgcggggtgtcgccaacgcggttgactttgtgcccgtggaaagcatggagacc

SEQ ID NO: 107671 - DNA, 75 bp, Artificial Sequence
  Synthetic
ctcttacgagctgctgtctgcacgcggggtgtcgccaaggcgattgactttgtgcccgtggaaagcatggagacc

SEQ ID NO: 107672 - DNA, 75 bp, Artificial Sequence
  Synthetic
ctcttacgagctgctgtctgcacgcggggtgtcgccaaggcgtttgactttgtgcccgtggaaagcatggagacc

SEQ ID NO: 107673 - DNA, 75 bp, Artificial Sequence
  Synthetic
ctcttacgagctgctgtctgcacgcggggtgtcgccaaggcgcttgactttgtgcccgtggaaagcatggagacc

SEQ ID NO: 107674 - DNA, 75 bp, Artificial Sequence
  Synthetic
ctcttacgagctgctgtctgcacgcggggtgtcgccaaggcggttgactttgtgcccgtggaaagcatggagacc

SEQ ID NO: 107675 - DNA, 75 bp, Artificial Sequence
  Synthetic
ctcttacgagctgctgtctggacgcggggtgtcgccaaagcgattgactttgtgcccgtggaaagcatggagacc

SEQ ID NO: 107676 - DNA, 75 bp, Artificial Sequence
  Synthetic
ctcttacgagctgctgtctggacgcggggtgtcgccaaagcgtttgactttgtgcccgtggaaagcatggagacc

SEQ ID NO: 107677 - DNA, 75 bp, Artificial Sequence
  Synthetic
ctcttacgagctgctgtctggacgcggggtgtcgccaaagcgcttgactttgtgcccgtggaaagcatggagacc

SEQ ID NO: 107678 - DNA, 75 bp, Artificial Sequence
  Synthetic
ctcttacgagctgctgtctggacgcggggtgtcgccaaagcggttgactttgtgcccgtggaaagcatggagacc

SEQ ID NO: 107679 - DNA, 75 bp, Artificial Sequence
  Synthetic
ctcttacgagctgctgtctggacgcggggtgtcgccaatgcgattgactttgtgcccgtggaaagcatggagacc

SEQ ID NO: 107680 - DNA, 75 bp, Artificial Sequence
  Synthetic
ctcttacgagctgctgtctggacgcggggtgtcgccaatgcgtttgactttgtgcccgtggaaagcatggagacc

SEQ ID NO: 107681 - DNA, 75 bp, Artificial Sequence
  Synthetic
ctcttacgagctgctgtctggacgcggggtgtcgccaatgcgcttgactttgtgcccgtggaaagcatggagacc

SEQ ID NO: 107682 - DNA, 75 bp, Artificial Sequence
  Synthetic
ctcttacgagctgctgtctggacgcggggtgtcgccaatgcggttgactttgtgcccgtggaaagcatggagacc

SEQ ID NO: 107683 - DNA, 75 bp, Artificial Sequence
  Synthetic
ctcttacgagctgctgtctggacgcggggtgtcgccaacgcgattgactttgtgcccgtggaaagcatggagacc

SEQ ID NO: 107684 - DNA, 75 bp, Artificial Sequence
  Synthetic
ctcttacgagctgctgtctggacgcggggtgtcgccaacgcgtttgactttgtgcccgtggaaagcatggagacc

SEQ ID NO: 107685 - DNA, 75 bp, Artificial Sequence
  Synthetic
ctcttacgagctgctgtctggacgcggggtgtcgccaacgcgcttgactttgtgcccgtggaaagcatggagacc

SEQ ID NO: 107686 - DNA, 75 bp, Artificial Sequence
  Synthetic
ctcttacgagctgctgtctggacgcggggtgtcgccaacgcggttgactttgtgcccgtggaaagcatggagacc

SEQ ID NO: 107687 - DNA, 75 bp, Artificial Sequence
  Synthetic
ctcttacgagctgctgtctggacgcggggtgtcgccaaggcgattgactttgtgcccgtggaaagcatggagacc

SEQ ID NO: 107688 - DNA, 75 bp, Artificial Sequence
  Synthetic
ctcttacgagctgctgtctggacgcggggtgtcgccaaggcgtttgactttgtgcccgtggaaagcatggagacc

SEQ ID NO: 107689 - DNA, 75 bp, Artificial Sequence
  Synthetic
ctcttacgagctgctgtctggacgcggggtgtcgccaaggcgcttgactttgtgcccgtggaaagcatggagacc

SEQ ID NO: 107690 - DNA, 75 bp, Artificial Sequence
  Synthetic
ctcttacgagctgctgtctggacgcggggtgtcgccaaggcggttgactttgtgcccgtggaaagcatggagacc

SEQ ID NO: 107691 - DNA, 75 bp, Artificial Sequence
  Synthetic
ggccctgtgtactgcttcactcccagccccgtcgtcgtggggacaaccgataaaaagggtgttcccacttacgaa

SEQ ID NO: 107692 - DNA, 75 bp, Artificial Sequence
  Synthetic
acaaacctatcaagtggggtacctgcacgctccgactggcagtgggaagagcacgaaagtgccggcggcatatgc

SEQ ID NO: 107693 - DNA, 75 bp, Artificial Sequence
  Synthetic
cacggcgcggctggatttgcttcactcttcacatcaggcgccaaacagaacatccagttggtcaacagcaacggc

SEQ ID NO: 107694 - DNA, 75 bp, Artificial Sequence
  Synthetic
aaacgtgcggagcacccccctgcaacatcggaggggtgggcaacaacacccttatctgcccgaccgactgtttcc

SEQ ID NO: 107695 - DNA, 75 bp, Artificial Sequence
  Synthetic
gagcgccaccctctgctcggccctctatgtgggggacctgtgcgggtctgtcttccttgtcggtcaactgttcac

SEQ ID NO: 107696 - DNA, 75 bp, Artificial Sequence
  Synthetic
agaacaggtgttagaaccatcaccacgggaggccccattacatattccacctatggcaagtttctggccgatggg

SEQ ID NO: 107697 - DNA, 75 bp, Artificial Sequence
  Synthetic
agacggccggagtacgcctcacggtcctggctaccgccacgcctcctggttctgtcacagtcccccatccgaaca

SEQ ID NO: 107698 - DNA, 75 bp, Artificial Sequence
  Synthetic
tgacggccggagtacgcctcacggtcctggctaccgccacgcctcctggttctgtcacagtcccccatccgaaca

SEQ ID NO: 107699 - DNA, 75 bp, Artificial Sequence
  Synthetic
cgacggccggagtacgcctcacggtcctggctaccgccacgcctcctggttctgtcacagtcccccatccgaaca

SEQ ID NO: 107700 - DNA, 75 bp, Artificial Sequence
  Synthetic
ggacggccggagtacgcctcacggtcctggctaccgccacgcctcctggttctgtcacagtcccccatccgaaca

SEQ ID NO: 107701 - DNA, 75 bp, Artificial Sequence
  Synthetic
cactctcaactatactctgttcaagatcaggatgtacgtgggaggggtggaacatcggttgactgccgcgtgcaa

SEQ ID NO: 107702 - DNA, 75 bp, Artificial Sequence
  Synthetic
atcaggatgtacgtgggaggggtggaacatcggttgactgccgcgtgcaattggacgcgaggggagcggtgcgac

SEQ ID NO: 107703 - DNA, 75 bp, Artificial Sequence
  Synthetic
gcgatccccctagagtacatcaagggtggacgacaccttatcttttgccactccaaaaagaagtgcgacgagctg

SEQ ID NO: 107704 - DNA, 75 bp, Artificial Sequence
  Synthetic
tcaatgccgtagccttctacaggggtgttgatgtgtcagtgatccccaccgctggggacgtggtcgtctgcgcca

SEQ ID NO: 107705 - DNA, 75 bp, Artificial Sequence
  Synthetic
ttgcatggcctcccggtttccgcgaggttgggcagagaagttctgcttggccctgcagatagctacgcctcgaag

SEQ ID NO: 107706 - DNA, 75 bp, Artificial Sequence
  Synthetic
catcgtggacgtgcagtacctgtacggggtggggtcgagcattgtatcttgggccatcaaatgggaatatgtcat

SEQ ID NO: 107707 - DNA, 75 bp, Artificial Sequence
  Synthetic
tacaattgagaccaccaccgtcccgcaagatgctgtggcgagaagccaacggcgtggccgcacgggcagggggaa

SEQ ID NO: 107708 - DNA, 75 bp, Artificial Sequence
  Synthetic
cacctggcagctcgacgctgcggtcctccacgtccccgggtgcgtcccgtgcgagaaggtgggggacacatctcg

SEQ ID NO: 107709 - DNA, 75 bp, Artificial Sequence
  Synthetic
ctcaacgcagcatcactggcagggacacacggtatcttgtccttcttggtgttcttctgcttcgcgtggtacctg

SEQ ID NO: 107710 - DNA, 75 bp, Artificial Sequence
  Synthetic
ctccgtcacacaatctttcttggggacatctatttcgggggtcctctggacagtatatcacggggctggtaataa

SEQ ID NO: 107711 - DNA, 75 bp, Artificial Sequence
  Synthetic
acattaacaggaccgccctgaactgcaatgactccctcaacaccgggtttattgccgcgctgttctacgtacgcc

SEQ ID NO: 107712 - DNA, 75 bp, Artificial Sequence
  Synthetic
tcgacaccgtcgtcctttgtgaggcctatgatacagggtgcgcgtggtatgagctaacaccctcagagaccaccg

SEQ ID NO: 107713 - DNA, 75 bp, Artificial Sequence
  Synthetic
tgcaactggacgcggggcgagcgttgcgatctggaagacagggacaggtccgagctcagcccgttgctgctgtcc

SEQ ID NO: 107714 - DNA, 75 bp, Artificial Sequence
  Synthetic
cggaggtggccgcggcgtgtggcagcaccgttctagtgtgcctggtggtgataaccctgtcgccacattacaagc

SEQ ID NO: 107715 - DNA, 75 bp, Artificial Sequence
  Synthetic
cttggaccagaggccttattgctggcactacgcgcctcggccgtgcggtattgtacccgcgtcgcaggtgtgtgg

SEQ ID NO: 107716 - DNA, 75 bp, Artificial Sequence
  Synthetic
tctacctggtcacccgaaacgctgacgtcattccggtccggaggaaagatgaccgacggggtgcactactctcgc

SEQ ID NO: 107717 - DNA, 75 bp, Artificial Sequence
  Synthetic
ccacttcctctcacaaaccaaacaggggggggagaaatttgcgtacctcgtggcataccaagccacggtgtgtgc

SEQ ID NO: 107718 - DNA, 75 bp, Artificial Sequence
  Synthetic
ccacttcctctcacaaaccaaacaggggggggagaaatttgcgtacctcgtggcttaccaagccacggtgtgtgc

SEQ ID NO: 107719 - DNA, 75 bp, Artificial Sequence
  Synthetic
ccacttcctctcacaaaccaaacaggggggggagaaatttgcgtacctcgtggcctaccaagccacggtgtgtgc

SEQ ID NO: 107720 - DNA, 75 bp, Artificial Sequence
  Synthetic
ccacttcctctcacaaaccaaacaggggggggagaaatttgcgtacctcgtggcgtaccaagccacggtgtgtgc

SEQ ID NO: 107721 - DNA, 75 bp, Artificial Sequence
  Synthetic
ccacttcctctcacaaaccaaacaggggggggagaattttgcgtacctcgtggcataccaagccacggtgtgtgc

SEQ ID NO: 107722 - DNA, 75 bp, Artificial Sequence
  Synthetic
ccacttcctctcacaaaccaaacaggggggggagaattttgcgtacctcgtggcttaccaagccacggtgtgtgc

SEQ ID NO: 107723 - DNA, 75 bp, Artificial Sequence
  Synthetic
ccacttcctctcacaaaccaaacaggggggggagaattttgcgtacctcgtggcctaccaagccacggtgtgtgc

SEQ ID NO: 107724 - DNA, 75 bp, Artificial Sequence
  Synthetic
ccacttcctctcacaaaccaaacaggggggggagaattttgcgtacctcgtggcgtaccaagccacggtgtgtgc

SEQ ID NO: 107725 - DNA, 75 bp, Artificial Sequence
  Synthetic
ccacttcctctcacaaaccaaacaggggggggagaactttgcgtacctcgtggcataccaagccacggtgtgtgc

SEQ ID NO: 107726 - DNA, 75 bp, Artificial Sequence
  Synthetic
ccacttcctctcacaaaccaaacaggggggggagaactttgcgtacctcgtggcttaccaagccacggtgtgtgc

SEQ ID NO: 107727 - DNA, 75 bp, Artificial Sequence
  Synthetic
ccacttcctctcacaaaccaaacaggggggggagaactttgcgtacctcgtggcctaccaagccacggtgtgtgc

SEQ ID NO: 107728 - DNA, 75 bp, Artificial Sequence
  Synthetic
ccacttcctctcacaaaccaaacaggggggggagaactttgcgtacctcgtggcgtaccaagccacggtgtgtgc

SEQ ID NO: 107729 - DNA, 75 bp, Artificial Sequence
  Synthetic
ccacttcctctcacaaaccaaacaggggggggagaagtttgcgtacctcgtggcataccaagccacggtgtgtgc

SEQ ID NO: 107730 - DNA, 75 bp, Artificial Sequence
  Synthetic
ccacttcctctcacaaaccaaacaggggggggagaagtttgcgtacctcgtggcttaccaagccacggtgtgtgc

SEQ ID NO: 107731 - DNA, 75 bp, Artificial Sequence
  Synthetic
ccacttcctctcacaaaccaaacaggggggggagaagtttgcgtacctcgtggcctaccaagccacggtgtgtgc

SEQ ID NO: 107732 - DNA, 75 bp, Artificial Sequence
  Synthetic
ccacttcctctcacaaaccaaacaggggggggagaagtttgcgtacctcgtggcgtaccaagccacggtgtgtgc

SEQ ID NO: 107733 - DNA, 75 bp, Artificial Sequence
  Synthetic
ccacttcctctctcaaaccaaacaggggggggagaaatttgcgtacctcgtggcataccaagccacggtgtgtgc

SEQ ID NO: 107734 - DNA, 75 bp, Artificial Sequence
  Synthetic
ccacttcctctctcaaaccaaacaggggggggagaaatttgcgtacctcgtggcttaccaagccacggtgtgtgc

SEQ ID NO: 107735 - DNA, 75 bp, Artificial Sequence
  Synthetic
ccacttcctctctcaaaccaaacaggggggggagaaatttgcgtacctcgtggcctaccaagccacggtgtgtgc

SEQ ID NO: 107736 - DNA, 75 bp, Artificial Sequence
  Synthetic
ccacttcctctctcaaaccaaacaggggggggagaaatttgcgtacctcgtggcgtaccaagccacggtgtgtgc

SEQ ID NO: 107737 - DNA, 75 bp, Artificial Sequence
  Synthetic
ccacttcctctctcaaaccaaacaggggggggagaattttgcgtacctcgtggcataccaagccacggtgtgtgc

SEQ ID NO: 107738 - DNA, 75 bp, Artificial Sequence
  Synthetic
ccacttcctctctcaaaccaaacaggggggggagaattttgcgtacctcgtggcttaccaagccacggtgtgtgc

SEQ ID NO: 107739 - DNA, 75 bp, Artificial Sequence
  Synthetic
ccacttcctctctcaaaccaaacaggggggggagaattttgcgtacctcgtggcctaccaagccacggtgtgtgc

SEQ ID NO: 107740 - DNA, 75 bp, Artificial Sequence
  Synthetic
ccacttcctctctcaaaccaaacaggggggggagaattttgcgtacctcgtggcgtaccaagccacggtgtgtgc

SEQ ID NO: 107741 - DNA, 75 bp, Artificial Sequence
  Synthetic
ccacttcctctctcaaaccaaacaggggggggagaactttgcgtacctcgtggcataccaagccacggtgtgtgc

SEQ ID NO: 107742 - DNA, 75 bp, Artificial Sequence
  Synthetic
ccacttcctctctcaaaccaaacaggggggggagaactttgcgtacctcgtggcttaccaagccacggtgtgtgc

SEQ ID NO: 107743 - DNA, 75 bp, Artificial Sequence
  Synthetic
ccacttcctctctcaaaccaaacaggggggggagaactttgcgtacctcgtggcctaccaagccacggtgtgtgc

SEQ ID NO: 107744 - DNA, 75 bp, Artificial Sequence
  Synthetic
ccacttcctctctcaaaccaaacaggggggggagaactttgcgtacctcgtggcgtaccaagccacggtgtgtgc

SEQ ID NO: 107745 - DNA, 75 bp, Artificial Sequence
  Synthetic
ccacttcctctctcaaaccaaacaggggggggagaagtttgcgtacctcgtggcataccaagccacggtgtgtgc

SEQ ID NO: 107746 - DNA, 75 bp, Artificial Sequence
  Synthetic
ccacttcctctctcaaaccaaacaggggggggagaagtttgcgtacctcgtggcttaccaagccacggtgtgtgc

SEQ ID NO: 107747 - DNA, 75 bp, Artificial Sequence
  Synthetic
ccacttcctctctcaaaccaaacaggggggggagaagtttgcgtacctcgtggcctaccaagccacggtgtgtgc

SEQ ID NO: 107748 - DNA, 75 bp, Artificial Sequence
  Synthetic
ccacttcctctctcaaaccaaacaggggggggagaagtttgcgtacctcgtggcgtaccaagccacggtgtgtgc

SEQ ID NO: 107749 - DNA, 75 bp, Artificial Sequence
  Synthetic
ccacttcctctcccaaaccaaacaggggggggagaaatttgcgtacctcgtggcataccaagccacggtgtgtgc

SEQ ID NO: 107750 - DNA, 75 bp, Artificial Sequence
  Synthetic
ccacttcctctcccaaaccaaacaggggggggagaaatttgcgtacctcgtggcttaccaagccacggtgtgtgc

SEQ ID NO: 107751 - DNA, 75 bp, Artificial Sequence
  Synthetic
ccacttcctctcccaaaccaaacaggggggggagaaatttgcgtacctcgtggcctaccaagccacggtgtgtgc

SEQ ID NO: 107752 - DNA, 75 bp, Artificial Sequence
  Synthetic
ccacttcctctcccaaaccaaacaggggggggagaaatttgcgtacctcgtggcgtaccaagccacggtgtgtgc

SEQ ID NO: 107753 - DNA, 75 bp, Artificial Sequence
  Synthetic
ccacttcctctcccaaaccaaacaggggggggagaattttgcgtacctcgtggcataccaagccacggtgtgtgc

SEQ ID NO: 107754 - DNA, 75 bp, Artificial Sequence
  Synthetic
ccacttcctctcccaaaccaaacaggggggggagaattttgcgtacctcgtggcttaccaagccacggtgtgtgc

SEQ ID NO: 107755 - DNA, 75 bp, Artificial Sequence
  Synthetic
ccacttcctctcccaaaccaaacaggggggggagaattttgcgtacctcgtggcctaccaagccacggtgtgtgc

SEQ ID NO: 107756 - DNA, 75 bp, Artificial Sequence
  Synthetic
ccacttcctctcccaaaccaaacaggggggggagaattttgcgtacctcgtggcgtaccaagccacggtgtgtgc

SEQ ID NO: 107757 - DNA, 75 bp, Artificial Sequence
  Synthetic
ccacttcctctcccaaaccaaacaggggggggagaactttgcgtacctcgtggcataccaagccacggtgtgtgc

SEQ ID NO: 107758 - DNA, 75 bp, Artificial Sequence
  Synthetic
ccacttcctctcccaaaccaaacaggggggggagaactttgcgtacctcgtggcttaccaagccacggtgtgtgc

SEQ ID NO: 107759 - DNA, 75 bp, Artificial Sequence
  Synthetic
ccacttcctctcccaaaccaaacaggggggggagaactttgcgtacctcgtggcctaccaagccacggtgtgtgc

SEQ ID NO: 107760 - DNA, 75 bp, Artificial Sequence
  Synthetic
ccacttcctctcccaaaccaaacaggggggggagaactttgcgtacctcgtggcgtaccaagccacggtgtgtgc

SEQ ID NO: 107761 - DNA, 75 bp, Artificial Sequence
  Synthetic
ccacttcctctcccaaaccaaacaggggggggagaagtttgcgtacctcgtggcataccaagccacggtgtgtgc

SEQ ID NO: 107762 - DNA, 75 bp, Artificial Sequence
  Synthetic
ccacttcctctcccaaaccaaacaggggggggagaagtttgcgtacctcgtggcttaccaagccacggtgtgtgc

SEQ ID NO: 107763 - DNA, 75 bp, Artificial Sequence
  Synthetic
ccacttcctctcccaaaccaaacaggggggggagaagtttgcgtacctcgtggcctaccaagccacggtgtgtgc

SEQ ID NO: 107764 - DNA, 75 bp, Artificial Sequence
  Synthetic
ccacttcctctcccaaaccaaacaggggggggagaagtttgcgtacctcgtggcgtaccaagccacggtgtgtgc

SEQ ID NO: 107765 - DNA, 75 bp, Artificial Sequence
  Synthetic
ccacttcctctcgcaaaccaaacaggggggggagaaatttgcgtacctcgtggcataccaagccacggtgtgtgc

SEQ ID NO: 107766 - DNA, 75 bp, Artificial Sequence
  Synthetic
ccacttcctctcgcaaaccaaacaggggggggagaaatttgcgtacctcgtggcttaccaagccacggtgtgtgc

SEQ ID NO: 107767 - DNA, 75 bp, Artificial Sequence
  Synthetic
ccacttcctctcgcaaaccaaacaggggggggagaaatttgcgtacctcgtggcctaccaagccacggtgtgtgc

SEQ ID NO: 107768 - DNA, 75 bp, Artificial Sequence
  Synthetic
ccacttcctctcgcaaaccaaacaggggggggagaaatttgcgtacctcgtggcgtaccaagccacggtgtgtgc

SEQ ID NO: 107769 - DNA, 75 bp, Artificial Sequence
  Synthetic
ccacttcctctcgcaaaccaaacaggggggggagaattttgcgtacctcgtggcataccaagccacggtgtgtgc

SEQ ID NO: 107770 - DNA, 75 bp, Artificial Sequence
  Synthetic
ccacttcctctcgcaaaccaaacaggggggggagaattttgcgtacctcgtggcttaccaagccacggtgtgtgc

SEQ ID NO: 107771 - DNA, 75 bp, Artificial Sequence
  Synthetic
ccacttcctctcgcaaaccaaacaggggggggagaattttgcgtacctcgtggcctaccaagccacggtgtgtgc

SEQ ID NO: 107772 - DNA, 75 bp, Artificial Sequence
  Synthetic
ccacttcctctcgcaaaccaaacaggggggggagaattttgcgtacctcgtggcgtaccaagccacggtgtgtgc

SEQ ID NO: 107773 - DNA, 75 bp, Artificial Sequence
  Synthetic
ccacttcctctcgcaaaccaaacaggggggggagaactttgcgtacctcgtggcataccaagccacggtgtgtgc

SEQ ID NO: 107774 - DNA, 75 bp, Artificial Sequence
  Synthetic
ccacttcctctcgcaaaccaaacaggggggggagaactttgcgtacctcgtggcttaccaagccacggtgtgtgc

SEQ ID NO: 107775 - DNA, 75 bp, Artificial Sequence
  Synthetic
ccacttcctctcgcaaaccaaacaggggggggagaactttgcgtacctcgtggcctaccaagccacggtgtgtgc

SEQ ID NO: 107776 - DNA, 75 bp, Artificial Sequence
  Synthetic
ccacttcctctcgcaaaccaaacaggggggggagaactttgcgtacctcgtggcgtaccaagccacggtgtgtgc

SEQ ID NO: 107777 - DNA, 75 bp, Artificial Sequence
  Synthetic
ccacttcctctcgcaaaccaaacaggggggggagaagtttgcgtacctcgtggcataccaagccacggtgtgtgc

SEQ ID NO: 107778 - DNA, 75 bp, Artificial Sequence
  Synthetic
ccacttcctctcgcaaaccaaacaggggggggagaagtttgcgtacctcgtggcttaccaagccacggtgtgtgc

SEQ ID NO: 107779 - DNA, 75 bp, Artificial Sequence
  Synthetic
ccacttcctctcgcaaaccaaacaggggggggagaagtttgcgtacctcgtggcctaccaagccacggtgtgtgc

SEQ ID NO: 107780 - DNA, 75 bp, Artificial Sequence
  Synthetic
ccacttcctctcgcaaaccaaacaggggggggagaagtttgcgtacctcgtggcgtaccaagccacggtgtgtgc

SEQ ID NO: 107781 - DNA, 75 bp, Artificial Sequence
  Synthetic
tgacgccgtcatcctgctcatgtgtgcaatacatccaagcctggtctttgatgttaccaaattgctcctggccgt

SEQ ID NO: 107782 - DNA, 75 bp, Artificial Sequence
  Synthetic
gcgtcatgtttggcttggcctacttctctatgcagggagcgtgggcgaaagtcgttgtcatccttctgctggccg

SEQ ID NO: 107783 - DNA, 75 bp, Artificial Sequence
  Synthetic
gcaggcggtcactatgttcagatgtttatcatcaagctgggagctcttactggcacatacatctataaccatctc

SEQ ID NO: 107784 - DNA, 75 bp, Artificial Sequence
  Synthetic
tcacgggaggggttcttgctgcattggcagcgtattgcctgacaacaggtagagctgtcatatgcggcaggatca

SEQ ID NO: 107785 - DNA, 75 bp, Artificial Sequence
  Synthetic
tcacgggaggggttcttgctgcattggcagcgtattgcctgacaacaggtagtgctgtcatatgcggcaggatca

SEQ ID NO: 107786 - DNA, 75 bp, Artificial Sequence
  Synthetic
tcacgggaggggttcttgctgcattggcagcgtattgcctgacaacaggtagcgctgtcatatgcggcaggatca

SEQ ID NO: 107787 - DNA, 75 bp, Artificial Sequence
  Synthetic
tcacgggaggggttcttgctgcattggcagcgtattgcctgacaacaggtagggctgtcatatgcggcaggatca

SEQ ID NO: 107788 - DNA, 75 bp, Artificial Sequence
  Synthetic
gcaatgaatccctgaacaccggctttcttgcggccctgttctacgccaaccgcttcaactcgtcaggatgtcctg

SEQ ID NO: 107789 - DNA, 75 bp, Artificial Sequence
  Synthetic
cacaggctcaacgccgcgtgcaattggactcgaggagagcgttgcaacttggaggacagggataggtcagagctt

SEQ ID NO: 107790 - DNA, 75 bp, Artificial Sequence
  Synthetic
gagcggacactgccgcatgtggcgacatcattaacggcttgcccgtctctgcacggaggggaaatgagatcttgc

SEQ ID NO: 107791 - DNA, 75 bp, Artificial Sequence
  Synthetic
gggtcaacatctcgctgagcaattcaaacagaaggtcatgggcctcctgcaggtcacagccaaacaggcggagga

SEQ ID NO: 107792 - DNA, 75 bp, Artificial Sequence
  Synthetic
gttgaagccggcggttcattccgcctggcctagacttgagcagttttggcagaaacacctgtggaactttgtcag

SEQ ID NO: 107793 - DNA, 75 bp, Artificial Sequence
  Synthetic
cagcctcaccggccgggacaagaaccaagtggagggcgagatccaaatcgtgtcgactgccacccagactttcct

SEQ ID NO: 107794 - DNA, 75 bp, Artificial Sequence
  Synthetic
gctgtccagaccaactggcaaaaactcgaggccttctgggcgaagcatatgtggaacttcatcagtgggatacaa

SEQ ID NO: 107795 - DNA, 75 bp, Artificial Sequence
  Synthetic
tccacgacccttctccttaacatcttaggaggatgggtggcatcccaactggcaccgccgtcggcgtccacggct

SEQ ID NO: 107796 - DNA, 75 bp, Artificial Sequence
  Synthetic
ggcaccgccgtcggcgtccacggcttttgtcgttagcggccttgcgggcgctgctgtcggcagcattggcctagg

SEQ ID NO: 107797 - DNA, 75 bp, Artificial Sequence
  Synthetic
gtggacttggacctcgtgggctggccggctcctgccggatcacgctccctacagccctgcacctgtggttcctcg

SEQ ID NO: 107798 - DNA, 75 bp, Artificial Sequence
  Synthetic
ccacccagtggatgaacaggcttatagcatttgcctctaggggcaatcatgtctcaccaacgcactatgtgcctg

SEQ ID NO: 107799 - DNA, 75 bp, Artificial Sequence
  Synthetic
agcatttgcctctaggggcaatcatgtctcaccaacgcactatgtgcctgaaacagacgcctccagaaatgtgat

SEQ ID NO: 107800 - DNA, 75 bp, Artificial Sequence
  Synthetic
ttgcttgacatcctggcagggtacggagccggagtctcaggcgctttggtggcgtttaagatcatgggaggagag

SEQ ID NO: 107801 - DNA, 75 bp, Artificial Sequence
  Synthetic
ccagaccttccaggtggcccacctgcatgcccccaccggcagtggcaagagcaccaaggttccagccgcctacgc

SEQ ID NO: 107802 - DNA, 75 bp, Artificial Sequence
  Synthetic
ctccaccaaaacatcgtggatgtacaatacatgtatggcctgtcacctgctcttacaaaatacatcgttcgatgg

SEQ ID NO: 107803 - DNA, 75 bp, Artificial Sequence
  Synthetic
gacaagtttgctcaggggtggggtcccatcacttacggtgagcctgacgactcggaccagaggccctattgctgg

SEQ ID NO: 107804 - DNA, 75 bp, Artificial Sequence
  Synthetic
gacatctgggactgggtttgcaccgtgttatctgactttaaggcatggttgaaggtcaaacttctacccgcccta

SEQ ID NO: 107805 - DNA, 75 bp, Artificial Sequence
  Synthetic
aatacatgtatggcctgtcacctgctcttacaaaatacatcgttcgatgggagtgggttgtactcttattcctgc

SEQ ID NO: 107806 - DNA, 75 bp, Artificial Sequence
  Synthetic
catgcccccaccggcagtggcaagagcaccaaggttccagccgcctacgcagcccaaggctacaaggtgctggtg

SEQ ID NO: 107807 - DNA, 75 bp, Artificial Sequence
  Synthetic
ccgggcatccctttcctctcgtgtcaacgagggttcagaggagtctggcggggcgatggcatctgctatacaaca

SEQ ID NO: 107808 - DNA, 75 bp, Artificial Sequence
  Synthetic
ctggcagcccgattacgtactccacctacggcaagtttcttgccgatggcgggtgctccggaggcgcctatgaca

SEQ ID NO: 107809 - DNA, 75 bp, Artificial Sequence
  Synthetic
cttactggcacctatgtttacaaccatctcactcctctccgggactgggcgcacaacggcctacgagatctggcc

SEQ ID NO: 107810 - DNA, 75 bp, Artificial Sequence
  Synthetic
aatgtctggcacggcacatttcccatcaacgccaccaccaccggccccagcgtgcctatcccggagcctaactac

SEQ ID NO: 107811 - DNA, 75 bp, Artificial Sequence
  Synthetic
ggtctatggtctttctgcctactgctcctggcattgccccaacaggcttatgcgtatgatacatctgcgcacgga

SEQ ID NO: 107812 - DNA, 75 bp, Artificial Sequence
  Synthetic
cctcgctactgccacccccccaggttctgtcaccgtgcctcacgccaacatcgaggaagttgccctgtccacaac

SEQ ID NO: 107813 - DNA, 75 bp, Artificial Sequence
  Synthetic
tcgaggaagttgccctgtccacaactggggagatccctttttatggcaaagccatcccccttgacgtcatcaaag

SEQ ID NO: 107814 - DNA, 75 bp, Artificial Sequence
  Synthetic
ggggcgacagctgacaacttaaagtgtccctgccaagtgccggctccagagttcttcactgaggtggatggcgtg

SEQ ID NO: 107815 - DNA, 75 bp, Artificial Sequence
  Synthetic
gttcttcactgaggtggatggcgtgaggttgcaccggtatgctccggcatgccggccattgctccgggatgaggt

SEQ ID NO: 107816 - DNA, 75 bp, Artificial Sequence
  Synthetic
gggccgcgcacgtgcgctaacatgtggcacggcactttccccatcaatgagtataccaccggacccagcatacct

SEQ ID NO: 107817 - DNA, 75 bp, Artificial Sequence
  Synthetic
gtcctcatagccagggatcagcttgaacaggcccttgattgcgagatctacggagcctgctactccatagaacca

SEQ ID NO: 107818 - DNA, 75 bp, Artificial Sequence
  Synthetic
gaccatatcaccgcggaggaggcgcgtcgacgcctcgcgcgaggttctcctccgtctctggccagttcctcagcg

SEQ ID NO: 107819 - DNA, 75 bp, Artificial Sequence
  Synthetic
aactcactccaatagcggccgctagccagctggacttgtccggctggttcacggctggctacagcgggggagaca

SEQ ID NO: 107820 - DNA, 75 bp, Artificial Sequence
  Synthetic
atgctgctgatagctcaggctgaggccgccttggagaacttggtggtcctcaacgcggcgtctgtggccggagcg

SEQ ID NO: 107821 - DNA, 75 bp, Artificial Sequence
  Synthetic
gctaatctcctgtggagacaggagatgggtggcaacatcacaagggttgagtctgagaataaggtcatcgtcctc

SEQ ID NO: 107822 - DNA, 75 bp, Artificial Sequence
  Synthetic
gctaatctcctgtggagacaggagatgggtggcaacatcactagggttgagtctgagaataaggtcatcgtcctc

SEQ ID NO: 107823 - DNA, 75 bp, Artificial Sequence
  Synthetic
gctaatctcctgtggagacaggagatgggtggcaacatcaccagggttgagtctgagaataaggtcatcgtcctc

SEQ ID NO: 107824 - DNA, 75 bp, Artificial Sequence
  Synthetic
gctaatctcctgtggagacaggagatgggtggcaacatcacgagggttgagtctgagaataaggtcatcgtcctc

SEQ ID NO: 107825 - DNA, 75 bp, Artificial Sequence
  Synthetic
gctaatctcctgtggagacaggagttgggtggcaacatcacaagggttgagtctgagaataaggtcatcgtcctc

SEQ ID NO: 107826 - DNA, 75 bp, Artificial Sequence
  Synthetic
gctaatctcctgtggagacaggagttgggtggcaacatcactagggttgagtctgagaataaggtcatcgtcctc

SEQ ID NO: 107827 - DNA, 75 bp, Artificial Sequence
  Synthetic
gctaatctcctgtggagacaggagttgggtggcaacatcaccagggttgagtctgagaataaggtcatcgtcctc

SEQ ID NO: 107828 - DNA, 75 bp, Artificial Sequence
  Synthetic
gctaatctcctgtggagacaggagttgggtggcaacatcacgagggttgagtctgagaataaggtcatcgtcctc

SEQ ID NO: 107829 - DNA, 75 bp, Artificial Sequence
  Synthetic
gctaatctcctgtggagacaggagctgggtggcaacatcacaagggttgagtctgagaataaggtcatcgtcctc

SEQ ID NO: 107830 - DNA, 75 bp, Artificial Sequence
  Synthetic
gctaatctcctgtggagacaggagctgggtggcaacatcactagggttgagtctgagaataaggtcatcgtcctc

SEQ ID NO: 107831 - DNA, 75 bp, Artificial Sequence
  Synthetic
gctaatctcctgtggagacaggagctgggtggcaacatcaccagggttgagtctgagaataaggtcatcgtcctc

SEQ ID NO: 107832 - DNA, 75 bp, Artificial Sequence
  Synthetic
gctaatctcctgtggagacaggagctgggtggcaacatcacgagggttgagtctgagaataaggtcatcgtcctc

SEQ ID NO: 107833 - DNA, 75 bp, Artificial Sequence
  Synthetic
gctaatctcctgtggagacaggaggtgggtggcaacatcacaagggttgagtctgagaataaggtcatcgtcctc

SEQ ID NO: 107834 - DNA, 75 bp, Artificial Sequence
  Synthetic
gctaatctcctgtggagacaggaggtgggtggcaacatcactagggttgagtctgagaataaggtcatcgtcctc

SEQ ID NO: 107835 - DNA, 75 bp, Artificial Sequence
  Synthetic
gctaatctcctgtggagacaggaggtgggtggcaacatcaccagggttgagtctgagaataaggtcatcgtcctc

SEQ ID NO: 107836 - DNA, 75 bp, Artificial Sequence
  Synthetic
gctaatctcctgtggagacaggaggtgggtggcaacatcacgagggttgagtctgagaataaggtcatcgtcctc

SEQ ID NO: 107837 - DNA, 75 bp, Artificial Sequence
  Synthetic
gagcttacgcccgctgagaccacagttaggctacgagcatacatgaacacccctgggctacccgtgtgccaggac

SEQ ID NO: 107838 - DNA, 75 bp, Artificial Sequence
  Synthetic
tcgatgttgagagaccctgctcacatcaccgctgaaaccgcggcacgccgcctcgcgcgtgggtcccctccatca

SEQ ID NO: 107839 - DNA, 75 bp, Artificial Sequence
  Synthetic
ccatatgggcgagacctgattataacccacctttactggagacttggaaagcccctgattataatcccccgacgg

SEQ ID NO: 107840 - DNA, 75 bp, Artificial Sequence
  Synthetic
tagactgcaacacgtgtgtcactcagacagtcgatttcagccttgaccctaccttcaccattgagacgaccacgc

SEQ ID NO: 107841 - DNA, 75 bp, Artificial Sequence
  Synthetic
gggtctaccacctgtaccaccgcctaggaggaagaaggttgtgaggcttgacgagtcctcagtttcaagcgcact

SEQ ID NO: 107842 - DNA, 75 bp, Artificial Sequence
  Synthetic
cagtccttcctcggaacatccatcgcgggggtcttatggactgtctatcatggggctggcaacaagaccttagct

SEQ ID NO: 107843 - DNA, 75 bp, Artificial Sequence
  Synthetic
aggaggaagaaggttgtgaggcttgacgagtcctcagtttcaagcgcacttgcggagcttgctcgcaagtcgttt

SEQ ID NO: 107844 - DNA, 75 bp, Artificial Sequence
  Synthetic
atgctgaatcttacagctccatgccaccgctggagggggagcccggagatccggacttggagtcgggctcctggt

SEQ ID NO: 107845 - DNA, 75 bp, Artificial Sequence
  Synthetic
tgggggtcattacgtccaaatggctttcatgaagctggccgcactgacaggtacgtacgtttatgaccatcttac

SEQ ID NO: 107846 - DNA, 75 bp, Artificial Sequence
  Synthetic
ccacggtcagcgaggaaagtgacagtgtggtgtgctgttcatattcttactcctggacgggagctcttgtgacac

SEQ ID NO: 107847 - DNA, 75 bp, Artificial Sequence
  Synthetic
gaacaatccagctggacggctccagcgtgtctgcggcgctagccgcgctggcagaaaaatcctttccgtcctcgg

SEQ ID NO: 107848 - DNA, 75 bp, Artificial Sequence
  Synthetic
gaattcgacgagatggaagaatgctctacgcacctcccatacatcgagcaagggatggctctcgccgaacagttc

SEQ ID NO: 107849 - DNA, 75 bp, Artificial Sequence
  Synthetic
gatttcgacgagatggaagaatgctctacgcacctcccatacatcgagcaagggatggctctcgccgaacagttc

SEQ ID NO: 107850 - DNA, 75 bp, Artificial Sequence
  Synthetic
gacttcgacgagatggaagaatgctctacgcacctcccatacatcgagcaagggatggctctcgccgaacagttc

SEQ ID NO: 107851 - DNA, 75 bp, Artificial Sequence
  Synthetic
gagttcgacgagatggaagaatgctctacgcacctcccatacatcgagcaagggatggctctcgccgaacagttc

SEQ ID NO: 107852 - DNA, 75 bp, Artificial Sequence
  Synthetic
tcctggacgggagctcttgtgacaccttgcgctgcggaagaggagaagctgcccatcagtcccctgagcaactct

SEQ ID NO: 107853 - DNA, 75 bp, Artificial Sequence
  Synthetic
caaagcacatgtggaatttcatcagcggcatacaatacctggcggggctgtcaacactacccggtaaccctgcta

SEQ ID NO: 107854 - DNA, 75 bp, Artificial Sequence
  Synthetic
ggggagccgggcgacccagacttgagctgcgactcctggtccaccgtgagcgacagtgaggagcagagtgtcgtc

SEQ ID NO: 107855 - DNA, 75 bp, Artificial Sequence
  Synthetic
tacaccgattcgcccccactccaggtcccttctttcgggatgaggtaacgttcaccgtgggcctcaattccttcg

SEQ ID NO: 107856 - DNA, 75 bp, Artificial Sequence
  Synthetic
tacctgtccaaggcacatggcatcaatcccaatatcaggactggagtcaggactgtgacgaccggagcggccatc

SEQ ID NO: 107857 - DNA, 75 bp, Artificial Sequence
  Synthetic
cgtttggaaggacttgatagaggacaatgcaactcccattccaaaaactattatggcaaagaatgaagtgttctg

SEQ ID NO: 107858 - DNA, 75 bp, Artificial Sequence
  Synthetic
cgtttggaaggacttgatagaggacaatgcaactcccattccaataactattatggcaaagaatgaagtgttctg

SEQ ID NO: 107859 - DNA, 75 bp, Artificial Sequence
  Synthetic
cgtttggaaggacttgatagaggacaatgcaactcccattccaacaactattatggcaaagaatgaagtgttctg

SEQ ID NO: 107860 - DNA, 75 bp, Artificial Sequence
  Synthetic
cgtttggaaggacttgatagaggacaatgcaactcccattccaagaactattatggcaaagaatgaagtgttctg

SEQ ID NO: 107861 - DNA, 75 bp, Artificial Sequence
  Synthetic
cgtttggaaggacttgttagaggacaatgcaactcccattccaaaaactattatggcaaagaatgaagtgttctg

SEQ ID NO: 107862 - DNA, 75 bp, Artificial Sequence
  Synthetic
cgtttggaaggacttgttagaggacaatgcaactcccattccaataactattatggcaaagaatgaagtgttctg

SEQ ID NO: 107863 - DNA, 75 bp, Artificial Sequence
  Synthetic
cgtttggaaggacttgttagaggacaatgcaactcccattccaacaactattatggcaaagaatgaagtgttctg

SEQ ID NO: 107864 - DNA, 75 bp, Artificial Sequence
  Synthetic
cgtttggaaggacttgttagaggacaatgcaactcccattccaagaactattatggcaaagaatgaagtgttctg

SEQ ID NO: 107865 - DNA, 75 bp, Artificial Sequence
  Synthetic
cgtttggaaggacttgctagaggacaatgcaactcccattccaaaaactattatggcaaagaatgaagtgttctg

SEQ ID NO: 107866 - DNA, 75 bp, Artificial Sequence
  Synthetic
cgtttggaaggacttgctagaggacaatgcaactcccattccaataactattatggcaaagaatgaagtgttctg

SEQ ID NO: 107867 - DNA, 75 bp, Artificial Sequence
  Synthetic
cgtttggaaggacttgctagaggacaatgcaactcccattccaacaactattatggcaaagaatgaagtgttctg

SEQ ID NO: 107868 - DNA, 75 bp, Artificial Sequence
  Synthetic
cgtttggaaggacttgctagaggacaatgcaactcccattccaagaactattatggcaaagaatgaagtgttctg

SEQ ID NO: 107869 - DNA, 75 bp, Artificial Sequence
  Synthetic
cgtttggaaggacttggtagaggacaatgcaactcccattccaaaaactattatggcaaagaatgaagtgttctg

SEQ ID NO: 107870 - DNA, 75 bp, Artificial Sequence
  Synthetic
cgtttggaaggacttggtagaggacaatgcaactcccattccaataactattatggcaaagaatgaagtgttctg

SEQ ID NO: 107871 - DNA, 75 bp, Artificial Sequence
  Synthetic
cgtttggaaggacttggtagaggacaatgcaactcccattccaacaactattatggcaaagaatgaagtgttctg

SEQ ID NO: 107872 - DNA, 75 bp, Artificial Sequence
  Synthetic
cgtttggaaggacttggtagaggacaatgcaactcccattccaagaactattatggcaaagaatgaagtgttctg

SEQ ID NO: 107873 - DNA, 75 bp, Artificial Sequence
  Synthetic
cgtttggtaggacttgatagaggacaatgcaactcccattccaaaaactattatggcaaagaatgaagtgttctg

SEQ ID NO: 107874 - DNA, 75 bp, Artificial Sequence
  Synthetic
cgtttggtaggacttgatagaggacaatgcaactcccattccaataactattatggcaaagaatgaagtgttctg

SEQ ID NO: 107875 - DNA, 75 bp, Artificial Sequence
  Synthetic
cgtttggtaggacttgatagaggacaatgcaactcccattccaacaactattatggcaaagaatgaagtgttctg

SEQ ID NO: 107876 - DNA, 75 bp, Artificial Sequence
  Synthetic
cgtttggtaggacttgatagaggacaatgcaactcccattccaagaactattatggcaaagaatgaagtgttctg

SEQ ID NO: 107877 - DNA, 75 bp, Artificial Sequence
  Synthetic
cgtttggtaggacttgttagaggacaatgcaactcccattccaaaaactattatggcaaagaatgaagtgttctg

SEQ ID NO: 107878 - DNA, 75 bp, Artificial Sequence
  Synthetic
cgtttggtaggacttgttagaggacaatgcaactcccattccaataactattatggcaaagaatgaagtgttctg

SEQ ID NO: 107879 - DNA, 75 bp, Artificial Sequence
  Synthetic
cgtttggtaggacttgttagaggacaatgcaactcccattccaacaactattatggcaaagaatgaagtgttctg

SEQ ID NO: 107880 - DNA, 75 bp, Artificial Sequence
  Synthetic
cgtttggtaggacttgttagaggacaatgcaactcccattccaagaactattatggcaaagaatgaagtgttctg

SEQ ID NO: 107881 - DNA, 75 bp, Artificial Sequence
  Synthetic
cgtttggtaggacttgctagaggacaatgcaactcccattccaaaaactattatggcaaagaatgaagtgttctg

SEQ ID NO: 107882 - DNA, 75 bp, Artificial Sequence
  Synthetic
cgtttggtaggacttgctagaggacaatgcaactcccattccaataactattatggcaaagaatgaagtgttctg

SEQ ID NO: 107883 - DNA, 75 bp, Artificial Sequence
  Synthetic
cgtttggtaggacttgctagaggacaatgcaactcccattccaacaactattatggcaaagaatgaagtgttctg

SEQ ID NO: 107884 - DNA, 75 bp, Artificial Sequence
  Synthetic
cgtttggtaggacttgctagaggacaatgcaactcccattccaagaactattatggcaaagaatgaagtgttctg

SEQ ID NO: 107885 - DNA, 75 bp, Artificial Sequence
  Synthetic
cgtttggtaggacttggtagaggacaatgcaactcccattccaaaaactattatggcaaagaatgaagtgttctg

SEQ ID NO: 107886 - DNA, 75 bp, Artificial Sequence
  Synthetic
cgtttggtaggacttggtagaggacaatgcaactcccattccaataactattatggcaaagaatgaagtgttctg

SEQ ID NO: 107887 - DNA, 75 bp, Artificial Sequence
  Synthetic
cgtttggtaggacttggtagaggacaatgcaactcccattccaacaactattatggcaaagaatgaagtgttctg

SEQ ID NO: 107888 - DNA, 75 bp, Artificial Sequence
  Synthetic
cgtttggtaggacttggtagaggacaatgcaactcccattccaagaactattatggcaaagaatgaagtgttctg

SEQ ID NO: 107889 - DNA, 75 bp, Artificial Sequence
  Synthetic
cgtttggcaggacttgatagaggacaatgcaactcccattccaaaaactattatggcaaagaatgaagtgttctg

SEQ ID NO: 107890 - DNA, 75 bp, Artificial Sequence
  Synthetic
cgtttggcaggacttgatagaggacaatgcaactcccattccaataactattatggcaaagaatgaagtgttctg

SEQ ID NO: 107891 - DNA, 75 bp, Artificial Sequence
  Synthetic
cgtttggcaggacttgatagaggacaatgcaactcccattccaacaactattatggcaaagaatgaagtgttctg

SEQ ID NO: 107892 - DNA, 75 bp, Artificial Sequence
  Synthetic
cgtttggcaggacttgatagaggacaatgcaactcccattccaagaactattatggcaaagaatgaagtgttctg

SEQ ID NO: 107893 - DNA, 75 bp, Artificial Sequence
  Synthetic
cgtttggcaggacttgttagaggacaatgcaactcccattccaaaaactattatggcaaagaatgaagtgttctg

SEQ ID NO: 107894 - DNA, 75 bp, Artificial Sequence
  Synthetic
cgtttggcaggacttgttagaggacaatgcaactcccattccaataactattatggcaaagaatgaagtgttctg

SEQ ID NO: 107895 - DNA, 75 bp, Artificial Sequence
  Synthetic
cgtttggcaggacttgttagaggacaatgcaactcccattccaacaactattatggcaaagaatgaagtgttctg

SEQ ID NO: 107896 - DNA, 75 bp, Artificial Sequence
  Synthetic
cgtttggcaggacttgttagaggacaatgcaactcccattccaagaactattatggcaaagaatgaagtgttctg

SEQ ID NO: 107897 - DNA, 75 bp, Artificial Sequence
  Synthetic
cgtttggcaggacttgctagaggacaatgcaactcccattccaaaaactattatggcaaagaatgaagtgttctg

SEQ ID NO: 107898 - DNA, 75 bp, Artificial Sequence
  Synthetic
cgtttggcaggacttgctagaggacaatgcaactcccattccaataactattatggcaaagaatgaagtgttctg

SEQ ID NO: 107899 - DNA, 75 bp, Artificial Sequence
  Synthetic
cgtttggcaggacttgctagaggacaatgcaactcccattccaacaactattatggcaaagaatgaagtgttctg

SEQ ID NO: 107900 - DNA, 75 bp, Artificial Sequence
  Synthetic
cgtttggcaggacttgctagaggacaatgcaactcccattccaagaactattatggcaaagaatgaagtgttctg

SEQ ID NO: 107901 - DNA, 75 bp, Artificial Sequence
  Synthetic
cgtttggcaggacttggtagaggacaatgcaactcccattccaaaaactattatggcaaagaatgaagtgttctg

SEQ ID NO: 107902 - DNA, 75 bp, Artificial Sequence
  Synthetic
cgtttggcaggacttggtagaggacaatgcaactcccattccaataactattatggcaaagaatgaagtgttctg

SEQ ID NO: 107903 - DNA, 75 bp, Artificial Sequence
  Synthetic
cgtttggcaggacttggtagaggacaatgcaactcccattccaacaactattatggcaaagaatgaagtgttctg

SEQ ID NO: 107904 - DNA, 75 bp, Artificial Sequence
  Synthetic
cgtttggcaggacttggtagaggacaatgcaactcccattccaagaactattatggcaaagaatgaagtgttctg

SEQ ID NO: 107905 - DNA, 75 bp, Artificial Sequence
  Synthetic
cgtttgggaggacttgatagaggacaatgcaactcccattccaaaaactattatggcaaagaatgaagtgttctg

SEQ ID NO: 107906 - DNA, 75 bp, Artificial Sequence
  Synthetic
cgtttgggaggacttgatagaggacaatgcaactcccattccaataactattatggcaaagaatgaagtgttctg

SEQ ID NO: 107907 - DNA, 75 bp, Artificial Sequence
  Synthetic
cgtttgggaggacttgatagaggacaatgcaactcccattccaacaactattatggcaaagaatgaagtgttctg

SEQ ID NO: 107908 - DNA, 75 bp, Artificial Sequence
  Synthetic
cgtttgggaggacttgatagaggacaatgcaactcccattccaagaactattatggcaaagaatgaagtgttctg

SEQ ID NO: 107909 - DNA, 75 bp, Artificial Sequence
  Synthetic
cgtttgggaggacttgttagaggacaatgcaactcccattccaaaaactattatggcaaagaatgaagtgttctg

SEQ ID NO: 107910 - DNA, 75 bp, Artificial Sequence
  Synthetic
cgtttgggaggacttgttagaggacaatgcaactcccattccaataactattatggcaaagaatgaagtgttctg

SEQ ID NO: 107911 - DNA, 75 bp, Artificial Sequence
  Synthetic
cgtttgggaggacttgttagaggacaatgcaactcccattccaacaactattatggcaaagaatgaagtgttctg

SEQ ID NO: 107912 - DNA, 75 bp, Artificial Sequence
  Synthetic
cgtttgggaggacttgttagaggacaatgcaactcccattccaagaactattatggcaaagaatgaagtgttctg

SEQ ID NO: 107913 - DNA, 75 bp, Artificial Sequence
  Synthetic
cgtttgggaggacttgctagaggacaatgcaactcccattccaaaaactattatggcaaagaatgaagtgttctg

SEQ ID NO: 107914 - DNA, 75 bp, Artificial Sequence
  Synthetic
cgtttgggaggacttgctagaggacaatgcaactcccattccaataactattatggcaaagaatgaagtgttctg

SEQ ID NO: 107915 - DNA, 75 bp, Artificial Sequence
  Synthetic
cgtttgggaggacttgctagaggacaatgcaactcccattccaacaactattatggcaaagaatgaagtgttctg

SEQ ID NO: 107916 - DNA, 75 bp, Artificial Sequence
  Synthetic
cgtttgggaggacttgctagaggacaatgcaactcccattccaagaactattatggcaaagaatgaagtgttctg

SEQ ID NO: 107917 - DNA, 75 bp, Artificial Sequence
  Synthetic
cgtttgggaggacttggtagaggacaatgcaactcccattccaaaaactattatggcaaagaatgaagtgttctg

SEQ ID NO: 107918 - DNA, 75 bp, Artificial Sequence
  Synthetic
cgtttgggaggacttggtagaggacaatgcaactcccattccaataactattatggcaaagaatgaagtgttctg

SEQ ID NO: 107919 - DNA, 75 bp, Artificial Sequence
  Synthetic
cgtttgggaggacttggtagaggacaatgcaactcccattccaacaactattatggcaaagaatgaagtgttctg

SEQ ID NO: 107920 - DNA, 75 bp, Artificial Sequence
  Synthetic
cgtttgggaggacttggtagaggacaatgcaactcccattccaagaactattatggcaaagaatgaagtgttctg

SEQ ID NO: 107921 - DNA, 75 bp, Artificial Sequence
  Synthetic
cgccgcccccggtgccgccaccgccttcgtaggcgctgggatagccggcgccgccgttggcagtgtcgggctggg

SEQ ID NO: 107922 - DNA, 75 bp, Artificial Sequence
  Synthetic
acgtactccacatacggcaaattcctcgccgatgggggctgctcgggcggcgcttatgatatcatcatatgcgat

SEQ ID NO: 107923 - DNA, 75 bp, Artificial Sequence
  Synthetic
gactacccaggattgcaattgttccatctacacagggcacatcactggccacagaatggcctgggacatgatgat

SEQ ID NO: 107924 - DNA, 75 bp, Artificial Sequence
  Synthetic
gcgccccccggggcgcgttccttgacaccatgcacctgcggcagctcggacctttacttggtcacgagacatgct

SEQ ID NO: 107925 - DNA, 75 bp, Artificial Sequence
  Synthetic
cctttacttggtcacgagacatgctgatgtcattccggtgcgccggcggggcgacagcagggggagcctactctc

SEQ ID NO: 107926 - DNA, 75 bp, Artificial Sequence
  Synthetic
ctaattgggccaaggttatcctggtcctgttcctctttgcaggggttgacgctgacacccacaccattggaggcg

SEQ ID NO: 107927 - DNA, 75 bp, Artificial Sequence
  Synthetic
gggtatggcgcaggcgtagcaggagctctagtagccttcaagatcatgagcggcgaggtcccctccaccgaggac

SEQ ID NO: 107928 - DNA, 75 bp, Artificial Sequence
  Synthetic
gggccgcgtatgggttccagtactcgcccaagcagcgggttgactacctcctcaagatgtggcgctcaaagaaga

SEQ ID NO: 107929 - DNA, 75 bp, Artificial Sequence
  Synthetic
agctctctgccccgtctctgaaggctacctgtaccacccatgagatggcatatgattatgacatggtggatgcca

SEQ ID NO: 107930 - DNA, 75 bp, Artificial Sequence
  Synthetic
aatgcaactcccattccaaaaactattatggcaaagaatgaagtgttctgtgtggatgctaaaaagggaggtcgg

SEQ ID NO: 107931 - DNA, 75 bp, Artificial Sequence
  Synthetic
aatgcaactcccattccaataactattatggcaaagaatgaagtgttctgtgtggatgctaaaaagggaggtcgg

SEQ ID NO: 107932 - DNA, 75 bp, Artificial Sequence
  Synthetic
aatgcaactcccattccaacaactattatggcaaagaatgaagtgttctgtgtggatgctaaaaagggaggtcgg

SEQ ID NO: 107933 - DNA, 75 bp, Artificial Sequence
  Synthetic
aatgcaactcccattccaagaactattatggcaaagaatgaagtgttctgtgtggatgctaaaaagggaggtcgg

SEQ ID NO: 107934 - DNA, 75 bp, Artificial Sequence
  Synthetic
ttacatcaagggagggagacacctgatcttctgccactcaaagaaaaagtgtgacgagctcgcggcggcccttcg

SEQ ID NO: 107935 - DNA, 75 bp, Artificial Sequence
  Synthetic
gactgctctcaactgcaatgacagtttgaacactgggttccttgctagcttattctacacccacaagttcaacag

SEQ ID NO: 107936 - DNA, 75 bp, Artificial Sequence
  Synthetic
aaggtgctttgactcgacagtcactgagcgcgacattcgcaccgagcacgacatctaccaatgttgccaacttga

SEQ ID NO: 107937 - DNA, 75 bp, Artificial Sequence
  Synthetic
tattctacacccacaagttcaacagctcagggtgccccgaccggctcgcaagctgcaagaaccttgacacatttg

SEQ ID NO: 107938 - DNA, 75 bp, Artificial Sequence
  Synthetic
gagcgcgacattcgcaccgagcacgacatctaccaatgttgccaacttgacctggtggcacgcaaagtcattaca

SEQ ID NO: 107939 - DNA, 75 bp, Artificial Sequence
  Synthetic
gagcgcgacattcgcaccgagcacgacatctaccaatgttgccaacttgacctggtggcacgcaatgtcattaca

SEQ ID NO: 107940 - DNA, 75 bp, Artificial Sequence
  Synthetic
gagcgcgacattcgcaccgagcacgacatctaccaatgttgccaacttgacctggtggcacgcaacgtcattaca

SEQ ID NO: 107941 - DNA, 75 bp, Artificial Sequence
  Synthetic
gagcgcgacattcgcaccgagcacgacatctaccaatgttgccaacttgacctggtggcacgcaaggtcattaca

SEQ ID NO: 107942 - DNA, 75 bp, Artificial Sequence
  Synthetic
agccttcgcctctcgggggaaccatgtctcccccacgcactatgtgcctgagagcgacgccgccgcccgcgtcac

SEQ ID NO: 107943 - DNA, 75 bp, Artificial Sequence
  Synthetic
gaaatctgggactggatatgcgaggtgatgagcgacttcaagacctggctgaaagccaagctcatgccgcagctc

SEQ ID NO: 107944 - DNA, 75 bp, Artificial Sequence
  Synthetic
gcttgggcaataccctaacatgctaattgaaagcacaagcagcgtgtaaggcagcaaagctaaaaaactatgaca

SEQ ID NO: 107945 - DNA, 75 bp, Artificial Sequence
  Synthetic
gcttgggcaataccctaacatgctaattgaaagcacaagcagcgtgtaaggcagcaaagctaataaactatgaca

SEQ ID NO: 107946 - DNA, 75 bp, Artificial Sequence
  Synthetic
gcttgggcaataccctaacatgctaattgaaagcacaagcagcgtgtaaggcagcaaagctaacaaactatgaca

SEQ ID NO: 107947 - DNA, 75 bp, Artificial Sequence
  Synthetic
gcttgggcaataccctaacatgctaattgaaagcacaagcagcgtgtaaggcagcaaagctaagaaactatgaca

SEQ ID NO: 107948 - DNA, 75 bp, Artificial Sequence
  Synthetic
gcttgggcaataccctaacatgctaattgaaagcacaagcagcgtgtaaggcagcaaagcttaaaaactatgaca

SEQ ID NO: 107949 - DNA, 75 bp, Artificial Sequence
  Synthetic
gcttgggcaataccctaacatgctaattgaaagcacaagcagcgtgtaaggcagcaaagcttataaactatgaca

SEQ ID NO: 107950 - DNA, 75 bp, Artificial Sequence
  Synthetic
gcttgggcaataccctaacatgctaattgaaagcacaagcagcgtgtaaggcagcaaagcttacaaactatgaca

SEQ ID NO: 107951 - DNA, 75 bp, Artificial Sequence
  Synthetic
gcttgggcaataccctaacatgctaattgaaagcacaagcagcgtgtaaggcagcaaagcttagaaactatgaca

SEQ ID NO: 107952 - DNA, 75 bp, Artificial Sequence
  Synthetic
gcttgggcaataccctaacatgctaattgaaagcacaagcagcgtgtaaggcagcaaagctcaaaaactatgaca

SEQ ID NO: 107953 - DNA, 75 bp, Artificial Sequence
  Synthetic
gcttgggcaataccctaacatgctaattgaaagcacaagcagcgtgtaaggcagcaaagctcataaactatgaca

SEQ ID NO: 107954 - DNA, 75 bp, Artificial Sequence
  Synthetic
gcttgggcaataccctaacatgctaattgaaagcacaagcagcgtgtaaggcagcaaagctcacaaactatgaca

SEQ ID NO: 107955 - DNA, 75 bp, Artificial Sequence
  Synthetic
gcttgggcaataccctaacatgctaattgaaagcacaagcagcgtgtaaggcagcaaagctcagaaactatgaca

SEQ ID NO: 107956 - DNA, 75 bp, Artificial Sequence
  Synthetic
gcttgggcaataccctaacatgctaattgaaagcacaagcagcgtgtaaggcagcaaagctgaaaaactatgaca

SEQ ID NO: 107957 - DNA, 75 bp, Artificial Sequence
  Synthetic
gcttgggcaataccctaacatgctaattgaaagcacaagcagcgtgtaaggcagcaaagctgataaactatgaca

SEQ ID NO: 107958 - DNA, 75 bp, Artificial Sequence
  Synthetic
gcttgggcaataccctaacatgctaattgaaagcacaagcagcgtgtaaggcagcaaagctgacaaactatgaca

SEQ ID NO: 107959 - DNA, 75 bp, Artificial Sequence
  Synthetic
gcttgggcaataccctaacatgctaattgaaagcacaagcagcgtgtaaggcagcaaagctgagaaactatgaca

SEQ ID NO: 107960 - DNA, 75 bp, Artificial Sequence
  Synthetic
gcttgggcaataccctaacatgctatttgaaagcacaagcagcgtgtaaggcagcaaagctaaaaaactatgaca

SEQ ID NO: 107961 - DNA, 75 bp, Artificial Sequence
  Synthetic
gcttgggcaataccctaacatgctatttgaaagcacaagcagcgtgtaaggcagcaaagctaataaactatgaca

SEQ ID NO: 107962 - DNA, 75 bp, Artificial Sequence
  Synthetic
gcttgggcaataccctaacatgctatttgaaagcacaagcagcgtgtaaggcagcaaagctaacaaactatgaca

SEQ ID NO: 107963 - DNA, 75 bp, Artificial Sequence
  Synthetic
gcttgggcaataccctaacatgctatttgaaagcacaagcagcgtgtaaggcagcaaagctaagaaactatgaca

SEQ ID NO: 107964 - DNA, 75 bp, Artificial Sequence
  Synthetic
gcttgggcaataccctaacatgctatttgaaagcacaagcagcgtgtaaggcagcaaagcttaaaaactatgaca

SEQ ID NO: 107965 - DNA, 75 bp, Artificial Sequence
  Synthetic
gcttgggcaataccctaacatgctatttgaaagcacaagcagcgtgtaaggcagcaaagcttataaactatgaca

SEQ ID NO: 107966 - DNA, 75 bp, Artificial Sequence
  Synthetic
gcttgggcaataccctaacatgctatttgaaagcacaagcagcgtgtaaggcagcaaagcttacaaactatgaca

SEQ ID NO: 107967 - DNA, 75 bp, Artificial Sequence
  Synthetic
gcttgggcaataccctaacatgctatttgaaagcacaagcagcgtgtaaggcagcaaagcttagaaactatgaca

SEQ ID NO: 107968 - DNA, 75 bp, Artificial Sequence
  Synthetic
gcttgggcaataccctaacatgctatttgaaagcacaagcagcgtgtaaggcagcaaagctcaaaaactatgaca

SEQ ID NO: 107969 - DNA, 75 bp, Artificial Sequence
  Synthetic
gcttgggcaataccctaacatgctatttgaaagcacaagcagcgtgtaaggcagcaaagctcataaactatgaca

SEQ ID NO: 107970 - DNA, 75 bp, Artificial Sequence
  Synthetic
gcttgggcaataccctaacatgctatttgaaagcacaagcagcgtgtaaggcagcaaagctcacaaactatgaca

SEQ ID NO: 107971 - DNA, 75 bp, Artificial Sequence
  Synthetic
gcttgggcaataccctaacatgctatttgaaagcacaagcagcgtgtaaggcagcaaagctcagaaactatgaca

SEQ ID NO: 107972 - DNA, 75 bp, Artificial Sequence
  Synthetic
gcttgggcaataccctaacatgctatttgaaagcacaagcagcgtgtaaggcagcaaagctgaaaaactatgaca

SEQ ID NO: 107973 - DNA, 75 bp, Artificial Sequence
  Synthetic
gcttgggcaataccctaacatgctatttgaaagcacaagcagcgtgtaaggcagcaaagctgataaactatgaca

SEQ ID NO: 107974 - DNA, 75 bp, Artificial Sequence
  Synthetic
gcttgggcaataccctaacatgctatttgaaagcacaagcagcgtgtaaggcagcaaagctgacaaactatgaca

SEQ ID NO: 107975 - DNA, 75 bp, Artificial Sequence
  Synthetic
gcttgggcaataccctaacatgctatttgaaagcacaagcagcgtgtaaggcagcaaagctgagaaactatgaca

SEQ ID NO: 107976 - DNA, 75 bp, Artificial Sequence
  Synthetic
gcttgggcaataccctaacatgctacttgaaagcacaagcagcgtgtaaggcagcaaagctaaaaaactatgaca

SEQ ID NO: 107977 - DNA, 75 bp, Artificial Sequence
  Synthetic
gcttgggcaataccctaacatgctacttgaaagcacaagcagcgtgtaaggcagcaaagctaataaactatgaca

SEQ ID NO: 107978 - DNA, 75 bp, Artificial Sequence
  Synthetic
gcttgggcaataccctaacatgctacttgaaagcacaagcagcgtgtaaggcagcaaagctaacaaactatgaca

SEQ ID NO: 107979 - DNA, 75 bp, Artificial Sequence
  Synthetic
gcttgggcaataccctaacatgctacttgaaagcacaagcagcgtgtaaggcagcaaagctaagaaactatgaca

SEQ ID NO: 107980 - DNA, 75 bp, Artificial Sequence
  Synthetic
gcttgggcaataccctaacatgctacttgaaagcacaagcagcgtgtaaggcagcaaagcttaaaaactatgaca

SEQ ID NO: 107981 - DNA, 75 bp, Artificial Sequence
  Synthetic
gcttgggcaataccctaacatgctacttgaaagcacaagcagcgtgtaaggcagcaaagcttataaactatgaca

SEQ ID NO: 107982 - DNA, 75 bp, Artificial Sequence
  Synthetic
gcttgggcaataccctaacatgctacttgaaagcacaagcagcgtgtaaggcagcaaagcttacaaactatgaca

SEQ ID NO: 107983 - DNA, 75 bp, Artificial Sequence
  Synthetic
gcttgggcaataccctaacatgctacttgaaagcacaagcagcgtgtaaggcagcaaagcttagaaactatgaca

SEQ ID NO: 107984 - DNA, 75 bp, Artificial Sequence
  Synthetic
gcttgggcaataccctaacatgctacttgaaagcacaagcagcgtgtaaggcagcaaagctcaaaaactatgaca

SEQ ID NO: 107985 - DNA, 75 bp, Artificial Sequence
  Synthetic
gcttgggcaataccctaacatgctacttgaaagcacaagcagcgtgtaaggcagcaaagctcataaactatgaca

SEQ ID NO: 107986 - DNA, 75 bp, Artificial Sequence
  Synthetic
gcttgggcaataccctaacatgctacttgaaagcacaagcagcgtgtaaggcagcaaagctcacaaactatgaca

SEQ ID NO: 107987 - DNA, 75 bp, Artificial Sequence
  Synthetic
gcttgggcaataccctaacatgctacttgaaagcacaagcagcgtgtaaggcagcaaagctcagaaactatgaca

SEQ ID NO: 107988 - DNA, 75 bp, Artificial Sequence
  Synthetic
gcttgggcaataccctaacatgctacttgaaagcacaagcagcgtgtaaggcagcaaagctgaaaaactatgaca

SEQ ID NO: 107989 - DNA, 75 bp, Artificial Sequence
  Synthetic
gcttgggcaataccctaacatgctacttgaaagcacaagcagcgtgtaaggcagcaaagctgataaactatgaca

SEQ ID NO: 107990 - DNA, 75 bp, Artificial Sequence
  Synthetic
gcttgggcaataccctaacatgctacttgaaagcacaagcagcgtgtaaggcagcaaagctgacaaactatgaca

SEQ ID NO: 107991 - DNA, 75 bp, Artificial Sequence
  Synthetic
gcttgggcaataccctaacatgctacttgaaagcacaagcagcgtgtaaggcagcaaagctgagaaactatgaca

SEQ ID NO: 107992 - DNA, 75 bp, Artificial Sequence
  Synthetic
gcttgggcaataccctaacatgctagttgaaagcacaagcagcgtgtaaggcagcaaagctaaaaaactatgaca

SEQ ID NO: 107993 - DNA, 75 bp, Artificial Sequence
  Synthetic
gcttgggcaataccctaacatgctagttgaaagcacaagcagcgtgtaaggcagcaaagctaataaactatgaca

SEQ ID NO: 107994 - DNA, 75 bp, Artificial Sequence
  Synthetic
gcttgggcaataccctaacatgctagttgaaagcacaagcagcgtgtaaggcagcaaagctaacaaactatgaca

SEQ ID NO: 107995 - DNA, 75 bp, Artificial Sequence
  Synthetic
gcttgggcaataccctaacatgctagttgaaagcacaagcagcgtgtaaggcagcaaagctaagaaactatgaca

SEQ ID NO: 107996 - DNA, 75 bp, Artificial Sequence
  Synthetic
gcttgggcaataccctaacatgctagttgaaagcacaagcagcgtgtaaggcagcaaagcttaaaaactatgaca

SEQ ID NO: 107997 - DNA, 75 bp, Artificial Sequence
  Synthetic
gcttgggcaataccctaacatgctagttgaaagcacaagcagcgtgtaaggcagcaaagcttataaactatgaca

SEQ ID NO: 107998 - DNA, 75 bp, Artificial Sequence
  Synthetic
gcttgggcaataccctaacatgctagttgaaagcacaagcagcgtgtaaggcagcaaagcttacaaactatgaca

SEQ ID NO: 107999 - DNA, 75 bp, Artificial Sequence
  Synthetic
gcttgggcaataccctaacatgctagttgaaagcacaagcagcgtgtaaggcagcaaagcttagaaactatgaca

SEQ ID NO: 108000 - DNA, 75 bp, Artificial Sequence
  Synthetic
gcttgggcaataccctaacatgctagttgaaagcacaagcagcgtgtaaggcagcaaagctcaaaaactatgaca

SEQ ID NO: 108001 - DNA, 75 bp, Artificial Sequence
  Synthetic
gcttgggcaataccctaacatgctagttgaaagcacaagcagcgtgtaaggcagcaaagctcataaactatgaca

SEQ ID NO: 108002 - DNA, 75 bp, Artificial Sequence
  Synthetic
gcttgggcaataccctaacatgctagttgaaagcacaagcagcgtgtaaggcagcaaagctcacaaactatgaca

SEQ ID NO: 108003 - DNA, 75 bp, Artificial Sequence
  Synthetic
gcttgggcaataccctaacatgctagttgaaagcacaagcagcgtgtaaggcagcaaagctcagaaactatgaca

SEQ ID NO: 108004 - DNA, 75 bp, Artificial Sequence
  Synthetic
gcttgggcaataccctaacatgctagttgaaagcacaagcagcgtgtaaggcagcaaagctgaaaaactatgaca

SEQ ID NO: 108005 - DNA, 75 bp, Artificial Sequence
  Synthetic
gcttgggcaataccctaacatgctagttgaaagcacaagcagcgtgtaaggcagcaaagctgataaactatgaca

SEQ ID NO: 108006 - DNA, 75 bp, Artificial Sequence
  Synthetic
gcttgggcaataccctaacatgctagttgaaagcacaagcagcgtgtaaggcagcaaagctgacaaactatgaca

SEQ ID NO: 108007 - DNA, 75 bp, Artificial Sequence
  Synthetic
gcttgggcaataccctaacatgctagttgaaagcacaagcagcgtgtaaggcagcaaagctgagaaactatgaca

SEQ ID NO: 108008 - DNA, 75 bp, Artificial Sequence
  Synthetic
gcagcaaagctaaaaaactatgacatgttggtctgcggagatgatctagtcgttatcgcggagagcggaggagtc

SEQ ID NO: 108009 - DNA, 75 bp, Artificial Sequence
  Synthetic
gcagcaaagctaataaactatgacatgttggtctgcggagatgatctagtcgttatcgcggagagcggaggagtc

SEQ ID NO: 108010 - DNA, 75 bp, Artificial Sequence
  Synthetic
gcagcaaagctaacaaactatgacatgttggtctgcggagatgatctagtcgttatcgcggagagcggaggagtc

SEQ ID NO: 108011 - DNA, 75 bp, Artificial Sequence
  Synthetic
gcagcaaagctaagaaactatgacatgttggtctgcggagatgatctagtcgttatcgcggagagcggaggagtc

SEQ ID NO: 108012 - DNA, 75 bp, Artificial Sequence
  Synthetic
gcagcaaagcttaaaaactatgacatgttggtctgcggagatgatctagtcgttatcgcggagagcggaggagtc

SEQ ID NO: 108013 - DNA, 75 bp, Artificial Sequence
  Synthetic
gcagcaaagcttataaactatgacatgttggtctgcggagatgatctagtcgttatcgcggagagcggaggagtc

SEQ ID NO: 108014 - DNA, 75 bp, Artificial Sequence
  Synthetic
gcagcaaagcttacaaactatgacatgttggtctgcggagatgatctagtcgttatcgcggagagcggaggagtc

SEQ ID NO: 108015 - DNA, 75 bp, Artificial Sequence
  Synthetic
gcagcaaagcttagaaactatgacatgttggtctgcggagatgatctagtcgttatcgcggagagcggaggagtc

SEQ ID NO: 108016 - DNA, 75 bp, Artificial Sequence
  Synthetic
gcagcaaagctcaaaaactatgacatgttggtctgcggagatgatctagtcgttatcgcggagagcggaggagtc

SEQ ID NO: 108017 - DNA, 75 bp, Artificial Sequence
  Synthetic
gcagcaaagctcataaactatgacatgttggtctgcggagatgatctagtcgttatcgcggagagcggaggagtc

SEQ ID NO: 108018 - DNA, 75 bp, Artificial Sequence
  Synthetic
gcagcaaagctcacaaactatgacatgttggtctgcggagatgatctagtcgttatcgcggagagcggaggagtc

SEQ ID NO: 108019 - DNA, 75 bp, Artificial Sequence
  Synthetic
gcagcaaagctcagaaactatgacatgttggtctgcggagatgatctagtcgttatcgcggagagcggaggagtc

SEQ ID NO: 108020 - DNA, 75 bp, Artificial Sequence
  Synthetic
gcagcaaagctgaaaaactatgacatgttggtctgcggagatgatctagtcgttatcgcggagagcggaggagtc

SEQ ID NO: 108021 - DNA, 75 bp, Artificial Sequence
  Synthetic
gcagcaaagctgataaactatgacatgttggtctgcggagatgatctagtcgttatcgcggagagcggaggagtc

SEQ ID NO: 108022 - DNA, 75 bp, Artificial Sequence
  Synthetic
gcagcaaagctgacaaactatgacatgttggtctgcggagatgatctagtcgttatcgcggagagcggaggagtc

SEQ ID NO: 108023 - DNA, 75 bp, Artificial Sequence
  Synthetic
gcagcaaagctgagaaactatgacatgttggtctgcggagatgatctagtcgttatcgcggagagcggaggagtc

SEQ ID NO: 108024 - DNA, 75 bp, Artificial Sequence
  Synthetic
ggggttctcgtatgacacccgctgctttgactcgactgtcaccgaacaggacatcagggtggaagaggagatata

SEQ ID NO: 108025 - DNA, 75 bp, Artificial Sequence
  Synthetic
acgtagccagcgccgggggcgtacgggtaggggaagactgggcatttataggtacgtgtccactggtgagcgagc

SEQ ID NO: 108026 - DNA, 75 bp, Artificial Sequence
  Synthetic
gacatgtcaagaacgggaccatgcggatcgttggccccaggacctgtagaaatacatggagtggaacgttcccca

SEQ ID NO: 108027 - DNA, 75 bp, Artificial Sequence
  Synthetic
aatggaagcggctccgaccaacgcccctactgctggcactaccccccaaaaccttgtggtattgtgcccgcgaag

SEQ ID NO: 108028 - DNA, 75 bp, Artificial Sequence
  Synthetic
agcaccgggtttacaaaagcctgtggtgctcctccatgcgaggttaagaccagcaatggatcctggcactgcccc

SEQ ID NO: 108029 - DNA, 75 bp, Artificial Sequence
  Synthetic
agataatattacctcaccagagacccaaccgtacctctttcacgggctgcttgggaaacagcccgccacactcca

SEQ ID NO: 108030 - DNA, 75 bp, Artificial Sequence
  Synthetic
agatattattacctcaccagagacccaaccgtacctctttcacgggctgcttgggaaacagcccgccacactcca

SEQ ID NO: 108031 - DNA, 75 bp, Artificial Sequence
  Synthetic
agatactattacctcaccagagacccaaccgtacctctttcacgggctgcttgggaaacagcccgccacactcca

SEQ ID NO: 108032 - DNA, 75 bp, Artificial Sequence
  Synthetic
agatagtattacctcaccagagacccaaccgtacctctttcacgggctgcttgggaaacagcccgccacactcca

SEQ ID NO: 108033 - DNA, 75 bp, Artificial Sequence
  Synthetic
agtgggggacttccattacataacgggcgtgaccactgacaacctcaagtgcccgtgtcaggtcccatcacccga

SEQ ID NO: 108034 - DNA, 75 bp, Artificial Sequence
  Synthetic
ggcattacccatgcactttcaactttactgtctttaaggtcagaacctttattggcggtatagagcatcggatgg

SEQ ID NO: 108035 - DNA, 75 bp, Artificial Sequence
  Synthetic
gaagtgcttgactcgactcaagcccacgctcgtgggccctacacctctcctgtaccgtttgggccctgtcaccaa

SEQ ID NO: 108036 - DNA, 75 bp, Artificial Sequence
  Synthetic
gcgagcccgaaccagacgtggccgtgttgacgtccatgctcactgacccctcccacataacagcggaggcggctg

SEQ ID NO: 108037 - DNA, 75 bp, Artificial Sequence
  Synthetic
acgaaatacatcgccacttgcatgcaagccgaccttgaggtcatgaccagcacgtgggtcttggctgggggagtc

SEQ ID NO: 108038 - DNA, 75 bp, Artificial Sequence
  Synthetic
gcctcaggaagcttggggcaccaccgttgagagcctggagacatcgggccagggcggtcagagccaaactcatag

SEQ ID NO: 108039 - DNA, 75 bp, Artificial Sequence
  Synthetic
ttcccctgatgccgagcttattgcggctaacctcctgtggagacaggagatgggcgggaacatcaccagggtcga

SEQ ID NO: 108040 - DNA, 75 bp, Artificial Sequence
  Synthetic
tcctctatgaggcttttgatgagatggaggagtgtgcctctagagcggccctcattgaagaggggcagcggatag

SEQ ID NO: 108041 - DNA, 75 bp, Artificial Sequence
  Synthetic
tggctaagggacatctgggactggatatgcgaggtgctgagcgattttaagacctggctaaaagccaagctcatg

SEQ ID NO: 108042 - DNA, 75 bp, Artificial Sequence
  Synthetic
tttactcctgtgcctactcctactcaccgtaggggtaggcatctttttgcttcccgcccggtaggcggggggccc

SEQ ID NO: 108043 - DNA, 75 bp, Artificial Sequence
  Synthetic
cggaagttcccctcggctatgcccatttgggcgtcgccgagttacaaccctccgctcctggagacgtggaaaaag

SEQ ID NO: 108044 - DNA, 75 bp, Artificial Sequence
  Synthetic
agccatcatgggacctctctacctgctgcaggcgagtttgttgcgcgtaccgtattacgtgcgcgctcacgctct

SEQ ID NO: 108045 - DNA, 75 bp, Artificial Sequence
  Synthetic
ggtcccttggtggcgcggtcgttgttgcgctgaccattctgacattgtctccatactacaagtcatggttggcta

SEQ ID NO: 108046 - DNA, 75 bp, Artificial Sequence
  Synthetic
gcattcagtgccgccctcaccagtccgttgtcaactagcaccactatccttctcaacattttgggaggctggctg

SEQ ID NO: 108047 - DNA, 75 bp, Artificial Sequence
  Synthetic
aagaagcggacggtggttctaactgagtcaacagtgtcctctgccctggctgagcttgccactaagacctttggc

SEQ ID NO: 108048 - DNA, 75 bp, Artificial Sequence
  Synthetic
gcgggggggacatatttcacagcgtgtcccgggcccgaccccgcactttactcctgtgcctactcctactcaccg

SEQ ID NO: 108049 - DNA, 75 bp, Artificial Sequence
  Synthetic
caaacagcaagggacaatcctgcggttacaggcgttgccgcgcaagcggtgtcttcactaccagcatggggaata

SEQ ID NO: 108050 - DNA, 75 bp, Artificial Sequence
  Synthetic
ccgcccacaggacgttaagttcccgggtggcggtcagatcgttggcggagtttacttgctgccgcgcaggggccc

SEQ ID NO: 108051 - DNA, 75 bp, Artificial Sequence
  Synthetic
atctcctagccatcttagggcccctctacatactccaggcctcgctcctacgcgtcccttacttcgtgagggcac

SEQ ID NO: 108052 - DNA, 75 bp, Artificial Sequence
  Synthetic
caggttgggtgtgcgcgcgacaaggaagacttctgagcgatcccagccgcgtgggagacgccagcccatcccgaa

SEQ ID NO: 108053 - DNA, 75 bp, Artificial Sequence
  Synthetic
caggcacggaggacgttgtgtgttgttcaatgtcctattcctggacaggcgcacttgtcaccccgtgcgcagcag

SEQ ID NO: 108054 - DNA, 75 bp, Artificial Sequence
  Synthetic
agatcggcgctccaccggcaagtcctggggaaagccaggatatccttggcctctgtacggaaacgagggctgcgg

SEQ ID NO: 108055 - DNA, 75 bp, Artificial Sequence
  Synthetic
tggggaaagccaggatatccttggcctctgtacggaaacgagggctgcggctgggcaggttggctcctgtcccct

SEQ ID NO: 108056 - DNA, 75 bp, Artificial Sequence
  Synthetic
agatcctctccagccttaccatcactcagctgttgaagaggctccaccagtggatcaatgaggactgctccacgc

SEQ ID NO: 108057 - DNA, 75 bp, Artificial Sequence
  Synthetic
accacatcaactccgtgtggaatgaccttctggaagacaatgtcacaccaatagacaccactatcatggcaaaga

SEQ ID NO: 108058 - DNA, 75 bp, Artificial Sequence
  Synthetic
gcgtcacagtgccagtgtctgcagtggaagtcaggaacaccagttccagctactacgccactaatgattgctcga

SEQ ID NO: 108059 - DNA, 75 bp, Artificial Sequence
  Synthetic
ggcgtatgggccggcactggtatcatgaccacacggtgtccttgcggcgccaatatctctggcaatgtccgcctg

SEQ ID NO: 108060 - DNA, 75 bp, Artificial Sequence
  Synthetic
gtatgaggtggtcagaaacctcccacccgccgtgatgggaagtgcctacggatttcagtactcaccacagcagcg

SEQ ID NO: 108061 - DNA, 75 bp, Artificial Sequence
  Synthetic
gcggcccaaagggacctgtcaatcagatgtacaccaatgttgaccaagacttagtggggtggcctgcgccccccg

SEQ ID NO: 108062 - DNA, 75 bp, Artificial Sequence
  Synthetic
gagggtggcggcctcagagtacgcggaggtgacgcaacacgggtcatactcctatataacaggactgaccacaga

SEQ ID NO: 108063 - DNA, 75 bp, Artificial Sequence
  Synthetic
tttcgtatgacactcgctgctttgactcaacggtcactgaggctgatatccgcactgaagaggcaatctaccagt

SEQ ID NO: 108064 - DNA, 75 bp, Artificial Sequence
  Synthetic
aagcggtggactttattccggtcgaatcacttgagaccactatgaggtcaccggtgttcactgacaactcaacac

SEQ ID NO: 108065 - DNA, 75 bp, Artificial Sequence
  Synthetic
taacagatccatctcatatcacggcggagaccgcagcgcggcgcttggcgcgggggtcacccccatctgaggcaa

SEQ ID NO: 108066 - DNA, 75 bp, Artificial Sequence
  Synthetic
gtgggccaaagtcatcgccatcctcctccttgtcgcaggagtggatgcaaccacctattccaccggcgcgcaagc

SEQ ID NO: 108067 - DNA, 75 bp, Artificial Sequence
  Synthetic
acatggtggatgccaacctattcatggggggcgatgtcactcggatagagtccgagtccaaagtggtcgttctgg

SEQ ID NO: 108068 - DNA, 75 bp, Artificial Sequence
  Synthetic
tccgagtccaaagtggtcgttctggactctctcgatccaatggtcgaagaagagggcgacctcgagccttcgata

SEQ ID NO: 108069 - DNA, 75 bp, Artificial Sequence
  Synthetic
aggccgtaaaccacatcaactccgtgtggaaggaccttctggaagacagtgtaacaccaatagatactaccatca

SEQ ID NO: 108070 - DNA, 75 bp, Artificial Sequence
  Synthetic
cgggtggggaaccttggaatatgagaccaatgtcaccaatgatgaggacatgaggccgtactgctggcattaccc

SEQ ID NO: 108071 - DNA, 75 bp, Artificial Sequence
  Synthetic
aagaccccgacgccccccccaaggaggcgccggacagtgggtctgagtgagagcaccataggggatgccctacaa

SEQ ID NO: 108072 - DNA, 75 bp, Artificial Sequence
  Synthetic
agctcgctacaaagaccttcggcagctccgaatcgtcggccgtcgacagcggcacggcgaccgcccctcctgacc

SEQ ID NO: 108073 - DNA, 75 bp, Artificial Sequence
  Synthetic
actccgctagcgctgctagtgccaatgggccgctgtggttcttcatcttcttcatagcggcctggtatttaaagg

SEQ ID NO: 108074 - DNA, 75 bp, Artificial Sequence
  Synthetic
atgagtcggctctttcggagacaggttccatctcctccatgccccccctcgagggggagcctggagatccagacc

SEQ ID NO: 108075 - DNA, 75 bp, Artificial Sequence
  Synthetic
tgtgccccacagactgttttaggaagcacccagatgctacctatattaagtgtggagcagggccttggttgaccc

SEQ ID NO: 108076 - DNA, 75 bp, Artificial Sequence
  Synthetic
cagcatgcaagccaattgggccaaagtcattttagtcctgttcatgtttgcaggggttgacgctaatactcatat

SEQ ID NO: 108077 - DNA, 75 bp, Artificial Sequence
  Synthetic
cccggccccgcctctttctcctttgcctactcctactttccgtaggggtaggcgttttcctgcttcccaaccggt

SEQ ID NO: 108078 - DNA, 75 bp, Artificial Sequence
  Synthetic
tgtactgtaccacatcaaagagcgcctcactgagggctaaaaaggtaacttttgataggatgcaagtgctcgacg

SEQ ID NO: 108079 - DNA, 75 bp, Artificial Sequence
  Synthetic
tgggcggtgttgccatgctccttctccgacctaccggcactatccagtggcctattgcacctccaccaaaacata

SEQ ID NO: 108080 - DNA, 75 bp, Artificial Sequence
  Synthetic
ctggcactacgcacctcggccgtgcgggatcgtgccagcatcccaagtgtgtggccctgtgtactgtttcactcc

SEQ ID NO: 108081 - DNA, 75 bp, Artificial Sequence
  Synthetic
tgggagagcgtctttacggggctaacccaaatagacggtcatttcctatcccagaccaagcaatcgggtgagaat

SEQ ID NO: 108082 - DNA, 75 bp, Artificial Sequence
  Synthetic
ccgcgtggtgcgtggttcggatgcgtgtggatgaacagcaccggttatacaaaaacctgtggcgctcctccatgc

SEQ ID NO: 108083 - DNA, 75 bp, Artificial Sequence
  Synthetic
ctcccccgcccagcgggtggagtttctcttgaaggcatgggcggaaaagaaagaccctatgggtttttcgtatga

SEQ ID NO: 108084 - DNA, 75 bp, Artificial Sequence
  Synthetic
cacgatgcatgattcattatccgtaccggctatggcactatccatgcaccgtcaactttaccgtctttaagatca

SEQ ID NO: 108085 - DNA, 75 bp, Artificial Sequence
  Synthetic
gtcaactttaccgtctttaagatcaggacatttattggcggtatagagcatcggatggaagcggcatgcaactgg

SEQ ID NO: 108086 - DNA, 75 bp, Artificial Sequence
  Synthetic
ggcagagcaattcaagcagaaggccataggtcttctaaacttcgctggcaagcaagctcaagaggcaacaccagt

SEQ ID NO: 108087 - DNA, 75 bp, Artificial Sequence
  Synthetic
tggcaaatcctcccctgctctttcaccactctacctgccctttctaccggcttgatccacctccaccaaaatatc

SEQ ID NO: 108088 - DNA, 75 bp, Artificial Sequence
  Synthetic
gatcaccataggcaggtggaccggcacttacatctatgaccacctctcccctttatcaacttgggcagcccaggg

SEQ ID NO: 108089 - DNA, 75 bp, Artificial Sequence
  Synthetic
tgtggccaaatctattgacttcatccctgttgaatctctcgatatcgccacacggacgcccagtttctctgacaa

SEQ ID NO: 108090 - DNA, 75 bp, Artificial Sequence
  Synthetic
tgcggcctgcgggatgtggcccctgcttctcctacttctgatgctgcccgaaagggcctaagcatatgaccggga

SEQ ID NO: 108091 - DNA, 75 bp, Artificial Sequence
  Synthetic
tgcggcctgcgggatgtggcccctgcttctcctacttctgatgctgcccgaaagggcctatgcatatgaccggga

SEQ ID NO: 108092 - DNA, 75 bp, Artificial Sequence
  Synthetic
tgcggcctgcgggatgtggcccctgcttctcctacttctgatgctgcccgaaagggcctacgcatatgaccggga

SEQ ID NO: 108093 - DNA, 75 bp, Artificial Sequence
  Synthetic
tgcggcctgcgggatgtggcccctgcttctcctacttctgatgctgcccgaaagggcctaggcatatgaccggga

SEQ ID NO: 108094 - DNA, 75 bp, Artificial Sequence
  Synthetic
cgttgttctacgcacgcagtttcaactcgtccggatgcccagaacgcatggccagctgtctccccatcagtgagt

SEQ ID NO: 108095 - DNA, 75 bp, Artificial Sequence
  Synthetic
aaggtcatcgatacccttacgtgcggctttgccgacctcatggggtacatccctgtcgtcggcgctccagttggt

SEQ ID NO: 108096 - DNA, 75 bp, Artificial Sequence
  Synthetic
ccggccatataacgggtcaccgcatggcatgggatatgatgatgaactggtcccctacgacggcgttggtaatgg

SEQ ID NO: 108097 - DNA, 75 bp, Artificial Sequence
  Synthetic
caatacttcatagccagggctgaggccatgctgcatgtctaagttccatccttcgacgtgcgtgggcctcgcgac

SEQ ID NO: 108098 - DNA, 75 bp, Artificial Sequence
  Synthetic
caatacttcatagccagggctgaggccatgctgcatgtctatgttccatccttcgacgtgcgtgggcctcgcgac

SEQ ID NO: 108099 - DNA, 75 bp, Artificial Sequence
  Synthetic
caatacttcatagccagggctgaggccatgctgcatgtctacgttccatccttcgacgtgcgtgggcctcgcgac

SEQ ID NO: 108100 - DNA, 75 bp, Artificial Sequence
  Synthetic
caatacttcatagccagggctgaggccatgctgcatgtctaggttccatccttcgacgtgcgtgggcctcgcgac

SEQ ID NO: 108101 - DNA, 75 bp, Artificial Sequence
  Synthetic
cattacttcatagccagggctgaggccatgctgcatgtctaagttccatccttcgacgtgcgtgggcctcgcgac

SEQ ID NO: 108102 - DNA, 75 bp, Artificial Sequence
  Synthetic
cattacttcatagccagggctgaggccatgctgcatgtctatgttccatccttcgacgtgcgtgggcctcgcgac

SEQ ID NO: 108103 - DNA, 75 bp, Artificial Sequence
  Synthetic
cattacttcatagccagggctgaggccatgctgcatgtctacgttccatccttcgacgtgcgtgggcctcgcgac

SEQ ID NO: 108104 - DNA, 75 bp, Artificial Sequence
  Synthetic
cattacttcatagccagggctgaggccatgctgcatgtctaggttccatccttcgacgtgcgtgggcctcgcgac

SEQ ID NO: 108105 - DNA, 75 bp, Artificial Sequence
  Synthetic
cactacttcatagccagggctgaggccatgctgcatgtctaagttccatccttcgacgtgcgtgggcctcgcgac

SEQ ID NO: 108106 - DNA, 75 bp, Artificial Sequence
  Synthetic
cactacttcatagccagggctgaggccatgctgcatgtctatgttccatccttcgacgtgcgtgggcctcgcgac

SEQ ID NO: 108107 - DNA, 75 bp, Artificial Sequence
  Synthetic
cactacttcatagccagggctgaggccatgctgcatgtctacgttccatccttcgacgtgcgtgggcctcgcgac

SEQ ID NO: 108108 - DNA, 75 bp, Artificial Sequence
  Synthetic
cactacttcatagccagggctgaggccatgctgcatgtctaggttccatccttcgacgtgcgtgggcctcgcgac

SEQ ID NO: 108109 - DNA, 75 bp, Artificial Sequence
  Synthetic
cagtacttcatagccagggctgaggccatgctgcatgtctaagttccatccttcgacgtgcgtgggcctcgcgac

SEQ ID NO: 108110 - DNA, 75 bp, Artificial Sequence
  Synthetic
cagtacttcatagccagggctgaggccatgctgcatgtctatgttccatccttcgacgtgcgtgggcctcgcgac

SEQ ID NO: 108111 - DNA, 75 bp, Artificial Sequence
  Synthetic
cagtacttcatagccagggctgaggccatgctgcatgtctacgttccatccttcgacgtgcgtgggcctcgcgac

SEQ ID NO: 108112 - DNA, 75 bp, Artificial Sequence
  Synthetic
cagtacttcatagccagggctgaggccatgctgcatgtctaggttccatccttcgacgtgcgtgggcctcgcgac

SEQ ID NO: 108113 - DNA, 75 bp, Artificial Sequence
  Synthetic
tggccctgctatcttgcatcactgtgccggtctccggcttgcaggtcaagaacaccagcagctcttacatggtga

SEQ ID NO: 108114 - DNA, 75 bp, Artificial Sequence
  Synthetic
ccatgctgcatgtctaagttccatccttcgacgtgcgtgggcctcgcgactcactgatcatccttgcaatcctgg

SEQ ID NO: 108115 - DNA, 75 bp, Artificial Sequence
  Synthetic
ccatgctgcatgtctatgttccatccttcgacgtgcgtgggcctcgcgactcactgatcatccttgcaatcctgg

SEQ ID NO: 108116 - DNA, 75 bp, Artificial Sequence
  Synthetic
ccatgctgcatgtctacgttccatccttcgacgtgcgtgggcctcgcgactcactgatcatccttgcaatcctgg

SEQ ID NO: 108117 - DNA, 75 bp, Artificial Sequence
  Synthetic
ccatgctgcatgtctaggttccatccttcgacgtgcgtgggcctcgcgactcactgatcatccttgcaatcctgg

SEQ ID NO: 108118 - DNA, 75 bp, Artificial Sequence
  Synthetic
atcttggctatgggagatatgggattgggtctgcaccgtgctgagtgacttcaagacgtggcttaaagccaagct

SEQ ID NO: 108119 - DNA, 75 bp, Artificial Sequence
  Synthetic
ctgttggataccagtcacgcctaacgtagctgtgagccaacctggtgctctcaccaagggtttgcggacgcacat

SEQ ID NO: 108120 - DNA, 75 bp, Artificial Sequence
  Synthetic
ggatttatccagctggttcaccgtcggcgccggcgggggcgacatttatcacagcgtgtcgcgtgcccgaccccg

SEQ ID NO: 108121 - DNA, 75 bp, Artificial Sequence
  Synthetic
cagcaccatcagtttgttcagagctgcaactgttccatgtatccaggccacatcacaggacatcggatggcgtgg

SEQ ID NO: 108122 - DNA, 75 bp, Artificial Sequence
  Synthetic
gggtggaggctccttgcccccatcacggcgtacgctcagcagacccgcggcttgtttggcaccatcataacaagc

SEQ ID NO: 108123 - DNA, 75 bp, Artificial Sequence
  Synthetic
gtgtgatgttcggcttagcctatttctctatgcagggagcatgggcgaaggtcgtcgtcatcctcttgttgaccg

SEQ ID NO: 108124 - DNA, 75 bp, Artificial Sequence
  Synthetic
ttccggccccagagttcttcacggaggtagacggcatcaggctacaccgccacgccccgaagtgcaaacccttgc

SEQ ID NO: 108125 - DNA, 75 bp, Artificial Sequence
  Synthetic
tgcgggacgaagtgtcgttctcggtaggactcaattcgttcgtagtgggatcacaactcccatgcgagccggagc

SEQ ID NO: 108126 - DNA, 75 bp, Artificial Sequence
  Synthetic
actcatcaacaccaatggtagctggcacatcaatcgcacagctcttaactgtaatgacagtatgaacactggctt

SEQ ID NO: 108127 - DNA, 75 bp, Artificial Sequence
  Synthetic
actcatcaacaccaatggtagctggcacatcaatcgcacagctcttaactgtaatgacagtttgaacactggctt

SEQ ID NO: 108128 - DNA, 75 bp, Artificial Sequence
  Synthetic
actcatcaacaccaatggtagctggcacatcaatcgcacagctcttaactgtaatgacagtctgaacactggctt

SEQ ID NO: 108129 - DNA, 75 bp, Artificial Sequence
  Synthetic
actcatcaacaccaatggtagctggcacatcaatcgcacagctcttaactgtaatgacagtgtgaacactggctt

SEQ ID NO: 108130 - DNA, 75 bp, Artificial Sequence
  Synthetic
ggcaagtttctcgcggacggaggctgctcagctggcgcctatgacgtcatcatatgcgacgaatgccattcagtg

SEQ ID NO: 108131 - DNA, 75 bp, Artificial Sequence
  Synthetic
tatacttagtcaccaggcacgccgacgtggtgcctgtgcgcaggaggggagacaccagaggagctctcttgagcc

SEQ ID NO: 108132 - DNA, 75 bp, Artificial Sequence
  Synthetic
tttacttagtcaccaggcacgccgacgtggtgcctgtgcgcaggaggggagacaccagaggagctctcttgagcc

SEQ ID NO: 108133 - DNA, 75 bp, Artificial Sequence
  Synthetic
tctacttagtcaccaggcacgccgacgtggtgcctgtgcgcaggaggggagacaccagaggagctctcttgagcc

SEQ ID NO: 108134 - DNA, 75 bp, Artificial Sequence
  Synthetic
tgtacttagtcaccaggcacgccgacgtggtgcctgtgcgcaggaggggagacaccagaggagctctcttgagcc

SEQ ID NO: 108135 - DNA, 75 bp, Artificial Sequence
  Synthetic
tcctcggctagccagctgtccgccccatctctcaaggcaacttgcaccgccaaccatgactcccctgacgccgag

SEQ ID NO: 108136 - DNA, 75 bp, Artificial Sequence
  Synthetic
gctctggagcacgaggagaatgtcaccaaagacggggacatgaggccttactgctggcactatccgcctaaacct

SEQ ID NO: 108137 - DNA, 75 bp, Artificial Sequence
  Synthetic
gctctggagcacgaggagaatgtcaccaatgacggggacatgaggccttactgctggcactatccgcctaaacct

SEQ ID NO: 108138 - DNA, 75 bp, Artificial Sequence
  Synthetic
gctctggagcacgaggagaatgtcaccaacgacggggacatgaggccttactgctggcactatccgcctaaacct

SEQ ID NO: 108139 - DNA, 75 bp, Artificial Sequence
  Synthetic
gctctggagcacgaggagaatgtcaccaaggacggggacatgaggccttactgctggcactatccgcctaaacct

SEQ ID NO: 108140 - DNA, 75 bp, Artificial Sequence
  Synthetic
cggcagttggcacatcaacaggacggccttgaactgcaatgctagccttgacaccggctgggtagcagggctttt

SEQ ID NO: 108141 - DNA, 75 bp, Artificial Sequence
  Synthetic
actcatggggggagaaagagacggacgtcttactattgaacagcacccgtccaccaaagggcgcttggtttgggt

SEQ ID NO: 108142 - DNA, 75 bp, Artificial Sequence
  Synthetic
actcatggggggagaaagagacggacgtcttactattgaacagcacccgtcctccaaagggcgcttggtttgggt

SEQ ID NO: 108143 - DNA, 75 bp, Artificial Sequence
  Synthetic
actcatggggggagaaagagacggacgtcttactattgaacagcacccgtcccccaaagggcgcttggtttgggt

SEQ ID NO: 108144 - DNA, 75 bp, Artificial Sequence
  Synthetic
actcatggggggagaaagagacggacgtcttactattgaacagcacccgtccgccaaagggcgcttggtttgggt

SEQ ID NO: 108145 - DNA, 75 bp, Artificial Sequence
  Synthetic
actcatggggggagaaagagacggacgtctttctattgaacagcacccgtccaccaaagggcgcttggtttgggt

SEQ ID NO: 108146 - DNA, 75 bp, Artificial Sequence
  Synthetic
actcatggggggagaaagagacggacgtctttctattgaacagcacccgtcctccaaagggcgcttggtttgggt

SEQ ID NO: 108147 - DNA, 75 bp, Artificial Sequence
  Synthetic
actcatggggggagaaagagacggacgtctttctattgaacagcacccgtcccccaaagggcgcttggtttgggt

SEQ ID NO: 108148 - DNA, 75 bp, Artificial Sequence
  Synthetic
actcatggggggagaaagagacggacgtctttctattgaacagcacccgtccgccaaagggcgcttggtttgggt

SEQ ID NO: 108149 - DNA, 75 bp, Artificial Sequence
  Synthetic
actcatggggggagaaagagacggacgtcttcctattgaacagcacccgtccaccaaagggcgcttggtttgggt

SEQ ID NO: 108150 - DNA, 75 bp, Artificial Sequence
  Synthetic
actcatggggggagaaagagacggacgtcttcctattgaacagcacccgtcctccaaagggcgcttggtttgggt

SEQ ID NO: 108151 - DNA, 75 bp, Artificial Sequence
  Synthetic
actcatggggggagaaagagacggacgtcttcctattgaacagcacccgtcccccaaagggcgcttggtttgggt

SEQ ID NO: 108152 - DNA, 75 bp, Artificial Sequence
  Synthetic
actcatggggggagaaagagacggacgtcttcctattgaacagcacccgtccgccaaagggcgcttggtttgggt

SEQ ID NO: 108153 - DNA, 75 bp, Artificial Sequence
  Synthetic
actcatggggggagaaagagacggacgtcttgctattgaacagcacccgtccaccaaagggcgcttggtttgggt

SEQ ID NO: 108154 - DNA, 75 bp, Artificial Sequence
  Synthetic
actcatggggggagaaagagacggacgtcttgctattgaacagcacccgtcctccaaagggcgcttggtttgggt

SEQ ID NO: 108155 - DNA, 75 bp, Artificial Sequence
  Synthetic
actcatggggggagaaagagacggacgtcttgctattgaacagcacccgtcccccaaagggcgcttggtttgggt

SEQ ID NO: 108156 - DNA, 75 bp, Artificial Sequence
  Synthetic
actcatggggggagaaagagacggacgtcttgctattgaacagcacccgtccgccaaagggcgcttggtttgggt

SEQ ID NO: 108157 - DNA, 75 bp, Artificial Sequence
  Synthetic
actcatggggggagaatgagacggacgtcttactattgaacagcacccgtccaccaaagggcgcttggtttgggt

SEQ ID NO: 108158 - DNA, 75 bp, Artificial Sequence
  Synthetic
actcatggggggagaatgagacggacgtcttactattgaacagcacccgtcctccaaagggcgcttggtttgggt

SEQ ID NO: 108159 - DNA, 75 bp, Artificial Sequence
  Synthetic
actcatggggggagaatgagacggacgtcttactattgaacagcacccgtcccccaaagggcgcttggtttgggt

SEQ ID NO: 108160 - DNA, 75 bp, Artificial Sequence
  Synthetic
actcatggggggagaatgagacggacgtcttactattgaacagcacccgtccgccaaagggcgcttggtttgggt

SEQ ID NO: 108161 - DNA, 75 bp, Artificial Sequence
  Synthetic
actcatggggggagaatgagacggacgtctttctattgaacagcacccgtccaccaaagggcgcttggtttgggt

SEQ ID NO: 108162 - DNA, 75 bp, Artificial Sequence
  Synthetic
actcatggggggagaatgagacggacgtctttctattgaacagcacccgtcctccaaagggcgcttggtttgggt

SEQ ID NO: 108163 - DNA, 75 bp, Artificial Sequence
  Synthetic
actcatggggggagaatgagacggacgtctttctattgaacagcacccgtcccccaaagggcgcttggtttgggt

SEQ ID NO: 108164 - DNA, 75 bp, Artificial Sequence
  Synthetic
actcatggggggagaatgagacggacgtctttctattgaacagcacccgtccgccaaagggcgcttggtttgggt

SEQ ID NO: 108165 - DNA, 75 bp, Artificial Sequence
  Synthetic
actcatggggggagaatgagacggacgtcttcctattgaacagcacccgtccaccaaagggcgcttggtttgggt

SEQ ID NO: 108166 - DNA, 75 bp, Artificial Sequence
  Synthetic
actcatggggggagaatgagacggacgtcttcctattgaacagcacccgtcctccaaagggcgcttggtttgggt

SEQ ID NO: 108167 - DNA, 75 bp, Artificial Sequence
  Synthetic
actcatggggggagaatgagacggacgtcttcctattgaacagcacccgtcccccaaagggcgcttggtttgggt

SEQ ID NO: 108168 - DNA, 75 bp, Artificial Sequence
  Synthetic
actcatggggggagaatgagacggacgtcttcctattgaacagcacccgtccgccaaagggcgcttggtttgggt

SEQ ID NO: 108169 - DNA, 75 bp, Artificial Sequence
  Synthetic
actcatggggggagaatgagacggacgtcttgctattgaacagcacccgtccaccaaagggcgcttggtttgggt

SEQ ID NO: 108170 - DNA, 75 bp, Artificial Sequence
  Synthetic
actcatggggggagaatgagacggacgtcttgctattgaacagcacccgtcctccaaagggcgcttggtttgggt

SEQ ID NO: 108171 - DNA, 75 bp, Artificial Sequence
  Synthetic
actcatggggggagaatgagacggacgtcttgctattgaacagcacccgtcccccaaagggcgcttggtttgggt

SEQ ID NO: 108172 - DNA, 75 bp, Artificial Sequence
  Synthetic
actcatggggggagaatgagacggacgtcttgctattgaacagcacccgtccgccaaagggcgcttggtttgggt

SEQ ID NO: 108173 - DNA, 75 bp, Artificial Sequence
  Synthetic
actcatggggggagaacgagacggacgtcttactattgaacagcacccgtccaccaaagggcgcttggtttgggt

SEQ ID NO: 108174 - DNA, 75 bp, Artificial Sequence
  Synthetic
actcatggggggagaacgagacggacgtcttactattgaacagcacccgtcctccaaagggcgcttggtttgggt

SEQ ID NO: 108175 - DNA, 75 bp, Artificial Sequence
  Synthetic
actcatggggggagaacgagacggacgtcttactattgaacagcacccgtcccccaaagggcgcttggtttgggt

SEQ ID NO: 108176 - DNA, 75 bp, Artificial Sequence
  Synthetic
actcatggggggagaacgagacggacgtcttactattgaacagcacccgtccgccaaagggcgcttggtttgggt

SEQ ID NO: 108177 - DNA, 75 bp, Artificial Sequence
  Synthetic
actcatggggggagaacgagacggacgtctttctattgaacagcacccgtccaccaaagggcgcttggtttgggt

SEQ ID NO: 108178 - DNA, 75 bp, Artificial Sequence
  Synthetic
actcatggggggagaacgagacggacgtctttctattgaacagcacccgtcctccaaagggcgcttggtttgggt

SEQ ID NO: 108179 - DNA, 75 bp, Artificial Sequence
  Synthetic
actcatggggggagaacgagacggacgtctttctattgaacagcacccgtcccccaaagggcgcttggtttgggt

SEQ ID NO: 108180 - DNA, 75 bp, Artificial Sequence
  Synthetic
actcatggggggagaacgagacggacgtctttctattgaacagcacccgtccgccaaagggcgcttggtttgggt

SEQ ID NO: 108181 - DNA, 75 bp, Artificial Sequence
  Synthetic
actcatggggggagaacgagacggacgtcttcctattgaacagcacccgtccaccaaagggcgcttggtttgggt

SEQ ID NO: 108182 - DNA, 75 bp, Artificial Sequence
  Synthetic
actcatggggggagaacgagacggacgtcttcctattgaacagcacccgtcctccaaagggcgcttggtttgggt

SEQ ID NO: 108183 - DNA, 75 bp, Artificial Sequence
  Synthetic
actcatggggggagaacgagacggacgtcttcctattgaacagcacccgtcccccaaagggcgcttggtttgggt

SEQ ID NO: 108184 - DNA, 75 bp, Artificial Sequence
  Synthetic
actcatggggggagaacgagacggacgtcttcctattgaacagcacccgtccgccaaagggcgcttggtttgggt

SEQ ID NO: 108185 - DNA, 75 bp, Artificial Sequence
  Synthetic
actcatggggggagaacgagacggacgtcttgctattgaacagcacccgtccaccaaagggcgcttggtttgggt

SEQ ID NO: 108186 - DNA, 75 bp, Artificial Sequence
  Synthetic
actcatggggggagaacgagacggacgtcttgctattgaacagcacccgtcctccaaagggcgcttggtttgggt

SEQ ID NO: 108187 - DNA, 75 bp, Artificial Sequence
  Synthetic
actcatggggggagaacgagacggacgtcttgctattgaacagcacccgtcccccaaagggcgcttggtttgggt

SEQ ID NO: 108188 - DNA, 75 bp, Artificial Sequence
  Synthetic
actcatggggggagaacgagacggacgtcttgctattgaacagcacccgtccgccaaagggcgcttggtttgggt

SEQ ID NO: 108189 - DNA, 75 bp, Artificial Sequence
  Synthetic
actcatggggggagaaggagacggacgtcttactattgaacagcacccgtccaccaaagggcgcttggtttgggt

SEQ ID NO: 108190 - DNA, 75 bp, Artificial Sequence
  Synthetic
actcatggggggagaaggagacggacgtcttactattgaacagcacccgtcctccaaagggcgcttggtttgggt

SEQ ID NO: 108191 - DNA, 75 bp, Artificial Sequence
  Synthetic
actcatggggggagaaggagacggacgtcttactattgaacagcacccgtcccccaaagggcgcttggtttgggt

SEQ ID NO: 108192 - DNA, 75 bp, Artificial Sequence
  Synthetic
actcatggggggagaaggagacggacgtcttactattgaacagcacccgtccgccaaagggcgcttggtttgggt

SEQ ID NO: 108193 - DNA, 75 bp, Artificial Sequence
  Synthetic
actcatggggggagaaggagacggacgtctttctattgaacagcacccgtccaccaaagggcgcttggtttgggt

SEQ ID NO: 108194 - DNA, 75 bp, Artificial Sequence
  Synthetic
actcatggggggagaaggagacggacgtctttctattgaacagcacccgtcctccaaagggcgcttggtttgggt

SEQ ID NO: 108195 - DNA, 75 bp, Artificial Sequence
  Synthetic
actcatggggggagaaggagacggacgtctttctattgaacagcacccgtcccccaaagggcgcttggtttgggt

SEQ ID NO: 108196 - DNA, 75 bp, Artificial Sequence
  Synthetic
actcatggggggagaaggagacggacgtctttctattgaacagcacccgtccgccaaagggcgcttggtttgggt

SEQ ID NO: 108197 - DNA, 75 bp, Artificial Sequence
  Synthetic
actcatggggggagaaggagacggacgtcttcctattgaacagcacccgtccaccaaagggcgcttggtttgggt

SEQ ID NO: 108198 - DNA, 75 bp, Artificial Sequence
  Synthetic
actcatggggggagaaggagacggacgtcttcctattgaacagcacccgtcctccaaagggcgcttggtttgggt

SEQ ID NO: 108199 - DNA, 75 bp, Artificial Sequence
  Synthetic
actcatggggggagaaggagacggacgtcttcctattgaacagcacccgtcccccaaagggcgcttggtttgggt

SEQ ID NO: 108200 - DNA, 75 bp, Artificial Sequence
  Synthetic
actcatggggggagaaggagacggacgtcttcctattgaacagcacccgtccgccaaagggcgcttggtttgggt

SEQ ID NO: 108201 - DNA, 75 bp, Artificial Sequence
  Synthetic
actcatggggggagaaggagacggacgtcttgctattgaacagcacccgtccaccaaagggcgcttggtttgggt

SEQ ID NO: 108202 - DNA, 75 bp, Artificial Sequence
  Synthetic
actcatggggggagaaggagacggacgtcttgctattgaacagcacccgtcctccaaagggcgcttggtttgggt

SEQ ID NO: 108203 - DNA, 75 bp, Artificial Sequence
  Synthetic
actcatggggggagaaggagacggacgtcttgctattgaacagcacccgtcccccaaagggcgcttggtttgggt

SEQ ID NO: 108204 - DNA, 75 bp, Artificial Sequence
  Synthetic
actcatggggggagaaggagacggacgtcttgctattgaacagcacccgtccgccaaagggcgcttggtttgggt

SEQ ID NO: 108205 - DNA, 75 bp, Artificial Sequence
  Synthetic
atccacctctcaccgaaacgtggaagcaacaagattacaaacctccaaccgtccacgggtgtgccttgcctccca

SEQ ID NO: 108206 - DNA, 75 bp, Artificial Sequence
  Synthetic
cgactgcttcagaaaacaccctgaggccacctatctcaaatgtggagctggaccctggctgacccctcgatgcat

SEQ ID NO: 108207 - DNA, 75 bp, Artificial Sequence
  Synthetic
catctgtgacgagtgccattccactgactccacgacgatccttggcataggcacggtcctggaccaagcggagac

SEQ ID NO: 108208 - DNA, 75 bp, Artificial Sequence
  Synthetic
gcagcgtgtaacttcactcgtggagaccgctgtagcctagaggacagagacaggagccagttgagcccactgtta

SEQ ID NO: 108209 - DNA, 75 bp, Artificial Sequence
  Synthetic
ggtttacccgtgtgtcaagaccacctggagttctgggaagcggtcttcacgggtctcacacacattgatgcccac

SEQ ID NO: 108210 - DNA, 75 bp, Artificial Sequence
  Synthetic
ttcctctctcagacgaagcaaggaggagacaactttgcgtatctgacggcctaccaggccacagtatgcgctagg

SEQ ID NO: 108211 - DNA, 75 bp, Artificial Sequence
  Synthetic
aatatctgtatggtctgtcaccagccatcacaaagtacattgtcaagtgggagtgggtcgtcctcctctttctgc

SEQ ID NO: 108212 - DNA, 75 bp, Artificial Sequence
  Synthetic
ttctccatggtggggaactgggcgaaggtcctggtagtgctgttgctgtttgccggtgtcgatgcggaaacctac

SEQ ID NO: 108213 - DNA, 75 bp, Artificial Sequence
  Synthetic
gcttaaacctacactgactggtcctacccccctcctgtaccgcttgggcgccgtgaccaacgaggttactctgac

SEQ ID NO: 108214 - DNA, 75 bp, Artificial Sequence
  Synthetic
gagacactcaaggagatcaaggcacgagcatccaaagtgaaggcacgcttgcttactacagaggaagcttgcgac

SEQ ID NO: 108215 - DNA, 75 bp, Artificial Sequence
  Synthetic
acaccccgtgacgaaatatatcgccacatgcatgcaggctgacctcgagatcatgacaagcacatgggtcctggc

SEQ ID NO: 108216 - DNA, 75 bp, Artificial Sequence
  Synthetic
tgctgcgagctctcatggtctccagtacttcatcatcttctttatcgcggcctggtacatcaaagggcgagcagt

SEQ ID NO: 108217 - DNA, 75 bp, Artificial Sequence
  Synthetic
caggttggactcgtactgctggtgatagtatgttgcttcacgcttaccccggcgtacaagactctcctcagccga

SEQ ID NO: 108218 - DNA, 75 bp, Artificial Sequence
  Synthetic
gagcccttgtggtcggtgtggtttgcgcagcaatactacgccggcacgttggcccgggcgagggagcagtgcaat

SEQ ID NO: 108219 - DNA, 75 bp, Artificial Sequence
  Synthetic
acctaaggccgtgatgggagccgcttacggcttccagtactcaccagcgcagcgggtggaatttcttctgacttc

SEQ ID NO: 108220 - DNA, 75 bp, Artificial Sequence
  Synthetic
gctgagagcttacttcaacacaccaggccttcctgtgtgccaagaccatctggagttctgggagagcgtctttac

SEQ ID NO: 108221 - DNA, 75 bp, Artificial Sequence
  Synthetic
gggctgtggtgatgtttcgcccagggttagtgtttgacatagctaagtggcttctggcaattctgggacctggct

SEQ ID NO: 108222 - DNA, 75 bp, Artificial Sequence
  Synthetic
catccagtatttgctcatcacacttggcagatggactggcacgtacatctatgaccacctctcccccatgtcaga

SEQ ID NO: 108223 - DNA, 75 bp, Artificial Sequence
  Synthetic
ttgtcagtggtctagtgggggcggccgtcggaagcataggcctgggtaagatactggtggatgttttggccgggt

SEQ ID NO: 108224 - DNA, 75 bp, Artificial Sequence
  Synthetic
ctgtgcagaatgaagtgacacttacccatcctatcactaaatacatcatggcttgcatgtcagctgacctcgagg

SEQ ID NO: 108225 - DNA, 75 bp, Artificial Sequence
  Synthetic
gcctgtggtgacatcatgcacggactccctgtctctgctcggctaggccgggagatactgctaggccctgctgat

SEQ ID NO: 108226 - DNA, 75 bp, Artificial Sequence
  Synthetic
gcgataagacagagcaggccggagaggttcaggttttgtccacggttacccagtccttccttggaacatcaatct

SEQ ID NO: 108227 - DNA, 75 bp, Artificial Sequence
  Synthetic
ctcgagaccatcaagggggggagacaccttattttctgccactctaagaagaagtgtgacgagctcgccgcgaat

SEQ ID NO: 108228 - DNA, 75 bp, Artificial Sequence
  Synthetic
tggaagaggccgggctatgaaccacccactgtcctaggttgtgcccttccccccacacctcaagcgccggtgccc

SEQ ID NO: 108229 - DNA, 75 bp, Artificial Sequence
  Synthetic
atgagcacaaatcctaaacctcaaagaaaaaccaaaagaaacacaaaccgtcgcccacaggacgtcaagttcccg

SEQ ID NO: 108230 - DNA, 75 bp, Artificial Sequence
  Synthetic
tgtagggtggcccagtcctcccggaaccaggtccctggaaccgtgcacatgcggggccgtagacctatacctcgt

SEQ ID NO: 108231 - DNA, 75 bp, Artificial Sequence
  Synthetic
tgtagggtggcccagtcctcccggaaccaggtccctggaaccgtgcacatgcggggccgtagacctttacctcgt

SEQ ID NO: 108232 - DNA, 75 bp, Artificial Sequence
  Synthetic
tgtagggtggcccagtcctcccggaaccaggtccctggaaccgtgcacatgcggggccgtagacctctacctcgt

SEQ ID NO: 108233 - DNA, 75 bp, Artificial Sequence
  Synthetic
tgtagggtggcccagtcctcccggaaccaggtccctggaaccgtgcacatgcggggccgtagacctgtacctcgt

SEQ ID NO: 108234 - DNA, 75 bp, Artificial Sequence
  Synthetic
gggccagtcctttgccctagaggacacgctgtcggaattttccgtgcagctgtgtgctccagaggggtagcaaag

SEQ ID NO: 108235 - DNA, 75 bp, Artificial Sequence
  Synthetic
gggccagtcctttgccctagaggacacgctgtcggaattttccgtgctgctgtgtgctccagaggggtagcaaag

SEQ ID NO: 108236 - DNA, 75 bp, Artificial Sequence
  Synthetic
gggccagtcctttgccctagaggacacgctgtcggaattttccgtgccgctgtgtgctccagaggggtagcaaag

SEQ ID NO: 108237 - DNA, 75 bp, Artificial Sequence
  Synthetic
gggccagtcctttgccctagaggacacgctgtcggaattttccgtgcggctgtgtgctccagaggggtagcaaag

SEQ ID NO: 108238 - DNA, 75 bp, Artificial Sequence
  Synthetic
gggccagtcctttgccctagtggacacgctgtcggaattttccgtgcagctgtgtgctccagaggggtagcaaag

SEQ ID NO: 108239 - DNA, 75 bp, Artificial Sequence
  Synthetic
gggccagtcctttgccctagtggacacgctgtcggaattttccgtgctgctgtgtgctccagaggggtagcaaag

SEQ ID NO: 108240 - DNA, 75 bp, Artificial Sequence
  Synthetic
gggccagtcctttgccctagtggacacgctgtcggaattttccgtgccgctgtgtgctccagaggggtagcaaag

SEQ ID NO: 108241 - DNA, 75 bp, Artificial Sequence
  Synthetic
gggccagtcctttgccctagtggacacgctgtcggaattttccgtgcggctgtgtgctccagaggggtagcaaag

SEQ ID NO: 108242 - DNA, 75 bp, Artificial Sequence
  Synthetic
gggccagtcctttgccctagcggacacgctgtcggaattttccgtgcagctgtgtgctccagaggggtagcaaag

SEQ ID NO: 108243 - DNA, 75 bp, Artificial Sequence
  Synthetic
gggccagtcctttgccctagcggacacgctgtcggaattttccgtgctgctgtgtgctccagaggggtagcaaag

SEQ ID NO: 108244 - DNA, 75 bp, Artificial Sequence
  Synthetic
gggccagtcctttgccctagcggacacgctgtcggaattttccgtgccgctgtgtgctccagaggggtagcaaag

SEQ ID NO: 108245 - DNA, 75 bp, Artificial Sequence
  Synthetic
gggccagtcctttgccctagcggacacgctgtcggaattttccgtgcggctgtgtgctccagaggggtagcaaag

SEQ ID NO: 108246 - DNA, 75 bp, Artificial Sequence
  Synthetic
gggccagtcctttgccctaggggacacgctgtcggaattttccgtgcagctgtgtgctccagaggggtagcaaag

SEQ ID NO: 108247 - DNA, 75 bp, Artificial Sequence
  Synthetic
gggccagtcctttgccctaggggacacgctgtcggaattttccgtgctgctgtgtgctccagaggggtagcaaag

SEQ ID NO: 108248 - DNA, 75 bp, Artificial Sequence
  Synthetic
gggccagtcctttgccctaggggacacgctgtcggaattttccgtgccgctgtgtgctccagaggggtagcaaag

SEQ ID NO: 108249 - DNA, 75 bp, Artificial Sequence
  Synthetic
gggccagtcctttgccctaggggacacgctgtcggaattttccgtgcggctgtgtgctccagaggggtagcaaag

SEQ ID NO: 108250 - DNA, 75 bp, Artificial Sequence
  Synthetic
tgtggcaggggaccttccccatcaattgttacacagaagggccttgcgtgccgaaaccccctcctaattataaga

SEQ ID NO: 108251 - DNA, 75 bp, Artificial Sequence
  Synthetic
tggggtacctacatgcccccacaggcagtgggaagagcactaaggtccccgcggcgtatgccgctcaggggtaca

SEQ ID NO: 108252 - DNA, 75 bp, Artificial Sequence
  Synthetic
tggggtacctacatgcccccactggcagtgggaagagcactaaggtccccgcggcgtatgccgctcaggggtaca

SEQ ID NO: 108253 - DNA, 75 bp, Artificial Sequence
  Synthetic
tggggtacctacatgcccccaccggcagtgggaagagcactaaggtccccgcggcgtatgccgctcaggggtaca

SEQ ID NO: 108254 - DNA, 75 bp, Artificial Sequence
  Synthetic
tggggtacctacatgcccccacgggcagtgggaagagcactaaggtccccgcggcgtatgccgctcaggggtaca

SEQ ID NO: 108255 - DNA, 75 bp, Artificial Sequence
  Synthetic
ggtaggcatctttctgctgcctgctcggtaggcagcttaacactccgaccttagggtcctagtttattttttttt

SEQ ID NO: 108256 - DNA, 75 bp, Artificial Sequence
  Synthetic
ggtaggcatctttctgctgcctgctcggtaggcagcttaacactccgaccttagggtcctagttttttttttttt

SEQ ID NO: 108257 - DNA, 75 bp, Artificial Sequence
  Synthetic
ggtaggcatctttctgctgcctgctcggtaggcagcttaacactccgaccttagggtcctagtttcttttttttt

SEQ ID NO: 108258 - DNA, 75 bp, Artificial Sequence
  Synthetic
ggtaggcatctttctgctgcctgctcggtaggcagcttaacactccgaccttagggtcctagtttgttttttttt

SEQ ID NO: 108259 - DNA, 75 bp, Artificial Sequence
  Synthetic
caccgtgacaactggggaggccatcacctactctacgtatggcaaattcctcgcagacggaggctgctcaggcgg

SEQ ID NO: 108260 - DNA, 75 bp, Artificial Sequence
  Synthetic
gagattggccaggggatctcccccttcacaggccagctcctcagcaagccagctctctgccccgtctttgaaggc

SEQ ID NO: 108261 - DNA, 75 bp, Artificial Sequence
  Synthetic
cgcctagtggtcctggccacggcaacgccgcctggttccgtgacgaccccccacgccaacatagaggagatagct

SEQ ID NO: 108262 - DNA, 75 bp, Artificial Sequence
  Synthetic
cgcctagtggtcctggccacggctacgccgcctggttccgtgacgaccccccacgccaacatagaggagatagct

SEQ ID NO: 108263 - DNA, 75 bp, Artificial Sequence
  Synthetic
cgcctagtggtcctggccacggccacgccgcctggttccgtgacgaccccccacgccaacatagaggagatagct

SEQ ID NO: 108264 - DNA, 75 bp, Artificial Sequence
  Synthetic
cgcctagtggtcctggccacggcgacgccgcctggttccgtgacgaccccccacgccaacatagaggagatagct

SEQ ID NO: 108265 - DNA, 75 bp, Artificial Sequence
  Synthetic
gcgacgagctcgcggcagcccttcgcaacatgggcttgaacgcagtggcattttacagagggctggacgtctcca

SEQ ID NO: 108266 - DNA, 75 bp, Artificial Sequence
  Synthetic
tgacgggctataccggcgactttgactcagtgatcgactgtaacacatgtgtcacccagacagtcgatttcagct

SEQ ID NO: 108267 - DNA, 75 bp, Artificial Sequence
  Synthetic
ccccacacctcaagcgccggtgcccccacctcggaggcgccgcgccaaagtcctgactcaggacaatgtggagga

SEQ ID NO: 108268 - DNA, 75 bp, Artificial Sequence
  Synthetic
tggcctatttctccatgcagggagcatgggccaaagtcattgccatcctccttcttgtcgcaggagtggacgcac

SEQ ID NO: 108269 - DNA, 75 bp, Artificial Sequence
  Synthetic
cactcaggtcgtggacttcagtctagaccccacattcacaataactacacagactgttccccaggactctgtctc

SEQ ID NO: 108270 - DNA, 75 bp, Artificial Sequence
  Synthetic
tggcagttggcatataaaccggaccgccctcaactgtaatgacagcttgcagacggggtttatcgcttccctgtt

SEQ ID NO: 108271 - DNA, 75 bp, Artificial Sequence
  Synthetic
ctctgtgagtgttatgacgccggcgcagcgtggtacgagcttacgccggctgagaccaccgtcagactgcgggcg

SEQ ID NO: 108272 - DNA, 75 bp, Artificial Sequence
  Synthetic
gtgtggctgaactagatgatgacaaagaggtctcggtcgccgcggaaattctgcgtccgaccaaaaagtttcccc

SEQ ID NO: 108273 - DNA, 75 bp, Artificial Sequence
  Synthetic
agacaaaacaagccggagagaacttcccatacttggtggcctatcaggccaccgtgtgtgccagagctaaagctc

SEQ ID NO: 108274 - DNA, 75 bp, Artificial Sequence
  Synthetic
cggctcagggctacaaggtgctggtgctcaacccctccgttgctgcaacactgggctttggtgcttacatgtcca

SEQ ID NO: 108275 - DNA, 75 bp, Artificial Sequence
  Synthetic
ctctaaggttagtgcgaggctcctctcagtagaggaagcctgcgcgctgaccccgccccactccgccaaatcacg

SEQ ID NO: 108276 - DNA, 75 bp, Artificial Sequence
  Synthetic
tgaggtcaccctcacccatcctatcaccaagtacatcgccacctgcatgcaggctgaccttgaaatcatgactag

SEQ ID NO: 108277 - DNA, 75 bp, Artificial Sequence
  Synthetic
tccttgcagctctggccgcgtattgcctgacaacaggcagcgtggtcattgtgggcaggatcatcttgtccggga

SEQ ID NO: 108278 - DNA, 75 bp, Artificial Sequence
  Synthetic
cactccaactgagaccacagactcgggtcccgtcctcgtggatgacgcatctgacgacggatctatctcgtcaat

SEQ ID NO: 108279 - DNA, 75 bp, Artificial Sequence
  Synthetic
cactccaactgagaccacagactcgggtcccgtcctcgtggatgacgcatctgacgacggatctttctcgtcaat

SEQ ID NO: 108280 - DNA, 75 bp, Artificial Sequence
  Synthetic
cactccaactgagaccacagactcgggtcccgtcctcgtggatgacgcatctgacgacggatctctctcgtcaat

SEQ ID NO: 108281 - DNA, 75 bp, Artificial Sequence
  Synthetic
cactccaactgagaccacagactcgggtcccgtcctcgtggatgacgcatctgacgacggatctgtctcgtcaat

SEQ ID NO: 108282 - DNA, 75 bp, Artificial Sequence
  Synthetic
tgccggagagcgatgcagctgcccgcgtcactgccatactcagcagcctcactgtgacccagctcctgaggcgac

SEQ ID NO: 108283 - DNA, 75 bp, Artificial Sequence
  Synthetic
acctccaccaaaacatcgtggatgtacatcacctctatgggcttagtccggctctcacaaaatacatcgtgaagt

SEQ ID NO: 108284 - DNA, 75 bp, Artificial Sequence
  Synthetic
acggtcattgcccccgataaagaggtcctctatgaggccttcgacgagatggaggagtgcgcctctaaggccgtc

SEQ ID NO: 108285 - DNA, 75 bp, Artificial Sequence
  Synthetic
acatcacctctatgggcttagtccggctctcacaaaatacatcgtgaagtgggaaggggtgtcccttctctttct

SEQ ID NO: 108286 - DNA, 75 bp, Artificial Sequence
  Synthetic
caggcccaagacattcaacctgccgttcaggcgacatggcctaagctagagcaattctgggccaaacacatgtgg

SEQ ID NO: 108287 - DNA, 75 bp, Artificial Sequence
  Synthetic
cgctgcttcggctttcgtgggcgccggcattgccggtgcggctgttggcagcataggccttgggaaggtgcttgt

SEQ ID NO: 108288 - DNA, 75 bp, Artificial Sequence
  Synthetic
atgtcctggctggatatggcgcaggcatttcgggggcactcgtcgcctttaaaatcatgtccggcgagaagccct

SEQ ID NO: 108289 - DNA, 75 bp, Artificial Sequence
  Synthetic
cctgagccgttcagtgtggtggctgtcctacatgctggtcttggccgaggcccagattcagcaatgggttccccc

SEQ ID NO: 108290 - DNA, 75 bp, Artificial Sequence
  Synthetic
gactgccctatcccgtgttctgggtcatggctccgggacgtttgggattgggtttgctctaccttgacagacttc

SEQ ID NO: 108291 - DNA, 75 bp, Artificial Sequence
  Synthetic
ggtttgctctaccttgacagacttcaagaattggctgtcttcaaaattacttccaaaattgcctggcctcccctt

SEQ ID NO: 108292 - DNA, 75 bp, Artificial Sequence
  Synthetic
gcacatcaacaggactgccttgaattgcaacgactccctccagactgggttccttgccgcgctgttctacacaca

SEQ ID NO: 108293 - DNA, 75 bp, Artificial Sequence
  Synthetic
gcgtgagagtcctggaggacggggttaattatgcaacagggaacttacctggttgctccttttctatcttcttgc

SEQ ID NO: 108294 - DNA, 75 bp, Artificial Sequence
  Synthetic
tgcccacttccacctccacagtcccctcctgtgcctccgcctcggaagaagcggacggtggtcctcaccgaatca

SEQ ID NO: 108295 - DNA, 75 bp, Artificial Sequence
  Synthetic
aaggtgtactacctgacccgagaccctgaaactcccctggcgcgagccgcgtgggagacagtccgacacactcca

SEQ ID NO: 108296 - DNA, 75 bp, Artificial Sequence
  Synthetic
ccctgccgatagctacacctcgaaggggtggaagctcctagctcccattactgcttacactcagcagactcgtgg

SEQ ID NO: 108297 - DNA, 75 bp, Artificial Sequence
  Synthetic
cgtacgtgacggggttgacgactgacaacttgaaagtcccctgccaactaccagccccagagttcttctcttggg

SEQ ID NO: 108298 - DNA, 75 bp, Artificial Sequence
  Synthetic
ctctgctccgccctctacgtgggggacctctgtggcggggtgatgctcgcagcccagatgttcattgtctcgccg

SEQ ID NO: 108299 - DNA, 75 bp, Artificial Sequence
  Synthetic
cgaccccgcctattactcctttgcctactcctactcaccgtaggggtaggcatctttttactccccgctcggtag

SEQ ID NO: 108300 - DNA, 75 bp, Artificial Sequence
  Synthetic
tcagctcccttgtgagcctgaacccgatacggaggtgctggcgtctatgttgacagacccttctcatatcacggc

SEQ ID NO: 108301 - DNA, 75 bp, Artificial Sequence
  Synthetic
gaaccggtgagtacaccggaattgccaggacgaccgggtcctttcttggatcaacccgctcaatgcctggagatt

SEQ ID NO: 108302 - DNA, 75 bp, Artificial Sequence
  Synthetic
agggggacctcgtgggatggcctagcccccccgggactaagtcattagacccctgtacctgcggggccgtggacc

SEQ ID NO: 108303 - DNA, 75 bp, Artificial Sequence
  Synthetic
ccctgtacctgcggggccgtggacctctacctggtcacccgaaacgctgatgtcattccggtccggaggaaagat

SEQ ID NO: 108304 - DNA, 75 bp, Artificial Sequence
  Synthetic
actcatggcaaacaccctgacatcgacatggtagacgccaaccttttcatgggaagcgatgtgactcgcatagag

SEQ ID NO: 108305 - DNA, 75 bp, Artificial Sequence
  Synthetic
cgagcagtccgcgctaagctcatcgcccagggaggtaaagccaaaatctgtggcatatacctctttaactgggcg

SEQ ID NO: 108306 - DNA, 75 bp, Artificial Sequence
  Synthetic
gctcattaacaccaatggcagttggcacatcaaccgcactgccctgaattgcaatgactccttgaacaccggctt

SEQ ID NO: 108307 - DNA, 75 bp, Artificial Sequence
  Synthetic
aaaggtttccaccagctctaccgccttgggcgcggcctgattacaacccgccactcttggagacctggaagaggc

SEQ ID NO: 108308 - DNA, 75 bp, Artificial Sequence
  Synthetic
ataggtttccaccagctctaccgccttgggcgcggcctgattacaacccgccactcttggagacctggaagaggc

SEQ ID NO: 108309 - DNA, 75 bp, Artificial Sequence
  Synthetic
acaggtttccaccagctctaccgccttgggcgcggcctgattacaacccgccactcttggagacctggaagaggc

SEQ ID NO: 108310 - DNA, 75 bp, Artificial Sequence
  Synthetic
agaggtttccaccagctctaccgccttgggcgcggcctgattacaacccgccactcttggagacctggaagaggc

SEQ ID NO: 108311 - DNA, 75 bp, Artificial Sequence
  Synthetic
gagcactgtgggggctgcacttcaggacctggccattaaaacctttggccagcccccccccagcggagactcggg

SEQ ID NO: 108312 - DNA, 75 bp, Artificial Sequence
  Synthetic
tgtggcatagtctccgcgaggtctgtgtgtggcccagtgtactgcttcacccccagcccagtggtagtgggcacg

SEQ ID NO: 108313 - DNA, 75 bp, Artificial Sequence
  Synthetic
taccgggacgtgctcaaggagatgaaggcgaaggcgtccacagttaaggctaaacttctatccgtagaagaagcc

SEQ ID NO: 108314 - DNA, 75 bp, Artificial Sequence
  Synthetic
gagggggagcctggggaccccgacctggagccggaggcggttgagccccaaccctccccgcaggagggagggggc

SEQ ID NO: 108315 - DNA, 75 bp, Artificial Sequence
  Synthetic
ccccctgcagaccagaggaggaaaagttaccgattaaccctctcagcaactcgttgctgcggtatcacaacaaag

SEQ ID NO: 108316 - DNA, 75 bp, Artificial Sequence
  Synthetic
ccccctgcagtccagaggaggaaaagttaccgattaaccctctcagcaactcgttgctgcggtatcacaacaaag

SEQ ID NO: 108317 - DNA, 75 bp, Artificial Sequence
  Synthetic
ccccctgcagcccagaggaggaaaagttaccgattaaccctctcagcaactcgttgctgcggtatcacaacaaag

SEQ ID NO: 108318 - DNA, 75 bp, Artificial Sequence
  Synthetic
ccccctgcaggccagaggaggaaaagttaccgattaaccctctcagcaactcgttgctgcggtatcacaacaaag

SEQ ID NO: 108319 - DNA, 75 bp, Artificial Sequence
  Synthetic
tgctgggtagcgctcactcccacgctcgcggccaggaatgccagcgtccccactacgacaatacgacgccatgtc

SEQ ID NO: 108320 - DNA, 75 bp, Artificial Sequence
  Synthetic
ccatcttcaagataaggatgtatgtggggggggttgagcacaggctcacggccgcatgcaacttcactcgtgggg

SEQ ID NO: 108321 - DNA, 75 bp, Artificial Sequence
  Synthetic
ctcattataactcagtcttaaaggacatcaagctggcggcctctaaggttagcgccaggctcctctctatagagg

SEQ ID NO: 108322 - DNA, 75 bp, Artificial Sequence
  Synthetic
agtacatgtatggcctgtcacctgctctcacaaaatacatcgttcggtgggagtgggtagtactcttattcctgc

SEQ ID NO: 108323 - DNA, 75 bp, Artificial Sequence
  Synthetic
acatggtggcgggggcccactggggagtcctggcgggcctcgcctactattccatggtggggaactgggctaagg

SEQ ID NO: 108324 - DNA, 75 bp, Artificial Sequence
  Synthetic
agtcctggcgggcctcgcctactattccatggtggggaactgggctaaggtcttgattgtgatgctactctttgc

SEQ ID NO: 108325 - DNA, 75 bp, Artificial Sequence
  Synthetic
gtggcaggtacctcttcaactgggcagtaaggaccaagctcaaactcactccaatcccggctgcgtcccagttgg

SEQ ID NO: 108326 - DNA, 75 bp, Artificial Sequence
  Synthetic
gcacagaagctccccatcgctgtgatgggagcctcttatggattccaatacactcctacggagcgggtcgacttc

SEQ ID NO: 108327 - DNA, 75 bp, Artificial Sequence
  Synthetic
gcacagaagctccccatcgctgtgatgggagcctcttatggattccaatactctcctacggagcgggtcgacttc

SEQ ID NO: 108328 - DNA, 75 bp, Artificial Sequence
  Synthetic
gcacagaagctccccatcgctgtgatgggagcctcttatggattccaataccctcctacggagcgggtcgacttc

SEQ ID NO: 108329 - DNA, 75 bp, Artificial Sequence
  Synthetic
gcacagaagctccccatcgctgtgatgggagcctcttatggattccaatacgctcctacggagcgggtcgacttc

SEQ ID NO: 108330 - DNA, 75 bp, Artificial Sequence
  Synthetic
gaatcaaccgtatctactgccttggctgagcttgccaccaagagctttggcagctcctcaacttccggtattacg

SEQ ID NO: 108331 - DNA, 75 bp, Artificial Sequence
  Synthetic
agtccatataccttgcttgctccttacccgagcaggcacggactgtcatacactcactgactgagaggctttacg

SEQ ID NO: 108332 - DNA, 75 bp, Artificial Sequence
  Synthetic
agtccatataccttgcttgctccttacccgagcaggctcggactgtcatacactcactgactgagaggctttacg

SEQ ID NO: 108333 - DNA, 75 bp, Artificial Sequence
  Synthetic
agtccatataccttgcttgctccttacccgagcaggcccggactgtcatacactcactgactgagaggctttacg

SEQ ID NO: 108334 - DNA, 75 bp, Artificial Sequence
  Synthetic
agtccatataccttgcttgctccttacccgagcaggcgcggactgtcatacactcactgactgagaggctttacg

SEQ ID NO: 108335 - DNA, 75 bp, Artificial Sequence
  Synthetic
ctacgtgaaggcacaagcagcctgtaaggctgcgggcattgttgcccccacgatgctggtgtgcggcgacgatct

SEQ ID NO: 108336 - DNA, 75 bp, Artificial Sequence
  Synthetic
gagccttcacagaggctatgaccaggtattccgccccaccaggagatcccccaaaaccagaatatgacttggagc

SEQ ID NO: 108337 - DNA, 75 bp, Artificial Sequence
  Synthetic
gagccttcacagaggctatgaccaggtattccgccccaccaggtgatcccccaaaaccagaatatgacttggagc

SEQ ID NO: 108338 - DNA, 75 bp, Artificial Sequence
  Synthetic
gagccttcacagaggctatgaccaggtattccgccccaccaggcgatcccccaaaaccagaatatgacttggagc

SEQ ID NO: 108339 - DNA, 75 bp, Artificial Sequence
  Synthetic
gagccttcacagaggctatgaccaggtattccgccccaccaggggatcccccaaaaccagaatatgacttggagc

SEQ ID NO: 108340 - DNA, 75 bp, Artificial Sequence
  Synthetic
gagccttcacagaggctatgaccaggtattccgccccacctggagatcccccaaaaccagaatatgacttggagc

SEQ ID NO: 108341 - DNA, 75 bp, Artificial Sequence
  Synthetic
gagccttcacagaggctatgaccaggtattccgccccacctggtgatcccccaaaaccagaatatgacttggagc

SEQ ID NO: 108342 - DNA, 75 bp, Artificial Sequence
  Synthetic
gagccttcacagaggctatgaccaggtattccgccccacctggcgatcccccaaaaccagaatatgacttggagc

SEQ ID NO: 108343 - DNA, 75 bp, Artificial Sequence
  Synthetic
gagccttcacagaggctatgaccaggtattccgccccacctggggatcccccaaaaccagaatatgacttggagc

SEQ ID NO: 108344 - DNA, 75 bp, Artificial Sequence
  Synthetic
gagccttcacagaggctatgaccaggtattccgccccacccggagatcccccaaaaccagaatatgacttggagc

SEQ ID NO: 108345 - DNA, 75 bp, Artificial Sequence
  Synthetic
gagccttcacagaggctatgaccaggtattccgccccacccggtgatcccccaaaaccagaatatgacttggagc

SEQ ID NO: 108346 - DNA, 75 bp, Artificial Sequence
  Synthetic
gagccttcacagaggctatgaccaggtattccgccccacccggcgatcccccaaaaccagaatatgacttggagc

SEQ ID NO: 108347 - DNA, 75 bp, Artificial Sequence
  Synthetic
gagccttcacagaggctatgaccaggtattccgccccacccggggatcccccaaaaccagaatatgacttggagc

SEQ ID NO: 108348 - DNA, 75 bp, Artificial Sequence
  Synthetic
gagccttcacagaggctatgaccaggtattccgccccaccgggagatcccccaaaaccagaatatgacttggagc

SEQ ID NO: 108349 - DNA, 75 bp, Artificial Sequence
  Synthetic
gagccttcacagaggctatgaccaggtattccgccccaccgggtgatcccccaaaaccagaatatgacttggagc

SEQ ID NO: 108350 - DNA, 75 bp, Artificial Sequence
  Synthetic
gagccttcacagaggctatgaccaggtattccgccccaccgggcgatcccccaaaaccagaatatgacttggagc

SEQ ID NO: 108351 - DNA, 75 bp, Artificial Sequence
  Synthetic
gagccttcacagaggctatgaccaggtattccgccccaccgggggatcccccaaaaccagaatatgacttggagc

SEQ ID NO: 108352 - DNA, 75 bp, Artificial Sequence
  Synthetic
tcgaggccttctgggcgaagcacatgtggaacttcatcagtgggatacaatacctggcgggcttgtcaacgttgc

SEQ ID NO: 108353 - DNA, 75 bp, Artificial Sequence
  Synthetic
cctgtcaattcatggctgggaaacatcatccagtacgctcctacaatctgggttcgcatggtcctgctcacacat

SEQ ID NO: 108354 - DNA, 75 bp, Artificial Sequence
  Synthetic
gtgacaagacagaacaggccggggaaatccaagtcctatccacagtcactcagtccttcctcggaacatccattt

SEQ ID NO: 108355 - DNA, 75 bp, Artificial Sequence
  Synthetic
ttgtcagtggtctagtgggggcggccgtcggaagtataggcctgggtaagatactggtggacgtcttggccgggt

SEQ ID NO: 108356 - DNA, 75 bp, Artificial Sequence
  Synthetic
atgctgctggtagctcaagctgaggccgccttagagaacctggtggtcctcaatgcggcgtccgtggccggagcg

SEQ ID NO: 108357 - DNA, 75 bp, Artificial Sequence
  Synthetic
ccgccttagagaacctggtggtcctcaatgcggcgtccgtggccggagcgcatggcattctctccttccttgtgt

SEQ ID NO: 108358 - DNA, 75 bp, Artificial Sequence
  Synthetic
tcctggtgctttggtagtgggagtcatctgtgcagcaatcttgcgccgccacgtcggccagggagagggggcggt

SEQ ID NO: 108359 - DNA, 75 bp, Artificial Sequence
  Synthetic
caatgcggcgtccgtggccggagcgcatggcattctctccttccttgtgttcttctgtgctgcctggtacatcaa

SEQ ID NO: 108360 - DNA, 75 bp, Artificial Sequence
  Synthetic
atctgtgcagcaatcttgcgccgccacgtcggccagggagagggggcggtccagtggatgaacagactgatcgcc

SEQ ID NO: 108361 - DNA, 75 bp, Artificial Sequence
  Synthetic
aacaggactgccctgaactgcaatgaatctctcaacactgggtggctagctgcgctgttctatgcaaacaagttc

SEQ ID NO: 108362 - DNA, 75 bp, Artificial Sequence
  Synthetic
gaccttgtcaccatactacaaagtgttcctcgccaggctcatatggtggttacaatattttatcaccagagccga

SEQ ID NO: 108363 - DNA, 75 bp, Artificial Sequence
  Synthetic
gtgtatgaggcagcggacatgatcatgcacacccccgggtgcgtaccctgcgttcgggagggcaactcctcccgc

SEQ ID NO: 108364 - DNA, 75 bp, Artificial Sequence
  Synthetic
ttccactacgtgacgggtatgactactgacaatcttaaatgcccgtgccaggtcccatcgcccgaatttttcaca

SEQ ID NO: 108365 - DNA, 75 bp, Artificial Sequence
  Synthetic
ccatcccaatatagaggaggtagccctcgggcaggagggcgagatccccttctatgggagggcgattcccctgtc

SEQ ID NO: 108366 - DNA, 75 bp, Artificial Sequence
  Synthetic
tcacacaccccataaccaagtacatcatggcatgcatgtcggccgacctggaggtcgtcacgagcacctgggtgc

SEQ ID NO: 108367 - DNA, 75 bp, Artificial Sequence
  Synthetic
cccgggtgcgtcccgtgcgagaaagtggaaaatacatcacggtgctggataccggtctcaccaaacgtggctgtg

SEQ ID NO: 108368 - DNA, 75 bp, Artificial Sequence
  Synthetic
tcccgacagggaagttctctaccaggagttcgatgagatggaagagtgcgcctcgcacctcccttacatcgaaca

SEQ ID NO: 108369 - DNA, 75 bp, Artificial Sequence
  Synthetic
caatgactctctccagactgggttccttgctgcgctgttctacgtacacaagttcaactcgtctggatgcccgga

SEQ ID NO: 108370 - DNA, 75 bp, Artificial Sequence
  Synthetic
caatcacccaaatgtacaccaatgtagaccaggacctcgtcggctggcaagcgccccctggggcgcgttccttga

SEQ ID NO: 108371 - DNA, 75 bp, Artificial Sequence
  Synthetic
ggtagaggaagactgggcatttataggtatgtttccactggtgagcgagcctcaggaatgtttgacagtgtagtg

SEQ ID NO: 108372 - DNA, 75 bp, Artificial Sequence
  Synthetic
ggtatgtttccactggtgagcgagcctcaggaatgtttgacagtgtagtgctctgtgagtgctacgacgcagggg

SEQ ID NO: 108373 - DNA, 75 bp, Artificial Sequence
  Synthetic
agcggggctcactggggcgtcatgttcggcctagcctacttctccatgcagggagcgtgggcgaaggtcgttgtc

SEQ ID NO: 108374 - DNA, 75 bp, Artificial Sequence
  Synthetic
ctcccccgtcctgggacgtcatgtggaagtgcttgactcgactcaagcccacactcgtgggccctacacctctcc

SEQ ID NO: 108375 - DNA, 75 bp, Artificial Sequence
  Synthetic
cagaagcgggatcactgtcctccatgcctccccttgagggagagccgggggaccctgacctggagtttgaaccag

SEQ ID NO: 108376 - DNA, 75 bp, Artificial Sequence
  Synthetic
tcggataggatggggcaccttgcaatacgaggataatgtcaccaacccagaagatatgagaccatactgctggca

SEQ ID NO: 108377 - DNA, 75 bp, Artificial Sequence
  Synthetic
gccctcataacaccatgtgggcccgaggaggagaagttgccgatcaaccctctgagtaattcgctcatgcgattc

SEQ ID NO: 108378 - DNA, 75 bp, Artificial Sequence
  Synthetic
attgaacagcacccgaccaccgcgggggtcatggttcggctgcacgtggatgaactccactggcttcaccaagac

SEQ ID NO: 108379 - DNA, 75 bp, Artificial Sequence
  Synthetic
gggtcatggttcggctgcacgtggatgaactccactggcttcaccaagacttgtggcgcaccaccttgccgcact

SEQ ID NO: 108380 - DNA, 75 bp, Artificial Sequence
  Synthetic
tgaactacgcaacagggaatttgcccggttgctctttctctatcttcctcttagccttgctgtcctgcttgacgg

SEQ ID NO: 108381 - DNA, 75 bp, Artificial Sequence
  Synthetic
agagctgacttcaacgccagcacggacctgttgtgccccacggactgttttaggaagcatcctgaagccacttac

SEQ ID NO: 108382 - DNA, 75 bp, Artificial Sequence
  Synthetic
caggcccaggatatacaacccgctgtgcaggcctcatggcccaaggtggagcaattctgggccaaacacatgtgg

SEQ ID NO: 108383 - DNA, 75 bp, Artificial Sequence
  Synthetic
catgcatgccccggggtgtgtcccctgcgttcaggagaacaactcctctcgttgctggatggcgctcacccccac

SEQ ID NO: 108384 - DNA, 75 bp, Artificial Sequence
  Synthetic
atgctgctgatagcccaggccgaggccgccttagagaacctggtggtcctcaatgcggcgtccgtggccggagcg

SEQ ID NO: 108385 - DNA, 75 bp, Artificial Sequence
  Synthetic
catggcattctctccttccttgtgttcttctgtgctgcctggtacatcaaaggcaggctggtccctggggcggca

SEQ ID NO: 108386 - DNA, 75 bp, Artificial Sequence
  Synthetic
aatgctgtagcatattaccggggtcttgatgtgtccgtcataccggccagcggagacgtcgttgtcgtggcaaca

SEQ ID NO: 108387 - DNA, 75 bp, Artificial Sequence
  Synthetic
tgagcacaggctcacggccgcgtgcaatttcactcgtggggatcgttgcgacttggaggacagggacagaagtca

SEQ ID NO: 108388 - DNA, 75 bp, Artificial Sequence
  Synthetic
gacctttgcgggtccatcttccttgttggccagctattcacccttagaccccgcatataccatacaacacaggat

SEQ ID NO: 108389 - DNA, 75 bp, Artificial Sequence
  Synthetic
gactggtcttctccacctccaccaaaatatcgtggacgtacaatacatgtatggcctgtcacctgcccttacaaa

SEQ ID NO: 108390 - DNA, 75 bp, Artificial Sequence
  Synthetic
tgctccgaatccctcaggctgtcgtggacatggtggcgggggcccactggggagttctagcgggcttagcttact

SEQ ID NO: 108391 - DNA, 75 bp, Artificial Sequence
  Synthetic
atcttttttgtggctgcttggtacatcaagggtcgggcggtccccttggccgcctattccctcactggcctatgg

SEQ ID NO: 108392 - DNA, 75 bp, Artificial Sequence
  Synthetic
agcgcgaggctttaccaggttcttttaccccggggcgtcccagaacattcagctcatacataccaacggcagttg

SEQ ID NO: 108393 - DNA, 75 bp, Artificial Sequence
  Synthetic
ggtttgcaccatcttaacagactttaaaaactggctgacctccaagttgttcccaaagatgcccggcctcccctt

SEQ ID NO: 108394 - DNA, 75 bp, Artificial Sequence
  Synthetic
tcattgccgcgctgttatacgtcaacaagttcaactcgtctggatgtagcgagcgcatggccagctgccgaccca

SEQ ID NO: 108395 - DNA, 75 bp, Artificial Sequence
  Synthetic
tgcatctgtgcacggacagataggcgcggttctgttgatactgattaccctctttacactcaccccgggttataa

SEQ ID NO: 108396 - DNA, 75 bp, Artificial Sequence
  Synthetic
tgcatctgtgcacggacagattggcgcggttctgttgatactgattaccctctttacactcaccccgggttataa

SEQ ID NO: 108397 - DNA, 75 bp, Artificial Sequence
  Synthetic
tgcatctgtgcacggacagatcggcgcggttctgttgatactgattaccctctttacactcaccccgggttataa

SEQ ID NO: 108398 - DNA, 75 bp, Artificial Sequence
  Synthetic
tgcatctgtgcacggacagatgggcgcggttctgttgatactgattaccctctttacactcaccccgggttataa

SEQ ID NO: 108399 - DNA, 75 bp, Artificial Sequence
  Synthetic
aaaaactggctgacctccaagttgttcccaaagatgcccggcctcccctttatctcctgccaaaaggggtacagg

SEQ ID NO: 108400 - DNA, 75 bp, Artificial Sequence
  Synthetic
gagggtggcggcctcggagtacgcggaggtgacgcagcacgggtcatactcctatataacaggactgactactga

SEQ ID NO: 108401 - DNA, 75 bp, Artificial Sequence
  Synthetic
tcgaggaggtgcccctggccaacacaggggaaatccccttctacgccaaaaccatccccattgaggtcatcaggg

SEQ ID NO: 108402 - DNA, 75 bp, Artificial Sequence
  Synthetic
ggcgctattagcccttggtaggtggaccggcacttacatctatgaccacctcacccctatgtcggattgggctgc

SEQ ID NO: 108403 - DNA, 75 bp, Artificial Sequence
  Synthetic
tcgcggggggtaggtacgtccagatggcgctattagcccttggtaggtggaccggcacttacatctatgaccacc

SEQ ID NO: 108404 - DNA, 75 bp, Artificial Sequence
  Synthetic
tggatgaacaacaccgggttcaccaagacatgtgggggtcccccgtgtaacatcggggggaccggtaataacacc

SEQ ID NO: 108405 - DNA, 75 bp, Artificial Sequence
  Synthetic
cgcatgtcttcctgcaagccgatcacctcttttgaccagggttggggccctattacatgtgccaacatatccggt

SEQ ID NO: 108406 - DNA, 75 bp, Artificial Sequence
  Synthetic
gctgtggagcctatcatcttcagtccgatggagaagaaggtcatcgtctggggagcggagacggctgcatgcggg

SEQ ID NO: 108407 - DNA, 75 bp, Artificial Sequence
  Synthetic
ggatacagtacctagcaggcttgtccaccctgcctgggaatcccgcaatagcatctctgatggcattcacagcct

SEQ ID NO: 108408 - DNA, 75 bp, Artificial Sequence
  Synthetic
cgtacaggctatggcactacccttgcactgtcaacttctccatctttaaggtcaggatgtatgtgggtggcgtgg

SEQ ID NO: 108409 - DNA, 75 bp, Artificial Sequence
  Synthetic
ggagtggcaggtactgccctgttccttcaccaccttaccggccctgtccacaggcttaatccatctccaccaaaa

SEQ ID NO: 108410 - DNA, 75 bp, Artificial Sequence
  Synthetic
ggagtggcaggttctgccctgttccttcaccaccttaccggccctgtccacaggcttaatccatctccaccaaaa

SEQ ID NO: 108411 - DNA, 75 bp, Artificial Sequence
  Synthetic
ggagtggcaggtcctgccctgttccttcaccaccttaccggccctgtccacaggcttaatccatctccaccaaaa

SEQ ID NO: 108412 - DNA, 75 bp, Artificial Sequence
  Synthetic
ggagtggcaggtgctgccctgttccttcaccaccttaccggccctgtccacaggcttaatccatctccaccaaaa

SEQ ID NO: 108413 - DNA, 75 bp, Artificial Sequence
  Synthetic
ttcaccaccttaccggccctgtccacaggcttaatccatctccaccaaaacatcgtggacatacaatatttgtat

SEQ ID NO: 108414 - DNA, 75 bp, Artificial Sequence
  Synthetic
ctacaaggtgctggtgctcaacccctccgttgctgcaacactgggctttggcgcttacatgtccaaggcccatgg

SEQ ID NO: 108415 - DNA, 75 bp, Artificial Sequence
  Synthetic
ttggagccgtgcacgtgtggagcggtcgacctgtacctggtcacgcggaacgctgatgtcatcccggctcgaaga

SEQ ID NO: 108416 - DNA, 75 bp, Artificial Sequence
  Synthetic
tgatgctgctgatagctcaagcagaggccgcgttggagaacctggtggtcctcaatgcggcatccctggctggga

SEQ ID NO: 108417 - DNA, 75 bp, Artificial Sequence
  Synthetic
gctgcttttgctcctgctggcactgcctccacgagcttatgctttggaccgggaaatggccgcgtcatgcggagg

SEQ ID NO: 108418 - DNA, 75 bp, Artificial Sequence
  Synthetic
atgagggcctgggatgggcagggtggctcctgtccccccgaggctcccgccctaattggggccccactgaccccc

SEQ ID NO: 108419 - DNA, 75 bp, Artificial Sequence
  Synthetic
cgacaacagcacaccaccagctgtgccccagacctatcaggtcgggtacttgcatgccccaactggcagtggaaa

SEQ ID NO: 108420 - DNA, 75 bp, Artificial Sequence
  Synthetic
ccccttttatggcaaggctatcccccttgaggcaatcaagggggggagacatctcatcttctgtcactccaagaa

SEQ ID NO: 108421 - DNA, 75 bp, Artificial Sequence
  Synthetic
gccgcccaggggtataaggtgctagtgctcaatccctcggtggctgccaccctggggtttggggcgtacttgtcc

SEQ ID NO: 108422 - DNA, 75 bp, Artificial Sequence
  Synthetic
gaggcaggattgcatgagtgggtcccctccctgaacgctcggggaggccgcgacgctgtcatccttctcgcggcc

SEQ ID NO: 108423 - DNA, 75 bp, Artificial Sequence
  Synthetic
cgttgccagggccctggcgcatggcgtcagagtcctggaagatgggataaactatgcaacagggaatttgcctgg

SEQ ID NO: 108424 - DNA, 75 bp, Artificial Sequence
  Synthetic
ggctaacctcctatggaggcaggagatgggtggcaacatcaccagggttgagtcagagaataaagtggtgattct

SEQ ID NO: 108425 - DNA, 75 bp, Artificial Sequence
  Synthetic
tcgtgcgcgcccaggggctcatccggttgtgcatgctggtgcgcaaagtttatggaggccactacatgcagatgg

SEQ ID NO: 108426 - DNA, 75 bp, Artificial Sequence
  Synthetic
tttgacaggatgcaagtgctcgacgcccattatgactcagtcttaaaggacatcaagctagcggcctccaaggtc

SEQ ID NO: 108427 - DNA, 75 bp, Artificial Sequence
  Synthetic
aatgactgctccaacaggagcatcacttggcagcttcatgaagctgtgctccatgtccccggctgtgtcccctgt

SEQ ID NO: 108428 - DNA, 75 bp, Artificial Sequence
  Synthetic
gttgtgcatgctggtgcgcaaagtttatggaggccactacatgcagatggccttcatgaagctgggcgcgctaac

SEQ ID NO: 108429 - DNA, 75 bp, Artificial Sequence
  Synthetic
acaccatcgtgatgtcggcaactctgtgttcggccctttatgtgggggacgtatgcggggctgtgatgatagccg

SEQ ID NO: 108430 - DNA, 75 bp, Artificial Sequence
  Synthetic
atggaaaataagatcatcacctggggggcggacaccgcggcgtgtggggacatcctccaaggactgcctgtctct

SEQ ID NO: 108431 - DNA, 75 bp, Artificial Sequence
  Synthetic
atggaaaataagatcatcacctggggggcggacaccgcggcgtgtggggacatcctccatggactgcctgtctct

SEQ ID NO: 108432 - DNA, 75 bp, Artificial Sequence
  Synthetic
atggaaaataagatcatcacctggggggcggacaccgcggcgtgtggggacatcctccacggactgcctgtctct

SEQ ID NO: 108433 - DNA, 75 bp, Artificial Sequence
  Synthetic
atggaaaataagatcatcacctggggggcggacaccgcggcgtgtggggacatcctccagggactgcctgtctct

SEQ ID NO: 108434 - DNA, 75 bp, Artificial Sequence
  Synthetic
tcacttccatgctcaccgacccctcccacatcacagcagagacggctaagcgtaggctggccagggggtcccccc

SEQ ID NO: 108435 - DNA, 75 bp, Artificial Sequence
  Synthetic
tatgatgatgaactggtcaccaaccatcgccctgattgcagcttatgccgcccgcgtcccggaggtggtccttga

SEQ ID NO: 108436 - DNA, 75 bp, Artificial Sequence
  Synthetic
gaggtctcctgggatgcatcatcaccagccttacaggtagggacagaaatgaggtcgaaggagaggtccagatag

SEQ ID NO: 108437 - DNA, 75 bp, Artificial Sequence
  Synthetic
gaggtctcctgggttgcatcatcaccagccttacaggtagggacagaaatgaggtcgaaggagaggtccagatag

SEQ ID NO: 108438 - DNA, 75 bp, Artificial Sequence
  Synthetic
gaggtctcctgggctgcatcatcaccagccttacaggtagggacagaaatgaggtcgaaggagaggtccagatag

SEQ ID NO: 108439 - DNA, 75 bp, Artificial Sequence
  Synthetic
gaggtctcctggggtgcatcatcaccagccttacaggtagggacagaaatgaggtcgaaggagaggtccagatag

SEQ ID NO: 108440 - DNA, 75 bp, Artificial Sequence
  Synthetic
ccccggacgctgacctcattgaggccaacctcctgtggcggcaggagatgggcggaaacatcacccgcgtggagt

SEQ ID NO: 108441 - DNA, 75 bp, Artificial Sequence
  Synthetic
ttcactataaccacacagaccgtccctcaagacgctgtctcacgtagccagcgccgggggcgcacaggtagagga

SEQ ID NO: 108442 - DNA, 75 bp, Artificial Sequence
  Synthetic
ggggttgacgctcagacgcgtaccgttggtggccaagcggcaagcgtggtttcctccttgacgagtatgttcagc

SEQ ID NO: 108443 - DNA, 75 bp, Artificial Sequence
  Synthetic
gcccatcacccaaatgtacaccaatgttgacaaagacctcgtcggctggccagcgcctcctggagcgcgatcctt

SEQ ID NO: 108444 - DNA, 75 bp, Artificial Sequence
  Synthetic
acgcctggcctgcctgtgtgccaagaccatcttgagttttgggaggcagttttcaccggcctcacacacatagac

SEQ ID NO: 108445 - DNA, 75 bp, Artificial Sequence
  Synthetic
tctccccggcccatctcataactgaaaggatcatcggggggaccattgctatgcccctctgggcatgccgtgggc

SEQ ID NO: 108446 - DNA, 75 bp, Artificial Sequence
  Synthetic
tctccccggcccatctcataactgaaaggatcatcggggggtccattgctatgcccctctgggcatgccgtgggc

SEQ ID NO: 108447 - DNA, 75 bp, Artificial Sequence
  Synthetic
tctccccggcccatctcataactgaaaggatcatcggggggcccattgctatgcccctctgggcatgccgtgggc

SEQ ID NO: 108448 - DNA, 75 bp, Artificial Sequence
  Synthetic
tctccccggcccatctcataactgaaaggatcatcgggggggccattgctatgcccctctgggcatgccgtgggc

SEQ ID NO: 108449 - DNA, 75 bp, Artificial Sequence
  Synthetic
tctccccggcccatctcataactgaaaggatcttcggggggaccattgctatgcccctctgggcatgccgtgggc

SEQ ID NO: 108450 - DNA, 75 bp, Artificial Sequence
  Synthetic
tctccccggcccatctcataactgaaaggatcttcggggggtccattgctatgcccctctgggcatgccgtgggc

SEQ ID NO: 108451 - DNA, 75 bp, Artificial Sequence
  Synthetic
tctccccggcccatctcataactgaaaggatcttcggggggcccattgctatgcccctctgggcatgccgtgggc

SEQ ID NO: 108452 - DNA, 75 bp, Artificial Sequence
  Synthetic
tctccccggcccatctcataactgaaaggatcttcgggggggccattgctatgcccctctgggcatgccgtgggc

SEQ ID NO: 108453 - DNA, 75 bp, Artificial Sequence
  Synthetic
tctccccggcccatctcataactgaaaggatcctcggggggaccattgctatgcccctctgggcatgccgtgggc

SEQ ID NO: 108454 - DNA, 75 bp, Artificial Sequence
  Synthetic
tctccccggcccatctcataactgaaaggatcctcggggggtccattgctatgcccctctgggcatgccgtgggc

SEQ ID NO: 108455 - DNA, 75 bp, Artificial Sequence
  Synthetic
tctccccggcccatctcataactgaaaggatcctcggggggcccattgctatgcccctctgggcatgccgtgggc

SEQ ID NO: 108456 - DNA, 75 bp, Artificial Sequence
  Synthetic
tctccccggcccatctcataactgaaaggatcctcgggggggccattgctatgcccctctgggcatgccgtgggc

SEQ ID NO: 108457 - DNA, 75 bp, Artificial Sequence
  Synthetic
tctccccggcccatctcataactgaaaggatcgtcggggggaccattgctatgcccctctgggcatgccgtgggc

SEQ ID NO: 108458 - DNA, 75 bp, Artificial Sequence
  Synthetic
tctccccggcccatctcataactgaaaggatcgtcggggggtccattgctatgcccctctgggcatgccgtgggc

SEQ ID NO: 108459 - DNA, 75 bp, Artificial Sequence
  Synthetic
tctccccggcccatctcataactgaaaggatcgtcggggggcccattgctatgcccctctgggcatgccgtgggc

SEQ ID NO: 108460 - DNA, 75 bp, Artificial Sequence
  Synthetic
tctccccggcccatctcataactgaaaggatcgtcgggggggccattgctatgcccctctgggcatgccgtgggc

SEQ ID NO: 108461 - DNA, 75 bp, Artificial Sequence
  Synthetic
tctccccggcccatctcatatctgaaaggatcatcggggggaccattgctatgcccctctgggcatgccgtgggc

SEQ ID NO: 108462 - DNA, 75 bp, Artificial Sequence
  Synthetic
tctccccggcccatctcatatctgaaaggatcatcggggggtccattgctatgcccctctgggcatgccgtgggc

SEQ ID NO: 108463 - DNA, 75 bp, Artificial Sequence
  Synthetic
tctccccggcccatctcatatctgaaaggatcatcggggggcccattgctatgcccctctgggcatgccgtgggc

SEQ ID NO: 108464 - DNA, 75 bp, Artificial Sequence
  Synthetic
tctccccggcccatctcatatctgaaaggatcatcgggggggccattgctatgcccctctgggcatgccgtgggc

SEQ ID NO: 108465 - DNA, 75 bp, Artificial Sequence
  Synthetic
tctccccggcccatctcatatctgaaaggatcttcggggggaccattgctatgcccctctgggcatgccgtgggc

SEQ ID NO: 108466 - DNA, 75 bp, Artificial Sequence
  Synthetic
tctccccggcccatctcatatctgaaaggatcttcggggggtccattgctatgcccctctgggcatgccgtgggc

SEQ ID NO: 108467 - DNA, 75 bp, Artificial Sequence
  Synthetic
tctccccggcccatctcatatctgaaaggatcttcggggggcccattgctatgcccctctgggcatgccgtgggc

SEQ ID NO: 108468 - DNA, 75 bp, Artificial Sequence
  Synthetic
tctccccggcccatctcatatctgaaaggatcttcgggggggccattgctatgcccctctgggcatgccgtgggc

SEQ ID NO: 108469 - DNA, 75 bp, Artificial Sequence
  Synthetic
tctccccggcccatctcatatctgaaaggatcctcggggggaccattgctatgcccctctgggcatgccgtgggc

SEQ ID NO: 108470 - DNA, 75 bp, Artificial Sequence
  Synthetic
tctccccggcccatctcatatctgaaaggatcctcggggggtccattgctatgcccctctgggcatgccgtgggc

SEQ ID NO: 108471 - DNA, 75 bp, Artificial Sequence
  Synthetic
tctccccggcccatctcatatctgaaaggatcctcggggggcccattgctatgcccctctgggcatgccgtgggc

SEQ ID NO: 108472 - DNA, 75 bp, Artificial Sequence
  Synthetic
tctccccggcccatctcatatctgaaaggatcctcgggggggccattgctatgcccctctgggcatgccgtgggc

SEQ ID NO: 108473 - DNA, 75 bp, Artificial Sequence
  Synthetic
tctccccggcccatctcatatctgaaaggatcgtcggggggaccattgctatgcccctctgggcatgccgtgggc

SEQ ID NO: 108474 - DNA, 75 bp, Artificial Sequence
  Synthetic
tctccccggcccatctcatatctgaaaggatcgtcggggggtccattgctatgcccctctgggcatgccgtgggc

SEQ ID NO: 108475 - DNA, 75 bp, Artificial Sequence
  Synthetic
tctccccggcccatctcatatctgaaaggatcgtcggggggcccattgctatgcccctctgggcatgccgtgggc

SEQ ID NO: 108476 - DNA, 75 bp, Artificial Sequence
  Synthetic
tctccccggcccatctcatatctgaaaggatcgtcgggggggccattgctatgcccctctgggcatgccgtgggc

SEQ ID NO: 108477 - DNA, 75 bp, Artificial Sequence
  Synthetic
tctccccggcccatctcatacctgaaaggatcatcggggggaccattgctatgcccctctgggcatgccgtgggc

SEQ ID NO: 108478 - DNA, 75 bp, Artificial Sequence
  Synthetic
tctccccggcccatctcatacctgaaaggatcatcggggggtccattgctatgcccctctgggcatgccgtgggc

SEQ ID NO: 108479 - DNA, 75 bp, Artificial Sequence
  Synthetic
tctccccggcccatctcatacctgaaaggatcatcggggggcccattgctatgcccctctgggcatgccgtgggc

SEQ ID NO: 108480 - DNA, 75 bp, Artificial Sequence
  Synthetic
tctccccggcccatctcatacctgaaaggatcatcgggggggccattgctatgcccctctgggcatgccgtgggc

SEQ ID NO: 108481 - DNA, 75 bp, Artificial Sequence
  Synthetic
tctccccggcccatctcatacctgaaaggatcttcggggggaccattgctatgcccctctgggcatgccgtgggc

SEQ ID NO: 108482 - DNA, 75 bp, Artificial Sequence
  Synthetic
tctccccggcccatctcatacctgaaaggatcttcggggggtccattgctatgcccctctgggcatgccgtgggc

SEQ ID NO: 108483 - DNA, 75 bp, Artificial Sequence
  Synthetic
tctccccggcccatctcatacctgaaaggatcttcggggggcccattgctatgcccctctgggcatgccgtgggc

SEQ ID NO: 108484 - DNA, 75 bp, Artificial Sequence
  Synthetic
tctccccggcccatctcatacctgaaaggatcttcgggggggccattgctatgcccctctgggcatgccgtgggc

SEQ ID NO: 108485 - DNA, 75 bp, Artificial Sequence
  Synthetic
tctccccggcccatctcatacctgaaaggatcctcggggggaccattgctatgcccctctgggcatgccgtgggc

SEQ ID NO: 108486 - DNA, 75 bp, Artificial Sequence
  Synthetic
tctccccggcccatctcatacctgaaaggatcctcggggggtccattgctatgcccctctgggcatgccgtgggc

SEQ ID NO: 108487 - DNA, 75 bp, Artificial Sequence
  Synthetic
tctccccggcccatctcatacctgaaaggatcctcggggggcccattgctatgcccctctgggcatgccgtgggc

SEQ ID NO: 108488 - DNA, 75 bp, Artificial Sequence
  Synthetic
tctccccggcccatctcatacctgaaaggatcctcgggggggccattgctatgcccctctgggcatgccgtgggc

SEQ ID NO: 108489 - DNA, 75 bp, Artificial Sequence
  Synthetic
tctccccggcccatctcatacctgaaaggatcgtcggggggaccattgctatgcccctctgggcatgccgtgggc

SEQ ID NO: 108490 - DNA, 75 bp, Artificial Sequence
  Synthetic
tctccccggcccatctcatacctgaaaggatcgtcggggggtccattgctatgcccctctgggcatgccgtgggc

SEQ ID NO: 108491 - DNA, 75 bp, Artificial Sequence
  Synthetic
tctccccggcccatctcatacctgaaaggatcgtcggggggcccattgctatgcccctctgggcatgccgtgggc

SEQ ID NO: 108492 - DNA, 75 bp, Artificial Sequence
  Synthetic
tctccccggcccatctcatacctgaaaggatcgtcgggggggccattgctatgcccctctgggcatgccgtgggc

SEQ ID NO: 108493 - DNA, 75 bp, Artificial Sequence
  Synthetic
tctccccggcccatctcatagctgaaaggatcatcggggggaccattgctatgcccctctgggcatgccgtgggc

SEQ ID NO: 108494 - DNA, 75 bp, Artificial Sequence
  Synthetic
tctccccggcccatctcatagctgaaaggatcatcggggggtccattgctatgcccctctgggcatgccgtgggc

SEQ ID NO: 108495 - DNA, 75 bp, Artificial Sequence
  Synthetic
tctccccggcccatctcatagctgaaaggatcatcggggggcccattgctatgcccctctgggcatgccgtgggc

SEQ ID NO: 108496 - DNA, 75 bp, Artificial Sequence
  Synthetic
tctccccggcccatctcatagctgaaaggatcatcgggggggccattgctatgcccctctgggcatgccgtgggc

SEQ ID NO: 108497 - DNA, 75 bp, Artificial Sequence
  Synthetic
tctccccggcccatctcatagctgaaaggatcttcggggggaccattgctatgcccctctgggcatgccgtgggc

SEQ ID NO: 108498 - DNA, 75 bp, Artificial Sequence
  Synthetic
tctccccggcccatctcatagctgaaaggatcttcggggggtccattgctatgcccctctgggcatgccgtgggc

SEQ ID NO: 108499 - DNA, 75 bp, Artificial Sequence
  Synthetic
tctccccggcccatctcatagctgaaaggatcttcggggggcccattgctatgcccctctgggcatgccgtgggc

SEQ ID NO: 108500 - DNA, 75 bp, Artificial Sequence
  Synthetic
tctccccggcccatctcatagctgaaaggatcttcgggggggccattgctatgcccctctgggcatgccgtgggc

SEQ ID NO: 108501 - DNA, 75 bp, Artificial Sequence
  Synthetic
tctccccggcccatctcatagctgaaaggatcctcggggggaccattgctatgcccctctgggcatgccgtgggc

SEQ ID NO: 108502 - DNA, 75 bp, Artificial Sequence
  Synthetic
tctccccggcccatctcatagctgaaaggatcctcggggggtccattgctatgcccctctgggcatgccgtgggc

SEQ ID NO: 108503 - DNA, 75 bp, Artificial Sequence
  Synthetic
tctccccggcccatctcatagctgaaaggatcctcggggggcccattgctatgcccctctgggcatgccgtgggc

SEQ ID NO: 108504 - DNA, 75 bp, Artificial Sequence
  Synthetic
tctccccggcccatctcatagctgaaaggatcctcgggggggccattgctatgcccctctgggcatgccgtgggc

SEQ ID NO: 108505 - DNA, 75 bp, Artificial Sequence
  Synthetic
tctccccggcccatctcatagctgaaaggatcgtcggggggaccattgctatgcccctctgggcatgccgtgggc

SEQ ID NO: 108506 - DNA, 75 bp, Artificial Sequence
  Synthetic
tctccccggcccatctcatagctgaaaggatcgtcggggggtccattgctatgcccctctgggcatgccgtgggc

SEQ ID NO: 108507 - DNA, 75 bp, Artificial Sequence
  Synthetic
tctccccggcccatctcatagctgaaaggatcgtcggggggcccattgctatgcccctctgggcatgccgtgggc

SEQ ID NO: 108508 - DNA, 75 bp, Artificial Sequence
  Synthetic
tctccccggcccatctcatagctgaaaggatcgtcgggggggccattgctatgcccctctgggcatgccgtgggc

SEQ ID NO: 108509 - DNA, 75 bp, Artificial Sequence
  Synthetic
tcgcatctctattttatgttcaccgtttcaacagttcaggctgccaagagcgcatgtcatcgtgccgcagtctcg

SEQ ID NO: 108510 - DNA, 75 bp, Artificial Sequence
  Synthetic
agcttgctacaaagacctttggcagctccggatcgtcggccgtcgacagcggcacggcgaccgcccctcctgacc

SEQ ID NO: 108511 - DNA, 75 bp, Artificial Sequence
  Synthetic
ttgtggatgatgctgctgatagctcaagctgaggccgccttagagaacttggtggtcctcaatgcagcgtccgtg

SEQ ID NO: 108512 - DNA, 75 bp, Artificial Sequence
  Synthetic
tggtgtagttgacgcccgcaccgtatgcgggccagtttattgcttcacccccagcccagtagttgtgggcactac

SEQ ID NO: 108513 - DNA, 75 bp, Artificial Sequence
  Synthetic
acaattcatctccaccagctgtgccccagacgttccaagtcgctcatttacatgcccctacaggtagcggcaaaa

SEQ ID NO: 108514 - DNA, 75 bp, Artificial Sequence
  Synthetic
acaattcatctccaccagctgtgccccagacgttccaagtcgctcatttacatgcccctactggtagcggcaaaa

SEQ ID NO: 108515 - DNA, 75 bp, Artificial Sequence
  Synthetic
acaattcatctccaccagctgtgccccagacgttccaagtcgctcatttacatgcccctaccggtagcggcaaaa

SEQ ID NO: 108516 - DNA, 75 bp, Artificial Sequence
  Synthetic
acaattcatctccaccagctgtgccccagacgttccaagtcgctcatttacatgcccctacgggtagcggcaaaa

SEQ ID NO: 108517 - DNA, 75 bp, Artificial Sequence
  Synthetic
tgggctctgttaccaacgaggtcaccctcacacatcctgtgacaaaatacatcgccacatgcatgcaagctgacc

SEQ ID NO: 108518 - DNA, 75 bp, Artificial Sequence
  Synthetic
gcaccaaggtacctgctgcatacgcagcccaaggatacaaggtccttgtgttgaatccatctgtcgccgccactc

SEQ ID NO: 108519 - DNA, 75 bp, Artificial Sequence
  Synthetic
gcaccaaggtacctgctgcatacgcagcccaaggttacaaggtccttgtgttgaatccatctgtcgccgccactc

SEQ ID NO: 108520 - DNA, 75 bp, Artificial Sequence
  Synthetic
gcaccaaggtacctgctgcatacgcagcccaaggctacaaggtccttgtgttgaatccatctgtcgccgccactc

SEQ ID NO: 108521 - DNA, 75 bp, Artificial Sequence
  Synthetic
gcaccaaggtacctgctgcatacgcagcccaagggtacaaggtccttgtgttgaatccatctgtcgccgccactc

SEQ ID NO: 108522 - DNA, 75 bp, Artificial Sequence
  Synthetic
cctagctgggggagtcttggcagccgtcgccgcgtattgcttggcgaccgggtgtgtttccatcatcggccgttt

SEQ ID NO: 108523 - DNA, 75 bp, Artificial Sequence
  Synthetic
acatggatgaacggcactgggtttaccaaaacctgtggcgcgcctccttgtcgcattcgaaaggacttcaacgcc

SEQ ID NO: 108524 - DNA, 75 bp, Artificial Sequence
  Synthetic
ttacctttgacagactgcaagtcctggacgaccactaccgggacgtgctcaaggagatgaaggcgaaggcgtcca

SEQ ID NO: 108525 - DNA, 75 bp, Artificial Sequence
  Synthetic
tccattacccctataggttgtggcactatccatgtacagtcaacttcacgatcttcaaaataaggatgttcgtgg

SEQ ID NO: 108526 - DNA, 75 bp, Artificial Sequence
  Synthetic
tcagtcaccgtgccacatcccaacattgaggaagtcgcgctgtccaacagcggagagatcccgttctatggcaag

SEQ ID NO: 108527 - DNA, 75 bp, Artificial Sequence
  Synthetic
ctctactacggagtgggctatactgccatgtactttttcagacctgccagcactctccacggggttggtacatct

SEQ ID NO: 108528 - DNA, 75 bp, Artificial Sequence
  Synthetic
gccgccctcaccagtccgttgtcaactagcaccactatccttctcaacattttggggggctggctagcgtcccaa

SEQ ID NO: 108529 - DNA, 75 bp, Artificial Sequence
  Synthetic
tcattcgtgcatgcatgctggtgcggaaagccgctgggggccattatgtccaaatggctctcatgaggctggccg

SEQ ID NO: 108530 - DNA, 75 bp, Artificial Sequence
  Synthetic
ggtcatcgatacccttacgtgcggctttgccgacctcatggggtacatacccgtcgtgggcgcacctgttggtgg

SEQ ID NO: 108531 - DNA, 75 bp, Artificial Sequence
  Synthetic
tcaacgctgtggcgtactaccgaggccttgatgtgtctgttataccatccagtggggacgtcgtcgtggtagcga

SEQ ID NO: 108532 - DNA, 75 bp, Artificial Sequence
  Synthetic
ctggcagatgccagagtctgtgcatgtttctggatgattatcctactaggccaggccgaggcggcgttggagaaa

SEQ ID NO: 108533 - DNA, 75 bp, Artificial Sequence
  Synthetic
acctggggggcagataccgcggcgtgtggggacatcatctcgggtctacctgtctccgcccgaagggggagggag

SEQ ID NO: 108534 - DNA, 75 bp, Artificial Sequence
  Synthetic
ggctctcgtcgcattcaagatcatgtctggcgagaagccctccatggaggatgtcgtcaacctgctgcctgggat

SEQ ID NO: 108535 - DNA, 75 bp, Artificial Sequence
  Synthetic
gctctcttgtcttgtttgttggtgcccgtatctgctgtggaggtgaaaaacacctcgtcaagctatatggcaacc

SEQ ID NO: 108536 - DNA, 75 bp, Artificial Sequence
  Synthetic
caccatcgacacgacgaccatgccccaagacgcggtgtctcgctcccagaggcggggcaggacgggcaggggcag

SEQ ID NO: 108537 - DNA, 75 bp, Artificial Sequence
  Synthetic
caacggcagttggcacatcaataggacggccttgaactgcaatgatagccttcacaccggctggatagcagggct

SEQ ID NO: 108538 - DNA, 75 bp, Artificial Sequence
  Synthetic
ctgcgactacttattccctcctaggcctttggtcctttctcctgctagtcctagccctaccccagcgagcctacg

SEQ ID NO: 108539 - DNA, 75 bp, Artificial Sequence
  Synthetic
gcgagttgactaccttctcaagatgtggcgctcgaagaagacccctatggggttctcctacgacaccaggtgctt

SEQ ID NO: 108540 - DNA, 75 bp, Artificial Sequence
  Synthetic
cgtgctggataccggtcgcgcccaatgtggccgtgaaggaatatggcgccatcactaagggactgagggctcata

SEQ ID NO: 108541 - DNA, 75 bp, Artificial Sequence
  Synthetic
gccgggcatctataggtatgtcactccaggagaacgaccctctggtatgtttgactcctcggtcctctgcgagtg

SEQ ID NO: 108542 - DNA, 75 bp, Artificial Sequence
  Synthetic
gctgccgacctcttaccgattttgaccagggctggggccctatcaatcatgtcaacggaagtggcctcgaccaac

SEQ ID NO: 108543 - DNA, 75 bp, Artificial Sequence
  Synthetic
cttgtggtggttgtgttacatgctggctctggcggaggctctgatccaggagtgggccccccctttggtagtgag

SEQ ID NO: 108544 - DNA, 75 bp, Artificial Sequence
  Synthetic
catttggagttctgggagagcgtctttacaggcctcacccacatagaagcccatttcctgtcccagacaaaacaa

SEQ ID NO: 108545 - DNA, 75 bp, Artificial Sequence
  Synthetic
catttggagttctgggagagcgtctttacaggcctcacccacatagaagcccatttcctgtcccagacaaatcaa

SEQ ID NO: 108546 - DNA, 75 bp, Artificial Sequence
  Synthetic
catttggagttctgggagagcgtctttacaggcctcacccacatagaagcccatttcctgtcccagacaaaccaa

SEQ ID NO: 108547 - DNA, 75 bp, Artificial Sequence
  Synthetic
catttggagttctgggagagcgtctttacaggcctcacccacatagaagcccatttcctgtcccagacaaagcaa

SEQ ID NO: 108548 - DNA, 75 bp, Artificial Sequence
  Synthetic
catttggagttctgggagagcgtctttacaggcctcacccacatagatgcccatttcctgtcccagacaaaacaa

SEQ ID NO: 108549 - DNA, 75 bp, Artificial Sequence
  Synthetic
catttggagttctgggagagcgtctttacaggcctcacccacatagatgcccatttcctgtcccagacaaatcaa

SEQ ID NO: 108550 - DNA, 75 bp, Artificial Sequence
  Synthetic
catttggagttctgggagagcgtctttacaggcctcacccacatagatgcccatttcctgtcccagacaaaccaa

SEQ ID NO: 108551 - DNA, 75 bp, Artificial Sequence
  Synthetic
catttggagttctgggagagcgtctttacaggcctcacccacatagatgcccatttcctgtcccagacaaagcaa

SEQ ID NO: 108552 - DNA, 75 bp, Artificial Sequence
  Synthetic
catttggagttctgggagagcgtctttacaggcctcacccacatagacgcccatttcctgtcccagacaaaacaa

SEQ ID NO: 108553 - DNA, 75 bp, Artificial Sequence
  Synthetic
catttggagttctgggagagcgtctttacaggcctcacccacatagacgcccatttcctgtcccagacaaatcaa

SEQ ID NO: 108554 - DNA, 75 bp, Artificial Sequence
  Synthetic
catttggagttctgggagagcgtctttacaggcctcacccacatagacgcccatttcctgtcccagacaaaccaa

SEQ ID NO: 108555 - DNA, 75 bp, Artificial Sequence
  Synthetic
catttggagttctgggagagcgtctttacaggcctcacccacatagacgcccatttcctgtcccagacaaagcaa

SEQ ID NO: 108556 - DNA, 75 bp, Artificial Sequence
  Synthetic
catttggagttctgggagagcgtctttacaggcctcacccacatagaggcccatttcctgtcccagacaaaacaa

SEQ ID NO: 108557 - DNA, 75 bp, Artificial Sequence
  Synthetic
catttggagttctgggagagcgtctttacaggcctcacccacatagaggcccatttcctgtcccagacaaatcaa

SEQ ID NO: 108558 - DNA, 75 bp, Artificial Sequence
  Synthetic
catttggagttctgggagagcgtctttacaggcctcacccacatagaggcccatttcctgtcccagacaaaccaa

SEQ ID NO: 108559 - DNA, 75 bp, Artificial Sequence
  Synthetic
catttggagttctgggagagcgtctttacaggcctcacccacatagaggcccatttcctgtcccagacaaagcaa

SEQ ID NO: 108560 - DNA, 75 bp, Artificial Sequence
  Synthetic
gctgcacaggtacgctccggcgtgcaaacctctcctacgggaggaggtcacattccaggtcgggctcaaccaata

SEQ ID NO: 108561 - DNA, 75 bp, Artificial Sequence
  Synthetic
ccagcaccatcattttgtccaagactgtaattgctccatataccccggccatgtcactggacaccgtatggcgtg

SEQ ID NO: 108562 - DNA, 75 bp, Artificial Sequence
  Synthetic
cacggctgaaacctacgctacatgggcctacgcccatgttgtataggttgggtgccgtccagaatgaggtcactc

SEQ ID NO: 108563 - DNA, 75 bp, Artificial Sequence
  Synthetic
cacggctgaaacctacgctacatgggcctacgcccttgttgtataggttgggtgccgtccagaatgaggtcactc

SEQ ID NO: 108564 - DNA, 75 bp, Artificial Sequence
  Synthetic
cacggctgaaacctacgctacatgggcctacgcccctgttgtataggttgggtgccgtccagaatgaggtcactc

SEQ ID NO: 108565 - DNA, 75 bp, Artificial Sequence
  Synthetic
cacggctgaaacctacgctacatgggcctacgcccgtgttgtataggttgggtgccgtccagaatgaggtcactc

SEQ ID NO: 108566 - DNA, 75 bp, Artificial Sequence
  Synthetic
ctcctcaagtatacccttatgcaggtgccctacttcgtacgagctcaagctctgctgagggtgtgcgccctggtg

SEQ ID NO: 108567 - DNA, 75 bp, Artificial Sequence
  Synthetic
ggtgtgatgttcggcctggcctatttctccatgcagggggcatgggccaaggtcgtcgtcatcctcctattgacg

SEQ ID NO: 108568 - DNA, 75 bp, Artificial Sequence
  Synthetic
ggcgggaacatcacccgcgtggagtcagagaataaggtagtaattctggactctttcgacccgcttcgagcggag

SEQ ID NO: 108569 - DNA, 75 bp, Artificial Sequence
  Synthetic
ggccgcgtactgcttatcaacaggctgcgtggtcatagtgggcaggatagtcttgtccggcaagccggctgtcgt

SEQ ID NO: 108570 - DNA, 75 bp, Artificial Sequence
  Synthetic
ggccgcgtactgcttttcaacaggctgcgtggtcatagtgggcaggatagtcttgtccggcaagccggctgtcgt

SEQ ID NO: 108571 - DNA, 75 bp, Artificial Sequence
  Synthetic
ggccgcgtactgcttctcaacaggctgcgtggtcatagtgggcaggatagtcttgtccggcaagccggctgtcgt

SEQ ID NO: 108572 - DNA, 75 bp, Artificial Sequence
  Synthetic
ggccgcgtactgcttgtcaacaggctgcgtggtcatagtgggcaggatagtcttgtccggcaagccggctgtcgt

SEQ ID NO: 108573 - DNA, 75 bp, Artificial Sequence
  Synthetic
gggcttctcaaggcctgcgtgaccttgccatcgccgtggagcccataactttcagcccgatggagaggaaaatca

SEQ ID NO: 108574 - DNA, 75 bp, Artificial Sequence
  Synthetic
agctcatcaacacaaatggtagttggcatatcaacaggacagcgctaaattgcaatgacagcttgcaaacaggtt

SEQ ID NO: 108575 - DNA, 75 bp, Artificial Sequence
  Synthetic
cggcggagatcctgcggaaaaccaggaaattccccccagcgatgcccatatgggcacgcccggattacaaccctc

SEQ ID NO: 108576 - DNA, 75 bp, Artificial Sequence
  Synthetic
aagcagaaagcgctcggcttgctgcaaacagcaacaaagcaggcggaggccgtggcccccgcagtgcagacaaaa

SEQ ID NO: 108577 - DNA, 75 bp, Artificial Sequence
  Synthetic
ctacacctccaaagggtggaggttgttggcacccattactgcctatgcccagcaaacacgaggccttttgggtac

SEQ ID NO: 108578 - DNA, 75 bp, Artificial Sequence
  Synthetic
tgtccaaggcacatggtgtcgaccctaacatcagaactggggtaaggactatcaccacgggcgcccccatcacat

SEQ ID NO: 108579 - DNA, 75 bp, Artificial Sequence
  Synthetic
ttccctcgagtacgaagagaatgtcaccaaccccgaagacatgaggccgtactgctggcattatccacctaagcc

SEQ ID NO: 108580 - DNA, 75 bp, Artificial Sequence
  Synthetic
aaatctccgtcgctgcggaggtcctctgcccctcaaagagattcccacctgccttacctatctgggcacggccag

SEQ ID NO: 108581 - DNA, 75 bp, Artificial Sequence
  Synthetic
ggggaactgggcgaaggtcctggtagtgctgctgctatttgccggcgtcgacgcggaaacccacgtcaccggggg

SEQ ID NO: 108582 - DNA, 75 bp, Artificial Sequence
  Synthetic
tagcatcattgatggcatttacagcttccatcaccagcccattaaccacccagcaaaccctcctgtttaacatct

SEQ ID NO: 108583 - DNA, 75 bp, Artificial Sequence
  Synthetic
ggggtcctctggaccgtcttccatggggctggaaacaagacgctagccggccctagggggccggttacgcagatg

SEQ ID NO: 108584 - DNA, 75 bp, Artificial Sequence
  Synthetic
tacacctggggggagaatgagactgatgttttcctcctcaatagcacaagaccaccacggggtgcgtggtttggg

SEQ ID NO: 108585 - DNA, 75 bp, Artificial Sequence
  Synthetic
gaaggtgctcattgacatcctggcgggttatggggcgggagtggcaggcgcactcgtggcctttaagatcatgag

SEQ ID NO: 108586 - DNA, 75 bp, Artificial Sequence
  Synthetic
cccggaatgctgacgtcattcctgttcggaggcggggcgaccggcgcggggctttactttctccaagacctctct

SEQ ID NO: 108587 - DNA, 75 bp, Artificial Sequence
  Synthetic
cactcgtggcctttaagatcatgagtggcgaggtcccatccaccgaggacatagtcaacttgctgcctgccattc

SEQ ID NO: 108588 - DNA, 75 bp, Artificial Sequence
  Synthetic
cactcgtggcctttaagatcatgagtggcgaggtcccatccaccgaggacttagtcaacttgctgcctgccattc

SEQ ID NO: 108589 - DNA, 75 bp, Artificial Sequence
  Synthetic
cactcgtggcctttaagatcatgagtggcgaggtcccatccaccgaggacctagtcaacttgctgcctgccattc

SEQ ID NO: 108590 - DNA, 75 bp, Artificial Sequence
  Synthetic
cactcgtggcctttaagatcatgagtggcgaggtcccatccaccgaggacgtagtcaacttgctgcctgccattc

SEQ ID NO: 108591 - DNA, 75 bp, Artificial Sequence
  Synthetic
cactcgtggcctttaagatcatgagtggcgaggtcccttccaccgaggacatagtcaacttgctgcctgccattc

SEQ ID NO: 108592 - DNA, 75 bp, Artificial Sequence
  Synthetic
cactcgtggcctttaagatcatgagtggcgaggtcccttccaccgaggacttagtcaacttgctgcctgccattc

SEQ ID NO: 108593 - DNA, 75 bp, Artificial Sequence
  Synthetic
cactcgtggcctttaagatcatgagtggcgaggtcccttccaccgaggacctagtcaacttgctgcctgccattc

SEQ ID NO: 108594 - DNA, 75 bp, Artificial Sequence
  Synthetic
cactcgtggcctttaagatcatgagtggcgaggtcccttccaccgaggacgtagtcaacttgctgcctgccattc

SEQ ID NO: 108595 - DNA, 75 bp, Artificial Sequence
  Synthetic
cactcgtggcctttaagatcatgagtggcgaggtcccctccaccgaggacatagtcaacttgctgcctgccattc

SEQ ID NO: 108596 - DNA, 75 bp, Artificial Sequence
  Synthetic
cactcgtggcctttaagatcatgagtggcgaggtcccctccaccgaggacttagtcaacttgctgcctgccattc

SEQ ID NO: 108597 - DNA, 75 bp, Artificial Sequence
  Synthetic
cactcgtggcctttaagatcatgagtggcgaggtcccctccaccgaggacctagtcaacttgctgcctgccattc

SEQ ID NO: 108598 - DNA, 75 bp, Artificial Sequence
  Synthetic
cactcgtggcctttaagatcatgagtggcgaggtcccctccaccgaggacgtagtcaacttgctgcctgccattc

SEQ ID NO: 108599 - DNA, 75 bp, Artificial Sequence
  Synthetic
cactcgtggcctttaagatcatgagtggcgaggtcccgtccaccgaggacatagtcaacttgctgcctgccattc

SEQ ID NO: 108600 - DNA, 75 bp, Artificial Sequence
  Synthetic
cactcgtggcctttaagatcatgagtggcgaggtcccgtccaccgaggacttagtcaacttgctgcctgccattc

SEQ ID NO: 108601 - DNA, 75 bp, Artificial Sequence
  Synthetic
cactcgtggcctttaagatcatgagtggcgaggtcccgtccaccgaggacctagtcaacttgctgcctgccattc

SEQ ID NO: 108602 - DNA, 75 bp, Artificial Sequence
  Synthetic
cactcgtggcctttaagatcatgagtggcgaggtcccgtccaccgaggacgtagtcaacttgctgcctgccattc

SEQ ID NO: 108603 - DNA, 75 bp, Artificial Sequence
  Synthetic
cagattgcttcaggaaacatcctgaggccacctacatcaaatgtggggcaggcccctggctaacacctagatgcc

SEQ ID NO: 108604 - DNA, 75 bp, Artificial Sequence
  Synthetic
cgggatgtggcccctcctcctgctcctgttggcgttgccccaacgggcgtacgcgctggacacggaggtggccgc

SEQ ID NO: 108605 - DNA, 75 bp, Artificial Sequence
  Synthetic
tcttcgggctgtcccgagaggttggccagctgccgactccttgccgattttgaccagggctggggccctatcagt

SEQ ID NO: 108606 - DNA, 75 bp, Artificial Sequence
  Synthetic
acaaacgatgaggacatgaggccctactgttggcattaccctccgaagccttgcggaatcgttccggctaggaaa

SEQ ID NO: 108607 - DNA, 75 bp, Artificial Sequence
  Synthetic
acaaacgatgaggacatgaggccctactgttggcattaccctccgaagccttgcggaatcgttccggctaggaat

SEQ ID NO: 108608 - DNA, 75 bp, Artificial Sequence
  Synthetic
acaaacgatgaggacatgaggccctactgttggcattaccctccgaagccttgcggaatcgttccggctaggaac

SEQ ID NO: 108609 - DNA, 75 bp, Artificial Sequence
  Synthetic
acaaacgatgaggacatgaggccctactgttggcattaccctccgaagccttgcggaatcgttccggctaggaag

SEQ ID NO: 108610 - DNA, 75 bp, Artificial Sequence
  Synthetic
acaaacgatgaggacatgaggccctactgttggcattaccctccgaagccttgcggtatcgttccggctaggaaa

SEQ ID NO: 108611 - DNA, 75 bp, Artificial Sequence
  Synthetic
acaaacgatgaggacatgaggccctactgttggcattaccctccgaagccttgcggtatcgttccggctaggaat

SEQ ID NO: 108612 - DNA, 75 bp, Artificial Sequence
  Synthetic
acaaacgatgaggacatgaggccctactgttggcattaccctccgaagccttgcggtatcgttccggctaggaac

SEQ ID NO: 108613 - DNA, 75 bp, Artificial Sequence
  Synthetic
acaaacgatgaggacatgaggccctactgttggcattaccctccgaagccttgcggtatcgttccggctaggaag

SEQ ID NO: 108614 - DNA, 75 bp, Artificial Sequence
  Synthetic
acaaacgatgaggacatgaggccctactgttggcattaccctccgaagccttgcggcatcgttccggctaggaaa

SEQ ID NO: 108615 - DNA, 75 bp, Artificial Sequence
  Synthetic
acaaacgatgaggacatgaggccctactgttggcattaccctccgaagccttgcggcatcgttccggctaggaat

SEQ ID NO: 108616 - DNA, 75 bp, Artificial Sequence
  Synthetic
acaaacgatgaggacatgaggccctactgttggcattaccctccgaagccttgcggcatcgttccggctaggaac

SEQ ID NO: 108617 - DNA, 75 bp, Artificial Sequence
  Synthetic
acaaacgatgaggacatgaggccctactgttggcattaccctccgaagccttgcggcatcgttccggctaggaag

SEQ ID NO: 108618 - DNA, 75 bp, Artificial Sequence
  Synthetic
acaaacgatgaggacatgaggccctactgttggcattaccctccgaagccttgcgggatcgttccggctaggaaa

SEQ ID NO: 108619 - DNA, 75 bp, Artificial Sequence
  Synthetic
acaaacgatgaggacatgaggccctactgttggcattaccctccgaagccttgcgggatcgttccggctaggaat

SEQ ID NO: 108620 - DNA, 75 bp, Artificial Sequence
  Synthetic
acaaacgatgaggacatgaggccctactgttggcattaccctccgaagccttgcgggatcgttccggctaggaac

SEQ ID NO: 108621 - DNA, 75 bp, Artificial Sequence
  Synthetic
acaaacgatgaggacatgaggccctactgttggcattaccctccgaagccttgcgggatcgttccggctaggaag

SEQ ID NO: 108622 - DNA, 75 bp, Artificial Sequence
  Synthetic
actaacgatgaggacatgaggccctactgttggcattaccctccgaagccttgcggaatcgttccggctaggaaa

SEQ ID NO: 108623 - DNA, 75 bp, Artificial Sequence
  Synthetic
actaacgatgaggacatgaggccctactgttggcattaccctccgaagccttgcggaatcgttccggctaggaat

SEQ ID NO: 108624 - DNA, 75 bp, Artificial Sequence
  Synthetic
actaacgatgaggacatgaggccctactgttggcattaccctccgaagccttgcggaatcgttccggctaggaac

SEQ ID NO: 108625 - DNA, 75 bp, Artificial Sequence
  Synthetic
actaacgatgaggacatgaggccctactgttggcattaccctccgaagccttgcggaatcgttccggctaggaag

SEQ ID NO: 108626 - DNA, 75 bp, Artificial Sequence
  Synthetic
actaacgatgaggacatgaggccctactgttggcattaccctccgaagccttgcggtatcgttccggctaggaaa

SEQ ID NO: 108627 - DNA, 75 bp, Artificial Sequence
  Synthetic
actaacgatgaggacatgaggccctactgttggcattaccctccgaagccttgcggtatcgttccggctaggaat

SEQ ID NO: 108628 - DNA, 75 bp, Artificial Sequence
  Synthetic
actaacgatgaggacatgaggccctactgttggcattaccctccgaagccttgcggtatcgttccggctaggaac

SEQ ID NO: 108629 - DNA, 75 bp, Artificial Sequence
  Synthetic
actaacgatgaggacatgaggccctactgttggcattaccctccgaagccttgcggtatcgttccggctaggaag

SEQ ID NO: 108630 - DNA, 75 bp, Artificial Sequence
  Synthetic
actaacgatgaggacatgaggccctactgttggcattaccctccgaagccttgcggcatcgttccggctaggaaa

SEQ ID NO: 108631 - DNA, 75 bp, Artificial Sequence
  Synthetic
actaacgatgaggacatgaggccctactgttggcattaccctccgaagccttgcggcatcgttccggctaggaat

SEQ ID NO: 108632 - DNA, 75 bp, Artificial Sequence
  Synthetic
actaacgatgaggacatgaggccctactgttggcattaccctccgaagccttgcggcatcgttccggctaggaac

SEQ ID NO: 108633 - DNA, 75 bp, Artificial Sequence
  Synthetic
actaacgatgaggacatgaggccctactgttggcattaccctccgaagccttgcggcatcgttccggctaggaag

SEQ ID NO: 108634 - DNA, 75 bp, Artificial Sequence
  Synthetic
actaacgatgaggacatgaggccctactgttggcattaccctccgaagccttgcgggatcgttccggctaggaaa

SEQ ID NO: 108635 - DNA, 75 bp, Artificial Sequence
  Synthetic
actaacgatgaggacatgaggccctactgttggcattaccctccgaagccttgcgggatcgttccggctaggaat

SEQ ID NO: 108636 - DNA, 75 bp, Artificial Sequence
  Synthetic
actaacgatgaggacatgaggccctactgttggcattaccctccgaagccttgcgggatcgttccggctaggaac

SEQ ID NO: 108637 - DNA, 75 bp, Artificial Sequence
  Synthetic
actaacgatgaggacatgaggccctactgttggcattaccctccgaagccttgcgggatcgttccggctaggaag

SEQ ID NO: 108638 - DNA, 75 bp, Artificial Sequence
  Synthetic
accaacgatgaggacatgaggccctactgttggcattaccctccgaagccttgcggaatcgttccggctaggaaa

SEQ ID NO: 108639 - DNA, 75 bp, Artificial Sequence
  Synthetic
accaacgatgaggacatgaggccctactgttggcattaccctccgaagccttgcggaatcgttccggctaggaat

SEQ ID NO: 108640 - DNA, 75 bp, Artificial Sequence
  Synthetic
accaacgatgaggacatgaggccctactgttggcattaccctccgaagccttgcggaatcgttccggctaggaac

SEQ ID NO: 108641 - DNA, 75 bp, Artificial Sequence
  Synthetic
accaacgatgaggacatgaggccctactgttggcattaccctccgaagccttgcggaatcgttccggctaggaag

SEQ ID NO: 108642 - DNA, 75 bp, Artificial Sequence
  Synthetic
accaacgatgaggacatgaggccctactgttggcattaccctccgaagccttgcggtatcgttccggctaggaaa

SEQ ID NO: 108643 - DNA, 75 bp, Artificial Sequence
  Synthetic
accaacgatgaggacatgaggccctactgttggcattaccctccgaagccttgcggtatcgttccggctaggaat

SEQ ID NO: 108644 - DNA, 75 bp, Artificial Sequence
  Synthetic
accaacgatgaggacatgaggccctactgttggcattaccctccgaagccttgcggtatcgttccggctaggaac

SEQ ID NO: 108645 - DNA, 75 bp, Artificial Sequence
  Synthetic
accaacgatgaggacatgaggccctactgttggcattaccctccgaagccttgcggtatcgttccggctaggaag

SEQ ID NO: 108646 - DNA, 75 bp, Artificial Sequence
  Synthetic
accaacgatgaggacatgaggccctactgttggcattaccctccgaagccttgcggcatcgttccggctaggaaa

SEQ ID NO: 108647 - DNA, 75 bp, Artificial Sequence
  Synthetic
accaacgatgaggacatgaggccctactgttggcattaccctccgaagccttgcggcatcgttccggctaggaat

SEQ ID NO: 108648 - DNA, 75 bp, Artificial Sequence
  Synthetic
accaacgatgaggacatgaggccctactgttggcattaccctccgaagccttgcggcatcgttccggctaggaac

SEQ ID NO: 108649 - DNA, 75 bp, Artificial Sequence
  Synthetic
accaacgatgaggacatgaggccctactgttggcattaccctccgaagccttgcggcatcgttccggctaggaag

SEQ ID NO: 108650 - DNA, 75 bp, Artificial Sequence
  Synthetic
accaacgatgaggacatgaggccctactgttggcattaccctccgaagccttgcgggatcgttccggctaggaaa

SEQ ID NO: 108651 - DNA, 75 bp, Artificial Sequence
  Synthetic
accaacgatgaggacatgaggccctactgttggcattaccctccgaagccttgcgggatcgttccggctaggaat

SEQ ID NO: 108652 - DNA, 75 bp, Artificial Sequence
  Synthetic
accaacgatgaggacatgaggccctactgttggcattaccctccgaagccttgcgggatcgttccggctaggaac

SEQ ID NO: 108653 - DNA, 75 bp, Artificial Sequence
  Synthetic
accaacgatgaggacatgaggccctactgttggcattaccctccgaagccttgcgggatcgttccggctaggaag

SEQ ID NO: 108654 - DNA, 75 bp, Artificial Sequence
  Synthetic
acgaacgatgaggacatgaggccctactgttggcattaccctccgaagccttgcggaatcgttccggctaggaaa

SEQ ID NO: 108655 - DNA, 75 bp, Artificial Sequence
  Synthetic
acgaacgatgaggacatgaggccctactgttggcattaccctccgaagccttgcggaatcgttccggctaggaat

SEQ ID NO: 108656 - DNA, 75 bp, Artificial Sequence
  Synthetic
acgaacgatgaggacatgaggccctactgttggcattaccctccgaagccttgcggaatcgttccggctaggaac

SEQ ID NO: 108657 - DNA, 75 bp, Artificial Sequence
  Synthetic
acgaacgatgaggacatgaggccctactgttggcattaccctccgaagccttgcggaatcgttccggctaggaag

SEQ ID NO: 108658 - DNA, 75 bp, Artificial Sequence
  Synthetic
acgaacgatgaggacatgaggccctactgttggcattaccctccgaagccttgcggtatcgttccggctaggaaa

SEQ ID NO: 108659 - DNA, 75 bp, Artificial Sequence
  Synthetic
acgaacgatgaggacatgaggccctactgttggcattaccctccgaagccttgcggtatcgttccggctaggaat

SEQ ID NO: 108660 - DNA, 75 bp, Artificial Sequence
  Synthetic
acgaacgatgaggacatgaggccctactgttggcattaccctccgaagccttgcggtatcgttccggctaggaac

SEQ ID NO: 108661 - DNA, 75 bp, Artificial Sequence
  Synthetic
acgaacgatgaggacatgaggccctactgttggcattaccctccgaagccttgcggtatcgttccggctaggaag

SEQ ID NO: 108662 - DNA, 75 bp, Artificial Sequence
  Synthetic
acgaacgatgaggacatgaggccctactgttggcattaccctccgaagccttgcggcatcgttccggctaggaaa

SEQ ID NO: 108663 - DNA, 75 bp, Artificial Sequence
  Synthetic
acgaacgatgaggacatgaggccctactgttggcattaccctccgaagccttgcggcatcgttccggctaggaat

SEQ ID NO: 108664 - DNA, 75 bp, Artificial Sequence
  Synthetic
acgaacgatgaggacatgaggccctactgttggcattaccctccgaagccttgcggcatcgttccggctaggaac

SEQ ID NO: 108665 - DNA, 75 bp, Artificial Sequence
  Synthetic
acgaacgatgaggacatgaggccctactgttggcattaccctccgaagccttgcggcatcgttccggctaggaag

SEQ ID NO: 108666 - DNA, 75 bp, Artificial Sequence
  Synthetic
acgaacgatgaggacatgaggccctactgttggcattaccctccgaagccttgcgggatcgttccggctaggaaa

SEQ ID NO: 108667 - DNA, 75 bp, Artificial Sequence
  Synthetic
acgaacgatgaggacatgaggccctactgttggcattaccctccgaagccttgcgggatcgttccggctaggaat

SEQ ID NO: 108668 - DNA, 75 bp, Artificial Sequence
  Synthetic
acgaacgatgaggacatgaggccctactgttggcattaccctccgaagccttgcgggatcgttccggctaggaac

SEQ ID NO: 108669 - DNA, 75 bp, Artificial Sequence
  Synthetic
acgaacgatgaggacatgaggccctactgttggcattaccctccgaagccttgcgggatcgttccggctaggaag

SEQ ID NO: 108670 - DNA, 75 bp, Artificial Sequence
  Synthetic
catcgacttcatccccgtggagtcgctcaacatcgttacaaggtcccccagtttcagcgacaacagcactccgcc

SEQ ID NO: 108671 - DNA, 75 bp, Artificial Sequence
  Synthetic
accccccccccaaggaaaccccggacagtgggtctgaacgagagcactatagcagatgccctccagcagctggcc

SEQ ID NO: 108672 - DNA, 75 bp, Artificial Sequence
  Synthetic
tttagcttttctggtgttggccgacgcgcgcatttgtgcgtgcatgtggttgatgttcctggtgggccaagcgga

SEQ ID NO: 108673 - DNA, 75 bp, Artificial Sequence
  Synthetic
agcagcatgtaacttcacccggggagaacggtgcgatctctcagaccgagacaggagtcagctcagtcctctcct

SEQ ID NO: 108674 - DNA, 75 bp, Artificial Sequence
  Synthetic
agcgttcgcttcacgaggcaaccacgtctcccccacgcactatgtgcctgagagcgatgctgccgcacgtgtaac

SEQ ID NO: 108675 - DNA, 75 bp, Artificial Sequence
  Synthetic
gtactcgtactaaacccctccgtggctgccactttgggattcggcgcatacatgtcgaaggcccacggtatcaac

SEQ ID NO: 108676 - DNA, 75 bp, Artificial Sequence
  Synthetic
gctgctggccatctttggacccctttggattcttcaaaccagtttgcttaaagtaccctacttcgtgcgcgtcca

SEQ ID NO: 108677 - DNA, 75 bp, Artificial Sequence
  Synthetic
gacatctgggactggatatgcacagtgttgagcgacttcaagacctggcttaaagcaaaactcctaccgcgcatg

SEQ ID NO: 108678 - DNA, 75 bp, Artificial Sequence
  Synthetic
gacatctgggactggatatgcacagtgttgagcgacttcaagacctggcttaaagcaaatctcctaccgcgcatg

SEQ ID NO: 108679 - DNA, 75 bp, Artificial Sequence
  Synthetic
gacatctgggactggatatgcacagtgttgagcgacttcaagacctggcttaaagcaaacctcctaccgcgcatg

SEQ ID NO: 108680 - DNA, 75 bp, Artificial Sequence
  Synthetic
gacatctgggactggatatgcacagtgttgagcgacttcaagacctggcttaaagcaaagctcctaccgcgcatg

SEQ ID NO: 108681 - DNA, 75 bp, Artificial Sequence
  Synthetic
cagtatctttatggcctgtcaccagccataactaggtacatagtcaaatgggagtgggtgatcctcctgttcctg

SEQ ID NO: 108682 - DNA, 75 bp, Artificial Sequence
  Synthetic
taaagcaaaactcctaccgcgcatgccaggagtccctttcttgtcgtgccagcgtgggtacaagggcgtctggcg

SEQ ID NO: 108683 - DNA, 75 bp, Artificial Sequence
  Synthetic
taaagcaaatctcctaccgcgcatgccaggagtccctttcttgtcgtgccagcgtgggtacaagggcgtctggcg

SEQ ID NO: 108684 - DNA, 75 bp, Artificial Sequence
  Synthetic
taaagcaaacctcctaccgcgcatgccaggagtccctttcttgtcgtgccagcgtgggtacaagggcgtctggcg

SEQ ID NO: 108685 - DNA, 75 bp, Artificial Sequence
  Synthetic
taaagcaaagctcctaccgcgcatgccaggagtccctttcttgtcgtgccagcgtgggtacaagggcgtctggcg

SEQ ID NO: 108686 - DNA, 75 bp, Artificial Sequence
  Synthetic
tagtagactacccttaaagattgtggcactatccatgcactgtgaattttaccatctttaaggtgcggatgtatg

SEQ ID NO: 108687 - DNA, 75 bp, Artificial Sequence
  Synthetic
tagtagactacccttatagattgtggcactatccatgcactgtgaattttaccatctttaaggtgcggatgtatg

SEQ ID NO: 108688 - DNA, 75 bp, Artificial Sequence
  Synthetic
tagtagactacccttacagattgtggcactatccatgcactgtgaattttaccatctttaaggtgcggatgtatg

SEQ ID NO: 108689 - DNA, 75 bp, Artificial Sequence
  Synthetic
tagtagactacccttagagattgtggcactatccatgcactgtgaattttaccatctttaaggtgcggatgtatg

SEQ ID NO: 108690 - DNA, 75 bp, Artificial Sequence
  Synthetic
cctatgacgtcataatgtgcgacgaatgccattccgtggactccacaacgatccttggcattggcactgttcttg

SEQ ID NO: 108691 - DNA, 75 bp, Artificial Sequence
  Synthetic
gcgtggctagctccaacagctttgcgtggttcattctcttcttcatagcggcctggcacttcaagggccggttgg

SEQ ID NO: 108692 - DNA, 75 bp, Artificial Sequence
  Synthetic
aacacctggcatggaacgttccccatcaacgcgtacaccacgggccccagcacgccttccccggcgcccaactac

SEQ ID NO: 108693 - DNA, 75 bp, Artificial Sequence
  Synthetic
tggccaagagggcgagatccccttttatgggaaagccatccccttggcttatattaaggggggtaggcatttgat

SEQ ID NO: 108694 - DNA, 75 bp, Artificial Sequence
  Synthetic
acaggtcggcttggtgttgctagcaatcctatccatcttcaccctcagcccagcttataaatccatgataagtcg

SEQ ID NO: 108695 - DNA, 75 bp, Artificial Sequence
  Synthetic
gcccttgccaggttccttctcccgagttcttcacagaggtggacggggtgcggctgcacaggtacgctccggtat

SEQ ID NO: 108696 - DNA, 75 bp, Artificial Sequence
  Synthetic
tggccctgttgtcctgcatcaccgttccggtctctgctgcccaggtgaagaataccagtagcagctacatggtga

SEQ ID NO: 108697 - DNA, 75 bp, Artificial Sequence
  Synthetic
caggatacccttggcccctgtatgggaatgagggcctcgggtgggcaggatggctcctgtccccccggggctctc

SEQ ID NO: 108698 - DNA, 75 bp, Artificial Sequence
  Synthetic
ataccaacccaaggagatgtcgtggttgtcgccaccgacgctctcatgaccgggtacactggagacttcgactct

SEQ ID NO: 108699 - DNA, 75 bp, Artificial Sequence
  Synthetic
tgggccatggttgtgttctgcccgggtgtggtgtttgaagtcaccaagtggttgttggcgctcctaggacccgcc

SEQ ID NO: 108700 - DNA, 75 bp, Artificial Sequence
  Synthetic
gctaacttccatgctgaccgatcctgcccacatcaccgcagaagcggctagacgcaggctaggtagagggtcccc

SEQ ID NO: 108701 - DNA, 75 bp, Artificial Sequence
  Synthetic
gtgttgggtgccagtctcgccaaacatggctgtgcggcagctcggtgccctcacgcagggtctgcggacgcacat

SEQ ID NO: 108702 - DNA, 75 bp, Artificial Sequence
  Synthetic
gaagccagcggcgcgggaggacgggtagggggaggctaggcacctataggtatgtctcccagggtgagcggccat

SEQ ID NO: 108703 - DNA, 75 bp, Artificial Sequence
  Synthetic
ctttctgtaggggtaggcatctacctgctccccaaccgatgaacggggagctaaacactccaggccaataggcca

SEQ ID NO: 108704 - DNA, 75 bp, Artificial Sequence
  Synthetic
acgtccaaatggcgctcatcgcttgtggcagatggacggggacctacatctatgaccacctgtctcctatgtcaa

SEQ ID NO: 108705 - DNA, 75 bp, Artificial Sequence
  Synthetic
gtcgggttaatggcgctgactctgtcaccatattacaagcgctatatcagctggtgcttatggtggcttcagtat

SEQ ID NO: 108706 - DNA, 75 bp, Artificial Sequence
  Synthetic
gccaatctactgtggaggcagcagatgggcgggaacatcacccgtgtggagtcagagaacaaggtagtcattttg

SEQ ID NO: 108707 - DNA, 75 bp, Artificial Sequence
  Synthetic
attatatcaatctttactcttaccccagcctacaagactctcctgagccgttcagtgtggtggttgtcctacctg

SEQ ID NO: 108708 - DNA, 75 bp, Artificial Sequence
  Synthetic
ctttaacacccctggtttgcccgtgtgccaagaccacctggaattctgggaggcagtctttaccggcctcacgca

SEQ ID NO: 108709 - DNA, 75 bp, Artificial Sequence
  Synthetic
cagtaccactggtttgtgcaagaatgcaattgctccatctaccctggcaccatcactggacaccgcatggcatgg

SEQ ID NO: 108710 - DNA, 75 bp, Artificial Sequence
  Synthetic
ggcctgtggggacattttacacggtcttcccgtctccgcacgacttggtcgtgaggtcctactaggcccagctga

SEQ ID NO: 108711 - DNA, 75 bp, Artificial Sequence
  Synthetic
tatgggcccggccggattacaacccccctctgttggagtcctggaaaaagccggattacactcctcccctagtaa

SEQ ID NO: 108712 - DNA, 75 bp, Artificial Sequence
  Synthetic
tatgggcccggccggattacaacccccctctgttggagtcctggaaaatgccggattacactcctcccctagtaa

SEQ ID NO: 108713 - DNA, 75 bp, Artificial Sequence
  Synthetic
tatgggcccggccggattacaacccccctctgttggagtcctggaaaacgccggattacactcctcccctagtaa

SEQ ID NO: 108714 - DNA, 75 bp, Artificial Sequence
  Synthetic
tatgggcccggccggattacaacccccctctgttggagtcctggaaaaggccggattacactcctcccctagtaa

SEQ ID NO: 108715 - DNA, 75 bp, Artificial Sequence
  Synthetic
gacatcgttagcggggctcactggggcgtcatgttcggcctggcctacttctctatgcagggagcgtgggcgaag

SEQ ID NO: 108716 - DNA, 75 bp, Artificial Sequence
  Synthetic
ccaccctcttgggacacaatgtggaaatgtctaattaggctcaaaccaaccttggtcggtcccacccccctgttg

SEQ ID NO: 108717 - DNA, 75 bp, Artificial Sequence
  Synthetic
ggcccctcccataccacctccacggaggaagaggacagttgtcctgactgagtccaccgtgtcgtctgctctggc

SEQ ID NO: 108718 - DNA, 75 bp, Artificial Sequence
  Synthetic
cgcgacaaaaatgagcatgctggagaagtccaggtcttgtcatctgtcacccagtccttcctaggcacatccatc

SEQ ID NO: 108719 - DNA, 75 bp, Artificial Sequence
  Synthetic
catgggtcctcgcagggggagtgctggcagctgtcgcggcctatttccttgcaacaggctgctttgttgtcatag

SEQ ID NO: 108720 - DNA, 75 bp, Artificial Sequence
  Synthetic
tctcgcggccttgttctacaccaaccgctttaactcgtcagggtgtccagggcgcctgtccgcctgccgcaacat

SEQ ID NO: 108721 - DNA, 75 bp, Artificial Sequence
  Synthetic
ctcccagtttccgcgaggctaggcagggaagttctgcttggccccgccgatggctacacctcgaaggggtggaag

SEQ ID NO: 108722 - DNA, 75 bp, Artificial Sequence
  Synthetic
tggtgggctggcctagccctcccgggacaaaatccctggagccatgcacctgtggggccgcagacctctaccttg

SEQ ID NO: 108723 - DNA, 75 bp, Artificial Sequence
  Synthetic
gcgtgatgttcggcctagcctacttctccatgcaaggggcgtgggccaaggtcgtcgtcatcctcctgttaactg

SEQ ID NO: 108724 - DNA, 75 bp, Artificial Sequence
  Synthetic
cattgaggaagcccaaaaaatagcagatatgctcaagtccaaaatccaaagtgttttacaacaagccacgaagca

SEQ ID NO: 108725 - DNA, 75 bp, Artificial Sequence
  Synthetic
tgtggcgtagtccccgcgaggtctgtgtgtggcccagtgtactgtttcacccccagcccggtggtagtgggcacg

SEQ ID NO: 108726 - DNA, 75 bp, Artificial Sequence
  Synthetic
agagcaaacttcccatcaacgcgttgagcaactccttgctgcgacatcacaatatggtctacgctacgacctccc

SEQ ID NO: 108727 - DNA, 75 bp, Artificial Sequence
  Synthetic
cgggccagtgctatgcccaaggggtcatgctgtcgggatcttccgcgcagccgtgtgttccagaggggtagccaa

SEQ ID NO: 108728 - DNA, 75 bp, Artificial Sequence
  Synthetic
actcatcaacaccaacggcagttggcacatcaatcgcactgccttgaactgcaatgattcattgaatacgggctt

SEQ ID NO: 108729 - DNA, 75 bp, Artificial Sequence
  Synthetic
ctggacaatcactaccgggacgtgcttcaggagattaaggcgaaggcgtccacagtgaaggccaggctactctca

SEQ ID NO: 108730 - DNA, 75 bp, Artificial Sequence
  Synthetic
gcgggtttgtcaaccttaccagggaatcctgccatagcatcaatgatggcattcagcgctgccctcaccagcccg

SEQ ID NO: 108731 - DNA, 75 bp, Artificial Sequence
  Synthetic
tgccgcaccagagctgatttcaacgccagcacggacttgttgtgccctacggattgttttaggaagcaccctgat

SEQ ID NO: 108732 - DNA, 75 bp, Artificial Sequence
  Synthetic
gtgggctacctccacgcgcctaccggtagcgggaagagcacaaaggtcccggccgcgtatgcagcccaggggtat

SEQ ID NO: 108733 - DNA, 75 bp, Artificial Sequence
  Synthetic
aggctagagtatgaggagaatgtcaccaacgacgaggacatgaggccctattgttggcattatccacccaaacaa

SEQ ID NO: 108734 - DNA, 75 bp, Artificial Sequence
  Synthetic
ccaacgacgaggacatgaggccctattgttggcattatccacccaaacaatgtggcatcgttcctgctcagaccg

SEQ ID NO: 108735 - DNA, 75 bp, Artificial Sequence
  Synthetic
tggtgggggcagctgtgggaagcataggcctcggcaagatactggtggatgtgttggcggggtacggcgctggta

SEQ ID NO: 108736 - DNA, 75 bp, Artificial Sequence
  Synthetic
caccaacggcagttggcacatcaacagcacggccttaaactgcaatgagagccttaccaccggctggttagcagg

SEQ ID NO: 108737 - DNA, 75 bp, Artificial Sequence
  Synthetic
acatcaactccgtgtggaaggacctcctggaagacaatgtaacaccaatagacactaccatcatggccaaaaaag

SEQ ID NO: 108738 - DNA, 75 bp, Artificial Sequence
  Synthetic
acatcaactccgtgtggaaggacctcctggaagacaatgtaacaccaatagacactaccatcatggccaaaaatg

SEQ ID NO: 108739 - DNA, 75 bp, Artificial Sequence
  Synthetic
acatcaactccgtgtggaaggacctcctggaagacaatgtaacaccaatagacactaccatcatggccaaaaacg

SEQ ID NO: 108740 - DNA, 75 bp, Artificial Sequence
  Synthetic
acatcaactccgtgtggaaggacctcctggaagacaatgtaacaccaatagacactaccatcatggccaaaaagg

SEQ ID NO: 108741 - DNA, 75 bp, Artificial Sequence
  Synthetic
acatcaactccgtgtggaaggacctcctggaagacaatgtaacaccaatagacactaccatcatggccaataaag

SEQ ID NO: 108742 - DNA, 75 bp, Artificial Sequence
  Synthetic
acatcaactccgtgtggaaggacctcctggaagacaatgtaacaccaatagacactaccatcatggccaataatg

SEQ ID NO: 108743 - DNA, 75 bp, Artificial Sequence
  Synthetic
acatcaactccgtgtggaaggacctcctggaagacaatgtaacaccaatagacactaccatcatggccaataacg

SEQ ID NO: 108744 - DNA, 75 bp, Artificial Sequence
  Synthetic
acatcaactccgtgtggaaggacctcctggaagacaatgtaacaccaatagacactaccatcatggccaataagg

SEQ ID NO: 108745 - DNA, 75 bp, Artificial Sequence
  Synthetic
acatcaactccgtgtggaaggacctcctggaagacaatgtaacaccaatagacactaccatcatggccaacaaag

SEQ ID NO: 108746 - DNA, 75 bp, Artificial Sequence
  Synthetic
acatcaactccgtgtggaaggacctcctggaagacaatgtaacaccaatagacactaccatcatggccaacaatg

SEQ ID NO: 108747 - DNA, 75 bp, Artificial Sequence
  Synthetic
acatcaactccgtgtggaaggacctcctggaagacaatgtaacaccaatagacactaccatcatggccaacaacg

SEQ ID NO: 108748 - DNA, 75 bp, Artificial Sequence
  Synthetic
acatcaactccgtgtggaaggacctcctggaagacaatgtaacaccaatagacactaccatcatggccaacaagg

SEQ ID NO: 108749 - DNA, 75 bp, Artificial Sequence
  Synthetic
acatcaactccgtgtggaaggacctcctggaagacaatgtaacaccaatagacactaccatcatggccaagaaag

SEQ ID NO: 108750 - DNA, 75 bp, Artificial Sequence
  Synthetic
acatcaactccgtgtggaaggacctcctggaagacaatgtaacaccaatagacactaccatcatggccaagaatg

SEQ ID NO: 108751 - DNA, 75 bp, Artificial Sequence
  Synthetic
acatcaactccgtgtggaaggacctcctggaagacaatgtaacaccaatagacactaccatcatggccaagaacg

SEQ ID NO: 108752 - DNA, 75 bp, Artificial Sequence
  Synthetic
acatcaactccgtgtggaaggacctcctggaagacaatgtaacaccaatagacactaccatcatggccaagaagg

SEQ ID NO: 108753 - DNA, 75 bp, Artificial Sequence
  Synthetic
ggacagtgaccactggggaccccatcacctactccacgtacggcaaattcctcgcagacggaggcatttcaccag

SEQ ID NO: 108754 - DNA, 75 bp, Artificial Sequence
  Synthetic
gatcatgtcgggtgagaagcctagcgtggaggatgttgtcaacctgctgccggcgatcttgtcaccaggcgcctt

SEQ ID NO: 108755 - DNA, 75 bp, Artificial Sequence
  Synthetic
tgtgttcttactgaacagcacgcggcctccgcggggagcttggtttggatgcacatggatgaatggcaccgggtt

SEQ ID NO: 108756 - DNA, 75 bp, Artificial Sequence
  Synthetic
agacgtggtctccacgcttcctcaggccgtgatgggatcctcgtacgggtttcagtactcgccggggcaacgggt

SEQ ID NO: 108757 - DNA, 75 bp, Artificial Sequence
  Synthetic
tgacgtggtctccacgcttcctcaggccgtgatgggatcctcgtacgggtttcagtactcgccggggcaacgggt

SEQ ID NO: 108758 - DNA, 75 bp, Artificial Sequence
  Synthetic
cgacgtggtctccacgcttcctcaggccgtgatgggatcctcgtacgggtttcagtactcgccggggcaacgggt

SEQ ID NO: 108759 - DNA, 75 bp, Artificial Sequence
  Synthetic
ggacgtggtctccacgcttcctcaggccgtgatgggatcctcgtacgggtttcagtactcgccggggcaacgggt

SEQ ID NO: 108760 - DNA, 75 bp, Artificial Sequence
  Synthetic
caagctgttggtcctggccacggcgaccccccccgggtcggtgacaactccacatccaaacatagaagaagtagc

SEQ ID NO: 108761 - DNA, 75 bp, Artificial Sequence
  Synthetic
gggaaccatgttgcccctacccactacgtggcggagtccgacgcctcacagcgcgtaactcagttgctaggctcc

SEQ ID NO: 108762 - DNA, 75 bp, Artificial Sequence
  Synthetic
gcgtggagtcagagaataaggtagtaattctggactctttcgacccgcttcgagcggaggaggatgagagggaag

SEQ ID NO: 108763 - DNA, 75 bp, Artificial Sequence
  Synthetic
gtcgaggaatccatctatcaatgttgtgacttagcccccgaggcccgcaaggccataaagtcgctcaccgagcgg

SEQ ID NO: 108764 - DNA, 75 bp, Artificial Sequence
  Synthetic
tcttagcggacgccagagtctgcgcctgcttgtggatgctcatcttgttgggccaggccgaagcagcattggaga

SEQ ID NO: 108765 - DNA, 75 bp, Artificial Sequence
  Synthetic
ggccataaagtcgctcaccgagcggctgtacatcgggggccccctaaccaattcaaaagggcagaactgcggcta

SEQ ID NO: 108766 - DNA, 75 bp, Artificial Sequence
  Synthetic
ggccataaagtcgctcaccgagcggctgtacatcgggggcccccttaccaattcaaaagggcagaactgcggcta

SEQ ID NO: 108767 - DNA, 75 bp, Artificial Sequence
  Synthetic
ggccataaagtcgctcaccgagcggctgtacatcgggggccccctcaccaattcaaaagggcagaactgcggcta

SEQ ID NO: 108768 - DNA, 75 bp, Artificial Sequence
  Synthetic
ggccataaagtcgctcaccgagcggctgtacatcgggggccccctgaccaattcaaaagggcagaactgcggcta

SEQ ID NO: 108769 - DNA, 75 bp, Artificial Sequence
  Synthetic
ccatcttcaaaatacggatgttcatagggggagtcgagcataggctcgaagcggcgtgcaattttacccgtgggg

SEQ ID NO: 108770 - DNA, 75 bp, Artificial Sequence
  Synthetic
tttgcaccatccttactgactttaaaaattggctgtcctgcaaattgttaccaaaattgccgggcctccccttcg

SEQ ID NO: 108771 - DNA, 75 bp, Artificial Sequence
  Synthetic
tgcgacgaattggctgcggccctgcggggcatgggcctcaacgcagtcgcatactatcggggtctcgacgtctcc

SEQ ID NO: 108772 - DNA, 75 bp, Artificial Sequence
  Synthetic
ccccctgaccacctattgcctcactggcctatggcccttctgcctactgctcatggcactgccccggcaggctta

SEQ ID NO: 108773 - DNA, 75 bp, Artificial Sequence
  Synthetic
taccttgcacctactctgacatgccggctttatctaccggtcttttacacctccaccaaaacattgtggacgtgc

SEQ ID NO: 108774 - DNA, 75 bp, Artificial Sequence
  Synthetic
tcacacaggtagttgacttcagccttgaccctacctttactataaccacccaaactgtgccccaagactcagtct

SEQ ID NO: 108775 - DNA, 75 bp, Artificial Sequence
  Synthetic
taccatgaaaatcacaggccccaagacttgcatggacacctggcagggggccttccttatcaactgttacacggt

SEQ ID NO: 108776 - DNA, 75 bp, Artificial Sequence
  Synthetic
ctcctgaccaggcctccgacgccggcgacacaggatccgacgttgagtcgtactcctccatgcccccccttgagg

SEQ ID NO: 108777 - DNA, 75 bp, Artificial Sequence
  Synthetic
tgaccctgggggaagccatgattcaggagtgggtaccacccatgcaggtgcgcggcggccgcgatggcatcgcgt

SEQ ID NO: 108778 - DNA, 75 bp, Artificial Sequence
  Synthetic
tctctgtgagtgctacgattctggagcagcctggtacgagctgaccccaagagacgttaccgtcaagctcagagc

SEQ ID NO: 108779 - DNA, 75 bp, Artificial Sequence
  Synthetic
tatgtgacaggactgaccacagacaacctgaaggtaccttgccaagtgcctatgccagagttcttttcttgggtg

SEQ ID NO: 108780 - DNA, 75 bp, Artificial Sequence
  Synthetic
tgccagccttgtccaccggcctcatccacctccaccagaacatcgtggacgtgcagtacttgtacggggtggggt

SEQ ID NO: 108781 - DNA, 75 bp, Artificial Sequence
  Synthetic
tgctcttccttctcctggcggacgcgcgcttctgtgcctgcttgtggatgatgctgctgatagctcaggctgagg

SEQ ID NO: 108782 - DNA, 75 bp, Artificial Sequence
  Synthetic
acacactccagtcaactcctggctaggcaacatcattatgtttgcccccactctatgggcgaggactattctaat

SEQ ID NO: 108783 - DNA, 75 bp, Artificial Sequence
  Synthetic
acacactccagtcaactcctggctaggcaacatcattatgtttgcccccactctatgggcgaggactattcttat

SEQ ID NO: 108784 - DNA, 75 bp, Artificial Sequence
  Synthetic
acacactccagtcaactcctggctaggcaacatcattatgtttgcccccactctatgggcgaggactattctcat

SEQ ID NO: 108785 - DNA, 75 bp, Artificial Sequence
  Synthetic
acacactccagtcaactcctggctaggcaacatcattatgtttgcccccactctatgggcgaggactattctgat

SEQ ID NO: 108786 - DNA, 75 bp, Artificial Sequence
  Synthetic
acacactcctgtcaactcctggctaggcaacatcattatgtttgcccccactctatgggcgaggactattctaat

SEQ ID NO: 108787 - DNA, 75 bp, Artificial Sequence
  Synthetic
acacactcctgtcaactcctggctaggcaacatcattatgtttgcccccactctatgggcgaggactattcttat

SEQ ID NO: 108788 - DNA, 75 bp, Artificial Sequence
  Synthetic
acacactcctgtcaactcctggctaggcaacatcattatgtttgcccccactctatgggcgaggactattctcat

SEQ ID NO: 108789 - DNA, 75 bp, Artificial Sequence
  Synthetic
acacactcctgtcaactcctggctaggcaacatcattatgtttgcccccactctatgggcgaggactattctgat

SEQ ID NO: 108790 - DNA, 75 bp, Artificial Sequence
  Synthetic
acacactcccgtcaactcctggctaggcaacatcattatgtttgcccccactctatgggcgaggactattctaat

SEQ ID NO: 108791 - DNA, 75 bp, Artificial Sequence
  Synthetic
acacactcccgtcaactcctggctaggcaacatcattatgtttgcccccactctatgggcgaggactattcttat

SEQ ID NO: 108792 - DNA, 75 bp, Artificial Sequence
  Synthetic
acacactcccgtcaactcctggctaggcaacatcattatgtttgcccccactctatgggcgaggactattctcat

SEQ ID NO: 108793 - DNA, 75 bp, Artificial Sequence
  Synthetic
acacactcccgtcaactcctggctaggcaacatcattatgtttgcccccactctatgggcgaggactattctgat

SEQ ID NO: 108794 - DNA, 75 bp, Artificial Sequence
  Synthetic
acacactccggtcaactcctggctaggcaacatcattatgtttgcccccactctatgggcgaggactattctaat

SEQ ID NO: 108795 - DNA, 75 bp, Artificial Sequence
  Synthetic
acacactccggtcaactcctggctaggcaacatcattatgtttgcccccactctatgggcgaggactattcttat

SEQ ID NO: 108796 - DNA, 75 bp, Artificial Sequence
  Synthetic
acacactccggtcaactcctggctaggcaacatcattatgtttgcccccactctatgggcgaggactattctcat

SEQ ID NO: 108797 - DNA, 75 bp, Artificial Sequence
  Synthetic
acacactccggtcaactcctggctaggcaacatcattatgtttgcccccactctatgggcgaggactattctgat

SEQ ID NO: 108798 - DNA, 75 bp, Artificial Sequence
  Synthetic
tcacactccagtcaactcctggctaggcaacatcattatgtttgcccccactctatgggcgaggactattctaat

SEQ ID NO: 108799 - DNA, 75 bp, Artificial Sequence
  Synthetic
tcacactccagtcaactcctggctaggcaacatcattatgtttgcccccactctatgggcgaggactattcttat

SEQ ID NO: 108800 - DNA, 75 bp, Artificial Sequence
  Synthetic
tcacactccagtcaactcctggctaggcaacatcattatgtttgcccccactctatgggcgaggactattctcat

SEQ ID NO: 108801 - DNA, 75 bp, Artificial Sequence
  Synthetic
tcacactccagtcaactcctggctaggcaacatcattatgtttgcccccactctatgggcgaggactattctgat

SEQ ID NO: 108802 - DNA, 75 bp, Artificial Sequence
  Synthetic
tcacactcctgtcaactcctggctaggcaacatcattatgtttgcccccactctatgggcgaggactattctaat

SEQ ID NO: 108803 - DNA, 75 bp, Artificial Sequence
  Synthetic
tcacactcctgtcaactcctggctaggcaacatcattatgtttgcccccactctatgggcgaggactattcttat

SEQ ID NO: 108804 - DNA, 75 bp, Artificial Sequence
  Synthetic
tcacactcctgtcaactcctggctaggcaacatcattatgtttgcccccactctatgggcgaggactattctcat

SEQ ID NO: 108805 - DNA, 75 bp, Artificial Sequence
  Synthetic
tcacactcctgtcaactcctggctaggcaacatcattatgtttgcccccactctatgggcgaggactattctgat

SEQ ID NO: 108806 - DNA, 75 bp, Artificial Sequence
  Synthetic
tcacactcccgtcaactcctggctaggcaacatcattatgtttgcccccactctatgggcgaggactattctaat

SEQ ID NO: 108807 - DNA, 75 bp, Artificial Sequence
  Synthetic
tcacactcccgtcaactcctggctaggcaacatcattatgtttgcccccactctatgggcgaggactattcttat

SEQ ID NO: 108808 - DNA, 75 bp, Artificial Sequence
  Synthetic
tcacactcccgtcaactcctggctaggcaacatcattatgtttgcccccactctatgggcgaggactattctcat

SEQ ID NO: 108809 - DNA, 75 bp, Artificial Sequence
  Synthetic
tcacactcccgtcaactcctggctaggcaacatcattatgtttgcccccactctatgggcgaggactattctgat

SEQ ID NO: 108810 - DNA, 75 bp, Artificial Sequence
  Synthetic
tcacactccggtcaactcctggctaggcaacatcattatgtttgcccccactctatgggcgaggactattctaat

SEQ ID NO: 108811 - DNA, 75 bp, Artificial Sequence
  Synthetic
tcacactccggtcaactcctggctaggcaacatcattatgtttgcccccactctatgggcgaggactattcttat

SEQ ID NO: 108812 - DNA, 75 bp, Artificial Sequence
  Synthetic
tcacactccggtcaactcctggctaggcaacatcattatgtttgcccccactctatgggcgaggactattctcat

SEQ ID NO: 108813 - DNA, 75 bp, Artificial Sequence
  Synthetic
tcacactccggtcaactcctggctaggcaacatcattatgtttgcccccactctatgggcgaggactattctgat

SEQ ID NO: 108814 - DNA, 75 bp, Artificial Sequence
  Synthetic
ccacactccagtcaactcctggctaggcaacatcattatgtttgcccccactctatgggcgaggactattctaat

SEQ ID NO: 108815 - DNA, 75 bp, Artificial Sequence
  Synthetic
ccacactccagtcaactcctggctaggcaacatcattatgtttgcccccactctatgggcgaggactattcttat

SEQ ID NO: 108816 - DNA, 75 bp, Artificial Sequence
  Synthetic
ccacactccagtcaactcctggctaggcaacatcattatgtttgcccccactctatgggcgaggactattctcat

SEQ ID NO: 108817 - DNA, 75 bp, Artificial Sequence
  Synthetic
ccacactccagtcaactcctggctaggcaacatcattatgtttgcccccactctatgggcgaggactattctgat

SEQ ID NO: 108818 - DNA, 75 bp, Artificial Sequence
  Synthetic
ccacactcctgtcaactcctggctaggcaacatcattatgtttgcccccactctatgggcgaggactattctaat

SEQ ID NO: 108819 - DNA, 75 bp, Artificial Sequence
  Synthetic
ccacactcctgtcaactcctggctaggcaacatcattatgtttgcccccactctatgggcgaggactattcttat

SEQ ID NO: 108820 - DNA, 75 bp, Artificial Sequence
  Synthetic
ccacactcctgtcaactcctggctaggcaacatcattatgtttgcccccactctatgggcgaggactattctcat

SEQ ID NO: 108821 - DNA, 75 bp, Artificial Sequence
  Synthetic
ccacactcctgtcaactcctggctaggcaacatcattatgtttgcccccactctatgggcgaggactattctgat

SEQ ID NO: 108822 - DNA, 75 bp, Artificial Sequence
  Synthetic
ccacactcccgtcaactcctggctaggcaacatcattatgtttgcccccactctatgggcgaggactattctaat

SEQ ID NO: 108823 - DNA, 75 bp, Artificial Sequence
  Synthetic
ccacactcccgtcaactcctggctaggcaacatcattatgtttgcccccactctatgggcgaggactattcttat

SEQ ID NO: 108824 - DNA, 75 bp, Artificial Sequence
  Synthetic
ccacactcccgtcaactcctggctaggcaacatcattatgtttgcccccactctatgggcgaggactattctcat

SEQ ID NO: 108825 - DNA, 75 bp, Artificial Sequence
  Synthetic
ccacactcccgtcaactcctggctaggcaacatcattatgtttgcccccactctatgggcgaggactattctgat

SEQ ID NO: 108826 - DNA, 75 bp, Artificial Sequence
  Synthetic
ccacactccggtcaactcctggctaggcaacatcattatgtttgcccccactctatgggcgaggactattctaat

SEQ ID NO: 108827 - DNA, 75 bp, Artificial Sequence
  Synthetic
ccacactccggtcaactcctggctaggcaacatcattatgtttgcccccactctatgggcgaggactattcttat

SEQ ID NO: 108828 - DNA, 75 bp, Artificial Sequence
  Synthetic
ccacactccggtcaactcctggctaggcaacatcattatgtttgcccccactctatgggcgaggactattctcat

SEQ ID NO: 108829 - DNA, 75 bp, Artificial Sequence
  Synthetic
ccacactccggtcaactcctggctaggcaacatcattatgtttgcccccactctatgggcgaggactattctgat

SEQ ID NO: 108830 - DNA, 75 bp, Artificial Sequence
  Synthetic
gcacactccagtcaactcctggctaggcaacatcattatgtttgcccccactctatgggcgaggactattctaat

SEQ ID NO: 108831 - DNA, 75 bp, Artificial Sequence
  Synthetic
gcacactccagtcaactcctggctaggcaacatcattatgtttgcccccactctatgggcgaggactattcttat

SEQ ID NO: 108832 - DNA, 75 bp, Artificial Sequence
  Synthetic
gcacactccagtcaactcctggctaggcaacatcattatgtttgcccccactctatgggcgaggactattctcat

SEQ ID NO: 108833 - DNA, 75 bp, Artificial Sequence
  Synthetic
gcacactccagtcaactcctggctaggcaacatcattatgtttgcccccactctatgggcgaggactattctgat

SEQ ID NO: 108834 - DNA, 75 bp, Artificial Sequence
  Synthetic
gcacactcctgtcaactcctggctaggcaacatcattatgtttgcccccactctatgggcgaggactattctaat

SEQ ID NO: 108835 - DNA, 75 bp, Artificial Sequence
  Synthetic
gcacactcctgtcaactcctggctaggcaacatcattatgtttgcccccactctatgggcgaggactattcttat

SEQ ID NO: 108836 - DNA, 75 bp, Artificial Sequence
  Synthetic
gcacactcctgtcaactcctggctaggcaacatcattatgtttgcccccactctatgggcgaggactattctcat

SEQ ID NO: 108837 - DNA, 75 bp, Artificial Sequence
  Synthetic
gcacactcctgtcaactcctggctaggcaacatcattatgtttgcccccactctatgggcgaggactattctgat

SEQ ID NO: 108838 - DNA, 75 bp, Artificial Sequence
  Synthetic
gcacactcccgtcaactcctggctaggcaacatcattatgtttgcccccactctatgggcgaggactattctaat

SEQ ID NO: 108839 - DNA, 75 bp, Artificial Sequence
  Synthetic
gcacactcccgtcaactcctggctaggcaacatcattatgtttgcccccactctatgggcgaggactattcttat

SEQ ID NO: 108840 - DNA, 75 bp, Artificial Sequence
  Synthetic
gcacactcccgtcaactcctggctaggcaacatcattatgtttgcccccactctatgggcgaggactattctcat

SEQ ID NO: 108841 - DNA, 75 bp, Artificial Sequence
  Synthetic
gcacactcccgtcaactcctggctaggcaacatcattatgtttgcccccactctatgggcgaggactattctgat

SEQ ID NO: 108842 - DNA, 75 bp, Artificial Sequence
  Synthetic
gcacactccggtcaactcctggctaggcaacatcattatgtttgcccccactctatgggcgaggactattctaat

SEQ ID NO: 108843 - DNA, 75 bp, Artificial Sequence
  Synthetic
gcacactccggtcaactcctggctaggcaacatcattatgtttgcccccactctatgggcgaggactattcttat

SEQ ID NO: 108844 - DNA, 75 bp, Artificial Sequence
  Synthetic
gcacactccggtcaactcctggctaggcaacatcattatgtttgcccccactctatgggcgaggactattctcat

SEQ ID NO: 108845 - DNA, 75 bp, Artificial Sequence
  Synthetic
gcacactccggtcaactcctggctaggcaacatcattatgtttgcccccactctatgggcgaggactattctgat

SEQ ID NO: 108846 - DNA, 75 bp, Artificial Sequence
  Synthetic
tgtgccgtacttcgtcagagctcacgctctgataagggtatgcgctttggtgaagcagctcgcggggggtaggta

SEQ ID NO: 108847 - DNA, 75 bp, Artificial Sequence
  Synthetic
caaacaaaacaggcgggagacaactttgcgtacctcgtggcttatcaagccacggtatgcgctagagctaaggct

SEQ ID NO: 108848 - DNA, 75 bp, Artificial Sequence
  Synthetic
agctcccatgcgagcctgagccagacaccgaggtgttggcctctatgcttactgacccatcccacataacggcgg

SEQ ID NO: 108849 - DNA, 75 bp, Artificial Sequence
  Synthetic
tcctggcacttccccaacaggcctatgccctcgatacaacggaacaggggcaaatgggcttggtccttctagtgg

SEQ ID NO: 108850 - DNA, 75 bp, Artificial Sequence
  Synthetic
ccactgactgtttccgcaagcatccggaagctacatactcccgatgtggctccggtccttggatcacgcccaggt

SEQ ID NO: 108851 - DNA, 75 bp, Artificial Sequence
  Synthetic
acgaagtgactatgacacatcctgtgaccaagtacatagccacatgcatgcaggcggatttggagatcatgacga

SEQ ID NO: 108852 - DNA, 75 bp, Artificial Sequence
  Synthetic
cgaggcggccgtgacggcatcatatgggccgccgccatactctgtccgggtgtagtgtttgacataaccaagtgg

SEQ ID NO: 108853 - DNA, 75 bp, Artificial Sequence
  Synthetic
ccatgggagaaacatggacacagacatggtggacgccaacttgttcatgggggcaagcgtggttcgagctgaatc

SEQ ID NO: 108854 - DNA, 75 bp, Artificial Sequence
  Synthetic
tgagtgggtaccgcctttgcaggcacgaggcggccgtgacggcatcatatgggccgccgccatactctgtccggg

SEQ ID NO: 108855 - DNA, 75 bp, Artificial Sequence
  Synthetic
ggaactgggctaaggtcttgattgtgatgctactttttgccggcgtcgatgggactacctacacgacgggggggg

SEQ ID NO: 108856 - DNA, 75 bp, Artificial Sequence
  Synthetic
caccatattacaagcgccatatcagctggtgcttgtggtggcttcagtattttctgaccagagcagaagcgcaac

SEQ ID NO: 108857 - DNA, 75 bp, Artificial Sequence
  Synthetic
atccgttatcgccccagataaagaggtcctgtatgaagcttttgacgagatggaggaatgcgcttctagggccgc

SEQ ID NO: 108858 - DNA, 75 bp, Artificial Sequence
  Synthetic
taagacatctctcgggtggcaagtacgtccagatgatgctgctaacccttggtagatggactggcacctacattt

SEQ ID NO: 108859 - DNA, 75 bp, Artificial Sequence
  Synthetic
aggttcccaccagcgctgccagcctgggcagcgccggagtacaacccacctctcgtggaaaactggaagaagtca

SEQ ID NO: 108860 - DNA, 75 bp, Artificial Sequence
  Synthetic
cgtccagatgatgctgctaacccttggtagatggactggcacctacatttatgaccatctcactccactgcggga

SEQ ID NO: 108861 - DNA, 75 bp, Artificial Sequence
  Synthetic
atctacctgcttcccaaccgatagttgggaagctatacactccaggccaataggccattctgttatttttttttt

SEQ ID NO: 108862 - DNA, 75 bp, Artificial Sequence
  Synthetic
atctacctgcttcccaaccgatagttgggaagctatacactccaggccaataggccattctgttttttttttttt

SEQ ID NO: 108863 - DNA, 75 bp, Artificial Sequence
  Synthetic
atctacctgcttcccaaccgatagttgggaagctatacactccaggccaataggccattctgttctttttttttt

SEQ ID NO: 108864 - DNA, 75 bp, Artificial Sequence
  Synthetic
atctacctgcttcccaaccgatagttgggaagctatacactccaggccaataggccattctgttgtttttttttt

SEQ ID NO: 108865 - DNA, 75 bp, Artificial Sequence
  Synthetic
ctggaggcaccgagccagggcagtcagagctaagctcatcgcccaaggggggaaacacgctatatgcggtaagta

SEQ ID NO: 108866 - DNA, 75 bp, Artificial Sequence
  Synthetic
gttcaggcgtcatggcctaagcttgagcagttttgggccaagcacatgtggaacttcatcagcggcattcaatac

SEQ ID NO: 108867 - DNA, 75 bp, Artificial Sequence
  Synthetic
gcaatgtgggggaggtcctcaaagacctggctgacaaggctttcagccaaccttcccgccctactgactccggaa

SEQ ID NO: 108868 - DNA, 75 bp, Artificial Sequence
  Synthetic
cacgcggaacgctgatgtcatcccggctcggagacgcggggacaagcggggagcattgctctccccgagacccgt

SEQ ID NO: 108869 - DNA, 75 bp, Artificial Sequence
  Synthetic
tcctaaacatcatggggggatggctagcttctcagatcgcccccccccaagcggctactggctttgttgtcagtg

SEQ ID NO: 108870 - DNA, 75 bp, Artificial Sequence
  Synthetic
ttcgaccttgaaggggtcctcgggggggccggtgctctgccctaggggccacgtcgttgggctcttccgagcagc

SEQ ID NO: 108871 - DNA, 75 bp, Artificial Sequence
  Synthetic
aggggaacccggagatcctgatttggagcctgagccggtagaagacccgatcgttattactgatggtccggagga

SEQ ID NO: 108872 - DNA, 75 bp, Artificial Sequence
  Synthetic
caagatcatgtccggtgagagacctactacagaggaccttgtcaatttattacctgctattctttcccctggcgc

SEQ ID NO: 108873 - DNA, 75 bp, Artificial Sequence
  Synthetic
ccctgcaatccggaggaagaaaagttgccagttaaccccctcagcaactcactgatgcgctaccacaacaaggtt

SEQ ID NO: 108874 - DNA, 75 bp, Artificial Sequence
  Synthetic
cgacaggatgcaggtcttggacacacactatgaggctgtcttaaaggacattaagcttgctgcctcaaaggttag

SEQ ID NO: 108875 - DNA, 75 bp, Artificial Sequence
  Synthetic
agggggaatcacgtcgccccaacccactatgtgactgagtctgacgcgtccgcacgcgtgactcaactactcagt

SEQ ID NO: 108876 - DNA, 75 bp, Artificial Sequence
  Synthetic
ccatggaaaccactatgcggtccccggtctttacggacaactcgtcccctccggccgtaccgcagacattccaag

SEQ ID NO: 108877 - DNA, 75 bp, Artificial Sequence
  Synthetic
ccattctcggcatcggaacggtccttgatcaagcagagacagccggggtcagactaactgtgctggctacggcca

SEQ ID NO: 108878 - DNA, 75 bp, Artificial Sequence
  Synthetic
gggtctgttccattctcgcggacttcaagaactggctttccgccaagctgttcccgaagctgccgggcctcccct

SEQ ID NO: 108879 - DNA, 75 bp, Artificial Sequence
  Synthetic
caagtgtgggtcccccctctcaacgttcgggggggccgcgatgccatcatcctcctcatgtgcgcgatccaccca

SEQ ID NO: 108880 - DNA, 75 bp, Artificial Sequence
  Synthetic
gaagccagctcgcctcatcgtcttccctgacctcggcgtcagggtatgcgagaagatggccctttatgacattgc

SEQ ID NO: 108881 - DNA, 75 bp, Artificial Sequence
  Synthetic
gggcactatgaagatcgtgggcccaaagacctgcatgaacacctggcaggggaccttcccaatcaactgctacac

SEQ ID NO: 108882 - DNA, 75 bp, Artificial Sequence
  Synthetic
gggcatgggcttgaatgccgtggcatactatagagggttggacgtctccataataccagctcagggagatgtggt

SEQ ID NO: 108883 - DNA, 75 bp, Artificial Sequence
  Synthetic
gaacccatgggtttctcatatgacactcgctgttttgactctactgtcacagagcgggacattagaactgaggag

SEQ ID NO: 108884 - DNA, 75 bp, Artificial Sequence
  Synthetic
taattatgcaacggggaatcttcctggttgctctttctctatcttcctcttggcgcttctctcgtgcctgactgt

SEQ ID NO: 108885 - DNA, 75 bp, Artificial Sequence
  Synthetic
tcatatgtgacgggcctgactaccgacaacttgaaggtcccttgccagttgccagccccggagttcttctcgtgg

SEQ ID NO: 108886 - DNA, 75 bp, Artificial Sequence
  Synthetic
ctacacctcccggggtgcttaccctgtgtgaggaacgggaatcagtcacactgctgggtggccctcacccccacg

SEQ ID NO: 108887 - DNA, 75 bp, Artificial Sequence
  Synthetic
ggcaatcctgcggatacaggcgatgccgcgccagcggggtttttaccactagcatgggcaacaccataacgtgct

SEQ ID NO: 108888 - DNA, 75 bp, Artificial Sequence
  Synthetic
ctcaacaccgggttccttgccgcgctgttctacacacacaggttcaactcgtccggatgcccagagcgcatggcc

SEQ ID NO: 108889 - DNA, 75 bp, Artificial Sequence
  Synthetic
tgttctacacacacaggttcaactcgtccggatgcccagagcgcatggccagctgccgccccattgacaagttcg

SEQ ID NO: 108890 - DNA, 75 bp, Artificial Sequence
  Synthetic
gtccggatgcccagagcgcatggccagctgccgccccattgacaagttcgctcaggggtggggtcccatcactca

SEQ ID NO: 108891 - DNA, 75 bp, Artificial Sequence
  Synthetic
ggcagcggcaagagcactaaggtgccggctgcgtatgcagcccaagggtacaaggtactcgtcttgaacccgtct

SEQ ID NO: 108892 - DNA, 75 bp, Artificial Sequence
  Synthetic
ctcagctcccttgtgagcctgagccggacactgaggtgttggcctccatgcttactgacccatcccatattacgg

SEQ ID NO: 108893 - DNA, 75 bp, Artificial Sequence
  Synthetic
acctgtgtggtggtgcattcttggttggtcagatgttctctttccagccgcgacgccactggaccacgcaggact

SEQ ID NO: 108894 - DNA, 75 bp, Artificial Sequence
  Synthetic
tagtcatctcagagagtcagggcaccgaggaggatgagcggaacctgagagtcttcgcggaggctatgaccaggt

SEQ ID NO: 108895 - DNA, 75 bp, Artificial Sequence
  Synthetic
cacccatgggccgcactttgatgtggacatggtagatgctagtctcttcatggggggggatgtcactcggattga

SEQ ID NO: 108896 - DNA, 75 bp, Artificial Sequence
  Synthetic
cgcgtacctagtagcctaccaagctacggtgtgcgccagagccaaggcccctcccccgtcctgggacgccatgtg

SEQ ID NO: 108897 - DNA, 75 bp, Artificial Sequence
  Synthetic
catgagggtccctagcactctggtagacctactcactggagggcactggggcgtccttgtcgggttggcgtactt

SEQ ID NO: 108898 - DNA, 75 bp, Artificial Sequence
  Synthetic
catgagggtccctagcactctggtagacctactctctggagggcactggggcgtccttgtcgggttggcgtactt

SEQ ID NO: 108899 - DNA, 75 bp, Artificial Sequence
  Synthetic
catgagggtccctagcactctggtagacctactccctggagggcactggggcgtccttgtcgggttggcgtactt

SEQ ID NO: 108900 - DNA, 75 bp, Artificial Sequence
  Synthetic
catgagggtccctagcactctggtagacctactcgctggagggcactggggcgtccttgtcgggttggcgtactt

SEQ ID NO: 108901 - DNA, 75 bp, Artificial Sequence
  Synthetic
catgagggtccctagcactctggtagaccttctcactggagggcactggggcgtccttgtcgggttggcgtactt

SEQ ID NO: 108902 - DNA, 75 bp, Artificial Sequence
  Synthetic
catgagggtccctagcactctggtagaccttctctctggagggcactggggcgtccttgtcgggttggcgtactt

SEQ ID NO: 108903 - DNA, 75 bp, Artificial Sequence
  Synthetic
catgagggtccctagcactctggtagaccttctccctggagggcactggggcgtccttgtcgggttggcgtactt

SEQ ID NO: 108904 - DNA, 75 bp, Artificial Sequence
  Synthetic
catgagggtccctagcactctggtagaccttctcgctggagggcactggggcgtccttgtcgggttggcgtactt

SEQ ID NO: 108905 - DNA, 75 bp, Artificial Sequence
  Synthetic
catgagggtccctagcactctggtagacctcctcactggagggcactggggcgtccttgtcgggttggcgtactt

SEQ ID NO: 108906 - DNA, 75 bp, Artificial Sequence
  Synthetic
catgagggtccctagcactctggtagacctcctctctggagggcactggggcgtccttgtcgggttggcgtactt

SEQ ID NO: 108907 - DNA, 75 bp, Artificial Sequence
  Synthetic
catgagggtccctagcactctggtagacctcctccctggagggcactggggcgtccttgtcgggttggcgtactt

SEQ ID NO: 108908 - DNA, 75 bp, Artificial Sequence
  Synthetic
catgagggtccctagcactctggtagacctcctcgctggagggcactggggcgtccttgtcgggttggcgtactt

SEQ ID NO: 108909 - DNA, 75 bp, Artificial Sequence
  Synthetic
catgagggtccctagcactctggtagacctgctcactggagggcactggggcgtccttgtcgggttggcgtactt

SEQ ID NO: 108910 - DNA, 75 bp, Artificial Sequence
  Synthetic
catgagggtccctagcactctggtagacctgctctctggagggcactggggcgtccttgtcgggttggcgtactt

SEQ ID NO: 108911 - DNA, 75 bp, Artificial Sequence
  Synthetic
catgagggtccctagcactctggtagacctgctccctggagggcactggggcgtccttgtcgggttggcgtactt

SEQ ID NO: 108912 - DNA, 75 bp, Artificial Sequence
  Synthetic
catgagggtccctagcactctggtagacctgctcgctggagggcactggggcgtccttgtcgggttggcgtactt

SEQ ID NO: 108913 - DNA, 75 bp, Artificial Sequence
  Synthetic
gacctactcactggagggcactggggcgtccttgtcgggttggcgtacttcagtatgcaagcaaattgggccaaa

SEQ ID NO: 108914 - DNA, 75 bp, Artificial Sequence
  Synthetic
gacctactcactggagggcactggggcgtccttgtcgggttggcgtacttcagtatgcaagctaattgggccaaa

SEQ ID NO: 108915 - DNA, 75 bp, Artificial Sequence
  Synthetic
gacctactcactggagggcactggggcgtccttgtcgggttggcgtacttcagtatgcaagccaattgggccaaa

SEQ ID NO: 108916 - DNA, 75 bp, Artificial Sequence
  Synthetic
gacctactcactggagggcactggggcgtccttgtcgggttggcgtacttcagtatgcaagcgaattgggccaaa

SEQ ID NO: 108917 - DNA, 75 bp, Artificial Sequence
  Synthetic
gacctactctctggagggcactggggcgtccttgtcgggttggcgtacttcagtatgcaagcaaattgggccaaa

SEQ ID NO: 108918 - DNA, 75 bp, Artificial Sequence
  Synthetic
gacctactctctggagggcactggggcgtccttgtcgggttggcgtacttcagtatgcaagctaattgggccaaa

SEQ ID NO: 108919 - DNA, 75 bp, Artificial Sequence
  Synthetic
gacctactctctggagggcactggggcgtccttgtcgggttggcgtacttcagtatgcaagccaattgggccaaa

SEQ ID NO: 108920 - DNA, 75 bp, Artificial Sequence
  Synthetic
gacctactctctggagggcactggggcgtccttgtcgggttggcgtacttcagtatgcaagcgaattgggccaaa

SEQ ID NO: 108921 - DNA, 75 bp, Artificial Sequence
  Synthetic
gacctactccctggagggcactggggcgtccttgtcgggttggcgtacttcagtatgcaagcaaattgggccaaa

SEQ ID NO: 108922 - DNA, 75 bp, Artificial Sequence
  Synthetic
gacctactccctggagggcactggggcgtccttgtcgggttggcgtacttcagtatgcaagctaattgggccaaa

SEQ ID NO: 108923 - DNA, 75 bp, Artificial Sequence
  Synthetic
gacctactccctggagggcactggggcgtccttgtcgggttggcgtacttcagtatgcaagccaattgggccaaa

SEQ ID NO: 108924 - DNA, 75 bp, Artificial Sequence
  Synthetic
gacctactccctggagggcactggggcgtccttgtcgggttggcgtacttcagtatgcaagcgaattgggccaaa

SEQ ID NO: 108925 - DNA, 75 bp, Artificial Sequence
  Synthetic
gacctactcgctggagggcactggggcgtccttgtcgggttggcgtacttcagtatgcaagcaaattgggccaaa

SEQ ID NO: 108926 - DNA, 75 bp, Artificial Sequence
  Synthetic
gacctactcgctggagggcactggggcgtccttgtcgggttggcgtacttcagtatgcaagctaattgggccaaa

SEQ ID NO: 108927 - DNA, 75 bp, Artificial Sequence
  Synthetic
gacctactcgctggagggcactggggcgtccttgtcgggttggcgtacttcagtatgcaagccaattgggccaaa

SEQ ID NO: 108928 - DNA, 75 bp, Artificial Sequence
  Synthetic
gacctactcgctggagggcactggggcgtccttgtcgggttggcgtacttcagtatgcaagcgaattgggccaaa

SEQ ID NO: 108929 - DNA, 75 bp, Artificial Sequence
  Synthetic
gaccttctcactggagggcactggggcgtccttgtcgggttggcgtacttcagtatgcaagcaaattgggccaaa

SEQ ID NO: 108930 - DNA, 75 bp, Artificial Sequence
  Synthetic
gaccttctcactggagggcactggggcgtccttgtcgggttggcgtacttcagtatgcaagctaattgggccaaa

SEQ ID NO: 108931 - DNA, 75 bp, Artificial Sequence
  Synthetic
gaccttctcactggagggcactggggcgtccttgtcgggttggcgtacttcagtatgcaagccaattgggccaaa

SEQ ID NO: 108932 - DNA, 75 bp, Artificial Sequence
  Synthetic
gaccttctcactggagggcactggggcgtccttgtcgggttggcgtacttcagtatgcaagcgaattgggccaaa

SEQ ID NO: 108933 - DNA, 75 bp, Artificial Sequence
  Synthetic
gaccttctctctggagggcactggggcgtccttgtcgggttggcgtacttcagtatgcaagcaaattgggccaaa

SEQ ID NO: 108934 - DNA, 75 bp, Artificial Sequence
  Synthetic
gaccttctctctggagggcactggggcgtccttgtcgggttggcgtacttcagtatgcaagctaattgggccaaa

SEQ ID NO: 108935 - DNA, 75 bp, Artificial Sequence
  Synthetic
gaccttctctctggagggcactggggcgtccttgtcgggttggcgtacttcagtatgcaagccaattgggccaaa

SEQ ID NO: 108936 - DNA, 75 bp, Artificial Sequence
  Synthetic
gaccttctctctggagggcactggggcgtccttgtcgggttggcgtacttcagtatgcaagcgaattgggccaaa

SEQ ID NO: 108937 - DNA, 75 bp, Artificial Sequence
  Synthetic
gaccttctccctggagggcactggggcgtccttgtcgggttggcgtacttcagtatgcaagcaaattgggccaaa

SEQ ID NO: 108938 - DNA, 75 bp, Artificial Sequence
  Synthetic
gaccttctccctggagggcactggggcgtccttgtcgggttggcgtacttcagtatgcaagctaattgggccaaa

SEQ ID NO: 108939 - DNA, 75 bp, Artificial Sequence
  Synthetic
gaccttctccctggagggcactggggcgtccttgtcgggttggcgtacttcagtatgcaagccaattgggccaaa

SEQ ID NO: 108940 - DNA, 75 bp, Artificial Sequence
  Synthetic
gaccttctccctggagggcactggggcgtccttgtcgggttggcgtacttcagtatgcaagcgaattgggccaaa

SEQ ID NO: 108941 - DNA, 75 bp, Artificial Sequence
  Synthetic
gaccttctcgctggagggcactggggcgtccttgtcgggttggcgtacttcagtatgcaagcaaattgggccaaa

SEQ ID NO: 108942 - DNA, 75 bp, Artificial Sequence
  Synthetic
gaccttctcgctggagggcactggggcgtccttgtcgggttggcgtacttcagtatgcaagctaattgggccaaa

SEQ ID NO: 108943 - DNA, 75 bp, Artificial Sequence
  Synthetic
gaccttctcgctggagggcactggggcgtccttgtcgggttggcgtacttcagtatgcaagccaattgggccaaa

SEQ ID NO: 108944 - DNA, 75 bp, Artificial Sequence
  Synthetic
gaccttctcgctggagggcactggggcgtccttgtcgggttggcgtacttcagtatgcaagcgaattgggccaaa

SEQ ID NO: 108945 - DNA, 75 bp, Artificial Sequence
  Synthetic
gacctcctcactggagggcactggggcgtccttgtcgggttggcgtacttcagtatgcaagcaaattgggccaaa

SEQ ID NO: 108946 - DNA, 75 bp, Artificial Sequence
  Synthetic
gacctcctcactggagggcactggggcgtccttgtcgggttggcgtacttcagtatgcaagctaattgggccaaa

SEQ ID NO: 108947 - DNA, 75 bp, Artificial Sequence
  Synthetic
gacctcctcactggagggcactggggcgtccttgtcgggttggcgtacttcagtatgcaagccaattgggccaaa

SEQ ID NO: 108948 - DNA, 75 bp, Artificial Sequence
  Synthetic
gacctcctcactggagggcactggggcgtccttgtcgggttggcgtacttcagtatgcaagcgaattgggccaaa

SEQ ID NO: 108949 - DNA, 75 bp, Artificial Sequence
  Synthetic
gacctcctctctggagggcactggggcgtccttgtcgggttggcgtacttcagtatgcaagcaaattgggccaaa

SEQ ID NO: 108950 - DNA, 75 bp, Artificial Sequence
  Synthetic
gacctcctctctggagggcactggggcgtccttgtcgggttggcgtacttcagtatgcaagctaattgggccaaa

SEQ ID NO: 108951 - DNA, 75 bp, Artificial Sequence
  Synthetic
gacctcctctctggagggcactggggcgtccttgtcgggttggcgtacttcagtatgcaagccaattgggccaaa

SEQ ID NO: 108952 - DNA, 75 bp, Artificial Sequence
  Synthetic
gacctcctctctggagggcactggggcgtccttgtcgggttggcgtacttcagtatgcaagcgaattgggccaaa

SEQ ID NO: 108953 - DNA, 75 bp, Artificial Sequence
  Synthetic
gacctcctccctggagggcactggggcgtccttgtcgggttggcgtacttcagtatgcaagcaaattgggccaaa

SEQ ID NO: 108954 - DNA, 75 bp, Artificial Sequence
  Synthetic
gacctcctccctggagggcactggggcgtccttgtcgggttggcgtacttcagtatgcaagctaattgggccaaa

SEQ ID NO: 108955 - DNA, 75 bp, Artificial Sequence
  Synthetic
gacctcctccctggagggcactggggcgtccttgtcgggttggcgtacttcagtatgcaagccaattgggccaaa

SEQ ID NO: 108956 - DNA, 75 bp, Artificial Sequence
  Synthetic
gacctcctccctggagggcactggggcgtccttgtcgggttggcgtacttcagtatgcaagcgaattgggccaaa

SEQ ID NO: 108957 - DNA, 75 bp, Artificial Sequence
  Synthetic
gacctcctcgctggagggcactggggcgtccttgtcgggttggcgtacttcagtatgcaagcaaattgggccaaa

SEQ ID NO: 108958 - DNA, 75 bp, Artificial Sequence
  Synthetic
gacctcctcgctggagggcactggggcgtccttgtcgggttggcgtacttcagtatgcaagctaattgggccaaa

SEQ ID NO: 108959 - DNA, 75 bp, Artificial Sequence
  Synthetic
gacctcctcgctggagggcactggggcgtccttgtcgggttggcgtacttcagtatgcaagccaattgggccaaa

SEQ ID NO: 108960 - DNA, 75 bp, Artificial Sequence
  Synthetic
gacctcctcgctggagggcactggggcgtccttgtcgggttggcgtacttcagtatgcaagcgaattgggccaaa

SEQ ID NO: 108961 - DNA, 75 bp, Artificial Sequence
  Synthetic
gacctgctcactggagggcactggggcgtccttgtcgggttggcgtacttcagtatgcaagcaaattgggccaaa

SEQ ID NO: 108962 - DNA, 75 bp, Artificial Sequence
  Synthetic
gacctgctcactggagggcactggggcgtccttgtcgggttggcgtacttcagtatgcaagctaattgggccaaa

SEQ ID NO: 108963 - DNA, 75 bp, Artificial Sequence
  Synthetic
gacctgctcactggagggcactggggcgtccttgtcgggttggcgtacttcagtatgcaagccaattgggccaaa

SEQ ID NO: 108964 - DNA, 75 bp, Artificial Sequence
  Synthetic
gacctgctcactggagggcactggggcgtccttgtcgggttggcgtacttcagtatgcaagcgaattgggccaaa

SEQ ID NO: 108965 - DNA, 75 bp, Artificial Sequence
  Synthetic
gacctgctctctggagggcactggggcgtccttgtcgggttggcgtacttcagtatgcaagcaaattgggccaaa

SEQ ID NO: 108966 - DNA, 75 bp, Artificial Sequence
  Synthetic
gacctgctctctggagggcactggggcgtccttgtcgggttggcgtacttcagtatgcaagctaattgggccaaa

SEQ ID NO: 108967 - DNA, 75 bp, Artificial Sequence
  Synthetic
gacctgctctctggagggcactggggcgtccttgtcgggttggcgtacttcagtatgcaagccaattgggccaaa

SEQ ID NO: 108968 - DNA, 75 bp, Artificial Sequence
  Synthetic
gacctgctctctggagggcactggggcgtccttgtcgggttggcgtacttcagtatgcaagcgaattgggccaaa

SEQ ID NO: 108969 - DNA, 75 bp, Artificial Sequence
  Synthetic
gacctgctccctggagggcactggggcgtccttgtcgggttggcgtacttcagtatgcaagcaaattgggccaaa

SEQ ID NO: 108970 - DNA, 75 bp, Artificial Sequence
  Synthetic
gacctgctccctggagggcactggggcgtccttgtcgggttggcgtacttcagtatgcaagctaattgggccaaa

SEQ ID NO: 108971 - DNA, 75 bp, Artificial Sequence
  Synthetic
gacctgctccctggagggcactggggcgtccttgtcgggttggcgtacttcagtatgcaagccaattgggccaaa

SEQ ID NO: 108972 - DNA, 75 bp, Artificial Sequence
  Synthetic
gacctgctccctggagggcactggggcgtccttgtcgggttggcgtacttcagtatgcaagcgaattgggccaaa

SEQ ID NO: 108973 - DNA, 75 bp, Artificial Sequence
  Synthetic
gacctgctcgctggagggcactggggcgtccttgtcgggttggcgtacttcagtatgcaagcaaattgggccaaa

SEQ ID NO: 108974 - DNA, 75 bp, Artificial Sequence
  Synthetic
gacctgctcgctggagggcactggggcgtccttgtcgggttggcgtacttcagtatgcaagctaattgggccaaa

SEQ ID NO: 108975 - DNA, 75 bp, Artificial Sequence
  Synthetic
gacctgctcgctggagggcactggggcgtccttgtcgggttggcgtacttcagtatgcaagccaattgggccaaa

SEQ ID NO: 108976 - DNA, 75 bp, Artificial Sequence
  Synthetic
gacctgctcgctggagggcactggggcgtccttgtcgggttggcgtacttcagtatgcaagcgaattgggccaaa

SEQ ID NO: 108977 - DNA, 75 bp, Artificial Sequence
  Synthetic
aagaagttcccccccgcattgccagtatgggctcagcctaactacaaccctccactcgtggagaactggaagagg

SEQ ID NO: 108978 - DNA, 75 bp, Artificial Sequence
  Synthetic
cgccacgtcggccagggagagggggcggtccagtggatgaacagactgatcgcctttgcctccagaggaaaccat

SEQ ID NO: 108979 - DNA, 75 bp, Artificial Sequence
  Synthetic
ctcctggggccaagcagaacatacagctcattaacaccaacggaagctggcacatcaacaggactgcactcaact

SEQ ID NO: 108980 - DNA, 75 bp, Artificial Sequence
  Synthetic
ctcctggggccaagcagaacatacagctcattaacaccaacggaagctggcacatcaacaggactgctctcaact

SEQ ID NO: 108981 - DNA, 75 bp, Artificial Sequence
  Synthetic
ctcctggggccaagcagaacatacagctcattaacaccaacggaagctggcacatcaacaggactgccctcaact

SEQ ID NO: 108982 - DNA, 75 bp, Artificial Sequence
  Synthetic
ctcctggggccaagcagaacatacagctcattaacaccaacggaagctggcacatcaacaggactgcgctcaact

SEQ ID NO: 108983 - DNA, 75 bp, Artificial Sequence
  Synthetic
ctcctggggccaagcagaacatacagctcattaacaccaacggtagctggcacatcaacaggactgcactcaact

SEQ ID NO: 108984 - DNA, 75 bp, Artificial Sequence
  Synthetic
ctcctggggccaagcagaacatacagctcattaacaccaacggtagctggcacatcaacaggactgctctcaact

SEQ ID NO: 108985 - DNA, 75 bp, Artificial Sequence
  Synthetic
ctcctggggccaagcagaacatacagctcattaacaccaacggtagctggcacatcaacaggactgccctcaact

SEQ ID NO: 108986 - DNA, 75 bp, Artificial Sequence
  Synthetic
ctcctggggccaagcagaacatacagctcattaacaccaacggtagctggcacatcaacaggactgcgctcaact

SEQ ID NO: 108987 - DNA, 75 bp, Artificial Sequence
  Synthetic
ctcctggggccaagcagaacatacagctcattaacaccaacggcagctggcacatcaacaggactgcactcaact

SEQ ID NO: 108988 - DNA, 75 bp, Artificial Sequence
  Synthetic
ctcctggggccaagcagaacatacagctcattaacaccaacggcagctggcacatcaacaggactgctctcaact

SEQ ID NO: 108989 - DNA, 75 bp, Artificial Sequence
  Synthetic
ctcctggggccaagcagaacatacagctcattaacaccaacggcagctggcacatcaacaggactgccctcaact

SEQ ID NO: 108990 - DNA, 75 bp, Artificial Sequence
  Synthetic
ctcctggggccaagcagaacatacagctcattaacaccaacggcagctggcacatcaacaggactgcgctcaact

SEQ ID NO: 108991 - DNA, 75 bp, Artificial Sequence
  Synthetic
ctcctggggccaagcagaacatacagctcattaacaccaacgggagctggcacatcaacaggactgcactcaact

SEQ ID NO: 108992 - DNA, 75 bp, Artificial Sequence
  Synthetic
ctcctggggccaagcagaacatacagctcattaacaccaacgggagctggcacatcaacaggactgctctcaact

SEQ ID NO: 108993 - DNA, 75 bp, Artificial Sequence
  Synthetic
ctcctggggccaagcagaacatacagctcattaacaccaacgggagctggcacatcaacaggactgccctcaact

SEQ ID NO: 108994 - DNA, 75 bp, Artificial Sequence
  Synthetic
ctcctggggccaagcagaacatacagctcattaacaccaacgggagctggcacatcaacaggactgcgctcaact

SEQ ID NO: 108995 - DNA, 75 bp, Artificial Sequence
  Synthetic
tccgcatggtctttttgacccatttcttcgccatactactggcccaagatactttaaatcaaaacctcaattttg

SEQ ID NO: 108996 - DNA, 75 bp, Artificial Sequence
  Synthetic
tttttttttttttttttttttttttttttttttttttttttttttttttttttttcctttcctacttttctttct

SEQ ID NO: 108997 - DNA, 75 bp, Artificial Sequence
  Synthetic
aaagtaacgtggctgaggcgctcaaggagctggccaccaaatcttttggccaatcaccttgcagtgccgactccg

SEQ ID NO: 108998 - DNA, 75 bp, Artificial Sequence
  Synthetic
cgacgactttacccaaggttggggcccactcagtcccgctaacctctcgggatcatctgatgaaaggccctactg

SEQ ID NO: 108999 - DNA, 75 bp, Artificial Sequence
  Synthetic
cgacgactttacccaaggttggggcccactcagtcccgctaacctctcgggatcatctgatgataggccctactg

SEQ ID NO: 109000 - DNA, 75 bp, Artificial Sequence
  Synthetic
cgacgactttacccaaggttggggcccactcagtcccgctaacctctcgggatcatctgatgacaggccctactg

SEQ ID NO: 109001 - DNA, 75 bp, Artificial Sequence
  Synthetic
cgacgactttacccaaggttggggcccactcagtcccgctaacctctcgggatcatctgatgagaggccctactg

SEQ ID NO: 109002 - DNA, 75 bp, Artificial Sequence
  Synthetic
cgacgacttttcccaaggttggggcccactcagtcccgctaacctctcgggatcatctgatgaaaggccctactg

SEQ ID NO: 109003 - DNA, 75 bp, Artificial Sequence
  Synthetic
cgacgacttttcccaaggttggggcccactcagtcccgctaacctctcgggatcatctgatgataggccctactg

SEQ ID NO: 109004 - DNA, 75 bp, Artificial Sequence
  Synthetic
cgacgacttttcccaaggttggggcccactcagtcccgctaacctctcgggatcatctgatgacaggccctactg

SEQ ID NO: 109005 - DNA, 75 bp, Artificial Sequence
  Synthetic
cgacgacttttcccaaggttggggcccactcagtcccgctaacctctcgggatcatctgatgagaggccctactg

SEQ ID NO: 109006 - DNA, 75 bp, Artificial Sequence
  Synthetic
cgacgactttccccaaggttggggcccactcagtcccgctaacctctcgggatcatctgatgaaaggccctactg

SEQ ID NO: 109007 - DNA, 75 bp, Artificial Sequence
  Synthetic
cgacgactttccccaaggttggggcccactcagtcccgctaacctctcgggatcatctgatgataggccctactg

SEQ ID NO: 109008 - DNA, 75 bp, Artificial Sequence
  Synthetic
cgacgactttccccaaggttggggcccactcagtcccgctaacctctcgggatcatctgatgacaggccctactg

SEQ ID NO: 109009 - DNA, 75 bp, Artificial Sequence
  Synthetic
cgacgactttccccaaggttggggcccactcagtcccgctaacctctcgggatcatctgatgagaggccctactg

SEQ ID NO: 109010 - DNA, 75 bp, Artificial Sequence
  Synthetic
cgacgactttgcccaaggttggggcccactcagtcccgctaacctctcgggatcatctgatgaaaggccctactg

SEQ ID NO: 109011 - DNA, 75 bp, Artificial Sequence
  Synthetic
cgacgactttgcccaaggttggggcccactcagtcccgctaacctctcgggatcatctgatgataggccctactg

SEQ ID NO: 109012 - DNA, 75 bp, Artificial Sequence
  Synthetic
cgacgactttgcccaaggttggggcccactcagtcccgctaacctctcgggatcatctgatgacaggccctactg

SEQ ID NO: 109013 - DNA, 75 bp, Artificial Sequence
  Synthetic
cgacgactttgcccaaggttggggcccactcagtcccgctaacctctcgggatcatctgatgagaggccctactg

SEQ ID NO: 109014 - DNA, 75 bp, Artificial Sequence
  Synthetic
cacctccatcgtgggatcaaatgtggaagtgtctcatacggctaaagcctacgctgcacgggccaacgcccctgc

SEQ ID NO: 109015 - DNA, 75 bp, Artificial Sequence
  Synthetic
ggaaggggagccgggggaccccgatctagagctagaggtcggggagccctccccccctcctgagggggagcggga

SEQ ID NO: 109016 - DNA, 75 bp, Artificial Sequence
  Synthetic
gaccctcgcggggtccccacatacacctggggagagaataagaccgaagtcttcctccttggttcagccaggccg

SEQ ID NO: 109017 - DNA, 75 bp, Artificial Sequence
  Synthetic
gaccctcgcggggtccccacatacacctggggagagaataagaccgatgtcttcctccttggttcagccaggccg

SEQ ID NO: 109018 - DNA, 75 bp, Artificial Sequence
  Synthetic
gaccctcgcggggtccccacatacacctggggagagaataagaccgacgtcttcctccttggttcagccaggccg

SEQ ID NO: 109019 - DNA, 75 bp, Artificial Sequence
  Synthetic
gaccctcgcggggtccccacatacacctggggagagaataagaccgaggtcttcctccttggttcagccaggccg

SEQ ID NO: 109020 - DNA, 75 bp, Artificial Sequence
  Synthetic
agggaaccttcctggttgctctttctctatcttccttctggccctgctctcttgcctgaccgtgcccgcttcagc

SEQ ID NO: 109021 - DNA, 75 bp, Artificial Sequence
  Synthetic
cgaccccgccttttactccttggcctactcctacttactgtaggggtaggcatctttctactccccgctcggtag

SEQ ID NO: 109022 - DNA, 75 bp, Artificial Sequence
  Synthetic
ctcgcagctctggccgcgtactgcctgacaacgggcagcgtggtcattgtaggcaggatcatcttgtccgggaag

SEQ ID NO: 109023 - DNA, 75 bp, Artificial Sequence
  Synthetic
tccatgactgaggtagaggatgatcgcgagccttccgtaccatcagagtacttgatcaggaggaaaaagttccca

SEQ ID NO: 109024 - DNA, 75 bp, Artificial Sequence
  Synthetic
acgccctgtaacccagaggaggagaagttaccaattaaccctctgagcaactcattgttgcgataccacaacaaa

SEQ ID NO: 109025 - DNA, 75 bp, Artificial Sequence
  Synthetic
ggcattgtcccaccgactgcttcaggaaacacccggagactacctatgccaagtgcgggtcagggccctggctta

SEQ ID NO: 109026 - DNA, 75 bp, Artificial Sequence
  Synthetic
acattaagcttgccgcctccagggttagcgccaggctcctcacggtggaggaagcctgtgcgttgaccccacccc

SEQ ID NO: 109027 - DNA, 75 bp, Artificial Sequence
  Synthetic
gcatcggctgactgcagcatgtaactggaccaggggggagccctgcgggctggaacaaagagatcgctcggagtt

SEQ ID NO: 109028 - DNA, 75 bp, Artificial Sequence
  Synthetic
gcatcggctgactgcagcatgtaactggaccaggggggagccctgcgggctggaacatagagatcgctcggagtt

SEQ ID NO: 109029 - DNA, 75 bp, Artificial Sequence
  Synthetic
gcatcggctgactgcagcatgtaactggaccaggggggagccctgcgggctggaacacagagatcgctcggagtt

SEQ ID NO: 109030 - DNA, 75 bp, Artificial Sequence
  Synthetic
gcatcggctgactgcagcatgtaactggaccaggggggagccctgcgggctggaacagagagatcgctcggagtt

SEQ ID NO: 109031 - DNA, 75 bp, Artificial Sequence
  Synthetic
agaccaagacacaccaatctcgaccactatcatggcaaagaatgaggtattctgtgtcgatcccgccaagggtgg

SEQ ID NO: 109032 - DNA, 75 bp, Artificial Sequence
  Synthetic
atcgtggatgtccagtacctctacggcattggatctacggttgtatcctgggcactcaagtgggaatacgtcgtg

SEQ ID NO: 109033 - DNA, 75 bp, Artificial Sequence
  Synthetic
aagcaccctcctgttcaacatcctggggggatgggtggccgcccagctcgctccccccagcgccgcttcggcgtt

SEQ ID NO: 109034 - DNA, 75 bp, Artificial Sequence
  Synthetic
cagcgtgtgacccaactacttggctctcttactataaccagcctactcagaagactccacaattggataactgag

SEQ ID NO: 109035 - DNA, 75 bp, Artificial Sequence
  Synthetic
atggggccctcctatggtttccagtattctccagcacaacgggtcgatttcctcctcaacgcttggaggtcaaag

SEQ ID NO: 109036 - DNA, 75 bp, Artificial Sequence
  Synthetic
tcaacgctgcttcagtcgccagcactcatggtttctaccacgccatcctcttcatctgtgtggcttggcacgtca

SEQ ID NO: 109037 - DNA, 75 bp, Artificial Sequence
  Synthetic
ggtttgcaccatcttgacagacttcaaaaattggctgacctctaaattgatccccaagctgcccggcctcccctt

SEQ ID NO: 109038 - DNA, 75 bp, Artificial Sequence
  Synthetic
gacaacataaagtgcccatgccaggttccggcccccgaattcttcacggaggtggacggggtgcggctgcacagg

SEQ ID NO: 109039 - DNA, 75 bp, Artificial Sequence
  Synthetic
tacccgaagaggctcgggttgccatacattcattgactgagagactctacgtgggaggccccatgcttaacagca

SEQ ID NO: 109040 - DNA, 75 bp, Artificial Sequence
  Synthetic
tgaaccggctgatagcgttcgcttcgcggggtaaccatgtctcccccacgcactatgtgcccgagagcgacgctg

SEQ ID NO: 109041 - DNA, 75 bp, Artificial Sequence
  Synthetic
ggaggtggcagggtcccttggcggcggtgttgtcatcgcactggcccttttgacgttgtctccgcattacaaaca

SEQ ID NO: 109042 - DNA, 75 bp, Artificial Sequence
  Synthetic
aggggcaatcctgcggctaccggcgctgccgggccagcggggtcttcaccaccagcatgggcaacaccatcacgt

SEQ ID NO: 109043 - DNA, 75 bp, Artificial Sequence
  Synthetic
tgtggagacgacctggttgtcatctcagagagccaaggaaacgaggaggatgagcgaaacctgagagctttcacg

SEQ ID NO: 109044 - DNA, 75 bp, Artificial Sequence
  Synthetic
ggtgtgtgggccggcactggcatcatgaccacgcgctgcccttgcggcgccaacatctctggcaatgtccgcctg

SEQ ID NO: 109045 - DNA, 75 bp, Artificial Sequence
  Synthetic
gactcggtcatcatcataacaatcctggttttcccccatctgacttttgacatcacaaagtacctcctggccatc

SEQ ID NO: 109046 - DNA, 75 bp, Artificial Sequence
  Synthetic
tgcacccacaccaaagccgtttttccgggatgaggtctcgttctgcgttgggcttaattcctatgctgtcgggtc

SEQ ID NO: 109047 - DNA, 75 bp, Artificial Sequence
  Synthetic
tgaataccacctgctcgtgtggtgcacaaatcaccggacatgtcaagaatggttccatgaggatcgtggggccta

SEQ ID NO: 109048 - DNA, 75 bp, Artificial Sequence
  Synthetic
tctatggcaagtactgccagatggccctactcaaagtgggggctttcactggtacctatgtctacaaccacctta

SEQ ID NO: 109049 - DNA, 75 bp, Artificial Sequence
  Synthetic
ctgcctgggaaactgtaagacactcccctgtcaattcatggctgggtaacatcatattatacgcccccaccattt

SEQ ID NO: 109050 - DNA, 75 bp, Artificial Sequence
  Synthetic
cggggatcacctccatctgaggcgagctcctcagtgagccagctatcagcaccgtcgctgcgggccacctgcacc

SEQ ID NO: 109051 - DNA, 75 bp, Artificial Sequence
  Synthetic
agcagataccgctgcgtgtggtgacatcataagggggctgccagtttcggctaggctaggcaatgagatcctgct

SEQ ID NO: 109052 - DNA, 75 bp, Artificial Sequence
  Synthetic
cgtctctccactggacctcccagccataattgaaagactccacgggcttgaggccttttcactgcactcatacac

SEQ ID NO: 109053 - DNA, 75 bp, Artificial Sequence
  Synthetic
actttctcgagccaatggccgaggaagagagcgaccttgagccctcaatactatcggagtgcatgctccccagga

SEQ ID NO: 109054 - DNA, 75 bp, Artificial Sequence
  Synthetic
tcaccgcatacgcacagcagacccgcggcttgctcagcaccatagtgacaagcctcactggcagagacaccaatg

SEQ ID NO: 109055 - DNA, 75 bp, Artificial Sequence
  Synthetic
agagagcgaccttgagccctcaatactatcggagtgcatgctccccaggagcgggtttccacgggccttaccggc

SEQ ID NO: 109056 - DNA, 75 bp, Artificial Sequence
  Synthetic
cctgcttgtggatgatgttactcatatcccaagtggaggcggctttggagaacctcgtagtactcaatgcagcat

SEQ ID NO: 109057 - DNA, 75 bp, Artificial Sequence
  Synthetic
aaggccccgacgcctcccccaaggagacgccggacagtgggtctgagcaagagcaccatatcagaagccctccag

SEQ ID NO: 109058 - DNA, 75 bp, Artificial Sequence
  Synthetic
gccggactacaaccccccgctagtagagacgtggaaaaagcctgactacgaaccacctgtggtccatggctgccc

SEQ ID NO: 109059 - DNA, 75 bp, Artificial Sequence
  Synthetic
gtgagccggccccctcagagacaggttccgcctcctctatgccccccctcgagggggagcctggagatccggacc

SEQ ID NO: 109060 - DNA, 75 bp, Artificial Sequence
  Synthetic
ggcgacactaggggctccctcttgagccctaggccaatctctactctcaagggatcttctggtggcccgctgctg

SEQ ID NO: 109061 - DNA, 75 bp, Artificial Sequence
  Synthetic
ttccgcctcctctatgccccccctcgagggggagcctggagatccggacctggagtctgatcaggtagagcttca

SEQ ID NO: 109062 - DNA, 75 bp, Artificial Sequence
  Synthetic
tggggtggctaaagcagtggactttgtgccagtcgagtccctcgaaaccaccatgagatcaccagttttcactga

SEQ ID NO: 109063 - DNA, 75 bp, Artificial Sequence
  Synthetic
tccccacaacgcagcttcgacgtcacatcgatctgcttgtcgggagtgccaccctctgctcggccctctatgtgg

SEQ ID NO: 109064 - DNA, 75 bp, Artificial Sequence
  Synthetic
cgtttggcagcttgaaggagcagtgcttcacactcctggatgcgtcccttgtgagcgtaccgccaacgtctctcg

SEQ ID NO: 109065 - DNA, 75 bp, Artificial Sequence
  Synthetic
gctcagggctacaaggtgctggtgctcaacccctcggttgcggccactttgggctttggggcgtacatgtccaag

SEQ ID NO: 109066 - DNA, 75 bp, Artificial Sequence
  Synthetic
tcactaagggcctgcgagcacacatcgatatcatcgtgatgtctgctacggtctgttctgccctttacgtggggg

SEQ ID NO: 109067 - DNA, 75 bp, Artificial Sequence
  Synthetic
tcaacccctcggttgcggccactttgggctttggggcgtacatgtccaaggcatatggcattgatccgaacatca

SEQ ID NO: 109068 - DNA, 75 bp, Artificial Sequence
  Synthetic
cattacgggacaccgcatggcttgggatatgatgatgaactggtcgcccactaccaccatgctcctggcgtactt

SEQ ID NO: 109069 - DNA, 75 bp, Artificial Sequence
  Synthetic
ccagctgatcaacaccaacggcagttggcacatcaatcgcactgccttgaattgtaatgcgagcctcgacactgg

SEQ ID NO: 109070 - DNA, 75 bp, Artificial Sequence
  Synthetic
cggtgaccacgccccattccaacatagaggaaatagccctgccgacgacgggagaaatacccttctatggcaagg

SEQ ID NO: 109071 - DNA, 75 bp, Artificial Sequence
  Synthetic
tgtgcgcgcgacgaggaagacttccgagcgatcccagcccagaggtaggcgccaacctatacccaaggcgcgccc

SEQ ID NO: 109072 - DNA, 75 bp, Artificial Sequence
  Synthetic
aagaaaccagctcgcctcatcgtttaccctgacctcggcgtccgggtctgcgagaaaatggccctctatgacatt

SEQ ID NO: 109073 - DNA, 75 bp, Artificial Sequence
  Synthetic
gtcatcgttatcctcctgctgactgctggggtggaggcgaccacttataccactggagcatctgctggacagcag

SEQ ID NO: 109074 - DNA, 75 bp, Artificial Sequence
  Synthetic
gggtagacacctcatcttctgccattcaaaaaagaaatgtgacgagttagccaagcaactgtcaggccttggtct

SEQ ID NO: 109075 - DNA, 75 bp, Artificial Sequence
  Synthetic
gcaatgatagcctgcaaaccggcttcattgcggctctgttctatactagatccttcaactcctcagggtgccccg

SEQ ID NO: 109076 - DNA, 75 bp, Artificial Sequence
  Synthetic
ccccttacgtatgaggagaatgtcaccaatgacgcggatatgaggccttactgctggcattatcctcctaagccg

SEQ ID NO: 109077 - DNA, 75 bp, Artificial Sequence
  Synthetic
ttaactatgcaacagggaatcttcccggatgctcattttctatcttcctcttggcactgctttcgtgcctcacca

SEQ ID NO: 109078 - DNA, 75 bp, Artificial Sequence
  Synthetic
ttaactatgcaacagggaatcttcccggatgctctttttctatcttcctcttggcactgctttcgtgcctcacca

SEQ ID NO: 109079 - DNA, 75 bp, Artificial Sequence
  Synthetic
ttaactatgcaacagggaatcttcccggatgctccttttctatcttcctcttggcactgctttcgtgcctcacca

SEQ ID NO: 109080 - DNA, 75 bp, Artificial Sequence
  Synthetic
ttaactatgcaacagggaatcttcccggatgctcgttttctatcttcctcttggcactgctttcgtgcctcacca

SEQ ID NO: 109081 - DNA, 75 bp, Artificial Sequence
  Synthetic
ttaactatgcaacagggaatcttcccggttgctcattttctatcttcctcttggcactgctttcgtgcctcacca

SEQ ID NO: 109082 - DNA, 75 bp, Artificial Sequence
  Synthetic
ttaactatgcaacagggaatcttcccggttgctctttttctatcttcctcttggcactgctttcgtgcctcacca

SEQ ID NO: 109083 - DNA, 75 bp, Artificial Sequence
  Synthetic
ttaactatgcaacagggaatcttcccggttgctccttttctatcttcctcttggcactgctttcgtgcctcacca

SEQ ID NO: 109084 - DNA, 75 bp, Artificial Sequence
  Synthetic
ttaactatgcaacagggaatcttcccggttgctcgttttctatcttcctcttggcactgctttcgtgcctcacca

SEQ ID NO: 109085 - DNA, 75 bp, Artificial Sequence
  Synthetic
ttaactatgcaacagggaatcttcccggctgctcattttctatcttcctcttggcactgctttcgtgcctcacca

SEQ ID NO: 109086 - DNA, 75 bp, Artificial Sequence
  Synthetic
ttaactatgcaacagggaatcttcccggctgctctttttctatcttcctcttggcactgctttcgtgcctcacca

SEQ ID NO: 109087 - DNA, 75 bp, Artificial Sequence
  Synthetic
ttaactatgcaacagggaatcttcccggctgctccttttctatcttcctcttggcactgctttcgtgcctcacca

SEQ ID NO: 109088 - DNA, 75 bp, Artificial Sequence
  Synthetic
ttaactatgcaacagggaatcttcccggctgctcgttttctatcttcctcttggcactgctttcgtgcctcacca

SEQ ID NO: 109089 - DNA, 75 bp, Artificial Sequence
  Synthetic
ttaactatgcaacagggaatcttcccgggtgctcattttctatcttcctcttggcactgctttcgtgcctcacca

SEQ ID NO: 109090 - DNA, 75 bp, Artificial Sequence
  Synthetic
ttaactatgcaacagggaatcttcccgggtgctctttttctatcttcctcttggcactgctttcgtgcctcacca

SEQ ID NO: 109091 - DNA, 75 bp, Artificial Sequence
  Synthetic
ttaactatgcaacagggaatcttcccgggtgctccttttctatcttcctcttggcactgctttcgtgcctcacca

SEQ ID NO: 109092 - DNA, 75 bp, Artificial Sequence
  Synthetic
ttaactatgcaacagggaatcttcccgggtgctcgttttctatcttcctcttggcactgctttcgtgcctcacca

SEQ ID NO: 109093 - DNA, 75 bp, Artificial Sequence
  Synthetic
tccatagagaccaccactgtgccccaggatgcggtatcccgcagccagcggagaggccgcactggtagggggagg

SEQ ID NO: 109094 - DNA, 75 bp, Artificial Sequence
  Synthetic
tgacaccgcagtactctgcgagtgctatgatgctggatgtgcctggtacgaactgacaccagctgagaccacaac

SEQ ID NO: 109095 - DNA, 75 bp, Artificial Sequence
  Synthetic
catgcacctagctggctgtgtgccctgtgtgagagagaacggcacctcatactgttggcactctgtctctcccac

SEQ ID NO: 109096 - DNA, 75 bp, Artificial Sequence
  Synthetic
catgcacctagctggctgtgtgccctgtgtgagagagaacggcacctcttactgttggcactctgtctctcccac

SEQ ID NO: 109097 - DNA, 75 bp, Artificial Sequence
  Synthetic
catgcacctagctggctgtgtgccctgtgtgagagagaacggcacctcctactgttggcactctgtctctcccac

SEQ ID NO: 109098 - DNA, 75 bp, Artificial Sequence
  Synthetic
catgcacctagctggctgtgtgccctgtgtgagagagaacggcacctcgtactgttggcactctgtctctcccac

SEQ ID NO: 109099 - DNA, 75 bp, Artificial Sequence
  Synthetic
cttgcacctagctggctgtgtgccctgtgtgagagagaacggcacctcatactgttggcactctgtctctcccac

SEQ ID NO: 109100 - DNA, 75 bp, Artificial Sequence
  Synthetic
cttgcacctagctggctgtgtgccctgtgtgagagagaacggcacctcttactgttggcactctgtctctcccac

SEQ ID NO: 109101 - DNA, 75 bp, Artificial Sequence
  Synthetic
cttgcacctagctggctgtgtgccctgtgtgagagagaacggcacctcctactgttggcactctgtctctcccac

SEQ ID NO: 109102 - DNA, 75 bp, Artificial Sequence
  Synthetic
cttgcacctagctggctgtgtgccctgtgtgagagagaacggcacctcgtactgttggcactctgtctctcccac

SEQ ID NO: 109103 - DNA, 75 bp, Artificial Sequence
  Synthetic
cctgcacctagctggctgtgtgccctgtgtgagagagaacggcacctcatactgttggcactctgtctctcccac

SEQ ID NO: 109104 - DNA, 75 bp, Artificial Sequence
  Synthetic
cctgcacctagctggctgtgtgccctgtgtgagagagaacggcacctcttactgttggcactctgtctctcccac

SEQ ID NO: 109105 - DNA, 75 bp, Artificial Sequence
  Synthetic
cctgcacctagctggctgtgtgccctgtgtgagagagaacggcacctcctactgttggcactctgtctctcccac

SEQ ID NO: 109106 - DNA, 75 bp, Artificial Sequence
  Synthetic
cctgcacctagctggctgtgtgccctgtgtgagagagaacggcacctcgtactgttggcactctgtctctcccac

SEQ ID NO: 109107 - DNA, 75 bp, Artificial Sequence
  Synthetic
cgtgcacctagctggctgtgtgccctgtgtgagagagaacggcacctcatactgttggcactctgtctctcccac

SEQ ID NO: 109108 - DNA, 75 bp, Artificial Sequence
  Synthetic
cgtgcacctagctggctgtgtgccctgtgtgagagagaacggcacctcttactgttggcactctgtctctcccac

SEQ ID NO: 109109 - DNA, 75 bp, Artificial Sequence
  Synthetic
cgtgcacctagctggctgtgtgccctgtgtgagagagaacggcacctcctactgttggcactctgtctctcccac

SEQ ID NO: 109110 - DNA, 75 bp, Artificial Sequence
  Synthetic
cgtgcacctagctggctgtgtgccctgtgtgagagagaacggcacctcgtactgttggcactctgtctctcccac

SEQ ID NO: 109111 - DNA, 75 bp, Artificial Sequence
  Synthetic
caccaaaacctgtggtgcaccaccttgccgcatcagggaggacttcaacgccagtcaagacctgttgtgccccac

SEQ ID NO: 109112 - DNA, 75 bp, Artificial Sequence
  Synthetic
catttcctatcccagaccaagcaagcgggcgagaacttcccgtacctcgttgcttaccaggccacagtgtgcgcc

SEQ ID NO: 109113 - DNA, 75 bp, Artificial Sequence
  Synthetic
gacctgtgtggaggtgcatttttggtagggcagatgttcaccttcgctcctcgccatcaaaagctggtgcaggat

SEQ ID NO: 109114 - DNA, 75 bp, Artificial Sequence
  Synthetic
gacctgtgtggaggtgcatttttggtagggcagatgttcaccttcgctcctcgccatcaaatgctggtgcaggat

SEQ ID NO: 109115 - DNA, 75 bp, Artificial Sequence
  Synthetic
gacctgtgtggaggtgcatttttggtagggcagatgttcaccttcgctcctcgccatcaaacgctggtgcaggat

SEQ ID NO: 109116 - DNA, 75 bp, Artificial Sequence
  Synthetic
gacctgtgtggaggtgcatttttggtagggcagatgttcaccttcgctcctcgccatcaaaggctggtgcaggat

SEQ ID NO: 109117 - DNA, 75 bp, Artificial Sequence
  Synthetic
gacctgtgtggaggtgcatttttggtagggcagatgttcaccttcgctcctcgccatcataagctggtgcaggat

SEQ ID NO: 109118 - DNA, 75 bp, Artificial Sequence
  Synthetic
gacctgtgtggaggtgcatttttggtagggcagatgttcaccttcgctcctcgccatcatatgctggtgcaggat

SEQ ID NO: 109119 - DNA, 75 bp, Artificial Sequence
  Synthetic
gacctgtgtggaggtgcatttttggtagggcagatgttcaccttcgctcctcgccatcatacgctggtgcaggat

SEQ ID NO: 109120 - DNA, 75 bp, Artificial Sequence
  Synthetic
gacctgtgtggaggtgcatttttggtagggcagatgttcaccttcgctcctcgccatcataggctggtgcaggat

SEQ ID NO: 109121 - DNA, 75 bp, Artificial Sequence
  Synthetic
gacctgtgtggaggtgcatttttggtagggcagatgttcaccttcgctcctcgccatcacaagctggtgcaggat

SEQ ID NO: 109122 - DNA, 75 bp, Artificial Sequence
  Synthetic
gacctgtgtggaggtgcatttttggtagggcagatgttcaccttcgctcctcgccatcacatgctggtgcaggat

SEQ ID NO: 109123 - DNA, 75 bp, Artificial Sequence
  Synthetic
gacctgtgtggaggtgcatttttggtagggcagatgttcaccttcgctcctcgccatcacacgctggtgcaggat

SEQ ID NO: 109124 - DNA, 75 bp, Artificial Sequence
  Synthetic
gacctgtgtggaggtgcatttttggtagggcagatgttcaccttcgctcctcgccatcacaggctggtgcaggat

SEQ ID NO: 109125 - DNA, 75 bp, Artificial Sequence
  Synthetic
gacctgtgtggaggtgcatttttggtagggcagatgttcaccttcgctcctcgccatcagaagctggtgcaggat

SEQ ID NO: 109126 - DNA, 75 bp, Artificial Sequence
  Synthetic
gacctgtgtggaggtgcatttttggtagggcagatgttcaccttcgctcctcgccatcagatgctggtgcaggat

SEQ ID NO: 109127 - DNA, 75 bp, Artificial Sequence
  Synthetic
gacctgtgtggaggtgcatttttggtagggcagatgttcaccttcgctcctcgccatcagacgctggtgcaggat

SEQ ID NO: 109128 - DNA, 75 bp, Artificial Sequence
  Synthetic
gacctgtgtggaggtgcatttttggtagggcagatgttcaccttcgctcctcgccatcagaggctggtgcaggat

SEQ ID NO: 109129 - DNA, 75 bp, Artificial Sequence
  Synthetic
gacctgtgtggaggtgcatttttggttgggcagatgttcaccttcgctcctcgccatcaaaagctggtgcaggat

SEQ ID NO: 109130 - DNA, 75 bp, Artificial Sequence
  Synthetic
gacctgtgtggaggtgcatttttggttgggcagatgttcaccttcgctcctcgccatcaaatgctggtgcaggat

SEQ ID NO: 109131 - DNA, 75 bp, Artificial Sequence
  Synthetic
gacctgtgtggaggtgcatttttggttgggcagatgttcaccttcgctcctcgccatcaaacgctggtgcaggat

SEQ ID NO: 109132 - DNA, 75 bp, Artificial Sequence
  Synthetic
gacctgtgtggaggtgcatttttggttgggcagatgttcaccttcgctcctcgccatcaaaggctggtgcaggat

SEQ ID NO: 109133 - DNA, 75 bp, Artificial Sequence
  Synthetic
gacctgtgtggaggtgcatttttggttgggcagatgttcaccttcgctcctcgccatcataagctggtgcaggat

SEQ ID NO: 109134 - DNA, 75 bp, Artificial Sequence
  Synthetic
gacctgtgtggaggtgcatttttggttgggcagatgttcaccttcgctcctcgccatcatatgctggtgcaggat

SEQ ID NO: 109135 - DNA, 75 bp, Artificial Sequence
  Synthetic
gacctgtgtggaggtgcatttttggttgggcagatgttcaccttcgctcctcgccatcatacgctggtgcaggat

SEQ ID NO: 109136 - DNA, 75 bp, Artificial Sequence
  Synthetic
gacctgtgtggaggtgcatttttggttgggcagatgttcaccttcgctcctcgccatcataggctggtgcaggat

SEQ ID NO: 109137 - DNA, 75 bp, Artificial Sequence
  Synthetic
gacctgtgtggaggtgcatttttggttgggcagatgttcaccttcgctcctcgccatcacaagctggtgcaggat

SEQ ID NO: 109138 - DNA, 75 bp, Artificial Sequence
  Synthetic
gacctgtgtggaggtgcatttttggttgggcagatgttcaccttcgctcctcgccatcacatgctggtgcaggat

SEQ ID NO: 109139 - DNA, 75 bp, Artificial Sequence
  Synthetic
gacctgtgtggaggtgcatttttggttgggcagatgttcaccttcgctcctcgccatcacacgctggtgcaggat

SEQ ID NO: 109140 - DNA, 75 bp, Artificial Sequence
  Synthetic
gacctgtgtggaggtgcatttttggttgggcagatgttcaccttcgctcctcgccatcacaggctggtgcaggat

SEQ ID NO: 109141 - DNA, 75 bp, Artificial Sequence
  Synthetic
gacctgtgtggaggtgcatttttggttgggcagatgttcaccttcgctcctcgccatcagaagctggtgcaggat

SEQ ID NO: 109142 - DNA, 75 bp, Artificial Sequence
  Synthetic
gacctgtgtggaggtgcatttttggttgggcagatgttcaccttcgctcctcgccatcagatgctggtgcaggat

SEQ ID NO: 109143 - DNA, 75 bp, Artificial Sequence
  Synthetic
gacctgtgtggaggtgcatttttggttgggcagatgttcaccttcgctcctcgccatcagacgctggtgcaggat

SEQ ID NO: 109144 - DNA, 75 bp, Artificial Sequence
  Synthetic
gacctgtgtggaggtgcatttttggttgggcagatgttcaccttcgctcctcgccatcagaggctggtgcaggat

SEQ ID NO: 109145 - DNA, 75 bp, Artificial Sequence
  Synthetic
gacctgtgtggaggtgcatttttggtcgggcagatgttcaccttcgctcctcgccatcaaaagctggtgcaggat

SEQ ID NO: 109146 - DNA, 75 bp, Artificial Sequence
  Synthetic
gacctgtgtggaggtgcatttttggtcgggcagatgttcaccttcgctcctcgccatcaaatgctggtgcaggat

SEQ ID NO: 109147 - DNA, 75 bp, Artificial Sequence
  Synthetic
gacctgtgtggaggtgcatttttggtcgggcagatgttcaccttcgctcctcgccatcaaacgctggtgcaggat

SEQ ID NO: 109148 - DNA, 75 bp, Artificial Sequence
  Synthetic
gacctgtgtggaggtgcatttttggtcgggcagatgttcaccttcgctcctcgccatcaaaggctggtgcaggat

SEQ ID NO: 109149 - DNA, 75 bp, Artificial Sequence
  Synthetic
gacctgtgtggaggtgcatttttggtcgggcagatgttcaccttcgctcctcgccatcataagctggtgcaggat

SEQ ID NO: 109150 - DNA, 75 bp, Artificial Sequence
  Synthetic
gacctgtgtggaggtgcatttttggtcgggcagatgttcaccttcgctcctcgccatcatatgctggtgcaggat

SEQ ID NO: 109151 - DNA, 75 bp, Artificial Sequence
  Synthetic
gacctgtgtggaggtgcatttttggtcgggcagatgttcaccttcgctcctcgccatcatacgctggtgcaggat

SEQ ID NO: 109152 - DNA, 75 bp, Artificial Sequence
  Synthetic
gacctgtgtggaggtgcatttttggtcgggcagatgttcaccttcgctcctcgccatcataggctggtgcaggat

SEQ ID NO: 109153 - DNA, 75 bp, Artificial Sequence
  Synthetic
gacctgtgtggaggtgcatttttggtcgggcagatgttcaccttcgctcctcgccatcacaagctggtgcaggat

SEQ ID NO: 109154 - DNA, 75 bp, Artificial Sequence
  Synthetic
gacctgtgtggaggtgcatttttggtcgggcagatgttcaccttcgctcctcgccatcacatgctggtgcaggat

SEQ ID NO: 109155 - DNA, 75 bp, Artificial Sequence
  Synthetic
gacctgtgtggaggtgcatttttggtcgggcagatgttcaccttcgctcctcgccatcacacgctggtgcaggat

SEQ ID NO: 109156 - DNA, 75 bp, Artificial Sequence
  Synthetic
gacctgtgtggaggtgcatttttggtcgggcagatgttcaccttcgctcctcgccatcacaggctggtgcaggat

SEQ ID NO: 109157 - DNA, 75 bp, Artificial Sequence
  Synthetic
gacctgtgtggaggtgcatttttggtcgggcagatgttcaccttcgctcctcgccatcagaagctggtgcaggat

SEQ ID NO: 109158 - DNA, 75 bp, Artificial Sequence
  Synthetic
gacctgtgtggaggtgcatttttggtcgggcagatgttcaccttcgctcctcgccatcagatgctggtgcaggat

SEQ ID NO: 109159 - DNA, 75 bp, Artificial Sequence
  Synthetic
gacctgtgtggaggtgcatttttggtcgggcagatgttcaccttcgctcctcgccatcagacgctggtgcaggat

SEQ ID NO: 109160 - DNA, 75 bp, Artificial Sequence
  Synthetic
gacctgtgtggaggtgcatttttggtcgggcagatgttcaccttcgctcctcgccatcagaggctggtgcaggat

SEQ ID NO: 109161 - DNA, 75 bp, Artificial Sequence
  Synthetic
gacctgtgtggaggtgcatttttggtggggcagatgttcaccttcgctcctcgccatcaaaagctggtgcaggat

SEQ ID NO: 109162 - DNA, 75 bp, Artificial Sequence
  Synthetic
gacctgtgtggaggtgcatttttggtggggcagatgttcaccttcgctcctcgccatcaaatgctggtgcaggat

SEQ ID NO: 109163 - DNA, 75 bp, Artificial Sequence
  Synthetic
gacctgtgtggaggtgcatttttggtggggcagatgttcaccttcgctcctcgccatcaaacgctggtgcaggat

SEQ ID NO: 109164 - DNA, 75 bp, Artificial Sequence
  Synthetic
gacctgtgtggaggtgcatttttggtggggcagatgttcaccttcgctcctcgccatcaaaggctggtgcaggat

SEQ ID NO: 109165 - DNA, 75 bp, Artificial Sequence
  Synthetic
gacctgtgtggaggtgcatttttggtggggcagatgttcaccttcgctcctcgccatcataagctggtgcaggat

SEQ ID NO: 109166 - DNA, 75 bp, Artificial Sequence
  Synthetic
gacctgtgtggaggtgcatttttggtggggcagatgttcaccttcgctcctcgccatcatatgctggtgcaggat

SEQ ID NO: 109167 - DNA, 75 bp, Artificial Sequence
  Synthetic
gacctgtgtggaggtgcatttttggtggggcagatgttcaccttcgctcctcgccatcatacgctggtgcaggat

SEQ ID NO: 109168 - DNA, 75 bp, Artificial Sequence
  Synthetic
gacctgtgtggaggtgcatttttggtggggcagatgttcaccttcgctcctcgccatcataggctggtgcaggat

SEQ ID NO: 109169 - DNA, 75 bp, Artificial Sequence
  Synthetic
gacctgtgtggaggtgcatttttggtggggcagatgttcaccttcgctcctcgccatcacaagctggtgcaggat

SEQ ID NO: 109170 - DNA, 75 bp, Artificial Sequence
  Synthetic
gacctgtgtggaggtgcatttttggtggggcagatgttcaccttcgctcctcgccatcacatgctggtgcaggat

SEQ ID NO: 109171 - DNA, 75 bp, Artificial Sequence
  Synthetic
gacctgtgtggaggtgcatttttggtggggcagatgttcaccttcgctcctcgccatcacacgctggtgcaggat

SEQ ID NO: 109172 - DNA, 75 bp, Artificial Sequence
  Synthetic
gacctgtgtggaggtgcatttttggtggggcagatgttcaccttcgctcctcgccatcacaggctggtgcaggat

SEQ ID NO: 109173 - DNA, 75 bp, Artificial Sequence
  Synthetic
gacctgtgtggaggtgcatttttggtggggcagatgttcaccttcgctcctcgccatcagaagctggtgcaggat

SEQ ID NO: 109174 - DNA, 75 bp, Artificial Sequence
  Synthetic
gacctgtgtggaggtgcatttttggtggggcagatgttcaccttcgctcctcgccatcagatgctggtgcaggat

SEQ ID NO: 109175 - DNA, 75 bp, Artificial Sequence
  Synthetic
gacctgtgtggaggtgcatttttggtggggcagatgttcaccttcgctcctcgccatcagacgctggtgcaggat

SEQ ID NO: 109176 - DNA, 75 bp, Artificial Sequence
  Synthetic
gacctgtgtggaggtgcatttttggtggggcagatgttcaccttcgctcctcgccatcagaggctggtgcaggat

SEQ ID NO: 109177 - DNA, 75 bp, Artificial Sequence
  Synthetic
cattatccgtgcacagtcaactacaccatcttcaaaatacggatgtttgtggggggtgttgaacataggctcgaa

SEQ ID NO: 109178 - DNA, 75 bp, Artificial Sequence
  Synthetic
cacccatcctataaccaaatacatcatggcttgcatgtcagctgaccttgaggtggtgactagtacgtgggttct

SEQ ID NO: 109179 - DNA, 75 bp, Artificial Sequence
  Synthetic
tcctgagagtgcctgagattgtgctggaagtgtttactggcggccattggggcataataattgccgttgcctact

SEQ ID NO: 109180 - DNA, 75 bp, Artificial Sequence
  Synthetic
taccctgcacgttctcagacctgccagccttgtcaacgggcctgctgcatctccaccagaacatcgtggatgtgc

SEQ ID NO: 109181 - DNA, 75 bp, Artificial Sequence
  Synthetic
cctgaccgagaggcgctctaccagcagttcgacgagatggaggaatgctccaaacatcttccgctagtcgagcaa

SEQ ID NO: 109182 - DNA, 75 bp, Artificial Sequence
  Synthetic
ggcaagcggtctcgctggccttttcacgcctggcgcaaagcagaacatacagctcattaacaccaatggtagctg

SEQ ID NO: 109183 - DNA, 75 bp, Artificial Sequence
  Synthetic
ctgtctttggatgctcatcctattgggtcaggctgaagcggctctggagaagctggtcattttgcacgcggctag

SEQ ID NO: 109184 - DNA, 75 bp, Artificial Sequence
  Synthetic
ttgccaagcttgagcagttctgggccaagcacatgtggaatttcatcagtggcattcaatacctagctggcttgt

SEQ ID NO: 109185 - DNA, 75 bp, Artificial Sequence
  Synthetic
cagcgactcgaggcgtgcaaacctctagagtacttccagcaagggtggggctccatatcctacaagcataacatc

SEQ ID NO: 109186 - DNA, 75 bp, Artificial Sequence
  Synthetic
cagcgactcgaggcgtgcaaacctctagagtacttcctgcaagggtggggctccatatcctacaagcataacatc

SEQ ID NO: 109187 - DNA, 75 bp, Artificial Sequence
  Synthetic
cagcgactcgaggcgtgcaaacctctagagtacttcccgcaagggtggggctccatatcctacaagcataacatc

SEQ ID NO: 109188 - DNA, 75 bp, Artificial Sequence
  Synthetic
cagcgactcgaggcgtgcaaacctctagagtacttccggcaagggtggggctccatatcctacaagcataacatc

SEQ ID NO: 109189 - DNA, 75 bp, Artificial Sequence
  Synthetic
ggatgctggtcctttgtcttactactcgtggcgttacctcaacaggcttacgccctcgagatagcagaacaaggc

SEQ ID NO: 109190 - DNA, 75 bp, Artificial Sequence
  Synthetic
aggaggttgggtggcttcgcagatcgcaactccgacagcctccacggcattcgttgtgagcggtttggcgggggc

SEQ ID NO: 109191 - DNA, 75 bp, Artificial Sequence
  Synthetic
cgcctagtccagtcgtggttggcaccaccgacagactgggcaaccccacctacacctggggagaaaacgagacag

SEQ ID NO: 109192 - DNA, 75 bp, Artificial Sequence
  Synthetic
cgcctagtcctgtcgtggttggcaccaccgacagactgggcaaccccacctacacctggggagaaaacgagacag

SEQ ID NO: 109193 - DNA, 75 bp, Artificial Sequence
  Synthetic
cgcctagtcccgtcgtggttggcaccaccgacagactgggcaaccccacctacacctggggagaaaacgagacag

SEQ ID NO: 109194 - DNA, 75 bp, Artificial Sequence
  Synthetic
cgcctagtccggtcgtggttggcaccaccgacagactgggcaaccccacctacacctggggagaaaacgagacag

SEQ ID NO: 109195 - DNA, 75 bp, Artificial Sequence
  Synthetic
tcaagacctggctccagtccaagctcctgccgcggttaccgggagtccccttcctctcatgccaacgtgggtaca

SEQ ID NO: 109196 - DNA, 75 bp, Artificial Sequence
  Synthetic
aaaccagtctgctcaaagtgccctacttcgtgcgcgtccaaggccttctccggctctgcgcgctagtgcgcaaga

SEQ ID NO: 109197 - DNA, 75 bp, Artificial Sequence
  Synthetic
tggtcctggcggaggccctgatccaagattgggtgccaccactgcaagcgcggggcggtcgtgacggtgtcatat

SEQ ID NO: 109198 - DNA, 75 bp, Artificial Sequence
  Synthetic
tggcacatcaataggacggccttgaactgcaatgacagccttaacaccggctgggtagcagggctcttctatcac

SEQ ID NO: 109199 - DNA, 75 bp, Artificial Sequence
  Synthetic
ttttttttttttttttttttttttcttttttttttttttccctctttcttcccttctcatcttattctactttct

SEQ ID NO: 109200 - DNA, 75 bp, Artificial Sequence
  Synthetic
ggcgagatgccgtccacagaggatctggtaaacttgctcccagccattctatcgccgggggcattagtagtgggg

SEQ ID NO: 109201 - DNA, 75 bp, Artificial Sequence
  Synthetic
ttgccagataattccgggggactataacagctcatctaatgagcttttgtgccccaccgactgcttccgcaagca

SEQ ID NO: 109202 - DNA, 75 bp, Artificial Sequence
  Synthetic
tgcccgccatcctctcgcctggagcccttgtagtcggcgtggtctgcgcagcaatactgcgccggcacgttggcc

SEQ ID NO: 109203 - DNA, 75 bp, Artificial Sequence
  Synthetic
atcgccgggggcattagtagtgggggtggtgtgcgccgcgatcttgcgccgccacgtgggtccaggtgagggggc

SEQ ID NO: 109204 - DNA, 75 bp, Artificial Sequence
  Synthetic
cacgccatacttcgtcagggcgaacgcgcttctgaggatgtgtgcgatggtgaagcaactcgcgggaggcaaata

SEQ ID NO: 109205 - DNA, 75 bp, Artificial Sequence
  Synthetic
aactacacaattcacaaggtccgcgtgttcatcggaggtgttgagcataggttcaatgctgcctgtaactggaca

SEQ ID NO: 109206 - DNA, 75 bp, Artificial Sequence
  Synthetic
ctagcggtggctgtcgagcccattgtcttcagcccaatggagaggaaggtcatcgtgtggggggcggagacggca

SEQ ID NO: 109207 - DNA, 75 bp, Artificial Sequence
  Synthetic
acatatgggactgggtctgcaccgtgctgagcgatttcaagacatggctgaaagctaagctgctgccccgcatgc

SEQ ID NO: 109208 - DNA, 75 bp, Artificial Sequence
  Synthetic
ccatgcctgccttgtcaacaggactcatacatctacatcagaatattgtggacgtacagtacctctacggagtct

SEQ ID NO: 109209 - DNA, 75 bp, Artificial Sequence
  Synthetic
acttgtcagtagtgtcgaagcggcggtggagaggcttgtcgtccttaacgctgctagcgcagcaggcactgccgg

SEQ ID NO: 109210 - DNA, 75 bp, Artificial Sequence
  Synthetic
agttcgcgctttggagggtatctgccgaggagtacgtggaggttcgcagggtgggtgatttccattacatcactg

SEQ ID NO: 109211 - DNA, 75 bp, Artificial Sequence
  Synthetic
ctggtggtctgtgtgctaccccaccgggcatatgcttgggacgacagccagactgcaacgctcggagctactgtc

SEQ ID NO: 109212 - DNA, 75 bp, Artificial Sequence
  Synthetic
caaacccctgctgcgagaggaggtgacgttctcagtaggactcaactcattcgtagtgggttcccagctcccatg

SEQ ID NO: 109213 - DNA, 75 bp, Artificial Sequence
  Synthetic
cgaagggtccaatcacccaaatgtacaccaatgtagaccaagacctcgtcggctggcaggcgccccccggggcgc

SEQ ID NO: 109214 - DNA, 75 bp, Artificial Sequence
  Synthetic
acgttaagttcccgggcggcggccagatcgttggtggagtatacttgttgccgcgcaggggcccacgattgggtg

SEQ ID NO: 109215 - DNA, 75 bp, Artificial Sequence
  Synthetic
tggtgcacgattgggtaccagacttgcgggtcaggggtggcagggatgccatcatcctgcttacctgcctgctac

SEQ ID NO: 109216 - DNA, 75 bp, Artificial Sequence
  Synthetic
ccctcgttagccagttcttcggccagccagctgtccgccccgtctctcaaagccacatgcgccgcccatgactct

SEQ ID NO: 109217 - DNA, 75 bp, Artificial Sequence
  Synthetic
tctcccacgttgcgcaaggggtatctaacctcttctcatcaggcgcccagcagaacatccagctaatcaacaccg

SEQ ID NO: 109218 - DNA, 75 bp, Artificial Sequence
  Synthetic
cataataatttgtgacgagtgccactccacggatgcaacatccatcttgggcatcggcaccgtccttgaccaagc

SEQ ID NO: 109219 - DNA, 75 bp, Artificial Sequence
  Synthetic
tgcccacgttctcctgcgggcctgtatgctcttccgcaaagtggcaggcggtaagtacgtgcaggctttcctctt

SEQ ID NO: 109220 - DNA, 75 bp, Artificial Sequence
  Synthetic
aactatgcaacagggaatctgcccggttgctctttctctatcttcctcttggctctgctgtcctgtttgaccatc

SEQ ID NO: 109221 - DNA, 75 bp, Artificial Sequence
  Synthetic
tcgtggctgagacggatgacagggagacttcagtcgccgcagagatcctgaggccgactaagaggttcccccctg

SEQ ID NO: 109222 - DNA, 75 bp, Artificial Sequence
  Synthetic
ccgctcgtcggcgctccggtaggaggcgtcgcgagggccctcgcacacggggtaagggctctcgaggacggaata

SEQ ID NO: 109223 - DNA, 75 bp, Artificial Sequence
  Synthetic
ccagtcatcttctctcccatggagaagaagatcatcacatggggcgcagacaccgccgcgtgtggcgatatcttg

SEQ ID NO: 109224 - DNA, 75 bp, Artificial Sequence
  Synthetic
catctggggcgtctcagaaaatccagcttgtgaataccaacggcagctggcacatcaacaggactgccctaaatt

SEQ ID NO: 109225 - DNA, 75 bp, Artificial Sequence
  Synthetic
tcccagtggtcaggcccccattcccccgccccggaggaagagggtggtcgcgctcgacgggtccaacatctccaa

SEQ ID NO: 109226 - DNA, 75 bp, Artificial Sequence
  Synthetic
acgcatccggtctctacatgctcaccaatgactgctcaaacagcagcatagtatatgaggcggaagatgtgatcc

SEQ ID NO: 109227 - DNA, 75 bp, Artificial Sequence
  Synthetic
cgtacgcacagcagacgcggggcctggttggcaccatagtgaccagtctgactggccgtgataagaatgaggttg

SEQ ID NO: 109228 - DNA, 75 bp, Artificial Sequence
  Synthetic
ggaggacagggatagatcagagcttagcccgctgctgctgtctacaacagagtggcaggtattgccctgttcctt

SEQ ID NO: 109229 - DNA, 75 bp, Artificial Sequence
  Synthetic
cccatcacctatactaagcctaacagctcggatcagaggccttattgctggcattacgcgcctcgaccgtgtggt

SEQ ID NO: 109230 - DNA, 75 bp, Artificial Sequence
  Synthetic
cctgttgtcgtagacgaccagtccgacgacggatcctactcgtcgatgccccctttagagggagagcccggcgac

SEQ ID NO: 109231 - DNA, 75 bp, Artificial Sequence
  Synthetic
gacggcttccgtacgcggacacgtggatttgctagtcggcagtgccactctgtgctccgcgctctatgtcggtga

SEQ ID NO: 109232 - DNA, 75 bp, Artificial Sequence
  Synthetic
tcttgccggatcgaagggacccatatgccagatgtacactaatgtagaattagacttggtggggtggccagctcc

SEQ ID NO: 109233 - DNA, 75 bp, Artificial Sequence
  Synthetic
tcttgccggatcgaagggacccatatgccagatgtacactaatgttgaattagacttggtggggtggccagctcc

SEQ ID NO: 109234 - DNA, 75 bp, Artificial Sequence
  Synthetic
tcttgccggatcgaagggacccatatgccagatgtacactaatgtcgaattagacttggtggggtggccagctcc

SEQ ID NO: 109235 - DNA, 75 bp, Artificial Sequence
  Synthetic
tcttgccggatcgaagggacccatatgccagatgtacactaatgtggaattagacttggtggggtggccagctcc

SEQ ID NO: 109236 - DNA, 75 bp, Artificial Sequence
  Synthetic
ccggatttgacatcgtcgatggccccttcagagggagagcccggcgacccggatttgacatcagactcttggtcc

SEQ ID NO: 109237 - DNA, 75 bp, Artificial Sequence
  Synthetic
tgccagatgtacactaatgtagaattagacttggtggggtggccagctccccagggggccaggtcattcacccct

SEQ ID NO: 109238 - DNA, 75 bp, Artificial Sequence
  Synthetic
tgccagatgtacactaatgttgaattagacttggtggggtggccagctccccagggggccaggtcattcacccct

SEQ ID NO: 109239 - DNA, 75 bp, Artificial Sequence
  Synthetic
tgccagatgtacactaatgtcgaattagacttggtggggtggccagctccccagggggccaggtcattcacccct

SEQ ID NO: 109240 - DNA, 75 bp, Artificial Sequence
  Synthetic
tgccagatgtacactaatgtggaattagacttggtggggtggccagctccccagggggccaggtcattcacccct

SEQ ID NO: 109241 - DNA, 75 bp, Artificial Sequence
  Synthetic
gctcctcaacaacacgcgtccgccacaaggcaactggttcggctgtacatggatgaatagtactgggttcactaa

SEQ ID NO: 109242 - DNA, 75 bp, Artificial Sequence
  Synthetic
atcacaggacatcgcatggcatgggatatgatgatgaactggtccccagccgccggtctagctctagcacacttg

SEQ ID NO: 109243 - DNA, 75 bp, Artificial Sequence
  Synthetic
ggcctataagcaccctcaaaggctcttcgggaggccctctcatgtgcccgtcagggcacgtggtggggcttttcc

SEQ ID NO: 109244 - DNA, 75 bp, Artificial Sequence
  Synthetic
gaggaggtggccctgtccaatatcggagagatccccttttatggcaaagccatccccctcggaaccatcaagggg

SEQ ID NO: 109245 - DNA, 75 bp, Artificial Sequence
  Synthetic
acgactacccgttctgccactacccggcagaagaaggtaaccttcgaccgcatgcaagtggtggacaaccattac

SEQ ID NO: 109246 - DNA, 75 bp, Artificial Sequence
  Synthetic
tcatagtcatcttggtcatgtttgcgggggttgacgctcacacgaacgtcatcggcagtaatgcgggaagcacgc

SEQ ID NO: 109247 - DNA, 75 bp, Artificial Sequence
  Synthetic
ctcgccacccgcggtgcctcagacttatcaggtggggtacttacacgctccaacgggtagtgggaagagcactcg

SEQ ID NO: 109248 - DNA, 75 bp, Artificial Sequence
  Synthetic
gatcaaagtttggctatggggcaaaagatgttcgcagccattcccgcaaggccgttaaccacatcaactccgtgt

SEQ ID NO: 109249 - DNA, 75 bp, Artificial Sequence
  Synthetic
caacgactcgttgcaaactggcttcatagcggggttattctacagttacaaattcaatgccacggggtgccctga

SEQ ID NO: 109250 - DNA, 75 bp, Artificial Sequence
  Synthetic
ggtatagacccaaacatccgaacgggtgtcaggaccataaccacggggggcgctatcacatactcaacatatggg

SEQ ID NO: 109251 - DNA, 75 bp, Artificial Sequence
  Synthetic
ctccactgcgggactgggcccacgcgggcctgcgagaccttgcggtggcagttgagcccgttgtcttctctgaca

SEQ ID NO: 109252 - DNA, 75 bp, Artificial Sequence
  Synthetic
tggcactatccacccaagccttgtaaaatagtccccgcgaagtctgtctgcggtccggtctactgttttactcca

SEQ ID NO: 109253 - DNA, 75 bp, Artificial Sequence
  Synthetic
ctgtcttagatcaggcagagaccgcaggggtccgcctcactgtgcttgctactgcaacaccaccaggctccgtca

SEQ ID NO: 109254 - DNA, 75 bp, Artificial Sequence
  Synthetic
cctctggtggttggttcggctgtgcgtggatgaactctacggggttcgtgaagacgtgcggcgcccccccctgca

SEQ ID NO: 109255 - DNA, 75 bp, Artificial Sequence
  Synthetic
ccctcgagttcatcaaaggggggagacacctcatcttttgccactcaaagaagaaatgcgacgagctagccaaac

SEQ ID NO: 109256 - DNA, 75 bp, Artificial Sequence
  Synthetic
ataggcttgggtaaggtgctggtggacatcctggcgggatacggtgcgggcatctcgggggctctcgtcgcgttc

SEQ ID NO: 109257 - DNA, 75 bp, Artificial Sequence
  Synthetic
tggaccctggcttaccccgcggtgcttggttgactacccgtaccggctctggcactacccttgcactgtgaactt

SEQ ID NO: 109258 - DNA, 75 bp, Artificial Sequence
  Synthetic
cctcatgaccggctacacaggcgactttgactcagtcatcgattgcaatgtggccgtgacgcaggtggtagattt

SEQ ID NO: 109259 - DNA, 75 bp, Artificial Sequence
  Synthetic
gggctcttcgggtggtccgctgctctgcccctcggggcacgctgtgggcatcttccgggctgctgtgtgcacccg

SEQ ID NO: 109260 - DNA, 75 bp, Artificial Sequence
  Synthetic
gaccgcagtgaaatacatccgctgcttcactccacaaccgagtttgccatactgccctgctcgtttgcaccaatg

SEQ ID NO: 109261 - DNA, 75 bp, Artificial Sequence
  Synthetic
gtgtataggtttgtctcgcagggggaaaggccttcgggcatgttcgactctgtcgtgctctgtgaagcatatgac

SEQ ID NO: 109262 - DNA, 75 bp, Artificial Sequence
  Synthetic
gggagattgtcatccttgtattcttactcttggcagacgctcgagtgtgtgtggctctctggatgatgctactaa

SEQ ID NO: 109263 - DNA, 75 bp, Artificial Sequence
  Synthetic
agttttgggagggggtattcacgggcctgactcacatagacgcccactttctatctcagaccaagcaggggggcg

SEQ ID NO: 109264 - DNA, 75 bp, Artificial Sequence
  Synthetic
aggaaacttggggtacccccattgagagcgtggagacatcgggcccgagcagtccgcgctaagctcatcgcccag

SEQ ID NO: 109265 - DNA, 75 bp, Artificial Sequence
  Synthetic
agcctggcacgtgcgaggcaagcttgtcccgatagttacctatgggttgacaggcctgtggtccctggccttgct

SEQ ID NO: 109266 - DNA, 75 bp, Artificial Sequence
  Synthetic
agcctggcacgtgcgaggcaagcttgtcccgattgttacctatgggttgacaggcctgtggtccctggccttgct

SEQ ID NO: 109267 - DNA, 75 bp, Artificial Sequence
  Synthetic
agcctggcacgtgcgaggcaagcttgtcccgatcgttacctatgggttgacaggcctgtggtccctggccttgct

SEQ ID NO: 109268 - DNA, 75 bp, Artificial Sequence
  Synthetic
agcctggcacgtgcgaggcaagcttgtcccgatggttacctatgggttgacaggcctgtggtccctggccttgct

SEQ ID NO: 109269 - DNA, 75 bp, Artificial Sequence
  Synthetic
taaaccaactctcactggcccgaccccccttctatatcgattgggggctgtccaaaatgagataataacaactca

SEQ ID NO: 109270 - DNA, 75 bp, Artificial Sequence
  Synthetic
ccttggtacaaacactggatctcgcgcctcatttggtggaaccaatacgccatttgtaggagcgaggctgctctt

SEQ ID NO: 109271 - DNA, 75 bp, Artificial Sequence
  Synthetic
tactgtctaacagtaggctgcgttgtcatctgtggcagggtcataaccaccggtaagcccgcggtcattcccgac

SEQ ID NO: 109272 - DNA, 75 bp, Artificial Sequence
  Synthetic
ctggcgcatggcgtccgggttctggaagacggcgtgaattatgcaacagggaaccttcctggttgctctttctct

SEQ ID NO: 109273 - DNA, 75 bp, Artificial Sequence
  Synthetic
cctggctccagtccaagctcctgccacggttaccgggagtccctttcttctcatgccaacgcgggtacaagggag

SEQ ID NO: 109274 - DNA, 75 bp, Artificial Sequence
  Synthetic
tcttgatagctgtacttggcccattgtacctaattcaagctgccctctcgcgtaccccgtatttcgtgcgagcac

SEQ ID NO: 109275 - DNA, 75 bp, Artificial Sequence
  Synthetic
aagtgctcggactgctccaagcaagcgccaaacaagcagaggagctgaagcccgctattcactccacgtggccca

SEQ ID NO: 109276 - DNA, 75 bp, Artificial Sequence
  Synthetic
ctatgaccatctgacaccgttgcgggactgggccgccagcggccttaaggacctggcggtggctgtagagccggt

SEQ ID NO: 109277 - DNA, 75 bp, Artificial Sequence
  Synthetic
gctgatgtcattcacggcgtctctcaccagccctctaaggacctcccaaaccctgttgctcaacatactgggcgg

SEQ ID NO: 109278 - DNA, 75 bp, Artificial Sequence
  Synthetic
cgagagattctactaggtcccgctgatgactaccggcaaatgggttggagacttctggccccgatttcagcatat

SEQ ID NO: 109279 - DNA, 75 bp, Artificial Sequence
  Synthetic
gggtagcattgggctcgggagggtcatagttgatgtcctcgctgggtacggggctggcgtggcaggcgcgctggt

SEQ ID NO: 109280 - DNA, 75 bp, Artificial Sequence
  Synthetic
cgccccccgggtcagtgacaaccccccatcccaatatagaggaggtagccctcgggcaggagggtgagatcccct

SEQ ID NO: 109281 - DNA, 75 bp, Artificial Sequence
  Synthetic
cccaatccttcttaggtacaactgtaggaggtgtcttgtggactgtctaccacggagcgggctctaaaacacttg

SEQ ID NO: 109282 - DNA, 75 bp, Artificial Sequence
  Synthetic
tgcgctgccatcttgaggcgccacgttggcccttccgagggtgccaaccagtggatgaacaggctgatagccttt

SEQ ID NO: 109283 - DNA, 75 bp, Artificial Sequence
  Synthetic
tagcgtatttctccatggcggggaactgggcgaaggtcctgctagtgctgttgctgtttgccggcgtcgacgcgg

SEQ ID NO: 109284 - DNA, 75 bp, Artificial Sequence
  Synthetic
ttgtgggtccacagatttgtatctgatcacccgtgacgctgatgttcttccagcccgccgtaggggagactctac

SEQ ID NO: 109285 - DNA, 75 bp, Artificial Sequence
  Synthetic
tactccgtaggctacatcagtggatccatgaggatgcgtctactccctgcgcgtccacgtggttacgtgacgtgt

SEQ ID NO: 109286 - DNA, 75 bp, Artificial Sequence
  Synthetic
tgcctgggatcccctttgtgtcctgccagcgcgggtataggggggtctggcgaggagacggcatcatgcacactc

SEQ ID NO: 109287 - DNA, 75 bp, Artificial Sequence
  Synthetic
gaatgccgtggcatactatagagggttggacgtctccataataccagctcagggagatgtggtggtcgtcgccac

SEQ ID NO: 109288 - DNA, 75 bp, Artificial Sequence
  Synthetic
gccgtctgtaccagaggtgttgcaaaaggcctccaatttataccagtggaaacccttagtacacagactaggtcc

SEQ ID NO: 109289 - DNA, 75 bp, Artificial Sequence
  Synthetic
ttataggggggtctgggctggcgacggggtatgccataccacttgtccttgcggggctcagaatgctggacacgt

SEQ ID NO: 109290 - DNA, 75 bp, Artificial Sequence
  Synthetic
ttataggggggtctgggctggcgacggggtatgccataccacttgtccttgcggggctcagattgctggacacgt

SEQ ID NO: 109291 - DNA, 75 bp, Artificial Sequence
  Synthetic
ttataggggggtctgggctggcgacggggtatgccataccacttgtccttgcggggctcagactgctggacacgt

SEQ ID NO: 109292 - DNA, 75 bp, Artificial Sequence
  Synthetic
ttataggggggtctgggctggcgacggggtatgccataccacttgtccttgcggggctcagagtgctggacacgt

SEQ ID NO: 109293 - DNA, 75 bp, Artificial Sequence
  Synthetic
cggctgcctatgtggctcaaggatataatgtcctcgtgcttaatccatcagtggcggctaccctagggttcggca

SEQ ID NO: 109294 - DNA, 75 bp, Artificial Sequence
  Synthetic
gtcccagccccgaactataaacgcgctctttggcgggtatccgccgaagagtacgttgaagtccggagactaggg

SEQ ID NO: 109295 - DNA, 75 bp, Artificial Sequence
  Synthetic
gtcccagccccgaactataaacgcgctctttggcgggtttccgccgaagagtacgttgaagtccggagactaggg

SEQ ID NO: 109296 - DNA, 75 bp, Artificial Sequence
  Synthetic
gtcccagccccgaactataaacgcgctctttggcgggtctccgccgaagagtacgttgaagtccggagactaggg

SEQ ID NO: 109297 - DNA, 75 bp, Artificial Sequence
  Synthetic
gtcccagccccgaactataaacgcgctctttggcgggtgtccgccgaagagtacgttgaagtccggagactaggg

SEQ ID NO: 109298 - DNA, 75 bp, Artificial Sequence
  Synthetic
gatttaccaaagtgtgcggagcgcctccttgtgtcatcggaggggtgggcaacaacaccttgcactgccccactg

SEQ ID NO: 109299 - DNA, 75 bp, Artificial Sequence
  Synthetic
ccttgcagacggaggttgttccggaggagcatacgatgtgatcatctgtgacgagtgccatgcgcaagatgcgac

SEQ ID NO: 109300 - DNA, 75 bp, Artificial Sequence
  Synthetic
accattgtgaccagcctaaccgggcgtgacaaaaatgaggtcgaaggggaggtacaggtggtctccacggctacc

SEQ ID NO: 109301 - DNA, 75 bp, Artificial Sequence
  Synthetic
accgctacgcgccaccctgtaagcccctactcagagatgaggtgtgcttctcagtgggcctctctgattatgttg

SEQ ID NO: 109302 - DNA, 75 bp, Artificial Sequence
  Synthetic
cttgccgcgctgttctacacgcacaagttcaactcgtccggatgccgcgagcgcctggccagctgtcgccccctt

SEQ ID NO: 109303 - DNA, 75 bp, Artificial Sequence
  Synthetic
cccccttctgtggccagctcctcggctagccagctgtccgctccatctctcaaggcaacttgcaccgccaaccat

SEQ ID NO: 109304 - DNA, 75 bp, Artificial Sequence
  Synthetic
ccacattccaacatcgaagaggtggctttgactaatgatggggagattcccttctatggcaaggctatcccgata

SEQ ID NO: 109305 - DNA, 75 bp, Artificial Sequence
  Synthetic
cctgaagaggggatctcccccctctctggctagctcctctgctagccagttgtcagcgccgtcccttaaagccac

SEQ ID NO: 109306 - DNA, 75 bp, Artificial Sequence
  Synthetic
aatactacagaggtcttgatgtttctgttatcccggccacgggggatgtcgtgatctgcgccactgacgccctca

SEQ ID NO: 109307 - DNA, 75 bp, Artificial Sequence
  Synthetic
aacaaggtcatcgttctcgactcatttgatcctctggttccagagtatgacgacagggagatatctgtgccagca

SEQ ID NO: 109308 - DNA, 75 bp, Artificial Sequence
  Synthetic
acgtactgcccctcaagacgcagtgtcccggagtcaacgccgtggccgcacgggtaggggtaggctcggtacata

SEQ ID NO: 109309 - DNA, 75 bp, Artificial Sequence
  Synthetic
gatacgagcctcccgtcgtgtccgggtgcgcgttacctccagctaagcaaccacctgtccctccgccaaggcgga

SEQ ID NO: 109310 - DNA, 75 bp, Artificial Sequence
  Synthetic
gccgagaccacagtgcgattgaaggcttacttatccacacccggcttgcccgtttgtcaagatcatacggaattc

SEQ ID NO: 109311 - DNA, 75 bp, Artificial Sequence
  Synthetic
cggctttgagggatcggtagctagtccaccgtcttctgaaccagcaacggcagacgacgcatgctcggatgcggg

SEQ ID NO: 109312 - DNA, 75 bp, Artificial Sequence
  Synthetic
cggctttgagggttcggtagctagtccaccgtcttctgaaccagcaacggcagacgacgcatgctcggatgcggg

SEQ ID NO: 109313 - DNA, 75 bp, Artificial Sequence
  Synthetic
cggctttgagggctcggtagctagtccaccgtcttctgaaccagcaacggcagacgacgcatgctcggatgcggg

SEQ ID NO: 109314 - DNA, 75 bp, Artificial Sequence
  Synthetic
cggctttgaggggtcggtagctagtccaccgtcttctgaaccagcaacggcagacgacgcatgctcggatgcggg

SEQ ID NO: 109315 - DNA, 75 bp, Artificial Sequence
  Synthetic
gagggggagcccggggatccggatttgagctctggttcctggtccactgtcagaggggaggacgacgtcgtctgt

SEQ ID NO: 109316 - DNA, 75 bp, Artificial Sequence
  Synthetic
gagggggagcccggggatccggatttgagctctggttcctggtccactgtcagtggggaggacgacgtcgtctgt

SEQ ID NO: 109317 - DNA, 75 bp, Artificial Sequence
  Synthetic
gagggggagcccggggatccggatttgagctctggttcctggtccactgtcagcggggaggacgacgtcgtctgt

SEQ ID NO: 109318 - DNA, 75 bp, Artificial Sequence
  Synthetic
gagggggagcccggggatccggatttgagctctggttcctggtccactgtcaggggggaggacgacgtcgtctgt

SEQ ID NO: 109319 - DNA, 75 bp, Artificial Sequence
  Synthetic
cgactgtgtgcgctcgcgcgcaagcgctcccaccgagctgggatgagatgtggaagtgccttgtgagactcaaac

SEQ ID NO: 109320 - DNA, 75 bp, Artificial Sequence
  Synthetic
gattgccaaatctacggggcctgttactccattgagccacttgacctacctcagatcattcaaagactccatggc

SEQ ID NO: 109321 - DNA, 75 bp, Artificial Sequence
  Synthetic
atcacaacatggtttactccaccacatcacgcagcgctggcctccgccagaagaaggtcacatttgacagagtac

SEQ ID NO: 109322 - DNA, 75 bp, Artificial Sequence
  Synthetic
gtcggctgatcttgaggtcaccacgagcacttgggtgctacttgggggagttctagcagccctagctgcttactg

SEQ ID NO: 109323 - DNA, 75 bp, Artificial Sequence
  Synthetic
cacgccaccacattcagcccgatccaagtacgggtacggggcacgggatgtcaggagtcatgctagcaaggccgt

SEQ ID NO: 109324 - DNA, 75 bp, Artificial Sequence
  Synthetic
atggaggaatgtgctcaagccactccatacatcgagcaagcccaagccatagcccaccagttcaaggaaaagatc

SEQ ID NO: 109325 - DNA, 75 bp, Artificial Sequence
  Synthetic
cagaagggcgggcgcaagcccgcgcggttaatagtctatccagacttgtccgtgcgggtctgcgagaaaagggcc

SEQ ID NO: 109326 - DNA, 75 bp, Artificial Sequence
  Synthetic
ggaacttcgtaagtggcatacaatacctagctggcctctcgacgctgcccggtaaccccgccgtagcgtccctta

SEQ ID NO: 109327 - DNA, 75 bp, Artificial Sequence
  Synthetic
cgggtacccatggcccctgtatgggaatgagggctgcggatgggcagggtggctcctgtctccccgcggctctcg

SEQ ID NO: 109328 - DNA, 75 bp, Artificial Sequence
  Synthetic
ggctcctgtctccccgcggctctcgccctaattggggccccaatgacccccggcgaagatcccgcaacttgggta

SEQ ID NO: 109329 - DNA, 75 bp, Artificial Sequence
  Synthetic
ggcgctcgaaaaagacaccgatggggttctcatatgacaccaggtgtttcgattcgaccgtcactgagcgggaca

SEQ ID NO: 109330 - DNA, 75 bp, Artificial Sequence
  Synthetic
agcttcctcagcgttcgtggtgagtggcctcgccggcgctgcgataggtggtataggcctgggcagaattttact

SEQ ID NO: 109331 - DNA, 75 bp, Artificial Sequence
  Synthetic
agaccgccatctggagggtggcggcctcggagtacgcggaggtgacgcagcatgggtcgtactcctatgtaacag

SEQ ID NO: 109332 - DNA, 75 bp, Artificial Sequence
  Synthetic
gacaaactccagaggagagtcatgtggctaccgccggtgccgtgctagcggggtgttcaccacgagcttggggaa

SEQ ID NO: 109333 - DNA, 75 bp, Artificial Sequence
  Synthetic
ctgcccgccatactgtctccaggagccctggtcgtcggtgtgatatgtgcggccattctacgccggcatgtgggt

SEQ ID NO: 109334 - DNA, 75 bp, Artificial Sequence
  Synthetic
cggagacgatttggtagtcatttgtgagagttccggcacacaggaggacgctgcatcactgagagctttcacgga

SEQ ID NO: 109335 - DNA, 75 bp, Artificial Sequence
  Synthetic
tgcatcttccaggatgcgttccctgcgtcaagtccggtaataattcaaagtgttggttgcccgccacgcccacca

SEQ ID NO: 109336 - DNA, 75 bp, Artificial Sequence
  Synthetic
tgcatcttccaggatgcgttccctgcgtcaagtccggtaataattctaagtgttggttgcccgccacgcccacca

SEQ ID NO: 109337 - DNA, 75 bp, Artificial Sequence
  Synthetic
tgcatcttccaggatgcgttccctgcgtcaagtccggtaataattccaagtgttggttgcccgccacgcccacca

SEQ ID NO: 109338 - DNA, 75 bp, Artificial Sequence
  Synthetic
tgcatcttccaggatgcgttccctgcgtcaagtccggtaataattcgaagtgttggttgcccgccacgcccacca

SEQ ID NO: 109339 - DNA, 75 bp, Artificial Sequence
  Synthetic
tgggggatttccactacgtgacgggcatgaccactgacaacgtaaaatgcccatgccaggtcccggcccccgaat

SEQ ID NO: 109340 - DNA, 75 bp, Artificial Sequence
  Synthetic
cagcgaagatcacctcgctgctaagctccttaaccgtcacgcagctgttgcggcggctgcatcgatggatcaatg

SEQ ID NO: 109341 - DNA, 75 bp, Artificial Sequence
  Synthetic
tctgtgcggtggcgtgttcctggtcggccaactgttcgccatcaggcctcggcagcatgagaccgtccaggaatg

SEQ ID NO: 109342 - DNA, 75 bp, Artificial Sequence
  Synthetic
gcccgccacaccccagtcaactcgtggttgggtaacatcattatgtacgcccccacaatctgggtgcgcatggtt

SEQ ID NO: 109343 - DNA, 75 bp, Artificial Sequence
  Synthetic
aatgcctaagttaccaggcatccccttcctctcttgtcaaaaggggtacaaaggggtgtggcgaggggacggcat

SEQ ID NO: 109344 - DNA, 75 bp, Artificial Sequence
  Synthetic
atcgttggtggagtatacttgttgccgcgcaggggcccccggttgggtgtgcgcgcgacgaggaagacttccgaa

SEQ ID NO: 109345 - DNA, 75 bp, Artificial Sequence
  Synthetic
atgcggacgcctcagttgatcatcgacattatcgttggtggtcactggggcgttcttgctgggctactgtactac

SEQ ID NO: 109346 - DNA, 75 bp, Artificial Sequence
  Synthetic
atgcggacgcctcagttgatcatcgacattatcgttggtggtcactggggcgttcttgctgggcttctgtactac

SEQ ID NO: 109347 - DNA, 75 bp, Artificial Sequence
  Synthetic
atgcggacgcctcagttgatcatcgacattatcgttggtggtcactggggcgttcttgctgggctcctgtactac

SEQ ID NO: 109348 - DNA, 75 bp, Artificial Sequence
  Synthetic
atgcggacgcctcagttgatcatcgacattatcgttggtggtcactggggcgttcttgctgggctgctgtactac

SEQ ID NO: 109349 - DNA, 75 bp, Artificial Sequence
  Synthetic
atgcggacgcctcagttgatcatcgacattttcgttggtggtcactggggcgttcttgctgggctactgtactac

SEQ ID NO: 109350 - DNA, 75 bp, Artificial Sequence
  Synthetic
atgcggacgcctcagttgatcatcgacattttcgttggtggtcactggggcgttcttgctgggcttctgtactac

SEQ ID NO: 109351 - DNA, 75 bp, Artificial Sequence
  Synthetic
atgcggacgcctcagttgatcatcgacattttcgttggtggtcactggggcgttcttgctgggctcctgtactac

SEQ ID NO: 109352 - DNA, 75 bp, Artificial Sequence
  Synthetic
atgcggacgcctcagttgatcatcgacattttcgttggtggtcactggggcgttcttgctgggctgctgtactac

SEQ ID NO: 109353 - DNA, 75 bp, Artificial Sequence
  Synthetic
atgcggacgcctcagttgatcatcgacattctcgttggtggtcactggggcgttcttgctgggctactgtactac

SEQ ID NO: 109354 - DNA, 75 bp, Artificial Sequence
  Synthetic
atgcggacgcctcagttgatcatcgacattctcgttggtggtcactggggcgttcttgctgggcttctgtactac

SEQ ID NO: 109355 - DNA, 75 bp, Artificial Sequence
  Synthetic
atgcggacgcctcagttgatcatcgacattctcgttggtggtcactggggcgttcttgctgggctcctgtactac

SEQ ID NO: 109356 - DNA, 75 bp, Artificial Sequence
  Synthetic
atgcggacgcctcagttgatcatcgacattctcgttggtggtcactggggcgttcttgctgggctgctgtactac

SEQ ID NO: 109357 - DNA, 75 bp, Artificial Sequence
  Synthetic
atgcggacgcctcagttgatcatcgacattgtcgttggtggtcactggggcgttcttgctgggctactgtactac

SEQ ID NO: 109358 - DNA, 75 bp, Artificial Sequence
  Synthetic
atgcggacgcctcagttgatcatcgacattgtcgttggtggtcactggggcgttcttgctgggcttctgtactac

SEQ ID NO: 109359 - DNA, 75 bp, Artificial Sequence
  Synthetic
atgcggacgcctcagttgatcatcgacattgtcgttggtggtcactggggcgttcttgctgggctcctgtactac

SEQ ID NO: 109360 - DNA, 75 bp, Artificial Sequence
  Synthetic
atgcggacgcctcagttgatcatcgacattgtcgttggtggtcactggggcgttcttgctgggctgctgtactac

SEQ ID NO: 109361 - DNA, 75 bp, Artificial Sequence
  Synthetic
atctccctgcaatcattcaaagactccatggcatggcagcattttcactccatggatactctccaaccgaactca

SEQ ID NO: 109362 - DNA, 75 bp, Artificial Sequence
  Synthetic
ggtaccttccccatcaatgagtacaccacaggaccctgcacgccttgcccatcacatacctactcccgcgcgtta

SEQ ID NO: 109363 - DNA, 75 bp, Artificial Sequence
  Synthetic
tcatcgccgcgctgttctaccatcacaagttcaacgcgtccggatgcccagaacgcatggcgagctgccgtccca

SEQ ID NO: 109364 - DNA, 75 bp, Artificial Sequence
  Synthetic
cgaagcttacaaacttattcagcctaggggccagccaaaaattgcagcttgtcaacaccaacggaagctggcaca

SEQ ID NO: 109365 - DNA, 75 bp, Artificial Sequence
  Synthetic
gaaagcggctatatgcggcacgtacctctttaactgggcggtgaaaactaagctcaaactcactccattggccgc

SEQ ID NO: 109366 - DNA, 75 bp, Artificial Sequence
  Synthetic
tgccggcacctgaattcttcaccgaggtagacggggtaagacttcatcgatacgcccctgcatgcaagcccttgt

SEQ ID NO: 109367 - DNA, 75 bp, Artificial Sequence
  Synthetic
tttgccgacctcatggggtacatacccgtcgtaggcgctccagttggcggcgtcgccagagccctcgcgcatggc

SEQ ID NO: 109368 - DNA, 75 bp, Artificial Sequence
  Synthetic
gctcgccgcatgtaagcctatcacatactttgaccaaggatggggtcccatctcgtacgccaacgtgagtgggcc

SEQ ID NO: 109369 - DNA, 75 bp, Artificial Sequence
  Synthetic
ggggaagtgtcgcccacgacttgtcaagaataacaagcttcttcacaccaggccctaagcagaacatccagttga

SEQ ID NO: 109370 - DNA, 75 bp, Artificial Sequence
  Synthetic
tcgtggcaactgatgccctcatgaccggctataccggcgacttcgactcggtgatagactgcaacacgtgtgtca

SEQ ID NO: 109371 - DNA, 75 bp, Artificial Sequence
  Synthetic
gctgagagacccttcccacatcaccgccgcagcggcagcacgtcgcttggcacgtgggtctcctccgtcagaagc

SEQ ID NO: 109372 - DNA, 75 bp, Artificial Sequence
  Synthetic
cagtgtccgctgtggaggtcaagaacaccagccagacctacatggccaccaatgactgctctaacagcagcatca

SEQ ID NO: 109373 - DNA, 75 bp, Artificial Sequence
  Synthetic
cctgtggttgtaggcactacggacagacggggggcgcccacctacacgttcggtgagaacgagactgacgtcctc

SEQ ID NO: 109374 - DNA, 75 bp, Artificial Sequence
  Synthetic
gtcagggcaatcgaggacggggttaactatgcaacggggaatcttcctggttgctctttctctatctttctattg

SEQ ID NO: 109375 - DNA, 75 bp, Artificial Sequence
  Synthetic
aggtggaggcatgacatgggcggcaacatcacacgggtggagtctgaaaccaaggtggtcattctcgattcgttc

SEQ ID NO: 109376 - DNA, 75 bp, Artificial Sequence
  Synthetic
aatgctgtagcgtattaccggggtctcgatgtgtccgtcataccgaccagcggagacgtcgttgtcgtggcaaca

SEQ ID NO: 109377 - DNA, 75 bp, Artificial Sequence
  Synthetic
tgccgtgagggagagaggggcgctcactaaaggcctgcgggctcacatcgacgtgatcgtgatgtccgccacgct

SEQ ID NO: 109378 - DNA, 75 bp, Artificial Sequence
  Synthetic
actaaaggcctgcgggctcacatcgacgtgatcgtgatgtccgccacgctctgctctgctctatacgtaggggat

SEQ ID NO: 109379 - DNA, 75 bp, Artificial Sequence
  Synthetic
tcggacctgagtccaacaagtcgctaatctgtcccactgattgcttccggaaacatccggaggccacctatggga

SEQ ID NO: 109380 - DNA, 75 bp, Artificial Sequence
  Synthetic
tttacgaagcggatactgtcattttacacctccctggatgcatcccgtgcatcaaaacaggaaatgagtctaagt

SEQ ID NO: 109381 - DNA, 75 bp, Artificial Sequence
  Synthetic
tttacgaagcggatactgtcattttacacctccctggatgcatcccgtgcatcaaaacaggatatgagtctaagt

SEQ ID NO: 109382 - DNA, 75 bp, Artificial Sequence
  Synthetic
tttacgaagcggatactgtcattttacacctccctggatgcatcccgtgcatcaaaacaggacatgagtctaagt

SEQ ID NO: 109383 - DNA, 75 bp, Artificial Sequence
  Synthetic
tttacgaagcggatactgtcattttacacctccctggatgcatcccgtgcatcaaaacaggagatgagtctaagt

SEQ ID NO: 109384 - DNA, 75 bp, Artificial Sequence
  Synthetic
ggccagactacaatccaccattaatagagcagtggaagaaaccggactatgtgccaccatctgtccacgggtgtc

SEQ ID NO: 109385 - DNA, 75 bp, Artificial Sequence
  Synthetic
ttaataacaccaggccaccgctgggcaactggttcggttgcacctggatgaactcaactggattcaccaaagtgt

SEQ ID NO: 109386 - DNA, 75 bp, Artificial Sequence
  Synthetic
tcacaggacatcgcatggcgtgggacatgatgatgaactggtccccaacaaccaccatggtcgtggcctacctca

SEQ ID NO: 109387 - DNA, 75 bp, Artificial Sequence
  Synthetic
tttaccaccctaccagccttgtccactggcttaatccatctccatcagaacatcgtggatatacagtacctgtac

SEQ ID NO: 109388 - DNA, 75 bp, Artificial Sequence
  Synthetic
ccgtgtcttcctaggtggacttgaacatcgatttgaagcagcttgcaattggacccgtggtgagcgctgtgagct

SEQ ID NO: 109389 - DNA, 75 bp, Artificial Sequence
  Synthetic
ttgctcatctatgtacattggggatctgtgtggcggcgtatttctagtagggcaacttttcactttcaggccgag

SEQ ID NO: 109390 - DNA, 75 bp, Artificial Sequence
  Synthetic
ggagaagtctttcccgtcctcaccatcccaggaggcgagcagcccatcgttaggggtcgacgtgcagtctactca

SEQ ID NO: 109391 - DNA, 75 bp, Artificial Sequence
  Synthetic
cgtcgtcatcctcctactggttgcaggcgtggacgcgaacacgcgtacgatgggccacgtcgcggccagcaatac

SEQ ID NO: 109392 - DNA, 75 bp, Artificial Sequence
  Synthetic
gggttgatacacctgcaccagaacatcgtggacgttcaatacctctatggcatttcgcctgcgctggtgtcctgg

SEQ ID NO: 109393 - DNA, 75 bp, Artificial Sequence
  Synthetic
gtaggttatgtcatctctagtgttctgaggataccacaactgctcctggaaattttcctggagggccattggggt

SEQ ID NO: 109394 - DNA, 75 bp, Artificial Sequence
  Synthetic
tgcgactcttggtccaccgtcagcgatgatgcagggcaaaacgtggtttgctgctctatgtcttactcttggacc

SEQ ID NO: 109395 - DNA, 75 bp, Artificial Sequence
  Synthetic
atcaggaccgaggagtccatataccaggcctgctccctgcccgaggaggcccgcactgccatacactcgctgact

SEQ ID NO: 109396 - DNA, 75 bp, Artificial Sequence
  Synthetic
aggcctgctccctgcccgaggaggcccgcactgccatacactcgctgactgagagactttacgtaggagggccca

SEQ ID NO: 109397 - DNA, 75 bp, Artificial Sequence
  Synthetic
cagccatggagaacctggtcatgctcaacgctgcgtctgcagccagtaagcaggggtggatctggtgtgctgtct

SEQ ID NO: 109398 - DNA, 75 bp, Artificial Sequence
  Synthetic
aatgacagcctaaacaccggattcctcgcagccttgttctatgtgcacaagttcaactcctcgggctgcacgcca

SEQ ID NO: 109399 - DNA, 75 bp, Artificial Sequence
  Synthetic
aatgacagcctaaacaccggattcctcgcagccttgttctatgtgcacatgttcaactcctcgggctgcacgcca

SEQ ID NO: 109400 - DNA, 75 bp, Artificial Sequence
  Synthetic
aatgacagcctaaacaccggattcctcgcagccttgttctatgtgcacacgttcaactcctcgggctgcacgcca

SEQ ID NO: 109401 - DNA, 75 bp, Artificial Sequence
  Synthetic
aatgacagcctaaacaccggattcctcgcagccttgttctatgtgcacaggttcaactcctcgggctgcacgcca

SEQ ID NO: 109402 - DNA, 75 bp, Artificial Sequence
  Synthetic
gcagcgctgtcagtgagaacacccgcggccttgcttcactgttcacgcccggcgccaagcaaaacctccagctca

SEQ ID NO: 109403 - DNA, 75 bp, Artificial Sequence
  Synthetic
catccaagagcgccgctttacgccagaaaaaggttaccttcgacaggctgcaggtgcttgatgaccactacaaaa

SEQ ID NO: 109404 - DNA, 75 bp, Artificial Sequence
  Synthetic
ggcctactcggctgcattatcaccagtctcacaggccgggacaggaaccaggtcgagggggaggttcaagtagtt

SEQ ID NO: 109405 - DNA, 75 bp, Artificial Sequence
  Synthetic
gctggcattacccacccaagccatgtggcatcgtccccgcaaggaccgtgtgtggcccagtctactgttttactc

SEQ ID NO: 109406 - DNA, 75 bp, Artificial Sequence
  Synthetic
ccagcgcgcctacgcttacgacagtgagcaggccgcatccattggggcagtagtgcttgttgccatcactgtgct

SEQ ID NO: 109407 - DNA, 75 bp, Artificial Sequence
  Synthetic
caattcctctgggtgttccgagcgcttgtcccactgcaaaccgctacgcgatttcgcacagggttggggccctat

SEQ ID NO: 109408 - DNA, 75 bp, Artificial Sequence
  Synthetic
gacattcgggtacagtgcgagagatgtccgctccttatccggcaaggccattaaccagatcaactccgtctggga

SEQ ID NO: 109409 - DNA, 75 bp, Artificial Sequence
  Synthetic
tccgcgggggggttggtttgggtgcacctggatgaacgggactggattcaccaagacatgtggcgcgccaccttg

SEQ ID NO: 109410 - DNA, 75 bp, Artificial Sequence
  Synthetic
agtttccatgttcgggggggtcgagatgccgtgatactgctcacttgtttactccacccctctcttgggtttgac

SEQ ID NO: 109411 - DNA, 75 bp, Artificial Sequence
  Synthetic
cctgtttactgctttacacctagtcctgtggtaataggtactacagacgccagaggagtgcccacgtactcttgg

SEQ ID NO: 109412 - DNA, 75 bp, Artificial Sequence
  Synthetic
cgcctaatagtgtatcctgacctgggggtgcgtgtctgcgagaagcgcgccctgtatgacgtgattagtaagttg

SEQ ID NO: 109413 - DNA, 75 bp, Artificial Sequence
  Synthetic
aacaccgcccctactgctggcactatcccccaaagccttgtggtatcgtgccagcacggaatgtatgtggcccag

SEQ ID NO: 109414 - DNA, 75 bp, Artificial Sequence
  Synthetic
ccatggctgacccctaggtgcctggtagactatccctatagactctggcactacccatgcacagtcaatttcacc

SEQ ID NO: 109415 - DNA, 75 bp, Artificial Sequence
  Synthetic
tgtgcatgctcgcgcgccgcgtagcgtgtggcaagtatgttcaggcctgcctattgaagctaggagcttggacgg

SEQ ID NO: 109416 - DNA, 75 bp, Artificial Sequence
  Synthetic
cgtgcggagcacccccctgtgtaacacgacctggcccagatagtgacaacagaaccctaaagtgccctactgatt

SEQ ID NO: 109417 - DNA, 75 bp, Artificial Sequence
  Synthetic
ggttctcatatgacacccgctgcttcgactctactgtcactgaacaggacatcaggacggaagcggatatatacc

SEQ ID NO: 109418 - DNA, 75 bp, Artificial Sequence
  Synthetic
gaagtgaaataagcccattgttgcattccaccaccgagtgggccatcttgccctgcaccttcgctgacatgccgg

SEQ ID NO: 109419 - DNA, 75 bp, Artificial Sequence
  Synthetic
ggagaagaagatcataacctggggagcagacaccgccgcgtgcggtgacatcttggctggccttccggtgtcagc

SEQ ID NO: 109420 - DNA, 75 bp, Artificial Sequence
  Synthetic
cccttgcaccgtgaacttcactcttcatcgtgttcgggtctttgttgccggggtcgagcacaggttcgacgccgc

SEQ ID NO: 109421 - DNA, 75 bp, Artificial Sequence
  Synthetic
tggttatcgccgatgccgcgccagcggggttctgcctactagttttggcaatactgtcacctgttacatcaaagc

SEQ ID NO: 109422 - DNA, 75 bp, Artificial Sequence
  Synthetic
tctccaccgcaacacaaactttcctggcaacctgcgtcaacggcgtgtgctggactgtctttcacggcgccggct

SEQ ID NO: 109423 - DNA, 75 bp, Artificial Sequence
  Synthetic
gtgggtggtccttttgttcctgctcctcgcggacgctagggtctgcgcctgcctgtggatgctcatcttgctagg

SEQ ID NO: 109424 - DNA, 75 bp, Artificial Sequence
  Synthetic
cgtgggcaccactgacaggcagggcgtgcccacctatagttggggggaaaatgagaccgacgtcttcctgctaaa

SEQ ID NO: 109425 - DNA, 75 bp, Artificial Sequence
  Synthetic
ggattggtgggaacgattgtcaccagtctcaccggccgcgataaaaacgaagttgaaggcgagatacaggtggtt

SEQ ID NO: 109426 - DNA, 75 bp, Artificial Sequence
  Synthetic
tgcacattcacaaccatgccagcactttcaactggtctgatccatctgcaccagaatattgtggacgtacagtac

SEQ ID NO: 109427 - DNA, 75 bp, Artificial Sequence
  Synthetic
tgcacattcacaaccatgcctgcactttcaactggtctgatccatctgcaccagaatattgtggacgtacagtac

SEQ ID NO: 109428 - DNA, 75 bp, Artificial Sequence
  Synthetic
tgcacattcacaaccatgcccgcactttcaactggtctgatccatctgcaccagaatattgtggacgtacagtac

SEQ ID NO: 109429 - DNA, 75 bp, Artificial Sequence
  Synthetic
tgcacattcacaaccatgccggcactttcaactggtctgatccatctgcaccagaatattgtggacgtacagtac

SEQ ID NO: 109430 - DNA, 75 bp, Artificial Sequence
  Synthetic
aagctatgaccaggtactctgctccccccggcgagcagccgcaggctacctacgacctggagctcatttcatctt

SEQ ID NO: 109431 - DNA, 75 bp, Artificial Sequence
  Synthetic
tggcacttcaagggccggatagtccccctggccacgtactcatatcttggcctatggtccttcagcatcttgatt

SEQ ID NO: 109432 - DNA, 75 bp, Artificial Sequence
  Synthetic
cggtctgtcaaatgtacaccaacgtggatcaggacttggtaggctggccagcacctcctggcgcgaggtcattga

SEQ ID NO: 109433 - DNA, 75 bp, Artificial Sequence
  Synthetic
tatggctaatgttcctggttggccaagcagaggcggcgttggagaacgtggtcatgctcaacgcggcttcggctg

SEQ ID NO: 109434 - DNA, 75 bp, Artificial Sequence
  Synthetic
tattctactttctttcttggtggctccatcttagccctagtcacggctagctgtgaaaggtccgtgagccgcatg

SEQ ID NO: 109435 - DNA, 75 bp, Artificial Sequence
  Synthetic
cttacaaagtccttattggcctctgcttatggtggctcagctacctgttggtcttagctgaggccgccatccagg

SEQ ID NO: 109436 - DNA, 75 bp, Artificial Sequence
  Synthetic
tcccaggcccctaagcacactcaaggggtcatcgggagggcccctcctgtgtccgtcaggccatgtggttgggct

SEQ ID NO: 109437 - DNA, 75 bp, Artificial Sequence
  Synthetic
atggccactactttttttagtcttggctctacccaggagagcgttcgcgtatgaggggactttaccagcatcggc

SEQ ID NO: 109438 - DNA, 75 bp, Artificial Sequence
  Synthetic
ctccaagctcaagagcaactcggaaaagtcgttgacttcgagatgtacggagctacttatgcagtcactccatta

SEQ ID NO: 109439 - DNA, 75 bp, Artificial Sequence
  Synthetic
ggccgcgtcgtgtggcggcgttgttcttgtcgggttaatggcgctgactctgtcaccgtattacaagcgctatat

SEQ ID NO: 109440 - DNA, 75 bp, Artificial Sequence
  Synthetic
aactccacaccacctgccgtgccccagacatatcaggtggggtatctccatgccccgacaggcagcggcaagagc

SEQ ID NO: 109441 - DNA, 75 bp, Artificial Sequence
  Synthetic
cttagcgcttctcgggcctgcctacctactcaaaactgttttggcgcgtacgccgtacttcgtcagggcccaagt

SEQ ID NO: 109442 - DNA, 75 bp, Artificial Sequence
  Synthetic
cgcacggaagccatcctgcatgtctgggtgccatctttccgggtcagaggcggccgagacgcggtcatcgttctg

SEQ ID NO: 109443 - DNA, 75 bp, Artificial Sequence
  Synthetic
cgcacggaagccatcctgcatgtctgggtgccttctttccgggtcagaggcggccgagacgcggtcatcgttctg

SEQ ID NO: 109444 - DNA, 75 bp, Artificial Sequence
  Synthetic
cgcacggaagccatcctgcatgtctgggtgccctctttccgggtcagaggcggccgagacgcggtcatcgttctg

SEQ ID NO: 109445 - DNA, 75 bp, Artificial Sequence
  Synthetic
cgcacggaagccatcctgcatgtctgggtgccgtctttccgggtcagaggcggccgagacgcggtcatcgttctg

SEQ ID NO: 109446 - DNA, 75 bp, Artificial Sequence
  Synthetic
ccgacctaccggcattatctactggcctattgcaccttcaccagaacatcgtggacgtgcaatacctctatggac

SEQ ID NO: 109447 - DNA, 75 bp, Artificial Sequence
  Synthetic
tagaccgtgcaccatgagcacgaatcctaaacctcaaagaaaaaccaaacgtaacaccaaccgccgccccatgga

SEQ ID NO: 109448 - DNA, 75 bp, Artificial Sequence
  Synthetic
gcaaactccccacaacgcagcttcgacgtcacatcgatctgcttgtcgggggcgccaccctctgctcggccctct

SEQ ID NO: 109449 - DNA, 75 bp, Artificial Sequence
  Synthetic
gaccacctctccccaatgtcagactgggctgctaatggtctacgggacttcgcagtagccgtggaacctgtcatc

SEQ ID NO: 109450 - DNA, 75 bp, Artificial Sequence
  Synthetic
gactctttcgacccgcttcgagcggaggaggatgagagggaagtatccgttgcggcggagatcctgcggaaaacc

SEQ ID NO: 109451 - DNA, 75 bp, Artificial Sequence
  Synthetic
cttatggtatagacccaaacatcaggactggtgtcagaaccatcacaacgggtggccccattacatactccacct

SEQ ID NO: 109452 - DNA, 75 bp, Artificial Sequence
  Synthetic
cctatttcgtgcgcgctcacatcctcatgcgcgcatgcatgttcgtccgcggccttgctggcggaaattatgttc

SEQ ID NO: 109453 - DNA, 75 bp, Artificial Sequence
  Synthetic
cctatttcgtgcgcgctcacatcctcatgcgcgcatgcatgttcgtccgcggccttgctggcggtaattatgttc

SEQ ID NO: 109454 - DNA, 75 bp, Artificial Sequence
  Synthetic
cctatttcgtgcgcgctcacatcctcatgcgcgcatgcatgttcgtccgcggccttgctggcggcaattatgttc

SEQ ID NO: 109455 - DNA, 75 bp, Artificial Sequence
  Synthetic
cctatttcgtgcgcgctcacatcctcatgcgcgcatgcatgttcgtccgcggccttgctggcgggaattatgttc

SEQ ID NO: 109456 - DNA, 75 bp, Artificial Sequence
  Synthetic
cctatttcgtgcgcgctcacatcctcatgcgcgcttgcatgttcgtccgcggccttgctggcggaaattatgttc

SEQ ID NO: 109457 - DNA, 75 bp, Artificial Sequence
  Synthetic
cctatttcgtgcgcgctcacatcctcatgcgcgcttgcatgttcgtccgcggccttgctggcggtaattatgttc

SEQ ID NO: 109458 - DNA, 75 bp, Artificial Sequence
  Synthetic
cctatttcgtgcgcgctcacatcctcatgcgcgcttgcatgttcgtccgcggccttgctggcggcaattatgttc

SEQ ID NO: 109459 - DNA, 75 bp, Artificial Sequence
  Synthetic
cctatttcgtgcgcgctcacatcctcatgcgcgcttgcatgttcgtccgcggccttgctggcgggaattatgttc

SEQ ID NO: 109460 - DNA, 75 bp, Artificial Sequence
  Synthetic
cctatttcgtgcgcgctcacatcctcatgcgcgcctgcatgttcgtccgcggccttgctggcggaaattatgttc

SEQ ID NO: 109461 - DNA, 75 bp, Artificial Sequence
  Synthetic
cctatttcgtgcgcgctcacatcctcatgcgcgcctgcatgttcgtccgcggccttgctggcggtaattatgttc

SEQ ID NO: 109462 - DNA, 75 bp, Artificial Sequence
  Synthetic
cctatttcgtgcgcgctcacatcctcatgcgcgcctgcatgttcgtccgcggccttgctggcggcaattatgttc

SEQ ID NO: 109463 - DNA, 75 bp, Artificial Sequence
  Synthetic
cctatttcgtgcgcgctcacatcctcatgcgcgcctgcatgttcgtccgcggccttgctggcgggaattatgttc

SEQ ID NO: 109464 - DNA, 75 bp, Artificial Sequence
  Synthetic
cctatttcgtgcgcgctcacatcctcatgcgcgcgtgcatgttcgtccgcggccttgctggcggaaattatgttc

SEQ ID NO: 109465 - DNA, 75 bp, Artificial Sequence
  Synthetic
cctatttcgtgcgcgctcacatcctcatgcgcgcgtgcatgttcgtccgcggccttgctggcggtaattatgttc

SEQ ID NO: 109466 - DNA, 75 bp, Artificial Sequence
  Synthetic
cctatttcgtgcgcgctcacatcctcatgcgcgcgtgcatgttcgtccgcggccttgctggcggcaattatgttc

SEQ ID NO: 109467 - DNA, 75 bp, Artificial Sequence
  Synthetic
cctatttcgtgcgcgctcacatcctcatgcgcgcgtgcatgttcgtccgcggccttgctggcgggaattatgttc

SEQ ID NO: 109468 - DNA, 75 bp, Artificial Sequence
  Synthetic
cctatttcgtgcgcgctcacatcctcttgcgcgcatgcatgttcgtccgcggccttgctggcggaaattatgttc

SEQ ID NO: 109469 - DNA, 75 bp, Artificial Sequence
  Synthetic
cctatttcgtgcgcgctcacatcctcttgcgcgcatgcatgttcgtccgcggccttgctggcggtaattatgttc

SEQ ID NO: 109470 - DNA, 75 bp, Artificial Sequence
  Synthetic
cctatttcgtgcgcgctcacatcctcttgcgcgcatgcatgttcgtccgcggccttgctggcggcaattatgttc

SEQ ID NO: 109471 - DNA, 75 bp, Artificial Sequence
  Synthetic
cctatttcgtgcgcgctcacatcctcttgcgcgcatgcatgttcgtccgcggccttgctggcgggaattatgttc

SEQ ID NO: 109472 - DNA, 75 bp, Artificial Sequence
  Synthetic
cctatttcgtgcgcgctcacatcctcttgcgcgcttgcatgttcgtccgcggccttgctggcggaaattatgttc

SEQ ID NO: 109473 - DNA, 75 bp, Artificial Sequence
  Synthetic
cctatttcgtgcgcgctcacatcctcttgcgcgcttgcatgttcgtccgcggccttgctggcggtaattatgttc

SEQ ID NO: 109474 - DNA, 75 bp, Artificial Sequence
  Synthetic
cctatttcgtgcgcgctcacatcctcttgcgcgcttgcatgttcgtccgcggccttgctggcggcaattatgttc

SEQ ID NO: 109475 - DNA, 75 bp, Artificial Sequence
  Synthetic
cctatttcgtgcgcgctcacatcctcttgcgcgcttgcatgttcgtccgcggccttgctggcgggaattatgttc

SEQ ID NO: 109476 - DNA, 75 bp, Artificial Sequence
  Synthetic
cctatttcgtgcgcgctcacatcctcttgcgcgcctgcatgttcgtccgcggccttgctggcggaaattatgttc

SEQ ID NO: 109477 - DNA, 75 bp, Artificial Sequence
  Synthetic
cctatttcgtgcgcgctcacatcctcttgcgcgcctgcatgttcgtccgcggccttgctggcggtaattatgttc

SEQ ID NO: 109478 - DNA, 75 bp, Artificial Sequence
  Synthetic
cctatttcgtgcgcgctcacatcctcttgcgcgcctgcatgttcgtccgcggccttgctggcggcaattatgttc

SEQ ID NO: 109479 - DNA, 75 bp, Artificial Sequence
  Synthetic
cctatttcgtgcgcgctcacatcctcttgcgcgcctgcatgttcgtccgcggccttgctggcgggaattatgttc

SEQ ID NO: 109480 - DNA, 75 bp, Artificial Sequence
  Synthetic
cctatttcgtgcgcgctcacatcctcttgcgcgcgtgcatgttcgtccgcggccttgctggcggaaattatgttc

SEQ ID NO: 109481 - DNA, 75 bp, Artificial Sequence
  Synthetic
cctatttcgtgcgcgctcacatcctcttgcgcgcgtgcatgttcgtccgcggccttgctggcggtaattatgttc

SEQ ID NO: 109482 - DNA, 75 bp, Artificial Sequence
  Synthetic
cctatttcgtgcgcgctcacatcctcttgcgcgcgtgcatgttcgtccgcggccttgctggcggcaattatgttc

SEQ ID NO: 109483 - DNA, 75 bp, Artificial Sequence
  Synthetic
cctatttcgtgcgcgctcacatcctcttgcgcgcgtgcatgttcgtccgcggccttgctggcgggaattatgttc

SEQ ID NO: 109484 - DNA, 75 bp, Artificial Sequence
  Synthetic
cctatttcgtgcgcgctcacatcctcctgcgcgcatgcatgttcgtccgcggccttgctggcggaaattatgttc

SEQ ID NO: 109485 - DNA, 75 bp, Artificial Sequence
  Synthetic
cctatttcgtgcgcgctcacatcctcctgcgcgcatgcatgttcgtccgcggccttgctggcggtaattatgttc

SEQ ID NO: 109486 - DNA, 75 bp, Artificial Sequence
  Synthetic
cctatttcgtgcgcgctcacatcctcctgcgcgcatgcatgttcgtccgcggccttgctggcggcaattatgttc

SEQ ID NO: 109487 - DNA, 75 bp, Artificial Sequence
  Synthetic
cctatttcgtgcgcgctcacatcctcctgcgcgcatgcatgttcgtccgcggccttgctggcgggaattatgttc

SEQ ID NO: 109488 - DNA, 75 bp, Artificial Sequence
  Synthetic
cctatttcgtgcgcgctcacatcctcctgcgcgcttgcatgttcgtccgcggccttgctggcggaaattatgttc

SEQ ID NO: 109489 - DNA, 75 bp, Artificial Sequence
  Synthetic
cctatttcgtgcgcgctcacatcctcctgcgcgcttgcatgttcgtccgcggccttgctggcggtaattatgttc

SEQ ID NO: 109490 - DNA, 75 bp, Artificial Sequence
  Synthetic
cctatttcgtgcgcgctcacatcctcctgcgcgcttgcatgttcgtccgcggccttgctggcggcaattatgttc

SEQ ID NO: 109491 - DNA, 75 bp, Artificial Sequence
  Synthetic
cctatttcgtgcgcgctcacatcctcctgcgcgcttgcatgttcgtccgcggccttgctggcgggaattatgttc

SEQ ID NO: 109492 - DNA, 75 bp, Artificial Sequence
  Synthetic
cctatttcgtgcgcgctcacatcctcctgcgcgcctgcatgttcgtccgcggccttgctggcggaaattatgttc

SEQ ID NO: 109493 - DNA, 75 bp, Artificial Sequence
  Synthetic
cctatttcgtgcgcgctcacatcctcctgcgcgcctgcatgttcgtccgcggccttgctggcggtaattatgttc

SEQ ID NO: 109494 - DNA, 75 bp, Artificial Sequence
  Synthetic
cctatttcgtgcgcgctcacatcctcctgcgcgcctgcatgttcgtccgcggccttgctggcggcaattatgttc

SEQ ID NO: 109495 - DNA, 75 bp, Artificial Sequence
  Synthetic
cctatttcgtgcgcgctcacatcctcctgcgcgcctgcatgttcgtccgcggccttgctggcgggaattatgttc

SEQ ID NO: 109496 - DNA, 75 bp, Artificial Sequence
  Synthetic
cctatttcgtgcgcgctcacatcctcctgcgcgcgtgcatgttcgtccgcggccttgctggcggaaattatgttc

SEQ ID NO: 109497 - DNA, 75 bp, Artificial Sequence
  Synthetic
cctatttcgtgcgcgctcacatcctcctgcgcgcgtgcatgttcgtccgcggccttgctggcggtaattatgttc

SEQ ID NO: 109498 - DNA, 75 bp, Artificial Sequence
  Synthetic
cctatttcgtgcgcgctcacatcctcctgcgcgcgtgcatgttcgtccgcggccttgctggcggcaattatgttc

SEQ ID NO: 109499 - DNA, 75 bp, Artificial Sequence
  Synthetic
cctatttcgtgcgcgctcacatcctcctgcgcgcgtgcatgttcgtccgcggccttgctggcgggaattatgttc

SEQ ID NO: 109500 - DNA, 75 bp, Artificial Sequence
  Synthetic
cctatttcgtgcgcgctcacatcctcgtgcgcgcatgcatgttcgtccgcggccttgctggcggaaattatgttc

SEQ ID NO: 109501 - DNA, 75 bp, Artificial Sequence
  Synthetic
cctatttcgtgcgcgctcacatcctcgtgcgcgcatgcatgttcgtccgcggccttgctggcggtaattatgttc

SEQ ID NO: 109502 - DNA, 75 bp, Artificial Sequence
  Synthetic
cctatttcgtgcgcgctcacatcctcgtgcgcgcatgcatgttcgtccgcggccttgctggcggcaattatgttc

SEQ ID NO: 109503 - DNA, 75 bp, Artificial Sequence
  Synthetic
cctatttcgtgcgcgctcacatcctcgtgcgcgcatgcatgttcgtccgcggccttgctggcgggaattatgttc

SEQ ID NO: 109504 - DNA, 75 bp, Artificial Sequence
  Synthetic
cctatttcgtgcgcgctcacatcctcgtgcgcgcttgcatgttcgtccgcggccttgctggcggaaattatgttc

SEQ ID NO: 109505 - DNA, 75 bp, Artificial Sequence
  Synthetic
cctatttcgtgcgcgctcacatcctcgtgcgcgcttgcatgttcgtccgcggccttgctggcggtaattatgttc

SEQ ID NO: 109506 - DNA, 75 bp, Artificial Sequence
  Synthetic
cctatttcgtgcgcgctcacatcctcgtgcgcgcttgcatgttcgtccgcggccttgctggcggcaattatgttc

SEQ ID NO: 109507 - DNA, 75 bp, Artificial Sequence
  Synthetic
cctatttcgtgcgcgctcacatcctcgtgcgcgcttgcatgttcgtccgcggccttgctggcgggaattatgttc

SEQ ID NO: 109508 - DNA, 75 bp, Artificial Sequence
  Synthetic
cctatttcgtgcgcgctcacatcctcgtgcgcgcctgcatgttcgtccgcggccttgctggcggaaattatgttc

SEQ ID NO: 109509 - DNA, 75 bp, Artificial Sequence
  Synthetic
cctatttcgtgcgcgctcacatcctcgtgcgcgcctgcatgttcgtccgcggccttgctggcggtaattatgttc

SEQ ID NO: 109510 - DNA, 75 bp, Artificial Sequence
  Synthetic
cctatttcgtgcgcgctcacatcctcgtgcgcgcctgcatgttcgtccgcggccttgctggcggcaattatgttc

SEQ ID NO: 109511 - DNA, 75 bp, Artificial Sequence
  Synthetic
cctatttcgtgcgcgctcacatcctcgtgcgcgcctgcatgttcgtccgcggccttgctggcgggaattatgttc

SEQ ID NO: 109512 - DNA, 75 bp, Artificial Sequence
  Synthetic
cctatttcgtgcgcgctcacatcctcgtgcgcgcgtgcatgttcgtccgcggccttgctggcggaaattatgttc

SEQ ID NO: 109513 - DNA, 75 bp, Artificial Sequence
  Synthetic
cctatttcgtgcgcgctcacatcctcgtgcgcgcgtgcatgttcgtccgcggccttgctggcggtaattatgttc

SEQ ID NO: 109514 - DNA, 75 bp, Artificial Sequence
  Synthetic
cctatttcgtgcgcgctcacatcctcgtgcgcgcgtgcatgttcgtccgcggccttgctggcggcaattatgttc

SEQ ID NO: 109515 - DNA, 75 bp, Artificial Sequence
  Synthetic
cctatttcgtgcgcgctcacatcctcgtgcgcgcgtgcatgttcgtccgcggccttgctggcgggaattatgttc

SEQ ID NO: 109516 - DNA, 75 bp, Artificial Sequence
  Synthetic
gtaggcatcttcctcctaccggctcggtgagctggtaggacaacactccatttctgtgttttttttttttttttt

SEQ ID NO: 109517 - DNA, 75 bp, Artificial Sequence
  Synthetic
aggtcctactaggccctgctgatggttacacctccaagggatggaaactcctagcgcccatcaccgcctatgctc

SEQ ID NO: 109518 - DNA, 75 bp, Artificial Sequence
  Synthetic
cggcaccgtcctagaccaagcagaaacagctgatgtgcgcctcacagtcttagcgaccgccacgccccctgggtc

SEQ ID NO: 109519 - DNA, 75 bp, Artificial Sequence
  Synthetic
cggcaccgtcctagaccaagcagaaacagctgttgtgcgcctcacagtcttagcgaccgccacgccccctgggtc

SEQ ID NO: 109520 - DNA, 75 bp, Artificial Sequence
  Synthetic
cggcaccgtcctagaccaagcagaaacagctgctgtgcgcctcacagtcttagcgaccgccacgccccctgggtc

SEQ ID NO: 109521 - DNA, 75 bp, Artificial Sequence
  Synthetic
cggcaccgtcctagaccaagcagaaacagctggtgtgcgcctcacagtcttagcgaccgccacgccccctgggtc

SEQ ID NO: 109522 - DNA, 75 bp, Artificial Sequence
  Synthetic
tgtcgctgtagagccggtcatcttctccccaatggagaaaaaggtcatcacttggggcgctgacactgcagcttg

SEQ ID NO: 109523 - DNA, 75 bp, Artificial Sequence
  Synthetic
atattagtaatcatatccatctttactctcaccccagcatacaagattctcctgagccgttcagtgtggtggctg

SEQ ID NO: 109524 - DNA, 75 bp, Artificial Sequence
  Synthetic
gctcctgtcacctcgcggctctcggccatcctggggccccaatgatccccggcggaggtcgcgcaatttgggtaa

SEQ ID NO: 109525 - DNA, 75 bp, Artificial Sequence
  Synthetic
atccttcctcgggacgtcaatatcaggggtcctctggacggtctttcacggcgcaggaaacaagacgctggccgg

SEQ ID NO: 109526 - DNA, 75 bp, Artificial Sequence
  Synthetic
atccttcctcgggacgtcaatatcaggggtcctctggacggtctttcacggcgctggaaacaagacgctggccgg

SEQ ID NO: 109527 - DNA, 75 bp, Artificial Sequence
  Synthetic
atccttcctcgggacgtcaatatcaggggtcctctggacggtctttcacggcgccggaaacaagacgctggccgg

SEQ ID NO: 109528 - DNA, 75 bp, Artificial Sequence
  Synthetic
atccttcctcgggacgtcaatatcaggggtcctctggacggtctttcacggcgcgggaaacaagacgctggccgg

SEQ ID NO: 109529 - DNA, 75 bp, Artificial Sequence
  Synthetic
ggtaggcacctcattttctgtcactcaaagaagaaatgcgatgagctggccggccagctgcgaaatcttggcctg

SEQ ID NO: 109530 - DNA, 75 bp, Artificial Sequence
  Synthetic
gcccctatcacggcttacgcgcaacaaactcgaggcgtgttaggcaccatcgtgactagcctcacgggccgtgac

SEQ ID NO: 109531 - DNA, 75 bp, Artificial Sequence
  Synthetic
actatgcaacagggaatcttcctggttgctccttttctatcttccttctggcactcctctcgtgcctaactgtcc

SEQ ID NO: 109532 - DNA, 75 bp, Artificial Sequence
  Synthetic
ggtgcctctgacttgtacctcgtcacccgaaacgccgatgtcatcccggcccggaggcgaggggatcggcggggg

SEQ ID NO: 109533 - DNA, 75 bp, Artificial Sequence
  Synthetic
gcacttaccggggtgtgtgccctgtgtgaggaccgggaacacttcacgctgctggacatctctaacacccaccgt

SEQ ID NO: 109534 - DNA, 75 bp, Artificial Sequence
  Synthetic
gcgacttcgactctgtaattgactgcaatgttgcggtcactcagatagtcgacttcagcctagaccctacctttg

SEQ ID NO: 109535 - DNA, 75 bp, Artificial Sequence
  Synthetic
ccggctctaagacccttgctggtcccaaaggacctatatgccagatgtacaccaatgtggaccaggacattgtgg

SEQ ID NO: 109536 - DNA, 75 bp, Artificial Sequence
  Synthetic
ggctggggccctatcagctacgccaacggaagtggccccgaacaccggccctactgctggcactaccccccaaaa

SEQ ID NO: 109537 - DNA, 75 bp, Artificial Sequence
  Synthetic
tgtgctccaggggggtagcaaagtccatagacttcatacccatcgagtcattggacgtcatcaccaggtccccca

SEQ ID NO: 109538 - DNA, 75 bp, Artificial Sequence
  Synthetic
ctctgcggaggtgtcttcctagttgggcagatgttcactttccagccgcgtcgccactggaccacccaggactgc

SEQ ID NO: 109539 - DNA, 75 bp, Artificial Sequence
  Synthetic
gggcgaacggccgtctggcatgtttgacactgttgtgctctgcgaggcatatgacgtggggtgtgcatggtatga

SEQ ID NO: 109540 - DNA, 75 bp, Artificial Sequence
  Synthetic
acgcaggggggacaaccgtgcagctctcctcagccccagacccataagtactcttaaagggtcgtccggcggacc

SEQ ID NO: 109541 - DNA, 75 bp, Artificial Sequence
  Synthetic
ccttgtggtatcgtgccagcacagagcgtatgtggcccagtgtattgcttcactcccagccccgtggtggtggga

SEQ ID NO: 109542 - DNA, 75 bp, Artificial Sequence
  Synthetic
gtggaaagaccttctggaagacagtgtaacaccaatagatactaccatcatggccaagaacgaggttttctgcgt

SEQ ID NO: 109543 - DNA, 75 bp, Artificial Sequence
  Synthetic
cgcctatgctgcccaagggtacaaagtactggtactgaacccctctgtggccgctaccctagggtttggggccta

SEQ ID NO: 109544 - DNA, 75 bp, Artificial Sequence
  Synthetic
tgcgggtcccctctgtcctcattgatattctcagtgggggccattggggtgtcctggcagggctcgcattcttcg

SEQ ID NO: 109545 - DNA, 75 bp, Artificial Sequence
  Synthetic
acgggcttgacccacatcgatgctcacttcctgtcacaaaccaaacaggggggagaaaacttcgcatacctagtg

SEQ ID NO: 109546 - DNA, 75 bp, Artificial Sequence
  Synthetic
acgggcttgacccacatcgatgctcacttcctgtcacaaaccaaacaggggggagaaaacttcgcataccttgtg

SEQ ID NO: 109547 - DNA, 75 bp, Artificial Sequence
  Synthetic
acgggcttgacccacatcgatgctcacttcctgtcacaaaccaaacaggggggagaaaacttcgcatacctcgtg

SEQ ID NO: 109548 - DNA, 75 bp, Artificial Sequence
  Synthetic
acgggcttgacccacatcgatgctcacttcctgtcacaaaccaaacaggggggagaaaacttcgcatacctggtg

SEQ ID NO: 109549 - DNA, 75 bp, Artificial Sequence
  Synthetic
cagtcctcccaacggtctccatccttctctgacaattcatctcctcctgccgtcccgcagacttaccaggtgggg

SEQ ID NO: 109550 - DNA, 75 bp, Artificial Sequence
  Synthetic
gccgatgggggttgcgcaggtggggcgtacgacgtcataatatgtgatgagtgtcactccaccgacgcaactacc

SEQ ID NO: 109551 - DNA, 75 bp, Artificial Sequence
  Synthetic
ctctgggcttggcggcctcttcacccccggggctaagcagaacatccagctcataaacaccaacggaagctggca

SEQ ID NO: 109552 - DNA, 75 bp, Artificial Sequence
  Synthetic
ctacgcccctgctgtacaggcttgggtccgtacaaaatgagatcacgaccacgcatccaatcactaaatacatca

SEQ ID NO: 109553 - DNA, 75 bp, Artificial Sequence
  Synthetic
ccaccctcggattcggggcctacatgtcgactgcacacggcatagaccctaatgtccgcacaggggtacgcacaa

SEQ ID NO: 109554 - DNA, 75 bp, Artificial Sequence
  Synthetic
atcccaatatagaggaggtcgcccttggccacgagggtgagatcccattctatgggaaggcgatccccctatccc

SEQ ID NO: 109555 - DNA, 75 bp, Artificial Sequence
  Synthetic
aggcttgcgtcatgcaagcgtctggaggacttctcccagggttggggccggctcactgccagcaacatcagcggc

SEQ ID NO: 109556 - DNA, 75 bp, Artificial Sequence
  Synthetic
tgccgtaatatgcggcagggttattgtatccggcaagcctgtaccagtgccagatcgtgaagtactctttcggca

SEQ ID NO: 109557 - DNA, 75 bp, Artificial Sequence
  Synthetic
tgccgtaatatgcggcagggttattgtatccggcaagcctgtaccagtgccagatcgtgatgtactctttcggca

SEQ ID NO: 109558 - DNA, 75 bp, Artificial Sequence
  Synthetic
tgccgtaatatgcggcagggttattgtatccggcaagcctgtaccagtgccagatcgtgacgtactctttcggca

SEQ ID NO: 109559 - DNA, 75 bp, Artificial Sequence
  Synthetic
tgccgtaatatgcggcagggttattgtatccggcaagcctgtaccagtgccagatcgtgaggtactctttcggca

SEQ ID NO: 109560 - DNA, 75 bp, Artificial Sequence
  Synthetic
tgccgttatatgcggcagggttattgtatccggcaagcctgtaccagtgccagatcgtgaagtactctttcggca

SEQ ID NO: 109561 - DNA, 75 bp, Artificial Sequence
  Synthetic
tgccgttatatgcggcagggttattgtatccggcaagcctgtaccagtgccagatcgtgatgtactctttcggca

SEQ ID NO: 109562 - DNA, 75 bp, Artificial Sequence
  Synthetic
tgccgttatatgcggcagggttattgtatccggcaagcctgtaccagtgccagatcgtgacgtactctttcggca

SEQ ID NO: 109563 - DNA, 75 bp, Artificial Sequence
  Synthetic
tgccgttatatgcggcagggttattgtatccggcaagcctgtaccagtgccagatcgtgaggtactctttcggca

SEQ ID NO: 109564 - DNA, 75 bp, Artificial Sequence
  Synthetic
tgccgtcatatgcggcagggttattgtatccggcaagcctgtaccagtgccagatcgtgaagtactctttcggca

SEQ ID NO: 109565 - DNA, 75 bp, Artificial Sequence
  Synthetic
tgccgtcatatgcggcagggttattgtatccggcaagcctgtaccagtgccagatcgtgatgtactctttcggca

SEQ ID NO: 109566 - DNA, 75 bp, Artificial Sequence
  Synthetic
tgccgtcatatgcggcagggttattgtatccggcaagcctgtaccagtgccagatcgtgacgtactctttcggca

SEQ ID NO: 109567 - DNA, 75 bp, Artificial Sequence
  Synthetic
tgccgtcatatgcggcagggttattgtatccggcaagcctgtaccagtgccagatcgtgaggtactctttcggca

SEQ ID NO: 109568 - DNA, 75 bp, Artificial Sequence
  Synthetic
tgccgtgatatgcggcagggttattgtatccggcaagcctgtaccagtgccagatcgtgaagtactctttcggca

SEQ ID NO: 109569 - DNA, 75 bp, Artificial Sequence
  Synthetic
tgccgtgatatgcggcagggttattgtatccggcaagcctgtaccagtgccagatcgtgatgtactctttcggca

SEQ ID NO: 109570 - DNA, 75 bp, Artificial Sequence
  Synthetic
tgccgtgatatgcggcagggttattgtatccggcaagcctgtaccagtgccagatcgtgacgtactctttcggca

SEQ ID NO: 109571 - DNA, 75 bp, Artificial Sequence
  Synthetic
tgccgtgatatgcggcagggttattgtatccggcaagcctgtaccagtgccagatcgtgaggtactctttcggca

SEQ ID NO: 109572 - DNA, 75 bp, Artificial Sequence
  Synthetic
ccattcgacagacgcaactacagtgttgggaatagggaccgtccttgatcaggcggagactagtggggttaggct

SEQ ID NO: 109573 - DNA, 75 bp, Artificial Sequence
  Synthetic
ttgcagacgcgcgcatctgctcctgcttgtggatgatgctactcatatcccaagcggaggcagctttggagaacc

SEQ ID NO: 109574 - DNA, 75 bp, Artificial Sequence
  Synthetic
gcccagtagtcgtcggcacgaccgaccggctcggggctcccacctacagctggggggagaatgagaccgacgtga

SEQ ID NO: 109575 - DNA, 75 bp, Artificial Sequence
  Synthetic
agcacggctaagcaggctgaagagctaaaacccgcagtccagtctgcttggccgaagctcgaacaattctggcag

SEQ ID NO: 109576 - DNA, 75 bp, Artificial Sequence
  Synthetic
ctacagagggctcgacgtctccgtcataccagcccaaggagacgtggtggtggttgccaccgatgccctcatgac

SEQ ID NO: 109577 - DNA, 75 bp, Artificial Sequence
  Synthetic
ggcaaggcaatccccctagagtatatcaaggggggtagacatctcatattttgccactcgaaaaagaaatgcgac

SEQ ID NO: 109578 - DNA, 75 bp, Artificial Sequence
  Synthetic
actgtccctcaagactccgtctctcgtagccaacgccgagggcggacgggtaggggtaggttgggcatatacagg

SEQ ID NO: 109579 - DNA, 75 bp, Artificial Sequence
  Synthetic
cgtcagtaactggtcgtgtcccaccgattgcttcaggaagcacccggacgccacttaccttaagtgtggctcggg

SEQ ID NO: 109580 - DNA, 75 bp, Artificial Sequence
  Synthetic
tggcgttgccccaacgggcatacgcgctggacacggaggtggccgcgtcgtgtggcggcgttgttcttgtcgggt

SEQ ID NO: 109581 - DNA, 75 bp, Artificial Sequence
  Synthetic
ccttgaccagcccgctacccacttcaaccaccctccttcttaacatcctaggagggtgggtggcatcacaactag

SEQ ID NO: 109582 - DNA, 75 bp, Artificial Sequence
  Synthetic
gcgctaccgatgctcttatgaccggctacactggcaactttgactctgtaatagattgcaatgtttctgtcacac

SEQ ID NO: 109583 - DNA, 75 bp, Artificial Sequence
  Synthetic
taggggtaggttgggcatatacaggtatgtttcctctggtgagcgagcctccgggatgttcgacaccgtggtgct

SEQ ID NO: 109584 - DNA, 75 bp, Artificial Sequence
  Synthetic
ggtggggtcgaacatcggctggaagcagcgtgtaactggaccaggggggagccctgcggcctggagcatagagat

SEQ ID NO: 109585 - DNA, 75 bp, Artificial Sequence
  Synthetic
tgccaagaccatctggagttctgggaggcagtcttcactggcctcacgcacatagatgcccacttcctctcccaa

SEQ ID NO: 109586 - DNA, 75 bp, Artificial Sequence
  Synthetic
gtacggagcaggcgtgtctggagctctcgtggcttttaaaatcatgagcggcgaggctcctgctatggaagacat

SEQ ID NO: 109587 - DNA, 75 bp, Artificial Sequence
  Synthetic
ggggaagcatggggagtatagatacgtctcgcaaggagaacggccatctggtatcttcgataccattgtcctatg

SEQ ID NO: 109588 - DNA, 75 bp, Artificial Sequence
  Synthetic
cattttctgtcactcaaagaagaagtgcgacgagctcgccgcaaagctggtcgcactgggcatcaatgccgtggc

SEQ ID NO: 109589 - DNA, 75 bp, Artificial Sequence
  Synthetic
tccaccaaaacatcgtggacgtccagtacctttacggtgttggatctgccgtggtttcatgggcactcaaatggg

SEQ ID NO: 109590 - DNA, 75 bp, Artificial Sequence
  Synthetic
gcccagtggatgaataggctcatagcgtttgcctcacgtggcaatcacgtgtcacctacacactacgtgcctgaa

SEQ ID NO: 109591 - DNA, 75 bp, Artificial Sequence
  Synthetic
aatgcctaatacgacttaaacccacactggttggcccaacacctctgctatatcgcctaggctcggtcagcaatg

SEQ ID NO: 109592 - DNA, 75 bp, Artificial Sequence
  Synthetic
caagaccatcttgagttctgggaaggcgtcttcactggacttacccatattgatgcacacttcctctcacaaaca

SEQ ID NO: 109593 - DNA, 75 bp, Artificial Sequence
  Synthetic
caagaccatcttgagttctgggaaggcgtcttcactggacttacccatattgatgcacacttcctctcacaaact

SEQ ID NO: 109594 - DNA, 75 bp, Artificial Sequence
  Synthetic
caagaccatcttgagttctgggaaggcgtcttcactggacttacccatattgatgcacacttcctctcacaaacc

SEQ ID NO: 109595 - DNA, 75 bp, Artificial Sequence
  Synthetic
caagaccatcttgagttctgggaaggcgtcttcactggacttacccatattgatgcacacttcctctcacaaacg

SEQ ID NO: 109596 - DNA, 75 bp, Artificial Sequence
  Synthetic
agctcgctacaaaaacctttggcagctccgcatcatcggccattaacagcggcgcagggaccgcccctcctgacc

SEQ ID NO: 109597 - DNA, 75 bp, Artificial Sequence
  Synthetic
cctgatcaccctcaatgccatctcagctgcgggcacccatggtttccactacgcactcatcttcatctgcgtggc

SEQ ID NO: 109598 - DNA, 75 bp, Artificial Sequence
  Synthetic
cggccccgctggttctggttttgcctactcctgcttgctgcaggggtaggcatctacctcctccccaaccgatga

SEQ ID NO: 109599 - DNA, 75 bp, Artificial Sequence
  Synthetic
catgtaacaccacatggttgagggaggtttgggactgggtttgcacggtgttgtctgatttcaaggtgtggctga

SEQ ID NO: 109600 - DNA, 75 bp, Artificial Sequence
  Synthetic
ggccgcggttgctgcctattgcttagcgactggctgcgtgtccatcatcggccgtgtgcacatcaaccaaagggc

SEQ ID NO: 109601 - DNA, 75 bp, Artificial Sequence
  Synthetic
gccttatacgcctcaagcctatgctcacagggcccacccccctgctgtacaggctaggggccgtacaaaatgaaa

SEQ ID NO: 109602 - DNA, 75 bp, Artificial Sequence
  Synthetic
gcgtttgacggtgaggttgcaggggctataggcggcggcgttttagtcgccctgactatcctgacactgtcccca

SEQ ID NO: 109603 - DNA, 75 bp, Artificial Sequence
  Synthetic
tgggtgcggtgccaacatcgctggccacgtgaaaaatgggaccatgaaaatcgtcgggcccaagacatgcagtaa

SEQ ID NO: 109604 - DNA, 75 bp, Artificial Sequence
  Synthetic
gagatgttgaaatccaaaattcagggtctgttacaacaagctacgaagcaggcccaagacatacagcccgcggtt

SEQ ID NO: 109605 - DNA, 75 bp, Artificial Sequence
  Synthetic
tgccctagctgcctactgcttatcggtgggatgcgtggtcatctgcggcagggtatgcaccactggtaagcctgt

SEQ ID NO: 109606 - DNA, 75 bp, Artificial Sequence
  Synthetic
ggggcccacgggattctgtcatccttctcgtggcccttttccatccccacctggcctttgacattaccaaacatc

SEQ ID NO: 109607 - DNA, 75 bp, Artificial Sequence
  Synthetic
gaggattacgttgaggtcgttcgtgtgggagatcatcattatgtgacggccgccacagccgacaatcttaagtgc

SEQ ID NO: 109608 - DNA, 75 bp, Artificial Sequence
  Synthetic
atcctgccgtggcctcgatgatggcgttcagcgcagctctaaccagcccactgtccaccagcaccaccatcctct

SEQ ID NO: 109609 - DNA, 75 bp, Artificial Sequence
  Synthetic
caatttaaacaaaaggtcctcggtctcatccaaaccacgaccaagcaagcagaggagcttaagccggcggtgcgc

SEQ ID NO: 109610 - DNA, 75 bp, Artificial Sequence
  Synthetic
acgtgggctggcgcacggcaaatacatccagatggctctgctcaagttgggggctagcaccggcacgtatgtgtt

SEQ ID NO: 109611 - DNA, 75 bp, Artificial Sequence
  Synthetic
ccttcagtgtggggctcaacagttacgttcttggttcccagctcccttgcgagccggagccggacgtcttggtgc

SEQ ID NO: 109612 - DNA, 75 bp, Artificial Sequence
  Synthetic
aggcttaggtaagatactggtggacattctggctggatacggcgctggcatctcgggggccctcgtcgctttcaa

SEQ ID NO: 109613 - DNA, 75 bp, Artificial Sequence
  Synthetic
cggtcgtcggcggccccctagggggcgttgccgcagctctggcgcatggcgtccgagctgtggaggacgggatta

SEQ ID NO: 109614 - DNA, 75 bp, Artificial Sequence
  Synthetic
cagctatagcctccctcatgtctttctcggcctccctaactagccctctaccggcttccacaaccctcctactta

SEQ ID NO: 109615 - DNA, 75 bp, Artificial Sequence
  Synthetic
tctagcatcgtttatgaggcagatgatgtcattctgcatacccctgggtgtgtgccgtgtgtcaaaactgggaac

SEQ ID NO: 109616 - DNA, 75 bp, Artificial Sequence
  Synthetic
atattgtggggcgctgatgcggctgcgtgcggtgacattatcaggggcctcccagtctctgctaggcgtggcaat

SEQ ID NO: 109617 - DNA, 75 bp, Artificial Sequence
  Synthetic
tcaactctctgccccatccctaaagggtacatgcacaacagctggggtacaccccgacgcagagttgattgaggc

SEQ ID NO: 109618 - DNA, 75 bp, Artificial Sequence
  Synthetic
atcctgcgccgccacgtgggccaaggggaaggtgcagtccagtggatgaataggcttattgcctttgcttccagg

SEQ ID NO: 109619 - DNA, 75 bp, Artificial Sequence
  Synthetic
cacatcaggcatataccatgttaccaacgactgtcccaactcaagcatcgtgtaagaatctgaggctgtcatttt

SEQ ID NO: 109620 - DNA, 75 bp, Artificial Sequence
  Synthetic
cacatcaggcatataccatgttaccaacgactgtcccaactcaagcatcgtgtatgaatctgaggctgtcatttt

SEQ ID NO: 109621 - DNA, 75 bp, Artificial Sequence
  Synthetic
cacatcaggcatataccatgttaccaacgactgtcccaactcaagcatcgtgtacgaatctgaggctgtcatttt

SEQ ID NO: 109622 - DNA, 75 bp, Artificial Sequence
  Synthetic
cacatcaggcatataccatgttaccaacgactgtcccaactcaagcatcgtgtaggaatctgaggctgtcatttt

SEQ ID NO: 109623 - DNA, 75 bp, Artificial Sequence
  Synthetic
cacatcaggcatataccatgttaccaacgactgtcccaactctagcatcgtgtaagaatctgaggctgtcatttt

SEQ ID NO: 109624 - DNA, 75 bp, Artificial Sequence
  Synthetic
cacatcaggcatataccatgttaccaacgactgtcccaactctagcatcgtgtatgaatctgaggctgtcatttt

SEQ ID NO: 109625 - DNA, 75 bp, Artificial Sequence
  Synthetic
cacatcaggcatataccatgttaccaacgactgtcccaactctagcatcgtgtacgaatctgaggctgtcatttt

SEQ ID NO: 109626 - DNA, 75 bp, Artificial Sequence
  Synthetic
cacatcaggcatataccatgttaccaacgactgtcccaactctagcatcgtgtaggaatctgaggctgtcatttt

SEQ ID NO: 109627 - DNA, 75 bp, Artificial Sequence
  Synthetic
cacatcaggcatataccatgttaccaacgactgtcccaactccagcatcgtgtaagaatctgaggctgtcatttt

SEQ ID NO: 109628 - DNA, 75 bp, Artificial Sequence
  Synthetic
cacatcaggcatataccatgttaccaacgactgtcccaactccagcatcgtgtatgaatctgaggctgtcatttt

SEQ ID NO: 109629 - DNA, 75 bp, Artificial Sequence
  Synthetic
cacatcaggcatataccatgttaccaacgactgtcccaactccagcatcgtgtacgaatctgaggctgtcatttt

SEQ ID NO: 109630 - DNA, 75 bp, Artificial Sequence
  Synthetic
cacatcaggcatataccatgttaccaacgactgtcccaactccagcatcgtgtaggaatctgaggctgtcatttt

SEQ ID NO: 109631 - DNA, 75 bp, Artificial Sequence
  Synthetic
cacatcaggcatataccatgttaccaacgactgtcccaactcgagcatcgtgtaagaatctgaggctgtcatttt

SEQ ID NO: 109632 - DNA, 75 bp, Artificial Sequence
  Synthetic
cacatcaggcatataccatgttaccaacgactgtcccaactcgagcatcgtgtatgaatctgaggctgtcatttt

SEQ ID NO: 109633 - DNA, 75 bp, Artificial Sequence
  Synthetic
cacatcaggcatataccatgttaccaacgactgtcccaactcgagcatcgtgtacgaatctgaggctgtcatttt

SEQ ID NO: 109634 - DNA, 75 bp, Artificial Sequence
  Synthetic
cacatcaggcatataccatgttaccaacgactgtcccaactcgagcatcgtgtaggaatctgaggctgtcatttt

SEQ ID NO: 109635 - DNA, 75 bp, Artificial Sequence
  Synthetic
gcttgggaaggtcattgtggatgtgcttgctggttacggagctggtgtatcgggggcgcttgttgcattcaagat

SEQ ID NO: 109636 - DNA, 75 bp, Artificial Sequence
  Synthetic
cggcagcggtttgttcagcgctttacatcggagacttatgcggcggcgtgttcttggtaggccagatgtttacgt

SEQ ID NO: 109637 - DNA, 75 bp, Artificial Sequence
  Synthetic
caattgtgaccagcctcactggcagagataccaatgagaactgcggcgaggtccaggtgctgtccacggccacgc

SEQ ID NO: 109638 - DNA, 75 bp, Artificial Sequence
  Synthetic
acagatgacagagagatatccgtggccgctgagtgccatagaccgcccagacccaagtttccaccagctttgccc

SEQ ID NO: 109639 - DNA, 75 bp, Artificial Sequence
  Synthetic
ggcttcataactggattactgaggattgtcccattccgtgcgctggctcttggctcagcgacatatgggattggg

SEQ ID NO: 109640 - DNA, 75 bp, Artificial Sequence
  Synthetic
ctcaagcgccatgccgggccaagcgagggagctacccagtggatgaacaggctcatcgcgtatgcctcaagaggc

SEQ ID NO: 109641 - DNA, 75 bp, Artificial Sequence
  Synthetic
ctcaagcgccatgccgggccaagcgagggagctacccagtggatgaacaggctcatcgcgtatgcctctagaggc

SEQ ID NO: 109642 - DNA, 75 bp, Artificial Sequence
  Synthetic
ctcaagcgccatgccgggccaagcgagggagctacccagtggatgaacaggctcatcgcgtatgcctccagaggc

SEQ ID NO: 109643 - DNA, 75 bp, Artificial Sequence
  Synthetic
ctcaagcgccatgccgggccaagcgagggagctacccagtggatgaacaggctcatcgcgtatgcctcgagaggc

SEQ ID NO: 109644 - DNA, 75 bp, Artificial Sequence
  Synthetic
ctcaagcgccatgccgggccaagcgagggagctacccagtggatgaacaggctcatcgcgtttgcctcaagaggc

SEQ ID NO: 109645 - DNA, 75 bp, Artificial Sequence
  Synthetic
ctcaagcgccatgccgggccaagcgagggagctacccagtggatgaacaggctcatcgcgtttgcctctagaggc

SEQ ID NO: 109646 - DNA, 75 bp, Artificial Sequence
  Synthetic
ctcaagcgccatgccgggccaagcgagggagctacccagtggatgaacaggctcatcgcgtttgcctccagaggc

SEQ ID NO: 109647 - DNA, 75 bp, Artificial Sequence
  Synthetic
ctcaagcgccatgccgggccaagcgagggagctacccagtggatgaacaggctcatcgcgtttgcctcgagaggc

SEQ ID NO: 109648 - DNA, 75 bp, Artificial Sequence
  Synthetic
ctcaagcgccatgccgggccaagcgagggagctacccagtggatgaacaggctcatcgcgtctgcctcaagaggc

SEQ ID NO: 109649 - DNA, 75 bp, Artificial Sequence
  Synthetic
ctcaagcgccatgccgggccaagcgagggagctacccagtggatgaacaggctcatcgcgtctgcctctagaggc

SEQ ID NO: 109650 - DNA, 75 bp, Artificial Sequence
  Synthetic
ctcaagcgccatgccgggccaagcgagggagctacccagtggatgaacaggctcatcgcgtctgcctccagaggc

SEQ ID NO: 109651 - DNA, 75 bp, Artificial Sequence
  Synthetic
ctcaagcgccatgccgggccaagcgagggagctacccagtggatgaacaggctcatcgcgtctgcctcgagaggc

SEQ ID NO: 109652 - DNA, 75 bp, Artificial Sequence
  Synthetic
ctcaagcgccatgccgggccaagcgagggagctacccagtggatgaacaggctcatcgcgtgtgcctcaagaggc

SEQ ID NO: 109653 - DNA, 75 bp, Artificial Sequence
  Synthetic
ctcaagcgccatgccgggccaagcgagggagctacccagtggatgaacaggctcatcgcgtgtgcctctagaggc

SEQ ID NO: 109654 - DNA, 75 bp, Artificial Sequence
  Synthetic
ctcaagcgccatgccgggccaagcgagggagctacccagtggatgaacaggctcatcgcgtgtgcctccagaggc

SEQ ID NO: 109655 - DNA, 75 bp, Artificial Sequence
  Synthetic
ctcaagcgccatgccgggccaagcgagggagctacccagtggatgaacaggctcatcgcgtgtgcctcgagaggc

SEQ ID NO: 109656 - DNA, 75 bp, Artificial Sequence
  Synthetic
ctcaagcgccatgccgggccaagcgagggagcttcccagtggatgaacaggctcatcgcgtatgcctcaagaggc

SEQ ID NO: 109657 - DNA, 75 bp, Artificial Sequence
  Synthetic
ctcaagcgccatgccgggccaagcgagggagcttcccagtggatgaacaggctcatcgcgtatgcctctagaggc

SEQ ID NO: 109658 - DNA, 75 bp, Artificial Sequence
  Synthetic
ctcaagcgccatgccgggccaagcgagggagcttcccagtggatgaacaggctcatcgcgtatgcctccagaggc

SEQ ID NO: 109659 - DNA, 75 bp, Artificial Sequence
  Synthetic
ctcaagcgccatgccgggccaagcgagggagcttcccagtggatgaacaggctcatcgcgtatgcctcgagaggc

SEQ ID NO: 109660 - DNA, 75 bp, Artificial Sequence
  Synthetic
ctcaagcgccatgccgggccaagcgagggagcttcccagtggatgaacaggctcatcgcgtttgcctcaagaggc

SEQ ID NO: 109661 - DNA, 75 bp, Artificial Sequence
  Synthetic
ctcaagcgccatgccgggccaagcgagggagcttcccagtggatgaacaggctcatcgcgtttgcctctagaggc

SEQ ID NO: 109662 - DNA, 75 bp, Artificial Sequence
  Synthetic
ctcaagcgccatgccgggccaagcgagggagcttcccagtggatgaacaggctcatcgcgtttgcctccagaggc

SEQ ID NO: 109663 - DNA, 75 bp, Artificial Sequence
  Synthetic
ctcaagcgccatgccgggccaagcgagggagcttcccagtggatgaacaggctcatcgcgtttgcctcgagaggc

SEQ ID NO: 109664 - DNA, 75 bp, Artificial Sequence
  Synthetic
ctcaagcgccatgccgggccaagcgagggagcttcccagtggatgaacaggctcatcgcgtctgcctcaagaggc

SEQ ID NO: 109665 - DNA, 75 bp, Artificial Sequence
  Synthetic
ctcaagcgccatgccgggccaagcgagggagcttcccagtggatgaacaggctcatcgcgtctgcctctagaggc

SEQ ID NO: 109666 - DNA, 75 bp, Artificial Sequence
  Synthetic
ctcaagcgccatgccgggccaagcgagggagcttcccagtggatgaacaggctcatcgcgtctgcctccagaggc

SEQ ID NO: 109667 - DNA, 75 bp, Artificial Sequence
  Synthetic
ctcaagcgccatgccgggccaagcgagggagcttcccagtggatgaacaggctcatcgcgtctgcctcgagaggc

SEQ ID NO: 109668 - DNA, 75 bp, Artificial Sequence
  Synthetic
ctcaagcgccatgccgggccaagcgagggagcttcccagtggatgaacaggctcatcgcgtgtgcctcaagaggc

SEQ ID NO: 109669 - DNA, 75 bp, Artificial Sequence
  Synthetic
ctcaagcgccatgccgggccaagcgagggagcttcccagtggatgaacaggctcatcgcgtgtgcctctagaggc

SEQ ID NO: 109670 - DNA, 75 bp, Artificial Sequence
  Synthetic
ctcaagcgccatgccgggccaagcgagggagcttcccagtggatgaacaggctcatcgcgtgtgcctccagaggc

SEQ ID NO: 109671 - DNA, 75 bp, Artificial Sequence
  Synthetic
ctcaagcgccatgccgggccaagcgagggagcttcccagtggatgaacaggctcatcgcgtgtgcctcgagaggc

SEQ ID NO: 109672 - DNA, 75 bp, Artificial Sequence
  Synthetic
ctcaagcgccatgccgggccaagcgagggagctccccagtggatgaacaggctcatcgcgtatgcctcaagaggc

SEQ ID NO: 109673 - DNA, 75 bp, Artificial Sequence
  Synthetic
ctcaagcgccatgccgggccaagcgagggagctccccagtggatgaacaggctcatcgcgtatgcctctagaggc

SEQ ID NO: 109674 - DNA, 75 bp, Artificial Sequence
  Synthetic
ctcaagcgccatgccgggccaagcgagggagctccccagtggatgaacaggctcatcgcgtatgcctccagaggc

SEQ ID NO: 109675 - DNA, 75 bp, Artificial Sequence
  Synthetic
ctcaagcgccatgccgggccaagcgagggagctccccagtggatgaacaggctcatcgcgtatgcctcgagaggc

SEQ ID NO: 109676 - DNA, 75 bp, Artificial Sequence
  Synthetic
ctcaagcgccatgccgggccaagcgagggagctccccagtggatgaacaggctcatcgcgtttgcctcaagaggc

SEQ ID NO: 109677 - DNA, 75 bp, Artificial Sequence
  Synthetic
ctcaagcgccatgccgggccaagcgagggagctccccagtggatgaacaggctcatcgcgtttgcctctagaggc

SEQ ID NO: 109678 - DNA, 75 bp, Artificial Sequence
  Synthetic
ctcaagcgccatgccgggccaagcgagggagctccccagtggatgaacaggctcatcgcgtttgcctccagaggc

SEQ ID NO: 109679 - DNA, 75 bp, Artificial Sequence
  Synthetic
ctcaagcgccatgccgggccaagcgagggagctccccagtggatgaacaggctcatcgcgtttgcctcgagaggc

SEQ ID NO: 109680 - DNA, 75 bp, Artificial Sequence
  Synthetic
ctcaagcgccatgccgggccaagcgagggagctccccagtggatgaacaggctcatcgcgtctgcctcaagaggc

SEQ ID NO: 109681 - DNA, 75 bp, Artificial Sequence
  Synthetic
ctcaagcgccatgccgggccaagcgagggagctccccagtggatgaacaggctcatcgcgtctgcctctagaggc

SEQ ID NO: 109682 - DNA, 75 bp, Artificial Sequence
  Synthetic
ctcaagcgccatgccgggccaagcgagggagctccccagtggatgaacaggctcatcgcgtctgcctccagaggc

SEQ ID NO: 109683 - DNA, 75 bp, Artificial Sequence
  Synthetic
ctcaagcgccatgccgggccaagcgagggagctccccagtggatgaacaggctcatcgcgtctgcctcgagaggc

SEQ ID NO: 109684 - DNA, 75 bp, Artificial Sequence
  Synthetic
ctcaagcgccatgccgggccaagcgagggagctccccagtggatgaacaggctcatcgcgtgtgcctcaagaggc

SEQ ID NO: 109685 - DNA, 75 bp, Artificial Sequence
  Synthetic
ctcaagcgccatgccgggccaagcgagggagctccccagtggatgaacaggctcatcgcgtgtgcctctagaggc

SEQ ID NO: 109686 - DNA, 75 bp, Artificial Sequence
  Synthetic
ctcaagcgccatgccgggccaagcgagggagctccccagtggatgaacaggctcatcgcgtgtgcctccagaggc

SEQ ID NO: 109687 - DNA, 75 bp, Artificial Sequence
  Synthetic
ctcaagcgccatgccgggccaagcgagggagctccccagtggatgaacaggctcatcgcgtgtgcctcgagaggc

SEQ ID NO: 109688 - DNA, 75 bp, Artificial Sequence
  Synthetic
ctcaagcgccatgccgggccaagcgagggagctgcccagtggatgaacaggctcatcgcgtatgcctcaagaggc

SEQ ID NO: 109689 - DNA, 75 bp, Artificial Sequence
  Synthetic
ctcaagcgccatgccgggccaagcgagggagctgcccagtggatgaacaggctcatcgcgtatgcctctagaggc

SEQ ID NO: 109690 - DNA, 75 bp, Artificial Sequence
  Synthetic
ctcaagcgccatgccgggccaagcgagggagctgcccagtggatgaacaggctcatcgcgtatgcctccagaggc

SEQ ID NO: 109691 - DNA, 75 bp, Artificial Sequence
  Synthetic
ctcaagcgccatgccgggccaagcgagggagctgcccagtggatgaacaggctcatcgcgtatgcctcgagaggc

SEQ ID NO: 109692 - DNA, 75 bp, Artificial Sequence
  Synthetic
ctcaagcgccatgccgggccaagcgagggagctgcccagtggatgaacaggctcatcgcgtttgcctcaagaggc

SEQ ID NO: 109693 - DNA, 75 bp, Artificial Sequence
  Synthetic
ctcaagcgccatgccgggccaagcgagggagctgcccagtggatgaacaggctcatcgcgtttgcctctagaggc

SEQ ID NO: 109694 - DNA, 75 bp, Artificial Sequence
  Synthetic
ctcaagcgccatgccgggccaagcgagggagctgcccagtggatgaacaggctcatcgcgtttgcctccagaggc

SEQ ID NO: 109695 - DNA, 75 bp, Artificial Sequence
  Synthetic
ctcaagcgccatgccgggccaagcgagggagctgcccagtggatgaacaggctcatcgcgtttgcctcgagaggc

SEQ ID NO: 109696 - DNA, 75 bp, Artificial Sequence
  Synthetic
ctcaagcgccatgccgggccaagcgagggagctgcccagtggatgaacaggctcatcgcgtctgcctcaagaggc

SEQ ID NO: 109697 - DNA, 75 bp, Artificial Sequence
  Synthetic
ctcaagcgccatgccgggccaagcgagggagctgcccagtggatgaacaggctcatcgcgtctgcctctagaggc

SEQ ID NO: 109698 - DNA, 75 bp, Artificial Sequence
  Synthetic
ctcaagcgccatgccgggccaagcgagggagctgcccagtggatgaacaggctcatcgcgtctgcctccagaggc

SEQ ID NO: 109699 - DNA, 75 bp, Artificial Sequence
  Synthetic
ctcaagcgccatgccgggccaagcgagggagctgcccagtggatgaacaggctcatcgcgtctgcctcgagaggc

SEQ ID NO: 109700 - DNA, 75 bp, Artificial Sequence
  Synthetic
ctcaagcgccatgccgggccaagcgagggagctgcccagtggatgaacaggctcatcgcgtgtgcctcaagaggc

SEQ ID NO: 109701 - DNA, 75 bp, Artificial Sequence
  Synthetic
ctcaagcgccatgccgggccaagcgagggagctgcccagtggatgaacaggctcatcgcgtgtgcctctagaggc

SEQ ID NO: 109702 - DNA, 75 bp, Artificial Sequence
  Synthetic
ctcaagcgccatgccgggccaagcgagggagctgcccagtggatgaacaggctcatcgcgtgtgcctccagaggc

SEQ ID NO: 109703 - DNA, 75 bp, Artificial Sequence
  Synthetic
ctcaagcgccatgccgggccaagcgagggagctgcccagtggatgaacaggctcatcgcgtgtgcctcgagaggc

SEQ ID NO: 109704 - DNA, 75 bp, Artificial Sequence
  Synthetic
ggctgcccccaacgcctcagtaccgcttcagggcttccgtggccatgtcgaccttatggttggcgtcgctacctt

SEQ ID NO: 109705 - DNA, 75 bp, Artificial Sequence
  Synthetic
ggctgcccccaacgcctcagtaccgcttcagggcttccgtggccatgtcgaccttatggttggcgtcgcttcctt

SEQ ID NO: 109706 - DNA, 75 bp, Artificial Sequence
  Synthetic
ggctgcccccaacgcctcagtaccgcttcagggcttccgtggccatgtcgaccttatggttggcgtcgctccctt

SEQ ID NO: 109707 - DNA, 75 bp, Artificial Sequence
  Synthetic
ggctgcccccaacgcctcagtaccgcttcagggcttccgtggccatgtcgaccttatggttggcgtcgctgcctt

SEQ ID NO: 109708 - DNA, 75 bp, Artificial Sequence
  Synthetic
ggctgcccccaacgcctctgtaccgcttcagggcttccgtggccatgtcgaccttatggttggcgtcgctacctt

SEQ ID NO: 109709 - DNA, 75 bp, Artificial Sequence
  Synthetic
ggctgcccccaacgcctctgtaccgcttcagggcttccgtggccatgtcgaccttatggttggcgtcgcttcctt

SEQ ID NO: 109710 - DNA, 75 bp, Artificial Sequence
  Synthetic
ggctgcccccaacgcctctgtaccgcttcagggcttccgtggccatgtcgaccttatggttggcgtcgctccctt

SEQ ID NO: 109711 - DNA, 75 bp, Artificial Sequence
  Synthetic
ggctgcccccaacgcctctgtaccgcttcagggcttccgtggccatgtcgaccttatggttggcgtcgctgcctt

SEQ ID NO: 109712 - DNA, 75 bp, Artificial Sequence
  Synthetic
ggctgcccccaacgcctccgtaccgcttcagggcttccgtggccatgtcgaccttatggttggcgtcgctacctt

SEQ ID NO: 109713 - DNA, 75 bp, Artificial Sequence
  Synthetic
ggctgcccccaacgcctccgtaccgcttcagggcttccgtggccatgtcgaccttatggttggcgtcgcttcctt

SEQ ID NO: 109714 - DNA, 75 bp, Artificial Sequence
  Synthetic
ggctgcccccaacgcctccgtaccgcttcagggcttccgtggccatgtcgaccttatggttggcgtcgctccctt

SEQ ID NO: 109715 - DNA, 75 bp, Artificial Sequence
  Synthetic
ggctgcccccaacgcctccgtaccgcttcagggcttccgtggccatgtcgaccttatggttggcgtcgctgcctt

SEQ ID NO: 109716 - DNA, 75 bp, Artificial Sequence
  Synthetic
ggctgcccccaacgcctcggtaccgcttcagggcttccgtggccatgtcgaccttatggttggcgtcgctacctt

SEQ ID NO: 109717 - DNA, 75 bp, Artificial Sequence
  Synthetic
ggctgcccccaacgcctcggtaccgcttcagggcttccgtggccatgtcgaccttatggttggcgtcgcttcctt

SEQ ID NO: 109718 - DNA, 75 bp, Artificial Sequence
  Synthetic
ggctgcccccaacgcctcggtaccgcttcagggcttccgtggccatgtcgaccttatggttggcgtcgctccctt

SEQ ID NO: 109719 - DNA, 75 bp, Artificial Sequence
  Synthetic
ggctgcccccaacgcctcggtaccgcttcagggcttccgtggccatgtcgaccttatggttggcgtcgctgcctt

SEQ ID NO: 109720 - DNA, 75 bp, Artificial Sequence
  Synthetic
gtccccggccctaacctttgtcacttcttcagcactgagggtaccgcagttgctcttcgaaatagtcattgaggg

SEQ ID NO: 109721 - DNA, 75 bp, Artificial Sequence
  Synthetic
gaccttgtcaccccactacaaagcattcctcgccaggctcatatggtggttacaatatcttatcaccagagccga

SEQ ID NO: 109722 - DNA, 75 bp, Artificial Sequence
  Synthetic
gtataccaatgttgaccaggacctagtgggttggccatcccctcccggggtcaagtccttggcgccatgcacctg

SEQ ID NO: 109723 - DNA, 75 bp, Artificial Sequence
  Synthetic
gactaccacctatcccgcctcctaggaggaagaaggttgtcaaacttgacgaggcaacggccgagaaggtcctgg

SEQ ID NO: 109724 - DNA, 75 bp, Artificial Sequence
  Synthetic
aactgttccatctactccgggcacattaccggccacagaatggcctgggacatgatgatgaattggtcacccacg

SEQ ID NO: 109725 - DNA, 75 bp, Artificial Sequence
  Synthetic
tgtgtgggccggcactggcattatgaccacaaggtgcccatgcggcgctaacatctctggcaatgtccgcctggg

SEQ ID NO: 109726 - DNA, 75 bp, Artificial Sequence
  Synthetic
tgcaagaatggatcaacaacgattggtccactccctgcagcgggtcgtggttgcgtgacatctgggactgggtga

SEQ ID NO: 109727 - DNA, 75 bp, Artificial Sequence
  Synthetic
tgcatgaatggatcaacaacgattggtccactccctgcagcgggtcgtggttgcgtgacatctgggactgggtga

SEQ ID NO: 109728 - DNA, 75 bp, Artificial Sequence
  Synthetic
tgcacgaatggatcaacaacgattggtccactccctgcagcgggtcgtggttgcgtgacatctgggactgggtga

SEQ ID NO: 109729 - DNA, 75 bp, Artificial Sequence
  Synthetic
tgcaggaatggatcaacaacgattggtccactccctgcagcgggtcgtggttgcgtgacatctgggactgggtga

SEQ ID NO: 109730 - DNA, 75 bp, Artificial Sequence
  Synthetic
accaacgtcgggcattctgtgggccgcacagtaaacagcttcactggcatttttgcgcaggggcccaaacagaac

SEQ ID NO: 109731 - DNA, 75 bp, Artificial Sequence
  Synthetic
ggggcctgcttggttgcatcatcaccagccttacgggccgggataagaaccaggtcgagggggaggttcaagtgg

SEQ ID NO: 109732 - DNA, 75 bp, Artificial Sequence
  Synthetic
gccactctcaaaggatcgtctggtggcccgctactatgttccaaaggacacgccgtaggcatattccgtgccgcg

SEQ ID NO: 109733 - DNA, 75 bp, Artificial Sequence
  Synthetic
tgagggggctgatggggtttcagatgacggttcatacgattcgatgccgccccttgagggtgagcctggtgaccc

SEQ ID NO: 109734 - DNA, 75 bp, Artificial Sequence
  Synthetic
gtatggtgggcaattggctgaaggtaatagggatcttgctcctagtcgctggcacggatgcgaacacccgctccg

SEQ ID NO: 109735 - DNA, 75 bp, Artificial Sequence
  Synthetic
gtggaggggggacggcatttgccacaccacttgcccttgtggagcgaagatcaccggacatgtgaagaacgggac

SEQ ID NO: 109736 - DNA, 75 bp, Artificial Sequence
  Synthetic
aggccagtgtgtaccaaaacctgcacacaactttaaaactgccatttggcgagttgctgcggcggactacgctga

SEQ ID NO: 109737 - DNA, 75 bp, Artificial Sequence
  Synthetic
cccaccaattcaactcctcgggctgtcccgagcgtttgagcagttgtcggccgctgcatgcgtttgatcagggtt

SEQ ID NO: 109738 - DNA, 75 bp, Artificial Sequence
  Synthetic
gacggggtccaaatccacaggttcgctcccactccaaagccgttcattagggatgaggtctcgttcagcgtgggc

SEQ ID NO: 109739 - DNA, 75 bp, Artificial Sequence
  Synthetic
tttgggattgggtttgttccattctcacagactttaaaaactggctgtcttcaaaattgctccctaaaatgcccg

SEQ ID NO: 109740 - DNA, 75 bp, Artificial Sequence
  Synthetic
cagctgtgccccaatcatatcaagttgcccacttgcacgcgcctacagggagcggcaagagcaccaaagttccgg

SEQ ID NO: 109741 - DNA, 75 bp, Artificial Sequence
  Synthetic
catcaaccgcaccgcgctcaactgcaatgattcccttaacacgggatttttggctggcctgctctattacaagca

SEQ ID NO: 109742 - DNA, 75 bp, Artificial Sequence
  Synthetic
catcaaccgcaccgcgctcaactgcaatgattcccttaacacgggttttttggctggcctgctctattacaagca

SEQ ID NO: 109743 - DNA, 75 bp, Artificial Sequence
  Synthetic
catcaaccgcaccgcgctcaactgcaatgattcccttaacacgggctttttggctggcctgctctattacaagca

SEQ ID NO: 109744 - DNA, 75 bp, Artificial Sequence
  Synthetic
catcaaccgcaccgcgctcaactgcaatgattcccttaacacggggtttttggctggcctgctctattacaagca

SEQ ID NO: 109745 - DNA, 75 bp, Artificial Sequence
  Synthetic
tgtgctgctgaggaggagaagctgccaattagcccattgagcaactccctcattcggcaccacaacatggtgtat

SEQ ID NO: 109746 - DNA, 75 bp, Artificial Sequence
  Synthetic
aactacaagcaagctctttggagggtgtctgctgacgagtacgtcgaggtccggagggtaggggacaaccactac

SEQ ID NO: 109747 - DNA, 75 bp, Artificial Sequence
  Synthetic
agtttgcgggcctgtgtattgtttcacgcccggtccggttgtggtcggtaccactgaccggaaagggtctgctac

SEQ ID NO: 109748 - DNA, 75 bp, Artificial Sequence
  Synthetic
aggcagcggcgaggcgactggcacggggttcgcccccgtctgaagccagctcgtctgcgagccaactgtcagcgc

SEQ ID NO: 109749 - DNA, 75 bp, Artificial Sequence
  Synthetic
cagagcccaaaccgcttctgagggatgagatctccttcaccgtggggctatcttcctatgtcctgggatcccaac

SEQ ID NO: 109750 - DNA, 75 bp, Artificial Sequence
  Synthetic
tcatcggacgacaagccttattgctggcattacgcccccagaccctgcgaggtggtgccagcagtgaacgtgtgt

SEQ ID NO: 109751 - DNA, 75 bp, Artificial Sequence
  Synthetic
ccgtctccaggtgtttgaccagcattaccatgatgtcctaaaggaggttaaggcccgagcctcaggggtgagcgc

SEQ ID NO: 109752 - DNA, 75 bp, Artificial Sequence
  Synthetic
agcggcaagagcaccaaagttccggctgcttacgctgcccagggatacaaggtgctcgtgctcaacccctctgtc

SEQ ID NO: 109753 - DNA, 75 bp, Artificial Sequence
  Synthetic
ttcgtcaagacatgcggtgcaccgccatgtaacatccggccgtcgtccaatggtaacaacaccttactatgcccc

SEQ ID NO: 109754 - DNA, 75 bp, Artificial Sequence
  Synthetic
aatccttggcataggcacggtcctagaccaagcggagaccgctggagcgcgccttgtcgtgctcgcgaccgctac

SEQ ID NO: 109755 - DNA, 75 bp, Artificial Sequence
  Synthetic
tgagtctaaagtgctcgtgctagactcccttgatccctcaatcgaggaggaggacgagcgcgagccctcaatacc

SEQ ID NO: 109756 - DNA, 75 bp, Artificial Sequence
  Synthetic
atctcctccttcgctcgccagctcatcggcgagccagctttcagcaccatccttgaaggctacttgtaccacaca

SEQ ID NO: 109757 - DNA, 75 bp, Artificial Sequence
  Synthetic
tcttgctgacaagcttgcgtcccccaaaaggagcatggttcggatgtacttggatgaactccactgggttcgtca

SEQ ID NO: 109758 - DNA, 75 bp, Artificial Sequence
  Synthetic
tgtgggaggacttgctggaagacaattgtacaccaatccctactaccataatggccaagaatgaagtcttctgtg

SEQ ID NO: 109759 - DNA, 75 bp, Artificial Sequence
  Synthetic
catactccacgtacgggaaattcctggccgatggaggttgtggggggggcgcttatgacatcatcatctgtgacg

SEQ ID NO: 109760 - DNA, 75 bp, Artificial Sequence
  Synthetic
ggcattatccttgcaccgtaaacttcaccctccataaggtacggatgtatgtgggtggcgtggaacatcggttta

SEQ ID NO: 109761 - DNA, 75 bp, Artificial Sequence
  Synthetic
gaagctccccgcagcagtgatgggatccgcatacggcttccaatattcacccaaacagcgggtcgagcagctcct

SEQ ID NO: 109762 - DNA, 75 bp, Artificial Sequence
  Synthetic
ggctatgaaccaccaacggtggctggatgtgctcttcccccctcgactcaggcccccgttcctccacccaggaga

SEQ ID NO: 109763 - DNA, 75 bp, Artificial Sequence
  Synthetic
gtcctcgactctttcgaccctctcatcgcggagtatgatgacagggaaccatctatacctgctgagtgtcatcgg

SEQ ID NO: 109764 - DNA, 75 bp, Artificial Sequence
  Synthetic
cactcgctgcggctcagggccttggatcacgccgcggtgcattgtagactatccatatagactgtggcattatcc

SEQ ID NO: 109765 - DNA, 75 bp, Artificial Sequence
  Synthetic
ttcctcaaggggggtagacaccttatattttgccactccaggaaaaagtgtgacgagttggccaagcagctaaca

SEQ ID NO: 109766 - DNA, 75 bp, Artificial Sequence
  Synthetic
agagcggtgcgacttggaggacagagacaggatcgagatgagccctctgttgttttcaacgacggagttagccgt

SEQ ID NO: 109767 - DNA, 75 bp, Artificial Sequence
  Synthetic
atctaccagtgttgccagttgaatccgacagcacgcaaggccataacatcactcaccgagcggctgtactgcgga

SEQ ID NO: 109768 - DNA, 75 bp, Artificial Sequence
  Synthetic
atcacacaggagagggcaccaccgacagccccagggacataccaccggatgagtccgatgcctcggagacgggct

SEQ ID NO: 109769 - DNA, 75 bp, Artificial Sequence
  Synthetic
cactggtccacggctgagctctgcccccccagaaacccgctcctattccgccgcctagacggaagaaggttgtgc

SEQ ID NO: 109770 - DNA, 75 bp, Artificial Sequence
  Synthetic
cactggtccacggctgtgctctgcccccccagaaacccgctcctattccgccgcctagacggaagaaggttgtgc

SEQ ID NO: 109771 - DNA, 75 bp, Artificial Sequence
  Synthetic
cactggtccacggctgcgctctgcccccccagaaacccgctcctattccgccgcctagacggaagaaggttgtgc

SEQ ID NO: 109772 - DNA, 75 bp, Artificial Sequence
  Synthetic
cactggtccacggctgggctctgcccccccagaaacccgctcctattccgccgcctagacggaagaaggttgtgc

SEQ ID NO: 109773 - DNA, 75 bp, Artificial Sequence
  Synthetic
gagttagacgacagagacagggtcgaaatgagcccactcttgttttctaccactgagctctcaatattgccttgc

SEQ ID NO: 109774 - DNA, 75 bp, Artificial Sequence
  Synthetic
tccatggtggggaactgggctaaggttctgattgtgatgctactctttgccggcgttgacgggaacacccacacg

SEQ ID NO: 109775 - DNA, 75 bp, Artificial Sequence
  Synthetic
cgggttacaccggcgactttgactctgtgatagactgcaacacatccgtcatacagactgttgacttcagcttgg

SEQ ID NO: 109776 - DNA, 75 bp, Artificial Sequence
  Synthetic
gtatgtcacgccaggggagaggccgtcaggcatgtttgacacctcagtgctctgcgagtgctatgacgccggctg

SEQ ID NO: 109777 - DNA, 75 bp, Artificial Sequence
  Synthetic
tgaaggcacaagcagcttgcagagcagcagggctcaaaaaatttgacatgttggtctgcggagacgacttggtca

SEQ ID NO: 109778 - DNA, 75 bp, Artificial Sequence
  Synthetic
tgaaggcacaagcagcttgcagagcagcagggctctaaaaatttgacatgttggtctgcggagacgacttggtca

SEQ ID NO: 109779 - DNA, 75 bp, Artificial Sequence
  Synthetic
tgaaggcacaagcagcttgcagagcagcagggctccaaaaatttgacatgttggtctgcggagacgacttggtca

SEQ ID NO: 109780 - DNA, 75 bp, Artificial Sequence
  Synthetic
tgaaggcacaagcagcttgcagagcagcagggctcgaaaaatttgacatgttggtctgcggagacgacttggtca

SEQ ID NO: 109781 - DNA, 75 bp, Artificial Sequence
  Synthetic
tcccgactcagacgcagggtcttggaccacggtctccgatgagggcgactccgtcatttgctgctccatgtcgta

SEQ ID NO: 109782 - DNA, 75 bp, Artificial Sequence
  Synthetic
cgtgggccgtgaagtgggagtacgtagtcctggctttcttggtgcttgctgacgcgcgcatttgcgcctgcctgt

SEQ ID NO: 109783 - DNA, 75 bp, Artificial Sequence
  Synthetic
cgtgggccgtgaagtgggagtacgttgtcctggctttcttggtgcttgctgacgcgcgcatttgcgcctgcctgt

SEQ ID NO: 109784 - DNA, 75 bp, Artificial Sequence
  Synthetic
cgtgggccgtgaagtgggagtacgtcgtcctggctttcttggtgcttgctgacgcgcgcatttgcgcctgcctgt

SEQ ID NO: 109785 - DNA, 75 bp, Artificial Sequence
  Synthetic
cgtgggccgtgaagtgggagtacgtggtcctggctttcttggtgcttgctgacgcgcgcatttgcgcctgcctgt

SEQ ID NO: 109786 - DNA, 75 bp, Artificial Sequence
  Synthetic
agatcacagcatcgagcgcggagagcattctgaggacgaggattgcgcttctgaagcagggtcttacagctccat

SEQ ID NO: 109787 - DNA, 75 bp, Artificial Sequence
  Synthetic
agatcacagcatcgagcgcggagagcattctgtggacgaggattgcgcttctgaagcagggtcttacagctccat

SEQ ID NO: 109788 - DNA, 75 bp, Artificial Sequence
  Synthetic
agatcacagcatcgagcgcggagagcattctgcggacgaggattgcgcttctgaagcagggtcttacagctccat

SEQ ID NO: 109789 - DNA, 75 bp, Artificial Sequence
  Synthetic
agatcacagcatcgagcgcggagagcattctggggacgaggattgcgcttctgaagcagggtcttacagctccat

SEQ ID NO: 109790 - DNA, 75 bp, Artificial Sequence
  Synthetic
agatcacagcttcgagcgcggagagcattctgaggacgaggattgcgcttctgaagcagggtcttacagctccat

SEQ ID NO: 109791 - DNA, 75 bp, Artificial Sequence
  Synthetic
agatcacagcttcgagcgcggagagcattctgtggacgaggattgcgcttctgaagcagggtcttacagctccat

SEQ ID NO: 109792 - DNA, 75 bp, Artificial Sequence
  Synthetic
agatcacagcttcgagcgcggagagcattctgcggacgaggattgcgcttctgaagcagggtcttacagctccat

SEQ ID NO: 109793 - DNA, 75 bp, Artificial Sequence
  Synthetic
agatcacagcttcgagcgcggagagcattctggggacgaggattgcgcttctgaagcagggtcttacagctccat

SEQ ID NO: 109794 - DNA, 75 bp, Artificial Sequence
  Synthetic
agatcacagcctcgagcgcggagagcattctgaggacgaggattgcgcttctgaagcagggtcttacagctccat

SEQ ID NO: 109795 - DNA, 75 bp, Artificial Sequence
  Synthetic
agatcacagcctcgagcgcggagagcattctgtggacgaggattgcgcttctgaagcagggtcttacagctccat

SEQ ID NO: 109796 - DNA, 75 bp, Artificial Sequence
  Synthetic
agatcacagcctcgagcgcggagagcattctgcggacgaggattgcgcttctgaagcagggtcttacagctccat

SEQ ID NO: 109797 - DNA, 75 bp, Artificial Sequence
  Synthetic
agatcacagcctcgagcgcggagagcattctggggacgaggattgcgcttctgaagcagggtcttacagctccat

SEQ ID NO: 109798 - DNA, 75 bp, Artificial Sequence
  Synthetic
agatcacagcgtcgagcgcggagagcattctgaggacgaggattgcgcttctgaagcagggtcttacagctccat

SEQ ID NO: 109799 - DNA, 75 bp, Artificial Sequence
  Synthetic
agatcacagcgtcgagcgcggagagcattctgtggacgaggattgcgcttctgaagcagggtcttacagctccat

SEQ ID NO: 109800 - DNA, 75 bp, Artificial Sequence
  Synthetic
agatcacagcgtcgagcgcggagagcattctgcggacgaggattgcgcttctgaagcagggtcttacagctccat

SEQ ID NO: 109801 - DNA, 75 bp, Artificial Sequence
  Synthetic
agatcacagcgtcgagcgcggagagcattctggggacgaggattgcgcttctgaagcagggtcttacagctccat

SEQ ID NO: 109802 - DNA, 75 bp, Artificial Sequence
  Synthetic
tgatcacagcatcgagcgcggagagcattctgaggacgaggattgcgcttctgaagcagggtcttacagctccat

SEQ ID NO: 109803 - DNA, 75 bp, Artificial Sequence
  Synthetic
tgatcacagcatcgagcgcggagagcattctgtggacgaggattgcgcttctgaagcagggtcttacagctccat

SEQ ID NO: 109804 - DNA, 75 bp, Artificial Sequence
  Synthetic
tgatcacagcatcgagcgcggagagcattctgcggacgaggattgcgcttctgaagcagggtcttacagctccat

SEQ ID NO: 109805 - DNA, 75 bp, Artificial Sequence
  Synthetic
tgatcacagcatcgagcgcggagagcattctggggacgaggattgcgcttctgaagcagggtcttacagctccat

SEQ ID NO: 109806 - DNA, 75 bp, Artificial Sequence
  Synthetic
tgatcacagcttcgagcgcggagagcattctgaggacgaggattgcgcttctgaagcagggtcttacagctccat

SEQ ID NO: 109807 - DNA, 75 bp, Artificial Sequence
  Synthetic
tgatcacagcttcgagcgcggagagcattctgtggacgaggattgcgcttctgaagcagggtcttacagctccat

SEQ ID NO: 109808 - DNA, 75 bp, Artificial Sequence
  Synthetic
tgatcacagcttcgagcgcggagagcattctgcggacgaggattgcgcttctgaagcagggtcttacagctccat

SEQ ID NO: 109809 - DNA, 75 bp, Artificial Sequence
  Synthetic
tgatcacagcttcgagcgcggagagcattctggggacgaggattgcgcttctgaagcagggtcttacagctccat

SEQ ID NO: 109810 - DNA, 75 bp, Artificial Sequence
  Synthetic
tgatcacagcctcgagcgcggagagcattctgaggacgaggattgcgcttctgaagcagggtcttacagctccat

SEQ ID NO: 109811 - DNA, 75 bp, Artificial Sequence
  Synthetic
tgatcacagcctcgagcgcggagagcattctgtggacgaggattgcgcttctgaagcagggtcttacagctccat

SEQ ID NO: 109812 - DNA, 75 bp, Artificial Sequence
  Synthetic
tgatcacagcctcgagcgcggagagcattctgcggacgaggattgcgcttctgaagcagggtcttacagctccat

SEQ ID NO: 109813 - DNA, 75 bp, Artificial Sequence
  Synthetic
tgatcacagcctcgagcgcggagagcattctggggacgaggattgcgcttctgaagcagggtcttacagctccat

SEQ ID NO: 109814 - DNA, 75 bp, Artificial Sequence
  Synthetic
tgatcacagcgtcgagcgcggagagcattctgaggacgaggattgcgcttctgaagcagggtcttacagctccat

SEQ ID NO: 109815 - DNA, 75 bp, Artificial Sequence
  Synthetic
tgatcacagcgtcgagcgcggagagcattctgtggacgaggattgcgcttctgaagcagggtcttacagctccat

SEQ ID NO: 109816 - DNA, 75 bp, Artificial Sequence
  Synthetic
tgatcacagcgtcgagcgcggagagcattctgcggacgaggattgcgcttctgaagcagggtcttacagctccat

SEQ ID NO: 109817 - DNA, 75 bp, Artificial Sequence
  Synthetic
tgatcacagcgtcgagcgcggagagcattctggggacgaggattgcgcttctgaagcagggtcttacagctccat

SEQ ID NO: 109818 - DNA, 75 bp, Artificial Sequence
  Synthetic
cgatcacagcatcgagcgcggagagcattctgaggacgaggattgcgcttctgaagcagggtcttacagctccat

SEQ ID NO: 109819 - DNA, 75 bp, Artificial Sequence
  Synthetic
cgatcacagcatcgagcgcggagagcattctgtggacgaggattgcgcttctgaagcagggtcttacagctccat

SEQ ID NO: 109820 - DNA, 75 bp, Artificial Sequence
  Synthetic
cgatcacagcatcgagcgcggagagcattctgcggacgaggattgcgcttctgaagcagggtcttacagctccat

SEQ ID NO: 109821 - DNA, 75 bp, Artificial Sequence
  Synthetic
cgatcacagcatcgagcgcggagagcattctggggacgaggattgcgcttctgaagcagggtcttacagctccat

SEQ ID NO: 109822 - DNA, 75 bp, Artificial Sequence
  Synthetic
cgatcacagcttcgagcgcggagagcattctgaggacgaggattgcgcttctgaagcagggtcttacagctccat

SEQ ID NO: 109823 - DNA, 75 bp, Artificial Sequence
  Synthetic
cgatcacagcttcgagcgcggagagcattctgtggacgaggattgcgcttctgaagcagggtcttacagctccat

SEQ ID NO: 109824 - DNA, 75 bp, Artificial Sequence
  Synthetic
cgatcacagcttcgagcgcggagagcattctgcggacgaggattgcgcttctgaagcagggtcttacagctccat

SEQ ID NO: 109825 - DNA, 75 bp, Artificial Sequence
  Synthetic
cgatcacagcttcgagcgcggagagcattctggggacgaggattgcgcttctgaagcagggtcttacagctccat

SEQ ID NO: 109826 - DNA, 75 bp, Artificial Sequence
  Synthetic
cgatcacagcctcgagcgcggagagcattctgaggacgaggattgcgcttctgaagcagggtcttacagctccat

SEQ ID NO: 109827 - DNA, 75 bp, Artificial Sequence
  Synthetic
cgatcacagcctcgagcgcggagagcattctgtggacgaggattgcgcttctgaagcagggtcttacagctccat

SEQ ID NO: 109828 - DNA, 75 bp, Artificial Sequence
  Synthetic
cgatcacagcctcgagcgcggagagcattctgcggacgaggattgcgcttctgaagcagggtcttacagctccat

SEQ ID NO: 109829 - DNA, 75 bp, Artificial Sequence
  Synthetic
cgatcacagcctcgagcgcggagagcattctggggacgaggattgcgcttctgaagcagggtcttacagctccat

SEQ ID NO: 109830 - DNA, 75 bp, Artificial Sequence
  Synthetic
cgatcacagcgtcgagcgcggagagcattctgaggacgaggattgcgcttctgaagcagggtcttacagctccat

SEQ ID NO: 109831 - DNA, 75 bp, Artificial Sequence
  Synthetic
cgatcacagcgtcgagcgcggagagcattctgtggacgaggattgcgcttctgaagcagggtcttacagctccat

SEQ ID NO: 109832 - DNA, 75 bp, Artificial Sequence
  Synthetic
cgatcacagcgtcgagcgcggagagcattctgcggacgaggattgcgcttctgaagcagggtcttacagctccat

SEQ ID NO: 109833 - DNA, 75 bp, Artificial Sequence
  Synthetic
cgatcacagcgtcgagcgcggagagcattctggggacgaggattgcgcttctgaagcagggtcttacagctccat

SEQ ID NO: 109834 - DNA, 75 bp, Artificial Sequence
  Synthetic
ggatcacagcatcgagcgcggagagcattctgaggacgaggattgcgcttctgaagcagggtcttacagctccat

SEQ ID NO: 109835 - DNA, 75 bp, Artificial Sequence
  Synthetic
ggatcacagcatcgagcgcggagagcattctgtggacgaggattgcgcttctgaagcagggtcttacagctccat

SEQ ID NO: 109836 - DNA, 75 bp, Artificial Sequence
  Synthetic
ggatcacagcatcgagcgcggagagcattctgcggacgaggattgcgcttctgaagcagggtcttacagctccat

SEQ ID NO: 109837 - DNA, 75 bp, Artificial Sequence
  Synthetic
ggatcacagcatcgagcgcggagagcattctggggacgaggattgcgcttctgaagcagggtcttacagctccat

SEQ ID NO: 109838 - DNA, 75 bp, Artificial Sequence
  Synthetic
ggatcacagcttcgagcgcggagagcattctgaggacgaggattgcgcttctgaagcagggtcttacagctccat

SEQ ID NO: 109839 - DNA, 75 bp, Artificial Sequence
  Synthetic
ggatcacagcttcgagcgcggagagcattctgtggacgaggattgcgcttctgaagcagggtcttacagctccat

SEQ ID NO: 109840 - DNA, 75 bp, Artificial Sequence
  Synthetic
ggatcacagcttcgagcgcggagagcattctgcggacgaggattgcgcttctgaagcagggtcttacagctccat

SEQ ID NO: 109841 - DNA, 75 bp, Artificial Sequence
  Synthetic
ggatcacagcttcgagcgcggagagcattctggggacgaggattgcgcttctgaagcagggtcttacagctccat

SEQ ID NO: 109842 - DNA, 75 bp, Artificial Sequence
  Synthetic
ggatcacagcctcgagcgcggagagcattctgaggacgaggattgcgcttctgaagcagggtcttacagctccat

SEQ ID NO: 109843 - DNA, 75 bp, Artificial Sequence
  Synthetic
ggatcacagcctcgagcgcggagagcattctgtggacgaggattgcgcttctgaagcagggtcttacagctccat

SEQ ID NO: 109844 - DNA, 75 bp, Artificial Sequence
  Synthetic
ggatcacagcctcgagcgcggagagcattctgcggacgaggattgcgcttctgaagcagggtcttacagctccat

SEQ ID NO: 109845 - DNA, 75 bp, Artificial Sequence
  Synthetic
ggatcacagcctcgagcgcggagagcattctggggacgaggattgcgcttctgaagcagggtcttacagctccat

SEQ ID NO: 109846 - DNA, 75 bp, Artificial Sequence
  Synthetic
ggatcacagcgtcgagcgcggagagcattctgaggacgaggattgcgcttctgaagcagggtcttacagctccat

SEQ ID NO: 109847 - DNA, 75 bp, Artificial Sequence
  Synthetic
ggatcacagcgtcgagcgcggagagcattctgtggacgaggattgcgcttctgaagcagggtcttacagctccat

SEQ ID NO: 109848 - DNA, 75 bp, Artificial Sequence
  Synthetic
ggatcacagcgtcgagcgcggagagcattctgcggacgaggattgcgcttctgaagcagggtcttacagctccat

SEQ ID NO: 109849 - DNA, 75 bp, Artificial Sequence
  Synthetic
ggatcacagcgtcgagcgcggagagcattctggggacgaggattgcgcttctgaagcagggtcttacagctccat

SEQ ID NO: 109850 - DNA, 75 bp, Artificial Sequence
  Synthetic
ccgtcatttgctgctccatgtcgtattcctggaccggggcactggtcaccccttgtggcccggaggaggaaaggt

SEQ ID NO: 109851 - DNA, 75 bp, Artificial Sequence
  Synthetic
tgtgcgggatagcattcatctgcgccgcctggtatatccgtggcaggcttgtccccgtaactgcctatgtgctgt

SEQ ID NO: 109852 - DNA, 75 bp, Artificial Sequence
  Synthetic
gagagcgtctttaccggtctaacccatatagacgcccacttcctgtctcaggtaaaacaggcgggagagaactac

SEQ ID NO: 109853 - DNA, 75 bp, Artificial Sequence
  Synthetic
cccggagtacgacctcgagctgataacatcctgctcttccaacgtttccgtggcccacgacaacaatggacagag

SEQ ID NO: 109854 - DNA, 75 bp, Artificial Sequence
  Synthetic
tacagctggacgggagctcttgtgaccccttgtgttcctgaggaggagaaattgcccataaacgctttaagcaat

SEQ ID NO: 109855 - DNA, 75 bp, Artificial Sequence
  Synthetic
agctgtggtgtgcctcgcctggtatatcaaaggccgccttatcccagcgggtacctattgtgccttacaaatgtg

SEQ ID NO: 109856 - DNA, 75 bp, Artificial Sequence
  Synthetic
agctgtggtgtgcctcgcctggtatatcaaaggccgccttttcccagcgggtacctattgtgccttacaaatgtg

SEQ ID NO: 109857 - DNA, 75 bp, Artificial Sequence
  Synthetic
agctgtggtgtgcctcgcctggtatatcaaaggccgccttctcccagcgggtacctattgtgccttacaaatgtg

SEQ ID NO: 109858 - DNA, 75 bp, Artificial Sequence
  Synthetic
agctgtggtgtgcctcgcctggtatatcaaaggccgccttgtcccagcgggtacctattgtgccttacaaatgtg

SEQ ID NO: 109859 - DNA, 75 bp, Artificial Sequence
  Synthetic
cgacagggtgcagctacttgactcccactatgatgaagtcttaaaggacgtcaagcaggctgcctccaaggtcag

SEQ ID NO: 109860 - DNA, 75 bp, Artificial Sequence
  Synthetic
catcattactgtgtttaccctcactccagcttataagtccctccttgtgaccacgatctggtggatacagtactt

SEQ ID NO: 109861 - DNA, 75 bp, Artificial Sequence
  Synthetic
agccgctcgtcaaaagaaggtgacctttgatcgagtccagcttgtggaccaacactattatgacacattgaagga

SEQ ID NO: 109862 - DNA, 75 bp, Artificial Sequence
  Synthetic
cactacacgggcccacccctctcctctacagattggggtctgtgcaaaatgaggtgacattaacccatcccgtaa

SEQ ID NO: 109863 - DNA, 75 bp, Artificial Sequence
  Synthetic
tggcccacgacaacaatggacagagatattactacctcacgagagacccaaccataccactctcacgagctgctt

SEQ ID NO: 109864 - DNA, 75 bp, Artificial Sequence
  Synthetic
gaggtgacattaacccatcccgtaaccaaatacatcatggcctgcatgtcagcggatcttgaagtggtcactagc

SEQ ID NO: 109865 - DNA, 75 bp, Artificial Sequence
  Synthetic
atcttcaccataacgccgctgtataaagtaatgcttgcccgcctgatatggtggaaccagtactttattgcgagg

SEQ ID NO: 109866 - DNA, 75 bp, Artificial Sequence
  Synthetic
atcttcaccataacgccgctgtataatgtaatgcttgcccgcctgatatggtggaaccagtactttattgcgagg

SEQ ID NO: 109867 - DNA, 75 bp, Artificial Sequence
  Synthetic
atcttcaccataacgccgctgtataacgtaatgcttgcccgcctgatatggtggaaccagtactttattgcgagg

SEQ ID NO: 109868 - DNA, 75 bp, Artificial Sequence
  Synthetic
atcttcaccataacgccgctgtataaggtaatgcttgcccgcctgatatggtggaaccagtactttattgcgagg

SEQ ID NO: 109869 - DNA, 75 bp, Artificial Sequence
  Synthetic
gagctggggttcgaggtcaccaagatcattttggccataatcggccctatctacatcttgcagtacagcctgctt

SEQ ID NO: 109870 - DNA, 75 bp, Artificial Sequence
  Synthetic
cgcgtcactgccatactcagcagcctcactgtaacccagctcctgaggcgactacaccagtggataagctcggag

SEQ ID NO: 109871 - DNA, 75 bp, Artificial Sequence
  Synthetic
tggaatactccagtcccaagagacactccataaagtacttgacttcgacatgtacggagtcacttactctgtcac

SEQ ID NO: 109872 - DNA, 75 bp, Artificial Sequence
  Synthetic
tccccccactccaggtgcggggggctcgagactcaatcatcctgctagcatgtttcatccatccacggctgatct

SEQ ID NO: 109873 - DNA, 75 bp, Artificial Sequence
  Synthetic
tccccccactccaggtgcggggggctcgagactcaatcatcctgctagcatgtttcttccatccacggctgatct

SEQ ID NO: 109874 - DNA, 75 bp, Artificial Sequence
  Synthetic
tccccccactccaggtgcggggggctcgagactcaatcatcctgctagcatgtttcctccatccacggctgatct

SEQ ID NO: 109875 - DNA, 75 bp, Artificial Sequence
  Synthetic
tccccccactccaggtgcggggggctcgagactcaatcatcctgctagcatgtttcgtccatccacggctgatct

SEQ ID NO: 109876 - DNA, 75 bp, Artificial Sequence
  Synthetic
acatcctcctacgcgcttgcctggctctccgcggagtagcaggcggcaagtatgcccaagccgcgcttctgaggc

SEQ ID NO: 109877 - DNA, 75 bp, Artificial Sequence
  Synthetic
ccgctgtcatacccgaccgagaagtgctctatcagcagtttgatgagatggaagagtgctccaaccatatcccgc

SEQ ID NO: 109878 - DNA, 75 bp, Artificial Sequence
  Synthetic
tgagagcctggagacatcgggccagggcggtcagagctaagctcattgctcagggggggaaagccgctatttgcg

SEQ ID NO: 109879 - DNA, 75 bp, Artificial Sequence
  Synthetic
acagaagctaccccaggcagtaatgggagcttcgtatgggttccagtactctcctgggcagcgggttgaattcct

SEQ ID NO: 109880 - DNA, 75 bp, Artificial Sequence
  Synthetic
cgcaaaccagcgcggctaatcgtgttcccggacttgggagtccgggtgtgcgaaaagaaggcccttttcgatgtc

SEQ ID NO: 109881 - DNA, 75 bp, Artificial Sequence
  Synthetic
ccgtgtgggaggacctcctggaagaccaacagtcaccaattcctacaaccatcatggccaagaatgaggtgtttt

SEQ ID NO: 109882 - DNA, 75 bp, Artificial Sequence
  Synthetic
ccgggcgtgcatgctcttccgtcgccttgccggcggcaagtacgtgcaagcactgttgctgaagattggatcttg

SEQ ID NO: 109883 - DNA, 75 bp, Artificial Sequence
  Synthetic
ccgggcgtgcatgctcttccgtcgccttgccggcggcaagtacgtgcaagcactgttgctgaagattggttcttg

SEQ ID NO: 109884 - DNA, 75 bp, Artificial Sequence
  Synthetic
ccgggcgtgcatgctcttccgtcgccttgccggcggcaagtacgtgcaagcactgttgctgaagattggctcttg

SEQ ID NO: 109885 - DNA, 75 bp, Artificial Sequence
  Synthetic
ccgggcgtgcatgctcttccgtcgccttgccggcggcaagtacgtgcaagcactgttgctgaagattgggtcttg

SEQ ID NO: 109886 - DNA, 75 bp, Artificial Sequence
  Synthetic
ccagtccaactttgctaagctcgaacaattctgggcaaagcacatgtggaacttcatcagtggcatccaatacct

SEQ ID NO: 109887 - DNA, 75 bp, Artificial Sequence
  Synthetic
tccatataccaggcttgctcgatacccgaggaggcccgaactgccatccattcactaactgagaggctctacgta

SEQ ID NO: 109888 - DNA, 75 bp, Artificial Sequence
  Synthetic
tccatataccaggcttgctcgttacccgaggaggcccgaactgccatccattcactaactgagaggctctacgta

SEQ ID NO: 109889 - DNA, 75 bp, Artificial Sequence
  Synthetic
tccatataccaggcttgctcgctacccgaggaggcccgaactgccatccattcactaactgagaggctctacgta

SEQ ID NO: 109890 - DNA, 75 bp, Artificial Sequence
  Synthetic
tccatataccaggcttgctcggtacccgaggaggcccgaactgccatccattcactaactgagaggctctacgta

SEQ ID NO: 109891 - DNA, 75 bp, Artificial Sequence
  Synthetic
agacccctatggggttttcctatgacaccagatgttttgactctacagtcacagagcgcgacatacgagccgaac

SEQ ID NO: 109892 - DNA, 75 bp, Artificial Sequence
  Synthetic
cgccgttgagcctgttattttctcgcctatggagaagaaagttattacttggggggctgacactgctgcttgtgg

SEQ ID NO: 109893 - DNA, 75 bp, Artificial Sequence
  Synthetic
cattcactgccgcagtcacgagccccctaaccactcagcaaaccctcctcttcaacatcttgggggggtgggtcg

SEQ ID NO: 109894 - DNA, 75 bp, Artificial Sequence
  Synthetic
ggtaggagtaggcatctttttacttcccgctcgatagacggggagcataaagctacactccattaggcttttttt

SEQ ID NO: 109895 - DNA, 75 bp, Artificial Sequence
  Synthetic
atgtgaaggcccaagccgcttgtaaagcggcagggattatcgctcctaccatgctggtgtgtggcgatgacctgg

SEQ ID NO: 109896 - DNA, 75 bp, Artificial Sequence
  Synthetic
gggccaactctgcggcaaacgcagatgccgggcgagcggcgtgcttcccacgagtatgggcaacaccatcacgtg

SEQ ID NO: 109897 - DNA, 75 bp, Artificial Sequence
  Synthetic
gggccaactctgcggctaacgcagatgccgggcgagcggcgtgcttcccacgagtatgggcaacaccatcacgtg

SEQ ID NO: 109898 - DNA, 75 bp, Artificial Sequence
  Synthetic
gggccaactctgcggccaacgcagatgccgggcgagcggcgtgcttcccacgagtatgggcaacaccatcacgtg

SEQ ID NO: 109899 - DNA, 75 bp, Artificial Sequence
  Synthetic
gggccaactctgcggcgaacgcagatgccgggcgagcggcgtgcttcccacgagtatgggcaacaccatcacgtg

SEQ ID NO: 109900 - DNA, 75 bp, Artificial Sequence
  Synthetic
cccatcacggcctacgcgcagcaaacacgtgggctggtgggcaccatcgtaaccagcctaacgggtcgggataag

SEQ ID NO: 109901 - DNA, 75 bp, Artificial Sequence
  Synthetic
tagtcatctcagaaagtcagggcgccgaagaggatgagcggaatctgagagtcttcacggaggctatgaccagat

SEQ ID NO: 109902 - DNA, 75 bp, Artificial Sequence
  Synthetic
ctgtggctcaagtgacctctacctcgtgacaaggaacgccgacgttatccctgcaaggcgcagaggagacactcg

SEQ ID NO: 109903 - DNA, 75 bp, Artificial Sequence
  Synthetic
gtcaatgaggatatcgccagcctgcgagctttcacggaagctatgaccaggtactcggccactcccggggaccta

SEQ ID NO: 109904 - DNA, 75 bp, Artificial Sequence
  Synthetic
gcagcaagacccttgccgggcctaaagggccggtgtgtcaaatgtatactaatgtggaccaggaccttgtaggct

SEQ ID NO: 109905 - DNA, 75 bp, Artificial Sequence
  Synthetic
cggctgttggcagcataggcctcgggaaggtgcttgtggacattctggcgggttatggagcaggggtggcaggcg

SEQ ID NO: 109906 - DNA, 75 bp, Artificial Sequence
  Synthetic
cctgggagacagtcagacactcccctgtcaattcatggctgggaaacatcatccaatacgcccccaccttatggg

SEQ ID NO: 109907 - DNA, 75 bp, Artificial Sequence
  Synthetic
acccaaccacccctctttctagggcagcttgggagactgcccgacacactccagtaaactcatggttggggaaca

SEQ ID NO: 109908 - DNA, 75 bp, Artificial Sequence
  Synthetic
caggggtgacacccgagcaagcctgctcagccccaggccactaagcaccctcaagggatcctctggtgggccagt

SEQ ID NO: 109909 - DNA, 75 bp, Artificial Sequence
  Synthetic
actgctccactccctgtgattcatcatggttgagggagatctgggattgggtttgcaccgtactgactgacttca

SEQ ID NO: 109910 - DNA, 75 bp, Artificial Sequence
  Synthetic
ggccttgcctactattccatggtggggaactgggctaaggtcttgattgtgatgctactctttgctggcgttgac

SEQ ID NO: 109911 - DNA, 75 bp, Artificial Sequence
  Synthetic
aaaccctctggacctaccagccataattgagaggatacatgggctcgacgccttctcactgcacacatactctcc

SEQ ID NO: 109912 - DNA, 75 bp, Artificial Sequence
  Synthetic
agcttgggagactgcccgacacactccagtaaactcatggttggggaacatcataatgtatgctcctgcgatttg

SEQ ID NO: 109913 - DNA, 75 bp, Artificial Sequence
  Synthetic
ccaacggcagctggcacatcaacaggaccgctctgaattgcaatgactccctccaaactgggttcattgctgcgc

SEQ ID NO: 109914 - DNA, 75 bp, Artificial Sequence
  Synthetic
actcttcaggctgtcccgagaggttggccagctgccgaccccttgccgattttgaccagggctggggccctatca

SEQ ID NO: 109915 - DNA, 75 bp, Artificial Sequence
  Synthetic
gcatacaacgtgcccatgcggcgcacaaatagccggccatatcaagaacggctcgatgagaatcgtcgggcctaa

SEQ ID NO: 109916 - DNA, 75 bp, Artificial Sequence
  Synthetic
accaccatgaggtccccggtcttcactgacaactcgtctcctccggccgtgccccaaacataccaggtagggtac

SEQ ID NO: 109917 - DNA, 75 bp, Artificial Sequence
  Synthetic
gctacgccaacggaagcggccccgaccaacgcccctattgctggcactaccccccaaaaccttgtggtattgtgc

SEQ ID NO: 109918 - DNA, 75 bp, Artificial Sequence
  Synthetic
gccccaaacataccaggtagggtacctccacgctcccacgggtagcgggaagagtactaaagtcccggcagctta

SEQ ID NO: 109919 - DNA, 75 bp, Artificial Sequence
  Synthetic
caaatagccggccatatcaagaacggctcgatgagaatcgtcgggcctaagacatgcagcaacacctggcatggg

SEQ ID NO: 109920 - DNA, 75 bp, Artificial Sequence
  Synthetic
gccagagcggtcagggccaagctcattgtccaggggggaaaagctgcaatatgcggcaagtacctcttcaactgg

SEQ ID NO: 109921 - DNA, 75 bp, Artificial Sequence
  Synthetic
aggtccgcagggtgggcgactaccactatgtggtgggtgtcacgcaggataacatcaagtgcccctgccaggtcc

SEQ ID NO: 109922 - DNA, 75 bp, Artificial Sequence
  Synthetic
atcaggaccggagtcaggaccataaccaccggcggtcctattacatactctacctatggcaaattcctggctgac

SEQ ID NO: 109923 - DNA, 75 bp, Artificial Sequence
  Synthetic
ccctaccaaccactggtgagatacccttctatggaaaggcgatcccccttgaatacatcaaagggggcagacacc

SEQ ID NO: 109924 - DNA, 75 bp, Artificial Sequence
  Synthetic
aacacgtggcacggaacatttcccatcaacgcgtacaccacaggcccctgcacaccctccccggcgccaaactat

SEQ ID NO: 109925 - DNA, 75 bp, Artificial Sequence
  Synthetic
ttccttttttttttctttcctactttcctatctcatttctttcttggtggctccatcttagccctagtcacggct

SEQ ID NO: 109926 - DNA, 75 bp, Artificial Sequence
  Synthetic
cagagaccgctggcgcgcgccttacagtgcttgccacggctacacctcccggatctgtcacggtccctcatccca

SEQ ID NO: 109927 - DNA, 75 bp, Artificial Sequence
  Synthetic
gcttaacacatttgtagtggggtcccagctcccttgtgaaccggagcctgacgttgcggtgctgacatccatgct

SEQ ID NO: 109928 - DNA, 75 bp, Artificial Sequence
  Synthetic
aaagccataccgttggaatacatcaaggggggaagacacttgattttctgccattcgaagaagaaatgcgacgag

SEQ ID NO: 109929 - DNA, 75 bp, Artificial Sequence
  Synthetic
cctttacttggtcacgaggcatgctgatgtcatcccggtgcgccggcggggcgacagcagggggagcctgctctc

SEQ ID NO: 109930 - DNA, 75 bp, Artificial Sequence
  Synthetic
ccgtctctcaaggccacatgtaccaccaatcacgactcccccgatgctgacctgattgaagctaacctcctgtgg

SEQ ID NO: 109931 - DNA, 75 bp, Artificial Sequence
  Synthetic
tggaccccacattcaccatagagactaccacagtgccccaggatgctgtctcacgcagtcagaggagaggtagga

SEQ ID NO: 109932 - DNA, 75 bp, Artificial Sequence
  Synthetic
ccaccgatgcccttatgacaggttacaccggtgattttgacagcgtcatcgattgtaacgtggcagtaactcaag

SEQ ID NO: 109933 - DNA, 75 bp, Artificial Sequence
  Synthetic
aggtttctgtggcggcggaagctctgcgcaagaccaagaagtttccgcaagctataccggtgtgggcacgtccgg

SEQ ID NO: 109934 - DNA, 75 bp, Artificial Sequence
  Synthetic
ttgtgcttggtatgagctatctccacaagaaacaactgtgagactgcgagcctacctgaataccccggggcttcc

SEQ ID NO: 109935 - DNA, 75 bp, Artificial Sequence
  Synthetic
taaaccgggggtgtataggtacgtagcccaaggggagcgaccttcggggatgtttgattcggtcgtactgtgcga

SEQ ID NO: 109936 - DNA, 75 bp, Artificial Sequence
  Synthetic
tcctccacggaggaaacggacggtagtgcttaccgagtcgagcgtctctggcgctctagctgaacttgccaagaa

SEQ ID NO: 109937 - DNA, 75 bp, Artificial Sequence
  Synthetic
tgtttgattcggtcgtactgtgcgaagcctatgacaccggctgcgcctggtatgagctgactccctccgagacca

SEQ ID NO: 109938 - DNA, 75 bp, Artificial Sequence
  Synthetic
gtgcttaccgagtcgagcgtctctggcgctctagctgaacttgccaagaagaccttcagcccctccactcaggat

SEQ ID NO: 109939 - DNA, 75 bp, Artificial Sequence
  Synthetic
atcgctggtgcccactggggagtcctagcgggcatagcgtatttctccatggtggggaactgggcgaaggtcctg

SEQ ID NO: 109940 - DNA, 75 bp, Artificial Sequence
  Synthetic
tgcccatttcctctcccagacgaagcaggggggggagaattttgcatatcttgtggcctaccaggccaccgtgtg

SEQ ID NO: 109941 - DNA, 75 bp, Artificial Sequence
  Synthetic
aatgaggtcattacaacacaccctatcacaaaatacatcatgacatgtatgtctgcagacttggaagtcataacc

SEQ ID NO: 109942 - DNA, 75 bp, Artificial Sequence
  Synthetic
ctccgctcgaaggggagccaggtgatcctgacttgacttcagactcgtggtccactgttagcggtagtgaggacg

SEQ ID NO: 109943 - DNA, 75 bp, Artificial Sequence
  Synthetic
ctaggggccgtacaaaatgagatcaccaccacacacccgatcaccaaataaatttccacctgtatggcagctgat

SEQ ID NO: 109944 - DNA, 75 bp, Artificial Sequence
  Synthetic
ctaggggccgtacaaaatgagatcaccaccacacacccgatcaccaaatatatttccacctgtatggcagctgat

SEQ ID NO: 109945 - DNA, 75 bp, Artificial Sequence
  Synthetic
ctaggggccgtacaaaatgagatcaccaccacacacccgatcaccaaatacatttccacctgtatggcagctgat

SEQ ID NO: 109946 - DNA, 75 bp, Artificial Sequence
  Synthetic
ctaggggccgtacaaaatgagatcaccaccacacacccgatcaccaaatagatttccacctgtatggcagctgat

SEQ ID NO: 109947 - DNA, 75 bp, Artificial Sequence
  Synthetic
cctgcgccatcacaacatggtgtacgcgacgacctcccgctcagcgaccacccgccagaagaaggtcacttttga

SEQ ID NO: 109948 - DNA, 75 bp, Artificial Sequence
  Synthetic
cccgccagaagaaggtcacttttgaccgtctccaggtggtcgacaaccattaccacgatgtcttaaaggagatta

SEQ ID NO: 109949 - DNA, 75 bp, Artificial Sequence
  Synthetic
ttgtaacgtctggcaagcccgtattggtgcctgatcgggaagtcttgtatcaacaattcgacgagatggaagagt

SEQ ID NO: 109950 - DNA, 75 bp, Artificial Sequence
  Synthetic
aaaggacgtgcgtagccactctcgcaaggccattaaccacatcaactccgtgtgggaggacttgctggaggactc

SEQ ID NO: 109951 - DNA, 75 bp, Artificial Sequence
  Synthetic
tcccgcttcggccgtgcactaccgcaacagctcaggcgtctatcacatcaccaacgactgccctaactcaagcat

SEQ ID NO: 109952 - DNA, 75 bp, Artificial Sequence
  Synthetic
ggagatcaagccagctgtcacagccgcatggcctaagctggagcaattctggcagaagcatttgtggaactttgt

SEQ ID NO: 109953 - DNA, 75 bp, Artificial Sequence
  Synthetic
ggcgtgcctacctacaactggggtgagaatgatacggacgtcctcgtccttaataacaccaggccaccgttgggc

SEQ ID NO: 109954 - DNA, 75 bp, Artificial Sequence
  Synthetic
cccacttaagacttccacaaccctcctactaaatatcttaggggggtgggttgcctcgcagcttgcaaaccctgt

SEQ ID NO: 109955 - DNA, 75 bp, Artificial Sequence
  Synthetic
gacttgggtgtgcgagtctgcgagaagaaggcactctacgatgtcatccaacaactgcctaaggcagtgatggga

SEQ ID NO: 109956 - DNA, 75 bp, Artificial Sequence
  Synthetic
gtggcggcgccctacctcggtgctccagttgactccctgcggagtcacgtggatctgatggtgggcgccgccact

SEQ ID NO: 109957 - DNA, 75 bp, Artificial Sequence
  Synthetic
acatccaccaccctcctcctcaacatcttgggggggtgggtcgcatcccaactagccccgccctccgcttcaacg

SEQ ID NO: 109958 - DNA, 75 bp, Artificial Sequence
  Synthetic
ttcaagccagtttgctcaaagtaccctactttgtgcgcgttcaaggcctcctccggatctgcgcgctagcgcgga

SEQ ID NO: 109959 - DNA, 75 bp, Artificial Sequence
  Synthetic
ttcccgcctccgccatcgaggtgcgcaacgcgtccgggctttaccatgtcacaaacgactgctccaatgctagca

SEQ ID NO: 109960 - DNA, 75 bp, Artificial Sequence
  Synthetic
gcaattgttccatctacagcggacacattacaggccacaggatggcctgggacatgatgatgaactggagcccga

SEQ ID NO: 109961 - DNA, 75 bp, Artificial Sequence
  Synthetic
gggcactcgtagcgttcaagatcatgagcggagatgccccggcagcagaagacatggtcaatctccttcccgcca

SEQ ID NO: 109962 - DNA, 75 bp, Artificial Sequence
  Synthetic
gggcactcgtagcgttcaagatcatgagcggtgatgccccggcagcagaagacatggtcaatctccttcccgcca

SEQ ID NO: 109963 - DNA, 75 bp, Artificial Sequence
  Synthetic
gggcactcgtagcgttcaagatcatgagcggcgatgccccggcagcagaagacatggtcaatctccttcccgcca

SEQ ID NO: 109964 - DNA, 75 bp, Artificial Sequence
  Synthetic
gggcactcgtagcgttcaagatcatgagcggggatgccccggcagcagaagacatggtcaatctccttcccgcca

SEQ ID NO: 109965 - DNA, 75 bp, Artificial Sequence
  Synthetic
gggctctcgtagcgttcaagatcatgagcggagatgccccggcagcagaagacatggtcaatctccttcccgcca

SEQ ID NO: 109966 - DNA, 75 bp, Artificial Sequence
  Synthetic
gggctctcgtagcgttcaagatcatgagcggtgatgccccggcagcagaagacatggtcaatctccttcccgcca

SEQ ID NO: 109967 - DNA, 75 bp, Artificial Sequence
  Synthetic
gggctctcgtagcgttcaagatcatgagcggcgatgccccggcagcagaagacatggtcaatctccttcccgcca

SEQ ID NO: 109968 - DNA, 75 bp, Artificial Sequence
  Synthetic
gggctctcgtagcgttcaagatcatgagcggggatgccccggcagcagaagacatggtcaatctccttcccgcca

SEQ ID NO: 109969 - DNA, 75 bp, Artificial Sequence
  Synthetic
gggccctcgtagcgttcaagatcatgagcggagatgccccggcagcagaagacatggtcaatctccttcccgcca

SEQ ID NO: 109970 - DNA, 75 bp, Artificial Sequence
  Synthetic
gggccctcgtagcgttcaagatcatgagcggtgatgccccggcagcagaagacatggtcaatctccttcccgcca

SEQ ID NO: 109971 - DNA, 75 bp, Artificial Sequence
  Synthetic
gggccctcgtagcgttcaagatcatgagcggcgatgccccggcagcagaagacatggtcaatctccttcccgcca

SEQ ID NO: 109972 - DNA, 75 bp, Artificial Sequence
  Synthetic
gggccctcgtagcgttcaagatcatgagcggggatgccccggcagcagaagacatggtcaatctccttcccgcca

SEQ ID NO: 109973 - DNA, 75 bp, Artificial Sequence
  Synthetic
gggcgctcgtagcgttcaagatcatgagcggagatgccccggcagcagaagacatggtcaatctccttcccgcca

SEQ ID NO: 109974 - DNA, 75 bp, Artificial Sequence
  Synthetic
gggcgctcgtagcgttcaagatcatgagcggtgatgccccggcagcagaagacatggtcaatctccttcccgcca

SEQ ID NO: 109975 - DNA, 75 bp, Artificial Sequence
  Synthetic
gggcgctcgtagcgttcaagatcatgagcggcgatgccccggcagcagaagacatggtcaatctccttcccgcca

SEQ ID NO: 109976 - DNA, 75 bp, Artificial Sequence
  Synthetic
gggcgctcgtagcgttcaagatcatgagcggggatgccccggcagcagaagacatggtcaatctccttcccgcca

SEQ ID NO: 109977 - DNA, 75 bp, Artificial Sequence
  Synthetic
gatcgcggctagggacatcggctcctccactgcagagcttcgacggcatgtcgacttgctcgttgggggggcggt

SEQ ID NO: 109978 - DNA, 75 bp, Artificial Sequence
  Synthetic
actgggcagtaaagaccaaactcaaactcactccaatcccggctgcgtctcggttggacttgtccggctggttcg

SEQ ID NO: 109979 - DNA, 75 bp, Artificial Sequence
  Synthetic
ctctctcactgtgaccagcctcctacggcgtctgcacgaatggatcaataacgactggtccactccatgtagtgg

SEQ ID NO: 109980 - DNA, 75 bp, Artificial Sequence
  Synthetic
cagcatgcaggctaactgggccaaggtcatcctggtcctgttcctttttgccggagtcgacgcaaagacctacac

SEQ ID NO: 109981 - DNA, 75 bp, Artificial Sequence
  Synthetic
aatcgcgtttgcctcacgaggcaatcacgtgtcgcctacccactaagtgcccgagacagacgcatcgcgtacagt

SEQ ID NO: 109982 - DNA, 75 bp, Artificial Sequence
  Synthetic
aatcgcgtttgcctcacgaggcaatcacgtgtcgcctacccactatgtgcccgagacagacgcatcgcgtacagt

SEQ ID NO: 109983 - DNA, 75 bp, Artificial Sequence
  Synthetic
aatcgcgtttgcctcacgaggcaatcacgtgtcgcctacccactacgtgcccgagacagacgcatcgcgtacagt

SEQ ID NO: 109984 - DNA, 75 bp, Artificial Sequence
  Synthetic
aatcgcgtttgcctcacgaggcaatcacgtgtcgcctacccactaggtgcccgagacagacgcatcgcgtacagt

SEQ ID NO: 109985 - DNA, 75 bp, Artificial Sequence
  Synthetic
aatcgcgtttgcctcacgtggcaatcacgtgtcgcctacccactaagtgcccgagacagacgcatcgcgtacagt

SEQ ID NO: 109986 - DNA, 75 bp, Artificial Sequence
  Synthetic
aatcgcgtttgcctcacgtggcaatcacgtgtcgcctacccactatgtgcccgagacagacgcatcgcgtacagt

SEQ ID NO: 109987 - DNA, 75 bp, Artificial Sequence
  Synthetic
aatcgcgtttgcctcacgtggcaatcacgtgtcgcctacccactacgtgcccgagacagacgcatcgcgtacagt

SEQ ID NO: 109988 - DNA, 75 bp, Artificial Sequence
  Synthetic
aatcgcgtttgcctcacgtggcaatcacgtgtcgcctacccactaggtgcccgagacagacgcatcgcgtacagt

SEQ ID NO: 109989 - DNA, 75 bp, Artificial Sequence
  Synthetic
aatcgcgtttgcctcacgcggcaatcacgtgtcgcctacccactaagtgcccgagacagacgcatcgcgtacagt

SEQ ID NO: 109990 - DNA, 75 bp, Artificial Sequence
  Synthetic
aatcgcgtttgcctcacgcggcaatcacgtgtcgcctacccactatgtgcccgagacagacgcatcgcgtacagt

SEQ ID NO: 109991 - DNA, 75 bp, Artificial Sequence
  Synthetic
aatcgcgtttgcctcacgcggcaatcacgtgtcgcctacccactacgtgcccgagacagacgcatcgcgtacagt

SEQ ID NO: 109992 - DNA, 75 bp, Artificial Sequence
  Synthetic
aatcgcgtttgcctcacgcggcaatcacgtgtcgcctacccactaggtgcccgagacagacgcatcgcgtacagt

SEQ ID NO: 109993 - DNA, 75 bp, Artificial Sequence
  Synthetic
aatcgcgtttgcctcacggggcaatcacgtgtcgcctacccactaagtgcccgagacagacgcatcgcgtacagt

SEQ ID NO: 109994 - DNA, 75 bp, Artificial Sequence
  Synthetic
aatcgcgtttgcctcacggggcaatcacgtgtcgcctacccactatgtgcccgagacagacgcatcgcgtacagt

SEQ ID NO: 109995 - DNA, 75 bp, Artificial Sequence
  Synthetic
aatcgcgtttgcctcacggggcaatcacgtgtcgcctacccactacgtgcccgagacagacgcatcgcgtacagt

SEQ ID NO: 109996 - DNA, 75 bp, Artificial Sequence
  Synthetic
aatcgcgtttgcctcacggggcaatcacgtgtcgcctacccactaggtgcccgagacagacgcatcgcgtacagt

SEQ ID NO: 109997 - DNA, 75 bp, Artificial Sequence
  Synthetic
ttggtcagctgttcaccttttcacctcggcgccattggacaacacaaggctgcaactgctccatctacccaggtc

SEQ ID NO: 109998 - DNA, 75 bp, Artificial Sequence
  Synthetic
cctaactggggccccaatgacccccggcggaggtcccgcaatttgggtaaagtcatcgataccctaacttgtggc

SEQ ID NO: 109999 - DNA, 75 bp, Artificial Sequence
  Synthetic
caccaacattctaagctcgcttaccatcaccagtctcctccgtaagctccatgagtggatcaacagtgattggtc

SEQ ID NO: 110000 - DNA, 75 bp, Artificial Sequence
  Synthetic
caccaacattcttagctcgcttaccatcaccagtctcctccgtaagctccatgagtggatcaacagtgattggtc

SEQ ID NO: 110001 - DNA, 75 bp, Artificial Sequence
  Synthetic
caccaacattctcagctcgcttaccatcaccagtctcctccgtaagctccatgagtggatcaacagtgattggtc

SEQ ID NO: 110002 - DNA, 75 bp, Artificial Sequence
  Synthetic
caccaacattctgagctcgcttaccatcaccagtctcctccgtaagctccatgagtggatcaacagtgattggtc

SEQ ID NO: 110003 - DNA, 75 bp, Artificial Sequence
  Synthetic
cacatcaacaggacttccctcaactgcaatgacagcctcaacacggggtggctggctagcttgttctacgcccat

SEQ ID NO: 110004 - DNA, 75 bp, Artificial Sequence
  Synthetic
ggacatcgtggcaggggcccactggggcatcctagcgggcctggcttactactccatggtagcgaactgggcgaa

SEQ ID NO: 110005 - DNA, 75 bp, Artificial Sequence
  Synthetic
ttgccgggcgtccccttcttctcctgccagcgaggcttcaaaggggtttggaggggcgacggcgtgtgccacaca

SEQ ID NO: 110006 - DNA, 75 bp, Artificial Sequence
  Synthetic
cctccgacgagaggccctactgctggcattacccgccccgcccgtgcggggtggagtcggcatccacggtgtgtg

SEQ ID NO: 110007 - DNA, 75 bp, Artificial Sequence
  Synthetic
ccatcttcctggatgtgtcccctgcgtcaggtacgacaacacgtcgcagtgttggctgcctgttgctcccactat

SEQ ID NO: 110008 - DNA, 75 bp, Artificial Sequence
  Synthetic
cagctggtgcttgtggtggcttcagtacttcctgaccagagtagaagcgcaactgcacgtgtgggttccccccct

SEQ ID NO: 110009 - DNA, 75 bp, Artificial Sequence
  Synthetic
tcattggggccgcatcagaaaattcaactcatgaacaccagtggcagctggcacatcaacaggactgctctaagc

SEQ ID NO: 110010 - DNA, 75 bp, Artificial Sequence
  Synthetic
ccatcaatgccaccaccactggcccaagcgtgcccattccagagcccaactatcggaaggccctgctccgagtat

SEQ ID NO: 110011 - DNA, 75 bp, Artificial Sequence
  Synthetic
acacactccagtcaactcctggctaggcaacatcatcatgtacgcgcccaccttatgggcaaggatgattctgat

SEQ ID NO: 110012 - DNA, 75 bp, Artificial Sequence
  Synthetic
cttcctgaactcgactaggccccctagtggtgcgtggtttgggtgctcttggatgaacagtacagggttcacaaa

SEQ ID NO: 110013 - DNA, 75 bp, Artificial Sequence
  Synthetic
cctcgaggcaatcaagggggggaggcatctcatcttctgtcactcaaagaagaagtgcgacgagctcgccgcaaa

SEQ ID NO: 110014 - DNA, 75 bp, Artificial Sequence
  Synthetic
ctgtgtggtggcgtcttcctggtgggccagctcttcactttccggcccaggtatcacgctactgtccaggattgc

SEQ ID NO: 110015 - DNA, 75 bp, Artificial Sequence
  Synthetic
gagaggatggctagttgccggcgcatcacagactttgcccaagggtcaggtcccatcacatatgccagtgtcaat

SEQ ID NO: 110016 - DNA, 75 bp, Artificial Sequence
  Synthetic
ataggtgtcaccgctggccatctgaagtgtccctgccaagtgccagcccctgaatttttcaccgaggtcgacggc

SEQ ID NO: 110017 - DNA, 75 bp, Artificial Sequence
  Synthetic
ataggtgtcaccgctggccatctgaagtgtccctgccaagtgccagcccctgattttttcaccgaggtcgacggc

SEQ ID NO: 110018 - DNA, 75 bp, Artificial Sequence
  Synthetic
ataggtgtcaccgctggccatctgaagtgtccctgccaagtgccagcccctgactttttcaccgaggtcgacggc

SEQ ID NO: 110019 - DNA, 75 bp, Artificial Sequence
  Synthetic
ataggtgtcaccgctggccatctgaagtgtccctgccaagtgccagcccctgagtttttcaccgaggtcgacggc

SEQ ID NO: 110020 - DNA, 75 bp, Artificial Sequence
  Synthetic
tgagagcgtggagacatcgggccagagcagtccgcgccaagctgatcgcccaaggggggagggcccgcatttgcg

SEQ ID NO: 110021 - DNA, 75 bp, Artificial Sequence
  Synthetic
gacgggattaactatgcaacagggaatcttcctggttgctctttctctatcttcctcttggcacttctctcgtgc

SEQ ID NO: 110022 - DNA, 75 bp, Artificial Sequence
  Synthetic
gcccggtcgtggtgggtaccactgatcgggcgggtgtgcccacctacacttggggggagaatgagacagacgtgt

SEQ ID NO: 110023 - DNA, 75 bp, Artificial Sequence
  Synthetic
tgagggtgccgcagcttctcctcgatatctttcttgaaggacattggggagttatcggtgctgtattatattata

SEQ ID NO: 110024 - DNA, 75 bp, Artificial Sequence
  Synthetic
catgtgagccagagcccgataccgtagtattgacatccatgctacgtgacccagaccacatcaccgccgaaacgg

SEQ ID NO: 110025 - DNA, 75 bp, Artificial Sequence
  Synthetic
tgtggttcagggccttggctcacgccgaggtgtatggtccactacccgtataggctgtggcattacccgtgcact

SEQ ID NO: 110026 - DNA, 75 bp, Artificial Sequence
  Synthetic
ggcgggcaactggttcggctgcacctggatgaatgctaccgggtttaccaaaacgtgcggggcccccccatgtaa

SEQ ID NO: 110027 - DNA, 75 bp, Artificial Sequence
  Synthetic
cagctcatcagcaagtcagctctcagctccatcattaaaggcgacgtgcactacgcacggtcagcatcctgacgc

SEQ ID NO: 110028 - DNA, 75 bp, Artificial Sequence
  Synthetic
atgtcctatgcccgaccccgctatttcctcctgtgcctactcctgcttactgcaggggtaggcatcttcctgctg

SEQ ID NO: 110029 - DNA, 75 bp, Artificial Sequence
  Synthetic
agcacagagaccgctccgagctgtctcccctgctcctcactaccacgcaatggcaagtcctcccttgctccttta

SEQ ID NO: 110030 - DNA, 75 bp, Artificial Sequence
  Synthetic
cagcattgtcaagatctttgaccaggggccccggcagaacatccagcttatcaacactaatggcagctggcacat

SEQ ID NO: 110031 - DNA, 75 bp, Artificial Sequence
  Synthetic
cagctttgtcaagatctttgaccaggggccccggcagaacatccagcttatcaacactaatggcagctggcacat

SEQ ID NO: 110032 - DNA, 75 bp, Artificial Sequence
  Synthetic
cagccttgtcaagatctttgaccaggggccccggcagaacatccagcttatcaacactaatggcagctggcacat

SEQ ID NO: 110033 - DNA, 75 bp, Artificial Sequence
  Synthetic
cagcgttgtcaagatctttgaccaggggccccggcagaacatccagcttatcaacactaatggcagctggcacat

SEQ ID NO: 110034 - DNA, 75 bp, Artificial Sequence
  Synthetic
ctgcattgtcaagatctttgaccaggggccccggcagaacatccagcttatcaacactaatggcagctggcacat

SEQ ID NO: 110035 - DNA, 75 bp, Artificial Sequence
  Synthetic
ctgctttgtcaagatctttgaccaggggccccggcagaacatccagcttatcaacactaatggcagctggcacat

SEQ ID NO: 110036 - DNA, 75 bp, Artificial Sequence
  Synthetic
ctgccttgtcaagatctttgaccaggggccccggcagaacatccagcttatcaacactaatggcagctggcacat

SEQ ID NO: 110037 - DNA, 75 bp, Artificial Sequence
  Synthetic
ctgcgttgtcaagatctttgaccaggggccccggcagaacatccagcttatcaacactaatggcagctggcacat

SEQ ID NO: 110038 - DNA, 75 bp, Artificial Sequence
  Synthetic
ccgcattgtcaagatctttgaccaggggccccggcagaacatccagcttatcaacactaatggcagctggcacat

SEQ ID NO: 110039 - DNA, 75 bp, Artificial Sequence
  Synthetic
ccgctttgtcaagatctttgaccaggggccccggcagaacatccagcttatcaacactaatggcagctggcacat

SEQ ID NO: 110040 - DNA, 75 bp, Artificial Sequence
  Synthetic
ccgccttgtcaagatctttgaccaggggccccggcagaacatccagcttatcaacactaatggcagctggcacat

SEQ ID NO: 110041 - DNA, 75 bp, Artificial Sequence
  Synthetic
ccgcgttgtcaagatctttgaccaggggccccggcagaacatccagcttatcaacactaatggcagctggcacat

SEQ ID NO: 110042 - DNA, 75 bp, Artificial Sequence
  Synthetic
cggcattgtcaagatctttgaccaggggccccggcagaacatccagcttatcaacactaatggcagctggcacat

SEQ ID NO: 110043 - DNA, 75 bp, Artificial Sequence
  Synthetic
cggctttgtcaagatctttgaccaggggccccggcagaacatccagcttatcaacactaatggcagctggcacat

SEQ ID NO: 110044 - DNA, 75 bp, Artificial Sequence
  Synthetic
cggccttgtcaagatctttgaccaggggccccggcagaacatccagcttatcaacactaatggcagctggcacat

SEQ ID NO: 110045 - DNA, 75 bp, Artificial Sequence
  Synthetic
cggcgttgtcaagatctttgaccaggggccccggcagaacatccagcttatcaacactaatggcagctggcacat

SEQ ID NO: 110046 - DNA, 75 bp, Artificial Sequence
  Synthetic
tgtgcaccctgatgctgagctgatcgaagctaatttgctatggaggcaggagatgggtggcaacattacaagagt

SEQ ID NO: 110047 - DNA, 75 bp, Artificial Sequence
  Synthetic
catcgggggggggagcggcagcaacaccttgatctgccctaccgactgctttcgcaagcatccggaggccactta

SEQ ID NO: 110048 - DNA, 75 bp, Artificial Sequence
  Synthetic
agagtcagagaacaaagtagtgatcctcgactcatttgaccctctggtcgctgaaaccgacgatagggagatttc

SEQ ID NO: 110049 - DNA, 75 bp, Artificial Sequence
  Synthetic
tgagacctggaagagaccggactatgacccaccgctggttcgagggtgtgccatgcctccccccaaacaacctcc

SEQ ID NO: 110050 - DNA, 75 bp, Artificial Sequence
  Synthetic
aaggtccggatgtatgtgggcggagtggagcacaggttggacgccgcatgcaactggacccggggggagcgctgc

SEQ ID NO: 110051 - DNA, 75 bp, Artificial Sequence
  Synthetic
atgagtagttgcaagccgctgcatgcatttgatcaaggctggggacccctcgaatatgtcaacatcagtggctca

SEQ ID NO: 110052 - DNA, 75 bp, Artificial Sequence
  Synthetic
gattaagtgggagtacgtagtgctcgcatttttgttgctcgcggacgccagggtctgtgcatgcctctggatgat

SEQ ID NO: 110053 - DNA, 75 bp, Artificial Sequence
  Synthetic
aaggccccagactacgaccctcccgtggtgtccggatgtgctttgccccctcaggggttgccacccgtccctccg

SEQ ID NO: 110054 - DNA, 75 bp, Artificial Sequence
  Synthetic
ccccccacagctgactcagattctggtcaccctacaaccagtaagagctcagaccaagccagcgacgaggctgat

SEQ ID NO: 110055 - DNA, 75 bp, Artificial Sequence
  Synthetic
tcctaactgacctcctagccgggggtcattggggcgtgctcgcagggctagcatacttcagcatgcaagccaact

SEQ ID NO: 110056 - DNA, 75 bp, Artificial Sequence
  Synthetic
ccacaggtctaatccatctccaccaaaacatcgtggacatacagtacctgtatggaatagggtcggtagtcgtga

SEQ ID NO: 110057 - DNA, 75 bp, Artificial Sequence
  Synthetic
ctgtggtggtaggtaccaccgacaggaagggacttcccacatatacttggggagagaacgagaccgacgtgttct

SEQ ID NO: 110058 - DNA, 75 bp, Artificial Sequence
  Synthetic
atctgtgtggcctggcacatcaaaggaagactcccagccgccgctgcttacgcggcttgcgggatgtggcccctg

SEQ ID NO: 110059 - DNA, 75 bp, Artificial Sequence
  Synthetic
tcaggggttgccacccgtccctccgcctcggcggaaaaggatggtgagccttgacgagtcctccgtctcggccgc

SEQ ID NO: 110060 - DNA, 75 bp, Artificial Sequence
  Synthetic
tcaggggttgccacccgtccctccgcctcggcggaaaaggatggtgtgccttgacgagtcctccgtctcggccgc

SEQ ID NO: 110061 - DNA, 75 bp, Artificial Sequence
  Synthetic
tcaggggttgccacccgtccctccgcctcggcggaaaaggatggtgcgccttgacgagtcctccgtctcggccgc

SEQ ID NO: 110062 - DNA, 75 bp, Artificial Sequence
  Synthetic
tcaggggttgccacccgtccctccgcctcggcggaaaaggatggtgggccttgacgagtcctccgtctcggccgc

SEQ ID NO: 110063 - DNA, 75 bp, Artificial Sequence
  Synthetic
tgagatggaagagtgctctcagcacttaccgtacatcgagcaggggatgatgctcgctgagcagttcaagcagaa

SEQ ID NO: 110064 - DNA, 75 bp, Artificial Sequence
  Synthetic
agggtgacagcgtcgtgtgctgttctatgtcatacagttggacgggggcactggttacaccatgtgcagccgaag

SEQ ID NO: 110065 - DNA, 75 bp, Artificial Sequence
  Synthetic
agggtgacagcgtcgtgtgctgttctatgtcatacagttggacgggggcactggttacaccttgtgcagccgaag

SEQ ID NO: 110066 - DNA, 75 bp, Artificial Sequence
  Synthetic
agggtgacagcgtcgtgtgctgttctatgtcatacagttggacgggggcactggttacaccctgtgcagccgaag

SEQ ID NO: 110067 - DNA, 75 bp, Artificial Sequence
  Synthetic
agggtgacagcgtcgtgtgctgttctatgtcatacagttggacgggggcactggttacaccgtgtgcagccgaag

SEQ ID NO: 110068 - DNA, 75 bp, Artificial Sequence
  Synthetic
agggtgacagcgtcgtgtgctgttctatgtcatacagttggacgggggctctggttacaccatgtgcagccgaag

SEQ ID NO: 110069 - DNA, 75 bp, Artificial Sequence
  Synthetic
agggtgacagcgtcgtgtgctgttctatgtcatacagttggacgggggctctggttacaccttgtgcagccgaag

SEQ ID NO: 110070 - DNA, 75 bp, Artificial Sequence
  Synthetic
agggtgacagcgtcgtgtgctgttctatgtcatacagttggacgggggctctggttacaccctgtgcagccgaag

SEQ ID NO: 110071 - DNA, 75 bp, Artificial Sequence
  Synthetic
agggtgacagcgtcgtgtgctgttctatgtcatacagttggacgggggctctggttacaccgtgtgcagccgaag

SEQ ID NO: 110072 - DNA, 75 bp, Artificial Sequence
  Synthetic
agggtgacagcgtcgtgtgctgttctatgtcatacagttggacgggggccctggttacaccatgtgcagccgaag

SEQ ID NO: 110073 - DNA, 75 bp, Artificial Sequence
  Synthetic
agggtgacagcgtcgtgtgctgttctatgtcatacagttggacgggggccctggttacaccttgtgcagccgaag

SEQ ID NO: 110074 - DNA, 75 bp, Artificial Sequence
  Synthetic
agggtgacagcgtcgtgtgctgttctatgtcatacagttggacgggggccctggttacaccctgtgcagccgaag

SEQ ID NO: 110075 - DNA, 75 bp, Artificial Sequence
  Synthetic
agggtgacagcgtcgtgtgctgttctatgtcatacagttggacgggggccctggttacaccgtgtgcagccgaag

SEQ ID NO: 110076 - DNA, 75 bp, Artificial Sequence
  Synthetic
agggtgacagcgtcgtgtgctgttctatgtcatacagttggacgggggcgctggttacaccatgtgcagccgaag

SEQ ID NO: 110077 - DNA, 75 bp, Artificial Sequence
  Synthetic
agggtgacagcgtcgtgtgctgttctatgtcatacagttggacgggggcgctggttacaccttgtgcagccgaag

SEQ ID NO: 110078 - DNA, 75 bp, Artificial Sequence
  Synthetic
agggtgacagcgtcgtgtgctgttctatgtcatacagttggacgggggcgctggttacaccctgtgcagccgaag

SEQ ID NO: 110079 - DNA, 75 bp, Artificial Sequence
  Synthetic
agggtgacagcgtcgtgtgctgttctatgtcatacagttggacgggggcgctggttacaccgtgtgcagccgaag

SEQ ID NO: 110080 - DNA, 75 bp, Artificial Sequence
  Synthetic
gatggaccctgctcagacgcgtccgatgatgactcttgcagctcaatgccgcccttggaaggcgagcccggcgat

SEQ ID NO: 110081 - DNA, 75 bp, Artificial Sequence
  Synthetic
tatgtctagaggcactagcaacaatagcctggtgtgtcccactgactgcttccggaaacacccagaagctactta

SEQ ID NO: 110082 - DNA, 75 bp, Artificial Sequence
  Synthetic
gggtgcatggcgtcgttcccttccttgtgtttttctgcgccgcatggtatgtgaaaggcagatgggttcctggtg

SEQ ID NO: 110083 - DNA, 75 bp, Artificial Sequence
  Synthetic
cgctgtcgccacattacaaacagtggctggcacggggagtgtggtggttgcaatattttattgccagagttgagg

SEQ ID NO: 110084 - DNA, 75 bp, Artificial Sequence
  Synthetic
ccgtggcttactaccgcggccttgacgtgtccgtcatcccgaccagcggcgatgttgtcgtcgtggcaactgatg

SEQ ID NO: 110085 - DNA, 75 bp, Artificial Sequence
  Synthetic
tctcctttcacctggaccgaaccagcagctgcagcttgttaacagcaatggaagctggcacatcaataggactgc

SEQ ID NO: 110086 - DNA, 75 bp, Artificial Sequence
  Synthetic
gacgcccgcgtctgcgcgtgcttgtggatgatgttgctggtctcccaggtggaagcggctttggagaacctggtg

SEQ ID NO: 110087 - DNA, 75 bp, Artificial Sequence
  Synthetic
caccaagcacttgctcgctctgctgggtcctatttatgtacttcaggcctcattgctgcgtatcccctactttgt

SEQ ID NO: 110088 - DNA, 75 bp, Artificial Sequence
  Synthetic
gcctataagccccttaagcaattctcttatacgccatcacaacttggtgtattcaaccacttctcgcacagcgag

SEQ ID NO: 110089 - DNA, 75 bp, Artificial Sequence
  Synthetic
atcgggaggtagccgcgtcctgtggcggtgctgtcctcgtctgccttatggtcctcactttgtcaccacattaca

SEQ ID NO: 110090 - DNA, 75 bp, Artificial Sequence
  Synthetic
gttgaggaagcatgcgatcttacccctccacactcagctcgttcgaagtttgggtatggagcaaaagacgtccgg

SEQ ID NO: 110091 - DNA, 75 bp, Artificial Sequence
  Synthetic
aaggtgcggatgtttgtgggcggtattgaacacaggttcgaggctgcctgcaactggactcgcggtgacccatgt

SEQ ID NO: 110092 - DNA, 75 bp, Artificial Sequence
  Synthetic
acagggtggttggccagcttgttctacacccacagattcaacagctctgggtgtcctgagcgaacagctagctgc

SEQ ID NO: 110093 - DNA, 75 bp, Artificial Sequence
  Synthetic
cccctactggcaattggtttggctgcacctggatgaatgccacagggtatgtgaagacttgcggggccccgcctt

SEQ ID NO: 110094 - DNA, 75 bp, Artificial Sequence
  Synthetic
aaaagctcgggctgcaagcgtgagcgcaaagctcctctcaacggaggatgcctgtgatctcacgcctccccactc

SEQ ID NO: 110095 - DNA, 75 bp, Artificial Sequence
  Synthetic
ccgcgatgctatcatcctcctcgcgtgcttggtccaccctggtcttatgtttgacatcactaagctgttgctcgc

SEQ ID NO: 110096 - DNA, 75 bp, Artificial Sequence
  Synthetic
ccaccggcttaatccacctccaccaaaacatcgtggacgtccagtacctttacggagtttcctcggcccttgtgt

SEQ ID NO: 110097 - DNA, 75 bp, Artificial Sequence
  Synthetic
acctacgtctatgaccatcttgctccgctgtccacctggactgccgacggcctcaaagacctagcagtggcgctt

SEQ ID NO: 110098 - DNA, 75 bp, Artificial Sequence
  Synthetic
acctacgtctatgaccatcttgctccgctgtccacctggtctgccgacggcctcaaagacctagcagtggcgctt

SEQ ID NO: 110099 - DNA, 75 bp, Artificial Sequence
  Synthetic
acctacgtctatgaccatcttgctccgctgtccacctggcctgccgacggcctcaaagacctagcagtggcgctt

SEQ ID NO: 110100 - DNA, 75 bp, Artificial Sequence
  Synthetic
acctacgtctatgaccatcttgctccgctgtccacctgggctgccgacggcctcaaagacctagcagtggcgctt

SEQ ID NO: 110101 - DNA, 75 bp, Artificial Sequence
  Synthetic
gtgcgtttggatgaacggcaccggatttacaaaggcatgtggcggccctccgtgcgaggtgacaaccaacaacca

SEQ ID NO: 110102 - DNA, 75 bp, Artificial Sequence
  Synthetic
gctaaggaagtccgtagccattctagcagggccattaaccacatcaactccgtgtgggaggacctgttagaagac

SEQ ID NO: 110103 - DNA, 75 bp, Artificial Sequence
  Synthetic
tacatcatgacatgcatgtcggccgacctggaggtcgtcacgagtacctgggtgctcgttggcggcgtcctggct

SEQ ID NO: 110104 - DNA, 75 bp, Artificial Sequence
  Synthetic
actttgtgcgcgcgcagggccttatccgcatgtgcatgttggtgcgcaagctcgtggggggccattacgtgcaga

SEQ ID NO: 110105 - DNA, 75 bp, Artificial Sequence
  Synthetic
ggaagctgctttggagaaccttatcgctcttaacgctgcttctgccgccagtaaccagggattgatgtggggatt

SEQ ID NO: 110106 - DNA, 75 bp, Artificial Sequence
  Synthetic
ggctgggcaacgagatcttgctcggccctgctgatgcggagacaagcagggggtggagactccttgctccggtca

SEQ ID NO: 110107 - DNA, 75 bp, Artificial Sequence
  Synthetic
cgtgatgtccgctacgctctgctctgctctctacgtgggggacctctgcggcggggtaatgctggcagcccagat

SEQ ID NO: 110108 - DNA, 75 bp, Artificial Sequence
  Synthetic
cggatctaggggttcgggtgtgcgagaaaagggcactgtatgacatcacacgcaagttgcccttggccgccatgg

SEQ ID NO: 110109 - DNA, 75 bp, Artificial Sequence
  Synthetic
ggcggtcgagccggtcgtgttctcccaaatggagacaaaggtcatcacctggggggcagacaccgccgcatgtgg

SEQ ID NO: 110110 - DNA, 75 bp, Artificial Sequence
  Synthetic
tactgccacgcagtcctttttggggaccgcagtaaatggtgttatgtggactgtataccatggggccggcagcaa

SEQ ID NO: 110111 - DNA, 75 bp, Artificial Sequence
  Synthetic
tactgccacgcagtcctttttggggaccgcagtaaatggtgttatgtggactgtttaccatggggccggcagcaa

SEQ ID NO: 110112 - DNA, 75 bp, Artificial Sequence
  Synthetic
tactgccacgcagtcctttttggggaccgcagtaaatggtgttatgtggactgtctaccatggggccggcagcaa

SEQ ID NO: 110113 - DNA, 75 bp, Artificial Sequence
  Synthetic
tactgccacgcagtcctttttggggaccgcagtaaatggtgttatgtggactgtgtaccatggggccggcagcaa

SEQ ID NO: 110114 - DNA, 75 bp, Artificial Sequence
  Synthetic
ttaccacggagggcatatgccttccagggagacgaggcagcgtctctggggttgctggtaatcatcatcatcact

SEQ ID NO: 110115 - DNA, 75 bp, Artificial Sequence
  Synthetic
agttcaagcagaaggccctcggcctcctgcagaccgcgtcccgccaggcagaggtcatcgcccctgctgtccaga

SEQ ID NO: 110116 - DNA, 75 bp, Artificial Sequence
  Synthetic
tgctctggaggacagagatcgctcggagctttcgcccttgcttctttccaccacgcagtggcaggtgctcccctg

SEQ ID NO: 110117 - DNA, 75 bp, Artificial Sequence
  Synthetic
taggtgttttgactcgactgtcacggaaagagacatccgtacagaaggggatatataccagtgttgccaactcga

SEQ ID NO: 110118 - DNA, 75 bp, Artificial Sequence
  Synthetic
atgaactggtcacccactaccaccatgatcctggcttacgtgatgcgcgtccccgaggtcatcatagacatcatt

SEQ ID NO: 110119 - DNA, 75 bp, Artificial Sequence
  Synthetic
ccgtgtacttgcggcgcgtcagacctattcctagtcaccaggcacgcggacgtcattcctgttcgcaggagaggt

SEQ ID NO: 110120 - DNA, 75 bp, Artificial Sequence
  Synthetic
tacgagcctaaccggccgggacaagaaccaggtggagggtgagatccagattgtgtccaccgcgacgcaaacctt

SEQ ID NO: 110121 - DNA, 75 bp, Artificial Sequence
  Synthetic
acgcgggatccaccagaattgggagtgctgtctctcataacaccgacagcttcgccggcctcctctcacccggct

SEQ ID NO: 110122 - DNA, 75 bp, Artificial Sequence
  Synthetic
tgcccccattgcaagttcgcggcgggcgtgatgccgtcatcttgcttgcttgcttgctccatccgcaattggggt

SEQ ID NO: 110123 - DNA, 75 bp, Artificial Sequence
  Synthetic
accagaagccagaaaagtcatatcatcactgactgagaggctgtacgttgggggccctatgttaaactccaaggg

SEQ ID NO: 110124 - DNA, 75 bp, Artificial Sequence
  Synthetic
ctaagcagaacatccagcttattaacaccaatggcagttggcacatcaaccgcaccgccctgaattgtaatgaca

SEQ ID NO: 110125 - DNA, 75 bp, Artificial Sequence
  Synthetic
cattaaggccgaggccgcatgccgtgcagccaaactcaagaattatgacatgttggtctgtggggacgacttagt

SEQ ID NO: 110126 - DNA, 75 bp, Artificial Sequence
  Synthetic
cattaaggccgaggccgcatgccgtgcagccaaactcaagaattttgacatgttggtctgtggggacgacttagt

SEQ ID NO: 110127 - DNA, 75 bp, Artificial Sequence
  Synthetic
cattaaggccgaggccgcatgccgtgcagccaaactcaagaattctgacatgttggtctgtggggacgacttagt

SEQ ID NO: 110128 - DNA, 75 bp, Artificial Sequence
  Synthetic
cattaaggccgaggccgcatgccgtgcagccaaactcaagaattgtgacatgttggtctgtggggacgacttagt

SEQ ID NO: 110129 - DNA, 75 bp, Artificial Sequence
  Synthetic
tccgagcggcagtatgtacccggggcgtggctaaagcggtggactttgtgccagttgagtccatagagaccacca

SEQ ID NO: 110130 - DNA, 75 bp, Artificial Sequence
  Synthetic
tccgagcggcagtatgtacccggggcgtggctaaagcggtggactttgtgccagttgagtccttagagaccacca

SEQ ID NO: 110131 - DNA, 75 bp, Artificial Sequence
  Synthetic
tccgagcggcagtatgtacccggggcgtggctaaagcggtggactttgtgccagttgagtccctagagaccacca

SEQ ID NO: 110132 - DNA, 75 bp, Artificial Sequence
  Synthetic
tccgagcggcagtatgtacccggggcgtggctaaagcggtggactttgtgccagttgagtccgtagagaccacca

SEQ ID NO: 110133 - DNA, 75 bp, Artificial Sequence
  Synthetic
aatgtggaccaagaccttgtcggctggccggcgccccccggggcgcggtcattaacgccatgtacctgcggctcc

SEQ ID NO: 110134 - DNA, 75 bp, Artificial Sequence
  Synthetic
tcgcgcctgtatgaccctccggggtattgcaggtgggaagtatgcccaggctttgctgttaaaactgggcgcatg

SEQ ID NO: 110135 - DNA, 75 bp, Artificial Sequence
  Synthetic
ttctcttcatctgtgttgcttggcatattaaaggcaggcttccagccgctaccgcttacgcggcttgtgggctgt

SEQ ID NO: 110136 - DNA, 75 bp, Artificial Sequence
  Synthetic
cctgaggacgaagctgctctgcgagcattcacggatgctatgaccagatactcagcccctcctggggatgccccg

SEQ ID NO: 110137 - DNA, 75 bp, Artificial Sequence
  Synthetic
cctgaggacgatgctgctctgcgagcattcacggatgctatgaccagatactcagcccctcctggggatgccccg

SEQ ID NO: 110138 - DNA, 75 bp, Artificial Sequence
  Synthetic
cctgaggacgacgctgctctgcgagcattcacggatgctatgaccagatactcagcccctcctggggatgccccg

SEQ ID NO: 110139 - DNA, 75 bp, Artificial Sequence
  Synthetic
cctgaggacgaggctgctctgcgagcattcacggatgctatgaccagatactcagcccctcctggggatgccccg

SEQ ID NO: 110140 - DNA, 75 bp, Artificial Sequence
  Synthetic
ccagatctccagtgttcaccgacaattcaacgcctcctgcggtgccccagacttaccaagtggcccatttgcatg

SEQ ID NO: 110141 - DNA, 75 bp, Artificial Sequence
  Synthetic
gcgaggcgacagcagagggagcttgctctctcctcggccagtgtcctacttgaagggctcttcgggtgggccact

SEQ ID NO: 110142 - DNA, 75 bp, Artificial Sequence
  Synthetic
cgtggccactgataataccgggagccggtattactacctcactcgtgatccagctactccactgtcgcgggcggc

SEQ ID NO: 110143 - DNA, 75 bp, Artificial Sequence
  Synthetic
cccatggaaaagaaggtcatcatttggggcgccgacaccgccgcatgcggagacatcataactgggctgcctgtc

SEQ ID NO: 110144 - DNA, 75 bp, Artificial Sequence
  Synthetic
catcttgacgctatccccatattacaagcagtggctggcacgaggtgtttggtggttgcaatatttcatcgctag

SEQ ID NO: 110145 - DNA, 75 bp, Artificial Sequence
  Synthetic
ttttggggcatacatgtccaaggcatacggcatcgacccgaacatccggtcgggcgtcaggaccatcactacagg

SEQ ID NO: 110146 - DNA, 75 bp, Artificial Sequence
  Synthetic
agttgaggctgagttgttcgtgtacattccatcatttgaagtacgcggcccgcgagactcgttgatcattctcgc

SEQ ID NO: 110147 - DNA, 75 bp, Artificial Sequence
  Synthetic
accacaatgcggtctccagttttcactgacaattcatccccacctgtcgtgccccagacataccaagtggcgcac

SEQ ID NO: 110148 - DNA, 75 bp, Artificial Sequence
  Synthetic
gggagaatgagacagatgttttcctgttgaacagcacccgaccaccgcgggggtcatggttcggctgcacgtgga

SEQ ID NO: 110149 - DNA, 75 bp, Artificial Sequence
  Synthetic
ttctcaatactccaatcccaagaactactccatagggcccttgactttgatatgtacggggttacctattcagtc

SEQ ID NO: 110150 - DNA, 75 bp, Artificial Sequence
  Synthetic
ccaggggtgtggtgggtaccatcgtcaccagcctcactggtcgggacaaaaatgaggtggggggagagattcagg

SEQ ID NO: 110151 - DNA, 75 bp, Artificial Sequence
  Synthetic
gattccacaacgatccttggcataggcacagtcctagaccaagccgagaccgctggggttcgcctcaccgtgctc

SEQ ID NO: 110152 - DNA, 75 bp, Artificial Sequence
  Synthetic
gttctgaatccctctgtcgccgccaccctcggcttcggcgcttatatgtccaaagcgcatgggatagatccaaac

SEQ ID NO: 110153 - DNA, 75 bp, Artificial Sequence
  Synthetic
caaagcgcatgggatagatccaaacataaggaccggtgtgaggaccatcaacacgggctccgccatcacatattc

SEQ ID NO: 110154 - DNA, 75 bp, Artificial Sequence
  Synthetic
gcctcaggaagcttggggcgcccccgttaagggcgtggagacatcgggcaagggcggtcagagcaaaactcattg

SEQ ID NO: 110155 - DNA, 75 bp, Artificial Sequence
  Synthetic
gcctcaggaagcttggggcgcccccgttaagggcgtggagacatcgggcaagggcggtcagagctaaactcattg

SEQ ID NO: 110156 - DNA, 75 bp, Artificial Sequence
  Synthetic
gcctcaggaagcttggggcgcccccgttaagggcgtggagacatcgggcaagggcggtcagagccaaactcattg

SEQ ID NO: 110157 - DNA, 75 bp, Artificial Sequence
  Synthetic
gcctcaggaagcttggggcgcccccgttaagggcgtggagacatcgggcaagggcggtcagagcgaaactcattg

SEQ ID NO: 110158 - DNA, 75 bp, Artificial Sequence
  Synthetic
ggggccagtgtgtcaaatgtacaccaatgttgatcaggatctggtaggatggcctgcaccccccggagcacgctc

SEQ ID NO: 110159 - DNA, 75 bp, Artificial Sequence
  Synthetic
atttatcacagcgtgtcccaggctcgaccccgcatgttactcctgtgcctactcctactttccgtaggggtaggc

SEQ ID NO: 110160 - DNA, 75 bp, Artificial Sequence
  Synthetic
tccccttatccctgatcaaggggggcaggcatcttatcttttgccattcaaagaagaagtgtgacgagttggcca

SEQ ID NO: 110161 - DNA, 75 bp, Artificial Sequence
  Synthetic
tgcacagttaactattccatcttcaagataaggatgtatgtaggggggattgagcacaggctcacggccgcgtgt

SEQ ID NO: 110162 - DNA, 75 bp, Artificial Sequence
  Synthetic
ctcagggggggaaagcggcaaactgcggcaagtacctcttcaactgggcggtgaggactaagctcaaactcactc

SEQ ID NO: 110163 - DNA, 75 bp, Artificial Sequence
  Synthetic
ctcagggggggaaagcggctaactgcggcaagtacctcttcaactgggcggtgaggactaagctcaaactcactc

SEQ ID NO: 110164 - DNA, 75 bp, Artificial Sequence
  Synthetic
ctcagggggggaaagcggccaactgcggcaagtacctcttcaactgggcggtgaggactaagctcaaactcactc

SEQ ID NO: 110165 - DNA, 75 bp, Artificial Sequence
  Synthetic
ctcagggggggaaagcggcgaactgcggcaagtacctcttcaactgggcggtgaggactaagctcaaactcactc

SEQ ID NO: 110166 - DNA, 75 bp, Artificial Sequence
  Synthetic
cctactcctactttccgtaggggtaggcattttcttgctgcctgctcggtagacgggtagcttaacactccattt

SEQ ID NO: 110167 - DNA, 75 bp, Artificial Sequence
  Synthetic
cttagtccgagacctatcagtacactgaaggggtcgtctggtggtcctctgatgtgtccctccggtcatgtcgtg

SEQ ID NO: 110168 - DNA, 75 bp, Artificial Sequence
  Synthetic
ggacgcgggggggacatatttcacagcgtgtcccgtgcccgaccccgcttgttactcctttgcctactcctactg

SEQ ID NO: 110169 - DNA, 75 bp, Artificial Sequence
  Synthetic
caggcatcttatcttttgccattcaaagaagaagtgtgacgagttggccaaacagttatcatcacttggccttaa

SEQ ID NO: 110170 - DNA, 75 bp, Artificial Sequence
  Synthetic
tccgtaggggtaggcgtcatcttgctccctaaccggtgagcaagaaactaaggcaacactccactgttttttttt

SEQ ID NO: 110171 - DNA, 75 bp, Artificial Sequence
  Synthetic
atagagaccacaacggtgcctcaggatgcggtatcccgaagccagcggagaggccgcactggtagggggaggctg

SEQ ID NO: 110172 - DNA, 75 bp, Artificial Sequence
  Synthetic
cagacaattcaactccacctgctgtcccacaaacatatcaagtggggtatcttcacgcccctacgggcagtggca

SEQ ID NO: 110173 - DNA, 75 bp, Artificial Sequence
  Synthetic
gaccccccctcccgggagagccatagtggtctgcggaaccggtgagtacaccggaattgccaggacgaccgggtc

SEQ ID NO: 110174 - DNA, 75 bp, Artificial Sequence
  Synthetic
gtgtcaacgccgtagcgtactaccggggcctcgacgtgtccgttattccatctagcggtgacgtcgtcgttgttt

SEQ ID NO: 110175 - DNA, 75 bp, Artificial Sequence
  Synthetic
tcttgcacgctgcgagcgcagctagctgcaatggcttcctatattttgtcatctttttcgtggctgcttggtaca

SEQ ID NO: 110176 - DNA, 75 bp, Artificial Sequence
  Synthetic
gggcctcgacgtgtccgttattccatctagcggtgacgtcgtcgttgtttccaccgacgccctgatgacaggttt

SEQ ID NO: 110177 - DNA, 75 bp, Artificial Sequence
  Synthetic
atctttttcgtggctgcttggtacatcaaaggtcgggtggtccccttggccacctattccctcaccggcctatgg

SEQ ID NO: 110178 - DNA, 75 bp, Artificial Sequence
  Synthetic
tgacaccggctgagacaaccaccaggctgcgggcatatttcaacacaccaggtctccccgtctgtcaagatcacc

SEQ ID NO: 110179 - DNA, 75 bp, Artificial Sequence
  Synthetic
caaagcccacggtattgaccctaacatccgtactggggtgaggactattacaactggtggagcaattacttattc

SEQ ID NO: 110180 - DNA, 75 bp, Artificial Sequence
  Synthetic
ccccaagacgccgtgtcccgctcccaacgacggggtagaaccggcaggggcaggcctggcatctacaggtttgtg

SEQ ID NO: 110181 - DNA, 75 bp, Artificial Sequence
  Synthetic
ggtataccatgtcacgaacgactgctccaactcaagcattgtgtatgaggcagcggacatgatcatgcatacccc

SEQ ID NO: 110182 - DNA, 75 bp, Artificial Sequence
  Synthetic
cattcagccagatccaagtttggctatggggcaaaagacgtccgttgccatgccagaaaggccgtaaaccacatc

SEQ ID NO: 110183 - DNA, 75 bp, Artificial Sequence
  Synthetic
cctcagccctagaccaatatccactcttaagggctcttcgggcggtcctctgctgtgccccctgggccacgctgt

SEQ ID NO: 110184 - DNA, 75 bp, Artificial Sequence
  Synthetic
tggttgtgctatctcctgaccctgggggaagccatgattcaggagtgggtaccacccatgcaggcgcgtggtggc

SEQ ID NO: 110185 - DNA, 75 bp, Artificial Sequence
  Synthetic
tgtttgattcctcggtcttatgtgagtgctatgacgccggctgtgcttggtacgagctcacgcccgccgagacct

SEQ ID NO: 110186 - DNA, 75 bp, Artificial Sequence
  Synthetic
tgctgtgccccctgggccacgctgtcgggatattccgtgcagcagtgtgtacccggggcgtggctaaagcagtag

SEQ ID NO: 110187 - DNA, 75 bp, Artificial Sequence
  Synthetic
ggtatagggactgtgctggaccaggcggaaacggccggggtcaggctcaccgtgcttgctacagcgactccccct

SEQ ID NO: 110188 - DNA, 75 bp, Artificial Sequence
  Synthetic
ccatattctgcccgggtgtggtgtttgacataaccaagtggctcctggcgctgcttgggcctggctacctcctga

SEQ ID NO: 110189 - DNA, 75 bp, Artificial Sequence
  Synthetic
tctgacaactctacgcctcctgcagtgcctcaatcctaccaagttgcccatttgcatgcgccgacgggaagtggc

SEQ ID NO: 110190 - DNA, 75 bp, Artificial Sequence
  Synthetic
gcttgtatgtcagctgacctggaagtggtgactagcacgtgggtcttggtaggcggcattctggcggccctggct

SEQ ID NO: 110191 - DNA, 75 bp, Artificial Sequence
  Synthetic
agggaggaagacacctaattttctgccattccaagaagaagtgtgatgaactggccaaacaactcacatctttgg

SEQ ID NO: 110192 - DNA, 75 bp, Artificial Sequence
  Synthetic
cttcgtcagagctcacgctctgctgaggatgtgcactatggtgaggcacctcgcggggggtaggtacgtccagat

SEQ ID NO: 110193 - DNA, 75 bp, Artificial Sequence
  Synthetic
tggtggcatatcaagccactgtgtgtgccagagccgcggctcctcccccatcatgggaccaaatgtggaaatgcc

SEQ ID NO: 110194 - DNA, 75 bp, Artificial Sequence
  Synthetic
tacgaaccacctgtggtccatggctgcccacttccacctccacggtcccctcctgtgcctccgccccggaagaag

SEQ ID NO: 110195 - DNA, 75 bp, Artificial Sequence
  Synthetic
tcgacgagatggaggaatgctcaaagcatcttccactaatcgagcatggcttgcaactggcagaccagttcaagc

SEQ ID NO: 110196 - DNA, 75 bp, Artificial Sequence
  Synthetic
cactggcgactttgacaccgtgattgactgtaatgtctcagtcacccaagtcatcgacttcagcctagaccccac

SEQ ID NO: 110197 - DNA, 75 bp, Artificial Sequence
  Synthetic
gctgtagagcctatcatcttcagtccgatggagaagaaagtcatcgtctggggggcggagacggccgcatgcggg

SEQ ID NO: 110198 - DNA, 75 bp, Artificial Sequence
  Synthetic
tgctacatcaaggcccaagcagcctgtcgagccgcagggctccaggactgcaccatgctcgtgtgtggcgacgac

SEQ ID NO: 110199 - DNA, 75 bp, Artificial Sequence
  Synthetic
gcacatgtggaacttcattagcggcattcaatacctagctgggctttccaccctgcctggcaatcccgctattgc

SEQ ID NO: 110200 - DNA, 75 bp, Artificial Sequence
  Synthetic
tcgcaaggggaacgaccatccggtatctttgatactgttgtcctatgcgaggcatacgatacaggatgcgcgtgg

SEQ ID NO: 110201 - DNA, 75 bp, Artificial Sequence
  Synthetic
caacagttcgatgagatggaggagtgcgcggcacatcttccctatctcgaacaggggatgcacctcgcggagcaa

SEQ ID NO: 110202 - DNA, 75 bp, Artificial Sequence
  Synthetic
aatatagaggaggtcgccttgccgacgacaggagagatacctttctacggtagggctatccctctagcactggtt

SEQ ID NO: 110203 - DNA, 75 bp, Artificial Sequence
  Synthetic
ccgtgagactacgcgcctacctgaatactccaggcctccccgtgtgccaagaccatctcgagttctgggagggcg

SEQ ID NO: 110204 - DNA, 75 bp, Artificial Sequence
  Synthetic
actcccaccgcgtccacggcttttgtcgtgagcggtcttgcgggagcagcagttggcagcgtcggcctggggaag

SEQ ID NO: 110205 - DNA, 75 bp, Artificial Sequence
  Synthetic
gggccaaacacatgtggaatttcatcagtggaatacagtacttagcaggcctatcgacgctgcctggcaatccag

SEQ ID NO: 110206 - DNA, 75 bp, Artificial Sequence
  Synthetic
gctaggacggtttgcgggccggtctactgttttactcctagccccgttgtcgtgggcaccactgacaggcagggc

SEQ ID NO: 110207 - DNA, 75 bp, Artificial Sequence
  Synthetic
cgccagggctaaagctccccccccttcttgggacacaatgtggaaatgtcttatccgcctcaagcccatgctcac

SEQ ID NO: 110208 - DNA, 75 bp, Artificial Sequence
  Synthetic
gcctgcttgtggatgatgctgctgatagcccaggccgaggccgccttggagaacctggtggtcctcaatgcggca

SEQ ID NO: 110209 - DNA, 75 bp, Artificial Sequence
  Synthetic
tgaacttgctcccagccatactatcgccgggagcattggtggtaggggtggtgtgcgccgcaatcctgcggcgcc

SEQ ID NO: 110210 - DNA, 75 bp, Artificial Sequence
  Synthetic
tcttgggacacaatgtggaaatgtcttatccgcctcaagcccatgctcacggggcccactcccctgttgtacagg

SEQ ID NO: 110211 - DNA, 75 bp, Artificial Sequence
  Synthetic
ccttctccatagagaccacaacagtgccccaggacgcggtatcccgaagccagcggagaggccgcactggaaggg

SEQ ID NO: 110212 - DNA, 75 bp, Artificial Sequence
  Synthetic
actagcggccccccccgccgccaccgctttcgtgggcgccggtctagtcggcgctgccgtcggcagtgtgggtat

SEQ ID NO: 110213 - DNA, 75 bp, Artificial Sequence
  Synthetic
gctttcgtgggcgccggtctagtcggcgctgccgtcggcagtgtgggtatcgggaaggtactcgttgacatcctt

SEQ ID NO: 110214 - DNA, 75 bp, Artificial Sequence
  Synthetic
agcaccaccttgccgcattaagagggacttcaacagcactctcgatctattgtgccccacagactgctttaggaa

SEQ ID NO: 110215 - DNA, 75 bp, Artificial Sequence
  Synthetic
tactacttggtggggttctcgcagcgctggcagcctactgtttatcagtgggttgcgtagtaatctgcggtagga

SEQ ID NO: 110216 - DNA, 75 bp, Artificial Sequence
  Synthetic
tgacgcggcggcccgtgtaacggccatactgtcatcccttaccgtgacctccctgctcaggcgcctccacaagtg

SEQ ID NO: 110217 - DNA, 75 bp, Artificial Sequence
  Synthetic
gacttcaacagcactctcgatctattgtgccccacagactgctttaggaagcacccaggtactacctatcttaag

SEQ ID NO: 110218 - DNA, 75 bp, Artificial Sequence
  Synthetic
ggaggatgtcgtgtgctgctcaatgtcttattcctggacaggcgcacttgtcaccccgtgtgccgcggaagaaca

SEQ ID NO: 110219 - DNA, 75 bp, Artificial Sequence
  Synthetic
gctcacaacgcgcgcacattcgctggcctctttacatcgggtcccaagcagaagctccagctcatcaactccaat

SEQ ID NO: 110220 - DNA, 75 bp, Artificial Sequence
  Synthetic
tcctatcgccgggagctctggtggtcggcgtcgtttgcgcagcaatactgcgccggcacgtaggccccggcgaag

SEQ ID NO: 110221 - DNA, 75 bp, Artificial Sequence
  Synthetic
cgagggccaacaaattgcagagcaattcaaacagaaggttcttggtatcattcaggcctccaccaaacacgcgga

SEQ ID NO: 110222 - DNA, 75 bp, Artificial Sequence
  Synthetic
gagtgacttcaagacatggctcaaagccaaactgatgccgcgcctgcctggcatccccttcctctcctgtcagag

SEQ ID NO: 110223 - DNA, 75 bp, Artificial Sequence
  Synthetic
cttgaaaaagccctggattgtcagatctacggggcctgttactccattgagccacttgacctacctcagatcatt

SEQ ID NO: 110224 - DNA, 75 bp, Artificial Sequence
  Synthetic
ctggttgcttatcaggctacggtctgcgccagagcgctggcccctccaccaagctgggacaccatgtggaagtgc

SEQ ID NO: 110225 - DNA, 75 bp, Artificial Sequence
  Synthetic
gtcacgcagctgctaaaaaggctccaccaatggatcactgaggactgctccaccccgtgctccggttcctggctg

SEQ ID NO: 110226 - DNA, 75 bp, Artificial Sequence
  Synthetic
ttgtccactctaccaggcaatccagcggtggcatcgctgatgtcgttctcggcgtcccttacaagcccactgtca

SEQ ID NO: 110227 - DNA, 75 bp, Artificial Sequence
  Synthetic
cctggcatggaacctttcccatcaatgcgtacaccacaggccccggcgtacccgtcccagcgccaaactaaaagt

SEQ ID NO: 110228 - DNA, 75 bp, Artificial Sequence
  Synthetic
cctggcatggaacctttcccatcaatgcgtacaccacaggccccggcgtacccgtcccagcgccaaactataagt

SEQ ID NO: 110229 - DNA, 75 bp, Artificial Sequence
  Synthetic
cctggcatggaacctttcccatcaatgcgtacaccacaggccccggcgtacccgtcccagcgccaaactacaagt

SEQ ID NO: 110230 - DNA, 75 bp, Artificial Sequence
  Synthetic
cctggcatggaacctttcccatcaatgcgtacaccacaggccccggcgtacccgtcccagcgccaaactagaagt

SEQ ID NO: 110231 - DNA, 75 bp, Artificial Sequence
  Synthetic
cctggcatggaacctttcccatcaatgcgtacaccactggccccggcgtacccgtcccagcgccaaactaaaagt

SEQ ID NO: 110232 - DNA, 75 bp, Artificial Sequence
  Synthetic
cctggcatggaacctttcccatcaatgcgtacaccactggccccggcgtacccgtcccagcgccaaactataagt

SEQ ID NO: 110233 - DNA, 75 bp, Artificial Sequence
  Synthetic
cctggcatggaacctttcccatcaatgcgtacaccactggccccggcgtacccgtcccagcgccaaactacaagt

SEQ ID NO: 110234 - DNA, 75 bp, Artificial Sequence
  Synthetic
cctggcatggaacctttcccatcaatgcgtacaccactggccccggcgtacccgtcccagcgccaaactagaagt

SEQ ID NO: 110235 - DNA, 75 bp, Artificial Sequence
  Synthetic
cctggcatggaacctttcccatcaatgcgtacaccaccggccccggcgtacccgtcccagcgccaaactaaaagt

SEQ ID NO: 110236 - DNA, 75 bp, Artificial Sequence
  Synthetic
cctggcatggaacctttcccatcaatgcgtacaccaccggccccggcgtacccgtcccagcgccaaactataagt

SEQ ID NO: 110237 - DNA, 75 bp, Artificial Sequence
  Synthetic
cctggcatggaacctttcccatcaatgcgtacaccaccggccccggcgtacccgtcccagcgccaaactacaagt

SEQ ID NO: 110238 - DNA, 75 bp, Artificial Sequence
  Synthetic
cctggcatggaacctttcccatcaatgcgtacaccaccggccccggcgtacccgtcccagcgccaaactagaagt

SEQ ID NO: 110239 - DNA, 75 bp, Artificial Sequence
  Synthetic
cctggcatggaacctttcccatcaatgcgtacaccacgggccccggcgtacccgtcccagcgccaaactaaaagt

SEQ ID NO: 110240 - DNA, 75 bp, Artificial Sequence
  Synthetic
cctggcatggaacctttcccatcaatgcgtacaccacgggccccggcgtacccgtcccagcgccaaactataagt

SEQ ID NO: 110241 - DNA, 75 bp, Artificial Sequence
  Synthetic
cctggcatggaacctttcccatcaatgcgtacaccacgggccccggcgtacccgtcccagcgccaaactacaagt

SEQ ID NO: 110242 - DNA, 75 bp, Artificial Sequence
  Synthetic
cctggcatggaacctttcccatcaatgcgtacaccacgggccccggcgtacccgtcccagcgccaaactagaagt

SEQ ID NO: 110243 - DNA, 75 bp, Artificial Sequence
  Synthetic
acactcacacatccaataaccaaatacatcatggcctgtatgtcagcagacctagaagtggtgaccagcacgtgg

SEQ ID NO: 110244 - DNA, 75 bp, Artificial Sequence
  Synthetic
gccaacgggggtacaaaggggtctggcggggagacggcattatgaacacccaatgcccatgtggagccaacatta

SEQ ID NO: 110245 - DNA, 75 bp, Artificial Sequence
  Synthetic
gcgctgcagttggcagcatagggctggggaaggtcctagtggacatacttgcgggttacggagcgggtgtgtccg

SEQ ID NO: 110246 - DNA, 75 bp, Artificial Sequence
  Synthetic
ctgccaggtccctgctcctgaattcttcactgaggtggacggcgtcaggctccatcgccacgcccccccatgcaa

SEQ ID NO: 110247 - DNA, 75 bp, Artificial Sequence
  Synthetic
tgacataataatttgtgacgagtgccactccacggatgccacatccatcttgggcatcggcaccgtccttgacca

SEQ ID NO: 110248 - DNA, 75 bp, Artificial Sequence
  Synthetic
ctattaacgcttacaccacgggcccttgcactccctctccagcgcacaactactcacgcgcgctgtggagggtat

SEQ ID NO: 110249 - DNA, 75 bp, Artificial Sequence
  Synthetic
ctactcctgcttgctgcaggggtaggcatctacctccttcccaaccgatgaaggttgggataaacactccggcct

SEQ ID NO: 110250 - DNA, 75 bp, Artificial Sequence
  Synthetic
gggcgttgtgtgtgcaggcatcctgaggcggcacgctggccccgcagagggggccacgcagtggatgaatcgact

SEQ ID NO: 110251 - DNA, 75 bp, Artificial Sequence
  Synthetic
acatccatgttaacagacccatctcatctgacagcggagactgctcgccgtaggttggctagggggtctccaccc

SEQ ID NO: 110252 - DNA, 75 bp, Artificial Sequence
  Synthetic
gggccacgcagtggatgaatcgactgatagcgttcgcttcgaggggcaaccacgtgtcacccacgcactacgtac

SEQ ID NO: 110253 - DNA, 75 bp, Artificial Sequence
  Synthetic
agtgcccatgtcaagtcccttcaccagagttcttcacagagctggacggagtgaggctgcacaggtatgcaccac

SEQ ID NO: 110254 - DNA, 75 bp, Artificial Sequence
  Synthetic
actgcaacgtagcggtcactcaagtcgtagacttcagcctggaccccaccttcactataaccacacagactgtcc

SEQ ID NO: 110255 - DNA, 75 bp, Artificial Sequence
  Synthetic
aactccatgcagtggttcgtggctgcgagaagtctgggactgggtgtgcactgtgctctctgactttaagacctg

SEQ ID NO: 110256 - DNA, 75 bp, Artificial Sequence
  Synthetic
tacgcctccgggatcggtcaccgtgccacaccccaatatcgaggaggtggccctgtccaacactggagagatccc

SEQ ID NO: 110257 - DNA, 75 bp, Artificial Sequence
  Synthetic
acctcttgtggggtgcagcagctaccaggatcgagacggagggcaaagtcgtggtactggactcttttgaaccac

SEQ ID NO: 110258 - DNA, 75 bp, Artificial Sequence
  Synthetic
gcttaagaccaaactcgtgccagcactgcccggcgtcccctttttgtcatgccaacgggggttccggggcgtatg

SEQ ID NO: 110259 - DNA, 75 bp, Artificial Sequence
  Synthetic
ggctttcgtcgtgagtggcttagcgggggcagcggtaggcagcgtgggcctggggaagatcctggtcgacattct

SEQ ID NO: 110260 - DNA, 75 bp, Artificial Sequence
  Synthetic
agtgttaacatccatgctcactgacccctcccacatcaccgcggaggcggccaagcgcagactagataggggatc

SEQ ID NO: 110261 - DNA, 75 bp, Artificial Sequence
  Synthetic
ccctcccacatcaccgcggaggcggccaagcgcagactagataggggatcacctccctccctggctagctcttcg

SEQ ID NO: 110262 - DNA, 75 bp, Artificial Sequence
  Synthetic
ctacaatccacccttggttgaggcatggaagcagccagactacgaaccaccagtcgtgcacggctgcgccttgcc

SEQ ID NO: 110263 - DNA, 75 bp, Artificial Sequence
  Synthetic
accatcttgagttttgggaggcagttttcaccggcctcacacacatagatgcccacttcctttcccaaacaaagc

SEQ ID NO: 110264 - DNA, 75 bp, Artificial Sequence
  Synthetic
tcttttggccaggcagagtctatccctgactccggagcgggactaaccatctcaaccagttcttctgaccagggc

SEQ ID NO: 110265 - DNA, 75 bp, Artificial Sequence
  Synthetic
agtgcccctgccaggttccctctccggagttcttcactgaggtggatggcgtacgattacatcgctacgctcctc

SEQ ID NO: 110266 - DNA, 75 bp, Artificial Sequence
  Synthetic
cctgaatccgacgcagcagcccgcgtaacagctatactatcatccctcactgtgacttccctactcaggcgcctc

SEQ ID NO: 110267 - DNA, 75 bp, Artificial Sequence
  Synthetic
ccctcctctactggagccatggaagagggatgactacgtaccaccagtagtccatggctgccctcttccgcccgg

SEQ ID NO: 110268 - DNA, 75 bp, Artificial Sequence
  Synthetic
tgtggcggcgttgttcttgtcgggttgatggcgctgactctgtcaccatattacaagcactatatcagctggtgc

SEQ ID NO: 110269 - DNA, 75 bp, Artificial Sequence
  Synthetic
ccaccgtcagcggttcggaggacgtagtgtgctgctcgatgtcttactcatggacgggagcgctgataacaccct

SEQ ID NO: 110270 - DNA, 75 bp, Artificial Sequence
  Synthetic
ggtcgttacatcaatgctggttgacccgtctcatgtgactgcagaagctgccgctcgccggcttggacgcggctc

SEQ ID NO: 110271 - DNA, 75 bp, Artificial Sequence
  Synthetic
tttagcgactccaacacttccggcgtcgacagcggcaccacggcacctccatctgacccaccatctgctgagggc

SEQ ID NO: 110272 - DNA, 75 bp, Artificial Sequence
  Synthetic
gcacatcaaccagcgagccgtcgtcgcaccggacaaggaggtcctttatgaggcttttgatgaaatggaggaatg

SEQ ID NO: 110273 - DNA, 75 bp, Artificial Sequence
  Synthetic
gcggcagaagaaagtcaccttcgaccgcatacaggtgttagaccagcactacaatgatgtactgaaagagattaa

SEQ ID NO: 110274 - DNA, 75 bp, Artificial Sequence
  Synthetic
gcggcagaagaaagtcaccttcgaccgcatacaggtgttagaccagcactacaatgatgtactgaatgagattaa

SEQ ID NO: 110275 - DNA, 75 bp, Artificial Sequence
  Synthetic
gcggcagaagaaagtcaccttcgaccgcatacaggtgttagaccagcactacaatgatgtactgaacgagattaa

SEQ ID NO: 110276 - DNA, 75 bp, Artificial Sequence
  Synthetic
gcggcagaagaaagtcaccttcgaccgcatacaggtgttagaccagcactacaatgatgtactgaaggagattaa

SEQ ID NO: 110277 - DNA, 75 bp, Artificial Sequence
  Synthetic
tgtgcaaacttgctgtggaagcacgagttggggggtaacatcactcgggtagagtccgagaacaaagtcgtcgtg

SEQ ID NO: 110278 - DNA, 75 bp, Artificial Sequence
  Synthetic
gacacaggatctgacgctgggtcgtattcctccatgccccctctcgaaggggagccgggggatcccgacctcagc

SEQ ID NO: 110279 - DNA, 75 bp, Artificial Sequence
  Synthetic
accagggatggggtcctatcacttatgctgagcctgccgacctggaccagaggccttattgctggcactacccac

SEQ ID NO: 110280 - DNA, 75 bp, Artificial Sequence
  Synthetic
ccggcgtgcccatcccagcgccaaactacaagttcgcgctgtggagggtatccgccgaggagtacgtggaagttc

SEQ ID NO: 110281 - DNA, 75 bp, Artificial Sequence
  Synthetic
cagaggaggagaagttgcccatcaatgcgctaagcaacaccctgctgcgccaccgcaacatggtgtatgctacca

SEQ ID NO: 110282 - DNA, 75 bp, Artificial Sequence
  Synthetic
tccccatttgggcgcggcctgactacaacccgcctctgcttgagacttggaaaaaaccggactatgacccaccac

SEQ ID NO: 110283 - DNA, 75 bp, Artificial Sequence
  Synthetic
caccgcaacatggtgtatgctaccacctctcgcagcgctagccagaggcagaaaaaagtcacatttgacagaatg

SEQ ID NO: 110284 - DNA, 75 bp, Artificial Sequence
  Synthetic
cctctcgcagcgctagccagaggcagaaaaaagtcacatttgacagaatgcaggtcctggacagtcattaccagg

SEQ ID NO: 110285 - DNA, 75 bp, Artificial Sequence
  Synthetic
tgtcaacactaccagggaatcctgctgtggcttccatgatggcattcagtgctgccctcaccagtccgttatcaa

SEQ ID NO: 110286 - DNA, 75 bp, Artificial Sequence
  Synthetic
actggcacaattggcaaagaggtcctttccggcgtcaacgtccgccacgactggttcggactcaggcctccctgc

SEQ ID NO: 110287 - DNA, 75 bp, Artificial Sequence
  Synthetic
ccctgtgaaccggagccagacgtagcagtattaacatctatgctgacagatccatctcacataacagcggagaca

SEQ ID NO: 110288 - DNA, 75 bp, Artificial Sequence
  Synthetic
taaatttggctatggggcgaaggatgtccgggacctaaccagtaaggccgtacgccacatcaactccgtgtggca

SEQ ID NO: 110289 - DNA, 75 bp, Artificial Sequence
  Synthetic
ataatcaccagcctgactggccgggacaaaaaccaagtggagggtgaggtccagattgtgtcaactgctgcccaa

SEQ ID NO: 110290 - DNA, 75 bp, Artificial Sequence
  Synthetic
ccggaccttagttcgggctcctggtccacagtcagcgaggagggtgacggcgtcgtgtgctgctcaatgtcatac

SEQ ID NO: 110291 - DNA, 75 bp, Artificial Sequence
  Synthetic
agaggctaacctcttgtggggtacaactgctaccaggatcgagactgagaacaaggtggtggtactggactcttt

SEQ ID NO: 110292 - DNA, 75 bp, Artificial Sequence
  Synthetic
cgcctcatcgtattccctgacttgggagtgcgtgtatgcgagaaaatggctttatacgatgtcatctctaagctt

SEQ ID NO: 110293 - DNA, 75 bp, Artificial Sequence
  Synthetic
gtcggtgtggtctgcgcagcaatactacgccggcacgttggcccgggcgagggggcagtgcaatggatgaaccgg

SEQ ID NO: 110294 - DNA, 75 bp, Artificial Sequence
  Synthetic
tctatcagtgttgcaacctggaacccgaggcccgcaaggtgataaccgcactcacggagagactctacgtgggcg

SEQ ID NO: 110295 - DNA, 75 bp, Artificial Sequence
  Synthetic
gccacagccacgcctcccggtacggtgacaactccccacagcaacatagaggaggtggcccttggtcacgagggc

SEQ ID NO: 110296 - DNA, 75 bp, Artificial Sequence
  Synthetic
acggatttcagtactcaccagggcagcgggttgagttccttgtgaagacttggaagtccaaagctaaccctatgg

SEQ ID NO: 110297 - DNA, 75 bp, Artificial Sequence
  Synthetic
gttcccgccggccatgcccatttgggctcgacctgaatacaatccaccgctggttgagaagtggaagcagcagga

SEQ ID NO: 110298 - DNA, 75 bp, Artificial Sequence
  Synthetic
actccacaacatctcggagtgctgcgacgcggcagaagaaagtgacctttgaccgtctacaactgctagaccaac

SEQ ID NO: 110299 - DNA, 75 bp, Artificial Sequence
  Synthetic
aaaggccacggccgccacaagggcggctggcctaaaggattgcaccatgctggtttgcggtgacgacttggtcat

SEQ ID NO: 110300 - DNA, 75 bp, Artificial Sequence
  Synthetic
aaaggccacggccgccacaagggcggctggcctaaaggattgcaccatgctggtttgcggtgacgacttggtctt

SEQ ID NO: 110301 - DNA, 75 bp, Artificial Sequence
  Synthetic
aaaggccacggccgccacaagggcggctggcctaaaggattgcaccatgctggtttgcggtgacgacttggtcct

SEQ ID NO: 110302 - DNA, 75 bp, Artificial Sequence
  Synthetic
aaaggccacggccgccacaagggcggctggcctaaaggattgcaccatgctggtttgcggtgacgacttggtcgt

SEQ ID NO: 110303 - DNA, 75 bp, Artificial Sequence
  Synthetic
aaaggccacggccgccactagggcggctggcctaaaggattgcaccatgctggtttgcggtgacgacttggtcat

SEQ ID NO: 110304 - DNA, 75 bp, Artificial Sequence
  Synthetic
aaaggccacggccgccactagggcggctggcctaaaggattgcaccatgctggtttgcggtgacgacttggtctt

SEQ ID NO: 110305 - DNA, 75 bp, Artificial Sequence
  Synthetic
aaaggccacggccgccactagggcggctggcctaaaggattgcaccatgctggtttgcggtgacgacttggtcct

SEQ ID NO: 110306 - DNA, 75 bp, Artificial Sequence
  Synthetic
aaaggccacggccgccactagggcggctggcctaaaggattgcaccatgctggtttgcggtgacgacttggtcgt

SEQ ID NO: 110307 - DNA, 75 bp, Artificial Sequence
  Synthetic
aaaggccacggccgccaccagggcggctggcctaaaggattgcaccatgctggtttgcggtgacgacttggtcat

SEQ ID NO: 110308 - DNA, 75 bp, Artificial Sequence
  Synthetic
aaaggccacggccgccaccagggcggctggcctaaaggattgcaccatgctggtttgcggtgacgacttggtctt

SEQ ID NO: 110309 - DNA, 75 bp, Artificial Sequence
  Synthetic
aaaggccacggccgccaccagggcggctggcctaaaggattgcaccatgctggtttgcggtgacgacttggtcct

SEQ ID NO: 110310 - DNA, 75 bp, Artificial Sequence
  Synthetic
aaaggccacggccgccaccagggcggctggcctaaaggattgcaccatgctggtttgcggtgacgacttggtcgt

SEQ ID NO: 110311 - DNA, 75 bp, Artificial Sequence
  Synthetic
aaaggccacggccgccacgagggcggctggcctaaaggattgcaccatgctggtttgcggtgacgacttggtcat

SEQ ID NO: 110312 - DNA, 75 bp, Artificial Sequence
  Synthetic
aaaggccacggccgccacgagggcggctggcctaaaggattgcaccatgctggtttgcggtgacgacttggtctt

SEQ ID NO: 110313 - DNA, 75 bp, Artificial Sequence
  Synthetic
aaaggccacggccgccacgagggcggctggcctaaaggattgcaccatgctggtttgcggtgacgacttggtcct

SEQ ID NO: 110314 - DNA, 75 bp, Artificial Sequence
  Synthetic
aaaggccacggccgccacgagggcggctggcctaaaggattgcaccatgctggtttgcggtgacgacttggtcgt

SEQ ID NO: 110315 - DNA, 75 bp, Artificial Sequence
  Synthetic
ggagtcggatgcgtcgcagcgtgtgacccaactgcttggctcccttactataactagcctactcagaagactcca

SEQ ID NO: 110316 - DNA, 75 bp, Artificial Sequence
  Synthetic
gaagcgttgctcacagcgtggctggatttgccggcctcttcagcccaggcgccaggcaaaacattcagctgatca

SEQ ID NO: 110317 - DNA, 75 bp, Artificial Sequence
  Synthetic
aatcttgtgacttggaccccgatgctcgcaaagcgatagcctctctcaccgagaggctttacatcgggggccctc

SEQ ID NO: 110318 - DNA, 75 bp, Artificial Sequence
  Synthetic
cccccgttcccccgcctaggaggaagcggacggtcgccctcaccgagtccaatgttgcccaagctctgtctgacc

SEQ ID NO: 110319 - DNA, 75 bp, Artificial Sequence
  Synthetic
tgcccgatcaaaattcgggtatggagcgcaggatgtccggagccatgccagcaaggccgttaaacatatcaactc

SEQ ID NO: 110320 - DNA, 75 bp, Artificial Sequence
  Synthetic
ggctcccccaggggacgctccgcagccagcttatgacctcgagcatataacatcatgctcatccaacgtatcggt

SEQ ID NO: 110321 - DNA, 75 bp, Artificial Sequence
  Synthetic
ggcgtcttaaccactagctgcgggaacaccctcacatgttatctgaaagccatggcggcctgtcgagctgcgaag

SEQ ID NO: 110322 - DNA, 75 bp, Artificial Sequence
  Synthetic
tgcatgccgaaacccgcgccaaacttcaagaccgccatctggagggtggcggcctcagagtacgcggaggtgacg

SEQ ID NO: 110323 - DNA, 75 bp, Artificial Sequence
  Synthetic
aaaccagcccgcctcatcgtgtacccggacctctcagtccgggtgtgcgaaaagagggccctctttgacatcacc

SEQ ID NO: 110324 - DNA, 75 bp, Artificial Sequence
  Synthetic
cggacctctcagtccgggtgtgcgaaaagagggccctctttgacatcacccgcaaattaccaatcgccataatgg

SEQ ID NO: 110325 - DNA, 75 bp, Artificial Sequence
  Synthetic
agacagtcactacaatgatgtactcaaggagattaaggcacgagcatccaccgtgaaggcgcgagccctctcagt

SEQ ID NO: 110326 - DNA, 75 bp, Artificial Sequence
  Synthetic
gtattgatgtccatgctaacagatccatcccatatcacggcggaggctgcagcgcggcgcttagcgcgggggtca

SEQ ID NO: 110327 - DNA, 75 bp, Artificial Sequence
  Synthetic
cccccacgttgtgggtgaggatggttctgatgacccatttcttctccgtcctcatagcacaggatcagcttgaga

SEQ ID NO: 110328 - DNA, 75 bp, Artificial Sequence
  Synthetic
cccccatctgaggcaagctcctcggcgagccagctatcggcgccatcgctgcgagccacctgcaccacccacggc

SEQ ID NO: 110329 - DNA, 75 bp, Artificial Sequence
  Synthetic
cgggctagtggagtgctcaccactagcctgggtaacaccatgacctgctacataaaagctcaagcggcctgccga

SEQ ID NO: 110330 - DNA, 75 bp, Artificial Sequence
  Synthetic
gccgccttatatggtggaaccagtacaccatatgtagatgcgagtccgccctccaagtgtgggtcccccccttac

SEQ ID NO: 110331 - DNA, 75 bp, Artificial Sequence
  Synthetic
gcctgggtaacaccatgacctgctacataaaagctcaagcggcctgccgagcagcgggccttaccaactatgaca

SEQ ID NO: 110332 - DNA, 75 bp, Artificial Sequence
  Synthetic
ttgcacgcgggagtagggacggtgtcatcctgctaacaagcctgctttatccatcattaatttttgacatcacta

SEQ ID NO: 110333 - DNA, 75 bp, Artificial Sequence
  Synthetic
gcggccgaaagcctgcgcgcctaatcgtataccctgacctaggggtccgggtgtgcgagaagagagcgctatatg

SEQ ID NO: 110334 - DNA, 75 bp, Artificial Sequence
  Synthetic
gctcgtgcgctccgtgatgggggggaaatacttccagatgatcatactgagcattggcagatggttcaacaccta

SEQ ID NO: 110335 - DNA, 75 bp, Artificial Sequence
  Synthetic
gtgaactcatggttgggaaacataatcatgtatgctcctgcaatctgggtacgtatggttctgatgacccatttt

SEQ ID NO: 110336 - DNA, 75 bp, Artificial Sequence
  Synthetic
acgccccccccaaggagacgtcggacagtgggtctgagcgagagcaccataggagatgccctccagcagctggcc

SEQ ID NO: 110337 - DNA, 75 bp, Artificial Sequence
  Synthetic
taggggtaagcatctacctgctccccaatcgatgattggggagctaaacactccggccctttaggccatctgctt

SEQ ID NO: 110338 - DNA, 75 bp, Artificial Sequence
  Synthetic
acgtatggttctgatgacccattttttccaagtactccaggctcaggagcaactcaataaggtgcttgacttcga

SEQ ID NO: 110339 - DNA, 75 bp, Artificial Sequence
  Synthetic
ttgggactattgtgaccagcttgactggcagggataagaacgtggtgaccggtgaagtgcaggtgctttctacgg

SEQ ID NO: 110340 - DNA, 75 bp, Artificial Sequence
  Synthetic
cttgtcggggtggtttgtatcgggctacagcgggggggacatttatcacagcgtgtcccgggctcgaccccgcat

SEQ ID NO: 110341 - DNA, 75 bp, Artificial Sequence
  Synthetic
gacttcgacatgtacggagtcacatattcaatcactccgctggatctgccagctataattcagaaactccatggc

SEQ ID NO: 110342 - DNA, 75 bp, Artificial Sequence
  Synthetic
ccgatggaatggtctccaaggggtggaggttgctggcgcccattacggcgtacgcccagcagacaaggggcctcc

SEQ ID NO: 110343 - DNA, 75 bp, Artificial Sequence
  Synthetic
ccgttaaccacatcaagtccgtgtggaaggacctcctggaagactcacaaacaccaattcctacgaccatcatgg

SEQ ID NO: 110344 - DNA, 75 bp, Artificial Sequence
  Synthetic
gatatggtagcgggggcccactggggagtcctggcgggccttgcttactattccatggtggggaactgggccaag

SEQ ID NO: 110345 - DNA, 75 bp, Artificial Sequence
  Synthetic
atagccctgctcaagggggggaggcaccttatcttttgccattccaagaaaaaatgtgatgagatagcgtccaaa

SEQ ID NO: 110346 - DNA, 75 bp, Artificial Sequence
  Synthetic
actatgcaacagggaatttgcccggttgctctttctctatcttcctcttggcacttctctcgtgcctcaccaccc

SEQ ID NO: 110347 - DNA, 75 bp, Artificial Sequence
  Synthetic
ttgctctttctctatcttcctcttggcacttctctcgtgcctcaccacccccgcctcggcagtccattacagaaa

SEQ ID NO: 110348 - DNA, 75 bp, Artificial Sequence
  Synthetic
gcactacgcacctcagccgtgcggtattgtgcccgcggcgcaggtgtgtggtccagtgtattgcttcaccccaag

SEQ ID NO: 110349 - DNA, 75 bp, Artificial Sequence
  Synthetic
gggatagttgcgcccacaatgctggtatgcggcgatgacttggttgtcatctcagaaagccaggggactgaggag

SEQ ID NO: 110350 - DNA, 75 bp, Artificial Sequence
  Synthetic
ctccaatcgcccgggctgcctgggaaacagttagacactcccctgtcaattcatggttgggaaacatcatccagt

SEQ ID NO: 110351 - DNA, 75 bp, Artificial Sequence
  Synthetic
aacagttagacactcccctgtcaattcatggttgggaaacatcatccagtatgctccaactatatgggtccgcat

SEQ ID NO: 110352 - DNA, 75 bp, Artificial Sequence
  Synthetic
gttctcggtgctttgctgtattacagcatggtggcaaattgggctaaggtcttggcagttctgctcctctttgcg

SEQ ID NO: 110353 - DNA, 75 bp, Artificial Sequence
  Synthetic
ccttgcggcattgtgtccgcacaaaccgtatgtggcccagtgtactgcttcactcctagccctgtggtggtggga

SEQ ID NO: 110354 - DNA, 75 bp, Artificial Sequence
  Synthetic
accagcacctgggtgttgcttggaggggtccttgcggccctagcggcctactgcttgtcagtcggctgcgttgtg

SEQ ID NO: 110355 - DNA, 75 bp, Artificial Sequence
  Synthetic
gccgccttagagaacctggtggtcctcaacgcggcgtccgtggccggagcgcatggcattctccctttccttgtg

SEQ ID NO: 110356 - DNA, 75 bp, Artificial Sequence
  Synthetic
cttattactccttggcctactcctactttccgtaggggtaggcctcttcctactccccgctcggtagagcggcac

SEQ ID NO: 110357 - DNA, 75 bp, Artificial Sequence
  Synthetic
tcctggcgggccttgcttactattccatggtggggaactgggctaaggttctaattgtgatgttactctttgccg

SEQ ID NO: 110358 - DNA, 75 bp, Artificial Sequence
  Synthetic
tgtgaacaccaatggcagttggcacatcaacagcactgccctcaattgcaatgactctcttcacactgggttcct

SEQ ID NO: 110359 - DNA, 75 bp, Artificial Sequence
  Synthetic
atcaacagcactgccctcaattgcaatgactctcttcacactgggttccttgccgggctgttctaccagggcaaa

SEQ ID NO: 110360 - DNA, 75 bp, Artificial Sequence
  Synthetic
tcctgctgcagagcgccagacctcctcgtggtgcctggtttggatgtacctggatgaattccaccggctatgtca

SEQ ID NO: 110361 - DNA, 75 bp, Artificial Sequence
  Synthetic
cggaccagaggccttattgttggcactacgcacctcggccgtgtggtattgtacccgcgtcgcaggtgtgtggtc

SEQ ID NO: 110362 - DNA, 75 bp, Artificial Sequence
  Synthetic
aaggtgcgggtcggggccttggctcactccccggtgtttggtagactacccataccggctgtggcattacccgtg

SEQ ID NO: 110363 - DNA, 75 bp, Artificial Sequence
  Synthetic
ccccgtcctaggtggtcccttagggggcgtcgcggcagccttagcgcatggcgtgagggctctcgaggacggggt

SEQ ID NO: 110364 - DNA, 75 bp, Artificial Sequence
  Synthetic
ttggaagacagggacagagtggagatgagcccacttctgttctccacgacagagttggccatcctaccctgctct

SEQ ID NO: 110365 - DNA, 75 bp, Artificial Sequence
  Synthetic
gggcttacgagaccttgcagtggcagttgagcccgttgtcttctctgacatggagaccaagatcatcacctgggg

SEQ ID NO: 110366 - DNA, 75 bp, Artificial Sequence
  Synthetic
gccagcctcggcagtcaattatgccaataagagcggcatttaccatctcaccaatgactgcccgaacagcagcat

SEQ ID NO: 110367 - DNA, 75 bp, Artificial Sequence
  Synthetic
gaacaccagcagatcctatatggcgaccaacgactgctccaactctagcatcgtttggcagcttgaaggcgcagt

SEQ ID NO: 110368 - DNA, 75 bp, Artificial Sequence
  Synthetic
cccttcatttcctgtcaaaagggatacaagggcgtgtggcggggggacggcgtgatgtcgacacgctgtccttgc

SEQ ID NO: 110369 - DNA, 75 bp, Artificial Sequence
  Synthetic
cttgccatcccgaacgcatcggtgtccattagcgggttccgtgaccacctggacctactcgtgggcactgctgcc

SEQ ID NO: 110370 - DNA, 75 bp, Artificial Sequence
  Synthetic
ctcactaagggcctgcgggcgcacatcgatgtcatcgtgatgtctgctacgctctgctctgccctctatgtgggg

SEQ ID NO: 110371 - DNA, 75 bp, Artificial Sequence
  Synthetic
tcgatgtcatcgtgatgtctgctacgctctgctctgccctctatgtgggggatgtctgtggcgcgttgatgatag

SEQ ID NO: 110372 - DNA, 75 bp, Artificial Sequence
  Synthetic
gcaactgttccatctttcctggccccctcaccggccataggatggcatgggacatgatgatgaattggtcgccca

SEQ ID NO: 110373 - DNA, 75 bp, Artificial Sequence
  Synthetic
tagcatggtcgctaattgggcaaaagtcatcataatcctgttcctgttcgcgggtgtcgatgcatccaccgacat

SEQ ID NO: 110374 - DNA, 75 bp, Artificial Sequence
  Synthetic
tagcatggtcgctaattgggcaaaagtcatcataatcctgttcctgttcgcgggtgtcgatgcatccaccgactt

SEQ ID NO: 110375 - DNA, 75 bp, Artificial Sequence
  Synthetic
tagcatggtcgctaattgggcaaaagtcatcataatcctgttcctgttcgcgggtgtcgatgcatccaccgacct

SEQ ID NO: 110376 - DNA, 75 bp, Artificial Sequence
  Synthetic
tagcatggtcgctaattgggcaaaagtcatcataatcctgttcctgttcgcgggtgtcgatgcatccaccgacgt

SEQ ID NO: 110377 - DNA, 75 bp, Artificial Sequence
  Synthetic
tagcatggtcgctaattgggcaaaagtcatcataatcctgttcctgttcgcgggtgtcgatgcttccaccgacat

SEQ ID NO: 110378 - DNA, 75 bp, Artificial Sequence
  Synthetic
tagcatggtcgctaattgggcaaaagtcatcataatcctgttcctgttcgcgggtgtcgatgcttccaccgactt

SEQ ID NO: 110379 - DNA, 75 bp, Artificial Sequence
  Synthetic
tagcatggtcgctaattgggcaaaagtcatcataatcctgttcctgttcgcgggtgtcgatgcttccaccgacct

SEQ ID NO: 110380 - DNA, 75 bp, Artificial Sequence
  Synthetic
tagcatggtcgctaattgggcaaaagtcatcataatcctgttcctgttcgcgggtgtcgatgcttccaccgacgt

SEQ ID NO: 110381 - DNA, 75 bp, Artificial Sequence
  Synthetic
tagcatggtcgctaattgggcaaaagtcatcataatcctgttcctgttcgcgggtgtcgatgcctccaccgacat

SEQ ID NO: 110382 - DNA, 75 bp, Artificial Sequence
  Synthetic
tagcatggtcgctaattgggcaaaagtcatcataatcctgttcctgttcgcgggtgtcgatgcctccaccgactt

SEQ ID NO: 110383 - DNA, 75 bp, Artificial Sequence
  Synthetic
tagcatggtcgctaattgggcaaaagtcatcataatcctgttcctgttcgcgggtgtcgatgcctccaccgacct

SEQ ID NO: 110384 - DNA, 75 bp, Artificial Sequence
  Synthetic
tagcatggtcgctaattgggcaaaagtcatcataatcctgttcctgttcgcgggtgtcgatgcctccaccgacgt

SEQ ID NO: 110385 - DNA, 75 bp, Artificial Sequence
  Synthetic
tagcatggtcgctaattgggcaaaagtcatcataatcctgttcctgttcgcgggtgtcgatgcgtccaccgacat

SEQ ID NO: 110386 - DNA, 75 bp, Artificial Sequence
  Synthetic
tagcatggtcgctaattgggcaaaagtcatcataatcctgttcctgttcgcgggtgtcgatgcgtccaccgactt

SEQ ID NO: 110387 - DNA, 75 bp, Artificial Sequence
  Synthetic
tagcatggtcgctaattgggcaaaagtcatcataatcctgttcctgttcgcgggtgtcgatgcgtccaccgacct

SEQ ID NO: 110388 - DNA, 75 bp, Artificial Sequence
  Synthetic
tagcatggtcgctaattgggcaaaagtcatcataatcctgttcctgttcgcgggtgtcgatgcgtccaccgacgt

SEQ ID NO: 110389 - DNA, 75 bp, Artificial Sequence
  Synthetic
gtggagagtggtagtgacccagaacctagttcagactcgggaccatcaatagccagtcgcgttccacctgtccct

SEQ ID NO: 110390 - DNA, 75 bp, Artificial Sequence
  Synthetic
gactcttttgaaccgcttcgggcagaagaagatgagagggaagtgtccgtagcggcggagatcctgcggaaaacc

SEQ ID NO: 110391 - DNA, 75 bp, Artificial Sequence
  Synthetic
gcttggtcctctttacttgctccagtatagcttgcttaagactccctattttgtgcgagcgcacatccttctgcg

SEQ ID NO: 110392 - DNA, 75 bp, Artificial Sequence
  Synthetic
gcagacaaggggcctcttgggatgtataattaccagcctgaccggccgggacaaaaaccaggtggagggtgaggt

SEQ ID NO: 110393 - DNA, 75 bp, Artificial Sequence
  Synthetic
ggtcatcgtcatcctcctgttggccgccggggtggaggcgaacacacacaccaccgcaggaagtgccgcacgtca

SEQ ID NO: 110394 - DNA, 75 bp, Artificial Sequence
  Synthetic
atcaacaggactgccctcaactgcaacgactcgctgcagactggattcttagcgagccttttctacgcccatagg

SEQ ID NO: 110395 - DNA, 75 bp, Artificial Sequence
  Synthetic
atcaacaggactgccctcaactgcaacgactcgctgcagactggtttcttagcgagccttttctacgcccatagg

SEQ ID NO: 110396 - DNA, 75 bp, Artificial Sequence
  Synthetic
atcaacaggactgccctcaactgcaacgactcgctgcagactggcttcttagcgagccttttctacgcccatagg

SEQ ID NO: 110397 - DNA, 75 bp, Artificial Sequence
  Synthetic
atcaacaggactgccctcaactgcaacgactcgctgcagactgggttcttagcgagccttttctacgcccatagg

SEQ ID NO: 110398 - DNA, 75 bp, Artificial Sequence
  Synthetic
tgcaacgacagcctgaataccggtttcattgcggccttgttttacgtcaagtccttcaactcctcaggatgccct

SEQ ID NO: 110399 - DNA, 75 bp, Artificial Sequence
  Synthetic
cctcggctgagaaaccctactgttggcactacgctcctaggccatgtaagaccatttcagccgggggtgtttgtg

SEQ ID NO: 110400 - DNA, 75 bp, Artificial Sequence
  Synthetic
cgaagccgtattgttggcattaccctcctaaaccatgtggcatagttcctgcactgaacgtatgtggcccggtgt

SEQ ID NO: 110401 - DNA, 75 bp, Artificial Sequence
  Synthetic
tatgatgtccagtctccggccccctgcgggaggatggtacggttgcacgtggatgaacagtacagggttcgtcaa

SEQ ID NO: 110402 - DNA, 75 bp, Artificial Sequence
  Synthetic
gtgcctacttactcttggggggagaatgagacagatgtcttcctgctcaacagcacccgcccaccgaaaggcgct

SEQ ID NO: 110403 - DNA, 75 bp, Artificial Sequence
  Synthetic
cgctacctctgtcaacggggttctttggacggtttaccatggcgctggctccaagacgctggctggcccgaaggg

SEQ ID NO: 110404 - DNA, 75 bp, Artificial Sequence
  Synthetic
gctacctacacccgatgtgggtcgggcccatggctcacccctaggtgtttggtggactacccatacagattgtgg

SEQ ID NO: 110405 - DNA, 75 bp, Artificial Sequence
  Synthetic
gctacctactcccgatgtgggtcgggcccatggctcacccctaggtgtttggtggactacccatacagattgtgg

SEQ ID NO: 110406 - DNA, 75 bp, Artificial Sequence
  Synthetic
gctacctacccccgatgtgggtcgggcccatggctcacccctaggtgtttggtggactacccatacagattgtgg

SEQ ID NO: 110407 - DNA, 75 bp, Artificial Sequence
  Synthetic
gctacctacgcccgatgtgggtcgggcccatggctcacccctaggtgtttggtggactacccatacagattgtgg

SEQ ID NO: 110408 - DNA, 75 bp, Artificial Sequence
  Synthetic
tgtgccccacggattgcttcagaaaacatcctgaggcgacttatatcaggtgtggggccgggccgtggttaacac

SEQ ID NO: 110409 - DNA, 75 bp, Artificial Sequence
  Synthetic
cccactcagcaactccttgctgagacatcataacctagtctattcaacgtcgtctagaagcgcttctcagcgtca

SEQ ID NO: 110410 - DNA, 75 bp, Artificial Sequence
  Synthetic
caggctatggcattatccgtgcacagtcaactataccatcttcaaaatacggatgtttgtggggggtgtcgaaca

SEQ ID NO: 110411 - DNA, 75 bp, Artificial Sequence
  Synthetic
cggcctactcccaacagacacggggcctacttggttgcatcatcactagcctcacaggccgggataagaaccagg

SEQ ID NO: 110412 - DNA, 75 bp, Artificial Sequence
  Synthetic
agaggtgcaacctggacgaccgtgacaggattgaaatgagtccactcctgttttcaacaactgagcttgccattt

SEQ ID NO: 110413 - DNA, 75 bp, Artificial Sequence
  Synthetic
agaggtgcaacctggacgaccgtgactggattgaaatgagtccactcctgttttcaacaactgagcttgccattt

SEQ ID NO: 110414 - DNA, 75 bp, Artificial Sequence
  Synthetic
agaggtgcaacctggacgaccgtgaccggattgaaatgagtccactcctgttttcaacaactgagcttgccattt

SEQ ID NO: 110415 - DNA, 75 bp, Artificial Sequence
  Synthetic
agaggtgcaacctggacgaccgtgacgggattgaaatgagtccactcctgttttcaacaactgagcttgccattt

SEQ ID NO: 110416 - DNA, 75 bp, Artificial Sequence
  Synthetic
gtcaactataccatcttcaaaatacggatgtttgtggggggtgtcgaacacagacttaatgcagcttgcaacttc

SEQ ID NO: 110417 - DNA, 75 bp, Artificial Sequence
  Synthetic
catcgtcaactgggcgatcaagtgggagtacgtcgtcctcatgtttctggtgttggcagatgcccgtgtctgcgc

SEQ ID NO: 110418 - DNA, 75 bp, Artificial Sequence
  Synthetic
acatgatcgctggtgcccactggggagtcctggcgggcatagcgtatttctccatggtggggaactgggcaaagg

SEQ ID NO: 110419 - DNA, 75 bp, Artificial Sequence
  Synthetic
cgtcaaatgggaatgggtcatcctcctattcctgcttttggcggacgctagagtctgcgcctgcctttggatgct

SEQ ID NO: 110420 - DNA, 75 bp, Artificial Sequence
  Synthetic
cacaggcctcacccacatagacgcccacttcttgtcccagactaagcaggcaggagacaacttcccctacctggt

SEQ ID NO: 110421 - DNA, 75 bp, Artificial Sequence
  Synthetic
tgggctctacttttcatctgttgtgcgtggcacatacggggtcggttggtccctgccgccacgtacggggttctt

SEQ ID NO: 110422 - DNA, 75 bp, Artificial Sequence
  Synthetic
ttccttgctaggatgctggtcctttgtcttactactcgtggcgctgcctcaacaggcttacgccctcgagatagc

SEQ ID NO: 110423 - DNA, 75 bp, Artificial Sequence
  Synthetic
ccctgacaattgtcacgctcacccctacctacaagaccttattggcgcagctcttgtggtggatccagtacttca

SEQ ID NO: 110424 - DNA, 75 bp, Artificial Sequence
  Synthetic
tgctacatgctggtcctggcggaggccctgatccaagattgggtgccgccgctgcaagtgcggggtggccgcgat

SEQ ID NO: 110425 - DNA, 75 bp, Artificial Sequence
  Synthetic
cctgggttttgaaataaccaagatcctactagcaatagtgggacccttgtacttgttacaggctagcctcctgcg

SEQ ID NO: 110426 - DNA, 75 bp, Artificial Sequence
  Synthetic
ggtttcatatgggctgtgaccatgttctacccaagtgtggtgtttgacataaccaagtggttgttggcgatcctc

SEQ ID NO: 110427 - DNA, 75 bp, Artificial Sequence
  Synthetic
cgggtacccttggcccctctacggtaacgagggctgtgggtgggcagggtggctcctgtccccacgcggctcccg

SEQ ID NO: 110428 - DNA, 75 bp, Artificial Sequence
  Synthetic
gggtcttggactggcacttacatctatgaccacctggcccccctaactacatgggctagcgacggtctgcgtgac

SEQ ID NO: 110429 - DNA, 75 bp, Artificial Sequence
  Synthetic
ggggcaagtacatccaggtggcactgatcacccttggcaagtggacaggcacatacatctatgaccacctatccc

SEQ ID NO: 110430 - DNA, 75 bp, Artificial Sequence
  Synthetic
tctgcgtgacctagcggtggctgtcgagcctatcgtcttcagcccaatggagaggaagatcattgtgtggggggc

SEQ ID NO: 110431 - DNA, 75 bp, Artificial Sequence
  Synthetic
catcttgagttctgggaaggagtttttactggacttacacatattgatgcccacttcctctcacaaactaaacaa

SEQ ID NO: 110432 - DNA, 75 bp, Artificial Sequence
  Synthetic
ttcccgtctccgccaggaggggaaaactgctccttctcgggcctgccgatgacgtcaaggacaaagggtggtcac

SEQ ID NO: 110433 - DNA, 75 bp, Artificial Sequence
  Synthetic
ggccgttggcagcataggccttgggaaggtgcttgtggacatcttggcgggctatggagcgggggtggcaggcgc

SEQ ID NO: 110434 - DNA, 75 bp, Artificial Sequence
  Synthetic
ggctggagacttctcgcccctatcaccgcatacgcccagcaaacccgagggctgctgggcgctatagtggtgagc

SEQ ID NO: 110435 - DNA, 75 bp, Artificial Sequence
  Synthetic
atacgtctggtctctatgtccttaccaacgactgtcctaatagcagtattgtatacgaggccgatgacgttattc

SEQ ID NO: 110436 - DNA, 75 bp, Artificial Sequence
  Synthetic
ggtgcaaatcctctccacagccacccagacctttctcgggaccaccgtcaacggcgtaatgtggactgtctacca

SEQ ID NO: 110437 - DNA, 75 bp, Artificial Sequence
  Synthetic
cactgcttcggtacgcagtcatgtggacctgttagtgggcgcggccacgatgtgttctgcgctctacgtgggtga

SEQ ID NO: 110438 - DNA, 75 bp, Artificial Sequence
  Synthetic
gccagatcgtacactccctgctcatgtggtgccaacgatttgtacctcgtcacacgagggggtgatgtgatccca

SEQ ID NO: 110439 - DNA, 75 bp, Artificial Sequence
  Synthetic
cccccctggcaccagatccctggagccttgcacctgcggggcagttgacctttacctcgtcactcggaacgctga

SEQ ID NO: 110440 - DNA, 75 bp, Artificial Sequence
  Synthetic
acgtggttgggttgttccgcgcagcagtttgcactcgtggcgttgccaaggcacttgaattcatacctgtggagg

SEQ ID NO: 110441 - DNA, 75 bp, Artificial Sequence
  Synthetic
acgtggttgggttgttccgcgcagctgtttgcactcgtggcgttgccaaggcacttgaattcatacctgtggagg

SEQ ID NO: 110442 - DNA, 75 bp, Artificial Sequence
  Synthetic
acgtggttgggttgttccgcgcagccgtttgcactcgtggcgttgccaaggcacttgaattcatacctgtggagg

SEQ ID NO: 110443 - DNA, 75 bp, Artificial Sequence
  Synthetic
acgtggttgggttgttccgcgcagcggtttgcactcgtggcgttgccaaggcacttgaattcatacctgtggagg

SEQ ID NO: 110444 - DNA, 75 bp, Artificial Sequence
  Synthetic
tccatgcaaggtaactgggccaaggtcgctatcatcatggtcatgttttcaggggttgatgcaggaacacacacc

SEQ ID NO: 110445 - DNA, 75 bp, Artificial Sequence
  Synthetic
tagtgggaagagtacgaaagtgcctgtggcctatgcctcacagggttacaaggtccttgtgctcaacccgtcagt

SEQ ID NO: 110446 - DNA, 75 bp, Artificial Sequence
  Synthetic
tagtgggaagagtacgaaagtgcctgtggcctatgcctctcagggttacaaggtccttgtgctcaacccgtcagt

SEQ ID NO: 110447 - DNA, 75 bp, Artificial Sequence
  Synthetic
tagtgggaagagtacgaaagtgcctgtggcctatgcctcccagggttacaaggtccttgtgctcaacccgtcagt

SEQ ID NO: 110448 - DNA, 75 bp, Artificial Sequence
  Synthetic
tagtgggaagagtacgaaagtgcctgtggcctatgcctcgcagggttacaaggtccttgtgctcaacccgtcagt

SEQ ID NO: 110449 - DNA, 75 bp, Artificial Sequence
  Synthetic
tagtgggaagagtacgaatgtgcctgtggcctatgcctcacagggttacaaggtccttgtgctcaacccgtcagt

SEQ ID NO: 110450 - DNA, 75 bp, Artificial Sequence
  Synthetic
tagtgggaagagtacgaatgtgcctgtggcctatgcctctcagggttacaaggtccttgtgctcaacccgtcagt

SEQ ID NO: 110451 - DNA, 75 bp, Artificial Sequence
  Synthetic
tagtgggaagagtacgaatgtgcctgtggcctatgcctcccagggttacaaggtccttgtgctcaacccgtcagt

SEQ ID NO: 110452 - DNA, 75 bp, Artificial Sequence
  Synthetic
tagtgggaagagtacgaatgtgcctgtggcctatgcctcgcagggttacaaggtccttgtgctcaacccgtcagt

SEQ ID NO: 110453 - DNA, 75 bp, Artificial Sequence
  Synthetic
tagtgggaagagtacgaacgtgcctgtggcctatgcctcacagggttacaaggtccttgtgctcaacccgtcagt

SEQ ID NO: 110454 - DNA, 75 bp, Artificial Sequence
  Synthetic
tagtgggaagagtacgaacgtgcctgtggcctatgcctctcagggttacaaggtccttgtgctcaacccgtcagt

SEQ ID NO: 110455 - DNA, 75 bp, Artificial Sequence
  Synthetic
tagtgggaagagtacgaacgtgcctgtggcctatgcctcccagggttacaaggtccttgtgctcaacccgtcagt

SEQ ID NO: 110456 - DNA, 75 bp, Artificial Sequence
  Synthetic
tagtgggaagagtacgaacgtgcctgtggcctatgcctcgcagggttacaaggtccttgtgctcaacccgtcagt

SEQ ID NO: 110457 - DNA, 75 bp, Artificial Sequence
  Synthetic
tagtgggaagagtacgaaggtgcctgtggcctatgcctcacagggttacaaggtccttgtgctcaacccgtcagt

SEQ ID NO: 110458 - DNA, 75 bp, Artificial Sequence
  Synthetic
tagtgggaagagtacgaaggtgcctgtggcctatgcctctcagggttacaaggtccttgtgctcaacccgtcagt

SEQ ID NO: 110459 - DNA, 75 bp, Artificial Sequence
  Synthetic
tagtgggaagagtacgaaggtgcctgtggcctatgcctcccagggttacaaggtccttgtgctcaacccgtcagt

SEQ ID NO: 110460 - DNA, 75 bp, Artificial Sequence
  Synthetic
tagtgggaagagtacgaaggtgcctgtggcctatgcctcgcagggttacaaggtccttgtgctcaacccgtcagt

SEQ ID NO: 110461 - DNA, 75 bp, Artificial Sequence
  Synthetic
acctaccaagtgggatacctccacgcccccactggtagtgggaagagcactaaggtccccgcggcgtatgccgct

SEQ ID NO: 110462 - DNA, 75 bp, Artificial Sequence
  Synthetic
acatcaatagaacggccctgaactgcaatgattccataaacaccgggttcttagctgggttattttactaccata

SEQ ID NO: 110463 - DNA, 75 bp, Artificial Sequence
  Synthetic
gaccccacaacccccctcgcgagagccgcgtgggagacagcaagacacactccagtcaattcctggctaggcaac

SEQ ID NO: 110464 - DNA, 75 bp, Artificial Sequence
  Synthetic
aacaatcaccacaggagctcctatcacataatccacctatggcaagtttctggcagatgggggctgttcgggggg

SEQ ID NO: 110465 - DNA, 75 bp, Artificial Sequence
  Synthetic
aacaatcaccacaggagctcctatcacatattccacctatggcaagtttctggcagatgggggctgttcgggggg

SEQ ID NO: 110466 - DNA, 75 bp, Artificial Sequence
  Synthetic
aacaatcaccacaggagctcctatcacatactccacctatggcaagtttctggcagatgggggctgttcgggggg

SEQ ID NO: 110467 - DNA, 75 bp, Artificial Sequence
  Synthetic
aacaatcaccacaggagctcctatcacatagtccacctatggcaagtttctggcagatgggggctgttcgggggg

SEQ ID NO: 110468 - DNA, 75 bp, Artificial Sequence
  Synthetic
ccggggtccgcaccgtgacaactggagatgccatcacctactccacatatggcaaattcctcgcggatgggggct

SEQ ID NO: 110469 - DNA, 75 bp, Artificial Sequence
  Synthetic
gcacaactcgaccgaaaagccgtactgttggcattatgcacctaacccttgtgacactgtcgtagcgaaaaatgt

SEQ ID NO: 110470 - DNA, 75 bp, Artificial Sequence
  Synthetic
gctccggtggcgcctatgacatcataatgtgcgatgagtgccattcaacggactctacgaccatactcggcatcg

SEQ ID NO: 110471 - DNA, 75 bp, Artificial Sequence
  Synthetic
cgcctcacggtgcttgctaccgccacgccgcctggatctgttacggtccctcaacccaacatacaagaagtggca

SEQ ID NO: 110472 - DNA, 75 bp, Artificial Sequence
  Synthetic
cgcctcacggtgcttgctaccgccacgccgcctggatctgttacggtccctcatcccaacatacaagaagtggca

SEQ ID NO: 110473 - DNA, 75 bp, Artificial Sequence
  Synthetic
cgcctcacggtgcttgctaccgccacgccgcctggatctgttacggtccctcaccccaacatacaagaagtggca

SEQ ID NO: 110474 - DNA, 75 bp, Artificial Sequence
  Synthetic
cgcctcacggtgcttgctaccgccacgccgcctggatctgttacggtccctcagcccaacatacaagaagtggca

SEQ ID NO: 110475 - DNA, 75 bp, Artificial Sequence
  Synthetic
cacctggggtgagaatgagactgacgtgttcctgctgaggtccctgcggcctcctagtggtcagtggtttgggtg

SEQ ID NO: 110476 - DNA, 75 bp, Artificial Sequence
  Synthetic
ggaggtggccctcggacacgagggcgagatccccttttatgggaaggccatccctctctcagccatcaagggggg

SEQ ID NO: 110477 - DNA, 75 bp, Artificial Sequence
  Synthetic
ggtcattggggtgtggcgtttggcttggcctatttcgccatgcaggggtcatgggccaaagtcatcgccatcctc

SEQ ID NO: 110478 - DNA, 75 bp, Artificial Sequence
  Synthetic
gtgaagagcttgctaaccaactgagaagcttgggtctgaacgctgttgccttttacaggggcatagatgtatctg

SEQ ID NO: 110479 - DNA, 75 bp, Artificial Sequence
  Synthetic
gtgatgagcttgctaaccaactgagaagcttgggtctgaacgctgttgccttttacaggggcatagatgtatctg

SEQ ID NO: 110480 - DNA, 75 bp, Artificial Sequence
  Synthetic
gtgacgagcttgctaaccaactgagaagcttgggtctgaacgctgttgccttttacaggggcatagatgtatctg

SEQ ID NO: 110481 - DNA, 75 bp, Artificial Sequence
  Synthetic
gtgaggagcttgctaaccaactgagaagcttgggtctgaacgctgttgccttttacaggggcatagatgtatctg

SEQ ID NO: 110482 - DNA, 75 bp, Artificial Sequence
  Synthetic
gcgacatctaatcttctgccactcaaagaaaaagtgcgacgaacttgcgtcggcccttcgaggaatgggcctcaa

SEQ ID NO: 110483 - DNA, 75 bp, Artificial Sequence
  Synthetic
acatcaatagaactgctctgaactgcaatgaatccctcaccaccgggtttctcgccgcgctgttctacacaaata

SEQ ID NO: 110484 - DNA, 75 bp, Artificial Sequence
  Synthetic
ctcttttgccccaccgactgcttcagaaaacatcctggggccacgtacagccggtgtggtgcggggccttggttg

SEQ ID NO: 110485 - DNA, 75 bp, Artificial Sequence
  Synthetic
ctggaccagaggccctactgctggcactacgcgcctcggccgtgcggtattgtacccgcgtcacaggtgtgtggt

SEQ ID NO: 110486 - DNA, 75 bp, Artificial Sequence
  Synthetic
aactcaggttgttgatttcagcctggaccccaccttcactattgagaccacaacggtcccccaggacgcagtgtc

SEQ ID NO: 110487 - DNA, 75 bp, Artificial Sequence
  Synthetic
gatttcgactctgtgattgactgcaacatggctgtcacccaggtcgtagatttcagtttggaccctacttttacc

SEQ ID NO: 110488 - DNA, 75 bp, Artificial Sequence
  Synthetic
tggggtacatccctgtcgttggcgccccggtcggaggcgtcgccagagccctggcacatggtgttagggtcctgg

SEQ ID NO: 110489 - DNA, 75 bp, Artificial Sequence
  Synthetic
agcaccggttttccgccgcttgcaactggaccaggggggagcgcagtgatatcgaagatcgtgatcgcagcgagc

SEQ ID NO: 110490 - DNA, 75 bp, Artificial Sequence
  Synthetic
gaatctacccggttgctctttttctatcttcttacttgcccttctgtcgtgcgttacagtgccagtgtctgcagt

SEQ ID NO: 110491 - DNA, 75 bp, Artificial Sequence
  Synthetic
ctggaccaggggggagcgcagtgatatcgaagatcgtgatcgcagcgagcagcacccgctgctgcattcaacaac

SEQ ID NO: 110492 - DNA, 75 bp, Artificial Sequence
  Synthetic
ctctgtgaggcgtatgataccggagctgcgtggtatgagctaacacctgcagagaccacagtcaggcttcgggcc

SEQ ID NO: 110493 - DNA, 75 bp, Artificial Sequence
  Synthetic
gtgagagagcgtcgggtatgttcgacaccgtggtgctctgcgagtgctacgatgccggcgcggcctggtatgaac

SEQ ID NO: 110494 - DNA, 75 bp, Artificial Sequence
  Synthetic
tggcctatttctccatgcagggagcgtgggccaaagtctttgccatcctccttcttgttgcaggagtggatgcga

SEQ ID NO: 110495 - DNA, 75 bp, Artificial Sequence
  Synthetic
agacgaagcagggaggggaaaacttcgcgtacttggtggcctatcaggctacggtgtgcgctagagctaaggccc

SEQ ID NO: 110496 - DNA, 75 bp, Artificial Sequence
  Synthetic
cggtctcacacatattgatgcccacttcctctcccaaacaaagcaggcaggggagggttttccatacctagtggc

SEQ ID NO: 110497 - DNA, 75 bp, Artificial Sequence
  Synthetic
tggtgaggacgtcgtctgctgctcgatgtcctacacatggacaggcgccttgatcacgccatgcgccgcggagga

SEQ ID NO: 110498 - DNA, 75 bp, Artificial Sequence
  Synthetic
ttcctctcccaaacaaagcaggcaggggagggttttccatacctagtggcctaccaggccacggtgtgtgctaga

SEQ ID NO: 110499 - DNA, 75 bp, Artificial Sequence
  Synthetic
tgaggtgataacatctcaccctataaccaagtacatcatggcatgcatgtcagctgaccttgaggtgatcaccag

SEQ ID NO: 110500 - DNA, 75 bp, Artificial Sequence
  Synthetic
ggaggacagggatagatcagagctcagcccgctgctgctgtccacaacagagtggcagatactgccctgctcctt

SEQ ID NO: 110501 - DNA, 75 bp, Artificial Sequence
  Synthetic
cagcctcagcaattcaagtcaggaatgcctctgggatctaccaccttaccaatgactgctcgaacaatagcatcg

SEQ ID NO: 110502 - DNA, 75 bp, Artificial Sequence
  Synthetic
gtaaattttaccatcttcaaggtgcggatgtatgtagggggagtggagcatcgattgtccgcagcttgtaacttc

SEQ ID NO: 110503 - DNA, 75 bp, Artificial Sequence
  Synthetic
tgcctctgggatctaccaccttaccaatgactgctcgaacaatagcatcgtttttgaggcggagaccattatact

SEQ ID NO: 110504 - DNA, 75 bp, Artificial Sequence
  Synthetic
ccagcagttgtgcctgatcgggaggttatgtaccagcagtatgacgagatggaagagtgctctcgtcacctccca

SEQ ID NO: 110505 - DNA, 75 bp, Artificial Sequence
  Synthetic
caatcagaggacggtcatcgcccctgacaaagaggtcctttacgaagcatttgatgagatggaggaatgtgcttc

SEQ ID NO: 110506 - DNA, 75 bp, Artificial Sequence
  Synthetic
atccacgggtttcgccggcacgtagatctcctcgtcggggccgcggcattttgttcggccatgtacattggagat

SEQ ID NO: 110507 - DNA, 75 bp, Artificial Sequence
  Synthetic
atctcctcgtcggggccgcggcattttgttcggccatgtacattggagatctttgtggtagcgtattcttggtag

SEQ ID NO: 110508 - DNA, 75 bp, Artificial Sequence
  Synthetic
ttgatgagatggaggaatgtgcttctaggaccgccctcatcgaggaggggcaccggatagccgagatgctaaagt

SEQ ID NO: 110509 - DNA, 75 bp, Artificial Sequence
  Synthetic
tccactctgcatggcccaagcttgaacagttttggcacaagcatatgtggaatttcataagcggcatacaatatc

SEQ ID NO: 110510 - DNA, 75 bp, Artificial Sequence
  Synthetic
tgctctctatggcgtatggccgctgctcctgctcttgctggcactaccaccacgagcatatgccatggaccggga

SEQ ID NO: 110511 - DNA, 75 bp, Artificial Sequence
  Synthetic
ggcagctgtttactttcaggcctaagcaccatcaggtcacccaggattgtaactgctctatatatgctggccaca

SEQ ID NO: 110512 - DNA, 75 bp, Artificial Sequence
  Synthetic
agcctccaagcaggcgcaggacatacaacccgctgtccaagcgacatggccaaaattagagcaattctgggccaa

SEQ ID NO: 110513 - DNA, 75 bp, Artificial Sequence
  Synthetic
tagcctgacgcccccacattcagccagatccaaatttggctatggggcaaaagacgtccgttgccatgccagaaa

SEQ ID NO: 110514 - DNA, 75 bp, Artificial Sequence
  Synthetic
gaccttagttcggggtcttggtctacggtcagtgaggagggcgacagcgttgtctgctgctcgatgtcctacagt

SEQ ID NO: 110515 - DNA, 75 bp, Artificial Sequence
  Synthetic
catgatgctcaactggtcgcccacggtgagctatgtggtttctagtgccctgagagtaccccagttgctcttaga

SEQ ID NO: 110516 - DNA, 75 bp, Artificial Sequence
  Synthetic
ccttaacatactgggagggtgggtggcatcccaattggccagccctgtgccgtccactgccttcgtggttagcgg

SEQ ID NO: 110517 - DNA, 75 bp, Artificial Sequence
  Synthetic
cttaccagcccactctctaccagcactaccatcctcctcaacatcatgggagggtggttggcttctcaaatcgcc

SEQ ID NO: 110518 - DNA, 75 bp, Artificial Sequence
  Synthetic
gtcatcacttggggcgcggacacagcggcttgcggagacatcctttgcgggctgcctgtctccgcgcggttgggc

SEQ ID NO: 110519 - DNA, 75 bp, Artificial Sequence
  Synthetic
ggagctgatgccacgacctacacgggcagcgccgtgagtagcaccaccggggccttcgtcagtcttttctcccct

SEQ ID NO: 110520 - DNA, 75 bp, Artificial Sequence
  Synthetic
aagatcatgagcggtgaggccccatctgtagaggatatggttaatatgctacctgcccttctgtcaccaggggca

SEQ ID NO: 110521 - DNA, 75 bp, Artificial Sequence
  Synthetic
atactggtggatgtgttggccgggtatggtgcgggtatctcgggggctcttgtcgctttcaagatcatgtcaggc

SEQ ID NO: 110522 - DNA, 75 bp, Artificial Sequence
  Synthetic
aggaggacgagcggaacctgagagccttcacggaggccatgaccaggtactctgcccctcctggtgatcccccca

SEQ ID NO: 110523 - DNA, 75 bp, Artificial Sequence
  Synthetic
caggactgtttgcccgctacaagttcaattctacggggtgcccggaacggatgagtaaatgtagaccattgcact

SEQ ID NO: 110524 - DNA, 75 bp, Artificial Sequence
  Synthetic
gaagtgcaggtgctttccaccaccactcagacctttcttggtacgacagtgggaggggtcatgtggactgtctac

SEQ ID NO: 110525 - DNA, 75 bp, Artificial Sequence
  Synthetic
ggggcaaccacgtgtcgcccacacattatgtgcccgagactgatgcgtcacgggccgtgaccaacatactcagtt

SEQ ID NO: 110526 - DNA, 75 bp, Artificial Sequence
  Synthetic
acgtagggcaaggggaaggcgcggtccaatggatgaataggctcatcgcctttgcgtccagagggaaccatgtcg

SEQ ID NO: 110527 - DNA, 75 bp, Artificial Sequence
  Synthetic
attacgcccccagaccatgtggcatcgttccagcgcggaacgtctgtgggcctgtctactgcttcacacctagcc

SEQ ID NO: 110528 - DNA, 75 bp, Artificial Sequence
  Synthetic
ctgcttggctccctcaccataactagcctgctcaggagacttcaccaatggatcacagaagattgccctgtcccc

SEQ ID NO: 110529 - DNA, 75 bp, Artificial Sequence
  Synthetic
ggtgtgtactatcttgactgacttcaaaacttggctgaaagccaagctactgcccagcctcccgggcgtcccctt

SEQ ID NO: 110530 - DNA, 75 bp, Artificial Sequence
  Synthetic
gggggcctggttcggttgcacgtggatgaactcgtcggggtttgtcaagacgtgtggggctccaccttgtagaat

SEQ ID NO: 110531 - DNA, 75 bp, Artificial Sequence
  Synthetic
gcctccccttcatctcctgtcaaaagggctacaagggggtgtgggccggcactggcattatgactacacggtgtc

SEQ ID NO: 110532 - DNA, 75 bp, Artificial Sequence
  Synthetic
gcatgttgcggggatctttagggctgctgtatgtaccagaggtgtagcaaaagccttacagttcataccagtaga

SEQ ID NO: 110533 - DNA, 75 bp, Artificial Sequence
  Synthetic
tactccattgagccacttgacctacctcagatcattcagcgactccatggtcttagcgcattttcactccatagt

SEQ ID NO: 110534 - DNA, 75 bp, Artificial Sequence
  Synthetic
gggactatgaaaatagtaggccctcgcacttgcagcaacgtatggcatggcactttccccatcaatccatcgaca

SEQ ID NO: 110535 - DNA, 75 bp, Artificial Sequence
  Synthetic
ggaagcatccagacgcctcatttgtgaagtgcgggtcgggtccctggctcactccccgctgcatggtagactacc

SEQ ID NO: 110536 - DNA, 75 bp, Artificial Sequence
  Synthetic
cgtagctgagagcgttggcgttcccgaggatgcagccaacctgcgagctttcacggaagctatgaccaggtattc

SEQ ID NO: 110537 - DNA, 75 bp, Artificial Sequence
  Synthetic
cctggcaggggacatttcctatcaactgttacacggagggcccatgcgtgcctaagccagcccccaatttcaaga

SEQ ID NO: 110538 - DNA, 75 bp, Artificial Sequence
  Synthetic
ctgttacacggagggcccatgcgtgcctaagccagcccccaatttcaagaccgccatctggcgggtggcggcatc

SEQ ID NO: 110539 - DNA, 75 bp, Artificial Sequence
  Synthetic
attacattacaggggttacggcagataacatcaagtgcccctgccaagtccctgctccagagttcttcacggagg

SEQ ID NO: 110540 - DNA, 75 bp, Artificial Sequence
  Synthetic
attacattacaggggttacggctgataacatcaagtgcccctgccaagtccctgctccagagttcttcacggagg

SEQ ID NO: 110541 - DNA, 75 bp, Artificial Sequence
  Synthetic
attacattacaggggttacggccgataacatcaagtgcccctgccaagtccctgctccagagttcttcacggagg

SEQ ID NO: 110542 - DNA, 75 bp, Artificial Sequence
  Synthetic
attacattacaggggttacggcggataacatcaagtgcccctgccaagtccctgctccagagttcttcacggagg

SEQ ID NO: 110543 - DNA, 75 bp, Artificial Sequence
  Synthetic
cgttcatgtcacgcgcttacggaatcgaccccaacatccgcactgggacccgcaccgtcacaactggtgctaaac

SEQ ID NO: 110544 - DNA, 75 bp, Artificial Sequence
  Synthetic
ttctcctgggtggacggggtccaaatccatcggttcgcccccacaccaaaggcgtttatgagggacgaggtatcg

SEQ ID NO: 110545 - DNA, 75 bp, Artificial Sequence
  Synthetic
gcagcttccttgcgaacctgagccggacgagctagtggtaacatcattgttgaaagacccaagtcatatcaccgc

SEQ ID NO: 110546 - DNA, 75 bp, Artificial Sequence
  Synthetic
cccgttgagtccatggaaactactatgcggtccccggtcttcacggacaactcgtcccccccggctgtaccgcag

SEQ ID NO: 110547 - DNA, 75 bp, Artificial Sequence
  Synthetic
ggagtatccacggcagttgtgtcgtgggcaatgaagtgggaatacgtagtccttgcatttctggtcctggccgat

SEQ ID NO: 110548 - DNA, 75 bp, Artificial Sequence
  Synthetic
tgagacggcacggcgccgcctcgcgaggggatctccaccgtcccttgctagctcgtctgctagtcaactatcagc

SEQ ID NO: 110549 - DNA, 75 bp, Artificial Sequence
  Synthetic
gggcaatgaagtgggaatacgtagtccttgcatttctggtcctggccgatgctcgcgtttgtgcgtgcttatggt

SEQ ID NO: 110550 - DNA, 75 bp, Artificial Sequence
  Synthetic
acatcacagccgagacggcggcgagacgcctggcccgggggtcacccccttctgaggctagttcctcagctagcc

SEQ ID NO: 110551 - DNA, 75 bp, Artificial Sequence
  Synthetic
acgcgggtggagtcagagaataaggtcatcattctagactcatttgatccgctaagggccgaggaggaagataaa

SEQ ID NO: 110552 - DNA, 75 bp, Artificial Sequence
  Synthetic
acgcgggtggagtcagagaataaggtcatcattctagactcatttgatccgctaagggccgaggaggaagatata

SEQ ID NO: 110553 - DNA, 75 bp, Artificial Sequence
  Synthetic
acgcgggtggagtcagagaataaggtcatcattctagactcatttgatccgctaagggccgaggaggaagataca

SEQ ID NO: 110554 - DNA, 75 bp, Artificial Sequence
  Synthetic
acgcgggtggagtcagagaataaggtcatcattctagactcatttgatccgctaagggccgaggaggaagataga

SEQ ID NO: 110555 - DNA, 75 bp, Artificial Sequence
  Synthetic
cattgtggacatacagtatctctatggagtatccacggcagttgtgtcgtgggcaatgaagtgggaatacgtagt

SEQ ID NO: 110556 - DNA, 75 bp, Artificial Sequence
  Synthetic
gaactcaatcgagtgggagcatgcctcaggaagcttggggctcccccattgagagcctggagacatcgagctcga

SEQ ID NO: 110557 - DNA, 75 bp, Artificial Sequence
  Synthetic
tgacacccgctgtttcgactcaacggtcaccgagagtgacatccgtgttgaggagtcaatttaccaatgttgtga

SEQ ID NO: 110558 - DNA, 75 bp, Artificial Sequence
  Synthetic
gtcaggggttgctatggggcctaatcttcatctgttgcgcttggcacgtgcggggccgggctgtccccgtgacca

SEQ ID NO: 110559 - DNA, 75 bp, Artificial Sequence
  Synthetic
agacatggaaagcaccggattatgatcccccggtagtgtccggatgcccattgcccccgcagggatcggcccccg

SEQ ID NO: 110560 - DNA, 75 bp, Artificial Sequence
  Synthetic
aaggggggaaagccgctatatgcggcaagtacctctttaactgggcggtgagaaccaagctcaaactcactccat

SEQ ID NO: 110561 - DNA, 75 bp, Artificial Sequence
  Synthetic
ccggacatcgacatggtagacgccaatctctttatgggaggcagtgtgactcgcatagagtccgagtccaaggtg

SEQ ID NO: 110562 - DNA, 75 bp, Artificial Sequence
  Synthetic
cggggccgggctgtccccgtgaccacctacgcgttactccagctttggccgctcttgttactaatactagcctta

SEQ ID NO: 110563 - DNA, 75 bp, Artificial Sequence
  Synthetic
cacgggatcaaccccaacatcagaaccggagtacggactgtgaccaccggggaccctatcacctactccacttat

SEQ ID NO: 110564 - DNA, 75 bp, Artificial Sequence
  Synthetic
ctcatcccaggccgcctcagactcaggccgtggcactaacggtgccacgtctgtgccatcactcgctgaggatga

SEQ ID NO: 110565 - DNA, 75 bp, Artificial Sequence
  Synthetic
tgttggaccagagcaatgtgggagaggctctcaaagagcttgccatcaagagctttggctgccccccccccagcg

SEQ ID NO: 110566 - DNA, 75 bp, Artificial Sequence
  Synthetic
aggtaactaagatcttactggccttgctcggcccactctacctactgcagtacagcctgcttaagactccatatt

SEQ ID NO: 110567 - DNA, 75 bp, Artificial Sequence
  Synthetic
gtcagtactgaagaggccagcgttgtctgttgctcaatgtcgtactcttggacgggggcgctcatcaccccctgc

SEQ ID NO: 110568 - DNA, 75 bp, Artificial Sequence
  Synthetic
ggaggtggcccttggtcatgagggcgagatccctttttacggcaaggctattcccctagcttacatcaagggggg

SEQ ID NO: 110569 - DNA, 75 bp, Artificial Sequence
  Synthetic
cggatgcgggatctgtgtcctccatgcccccccttgagggggagcctggagacccagatctagagtctgagcagg

SEQ ID NO: 110570 - DNA, 75 bp, Artificial Sequence
  Synthetic
tactgctgcgaattggagcatggactggaacatacatctatgaccatcttgccccccttagcgactgggcttgcg

SEQ ID NO: 110571 - DNA, 75 bp, Artificial Sequence
  Synthetic
tggaacatacatctatgaccatcttgccccccttagcgactgggcttgcgacggcttgcgagatctagctgtcgc

SEQ ID NO: 110572 - DNA, 75 bp, Artificial Sequence
  Synthetic
gtcaaaagaaggtcaccttcgacagacagcaggtgcttgacaaacattaccatgagactcttgaggagataaaag

SEQ ID NO: 110573 - DNA, 75 bp, Artificial Sequence
  Synthetic
tgttgagcccgtcgtcttctccccaatggagaagaaggtcatcacatggggtgctgataccgctgcctgcggcga

SEQ ID NO: 110574 - DNA, 75 bp, Artificial Sequence
  Synthetic
gactttgactctgtcatcgactgcaatgttgcagtcacccagattgttgactttagcctagacccaacctttacc

SEQ ID NO: 110575 - DNA, 75 bp, Artificial Sequence
  Synthetic
tatgggcgccaagcagaaactgcagttggtcaacaccaatggctcgtggcacatcaacagtactgccctgaactg

SEQ ID NO: 110576 - DNA, 75 bp, Artificial Sequence
  Synthetic
agacgtccgtggccacactagcagggccatcaaccacatccgctccgtgtgggaggacctgctagaggacaatga

SEQ ID NO: 110577 - DNA, 75 bp, Artificial Sequence
  Synthetic
atcactgcatatgctcaacagactcggggcatagtgggcaccatcgtcactagcctcaccggccgagacaagaat

SEQ ID NO: 110578 - DNA, 75 bp, Artificial Sequence
  Synthetic
atagctgggttgttttattaccataagttcaactctactggatgtcctcaaaggctcagcagctgcaagcccatc

SEQ ID NO: 110579 - DNA, 75 bp, Artificial Sequence
  Synthetic
ggttgctccttttctatcttcctccttgctctcttatcttgtgtctccattccagtctctgccgtacaagtcaag

SEQ ID NO: 110580 - DNA, 75 bp, Artificial Sequence
  Synthetic
ggcccgctttattgtatacccggacctcagtgtacgggtgtgcgaaaaaatggccttatatgacattacacgcaa

SEQ ID NO: 110581 - DNA, 75 bp, Artificial Sequence
  Synthetic
ggtggggaactgggcgaaggtcctggtagtgctgctgctatttgccggcgtcgacgcggagacccacgtcaccgg

SEQ ID NO: 110582 - DNA, 75 bp, Artificial Sequence
  Synthetic
accaaggtcacatcaccggccaccgcatggcatgggacatgatgctaaactggtcaccaactcttaccatgatcc

SEQ ID NO: 110583 - DNA, 75 bp, Artificial Sequence
  Synthetic
ctaagacacttgctggccccaaaggacccgtgtgccaaatgtacactaatgttgaccaagatcttgtaggttggc

SEQ ID NO: 110584 - DNA, 75 bp, Artificial Sequence
  Synthetic
tacgccatggaccgggagatggctgcatcgtgcggaggcgcggtttttataggtctggcacttttgaccttgtca

SEQ ID NO: 110585 - DNA, 75 bp, Artificial Sequence
  Synthetic
gttgaccaagatcttgtaggttggcccgcccctgcgggggcgcggtccctgacaccgtgctcctgtggctcaagt

SEQ ID NO: 110586 - DNA, 75 bp, Artificial Sequence
  Synthetic
gtgttggataccggtcacacccaatgtggccatcagccaacccggtgctctcacgcaggggctgcggacacacat

SEQ ID NO: 110587 - DNA, 75 bp, Artificial Sequence
  Synthetic
atgggtttctcatatgataccaggtgttttgattcaacagtgactgagcgcgacatccgcactgaggagtcgatt

SEQ ID NO: 110588 - DNA, 75 bp, Artificial Sequence
  Synthetic
tcagggtttgcgagaaaatggccctttatgacataacacagaagcttcccgtcgcagtgatggggcgctcctatg

SEQ ID NO: 110589 - DNA, 75 bp, Artificial Sequence
  Synthetic
agcccacgacccataagcaccttaaaggggtcgtctggcggtcccatgctatgcccttcgggccacgtcgcgggg

SEQ ID NO: 110590 - DNA, 75 bp, Artificial Sequence
  Synthetic
cgtcacgagcacctgggtgctggtaggcggggtccttgcagctctggccgcgtactgcctgacaacaggcagcgt

SEQ ID NO: 110591 - DNA, 75 bp, Artificial Sequence
  Synthetic
gggtgaaaccgcttcgaggttcgctggtattttctcctccggctccaggcagaacatccagttgattaacaccaa

SEQ ID NO: 110592 - DNA, 75 bp, Artificial Sequence
  Synthetic
taccaatgctgccagctggactctgtggcccgtaaggctatttcatcgctcaccgagcggttatacgtaggaggc

SEQ ID NO: 110593 - DNA, 75 bp, Artificial Sequence
  Synthetic
aggggtcgtctggcggtcccatgctatgcccttcgggccacgtcgcggggattttccgcgcggctgtgtgcacca

SEQ ID NO: 110594 - DNA, 75 bp, Artificial Sequence
  Synthetic
cacctcccttacatcgaacagggaatgcagcttgccgagcagttcaagcagaaggcgctcgggttgctgcaaaca

SEQ ID NO: 110595 - DNA, 75 bp, Artificial Sequence
  Synthetic
aggccacggccgcttgaaaagcagccggcctcaagaactttgacatgttggtctgcggagacgatttggtggtca

SEQ ID NO: 110596 - DNA, 75 bp, Artificial Sequence
  Synthetic
aggccacggccgcttgaaaagctgccggcctcaagaactttgacatgttggtctgcggagacgatttggtggtca

SEQ ID NO: 110597 - DNA, 75 bp, Artificial Sequence
  Synthetic
aggccacggccgcttgaaaagccgccggcctcaagaactttgacatgttggtctgcggagacgatttggtggtca

SEQ ID NO: 110598 - DNA, 75 bp, Artificial Sequence
  Synthetic
aggccacggccgcttgaaaagcggccggcctcaagaactttgacatgttggtctgcggagacgatttggtggtca

SEQ ID NO: 110599 - DNA, 75 bp, Artificial Sequence
  Synthetic
aggccacggccgcttgtaaagcagccggcctcaagaactttgacatgttggtctgcggagacgatttggtggtca

SEQ ID NO: 110600 - DNA, 75 bp, Artificial Sequence
  Synthetic
aggccacggccgcttgtaaagctgccggcctcaagaactttgacatgttggtctgcggagacgatttggtggtca

SEQ ID NO: 110601 - DNA, 75 bp, Artificial Sequence
  Synthetic
aggccacggccgcttgtaaagccgccggcctcaagaactttgacatgttggtctgcggagacgatttggtggtca

SEQ ID NO: 110602 - DNA, 75 bp, Artificial Sequence
  Synthetic
aggccacggccgcttgtaaagcggccggcctcaagaactttgacatgttggtctgcggagacgatttggtggtca

SEQ ID NO: 110603 - DNA, 75 bp, Artificial Sequence
  Synthetic
aggccacggccgcttgcaaagcagccggcctcaagaactttgacatgttggtctgcggagacgatttggtggtca

SEQ ID NO: 110604 - DNA, 75 bp, Artificial Sequence
  Synthetic
aggccacggccgcttgcaaagctgccggcctcaagaactttgacatgttggtctgcggagacgatttggtggtca

SEQ ID NO: 110605 - DNA, 75 bp, Artificial Sequence
  Synthetic
aggccacggccgcttgcaaagccgccggcctcaagaactttgacatgttggtctgcggagacgatttggtggtca

SEQ ID NO: 110606 - DNA, 75 bp, Artificial Sequence
  Synthetic
aggccacggccgcttgcaaagcggccggcctcaagaactttgacatgttggtctgcggagacgatttggtggtca

SEQ ID NO: 110607 - DNA, 75 bp, Artificial Sequence
  Synthetic
aggccacggccgcttggaaagcagccggcctcaagaactttgacatgttggtctgcggagacgatttggtggtca

SEQ ID NO: 110608 - DNA, 75 bp, Artificial Sequence
  Synthetic
aggccacggccgcttggaaagctgccggcctcaagaactttgacatgttggtctgcggagacgatttggtggtca

SEQ ID NO: 110609 - DNA, 75 bp, Artificial Sequence
  Synthetic
aggccacggccgcttggaaagccgccggcctcaagaactttgacatgttggtctgcggagacgatttggtggtca

SEQ ID NO: 110610 - DNA, 75 bp, Artificial Sequence
  Synthetic
aggccacggccgcttggaaagcggccggcctcaagaactttgacatgttggtctgcggagacgatttggtggtca

SEQ ID NO: 110611 - DNA, 75 bp, Artificial Sequence
  Synthetic
cggcctcaagaactttgacatgttggtctgcggagacgatttggtggtcatctctgagagcctcggagtctcaga

SEQ ID NO: 110612 - DNA, 75 bp, Artificial Sequence
  Synthetic
attctccatggtggggaactgggcgaaagtcctggtagtactgctgctatttgccggcgtcgacgcggaaaccca

SEQ ID NO: 110613 - DNA, 75 bp, Artificial Sequence
  Synthetic
attctccatggtggggaactgggcgaaagtcctggtagttctgctgctatttgccggcgtcgacgcggaaaccca

SEQ ID NO: 110614 - DNA, 75 bp, Artificial Sequence
  Synthetic
attctccatggtggggaactgggcgaaagtcctggtagtcctgctgctatttgccggcgtcgacgcggaaaccca

SEQ ID NO: 110615 - DNA, 75 bp, Artificial Sequence
  Synthetic
attctccatggtggggaactgggcgaaagtcctggtagtgctgctgctatttgccggcgtcgacgcggaaaccca

SEQ ID NO: 110616 - DNA, 75 bp, Artificial Sequence
  Synthetic
tttctccatggtggggaactgggcgaaagtcctggtagtactgctgctatttgccggcgtcgacgcggaaaccca

SEQ ID NO: 110617 - DNA, 75 bp, Artificial Sequence
  Synthetic
tttctccatggtggggaactgggcgaaagtcctggtagttctgctgctatttgccggcgtcgacgcggaaaccca

SEQ ID NO: 110618 - DNA, 75 bp, Artificial Sequence
  Synthetic
tttctccatggtggggaactgggcgaaagtcctggtagtcctgctgctatttgccggcgtcgacgcggaaaccca

SEQ ID NO: 110619 - DNA, 75 bp, Artificial Sequence
  Synthetic
tttctccatggtggggaactgggcgaaagtcctggtagtgctgctgctatttgccggcgtcgacgcggaaaccca

SEQ ID NO: 110620 - DNA, 75 bp, Artificial Sequence
  Synthetic
cttctccatggtggggaactgggcgaaagtcctggtagtactgctgctatttgccggcgtcgacgcggaaaccca

SEQ ID NO: 110621 - DNA, 75 bp, Artificial Sequence
  Synthetic
cttctccatggtggggaactgggcgaaagtcctggtagttctgctgctatttgccggcgtcgacgcggaaaccca

SEQ ID NO: 110622 - DNA, 75 bp, Artificial Sequence
  Synthetic
cttctccatggtggggaactgggcgaaagtcctggtagtcctgctgctatttgccggcgtcgacgcggaaaccca

SEQ ID NO: 110623 - DNA, 75 bp, Artificial Sequence
  Synthetic
cttctccatggtggggaactgggcgaaagtcctggtagtgctgctgctatttgccggcgtcgacgcggaaaccca

SEQ ID NO: 110624 - DNA, 75 bp, Artificial Sequence
  Synthetic
gttctccatggtggggaactgggcgaaagtcctggtagtactgctgctatttgccggcgtcgacgcggaaaccca

SEQ ID NO: 110625 - DNA, 75 bp, Artificial Sequence
  Synthetic
gttctccatggtggggaactgggcgaaagtcctggtagttctgctgctatttgccggcgtcgacgcggaaaccca

SEQ ID NO: 110626 - DNA, 75 bp, Artificial Sequence
  Synthetic
gttctccatggtggggaactgggcgaaagtcctggtagtcctgctgctatttgccggcgtcgacgcggaaaccca

SEQ ID NO: 110627 - DNA, 75 bp, Artificial Sequence
  Synthetic
gttctccatggtggggaactgggcgaaagtcctggtagtgctgctgctatttgccggcgtcgacgcggaaaccca

SEQ ID NO: 110628 - DNA, 75 bp, Artificial Sequence
  Synthetic
cgggtggggaaccttggaatacgagaccaatgtcaccaacgatgaggacatgaggccgtactgctggcattaccc

SEQ ID NO: 110629 - DNA, 75 bp, Artificial Sequence
  Synthetic
ttccatgcaaggggcgtgggcaaaggtcgttgtcatcttgctcctaaccgcgggggtagaagcaagtaccagggt

SEQ ID NO: 110630 - DNA, 75 bp, Artificial Sequence
  Synthetic
agctcaagggtacaaggtcctggtgctcaatccatcggtcgctgccaccctaggcttcggtagttacatgtctac

SEQ ID NO: 110631 - DNA, 75 bp, Artificial Sequence
  Synthetic
caaacagcaaagggcaatcctgcgggtacaggcgttgccgcgcgagcggagtgctcaccaccagcatgggtaaca

SEQ ID NO: 110632 - DNA, 75 bp, Artificial Sequence
  Synthetic
ctatggtaagttcctcgctgacggcgggtgctctggcggagcctatgatgtcatcatctgtgatgagtgtcactc

SEQ ID NO: 110633 - DNA, 75 bp, Artificial Sequence
  Synthetic
catgtcaaccgtacagctttgaattgtaatgatagtctaaacactggcttccttgcgtccttgttctacacccgc

SEQ ID NO: 110634 - DNA, 75 bp, Artificial Sequence
  Synthetic
cgaaacctgagagtcttcacggaggctatgaccaggtactccgctccccccggtgacccccccaaagcagaatat

SEQ ID NO: 110635 - DNA, 75 bp, Artificial Sequence
  Synthetic
tatactccagtcccaagaaacactccataaagcactcgacttcgatatatacggagtcacatacagcatcactcc

SEQ ID NO: 110636 - DNA, 75 bp, Artificial Sequence
  Synthetic
tggtatcacaagcagaagcagccttggagaaccttgtcacgctgaacgccgtcgctgctgctgggacacatggta

SEQ ID NO: 110637 - DNA, 75 bp, Artificial Sequence
  Synthetic
ctaacagtgatgacatgaggccctactgttggcattacccacctaaaccgtgtggtatagtacctgcacagtctg

SEQ ID NO: 110638 - DNA, 75 bp, Artificial Sequence
  Synthetic
cctcgcgaccgccactccgcctggttcagtcacagtcccccatccaaacataacggagtcagcgttacctaccac

SEQ ID NO: 110639 - DNA, 75 bp, Artificial Sequence
  Synthetic
tcccaagaagaagtgtgacgagctcgccaaacagctcgtgtcattaggcctgaacgccgtggcattttatcgagg

SEQ ID NO: 110640 - DNA, 75 bp, Artificial Sequence
  Synthetic
tgtaatgttactgtcacacaggtcgtggactttagtctcgacccgacatttacaatagagaccaccactgtccca

SEQ ID NO: 110641 - DNA, 75 bp, Artificial Sequence
  Synthetic
cacatactctccccacgaactcactcgggtggctgctgctctcagaaaacttggagcgcctccccttagagcgtg

SEQ ID NO: 110642 - DNA, 75 bp, Artificial Sequence
  Synthetic
gtgctgagttcactcacaattaccagcttacttaggagactacatgcctggatcactgaagattgcccagtccca

SEQ ID NO: 110643 - DNA, 75 bp, Artificial Sequence
  Synthetic
ttggagcgcctccccttagagcgtggaagagccgagctcgtgtagtgagggcttccctcatcagccgggggggga

SEQ ID NO: 110644 - DNA, 75 bp, Artificial Sequence
  Synthetic
gcgacatacgtcaagtgcggggccgggccttggctgacacctaggtgtttgatccactacccctacaggctgtgg

SEQ ID NO: 110645 - DNA, 75 bp, Artificial Sequence
  Synthetic
ccatccttaatttttgacatcactaagctgctgatagcagtaataggcccattatacttaatacaggccgccatc

SEQ ID NO: 110646 - DNA, 75 bp, Artificial Sequence
  Synthetic
tcctgtgcctactcctacttacagtaggagtaggcatctttttactccccgcccgatagaggggggggcctaagc

SEQ ID NO: 110647 - DNA, 75 bp, Artificial Sequence
  Synthetic
tcgacagtgtcatcctctgcgaggcgtacgacacagggtgcgcgtggtatgaactgacaccagcggagaccaccg

SEQ ID NO: 110648 - DNA, 75 bp, Artificial Sequence
  Synthetic
ccattttcaagatacggatgtacgtagggggagttgaacacaggctggaagcagcatgcaatttcacccgtgggg

SEQ ID NO: 110649 - DNA, 75 bp, Artificial Sequence
  Synthetic
ttcggctgcgcgcctacctaaataccccagggcttccggtctgccaagaccatcttgagttttgggagggggtct

SEQ ID NO: 110650 - DNA, 75 bp, Artificial Sequence
  Synthetic
ctctgccctcggcttgtggtcctttctccttctagtgctggccctgccacggcaggcttatgccttggaccccgc

SEQ ID NO: 110651 - DNA, 75 bp, Artificial Sequence
  Synthetic
agcattgtccaccggcctcctacacctccaccagaacatcgtggacgtacagtacatgtatggcctgtcaccagc

SEQ ID NO: 110652 - DNA, 75 bp, Artificial Sequence
  Synthetic
agcacctgggtgctagtaggcggggtcctcgcagctctggccgcgtattgcctgacaacaggcagcgtggtcatt

SEQ ID NO: 110653 - DNA, 75 bp, Artificial Sequence
  Synthetic
cagagctaaggccccccccccctcctgggacacgatgtggaagtgcctaatcaggctcaagcctatgctcacggg

SEQ ID NO: 110654 - DNA, 75 bp, Artificial Sequence
  Synthetic
catcacgaagtacgtcgtcaagtgggagtgggtggtcctcttgttcctgctgctagcggacgctagggtctgcgc

SEQ ID NO: 110655 - DNA, 75 bp, Artificial Sequence
  Synthetic
gcgtctgttggccccgatcacagcatacgcccagcaaactaggggccttcttgggactattgtgaccagcttgac

SEQ ID NO: 110656 - DNA, 75 bp, Artificial Sequence
  Synthetic
catgacttgcatgtctgcagaccttgaggtgatcacgagtacctgggtgttggtggggggggtcgtcgccgccct

SEQ ID NO: 110657 - DNA, 75 bp, Artificial Sequence
  Synthetic
tacttcttcctgttctttgtggcagcctggtacatcaaaggtcgggtggtcccttccgccacttactgcttgctc

SEQ ID NO: 110658 - DNA, 75 bp, Artificial Sequence
  Synthetic
tacacctccaccaaaatatcgtggatgtccaatacctttatggtgttggatctggcatggtggggtgggcgttga

SEQ ID NO: 110659 - DNA, 75 bp, Artificial Sequence
  Synthetic
cccgctcaccacccaacataccctcctgttcaacatcttggggggatgggtggccgcccaactcgccccccccag

SEQ ID NO: 110660 - DNA, 75 bp, Artificial Sequence
  Synthetic
ccatttctgttatcacactcactccggcgtataagatcttcctttaccggtgtttgtggtggctgagctatatgc

SEQ ID NO: 110661 - DNA, 75 bp, Artificial Sequence
  Synthetic
aaacaaaaagtccttggcctcatacaatccacaagcaaacaagcagaggaactaaagccggcagtccacgcggcc

SEQ ID NO: 110662 - DNA, 75 bp, Artificial Sequence
  Synthetic
gggtcgacacacagtccagcactacttccaaggtgcccccttctccgggaggggagtccgactcagagtcatgct

SEQ ID NO: 110663 - DNA, 75 bp, Artificial Sequence
  Synthetic
cgaggaggtcgcgacggcatcatatgggcagcaaccatgttctgcccaggtgtggtgtttgacgtaaccaaatgg

SEQ ID NO: 110664 - DNA, 75 bp, Artificial Sequence
  Synthetic
gagttgcacacccgactttggtatttgacatcaccaaactgttgctggccgtcatcgggcccctttggattctac

SEQ ID NO: 110665 - DNA, 75 bp, Artificial Sequence
  Synthetic
gagttgcacacccgactttggtatttgacatcaccaaactgttgctggccgtcatcgggcccctttggattcttc

SEQ ID NO: 110666 - DNA, 75 bp, Artificial Sequence
  Synthetic
gagttgcacacccgactttggtatttgacatcaccaaactgttgctggccgtcatcgggcccctttggattctcc

SEQ ID NO: 110667 - DNA, 75 bp, Artificial Sequence
  Synthetic
gagttgcacacccgactttggtatttgacatcaccaaactgttgctggccgtcatcgggcccctttggattctgc

SEQ ID NO: 110668 - DNA, 75 bp, Artificial Sequence
  Synthetic
gagttgcacacccgactttggtatttgacatcaccaaactgttgctggccgtcttcgggcccctttggattctac

SEQ ID NO: 110669 - DNA, 75 bp, Artificial Sequence
  Synthetic
gagttgcacacccgactttggtatttgacatcaccaaactgttgctggccgtcttcgggcccctttggattcttc

SEQ ID NO: 110670 - DNA, 75 bp, Artificial Sequence
  Synthetic
gagttgcacacccgactttggtatttgacatcaccaaactgttgctggccgtcttcgggcccctttggattctcc

SEQ ID NO: 110671 - DNA, 75 bp, Artificial Sequence
  Synthetic
gagttgcacacccgactttggtatttgacatcaccaaactgttgctggccgtcttcgggcccctttggattctgc

SEQ ID NO: 110672 - DNA, 75 bp, Artificial Sequence
  Synthetic
gagttgcacacccgactttggtatttgacatcaccaaactgttgctggccgtcctcgggcccctttggattctac

SEQ ID NO: 110673 - DNA, 75 bp, Artificial Sequence
  Synthetic
gagttgcacacccgactttggtatttgacatcaccaaactgttgctggccgtcctcgggcccctttggattcttc

SEQ ID NO: 110674 - DNA, 75 bp, Artificial Sequence
  Synthetic
gagttgcacacccgactttggtatttgacatcaccaaactgttgctggccgtcctcgggcccctttggattctcc

SEQ ID NO: 110675 - DNA, 75 bp, Artificial Sequence
  Synthetic
gagttgcacacccgactttggtatttgacatcaccaaactgttgctggccgtcctcgggcccctttggattctgc

SEQ ID NO: 110676 - DNA, 75 bp, Artificial Sequence
  Synthetic
gagttgcacacccgactttggtatttgacatcaccaaactgttgctggccgtcgtcgggcccctttggattctac

SEQ ID NO: 110677 - DNA, 75 bp, Artificial Sequence
  Synthetic
gagttgcacacccgactttggtatttgacatcaccaaactgttgctggccgtcgtcgggcccctttggattcttc

SEQ ID NO: 110678 - DNA, 75 bp, Artificial Sequence
  Synthetic
gagttgcacacccgactttggtatttgacatcaccaaactgttgctggccgtcgtcgggcccctttggattctcc

SEQ ID NO: 110679 - DNA, 75 bp, Artificial Sequence
  Synthetic
gagttgcacacccgactttggtatttgacatcaccaaactgttgctggccgtcgtcgggcccctttggattctgc

SEQ ID NO: 110680 - DNA, 75 bp, Artificial Sequence
  Synthetic
gtgttgcacacccgactttggtatttgacatcaccaaactgttgctggccgtcatcgggcccctttggattctac

SEQ ID NO: 110681 - DNA, 75 bp, Artificial Sequence
  Synthetic
gtgttgcacacccgactttggtatttgacatcaccaaactgttgctggccgtcatcgggcccctttggattcttc

SEQ ID NO: 110682 - DNA, 75 bp, Artificial Sequence
  Synthetic
gtgttgcacacccgactttggtatttgacatcaccaaactgttgctggccgtcatcgggcccctttggattctcc

SEQ ID NO: 110683 - DNA, 75 bp, Artificial Sequence
  Synthetic
gtgttgcacacccgactttggtatttgacatcaccaaactgttgctggccgtcatcgggcccctttggattctgc

SEQ ID NO: 110684 - DNA, 75 bp, Artificial Sequence
  Synthetic
gtgttgcacacccgactttggtatttgacatcaccaaactgttgctggccgtcttcgggcccctttggattctac

SEQ ID NO: 110685 - DNA, 75 bp, Artificial Sequence
  Synthetic
gtgttgcacacccgactttggtatttgacatcaccaaactgttgctggccgtcttcgggcccctttggattcttc

SEQ ID NO: 110686 - DNA, 75 bp, Artificial Sequence
  Synthetic
gtgttgcacacccgactttggtatttgacatcaccaaactgttgctggccgtcttcgggcccctttggattctcc

SEQ ID NO: 110687 - DNA, 75 bp, Artificial Sequence
  Synthetic
gtgttgcacacccgactttggtatttgacatcaccaaactgttgctggccgtcttcgggcccctttggattctgc

SEQ ID NO: 110688 - DNA, 75 bp, Artificial Sequence
  Synthetic
gtgttgcacacccgactttggtatttgacatcaccaaactgttgctggccgtcctcgggcccctttggattctac

SEQ ID NO: 110689 - DNA, 75 bp, Artificial Sequence
  Synthetic
gtgttgcacacccgactttggtatttgacatcaccaaactgttgctggccgtcctcgggcccctttggattcttc

SEQ ID NO: 110690 - DNA, 75 bp, Artificial Sequence
  Synthetic
gtgttgcacacccgactttggtatttgacatcaccaaactgttgctggccgtcctcgggcccctttggattctcc

SEQ ID NO: 110691 - DNA, 75 bp, Artificial Sequence
  Synthetic
gtgttgcacacccgactttggtatttgacatcaccaaactgttgctggccgtcctcgggcccctttggattctgc

SEQ ID NO: 110692 - DNA, 75 bp, Artificial Sequence
  Synthetic
gtgttgcacacccgactttggtatttgacatcaccaaactgttgctggccgtcgtcgggcccctttggattctac

SEQ ID NO: 110693 - DNA, 75 bp, Artificial Sequence
  Synthetic
gtgttgcacacccgactttggtatttgacatcaccaaactgttgctggccgtcgtcgggcccctttggattcttc

SEQ ID NO: 110694 - DNA, 75 bp, Artificial Sequence
  Synthetic
gtgttgcacacccgactttggtatttgacatcaccaaactgttgctggccgtcgtcgggcccctttggattctcc

SEQ ID NO: 110695 - DNA, 75 bp, Artificial Sequence
  Synthetic
gtgttgcacacccgactttggtatttgacatcaccaaactgttgctggccgtcgtcgggcccctttggattctgc

SEQ ID NO: 110696 - DNA, 75 bp, Artificial Sequence
  Synthetic
gcgttgcacacccgactttggtatttgacatcaccaaactgttgctggccgtcatcgggcccctttggattctac

SEQ ID NO: 110697 - DNA, 75 bp, Artificial Sequence
  Synthetic
gcgttgcacacccgactttggtatttgacatcaccaaactgttgctggccgtcatcgggcccctttggattcttc

SEQ ID NO: 110698 - DNA, 75 bp, Artificial Sequence
  Synthetic
gcgttgcacacccgactttggtatttgacatcaccaaactgttgctggccgtcatcgggcccctttggattctcc

SEQ ID NO: 110699 - DNA, 75 bp, Artificial Sequence
  Synthetic
gcgttgcacacccgactttggtatttgacatcaccaaactgttgctggccgtcatcgggcccctttggattctgc

SEQ ID NO: 110700 - DNA, 75 bp, Artificial Sequence
  Synthetic
gcgttgcacacccgactttggtatttgacatcaccaaactgttgctggccgtcttcgggcccctttggattctac

SEQ ID NO: 110701 - DNA, 75 bp, Artificial Sequence
  Synthetic
gcgttgcacacccgactttggtatttgacatcaccaaactgttgctggccgtcttcgggcccctttggattcttc

SEQ ID NO: 110702 - DNA, 75 bp, Artificial Sequence
  Synthetic
gcgttgcacacccgactttggtatttgacatcaccaaactgttgctggccgtcttcgggcccctttggattctcc

SEQ ID NO: 110703 - DNA, 75 bp, Artificial Sequence
  Synthetic
gcgttgcacacccgactttggtatttgacatcaccaaactgttgctggccgtcttcgggcccctttggattctgc

SEQ ID NO: 110704 - DNA, 75 bp, Artificial Sequence
  Synthetic
gcgttgcacacccgactttggtatttgacatcaccaaactgttgctggccgtcctcgggcccctttggattctac

SEQ ID NO: 110705 - DNA, 75 bp, Artificial Sequence
  Synthetic
gcgttgcacacccgactttggtatttgacatcaccaaactgttgctggccgtcctcgggcccctttggattcttc

SEQ ID NO: 110706 - DNA, 75 bp, Artificial Sequence
  Synthetic
gcgttgcacacccgactttggtatttgacatcaccaaactgttgctggccgtcctcgggcccctttggattctcc

SEQ ID NO: 110707 - DNA, 75 bp, Artificial Sequence
  Synthetic
gcgttgcacacccgactttggtatttgacatcaccaaactgttgctggccgtcctcgggcccctttggattctgc

SEQ ID NO: 110708 - DNA, 75 bp, Artificial Sequence
  Synthetic
gcgttgcacacccgactttggtatttgacatcaccaaactgttgctggccgtcgtcgggcccctttggattctac

SEQ ID NO: 110709 - DNA, 75 bp, Artificial Sequence
  Synthetic
gcgttgcacacccgactttggtatttgacatcaccaaactgttgctggccgtcgtcgggcccctttggattcttc

SEQ ID NO: 110710 - DNA, 75 bp, Artificial Sequence
  Synthetic
gcgttgcacacccgactttggtatttgacatcaccaaactgttgctggccgtcgtcgggcccctttggattctcc

SEQ ID NO: 110711 - DNA, 75 bp, Artificial Sequence
  Synthetic
gcgttgcacacccgactttggtatttgacatcaccaaactgttgctggccgtcgtcgggcccctttggattctgc

SEQ ID NO: 110712 - DNA, 75 bp, Artificial Sequence
  Synthetic
gggttgcacacccgactttggtatttgacatcaccaaactgttgctggccgtcatcgggcccctttggattctac

SEQ ID NO: 110713 - DNA, 75 bp, Artificial Sequence
  Synthetic
gggttgcacacccgactttggtatttgacatcaccaaactgttgctggccgtcatcgggcccctttggattcttc

SEQ ID NO: 110714 - DNA, 75 bp, Artificial Sequence
  Synthetic
gggttgcacacccgactttggtatttgacatcaccaaactgttgctggccgtcatcgggcccctttggattctcc

SEQ ID NO: 110715 - DNA, 75 bp, Artificial Sequence
  Synthetic
gggttgcacacccgactttggtatttgacatcaccaaactgttgctggccgtcatcgggcccctttggattctgc

SEQ ID NO: 110716 - DNA, 75 bp, Artificial Sequence
  Synthetic
gggttgcacacccgactttggtatttgacatcaccaaactgttgctggccgtcttcgggcccctttggattctac

SEQ ID NO: 110717 - DNA, 75 bp, Artificial Sequence
  Synthetic
gggttgcacacccgactttggtatttgacatcaccaaactgttgctggccgtcttcgggcccctttggattcttc

SEQ ID NO: 110718 - DNA, 75 bp, Artificial Sequence
  Synthetic
gggttgcacacccgactttggtatttgacatcaccaaactgttgctggccgtcttcgggcccctttggattctcc

SEQ ID NO: 110719 - DNA, 75 bp, Artificial Sequence
  Synthetic
gggttgcacacccgactttggtatttgacatcaccaaactgttgctggccgtcttcgggcccctttggattctgc

SEQ ID NO: 110720 - DNA, 75 bp, Artificial Sequence
  Synthetic
gggttgcacacccgactttggtatttgacatcaccaaactgttgctggccgtcctcgggcccctttggattctac

SEQ ID NO: 110721 - DNA, 75 bp, Artificial Sequence
  Synthetic
gggttgcacacccgactttggtatttgacatcaccaaactgttgctggccgtcctcgggcccctttggattcttc

SEQ ID NO: 110722 - DNA, 75 bp, Artificial Sequence
  Synthetic
gggttgcacacccgactttggtatttgacatcaccaaactgttgctggccgtcctcgggcccctttggattctcc

SEQ ID NO: 110723 - DNA, 75 bp, Artificial Sequence
  Synthetic
gggttgcacacccgactttggtatttgacatcaccaaactgttgctggccgtcctcgggcccctttggattctgc

SEQ ID NO: 110724 - DNA, 75 bp, Artificial Sequence
  Synthetic
gggttgcacacccgactttggtatttgacatcaccaaactgttgctggccgtcgtcgggcccctttggattctac

SEQ ID NO: 110725 - DNA, 75 bp, Artificial Sequence
  Synthetic
gggttgcacacccgactttggtatttgacatcaccaaactgttgctggccgtcgtcgggcccctttggattcttc

SEQ ID NO: 110726 - DNA, 75 bp, Artificial Sequence
  Synthetic
gggttgcacacccgactttggtatttgacatcaccaaactgttgctggccgtcgtcgggcccctttggattctcc

SEQ ID NO: 110727 - DNA, 75 bp, Artificial Sequence
  Synthetic
gggttgcacacccgactttggtatttgacatcaccaaactgttgctggccgtcgtcgggcccctttggattctgc

SEQ ID NO: 110728 - DNA, 75 bp, Artificial Sequence
  Synthetic
ggggagtccgactcagagtcatgctcgtctatgcctcctctcgagggagagccgggcgatccagacttgagttgc

SEQ ID NO: 110729 - DNA, 75 bp, Artificial Sequence
  Synthetic
ttgcctctctcatgtctttctctgcctctctcactagcccgctgtcgacgcatcaaaccctcctattgaacatct

SEQ ID NO: 110730 - DNA, 75 bp, Artificial Sequence
  Synthetic
tcggtggcggccacactaggcttcggctctttcatgtcgcgtgcctatgggatcgaccccaacatccgcactggg

SEQ ID NO: 110731 - DNA, 75 bp, Artificial Sequence
  Synthetic
acgggtgatcgtggacgtcttagccggatacggtgctggcgtgtccggggcacttgtcgcatttaaaatcatgtg

SEQ ID NO: 110732 - DNA, 75 bp, Artificial Sequence
  Synthetic
cgccatgctggacctagtgagggagcaactcagtggatgaacaggctcatagcctttgcctctagaggcaatcat

SEQ ID NO: 110733 - DNA, 75 bp, Artificial Sequence
  Synthetic
gagtacgtctccaagggctggaggctccttgcccccatcaccgcttatgctcaacagacccgtggcctgttgggc

SEQ ID NO: 110734 - DNA, 75 bp, Artificial Sequence
  Synthetic
gtgccacattctaacatcgaagaagtggccctgggctctgaaggtgagatccctttctacggtaaggctataccg

SEQ ID NO: 110735 - DNA, 75 bp, Artificial Sequence
  Synthetic
cttgctggaagacaccacaactccaattccaaccaccatcatggcgaagagcgaggttttttgtgtggatcctac

SEQ ID NO: 110736 - DNA, 75 bp, Artificial Sequence
  Synthetic
ccctttctacggtaaggctataccgatagccctgctcaagggggggaggcaccttatcttttgccattccaagaa

SEQ ID NO: 110737 - DNA, 75 bp, Artificial Sequence
  Synthetic
cgggggttctttggactgtcttccatggtgctgggaacaagacgctggctggctcgcgagggccagttacgcaga

SEQ ID NO: 110738 - DNA, 75 bp, Artificial Sequence
  Synthetic
gtggggacgatgggtcctgcctatggattccaatactcgcctcaacagcgggtcgaacgtctgctgaagatgtgg

SEQ ID NO: 110739 - DNA, 75 bp, Artificial Sequence
  Synthetic
tgctctctgatttcaagacctggcttaaagcaaagctcgttccagcgctacctggagtcccctttctctcgtgcc

SEQ ID NO: 110740 - DNA, 75 bp, Artificial Sequence
  Synthetic
tcatgactggattcaccggagacttcgattctgtcatagattgcaacgtggctgttgaacagtacgttgacttca

SEQ ID NO: 110741 - DNA, 75 bp, Artificial Sequence
  Synthetic
aacgagggttccgcgggacgtggcggggggacggcatttgccataccacgtgcccatgcgggtcagagatcaccg

SEQ ID NO: 110742 - DNA, 75 bp, Artificial Sequence
  Synthetic
cacccggaacgccgatgtcatcccggctcggaggcggggagaccgccggggagcgctgctctctccaaggcccct

SEQ ID NO: 110743 - DNA, 75 bp, Artificial Sequence
  Synthetic
gggggacggcatttgccataccacgtgcccatgcgggtcagagatcaccggacacgtcaaaaatgggaccatgaa

SEQ ID NO: 110744 - DNA, 75 bp, Artificial Sequence
  Synthetic
gtcatccctcaaggggtcgtcgggtgggccggtcctttgctccagggggcatgcggttggaattttccgggcggc

SEQ ID NO: 110745 - DNA, 75 bp, Artificial Sequence
  Synthetic
gtcatccctcaaggggtcgtcgggtgggccggtcctttgctccagggggcatgcggttggtattttccgggcggc

SEQ ID NO: 110746 - DNA, 75 bp, Artificial Sequence
  Synthetic
gtcatccctcaaggggtcgtcgggtgggccggtcctttgctccagggggcatgcggttggcattttccgggcggc

SEQ ID NO: 110747 - DNA, 75 bp, Artificial Sequence
  Synthetic
gtcatccctcaaggggtcgtcgggtgggccggtcctttgctccagggggcatgcggttgggattttccgggcggc

SEQ ID NO: 110748 - DNA, 75 bp, Artificial Sequence
  Synthetic
catatgcgatgaatgccattcagtggacgccactaccatccttggcattggaacagtcctcgaccaggctgagac

SEQ ID NO: 110749 - DNA, 75 bp, Artificial Sequence
  Synthetic
tccctgcgcggcgcaggggggactccacagcgagcttgctcagtcctaggcctctcgccagtctcaagggttcct

SEQ ID NO: 110750 - DNA, 75 bp, Artificial Sequence
  Synthetic
gcgaaccggaaccagacgtcacggttgtaacgtccatgctcatcgacccctcacatgtaactgctgaggctgcgg

SEQ ID NO: 110751 - DNA, 75 bp, Artificial Sequence
  Synthetic
catcttgctcctccaacgtctccgtggcacgggacgacaaggggaggaggtactattacctcacccgtgatgcca

SEQ ID NO: 110752 - DNA, 75 bp, Artificial Sequence
  Synthetic
tcgcagatggaggctgctctggaggagcctatgacatcataatatgcgatgaatgccattcagtggattccacaa

SEQ ID NO: 110753 - DNA, 75 bp, Artificial Sequence
  Synthetic
ccacccccctggcccgtgctgcttgggagacagctcgtcacactccagttacctcctggctggggaacatcatca

SEQ ID NO: 110754 - DNA, 75 bp, Artificial Sequence
  Synthetic
actggcagcggtaagagcacaaaggtcccggccgcctacgtagcacaaggatataatgttctcgtgttgaatcca

SEQ ID NO: 110755 - DNA, 75 bp, Artificial Sequence
  Synthetic
gcccgctgaatgccatcggcctcgcaggcccaaattcccaccagcgctgcctatatgggctacgccaggttacaa

SEQ ID NO: 110756 - DNA, 75 bp, Artificial Sequence
  Synthetic
gggcatgggtctcaacgcagtggcatactatagggggctagatgtctccgtgattccatctcaaggagatgtggt

SEQ ID NO: 110757 - DNA, 75 bp, Artificial Sequence
  Synthetic
acgagcttggagacatcgggcacgagcagtgcgcgctatgcttatcgcccagggagggaaggccaggatttgtgg

SEQ ID NO: 110758 - DNA, 75 bp, Artificial Sequence
  Synthetic
aggaggaagaaagtggtacagctcgattcttccaacgtttcggccgcccttgcgcagttggctgcaaagactttt

SEQ ID NO: 110759 - DNA, 75 bp, Artificial Sequence
  Synthetic
gaccccactttcaccataaccacacagactgtcccccaggatgcggtatcgcgcagccagcgccgaggaaggacg

SEQ ID NO: 110760 - DNA, 75 bp, Artificial Sequence
  Synthetic
tagcactgagtcttcagaacacgacagggatgatggggttgcatctgaagctgaatcctacagctctatgccccc

SEQ ID NO: 110761 - DNA, 75 bp, Artificial Sequence
  Synthetic
ctgctttgcctactccctactaacagtaggggtaggcatctttctcttgccagctcgatgagctggtaagataac

SEQ ID NO: 110762 - DNA, 75 bp, Artificial Sequence
  Synthetic
tcgcgtggtatgagctcacaccaacggagacaacagttaggctccgggcatacttcaacacgcccggactgcccg

SEQ ID NO: 110763 - DNA, 75 bp, Artificial Sequence
  Synthetic
ccccactactgaggacatggtcaacctgttgcccgccatactatctccgggcgctctcgtcgtcggtgtgatatg

SEQ ID NO: 110764 - DNA, 75 bp, Artificial Sequence
  Synthetic
gcgctctcgtcgtcggtgtgatatgcgctgccatactacgtcgacacgtaggacctggggagggagcggtacagt

SEQ ID NO: 110765 - DNA, 75 bp, Artificial Sequence
  Synthetic
gatcacgtcggggtccctacttacacctggggggagaatgagactgatgtcttccttttgaactcgaccagaccg

SEQ ID NO: 110766 - DNA, 75 bp, Artificial Sequence
  Synthetic
catatagatgcccacttcctttctcaaacaaagcaatcgggggagaacttcccatacctagtggcttaccaggcc

SEQ ID NO: 110767 - DNA, 75 bp, Artificial Sequence
  Synthetic
catcaatcctctaagcaactccctcatccgtcaccataacttggtatattccacttcatctagaagcgcggcgac

SEQ ID NO: 110768 - DNA, 75 bp, Artificial Sequence
  Synthetic
ccgggacaagaaccaggtcgagggggaggttcaagtggtctccaccgcaacacaatctttcctggcgacctgcgt

SEQ ID NO: 110769 - DNA, 75 bp, Artificial Sequence
  Synthetic
gagttctctaactgtcacaagtctgctccggcggttacacaagtggatcaatgaagactacccaagcccttgcag

SEQ ID NO: 110770 - DNA, 75 bp, Artificial Sequence
  Synthetic
tgtatcgtcttggggcagtcagcaatgaggtcaccttcacccaccccgtgaccaagtacatcgccacgtgcatgc

SEQ ID NO: 110771 - DNA, 75 bp, Artificial Sequence
  Synthetic
aacgggactgggttcaccaagacatgcggcgcaccaccatgccgcattaggagggattacaacagcactctcgat

SEQ ID NO: 110772 - DNA, 75 bp, Artificial Sequence
  Synthetic
aggccattaaccacatcaactccgtgtgggcggacttgctggaggacactcaaacaccaataccaacaacaatca

SEQ ID NO: 110773 - DNA, 75 bp, Artificial Sequence
  Synthetic
ctggctgccatggctgcctactgcctagcgaccggctgtgttgtcatcattggtcgcgtgtgtgttaaccaacgg

SEQ ID NO: 110774 - DNA, 75 bp, Artificial Sequence
  Synthetic
tgcgagacctggccacggctgtggaaccagtcgtcttctcccaaatggagaccaagctcatcacgtggggggcag

SEQ ID NO: 110775 - DNA, 75 bp, Artificial Sequence
  Synthetic
aagatgtggcgctccaagaaaaccccaatggggttctcttatgacaccagatgctttgactcaacagtcacggag

SEQ ID NO: 110776 - DNA, 75 bp, Artificial Sequence
  Synthetic
gccctatgtacaactcaaagggccagctctgtggtcaacgccgatgccgggcaagcggggtactccccacaagca

SEQ ID NO: 110777 - DNA, 75 bp, Artificial Sequence
  Synthetic
acccaagagtgcaactgctccatctaccaaggtcacatcacgggccaccgcatggcatgggacatgatgttgaac

SEQ ID NO: 110778 - DNA, 75 bp, Artificial Sequence
  Synthetic
gccagggtctgtgcatgcctttggatgctcatcatactgggccaggccgaggcggcgcttgagaagctcatcatc

SEQ ID NO: 110779 - DNA, 75 bp, Artificial Sequence
  Synthetic
agctgtcgccccattgacacgttcgctcaggggtggggtcccatcactcatgccatgcctagcgtctcggaccag

SEQ ID NO: 110780 - DNA, 75 bp, Artificial Sequence
  Synthetic
cagctggtcaacaccaacggcagctggcatatcaataggacggccctgaactgcaatgatagccttcacaccggc

SEQ ID NO: 110781 - DNA, 75 bp, Artificial Sequence
  Synthetic
gatttccggcgcgctcgtggcttttaagatcatgtcaggcgagaaaccctctgtggaggatgtcgtcaatctact

SEQ ID NO: 110782 - DNA, 75 bp, Artificial Sequence
  Synthetic
cgtaactgaaagtgctggagtgaacgaggatatcgctaacctgcgagccttcacggaggctatgaccaggtattc

SEQ ID NO: 110783 - DNA, 75 bp, Artificial Sequence
  Synthetic
gtgggccaaagtcattgccatcctccttctcgtcgcgggggtggatgcgagcaccaccatcaccggtagcctagt

SEQ ID NO: 110784 - DNA, 75 bp, Artificial Sequence
  Synthetic
ggcccacgatggagacggcaggagatattactacctcactcgtgaccctgtcaccccactggcgagggcggcgtg

SEQ ID NO: 110785 - DNA, 75 bp, Artificial Sequence
  Synthetic
ggtcatgattgcaatcatatccatctttactcttaccccagcatacaagactcttttgagccggtcagtgtggtg

SEQ ID NO: 110786 - DNA, 75 bp, Artificial Sequence
  Synthetic
ggccggactacaaccctccactgttggaccgctggaaagcaccggattatgtaccaccaactgtccatggatgtg

SEQ ID NO: 110787 - DNA, 75 bp, Artificial Sequence
  Synthetic
ggtgcctcctcctcggaggaaaagaacaatccagctggacggctccaatgtgtccgcggcgctagctgcgctagc

SEQ ID NO: 110788 - DNA, 75 bp, Artificial Sequence
  Synthetic
ccccactgctgaggacatggtcaacctattgcccgctatactttctccaggcgctctcgtcgtcggcgtgatatg

SEQ ID NO: 110789 - DNA, 75 bp, Artificial Sequence
  Synthetic
tcccgaaaatgcctggtatcccctttatctcctgtcaaaagggttataagggggtgtggtctggcacaggcatca

SEQ ID NO: 110790 - DNA, 75 bp, Artificial Sequence
  Synthetic
tcccgaaaatgcctggtatcccctttatctcctgtcaaaagggttataagggggtgtggtctggcactggcatca

SEQ ID NO: 110791 - DNA, 75 bp, Artificial Sequence
  Synthetic
tcccgaaaatgcctggtatcccctttatctcctgtcaaaagggttataagggggtgtggtctggcaccggcatca

SEQ ID NO: 110792 - DNA, 75 bp, Artificial Sequence
  Synthetic
tcccgaaaatgcctggtatcccctttatctcctgtcaaaagggttataagggggtgtggtctggcacgggcatca

SEQ ID NO: 110793 - DNA, 75 bp, Artificial Sequence
  Synthetic
tcccgaaaatgcctggtatcccctttatctcctgtcaaaagggttatatgggggtgtggtctggcacaggcatca

SEQ ID NO: 110794 - DNA, 75 bp, Artificial Sequence
  Synthetic
tcccgaaaatgcctggtatcccctttatctcctgtcaaaagggttatatgggggtgtggtctggcactggcatca

SEQ ID NO: 110795 - DNA, 75 bp, Artificial Sequence
  Synthetic
tcccgaaaatgcctggtatcccctttatctcctgtcaaaagggttatatgggggtgtggtctggcaccggcatca

SEQ ID NO: 110796 - DNA, 75 bp, Artificial Sequence
  Synthetic
tcccgaaaatgcctggtatcccctttatctcctgtcaaaagggttatatgggggtgtggtctggcacgggcatca

SEQ ID NO: 110797 - DNA, 75 bp, Artificial Sequence
  Synthetic
tcccgaaaatgcctggtatcccctttatctcctgtcaaaagggttatacgggggtgtggtctggcacaggcatca

SEQ ID NO: 110798 - DNA, 75 bp, Artificial Sequence
  Synthetic
tcccgaaaatgcctggtatcccctttatctcctgtcaaaagggttatacgggggtgtggtctggcactggcatca

SEQ ID NO: 110799 - DNA, 75 bp, Artificial Sequence
  Synthetic
tcccgaaaatgcctggtatcccctttatctcctgtcaaaagggttatacgggggtgtggtctggcaccggcatca

SEQ ID NO: 110800 - DNA, 75 bp, Artificial Sequence
  Synthetic
tcccgaaaatgcctggtatcccctttatctcctgtcaaaagggttatacgggggtgtggtctggcacgggcatca

SEQ ID NO: 110801 - DNA, 75 bp, Artificial Sequence
  Synthetic
tcccgaaaatgcctggtatcccctttatctcctgtcaaaagggttataggggggtgtggtctggcacaggcatca

SEQ ID NO: 110802 - DNA, 75 bp, Artificial Sequence
  Synthetic
tcccgaaaatgcctggtatcccctttatctcctgtcaaaagggttataggggggtgtggtctggcactggcatca

SEQ ID NO: 110803 - DNA, 75 bp, Artificial Sequence
  Synthetic
tcccgaaaatgcctggtatcccctttatctcctgtcaaaagggttataggggggtgtggtctggcaccggcatca

SEQ ID NO: 110804 - DNA, 75 bp, Artificial Sequence
  Synthetic
tcccgaaaatgcctggtatcccctttatctcctgtcaaaagggttataggggggtgtggtctggcacgggcatca

SEQ ID NO: 110805 - DNA, 75 bp, Artificial Sequence
  Synthetic
tcccgaaaatgcctggtatcccctttttctcctgtcaaaagggttataagggggtgtggtctggcacaggcatca

SEQ ID NO: 110806 - DNA, 75 bp, Artificial Sequence
  Synthetic
tcccgaaaatgcctggtatcccctttttctcctgtcaaaagggttataagggggtgtggtctggcactggcatca

SEQ ID NO: 110807 - DNA, 75 bp, Artificial Sequence
  Synthetic
tcccgaaaatgcctggtatcccctttttctcctgtcaaaagggttataagggggtgtggtctggcaccggcatca

SEQ ID NO: 110808 - DNA, 75 bp, Artificial Sequence
  Synthetic
tcccgaaaatgcctggtatcccctttttctcctgtcaaaagggttataagggggtgtggtctggcacgggcatca

SEQ ID NO: 110809 - DNA, 75 bp, Artificial Sequence
  Synthetic
tcccgaaaatgcctggtatcccctttttctcctgtcaaaagggttatatgggggtgtggtctggcacaggcatca

SEQ ID NO: 110810 - DNA, 75 bp, Artificial Sequence
  Synthetic
tcccgaaaatgcctggtatcccctttttctcctgtcaaaagggttatatgggggtgtggtctggcactggcatca

SEQ ID NO: 110811 - DNA, 75 bp, Artificial Sequence
  Synthetic
tcccgaaaatgcctggtatcccctttttctcctgtcaaaagggttatatgggggtgtggtctggcaccggcatca

SEQ ID NO: 110812 - DNA, 75 bp, Artificial Sequence
  Synthetic
tcccgaaaatgcctggtatcccctttttctcctgtcaaaagggttatatgggggtgtggtctggcacgggcatca

SEQ ID NO: 110813 - DNA, 75 bp, Artificial Sequence
  Synthetic
tcccgaaaatgcctggtatcccctttttctcctgtcaaaagggttatacgggggtgtggtctggcacaggcatca

SEQ ID NO: 110814 - DNA, 75 bp, Artificial Sequence
  Synthetic
tcccgaaaatgcctggtatcccctttttctcctgtcaaaagggttatacgggggtgtggtctggcactggcatca

SEQ ID NO: 110815 - DNA, 75 bp, Artificial Sequence
  Synthetic
tcccgaaaatgcctggtatcccctttttctcctgtcaaaagggttatacgggggtgtggtctggcaccggcatca

SEQ ID NO: 110816 - DNA, 75 bp, Artificial Sequence
  Synthetic
tcccgaaaatgcctggtatcccctttttctcctgtcaaaagggttatacgggggtgtggtctggcacgggcatca

SEQ ID NO: 110817 - DNA, 75 bp, Artificial Sequence
  Synthetic
tcccgaaaatgcctggtatcccctttttctcctgtcaaaagggttataggggggtgtggtctggcacaggcatca

SEQ ID NO: 110818 - DNA, 75 bp, Artificial Sequence
  Synthetic
tcccgaaaatgcctggtatcccctttttctcctgtcaaaagggttataggggggtgtggtctggcactggcatca

SEQ ID NO: 110819 - DNA, 75 bp, Artificial Sequence
  Synthetic
tcccgaaaatgcctggtatcccctttttctcctgtcaaaagggttataggggggtgtggtctggcaccggcatca

SEQ ID NO: 110820 - DNA, 75 bp, Artificial Sequence
  Synthetic
tcccgaaaatgcctggtatcccctttttctcctgtcaaaagggttataggggggtgtggtctggcacgggcatca

SEQ ID NO: 110821 - DNA, 75 bp, Artificial Sequence
  Synthetic
tcccgaaaatgcctggtatcccctttctctcctgtcaaaagggttataagggggtgtggtctggcacaggcatca

SEQ ID NO: 110822 - DNA, 75 bp, Artificial Sequence
  Synthetic
tcccgaaaatgcctggtatcccctttctctcctgtcaaaagggttataagggggtgtggtctggcactggcatca

SEQ ID NO: 110823 - DNA, 75 bp, Artificial Sequence
  Synthetic
tcccgaaaatgcctggtatcccctttctctcctgtcaaaagggttataagggggtgtggtctggcaccggcatca

SEQ ID NO: 110824 - DNA, 75 bp, Artificial Sequence
  Synthetic
tcccgaaaatgcctggtatcccctttctctcctgtcaaaagggttataagggggtgtggtctggcacgggcatca

SEQ ID NO: 110825 - DNA, 75 bp, Artificial Sequence
  Synthetic
tcccgaaaatgcctggtatcccctttctctcctgtcaaaagggttatatgggggtgtggtctggcacaggcatca

SEQ ID NO: 110826 - DNA, 75 bp, Artificial Sequence
  Synthetic
tcccgaaaatgcctggtatcccctttctctcctgtcaaaagggttatatgggggtgtggtctggcactggcatca

SEQ ID NO: 110827 - DNA, 75 bp, Artificial Sequence
  Synthetic
tcccgaaaatgcctggtatcccctttctctcctgtcaaaagggttatatgggggtgtggtctggcaccggcatca

SEQ ID NO: 110828 - DNA, 75 bp, Artificial Sequence
  Synthetic
tcccgaaaatgcctggtatcccctttctctcctgtcaaaagggttatatgggggtgtggtctggcacgggcatca

SEQ ID NO: 110829 - DNA, 75 bp, Artificial Sequence
  Synthetic
tcccgaaaatgcctggtatcccctttctctcctgtcaaaagggttatacgggggtgtggtctggcacaggcatca

SEQ ID NO: 110830 - DNA, 75 bp, Artificial Sequence
  Synthetic
tcccgaaaatgcctggtatcccctttctctcctgtcaaaagggttatacgggggtgtggtctggcactggcatca

SEQ ID NO: 110831 - DNA, 75 bp, Artificial Sequence
  Synthetic
tcccgaaaatgcctggtatcccctttctctcctgtcaaaagggttatacgggggtgtggtctggcaccggcatca

SEQ ID NO: 110832 - DNA, 75 bp, Artificial Sequence
  Synthetic
tcccgaaaatgcctggtatcccctttctctcctgtcaaaagggttatacgggggtgtggtctggcacgggcatca

SEQ ID NO: 110833 - DNA, 75 bp, Artificial Sequence
  Synthetic
tcccgaaaatgcctggtatcccctttctctcctgtcaaaagggttataggggggtgtggtctggcacaggcatca

SEQ ID NO: 110834 - DNA, 75 bp, Artificial Sequence
  Synthetic
tcccgaaaatgcctggtatcccctttctctcctgtcaaaagggttataggggggtgtggtctggcactggcatca

SEQ ID NO: 110835 - DNA, 75 bp, Artificial Sequence
  Synthetic
tcccgaaaatgcctggtatcccctttctctcctgtcaaaagggttataggggggtgtggtctggcaccggcatca

SEQ ID NO: 110836 - DNA, 75 bp, Artificial Sequence
  Synthetic
tcccgaaaatgcctggtatcccctttctctcctgtcaaaagggttataggggggtgtggtctggcacgggcatca

SEQ ID NO: 110837 - DNA, 75 bp, Artificial Sequence
  Synthetic
tcccgaaaatgcctggtatcccctttgtctcctgtcaaaagggttataagggggtgtggtctggcacaggcatca

SEQ ID NO: 110838 - DNA, 75 bp, Artificial Sequence
  Synthetic
tcccgaaaatgcctggtatcccctttgtctcctgtcaaaagggttataagggggtgtggtctggcactggcatca

SEQ ID NO: 110839 - DNA, 75 bp, Artificial Sequence
  Synthetic
tcccgaaaatgcctggtatcccctttgtctcctgtcaaaagggttataagggggtgtggtctggcaccggcatca

SEQ ID NO: 110840 - DNA, 75 bp, Artificial Sequence
  Synthetic
tcccgaaaatgcctggtatcccctttgtctcctgtcaaaagggttataagggggtgtggtctggcacgggcatca

SEQ ID NO: 110841 - DNA, 75 bp, Artificial Sequence
  Synthetic
tcccgaaaatgcctggtatcccctttgtctcctgtcaaaagggttatatgggggtgtggtctggcacaggcatca

SEQ ID NO: 110842 - DNA, 75 bp, Artificial Sequence
  Synthetic
tcccgaaaatgcctggtatcccctttgtctcctgtcaaaagggttatatgggggtgtggtctggcactggcatca

SEQ ID NO: 110843 - DNA, 75 bp, Artificial Sequence
  Synthetic
tcccgaaaatgcctggtatcccctttgtctcctgtcaaaagggttatatgggggtgtggtctggcaccggcatca

SEQ ID NO: 110844 - DNA, 75 bp, Artificial Sequence
  Synthetic
tcccgaaaatgcctggtatcccctttgtctcctgtcaaaagggttatatgggggtgtggtctggcacgggcatca

SEQ ID NO: 110845 - DNA, 75 bp, Artificial Sequence
  Synthetic
tcccgaaaatgcctggtatcccctttgtctcctgtcaaaagggttatacgggggtgtggtctggcacaggcatca

SEQ ID NO: 110846 - DNA, 75 bp, Artificial Sequence
  Synthetic
tcccgaaaatgcctggtatcccctttgtctcctgtcaaaagggttatacgggggtgtggtctggcactggcatca

SEQ ID NO: 110847 - DNA, 75 bp, Artificial Sequence
  Synthetic
tcccgaaaatgcctggtatcccctttgtctcctgtcaaaagggttatacgggggtgtggtctggcaccggcatca

SEQ ID NO: 110848 - DNA, 75 bp, Artificial Sequence
  Synthetic
tcccgaaaatgcctggtatcccctttgtctcctgtcaaaagggttatacgggggtgtggtctggcacgggcatca

SEQ ID NO: 110849 - DNA, 75 bp, Artificial Sequence
  Synthetic
tcccgaaaatgcctggtatcccctttgtctcctgtcaaaagggttataggggggtgtggtctggcacaggcatca

SEQ ID NO: 110850 - DNA, 75 bp, Artificial Sequence
  Synthetic
tcccgaaaatgcctggtatcccctttgtctcctgtcaaaagggttataggggggtgtggtctggcactggcatca

SEQ ID NO: 110851 - DNA, 75 bp, Artificial Sequence
  Synthetic
tcccgaaaatgcctggtatcccctttgtctcctgtcaaaagggttataggggggtgtggtctggcaccggcatca

SEQ ID NO: 110852 - DNA, 75 bp, Artificial Sequence
  Synthetic
tcccgaaaatgcctggtatcccctttgtctcctgtcaaaagggttataggggggtgtggtctggcacgggcatca

SEQ ID NO: 110853 - DNA, 75 bp, Artificial Sequence
  Synthetic
ctggcattaccccccaaagccttgcggcatcgtcccggctaggacggtttgcgggccggtctattgcttcactcc

SEQ ID NO: 110854 - DNA, 75 bp, Artificial Sequence
  Synthetic
ggaggggagtccgactcagagtcatgctcgtccatgcctcctctcgagggagagccgggcgatccggacttgagt

SEQ ID NO: 110855 - DNA, 75 bp, Artificial Sequence
  Synthetic
ccacgaggagcttggtttggctgcacttggatgaacgcgaccgggtacactaagacgtgcggcgctccaccctgc

SEQ ID NO: 110856 - DNA, 75 bp, Artificial Sequence
  Synthetic
tgcgtggtgcatccgctctcgacttgtcggggtggtttacatcaggctacggcgggggggacgtatatcacagcg

SEQ ID NO: 110857 - DNA, 75 bp, Artificial Sequence
  Synthetic
gaggtaacacaacatggtccttatgcgtatgtgacagggttgaccaatgacaaccttaaggttccttgccaaata

SEQ ID NO: 110858 - DNA, 75 bp, Artificial Sequence
  Synthetic
cttccgatctactgtgccccactgactgttttaggaagcacccgggtgctacctatcttaagtgtggggcagggc

SEQ ID NO: 110859 - DNA, 75 bp, Artificial Sequence
  Synthetic
gccaccaaaagctttggcagctcctcaacttccggcattacgggcgacaacacgacaacatcctctgagcccgcc

SEQ ID NO: 110860 - DNA, 75 bp, Artificial Sequence
  Synthetic
actcctgtgcctactcctactgtccgtaggggtaggcatcttcctgctcccagcccggtaggctgagagctaaac

SEQ ID NO: 110861 - DNA, 75 bp, Artificial Sequence
  Synthetic
cgtgatgtctacacgctgtccttgcggagcatcaataactggtcatgtgaagaacgggtccatgcgacttgcagg

SEQ ID NO: 110862 - DNA, 75 bp, Artificial Sequence
  Synthetic
gcctcaactccttcgtagtcggatcccagcttccttgtgatcctgagcccgacacggaggtgcttgcgtccatgc

SEQ ID NO: 110863 - DNA, 75 bp, Artificial Sequence
  Synthetic
ggggacatctatttcgggggtactctggacagtgtatcacggggctggtaataagaccttggccggtcccaaagg

SEQ ID NO: 110864 - DNA, 75 bp, Artificial Sequence
  Synthetic
ccgtggcctattaccgcggtcttgacgtgtctgtcatcccgaccagcggcgacgttgtcgtcgtggcgaccgatg

SEQ ID NO: 110865 - DNA, 75 bp, Artificial Sequence
  Synthetic
gcaagtacctcttcaactgggcagtaaggaccaagcttaaactcactccaatcccggccgcgtcccagttggact

SEQ ID NO: 110866 - DNA, 75 bp, Artificial Sequence
  Synthetic
cccgtcattgcgggctacctgtactacacacggccggggccccgacattgacatggtagatgccaatcttttcat

SEQ ID NO: 110867 - DNA, 75 bp, Artificial Sequence
  Synthetic
tttccattacatcacgggggctacggaggacggactcaagtgtccgtgccaagtgccagctgctgagttctttac

SEQ ID NO: 110868 - DNA, 75 bp, Artificial Sequence
  Synthetic
agatgaccggcggggtgcactactctcgccgaggcctctttcaaccctcaagggatcatctggtggacccgtgct

SEQ ID NO: 110869 - DNA, 75 bp, Artificial Sequence
  Synthetic
ccatccgagtacttgctccccaggaagaggttcccaccggcattaccgccctgggcgcggcctgactacaacccg

SEQ ID NO: 110870 - DNA, 75 bp, Artificial Sequence
  Synthetic
tgccagtgccaatgggccgctgtggtctctcatcttctttacagcggcctggtacttaaaaggcagggtggttcc

SEQ ID NO: 110871 - DNA, 75 bp, Artificial Sequence
  Synthetic
caagctccagtgccgcctccacggaaaaagcggactgtagtcctagatcagagcaccgtgggggaggctcttaag

SEQ ID NO: 110872 - DNA, 75 bp, Artificial Sequence
  Synthetic
cgccgtagcgtattaccggggtcttgatgtgtccgtcataccgaccagcggagacgtcgttgtcgtggcaacaga

SEQ ID NO: 110873 - DNA, 75 bp, Artificial Sequence
  Synthetic
atgggttccccccctggaggcccgaggggggcgtgacgggatcatctgggtagctgtcattctacacccacgcct

SEQ ID NO: 110874 - DNA, 75 bp, Artificial Sequence
  Synthetic
aagagtccattgattcggagacggattccttgtcttcaatgccccccctggagggggagcctggagatcctgacc

SEQ ID NO: 110875 - DNA, 75 bp, Artificial Sequence
  Synthetic
atctccctccctggagggggaagcggctcccggctcgcactccggttcttggtctacgtgctctgaagaggacga

SEQ ID NO: 110876 - DNA, 75 bp, Artificial Sequence
  Synthetic
tgagagccttcacggaggctatgaccaggtactccgccccccccggggaccccccacaaccagaatacgacttgg

SEQ ID NO: 110877 - DNA, 75 bp, Artificial Sequence
  Synthetic
aatgatgacacactttttctccatactccaatcccaggagatacttgatcgaccccttgactttgaaatgtacgg

SEQ ID NO: 110878 - DNA, 75 bp, Artificial Sequence
  Synthetic
ctcattgagggcgaagaaggtaacgtttgacagggtgcaactacttgactcatactatgactcaaccctaaagga

SEQ ID NO: 110879 - DNA, 75 bp, Artificial Sequence
  Synthetic
tgtgtggggagccgagacggtggcatgtggggacatcctgcatggcctcccggtttccgcgaggctaggtaggga

SEQ ID NO: 110880 - DNA, 75 bp, Artificial Sequence
  Synthetic
tgcgactcttggtccaccgttagtgacagcgaggagcagagcgtggtctgctgctctatgtcgtactcttggacc

SEQ ID NO: 110881 - DNA, 75 bp, Artificial Sequence
  Synthetic
gtctatggaaactactatgcggtctccggtctttacggacaattcatctcccccggccgtaccgcagacattcca

SEQ ID NO: 110882 - DNA, 75 bp, Artificial Sequence
  Synthetic
gtccgtgtggaaggaccttttggaggactcagacacaccaattcctacaaccatcatggccaagaacgaggtgtt

SEQ ID NO: 110883 - DNA, 75 bp, Artificial Sequence
  Synthetic
cgtcaggggccttacgtccctctttacaccagggccgtctcagaaaatccagctcataaattctaacggcagctg

SEQ ID NO: 110884 - DNA, 75 bp, Artificial Sequence
  Synthetic
agaaaatccagcttgtaaacaccaacggcagctggcacatcaacaggactgccctgaactgcaatgactccctca

SEQ ID NO: 110885 - DNA, 75 bp, Artificial Sequence
  Synthetic
gccctgaactgcaatgactccctcaacactgggttccttgctgcgctgttctacgtgcacaagttcaactcatct

SEQ ID NO: 110886 - DNA, 75 bp, Artificial Sequence
  Synthetic
cacccgctgcttcgactcaacagtgacggagagggacatcagaaccgaggagtccatatatcttgcctgttccct

SEQ ID NO: 110887 - DNA, 75 bp, Artificial Sequence
  Synthetic
tgggacgtgatgtggaagtgtctaactaggctcaaacctacactgactggtcctacccccctcctgtaccgcttg

SEQ ID NO: 110888 - DNA, 75 bp, Artificial Sequence
  Synthetic
gggccagtcctgcggatatagacgttgtcgcgccagcggagtgctcaccactagcatgggaaacaccatcacgtg

SEQ ID NO: 110889 - DNA, 75 bp, Artificial Sequence
  Synthetic
gctttgccgacctcatggggtacatccccgtcgtaggcgccccgcttggaggcgtcgccagggctctcgcgcatg

SEQ ID NO: 110890 - DNA, 75 bp, Artificial Sequence
  Synthetic
cagatggaggctgttcagctggcgcctatgacgtcatcatatgcgacgaatgccattcagtggacgccactacca

SEQ ID NO: 110891 - DNA, 75 bp, Artificial Sequence
  Synthetic
caggtttgtgactccaggggaacggccttcgggcatgttcgattcttcggtcctgtgtgagtgctatgacgcggg

SEQ ID NO: 110892 - DNA, 75 bp, Artificial Sequence
  Synthetic
tgccattcagtggacgccactaccatccttggcattggaacggtcctcgaccaggctgagactgccggtgctagg

SEQ ID NO: 110893 - DNA, 75 bp, Artificial Sequence
  Synthetic
acggcaaggctattcccctagcccacatcaaggggggtagacacctgatcttctgccattcaaagaaaaagtgcg

SEQ ID NO: 110894 - DNA, 75 bp, Artificial Sequence
  Synthetic
ccgctctcagaaagcttggagcgccgcccttgagggcgtggaagagccgggctcgtgcagtgcgagcatctctca

SEQ ID NO: 110895 - DNA, 75 bp, Artificial Sequence
  Synthetic
ccgtcctgacgtcaatgctgtcagatcctgcccatatcacggcggagacggccaagcgcaggctagatcgagggt

SEQ ID NO: 110896 - DNA, 75 bp, Artificial Sequence
  Synthetic
acgcccctactgctggcactaccccccaaaaccttgtggtattgtgcccgcaaggagcgtgtgtggcccggtata

SEQ ID NO: 110897 - DNA, 75 bp, Artificial Sequence
  Synthetic
ctcctatggaggcaggagatgggcggcaacatcaccagggttgagtcagagaacaaagtggtgattctggactcc

SEQ ID NO: 110898 - DNA, 75 bp, Artificial Sequence
  Synthetic
gggggagaatgagacggatgtgctgcttcttaacaacacgcggccgccacagggcaactggttcggctgtacatg

SEQ ID NO: 110899 - DNA, 75 bp, Artificial Sequence
  Synthetic
tgcgagtgctacgatgccggagcagcctggtatgagctcacaccatctgagaccacggtgagactccgggcttat

SEQ ID NO: 110900 - DNA, 75 bp, Artificial Sequence
  Synthetic
gctcatcaacaccaacggcagctggcacatcaatcgcactgccttgaattgcaatgattctttgcacactggctt

SEQ ID NO: 110901 - DNA, 75 bp, Artificial Sequence
  Synthetic
cctaattggggccccaatgacccccggcgacggtcgcgcaatttgggtaaagtcatcgataccataacttgcggc

SEQ ID NO: 110902 - DNA, 75 bp, Artificial Sequence
  Synthetic
ctcttctggctgccccccagactccgacgctgagtcctattcttccatgccccccctggagggggagcctgggga

SEQ ID NO: 110903 - DNA, 75 bp, Artificial Sequence
  Synthetic
ttgctggcactacccaccgaaacagtgtggtatagtccccgcgagatctgtgtgtggcccagtgtattgtttcac

SEQ ID NO: 110904 - DNA, 75 bp, Artificial Sequence
  Synthetic
tgccgcatcagggccgacttcaatgccagcacggacttgctgtgtcccacggactgtttcagaaagcatcctgac

SEQ ID NO: 110905 - DNA, 75 bp, Artificial Sequence
  Synthetic
cttctgggcgaagcatatgtggaacttcatcagtgggatacaatacttggcgggcctgtcaacgttgcctggtaa

SEQ ID NO: 110906 - DNA, 75 bp, Artificial Sequence
  Synthetic
cgccctgtcaactggtctcatccacctccaccaaaacatcgtggacgtgcagtacttgtatggcctgtcacctgc

SEQ ID NO: 110907 - DNA, 75 bp, Artificial Sequence
  Synthetic
ctggtcaacaccaatggctcgtggcacatcaacagtactgccctgaattgtaatgagtccataaacaccgggttc

SEQ ID NO: 110908 - DNA, 75 bp, Artificial Sequence
  Synthetic
ccttccgaggacaagccgtactgctggcattattcgcccagaccctgtgacatagtgccagcaggagaggtttgc

SEQ ID NO: 110909 - DNA, 75 bp, Artificial Sequence
  Synthetic
ggagtgggcaccacccatgcaggcgcgtggcggccgcgatggcatcatatgggccgccactatattctgcccggg

SEQ ID NO: 110910 - DNA, 75 bp, Artificial Sequence
  Synthetic
ctcgccgatgggggatgctcagggggggcatatgacatcatcatatgtgacgagtgccattctacggaccctact

SEQ ID NO: 110911 - DNA, 75 bp, Artificial Sequence
  Synthetic
gaggctcagcagctgcaagcccatcacttccttcaagcaagggtggggccccttgacagatgctaacatcaccgg

SEQ ID NO: 110912 - DNA, 75 bp, Artificial Sequence
  Synthetic
atctcctaagagatgcattgacgcgtgtgccgtactttgtcagggctcacgctctgctgaggctgtgcgctatgg

SEQ ID NO: 110913 - DNA, 75 bp, Artificial Sequence
  Synthetic
agcggagacgtcgttgtcgtggcaacagacgctctaatgacgggctacaccggtgactttgactcagtgatcgac

SEQ ID NO: 110914 - DNA, 75 bp, Artificial Sequence
  Synthetic
gagccgcgtgggagacagcaagacacactccagtcaactcctggctaggcaacataatcatgtttgcccccacac

SEQ ID NO: 110915 - DNA, 75 bp, Artificial Sequence
  Synthetic
ctggggcgcgaatgagacagacgtgtttctgctggagtccctgcggcctcccagtggtcggtggtttgggtgcgc

SEQ ID NO: 110916 - DNA, 75 bp, Artificial Sequence
  Synthetic
accacctccacggaggaaaaagacggttgtcctgacagaatccaccgtgtcctctgccttggcggagcttgccac

SEQ ID NO: 110917 - DNA, 75 bp, Artificial Sequence
  Synthetic
cgcccccactggcagcggcaagagcaccaaggtgccggctgcgtatgcagcccaggggtacaaggtactcgtcct

SEQ ID NO: 110918 - DNA, 75 bp, Artificial Sequence
  Synthetic
tgtactccagtgctgagggggacttggtagggtggcccagcccccctgggaccaaatccttggagccgtgcacat

SEQ ID NO: 110919 - DNA, 75 bp, Artificial Sequence
  Synthetic
tttcatctgcttcgcatggcacatacggggcagggctgtccctctatttgcctatgcttgtcttcagttatggcc

SEQ ID NO: 110920 - DNA, 75 bp, Artificial Sequence
  Synthetic
accggaattgccaggacgaccgggtcctttcttggataaacccgctcaatgcctggagatttgggcgtgcccccg

SEQ ID NO: 110921 - DNA, 75 bp, Artificial Sequence
  Synthetic
ggaccggtgctttgccccaggggccacgctgtcggaatcttccgggcagctgtgtgctctcggggcgtggccaag

SEQ ID NO: 110922 - DNA, 75 bp, Artificial Sequence
  Synthetic
tactacagagggctggacgtctccgtaataccagcacagggagatgtggtggttgtcgccaccgatgccctcatg

SEQ ID NO: 110923 - DNA, 75 bp, Artificial Sequence
  Synthetic
caccctgcctgggaaccccgcaatagcatcactgatggcattcacagcctccatcaccagcccgcttaccaccca

SEQ ID NO: 110924 - DNA, 75 bp, Artificial Sequence
  Synthetic
acgcaagactgcaattgttctatctatcccggccatataacgggtcaccgcatggcatgggacatgatgatgaac

SEQ ID NO: 110925 - DNA, 75 bp, Artificial Sequence
  Synthetic
tgcgagcggtacgcaagacttccgagcggtcacagccccgtggtaggcgccaacccatccctaaggcgcgcccac

SEQ ID NO: 110926 - DNA, 75 bp, Artificial Sequence
  Synthetic
gcggtcacagccccgtggtaggcgccaacccatccctaaggcgcgcccacgcgagggccggtcctgggctcagcc

SEQ ID NO: 110927 - DNA, 75 bp, Artificial Sequence
  Synthetic
cagggggggagggccgccacttgtggcaagtacctcttcaactgggcagtaaagaccaagctcaaactcactcca

SEQ ID NO: 110928 - DNA, 75 bp, Artificial Sequence
  Synthetic
cctacctctaatcattcaaagactccacggccttagcgcattttcactccacagttactctccaggtgaaatcaa

SEQ ID NO: 110929 - DNA, 75 bp, Artificial Sequence
  Synthetic
gctcactggggagtcctggcgggcatagcgtatttctccatggtggggaactgggcgaaggtcctggtggtgctg

SEQ ID NO: 110930 - DNA, 75 bp, Artificial Sequence
  Synthetic
ggaggcggttttcactggccttacacacatagatgcccacttcctctcccagacaaagcaatcgggggagaactt

SEQ ID NO: 110931 - DNA, 75 bp, Artificial Sequence
  Synthetic
cggcgaagatcccgcaatttgggtaaggtcatcgatacccttacttgtggatttgccgacctcatggggtacatt

SEQ ID NO: 110932 - DNA, 75 bp, Artificial Sequence
  Synthetic
tagcgtatttctccatggtggggaactgggcgaaggtcctggtggtgctgttgctatttgccggcgtcgacgcgg

SEQ ID NO: 110933 - DNA, 75 bp, Artificial Sequence
  Synthetic
gcatctttctccttcccgcccgataggcgggaacaataaagctacactccatcagcttttccctgttacgctgtt

SEQ ID NO: 110934 - DNA, 75 bp, Artificial Sequence
  Synthetic
gaaatgcttgactcgactcaaacccacgctcgtgggtcctacgcccctcctctatcgtctgggctctgtcaccaa

SEQ ID NO: 110935 - DNA, 75 bp, Artificial Sequence
  Synthetic
gttgctctttctctatcttcctcctcgccatcttgtcatgcctgacagtgcctgcttctggtctggaatatcgga

SEQ ID NO: 110936 - DNA, 75 bp, Artificial Sequence
  Synthetic
gtggtgggaacgaccaacaggttgggcgtgcctacctacaactggggtagcaatgacacggacgtcttcgtcctt

SEQ ID NO: 110937 - DNA, 75 bp, Artificial Sequence
  Synthetic
cgcaacctcgaggtagacgtcagcctatccccaaggcgcgtcggcccgagggcaggacctgggctcagcccgggt

SEQ ID NO: 110938 - DNA, 75 bp, Artificial Sequence
  Synthetic
cgtcaggaagggcaacacatcccagtgctggataccattgtcacccacggtctctgtgagtggccctggggtcgt

SEQ ID NO: 110939 - DNA, 75 bp, Artificial Sequence
  Synthetic
acgggtgtccattgccacctaccaaggcccctccaataccacctccacggagaaagaggacggttgtcctgacag

SEQ ID NO: 110940 - DNA, 75 bp, Artificial Sequence
  Synthetic
ggacaagcattcacctttcgccaacgcagacattggacaacgcaggactgcaattgttccatgtaccccggacac

SEQ ID NO: 110941 - DNA, 75 bp, Artificial Sequence
  Synthetic
atctattgaccggagcgcactggggtgtgctggcggggctagcgtacttttccatgcagggcaactgggctaaag

SEQ ID NO: 110942 - DNA, 75 bp, Artificial Sequence
  Synthetic
acgtaaacaggaccgccctgaactgcaacgactccctccaaaccgggtgggttgccgcgctgttctacagccaca

SEQ ID NO: 110943 - DNA, 75 bp, Artificial Sequence
  Synthetic
ggttcaactcgtctggctgcccagagcgcatggccagctgccgccccatcggcgaattcgctcaggggtggggtc

SEQ ID NO: 110944 - DNA, 75 bp, Artificial Sequence
  Synthetic
cctcacaggtcgggacaagaaccaggtcgagggggaggttcaggtggtctccaccgcaacgcagtctttcctggc

SEQ ID NO: 110945 - DNA, 75 bp, Artificial Sequence
  Synthetic
ccagggtcctcagcagaagctcgaactcgtcaaatccaacgggtcgtggcacattaacaggacagctctgaactg

SEQ ID NO: 110946 - DNA, 75 bp, Artificial Sequence
  Synthetic
agcgacgggtcttggtctaccgtaagcgaggaggctggtgaggacgtcgtctgctgctcgatgtcctacacatgg

SEQ ID NO: 110947 - DNA, 75 bp, Artificial Sequence
  Synthetic
gggggaaggcgcggtccagtggatgaacaggctcattgcctttgcttccagagggaaccacgtcgcccccactca

SEQ ID NO: 110948 - DNA, 75 bp, Artificial Sequence
  Synthetic
aactggtttgaacaggggtatgggaaggtgaggcctgccaacatcacagaaaccgaggatgcgcgacaccattgc

SEQ ID NO: 110949 - DNA, 75 bp, Artificial Sequence
  Synthetic
ggcccaggccgcttcggggttcgctggtctctttaccactggtgccaagcagaacatccaattgattaacagcaa

SEQ ID NO: 110950 - DNA, 75 bp, Artificial Sequence
  Synthetic
acaagcttgggtaccccaccttcacctggggtgccaacgaatcagacgtcttcctgctggagtccaacaggccgc

SEQ ID NO: 110951 - DNA, 75 bp, Artificial Sequence
  Synthetic
acatgcttgggtaccccaccttcacctggggtgccaacgaatcagacgtcttcctgctggagtccaacaggccgc

SEQ ID NO: 110952 - DNA, 75 bp, Artificial Sequence
  Synthetic
acacgcttgggtaccccaccttcacctggggtgccaacgaatcagacgtcttcctgctggagtccaacaggccgc

SEQ ID NO: 110953 - DNA, 75 bp, Artificial Sequence
  Synthetic
acaggcttgggtaccccaccttcacctggggtgccaacgaatcagacgtcttcctgctggagtccaacaggccgc

SEQ ID NO: 110954 - DNA, 75 bp, Artificial Sequence
  Synthetic
gtcacagactaaacagcagggactcaacttcgcgtacctggctgcctaccaagccacagtgtgcgcacgcgcgca

SEQ ID NO: 110955 - DNA, 75 bp, Artificial Sequence
  Synthetic
actgcacgtgtgggttccccccctcaacgtccgaggggggcgcgacgctatcatcctactcatgtgtgttgtgca

SEQ ID NO: 110956 - DNA, 75 bp, Artificial Sequence
  Synthetic
gaaccgctctctgaactgcccaactgattgcttcaggaagcatcctgaggccacctacttgaagtgcggatcagg

SEQ ID NO: 110957 - DNA, 75 bp, Artificial Sequence
  Synthetic
ggtggcgtggaacatcgattagaggcagcctgcaactggaccagaggagaacgctgcgacctctccgatcgagat

SEQ ID NO: 110958 - DNA, 75 bp, Artificial Sequence
  Synthetic
ggtggcgtggaacatcgattagaggcagcctgcaactggaccagaggagaacgctgcgacctctccgatcgtgat

SEQ ID NO: 110959 - DNA, 75 bp, Artificial Sequence
  Synthetic
ggtggcgtggaacatcgattagaggcagcctgcaactggaccagaggagaacgctgcgacctctccgatcgcgat

SEQ ID NO: 110960 - DNA, 75 bp, Artificial Sequence
  Synthetic
ggtggcgtggaacatcgattagaggcagcctgcaactggaccagaggagaacgctgcgacctctccgatcgggat

SEQ ID NO: 110961 - DNA, 75 bp, Artificial Sequence
  Synthetic
tccaccagaacattgtggatgtccaatacttttacggtatcggctccagcgtcacgggttgggttatcaagtggg

SEQ ID NO: 110962 - DNA, 75 bp, Artificial Sequence
  Synthetic
gcaagctgcccatcaatgcgttgagcaactctttgctgcgtcaccacaacatggtctatgccacaacatcccgca

SEQ ID NO: 110963 - DNA, 75 bp, Artificial Sequence
  Synthetic
acagagcggctttacatcgggggccccctgactaattcaaaggggcagaactgcggctatcgccggtgccgcgcg

SEQ ID NO: 110964 - DNA, 75 bp, Artificial Sequence
  Synthetic
taggctgtggcattatccgtgcactgtaaattttaccatcttcaaggtgcggatgtatgtagggggggtggagca

SEQ ID NO: 110965 - DNA, 75 bp, Artificial Sequence
  Synthetic
atggtgaatctgctcccagctcttttgtcacctggggccctagtagtgggcgttgtgtgtgcggccatattgcgc

SEQ ID NO: 110966 - DNA, 75 bp, Artificial Sequence
  Synthetic
cctagtggtgctcaacgccgtttctgcggccggtacccacggcctagcttggtctttgttggtgttcatcctagc

SEQ ID NO: 110967 - DNA, 75 bp, Artificial Sequence
  Synthetic
ccgacctaccggcactatctactggcctattgcacctccaccaaaacatcgtggacgtgcagtacctttatggac

SEQ ID NO: 110968 - DNA, 75 bp, Artificial Sequence
  Synthetic
gcgtggacaggtgaggactctgcaaccttggggtgtgggatactgctcttgttcgggctgttcaccctttctccc

SEQ ID NO: 110969 - DNA, 75 bp, Artificial Sequence
  Synthetic
ccatctgagtatatgctccccaagagcaggttcccgccagccctaccgccttgggcacggccagactacaaccca

SEQ ID NO: 110970 - DNA, 75 bp, Artificial Sequence
  Synthetic
gcgcttgagaagctcatcatcttgcactccgctagcgctgctagtgccaatgggccgctgtggttcttcatcttc

SEQ ID NO: 110971 - DNA, 75 bp, Artificial Sequence
  Synthetic
gaggagggagagatggggtcattttggcaacagcgttcctttaccccactttgatgtttgacatcacgaagctcc

SEQ ID NO: 110972 - DNA, 75 bp, Artificial Sequence
  Synthetic
gacgccggacagtgggtttgagcgagagcaccataggagatgccctccaacagctggccgttaagaccttcggcc

SEQ ID NO: 110973 - DNA, 75 bp, Artificial Sequence
  Synthetic
cggcgtctctggccgggacgcacggtcttgtgtccttcctcgtgtttttctgctttgcatggcatctgaagggta

SEQ ID NO: 110974 - DNA, 75 bp, Artificial Sequence
  Synthetic
gcgcaacatcgtggggggtaaatatgtccaaatggctctactcacgttgggccggtggtgcggcacctacgtgta

SEQ ID NO: 110975 - DNA, 75 bp, Artificial Sequence
  Synthetic
atcacttggggtgcagacacagcagcatgcggagatatcctttgcggactgccggtgtccgcgcggctgggaagg

SEQ ID NO: 110976 - DNA, 75 bp, Artificial Sequence
  Synthetic
atcacttggggtgcagacacagctgcatgcggagatatcctttgcggactgccggtgtccgcgcggctgggaagg

SEQ ID NO: 110977 - DNA, 75 bp, Artificial Sequence
  Synthetic
atcacttggggtgcagacacagccgcatgcggagatatcctttgcggactgccggtgtccgcgcggctgggaagg

SEQ ID NO: 110978 - DNA, 75 bp, Artificial Sequence
  Synthetic
atcacttggggtgcagacacagcggcatgcggagatatcctttgcggactgccggtgtccgcgcggctgggaagg

SEQ ID NO: 110979 - DNA, 75 bp, Artificial Sequence
  Synthetic
tttgataggatgcaggtgctcgacgcctactatgactcaaccctaaaggacatcaagctagcggcctccaaggtc

SEQ ID NO: 110980 - DNA, 75 bp, Artificial Sequence
  Synthetic
caatcgtcaccagccttaccggaagggacaaaaatgatgctaccggccatgtgcaagtgttgtccaccaccacgc

SEQ ID NO: 110981 - DNA, 75 bp, Artificial Sequence
  Synthetic
ctatcgtcaccagccttaccggaagggacaaaaatgatgctaccggccatgtgcaagtgttgtccaccaccacgc

SEQ ID NO: 110982 - DNA, 75 bp, Artificial Sequence
  Synthetic
ccatcgtcaccagccttaccggaagggacaaaaatgatgctaccggccatgtgcaagtgttgtccaccaccacgc

SEQ ID NO: 110983 - DNA, 75 bp, Artificial Sequence
  Synthetic
cgatcgtcaccagccttaccggaagggacaaaaatgatgctaccggccatgtgcaagtgttgtccaccaccacgc

SEQ ID NO: 110984 - DNA, 75 bp, Artificial Sequence
  Synthetic
agaagaaggtcattgtgtggggggctgagacagtggcatgtggagacatcctgcatggcctcccggtttccgcga

SEQ ID NO: 110985 - DNA, 75 bp, Artificial Sequence
  Synthetic
ggggccaaggaggtccgcagcttgtccaggagggccgttaaccacatcaagtccgtgtgggaggaccttctggaa

SEQ ID NO: 110986 - DNA, 75 bp, Artificial Sequence
  Synthetic
gtacaccaatgtggaccaagatctggttggatggccggcgccacctggcaccaagtcattggacccatgcacatg

SEQ ID NO: 110987 - DNA, 75 bp, Artificial Sequence
  Synthetic
gtccaccaccggagagatccctttttacggcaaggccatccccctcgaagtaatcaagggggggagacatctcat

SEQ ID NO: 110988 - DNA, 75 bp, Artificial Sequence
  Synthetic
aggccgggcaggtccaggttctgtcctccgtcacacaatctttcttgggaacatccatttcgggggtcctctgga

SEQ ID NO: 110989 - DNA, 75 bp, Artificial Sequence
  Synthetic
tcttgtctcaagggttcatctggagggcctttgttgtgccccatgggccacgtggctggcatcttccgagctgcc

SEQ ID NO: 110990 - DNA, 75 bp, Artificial Sequence
  Synthetic
ttgcgcgcgggtcccctccatcagaggcaagctcatccgccagccaactatcggctccgtcgttgaaggccactt

SEQ ID NO: 110991 - DNA, 75 bp, Artificial Sequence
  Synthetic
ggcgcccccatcacgtactccacctacggcaagttccttgccgacggtggatgctccgggggcgcctatgacatc

SEQ ID NO: 110992 - DNA, 75 bp, Artificial Sequence
  Synthetic
acccatggcctctttacggtaatgagggttgcgggtgggcaggatggctcttgtccccccgtggttctcgaccgt

SEQ ID NO: 110993 - DNA, 75 bp, Artificial Sequence
  Synthetic
ttatggcggcaagagatgggcagcaacattacacgggtagagtctgaaacaaaggttgtgattcttgattcattc

SEQ ID NO: 110994 - DNA, 75 bp, Artificial Sequence
  Synthetic
cggctgtacctcaaacataccaagtggggtatctacatgcccctacaggcagtggtaagagcactaaggttcctg

SEQ ID NO: 110995 - DNA, 75 bp, Artificial Sequence
  Synthetic
cggctgttcctcaaacataccaagtggggtatctacatgcccctacaggcagtggtaagagcactaaggttcctg

SEQ ID NO: 110996 - DNA, 75 bp, Artificial Sequence
  Synthetic
cggctgtccctcaaacataccaagtggggtatctacatgcccctacaggcagtggtaagagcactaaggttcctg

SEQ ID NO: 110997 - DNA, 75 bp, Artificial Sequence
  Synthetic
cggctgtgcctcaaacataccaagtggggtatctacatgcccctacaggcagtggtaagagcactaaggttcctg

SEQ ID NO: 110998 - DNA, 75 bp, Artificial Sequence
  Synthetic
ccaccacttcccggagcgcagcaatgcgccagaagaaggtgactttcgatcgcatgcaagtgctagacaaacatt

SEQ ID NO: 110999 - DNA, 75 bp, Artificial Sequence
  Synthetic
tccaaacatacgcaccggcaccaggactgtcaacacaggggcccggctcacctattccacctacgggaaattcct

SEQ ID NO: 111000 - DNA, 75 bp, Artificial Sequence
  Synthetic
ggcgcacttgcaagtgtgggtcccccctctcaacgtccgggggggccgcgatgccatcatcctccttacgtgcgc

SEQ ID NO: 111001 - DNA, 75 bp, Artificial Sequence
  Synthetic
tctttctctatcttcctcttggcactactctcgtgcctgactgtccccgcttcggccataaactatcgcaaagct

SEQ ID NO: 111002 - DNA, 75 bp, Artificial Sequence
  Synthetic
tctttctctatcttcctcttggcactactctcgtgcctgactgtccccgcttcggccataaactatcgcaatgct

SEQ ID NO: 111003 - DNA, 75 bp, Artificial Sequence
  Synthetic
tctttctctatcttcctcttggcactactctcgtgcctgactgtccccgcttcggccataaactatcgcaacgct

SEQ ID NO: 111004 - DNA, 75 bp, Artificial Sequence
  Synthetic
tctttctctatcttcctcttggcactactctcgtgcctgactgtccccgcttcggccataaactatcgcaaggct

SEQ ID NO: 111005 - DNA, 75 bp, Artificial Sequence
  Synthetic
tctttctctatcttcctcttggcactactctcgtgcctgactgtccccgcttcggccattaactatcgcaaagct

SEQ ID NO: 111006 - DNA, 75 bp, Artificial Sequence
  Synthetic
tctttctctatcttcctcttggcactactctcgtgcctgactgtccccgcttcggccattaactatcgcaatgct

SEQ ID NO: 111007 - DNA, 75 bp, Artificial Sequence
  Synthetic
tctttctctatcttcctcttggcactactctcgtgcctgactgtccccgcttcggccattaactatcgcaacgct

SEQ ID NO: 111008 - DNA, 75 bp, Artificial Sequence
  Synthetic
tctttctctatcttcctcttggcactactctcgtgcctgactgtccccgcttcggccattaactatcgcaaggct

SEQ ID NO: 111009 - DNA, 75 bp, Artificial Sequence
  Synthetic
tctttctctatcttcctcttggcactactctcgtgcctgactgtccccgcttcggccatcaactatcgcaaagct

SEQ ID NO: 111010 - DNA, 75 bp, Artificial Sequence
  Synthetic
tctttctctatcttcctcttggcactactctcgtgcctgactgtccccgcttcggccatcaactatcgcaatgct

SEQ ID NO: 111011 - DNA, 75 bp, Artificial Sequence
  Synthetic
tctttctctatcttcctcttggcactactctcgtgcctgactgtccccgcttcggccatcaactatcgcaacgct

SEQ ID NO: 111012 - DNA, 75 bp, Artificial Sequence
  Synthetic
tctttctctatcttcctcttggcactactctcgtgcctgactgtccccgcttcggccatcaactatcgcaaggct

SEQ ID NO: 111013 - DNA, 75 bp, Artificial Sequence
  Synthetic
tctttctctatcttcctcttggcactactctcgtgcctgactgtccccgcttcggccatgaactatcgcaaagct

SEQ ID NO: 111014 - DNA, 75 bp, Artificial Sequence
  Synthetic
tctttctctatcttcctcttggcactactctcgtgcctgactgtccccgcttcggccatgaactatcgcaatgct

SEQ ID NO: 111015 - DNA, 75 bp, Artificial Sequence
  Synthetic
tctttctctatcttcctcttggcactactctcgtgcctgactgtccccgcttcggccatgaactatcgcaacgct

SEQ ID NO: 111016 - DNA, 75 bp, Artificial Sequence
  Synthetic
tctttctctatcttcctcttggcactactctcgtgcctgactgtccccgcttcggccatgaactatcgcaaggct

SEQ ID NO: 111017 - DNA, 75 bp, Artificial Sequence
  Synthetic
tctttctctatcttcctcttggcactactctcgtgcctgactgtccccgcttcggccttaaactatcgcaaagct

SEQ ID NO: 111018 - DNA, 75 bp, Artificial Sequence
  Synthetic
tctttctctatcttcctcttggcactactctcgtgcctgactgtccccgcttcggccttaaactatcgcaatgct

SEQ ID NO: 111019 - DNA, 75 bp, Artificial Sequence
  Synthetic
tctttctctatcttcctcttggcactactctcgtgcctgactgtccccgcttcggccttaaactatcgcaacgct

SEQ ID NO: 111020 - DNA, 75 bp, Artificial Sequence
  Synthetic
tctttctctatcttcctcttggcactactctcgtgcctgactgtccccgcttcggccttaaactatcgcaaggct

SEQ ID NO: 111021 - DNA, 75 bp, Artificial Sequence
  Synthetic
tctttctctatcttcctcttggcactactctcgtgcctgactgtccccgcttcggcctttaactatcgcaaagct

SEQ ID NO: 111022 - DNA, 75 bp, Artificial Sequence
  Synthetic
tctttctctatcttcctcttggcactactctcgtgcctgactgtccccgcttcggcctttaactatcgcaatgct

SEQ ID NO: 111023 - DNA, 75 bp, Artificial Sequence
  Synthetic
tctttctctatcttcctcttggcactactctcgtgcctgactgtccccgcttcggcctttaactatcgcaacgct

SEQ ID NO: 111024 - DNA, 75 bp, Artificial Sequence
  Synthetic
tctttctctatcttcctcttggcactactctcgtgcctgactgtccccgcttcggcctttaactatcgcaaggct

SEQ ID NO: 111025 - DNA, 75 bp, Artificial Sequence
  Synthetic
tctttctctatcttcctcttggcactactctcgtgcctgactgtccccgcttcggccttcaactatcgcaaagct

SEQ ID NO: 111026 - DNA, 75 bp, Artificial Sequence
  Synthetic
tctttctctatcttcctcttggcactactctcgtgcctgactgtccccgcttcggccttcaactatcgcaatgct

SEQ ID NO: 111027 - DNA, 75 bp, Artificial Sequence
  Synthetic
tctttctctatcttcctcttggcactactctcgtgcctgactgtccccgcttcggccttcaactatcgcaacgct

SEQ ID NO: 111028 - DNA, 75 bp, Artificial Sequence
  Synthetic
tctttctctatcttcctcttggcactactctcgtgcctgactgtccccgcttcggccttcaactatcgcaaggct

SEQ ID NO: 111029 - DNA, 75 bp, Artificial Sequence
  Synthetic
tctttctctatcttcctcttggcactactctcgtgcctgactgtccccgcttcggccttgaactatcgcaaagct

SEQ ID NO: 111030 - DNA, 75 bp, Artificial Sequence
  Synthetic
tctttctctatcttcctcttggcactactctcgtgcctgactgtccccgcttcggccttgaactatcgcaatgct

SEQ ID NO: 111031 - DNA, 75 bp, Artificial Sequence
  Synthetic
tctttctctatcttcctcttggcactactctcgtgcctgactgtccccgcttcggccttgaactatcgcaacgct

SEQ ID NO: 111032 - DNA, 75 bp, Artificial Sequence
  Synthetic
tctttctctatcttcctcttggcactactctcgtgcctgactgtccccgcttcggccttgaactatcgcaaggct

SEQ ID NO: 111033 - DNA, 75 bp, Artificial Sequence
  Synthetic
tctttctctatcttcctcttggcactactctcgtgcctgactgtccccgcttcggccctaaactatcgcaaagct

SEQ ID NO: 111034 - DNA, 75 bp, Artificial Sequence
  Synthetic
tctttctctatcttcctcttggcactactctcgtgcctgactgtccccgcttcggccctaaactatcgcaatgct

SEQ ID NO: 111035 - DNA, 75 bp, Artificial Sequence
  Synthetic
tctttctctatcttcctcttggcactactctcgtgcctgactgtccccgcttcggccctaaactatcgcaacgct

SEQ ID NO: 111036 - DNA, 75 bp, Artificial Sequence
  Synthetic
tctttctctatcttcctcttggcactactctcgtgcctgactgtccccgcttcggccctaaactatcgcaaggct

SEQ ID NO: 111037 - DNA, 75 bp, Artificial Sequence
  Synthetic
tctttctctatcttcctcttggcactactctcgtgcctgactgtccccgcttcggcccttaactatcgcaaagct

SEQ ID NO: 111038 - DNA, 75 bp, Artificial Sequence
  Synthetic
tctttctctatcttcctcttggcactactctcgtgcctgactgtccccgcttcggcccttaactatcgcaatgct

SEQ ID NO: 111039 - DNA, 75 bp, Artificial Sequence
  Synthetic
tctttctctatcttcctcttggcactactctcgtgcctgactgtccccgcttcggcccttaactatcgcaacgct

SEQ ID NO: 111040 - DNA, 75 bp, Artificial Sequence
  Synthetic
tctttctctatcttcctcttggcactactctcgtgcctgactgtccccgcttcggcccttaactatcgcaaggct

SEQ ID NO: 111041 - DNA, 75 bp, Artificial Sequence
  Synthetic
tctttctctatcttcctcttggcactactctcgtgcctgactgtccccgcttcggccctcaactatcgcaaagct

SEQ ID NO: 111042 - DNA, 75 bp, Artificial Sequence
  Synthetic
tctttctctatcttcctcttggcactactctcgtgcctgactgtccccgcttcggccctcaactatcgcaatgct

SEQ ID NO: 111043 - DNA, 75 bp, Artificial Sequence
  Synthetic
tctttctctatcttcctcttggcactactctcgtgcctgactgtccccgcttcggccctcaactatcgcaacgct

SEQ ID NO: 111044 - DNA, 75 bp, Artificial Sequence
  Synthetic
tctttctctatcttcctcttggcactactctcgtgcctgactgtccccgcttcggccctcaactatcgcaaggct

SEQ ID NO: 111045 - DNA, 75 bp, Artificial Sequence
  Synthetic
tctttctctatcttcctcttggcactactctcgtgcctgactgtccccgcttcggccctgaactatcgcaaagct

SEQ ID NO: 111046 - DNA, 75 bp, Artificial Sequence
  Synthetic
tctttctctatcttcctcttggcactactctcgtgcctgactgtccccgcttcggccctgaactatcgcaatgct

SEQ ID NO: 111047 - DNA, 75 bp, Artificial Sequence
  Synthetic
tctttctctatcttcctcttggcactactctcgtgcctgactgtccccgcttcggccctgaactatcgcaacgct

SEQ ID NO: 111048 - DNA, 75 bp, Artificial Sequence
  Synthetic
tctttctctatcttcctcttggcactactctcgtgcctgactgtccccgcttcggccctgaactatcgcaaggct

SEQ ID NO: 111049 - DNA, 75 bp, Artificial Sequence
  Synthetic
tctttctctatcttcctcttggcactactctcgtgcctgactgtccccgcttcggccgtaaactatcgcaaagct

SEQ ID NO: 111050 - DNA, 75 bp, Artificial Sequence
  Synthetic
tctttctctatcttcctcttggcactactctcgtgcctgactgtccccgcttcggccgtaaactatcgcaatgct

SEQ ID NO: 111051 - DNA, 75 bp, Artificial Sequence
  Synthetic
tctttctctatcttcctcttggcactactctcgtgcctgactgtccccgcttcggccgtaaactatcgcaacgct

SEQ ID NO: 111052 - DNA, 75 bp, Artificial Sequence
  Synthetic
tctttctctatcttcctcttggcactactctcgtgcctgactgtccccgcttcggccgtaaactatcgcaaggct

SEQ ID NO: 111053 - DNA, 75 bp, Artificial Sequence
  Synthetic
tctttctctatcttcctcttggcactactctcgtgcctgactgtccccgcttcggccgttaactatcgcaaagct

SEQ ID NO: 111054 - DNA, 75 bp, Artificial Sequence
  Synthetic
tctttctctatcttcctcttggcactactctcgtgcctgactgtccccgcttcggccgttaactatcgcaatgct

SEQ ID NO: 111055 - DNA, 75 bp, Artificial Sequence
  Synthetic
tctttctctatcttcctcttggcactactctcgtgcctgactgtccccgcttcggccgttaactatcgcaacgct

SEQ ID NO: 111056 - DNA, 75 bp, Artificial Sequence
  Synthetic
tctttctctatcttcctcttggcactactctcgtgcctgactgtccccgcttcggccgttaactatcgcaaggct

SEQ ID NO: 111057 - DNA, 75 bp, Artificial Sequence
  Synthetic
tctttctctatcttcctcttggcactactctcgtgcctgactgtccccgcttcggccgtcaactatcgcaaagct

SEQ ID NO: 111058 - DNA, 75 bp, Artificial Sequence
  Synthetic
tctttctctatcttcctcttggcactactctcgtgcctgactgtccccgcttcggccgtcaactatcgcaatgct

SEQ ID NO: 111059 - DNA, 75 bp, Artificial Sequence
  Synthetic
tctttctctatcttcctcttggcactactctcgtgcctgactgtccccgcttcggccgtcaactatcgcaacgct

SEQ ID NO: 111060 - DNA, 75 bp, Artificial Sequence
  Synthetic
tctttctctatcttcctcttggcactactctcgtgcctgactgtccccgcttcggccgtcaactatcgcaaggct

SEQ ID NO: 111061 - DNA, 75 bp, Artificial Sequence
  Synthetic
tctttctctatcttcctcttggcactactctcgtgcctgactgtccccgcttcggccgtgaactatcgcaaagct

SEQ ID NO: 111062 - DNA, 75 bp, Artificial Sequence
  Synthetic
tctttctctatcttcctcttggcactactctcgtgcctgactgtccccgcttcggccgtgaactatcgcaatgct

SEQ ID NO: 111063 - DNA, 75 bp, Artificial Sequence
  Synthetic
tctttctctatcttcctcttggcactactctcgtgcctgactgtccccgcttcggccgtgaactatcgcaacgct

SEQ ID NO: 111064 - DNA, 75 bp, Artificial Sequence
  Synthetic
tctttctctatcttcctcttggcactactctcgtgcctgactgtccccgcttcggccgtgaactatcgcaaggct

SEQ ID NO: 111065 - DNA, 75 bp, Artificial Sequence
  Synthetic
cttacctggtagcgtaccaagccaccgtgtgcgctagggcccaagcccctcccccgtcgtgggaccagatgtgga

SEQ ID NO: 111066 - DNA, 75 bp, Artificial Sequence
  Synthetic
ggttgtcccgagaggttggccagctgccgaccccttacctattttgcccagggctggggccctatcagtcatgcc

SEQ ID NO: 111067 - DNA, 75 bp, Artificial Sequence
  Synthetic
gatcaggctgagacagcgggtgtgagactaaccgtgctcgccacagctactcctcctggtagtgttactgtgccg

SEQ ID NO: 111068 - DNA, 75 bp, Artificial Sequence
  Synthetic
cagaggccgacacacagtccagcattacttccaaggtgccccctccaccaggagaggagtccgattcagagtcat

SEQ ID NO: 111069 - DNA, 75 bp, Artificial Sequence
  Synthetic
gagccatacatcggcgcgccgcttgagtccttgcggagtcatgtggaactgatggtgggggctgccactgtatgt

SEQ ID NO: 111070 - DNA, 75 bp, Artificial Sequence
  Synthetic
gagccatacatcggcgcgccgcttgagtccttgcggagtcatgtggaactgatggtgggggctgccactgtttgt

SEQ ID NO: 111071 - DNA, 75 bp, Artificial Sequence
  Synthetic
gagccatacatcggcgcgccgcttgagtccttgcggagtcatgtggaactgatggtgggggctgccactgtctgt

SEQ ID NO: 111072 - DNA, 75 bp, Artificial Sequence
  Synthetic
gagccatacatcggcgcgccgcttgagtccttgcggagtcatgtggaactgatggtgggggctgccactgtgtgt

SEQ ID NO: 111073 - DNA, 75 bp, Artificial Sequence
  Synthetic
gagccatacatcggcgcgccgcttgagtccttgcggagtcatgtggatctgatggtgggggctgccactgtatgt

SEQ ID NO: 111074 - DNA, 75 bp, Artificial Sequence
  Synthetic
gagccatacatcggcgcgccgcttgagtccttgcggagtcatgtggatctgatggtgggggctgccactgtttgt

SEQ ID NO: 111075 - DNA, 75 bp, Artificial Sequence
  Synthetic
gagccatacatcggcgcgccgcttgagtccttgcggagtcatgtggatctgatggtgggggctgccactgtctgt

SEQ ID NO: 111076 - DNA, 75 bp, Artificial Sequence
  Synthetic
gagccatacatcggcgcgccgcttgagtccttgcggagtcatgtggatctgatggtgggggctgccactgtgtgt

SEQ ID NO: 111077 - DNA, 75 bp, Artificial Sequence
  Synthetic
gagccatacatcggcgcgccgcttgagtccttgcggagtcatgtggacctgatggtgggggctgccactgtatgt

SEQ ID NO: 111078 - DNA, 75 bp, Artificial Sequence
  Synthetic
gagccatacatcggcgcgccgcttgagtccttgcggagtcatgtggacctgatggtgggggctgccactgtttgt

SEQ ID NO: 111079 - DNA, 75 bp, Artificial Sequence
  Synthetic
gagccatacatcggcgcgccgcttgagtccttgcggagtcatgtggacctgatggtgggggctgccactgtctgt

SEQ ID NO: 111080 - DNA, 75 bp, Artificial Sequence
  Synthetic
gagccatacatcggcgcgccgcttgagtccttgcggagtcatgtggacctgatggtgggggctgccactgtgtgt

SEQ ID NO: 111081 - DNA, 75 bp, Artificial Sequence
  Synthetic
gagccatacatcggcgcgccgcttgagtccttgcggagtcatgtggagctgatggtgggggctgccactgtatgt

SEQ ID NO: 111082 - DNA, 75 bp, Artificial Sequence
  Synthetic
gagccatacatcggcgcgccgcttgagtccttgcggagtcatgtggagctgatggtgggggctgccactgtttgt

SEQ ID NO: 111083 - DNA, 75 bp, Artificial Sequence
  Synthetic
gagccatacatcggcgcgccgcttgagtccttgcggagtcatgtggagctgatggtgggggctgccactgtctgt

SEQ ID NO: 111084 - DNA, 75 bp, Artificial Sequence
  Synthetic
gagccatacatcggcgcgccgcttgagtccttgcggagtcatgtggagctgatggtgggggctgccactgtgtgt

SEQ ID NO: 111085 - DNA, 75 bp, Artificial Sequence
  Synthetic
gtgccatacatcggcgcgccgcttgagtccttgcggagtcatgtggaactgatggtgggggctgccactgtatgt

SEQ ID NO: 111086 - DNA, 75 bp, Artificial Sequence
  Synthetic
gtgccatacatcggcgcgccgcttgagtccttgcggagtcatgtggaactgatggtgggggctgccactgtttgt

SEQ ID NO: 111087 - DNA, 75 bp, Artificial Sequence
  Synthetic
gtgccatacatcggcgcgccgcttgagtccttgcggagtcatgtggaactgatggtgggggctgccactgtctgt

SEQ ID NO: 111088 - DNA, 75 bp, Artificial Sequence
  Synthetic
gtgccatacatcggcgcgccgcttgagtccttgcggagtcatgtggaactgatggtgggggctgccactgtgtgt

SEQ ID NO: 111089 - DNA, 75 bp, Artificial Sequence
  Synthetic
gtgccatacatcggcgcgccgcttgagtccttgcggagtcatgtggatctgatggtgggggctgccactgtatgt

SEQ ID NO: 111090 - DNA, 75 bp, Artificial Sequence
  Synthetic
gtgccatacatcggcgcgccgcttgagtccttgcggagtcatgtggatctgatggtgggggctgccactgtttgt

SEQ ID NO: 111091 - DNA, 75 bp, Artificial Sequence
  Synthetic
gtgccatacatcggcgcgccgcttgagtccttgcggagtcatgtggatctgatggtgggggctgccactgtctgt

SEQ ID NO: 111092 - DNA, 75 bp, Artificial Sequence
  Synthetic
gtgccatacatcggcgcgccgcttgagtccttgcggagtcatgtggatctgatggtgggggctgccactgtgtgt

SEQ ID NO: 111093 - DNA, 75 bp, Artificial Sequence
  Synthetic
gtgccatacatcggcgcgccgcttgagtccttgcggagtcatgtggacctgatggtgggggctgccactgtatgt

SEQ ID NO: 111094 - DNA, 75 bp, Artificial Sequence
  Synthetic
gtgccatacatcggcgcgccgcttgagtccttgcggagtcatgtggacctgatggtgggggctgccactgtttgt

SEQ ID NO: 111095 - DNA, 75 bp, Artificial Sequence
  Synthetic
gtgccatacatcggcgcgccgcttgagtccttgcggagtcatgtggacctgatggtgggggctgccactgtctgt

SEQ ID NO: 111096 - DNA, 75 bp, Artificial Sequence
  Synthetic
gtgccatacatcggcgcgccgcttgagtccttgcggagtcatgtggacctgatggtgggggctgccactgtgtgt

SEQ ID NO: 111097 - DNA, 75 bp, Artificial Sequence
  Synthetic
gtgccatacatcggcgcgccgcttgagtccttgcggagtcatgtggagctgatggtgggggctgccactgtatgt

SEQ ID NO: 111098 - DNA, 75 bp, Artificial Sequence
  Synthetic
gtgccatacatcggcgcgccgcttgagtccttgcggagtcatgtggagctgatggtgggggctgccactgtttgt

SEQ ID NO: 111099 - DNA, 75 bp, Artificial Sequence
  Synthetic
gtgccatacatcggcgcgccgcttgagtccttgcggagtcatgtggagctgatggtgggggctgccactgtctgt

SEQ ID NO: 111100 - DNA, 75 bp, Artificial Sequence
  Synthetic
gtgccatacatcggcgcgccgcttgagtccttgcggagtcatgtggagctgatggtgggggctgccactgtgtgt

SEQ ID NO: 111101 - DNA, 75 bp, Artificial Sequence
  Synthetic
gcgccatacatcggcgcgccgcttgagtccttgcggagtcatgtggaactgatggtgggggctgccactgtatgt

SEQ ID NO: 111102 - DNA, 75 bp, Artificial Sequence
  Synthetic
gcgccatacatcggcgcgccgcttgagtccttgcggagtcatgtggaactgatggtgggggctgccactgtttgt

SEQ ID NO: 111103 - DNA, 75 bp, Artificial Sequence
  Synthetic
gcgccatacatcggcgcgccgcttgagtccttgcggagtcatgtggaactgatggtgggggctgccactgtctgt

SEQ ID NO: 111104 - DNA, 75 bp, Artificial Sequence
  Synthetic
gcgccatacatcggcgcgccgcttgagtccttgcggagtcatgtggaactgatggtgggggctgccactgtgtgt

SEQ ID NO: 111105 - DNA, 75 bp, Artificial Sequence
  Synthetic
gcgccatacatcggcgcgccgcttgagtccttgcggagtcatgtggatctgatggtgggggctgccactgtatgt

SEQ ID NO: 111106 - DNA, 75 bp, Artificial Sequence
  Synthetic
gcgccatacatcggcgcgccgcttgagtccttgcggagtcatgtggatctgatggtgggggctgccactgtttgt

SEQ ID NO: 111107 - DNA, 75 bp, Artificial Sequence
  Synthetic
gcgccatacatcggcgcgccgcttgagtccttgcggagtcatgtggatctgatggtgggggctgccactgtctgt

SEQ ID NO: 111108 - DNA, 75 bp, Artificial Sequence
  Synthetic
gcgccatacatcggcgcgccgcttgagtccttgcggagtcatgtggatctgatggtgggggctgccactgtgtgt

SEQ ID NO: 111109 - DNA, 75 bp, Artificial Sequence
  Synthetic
gcgccatacatcggcgcgccgcttgagtccttgcggagtcatgtggacctgatggtgggggctgccactgtatgt

SEQ ID NO: 111110 - DNA, 75 bp, Artificial Sequence
  Synthetic
gcgccatacatcggcgcgccgcttgagtccttgcggagtcatgtggacctgatggtgggggctgccactgtttgt

SEQ ID NO: 111111 - DNA, 75 bp, Artificial Sequence
  Synthetic
gcgccatacatcggcgcgccgcttgagtccttgcggagtcatgtggacctgatggtgggggctgccactgtctgt

SEQ ID NO: 111112 - DNA, 75 bp, Artificial Sequence
  Synthetic
gcgccatacatcggcgcgccgcttgagtccttgcggagtcatgtggacctgatggtgggggctgccactgtgtgt

SEQ ID NO: 111113 - DNA, 75 bp, Artificial Sequence
  Synthetic
gcgccatacatcggcgcgccgcttgagtccttgcggagtcatgtggagctgatggtgggggctgccactgtatgt

SEQ ID NO: 111114 - DNA, 75 bp, Artificial Sequence
  Synthetic
gcgccatacatcggcgcgccgcttgagtccttgcggagtcatgtggagctgatggtgggggctgccactgtttgt

SEQ ID NO: 111115 - DNA, 75 bp, Artificial Sequence
  Synthetic
gcgccatacatcggcgcgccgcttgagtccttgcggagtcatgtggagctgatggtgggggctgccactgtctgt

SEQ ID NO: 111116 - DNA, 75 bp, Artificial Sequence
  Synthetic
gcgccatacatcggcgcgccgcttgagtccttgcggagtcatgtggagctgatggtgggggctgccactgtgtgt

SEQ ID NO: 111117 - DNA, 75 bp, Artificial Sequence
  Synthetic
gggccatacatcggcgcgccgcttgagtccttgcggagtcatgtggaactgatggtgggggctgccactgtatgt

SEQ ID NO: 111118 - DNA, 75 bp, Artificial Sequence
  Synthetic
gggccatacatcggcgcgccgcttgagtccttgcggagtcatgtggaactgatggtgggggctgccactgtttgt

SEQ ID NO: 111119 - DNA, 75 bp, Artificial Sequence
  Synthetic
gggccatacatcggcgcgccgcttgagtccttgcggagtcatgtggaactgatggtgggggctgccactgtctgt

SEQ ID NO: 111120 - DNA, 75 bp, Artificial Sequence
  Synthetic
gggccatacatcggcgcgccgcttgagtccttgcggagtcatgtggaactgatggtgggggctgccactgtgtgt

SEQ ID NO: 111121 - DNA, 75 bp, Artificial Sequence
  Synthetic
gggccatacatcggcgcgccgcttgagtccttgcggagtcatgtggatctgatggtgggggctgccactgtatgt

SEQ ID NO: 111122 - DNA, 75 bp, Artificial Sequence
  Synthetic
gggccatacatcggcgcgccgcttgagtccttgcggagtcatgtggatctgatggtgggggctgccactgtttgt

SEQ ID NO: 111123 - DNA, 75 bp, Artificial Sequence
  Synthetic
gggccatacatcggcgcgccgcttgagtccttgcggagtcatgtggatctgatggtgggggctgccactgtctgt

SEQ ID NO: 111124 - DNA, 75 bp, Artificial Sequence
  Synthetic
gggccatacatcggcgcgccgcttgagtccttgcggagtcatgtggatctgatggtgggggctgccactgtgtgt

SEQ ID NO: 111125 - DNA, 75 bp, Artificial Sequence
  Synthetic
gggccatacatcggcgcgccgcttgagtccttgcggagtcatgtggacctgatggtgggggctgccactgtatgt

SEQ ID NO: 111126 - DNA, 75 bp, Artificial Sequence
  Synthetic
gggccatacatcggcgcgccgcttgagtccttgcggagtcatgtggacctgatggtgggggctgccactgtttgt

SEQ ID NO: 111127 - DNA, 75 bp, Artificial Sequence
  Synthetic
gggccatacatcggcgcgccgcttgagtccttgcggagtcatgtggacctgatggtgggggctgccactgtctgt

SEQ ID NO: 111128 - DNA, 75 bp, Artificial Sequence
  Synthetic
gggccatacatcggcgcgccgcttgagtccttgcggagtcatgtggacctgatggtgggggctgccactgtgtgt

SEQ ID NO: 111129 - DNA, 75 bp, Artificial Sequence
  Synthetic
gggccatacatcggcgcgccgcttgagtccttgcggagtcatgtggagctgatggtgggggctgccactgtatgt

SEQ ID NO: 111130 - DNA, 75 bp, Artificial Sequence
  Synthetic
gggccatacatcggcgcgccgcttgagtccttgcggagtcatgtggagctgatggtgggggctgccactgtttgt

SEQ ID NO: 111131 - DNA, 75 bp, Artificial Sequence
  Synthetic
gggccatacatcggcgcgccgcttgagtccttgcggagtcatgtggagctgatggtgggggctgccactgtctgt

SEQ ID NO: 111132 - DNA, 75 bp, Artificial Sequence
  Synthetic
gggccatacatcggcgcgccgcttgagtccttgcggagtcatgtggagctgatggtgggggctgccactgtgtgt

SEQ ID NO: 111133 - DNA, 75 bp, Artificial Sequence
  Synthetic
tgcctgggaaacagttaaacactcccctgtcaattcatggctgggaaacatcatccaatacgccccaactatatg

SEQ ID NO: 111134 - DNA, 75 bp, Artificial Sequence
  Synthetic
ccccatcacgtactccacctacggcaagttccttgccgacggcgggtgctcagggggtgcttatgacataataat

SEQ ID NO: 111135 - DNA, 75 bp, Artificial Sequence
  Synthetic
tcttctgtcattcaagaaagaagtgtgatgaactggcatccaaattagccgcacaagggattcacgctgtgtcat

SEQ ID NO: 111136 - DNA, 75 bp, Artificial Sequence
  Synthetic
cagacacctgatcttttgccattcaaagaagaagtgcgatgagctcgcagcagcccttcggggcatgggtgtcaa

SEQ ID NO: 111137 - DNA, 75 bp, Artificial Sequence
  Synthetic
cgtctagaagcgcttctcagcgtcagaagaaggttaccttcgacagactgcaggtgctcgacgaccattacaaaa

SEQ ID NO: 111138 - DNA, 75 bp, Artificial Sequence
  Synthetic
ggtaatcgactgtaatgttgcagtcgagcaatatgttgacttcagcctagatccaactttcacaatcgagacgcg

SEQ ID NO: 111139 - DNA, 75 bp, Artificial Sequence
  Synthetic
tgccctaatgactggatacactggtgactttgactctgtcattgactgcaacgttgcagtcacccagattgttga

SEQ ID NO: 111140 - DNA, 75 bp, Artificial Sequence
  Synthetic
tcagggatgtttgactccgtagtgctctgcgagtgctacgacgtaggctgcgcctggtatgagctgactcccgct

SEQ ID NO: 111141 - DNA, 75 bp, Artificial Sequence
  Synthetic
cttgaactcgaccagaccgccacgtggagcgtggttcgggtgcgtatggatgaacagcaccgggtatacaaaaac

SEQ ID NO: 111142 - DNA, 75 bp, Artificial Sequence
  Synthetic
cttgaactcgaccagaccgccacgtggagcgtggttcgggtgcgtatggatgaacagcaccgggtttacaaaaac

SEQ ID NO: 111143 - DNA, 75 bp, Artificial Sequence
  Synthetic
cttgaactcgaccagaccgccacgtggagcgtggttcgggtgcgtatggatgaacagcaccgggtctacaaaaac

SEQ ID NO: 111144 - DNA, 75 bp, Artificial Sequence
  Synthetic
cttgaactcgaccagaccgccacgtggagcgtggttcgggtgcgtatggatgaacagcaccgggtgtacaaaaac

SEQ ID NO: 111145 - DNA, 75 bp, Artificial Sequence
  Synthetic
cttgaactcgaccagaccgccacgtggagcgtggttcgggtgcgtttggatgaacagcaccgggtatacaaaaac

SEQ ID NO: 111146 - DNA, 75 bp, Artificial Sequence
  Synthetic
cttgaactcgaccagaccgccacgtggagcgtggttcgggtgcgtttggatgaacagcaccgggtttacaaaaac

SEQ ID NO: 111147 - DNA, 75 bp, Artificial Sequence
  Synthetic
cttgaactcgaccagaccgccacgtggagcgtggttcgggtgcgtttggatgaacagcaccgggtctacaaaaac

SEQ ID NO: 111148 - DNA, 75 bp, Artificial Sequence
  Synthetic
cttgaactcgaccagaccgccacgtggagcgtggttcgggtgcgtttggatgaacagcaccgggtgtacaaaaac

SEQ ID NO: 111149 - DNA, 75 bp, Artificial Sequence
  Synthetic
cttgaactcgaccagaccgccacgtggagcgtggttcgggtgcgtctggatgaacagcaccgggtatacaaaaac

SEQ ID NO: 111150 - DNA, 75 bp, Artificial Sequence
  Synthetic
cttgaactcgaccagaccgccacgtggagcgtggttcgggtgcgtctggatgaacagcaccgggtttacaaaaac

SEQ ID NO: 111151 - DNA, 75 bp, Artificial Sequence
  Synthetic
cttgaactcgaccagaccgccacgtggagcgtggttcgggtgcgtctggatgaacagcaccgggtctacaaaaac

SEQ ID NO: 111152 - DNA, 75 bp, Artificial Sequence
  Synthetic
cttgaactcgaccagaccgccacgtggagcgtggttcgggtgcgtctggatgaacagcaccgggtgtacaaaaac

SEQ ID NO: 111153 - DNA, 75 bp, Artificial Sequence
  Synthetic
cttgaactcgaccagaccgccacgtggagcgtggttcgggtgcgtgtggatgaacagcaccgggtatacaaaaac

SEQ ID NO: 111154 - DNA, 75 bp, Artificial Sequence
  Synthetic
cttgaactcgaccagaccgccacgtggagcgtggttcgggtgcgtgtggatgaacagcaccgggtttacaaaaac

SEQ ID NO: 111155 - DNA, 75 bp, Artificial Sequence
  Synthetic
cttgaactcgaccagaccgccacgtggagcgtggttcgggtgcgtgtggatgaacagcaccgggtctacaaaaac

SEQ ID NO: 111156 - DNA, 75 bp, Artificial Sequence
  Synthetic
cttgaactcgaccagaccgccacgtggagcgtggttcgggtgcgtgtggatgaacagcaccgggtgtacaaaaac

SEQ ID NO: 111157 - DNA, 75 bp, Artificial Sequence
  Synthetic
cttgaactcgaccagaccgccacgtggtgcgtggttcgggtgcgtatggatgaacagcaccgggtatacaaaaac

SEQ ID NO: 111158 - DNA, 75 bp, Artificial Sequence
  Synthetic
cttgaactcgaccagaccgccacgtggtgcgtggttcgggtgcgtatggatgaacagcaccgggtttacaaaaac

SEQ ID NO: 111159 - DNA, 75 bp, Artificial Sequence
  Synthetic
cttgaactcgaccagaccgccacgtggtgcgtggttcgggtgcgtatggatgaacagcaccgggtctacaaaaac

SEQ ID NO: 111160 - DNA, 75 bp, Artificial Sequence
  Synthetic
cttgaactcgaccagaccgccacgtggtgcgtggttcgggtgcgtatggatgaacagcaccgggtgtacaaaaac

SEQ ID NO: 111161 - DNA, 75 bp, Artificial Sequence
  Synthetic
cttgaactcgaccagaccgccacgtggtgcgtggttcgggtgcgtttggatgaacagcaccgggtatacaaaaac

SEQ ID NO: 111162 - DNA, 75 bp, Artificial Sequence
  Synthetic
cttgaactcgaccagaccgccacgtggtgcgtggttcgggtgcgtttggatgaacagcaccgggtttacaaaaac

SEQ ID NO: 111163 - DNA, 75 bp, Artificial Sequence
  Synthetic
cttgaactcgaccagaccgccacgtggtgcgtggttcgggtgcgtttggatgaacagcaccgggtctacaaaaac

SEQ ID NO: 111164 - DNA, 75 bp, Artificial Sequence
  Synthetic
cttgaactcgaccagaccgccacgtggtgcgtggttcgggtgcgtttggatgaacagcaccgggtgtacaaaaac

SEQ ID NO: 111165 - DNA, 75 bp, Artificial Sequence
  Synthetic
cttgaactcgaccagaccgccacgtggtgcgtggttcgggtgcgtctggatgaacagcaccgggtatacaaaaac

SEQ ID NO: 111166 - DNA, 75 bp, Artificial Sequence
  Synthetic
cttgaactcgaccagaccgccacgtggtgcgtggttcgggtgcgtctggatgaacagcaccgggtttacaaaaac

SEQ ID NO: 111167 - DNA, 75 bp, Artificial Sequence
  Synthetic
cttgaactcgaccagaccgccacgtggtgcgtggttcgggtgcgtctggatgaacagcaccgggtctacaaaaac

SEQ ID NO: 111168 - DNA, 75 bp, Artificial Sequence
  Synthetic
cttgaactcgaccagaccgccacgtggtgcgtggttcgggtgcgtctggatgaacagcaccgggtgtacaaaaac

SEQ ID NO: 111169 - DNA, 75 bp, Artificial Sequence
  Synthetic
cttgaactcgaccagaccgccacgtggtgcgtggttcgggtgcgtgtggatgaacagcaccgggtatacaaaaac

SEQ ID NO: 111170 - DNA, 75 bp, Artificial Sequence
  Synthetic
cttgaactcgaccagaccgccacgtggtgcgtggttcgggtgcgtgtggatgaacagcaccgggtttacaaaaac

SEQ ID NO: 111171 - DNA, 75 bp, Artificial Sequence
  Synthetic
cttgaactcgaccagaccgccacgtggtgcgtggttcgggtgcgtgtggatgaacagcaccgggtctacaaaaac

SEQ ID NO: 111172 - DNA, 75 bp, Artificial Sequence
  Synthetic
cttgaactcgaccagaccgccacgtggtgcgtggttcgggtgcgtgtggatgaacagcaccgggtgtacaaaaac

SEQ ID NO: 111173 - DNA, 75 bp, Artificial Sequence
  Synthetic
cttgaactcgaccagaccgccacgtggcgcgtggttcgggtgcgtatggatgaacagcaccgggtatacaaaaac

SEQ ID NO: 111174 - DNA, 75 bp, Artificial Sequence
  Synthetic
cttgaactcgaccagaccgccacgtggcgcgtggttcgggtgcgtatggatgaacagcaccgggtttacaaaaac

SEQ ID NO: 111175 - DNA, 75 bp, Artificial Sequence
  Synthetic
cttgaactcgaccagaccgccacgtggcgcgtggttcgggtgcgtatggatgaacagcaccgggtctacaaaaac

SEQ ID NO: 111176 - DNA, 75 bp, Artificial Sequence
  Synthetic
cttgaactcgaccagaccgccacgtggcgcgtggttcgggtgcgtatggatgaacagcaccgggtgtacaaaaac

SEQ ID NO: 111177 - DNA, 75 bp, Artificial Sequence
  Synthetic
cttgaactcgaccagaccgccacgtggcgcgtggttcgggtgcgtttggatgaacagcaccgggtatacaaaaac

SEQ ID NO: 111178 - DNA, 75 bp, Artificial Sequence
  Synthetic
cttgaactcgaccagaccgccacgtggcgcgtggttcgggtgcgtttggatgaacagcaccgggtttacaaaaac

SEQ ID NO: 111179 - DNA, 75 bp, Artificial Sequence
  Synthetic
cttgaactcgaccagaccgccacgtggcgcgtggttcgggtgcgtttggatgaacagcaccgggtctacaaaaac

SEQ ID NO: 111180 - DNA, 75 bp, Artificial Sequence
  Synthetic
cttgaactcgaccagaccgccacgtggcgcgtggttcgggtgcgtttggatgaacagcaccgggtgtacaaaaac

SEQ ID NO: 111181 - DNA, 75 bp, Artificial Sequence
  Synthetic
cttgaactcgaccagaccgccacgtggcgcgtggttcgggtgcgtctggatgaacagcaccgggtatacaaaaac

SEQ ID NO: 111182 - DNA, 75 bp, Artificial Sequence
  Synthetic
cttgaactcgaccagaccgccacgtggcgcgtggttcgggtgcgtctggatgaacagcaccgggtttacaaaaac

SEQ ID NO: 111183 - DNA, 75 bp, Artificial Sequence
  Synthetic
cttgaactcgaccagaccgccacgtggcgcgtggttcgggtgcgtctggatgaacagcaccgggtctacaaaaac

SEQ ID NO: 111184 - DNA, 75 bp, Artificial Sequence
  Synthetic
cttgaactcgaccagaccgccacgtggcgcgtggttcgggtgcgtctggatgaacagcaccgggtgtacaaaaac

SEQ ID NO: 111185 - DNA, 75 bp, Artificial Sequence
  Synthetic
cttgaactcgaccagaccgccacgtggcgcgtggttcgggtgcgtgtggatgaacagcaccgggtatacaaaaac

SEQ ID NO: 111186 - DNA, 75 bp, Artificial Sequence
  Synthetic
cttgaactcgaccagaccgccacgtggcgcgtggttcgggtgcgtgtggatgaacagcaccgggtttacaaaaac

SEQ ID NO: 111187 - DNA, 75 bp, Artificial Sequence
  Synthetic
cttgaactcgaccagaccgccacgtggcgcgtggttcgggtgcgtgtggatgaacagcaccgggtctacaaaaac

SEQ ID NO: 111188 - DNA, 75 bp, Artificial Sequence
  Synthetic
cttgaactcgaccagaccgccacgtggcgcgtggttcgggtgcgtgtggatgaacagcaccgggtgtacaaaaac

SEQ ID NO: 111189 - DNA, 75 bp, Artificial Sequence
  Synthetic
cttgaactcgaccagaccgccacgtggggcgtggttcgggtgcgtatggatgaacagcaccgggtatacaaaaac

SEQ ID NO: 111190 - DNA, 75 bp, Artificial Sequence
  Synthetic
cttgaactcgaccagaccgccacgtggggcgtggttcgggtgcgtatggatgaacagcaccgggtttacaaaaac

SEQ ID NO: 111191 - DNA, 75 bp, Artificial Sequence
  Synthetic
cttgaactcgaccagaccgccacgtggggcgtggttcgggtgcgtatggatgaacagcaccgggtctacaaaaac

SEQ ID NO: 111192 - DNA, 75 bp, Artificial Sequence
  Synthetic
cttgaactcgaccagaccgccacgtggggcgtggttcgggtgcgtatggatgaacagcaccgggtgtacaaaaac

SEQ ID NO: 111193 - DNA, 75 bp, Artificial Sequence
  Synthetic
cttgaactcgaccagaccgccacgtggggcgtggttcgggtgcgtttggatgaacagcaccgggtatacaaaaac

SEQ ID NO: 111194 - DNA, 75 bp, Artificial Sequence
  Synthetic
cttgaactcgaccagaccgccacgtggggcgtggttcgggtgcgtttggatgaacagcaccgggtttacaaaaac

SEQ ID NO: 111195 - DNA, 75 bp, Artificial Sequence
  Synthetic
cttgaactcgaccagaccgccacgtggggcgtggttcgggtgcgtttggatgaacagcaccgggtctacaaaaac

SEQ ID NO: 111196 - DNA, 75 bp, Artificial Sequence
  Synthetic
cttgaactcgaccagaccgccacgtggggcgtggttcgggtgcgtttggatgaacagcaccgggtgtacaaaaac

SEQ ID NO: 111197 - DNA, 75 bp, Artificial Sequence
  Synthetic
cttgaactcgaccagaccgccacgtggggcgtggttcgggtgcgtctggatgaacagcaccgggtatacaaaaac

SEQ ID NO: 111198 - DNA, 75 bp, Artificial Sequence
  Synthetic
cttgaactcgaccagaccgccacgtggggcgtggttcgggtgcgtctggatgaacagcaccgggtttacaaaaac

SEQ ID NO: 111199 - DNA, 75 bp, Artificial Sequence
  Synthetic
cttgaactcgaccagaccgccacgtggggcgtggttcgggtgcgtctggatgaacagcaccgggtctacaaaaac

SEQ ID NO: 111200 - DNA, 75 bp, Artificial Sequence
  Synthetic
cttgaactcgaccagaccgccacgtggggcgtggttcgggtgcgtctggatgaacagcaccgggtgtacaaaaac

SEQ ID NO: 111201 - DNA, 75 bp, Artificial Sequence
  Synthetic
cttgaactcgaccagaccgccacgtggggcgtggttcgggtgcgtgtggatgaacagcaccgggtatacaaaaac

SEQ ID NO: 111202 - DNA, 75 bp, Artificial Sequence
  Synthetic
cttgaactcgaccagaccgccacgtggggcgtggttcgggtgcgtgtggatgaacagcaccgggtttacaaaaac

SEQ ID NO: 111203 - DNA, 75 bp, Artificial Sequence
  Synthetic
cttgaactcgaccagaccgccacgtggggcgtggttcgggtgcgtgtggatgaacagcaccgggtctacaaaaac

SEQ ID NO: 111204 - DNA, 75 bp, Artificial Sequence
  Synthetic
cttgaactcgaccagaccgccacgtggggcgtggttcgggtgcgtgtggatgaacagcaccgggtgtacaaaaac

SEQ ID NO: 111205 - DNA, 75 bp, Artificial Sequence
  Synthetic
acattgatgcgcacttcctatcccagaccaaacagcaaggtgtaaatttcccatatctggtggcctaccaggcta

SEQ ID NO: 111206 - DNA, 75 bp, Artificial Sequence
  Synthetic
tcagggccttggatcacaccacgatgcttggttcactaaccgtaccgactgtggcattacccatgcaccgtcaat

SEQ ID NO: 111207 - DNA, 75 bp, Artificial Sequence
  Synthetic
tcagggccttggatcacaccacgatgcttggttcactaaccgtaccgtctgtggcattacccatgcaccgtcaat

SEQ ID NO: 111208 - DNA, 75 bp, Artificial Sequence
  Synthetic
tcagggccttggatcacaccacgatgcttggttcactaaccgtaccgcctgtggcattacccatgcaccgtcaat

SEQ ID NO: 111209 - DNA, 75 bp, Artificial Sequence
  Synthetic
tcagggccttggatcacaccacgatgcttggttcactaaccgtaccggctgtggcattacccatgcaccgtcaat

SEQ ID NO: 111210 - DNA, 75 bp, Artificial Sequence
  Synthetic
tcagggccttggatcacaccacgatgcttggttcactatccgtaccgactgtggcattacccatgcaccgtcaat

SEQ ID NO: 111211 - DNA, 75 bp, Artificial Sequence
  Synthetic
tcagggccttggatcacaccacgatgcttggttcactatccgtaccgtctgtggcattacccatgcaccgtcaat

SEQ ID NO: 111212 - DNA, 75 bp, Artificial Sequence
  Synthetic
tcagggccttggatcacaccacgatgcttggttcactatccgtaccgcctgtggcattacccatgcaccgtcaat

SEQ ID NO: 111213 - DNA, 75 bp, Artificial Sequence
  Synthetic
tcagggccttggatcacaccacgatgcttggttcactatccgtaccggctgtggcattacccatgcaccgtcaat

SEQ ID NO: 111214 - DNA, 75 bp, Artificial Sequence
  Synthetic
tcagggccttggatcacaccacgatgcttggttcactacccgtaccgactgtggcattacccatgcaccgtcaat

SEQ ID NO: 111215 - DNA, 75 bp, Artificial Sequence
  Synthetic
tcagggccttggatcacaccacgatgcttggttcactacccgtaccgtctgtggcattacccatgcaccgtcaat

SEQ ID NO: 111216 - DNA, 75 bp, Artificial Sequence
  Synthetic
tcagggccttggatcacaccacgatgcttggttcactacccgtaccgcctgtggcattacccatgcaccgtcaat

SEQ ID NO: 111217 - DNA, 75 bp, Artificial Sequence
  Synthetic
tcagggccttggatcacaccacgatgcttggttcactacccgtaccggctgtggcattacccatgcaccgtcaat

SEQ ID NO: 111218 - DNA, 75 bp, Artificial Sequence
  Synthetic
tcagggccttggatcacaccacgatgcttggttcactagccgtaccgactgtggcattacccatgcaccgtcaat

SEQ ID NO: 111219 - DNA, 75 bp, Artificial Sequence
  Synthetic
tcagggccttggatcacaccacgatgcttggttcactagccgtaccgtctgtggcattacccatgcaccgtcaat

SEQ ID NO: 111220 - DNA, 75 bp, Artificial Sequence
  Synthetic
tcagggccttggatcacaccacgatgcttggttcactagccgtaccgcctgtggcattacccatgcaccgtcaat

SEQ ID NO: 111221 - DNA, 75 bp, Artificial Sequence
  Synthetic
tcagggccttggatcacaccacgatgcttggttcactagccgtaccggctgtggcattacccatgcaccgtcaat

SEQ ID NO: 111222 - DNA, 75 bp, Artificial Sequence
  Synthetic
gacagggatagatcagagcttagcccgctactgctgtctacaacagagtggcagatactgccctgttccttcacc

SEQ ID NO: 111223 - DNA, 75 bp, Artificial Sequence
  Synthetic
atataggattggggccgtccaaaatgagataactttgacacaccccatcactaaatacatcatgacctgcatgtc

SEQ ID NO: 111224 - DNA, 75 bp, Artificial Sequence
  Synthetic
gtggagggcgaggtccagattgtgtcaactgctgcccagactttcctggcaacatgtatcaatggggtatgctgg

SEQ ID NO: 111225 - DNA, 75 bp, Artificial Sequence
  Synthetic
gagatcgggcagaactatcacccctgctccttaccacaacaacgtggcaagttctcccctgctctttaaccactc

SEQ ID NO: 111226 - DNA, 75 bp, Artificial Sequence
  Synthetic
gagatcgggcagaactatcacccctgctccttaccacaacaacgtggcaagttctcccctgctcttttaccactc

SEQ ID NO: 111227 - DNA, 75 bp, Artificial Sequence
  Synthetic
gagatcgggcagaactatcacccctgctccttaccacaacaacgtggcaagttctcccctgctctttcaccactc

SEQ ID NO: 111228 - DNA, 75 bp, Artificial Sequence
  Synthetic
gagatcgggcagaactatcacccctgctccttaccacaacaacgtggcaagttctcccctgctctttgaccactc

SEQ ID NO: 111229 - DNA, 75 bp, Artificial Sequence
  Synthetic
gagatcgggcagaactatcacccctgctccttaccactacaacgtggcaagttctcccctgctctttaaccactc

SEQ ID NO: 111230 - DNA, 75 bp, Artificial Sequence
  Synthetic
gagatcgggcagaactatcacccctgctccttaccactacaacgtggcaagttctcccctgctcttttaccactc

SEQ ID NO: 111231 - DNA, 75 bp, Artificial Sequence
  Synthetic
gagatcgggcagaactatcacccctgctccttaccactacaacgtggcaagttctcccctgctctttcaccactc

SEQ ID NO: 111232 - DNA, 75 bp, Artificial Sequence
  Synthetic
gagatcgggcagaactatcacccctgctccttaccactacaacgtggcaagttctcccctgctctttgaccactc

SEQ ID NO: 111233 - DNA, 75 bp, Artificial Sequence
  Synthetic
gagatcgggcagaactatcacccctgctccttaccaccacaacgtggcaagttctcccctgctctttaaccactc

SEQ ID NO: 111234 - DNA, 75 bp, Artificial Sequence
  Synthetic
gagatcgggcagaactatcacccctgctccttaccaccacaacgtggcaagttctcccctgctcttttaccactc

SEQ ID NO: 111235 - DNA, 75 bp, Artificial Sequence
  Synthetic
gagatcgggcagaactatcacccctgctccttaccaccacaacgtggcaagttctcccctgctctttcaccactc

SEQ ID NO: 111236 - DNA, 75 bp, Artificial Sequence
  Synthetic
gagatcgggcagaactatcacccctgctccttaccaccacaacgtggcaagttctcccctgctctttgaccactc

SEQ ID NO: 111237 - DNA, 75 bp, Artificial Sequence
  Synthetic
gagatcgggcagaactatcacccctgctccttaccacgacaacgtggcaagttctcccctgctctttaaccactc

SEQ ID NO: 111238 - DNA, 75 bp, Artificial Sequence
  Synthetic
gagatcgggcagaactatcacccctgctccttaccacgacaacgtggcaagttctcccctgctcttttaccactc

SEQ ID NO: 111239 - DNA, 75 bp, Artificial Sequence
  Synthetic
gagatcgggcagaactatcacccctgctccttaccacgacaacgtggcaagttctcccctgctctttcaccactc

SEQ ID NO: 111240 - DNA, 75 bp, Artificial Sequence
  Synthetic
gagatcgggcagaactatcacccctgctccttaccacgacaacgtggcaagttctcccctgctctttgaccactc

SEQ ID NO: 111241 - DNA, 75 bp, Artificial Sequence
  Synthetic
gagatcgggcagaactatctcccctgctccttaccacaacaacgtggcaagttctcccctgctctttaaccactc

SEQ ID NO: 111242 - DNA, 75 bp, Artificial Sequence
  Synthetic
gagatcgggcagaactatctcccctgctccttaccacaacaacgtggcaagttctcccctgctcttttaccactc

SEQ ID NO: 111243 - DNA, 75 bp, Artificial Sequence
  Synthetic
gagatcgggcagaactatctcccctgctccttaccacaacaacgtggcaagttctcccctgctctttcaccactc

SEQ ID NO: 111244 - DNA, 75 bp, Artificial Sequence
  Synthetic
gagatcgggcagaactatctcccctgctccttaccacaacaacgtggcaagttctcccctgctctttgaccactc

SEQ ID NO: 111245 - DNA, 75 bp, Artificial Sequence
  Synthetic
gagatcgggcagaactatctcccctgctccttaccactacaacgtggcaagttctcccctgctctttaaccactc

SEQ ID NO: 111246 - DNA, 75 bp, Artificial Sequence
  Synthetic
gagatcgggcagaactatctcccctgctccttaccactacaacgtggcaagttctcccctgctcttttaccactc

SEQ ID NO: 111247 - DNA, 75 bp, Artificial Sequence
  Synthetic
gagatcgggcagaactatctcccctgctccttaccactacaacgtggcaagttctcccctgctctttcaccactc

SEQ ID NO: 111248 - DNA, 75 bp, Artificial Sequence
  Synthetic
gagatcgggcagaactatctcccctgctccttaccactacaacgtggcaagttctcccctgctctttgaccactc

SEQ ID NO: 111249 - DNA, 75 bp, Artificial Sequence
  Synthetic
gagatcgggcagaactatctcccctgctccttaccaccacaacgtggcaagttctcccctgctctttaaccactc

SEQ ID NO: 111250 - DNA, 75 bp, Artificial Sequence
  Synthetic
gagatcgggcagaactatctcccctgctccttaccaccacaacgtggcaagttctcccctgctcttttaccactc

SEQ ID NO: 111251 - DNA, 75 bp, Artificial Sequence
  Synthetic
gagatcgggcagaactatctcccctgctccttaccaccacaacgtggcaagttctcccctgctctttcaccactc

SEQ ID NO: 111252 - DNA, 75 bp, Artificial Sequence
  Synthetic
gagatcgggcagaactatctcccctgctccttaccaccacaacgtggcaagttctcccctgctctttgaccactc

SEQ ID NO: 111253 - DNA, 75 bp, Artificial Sequence
  Synthetic
gagatcgggcagaactatctcccctgctccttaccacgacaacgtggcaagttctcccctgctctttaaccactc

SEQ ID NO: 111254 - DNA, 75 bp, Artificial Sequence
  Synthetic
gagatcgggcagaactatctcccctgctccttaccacgacaacgtggcaagttctcccctgctcttttaccactc

SEQ ID NO: 111255 - DNA, 75 bp, Artificial Sequence
  Synthetic
gagatcgggcagaactatctcccctgctccttaccacgacaacgtggcaagttctcccctgctctttcaccactc

SEQ ID NO: 111256 - DNA, 75 bp, Artificial Sequence
  Synthetic
gagatcgggcagaactatctcccctgctccttaccacgacaacgtggcaagttctcccctgctctttgaccactc

SEQ ID NO: 111257 - DNA, 75 bp, Artificial Sequence
  Synthetic
gagatcgggcagaactatcccccctgctccttaccacaacaacgtggcaagttctcccctgctctttaaccactc

SEQ ID NO: 111258 - DNA, 75 bp, Artificial Sequence
  Synthetic
gagatcgggcagaactatcccccctgctccttaccacaacaacgtggcaagttctcccctgctcttttaccactc

SEQ ID NO: 111259 - DNA, 75 bp, Artificial Sequence
  Synthetic
gagatcgggcagaactatcccccctgctccttaccacaacaacgtggcaagttctcccctgctctttcaccactc

SEQ ID NO: 111260 - DNA, 75 bp, Artificial Sequence
  Synthetic
gagatcgggcagaactatcccccctgctccttaccacaacaacgtggcaagttctcccctgctctttgaccactc

SEQ ID NO: 111261 - DNA, 75 bp, Artificial Sequence
  Synthetic
gagatcgggcagaactatcccccctgctccttaccactacaacgtggcaagttctcccctgctctttaaccactc

SEQ ID NO: 111262 - DNA, 75 bp, Artificial Sequence
  Synthetic
gagatcgggcagaactatcccccctgctccttaccactacaacgtggcaagttctcccctgctcttttaccactc

SEQ ID NO: 111263 - DNA, 75 bp, Artificial Sequence
  Synthetic
gagatcgggcagaactatcccccctgctccttaccactacaacgtggcaagttctcccctgctctttcaccactc

SEQ ID NO: 111264 - DNA, 75 bp, Artificial Sequence
  Synthetic
gagatcgggcagaactatcccccctgctccttaccactacaacgtggcaagttctcccctgctctttgaccactc

SEQ ID NO: 111265 - DNA, 75 bp, Artificial Sequence
  Synthetic
gagatcgggcagaactatcccccctgctccttaccaccacaacgtggcaagttctcccctgctctttaaccactc

SEQ ID NO: 111266 - DNA, 75 bp, Artificial Sequence
  Synthetic
gagatcgggcagaactatcccccctgctccttaccaccacaacgtggcaagttctcccctgctcttttaccactc

SEQ ID NO: 111267 - DNA, 75 bp, Artificial Sequence
  Synthetic
gagatcgggcagaactatcccccctgctccttaccaccacaacgtggcaagttctcccctgctctttcaccactc

SEQ ID NO: 111268 - DNA, 75 bp, Artificial Sequence
  Synthetic
gagatcgggcagaactatcccccctgctccttaccaccacaacgtggcaagttctcccctgctctttgaccactc

SEQ ID NO: 111269 - DNA, 75 bp, Artificial Sequence
  Synthetic
gagatcgggcagaactatcccccctgctccttaccacgacaacgtggcaagttctcccctgctctttaaccactc

SEQ ID NO: 111270 - DNA, 75 bp, Artificial Sequence
  Synthetic
gagatcgggcagaactatcccccctgctccttaccacgacaacgtggcaagttctcccctgctcttttaccactc

SEQ ID NO: 111271 - DNA, 75 bp, Artificial Sequence
  Synthetic
gagatcgggcagaactatcccccctgctccttaccacgacaacgtggcaagttctcccctgctctttcaccactc

SEQ ID NO: 111272 - DNA, 75 bp, Artificial Sequence
  Synthetic
gagatcgggcagaactatcccccctgctccttaccacgacaacgtggcaagttctcccctgctctttgaccactc

SEQ ID NO: 111273 - DNA, 75 bp, Artificial Sequence
  Synthetic
gagatcgggcagaactatcgcccctgctccttaccacaacaacgtggcaagttctcccctgctctttaaccactc

SEQ ID NO: 111274 - DNA, 75 bp, Artificial Sequence
  Synthetic
gagatcgggcagaactatcgcccctgctccttaccacaacaacgtggcaagttctcccctgctcttttaccactc

SEQ ID NO: 111275 - DNA, 75 bp, Artificial Sequence
  Synthetic
gagatcgggcagaactatcgcccctgctccttaccacaacaacgtggcaagttctcccctgctctttcaccactc

SEQ ID NO: 111276 - DNA, 75 bp, Artificial Sequence
  Synthetic
gagatcgggcagaactatcgcccctgctccttaccacaacaacgtggcaagttctcccctgctctttgaccactc

SEQ ID NO: 111277 - DNA, 75 bp, Artificial Sequence
  Synthetic
gagatcgggcagaactatcgcccctgctccttaccactacaacgtggcaagttctcccctgctctttaaccactc

SEQ ID NO: 111278 - DNA, 75 bp, Artificial Sequence
  Synthetic
gagatcgggcagaactatcgcccctgctccttaccactacaacgtggcaagttctcccctgctcttttaccactc

SEQ ID NO: 111279 - DNA, 75 bp, Artificial Sequence
  Synthetic
gagatcgggcagaactatcgcccctgctccttaccactacaacgtggcaagttctcccctgctctttcaccactc

SEQ ID NO: 111280 - DNA, 75 bp, Artificial Sequence
  Synthetic
gagatcgggcagaactatcgcccctgctccttaccactacaacgtggcaagttctcccctgctctttgaccactc

SEQ ID NO: 111281 - DNA, 75 bp, Artificial Sequence
  Synthetic
gagatcgggcagaactatcgcccctgctccttaccaccacaacgtggcaagttctcccctgctctttaaccactc

SEQ ID NO: 111282 - DNA, 75 bp, Artificial Sequence
  Synthetic
gagatcgggcagaactatcgcccctgctccttaccaccacaacgtggcaagttctcccctgctcttttaccactc

SEQ ID NO: 111283 - DNA, 75 bp, Artificial Sequence
  Synthetic
gagatcgggcagaactatcgcccctgctccttaccaccacaacgtggcaagttctcccctgctctttcaccactc

SEQ ID NO: 111284 - DNA, 75 bp, Artificial Sequence
  Synthetic
gagatcgggcagaactatcgcccctgctccttaccaccacaacgtggcaagttctcccctgctctttgaccactc

SEQ ID NO: 111285 - DNA, 75 bp, Artificial Sequence
  Synthetic
gagatcgggcagaactatcgcccctgctccttaccacgacaacgtggcaagttctcccctgctctttaaccactc

SEQ ID NO: 111286 - DNA, 75 bp, Artificial Sequence
  Synthetic
gagatcgggcagaactatcgcccctgctccttaccacgacaacgtggcaagttctcccctgctcttttaccactc

SEQ ID NO: 111287 - DNA, 75 bp, Artificial Sequence
  Synthetic
gagatcgggcagaactatcgcccctgctccttaccacgacaacgtggcaagttctcccctgctctttcaccactc

SEQ ID NO: 111288 - DNA, 75 bp, Artificial Sequence
  Synthetic
gagatcgggcagaactatcgcccctgctccttaccacgacaacgtggcaagttctcccctgctctttgaccactc

SEQ ID NO: 111289 - DNA, 75 bp, Artificial Sequence
  Synthetic
tacctgccctttctactggcttaatccacctccaccaaaatatcgtggacgtccagtacctatacggtattggat

SEQ ID NO: 111290 - DNA, 75 bp, Artificial Sequence
  Synthetic
tacctgccctttctactggcttaatccacctccaccaaaatatcgtggacgtccagtacctatacggttttggat

SEQ ID NO: 111291 - DNA, 75 bp, Artificial Sequence
  Synthetic
tacctgccctttctactggcttaatccacctccaccaaaatatcgtggacgtccagtacctatacggtcttggat

SEQ ID NO: 111292 - DNA, 75 bp, Artificial Sequence
  Synthetic
tacctgccctttctactggcttaatccacctccaccaaaatatcgtggacgtccagtacctatacggtgttggat

SEQ ID NO: 111293 - DNA, 75 bp, Artificial Sequence
  Synthetic
tacctgccctttctactggcttaatccacctccaccataatatcgtggacgtccagtacctatacggtattggat

SEQ ID NO: 111294 - DNA, 75 bp, Artificial Sequence
  Synthetic
tacctgccctttctactggcttaatccacctccaccataatatcgtggacgtccagtacctatacggttttggat

SEQ ID NO: 111295 - DNA, 75 bp, Artificial Sequence
  Synthetic
tacctgccctttctactggcttaatccacctccaccataatatcgtggacgtccagtacctatacggtcttggat

SEQ ID NO: 111296 - DNA, 75 bp, Artificial Sequence
  Synthetic
tacctgccctttctactggcttaatccacctccaccataatatcgtggacgtccagtacctatacggtgttggat

SEQ ID NO: 111297 - DNA, 75 bp, Artificial Sequence
  Synthetic
tacctgccctttctactggcttaatccacctccaccacaatatcgtggacgtccagtacctatacggtattggat

SEQ ID NO: 111298 - DNA, 75 bp, Artificial Sequence
  Synthetic
tacctgccctttctactggcttaatccacctccaccacaatatcgtggacgtccagtacctatacggttttggat

SEQ ID NO: 111299 - DNA, 75 bp, Artificial Sequence
  Synthetic
tacctgccctttctactggcttaatccacctccaccacaatatcgtggacgtccagtacctatacggtcttggat

SEQ ID NO: 111300 - DNA, 75 bp, Artificial Sequence
  Synthetic
tacctgccctttctactggcttaatccacctccaccacaatatcgtggacgtccagtacctatacggtgttggat

SEQ ID NO: 111301 - DNA, 75 bp, Artificial Sequence
  Synthetic
tacctgccctttctactggcttaatccacctccaccagaatatcgtggacgtccagtacctatacggtattggat

SEQ ID NO: 111302 - DNA, 75 bp, Artificial Sequence
  Synthetic
tacctgccctttctactggcttaatccacctccaccagaatatcgtggacgtccagtacctatacggttttggat

SEQ ID NO: 111303 - DNA, 75 bp, Artificial Sequence
  Synthetic
tacctgccctttctactggcttaatccacctccaccagaatatcgtggacgtccagtacctatacggtcttggat

SEQ ID NO: 111304 - DNA, 75 bp, Artificial Sequence
  Synthetic
tacctgccctttctactggcttaatccacctccaccagaatatcgtggacgtccagtacctatacggtgttggat

SEQ ID NO: 111305 - DNA, 75 bp, Artificial Sequence
  Synthetic
tacctgccctttctactggctttatccacctccaccaaaatatcgtggacgtccagtacctatacggtattggat

SEQ ID NO: 111306 - DNA, 75 bp, Artificial Sequence
  Synthetic
tacctgccctttctactggctttatccacctccaccaaaatatcgtggacgtccagtacctatacggttttggat

SEQ ID NO: 111307 - DNA, 75 bp, Artificial Sequence
  Synthetic
tacctgccctttctactggctttatccacctccaccaaaatatcgtggacgtccagtacctatacggtcttggat

SEQ ID NO: 111308 - DNA, 75 bp, Artificial Sequence
  Synthetic
tacctgccctttctactggctttatccacctccaccaaaatatcgtggacgtccagtacctatacggtgttggat

SEQ ID NO: 111309 - DNA, 75 bp, Artificial Sequence
  Synthetic
tacctgccctttctactggctttatccacctccaccataatatcgtggacgtccagtacctatacggtattggat

SEQ ID NO: 111310 - DNA, 75 bp, Artificial Sequence
  Synthetic
tacctgccctttctactggctttatccacctccaccataatatcgtggacgtccagtacctatacggttttggat

SEQ ID NO: 111311 - DNA, 75 bp, Artificial Sequence
  Synthetic
tacctgccctttctactggctttatccacctccaccataatatcgtggacgtccagtacctatacggtcttggat

SEQ ID NO: 111312 - DNA, 75 bp, Artificial Sequence
  Synthetic
tacctgccctttctactggctttatccacctccaccataatatcgtggacgtccagtacctatacggtgttggat

SEQ ID NO: 111313 - DNA, 75 bp, Artificial Sequence
  Synthetic
tacctgccctttctactggctttatccacctccaccacaatatcgtggacgtccagtacctatacggtattggat

SEQ ID NO: 111314 - DNA, 75 bp, Artificial Sequence
  Synthetic
tacctgccctttctactggctttatccacctccaccacaatatcgtggacgtccagtacctatacggttttggat

SEQ ID NO: 111315 - DNA, 75 bp, Artificial Sequence
  Synthetic
tacctgccctttctactggctttatccacctccaccacaatatcgtggacgtccagtacctatacggtcttggat

SEQ ID NO: 111316 - DNA, 75 bp, Artificial Sequence
  Synthetic
tacctgccctttctactggctttatccacctccaccacaatatcgtggacgtccagtacctatacggtgttggat

SEQ ID NO: 111317 - DNA, 75 bp, Artificial Sequence
  Synthetic
tacctgccctttctactggctttatccacctccaccagaatatcgtggacgtccagtacctatacggtattggat

SEQ ID NO: 111318 - DNA, 75 bp, Artificial Sequence
  Synthetic
tacctgccctttctactggctttatccacctccaccagaatatcgtggacgtccagtacctatacggttttggat

SEQ ID NO: 111319 - DNA, 75 bp, Artificial Sequence
  Synthetic
tacctgccctttctactggctttatccacctccaccagaatatcgtggacgtccagtacctatacggtcttggat

SEQ ID NO: 111320 - DNA, 75 bp, Artificial Sequence
  Synthetic
tacctgccctttctactggctttatccacctccaccagaatatcgtggacgtccagtacctatacggtgttggat

SEQ ID NO: 111321 - DNA, 75 bp, Artificial Sequence
  Synthetic
tacctgccctttctactggcttcatccacctccaccaaaatatcgtggacgtccagtacctatacggtattggat

SEQ ID NO: 111322 - DNA, 75 bp, Artificial Sequence
  Synthetic
tacctgccctttctactggcttcatccacctccaccaaaatatcgtggacgtccagtacctatacggttttggat

SEQ ID NO: 111323 - DNA, 75 bp, Artificial Sequence
  Synthetic
tacctgccctttctactggcttcatccacctccaccaaaatatcgtggacgtccagtacctatacggtcttggat

SEQ ID NO: 111324 - DNA, 75 bp, Artificial Sequence
  Synthetic
tacctgccctttctactggcttcatccacctccaccaaaatatcgtggacgtccagtacctatacggtgttggat

SEQ ID NO: 111325 - DNA, 75 bp, Artificial Sequence
  Synthetic
tacctgccctttctactggcttcatccacctccaccataatatcgtggacgtccagtacctatacggtattggat

SEQ ID NO: 111326 - DNA, 75 bp, Artificial Sequence
  Synthetic
tacctgccctttctactggcttcatccacctccaccataatatcgtggacgtccagtacctatacggttttggat

SEQ ID NO: 111327 - DNA, 75 bp, Artificial Sequence
  Synthetic
tacctgccctttctactggcttcatccacctccaccataatatcgtggacgtccagtacctatacggtcttggat

SEQ ID NO: 111328 - DNA, 75 bp, Artificial Sequence
  Synthetic
tacctgccctttctactggcttcatccacctccaccataatatcgtggacgtccagtacctatacggtgttggat

SEQ ID NO: 111329 - DNA, 75 bp, Artificial Sequence
  Synthetic
tacctgccctttctactggcttcatccacctccaccacaatatcgtggacgtccagtacctatacggtattggat

SEQ ID NO: 111330 - DNA, 75 bp, Artificial Sequence
  Synthetic
tacctgccctttctactggcttcatccacctccaccacaatatcgtggacgtccagtacctatacggttttggat

SEQ ID NO: 111331 - DNA, 75 bp, Artificial Sequence
  Synthetic
tacctgccctttctactggcttcatccacctccaccacaatatcgtggacgtccagtacctatacggtcttggat

SEQ ID NO: 111332 - DNA, 75 bp, Artificial Sequence
  Synthetic
tacctgccctttctactggcttcatccacctccaccacaatatcgtggacgtccagtacctatacggtgttggat

SEQ ID NO: 111333 - DNA, 75 bp, Artificial Sequence
  Synthetic
tacctgccctttctactggcttcatccacctccaccagaatatcgtggacgtccagtacctatacggtattggat

SEQ ID NO: 111334 - DNA, 75 bp, Artificial Sequence
  Synthetic
tacctgccctttctactggcttcatccacctccaccagaatatcgtggacgtccagtacctatacggttttggat

SEQ ID NO: 111335 - DNA, 75 bp, Artificial Sequence
  Synthetic
tacctgccctttctactggcttcatccacctccaccagaatatcgtggacgtccagtacctatacggtcttggat

SEQ ID NO: 111336 - DNA, 75 bp, Artificial Sequence
  Synthetic
tacctgccctttctactggcttcatccacctccaccagaatatcgtggacgtccagtacctatacggtgttggat

SEQ ID NO: 111337 - DNA, 75 bp, Artificial Sequence
  Synthetic
tacctgccctttctactggcttgatccacctccaccaaaatatcgtggacgtccagtacctatacggtattggat

SEQ ID NO: 111338 - DNA, 75 bp, Artificial Sequence
  Synthetic
tacctgccctttctactggcttgatccacctccaccaaaatatcgtggacgtccagtacctatacggttttggat

SEQ ID NO: 111339 - DNA, 75 bp, Artificial Sequence
  Synthetic
tacctgccctttctactggcttgatccacctccaccaaaatatcgtggacgtccagtacctatacggtcttggat

SEQ ID NO: 111340 - DNA, 75 bp, Artificial Sequence
  Synthetic
tacctgccctttctactggcttgatccacctccaccaaaatatcgtggacgtccagtacctatacggtgttggat

SEQ ID NO: 111341 - DNA, 75 bp, Artificial Sequence
  Synthetic
tacctgccctttctactggcttgatccacctccaccataatatcgtggacgtccagtacctatacggtattggat

SEQ ID NO: 111342 - DNA, 75 bp, Artificial Sequence
  Synthetic
tacctgccctttctactggcttgatccacctccaccataatatcgtggacgtccagtacctatacggttttggat

SEQ ID NO: 111343 - DNA, 75 bp, Artificial Sequence
  Synthetic
tacctgccctttctactggcttgatccacctccaccataatatcgtggacgtccagtacctatacggtcttggat

SEQ ID NO: 111344 - DNA, 75 bp, Artificial Sequence
  Synthetic
tacctgccctttctactggcttgatccacctccaccataatatcgtggacgtccagtacctatacggtgttggat

SEQ ID NO: 111345 - DNA, 75 bp, Artificial Sequence
  Synthetic
tacctgccctttctactggcttgatccacctccaccacaatatcgtggacgtccagtacctatacggtattggat

SEQ ID NO: 111346 - DNA, 75 bp, Artificial Sequence
  Synthetic
tacctgccctttctactggcttgatccacctccaccacaatatcgtggacgtccagtacctatacggttttggat

SEQ ID NO: 111347 - DNA, 75 bp, Artificial Sequence
  Synthetic
tacctgccctttctactggcttgatccacctccaccacaatatcgtggacgtccagtacctatacggtcttggat

SEQ ID NO: 111348 - DNA, 75 bp, Artificial Sequence
  Synthetic
tacctgccctttctactggcttgatccacctccaccacaatatcgtggacgtccagtacctatacggtgttggat

SEQ ID NO: 111349 - DNA, 75 bp, Artificial Sequence
  Synthetic
tacctgccctttctactggcttgatccacctccaccagaatatcgtggacgtccagtacctatacggtattggat

SEQ ID NO: 111350 - DNA, 75 bp, Artificial Sequence
  Synthetic
tacctgccctttctactggcttgatccacctccaccagaatatcgtggacgtccagtacctatacggttttggat

SEQ ID NO: 111351 - DNA, 75 bp, Artificial Sequence
  Synthetic
tacctgccctttctactggcttgatccacctccaccagaatatcgtggacgtccagtacctatacggtcttggat

SEQ ID NO: 111352 - DNA, 75 bp, Artificial Sequence
  Synthetic
tacctgccctttctactggcttgatccacctccaccagaatatcgtggacgtccagtacctatacggtgttggat

SEQ ID NO: 111353 - DNA, 75 bp, Artificial Sequence
  Synthetic
gggcgcatagagcttgaaggcagaccagtcctggtgcctgataaggaggtcttataccagcagtacgatgagatg

SEQ ID NO: 111354 - DNA, 75 bp, Artificial Sequence
  Synthetic
acacaatcacttgttacatcaaggccacagcggctgcgagggccgcaggcctccggaacccggactttctcgtct

SEQ ID NO: 111355 - DNA, 75 bp, Artificial Sequence
  Synthetic
actcctgtgcctactcctactttccgtaggggtaggcatcttcctgctccccgcccgataggcggggagcctaac

SEQ ID NO: 111356 - DNA, 75 bp, Artificial Sequence
  Synthetic
ggtatctcaagttgaggcggcactgtccaacctgattaacatcaatgctgcttcagctgcaggcacacacggctt

SEQ ID NO: 111357 - DNA, 75 bp, Artificial Sequence
  Synthetic
ggtatctcaagttgaggcggcactgtccaacctgattaacatcaatgctgcttcagctgcaggcactcacggctt

SEQ ID NO: 111358 - DNA, 75 bp, Artificial Sequence
  Synthetic
ggtatctcaagttgaggcggcactgtccaacctgattaacatcaatgctgcttcagctgcaggcacccacggctt

SEQ ID NO: 111359 - DNA, 75 bp, Artificial Sequence
  Synthetic
ggtatctcaagttgaggcggcactgtccaacctgattaacatcaatgctgcttcagctgcaggcacgcacggctt

SEQ ID NO: 111360 - DNA, 75 bp, Artificial Sequence
  Synthetic
ggtatctcaagttgaggcggcactgtccaacctgattaacatcaatgctgcttcagctgctggcacacacggctt

SEQ ID NO: 111361 - DNA, 75 bp, Artificial Sequence
  Synthetic
ggtatctcaagttgaggcggcactgtccaacctgattaacatcaatgctgcttcagctgctggcactcacggctt

SEQ ID NO: 111362 - DNA, 75 bp, Artificial Sequence
  Synthetic
ggtatctcaagttgaggcggcactgtccaacctgattaacatcaatgctgcttcagctgctggcacccacggctt

SEQ ID NO: 111363 - DNA, 75 bp, Artificial Sequence
  Synthetic
ggtatctcaagttgaggcggcactgtccaacctgattaacatcaatgctgcttcagctgctggcacgcacggctt

SEQ ID NO: 111364 - DNA, 75 bp, Artificial Sequence
  Synthetic
ggtatctcaagttgaggcggcactgtccaacctgattaacatcaatgctgcttcagctgccggcacacacggctt

SEQ ID NO: 111365 - DNA, 75 bp, Artificial Sequence
  Synthetic
ggtatctcaagttgaggcggcactgtccaacctgattaacatcaatgctgcttcagctgccggcactcacggctt

SEQ ID NO: 111366 - DNA, 75 bp, Artificial Sequence
  Synthetic
ggtatctcaagttgaggcggcactgtccaacctgattaacatcaatgctgcttcagctgccggcacccacggctt

SEQ ID NO: 111367 - DNA, 75 bp, Artificial Sequence
  Synthetic
ggtatctcaagttgaggcggcactgtccaacctgattaacatcaatgctgcttcagctgccggcacgcacggctt

SEQ ID NO: 111368 - DNA, 75 bp, Artificial Sequence
  Synthetic
ggtatctcaagttgaggcggcactgtccaacctgattaacatcaatgctgcttcagctgcgggcacacacggctt

SEQ ID NO: 111369 - DNA, 75 bp, Artificial Sequence
  Synthetic
ggtatctcaagttgaggcggcactgtccaacctgattaacatcaatgctgcttcagctgcgggcactcacggctt

SEQ ID NO: 111370 - DNA, 75 bp, Artificial Sequence
  Synthetic
ggtatctcaagttgaggcggcactgtccaacctgattaacatcaatgctgcttcagctgcgggcacccacggctt

SEQ ID NO: 111371 - DNA, 75 bp, Artificial Sequence
  Synthetic
ggtatctcaagttgaggcggcactgtccaacctgattaacatcaatgctgcttcagctgcgggcacgcacggctt

SEQ ID NO: 111372 - DNA, 75 bp, Artificial Sequence
  Synthetic
ggtatctcaagttgaggcggctctgtccaacctgattaacatcaatgctgcttcagctgcaggcacacacggctt

SEQ ID NO: 111373 - DNA, 75 bp, Artificial Sequence
  Synthetic
ggtatctcaagttgaggcggctctgtccaacctgattaacatcaatgctgcttcagctgcaggcactcacggctt

SEQ ID NO: 111374 - DNA, 75 bp, Artificial Sequence
  Synthetic
ggtatctcaagttgaggcggctctgtccaacctgattaacatcaatgctgcttcagctgcaggcacccacggctt

SEQ ID NO: 111375 - DNA, 75 bp, Artificial Sequence
  Synthetic
ggtatctcaagttgaggcggctctgtccaacctgattaacatcaatgctgcttcagctgcaggcacgcacggctt

SEQ ID NO: 111376 - DNA, 75 bp, Artificial Sequence
  Synthetic
ggtatctcaagttgaggcggctctgtccaacctgattaacatcaatgctgcttcagctgctggcacacacggctt

SEQ ID NO: 111377 - DNA, 75 bp, Artificial Sequence
  Synthetic
ggtatctcaagttgaggcggctctgtccaacctgattaacatcaatgctgcttcagctgctggcactcacggctt

SEQ ID NO: 111378 - DNA, 75 bp, Artificial Sequence
  Synthetic
ggtatctcaagttgaggcggctctgtccaacctgattaacatcaatgctgcttcagctgctggcacccacggctt

SEQ ID NO: 111379 - DNA, 75 bp, Artificial Sequence
  Synthetic
ggtatctcaagttgaggcggctctgtccaacctgattaacatcaatgctgcttcagctgctggcacgcacggctt

SEQ ID NO: 111380 - DNA, 75 bp, Artificial Sequence
  Synthetic
ggtatctcaagttgaggcggctctgtccaacctgattaacatcaatgctgcttcagctgccggcacacacggctt

SEQ ID NO: 111381 - DNA, 75 bp, Artificial Sequence
  Synthetic
ggtatctcaagttgaggcggctctgtccaacctgattaacatcaatgctgcttcagctgccggcactcacggctt

SEQ ID NO: 111382 - DNA, 75 bp, Artificial Sequence
  Synthetic
ggtatctcaagttgaggcggctctgtccaacctgattaacatcaatgctgcttcagctgccggcacccacggctt

SEQ ID NO: 111383 - DNA, 75 bp, Artificial Sequence
  Synthetic
ggtatctcaagttgaggcggctctgtccaacctgattaacatcaatgctgcttcagctgccggcacgcacggctt

SEQ ID NO: 111384 - DNA, 75 bp, Artificial Sequence
  Synthetic
ggtatctcaagttgaggcggctctgtccaacctgattaacatcaatgctgcttcagctgcgggcacacacggctt

SEQ ID NO: 111385 - DNA, 75 bp, Artificial Sequence
  Synthetic
ggtatctcaagttgaggcggctctgtccaacctgattaacatcaatgctgcttcagctgcgggcactcacggctt

SEQ ID NO: 111386 - DNA, 75 bp, Artificial Sequence
  Synthetic
ggtatctcaagttgaggcggctctgtccaacctgattaacatcaatgctgcttcagctgcgggcacccacggctt

SEQ ID NO: 111387 - DNA, 75 bp, Artificial Sequence
  Synthetic
ggtatctcaagttgaggcggctctgtccaacctgattaacatcaatgctgcttcagctgcgggcacgcacggctt

SEQ ID NO: 111388 - DNA, 75 bp, Artificial Sequence
  Synthetic
ggtatctcaagttgaggcggccctgtccaacctgattaacatcaatgctgcttcagctgcaggcacacacggctt

SEQ ID NO: 111389 - DNA, 75 bp, Artificial Sequence
  Synthetic
ggtatctcaagttgaggcggccctgtccaacctgattaacatcaatgctgcttcagctgcaggcactcacggctt

SEQ ID NO: 111390 - DNA, 75 bp, Artificial Sequence
  Synthetic
ggtatctcaagttgaggcggccctgtccaacctgattaacatcaatgctgcttcagctgcaggcacccacggctt

SEQ ID NO: 111391 - DNA, 75 bp, Artificial Sequence
  Synthetic
ggtatctcaagttgaggcggccctgtccaacctgattaacatcaatgctgcttcagctgcaggcacgcacggctt

SEQ ID NO: 111392 - DNA, 75 bp, Artificial Sequence
  Synthetic
ggtatctcaagttgaggcggccctgtccaacctgattaacatcaatgctgcttcagctgctggcacacacggctt

SEQ ID NO: 111393 - DNA, 75 bp, Artificial Sequence
  Synthetic
ggtatctcaagttgaggcggccctgtccaacctgattaacatcaatgctgcttcagctgctggcactcacggctt

SEQ ID NO: 111394 - DNA, 75 bp, Artificial Sequence
  Synthetic
ggtatctcaagttgaggcggccctgtccaacctgattaacatcaatgctgcttcagctgctggcacccacggctt

SEQ ID NO: 111395 - DNA, 75 bp, Artificial Sequence
  Synthetic
ggtatctcaagttgaggcggccctgtccaacctgattaacatcaatgctgcttcagctgctggcacgcacggctt

SEQ ID NO: 111396 - DNA, 75 bp, Artificial Sequence
  Synthetic
ggtatctcaagttgaggcggccctgtccaacctgattaacatcaatgctgcttcagctgccggcacacacggctt

SEQ ID NO: 111397 - DNA, 75 bp, Artificial Sequence
  Synthetic
ggtatctcaagttgaggcggccctgtccaacctgattaacatcaatgctgcttcagctgccggcactcacggctt

SEQ ID NO: 111398 - DNA, 75 bp, Artificial Sequence
  Synthetic
ggtatctcaagttgaggcggccctgtccaacctgattaacatcaatgctgcttcagctgccggcacccacggctt

SEQ ID NO: 111399 - DNA, 75 bp, Artificial Sequence
  Synthetic
ggtatctcaagttgaggcggccctgtccaacctgattaacatcaatgctgcttcagctgccggcacgcacggctt

SEQ ID NO: 111400 - DNA, 75 bp, Artificial Sequence
  Synthetic
ggtatctcaagttgaggcggccctgtccaacctgattaacatcaatgctgcttcagctgcgggcacacacggctt

SEQ ID NO: 111401 - DNA, 75 bp, Artificial Sequence
  Synthetic
ggtatctcaagttgaggcggccctgtccaacctgattaacatcaatgctgcttcagctgcgggcactcacggctt

SEQ ID NO: 111402 - DNA, 75 bp, Artificial Sequence
  Synthetic
ggtatctcaagttgaggcggccctgtccaacctgattaacatcaatgctgcttcagctgcgggcacccacggctt

SEQ ID NO: 111403 - DNA, 75 bp, Artificial Sequence
  Synthetic
ggtatctcaagttgaggcggccctgtccaacctgattaacatcaatgctgcttcagctgcgggcacgcacggctt

SEQ ID NO: 111404 - DNA, 75 bp, Artificial Sequence
  Synthetic
ggtatctcaagttgaggcggcgctgtccaacctgattaacatcaatgctgcttcagctgcaggcacacacggctt

SEQ ID NO: 111405 - DNA, 75 bp, Artificial Sequence
  Synthetic
ggtatctcaagttgaggcggcgctgtccaacctgattaacatcaatgctgcttcagctgcaggcactcacggctt

SEQ ID NO: 111406 - DNA, 75 bp, Artificial Sequence
  Synthetic
ggtatctcaagttgaggcggcgctgtccaacctgattaacatcaatgctgcttcagctgcaggcacccacggctt

SEQ ID NO: 111407 - DNA, 75 bp, Artificial Sequence
  Synthetic
ggtatctcaagttgaggcggcgctgtccaacctgattaacatcaatgctgcttcagctgcaggcacgcacggctt

SEQ ID NO: 111408 - DNA, 75 bp, Artificial Sequence
  Synthetic
ggtatctcaagttgaggcggcgctgtccaacctgattaacatcaatgctgcttcagctgctggcacacacggctt

SEQ ID NO: 111409 - DNA, 75 bp, Artificial Sequence
  Synthetic
ggtatctcaagttgaggcggcgctgtccaacctgattaacatcaatgctgcttcagctgctggcactcacggctt

SEQ ID NO: 111410 - DNA, 75 bp, Artificial Sequence
  Synthetic
ggtatctcaagttgaggcggcgctgtccaacctgattaacatcaatgctgcttcagctgctggcacccacggctt

SEQ ID NO: 111411 - DNA, 75 bp, Artificial Sequence
  Synthetic
ggtatctcaagttgaggcggcgctgtccaacctgattaacatcaatgctgcttcagctgctggcacgcacggctt

SEQ ID NO: 111412 - DNA, 75 bp, Artificial Sequence
  Synthetic
ggtatctcaagttgaggcggcgctgtccaacctgattaacatcaatgctgcttcagctgccggcacacacggctt

SEQ ID NO: 111413 - DNA, 75 bp, Artificial Sequence
  Synthetic
ggtatctcaagttgaggcggcgctgtccaacctgattaacatcaatgctgcttcagctgccggcactcacggctt

SEQ ID NO: 111414 - DNA, 75 bp, Artificial Sequence
  Synthetic
ggtatctcaagttgaggcggcgctgtccaacctgattaacatcaatgctgcttcagctgccggcacccacggctt

SEQ ID NO: 111415 - DNA, 75 bp, Artificial Sequence
  Synthetic
ggtatctcaagttgaggcggcgctgtccaacctgattaacatcaatgctgcttcagctgccggcacgcacggctt

SEQ ID NO: 111416 - DNA, 75 bp, Artificial Sequence
  Synthetic
ggtatctcaagttgaggcggcgctgtccaacctgattaacatcaatgctgcttcagctgcgggcacacacggctt

SEQ ID NO: 111417 - DNA, 75 bp, Artificial Sequence
  Synthetic
ggtatctcaagttgaggcggcgctgtccaacctgattaacatcaatgctgcttcagctgcgggcactcacggctt

SEQ ID NO: 111418 - DNA, 75 bp, Artificial Sequence
  Synthetic
ggtatctcaagttgaggcggcgctgtccaacctgattaacatcaatgctgcttcagctgcgggcacccacggctt

SEQ ID NO: 111419 - DNA, 75 bp, Artificial Sequence
  Synthetic
ggtatctcaagttgaggcggcgctgtccaacctgattaacatcaatgctgcttcagctgcgggcacgcacggctt

SEQ ID NO: 111420 - DNA, 75 bp, Artificial Sequence
  Synthetic
aggccgacgagatccagcctatagcacagccatactggcacaaggtggagacgttctggagtaagcatatgtgga

SEQ ID NO: 111421 - DNA, 75 bp, Artificial Sequence
  Synthetic
ctactactaatgctgcccgaaagggcttacgcataagaccgggaggtggcagggtcccttggtggcgccgtcctt

SEQ ID NO: 111422 - DNA, 75 bp, Artificial Sequence
  Synthetic
ctactactaatgctgcccgaaagggcttacgcatatgaccgggaggtggcagggtcccttggtggcgccgtcctt

SEQ ID NO: 111423 - DNA, 75 bp, Artificial Sequence
  Synthetic
ctactactaatgctgcccgaaagggcttacgcatacgaccgggaggtggcagggtcccttggtggcgccgtcctt

SEQ ID NO: 111424 - DNA, 75 bp, Artificial Sequence
  Synthetic
ctactactaatgctgcccgaaagggcttacgcataggaccgggaggtggcagggtcccttggtggcgccgtcctt

SEQ ID NO: 111425 - DNA, 75 bp, Artificial Sequence
  Synthetic
ctactactaatgctgcccgatagggcttacgcataagaccgggaggtggcagggtcccttggtggcgccgtcctt

SEQ ID NO: 111426 - DNA, 75 bp, Artificial Sequence
  Synthetic
ctactactaatgctgcccgatagggcttacgcatatgaccgggaggtggcagggtcccttggtggcgccgtcctt

SEQ ID NO: 111427 - DNA, 75 bp, Artificial Sequence
  Synthetic
ctactactaatgctgcccgatagggcttacgcatacgaccgggaggtggcagggtcccttggtggcgccgtcctt

SEQ ID NO: 111428 - DNA, 75 bp, Artificial Sequence
  Synthetic
ctactactaatgctgcccgatagggcttacgcataggaccgggaggtggcagggtcccttggtggcgccgtcctt

SEQ ID NO: 111429 - DNA, 75 bp, Artificial Sequence
  Synthetic
ctactactaatgctgcccgacagggcttacgcataagaccgggaggtggcagggtcccttggtggcgccgtcctt

SEQ ID NO: 111430 - DNA, 75 bp, Artificial Sequence
  Synthetic
ctactactaatgctgcccgacagggcttacgcatatgaccgggaggtggcagggtcccttggtggcgccgtcctt

SEQ ID NO: 111431 - DNA, 75 bp, Artificial Sequence
  Synthetic
ctactactaatgctgcccgacagggcttacgcatacgaccgggaggtggcagggtcccttggtggcgccgtcctt

SEQ ID NO: 111432 - DNA, 75 bp, Artificial Sequence
  Synthetic
ctactactaatgctgcccgacagggcttacgcataggaccgggaggtggcagggtcccttggtggcgccgtcctt

SEQ ID NO: 111433 - DNA, 75 bp, Artificial Sequence
  Synthetic
ctactactaatgctgcccgagagggcttacgcataagaccgggaggtggcagggtcccttggtggcgccgtcctt

SEQ ID NO: 111434 - DNA, 75 bp, Artificial Sequence
  Synthetic
ctactactaatgctgcccgagagggcttacgcatatgaccgggaggtggcagggtcccttggtggcgccgtcctt

SEQ ID NO: 111435 - DNA, 75 bp, Artificial Sequence
  Synthetic
ctactactaatgctgcccgagagggcttacgcatacgaccgggaggtggcagggtcccttggtggcgccgtcctt

SEQ ID NO: 111436 - DNA, 75 bp, Artificial Sequence
  Synthetic
ctactactaatgctgcccgagagggcttacgcataggaccgggaggtggcagggtcccttggtggcgccgtcctt

SEQ ID NO: 111437 - DNA, 75 bp, Artificial Sequence
  Synthetic
ctacttctaatgctgcccgaaagggcttacgcataagaccgggaggtggcagggtcccttggtggcgccgtcctt

SEQ ID NO: 111438 - DNA, 75 bp, Artificial Sequence
  Synthetic
ctacttctaatgctgcccgaaagggcttacgcatatgaccgggaggtggcagggtcccttggtggcgccgtcctt

SEQ ID NO: 111439 - DNA, 75 bp, Artificial Sequence
  Synthetic
ctacttctaatgctgcccgaaagggcttacgcatacgaccgggaggtggcagggtcccttggtggcgccgtcctt

SEQ ID NO: 111440 - DNA, 75 bp, Artificial Sequence
  Synthetic
ctacttctaatgctgcccgaaagggcttacgcataggaccgggaggtggcagggtcccttggtggcgccgtcctt

SEQ ID NO: 111441 - DNA, 75 bp, Artificial Sequence
  Synthetic
ctacttctaatgctgcccgatagggcttacgcataagaccgggaggtggcagggtcccttggtggcgccgtcctt

SEQ ID NO: 111442 - DNA, 75 bp, Artificial Sequence
  Synthetic
ctacttctaatgctgcccgatagggcttacgcatatgaccgggaggtggcagggtcccttggtggcgccgtcctt

SEQ ID NO: 111443 - DNA, 75 bp, Artificial Sequence
  Synthetic
ctacttctaatgctgcccgatagggcttacgcatacgaccgggaggtggcagggtcccttggtggcgccgtcctt

SEQ ID NO: 111444 - DNA, 75 bp, Artificial Sequence
  Synthetic
ctacttctaatgctgcccgatagggcttacgcataggaccgggaggtggcagggtcccttggtggcgccgtcctt

SEQ ID NO: 111445 - DNA, 75 bp, Artificial Sequence
  Synthetic
ctacttctaatgctgcccgacagggcttacgcataagaccgggaggtggcagggtcccttggtggcgccgtcctt

SEQ ID NO: 111446 - DNA, 75 bp, Artificial Sequence
  Synthetic
ctacttctaatgctgcccgacagggcttacgcatatgaccgggaggtggcagggtcccttggtggcgccgtcctt

SEQ ID NO: 111447 - DNA, 75 bp, Artificial Sequence
  Synthetic
ctacttctaatgctgcccgacagggcttacgcatacgaccgggaggtggcagggtcccttggtggcgccgtcctt

SEQ ID NO: 111448 - DNA, 75 bp, Artificial Sequence
  Synthetic
ctacttctaatgctgcccgacagggcttacgcataggaccgggaggtggcagggtcccttggtggcgccgtcctt

SEQ ID NO: 111449 - DNA, 75 bp, Artificial Sequence
  Synthetic
ctacttctaatgctgcccgagagggcttacgcataagaccgggaggtggcagggtcccttggtggcgccgtcctt

SEQ ID NO: 111450 - DNA, 75 bp, Artificial Sequence
  Synthetic
ctacttctaatgctgcccgagagggcttacgcatatgaccgggaggtggcagggtcccttggtggcgccgtcctt

SEQ ID NO: 111451 - DNA, 75 bp, Artificial Sequence
  Synthetic
ctacttctaatgctgcccgagagggcttacgcatacgaccgggaggtggcagggtcccttggtggcgccgtcctt

SEQ ID NO: 111452 - DNA, 75 bp, Artificial Sequence
  Synthetic
ctacttctaatgctgcccgagagggcttacgcataggaccgggaggtggcagggtcccttggtggcgccgtcctt

SEQ ID NO: 111453 - DNA, 75 bp, Artificial Sequence
  Synthetic
ctactcctaatgctgcccgaaagggcttacgcataagaccgggaggtggcagggtcccttggtggcgccgtcctt

SEQ ID NO: 111454 - DNA, 75 bp, Artificial Sequence
  Synthetic
ctactcctaatgctgcccgaaagggcttacgcatatgaccgggaggtggcagggtcccttggtggcgccgtcctt

SEQ ID NO: 111455 - DNA, 75 bp, Artificial Sequence
  Synthetic
ctactcctaatgctgcccgaaagggcttacgcatacgaccgggaggtggcagggtcccttggtggcgccgtcctt

SEQ ID NO: 111456 - DNA, 75 bp, Artificial Sequence
  Synthetic
ctactcctaatgctgcccgaaagggcttacgcataggaccgggaggtggcagggtcccttggtggcgccgtcctt

SEQ ID NO: 111457 - DNA, 75 bp, Artificial Sequence
  Synthetic
ctactcctaatgctgcccgatagggcttacgcataagaccgggaggtggcagggtcccttggtggcgccgtcctt

SEQ ID NO: 111458 - DNA, 75 bp, Artificial Sequence
  Synthetic
ctactcctaatgctgcccgatagggcttacgcatatgaccgggaggtggcagggtcccttggtggcgccgtcctt

SEQ ID NO: 111459 - DNA, 75 bp, Artificial Sequence
  Synthetic
ctactcctaatgctgcccgatagggcttacgcatacgaccgggaggtggcagggtcccttggtggcgccgtcctt

SEQ ID NO: 111460 - DNA, 75 bp, Artificial Sequence
  Synthetic
ctactcctaatgctgcccgatagggcttacgcataggaccgggaggtggcagggtcccttggtggcgccgtcctt

SEQ ID NO: 111461 - DNA, 75 bp, Artificial Sequence
  Synthetic
ctactcctaatgctgcccgacagggcttacgcataagaccgggaggtggcagggtcccttggtggcgccgtcctt

SEQ ID NO: 111462 - DNA, 75 bp, Artificial Sequence
  Synthetic
ctactcctaatgctgcccgacagggcttacgcatatgaccgggaggtggcagggtcccttggtggcgccgtcctt

SEQ ID NO: 111463 - DNA, 75 bp, Artificial Sequence
  Synthetic
ctactcctaatgctgcccgacagggcttacgcatacgaccgggaggtggcagggtcccttggtggcgccgtcctt

SEQ ID NO: 111464 - DNA, 75 bp, Artificial Sequence
  Synthetic
ctactcctaatgctgcccgacagggcttacgcataggaccgggaggtggcagggtcccttggtggcgccgtcctt

SEQ ID NO: 111465 - DNA, 75 bp, Artificial Sequence
  Synthetic
ctactcctaatgctgcccgagagggcttacgcataagaccgggaggtggcagggtcccttggtggcgccgtcctt

SEQ ID NO: 111466 - DNA, 75 bp, Artificial Sequence
  Synthetic
ctactcctaatgctgcccgagagggcttacgcatatgaccgggaggtggcagggtcccttggtggcgccgtcctt

SEQ ID NO: 111467 - DNA, 75 bp, Artificial Sequence
  Synthetic
ctactcctaatgctgcccgagagggcttacgcatacgaccgggaggtggcagggtcccttggtggcgccgtcctt

SEQ ID NO: 111468 - DNA, 75 bp, Artificial Sequence
  Synthetic
ctactcctaatgctgcccgagagggcttacgcataggaccgggaggtggcagggtcccttggtggcgccgtcctt

SEQ ID NO: 111469 - DNA, 75 bp, Artificial Sequence
  Synthetic
ctactgctaatgctgcccgaaagggcttacgcataagaccgggaggtggcagggtcccttggtggcgccgtcctt

SEQ ID NO: 111470 - DNA, 75 bp, Artificial Sequence
  Synthetic
ctactgctaatgctgcccgaaagggcttacgcatatgaccgggaggtggcagggtcccttggtggcgccgtcctt

SEQ ID NO: 111471 - DNA, 75 bp, Artificial Sequence
  Synthetic
ctactgctaatgctgcccgaaagggcttacgcatacgaccgggaggtggcagggtcccttggtggcgccgtcctt

SEQ ID NO: 111472 - DNA, 75 bp, Artificial Sequence
  Synthetic
ctactgctaatgctgcccgaaagggcttacgcataggaccgggaggtggcagggtcccttggtggcgccgtcctt

SEQ ID NO: 111473 - DNA, 75 bp, Artificial Sequence
  Synthetic
ctactgctaatgctgcccgatagggcttacgcataagaccgggaggtggcagggtcccttggtggcgccgtcctt

SEQ ID NO: 111474 - DNA, 75 bp, Artificial Sequence
  Synthetic
ctactgctaatgctgcccgatagggcttacgcatatgaccgggaggtggcagggtcccttggtggcgccgtcctt

SEQ ID NO: 111475 - DNA, 75 bp, Artificial Sequence
  Synthetic
ctactgctaatgctgcccgatagggcttacgcatacgaccgggaggtggcagggtcccttggtggcgccgtcctt

SEQ ID NO: 111476 - DNA, 75 bp, Artificial Sequence
  Synthetic
ctactgctaatgctgcccgatagggcttacgcataggaccgggaggtggcagggtcccttggtggcgccgtcctt

SEQ ID NO: 111477 - DNA, 75 bp, Artificial Sequence
  Synthetic
ctactgctaatgctgcccgacagggcttacgcataagaccgggaggtggcagggtcccttggtggcgccgtcctt

SEQ ID NO: 111478 - DNA, 75 bp, Artificial Sequence
  Synthetic
ctactgctaatgctgcccgacagggcttacgcatatgaccgggaggtggcagggtcccttggtggcgccgtcctt

SEQ ID NO: 111479 - DNA, 75 bp, Artificial Sequence
  Synthetic
ctactgctaatgctgcccgacagggcttacgcatacgaccgggaggtggcagggtcccttggtggcgccgtcctt

SEQ ID NO: 111480 - DNA, 75 bp, Artificial Sequence
  Synthetic
ctactgctaatgctgcccgacagggcttacgcataggaccgggaggtggcagggtcccttggtggcgccgtcctt

SEQ ID NO: 111481 - DNA, 75 bp, Artificial Sequence
  Synthetic
ctactgctaatgctgcccgagagggcttacgcataagaccgggaggtggcagggtcccttggtggcgccgtcctt

SEQ ID NO: 111482 - DNA, 75 bp, Artificial Sequence
  Synthetic
ctactgctaatgctgcccgagagggcttacgcatatgaccgggaggtggcagggtcccttggtggcgccgtcctt

SEQ ID NO: 111483 - DNA, 75 bp, Artificial Sequence
  Synthetic
ctactgctaatgctgcccgagagggcttacgcatacgaccgggaggtggcagggtcccttggtggcgccgtcctt

SEQ ID NO: 111484 - DNA, 75 bp, Artificial Sequence
  Synthetic
ctactgctaatgctgcccgagagggcttacgcataggaccgggaggtggcagggtcccttggtggcgccgtcctt

SEQ ID NO: 111485 - DNA, 75 bp, Artificial Sequence
  Synthetic
tacatgtctatgttccatccttcgacgtgcgcggtcctcgcgactcattgataattcttgcagtcctggcatacc

SEQ ID NO: 111486 - DNA, 75 bp, Artificial Sequence
  Synthetic
tacatgtctatgttccatccttcgacgtgcgcggtcctcgcgactcattgataattcttgcagtcctggcattcc

SEQ ID NO: 111487 - DNA, 75 bp, Artificial Sequence
  Synthetic
tacatgtctatgttccatccttcgacgtgcgcggtcctcgcgactcattgataattcttgcagtcctggcatccc

SEQ ID NO: 111488 - DNA, 75 bp, Artificial Sequence
  Synthetic
tacatgtctatgttccatccttcgacgtgcgcggtcctcgcgactcattgataattcttgcagtcctggcatgcc

SEQ ID NO: 111489 - DNA, 75 bp, Artificial Sequence
  Synthetic
tacatgtctatgttccatccttcgacgtgcgcggtcctcgcgactcattgataattcttgcagtcctggcttacc

SEQ ID NO: 111490 - DNA, 75 bp, Artificial Sequence
  Synthetic
tacatgtctatgttccatccttcgacgtgcgcggtcctcgcgactcattgataattcttgcagtcctggctttcc

SEQ ID NO: 111491 - DNA, 75 bp, Artificial Sequence
  Synthetic
tacatgtctatgttccatccttcgacgtgcgcggtcctcgcgactcattgataattcttgcagtcctggcttccc

SEQ ID NO: 111492 - DNA, 75 bp, Artificial Sequence
  Synthetic
tacatgtctatgttccatccttcgacgtgcgcggtcctcgcgactcattgataattcttgcagtcctggcttgcc

SEQ ID NO: 111493 - DNA, 75 bp, Artificial Sequence
  Synthetic
tacatgtctatgttccatccttcgacgtgcgcggtcctcgcgactcattgataattcttgcagtcctggcctacc

SEQ ID NO: 111494 - DNA, 75 bp, Artificial Sequence
  Synthetic
tacatgtctatgttccatccttcgacgtgcgcggtcctcgcgactcattgataattcttgcagtcctggccttcc

SEQ ID NO: 111495 - DNA, 75 bp, Artificial Sequence
  Synthetic
tacatgtctatgttccatccttcgacgtgcgcggtcctcgcgactcattgataattcttgcagtcctggcctccc

SEQ ID NO: 111496 - DNA, 75 bp, Artificial Sequence
  Synthetic
tacatgtctatgttccatccttcgacgtgcgcggtcctcgcgactcattgataattcttgcagtcctggcctgcc

SEQ ID NO: 111497 - DNA, 75 bp, Artificial Sequence
  Synthetic
tacatgtctatgttccatccttcgacgtgcgcggtcctcgcgactcattgataattcttgcagtcctggcgtacc

SEQ ID NO: 111498 - DNA, 75 bp, Artificial Sequence
  Synthetic
tacatgtctatgttccatccttcgacgtgcgcggtcctcgcgactcattgataattcttgcagtcctggcgttcc

SEQ ID NO: 111499 - DNA, 75 bp, Artificial Sequence
  Synthetic
tacatgtctatgttccatccttcgacgtgcgcggtcctcgcgactcattgataattcttgcagtcctggcgtccc

SEQ ID NO: 111500 - DNA, 75 bp, Artificial Sequence
  Synthetic
tacatgtctatgttccatccttcgacgtgcgcggtcctcgcgactcattgataattcttgcagtcctggcgtgcc

SEQ ID NO: 111501 - DNA, 75 bp, Artificial Sequence
  Synthetic
ttcatgtctatgttccatccttcgacgtgcgcggtcctcgcgactcattgataattcttgcagtcctggcatacc

SEQ ID NO: 111502 - DNA, 75 bp, Artificial Sequence
  Synthetic
ttcatgtctatgttccatccttcgacgtgcgcggtcctcgcgactcattgataattcttgcagtcctggcattcc

SEQ ID NO: 111503 - DNA, 75 bp, Artificial Sequence
  Synthetic
ttcatgtctatgttccatccttcgacgtgcgcggtcctcgcgactcattgataattcttgcagtcctggcatccc

SEQ ID NO: 111504 - DNA, 75 bp, Artificial Sequence
  Synthetic
ttcatgtctatgttccatccttcgacgtgcgcggtcctcgcgactcattgataattcttgcagtcctggcatgcc

SEQ ID NO: 111505 - DNA, 75 bp, Artificial Sequence
  Synthetic
ttcatgtctatgttccatccttcgacgtgcgcggtcctcgcgactcattgataattcttgcagtcctggcttacc

SEQ ID NO: 111506 - DNA, 75 bp, Artificial Sequence
  Synthetic
ttcatgtctatgttccatccttcgacgtgcgcggtcctcgcgactcattgataattcttgcagtcctggctttcc

SEQ ID NO: 111507 - DNA, 75 bp, Artificial Sequence
  Synthetic
ttcatgtctatgttccatccttcgacgtgcgcggtcctcgcgactcattgataattcttgcagtcctggcttccc

SEQ ID NO: 111508 - DNA, 75 bp, Artificial Sequence
  Synthetic
ttcatgtctatgttccatccttcgacgtgcgcggtcctcgcgactcattgataattcttgcagtcctggcttgcc

SEQ ID NO: 111509 - DNA, 75 bp, Artificial Sequence
  Synthetic
ttcatgtctatgttccatccttcgacgtgcgcggtcctcgcgactcattgataattcttgcagtcctggcctacc

SEQ ID NO: 111510 - DNA, 75 bp, Artificial Sequence
  Synthetic
ttcatgtctatgttccatccttcgacgtgcgcggtcctcgcgactcattgataattcttgcagtcctggccttcc

SEQ ID NO: 111511 - DNA, 75 bp, Artificial Sequence
  Synthetic
ttcatgtctatgttccatccttcgacgtgcgcggtcctcgcgactcattgataattcttgcagtcctggcctccc

SEQ ID NO: 111512 - DNA, 75 bp, Artificial Sequence
  Synthetic
ttcatgtctatgttccatccttcgacgtgcgcggtcctcgcgactcattgataattcttgcagtcctggcctgcc

SEQ ID NO: 111513 - DNA, 75 bp, Artificial Sequence
  Synthetic
ttcatgtctatgttccatccttcgacgtgcgcggtcctcgcgactcattgataattcttgcagtcctggcgtacc

SEQ ID NO: 111514 - DNA, 75 bp, Artificial Sequence
  Synthetic
ttcatgtctatgttccatccttcgacgtgcgcggtcctcgcgactcattgataattcttgcagtcctggcgttcc

SEQ ID NO: 111515 - DNA, 75 bp, Artificial Sequence
  Synthetic
ttcatgtctatgttccatccttcgacgtgcgcggtcctcgcgactcattgataattcttgcagtcctggcgtccc

SEQ ID NO: 111516 - DNA, 75 bp, Artificial Sequence
  Synthetic
ttcatgtctatgttccatccttcgacgtgcgcggtcctcgcgactcattgataattcttgcagtcctggcgtgcc

SEQ ID NO: 111517 - DNA, 75 bp, Artificial Sequence
  Synthetic
tccatgtctatgttccatccttcgacgtgcgcggtcctcgcgactcattgataattcttgcagtcctggcatacc

SEQ ID NO: 111518 - DNA, 75 bp, Artificial Sequence
  Synthetic
tccatgtctatgttccatccttcgacgtgcgcggtcctcgcgactcattgataattcttgcagtcctggcattcc

SEQ ID NO: 111519 - DNA, 75 bp, Artificial Sequence
  Synthetic
tccatgtctatgttccatccttcgacgtgcgcggtcctcgcgactcattgataattcttgcagtcctggcatccc

SEQ ID NO: 111520 - DNA, 75 bp, Artificial Sequence
  Synthetic
tccatgtctatgttccatccttcgacgtgcgcggtcctcgcgactcattgataattcttgcagtcctggcatgcc

SEQ ID NO: 111521 - DNA, 75 bp, Artificial Sequence
  Synthetic
tccatgtctatgttccatccttcgacgtgcgcggtcctcgcgactcattgataattcttgcagtcctggcttacc

SEQ ID NO: 111522 - DNA, 75 bp, Artificial Sequence
  Synthetic
tccatgtctatgttccatccttcgacgtgcgcggtcctcgcgactcattgataattcttgcagtcctggctttcc

SEQ ID NO: 111523 - DNA, 75 bp, Artificial Sequence
  Synthetic
tccatgtctatgttccatccttcgacgtgcgcggtcctcgcgactcattgataattcttgcagtcctggcttccc

SEQ ID NO: 111524 - DNA, 75 bp, Artificial Sequence
  Synthetic
tccatgtctatgttccatccttcgacgtgcgcggtcctcgcgactcattgataattcttgcagtcctggcttgcc

SEQ ID NO: 111525 - DNA, 75 bp, Artificial Sequence
  Synthetic
tccatgtctatgttccatccttcgacgtgcgcggtcctcgcgactcattgataattcttgcagtcctggcctacc

SEQ ID NO: 111526 - DNA, 75 bp, Artificial Sequence
  Synthetic
tccatgtctatgttccatccttcgacgtgcgcggtcctcgcgactcattgataattcttgcagtcctggccttcc

SEQ ID NO: 111527 - DNA, 75 bp, Artificial Sequence
  Synthetic
tccatgtctatgttccatccttcgacgtgcgcggtcctcgcgactcattgataattcttgcagtcctggcctccc

SEQ ID NO: 111528 - DNA, 75 bp, Artificial Sequence
  Synthetic
tccatgtctatgttccatccttcgacgtgcgcggtcctcgcgactcattgataattcttgcagtcctggcctgcc

SEQ ID NO: 111529 - DNA, 75 bp, Artificial Sequence
  Synthetic
tccatgtctatgttccatccttcgacgtgcgcggtcctcgcgactcattgataattcttgcagtcctggcgtacc

SEQ ID NO: 111530 - DNA, 75 bp, Artificial Sequence
  Synthetic
tccatgtctatgttccatccttcgacgtgcgcggtcctcgcgactcattgataattcttgcagtcctggcgttcc

SEQ ID NO: 111531 - DNA, 75 bp, Artificial Sequence
  Synthetic
tccatgtctatgttccatccttcgacgtgcgcggtcctcgcgactcattgataattcttgcagtcctggcgtccc

SEQ ID NO: 111532 - DNA, 75 bp, Artificial Sequence
  Synthetic
tccatgtctatgttccatccttcgacgtgcgcggtcctcgcgactcattgataattcttgcagtcctggcgtgcc

SEQ ID NO: 111533 - DNA, 75 bp, Artificial Sequence
  Synthetic
tgcatgtctatgttccatccttcgacgtgcgcggtcctcgcgactcattgataattcttgcagtcctggcatacc

SEQ ID NO: 111534 - DNA, 75 bp, Artificial Sequence
  Synthetic
tgcatgtctatgttccatccttcgacgtgcgcggtcctcgcgactcattgataattcttgcagtcctggcattcc

SEQ ID NO: 111535 - DNA, 75 bp, Artificial Sequence
  Synthetic
tgcatgtctatgttccatccttcgacgtgcgcggtcctcgcgactcattgataattcttgcagtcctggcatccc

SEQ ID NO: 111536 - DNA, 75 bp, Artificial Sequence
  Synthetic
tgcatgtctatgttccatccttcgacgtgcgcggtcctcgcgactcattgataattcttgcagtcctggcatgcc

SEQ ID NO: 111537 - DNA, 75 bp, Artificial Sequence
  Synthetic
tgcatgtctatgttccatccttcgacgtgcgcggtcctcgcgactcattgataattcttgcagtcctggcttacc

SEQ ID NO: 111538 - DNA, 75 bp, Artificial Sequence
  Synthetic
tgcatgtctatgttccatccttcgacgtgcgcggtcctcgcgactcattgataattcttgcagtcctggctttcc

SEQ ID NO: 111539 - DNA, 75 bp, Artificial Sequence
  Synthetic
tgcatgtctatgttccatccttcgacgtgcgcggtcctcgcgactcattgataattcttgcagtcctggcttccc

SEQ ID NO: 111540 - DNA, 75 bp, Artificial Sequence
  Synthetic
tgcatgtctatgttccatccttcgacgtgcgcggtcctcgcgactcattgataattcttgcagtcctggcttgcc

SEQ ID NO: 111541 - DNA, 75 bp, Artificial Sequence
  Synthetic
tgcatgtctatgttccatccttcgacgtgcgcggtcctcgcgactcattgataattcttgcagtcctggcctacc

SEQ ID NO: 111542 - DNA, 75 bp, Artificial Sequence
  Synthetic
tgcatgtctatgttccatccttcgacgtgcgcggtcctcgcgactcattgataattcttgcagtcctggccttcc

SEQ ID NO: 111543 - DNA, 75 bp, Artificial Sequence
  Synthetic
tgcatgtctatgttccatccttcgacgtgcgcggtcctcgcgactcattgataattcttgcagtcctggcctccc

SEQ ID NO: 111544 - DNA, 75 bp, Artificial Sequence
  Synthetic
tgcatgtctatgttccatccttcgacgtgcgcggtcctcgcgactcattgataattcttgcagtcctggcctgcc

SEQ ID NO: 111545 - DNA, 75 bp, Artificial Sequence
  Synthetic
tgcatgtctatgttccatccttcgacgtgcgcggtcctcgcgactcattgataattcttgcagtcctggcgtacc

SEQ ID NO: 111546 - DNA, 75 bp, Artificial Sequence
  Synthetic
tgcatgtctatgttccatccttcgacgtgcgcggtcctcgcgactcattgataattcttgcagtcctggcgttcc

SEQ ID NO: 111547 - DNA, 75 bp, Artificial Sequence
  Synthetic
tgcatgtctatgttccatccttcgacgtgcgcggtcctcgcgactcattgataattcttgcagtcctggcgtccc

SEQ ID NO: 111548 - DNA, 75 bp, Artificial Sequence
  Synthetic
tgcatgtctatgttccatccttcgacgtgcgcggtcctcgcgactcattgataattcttgcagtcctggcgtgcc

SEQ ID NO: 111549 - DNA, 75 bp, Artificial Sequence
  Synthetic
atgcaacagggaatcttcccggttgctctttctctatcttccttttggcacttctctcgtgcctgactgtccccg

SEQ ID NO: 111550 - DNA, 75 bp, Artificial Sequence
  Synthetic
tctcagcacacaacaaaccatgctcttcaacatcttgggagggtgggtggccacccagttggcttcccccacggc

SEQ ID NO: 111551 - DNA, 75 bp, Artificial Sequence
  Synthetic
tctcagcacacaacaaaccttgctcttcaacatcttgggagggtgggtggccacccagttggcttcccccacggc

SEQ ID NO: 111552 - DNA, 75 bp, Artificial Sequence
  Synthetic
tctcagcacacaacaaaccctgctcttcaacatcttgggagggtgggtggccacccagttggcttcccccacggc

SEQ ID NO: 111553 - DNA, 75 bp, Artificial Sequence
  Synthetic
tctcagcacacaacaaaccgtgctcttcaacatcttgggagggtgggtggccacccagttggcttcccccacggc

SEQ ID NO: 111554 - DNA, 75 bp, Artificial Sequence
  Synthetic
tctcagcactcaacaaaccatgctcttcaacatcttgggagggtgggtggccacccagttggcttcccccacggc

SEQ ID NO: 111555 - DNA, 75 bp, Artificial Sequence
  Synthetic
tctcagcactcaacaaaccttgctcttcaacatcttgggagggtgggtggccacccagttggcttcccccacggc

SEQ ID NO: 111556 - DNA, 75 bp, Artificial Sequence
  Synthetic
tctcagcactcaacaaaccctgctcttcaacatcttgggagggtgggtggccacccagttggcttcccccacggc

SEQ ID NO: 111557 - DNA, 75 bp, Artificial Sequence
  Synthetic
tctcagcactcaacaaaccgtgctcttcaacatcttgggagggtgggtggccacccagttggcttcccccacggc

SEQ ID NO: 111558 - DNA, 75 bp, Artificial Sequence
  Synthetic
tctcagcacccaacaaaccatgctcttcaacatcttgggagggtgggtggccacccagttggcttcccccacggc

SEQ ID NO: 111559 - DNA, 75 bp, Artificial Sequence
  Synthetic
tctcagcacccaacaaaccttgctcttcaacatcttgggagggtgggtggccacccagttggcttcccccacggc

SEQ ID NO: 111560 - DNA, 75 bp, Artificial Sequence
  Synthetic
tctcagcacccaacaaaccctgctcttcaacatcttgggagggtgggtggccacccagttggcttcccccacggc

SEQ ID NO: 111561 - DNA, 75 bp, Artificial Sequence
  Synthetic
tctcagcacccaacaaaccgtgctcttcaacatcttgggagggtgggtggccacccagttggcttcccccacggc

SEQ ID NO: 111562 - DNA, 75 bp, Artificial Sequence
  Synthetic
tctcagcacgcaacaaaccatgctcttcaacatcttgggagggtgggtggccacccagttggcttcccccacggc

SEQ ID NO: 111563 - DNA, 75 bp, Artificial Sequence
  Synthetic
tctcagcacgcaacaaaccttgctcttcaacatcttgggagggtgggtggccacccagttggcttcccccacggc

SEQ ID NO: 111564 - DNA, 75 bp, Artificial Sequence
  Synthetic
tctcagcacgcaacaaaccctgctcttcaacatcttgggagggtgggtggccacccagttggcttcccccacggc

SEQ ID NO: 111565 - DNA, 75 bp, Artificial Sequence
  Synthetic
tctcagcacgcaacaaaccgtgctcttcaacatcttgggagggtgggtggccacccagttggcttcccccacggc

SEQ ID NO: 111566 - DNA, 75 bp, Artificial Sequence
  Synthetic
ctctacatactccaggcctcactactacgcgtcccttactttgtgagggcacacgcgctgattaagatctgcggc

SEQ ID NO: 111567 - DNA, 75 bp, Artificial Sequence
  Synthetic
ctctacatactccaggcctcacttctacgcgtcccttactttgtgagggcacacgcgctgattaagatctgcggc

SEQ ID NO: 111568 - DNA, 75 bp, Artificial Sequence
  Synthetic
ctctacatactccaggcctcactcctacgcgtcccttactttgtgagggcacacgcgctgattaagatctgcggc

SEQ ID NO: 111569 - DNA, 75 bp, Artificial Sequence
  Synthetic
ctctacatactccaggcctcactgctacgcgtcccttactttgtgagggcacacgcgctgattaagatctgcggc

SEQ ID NO: 111570 - DNA, 75 bp, Artificial Sequence
  Synthetic
ctctacattctccaggcctcactactacgcgtcccttactttgtgagggcacacgcgctgattaagatctgcggc

SEQ ID NO: 111571 - DNA, 75 bp, Artificial Sequence
  Synthetic
ctctacattctccaggcctcacttctacgcgtcccttactttgtgagggcacacgcgctgattaagatctgcggc

SEQ ID NO: 111572 - DNA, 75 bp, Artificial Sequence
  Synthetic
ctctacattctccaggcctcactcctacgcgtcccttactttgtgagggcacacgcgctgattaagatctgcggc

SEQ ID NO: 111573 - DNA, 75 bp, Artificial Sequence
  Synthetic
ctctacattctccaggcctcactgctacgcgtcccttactttgtgagggcacacgcgctgattaagatctgcggc

SEQ ID NO: 111574 - DNA, 75 bp, Artificial Sequence
  Synthetic
ctctacatcctccaggcctcactactacgcgtcccttactttgtgagggcacacgcgctgattaagatctgcggc

SEQ ID NO: 111575 - DNA, 75 bp, Artificial Sequence
  Synthetic
ctctacatcctccaggcctcacttctacgcgtcccttactttgtgagggcacacgcgctgattaagatctgcggc

SEQ ID NO: 111576 - DNA, 75 bp, Artificial Sequence
  Synthetic
ctctacatcctccaggcctcactcctacgcgtcccttactttgtgagggcacacgcgctgattaagatctgcggc

SEQ ID NO: 111577 - DNA, 75 bp, Artificial Sequence
  Synthetic
ctctacatcctccaggcctcactgctacgcgtcccttactttgtgagggcacacgcgctgattaagatctgcggc

SEQ ID NO: 111578 - DNA, 75 bp, Artificial Sequence
  Synthetic
ctctacatgctccaggcctcactactacgcgtcccttactttgtgagggcacacgcgctgattaagatctgcggc

SEQ ID NO: 111579 - DNA, 75 bp, Artificial Sequence
  Synthetic
ctctacatgctccaggcctcacttctacgcgtcccttactttgtgagggcacacgcgctgattaagatctgcggc

SEQ ID NO: 111580 - DNA, 75 bp, Artificial Sequence
  Synthetic
ctctacatgctccaggcctcactcctacgcgtcccttactttgtgagggcacacgcgctgattaagatctgcggc

SEQ ID NO: 111581 - DNA, 75 bp, Artificial Sequence
  Synthetic
ctctacatgctccaggcctcactgctacgcgtcccttactttgtgagggcacacgcgctgattaagatctgcggc

SEQ ID NO: 111582 - DNA, 75 bp, Artificial Sequence
  Synthetic
ctctacttactccaggcctcactactacgcgtcccttactttgtgagggcacacgcgctgattaagatctgcggc

SEQ ID NO: 111583 - DNA, 75 bp, Artificial Sequence
  Synthetic
ctctacttactccaggcctcacttctacgcgtcccttactttgtgagggcacacgcgctgattaagatctgcggc

SEQ ID NO: 111584 - DNA, 75 bp, Artificial Sequence
  Synthetic
ctctacttactccaggcctcactcctacgcgtcccttactttgtgagggcacacgcgctgattaagatctgcggc

SEQ ID NO: 111585 - DNA, 75 bp, Artificial Sequence
  Synthetic
ctctacttactccaggcctcactgctacgcgtcccttactttgtgagggcacacgcgctgattaagatctgcggc

SEQ ID NO: 111586 - DNA, 75 bp, Artificial Sequence
  Synthetic
ctctactttctccaggcctcactactacgcgtcccttactttgtgagggcacacgcgctgattaagatctgcggc

SEQ ID NO: 111587 - DNA, 75 bp, Artificial Sequence
  Synthetic
ctctactttctccaggcctcacttctacgcgtcccttactttgtgagggcacacgcgctgattaagatctgcggc

SEQ ID NO: 111588 - DNA, 75 bp, Artificial Sequence
  Synthetic
ctctactttctccaggcctcactcctacgcgtcccttactttgtgagggcacacgcgctgattaagatctgcggc

SEQ ID NO: 111589 - DNA, 75 bp, Artificial Sequence
  Synthetic
ctctactttctccaggcctcactgctacgcgtcccttactttgtgagggcacacgcgctgattaagatctgcggc

SEQ ID NO: 111590 - DNA, 75 bp, Artificial Sequence
  Synthetic
ctctacttcctccaggcctcactactacgcgtcccttactttgtgagggcacacgcgctgattaagatctgcggc

SEQ ID NO: 111591 - DNA, 75 bp, Artificial Sequence
  Synthetic
ctctacttcctccaggcctcacttctacgcgtcccttactttgtgagggcacacgcgctgattaagatctgcggc

SEQ ID NO: 111592 - DNA, 75 bp, Artificial Sequence
  Synthetic
ctctacttcctccaggcctcactcctacgcgtcccttactttgtgagggcacacgcgctgattaagatctgcggc

SEQ ID NO: 111593 - DNA, 75 bp, Artificial Sequence
  Synthetic
ctctacttcctccaggcctcactgctacgcgtcccttactttgtgagggcacacgcgctgattaagatctgcggc

SEQ ID NO: 111594 - DNA, 75 bp, Artificial Sequence
  Synthetic
ctctacttgctccaggcctcactactacgcgtcccttactttgtgagggcacacgcgctgattaagatctgcggc

SEQ ID NO: 111595 - DNA, 75 bp, Artificial Sequence
  Synthetic
ctctacttgctccaggcctcacttctacgcgtcccttactttgtgagggcacacgcgctgattaagatctgcggc

SEQ ID NO: 111596 - DNA, 75 bp, Artificial Sequence
  Synthetic
ctctacttgctccaggcctcactcctacgcgtcccttactttgtgagggcacacgcgctgattaagatctgcggc

SEQ ID NO: 111597 - DNA, 75 bp, Artificial Sequence
  Synthetic
ctctacttgctccaggcctcactgctacgcgtcccttactttgtgagggcacacgcgctgattaagatctgcggc

SEQ ID NO: 111598 - DNA, 75 bp, Artificial Sequence
  Synthetic
ctctacctactccaggcctcactactacgcgtcccttactttgtgagggcacacgcgctgattaagatctgcggc

SEQ ID NO: 111599 - DNA, 75 bp, Artificial Sequence
  Synthetic
ctctacctactccaggcctcacttctacgcgtcccttactttgtgagggcacacgcgctgattaagatctgcggc

SEQ ID NO: 111600 - DNA, 75 bp, Artificial Sequence
  Synthetic
ctctacctactccaggcctcactcctacgcgtcccttactttgtgagggcacacgcgctgattaagatctgcggc

SEQ ID NO: 111601 - DNA, 75 bp, Artificial Sequence
  Synthetic
ctctacctactccaggcctcactgctacgcgtcccttactttgtgagggcacacgcgctgattaagatctgcggc

SEQ ID NO: 111602 - DNA, 75 bp, Artificial Sequence
  Synthetic
ctctaccttctccaggcctcactactacgcgtcccttactttgtgagggcacacgcgctgattaagatctgcggc

SEQ ID NO: 111603 - DNA, 75 bp, Artificial Sequence
  Synthetic
ctctaccttctccaggcctcacttctacgcgtcccttactttgtgagggcacacgcgctgattaagatctgcggc

SEQ ID NO: 111604 - DNA, 75 bp, Artificial Sequence
  Synthetic
ctctaccttctccaggcctcactcctacgcgtcccttactttgtgagggcacacgcgctgattaagatctgcggc

SEQ ID NO: 111605 - DNA, 75 bp, Artificial Sequence
  Synthetic
ctctaccttctccaggcctcactgctacgcgtcccttactttgtgagggcacacgcgctgattaagatctgcggc

SEQ ID NO: 111606 - DNA, 75 bp, Artificial Sequence
  Synthetic
ctctacctcctccaggcctcactactacgcgtcccttactttgtgagggcacacgcgctgattaagatctgcggc

SEQ ID NO: 111607 - DNA, 75 bp, Artificial Sequence
  Synthetic
ctctacctcctccaggcctcacttctacgcgtcccttactttgtgagggcacacgcgctgattaagatctgcggc

SEQ ID NO: 111608 - DNA, 75 bp, Artificial Sequence
  Synthetic
ctctacctcctccaggcctcactcctacgcgtcccttactttgtgagggcacacgcgctgattaagatctgcggc

SEQ ID NO: 111609 - DNA, 75 bp, Artificial Sequence
  Synthetic
ctctacctcctccaggcctcactgctacgcgtcccttactttgtgagggcacacgcgctgattaagatctgcggc

SEQ ID NO: 111610 - DNA, 75 bp, Artificial Sequence
  Synthetic
ctctacctgctccaggcctcactactacgcgtcccttactttgtgagggcacacgcgctgattaagatctgcggc

SEQ ID NO: 111611 - DNA, 75 bp, Artificial Sequence
  Synthetic
ctctacctgctccaggcctcacttctacgcgtcccttactttgtgagggcacacgcgctgattaagatctgcggc

SEQ ID NO: 111612 - DNA, 75 bp, Artificial Sequence
  Synthetic
ctctacctgctccaggcctcactcctacgcgtcccttactttgtgagggcacacgcgctgattaagatctgcggc

SEQ ID NO: 111613 - DNA, 75 bp, Artificial Sequence
  Synthetic
ctctacctgctccaggcctcactgctacgcgtcccttactttgtgagggcacacgcgctgattaagatctgcggc

SEQ ID NO: 111614 - DNA, 75 bp, Artificial Sequence
  Synthetic
ctctacgtactccaggcctcactactacgcgtcccttactttgtgagggcacacgcgctgattaagatctgcggc

SEQ ID NO: 111615 - DNA, 75 bp, Artificial Sequence
  Synthetic
ctctacgtactccaggcctcacttctacgcgtcccttactttgtgagggcacacgcgctgattaagatctgcggc

SEQ ID NO: 111616 - DNA, 75 bp, Artificial Sequence
  Synthetic
ctctacgtactccaggcctcactcctacgcgtcccttactttgtgagggcacacgcgctgattaagatctgcggc

SEQ ID NO: 111617 - DNA, 75 bp, Artificial Sequence
  Synthetic
ctctacgtactccaggcctcactgctacgcgtcccttactttgtgagggcacacgcgctgattaagatctgcggc

SEQ ID NO: 111618 - DNA, 75 bp, Artificial Sequence
  Synthetic
ctctacgttctccaggcctcactactacgcgtcccttactttgtgagggcacacgcgctgattaagatctgcggc

SEQ ID NO: 111619 - DNA, 75 bp, Artificial Sequence
  Synthetic
ctctacgttctccaggcctcacttctacgcgtcccttactttgtgagggcacacgcgctgattaagatctgcggc

SEQ ID NO: 111620 - DNA, 75 bp, Artificial Sequence
  Synthetic
ctctacgttctccaggcctcactcctacgcgtcccttactttgtgagggcacacgcgctgattaagatctgcggc

SEQ ID NO: 111621 - DNA, 75 bp, Artificial Sequence
  Synthetic
ctctacgttctccaggcctcactgctacgcgtcccttactttgtgagggcacacgcgctgattaagatctgcggc

SEQ ID NO: 111622 - DNA, 75 bp, Artificial Sequence
  Synthetic
ctctacgtcctccaggcctcactactacgcgtcccttactttgtgagggcacacgcgctgattaagatctgcggc

SEQ ID NO: 111623 - DNA, 75 bp, Artificial Sequence
  Synthetic
ctctacgtcctccaggcctcacttctacgcgtcccttactttgtgagggcacacgcgctgattaagatctgcggc

SEQ ID NO: 111624 - DNA, 75 bp, Artificial Sequence
  Synthetic
ctctacgtcctccaggcctcactcctacgcgtcccttactttgtgagggcacacgcgctgattaagatctgcggc

SEQ ID NO: 111625 - DNA, 75 bp, Artificial Sequence
  Synthetic
ctctacgtcctccaggcctcactgctacgcgtcccttactttgtgagggcacacgcgctgattaagatctgcggc

SEQ ID NO: 111626 - DNA, 75 bp, Artificial Sequence
  Synthetic
ctctacgtgctccaggcctcactactacgcgtcccttactttgtgagggcacacgcgctgattaagatctgcggc

SEQ ID NO: 111627 - DNA, 75 bp, Artificial Sequence
  Synthetic
ctctacgtgctccaggcctcacttctacgcgtcccttactttgtgagggcacacgcgctgattaagatctgcggc

SEQ ID NO: 111628 - DNA, 75 bp, Artificial Sequence
  Synthetic
ctctacgtgctccaggcctcactcctacgcgtcccttactttgtgagggcacacgcgctgattaagatctgcggc

SEQ ID NO: 111629 - DNA, 75 bp, Artificial Sequence
  Synthetic
ctctacgtgctccaggcctcactgctacgcgtcccttactttgtgagggcacacgcgctgattaagatctgcggc

SEQ ID NO: 111630 - DNA, 75 bp, Artificial Sequence
  Synthetic
atcttaaatgcccgtgccaggtcccgtcgcccgaatttttcacagaattggacggggtgcgcctacataggtttg

SEQ ID NO: 111631 - DNA, 75 bp, Artificial Sequence
  Synthetic
gtcgcccgaatttttcacagaattggacggggtgcgcctacataggtttgcgcccccctgcaagcccttgctgcg

SEQ ID NO: 111632 - DNA, 75 bp, Artificial Sequence
  Synthetic
gtatctggagcattggtggctttcaaaatcatgagcggcgaatgccctagcactgaggacctagtcaacctctta

SEQ ID NO: 111633 - DNA, 75 bp, Artificial Sequence
  Synthetic
ttggagacatcgggcacgagcagtgcgcgccaagcttatcgcccaaggagggaaggccaaaatatgcggccttta

SEQ ID NO: 111634 - DNA, 75 bp, Artificial Sequence
  Synthetic
agatgttctctttccgaccacggcgccactggaccacccaggattgcaattgttccatctacacagggcacatca

SEQ ID NO: 111635 - DNA, 75 bp, Artificial Sequence
  Synthetic
ataggcttatcgccttcgcatcgcgcgggaaccatgtgtcaccgactcattacgtccccgagagcgacgctgccg

SEQ ID NO: 111636 - DNA, 75 bp, Artificial Sequence
  Synthetic
gtgcccgaacccgccatttgctgctttgcctactcctactaacggtaggggtaggcatcttcctcctgccagcac

SEQ ID NO: 111637 - DNA, 75 bp, Artificial Sequence
  Synthetic
tgcaattgctcaatctatcccggccacgtatcaggtcaccgcatggcttgggatatgatgatgaactggtcacct

SEQ ID NO: 111638 - DNA, 75 bp, Artificial Sequence
  Synthetic
tcctcggccagccagctgtccgctccatctctcaaggcaacttgcaccaccaaccatgactcccctgacgccgag

SEQ ID NO: 111639 - DNA, 75 bp, Artificial Sequence
  Synthetic
ttggttgtatgaggtctggaactggatttgcattgtgttgagcgactttaaaacgtggctatcatccaagctcat

SEQ ID NO: 111640 - DNA, 75 bp, Artificial Sequence
  Synthetic
tgcaagccaattgggccaaagtcatcttagtcctgttcctttttgcaggggttgatgccagcacctacacgaccg

SEQ ID NO: 111641 - DNA, 75 bp, Artificial Sequence
  Synthetic
actatctcaggccacgtgaagaacgggtcaatgagacttgtaggcccccgcaagtgcgccaatctctggcatggc

SEQ ID NO: 111642 - DNA, 75 bp, Artificial Sequence
  Synthetic
aaacaggacagccctcaactgcaatgacagcctaaacactgggttcttggctagcttgttctacgcccacaagtt

SEQ ID NO: 111643 - DNA, 75 bp, Artificial Sequence
  Synthetic
aaacaggactgccctcaactgcaatgacagcctaaacactgggttcttggctagcttgttctacgcccacaagtt

SEQ ID NO: 111644 - DNA, 75 bp, Artificial Sequence
  Synthetic
aaacaggaccgccctcaactgcaatgacagcctaaacactgggttcttggctagcttgttctacgcccacaagtt

SEQ ID NO: 111645 - DNA, 75 bp, Artificial Sequence
  Synthetic
aaacaggacggccctcaactgcaatgacagcctaaacactgggttcttggctagcttgttctacgcccacaagtt

SEQ ID NO: 111646 - DNA, 75 bp, Artificial Sequence
  Synthetic
agaggagctctcttgagccctagaccaatatccactcttaaagggtcctctggcggtccgctgctgtgccccatg

SEQ ID NO: 111647 - DNA, 75 bp, Artificial Sequence
  Synthetic
agaggagctctcttgagccctagaccaatatccactcttaatgggtcctctggcggtccgctgctgtgccccatg

SEQ ID NO: 111648 - DNA, 75 bp, Artificial Sequence
  Synthetic
agaggagctctcttgagccctagaccaatatccactcttaacgggtcctctggcggtccgctgctgtgccccatg

SEQ ID NO: 111649 - DNA, 75 bp, Artificial Sequence
  Synthetic
agaggagctctcttgagccctagaccaatatccactcttaaggggtcctctggcggtccgctgctgtgccccatg

SEQ ID NO: 111650 - DNA, 75 bp, Artificial Sequence
  Synthetic
agattactaaggtaggtgatttccactatgtcacaggcgtaactacagacaacctgaagtgtccgtgtcaagtgc

SEQ ID NO: 111651 - DNA, 75 bp, Artificial Sequence
  Synthetic
actttgcccaaggttggggcccactcaaagccgctaaaatcagcggcccgtctaatgaccggccttattgctggc

SEQ ID NO: 111652 - DNA, 75 bp, Artificial Sequence
  Synthetic
actttgcccaaggttggggcccactcaaagccgctaatatcagcggcccgtctaatgaccggccttattgctggc

SEQ ID NO: 111653 - DNA, 75 bp, Artificial Sequence
  Synthetic
actttgcccaaggttggggcccactcaaagccgctaacatcagcggcccgtctaatgaccggccttattgctggc

SEQ ID NO: 111654 - DNA, 75 bp, Artificial Sequence
  Synthetic
actttgcccaaggttggggcccactcaaagccgctaagatcagcggcccgtctaatgaccggccttattgctggc

SEQ ID NO: 111655 - DNA, 75 bp, Artificial Sequence
  Synthetic
actttgcccaaggttggggcccactcaatgccgctaaaatcagcggcccgtctaatgaccggccttattgctggc

SEQ ID NO: 111656 - DNA, 75 bp, Artificial Sequence
  Synthetic
actttgcccaaggttggggcccactcaatgccgctaatatcagcggcccgtctaatgaccggccttattgctggc

SEQ ID NO: 111657 - DNA, 75 bp, Artificial Sequence
  Synthetic
actttgcccaaggttggggcccactcaatgccgctaacatcagcggcccgtctaatgaccggccttattgctggc

SEQ ID NO: 111658 - DNA, 75 bp, Artificial Sequence
  Synthetic
actttgcccaaggttggggcccactcaatgccgctaagatcagcggcccgtctaatgaccggccttattgctggc

SEQ ID NO: 111659 - DNA, 75 bp, Artificial Sequence
  Synthetic
actttgcccaaggttggggcccactcaacgccgctaaaatcagcggcccgtctaatgaccggccttattgctggc

SEQ ID NO: 111660 - DNA, 75 bp, Artificial Sequence
  Synthetic
actttgcccaaggttggggcccactcaacgccgctaatatcagcggcccgtctaatgaccggccttattgctggc

SEQ ID NO: 111661 - DNA, 75 bp, Artificial Sequence
  Synthetic
actttgcccaaggttggggcccactcaacgccgctaacatcagcggcccgtctaatgaccggccttattgctggc

SEQ ID NO: 111662 - DNA, 75 bp, Artificial Sequence
  Synthetic
actttgcccaaggttggggcccactcaacgccgctaagatcagcggcccgtctaatgaccggccttattgctggc

SEQ ID NO: 111663 - DNA, 75 bp, Artificial Sequence
  Synthetic
actttgcccaaggttggggcccactcaaggccgctaaaatcagcggcccgtctaatgaccggccttattgctggc

SEQ ID NO: 111664 - DNA, 75 bp, Artificial Sequence
  Synthetic
actttgcccaaggttggggcccactcaaggccgctaatatcagcggcccgtctaatgaccggccttattgctggc

SEQ ID NO: 111665 - DNA, 75 bp, Artificial Sequence
  Synthetic
actttgcccaaggttggggcccactcaaggccgctaacatcagcggcccgtctaatgaccggccttattgctggc

SEQ ID NO: 111666 - DNA, 75 bp, Artificial Sequence
  Synthetic
actttgcccaaggttggggcccactcaaggccgctaagatcagcggcccgtctaatgaccggccttattgctggc

SEQ ID NO: 111667 - DNA, 75 bp, Artificial Sequence
  Synthetic
caccagtgttcactgacaactcaacaccccccgcggtgccgcagacctatcaggtagcacacctacatgcaccaa

SEQ ID NO: 111668 - DNA, 75 bp, Artificial Sequence
  Synthetic
caccagtgttcactgacaactcaacaccccccgcggtgccgcagacctatcaggtagcacaccttcatgcaccaa

SEQ ID NO: 111669 - DNA, 75 bp, Artificial Sequence
  Synthetic
caccagtgttcactgacaactcaacaccccccgcggtgccgcagacctatcaggtagcacacctccatgcaccaa

SEQ ID NO: 111670 - DNA, 75 bp, Artificial Sequence
  Synthetic
caccagtgttcactgacaactcaacaccccccgcggtgccgcagacctatcaggtagcacacctgcatgcaccaa

SEQ ID NO: 111671 - DNA, 75 bp, Artificial Sequence
  Synthetic
caccagtgttcactgacaactcaacaccccccgcggtgccgcagacctatcaggttgcacacctacatgcaccaa

SEQ ID NO: 111672 - DNA, 75 bp, Artificial Sequence
  Synthetic
caccagtgttcactgacaactcaacaccccccgcggtgccgcagacctatcaggttgcacaccttcatgcaccaa

SEQ ID NO: 111673 - DNA, 75 bp, Artificial Sequence
  Synthetic
caccagtgttcactgacaactcaacaccccccgcggtgccgcagacctatcaggttgcacacctccatgcaccaa

SEQ ID NO: 111674 - DNA, 75 bp, Artificial Sequence
  Synthetic
caccagtgttcactgacaactcaacaccccccgcggtgccgcagacctatcaggttgcacacctgcatgcaccaa

SEQ ID NO: 111675 - DNA, 75 bp, Artificial Sequence
  Synthetic
caccagtgttcactgacaactcaacaccccccgcggtgccgcagacctatcaggtcgcacacctacatgcaccaa

SEQ ID NO: 111676 - DNA, 75 bp, Artificial Sequence
  Synthetic
caccagtgttcactgacaactcaacaccccccgcggtgccgcagacctatcaggtcgcacaccttcatgcaccaa

SEQ ID NO: 111677 - DNA, 75 bp, Artificial Sequence
  Synthetic
caccagtgttcactgacaactcaacaccccccgcggtgccgcagacctatcaggtcgcacacctccatgcaccaa

SEQ ID NO: 111678 - DNA, 75 bp, Artificial Sequence
  Synthetic
caccagtgttcactgacaactcaacaccccccgcggtgccgcagacctatcaggtcgcacacctgcatgcaccaa

SEQ ID NO: 111679 - DNA, 75 bp, Artificial Sequence
  Synthetic
caccagtgttcactgacaactcaacaccccccgcggtgccgcagacctatcaggtggcacacctacatgcaccaa

SEQ ID NO: 111680 - DNA, 75 bp, Artificial Sequence
  Synthetic
caccagtgttcactgacaactcaacaccccccgcggtgccgcagacctatcaggtggcacaccttcatgcaccaa

SEQ ID NO: 111681 - DNA, 75 bp, Artificial Sequence
  Synthetic
caccagtgttcactgacaactcaacaccccccgcggtgccgcagacctatcaggtggcacacctccatgcaccaa

SEQ ID NO: 111682 - DNA, 75 bp, Artificial Sequence
  Synthetic
caccagtgttcactgacaactcaacaccccccgcggtgccgcagacctatcaggtggcacacctgcatgcaccaa

SEQ ID NO: 111683 - DNA, 75 bp, Artificial Sequence
  Synthetic
caccagtgttcactgacaactcaactccccccgcggtgccgcagacctatcaggtagcacacctacatgcaccaa

SEQ ID NO: 111684 - DNA, 75 bp, Artificial Sequence
  Synthetic
caccagtgttcactgacaactcaactccccccgcggtgccgcagacctatcaggtagcacaccttcatgcaccaa

SEQ ID NO: 111685 - DNA, 75 bp, Artificial Sequence
  Synthetic
caccagtgttcactgacaactcaactccccccgcggtgccgcagacctatcaggtagcacacctccatgcaccaa

SEQ ID NO: 111686 - DNA, 75 bp, Artificial Sequence
  Synthetic
caccagtgttcactgacaactcaactccccccgcggtgccgcagacctatcaggtagcacacctgcatgcaccaa

SEQ ID NO: 111687 - DNA, 75 bp, Artificial Sequence
  Synthetic
caccagtgttcactgacaactcaactccccccgcggtgccgcagacctatcaggttgcacacctacatgcaccaa

SEQ ID NO: 111688 - DNA, 75 bp, Artificial Sequence
  Synthetic
caccagtgttcactgacaactcaactccccccgcggtgccgcagacctatcaggttgcacaccttcatgcaccaa

SEQ ID NO: 111689 - DNA, 75 bp, Artificial Sequence
  Synthetic
caccagtgttcactgacaactcaactccccccgcggtgccgcagacctatcaggttgcacacctccatgcaccaa

SEQ ID NO: 111690 - DNA, 75 bp, Artificial Sequence
  Synthetic
caccagtgttcactgacaactcaactccccccgcggtgccgcagacctatcaggttgcacacctgcatgcaccaa

SEQ ID NO: 111691 - DNA, 75 bp, Artificial Sequence
  Synthetic
caccagtgttcactgacaactcaactccccccgcggtgccgcagacctatcaggtcgcacacctacatgcaccaa

SEQ ID NO: 111692 - DNA, 75 bp, Artificial Sequence
  Synthetic
caccagtgttcactgacaactcaactccccccgcggtgccgcagacctatcaggtcgcacaccttcatgcaccaa

SEQ ID NO: 111693 - DNA, 75 bp, Artificial Sequence
  Synthetic
caccagtgttcactgacaactcaactccccccgcggtgccgcagacctatcaggtcgcacacctccatgcaccaa

SEQ ID NO: 111694 - DNA, 75 bp, Artificial Sequence
  Synthetic
caccagtgttcactgacaactcaactccccccgcggtgccgcagacctatcaggtcgcacacctgcatgcaccaa

SEQ ID NO: 111695 - DNA, 75 bp, Artificial Sequence
  Synthetic
caccagtgttcactgacaactcaactccccccgcggtgccgcagacctatcaggtggcacacctacatgcaccaa

SEQ ID NO: 111696 - DNA, 75 bp, Artificial Sequence
  Synthetic
caccagtgttcactgacaactcaactccccccgcggtgccgcagacctatcaggtggcacaccttcatgcaccaa

SEQ ID NO: 111697 - DNA, 75 bp, Artificial Sequence
  Synthetic
caccagtgttcactgacaactcaactccccccgcggtgccgcagacctatcaggtggcacacctccatgcaccaa

SEQ ID NO: 111698 - DNA, 75 bp, Artificial Sequence
  Synthetic
caccagtgttcactgacaactcaactccccccgcggtgccgcagacctatcaggtggcacacctgcatgcaccaa

SEQ ID NO: 111699 - DNA, 75 bp, Artificial Sequence
  Synthetic
caccagtgttcactgacaactcaaccccccccgcggtgccgcagacctatcaggtagcacacctacatgcaccaa

SEQ ID NO: 111700 - DNA, 75 bp, Artificial Sequence
  Synthetic
caccagtgttcactgacaactcaaccccccccgcggtgccgcagacctatcaggtagcacaccttcatgcaccaa

SEQ ID NO: 111701 - DNA, 75 bp, Artificial Sequence
  Synthetic
caccagtgttcactgacaactcaaccccccccgcggtgccgcagacctatcaggtagcacacctccatgcaccaa

SEQ ID NO: 111702 - DNA, 75 bp, Artificial Sequence
  Synthetic
caccagtgttcactgacaactcaaccccccccgcggtgccgcagacctatcaggtagcacacctgcatgcaccaa

SEQ ID NO: 111703 - DNA, 75 bp, Artificial Sequence
  Synthetic
caccagtgttcactgacaactcaaccccccccgcggtgccgcagacctatcaggttgcacacctacatgcaccaa

SEQ ID NO: 111704 - DNA, 75 bp, Artificial Sequence
  Synthetic
caccagtgttcactgacaactcaaccccccccgcggtgccgcagacctatcaggttgcacaccttcatgcaccaa

SEQ ID NO: 111705 - DNA, 75 bp, Artificial Sequence
  Synthetic
caccagtgttcactgacaactcaaccccccccgcggtgccgcagacctatcaggttgcacacctccatgcaccaa

SEQ ID NO: 111706 - DNA, 75 bp, Artificial Sequence
  Synthetic
caccagtgttcactgacaactcaaccccccccgcggtgccgcagacctatcaggttgcacacctgcatgcaccaa

SEQ ID NO: 111707 - DNA, 75 bp, Artificial Sequence
  Synthetic
caccagtgttcactgacaactcaaccccccccgcggtgccgcagacctatcaggtcgcacacctacatgcaccaa

SEQ ID NO: 111708 - DNA, 75 bp, Artificial Sequence
  Synthetic
caccagtgttcactgacaactcaaccccccccgcggtgccgcagacctatcaggtcgcacaccttcatgcaccaa

SEQ ID NO: 111709 - DNA, 75 bp, Artificial Sequence
  Synthetic
caccagtgttcactgacaactcaaccccccccgcggtgccgcagacctatcaggtcgcacacctccatgcaccaa

SEQ ID NO: 111710 - DNA, 75 bp, Artificial Sequence
  Synthetic
caccagtgttcactgacaactcaaccccccccgcggtgccgcagacctatcaggtcgcacacctgcatgcaccaa

SEQ ID NO: 111711 - DNA, 75 bp, Artificial Sequence
  Synthetic
caccagtgttcactgacaactcaaccccccccgcggtgccgcagacctatcaggtggcacacctacatgcaccaa

SEQ ID NO: 111712 - DNA, 75 bp, Artificial Sequence
  Synthetic
caccagtgttcactgacaactcaaccccccccgcggtgccgcagacctatcaggtggcacaccttcatgcaccaa

SEQ ID NO: 111713 - DNA, 75 bp, Artificial Sequence
  Synthetic
caccagtgttcactgacaactcaaccccccccgcggtgccgcagacctatcaggtggcacacctccatgcaccaa

SEQ ID NO: 111714 - DNA, 75 bp, Artificial Sequence
  Synthetic
caccagtgttcactgacaactcaaccccccccgcggtgccgcagacctatcaggtggcacacctgcatgcaccaa

SEQ ID NO: 111715 - DNA, 75 bp, Artificial Sequence
  Synthetic
caccagtgttcactgacaactcaacgccccccgcggtgccgcagacctatcaggtagcacacctacatgcaccaa

SEQ ID NO: 111716 - DNA, 75 bp, Artificial Sequence
  Synthetic
caccagtgttcactgacaactcaacgccccccgcggtgccgcagacctatcaggtagcacaccttcatgcaccaa

SEQ ID NO: 111717 - DNA, 75 bp, Artificial Sequence
  Synthetic
caccagtgttcactgacaactcaacgccccccgcggtgccgcagacctatcaggtagcacacctccatgcaccaa

SEQ ID NO: 111718 - DNA, 75 bp, Artificial Sequence
  Synthetic
caccagtgttcactgacaactcaacgccccccgcggtgccgcagacctatcaggtagcacacctgcatgcaccaa

SEQ ID NO: 111719 - DNA, 75 bp, Artificial Sequence
  Synthetic
caccagtgttcactgacaactcaacgccccccgcggtgccgcagacctatcaggttgcacacctacatgcaccaa

SEQ ID NO: 111720 - DNA, 75 bp, Artificial Sequence
  Synthetic
caccagtgttcactgacaactcaacgccccccgcggtgccgcagacctatcaggttgcacaccttcatgcaccaa

SEQ ID NO: 111721 - DNA, 75 bp, Artificial Sequence
  Synthetic
caccagtgttcactgacaactcaacgccccccgcggtgccgcagacctatcaggttgcacacctccatgcaccaa

SEQ ID NO: 111722 - DNA, 75 bp, Artificial Sequence
  Synthetic
caccagtgttcactgacaactcaacgccccccgcggtgccgcagacctatcaggttgcacacctgcatgcaccaa

SEQ ID NO: 111723 - DNA, 75 bp, Artificial Sequence
  Synthetic
caccagtgttcactgacaactcaacgccccccgcggtgccgcagacctatcaggtcgcacacctacatgcaccaa

SEQ ID NO: 111724 - DNA, 75 bp, Artificial Sequence
  Synthetic
caccagtgttcactgacaactcaacgccccccgcggtgccgcagacctatcaggtcgcacaccttcatgcaccaa

SEQ ID NO: 111725 - DNA, 75 bp, Artificial Sequence
  Synthetic
caccagtgttcactgacaactcaacgccccccgcggtgccgcagacctatcaggtcgcacacctccatgcaccaa

SEQ ID NO: 111726 - DNA, 75 bp, Artificial Sequence
  Synthetic
caccagtgttcactgacaactcaacgccccccgcggtgccgcagacctatcaggtcgcacacctgcatgcaccaa

SEQ ID NO: 111727 - DNA, 75 bp, Artificial Sequence
  Synthetic
caccagtgttcactgacaactcaacgccccccgcggtgccgcagacctatcaggtggcacacctacatgcaccaa

SEQ ID NO: 111728 - DNA, 75 bp, Artificial Sequence
  Synthetic
caccagtgttcactgacaactcaacgccccccgcggtgccgcagacctatcaggtggcacaccttcatgcaccaa

SEQ ID NO: 111729 - DNA, 75 bp, Artificial Sequence
  Synthetic
caccagtgttcactgacaactcaacgccccccgcggtgccgcagacctatcaggtggcacacctccatgcaccaa

SEQ ID NO: 111730 - DNA, 75 bp, Artificial Sequence
  Synthetic
caccagtgttcactgacaactcaacgccccccgcggtgccgcagacctatcaggtggcacacctgcatgcaccaa

SEQ ID NO: 111731 - DNA, 75 bp, Artificial Sequence
  Synthetic
gttgcacagctacgtaattggctctcagctcccctgtgagccggaaccagatgtgactgtggtaacatccatgct

SEQ ID NO: 111732 - DNA, 75 bp, Artificial Sequence
  Synthetic
catcaacgcactgagcaactcgttgctgcgtcaccacaatctggtgtattccaccacctcacgcagtgcttgcct

SEQ ID NO: 111733 - DNA, 75 bp, Artificial Sequence
  Synthetic
ggcgtacatgtccaaggcatacggcattgacccgaacatacggtcaggagtcaggaccatcactacgggtgcgcc

SEQ ID NO: 111734 - DNA, 75 bp, Artificial Sequence
  Synthetic
ggcgtacatgtccaaggcatacggcattgacccgaacattcggtcaggagtcaggaccatcactacgggtgcgcc

SEQ ID NO: 111735 - DNA, 75 bp, Artificial Sequence
  Synthetic
ggcgtacatgtccaaggcatacggcattgacccgaacatccggtcaggagtcaggaccatcactacgggtgcgcc

SEQ ID NO: 111736 - DNA, 75 bp, Artificial Sequence
  Synthetic
ggcgtacatgtccaaggcatacggcattgacccgaacatgcggtcaggagtcaggaccatcactacgggtgcgcc

SEQ ID NO: 111737 - DNA, 75 bp, Artificial Sequence
  Synthetic
cctgcggcgctcctccatgcgaggttaccgccaatggtacatcctggtactgccccaccgattgcttcaggaagc

SEQ ID NO: 111738 - DNA, 75 bp, Artificial Sequence
  Synthetic
ccctctttgcgggcaacctgccacacccatggcgggttgcctgactcggagctagtagatgccaacttactgtgg

SEQ ID NO: 111739 - DNA, 75 bp, Artificial Sequence
  Synthetic
acaacaatccttggcataggcacagtcctggaccaagcggagaccgctggagtgcgcctcgtcgtgctcgcgacc

SEQ ID NO: 111740 - DNA, 75 bp, Artificial Sequence
  Synthetic
acaacaatccttggcataggcactgtcctggaccaagcggagaccgctggagtgcgcctcgtcgtgctcgcgacc

SEQ ID NO: 111741 - DNA, 75 bp, Artificial Sequence
  Synthetic
acaacaatccttggcataggcaccgtcctggaccaagcggagaccgctggagtgcgcctcgtcgtgctcgcgacc

SEQ ID NO: 111742 - DNA, 75 bp, Artificial Sequence
  Synthetic
acaacaatccttggcataggcacggtcctggaccaagcggagaccgctggagtgcgcctcgtcgtgctcgcgacc

SEQ ID NO: 111743 - DNA, 75 bp, Artificial Sequence
  Synthetic
caacttcactgtctttaagatcaggacatttgtcggcggtatagagcatcggatgcaggcggcatgcaactggac

SEQ ID NO: 111744 - DNA, 75 bp, Artificial Sequence
  Synthetic
agatctcggtgccggctgactgcttcaaaaaaccgccgcactatccaccagctctcccaatttgggcccgaccgg

SEQ ID NO: 111745 - DNA, 75 bp, Artificial Sequence
  Synthetic
ctcgtggcctttaaggtcatgagcggcgagatgccctccaccgaggacctggtcaacttactccctgccatcctc

SEQ ID NO: 111746 - DNA, 75 bp, Artificial Sequence
  Synthetic
ctggagcgcggctcgtcgtgctcgccaccgctacacctccgggatcggtcaccgtgccacaccccaacatcgagg

SEQ ID NO: 111747 - DNA, 75 bp, Artificial Sequence
  Synthetic
ccctcctcgcaagaagaggacaatcgctctaagtgagtcaacagtggcctcggagttagcccgcctagctactac

SEQ ID NO: 111748 - DNA, 75 bp, Artificial Sequence
  Synthetic
ggcgaaggtcctggtagtgttgatgctgtttgccggcgttgatgcggagacccacgtctccgggggaactgccgc

SEQ ID NO: 111749 - DNA, 75 bp, Artificial Sequence
  Synthetic
ctgcattgcctggcatatcaagggccggctaccagctgctgcaacctacgcggcctgcggaatgtggcccctgct

SEQ ID NO: 111750 - DNA, 75 bp, Artificial Sequence
  Synthetic
ctgcattgcctggcatatcaagggccggctaccagctgctgctacctacgcggcctgcggaatgtggcccctgct

SEQ ID NO: 111751 - DNA, 75 bp, Artificial Sequence
  Synthetic
ctgcattgcctggcatatcaagggccggctaccagctgctgccacctacgcggcctgcggaatgtggcccctgct

SEQ ID NO: 111752 - DNA, 75 bp, Artificial Sequence
  Synthetic
ctgcattgcctggcatatcaagggccggctaccagctgctgcgacctacgcggcctgcggaatgtggcccctgct

SEQ ID NO: 111753 - DNA, 75 bp, Artificial Sequence
  Synthetic
ctgcattgcctggcatatcaagggccggcttccagctgctgcaacctacgcggcctgcggaatgtggcccctgct

SEQ ID NO: 111754 - DNA, 75 bp, Artificial Sequence
  Synthetic
ctgcattgcctggcatatcaagggccggcttccagctgctgctacctacgcggcctgcggaatgtggcccctgct

SEQ ID NO: 111755 - DNA, 75 bp, Artificial Sequence
  Synthetic
ctgcattgcctggcatatcaagggccggcttccagctgctgccacctacgcggcctgcggaatgtggcccctgct

SEQ ID NO: 111756 - DNA, 75 bp, Artificial Sequence
  Synthetic
ctgcattgcctggcatatcaagggccggcttccagctgctgcgacctacgcggcctgcggaatgtggcccctgct

SEQ ID NO: 111757 - DNA, 75 bp, Artificial Sequence
  Synthetic
ctgcattgcctggcatatcaagggccggctcccagctgctgcaacctacgcggcctgcggaatgtggcccctgct

SEQ ID NO: 111758 - DNA, 75 bp, Artificial Sequence
  Synthetic
ctgcattgcctggcatatcaagggccggctcccagctgctgctacctacgcggcctgcggaatgtggcccctgct

SEQ ID NO: 111759 - DNA, 75 bp, Artificial Sequence
  Synthetic
ctgcattgcctggcatatcaagggccggctcccagctgctgccacctacgcggcctgcggaatgtggcccctgct

SEQ ID NO: 111760 - DNA, 75 bp, Artificial Sequence
  Synthetic
ctgcattgcctggcatatcaagggccggctcccagctgctgcgacctacgcggcctgcggaatgtggcccctgct

SEQ ID NO: 111761 - DNA, 75 bp, Artificial Sequence
  Synthetic
ctgcattgcctggcatatcaagggccggctgccagctgctgcaacctacgcggcctgcggaatgtggcccctgct

SEQ ID NO: 111762 - DNA, 75 bp, Artificial Sequence
  Synthetic
ctgcattgcctggcatatcaagggccggctgccagctgctgctacctacgcggcctgcggaatgtggcccctgct

SEQ ID NO: 111763 - DNA, 75 bp, Artificial Sequence
  Synthetic
ctgcattgcctggcatatcaagggccggctgccagctgctgccacctacgcggcctgcggaatgtggcccctgct

SEQ ID NO: 111764 - DNA, 75 bp, Artificial Sequence
  Synthetic
ctgcattgcctggcatatcaagggccggctgccagctgctgcgacctacgcggcctgcggaatgtggcccctgct

SEQ ID NO: 111765 - DNA, 75 bp, Artificial Sequence
  Synthetic
gcatccgacgccgggtcgtggtcttccatgcccccccttgagggcgagcctggggatcctgacttgagcgcgggc

SEQ ID NO: 111766 - DNA, 75 bp, Artificial Sequence
  Synthetic
ttgtctccacactacaagtcgtggctggcaagaggactgtggtggatccaatatttcatagcaaggacagaggct

SEQ ID NO: 111767 - DNA, 75 bp, Artificial Sequence
  Synthetic
ttgtctccacactacaagtcgtggctggcaagaggactgtggtggatccaatatttcatagcaaggactgaggct

SEQ ID NO: 111768 - DNA, 75 bp, Artificial Sequence
  Synthetic
ttgtctccacactacaagtcgtggctggcaagaggactgtggtggatccaatatttcatagcaaggaccgaggct

SEQ ID NO: 111769 - DNA, 75 bp, Artificial Sequence
  Synthetic
ttgtctccacactacaagtcgtggctggcaagaggactgtggtggatccaatatttcatagcaaggacggaggct

SEQ ID NO: 111770 - DNA, 75 bp, Artificial Sequence
  Synthetic
ttgtctccacactacaagtcgtggctggcaagaggactgtggtggatccaatatttcatagctaggacagaggct

SEQ ID NO: 111771 - DNA, 75 bp, Artificial Sequence
  Synthetic
ttgtctccacactacaagtcgtggctggcaagaggactgtggtggatccaatatttcatagctaggactgaggct

SEQ ID NO: 111772 - DNA, 75 bp, Artificial Sequence
  Synthetic
ttgtctccacactacaagtcgtggctggcaagaggactgtggtggatccaatatttcatagctaggaccgaggct

SEQ ID NO: 111773 - DNA, 75 bp, Artificial Sequence
  Synthetic
ttgtctccacactacaagtcgtggctggcaagaggactgtggtggatccaatatttcatagctaggacggaggct

SEQ ID NO: 111774 - DNA, 75 bp, Artificial Sequence
  Synthetic
ttgtctccacactacaagtcgtggctggcaagaggactgtggtggatccaatatttcatagccaggacagaggct

SEQ ID NO: 111775 - DNA, 75 bp, Artificial Sequence
  Synthetic
ttgtctccacactacaagtcgtggctggcaagaggactgtggtggatccaatatttcatagccaggactgaggct

SEQ ID NO: 111776 - DNA, 75 bp, Artificial Sequence
  Synthetic
ttgtctccacactacaagtcgtggctggcaagaggactgtggtggatccaatatttcatagccaggaccgaggct

SEQ ID NO: 111777 - DNA, 75 bp, Artificial Sequence
  Synthetic
ttgtctccacactacaagtcgtggctggcaagaggactgtggtggatccaatatttcatagccaggacggaggct

SEQ ID NO: 111778 - DNA, 75 bp, Artificial Sequence
  Synthetic
ttgtctccacactacaagtcgtggctggcaagaggactgtggtggatccaatatttcatagcgaggacagaggct

SEQ ID NO: 111779 - DNA, 75 bp, Artificial Sequence
  Synthetic
ttgtctccacactacaagtcgtggctggcaagaggactgtggtggatccaatatttcatagcgaggactgaggct

SEQ ID NO: 111780 - DNA, 75 bp, Artificial Sequence
  Synthetic
ttgtctccacactacaagtcgtggctggcaagaggactgtggtggatccaatatttcatagcgaggaccgaggct

SEQ ID NO: 111781 - DNA, 75 bp, Artificial Sequence
  Synthetic
ttgtctccacactacaagtcgtggctggcaagaggactgtggtggatccaatatttcatagcgaggacggaggct

SEQ ID NO: 111782 - DNA, 75 bp, Artificial Sequence
  Synthetic
ttgtctccacactacaagtcgtggctggctagaggactgtggtggatccaatatttcatagcaaggacagaggct

SEQ ID NO: 111783 - DNA, 75 bp, Artificial Sequence
  Synthetic
ttgtctccacactacaagtcgtggctggctagaggactgtggtggatccaatatttcatagcaaggactgaggct

SEQ ID NO: 111784 - DNA, 75 bp, Artificial Sequence
  Synthetic
ttgtctccacactacaagtcgtggctggctagaggactgtggtggatccaatatttcatagcaaggaccgaggct

SEQ ID NO: 111785 - DNA, 75 bp, Artificial Sequence
  Synthetic
ttgtctccacactacaagtcgtggctggctagaggactgtggtggatccaatatttcatagcaaggacggaggct

SEQ ID NO: 111786 - DNA, 75 bp, Artificial Sequence
  Synthetic
ttgtctccacactacaagtcgtggctggctagaggactgtggtggatccaatatttcatagctaggacagaggct

SEQ ID NO: 111787 - DNA, 75 bp, Artificial Sequence
  Synthetic
ttgtctccacactacaagtcgtggctggctagaggactgtggtggatccaatatttcatagctaggactgaggct

SEQ ID NO: 111788 - DNA, 75 bp, Artificial Sequence
  Synthetic
ttgtctccacactacaagtcgtggctggctagaggactgtggtggatccaatatttcatagctaggaccgaggct

SEQ ID NO: 111789 - DNA, 75 bp, Artificial Sequence
  Synthetic
ttgtctccacactacaagtcgtggctggctagaggactgtggtggatccaatatttcatagctaggacggaggct

SEQ ID NO: 111790 - DNA, 75 bp, Artificial Sequence
  Synthetic
ttgtctccacactacaagtcgtggctggctagaggactgtggtggatccaatatttcatagccaggacagaggct

SEQ ID NO: 111791 - DNA, 75 bp, Artificial Sequence
  Synthetic
ttgtctccacactacaagtcgtggctggctagaggactgtggtggatccaatatttcatagccaggactgaggct

SEQ ID NO: 111792 - DNA, 75 bp, Artificial Sequence
  Synthetic
ttgtctccacactacaagtcgtggctggctagaggactgtggtggatccaatatttcatagccaggaccgaggct

SEQ ID NO: 111793 - DNA, 75 bp, Artificial Sequence
  Synthetic
ttgtctccacactacaagtcgtggctggctagaggactgtggtggatccaatatttcatagccaggacggaggct

SEQ ID NO: 111794 - DNA, 75 bp, Artificial Sequence
  Synthetic
ttgtctccacactacaagtcgtggctggctagaggactgtggtggatccaatatttcatagcgaggacagaggct

SEQ ID NO: 111795 - DNA, 75 bp, Artificial Sequence
  Synthetic
ttgtctccacactacaagtcgtggctggctagaggactgtggtggatccaatatttcatagcgaggactgaggct

SEQ ID NO: 111796 - DNA, 75 bp, Artificial Sequence
  Synthetic
ttgtctccacactacaagtcgtggctggctagaggactgtggtggatccaatatttcatagcgaggaccgaggct

SEQ ID NO: 111797 - DNA, 75 bp, Artificial Sequence
  Synthetic
ttgtctccacactacaagtcgtggctggctagaggactgtggtggatccaatatttcatagcgaggacggaggct

SEQ ID NO: 111798 - DNA, 75 bp, Artificial Sequence
  Synthetic
ttgtctccacactacaagtcgtggctggccagaggactgtggtggatccaatatttcatagcaaggacagaggct

SEQ ID NO: 111799 - DNA, 75 bp, Artificial Sequence
  Synthetic
ttgtctccacactacaagtcgtggctggccagaggactgtggtggatccaatatttcatagcaaggactgaggct

SEQ ID NO: 111800 - DNA, 75 bp, Artificial Sequence
  Synthetic
ttgtctccacactacaagtcgtggctggccagaggactgtggtggatccaatatttcatagcaaggaccgaggct

SEQ ID NO: 111801 - DNA, 75 bp, Artificial Sequence
  Synthetic
ttgtctccacactacaagtcgtggctggccagaggactgtggtggatccaatatttcatagcaaggacggaggct

SEQ ID NO: 111802 - DNA, 75 bp, Artificial Sequence
  Synthetic
ttgtctccacactacaagtcgtggctggccagaggactgtggtggatccaatatttcatagctaggacagaggct

SEQ ID NO: 111803 - DNA, 75 bp, Artificial Sequence
  Synthetic
ttgtctccacactacaagtcgtggctggccagaggactgtggtggatccaatatttcatagctaggactgaggct

SEQ ID NO: 111804 - DNA, 75 bp, Artificial Sequence
  Synthetic
ttgtctccacactacaagtcgtggctggccagaggactgtggtggatccaatatttcatagctaggaccgaggct

SEQ ID NO: 111805 - DNA, 75 bp, Artificial Sequence
  Synthetic
ttgtctccacactacaagtcgtggctggccagaggactgtggtggatccaatatttcatagctaggacggaggct

SEQ ID NO: 111806 - DNA, 75 bp, Artificial Sequence
  Synthetic
ttgtctccacactacaagtcgtggctggccagaggactgtggtggatccaatatttcatagccaggacagaggct

SEQ ID NO: 111807 - DNA, 75 bp, Artificial Sequence
  Synthetic
ttgtctccacactacaagtcgtggctggccagaggactgtggtggatccaatatttcatagccaggactgaggct

SEQ ID NO: 111808 - DNA, 75 bp, Artificial Sequence
  Synthetic
ttgtctccacactacaagtcgtggctggccagaggactgtggtggatccaatatttcatagccaggaccgaggct

SEQ ID NO: 111809 - DNA, 75 bp, Artificial Sequence
  Synthetic
ttgtctccacactacaagtcgtggctggccagaggactgtggtggatccaatatttcatagccaggacggaggct

SEQ ID NO: 111810 - DNA, 75 bp, Artificial Sequence
  Synthetic
ttgtctccacactacaagtcgtggctggccagaggactgtggtggatccaatatttcatagcgaggacagaggct

SEQ ID NO: 111811 - DNA, 75 bp, Artificial Sequence
  Synthetic
ttgtctccacactacaagtcgtggctggccagaggactgtggtggatccaatatttcatagcgaggactgaggct

SEQ ID NO: 111812 - DNA, 75 bp, Artificial Sequence
  Synthetic
ttgtctccacactacaagtcgtggctggccagaggactgtggtggatccaatatttcatagcgaggaccgaggct

SEQ ID NO: 111813 - DNA, 75 bp, Artificial Sequence
  Synthetic
ttgtctccacactacaagtcgtggctggccagaggactgtggtggatccaatatttcatagcgaggacggaggct

SEQ ID NO: 111814 - DNA, 75 bp, Artificial Sequence
  Synthetic
ttgtctccacactacaagtcgtggctggcgagaggactgtggtggatccaatatttcatagcaaggacagaggct

SEQ ID NO: 111815 - DNA, 75 bp, Artificial Sequence
  Synthetic
ttgtctccacactacaagtcgtggctggcgagaggactgtggtggatccaatatttcatagcaaggactgaggct

SEQ ID NO: 111816 - DNA, 75 bp, Artificial Sequence
  Synthetic
ttgtctccacactacaagtcgtggctggcgagaggactgtggtggatccaatatttcatagcaaggaccgaggct

SEQ ID NO: 111817 - DNA, 75 bp, Artificial Sequence
  Synthetic
ttgtctccacactacaagtcgtggctggcgagaggactgtggtggatccaatatttcatagcaaggacggaggct

SEQ ID NO: 111818 - DNA, 75 bp, Artificial Sequence
  Synthetic
ttgtctccacactacaagtcgtggctggcgagaggactgtggtggatccaatatttcatagctaggacagaggct

SEQ ID NO: 111819 - DNA, 75 bp, Artificial Sequence
  Synthetic
ttgtctccacactacaagtcgtggctggcgagaggactgtggtggatccaatatttcatagctaggactgaggct

SEQ ID NO: 111820 - DNA, 75 bp, Artificial Sequence
  Synthetic
ttgtctccacactacaagtcgtggctggcgagaggactgtggtggatccaatatttcatagctaggaccgaggct

SEQ ID NO: 111821 - DNA, 75 bp, Artificial Sequence
  Synthetic
ttgtctccacactacaagtcgtggctggcgagaggactgtggtggatccaatatttcatagctaggacggaggct

SEQ ID NO: 111822 - DNA, 75 bp, Artificial Sequence
  Synthetic
ttgtctccacactacaagtcgtggctggcgagaggactgtggtggatccaatatttcatagccaggacagaggct

SEQ ID NO: 111823 - DNA, 75 bp, Artificial Sequence
  Synthetic
ttgtctccacactacaagtcgtggctggcgagaggactgtggtggatccaatatttcatagccaggactgaggct

SEQ ID NO: 111824 - DNA, 75 bp, Artificial Sequence
  Synthetic
ttgtctccacactacaagtcgtggctggcgagaggactgtggtggatccaatatttcatagccaggaccgaggct

SEQ ID NO: 111825 - DNA, 75 bp, Artificial Sequence
  Synthetic
ttgtctccacactacaagtcgtggctggcgagaggactgtggtggatccaatatttcatagccaggacggaggct

SEQ ID NO: 111826 - DNA, 75 bp, Artificial Sequence
  Synthetic
ttgtctccacactacaagtcgtggctggcgagaggactgtggtggatccaatatttcatagcgaggacagaggct

SEQ ID NO: 111827 - DNA, 75 bp, Artificial Sequence
  Synthetic
ttgtctccacactacaagtcgtggctggcgagaggactgtggtggatccaatatttcatagcgaggactgaggct

SEQ ID NO: 111828 - DNA, 75 bp, Artificial Sequence
  Synthetic
ttgtctccacactacaagtcgtggctggcgagaggactgtggtggatccaatatttcatagcgaggaccgaggct

SEQ ID NO: 111829 - DNA, 75 bp, Artificial Sequence
  Synthetic
ttgtctccacactacaagtcgtggctggcgagaggactgtggtggatccaatatttcatagcgaggacggaggct

SEQ ID NO: 111830 - DNA, 75 bp, Artificial Sequence
  Synthetic
ctgaggaggagaaactccccataagcccactaagtaactcacttataagacatcacaaccttgtgtattccacat

SEQ ID NO: 111831 - DNA, 75 bp, Artificial Sequence
  Synthetic
caaaatatctcatggccatcttgggccccctttacatactccaggcctcactcctacgcgtcccatactttgtga

SEQ ID NO: 111832 - DNA, 75 bp, Artificial Sequence
  Synthetic
caaaatatctcatggccatcttgggccccctttacatactccaggcctcactcctacgcgtcccttactttgtga

SEQ ID NO: 111833 - DNA, 75 bp, Artificial Sequence
  Synthetic
caaaatatctcatggccatcttgggccccctttacatactccaggcctcactcctacgcgtcccctactttgtga

SEQ ID NO: 111834 - DNA, 75 bp, Artificial Sequence
  Synthetic
caaaatatctcatggccatcttgggccccctttacatactccaggcctcactcctacgcgtcccgtactttgtga

SEQ ID NO: 111835 - DNA, 75 bp, Artificial Sequence
  Synthetic
caaaatatctcttggccatcttgggccccctttacatactccaggcctcactcctacgcgtcccatactttgtga

SEQ ID NO: 111836 - DNA, 75 bp, Artificial Sequence
  Synthetic
caaaatatctcttggccatcttgggccccctttacatactccaggcctcactcctacgcgtcccttactttgtga

SEQ ID NO: 111837 - DNA, 75 bp, Artificial Sequence
  Synthetic
caaaatatctcttggccatcttgggccccctttacatactccaggcctcactcctacgcgtcccctactttgtga

SEQ ID NO: 111838 - DNA, 75 bp, Artificial Sequence
  Synthetic
caaaatatctcttggccatcttgggccccctttacatactccaggcctcactcctacgcgtcccgtactttgtga

SEQ ID NO: 111839 - DNA, 75 bp, Artificial Sequence
  Synthetic
caaaatatctcctggccatcttgggccccctttacatactccaggcctcactcctacgcgtcccatactttgtga

SEQ ID NO: 111840 - DNA, 75 bp, Artificial Sequence
  Synthetic
caaaatatctcctggccatcttgggccccctttacatactccaggcctcactcctacgcgtcccttactttgtga

SEQ ID NO: 111841 - DNA, 75 bp, Artificial Sequence
  Synthetic
caaaatatctcctggccatcttgggccccctttacatactccaggcctcactcctacgcgtcccctactttgtga

SEQ ID NO: 111842 - DNA, 75 bp, Artificial Sequence
  Synthetic
caaaatatctcctggccatcttgggccccctttacatactccaggcctcactcctacgcgtcccgtactttgtga

SEQ ID NO: 111843 - DNA, 75 bp, Artificial Sequence
  Synthetic
caaaatatctcgtggccatcttgggccccctttacatactccaggcctcactcctacgcgtcccatactttgtga

SEQ ID NO: 111844 - DNA, 75 bp, Artificial Sequence
  Synthetic
caaaatatctcgtggccatcttgggccccctttacatactccaggcctcactcctacgcgtcccttactttgtga

SEQ ID NO: 111845 - DNA, 75 bp, Artificial Sequence
  Synthetic
caaaatatctcgtggccatcttgggccccctttacatactccaggcctcactcctacgcgtcccctactttgtga

SEQ ID NO: 111846 - DNA, 75 bp, Artificial Sequence
  Synthetic
caaaatatctcgtggccatcttgggccccctttacatactccaggcctcactcctacgcgtcccgtactttgtga

SEQ ID NO: 111847 - DNA, 75 bp, Artificial Sequence
  Synthetic
gggcacatgcgctgattaagatctgcagcttgttgcgtggggtagtctatggcaagtattgccaaatggccgtgc

SEQ ID NO: 111848 - DNA, 75 bp, Artificial Sequence
  Synthetic
agcgtcgggagtgcaggcagacttgctttctgtagaggaagcttgtagcctcactccccctcattcagcccgttc

SEQ ID NO: 111849 - DNA, 75 bp, Artificial Sequence
  Synthetic
tcttcacacaattggatggggtgcggctgcacaggtacgctccagcatgcaagcctctcctacgggatgatgtca

SEQ ID NO: 111850 - DNA, 75 bp, Artificial Sequence
  Synthetic
ccttctggaagaccaacatactccaattgacacaactatcatggctaaaaatgaggtgttctgtgttgatcccgc

SEQ ID NO: 111851 - DNA, 75 bp, Artificial Sequence
  Synthetic
ccaattccaacaacgatcatggcgaagaatgaggtattctcggtcaacccacaaaagggtggccggaagcctgcc

SEQ ID NO: 111852 - DNA, 75 bp, Artificial Sequence
  Synthetic
cgtcctggcagctctagctgcttactgtctttcagtgggcagcgtagtgattgtcgggagagtcgtcctgtcggg

SEQ ID NO: 111853 - DNA, 75 bp, Artificial Sequence
  Synthetic
gtggagactccttgcccccatcacggcgtaagcgcagcagacccgtggcttgttcagtaccatcataaccagtct

SEQ ID NO: 111854 - DNA, 75 bp, Artificial Sequence
  Synthetic
gtggagactccttgcccccatcacggcgtatgcgcagcagacccgtggcttgttcagtaccatcataaccagtct

SEQ ID NO: 111855 - DNA, 75 bp, Artificial Sequence
  Synthetic
gtggagactccttgcccccatcacggcgtacgcgcagcagacccgtggcttgttcagtaccatcataaccagtct

SEQ ID NO: 111856 - DNA, 75 bp, Artificial Sequence
  Synthetic
gtggagactccttgcccccatcacggcgtaggcgcagcagacccgtggcttgttcagtaccatcataaccagtct

SEQ ID NO: 111857 - DNA, 75 bp, Artificial Sequence
  Synthetic
ctacggggcctgctactccatagaaccactggatctacctccaatcattcaaagactccatggccttagcgcatt

SEQ ID NO: 111858 - DNA, 75 bp, Artificial Sequence
  Synthetic
acgggttccagtattcgcccgcacagcgagtagaacgcctcctagctatgtggaggtcgaagaagaccccgttgg

SEQ ID NO: 111859 - DNA, 75 bp, Artificial Sequence
  Synthetic
ctggctgagcaattcaagcagaaggccgtaggcctcctaaatttcgctggcaagcaagcccaagaggcaacacca

SEQ ID NO: 111860 - DNA, 75 bp, Artificial Sequence
  Synthetic
ccatcagcggcccgaaaggacctgtcaatcaaatgtacaccaatgttgaccaagacctggtggggtggccagcgc

SEQ ID NO: 111861 - DNA, 75 bp, Artificial Sequence
  Synthetic
taggaaggcaatcaaggctcttaccgagcgcttgtattgcggaggccctatgttcaacagcaagggcgagaagtg

SEQ ID NO: 111862 - DNA, 75 bp, Artificial Sequence
  Synthetic
cccccggagtcagatctcttgcgccgtgcacctgtggcgcgtcagacatgtacttagtcactaggcacgctgatg

SEQ ID NO: 111863 - DNA, 75 bp, Artificial Sequence
  Synthetic
cccccggagtcagatctcttgcgccgtgcacctgtggcgcgtcagacttgtacttagtcactaggcacgctgatg

SEQ ID NO: 111864 - DNA, 75 bp, Artificial Sequence
  Synthetic
cccccggagtcagatctcttgcgccgtgcacctgtggcgcgtcagacctgtacttagtcactaggcacgctgatg

SEQ ID NO: 111865 - DNA, 75 bp, Artificial Sequence
  Synthetic
cccccggagtcagatctcttgcgccgtgcacctgtggcgcgtcagacgtgtacttagtcactaggcacgctgatg

SEQ ID NO: 111866 - DNA, 75 bp, Artificial Sequence
  Synthetic
cccccggtgtcagatctcttgcgccgtgcacctgtggcgcgtcagacatgtacttagtcactaggcacgctgatg

SEQ ID NO: 111867 - DNA, 75 bp, Artificial Sequence
  Synthetic
cccccggtgtcagatctcttgcgccgtgcacctgtggcgcgtcagacttgtacttagtcactaggcacgctgatg

SEQ ID NO: 111868 - DNA, 75 bp, Artificial Sequence
  Synthetic
cccccggtgtcagatctcttgcgccgtgcacctgtggcgcgtcagacctgtacttagtcactaggcacgctgatg

SEQ ID NO: 111869 - DNA, 75 bp, Artificial Sequence
  Synthetic
cccccggtgtcagatctcttgcgccgtgcacctgtggcgcgtcagacgtgtacttagtcactaggcacgctgatg

SEQ ID NO: 111870 - DNA, 75 bp, Artificial Sequence
  Synthetic
cccccggcgtcagatctcttgcgccgtgcacctgtggcgcgtcagacatgtacttagtcactaggcacgctgatg

SEQ ID NO: 111871 - DNA, 75 bp, Artificial Sequence
  Synthetic
cccccggcgtcagatctcttgcgccgtgcacctgtggcgcgtcagacttgtacttagtcactaggcacgctgatg

SEQ ID NO: 111872 - DNA, 75 bp, Artificial Sequence
  Synthetic
cccccggcgtcagatctcttgcgccgtgcacctgtggcgcgtcagacctgtacttagtcactaggcacgctgatg

SEQ ID NO: 111873 - DNA, 75 bp, Artificial Sequence
  Synthetic
cccccggcgtcagatctcttgcgccgtgcacctgtggcgcgtcagacgtgtacttagtcactaggcacgctgatg

SEQ ID NO: 111874 - DNA, 75 bp, Artificial Sequence
  Synthetic
cccccggggtcagatctcttgcgccgtgcacctgtggcgcgtcagacatgtacttagtcactaggcacgctgatg

SEQ ID NO: 111875 - DNA, 75 bp, Artificial Sequence
  Synthetic
cccccggggtcagatctcttgcgccgtgcacctgtggcgcgtcagacttgtacttagtcactaggcacgctgatg

SEQ ID NO: 111876 - DNA, 75 bp, Artificial Sequence
  Synthetic
cccccggggtcagatctcttgcgccgtgcacctgtggcgcgtcagacctgtacttagtcactaggcacgctgatg

SEQ ID NO: 111877 - DNA, 75 bp, Artificial Sequence
  Synthetic
cccccggggtcagatctcttgcgccgtgcacctgtggcgcgtcagacgtgtacttagtcactaggcacgctgatg

SEQ ID NO: 111878 - DNA, 75 bp, Artificial Sequence
  Synthetic
gtccggctggttcacggctggctacagcgggggagacatttatcacagcgtgtctcatgcccggccccgctggtt

SEQ ID NO: 111879 - DNA, 75 bp, Artificial Sequence
  Synthetic
ctccagagcccatgcctactggtttgtggagatgatctggtggtggtggctgaaagtgcaggtgttaacgaggac

SEQ ID NO: 111880 - DNA, 75 bp, Artificial Sequence
  Synthetic
ccggtgagtacaccggaattgccaggacgaccgggtcctttcttggattaacccgctcaatgcctggagatttgg

SEQ ID NO: 111881 - DNA, 75 bp, Artificial Sequence
  Synthetic
gtggacatccttgccggttacggcgctggcgtggccggcgccgtggtcacttttaagatcatgagtggcgagatg

SEQ ID NO: 111882 - DNA, 75 bp, Artificial Sequence
  Synthetic
tagccaaagcggtggactttgtcccggtcgaatctcttgagaccacaatgagatcaccagtgttcactgacaatt

SEQ ID NO: 111883 - DNA, 75 bp, Artificial Sequence
  Synthetic
tagccaaagcggtggactttgtcccggtcgaatctcttgagaccactatgagatcaccagtgttcactgacaatt

SEQ ID NO: 111884 - DNA, 75 bp, Artificial Sequence
  Synthetic
tagccaaagcggtggactttgtcccggtcgaatctcttgagaccaccatgagatcaccagtgttcactgacaatt

SEQ ID NO: 111885 - DNA, 75 bp, Artificial Sequence
  Synthetic
tagccaaagcggtggactttgtcccggtcgaatctcttgagaccacgatgagatcaccagtgttcactgacaatt

SEQ ID NO: 111886 - DNA, 75 bp, Artificial Sequence
  Synthetic
gctcctcaaacgtctccgtcgcccatgactcgacgggaaagcgggtatactatctcacacgagattgtgacatcc

SEQ ID NO: 111887 - DNA, 75 bp, Artificial Sequence
  Synthetic
actgatgacccactttttctccattctccaggctcaagaacaactggagaaagccctagacttccaaatgtacgg

SEQ ID NO: 111888 - DNA, 75 bp, Artificial Sequence
  Synthetic
gcaactctttgctgcgccaccacaacatggtctacgccacaacatcccgcagcgcaagccaacggcagaagaagg

SEQ ID NO: 111889 - DNA, 75 bp, Artificial Sequence
  Synthetic
gtcagggctgttgaggatgggattaattacgcaacagggaatctacccggttgctccttttctatcttcattctg

SEQ ID NO: 111890 - DNA, 75 bp, Artificial Sequence
  Synthetic
gttcaccgtgggcgccggcgggggcgacatctttcacagcgtgtcgcatgcccgaccccgcctattactcctttg

SEQ ID NO: 111891 - DNA, 75 bp, Artificial Sequence
  Synthetic
aacagagtagcgggggcactcaggaaacttggtgcgccccccctacgagcgtggagacatcgggcaagggccgtg

SEQ ID NO: 111892 - DNA, 75 bp, Artificial Sequence
  Synthetic
tgtatgaggcgcctactgtcatcatgcacttgcctggatgcgtcccttgtgtcaaggtcggcgacaattccacct

SEQ ID NO: 111893 - DNA, 75 bp, Artificial Sequence
  Synthetic
acagtcctggatcaagcggagaccgctggagcgcgccttgtcgtgctcgcgaccgctaccccgccagggtcagtg

SEQ ID NO: 111894 - DNA, 75 bp, Artificial Sequence
  Synthetic
ggctgttccgaatgcgtcaacacctctcacggggttccgcaagcatgtggacctcatggtgggtgctgccgcctt

SEQ ID NO: 111895 - DNA, 75 bp, Artificial Sequence
  Synthetic
gtaaggccgctatatgcggcttatacctcttcaattgggctgtacgcacaaaggccaaactcactccattgccgc

SEQ ID NO: 111896 - DNA, 75 bp, Artificial Sequence
  Synthetic
gtgcctactcctactttccgtaggggtaggcatctttttgctgcctgctcggtaggcggctaacactccgacctt

SEQ ID NO: 111897 - DNA, 75 bp, Artificial Sequence
  Synthetic
tgattgccccaactcgagtattgtgtacgagacggccgataccatcctacactctccggggtgtgtcccttgcgt

SEQ ID NO: 111898 - DNA, 75 bp, Artificial Sequence
  Synthetic
tttttttttttttttttttttttttttcctttctatatttcctattctttactatcttcttccttttctggtggc

SEQ ID NO: 111899 - DNA, 75 bp, Artificial Sequence
  Synthetic
gtatggttgccaactgggccaaggtcatcggtattctgctcctgttcgcaggggtggatgcaaccacggacacca

SEQ ID NO: 111900 - DNA, 75 bp, Artificial Sequence
  Synthetic
catcaacaggacagctctcaattgcaatgacagcctacagaccggatttgtagccgctctgttctatgctcacaa

SEQ ID NO: 111901 - DNA, 75 bp, Artificial Sequence
  Synthetic
ttgctccttttctatctttctcttggcactgctctcgtgccttaccacacctgcctcggccctgcattatgccaa

SEQ ID NO: 111902 - DNA, 75 bp, Artificial Sequence
  Synthetic
tctggcgtctccgccaagctgggacatcatgtggaagtgcataattcgacactagcgtactatgcgcgagcccac

SEQ ID NO: 111903 - DNA, 75 bp, Artificial Sequence
  Synthetic
tctggcgtctccgccaagctgggacatcatgtggaagtgcataattcgactctagcgtactatgcgcgagcccac

SEQ ID NO: 111904 - DNA, 75 bp, Artificial Sequence
  Synthetic
tctggcgtctccgccaagctgggacatcatgtggaagtgcataattcgaccctagcgtactatgcgcgagcccac

SEQ ID NO: 111905 - DNA, 75 bp, Artificial Sequence
  Synthetic
tctggcgtctccgccaagctgggacatcatgtggaagtgcataattcgacgctagcgtactatgcgcgagcccac

SEQ ID NO: 111906 - DNA, 75 bp, Artificial Sequence
  Synthetic
tctggcgtctccgccaagctgggacatcatgtggaagtgcataattcgtcactagcgtactatgcgcgagcccac

SEQ ID NO: 111907 - DNA, 75 bp, Artificial Sequence
  Synthetic
tctggcgtctccgccaagctgggacatcatgtggaagtgcataattcgtctctagcgtactatgcgcgagcccac

SEQ ID NO: 111908 - DNA, 75 bp, Artificial Sequence
  Synthetic
tctggcgtctccgccaagctgggacatcatgtggaagtgcataattcgtccctagcgtactatgcgcgagcccac

SEQ ID NO: 111909 - DNA, 75 bp, Artificial Sequence
  Synthetic
tctggcgtctccgccaagctgggacatcatgtggaagtgcataattcgtcgctagcgtactatgcgcgagcccac

SEQ ID NO: 111910 - DNA, 75 bp, Artificial Sequence
  Synthetic
tctggcgtctccgccaagctgggacatcatgtggaagtgcataattcgccactagcgtactatgcgcgagcccac

SEQ ID NO: 111911 - DNA, 75 bp, Artificial Sequence
  Synthetic
tctggcgtctccgccaagctgggacatcatgtggaagtgcataattcgcctctagcgtactatgcgcgagcccac

SEQ ID NO: 111912 - DNA, 75 bp, Artificial Sequence
  Synthetic
tctggcgtctccgccaagctgggacatcatgtggaagtgcataattcgcccctagcgtactatgcgcgagcccac

SEQ ID NO: 111913 - DNA, 75 bp, Artificial Sequence
  Synthetic
tctggcgtctccgccaagctgggacatcatgtggaagtgcataattcgccgctagcgtactatgcgcgagcccac

SEQ ID NO: 111914 - DNA, 75 bp, Artificial Sequence
  Synthetic
tctggcgtctccgccaagctgggacatcatgtggaagtgcataattcggcactagcgtactatgcgcgagcccac

SEQ ID NO: 111915 - DNA, 75 bp, Artificial Sequence
  Synthetic
tctggcgtctccgccaagctgggacatcatgtggaagtgcataattcggctctagcgtactatgcgcgagcccac

SEQ ID NO: 111916 - DNA, 75 bp, Artificial Sequence
  Synthetic
tctggcgtctccgccaagctgggacatcatgtggaagtgcataattcggccctagcgtactatgcgcgagcccac

SEQ ID NO: 111917 - DNA, 75 bp, Artificial Sequence
  Synthetic
tctggcgtctccgccaagctgggacatcatgtggaagtgcataattcggcgctagcgtactatgcgcgagcccac

SEQ ID NO: 111918 - DNA, 75 bp, Artificial Sequence
  Synthetic
tctggcgtctccgccaagctgggacatcatgtggaagtgcttaattcgacactagcgtactatgcgcgagcccac

SEQ ID NO: 111919 - DNA, 75 bp, Artificial Sequence
  Synthetic
tctggcgtctccgccaagctgggacatcatgtggaagtgcttaattcgactctagcgtactatgcgcgagcccac

SEQ ID NO: 111920 - DNA, 75 bp, Artificial Sequence
  Synthetic
tctggcgtctccgccaagctgggacatcatgtggaagtgcttaattcgaccctagcgtactatgcgcgagcccac

SEQ ID NO: 111921 - DNA, 75 bp, Artificial Sequence
  Synthetic
tctggcgtctccgccaagctgggacatcatgtggaagtgcttaattcgacgctagcgtactatgcgcgagcccac

SEQ ID NO: 111922 - DNA, 75 bp, Artificial Sequence
  Synthetic
tctggcgtctccgccaagctgggacatcatgtggaagtgcttaattcgtcactagcgtactatgcgcgagcccac

SEQ ID NO: 111923 - DNA, 75 bp, Artificial Sequence
  Synthetic
tctggcgtctccgccaagctgggacatcatgtggaagtgcttaattcgtctctagcgtactatgcgcgagcccac

SEQ ID NO: 111924 - DNA, 75 bp, Artificial Sequence
  Synthetic
tctggcgtctccgccaagctgggacatcatgtggaagtgcttaattcgtccctagcgtactatgcgcgagcccac

SEQ ID NO: 111925 - DNA, 75 bp, Artificial Sequence
  Synthetic
tctggcgtctccgccaagctgggacatcatgtggaagtgcttaattcgtcgctagcgtactatgcgcgagcccac

SEQ ID NO: 111926 - DNA, 75 bp, Artificial Sequence
  Synthetic
tctggcgtctccgccaagctgggacatcatgtggaagtgcttaattcgccactagcgtactatgcgcgagcccac

SEQ ID NO: 111927 - DNA, 75 bp, Artificial Sequence
  Synthetic
tctggcgtctccgccaagctgggacatcatgtggaagtgcttaattcgcctctagcgtactatgcgcgagcccac

SEQ ID NO: 111928 - DNA, 75 bp, Artificial Sequence
  Synthetic
tctggcgtctccgccaagctgggacatcatgtggaagtgcttaattcgcccctagcgtactatgcgcgagcccac

SEQ ID NO: 111929 - DNA, 75 bp, Artificial Sequence
  Synthetic
tctggcgtctccgccaagctgggacatcatgtggaagtgcttaattcgccgctagcgtactatgcgcgagcccac

SEQ ID NO: 111930 - DNA, 75 bp, Artificial Sequence
  Synthetic
tctggcgtctccgccaagctgggacatcatgtggaagtgcttaattcggcactagcgtactatgcgcgagcccac

SEQ ID NO: 111931 - DNA, 75 bp, Artificial Sequence
  Synthetic
tctggcgtctccgccaagctgggacatcatgtggaagtgcttaattcggctctagcgtactatgcgcgagcccac

SEQ ID NO: 111932 - DNA, 75 bp, Artificial Sequence
  Synthetic
tctggcgtctccgccaagctgggacatcatgtggaagtgcttaattcggccctagcgtactatgcgcgagcccac

SEQ ID NO: 111933 - DNA, 75 bp, Artificial Sequence
  Synthetic
tctggcgtctccgccaagctgggacatcatgtggaagtgcttaattcggcgctagcgtactatgcgcgagcccac

SEQ ID NO: 111934 - DNA, 75 bp, Artificial Sequence
  Synthetic
tctggcgtctccgccaagctgggacatcatgtggaagtgcctaattcgacactagcgtactatgcgcgagcccac

SEQ ID NO: 111935 - DNA, 75 bp, Artificial Sequence
  Synthetic
tctggcgtctccgccaagctgggacatcatgtggaagtgcctaattcgactctagcgtactatgcgcgagcccac

SEQ ID NO: 111936 - DNA, 75 bp, Artificial Sequence
  Synthetic
tctggcgtctccgccaagctgggacatcatgtggaagtgcctaattcgaccctagcgtactatgcgcgagcccac

SEQ ID NO: 111937 - DNA, 75 bp, Artificial Sequence
  Synthetic
tctggcgtctccgccaagctgggacatcatgtggaagtgcctaattcgacgctagcgtactatgcgcgagcccac

SEQ ID NO: 111938 - DNA, 75 bp, Artificial Sequence
  Synthetic
tctggcgtctccgccaagctgggacatcatgtggaagtgcctaattcgtcactagcgtactatgcgcgagcccac

SEQ ID NO: 111939 - DNA, 75 bp, Artificial Sequence
  Synthetic
tctggcgtctccgccaagctgggacatcatgtggaagtgcctaattcgtctctagcgtactatgcgcgagcccac

SEQ ID NO: 111940 - DNA, 75 bp, Artificial Sequence
  Synthetic
tctggcgtctccgccaagctgggacatcatgtggaagtgcctaattcgtccctagcgtactatgcgcgagcccac

SEQ ID NO: 111941 - DNA, 75 bp, Artificial Sequence
  Synthetic
tctggcgtctccgccaagctgggacatcatgtggaagtgcctaattcgtcgctagcgtactatgcgcgagcccac

SEQ ID NO: 111942 - DNA, 75 bp, Artificial Sequence
  Synthetic
tctggcgtctccgccaagctgggacatcatgtggaagtgcctaattcgccactagcgtactatgcgcgagcccac

SEQ ID NO: 111943 - DNA, 75 bp, Artificial Sequence
  Synthetic
tctggcgtctccgccaagctgggacatcatgtggaagtgcctaattcgcctctagcgtactatgcgcgagcccac

SEQ ID NO: 111944 - DNA, 75 bp, Artificial Sequence
  Synthetic
tctggcgtctccgccaagctgggacatcatgtggaagtgcctaattcgcccctagcgtactatgcgcgagcccac

SEQ ID NO: 111945 - DNA, 75 bp, Artificial Sequence
  Synthetic
tctggcgtctccgccaagctgggacatcatgtggaagtgcctaattcgccgctagcgtactatgcgcgagcccac

SEQ ID NO: 111946 - DNA, 75 bp, Artificial Sequence
  Synthetic
tctggcgtctccgccaagctgggacatcatgtggaagtgcctaattcggcactagcgtactatgcgcgagcccac

SEQ ID NO: 111947 - DNA, 75 bp, Artificial Sequence
  Synthetic
tctggcgtctccgccaagctgggacatcatgtggaagtgcctaattcggctctagcgtactatgcgcgagcccac

SEQ ID NO: 111948 - DNA, 75 bp, Artificial Sequence
  Synthetic
tctggcgtctccgccaagctgggacatcatgtggaagtgcctaattcggccctagcgtactatgcgcgagcccac

SEQ ID NO: 111949 - DNA, 75 bp, Artificial Sequence
  Synthetic
tctggcgtctccgccaagctgggacatcatgtggaagtgcctaattcggcgctagcgtactatgcgcgagcccac

SEQ ID NO: 111950 - DNA, 75 bp, Artificial Sequence
  Synthetic
tctggcgtctccgccaagctgggacatcatgtggaagtgcgtaattcgacactagcgtactatgcgcgagcccac

SEQ ID NO: 111951 - DNA, 75 bp, Artificial Sequence
  Synthetic
tctggcgtctccgccaagctgggacatcatgtggaagtgcgtaattcgactctagcgtactatgcgcgagcccac

SEQ ID NO: 111952 - DNA, 75 bp, Artificial Sequence
  Synthetic
tctggcgtctccgccaagctgggacatcatgtggaagtgcgtaattcgaccctagcgtactatgcgcgagcccac

SEQ ID NO: 111953 - DNA, 75 bp, Artificial Sequence
  Synthetic
tctggcgtctccgccaagctgggacatcatgtggaagtgcgtaattcgacgctagcgtactatgcgcgagcccac

SEQ ID NO: 111954 - DNA, 75 bp, Artificial Sequence
  Synthetic
tctggcgtctccgccaagctgggacatcatgtggaagtgcgtaattcgtcactagcgtactatgcgcgagcccac

SEQ ID NO: 111955 - DNA, 75 bp, Artificial Sequence
  Synthetic
tctggcgtctccgccaagctgggacatcatgtggaagtgcgtaattcgtctctagcgtactatgcgcgagcccac

SEQ ID NO: 111956 - DNA, 75 bp, Artificial Sequence
  Synthetic
tctggcgtctccgccaagctgggacatcatgtggaagtgcgtaattcgtccctagcgtactatgcgcgagcccac

SEQ ID NO: 111957 - DNA, 75 bp, Artificial Sequence
  Synthetic
tctggcgtctccgccaagctgggacatcatgtggaagtgcgtaattcgtcgctagcgtactatgcgcgagcccac

SEQ ID NO: 111958 - DNA, 75 bp, Artificial Sequence
  Synthetic
tctggcgtctccgccaagctgggacatcatgtggaagtgcgtaattcgccactagcgtactatgcgcgagcccac

SEQ ID NO: 111959 - DNA, 75 bp, Artificial Sequence
  Synthetic
tctggcgtctccgccaagctgggacatcatgtggaagtgcgtaattcgcctctagcgtactatgcgcgagcccac

SEQ ID NO: 111960 - DNA, 75 bp, Artificial Sequence
  Synthetic
tctggcgtctccgccaagctgggacatcatgtggaagtgcgtaattcgcccctagcgtactatgcgcgagcccac

SEQ ID NO: 111961 - DNA, 75 bp, Artificial Sequence
  Synthetic
tctggcgtctccgccaagctgggacatcatgtggaagtgcgtaattcgccgctagcgtactatgcgcgagcccac

SEQ ID NO: 111962 - DNA, 75 bp, Artificial Sequence
  Synthetic
tctggcgtctccgccaagctgggacatcatgtggaagtgcgtaattcggcactagcgtactatgcgcgagcccac

SEQ ID NO: 111963 - DNA, 75 bp, Artificial Sequence
  Synthetic
tctggcgtctccgccaagctgggacatcatgtggaagtgcgtaattcggctctagcgtactatgcgcgagcccac

SEQ ID NO: 111964 - DNA, 75 bp, Artificial Sequence
  Synthetic
tctggcgtctccgccaagctgggacatcatgtggaagtgcgtaattcggccctagcgtactatgcgcgagcccac

SEQ ID NO: 111965 - DNA, 75 bp, Artificial Sequence
  Synthetic
tctggcgtctccgccaagctgggacatcatgtggaagtgcgtaattcggcgctagcgtactatgcgcgagcccac

SEQ ID NO: 111966 - DNA, 75 bp, Artificial Sequence
  Synthetic
gttaaggttggaaatcagtctacatgctggctgacagccgcgcccacgctggccgtcccgaacgcgacgacgccc

SEQ ID NO: 111967 - DNA, 75 bp, Artificial Sequence
  Synthetic
gttaaggttggaaatcagtctacatgctggctgacagccgcgcccacgctggccgtcccgaacgcgtcgacgccc

SEQ ID NO: 111968 - DNA, 75 bp, Artificial Sequence
  Synthetic
gttaaggttggaaatcagtctacatgctggctgacagccgcgcccacgctggccgtcccgaacgcgccgacgccc

SEQ ID NO: 111969 - DNA, 75 bp, Artificial Sequence
  Synthetic
gttaaggttggaaatcagtctacatgctggctgacagccgcgcccacgctggccgtcccgaacgcggcgacgccc

SEQ ID NO: 111970 - DNA, 75 bp, Artificial Sequence
  Synthetic
gttaaggttggaaatcagtctacatgctggctgtcagccgcgcccacgctggccgtcccgaacgcgacgacgccc

SEQ ID NO: 111971 - DNA, 75 bp, Artificial Sequence
  Synthetic
gttaaggttggaaatcagtctacatgctggctgtcagccgcgcccacgctggccgtcccgaacgcgtcgacgccc

SEQ ID NO: 111972 - DNA, 75 bp, Artificial Sequence
  Synthetic
gttaaggttggaaatcagtctacatgctggctgtcagccgcgcccacgctggccgtcccgaacgcgccgacgccc

SEQ ID NO: 111973 - DNA, 75 bp, Artificial Sequence
  Synthetic
gttaaggttggaaatcagtctacatgctggctgtcagccgcgcccacgctggccgtcccgaacgcggcgacgccc

SEQ ID NO: 111974 - DNA, 75 bp, Artificial Sequence
  Synthetic
gttaaggttggaaatcagtctacatgctggctgccagccgcgcccacgctggccgtcccgaacgcgacgacgccc

SEQ ID NO: 111975 - DNA, 75 bp, Artificial Sequence
  Synthetic
gttaaggttggaaatcagtctacatgctggctgccagccgcgcccacgctggccgtcccgaacgcgtcgacgccc

SEQ ID NO: 111976 - DNA, 75 bp, Artificial Sequence
  Synthetic
gttaaggttggaaatcagtctacatgctggctgccagccgcgcccacgctggccgtcccgaacgcgccgacgccc

SEQ ID NO: 111977 - DNA, 75 bp, Artificial Sequence
  Synthetic
gttaaggttggaaatcagtctacatgctggctgccagccgcgcccacgctggccgtcccgaacgcggcgacgccc

SEQ ID NO: 111978 - DNA, 75 bp, Artificial Sequence
  Synthetic
gttaaggttggaaatcagtctacatgctggctggcagccgcgcccacgctggccgtcccgaacgcgacgacgccc

SEQ ID NO: 111979 - DNA, 75 bp, Artificial Sequence
  Synthetic
gttaaggttggaaatcagtctacatgctggctggcagccgcgcccacgctggccgtcccgaacgcgtcgacgccc

SEQ ID NO: 111980 - DNA, 75 bp, Artificial Sequence
  Synthetic
gttaaggttggaaatcagtctacatgctggctggcagccgcgcccacgctggccgtcccgaacgcgccgacgccc

SEQ ID NO: 111981 - DNA, 75 bp, Artificial Sequence
  Synthetic
gttaaggttggaaatcagtctacatgctggctggcagccgcgcccacgctggccgtcccgaacgcggcgacgccc

SEQ ID NO: 111982 - DNA, 75 bp, Artificial Sequence
  Synthetic
gttaaggttggtaatcagtctacatgctggctgacagccgcgcccacgctggccgtcccgaacgcgacgacgccc

SEQ ID NO: 111983 - DNA, 75 bp, Artificial Sequence
  Synthetic
gttaaggttggtaatcagtctacatgctggctgacagccgcgcccacgctggccgtcccgaacgcgtcgacgccc

SEQ ID NO: 111984 - DNA, 75 bp, Artificial Sequence
  Synthetic
gttaaggttggtaatcagtctacatgctggctgacagccgcgcccacgctggccgtcccgaacgcgccgacgccc

SEQ ID NO: 111985 - DNA, 75 bp, Artificial Sequence
  Synthetic
gttaaggttggtaatcagtctacatgctggctgacagccgcgcccacgctggccgtcccgaacgcggcgacgccc

SEQ ID NO: 111986 - DNA, 75 bp, Artificial Sequence
  Synthetic
gttaaggttggtaatcagtctacatgctggctgtcagccgcgcccacgctggccgtcccgaacgcgacgacgccc

SEQ ID NO: 111987 - DNA, 75 bp, Artificial Sequence
  Synthetic
gttaaggttggtaatcagtctacatgctggctgtcagccgcgcccacgctggccgtcccgaacgcgtcgacgccc

SEQ ID NO: 111988 - DNA, 75 bp, Artificial Sequence
  Synthetic
gttaaggttggtaatcagtctacatgctggctgtcagccgcgcccacgctggccgtcccgaacgcgccgacgccc

SEQ ID NO: 111989 - DNA, 75 bp, Artificial Sequence
  Synthetic
gttaaggttggtaatcagtctacatgctggctgtcagccgcgcccacgctggccgtcccgaacgcggcgacgccc

SEQ ID NO: 111990 - DNA, 75 bp, Artificial Sequence
  Synthetic
gttaaggttggtaatcagtctacatgctggctgccagccgcgcccacgctggccgtcccgaacgcgacgacgccc

SEQ ID NO: 111991 - DNA, 75 bp, Artificial Sequence
  Synthetic
gttaaggttggtaatcagtctacatgctggctgccagccgcgcccacgctggccgtcccgaacgcgtcgacgccc

SEQ ID NO: 111992 - DNA, 75 bp, Artificial Sequence
  Synthetic
gttaaggttggtaatcagtctacatgctggctgccagccgcgcccacgctggccgtcccgaacgcgccgacgccc

SEQ ID NO: 111993 - DNA, 75 bp, Artificial Sequence
  Synthetic
gttaaggttggtaatcagtctacatgctggctgccagccgcgcccacgctggccgtcccgaacgcggcgacgccc

SEQ ID NO: 111994 - DNA, 75 bp, Artificial Sequence
  Synthetic
gttaaggttggtaatcagtctacatgctggctggcagccgcgcccacgctggccgtcccgaacgcgacgacgccc

SEQ ID NO: 111995 - DNA, 75 bp, Artificial Sequence
  Synthetic
gttaaggttggtaatcagtctacatgctggctggcagccgcgcccacgctggccgtcccgaacgcgtcgacgccc

SEQ ID NO: 111996 - DNA, 75 bp, Artificial Sequence
  Synthetic
gttaaggttggtaatcagtctacatgctggctggcagccgcgcccacgctggccgtcccgaacgcgccgacgccc

SEQ ID NO: 111997 - DNA, 75 bp, Artificial Sequence
  Synthetic
gttaaggttggtaatcagtctacatgctggctggcagccgcgcccacgctggccgtcccgaacgcggcgacgccc

SEQ ID NO: 111998 - DNA, 75 bp, Artificial Sequence
  Synthetic
gttaaggttggcaatcagtctacatgctggctgacagccgcgcccacgctggccgtcccgaacgcgacgacgccc

SEQ ID NO: 111999 - DNA, 75 bp, Artificial Sequence
  Synthetic
gttaaggttggcaatcagtctacatgctggctgacagccgcgcccacgctggccgtcccgaacgcgtcgacgccc

SEQ ID NO: 112000 - DNA, 75 bp, Artificial Sequence
  Synthetic
gttaaggttggcaatcagtctacatgctggctgacagccgcgcccacgctggccgtcccgaacgcgccgacgccc

SEQ ID NO: 112001 - DNA, 75 bp, Artificial Sequence
  Synthetic
gttaaggttggcaatcagtctacatgctggctgacagccgcgcccacgctggccgtcccgaacgcggcgacgccc

SEQ ID NO: 112002 - DNA, 75 bp, Artificial Sequence
  Synthetic
gttaaggttggcaatcagtctacatgctggctgtcagccgcgcccacgctggccgtcccgaacgcgacgacgccc

SEQ ID NO: 112003 - DNA, 75 bp, Artificial Sequence
  Synthetic
gttaaggttggcaatcagtctacatgctggctgtcagccgcgcccacgctggccgtcccgaacgcgtcgacgccc

SEQ ID NO: 112004 - DNA, 75 bp, Artificial Sequence
  Synthetic
gttaaggttggcaatcagtctacatgctggctgtcagccgcgcccacgctggccgtcccgaacgcgccgacgccc

SEQ ID NO: 112005 - DNA, 75 bp, Artificial Sequence
  Synthetic
gttaaggttggcaatcagtctacatgctggctgtcagccgcgcccacgctggccgtcccgaacgcggcgacgccc

SEQ ID NO: 112006 - DNA, 75 bp, Artificial Sequence
  Synthetic
gttaaggttggcaatcagtctacatgctggctgccagccgcgcccacgctggccgtcccgaacgcgacgacgccc

SEQ ID NO: 112007 - DNA, 75 bp, Artificial Sequence
  Synthetic
gttaaggttggcaatcagtctacatgctggctgccagccgcgcccacgctggccgtcccgaacgcgtcgacgccc

SEQ ID NO: 112008 - DNA, 75 bp, Artificial Sequence
  Synthetic
gttaaggttggcaatcagtctacatgctggctgccagccgcgcccacgctggccgtcccgaacgcgccgacgccc

SEQ ID NO: 112009 - DNA, 75 bp, Artificial Sequence
  Synthetic
gttaaggttggcaatcagtctacatgctggctgccagccgcgcccacgctggccgtcccgaacgcggcgacgccc

SEQ ID NO: 112010 - DNA, 75 bp, Artificial Sequence
  Synthetic
gttaaggttggcaatcagtctacatgctggctggcagccgcgcccacgctggccgtcccgaacgcgacgacgccc

SEQ ID NO: 112011 - DNA, 75 bp, Artificial Sequence
  Synthetic
gttaaggttggcaatcagtctacatgctggctggcagccgcgcccacgctggccgtcccgaacgcgtcgacgccc

SEQ ID NO: 112012 - DNA, 75 bp, Artificial Sequence
  Synthetic
gttaaggttggcaatcagtctacatgctggctggcagccgcgcccacgctggccgtcccgaacgcgccgacgccc

SEQ ID NO: 112013 - DNA, 75 bp, Artificial Sequence
  Synthetic
gttaaggttggcaatcagtctacatgctggctggcagccgcgcccacgctggccgtcccgaacgcggcgacgccc

SEQ ID NO: 112014 - DNA, 75 bp, Artificial Sequence
  Synthetic
gttaaggttgggaatcagtctacatgctggctgacagccgcgcccacgctggccgtcccgaacgcgacgacgccc

SEQ ID NO: 112015 - DNA, 75 bp, Artificial Sequence
  Synthetic
gttaaggttgggaatcagtctacatgctggctgacagccgcgcccacgctggccgtcccgaacgcgtcgacgccc

SEQ ID NO: 112016 - DNA, 75 bp, Artificial Sequence
  Synthetic
gttaaggttgggaatcagtctacatgctggctgacagccgcgcccacgctggccgtcccgaacgcgccgacgccc

SEQ ID NO: 112017 - DNA, 75 bp, Artificial Sequence
  Synthetic
gttaaggttgggaatcagtctacatgctggctgacagccgcgcccacgctggccgtcccgaacgcggcgacgccc

SEQ ID NO: 112018 - DNA, 75 bp, Artificial Sequence
  Synthetic
gttaaggttgggaatcagtctacatgctggctgtcagccgcgcccacgctggccgtcccgaacgcgacgacgccc

SEQ ID NO: 112019 - DNA, 75 bp, Artificial Sequence
  Synthetic
gttaaggttgggaatcagtctacatgctggctgtcagccgcgcccacgctggccgtcccgaacgcgtcgacgccc

SEQ ID NO: 112020 - DNA, 75 bp, Artificial Sequence
  Synthetic
gttaaggttgggaatcagtctacatgctggctgtcagccgcgcccacgctggccgtcccgaacgcgccgacgccc

SEQ ID NO: 112021 - DNA, 75 bp, Artificial Sequence
  Synthetic
gttaaggttgggaatcagtctacatgctggctgtcagccgcgcccacgctggccgtcccgaacgcggcgacgccc

SEQ ID NO: 112022 - DNA, 75 bp, Artificial Sequence
  Synthetic
gttaaggttgggaatcagtctacatgctggctgccagccgcgcccacgctggccgtcccgaacgcgacgacgccc

SEQ ID NO: 112023 - DNA, 75 bp, Artificial Sequence
  Synthetic
gttaaggttgggaatcagtctacatgctggctgccagccgcgcccacgctggccgtcccgaacgcgtcgacgccc

SEQ ID NO: 112024 - DNA, 75 bp, Artificial Sequence
  Synthetic
gttaaggttgggaatcagtctacatgctggctgccagccgcgcccacgctggccgtcccgaacgcgccgacgccc

SEQ ID NO: 112025 - DNA, 75 bp, Artificial Sequence
  Synthetic
gttaaggttgggaatcagtctacatgctggctgccagccgcgcccacgctggccgtcccgaacgcggcgacgccc

SEQ ID NO: 112026 - DNA, 75 bp, Artificial Sequence
  Synthetic
gttaaggttgggaatcagtctacatgctggctggcagccgcgcccacgctggccgtcccgaacgcgacgacgccc

SEQ ID NO: 112027 - DNA, 75 bp, Artificial Sequence
  Synthetic
gttaaggttgggaatcagtctacatgctggctggcagccgcgcccacgctggccgtcccgaacgcgtcgacgccc

SEQ ID NO: 112028 - DNA, 75 bp, Artificial Sequence
  Synthetic
gttaaggttgggaatcagtctacatgctggctggcagccgcgcccacgctggccgtcccgaacgcgccgacgccc

SEQ ID NO: 112029 - DNA, 75 bp, Artificial Sequence
  Synthetic
gttaaggttgggaatcagtctacatgctggctggcagccgcgcccacgctggccgtcccgaacgcggcgacgccc

SEQ ID NO: 112030 - DNA, 75 bp, Artificial Sequence
  Synthetic
tcatcaaacgacaagccgtactgttggcactaccccccgagaccatgtggggtggtgccagcatctacagtgtgc

SEQ ID NO: 112031 - DNA, 75 bp, Artificial Sequence
  Synthetic
ggccgtcccgaacgcgacaacgcccctcatagggttccgcagacatgtggaccttatggtaggcgcggccgctct

SEQ ID NO: 112032 - DNA, 75 bp, Artificial Sequence
  Synthetic
ggccgtcccgaacgcgacaacgcccctcattgggttccgcagacatgtggaccttatggtaggcgcggccgctct

SEQ ID NO: 112033 - DNA, 75 bp, Artificial Sequence
  Synthetic
ggccgtcccgaacgcgacaacgcccctcatcgggttccgcagacatgtggaccttatggtaggcgcggccgctct

SEQ ID NO: 112034 - DNA, 75 bp, Artificial Sequence
  Synthetic
ggccgtcccgaacgcgacaacgcccctcatggggttccgcagacatgtggaccttatggtaggcgcggccgctct

SEQ ID NO: 112035 - DNA, 75 bp, Artificial Sequence
  Synthetic
ggccgtcccgaacgcgactacgcccctcatagggttccgcagacatgtggaccttatggtaggcgcggccgctct

SEQ ID NO: 112036 - DNA, 75 bp, Artificial Sequence
  Synthetic
ggccgtcccgaacgcgactacgcccctcattgggttccgcagacatgtggaccttatggtaggcgcggccgctct

SEQ ID NO: 112037 - DNA, 75 bp, Artificial Sequence
  Synthetic
ggccgtcccgaacgcgactacgcccctcatcgggttccgcagacatgtggaccttatggtaggcgcggccgctct

SEQ ID NO: 112038 - DNA, 75 bp, Artificial Sequence
  Synthetic
ggccgtcccgaacgcgactacgcccctcatggggttccgcagacatgtggaccttatggtaggcgcggccgctct

SEQ ID NO: 112039 - DNA, 75 bp, Artificial Sequence
  Synthetic
ggccgtcccgaacgcgaccacgcccctcatagggttccgcagacatgtggaccttatggtaggcgcggccgctct

SEQ ID NO: 112040 - DNA, 75 bp, Artificial Sequence
  Synthetic
ggccgtcccgaacgcgaccacgcccctcattgggttccgcagacatgtggaccttatggtaggcgcggccgctct

SEQ ID NO: 112041 - DNA, 75 bp, Artificial Sequence
  Synthetic
ggccgtcccgaacgcgaccacgcccctcatcgggttccgcagacatgtggaccttatggtaggcgcggccgctct

SEQ ID NO: 112042 - DNA, 75 bp, Artificial Sequence
  Synthetic
ggccgtcccgaacgcgaccacgcccctcatggggttccgcagacatgtggaccttatggtaggcgcggccgctct

SEQ ID NO: 112043 - DNA, 75 bp, Artificial Sequence
  Synthetic
ggccgtcccgaacgcgacgacgcccctcatagggttccgcagacatgtggaccttatggtaggcgcggccgctct

SEQ ID NO: 112044 - DNA, 75 bp, Artificial Sequence
  Synthetic
ggccgtcccgaacgcgacgacgcccctcattgggttccgcagacatgtggaccttatggtaggcgcggccgctct

SEQ ID NO: 112045 - DNA, 75 bp, Artificial Sequence
  Synthetic
ggccgtcccgaacgcgacgacgcccctcatcgggttccgcagacatgtggaccttatggtaggcgcggccgctct

SEQ ID NO: 112046 - DNA, 75 bp, Artificial Sequence
  Synthetic
ggccgtcccgaacgcgacgacgcccctcatggggttccgcagacatgtggaccttatggtaggcgcggccgctct

SEQ ID NO: 112047 - DNA, 75 bp, Artificial Sequence
  Synthetic
ggccgtcccgaacgcgtcaacgcccctcatagggttccgcagacatgtggaccttatggtaggcgcggccgctct

SEQ ID NO: 112048 - DNA, 75 bp, Artificial Sequence
  Synthetic
ggccgtcccgaacgcgtcaacgcccctcattgggttccgcagacatgtggaccttatggtaggcgcggccgctct

SEQ ID NO: 112049 - DNA, 75 bp, Artificial Sequence
  Synthetic
ggccgtcccgaacgcgtcaacgcccctcatcgggttccgcagacatgtggaccttatggtaggcgcggccgctct

SEQ ID NO: 112050 - DNA, 75 bp, Artificial Sequence
  Synthetic
ggccgtcccgaacgcgtcaacgcccctcatggggttccgcagacatgtggaccttatggtaggcgcggccgctct

SEQ ID NO: 112051 - DNA, 75 bp, Artificial Sequence
  Synthetic
ggccgtcccgaacgcgtctacgcccctcatagggttccgcagacatgtggaccttatggtaggcgcggccgctct

SEQ ID NO: 112052 - DNA, 75 bp, Artificial Sequence
  Synthetic
ggccgtcccgaacgcgtctacgcccctcattgggttccgcagacatgtggaccttatggtaggcgcggccgctct

SEQ ID NO: 112053 - DNA, 75 bp, Artificial Sequence
  Synthetic
ggccgtcccgaacgcgtctacgcccctcatcgggttccgcagacatgtggaccttatggtaggcgcggccgctct

SEQ ID NO: 112054 - DNA, 75 bp, Artificial Sequence
  Synthetic
ggccgtcccgaacgcgtctacgcccctcatggggttccgcagacatgtggaccttatggtaggcgcggccgctct

SEQ ID NO: 112055 - DNA, 75 bp, Artificial Sequence
  Synthetic
ggccgtcccgaacgcgtccacgcccctcatagggttccgcagacatgtggaccttatggtaggcgcggccgctct

SEQ ID NO: 112056 - DNA, 75 bp, Artificial Sequence
  Synthetic
ggccgtcccgaacgcgtccacgcccctcattgggttccgcagacatgtggaccttatggtaggcgcggccgctct

SEQ ID NO: 112057 - DNA, 75 bp, Artificial Sequence
  Synthetic
ggccgtcccgaacgcgtccacgcccctcatcgggttccgcagacatgtggaccttatggtaggcgcggccgctct

SEQ ID NO: 112058 - DNA, 75 bp, Artificial Sequence
  Synthetic
ggccgtcccgaacgcgtccacgcccctcatggggttccgcagacatgtggaccttatggtaggcgcggccgctct

SEQ ID NO: 112059 - DNA, 75 bp, Artificial Sequence
  Synthetic
ggccgtcccgaacgcgtcgacgcccctcatagggttccgcagacatgtggaccttatggtaggcgcggccgctct

SEQ ID NO: 112060 - DNA, 75 bp, Artificial Sequence
  Synthetic
ggccgtcccgaacgcgtcgacgcccctcattgggttccgcagacatgtggaccttatggtaggcgcggccgctct

SEQ ID NO: 112061 - DNA, 75 bp, Artificial Sequence
  Synthetic
ggccgtcccgaacgcgtcgacgcccctcatcgggttccgcagacatgtggaccttatggtaggcgcggccgctct

SEQ ID NO: 112062 - DNA, 75 bp, Artificial Sequence
  Synthetic
ggccgtcccgaacgcgtcgacgcccctcatggggttccgcagacatgtggaccttatggtaggcgcggccgctct

SEQ ID NO: 112063 - DNA, 75 bp, Artificial Sequence
  Synthetic
ggccgtcccgaacgcgccaacgcccctcatagggttccgcagacatgtggaccttatggtaggcgcggccgctct

SEQ ID NO: 112064 - DNA, 75 bp, Artificial Sequence
  Synthetic
ggccgtcccgaacgcgccaacgcccctcattgggttccgcagacatgtggaccttatggtaggcgcggccgctct

SEQ ID NO: 112065 - DNA, 75 bp, Artificial Sequence
  Synthetic
ggccgtcccgaacgcgccaacgcccctcatcgggttccgcagacatgtggaccttatggtaggcgcggccgctct

SEQ ID NO: 112066 - DNA, 75 bp, Artificial Sequence
  Synthetic
ggccgtcccgaacgcgccaacgcccctcatggggttccgcagacatgtggaccttatggtaggcgcggccgctct

SEQ ID NO: 112067 - DNA, 75 bp, Artificial Sequence
  Synthetic
ggccgtcccgaacgcgcctacgcccctcatagggttccgcagacatgtggaccttatggtaggcgcggccgctct

SEQ ID NO: 112068 - DNA, 75 bp, Artificial Sequence
  Synthetic
ggccgtcccgaacgcgcctacgcccctcattgggttccgcagacatgtggaccttatggtaggcgcggccgctct

SEQ ID NO: 112069 - DNA, 75 bp, Artificial Sequence
  Synthetic
ggccgtcccgaacgcgcctacgcccctcatcgggttccgcagacatgtggaccttatggtaggcgcggccgctct

SEQ ID NO: 112070 - DNA, 75 bp, Artificial Sequence
  Synthetic
ggccgtcccgaacgcgcctacgcccctcatggggttccgcagacatgtggaccttatggtaggcgcggccgctct

SEQ ID NO: 112071 - DNA, 75 bp, Artificial Sequence
  Synthetic
ggccgtcccgaacgcgcccacgcccctcatagggttccgcagacatgtggaccttatggtaggcgcggccgctct

SEQ ID NO: 112072 - DNA, 75 bp, Artificial Sequence
  Synthetic
ggccgtcccgaacgcgcccacgcccctcattgggttccgcagacatgtggaccttatggtaggcgcggccgctct

SEQ ID NO: 112073 - DNA, 75 bp, Artificial Sequence
  Synthetic
ggccgtcccgaacgcgcccacgcccctcatcgggttccgcagacatgtggaccttatggtaggcgcggccgctct

SEQ ID NO: 112074 - DNA, 75 bp, Artificial Sequence
  Synthetic
ggccgtcccgaacgcgcccacgcccctcatggggttccgcagacatgtggaccttatggtaggcgcggccgctct

SEQ ID NO: 112075 - DNA, 75 bp, Artificial Sequence
  Synthetic
ggccgtcccgaacgcgccgacgcccctcatagggttccgcagacatgtggaccttatggtaggcgcggccgctct

SEQ ID NO: 112076 - DNA, 75 bp, Artificial Sequence
  Synthetic
ggccgtcccgaacgcgccgacgcccctcattgggttccgcagacatgtggaccttatggtaggcgcggccgctct

SEQ ID NO: 112077 - DNA, 75 bp, Artificial Sequence
  Synthetic
ggccgtcccgaacgcgccgacgcccctcatcgggttccgcagacatgtggaccttatggtaggcgcggccgctct

SEQ ID NO: 112078 - DNA, 75 bp, Artificial Sequence
  Synthetic
ggccgtcccgaacgcgccgacgcccctcatggggttccgcagacatgtggaccttatggtaggcgcggccgctct

SEQ ID NO: 112079 - DNA, 75 bp, Artificial Sequence
  Synthetic
ggccgtcccgaacgcggcaacgcccctcatagggttccgcagacatgtggaccttatggtaggcgcggccgctct

SEQ ID NO: 112080 - DNA, 75 bp, Artificial Sequence
  Synthetic
ggccgtcccgaacgcggcaacgcccctcattgggttccgcagacatgtggaccttatggtaggcgcggccgctct

SEQ ID NO: 112081 - DNA, 75 bp, Artificial Sequence
  Synthetic
ggccgtcccgaacgcggcaacgcccctcatcgggttccgcagacatgtggaccttatggtaggcgcggccgctct

SEQ ID NO: 112082 - DNA, 75 bp, Artificial Sequence
  Synthetic
ggccgtcccgaacgcggcaacgcccctcatggggttccgcagacatgtggaccttatggtaggcgcggccgctct

SEQ ID NO: 112083 - DNA, 75 bp, Artificial Sequence
  Synthetic
ggccgtcccgaacgcggctacgcccctcatagggttccgcagacatgtggaccttatggtaggcgcggccgctct

SEQ ID NO: 112084 - DNA, 75 bp, Artificial Sequence
  Synthetic
ggccgtcccgaacgcggctacgcccctcattgggttccgcagacatgtggaccttatggtaggcgcggccgctct

SEQ ID NO: 112085 - DNA, 75 bp, Artificial Sequence
  Synthetic
ggccgtcccgaacgcggctacgcccctcatcgggttccgcagacatgtggaccttatggtaggcgcggccgctct

SEQ ID NO: 112086 - DNA, 75 bp, Artificial Sequence
  Synthetic
ggccgtcccgaacgcggctacgcccctcatggggttccgcagacatgtggaccttatggtaggcgcggccgctct

SEQ ID NO: 112087 - DNA, 75 bp, Artificial Sequence
  Synthetic
ggccgtcccgaacgcggccacgcccctcatagggttccgcagacatgtggaccttatggtaggcgcggccgctct

SEQ ID NO: 112088 - DNA, 75 bp, Artificial Sequence
  Synthetic
ggccgtcccgaacgcggccacgcccctcattgggttccgcagacatgtggaccttatggtaggcgcggccgctct

SEQ ID NO: 112089 - DNA, 75 bp, Artificial Sequence
  Synthetic
ggccgtcccgaacgcggccacgcccctcatcgggttccgcagacatgtggaccttatggtaggcgcggccgctct

SEQ ID NO: 112090 - DNA, 75 bp, Artificial Sequence
  Synthetic
ggccgtcccgaacgcggccacgcccctcatggggttccgcagacatgtggaccttatggtaggcgcggccgctct

SEQ ID NO: 112091 - DNA, 75 bp, Artificial Sequence
  Synthetic
ggccgtcccgaacgcggcgacgcccctcatagggttccgcagacatgtggaccttatggtaggcgcggccgctct

SEQ ID NO: 112092 - DNA, 75 bp, Artificial Sequence
  Synthetic
ggccgtcccgaacgcggcgacgcccctcattgggttccgcagacatgtggaccttatggtaggcgcggccgctct

SEQ ID NO: 112093 - DNA, 75 bp, Artificial Sequence
  Synthetic
ggccgtcccgaacgcggcgacgcccctcatcgggttccgcagacatgtggaccttatggtaggcgcggccgctct

SEQ ID NO: 112094 - DNA, 75 bp, Artificial Sequence
  Synthetic
ggccgtcccgaacgcggcgacgcccctcatggggttccgcagacatgtggaccttatggtaggcgcggccgctct

SEQ ID NO: 112095 - DNA, 75 bp, Artificial Sequence
  Synthetic
aagggcagggtggtccccgtggccacgtactctgtcctcggcttgtggtcctttctcctcctagtcctggcccta

SEQ ID NO: 112096 - DNA, 75 bp, Artificial Sequence
  Synthetic
tcgagcctgctatgcgcgggcccacaccactactcaacaggttggtgtctgtgcagaatgaagtgacactcactc

SEQ ID NO: 112097 - DNA, 75 bp, Artificial Sequence
  Synthetic
tcgagcctgctatgcgcgggcccacaccactactctacaggttggtgtctgtgcagaatgaagtgacactcactc

SEQ ID NO: 112098 - DNA, 75 bp, Artificial Sequence
  Synthetic
tcgagcctgctatgcgcgggcccacaccactactccacaggttggtgtctgtgcagaatgaagtgacactcactc

SEQ ID NO: 112099 - DNA, 75 bp, Artificial Sequence
  Synthetic
tcgagcctgctatgcgcgggcccacaccactactcgacaggttggtgtctgtgcagaatgaagtgacactcactc

SEQ ID NO: 112100 - DNA, 75 bp, Artificial Sequence
  Synthetic
tcgagcctgctatgcgcgggcccacaccacttctcaacaggttggtgtctgtgcagaatgaagtgacactcactc

SEQ ID NO: 112101 - DNA, 75 bp, Artificial Sequence
  Synthetic
tcgagcctgctatgcgcgggcccacaccacttctctacaggttggtgtctgtgcagaatgaagtgacactcactc

SEQ ID NO: 112102 - DNA, 75 bp, Artificial Sequence
  Synthetic
tcgagcctgctatgcgcgggcccacaccacttctccacaggttggtgtctgtgcagaatgaagtgacactcactc

SEQ ID NO: 112103 - DNA, 75 bp, Artificial Sequence
  Synthetic
tcgagcctgctatgcgcgggcccacaccacttctcgacaggttggtgtctgtgcagaatgaagtgacactcactc

SEQ ID NO: 112104 - DNA, 75 bp, Artificial Sequence
  Synthetic
tcgagcctgctatgcgcgggcccacaccactcctcaacaggttggtgtctgtgcagaatgaagtgacactcactc

SEQ ID NO: 112105 - DNA, 75 bp, Artificial Sequence
  Synthetic
tcgagcctgctatgcgcgggcccacaccactcctctacaggttggtgtctgtgcagaatgaagtgacactcactc

SEQ ID NO: 112106 - DNA, 75 bp, Artificial Sequence
  Synthetic
tcgagcctgctatgcgcgggcccacaccactcctccacaggttggtgtctgtgcagaatgaagtgacactcactc

SEQ ID NO: 112107 - DNA, 75 bp, Artificial Sequence
  Synthetic
tcgagcctgctatgcgcgggcccacaccactcctcgacaggttggtgtctgtgcagaatgaagtgacactcactc

SEQ ID NO: 112108 - DNA, 75 bp, Artificial Sequence
  Synthetic
tcgagcctgctatgcgcgggcccacaccactgctcaacaggttggtgtctgtgcagaatgaagtgacactcactc

SEQ ID NO: 112109 - DNA, 75 bp, Artificial Sequence
  Synthetic
tcgagcctgctatgcgcgggcccacaccactgctctacaggttggtgtctgtgcagaatgaagtgacactcactc

SEQ ID NO: 112110 - DNA, 75 bp, Artificial Sequence
  Synthetic
tcgagcctgctatgcgcgggcccacaccactgctccacaggttggtgtctgtgcagaatgaagtgacactcactc

SEQ ID NO: 112111 - DNA, 75 bp, Artificial Sequence
  Synthetic
tcgagcctgctatgcgcgggcccacaccactgctcgacaggttggtgtctgtgcagaatgaagtgacactcactc

SEQ ID NO: 112112 - DNA, 75 bp, Artificial Sequence
  Synthetic
tcgagcctgctatgcgcgggcccacacctctactcaacaggttggtgtctgtgcagaatgaagtgacactcactc

SEQ ID NO: 112113 - DNA, 75 bp, Artificial Sequence
  Synthetic
tcgagcctgctatgcgcgggcccacacctctactctacaggttggtgtctgtgcagaatgaagtgacactcactc

SEQ ID NO: 112114 - DNA, 75 bp, Artificial Sequence
  Synthetic
tcgagcctgctatgcgcgggcccacacctctactccacaggttggtgtctgtgcagaatgaagtgacactcactc

SEQ ID NO: 112115 - DNA, 75 bp, Artificial Sequence
  Synthetic
tcgagcctgctatgcgcgggcccacacctctactcgacaggttggtgtctgtgcagaatgaagtgacactcactc

SEQ ID NO: 112116 - DNA, 75 bp, Artificial Sequence
  Synthetic
tcgagcctgctatgcgcgggcccacacctcttctcaacaggttggtgtctgtgcagaatgaagtgacactcactc

SEQ ID NO: 112117 - DNA, 75 bp, Artificial Sequence
  Synthetic
tcgagcctgctatgcgcgggcccacacctcttctctacaggttggtgtctgtgcagaatgaagtgacactcactc

SEQ ID NO: 112118 - DNA, 75 bp, Artificial Sequence
  Synthetic
tcgagcctgctatgcgcgggcccacacctcttctccacaggttggtgtctgtgcagaatgaagtgacactcactc

SEQ ID NO: 112119 - DNA, 75 bp, Artificial Sequence
  Synthetic
tcgagcctgctatgcgcgggcccacacctcttctcgacaggttggtgtctgtgcagaatgaagtgacactcactc

SEQ ID NO: 112120 - DNA, 75 bp, Artificial Sequence
  Synthetic
tcgagcctgctatgcgcgggcccacacctctcctcaacaggttggtgtctgtgcagaatgaagtgacactcactc

SEQ ID NO: 112121 - DNA, 75 bp, Artificial Sequence
  Synthetic
tcgagcctgctatgcgcgggcccacacctctcctctacaggttggtgtctgtgcagaatgaagtgacactcactc

SEQ ID NO: 112122 - DNA, 75 bp, Artificial Sequence
  Synthetic
tcgagcctgctatgcgcgggcccacacctctcctccacaggttggtgtctgtgcagaatgaagtgacactcactc

SEQ ID NO: 112123 - DNA, 75 bp, Artificial Sequence
  Synthetic
tcgagcctgctatgcgcgggcccacacctctcctcgacaggttggtgtctgtgcagaatgaagtgacactcactc

SEQ ID NO: 112124 - DNA, 75 bp, Artificial Sequence
  Synthetic
tcgagcctgctatgcgcgggcccacacctctgctcaacaggttggtgtctgtgcagaatgaagtgacactcactc

SEQ ID NO: 112125 - DNA, 75 bp, Artificial Sequence
  Synthetic
tcgagcctgctatgcgcgggcccacacctctgctctacaggttggtgtctgtgcagaatgaagtgacactcactc

SEQ ID NO: 112126 - DNA, 75 bp, Artificial Sequence
  Synthetic
tcgagcctgctatgcgcgggcccacacctctgctccacaggttggtgtctgtgcagaatgaagtgacactcactc

SEQ ID NO: 112127 - DNA, 75 bp, Artificial Sequence
  Synthetic
tcgagcctgctatgcgcgggcccacacctctgctcgacaggttggtgtctgtgcagaatgaagtgacactcactc

SEQ ID NO: 112128 - DNA, 75 bp, Artificial Sequence
  Synthetic
tcgagcctgctatgcgcgggcccacacccctactcaacaggttggtgtctgtgcagaatgaagtgacactcactc

SEQ ID NO: 112129 - DNA, 75 bp, Artificial Sequence
  Synthetic
tcgagcctgctatgcgcgggcccacacccctactctacaggttggtgtctgtgcagaatgaagtgacactcactc

SEQ ID NO: 112130 - DNA, 75 bp, Artificial Sequence
  Synthetic
tcgagcctgctatgcgcgggcccacacccctactccacaggttggtgtctgtgcagaatgaagtgacactcactc

SEQ ID NO: 112131 - DNA, 75 bp, Artificial Sequence
  Synthetic
tcgagcctgctatgcgcgggcccacacccctactcgacaggttggtgtctgtgcagaatgaagtgacactcactc

SEQ ID NO: 112132 - DNA, 75 bp, Artificial Sequence
  Synthetic
tcgagcctgctatgcgcgggcccacaccccttctcaacaggttggtgtctgtgcagaatgaagtgacactcactc

SEQ ID NO: 112133 - DNA, 75 bp, Artificial Sequence
  Synthetic
tcgagcctgctatgcgcgggcccacaccccttctctacaggttggtgtctgtgcagaatgaagtgacactcactc

SEQ ID NO: 112134 - DNA, 75 bp, Artificial Sequence
  Synthetic
tcgagcctgctatgcgcgggcccacaccccttctccacaggttggtgtctgtgcagaatgaagtgacactcactc

SEQ ID NO: 112135 - DNA, 75 bp, Artificial Sequence
  Synthetic
tcgagcctgctatgcgcgggcccacaccccttctcgacaggttggtgtctgtgcagaatgaagtgacactcactc

SEQ ID NO: 112136 - DNA, 75 bp, Artificial Sequence
  Synthetic
tcgagcctgctatgcgcgggcccacacccctcctcaacaggttggtgtctgtgcagaatgaagtgacactcactc

SEQ ID NO: 112137 - DNA, 75 bp, Artificial Sequence
  Synthetic
tcgagcctgctatgcgcgggcccacacccctcctctacaggttggtgtctgtgcagaatgaagtgacactcactc

SEQ ID NO: 112138 - DNA, 75 bp, Artificial Sequence
  Synthetic
tcgagcctgctatgcgcgggcccacacccctcctccacaggttggtgtctgtgcagaatgaagtgacactcactc

SEQ ID NO: 112139 - DNA, 75 bp, Artificial Sequence
  Synthetic
tcgagcctgctatgcgcgggcccacacccctcctcgacaggttggtgtctgtgcagaatgaagtgacactcactc

SEQ ID NO: 112140 - DNA, 75 bp, Artificial Sequence
  Synthetic
tcgagcctgctatgcgcgggcccacacccctgctcaacaggttggtgtctgtgcagaatgaagtgacactcactc

SEQ ID NO: 112141 - DNA, 75 bp, Artificial Sequence
  Synthetic
tcgagcctgctatgcgcgggcccacacccctgctctacaggttggtgtctgtgcagaatgaagtgacactcactc

SEQ ID NO: 112142 - DNA, 75 bp, Artificial Sequence
  Synthetic
tcgagcctgctatgcgcgggcccacacccctgctccacaggttggtgtctgtgcagaatgaagtgacactcactc

SEQ ID NO: 112143 - DNA, 75 bp, Artificial Sequence
  Synthetic
tcgagcctgctatgcgcgggcccacacccctgctcgacaggttggtgtctgtgcagaatgaagtgacactcactc

SEQ ID NO: 112144 - DNA, 75 bp, Artificial Sequence
  Synthetic
tcgagcctgctatgcgcgggcccacaccgctactcaacaggttggtgtctgtgcagaatgaagtgacactcactc

SEQ ID NO: 112145 - DNA, 75 bp, Artificial Sequence
  Synthetic
tcgagcctgctatgcgcgggcccacaccgctactctacaggttggtgtctgtgcagaatgaagtgacactcactc

SEQ ID NO: 112146 - DNA, 75 bp, Artificial Sequence
  Synthetic
tcgagcctgctatgcgcgggcccacaccgctactccacaggttggtgtctgtgcagaatgaagtgacactcactc

SEQ ID NO: 112147 - DNA, 75 bp, Artificial Sequence
  Synthetic
tcgagcctgctatgcgcgggcccacaccgctactcgacaggttggtgtctgtgcagaatgaagtgacactcactc

SEQ ID NO: 112148 - DNA, 75 bp, Artificial Sequence
  Synthetic
tcgagcctgctatgcgcgggcccacaccgcttctcaacaggttggtgtctgtgcagaatgaagtgacactcactc

SEQ ID NO: 112149 - DNA, 75 bp, Artificial Sequence
  Synthetic
tcgagcctgctatgcgcgggcccacaccgcttctctacaggttggtgtctgtgcagaatgaagtgacactcactc

SEQ ID NO: 112150 - DNA, 75 bp, Artificial Sequence
  Synthetic
tcgagcctgctatgcgcgggcccacaccgcttctccacaggttggtgtctgtgcagaatgaagtgacactcactc

SEQ ID NO: 112151 - DNA, 75 bp, Artificial Sequence
  Synthetic
tcgagcctgctatgcgcgggcccacaccgcttctcgacaggttggtgtctgtgcagaatgaagtgacactcactc

SEQ ID NO: 112152 - DNA, 75 bp, Artificial Sequence
  Synthetic
tcgagcctgctatgcgcgggcccacaccgctcctcaacaggttggtgtctgtgcagaatgaagtgacactcactc

SEQ ID NO: 112153 - DNA, 75 bp, Artificial Sequence
  Synthetic
tcgagcctgctatgcgcgggcccacaccgctcctctacaggttggtgtctgtgcagaatgaagtgacactcactc

SEQ ID NO: 112154 - DNA, 75 bp, Artificial Sequence
  Synthetic
tcgagcctgctatgcgcgggcccacaccgctcctccacaggttggtgtctgtgcagaatgaagtgacactcactc

SEQ ID NO: 112155 - DNA, 75 bp, Artificial Sequence
  Synthetic
tcgagcctgctatgcgcgggcccacaccgctcctcgacaggttggtgtctgtgcagaatgaagtgacactcactc

SEQ ID NO: 112156 - DNA, 75 bp, Artificial Sequence
  Synthetic
tcgagcctgctatgcgcgggcccacaccgctgctcaacaggttggtgtctgtgcagaatgaagtgacactcactc

SEQ ID NO: 112157 - DNA, 75 bp, Artificial Sequence
  Synthetic
tcgagcctgctatgcgcgggcccacaccgctgctctacaggttggtgtctgtgcagaatgaagtgacactcactc

SEQ ID NO: 112158 - DNA, 75 bp, Artificial Sequence
  Synthetic
tcgagcctgctatgcgcgggcccacaccgctgctccacaggttggtgtctgtgcagaatgaagtgacactcactc

SEQ ID NO: 112159 - DNA, 75 bp, Artificial Sequence
  Synthetic
tcgagcctgctatgcgcgggcccacaccgctgctcgacaggttggtgtctgtgcagaatgaagtgacactcactc

SEQ ID NO: 112160 - DNA, 75 bp, Artificial Sequence
  Synthetic
acacactccagtcaactcctggctaggcaacataatcatgtttgcccccacattgtgggcgaggatgatactgat

SEQ ID NO: 112161 - DNA, 75 bp, Artificial Sequence
  Synthetic
cagcaagcaaacccccgttcctcctcccaggaggaagcggacggttcaactcactgagtccgttgtttctactgc

SEQ ID NO: 112162 - DNA, 75 bp, Artificial Sequence
  Synthetic
tcttgctggagagcttgcgaccacctaccggtggctggttcgggtgtacttggatgaactccaccggttatgtta

SEQ ID NO: 112163 - DNA, 75 bp, Artificial Sequence
  Synthetic
cccagaagcaacatacagtaagtgtggctcgggaccctggctaactcccagatgcctcgtccattactcctacag

SEQ ID NO: 112164 - DNA, 75 bp, Artificial Sequence
  Synthetic
tgaacaccaacggaagctggcacatcaataggacagccttaaactgtaatgacagcttacagacaggtttcttgg

SEQ ID NO: 112165 - DNA, 75 bp, Artificial Sequence
  Synthetic
tgaacaccaacggaagctggcacatcaataggactgccttaaactgtaatgacagcttacagacaggtttcttgg

SEQ ID NO: 112166 - DNA, 75 bp, Artificial Sequence
  Synthetic
tgaacaccaacggaagctggcacatcaataggaccgccttaaactgtaatgacagcttacagacaggtttcttgg

SEQ ID NO: 112167 - DNA, 75 bp, Artificial Sequence
  Synthetic
tgaacaccaacggaagctggcacatcaataggacggccttaaactgtaatgacagcttacagacaggtttcttgg

SEQ ID NO: 112168 - DNA, 75 bp, Artificial Sequence
  Synthetic
tctaccgtgagtgaggaggccagtgaggacgtcgtctgctgttcgatgtcctacacatggacaggcgccctgatc

SEQ ID NO: 112169 - DNA, 75 bp, Artificial Sequence
  Synthetic
ccatcacttacgctgggcagcgcggcttggatcagaggccctattgctggcactacgcgcctaaaccgtgcggta

SEQ ID NO: 112170 - DNA, 75 bp, Artificial Sequence
  Synthetic
cgtggggatccctgagaaatggatgatcgtgacagggtcgagatgagtcctctactgttctcaacaactgagctc

SEQ ID NO: 112171 - DNA, 75 bp, Artificial Sequence
  Synthetic
cgtggggatccctgagaattggatgatcgtgacagggtcgagatgagtcctctactgttctcaacaactgagctc

SEQ ID NO: 112172 - DNA, 75 bp, Artificial Sequence
  Synthetic
cgtggggatccctgagaactggatgatcgtgacagggtcgagatgagtcctctactgttctcaacaactgagctc

SEQ ID NO: 112173 - DNA, 75 bp, Artificial Sequence
  Synthetic
cgtggggatccctgagaagtggatgatcgtgacagggtcgagatgagtcctctactgttctcaacaactgagctc

SEQ ID NO: 112174 - DNA, 75 bp, Artificial Sequence
  Synthetic
cgtggggatccctgtgaaatggatgatcgtgacagggtcgagatgagtcctctactgttctcaacaactgagctc

SEQ ID NO: 112175 - DNA, 75 bp, Artificial Sequence
  Synthetic
cgtggggatccctgtgaattggatgatcgtgacagggtcgagatgagtcctctactgttctcaacaactgagctc

SEQ ID NO: 112176 - DNA, 75 bp, Artificial Sequence
  Synthetic
cgtggggatccctgtgaactggatgatcgtgacagggtcgagatgagtcctctactgttctcaacaactgagctc

SEQ ID NO: 112177 - DNA, 75 bp, Artificial Sequence
  Synthetic
cgtggggatccctgtgaagtggatgatcgtgacagggtcgagatgagtcctctactgttctcaacaactgagctc

SEQ ID NO: 112178 - DNA, 75 bp, Artificial Sequence
  Synthetic
cgtggggatccctgcgaaatggatgatcgtgacagggtcgagatgagtcctctactgttctcaacaactgagctc

SEQ ID NO: 112179 - DNA, 75 bp, Artificial Sequence
  Synthetic
cgtggggatccctgcgaattggatgatcgtgacagggtcgagatgagtcctctactgttctcaacaactgagctc

SEQ ID NO: 112180 - DNA, 75 bp, Artificial Sequence
  Synthetic
cgtggggatccctgcgaactggatgatcgtgacagggtcgagatgagtcctctactgttctcaacaactgagctc

SEQ ID NO: 112181 - DNA, 75 bp, Artificial Sequence
  Synthetic
cgtggggatccctgcgaagtggatgatcgtgacagggtcgagatgagtcctctactgttctcaacaactgagctc

SEQ ID NO: 112182 - DNA, 75 bp, Artificial Sequence
  Synthetic
cgtggggatccctgggaaatggatgatcgtgacagggtcgagatgagtcctctactgttctcaacaactgagctc

SEQ ID NO: 112183 - DNA, 75 bp, Artificial Sequence
  Synthetic
cgtggggatccctgggaattggatgatcgtgacagggtcgagatgagtcctctactgttctcaacaactgagctc

SEQ ID NO: 112184 - DNA, 75 bp, Artificial Sequence
  Synthetic
cgtggggatccctgggaactggatgatcgtgacagggtcgagatgagtcctctactgttctcaacaactgagctc

SEQ ID NO: 112185 - DNA, 75 bp, Artificial Sequence
  Synthetic
cgtggggatccctgggaagtggatgatcgtgacagggtcgagatgagtcctctactgttctcaacaactgagctc

SEQ ID NO: 112186 - DNA, 75 bp, Artificial Sequence
  Synthetic
cggcagaagaatcgaagctgccaattagccccctgagcaactcgctcttacgccatcacaacatggtgtatgcca

SEQ ID NO: 112187 - DNA, 75 bp, Artificial Sequence
  Synthetic
cggcagaagaatcgaagctgccaattagccccctgagcaactcgctcttacgccatcacaacttggtgtatgcca

SEQ ID NO: 112188 - DNA, 75 bp, Artificial Sequence
  Synthetic
cggcagaagaatcgaagctgccaattagccccctgagcaactcgctcttacgccatcacaacctggtgtatgcca

SEQ ID NO: 112189 - DNA, 75 bp, Artificial Sequence
  Synthetic
cggcagaagaatcgaagctgccaattagccccctgagcaactcgctcttacgccatcacaacgtggtgtatgcca

SEQ ID NO: 112190 - DNA, 75 bp, Artificial Sequence
  Synthetic
tagctatgccaatgtgaacgggagctcggaagacaagccctattgctggcaatacacgccaagaccatgcggggt

SEQ ID NO: 112191 - DNA, 75 bp, Artificial Sequence
  Synthetic
tagctatgccaatgtgaacgggagctcggaagacaagccctattgctggcaatactcgccaagaccatgcggggt

SEQ ID NO: 112192 - DNA, 75 bp, Artificial Sequence
  Synthetic
tagctatgccaatgtgaacgggagctcggaagacaagccctattgctggcaatacccgccaagaccatgcggggt

SEQ ID NO: 112193 - DNA, 75 bp, Artificial Sequence
  Synthetic
tagctatgccaatgtgaacgggagctcggaagacaagccctattgctggcaatacgcgccaagaccatgcggggt

SEQ ID NO: 112194 - DNA, 75 bp, Artificial Sequence
  Synthetic
tagctatgccaatgtgaacgggagctcggaagacaagccctattgctggcattacacgccaagaccatgcggggt

SEQ ID NO: 112195 - DNA, 75 bp, Artificial Sequence
  Synthetic
tagctatgccaatgtgaacgggagctcggaagacaagccctattgctggcattactcgccaagaccatgcggggt

SEQ ID NO: 112196 - DNA, 75 bp, Artificial Sequence
  Synthetic
tagctatgccaatgtgaacgggagctcggaagacaagccctattgctggcattacccgccaagaccatgcggggt

SEQ ID NO: 112197 - DNA, 75 bp, Artificial Sequence
  Synthetic
tagctatgccaatgtgaacgggagctcggaagacaagccctattgctggcattacgcgccaagaccatgcggggt

SEQ ID NO: 112198 - DNA, 75 bp, Artificial Sequence
  Synthetic
tagctatgccaatgtgaacgggagctcggaagacaagccctattgctggcactacacgccaagaccatgcggggt

SEQ ID NO: 112199 - DNA, 75 bp, Artificial Sequence
  Synthetic
tagctatgccaatgtgaacgggagctcggaagacaagccctattgctggcactactcgccaagaccatgcggggt

SEQ ID NO: 112200 - DNA, 75 bp, Artificial Sequence
  Synthetic
tagctatgccaatgtgaacgggagctcggaagacaagccctattgctggcactacccgccaagaccatgcggggt

SEQ ID NO: 112201 - DNA, 75 bp, Artificial Sequence
  Synthetic
tagctatgccaatgtgaacgggagctcggaagacaagccctattgctggcactacgcgccaagaccatgcggggt

SEQ ID NO: 112202 - DNA, 75 bp, Artificial Sequence
  Synthetic
tagctatgccaatgtgaacgggagctcggaagacaagccctattgctggcagtacacgccaagaccatgcggggt

SEQ ID NO: 112203 - DNA, 75 bp, Artificial Sequence
  Synthetic
tagctatgccaatgtgaacgggagctcggaagacaagccctattgctggcagtactcgccaagaccatgcggggt

SEQ ID NO: 112204 - DNA, 75 bp, Artificial Sequence
  Synthetic
tagctatgccaatgtgaacgggagctcggaagacaagccctattgctggcagtacccgccaagaccatgcggggt

SEQ ID NO: 112205 - DNA, 75 bp, Artificial Sequence
  Synthetic
tagctatgccaatgtgaacgggagctcggaagacaagccctattgctggcagtacgcgccaagaccatgcggggt

SEQ ID NO: 112206 - DNA, 75 bp, Artificial Sequence
  Synthetic
tagctatgccaatgtgatcgggagctcggaagacaagccctattgctggcaatacacgccaagaccatgcggggt

SEQ ID NO: 112207 - DNA, 75 bp, Artificial Sequence
  Synthetic
tagctatgccaatgtgatcgggagctcggaagacaagccctattgctggcaatactcgccaagaccatgcggggt

SEQ ID NO: 112208 - DNA, 75 bp, Artificial Sequence
  Synthetic
tagctatgccaatgtgatcgggagctcggaagacaagccctattgctggcaatacccgccaagaccatgcggggt

SEQ ID NO: 112209 - DNA, 75 bp, Artificial Sequence
  Synthetic
tagctatgccaatgtgatcgggagctcggaagacaagccctattgctggcaatacgcgccaagaccatgcggggt

SEQ ID NO: 112210 - DNA, 75 bp, Artificial Sequence
  Synthetic
tagctatgccaatgtgatcgggagctcggaagacaagccctattgctggcattacacgccaagaccatgcggggt

SEQ ID NO: 112211 - DNA, 75 bp, Artificial Sequence
  Synthetic
tagctatgccaatgtgatcgggagctcggaagacaagccctattgctggcattactcgccaagaccatgcggggt

SEQ ID NO: 112212 - DNA, 75 bp, Artificial Sequence
  Synthetic
tagctatgccaatgtgatcgggagctcggaagacaagccctattgctggcattacccgccaagaccatgcggggt

SEQ ID NO: 112213 - DNA, 75 bp, Artificial Sequence
  Synthetic
tagctatgccaatgtgatcgggagctcggaagacaagccctattgctggcattacgcgccaagaccatgcggggt

SEQ ID NO: 112214 - DNA, 75 bp, Artificial Sequence
  Synthetic
tagctatgccaatgtgatcgggagctcggaagacaagccctattgctggcactacacgccaagaccatgcggggt

SEQ ID NO: 112215 - DNA, 75 bp, Artificial Sequence
  Synthetic
tagctatgccaatgtgatcgggagctcggaagacaagccctattgctggcactactcgccaagaccatgcggggt

SEQ ID NO: 112216 - DNA, 75 bp, Artificial Sequence
  Synthetic
tagctatgccaatgtgatcgggagctcggaagacaagccctattgctggcactacccgccaagaccatgcggggt

SEQ ID NO: 112217 - DNA, 75 bp, Artificial Sequence
  Synthetic
tagctatgccaatgtgatcgggagctcggaagacaagccctattgctggcactacgcgccaagaccatgcggggt

SEQ ID NO: 112218 - DNA, 75 bp, Artificial Sequence
  Synthetic
tagctatgccaatgtgatcgggagctcggaagacaagccctattgctggcagtacacgccaagaccatgcggggt

SEQ ID NO: 112219 - DNA, 75 bp, Artificial Sequence
  Synthetic
tagctatgccaatgtgatcgggagctcggaagacaagccctattgctggcagtactcgccaagaccatgcggggt

SEQ ID NO: 112220 - DNA, 75 bp, Artificial Sequence
  Synthetic
tagctatgccaatgtgatcgggagctcggaagacaagccctattgctggcagtacccgccaagaccatgcggggt

SEQ ID NO: 112221 - DNA, 75 bp, Artificial Sequence
  Synthetic
tagctatgccaatgtgatcgggagctcggaagacaagccctattgctggcagtacgcgccaagaccatgcggggt

SEQ ID NO: 112222 - DNA, 75 bp, Artificial Sequence
  Synthetic
tagctatgccaatgtgaccgggagctcggaagacaagccctattgctggcaatacacgccaagaccatgcggggt

SEQ ID NO: 112223 - DNA, 75 bp, Artificial Sequence
  Synthetic
tagctatgccaatgtgaccgggagctcggaagacaagccctattgctggcaatactcgccaagaccatgcggggt

SEQ ID NO: 112224 - DNA, 75 bp, Artificial Sequence
  Synthetic
tagctatgccaatgtgaccgggagctcggaagacaagccctattgctggcaatacccgccaagaccatgcggggt

SEQ ID NO: 112225 - DNA, 75 bp, Artificial Sequence
  Synthetic
tagctatgccaatgtgaccgggagctcggaagacaagccctattgctggcaatacgcgccaagaccatgcggggt

SEQ ID NO: 112226 - DNA, 75 bp, Artificial Sequence
  Synthetic
tagctatgccaatgtgaccgggagctcggaagacaagccctattgctggcattacacgccaagaccatgcggggt

SEQ ID NO: 112227 - DNA, 75 bp, Artificial Sequence
  Synthetic
tagctatgccaatgtgaccgggagctcggaagacaagccctattgctggcattactcgccaagaccatgcggggt

SEQ ID NO: 112228 - DNA, 75 bp, Artificial Sequence
  Synthetic
tagctatgccaatgtgaccgggagctcggaagacaagccctattgctggcattacccgccaagaccatgcggggt

SEQ ID NO: 112229 - DNA, 75 bp, Artificial Sequence
  Synthetic
tagctatgccaatgtgaccgggagctcggaagacaagccctattgctggcattacgcgccaagaccatgcggggt

SEQ ID NO: 112230 - DNA, 75 bp, Artificial Sequence
  Synthetic
tagctatgccaatgtgaccgggagctcggaagacaagccctattgctggcactacacgccaagaccatgcggggt

SEQ ID NO: 112231 - DNA, 75 bp, Artificial Sequence
  Synthetic
tagctatgccaatgtgaccgggagctcggaagacaagccctattgctggcactactcgccaagaccatgcggggt

SEQ ID NO: 112232 - DNA, 75 bp, Artificial Sequence
  Synthetic
tagctatgccaatgtgaccgggagctcggaagacaagccctattgctggcactacccgccaagaccatgcggggt

SEQ ID NO: 112233 - DNA, 75 bp, Artificial Sequence
  Synthetic
tagctatgccaatgtgaccgggagctcggaagacaagccctattgctggcactacgcgccaagaccatgcggggt

SEQ ID NO: 112234 - DNA, 75 bp, Artificial Sequence
  Synthetic
tagctatgccaatgtgaccgggagctcggaagacaagccctattgctggcagtacacgccaagaccatgcggggt

SEQ ID NO: 112235 - DNA, 75 bp, Artificial Sequence
  Synthetic
tagctatgccaatgtgaccgggagctcggaagacaagccctattgctggcagtactcgccaagaccatgcggggt

SEQ ID NO: 112236 - DNA, 75 bp, Artificial Sequence
  Synthetic
tagctatgccaatgtgaccgggagctcggaagacaagccctattgctggcagtacccgccaagaccatgcggggt

SEQ ID NO: 112237 - DNA, 75 bp, Artificial Sequence
  Synthetic
tagctatgccaatgtgaccgggagctcggaagacaagccctattgctggcagtacgcgccaagaccatgcggggt

SEQ ID NO: 112238 - DNA, 75 bp, Artificial Sequence
  Synthetic
tagctatgccaatgtgagcgggagctcggaagacaagccctattgctggcaatacacgccaagaccatgcggggt

SEQ ID NO: 112239 - DNA, 75 bp, Artificial Sequence
  Synthetic
tagctatgccaatgtgagcgggagctcggaagacaagccctattgctggcaatactcgccaagaccatgcggggt

SEQ ID NO: 112240 - DNA, 75 bp, Artificial Sequence
  Synthetic
tagctatgccaatgtgagcgggagctcggaagacaagccctattgctggcaatacccgccaagaccatgcggggt

SEQ ID NO: 112241 - DNA, 75 bp, Artificial Sequence
  Synthetic
tagctatgccaatgtgagcgggagctcggaagacaagccctattgctggcaatacgcgccaagaccatgcggggt

SEQ ID NO: 112242 - DNA, 75 bp, Artificial Sequence
  Synthetic
tagctatgccaatgtgagcgggagctcggaagacaagccctattgctggcattacacgccaagaccatgcggggt

SEQ ID NO: 112243 - DNA, 75 bp, Artificial Sequence
  Synthetic
tagctatgccaatgtgagcgggagctcggaagacaagccctattgctggcattactcgccaagaccatgcggggt

SEQ ID NO: 112244 - DNA, 75 bp, Artificial Sequence
  Synthetic
tagctatgccaatgtgagcgggagctcggaagacaagccctattgctggcattacccgccaagaccatgcggggt

SEQ ID NO: 112245 - DNA, 75 bp, Artificial Sequence
  Synthetic
tagctatgccaatgtgagcgggagctcggaagacaagccctattgctggcattacgcgccaagaccatgcggggt

SEQ ID NO: 112246 - DNA, 75 bp, Artificial Sequence
  Synthetic
tagctatgccaatgtgagcgggagctcggaagacaagccctattgctggcactacacgccaagaccatgcggggt

SEQ ID NO: 112247 - DNA, 75 bp, Artificial Sequence
  Synthetic
tagctatgccaatgtgagcgggagctcggaagacaagccctattgctggcactactcgccaagaccatgcggggt

SEQ ID NO: 112248 - DNA, 75 bp, Artificial Sequence
  Synthetic
tagctatgccaatgtgagcgggagctcggaagacaagccctattgctggcactacccgccaagaccatgcggggt

SEQ ID NO: 112249 - DNA, 75 bp, Artificial Sequence
  Synthetic
tagctatgccaatgtgagcgggagctcggaagacaagccctattgctggcactacgcgccaagaccatgcggggt

SEQ ID NO: 112250 - DNA, 75 bp, Artificial Sequence
  Synthetic
tagctatgccaatgtgagcgggagctcggaagacaagccctattgctggcagtacacgccaagaccatgcggggt

SEQ ID NO: 112251 - DNA, 75 bp, Artificial Sequence
  Synthetic
tagctatgccaatgtgagcgggagctcggaagacaagccctattgctggcagtactcgccaagaccatgcggggt

SEQ ID NO: 112252 - DNA, 75 bp, Artificial Sequence
  Synthetic
tagctatgccaatgtgagcgggagctcggaagacaagccctattgctggcagtacccgccaagaccatgcggggt

SEQ ID NO: 112253 - DNA, 75 bp, Artificial Sequence
  Synthetic
tagctatgccaatgtgagcgggagctcggaagacaagccctattgctggcagtacgcgccaagaccatgcggggt

SEQ ID NO: 112254 - DNA, 75 bp, Artificial Sequence
  Synthetic
ggtgaaaatgagactgaagtgttcctgttagagagcatacgaccgcccaaaggtggttggtttggctgcacctgg

SEQ ID NO: 112255 - DNA, 75 bp, Artificial Sequence
  Synthetic
ggtgaaaatgagactgaagtgttcctgttagagagcatacgaccgcccaatggtggttggtttggctgcacctgg

SEQ ID NO: 112256 - DNA, 75 bp, Artificial Sequence
  Synthetic
ggtgaaaatgagactgaagtgttcctgttagagagcatacgaccgcccaacggtggttggtttggctgcacctgg

SEQ ID NO: 112257 - DNA, 75 bp, Artificial Sequence
  Synthetic
ggtgaaaatgagactgaagtgttcctgttagagagcatacgaccgcccaagggtggttggtttggctgcacctgg

SEQ ID NO: 112258 - DNA, 75 bp, Artificial Sequence
  Synthetic
ggtgaaaatgagactgaagtgttcctgttagagagcttacgaccgcccaaaggtggttggtttggctgcacctgg

SEQ ID NO: 112259 - DNA, 75 bp, Artificial Sequence
  Synthetic
ggtgaaaatgagactgaagtgttcctgttagagagcttacgaccgcccaatggtggttggtttggctgcacctgg

SEQ ID NO: 112260 - DNA, 75 bp, Artificial Sequence
  Synthetic
ggtgaaaatgagactgaagtgttcctgttagagagcttacgaccgcccaacggtggttggtttggctgcacctgg

SEQ ID NO: 112261 - DNA, 75 bp, Artificial Sequence
  Synthetic
ggtgaaaatgagactgaagtgttcctgttagagagcttacgaccgcccaagggtggttggtttggctgcacctgg

SEQ ID NO: 112262 - DNA, 75 bp, Artificial Sequence
  Synthetic
ggtgaaaatgagactgaagtgttcctgttagagagcctacgaccgcccaaaggtggttggtttggctgcacctgg

SEQ ID NO: 112263 - DNA, 75 bp, Artificial Sequence
  Synthetic
ggtgaaaatgagactgaagtgttcctgttagagagcctacgaccgcccaatggtggttggtttggctgcacctgg

SEQ ID NO: 112264 - DNA, 75 bp, Artificial Sequence
  Synthetic
ggtgaaaatgagactgaagtgttcctgttagagagcctacgaccgcccaacggtggttggtttggctgcacctgg

SEQ ID NO: 112265 - DNA, 75 bp, Artificial Sequence
  Synthetic
ggtgaaaatgagactgaagtgttcctgttagagagcctacgaccgcccaagggtggttggtttggctgcacctgg

SEQ ID NO: 112266 - DNA, 75 bp, Artificial Sequence
  Synthetic
ggtgaaaatgagactgaagtgttcctgttagagagcgtacgaccgcccaaaggtggttggtttggctgcacctgg

SEQ ID NO: 112267 - DNA, 75 bp, Artificial Sequence
  Synthetic
ggtgaaaatgagactgaagtgttcctgttagagagcgtacgaccgcccaatggtggttggtttggctgcacctgg

SEQ ID NO: 112268 - DNA, 75 bp, Artificial Sequence
  Synthetic
ggtgaaaatgagactgaagtgttcctgttagagagcgtacgaccgcccaacggtggttggtttggctgcacctgg

SEQ ID NO: 112269 - DNA, 75 bp, Artificial Sequence
  Synthetic
ggtgaaaatgagactgaagtgttcctgttagagagcgtacgaccgcccaagggtggttggtttggctgcacctgg

SEQ ID NO: 112270 - DNA, 75 bp, Artificial Sequence
  Synthetic
ggtgaaaatgagactgatgtgttcctgttagagagcatacgaccgcccaaaggtggttggtttggctgcacctgg

SEQ ID NO: 112271 - DNA, 75 bp, Artificial Sequence
  Synthetic
ggtgaaaatgagactgatgtgttcctgttagagagcatacgaccgcccaatggtggttggtttggctgcacctgg

SEQ ID NO: 112272 - DNA, 75 bp, Artificial Sequence
  Synthetic
ggtgaaaatgagactgatgtgttcctgttagagagcatacgaccgcccaacggtggttggtttggctgcacctgg

SEQ ID NO: 112273 - DNA, 75 bp, Artificial Sequence
  Synthetic
ggtgaaaatgagactgatgtgttcctgttagagagcatacgaccgcccaagggtggttggtttggctgcacctgg

SEQ ID NO: 112274 - DNA, 75 bp, Artificial Sequence
  Synthetic
ggtgaaaatgagactgatgtgttcctgttagagagcttacgaccgcccaaaggtggttggtttggctgcacctgg

SEQ ID NO: 112275 - DNA, 75 bp, Artificial Sequence
  Synthetic
ggtgaaaatgagactgatgtgttcctgttagagagcttacgaccgcccaatggtggttggtttggctgcacctgg

SEQ ID NO: 112276 - DNA, 75 bp, Artificial Sequence
  Synthetic
ggtgaaaatgagactgatgtgttcctgttagagagcttacgaccgcccaacggtggttggtttggctgcacctgg

SEQ ID NO: 112277 - DNA, 75 bp, Artificial Sequence
  Synthetic
ggtgaaaatgagactgatgtgttcctgttagagagcttacgaccgcccaagggtggttggtttggctgcacctgg

SEQ ID NO: 112278 - DNA, 75 bp, Artificial Sequence
  Synthetic
ggtgaaaatgagactgatgtgttcctgttagagagcctacgaccgcccaaaggtggttggtttggctgcacctgg

SEQ ID NO: 112279 - DNA, 75 bp, Artificial Sequence
  Synthetic
ggtgaaaatgagactgatgtgttcctgttagagagcctacgaccgcccaatggtggttggtttggctgcacctgg

SEQ ID NO: 112280 - DNA, 75 bp, Artificial Sequence
  Synthetic
ggtgaaaatgagactgatgtgttcctgttagagagcctacgaccgcccaacggtggttggtttggctgcacctgg

SEQ ID NO: 112281 - DNA, 75 bp, Artificial Sequence
  Synthetic
ggtgaaaatgagactgatgtgttcctgttagagagcctacgaccgcccaagggtggttggtttggctgcacctgg

SEQ ID NO: 112282 - DNA, 75 bp, Artificial Sequence
  Synthetic
ggtgaaaatgagactgatgtgttcctgttagagagcgtacgaccgcccaaaggtggttggtttggctgcacctgg

SEQ ID NO: 112283 - DNA, 75 bp, Artificial Sequence
  Synthetic
ggtgaaaatgagactgatgtgttcctgttagagagcgtacgaccgcccaatggtggttggtttggctgcacctgg

SEQ ID NO: 112284 - DNA, 75 bp, Artificial Sequence
  Synthetic
ggtgaaaatgagactgatgtgttcctgttagagagcgtacgaccgcccaacggtggttggtttggctgcacctgg

SEQ ID NO: 112285 - DNA, 75 bp, Artificial Sequence
  Synthetic
ggtgaaaatgagactgatgtgttcctgttagagagcgtacgaccgcccaagggtggttggtttggctgcacctgg

SEQ ID NO: 112286 - DNA, 75 bp, Artificial Sequence
  Synthetic
ggtgaaaatgagactgacgtgttcctgttagagagcatacgaccgcccaaaggtggttggtttggctgcacctgg

SEQ ID NO: 112287 - DNA, 75 bp, Artificial Sequence
  Synthetic
ggtgaaaatgagactgacgtgttcctgttagagagcatacgaccgcccaatggtggttggtttggctgcacctgg

SEQ ID NO: 112288 - DNA, 75 bp, Artificial Sequence
  Synthetic
ggtgaaaatgagactgacgtgttcctgttagagagcatacgaccgcccaacggtggttggtttggctgcacctgg

SEQ ID NO: 112289 - DNA, 75 bp, Artificial Sequence
  Synthetic
ggtgaaaatgagactgacgtgttcctgttagagagcatacgaccgcccaagggtggttggtttggctgcacctgg

SEQ ID NO: 112290 - DNA, 75 bp, Artificial Sequence
  Synthetic
ggtgaaaatgagactgacgtgttcctgttagagagcttacgaccgcccaaaggtggttggtttggctgcacctgg

SEQ ID NO: 112291 - DNA, 75 bp, Artificial Sequence
  Synthetic
ggtgaaaatgagactgacgtgttcctgttagagagcttacgaccgcccaatggtggttggtttggctgcacctgg

SEQ ID NO: 112292 - DNA, 75 bp, Artificial Sequence
  Synthetic
ggtgaaaatgagactgacgtgttcctgttagagagcttacgaccgcccaacggtggttggtttggctgcacctgg

SEQ ID NO: 112293 - DNA, 75 bp, Artificial Sequence
  Synthetic
ggtgaaaatgagactgacgtgttcctgttagagagcttacgaccgcccaagggtggttggtttggctgcacctgg

SEQ ID NO: 112294 - DNA, 75 bp, Artificial Sequence
  Synthetic
ggtgaaaatgagactgacgtgttcctgttagagagcctacgaccgcccaaaggtggttggtttggctgcacctgg

SEQ ID NO: 112295 - DNA, 75 bp, Artificial Sequence
  Synthetic
ggtgaaaatgagactgacgtgttcctgttagagagcctacgaccgcccaatggtggttggtttggctgcacctgg

SEQ ID NO: 112296 - DNA, 75 bp, Artificial Sequence
  Synthetic
ggtgaaaatgagactgacgtgttcctgttagagagcctacgaccgcccaacggtggttggtttggctgcacctgg

SEQ ID NO: 112297 - DNA, 75 bp, Artificial Sequence
  Synthetic
ggtgaaaatgagactgacgtgttcctgttagagagcctacgaccgcccaagggtggttggtttggctgcacctgg

SEQ ID NO: 112298 - DNA, 75 bp, Artificial Sequence
  Synthetic
ggtgaaaatgagactgacgtgttcctgttagagagcgtacgaccgcccaaaggtggttggtttggctgcacctgg

SEQ ID NO: 112299 - DNA, 75 bp, Artificial Sequence
  Synthetic
ggtgaaaatgagactgacgtgttcctgttagagagcgtacgaccgcccaatggtggttggtttggctgcacctgg

SEQ ID NO: 112300 - DNA, 75 bp, Artificial Sequence
  Synthetic
ggtgaaaatgagactgacgtgttcctgttagagagcgtacgaccgcccaacggtggttggtttggctgcacctgg

SEQ ID NO: 112301 - DNA, 75 bp, Artificial Sequence
  Synthetic
ggtgaaaatgagactgacgtgttcctgttagagagcgtacgaccgcccaagggtggttggtttggctgcacctgg

SEQ ID NO: 112302 - DNA, 75 bp, Artificial Sequence
  Synthetic
ggtgaaaatgagactgaggtgttcctgttagagagcatacgaccgcccaaaggtggttggtttggctgcacctgg

SEQ ID NO: 112303 - DNA, 75 bp, Artificial Sequence
  Synthetic
ggtgaaaatgagactgaggtgttcctgttagagagcatacgaccgcccaatggtggttggtttggctgcacctgg

SEQ ID NO: 112304 - DNA, 75 bp, Artificial Sequence
  Synthetic
ggtgaaaatgagactgaggtgttcctgttagagagcatacgaccgcccaacggtggttggtttggctgcacctgg

SEQ ID NO: 112305 - DNA, 75 bp, Artificial Sequence
  Synthetic
ggtgaaaatgagactgaggtgttcctgttagagagcatacgaccgcccaagggtggttggtttggctgcacctgg

SEQ ID NO: 112306 - DNA, 75 bp, Artificial Sequence
  Synthetic
ggtgaaaatgagactgaggtgttcctgttagagagcttacgaccgcccaaaggtggttggtttggctgcacctgg

SEQ ID NO: 112307 - DNA, 75 bp, Artificial Sequence
  Synthetic
ggtgaaaatgagactgaggtgttcctgttagagagcttacgaccgcccaatggtggttggtttggctgcacctgg

SEQ ID NO: 112308 - DNA, 75 bp, Artificial Sequence
  Synthetic
ggtgaaaatgagactgaggtgttcctgttagagagcttacgaccgcccaacggtggttggtttggctgcacctgg

SEQ ID NO: 112309 - DNA, 75 bp, Artificial Sequence
  Synthetic
ggtgaaaatgagactgaggtgttcctgttagagagcttacgaccgcccaagggtggttggtttggctgcacctgg

SEQ ID NO: 112310 - DNA, 75 bp, Artificial Sequence
  Synthetic
ggtgaaaatgagactgaggtgttcctgttagagagcctacgaccgcccaaaggtggttggtttggctgcacctgg

SEQ ID NO: 112311 - DNA, 75 bp, Artificial Sequence
  Synthetic
ggtgaaaatgagactgaggtgttcctgttagagagcctacgaccgcccaatggtggttggtttggctgcacctgg

SEQ ID NO: 112312 - DNA, 75 bp, Artificial Sequence
  Synthetic
ggtgaaaatgagactgaggtgttcctgttagagagcctacgaccgcccaacggtggttggtttggctgcacctgg

SEQ ID NO: 112313 - DNA, 75 bp, Artificial Sequence
  Synthetic
ggtgaaaatgagactgaggtgttcctgttagagagcctacgaccgcccaagggtggttggtttggctgcacctgg

SEQ ID NO: 112314 - DNA, 75 bp, Artificial Sequence
  Synthetic
ggtgaaaatgagactgaggtgttcctgttagagagcgtacgaccgcccaaaggtggttggtttggctgcacctgg

SEQ ID NO: 112315 - DNA, 75 bp, Artificial Sequence
  Synthetic
ggtgaaaatgagactgaggtgttcctgttagagagcgtacgaccgcccaatggtggttggtttggctgcacctgg

SEQ ID NO: 112316 - DNA, 75 bp, Artificial Sequence
  Synthetic
ggtgaaaatgagactgaggtgttcctgttagagagcgtacgaccgcccaacggtggttggtttggctgcacctgg

SEQ ID NO: 112317 - DNA, 75 bp, Artificial Sequence
  Synthetic
ggtgaaaatgagactgaggtgttcctgttagagagcgtacgaccgcccaagggtggttggtttggctgcacctgg

SEQ ID NO: 112318 - DNA, 75 bp, Artificial Sequence
  Synthetic
ccccatcagttacatcatgggtcatcaaatgggagtatgtggttctcgctttcctgctgctggcagatgcgcgcg

SEQ ID NO: 112319 - DNA, 75 bp, Artificial Sequence
  Synthetic
aaggccaggcaaccataacggaaacaccactttgagatgtcccaccgattgctttcgaaaacatccagaggcaac

SEQ ID NO: 112320 - DNA, 75 bp, Artificial Sequence
  Synthetic
aaggccaggcaaccataacggtaacaccactttgagatgtcccaccgattgctttcgaaaacatccagaggcaac

SEQ ID NO: 112321 - DNA, 75 bp, Artificial Sequence
  Synthetic
aaggccaggcaaccataacggcaacaccactttgagatgtcccaccgattgctttcgaaaacatccagaggcaac

SEQ ID NO: 112322 - DNA, 75 bp, Artificial Sequence
  Synthetic
aaggccaggcaaccataacgggaacaccactttgagatgtcccaccgattgctttcgaaaacatccagaggcaac

SEQ ID NO: 112323 - DNA, 75 bp, Artificial Sequence
  Synthetic
cctgggttggggtcttatctttatatgctgtgcctggtacatcaagggccgtacagtcccagttgccacctacgg

SEQ ID NO: 112324 - DNA, 75 bp, Artificial Sequence
  Synthetic
cataaggtccgtatgtttatagggggactggaacaccggttccaagccgcctgtaactggactcgtggggacccg

SEQ ID NO: 112325 - DNA, 75 bp, Artificial Sequence
  Synthetic
cttgtgggcattaccatctttacattaacaccgcactacaagtggctgctcgttcagatgatatggtggtgccag

SEQ ID NO: 112326 - DNA, 75 bp, Artificial Sequence
  Synthetic
cttgtgggcattaccatctttacattaacaccgcactacaagtggctgctcgttcagttgatatggtggtgccag

SEQ ID NO: 112327 - DNA, 75 bp, Artificial Sequence
  Synthetic
cttgtgggcattaccatctttacattaacaccgcactacaagtggctgctcgttcagctgatatggtggtgccag

SEQ ID NO: 112328 - DNA, 75 bp, Artificial Sequence
  Synthetic
cttgtgggcattaccatctttacattaacaccgcactacaagtggctgctcgttcaggtgatatggtggtgccag

SEQ ID NO: 112329 - DNA, 75 bp, Artificial Sequence
  Synthetic
aactgcaatgactccctccagactgggttccttgccgcgctgttttacgcgcacaggttcaacgcgtccggatgt

SEQ ID NO: 112330 - DNA, 75 bp, Artificial Sequence
  Synthetic
tgccgaatcttggctatgggaggtgtgggattgggtctgcaccgtgctgagtgacttcaaaacgtggctaaaagc

SEQ ID NO: 112331 - DNA, 75 bp, Artificial Sequence
  Synthetic
tgggattgggtctgcaccgtgctgagtgacttcaaaacgtggctaaaagctaagctgctgcctctcatgccaggt

SEQ ID NO: 112332 - DNA, 75 bp, Artificial Sequence
  Synthetic
tttctacggggttgatacactttcaccacaacgtagtagaagttcagtccctctacggtatatctccatcagtta

SEQ ID NO: 112333 - DNA, 75 bp, Artificial Sequence
  Synthetic
tttctacggggttgatacactttcaccacaacgtagtagaagttcagtccctctacggtatatctccatcagttt

SEQ ID NO: 112334 - DNA, 75 bp, Artificial Sequence
  Synthetic
tttctacggggttgatacactttcaccacaacgtagtagaagttcagtccctctacggtatatctccatcagttc

SEQ ID NO: 112335 - DNA, 75 bp, Artificial Sequence
  Synthetic
tttctacggggttgatacactttcaccacaacgtagtagaagttcagtccctctacggtatatctccatcagttg

SEQ ID NO: 112336 - DNA, 75 bp, Artificial Sequence
  Synthetic
tttctacggggttgatacactttcaccacaacgtagtagatgttcagtccctctacggtatatctccatcagtta

SEQ ID NO: 112337 - DNA, 75 bp, Artificial Sequence
  Synthetic
tttctacggggttgatacactttcaccacaacgtagtagatgttcagtccctctacggtatatctccatcagttt

SEQ ID NO: 112338 - DNA, 75 bp, Artificial Sequence
  Synthetic
tttctacggggttgatacactttcaccacaacgtagtagatgttcagtccctctacggtatatctccatcagttc

SEQ ID NO: 112339 - DNA, 75 bp, Artificial Sequence
  Synthetic
tttctacggggttgatacactttcaccacaacgtagtagatgttcagtccctctacggtatatctccatcagttg

SEQ ID NO: 112340 - DNA, 75 bp, Artificial Sequence
  Synthetic
tttctacggggttgatacactttcaccacaacgtagtagacgttcagtccctctacggtatatctccatcagtta

SEQ ID NO: 112341 - DNA, 75 bp, Artificial Sequence
  Synthetic
tttctacggggttgatacactttcaccacaacgtagtagacgttcagtccctctacggtatatctccatcagttt

SEQ ID NO: 112342 - DNA, 75 bp, Artificial Sequence
  Synthetic
tttctacggggttgatacactttcaccacaacgtagtagacgttcagtccctctacggtatatctccatcagttc

SEQ ID NO: 112343 - DNA, 75 bp, Artificial Sequence
  Synthetic
tttctacggggttgatacactttcaccacaacgtagtagacgttcagtccctctacggtatatctccatcagttg

SEQ ID NO: 112344 - DNA, 75 bp, Artificial Sequence
  Synthetic
tttctacggggttgatacactttcaccacaacgtagtagaggttcagtccctctacggtatatctccatcagtta

SEQ ID NO: 112345 - DNA, 75 bp, Artificial Sequence
  Synthetic
tttctacggggttgatacactttcaccacaacgtagtagaggttcagtccctctacggtatatctccatcagttt

SEQ ID NO: 112346 - DNA, 75 bp, Artificial Sequence
  Synthetic
tttctacggggttgatacactttcaccacaacgtagtagaggttcagtccctctacggtatatctccatcagttc

SEQ ID NO: 112347 - DNA, 75 bp, Artificial Sequence
  Synthetic
tttctacggggttgatacactttcaccacaacgtagtagaggttcagtccctctacggtatatctccatcagttg

SEQ ID NO: 112348 - DNA, 75 bp, Artificial Sequence
  Synthetic
tttctacggggttgatacactttcaccacaacgtagttgaagttcagtccctctacggtatatctccatcagtta

SEQ ID NO: 112349 - DNA, 75 bp, Artificial Sequence
  Synthetic
tttctacggggttgatacactttcaccacaacgtagttgaagttcagtccctctacggtatatctccatcagttt

SEQ ID NO: 112350 - DNA, 75 bp, Artificial Sequence
  Synthetic
tttctacggggttgatacactttcaccacaacgtagttgaagttcagtccctctacggtatatctccatcagttc

SEQ ID NO: 112351 - DNA, 75 bp, Artificial Sequence
  Synthetic
tttctacggggttgatacactttcaccacaacgtagttgaagttcagtccctctacggtatatctccatcagttg

SEQ ID NO: 112352 - DNA, 75 bp, Artificial Sequence
  Synthetic
tttctacggggttgatacactttcaccacaacgtagttgatgttcagtccctctacggtatatctccatcagtta

SEQ ID NO: 112353 - DNA, 75 bp, Artificial Sequence
  Synthetic
tttctacggggttgatacactttcaccacaacgtagttgatgttcagtccctctacggtatatctccatcagttt

SEQ ID NO: 112354 - DNA, 75 bp, Artificial Sequence
  Synthetic
tttctacggggttgatacactttcaccacaacgtagttgatgttcagtccctctacggtatatctccatcagttc

SEQ ID NO: 112355 - DNA, 75 bp, Artificial Sequence
  Synthetic
tttctacggggttgatacactttcaccacaacgtagttgatgttcagtccctctacggtatatctccatcagttg

SEQ ID NO: 112356 - DNA, 75 bp, Artificial Sequence
  Synthetic
tttctacggggttgatacactttcaccacaacgtagttgacgttcagtccctctacggtatatctccatcagtta

SEQ ID NO: 112357 - DNA, 75 bp, Artificial Sequence
  Synthetic
tttctacggggttgatacactttcaccacaacgtagttgacgttcagtccctctacggtatatctccatcagttt

SEQ ID NO: 112358 - DNA, 75 bp, Artificial Sequence
  Synthetic
tttctacggggttgatacactttcaccacaacgtagttgacgttcagtccctctacggtatatctccatcagttc

SEQ ID NO: 112359 - DNA, 75 bp, Artificial Sequence
  Synthetic
tttctacggggttgatacactttcaccacaacgtagttgacgttcagtccctctacggtatatctccatcagttg

SEQ ID NO: 112360 - DNA, 75 bp, Artificial Sequence
  Synthetic
tttctacggggttgatacactttcaccacaacgtagttgaggttcagtccctctacggtatatctccatcagtta

SEQ ID NO: 112361 - DNA, 75 bp, Artificial Sequence
  Synthetic
tttctacggggttgatacactttcaccacaacgtagttgaggttcagtccctctacggtatatctccatcagttt

SEQ ID NO: 112362 - DNA, 75 bp, Artificial Sequence
  Synthetic
tttctacggggttgatacactttcaccacaacgtagttgaggttcagtccctctacggtatatctccatcagttc

SEQ ID NO: 112363 - DNA, 75 bp, Artificial Sequence
  Synthetic
tttctacggggttgatacactttcaccacaacgtagttgaggttcagtccctctacggtatatctccatcagttg

SEQ ID NO: 112364 - DNA, 75 bp, Artificial Sequence
  Synthetic
tttctacggggttgatacactttcaccacaacgtagtcgaagttcagtccctctacggtatatctccatcagtta

SEQ ID NO: 112365 - DNA, 75 bp, Artificial Sequence
  Synthetic
tttctacggggttgatacactttcaccacaacgtagtcgaagttcagtccctctacggtatatctccatcagttt

SEQ ID NO: 112366 - DNA, 75 bp, Artificial Sequence
  Synthetic
tttctacggggttgatacactttcaccacaacgtagtcgaagttcagtccctctacggtatatctccatcagttc

SEQ ID NO: 112367 - DNA, 75 bp, Artificial Sequence
  Synthetic
tttctacggggttgatacactttcaccacaacgtagtcgaagttcagtccctctacggtatatctccatcagttg

SEQ ID NO: 112368 - DNA, 75 bp, Artificial Sequence
  Synthetic
tttctacggggttgatacactttcaccacaacgtagtcgatgttcagtccctctacggtatatctccatcagtta

SEQ ID NO: 112369 - DNA, 75 bp, Artificial Sequence
  Synthetic
tttctacggggttgatacactttcaccacaacgtagtcgatgttcagtccctctacggtatatctccatcagttt

SEQ ID NO: 112370 - DNA, 75 bp, Artificial Sequence
  Synthetic
tttctacggggttgatacactttcaccacaacgtagtcgatgttcagtccctctacggtatatctccatcagttc

SEQ ID NO: 112371 - DNA, 75 bp, Artificial Sequence
  Synthetic
tttctacggggttgatacactttcaccacaacgtagtcgatgttcagtccctctacggtatatctccatcagttg

SEQ ID NO: 112372 - DNA, 75 bp, Artificial Sequence
  Synthetic
tttctacggggttgatacactttcaccacaacgtagtcgacgttcagtccctctacggtatatctccatcagtta

SEQ ID NO: 112373 - DNA, 75 bp, Artificial Sequence
  Synthetic
tttctacggggttgatacactttcaccacaacgtagtcgacgttcagtccctctacggtatatctccatcagttt

SEQ ID NO: 112374 - DNA, 75 bp, Artificial Sequence
  Synthetic
tttctacggggttgatacactttcaccacaacgtagtcgacgttcagtccctctacggtatatctccatcagttc

SEQ ID NO: 112375 - DNA, 75 bp, Artificial Sequence
  Synthetic
tttctacggggttgatacactttcaccacaacgtagtcgacgttcagtccctctacggtatatctccatcagttg

SEQ ID NO: 112376 - DNA, 75 bp, Artificial Sequence
  Synthetic
tttctacggggttgatacactttcaccacaacgtagtcgaggttcagtccctctacggtatatctccatcagtta

SEQ ID NO: 112377 - DNA, 75 bp, Artificial Sequence
  Synthetic
tttctacggggttgatacactttcaccacaacgtagtcgaggttcagtccctctacggtatatctccatcagttt

SEQ ID NO: 112378 - DNA, 75 bp, Artificial Sequence
  Synthetic
tttctacggggttgatacactttcaccacaacgtagtcgaggttcagtccctctacggtatatctccatcagttc

SEQ ID NO: 112379 - DNA, 75 bp, Artificial Sequence
  Synthetic
tttctacggggttgatacactttcaccacaacgtagtcgaggttcagtccctctacggtatatctccatcagttg

SEQ ID NO: 112380 - DNA, 75 bp, Artificial Sequence
  Synthetic
tttctacggggttgatacactttcaccacaacgtagtggaagttcagtccctctacggtatatctccatcagtta

SEQ ID NO: 112381 - DNA, 75 bp, Artificial Sequence
  Synthetic
tttctacggggttgatacactttcaccacaacgtagtggaagttcagtccctctacggtatatctccatcagttt

SEQ ID NO: 112382 - DNA, 75 bp, Artificial Sequence
  Synthetic
tttctacggggttgatacactttcaccacaacgtagtggaagttcagtccctctacggtatatctccatcagttc

SEQ ID NO: 112383 - DNA, 75 bp, Artificial Sequence
  Synthetic
tttctacggggttgatacactttcaccacaacgtagtggaagttcagtccctctacggtatatctccatcagttg

SEQ ID NO: 112384 - DNA, 75 bp, Artificial Sequence
  Synthetic
tttctacggggttgatacactttcaccacaacgtagtggatgttcagtccctctacggtatatctccatcagtta

SEQ ID NO: 112385 - DNA, 75 bp, Artificial Sequence
  Synthetic
tttctacggggttgatacactttcaccacaacgtagtggatgttcagtccctctacggtatatctccatcagttt

SEQ ID NO: 112386 - DNA, 75 bp, Artificial Sequence
  Synthetic
tttctacggggttgatacactttcaccacaacgtagtggatgttcagtccctctacggtatatctccatcagttc

SEQ ID NO: 112387 - DNA, 75 bp, Artificial Sequence
  Synthetic
tttctacggggttgatacactttcaccacaacgtagtggatgttcagtccctctacggtatatctccatcagttg

SEQ ID NO: 112388 - DNA, 75 bp, Artificial Sequence
  Synthetic
tttctacggggttgatacactttcaccacaacgtagtggacgttcagtccctctacggtatatctccatcagtta

SEQ ID NO: 112389 - DNA, 75 bp, Artificial Sequence
  Synthetic
tttctacggggttgatacactttcaccacaacgtagtggacgttcagtccctctacggtatatctccatcagttt

SEQ ID NO: 112390 - DNA, 75 bp, Artificial Sequence
  Synthetic
tttctacggggttgatacactttcaccacaacgtagtggacgttcagtccctctacggtatatctccatcagttc

SEQ ID NO: 112391 - DNA, 75 bp, Artificial Sequence
  Synthetic
tttctacggggttgatacactttcaccacaacgtagtggacgttcagtccctctacggtatatctccatcagttg

SEQ ID NO: 112392 - DNA, 75 bp, Artificial Sequence
  Synthetic
tttctacggggttgatacactttcaccacaacgtagtggaggttcagtccctctacggtatatctccatcagtta

SEQ ID NO: 112393 - DNA, 75 bp, Artificial Sequence
  Synthetic
tttctacggggttgatacactttcaccacaacgtagtggaggttcagtccctctacggtatatctccatcagttt

SEQ ID NO: 112394 - DNA, 75 bp, Artificial Sequence
  Synthetic
tttctacggggttgatacactttcaccacaacgtagtggaggttcagtccctctacggtatatctccatcagttc

SEQ ID NO: 112395 - DNA, 75 bp, Artificial Sequence
  Synthetic
tttctacggggttgatacactttcaccacaacgtagtggaggttcagtccctctacggtatatctccatcagttg

SEQ ID NO: 112396 - DNA, 75 bp, Artificial Sequence
  Synthetic
aagggcagaactgcggttatcgccggtgccgcgcgagcggcgtgctgacgaccagctgcggtaataccctcacat

SEQ ID NO: 112397 - DNA, 75 bp, Artificial Sequence
  Synthetic
acccctatctcgggtttgacatcaccaaggtccttttggctcttattggcccactttacctcctgcaagctagct

SEQ ID NO: 112398 - DNA, 75 bp, Artificial Sequence
  Synthetic
ccatgcataacagcaagggagacctttgtgggtatcggagatgccgcgcgagtggcgtctataccaccagcttcg

SEQ ID NO: 112399 - DNA, 75 bp, Artificial Sequence
  Synthetic
ggggtgtagccaaatctattgacttcatccctgttgaatctctcgatatcgccgcacggacgcccagtttctctg

SEQ ID NO: 112400 - DNA, 75 bp, Artificial Sequence
  Synthetic
gccgcacggacgcccagtttctctgacaacagcacgccaccagctgtgccccagacttaccaggtgggctacttg

SEQ ID NO: 112401 - DNA, 75 bp, Artificial Sequence
  Synthetic
agccgaggcagcattagagaacctgatcgtcctcaacgcagcttcggccgcaagcgcccatggatgggggtggtg

SEQ ID NO: 112402 - DNA, 75 bp, Artificial Sequence
  Synthetic
agccgaggcagcattagagaacctgatcgtcctcaacgcagcttcggccgctagcgcccatggatgggggtggtg

SEQ ID NO: 112403 - DNA, 75 bp, Artificial Sequence
  Synthetic
agccgaggcagcattagagaacctgatcgtcctcaacgcagcttcggccgccagcgcccatggatgggggtggtg

SEQ ID NO: 112404 - DNA, 75 bp, Artificial Sequence
  Synthetic
agccgaggcagcattagagaacctgatcgtcctcaacgcagcttcggccgcgagcgcccatggatgggggtggtg

SEQ ID NO: 112405 - DNA, 75 bp, Artificial Sequence
  Synthetic
agccgaggcagcattagagaacctgatcgtcctcaacgctgcttcggccgcaagcgcccatggatgggggtggtg

SEQ ID NO: 112406 - DNA, 75 bp, Artificial Sequence
  Synthetic
agccgaggcagcattagagaacctgatcgtcctcaacgctgcttcggccgctagcgcccatggatgggggtggtg

SEQ ID NO: 112407 - DNA, 75 bp, Artificial Sequence
  Synthetic
agccgaggcagcattagagaacctgatcgtcctcaacgctgcttcggccgccagcgcccatggatgggggtggtg

SEQ ID NO: 112408 - DNA, 75 bp, Artificial Sequence
  Synthetic
agccgaggcagcattagagaacctgatcgtcctcaacgctgcttcggccgcgagcgcccatggatgggggtggtg

SEQ ID NO: 112409 - DNA, 75 bp, Artificial Sequence
  Synthetic
agccgaggcagcattagagaacctgatcgtcctcaacgccgcttcggccgcaagcgcccatggatgggggtggtg

SEQ ID NO: 112410 - DNA, 75 bp, Artificial Sequence
  Synthetic
agccgaggcagcattagagaacctgatcgtcctcaacgccgcttcggccgctagcgcccatggatgggggtggtg

SEQ ID NO: 112411 - DNA, 75 bp, Artificial Sequence
  Synthetic
agccgaggcagcattagagaacctgatcgtcctcaacgccgcttcggccgccagcgcccatggatgggggtggtg

SEQ ID NO: 112412 - DNA, 75 bp, Artificial Sequence
  Synthetic
agccgaggcagcattagagaacctgatcgtcctcaacgccgcttcggccgcgagcgcccatggatgggggtggtg

SEQ ID NO: 112413 - DNA, 75 bp, Artificial Sequence
  Synthetic
agccgaggcagcattagagaacctgatcgtcctcaacgcggcttcggccgcaagcgcccatggatgggggtggtg

SEQ ID NO: 112414 - DNA, 75 bp, Artificial Sequence
  Synthetic
agccgaggcagcattagagaacctgatcgtcctcaacgcggcttcggccgctagcgcccatggatgggggtggtg

SEQ ID NO: 112415 - DNA, 75 bp, Artificial Sequence
  Synthetic
agccgaggcagcattagagaacctgatcgtcctcaacgcggcttcggccgccagcgcccatggatgggggtggtg

SEQ ID NO: 112416 - DNA, 75 bp, Artificial Sequence
  Synthetic
agccgaggcagcattagagaacctgatcgtcctcaacgcggcttcggccgcgagcgcccatggatgggggtggtg

SEQ ID NO: 112417 - DNA, 75 bp, Artificial Sequence
  Synthetic
agccgaggctgcattagagaacctgatcgtcctcaacgcagcttcggccgcaagcgcccatggatgggggtggtg

SEQ ID NO: 112418 - DNA, 75 bp, Artificial Sequence
  Synthetic
agccgaggctgcattagagaacctgatcgtcctcaacgcagcttcggccgctagcgcccatggatgggggtggtg

SEQ ID NO: 112419 - DNA, 75 bp, Artificial Sequence
  Synthetic
agccgaggctgcattagagaacctgatcgtcctcaacgcagcttcggccgccagcgcccatggatgggggtggtg

SEQ ID NO: 112420 - DNA, 75 bp, Artificial Sequence
  Synthetic
agccgaggctgcattagagaacctgatcgtcctcaacgcagcttcggccgcgagcgcccatggatgggggtggtg

SEQ ID NO: 112421 - DNA, 75 bp, Artificial Sequence
  Synthetic
agccgaggctgcattagagaacctgatcgtcctcaacgctgcttcggccgcaagcgcccatggatgggggtggtg

SEQ ID NO: 112422 - DNA, 75 bp, Artificial Sequence
  Synthetic
agccgaggctgcattagagaacctgatcgtcctcaacgctgcttcggccgctagcgcccatggatgggggtggtg

SEQ ID NO: 112423 - DNA, 75 bp, Artificial Sequence
  Synthetic
agccgaggctgcattagagaacctgatcgtcctcaacgctgcttcggccgccagcgcccatggatgggggtggtg

SEQ ID NO: 112424 - DNA, 75 bp, Artificial Sequence
  Synthetic
agccgaggctgcattagagaacctgatcgtcctcaacgctgcttcggccgcgagcgcccatggatgggggtggtg

SEQ ID NO: 112425 - DNA, 75 bp, Artificial Sequence
  Synthetic
agccgaggctgcattagagaacctgatcgtcctcaacgccgcttcggccgcaagcgcccatggatgggggtggtg

SEQ ID NO: 112426 - DNA, 75 bp, Artificial Sequence
  Synthetic
agccgaggctgcattagagaacctgatcgtcctcaacgccgcttcggccgctagcgcccatggatgggggtggtg

SEQ ID NO: 112427 - DNA, 75 bp, Artificial Sequence
  Synthetic
agccgaggctgcattagagaacctgatcgtcctcaacgccgcttcggccgccagcgcccatggatgggggtggtg

SEQ ID NO: 112428 - DNA, 75 bp, Artificial Sequence
  Synthetic
agccgaggctgcattagagaacctgatcgtcctcaacgccgcttcggccgcgagcgcccatggatgggggtggtg

SEQ ID NO: 112429 - DNA, 75 bp, Artificial Sequence
  Synthetic
agccgaggctgcattagagaacctgatcgtcctcaacgcggcttcggccgcaagcgcccatggatgggggtggtg

SEQ ID NO: 112430 - DNA, 75 bp, Artificial Sequence
  Synthetic
agccgaggctgcattagagaacctgatcgtcctcaacgcggcttcggccgctagcgcccatggatgggggtggtg

SEQ ID NO: 112431 - DNA, 75 bp, Artificial Sequence
  Synthetic
agccgaggctgcattagagaacctgatcgtcctcaacgcggcttcggccgccagcgcccatggatgggggtggtg

SEQ ID NO: 112432 - DNA, 75 bp, Artificial Sequence
  Synthetic
agccgaggctgcattagagaacctgatcgtcctcaacgcggcttcggccgcgagcgcccatggatgggggtggtg

SEQ ID NO: 112433 - DNA, 75 bp, Artificial Sequence
  Synthetic
agccgaggccgcattagagaacctgatcgtcctcaacgcagcttcggccgcaagcgcccatggatgggggtggtg

SEQ ID NO: 112434 - DNA, 75 bp, Artificial Sequence
  Synthetic
agccgaggccgcattagagaacctgatcgtcctcaacgcagcttcggccgctagcgcccatggatgggggtggtg

SEQ ID NO: 112435 - DNA, 75 bp, Artificial Sequence
  Synthetic
agccgaggccgcattagagaacctgatcgtcctcaacgcagcttcggccgccagcgcccatggatgggggtggtg

SEQ ID NO: 112436 - DNA, 75 bp, Artificial Sequence
  Synthetic
agccgaggccgcattagagaacctgatcgtcctcaacgcagcttcggccgcgagcgcccatggatgggggtggtg

SEQ ID NO: 112437 - DNA, 75 bp, Artificial Sequence
  Synthetic
agccgaggccgcattagagaacctgatcgtcctcaacgctgcttcggccgcaagcgcccatggatgggggtggtg

SEQ ID NO: 112438 - DNA, 75 bp, Artificial Sequence
  Synthetic
agccgaggccgcattagagaacctgatcgtcctcaacgctgcttcggccgctagcgcccatggatgggggtggtg

SEQ ID NO: 112439 - DNA, 75 bp, Artificial Sequence
  Synthetic
agccgaggccgcattagagaacctgatcgtcctcaacgctgcttcggccgccagcgcccatggatgggggtggtg

SEQ ID NO: 112440 - DNA, 75 bp, Artificial Sequence
  Synthetic
agccgaggccgcattagagaacctgatcgtcctcaacgctgcttcggccgcgagcgcccatggatgggggtggtg

SEQ ID NO: 112441 - DNA, 75 bp, Artificial Sequence
  Synthetic
agccgaggccgcattagagaacctgatcgtcctcaacgccgcttcggccgcaagcgcccatggatgggggtggtg

SEQ ID NO: 112442 - DNA, 75 bp, Artificial Sequence
  Synthetic
agccgaggccgcattagagaacctgatcgtcctcaacgccgcttcggccgctagcgcccatggatgggggtggtg

SEQ ID NO: 112443 - DNA, 75 bp, Artificial Sequence
  Synthetic
agccgaggccgcattagagaacctgatcgtcctcaacgccgcttcggccgccagcgcccatggatgggggtggtg

SEQ ID NO: 112444 - DNA, 75 bp, Artificial Sequence
  Synthetic
agccgaggccgcattagagaacctgatcgtcctcaacgccgcttcggccgcgagcgcccatggatgggggtggtg

SEQ ID NO: 112445 - DNA, 75 bp, Artificial Sequence
  Synthetic
agccgaggccgcattagagaacctgatcgtcctcaacgcggcttcggccgcaagcgcccatggatgggggtggtg

SEQ ID NO: 112446 - DNA, 75 bp, Artificial Sequence
  Synthetic
agccgaggccgcattagagaacctgatcgtcctcaacgcggcttcggccgctagcgcccatggatgggggtggtg

SEQ ID NO: 112447 - DNA, 75 bp, Artificial Sequence
  Synthetic
agccgaggccgcattagagaacctgatcgtcctcaacgcggcttcggccgccagcgcccatggatgggggtggtg

SEQ ID NO: 112448 - DNA, 75 bp, Artificial Sequence
  Synthetic
agccgaggccgcattagagaacctgatcgtcctcaacgcggcttcggccgcgagcgcccatggatgggggtggtg

SEQ ID NO: 112449 - DNA, 75 bp, Artificial Sequence
  Synthetic
agccgaggcggcattagagaacctgatcgtcctcaacgcagcttcggccgcaagcgcccatggatgggggtggtg

SEQ ID NO: 112450 - DNA, 75 bp, Artificial Sequence
  Synthetic
agccgaggcggcattagagaacctgatcgtcctcaacgcagcttcggccgctagcgcccatggatgggggtggtg

SEQ ID NO: 112451 - DNA, 75 bp, Artificial Sequence
  Synthetic
agccgaggcggcattagagaacctgatcgtcctcaacgcagcttcggccgccagcgcccatggatgggggtggtg

SEQ ID NO: 112452 - DNA, 75 bp, Artificial Sequence
  Synthetic
agccgaggcggcattagagaacctgatcgtcctcaacgcagcttcggccgcgagcgcccatggatgggggtggtg

SEQ ID NO: 112453 - DNA, 75 bp, Artificial Sequence
  Synthetic
agccgaggcggcattagagaacctgatcgtcctcaacgctgcttcggccgcaagcgcccatggatgggggtggtg

SEQ ID NO: 112454 - DNA, 75 bp, Artificial Sequence
  Synthetic
agccgaggcggcattagagaacctgatcgtcctcaacgctgcttcggccgctagcgcccatggatgggggtggtg

SEQ ID NO: 112455 - DNA, 75 bp, Artificial Sequence
  Synthetic
agccgaggcggcattagagaacctgatcgtcctcaacgctgcttcggccgccagcgcccatggatgggggtggtg

SEQ ID NO: 112456 - DNA, 75 bp, Artificial Sequence
  Synthetic
agccgaggcggcattagagaacctgatcgtcctcaacgctgcttcggccgcgagcgcccatggatgggggtggtg

SEQ ID NO: 112457 - DNA, 75 bp, Artificial Sequence
  Synthetic
agccgaggcggcattagagaacctgatcgtcctcaacgccgcttcggccgcaagcgcccatggatgggggtggtg

SEQ ID NO: 112458 - DNA, 75 bp, Artificial Sequence
  Synthetic
agccgaggcggcattagagaacctgatcgtcctcaacgccgcttcggccgctagcgcccatggatgggggtggtg

SEQ ID NO: 112459 - DNA, 75 bp, Artificial Sequence
  Synthetic
agccgaggcggcattagagaacctgatcgtcctcaacgccgcttcggccgccagcgcccatggatgggggtggtg

SEQ ID NO: 112460 - DNA, 75 bp, Artificial Sequence
  Synthetic
agccgaggcggcattagagaacctgatcgtcctcaacgccgcttcggccgcgagcgcccatggatgggggtggtg

SEQ ID NO: 112461 - DNA, 75 bp, Artificial Sequence
  Synthetic
agccgaggcggcattagagaacctgatcgtcctcaacgcggcttcggccgcaagcgcccatggatgggggtggtg

SEQ ID NO: 112462 - DNA, 75 bp, Artificial Sequence
  Synthetic
agccgaggcggcattagagaacctgatcgtcctcaacgcggcttcggccgctagcgcccatggatgggggtggtg

SEQ ID NO: 112463 - DNA, 75 bp, Artificial Sequence
  Synthetic
agccgaggcggcattagagaacctgatcgtcctcaacgcggcttcggccgccagcgcccatggatgggggtggtg

SEQ ID NO: 112464 - DNA, 75 bp, Artificial Sequence
  Synthetic
agccgaggcggcattagagaacctgatcgtcctcaacgcggcttcggccgcgagcgcccatggatgggggtggtg

SEQ ID NO: 112465 - DNA, 75 bp, Artificial Sequence
  Synthetic
aaaaattgggacttggacaggcacttacatctatgaccacttggctcccctgcagacttgggctagtgacgggct

SEQ ID NO: 112466 - DNA, 75 bp, Artificial Sequence
  Synthetic
atacgtctggtctctatgtccttaccaacgcccgttccaacagcagtatagtgtacgaggccgacgacgttatcc

SEQ ID NO: 112467 - DNA, 75 bp, Artificial Sequence
  Synthetic
gcgttgccccaacgggccttcgcataagatcaagagcaagcagcctctatcggtgcagctgtgctggtagcaatt

SEQ ID NO: 112468 - DNA, 75 bp, Artificial Sequence
  Synthetic
gcgttgccccaacgggccttcgcataagatcaagagcaagcagcctctatcggtgcagctgtgctggtagctatt

SEQ ID NO: 112469 - DNA, 75 bp, Artificial Sequence
  Synthetic
gcgttgccccaacgggccttcgcataagatcaagagcaagcagcctctatcggtgcagctgtgctggtagccatt

SEQ ID NO: 112470 - DNA, 75 bp, Artificial Sequence
  Synthetic
gcgttgccccaacgggccttcgcataagatcaagagcaagcagcctctatcggtgcagctgtgctggtagcgatt

SEQ ID NO: 112471 - DNA, 75 bp, Artificial Sequence
  Synthetic
gcgttgccccaacgggccttcgcatatgatcaagagcaagcagcctctatcggtgcagctgtgctggtagcaatt

SEQ ID NO: 112472 - DNA, 75 bp, Artificial Sequence
  Synthetic
gcgttgccccaacgggccttcgcatatgatcaagagcaagcagcctctatcggtgcagctgtgctggtagctatt

SEQ ID NO: 112473 - DNA, 75 bp, Artificial Sequence
  Synthetic
gcgttgccccaacgggccttcgcatatgatcaagagcaagcagcctctatcggtgcagctgtgctggtagccatt

SEQ ID NO: 112474 - DNA, 75 bp, Artificial Sequence
  Synthetic
gcgttgccccaacgggccttcgcatatgatcaagagcaagcagcctctatcggtgcagctgtgctggtagcgatt

SEQ ID NO: 112475 - DNA, 75 bp, Artificial Sequence
  Synthetic
gcgttgccccaacgggccttcgcatacgatcaagagcaagcagcctctatcggtgcagctgtgctggtagcaatt

SEQ ID NO: 112476 - DNA, 75 bp, Artificial Sequence
  Synthetic
gcgttgccccaacgggccttcgcatacgatcaagagcaagcagcctctatcggtgcagctgtgctggtagctatt

SEQ ID NO: 112477 - DNA, 75 bp, Artificial Sequence
  Synthetic
gcgttgccccaacgggccttcgcatacgatcaagagcaagcagcctctatcggtgcagctgtgctggtagccatt

SEQ ID NO: 112478 - DNA, 75 bp, Artificial Sequence
  Synthetic
gcgttgccccaacgggccttcgcatacgatcaagagcaagcagcctctatcggtgcagctgtgctggtagcgatt

SEQ ID NO: 112479 - DNA, 75 bp, Artificial Sequence
  Synthetic
gcgttgccccaacgggccttcgcataggatcaagagcaagcagcctctatcggtgcagctgtgctggtagcaatt

SEQ ID NO: 112480 - DNA, 75 bp, Artificial Sequence
  Synthetic
gcgttgccccaacgggccttcgcataggatcaagagcaagcagcctctatcggtgcagctgtgctggtagctatt

SEQ ID NO: 112481 - DNA, 75 bp, Artificial Sequence
  Synthetic
gcgttgccccaacgggccttcgcataggatcaagagcaagcagcctctatcggtgcagctgtgctggtagccatt

SEQ ID NO: 112482 - DNA, 75 bp, Artificial Sequence
  Synthetic
gcgttgccccaacgggccttcgcataggatcaagagcaagcagcctctatcggtgcagctgtgctggtagcgatt

SEQ ID NO: 112483 - DNA, 75 bp, Artificial Sequence
  Synthetic
gcgttgccccaacgggccttcgcttaagatcaagagcaagcagcctctatcggtgcagctgtgctggtagcaatt

SEQ ID NO: 112484 - DNA, 75 bp, Artificial Sequence
  Synthetic
gcgttgccccaacgggccttcgcttaagatcaagagcaagcagcctctatcggtgcagctgtgctggtagctatt

SEQ ID NO: 112485 - DNA, 75 bp, Artificial Sequence
  Synthetic
gcgttgccccaacgggccttcgcttaagatcaagagcaagcagcctctatcggtgcagctgtgctggtagccatt

SEQ ID NO: 112486 - DNA, 75 bp, Artificial Sequence
  Synthetic
gcgttgccccaacgggccttcgcttaagatcaagagcaagcagcctctatcggtgcagctgtgctggtagcgatt

SEQ ID NO: 112487 - DNA, 75 bp, Artificial Sequence
  Synthetic
gcgttgccccaacgggccttcgcttatgatcaagagcaagcagcctctatcggtgcagctgtgctggtagcaatt

SEQ ID NO: 112488 - DNA, 75 bp, Artificial Sequence
  Synthetic
gcgttgccccaacgggccttcgcttatgatcaagagcaagcagcctctatcggtgcagctgtgctggtagctatt

SEQ ID NO: 112489 - DNA, 75 bp, Artificial Sequence
  Synthetic
gcgttgccccaacgggccttcgcttatgatcaagagcaagcagcctctatcggtgcagctgtgctggtagccatt

SEQ ID NO: 112490 - DNA, 75 bp, Artificial Sequence
  Synthetic
gcgttgccccaacgggccttcgcttatgatcaagagcaagcagcctctatcggtgcagctgtgctggtagcgatt

SEQ ID NO: 112491 - DNA, 75 bp, Artificial Sequence
  Synthetic
gcgttgccccaacgggccttcgcttacgatcaagagcaagcagcctctatcggtgcagctgtgctggtagcaatt

SEQ ID NO: 112492 - DNA, 75 bp, Artificial Sequence
  Synthetic
gcgttgccccaacgggccttcgcttacgatcaagagcaagcagcctctatcggtgcagctgtgctggtagctatt

SEQ ID NO: 112493 - DNA, 75 bp, Artificial Sequence
  Synthetic
gcgttgccccaacgggccttcgcttacgatcaagagcaagcagcctctatcggtgcagctgtgctggtagccatt

SEQ ID NO: 112494 - DNA, 75 bp, Artificial Sequence
  Synthetic
gcgttgccccaacgggccttcgcttacgatcaagagcaagcagcctctatcggtgcagctgtgctggtagcgatt

SEQ ID NO: 112495 - DNA, 75 bp, Artificial Sequence
  Synthetic
gcgttgccccaacgggccttcgcttaggatcaagagcaagcagcctctatcggtgcagctgtgctggtagcaatt

SEQ ID NO: 112496 - DNA, 75 bp, Artificial Sequence
  Synthetic
gcgttgccccaacgggccttcgcttaggatcaagagcaagcagcctctatcggtgcagctgtgctggtagctatt

SEQ ID NO: 112497 - DNA, 75 bp, Artificial Sequence
  Synthetic
gcgttgccccaacgggccttcgcttaggatcaagagcaagcagcctctatcggtgcagctgtgctggtagccatt

SEQ ID NO: 112498 - DNA, 75 bp, Artificial Sequence
  Synthetic
gcgttgccccaacgggccttcgcttaggatcaagagcaagcagcctctatcggtgcagctgtgctggtagcgatt

SEQ ID NO: 112499 - DNA, 75 bp, Artificial Sequence
  Synthetic
gcgttgccccaacgggccttcgcctaagatcaagagcaagcagcctctatcggtgcagctgtgctggtagcaatt

SEQ ID NO: 112500 - DNA, 75 bp, Artificial Sequence
  Synthetic
gcgttgccccaacgggccttcgcctaagatcaagagcaagcagcctctatcggtgcagctgtgctggtagctatt

SEQ ID NO: 112501 - DNA, 75 bp, Artificial Sequence
  Synthetic
gcgttgccccaacgggccttcgcctaagatcaagagcaagcagcctctatcggtgcagctgtgctggtagccatt

SEQ ID NO: 112502 - DNA, 75 bp, Artificial Sequence
  Synthetic
gcgttgccccaacgggccttcgcctaagatcaagagcaagcagcctctatcggtgcagctgtgctggtagcgatt

SEQ ID NO: 112503 - DNA, 75 bp, Artificial Sequence
  Synthetic
gcgttgccccaacgggccttcgcctatgatcaagagcaagcagcctctatcggtgcagctgtgctggtagcaatt

SEQ ID NO: 112504 - DNA, 75 bp, Artificial Sequence
  Synthetic
gcgttgccccaacgggccttcgcctatgatcaagagcaagcagcctctatcggtgcagctgtgctggtagctatt

SEQ ID NO: 112505 - DNA, 75 bp, Artificial Sequence
  Synthetic
gcgttgccccaacgggccttcgcctatgatcaagagcaagcagcctctatcggtgcagctgtgctggtagccatt

SEQ ID NO: 112506 - DNA, 75 bp, Artificial Sequence
  Synthetic
gcgttgccccaacgggccttcgcctatgatcaagagcaagcagcctctatcggtgcagctgtgctggtagcgatt

SEQ ID NO: 112507 - DNA, 75 bp, Artificial Sequence
  Synthetic
gcgttgccccaacgggccttcgcctacgatcaagagcaagcagcctctatcggtgcagctgtgctggtagcaatt

SEQ ID NO: 112508 - DNA, 75 bp, Artificial Sequence
  Synthetic
gcgttgccccaacgggccttcgcctacgatcaagagcaagcagcctctatcggtgcagctgtgctggtagctatt

SEQ ID NO: 112509 - DNA, 75 bp, Artificial Sequence
  Synthetic
gcgttgccccaacgggccttcgcctacgatcaagagcaagcagcctctatcggtgcagctgtgctggtagccatt

SEQ ID NO: 112510 - DNA, 75 bp, Artificial Sequence
  Synthetic
gcgttgccccaacgggccttcgcctacgatcaagagcaagcagcctctatcggtgcagctgtgctggtagcgatt

SEQ ID NO: 112511 - DNA, 75 bp, Artificial Sequence
  Synthetic
gcgttgccccaacgggccttcgcctaggatcaagagcaagcagcctctatcggtgcagctgtgctggtagcaatt

SEQ ID NO: 112512 - DNA, 75 bp, Artificial Sequence
  Synthetic
gcgttgccccaacgggccttcgcctaggatcaagagcaagcagcctctatcggtgcagctgtgctggtagctatt

SEQ ID NO: 112513 - DNA, 75 bp, Artificial Sequence
  Synthetic
gcgttgccccaacgggccttcgcctaggatcaagagcaagcagcctctatcggtgcagctgtgctggtagccatt

SEQ ID NO: 112514 - DNA, 75 bp, Artificial Sequence
  Synthetic
gcgttgccccaacgggccttcgcctaggatcaagagcaagcagcctctatcggtgcagctgtgctggtagcgatt

SEQ ID NO: 112515 - DNA, 75 bp, Artificial Sequence
  Synthetic
gcgttgccccaacgggccttcgcgtaagatcaagagcaagcagcctctatcggtgcagctgtgctggtagcaatt

SEQ ID NO: 112516 - DNA, 75 bp, Artificial Sequence
  Synthetic
gcgttgccccaacgggccttcgcgtaagatcaagagcaagcagcctctatcggtgcagctgtgctggtagctatt

SEQ ID NO: 112517 - DNA, 75 bp, Artificial Sequence
  Synthetic
gcgttgccccaacgggccttcgcgtaagatcaagagcaagcagcctctatcggtgcagctgtgctggtagccatt

SEQ ID NO: 112518 - DNA, 75 bp, Artificial Sequence
  Synthetic
gcgttgccccaacgggccttcgcgtaagatcaagagcaagcagcctctatcggtgcagctgtgctggtagcgatt

SEQ ID NO: 112519 - DNA, 75 bp, Artificial Sequence
  Synthetic
gcgttgccccaacgggccttcgcgtatgatcaagagcaagcagcctctatcggtgcagctgtgctggtagcaatt

SEQ ID NO: 112520 - DNA, 75 bp, Artificial Sequence
  Synthetic
gcgttgccccaacgggccttcgcgtatgatcaagagcaagcagcctctatcggtgcagctgtgctggtagctatt

SEQ ID NO: 112521 - DNA, 75 bp, Artificial Sequence
  Synthetic
gcgttgccccaacgggccttcgcgtatgatcaagagcaagcagcctctatcggtgcagctgtgctggtagccatt

SEQ ID NO: 112522 - DNA, 75 bp, Artificial Sequence
  Synthetic
gcgttgccccaacgggccttcgcgtatgatcaagagcaagcagcctctatcggtgcagctgtgctggtagcgatt

SEQ ID NO: 112523 - DNA, 75 bp, Artificial Sequence
  Synthetic
gcgttgccccaacgggccttcgcgtacgatcaagagcaagcagcctctatcggtgcagctgtgctggtagcaatt

SEQ ID NO: 112524 - DNA, 75 bp, Artificial Sequence
  Synthetic
gcgttgccccaacgggccttcgcgtacgatcaagagcaagcagcctctatcggtgcagctgtgctggtagctatt

SEQ ID NO: 112525 - DNA, 75 bp, Artificial Sequence
  Synthetic
gcgttgccccaacgggccttcgcgtacgatcaagagcaagcagcctctatcggtgcagctgtgctggtagccatt

SEQ ID NO: 112526 - DNA, 75 bp, Artificial Sequence
  Synthetic
gcgttgccccaacgggccttcgcgtacgatcaagagcaagcagcctctatcggtgcagctgtgctggtagcgatt

SEQ ID NO: 112527 - DNA, 75 bp, Artificial Sequence
  Synthetic
gcgttgccccaacgggccttcgcgtaggatcaagagcaagcagcctctatcggtgcagctgtgctggtagcaatt

SEQ ID NO: 112528 - DNA, 75 bp, Artificial Sequence
  Synthetic
gcgttgccccaacgggccttcgcgtaggatcaagagcaagcagcctctatcggtgcagctgtgctggtagctatt

SEQ ID NO: 112529 - DNA, 75 bp, Artificial Sequence
  Synthetic
gcgttgccccaacgggccttcgcgtaggatcaagagcaagcagcctctatcggtgcagctgtgctggtagccatt

SEQ ID NO: 112530 - DNA, 75 bp, Artificial Sequence
  Synthetic
gcgttgccccaacgggccttcgcgtaggatcaagagcaagcagcctctatcggtgcagctgtgctggtagcgatt

SEQ ID NO: 112531 - DNA, 75 bp, Artificial Sequence
  Synthetic
gccggcttaccagtctcagctcggcgcggcaggctcgttttgctaggaccagccgacgacatgcgcggaagtggc

SEQ ID NO: 112532 - DNA, 75 bp, Artificial Sequence
  Synthetic
gcatgacgcaacgggtaaaaaggtatactacctgacccgagaccctgaaactcccctggcgcgagccgcgtggga

SEQ ID NO: 112533 - DNA, 75 bp, Artificial Sequence
  Synthetic
gggacccaagcctgtcagaccggggaggccgtgatgccgtcatcttgctcacgtgcatgttacatccctcccttg

SEQ ID NO: 112534 - DNA, 75 bp, Artificial Sequence
  Synthetic
gggacccaagcctgtcagtccggggaggccgtgatgccgtcatcttgctcacgtgcatgttacatccctcccttg

SEQ ID NO: 112535 - DNA, 75 bp, Artificial Sequence
  Synthetic
gggacccaagcctgtcagcccggggaggccgtgatgccgtcatcttgctcacgtgcatgttacatccctcccttg

SEQ ID NO: 112536 - DNA, 75 bp, Artificial Sequence
  Synthetic
gggacccaagcctgtcaggccggggaggccgtgatgccgtcatcttgctcacgtgcatgttacatccctcccttg

SEQ ID NO: 112537 - DNA, 75 bp, Artificial Sequence
  Synthetic
gggacccatgcctgtcagaccggggaggccgtgatgccgtcatcttgctcacgtgcatgttacatccctcccttg

SEQ ID NO: 112538 - DNA, 75 bp, Artificial Sequence
  Synthetic
gggacccatgcctgtcagtccggggaggccgtgatgccgtcatcttgctcacgtgcatgttacatccctcccttg

SEQ ID NO: 112539 - DNA, 75 bp, Artificial Sequence
  Synthetic
gggacccatgcctgtcagcccggggaggccgtgatgccgtcatcttgctcacgtgcatgttacatccctcccttg

SEQ ID NO: 112540 - DNA, 75 bp, Artificial Sequence
  Synthetic
gggacccatgcctgtcaggccggggaggccgtgatgccgtcatcttgctcacgtgcatgttacatccctcccttg

SEQ ID NO: 112541 - DNA, 75 bp, Artificial Sequence
  Synthetic
gggacccacgcctgtcagaccggggaggccgtgatgccgtcatcttgctcacgtgcatgttacatccctcccttg

SEQ ID NO: 112542 - DNA, 75 bp, Artificial Sequence
  Synthetic
gggacccacgcctgtcagtccggggaggccgtgatgccgtcatcttgctcacgtgcatgttacatccctcccttg

SEQ ID NO: 112543 - DNA, 75 bp, Artificial Sequence
  Synthetic
gggacccacgcctgtcagcccggggaggccgtgatgccgtcatcttgctcacgtgcatgttacatccctcccttg

SEQ ID NO: 112544 - DNA, 75 bp, Artificial Sequence
  Synthetic
gggacccacgcctgtcaggccggggaggccgtgatgccgtcatcttgctcacgtgcatgttacatccctcccttg

SEQ ID NO: 112545 - DNA, 75 bp, Artificial Sequence
  Synthetic
gggacccaggcctgtcagaccggggaggccgtgatgccgtcatcttgctcacgtgcatgttacatccctcccttg

SEQ ID NO: 112546 - DNA, 75 bp, Artificial Sequence
  Synthetic
gggacccaggcctgtcagtccggggaggccgtgatgccgtcatcttgctcacgtgcatgttacatccctcccttg

SEQ ID NO: 112547 - DNA, 75 bp, Artificial Sequence
  Synthetic
gggacccaggcctgtcagcccggggaggccgtgatgccgtcatcttgctcacgtgcatgttacatccctcccttg

SEQ ID NO: 112548 - DNA, 75 bp, Artificial Sequence
  Synthetic
gggacccaggcctgtcaggccggggaggccgtgatgccgtcatcttgctcacgtgcatgttacatccctcccttg

SEQ ID NO: 112549 - DNA, 75 bp, Artificial Sequence
  Synthetic
gggtcccaagcctgtcagaccggggaggccgtgatgccgtcatcttgctcacgtgcatgttacatccctcccttg

SEQ ID NO: 112550 - DNA, 75 bp, Artificial Sequence
  Synthetic
gggtcccaagcctgtcagtccggggaggccgtgatgccgtcatcttgctcacgtgcatgttacatccctcccttg

SEQ ID NO: 112551 - DNA, 75 bp, Artificial Sequence
  Synthetic
gggtcccaagcctgtcagcccggggaggccgtgatgccgtcatcttgctcacgtgcatgttacatccctcccttg

SEQ ID NO: 112552 - DNA, 75 bp, Artificial Sequence
  Synthetic
gggtcccaagcctgtcaggccggggaggccgtgatgccgtcatcttgctcacgtgcatgttacatccctcccttg

SEQ ID NO: 112553 - DNA, 75 bp, Artificial Sequence
  Synthetic
gggtcccatgcctgtcagaccggggaggccgtgatgccgtcatcttgctcacgtgcatgttacatccctcccttg

SEQ ID NO: 112554 - DNA, 75 bp, Artificial Sequence
  Synthetic
gggtcccatgcctgtcagtccggggaggccgtgatgccgtcatcttgctcacgtgcatgttacatccctcccttg

SEQ ID NO: 112555 - DNA, 75 bp, Artificial Sequence
  Synthetic
gggtcccatgcctgtcagcccggggaggccgtgatgccgtcatcttgctcacgtgcatgttacatccctcccttg

SEQ ID NO: 112556 - DNA, 75 bp, Artificial Sequence
  Synthetic
gggtcccatgcctgtcaggccggggaggccgtgatgccgtcatcttgctcacgtgcatgttacatccctcccttg

SEQ ID NO: 112557 - DNA, 75 bp, Artificial Sequence
  Synthetic
gggtcccacgcctgtcagaccggggaggccgtgatgccgtcatcttgctcacgtgcatgttacatccctcccttg

SEQ ID NO: 112558 - DNA, 75 bp, Artificial Sequence
  Synthetic
gggtcccacgcctgtcagtccggggaggccgtgatgccgtcatcttgctcacgtgcatgttacatccctcccttg

SEQ ID NO: 112559 - DNA, 75 bp, Artificial Sequence
  Synthetic
gggtcccacgcctgtcagcccggggaggccgtgatgccgtcatcttgctcacgtgcatgttacatccctcccttg

SEQ ID NO: 112560 - DNA, 75 bp, Artificial Sequence
  Synthetic
gggtcccacgcctgtcaggccggggaggccgtgatgccgtcatcttgctcacgtgcatgttacatccctcccttg

SEQ ID NO: 112561 - DNA, 75 bp, Artificial Sequence
  Synthetic
gggtcccaggcctgtcagaccggggaggccgtgatgccgtcatcttgctcacgtgcatgttacatccctcccttg

SEQ ID NO: 112562 - DNA, 75 bp, Artificial Sequence
  Synthetic
gggtcccaggcctgtcagtccggggaggccgtgatgccgtcatcttgctcacgtgcatgttacatccctcccttg

SEQ ID NO: 112563 - DNA, 75 bp, Artificial Sequence
  Synthetic
gggtcccaggcctgtcagcccggggaggccgtgatgccgtcatcttgctcacgtgcatgttacatccctcccttg

SEQ ID NO: 112564 - DNA, 75 bp, Artificial Sequence
  Synthetic
gggtcccaggcctgtcaggccggggaggccgtgatgccgtcatcttgctcacgtgcatgttacatccctcccttg

SEQ ID NO: 112565 - DNA, 75 bp, Artificial Sequence
  Synthetic
gggccccaagcctgtcagaccggggaggccgtgatgccgtcatcttgctcacgtgcatgttacatccctcccttg

SEQ ID NO: 112566 - DNA, 75 bp, Artificial Sequence
  Synthetic
gggccccaagcctgtcagtccggggaggccgtgatgccgtcatcttgctcacgtgcatgttacatccctcccttg

SEQ ID NO: 112567 - DNA, 75 bp, Artificial Sequence
  Synthetic
gggccccaagcctgtcagcccggggaggccgtgatgccgtcatcttgctcacgtgcatgttacatccctcccttg

SEQ ID NO: 112568 - DNA, 75 bp, Artificial Sequence
  Synthetic
gggccccaagcctgtcaggccggggaggccgtgatgccgtcatcttgctcacgtgcatgttacatccctcccttg

SEQ ID NO: 112569 - DNA, 75 bp, Artificial Sequence
  Synthetic
gggccccatgcctgtcagaccggggaggccgtgatgccgtcatcttgctcacgtgcatgttacatccctcccttg

SEQ ID NO: 112570 - DNA, 75 bp, Artificial Sequence
  Synthetic
gggccccatgcctgtcagtccggggaggccgtgatgccgtcatcttgctcacgtgcatgttacatccctcccttg

SEQ ID NO: 112571 - DNA, 75 bp, Artificial Sequence
  Synthetic
gggccccatgcctgtcagcccggggaggccgtgatgccgtcatcttgctcacgtgcatgttacatccctcccttg

SEQ ID NO: 112572 - DNA, 75 bp, Artificial Sequence
  Synthetic
gggccccatgcctgtcaggccggggaggccgtgatgccgtcatcttgctcacgtgcatgttacatccctcccttg

SEQ ID NO: 112573 - DNA, 75 bp, Artificial Sequence
  Synthetic
gggccccacgcctgtcagaccggggaggccgtgatgccgtcatcttgctcacgtgcatgttacatccctcccttg

SEQ ID NO: 112574 - DNA, 75 bp, Artificial Sequence
  Synthetic
gggccccacgcctgtcagtccggggaggccgtgatgccgtcatcttgctcacgtgcatgttacatccctcccttg

SEQ ID NO: 112575 - DNA, 75 bp, Artificial Sequence
  Synthetic
gggccccacgcctgtcagcccggggaggccgtgatgccgtcatcttgctcacgtgcatgttacatccctcccttg

SEQ ID NO: 112576 - DNA, 75 bp, Artificial Sequence
  Synthetic
gggccccacgcctgtcaggccggggaggccgtgatgccgtcatcttgctcacgtgcatgttacatccctcccttg

SEQ ID NO: 112577 - DNA, 75 bp, Artificial Sequence
  Synthetic
gggccccaggcctgtcagaccggggaggccgtgatgccgtcatcttgctcacgtgcatgttacatccctcccttg

SEQ ID NO: 112578 - DNA, 75 bp, Artificial Sequence
  Synthetic
gggccccaggcctgtcagtccggggaggccgtgatgccgtcatcttgctcacgtgcatgttacatccctcccttg

SEQ ID NO: 112579 - DNA, 75 bp, Artificial Sequence
  Synthetic
gggccccaggcctgtcagcccggggaggccgtgatgccgtcatcttgctcacgtgcatgttacatccctcccttg

SEQ ID NO: 112580 - DNA, 75 bp, Artificial Sequence
  Synthetic
gggccccaggcctgtcaggccggggaggccgtgatgccgtcatcttgctcacgtgcatgttacatccctcccttg

SEQ ID NO: 112581 - DNA, 75 bp, Artificial Sequence
  Synthetic
ggggcccaagcctgtcagaccggggaggccgtgatgccgtcatcttgctcacgtgcatgttacatccctcccttg

SEQ ID NO: 112582 - DNA, 75 bp, Artificial Sequence
  Synthetic
ggggcccaagcctgtcagtccggggaggccgtgatgccgtcatcttgctcacgtgcatgttacatccctcccttg

SEQ ID NO: 112583 - DNA, 75 bp, Artificial Sequence
  Synthetic
ggggcccaagcctgtcagcccggggaggccgtgatgccgtcatcttgctcacgtgcatgttacatccctcccttg

SEQ ID NO: 112584 - DNA, 75 bp, Artificial Sequence
  Synthetic
ggggcccaagcctgtcaggccggggaggccgtgatgccgtcatcttgctcacgtgcatgttacatccctcccttg

SEQ ID NO: 112585 - DNA, 75 bp, Artificial Sequence
  Synthetic
ggggcccatgcctgtcagaccggggaggccgtgatgccgtcatcttgctcacgtgcatgttacatccctcccttg

SEQ ID NO: 112586 - DNA, 75 bp, Artificial Sequence
  Synthetic
ggggcccatgcctgtcagtccggggaggccgtgatgccgtcatcttgctcacgtgcatgttacatccctcccttg

SEQ ID NO: 112587 - DNA, 75 bp, Artificial Sequence
  Synthetic
ggggcccatgcctgtcagcccggggaggccgtgatgccgtcatcttgctcacgtgcatgttacatccctcccttg

SEQ ID NO: 112588 - DNA, 75 bp, Artificial Sequence
  Synthetic
ggggcccatgcctgtcaggccggggaggccgtgatgccgtcatcttgctcacgtgcatgttacatccctcccttg

SEQ ID NO: 112589 - DNA, 75 bp, Artificial Sequence
  Synthetic
ggggcccacgcctgtcagaccggggaggccgtgatgccgtcatcttgctcacgtgcatgttacatccctcccttg

SEQ ID NO: 112590 - DNA, 75 bp, Artificial Sequence
  Synthetic
ggggcccacgcctgtcagtccggggaggccgtgatgccgtcatcttgctcacgtgcatgttacatccctcccttg

SEQ ID NO: 112591 - DNA, 75 bp, Artificial Sequence
  Synthetic
ggggcccacgcctgtcagcccggggaggccgtgatgccgtcatcttgctcacgtgcatgttacatccctcccttg

SEQ ID NO: 112592 - DNA, 75 bp, Artificial Sequence
  Synthetic
ggggcccacgcctgtcaggccggggaggccgtgatgccgtcatcttgctcacgtgcatgttacatccctcccttg

SEQ ID NO: 112593 - DNA, 75 bp, Artificial Sequence
  Synthetic
ggggcccaggcctgtcagaccggggaggccgtgatgccgtcatcttgctcacgtgcatgttacatccctcccttg

SEQ ID NO: 112594 - DNA, 75 bp, Artificial Sequence
  Synthetic
ggggcccaggcctgtcagtccggggaggccgtgatgccgtcatcttgctcacgtgcatgttacatccctcccttg

SEQ ID NO: 112595 - DNA, 75 bp, Artificial Sequence
  Synthetic
ggggcccaggcctgtcagcccggggaggccgtgatgccgtcatcttgctcacgtgcatgttacatccctcccttg

SEQ ID NO: 112596 - DNA, 75 bp, Artificial Sequence
  Synthetic
ggggcccaggcctgtcaggccggggaggccgtgatgccgtcatcttgctcacgtgcatgttacatccctcccttg

SEQ ID NO: 112597 - DNA, 75 bp, Artificial Sequence
  Synthetic
gacccctttggattcttcaagccagtttgcttagagtgccctactttgtgcgcgttcaaggccttctccggatct

SEQ ID NO: 112598 - DNA, 75 bp, Artificial Sequence
  Synthetic
gactctttcgacccgcttcgagcggaggaggatgagagggaagtatccgttccggcggagatcctgcggaaatcc

SEQ ID NO: 112599 - DNA, 75 bp, Artificial Sequence
  Synthetic
gaggcccagattcagcaatgggttccccccctggaggcccggggggggcgtgacgggatcatctggctggctgtc

SEQ ID NO: 112600 - DNA, 75 bp, Artificial Sequence
  Synthetic
agggcgaaatccaggtggtctccacggctacgcagacgttcttagccactgccatcaatggggttttatggactg

SEQ ID NO: 112601 - DNA, 75 bp, Artificial Sequence
  Synthetic
tcggtccgctcatggtgctccaggctggcataaccaaggtgccgtacttcgtacgcgcacacgggctcattcgtg

SEQ ID NO: 112602 - DNA, 75 bp, Artificial Sequence
  Synthetic
gattagacgttactaaaatgcttctggcaatagtagggcctctctacctcctacaggctagccttttgcacgtac

SEQ ID NO: 112603 - DNA, 75 bp, Artificial Sequence
  Synthetic
gattagacgttactaaaatgcttctggcaattgtagggcctctctacctcctacaggctagccttttgcacgtac

SEQ ID NO: 112604 - DNA, 75 bp, Artificial Sequence
  Synthetic
gattagacgttactaaaatgcttctggcaatcgtagggcctctctacctcctacaggctagccttttgcacgtac

SEQ ID NO: 112605 - DNA, 75 bp, Artificial Sequence
  Synthetic
gattagacgttactaaaatgcttctggcaatggtagggcctctctacctcctacaggctagccttttgcacgtac

SEQ ID NO: 112606 - DNA, 75 bp, Artificial Sequence
  Synthetic
gatttgacgttactaaaatgcttctggcaatagtagggcctctctacctcctacaggctagccttttgcacgtac

SEQ ID NO: 112607 - DNA, 75 bp, Artificial Sequence
  Synthetic
gatttgacgttactaaaatgcttctggcaattgtagggcctctctacctcctacaggctagccttttgcacgtac

SEQ ID NO: 112608 - DNA, 75 bp, Artificial Sequence
  Synthetic
gatttgacgttactaaaatgcttctggcaatcgtagggcctctctacctcctacaggctagccttttgcacgtac

SEQ ID NO: 112609 - DNA, 75 bp, Artificial Sequence
  Synthetic
gatttgacgttactaaaatgcttctggcaatggtagggcctctctacctcctacaggctagccttttgcacgtac

SEQ ID NO: 112610 - DNA, 75 bp, Artificial Sequence
  Synthetic
gattcgacgttactaaaatgcttctggcaatagtagggcctctctacctcctacaggctagccttttgcacgtac

SEQ ID NO: 112611 - DNA, 75 bp, Artificial Sequence
  Synthetic
gattcgacgttactaaaatgcttctggcaattgtagggcctctctacctcctacaggctagccttttgcacgtac

SEQ ID NO: 112612 - DNA, 75 bp, Artificial Sequence
  Synthetic
gattcgacgttactaaaatgcttctggcaatcgtagggcctctctacctcctacaggctagccttttgcacgtac

SEQ ID NO: 112613 - DNA, 75 bp, Artificial Sequence
  Synthetic
gattcgacgttactaaaatgcttctggcaatggtagggcctctctacctcctacaggctagccttttgcacgtac

SEQ ID NO: 112614 - DNA, 75 bp, Artificial Sequence
  Synthetic
gattggacgttactaaaatgcttctggcaatagtagggcctctctacctcctacaggctagccttttgcacgtac

SEQ ID NO: 112615 - DNA, 75 bp, Artificial Sequence
  Synthetic
gattggacgttactaaaatgcttctggcaattgtagggcctctctacctcctacaggctagccttttgcacgtac

SEQ ID NO: 112616 - DNA, 75 bp, Artificial Sequence
  Synthetic
gattggacgttactaaaatgcttctggcaatcgtagggcctctctacctcctacaggctagccttttgcacgtac

SEQ ID NO: 112617 - DNA, 75 bp, Artificial Sequence
  Synthetic
gattggacgttactaaaatgcttctggcaatggtagggcctctctacctcctacaggctagccttttgcacgtac

SEQ ID NO: 112618 - DNA, 75 bp, Artificial Sequence
  Synthetic
ataacggcggaggcagcaggccgaagactggctcgggggtcaccaccctcgatagctagttcatcggcgagccag

SEQ ID NO: 112619 - DNA, 75 bp, Artificial Sequence
  Synthetic
ataacggcggaggcagcaggccgaagactggctcgggggtcaccaccctcgatagctagttcttcggcgagccag

SEQ ID NO: 112620 - DNA, 75 bp, Artificial Sequence
  Synthetic
ataacggcggaggcagcaggccgaagactggctcgggggtcaccaccctcgatagctagttcctcggcgagccag

SEQ ID NO: 112621 - DNA, 75 bp, Artificial Sequence
  Synthetic
ataacggcggaggcagcaggccgaagactggctcgggggtcaccaccctcgatagctagttcgtcggcgagccag

SEQ ID NO: 112622 - DNA, 75 bp, Artificial Sequence
  Synthetic
ataacggcggaggcagcaggccgaagactggctcgggggtcaccaccctcgttagctagttcatcggcgagccag

SEQ ID NO: 112623 - DNA, 75 bp, Artificial Sequence
  Synthetic
ataacggcggaggcagcaggccgaagactggctcgggggtcaccaccctcgttagctagttcttcggcgagccag

SEQ ID NO: 112624 - DNA, 75 bp, Artificial Sequence
  Synthetic
ataacggcggaggcagcaggccgaagactggctcgggggtcaccaccctcgttagctagttcctcggcgagccag

SEQ ID NO: 112625 - DNA, 75 bp, Artificial Sequence
  Synthetic
ataacggcggaggcagcaggccgaagactggctcgggggtcaccaccctcgttagctagttcgtcggcgagccag

SEQ ID NO: 112626 - DNA, 75 bp, Artificial Sequence
  Synthetic
ataacggcggaggcagcaggccgaagactggctcgggggtcaccaccctcgctagctagttcatcggcgagccag

SEQ ID NO: 112627 - DNA, 75 bp, Artificial Sequence
  Synthetic
ataacggcggaggcagcaggccgaagactggctcgggggtcaccaccctcgctagctagttcttcggcgagccag

SEQ ID NO: 112628 - DNA, 75 bp, Artificial Sequence
  Synthetic
ataacggcggaggcagcaggccgaagactggctcgggggtcaccaccctcgctagctagttcctcggcgagccag

SEQ ID NO: 112629 - DNA, 75 bp, Artificial Sequence
  Synthetic
ataacggcggaggcagcaggccgaagactggctcgggggtcaccaccctcgctagctagttcgtcggcgagccag

SEQ ID NO: 112630 - DNA, 75 bp, Artificial Sequence
  Synthetic
ataacggcggaggcagcaggccgaagactggctcgggggtcaccaccctcggtagctagttcatcggcgagccag

SEQ ID NO: 112631 - DNA, 75 bp, Artificial Sequence
  Synthetic
ataacggcggaggcagcaggccgaagactggctcgggggtcaccaccctcggtagctagttcttcggcgagccag

SEQ ID NO: 112632 - DNA, 75 bp, Artificial Sequence
  Synthetic
ataacggcggaggcagcaggccgaagactggctcgggggtcaccaccctcggtagctagttcctcggcgagccag

SEQ ID NO: 112633 - DNA, 75 bp, Artificial Sequence
  Synthetic
ataacggcggaggcagcaggccgaagactggctcgggggtcaccaccctcggtagctagttcgtcggcgagccag

SEQ ID NO: 112634 - DNA, 75 bp, Artificial Sequence
  Synthetic
ataacggcggaggcagctggccgaagactggctcgggggtcaccaccctcgatagctagttcatcggcgagccag

SEQ ID NO: 112635 - DNA, 75 bp, Artificial Sequence
  Synthetic
ataacggcggaggcagctggccgaagactggctcgggggtcaccaccctcgatagctagttcttcggcgagccag

SEQ ID NO: 112636 - DNA, 75 bp, Artificial Sequence
  Synthetic
ataacggcggaggcagctggccgaagactggctcgggggtcaccaccctcgatagctagttcctcggcgagccag

SEQ ID NO: 112637 - DNA, 75 bp, Artificial Sequence
  Synthetic
ataacggcggaggcagctggccgaagactggctcgggggtcaccaccctcgatagctagttcgtcggcgagccag

SEQ ID NO: 112638 - DNA, 75 bp, Artificial Sequence
  Synthetic
ataacggcggaggcagctggccgaagactggctcgggggtcaccaccctcgttagctagttcatcggcgagccag

SEQ ID NO: 112639 - DNA, 75 bp, Artificial Sequence
  Synthetic
ataacggcggaggcagctggccgaagactggctcgggggtcaccaccctcgttagctagttcttcggcgagccag

SEQ ID NO: 112640 - DNA, 75 bp, Artificial Sequence
  Synthetic
ataacggcggaggcagctggccgaagactggctcgggggtcaccaccctcgttagctagttcctcggcgagccag

SEQ ID NO: 112641 - DNA, 75 bp, Artificial Sequence
  Synthetic
ataacggcggaggcagctggccgaagactggctcgggggtcaccaccctcgttagctagttcgtcggcgagccag

SEQ ID NO: 112642 - DNA, 75 bp, Artificial Sequence
  Synthetic
ataacggcggaggcagctggccgaagactggctcgggggtcaccaccctcgctagctagttcatcggcgagccag

SEQ ID NO: 112643 - DNA, 75 bp, Artificial Sequence
  Synthetic
ataacggcggaggcagctggccgaagactggctcgggggtcaccaccctcgctagctagttcttcggcgagccag

SEQ ID NO: 112644 - DNA, 75 bp, Artificial Sequence
  Synthetic
ataacggcggaggcagctggccgaagactggctcgggggtcaccaccctcgctagctagttcctcggcgagccag

SEQ ID NO: 112645 - DNA, 75 bp, Artificial Sequence
  Synthetic
ataacggcggaggcagctggccgaagactggctcgggggtcaccaccctcgctagctagttcgtcggcgagccag

SEQ ID NO: 112646 - DNA, 75 bp, Artificial Sequence
  Synthetic
ataacggcggaggcagctggccgaagactggctcgggggtcaccaccctcggtagctagttcatcggcgagccag

SEQ ID NO: 112647 - DNA, 75 bp, Artificial Sequence
  Synthetic
ataacggcggaggcagctggccgaagactggctcgggggtcaccaccctcggtagctagttcttcggcgagccag

SEQ ID NO: 112648 - DNA, 75 bp, Artificial Sequence
  Synthetic
ataacggcggaggcagctggccgaagactggctcgggggtcaccaccctcggtagctagttcctcggcgagccag

SEQ ID NO: 112649 - DNA, 75 bp, Artificial Sequence
  Synthetic
ataacggcggaggcagctggccgaagactggctcgggggtcaccaccctcggtagctagttcgtcggcgagccag

SEQ ID NO: 112650 - DNA, 75 bp, Artificial Sequence
  Synthetic
ataacggcggaggcagccggccgaagactggctcgggggtcaccaccctcgatagctagttcatcggcgagccag

SEQ ID NO: 112651 - DNA, 75 bp, Artificial Sequence
  Synthetic
ataacggcggaggcagccggccgaagactggctcgggggtcaccaccctcgatagctagttcttcggcgagccag

SEQ ID NO: 112652 - DNA, 75 bp, Artificial Sequence
  Synthetic
ataacggcggaggcagccggccgaagactggctcgggggtcaccaccctcgatagctagttcctcggcgagccag

SEQ ID NO: 112653 - DNA, 75 bp, Artificial Sequence
  Synthetic
ataacggcggaggcagccggccgaagactggctcgggggtcaccaccctcgatagctagttcgtcggcgagccag

SEQ ID NO: 112654 - DNA, 75 bp, Artificial Sequence
  Synthetic
ataacggcggaggcagccggccgaagactggctcgggggtcaccaccctcgttagctagttcatcggcgagccag

SEQ ID NO: 112655 - DNA, 75 bp, Artificial Sequence
  Synthetic
ataacggcggaggcagccggccgaagactggctcgggggtcaccaccctcgttagctagttcttcggcgagccag

SEQ ID NO: 112656 - DNA, 75 bp, Artificial Sequence
  Synthetic
ataacggcggaggcagccggccgaagactggctcgggggtcaccaccctcgttagctagttcctcggcgagccag

SEQ ID NO: 112657 - DNA, 75 bp, Artificial Sequence
  Synthetic
ataacggcggaggcagccggccgaagactggctcgggggtcaccaccctcgttagctagttcgtcggcgagccag

SEQ ID NO: 112658 - DNA, 75 bp, Artificial Sequence
  Synthetic
ataacggcggaggcagccggccgaagactggctcgggggtcaccaccctcgctagctagttcatcggcgagccag

SEQ ID NO: 112659 - DNA, 75 bp, Artificial Sequence
  Synthetic
ataacggcggaggcagccggccgaagactggctcgggggtcaccaccctcgctagctagttcttcggcgagccag

SEQ ID NO: 112660 - DNA, 75 bp, Artificial Sequence
  Synthetic
ataacggcggaggcagccggccgaagactggctcgggggtcaccaccctcgctagctagttcctcggcgagccag

SEQ ID NO: 112661 - DNA, 75 bp, Artificial Sequence
  Synthetic
ataacggcggaggcagccggccgaagactggctcgggggtcaccaccctcgctagctagttcgtcggcgagccag

SEQ ID NO: 112662 - DNA, 75 bp, Artificial Sequence
  Synthetic
ataacggcggaggcagccggccgaagactggctcgggggtcaccaccctcggtagctagttcatcggcgagccag

SEQ ID NO: 112663 - DNA, 75 bp, Artificial Sequence
  Synthetic
ataacggcggaggcagccggccgaagactggctcgggggtcaccaccctcggtagctagttcttcggcgagccag

SEQ ID NO: 112664 - DNA, 75 bp, Artificial Sequence
  Synthetic
ataacggcggaggcagccggccgaagactggctcgggggtcaccaccctcggtagctagttcctcggcgagccag

SEQ ID NO: 112665 - DNA, 75 bp, Artificial Sequence
  Synthetic
ataacggcggaggcagccggccgaagactggctcgggggtcaccaccctcggtagctagttcgtcggcgagccag

SEQ ID NO: 112666 - DNA, 75 bp, Artificial Sequence
  Synthetic
ataacggcggaggcagcgggccgaagactggctcgggggtcaccaccctcgatagctagttcatcggcgagccag

SEQ ID NO: 112667 - DNA, 75 bp, Artificial Sequence
  Synthetic
ataacggcggaggcagcgggccgaagactggctcgggggtcaccaccctcgatagctagttcttcggcgagccag

SEQ ID NO: 112668 - DNA, 75 bp, Artificial Sequence
  Synthetic
ataacggcggaggcagcgggccgaagactggctcgggggtcaccaccctcgatagctagttcctcggcgagccag

SEQ ID NO: 112669 - DNA, 75 bp, Artificial Sequence
  Synthetic
ataacggcggaggcagcgggccgaagactggctcgggggtcaccaccctcgatagctagttcgtcggcgagccag

SEQ ID NO: 112670 - DNA, 75 bp, Artificial Sequence
  Synthetic
ataacggcggaggcagcgggccgaagactggctcgggggtcaccaccctcgttagctagttcatcggcgagccag

SEQ ID NO: 112671 - DNA, 75 bp, Artificial Sequence
  Synthetic
ataacggcggaggcagcgggccgaagactggctcgggggtcaccaccctcgttagctagttcttcggcgagccag

SEQ ID NO: 112672 - DNA, 75 bp, Artificial Sequence
  Synthetic
ataacggcggaggcagcgggccgaagactggctcgggggtcaccaccctcgttagctagttcctcggcgagccag

SEQ ID NO: 112673 - DNA, 75 bp, Artificial Sequence
  Synthetic
ataacggcggaggcagcgggccgaagactggctcgggggtcaccaccctcgttagctagttcgtcggcgagccag

SEQ ID NO: 112674 - DNA, 75 bp, Artificial Sequence
  Synthetic
ataacggcggaggcagcgggccgaagactggctcgggggtcaccaccctcgctagctagttcatcggcgagccag

SEQ ID NO: 112675 - DNA, 75 bp, Artificial Sequence
  Synthetic
ataacggcggaggcagcgggccgaagactggctcgggggtcaccaccctcgctagctagttcttcggcgagccag

SEQ ID NO: 112676 - DNA, 75 bp, Artificial Sequence
  Synthetic
ataacggcggaggcagcgggccgaagactggctcgggggtcaccaccctcgctagctagttcctcggcgagccag

SEQ ID NO: 112677 - DNA, 75 bp, Artificial Sequence
  Synthetic
ataacggcggaggcagcgggccgaagactggctcgggggtcaccaccctcgctagctagttcgtcggcgagccag

SEQ ID NO: 112678 - DNA, 75 bp, Artificial Sequence
  Synthetic
ataacggcggaggcagcgggccgaagactggctcgggggtcaccaccctcggtagctagttcatcggcgagccag

SEQ ID NO: 112679 - DNA, 75 bp, Artificial Sequence
  Synthetic
ataacggcggaggcagcgggccgaagactggctcgggggtcaccaccctcggtagctagttcttcggcgagccag

SEQ ID NO: 112680 - DNA, 75 bp, Artificial Sequence
  Synthetic
ataacggcggaggcagcgggccgaagactggctcgggggtcaccaccctcggtagctagttcctcggcgagccag

SEQ ID NO: 112681 - DNA, 75 bp, Artificial Sequence
  Synthetic
ataacggcggaggcagcgggccgaagactggctcgggggtcaccaccctcggtagctagttcgtcggcgagccag

SEQ ID NO: 112682 - DNA, 75 bp, Artificial Sequence
  Synthetic
aggccattacgtgcaaatggctatcatcaaggtaggggcgcttactggcacttatatctacaaccatctcactcc

SEQ ID NO: 112683 - DNA, 75 bp, Artificial Sequence
  Synthetic
ttgagcccgttgtcttctctgacatggagaccaaggtcatcacctggggggcagacaccgcggcgtgtggggaca

SEQ ID NO: 112684 - DNA, 75 bp, Artificial Sequence
  Synthetic
accatgcagggcaactgggccaaggtcgcaatcatcatggttatgttctcaggggtcgatgccgttacgtacatc

SEQ ID NO: 112685 - DNA, 75 bp, Artificial Sequence
  Synthetic
tcctggtgctaggtctttgacgccctgcacctgcggtgccagcgatctttacctcgtgacccggaatgctgacat

SEQ ID NO: 112686 - DNA, 75 bp, Artificial Sequence
  Synthetic
tggttacagcgggggagacatatatcacagcgtgtctcgtgcccgaccccgctggttcatgtggtgcctactcct

SEQ ID NO: 112687 - DNA, 75 bp, Artificial Sequence
  Synthetic
tgacgcaccccgtgacgaaatatatcgccacgtgcatgcaggctgacctcgagatcatgacaagcacatgggtcc

SEQ ID NO: 112688 - DNA, 75 bp, Artificial Sequence
  Synthetic
gctaattgggcaaaagtcatcttagtcctattcctcttcgcaggggttgacgctgacacactcgtatcagggggt

SEQ ID NO: 112689 - DNA, 75 bp, Artificial Sequence
  Synthetic
gctaattgggcaaaagtcatcttagtcctattcctcttcgcaggggttgacgctgacactctcgtatcagggggt

SEQ ID NO: 112690 - DNA, 75 bp, Artificial Sequence
  Synthetic
gctaattgggcaaaagtcatcttagtcctattcctcttcgcaggggttgacgctgacaccctcgtatcagggggt

SEQ ID NO: 112691 - DNA, 75 bp, Artificial Sequence
  Synthetic
gctaattgggcaaaagtcatcttagtcctattcctcttcgcaggggttgacgctgacacgctcgtatcagggggt

SEQ ID NO: 112692 - DNA, 75 bp, Artificial Sequence
  Synthetic
gctaattgggcaaaagtcatcttagtcctattcctcttcgctggggttgacgctgacacactcgtatcagggggt

SEQ ID NO: 112693 - DNA, 75 bp, Artificial Sequence
  Synthetic
gctaattgggcaaaagtcatcttagtcctattcctcttcgctggggttgacgctgacactctcgtatcagggggt

SEQ ID NO: 112694 - DNA, 75 bp, Artificial Sequence
  Synthetic
gctaattgggcaaaagtcatcttagtcctattcctcttcgctggggttgacgctgacaccctcgtatcagggggt

SEQ ID NO: 112695 - DNA, 75 bp, Artificial Sequence
  Synthetic
gctaattgggcaaaagtcatcttagtcctattcctcttcgctggggttgacgctgacacgctcgtatcagggggt

SEQ ID NO: 112696 - DNA, 75 bp, Artificial Sequence
  Synthetic
gctaattgggcaaaagtcatcttagtcctattcctcttcgccggggttgacgctgacacactcgtatcagggggt

SEQ ID NO: 112697 - DNA, 75 bp, Artificial Sequence
  Synthetic
gctaattgggcaaaagtcatcttagtcctattcctcttcgccggggttgacgctgacactctcgtatcagggggt

SEQ ID NO: 112698 - DNA, 75 bp, Artificial Sequence
  Synthetic
gctaattgggcaaaagtcatcttagtcctattcctcttcgccggggttgacgctgacaccctcgtatcagggggt

SEQ ID NO: 112699 - DNA, 75 bp, Artificial Sequence
  Synthetic
gctaattgggcaaaagtcatcttagtcctattcctcttcgccggggttgacgctgacacgctcgtatcagggggt

SEQ ID NO: 112700 - DNA, 75 bp, Artificial Sequence
  Synthetic
gctaattgggcaaaagtcatcttagtcctattcctcttcgcgggggttgacgctgacacactcgtatcagggggt

SEQ ID NO: 112701 - DNA, 75 bp, Artificial Sequence
  Synthetic
gctaattgggcaaaagtcatcttagtcctattcctcttcgcgggggttgacgctgacactctcgtatcagggggt

SEQ ID NO: 112702 - DNA, 75 bp, Artificial Sequence
  Synthetic
gctaattgggcaaaagtcatcttagtcctattcctcttcgcgggggttgacgctgacaccctcgtatcagggggt

SEQ ID NO: 112703 - DNA, 75 bp, Artificial Sequence
  Synthetic
gctaattgggcaaaagtcatcttagtcctattcctcttcgcgggggttgacgctgacacgctcgtatcagggggt

SEQ ID NO: 112704 - DNA, 75 bp, Artificial Sequence
  Synthetic
gctaattgggcaaatgtcatcttagtcctattcctcttcgcaggggttgacgctgacacactcgtatcagggggt

SEQ ID NO: 112705 - DNA, 75 bp, Artificial Sequence
  Synthetic
gctaattgggcaaatgtcatcttagtcctattcctcttcgcaggggttgacgctgacactctcgtatcagggggt

SEQ ID NO: 112706 - DNA, 75 bp, Artificial Sequence
  Synthetic
gctaattgggcaaatgtcatcttagtcctattcctcttcgcaggggttgacgctgacaccctcgtatcagggggt

SEQ ID NO: 112707 - DNA, 75 bp, Artificial Sequence
  Synthetic
gctaattgggcaaatgtcatcttagtcctattcctcttcgcaggggttgacgctgacacgctcgtatcagggggt

SEQ ID NO: 112708 - DNA, 75 bp, Artificial Sequence
  Synthetic
gctaattgggcaaatgtcatcttagtcctattcctcttcgctggggttgacgctgacacactcgtatcagggggt

SEQ ID NO: 112709 - DNA, 75 bp, Artificial Sequence
  Synthetic
gctaattgggcaaatgtcatcttagtcctattcctcttcgctggggttgacgctgacactctcgtatcagggggt

SEQ ID NO: 112710 - DNA, 75 bp, Artificial Sequence
  Synthetic
gctaattgggcaaatgtcatcttagtcctattcctcttcgctggggttgacgctgacaccctcgtatcagggggt

SEQ ID NO: 112711 - DNA, 75 bp, Artificial Sequence
  Synthetic
gctaattgggcaaatgtcatcttagtcctattcctcttcgctggggttgacgctgacacgctcgtatcagggggt

SEQ ID NO: 112712 - DNA, 75 bp, Artificial Sequence
  Synthetic
gctaattgggcaaatgtcatcttagtcctattcctcttcgccggggttgacgctgacacactcgtatcagggggt

SEQ ID NO: 112713 - DNA, 75 bp, Artificial Sequence
  Synthetic
gctaattgggcaaatgtcatcttagtcctattcctcttcgccggggttgacgctgacactctcgtatcagggggt

SEQ ID NO: 112714 - DNA, 75 bp, Artificial Sequence
  Synthetic
gctaattgggcaaatgtcatcttagtcctattcctcttcgccggggttgacgctgacaccctcgtatcagggggt

SEQ ID NO: 112715 - DNA, 75 bp, Artificial Sequence
  Synthetic
gctaattgggcaaatgtcatcttagtcctattcctcttcgccggggttgacgctgacacgctcgtatcagggggt

SEQ ID NO: 112716 - DNA, 75 bp, Artificial Sequence
  Synthetic
gctaattgggcaaatgtcatcttagtcctattcctcttcgcgggggttgacgctgacacactcgtatcagggggt

SEQ ID NO: 112717 - DNA, 75 bp, Artificial Sequence
  Synthetic
gctaattgggcaaatgtcatcttagtcctattcctcttcgcgggggttgacgctgacactctcgtatcagggggt

SEQ ID NO: 112718 - DNA, 75 bp, Artificial Sequence
  Synthetic
gctaattgggcaaatgtcatcttagtcctattcctcttcgcgggggttgacgctgacaccctcgtatcagggggt

SEQ ID NO: 112719 - DNA, 75 bp, Artificial Sequence
  Synthetic
gctaattgggcaaatgtcatcttagtcctattcctcttcgcgggggttgacgctgacacgctcgtatcagggggt

SEQ ID NO: 112720 - DNA, 75 bp, Artificial Sequence
  Synthetic
gctaattgggcaaacgtcatcttagtcctattcctcttcgcaggggttgacgctgacacactcgtatcagggggt

SEQ ID NO: 112721 - DNA, 75 bp, Artificial Sequence
  Synthetic
gctaattgggcaaacgtcatcttagtcctattcctcttcgcaggggttgacgctgacactctcgtatcagggggt

SEQ ID NO: 112722 - DNA, 75 bp, Artificial Sequence
  Synthetic
gctaattgggcaaacgtcatcttagtcctattcctcttcgcaggggttgacgctgacaccctcgtatcagggggt

SEQ ID NO: 112723 - DNA, 75 bp, Artificial Sequence
  Synthetic
gctaattgggcaaacgtcatcttagtcctattcctcttcgcaggggttgacgctgacacgctcgtatcagggggt

SEQ ID NO: 112724 - DNA, 75 bp, Artificial Sequence
  Synthetic
gctaattgggcaaacgtcatcttagtcctattcctcttcgctggggttgacgctgacacactcgtatcagggggt

SEQ ID NO: 112725 - DNA, 75 bp, Artificial Sequence
  Synthetic
gctaattgggcaaacgtcatcttagtcctattcctcttcgctggggttgacgctgacactctcgtatcagggggt

SEQ ID NO: 112726 - DNA, 75 bp, Artificial Sequence
  Synthetic
gctaattgggcaaacgtcatcttagtcctattcctcttcgctggggttgacgctgacaccctcgtatcagggggt

SEQ ID NO: 112727 - DNA, 75 bp, Artificial Sequence
  Synthetic
gctaattgggcaaacgtcatcttagtcctattcctcttcgctggggttgacgctgacacgctcgtatcagggggt

SEQ ID NO: 112728 - DNA, 75 bp, Artificial Sequence
  Synthetic
gctaattgggcaaacgtcatcttagtcctattcctcttcgccggggttgacgctgacacactcgtatcagggggt

SEQ ID NO: 112729 - DNA, 75 bp, Artificial Sequence
  Synthetic
gctaattgggcaaacgtcatcttagtcctattcctcttcgccggggttgacgctgacactctcgtatcagggggt

SEQ ID NO: 112730 - DNA, 75 bp, Artificial Sequence
  Synthetic
gctaattgggcaaacgtcatcttagtcctattcctcttcgccggggttgacgctgacaccctcgtatcagggggt

SEQ ID NO: 112731 - DNA, 75 bp, Artificial Sequence
  Synthetic
gctaattgggcaaacgtcatcttagtcctattcctcttcgccggggttgacgctgacacgctcgtatcagggggt

SEQ ID NO: 112732 - DNA, 75 bp, Artificial Sequence
  Synthetic
gctaattgggcaaacgtcatcttagtcctattcctcttcgcgggggttgacgctgacacactcgtatcagggggt

SEQ ID NO: 112733 - DNA, 75 bp, Artificial Sequence
  Synthetic
gctaattgggcaaacgtcatcttagtcctattcctcttcgcgggggttgacgctgacactctcgtatcagggggt

SEQ ID NO: 112734 - DNA, 75 bp, Artificial Sequence
  Synthetic
gctaattgggcaaacgtcatcttagtcctattcctcttcgcgggggttgacgctgacaccctcgtatcagggggt

SEQ ID NO: 112735 - DNA, 75 bp, Artificial Sequence
  Synthetic
gctaattgggcaaacgtcatcttagtcctattcctcttcgcgggggttgacgctgacacgctcgtatcagggggt

SEQ ID NO: 112736 - DNA, 75 bp, Artificial Sequence
  Synthetic
gctaattgggcaaaggtcatcttagtcctattcctcttcgcaggggttgacgctgacacactcgtatcagggggt

SEQ ID NO: 112737 - DNA, 75 bp, Artificial Sequence
  Synthetic
gctaattgggcaaaggtcatcttagtcctattcctcttcgcaggggttgacgctgacactctcgtatcagggggt

SEQ ID NO: 112738 - DNA, 75 bp, Artificial Sequence
  Synthetic
gctaattgggcaaaggtcatcttagtcctattcctcttcgcaggggttgacgctgacaccctcgtatcagggggt

SEQ ID NO: 112739 - DNA, 75 bp, Artificial Sequence
  Synthetic
gctaattgggcaaaggtcatcttagtcctattcctcttcgcaggggttgacgctgacacgctcgtatcagggggt

SEQ ID NO: 112740 - DNA, 75 bp, Artificial Sequence
  Synthetic
gctaattgggcaaaggtcatcttagtcctattcctcttcgctggggttgacgctgacacactcgtatcagggggt

SEQ ID NO: 112741 - DNA, 75 bp, Artificial Sequence
  Synthetic
gctaattgggcaaaggtcatcttagtcctattcctcttcgctggggttgacgctgacactctcgtatcagggggt

SEQ ID NO: 112742 - DNA, 75 bp, Artificial Sequence
  Synthetic
gctaattgggcaaaggtcatcttagtcctattcctcttcgctggggttgacgctgacaccctcgtatcagggggt

SEQ ID NO: 112743 - DNA, 75 bp, Artificial Sequence
  Synthetic
gctaattgggcaaaggtcatcttagtcctattcctcttcgctggggttgacgctgacacgctcgtatcagggggt

SEQ ID NO: 112744 - DNA, 75 bp, Artificial Sequence
  Synthetic
gctaattgggcaaaggtcatcttagtcctattcctcttcgccggggttgacgctgacacactcgtatcagggggt

SEQ ID NO: 112745 - DNA, 75 bp, Artificial Sequence
  Synthetic
gctaattgggcaaaggtcatcttagtcctattcctcttcgccggggttgacgctgacactctcgtatcagggggt

SEQ ID NO: 112746 - DNA, 75 bp, Artificial Sequence
  Synthetic
gctaattgggcaaaggtcatcttagtcctattcctcttcgccggggttgacgctgacaccctcgtatcagggggt

SEQ ID NO: 112747 - DNA, 75 bp, Artificial Sequence
  Synthetic
gctaattgggcaaaggtcatcttagtcctattcctcttcgccggggttgacgctgacacgctcgtatcagggggt

SEQ ID NO: 112748 - DNA, 75 bp, Artificial Sequence
  Synthetic
gctaattgggcaaaggtcatcttagtcctattcctcttcgcgggggttgacgctgacacactcgtatcagggggt

SEQ ID NO: 112749 - DNA, 75 bp, Artificial Sequence
  Synthetic
gctaattgggcaaaggtcatcttagtcctattcctcttcgcgggggttgacgctgacactctcgtatcagggggt

SEQ ID NO: 112750 - DNA, 75 bp, Artificial Sequence
  Synthetic
gctaattgggcaaaggtcatcttagtcctattcctcttcgcgggggttgacgctgacaccctcgtatcagggggt

SEQ ID NO: 112751 - DNA, 75 bp, Artificial Sequence
  Synthetic
gctaattgggcaaaggtcatcttagtcctattcctcttcgcgggggttgacgctgacacgctcgtatcagggggt

SEQ ID NO: 112752 - DNA, 75 bp, Artificial Sequence
  Synthetic
aggtctcggtcgcagcggaaatactgcgtccgaccaagaagttccccccagctctaccgatctgggcccgaccag

SEQ ID NO: 112753 - DNA, 75 bp, Artificial Sequence
  Synthetic
aggtctcggtcgcagcggaaattctgcgtccgaccaagaagttccccccagctctaccgatctgggcccgaccag

SEQ ID NO: 112754 - DNA, 75 bp, Artificial Sequence
  Synthetic
aggtctcggtcgcagcggaaatcctgcgtccgaccaagaagttccccccagctctaccgatctgggcccgaccag

SEQ ID NO: 112755 - DNA, 75 bp, Artificial Sequence
  Synthetic
aggtctcggtcgcagcggaaatgctgcgtccgaccaagaagttccccccagctctaccgatctgggcccgaccag

SEQ ID NO: 112756 - DNA, 75 bp, Artificial Sequence
  Synthetic
aggtctcggtcgcagcggaattactgcgtccgaccaagaagttccccccagctctaccgatctgggcccgaccag

SEQ ID NO: 112757 - DNA, 75 bp, Artificial Sequence
  Synthetic
aggtctcggtcgcagcggaatttctgcgtccgaccaagaagttccccccagctctaccgatctgggcccgaccag

SEQ ID NO: 112758 - DNA, 75 bp, Artificial Sequence
  Synthetic
aggtctcggtcgcagcggaattcctgcgtccgaccaagaagttccccccagctctaccgatctgggcccgaccag

SEQ ID NO: 112759 - DNA, 75 bp, Artificial Sequence
  Synthetic
aggtctcggtcgcagcggaattgctgcgtccgaccaagaagttccccccagctctaccgatctgggcccgaccag

SEQ ID NO: 112760 - DNA, 75 bp, Artificial Sequence
  Synthetic
aggtctcggtcgcagcggaactactgcgtccgaccaagaagttccccccagctctaccgatctgggcccgaccag

SEQ ID NO: 112761 - DNA, 75 bp, Artificial Sequence
  Synthetic
aggtctcggtcgcagcggaacttctgcgtccgaccaagaagttccccccagctctaccgatctgggcccgaccag

SEQ ID NO: 112762 - DNA, 75 bp, Artificial Sequence
  Synthetic
aggtctcggtcgcagcggaactcctgcgtccgaccaagaagttccccccagctctaccgatctgggcccgaccag

SEQ ID NO: 112763 - DNA, 75 bp, Artificial Sequence
  Synthetic
aggtctcggtcgcagcggaactgctgcgtccgaccaagaagttccccccagctctaccgatctgggcccgaccag

SEQ ID NO: 112764 - DNA, 75 bp, Artificial Sequence
  Synthetic
aggtctcggtcgcagcggaagtactgcgtccgaccaagaagttccccccagctctaccgatctgggcccgaccag

SEQ ID NO: 112765 - DNA, 75 bp, Artificial Sequence
  Synthetic
aggtctcggtcgcagcggaagttctgcgtccgaccaagaagttccccccagctctaccgatctgggcccgaccag

SEQ ID NO: 112766 - DNA, 75 bp, Artificial Sequence
  Synthetic
aggtctcggtcgcagcggaagtcctgcgtccgaccaagaagttccccccagctctaccgatctgggcccgaccag

SEQ ID NO: 112767 - DNA, 75 bp, Artificial Sequence
  Synthetic
aggtctcggtcgcagcggaagtgctgcgtccgaccaagaagttccccccagctctaccgatctgggcccgaccag

SEQ ID NO: 112768 - DNA, 75 bp, Artificial Sequence
  Synthetic
aggtctcggtcgctgcggaaatactgcgtccgaccaagaagttccccccagctctaccgatctgggcccgaccag

SEQ ID NO: 112769 - DNA, 75 bp, Artificial Sequence
  Synthetic
aggtctcggtcgctgcggaaattctgcgtccgaccaagaagttccccccagctctaccgatctgggcccgaccag

SEQ ID NO: 112770 - DNA, 75 bp, Artificial Sequence
  Synthetic
aggtctcggtcgctgcggaaatcctgcgtccgaccaagaagttccccccagctctaccgatctgggcccgaccag

SEQ ID NO: 112771 - DNA, 75 bp, Artificial Sequence
  Synthetic
aggtctcggtcgctgcggaaatgctgcgtccgaccaagaagttccccccagctctaccgatctgggcccgaccag

SEQ ID NO: 112772 - DNA, 75 bp, Artificial Sequence
  Synthetic
aggtctcggtcgctgcggaattactgcgtccgaccaagaagttccccccagctctaccgatctgggcccgaccag

SEQ ID NO: 112773 - DNA, 75 bp, Artificial Sequence
  Synthetic
aggtctcggtcgctgcggaatttctgcgtccgaccaagaagttccccccagctctaccgatctgggcccgaccag

SEQ ID NO: 112774 - DNA, 75 bp, Artificial Sequence
  Synthetic
aggtctcggtcgctgcggaattcctgcgtccgaccaagaagttccccccagctctaccgatctgggcccgaccag

SEQ ID NO: 112775 - DNA, 75 bp, Artificial Sequence
  Synthetic
aggtctcggtcgctgcggaattgctgcgtccgaccaagaagttccccccagctctaccgatctgggcccgaccag

SEQ ID NO: 112776 - DNA, 75 bp, Artificial Sequence
  Synthetic
aggtctcggtcgctgcggaactactgcgtccgaccaagaagttccccccagctctaccgatctgggcccgaccag

SEQ ID NO: 112777 - DNA, 75 bp, Artificial Sequence
  Synthetic
aggtctcggtcgctgcggaacttctgcgtccgaccaagaagttccccccagctctaccgatctgggcccgaccag

SEQ ID NO: 112778 - DNA, 75 bp, Artificial Sequence
  Synthetic
aggtctcggtcgctgcggaactcctgcgtccgaccaagaagttccccccagctctaccgatctgggcccgaccag

SEQ ID NO: 112779 - DNA, 75 bp, Artificial Sequence
  Synthetic
aggtctcggtcgctgcggaactgctgcgtccgaccaagaagttccccccagctctaccgatctgggcccgaccag

SEQ ID NO: 112780 - DNA, 75 bp, Artificial Sequence
  Synthetic
aggtctcggtcgctgcggaagtactgcgtccgaccaagaagttccccccagctctaccgatctgggcccgaccag

SEQ ID NO: 112781 - DNA, 75 bp, Artificial Sequence
  Synthetic
aggtctcggtcgctgcggaagttctgcgtccgaccaagaagttccccccagctctaccgatctgggcccgaccag

SEQ ID NO: 112782 - DNA, 75 bp, Artificial Sequence
  Synthetic
aggtctcggtcgctgcggaagtcctgcgtccgaccaagaagttccccccagctctaccgatctgggcccgaccag

SEQ ID NO: 112783 - DNA, 75 bp, Artificial Sequence
  Synthetic
aggtctcggtcgctgcggaagtgctgcgtccgaccaagaagttccccccagctctaccgatctgggcccgaccag

SEQ ID NO: 112784 - DNA, 75 bp, Artificial Sequence
  Synthetic
aggtctcggtcgccgcggaaatactgcgtccgaccaagaagttccccccagctctaccgatctgggcccgaccag

SEQ ID NO: 112785 - DNA, 75 bp, Artificial Sequence
  Synthetic
aggtctcggtcgccgcggaaattctgcgtccgaccaagaagttccccccagctctaccgatctgggcccgaccag

SEQ ID NO: 112786 - DNA, 75 bp, Artificial Sequence
  Synthetic
aggtctcggtcgccgcggaaatcctgcgtccgaccaagaagttccccccagctctaccgatctgggcccgaccag

SEQ ID NO: 112787 - DNA, 75 bp, Artificial Sequence
  Synthetic
aggtctcggtcgccgcggaaatgctgcgtccgaccaagaagttccccccagctctaccgatctgggcccgaccag

SEQ ID NO: 112788 - DNA, 75 bp, Artificial Sequence
  Synthetic
aggtctcggtcgccgcggaattactgcgtccgaccaagaagttccccccagctctaccgatctgggcccgaccag

SEQ ID NO: 112789 - DNA, 75 bp, Artificial Sequence
  Synthetic
aggtctcggtcgccgcggaatttctgcgtccgaccaagaagttccccccagctctaccgatctgggcccgaccag

SEQ ID NO: 112790 - DNA, 75 bp, Artificial Sequence
  Synthetic
aggtctcggtcgccgcggaattcctgcgtccgaccaagaagttccccccagctctaccgatctgggcccgaccag

SEQ ID NO: 112791 - DNA, 75 bp, Artificial Sequence
  Synthetic
aggtctcggtcgccgcggaattgctgcgtccgaccaagaagttccccccagctctaccgatctgggcccgaccag

SEQ ID NO: 112792 - DNA, 75 bp, Artificial Sequence
  Synthetic
aggtctcggtcgccgcggaactactgcgtccgaccaagaagttccccccagctctaccgatctgggcccgaccag

SEQ ID NO: 112793 - DNA, 75 bp, Artificial Sequence
  Synthetic
aggtctcggtcgccgcggaacttctgcgtccgaccaagaagttccccccagctctaccgatctgggcccgaccag

SEQ ID NO: 112794 - DNA, 75 bp, Artificial Sequence
  Synthetic
aggtctcggtcgccgcggaactcctgcgtccgaccaagaagttccccccagctctaccgatctgggcccgaccag

SEQ ID NO: 112795 - DNA, 75 bp, Artificial Sequence
  Synthetic
aggtctcggtcgccgcggaactgctgcgtccgaccaagaagttccccccagctctaccgatctgggcccgaccag

SEQ ID NO: 112796 - DNA, 75 bp, Artificial Sequence
  Synthetic
aggtctcggtcgccgcggaagtactgcgtccgaccaagaagttccccccagctctaccgatctgggcccgaccag

SEQ ID NO: 112797 - DNA, 75 bp, Artificial Sequence
  Synthetic
aggtctcggtcgccgcggaagttctgcgtccgaccaagaagttccccccagctctaccgatctgggcccgaccag

SEQ ID NO: 112798 - DNA, 75 bp, Artificial Sequence
  Synthetic
aggtctcggtcgccgcggaagtcctgcgtccgaccaagaagttccccccagctctaccgatctgggcccgaccag

SEQ ID NO: 112799 - DNA, 75 bp, Artificial Sequence
  Synthetic
aggtctcggtcgccgcggaagtgctgcgtccgaccaagaagttccccccagctctaccgatctgggcccgaccag

SEQ ID NO: 112800 - DNA, 75 bp, Artificial Sequence
  Synthetic
aggtctcggtcgcggcggaaatactgcgtccgaccaagaagttccccccagctctaccgatctgggcccgaccag

SEQ ID NO: 112801 - DNA, 75 bp, Artificial Sequence
  Synthetic
aggtctcggtcgcggcggaaattctgcgtccgaccaagaagttccccccagctctaccgatctgggcccgaccag

SEQ ID NO: 112802 - DNA, 75 bp, Artificial Sequence
  Synthetic
aggtctcggtcgcggcggaaatcctgcgtccgaccaagaagttccccccagctctaccgatctgggcccgaccag

SEQ ID NO: 112803 - DNA, 75 bp, Artificial Sequence
  Synthetic
aggtctcggtcgcggcggaaatgctgcgtccgaccaagaagttccccccagctctaccgatctgggcccgaccag

SEQ ID NO: 112804 - DNA, 75 bp, Artificial Sequence
  Synthetic
aggtctcggtcgcggcggaattactgcgtccgaccaagaagttccccccagctctaccgatctgggcccgaccag

SEQ ID NO: 112805 - DNA, 75 bp, Artificial Sequence
  Synthetic
aggtctcggtcgcggcggaatttctgcgtccgaccaagaagttccccccagctctaccgatctgggcccgaccag

SEQ ID NO: 112806 - DNA, 75 bp, Artificial Sequence
  Synthetic
aggtctcggtcgcggcggaattcctgcgtccgaccaagaagttccccccagctctaccgatctgggcccgaccag

SEQ ID NO: 112807 - DNA, 75 bp, Artificial Sequence
  Synthetic
aggtctcggtcgcggcggaattgctgcgtccgaccaagaagttccccccagctctaccgatctgggcccgaccag

SEQ ID NO: 112808 - DNA, 75 bp, Artificial Sequence
  Synthetic
aggtctcggtcgcggcggaactactgcgtccgaccaagaagttccccccagctctaccgatctgggcccgaccag

SEQ ID NO: 112809 - DNA, 75 bp, Artificial Sequence
  Synthetic
aggtctcggtcgcggcggaacttctgcgtccgaccaagaagttccccccagctctaccgatctgggcccgaccag

SEQ ID NO: 112810 - DNA, 75 bp, Artificial Sequence
  Synthetic
aggtctcggtcgcggcggaactcctgcgtccgaccaagaagttccccccagctctaccgatctgggcccgaccag

SEQ ID NO: 112811 - DNA, 75 bp, Artificial Sequence
  Synthetic
aggtctcggtcgcggcggaactgctgcgtccgaccaagaagttccccccagctctaccgatctgggcccgaccag

SEQ ID NO: 112812 - DNA, 75 bp, Artificial Sequence
  Synthetic
aggtctcggtcgcggcggaagtactgcgtccgaccaagaagttccccccagctctaccgatctgggcccgaccag

SEQ ID NO: 112813 - DNA, 75 bp, Artificial Sequence
  Synthetic
aggtctcggtcgcggcggaagttctgcgtccgaccaagaagttccccccagctctaccgatctgggcccgaccag

SEQ ID NO: 112814 - DNA, 75 bp, Artificial Sequence
  Synthetic
aggtctcggtcgcggcggaagtcctgcgtccgaccaagaagttccccccagctctaccgatctgggcccgaccag

SEQ ID NO: 112815 - DNA, 75 bp, Artificial Sequence
  Synthetic
aggtctcggtcgcggcggaagtgctgcgtccgaccaagaagttccccccagctctaccgatctgggcccgaccag

SEQ ID NO: 112816 - DNA, 75 bp, Artificial Sequence
  Synthetic
ctcagggtgtcccgaacggctagcaagttgcaggagccttgacagctttgaccaaggctggggcccacttggggt

SEQ ID NO: 112817 - DNA, 75 bp, Artificial Sequence
  Synthetic
ctcagggtgtcccgaacggcttgcaagttgcaggagccttgacagctttgaccaaggctggggcccacttggggt

SEQ ID NO: 112818 - DNA, 75 bp, Artificial Sequence
  Synthetic
ctcagggtgtcccgaacggctcgcaagttgcaggagccttgacagctttgaccaaggctggggcccacttggggt

SEQ ID NO: 112819 - DNA, 75 bp, Artificial Sequence
  Synthetic
ctcagggtgtcccgaacggctggcaagttgcaggagccttgacagctttgaccaaggctggggcccacttggggt

SEQ ID NO: 112820 - DNA, 75 bp, Artificial Sequence
  Synthetic
acatcaacagtactgtcctccactgcaatgagtccataaacacagggtttatagctgggttgttttattatcata

SEQ ID NO: 112821 - DNA, 75 bp, Artificial Sequence
  Synthetic
gcgggtcatgccgtcgggctgttccgagctgccgtctgtacccgcggcgttgccaaggcgatagatttcatacct

SEQ ID NO: 112822 - DNA, 75 bp, Artificial Sequence
  Synthetic
aaacacgcggcctgctggggacgatcgtaaccagcttgaccggcagggacaaaaatgaggttgagggtgaagtcc

SEQ ID NO: 112823 - DNA, 75 bp, Artificial Sequence
  Synthetic
aaacacgcggcctgctggggacgatcgttaccagcttgaccggcagggacaaaaatgaggttgagggtgaagtcc

SEQ ID NO: 112824 - DNA, 75 bp, Artificial Sequence
  Synthetic
aaacacgcggcctgctggggacgatcgtcaccagcttgaccggcagggacaaaaatgaggttgagggtgaagtcc

SEQ ID NO: 112825 - DNA, 75 bp, Artificial Sequence
  Synthetic
aaacacgcggcctgctggggacgatcgtgaccagcttgaccggcagggacaaaaatgaggttgagggtgaagtcc

SEQ ID NO: 112826 - DNA, 75 bp, Artificial Sequence
  Synthetic
aaactcgcggcctgctggggacgatcgtaaccagcttgaccggcagggacaaaaatgaggttgagggtgaagtcc

SEQ ID NO: 112827 - DNA, 75 bp, Artificial Sequence
  Synthetic
aaactcgcggcctgctggggacgatcgttaccagcttgaccggcagggacaaaaatgaggttgagggtgaagtcc

SEQ ID NO: 112828 - DNA, 75 bp, Artificial Sequence
  Synthetic
aaactcgcggcctgctggggacgatcgtcaccagcttgaccggcagggacaaaaatgaggttgagggtgaagtcc

SEQ ID NO: 112829 - DNA, 75 bp, Artificial Sequence
  Synthetic
aaactcgcggcctgctggggacgatcgtgaccagcttgaccggcagggacaaaaatgaggttgagggtgaagtcc

SEQ ID NO: 112830 - DNA, 75 bp, Artificial Sequence
  Synthetic
aaacccgcggcctgctggggacgatcgtaaccagcttgaccggcagggacaaaaatgaggttgagggtgaagtcc

SEQ ID NO: 112831 - DNA, 75 bp, Artificial Sequence
  Synthetic
aaacccgcggcctgctggggacgatcgttaccagcttgaccggcagggacaaaaatgaggttgagggtgaagtcc

SEQ ID NO: 112832 - DNA, 75 bp, Artificial Sequence
  Synthetic
aaacccgcggcctgctggggacgatcgtcaccagcttgaccggcagggacaaaaatgaggttgagggtgaagtcc

SEQ ID NO: 112833 - DNA, 75 bp, Artificial Sequence
  Synthetic
aaacccgcggcctgctggggacgatcgtgaccagcttgaccggcagggacaaaaatgaggttgagggtgaagtcc

SEQ ID NO: 112834 - DNA, 75 bp, Artificial Sequence
  Synthetic
aaacgcgcggcctgctggggacgatcgtaaccagcttgaccggcagggacaaaaatgaggttgagggtgaagtcc

SEQ ID NO: 112835 - DNA, 75 bp, Artificial Sequence
  Synthetic
aaacgcgcggcctgctggggacgatcgttaccagcttgaccggcagggacaaaaatgaggttgagggtgaagtcc

SEQ ID NO: 112836 - DNA, 75 bp, Artificial Sequence
  Synthetic
aaacgcgcggcctgctggggacgatcgtcaccagcttgaccggcagggacaaaaatgaggttgagggtgaagtcc

SEQ ID NO: 112837 - DNA, 75 bp, Artificial Sequence
  Synthetic
aaacgcgcggcctgctggggacgatcgtgaccagcttgaccggcagggacaaaaatgaggttgagggtgaagtcc

SEQ ID NO: 112838 - DNA, 75 bp, Artificial Sequence
  Synthetic
tcctcccaggaggaaacggacggttcaactcactgagtccgttgtttctaccgctctagcagagctggccgcaaa

SEQ ID NO: 112839 - DNA, 75 bp, Artificial Sequence
  Synthetic
tcctcccaggaggaaacggacggttcaactcactgagtccgttgtttctaccgctcttgcagagctggccgcaaa

SEQ ID NO: 112840 - DNA, 75 bp, Artificial Sequence
  Synthetic
tcctcccaggaggaaacggacggttcaactcactgagtccgttgtttctaccgctctcgcagagctggccgcaaa

SEQ ID NO: 112841 - DNA, 75 bp, Artificial Sequence
  Synthetic
tcctcccaggaggaaacggacggttcaactcactgagtccgttgtttctaccgctctggcagagctggccgcaaa

SEQ ID NO: 112842 - DNA, 75 bp, Artificial Sequence
  Synthetic
ctatgatgccggggcagcctggtacgagcttacgcctgctgagactacggtgaggctccgggcttatttcaacac

SEQ ID NO: 112843 - DNA, 75 bp, Artificial Sequence
  Synthetic
accgggaaatggctgcatcgtgcggaggtgcggttttcataggtctggtgctcctgaccttatcaccacactaca

SEQ ID NO: 112844 - DNA, 75 bp, Artificial Sequence
  Synthetic
tgtctcctggcgctttggtagtgggagtcatctgcgcagcaatcctgcgccgccacgtcggccagggagaggggg

SEQ ID NO: 112845 - DNA, 75 bp, Artificial Sequence
  Synthetic
ccttctgatgacaaccgtactgctggcatacgcacctagaccttgtgacagcgtaaagcagcacgtgtctccggt

SEQ ID NO: 112846 - DNA, 75 bp, Artificial Sequence
  Synthetic
ccaccggtagcgggaagagcaccaaagtgccggcagcctatgcctcgcagggttacaaggtgttggtgctcaacc

SEQ ID NO: 112847 - DNA, 75 bp, Artificial Sequence
  Synthetic
aaagggcccagtgtgacagatgtacaccaatgttgaccaggaattggtaggatggccggctcccccgggcgccag

SEQ ID NO: 112848 - DNA, 75 bp, Artificial Sequence
  Synthetic
aaagggcccagtgtgacagatgtacaccaatgttgaccaggaattggttggatggccggctcccccgggcgccag

SEQ ID NO: 112849 - DNA, 75 bp, Artificial Sequence
  Synthetic
aaagggcccagtgtgacagatgtacaccaatgttgaccaggaattggtcggatggccggctcccccgggcgccag

SEQ ID NO: 112850 - DNA, 75 bp, Artificial Sequence
  Synthetic
aaagggcccagtgtgacagatgtacaccaatgttgaccaggaattggtgggatggccggctcccccgggcgccag

SEQ ID NO: 112851 - DNA, 75 bp, Artificial Sequence
  Synthetic
aaagggcccagtgtgacagatgtacaccaatgttgaccaggatttggtaggatggccggctcccccgggcgccag

SEQ ID NO: 112852 - DNA, 75 bp, Artificial Sequence
  Synthetic
aaagggcccagtgtgacagatgtacaccaatgttgaccaggatttggttggatggccggctcccccgggcgccag

SEQ ID NO: 112853 - DNA, 75 bp, Artificial Sequence
  Synthetic
aaagggcccagtgtgacagatgtacaccaatgttgaccaggatttggtcggatggccggctcccccgggcgccag

SEQ ID NO: 112854 - DNA, 75 bp, Artificial Sequence
  Synthetic
aaagggcccagtgtgacagatgtacaccaatgttgaccaggatttggtgggatggccggctcccccgggcgccag

SEQ ID NO: 112855 - DNA, 75 bp, Artificial Sequence
  Synthetic
aaagggcccagtgtgacagatgtacaccaatgttgaccaggacttggtaggatggccggctcccccgggcgccag

SEQ ID NO: 112856 - DNA, 75 bp, Artificial Sequence
  Synthetic
aaagggcccagtgtgacagatgtacaccaatgttgaccaggacttggttggatggccggctcccccgggcgccag

SEQ ID NO: 112857 - DNA, 75 bp, Artificial Sequence
  Synthetic
aaagggcccagtgtgacagatgtacaccaatgttgaccaggacttggtcggatggccggctcccccgggcgccag

SEQ ID NO: 112858 - DNA, 75 bp, Artificial Sequence
  Synthetic
aaagggcccagtgtgacagatgtacaccaatgttgaccaggacttggtgggatggccggctcccccgggcgccag

SEQ ID NO: 112859 - DNA, 75 bp, Artificial Sequence
  Synthetic
aaagggcccagtgtgacagatgtacaccaatgttgaccaggagttggtaggatggccggctcccccgggcgccag

SEQ ID NO: 112860 - DNA, 75 bp, Artificial Sequence
  Synthetic
aaagggcccagtgtgacagatgtacaccaatgttgaccaggagttggttggatggccggctcccccgggcgccag

SEQ ID NO: 112861 - DNA, 75 bp, Artificial Sequence
  Synthetic
aaagggcccagtgtgacagatgtacaccaatgttgaccaggagttggtcggatggccggctcccccgggcgccag

SEQ ID NO: 112862 - DNA, 75 bp, Artificial Sequence
  Synthetic
aaagggcccagtgtgacagatgtacaccaatgttgaccaggagttggtgggatggccggctcccccgggcgccag

SEQ ID NO: 112863 - DNA, 75 bp, Artificial Sequence
  Synthetic
aaagggcccagtgtgtcagatgtacaccaatgttgaccaggaattggtaggatggccggctcccccgggcgccag

SEQ ID NO: 112864 - DNA, 75 bp, Artificial Sequence
  Synthetic
aaagggcccagtgtgtcagatgtacaccaatgttgaccaggaattggttggatggccggctcccccgggcgccag

SEQ ID NO: 112865 - DNA, 75 bp, Artificial Sequence
  Synthetic
aaagggcccagtgtgtcagatgtacaccaatgttgaccaggaattggtcggatggccggctcccccgggcgccag

SEQ ID NO: 112866 - DNA, 75 bp, Artificial Sequence
  Synthetic
aaagggcccagtgtgtcagatgtacaccaatgttgaccaggaattggtgggatggccggctcccccgggcgccag

SEQ ID NO: 112867 - DNA, 75 bp, Artificial Sequence
  Synthetic
aaagggcccagtgtgtcagatgtacaccaatgttgaccaggatttggtaggatggccggctcccccgggcgccag

SEQ ID NO: 112868 - DNA, 75 bp, Artificial Sequence
  Synthetic
aaagggcccagtgtgtcagatgtacaccaatgttgaccaggatttggttggatggccggctcccccgggcgccag

SEQ ID NO: 112869 - DNA, 75 bp, Artificial Sequence
  Synthetic
aaagggcccagtgtgtcagatgtacaccaatgttgaccaggatttggtcggatggccggctcccccgggcgccag

SEQ ID NO: 112870 - DNA, 75 bp, Artificial Sequence
  Synthetic
aaagggcccagtgtgtcagatgtacaccaatgttgaccaggatttggtgggatggccggctcccccgggcgccag

SEQ ID NO: 112871 - DNA, 75 bp, Artificial Sequence
  Synthetic
aaagggcccagtgtgtcagatgtacaccaatgttgaccaggacttggtaggatggccggctcccccgggcgccag

SEQ ID NO: 112872 - DNA, 75 bp, Artificial Sequence
  Synthetic
aaagggcccagtgtgtcagatgtacaccaatgttgaccaggacttggttggatggccggctcccccgggcgccag

SEQ ID NO: 112873 - DNA, 75 bp, Artificial Sequence
  Synthetic
aaagggcccagtgtgtcagatgtacaccaatgttgaccaggacttggtcggatggccggctcccccgggcgccag

SEQ ID NO: 112874 - DNA, 75 bp, Artificial Sequence
  Synthetic
aaagggcccagtgtgtcagatgtacaccaatgttgaccaggacttggtgggatggccggctcccccgggcgccag

SEQ ID NO: 112875 - DNA, 75 bp, Artificial Sequence
  Synthetic
aaagggcccagtgtgtcagatgtacaccaatgttgaccaggagttggtaggatggccggctcccccgggcgccag

SEQ ID NO: 112876 - DNA, 75 bp, Artificial Sequence
  Synthetic
aaagggcccagtgtgtcagatgtacaccaatgttgaccaggagttggttggatggccggctcccccgggcgccag

SEQ ID NO: 112877 - DNA, 75 bp, Artificial Sequence
  Synthetic
aaagggcccagtgtgtcagatgtacaccaatgttgaccaggagttggtcggatggccggctcccccgggcgccag

SEQ ID NO: 112878 - DNA, 75 bp, Artificial Sequence
  Synthetic
aaagggcccagtgtgtcagatgtacaccaatgttgaccaggagttggtgggatggccggctcccccgggcgccag

SEQ ID NO: 112879 - DNA, 75 bp, Artificial Sequence
  Synthetic
aaagggcccagtgtgccagatgtacaccaatgttgaccaggaattggtaggatggccggctcccccgggcgccag

SEQ ID NO: 112880 - DNA, 75 bp, Artificial Sequence
  Synthetic
aaagggcccagtgtgccagatgtacaccaatgttgaccaggaattggttggatggccggctcccccgggcgccag

SEQ ID NO: 112881 - DNA, 75 bp, Artificial Sequence
  Synthetic
aaagggcccagtgtgccagatgtacaccaatgttgaccaggaattggtcggatggccggctcccccgggcgccag

SEQ ID NO: 112882 - DNA, 75 bp, Artificial Sequence
  Synthetic
aaagggcccagtgtgccagatgtacaccaatgttgaccaggaattggtgggatggccggctcccccgggcgccag

SEQ ID NO: 112883 - DNA, 75 bp, Artificial Sequence
  Synthetic
aaagggcccagtgtgccagatgtacaccaatgttgaccaggatttggtaggatggccggctcccccgggcgccag

SEQ ID NO: 112884 - DNA, 75 bp, Artificial Sequence
  Synthetic
aaagggcccagtgtgccagatgtacaccaatgttgaccaggatttggttggatggccggctcccccgggcgccag

SEQ ID NO: 112885 - DNA, 75 bp, Artificial Sequence
  Synthetic
aaagggcccagtgtgccagatgtacaccaatgttgaccaggatttggtcggatggccggctcccccgggcgccag

SEQ ID NO: 112886 - DNA, 75 bp, Artificial Sequence
  Synthetic
aaagggcccagtgtgccagatgtacaccaatgttgaccaggatttggtgggatggccggctcccccgggcgccag

SEQ ID NO: 112887 - DNA, 75 bp, Artificial Sequence
  Synthetic
aaagggcccagtgtgccagatgtacaccaatgttgaccaggacttggtaggatggccggctcccccgggcgccag

SEQ ID NO: 112888 - DNA, 75 bp, Artificial Sequence
  Synthetic
aaagggcccagtgtgccagatgtacaccaatgttgaccaggacttggttggatggccggctcccccgggcgccag

SEQ ID NO: 112889 - DNA, 75 bp, Artificial Sequence
  Synthetic
aaagggcccagtgtgccagatgtacaccaatgttgaccaggacttggtcggatggccggctcccccgggcgccag

SEQ ID NO: 112890 - DNA, 75 bp, Artificial Sequence
  Synthetic
aaagggcccagtgtgccagatgtacaccaatgttgaccaggacttggtgggatggccggctcccccgggcgccag

SEQ ID NO: 112891 - DNA, 75 bp, Artificial Sequence
  Synthetic
aaagggcccagtgtgccagatgtacaccaatgttgaccaggagttggtaggatggccggctcccccgggcgccag

SEQ ID NO: 112892 - DNA, 75 bp, Artificial Sequence
  Synthetic
aaagggcccagtgtgccagatgtacaccaatgttgaccaggagttggttggatggccggctcccccgggcgccag

SEQ ID NO: 112893 - DNA, 75 bp, Artificial Sequence
  Synthetic
aaagggcccagtgtgccagatgtacaccaatgttgaccaggagttggtcggatggccggctcccccgggcgccag

SEQ ID NO: 112894 - DNA, 75 bp, Artificial Sequence
  Synthetic
aaagggcccagtgtgccagatgtacaccaatgttgaccaggagttggtgggatggccggctcccccgggcgccag

SEQ ID NO: 112895 - DNA, 75 bp, Artificial Sequence
  Synthetic
aaagggcccagtgtggcagatgtacaccaatgttgaccaggaattggtaggatggccggctcccccgggcgccag

SEQ ID NO: 112896 - DNA, 75 bp, Artificial Sequence
  Synthetic
aaagggcccagtgtggcagatgtacaccaatgttgaccaggaattggttggatggccggctcccccgggcgccag

SEQ ID NO: 112897 - DNA, 75 bp, Artificial Sequence
  Synthetic
aaagggcccagtgtggcagatgtacaccaatgttgaccaggaattggtcggatggccggctcccccgggcgccag

SEQ ID NO: 112898 - DNA, 75 bp, Artificial Sequence
  Synthetic
aaagggcccagtgtggcagatgtacaccaatgttgaccaggaattggtgggatggccggctcccccgggcgccag

SEQ ID NO: 112899 - DNA, 75 bp, Artificial Sequence
  Synthetic
aaagggcccagtgtggcagatgtacaccaatgttgaccaggatttggtaggatggccggctcccccgggcgccag

SEQ ID NO: 112900 - DNA, 75 bp, Artificial Sequence
  Synthetic
aaagggcccagtgtggcagatgtacaccaatgttgaccaggatttggttggatggccggctcccccgggcgccag

SEQ ID NO: 112901 - DNA, 75 bp, Artificial Sequence
  Synthetic
aaagggcccagtgtggcagatgtacaccaatgttgaccaggatttggtcggatggccggctcccccgggcgccag

SEQ ID NO: 112902 - DNA, 75 bp, Artificial Sequence
  Synthetic
aaagggcccagtgtggcagatgtacaccaatgttgaccaggatttggtgggatggccggctcccccgggcgccag

SEQ ID NO: 112903 - DNA, 75 bp, Artificial Sequence
  Synthetic
aaagggcccagtgtggcagatgtacaccaatgttgaccaggacttggtaggatggccggctcccccgggcgccag

SEQ ID NO: 112904 - DNA, 75 bp, Artificial Sequence
  Synthetic
aaagggcccagtgtggcagatgtacaccaatgttgaccaggacttggttggatggccggctcccccgggcgccag

SEQ ID NO: 112905 - DNA, 75 bp, Artificial Sequence
  Synthetic
aaagggcccagtgtggcagatgtacaccaatgttgaccaggacttggtcggatggccggctcccccgggcgccag

SEQ ID NO: 112906 - DNA, 75 bp, Artificial Sequence
  Synthetic
aaagggcccagtgtggcagatgtacaccaatgttgaccaggacttggtgggatggccggctcccccgggcgccag

SEQ ID NO: 112907 - DNA, 75 bp, Artificial Sequence
  Synthetic
aaagggcccagtgtggcagatgtacaccaatgttgaccaggagttggtaggatggccggctcccccgggcgccag

SEQ ID NO: 112908 - DNA, 75 bp, Artificial Sequence
  Synthetic
aaagggcccagtgtggcagatgtacaccaatgttgaccaggagttggttggatggccggctcccccgggcgccag

SEQ ID NO: 112909 - DNA, 75 bp, Artificial Sequence
  Synthetic
aaagggcccagtgtggcagatgtacaccaatgttgaccaggagttggtcggatggccggctcccccgggcgccag

SEQ ID NO: 112910 - DNA, 75 bp, Artificial Sequence
  Synthetic
aaagggcccagtgtggcagatgtacaccaatgttgaccaggagttggtgggatggccggctcccccgggcgccag

SEQ ID NO: 112911 - DNA, 75 bp, Artificial Sequence
  Synthetic
gtctctgacaccatgcacgtgtggagctagagatctctacttgataacccggaatgccgatgtcatccctgctag

SEQ ID NO: 112912 - DNA, 75 bp, Artificial Sequence
  Synthetic
gtctctgacaccatgcacgtgtggagctagtgatctctacttgataacccggaatgccgatgtcatccctgctag

SEQ ID NO: 112913 - DNA, 75 bp, Artificial Sequence
  Synthetic
gtctctgacaccatgcacgtgtggagctagcgatctctacttgataacccggaatgccgatgtcatccctgctag

SEQ ID NO: 112914 - DNA, 75 bp, Artificial Sequence
  Synthetic
gtctctgacaccatgcacgtgtggagctagggatctctacttgataacccggaatgccgatgtcatccctgctag

SEQ ID NO: 112915 - DNA, 75 bp, Artificial Sequence
  Synthetic
gtctctgacaccatgcacgtgtggtgctagagatctctacttgataacccggaatgccgatgtcatccctgctag

SEQ ID NO: 112916 - DNA, 75 bp, Artificial Sequence
  Synthetic
gtctctgacaccatgcacgtgtggtgctagtgatctctacttgataacccggaatgccgatgtcatccctgctag

SEQ ID NO: 112917 - DNA, 75 bp, Artificial Sequence
  Synthetic
gtctctgacaccatgcacgtgtggtgctagcgatctctacttgataacccggaatgccgatgtcatccctgctag

SEQ ID NO: 112918 - DNA, 75 bp, Artificial Sequence
  Synthetic
gtctctgacaccatgcacgtgtggtgctagggatctctacttgataacccggaatgccgatgtcatccctgctag

SEQ ID NO: 112919 - DNA, 75 bp, Artificial Sequence
  Synthetic
gtctctgacaccatgcacgtgtggcgctagagatctctacttgataacccggaatgccgatgtcatccctgctag

SEQ ID NO: 112920 - DNA, 75 bp, Artificial Sequence
  Synthetic
gtctctgacaccatgcacgtgtggcgctagtgatctctacttgataacccggaatgccgatgtcatccctgctag

SEQ ID NO: 112921 - DNA, 75 bp, Artificial Sequence
  Synthetic
gtctctgacaccatgcacgtgtggcgctagcgatctctacttgataacccggaatgccgatgtcatccctgctag

SEQ ID NO: 112922 - DNA, 75 bp, Artificial Sequence
  Synthetic
gtctctgacaccatgcacgtgtggcgctagggatctctacttgataacccggaatgccgatgtcatccctgctag

SEQ ID NO: 112923 - DNA, 75 bp, Artificial Sequence
  Synthetic
gtctctgacaccatgcacgtgtggggctagagatctctacttgataacccggaatgccgatgtcatccctgctag

SEQ ID NO: 112924 - DNA, 75 bp, Artificial Sequence
  Synthetic
gtctctgacaccatgcacgtgtggggctagtgatctctacttgataacccggaatgccgatgtcatccctgctag

SEQ ID NO: 112925 - DNA, 75 bp, Artificial Sequence
  Synthetic
gtctctgacaccatgcacgtgtggggctagcgatctctacttgataacccggaatgccgatgtcatccctgctag

SEQ ID NO: 112926 - DNA, 75 bp, Artificial Sequence
  Synthetic
gtctctgacaccatgcacgtgtggggctagggatctctacttgataacccggaatgccgatgtcatccctgctag

SEQ ID NO: 112927 - DNA, 75 bp, Artificial Sequence
  Synthetic
gtctctgactccatgcacgtgtggagctagagatctctacttgataacccggaatgccgatgtcatccctgctag

SEQ ID NO: 112928 - DNA, 75 bp, Artificial Sequence
  Synthetic
gtctctgactccatgcacgtgtggagctagtgatctctacttgataacccggaatgccgatgtcatccctgctag

SEQ ID NO: 112929 - DNA, 75 bp, Artificial Sequence
  Synthetic
gtctctgactccatgcacgtgtggagctagcgatctctacttgataacccggaatgccgatgtcatccctgctag

SEQ ID NO: 112930 - DNA, 75 bp, Artificial Sequence
  Synthetic
gtctctgactccatgcacgtgtggagctagggatctctacttgataacccggaatgccgatgtcatccctgctag

SEQ ID NO: 112931 - DNA, 75 bp, Artificial Sequence
  Synthetic
gtctctgactccatgcacgtgtggtgctagagatctctacttgataacccggaatgccgatgtcatccctgctag

SEQ ID NO: 112932 - DNA, 75 bp, Artificial Sequence
  Synthetic
gtctctgactccatgcacgtgtggtgctagtgatctctacttgataacccggaatgccgatgtcatccctgctag

SEQ ID NO: 112933 - DNA, 75 bp, Artificial Sequence
  Synthetic
gtctctgactccatgcacgtgtggtgctagcgatctctacttgataacccggaatgccgatgtcatccctgctag

SEQ ID NO: 112934 - DNA, 75 bp, Artificial Sequence
  Synthetic
gtctctgactccatgcacgtgtggtgctagggatctctacttgataacccggaatgccgatgtcatccctgctag

SEQ ID NO: 112935 - DNA, 75 bp, Artificial Sequence
  Synthetic
gtctctgactccatgcacgtgtggcgctagagatctctacttgataacccggaatgccgatgtcatccctgctag

SEQ ID NO: 112936 - DNA, 75 bp, Artificial Sequence
  Synthetic
gtctctgactccatgcacgtgtggcgctagtgatctctacttgataacccggaatgccgatgtcatccctgctag

SEQ ID NO: 112937 - DNA, 75 bp, Artificial Sequence
  Synthetic
gtctctgactccatgcacgtgtggcgctagcgatctctacttgataacccggaatgccgatgtcatccctgctag

SEQ ID NO: 112938 - DNA, 75 bp, Artificial Sequence
  Synthetic
gtctctgactccatgcacgtgtggcgctagggatctctacttgataacccggaatgccgatgtcatccctgctag

SEQ ID NO: 112939 - DNA, 75 bp, Artificial Sequence
  Synthetic
gtctctgactccatgcacgtgtggggctagagatctctacttgataacccggaatgccgatgtcatccctgctag

SEQ ID NO: 112940 - DNA, 75 bp, Artificial Sequence
  Synthetic
gtctctgactccatgcacgtgtggggctagtgatctctacttgataacccggaatgccgatgtcatccctgctag

SEQ ID NO: 112941 - DNA, 75 bp, Artificial Sequence
  Synthetic
gtctctgactccatgcacgtgtggggctagcgatctctacttgataacccggaatgccgatgtcatccctgctag

SEQ ID NO: 112942 - DNA, 75 bp, Artificial Sequence
  Synthetic
gtctctgactccatgcacgtgtggggctagggatctctacttgataacccggaatgccgatgtcatccctgctag

SEQ ID NO: 112943 - DNA, 75 bp, Artificial Sequence
  Synthetic
gtctctgaccccatgcacgtgtggagctagagatctctacttgataacccggaatgccgatgtcatccctgctag

SEQ ID NO: 112944 - DNA, 75 bp, Artificial Sequence
  Synthetic
gtctctgaccccatgcacgtgtggagctagtgatctctacttgataacccggaatgccgatgtcatccctgctag

SEQ ID NO: 112945 - DNA, 75 bp, Artificial Sequence
  Synthetic
gtctctgaccccatgcacgtgtggagctagcgatctctacttgataacccggaatgccgatgtcatccctgctag

SEQ ID NO: 112946 - DNA, 75 bp, Artificial Sequence
  Synthetic
gtctctgaccccatgcacgtgtggagctagggatctctacttgataacccggaatgccgatgtcatccctgctag

SEQ ID NO: 112947 - DNA, 75 bp, Artificial Sequence
  Synthetic
gtctctgaccccatgcacgtgtggtgctagagatctctacttgataacccggaatgccgatgtcatccctgctag

SEQ ID NO: 112948 - DNA, 75 bp, Artificial Sequence
  Synthetic
gtctctgaccccatgcacgtgtggtgctagtgatctctacttgataacccggaatgccgatgtcatccctgctag

SEQ ID NO: 112949 - DNA, 75 bp, Artificial Sequence
  Synthetic
gtctctgaccccatgcacgtgtggtgctagcgatctctacttgataacccggaatgccgatgtcatccctgctag

SEQ ID NO: 112950 - DNA, 75 bp, Artificial Sequence
  Synthetic
gtctctgaccccatgcacgtgtggtgctagggatctctacttgataacccggaatgccgatgtcatccctgctag

SEQ ID NO: 112951 - DNA, 75 bp, Artificial Sequence
  Synthetic
gtctctgaccccatgcacgtgtggcgctagagatctctacttgataacccggaatgccgatgtcatccctgctag

SEQ ID NO: 112952 - DNA, 75 bp, Artificial Sequence
  Synthetic
gtctctgaccccatgcacgtgtggcgctagtgatctctacttgataacccggaatgccgatgtcatccctgctag

SEQ ID NO: 112953 - DNA, 75 bp, Artificial Sequence
  Synthetic
gtctctgaccccatgcacgtgtggcgctagcgatctctacttgataacccggaatgccgatgtcatccctgctag

SEQ ID NO: 112954 - DNA, 75 bp, Artificial Sequence
  Synthetic
gtctctgaccccatgcacgtgtggcgctagggatctctacttgataacccggaatgccgatgtcatccctgctag

SEQ ID NO: 112955 - DNA, 75 bp, Artificial Sequence
  Synthetic
gtctctgaccccatgcacgtgtggggctagagatctctacttgataacccggaatgccgatgtcatccctgctag

SEQ ID NO: 112956 - DNA, 75 bp, Artificial Sequence
  Synthetic
gtctctgaccccatgcacgtgtggggctagtgatctctacttgataacccggaatgccgatgtcatccctgctag

SEQ ID NO: 112957 - DNA, 75 bp, Artificial Sequence
  Synthetic
gtctctgaccccatgcacgtgtggggctagcgatctctacttgataacccggaatgccgatgtcatccctgctag

SEQ ID NO: 112958 - DNA, 75 bp, Artificial Sequence
  Synthetic
gtctctgaccccatgcacgtgtggggctagggatctctacttgataacccggaatgccgatgtcatccctgctag

SEQ ID NO: 112959 - DNA, 75 bp, Artificial Sequence
  Synthetic
gtctctgacgccatgcacgtgtggagctagagatctctacttgataacccggaatgccgatgtcatccctgctag

SEQ ID NO: 112960 - DNA, 75 bp, Artificial Sequence
  Synthetic
gtctctgacgccatgcacgtgtggagctagtgatctctacttgataacccggaatgccgatgtcatccctgctag

SEQ ID NO: 112961 - DNA, 75 bp, Artificial Sequence
  Synthetic
gtctctgacgccatgcacgtgtggagctagcgatctctacttgataacccggaatgccgatgtcatccctgctag

SEQ ID NO: 112962 - DNA, 75 bp, Artificial Sequence
  Synthetic
gtctctgacgccatgcacgtgtggagctagggatctctacttgataacccggaatgccgatgtcatccctgctag

SEQ ID NO: 112963 - DNA, 75 bp, Artificial Sequence
  Synthetic
gtctctgacgccatgcacgtgtggtgctagagatctctacttgataacccggaatgccgatgtcatccctgctag

SEQ ID NO: 112964 - DNA, 75 bp, Artificial Sequence
  Synthetic
gtctctgacgccatgcacgtgtggtgctagtgatctctacttgataacccggaatgccgatgtcatccctgctag

SEQ ID NO: 112965 - DNA, 75 bp, Artificial Sequence
  Synthetic
gtctctgacgccatgcacgtgtggtgctagcgatctctacttgataacccggaatgccgatgtcatccctgctag

SEQ ID NO: 112966 - DNA, 75 bp, Artificial Sequence
  Synthetic
gtctctgacgccatgcacgtgtggtgctagggatctctacttgataacccggaatgccgatgtcatccctgctag

SEQ ID NO: 112967 - DNA, 75 bp, Artificial Sequence
  Synthetic
gtctctgacgccatgcacgtgtggcgctagagatctctacttgataacccggaatgccgatgtcatccctgctag

SEQ ID NO: 112968 - DNA, 75 bp, Artificial Sequence
  Synthetic
gtctctgacgccatgcacgtgtggcgctagtgatctctacttgataacccggaatgccgatgtcatccctgctag

SEQ ID NO: 112969 - DNA, 75 bp, Artificial Sequence
  Synthetic
gtctctgacgccatgcacgtgtggcgctagcgatctctacttgataacccggaatgccgatgtcatccctgctag

SEQ ID NO: 112970 - DNA, 75 bp, Artificial Sequence
  Synthetic
gtctctgacgccatgcacgtgtggcgctagggatctctacttgataacccggaatgccgatgtcatccctgctag

SEQ ID NO: 112971 - DNA, 75 bp, Artificial Sequence
  Synthetic
gtctctgacgccatgcacgtgtggggctagagatctctacttgataacccggaatgccgatgtcatccctgctag

SEQ ID NO: 112972 - DNA, 75 bp, Artificial Sequence
  Synthetic
gtctctgacgccatgcacgtgtggggctagtgatctctacttgataacccggaatgccgatgtcatccctgctag

SEQ ID NO: 112973 - DNA, 75 bp, Artificial Sequence
  Synthetic
gtctctgacgccatgcacgtgtggggctagcgatctctacttgataacccggaatgccgatgtcatccctgctag

SEQ ID NO: 112974 - DNA, 75 bp, Artificial Sequence
  Synthetic
gtctctgacgccatgcacgtgtggggctagggatctctacttgataacccggaatgccgatgtcatccctgctag

SEQ ID NO: 112975 - DNA, 75 bp, Artificial Sequence
  Synthetic
gggcgagaatgagacagacgtgttcctgctgaatccctgcggcctcctagtggtcggtggtttgggtggcacgtg

SEQ ID NO: 112976 - DNA, 75 bp, Artificial Sequence
  Synthetic
ccctatcacgtactccacttatggcaagtttttggctgacgggggatgctccgggggggcatatgatatcatcat

SEQ ID NO: 112977 - DNA, 75 bp, Artificial Sequence
  Synthetic
atggactggggcgcttgtgacaccttgtgcggctgaagaatcaaagctgccaattagccccctgagcaattcact

SEQ ID NO: 112978 - DNA, 75 bp, Artificial Sequence
  Synthetic
gtcggactattccgcgccgccgtttgtaccaggggagttgccaaggcaatagactttgtgccagtagagaatatg

SEQ ID NO: 112979 - DNA, 75 bp, Artificial Sequence
  Synthetic
ccccaccgactgcttcaggaaacatcccgaggccacatacagccggtgcggctcggggccctggttgacacctcg

SEQ ID NO: 112980 - DNA, 75 bp, Artificial Sequence
  Synthetic
acggcaacaccccccgggtcggtcaccgttccccacccgaacatttcagaggtcgcgctgtccacaacgggggag

SEQ ID NO: 112981 - DNA, 75 bp, Artificial Sequence
  Synthetic
gcttccaggtggcccacctgcatgctcccaccggcagtggtaagagcaccaaggtcccggccgcatacgcggctc

SEQ ID NO: 112982 - DNA, 75 bp, Artificial Sequence
  Synthetic
ccctagaggtcatcaagggcggtagacatctgatcttttgccattcgaagaagaaatgtgatgagctagccaagc

SEQ ID NO: 112983 - DNA, 75 bp, Artificial Sequence
  Synthetic
ccagatcaaagtttggctatggggcgaaggatgttcgtagccattcccgcaaggccattaaccacatcaactccg

SEQ ID NO: 112984 - DNA, 75 bp, Artificial Sequence
  Synthetic
ggaagagcacgaaggtaccggcggcgtacgcctcacagggttacaaagtgcttgtgctcaatccatcggtggccg

SEQ ID NO: 112985 - DNA, 75 bp, Artificial Sequence
  Synthetic
ggaagagcacgaaggttccggcggcgtacgcctcacagggttacaaagtgcttgtgctcaatccatcggtggccg

SEQ ID NO: 112986 - DNA, 75 bp, Artificial Sequence
  Synthetic
ggaagagcacgaaggtcccggcggcgtacgcctcacagggttacaaagtgcttgtgctcaatccatcggtggccg

SEQ ID NO: 112987 - DNA, 75 bp, Artificial Sequence
  Synthetic
ggaagagcacgaaggtgccggcggcgtacgcctcacagggttacaaagtgcttgtgctcaatccatcggtggccg

SEQ ID NO: 112988 - DNA, 75 bp, Artificial Sequence
  Synthetic
gagcaaggcatatggggtggatcctaacattaggacaggtgtcaggactataacaacaggaggtcctattaccta

SEQ ID NO: 112989 - DNA, 75 bp, Artificial Sequence
  Synthetic
tctcatgactggctatacgggagacttcgactctgttatagactgcaatgttgcggtcacacaggtggtcgactt

SEQ ID NO: 112990 - DNA, 75 bp, Artificial Sequence
  Synthetic
tctcatgactggctatacgggtgacttcgactctgttatagactgcaatgttgcggtcacacaggtggtcgactt

SEQ ID NO: 112991 - DNA, 75 bp, Artificial Sequence
  Synthetic
tctcatgactggctatacgggcgacttcgactctgttatagactgcaatgttgcggtcacacaggtggtcgactt

SEQ ID NO: 112992 - DNA, 75 bp, Artificial Sequence
  Synthetic
tctcatgactggctatacgggggacttcgactctgttatagactgcaatgttgcggtcacacaggtggtcgactt

SEQ ID NO: 112993 - DNA, 75 bp, Artificial Sequence
  Synthetic
cctggcgacctgcatcaacggcgtgtgttggactgtctaccatggtgccggctccaagaccctagccggcccaaa

SEQ ID NO: 112994 - DNA, 75 bp, Artificial Sequence
  Synthetic
catccccatcgagaccatcaagggggggaggcatctcatcttctgccattccaagaagaagtgtgatgagctcgc

SEQ ID NO: 112995 - DNA, 75 bp, Artificial Sequence
  Synthetic
atatataggtatgtctcgcaaggggaacgaccgtctgggatgttcgacagcgtcgtcctctgcgaggcttatgac

SEQ ID NO: 112996 - DNA, 75 bp, Artificial Sequence
  Synthetic
gccgtggcttactaccgcggccttgacgtgtcggtcatcccgaccagtggcgatgttgtcgtcgtggcaactgat

SEQ ID NO: 112997 - DNA, 75 bp, Artificial Sequence
  Synthetic
tcggtctcaacgccgttgcgttctatagaggagtcgatgtggcagtaatccccacccaaggggatgtagtcatct

SEQ ID NO: 112998 - DNA, 75 bp, Artificial Sequence
  Synthetic
tcggtctcaacgccgttgcgttctatagaggagtcgatgtggcagtaatccccacccaaggggatgttgtcatct

SEQ ID NO: 112999 - DNA, 75 bp, Artificial Sequence
  Synthetic
tcggtctcaacgccgttgcgttctatagaggagtcgatgtggcagtaatccccacccaaggggatgtcgtcatct

SEQ ID NO: 113000 - DNA, 75 bp, Artificial Sequence
  Synthetic
tcggtctcaacgccgttgcgttctatagaggagtcgatgtggcagtaatccccacccaaggggatgtggtcatct

SEQ ID NO: 113001 - DNA, 75 bp, Artificial Sequence
  Synthetic
tcggtctcaacgccgttgcgttctatagaggagtcgatgtggcagtaatccccacccatggggatgtagtcatct

SEQ ID NO: 113002 - DNA, 75 bp, Artificial Sequence
  Synthetic
tcggtctcaacgccgttgcgttctatagaggagtcgatgtggcagtaatccccacccatggggatgttgtcatct

SEQ ID NO: 113003 - DNA, 75 bp, Artificial Sequence
  Synthetic
tcggtctcaacgccgttgcgttctatagaggagtcgatgtggcagtaatccccacccatggggatgtcgtcatct

SEQ ID NO: 113004 - DNA, 75 bp, Artificial Sequence
  Synthetic
tcggtctcaacgccgttgcgttctatagaggagtcgatgtggcagtaatccccacccatggggatgtggtcatct

SEQ ID NO: 113005 - DNA, 75 bp, Artificial Sequence
  Synthetic
tcggtctcaacgccgttgcgttctatagaggagtcgatgtggcagtaatccccacccacggggatgtagtcatct

SEQ ID NO: 113006 - DNA, 75 bp, Artificial Sequence
  Synthetic
tcggtctcaacgccgttgcgttctatagaggagtcgatgtggcagtaatccccacccacggggatgttgtcatct

SEQ ID NO: 113007 - DNA, 75 bp, Artificial Sequence
  Synthetic
tcggtctcaacgccgttgcgttctatagaggagtcgatgtggcagtaatccccacccacggggatgtcgtcatct

SEQ ID NO: 113008 - DNA, 75 bp, Artificial Sequence
  Synthetic
tcggtctcaacgccgttgcgttctatagaggagtcgatgtggcagtaatccccacccacggggatgtggtcatct

SEQ ID NO: 113009 - DNA, 75 bp, Artificial Sequence
  Synthetic
tcggtctcaacgccgttgcgttctatagaggagtcgatgtggcagtaatccccacccagggggatgtagtcatct

SEQ ID NO: 113010 - DNA, 75 bp, Artificial Sequence
  Synthetic
tcggtctcaacgccgttgcgttctatagaggagtcgatgtggcagtaatccccacccagggggatgttgtcatct

SEQ ID NO: 113011 - DNA, 75 bp, Artificial Sequence
  Synthetic
tcggtctcaacgccgttgcgttctatagaggagtcgatgtggcagtaatccccacccagggggatgtcgtcatct

SEQ ID NO: 113012 - DNA, 75 bp, Artificial Sequence
  Synthetic
tcggtctcaacgccgttgcgttctatagaggagtcgatgtggcagtaatccccacccagggggatgtggtcatct

SEQ ID NO: 113013 - DNA, 75 bp, Artificial Sequence
  Synthetic
tcggtctcaacgccgttgcgttctatagaggtgtcgatgtggcagtaatccccacccaaggggatgtagtcatct

SEQ ID NO: 113014 - DNA, 75 bp, Artificial Sequence
  Synthetic
tcggtctcaacgccgttgcgttctatagaggtgtcgatgtggcagtaatccccacccaaggggatgttgtcatct

SEQ ID NO: 113015 - DNA, 75 bp, Artificial Sequence
  Synthetic
tcggtctcaacgccgttgcgttctatagaggtgtcgatgtggcagtaatccccacccaaggggatgtcgtcatct

SEQ ID NO: 113016 - DNA, 75 bp, Artificial Sequence
  Synthetic
tcggtctcaacgccgttgcgttctatagaggtgtcgatgtggcagtaatccccacccaaggggatgtggtcatct

SEQ ID NO: 113017 - DNA, 75 bp, Artificial Sequence
  Synthetic
tcggtctcaacgccgttgcgttctatagaggtgtcgatgtggcagtaatccccacccatggggatgtagtcatct

SEQ ID NO: 113018 - DNA, 75 bp, Artificial Sequence
  Synthetic
tcggtctcaacgccgttgcgttctatagaggtgtcgatgtggcagtaatccccacccatggggatgttgtcatct

SEQ ID NO: 113019 - DNA, 75 bp, Artificial Sequence
  Synthetic
tcggtctcaacgccgttgcgttctatagaggtgtcgatgtggcagtaatccccacccatggggatgtcgtcatct

SEQ ID NO: 113020 - DNA, 75 bp, Artificial Sequence
  Synthetic
tcggtctcaacgccgttgcgttctatagaggtgtcgatgtggcagtaatccccacccatggggatgtggtcatct

SEQ ID NO: 113021 - DNA, 75 bp, Artificial Sequence
  Synthetic
tcggtctcaacgccgttgcgttctatagaggtgtcgatgtggcagtaatccccacccacggggatgtagtcatct

SEQ ID NO: 113022 - DNA, 75 bp, Artificial Sequence
  Synthetic
tcggtctcaacgccgttgcgttctatagaggtgtcgatgtggcagtaatccccacccacggggatgttgtcatct

SEQ ID NO: 113023 - DNA, 75 bp, Artificial Sequence
  Synthetic
tcggtctcaacgccgttgcgttctatagaggtgtcgatgtggcagtaatccccacccacggggatgtcgtcatct

SEQ ID NO: 113024 - DNA, 75 bp, Artificial Sequence
  Synthetic
tcggtctcaacgccgttgcgttctatagaggtgtcgatgtggcagtaatccccacccacggggatgtggtcatct

SEQ ID NO: 113025 - DNA, 75 bp, Artificial Sequence
  Synthetic
tcggtctcaacgccgttgcgttctatagaggtgtcgatgtggcagtaatccccacccagggggatgtagtcatct

SEQ ID NO: 113026 - DNA, 75 bp, Artificial Sequence
  Synthetic
tcggtctcaacgccgttgcgttctatagaggtgtcgatgtggcagtaatccccacccagggggatgttgtcatct

SEQ ID NO: 113027 - DNA, 75 bp, Artificial Sequence
  Synthetic
tcggtctcaacgccgttgcgttctatagaggtgtcgatgtggcagtaatccccacccagggggatgtcgtcatct

SEQ ID NO: 113028 - DNA, 75 bp, Artificial Sequence
  Synthetic
tcggtctcaacgccgttgcgttctatagaggtgtcgatgtggcagtaatccccacccagggggatgtggtcatct

SEQ ID NO: 113029 - DNA, 75 bp, Artificial Sequence
  Synthetic
tcggtctcaacgccgttgcgttctatagaggcgtcgatgtggcagtaatccccacccaaggggatgtagtcatct

SEQ ID NO: 113030 - DNA, 75 bp, Artificial Sequence
  Synthetic
tcggtctcaacgccgttgcgttctatagaggcgtcgatgtggcagtaatccccacccaaggggatgttgtcatct

SEQ ID NO: 113031 - DNA, 75 bp, Artificial Sequence
  Synthetic
tcggtctcaacgccgttgcgttctatagaggcgtcgatgtggcagtaatccccacccaaggggatgtcgtcatct

SEQ ID NO: 113032 - DNA, 75 bp, Artificial Sequence
  Synthetic
tcggtctcaacgccgttgcgttctatagaggcgtcgatgtggcagtaatccccacccaaggggatgtggtcatct

SEQ ID NO: 113033 - DNA, 75 bp, Artificial Sequence
  Synthetic
tcggtctcaacgccgttgcgttctatagaggcgtcgatgtggcagtaatccccacccatggggatgtagtcatct

SEQ ID NO: 113034 - DNA, 75 bp, Artificial Sequence
  Synthetic
tcggtctcaacgccgttgcgttctatagaggcgtcgatgtggcagtaatccccacccatggggatgttgtcatct

SEQ ID NO: 113035 - DNA, 75 bp, Artificial Sequence
  Synthetic
tcggtctcaacgccgttgcgttctatagaggcgtcgatgtggcagtaatccccacccatggggatgtcgtcatct

SEQ ID NO: 113036 - DNA, 75 bp, Artificial Sequence
  Synthetic
tcggtctcaacgccgttgcgttctatagaggcgtcgatgtggcagtaatccccacccatggggatgtggtcatct

SEQ ID NO: 113037 - DNA, 75 bp, Artificial Sequence
  Synthetic
tcggtctcaacgccgttgcgttctatagaggcgtcgatgtggcagtaatccccacccacggggatgtagtcatct

SEQ ID NO: 113038 - DNA, 75 bp, Artificial Sequence
  Synthetic
tcggtctcaacgccgttgcgttctatagaggcgtcgatgtggcagtaatccccacccacggggatgttgtcatct

SEQ ID NO: 113039 - DNA, 75 bp, Artificial Sequence
  Synthetic
tcggtctcaacgccgttgcgttctatagaggcgtcgatgtggcagtaatccccacccacggggatgtcgtcatct

SEQ ID NO: 113040 - DNA, 75 bp, Artificial Sequence
  Synthetic
tcggtctcaacgccgttgcgttctatagaggcgtcgatgtggcagtaatccccacccacggggatgtggtcatct

SEQ ID NO: 113041 - DNA, 75 bp, Artificial Sequence
  Synthetic
tcggtctcaacgccgttgcgttctatagaggcgtcgatgtggcagtaatccccacccagggggatgtagtcatct

SEQ ID NO: 113042 - DNA, 75 bp, Artificial Sequence
  Synthetic
tcggtctcaacgccgttgcgttctatagaggcgtcgatgtggcagtaatccccacccagggggatgttgtcatct

SEQ ID NO: 113043 - DNA, 75 bp, Artificial Sequence
  Synthetic
tcggtctcaacgccgttgcgttctatagaggcgtcgatgtggcagtaatccccacccagggggatgtcgtcatct

SEQ ID NO: 113044 - DNA, 75 bp, Artificial Sequence
  Synthetic
tcggtctcaacgccgttgcgttctatagaggcgtcgatgtggcagtaatccccacccagggggatgtggtcatct

SEQ ID NO: 113045 - DNA, 75 bp, Artificial Sequence
  Synthetic
tcggtctcaacgccgttgcgttctatagaggggtcgatgtggcagtaatccccacccaaggggatgtagtcatct

SEQ ID NO: 113046 - DNA, 75 bp, Artificial Sequence
  Synthetic
tcggtctcaacgccgttgcgttctatagaggggtcgatgtggcagtaatccccacccaaggggatgttgtcatct

SEQ ID NO: 113047 - DNA, 75 bp, Artificial Sequence
  Synthetic
tcggtctcaacgccgttgcgttctatagaggggtcgatgtggcagtaatccccacccaaggggatgtcgtcatct

SEQ ID NO: 113048 - DNA, 75 bp, Artificial Sequence
  Synthetic
tcggtctcaacgccgttgcgttctatagaggggtcgatgtggcagtaatccccacccaaggggatgtggtcatct

SEQ ID NO: 113049 - DNA, 75 bp, Artificial Sequence
  Synthetic
tcggtctcaacgccgttgcgttctatagaggggtcgatgtggcagtaatccccacccatggggatgtagtcatct

SEQ ID NO: 113050 - DNA, 75 bp, Artificial Sequence
  Synthetic
tcggtctcaacgccgttgcgttctatagaggggtcgatgtggcagtaatccccacccatggggatgttgtcatct

SEQ ID NO: 113051 - DNA, 75 bp, Artificial Sequence
  Synthetic
tcggtctcaacgccgttgcgttctatagaggggtcgatgtggcagtaatccccacccatggggatgtcgtcatct

SEQ ID NO: 113052 - DNA, 75 bp, Artificial Sequence
  Synthetic
tcggtctcaacgccgttgcgttctatagaggggtcgatgtggcagtaatccccacccatggggatgtggtcatct

SEQ ID NO: 113053 - DNA, 75 bp, Artificial Sequence
  Synthetic
tcggtctcaacgccgttgcgttctatagaggggtcgatgtggcagtaatccccacccacggggatgtagtcatct

SEQ ID NO: 113054 - DNA, 75 bp, Artificial Sequence
  Synthetic
tcggtctcaacgccgttgcgttctatagaggggtcgatgtggcagtaatccccacccacggggatgttgtcatct

SEQ ID NO: 113055 - DNA, 75 bp, Artificial Sequence
  Synthetic
tcggtctcaacgccgttgcgttctatagaggggtcgatgtggcagtaatccccacccacggggatgtcgtcatct

SEQ ID NO: 113056 - DNA, 75 bp, Artificial Sequence
  Synthetic
tcggtctcaacgccgttgcgttctatagaggggtcgatgtggcagtaatccccacccacggggatgtggtcatct

SEQ ID NO: 113057 - DNA, 75 bp, Artificial Sequence
  Synthetic
tcggtctcaacgccgttgcgttctatagaggggtcgatgtggcagtaatccccacccagggggatgtagtcatct

SEQ ID NO: 113058 - DNA, 75 bp, Artificial Sequence
  Synthetic
tcggtctcaacgccgttgcgttctatagaggggtcgatgtggcagtaatccccacccagggggatgttgtcatct

SEQ ID NO: 113059 - DNA, 75 bp, Artificial Sequence
  Synthetic
tcggtctcaacgccgttgcgttctatagaggggtcgatgtggcagtaatccccacccagggggatgtcgtcatct

SEQ ID NO: 113060 - DNA, 75 bp, Artificial Sequence
  Synthetic
tcggtctcaacgccgttgcgttctatagaggggtcgatgtggcagtaatccccacccagggggatgtggtcatct

SEQ ID NO: 113061 - DNA, 75 bp, Artificial Sequence
  Synthetic
aattttgggaaggagtttttaccgggcttactcatattgatgctcatttcctctctcggaccaagcaaggaggtg

SEQ ID NO: 113062 - DNA, 75 bp, Artificial Sequence
  Synthetic
ttcggaaacacactgacgtgctatctcaaagctacggccgcaattagggcggcggggctgagagactgcaccatg

SEQ ID NO: 113063 - DNA, 75 bp, Artificial Sequence
  Synthetic
ttcggaaacacactgacgtgctatctcaaagctacggccgctattagggcggcggggctgagagactgcaccatg

SEQ ID NO: 113064 - DNA, 75 bp, Artificial Sequence
  Synthetic
ttcggaaacacactgacgtgctatctcaaagctacggccgccattagggcggcggggctgagagactgcaccatg

SEQ ID NO: 113065 - DNA, 75 bp, Artificial Sequence
  Synthetic
ttcggaaacacactgacgtgctatctcaaagctacggccgcgattagggcggcggggctgagagactgcaccatg

SEQ ID NO: 113066 - DNA, 75 bp, Artificial Sequence
  Synthetic
accgcagacattccaagtggcccatctacacgctcccactggcagcggcaagagcactaaggtgccggctgcgta

SEQ ID NO: 113067 - DNA, 75 bp, Artificial Sequence
  Synthetic
caagcccatgcttacaggccccacccccttgttgtataggctaggggccgtacagaatgaggtcattaccaccca

SEQ ID NO: 113068 - DNA, 75 bp, Artificial Sequence
  Synthetic
agggaagccagggatataaagatacgtctcacaaggagagcgaccatctgggttatttgacaccgtcgtactctg

SEQ ID NO: 113069 - DNA, 75 bp, Artificial Sequence
  Synthetic
agggaagccagggatataaagatacgtctcacaaggagagcgaccatctgggttatttgactccgtcgtactctg

SEQ ID NO: 113070 - DNA, 75 bp, Artificial Sequence
  Synthetic
agggaagccagggatataaagatacgtctcacaaggagagcgaccatctgggttatttgaccccgtcgtactctg

SEQ ID NO: 113071 - DNA, 75 bp, Artificial Sequence
  Synthetic
agggaagccagggatataaagatacgtctcacaaggagagcgaccatctgggttatttgacgccgtcgtactctg

SEQ ID NO: 113072 - DNA, 75 bp, Artificial Sequence
  Synthetic
agggaagccagggatataaagatacgtctcacaaggagagcgaccttctgggttatttgacaccgtcgtactctg

SEQ ID NO: 113073 - DNA, 75 bp, Artificial Sequence
  Synthetic
agggaagccagggatataaagatacgtctcacaaggagagcgaccttctgggttatttgactccgtcgtactctg

SEQ ID NO: 113074 - DNA, 75 bp, Artificial Sequence
  Synthetic
agggaagccagggatataaagatacgtctcacaaggagagcgaccttctgggttatttgaccccgtcgtactctg

SEQ ID NO: 113075 - DNA, 75 bp, Artificial Sequence
  Synthetic
agggaagccagggatataaagatacgtctcacaaggagagcgaccttctgggttatttgacgccgtcgtactctg

SEQ ID NO: 113076 - DNA, 75 bp, Artificial Sequence
  Synthetic
agggaagccagggatataaagatacgtctcacaaggagagcgaccctctgggttatttgacaccgtcgtactctg

SEQ ID NO: 113077 - DNA, 75 bp, Artificial Sequence
  Synthetic
agggaagccagggatataaagatacgtctcacaaggagagcgaccctctgggttatttgactccgtcgtactctg

SEQ ID NO: 113078 - DNA, 75 bp, Artificial Sequence
  Synthetic
agggaagccagggatataaagatacgtctcacaaggagagcgaccctctgggttatttgaccccgtcgtactctg

SEQ ID NO: 113079 - DNA, 75 bp, Artificial Sequence
  Synthetic
agggaagccagggatataaagatacgtctcacaaggagagcgaccctctgggttatttgacgccgtcgtactctg

SEQ ID NO: 113080 - DNA, 75 bp, Artificial Sequence
  Synthetic
agggaagccagggatataaagatacgtctcacaaggagagcgaccgtctgggttatttgacaccgtcgtactctg

SEQ ID NO: 113081 - DNA, 75 bp, Artificial Sequence
  Synthetic
agggaagccagggatataaagatacgtctcacaaggagagcgaccgtctgggttatttgactccgtcgtactctg

SEQ ID NO: 113082 - DNA, 75 bp, Artificial Sequence
  Synthetic
agggaagccagggatataaagatacgtctcacaaggagagcgaccgtctgggttatttgaccccgtcgtactctg

SEQ ID NO: 113083 - DNA, 75 bp, Artificial Sequence
  Synthetic
agggaagccagggatataaagatacgtctcacaaggagagcgaccgtctgggttatttgacgccgtcgtactctg

SEQ ID NO: 113084 - DNA, 75 bp, Artificial Sequence
  Synthetic
agggaagccagggatatatagatacgtctcacaaggagagcgaccatctgggttatttgacaccgtcgtactctg

SEQ ID NO: 113085 - DNA, 75 bp, Artificial Sequence
  Synthetic
agggaagccagggatatatagatacgtctcacaaggagagcgaccatctgggttatttgactccgtcgtactctg

SEQ ID NO: 113086 - DNA, 75 bp, Artificial Sequence
  Synthetic
agggaagccagggatatatagatacgtctcacaaggagagcgaccatctgggttatttgaccccgtcgtactctg

SEQ ID NO: 113087 - DNA, 75 bp, Artificial Sequence
  Synthetic
agggaagccagggatatatagatacgtctcacaaggagagcgaccatctgggttatttgacgccgtcgtactctg

SEQ ID NO: 113088 - DNA, 75 bp, Artificial Sequence
  Synthetic
agggaagccagggatatatagatacgtctcacaaggagagcgaccttctgggttatttgacaccgtcgtactctg

SEQ ID NO: 113089 - DNA, 75 bp, Artificial Sequence
  Synthetic
agggaagccagggatatatagatacgtctcacaaggagagcgaccttctgggttatttgactccgtcgtactctg

SEQ ID NO: 113090 - DNA, 75 bp, Artificial Sequence
  Synthetic
agggaagccagggatatatagatacgtctcacaaggagagcgaccttctgggttatttgaccccgtcgtactctg

SEQ ID NO: 113091 - DNA, 75 bp, Artificial Sequence
  Synthetic
agggaagccagggatatatagatacgtctcacaaggagagcgaccttctgggttatttgacgccgtcgtactctg

SEQ ID NO: 113092 - DNA, 75 bp, Artificial Sequence
  Synthetic
agggaagccagggatatatagatacgtctcacaaggagagcgaccctctgggttatttgacaccgtcgtactctg

SEQ ID NO: 113093 - DNA, 75 bp, Artificial Sequence
  Synthetic
agggaagccagggatatatagatacgtctcacaaggagagcgaccctctgggttatttgactccgtcgtactctg

SEQ ID NO: 113094 - DNA, 75 bp, Artificial Sequence
  Synthetic
agggaagccagggatatatagatacgtctcacaaggagagcgaccctctgggttatttgaccccgtcgtactctg

SEQ ID NO: 113095 - DNA, 75 bp, Artificial Sequence
  Synthetic
agggaagccagggatatatagatacgtctcacaaggagagcgaccctctgggttatttgacgccgtcgtactctg

SEQ ID NO: 113096 - DNA, 75 bp, Artificial Sequence
  Synthetic
agggaagccagggatatatagatacgtctcacaaggagagcgaccgtctgggttatttgacaccgtcgtactctg

SEQ ID NO: 113097 - DNA, 75 bp, Artificial Sequence
  Synthetic
agggaagccagggatatatagatacgtctcacaaggagagcgaccgtctgggttatttgactccgtcgtactctg

SEQ ID NO: 113098 - DNA, 75 bp, Artificial Sequence
  Synthetic
agggaagccagggatatatagatacgtctcacaaggagagcgaccgtctgggttatttgaccccgtcgtactctg

SEQ ID NO: 113099 - DNA, 75 bp, Artificial Sequence
  Synthetic
agggaagccagggatatatagatacgtctcacaaggagagcgaccgtctgggttatttgacgccgtcgtactctg

SEQ ID NO: 113100 - DNA, 75 bp, Artificial Sequence
  Synthetic
agggaagccagggatatacagatacgtctcacaaggagagcgaccatctgggttatttgacaccgtcgtactctg

SEQ ID NO: 113101 - DNA, 75 bp, Artificial Sequence
  Synthetic
agggaagccagggatatacagatacgtctcacaaggagagcgaccatctgggttatttgactccgtcgtactctg

SEQ ID NO: 113102 - DNA, 75 bp, Artificial Sequence
  Synthetic
agggaagccagggatatacagatacgtctcacaaggagagcgaccatctgggttatttgaccccgtcgtactctg

SEQ ID NO: 113103 - DNA, 75 bp, Artificial Sequence
  Synthetic
agggaagccagggatatacagatacgtctcacaaggagagcgaccatctgggttatttgacgccgtcgtactctg

SEQ ID NO: 113104 - DNA, 75 bp, Artificial Sequence
  Synthetic
agggaagccagggatatacagatacgtctcacaaggagagcgaccttctgggttatttgacaccgtcgtactctg

SEQ ID NO: 113105 - DNA, 75 bp, Artificial Sequence
  Synthetic
agggaagccagggatatacagatacgtctcacaaggagagcgaccttctgggttatttgactccgtcgtactctg

SEQ ID NO: 113106 - DNA, 75 bp, Artificial Sequence
  Synthetic
agggaagccagggatatacagatacgtctcacaaggagagcgaccttctgggttatttgaccccgtcgtactctg

SEQ ID NO: 113107 - DNA, 75 bp, Artificial Sequence
  Synthetic
agggaagccagggatatacagatacgtctcacaaggagagcgaccttctgggttatttgacgccgtcgtactctg

SEQ ID NO: 113108 - DNA, 75 bp, Artificial Sequence
  Synthetic
agggaagccagggatatacagatacgtctcacaaggagagcgaccctctgggttatttgacaccgtcgtactctg

SEQ ID NO: 113109 - DNA, 75 bp, Artificial Sequence
  Synthetic
agggaagccagggatatacagatacgtctcacaaggagagcgaccctctgggttatttgactccgtcgtactctg

SEQ ID NO: 113110 - DNA, 75 bp, Artificial Sequence
  Synthetic
agggaagccagggatatacagatacgtctcacaaggagagcgaccctctgggttatttgaccccgtcgtactctg

SEQ ID NO: 113111 - DNA, 75 bp, Artificial Sequence
  Synthetic
agggaagccagggatatacagatacgtctcacaaggagagcgaccctctgggttatttgacgccgtcgtactctg

SEQ ID NO: 113112 - DNA, 75 bp, Artificial Sequence
  Synthetic
agggaagccagggatatacagatacgtctcacaaggagagcgaccgtctgggttatttgacaccgtcgtactctg

SEQ ID NO: 113113 - DNA, 75 bp, Artificial Sequence
  Synthetic
agggaagccagggatatacagatacgtctcacaaggagagcgaccgtctgggttatttgactccgtcgtactctg

SEQ ID NO: 113114 - DNA, 75 bp, Artificial Sequence
  Synthetic
agggaagccagggatatacagatacgtctcacaaggagagcgaccgtctgggttatttgaccccgtcgtactctg

SEQ ID NO: 113115 - DNA, 75 bp, Artificial Sequence
  Synthetic
agggaagccagggatatacagatacgtctcacaaggagagcgaccgtctgggttatttgacgccgtcgtactctg

SEQ ID NO: 113116 - DNA, 75 bp, Artificial Sequence
  Synthetic
agggaagccagggatatagagatacgtctcacaaggagagcgaccatctgggttatttgacaccgtcgtactctg

SEQ ID NO: 113117 - DNA, 75 bp, Artificial Sequence
  Synthetic
agggaagccagggatatagagatacgtctcacaaggagagcgaccatctgggttatttgactccgtcgtactctg

SEQ ID NO: 113118 - DNA, 75 bp, Artificial Sequence
  Synthetic
agggaagccagggatatagagatacgtctcacaaggagagcgaccatctgggttatttgaccccgtcgtactctg

SEQ ID NO: 113119 - DNA, 75 bp, Artificial Sequence
  Synthetic
agggaagccagggatatagagatacgtctcacaaggagagcgaccatctgggttatttgacgccgtcgtactctg

SEQ ID NO: 113120 - DNA, 75 bp, Artificial Sequence
  Synthetic
agggaagccagggatatagagatacgtctcacaaggagagcgaccttctgggttatttgacaccgtcgtactctg

SEQ ID NO: 113121 - DNA, 75 bp, Artificial Sequence
  Synthetic
agggaagccagggatatagagatacgtctcacaaggagagcgaccttctgggttatttgactccgtcgtactctg

SEQ ID NO: 113122 - DNA, 75 bp, Artificial Sequence
  Synthetic
agggaagccagggatatagagatacgtctcacaaggagagcgaccttctgggttatttgaccccgtcgtactctg

SEQ ID NO: 113123 - DNA, 75 bp, Artificial Sequence
  Synthetic
agggaagccagggatatagagatacgtctcacaaggagagcgaccttctgggttatttgacgccgtcgtactctg

SEQ ID NO: 113124 - DNA, 75 bp, Artificial Sequence
  Synthetic
agggaagccagggatatagagatacgtctcacaaggagagcgaccctctgggttatttgacaccgtcgtactctg

SEQ ID NO: 113125 - DNA, 75 bp, Artificial Sequence
  Synthetic
agggaagccagggatatagagatacgtctcacaaggagagcgaccctctgggttatttgactccgtcgtactctg

SEQ ID NO: 113126 - DNA, 75 bp, Artificial Sequence
  Synthetic
agggaagccagggatatagagatacgtctcacaaggagagcgaccctctgggttatttgaccccgtcgtactctg

SEQ ID NO: 113127 - DNA, 75 bp, Artificial Sequence
  Synthetic
agggaagccagggatatagagatacgtctcacaaggagagcgaccctctgggttatttgacgccgtcgtactctg

SEQ ID NO: 113128 - DNA, 75 bp, Artificial Sequence
  Synthetic
agggaagccagggatatagagatacgtctcacaaggagagcgaccgtctgggttatttgacaccgtcgtactctg

SEQ ID NO: 113129 - DNA, 75 bp, Artificial Sequence
  Synthetic
agggaagccagggatatagagatacgtctcacaaggagagcgaccgtctgggttatttgactccgtcgtactctg

SEQ ID NO: 113130 - DNA, 75 bp, Artificial Sequence
  Synthetic
agggaagccagggatatagagatacgtctcacaaggagagcgaccgtctgggttatttgaccccgtcgtactctg

SEQ ID NO: 113131 - DNA, 75 bp, Artificial Sequence
  Synthetic
agggaagccagggatatagagatacgtctcacaaggagagcgaccgtctgggttatttgacgccgtcgtactctg

SEQ ID NO: 113132 - DNA, 75 bp, Artificial Sequence
  Synthetic
ctacgagcgtacatgaacaccccgggacttcccgtgtgccaggaccatcttgaattttgggagggcgtcttcacg

SEQ ID NO: 113133 - DNA, 75 bp, Artificial Sequence
  Synthetic
atatctaatacaggccgccatcactactaccccctactttgtgcgtgcgcatgttctggtccgcctttgcatgtt

SEQ ID NO: 113134 - DNA, 75 bp, Artificial Sequence
  Synthetic
caacacccctgctgtacaggctaggagccgtccaaaacgaggtcaccctcacacaccccataaccaaatacatca

SEQ ID NO: 113135 - DNA, 75 bp, Artificial Sequence
  Synthetic
tactgcttaacagtaggtagtgctgtcatttgtggcaggatcgtgacctcgggaaaacccgtactggtccccgac

SEQ ID NO: 113136 - DNA, 75 bp, Artificial Sequence
  Synthetic
actaccccctactttgtgcgtgcgcatgttctggtccgcctttgcatgttcgtgcgctccgtgacggggggaaag

SEQ ID NO: 113137 - DNA, 75 bp, Artificial Sequence
  Synthetic
caccacaatttggtgtattccaccacctcacgcagtgctagccaaaggcagaagaaagtcacatttgacagactg

SEQ ID NO: 113138 - DNA, 75 bp, Artificial Sequence
  Synthetic
aggtcctgggtctgctgcagagcactgctaagcaggcagaggatctcaagccggctgtcagctcggcatggccga

SEQ ID NO: 113139 - DNA, 75 bp, Artificial Sequence
  Synthetic
acaccgtatggcatgggacatgatgatgaactggtcgcccacggccaccatgatcttggcgtacgcgatgcgcgt

SEQ ID NO: 113140 - DNA, 75 bp, Artificial Sequence
  Synthetic
tctaatgtccttctccgctgcccttaccagcccattatcaacatctactacccttctcctcaatattttgggggg

SEQ ID NO: 113141 - DNA, 75 bp, Artificial Sequence
  Synthetic
cactctgcctggcaaccccgcaatagcatcactaatggcattcacagcctccatcaccagcccgctcaccaccca

SEQ ID NO: 113142 - DNA, 75 bp, Artificial Sequence
  Synthetic
taccggcgacttcgactcagtgatcgactgtaacacatgtgtcacccagacggtcgatttcagcttggaccctac

SEQ ID NO: 113143 - DNA, 75 bp, Artificial Sequence
  Synthetic
attgttgatattctagcagggtacggagctggcgtgtcaggcgctctcgtcgcttttaagatcatgtgcggcgag

SEQ ID NO: 113144 - DNA, 75 bp, Artificial Sequence
  Synthetic
ctcagcagaacattcagctcatcaacaccaatggcagttggcatatcaaccgcactgccttgaactgcaatgact

SEQ ID NO: 113145 - DNA, 75 bp, Artificial Sequence
  Synthetic
agcgagcttgctcagtcctaggcctctcgcctgtctcaaaggttcctctggaggtcctgttatgtgcccttcggg

SEQ ID NO: 113146 - DNA, 75 bp, Artificial Sequence
  Synthetic
tcggtccttccgagggtgctaatcaatggatgaacagactcatagcttttgcctcccggggcaatcacgtgtccc

SEQ ID NO: 113147 - DNA, 75 bp, Artificial Sequence
  Synthetic
cagtggggattggacatcaccgtgtggcaccagctggttgagggaagtatgggactgggtgtgaacagtactatc

SEQ ID NO: 113148 - DNA, 75 bp, Artificial Sequence
  Synthetic
cagtggggattggacatcaccgtgtggcaccagctggttgagggaagtatgggactgggtgtgtacagtactatc

SEQ ID NO: 113149 - DNA, 75 bp, Artificial Sequence
  Synthetic
cagtggggattggacatcaccgtgtggcaccagctggttgagggaagtatgggactgggtgtgcacagtactatc

SEQ ID NO: 113150 - DNA, 75 bp, Artificial Sequence
  Synthetic
cagtggggattggacatcaccgtgtggcaccagctggttgagggaagtatgggactgggtgtggacagtactatc

SEQ ID NO: 113151 - DNA, 75 bp, Artificial Sequence
  Synthetic
agtagggtaccttcatgccccgaccggcagcggtaagagcacaaaggtcccggccgcttatgtagcacaaggata

SEQ ID NO: 113152 - DNA, 75 bp, Artificial Sequence
  Synthetic
ggtatttgctataccacttgcccctgtggggggcagattacaggtcatgtgaagaacgggacgatgaagatcgtc

SEQ ID NO: 113153 - DNA, 75 bp, Artificial Sequence
  Synthetic
ctgaggcgccatgtgggaccgtcagagggcgctgctcaatggatgaacaggctcatagcgtttgcatcacggggc

SEQ ID NO: 113154 - DNA, 75 bp, Artificial Sequence
  Synthetic
ccttgtggagggtatccgcggaggactatgttgaggtcgtccgtaacaaggattgccactatgtggtaggggcca

SEQ ID NO: 113155 - DNA, 75 bp, Artificial Sequence
  Synthetic
ctagatcaggctgaaacggctggggtgaggctgacggttttagcaacagcaactcccccaggcagcatcattggg

SEQ ID NO: 113156 - DNA, 75 bp, Artificial Sequence
  Synthetic
tgccgtactttgtacgcgctcaagggctcatccgtgcatgcatgttggtgcggaaagtcgccgggggtcattatg

SEQ ID NO: 113157 - DNA, 75 bp, Artificial Sequence
  Synthetic
gctcatcagagacgaagtgtcatttcaagttgggcttcacagctacgttttgggatcccaactcccatgcgagcc

SEQ ID NO: 113158 - DNA, 75 bp, Artificial Sequence
  Synthetic
gggcccacgcgggcttacgagacctcgcggtggcagtagagcctgtcatcttctctgacatggagattaagatca

SEQ ID NO: 113159 - DNA, 75 bp, Artificial Sequence
  Synthetic
gggcgaagcacatgtggaatttcatcagcgggatacagtacttagcaggcttgtccactctgcctgggaaccccg

SEQ ID NO: 113160 - DNA, 75 bp, Artificial Sequence
  Synthetic
ttggcgcggtgacggcatatgttacaccacatgccattgtggagcacaaatcacaggacaagtcaaaaatgggtc

SEQ ID NO: 113161 - DNA, 75 bp, Artificial Sequence
  Synthetic
ttggcgcggtgacggcatatgttacaccacatgccattgtggagcacaaatcacaggacatgtcaaaaatgggtc

SEQ ID NO: 113162 - DNA, 75 bp, Artificial Sequence
  Synthetic
ttggcgcggtgacggcatatgttacaccacatgccattgtggagcacaaatcacaggacacgtcaaaaatgggtc

SEQ ID NO: 113163 - DNA, 75 bp, Artificial Sequence
  Synthetic
ttggcgcggtgacggcatatgttacaccacatgccattgtggagcacaaatcacaggacaggtcaaaaatgggtc

SEQ ID NO: 113164 - DNA, 75 bp, Artificial Sequence
  Synthetic
ttggcgcggtgacggcatatgttacaccacttgccattgtggagcacaaatcacaggacaagtcaaaaatgggtc

SEQ ID NO: 113165 - DNA, 75 bp, Artificial Sequence
  Synthetic
ttggcgcggtgacggcatatgttacaccacttgccattgtggagcacaaatcacaggacatgtcaaaaatgggtc

SEQ ID NO: 113166 - DNA, 75 bp, Artificial Sequence
  Synthetic
ttggcgcggtgacggcatatgttacaccacttgccattgtggagcacaaatcacaggacacgtcaaaaatgggtc

SEQ ID NO: 113167 - DNA, 75 bp, Artificial Sequence
  Synthetic
ttggcgcggtgacggcatatgttacaccacttgccattgtggagcacaaatcacaggacaggtcaaaaatgggtc

SEQ ID NO: 113168 - DNA, 75 bp, Artificial Sequence
  Synthetic
ttggcgcggtgacggcatatgttacaccacctgccattgtggagcacaaatcacaggacaagtcaaaaatgggtc

SEQ ID NO: 113169 - DNA, 75 bp, Artificial Sequence
  Synthetic
ttggcgcggtgacggcatatgttacaccacctgccattgtggagcacaaatcacaggacatgtcaaaaatgggtc

SEQ ID NO: 113170 - DNA, 75 bp, Artificial Sequence
  Synthetic
ttggcgcggtgacggcatatgttacaccacctgccattgtggagcacaaatcacaggacacgtcaaaaatgggtc

SEQ ID NO: 113171 - DNA, 75 bp, Artificial Sequence
  Synthetic
ttggcgcggtgacggcatatgttacaccacctgccattgtggagcacaaatcacaggacaggtcaaaaatgggtc

SEQ ID NO: 113172 - DNA, 75 bp, Artificial Sequence
  Synthetic
ttggcgcggtgacggcatatgttacaccacgtgccattgtggagcacaaatcacaggacaagtcaaaaatgggtc

SEQ ID NO: 113173 - DNA, 75 bp, Artificial Sequence
  Synthetic
ttggcgcggtgacggcatatgttacaccacgtgccattgtggagcacaaatcacaggacatgtcaaaaatgggtc

SEQ ID NO: 113174 - DNA, 75 bp, Artificial Sequence
  Synthetic
ttggcgcggtgacggcatatgttacaccacgtgccattgtggagcacaaatcacaggacacgtcaaaaatgggtc

SEQ ID NO: 113175 - DNA, 75 bp, Artificial Sequence
  Synthetic
ttggcgcggtgacggcatatgttacaccacgtgccattgtggagcacaaatcacaggacaggtcaaaaatgggtc

SEQ ID NO: 113176 - DNA, 75 bp, Artificial Sequence
  Synthetic
aacatcgtggacgtacaatacatgtatggcctgtcaccagccctcacaaaatacgtcgttcgatgggagtgggta

SEQ ID NO: 113177 - DNA, 75 bp, Artificial Sequence
  Synthetic
aacatcgtggacgttcaatacatgtatggcctgtcaccagccctcacaaaatacgtcgttcgatgggagtgggta

SEQ ID NO: 113178 - DNA, 75 bp, Artificial Sequence
  Synthetic
aacatcgtggacgtccaatacatgtatggcctgtcaccagccctcacaaaatacgtcgttcgatgggagtgggta

SEQ ID NO: 113179 - DNA, 75 bp, Artificial Sequence
  Synthetic
aacatcgtggacgtgcaatacatgtatggcctgtcaccagccctcacaaaatacgtcgttcgatgggagtgggta

SEQ ID NO: 113180 - DNA, 75 bp, Artificial Sequence
  Synthetic
ctctttcgagccgcttcgagcggaagaggatgagagggaagtgtccgtgccagcggagatcctgcggaaatccag

SEQ ID NO: 113181 - DNA, 75 bp, Artificial Sequence
  Synthetic
aatgaggattgctggtcccaaaacatgcagcaatgtttggcatggcactttccccataaacgcctcaacaatggg

SEQ ID NO: 113182 - DNA, 75 bp, Artificial Sequence
  Synthetic
ctggccagctcgtccgccagtcaactttcagctccatctctcaaggcaacgtgcactactgctgccaaccaccct

SEQ ID NO: 113183 - DNA, 75 bp, Artificial Sequence
  Synthetic
atttctccatggtggggaactgggcgaaggttctggttgtgctgctgctatttgccggcgtcgacgcgaacacct

SEQ ID NO: 113184 - DNA, 75 bp, Artificial Sequence
  Synthetic
gtcgtggcaactgatgctctcatgaccggctttaccggcgacttcgactcggtgatagactgcaacacgtgtgtc

SEQ ID NO: 113185 - DNA, 75 bp, Artificial Sequence
  Synthetic
tggaccccaccttttccattgagactcgcactgctccccaagacgcggtttcccgcagtcaacgtcgtggccgta

SEQ ID NO: 113186 - DNA, 75 bp, Artificial Sequence
  Synthetic
ccacaaattcaactcttcaggctgtcctgagaggttggccagctgccgaccccttaccgattttgcccagggctg

SEQ ID NO: 113187 - DNA, 75 bp, Artificial Sequence
  Synthetic
ttgacccgttggtggccgaaacagacgacagggaaatttccgtgtcagctgagtgccacaggcctcccagaccaa

SEQ ID NO: 113188 - DNA, 75 bp, Artificial Sequence
  Synthetic
cgcctattccctcactggcctatggcccttctgcctattgctcctagcactgccccaacaggcttatgcctatga

SEQ ID NO: 113189 - DNA, 75 bp, Artificial Sequence
  Synthetic
atattagtaatcatatccatctttactcttaccccagcatacaagattctcctgagccgttcagtgtggtggctg

SEQ ID NO: 113190 - DNA, 75 bp, Artificial Sequence
  Synthetic
cctttgctacgagatgaggtgtcgttcagagtaggactacacgattacccggtggggtcgcaattaccttgcgag

SEQ ID NO: 113191 - DNA, 75 bp, Artificial Sequence
  Synthetic
ttccgtgtgagcccgagcctgatgtaatggtactaacatcaatgctatctgacccatcacacataaccgcagaga

SEQ ID NO: 113192 - DNA, 75 bp, Artificial Sequence
  Synthetic
ttccgtgtgagcccgagcctgatgtaatggtactaacatcaatgctatctgacccatctcacataaccgcagaga

SEQ ID NO: 113193 - DNA, 75 bp, Artificial Sequence
  Synthetic
ttccgtgtgagcccgagcctgatgtaatggtactaacatcaatgctatctgacccatcccacataaccgcagaga

SEQ ID NO: 113194 - DNA, 75 bp, Artificial Sequence
  Synthetic
ttccgtgtgagcccgagcctgatgtaatggtactaacatcaatgctatctgacccatcgcacataaccgcagaga

SEQ ID NO: 113195 - DNA, 75 bp, Artificial Sequence
  Synthetic
ttccgtgtgagcccgagcctgatgtaatggtactaacatctatgctatctgacccatcacacataaccgcagaga

SEQ ID NO: 113196 - DNA, 75 bp, Artificial Sequence
  Synthetic
ttccgtgtgagcccgagcctgatgtaatggtactaacatctatgctatctgacccatctcacataaccgcagaga

SEQ ID NO: 113197 - DNA, 75 bp, Artificial Sequence
  Synthetic
ttccgtgtgagcccgagcctgatgtaatggtactaacatctatgctatctgacccatcccacataaccgcagaga

SEQ ID NO: 113198 - DNA, 75 bp, Artificial Sequence
  Synthetic
ttccgtgtgagcccgagcctgatgtaatggtactaacatctatgctatctgacccatcgcacataaccgcagaga

SEQ ID NO: 113199 - DNA, 75 bp, Artificial Sequence
  Synthetic
ttccgtgtgagcccgagcctgatgtaatggtactaacatccatgctatctgacccatcacacataaccgcagaga

SEQ ID NO: 113200 - DNA, 75 bp, Artificial Sequence
  Synthetic
ttccgtgtgagcccgagcctgatgtaatggtactaacatccatgctatctgacccatctcacataaccgcagaga

SEQ ID NO: 113201 - DNA, 75 bp, Artificial Sequence
  Synthetic
ttccgtgtgagcccgagcctgatgtaatggtactaacatccatgctatctgacccatcccacataaccgcagaga

SEQ ID NO: 113202 - DNA, 75 bp, Artificial Sequence
  Synthetic
ttccgtgtgagcccgagcctgatgtaatggtactaacatccatgctatctgacccatcgcacataaccgcagaga

SEQ ID NO: 113203 - DNA, 75 bp, Artificial Sequence
  Synthetic
ttccgtgtgagcccgagcctgatgtaatggtactaacatcgatgctatctgacccatcacacataaccgcagaga

SEQ ID NO: 113204 - DNA, 75 bp, Artificial Sequence
  Synthetic
ttccgtgtgagcccgagcctgatgtaatggtactaacatcgatgctatctgacccatctcacataaccgcagaga

SEQ ID NO: 113205 - DNA, 75 bp, Artificial Sequence
  Synthetic
ttccgtgtgagcccgagcctgatgtaatggtactaacatcgatgctatctgacccatcccacataaccgcagaga

SEQ ID NO: 113206 - DNA, 75 bp, Artificial Sequence
  Synthetic
ttccgtgtgagcccgagcctgatgtaatggtactaacatcgatgctatctgacccatcgcacataaccgcagaga

SEQ ID NO: 113207 - DNA, 75 bp, Artificial Sequence
  Synthetic
tctttacactcaccccggggtataagacccttctcagccggtgcctgtggtggttgtgctatctcctgaccctgg

SEQ ID NO: 113208 - DNA, 75 bp, Artificial Sequence
  Synthetic
atgtgccctccctcccaaggggttgccacccatacctccacctaggcggaagaaggtcgtacagctcgacgaatc

SEQ ID NO: 113209 - DNA, 75 bp, Artificial Sequence
  Synthetic
gtcaccgtgccacatcccaacatcgaggaggtggctctgtccaacattggagagatccccttctatggcaaagcc

SEQ ID NO: 113210 - DNA, 75 bp, Artificial Sequence
  Synthetic
cccagatccaacaatgggttccccccctggaagcccgaggggggcgtgacgggatcatctgggctgctgtcatct

SEQ ID NO: 113211 - DNA, 75 bp, Artificial Sequence
  Synthetic
agcctactctcccccaggcctgtctcctacctgaagggctcttcgggtggtccattgctctgcccttccgggcac

SEQ ID NO: 113212 - DNA, 75 bp, Artificial Sequence
  Synthetic
cgcggcccaccctgacgctgaattagttgaggccaatctcttgtggaggcaggagaaggggggcaacataacaag

SEQ ID NO: 113213 - DNA, 75 bp, Artificial Sequence
  Synthetic
cgcggcccaccctgacgctgaattagttgaggccaatctcttgtggaggcaggagaaggggggcaacataactag

SEQ ID NO: 113214 - DNA, 75 bp, Artificial Sequence
  Synthetic
cgcggcccaccctgacgctgaattagttgaggccaatctcttgtggaggcaggagaaggggggcaacataaccag

SEQ ID NO: 113215 - DNA, 75 bp, Artificial Sequence
  Synthetic
cgcggcccaccctgacgctgaattagttgaggccaatctcttgtggaggcaggagaaggggggcaacataacgag

SEQ ID NO: 113216 - DNA, 75 bp, Artificial Sequence
  Synthetic
cgcggcccaccctgacgctgaattagttgaggccaatctcttgtggaggcaggagatggggggcaacataacaag

SEQ ID NO: 113217 - DNA, 75 bp, Artificial Sequence
  Synthetic
cgcggcccaccctgacgctgaattagttgaggccaatctcttgtggaggcaggagatggggggcaacataactag

SEQ ID NO: 113218 - DNA, 75 bp, Artificial Sequence
  Synthetic
cgcggcccaccctgacgctgaattagttgaggccaatctcttgtggaggcaggagatggggggcaacataaccag

SEQ ID NO: 113219 - DNA, 75 bp, Artificial Sequence
  Synthetic
cgcggcccaccctgacgctgaattagttgaggccaatctcttgtggaggcaggagatggggggcaacataacgag

SEQ ID NO: 113220 - DNA, 75 bp, Artificial Sequence
  Synthetic
cgcggcccaccctgacgctgaattagttgaggccaatctcttgtggaggcaggagacggggggcaacataacaag

SEQ ID NO: 113221 - DNA, 75 bp, Artificial Sequence
  Synthetic
cgcggcccaccctgacgctgaattagttgaggccaatctcttgtggaggcaggagacggggggcaacataactag

SEQ ID NO: 113222 - DNA, 75 bp, Artificial Sequence
  Synthetic
cgcggcccaccctgacgctgaattagttgaggccaatctcttgtggaggcaggagacggggggcaacataaccag

SEQ ID NO: 113223 - DNA, 75 bp, Artificial Sequence
  Synthetic
cgcggcccaccctgacgctgaattagttgaggccaatctcttgtggaggcaggagacggggggcaacataacgag

SEQ ID NO: 113224 - DNA, 75 bp, Artificial Sequence
  Synthetic
cgcggcccaccctgacgctgaattagttgaggccaatctcttgtggaggcaggagagggggggcaacataacaag

SEQ ID NO: 113225 - DNA, 75 bp, Artificial Sequence
  Synthetic
cgcggcccaccctgacgctgaattagttgaggccaatctcttgtggaggcaggagagggggggcaacataactag

SEQ ID NO: 113226 - DNA, 75 bp, Artificial Sequence
  Synthetic
cgcggcccaccctgacgctgaattagttgaggccaatctcttgtggaggcaggagagggggggcaacataaccag

SEQ ID NO: 113227 - DNA, 75 bp, Artificial Sequence
  Synthetic
cgcggcccaccctgacgctgaattagttgaggccaatctcttgtggaggcaggagagggggggcaacataacgag

SEQ ID NO: 113228 - DNA, 75 bp, Artificial Sequence
  Synthetic
cgcggcccaccctgacgctgaatttgttgaggccaatctcttgtggaggcaggagaaggggggcaacataacaag

SEQ ID NO: 113229 - DNA, 75 bp, Artificial Sequence
  Synthetic
cgcggcccaccctgacgctgaatttgttgaggccaatctcttgtggaggcaggagaaggggggcaacataactag

SEQ ID NO: 113230 - DNA, 75 bp, Artificial Sequence
  Synthetic
cgcggcccaccctgacgctgaatttgttgaggccaatctcttgtggaggcaggagaaggggggcaacataaccag

SEQ ID NO: 113231 - DNA, 75 bp, Artificial Sequence
  Synthetic
cgcggcccaccctgacgctgaatttgttgaggccaatctcttgtggaggcaggagaaggggggcaacataacgag

SEQ ID NO: 113232 - DNA, 75 bp, Artificial Sequence
  Synthetic
cgcggcccaccctgacgctgaatttgttgaggccaatctcttgtggaggcaggagatggggggcaacataacaag

SEQ ID NO: 113233 - DNA, 75 bp, Artificial Sequence
  Synthetic
cgcggcccaccctgacgctgaatttgttgaggccaatctcttgtggaggcaggagatggggggcaacataactag

SEQ ID NO: 113234 - DNA, 75 bp, Artificial Sequence
  Synthetic
cgcggcccaccctgacgctgaatttgttgaggccaatctcttgtggaggcaggagatggggggcaacataaccag

SEQ ID NO: 113235 - DNA, 75 bp, Artificial Sequence
  Synthetic
cgcggcccaccctgacgctgaatttgttgaggccaatctcttgtggaggcaggagatggggggcaacataacgag

SEQ ID NO: 113236 - DNA, 75 bp, Artificial Sequence
  Synthetic
cgcggcccaccctgacgctgaatttgttgaggccaatctcttgtggaggcaggagacggggggcaacataacaag

SEQ ID NO: 113237 - DNA, 75 bp, Artificial Sequence
  Synthetic
cgcggcccaccctgacgctgaatttgttgaggccaatctcttgtggaggcaggagacggggggcaacataactag

SEQ ID NO: 113238 - DNA, 75 bp, Artificial Sequence
  Synthetic
cgcggcccaccctgacgctgaatttgttgaggccaatctcttgtggaggcaggagacggggggcaacataaccag

SEQ ID NO: 113239 - DNA, 75 bp, Artificial Sequence
  Synthetic
cgcggcccaccctgacgctgaatttgttgaggccaatctcttgtggaggcaggagacggggggcaacataacgag

SEQ ID NO: 113240 - DNA, 75 bp, Artificial Sequence
  Synthetic
cgcggcccaccctgacgctgaatttgttgaggccaatctcttgtggaggcaggagagggggggcaacataacaag

SEQ ID NO: 113241 - DNA, 75 bp, Artificial Sequence
  Synthetic
cgcggcccaccctgacgctgaatttgttgaggccaatctcttgtggaggcaggagagggggggcaacataactag

SEQ ID NO: 113242 - DNA, 75 bp, Artificial Sequence
  Synthetic
cgcggcccaccctgacgctgaatttgttgaggccaatctcttgtggaggcaggagagggggggcaacataaccag

SEQ ID NO: 113243 - DNA, 75 bp, Artificial Sequence
  Synthetic
cgcggcccaccctgacgctgaatttgttgaggccaatctcttgtggaggcaggagagggggggcaacataacgag

SEQ ID NO: 113244 - DNA, 75 bp, Artificial Sequence
  Synthetic
cgcggcccaccctgacgctgaattcgttgaggccaatctcttgtggaggcaggagaaggggggcaacataacaag

SEQ ID NO: 113245 - DNA, 75 bp, Artificial Sequence
  Synthetic
cgcggcccaccctgacgctgaattcgttgaggccaatctcttgtggaggcaggagaaggggggcaacataactag

SEQ ID NO: 113246 - DNA, 75 bp, Artificial Sequence
  Synthetic
cgcggcccaccctgacgctgaattcgttgaggccaatctcttgtggaggcaggagaaggggggcaacataaccag

SEQ ID NO: 113247 - DNA, 75 bp, Artificial Sequence
  Synthetic
cgcggcccaccctgacgctgaattcgttgaggccaatctcttgtggaggcaggagaaggggggcaacataacgag

SEQ ID NO: 113248 - DNA, 75 bp, Artificial Sequence
  Synthetic
cgcggcccaccctgacgctgaattcgttgaggccaatctcttgtggaggcaggagatggggggcaacataacaag

SEQ ID NO: 113249 - DNA, 75 bp, Artificial Sequence
  Synthetic
cgcggcccaccctgacgctgaattcgttgaggccaatctcttgtggaggcaggagatggggggcaacataactag

SEQ ID NO: 113250 - DNA, 75 bp, Artificial Sequence
  Synthetic
cgcggcccaccctgacgctgaattcgttgaggccaatctcttgtggaggcaggagatggggggcaacataaccag

SEQ ID NO: 113251 - DNA, 75 bp, Artificial Sequence
  Synthetic
cgcggcccaccctgacgctgaattcgttgaggccaatctcttgtggaggcaggagatggggggcaacataacgag

SEQ ID NO: 113252 - DNA, 75 bp, Artificial Sequence
  Synthetic
cgcggcccaccctgacgctgaattcgttgaggccaatctcttgtggaggcaggagacggggggcaacataacaag

SEQ ID NO: 113253 - DNA, 75 bp, Artificial Sequence
  Synthetic
cgcggcccaccctgacgctgaattcgttgaggccaatctcttgtggaggcaggagacggggggcaacataactag

SEQ ID NO: 113254 - DNA, 75 bp, Artificial Sequence
  Synthetic
cgcggcccaccctgacgctgaattcgttgaggccaatctcttgtggaggcaggagacggggggcaacataaccag

SEQ ID NO: 113255 - DNA, 75 bp, Artificial Sequence
  Synthetic
cgcggcccaccctgacgctgaattcgttgaggccaatctcttgtggaggcaggagacggggggcaacataacgag

SEQ ID NO: 113256 - DNA, 75 bp, Artificial Sequence
  Synthetic
cgcggcccaccctgacgctgaattcgttgaggccaatctcttgtggaggcaggagagggggggcaacataacaag

SEQ ID NO: 113257 - DNA, 75 bp, Artificial Sequence
  Synthetic
cgcggcccaccctgacgctgaattcgttgaggccaatctcttgtggaggcaggagagggggggcaacataactag

SEQ ID NO: 113258 - DNA, 75 bp, Artificial Sequence
  Synthetic
cgcggcccaccctgacgctgaattcgttgaggccaatctcttgtggaggcaggagagggggggcaacataaccag

SEQ ID NO: 113259 - DNA, 75 bp, Artificial Sequence
  Synthetic
cgcggcccaccctgacgctgaattcgttgaggccaatctcttgtggaggcaggagagggggggcaacataacgag

SEQ ID NO: 113260 - DNA, 75 bp, Artificial Sequence
  Synthetic
cgcggcccaccctgacgctgaattggttgaggccaatctcttgtggaggcaggagaaggggggcaacataacaag

SEQ ID NO: 113261 - DNA, 75 bp, Artificial Sequence
  Synthetic
cgcggcccaccctgacgctgaattggttgaggccaatctcttgtggaggcaggagaaggggggcaacataactag

SEQ ID NO: 113262 - DNA, 75 bp, Artificial Sequence
  Synthetic
cgcggcccaccctgacgctgaattggttgaggccaatctcttgtggaggcaggagaaggggggcaacataaccag

SEQ ID NO: 113263 - DNA, 75 bp, Artificial Sequence
  Synthetic
cgcggcccaccctgacgctgaattggttgaggccaatctcttgtggaggcaggagaaggggggcaacataacgag

SEQ ID NO: 113264 - DNA, 75 bp, Artificial Sequence
  Synthetic
cgcggcccaccctgacgctgaattggttgaggccaatctcttgtggaggcaggagatggggggcaacataacaag

SEQ ID NO: 113265 - DNA, 75 bp, Artificial Sequence
  Synthetic
cgcggcccaccctgacgctgaattggttgaggccaatctcttgtggaggcaggagatggggggcaacataactag

SEQ ID NO: 113266 - DNA, 75 bp, Artificial Sequence
  Synthetic
cgcggcccaccctgacgctgaattggttgaggccaatctcttgtggaggcaggagatggggggcaacataaccag

SEQ ID NO: 113267 - DNA, 75 bp, Artificial Sequence
  Synthetic
cgcggcccaccctgacgctgaattggttgaggccaatctcttgtggaggcaggagatggggggcaacataacgag

SEQ ID NO: 113268 - DNA, 75 bp, Artificial Sequence
  Synthetic
cgcggcccaccctgacgctgaattggttgaggccaatctcttgtggaggcaggagacggggggcaacataacaag

SEQ ID NO: 113269 - DNA, 75 bp, Artificial Sequence
  Synthetic
cgcggcccaccctgacgctgaattggttgaggccaatctcttgtggaggcaggagacggggggcaacataactag

SEQ ID NO: 113270 - DNA, 75 bp, Artificial Sequence
  Synthetic
cgcggcccaccctgacgctgaattggttgaggccaatctcttgtggaggcaggagacggggggcaacataaccag

SEQ ID NO: 113271 - DNA, 75 bp, Artificial Sequence
  Synthetic
cgcggcccaccctgacgctgaattggttgaggccaatctcttgtggaggcaggagacggggggcaacataacgag

SEQ ID NO: 113272 - DNA, 75 bp, Artificial Sequence
  Synthetic
cgcggcccaccctgacgctgaattggttgaggccaatctcttgtggaggcaggagagggggggcaacataacaag

SEQ ID NO: 113273 - DNA, 75 bp, Artificial Sequence
  Synthetic
cgcggcccaccctgacgctgaattggttgaggccaatctcttgtggaggcaggagagggggggcaacataactag

SEQ ID NO: 113274 - DNA, 75 bp, Artificial Sequence
  Synthetic
cgcggcccaccctgacgctgaattggttgaggccaatctcttgtggaggcaggagagggggggcaacataaccag

SEQ ID NO: 113275 - DNA, 75 bp, Artificial Sequence
  Synthetic
cgcggcccaccctgacgctgaattggttgaggccaatctcttgtggaggcaggagagggggggcaacataacgag

SEQ ID NO: 113276 - DNA, 75 bp, Artificial Sequence
  Synthetic
tccgagtcagagcctatctctgatgggatggacgcgcactccgacgctgggtcatacagttccatgccccctctc

SEQ ID NO: 113277 - DNA, 75 bp, Artificial Sequence
  Synthetic
ggtcgagtctgaaaacaagatcatagtcctcgactcttttgacccattagtggccgaaccggacgacagggaaat

SEQ ID NO: 113278 - DNA, 75 bp, Artificial Sequence
  Synthetic
ggtcgagtctgaaaacaagatcatagtcctcgactcttttgacccattagtggccgatccggacgacagggaaat

SEQ ID NO: 113279 - DNA, 75 bp, Artificial Sequence
  Synthetic
ggtcgagtctgaaaacaagatcatagtcctcgactcttttgacccattagtggccgacccggacgacagggaaat

SEQ ID NO: 113280 - DNA, 75 bp, Artificial Sequence
  Synthetic
ggtcgagtctgaaaacaagatcatagtcctcgactcttttgacccattagtggccgagccggacgacagggaaat

SEQ ID NO: 113281 - DNA, 75 bp, Artificial Sequence
  Synthetic
ggtcgagtctgaaaacaagttcatagtcctcgactcttttgacccattagtggccgaaccggacgacagggaaat

SEQ ID NO: 113282 - DNA, 75 bp, Artificial Sequence
  Synthetic
ggtcgagtctgaaaacaagttcatagtcctcgactcttttgacccattagtggccgatccggacgacagggaaat

SEQ ID NO: 113283 - DNA, 75 bp, Artificial Sequence
  Synthetic
ggtcgagtctgaaaacaagttcatagtcctcgactcttttgacccattagtggccgacccggacgacagggaaat

SEQ ID NO: 113284 - DNA, 75 bp, Artificial Sequence
  Synthetic
ggtcgagtctgaaaacaagttcatagtcctcgactcttttgacccattagtggccgagccggacgacagggaaat

SEQ ID NO: 113285 - DNA, 75 bp, Artificial Sequence
  Synthetic
ggtcgagtctgaaaacaagctcatagtcctcgactcttttgacccattagtggccgaaccggacgacagggaaat

SEQ ID NO: 113286 - DNA, 75 bp, Artificial Sequence
  Synthetic
ggtcgagtctgaaaacaagctcatagtcctcgactcttttgacccattagtggccgatccggacgacagggaaat

SEQ ID NO: 113287 - DNA, 75 bp, Artificial Sequence
  Synthetic
ggtcgagtctgaaaacaagctcatagtcctcgactcttttgacccattagtggccgacccggacgacagggaaat

SEQ ID NO: 113288 - DNA, 75 bp, Artificial Sequence
  Synthetic
ggtcgagtctgaaaacaagctcatagtcctcgactcttttgacccattagtggccgagccggacgacagggaaat

SEQ ID NO: 113289 - DNA, 75 bp, Artificial Sequence
  Synthetic
ggtcgagtctgaaaacaaggtcatagtcctcgactcttttgacccattagtggccgaaccggacgacagggaaat

SEQ ID NO: 113290 - DNA, 75 bp, Artificial Sequence
  Synthetic
ggtcgagtctgaaaacaaggtcatagtcctcgactcttttgacccattagtggccgatccggacgacagggaaat

SEQ ID NO: 113291 - DNA, 75 bp, Artificial Sequence
  Synthetic
ggtcgagtctgaaaacaaggtcatagtcctcgactcttttgacccattagtggccgacccggacgacagggaaat

SEQ ID NO: 113292 - DNA, 75 bp, Artificial Sequence
  Synthetic
ggtcgagtctgaaaacaaggtcatagtcctcgactcttttgacccattagtggccgagccggacgacagggaaat

SEQ ID NO: 113293 - DNA, 75 bp, Artificial Sequence
  Synthetic
aatgaaacctgcttgacacaccccatcacaaaatacctcatggcatgcatgtcagccgatctggaagtaaccacc

SEQ ID NO: 113294 - DNA, 75 bp, Artificial Sequence
  Synthetic
tgccagggccctggcgcatggcgtccgggttctggaggacggcgtgaactatgcaacagggaatttgcccggttg

SEQ ID NO: 113295 - DNA, 75 bp, Artificial Sequence
  Synthetic
tggaaagcgccggattacgacccccccaccgtgtcggggtgtgcgctgcccccaaaagggctgccacccgtaccc

SEQ ID NO: 113296 - DNA, 75 bp, Artificial Sequence
  Synthetic
tggaaagcgccggattacgacccccccaccgtgtcggggtgtgcgctgcccccaaatgggctgccacccgtaccc

SEQ ID NO: 113297 - DNA, 75 bp, Artificial Sequence
  Synthetic
tggaaagcgccggattacgacccccccaccgtgtcggggtgtgcgctgcccccaaacgggctgccacccgtaccc

SEQ ID NO: 113298 - DNA, 75 bp, Artificial Sequence
  Synthetic
tggaaagcgccggattacgacccccccaccgtgtcggggtgtgcgctgcccccaaaggggctgccacccgtaccc

SEQ ID NO: 113299 - DNA, 75 bp, Artificial Sequence
  Synthetic
cgggggccctggttacaccgtgcgctgctgaagaagagaagttgccgattagcccattgagcaactctctcataa

SEQ ID NO: 113300 - DNA, 75 bp, Artificial Sequence
  Synthetic
agcgctcgccgagatggcccggaaatcttttccaacaaatccatcagagcctgaggagcccgcggtggggacctc

SEQ ID NO: 113301 - DNA, 75 bp, Artificial Sequence
  Synthetic
agcgctcgccgagatggcccggaaatcttttccaacaaatccatcagagcctgaggagcccgcggtggggtcctc

SEQ ID NO: 113302 - DNA, 75 bp, Artificial Sequence
  Synthetic
agcgctcgccgagatggcccggaaatcttttccaacaaatccatcagagcctgaggagcccgcggtggggccctc

SEQ ID NO: 113303 - DNA, 75 bp, Artificial Sequence
  Synthetic
agcgctcgccgagatggcccggaaatcttttccaacaaatccatcagagcctgaggagcccgcggtgggggcctc

SEQ ID NO: 113304 - DNA, 75 bp, Artificial Sequence
  Synthetic
agcgctcgccgagatggcccggaaatcttttccaactaatccatcagagcctgaggagcccgcggtggggacctc

SEQ ID NO: 113305 - DNA, 75 bp, Artificial Sequence
  Synthetic
agcgctcgccgagatggcccggaaatcttttccaactaatccatcagagcctgaggagcccgcggtggggtcctc

SEQ ID NO: 113306 - DNA, 75 bp, Artificial Sequence
  Synthetic
agcgctcgccgagatggcccggaaatcttttccaactaatccatcagagcctgaggagcccgcggtggggccctc

SEQ ID NO: 113307 - DNA, 75 bp, Artificial Sequence
  Synthetic
agcgctcgccgagatggcccggaaatcttttccaactaatccatcagagcctgaggagcccgcggtgggggcctc

SEQ ID NO: 113308 - DNA, 75 bp, Artificial Sequence
  Synthetic
agcgctcgccgagatggcccggaaatcttttccaaccaatccatcagagcctgaggagcccgcggtggggacctc

SEQ ID NO: 113309 - DNA, 75 bp, Artificial Sequence
  Synthetic
agcgctcgccgagatggcccggaaatcttttccaaccaatccatcagagcctgaggagcccgcggtggggtcctc

SEQ ID NO: 113310 - DNA, 75 bp, Artificial Sequence
  Synthetic
agcgctcgccgagatggcccggaaatcttttccaaccaatccatcagagcctgaggagcccgcggtggggccctc

SEQ ID NO: 113311 - DNA, 75 bp, Artificial Sequence
  Synthetic
agcgctcgccgagatggcccggaaatcttttccaaccaatccatcagagcctgaggagcccgcggtgggggcctc

SEQ ID NO: 113312 - DNA, 75 bp, Artificial Sequence
  Synthetic
agcgctcgccgagatggcccggaaatcttttccaacgaatccatcagagcctgaggagcccgcggtggggacctc

SEQ ID NO: 113313 - DNA, 75 bp, Artificial Sequence
  Synthetic
agcgctcgccgagatggcccggaaatcttttccaacgaatccatcagagcctgaggagcccgcggtggggtcctc

SEQ ID NO: 113314 - DNA, 75 bp, Artificial Sequence
  Synthetic
agcgctcgccgagatggcccggaaatcttttccaacgaatccatcagagcctgaggagcccgcggtggggccctc

SEQ ID NO: 113315 - DNA, 75 bp, Artificial Sequence
  Synthetic
agcgctcgccgagatggcccggaaatcttttccaacgaatccatcagagcctgaggagcccgcggtgggggcctc

SEQ ID NO: 113316 - DNA, 75 bp, Artificial Sequence
  Synthetic
agcgctcgccgagatggcccggaaatcttttccatcaaatccatcagagcctgaggagcccgcggtggggacctc

SEQ ID NO: 113317 - DNA, 75 bp, Artificial Sequence
  Synthetic
agcgctcgccgagatggcccggaaatcttttccatcaaatccatcagagcctgaggagcccgcggtggggtcctc

SEQ ID NO: 113318 - DNA, 75 bp, Artificial Sequence
  Synthetic
agcgctcgccgagatggcccggaaatcttttccatcaaatccatcagagcctgaggagcccgcggtggggccctc

SEQ ID NO: 113319 - DNA, 75 bp, Artificial Sequence
  Synthetic
agcgctcgccgagatggcccggaaatcttttccatcaaatccatcagagcctgaggagcccgcggtgggggcctc

SEQ ID NO: 113320 - DNA, 75 bp, Artificial Sequence
  Synthetic
agcgctcgccgagatggcccggaaatcttttccatctaatccatcagagcctgaggagcccgcggtggggacctc

SEQ ID NO: 113321 - DNA, 75 bp, Artificial Sequence
  Synthetic
agcgctcgccgagatggcccggaaatcttttccatctaatccatcagagcctgaggagcccgcggtggggtcctc

SEQ ID NO: 113322 - DNA, 75 bp, Artificial Sequence
  Synthetic
agcgctcgccgagatggcccggaaatcttttccatctaatccatcagagcctgaggagcccgcggtggggccctc

SEQ ID NO: 113323 - DNA, 75 bp, Artificial Sequence
  Synthetic
agcgctcgccgagatggcccggaaatcttttccatctaatccatcagagcctgaggagcccgcggtgggggcctc

SEQ ID NO: 113324 - DNA, 75 bp, Artificial Sequence
  Synthetic
agcgctcgccgagatggcccggaaatcttttccatccaatccatcagagcctgaggagcccgcggtggggacctc

SEQ ID NO: 113325 - DNA, 75 bp, Artificial Sequence
  Synthetic
agcgctcgccgagatggcccggaaatcttttccatccaatccatcagagcctgaggagcccgcggtggggtcctc

SEQ ID NO: 113326 - DNA, 75 bp, Artificial Sequence
  Synthetic
agcgctcgccgagatggcccggaaatcttttccatccaatccatcagagcctgaggagcccgcggtggggccctc

SEQ ID NO: 113327 - DNA, 75 bp, Artificial Sequence
  Synthetic
agcgctcgccgagatggcccggaaatcttttccatccaatccatcagagcctgaggagcccgcggtgggggcctc

SEQ ID NO: 113328 - DNA, 75 bp, Artificial Sequence
  Synthetic
agcgctcgccgagatggcccggaaatcttttccatcgaatccatcagagcctgaggagcccgcggtggggacctc

SEQ ID NO: 113329 - DNA, 75 bp, Artificial Sequence
  Synthetic
agcgctcgccgagatggcccggaaatcttttccatcgaatccatcagagcctgaggagcccgcggtggggtcctc

SEQ ID NO: 113330 - DNA, 75 bp, Artificial Sequence
  Synthetic
agcgctcgccgagatggcccggaaatcttttccatcgaatccatcagagcctgaggagcccgcggtggggccctc

SEQ ID NO: 113331 - DNA, 75 bp, Artificial Sequence
  Synthetic
agcgctcgccgagatggcccggaaatcttttccatcgaatccatcagagcctgaggagcccgcggtgggggcctc

SEQ ID NO: 113332 - DNA, 75 bp, Artificial Sequence
  Synthetic
agcgctcgccgagatggcccggaaatcttttccaccaaatccatcagagcctgaggagcccgcggtggggacctc

SEQ ID NO: 113333 - DNA, 75 bp, Artificial Sequence
  Synthetic
agcgctcgccgagatggcccggaaatcttttccaccaaatccatcagagcctgaggagcccgcggtggggtcctc

SEQ ID NO: 113334 - DNA, 75 bp, Artificial Sequence
  Synthetic
agcgctcgccgagatggcccggaaatcttttccaccaaatccatcagagcctgaggagcccgcggtggggccctc

SEQ ID NO: 113335 - DNA, 75 bp, Artificial Sequence
  Synthetic
agcgctcgccgagatggcccggaaatcttttccaccaaatccatcagagcctgaggagcccgcggtgggggcctc

SEQ ID NO: 113336 - DNA, 75 bp, Artificial Sequence
  Synthetic
agcgctcgccgagatggcccggaaatcttttccacctaatccatcagagcctgaggagcccgcggtggggacctc

SEQ ID NO: 113337 - DNA, 75 bp, Artificial Sequence
  Synthetic
agcgctcgccgagatggcccggaaatcttttccacctaatccatcagagcctgaggagcccgcggtggggtcctc

SEQ ID NO: 113338 - DNA, 75 bp, Artificial Sequence
  Synthetic
agcgctcgccgagatggcccggaaatcttttccacctaatccatcagagcctgaggagcccgcggtggggccctc

SEQ ID NO: 113339 - DNA, 75 bp, Artificial Sequence
  Synthetic
agcgctcgccgagatggcccggaaatcttttccacctaatccatcagagcctgaggagcccgcggtgggggcctc

SEQ ID NO: 113340 - DNA, 75 bp, Artificial Sequence
  Synthetic
agcgctcgccgagatggcccggaaatcttttccacccaatccatcagagcctgaggagcccgcggtggggacctc

SEQ ID NO: 113341 - DNA, 75 bp, Artificial Sequence
  Synthetic
agcgctcgccgagatggcccggaaatcttttccacccaatccatcagagcctgaggagcccgcggtggggtcctc

SEQ ID NO: 113342 - DNA, 75 bp, Artificial Sequence
  Synthetic
agcgctcgccgagatggcccggaaatcttttccacccaatccatcagagcctgaggagcccgcggtggggccctc

SEQ ID NO: 113343 - DNA, 75 bp, Artificial Sequence
  Synthetic
agcgctcgccgagatggcccggaaatcttttccacccaatccatcagagcctgaggagcccgcggtgggggcctc

SEQ ID NO: 113344 - DNA, 75 bp, Artificial Sequence
  Synthetic
agcgctcgccgagatggcccggaaatcttttccaccgaatccatcagagcctgaggagcccgcggtggggacctc

SEQ ID NO: 113345 - DNA, 75 bp, Artificial Sequence
  Synthetic
agcgctcgccgagatggcccggaaatcttttccaccgaatccatcagagcctgaggagcccgcggtggggtcctc

SEQ ID NO: 113346 - DNA, 75 bp, Artificial Sequence
  Synthetic
agcgctcgccgagatggcccggaaatcttttccaccgaatccatcagagcctgaggagcccgcggtggggccctc

SEQ ID NO: 113347 - DNA, 75 bp, Artificial Sequence
  Synthetic
agcgctcgccgagatggcccggaaatcttttccaccgaatccatcagagcctgaggagcccgcggtgggggcctc

SEQ ID NO: 113348 - DNA, 75 bp, Artificial Sequence
  Synthetic
agcgctcgccgagatggcccggaaatcttttccagcaaatccatcagagcctgaggagcccgcggtggggacctc

SEQ ID NO: 113349 - DNA, 75 bp, Artificial Sequence
  Synthetic
agcgctcgccgagatggcccggaaatcttttccagcaaatccatcagagcctgaggagcccgcggtggggtcctc

SEQ ID NO: 113350 - DNA, 75 bp, Artificial Sequence
  Synthetic
agcgctcgccgagatggcccggaaatcttttccagcaaatccatcagagcctgaggagcccgcggtggggccctc

SEQ ID NO: 113351 - DNA, 75 bp, Artificial Sequence
  Synthetic
agcgctcgccgagatggcccggaaatcttttccagcaaatccatcagagcctgaggagcccgcggtgggggcctc

SEQ ID NO: 113352 - DNA, 75 bp, Artificial Sequence
  Synthetic
agcgctcgccgagatggcccggaaatcttttccagctaatccatcagagcctgaggagcccgcggtggggacctc

SEQ ID NO: 113353 - DNA, 75 bp, Artificial Sequence
  Synthetic
agcgctcgccgagatggcccggaaatcttttccagctaatccatcagagcctgaggagcccgcggtggggtcctc

SEQ ID NO: 113354 - DNA, 75 bp, Artificial Sequence
  Synthetic
agcgctcgccgagatggcccggaaatcttttccagctaatccatcagagcctgaggagcccgcggtggggccctc

SEQ ID NO: 113355 - DNA, 75 bp, Artificial Sequence
  Synthetic
agcgctcgccgagatggcccggaaatcttttccagctaatccatcagagcctgaggagcccgcggtgggggcctc

SEQ ID NO: 113356 - DNA, 75 bp, Artificial Sequence
  Synthetic
agcgctcgccgagatggcccggaaatcttttccagccaatccatcagagcctgaggagcccgcggtggggacctc

SEQ ID NO: 113357 - DNA, 75 bp, Artificial Sequence
  Synthetic
agcgctcgccgagatggcccggaaatcttttccagccaatccatcagagcctgaggagcccgcggtggggtcctc

SEQ ID NO: 113358 - DNA, 75 bp, Artificial Sequence
  Synthetic
agcgctcgccgagatggcccggaaatcttttccagccaatccatcagagcctgaggagcccgcggtggggccctc

SEQ ID NO: 113359 - DNA, 75 bp, Artificial Sequence
  Synthetic
agcgctcgccgagatggcccggaaatcttttccagccaatccatcagagcctgaggagcccgcggtgggggcctc

SEQ ID NO: 113360 - DNA, 75 bp, Artificial Sequence
  Synthetic
agcgctcgccgagatggcccggaaatcttttccagcgaatccatcagagcctgaggagcccgcggtggggacctc

SEQ ID NO: 113361 - DNA, 75 bp, Artificial Sequence
  Synthetic
agcgctcgccgagatggcccggaaatcttttccagcgaatccatcagagcctgaggagcccgcggtggggtcctc

SEQ ID NO: 113362 - DNA, 75 bp, Artificial Sequence
  Synthetic
agcgctcgccgagatggcccggaaatcttttccagcgaatccatcagagcctgaggagcccgcggtggggccctc

SEQ ID NO: 113363 - DNA, 75 bp, Artificial Sequence
  Synthetic
agcgctcgccgagatggcccggaaatcttttccagcgaatccatcagagcctgaggagcccgcggtgggggcctc

SEQ ID NO: 113364 - DNA, 75 bp, Artificial Sequence
  Synthetic
tccaggtggtagaccagcactatcatgatgttctcaaggagatgaaggatcgggcctctagggtgaacgccaggc

SEQ ID NO: 113365 - DNA, 75 bp, Artificial Sequence
  Synthetic
tccaggtggttgaccagcactatcatgatgttctcaaggagatgaaggatcgggcctctagggtgaacgccaggc

SEQ ID NO: 113366 - DNA, 75 bp, Artificial Sequence
  Synthetic
tccaggtggtcgaccagcactatcatgatgttctcaaggagatgaaggatcgggcctctagggtgaacgccaggc

SEQ ID NO: 113367 - DNA, 75 bp, Artificial Sequence
  Synthetic
tccaggtggtggaccagcactatcatgatgttctcaaggagatgaaggatcgggcctctagggtgaacgccaggc

SEQ ID NO: 113368 - DNA, 75 bp, Artificial Sequence
  Synthetic
gaccccgacttaagctcgggatcatggtctacagtcagtgaggatggcgagactgaacacgacaatgttgtgtgt

SEQ ID NO: 113369 - DNA, 75 bp, Artificial Sequence
  Synthetic
gaccccgacttaagctcgggatcatggtctacagtcagtgaggatggcgagactgaacacgacattgttgtgtgt

SEQ ID NO: 113370 - DNA, 75 bp, Artificial Sequence
  Synthetic
gaccccgacttaagctcgggatcatggtctacagtcagtgaggatggcgagactgaacacgacactgttgtgtgt

SEQ ID NO: 113371 - DNA, 75 bp, Artificial Sequence
  Synthetic
gaccccgacttaagctcgggatcatggtctacagtcagtgaggatggcgagactgaacacgacagtgttgtgtgt

SEQ ID NO: 113372 - DNA, 75 bp, Artificial Sequence
  Synthetic
gaccccgacttaagctcgggatcatggtctacagtcagtgaggatggcgagtctgaacacgacaatgttgtgtgt

SEQ ID NO: 113373 - DNA, 75 bp, Artificial Sequence
  Synthetic
gaccccgacttaagctcgggatcatggtctacagtcagtgaggatggcgagtctgaacacgacattgttgtgtgt

SEQ ID NO: 113374 - DNA, 75 bp, Artificial Sequence
  Synthetic
gaccccgacttaagctcgggatcatggtctacagtcagtgaggatggcgagtctgaacacgacactgttgtgtgt

SEQ ID NO: 113375 - DNA, 75 bp, Artificial Sequence
  Synthetic
gaccccgacttaagctcgggatcatggtctacagtcagtgaggatggcgagtctgaacacgacagtgttgtgtgt

SEQ ID NO: 113376 - DNA, 75 bp, Artificial Sequence
  Synthetic
gaccccgacttaagctcgggatcatggtctacagtcagtgaggatggcgagcctgaacacgacaatgttgtgtgt

SEQ ID NO: 113377 - DNA, 75 bp, Artificial Sequence
  Synthetic
gaccccgacttaagctcgggatcatggtctacagtcagtgaggatggcgagcctgaacacgacattgttgtgtgt

SEQ ID NO: 113378 - DNA, 75 bp, Artificial Sequence
  Synthetic
gaccccgacttaagctcgggatcatggtctacagtcagtgaggatggcgagcctgaacacgacactgttgtgtgt

SEQ ID NO: 113379 - DNA, 75 bp, Artificial Sequence
  Synthetic
gaccccgacttaagctcgggatcatggtctacagtcagtgaggatggcgagcctgaacacgacagtgttgtgtgt

SEQ ID NO: 113380 - DNA, 75 bp, Artificial Sequence
  Synthetic
gaccccgacttaagctcgggatcatggtctacagtcagtgaggatggcgaggctgaacacgacaatgttgtgtgt

SEQ ID NO: 113381 - DNA, 75 bp, Artificial Sequence
  Synthetic
gaccccgacttaagctcgggatcatggtctacagtcagtgaggatggcgaggctgaacacgacattgttgtgtgt

SEQ ID NO: 113382 - DNA, 75 bp, Artificial Sequence
  Synthetic
gaccccgacttaagctcgggatcatggtctacagtcagtgaggatggcgaggctgaacacgacactgttgtgtgt

SEQ ID NO: 113383 - DNA, 75 bp, Artificial Sequence
  Synthetic
gaccccgacttaagctcgggatcatggtctacagtcagtgaggatggcgaggctgaacacgacagtgttgtgtgt

SEQ ID NO: 113384 - DNA, 75 bp, Artificial Sequence
  Synthetic
acatctatttcgggggtcctctggacggtatatcacggggctggtaataagaccttggctggccccaaaggacca

SEQ ID NO: 113385 - DNA, 75 bp, Artificial Sequence
  Synthetic
cattaaccacatcaactccgtgtgggaggacttactagaagacagttccacacctattcctacaaccattatggc

SEQ ID NO: 113386 - DNA, 75 bp, Artificial Sequence
  Synthetic
accataatctagtgtattctaccaccactcgcagtgcagccctccgccagaagaaggtgacttttgacagggtcc

SEQ ID NO: 113387 - DNA, 75 bp, Artificial Sequence
  Synthetic
gcactttacgacatcacccgcaagctgcctgaagcagtaatgggagcctcttacggtttccagtactcgccaaag

SEQ ID NO: 113388 - DNA, 75 bp, Artificial Sequence
  Synthetic
tcgacctgtatctggtcacgcggaacgctgatgtcatcccggctcgaagacgcggggacaagcggggagcgttgc

SEQ ID NO: 113389 - DNA, 75 bp, Artificial Sequence
  Synthetic
ttaccggggccttgatgtgtccgtcataccgactagcggagacgtcgttgtcgtggcaacagacgctctaatgac

SEQ ID NO: 113390 - DNA, 75 bp, Artificial Sequence
  Synthetic
aatgactgtcctaacagcagcatcgtgtatgaggcggaagacatcattctgcatctccctggctgtgtaccttgc

SEQ ID NO: 113391 - DNA, 75 bp, Artificial Sequence
  Synthetic
tctcaacggaggaggcgtgcaagctcacccccccgcactcggctcgctccaagttcgggtacggggccaaggagg

SEQ ID NO: 113392 - DNA, 75 bp, Artificial Sequence
  Synthetic
gcatctccctggctgtgtaccttgcgtcaaaactggtaacaccagcaagtgttggacaccggcctcgcctacgct

SEQ ID NO: 113393 - DNA, 75 bp, Artificial Sequence
  Synthetic
ctggactctttcgacccgctccgagcggaggaggatgagagggaagtatccgttccggcggagatcttgcggaaa

SEQ ID NO: 113394 - DNA, 75 bp, Artificial Sequence
  Synthetic
acattcaagttgaacattccatataccagtgctgccagttagagccggccgcacggaaggccatcacttctctca

SEQ ID NO: 113395 - DNA, 75 bp, Artificial Sequence
  Synthetic
acattcaagttgaacattccatttaccagtgctgccagttagagccggccgcacggaaggccatcacttctctca

SEQ ID NO: 113396 - DNA, 75 bp, Artificial Sequence
  Synthetic
acattcaagttgaacattccatctaccagtgctgccagttagagccggccgcacggaaggccatcacttctctca

SEQ ID NO: 113397 - DNA, 75 bp, Artificial Sequence
  Synthetic
acattcaagttgaacattccatgtaccagtgctgccagttagagccggccgcacggaaggccatcacttctctca

SEQ ID NO: 113398 - DNA, 75 bp, Artificial Sequence
  Synthetic
taaacaccaacggcagctggcacatcaacaggactgccctgaattgcaatgactccctccagactgggttccttg

SEQ ID NO: 113399 - DNA, 75 bp, Artificial Sequence
  Synthetic
cacggacgcccagtttctctgacaacagcacgccaccagctgtgcctcagacttaccaggtgggctacttgcacg

SEQ ID NO: 113400 - DNA, 75 bp, Artificial Sequence
  Synthetic
ccccagacctatcaggtcgggtacttgcatgccccaactggcagtggaaagagtaccaaggtccctgtcgcgtac

SEQ ID NO: 113401 - DNA, 75 bp, Artificial Sequence
  Synthetic
caactcgtccggatgcccagagcgtatggccagctgtcgctccattgacaaattcgctcaggggtggggtcccat

SEQ ID NO: 113402 - DNA, 75 bp, Artificial Sequence
  Synthetic
caataccttgacatgctacctgaaagcacaggctgcgtgtagggctgccaggctcaaggactttgacatgttggt

SEQ ID NO: 113403 - DNA, 75 bp, Artificial Sequence
  Synthetic
caataccttgacatgctacctgaaagcacaggctgcgtgtagggctgcctggctcaaggactttgacatgttggt

SEQ ID NO: 113404 - DNA, 75 bp, Artificial Sequence
  Synthetic
caataccttgacatgctacctgaaagcacaggctgcgtgtagggctgcccggctcaaggactttgacatgttggt

SEQ ID NO: 113405 - DNA, 75 bp, Artificial Sequence
  Synthetic
caataccttgacatgctacctgaaagcacaggctgcgtgtagggctgccgggctcaaggactttgacatgttggt

SEQ ID NO: 113406 - DNA, 75 bp, Artificial Sequence
  Synthetic
gaccagaggccttattgctggcactacgcacctaaaccgtgtggtattgtacccgcgtcgcaggtgtgtggtcca

SEQ ID NO: 113407 - DNA, 75 bp, Artificial Sequence
  Synthetic
ggctcaaggactttgacatgttggtctgcggagacgatcttgtcatcatttcggagagcttaggagactcggagg

SEQ ID NO: 113408 - DNA, 75 bp, Artificial Sequence
  Synthetic
ggctcaaggactttgacatgttggtctgcggagacgatcttgtcatcatttcggagagcttaggagtctcggagg

SEQ ID NO: 113409 - DNA, 75 bp, Artificial Sequence
  Synthetic
ggctcaaggactttgacatgttggtctgcggagacgatcttgtcatcatttcggagagcttaggagcctcggagg

SEQ ID NO: 113410 - DNA, 75 bp, Artificial Sequence
  Synthetic
ggctcaaggactttgacatgttggtctgcggagacgatcttgtcatcatttcggagagcttaggaggctcggagg

SEQ ID NO: 113411 - DNA, 75 bp, Artificial Sequence
  Synthetic
acccgcgtcgcaggtgtgtggtccagtgtattgcttcaccccgagccctgttgtggtggggacgaccgatcgttt

SEQ ID NO: 113412 - DNA, 75 bp, Artificial Sequence
  Synthetic
tgctaagatcatgccattgctccctgggttgcccttcatttcctgtcaaaagggatataagggcgtttggcaggg

SEQ ID NO: 113413 - DNA, 75 bp, Artificial Sequence
  Synthetic
ggtgtggacgcgcatacctacaccaccgggggggttgcggcccacacagcaagcgggttcacaagtttgtttaaa

SEQ ID NO: 113414 - DNA, 75 bp, Artificial Sequence
  Synthetic
cacgacaacaatggacagagatactactacctcacaagagacccaaccatacctctctcccgagcggcttgggaa

SEQ ID NO: 113415 - DNA, 75 bp, Artificial Sequence
  Synthetic
caaatacatcatggcatgcatgtcagctgacttggaggtcgtcaccagcacctgggtgctggtgggcggagtcct

SEQ ID NO: 113416 - DNA, 75 bp, Artificial Sequence
  Synthetic
cgcagccctggccgcatattgcttgacaacaggcagcgtggtcattgtgggcaggatcaacttgtccgggagacc

SEQ ID NO: 113417 - DNA, 75 bp, Artificial Sequence
  Synthetic
tggcagcgctgttctatacccacaagttcaactcctctggttgtcccgagcgcttatcatcttgcaaaccgctca

SEQ ID NO: 113418 - DNA, 75 bp, Artificial Sequence
  Synthetic
acgatcttgagctgattacatcctgctcttcaaacgtatccgtagcccacgacaacaacggacagagataatact

SEQ ID NO: 113419 - DNA, 75 bp, Artificial Sequence
  Synthetic
acgatcttgagctgattacatcctgctcttcaaacgtatccgtagcccacgacaacaacggacagagatattact

SEQ ID NO: 113420 - DNA, 75 bp, Artificial Sequence
  Synthetic
acgatcttgagctgattacatcctgctcttcaaacgtatccgtagcccacgacaacaacggacagagatactact

SEQ ID NO: 113421 - DNA, 75 bp, Artificial Sequence
  Synthetic
acgatcttgagctgattacatcctgctcttcaaacgtatccgtagcccacgacaacaacggacagagatagtact

SEQ ID NO: 113422 - DNA, 75 bp, Artificial Sequence
  Synthetic
gacagggatagatcagagcttagcccgctgctactgtccacaacagagtggcaggtactgccctgttccttcacc

SEQ ID NO: 113423 - DNA, 75 bp, Artificial Sequence
  Synthetic
gaccatatcagcaagagatgtctgtggccccgtctactgcttcaccccaagtccggtcgtggtagggaccactga

SEQ ID NO: 113424 - DNA, 75 bp, Artificial Sequence
  Synthetic
gaccatatctgcaagagatgtctgtggccccgtctactgcttcaccccaagtccggtcgtggtagggaccactga

SEQ ID NO: 113425 - DNA, 75 bp, Artificial Sequence
  Synthetic
gaccatatccgcaagagatgtctgtggccccgtctactgcttcaccccaagtccggtcgtggtagggaccactga

SEQ ID NO: 113426 - DNA, 75 bp, Artificial Sequence
  Synthetic
gaccatatcggcaagagatgtctgtggccccgtctactgcttcaccccaagtccggtcgtggtagggaccactga

SEQ ID NO: 113427 - DNA, 75 bp, Artificial Sequence
  Synthetic
tcccacaatatgggtacgcatggtactgatgactcatttctttggaatactccagtcccaagaaacactccataa

SEQ ID NO: 113428 - DNA, 75 bp, Artificial Sequence
  Synthetic
tggatgaattctacggggttcgtcaagacgtgcggggcgcctccctgtaacatcgggccaagaggcaacaactcc

SEQ ID NO: 113429 - DNA, 75 bp, Artificial Sequence
  Synthetic
acttgtgtttggcgacaagagatgggcagcaacatcacacgggtagagtccgaaacaaaggttgtgattcttgac

SEQ ID NO: 113430 - DNA, 75 bp, Artificial Sequence
  Synthetic
ccaggcccgaccccgcatgttacttctgtgcctactcctactatccgtaggggtaggcattttcttgcttcccgc

SEQ ID NO: 113431 - DNA, 75 bp, Artificial Sequence
  Synthetic
cgtcaggcttagagcgtacttcaacacgcctggcttgcctgtgtgccaagaccatcttgagttctgggaggcagt

SEQ ID NO: 113432 - DNA, 75 bp, Artificial Sequence
  Synthetic
cggtcccagccacgtgggaggcgccagcccatccctaaagatcggcgctccactggcaagtcctggggaaggcca

SEQ ID NO: 113433 - DNA, 75 bp, Artificial Sequence
  Synthetic
catgccaggttccggcccccgaatttttcacagaagtggatggggtacggttgcacaggtacgctccggcgtgca

SEQ ID NO: 113434 - DNA, 75 bp, Artificial Sequence
  Synthetic
cgagctctcgatcttaccatgctcattttccactatgccagccttatcaactggcttaatacacctccatcagaa

SEQ ID NO: 113435 - DNA, 75 bp, Artificial Sequence
  Synthetic
gggtcgtaccacctcgggcctcgctggcctcttcaccactggtcccaggcagaatctccagctgatcaacaccaa

SEQ ID NO: 113436 - DNA, 75 bp, Artificial Sequence
  Synthetic
aaaagaacaatccagctggacggctccaatgtgtccgcggcgctagctgcgctagcggaaaaatcattcccggcc

SEQ ID NO: 113437 - DNA, 75 bp, Artificial Sequence
  Synthetic
acctgcctctttcgaggcgacactccaccatggatcactcccctgtgaggaacttctgtcttcacgcggaaagcg

SEQ ID NO: 113438 - DNA, 75 bp, Artificial Sequence
  Synthetic
attccccttgaatacatcaagggaggtaggcatctaatcttctgccagtcaaagaagaagtgcgaagagctggcc

SEQ ID NO: 113439 - DNA, 75 bp, Artificial Sequence
  Synthetic
attccccttgaatacatcaagggaggtaggcatctaatcttctgccagtcaaagaagaagtgcgatgagctggcc

SEQ ID NO: 113440 - DNA, 75 bp, Artificial Sequence
  Synthetic
attccccttgaatacatcaagggaggtaggcatctaatcttctgccagtcaaagaagaagtgcgacgagctggcc

SEQ ID NO: 113441 - DNA, 75 bp, Artificial Sequence
  Synthetic
attccccttgaatacatcaagggaggtaggcatctaatcttctgccagtcaaagaagaagtgcgaggagctggcc

SEQ ID NO: 113442 - DNA, 75 bp, Artificial Sequence
  Synthetic
attccccttgaatacatcaagggaggtaggcatctaatcttctgccagtctaagaagaagtgcgaagagctggcc

SEQ ID NO: 113443 - DNA, 75 bp, Artificial Sequence
  Synthetic
attccccttgaatacatcaagggaggtaggcatctaatcttctgccagtctaagaagaagtgcgatgagctggcc

SEQ ID NO: 113444 - DNA, 75 bp, Artificial Sequence
  Synthetic
attccccttgaatacatcaagggaggtaggcatctaatcttctgccagtctaagaagaagtgcgacgagctggcc

SEQ ID NO: 113445 - DNA, 75 bp, Artificial Sequence
  Synthetic
attccccttgaatacatcaagggaggtaggcatctaatcttctgccagtctaagaagaagtgcgaggagctggcc

SEQ ID NO: 113446 - DNA, 75 bp, Artificial Sequence
  Synthetic
attccccttgaatacatcaagggaggtaggcatctaatcttctgccagtccaagaagaagtgcgaagagctggcc

SEQ ID NO: 113447 - DNA, 75 bp, Artificial Sequence
  Synthetic
attccccttgaatacatcaagggaggtaggcatctaatcttctgccagtccaagaagaagtgcgatgagctggcc

SEQ ID NO: 113448 - DNA, 75 bp, Artificial Sequence
  Synthetic
attccccttgaatacatcaagggaggtaggcatctaatcttctgccagtccaagaagaagtgcgacgagctggcc

SEQ ID NO: 113449 - DNA, 75 bp, Artificial Sequence
  Synthetic
attccccttgaatacatcaagggaggtaggcatctaatcttctgccagtccaagaagaagtgcgaggagctggcc

SEQ ID NO: 113450 - DNA, 75 bp, Artificial Sequence
  Synthetic
attccccttgaatacatcaagggaggtaggcatctaatcttctgccagtcgaagaagaagtgcgaagagctggcc

SEQ ID NO: 113451 - DNA, 75 bp, Artificial Sequence
  Synthetic
attccccttgaatacatcaagggaggtaggcatctaatcttctgccagtcgaagaagaagtgcgatgagctggcc

SEQ ID NO: 113452 - DNA, 75 bp, Artificial Sequence
  Synthetic
attccccttgaatacatcaagggaggtaggcatctaatcttctgccagtcgaagaagaagtgcgacgagctggcc

SEQ ID NO: 113453 - DNA, 75 bp, Artificial Sequence
  Synthetic
attccccttgaatacatcaagggaggtaggcatctaatcttctgccagtcgaagaagaagtgcgaggagctggcc

SEQ ID NO: 113454 - DNA, 75 bp, Artificial Sequence
  Synthetic
attccccttgaatacatcaagggtggtaggcatctaatcttctgccagtcaaagaagaagtgcgaagagctggcc

SEQ ID NO: 113455 - DNA, 75 bp, Artificial Sequence
  Synthetic
attccccttgaatacatcaagggtggtaggcatctaatcttctgccagtcaaagaagaagtgcgatgagctggcc

SEQ ID NO: 113456 - DNA, 75 bp, Artificial Sequence
  Synthetic
attccccttgaatacatcaagggtggtaggcatctaatcttctgccagtcaaagaagaagtgcgacgagctggcc

SEQ ID NO: 113457 - DNA, 75 bp, Artificial Sequence
  Synthetic
attccccttgaatacatcaagggtggtaggcatctaatcttctgccagtcaaagaagaagtgcgaggagctggcc

SEQ ID NO: 113458 - DNA, 75 bp, Artificial Sequence
  Synthetic
attccccttgaatacatcaagggtggtaggcatctaatcttctgccagtctaagaagaagtgcgaagagctggcc

SEQ ID NO: 113459 - DNA, 75 bp, Artificial Sequence
  Synthetic
attccccttgaatacatcaagggtggtaggcatctaatcttctgccagtctaagaagaagtgcgatgagctggcc

SEQ ID NO: 113460 - DNA, 75 bp, Artificial Sequence
  Synthetic
attccccttgaatacatcaagggtggtaggcatctaatcttctgccagtctaagaagaagtgcgacgagctggcc

SEQ ID NO: 113461 - DNA, 75 bp, Artificial Sequence
  Synthetic
attccccttgaatacatcaagggtggtaggcatctaatcttctgccagtctaagaagaagtgcgaggagctggcc

SEQ ID NO: 113462 - DNA, 75 bp, Artificial Sequence
  Synthetic
attccccttgaatacatcaagggtggtaggcatctaatcttctgccagtccaagaagaagtgcgaagagctggcc

SEQ ID NO: 113463 - DNA, 75 bp, Artificial Sequence
  Synthetic
attccccttgaatacatcaagggtggtaggcatctaatcttctgccagtccaagaagaagtgcgatgagctggcc

SEQ ID NO: 113464 - DNA, 75 bp, Artificial Sequence
  Synthetic
attccccttgaatacatcaagggtggtaggcatctaatcttctgccagtccaagaagaagtgcgacgagctggcc

SEQ ID NO: 113465 - DNA, 75 bp, Artificial Sequence
  Synthetic
attccccttgaatacatcaagggtggtaggcatctaatcttctgccagtccaagaagaagtgcgaggagctggcc

SEQ ID NO: 113466 - DNA, 75 bp, Artificial Sequence
  Synthetic
attccccttgaatacatcaagggtggtaggcatctaatcttctgccagtcgaagaagaagtgcgaagagctggcc

SEQ ID NO: 113467 - DNA, 75 bp, Artificial Sequence
  Synthetic
attccccttgaatacatcaagggtggtaggcatctaatcttctgccagtcgaagaagaagtgcgatgagctggcc

SEQ ID NO: 113468 - DNA, 75 bp, Artificial Sequence
  Synthetic
attccccttgaatacatcaagggtggtaggcatctaatcttctgccagtcgaagaagaagtgcgacgagctggcc

SEQ ID NO: 113469 - DNA, 75 bp, Artificial Sequence
  Synthetic
attccccttgaatacatcaagggtggtaggcatctaatcttctgccagtcgaagaagaagtgcgaggagctggcc

SEQ ID NO: 113470 - DNA, 75 bp, Artificial Sequence
  Synthetic
attccccttgaatacatcaagggcggtaggcatctaatcttctgccagtcaaagaagaagtgcgaagagctggcc

SEQ ID NO: 113471 - DNA, 75 bp, Artificial Sequence
  Synthetic
attccccttgaatacatcaagggcggtaggcatctaatcttctgccagtcaaagaagaagtgcgatgagctggcc

SEQ ID NO: 113472 - DNA, 75 bp, Artificial Sequence
  Synthetic
attccccttgaatacatcaagggcggtaggcatctaatcttctgccagtcaaagaagaagtgcgacgagctggcc

SEQ ID NO: 113473 - DNA, 75 bp, Artificial Sequence
  Synthetic
attccccttgaatacatcaagggcggtaggcatctaatcttctgccagtcaaagaagaagtgcgaggagctggcc

SEQ ID NO: 113474 - DNA, 75 bp, Artificial Sequence
  Synthetic
attccccttgaatacatcaagggcggtaggcatctaatcttctgccagtctaagaagaagtgcgaagagctggcc

SEQ ID NO: 113475 - DNA, 75 bp, Artificial Sequence
  Synthetic
attccccttgaatacatcaagggcggtaggcatctaatcttctgccagtctaagaagaagtgcgatgagctggcc

SEQ ID NO: 113476 - DNA, 75 bp, Artificial Sequence
  Synthetic
attccccttgaatacatcaagggcggtaggcatctaatcttctgccagtctaagaagaagtgcgacgagctggcc

SEQ ID NO: 113477 - DNA, 75 bp, Artificial Sequence
  Synthetic
attccccttgaatacatcaagggcggtaggcatctaatcttctgccagtctaagaagaagtgcgaggagctggcc

SEQ ID NO: 113478 - DNA, 75 bp, Artificial Sequence
  Synthetic
attccccttgaatacatcaagggcggtaggcatctaatcttctgccagtccaagaagaagtgcgaagagctggcc

SEQ ID NO: 113479 - DNA, 75 bp, Artificial Sequence
  Synthetic
attccccttgaatacatcaagggcggtaggcatctaatcttctgccagtccaagaagaagtgcgatgagctggcc

SEQ ID NO: 113480 - DNA, 75 bp, Artificial Sequence
  Synthetic
attccccttgaatacatcaagggcggtaggcatctaatcttctgccagtccaagaagaagtgcgacgagctggcc

SEQ ID NO: 113481 - DNA, 75 bp, Artificial Sequence
  Synthetic
attccccttgaatacatcaagggcggtaggcatctaatcttctgccagtccaagaagaagtgcgaggagctggcc

SEQ ID NO: 113482 - DNA, 75 bp, Artificial Sequence
  Synthetic
attccccttgaatacatcaagggcggtaggcatctaatcttctgccagtcgaagaagaagtgcgaagagctggcc

SEQ ID NO: 113483 - DNA, 75 bp, Artificial Sequence
  Synthetic
attccccttgaatacatcaagggcggtaggcatctaatcttctgccagtcgaagaagaagtgcgatgagctggcc

SEQ ID NO: 113484 - DNA, 75 bp, Artificial Sequence
  Synthetic
attccccttgaatacatcaagggcggtaggcatctaatcttctgccagtcgaagaagaagtgcgacgagctggcc

SEQ ID NO: 113485 - DNA, 75 bp, Artificial Sequence
  Synthetic
attccccttgaatacatcaagggcggtaggcatctaatcttctgccagtcgaagaagaagtgcgaggagctggcc

SEQ ID NO: 113486 - DNA, 75 bp, Artificial Sequence
  Synthetic
attccccttgaatacatcaaggggggtaggcatctaatcttctgccagtcaaagaagaagtgcgaagagctggcc

SEQ ID NO: 113487 - DNA, 75 bp, Artificial Sequence
  Synthetic
attccccttgaatacatcaaggggggtaggcatctaatcttctgccagtcaaagaagaagtgcgatgagctggcc

SEQ ID NO: 113488 - DNA, 75 bp, Artificial Sequence
  Synthetic
attccccttgaatacatcaaggggggtaggcatctaatcttctgccagtcaaagaagaagtgcgacgagctggcc

SEQ ID NO: 113489 - DNA, 75 bp, Artificial Sequence
  Synthetic
attccccttgaatacatcaaggggggtaggcatctaatcttctgccagtcaaagaagaagtgcgaggagctggcc

SEQ ID NO: 113490 - DNA, 75 bp, Artificial Sequence
  Synthetic
attccccttgaatacatcaaggggggtaggcatctaatcttctgccagtctaagaagaagtgcgaagagctggcc

SEQ ID NO: 113491 - DNA, 75 bp, Artificial Sequence
  Synthetic
attccccttgaatacatcaaggggggtaggcatctaatcttctgccagtctaagaagaagtgcgatgagctggcc

SEQ ID NO: 113492 - DNA, 75 bp, Artificial Sequence
  Synthetic
attccccttgaatacatcaaggggggtaggcatctaatcttctgccagtctaagaagaagtgcgacgagctggcc

SEQ ID NO: 113493 - DNA, 75 bp, Artificial Sequence
  Synthetic
attccccttgaatacatcaaggggggtaggcatctaatcttctgccagtctaagaagaagtgcgaggagctggcc

SEQ ID NO: 113494 - DNA, 75 bp, Artificial Sequence
  Synthetic
attccccttgaatacatcaaggggggtaggcatctaatcttctgccagtccaagaagaagtgcgaagagctggcc

SEQ ID NO: 113495 - DNA, 75 bp, Artificial Sequence
  Synthetic
attccccttgaatacatcaaggggggtaggcatctaatcttctgccagtccaagaagaagtgcgatgagctggcc

SEQ ID NO: 113496 - DNA, 75 bp, Artificial Sequence
  Synthetic
attccccttgaatacatcaaggggggtaggcatctaatcttctgccagtccaagaagaagtgcgacgagctggcc

SEQ ID NO: 113497 - DNA, 75 bp, Artificial Sequence
  Synthetic
attccccttgaatacatcaaggggggtaggcatctaatcttctgccagtccaagaagaagtgcgaggagctggcc

SEQ ID NO: 113498 - DNA, 75 bp, Artificial Sequence
  Synthetic
attccccttgaatacatcaaggggggtaggcatctaatcttctgccagtcgaagaagaagtgcgaagagctggcc

SEQ ID NO: 113499 - DNA, 75 bp, Artificial Sequence
  Synthetic
attccccttgaatacatcaaggggggtaggcatctaatcttctgccagtcgaagaagaagtgcgatgagctggcc

SEQ ID NO: 113500 - DNA, 75 bp, Artificial Sequence
  Synthetic
attccccttgaatacatcaaggggggtaggcatctaatcttctgccagtcgaagaagaagtgcgacgagctggcc

SEQ ID NO: 113501 - DNA, 75 bp, Artificial Sequence
  Synthetic
attccccttgaatacatcaaggggggtaggcatctaatcttctgccagtcgaagaagaagtgcgaggagctggcc

SEQ ID NO: 113502 - DNA, 75 bp, Artificial Sequence
  Synthetic
tgaagtccaagatccaaggcttattgcagcaagcctctaaacaggcccaggacatacaacccgctgtgcaggctt

SEQ ID NO: 113503 - DNA, 75 bp, Artificial Sequence
  Synthetic
tttggcagtttcaaggtgcagtgctccacacccctggatgtgtcccctgcgagaaggctaacaacaagtctcgat

SEQ ID NO: 113504 - DNA, 75 bp, Artificial Sequence
  Synthetic
agcggcattccatacctcgcaagactgtcacaactgccagggaacccggctgtggcttcaatgatggcattcaag

SEQ ID NO: 113505 - DNA, 75 bp, Artificial Sequence
  Synthetic
cagttaggctacgagcgtacatgaacaccccggggcttcccgtgtgccaagaccatcttgaattttgggagggcg

SEQ ID NO: 113506 - DNA, 75 bp, Artificial Sequence
  Synthetic
gaagctatgctacatgtatgggtcccgagcctctccgtgcgggggggccgtgatgcagtcatcttgctcacctgc

SEQ ID NO: 113507 - DNA, 75 bp, Artificial Sequence
  Synthetic
ccgctctgccctctatgtgggggacgtgtgtggcgcgctgatgatagccgctcaggctttcatcgtatcaccgca

SEQ ID NO: 113508 - DNA, 75 bp, Artificial Sequence
  Synthetic
cttagggccgctgtacctctttcaggccagcctactacgcataccatattatgtacgagctcatgctcttctgcg

SEQ ID NO: 113509 - DNA, 75 bp, Artificial Sequence
  Synthetic
cttagggccgctgtacctctttcaggccagcctacttcgcataccatattatgtacgagctcatgctcttctgcg

SEQ ID NO: 113510 - DNA, 75 bp, Artificial Sequence
  Synthetic
cttagggccgctgtacctctttcaggccagcctactccgcataccatattatgtacgagctcatgctcttctgcg

SEQ ID NO: 113511 - DNA, 75 bp, Artificial Sequence
  Synthetic
cttagggccgctgtacctctttcaggccagcctactgcgcataccatattatgtacgagctcatgctcttctgcg

SEQ ID NO: 113512 - DNA, 75 bp, Artificial Sequence
  Synthetic
actgccatgctcttggcctacctgatgcgcatcccagaggccatcctggatatcatcgcaggaggccactggggc

SEQ ID NO: 113513 - DNA, 75 bp, Artificial Sequence
  Synthetic
ggagtcatctgcgcggccattctgcgccgccacgtgggaccgggggaaggcgcggtccaatggatgaacaggctc

SEQ ID NO: 113514 - DNA, 75 bp, Artificial Sequence
  Synthetic
agttgagcccgttgtcttctctgatatggagactaagatcatcacgtggggggcagagacggcggcgtgtgggga

SEQ ID NO: 113515 - DNA, 75 bp, Artificial Sequence
  Synthetic
ctggaggaagcgccggacaaactgcgtatggcgttactagcctcttctccttcgggcccaggcaaactatccagc

SEQ ID NO: 113516 - DNA, 75 bp, Artificial Sequence
  Synthetic
atggagaagaaggtcatcacttggggagcggacacggccgcttgtggcgacattctggcgggcatgccagtctct

SEQ ID NO: 113517 - DNA, 75 bp, Artificial Sequence
  Synthetic
atggagaagaaggtcatcacttggggagcggacacggccgcttgtggcgacattctggcgggcttgccagtctct

SEQ ID NO: 113518 - DNA, 75 bp, Artificial Sequence
  Synthetic
atggagaagaaggtcatcacttggggagcggacacggccgcttgtggcgacattctggcgggcctgccagtctct

SEQ ID NO: 113519 - DNA, 75 bp, Artificial Sequence
  Synthetic
atggagaagaaggtcatcacttggggagcggacacggccgcttgtggcgacattctggcgggcgtgccagtctct

SEQ ID NO: 113520 - DNA, 75 bp, Artificial Sequence
  Synthetic
cgggccgctgtgtgcactcggggggttgcgaaggcggtggactttatacctgttgagtctatggaaaccactatg

SEQ ID NO: 113521 - DNA, 75 bp, Artificial Sequence
  Synthetic
gtggcctactggggacaatcgtcaccagcctcacaggtcgtgacaaaaatgaagttgagggtgaggtgcaagtgc

SEQ ID NO: 113522 - DNA, 75 bp, Artificial Sequence
  Synthetic
cttcaactcctcaggatgccccgagcgcatgtcagcttgccgcggcatagaatccttccgcataggatggggttc

SEQ ID NO: 113523 - DNA, 75 bp, Artificial Sequence
  Synthetic
tgcccggcctcccctttatctcttgccaaaaggggtataggggtgtgtgggccggcactggcatcatgaccacac

SEQ ID NO: 113524 - DNA, 75 bp, Artificial Sequence
  Synthetic
ccttgagtatgaggagaatgtcaccaatgaggtggacatgagaccgtactgctggcattatcctcccaaacaatg

SEQ ID NO: 113525 - DNA, 75 bp, Artificial Sequence
  Synthetic
ggacaagccttcacgttcagacctcgtcgccatcaaacggtccagacctgtaattgctcgctgtacccaggccat

SEQ ID NO: 113526 - DNA, 75 bp, Artificial Sequence
  Synthetic
tggagatacgggcagtcctgggagagccttcaccggaggctatggaccaggtatttcttgcttccacccggagat

SEQ ID NO: 113527 - DNA, 75 bp, Artificial Sequence
  Synthetic
gacctttaccttgtgacccgcggtgccgatgtcattcctgcaaggcgcagaggcgacactcgtgctggccttcta

SEQ ID NO: 113528 - DNA, 75 bp, Artificial Sequence
  Synthetic
cactcgtggtgccaccacccccctggcccgtgctgcttgggagacagctcgtcacactccagttacctcctggct

SEQ ID NO: 113529 - DNA, 75 bp, Artificial Sequence
  Synthetic
gccaaagccgttttttcgggatgaggtctcgttttgcgttgggctcaattcatttgtcgtcgggtctcagcttcc

SEQ ID NO: 113530 - DNA, 75 bp, Artificial Sequence
  Synthetic
attgcttcagaaaacatcctgaggcgacttacatcaagtgtggggccgggccgtggttaacaccccggtgtcttg

SEQ ID NO: 113531 - DNA, 75 bp, Artificial Sequence
  Synthetic
ctgatcaacaccaacggctcgtggcacatcaaccgtactgccctgaactgcaatgattccttaaacaccgggttc

SEQ ID NO: 113532 - DNA, 75 bp, Artificial Sequence
  Synthetic
agtttgcaacttcacccgtggggaccgctgcaatctcgaggacagggataggagtcaacaaagcccactgttaca

SEQ ID NO: 113533 - DNA, 75 bp, Artificial Sequence
  Synthetic
atagctgggttgttttattatcatcagttcaactctactggatgtactcaaatgctcagcagctgcaagcctatc

SEQ ID NO: 113534 - DNA, 75 bp, Artificial Sequence
  Synthetic
ggagtcaacaaagcccactgttacactctaccactgaatgggccatcctaccctgcacgttctcagacctaccag

SEQ ID NO: 113535 - DNA, 75 bp, Artificial Sequence
  Synthetic
gcactgtcccggcatcaagtgtctgcggccctgtgtactgcttcacaccatcgccagtggtcgtaggcactactg

SEQ ID NO: 113536 - DNA, 75 bp, Artificial Sequence
  Synthetic
tctaagtcgtggtccacagtctctgatcaagaggattctgttatctgctgctccatgtcatactcctggacgggg

SEQ ID NO: 113537 - DNA, 75 bp, Artificial Sequence
  Synthetic
gggtggaagctcctagctcccattactgcttacactcagcagactcgtggtctcctgggtgctatcgtggtcagc

SEQ ID NO: 113538 - DNA, 75 bp, Artificial Sequence
  Synthetic
tcatcatatgtgacgagtgtcattcaaccgaccccaccactatcttgggcatcggtacagtcctggaccaggcgg

SEQ ID NO: 113539 - DNA, 75 bp, Artificial Sequence
  Synthetic
cggccctgtgtactgcttcacaccatcgccagtggtcgtaggcactactgatgctaagggagccccaacctatac

SEQ ID NO: 113540 - DNA, 75 bp, Artificial Sequence
  Synthetic
cggccctgtgtactgcttcacaccatcgccagtggtcgtaggcactactgatgctaagggtgccccaacctatac

SEQ ID NO: 113541 - DNA, 75 bp, Artificial Sequence
  Synthetic
cggccctgtgtactgcttcacaccatcgccagtggtcgtaggcactactgatgctaagggcgccccaacctatac

SEQ ID NO: 113542 - DNA, 75 bp, Artificial Sequence
  Synthetic
cggccctgtgtactgcttcacaccatcgccagtggtcgtaggcactactgatgctaagggggccccaacctatac

SEQ ID NO: 113543 - DNA, 75 bp, Artificial Sequence
  Synthetic
atgggtcgtcctcctattcctgcttttggcggacgctagggtctgcgcctgcctgtggatgcttatcctattggg

SEQ ID NO: 113544 - DNA, 75 bp, Artificial Sequence
  Synthetic
aagacgtgcggagctcccccttgtaacatctatgggggtgaggagaacccagcaggaaatgggacagacctcttc

SEQ ID NO: 113545 - DNA, 75 bp, Artificial Sequence
  Synthetic
tggtacattaaaggtcgtgtggtcccgatggcaacttattctttgctaggatgctggtcctttgccttgctactc

SEQ ID NO: 113546 - DNA, 75 bp, Artificial Sequence
  Synthetic
catataagatccttctcacccgaagtttgtggtggacgtgctacatgctggtcttggccgaagccctgattcaag

SEQ ID NO: 113547 - DNA, 75 bp, Artificial Sequence
  Synthetic
tcagagcggccgtgtgtgccaggggtgtggccaaatccattgacttcatccctgttgaatctctcgacattgcca

SEQ ID NO: 113548 - DNA, 75 bp, Artificial Sequence
  Synthetic
ctgcggctatcgccggtgccgcgcgagcggcgtactgacgactagctgcggtaacaccctcacatgttacttgaa

SEQ ID NO: 113549 - DNA, 75 bp, Artificial Sequence
  Synthetic
ttcccgtcgtgggcgcgcctttgggcggcgtcgcggctgcgctcgcacatggtgtgagggcaatcgaggacggga

SEQ ID NO: 113550 - DNA, 75 bp, Artificial Sequence
  Synthetic
cctggggatccagacctagagcctgagcaggtagagcttcaacctcccccccaggggggggaggtagctcccggc

SEQ ID NO: 113551 - DNA, 75 bp, Artificial Sequence
  Synthetic
gtgctgctccatgtcatactcctggaccggggctctaataactccttgtagccccgaagaggaaaagttaccaat

SEQ ID NO: 113552 - DNA, 75 bp, Artificial Sequence
  Synthetic
cacaattgagactaccactgtcccacaagatgccgtggctagaagccaacgccgcggtcgcacgggcagggggaa

SEQ ID NO: 113553 - DNA, 75 bp, Artificial Sequence
  Synthetic
gttggcgatccttgggcccggctacctcctcaaagctgctttgacacgcgctccatacttcgttagggcgagcgc

SEQ ID NO: 113554 - DNA, 75 bp, Artificial Sequence
  Synthetic
gcccgggatatataggtacgtctcgcagggtgagcggccgtccggcatgttcgataccgtcgacctctgtgaggc

SEQ ID NO: 113555 - DNA, 75 bp, Artificial Sequence
  Synthetic
gcccgggatatataggtacgtctcgcagggtgagcggccgtccggcatgttcgataccgtcgtcctctgtgaggc

SEQ ID NO: 113556 - DNA, 75 bp, Artificial Sequence
  Synthetic
gcccgggatatataggtacgtctcgcagggtgagcggccgtccggcatgttcgataccgtcgccctctgtgaggc

SEQ ID NO: 113557 - DNA, 75 bp, Artificial Sequence
  Synthetic
gcccgggatatataggtacgtctcgcagggtgagcggccgtccggcatgttcgataccgtcggcctctgtgaggc

SEQ ID NO: 113558 - DNA, 75 bp, Artificial Sequence
  Synthetic
tccaggtggcactaatcacccttggcaggtggacaggtacatacatctatgaccacctatctcccatgtcagact

SEQ ID NO: 113559 - DNA, 75 bp, Artificial Sequence
  Synthetic
gatgaaatggaagagtgtgcctcacacctcccttacatcgaacagggaatgcagctcgccgagcaattcaagcag

SEQ ID NO: 113560 - DNA, 75 bp, Artificial Sequence
  Synthetic
cctgttggcatgctgtgtccgccaccctagccgtaccaaatgcctccacgcccgcaacaggattccgcaggcacg

SEQ ID NO: 113561 - DNA, 75 bp, Artificial Sequence
  Synthetic
gaggtccgcagcttgtccgggagggccgttaaccacatcaagtccgtgtggaaggacctcctggaagactcacaa

SEQ ID NO: 113562 - DNA, 75 bp, Artificial Sequence
  Synthetic
ttgtggtgacatcatacacgggcttcccgtctccgcccggctcggccgagagatcttgctgggccctgctgatgg

SEQ ID NO: 113563 - DNA, 75 bp, Artificial Sequence
  Synthetic
ccgccgtcattggactgtgcaagactgcaactgccccatttatacaggccacgtcaccggccacaggatggcttg

SEQ ID NO: 113564 - DNA, 75 bp, Artificial Sequence
  Synthetic
gacaagacagaccaagctggtgagattcaggttttgtccactgtcacacagtcttttcttggaacatcaatctca

SEQ ID NO: 113565 - DNA, 75 bp, Artificial Sequence
  Synthetic
ccagactccgacgctgagtcctattcttccatgccccccctggagggggagcctggggatccggatctcagcgac

SEQ ID NO: 113566 - DNA, 75 bp, Artificial Sequence
  Synthetic
tgggtttttcgtatgatacccgatgctttgactcaactgtcactgagagagacatcagaactgaggagtccatat

SEQ ID NO: 113567 - DNA, 75 bp, Artificial Sequence
  Synthetic
tacttgcacgcgggagtagggacggtgtcatcttgctaacaagcctgctttatccatctttgatgtttgacatca

SEQ ID NO: 113568 - DNA, 75 bp, Artificial Sequence
  Synthetic
tagggtggcccagcccccctggtaccaggtccctggaaccttgcacctgcggggcagttgacctctatcttgtca

SEQ ID NO: 113569 - DNA, 75 bp, Artificial Sequence
  Synthetic
acgactgctccaactcaagcatagtgtatgagacagcggacatgattatgcacatccccgggtgcgtgccctgcg

SEQ ID NO: 113570 - DNA, 75 bp, Artificial Sequence
  Synthetic
ggaaaatacttccagatgatcatactgagcattggcagatggtttaacacctacctatacgaccacctagcgccg

SEQ ID NO: 113571 - DNA, 75 bp, Artificial Sequence
  Synthetic
cagcttataaacaccaatggcagctggcacatcaacaggactgccctgaactgcaatgactccctccagaccggg

SEQ ID NO: 113572 - DNA, 75 bp, Artificial Sequence
  Synthetic
acctgttctctgccctaggggccacgccgtcgggatcttccgggcggccgtgtgttccaggggggtagccaagtc

SEQ ID NO: 113573 - DNA, 75 bp, Artificial Sequence
  Synthetic
catggagaccaaggtcatcacctggggagcagacaccgctgcgtgtggggacatcatcttgggtctacccgtctc

SEQ ID NO: 113574 - DNA, 75 bp, Artificial Sequence
  Synthetic
ctcgacgttgcgaccaggtctccaaacttcactgacaatagtacacctccagctgtgccccagacctatcaagtg

SEQ ID NO: 113575 - DNA, 75 bp, Artificial Sequence
  Synthetic
tgggactggatatgcacggtgttgaccgacttcaagacctggctccagtccaagctcctgccgcggttgccggga

SEQ ID NO: 113576 - DNA, 75 bp, Artificial Sequence
  Synthetic
taaggtcatcgtggacatcttagcgggctacggggcaggtgtctcaggtgctttggtggccttcaaaatcatgag

SEQ ID NO: 113577 - DNA, 75 bp, Artificial Sequence
  Synthetic
ctgccaccctggggtttggggcctacatgtcaaaagcgcatggaatcaatcccaacattaggactggggtccgca

SEQ ID NO: 113578 - DNA, 75 bp, Artificial Sequence
  Synthetic
catgtcaaaagcgcatggaatcaatcccaacattaggactggggtccgcacagtgacaactggggatgccatcac

SEQ ID NO: 113579 - DNA, 75 bp, Artificial Sequence
  Synthetic
tggcacatcaacaggactgccctgaactgcaatgactccctcaacactgggtttcttgccgcgctgttctacaca

SEQ ID NO: 113580 - DNA, 75 bp, Artificial Sequence
  Synthetic
ctccaggggctaagtcccttgaaccgtgcgcctgcgggtctgcggacttatacttggttacccgcgatgctgatg

SEQ ID NO: 113581 - DNA, 75 bp, Artificial Sequence
  Synthetic
tcttggctcttctatcatgcatctctataccggtctctgccttagaggtcaggaacaccagccagatttacatgg

SEQ ID NO: 113582 - DNA, 75 bp, Artificial Sequence
  Synthetic
tatggaaaggccgtccccctctcagccatcaagggggggcgacatctaatcttctgccgctcaaagaaaaggtgt

SEQ ID NO: 113583 - DNA, 75 bp, Artificial Sequence
  Synthetic
ctcctagctcccatcactgcttatgcccagcaaacacgaggcctcctgggcgccatagtggtgagtatgacgggg

SEQ ID NO: 113584 - DNA, 75 bp, Artificial Sequence
  Synthetic
tcgctgctggacaccggtcacgccaaacgtggccgtgagccagcccggcgccctcactagaggcttgcgggcaca

SEQ ID NO: 113585 - DNA, 75 bp, Artificial Sequence
  Synthetic
ccgcagcaccatacatttgtccaggactgcaactgctccatatacccggggcatgttacgggacaccgcatggcc

SEQ ID NO: 113586 - DNA, 75 bp, Artificial Sequence
  Synthetic
ctagtgccgctggcactgccggttggtggtgggcgatacttttcctgtgctgtgcttggtatgtgaaaggtcgcc

SEQ ID NO: 113587 - DNA, 75 bp, Artificial Sequence
  Synthetic
cagggggaagttgggcatatacaggtatgtttcttccggtgaaagggcgtcggggatgttcgacagcgtggtgct

SEQ ID NO: 113588 - DNA, 75 bp, Artificial Sequence
  Synthetic
ggggtgtgatgtttggcttggcttacttcgccatgcaaggagcgtgggcgaaggtcatcgccatcctcctgctga

SEQ ID NO: 113589 - DNA, 75 bp, Artificial Sequence
  Synthetic
gccgcccgctgatccgagatgaagtgactttctctgtcgggctctcgacctatgccatagggtcacaactacctt

SEQ ID NO: 113590 - DNA, 75 bp, Artificial Sequence
  Synthetic
tgtcaggaccatctagaattttgggaagccgtgttcaccggcctcacacatattgatgcccattttctttcccag

SEQ ID NO: 113591 - DNA, 75 bp, Artificial Sequence
  Synthetic
cgtacctggtggcctaccaggccacagcgtgcgccagagctaaggctcctcccccatcctgggacaccatgtgga

SEQ ID NO: 113592 - DNA, 75 bp, Artificial Sequence
  Synthetic
ccagctcatcaacaccagcggcagctggcacatcaaccgcacggcgcttaactgcaatgacagcctgaacaccgg

SEQ ID NO: 113593 - DNA, 75 bp, Artificial Sequence
  Synthetic
gccgtcccttgccagctcatctgccagccagttgtcagctccgtcactcaaggcaacgtgcaccaccgccggggc

SEQ ID NO: 113594 - DNA, 75 bp, Artificial Sequence
  Synthetic
ggcgctctggagtacgaagaaaatgtcaccaatgttgaggacatgaagccttactgttggcattatccccctaag

SEQ ID NO: 113595 - DNA, 75 bp, Artificial Sequence
  Synthetic
cgggtacgtacgtttatgaccaccttactccactgcgggactgggcccacgcgggcctacgagacctcgcggtgg

SEQ ID NO: 113596 - DNA, 75 bp, Artificial Sequence
  Synthetic
cctacacttggggggggaatgagtcagatgtcttcctgttgaacagcacccggccgccgaaaggcgcctggtttg

SEQ ID NO: 113597 - DNA, 75 bp, Artificial Sequence
  Synthetic
cccggtcggaggcgtcgctagagccctggcacacggtgtcagggtcctggaggacggggtaaattacgcaacagg

SEQ ID NO: 113598 - DNA, 75 bp, Artificial Sequence
  Synthetic
gcctaatgcaacaagcttccaagcaggcacaggacatacagcccgctgtccaagcgacatggcccaagttagaac

SEQ ID NO: 113599 - DNA, 75 bp, Artificial Sequence
  Synthetic
cgcagagctagctcgcaagtgcttcccatcagaaaccatagactcacaggggggctctgtaaccagcccctctgc

SEQ ID NO: 113600 - DNA, 75 bp, Artificial Sequence
  Synthetic
aacggactgtttcaggaaacatcccgactcgtcctacgttaagtgtggagctggcccttggctaacacctaaatg

SEQ ID NO: 113601 - DNA, 75 bp, Artificial Sequence
  Synthetic
acaacagcatcacctggcagctcactaacgcagttctccaccttcctggatgcgtcccatgtgagaatgataatg

SEQ ID NO: 113602 - DNA, 75 bp, Artificial Sequence
  Synthetic
gagacgtggaagtgtctcgtgcggcttaaaccaacactacatggacctacgccccttctataccggttggggcct

SEQ ID NO: 113603 - DNA, 75 bp, Artificial Sequence
  Synthetic
ccggacctcagttcggggtcatggtctacagttagtgaggagggcgacagcgtggtctgctgctcctactcatac

SEQ ID NO: 113604 - DNA, 75 bp, Artificial Sequence
  Synthetic
gtccaaaatgaaatctgcttgacacaccccgtcacaaaatacatcatggcatgcatgtcagctgatctggaagtg

SEQ ID NO: 113605 - DNA, 75 bp, Artificial Sequence
  Synthetic
caagctgcttgcaacttcacccgcggggatcgctgtggcctagaggatagagacagaagtcagttgagcccgctg

SEQ ID NO: 113606 - DNA, 75 bp, Artificial Sequence
  Synthetic
ggtcatcgataccctcacgtgcggctttgccgacctcatggggtacattcccgtcgtcggcgccccagtgggcgg

SEQ ID NO: 113607 - DNA, 75 bp, Artificial Sequence
  Synthetic
gtgcctactcctactttctgtgggggtaggcgtctacctgctccccaaccgataaacggggagctaaccactcca

SEQ ID NO: 113608 - DNA, 75 bp, Artificial Sequence
  Synthetic
tctcgggggctctcgtcgccttcaagatcatgtctggcgagaagccctccgtggaggacgtcgtcaacctgctac

SEQ ID NO: 113609 - DNA, 75 bp, Artificial Sequence
  Synthetic
tccaatacttgtatggcctttccctggccatcacgaagtatatggtcaagtgggaatgggtggttctcctctttc

SEQ ID NO: 113610 - DNA, 75 bp, Artificial Sequence
  Synthetic
caaagaggtgttgtatcaacaatacgatgagatggaggagtgctcgcaagccgccccatatatcgaacaagctca

SEQ ID NO: 113611 - DNA, 75 bp, Artificial Sequence
  Synthetic
cctggcagcttcaggacgcagtgcttcaccttcctggatgcgtcccctgtgaacgggtgaacaacgagtcccggt

SEQ ID NO: 113612 - DNA, 75 bp, Artificial Sequence
  Synthetic
ccacccaacaacaagctgtcattgagcccatagtagcttccaactggcaaaagcttgaggtcttttggcacaagc

SEQ ID NO: 113613 - DNA, 75 bp, Artificial Sequence
  Synthetic
cagtgctgctagttccaacggccccctgtacttcatcctgttcttcatagcggcgtggtacatcaagggtcggat

SEQ ID NO: 113614 - DNA, 75 bp, Artificial Sequence
  Synthetic
agccgtgggccgtcctggtgctctaaccgagggcttgcgatcgcacatcgacatcatcgtggcgtccgcaacggt

SEQ ID NO: 113615 - DNA, 75 bp, Artificial Sequence
  Synthetic
acgggtcacccagctgctcggctccctcaccataaccagcctgcttaggagacttcaccaatggatcactgaaga

SEQ ID NO: 113616 - DNA, 75 bp, Artificial Sequence
  Synthetic
agaggctctccctagtcaacaccaacggcagctggcacataaaccggaccgccctcaattgcaatgacagcttgc

SEQ ID NO: 113617 - DNA, 75 bp, Artificial Sequence
  Synthetic
ggccagatcggcctagcgctgctgatgatcataactgctttcacccttaccccggcatacaggctactcctcagt

SEQ ID NO: 113618 - DNA, 75 bp, Artificial Sequence
  Synthetic
aaagagggccttgtacgacataactcagaagctacccaaggcggttatgggatcatcgtatgggttacaatactc

SEQ ID NO: 113619 - DNA, 75 bp, Artificial Sequence
  Synthetic
aaagagggccttgtacgacataactcagaagctacccaaggcggttatgggatcatcgtatgggtttcaatactc

SEQ ID NO: 113620 - DNA, 75 bp, Artificial Sequence
  Synthetic
aaagagggccttgtacgacataactcagaagctacccaaggcggttatgggatcatcgtatgggttccaatactc

SEQ ID NO: 113621 - DNA, 75 bp, Artificial Sequence
  Synthetic
aaagagggccttgtacgacataactcagaagctacccaaggcggttatgggatcatcgtatgggttgcaatactc

SEQ ID NO: 113622 - DNA, 75 bp, Artificial Sequence
  Synthetic
cccaaattacccggcctcccctttgtttcctgtcaaaagggctacagggggacgtgggccggcactggtatcatg

SEQ ID NO: 113623 - DNA, 75 bp, Artificial Sequence
  Synthetic
gatcatcgtatgggttacaatactcgccgaaacaacgggtagattacctcctgggcgtatggcgctcaaagagag

SEQ ID NO: 113624 - DNA, 75 bp, Artificial Sequence
  Synthetic
gatcatcgtatgggtttcaatactcgccgaaacaacgggtagattacctcctgggcgtatggcgctcaaagagag

SEQ ID NO: 113625 - DNA, 75 bp, Artificial Sequence
  Synthetic
gatcatcgtatgggttccaatactcgccgaaacaacgggtagattacctcctgggcgtatggcgctcaaagagag

SEQ ID NO: 113626 - DNA, 75 bp, Artificial Sequence
  Synthetic
gatcatcgtatgggttgcaatactcgccgaaacaacgggtagattacctcctgggcgtatggcgctcaaagagag

SEQ ID NO: 113627 - DNA, 75 bp, Artificial Sequence
  Synthetic
tatgggccgcaaccatgctttacccgcgtgtggtattcgatgtcaccaagtggctgctggcaatcctcggccccg

SEQ ID NO: 113628 - DNA, 75 bp, Artificial Sequence
  Synthetic
ccatgcaaggagcgtgggcaaaggtcgtcgtcatcctcctgctgtcagctggggtggacgcgtccacgtactcca

SEQ ID NO: 113629 - DNA, 75 bp, Artificial Sequence
  Synthetic
catttcctatcaactgttacacagaaggcccatgcgtgcccaagcccgcccccaatttcaagaccgctatctgga

SEQ ID NO: 113630 - DNA, 75 bp, Artificial Sequence
  Synthetic
gtatgtccagatggcactcatcaccctcggtaagtggaccggcacatacatctacgaccatctctcccccatgac

SEQ ID NO: 113631 - DNA, 75 bp, Artificial Sequence
  Synthetic
cataaaccgtactgccctcaactgcaatgactccctgcagaccggcttcatcgcatccttgttctacgccaacag

SEQ ID NO: 113632 - DNA, 75 bp, Artificial Sequence
  Synthetic
gagtccggagtttttctcctgggtggacggggttcagatccatcggtttgcccccacgccgaaggcgtttatgag

SEQ ID NO: 113633 - DNA, 75 bp, Artificial Sequence
  Synthetic
ggagggtgaggtccagattgtgtcaactgctgcccaaactttcctggcaacgtgcatcaatggggtatgctggac

SEQ ID NO: 113634 - DNA, 75 bp, Artificial Sequence
  Synthetic
gcagcgtgtggggacatcatacacgggctccccgtctccgcccggttgggtcgagagatcctgctcggtccagct

SEQ ID NO: 113635 - DNA, 75 bp, Artificial Sequence
  Synthetic
aacgaggaagacatgaggccctactgttggcattacccacctaagccgtgtggtgtggttcctgccaagtctgtg

SEQ ID NO: 113636 - DNA, 75 bp, Artificial Sequence
  Synthetic
acggacccgtcccacattacagccgaggcggcagtgagacgcttggcccggggttcgcccccctctgaggctagt

SEQ ID NO: 113637 - DNA, 75 bp, Artificial Sequence
  Synthetic
cggcgtgatgtcaacacgctgcccttgcggggcatcaataaccggacatgtgaagaatgggtccatgcggcttgc

SEQ ID NO: 113638 - DNA, 75 bp, Artificial Sequence
  Synthetic
cggcgtgatgtcaacacgctgcccttgcggggcatcaataaccggtcatgtgaagaatgggtccatgcggcttgc

SEQ ID NO: 113639 - DNA, 75 bp, Artificial Sequence
  Synthetic
cggcgtgatgtcaacacgctgcccttgcggggcatcaataaccggccatgtgaagaatgggtccatgcggcttgc

SEQ ID NO: 113640 - DNA, 75 bp, Artificial Sequence
  Synthetic
cggcgtgatgtcaacacgctgcccttgcggggcatcaataaccgggcatgtgaagaatgggtccatgcggcttgc

SEQ ID NO: 113641 - DNA, 75 bp, Artificial Sequence
  Synthetic
cctgcacctgcggctcctcggacctctacctggtcacgaggcacgccgatgtcatccccgtgcgccggcggggtg

SEQ ID NO: 113642 - DNA, 75 bp, Artificial Sequence
  Synthetic
gtcgtgacaagaatgaggtggaaggcgaggtgcaggtcctgtccaccaccacccaatctttcctggggacgtgca

SEQ ID NO: 113643 - DNA, 75 bp, Artificial Sequence
  Synthetic
tcttccttctaaacagcacccggcctcccaagggagcctggtttggatgcacatggatgaatggcaccggattta

SEQ ID NO: 113644 - DNA, 75 bp, Artificial Sequence
  Synthetic
ggggcagcgtaactcgtattgagtctgaggctaaggtgctcgtcctcgactccttcgaccccgtggccgatgaag

SEQ ID NO: 113645 - DNA, 75 bp, Artificial Sequence
  Synthetic
tccttcgaccccgtggccgatgaagaggacgagcgcgagccctcgataccatcagaatacctgctccccaaatgc

SEQ ID NO: 113646 - DNA, 75 bp, Artificial Sequence
  Synthetic
cttggtggggtggccctgtccacccggcgctcggtcactggttccatgcacgtgcggatcatctgatctgtacct

SEQ ID NO: 113647 - DNA, 75 bp, Artificial Sequence
  Synthetic
aacgtatagtaaatgcggggccgggccctggctgacacccaggtgcctgatcgactacccctacaggctgtggca

SEQ ID NO: 113648 - DNA, 75 bp, Artificial Sequence
  Synthetic
tactgaagtggacggggtgagactccaccgttacgcccctccatgtaaacccctgttgagggatgagatcacttt

SEQ ID NO: 113649 - DNA, 75 bp, Artificial Sequence
  Synthetic
cggcgagctgtggtgttggaccggagcaacgtgggagaggctctcaaagagctcgccattaaaagctttggttgc

SEQ ID NO: 113650 - DNA, 75 bp, Artificial Sequence
  Synthetic
ggaggtccaattctgtgcccatcaggccacgccgtaggcttgtttagggctgccgtgtgcacgcggggtgtggcg

SEQ ID NO: 113651 - DNA, 75 bp, Artificial Sequence
  Synthetic
ggaggtccaattctgtgcccatcaggccacgccgttggcttgtttagggctgccgtgtgcacgcggggtgtggcg

SEQ ID NO: 113652 - DNA, 75 bp, Artificial Sequence
  Synthetic
ggaggtccaattctgtgcccatcaggccacgccgtcggcttgtttagggctgccgtgtgcacgcggggtgtggcg

SEQ ID NO: 113653 - DNA, 75 bp, Artificial Sequence
  Synthetic
ggaggtccaattctgtgcccatcaggccacgccgtgggcttgtttagggctgccgtgtgcacgcggggtgtggcg

SEQ ID NO: 113654 - DNA, 75 bp, Artificial Sequence
  Synthetic
cgctgtaaccttgatgacagagataggagccagctgagcccgctcctgcattccaccaccgagtgggccatcttg

SEQ ID NO: 113655 - DNA, 75 bp, Artificial Sequence
  Synthetic
tgggccgctgtggttcctcatcttctttacggcggcctggtacttaaagggcagggtggtccctatggccacgta

SEQ ID NO: 113656 - DNA, 75 bp, Artificial Sequence
  Synthetic
gttactcctgtgcctactcctactctctgtaggggtaggcatcttcctgctccccgctcgataagcgaggagcct

SEQ ID NO: 113657 - DNA, 75 bp, Artificial Sequence
  Synthetic
agatagggcatttgcatgccccaactggcagcggcaagagcaccaaggtccctgcagcctatgcggctcaggggt

SEQ ID NO: 113658 - DNA, 75 bp, Artificial Sequence
  Synthetic
tcacaaagtacgtcgtcaagtgggagtgggtagtgctcctttttctgctgttggcagacgccagggtctgtgcct

SEQ ID NO: 113659 - DNA, 75 bp, Artificial Sequence
  Synthetic
ccctcccgcaagagggggcggccgctcccggctcagattccgggtcctggtccacgtgttccgaggaagatgact

SEQ ID NO: 113660 - DNA, 75 bp, Artificial Sequence
  Synthetic
ctcttaccccagcatataagaccctcctaagtcgttcagtgtggtggctgtgctacatgcttgtcttggcagagg

SEQ ID NO: 113661 - DNA, 75 bp, Artificial Sequence
  Synthetic
aaggaccattaccactggaggggctataacatactccacatatggaaaatttctggcagacggggggtgctccgg

SEQ ID NO: 113662 - DNA, 75 bp, Artificial Sequence
  Synthetic
aaggaccattaccactggaggggctataacatactccacatatggtaaatttctggcagacggggggtgctccgg

SEQ ID NO: 113663 - DNA, 75 bp, Artificial Sequence
  Synthetic
aaggaccattaccactggaggggctataacatactccacatatggcaaatttctggcagacggggggtgctccgg

SEQ ID NO: 113664 - DNA, 75 bp, Artificial Sequence
  Synthetic
aaggaccattaccactggaggggctataacatactccacatatgggaaatttctggcagacggggggtgctccgg

SEQ ID NO: 113665 - DNA, 75 bp, Artificial Sequence
  Synthetic
aaggaccattaccactggaggggctataacatactccacttatggaaaatttctggcagacggggggtgctccgg

SEQ ID NO: 113666 - DNA, 75 bp, Artificial Sequence
  Synthetic
aaggaccattaccactggaggggctataacatactccacttatggtaaatttctggcagacggggggtgctccgg

SEQ ID NO: 113667 - DNA, 75 bp, Artificial Sequence
  Synthetic
aaggaccattaccactggaggggctataacatactccacttatggcaaatttctggcagacggggggtgctccgg

SEQ ID NO: 113668 - DNA, 75 bp, Artificial Sequence
  Synthetic
aaggaccattaccactggaggggctataacatactccacttatgggaaatttctggcagacggggggtgctccgg

SEQ ID NO: 113669 - DNA, 75 bp, Artificial Sequence
  Synthetic
aaggaccattaccactggaggggctataacatactccacctatggaaaatttctggcagacggggggtgctccgg

SEQ ID NO: 113670 - DNA, 75 bp, Artificial Sequence
  Synthetic
aaggaccattaccactggaggggctataacatactccacctatggtaaatttctggcagacggggggtgctccgg

SEQ ID NO: 113671 - DNA, 75 bp, Artificial Sequence
  Synthetic
aaggaccattaccactggaggggctataacatactccacctatggcaaatttctggcagacggggggtgctccgg

SEQ ID NO: 113672 - DNA, 75 bp, Artificial Sequence
  Synthetic
aaggaccattaccactggaggggctataacatactccacctatgggaaatttctggcagacggggggtgctccgg

SEQ ID NO: 113673 - DNA, 75 bp, Artificial Sequence
  Synthetic
aaggaccattaccactggaggggctataacatactccacgtatggaaaatttctggcagacggggggtgctccgg

SEQ ID NO: 113674 - DNA, 75 bp, Artificial Sequence
  Synthetic
aaggaccattaccactggaggggctataacatactccacgtatggtaaatttctggcagacggggggtgctccgg

SEQ ID NO: 113675 - DNA, 75 bp, Artificial Sequence
  Synthetic
aaggaccattaccactggaggggctataacatactccacgtatggcaaatttctggcagacggggggtgctccgg

SEQ ID NO: 113676 - DNA, 75 bp, Artificial Sequence
  Synthetic
aaggaccattaccactggaggggctataacatactccacgtatgggaaatttctggcagacggggggtgctccgg

SEQ ID NO: 113677 - DNA, 75 bp, Artificial Sequence
  Synthetic
taggaccattaccactggaggggctataacatactccacatatggaaaatttctggcagacggggggtgctccgg

SEQ ID NO: 113678 - DNA, 75 bp, Artificial Sequence
  Synthetic
taggaccattaccactggaggggctataacatactccacatatggtaaatttctggcagacggggggtgctccgg

SEQ ID NO: 113679 - DNA, 75 bp, Artificial Sequence
  Synthetic
taggaccattaccactggaggggctataacatactccacatatggcaaatttctggcagacggggggtgctccgg

SEQ ID NO: 113680 - DNA, 75 bp, Artificial Sequence
  Synthetic
taggaccattaccactggaggggctataacatactccacatatgggaaatttctggcagacggggggtgctccgg

SEQ ID NO: 113681 - DNA, 75 bp, Artificial Sequence
  Synthetic
taggaccattaccactggaggggctataacatactccacttatggaaaatttctggcagacggggggtgctccgg

SEQ ID NO: 113682 - DNA, 75 bp, Artificial Sequence
  Synthetic
taggaccattaccactggaggggctataacatactccacttatggtaaatttctggcagacggggggtgctccgg

SEQ ID NO: 113683 - DNA, 75 bp, Artificial Sequence
  Synthetic
taggaccattaccactggaggggctataacatactccacttatggcaaatttctggcagacggggggtgctccgg

SEQ ID NO: 113684 - DNA, 75 bp, Artificial Sequence
  Synthetic
taggaccattaccactggaggggctataacatactccacttatgggaaatttctggcagacggggggtgctccgg

SEQ ID NO: 113685 - DNA, 75 bp, Artificial Sequence
  Synthetic
taggaccattaccactggaggggctataacatactccacctatggaaaatttctggcagacggggggtgctccgg

SEQ ID NO: 113686 - DNA, 75 bp, Artificial Sequence
  Synthetic
taggaccattaccactggaggggctataacatactccacctatggtaaatttctggcagacggggggtgctccgg

SEQ ID NO: 113687 - DNA, 75 bp, Artificial Sequence
  Synthetic
taggaccattaccactggaggggctataacatactccacctatggcaaatttctggcagacggggggtgctccgg

SEQ ID NO: 113688 - DNA, 75 bp, Artificial Sequence
  Synthetic
taggaccattaccactggaggggctataacatactccacctatgggaaatttctggcagacggggggtgctccgg

SEQ ID NO: 113689 - DNA, 75 bp, Artificial Sequence
  Synthetic
taggaccattaccactggaggggctataacatactccacgtatggaaaatttctggcagacggggggtgctccgg

SEQ ID NO: 113690 - DNA, 75 bp, Artificial Sequence
  Synthetic
taggaccattaccactggaggggctataacatactccacgtatggtaaatttctggcagacggggggtgctccgg

SEQ ID NO: 113691 - DNA, 75 bp, Artificial Sequence
  Synthetic
taggaccattaccactggaggggctataacatactccacgtatggcaaatttctggcagacggggggtgctccgg

SEQ ID NO: 113692 - DNA, 75 bp, Artificial Sequence
  Synthetic
taggaccattaccactggaggggctataacatactccacgtatgggaaatttctggcagacggggggtgctccgg

SEQ ID NO: 113693 - DNA, 75 bp, Artificial Sequence
  Synthetic
caggaccattaccactggaggggctataacatactccacatatggaaaatttctggcagacggggggtgctccgg

SEQ ID NO: 113694 - DNA, 75 bp, Artificial Sequence
  Synthetic
caggaccattaccactggaggggctataacatactccacatatggtaaatttctggcagacggggggtgctccgg

SEQ ID NO: 113695 - DNA, 75 bp, Artificial Sequence
  Synthetic
caggaccattaccactggaggggctataacatactccacatatggcaaatttctggcagacggggggtgctccgg

SEQ ID NO: 113696 - DNA, 75 bp, Artificial Sequence
  Synthetic
caggaccattaccactggaggggctataacatactccacatatgggaaatttctggcagacggggggtgctccgg

SEQ ID NO: 113697 - DNA, 75 bp, Artificial Sequence
  Synthetic
caggaccattaccactggaggggctataacatactccacttatggaaaatttctggcagacggggggtgctccgg

SEQ ID NO: 113698 - DNA, 75 bp, Artificial Sequence
  Synthetic
caggaccattaccactggaggggctataacatactccacttatggtaaatttctggcagacggggggtgctccgg

SEQ ID NO: 113699 - DNA, 75 bp, Artificial Sequence
  Synthetic
caggaccattaccactggaggggctataacatactccacttatggcaaatttctggcagacggggggtgctccgg

SEQ ID NO: 113700 - DNA, 75 bp, Artificial Sequence
  Synthetic
caggaccattaccactggaggggctataacatactccacttatgggaaatttctggcagacggggggtgctccgg

SEQ ID NO: 113701 - DNA, 75 bp, Artificial Sequence
  Synthetic
caggaccattaccactggaggggctataacatactccacctatggaaaatttctggcagacggggggtgctccgg

SEQ ID NO: 113702 - DNA, 75 bp, Artificial Sequence
  Synthetic
caggaccattaccactggaggggctataacatactccacctatggtaaatttctggcagacggggggtgctccgg

SEQ ID NO: 113703 - DNA, 75 bp, Artificial Sequence
  Synthetic
caggaccattaccactggaggggctataacatactccacctatggcaaatttctggcagacggggggtgctccgg

SEQ ID NO: 113704 - DNA, 75 bp, Artificial Sequence
  Synthetic
caggaccattaccactggaggggctataacatactccacctatgggaaatttctggcagacggggggtgctccgg

SEQ ID NO: 113705 - DNA, 75 bp, Artificial Sequence
  Synthetic
caggaccattaccactggaggggctataacatactccacgtatggaaaatttctggcagacggggggtgctccgg

SEQ ID NO: 113706 - DNA, 75 bp, Artificial Sequence
  Synthetic
caggaccattaccactggaggggctataacatactccacgtatggtaaatttctggcagacggggggtgctccgg

SEQ ID NO: 113707 - DNA, 75 bp, Artificial Sequence
  Synthetic
caggaccattaccactggaggggctataacatactccacgtatggcaaatttctggcagacggggggtgctccgg

SEQ ID NO: 113708 - DNA, 75 bp, Artificial Sequence
  Synthetic
caggaccattaccactggaggggctataacatactccacgtatgggaaatttctggcagacggggggtgctccgg

SEQ ID NO: 113709 - DNA, 75 bp, Artificial Sequence
  Synthetic
gaggaccattaccactggaggggctataacatactccacatatggaaaatttctggcagacggggggtgctccgg

SEQ ID NO: 113710 - DNA, 75 bp, Artificial Sequence
  Synthetic
gaggaccattaccactggaggggctataacatactccacatatggtaaatttctggcagacggggggtgctccgg

SEQ ID NO: 113711 - DNA, 75 bp, Artificial Sequence
  Synthetic
gaggaccattaccactggaggggctataacatactccacatatggcaaatttctggcagacggggggtgctccgg

SEQ ID NO: 113712 - DNA, 75 bp, Artificial Sequence
  Synthetic
gaggaccattaccactggaggggctataacatactccacatatgggaaatttctggcagacggggggtgctccgg

SEQ ID NO: 113713 - DNA, 75 bp, Artificial Sequence
  Synthetic
gaggaccattaccactggaggggctataacatactccacttatggaaaatttctggcagacggggggtgctccgg

SEQ ID NO: 113714 - DNA, 75 bp, Artificial Sequence
  Synthetic
gaggaccattaccactggaggggctataacatactccacttatggtaaatttctggcagacggggggtgctccgg

SEQ ID NO: 113715 - DNA, 75 bp, Artificial Sequence
  Synthetic
gaggaccattaccactggaggggctataacatactccacttatggcaaatttctggcagacggggggtgctccgg

SEQ ID NO: 113716 - DNA, 75 bp, Artificial Sequence
  Synthetic
gaggaccattaccactggaggggctataacatactccacttatgggaaatttctggcagacggggggtgctccgg

SEQ ID NO: 113717 - DNA, 75 bp, Artificial Sequence
  Synthetic
gaggaccattaccactggaggggctataacatactccacctatggaaaatttctggcagacggggggtgctccgg

SEQ ID NO: 113718 - DNA, 75 bp, Artificial Sequence
  Synthetic
gaggaccattaccactggaggggctataacatactccacctatggtaaatttctggcagacggggggtgctccgg

SEQ ID NO: 113719 - DNA, 75 bp, Artificial Sequence
  Synthetic
gaggaccattaccactggaggggctataacatactccacctatggcaaatttctggcagacggggggtgctccgg

SEQ ID NO: 113720 - DNA, 75 bp, Artificial Sequence
  Synthetic
gaggaccattaccactggaggggctataacatactccacctatgggaaatttctggcagacggggggtgctccgg

SEQ ID NO: 113721 - DNA, 75 bp, Artificial Sequence
  Synthetic
gaggaccattaccactggaggggctataacatactccacgtatggaaaatttctggcagacggggggtgctccgg

SEQ ID NO: 113722 - DNA, 75 bp, Artificial Sequence
  Synthetic
gaggaccattaccactggaggggctataacatactccacgtatggtaaatttctggcagacggggggtgctccgg

SEQ ID NO: 113723 - DNA, 75 bp, Artificial Sequence
  Synthetic
gaggaccattaccactggaggggctataacatactccacgtatggcaaatttctggcagacggggggtgctccgg

SEQ ID NO: 113724 - DNA, 75 bp, Artificial Sequence
  Synthetic
gaggaccattaccactggaggggctataacatactccacgtatgggaaatttctggcagacggggggtgctccgg

SEQ ID NO: 113725 - DNA, 75 bp, Artificial Sequence
  Synthetic
cttcatcctcttctttgtagcagcttggtacatcaagggtcgggcagttccactggccacctattctcttcttgg

SEQ ID NO: 113726 - DNA, 75 bp, Artificial Sequence
  Synthetic
cacgaaatggttgttagcagtcctggggcctgcccacctccttaaggcgtctctgctacgggtaccatactttgt

SEQ ID NO: 113727 - DNA, 75 bp, Artificial Sequence
  Synthetic
gctaggctcgtcgtcttggcaacggccactccccccggaagtgtcacagtcccccaccctaacattgaggaggtg

SEQ ID NO: 113728 - DNA, 75 bp, Artificial Sequence
  Synthetic
gctcggtctcgcgctgctggtgatcataactgctttcacactcaccccggcatataagatccttctcacccggtg

SEQ ID NO: 113729 - DNA, 75 bp, Artificial Sequence
  Synthetic
aatgtgacgagctcgccaaacaattgacggggctcggaattaatgcagtcgccttctataggggcctggacgttt

SEQ ID NO: 113730 - DNA, 75 bp, Artificial Sequence
  Synthetic
attatgcaacagggaatcttcccggttgctccttttctatcttccttctggcactcttctcgtgcctcaccaccc

SEQ ID NO: 113731 - DNA, 75 bp, Artificial Sequence
  Synthetic
gggtggaggctcttagctcccatcaccgcctacactcaacaaacccgtggcgtcttgggtgccattgtggtcagc

SEQ ID NO: 113732 - DNA, 75 bp, Artificial Sequence
  Synthetic
ctgcctctgcggtacactatgcgaataggtctgacatttaccagctgaccaatgactgccccaacagtagcatcg

SEQ ID NO: 113733 - DNA, 75 bp, Artificial Sequence
  Synthetic
gtgctgaggaggagaagctgcccatcagcccactcagcaactctttgttgagacatcataacctagtctattcaa

SEQ ID NO: 113734 - DNA, 75 bp, Artificial Sequence
  Synthetic
tgtgactcaggtggtggacttttcactagaccccaccttcacgattgagactactacagtaccccaggactcagt

SEQ ID NO: 113735 - DNA, 75 bp, Artificial Sequence
  Synthetic
tcagaagaaggttaccttcgacaggctgcaggtgctcgacgaccattacaagactgcattacaggaggtaaagga

SEQ ID NO: 113736 - DNA, 75 bp, Artificial Sequence
  Synthetic
ggagagggacatcagaaccgaggagtccatctatctgtcctgttcactgcctgaggaggctcgaactgctataca

SEQ ID NO: 113737 - DNA, 75 bp, Artificial Sequence
  Synthetic
ccaccttccgggttgtgtgccctgtgtcatgactggcaatcagtctagatgctgggtgtcggcctcacctacgct

SEQ ID NO: 113738 - DNA, 75 bp, Artificial Sequence
  Synthetic
gcgagcgtctagggtaaaggctcgcatgctcaccatcgaggaagcgtgcgcgctcgtccctcctcactctgcccg

SEQ ID NO: 113739 - DNA, 75 bp, Artificial Sequence
  Synthetic
acaccggctggttagcagggcttttctatcgtaacaagttcaactcttcaggctgtcctgagaggttggccagct

SEQ ID NO: 113740 - DNA, 75 bp, Artificial Sequence
  Synthetic
gtgctctgtgagtgctacgacgccggatgtgcctggtatgagcttacccctgctgagacaaccgttaggttgcgc

SEQ ID NO: 113741 - DNA, 75 bp, Artificial Sequence
  Synthetic
atctgatggtgggcgctgccgcgttttgttcagctatgtacataggtgacttgtgtggtggtgtctttctagttg

SEQ ID NO: 113742 - DNA, 75 bp, Artificial Sequence
  Synthetic
agcggtcgctgtagagcccattgtcttcagcccgatggagaagaaagtcatcacttggggggcagagacggcggc

SEQ ID NO: 113743 - DNA, 75 bp, Artificial Sequence
  Synthetic
ctcgctcccattaccgcttacgcccagcagacacgtggcctgctgggcgccatagtggtaagtctaactgggcgc

SEQ ID NO: 113744 - DNA, 75 bp, Artificial Sequence
  Synthetic
gaccgacggggcgcattactctcaccaaggcctctctcaaccctcaaaggatcatctggtggacccgtgctctgt

SEQ ID NO: 113745 - DNA, 75 bp, Artificial Sequence
  Synthetic
tcactcccagccccgtggtggtgggaacgaccgacaagttgggcgtgcctacctacagctggggtgagaatgata

SEQ ID NO: 113746 - DNA, 75 bp, Artificial Sequence
  Synthetic
catgatgatgaattggtcgcctacggccggtctgatagtctcctacgccctacgcgtacccgaattgatcatgga

SEQ ID NO: 113747 - DNA, 75 bp, Artificial Sequence
  Synthetic
ctcaaactaagcagggaggggaaaacttcccctacctagtggcctaccaagccacggtgtgcgtccgtgtacagg

SEQ ID NO: 113748 - DNA, 75 bp, Artificial Sequence
  Synthetic
gtccttccttggcaccacaatctcgggggttctctggaccgtgttccacggcgccggcaacaagacgttggctgg

SEQ ID NO: 113749 - DNA, 75 bp, Artificial Sequence
  Synthetic
gtgcttggggcgctgctgtattattctatggtagctaattgggccaaggtcatcgccgttctcatcttgtttgcg

SEQ ID NO: 113750 - DNA, 75 bp, Artificial Sequence
  Synthetic
gaatgagatcactttaacccaccccataaccaagtacattatggcatgcatgtcagcagacctggaagtcatcac

SEQ ID NO: 113751 - DNA, 75 bp, Artificial Sequence
  Synthetic
caggttcgcaggcctatttacaccagggcctcaacagcacttgcagctcattaatagcaatggcagctggcacat

SEQ ID NO: 113752 - DNA, 75 bp, Artificial Sequence
  Synthetic
atccagtacgccccaacaatttgggcgcgcatggtcctaatgacacactttttctccgtcctaatggcccaggac

SEQ ID NO: 113753 - DNA, 75 bp, Artificial Sequence
  Synthetic
aaaccagccgttataccggatagagaggcaatgtaccaacaatttgatgagatggaggagtgctcctcccgcatt

SEQ ID NO: 113754 - DNA, 75 bp, Artificial Sequence
  Synthetic
gtgtggttatcgccgctgccgtgccagtggagttctgcctaccagcttcggcaacacaatcacttgttacatcaa

SEQ ID NO: 113755 - DNA, 75 bp, Artificial Sequence
  Synthetic
ggctccggtccctggattacacccaggtgcctggtcgactacccgtataggctttggcattatccttgtaccatc

SEQ ID NO: 113756 - DNA, 75 bp, Artificial Sequence
  Synthetic
atgagctcgtgtaagccccttacctcgtttgacaaggggtggggtcctatcacgtatgccaccatcaatggctca

SEQ ID NO: 113757 - DNA, 75 bp, Artificial Sequence
  Synthetic
ccgtgttcattcacgaccctgccagccttgtccaccggcctcatccacctccaccagaacattgtggacgtgcag

SEQ ID NO: 113758 - DNA, 75 bp, Artificial Sequence
  Synthetic
acctgtcctctgttccagggctcatgccgtcgggatcttccgcgcagctgtgtgctctaggggagtggcaaagtc

SEQ ID NO: 113759 - DNA, 75 bp, Artificial Sequence
  Synthetic
ggcaagttcctcgcagatggaggctgctcagccggcgcctatgatatcatcatatgcgacgaatgccattcagtg

SEQ ID NO: 113760 - DNA, 75 bp, Artificial Sequence
  Synthetic
tggcgacatccgcgtggaccaaggctgaacagttttggaacaagcacatgtggaacttcgtgagcgggattcaat

SEQ ID NO: 113761 - DNA, 75 bp, Artificial Sequence
  Synthetic
cccgtttactgctttacaccatctcctgtagtcgttggcactacggacagggcaggtctccccacttacacctgg

SEQ ID NO: 113762 - DNA, 75 bp, Artificial Sequence
  Synthetic
gggtacctgcatgctcctaccggaagcgggaagagtaccaaggttcctgcggcgtatgctgctcaggggtataaa

SEQ ID NO: 113763 - DNA, 75 bp, Artificial Sequence
  Synthetic
agtggagttctgcctaccagcttcggcaacacaatcacttgttacatcaaggccacagcggccgcaagggccgca

SEQ ID NO: 113764 - DNA, 75 bp, Artificial Sequence
  Synthetic
gcgggaagagtaccaaggttcctgcggcgtatgctgctcaggggtataaagtactagtactaaacccctcagtag

SEQ ID NO: 113765 - DNA, 75 bp, Artificial Sequence
  Synthetic
gggaggatggttcggctgtacctggatgaactctacggggttcgtcaagacatgcggagcacccccctgtaagtt

SEQ ID NO: 113766 - DNA, 75 bp, Artificial Sequence
  Synthetic
tctctttaatatcttgggaggttgggtagcctcccagatagccccccctacagctgctaccgcctttgtcgtcag

SEQ ID NO: 113767 - DNA, 75 bp, Artificial Sequence
  Synthetic
ctactccacatatggcaaattcctcgcagatggaggctgcgcaggcggagcctatgacatcataatatgcgacga

SEQ ID NO: 113768 - DNA, 75 bp, Artificial Sequence
  Synthetic
cccggactacgtccctccagtggtacacgggtgcccattaccacctactaaggcccctccaataccacctccacg

SEQ ID NO: 113769 - DNA, 75 bp, Artificial Sequence
  Synthetic
tgtgaacttcaccgtacacaagattcgcatgtatgttggcggggttgagcatagactcactgctgcttgcaattg

SEQ ID NO: 113770 - DNA, 75 bp, Artificial Sequence
  Synthetic
tttaagatcatgagtggcgagaggcccacaacagaagacctcgtcaacctcctgcctgccatcttgagccctggt

SEQ ID NO: 113771 - DNA, 75 bp, Artificial Sequence
  Synthetic
ggctagtgcacttgaatgagtcagtggtctcgagcgccttggcgcagcttgccgataaggtgtttgtggagagta

SEQ ID NO: 113772 - DNA, 75 bp, Artificial Sequence
  Synthetic
cccgaggcaaccacgtgtcacccacgcactacgtgcctgagacggacgcgtcagcaaaagtcacacagctgctga

SEQ ID NO: 113773 - DNA, 75 bp, Artificial Sequence
  Synthetic
acacccatgccagccctctccactggcctcatccacttgcatcagaacgtcgtggacgtgcagtatctctatggt

SEQ ID NO: 113774 - DNA, 75 bp, Artificial Sequence
  Synthetic
cgtggacgtgcagtatctctatggtctgaccccgtccgtcgtgtcgtggtcgatcaagtgggaataccttgtcct

SEQ ID NO: 113775 - DNA, 75 bp, Artificial Sequence
  Synthetic
cagctggtttacggttggcgtcggcgggaacgacatttatcacagcgtgtcacgtgcccgaacccgccatttgct

SEQ ID NO: 113776 - DNA, 75 bp, Artificial Sequence
  Synthetic
ctgggtgtgcaccattctaactgacttcaagaactggctcaaggctaaaatcactccgtcgctccccggcgttcc

SEQ ID NO: 113777 - DNA, 75 bp, Artificial Sequence
  Synthetic
accgttccccaggatgctgtctcgcgtagccagcgtcggggtaggaccggtcgagggagacatggcatatacagg

SEQ ID NO: 113778 - DNA, 75 bp, Artificial Sequence
  Synthetic
ggcgcttgagaatctcatcgtcctcaatgctgcctctgccgccagcagtcatggctggatctggtgcattgtctt

SEQ ID NO: 113779 - DNA, 75 bp, Artificial Sequence
  Synthetic
gtagccagcgtcggggtaggaccggtcgagggagacatggcatatacaggtatgtttcctccggtgaacgacctt

SEQ ID NO: 113780 - DNA, 75 bp, Artificial Sequence
  Synthetic
gctttgcctactcctactgactgtgggggtaggcatctttctcctgccagcacggtgagctggtaggataacact

SEQ ID NO: 113781 - DNA, 75 bp, Artificial Sequence
  Synthetic
aacgggaccatgagaattgtaggcccaaagatgtgctctaacacctggcacggaactttcccgataaacggcagc

SEQ ID NO: 113782 - DNA, 75 bp, Artificial Sequence
  Synthetic
ccagtcgtcttctccccaatggagaccaagctcatcacgtggggggcagacaccgccgcgtgcggtgacatcatc

SEQ ID NO: 113783 - DNA, 75 bp, Artificial Sequence
  Synthetic
caacgagcgtacgcttacgacagggagcaggctgcctccctcggggtgtcggtgattgttgtcatcaccgtccta

SEQ ID NO: 113784 - DNA, 75 bp, Artificial Sequence
  Synthetic
cctggacgaccattaccgggacgtgctcaaggagatgaaggcgaaggcgtccacagttaaggctaaacttctatc

SEQ ID NO: 113785 - DNA, 75 bp, Artificial Sequence
  Synthetic
tcactaaccccagtttacaagtggctgctcttgcagttcctgtggtggaaccagtacttcatagcacgcgccgaa

SEQ ID NO: 113786 - DNA, 75 bp, Artificial Sequence
  Synthetic
accattacatcactggaatgacccaggataacctgaaatgcccatgtcaagttccatcaccggagtttttcacgg

SEQ ID NO: 113787 - DNA, 75 bp, Artificial Sequence
  Synthetic
acaaagcaagcgggggaaaattttccgtacctagtggcttatcaggccacggtatgtgccagggcaaaagcccct

SEQ ID NO: 113788 - DNA, 75 bp, Artificial Sequence
  Synthetic
cgctgtgatattgctcacgtgcctcttccaccctgcactcggatttgacattaccaagatactccttgccatcct

SEQ ID NO: 113789 - DNA, 75 bp, Artificial Sequence
  Synthetic
tgcatcaacggggtatgctggactgtctaccacggggccgggacgaggaccattgcatcacccaaaggtcctgtc

SEQ ID NO: 113790 - DNA, 75 bp, Artificial Sequence
  Synthetic
ttaccaagatactccttgccatcctaggtcccctgtacatcctccaagcgggcttgctgcgggtaccatactatg

SEQ ID NO: 113791 - DNA, 75 bp, Artificial Sequence
  Synthetic
gtctcaattgccatgtgagccagagcccgacgtgacagtcctaacatcacttctaactgatccatctcacataac

SEQ ID NO: 113792 - DNA, 75 bp, Artificial Sequence
  Synthetic
ggctcctcggacctttacctggtcacgaggcacgccgatgtcattcccgtgcgccggcggggtgatagcaggggc

SEQ ID NO: 113793 - DNA, 75 bp, Artificial Sequence
  Synthetic
tgctgcggctcggggcttggactggcacctacatctatgaccatctggcaccgatgtccgactgggcatgtgatg

SEQ ID NO: 113794 - DNA, 75 bp, Artificial Sequence
  Synthetic
accacgcatcggaataccccggatgcggacctcatagaggccaatctcctatggagacagtgcatgggaggcaac

SEQ ID NO: 113795 - DNA, 75 bp, Artificial Sequence
  Synthetic
aatcattgcccctgacaaagaggtcctttacgaggcttttgacgagatggaggagtgcgcttccaaggccgccct

SEQ ID NO: 113796 - DNA, 75 bp, Artificial Sequence
  Synthetic
actcgagtattgtgtacgagacggccgataccatcctacactctccggggtgtgtcccttgcgttcgcgagggta

SEQ ID NO: 113797 - DNA, 75 bp, Artificial Sequence
  Synthetic
ctggggtcctatcagtcatgctaacggaaccggccttgaccaacgcccctactgttggcactatgctccaaaacc

SEQ ID NO: 113798 - DNA, 75 bp, Artificial Sequence
  Synthetic
gcttcaggaggggccccaagtttcctccggccctccctatatgggcgaggccggactataaccctccccttctgg

SEQ ID NO: 113799 - DNA, 75 bp, Artificial Sequence
  Synthetic
acagcataccatcaacagactcgtggcttgctcggcacgatcgtcaccagcttgaccggccgagacaagaacgaa

SEQ ID NO: 113800 - DNA, 75 bp, Artificial Sequence
  Synthetic
caggctacttggcccaagctggagcagttctgggccaagcacatgtggaacttcatcagcggtatccaatatctt

SEQ ID NO: 113801 - DNA, 75 bp, Artificial Sequence
  Synthetic
gcttgctcggcacgatcgtcaccagcttgaccggccgagacaagaacgaagctgagggtgaggtccaggtgctct

SEQ ID NO: 113802 - DNA, 75 bp, Artificial Sequence
  Synthetic
cttcatcagcggtatccaatatcttgctggactctccacactgccgggaaatcctgccgtggcggcgatgatggc

SEQ ID NO: 113803 - DNA, 75 bp, Artificial Sequence
  Synthetic
gagcctgcgagtcttcacggaggctatgaccaggtactctgccccccccggggacccgccccaaccagaatacga

SEQ ID NO: 113804 - DNA, 75 bp, Artificial Sequence
  Synthetic
caagaagaccccaatggggttttcgtatgatacccgctgcttcgactccacagtcactgagaatgatatccgtac

SEQ ID NO: 113805 - DNA, 75 bp, Artificial Sequence
  Synthetic
acaggtggagctatccgaatctacagtatcccaagtcctgaaagatctggcagacgccaggttttccggacttgc

SEQ ID NO: 113806 - DNA, 75 bp, Artificial Sequence
  Synthetic
tatggcatgggatatgatgatgaactggtcccctacaacagcgctggtagtagctcagctgctcagggtcccgca

SEQ ID NO: 113807 - DNA, 75 bp, Artificial Sequence
  Synthetic
tcctccatgccacccctagagggggagcctggggatcctgacttgagtgacgggtcgtggtccacaatgagtgac

SEQ ID NO: 113808 - DNA, 75 bp, Artificial Sequence
  Synthetic
agataccagggcaggcctgcttagccccagacccctgagcactttaaagggctcgtcaggagggccgatcctgtg

SEQ ID NO: 113809 - DNA, 75 bp, Artificial Sequence
  Synthetic
ccgccatcctttctcctggtgccctggtggtaggggtcatctgcgcggccattctgcgccgacacgtgggacaag

SEQ ID NO: 113810 - DNA, 75 bp, Artificial Sequence
  Synthetic
attctgcgccgacacgtgggacaaggggaaggcgcggtccaatggatgaataggctcattgcctttgcgtccaga

SEQ ID NO: 113811 - DNA, 75 bp, Artificial Sequence
  Synthetic
gggaaggcgcggtccaatggatgaataggctcattgcctttgcgtccagaggtaaccatgtcgccccgacacatt

SEQ ID NO: 113812 - DNA, 75 bp, Artificial Sequence
  Synthetic
agaatgttcagctggtgaacaccaacggcagttggcacattaacagcacggccttgaactgtaatgcgagtctcg

SEQ ID NO: 113813 - DNA, 75 bp, Artificial Sequence
  Synthetic
tgagcaatagcttgctacgccatcacaacctcgtgtactgtacatcgtcacgaagtgcggggcttaggcaaaaga

SEQ ID NO: 113814 - DNA, 75 bp, Artificial Sequence
  Synthetic
atgagatcaccggtcttcactgacaattcaaccccgccggccgtaccgcagacctaccaagtagggtacctccac

SEQ ID NO: 113815 - DNA, 75 bp, Artificial Sequence
  Synthetic
ctaccccgtcccttgcgccgggtcatggctctgggacgtgtgggattggatctgctccatcctaacggacttcaa

SEQ ID NO: 113816 - DNA, 75 bp, Artificial Sequence
  Synthetic
tttgtggcaccgggggagcgcccttccggcatgttcgactcgtccgtcctctgtgagtgctatgacgcgggctgt

SEQ ID NO: 113817 - DNA, 75 bp, Artificial Sequence
  Synthetic
cattcggtcagtatatgagcaaggcctatggtattgacccaaacattcggacgggtgtcagaacaatcactactg

SEQ ID NO: 113818 - DNA, 75 bp, Artificial Sequence
  Synthetic
ttttgaggcggcttgtcgcttaacaccgccccattcagcgcgttccaagtacggctatggggccaaggaagtccg

SEQ ID NO: 113819 - DNA, 75 bp, Artificial Sequence
  Synthetic
tttcctgtcaaaagggctacaagggggtgtgggccggtaccggcatcatgaccacacgatgcccgtgcggtgcta

SEQ ID NO: 113820 - DNA, 75 bp, Artificial Sequence
  Synthetic
ctatggtattgacccaaacattcggacgggtgtcagaacaatcactactgggggtgccattacctattccacata

SEQ ID NO: 113821 - DNA, 75 bp, Artificial Sequence
  Synthetic
gccttgtggcatcgtgccagcacggaacgtatgtggcccagtattctgcttcactcccagccccgtggtggtggg

SEQ ID NO: 113822 - DNA, 75 bp, Artificial Sequence
  Synthetic
ttcgatgaggataacagggccaaaaacttgcatgaacacttggcagggaaccttccccatcaactgttacacaga

SEQ ID NO: 113823 - DNA, 75 bp, Artificial Sequence
  Synthetic
gaggtgttcacggtggtaccatctaagggggggaaaaagcctgccaggctaatagtgttccccgacctgggagtg

SEQ ID NO: 113824 - DNA, 75 bp, Artificial Sequence
  Synthetic
ggcactgtcctagaccaagcggaaacagctggagcccgtctcacggtcctagctaccgcaactccccccggctca

SEQ ID NO: 113825 - DNA, 75 bp, Artificial Sequence
  Synthetic
cgcgcaggggcccgagattgggtgtgcgcgcgacgaggaagacttccgaacggtcccagcccagaggcaggcgcc

SEQ ID NO: 113826 - DNA, 75 bp, Artificial Sequence
  Synthetic
gtaaccgttccacaccccaacatcacagagacagctctgcccctaacgggggaggtgcctttctacggcaaggcc

SEQ ID NO: 113827 - DNA, 75 bp, Artificial Sequence
  Synthetic
cccttttcatgagagaagatgtgacccggattgagtctgactctaaggtgatcgttcttgactacctcgattcca

SEQ ID NO: 113828 - DNA, 75 bp, Artificial Sequence
  Synthetic
tcgaattcctggtgaagacctggaaacagaagaaagttcccatggctttctcgtatgacacccgctgctttgatt

SEQ ID NO: 113829 - DNA, 75 bp, Artificial Sequence
  Synthetic
cttataaacaccaacggcagctggcacatcaacaggactgctctgaactgcaatgactccctccagactgggttc

SEQ ID NO: 113830 - DNA, 75 bp, Artificial Sequence
  Synthetic
tatgtgacaggactgacaactgacaacttgaaggtcccctgccaaataccatctcctgaattcttctcctgggtg

SEQ ID NO: 113831 - DNA, 75 bp, Artificial Sequence
  Synthetic
acttgaaggtcccctgccaaataccatctcctgaattcttctcctgggtggacggtgtgcaaatccacagatttg

SEQ ID NO: 113832 - DNA, 75 bp, Artificial Sequence
  Synthetic
atgccgtcgccttctaccgtggtgtcgatgtggcagttattccaacgacgggcgacgtagttgtttgcgccaccg

SEQ ID NO: 113833 - DNA, 75 bp, Artificial Sequence
  Synthetic
ggccgtcttggggccccaatgatccccggcggaggtcccgcaatctgggtaaggtcatcgataccctgacatgcg

SEQ ID NO: 113834 - DNA, 75 bp, Artificial Sequence
  Synthetic
cttgtactgtggaggcccaatgtttaatagcaagggggagcggtgtggctaccgcagatgccgcgcaagcggcgt

SEQ ID NO: 113835 - DNA, 75 bp, Artificial Sequence
  Synthetic
ggcgacgtagttgtttgcgccaccgacgccctcatgaccgggtatacaggcgatttcgactctgtcatagactgc

SEQ ID NO: 113836 - DNA, 75 bp, Artificial Sequence
  Synthetic
catctcatatcacggctgaggcggcagcagggcgattggcgcggggttcgcccccatcggaggccagctcttccg

SEQ ID NO: 113837 - DNA, 75 bp, Artificial Sequence
  Synthetic
gatgctgtggccagaagtcaacggcgtggtcggactggacggggaaaaccgggggtgtataggtatgtctcgcag

SEQ ID NO: 113838 - DNA, 75 bp, Artificial Sequence
  Synthetic
gacgacttggtggtcatttgcgagagccagggagtcacggaggatgaagcctgcctgagagtcttcacggaggct

SEQ ID NO: 113839 - DNA, 75 bp, Artificial Sequence
  Synthetic
aggatgttcgtgggaggcatcgagcaccggtttgacgccgcatgtaattggaccaggggcgagcggtgcgagcta

SEQ ID NO: 113840 - DNA, 75 bp, Artificial Sequence
  Synthetic
ggttgctctttctctatcttcctcttggcacttctctcgtgcctgactgttcccgcttcggccgccgactatcgc

SEQ ID NO: 113841 - DNA, 75 bp, Artificial Sequence
  Synthetic
caactatgcaacggggaatcttcccggttgctctttctctatcttcctcttggcacttctctcgtgcctgactgt

SEQ ID NO: 113842 - DNA, 75 bp, Artificial Sequence
  Synthetic
cggactccctgtttgtcaagatcacctggagttctgggagggggtgtttactggcctcacccacattgatgccca

SEQ ID NO: 113843 - DNA, 75 bp, Artificial Sequence
  Synthetic
cacggcccgactacaacccgccggtcgtggagacctggaaaagaccagactatcaaccaccaacggtagcgggat

SEQ ID NO: 113844 - DNA, 75 bp, Artificial Sequence
  Synthetic
tggccagctgccgaccccttaccgattttgaccagggctggggccctatcagtcatgccaacggaagcggccccg

SEQ ID NO: 113845 - DNA, 75 bp, Artificial Sequence
  Synthetic
ccgcgggcaacagagtttactttctcacccgcgaccccgagattccgctcgcgagggctgcgtgggagactgcaa

SEQ ID NO: 113846 - DNA, 75 bp, Artificial Sequence
  Synthetic
gtgttaaatccgggaatcagtccaaatgctgggtggcccttactcccactgtggcggcgccttatctcggtgctc

SEQ ID NO: 113847 - DNA, 75 bp, Artificial Sequence
  Synthetic
cgcaccgtggcactagaccagagcaccgtgggggaagctcttagagagctggccattaaagcctttggccaacct

SEQ ID NO: 113848 - DNA, 75 bp, Artificial Sequence
  Synthetic
gacattatgtggaaatgcctcacacggctaaagcccatgctaacgggcccaacccccctgctgtacaggcttgga

SEQ ID NO: 113849 - DNA, 75 bp, Artificial Sequence
  Synthetic
gagccaggagacgctggagaaggctcttgccttcgaaatgtatggctcagtctactcagtcactccgctggattt

SEQ ID NO: 113850 - DNA, 75 bp, Artificial Sequence
  Synthetic
atactgcgccggcacgttggcccgggcgagggggcagtgcagtggatgaaccggctaatagccttcgcctcccgg

SEQ ID NO: 113851 - DNA, 75 bp, Artificial Sequence
  Synthetic
cggtcagatgttctctttccggccacggcgccattggactacccaggagtgcaactgcagcatctacgcggggca

SEQ ID NO: 113852 - DNA, 75 bp, Artificial Sequence
  Synthetic
ccccccaaaaccttgtggtattgtgcccgcaaagagcgtgtgtggcccagtatattgcttcactcccagccccgt

SEQ ID NO: 113853 - DNA, 75 bp, Artificial Sequence
  Synthetic
accatcacccccatgtacaagaagctgttgacctgcttcatttggtggaatcagtacttcctcgcccgagctgag

SEQ ID NO: 113854 - DNA, 75 bp, Artificial Sequence
  Synthetic
ggctaaagcccatgctaacgggcccaacccccctgctgtacaggcttggacctgtcaacaatgaggtcacgacca

SEQ ID NO: 113855 - DNA, 75 bp, Artificial Sequence
  Synthetic
ggggttccacctctgagagcttggagacatcgggcccgagctgttcgcgctaggctcatcgcccagggagggaag

SEQ ID NO: 113856 - DNA, 75 bp, Artificial Sequence
  Synthetic
ggcgtactgcctgacagtaggtagcgtcgtcatctgcggcagaattgtgacatcagggaaacctgtcccaatgcc

SEQ ID NO: 113857 - DNA, 75 bp, Artificial Sequence
  Synthetic
gacttgctcgccggggggcatcggggtgtcctcgctggagtggcgtacttcagcatgcaagccaactgggccaaa

SEQ ID NO: 113858 - DNA, 75 bp, Artificial Sequence
  Synthetic
taggctcatcgcccagggagggaaggctgcaatatgcggcaagtacctctttaactgggcggtaaaaacaaagct

SEQ ID NO: 113859 - DNA, 75 bp, Artificial Sequence
  Synthetic
aatgattccctgcagacagggttcattgccgggttgttatactattcgcggttcaattccacgggttgccccgcc

SEQ ID NO: 113860 - DNA, 75 bp, Artificial Sequence
  Synthetic
tgagctccatgccccccctcgagggggaacctggagacccagacttggagccaggaccggtcgagcaggagcctt

SEQ ID NO: 113861 - DNA, 75 bp, Artificial Sequence
  Synthetic
ctggactggggccttgataaccccttgcagcccggaggaaggaaagttgcctatcaatccactcagcaactcctt

SEQ ID NO: 113862 - DNA, 75 bp, Artificial Sequence
  Synthetic
cgcctcatcgtataccctgacctcggggtcagggtgtgcgaaaagatggccctttatgacattgcacaaaagctt

SEQ ID NO: 113863 - DNA, 75 bp, Artificial Sequence
  Synthetic
cagaaagtccttgggctgctccaggccacgaccaagcaagccgaagagcttaagccagcagttcaatcggcttgg

SEQ ID NO: 113864 - DNA, 75 bp, Artificial Sequence
  Synthetic
gccccggggccaagcaaagtttacagctcattgacaccaacggaagctggcacatcaacaggactgccctcaatt

SEQ ID NO: 113865 - DNA, 75 bp, Artificial Sequence
  Synthetic
ctatcaatccactcagcaactccttgttgcggtaccacaacaaggtatactgtaccacatcaaagagcgcctcac

SEQ ID NO: 113866 - DNA, 75 bp, Artificial Sequence
  Synthetic
cccaaggtggaacagttctggcagaaacatctatggaactttgtcagcgggatacagtatctagcgggtctttcc

SEQ ID NO: 113867 - DNA, 75 bp, Artificial Sequence
  Synthetic
tcgatccgcttgtggcggaggaggacgagcgggagatctccgtacccgcagaaatcctgcggaagtctcggagat

SEQ ID NO: 113868 - DNA, 75 bp, Artificial Sequence
  Synthetic
tgacgacttcccccagggctggggcccgcttaaagctgccaccatcagcgggccggctgaggacaggccctactg

SEQ ID NO: 113869 - DNA, 75 bp, Artificial Sequence
  Synthetic
tggggggagaatgagaccgatgtgttcttgctttccagcgcacgccctcctggcgggccctggttcggttgcaca

SEQ ID NO: 113870 - DNA, 75 bp, Artificial Sequence
  Synthetic
ggggttggatcgcctctcagctggccccgcctacggcatcgacggcctttgtcgttagcggcatggctggcgctg

SEQ ID NO: 113871 - DNA, 75 bp, Artificial Sequence
  Synthetic
gacggcgggtgctcagggggtgcttatgacataataatttgtgacgagtgccactccacggatgccacatccatc

SEQ ID NO: 113872 - DNA, 75 bp, Artificial Sequence
  Synthetic
gaccgcgtcggggtccctacatacaactggggggctaatgagactgatgtattcctcctcaattcaaccagacct

SEQ ID NO: 113873 - DNA, 75 bp, Artificial Sequence
  Synthetic
tgaagcccccgcgcttgaggacatggtcaatctcctaccggctcttctttcgccgggcgccctagtcgtgggcgt

SEQ ID NO: 113874 - DNA, 75 bp, Artificial Sequence
  Synthetic
agcgctgtcctactgactgtttcaggaaacacccggagactacctatgccaagtgcgggtcggggccttggatca

SEQ ID NO: 113875 - DNA, 75 bp, Artificial Sequence
  Synthetic
catattggaccttcggagggggccaatcagtggatgaacagactgatagcctttgcctctcggggcaatcatgtc

SEQ ID NO: 113876 - DNA, 75 bp, Artificial Sequence
  Synthetic
gacaaggacctagtaggatggccatctcccccgggagcaaggtcgctcaccccatgtacttgtggctctagtgac

SEQ ID NO: 113877 - DNA, 75 bp, Artificial Sequence
  Synthetic
gatactcagttccctcaccatcactagccttcttcggagactccacgagtggatcaacggagattggacaactcc

SEQ ID NO: 113878 - DNA, 75 bp, Artificial Sequence
  Synthetic
gcacaggatggacgcagcatgcaactggactaggggagaaccctgcgatctggaacacagagaccgcacggagct

SEQ ID NO: 113879 - DNA, 75 bp, Artificial Sequence
  Synthetic
ggtcccatgcaaaacagcaaggggcaatcctgcggatacaggcgctgccgcgccagcggggtgctcaccactagc

SEQ ID NO: 113880 - DNA, 75 bp, Artificial Sequence
  Synthetic
atgggaaacactctcacatgctacgtgaaagcccaagcggcctgtaaggccgcgggcattgttgcaccaacgatg

SEQ ID NO: 113881 - DNA, 75 bp, Artificial Sequence
  Synthetic
atcgtggatgtccagtacttgtacggcattgggtcgtcagtggtatcatggggtctcaagtgggagtacgttgtg

SEQ ID NO: 113882 - DNA, 75 bp, Artificial Sequence
  Synthetic
atgtgaagaatgggaccatgaagatcataggtcccaggacgtgcagcaatacctggcatggtacgttccccatca

SEQ ID NO: 113883 - DNA, 75 bp, Artificial Sequence
  Synthetic
gcacacatactctccccacgaactctcacgggtggcagcgactctcagaaagcttggagcgcctcccctcagagc

SEQ ID NO: 113884 - DNA, 75 bp, Artificial Sequence
  Synthetic
ccgcccctcccggcgaccccccaaaacctgaatatgacttggagctgataacatcatgctcttccaatgtatctg

SEQ ID NO: 113885 - DNA, 75 bp, Artificial Sequence
  Synthetic
tcaatgccgcatcagctgctagcacccatggcttcggctatgccgtcctcttcatctgcgttgcctggcacatca

SEQ ID NO: 113886 - DNA, 75 bp, Artificial Sequence
  Synthetic
tggggacagccactacatcgtggctgctacatcagacaacttgaaatgcccgtgtcaggtgccgtcccctgagtt

SEQ ID NO: 113887 - DNA, 75 bp, Artificial Sequence
  Synthetic
gctacatcagacaacttgaaatgcccgtgtcaggtgccgtcccctgagttcttcactgaggtggacggcgtcaga

SEQ ID NO: 113888 - DNA, 75 bp, Artificial Sequence
  Synthetic
ggaagtggcagggacccttggcggtggcgtagtcatcatgctgaccctactaacactgtctccaagctacaaaca

SEQ ID NO: 113889 - DNA, 75 bp, Artificial Sequence
  Synthetic
aaccggagcctgatgttgcagtgctgacgtccatgctcacagatccagcccacatcaccgcagagacggcgggtc

SEQ ID NO: 113890 - DNA, 75 bp, Artificial Sequence
  Synthetic
gaaagactccatgggcttgacgtcttctctctgcacacatactctccccacgaactcacgcgggtggcatctgct

SEQ ID NO: 113891 - DNA, 75 bp, Artificial Sequence
  Synthetic
cacatcaccgcagagacggcgggtcgacgcctcgcgagaggctccccaccgtcattggccagttcctccgcaagt

SEQ ID NO: 113892 - DNA, 75 bp, Artificial Sequence
  Synthetic
gactcgataatcatccttgctgtcctggtcaggccacagctaatctttgacattaccaaacatctcctatccatt

SEQ ID NO: 113893 - DNA, 75 bp, Artificial Sequence
  Synthetic
actagggtgccggctgcttatgcagcccaggggtacaaggtactcgtcctaaacccgtccgtcgctgctacctta

SEQ ID NO: 113894 - DNA, 75 bp, Artificial Sequence
  Synthetic
gtggaaacatcactcgggtcgagtctgagaacaaaataatagttctcgactcattcgatcctctggtcgccgaga

SEQ ID NO: 113895 - DNA, 75 bp, Artificial Sequence
  Synthetic
cctgcggcaagtactgccaaatggctatactcaagatgggggccctaactggcacctatgtctacaaccacctca

SEQ ID NO: 113896 - DNA, 75 bp, Artificial Sequence
  Synthetic
tcagcctgagaaggggggtcgtaagccagctcgtctcatcgtgttccccgacctgggtgtgcgcgtgtgcgagaa

SEQ ID NO: 113897 - DNA, 75 bp, Artificial Sequence
  Synthetic
tgcaagtgtggatcccccccctcaacgttcgggggggccgcgatgccatcatcctcctcatgtgcgtaatccacc

SEQ ID NO: 113898 - DNA, 75 bp, Artificial Sequence
  Synthetic
cagggggaagccaggcatctacagatttgtggcaccgggggagcgcccttccggcatgttcgactcgtccgtcct

SEQ ID NO: 113899 - DNA, 75 bp, Artificial Sequence
  Synthetic
gccgctgttggagacctggaagaaaccagattacgacccccccacagtggcgggctgtgcattgcccccctcagg

SEQ ID NO: 113900 - DNA, 75 bp, Artificial Sequence
  Synthetic
cagaccctgctcctcaacatactcggcggctggatagccgcccaagtggctcccccccccgcgtctacagctttt

SEQ ID NO: 113901 - DNA, 75 bp, Artificial Sequence
  Synthetic
ctgtggacagtctatcatggggccggctcgaagaccctcgccggcccaaaaggtcctgtttgccagatgtacacc

SEQ ID NO: 113902 - DNA, 75 bp, Artificial Sequence
  Synthetic
cgctgacaccgctgcgtgtggtgacatcataagggggctgccggtctcggctaggctaggcaatgagatcttgct

SEQ ID NO: 113903 - DNA, 75 bp, Artificial Sequence
  Synthetic
caagcgtggaagtccaagaagaccccaatggggttctcgtatgatacccgctgttttgactccacagtcactgag

SEQ ID NO: 113904 - DNA, 75 bp, Artificial Sequence
  Synthetic
aaggggtggaggctccttgccccgatcaccgcatacgcgcagcagacccgtggcttgttcagcaccatcataacg

SEQ ID NO: 113905 - DNA, 75 bp, Artificial Sequence
  Synthetic
cgagctcgcccagaagtccttcccagagggttccacggcgtcacaagctgagtcggggatagactgttctgtccc

SEQ ID NO: 113906 - DNA, 75 bp, Artificial Sequence
  Synthetic
cgtgtgcgctagggctcaagcccctcccccatcgtgggaccagatgtggaagtgcttgatccgcctcaagcccac

SEQ ID NO: 113907 - DNA, 75 bp, Artificial Sequence
  Synthetic
ggagaagacgacgccggctctgaggccggctcgttcagctcaatgccaccacttgagggcgagcctggtgaccca

SEQ ID NO: 113908 - DNA, 75 bp, Artificial Sequence
  Synthetic
gcggtccacccagagctaatctttgacatcaccaaactcctgctcgccatactcggtccgctcatggtgctccag

SEQ ID NO: 113909 - DNA, 75 bp, Artificial Sequence
  Synthetic
caagaccatcagcggcccgaagggacctgttaaccaaatgtacaccaatgttgaccaagacttggtgggatggcc

SEQ ID NO: 113910 - DNA, 75 bp, Artificial Sequence
  Synthetic
ggactgtttaccatggagcgggcagcaagaccatcagcggcccgaagggacctgttaaccaaatgtacaccaatg

SEQ ID NO: 113911 - DNA, 75 bp, Artificial Sequence
  Synthetic
cagcagcgttgtctgttgctctatgtcatactcatggacaggagcactcattacaccatgcgctgcggaggagga

SEQ ID NO: 113912 - DNA, 75 bp, Artificial Sequence
  Synthetic
tccatggtggggaactgggctaaggtcttgatcgtgatgctactctttgccggcgttgacgggggaaccgcggtg

SEQ ID NO: 113913 - DNA, 75 bp, Artificial Sequence
  Synthetic
accacaaacctaccaggtgggatatcttcacgcacccacagggagcgggaagagcactaaagtcccggcggctta

SEQ ID NO: 113914 - DNA, 75 bp, Artificial Sequence
  Synthetic
atatcaataggaccgctctgaactgcaatgagtcccacagcactgggtggcttgccgcgctgttctatgcgcgca

SEQ ID NO: 113915 - DNA, 75 bp, Artificial Sequence
  Synthetic
ggcgataccaggggggctctcctgagccccaggccaatatccactcttaagggatcttctggcgggccactgttg

SEQ ID NO: 113916 - DNA, 75 bp, Artificial Sequence
  Synthetic
tgccccatgggccacgctgccggcatattccgcgcggctgtgtgcacccgaggggtagccaaagcggtggacttc

SEQ ID NO: 113917 - DNA, 75 bp, Artificial Sequence
  Synthetic
tgccccatgggccacgctgccggcatattccgcgcggctgtgtgcacccgaggggtagccaatgcggtggacttc

SEQ ID NO: 113918 - DNA, 75 bp, Artificial Sequence
  Synthetic
tgccccatgggccacgctgccggcatattccgcgcggctgtgtgcacccgaggggtagccaacgcggtggacttc

SEQ ID NO: 113919 - DNA, 75 bp, Artificial Sequence
  Synthetic
tgccccatgggccacgctgccggcatattccgcgcggctgtgtgcacccgaggggtagccaaggcggtggacttc

SEQ ID NO: 113920 - DNA, 75 bp, Artificial Sequence
  Synthetic
accaacactattctgatgttctcaaggaggtaaaagcccgagcctcccaggtgagcgccaggctcctctccacgg

SEQ ID NO: 113921 - DNA, 75 bp, Artificial Sequence
  Synthetic
cccggaccagaggccttattgttggcactacgcacctcaaccgtgcggtattgtacccgcgtcgcaggtgtgtgg

SEQ ID NO: 113922 - DNA, 75 bp, Artificial Sequence
  Synthetic
ttgtacccgcgtcgcaggtgtgtggcccagtgtattgcttcaccccaagcccagttgtggtggggacgaccgatc

SEQ ID NO: 113923 - DNA, 75 bp, Artificial Sequence
  Synthetic
acgcaccaacggggagcggcaagagcaccaaggtcccggcagcgtacgctgcccagggctaaaaggtgctagtgc

SEQ ID NO: 113924 - DNA, 75 bp, Artificial Sequence
  Synthetic
acgcaccaacggggagcggcaagagcaccaaggtcccggcagcgtacgctgcccagggctataaggtgctagtgc

SEQ ID NO: 113925 - DNA, 75 bp, Artificial Sequence
  Synthetic
acgcaccaacggggagcggcaagagcaccaaggtcccggcagcgtacgctgcccagggctacaaggtgctagtgc

SEQ ID NO: 113926 - DNA, 75 bp, Artificial Sequence
  Synthetic
acgcaccaacggggagcggcaagagcaccaaggtcccggcagcgtacgctgcccagggctagaaggtgctagtgc

SEQ ID NO: 113927 - DNA, 75 bp, Artificial Sequence
  Synthetic
caactccgtgtgggaggacttgctagaggacaattctacacctatacctactaccataatggccaagaatgaggt

SEQ ID NO: 113928 - DNA, 75 bp, Artificial Sequence
  Synthetic
gcacatggcatcgacccgaacattcggtcgggcgtcaggaccattaccacgggtgcgccaatcacgtactctacg

SEQ ID NO: 113929 - DNA, 75 bp, Artificial Sequence
  Synthetic
gtcacacgcaagctgcccctggcggtaatgggaccagcttacggcttccagtactcgcctaagcagcgcgtagac

SEQ ID NO: 113930 - DNA, 75 bp, Artificial Sequence
  Synthetic
aggatgtactaaaggagattaagcttcgagcgtccacggtgcaggcgaagctcctatccatagaggaagcctgcg

SEQ ID NO: 113931 - DNA, 75 bp, Artificial Sequence
  Synthetic
gcatcaatgccgtcgcattctatagaggtgtggatgtcgctgtcataccaactgacggcgacgtggtcgtctgtg

SEQ ID NO: 113932 - DNA, 75 bp, Artificial Sequence
  Synthetic
aggagtccatttatcaatgctgccagttagacccggaagcaagaaaggccatcacatcactcaatgaacggctgt

SEQ ID NO: 113933 - DNA, 75 bp, Artificial Sequence
  Synthetic
tcgtaatcaatcgtgtggctatcgcaggtgccgggccagtggcgtcctcaccactagcctgggaaacaccctgac

SEQ ID NO: 113934 - DNA, 75 bp, Artificial Sequence
  Synthetic
caatccctctagctgtaataaaggggggcagacacctgattttctgtcattccagaaagaagtgtgatgagttgg

SEQ ID NO: 113935 - DNA, 75 bp, Artificial Sequence
  Synthetic
ggagtcaccgaggatgccagtgcactgcgagccttcacggaggctatgaccagatactcggctcctccaggggac

SEQ ID NO: 113936 - DNA, 75 bp, Artificial Sequence
  Synthetic
cagatactcggctcctccaggggacgaaccgcatcccgagtacgacctggagctcataacatcatgctcatccaa

SEQ ID NO: 113937 - DNA, 75 bp, Artificial Sequence
  Synthetic
aggatgcagtctcgcgcagccagcgcaggggccgcaccggtagaggaaggttggggatataccggttcgtcaccc

SEQ ID NO: 113938 - DNA, 75 bp, Artificial Sequence
  Synthetic
ttgttgcctatcaggccacagtatgcgccagggcgaaagcccccccaccctcatgggacgtcatgtggaaatgcc

SEQ ID NO: 113939 - DNA, 75 bp, Artificial Sequence
  Synthetic
atgggtgcgtatggtgttgatgacgcacttctttgggatcttgcagtctcaagaaacactccacaaagcgctcga

SEQ ID NO: 113940 - DNA, 75 bp, Artificial Sequence
  Synthetic
gccatccccatcgaggtcatcaaggggggaaggcatctcattttctgccattccaagaagaagtgtgacgagctc

SEQ ID NO: 113941 - DNA, 75 bp, Artificial Sequence
  Synthetic
ccaggccttcccgtatgccaagaccatctggagttctgggagagcgtctttacagggttaaccaatatagacgcc

SEQ ID NO: 113942 - DNA, 75 bp, Artificial Sequence
  Synthetic
agatcatccagaggttacacggaatggccgctttttcactccatggttattcgccaggggaactcaatcgggtgg

SEQ ID NO: 113943 - DNA, 75 bp, Artificial Sequence
  Synthetic
ggcgcacttgcaagtgtgggtcccccctctcaacgttcgggggggtcgcgatgccatcatcctcctcgcgtgcgt

SEQ ID NO: 113944 - DNA, 75 bp, Artificial Sequence
  Synthetic
ctcataaacaccaacggcagctggcacatcaacaggactgccctgaactgcaatgactccctccacactgggttc

SEQ ID NO: 113945 - DNA, 75 bp, Artificial Sequence
  Synthetic
gggacaccatgtggaagtgcctactccgcctcaagcccacactgcatgggcccacccccctcctatataggttgg

SEQ ID NO: 113946 - DNA, 75 bp, Artificial Sequence
  Synthetic
aatatgtggtcggtacctcttcaactgggctgtgagaacaaagctcaaactcactcctctgcgtgacgcgcaccg

SEQ ID NO: 113947 - DNA, 75 bp, Artificial Sequence
  Synthetic
gcaggcggaagcgggggggacatatttcacagcgtgtcccaggctcggccccgcactttactcctgtgcctactc

SEQ ID NO: 113948 - DNA, 75 bp, Artificial Sequence
  Synthetic
ggtaggcggcgttctggcggccctcgctgcttactgtctttcagtgggtagcgtggtgatcgtcgggagagtcgt

SEQ ID NO: 113949 - DNA, 75 bp, Artificial Sequence
  Synthetic
ccttcctcgtgtttttctgctttgcatggtatctgaagggtaggtgggtgcccggagtggcctacgccttctacg

SEQ ID NO: 113950 - DNA, 75 bp, Artificial Sequence
  Synthetic
ggactacagctggctgagcaattcaaacagaaagccctcggcgttctgagtcaagctggcaagcaagctcaagag

SEQ ID NO: 113951 - DNA, 75 bp, Artificial Sequence
  Synthetic
tgcctgacaacgggcagcgtggtcattgtgggcaggatcatcttgtccgggaggccggctatcattcccgacagg

SEQ ID NO: 113952 - DNA, 75 bp, Artificial Sequence
  Synthetic
tcaagctggcaagcaagctcaagaggcagcaccagtggtccagtccaattttgccaagctcgagcagttctgggc

SEQ ID NO: 113953 - DNA, 75 bp, Artificial Sequence
  Synthetic
gctgtcacaagccctctgaccactcaacaaaccctccttttcaacatcctaggagggtgggtggcctcgcaaatc

SEQ ID NO: 113954 - DNA, 75 bp, Artificial Sequence
  Synthetic
gagttcgatgagatggaagagtgcgcctcacacctcccttacatcgaacagggaatgcagctcgccgagcaattc

SEQ ID NO: 113955 - DNA, 75 bp, Artificial Sequence
  Synthetic
catgtgtctccaactcactacgtccccgaaacggacacctctcagaaaattaccaacatactcagttccctaacc

SEQ ID NO: 113956 - DNA, 75 bp, Artificial Sequence
  Synthetic
gcaatgagggctgcgggtgggcagggtggctcctgtcacctcgcggctctcggccgtcttggggcccaaatgatc

SEQ ID NO: 113957 - DNA, 75 bp, Artificial Sequence
  Synthetic
gatacggtgccggtgtagccggcgccgtagtcaccttcaaaatcatgagcggcgaggtaccgaccacagaggacc

SEQ ID NO: 113958 - DNA, 75 bp, Artificial Sequence
  Synthetic
ggctcttcgggtggtccactgctctgcccctcggggcacgttgtgggcatcttccgggctgccgtgtgcacccgg

SEQ ID NO: 113959 - DNA, 75 bp, Artificial Sequence
  Synthetic
agatctgggattgggtctgcaccgtgctgagtgacttcaagacatggctaaaagctaagctactgccccgattgc

SEQ ID NO: 113960 - DNA, 75 bp, Artificial Sequence
  Synthetic
ccaacagaagcgctcaggcgccatgtggacatgctggtgggtgccgctactttctgctctgccctttacatcggc

SEQ ID NO: 113961 - DNA, 75 bp, Artificial Sequence
  Synthetic
ggcgtgtttgcaagtgtggatcccccccctcaacgttcgggggggccgtgatgccatcatcctcctcacgtgtgc

SEQ ID NO: 113962 - DNA, 75 bp, Artificial Sequence
  Synthetic
ccatatcaagaacggttcgatgcgaatcgtcggaccgaagacttgcagcaatacatggcatggaactttccctat

SEQ ID NO: 113963 - DNA, 75 bp, Artificial Sequence
  Synthetic
gcgtcgccattggactacgcaggattgcaactgttccatctacactggccacatcacagggcacaggatggcttg

SEQ ID NO: 113964 - DNA, 75 bp, Artificial Sequence
  Synthetic
cctatccagcaaggccgttaaccacatccgctccgtgtggaaggacttgctggaagacactgaaacaccaattga

SEQ ID NO: 113965 - DNA, 75 bp, Artificial Sequence
  Synthetic
atccgctccgtgtggaaggacttgctggaagacactgaaacaccaattgacaccaccatcatggcaaaaaatgag

SEQ ID NO: 113966 - DNA, 75 bp, Artificial Sequence
  Synthetic
aagctccctgtggccgtgatgggaagctcctacggattccaatactcaccaggacagcgggttgagttcctcgtg

SEQ ID NO: 113967 - DNA, 75 bp, Artificial Sequence
  Synthetic
acgaggcacgccgatgtcattcccgtgcgccggcggggtgatagcaggggcagcctgctttcgccccggcctatc

SEQ ID NO: 113968 - DNA, 75 bp, Artificial Sequence
  Synthetic
gtaggtgaattccattacgtcaccggggtcacacaagacaacatcaagtgcccctgccaagtcccggctcccgag

SEQ ID NO: 113969 - DNA, 75 bp, Artificial Sequence
  Synthetic
ggtatcctggctggcgtggcgtacttcagcatgcagtcgaactgggccaaggtcatcttggtcttgttcctgttt

SEQ ID NO: 113970 - DNA, 75 bp, Artificial Sequence
  Synthetic
gggtcacacaagacaacatcaagtgcccctgccaagtcccggctcccgagttcttcacggaagtggatggcatca

SEQ ID NO: 113971 - DNA, 75 bp, Artificial Sequence
  Synthetic
agctcgtcaacaccaacgggagctggcatatcaataggactgctctcaactgcaatgacagcttgcaaacgggat

SEQ ID NO: 113972 - DNA, 75 bp, Artificial Sequence
  Synthetic
ttgagcccgtcgtcttctctgacatggagaccaaggtcatcacctggggggcagacaccgcggcgtgcggggaca

SEQ ID NO: 113973 - DNA, 75 bp, Artificial Sequence
  Synthetic
tgtggcgggtagctgctgaggagtacgtggaggttacgcgggtgggggatttccactacgtgacgggcatgacca

SEQ ID NO: 113974 - DNA, 75 bp, Artificial Sequence
  Synthetic
ctcaccgagaggctttatgttgggggccctcttaccaattcaaggggggaaaactgcggctatcgcagatgccgc

SEQ ID NO: 113975 - DNA, 75 bp, Artificial Sequence
  Synthetic
aagtcaccggactacgatcctcctgtggtccatggttgcgccttaccccctttggccacgactcccgttccgcca

SEQ ID NO: 113976 - DNA, 75 bp, Artificial Sequence
  Synthetic
aagtctccggactacgatcctcctgtggtccatggttgcgccttaccccctttggccacgactcccgttccgcca

SEQ ID NO: 113977 - DNA, 75 bp, Artificial Sequence
  Synthetic
aagtccccggactacgatcctcctgtggtccatggttgcgccttaccccctttggccacgactcccgttccgcca

SEQ ID NO: 113978 - DNA, 75 bp, Artificial Sequence
  Synthetic
aagtcgccggactacgatcctcctgtggtccatggttgcgccttaccccctttggccacgactcccgttccgcca

SEQ ID NO: 113979 - DNA, 75 bp, Artificial Sequence
  Synthetic
gaggcgcacttgcaagtgtgggtcccccctctcaacgttcgggggggccgcgatgccatcatcctcctcacgtgt

SEQ ID NO: 113980 - DNA, 75 bp, Artificial Sequence
  Synthetic
cgagccagagccggacgtggctgtgctgacgtccatgttgacagacccatcacacataacggcggagacggcatg

SEQ ID NO: 113981 - DNA, 75 bp, Artificial Sequence
  Synthetic
tccacttggggtcgcgaatgtcagcgatgaccctgaccagaggccctactgctggaactactcgccgcgtccatg

SEQ ID NO: 113982 - DNA, 75 bp, Artificial Sequence
  Synthetic
gctggaactactcgccgcgtccatgcggggtggtatcggcgaaggaggtctgtggcccggtatattgtttcacac

SEQ ID NO: 113983 - DNA, 75 bp, Artificial Sequence
  Synthetic
tcccctggcaccgacctcatcgaggctaacctcttgtggggatcgggtgccaccagggtcgagacagacacgaag

SEQ ID NO: 113984 - DNA, 75 bp, Artificial Sequence
  Synthetic
ctgccttgccaatctgggcccagccgagctataacccgcctttggtcgaggcgtggaagcagccggaatacgtcc

SEQ ID NO: 113985 - DNA, 75 bp, Artificial Sequence
  Synthetic
cgacgctctggctgagctggccgaaaagaccttcggcccatcggagcagggctcagactctggcgcaggctttac

SEQ ID NO: 113986 - DNA, 75 bp, Artificial Sequence
  Synthetic
tgtcaactacagcatttttaagatcaggatgtacatcggcgggattgagcatcggctgagcgccgcgtgtaactg

SEQ ID NO: 113987 - DNA, 75 bp, Artificial Sequence
  Synthetic
caaatctggcctgtaccatctcactaacgattgcccaaacagcagcatcgtttatgaggcggagacgctgatctt

SEQ ID NO: 113988 - DNA, 75 bp, Artificial Sequence
  Synthetic
caaatctggcctgtaccatctcactaacgattgccctaacagcagcatcgtttatgaggcggagacgctgatctt

SEQ ID NO: 113989 - DNA, 75 bp, Artificial Sequence
  Synthetic
caaatctggcctgtaccatctcactaacgattgccccaacagcagcatcgtttatgaggcggagacgctgatctt

SEQ ID NO: 113990 - DNA, 75 bp, Artificial Sequence
  Synthetic
caaatctggcctgtaccatctcactaacgattgcccgaacagcagcatcgtttatgaggcggagacgctgatctt

SEQ ID NO: 113991 - DNA, 75 bp, Artificial Sequence
  Synthetic
ggccccatcatcgtggatgacatgtctgacgacggatcttattcgtcgatgcctccactagagggggagcccgga

SEQ ID NO: 113992 - DNA, 75 bp, Artificial Sequence
  Synthetic
tatgggcacgcccggattacaaccctccactgctagagtcctggaaggacccggactacgtccctccggtggtac

SEQ ID NO: 113993 - DNA, 75 bp, Artificial Sequence
  Synthetic
gcgaaggaggttcggagtcatgccagcaaggccattaaccacatcaactccgtgtgggaggacttgcgggaagac

SEQ ID NO: 113994 - DNA, 75 bp, Artificial Sequence
  Synthetic
ccggactacgtccctccggtggtacacgggtgcccattgccgcctaccaaggcccccccaataccacctccacgg

SEQ ID NO: 113995 - DNA, 75 bp, Artificial Sequence
  Synthetic
accaccttgccagctctctcgactggtctgatccatctccaccagaacatcgtcgacgtccagtacctttacggt

SEQ ID NO: 113996 - DNA, 75 bp, Artificial Sequence
  Synthetic
tcatggcaaaaaatgaggtcttctgcgtggacacgtcgaaggggggccgcaaaccagcgcggttgatcgtatacc

SEQ ID NO: 113997 - DNA, 75 bp, Artificial Sequence
  Synthetic
cttgtgcggctgaggaatcgaagctgccaatcagccccctgagcaactcattgctgcgccatcacaacatggtgt

SEQ ID NO: 113998 - DNA, 75 bp, Artificial Sequence
  Synthetic
gacaccatgcacctgcggcagctcggacctttacttggtcacgaggcatgctgatgtcattccggtgcgccggcg

SEQ ID NO: 113999 - DNA, 75 bp, Artificial Sequence
  Synthetic
cgagtctgtgtgtgtctttggatgatgctgttagtgtcacaggtggaggcggcacttgtcaacttgatcaacatc

SEQ ID NO: 114000 - DNA, 75 bp, Artificial Sequence
  Synthetic
tgtctcgtgcccggccccgctggttctggttctgcctactcctgcttgctgcaggggtaggcatctacctcctcc

SEQ ID NO: 114001 - DNA, 75 bp, Artificial Sequence
  Synthetic
aacccggcagaaaaaggtgaccttcgaccgcctacaagtggtggatcagcactacaatgatgtactcaaggagat

SEQ ID NO: 114002 - DNA, 75 bp, Artificial Sequence
  Synthetic
acgcagcatgcggaatgtggcctttgctccttctggtcttaatgctgcccgagagggcatacgcatttgatcggg

SEQ ID NO: 114003 - DNA, 75 bp, Artificial Sequence
  Synthetic
acatatatttgtcttgccagctggacccagaggcccaacaagtcatcaagtctctcaccgagaggctttatgttg

SEQ ID NO: 114004 - DNA, 75 bp, Artificial Sequence
  Synthetic
ccggcagcggcgcaggccacagtgtaaggggcattacgtcgctgttcagtcagggctctaggcagaagatccaac

SEQ ID NO: 114005 - DNA, 75 bp, Artificial Sequence
  Synthetic
cgtccgggagaacaactcctcccgctgctgggtagcgctcactcccacgctcgcggccaggaacgccagcgtccc

SEQ ID NO: 114006 - DNA, 75 bp, Artificial Sequence
  Synthetic
gcagtacttcatagccagagtcgaggctttgttgcacgtctatattccatctatggatgtgcgtggcccccgaga

SEQ ID NO: 114007 - DNA, 75 bp, Artificial Sequence
  Synthetic
cctgcaagctgacgcccccacactcagccagatccaaatttggctacggggcgaaggacgtccggagcctatcca

SEQ ID NO: 114008 - DNA, 75 bp, Artificial Sequence
  Synthetic
cgttaagttcccgggcggtggccagatcgttggcggagtatacttgttgccgcgcaggggccccaggttgggtgt

SEQ ID NO: 114009 - DNA, 75 bp, Artificial Sequence
  Synthetic
cggacttaggagttcgggtctgcgagaagagggcgctcaatgacgtcatcaaccagctgccagaggccgtgatgg

SEQ ID NO: 114010 - DNA, 75 bp, Artificial Sequence
  Synthetic
gctttgttgcacgtctatattccatctatggatgtgcgtggcccccgagactcaatcatcattctcacagttctg

SEQ ID NO: 114011 - DNA, 75 bp, Artificial Sequence
  Synthetic
cttcaatgccagcgggtgccccgaacggctgagtgcttgcaagcccattacatacttctctcaagggtggggccc

SEQ ID NO: 114012 - DNA, 75 bp, Artificial Sequence
  Synthetic
cttcaatgccagcgggtgccccgaacggctgagtgcttgcaagcccattacatacttctctctagggtggggccc

SEQ ID NO: 114013 - DNA, 75 bp, Artificial Sequence
  Synthetic
cttcaatgccagcgggtgccccgaacggctgagtgcttgcaagcccattacatacttctctccagggtggggccc

SEQ ID NO: 114014 - DNA, 75 bp, Artificial Sequence
  Synthetic
cttcaatgccagcgggtgccccgaacggctgagtgcttgcaagcccattacatacttctctcgagggtggggccc

SEQ ID NO: 114015 - DNA, 75 bp, Artificial Sequence
  Synthetic
atcgttggcggagtatacttgttgccgcgcaggggccccaggttgggtgtgcgcgcgacgaggaagacttccgaa

SEQ ID NO: 114016 - DNA, 75 bp, Artificial Sequence
  Synthetic
cacgctcctactggcagcggcaaaagcactaaggtgccggctgcctatgcagcccaagggtacaaggtactcgtc

SEQ ID NO: 114017 - DNA, 75 bp, Artificial Sequence
  Synthetic
taagagcacatgcgctaatcaagatctgcagcatggtgcgtggggtgatgtacggcaaatactgtcaaatggctc

SEQ ID NO: 114018 - DNA, 75 bp, Artificial Sequence
  Synthetic
ggatatccctggcccctgtatgggaacgagggcctcggttgggcagggtggctcctgtccccccggggttctcgc

SEQ ID NO: 114019 - DNA, 75 bp, Artificial Sequence
  Synthetic
ccgctgttttgactccactgtaaccgaaaaggacatccgggtcgaggaagaagtctatcagtgttgtgatctgga

SEQ ID NO: 114020 - DNA, 75 bp, Artificial Sequence
  Synthetic
ggtcctgtttactgcttcacccctagccctgtggtcgtaggcactactgaccgtaggggtcttcccacctactcc

SEQ ID NO: 114021 - DNA, 75 bp, Artificial Sequence
  Synthetic
ccgtaggggtcttcccacctactcctggggtgtaaatgagtctgatgtattcctgctggaaagcccgaggccccc

SEQ ID NO: 114022 - DNA, 75 bp, Artificial Sequence
  Synthetic
tgagcctgtcgtgttcacacccatggagaagaaaatcatcacgtggggtgccgacactgctgcgtgcggcgacat

SEQ ID NO: 114023 - DNA, 75 bp, Artificial Sequence
  Synthetic
cgcgcgagcggcgtctataccaccagcttcggaaacacactgacgtgctacctcaaggccacagccgccaacagg

SEQ ID NO: 114024 - DNA, 75 bp, Artificial Sequence
  Synthetic
cgcgcgagcggcgtctataccaccagcttcggaaacacactgacgtgctacctcaaggccacagccgccatcagg

SEQ ID NO: 114025 - DNA, 75 bp, Artificial Sequence
  Synthetic
cgcgcgagcggcgtctataccaccagcttcggaaacacactgacgtgctacctcaaggccacagccgccaccagg

SEQ ID NO: 114026 - DNA, 75 bp, Artificial Sequence
  Synthetic
cgcgcgagcggcgtctataccaccagcttcggaaacacactgacgtgctacctcaaggccacagccgccagcagg

SEQ ID NO: 114027 - DNA, 75 bp, Artificial Sequence
  Synthetic
ccgacactgctgcgtgcggcgacattatcaggggcctcccggtttccgctaggaggggcaatgaaatcttgctcg

SEQ ID NO: 114028 - DNA, 75 bp, Artificial Sequence
  Synthetic
ctattgtgccccacagactgttttaggaagcacccagatgctacctatcttaagtgcggagcagggccctggttg

SEQ ID NO: 114029 - DNA, 75 bp, Artificial Sequence
  Synthetic
cttaactgccccactgactgtttccgaaaacatccagaggcaacctacagcaaatgcggctcaggcccctggctc

SEQ ID NO: 114030 - DNA, 75 bp, Artificial Sequence
  Synthetic
cttaactgccccactgactgtttccgaaaacatcctgaggcaacctacagcaaatgcggctcaggcccctggctc

SEQ ID NO: 114031 - DNA, 75 bp, Artificial Sequence
  Synthetic
cttaactgccccactgactgtttccgaaaacatcccgaggcaacctacagcaaatgcggctcaggcccctggctc

SEQ ID NO: 114032 - DNA, 75 bp, Artificial Sequence
  Synthetic
cttaactgccccactgactgtttccgaaaacatccggaggcaacctacagcaaatgcggctcaggcccctggctc

SEQ ID NO: 114033 - DNA, 75 bp, Artificial Sequence
  Synthetic
cttaactgccccactgactgtttccgtaaacatccagaggcaacctacagcaaatgcggctcaggcccctggctc

SEQ ID NO: 114034 - DNA, 75 bp, Artificial Sequence
  Synthetic
cttaactgccccactgactgtttccgtaaacatcctgaggcaacctacagcaaatgcggctcaggcccctggctc

SEQ ID NO: 114035 - DNA, 75 bp, Artificial Sequence
  Synthetic
cttaactgccccactgactgtttccgtaaacatcccgaggcaacctacagcaaatgcggctcaggcccctggctc

SEQ ID NO: 114036 - DNA, 75 bp, Artificial Sequence
  Synthetic
cttaactgccccactgactgtttccgtaaacatccggaggcaacctacagcaaatgcggctcaggcccctggctc

SEQ ID NO: 114037 - DNA, 75 bp, Artificial Sequence
  Synthetic
cttaactgccccactgactgtttccgcaaacatccagaggcaacctacagcaaatgcggctcaggcccctggctc

SEQ ID NO: 114038 - DNA, 75 bp, Artificial Sequence
  Synthetic
cttaactgccccactgactgtttccgcaaacatcctgaggcaacctacagcaaatgcggctcaggcccctggctc

SEQ ID NO: 114039 - DNA, 75 bp, Artificial Sequence
  Synthetic
cttaactgccccactgactgtttccgcaaacatcccgaggcaacctacagcaaatgcggctcaggcccctggctc

SEQ ID NO: 114040 - DNA, 75 bp, Artificial Sequence
  Synthetic
cttaactgccccactgactgtttccgcaaacatccggaggcaacctacagcaaatgcggctcaggcccctggctc

SEQ ID NO: 114041 - DNA, 75 bp, Artificial Sequence
  Synthetic
cttaactgccccactgactgtttccggaaacatccagaggcaacctacagcaaatgcggctcaggcccctggctc

SEQ ID NO: 114042 - DNA, 75 bp, Artificial Sequence
  Synthetic
cttaactgccccactgactgtttccggaaacatcctgaggcaacctacagcaaatgcggctcaggcccctggctc

SEQ ID NO: 114043 - DNA, 75 bp, Artificial Sequence
  Synthetic
cttaactgccccactgactgtttccggaaacatcccgaggcaacctacagcaaatgcggctcaggcccctggctc

SEQ ID NO: 114044 - DNA, 75 bp, Artificial Sequence
  Synthetic
cttaactgccccactgactgtttccggaaacatccggaggcaacctacagcaaatgcggctcaggcccctggctc

SEQ ID NO: 114045 - DNA, 75 bp, Artificial Sequence
  Synthetic
cttatctgccccactgactgtttccgaaaacatccagaggcaacctacagcaaatgcggctcaggcccctggctc

SEQ ID NO: 114046 - DNA, 75 bp, Artificial Sequence
  Synthetic
cttatctgccccactgactgtttccgaaaacatcctgaggcaacctacagcaaatgcggctcaggcccctggctc

SEQ ID NO: 114047 - DNA, 75 bp, Artificial Sequence
  Synthetic
cttatctgccccactgactgtttccgaaaacatcccgaggcaacctacagcaaatgcggctcaggcccctggctc

SEQ ID NO: 114048 - DNA, 75 bp, Artificial Sequence
  Synthetic
cttatctgccccactgactgtttccgaaaacatccggaggcaacctacagcaaatgcggctcaggcccctggctc

SEQ ID NO: 114049 - DNA, 75 bp, Artificial Sequence
  Synthetic
cttatctgccccactgactgtttccgtaaacatccagaggcaacctacagcaaatgcggctcaggcccctggctc

SEQ ID NO: 114050 - DNA, 75 bp, Artificial Sequence
  Synthetic
cttatctgccccactgactgtttccgtaaacatcctgaggcaacctacagcaaatgcggctcaggcccctggctc

SEQ ID NO: 114051 - DNA, 75 bp, Artificial Sequence
  Synthetic
cttatctgccccactgactgtttccgtaaacatcccgaggcaacctacagcaaatgcggctcaggcccctggctc

SEQ ID NO: 114052 - DNA, 75 bp, Artificial Sequence
  Synthetic
cttatctgccccactgactgtttccgtaaacatccggaggcaacctacagcaaatgcggctcaggcccctggctc

SEQ ID NO: 114053 - DNA, 75 bp, Artificial Sequence
  Synthetic
cttatctgccccactgactgtttccgcaaacatccagaggcaacctacagcaaatgcggctcaggcccctggctc

SEQ ID NO: 114054 - DNA, 75 bp, Artificial Sequence
  Synthetic
cttatctgccccactgactgtttccgcaaacatcctgaggcaacctacagcaaatgcggctcaggcccctggctc

SEQ ID NO: 114055 - DNA, 75 bp, Artificial Sequence
  Synthetic
cttatctgccccactgactgtttccgcaaacatcccgaggcaacctacagcaaatgcggctcaggcccctggctc

SEQ ID NO: 114056 - DNA, 75 bp, Artificial Sequence
  Synthetic
cttatctgccccactgactgtttccgcaaacatccggaggcaacctacagcaaatgcggctcaggcccctggctc

SEQ ID NO: 114057 - DNA, 75 bp, Artificial Sequence
  Synthetic
cttatctgccccactgactgtttccggaaacatccagaggcaacctacagcaaatgcggctcaggcccctggctc

SEQ ID NO: 114058 - DNA, 75 bp, Artificial Sequence
  Synthetic
cttatctgccccactgactgtttccggaaacatcctgaggcaacctacagcaaatgcggctcaggcccctggctc

SEQ ID NO: 114059 - DNA, 75 bp, Artificial Sequence
  Synthetic
cttatctgccccactgactgtttccggaaacatcccgaggcaacctacagcaaatgcggctcaggcccctggctc

SEQ ID NO: 114060 - DNA, 75 bp, Artificial Sequence
  Synthetic
cttatctgccccactgactgtttccggaaacatccggaggcaacctacagcaaatgcggctcaggcccctggctc

SEQ ID NO: 114061 - DNA, 75 bp, Artificial Sequence
  Synthetic
cttacctgccccactgactgtttccgaaaacatccagaggcaacctacagcaaatgcggctcaggcccctggctc

SEQ ID NO: 114062 - DNA, 75 bp, Artificial Sequence
  Synthetic
cttacctgccccactgactgtttccgaaaacatcctgaggcaacctacagcaaatgcggctcaggcccctggctc

SEQ ID NO: 114063 - DNA, 75 bp, Artificial Sequence
  Synthetic
cttacctgccccactgactgtttccgaaaacatcccgaggcaacctacagcaaatgcggctcaggcccctggctc

SEQ ID NO: 114064 - DNA, 75 bp, Artificial Sequence
  Synthetic
cttacctgccccactgactgtttccgaaaacatccggaggcaacctacagcaaatgcggctcaggcccctggctc

SEQ ID NO: 114065 - DNA, 75 bp, Artificial Sequence
  Synthetic
cttacctgccccactgactgtttccgtaaacatccagaggcaacctacagcaaatgcggctcaggcccctggctc

SEQ ID NO: 114066 - DNA, 75 bp, Artificial Sequence
  Synthetic
cttacctgccccactgactgtttccgtaaacatcctgaggcaacctacagcaaatgcggctcaggcccctggctc

SEQ ID NO: 114067 - DNA, 75 bp, Artificial Sequence
  Synthetic
cttacctgccccactgactgtttccgtaaacatcccgaggcaacctacagcaaatgcggctcaggcccctggctc

SEQ ID NO: 114068 - DNA, 75 bp, Artificial Sequence
  Synthetic
cttacctgccccactgactgtttccgtaaacatccggaggcaacctacagcaaatgcggctcaggcccctggctc

SEQ ID NO: 114069 - DNA, 75 bp, Artificial Sequence
  Synthetic
cttacctgccccactgactgtttccgcaaacatccagaggcaacctacagcaaatgcggctcaggcccctggctc

SEQ ID NO: 114070 - DNA, 75 bp, Artificial Sequence
  Synthetic
cttacctgccccactgactgtttccgcaaacatcctgaggcaacctacagcaaatgcggctcaggcccctggctc

SEQ ID NO: 114071 - DNA, 75 bp, Artificial Sequence
  Synthetic
cttacctgccccactgactgtttccgcaaacatcccgaggcaacctacagcaaatgcggctcaggcccctggctc

SEQ ID NO: 114072 - DNA, 75 bp, Artificial Sequence
  Synthetic
cttacctgccccactgactgtttccgcaaacatccggaggcaacctacagcaaatgcggctcaggcccctggctc

SEQ ID NO: 114073 - DNA, 75 bp, Artificial Sequence
  Synthetic
cttacctgccccactgactgtttccggaaacatccagaggcaacctacagcaaatgcggctcaggcccctggctc

SEQ ID NO: 114074 - DNA, 75 bp, Artificial Sequence
  Synthetic
cttacctgccccactgactgtttccggaaacatcctgaggcaacctacagcaaatgcggctcaggcccctggctc

SEQ ID NO: 114075 - DNA, 75 bp, Artificial Sequence
  Synthetic
cttacctgccccactgactgtttccggaaacatcccgaggcaacctacagcaaatgcggctcaggcccctggctc

SEQ ID NO: 114076 - DNA, 75 bp, Artificial Sequence
  Synthetic
cttacctgccccactgactgtttccggaaacatccggaggcaacctacagcaaatgcggctcaggcccctggctc

SEQ ID NO: 114077 - DNA, 75 bp, Artificial Sequence
  Synthetic
cttagctgccccactgactgtttccgaaaacatccagaggcaacctacagcaaatgcggctcaggcccctggctc

SEQ ID NO: 114078 - DNA, 75 bp, Artificial Sequence
  Synthetic
cttagctgccccactgactgtttccgaaaacatcctgaggcaacctacagcaaatgcggctcaggcccctggctc

SEQ ID NO: 114079 - DNA, 75 bp, Artificial Sequence
  Synthetic
cttagctgccccactgactgtttccgaaaacatcccgaggcaacctacagcaaatgcggctcaggcccctggctc

SEQ ID NO: 114080 - DNA, 75 bp, Artificial Sequence
  Synthetic
cttagctgccccactgactgtttccgaaaacatccggaggcaacctacagcaaatgcggctcaggcccctggctc

SEQ ID NO: 114081 - DNA, 75 bp, Artificial Sequence
  Synthetic
cttagctgccccactgactgtttccgtaaacatccagaggcaacctacagcaaatgcggctcaggcccctggctc

SEQ ID NO: 114082 - DNA, 75 bp, Artificial Sequence
  Synthetic
cttagctgccccactgactgtttccgtaaacatcctgaggcaacctacagcaaatgcggctcaggcccctggctc

SEQ ID NO: 114083 - DNA, 75 bp, Artificial Sequence
  Synthetic
cttagctgccccactgactgtttccgtaaacatcccgaggcaacctacagcaaatgcggctcaggcccctggctc

SEQ ID NO: 114084 - DNA, 75 bp, Artificial Sequence
  Synthetic
cttagctgccccactgactgtttccgtaaacatccggaggcaacctacagcaaatgcggctcaggcccctggctc

SEQ ID NO: 114085 - DNA, 75 bp, Artificial Sequence
  Synthetic
cttagctgccccactgactgtttccgcaaacatccagaggcaacctacagcaaatgcggctcaggcccctggctc

SEQ ID NO: 114086 - DNA, 75 bp, Artificial Sequence
  Synthetic
cttagctgccccactgactgtttccgcaaacatcctgaggcaacctacagcaaatgcggctcaggcccctggctc

SEQ ID NO: 114087 - DNA, 75 bp, Artificial Sequence
  Synthetic
cttagctgccccactgactgtttccgcaaacatcccgaggcaacctacagcaaatgcggctcaggcccctggctc

SEQ ID NO: 114088 - DNA, 75 bp, Artificial Sequence
  Synthetic
cttagctgccccactgactgtttccgcaaacatccggaggcaacctacagcaaatgcggctcaggcccctggctc

SEQ ID NO: 114089 - DNA, 75 bp, Artificial Sequence
  Synthetic
cttagctgccccactgactgtttccggaaacatccagaggcaacctacagcaaatgcggctcaggcccctggctc

SEQ ID NO: 114090 - DNA, 75 bp, Artificial Sequence
  Synthetic
cttagctgccccactgactgtttccggaaacatcctgaggcaacctacagcaaatgcggctcaggcccctggctc

SEQ ID NO: 114091 - DNA, 75 bp, Artificial Sequence
  Synthetic
cttagctgccccactgactgtttccggaaacatcccgaggcaacctacagcaaatgcggctcaggcccctggctc

SEQ ID NO: 114092 - DNA, 75 bp, Artificial Sequence
  Synthetic
cttagctgccccactgactgtttccggaaacatccggaggcaacctacagcaaatgcggctcaggcccctggctc

SEQ ID NO: 114093 - DNA, 75 bp, Artificial Sequence
  Synthetic
tactgtcaacttcacggtgcacaaggtgcggatgtacctcggggggatggagcacagatttaatgcagcctgcaa

SEQ ID NO: 114094 - DNA, 75 bp, Artificial Sequence
  Synthetic
aacgactgttcaaacagcagcatcacctggcagcttcaggatgcggtgcttcatgttcctggatgcgtcccctgt

SEQ ID NO: 114095 - DNA, 75 bp, Artificial Sequence
  Synthetic
ccttaccggcaaggacaccaatgaaaattgtggcgaggtccaagtgctatccactgccacgcagtcctttttagg

SEQ ID NO: 114096 - DNA, 75 bp, Artificial Sequence
  Synthetic
ccttaccggcaaggacaccaatgaaaattgtggcgaggtccaagtgctttccactgccacgcagtcctttttagg

SEQ ID NO: 114097 - DNA, 75 bp, Artificial Sequence
  Synthetic
ccttaccggcaaggacaccaatgaaaattgtggcgaggtccaagtgctctccactgccacgcagtcctttttagg

SEQ ID NO: 114098 - DNA, 75 bp, Artificial Sequence
  Synthetic
ccttaccggcaaggacaccaatgaaaattgtggcgaggtccaagtgctgtccactgccacgcagtcctttttagg

SEQ ID NO: 114099 - DNA, 75 bp, Artificial Sequence
  Synthetic
agcagtgagccggcctggtgccctaactgcggggttgcgttcgcacattgacgccatcgtggtgtctgcgacatt

SEQ ID NO: 114100 - DNA, 75 bp, Artificial Sequence
  Synthetic
gaccaagacctggtaggatggcctgcccccccgggggttaagtctttggccccctgcacctgcggagcttcagat

SEQ ID NO: 114101 - DNA, 75 bp, Artificial Sequence
  Synthetic
gaccaagacctggttggatggcctgcccccccgggggttaagtctttggccccctgcacctgcggagcttcagat

SEQ ID NO: 114102 - DNA, 75 bp, Artificial Sequence
  Synthetic
gaccaagacctggtcggatggcctgcccccccgggggttaagtctttggccccctgcacctgcggagcttcagat

SEQ ID NO: 114103 - DNA, 75 bp, Artificial Sequence
  Synthetic
gaccaagacctggtgggatggcctgcccccccgggggttaagtctttggccccctgcacctgcggagcttcagat

SEQ ID NO: 114104 - DNA, 75 bp, Artificial Sequence
  Synthetic
aactgctccatatacccgggccatatatctggacaccgtatggcatgggacatgatgatgaactggtcgccaacg

SEQ ID NO: 114105 - DNA, 75 bp, Artificial Sequence
  Synthetic
aagcgctactgcacgtgtgggttccccccctcaacgtccgaggggggcgcgacgctgtcatcctactcatgtgtg

SEQ ID NO: 114106 - DNA, 75 bp, Artificial Sequence
  Synthetic
ttatgttactcataggccaggcggaggcagctttggagaacttgatcgtgctcaatgccgcttccgccgccagct

SEQ ID NO: 114107 - DNA, 75 bp, Artificial Sequence
  Synthetic
attcatctgctgcgcctggtatatcaagggccgtctcgtgcccgcagccacatatggactattgcagctatggcc

SEQ ID NO: 114108 - DNA, 75 bp, Artificial Sequence
  Synthetic
gcctcaggaaacttggggtacccccattgagagcgtggagacatcgggcccgagcagtccgcgctaagctcatcg

SEQ ID NO: 114109 - DNA, 75 bp, Artificial Sequence
  Synthetic
ccatgcaaggggcgtgggcgaaggtcgctgtcatcctactgctgtgcgctggggtggacgcgcaaacgtacacta

SEQ ID NO: 114110 - DNA, 75 bp, Artificial Sequence
  Synthetic
attccagcccccccgctgtgccccagacctaccaagtagcccacctgcaagcgccgacagggagcggcaagagca

SEQ ID NO: 114111 - DNA, 75 bp, Artificial Sequence
  Synthetic
attccagcccccccgctgtgccccagacctaccaagtagcccacctgcatgcgccgacagggagcggcaagagca

SEQ ID NO: 114112 - DNA, 75 bp, Artificial Sequence
  Synthetic
attccagcccccccgctgtgccccagacctaccaagtagcccacctgcacgcgccgacagggagcggcaagagca

SEQ ID NO: 114113 - DNA, 75 bp, Artificial Sequence
  Synthetic
attccagcccccccgctgtgccccagacctaccaagtagcccacctgcaggcgccgacagggagcggcaagagca

SEQ ID NO: 114114 - DNA, 75 bp, Artificial Sequence
  Synthetic
atacccgctgttttgactcaacagttacggagagggatattagaactgaggagtccatatacctggcctgctcgt

SEQ ID NO: 114115 - DNA, 75 bp, Artificial Sequence
  Synthetic
acctaggtgcatggttgactatccatacaggctttggcactacccctgcactgtcaattttaccatcttcaaggt

SEQ ID NO: 114116 - DNA, 75 bp, Artificial Sequence
  Synthetic
gcgaggctaggtagggaagtcctgctcggccctgccgatagctacacctcgaaggggtggaagctcctggctccc

SEQ ID NO: 114117 - DNA, 75 bp, Artificial Sequence
  Synthetic
tcgtgcgtcacagtgccagtgtctgcagtggaagtcaggaacattagttctagttactatgccactaatgattgc

SEQ ID NO: 114118 - DNA, 75 bp, Artificial Sequence
  Synthetic
cattaaccgcacggccctcaactgtaatgattccctgaacaccggcttccttgcatccttgttctacgtcaggaa

SEQ ID NO: 114119 - DNA, 75 bp, Artificial Sequence
  Synthetic
ctcgataggcagcttaacactccgaccttagggtccctctgcttttttttttttttttttttttttttttttttt

SEQ ID NO: 114120 - DNA, 75 bp, Artificial Sequence
  Synthetic
acatctccaaagtgctcttagccattataggacctctctacctactgcaggcgagcctgttgcgcgtaccgtatt

SEQ ID NO: 114121 - DNA, 75 bp, Artificial Sequence
  Synthetic
taatctgtgatgaatgccattccacggacgccacaacgatccttggcataggcacggtgttggaccaggcggaga

SEQ ID NO: 114122 - DNA, 75 bp, Artificial Sequence
  Synthetic
aatgaggaggacatgaggccctactgctggcactacccacccaagccgtgcggtgtggtacctgctcagtccgtg

SEQ ID NO: 114123 - DNA, 75 bp, Artificial Sequence
  Synthetic
gatcgttggtggagtttacttgttgccgcgcaggggccccaggttgggtgtgcgcgcgactaggaagacttccga

SEQ ID NO: 114124 - DNA, 75 bp, Artificial Sequence
  Synthetic
gcgagcctgttgcgcgtaccgtattacgtgcgcgctcatgccctattacgggtgtgtttggctgtccgcagactg

SEQ ID NO: 114125 - DNA, 75 bp, Artificial Sequence
  Synthetic
gctggcactacccacccaagccgtgcggtgtggtacctgctcagtccgtgtgtggcccagtttactgtttcactc

SEQ ID NO: 114126 - DNA, 75 bp, Artificial Sequence
  Synthetic
acggcttgcgcgaccttgccgtcgcagttgagcccatcaccttctcccctatggagaagaaggtcatcacatggg

SEQ ID NO: 114127 - DNA, 75 bp, Artificial Sequence
  Synthetic
ccctaagggggcctggtttgggtgtacatggatgaatggcactgggtttaccaaaacatgcggcgcaccaccgtg

SEQ ID NO: 114128 - DNA, 75 bp, Artificial Sequence
  Synthetic
caaggggtggaagctacttgcgcccatcacggcctacgcccagcaaactcgcggcctgcttgggacgatcgtcac

SEQ ID NO: 114129 - DNA, 75 bp, Artificial Sequence
  Synthetic
ccctggttaacacccaagtgcctgatcgattacccctataggctgtggcactacccgtgcactgtcaactatacc

SEQ ID NO: 114130 - DNA, 75 bp, Artificial Sequence
  Synthetic
acgtgtccggggtgtaccatgtcacgaacgactgctccaactcaagcattgtgtatgaggcagcggacatgatca

SEQ ID NO: 114131 - DNA, 75 bp, Artificial Sequence
  Synthetic
aaggagatgaaggcgaaggcgtccacagttaaggctagacttctatctgtagaagaagcctgcaaactgacgccc

SEQ ID NO: 114132 - DNA, 75 bp, Artificial Sequence
  Synthetic
aagcagaacatccagttaatcaacaccaatggcagctggcacataaaccggaccgccctcaattgcaatgacagc

SEQ ID NO: 114133 - DNA, 75 bp, Artificial Sequence
  Synthetic
tgcacacccccgggtgcgtgccctgcgttcgggaggacaactcctcccgctgctgggtagcgctcactcccacgc

SEQ ID NO: 114134 - DNA, 75 bp, Artificial Sequence
  Synthetic
gaggccgtactgggagagggaagctagggatataccggtttgtcaccccgggggagagaccgtctggtatttttg

SEQ ID NO: 114135 - DNA, 75 bp, Artificial Sequence
  Synthetic
atcaccaagatcttgctcgccatactcggtccgctcatggtgctccaggctggcataacaaaagtgccgtacttc

SEQ ID NO: 114136 - DNA, 75 bp, Artificial Sequence
  Synthetic
ttccaccactgagtgggccatcttgccctgcacttactcagatctaccagccctctccacgggacttatccacct

SEQ ID NO: 114137 - DNA, 75 bp, Artificial Sequence
  Synthetic
ctggcggatgccagggcctgtgcctgcctatggatgctcatcttgttgggccaggctgaagcagcactggaaaag

SEQ ID NO: 114138 - DNA, 75 bp, Artificial Sequence
  Synthetic
ttgtcgtgggcaccactgacaagcagggcgtacccacctatagctggggggaaaatgagaccgatgtcttcctgc

SEQ ID NO: 114139 - DNA, 75 bp, Artificial Sequence
  Synthetic
gttgctgggtggcccttactcctaccgtcgcagcgccgtacatcggtgcgccacttgagtctctacggagtcatg

SEQ ID NO: 114140 - DNA, 75 bp, Artificial Sequence
  Synthetic
ggcactagctcctccaccgagctgggacactatgtggaagtgcctgattcgcctcaaacctaccttacacggtcc

SEQ ID NO: 114141 - DNA, 75 bp, Artificial Sequence
  Synthetic
ctcttccgagctgccgtctgcacgcgaggtgtcgccaaggcgattgacttcgtgcctgtggaaagcatggagacc

SEQ ID NO: 114142 - DNA, 75 bp, Artificial Sequence
  Synthetic
gggcgtacccacctatagctggggggaaaatgagaccgatgtcttcctgctaaatagcacaagacccccgcgagg

SEQ ID NO: 114143 - DNA, 75 bp, Artificial Sequence
  Synthetic
cgctggccacatattcccttgctggccaatggcccttcgtcctgcttctcttggcgctgcctcaacaggcctaca

SEQ ID NO: 114144 - DNA, 75 bp, Artificial Sequence
  Synthetic
acaaacctatcaggtggggtatctgcatgctccaactggcagcggaaagagcacgaaggtaccggcagcgtatgc

SEQ ID NO: 114145 - DNA, 75 bp, Artificial Sequence
  Synthetic
gtggtaaccagcacgtgggttctggtgggtggaatcctggcagccctagctgcgtactgcttgtcggtgggcagc

SEQ ID NO: 114146 - DNA, 75 bp, Artificial Sequence
  Synthetic
gtggtaaccagcacgtgggttctggtgggtggtatcctggcagccctagctgcgtactgcttgtcggtgggcagc

SEQ ID NO: 114147 - DNA, 75 bp, Artificial Sequence
  Synthetic
gtggtaaccagcacgtgggttctggtgggtggcatcctggcagccctagctgcgtactgcttgtcggtgggcagc

SEQ ID NO: 114148 - DNA, 75 bp, Artificial Sequence
  Synthetic
gtggtaaccagcacgtgggttctggtgggtgggatcctggcagccctagctgcgtactgcttgtcggtgggcagc

SEQ ID NO: 114149 - DNA, 75 bp, Artificial Sequence
  Synthetic
cagccagggctacaaagtgcttgtgctcaatccatcagtggcagccacccttggtttcggtgcatacatgagaaa

SEQ ID NO: 114150 - DNA, 75 bp, Artificial Sequence
  Synthetic
cagccagggctacaaagtgcttgtgctcaatccatcagtggcagccacccttggtttcggtgcatacatgagtaa

SEQ ID NO: 114151 - DNA, 75 bp, Artificial Sequence
  Synthetic
cagccagggctacaaagtgcttgtgctcaatccatcagtggcagccacccttggtttcggtgcatacatgagcaa

SEQ ID NO: 114152 - DNA, 75 bp, Artificial Sequence
  Synthetic
cagccagggctacaaagtgcttgtgctcaatccatcagtggcagccacccttggtttcggtgcatacatgaggaa

SEQ ID NO: 114153 - DNA, 75 bp, Artificial Sequence
  Synthetic
cagccagggctacaaagtgcttgtgctcaatccatcagtggcagccacccttggtttcggtgcttacatgagaaa

SEQ ID NO: 114154 - DNA, 75 bp, Artificial Sequence
  Synthetic
cagccagggctacaaagtgcttgtgctcaatccatcagtggcagccacccttggtttcggtgcttacatgagtaa

SEQ ID NO: 114155 - DNA, 75 bp, Artificial Sequence
  Synthetic
cagccagggctacaaagtgcttgtgctcaatccatcagtggcagccacccttggtttcggtgcttacatgagcaa

SEQ ID NO: 114156 - DNA, 75 bp, Artificial Sequence
  Synthetic
cagccagggctacaaagtgcttgtgctcaatccatcagtggcagccacccttggtttcggtgcttacatgaggaa

SEQ ID NO: 114157 - DNA, 75 bp, Artificial Sequence
  Synthetic
cagccagggctacaaagtgcttgtgctcaatccatcagtggcagccacccttggtttcggtgcctacatgagaaa

SEQ ID NO: 114158 - DNA, 75 bp, Artificial Sequence
  Synthetic
cagccagggctacaaagtgcttgtgctcaatccatcagtggcagccacccttggtttcggtgcctacatgagtaa

SEQ ID NO: 114159 - DNA, 75 bp, Artificial Sequence
  Synthetic
cagccagggctacaaagtgcttgtgctcaatccatcagtggcagccacccttggtttcggtgcctacatgagcaa

SEQ ID NO: 114160 - DNA, 75 bp, Artificial Sequence
  Synthetic
cagccagggctacaaagtgcttgtgctcaatccatcagtggcagccacccttggtttcggtgcctacatgaggaa

SEQ ID NO: 114161 - DNA, 75 bp, Artificial Sequence
  Synthetic
cagccagggctacaaagtgcttgtgctcaatccatcagtggcagccacccttggtttcggtgcgtacatgagaaa

SEQ ID NO: 114162 - DNA, 75 bp, Artificial Sequence
  Synthetic
cagccagggctacaaagtgcttgtgctcaatccatcagtggcagccacccttggtttcggtgcgtacatgagtaa

SEQ ID NO: 114163 - DNA, 75 bp, Artificial Sequence
  Synthetic
cagccagggctacaaagtgcttgtgctcaatccatcagtggcagccacccttggtttcggtgcgtacatgagcaa

SEQ ID NO: 114164 - DNA, 75 bp, Artificial Sequence
  Synthetic
cagccagggctacaaagtgcttgtgctcaatccatcagtggcagccacccttggtttcggtgcgtacatgaggaa

SEQ ID NO: 114165 - DNA, 75 bp, Artificial Sequence
  Synthetic
ggacatgatgatgaactggagtccaacaaccaccttaattctcgcccaggtcatgaggatcccggggactctgct

SEQ ID NO: 114166 - DNA, 75 bp, Artificial Sequence
  Synthetic
cggcggagatcctgcggaaatccaggaaatttccccgggcaatgcccatatgggcacgcccggattacaaccctc

SEQ ID NO: 114167 - DNA, 75 bp, Artificial Sequence
  Synthetic
cctctggtggttgtgctacatgttggttctggcggaagcccagatccagcagtgggtgccgcccttggaggcccg

SEQ ID NO: 114168 - DNA, 75 bp, Artificial Sequence
  Synthetic
ggaccgagaggtattgtaacaacagtttgatgagatggaggaatgctccaagaaccttccactcgtcgaacaagg

SEQ ID NO: 114169 - DNA, 75 bp, Artificial Sequence
  Synthetic
ggaccgagaggtattgtaacaacagtttgatgagatggaggaatgctccaagaaccttccactcgtcgaacatgg

SEQ ID NO: 114170 - DNA, 75 bp, Artificial Sequence
  Synthetic
ggaccgagaggtattgtaacaacagtttgatgagatggaggaatgctccaagaaccttccactcgtcgaacacgg

SEQ ID NO: 114171 - DNA, 75 bp, Artificial Sequence
  Synthetic
ggaccgagaggtattgtaacaacagtttgatgagatggaggaatgctccaagaaccttccactcgtcgaacaggg

SEQ ID NO: 114172 - DNA, 75 bp, Artificial Sequence
  Synthetic
ggaccgagaggtattgtaacaacagtttgatgagatggaggaatgctccaagatccttccactcgtcgaacaagg

SEQ ID NO: 114173 - DNA, 75 bp, Artificial Sequence
  Synthetic
ggaccgagaggtattgtaacaacagtttgatgagatggaggaatgctccaagatccttccactcgtcgaacatgg

SEQ ID NO: 114174 - DNA, 75 bp, Artificial Sequence
  Synthetic
ggaccgagaggtattgtaacaacagtttgatgagatggaggaatgctccaagatccttccactcgtcgaacacgg

SEQ ID NO: 114175 - DNA, 75 bp, Artificial Sequence
  Synthetic
ggaccgagaggtattgtaacaacagtttgatgagatggaggaatgctccaagatccttccactcgtcgaacaggg

SEQ ID NO: 114176 - DNA, 75 bp, Artificial Sequence
  Synthetic
ggaccgagaggtattgtaacaacagtttgatgagatggaggaatgctccaagacccttccactcgtcgaacaagg

SEQ ID NO: 114177 - DNA, 75 bp, Artificial Sequence
  Synthetic
ggaccgagaggtattgtaacaacagtttgatgagatggaggaatgctccaagacccttccactcgtcgaacatgg

SEQ ID NO: 114178 - DNA, 75 bp, Artificial Sequence
  Synthetic
ggaccgagaggtattgtaacaacagtttgatgagatggaggaatgctccaagacccttccactcgtcgaacacgg

SEQ ID NO: 114179 - DNA, 75 bp, Artificial Sequence
  Synthetic
ggaccgagaggtattgtaacaacagtttgatgagatggaggaatgctccaagacccttccactcgtcgaacaggg

SEQ ID NO: 114180 - DNA, 75 bp, Artificial Sequence
  Synthetic
ggaccgagaggtattgtaacaacagtttgatgagatggaggaatgctccaagagccttccactcgtcgaacaagg

SEQ ID NO: 114181 - DNA, 75 bp, Artificial Sequence
  Synthetic
ggaccgagaggtattgtaacaacagtttgatgagatggaggaatgctccaagagccttccactcgtcgaacatgg

SEQ ID NO: 114182 - DNA, 75 bp, Artificial Sequence
  Synthetic
ggaccgagaggtattgtaacaacagtttgatgagatggaggaatgctccaagagccttccactcgtcgaacacgg

SEQ ID NO: 114183 - DNA, 75 bp, Artificial Sequence
  Synthetic
ggaccgagaggtattgtaacaacagtttgatgagatggaggaatgctccaagagccttccactcgtcgaacaggg

SEQ ID NO: 114184 - DNA, 75 bp, Artificial Sequence
  Synthetic
ggaccgagaggtattgtatcaacagtttgatgagatggaggaatgctccaagaaccttccactcgtcgaacaagg

SEQ ID NO: 114185 - DNA, 75 bp, Artificial Sequence
  Synthetic
ggaccgagaggtattgtatcaacagtttgatgagatggaggaatgctccaagaaccttccactcgtcgaacatgg

SEQ ID NO: 114186 - DNA, 75 bp, Artificial Sequence
  Synthetic
ggaccgagaggtattgtatcaacagtttgatgagatggaggaatgctccaagaaccttccactcgtcgaacacgg

SEQ ID NO: 114187 - DNA, 75 bp, Artificial Sequence
  Synthetic
ggaccgagaggtattgtatcaacagtttgatgagatggaggaatgctccaagaaccttccactcgtcgaacaggg

SEQ ID NO: 114188 - DNA, 75 bp, Artificial Sequence
  Synthetic
ggaccgagaggtattgtatcaacagtttgatgagatggaggaatgctccaagatccttccactcgtcgaacaagg

SEQ ID NO: 114189 - DNA, 75 bp, Artificial Sequence
  Synthetic
ggaccgagaggtattgtatcaacagtttgatgagatggaggaatgctccaagatccttccactcgtcgaacatgg

SEQ ID NO: 114190 - DNA, 75 bp, Artificial Sequence
  Synthetic
ggaccgagaggtattgtatcaacagtttgatgagatggaggaatgctccaagatccttccactcgtcgaacacgg

SEQ ID NO: 114191 - DNA, 75 bp, Artificial Sequence
  Synthetic
ggaccgagaggtattgtatcaacagtttgatgagatggaggaatgctccaagatccttccactcgtcgaacaggg

SEQ ID NO: 114192 - DNA, 75 bp, Artificial Sequence
  Synthetic
ggaccgagaggtattgtatcaacagtttgatgagatggaggaatgctccaagacccttccactcgtcgaacaagg

SEQ ID NO: 114193 - DNA, 75 bp, Artificial Sequence
  Synthetic
ggaccgagaggtattgtatcaacagtttgatgagatggaggaatgctccaagacccttccactcgtcgaacatgg

SEQ ID NO: 114194 - DNA, 75 bp, Artificial Sequence
  Synthetic
ggaccgagaggtattgtatcaacagtttgatgagatggaggaatgctccaagacccttccactcgtcgaacacgg

SEQ ID NO: 114195 - DNA, 75 bp, Artificial Sequence
  Synthetic
ggaccgagaggtattgtatcaacagtttgatgagatggaggaatgctccaagacccttccactcgtcgaacaggg

SEQ ID NO: 114196 - DNA, 75 bp, Artificial Sequence
  Synthetic
ggaccgagaggtattgtatcaacagtttgatgagatggaggaatgctccaagagccttccactcgtcgaacaagg

SEQ ID NO: 114197 - DNA, 75 bp, Artificial Sequence
  Synthetic
ggaccgagaggtattgtatcaacagtttgatgagatggaggaatgctccaagagccttccactcgtcgaacatgg

SEQ ID NO: 114198 - DNA, 75 bp, Artificial Sequence
  Synthetic
ggaccgagaggtattgtatcaacagtttgatgagatggaggaatgctccaagagccttccactcgtcgaacacgg

SEQ ID NO: 114199 - DNA, 75 bp, Artificial Sequence
  Synthetic
ggaccgagaggtattgtatcaacagtttgatgagatggaggaatgctccaagagccttccactcgtcgaacaggg

SEQ ID NO: 114200 - DNA, 75 bp, Artificial Sequence
  Synthetic
ggaccgagaggtattgtaccaacagtttgatgagatggaggaatgctccaagaaccttccactcgtcgaacaagg

SEQ ID NO: 114201 - DNA, 75 bp, Artificial Sequence
  Synthetic
ggaccgagaggtattgtaccaacagtttgatgagatggaggaatgctccaagaaccttccactcgtcgaacatgg

SEQ ID NO: 114202 - DNA, 75 bp, Artificial Sequence
  Synthetic
ggaccgagaggtattgtaccaacagtttgatgagatggaggaatgctccaagaaccttccactcgtcgaacacgg

SEQ ID NO: 114203 - DNA, 75 bp, Artificial Sequence
  Synthetic
ggaccgagaggtattgtaccaacagtttgatgagatggaggaatgctccaagaaccttccactcgtcgaacaggg

SEQ ID NO: 114204 - DNA, 75 bp, Artificial Sequence
  Synthetic
ggaccgagaggtattgtaccaacagtttgatgagatggaggaatgctccaagatccttccactcgtcgaacaagg

SEQ ID NO: 114205 - DNA, 75 bp, Artificial Sequence
  Synthetic
ggaccgagaggtattgtaccaacagtttgatgagatggaggaatgctccaagatccttccactcgtcgaacatgg

SEQ ID NO: 114206 - DNA, 75 bp, Artificial Sequence
  Synthetic
ggaccgagaggtattgtaccaacagtttgatgagatggaggaatgctccaagatccttccactcgtcgaacacgg

SEQ ID NO: 114207 - DNA, 75 bp, Artificial Sequence
  Synthetic
ggaccgagaggtattgtaccaacagtttgatgagatggaggaatgctccaagatccttccactcgtcgaacaggg

SEQ ID NO: 114208 - DNA, 75 bp, Artificial Sequence
  Synthetic
ggaccgagaggtattgtaccaacagtttgatgagatggaggaatgctccaagacccttccactcgtcgaacaagg

SEQ ID NO: 114209 - DNA, 75 bp, Artificial Sequence
  Synthetic
ggaccgagaggtattgtaccaacagtttgatgagatggaggaatgctccaagacccttccactcgtcgaacatgg

SEQ ID NO: 114210 - DNA, 75 bp, Artificial Sequence
  Synthetic
ggaccgagaggtattgtaccaacagtttgatgagatggaggaatgctccaagacccttccactcgtcgaacacgg

SEQ ID NO: 114211 - DNA, 75 bp, Artificial Sequence
  Synthetic
ggaccgagaggtattgtaccaacagtttgatgagatggaggaatgctccaagacccttccactcgtcgaacaggg

SEQ ID NO: 114212 - DNA, 75 bp, Artificial Sequence
  Synthetic
ggaccgagaggtattgtaccaacagtttgatgagatggaggaatgctccaagagccttccactcgtcgaacaagg

SEQ ID NO: 114213 - DNA, 75 bp, Artificial Sequence
  Synthetic
ggaccgagaggtattgtaccaacagtttgatgagatggaggaatgctccaagagccttccactcgtcgaacatgg

SEQ ID NO: 114214 - DNA, 75 bp, Artificial Sequence
  Synthetic
ggaccgagaggtattgtaccaacagtttgatgagatggaggaatgctccaagagccttccactcgtcgaacacgg

SEQ ID NO: 114215 - DNA, 75 bp, Artificial Sequence
  Synthetic
ggaccgagaggtattgtaccaacagtttgatgagatggaggaatgctccaagagccttccactcgtcgaacaggg

SEQ ID NO: 114216 - DNA, 75 bp, Artificial Sequence
  Synthetic
ggaccgagaggtattgtagcaacagtttgatgagatggaggaatgctccaagaaccttccactcgtcgaacaagg

SEQ ID NO: 114217 - DNA, 75 bp, Artificial Sequence
  Synthetic
ggaccgagaggtattgtagcaacagtttgatgagatggaggaatgctccaagaaccttccactcgtcgaacatgg

SEQ ID NO: 114218 - DNA, 75 bp, Artificial Sequence
  Synthetic
ggaccgagaggtattgtagcaacagtttgatgagatggaggaatgctccaagaaccttccactcgtcgaacacgg

SEQ ID NO: 114219 - DNA, 75 bp, Artificial Sequence
  Synthetic
ggaccgagaggtattgtagcaacagtttgatgagatggaggaatgctccaagaaccttccactcgtcgaacaggg

SEQ ID NO: 114220 - DNA, 75 bp, Artificial Sequence
  Synthetic
ggaccgagaggtattgtagcaacagtttgatgagatggaggaatgctccaagatccttccactcgtcgaacaagg

SEQ ID NO: 114221 - DNA, 75 bp, Artificial Sequence
  Synthetic
ggaccgagaggtattgtagcaacagtttgatgagatggaggaatgctccaagatccttccactcgtcgaacatgg

SEQ ID NO: 114222 - DNA, 75 bp, Artificial Sequence
  Synthetic
ggaccgagaggtattgtagcaacagtttgatgagatggaggaatgctccaagatccttccactcgtcgaacacgg

SEQ ID NO: 114223 - DNA, 75 bp, Artificial Sequence
  Synthetic
ggaccgagaggtattgtagcaacagtttgatgagatggaggaatgctccaagatccttccactcgtcgaacaggg

SEQ ID NO: 114224 - DNA, 75 bp, Artificial Sequence
  Synthetic
ggaccgagaggtattgtagcaacagtttgatgagatggaggaatgctccaagacccttccactcgtcgaacaagg

SEQ ID NO: 114225 - DNA, 75 bp, Artificial Sequence
  Synthetic
ggaccgagaggtattgtagcaacagtttgatgagatggaggaatgctccaagacccttccactcgtcgaacatgg

SEQ ID NO: 114226 - DNA, 75 bp, Artificial Sequence
  Synthetic
ggaccgagaggtattgtagcaacagtttgatgagatggaggaatgctccaagacccttccactcgtcgaacacgg

SEQ ID NO: 114227 - DNA, 75 bp, Artificial Sequence
  Synthetic
ggaccgagaggtattgtagcaacagtttgatgagatggaggaatgctccaagacccttccactcgtcgaacaggg

SEQ ID NO: 114228 - DNA, 75 bp, Artificial Sequence
  Synthetic
ggaccgagaggtattgtagcaacagtttgatgagatggaggaatgctccaagagccttccactcgtcgaacaagg

SEQ ID NO: 114229 - DNA, 75 bp, Artificial Sequence
  Synthetic
ggaccgagaggtattgtagcaacagtttgatgagatggaggaatgctccaagagccttccactcgtcgaacatgg

SEQ ID NO: 114230 - DNA, 75 bp, Artificial Sequence
  Synthetic
ggaccgagaggtattgtagcaacagtttgatgagatggaggaatgctccaagagccttccactcgtcgaacacgg

SEQ ID NO: 114231 - DNA, 75 bp, Artificial Sequence
  Synthetic
ggaccgagaggtattgtagcaacagtttgatgagatggaggaatgctccaagagccttccactcgtcgaacaggg

SEQ ID NO: 114232 - DNA, 75 bp, Artificial Sequence
  Synthetic
cttcacgcgcggagaccgctgcagattggaagatagggataggggtcagcagagtccactgctgcattccaccac

SEQ ID NO: 114233 - DNA, 75 bp, Artificial Sequence
  Synthetic
accgcaaccatgttatttccgggcgtagtgtttgatataaccaagtggctcttggcgatcctcggacctggctac

SEQ ID NO: 114234 - DNA, 75 bp, Artificial Sequence
  Synthetic
gcaggggttgacgccgagactcatgtgactgggggggtagtcggtcgcagtgtctccagctttactgggctcttt

SEQ ID NO: 114235 - DNA, 75 bp, Artificial Sequence
  Synthetic
gaagaggacggttgtcctgacagaatccaccgtgtcttctgccctggcggagcttgctacaaagaccttcggcag

SEQ ID NO: 114236 - DNA, 75 bp, Artificial Sequence
  Synthetic
aactcgtcccctccggctgtaccgcagacattccaagtggcccatctacacgctcccactggcagcggcaagagc

SEQ ID NO: 114237 - DNA, 75 bp, Artificial Sequence
  Synthetic
ttctccgacctaccggcactatccactggtctattgcacctccaccaaaacatcgtggacgtgcagtacctctat

SEQ ID NO: 114238 - DNA, 75 bp, Artificial Sequence
  Synthetic
ctacagacacaaggtcaacttgtccgggtgcccagagcgcttggccagctgccgttccattgacaagttcgttca

SEQ ID NO: 114239 - DNA, 75 bp, Artificial Sequence
  Synthetic
ccatcacttacgatgggccccgcagccaggaccagaggccctattgttggcattacgcgcctcaaccgtgcggca

SEQ ID NO: 114240 - DNA, 75 bp, Artificial Sequence
  Synthetic
accctgccaagcaaccctgccattgcttcccttatgtcgttcaccgctgcagttacaagccctctaaccactcag

SEQ ID NO: 114241 - DNA, 75 bp, Artificial Sequence
  Synthetic
tcttggctgccttgttctacaccaacaggtttaacagctcagggtgtactgaacggctcgcaagctgcaagagcc

SEQ ID NO: 114242 - DNA, 75 bp, Artificial Sequence
  Synthetic
caggtggttcggcatatacatctacgaccacctcacccccatgtccgactgggctgctggtgggcttcgggacct

SEQ ID NO: 114243 - DNA, 75 bp, Artificial Sequence
  Synthetic
gtggacgacatctcattttctgccactccaagaagaagtgcgacgagctggccaagcggctgcgcgcgcttggcg

SEQ ID NO: 114244 - DNA, 75 bp, Artificial Sequence
  Synthetic
gaacggctcgcaagctgcaagagccttgacagctatgaccaaggctggggtccgctcggggtcgccaacatcagc

SEQ ID NO: 114245 - DNA, 75 bp, Artificial Sequence
  Synthetic
ccgttggcagcgtaggcttgggcagagtcttactcgacatcctcgcgggctacggtgccggcgtagccggcgccg

SEQ ID NO: 114246 - DNA, 75 bp, Artificial Sequence
  Synthetic
ccggtctcagcccgactgggccgggaggtcctgctgggccccgccgacggctacacctccaaggggtggagactt

SEQ ID NO: 114247 - DNA, 75 bp, Artificial Sequence
  Synthetic
aggtcctgctgggccccgccgacggctacacctccaaggggtggagacttctcgctcccatcaccgcgtacgccc

SEQ ID NO: 114248 - DNA, 75 bp, Artificial Sequence
  Synthetic
aggcgatttcgactctgtcatagactgcaatgttgcggtcactcaggtagtcgacttcagcctagaccctacttt

SEQ ID NO: 114249 - DNA, 75 bp, Artificial Sequence
  Synthetic
tggtcacctttaagatcatgagtggcgaggtgccatcgacagaggacctagtcaacttgctcccggccatcttat

SEQ ID NO: 114250 - DNA, 75 bp, Artificial Sequence
  Synthetic
ctacacctccaaggggtggagacttctcgctcccatcaccgcgtacgcccagcagacacgtggtctgctgggcgc

SEQ ID NO: 114251 - DNA, 75 bp, Artificial Sequence
  Synthetic
tgcaatgttgcggtcactcaggtagtcgacttcagcctagaccctactttcacaattgagaccaccactatcccg

SEQ ID NO: 114252 - DNA, 75 bp, Artificial Sequence
  Synthetic
ggaagcatcctgagactacctatgccaagtgcgggtcaggtccttggatcacgccacgatgcttgatcgattacc

SEQ ID NO: 114253 - DNA, 75 bp, Artificial Sequence
  Synthetic
caagtgcgggtcaggtccttggatcacgccacgatgcttgatcgattacccgtaccggctgtggcattacccatg

SEQ ID NO: 114254 - DNA, 75 bp, Artificial Sequence
  Synthetic
ggagctgttgacttgtacctcgtcacccggaacgctgatgtcatcccagctcggagacggggagaccgacgagcg

SEQ ID NO: 114255 - DNA, 75 bp, Artificial Sequence
  Synthetic
ccacttcctctcacaaactaagcaggggggggagaattttgcgtacctcgtggcataccaagccacggtgtgtgc

SEQ ID NO: 114256 - DNA, 75 bp, Artificial Sequence
  Synthetic
agccaagctgctgcccagcatgcccggcatcccctttctctcctgtcaaagggggtacaagggggaatggcgcgg

SEQ ID NO: 114257 - DNA, 75 bp, Artificial Sequence
  Synthetic
tgtgctctagaggggtggcaaagtcgattgatttcattccagttgaatcgctcgacattgtagcccggtccccca

SEQ ID NO: 114258 - DNA, 75 bp, Artificial Sequence
  Synthetic
gattgatttcattccagttgaatcgctcgacattgtagcccggtcccccagcttcaccgataatggcacgccccc

SEQ ID NO: 114259 - DNA, 75 bp, Artificial Sequence
  Synthetic
ggtgctgttcagaatgagatcacgaccacccatccaattactaagtacatcatgacctgcatgtcagctgacctc

SEQ ID NO: 114260 - DNA, 75 bp, Artificial Sequence
  Synthetic
tgctcctgctcctgctggcgttaccaccacgagcatacgccatggaccgggagatggctgcatcgtgcggaggcg

SEQ ID NO: 114261 - DNA, 75 bp, Artificial Sequence
  Synthetic
acctggcaagggacctttcccatcaacgcctacaccacgggtcccggcgtgcccatcccggcgccaaactataag

SEQ ID NO: 114262 - DNA, 75 bp, Artificial Sequence
  Synthetic
tcacgggaggggttcttgctgcattggcagcatactgcctaacgacaggtagtgctgtcatatgcggcaggatca

SEQ ID NO: 114263 - DNA, 75 bp, Artificial Sequence
  Synthetic
aactatgcaacagggaatcttcctggttgctctttctctatcttcctcttggcacttctctcgtgcctcaccaca

SEQ ID NO: 114264 - DNA, 75 bp, Artificial Sequence
  Synthetic
cctgccaggtcccttcccctgagttcttcactgaggtggatggcgttagaatacatcgccacgcccccgactgca

SEQ ID NO: 114265 - DNA, 75 bp, Artificial Sequence
  Synthetic
cttcatctgcattgcttggcatgtcaagggccggctcccggctattgccgcttacgcggcctgcgggatgtggcc

SEQ ID NO: 114266 - DNA, 75 bp, Artificial Sequence
  Synthetic
ctactccacgtatggtaaattcctcgcagatggaggctgctcaggtggagcctatgacatcataatatgcgatga

SEQ ID NO: 114267 - DNA, 75 bp, Artificial Sequence
  Synthetic
cttcacggtgggcctcaacacttttgtggtagggtcacaactgccatgcgagccagagccggacgtggccgtcct

SEQ ID NO: 114268 - DNA, 75 bp, Artificial Sequence
  Synthetic
cttcacggtgggcctcaacacttttgtggttgggtcacaactgccatgcgagccagagccggacgtggccgtcct

SEQ ID NO: 114269 - DNA, 75 bp, Artificial Sequence
  Synthetic
cttcacggtgggcctcaacacttttgtggtcgggtcacaactgccatgcgagccagagccggacgtggccgtcct

SEQ ID NO: 114270 - DNA, 75 bp, Artificial Sequence
  Synthetic
cttcacggtgggcctcaacacttttgtggtggggtcacaactgccatgcgagccagagccggacgtggccgtcct

SEQ ID NO: 114271 - DNA, 75 bp, Artificial Sequence
  Synthetic
tgtgaagaccggcgaccaaactaagtgttggctgccggcctctccgacattggcggtgcagaatgcgtcggtgcc

SEQ ID NO: 114272 - DNA, 75 bp, Artificial Sequence
  Synthetic
gttgaagccggcagttcactccgcctggccaaaactagagcagttatggcaaaaacacctgtggaactttgttag

SEQ ID NO: 114273 - DNA, 75 bp, Artificial Sequence
  Synthetic
gttgaagccggcagttcactccgcctggccaaaactagagcagttttggcaaaaacacctgtggaactttgttag

SEQ ID NO: 114274 - DNA, 75 bp, Artificial Sequence
  Synthetic
gttgaagccggcagttcactccgcctggccaaaactagagcagttctggcaaaaacacctgtggaactttgttag

SEQ ID NO: 114275 - DNA, 75 bp, Artificial Sequence
  Synthetic
gttgaagccggcagttcactccgcctggccaaaactagagcagttgtggcaaaaacacctgtggaactttgttag

SEQ ID NO: 114276 - DNA, 75 bp, Artificial Sequence
  Synthetic
gttgaagccggcagttcactccgcctggccaaaacttgagcagttatggcaaaaacacctgtggaactttgttag

SEQ ID NO: 114277 - DNA, 75 bp, Artificial Sequence
  Synthetic
gttgaagccggcagttcactccgcctggccaaaacttgagcagttttggcaaaaacacctgtggaactttgttag

SEQ ID NO: 114278 - DNA, 75 bp, Artificial Sequence
  Synthetic
gttgaagccggcagttcactccgcctggccaaaacttgagcagttctggcaaaaacacctgtggaactttgttag

SEQ ID NO: 114279 - DNA, 75 bp, Artificial Sequence
  Synthetic
gttgaagccggcagttcactccgcctggccaaaacttgagcagttgtggcaaaaacacctgtggaactttgttag

SEQ ID NO: 114280 - DNA, 75 bp, Artificial Sequence
  Synthetic
gttgaagccggcagttcactccgcctggccaaaactcgagcagttatggcaaaaacacctgtggaactttgttag

SEQ ID NO: 114281 - DNA, 75 bp, Artificial Sequence
  Synthetic
gttgaagccggcagttcactccgcctggccaaaactcgagcagttttggcaaaaacacctgtggaactttgttag

SEQ ID NO: 114282 - DNA, 75 bp, Artificial Sequence
  Synthetic
gttgaagccggcagttcactccgcctggccaaaactcgagcagttctggcaaaaacacctgtggaactttgttag

SEQ ID NO: 114283 - DNA, 75 bp, Artificial Sequence
  Synthetic
gttgaagccggcagttcactccgcctggccaaaactcgagcagttgtggcaaaaacacctgtggaactttgttag

SEQ ID NO: 114284 - DNA, 75 bp, Artificial Sequence
  Synthetic
gttgaagccggcagttcactccgcctggccaaaactggagcagttatggcaaaaacacctgtggaactttgttag

SEQ ID NO: 114285 - DNA, 75 bp, Artificial Sequence
  Synthetic
gttgaagccggcagttcactccgcctggccaaaactggagcagttttggcaaaaacacctgtggaactttgttag

SEQ ID NO: 114286 - DNA, 75 bp, Artificial Sequence
  Synthetic
gttgaagccggcagttcactccgcctggccaaaactggagcagttctggcaaaaacacctgtggaactttgttag

SEQ ID NO: 114287 - DNA, 75 bp, Artificial Sequence
  Synthetic
gttgaagccggcagttcactccgcctggccaaaactggagcagttgtggcaaaaacacctgtggaactttgttag

SEQ ID NO: 114288 - DNA, 75 bp, Artificial Sequence
  Synthetic
gttgaagccggcagttcactccgcctggcctaaactagagcagttatggcaaaaacacctgtggaactttgttag

SEQ ID NO: 114289 - DNA, 75 bp, Artificial Sequence
  Synthetic
gttgaagccggcagttcactccgcctggcctaaactagagcagttttggcaaaaacacctgtggaactttgttag

SEQ ID NO: 114290 - DNA, 75 bp, Artificial Sequence
  Synthetic
gttgaagccggcagttcactccgcctggcctaaactagagcagttctggcaaaaacacctgtggaactttgttag

SEQ ID NO: 114291 - DNA, 75 bp, Artificial Sequence
  Synthetic
gttgaagccggcagttcactccgcctggcctaaactagagcagttgtggcaaaaacacctgtggaactttgttag

SEQ ID NO: 114292 - DNA, 75 bp, Artificial Sequence
  Synthetic
gttgaagccggcagttcactccgcctggcctaaacttgagcagttatggcaaaaacacctgtggaactttgttag

SEQ ID NO: 114293 - DNA, 75 bp, Artificial Sequence
  Synthetic
gttgaagccggcagttcactccgcctggcctaaacttgagcagttttggcaaaaacacctgtggaactttgttag

SEQ ID NO: 114294 - DNA, 75 bp, Artificial Sequence
  Synthetic
gttgaagccggcagttcactccgcctggcctaaacttgagcagttctggcaaaaacacctgtggaactttgttag

SEQ ID NO: 114295 - DNA, 75 bp, Artificial Sequence
  Synthetic
gttgaagccggcagttcactccgcctggcctaaacttgagcagttgtggcaaaaacacctgtggaactttgttag

SEQ ID NO: 114296 - DNA, 75 bp, Artificial Sequence
  Synthetic
gttgaagccggcagttcactccgcctggcctaaactcgagcagttatggcaaaaacacctgtggaactttgttag

SEQ ID NO: 114297 - DNA, 75 bp, Artificial Sequence
  Synthetic
gttgaagccggcagttcactccgcctggcctaaactcgagcagttttggcaaaaacacctgtggaactttgttag

SEQ ID NO: 114298 - DNA, 75 bp, Artificial Sequence
  Synthetic
gttgaagccggcagttcactccgcctggcctaaactcgagcagttctggcaaaaacacctgtggaactttgttag

SEQ ID NO: 114299 - DNA, 75 bp, Artificial Sequence
  Synthetic
gttgaagccggcagttcactccgcctggcctaaactcgagcagttgtggcaaaaacacctgtggaactttgttag

SEQ ID NO: 114300 - DNA, 75 bp, Artificial Sequence
  Synthetic
gttgaagccggcagttcactccgcctggcctaaactggagcagttatggcaaaaacacctgtggaactttgttag

SEQ ID NO: 114301 - DNA, 75 bp, Artificial Sequence
  Synthetic
gttgaagccggcagttcactccgcctggcctaaactggagcagttttggcaaaaacacctgtggaactttgttag

SEQ ID NO: 114302 - DNA, 75 bp, Artificial Sequence
  Synthetic
gttgaagccggcagttcactccgcctggcctaaactggagcagttctggcaaaaacacctgtggaactttgttag

SEQ ID NO: 114303 - DNA, 75 bp, Artificial Sequence
  Synthetic
gttgaagccggcagttcactccgcctggcctaaactggagcagttgtggcaaaaacacctgtggaactttgttag

SEQ ID NO: 114304 - DNA, 75 bp, Artificial Sequence
  Synthetic
gttgaagccggcagttcactccgcctggcccaaactagagcagttatggcaaaaacacctgtggaactttgttag

SEQ ID NO: 114305 - DNA, 75 bp, Artificial Sequence
  Synthetic
gttgaagccggcagttcactccgcctggcccaaactagagcagttttggcaaaaacacctgtggaactttgttag

SEQ ID NO: 114306 - DNA, 75 bp, Artificial Sequence
  Synthetic
gttgaagccggcagttcactccgcctggcccaaactagagcagttctggcaaaaacacctgtggaactttgttag

SEQ ID NO: 114307 - DNA, 75 bp, Artificial Sequence
  Synthetic
gttgaagccggcagttcactccgcctggcccaaactagagcagttgtggcaaaaacacctgtggaactttgttag

SEQ ID NO: 114308 - DNA, 75 bp, Artificial Sequence
  Synthetic
gttgaagccggcagttcactccgcctggcccaaacttgagcagttatggcaaaaacacctgtggaactttgttag

SEQ ID NO: 114309 - DNA, 75 bp, Artificial Sequence
  Synthetic
gttgaagccggcagttcactccgcctggcccaaacttgagcagttttggcaaaaacacctgtggaactttgttag

SEQ ID NO: 114310 - DNA, 75 bp, Artificial Sequence
  Synthetic
gttgaagccggcagttcactccgcctggcccaaacttgagcagttctggcaaaaacacctgtggaactttgttag

SEQ ID NO: 114311 - DNA, 75 bp, Artificial Sequence
  Synthetic
gttgaagccggcagttcactccgcctggcccaaacttgagcagttgtggcaaaaacacctgtggaactttgttag

SEQ ID NO: 114312 - DNA, 75 bp, Artificial Sequence
  Synthetic
gttgaagccggcagttcactccgcctggcccaaactcgagcagttatggcaaaaacacctgtggaactttgttag

SEQ ID NO: 114313 - DNA, 75 bp, Artificial Sequence
  Synthetic
gttgaagccggcagttcactccgcctggcccaaactcgagcagttttggcaaaaacacctgtggaactttgttag

SEQ ID NO: 114314 - DNA, 75 bp, Artificial Sequence
  Synthetic
gttgaagccggcagttcactccgcctggcccaaactcgagcagttctggcaaaaacacctgtggaactttgttag

SEQ ID NO: 114315 - DNA, 75 bp, Artificial Sequence
  Synthetic
gttgaagccggcagttcactccgcctggcccaaactcgagcagttgtggcaaaaacacctgtggaactttgttag

SEQ ID NO: 114316 - DNA, 75 bp, Artificial Sequence
  Synthetic
gttgaagccggcagttcactccgcctggcccaaactggagcagttatggcaaaaacacctgtggaactttgttag

SEQ ID NO: 114317 - DNA, 75 bp, Artificial Sequence
  Synthetic
gttgaagccggcagttcactccgcctggcccaaactggagcagttttggcaaaaacacctgtggaactttgttag

SEQ ID NO: 114318 - DNA, 75 bp, Artificial Sequence
  Synthetic
gttgaagccggcagttcactccgcctggcccaaactggagcagttctggcaaaaacacctgtggaactttgttag

SEQ ID NO: 114319 - DNA, 75 bp, Artificial Sequence
  Synthetic
gttgaagccggcagttcactccgcctggcccaaactggagcagttgtggcaaaaacacctgtggaactttgttag

SEQ ID NO: 114320 - DNA, 75 bp, Artificial Sequence
  Synthetic
gttgaagccggcagttcactccgcctggccgaaactagagcagttatggcaaaaacacctgtggaactttgttag

SEQ ID NO: 114321 - DNA, 75 bp, Artificial Sequence
  Synthetic
gttgaagccggcagttcactccgcctggccgaaactagagcagttttggcaaaaacacctgtggaactttgttag

SEQ ID NO: 114322 - DNA, 75 bp, Artificial Sequence
  Synthetic
gttgaagccggcagttcactccgcctggccgaaactagagcagttctggcaaaaacacctgtggaactttgttag

SEQ ID NO: 114323 - DNA, 75 bp, Artificial Sequence
  Synthetic
gttgaagccggcagttcactccgcctggccgaaactagagcagttgtggcaaaaacacctgtggaactttgttag

SEQ ID NO: 114324 - DNA, 75 bp, Artificial Sequence
  Synthetic
gttgaagccggcagttcactccgcctggccgaaacttgagcagttatggcaaaaacacctgtggaactttgttag

SEQ ID NO: 114325 - DNA, 75 bp, Artificial Sequence
  Synthetic
gttgaagccggcagttcactccgcctggccgaaacttgagcagttttggcaaaaacacctgtggaactttgttag

SEQ ID NO: 114326 - DNA, 75 bp, Artificial Sequence
  Synthetic
gttgaagccggcagttcactccgcctggccgaaacttgagcagttctggcaaaaacacctgtggaactttgttag

SEQ ID NO: 114327 - DNA, 75 bp, Artificial Sequence
  Synthetic
gttgaagccggcagttcactccgcctggccgaaacttgagcagttgtggcaaaaacacctgtggaactttgttag

SEQ ID NO: 114328 - DNA, 75 bp, Artificial Sequence
  Synthetic
gttgaagccggcagttcactccgcctggccgaaactcgagcagttatggcaaaaacacctgtggaactttgttag

SEQ ID NO: 114329 - DNA, 75 bp, Artificial Sequence
  Synthetic
gttgaagccggcagttcactccgcctggccgaaactcgagcagttttggcaaaaacacctgtggaactttgttag

SEQ ID NO: 114330 - DNA, 75 bp, Artificial Sequence
  Synthetic
gttgaagccggcagttcactccgcctggccgaaactcgagcagttctggcaaaaacacctgtggaactttgttag

SEQ ID NO: 114331 - DNA, 75 bp, Artificial Sequence
  Synthetic
gttgaagccggcagttcactccgcctggccgaaactcgagcagttgtggcaaaaacacctgtggaactttgttag

SEQ ID NO: 114332 - DNA, 75 bp, Artificial Sequence
  Synthetic
gttgaagccggcagttcactccgcctggccgaaactggagcagttatggcaaaaacacctgtggaactttgttag

SEQ ID NO: 114333 - DNA, 75 bp, Artificial Sequence
  Synthetic
gttgaagccggcagttcactccgcctggccgaaactggagcagttttggcaaaaacacctgtggaactttgttag

SEQ ID NO: 114334 - DNA, 75 bp, Artificial Sequence
  Synthetic
gttgaagccggcagttcactccgcctggccgaaactggagcagttctggcaaaaacacctgtggaactttgttag

SEQ ID NO: 114335 - DNA, 75 bp, Artificial Sequence
  Synthetic
gttgaagccggcagttcactccgcctggccgaaactggagcagttgtggcaaaaacacctgtggaactttgttag

SEQ ID NO: 114336 - DNA, 75 bp, Artificial Sequence
  Synthetic
ctgacattgtctccacactacaagtcatggctggctcggggattgtggtggattcaatatttcatagctaggacc

SEQ ID NO: 114337 - DNA, 75 bp, Artificial Sequence
  Synthetic
gttggtggtcctggcgacagccacgccgccagggtccgtcacgacgcctcaccccaatattgaggaagtagccct

SEQ ID NO: 114338 - DNA, 75 bp, Artificial Sequence
  Synthetic
tggcggtgcagaatgcgtcggtgccagtcagggggatccgcgagcacgtggacctcttggtgggtgctgctgcgt

SEQ ID NO: 114339 - DNA, 75 bp, Artificial Sequence
  Synthetic
tggcggtgcagaatgcgtcggtgcctgtcagggggatccgcgagcacgtggacctcttggtgggtgctgctgcgt

SEQ ID NO: 114340 - DNA, 75 bp, Artificial Sequence
  Synthetic
tggcggtgcagaatgcgtcggtgcccgtcagggggatccgcgagcacgtggacctcttggtgggtgctgctgcgt

SEQ ID NO: 114341 - DNA, 75 bp, Artificial Sequence
  Synthetic
tggcggtgcagaatgcgtcggtgccggtcagggggatccgcgagcacgtggacctcttggtgggtgctgctgcgt

SEQ ID NO: 114342 - DNA, 75 bp, Artificial Sequence
  Synthetic
ttgagcccgtcgtcttttctgacatggagaccaagatcatcacctggggggcagacaccgcggcgtgcggggaca

SEQ ID NO: 114343 - DNA, 75 bp, Artificial Sequence
  Synthetic
ttgtttagagcggccgtgtgtgccagaggtgtggccaaatctattgacttcatccctgtcgagtctatcgacatc

SEQ ID NO: 114344 - DNA, 75 bp, Artificial Sequence
  Synthetic
ggcaccgccgtcagcgtccacggcatttgtcgtaagcggcctcacgggcgctgctgttggcagcatcggcctggg

SEQ ID NO: 114345 - DNA, 75 bp, Artificial Sequence
  Synthetic
ggcaccgccgtcagcgtccacggcatttgtcgtaagcggcctctcgggcgctgctgttggcagcatcggcctggg

SEQ ID NO: 114346 - DNA, 75 bp, Artificial Sequence
  Synthetic
ggcaccgccgtcagcgtccacggcatttgtcgtaagcggcctcccgggcgctgctgttggcagcatcggcctggg

SEQ ID NO: 114347 - DNA, 75 bp, Artificial Sequence
  Synthetic
ggcaccgccgtcagcgtccacggcatttgtcgtaagcggcctcgcgggcgctgctgttggcagcatcggcctggg

SEQ ID NO: 114348 - DNA, 75 bp, Artificial Sequence
  Synthetic
ggcaccgccgtcagcgtccacggcttttgtcgtaagcggcctcacgggcgctgctgttggcagcatcggcctggg

SEQ ID NO: 114349 - DNA, 75 bp, Artificial Sequence
  Synthetic
ggcaccgccgtcagcgtccacggcttttgtcgtaagcggcctctcgggcgctgctgttggcagcatcggcctggg

SEQ ID NO: 114350 - DNA, 75 bp, Artificial Sequence
  Synthetic
ggcaccgccgtcagcgtccacggcttttgtcgtaagcggcctcccgggcgctgctgttggcagcatcggcctggg

SEQ ID NO: 114351 - DNA, 75 bp, Artificial Sequence
  Synthetic
ggcaccgccgtcagcgtccacggcttttgtcgtaagcggcctcgcgggcgctgctgttggcagcatcggcctggg

SEQ ID NO: 114352 - DNA, 75 bp, Artificial Sequence
  Synthetic
ggcaccgccgtcagcgtccacggcctttgtcgtaagcggcctcacgggcgctgctgttggcagcatcggcctggg

SEQ ID NO: 114353 - DNA, 75 bp, Artificial Sequence
  Synthetic
ggcaccgccgtcagcgtccacggcctttgtcgtaagcggcctctcgggcgctgctgttggcagcatcggcctggg

SEQ ID NO: 114354 - DNA, 75 bp, Artificial Sequence
  Synthetic
ggcaccgccgtcagcgtccacggcctttgtcgtaagcggcctcccgggcgctgctgttggcagcatcggcctggg

SEQ ID NO: 114355 - DNA, 75 bp, Artificial Sequence
  Synthetic
ggcaccgccgtcagcgtccacggcctttgtcgtaagcggcctcgcgggcgctgctgttggcagcatcggcctggg

SEQ ID NO: 114356 - DNA, 75 bp, Artificial Sequence
  Synthetic
ggcaccgccgtcagcgtccacggcgtttgtcgtaagcggcctcacgggcgctgctgttggcagcatcggcctggg

SEQ ID NO: 114357 - DNA, 75 bp, Artificial Sequence
  Synthetic
ggcaccgccgtcagcgtccacggcgtttgtcgtaagcggcctctcgggcgctgctgttggcagcatcggcctggg

SEQ ID NO: 114358 - DNA, 75 bp, Artificial Sequence
  Synthetic
ggcaccgccgtcagcgtccacggcgtttgtcgtaagcggcctcccgggcgctgctgttggcagcatcggcctggg

SEQ ID NO: 114359 - DNA, 75 bp, Artificial Sequence
  Synthetic
ggcaccgccgtcagcgtccacggcgtttgtcgtaagcggcctcgcgggcgctgctgttggcagcatcggcctggg

SEQ ID NO: 114360 - DNA, 75 bp, Artificial Sequence
  Synthetic
ggcaccgccgtctgcgtccacggcatttgtcgtaagcggcctcacgggcgctgctgttggcagcatcggcctggg

SEQ ID NO: 114361 - DNA, 75 bp, Artificial Sequence
  Synthetic
ggcaccgccgtctgcgtccacggcatttgtcgtaagcggcctctcgggcgctgctgttggcagcatcggcctggg

SEQ ID NO: 114362 - DNA, 75 bp, Artificial Sequence
  Synthetic
ggcaccgccgtctgcgtccacggcatttgtcgtaagcggcctcccgggcgctgctgttggcagcatcggcctggg

SEQ ID NO: 114363 - DNA, 75 bp, Artificial Sequence
  Synthetic
ggcaccgccgtctgcgtccacggcatttgtcgtaagcggcctcgcgggcgctgctgttggcagcatcggcctggg

SEQ ID NO: 114364 - DNA, 75 bp, Artificial Sequence
  Synthetic
ggcaccgccgtctgcgtccacggcttttgtcgtaagcggcctcacgggcgctgctgttggcagcatcggcctggg

SEQ ID NO: 114365 - DNA, 75 bp, Artificial Sequence
  Synthetic
ggcaccgccgtctgcgtccacggcttttgtcgtaagcggcctctcgggcgctgctgttggcagcatcggcctggg

SEQ ID NO: 114366 - DNA, 75 bp, Artificial Sequence
  Synthetic
ggcaccgccgtctgcgtccacggcttttgtcgtaagcggcctcccgggcgctgctgttggcagcatcggcctggg

SEQ ID NO: 114367 - DNA, 75 bp, Artificial Sequence
  Synthetic
ggcaccgccgtctgcgtccacggcttttgtcgtaagcggcctcgcgggcgctgctgttggcagcatcggcctggg

SEQ ID NO: 114368 - DNA, 75 bp, Artificial Sequence
  Synthetic
ggcaccgccgtctgcgtccacggcctttgtcgtaagcggcctcacgggcgctgctgttggcagcatcggcctggg

SEQ ID NO: 114369 - DNA, 75 bp, Artificial Sequence
  Synthetic
ggcaccgccgtctgcgtccacggcctttgtcgtaagcggcctctcgggcgctgctgttggcagcatcggcctggg

SEQ ID NO: 114370 - DNA, 75 bp, Artificial Sequence
  Synthetic
ggcaccgccgtctgcgtccacggcctttgtcgtaagcggcctcccgggcgctgctgttggcagcatcggcctggg

SEQ ID NO: 114371 - DNA, 75 bp, Artificial Sequence
  Synthetic
ggcaccgccgtctgcgtccacggcctttgtcgtaagcggcctcgcgggcgctgctgttggcagcatcggcctggg

SEQ ID NO: 114372 - DNA, 75 bp, Artificial Sequence
  Synthetic
ggcaccgccgtctgcgtccacggcgtttgtcgtaagcggcctcacgggcgctgctgttggcagcatcggcctggg

SEQ ID NO: 114373 - DNA, 75 bp, Artificial Sequence
  Synthetic
ggcaccgccgtctgcgtccacggcgtttgtcgtaagcggcctctcgggcgctgctgttggcagcatcggcctggg

SEQ ID NO: 114374 - DNA, 75 bp, Artificial Sequence
  Synthetic
ggcaccgccgtctgcgtccacggcgtttgtcgtaagcggcctcccgggcgctgctgttggcagcatcggcctggg

SEQ ID NO: 114375 - DNA, 75 bp, Artificial Sequence
  Synthetic
ggcaccgccgtctgcgtccacggcgtttgtcgtaagcggcctcgcgggcgctgctgttggcagcatcggcctggg

SEQ ID NO: 114376 - DNA, 75 bp, Artificial Sequence
  Synthetic
ggcaccgccgtccgcgtccacggcatttgtcgtaagcggcctcacgggcgctgctgttggcagcatcggcctggg

SEQ ID NO: 114377 - DNA, 75 bp, Artificial Sequence
  Synthetic
ggcaccgccgtccgcgtccacggcatttgtcgtaagcggcctctcgggcgctgctgttggcagcatcggcctggg

SEQ ID NO: 114378 - DNA, 75 bp, Artificial Sequence
  Synthetic
ggcaccgccgtccgcgtccacggcatttgtcgtaagcggcctcccgggcgctgctgttggcagcatcggcctggg

SEQ ID NO: 114379 - DNA, 75 bp, Artificial Sequence
  Synthetic
ggcaccgccgtccgcgtccacggcatttgtcgtaagcggcctcgcgggcgctgctgttggcagcatcggcctggg

SEQ ID NO: 114380 - DNA, 75 bp, Artificial Sequence
  Synthetic
ggcaccgccgtccgcgtccacggcttttgtcgtaagcggcctcacgggcgctgctgttggcagcatcggcctggg

SEQ ID NO: 114381 - DNA, 75 bp, Artificial Sequence
  Synthetic
ggcaccgccgtccgcgtccacggcttttgtcgtaagcggcctctcgggcgctgctgttggcagcatcggcctggg

SEQ ID NO: 114382 - DNA, 75 bp, Artificial Sequence
  Synthetic
ggcaccgccgtccgcgtccacggcttttgtcgtaagcggcctcccgggcgctgctgttggcagcatcggcctggg

SEQ ID NO: 114383 - DNA, 75 bp, Artificial Sequence
  Synthetic
ggcaccgccgtccgcgtccacggcttttgtcgtaagcggcctcgcgggcgctgctgttggcagcatcggcctggg

SEQ ID NO: 114384 - DNA, 75 bp, Artificial Sequence
  Synthetic
ggcaccgccgtccgcgtccacggcctttgtcgtaagcggcctcacgggcgctgctgttggcagcatcggcctggg

SEQ ID NO: 114385 - DNA, 75 bp, Artificial Sequence
  Synthetic
ggcaccgccgtccgcgtccacggcctttgtcgtaagcggcctctcgggcgctgctgttggcagcatcggcctggg

SEQ ID NO: 114386 - DNA, 75 bp, Artificial Sequence
  Synthetic
ggcaccgccgtccgcgtccacggcctttgtcgtaagcggcctcccgggcgctgctgttggcagcatcggcctggg

SEQ ID NO: 114387 - DNA, 75 bp, Artificial Sequence
  Synthetic
ggcaccgccgtccgcgtccacggcctttgtcgtaagcggcctcgcgggcgctgctgttggcagcatcggcctggg

SEQ ID NO: 114388 - DNA, 75 bp, Artificial Sequence
  Synthetic
ggcaccgccgtccgcgtccacggcgtttgtcgtaagcggcctcacgggcgctgctgttggcagcatcggcctggg

SEQ ID NO: 114389 - DNA, 75 bp, Artificial Sequence
  Synthetic
ggcaccgccgtccgcgtccacggcgtttgtcgtaagcggcctctcgggcgctgctgttggcagcatcggcctggg

SEQ ID NO: 114390 - DNA, 75 bp, Artificial Sequence
  Synthetic
ggcaccgccgtccgcgtccacggcgtttgtcgtaagcggcctcccgggcgctgctgttggcagcatcggcctggg

SEQ ID NO: 114391 - DNA, 75 bp, Artificial Sequence
  Synthetic
ggcaccgccgtccgcgtccacggcgtttgtcgtaagcggcctcgcgggcgctgctgttggcagcatcggcctggg

SEQ ID NO: 114392 - DNA, 75 bp, Artificial Sequence
  Synthetic
ggcaccgccgtcggcgtccacggcatttgtcgtaagcggcctcacgggcgctgctgttggcagcatcggcctggg

SEQ ID NO: 114393 - DNA, 75 bp, Artificial Sequence
  Synthetic
ggcaccgccgtcggcgtccacggcatttgtcgtaagcggcctctcgggcgctgctgttggcagcatcggcctggg

SEQ ID NO: 114394 - DNA, 75 bp, Artificial Sequence
  Synthetic
ggcaccgccgtcggcgtccacggcatttgtcgtaagcggcctcccgggcgctgctgttggcagcatcggcctggg

SEQ ID NO: 114395 - DNA, 75 bp, Artificial Sequence
  Synthetic
ggcaccgccgtcggcgtccacggcatttgtcgtaagcggcctcgcgggcgctgctgttggcagcatcggcctggg

SEQ ID NO: 114396 - DNA, 75 bp, Artificial Sequence
  Synthetic
ggcaccgccgtcggcgtccacggcttttgtcgtaagcggcctcacgggcgctgctgttggcagcatcggcctggg

SEQ ID NO: 114397 - DNA, 75 bp, Artificial Sequence
  Synthetic
ggcaccgccgtcggcgtccacggcttttgtcgtaagcggcctctcgggcgctgctgttggcagcatcggcctggg

SEQ ID NO: 114398 - DNA, 75 bp, Artificial Sequence
  Synthetic
ggcaccgccgtcggcgtccacggcttttgtcgtaagcggcctcccgggcgctgctgttggcagcatcggcctggg

SEQ ID NO: 114399 - DNA, 75 bp, Artificial Sequence
  Synthetic
ggcaccgccgtcggcgtccacggcttttgtcgtaagcggcctcgcgggcgctgctgttggcagcatcggcctggg

SEQ ID NO: 114400 - DNA, 75 bp, Artificial Sequence
  Synthetic
ggcaccgccgtcggcgtccacggcctttgtcgtaagcggcctcacgggcgctgctgttggcagcatcggcctggg

SEQ ID NO: 114401 - DNA, 75 bp, Artificial Sequence
  Synthetic
ggcaccgccgtcggcgtccacggcctttgtcgtaagcggcctctcgggcgctgctgttggcagcatcggcctggg

SEQ ID NO: 114402 - DNA, 75 bp, Artificial Sequence
  Synthetic
ggcaccgccgtcggcgtccacggcctttgtcgtaagcggcctcccgggcgctgctgttggcagcatcggcctggg

SEQ ID NO: 114403 - DNA, 75 bp, Artificial Sequence
  Synthetic
ggcaccgccgtcggcgtccacggcctttgtcgtaagcggcctcgcgggcgctgctgttggcagcatcggcctggg

SEQ ID NO: 114404 - DNA, 75 bp, Artificial Sequence
  Synthetic
ggcaccgccgtcggcgtccacggcgtttgtcgtaagcggcctcacgggcgctgctgttggcagcatcggcctggg

SEQ ID NO: 114405 - DNA, 75 bp, Artificial Sequence
  Synthetic
ggcaccgccgtcggcgtccacggcgtttgtcgtaagcggcctctcgggcgctgctgttggcagcatcggcctggg

SEQ ID NO: 114406 - DNA, 75 bp, Artificial Sequence
  Synthetic
ggcaccgccgtcggcgtccacggcgtttgtcgtaagcggcctcccgggcgctgctgttggcagcatcggcctggg

SEQ ID NO: 114407 - DNA, 75 bp, Artificial Sequence
  Synthetic
ggcaccgccgtcggcgtccacggcgtttgtcgtaagcggcctcgcgggcgctgctgttggcagcatcggcctggg

SEQ ID NO: 114408 - DNA, 75 bp, Artificial Sequence
  Synthetic
ctaagggccgagacagacgacagggaaatctccgtcgctgcggaggtcctctgcccctcaaagagattcccacct

SEQ ID NO: 114409 - DNA, 75 bp, Artificial Sequence
  Synthetic
gcatgggcttgaacgcagtggcttattacagagggcttgacgtctcagtgataccagcacagggagacgtggtgg

SEQ ID NO: 114410 - DNA, 75 bp, Artificial Sequence
  Synthetic
ataccagcacagggagacgtggtggtcgtcgctaccgacgccctcatgaccgggtacactggggacttcgactct

SEQ ID NO: 114411 - DNA, 75 bp, Artificial Sequence
  Synthetic
caaggttaggatgtatgtggggggtgtggagcacaggctcgaagccgcatgcaattggactcgaggagagcgttg

SEQ ID NO: 114412 - DNA, 75 bp, Artificial Sequence
  Synthetic
cgtgctagctgggctgctatattacagcatggtggccaactgggctaaggttgtaggtatcctactcctgttctc

SEQ ID NO: 114413 - DNA, 75 bp, Artificial Sequence
  Synthetic
cgtgctagctgggctgctatattacagcatggtggccaactgggctaaggttgtaggtatccttctcctgttctc

SEQ ID NO: 114414 - DNA, 75 bp, Artificial Sequence
  Synthetic
cgtgctagctgggctgctatattacagcatggtggccaactgggctaaggttgtaggtatcctcctcctgttctc

SEQ ID NO: 114415 - DNA, 75 bp, Artificial Sequence
  Synthetic
cgtgctagctgggctgctatattacagcatggtggccaactgggctaaggttgtaggtatcctgctcctgttctc

SEQ ID NO: 114416 - DNA, 75 bp, Artificial Sequence
  Synthetic
cgtgctagctgggctgctatattacagcatggtggccaactgggctaaggttgttggtatcctactcctgttctc

SEQ ID NO: 114417 - DNA, 75 bp, Artificial Sequence
  Synthetic
cgtgctagctgggctgctatattacagcatggtggccaactgggctaaggttgttggtatccttctcctgttctc

SEQ ID NO: 114418 - DNA, 75 bp, Artificial Sequence
  Synthetic
cgtgctagctgggctgctatattacagcatggtggccaactgggctaaggttgttggtatcctcctcctgttctc

SEQ ID NO: 114419 - DNA, 75 bp, Artificial Sequence
  Synthetic
cgtgctagctgggctgctatattacagcatggtggccaactgggctaaggttgttggtatcctgctcctgttctc

SEQ ID NO: 114420 - DNA, 75 bp, Artificial Sequence
  Synthetic
cgtgctagctgggctgctatattacagcatggtggccaactgggctaaggttgtcggtatcctactcctgttctc

SEQ ID NO: 114421 - DNA, 75 bp, Artificial Sequence
  Synthetic
cgtgctagctgggctgctatattacagcatggtggccaactgggctaaggttgtcggtatccttctcctgttctc

SEQ ID NO: 114422 - DNA, 75 bp, Artificial Sequence
  Synthetic
cgtgctagctgggctgctatattacagcatggtggccaactgggctaaggttgtcggtatcctcctcctgttctc

SEQ ID NO: 114423 - DNA, 75 bp, Artificial Sequence
  Synthetic
cgtgctagctgggctgctatattacagcatggtggccaactgggctaaggttgtcggtatcctgctcctgttctc

SEQ ID NO: 114424 - DNA, 75 bp, Artificial Sequence
  Synthetic
cgtgctagctgggctgctatattacagcatggtggccaactgggctaaggttgtgggtatcctactcctgttctc

SEQ ID NO: 114425 - DNA, 75 bp, Artificial Sequence
  Synthetic
cgtgctagctgggctgctatattacagcatggtggccaactgggctaaggttgtgggtatccttctcctgttctc

SEQ ID NO: 114426 - DNA, 75 bp, Artificial Sequence
  Synthetic
cgtgctagctgggctgctatattacagcatggtggccaactgggctaaggttgtgggtatcctcctcctgttctc

SEQ ID NO: 114427 - DNA, 75 bp, Artificial Sequence
  Synthetic
cgtgctagctgggctgctatattacagcatggtggccaactgggctaaggttgtgggtatcctgctcctgttctc

SEQ ID NO: 114428 - DNA, 75 bp, Artificial Sequence
  Synthetic
ccatacccgcgtcgcaggtgtgcggtccggtgtattgcttcaccccaagccctgttgtggtggggacgaccgatc

SEQ ID NO: 114429 - DNA, 75 bp, Artificial Sequence
  Synthetic
gacgagctcgcggcggcccttcggggcatgggcttgaacgcagtggcttattacagagggcttgacgtctcagtg

SEQ ID NO: 114430 - DNA, 75 bp, Artificial Sequence
  Synthetic
agggtcttcgagacttggcggtggccctggagccggttgtgttcacgcccatggagaagaaaatcatcgtctggg

SEQ ID NO: 114431 - DNA, 75 bp, Artificial Sequence
  Synthetic
cctggagccggttgtgttcacgcccatggagaagaaaatcatcgtctggggcgctgacaccgctgcgtgtggcga

SEQ ID NO: 114432 - DNA, 75 bp, Artificial Sequence
  Synthetic
accgccccccaggacgctgtctcgcgtagtcagcgccgaggtaggaccggtcgagggagacatggtatatacagg

SEQ ID NO: 114433 - DNA, 75 bp, Artificial Sequence
  Synthetic
ggaccggctgatagtcttgaagggcaggggtggcgactcctcgcgcctatcacggcctacgcccaacagacgcgg

SEQ ID NO: 114434 - DNA, 75 bp, Artificial Sequence
  Synthetic
agacggacgcctccaaaaatgtgatgaccatactcagttccctgacaatcaccagcttacctcgtaagcttcacg

SEQ ID NO: 114435 - DNA, 75 bp, Artificial Sequence
  Synthetic
gaccatactcagttccctgacaatcaccagcttacctcgtaagcttcacgagtggatcaattcggactggtctgc

SEQ ID NO: 114436 - DNA, 75 bp, Artificial Sequence
  Synthetic
aaaggggtggagactccttgcccccatcacagcgtacgcgcagcagacccgcggcttgttcagtaccatcgtaac

SEQ ID NO: 114437 - DNA, 75 bp, Artificial Sequence
  Synthetic
gacgacgagtcgtactcatcgatgcctccacttgaaggggaacccggcgacccggatctggggtcagactcttgg

SEQ ID NO: 114438 - DNA, 75 bp, Artificial Sequence
  Synthetic
tttcaatacaccagggttgcccgtatgccaagaccatctggaattctgggaggcggtctttactggcctcaccca

SEQ ID NO: 114439 - DNA, 75 bp, Artificial Sequence
  Synthetic
agaccactgtcaggctacgggcatatttcaatacaccagggttgcccgtatgccaagaccatctggaattctggg

SEQ ID NO: 114440 - DNA, 75 bp, Artificial Sequence
  Synthetic
ccatcacatacgcaaacattagcggtccttcagatgatagaccgtactgttggcactacgcaccaagaccgtgca

SEQ ID NO: 114441 - DNA, 75 bp, Artificial Sequence
  Synthetic
ccatcacatacgcaaacattagcggtccttcagatgatagaccgtactgttggcactacgcacctagaccgtgca

SEQ ID NO: 114442 - DNA, 75 bp, Artificial Sequence
  Synthetic
ccatcacatacgcaaacattagcggtccttcagatgatagaccgtactgttggcactacgcacccagaccgtgca

SEQ ID NO: 114443 - DNA, 75 bp, Artificial Sequence
  Synthetic
ccatcacatacgcaaacattagcggtccttcagatgatagaccgtactgttggcactacgcaccgagaccgtgca

SEQ ID NO: 114444 - DNA, 75 bp, Artificial Sequence
  Synthetic
gcgccccccggggcgcgttccctgacaccatgcacctgtggcagctcggacctttacttggtcacgaggcatgct

SEQ ID NO: 114445 - DNA, 75 bp, Artificial Sequence
  Synthetic
accaagcaagcgggggaaaacttcccgtacctggtggcctaccaggctacggtatgtgccagggcgaaagctcct

SEQ ID NO: 114446 - DNA, 75 bp, Artificial Sequence
  Synthetic
cgtacctggtggcctaccaggctacggtatgtgccagggcgaaagctcctcctccgtcctgggacattatgtgga

SEQ ID NO: 114447 - DNA, 75 bp, Artificial Sequence
  Synthetic
caatcagccccttgagcaactccctactgcgtcaccacaacatggtgtacgccacgacttcccgttccgccacga

SEQ ID NO: 114448 - DNA, 75 bp, Artificial Sequence
  Synthetic
aggtcatcgataccctaacgtgcggattcgccgacctcatggggtacatcccgctcgtaggcggccccgttgggg

SEQ ID NO: 114449 - DNA, 75 bp, Artificial Sequence
  Synthetic
ttgctccttttctatcttcctcttggcactattctcgtgcctcactacgcctgcctcagcaatccattataagaa

SEQ ID NO: 114450 - DNA, 75 bp, Artificial Sequence
  Synthetic
ttggggtgaaaaagagactgacgtgttccttctcgagagcttgcgaccaccgaagggaggatggtttggttgcac

SEQ ID NO: 114451 - DNA, 75 bp, Artificial Sequence
  Synthetic
ttggggtgaaaaagagactgacgtgttccttctcgagagcttgcgtccaccgaagggaggatggtttggttgcac

SEQ ID NO: 114452 - DNA, 75 bp, Artificial Sequence
  Synthetic
ttggggtgaaaaagagactgacgtgttccttctcgagagcttgcgcccaccgaagggaggatggtttggttgcac

SEQ ID NO: 114453 - DNA, 75 bp, Artificial Sequence
  Synthetic
ttggggtgaaaaagagactgacgtgttccttctcgagagcttgcggccaccgaagggaggatggtttggttgcac

SEQ ID NO: 114454 - DNA, 75 bp, Artificial Sequence
  Synthetic
ttggggtgaaaatgagactgacgtgttccttctcgagagcttgcgaccaccgaagggaggatggtttggttgcac

SEQ ID NO: 114455 - DNA, 75 bp, Artificial Sequence
  Synthetic
ttggggtgaaaatgagactgacgtgttccttctcgagagcttgcgtccaccgaagggaggatggtttggttgcac

SEQ ID NO: 114456 - DNA, 75 bp, Artificial Sequence
  Synthetic
ttggggtgaaaatgagactgacgtgttccttctcgagagcttgcgcccaccgaagggaggatggtttggttgcac

SEQ ID NO: 114457 - DNA, 75 bp, Artificial Sequence
  Synthetic
ttggggtgaaaatgagactgacgtgttccttctcgagagcttgcggccaccgaagggaggatggtttggttgcac

SEQ ID NO: 114458 - DNA, 75 bp, Artificial Sequence
  Synthetic
ttggggtgaaaacgagactgacgtgttccttctcgagagcttgcgaccaccgaagggaggatggtttggttgcac

SEQ ID NO: 114459 - DNA, 75 bp, Artificial Sequence
  Synthetic
ttggggtgaaaacgagactgacgtgttccttctcgagagcttgcgtccaccgaagggaggatggtttggttgcac

SEQ ID NO: 114460 - DNA, 75 bp, Artificial Sequence
  Synthetic
ttggggtgaaaacgagactgacgtgttccttctcgagagcttgcgcccaccgaagggaggatggtttggttgcac

SEQ ID NO: 114461 - DNA, 75 bp, Artificial Sequence
  Synthetic
ttggggtgaaaacgagactgacgtgttccttctcgagagcttgcggccaccgaagggaggatggtttggttgcac

SEQ ID NO: 114462 - DNA, 75 bp, Artificial Sequence
  Synthetic
ttggggtgaaaaggagactgacgtgttccttctcgagagcttgcgaccaccgaagggaggatggtttggttgcac

SEQ ID NO: 114463 - DNA, 75 bp, Artificial Sequence
  Synthetic
ttggggtgaaaaggagactgacgtgttccttctcgagagcttgcgtccaccgaagggaggatggtttggttgcac

SEQ ID NO: 114464 - DNA, 75 bp, Artificial Sequence
  Synthetic
ttggggtgaaaaggagactgacgtgttccttctcgagagcttgcgcccaccgaagggaggatggtttggttgcac

SEQ ID NO: 114465 - DNA, 75 bp, Artificial Sequence
  Synthetic
ttggggtgaaaaggagactgacgtgttccttctcgagagcttgcggccaccgaagggaggatggtttggttgcac

SEQ ID NO: 114466 - DNA, 75 bp, Artificial Sequence
  Synthetic
ccgcatgcaggtcgttgattcccattacaatgacacattgaaggagattaaggcaagagcatcaggtgtgaaggc

SEQ ID NO: 114467 - DNA, 75 bp, Artificial Sequence
  Synthetic
tcaacgcttccaccactggccccagcgtacctatcccggagcccaactaccgcagagcactgtggagggtggctg

SEQ ID NO: 114468 - DNA, 75 bp, Artificial Sequence
  Synthetic
actccttcgatccgcttgtggcggaggaggatgaacgggaggtctccgtgcccgcagaaatcctgcggaagtctc

SEQ ID NO: 114469 - DNA, 75 bp, Artificial Sequence
  Synthetic
gttaggacagataacatctctcgatgctgggtgccggtggcacccaccctcgctgtaacgaatgtttccgtcccg

SEQ ID NO: 114470 - DNA, 75 bp, Artificial Sequence
  Synthetic
gttaggacagataacatctctcgatgctgggtgccggtggcacccaccctcgctgttacgaatgtttccgtcccg

SEQ ID NO: 114471 - DNA, 75 bp, Artificial Sequence
  Synthetic
gttaggacagataacatctctcgatgctgggtgccggtggcacccaccctcgctgtcacgaatgtttccgtcccg

SEQ ID NO: 114472 - DNA, 75 bp, Artificial Sequence
  Synthetic
gttaggacagataacatctctcgatgctgggtgccggtggcacccaccctcgctgtgacgaatgtttccgtcccg

SEQ ID NO: 114473 - DNA, 75 bp, Artificial Sequence
  Synthetic
gttaggacagataacatctctcgatgctgggtgccggtggctcccaccctcgctgtaacgaatgtttccgtcccg

SEQ ID NO: 114474 - DNA, 75 bp, Artificial Sequence
  Synthetic
gttaggacagataacatctctcgatgctgggtgccggtggctcccaccctcgctgttacgaatgtttccgtcccg

SEQ ID NO: 114475 - DNA, 75 bp, Artificial Sequence
  Synthetic
gttaggacagataacatctctcgatgctgggtgccggtggctcccaccctcgctgtcacgaatgtttccgtcccg

SEQ ID NO: 114476 - DNA, 75 bp, Artificial Sequence
  Synthetic
gttaggacagataacatctctcgatgctgggtgccggtggctcccaccctcgctgtgacgaatgtttccgtcccg

SEQ ID NO: 114477 - DNA, 75 bp, Artificial Sequence
  Synthetic
gttaggacagataacatctctcgatgctgggtgccggtggcccccaccctcgctgtaacgaatgtttccgtcccg

SEQ ID NO: 114478 - DNA, 75 bp, Artificial Sequence
  Synthetic
gttaggacagataacatctctcgatgctgggtgccggtggcccccaccctcgctgttacgaatgtttccgtcccg

SEQ ID NO: 114479 - DNA, 75 bp, Artificial Sequence
  Synthetic
gttaggacagataacatctctcgatgctgggtgccggtggcccccaccctcgctgtcacgaatgtttccgtcccg

SEQ ID NO: 114480 - DNA, 75 bp, Artificial Sequence
  Synthetic
gttaggacagataacatctctcgatgctgggtgccggtggcccccaccctcgctgtgacgaatgtttccgtcccg

SEQ ID NO: 114481 - DNA, 75 bp, Artificial Sequence
  Synthetic
gttaggacagataacatctctcgatgctgggtgccggtggcgcccaccctcgctgtaacgaatgtttccgtcccg

SEQ ID NO: 114482 - DNA, 75 bp, Artificial Sequence
  Synthetic
gttaggacagataacatctctcgatgctgggtgccggtggcgcccaccctcgctgttacgaatgtttccgtcccg

SEQ ID NO: 114483 - DNA, 75 bp, Artificial Sequence
  Synthetic
gttaggacagataacatctctcgatgctgggtgccggtggcgcccaccctcgctgtcacgaatgtttccgtcccg

SEQ ID NO: 114484 - DNA, 75 bp, Artificial Sequence
  Synthetic
gttaggacagataacatctctcgatgctgggtgccggtggcgcccaccctcgctgtgacgaatgtttccgtcccg

SEQ ID NO: 114485 - DNA, 75 bp, Artificial Sequence
  Synthetic
gttaggacagataacatctctcgttgctgggtgccggtggcacccaccctcgctgtaacgaatgtttccgtcccg

SEQ ID NO: 114486 - DNA, 75 bp, Artificial Sequence
  Synthetic
gttaggacagataacatctctcgttgctgggtgccggtggcacccaccctcgctgttacgaatgtttccgtcccg

SEQ ID NO: 114487 - DNA, 75 bp, Artificial Sequence
  Synthetic
gttaggacagataacatctctcgttgctgggtgccggtggcacccaccctcgctgtcacgaatgtttccgtcccg

SEQ ID NO: 114488 - DNA, 75 bp, Artificial Sequence
  Synthetic
gttaggacagataacatctctcgttgctgggtgccggtggcacccaccctcgctgtgacgaatgtttccgtcccg

SEQ ID NO: 114489 - DNA, 75 bp, Artificial Sequence
  Synthetic
gttaggacagataacatctctcgttgctgggtgccggtggctcccaccctcgctgtaacgaatgtttccgtcccg

SEQ ID NO: 114490 - DNA, 75 bp, Artificial Sequence
  Synthetic
gttaggacagataacatctctcgttgctgggtgccggtggctcccaccctcgctgttacgaatgtttccgtcccg

SEQ ID NO: 114491 - DNA, 75 bp, Artificial Sequence
  Synthetic
gttaggacagataacatctctcgttgctgggtgccggtggctcccaccctcgctgtcacgaatgtttccgtcccg

SEQ ID NO: 114492 - DNA, 75 bp, Artificial Sequence
  Synthetic
gttaggacagataacatctctcgttgctgggtgccggtggctcccaccctcgctgtgacgaatgtttccgtcccg

SEQ ID NO: 114493 - DNA, 75 bp, Artificial Sequence
  Synthetic
gttaggacagataacatctctcgttgctgggtgccggtggcccccaccctcgctgtaacgaatgtttccgtcccg

SEQ ID NO: 114494 - DNA, 75 bp, Artificial Sequence
  Synthetic
gttaggacagataacatctctcgttgctgggtgccggtggcccccaccctcgctgttacgaatgtttccgtcccg

SEQ ID NO: 114495 - DNA, 75 bp, Artificial Sequence
  Synthetic
gttaggacagataacatctctcgttgctgggtgccggtggcccccaccctcgctgtcacgaatgtttccgtcccg

SEQ ID NO: 114496 - DNA, 75 bp, Artificial Sequence
  Synthetic
gttaggacagataacatctctcgttgctgggtgccggtggcccccaccctcgctgtgacgaatgtttccgtcccg

SEQ ID NO: 114497 - DNA, 75 bp, Artificial Sequence
  Synthetic
gttaggacagataacatctctcgttgctgggtgccggtggcgcccaccctcgctgtaacgaatgtttccgtcccg

SEQ ID NO: 114498 - DNA, 75 bp, Artificial Sequence
  Synthetic
gttaggacagataacatctctcgttgctgggtgccggtggcgcccaccctcgctgttacgaatgtttccgtcccg

SEQ ID NO: 114499 - DNA, 75 bp, Artificial Sequence
  Synthetic
gttaggacagataacatctctcgttgctgggtgccggtggcgcccaccctcgctgtcacgaatgtttccgtcccg

SEQ ID NO: 114500 - DNA, 75 bp, Artificial Sequence
  Synthetic
gttaggacagataacatctctcgttgctgggtgccggtggcgcccaccctcgctgtgacgaatgtttccgtcccg

SEQ ID NO: 114501 - DNA, 75 bp, Artificial Sequence
  Synthetic
gttaggacagataacatctctcgctgctgggtgccggtggcacccaccctcgctgtaacgaatgtttccgtcccg

SEQ ID NO: 114502 - DNA, 75 bp, Artificial Sequence
  Synthetic
gttaggacagataacatctctcgctgctgggtgccggtggcacccaccctcgctgttacgaatgtttccgtcccg

SEQ ID NO: 114503 - DNA, 75 bp, Artificial Sequence
  Synthetic
gttaggacagataacatctctcgctgctgggtgccggtggcacccaccctcgctgtcacgaatgtttccgtcccg

SEQ ID NO: 114504 - DNA, 75 bp, Artificial Sequence
  Synthetic
gttaggacagataacatctctcgctgctgggtgccggtggcacccaccctcgctgtgacgaatgtttccgtcccg

SEQ ID NO: 114505 - DNA, 75 bp, Artificial Sequence
  Synthetic
gttaggacagataacatctctcgctgctgggtgccggtggctcccaccctcgctgtaacgaatgtttccgtcccg

SEQ ID NO: 114506 - DNA, 75 bp, Artificial Sequence
  Synthetic
gttaggacagataacatctctcgctgctgggtgccggtggctcccaccctcgctgttacgaatgtttccgtcccg

SEQ ID NO: 114507 - DNA, 75 bp, Artificial Sequence
  Synthetic
gttaggacagataacatctctcgctgctgggtgccggtggctcccaccctcgctgtcacgaatgtttccgtcccg

SEQ ID NO: 114508 - DNA, 75 bp, Artificial Sequence
  Synthetic
gttaggacagataacatctctcgctgctgggtgccggtggctcccaccctcgctgtgacgaatgtttccgtcccg

SEQ ID NO: 114509 - DNA, 75 bp, Artificial Sequence
  Synthetic
gttaggacagataacatctctcgctgctgggtgccggtggcccccaccctcgctgtaacgaatgtttccgtcccg

SEQ ID NO: 114510 - DNA, 75 bp, Artificial Sequence
  Synthetic
gttaggacagataacatctctcgctgctgggtgccggtggcccccaccctcgctgttacgaatgtttccgtcccg

SEQ ID NO: 114511 - DNA, 75 bp, Artificial Sequence
  Synthetic
gttaggacagataacatctctcgctgctgggtgccggtggcccccaccctcgctgtcacgaatgtttccgtcccg

SEQ ID NO: 114512 - DNA, 75 bp, Artificial Sequence
  Synthetic
gttaggacagataacatctctcgctgctgggtgccggtggcccccaccctcgctgtgacgaatgtttccgtcccg

SEQ ID NO: 114513 - DNA, 75 bp, Artificial Sequence
  Synthetic
gttaggacagataacatctctcgctgctgggtgccggtggcgcccaccctcgctgtaacgaatgtttccgtcccg

SEQ ID NO: 114514 - DNA, 75 bp, Artificial Sequence
  Synthetic
gttaggacagataacatctctcgctgctgggtgccggtggcgcccaccctcgctgttacgaatgtttccgtcccg

SEQ ID NO: 114515 - DNA, 75 bp, Artificial Sequence
  Synthetic
gttaggacagataacatctctcgctgctgggtgccggtggcgcccaccctcgctgtcacgaatgtttccgtcccg

SEQ ID NO: 114516 - DNA, 75 bp, Artificial Sequence
  Synthetic
gttaggacagataacatctctcgctgctgggtgccggtggcgcccaccctcgctgtgacgaatgtttccgtcccg

SEQ ID NO: 114517 - DNA, 75 bp, Artificial Sequence
  Synthetic
gttaggacagataacatctctcggtgctgggtgccggtggcacccaccctcgctgtaacgaatgtttccgtcccg

SEQ ID NO: 114518 - DNA, 75 bp, Artificial Sequence
  Synthetic
gttaggacagataacatctctcggtgctgggtgccggtggcacccaccctcgctgttacgaatgtttccgtcccg

SEQ ID NO: 114519 - DNA, 75 bp, Artificial Sequence
  Synthetic
gttaggacagataacatctctcggtgctgggtgccggtggcacccaccctcgctgtcacgaatgtttccgtcccg

SEQ ID NO: 114520 - DNA, 75 bp, Artificial Sequence
  Synthetic
gttaggacagataacatctctcggtgctgggtgccggtggcacccaccctcgctgtgacgaatgtttccgtcccg

SEQ ID NO: 114521 - DNA, 75 bp, Artificial Sequence
  Synthetic
gttaggacagataacatctctcggtgctgggtgccggtggctcccaccctcgctgtaacgaatgtttccgtcccg

SEQ ID NO: 114522 - DNA, 75 bp, Artificial Sequence
  Synthetic
gttaggacagataacatctctcggtgctgggtgccggtggctcccaccctcgctgttacgaatgtttccgtcccg

SEQ ID NO: 114523 - DNA, 75 bp, Artificial Sequence
  Synthetic
gttaggacagataacatctctcggtgctgggtgccggtggctcccaccctcgctgtcacgaatgtttccgtcccg

SEQ ID NO: 114524 - DNA, 75 bp, Artificial Sequence
  Synthetic
gttaggacagataacatctctcggtgctgggtgccggtggctcccaccctcgctgtgacgaatgtttccgtcccg

SEQ ID NO: 114525 - DNA, 75 bp, Artificial Sequence
  Synthetic
gttaggacagataacatctctcggtgctgggtgccggtggcccccaccctcgctgtaacgaatgtttccgtcccg

SEQ ID NO: 114526 - DNA, 75 bp, Artificial Sequence
  Synthetic
gttaggacagataacatctctcggtgctgggtgccggtggcccccaccctcgctgttacgaatgtttccgtcccg

SEQ ID NO: 114527 - DNA, 75 bp, Artificial Sequence
  Synthetic
gttaggacagataacatctctcggtgctgggtgccggtggcccccaccctcgctgtcacgaatgtttccgtcccg

SEQ ID NO: 114528 - DNA, 75 bp, Artificial Sequence
  Synthetic
gttaggacagataacatctctcggtgctgggtgccggtggcccccaccctcgctgtgacgaatgtttccgtcccg

SEQ ID NO: 114529 - DNA, 75 bp, Artificial Sequence
  Synthetic
gttaggacagataacatctctcggtgctgggtgccggtggcgcccaccctcgctgtaacgaatgtttccgtcccg

SEQ ID NO: 114530 - DNA, 75 bp, Artificial Sequence
  Synthetic
gttaggacagataacatctctcggtgctgggtgccggtggcgcccaccctcgctgttacgaatgtttccgtcccg

SEQ ID NO: 114531 - DNA, 75 bp, Artificial Sequence
  Synthetic
gttaggacagataacatctctcggtgctgggtgccggtggcgcccaccctcgctgtcacgaatgtttccgtcccg

SEQ ID NO: 114532 - DNA, 75 bp, Artificial Sequence
  Synthetic
gttaggacagataacatctctcggtgctgggtgccggtggcgcccaccctcgctgtgacgaatgtttccgtcccg

SEQ ID NO: 114533 - DNA, 75 bp, Artificial Sequence
  Synthetic
gtggatgaactccacggggtttgtcaaaacgtgcggcgcgccaccgtgtaacatcgggccggcctccaacaactc

SEQ ID NO: 114534 - DNA, 75 bp, Artificial Sequence
  Synthetic
cgctgtaacgaatgtttccgtcccggtgagggggttccgtagtcacgaggaccttctcgttggttcggcggcatt

SEQ ID NO: 114535 - DNA, 75 bp, Artificial Sequence
  Synthetic
cgctgtaacgaatgtttccgtcccggtgagggggttccgtagtcacgaggaccttctcgttggttcggcggcttt

SEQ ID NO: 114536 - DNA, 75 bp, Artificial Sequence
  Synthetic
cgctgtaacgaatgtttccgtcccggtgagggggttccgtagtcacgaggaccttctcgttggttcggcggcctt

SEQ ID NO: 114537 - DNA, 75 bp, Artificial Sequence
  Synthetic
cgctgtaacgaatgtttccgtcccggtgagggggttccgtagtcacgaggaccttctcgttggttcggcggcgtt

SEQ ID NO: 114538 - DNA, 75 bp, Artificial Sequence
  Synthetic
cgctgtaacgaatgtttccgtcccggtgagggggttccgtagtcacgtggaccttctcgttggttcggcggcatt

SEQ ID NO: 114539 - DNA, 75 bp, Artificial Sequence
  Synthetic
cgctgtaacgaatgtttccgtcccggtgagggggttccgtagtcacgtggaccttctcgttggttcggcggcttt

SEQ ID NO: 114540 - DNA, 75 bp, Artificial Sequence
  Synthetic
cgctgtaacgaatgtttccgtcccggtgagggggttccgtagtcacgtggaccttctcgttggttcggcggcctt

SEQ ID NO: 114541 - DNA, 75 bp, Artificial Sequence
  Synthetic
cgctgtaacgaatgtttccgtcccggtgagggggttccgtagtcacgtggaccttctcgttggttcggcggcgtt

SEQ ID NO: 114542 - DNA, 75 bp, Artificial Sequence
  Synthetic
cgctgtaacgaatgtttccgtcccggtgagggggttccgtagtcacgcggaccttctcgttggttcggcggcatt

SEQ ID NO: 114543 - DNA, 75 bp, Artificial Sequence
  Synthetic
cgctgtaacgaatgtttccgtcccggtgagggggttccgtagtcacgcggaccttctcgttggttcggcggcttt

SEQ ID NO: 114544 - DNA, 75 bp, Artificial Sequence
  Synthetic
cgctgtaacgaatgtttccgtcccggtgagggggttccgtagtcacgcggaccttctcgttggttcggcggcctt

SEQ ID NO: 114545 - DNA, 75 bp, Artificial Sequence
  Synthetic
cgctgtaacgaatgtttccgtcccggtgagggggttccgtagtcacgcggaccttctcgttggttcggcggcgtt

SEQ ID NO: 114546 - DNA, 75 bp, Artificial Sequence
  Synthetic
cgctgtaacgaatgtttccgtcccggtgagggggttccgtagtcacggggaccttctcgttggttcggcggcatt

SEQ ID NO: 114547 - DNA, 75 bp, Artificial Sequence
  Synthetic
cgctgtaacgaatgtttccgtcccggtgagggggttccgtagtcacggggaccttctcgttggttcggcggcttt

SEQ ID NO: 114548 - DNA, 75 bp, Artificial Sequence
  Synthetic
cgctgtaacgaatgtttccgtcccggtgagggggttccgtagtcacggggaccttctcgttggttcggcggcctt

SEQ ID NO: 114549 - DNA, 75 bp, Artificial Sequence
  Synthetic
cgctgtaacgaatgtttccgtcccggtgagggggttccgtagtcacggggaccttctcgttggttcggcggcgtt

SEQ ID NO: 114550 - DNA, 75 bp, Artificial Sequence
  Synthetic
cgctgttacgaatgtttccgtcccggtgagggggttccgtagtcacgaggaccttctcgttggttcggcggcatt

SEQ ID NO: 114551 - DNA, 75 bp, Artificial Sequence
  Synthetic
cgctgttacgaatgtttccgtcccggtgagggggttccgtagtcacgaggaccttctcgttggttcggcggcttt

SEQ ID NO: 114552 - DNA, 75 bp, Artificial Sequence
  Synthetic
cgctgttacgaatgtttccgtcccggtgagggggttccgtagtcacgaggaccttctcgttggttcggcggcctt

SEQ ID NO: 114553 - DNA, 75 bp, Artificial Sequence
  Synthetic
cgctgttacgaatgtttccgtcccggtgagggggttccgtagtcacgaggaccttctcgttggttcggcggcgtt

SEQ ID NO: 114554 - DNA, 75 bp, Artificial Sequence
  Synthetic
cgctgttacgaatgtttccgtcccggtgagggggttccgtagtcacgtggaccttctcgttggttcggcggcatt

SEQ ID NO: 114555 - DNA, 75 bp, Artificial Sequence
  Synthetic
cgctgttacgaatgtttccgtcccggtgagggggttccgtagtcacgtggaccttctcgttggttcggcggcttt

SEQ ID NO: 114556 - DNA, 75 bp, Artificial Sequence
  Synthetic
cgctgttacgaatgtttccgtcccggtgagggggttccgtagtcacgtggaccttctcgttggttcggcggcctt

SEQ ID NO: 114557 - DNA, 75 bp, Artificial Sequence
  Synthetic
cgctgttacgaatgtttccgtcccggtgagggggttccgtagtcacgtggaccttctcgttggttcggcggcgtt

SEQ ID NO: 114558 - DNA, 75 bp, Artificial Sequence
  Synthetic
cgctgttacgaatgtttccgtcccggtgagggggttccgtagtcacgcggaccttctcgttggttcggcggcatt

SEQ ID NO: 114559 - DNA, 75 bp, Artificial Sequence
  Synthetic
cgctgttacgaatgtttccgtcccggtgagggggttccgtagtcacgcggaccttctcgttggttcggcggcttt

SEQ ID NO: 114560 - DNA, 75 bp, Artificial Sequence
  Synthetic
cgctgttacgaatgtttccgtcccggtgagggggttccgtagtcacgcggaccttctcgttggttcggcggcctt

SEQ ID NO: 114561 - DNA, 75 bp, Artificial Sequence
  Synthetic
cgctgttacgaatgtttccgtcccggtgagggggttccgtagtcacgcggaccttctcgttggttcggcggcgtt

SEQ ID NO: 114562 - DNA, 75 bp, Artificial Sequence
  Synthetic
cgctgttacgaatgtttccgtcccggtgagggggttccgtagtcacggggaccttctcgttggttcggcggcatt

SEQ ID NO: 114563 - DNA, 75 bp, Artificial Sequence
  Synthetic
cgctgttacgaatgtttccgtcccggtgagggggttccgtagtcacggggaccttctcgttggttcggcggcttt

SEQ ID NO: 114564 - DNA, 75 bp, Artificial Sequence
  Synthetic
cgctgttacgaatgtttccgtcccggtgagggggttccgtagtcacggggaccttctcgttggttcggcggcctt

SEQ ID NO: 114565 - DNA, 75 bp, Artificial Sequence
  Synthetic
cgctgttacgaatgtttccgtcccggtgagggggttccgtagtcacggggaccttctcgttggttcggcggcgtt

SEQ ID NO: 114566 - DNA, 75 bp, Artificial Sequence
  Synthetic
cgctgtcacgaatgtttccgtcccggtgagggggttccgtagtcacgaggaccttctcgttggttcggcggcatt

SEQ ID NO: 114567 - DNA, 75 bp, Artificial Sequence
  Synthetic
cgctgtcacgaatgtttccgtcccggtgagggggttccgtagtcacgaggaccttctcgttggttcggcggcttt

SEQ ID NO: 114568 - DNA, 75 bp, Artificial Sequence
  Synthetic
cgctgtcacgaatgtttccgtcccggtgagggggttccgtagtcacgaggaccttctcgttggttcggcggcctt

SEQ ID NO: 114569 - DNA, 75 bp, Artificial Sequence
  Synthetic
cgctgtcacgaatgtttccgtcccggtgagggggttccgtagtcacgaggaccttctcgttggttcggcggcgtt

SEQ ID NO: 114570 - DNA, 75 bp, Artificial Sequence
  Synthetic
cgctgtcacgaatgtttccgtcccggtgagggggttccgtagtcacgtggaccttctcgttggttcggcggcatt

SEQ ID NO: 114571 - DNA, 75 bp, Artificial Sequence
  Synthetic
cgctgtcacgaatgtttccgtcccggtgagggggttccgtagtcacgtggaccttctcgttggttcggcggcttt

SEQ ID NO: 114572 - DNA, 75 bp, Artificial Sequence
  Synthetic
cgctgtcacgaatgtttccgtcccggtgagggggttccgtagtcacgtggaccttctcgttggttcggcggcctt

SEQ ID NO: 114573 - DNA, 75 bp, Artificial Sequence
  Synthetic
cgctgtcacgaatgtttccgtcccggtgagggggttccgtagtcacgtggaccttctcgttggttcggcggcgtt

SEQ ID NO: 114574 - DNA, 75 bp, Artificial Sequence
  Synthetic
cgctgtcacgaatgtttccgtcccggtgagggggttccgtagtcacgcggaccttctcgttggttcggcggcatt

SEQ ID NO: 114575 - DNA, 75 bp, Artificial Sequence
  Synthetic
cgctgtcacgaatgtttccgtcccggtgagggggttccgtagtcacgcggaccttctcgttggttcggcggcttt

SEQ ID NO: 114576 - DNA, 75 bp, Artificial Sequence
  Synthetic
cgctgtcacgaatgtttccgtcccggtgagggggttccgtagtcacgcggaccttctcgttggttcggcggcctt

SEQ ID NO: 114577 - DNA, 75 bp, Artificial Sequence
  Synthetic
cgctgtcacgaatgtttccgtcccggtgagggggttccgtagtcacgcggaccttctcgttggttcggcggcgtt

SEQ ID NO: 114578 - DNA, 75 bp, Artificial Sequence
  Synthetic
cgctgtcacgaatgtttccgtcccggtgagggggttccgtagtcacggggaccttctcgttggttcggcggcatt

SEQ ID NO: 114579 - DNA, 75 bp, Artificial Sequence
  Synthetic
cgctgtcacgaatgtttccgtcccggtgagggggttccgtagtcacggggaccttctcgttggttcggcggcttt

SEQ ID NO: 114580 - DNA, 75 bp, Artificial Sequence
  Synthetic
cgctgtcacgaatgtttccgtcccggtgagggggttccgtagtcacggggaccttctcgttggttcggcggcctt

SEQ ID NO: 114581 - DNA, 75 bp, Artificial Sequence
  Synthetic
cgctgtcacgaatgtttccgtcccggtgagggggttccgtagtcacggggaccttctcgttggttcggcggcgtt

SEQ ID NO: 114582 - DNA, 75 bp, Artificial Sequence
  Synthetic
cgctgtgacgaatgtttccgtcccggtgagggggttccgtagtcacgaggaccttctcgttggttcggcggcatt

SEQ ID NO: 114583 - DNA, 75 bp, Artificial Sequence
  Synthetic
cgctgtgacgaatgtttccgtcccggtgagggggttccgtagtcacgaggaccttctcgttggttcggcggcttt

SEQ ID NO: 114584 - DNA, 75 bp, Artificial Sequence
  Synthetic
cgctgtgacgaatgtttccgtcccggtgagggggttccgtagtcacgaggaccttctcgttggttcggcggcctt

SEQ ID NO: 114585 - DNA, 75 bp, Artificial Sequence
  Synthetic
cgctgtgacgaatgtttccgtcccggtgagggggttccgtagtcacgaggaccttctcgttggttcggcggcgtt

SEQ ID NO: 114586 - DNA, 75 bp, Artificial Sequence
  Synthetic
cgctgtgacgaatgtttccgtcccggtgagggggttccgtagtcacgtggaccttctcgttggttcggcggcatt

SEQ ID NO: 114587 - DNA, 75 bp, Artificial Sequence
  Synthetic
cgctgtgacgaatgtttccgtcccggtgagggggttccgtagtcacgtggaccttctcgttggttcggcggcttt

SEQ ID NO: 114588 - DNA, 75 bp, Artificial Sequence
  Synthetic
cgctgtgacgaatgtttccgtcccggtgagggggttccgtagtcacgtggaccttctcgttggttcggcggcctt

SEQ ID NO: 114589 - DNA, 75 bp, Artificial Sequence
  Synthetic
cgctgtgacgaatgtttccgtcccggtgagggggttccgtagtcacgtggaccttctcgttggttcggcggcgtt

SEQ ID NO: 114590 - DNA, 75 bp, Artificial Sequence
  Synthetic
cgctgtgacgaatgtttccgtcccggtgagggggttccgtagtcacgcggaccttctcgttggttcggcggcatt

SEQ ID NO: 114591 - DNA, 75 bp, Artificial Sequence
  Synthetic
cgctgtgacgaatgtttccgtcccggtgagggggttccgtagtcacgcggaccttctcgttggttcggcggcttt

SEQ ID NO: 114592 - DNA, 75 bp, Artificial Sequence
  Synthetic
cgctgtgacgaatgtttccgtcccggtgagggggttccgtagtcacgcggaccttctcgttggttcggcggcctt

SEQ ID NO: 114593 - DNA, 75 bp, Artificial Sequence
  Synthetic
cgctgtgacgaatgtttccgtcccggtgagggggttccgtagtcacgcggaccttctcgttggttcggcggcgtt

SEQ ID NO: 114594 - DNA, 75 bp, Artificial Sequence
  Synthetic
cgctgtgacgaatgtttccgtcccggtgagggggttccgtagtcacggggaccttctcgttggttcggcggcatt

SEQ ID NO: 114595 - DNA, 75 bp, Artificial Sequence
  Synthetic
cgctgtgacgaatgtttccgtcccggtgagggggttccgtagtcacggggaccttctcgttggttcggcggcttt

SEQ ID NO: 114596 - DNA, 75 bp, Artificial Sequence
  Synthetic
cgctgtgacgaatgtttccgtcccggtgagggggttccgtagtcacggggaccttctcgttggttcggcggcctt

SEQ ID NO: 114597 - DNA, 75 bp, Artificial Sequence
  Synthetic
cgctgtgacgaatgtttccgtcccggtgagggggttccgtagtcacggggaccttctcgttggttcggcggcgtt

SEQ ID NO: 114598 - DNA, 75 bp, Artificial Sequence
  Synthetic
tgctcttctctcgtgcctcaccgtcccggcctccgcagttccctaccgaaatgcctctgggatttatcatgtcac

SEQ ID NO: 114599 - DNA, 75 bp, Artificial Sequence
  Synthetic
aggagacactagaggagctctcttgagccctagaccaatatccactcttaaggggtcttctggtggtccgctgct

SEQ ID NO: 114600 - DNA, 75 bp, Artificial Sequence
  Synthetic
ctttatgaggcttttgatgagatggaggagtgcgcctccaaggcctccctcatcgcggaagggcaacggatagcc

SEQ ID NO: 114601 - DNA, 75 bp, Artificial Sequence
  Synthetic
tgtcagccccgagctttggagcagtcacggctcctcttcggagagccgttgactacttggcgggaggggctgccc

SEQ ID NO: 114602 - DNA, 75 bp, Artificial Sequence
  Synthetic
gcgagcccgagcccaatgtaatggtactcacgtccatgctcactgaccctgaccacatcaccgcggaagaggcgc

SEQ ID NO: 114603 - DNA, 75 bp, Artificial Sequence
  Synthetic
gcgagcccgagccctatgtaatggtactcacgtccatgctcactgaccctgaccacatcaccgcggaagaggcgc

SEQ ID NO: 114604 - DNA, 75 bp, Artificial Sequence
  Synthetic
gcgagcccgagccccatgtaatggtactcacgtccatgctcactgaccctgaccacatcaccgcggaagaggcgc

SEQ ID NO: 114605 - DNA, 75 bp, Artificial Sequence
  Synthetic
gcgagcccgagcccgatgtaatggtactcacgtccatgctcactgaccctgaccacatcaccgcggaagaggcgc

SEQ ID NO: 114606 - DNA, 75 bp, Artificial Sequence
  Synthetic
atgagccctcttctgcattcgacaactgagctcgcaatactcccatgtacattcaccaccatgccagccttatca

SEQ ID NO: 114607 - DNA, 75 bp, Artificial Sequence
  Synthetic
agttttgggccaagcacatgtggaacttcatcagcggcatccaataccttgctggactctccacgctaccgggaa

SEQ ID NO: 114608 - DNA, 75 bp, Artificial Sequence
  Synthetic
tggggtttggggtatacatgtccaaggcatatggtattgacccgaacattcggtcaggagtcaggaccatcacca

SEQ ID NO: 114609 - DNA, 75 bp, Artificial Sequence
  Synthetic
agacgcatggaggtctaagaaaacccccatggggttctcgtatgacacccgctgctttgactccacagtaaccga

SEQ ID NO: 114610 - DNA, 75 bp, Artificial Sequence
  Synthetic
gaatggatgccaattgggctaaagtcatcgctgtcctactcctttttgctggagtagaggggaccaccaccattg

SEQ ID NO: 114611 - DNA, 75 bp, Artificial Sequence
  Synthetic
gaatggatgccaattgggctaaagtcatcgctgtcctactcctttttgctggagttgaggggaccaccaccattg

SEQ ID NO: 114612 - DNA, 75 bp, Artificial Sequence
  Synthetic
gaatggatgccaattgggctaaagtcatcgctgtcctactcctttttgctggagtcgaggggaccaccaccattg

SEQ ID NO: 114613 - DNA, 75 bp, Artificial Sequence
  Synthetic
gaatggatgccaattgggctaaagtcatcgctgtcctactcctttttgctggagtggaggggaccaccaccattg

SEQ ID NO: 114614 - DNA, 75 bp, Artificial Sequence
  Synthetic
gaatggttgccaattgggctaaagtcatcgctgtcctactcctttttgctggagtagaggggaccaccaccattg

SEQ ID NO: 114615 - DNA, 75 bp, Artificial Sequence
  Synthetic
gaatggttgccaattgggctaaagtcatcgctgtcctactcctttttgctggagttgaggggaccaccaccattg

SEQ ID NO: 114616 - DNA, 75 bp, Artificial Sequence
  Synthetic
gaatggttgccaattgggctaaagtcatcgctgtcctactcctttttgctggagtcgaggggaccaccaccattg

SEQ ID NO: 114617 - DNA, 75 bp, Artificial Sequence
  Synthetic
gaatggttgccaattgggctaaagtcatcgctgtcctactcctttttgctggagtggaggggaccaccaccattg

SEQ ID NO: 114618 - DNA, 75 bp, Artificial Sequence
  Synthetic
gaatggctgccaattgggctaaagtcatcgctgtcctactcctttttgctggagtagaggggaccaccaccattg

SEQ ID NO: 114619 - DNA, 75 bp, Artificial Sequence
  Synthetic
gaatggctgccaattgggctaaagtcatcgctgtcctactcctttttgctggagttgaggggaccaccaccattg

SEQ ID NO: 114620 - DNA, 75 bp, Artificial Sequence
  Synthetic
gaatggctgccaattgggctaaagtcatcgctgtcctactcctttttgctggagtcgaggggaccaccaccattg

SEQ ID NO: 114621 - DNA, 75 bp, Artificial Sequence
  Synthetic
gaatggctgccaattgggctaaagtcatcgctgtcctactcctttttgctggagtggaggggaccaccaccattg

SEQ ID NO: 114622 - DNA, 75 bp, Artificial Sequence
  Synthetic
gaatgggtgccaattgggctaaagtcatcgctgtcctactcctttttgctggagtagaggggaccaccaccattg

SEQ ID NO: 114623 - DNA, 75 bp, Artificial Sequence
  Synthetic
gaatgggtgccaattgggctaaagtcatcgctgtcctactcctttttgctggagttgaggggaccaccaccattg

SEQ ID NO: 114624 - DNA, 75 bp, Artificial Sequence
  Synthetic
gaatgggtgccaattgggctaaagtcatcgctgtcctactcctttttgctggagtcgaggggaccaccaccattg

SEQ ID NO: 114625 - DNA, 75 bp, Artificial Sequence
  Synthetic
gaatgggtgccaattgggctaaagtcatcgctgtcctactcctttttgctggagtggaggggaccaccaccattg

SEQ ID NO: 114626 - DNA, 75 bp, Artificial Sequence
  Synthetic
gtatggatgccaattgggctaaagtcatcgctgtcctactcctttttgctggagtagaggggaccaccaccattg

SEQ ID NO: 114627 - DNA, 75 bp, Artificial Sequence
  Synthetic
gtatggatgccaattgggctaaagtcatcgctgtcctactcctttttgctggagttgaggggaccaccaccattg

SEQ ID NO: 114628 - DNA, 75 bp, Artificial Sequence
  Synthetic
gtatggatgccaattgggctaaagtcatcgctgtcctactcctttttgctggagtcgaggggaccaccaccattg

SEQ ID NO: 114629 - DNA, 75 bp, Artificial Sequence
  Synthetic
gtatggatgccaattgggctaaagtcatcgctgtcctactcctttttgctggagtggaggggaccaccaccattg

SEQ ID NO: 114630 - DNA, 75 bp, Artificial Sequence
  Synthetic
gtatggttgccaattgggctaaagtcatcgctgtcctactcctttttgctggagtagaggggaccaccaccattg

SEQ ID NO: 114631 - DNA, 75 bp, Artificial Sequence
  Synthetic
gtatggttgccaattgggctaaagtcatcgctgtcctactcctttttgctggagttgaggggaccaccaccattg

SEQ ID NO: 114632 - DNA, 75 bp, Artificial Sequence
  Synthetic
gtatggttgccaattgggctaaagtcatcgctgtcctactcctttttgctggagtcgaggggaccaccaccattg

SEQ ID NO: 114633 - DNA, 75 bp, Artificial Sequence
  Synthetic
gtatggttgccaattgggctaaagtcatcgctgtcctactcctttttgctggagtggaggggaccaccaccattg

SEQ ID NO: 114634 - DNA, 75 bp, Artificial Sequence
  Synthetic
gtatggctgccaattgggctaaagtcatcgctgtcctactcctttttgctggagtagaggggaccaccaccattg

SEQ ID NO: 114635 - DNA, 75 bp, Artificial Sequence
  Synthetic
gtatggctgccaattgggctaaagtcatcgctgtcctactcctttttgctggagttgaggggaccaccaccattg

SEQ ID NO: 114636 - DNA, 75 bp, Artificial Sequence
  Synthetic
gtatggctgccaattgggctaaagtcatcgctgtcctactcctttttgctggagtcgaggggaccaccaccattg

SEQ ID NO: 114637 - DNA, 75 bp, Artificial Sequence
  Synthetic
gtatggctgccaattgggctaaagtcatcgctgtcctactcctttttgctggagtggaggggaccaccaccattg

SEQ ID NO: 114638 - DNA, 75 bp, Artificial Sequence
  Synthetic
gtatgggtgccaattgggctaaagtcatcgctgtcctactcctttttgctggagtagaggggaccaccaccattg

SEQ ID NO: 114639 - DNA, 75 bp, Artificial Sequence
  Synthetic
gtatgggtgccaattgggctaaagtcatcgctgtcctactcctttttgctggagttgaggggaccaccaccattg

SEQ ID NO: 114640 - DNA, 75 bp, Artificial Sequence
  Synthetic
gtatgggtgccaattgggctaaagtcatcgctgtcctactcctttttgctggagtcgaggggaccaccaccattg

SEQ ID NO: 114641 - DNA, 75 bp, Artificial Sequence
  Synthetic
gtatgggtgccaattgggctaaagtcatcgctgtcctactcctttttgctggagtggaggggaccaccaccattg

SEQ ID NO: 114642 - DNA, 75 bp, Artificial Sequence
  Synthetic
gcatggatgccaattgggctaaagtcatcgctgtcctactcctttttgctggagtagaggggaccaccaccattg

SEQ ID NO: 114643 - DNA, 75 bp, Artificial Sequence
  Synthetic
gcatggatgccaattgggctaaagtcatcgctgtcctactcctttttgctggagttgaggggaccaccaccattg

SEQ ID NO: 114644 - DNA, 75 bp, Artificial Sequence
  Synthetic
gcatggatgccaattgggctaaagtcatcgctgtcctactcctttttgctggagtcgaggggaccaccaccattg

SEQ ID NO: 114645 - DNA, 75 bp, Artificial Sequence
  Synthetic
gcatggatgccaattgggctaaagtcatcgctgtcctactcctttttgctggagtggaggggaccaccaccattg

SEQ ID NO: 114646 - DNA, 75 bp, Artificial Sequence
  Synthetic
gcatggttgccaattgggctaaagtcatcgctgtcctactcctttttgctggagtagaggggaccaccaccattg

SEQ ID NO: 114647 - DNA, 75 bp, Artificial Sequence
  Synthetic
gcatggttgccaattgggctaaagtcatcgctgtcctactcctttttgctggagttgaggggaccaccaccattg

SEQ ID NO: 114648 - DNA, 75 bp, Artificial Sequence
  Synthetic
gcatggttgccaattgggctaaagtcatcgctgtcctactcctttttgctggagtcgaggggaccaccaccattg

SEQ ID NO: 114649 - DNA, 75 bp, Artificial Sequence
  Synthetic
gcatggttgccaattgggctaaagtcatcgctgtcctactcctttttgctggagtggaggggaccaccaccattg

SEQ ID NO: 114650 - DNA, 75 bp, Artificial Sequence
  Synthetic
gcatggctgccaattgggctaaagtcatcgctgtcctactcctttttgctggagtagaggggaccaccaccattg

SEQ ID NO: 114651 - DNA, 75 bp, Artificial Sequence
  Synthetic
gcatggctgccaattgggctaaagtcatcgctgtcctactcctttttgctggagttgaggggaccaccaccattg

SEQ ID NO: 114652 - DNA, 75 bp, Artificial Sequence
  Synthetic
gcatggctgccaattgggctaaagtcatcgctgtcctactcctttttgctggagtcgaggggaccaccaccattg

SEQ ID NO: 114653 - DNA, 75 bp, Artificial Sequence
  Synthetic
gcatggctgccaattgggctaaagtcatcgctgtcctactcctttttgctggagtggaggggaccaccaccattg

SEQ ID NO: 114654 - DNA, 75 bp, Artificial Sequence
  Synthetic
gcatgggtgccaattgggctaaagtcatcgctgtcctactcctttttgctggagtagaggggaccaccaccattg

SEQ ID NO: 114655 - DNA, 75 bp, Artificial Sequence
  Synthetic
gcatgggtgccaattgggctaaagtcatcgctgtcctactcctttttgctggagttgaggggaccaccaccattg

SEQ ID NO: 114656 - DNA, 75 bp, Artificial Sequence
  Synthetic
gcatgggtgccaattgggctaaagtcatcgctgtcctactcctttttgctggagtcgaggggaccaccaccattg

SEQ ID NO: 114657 - DNA, 75 bp, Artificial Sequence
  Synthetic
gcatgggtgccaattgggctaaagtcatcgctgtcctactcctttttgctggagtggaggggaccaccaccattg

SEQ ID NO: 114658 - DNA, 75 bp, Artificial Sequence
  Synthetic
ggatggatgccaattgggctaaagtcatcgctgtcctactcctttttgctggagtagaggggaccaccaccattg

SEQ ID NO: 114659 - DNA, 75 bp, Artificial Sequence
  Synthetic
ggatggatgccaattgggctaaagtcatcgctgtcctactcctttttgctggagttgaggggaccaccaccattg

SEQ ID NO: 114660 - DNA, 75 bp, Artificial Sequence
  Synthetic
ggatggatgccaattgggctaaagtcatcgctgtcctactcctttttgctggagtcgaggggaccaccaccattg

SEQ ID NO: 114661 - DNA, 75 bp, Artificial Sequence
  Synthetic
ggatggatgccaattgggctaaagtcatcgctgtcctactcctttttgctggagtggaggggaccaccaccattg

SEQ ID NO: 114662 - DNA, 75 bp, Artificial Sequence
  Synthetic
ggatggttgccaattgggctaaagtcatcgctgtcctactcctttttgctggagtagaggggaccaccaccattg

SEQ ID NO: 114663 - DNA, 75 bp, Artificial Sequence
  Synthetic
ggatggttgccaattgggctaaagtcatcgctgtcctactcctttttgctggagttgaggggaccaccaccattg

SEQ ID NO: 114664 - DNA, 75 bp, Artificial Sequence
  Synthetic
ggatggttgccaattgggctaaagtcatcgctgtcctactcctttttgctggagtcgaggggaccaccaccattg

SEQ ID NO: 114665 - DNA, 75 bp, Artificial Sequence
  Synthetic
ggatggttgccaattgggctaaagtcatcgctgtcctactcctttttgctggagtggaggggaccaccaccattg

SEQ ID NO: 114666 - DNA, 75 bp, Artificial Sequence
  Synthetic
ggatggctgccaattgggctaaagtcatcgctgtcctactcctttttgctggagtagaggggaccaccaccattg

SEQ ID NO: 114667 - DNA, 75 bp, Artificial Sequence
  Synthetic
ggatggctgccaattgggctaaagtcatcgctgtcctactcctttttgctggagttgaggggaccaccaccattg

SEQ ID NO: 114668 - DNA, 75 bp, Artificial Sequence
  Synthetic
ggatggctgccaattgggctaaagtcatcgctgtcctactcctttttgctggagtcgaggggaccaccaccattg

SEQ ID NO: 114669 - DNA, 75 bp, Artificial Sequence
  Synthetic
ggatggctgccaattgggctaaagtcatcgctgtcctactcctttttgctggagtggaggggaccaccaccattg

SEQ ID NO: 114670 - DNA, 75 bp, Artificial Sequence
  Synthetic
ggatgggtgccaattgggctaaagtcatcgctgtcctactcctttttgctggagtagaggggaccaccaccattg

SEQ ID NO: 114671 - DNA, 75 bp, Artificial Sequence
  Synthetic
ggatgggtgccaattgggctaaagtcatcgctgtcctactcctttttgctggagttgaggggaccaccaccattg

SEQ ID NO: 114672 - DNA, 75 bp, Artificial Sequence
  Synthetic
ggatgggtgccaattgggctaaagtcatcgctgtcctactcctttttgctggagtcgaggggaccaccaccattg

SEQ ID NO: 114673 - DNA, 75 bp, Artificial Sequence
  Synthetic
ggatgggtgccaattgggctaaagtcatcgctgtcctactcctttttgctggagtggaggggaccaccaccattg

SEQ ID NO: 114674 - DNA, 75 bp, Artificial Sequence
  Synthetic
tcatcccgacgcagagctgatagaagctaatctcctgtggaggcaggaggcgggtggcaacatcacaagggtcga

SEQ ID NO: 114675 - DNA, 75 bp, Artificial Sequence
  Synthetic
cttcatcagcggcatccaataccttgctggactctccacgctaccgggaaatcccgctgtggcgacgatgatggc

SEQ ID NO: 114676 - DNA, 75 bp, Artificial Sequence
  Synthetic
gtcaccggccaccgaatggcatgggacatgatgatgaattggtcacccacgacagctttgctgatggcccagttg

SEQ ID NO: 114677 - DNA, 75 bp, Artificial Sequence
  Synthetic
cgcaaagctgtcaggcctcggaatcaatgctgtagcgtattaccggggtcttgacgtgtccgtcataccaacaag

SEQ ID NO: 114678 - DNA, 75 bp, Artificial Sequence
  Synthetic
gccactggcttcgtcgtcagtggcctggtgggggctgctgtaggtagcataggcctaggcaagatattggtggac

SEQ ID NO: 114679 - DNA, 75 bp, Artificial Sequence
  Synthetic
ggccccatgtataacagcaagggggacctctgcggttaccgtagatgccgtgcaagcggcgtctacactaccagc

SEQ ID NO: 114680 - DNA, 75 bp, Artificial Sequence
  Synthetic
ggccccatgtataacagcatgggggacctctgcggttaccgtagatgccgtgcaagcggcgtctacactaccagc

SEQ ID NO: 114681 - DNA, 75 bp, Artificial Sequence
  Synthetic
ggccccatgtataacagcacgggggacctctgcggttaccgtagatgccgtgcaagcggcgtctacactaccagc

SEQ ID NO: 114682 - DNA, 75 bp, Artificial Sequence
  Synthetic
ggccccatgtataacagcaggggggacctctgcggttaccgtagatgccgtgcaagcggcgtctacactaccagc

SEQ ID NO: 114683 - DNA, 75 bp, Artificial Sequence
  Synthetic
ttgcgctagtcttgttcctgtttgcgggggttgatgccaccaccgtgatttcgggcggtaccgccgctcagacta

SEQ ID NO: 114684 - DNA, 75 bp, Artificial Sequence
  Synthetic
aaataggacagcactcaattgcaatgacaccctccacactggcttccttgccggcctgttcgctcaccacaggtt

SEQ ID NO: 114685 - DNA, 75 bp, Artificial Sequence
  Synthetic
aaataggactgcactcaattgcaatgacaccctccacactggcttccttgccggcctgttcgctcaccacaggtt

SEQ ID NO: 114686 - DNA, 75 bp, Artificial Sequence
  Synthetic
aaataggaccgcactcaattgcaatgacaccctccacactggcttccttgccggcctgttcgctcaccacaggtt

SEQ ID NO: 114687 - DNA, 75 bp, Artificial Sequence
  Synthetic
aaataggacggcactcaattgcaatgacaccctccacactggcttccttgccggcctgttcgctcaccacaggtt

SEQ ID NO: 114688 - DNA, 75 bp, Artificial Sequence
  Synthetic
taataggacagcactcaattgcaatgacaccctccacactggcttccttgccggcctgttcgctcaccacaggtt

SEQ ID NO: 114689 - DNA, 75 bp, Artificial Sequence
  Synthetic
taataggactgcactcaattgcaatgacaccctccacactggcttccttgccggcctgttcgctcaccacaggtt

SEQ ID NO: 114690 - DNA, 75 bp, Artificial Sequence
  Synthetic
taataggaccgcactcaattgcaatgacaccctccacactggcttccttgccggcctgttcgctcaccacaggtt

SEQ ID NO: 114691 - DNA, 75 bp, Artificial Sequence
  Synthetic
taataggacggcactcaattgcaatgacaccctccacactggcttccttgccggcctgttcgctcaccacaggtt

SEQ ID NO: 114692 - DNA, 75 bp, Artificial Sequence
  Synthetic
caataggacagcactcaattgcaatgacaccctccacactggcttccttgccggcctgttcgctcaccacaggtt

SEQ ID NO: 114693 - DNA, 75 bp, Artificial Sequence
  Synthetic
caataggactgcactcaattgcaatgacaccctccacactggcttccttgccggcctgttcgctcaccacaggtt

SEQ ID NO: 114694 - DNA, 75 bp, Artificial Sequence
  Synthetic
caataggaccgcactcaattgcaatgacaccctccacactggcttccttgccggcctgttcgctcaccacaggtt

SEQ ID NO: 114695 - DNA, 75 bp, Artificial Sequence
  Synthetic
caataggacggcactcaattgcaatgacaccctccacactggcttccttgccggcctgttcgctcaccacaggtt

SEQ ID NO: 114696 - DNA, 75 bp, Artificial Sequence
  Synthetic
gaataggacagcactcaattgcaatgacaccctccacactggcttccttgccggcctgttcgctcaccacaggtt

SEQ ID NO: 114697 - DNA, 75 bp, Artificial Sequence
  Synthetic
gaataggactgcactcaattgcaatgacaccctccacactggcttccttgccggcctgttcgctcaccacaggtt

SEQ ID NO: 114698 - DNA, 75 bp, Artificial Sequence
  Synthetic
gaataggaccgcactcaattgcaatgacaccctccacactggcttccttgccggcctgttcgctcaccacaggtt

SEQ ID NO: 114699 - DNA, 75 bp, Artificial Sequence
  Synthetic
gaataggacggcactcaattgcaatgacaccctccacactggcttccttgccggcctgttcgctcaccacaggtt

SEQ ID NO: 114700 - DNA, 75 bp, Artificial Sequence
  Synthetic
tctcgggagccctcgtcgccttcaaaatcatgtccggcgagaagccttcagtagaggatatggtcaacttgctgc

SEQ ID NO: 114701 - DNA, 75 bp, Artificial Sequence
  Synthetic
caggggtcgtttcgtcccagcagtcacatacgggctcttgcagatatggccgctactattgcttgtcttggccct

SEQ ID NO: 114702 - DNA, 75 bp, Artificial Sequence
  Synthetic
aggccaaaattcccgcccgcgctccccatatgggcgagacccgactataacccacctttactggagacttggaaa

SEQ ID NO: 114703 - DNA, 75 bp, Artificial Sequence
  Synthetic
caatgacagccttcatactgggtttttagccggtctcttttatgcccacaggttcaactcctccgggtgtccaga

SEQ ID NO: 114704 - DNA, 75 bp, Artificial Sequence
  Synthetic
tcctctgacaaaccctactgctggcactatccacctagaccttgcgaggttgttccagcgagaaatgtttgtggc

SEQ ID NO: 114705 - DNA, 75 bp, Artificial Sequence
  Synthetic
gggtgcccattgccacctaccaaggcccctccaataccacctccacggaggaagaggacggttgtcctaacagaa

SEQ ID NO: 114706 - DNA, 75 bp, Artificial Sequence
  Synthetic
cgaatgcttgtgttgtcagtttggtggatccagtacttcatagctcgggcagaggctgctctgcaagtgtgggtt

SEQ ID NO: 114707 - DNA, 75 bp, Artificial Sequence
  Synthetic
aggaggaagaaggttgtgaggcttaacgagtcctcagtttcaactgcacttgcagagctagctcgcaagtcattt

SEQ ID NO: 114708 - DNA, 75 bp, Artificial Sequence
  Synthetic
aggaggaagaaggttgtgaggcttaacgagtcctcagtttcaactgcacttgcagagcttgctcgcaagtcattt

SEQ ID NO: 114709 - DNA, 75 bp, Artificial Sequence
  Synthetic
aggaggaagaaggttgtgaggcttaacgagtcctcagtttcaactgcacttgcagagctcgctcgcaagtcattt

SEQ ID NO: 114710 - DNA, 75 bp, Artificial Sequence
  Synthetic
aggaggaagaaggttgtgaggcttaacgagtcctcagtttcaactgcacttgcagagctggctcgcaagtcattt

SEQ ID NO: 114711 - DNA, 75 bp, Artificial Sequence
  Synthetic
attctgcgccgacacgtgggacaaggggaaggcgcggtccaatggatgaacaggctcatcgcctttgcgtccaga

SEQ ID NO: 114712 - DNA, 75 bp, Artificial Sequence
  Synthetic
cggcgactttgactcagtgatagactgcaatacatctgtgatacagactgttgacttcagcttggaccccacctt

SEQ ID NO: 114713 - DNA, 75 bp, Artificial Sequence
  Synthetic
ggctccatcactggatcagcgaagactaccctgtcccatgcgccgggtcttggctttgggacgtgtgggactggg

SEQ ID NO: 114714 - DNA, 75 bp, Artificial Sequence
  Synthetic
tggcactatcccccacgaccgtgcggggtggtgccagcccgaaatgtctgcggtccagtctactgtttcacaccc

SEQ ID NO: 114715 - DNA, 75 bp, Artificial Sequence
  Synthetic
tgctgcaaactaccagaccccctggtggggggtggttcgggtgcacctggatgaactccacggggttcgtcaaaa

SEQ ID NO: 114716 - DNA, 75 bp, Artificial Sequence
  Synthetic
gacatcaccaaggtgctgttagcccttttggggcccctttacttggtgcaggcgagcttgctgcatgtgccttat

SEQ ID NO: 114717 - DNA, 75 bp, Artificial Sequence
  Synthetic
gacatcaccaaggtgctgtttgcccttttggggcccctttacttggtgcaggcgagcttgctgcatgtgccttat

SEQ ID NO: 114718 - DNA, 75 bp, Artificial Sequence
  Synthetic
gacatcaccaaggtgctgttcgcccttttggggcccctttacttggtgcaggcgagcttgctgcatgtgccttat

SEQ ID NO: 114719 - DNA, 75 bp, Artificial Sequence
  Synthetic
gacatcaccaaggtgctgttggcccttttggggcccctttacttggtgcaggcgagcttgctgcatgtgccttat

SEQ ID NO: 114720 - DNA, 75 bp, Artificial Sequence
  Synthetic
tttgctccattctgacagacttcaaaaactggctgtcctccaagttgttcccgaaaatgcctggcctccccttcg

SEQ ID NO: 114721 - DNA, 75 bp, Artificial Sequence
  Synthetic
tcctggacgggagctcttgtaacaccttgcgctgcggaggaggagaaactgcccatcagtcccctgagcaactct

SEQ ID NO: 114722 - DNA, 75 bp, Artificial Sequence
  Synthetic
tcctggacgggagctcttgttacaccttgcgctgcggaggaggagaaactgcccatcagtcccctgagcaactct

SEQ ID NO: 114723 - DNA, 75 bp, Artificial Sequence
  Synthetic
tcctggacgggagctcttgtcacaccttgcgctgcggaggaggagaaactgcccatcagtcccctgagcaactct

SEQ ID NO: 114724 - DNA, 75 bp, Artificial Sequence
  Synthetic
tcctggacgggagctcttgtgacaccttgcgctgcggaggaggagaaactgcccatcagtcccctgagcaactct

SEQ ID NO: 114725 - DNA, 75 bp, Artificial Sequence
  Synthetic
atgaactccacggggttcgtcaaaacctgcggtgctcccccctgcaaaacccggccggacaccaagaacaataat

SEQ ID NO: 114726 - DNA, 75 bp, Artificial Sequence
  Synthetic
caaggctgagagcttacttcaacacaccaggccttcctgtgtgccaagaccacctggagttctgggagagcgtct

SEQ ID NO: 114727 - DNA, 75 bp, Artificial Sequence
  Synthetic
ttacgctgcacggatactctccgcacgaactcaatcgggtggcaggaagcctcaggaaacttggggtacccccgt

SEQ ID NO: 114728 - DNA, 75 bp, Artificial Sequence
  Synthetic
ccttccccatcaactgctacacggagagccagtgcgtgccaaaacctgcgcctaacttcaagaccgccgtttgga

SEQ ID NO: 114729 - DNA, 75 bp, Artificial Sequence
  Synthetic
gatggagaagaaggtcatcacctggggagccgacactgcggcttgcggtgacatactgcagggcttgcccgtctc

SEQ ID NO: 114730 - DNA, 75 bp, Artificial Sequence
  Synthetic
cacccctcggtgtttggtgcattacccttaccggctgtggcactacccgtgcaccgtaaattacaccatttttaa

SEQ ID NO: 114731 - DNA, 75 bp, Artificial Sequence
  Synthetic
tacggagttgtccatcttaccctgttcttttacaactatgcctgcactatccaccgggctgatccatctccatca

SEQ ID NO: 114732 - DNA, 75 bp, Artificial Sequence
  Synthetic
cagagctatggcgccccctccaagttgggacaccatgtggaagtgcctaatccgcctcaagcctaccctgcacgg

SEQ ID NO: 114733 - DNA, 75 bp, Artificial Sequence
  Synthetic
atctcctgaattcttctcctgggtggacggtgtgcagatccacagatttgctcctactcccaaaccgttcatcag

SEQ ID NO: 114734 - DNA, 75 bp, Artificial Sequence
  Synthetic
cgcggcctacttgggacaatcgtcaccagtctcacaggtcgtgacaaaaatgaggtcgagggcgagatacaaata

SEQ ID NO: 114735 - DNA, 75 bp, Artificial Sequence
  Synthetic
ctgagcccactcttacacaccaccacacagtgggccatattgccgtgctctttcacacccacgcctgctcttagc

SEQ ID NO: 114736 - DNA, 75 bp, Artificial Sequence
  Synthetic
cacagtgggccatattgccgtgctctttcacacccacgcctgctcttagcactggcctcatacacttacatcaga

SEQ ID NO: 114737 - DNA, 75 bp, Artificial Sequence
  Synthetic
gacgcacgagtctgtgcatgcttgtggttaatgtttctggttggccaggcagaggcggcgttggacaaactcatc

SEQ ID NO: 114738 - DNA, 75 bp, Artificial Sequence
  Synthetic
ctgacctgggggtgagggtctgcgagaagaaggcgttatatgacatcacatgtaagctgcccgaagcagtaatgg

SEQ ID NO: 114739 - DNA, 75 bp, Artificial Sequence
  Synthetic
ctcgttaacagcaacgggagctggcacatcaacaggactgctcttaactgtaatgacagtttaaatactgggttc

SEQ ID NO: 114740 - DNA, 75 bp, Artificial Sequence
  Synthetic
acagacccatctcatatcacggctgaggcggcagcaaggcggttggcacgaggctcacccccatcagaagctagt

SEQ ID NO: 114741 - DNA, 75 bp, Artificial Sequence
  Synthetic
gccccatttgccaaatgtacaccaatgtggaccaggacatggtggggtggccagcacccccaggcgccagatcgc

SEQ ID NO: 114742 - DNA, 75 bp, Artificial Sequence
  Synthetic
cacttggggtcgctaacatcagcggcccatctgacgacaggccttattgctggcactacccgcctcgaccatgcg

SEQ ID NO: 114743 - DNA, 75 bp, Artificial Sequence
  Synthetic
ggttttggggcgtatatgtctaaggcacatggtgtcgaccccaacatcagaactggggtaaggaccatcaccacg

SEQ ID NO: 114744 - DNA, 75 bp, Artificial Sequence
  Synthetic
ctacttatgccatactacagatgtggcctctcctcttgctggtattggctctgccacgcagagcatacgccagta

SEQ ID NO: 114745 - DNA, 75 bp, Artificial Sequence
  Synthetic
tgggccgttaagtgggaatatatagtactggcctttttactgcttgctgatgcccgtatttgcacttgcctatgg

SEQ ID NO: 114746 - DNA, 75 bp, Artificial Sequence
  Synthetic
gcccaagcagcgggtagaccacctcctcaagatgtggcgctcaaagcacaaccccatggggttctcatatgacac

SEQ ID NO: 114747 - DNA, 75 bp, Artificial Sequence
  Synthetic
gcccaagcagcgggtagaccacctcctcaagatgtggcgctctaagcacaaccccatggggttctcatatgacac

SEQ ID NO: 114748 - DNA, 75 bp, Artificial Sequence
  Synthetic
gcccaagcagcgggtagaccacctcctcaagatgtggcgctccaagcacaaccccatggggttctcatatgacac

SEQ ID NO: 114749 - DNA, 75 bp, Artificial Sequence
  Synthetic
gcccaagcagcgggtagaccacctcctcaagatgtggcgctcgaagcacaaccccatggggttctcatatgacac

SEQ ID NO: 114750 - DNA, 75 bp, Artificial Sequence
  Synthetic
ggggcgcggtcactcgggtggagtctgagtccaaggtgatcatgctagactccctcgactcgatggtcgaggagg

SEQ ID NO: 114751 - DNA, 75 bp, Artificial Sequence
  Synthetic
cgatctctatttggtcaccaggaatgcggacgtcatccccgcaaggcgcaggggggacacccgcgccggactcct

SEQ ID NO: 114752 - DNA, 75 bp, Artificial Sequence
  Synthetic
tccctgactgagcggctgtactgcggtgggcccatgatgaactctcgtggccaatcatgcggataccgtagatgc

SEQ ID NO: 114753 - DNA, 75 bp, Artificial Sequence
  Synthetic
ctgccacgcagagcatacgccagtaacggcgaggaggctgcgtctttaggcttgttggtaattgccatcatcacc

SEQ ID NO: 114754 - DNA, 75 bp, Artificial Sequence
  Synthetic
ccaaacaccttccactagtcgagcatgggttacaactggctgagcagttcaagcagaaggccgtaggccttctaa

SEQ ID NO: 114755 - DNA, 75 bp, Artificial Sequence
  Synthetic
tccaccttgcctggcaatccggctattgcttccctcatgtccttcactgccgccgttacaagccccctgaccact

SEQ ID NO: 114756 - DNA, 75 bp, Artificial Sequence
  Synthetic
tcaagcgatggcgggactgtgggttgtctcgtgttaattatccttacaatctttacacttacccctgggtacaag

SEQ ID NO: 114757 - DNA, 75 bp, Artificial Sequence
  Synthetic
tactacgccactaatgattgctcgaacagcagcatcacctggcagctcaccaacgcagttctccatcttcccgga

SEQ ID NO: 114758 - DNA, 75 bp, Artificial Sequence
  Synthetic
gtgcagtggatgaaccggctgatagcgttcgcttcacggggcaaccacgtttcccccacgcactatgtgcctgag

SEQ ID NO: 114759 - DNA, 75 bp, Artificial Sequence
  Synthetic
atttcgtgcgagctcacatccttttgcgtgcttgcatgtttctccgtggtgtaatgggcgggaagtaccttcagg

SEQ ID NO: 114760 - DNA, 75 bp, Artificial Sequence
  Synthetic
cggcagttggcagtgtgggccttggcaagattctggtggacattctcgccggttacggcgccggcgtagctggcg

SEQ ID NO: 114761 - DNA, 75 bp, Artificial Sequence
  Synthetic
gcatgccccaacgggcagcgggaagagtacaaaggtaccggcagcatacgctagccagggttacaaggtgttggt

SEQ ID NO: 114762 - DNA, 75 bp, Artificial Sequence
  Synthetic
aggcggcgcgccgtagtattggaccagagcactgtgggggaagcttttagagagctggccattaagagctttggc

SEQ ID NO: 114763 - DNA, 75 bp, Artificial Sequence
  Synthetic
cattcacggaagctatgaccaggtactcagctcccccaggggacgaaccgcacccggaatacgacttggagctaa

SEQ ID NO: 114764 - DNA, 75 bp, Artificial Sequence
  Synthetic
tactgggccctttgtacctgctgcaacattcactcatcaaggtgccttactttgtcagggcgcgcgccctgctga

SEQ ID NO: 114765 - DNA, 75 bp, Artificial Sequence
  Synthetic
gttccacgagctccatgccccccctcgagggggagcctggagacccagacttagagccgggaccggttgagcaag

SEQ ID NO: 114766 - DNA, 75 bp, Artificial Sequence
  Synthetic
ggttacggcgccggcgtagctggcgccgtggtcaccttcaaaatcatgagcggcgagatgccatccacagaggac

SEQ ID NO: 114767 - DNA, 75 bp, Artificial Sequence
  Synthetic
cctcttccatcctgccctggggtttgagatcacaaaaatcctcctcgggatactgggccctttgtacctgctgca

SEQ ID NO: 114768 - DNA, 75 bp, Artificial Sequence
  Synthetic
catgctccggctcgtggctgagggatgtttgggactggatatgcacggtgttgagtgacttcaagacctggctcc

SEQ ID NO: 114769 - DNA, 75 bp, Artificial Sequence
  Synthetic
tgcgttcgcatcgcgaggcaatcacgtgtctcccacgcactacgtccctgagtctgacgcagcagctcgcgtgac

SEQ ID NO: 114770 - DNA, 75 bp, Artificial Sequence
  Synthetic
tcttagcgacagctactcctcctggatcagtcacggtgccgcatcctaacatctcggaagtcgccctacctacta

SEQ ID NO: 114771 - DNA, 75 bp, Artificial Sequence
  Synthetic
tcttagcgactgctactcctcctggatcagtcacggtgccgcatcctaacatctcggaagtcgccctacctacta

SEQ ID NO: 114772 - DNA, 75 bp, Artificial Sequence
  Synthetic
tcttagcgaccgctactcctcctggatcagtcacggtgccgcatcctaacatctcggaagtcgccctacctacta

SEQ ID NO: 114773 - DNA, 75 bp, Artificial Sequence
  Synthetic
tcttagcgacggctactcctcctggatcagtcacggtgccgcatcctaacatctcggaagtcgccctacctacta

SEQ ID NO: 114774 - DNA, 75 bp, Artificial Sequence
  Synthetic
gtactcctggactggggccttaataaccccctgcagtccggaggaggaaaagttgcctattaacccgcttagcaa

SEQ ID NO: 114775 - DNA, 75 bp, Artificial Sequence
  Synthetic
tgcccccatgaaggattgggcagcgtccgggctgcgcgacttagcggtggccacggagcccattatattctccgc

SEQ ID NO: 114776 - DNA, 75 bp, Artificial Sequence
  Synthetic
agttgcctattaacccgcttagcaattcattgctgcggtaccacaacaaggtgtactgtactacatcaaagagcg

SEQ ID NO: 114777 - DNA, 75 bp, Artificial Sequence
  Synthetic
gggaatccccctcgagtacatcaagggcggcaggcacctcattttctgccactcaaagaagaagtgcgacgagct

SEQ ID NO: 114778 - DNA, 75 bp, Artificial Sequence
  Synthetic
ttccccccacacctcaagcgccagtgcccccacctcggaggcgccgcgccaaagtcctgactcaggacaatgtgg

SEQ ID NO: 114779 - DNA, 75 bp, Artificial Sequence
  Synthetic
agctagacggggccgcgaaattttcctggggccggccgacgacatcaagtcggcgggttggcgacttctcgcccc

SEQ ID NO: 114780 - DNA, 75 bp, Artificial Sequence
  Synthetic
aaatgctgcttcagccgctggcacccacggcttctggtacgccatcttcttcatctgcattgcctggcatgtcaa

SEQ ID NO: 114781 - DNA, 75 bp, Artificial Sequence
  Synthetic
taatgctgcttcagccgctggcacccacggcttctggtacgccatcttcttcatctgcattgcctggcatgtcaa

SEQ ID NO: 114782 - DNA, 75 bp, Artificial Sequence
  Synthetic
caatgctgcttcagccgctggcacccacggcttctggtacgccatcttcttcatctgcattgcctggcatgtcaa

SEQ ID NO: 114783 - DNA, 75 bp, Artificial Sequence
  Synthetic
gaatgctgcttcagccgctggcacccacggcttctggtacgccatcttcttcatctgcattgcctggcatgtcaa

SEQ ID NO: 114784 - DNA, 75 bp, Artificial Sequence
  Synthetic
tatcaccgcgtacgcgcagcagacgcgaggggtgctgggcgctataatcgtcagcctaaccggccgggacaaaaa

SEQ ID NO: 114785 - DNA, 75 bp, Artificial Sequence
  Synthetic
gaggtgtgggattgggtctgcactgtgctgagtgacttcaagacgtggctaaaagccaagctgctacccctcatg

SEQ ID NO: 114786 - DNA, 75 bp, Artificial Sequence
  Synthetic
cagtgccaggcttctctcaatagaagaggcttgtgcattgaccccgccccattctgcacgatccaagtacggatt

SEQ ID NO: 114787 - DNA, 75 bp, Artificial Sequence
  Synthetic
attcaatcaacttaatcaattccaatggcaactggcacataaaccgaaccgccctcaattgcaatgacagcttgc

SEQ ID NO: 114788 - DNA, 75 bp, Artificial Sequence
  Synthetic
gaggtggcagggtcccttggtggcgcggtcgttgttgcgctaactattctgacattgtctccctactacaagtca

SEQ ID NO: 114789 - DNA, 75 bp, Artificial Sequence
  Synthetic
caccagccttaccggccgcgacaagaatgaagtggaaggtgagatccaggtcgtgtctactgctacacagtcttt

SEQ ID NO: 114790 - DNA, 75 bp, Artificial Sequence
  Synthetic
cactcgacatcgtcacgcggtcccccacctttagtgacaacagcacgccaccggctgtgccccagacctatcagg

SEQ ID NO: 114791 - DNA, 75 bp, Artificial Sequence
  Synthetic
tctaagacccttgctggccccaaaggcccagtggtgcaaatgtacaccaatgtggacaaagatctggtgggatgg

SEQ ID NO: 114792 - DNA, 75 bp, Artificial Sequence
  Synthetic
tgcccctgcggagcagagttggcaggccacatcaagaacggctcgatgagaatcactgggccgaaaacttgcagc

SEQ ID NO: 114793 - DNA, 75 bp, Artificial Sequence
  Synthetic
gcagggtgaacgaccgtcaggcacatttgacactgtcgtcctttgcgaagcctacgatgttggctgcgcgtggta

SEQ ID NO: 114794 - DNA, 75 bp, Artificial Sequence
  Synthetic
ggggcgacactcgcgcctccctgctcagcccaagacccattagttacctcaagggctcctcgggcggcccagtca

SEQ ID NO: 114795 - DNA, 75 bp, Artificial Sequence
  Synthetic
gttaggctgcgcgcgtaccttaacactcccgggctgcccgtgtgccaagaccatcttgaattctgggagggggtg

SEQ ID NO: 114796 - DNA, 75 bp, Artificial Sequence
  Synthetic
cagacaactcttcccccccagcagtaccacaaacataccaagtggggtaccttcatgcccctacgggtagtggta

SEQ ID NO: 114797 - DNA, 75 bp, Artificial Sequence
  Synthetic
cagacaactcttcccccccagcagtaccacaaacataccaagtggggtaccttcatgcccctacgggtagtggtt

SEQ ID NO: 114798 - DNA, 75 bp, Artificial Sequence
  Synthetic
cagacaactcttcccccccagcagtaccacaaacataccaagtggggtaccttcatgcccctacgggtagtggtc

SEQ ID NO: 114799 - DNA, 75 bp, Artificial Sequence
  Synthetic
cagacaactcttcccccccagcagtaccacaaacataccaagtggggtaccttcatgcccctacgggtagtggtg

SEQ ID NO: 114800 - DNA, 75 bp, Artificial Sequence
  Synthetic
accacaaacataccaagtggggtaccttcatgcccctacgggtagtggtaagagcaccaaagtcccggccgcgta

SEQ ID NO: 114801 - DNA, 75 bp, Artificial Sequence
  Synthetic
accacaaacataccaagtggggtaccttcatgcccctacgggtagtggttagagcaccaaagtcccggccgcgta

SEQ ID NO: 114802 - DNA, 75 bp, Artificial Sequence
  Synthetic
accacaaacataccaagtggggtaccttcatgcccctacgggtagtggtcagagcaccaaagtcccggccgcgta

SEQ ID NO: 114803 - DNA, 75 bp, Artificial Sequence
  Synthetic
accacaaacataccaagtggggtaccttcatgcccctacgggtagtggtgagagcaccaaagtcccggccgcgta

SEQ ID NO: 114804 - DNA, 75 bp, Artificial Sequence
  Synthetic
ttcctgaggaggcccggactgccatacactcactaactgagaggctatacgtgggaggtcccatgcaaaacagca

SEQ ID NO: 114805 - DNA, 75 bp, Artificial Sequence
  Synthetic
cggcccaggggtacaaggtgctggtgctaaacccgtccgtcgcagcgacgctcgggttcggggcatacatgtcaa

SEQ ID NO: 114806 - DNA, 75 bp, Artificial Sequence
  Synthetic
tcatgacctgcatgtcagctgacctcgaagtgatcactagcgcctgggtgctcacggggggaatacttgctgcgt

SEQ ID NO: 114807 - DNA, 75 bp, Artificial Sequence
  Synthetic
tcatgacctgcatgtcagctgacctcgaagtgatcactagcgcctgggtgctcacggggggaattcttgctgcgt

SEQ ID NO: 114808 - DNA, 75 bp, Artificial Sequence
  Synthetic
tcatgacctgcatgtcagctgacctcgaagtgatcactagcgcctgggtgctcacggggggaatccttgctgcgt

SEQ ID NO: 114809 - DNA, 75 bp, Artificial Sequence
  Synthetic
tcatgacctgcatgtcagctgacctcgaagtgatcactagcgcctgggtgctcacggggggaatgcttgctgcgt

SEQ ID NO: 114810 - DNA, 75 bp, Artificial Sequence
  Synthetic
taaggccgcgggcattgtcgcaccaacaatgctggtgtgcggcgacgacctggtcgtcatctcagagagccaggg

SEQ ID NO: 114811 - DNA, 75 bp, Artificial Sequence
  Synthetic
ggtgataatactggactcttttgagccatgtgtggctgaaccagatgatgacagggaggtctcggttgccgcaga

SEQ ID NO: 114812 - DNA, 75 bp, Artificial Sequence
  Synthetic
cagggacagccggggtaaggctcacagtgcttgctacggcaactccccctggttcaattacagtccctcatccaa

SEQ ID NO: 114813 - DNA, 75 bp, Artificial Sequence
  Synthetic
ggggtgctcaggcggcgcgtatgacgtgatcatatgcgacgagtgccattcccaggacgctaccaccattcttgg

SEQ ID NO: 114814 - DNA, 75 bp, Artificial Sequence
  Synthetic
gcagtttgatgagatggaggagtgctcacaccgactcccatacttggttgagggccaacaaattgccgagcaatt

SEQ ID NO: 114815 - DNA, 75 bp, Artificial Sequence
  Synthetic
gcagtttgatgagatggaggagtgctcacaccgactcccttacttggttgagggccaacaaattgccgagcaatt

SEQ ID NO: 114816 - DNA, 75 bp, Artificial Sequence
  Synthetic
gcagtttgatgagatggaggagtgctcacaccgactcccctacttggttgagggccaacaaattgccgagcaatt

SEQ ID NO: 114817 - DNA, 75 bp, Artificial Sequence
  Synthetic
gcagtttgatgagatggaggagtgctcacaccgactcccgtacttggttgagggccaacaaattgccgagcaatt

SEQ ID NO: 114818 - DNA, 75 bp, Artificial Sequence
  Synthetic
gggttctcatatgacacccgctgctttgactcaaccgtcacggagagggacataagaacagaagaatccatatat

SEQ ID NO: 114819 - DNA, 75 bp, Artificial Sequence
  Synthetic
ccctgtcaactcatggctgggaaacatcatccagtacgctccaacgttgtgggtccgcatggtcctgatgacaca

SEQ ID NO: 114820 - DNA, 75 bp, Artificial Sequence
  Synthetic
cagaaacatctgtggaactttgtcagtgggattcaatacctggcaggcctgtcaacgctgcccggtaacccggct

SEQ ID NO: 114821 - DNA, 75 bp, Artificial Sequence
  Synthetic
tctcagaagatccagcttataaataccaatggcagctggcacatcaacaggactgctctgaactgcaatgactcc

SEQ ID NO: 114822 - DNA, 75 bp, Artificial Sequence
  Synthetic
tggattaatgaggactgctccacgccatgctccggctcgtggctaagggatgtttgggactggatatgcacggtg

SEQ ID NO: 114823 - DNA, 75 bp, Artificial Sequence
  Synthetic
gactgtaacgtctcagtcactcaagtcgttgacttcagcctggatcctacattcactatagagaccaccactgtg

SEQ ID NO: 114824 - DNA, 75 bp, Artificial Sequence
  Synthetic
ctgcacttgccggggtgcgtgccctgtgtgagaactgggaacgagtcgcgttgctggacgccggtaacacccaca

SEQ ID NO: 114825 - DNA, 75 bp, Artificial Sequence
  Synthetic
ctgcacttgccggggtgcgtgccctgtgtgagaactgggaacgtgtcgcgttgctggacgccggtaacacccaca

SEQ ID NO: 114826 - DNA, 75 bp, Artificial Sequence
  Synthetic
ctgcacttgccggggtgcgtgccctgtgtgagaactgggaacgcgtcgcgttgctggacgccggtaacacccaca

SEQ ID NO: 114827 - DNA, 75 bp, Artificial Sequence
  Synthetic
ctgcacttgccggggtgcgtgccctgtgtgagaactgggaacgggtcgcgttgctggacgccggtaacacccaca

SEQ ID NO: 114828 - DNA, 75 bp, Artificial Sequence
  Synthetic
tgttctacacacacaggttcaacgactctgggtgcacagagcgtttggccagttgccgctccattgacaagttcg

SEQ ID NO: 114829 - DNA, 75 bp, Artificial Sequence
  Synthetic
ataattgaaaaactccatgggcttgacaccttttcactgcacacatactctccccacgaactcacacgggtggct

SEQ ID NO: 114830 - DNA, 75 bp, Artificial Sequence
  Synthetic
acctctgcggaggtgccttcctagtggggcaggtgttcaccttccagccgcgtcgccattggaccacgcaggatt

SEQ ID NO: 114831 - DNA, 75 bp, Artificial Sequence
  Synthetic
agcaggcttatgccctggataccactgagcaaggagaattagggctggtcttattagtaatcatatccatcttta

SEQ ID NO: 114832 - DNA, 75 bp, Artificial Sequence
  Synthetic
gctgccgtaggcagcatcggattaggccgcgtcatcgtcgacatcttggcgggctacggggcaggagtgtccggt

SEQ ID NO: 114833 - DNA, 75 bp, Artificial Sequence
  Synthetic
gtcaacgctgcccggtaacccggctgtggcctccctaatgtccttctctgcggctctgacaagtcctttagccac

SEQ ID NO: 114834 - DNA, 75 bp, Artificial Sequence
  Synthetic
agctgccaattagccccctgagcaattcactcttacgccatcacaacatggtgtatgccacgaccacccgttctg

SEQ ID NO: 114835 - DNA, 75 bp, Artificial Sequence
  Synthetic
tcgttgacttcagcctggatcctacattcactatagagaccaccactgtgcctcaagatgccgtttcacggagtc

SEQ ID NO: 114836 - DNA, 75 bp, Artificial Sequence
  Synthetic
ggggcaggtgttcaccttccagccgcgtcgccattggaccacgcaggattgaaattgctccatctaaaccggcca

SEQ ID NO: 114837 - DNA, 75 bp, Artificial Sequence
  Synthetic
ggggcaggtgttcaccttccagccgcgtcgccattggaccacgcaggattgaaattgctccatctataccggcca

SEQ ID NO: 114838 - DNA, 75 bp, Artificial Sequence
  Synthetic
ggggcaggtgttcaccttccagccgcgtcgccattggaccacgcaggattgaaattgctccatctacaccggcca

SEQ ID NO: 114839 - DNA, 75 bp, Artificial Sequence
  Synthetic
ggggcaggtgttcaccttccagccgcgtcgccattggaccacgcaggattgaaattgctccatctagaccggcca

SEQ ID NO: 114840 - DNA, 75 bp, Artificial Sequence
  Synthetic
ggggcaggtgttcaccttccagccgcgtcgccattggaccacgcaggattgtaattgctccatctaaaccggcca

SEQ ID NO: 114841 - DNA, 75 bp, Artificial Sequence
  Synthetic
ggggcaggtgttcaccttccagccgcgtcgccattggaccacgcaggattgtaattgctccatctataccggcca

SEQ ID NO: 114842 - DNA, 75 bp, Artificial Sequence
  Synthetic
ggggcaggtgttcaccttccagccgcgtcgccattggaccacgcaggattgtaattgctccatctacaccggcca

SEQ ID NO: 114843 - DNA, 75 bp, Artificial Sequence
  Synthetic
ggggcaggtgttcaccttccagccgcgtcgccattggaccacgcaggattgtaattgctccatctagaccggcca

SEQ ID NO: 114844 - DNA, 75 bp, Artificial Sequence
  Synthetic
ggggcaggtgttcaccttccagccgcgtcgccattggaccacgcaggattgcaattgctccatctaaaccggcca

SEQ ID NO: 114845 - DNA, 75 bp, Artificial Sequence
  Synthetic
ggggcaggtgttcaccttccagccgcgtcgccattggaccacgcaggattgcaattgctccatctataccggcca

SEQ ID NO: 114846 - DNA, 75 bp, Artificial Sequence
  Synthetic
ggggcaggtgttcaccttccagccgcgtcgccattggaccacgcaggattgcaattgctccatctacaccggcca

SEQ ID NO: 114847 - DNA, 75 bp, Artificial Sequence
  Synthetic
ggggcaggtgttcaccttccagccgcgtcgccattggaccacgcaggattgcaattgctccatctagaccggcca

SEQ ID NO: 114848 - DNA, 75 bp, Artificial Sequence
  Synthetic
ggggcaggtgttcaccttccagccgcgtcgccattggaccacgcaggattggaattgctccatctaaaccggcca

SEQ ID NO: 114849 - DNA, 75 bp, Artificial Sequence
  Synthetic
ggggcaggtgttcaccttccagccgcgtcgccattggaccacgcaggattggaattgctccatctataccggcca

SEQ ID NO: 114850 - DNA, 75 bp, Artificial Sequence
  Synthetic
ggggcaggtgttcaccttccagccgcgtcgccattggaccacgcaggattggaattgctccatctacaccggcca

SEQ ID NO: 114851 - DNA, 75 bp, Artificial Sequence
  Synthetic
ggggcaggtgttcaccttccagccgcgtcgccattggaccacgcaggattggaattgctccatctagaccggcca

SEQ ID NO: 114852 - DNA, 75 bp, Artificial Sequence
  Synthetic
gacatggtcgctggaggccattggggtgtcctcgcgggcttggcgttcttcagcatgcagggcaattgggccaag

SEQ ID NO: 114853 - DNA, 75 bp, Artificial Sequence
  Synthetic
ccctgctacgggtgccatacttcgtgagggctcaagccctactacgagtgtgcaccttggtgagacaccttgcag

SEQ ID NO: 114854 - DNA, 75 bp, Artificial Sequence
  Synthetic
tagcatttgcctcaaggggcaaccacgtatcaccgacacactacgtacctgagacagacgcctcccgagcagtaa

SEQ ID NO: 114855 - DNA, 75 bp, Artificial Sequence
  Synthetic
tagcatttgcctcaaggggcaaccacgtatcaccgacacactacgtacctgagacagacgcctcccgagctgtaa

SEQ ID NO: 114856 - DNA, 75 bp, Artificial Sequence
  Synthetic
tagcatttgcctcaaggggcaaccacgtatcaccgacacactacgtacctgagacagacgcctcccgagccgtaa

SEQ ID NO: 114857 - DNA, 75 bp, Artificial Sequence
  Synthetic
tagcatttgcctcaaggggcaaccacgtatcaccgacacactacgtacctgagacagacgcctcccgagcggtaa

SEQ ID NO: 114858 - DNA, 75 bp, Artificial Sequence
  Synthetic
gacttggggccaagcaaaacctccagctgataaactccaacggaagctggcacatcaatcggacggcccttaatt

SEQ ID NO: 114859 - DNA, 75 bp, Artificial Sequence
  Synthetic
tatgacacccgctgttttgactcaacggtcactgagaatgacatccgtgttgaggagtcaatttaccaatgttgt

SEQ ID NO: 114860 - DNA, 75 bp, Artificial Sequence
  Synthetic
ccgttccggcggagatcctgcggaaatccaggaagttcccccgagcgatgcccatatgggcacgcccggattaca

SEQ ID NO: 114861 - DNA, 75 bp, Artificial Sequence
  Synthetic
catcatgacttgcatgtcggcagacttggaggtcataacaagcacctgggtgcttgtaggtggggttctcgcggc

SEQ ID NO: 114862 - DNA, 75 bp, Artificial Sequence
  Synthetic
catcatgacttgcatgtcggcagacttggaggtcataactagcacctgggtgcttgtaggtggggttctcgcggc

SEQ ID NO: 114863 - DNA, 75 bp, Artificial Sequence
  Synthetic
catcatgacttgcatgtcggcagacttggaggtcataaccagcacctgggtgcttgtaggtggggttctcgcggc

SEQ ID NO: 114864 - DNA, 75 bp, Artificial Sequence
  Synthetic
catcatgacttgcatgtcggcagacttggaggtcataacgagcacctgggtgcttgtaggtggggttctcgcggc

SEQ ID NO: 114865 - DNA, 75 bp, Artificial Sequence
  Synthetic
agacatctgggactgggtctgtaccgtgctgtcagacttcaaaacctggcttaaggctaagcttgtgccttccct

SEQ ID NO: 114866 - DNA, 75 bp, Artificial Sequence
  Synthetic
ggaggacttcccgcagggctggggccggcttggcgtcgccaacatcagcggcccatccgaggacaagccttattg

SEQ ID NO: 114867 - DNA, 75 bp, Artificial Sequence
  Synthetic
cagcaattcgaagagatggaggagtgttcaagacacatgccatacctcgtcgagggtcaacacctggctgagcag

SEQ ID NO: 114868 - DNA, 75 bp, Artificial Sequence
  Synthetic
cagcaattcgaagagatggaggagtgttcaagacacatgccttacctcgtcgagggtcaacacctggctgagcag

SEQ ID NO: 114869 - DNA, 75 bp, Artificial Sequence
  Synthetic
cagcaattcgaagagatggaggagtgttcaagacacatgccctacctcgtcgagggtcaacacctggctgagcag

SEQ ID NO: 114870 - DNA, 75 bp, Artificial Sequence
  Synthetic
cagcaattcgaagagatggaggagtgttcaagacacatgccgtacctcgtcgagggtcaacacctggctgagcag

SEQ ID NO: 114871 - DNA, 75 bp, Artificial Sequence
  Synthetic
cagcaattcgaagagatggaggagtgttctagacacatgccatacctcgtcgagggtcaacacctggctgagcag

SEQ ID NO: 114872 - DNA, 75 bp, Artificial Sequence
  Synthetic
cagcaattcgaagagatggaggagtgttctagacacatgccttacctcgtcgagggtcaacacctggctgagcag

SEQ ID NO: 114873 - DNA, 75 bp, Artificial Sequence
  Synthetic
cagcaattcgaagagatggaggagtgttctagacacatgccctacctcgtcgagggtcaacacctggctgagcag

SEQ ID NO: 114874 - DNA, 75 bp, Artificial Sequence
  Synthetic
cagcaattcgaagagatggaggagtgttctagacacatgccgtacctcgtcgagggtcaacacctggctgagcag

SEQ ID NO: 114875 - DNA, 75 bp, Artificial Sequence
  Synthetic
cagcaattcgaagagatggaggagtgttccagacacatgccatacctcgtcgagggtcaacacctggctgagcag

SEQ ID NO: 114876 - DNA, 75 bp, Artificial Sequence
  Synthetic
cagcaattcgaagagatggaggagtgttccagacacatgccttacctcgtcgagggtcaacacctggctgagcag

SEQ ID NO: 114877 - DNA, 75 bp, Artificial Sequence
  Synthetic
cagcaattcgaagagatggaggagtgttccagacacatgccctacctcgtcgagggtcaacacctggctgagcag

SEQ ID NO: 114878 - DNA, 75 bp, Artificial Sequence
  Synthetic
cagcaattcgaagagatggaggagtgttccagacacatgccgtacctcgtcgagggtcaacacctggctgagcag

SEQ ID NO: 114879 - DNA, 75 bp, Artificial Sequence
  Synthetic
cagcaattcgaagagatggaggagtgttcgagacacatgccatacctcgtcgagggtcaacacctggctgagcag

SEQ ID NO: 114880 - DNA, 75 bp, Artificial Sequence
  Synthetic
cagcaattcgaagagatggaggagtgttcgagacacatgccttacctcgtcgagggtcaacacctggctgagcag

SEQ ID NO: 114881 - DNA, 75 bp, Artificial Sequence
  Synthetic
cagcaattcgaagagatggaggagtgttcgagacacatgccctacctcgtcgagggtcaacacctggctgagcag

SEQ ID NO: 114882 - DNA, 75 bp, Artificial Sequence
  Synthetic
cagcaattcgaagagatggaggagtgttcgagacacatgccgtacctcgtcgagggtcaacacctggctgagcag

SEQ ID NO: 114883 - DNA, 75 bp, Artificial Sequence
  Synthetic
cagcaattcgatgagatggaggagtgttcaagacacatgccatacctcgtcgagggtcaacacctggctgagcag

SEQ ID NO: 114884 - DNA, 75 bp, Artificial Sequence
  Synthetic
cagcaattcgatgagatggaggagtgttcaagacacatgccttacctcgtcgagggtcaacacctggctgagcag

SEQ ID NO: 114885 - DNA, 75 bp, Artificial Sequence
  Synthetic
cagcaattcgatgagatggaggagtgttcaagacacatgccctacctcgtcgagggtcaacacctggctgagcag

SEQ ID NO: 114886 - DNA, 75 bp, Artificial Sequence
  Synthetic
cagcaattcgatgagatggaggagtgttcaagacacatgccgtacctcgtcgagggtcaacacctggctgagcag

SEQ ID NO: 114887 - DNA, 75 bp, Artificial Sequence
  Synthetic
cagcaattcgatgagatggaggagtgttctagacacatgccatacctcgtcgagggtcaacacctggctgagcag

SEQ ID NO: 114888 - DNA, 75 bp, Artificial Sequence
  Synthetic
cagcaattcgatgagatggaggagtgttctagacacatgccttacctcgtcgagggtcaacacctggctgagcag

SEQ ID NO: 114889 - DNA, 75 bp, Artificial Sequence
  Synthetic
cagcaattcgatgagatggaggagtgttctagacacatgccctacctcgtcgagggtcaacacctggctgagcag

SEQ ID NO: 114890 - DNA, 75 bp, Artificial Sequence
  Synthetic
cagcaattcgatgagatggaggagtgttctagacacatgccgtacctcgtcgagggtcaacacctggctgagcag

SEQ ID NO: 114891 - DNA, 75 bp, Artificial Sequence
  Synthetic
cagcaattcgatgagatggaggagtgttccagacacatgccatacctcgtcgagggtcaacacctggctgagcag

SEQ ID NO: 114892 - DNA, 75 bp, Artificial Sequence
  Synthetic
cagcaattcgatgagatggaggagtgttccagacacatgccttacctcgtcgagggtcaacacctggctgagcag

SEQ ID NO: 114893 - DNA, 75 bp, Artificial Sequence
  Synthetic
cagcaattcgatgagatggaggagtgttccagacacatgccctacctcgtcgagggtcaacacctggctgagcag

SEQ ID NO: 114894 - DNA, 75 bp, Artificial Sequence
  Synthetic
cagcaattcgatgagatggaggagtgttccagacacatgccgtacctcgtcgagggtcaacacctggctgagcag

SEQ ID NO: 114895 - DNA, 75 bp, Artificial Sequence
  Synthetic
cagcaattcgatgagatggaggagtgttcgagacacatgccatacctcgtcgagggtcaacacctggctgagcag

SEQ ID NO: 114896 - DNA, 75 bp, Artificial Sequence
  Synthetic
cagcaattcgatgagatggaggagtgttcgagacacatgccttacctcgtcgagggtcaacacctggctgagcag

SEQ ID NO: 114897 - DNA, 75 bp, Artificial Sequence
  Synthetic
cagcaattcgatgagatggaggagtgttcgagacacatgccctacctcgtcgagggtcaacacctggctgagcag

SEQ ID NO: 114898 - DNA, 75 bp, Artificial Sequence
  Synthetic
cagcaattcgatgagatggaggagtgttcgagacacatgccgtacctcgtcgagggtcaacacctggctgagcag

SEQ ID NO: 114899 - DNA, 75 bp, Artificial Sequence
  Synthetic
cagcaattcgacgagatggaggagtgttcaagacacatgccatacctcgtcgagggtcaacacctggctgagcag

SEQ ID NO: 114900 - DNA, 75 bp, Artificial Sequence
  Synthetic
cagcaattcgacgagatggaggagtgttcaagacacatgccttacctcgtcgagggtcaacacctggctgagcag

SEQ ID NO: 114901 - DNA, 75 bp, Artificial Sequence
  Synthetic
cagcaattcgacgagatggaggagtgttcaagacacatgccctacctcgtcgagggtcaacacctggctgagcag

SEQ ID NO: 114902 - DNA, 75 bp, Artificial Sequence
  Synthetic
cagcaattcgacgagatggaggagtgttcaagacacatgccgtacctcgtcgagggtcaacacctggctgagcag

SEQ ID NO: 114903 - DNA, 75 bp, Artificial Sequence
  Synthetic
cagcaattcgacgagatggaggagtgttctagacacatgccatacctcgtcgagggtcaacacctggctgagcag

SEQ ID NO: 114904 - DNA, 75 bp, Artificial Sequence
  Synthetic
cagcaattcgacgagatggaggagtgttctagacacatgccttacctcgtcgagggtcaacacctggctgagcag

SEQ ID NO: 114905 - DNA, 75 bp, Artificial Sequence
  Synthetic
cagcaattcgacgagatggaggagtgttctagacacatgccctacctcgtcgagggtcaacacctggctgagcag

SEQ ID NO: 114906 - DNA, 75 bp, Artificial Sequence
  Synthetic
cagcaattcgacgagatggaggagtgttctagacacatgccgtacctcgtcgagggtcaacacctggctgagcag

SEQ ID NO: 114907 - DNA, 75 bp, Artificial Sequence
  Synthetic
cagcaattcgacgagatggaggagtgttccagacacatgccatacctcgtcgagggtcaacacctggctgagcag

SEQ ID NO: 114908 - DNA, 75 bp, Artificial Sequence
  Synthetic
cagcaattcgacgagatggaggagtgttccagacacatgccttacctcgtcgagggtcaacacctggctgagcag

SEQ ID NO: 114909 - DNA, 75 bp, Artificial Sequence
  Synthetic
cagcaattcgacgagatggaggagtgttccagacacatgccctacctcgtcgagggtcaacacctggctgagcag

SEQ ID NO: 114910 - DNA, 75 bp, Artificial Sequence
  Synthetic
cagcaattcgacgagatggaggagtgttccagacacatgccgtacctcgtcgagggtcaacacctggctgagcag

SEQ ID NO: 114911 - DNA, 75 bp, Artificial Sequence
  Synthetic
cagcaattcgacgagatggaggagtgttcgagacacatgccatacctcgtcgagggtcaacacctggctgagcag

SEQ ID NO: 114912 - DNA, 75 bp, Artificial Sequence
  Synthetic
cagcaattcgacgagatggaggagtgttcgagacacatgccttacctcgtcgagggtcaacacctggctgagcag

SEQ ID NO: 114913 - DNA, 75 bp, Artificial Sequence
  Synthetic
cagcaattcgacgagatggaggagtgttcgagacacatgccctacctcgtcgagggtcaacacctggctgagcag

SEQ ID NO: 114914 - DNA, 75 bp, Artificial Sequence
  Synthetic
cagcaattcgacgagatggaggagtgttcgagacacatgccgtacctcgtcgagggtcaacacctggctgagcag

SEQ ID NO: 114915 - DNA, 75 bp, Artificial Sequence
  Synthetic
cagcaattcgaggagatggaggagtgttcaagacacatgccatacctcgtcgagggtcaacacctggctgagcag

SEQ ID NO: 114916 - DNA, 75 bp, Artificial Sequence
  Synthetic
cagcaattcgaggagatggaggagtgttcaagacacatgccttacctcgtcgagggtcaacacctggctgagcag

SEQ ID NO: 114917 - DNA, 75 bp, Artificial Sequence
  Synthetic
cagcaattcgaggagatggaggagtgttcaagacacatgccctacctcgtcgagggtcaacacctggctgagcag

SEQ ID NO: 114918 - DNA, 75 bp, Artificial Sequence
  Synthetic
cagcaattcgaggagatggaggagtgttcaagacacatgccgtacctcgtcgagggtcaacacctggctgagcag

SEQ ID NO: 114919 - DNA, 75 bp, Artificial Sequence
  Synthetic
cagcaattcgaggagatggaggagtgttctagacacatgccatacctcgtcgagggtcaacacctggctgagcag

SEQ ID NO: 114920 - DNA, 75 bp, Artificial Sequence
  Synthetic
cagcaattcgaggagatggaggagtgttctagacacatgccttacctcgtcgagggtcaacacctggctgagcag

SEQ ID NO: 114921 - DNA, 75 bp, Artificial Sequence
  Synthetic
cagcaattcgaggagatggaggagtgttctagacacatgccctacctcgtcgagggtcaacacctggctgagcag

SEQ ID NO: 114922 - DNA, 75 bp, Artificial Sequence
  Synthetic
cagcaattcgaggagatggaggagtgttctagacacatgccgtacctcgtcgagggtcaacacctggctgagcag

SEQ ID NO: 114923 - DNA, 75 bp, Artificial Sequence
  Synthetic
cagcaattcgaggagatggaggagtgttccagacacatgccatacctcgtcgagggtcaacacctggctgagcag

SEQ ID NO: 114924 - DNA, 75 bp, Artificial Sequence
  Synthetic
cagcaattcgaggagatggaggagtgttccagacacatgccttacctcgtcgagggtcaacacctggctgagcag

SEQ ID NO: 114925 - DNA, 75 bp, Artificial Sequence
  Synthetic
cagcaattcgaggagatggaggagtgttccagacacatgccctacctcgtcgagggtcaacacctggctgagcag

SEQ ID NO: 114926 - DNA, 75 bp, Artificial Sequence
  Synthetic
cagcaattcgaggagatggaggagtgttccagacacatgccgtacctcgtcgagggtcaacacctggctgagcag

SEQ ID NO: 114927 - DNA, 75 bp, Artificial Sequence
  Synthetic
cagcaattcgaggagatggaggagtgttcgagacacatgccatacctcgtcgagggtcaacacctggctgagcag

SEQ ID NO: 114928 - DNA, 75 bp, Artificial Sequence
  Synthetic
cagcaattcgaggagatggaggagtgttcgagacacatgccttacctcgtcgagggtcaacacctggctgagcag

SEQ ID NO: 114929 - DNA, 75 bp, Artificial Sequence
  Synthetic
cagcaattcgaggagatggaggagtgttcgagacacatgccctacctcgtcgagggtcaacacctggctgagcag

SEQ ID NO: 114930 - DNA, 75 bp, Artificial Sequence
  Synthetic
cagcaattcgaggagatggaggagtgttcgagacacatgccgtacctcgtcgagggtcaacacctggctgagcag

SEQ ID NO: 114931 - DNA, 75 bp, Artificial Sequence
  Synthetic
caacgggggttcaggggggtgtggcgaggcgagggcatctgccatacttcatgcccctgcggggctatgatcaca

SEQ ID NO: 114932 - DNA, 75 bp, Artificial Sequence
  Synthetic
gttcaagacacataccatacctcgtcgagggtcaacacctggctgagcagttcaagcagaaggtccttggcctca

SEQ ID NO: 114933 - DNA, 75 bp, Artificial Sequence
  Synthetic
gttcaagacacataccttacctcgtcgagggtcaacacctggctgagcagttcaagcagaaggtccttggcctca

SEQ ID NO: 114934 - DNA, 75 bp, Artificial Sequence
  Synthetic
gttcaagacacataccctacctcgtcgagggtcaacacctggctgagcagttcaagcagaaggtccttggcctca

SEQ ID NO: 114935 - DNA, 75 bp, Artificial Sequence
  Synthetic
gttcaagacacataccgtacctcgtcgagggtcaacacctggctgagcagttcaagcagaaggtccttggcctca

SEQ ID NO: 114936 - DNA, 75 bp, Artificial Sequence
  Synthetic
gttcaagacacattccatacctcgtcgagggtcaacacctggctgagcagttcaagcagaaggtccttggcctca

SEQ ID NO: 114937 - DNA, 75 bp, Artificial Sequence
  Synthetic
gttcaagacacattccttacctcgtcgagggtcaacacctggctgagcagttcaagcagaaggtccttggcctca

SEQ ID NO: 114938 - DNA, 75 bp, Artificial Sequence
  Synthetic
gttcaagacacattccctacctcgtcgagggtcaacacctggctgagcagttcaagcagaaggtccttggcctca

SEQ ID NO: 114939 - DNA, 75 bp, Artificial Sequence
  Synthetic
gttcaagacacattccgtacctcgtcgagggtcaacacctggctgagcagttcaagcagaaggtccttggcctca

SEQ ID NO: 114940 - DNA, 75 bp, Artificial Sequence
  Synthetic
gttcaagacacatcccatacctcgtcgagggtcaacacctggctgagcagttcaagcagaaggtccttggcctca

SEQ ID NO: 114941 - DNA, 75 bp, Artificial Sequence
  Synthetic
gttcaagacacatcccttacctcgtcgagggtcaacacctggctgagcagttcaagcagaaggtccttggcctca

SEQ ID NO: 114942 - DNA, 75 bp, Artificial Sequence
  Synthetic
gttcaagacacatcccctacctcgtcgagggtcaacacctggctgagcagttcaagcagaaggtccttggcctca

SEQ ID NO: 114943 - DNA, 75 bp, Artificial Sequence
  Synthetic
gttcaagacacatcccgtacctcgtcgagggtcaacacctggctgagcagttcaagcagaaggtccttggcctca

SEQ ID NO: 114944 - DNA, 75 bp, Artificial Sequence
  Synthetic
gttcaagacacatgccatacctcgtcgagggtcaacacctggctgagcagttcaagcagaaggtccttggcctca

SEQ ID NO: 114945 - DNA, 75 bp, Artificial Sequence
  Synthetic
gttcaagacacatgccttacctcgtcgagggtcaacacctggctgagcagttcaagcagaaggtccttggcctca

SEQ ID NO: 114946 - DNA, 75 bp, Artificial Sequence
  Synthetic
gttcaagacacatgccctacctcgtcgagggtcaacacctggctgagcagttcaagcagaaggtccttggcctca

SEQ ID NO: 114947 - DNA, 75 bp, Artificial Sequence
  Synthetic
gttcaagacacatgccgtacctcgtcgagggtcaacacctggctgagcagttcaagcagaaggtccttggcctca

SEQ ID NO: 114948 - DNA, 75 bp, Artificial Sequence
  Synthetic
gttctagacacataccatacctcgtcgagggtcaacacctggctgagcagttcaagcagaaggtccttggcctca

SEQ ID NO: 114949 - DNA, 75 bp, Artificial Sequence
  Synthetic
gttctagacacataccttacctcgtcgagggtcaacacctggctgagcagttcaagcagaaggtccttggcctca

SEQ ID NO: 114950 - DNA, 75 bp, Artificial Sequence
  Synthetic
gttctagacacataccctacctcgtcgagggtcaacacctggctgagcagttcaagcagaaggtccttggcctca

SEQ ID NO: 114951 - DNA, 75 bp, Artificial Sequence
  Synthetic
gttctagacacataccgtacctcgtcgagggtcaacacctggctgagcagttcaagcagaaggtccttggcctca

SEQ ID NO: 114952 - DNA, 75 bp, Artificial Sequence
  Synthetic
gttctagacacattccatacctcgtcgagggtcaacacctggctgagcagttcaagcagaaggtccttggcctca

SEQ ID NO: 114953 - DNA, 75 bp, Artificial Sequence
  Synthetic
gttctagacacattccttacctcgtcgagggtcaacacctggctgagcagttcaagcagaaggtccttggcctca

SEQ ID NO: 114954 - DNA, 75 bp, Artificial Sequence
  Synthetic
gttctagacacattccctacctcgtcgagggtcaacacctggctgagcagttcaagcagaaggtccttggcctca

SEQ ID NO: 114955 - DNA, 75 bp, Artificial Sequence
  Synthetic
gttctagacacattccgtacctcgtcgagggtcaacacctggctgagcagttcaagcagaaggtccttggcctca

SEQ ID NO: 114956 - DNA, 75 bp, Artificial Sequence
  Synthetic
gttctagacacatcccatacctcgtcgagggtcaacacctggctgagcagttcaagcagaaggtccttggcctca

SEQ ID NO: 114957 - DNA, 75 bp, Artificial Sequence
  Synthetic
gttctagacacatcccttacctcgtcgagggtcaacacctggctgagcagttcaagcagaaggtccttggcctca

SEQ ID NO: 114958 - DNA, 75 bp, Artificial Sequence
  Synthetic
gttctagacacatcccctacctcgtcgagggtcaacacctggctgagcagttcaagcagaaggtccttggcctca

SEQ ID NO: 114959 - DNA, 75 bp, Artificial Sequence
  Synthetic
gttctagacacatcccgtacctcgtcgagggtcaacacctggctgagcagttcaagcagaaggtccttggcctca

SEQ ID NO: 114960 - DNA, 75 bp, Artificial Sequence
  Synthetic
gttctagacacatgccatacctcgtcgagggtcaacacctggctgagcagttcaagcagaaggtccttggcctca

SEQ ID NO: 114961 - DNA, 75 bp, Artificial Sequence
  Synthetic
gttctagacacatgccttacctcgtcgagggtcaacacctggctgagcagttcaagcagaaggtccttggcctca

SEQ ID NO: 114962 - DNA, 75 bp, Artificial Sequence
  Synthetic
gttctagacacatgccctacctcgtcgagggtcaacacctggctgagcagttcaagcagaaggtccttggcctca

SEQ ID NO: 114963 - DNA, 75 bp, Artificial Sequence
  Synthetic
gttctagacacatgccgtacctcgtcgagggtcaacacctggctgagcagttcaagcagaaggtccttggcctca

SEQ ID NO: 114964 - DNA, 75 bp, Artificial Sequence
  Synthetic
gttccagacacataccatacctcgtcgagggtcaacacctggctgagcagttcaagcagaaggtccttggcctca

SEQ ID NO: 114965 - DNA, 75 bp, Artificial Sequence
  Synthetic
gttccagacacataccttacctcgtcgagggtcaacacctggctgagcagttcaagcagaaggtccttggcctca

SEQ ID NO: 114966 - DNA, 75 bp, Artificial Sequence
  Synthetic
gttccagacacataccctacctcgtcgagggtcaacacctggctgagcagttcaagcagaaggtccttggcctca

SEQ ID NO: 114967 - DNA, 75 bp, Artificial Sequence
  Synthetic
gttccagacacataccgtacctcgtcgagggtcaacacctggctgagcagttcaagcagaaggtccttggcctca

SEQ ID NO: 114968 - DNA, 75 bp, Artificial Sequence
  Synthetic
gttccagacacattccatacctcgtcgagggtcaacacctggctgagcagttcaagcagaaggtccttggcctca

SEQ ID NO: 114969 - DNA, 75 bp, Artificial Sequence
  Synthetic
gttccagacacattccttacctcgtcgagggtcaacacctggctgagcagttcaagcagaaggtccttggcctca

SEQ ID NO: 114970 - DNA, 75 bp, Artificial Sequence
  Synthetic
gttccagacacattccctacctcgtcgagggtcaacacctggctgagcagttcaagcagaaggtccttggcctca

SEQ ID NO: 114971 - DNA, 75 bp, Artificial Sequence
  Synthetic
gttccagacacattccgtacctcgtcgagggtcaacacctggctgagcagttcaagcagaaggtccttggcctca

SEQ ID NO: 114972 - DNA, 75 bp, Artificial Sequence
  Synthetic
gttccagacacatcccatacctcgtcgagggtcaacacctggctgagcagttcaagcagaaggtccttggcctca

SEQ ID NO: 114973 - DNA, 75 bp, Artificial Sequence
  Synthetic
gttccagacacatcccttacctcgtcgagggtcaacacctggctgagcagttcaagcagaaggtccttggcctca

SEQ ID NO: 114974 - DNA, 75 bp, Artificial Sequence
  Synthetic
gttccagacacatcccctacctcgtcgagggtcaacacctggctgagcagttcaagcagaaggtccttggcctca

SEQ ID NO: 114975 - DNA, 75 bp, Artificial Sequence
  Synthetic
gttccagacacatcccgtacctcgtcgagggtcaacacctggctgagcagttcaagcagaaggtccttggcctca

SEQ ID NO: 114976 - DNA, 75 bp, Artificial Sequence
  Synthetic
gttccagacacatgccatacctcgtcgagggtcaacacctggctgagcagttcaagcagaaggtccttggcctca

SEQ ID NO: 114977 - DNA, 75 bp, Artificial Sequence
  Synthetic
gttccagacacatgccttacctcgtcgagggtcaacacctggctgagcagttcaagcagaaggtccttggcctca

SEQ ID NO: 114978 - DNA, 75 bp, Artificial Sequence
  Synthetic
gttccagacacatgccctacctcgtcgagggtcaacacctggctgagcagttcaagcagaaggtccttggcctca

SEQ ID NO: 114979 - DNA, 75 bp, Artificial Sequence
  Synthetic
gttccagacacatgccgtacctcgtcgagggtcaacacctggctgagcagttcaagcagaaggtccttggcctca

SEQ ID NO: 114980 - DNA, 75 bp, Artificial Sequence
  Synthetic
gttcgagacacataccatacctcgtcgagggtcaacacctggctgagcagttcaagcagaaggtccttggcctca

SEQ ID NO: 114981 - DNA, 75 bp, Artificial Sequence
  Synthetic
gttcgagacacataccttacctcgtcgagggtcaacacctggctgagcagttcaagcagaaggtccttggcctca

SEQ ID NO: 114982 - DNA, 75 bp, Artificial Sequence
  Synthetic
gttcgagacacataccctacctcgtcgagggtcaacacctggctgagcagttcaagcagaaggtccttggcctca

SEQ ID NO: 114983 - DNA, 75 bp, Artificial Sequence
  Synthetic
gttcgagacacataccgtacctcgtcgagggtcaacacctggctgagcagttcaagcagaaggtccttggcctca

SEQ ID NO: 114984 - DNA, 75 bp, Artificial Sequence
  Synthetic
gttcgagacacattccatacctcgtcgagggtcaacacctggctgagcagttcaagcagaaggtccttggcctca

SEQ ID NO: 114985 - DNA, 75 bp, Artificial Sequence
  Synthetic
gttcgagacacattccttacctcgtcgagggtcaacacctggctgagcagttcaagcagaaggtccttggcctca

SEQ ID NO: 114986 - DNA, 75 bp, Artificial Sequence
  Synthetic
gttcgagacacattccctacctcgtcgagggtcaacacctggctgagcagttcaagcagaaggtccttggcctca

SEQ ID NO: 114987 - DNA, 75 bp, Artificial Sequence
  Synthetic
gttcgagacacattccgtacctcgtcgagggtcaacacctggctgagcagttcaagcagaaggtccttggcctca

SEQ ID NO: 114988 - DNA, 75 bp, Artificial Sequence
  Synthetic
gttcgagacacatcccatacctcgtcgagggtcaacacctggctgagcagttcaagcagaaggtccttggcctca

SEQ ID NO: 114989 - DNA, 75 bp, Artificial Sequence
  Synthetic
gttcgagacacatcccttacctcgtcgagggtcaacacctggctgagcagttcaagcagaaggtccttggcctca

SEQ ID NO: 114990 - DNA, 75 bp, Artificial Sequence
  Synthetic
gttcgagacacatcccctacctcgtcgagggtcaacacctggctgagcagttcaagcagaaggtccttggcctca

SEQ ID NO: 114991 - DNA, 75 bp, Artificial Sequence
  Synthetic
gttcgagacacatcccgtacctcgtcgagggtcaacacctggctgagcagttcaagcagaaggtccttggcctca

SEQ ID NO: 114992 - DNA, 75 bp, Artificial Sequence
  Synthetic
gttcgagacacatgccatacctcgtcgagggtcaacacctggctgagcagttcaagcagaaggtccttggcctca

SEQ ID NO: 114993 - DNA, 75 bp, Artificial Sequence
  Synthetic
gttcgagacacatgccttacctcgtcgagggtcaacacctggctgagcagttcaagcagaaggtccttggcctca

SEQ ID NO: 114994 - DNA, 75 bp, Artificial Sequence
  Synthetic
gttcgagacacatgccctacctcgtcgagggtcaacacctggctgagcagttcaagcagaaggtccttggcctca

SEQ ID NO: 114995 - DNA, 75 bp, Artificial Sequence
  Synthetic
gttcgagacacatgccgtacctcgtcgagggtcaacacctggctgagcagttcaagcagaaggtccttggcctca

SEQ ID NO: 114996 - DNA, 75 bp, Artificial Sequence
  Synthetic
tggggacgtcgtggtatgcgccacggacgccctcatgacggggtttaccggcgactttgactcagtgatagactg

SEQ ID NO: 114997 - DNA, 75 bp, Artificial Sequence
  Synthetic
gcgtacccgtcccggatccaaactacaaaagagcattgtggagggtctctgcggaggactacgttgaggtcgtaa

SEQ ID NO: 114998 - DNA, 75 bp, Artificial Sequence
  Synthetic
gacgagcgcggtgcacctacctatacctggggggaaaatgagactgatgtcttcatattaaattccaccagacct

SEQ ID NO: 114999 - DNA, 75 bp, Artificial Sequence
  Synthetic
tccccgacagggaagtattataccagcagtttgatgagatggaggaatgctcgacctcactcccctatatggacg

SEQ ID NO: 115000 - DNA, 75 bp, Artificial Sequence
  Synthetic
ggatacatgactgccattatgtggtaggggctactaccgacaatctgaagtgcccctgccaggtaccagcaccag

SEQ ID NO: 115001 - DNA, 75 bp, Artificial Sequence
  Synthetic
agggagacctgtgtgggtatcggagatgccgtgcaagcggcgtctacaccaccagcttcggaaacacactgacgt

SEQ ID NO: 115002 - DNA, 75 bp, Artificial Sequence
  Synthetic
accacaacaaccctcctactaaacatcttgggagggtgggttgctgcgcaacttgcaaaccccacagcgtccact

SEQ ID NO: 115003 - DNA, 75 bp, Artificial Sequence
  Synthetic
ggccgtgccctaccgactgcttccggaagcatccagatgccacctacgccaaatgcggtgcaggcccttggctta

SEQ ID NO: 115004 - DNA, 75 bp, Artificial Sequence
  Synthetic
aacggtcccagccacgtggtaggcgccaacccatccccaaagaccggcgcaccactggcaagtcctggggaagac

SEQ ID NO: 115005 - DNA, 75 bp, Artificial Sequence
  Synthetic
gaaattccccccagcgatgcccatatgggcacgcccggattacaaccctccactgatagagtcctggaaggaccc

SEQ ID NO: 115006 - DNA, 75 bp, Artificial Sequence
  Synthetic
cgccgaggtgcatgatcgattatccatatcgactgtggcactacccatgcaccgtcaattacacaatatttaaga

SEQ ID NO: 115007 - DNA, 75 bp, Artificial Sequence
  Synthetic
gcaaaacatatgtggaactttgtcagcgggatccaatacctagccggcctttcgaccttgccgggtaaccctgca

SEQ ID NO: 115008 - DNA, 75 bp, Artificial Sequence
  Synthetic
gagccatatcaccgcggagacagcagcccggcgcctcgcacgggggtcccctccatctttggctagttcctcggc

SEQ ID NO: 115009 - DNA, 75 bp, Artificial Sequence
  Synthetic
gggtgagagttctggaggacgggataaaatatgcaacggggaacctgcccggttgctctttctctatcttcctct

SEQ ID NO: 115010 - DNA, 75 bp, Artificial Sequence
  Synthetic
gggtgagagttctggaggacgggataaattatgcaacggggaacctgcccggttgctctttctctatcttcctct

SEQ ID NO: 115011 - DNA, 75 bp, Artificial Sequence
  Synthetic
gggtgagagttctggaggacgggataaactatgcaacggggaacctgcccggttgctctttctctatcttcctct

SEQ ID NO: 115012 - DNA, 75 bp, Artificial Sequence
  Synthetic
gggtgagagttctggaggacgggataaagtatgcaacggggaacctgcccggttgctctttctctatcttcctct

SEQ ID NO: 115013 - DNA, 75 bp, Artificial Sequence
  Synthetic
gtcacctttgctgctttccactacacagtggcagattctcccctgctccttcacgaccttacccgctctctcaac

SEQ ID NO: 115014 - DNA, 75 bp, Artificial Sequence
  Synthetic
gcttatcaggccacagtgtgcgccagagctctggcgcccccaccaagctgggacaccatgtggaagtgcctaatc

SEQ ID NO: 115015 - DNA, 75 bp, Artificial Sequence
  Synthetic
tagccctgctgtcttgtatctctgtgccagtttccgccatagaagtcaagaacaacagagacatttatatggcga

SEQ ID NO: 115016 - DNA, 75 bp, Artificial Sequence
  Synthetic
tagccctgctgtcttgtatctctgtgccagtttccgccatagaagtcaagaacaacagagacttttatatggcga

SEQ ID NO: 115017 - DNA, 75 bp, Artificial Sequence
  Synthetic
tagccctgctgtcttgtatctctgtgccagtttccgccatagaagtcaagaacaacagagacctttatatggcga

SEQ ID NO: 115018 - DNA, 75 bp, Artificial Sequence
  Synthetic
tagccctgctgtcttgtatctctgtgccagtttccgccatagaagtcaagaacaacagagacgtttatatggcga

SEQ ID NO: 115019 - DNA, 75 bp, Artificial Sequence
  Synthetic
tagccctgctgtcttgtatctctgtgccagtttccgccatagaagtcaagaacaacagtgacatttatatggcga

SEQ ID NO: 115020 - DNA, 75 bp, Artificial Sequence
  Synthetic
tagccctgctgtcttgtatctctgtgccagtttccgccatagaagtcaagaacaacagtgacttttatatggcga

SEQ ID NO: 115021 - DNA, 75 bp, Artificial Sequence
  Synthetic
tagccctgctgtcttgtatctctgtgccagtttccgccatagaagtcaagaacaacagtgacctttatatggcga

SEQ ID NO: 115022 - DNA, 75 bp, Artificial Sequence
  Synthetic
tagccctgctgtcttgtatctctgtgccagtttccgccatagaagtcaagaacaacagtgacgtttatatggcga

SEQ ID NO: 115023 - DNA, 75 bp, Artificial Sequence
  Synthetic
tagccctgctgtcttgtatctctgtgccagtttccgccatagaagtcaagaacaacagcgacatttatatggcga

SEQ ID NO: 115024 - DNA, 75 bp, Artificial Sequence
  Synthetic
tagccctgctgtcttgtatctctgtgccagtttccgccatagaagtcaagaacaacagcgacttttatatggcga

SEQ ID NO: 115025 - DNA, 75 bp, Artificial Sequence
  Synthetic
tagccctgctgtcttgtatctctgtgccagtttccgccatagaagtcaagaacaacagcgacctttatatggcga

SEQ ID NO: 115026 - DNA, 75 bp, Artificial Sequence
  Synthetic
tagccctgctgtcttgtatctctgtgccagtttccgccatagaagtcaagaacaacagcgacgtttatatggcga

SEQ ID NO: 115027 - DNA, 75 bp, Artificial Sequence
  Synthetic
tagccctgctgtcttgtatctctgtgccagtttccgccatagaagtcaagaacaacagggacatttatatggcga

SEQ ID NO: 115028 - DNA, 75 bp, Artificial Sequence
  Synthetic
tagccctgctgtcttgtatctctgtgccagtttccgccatagaagtcaagaacaacagggacttttatatggcga

SEQ ID NO: 115029 - DNA, 75 bp, Artificial Sequence
  Synthetic
tagccctgctgtcttgtatctctgtgccagtttccgccatagaagtcaagaacaacagggacctttatatggcga

SEQ ID NO: 115030 - DNA, 75 bp, Artificial Sequence
  Synthetic
tagccctgctgtcttgtatctctgtgccagtttccgccatagaagtcaagaacaacagggacgtttatatggcga

SEQ ID NO: 115031 - DNA, 75 bp, Artificial Sequence
  Synthetic
atgggaggtaacatcactcgagttgagtctgagaacaaggttgtggtactcgactcctttgaccctcttgtcgcc

SEQ ID NO: 115032 - DNA, 75 bp, Artificial Sequence
  Synthetic
ctcgccttcctgctgctcgcagacgccagaatctgtgcatgtttctggatgatgttgcttgtagcgcaggttgaa

SEQ ID NO: 115033 - DNA, 75 bp, Artificial Sequence
  Synthetic
gtgctggatcccggtcacccccaacatagccgtagaccgacccggcgccctcactccgggcttgcgagcgcacat

SEQ ID NO: 115034 - DNA, 75 bp, Artificial Sequence
  Synthetic
gtgctggatcccggtcacccccaacatagccgtagaccgacccggcgccctcactccgggcttgcgtgcgcacat

SEQ ID NO: 115035 - DNA, 75 bp, Artificial Sequence
  Synthetic
gtgctggatcccggtcacccccaacatagccgtagaccgacccggcgccctcactccgggcttgcgcgcgcacat

SEQ ID NO: 115036 - DNA, 75 bp, Artificial Sequence
  Synthetic
gtgctggatcccggtcacccccaacatagccgtagaccgacccggcgccctcactccgggcttgcgggcgcacat

SEQ ID NO: 115037 - DNA, 75 bp, Artificial Sequence
  Synthetic
gtgctggatcccggtcacccccaacatagccgttgaccgacccggcgccctcactccgggcttgcgagcgcacat

SEQ ID NO: 115038 - DNA, 75 bp, Artificial Sequence
  Synthetic
gtgctggatcccggtcacccccaacatagccgttgaccgacccggcgccctcactccgggcttgcgtgcgcacat

SEQ ID NO: 115039 - DNA, 75 bp, Artificial Sequence
  Synthetic
gtgctggatcccggtcacccccaacatagccgttgaccgacccggcgccctcactccgggcttgcgcgcgcacat

SEQ ID NO: 115040 - DNA, 75 bp, Artificial Sequence
  Synthetic
gtgctggatcccggtcacccccaacatagccgttgaccgacccggcgccctcactccgggcttgcgggcgcacat

SEQ ID NO: 115041 - DNA, 75 bp, Artificial Sequence
  Synthetic
gtgctggatcccggtcacccccaacatagccgtcgaccgacccggcgccctcactccgggcttgcgagcgcacat

SEQ ID NO: 115042 - DNA, 75 bp, Artificial Sequence
  Synthetic
gtgctggatcccggtcacccccaacatagccgtcgaccgacccggcgccctcactccgggcttgcgtgcgcacat

SEQ ID NO: 115043 - DNA, 75 bp, Artificial Sequence
  Synthetic
gtgctggatcccggtcacccccaacatagccgtcgaccgacccggcgccctcactccgggcttgcgcgcgcacat

SEQ ID NO: 115044 - DNA, 75 bp, Artificial Sequence
  Synthetic
gtgctggatcccggtcacccccaacatagccgtcgaccgacccggcgccctcactccgggcttgcgggcgcacat

SEQ ID NO: 115045 - DNA, 75 bp, Artificial Sequence
  Synthetic
gtgctggatcccggtcacccccaacatagccgtggaccgacccggcgccctcactccgggcttgcgagcgcacat

SEQ ID NO: 115046 - DNA, 75 bp, Artificial Sequence
  Synthetic
gtgctggatcccggtcacccccaacatagccgtggaccgacccggcgccctcactccgggcttgcgtgcgcacat

SEQ ID NO: 115047 - DNA, 75 bp, Artificial Sequence
  Synthetic
gtgctggatcccggtcacccccaacatagccgtggaccgacccggcgccctcactccgggcttgcgcgcgcacat

SEQ ID NO: 115048 - DNA, 75 bp, Artificial Sequence
  Synthetic
gtgctggatcccggtcacccccaacatagccgtggaccgacccggcgccctcactccgggcttgcgggcgcacat

SEQ ID NO: 115049 - DNA, 75 bp, Artificial Sequence
  Synthetic
gtgctggttcccggtcacccccaacatagccgtagaccgacccggcgccctcactccgggcttgcgagcgcacat

SEQ ID NO: 115050 - DNA, 75 bp, Artificial Sequence
  Synthetic
gtgctggttcccggtcacccccaacatagccgtagaccgacccggcgccctcactccgggcttgcgtgcgcacat

SEQ ID NO: 115051 - DNA, 75 bp, Artificial Sequence
  Synthetic
gtgctggttcccggtcacccccaacatagccgtagaccgacccggcgccctcactccgggcttgcgcgcgcacat

SEQ ID NO: 115052 - DNA, 75 bp, Artificial Sequence
  Synthetic
gtgctggttcccggtcacccccaacatagccgtagaccgacccggcgccctcactccgggcttgcgggcgcacat

SEQ ID NO: 115053 - DNA, 75 bp, Artificial Sequence
  Synthetic
gtgctggttcccggtcacccccaacatagccgttgaccgacccggcgccctcactccgggcttgcgagcgcacat

SEQ ID NO: 115054 - DNA, 75 bp, Artificial Sequence
  Synthetic
gtgctggttcccggtcacccccaacatagccgttgaccgacccggcgccctcactccgggcttgcgtgcgcacat

SEQ ID NO: 115055 - DNA, 75 bp, Artificial Sequence
  Synthetic
gtgctggttcccggtcacccccaacatagccgttgaccgacccggcgccctcactccgggcttgcgcgcgcacat

SEQ ID NO: 115056 - DNA, 75 bp, Artificial Sequence
  Synthetic
gtgctggttcccggtcacccccaacatagccgttgaccgacccggcgccctcactccgggcttgcgggcgcacat

SEQ ID NO: 115057 - DNA, 75 bp, Artificial Sequence
  Synthetic
gtgctggttcccggtcacccccaacatagccgtcgaccgacccggcgccctcactccgggcttgcgagcgcacat

SEQ ID NO: 115058 - DNA, 75 bp, Artificial Sequence
  Synthetic
gtgctggttcccggtcacccccaacatagccgtcgaccgacccggcgccctcactccgggcttgcgtgcgcacat

SEQ ID NO: 115059 - DNA, 75 bp, Artificial Sequence
  Synthetic
gtgctggttcccggtcacccccaacatagccgtcgaccgacccggcgccctcactccgggcttgcgcgcgcacat

SEQ ID NO: 115060 - DNA, 75 bp, Artificial Sequence
  Synthetic
gtgctggttcccggtcacccccaacatagccgtcgaccgacccggcgccctcactccgggcttgcgggcgcacat

SEQ ID NO: 115061 - DNA, 75 bp, Artificial Sequence
  Synthetic
gtgctggttcccggtcacccccaacatagccgtggaccgacccggcgccctcactccgggcttgcgagcgcacat

SEQ ID NO: 115062 - DNA, 75 bp, Artificial Sequence
  Synthetic
gtgctggttcccggtcacccccaacatagccgtggaccgacccggcgccctcactccgggcttgcgtgcgcacat

SEQ ID NO: 115063 - DNA, 75 bp, Artificial Sequence
  Synthetic
gtgctggttcccggtcacccccaacatagccgtggaccgacccggcgccctcactccgggcttgcgcgcgcacat

SEQ ID NO: 115064 - DNA, 75 bp, Artificial Sequence
  Synthetic
gtgctggttcccggtcacccccaacatagccgtggaccgacccggcgccctcactccgggcttgcgggcgcacat

SEQ ID NO: 115065 - DNA, 75 bp, Artificial Sequence
  Synthetic
gtgctggctcccggtcacccccaacatagccgtagaccgacccggcgccctcactccgggcttgcgagcgcacat

SEQ ID NO: 115066 - DNA, 75 bp, Artificial Sequence
  Synthetic
gtgctggctcccggtcacccccaacatagccgtagaccgacccggcgccctcactccgggcttgcgtgcgcacat

SEQ ID NO: 115067 - DNA, 75 bp, Artificial Sequence
  Synthetic
gtgctggctcccggtcacccccaacatagccgtagaccgacccggcgccctcactccgggcttgcgcgcgcacat

SEQ ID NO: 115068 - DNA, 75 bp, Artificial Sequence
  Synthetic
gtgctggctcccggtcacccccaacatagccgtagaccgacccggcgccctcactccgggcttgcgggcgcacat

SEQ ID NO: 115069 - DNA, 75 bp, Artificial Sequence
  Synthetic
gtgctggctcccggtcacccccaacatagccgttgaccgacccggcgccctcactccgggcttgcgagcgcacat

SEQ ID NO: 115070 - DNA, 75 bp, Artificial Sequence
  Synthetic
gtgctggctcccggtcacccccaacatagccgttgaccgacccggcgccctcactccgggcttgcgtgcgcacat

SEQ ID NO: 115071 - DNA, 75 bp, Artificial Sequence
  Synthetic
gtgctggctcccggtcacccccaacatagccgttgaccgacccggcgccctcactccgggcttgcgcgcgcacat

SEQ ID NO: 115072 - DNA, 75 bp, Artificial Sequence
  Synthetic
gtgctggctcccggtcacccccaacatagccgttgaccgacccggcgccctcactccgggcttgcgggcgcacat

SEQ ID NO: 115073 - DNA, 75 bp, Artificial Sequence
  Synthetic
gtgctggctcccggtcacccccaacatagccgtcgaccgacccggcgccctcactccgggcttgcgagcgcacat

SEQ ID NO: 115074 - DNA, 75 bp, Artificial Sequence
  Synthetic
gtgctggctcccggtcacccccaacatagccgtcgaccgacccggcgccctcactccgggcttgcgtgcgcacat

SEQ ID NO: 115075 - DNA, 75 bp, Artificial Sequence
  Synthetic
gtgctggctcccggtcacccccaacatagccgtcgaccgacccggcgccctcactccgggcttgcgcgcgcacat

SEQ ID NO: 115076 - DNA, 75 bp, Artificial Sequence
  Synthetic
gtgctggctcccggtcacccccaacatagccgtcgaccgacccggcgccctcactccgggcttgcgggcgcacat

SEQ ID NO: 115077 - DNA, 75 bp, Artificial Sequence
  Synthetic
gtgctggctcccggtcacccccaacatagccgtggaccgacccggcgccctcactccgggcttgcgagcgcacat

SEQ ID NO: 115078 - DNA, 75 bp, Artificial Sequence
  Synthetic
gtgctggctcccggtcacccccaacatagccgtggaccgacccggcgccctcactccgggcttgcgtgcgcacat

SEQ ID NO: 115079 - DNA, 75 bp, Artificial Sequence
  Synthetic
gtgctggctcccggtcacccccaacatagccgtggaccgacccggcgccctcactccgggcttgcgcgcgcacat

SEQ ID NO: 115080 - DNA, 75 bp, Artificial Sequence
  Synthetic
gtgctggctcccggtcacccccaacatagccgtggaccgacccggcgccctcactccgggcttgcgggcgcacat

SEQ ID NO: 115081 - DNA, 75 bp, Artificial Sequence
  Synthetic
gtgctgggtcccggtcacccccaacatagccgtagaccgacccggcgccctcactccgggcttgcgagcgcacat

SEQ ID NO: 115082 - DNA, 75 bp, Artificial Sequence
  Synthetic
gtgctgggtcccggtcacccccaacatagccgtagaccgacccggcgccctcactccgggcttgcgtgcgcacat

SEQ ID NO: 115083 - DNA, 75 bp, Artificial Sequence
  Synthetic
gtgctgggtcccggtcacccccaacatagccgtagaccgacccggcgccctcactccgggcttgcgcgcgcacat

SEQ ID NO: 115084 - DNA, 75 bp, Artificial Sequence
  Synthetic
gtgctgggtcccggtcacccccaacatagccgtagaccgacccggcgccctcactccgggcttgcgggcgcacat

SEQ ID NO: 115085 - DNA, 75 bp, Artificial Sequence
  Synthetic
gtgctgggtcccggtcacccccaacatagccgttgaccgacccggcgccctcactccgggcttgcgagcgcacat

SEQ ID NO: 115086 - DNA, 75 bp, Artificial Sequence
  Synthetic
gtgctgggtcccggtcacccccaacatagccgttgaccgacccggcgccctcactccgggcttgcgtgcgcacat

SEQ ID NO: 115087 - DNA, 75 bp, Artificial Sequence
  Synthetic
gtgctgggtcccggtcacccccaacatagccgttgaccgacccggcgccctcactccgggcttgcgcgcgcacat

SEQ ID NO: 115088 - DNA, 75 bp, Artificial Sequence
  Synthetic
gtgctgggtcccggtcacccccaacatagccgttgaccgacccggcgccctcactccgggcttgcgggcgcacat

SEQ ID NO: 115089 - DNA, 75 bp, Artificial Sequence
  Synthetic
gtgctgggtcccggtcacccccaacatagccgtcgaccgacccggcgccctcactccgggcttgcgagcgcacat

SEQ ID NO: 115090 - DNA, 75 bp, Artificial Sequence
  Synthetic
gtgctgggtcccggtcacccccaacatagccgtcgaccgacccggcgccctcactccgggcttgcgtgcgcacat

SEQ ID NO: 115091 - DNA, 75 bp, Artificial Sequence
  Synthetic
gtgctgggtcccggtcacccccaacatagccgtcgaccgacccggcgccctcactccgggcttgcgcgcgcacat

SEQ ID NO: 115092 - DNA, 75 bp, Artificial Sequence
  Synthetic
gtgctgggtcccggtcacccccaacatagccgtcgaccgacccggcgccctcactccgggcttgcgggcgcacat

SEQ ID NO: 115093 - DNA, 75 bp, Artificial Sequence
  Synthetic
gtgctgggtcccggtcacccccaacatagccgtggaccgacccggcgccctcactccgggcttgcgagcgcacat

SEQ ID NO: 115094 - DNA, 75 bp, Artificial Sequence
  Synthetic
gtgctgggtcccggtcacccccaacatagccgtggaccgacccggcgccctcactccgggcttgcgtgcgcacat

SEQ ID NO: 115095 - DNA, 75 bp, Artificial Sequence
  Synthetic
gtgctgggtcccggtcacccccaacatagccgtggaccgacccggcgccctcactccgggcttgcgcgcgcacat

SEQ ID NO: 115096 - DNA, 75 bp, Artificial Sequence
  Synthetic
gtgctgggtcccggtcacccccaacatagccgtggaccgacccggcgccctcactccgggcttgcgggcgcacat

SEQ ID NO: 115097 - DNA, 75 bp, Artificial Sequence
  Synthetic
gcggcactcgccaacttggtcaccatcaacgccatttcggcggttggcactcacgggttccattacgccatcctt

SEQ ID NO: 115098 - DNA, 75 bp, Artificial Sequence
  Synthetic
tgtgtctccgacacactacgtgcccgagacggacgcgtcggccaaggtcacgcaactgctcagctccctcacagt

SEQ ID NO: 115099 - DNA, 75 bp, Artificial Sequence
  Synthetic
gtttcgggctgtgctctccctccgcagggtgtaccacccgtgccaccacctaggaggaagaaagttgtgcagctc

SEQ ID NO: 115100 - DNA, 75 bp, Artificial Sequence
  Synthetic
gaggggtgatggcatatgtcgcaccacctgcccatgtggggccgacatagtcggccatgtcaagaacgggtccat

SEQ ID NO: 115101 - DNA, 75 bp, Artificial Sequence
  Synthetic
cagcaccacacgtttgtacaggagtgcaaatgttccatatacccaggccatattacaggacaccgcatggcttgg

SEQ ID NO: 115102 - DNA, 75 bp, Artificial Sequence
  Synthetic
cagcaccacacgtttgtacaggagtgcaattgttccatatacccaggccatattacaggacaccgcatggcttgg

SEQ ID NO: 115103 - DNA, 75 bp, Artificial Sequence
  Synthetic
cagcaccacacgtttgtacaggagtgcaactgttccatatacccaggccatattacaggacaccgcatggcttgg

SEQ ID NO: 115104 - DNA, 75 bp, Artificial Sequence
  Synthetic
cagcaccacacgtttgtacaggagtgcaagtgttccatatacccaggccatattacaggacaccgcatggcttgg

SEQ ID NO: 115105 - DNA, 75 bp, Artificial Sequence
  Synthetic
cagcaccacacgtttgttcaggagtgcaaatgttccatatacccaggccatattacaggacaccgcatggcttgg

SEQ ID NO: 115106 - DNA, 75 bp, Artificial Sequence
  Synthetic
cagcaccacacgtttgttcaggagtgcaattgttccatatacccaggccatattacaggacaccgcatggcttgg

SEQ ID NO: 115107 - DNA, 75 bp, Artificial Sequence
  Synthetic
cagcaccacacgtttgttcaggagtgcaactgttccatatacccaggccatattacaggacaccgcatggcttgg

SEQ ID NO: 115108 - DNA, 75 bp, Artificial Sequence
  Synthetic
cagcaccacacgtttgttcaggagtgcaagtgttccatatacccaggccatattacaggacaccgcatggcttgg

SEQ ID NO: 115109 - DNA, 75 bp, Artificial Sequence
  Synthetic
cagcaccacacgtttgtccaggagtgcaaatgttccatatacccaggccatattacaggacaccgcatggcttgg

SEQ ID NO: 115110 - DNA, 75 bp, Artificial Sequence
  Synthetic
cagcaccacacgtttgtccaggagtgcaattgttccatatacccaggccatattacaggacaccgcatggcttgg

SEQ ID NO: 115111 - DNA, 75 bp, Artificial Sequence
  Synthetic
cagcaccacacgtttgtccaggagtgcaactgttccatatacccaggccatattacaggacaccgcatggcttgg

SEQ ID NO: 115112 - DNA, 75 bp, Artificial Sequence
  Synthetic
cagcaccacacgtttgtccaggagtgcaagtgttccatatacccaggccatattacaggacaccgcatggcttgg

SEQ ID NO: 115113 - DNA, 75 bp, Artificial Sequence
  Synthetic
cagcaccacacgtttgtgcaggagtgcaaatgttccatatacccaggccatattacaggacaccgcatggcttgg

SEQ ID NO: 115114 - DNA, 75 bp, Artificial Sequence
  Synthetic
cagcaccacacgtttgtgcaggagtgcaattgttccatatacccaggccatattacaggacaccgcatggcttgg

SEQ ID NO: 115115 - DNA, 75 bp, Artificial Sequence
  Synthetic
cagcaccacacgtttgtgcaggagtgcaactgttccatatacccaggccatattacaggacaccgcatggcttgg

SEQ ID NO: 115116 - DNA, 75 bp, Artificial Sequence
  Synthetic
cagcaccacacgtttgtgcaggagtgcaagtgttccatatacccaggccatattacaggacaccgcatggcttgg

SEQ ID NO: 115117 - DNA, 75 bp, Artificial Sequence
  Synthetic
ccgagagggcgttcgcctttgatggggaggtggctgggtctctgggaggcggcattgtggtcctattgaccatat

SEQ ID NO: 115118 - DNA, 75 bp, Artificial Sequence
  Synthetic
tgacaactccccacagtaacatagaggaggtggctcttggtcacgagggcgagatccctttttacggcaaggcta

SEQ ID NO: 115119 - DNA, 75 bp, Artificial Sequence
  Synthetic
ggccatttgggactgggtctgcacggcactgacagacttcaaagcctggttgcaggcaaaactcctcccgcaact

SEQ ID NO: 115120 - DNA, 75 bp, Artificial Sequence
  Synthetic
ttcccacctccactgaggcacagtcctccgatgacgtagagacggcatctgacgctggttcatacagctctatgc

SEQ ID NO: 115121 - DNA, 75 bp, Artificial Sequence
  Synthetic
ttcccacctccactgaggcacagtcctccgatgacgttgagacggcatctgacgctggttcatacagctctatgc

SEQ ID NO: 115122 - DNA, 75 bp, Artificial Sequence
  Synthetic
ttcccacctccactgaggcacagtcctccgatgacgtcgagacggcatctgacgctggttcatacagctctatgc

SEQ ID NO: 115123 - DNA, 75 bp, Artificial Sequence
  Synthetic
ttcccacctccactgaggcacagtcctccgatgacgtggagacggcatctgacgctggttcatacagctctatgc

SEQ ID NO: 115124 - DNA, 75 bp, Artificial Sequence
  Synthetic
ctccgatgacgtagagacggcatctgacgctggttcatacagctctatgccgccgttggagggggaacctggaga

SEQ ID NO: 115125 - DNA, 75 bp, Artificial Sequence
  Synthetic
ctccgatgacgtagagacggcatctgacgctggttcatacagctctatgccgccgttggagggggaacctggtga

SEQ ID NO: 115126 - DNA, 75 bp, Artificial Sequence
  Synthetic
ctccgatgacgtagagacggcatctgacgctggttcatacagctctatgccgccgttggagggggaacctggcga

SEQ ID NO: 115127 - DNA, 75 bp, Artificial Sequence
  Synthetic
ctccgatgacgtagagacggcatctgacgctggttcatacagctctatgccgccgttggagggggaacctgggga

SEQ ID NO: 115128 - DNA, 75 bp, Artificial Sequence
  Synthetic
ctccgatgacgttgagacggcatctgacgctggttcatacagctctatgccgccgttggagggggaacctggaga

SEQ ID NO: 115129 - DNA, 75 bp, Artificial Sequence
  Synthetic
ctccgatgacgttgagacggcatctgacgctggttcatacagctctatgccgccgttggagggggaacctggtga

SEQ ID NO: 115130 - DNA, 75 bp, Artificial Sequence
  Synthetic
ctccgatgacgttgagacggcatctgacgctggttcatacagctctatgccgccgttggagggggaacctggcga

SEQ ID NO: 115131 - DNA, 75 bp, Artificial Sequence
  Synthetic
ctccgatgacgttgagacggcatctgacgctggttcatacagctctatgccgccgttggagggggaacctgggga

SEQ ID NO: 115132 - DNA, 75 bp, Artificial Sequence
  Synthetic
ctccgatgacgtcgagacggcatctgacgctggttcatacagctctatgccgccgttggagggggaacctggaga

SEQ ID NO: 115133 - DNA, 75 bp, Artificial Sequence
  Synthetic
ctccgatgacgtcgagacggcatctgacgctggttcatacagctctatgccgccgttggagggggaacctggtga

SEQ ID NO: 115134 - DNA, 75 bp, Artificial Sequence
  Synthetic
ctccgatgacgtcgagacggcatctgacgctggttcatacagctctatgccgccgttggagggggaacctggcga

SEQ ID NO: 115135 - DNA, 75 bp, Artificial Sequence
  Synthetic
ctccgatgacgtcgagacggcatctgacgctggttcatacagctctatgccgccgttggagggggaacctgggga

SEQ ID NO: 115136 - DNA, 75 bp, Artificial Sequence
  Synthetic
ctccgatgacgtggagacggcatctgacgctggttcatacagctctatgccgccgttggagggggaacctggaga

SEQ ID NO: 115137 - DNA, 75 bp, Artificial Sequence
  Synthetic
ctccgatgacgtggagacggcatctgacgctggttcatacagctctatgccgccgttggagggggaacctggtga

SEQ ID NO: 115138 - DNA, 75 bp, Artificial Sequence
  Synthetic
ctccgatgacgtggagacggcatctgacgctggttcatacagctctatgccgccgttggagggggaacctggcga

SEQ ID NO: 115139 - DNA, 75 bp, Artificial Sequence
  Synthetic
ctccgatgacgtggagacggcatctgacgctggttcatacagctctatgccgccgttggagggggaacctgggga

SEQ ID NO: 115140 - DNA, 75 bp, Artificial Sequence
  Synthetic
gcgtgatgtttggtctggcttacttcgccatgcagggagcgtgggcaaaggtcgtcgtcatccttttgttgaccg

SEQ ID NO: 115141 - DNA, 75 bp, Artificial Sequence
  Synthetic
atctttgaacgttaggggtccccgggactccgtaatcatccttatggccctatgtcaccctcacctggtctttga

SEQ ID NO: 115142 - DNA, 75 bp, Artificial Sequence
  Synthetic
atctttgaacgttaggggtccccgggactccgtaatcatccttatggccctttgtcaccctcacctggtctttga

SEQ ID NO: 115143 - DNA, 75 bp, Artificial Sequence
  Synthetic
atctttgaacgttaggggtccccgggactccgtaatcatccttatggccctctgtcaccctcacctggtctttga

SEQ ID NO: 115144 - DNA, 75 bp, Artificial Sequence
  Synthetic
atctttgaacgttaggggtccccgggactccgtaatcatccttatggccctgtgtcaccctcacctggtctttga

SEQ ID NO: 115145 - DNA, 75 bp, Artificial Sequence
  Synthetic
gtgtccgtgcggagcgacgatatctggccacgtgaagaacggaaccatgagaatcgtcggcccaaagatgtgcag

SEQ ID NO: 115146 - DNA, 75 bp, Artificial Sequence
  Synthetic
atgagggctgtgggtgggcagggtggctcctgtccccccgcggctctcggccgtcttggggcccaaatgatcccc

SEQ ID NO: 115147 - DNA, 75 bp, Artificial Sequence
  Synthetic
ccctgcgccgcagaggaggagaagttgcccatcagtccactgagcaactccctcattcgccaccacaacctggta

SEQ ID NO: 115148 - DNA, 75 bp, Artificial Sequence
  Synthetic
gctcattaacaccaatggcagttggcacatcaatcgcacggccctgaactgcaacgacagtcttcaaaccggctt

SEQ ID NO: 115149 - DNA, 75 bp, Artificial Sequence
  Synthetic
gcttgcgcacttgtgcgcgggctgctgtacggcaagtagatacaaatggccctgttaaagatgggggcctacact

SEQ ID NO: 115150 - DNA, 75 bp, Artificial Sequence
  Synthetic
gcttgcgcacttgtgcgcgggctgctgtacggcaagtagatacaaatggccctgttaaagttgggggcctacact

SEQ ID NO: 115151 - DNA, 75 bp, Artificial Sequence
  Synthetic
gcttgcgcacttgtgcgcgggctgctgtacggcaagtagatacaaatggccctgttaaagctgggggcctacact

SEQ ID NO: 115152 - DNA, 75 bp, Artificial Sequence
  Synthetic
gcttgcgcacttgtgcgcgggctgctgtacggcaagtagatacaaatggccctgttaaaggtgggggcctacact

SEQ ID NO: 115153 - DNA, 75 bp, Artificial Sequence
  Synthetic
gcttgcgcacttgtgcgcgggctgctgtacggcaagtagattcaaatggccctgttaaagatgggggcctacact

SEQ ID NO: 115154 - DNA, 75 bp, Artificial Sequence
  Synthetic
gcttgcgcacttgtgcgcgggctgctgtacggcaagtagattcaaatggccctgttaaagttgggggcctacact

SEQ ID NO: 115155 - DNA, 75 bp, Artificial Sequence
  Synthetic
gcttgcgcacttgtgcgcgggctgctgtacggcaagtagattcaaatggccctgttaaagctgggggcctacact

SEQ ID NO: 115156 - DNA, 75 bp, Artificial Sequence
  Synthetic
gcttgcgcacttgtgcgcgggctgctgtacggcaagtagattcaaatggccctgttaaaggtgggggcctacact

SEQ ID NO: 115157 - DNA, 75 bp, Artificial Sequence
  Synthetic
gcttgcgcacttgtgcgcgggctgctgtacggcaagtagatccaaatggccctgttaaagatgggggcctacact

SEQ ID NO: 115158 - DNA, 75 bp, Artificial Sequence
  Synthetic
gcttgcgcacttgtgcgcgggctgctgtacggcaagtagatccaaatggccctgttaaagttgggggcctacact

SEQ ID NO: 115159 - DNA, 75 bp, Artificial Sequence
  Synthetic
gcttgcgcacttgtgcgcgggctgctgtacggcaagtagatccaaatggccctgttaaagctgggggcctacact

SEQ ID NO: 115160 - DNA, 75 bp, Artificial Sequence
  Synthetic
gcttgcgcacttgtgcgcgggctgctgtacggcaagtagatccaaatggccctgttaaaggtgggggcctacact

SEQ ID NO: 115161 - DNA, 75 bp, Artificial Sequence
  Synthetic
gcttgcgcacttgtgcgcgggctgctgtacggcaagtagatgcaaatggccctgttaaagatgggggcctacact

SEQ ID NO: 115162 - DNA, 75 bp, Artificial Sequence
  Synthetic
gcttgcgcacttgtgcgcgggctgctgtacggcaagtagatgcaaatggccctgttaaagttgggggcctacact

SEQ ID NO: 115163 - DNA, 75 bp, Artificial Sequence
  Synthetic
gcttgcgcacttgtgcgcgggctgctgtacggcaagtagatgcaaatggccctgttaaagctgggggcctacact

SEQ ID NO: 115164 - DNA, 75 bp, Artificial Sequence
  Synthetic
gcttgcgcacttgtgcgcgggctgctgtacggcaagtagatgcaaatggccctgttaaaggtgggggcctacact

SEQ ID NO: 115165 - DNA, 75 bp, Artificial Sequence
  Synthetic
gcttgcgcacttgtgcgcgggctgctgttcggcaagtagatacaaatggccctgttaaagatgggggcctacact

SEQ ID NO: 115166 - DNA, 75 bp, Artificial Sequence
  Synthetic
gcttgcgcacttgtgcgcgggctgctgttcggcaagtagatacaaatggccctgttaaagttgggggcctacact

SEQ ID NO: 115167 - DNA, 75 bp, Artificial Sequence
  Synthetic
gcttgcgcacttgtgcgcgggctgctgttcggcaagtagatacaaatggccctgttaaagctgggggcctacact

SEQ ID NO: 115168 - DNA, 75 bp, Artificial Sequence
  Synthetic
gcttgcgcacttgtgcgcgggctgctgttcggcaagtagatacaaatggccctgttaaaggtgggggcctacact

SEQ ID NO: 115169 - DNA, 75 bp, Artificial Sequence
  Synthetic
gcttgcgcacttgtgcgcgggctgctgttcggcaagtagattcaaatggccctgttaaagatgggggcctacact

SEQ ID NO: 115170 - DNA, 75 bp, Artificial Sequence
  Synthetic
gcttgcgcacttgtgcgcgggctgctgttcggcaagtagattcaaatggccctgttaaagttgggggcctacact

SEQ ID NO: 115171 - DNA, 75 bp, Artificial Sequence
  Synthetic
gcttgcgcacttgtgcgcgggctgctgttcggcaagtagattcaaatggccctgttaaagctgggggcctacact

SEQ ID NO: 115172 - DNA, 75 bp, Artificial Sequence
  Synthetic
gcttgcgcacttgtgcgcgggctgctgttcggcaagtagattcaaatggccctgttaaaggtgggggcctacact

SEQ ID NO: 115173 - DNA, 75 bp, Artificial Sequence
  Synthetic
gcttgcgcacttgtgcgcgggctgctgttcggcaagtagatccaaatggccctgttaaagatgggggcctacact

SEQ ID NO: 115174 - DNA, 75 bp, Artificial Sequence
  Synthetic
gcttgcgcacttgtgcgcgggctgctgttcggcaagtagatccaaatggccctgttaaagttgggggcctacact

SEQ ID NO: 115175 - DNA, 75 bp, Artificial Sequence
  Synthetic
gcttgcgcacttgtgcgcgggctgctgttcggcaagtagatccaaatggccctgttaaagctgggggcctacact

SEQ ID NO: 115176 - DNA, 75 bp, Artificial Sequence
  Synthetic
gcttgcgcacttgtgcgcgggctgctgttcggcaagtagatccaaatggccctgttaaaggtgggggcctacact

SEQ ID NO: 115177 - DNA, 75 bp, Artificial Sequence
  Synthetic
gcttgcgcacttgtgcgcgggctgctgttcggcaagtagatgcaaatggccctgttaaagatgggggcctacact

SEQ ID NO: 115178 - DNA, 75 bp, Artificial Sequence
  Synthetic
gcttgcgcacttgtgcgcgggctgctgttcggcaagtagatgcaaatggccctgttaaagttgggggcctacact

SEQ ID NO: 115179 - DNA, 75 bp, Artificial Sequence
  Synthetic
gcttgcgcacttgtgcgcgggctgctgttcggcaagtagatgcaaatggccctgttaaagctgggggcctacact

SEQ ID NO: 115180 - DNA, 75 bp, Artificial Sequence
  Synthetic
gcttgcgcacttgtgcgcgggctgctgttcggcaagtagatgcaaatggccctgttaaaggtgggggcctacact

SEQ ID NO: 115181 - DNA, 75 bp, Artificial Sequence
  Synthetic
gcttgcgcacttgtgcgcgggctgctgtccggcaagtagatacaaatggccctgttaaagatgggggcctacact

SEQ ID NO: 115182 - DNA, 75 bp, Artificial Sequence
  Synthetic
gcttgcgcacttgtgcgcgggctgctgtccggcaagtagatacaaatggccctgttaaagttgggggcctacact

SEQ ID NO: 115183 - DNA, 75 bp, Artificial Sequence
  Synthetic
gcttgcgcacttgtgcgcgggctgctgtccggcaagtagatacaaatggccctgttaaagctgggggcctacact

SEQ ID NO: 115184 - DNA, 75 bp, Artificial Sequence
  Synthetic
gcttgcgcacttgtgcgcgggctgctgtccggcaagtagatacaaatggccctgttaaaggtgggggcctacact

SEQ ID NO: 115185 - DNA, 75 bp, Artificial Sequence
  Synthetic
gcttgcgcacttgtgcgcgggctgctgtccggcaagtagattcaaatggccctgttaaagatgggggcctacact

SEQ ID NO: 115186 - DNA, 75 bp, Artificial Sequence
  Synthetic
gcttgcgcacttgtgcgcgggctgctgtccggcaagtagattcaaatggccctgttaaagttgggggcctacact

SEQ ID NO: 115187 - DNA, 75 bp, Artificial Sequence
  Synthetic
gcttgcgcacttgtgcgcgggctgctgtccggcaagtagattcaaatggccctgttaaagctgggggcctacact

SEQ ID NO: 115188 - DNA, 75 bp, Artificial Sequence
  Synthetic
gcttgcgcacttgtgcgcgggctgctgtccggcaagtagattcaaatggccctgttaaaggtgggggcctacact

SEQ ID NO: 115189 - DNA, 75 bp, Artificial Sequence
  Synthetic
gcttgcgcacttgtgcgcgggctgctgtccggcaagtagatccaaatggccctgttaaagatgggggcctacact

SEQ ID NO: 115190 - DNA, 75 bp, Artificial Sequence
  Synthetic
gcttgcgcacttgtgcgcgggctgctgtccggcaagtagatccaaatggccctgttaaagttgggggcctacact

SEQ ID NO: 115191 - DNA, 75 bp, Artificial Sequence
  Synthetic
gcttgcgcacttgtgcgcgggctgctgtccggcaagtagatccaaatggccctgttaaagctgggggcctacact

SEQ ID NO: 115192 - DNA, 75 bp, Artificial Sequence
  Synthetic
gcttgcgcacttgtgcgcgggctgctgtccggcaagtagatccaaatggccctgttaaaggtgggggcctacact

SEQ ID NO: 115193 - DNA, 75 bp, Artificial Sequence
  Synthetic
gcttgcgcacttgtgcgcgggctgctgtccggcaagtagatgcaaatggccctgttaaagatgggggcctacact

SEQ ID NO: 115194 - DNA, 75 bp, Artificial Sequence
  Synthetic
gcttgcgcacttgtgcgcgggctgctgtccggcaagtagatgcaaatggccctgttaaagttgggggcctacact

SEQ ID NO: 115195 - DNA, 75 bp, Artificial Sequence
  Synthetic
gcttgcgcacttgtgcgcgggctgctgtccggcaagtagatgcaaatggccctgttaaagctgggggcctacact

SEQ ID NO: 115196 - DNA, 75 bp, Artificial Sequence
  Synthetic
gcttgcgcacttgtgcgcgggctgctgtccggcaagtagatgcaaatggccctgttaaaggtgggggcctacact

SEQ ID NO: 115197 - DNA, 75 bp, Artificial Sequence
  Synthetic
gcttgcgcacttgtgcgcgggctgctgtgcggcaagtagatacaaatggccctgttaaagatgggggcctacact

SEQ ID NO: 115198 - DNA, 75 bp, Artificial Sequence
  Synthetic
gcttgcgcacttgtgcgcgggctgctgtgcggcaagtagatacaaatggccctgttaaagttgggggcctacact

SEQ ID NO: 115199 - DNA, 75 bp, Artificial Sequence
  Synthetic
gcttgcgcacttgtgcgcgggctgctgtgcggcaagtagatacaaatggccctgttaaagctgggggcctacact

SEQ ID NO: 115200 - DNA, 75 bp, Artificial Sequence
  Synthetic
gcttgcgcacttgtgcgcgggctgctgtgcggcaagtagatacaaatggccctgttaaaggtgggggcctacact

SEQ ID NO: 115201 - DNA, 75 bp, Artificial Sequence
  Synthetic
gcttgcgcacttgtgcgcgggctgctgtgcggcaagtagattcaaatggccctgttaaagatgggggcctacact

SEQ ID NO: 115202 - DNA, 75 bp, Artificial Sequence
  Synthetic
gcttgcgcacttgtgcgcgggctgctgtgcggcaagtagattcaaatggccctgttaaagttgggggcctacact

SEQ ID NO: 115203 - DNA, 75 bp, Artificial Sequence
  Synthetic
gcttgcgcacttgtgcgcgggctgctgtgcggcaagtagattcaaatggccctgttaaagctgggggcctacact

SEQ ID NO: 115204 - DNA, 75 bp, Artificial Sequence
  Synthetic
gcttgcgcacttgtgcgcgggctgctgtgcggcaagtagattcaaatggccctgttaaaggtgggggcctacact

SEQ ID NO: 115205 - DNA, 75 bp, Artificial Sequence
  Synthetic
gcttgcgcacttgtgcgcgggctgctgtgcggcaagtagatccaaatggccctgttaaagatgggggcctacact

SEQ ID NO: 115206 - DNA, 75 bp, Artificial Sequence
  Synthetic
gcttgcgcacttgtgcgcgggctgctgtgcggcaagtagatccaaatggccctgttaaagttgggggcctacact

SEQ ID NO: 115207 - DNA, 75 bp, Artificial Sequence
  Synthetic
gcttgcgcacttgtgcgcgggctgctgtgcggcaagtagatccaaatggccctgttaaagctgggggcctacact

SEQ ID NO: 115208 - DNA, 75 bp, Artificial Sequence
  Synthetic
gcttgcgcacttgtgcgcgggctgctgtgcggcaagtagatccaaatggccctgttaaaggtgggggcctacact

SEQ ID NO: 115209 - DNA, 75 bp, Artificial Sequence
  Synthetic
gcttgcgcacttgtgcgcgggctgctgtgcggcaagtagatgcaaatggccctgttaaagatgggggcctacact

SEQ ID NO: 115210 - DNA, 75 bp, Artificial Sequence
  Synthetic
gcttgcgcacttgtgcgcgggctgctgtgcggcaagtagatgcaaatggccctgttaaagttgggggcctacact

SEQ ID NO: 115211 - DNA, 75 bp, Artificial Sequence
  Synthetic
gcttgcgcacttgtgcgcgggctgctgtgcggcaagtagatgcaaatggccctgttaaagctgggggcctacact

SEQ ID NO: 115212 - DNA, 75 bp, Artificial Sequence
  Synthetic
gcttgcgcacttgtgcgcgggctgctgtgcggcaagtagatgcaaatggccctgttaaaggtgggggcctacact

SEQ ID NO: 115213 - DNA, 75 bp, Artificial Sequence
  Synthetic
tactccacaacatcacggagtgcctctctccgccaaaagaaggtgaccttcgaccgggtccagctgctggaccaa

SEQ ID NO: 115214 - DNA, 75 bp, Artificial Sequence
  Synthetic
tgtccggcaagtaaatacaaatggccctgttaaagatgggggcctacactggcacatacatctatgaccacctag

SEQ ID NO: 115215 - DNA, 75 bp, Artificial Sequence
  Synthetic
tgtccggcaagtaaatacaaatggccctgttaaagttgggggcctacactggcacatacatctatgaccacctag

SEQ ID NO: 115216 - DNA, 75 bp, Artificial Sequence
  Synthetic
tgtccggcaagtaaatacaaatggccctgttaaagctgggggcctacactggcacatacatctatgaccacctag

SEQ ID NO: 115217 - DNA, 75 bp, Artificial Sequence
  Synthetic
tgtccggcaagtaaatacaaatggccctgttaaaggtgggggcctacactggcacatacatctatgaccacctag

SEQ ID NO: 115218 - DNA, 75 bp, Artificial Sequence
  Synthetic
tgtccggcaagtaaattcaaatggccctgttaaagatgggggcctacactggcacatacatctatgaccacctag

SEQ ID NO: 115219 - DNA, 75 bp, Artificial Sequence
  Synthetic
tgtccggcaagtaaattcaaatggccctgttaaagttgggggcctacactggcacatacatctatgaccacctag

SEQ ID NO: 115220 - DNA, 75 bp, Artificial Sequence
  Synthetic
tgtccggcaagtaaattcaaatggccctgttaaagctgggggcctacactggcacatacatctatgaccacctag

SEQ ID NO: 115221 - DNA, 75 bp, Artificial Sequence
  Synthetic
tgtccggcaagtaaattcaaatggccctgttaaaggtgggggcctacactggcacatacatctatgaccacctag

SEQ ID NO: 115222 - DNA, 75 bp, Artificial Sequence
  Synthetic
tgtccggcaagtaaatccaaatggccctgttaaagatgggggcctacactggcacatacatctatgaccacctag

SEQ ID NO: 115223 - DNA, 75 bp, Artificial Sequence
  Synthetic
tgtccggcaagtaaatccaaatggccctgttaaagttgggggcctacactggcacatacatctatgaccacctag

SEQ ID NO: 115224 - DNA, 75 bp, Artificial Sequence
  Synthetic
tgtccggcaagtaaatccaaatggccctgttaaagctgggggcctacactggcacatacatctatgaccacctag

SEQ ID NO: 115225 - DNA, 75 bp, Artificial Sequence
  Synthetic
tgtccggcaagtaaatccaaatggccctgttaaaggtgggggcctacactggcacatacatctatgaccacctag

SEQ ID NO: 115226 - DNA, 75 bp, Artificial Sequence
  Synthetic
tgtccggcaagtaaatgcaaatggccctgttaaagatgggggcctacactggcacatacatctatgaccacctag

SEQ ID NO: 115227 - DNA, 75 bp, Artificial Sequence
  Synthetic
tgtccggcaagtaaatgcaaatggccctgttaaagttgggggcctacactggcacatacatctatgaccacctag

SEQ ID NO: 115228 - DNA, 75 bp, Artificial Sequence
  Synthetic
tgtccggcaagtaaatgcaaatggccctgttaaagctgggggcctacactggcacatacatctatgaccacctag

SEQ ID NO: 115229 - DNA, 75 bp, Artificial Sequence
  Synthetic
tgtccggcaagtaaatgcaaatggccctgttaaaggtgggggcctacactggcacatacatctatgaccacctag

SEQ ID NO: 115230 - DNA, 75 bp, Artificial Sequence
  Synthetic
tgtccggcaagtatatacaaatggccctgttaaagatgggggcctacactggcacatacatctatgaccacctag

SEQ ID NO: 115231 - DNA, 75 bp, Artificial Sequence
  Synthetic
tgtccggcaagtatatacaaatggccctgttaaagttgggggcctacactggcacatacatctatgaccacctag

SEQ ID NO: 115232 - DNA, 75 bp, Artificial Sequence
  Synthetic
tgtccggcaagtatatacaaatggccctgttaaagctgggggcctacactggcacatacatctatgaccacctag

SEQ ID NO: 115233 - DNA, 75 bp, Artificial Sequence
  Synthetic
tgtccggcaagtatatacaaatggccctgttaaaggtgggggcctacactggcacatacatctatgaccacctag

SEQ ID NO: 115234 - DNA, 75 bp, Artificial Sequence
  Synthetic
tgtccggcaagtatattcaaatggccctgttaaagatgggggcctacactggcacatacatctatgaccacctag

SEQ ID NO: 115235 - DNA, 75 bp, Artificial Sequence
  Synthetic
tgtccggcaagtatattcaaatggccctgttaaagttgggggcctacactggcacatacatctatgaccacctag

SEQ ID NO: 115236 - DNA, 75 bp, Artificial Sequence
  Synthetic
tgtccggcaagtatattcaaatggccctgttaaagctgggggcctacactggcacatacatctatgaccacctag

SEQ ID NO: 115237 - DNA, 75 bp, Artificial Sequence
  Synthetic
tgtccggcaagtatattcaaatggccctgttaaaggtgggggcctacactggcacatacatctatgaccacctag

SEQ ID NO: 115238 - DNA, 75 bp, Artificial Sequence
  Synthetic
tgtccggcaagtatatccaaatggccctgttaaagatgggggcctacactggcacatacatctatgaccacctag

SEQ ID NO: 115239 - DNA, 75 bp, Artificial Sequence
  Synthetic
tgtccggcaagtatatccaaatggccctgttaaagttgggggcctacactggcacatacatctatgaccacctag

SEQ ID NO: 115240 - DNA, 75 bp, Artificial Sequence
  Synthetic
tgtccggcaagtatatccaaatggccctgttaaagctgggggcctacactggcacatacatctatgaccacctag

SEQ ID NO: 115241 - DNA, 75 bp, Artificial Sequence
  Synthetic
tgtccggcaagtatatccaaatggccctgttaaaggtgggggcctacactggcacatacatctatgaccacctag

SEQ ID NO: 115242 - DNA, 75 bp, Artificial Sequence
  Synthetic
tgtccggcaagtatatgcaaatggccctgttaaagatgggggcctacactggcacatacatctatgaccacctag

SEQ ID NO: 115243 - DNA, 75 bp, Artificial Sequence
  Synthetic
tgtccggcaagtatatgcaaatggccctgttaaagttgggggcctacactggcacatacatctatgaccacctag

SEQ ID NO: 115244 - DNA, 75 bp, Artificial Sequence
  Synthetic
tgtccggcaagtatatgcaaatggccctgttaaagctgggggcctacactggcacatacatctatgaccacctag

SEQ ID NO: 115245 - DNA, 75 bp, Artificial Sequence
  Synthetic
tgtccggcaagtatatgcaaatggccctgttaaaggtgggggcctacactggcacatacatctatgaccacctag

SEQ ID NO: 115246 - DNA, 75 bp, Artificial Sequence
  Synthetic
tgtccggcaagtacatacaaatggccctgttaaagatgggggcctacactggcacatacatctatgaccacctag

SEQ ID NO: 115247 - DNA, 75 bp, Artificial Sequence
  Synthetic
tgtccggcaagtacatacaaatggccctgttaaagttgggggcctacactggcacatacatctatgaccacctag

SEQ ID NO: 115248 - DNA, 75 bp, Artificial Sequence
  Synthetic
tgtccggcaagtacatacaaatggccctgttaaagctgggggcctacactggcacatacatctatgaccacctag

SEQ ID NO: 115249 - DNA, 75 bp, Artificial Sequence
  Synthetic
tgtccggcaagtacatacaaatggccctgttaaaggtgggggcctacactggcacatacatctatgaccacctag

SEQ ID NO: 115250 - DNA, 75 bp, Artificial Sequence
  Synthetic
tgtccggcaagtacattcaaatggccctgttaaagatgggggcctacactggcacatacatctatgaccacctag

SEQ ID NO: 115251 - DNA, 75 bp, Artificial Sequence
  Synthetic
tgtccggcaagtacattcaaatggccctgttaaagttgggggcctacactggcacatacatctatgaccacctag

SEQ ID NO: 115252 - DNA, 75 bp, Artificial Sequence
  Synthetic
tgtccggcaagtacattcaaatggccctgttaaagctgggggcctacactggcacatacatctatgaccacctag

SEQ ID NO: 115253 - DNA, 75 bp, Artificial Sequence
  Synthetic
tgtccggcaagtacattcaaatggccctgttaaaggtgggggcctacactggcacatacatctatgaccacctag

SEQ ID NO: 115254 - DNA, 75 bp, Artificial Sequence
  Synthetic
tgtccggcaagtacatccaaatggccctgttaaagatgggggcctacactggcacatacatctatgaccacctag

SEQ ID NO: 115255 - DNA, 75 bp, Artificial Sequence
  Synthetic
tgtccggcaagtacatccaaatggccctgttaaagttgggggcctacactggcacatacatctatgaccacctag

SEQ ID NO: 115256 - DNA, 75 bp, Artificial Sequence
  Synthetic
tgtccggcaagtacatccaaatggccctgttaaagctgggggcctacactggcacatacatctatgaccacctag

SEQ ID NO: 115257 - DNA, 75 bp, Artificial Sequence
  Synthetic
tgtccggcaagtacatccaaatggccctgttaaaggtgggggcctacactggcacatacatctatgaccacctag

SEQ ID NO: 115258 - DNA, 75 bp, Artificial Sequence
  Synthetic
tgtccggcaagtacatgcaaatggccctgttaaagatgggggcctacactggcacatacatctatgaccacctag

SEQ ID NO: 115259 - DNA, 75 bp, Artificial Sequence
  Synthetic
tgtccggcaagtacatgcaaatggccctgttaaagttgggggcctacactggcacatacatctatgaccacctag

SEQ ID NO: 115260 - DNA, 75 bp, Artificial Sequence
  Synthetic
tgtccggcaagtacatgcaaatggccctgttaaagctgggggcctacactggcacatacatctatgaccacctag

SEQ ID NO: 115261 - DNA, 75 bp, Artificial Sequence
  Synthetic
tgtccggcaagtacatgcaaatggccctgttaaaggtgggggcctacactggcacatacatctatgaccacctag

SEQ ID NO: 115262 - DNA, 75 bp, Artificial Sequence
  Synthetic
tgtccggcaagtagatacaaatggccctgttaaagatgggggcctacactggcacatacatctatgaccacctag

SEQ ID NO: 115263 - DNA, 75 bp, Artificial Sequence
  Synthetic
tgtccggcaagtagatacaaatggccctgttaaagttgggggcctacactggcacatacatctatgaccacctag

SEQ ID NO: 115264 - DNA, 75 bp, Artificial Sequence
  Synthetic
tgtccggcaagtagatacaaatggccctgttaaagctgggggcctacactggcacatacatctatgaccacctag

SEQ ID NO: 115265 - DNA, 75 bp, Artificial Sequence
  Synthetic
tgtccggcaagtagatacaaatggccctgttaaaggtgggggcctacactggcacatacatctatgaccacctag

SEQ ID NO: 115266 - DNA, 75 bp, Artificial Sequence
  Synthetic
tgtccggcaagtagattcaaatggccctgttaaagatgggggcctacactggcacatacatctatgaccacctag

SEQ ID NO: 115267 - DNA, 75 bp, Artificial Sequence
  Synthetic
tgtccggcaagtagattcaaatggccctgttaaagttgggggcctacactggcacatacatctatgaccacctag

SEQ ID NO: 115268 - DNA, 75 bp, Artificial Sequence
  Synthetic
tgtccggcaagtagattcaaatggccctgttaaagctgggggcctacactggcacatacatctatgaccacctag

SEQ ID NO: 115269 - DNA, 75 bp, Artificial Sequence
  Synthetic
tgtccggcaagtagattcaaatggccctgttaaaggtgggggcctacactggcacatacatctatgaccacctag

SEQ ID NO: 115270 - DNA, 75 bp, Artificial Sequence
  Synthetic
tgtccggcaagtagatccaaatggccctgttaaagatgggggcctacactggcacatacatctatgaccacctag

SEQ ID NO: 115271 - DNA, 75 bp, Artificial Sequence
  Synthetic
tgtccggcaagtagatccaaatggccctgttaaagttgggggcctacactggcacatacatctatgaccacctag

SEQ ID NO: 115272 - DNA, 75 bp, Artificial Sequence
  Synthetic
tgtccggcaagtagatccaaatggccctgttaaagctgggggcctacactggcacatacatctatgaccacctag

SEQ ID NO: 115273 - DNA, 75 bp, Artificial Sequence
  Synthetic
tgtccggcaagtagatccaaatggccctgttaaaggtgggggcctacactggcacatacatctatgaccacctag

SEQ ID NO: 115274 - DNA, 75 bp, Artificial Sequence
  Synthetic
tgtccggcaagtagatgcaaatggccctgttaaagatgggggcctacactggcacatacatctatgaccacctag

SEQ ID NO: 115275 - DNA, 75 bp, Artificial Sequence
  Synthetic
tgtccggcaagtagatgcaaatggccctgttaaagttgggggcctacactggcacatacatctatgaccacctag

SEQ ID NO: 115276 - DNA, 75 bp, Artificial Sequence
  Synthetic
tgtccggcaagtagatgcaaatggccctgttaaagctgggggcctacactggcacatacatctatgaccacctag

SEQ ID NO: 115277 - DNA, 75 bp, Artificial Sequence
  Synthetic
tgtccggcaagtagatgcaaatggccctgttaaaggtgggggcctacactggcacatacatctatgaccacctag

SEQ ID NO: 115278 - DNA, 75 bp, Artificial Sequence
  Synthetic
ctctccgccaaaagaaggtgaccttcgaccgggtccagctgctggaccaacactacaatgatgtccttaaggaga

SEQ ID NO: 115279 - DNA, 75 bp, Artificial Sequence
  Synthetic
agttctttacggagctggatggcgtgaggattcatcgcttcgcgccgccctgcgcccccctcctaagggaggagg

SEQ ID NO: 115280 - DNA, 75 bp, Artificial Sequence
  Synthetic
tccctaaagaatgaggagaatgtcactaatgatgcagatatgagaccgtactgctggcattaccctccaaaacca

SEQ ID NO: 115281 - DNA, 75 bp, Artificial Sequence
  Synthetic
tccctaaagaatgaggagaatgtcactaatgatgcagatatgagaccgtactgctggcattaccctcctaaacca

SEQ ID NO: 115282 - DNA, 75 bp, Artificial Sequence
  Synthetic
tccctaaagaatgaggagaatgtcactaatgatgcagatatgagaccgtactgctggcattaccctcccaaacca

SEQ ID NO: 115283 - DNA, 75 bp, Artificial Sequence
  Synthetic
tccctaaagaatgaggagaatgtcactaatgatgcagatatgagaccgtactgctggcattaccctccgaaacca

SEQ ID NO: 115284 - DNA, 75 bp, Artificial Sequence
  Synthetic
tccctaaagtatgaggagaatgtcactaatgatgcagatatgagaccgtactgctggcattaccctccaaaacca

SEQ ID NO: 115285 - DNA, 75 bp, Artificial Sequence
  Synthetic
tccctaaagtatgaggagaatgtcactaatgatgcagatatgagaccgtactgctggcattaccctcctaaacca

SEQ ID NO: 115286 - DNA, 75 bp, Artificial Sequence
  Synthetic
tccctaaagtatgaggagaatgtcactaatgatgcagatatgagaccgtactgctggcattaccctcccaaacca

SEQ ID NO: 115287 - DNA, 75 bp, Artificial Sequence
  Synthetic
tccctaaagtatgaggagaatgtcactaatgatgcagatatgagaccgtactgctggcattaccctccgaaacca

SEQ ID NO: 115288 - DNA, 75 bp, Artificial Sequence
  Synthetic
tccctaaagcatgaggagaatgtcactaatgatgcagatatgagaccgtactgctggcattaccctccaaaacca

SEQ ID NO: 115289 - DNA, 75 bp, Artificial Sequence
  Synthetic
tccctaaagcatgaggagaatgtcactaatgatgcagatatgagaccgtactgctggcattaccctcctaaacca

SEQ ID NO: 115290 - DNA, 75 bp, Artificial Sequence
  Synthetic
tccctaaagcatgaggagaatgtcactaatgatgcagatatgagaccgtactgctggcattaccctcccaaacca

SEQ ID NO: 115291 - DNA, 75 bp, Artificial Sequence
  Synthetic
tccctaaagcatgaggagaatgtcactaatgatgcagatatgagaccgtactgctggcattaccctccgaaacca

SEQ ID NO: 115292 - DNA, 75 bp, Artificial Sequence
  Synthetic
tccctaaaggatgaggagaatgtcactaatgatgcagatatgagaccgtactgctggcattaccctccaaaacca

SEQ ID NO: 115293 - DNA, 75 bp, Artificial Sequence
  Synthetic
tccctaaaggatgaggagaatgtcactaatgatgcagatatgagaccgtactgctggcattaccctcctaaacca

SEQ ID NO: 115294 - DNA, 75 bp, Artificial Sequence
  Synthetic
tccctaaaggatgaggagaatgtcactaatgatgcagatatgagaccgtactgctggcattaccctcccaaacca

SEQ ID NO: 115295 - DNA, 75 bp, Artificial Sequence
  Synthetic
tccctaaaggatgaggagaatgtcactaatgatgcagatatgagaccgtactgctggcattaccctccgaaacca

SEQ ID NO: 115296 - DNA, 75 bp, Artificial Sequence
  Synthetic
tcccttaagaatgaggagaatgtcactaatgatgcagatatgagaccgtactgctggcattaccctccaaaacca

SEQ ID NO: 115297 - DNA, 75 bp, Artificial Sequence
  Synthetic
tcccttaagaatgaggagaatgtcactaatgatgcagatatgagaccgtactgctggcattaccctcctaaacca

SEQ ID NO: 115298 - DNA, 75 bp, Artificial Sequence
  Synthetic
tcccttaagaatgaggagaatgtcactaatgatgcagatatgagaccgtactgctggcattaccctcccaaacca

SEQ ID NO: 115299 - DNA, 75 bp, Artificial Sequence
  Synthetic
tcccttaagaatgaggagaatgtcactaatgatgcagatatgagaccgtactgctggcattaccctccgaaacca

SEQ ID NO: 115300 - DNA, 75 bp, Artificial Sequence
  Synthetic
tcccttaagtatgaggagaatgtcactaatgatgcagatatgagaccgtactgctggcattaccctccaaaacca

SEQ ID NO: 115301 - DNA, 75 bp, Artificial Sequence
  Synthetic
tcccttaagtatgaggagaatgtcactaatgatgcagatatgagaccgtactgctggcattaccctcctaaacca

SEQ ID NO: 115302 - DNA, 75 bp, Artificial Sequence
  Synthetic
tcccttaagtatgaggagaatgtcactaatgatgcagatatgagaccgtactgctggcattaccctcccaaacca

SEQ ID NO: 115303 - DNA, 75 bp, Artificial Sequence
  Synthetic
tcccttaagtatgaggagaatgtcactaatgatgcagatatgagaccgtactgctggcattaccctccgaaacca

SEQ ID NO: 115304 - DNA, 75 bp, Artificial Sequence
  Synthetic
tcccttaagcatgaggagaatgtcactaatgatgcagatatgagaccgtactgctggcattaccctccaaaacca

SEQ ID NO: 115305 - DNA, 75 bp, Artificial Sequence
  Synthetic
tcccttaagcatgaggagaatgtcactaatgatgcagatatgagaccgtactgctggcattaccctcctaaacca

SEQ ID NO: 115306 - DNA, 75 bp, Artificial Sequence
  Synthetic
tcccttaagcatgaggagaatgtcactaatgatgcagatatgagaccgtactgctggcattaccctcccaaacca

SEQ ID NO: 115307 - DNA, 75 bp, Artificial Sequence
  Synthetic
tcccttaagcatgaggagaatgtcactaatgatgcagatatgagaccgtactgctggcattaccctccgaaacca

SEQ ID NO: 115308 - DNA, 75 bp, Artificial Sequence
  Synthetic
tcccttaaggatgaggagaatgtcactaatgatgcagatatgagaccgtactgctggcattaccctccaaaacca

SEQ ID NO: 115309 - DNA, 75 bp, Artificial Sequence
  Synthetic
tcccttaaggatgaggagaatgtcactaatgatgcagatatgagaccgtactgctggcattaccctcctaaacca

SEQ ID NO: 115310 - DNA, 75 bp, Artificial Sequence
  Synthetic
tcccttaaggatgaggagaatgtcactaatgatgcagatatgagaccgtactgctggcattaccctcccaaacca

SEQ ID NO: 115311 - DNA, 75 bp, Artificial Sequence
  Synthetic
tcccttaaggatgaggagaatgtcactaatgatgcagatatgagaccgtactgctggcattaccctccgaaacca

SEQ ID NO: 115312 - DNA, 75 bp, Artificial Sequence
  Synthetic
tccctcaagaatgaggagaatgtcactaatgatgcagatatgagaccgtactgctggcattaccctccaaaacca

SEQ ID NO: 115313 - DNA, 75 bp, Artificial Sequence
  Synthetic
tccctcaagaatgaggagaatgtcactaatgatgcagatatgagaccgtactgctggcattaccctcctaaacca

SEQ ID NO: 115314 - DNA, 75 bp, Artificial Sequence
  Synthetic
tccctcaagaatgaggagaatgtcactaatgatgcagatatgagaccgtactgctggcattaccctcccaaacca

SEQ ID NO: 115315 - DNA, 75 bp, Artificial Sequence
  Synthetic
tccctcaagaatgaggagaatgtcactaatgatgcagatatgagaccgtactgctggcattaccctccgaaacca

SEQ ID NO: 115316 - DNA, 75 bp, Artificial Sequence
  Synthetic
tccctcaagtatgaggagaatgtcactaatgatgcagatatgagaccgtactgctggcattaccctccaaaacca

SEQ ID NO: 115317 - DNA, 75 bp, Artificial Sequence
  Synthetic
tccctcaagtatgaggagaatgtcactaatgatgcagatatgagaccgtactgctggcattaccctcctaaacca

SEQ ID NO: 115318 - DNA, 75 bp, Artificial Sequence
  Synthetic
tccctcaagtatgaggagaatgtcactaatgatgcagatatgagaccgtactgctggcattaccctcccaaacca

SEQ ID NO: 115319 - DNA, 75 bp, Artificial Sequence
  Synthetic
tccctcaagtatgaggagaatgtcactaatgatgcagatatgagaccgtactgctggcattaccctccgaaacca

SEQ ID NO: 115320 - DNA, 75 bp, Artificial Sequence
  Synthetic
tccctcaagcatgaggagaatgtcactaatgatgcagatatgagaccgtactgctggcattaccctccaaaacca

SEQ ID NO: 115321 - DNA, 75 bp, Artificial Sequence
  Synthetic
tccctcaagcatgaggagaatgtcactaatgatgcagatatgagaccgtactgctggcattaccctcctaaacca

SEQ ID NO: 115322 - DNA, 75 bp, Artificial Sequence
  Synthetic
tccctcaagcatgaggagaatgtcactaatgatgcagatatgagaccgtactgctggcattaccctcccaaacca

SEQ ID NO: 115323 - DNA, 75 bp, Artificial Sequence
  Synthetic
tccctcaagcatgaggagaatgtcactaatgatgcagatatgagaccgtactgctggcattaccctccgaaacca

SEQ ID NO: 115324 - DNA, 75 bp, Artificial Sequence
  Synthetic
tccctcaaggatgaggagaatgtcactaatgatgcagatatgagaccgtactgctggcattaccctccaaaacca

SEQ ID NO: 115325 - DNA, 75 bp, Artificial Sequence
  Synthetic
tccctcaaggatgaggagaatgtcactaatgatgcagatatgagaccgtactgctggcattaccctcctaaacca

SEQ ID NO: 115326 - DNA, 75 bp, Artificial Sequence
  Synthetic
tccctcaaggatgaggagaatgtcactaatgatgcagatatgagaccgtactgctggcattaccctcccaaacca

SEQ ID NO: 115327 - DNA, 75 bp, Artificial Sequence
  Synthetic
tccctcaaggatgaggagaatgtcactaatgatgcagatatgagaccgtactgctggcattaccctccgaaacca

SEQ ID NO: 115328 - DNA, 75 bp, Artificial Sequence
  Synthetic
tccctgaagaatgaggagaatgtcactaatgatgcagatatgagaccgtactgctggcattaccctccaaaacca

SEQ ID NO: 115329 - DNA, 75 bp, Artificial Sequence
  Synthetic
tccctgaagaatgaggagaatgtcactaatgatgcagatatgagaccgtactgctggcattaccctcctaaacca

SEQ ID NO: 115330 - DNA, 75 bp, Artificial Sequence
  Synthetic
tccctgaagaatgaggagaatgtcactaatgatgcagatatgagaccgtactgctggcattaccctcccaaacca

SEQ ID NO: 115331 - DNA, 75 bp, Artificial Sequence
  Synthetic
tccctgaagaatgaggagaatgtcactaatgatgcagatatgagaccgtactgctggcattaccctccgaaacca

SEQ ID NO: 115332 - DNA, 75 bp, Artificial Sequence
  Synthetic
tccctgaagtatgaggagaatgtcactaatgatgcagatatgagaccgtactgctggcattaccctccaaaacca

SEQ ID NO: 115333 - DNA, 75 bp, Artificial Sequence
  Synthetic
tccctgaagtatgaggagaatgtcactaatgatgcagatatgagaccgtactgctggcattaccctcctaaacca

SEQ ID NO: 115334 - DNA, 75 bp, Artificial Sequence
  Synthetic
tccctgaagtatgaggagaatgtcactaatgatgcagatatgagaccgtactgctggcattaccctcccaaacca

SEQ ID NO: 115335 - DNA, 75 bp, Artificial Sequence
  Synthetic
tccctgaagtatgaggagaatgtcactaatgatgcagatatgagaccgtactgctggcattaccctccgaaacca

SEQ ID NO: 115336 - DNA, 75 bp, Artificial Sequence
  Synthetic
tccctgaagcatgaggagaatgtcactaatgatgcagatatgagaccgtactgctggcattaccctccaaaacca

SEQ ID NO: 115337 - DNA, 75 bp, Artificial Sequence
  Synthetic
tccctgaagcatgaggagaatgtcactaatgatgcagatatgagaccgtactgctggcattaccctcctaaacca

SEQ ID NO: 115338 - DNA, 75 bp, Artificial Sequence
  Synthetic
tccctgaagcatgaggagaatgtcactaatgatgcagatatgagaccgtactgctggcattaccctcccaaacca

SEQ ID NO: 115339 - DNA, 75 bp, Artificial Sequence
  Synthetic
tccctgaagcatgaggagaatgtcactaatgatgcagatatgagaccgtactgctggcattaccctccgaaacca

SEQ ID NO: 115340 - DNA, 75 bp, Artificial Sequence
  Synthetic
tccctgaaggatgaggagaatgtcactaatgatgcagatatgagaccgtactgctggcattaccctccaaaacca

SEQ ID NO: 115341 - DNA, 75 bp, Artificial Sequence
  Synthetic
tccctgaaggatgaggagaatgtcactaatgatgcagatatgagaccgtactgctggcattaccctcctaaacca

SEQ ID NO: 115342 - DNA, 75 bp, Artificial Sequence
  Synthetic
tccctgaaggatgaggagaatgtcactaatgatgcagatatgagaccgtactgctggcattaccctcccaaacca

SEQ ID NO: 115343 - DNA, 75 bp, Artificial Sequence
  Synthetic
tccctgaaggatgaggagaatgtcactaatgatgcagatatgagaccgtactgctggcattaccctccgaaacca

SEQ ID NO: 115344 - DNA, 75 bp, Artificial Sequence
  Synthetic
gatgccggggcagcctggtacgaacttacgcccgctgagactacagtgagactccgggcttatttcaacacgccc

SEQ ID NO: 115345 - DNA, 75 bp, Artificial Sequence
  Synthetic
tgctgactcagccgcgtgtggcgacatcatcgaaggcctaccggtttcggctaggttgggcaatgaaatattgct

SEQ ID NO: 115346 - DNA, 75 bp, Artificial Sequence
  Synthetic
ttgctctttttctatcttccttctggcacttctctcgtgcttgacggtcccagcctcggctgtgcattatcacaa

SEQ ID NO: 115347 - DNA, 75 bp, Artificial Sequence
  Synthetic
ttgctctttttctatcttccttctggcacttctctcgtgcttgacggtccctgcctcggctgtgcattatcacaa

SEQ ID NO: 115348 - DNA, 75 bp, Artificial Sequence
  Synthetic
ttgctctttttctatcttccttctggcacttctctcgtgcttgacggtccccgcctcggctgtgcattatcacaa

SEQ ID NO: 115349 - DNA, 75 bp, Artificial Sequence
  Synthetic
ttgctctttttctatcttccttctggcacttctctcgtgcttgacggtcccggcctcggctgtgcattatcacaa

SEQ ID NO: 115350 - DNA, 75 bp, Artificial Sequence
  Synthetic
aatgactgccctaactctagcatagtctttgaggcagaacatcacatcttacatcttccaggatgcgtcccctgt

SEQ ID NO: 115351 - DNA, 75 bp, Artificial Sequence
  Synthetic
aatgactgccctaactctagcatagtctttgaggcagaacatcacatctttcatcttccaggatgcgtcccctgt

SEQ ID NO: 115352 - DNA, 75 bp, Artificial Sequence
  Synthetic
aatgactgccctaactctagcatagtctttgaggcagaacatcacatcttccatcttccaggatgcgtcccctgt

SEQ ID NO: 115353 - DNA, 75 bp, Artificial Sequence
  Synthetic
aatgactgccctaactctagcatagtctttgaggcagaacatcacatcttgcatcttccaggatgcgtcccctgt

SEQ ID NO: 115354 - DNA, 75 bp, Artificial Sequence
  Synthetic
tgcccacatcacggcagagacggccaagcgcaggctagatcgagggtctccgccctctctggctagctcctcggc

SEQ ID NO: 115355 - DNA, 75 bp, Artificial Sequence
  Synthetic
acacttggggggagaacgagacagatgtcttcttgctcaacagcacccgcccaccaaagggtgcttggttcgggt

SEQ ID NO: 115356 - DNA, 75 bp, Artificial Sequence
  Synthetic
acacttggggggagaacgagacagatgtcttcttgctcaacagcacccgcccacctaagggtgcttggttcgggt

SEQ ID NO: 115357 - DNA, 75 bp, Artificial Sequence
  Synthetic
acacttggggggagaacgagacagatgtcttcttgctcaacagcacccgcccacccaagggtgcttggttcgggt

SEQ ID NO: 115358 - DNA, 75 bp, Artificial Sequence
  Synthetic
acacttggggggagaacgagacagatgtcttcttgctcaacagcacccgcccaccgaagggtgcttggttcgggt

SEQ ID NO: 115359 - DNA, 75 bp, Artificial Sequence
  Synthetic
ccgaatatgacgacagagaaccatccatacccgcggagtgtcacaggccgaataggcccaagtttccaccagcac

SEQ ID NO: 115360 - DNA, 75 bp, Artificial Sequence
  Synthetic
aggggctggagacttcttgctcccatcactgcgtacgcgcagcaaacaaggggcttgcttggcaccatagtgacc

SEQ ID NO: 115361 - DNA, 75 bp, Artificial Sequence
  Synthetic
aggggctggagacttcttgctcccatcactgcgtacgcgcagcaaacaaggggcttgcttggcaccattgtgacc

SEQ ID NO: 115362 - DNA, 75 bp, Artificial Sequence
  Synthetic
aggggctggagacttcttgctcccatcactgcgtacgcgcagcaaacaaggggcttgcttggcaccatcgtgacc

SEQ ID NO: 115363 - DNA, 75 bp, Artificial Sequence
  Synthetic
aggggctggagacttcttgctcccatcactgcgtacgcgcagcaaacaaggggcttgcttggcaccatggtgacc

SEQ ID NO: 115364 - DNA, 75 bp, Artificial Sequence
  Synthetic
ccaccaaagggtgcttggttcgggtgcacgtggatgaacggcactgggttcaccaagacttgcggcgcaccacca

SEQ ID NO: 115365 - DNA, 75 bp, Artificial Sequence
  Synthetic
ccacctaagggtgcttggttcgggtgcacgtggatgaacggcactgggttcaccaagacttgcggcgcaccacca

SEQ ID NO: 115366 - DNA, 75 bp, Artificial Sequence
  Synthetic
ccacccaagggtgcttggttcgggtgcacgtggatgaacggcactgggttcaccaagacttgcggcgcaccacca

SEQ ID NO: 115367 - DNA, 75 bp, Artificial Sequence
  Synthetic
ccaccgaagggtgcttggttcgggtgcacgtggatgaacggcactgggttcaccaagacttgcggcgcaccacca

SEQ ID NO: 115368 - DNA, 75 bp, Artificial Sequence
  Synthetic
atttgatggtgggcactgccacactgtgctccgcactctacgttggagatctgtgcgggggcatattcctagtgg

SEQ ID NO: 115369 - DNA, 75 bp, Artificial Sequence
  Synthetic
ttccgggcagcctccaattccgccgcctaggaggaagaggacagtgcgcctggatgaatccaccgtagcaggagc

SEQ ID NO: 115370 - DNA, 75 bp, Artificial Sequence
  Synthetic
tgactcctttgagccgctcaaggcggaagacgacgacagggagatctccgtgtccgctgactgctttaagagggg

SEQ ID NO: 115371 - DNA, 75 bp, Artificial Sequence
  Synthetic
ggccatggttaacaccccggtgactggtccactacccctacagactgtggcattacccgtgcacagtcaactata

SEQ ID NO: 115372 - DNA, 75 bp, Artificial Sequence
  Synthetic
ggccatggttaacaccccggtgtctggtccactacccctacagactgtggcattacccgtgcacagtcaactata

SEQ ID NO: 115373 - DNA, 75 bp, Artificial Sequence
  Synthetic
ggccatggttaacaccccggtgcctggtccactacccctacagactgtggcattacccgtgcacagtcaactata

SEQ ID NO: 115374 - DNA, 75 bp, Artificial Sequence
  Synthetic
ggccatggttaacaccccggtggctggtccactacccctacagactgtggcattacccgtgcacagtcaactata

SEQ ID NO: 115375 - DNA, 75 bp, Artificial Sequence
  Synthetic
aattgttccatctatccgggccacatcacgggtcacagaatggcgtgggacatgatgatgaactggagccctacc

SEQ ID NO: 115376 - DNA, 75 bp, Artificial Sequence
  Synthetic
tcacgggtcacagaatggcgtgggacatgatgatgaactggagccctaccaccgctctggtcctagcacaaatca

SEQ ID NO: 115377 - DNA, 75 bp, Artificial Sequence
  Synthetic
gatgatgaagccgacaccgcttctgatgcagggtcttatagctctatgccgcctcttgaaggcgagccaggtgac

SEQ ID NO: 115378 - DNA, 75 bp, Artificial Sequence
  Synthetic
atgcagggtcttatagctctatgccgcctcttgaaggcgagccaggtgacccggacctcagttcaggatcatggt

SEQ ID NO: 115379 - DNA, 75 bp, Artificial Sequence
  Synthetic
taggagtcagttaagtccgctgctgcattctaccaccgaatgggccatcctaccctgtacattcacagacctgcc

SEQ ID NO: 115380 - DNA, 75 bp, Artificial Sequence
  Synthetic
taggagtcagtttagtccgctgctgcattctaccaccgaatgggccatcctaccctgtacattcacagacctgcc

SEQ ID NO: 115381 - DNA, 75 bp, Artificial Sequence
  Synthetic
taggagtcagttcagtccgctgctgcattctaccaccgaatgggccatcctaccctgtacattcacagacctgcc

SEQ ID NO: 115382 - DNA, 75 bp, Artificial Sequence
  Synthetic
taggagtcagttgagtccgctgctgcattctaccaccgaatgggccatcctaccctgtacattcacagacctgcc

SEQ ID NO: 115383 - DNA, 75 bp, Artificial Sequence
  Synthetic
gcatgcaggctaattgggctaaagtcatcctgattttgttcatttttgccggggtcgacgcgcacacgcacgtca

SEQ ID NO: 115384 - DNA, 75 bp, Artificial Sequence
  Synthetic
ttgtcgttgctgagagcgggggagtctctgaggacgccggggctctgcgagtcttcacggaggctatgaccagat

SEQ ID NO: 115385 - DNA, 75 bp, Artificial Sequence
  Synthetic
ggccaagattctgggttgggcgctagcagccaacccgatccagggcctgaggaaaaacgcgatactgactcggac

SEQ ID NO: 115386 - DNA, 75 bp, Artificial Sequence
  Synthetic
gagtggatcatcctcctatttctgctcatggcggacgctaggatctgagcctgcctttggatgctcatcctatta

SEQ ID NO: 115387 - DNA, 75 bp, Artificial Sequence
  Synthetic
gagtggatcatcctcctatttctgctcatggcggacgctaggatctgtgcctgcctttggatgctcatcctatta

SEQ ID NO: 115388 - DNA, 75 bp, Artificial Sequence
  Synthetic
gagtggatcatcctcctatttctgctcatggcggacgctaggatctgcgcctgcctttggatgctcatcctatta

SEQ ID NO: 115389 - DNA, 75 bp, Artificial Sequence
  Synthetic
gagtggatcatcctcctatttctgctcatggcggacgctaggatctgggcctgcctttggatgctcatcctatta

SEQ ID NO: 115390 - DNA, 75 bp, Artificial Sequence
  Synthetic
gagtggatcatcctcctatttctgctcttggcggacgctaggatctgagcctgcctttggatgctcatcctatta

SEQ ID NO: 115391 - DNA, 75 bp, Artificial Sequence
  Synthetic
gagtggatcatcctcctatttctgctcttggcggacgctaggatctgtgcctgcctttggatgctcatcctatta

SEQ ID NO: 115392 - DNA, 75 bp, Artificial Sequence
  Synthetic
gagtggatcatcctcctatttctgctcttggcggacgctaggatctgcgcctgcctttggatgctcatcctatta

SEQ ID NO: 115393 - DNA, 75 bp, Artificial Sequence
  Synthetic
gagtggatcatcctcctatttctgctcttggcggacgctaggatctgggcctgcctttggatgctcatcctatta

SEQ ID NO: 115394 - DNA, 75 bp, Artificial Sequence
  Synthetic
gagtggatcatcctcctatttctgctcctggcggacgctaggatctgagcctgcctttggatgctcatcctatta

SEQ ID NO: 115395 - DNA, 75 bp, Artificial Sequence
  Synthetic
gagtggatcatcctcctatttctgctcctggcggacgctaggatctgtgcctgcctttggatgctcatcctatta

SEQ ID NO: 115396 - DNA, 75 bp, Artificial Sequence
  Synthetic
gagtggatcatcctcctatttctgctcctggcggacgctaggatctgcgcctgcctttggatgctcatcctatta

SEQ ID NO: 115397 - DNA, 75 bp, Artificial Sequence
  Synthetic
gagtggatcatcctcctatttctgctcctggcggacgctaggatctgggcctgcctttggatgctcatcctatta

SEQ ID NO: 115398 - DNA, 75 bp, Artificial Sequence
  Synthetic
gagtggatcatcctcctatttctgctcgtggcggacgctaggatctgagcctgcctttggatgctcatcctatta

SEQ ID NO: 115399 - DNA, 75 bp, Artificial Sequence
  Synthetic
gagtggatcatcctcctatttctgctcgtggcggacgctaggatctgtgcctgcctttggatgctcatcctatta

SEQ ID NO: 115400 - DNA, 75 bp, Artificial Sequence
  Synthetic
gagtggatcatcctcctatttctgctcgtggcggacgctaggatctgcgcctgcctttggatgctcatcctatta

SEQ ID NO: 115401 - DNA, 75 bp, Artificial Sequence
  Synthetic
gagtggatcatcctcctatttctgctcgtggcggacgctaggatctgggcctgcctttggatgctcatcctatta

SEQ ID NO: 115402 - DNA, 75 bp, Artificial Sequence
  Synthetic
gagtggttcatcctcctatttctgctcatggcggacgctaggatctgagcctgcctttggatgctcatcctatta

SEQ ID NO: 115403 - DNA, 75 bp, Artificial Sequence
  Synthetic
gagtggttcatcctcctatttctgctcatggcggacgctaggatctgtgcctgcctttggatgctcatcctatta

SEQ ID NO: 115404 - DNA, 75 bp, Artificial Sequence
  Synthetic
gagtggttcatcctcctatttctgctcatggcggacgctaggatctgcgcctgcctttggatgctcatcctatta

SEQ ID NO: 115405 - DNA, 75 bp, Artificial Sequence
  Synthetic
gagtggttcatcctcctatttctgctcatggcggacgctaggatctgggcctgcctttggatgctcatcctatta

SEQ ID NO: 115406 - DNA, 75 bp, Artificial Sequence
  Synthetic
gagtggttcatcctcctatttctgctcttggcggacgctaggatctgagcctgcctttggatgctcatcctatta

SEQ ID NO: 115407 - DNA, 75 bp, Artificial Sequence
  Synthetic
gagtggttcatcctcctatttctgctcttggcggacgctaggatctgtgcctgcctttggatgctcatcctatta

SEQ ID NO: 115408 - DNA, 75 bp, Artificial Sequence
  Synthetic
gagtggttcatcctcctatttctgctcttggcggacgctaggatctgcgcctgcctttggatgctcatcctatta

SEQ ID NO: 115409 - DNA, 75 bp, Artificial Sequence
  Synthetic
gagtggttcatcctcctatttctgctcttggcggacgctaggatctgggcctgcctttggatgctcatcctatta

SEQ ID NO: 115410 - DNA, 75 bp, Artificial Sequence
  Synthetic
gagtggttcatcctcctatttctgctcctggcggacgctaggatctgagcctgcctttggatgctcatcctatta

SEQ ID NO: 115411 - DNA, 75 bp, Artificial Sequence
  Synthetic
gagtggttcatcctcctatttctgctcctggcggacgctaggatctgtgcctgcctttggatgctcatcctatta

SEQ ID NO: 115412 - DNA, 75 bp, Artificial Sequence
  Synthetic
gagtggttcatcctcctatttctgctcctggcggacgctaggatctgcgcctgcctttggatgctcatcctatta

SEQ ID NO: 115413 - DNA, 75 bp, Artificial Sequence
  Synthetic
gagtggttcatcctcctatttctgctcctggcggacgctaggatctgggcctgcctttggatgctcatcctatta

SEQ ID NO: 115414 - DNA, 75 bp, Artificial Sequence
  Synthetic
gagtggttcatcctcctatttctgctcgtggcggacgctaggatctgagcctgcctttggatgctcatcctatta

SEQ ID NO: 115415 - DNA, 75 bp, Artificial Sequence
  Synthetic
gagtggttcatcctcctatttctgctcgtggcggacgctaggatctgtgcctgcctttggatgctcatcctatta

SEQ ID NO: 115416 - DNA, 75 bp, Artificial Sequence
  Synthetic
gagtggttcatcctcctatttctgctcgtggcggacgctaggatctgcgcctgcctttggatgctcatcctatta

SEQ ID NO: 115417 - DNA, 75 bp, Artificial Sequence
  Synthetic
gagtggttcatcctcctatttctgctcgtggcggacgctaggatctgggcctgcctttggatgctcatcctatta

SEQ ID NO: 115418 - DNA, 75 bp, Artificial Sequence
  Synthetic
gagtggctcatcctcctatttctgctcatggcggacgctaggatctgagcctgcctttggatgctcatcctatta

SEQ ID NO: 115419 - DNA, 75 bp, Artificial Sequence
  Synthetic
gagtggctcatcctcctatttctgctcatggcggacgctaggatctgtgcctgcctttggatgctcatcctatta

SEQ ID NO: 115420 - DNA, 75 bp, Artificial Sequence
  Synthetic
gagtggctcatcctcctatttctgctcatggcggacgctaggatctgcgcctgcctttggatgctcatcctatta

SEQ ID NO: 115421 - DNA, 75 bp, Artificial Sequence
  Synthetic
gagtggctcatcctcctatttctgctcatggcggacgctaggatctgggcctgcctttggatgctcatcctatta

SEQ ID NO: 115422 - DNA, 75 bp, Artificial Sequence
  Synthetic
gagtggctcatcctcctatttctgctcttggcggacgctaggatctgagcctgcctttggatgctcatcctatta

SEQ ID NO: 115423 - DNA, 75 bp, Artificial Sequence
  Synthetic
gagtggctcatcctcctatttctgctcttggcggacgctaggatctgtgcctgcctttggatgctcatcctatta

SEQ ID NO: 115424 - DNA, 75 bp, Artificial Sequence
  Synthetic
gagtggctcatcctcctatttctgctcttggcggacgctaggatctgcgcctgcctttggatgctcatcctatta

SEQ ID NO: 115425 - DNA, 75 bp, Artificial Sequence
  Synthetic
gagtggctcatcctcctatttctgctcttggcggacgctaggatctgggcctgcctttggatgctcatcctatta

SEQ ID NO: 115426 - DNA, 75 bp, Artificial Sequence
  Synthetic
gagtggctcatcctcctatttctgctcctggcggacgctaggatctgagcctgcctttggatgctcatcctatta

SEQ ID NO: 115427 - DNA, 75 bp, Artificial Sequence
  Synthetic
gagtggctcatcctcctatttctgctcctggcggacgctaggatctgtgcctgcctttggatgctcatcctatta

SEQ ID NO: 115428 - DNA, 75 bp, Artificial Sequence
  Synthetic
gagtggctcatcctcctatttctgctcctggcggacgctaggatctgcgcctgcctttggatgctcatcctatta

SEQ ID NO: 115429 - DNA, 75 bp, Artificial Sequence
  Synthetic
gagtggctcatcctcctatttctgctcctggcggacgctaggatctgggcctgcctttggatgctcatcctatta

SEQ ID NO: 115430 - DNA, 75 bp, Artificial Sequence
  Synthetic
gagtggctcatcctcctatttctgctcgtggcggacgctaggatctgagcctgcctttggatgctcatcctatta

SEQ ID NO: 115431 - DNA, 75 bp, Artificial Sequence
  Synthetic
gagtggctcatcctcctatttctgctcgtggcggacgctaggatctgtgcctgcctttggatgctcatcctatta

SEQ ID NO: 115432 - DNA, 75 bp, Artificial Sequence
  Synthetic
gagtggctcatcctcctatttctgctcgtggcggacgctaggatctgcgcctgcctttggatgctcatcctatta

SEQ ID NO: 115433 - DNA, 75 bp, Artificial Sequence
  Synthetic
gagtggctcatcctcctatttctgctcgtggcggacgctaggatctgggcctgcctttggatgctcatcctatta

SEQ ID NO: 115434 - DNA, 75 bp, Artificial Sequence
  Synthetic
gagtgggtcatcctcctatttctgctcatggcggacgctaggatctgagcctgcctttggatgctcatcctatta

SEQ ID NO: 115435 - DNA, 75 bp, Artificial Sequence
  Synthetic
gagtgggtcatcctcctatttctgctcatggcggacgctaggatctgtgcctgcctttggatgctcatcctatta

SEQ ID NO: 115436 - DNA, 75 bp, Artificial Sequence
  Synthetic
gagtgggtcatcctcctatttctgctcatggcggacgctaggatctgcgcctgcctttggatgctcatcctatta

SEQ ID NO: 115437 - DNA, 75 bp, Artificial Sequence
  Synthetic
gagtgggtcatcctcctatttctgctcatggcggacgctaggatctgggcctgcctttggatgctcatcctatta

SEQ ID NO: 115438 - DNA, 75 bp, Artificial Sequence
  Synthetic
gagtgggtcatcctcctatttctgctcttggcggacgctaggatctgagcctgcctttggatgctcatcctatta

SEQ ID NO: 115439 - DNA, 75 bp, Artificial Sequence
  Synthetic
gagtgggtcatcctcctatttctgctcttggcggacgctaggatctgtgcctgcctttggatgctcatcctatta

SEQ ID NO: 115440 - DNA, 75 bp, Artificial Sequence
  Synthetic
gagtgggtcatcctcctatttctgctcttggcggacgctaggatctgcgcctgcctttggatgctcatcctatta

SEQ ID NO: 115441 - DNA, 75 bp, Artificial Sequence
  Synthetic
gagtgggtcatcctcctatttctgctcttggcggacgctaggatctgggcctgcctttggatgctcatcctatta

SEQ ID NO: 115442 - DNA, 75 bp, Artificial Sequence
  Synthetic
gagtgggtcatcctcctatttctgctcctggcggacgctaggatctgagcctgcctttggatgctcatcctatta

SEQ ID NO: 115443 - DNA, 75 bp, Artificial Sequence
  Synthetic
gagtgggtcatcctcctatttctgctcctggcggacgctaggatctgtgcctgcctttggatgctcatcctatta

SEQ ID NO: 115444 - DNA, 75 bp, Artificial Sequence
  Synthetic
gagtgggtcatcctcctatttctgctcctggcggacgctaggatctgcgcctgcctttggatgctcatcctatta

SEQ ID NO: 115445 - DNA, 75 bp, Artificial Sequence
  Synthetic
gagtgggtcatcctcctatttctgctcctggcggacgctaggatctgggcctgcctttggatgctcatcctatta

SEQ ID NO: 115446 - DNA, 75 bp, Artificial Sequence
  Synthetic
gagtgggtcatcctcctatttctgctcgtggcggacgctaggatctgagcctgcctttggatgctcatcctatta

SEQ ID NO: 115447 - DNA, 75 bp, Artificial Sequence
  Synthetic
gagtgggtcatcctcctatttctgctcgtggcggacgctaggatctgtgcctgcctttggatgctcatcctatta

SEQ ID NO: 115448 - DNA, 75 bp, Artificial Sequence
  Synthetic
gagtgggtcatcctcctatttctgctcgtggcggacgctaggatctgcgcctgcctttggatgctcatcctatta

SEQ ID NO: 115449 - DNA, 75 bp, Artificial Sequence
  Synthetic
gagtgggtcatcctcctatttctgctcgtggcggacgctaggatctgggcctgcctttggatgctcatcctatta

SEQ ID NO: 115450 - DNA, 75 bp, Artificial Sequence
  Synthetic
cattaacaggacagccctcaattgtaacgacagcttgcagacgggattcatcgccagcctgttctaccgtaataa

SEQ ID NO: 115451 - DNA, 75 bp, Artificial Sequence
  Synthetic
tatgcggcaaaagaaggttaccttcgaccgcaaacaggtcttagaccaacactacaaagatgtagtcaaggagat

SEQ ID NO: 115452 - DNA, 75 bp, Artificial Sequence
  Synthetic
tatgcggcaaaagaaggttaccttcgaccgcaaacaggtcttagaccaacactacaatgatgtagtcaaggagat

SEQ ID NO: 115453 - DNA, 75 bp, Artificial Sequence
  Synthetic
tatgcggcaaaagaaggttaccttcgaccgcaaacaggtcttagaccaacactacaacgatgtagtcaaggagat

SEQ ID NO: 115454 - DNA, 75 bp, Artificial Sequence
  Synthetic
tatgcggcaaaagaaggttaccttcgaccgcaaacaggtcttagaccaacactacaaggatgtagtcaaggagat

SEQ ID NO: 115455 - DNA, 75 bp, Artificial Sequence
  Synthetic
tatgcggcaaaagaaggttaccttcgaccgcaaacaggtctttgaccaacactacaaagatgtagtcaaggagat

SEQ ID NO: 115456 - DNA, 75 bp, Artificial Sequence
  Synthetic
tatgcggcaaaagaaggttaccttcgaccgcaaacaggtctttgaccaacactacaatgatgtagtcaaggagat

SEQ ID NO: 115457 - DNA, 75 bp, Artificial Sequence
  Synthetic
tatgcggcaaaagaaggttaccttcgaccgcaaacaggtctttgaccaacactacaacgatgtagtcaaggagat

SEQ ID NO: 115458 - DNA, 75 bp, Artificial Sequence
  Synthetic
tatgcggcaaaagaaggttaccttcgaccgcaaacaggtctttgaccaacactacaaggatgtagtcaaggagat

SEQ ID NO: 115459 - DNA, 75 bp, Artificial Sequence
  Synthetic
tatgcggcaaaagaaggttaccttcgaccgcaaacaggtcttcgaccaacactacaaagatgtagtcaaggagat

SEQ ID NO: 115460 - DNA, 75 bp, Artificial Sequence
  Synthetic
tatgcggcaaaagaaggttaccttcgaccgcaaacaggtcttcgaccaacactacaatgatgtagtcaaggagat

SEQ ID NO: 115461 - DNA, 75 bp, Artificial Sequence
  Synthetic
tatgcggcaaaagaaggttaccttcgaccgcaaacaggtcttcgaccaacactacaacgatgtagtcaaggagat

SEQ ID NO: 115462 - DNA, 75 bp, Artificial Sequence
  Synthetic
tatgcggcaaaagaaggttaccttcgaccgcaaacaggtcttcgaccaacactacaaggatgtagtcaaggagat

SEQ ID NO: 115463 - DNA, 75 bp, Artificial Sequence
  Synthetic
tatgcggcaaaagaaggttaccttcgaccgcaaacaggtcttggaccaacactacaaagatgtagtcaaggagat

SEQ ID NO: 115464 - DNA, 75 bp, Artificial Sequence
  Synthetic
tatgcggcaaaagaaggttaccttcgaccgcaaacaggtcttggaccaacactacaatgatgtagtcaaggagat

SEQ ID NO: 115465 - DNA, 75 bp, Artificial Sequence
  Synthetic
tatgcggcaaaagaaggttaccttcgaccgcaaacaggtcttggaccaacactacaacgatgtagtcaaggagat

SEQ ID NO: 115466 - DNA, 75 bp, Artificial Sequence
  Synthetic
tatgcggcaaaagaaggttaccttcgaccgcaaacaggtcttggaccaacactacaaggatgtagtcaaggagat

SEQ ID NO: 115467 - DNA, 75 bp, Artificial Sequence
  Synthetic
tatgcggcaaaagaaggttaccttcgaccgcatacaggtcttagaccaacactacaaagatgtagtcaaggagat

SEQ ID NO: 115468 - DNA, 75 bp, Artificial Sequence
  Synthetic
tatgcggcaaaagaaggttaccttcgaccgcatacaggtcttagaccaacactacaatgatgtagtcaaggagat

SEQ ID NO: 115469 - DNA, 75 bp, Artificial Sequence
  Synthetic
tatgcggcaaaagaaggttaccttcgaccgcatacaggtcttagaccaacactacaacgatgtagtcaaggagat

SEQ ID NO: 115470 - DNA, 75 bp, Artificial Sequence
  Synthetic
tatgcggcaaaagaaggttaccttcgaccgcatacaggtcttagaccaacactacaaggatgtagtcaaggagat

SEQ ID NO: 115471 - DNA, 75 bp, Artificial Sequence
  Synthetic
tatgcggcaaaagaaggttaccttcgaccgcatacaggtctttgaccaacactacaaagatgtagtcaaggagat

SEQ ID NO: 115472 - DNA, 75 bp, Artificial Sequence
  Synthetic
tatgcggcaaaagaaggttaccttcgaccgcatacaggtctttgaccaacactacaatgatgtagtcaaggagat

SEQ ID NO: 115473 - DNA, 75 bp, Artificial Sequence
  Synthetic
tatgcggcaaaagaaggttaccttcgaccgcatacaggtctttgaccaacactacaacgatgtagtcaaggagat

SEQ ID NO: 115474 - DNA, 75 bp, Artificial Sequence
  Synthetic
tatgcggcaaaagaaggttaccttcgaccgcatacaggtctttgaccaacactacaaggatgtagtcaaggagat

SEQ ID NO: 115475 - DNA, 75 bp, Artificial Sequence
  Synthetic
tatgcggcaaaagaaggttaccttcgaccgcatacaggtcttcgaccaacactacaaagatgtagtcaaggagat

SEQ ID NO: 115476 - DNA, 75 bp, Artificial Sequence
  Synthetic
tatgcggcaaaagaaggttaccttcgaccgcatacaggtcttcgaccaacactacaatgatgtagtcaaggagat

SEQ ID NO: 115477 - DNA, 75 bp, Artificial Sequence
  Synthetic
tatgcggcaaaagaaggttaccttcgaccgcatacaggtcttcgaccaacactacaacgatgtagtcaaggagat

SEQ ID NO: 115478 - DNA, 75 bp, Artificial Sequence
  Synthetic
tatgcggcaaaagaaggttaccttcgaccgcatacaggtcttcgaccaacactacaaggatgtagtcaaggagat

SEQ ID NO: 115479 - DNA, 75 bp, Artificial Sequence
  Synthetic
tatgcggcaaaagaaggttaccttcgaccgcatacaggtcttggaccaacactacaaagatgtagtcaaggagat

SEQ ID NO: 115480 - DNA, 75 bp, Artificial Sequence
  Synthetic
tatgcggcaaaagaaggttaccttcgaccgcatacaggtcttggaccaacactacaatgatgtagtcaaggagat

SEQ ID NO: 115481 - DNA, 75 bp, Artificial Sequence
  Synthetic
tatgcggcaaaagaaggttaccttcgaccgcatacaggtcttggaccaacactacaacgatgtagtcaaggagat

SEQ ID NO: 115482 - DNA, 75 bp, Artificial Sequence
  Synthetic
tatgcggcaaaagaaggttaccttcgaccgcatacaggtcttggaccaacactacaaggatgtagtcaaggagat

SEQ ID NO: 115483 - DNA, 75 bp, Artificial Sequence
  Synthetic
tatgcggcaaaagaaggttaccttcgaccgcacacaggtcttagaccaacactacaaagatgtagtcaaggagat

SEQ ID NO: 115484 - DNA, 75 bp, Artificial Sequence
  Synthetic
tatgcggcaaaagaaggttaccttcgaccgcacacaggtcttagaccaacactacaatgatgtagtcaaggagat

SEQ ID NO: 115485 - DNA, 75 bp, Artificial Sequence
  Synthetic
tatgcggcaaaagaaggttaccttcgaccgcacacaggtcttagaccaacactacaacgatgtagtcaaggagat

SEQ ID NO: 115486 - DNA, 75 bp, Artificial Sequence
  Synthetic
tatgcggcaaaagaaggttaccttcgaccgcacacaggtcttagaccaacactacaaggatgtagtcaaggagat

SEQ ID NO: 115487 - DNA, 75 bp, Artificial Sequence
  Synthetic
tatgcggcaaaagaaggttaccttcgaccgcacacaggtctttgaccaacactacaaagatgtagtcaaggagat

SEQ ID NO: 115488 - DNA, 75 bp, Artificial Sequence
  Synthetic
tatgcggcaaaagaaggttaccttcgaccgcacacaggtctttgaccaacactacaatgatgtagtcaaggagat

SEQ ID NO: 115489 - DNA, 75 bp, Artificial Sequence
  Synthetic
tatgcggcaaaagaaggttaccttcgaccgcacacaggtctttgaccaacactacaacgatgtagtcaaggagat

SEQ ID NO: 115490 - DNA, 75 bp, Artificial Sequence
  Synthetic
tatgcggcaaaagaaggttaccttcgaccgcacacaggtctttgaccaacactacaaggatgtagtcaaggagat

SEQ ID NO: 115491 - DNA, 75 bp, Artificial Sequence
  Synthetic
tatgcggcaaaagaaggttaccttcgaccgcacacaggtcttcgaccaacactacaaagatgtagtcaaggagat

SEQ ID NO: 115492 - DNA, 75 bp, Artificial Sequence
  Synthetic
tatgcggcaaaagaaggttaccttcgaccgcacacaggtcttcgaccaacactacaatgatgtagtcaaggagat

SEQ ID NO: 115493 - DNA, 75 bp, Artificial Sequence
  Synthetic
tatgcggcaaaagaaggttaccttcgaccgcacacaggtcttcgaccaacactacaacgatgtagtcaaggagat

SEQ ID NO: 115494 - DNA, 75 bp, Artificial Sequence
  Synthetic
tatgcggcaaaagaaggttaccttcgaccgcacacaggtcttcgaccaacactacaaggatgtagtcaaggagat

SEQ ID NO: 115495 - DNA, 75 bp, Artificial Sequence
  Synthetic
tatgcggcaaaagaaggttaccttcgaccgcacacaggtcttggaccaacactacaaagatgtagtcaaggagat

SEQ ID NO: 115496 - DNA, 75 bp, Artificial Sequence
  Synthetic
tatgcggcaaaagaaggttaccttcgaccgcacacaggtcttggaccaacactacaatgatgtagtcaaggagat

SEQ ID NO: 115497 - DNA, 75 bp, Artificial Sequence
  Synthetic
tatgcggcaaaagaaggttaccttcgaccgcacacaggtcttggaccaacactacaacgatgtagtcaaggagat

SEQ ID NO: 115498 - DNA, 75 bp, Artificial Sequence
  Synthetic
tatgcggcaaaagaaggttaccttcgaccgcacacaggtcttggaccaacactacaaggatgtagtcaaggagat

SEQ ID NO: 115499 - DNA, 75 bp, Artificial Sequence
  Synthetic
tatgcggcaaaagaaggttaccttcgaccgcagacaggtcttagaccaacactacaaagatgtagtcaaggagat

SEQ ID NO: 115500 - DNA, 75 bp, Artificial Sequence
  Synthetic
tatgcggcaaaagaaggttaccttcgaccgcagacaggtcttagaccaacactacaatgatgtagtcaaggagat

SEQ ID NO: 115501 - DNA, 75 bp, Artificial Sequence
  Synthetic
tatgcggcaaaagaaggttaccttcgaccgcagacaggtcttagaccaacactacaacgatgtagtcaaggagat

SEQ ID NO: 115502 - DNA, 75 bp, Artificial Sequence
  Synthetic
tatgcggcaaaagaaggttaccttcgaccgcagacaggtcttagaccaacactacaaggatgtagtcaaggagat

SEQ ID NO: 115503 - DNA, 75 bp, Artificial Sequence
  Synthetic
tatgcggcaaaagaaggttaccttcgaccgcagacaggtctttgaccaacactacaaagatgtagtcaaggagat

SEQ ID NO: 115504 - DNA, 75 bp, Artificial Sequence
  Synthetic
tatgcggcaaaagaaggttaccttcgaccgcagacaggtctttgaccaacactacaatgatgtagtcaaggagat

SEQ ID NO: 115505 - DNA, 75 bp, Artificial Sequence
  Synthetic
tatgcggcaaaagaaggttaccttcgaccgcagacaggtctttgaccaacactacaacgatgtagtcaaggagat

SEQ ID NO: 115506 - DNA, 75 bp, Artificial Sequence
  Synthetic
tatgcggcaaaagaaggttaccttcgaccgcagacaggtctttgaccaacactacaaggatgtagtcaaggagat

SEQ ID NO: 115507 - DNA, 75 bp, Artificial Sequence
  Synthetic
tatgcggcaaaagaaggttaccttcgaccgcagacaggtcttcgaccaacactacaaagatgtagtcaaggagat

SEQ ID NO: 115508 - DNA, 75 bp, Artificial Sequence
  Synthetic
tatgcggcaaaagaaggttaccttcgaccgcagacaggtcttcgaccaacactacaatgatgtagtcaaggagat

SEQ ID NO: 115509 - DNA, 75 bp, Artificial Sequence
  Synthetic
tatgcggcaaaagaaggttaccttcgaccgcagacaggtcttcgaccaacactacaacgatgtagtcaaggagat

SEQ ID NO: 115510 - DNA, 75 bp, Artificial Sequence
  Synthetic
tatgcggcaaaagaaggttaccttcgaccgcagacaggtcttcgaccaacactacaaggatgtagtcaaggagat

SEQ ID NO: 115511 - DNA, 75 bp, Artificial Sequence
  Synthetic
tatgcggcaaaagaaggttaccttcgaccgcagacaggtcttggaccaacactacaaagatgtagtcaaggagat

SEQ ID NO: 115512 - DNA, 75 bp, Artificial Sequence
  Synthetic
tatgcggcaaaagaaggttaccttcgaccgcagacaggtcttggaccaacactacaatgatgtagtcaaggagat

SEQ ID NO: 115513 - DNA, 75 bp, Artificial Sequence
  Synthetic
tatgcggcaaaagaaggttaccttcgaccgcagacaggtcttggaccaacactacaacgatgtagtcaaggagat

SEQ ID NO: 115514 - DNA, 75 bp, Artificial Sequence
  Synthetic
tatgcggcaaaagaaggttaccttcgaccgcagacaggtcttggaccaacactacaaggatgtagtcaaggagat

SEQ ID NO: 115515 - DNA, 75 bp, Artificial Sequence
  Synthetic
cgatgcgggcccccgttttcacagataattccacccctccagctgtgccccagacctatcaggttgcccacttgc

SEQ ID NO: 115516 - DNA, 75 bp, Artificial Sequence
  Synthetic
actcggcccccccaggagacgaaccacgcccagaatacgacctggagctgataacatcatgctcgtcaaacgtct

SEQ ID NO: 115517 - DNA, 75 bp, Artificial Sequence
  Synthetic
actcggcccccccaggagacgaaccacgcccagaatacgacctggagctgataacatcatgctcgtctaacgtct

SEQ ID NO: 115518 - DNA, 75 bp, Artificial Sequence
  Synthetic
actcggcccccccaggagacgaaccacgcccagaatacgacctggagctgataacatcatgctcgtccaacgtct

SEQ ID NO: 115519 - DNA, 75 bp, Artificial Sequence
  Synthetic
actcggcccccccaggagacgaaccacgcccagaatacgacctggagctgataacatcatgctcgtcgaacgtct

SEQ ID NO: 115520 - DNA, 75 bp, Artificial Sequence
  Synthetic
ggctggggccctatcagctacgccaacggaagcggccccgaacaccgcccctactgctggcactaccccccaaag

SEQ ID NO: 115521 - DNA, 75 bp, Artificial Sequence
  Synthetic
tgtgctgctccatgtcatacagctggactggggcgctcatcaccccttgctctgctgaggaggaaaaactaccta

SEQ ID NO: 115522 - DNA, 75 bp, Artificial Sequence
  Synthetic
cctggtgcattaagggtcgtgtggtaccgatggccacgtattctttgctgggatgctggtcctttgttttgctac

SEQ ID NO: 115523 - DNA, 75 bp, Artificial Sequence
  Synthetic
cctggtgcattaagggtcgtgtggttccgatggccacgtattctttgctgggatgctggtcctttgttttgctac

SEQ ID NO: 115524 - DNA, 75 bp, Artificial Sequence
  Synthetic
cctggtgcattaagggtcgtgtggtcccgatggccacgtattctttgctgggatgctggtcctttgttttgctac

SEQ ID NO: 115525 - DNA, 75 bp, Artificial Sequence
  Synthetic
cctggtgcattaagggtcgtgtggtgccgatggccacgtattctttgctgggatgctggtcctttgttttgctac

SEQ ID NO: 115526 - DNA, 75 bp, Artificial Sequence
  Synthetic
ccctctaatgacagaccttattgctggcactacccgcctcgcccatgcggggtggtacccgcgaccacagtgtgt

SEQ ID NO: 115527 - DNA, 75 bp, Artificial Sequence
  Synthetic
ccctctaatgacagtccttattgctggcactacccgcctcgcccatgcggggtggtacccgcgaccacagtgtgt

SEQ ID NO: 115528 - DNA, 75 bp, Artificial Sequence
  Synthetic
ccctctaatgacagcccttattgctggcactacccgcctcgcccatgcggggtggtacccgcgaccacagtgtgt

SEQ ID NO: 115529 - DNA, 75 bp, Artificial Sequence
  Synthetic
ccctctaatgacaggccttattgctggcactacccgcctcgcccatgcggggtggtacccgcgaccacagtgtgt

SEQ ID NO: 115530 - DNA, 75 bp, Artificial Sequence
  Synthetic
gcgccaccacaatcttgtatactccacttcctcccgaagtgcatctctgaggcagaagaaggtcactttcgacag

SEQ ID NO: 115531 - DNA, 75 bp, Artificial Sequence
  Synthetic
accgaagccacaacagtcctcggcataggcacggtcctggaccaagcagagactgctggagcgcgtctcgtcgtg

SEQ ID NO: 115532 - DNA, 75 bp, Artificial Sequence
  Synthetic
accgatgccacaacagtcctcggcataggcacggtcctggaccaagcagagactgctggagcgcgtctcgtcgtg

SEQ ID NO: 115533 - DNA, 75 bp, Artificial Sequence
  Synthetic
accgacgccacaacagtcctcggcataggcacggtcctggaccaagcagagactgctggagcgcgtctcgtcgtg

SEQ ID NO: 115534 - DNA, 75 bp, Artificial Sequence
  Synthetic
accgaggccacaacagtcctcggcataggcacggtcctggaccaagcagagactgctggagcgcgtctcgtcgtg

SEQ ID NO: 115535 - DNA, 75 bp, Artificial Sequence
  Synthetic
tcataactgccttcacaattacaccggcatataagatcctactcacccggagtttgtggtggacgtgctacctac

SEQ ID NO: 115536 - DNA, 75 bp, Artificial Sequence
  Synthetic
tcataactgccttcacaattacaccggcatataagatccttctcacccggagtttgtggtggacgtgctacctac

SEQ ID NO: 115537 - DNA, 75 bp, Artificial Sequence
  Synthetic
tcataactgccttcacaattacaccggcatataagatcctcctcacccggagtttgtggtggacgtgctacctac

SEQ ID NO: 115538 - DNA, 75 bp, Artificial Sequence
  Synthetic
tcataactgccttcacaattacaccggcatataagatcctgctcacccggagtttgtggtggacgtgctacctac

SEQ ID NO: 115539 - DNA, 75 bp, Artificial Sequence
  Synthetic
caggctcggcgtccccacatacaactggggggaaaatgagacagatgtcatcatcctcaactcgaccagacctcc

SEQ ID NO: 115540 - DNA, 75 bp, Artificial Sequence
  Synthetic
taggcacggtcctggaccaagcagagactgctggagcgcgtctcgtcgtgctcgcaactgctacgcccccggggt

SEQ ID NO: 115541 - DNA, 75 bp, Artificial Sequence
  Synthetic
gggttgacaccaccccactctgcccgttccaaatacggatacggcgcgaaggaggttcgctctctcgacaagaaa

SEQ ID NO: 115542 - DNA, 75 bp, Artificial Sequence
  Synthetic
agctggagttgtcccaccgactgcttcaggaaacacccagaaacaacctacaccaagtgtggttcaggtccttgg

SEQ ID NO: 115543 - DNA, 75 bp, Artificial Sequence
  Synthetic
tcaggaaacacccagaaacaacctacaccaagtgtggttcaggtccttggctcacgccgcggtgcttggtccact

SEQ ID NO: 115544 - DNA, 75 bp, Artificial Sequence
  Synthetic
tccctcctcccaggaggaagcggacagttcagctcacagagtccgttgcttctgctgccttggcggagctggccg

SEQ ID NO: 115545 - DNA, 75 bp, Artificial Sequence
  Synthetic
tccctcctcccaggaggaagcggactgttcagctcacagagtccgttgcttctgctgccttggcggagctggccg

SEQ ID NO: 115546 - DNA, 75 bp, Artificial Sequence
  Synthetic
tccctcctcccaggaggaagcggaccgttcagctcacagagtccgttgcttctgctgccttggcggagctggccg

SEQ ID NO: 115547 - DNA, 75 bp, Artificial Sequence
  Synthetic
tccctcctcccaggaggaagcggacggttcagctcacagagtccgttgcttctgctgccttggcggagctggccg

SEQ ID NO: 115548 - DNA, 75 bp, Artificial Sequence
  Synthetic
gcccttttgagagtgtgtgcactggagaagcagctcgcggggggtaagtacatccaagtagcactaattaccctt

SEQ ID NO: 115549 - DNA, 75 bp, Artificial Sequence
  Synthetic
gcccttttgagagtgtgtgcactggagaagcagctcgcggggggtaagtacatccatgtagcactaattaccctt

SEQ ID NO: 115550 - DNA, 75 bp, Artificial Sequence
  Synthetic
gcccttttgagagtgtgtgcactggagaagcagctcgcggggggtaagtacatccacgtagcactaattaccctt

SEQ ID NO: 115551 - DNA, 75 bp, Artificial Sequence
  Synthetic
gcccttttgagagtgtgtgcactggagaagcagctcgcggggggtaagtacatccaggtagcactaattaccctt

SEQ ID NO: 115552 - DNA, 75 bp, Artificial Sequence
  Synthetic
gcccttttgagagtgtgtgcactggtgaagcagctcgcggggggtaagtacatccaagtagcactaattaccctt

SEQ ID NO: 115553 - DNA, 75 bp, Artificial Sequence
  Synthetic
gcccttttgagagtgtgtgcactggtgaagcagctcgcggggggtaagtacatccatgtagcactaattaccctt

SEQ ID NO: 115554 - DNA, 75 bp, Artificial Sequence
  Synthetic
gcccttttgagagtgtgtgcactggtgaagcagctcgcggggggtaagtacatccacgtagcactaattaccctt

SEQ ID NO: 115555 - DNA, 75 bp, Artificial Sequence
  Synthetic
gcccttttgagagtgtgtgcactggtgaagcagctcgcggggggtaagtacatccaggtagcactaattaccctt

SEQ ID NO: 115556 - DNA, 75 bp, Artificial Sequence
  Synthetic
gcccttttgagagtgtgtgcactggcgaagcagctcgcggggggtaagtacatccaagtagcactaattaccctt

SEQ ID NO: 115557 - DNA, 75 bp, Artificial Sequence
  Synthetic
gcccttttgagagtgtgtgcactggcgaagcagctcgcggggggtaagtacatccatgtagcactaattaccctt

SEQ ID NO: 115558 - DNA, 75 bp, Artificial Sequence
  Synthetic
gcccttttgagagtgtgtgcactggcgaagcagctcgcggggggtaagtacatccacgtagcactaattaccctt

SEQ ID NO: 115559 - DNA, 75 bp, Artificial Sequence
  Synthetic
gcccttttgagagtgtgtgcactggcgaagcagctcgcggggggtaagtacatccaggtagcactaattaccctt

SEQ ID NO: 115560 - DNA, 75 bp, Artificial Sequence
  Synthetic
gcccttttgagagtgtgtgcactggggaagcagctcgcggggggtaagtacatccaagtagcactaattaccctt

SEQ ID NO: 115561 - DNA, 75 bp, Artificial Sequence
  Synthetic
gcccttttgagagtgtgtgcactggggaagcagctcgcggggggtaagtacatccatgtagcactaattaccctt

SEQ ID NO: 115562 - DNA, 75 bp, Artificial Sequence
  Synthetic
gcccttttgagagtgtgtgcactggggaagcagctcgcggggggtaagtacatccacgtagcactaattaccctt

SEQ ID NO: 115563 - DNA, 75 bp, Artificial Sequence
  Synthetic
gcccttttgagagtgtgtgcactggggaagcagctcgcggggggtaagtacatccaggtagcactaattaccctt

SEQ ID NO: 115564 - DNA, 75 bp, Artificial Sequence
  Synthetic
acccatatcggctatggcactacccatgcactgtcaactttaccgtcttcaaagtgaggatgtatgttggcggcg

SEQ ID NO: 115565 - DNA, 75 bp, Artificial Sequence
  Synthetic
cttggagtccgcgtctgtgagaagcgggcactgtatgacatagctcagaaactgccaacagcccttatggggccc

SEQ ID NO: 115566 - DNA, 75 bp, Artificial Sequence
  Synthetic
actgccaacagcccttatggggccctcgtatgggtttcagtactccccagcgcagcgggttgatttcttgctgaa

SEQ ID NO: 115567 - DNA, 75 bp, Artificial Sequence
  Synthetic
aacagtaggggtaggcatctttttgcttcccgctcggtagacgggaagcccactgctacactccattaactgttt

SEQ ID NO: 115568 - DNA, 75 bp, Artificial Sequence
  Synthetic
cgcgcaagcggcgtgcttaccacgagtctgggcaatactatgacctgcttcataaaagctgaggcagcctgccgt

SEQ ID NO: 115569 - DNA, 75 bp, Artificial Sequence
  Synthetic
tcttcagtccaatggagaggaaagtcatcgtgtggggtgcggagacgacggcttgtggtgacatcatacaagggc

SEQ ID NO: 115570 - DNA, 75 bp, Artificial Sequence
  Synthetic
tcttcagtccaatggagaggaaagtcatcgtgtggggtgcggagacgacggcttgtggtgacatcatacatgggc

SEQ ID NO: 115571 - DNA, 75 bp, Artificial Sequence
  Synthetic
tcttcagtccaatggagaggaaagtcatcgtgtggggtgcggagacgacggcttgtggtgacatcatacacgggc

SEQ ID NO: 115572 - DNA, 75 bp, Artificial Sequence
  Synthetic
tcttcagtccaatggagaggaaagtcatcgtgtggggtgcggagacgacggcttgtggtgacatcatacaggggc

SEQ ID NO: 115573 - DNA, 75 bp, Artificial Sequence
  Synthetic
tcttcagtccaatggagaggaatgtcatcgtgtggggtgcggagacgacggcttgtggtgacatcatacaagggc

SEQ ID NO: 115574 - DNA, 75 bp, Artificial Sequence
  Synthetic
tcttcagtccaatggagaggaatgtcatcgtgtggggtgcggagacgacggcttgtggtgacatcatacatgggc

SEQ ID NO: 115575 - DNA, 75 bp, Artificial Sequence
  Synthetic
tcttcagtccaatggagaggaatgtcatcgtgtggggtgcggagacgacggcttgtggtgacatcatacacgggc

SEQ ID NO: 115576 - DNA, 75 bp, Artificial Sequence
  Synthetic
tcttcagtccaatggagaggaatgtcatcgtgtggggtgcggagacgacggcttgtggtgacatcatacaggggc

SEQ ID NO: 115577 - DNA, 75 bp, Artificial Sequence
  Synthetic
tcttcagtccaatggagaggaacgtcatcgtgtggggtgcggagacgacggcttgtggtgacatcatacaagggc

SEQ ID NO: 115578 - DNA, 75 bp, Artificial Sequence
  Synthetic
tcttcagtccaatggagaggaacgtcatcgtgtggggtgcggagacgacggcttgtggtgacatcatacatgggc

SEQ ID NO: 115579 - DNA, 75 bp, Artificial Sequence
  Synthetic
tcttcagtccaatggagaggaacgtcatcgtgtggggtgcggagacgacggcttgtggtgacatcatacacgggc

SEQ ID NO: 115580 - DNA, 75 bp, Artificial Sequence
  Synthetic
tcttcagtccaatggagaggaacgtcatcgtgtggggtgcggagacgacggcttgtggtgacatcatacaggggc

SEQ ID NO: 115581 - DNA, 75 bp, Artificial Sequence
  Synthetic
tcttcagtccaatggagaggaaggtcatcgtgtggggtgcggagacgacggcttgtggtgacatcatacaagggc

SEQ ID NO: 115582 - DNA, 75 bp, Artificial Sequence
  Synthetic
tcttcagtccaatggagaggaaggtcatcgtgtggggtgcggagacgacggcttgtggtgacatcatacatgggc

SEQ ID NO: 115583 - DNA, 75 bp, Artificial Sequence
  Synthetic
tcttcagtccaatggagaggaaggtcatcgtgtggggtgcggagacgacggcttgtggtgacatcatacacgggc

SEQ ID NO: 115584 - DNA, 75 bp, Artificial Sequence
  Synthetic
tcttcagtccaatggagaggaaggtcatcgtgtggggtgcggagacgacggcttgtggtgacatcatacaggggc

SEQ ID NO: 115585 - DNA, 75 bp, Artificial Sequence
  Synthetic
tgtgtcctgggccatcaagtgggagtacgtcatcctcttgtttctcctgcttgcagacgcgcgcatctgctcctg

SEQ ID NO: 115586 - DNA, 75 bp, Artificial Sequence
  Synthetic
accaaccgccgcccacaggacgttaagttcccgggtggcggccagatcgttggtggagtttacttgttgccgcgc

SEQ ID NO: 115587 - DNA, 75 bp, Artificial Sequence
  Synthetic
agaccctacgacggtgttgggcattggcacggttctcgaccaggctgagactgccggggttcgccttactgtgct

SEQ ID NO: 115588 - DNA, 75 bp, Artificial Sequence
  Synthetic
cactcagtggcaggtccttccctgctcctttacacccctccctgccctctccaccggcctgatccatctccatca

SEQ ID NO: 115589 - DNA, 75 bp, Artificial Sequence
  Synthetic
cataaccagagtgccgtacttcgtacgcgctcacgggctcattcgtgcatgcatgctggtgcggaaagtcgctgg

SEQ ID NO: 115590 - DNA, 75 bp, Artificial Sequence
  Synthetic
ccggggacggactggcagggggaggttgggcacttaccgatatgtcactccgggcgagagaccatctggcatgtt

SEQ ID NO: 115591 - DNA, 75 bp, Artificial Sequence
  Synthetic
ccggggtcggactggcagggggaggttgggcacttaccgatatgtcactccgggcgagagaccatctggcatgtt

SEQ ID NO: 115592 - DNA, 75 bp, Artificial Sequence
  Synthetic
ccggggccggactggcagggggaggttgggcacttaccgatatgtcactccgggcgagagaccatctggcatgtt

SEQ ID NO: 115593 - DNA, 75 bp, Artificial Sequence
  Synthetic
ccgggggcggactggcagggggaggttgggcacttaccgatatgtcactccgggcgagagaccatctggcatgtt

SEQ ID NO: 115594 - DNA, 75 bp, Artificial Sequence
  Synthetic
gacgccaggatctgtgcatgtctttggatgatgctgctggtgtcgcaggttgaggcagccctggctaacctgatt

SEQ ID NO: 115595 - DNA, 75 bp, Artificial Sequence
  Synthetic
taacatcctgctcctccaatgtttccgtggcccacgaccacaccggacagagatattactacctcactcgtgacc

SEQ ID NO: 115596 - DNA, 75 bp, Artificial Sequence
  Synthetic
agcgactttaagacctggctaaaagccaagctcatgccgcaactgcctgggattcccctcgtgtcctgccagcgc

SEQ ID NO: 115597 - DNA, 75 bp, Artificial Sequence
  Synthetic
gcggcaggtataaccaattatgacatgttggtctgcggagacgacttagtagtcgttgccgagagtgctgggatc

SEQ ID NO: 115598 - DNA, 75 bp, Artificial Sequence
  Synthetic
gcggcaggtattaccaattatgacatgttggtctgcggagacgacttagtagtcgttgccgagagtgctgggatc

SEQ ID NO: 115599 - DNA, 75 bp, Artificial Sequence
  Synthetic
gcggcaggtatcaccaattatgacatgttggtctgcggagacgacttagtagtcgttgccgagagtgctgggatc

SEQ ID NO: 115600 - DNA, 75 bp, Artificial Sequence
  Synthetic
gcggcaggtatgaccaattatgacatgttggtctgcggagacgacttagtagtcgttgccgagagtgctgggatc

SEQ ID NO: 115601 - DNA, 75 bp, Artificial Sequence
  Synthetic
cagtcttttcttggaacatcaatctcaggggttctgtggaccgtctttcacggtgccggaaacaaaacgctggct

SEQ ID NO: 115602 - DNA, 75 bp, Artificial Sequence
  Synthetic
gggaaccccgcgatagcatcactgatggcattcacagcctctatcaccagcccgctcaccacccaaagtaccctc

SEQ ID NO: 115603 - DNA, 75 bp, Artificial Sequence
  Synthetic
caggggttctgtggaccgtctttcacggtgccggaaacaaaacgctggctggccttcgcggtcccgtcacgcaga

SEQ ID NO: 115604 - DNA, 75 bp, Artificial Sequence
  Synthetic
ccacgtacgcggcctgcggaatgtggcctttgctcctcctgctcctcgcgttgcctgaacgggcttacgcgcaaa

SEQ ID NO: 115605 - DNA, 75 bp, Artificial Sequence
  Synthetic
ccacgtacgcggcctgcggaatgtggcctttgctcctcctgctcctcgcgttgcctgaacgggcttacgcgcata

SEQ ID NO: 115606 - DNA, 75 bp, Artificial Sequence
  Synthetic
ccacgtacgcggcctgcggaatgtggcctttgctcctcctgctcctcgcgttgcctgaacgggcttacgcgcaca

SEQ ID NO: 115607 - DNA, 75 bp, Artificial Sequence
  Synthetic
ccacgtacgcggcctgcggaatgtggcctttgctcctcctgctcctcgcgttgcctgaacgggcttacgcgcaga

SEQ ID NO: 115608 - DNA, 75 bp, Artificial Sequence
  Synthetic
gggacactatgtggaagtgcctcatccgcctcaaacccactttgcaagggccgaccccccttctctatagattgg

SEQ ID NO: 115609 - DNA, 75 bp, Artificial Sequence
  Synthetic
cacccggaacgccgatgtcatcccggcccgcagacggggggaccggagaggggcactgctctcccccaggccctt

SEQ ID NO: 115610 - DNA, 75 bp, Artificial Sequence
  Synthetic
cacccggaacgccgatgtcatcccggcccgcagacggggggaccggagaggggctctgctctcccccaggccctt

SEQ ID NO: 115611 - DNA, 75 bp, Artificial Sequence
  Synthetic
cacccggaacgccgatgtcatcccggcccgcagacggggggaccggagaggggccctgctctcccccaggccctt

SEQ ID NO: 115612 - DNA, 75 bp, Artificial Sequence
  Synthetic
cacccggaacgccgatgtcatcccggcccgcagacggggggaccggagaggggcgctgctctcccccaggccctt

SEQ ID NO: 115613 - DNA, 75 bp, Artificial Sequence
  Synthetic
cacccggaacgccgatgtcatcccggcccgcagtcggggggaccggagaggggcactgctctcccccaggccctt

SEQ ID NO: 115614 - DNA, 75 bp, Artificial Sequence
  Synthetic
cacccggaacgccgatgtcatcccggcccgcagtcggggggaccggagaggggctctgctctcccccaggccctt

SEQ ID NO: 115615 - DNA, 75 bp, Artificial Sequence
  Synthetic
cacccggaacgccgatgtcatcccggcccgcagtcggggggaccggagaggggccctgctctcccccaggccctt

SEQ ID NO: 115616 - DNA, 75 bp, Artificial Sequence
  Synthetic
cacccggaacgccgatgtcatcccggcccgcagtcggggggaccggagaggggcgctgctctcccccaggccctt

SEQ ID NO: 115617 - DNA, 75 bp, Artificial Sequence
  Synthetic
cacccggaacgccgatgtcatcccggcccgcagccggggggaccggagaggggcactgctctcccccaggccctt

SEQ ID NO: 115618 - DNA, 75 bp, Artificial Sequence
  Synthetic
cacccggaacgccgatgtcatcccggcccgcagccggggggaccggagaggggctctgctctcccccaggccctt

SEQ ID NO: 115619 - DNA, 75 bp, Artificial Sequence
  Synthetic
cacccggaacgccgatgtcatcccggcccgcagccggggggaccggagaggggccctgctctcccccaggccctt

SEQ ID NO: 115620 - DNA, 75 bp, Artificial Sequence
  Synthetic
cacccggaacgccgatgtcatcccggcccgcagccggggggaccggagaggggcgctgctctcccccaggccctt

SEQ ID NO: 115621 - DNA, 75 bp, Artificial Sequence
  Synthetic
cacccggaacgccgatgtcatcccggcccgcaggcggggggaccggagaggggcactgctctcccccaggccctt

SEQ ID NO: 115622 - DNA, 75 bp, Artificial Sequence
  Synthetic
cacccggaacgccgatgtcatcccggcccgcaggcggggggaccggagaggggctctgctctcccccaggccctt

SEQ ID NO: 115623 - DNA, 75 bp, Artificial Sequence
  Synthetic
cacccggaacgccgatgtcatcccggcccgcaggcggggggaccggagaggggccctgctctcccccaggccctt

SEQ ID NO: 115624 - DNA, 75 bp, Artificial Sequence
  Synthetic
cacccggaacgccgatgtcatcccggcccgcaggcggggggaccggagaggggcgctgctctcccccaggccctt

SEQ ID NO: 115625 - DNA, 75 bp, Artificial Sequence
  Synthetic
gtggctgcaatacttcatagctagggcggaggccttactgcatgtttatgttccatcatttgagccacgtggccc

SEQ ID NO: 115626 - DNA, 75 bp, Artificial Sequence
  Synthetic
ggtgggaggcattgtggctgctctggctgcctactgcttgtctgtgggcagcgttgtcatcaccggaagagtcat

SEQ ID NO: 115627 - DNA, 75 bp, Artificial Sequence
  Synthetic
tccatcgacttcatccctgtcgagactcttgacgttgtgactaggtctccaaattttactgacaacagcacacct

SEQ ID NO: 115628 - DNA, 75 bp, Artificial Sequence
  Synthetic
caggcttcgctgatgcgggtgccttactttgtaagggctcacgcgttgattaagatctgtagcctggtacgaggg

SEQ ID NO: 115629 - DNA, 75 bp, Artificial Sequence
  Synthetic
ggcttgcaactagcagagcaattcaaacagaaggccttgggcgttttgcagacggctggcaggcaggcacaggaa

SEQ ID NO: 115630 - DNA, 75 bp, Artificial Sequence
  Synthetic
cgtgtgcgctgccatcttaagacgccacgttggccctgctgagggtgccaaccagtggatgaacaggctgatagc

SEQ ID NO: 115631 - DNA, 75 bp, Artificial Sequence
  Synthetic
aacagaaggccttgggcgttttgcagacggctggcaggcaggcacaggaagcagctcctgtagtccaatctaact

SEQ ID NO: 115632 - DNA, 75 bp, Artificial Sequence
  Synthetic
actttgtaagggctcacgcgttgattaagatctgtagcctggtacgaggggtcgtgcatggcaggtactgccaaa

SEQ ID NO: 115633 - DNA, 75 bp, Artificial Sequence
  Synthetic
aggtgctggtgctgaacccctcggtggccgccaccttagggtttggggcttaaatgtcaaaagcgtatggagtca

SEQ ID NO: 115634 - DNA, 75 bp, Artificial Sequence
  Synthetic
aggtgctggtgctgaacccctcggtggccgccaccttagggtttggggcttatatgtcaaaagcgtatggagtca

SEQ ID NO: 115635 - DNA, 75 bp, Artificial Sequence
  Synthetic
aggtgctggtgctgaacccctcggtggccgccaccttagggtttggggcttacatgtcaaaagcgtatggagtca

SEQ ID NO: 115636 - DNA, 75 bp, Artificial Sequence
  Synthetic
aggtgctggtgctgaacccctcggtggccgccaccttagggtttggggcttagatgtcaaaagcgtatggagtca

SEQ ID NO: 115637 - DNA, 75 bp, Artificial Sequence
  Synthetic
cgatatcatcaacggcctcccagtctcggctaggctaggcaatgagatcttgctcggcccggctgacgatgaggt

SEQ ID NO: 115638 - DNA, 75 bp, Artificial Sequence
  Synthetic
agcctatgacatcataatgtgcgacgaatgccaatcaatggaatctacaaccatccttgggatcgggaccgtcct

SEQ ID NO: 115639 - DNA, 75 bp, Artificial Sequence
  Synthetic
agcctatgacatcataatgtgcgacgaatgccaatcaatggattctacaaccatccttgggatcgggaccgtcct

SEQ ID NO: 115640 - DNA, 75 bp, Artificial Sequence
  Synthetic
agcctatgacatcataatgtgcgacgaatgccaatcaatggactctacaaccatccttgggatcgggaccgtcct

SEQ ID NO: 115641 - DNA, 75 bp, Artificial Sequence
  Synthetic
agcctatgacatcataatgtgcgacgaatgccaatcaatggagtctacaaccatccttgggatcgggaccgtcct

SEQ ID NO: 115642 - DNA, 75 bp, Artificial Sequence
  Synthetic
agcctatgacatcataatgtgcgacgaatgccattcaatggaatctacaaccatccttgggatcgggaccgtcct

SEQ ID NO: 115643 - DNA, 75 bp, Artificial Sequence
  Synthetic
agcctatgacatcataatgtgcgacgaatgccattcaatggattctacaaccatccttgggatcgggaccgtcct

SEQ ID NO: 115644 - DNA, 75 bp, Artificial Sequence
  Synthetic
agcctatgacatcataatgtgcgacgaatgccattcaatggactctacaaccatccttgggatcgggaccgtcct

SEQ ID NO: 115645 - DNA, 75 bp, Artificial Sequence
  Synthetic
agcctatgacatcataatgtgcgacgaatgccattcaatggagtctacaaccatccttgggatcgggaccgtcct

SEQ ID NO: 115646 - DNA, 75 bp, Artificial Sequence
  Synthetic
agcctatgacatcataatgtgcgacgaatgccactcaatggaatctacaaccatccttgggatcgggaccgtcct

SEQ ID NO: 115647 - DNA, 75 bp, Artificial Sequence
  Synthetic
agcctatgacatcataatgtgcgacgaatgccactcaatggattctacaaccatccttgggatcgggaccgtcct

SEQ ID NO: 115648 - DNA, 75 bp, Artificial Sequence
  Synthetic
agcctatgacatcataatgtgcgacgaatgccactcaatggactctacaaccatccttgggatcgggaccgtcct

SEQ ID NO: 115649 - DNA, 75 bp, Artificial Sequence
  Synthetic
agcctatgacatcataatgtgcgacgaatgccactcaatggagtctacaaccatccttgggatcgggaccgtcct

SEQ ID NO: 115650 - DNA, 75 bp, Artificial Sequence
  Synthetic
agcctatgacatcataatgtgcgacgaatgccagtcaatggaatctacaaccatccttgggatcgggaccgtcct

SEQ ID NO: 115651 - DNA, 75 bp, Artificial Sequence
  Synthetic
agcctatgacatcataatgtgcgacgaatgccagtcaatggattctacaaccatccttgggatcgggaccgtcct

SEQ ID NO: 115652 - DNA, 75 bp, Artificial Sequence
  Synthetic
agcctatgacatcataatgtgcgacgaatgccagtcaatggactctacaaccatccttgggatcgggaccgtcct

SEQ ID NO: 115653 - DNA, 75 bp, Artificial Sequence
  Synthetic
agcctatgacatcataatgtgcgacgaatgccagtcaatggagtctacaaccatccttgggatcgggaccgtcct

SEQ ID NO: 115654 - DNA, 75 bp, Artificial Sequence
  Synthetic
tgcctatgacatcataatgtgcgacgaatgccaatcaatggaatctacaaccatccttgggatcgggaccgtcct

SEQ ID NO: 115655 - DNA, 75 bp, Artificial Sequence
  Synthetic
tgcctatgacatcataatgtgcgacgaatgccaatcaatggattctacaaccatccttgggatcgggaccgtcct

SEQ ID NO: 115656 - DNA, 75 bp, Artificial Sequence
  Synthetic
tgcctatgacatcataatgtgcgacgaatgccaatcaatggactctacaaccatccttgggatcgggaccgtcct

SEQ ID NO: 115657 - DNA, 75 bp, Artificial Sequence
  Synthetic
tgcctatgacatcataatgtgcgacgaatgccaatcaatggagtctacaaccatccttgggatcgggaccgtcct

SEQ ID NO: 115658 - DNA, 75 bp, Artificial Sequence
  Synthetic
tgcctatgacatcataatgtgcgacgaatgccattcaatggaatctacaaccatccttgggatcgggaccgtcct

SEQ ID NO: 115659 - DNA, 75 bp, Artificial Sequence
  Synthetic
tgcctatgacatcataatgtgcgacgaatgccattcaatggattctacaaccatccttgggatcgggaccgtcct

SEQ ID NO: 115660 - DNA, 75 bp, Artificial Sequence
  Synthetic
tgcctatgacatcataatgtgcgacgaatgccattcaatggactctacaaccatccttgggatcgggaccgtcct

SEQ ID NO: 115661 - DNA, 75 bp, Artificial Sequence
  Synthetic
tgcctatgacatcataatgtgcgacgaatgccattcaatggagtctacaaccatccttgggatcgggaccgtcct

SEQ ID NO: 115662 - DNA, 75 bp, Artificial Sequence
  Synthetic
tgcctatgacatcataatgtgcgacgaatgccactcaatggaatctacaaccatccttgggatcgggaccgtcct

SEQ ID NO: 115663 - DNA, 75 bp, Artificial Sequence
  Synthetic
tgcctatgacatcataatgtgcgacgaatgccactcaatggattctacaaccatccttgggatcgggaccgtcct

SEQ ID NO: 115664 - DNA, 75 bp, Artificial Sequence
  Synthetic
tgcctatgacatcataatgtgcgacgaatgccactcaatggactctacaaccatccttgggatcgggaccgtcct

SEQ ID NO: 115665 - DNA, 75 bp, Artificial Sequence
  Synthetic
tgcctatgacatcataatgtgcgacgaatgccactcaatggagtctacaaccatccttgggatcgggaccgtcct

SEQ ID NO: 115666 - DNA, 75 bp, Artificial Sequence
  Synthetic
tgcctatgacatcataatgtgcgacgaatgccagtcaatggaatctacaaccatccttgggatcgggaccgtcct

SEQ ID NO: 115667 - DNA, 75 bp, Artificial Sequence
  Synthetic
tgcctatgacatcataatgtgcgacgaatgccagtcaatggattctacaaccatccttgggatcgggaccgtcct

SEQ ID NO: 115668 - DNA, 75 bp, Artificial Sequence
  Synthetic
tgcctatgacatcataatgtgcgacgaatgccagtcaatggactctacaaccatccttgggatcgggaccgtcct

SEQ ID NO: 115669 - DNA, 75 bp, Artificial Sequence
  Synthetic
tgcctatgacatcataatgtgcgacgaatgccagtcaatggagtctacaaccatccttgggatcgggaccgtcct

SEQ ID NO: 115670 - DNA, 75 bp, Artificial Sequence
  Synthetic
cgcctatgacatcataatgtgcgacgaatgccaatcaatggaatctacaaccatccttgggatcgggaccgtcct

SEQ ID NO: 115671 - DNA, 75 bp, Artificial Sequence
  Synthetic
cgcctatgacatcataatgtgcgacgaatgccaatcaatggattctacaaccatccttgggatcgggaccgtcct

SEQ ID NO: 115672 - DNA, 75 bp, Artificial Sequence
  Synthetic
cgcctatgacatcataatgtgcgacgaatgccaatcaatggactctacaaccatccttgggatcgggaccgtcct

SEQ ID NO: 115673 - DNA, 75 bp, Artificial Sequence
  Synthetic
cgcctatgacatcataatgtgcgacgaatgccaatcaatggagtctacaaccatccttgggatcgggaccgtcct

SEQ ID NO: 115674 - DNA, 75 bp, Artificial Sequence
  Synthetic
cgcctatgacatcataatgtgcgacgaatgccattcaatggaatctacaaccatccttgggatcgggaccgtcct

SEQ ID NO: 115675 - DNA, 75 bp, Artificial Sequence
  Synthetic
cgcctatgacatcataatgtgcgacgaatgccattcaatggattctacaaccatccttgggatcgggaccgtcct

SEQ ID NO: 115676 - DNA, 75 bp, Artificial Sequence
  Synthetic
cgcctatgacatcataatgtgcgacgaatgccattcaatggactctacaaccatccttgggatcgggaccgtcct

SEQ ID NO: 115677 - DNA, 75 bp, Artificial Sequence
  Synthetic
cgcctatgacatcataatgtgcgacgaatgccattcaatggagtctacaaccatccttgggatcgggaccgtcct

SEQ ID NO: 115678 - DNA, 75 bp, Artificial Sequence
  Synthetic
cgcctatgacatcataatgtgcgacgaatgccactcaatggaatctacaaccatccttgggatcgggaccgtcct

SEQ ID NO: 115679 - DNA, 75 bp, Artificial Sequence
  Synthetic
cgcctatgacatcataatgtgcgacgaatgccactcaatggattctacaaccatccttgggatcgggaccgtcct

SEQ ID NO: 115680 - DNA, 75 bp, Artificial Sequence
  Synthetic
cgcctatgacatcataatgtgcgacgaatgccactcaatggactctacaaccatccttgggatcgggaccgtcct

SEQ ID NO: 115681 - DNA, 75 bp, Artificial Sequence
  Synthetic
cgcctatgacatcataatgtgcgacgaatgccactcaatggagtctacaaccatccttgggatcgggaccgtcct

SEQ ID NO: 115682 - DNA, 75 bp, Artificial Sequence
  Synthetic
cgcctatgacatcataatgtgcgacgaatgccagtcaatggaatctacaaccatccttgggatcgggaccgtcct

SEQ ID NO: 115683 - DNA, 75 bp, Artificial Sequence
  Synthetic
cgcctatgacatcataatgtgcgacgaatgccagtcaatggattctacaaccatccttgggatcgggaccgtcct

SEQ ID NO: 115684 - DNA, 75 bp, Artificial Sequence
  Synthetic
cgcctatgacatcataatgtgcgacgaatgccagtcaatggactctacaaccatccttgggatcgggaccgtcct

SEQ ID NO: 115685 - DNA, 75 bp, Artificial Sequence
  Synthetic
cgcctatgacatcataatgtgcgacgaatgccagtcaatggagtctacaaccatccttgggatcgggaccgtcct

SEQ ID NO: 115686 - DNA, 75 bp, Artificial Sequence
  Synthetic
ggcctatgacatcataatgtgcgacgaatgccaatcaatggaatctacaaccatccttgggatcgggaccgtcct

SEQ ID NO: 115687 - DNA, 75 bp, Artificial Sequence
  Synthetic
ggcctatgacatcataatgtgcgacgaatgccaatcaatggattctacaaccatccttgggatcgggaccgtcct

SEQ ID NO: 115688 - DNA, 75 bp, Artificial Sequence
  Synthetic
ggcctatgacatcataatgtgcgacgaatgccaatcaatggactctacaaccatccttgggatcgggaccgtcct

SEQ ID NO: 115689 - DNA, 75 bp, Artificial Sequence
  Synthetic
ggcctatgacatcataatgtgcgacgaatgccaatcaatggagtctacaaccatccttgggatcgggaccgtcct

SEQ ID NO: 115690 - DNA, 75 bp, Artificial Sequence
  Synthetic
ggcctatgacatcataatgtgcgacgaatgccattcaatggaatctacaaccatccttgggatcgggaccgtcct

SEQ ID NO: 115691 - DNA, 75 bp, Artificial Sequence
  Synthetic
ggcctatgacatcataatgtgcgacgaatgccattcaatggattctacaaccatccttgggatcgggaccgtcct

SEQ ID NO: 115692 - DNA, 75 bp, Artificial Sequence
  Synthetic
ggcctatgacatcataatgtgcgacgaatgccattcaatggactctacaaccatccttgggatcgggaccgtcct

SEQ ID NO: 115693 - DNA, 75 bp, Artificial Sequence
  Synthetic
ggcctatgacatcataatgtgcgacgaatgccattcaatggagtctacaaccatccttgggatcgggaccgtcct

SEQ ID NO: 115694 - DNA, 75 bp, Artificial Sequence
  Synthetic
ggcctatgacatcataatgtgcgacgaatgccactcaatggaatctacaaccatccttgggatcgggaccgtcct

SEQ ID NO: 115695 - DNA, 75 bp, Artificial Sequence
  Synthetic
ggcctatgacatcataatgtgcgacgaatgccactcaatggattctacaaccatccttgggatcgggaccgtcct

SEQ ID NO: 115696 - DNA, 75 bp, Artificial Sequence
  Synthetic
ggcctatgacatcataatgtgcgacgaatgccactcaatggactctacaaccatccttgggatcgggaccgtcct

SEQ ID NO: 115697 - DNA, 75 bp, Artificial Sequence
  Synthetic
ggcctatgacatcataatgtgcgacgaatgccactcaatggagtctacaaccatccttgggatcgggaccgtcct

SEQ ID NO: 115698 - DNA, 75 bp, Artificial Sequence
  Synthetic
ggcctatgacatcataatgtgcgacgaatgccagtcaatggaatctacaaccatccttgggatcgggaccgtcct

SEQ ID NO: 115699 - DNA, 75 bp, Artificial Sequence
  Synthetic
ggcctatgacatcataatgtgcgacgaatgccagtcaatggattctacaaccatccttgggatcgggaccgtcct

SEQ ID NO: 115700 - DNA, 75 bp, Artificial Sequence
  Synthetic
ggcctatgacatcataatgtgcgacgaatgccagtcaatggactctacaaccatccttgggatcgggaccgtcct

SEQ ID NO: 115701 - DNA, 75 bp, Artificial Sequence
  Synthetic
ggcctatgacatcataatgtgcgacgaatgccagtcaatggagtctacaaccatccttgggatcgggaccgtcct

SEQ ID NO: 115702 - DNA, 75 bp, Artificial Sequence
  Synthetic
cgggggggacatttatcacagcatgtcccgtgcccgaccccgctatttactcctgtgcctactcctacttagcgt

SEQ ID NO: 115703 - DNA, 75 bp, Artificial Sequence
  Synthetic
gcaacccccacggcctccacggcttttgtcgtgagtggccttgctggagctgccgtcggtagcgtggggctggga

SEQ ID NO: 115704 - DNA, 75 bp, Artificial Sequence
  Synthetic
cccattaccgcctatgcgcagcaaacccgaggcttgctcggcaccatcgtgacgagcctcactggcagggacaca

SEQ ID NO: 115705 - DNA, 75 bp, Artificial Sequence
  Synthetic
cccattaccgcctatgcgcagcaaacccgaggcttgctcggcaccatcgtgacgagcctcactggcagggacact

SEQ ID NO: 115706 - DNA, 75 bp, Artificial Sequence
  Synthetic
cccattaccgcctatgcgcagcaaacccgaggcttgctcggcaccatcgtgacgagcctcactggcagggacacc

SEQ ID NO: 115707 - DNA, 75 bp, Artificial Sequence
  Synthetic
cccattaccgcctatgcgcagcaaacccgaggcttgctcggcaccatcgtgacgagcctcactggcagggacacg

SEQ ID NO: 115708 - DNA, 75 bp, Artificial Sequence
  Synthetic
agccttcacggaggctatgacgagatactcggctcccccaggagacgccccgcagccagcatatgacctggaact

SEQ ID NO: 115709 - DNA, 75 bp, Artificial Sequence
  Synthetic
tcctgtgcctactcctacttagcgtaggggtaggcatctttttgctccccgctcgataagctgggagctaaacac

SEQ ID NO: 115710 - DNA, 75 bp, Artificial Sequence
  Synthetic
aggcgaaggcgtccacagttaaggctaaacttctatctgtagaagaagcctgcaagctgacgcccccacattcgg

SEQ ID NO: 115711 - DNA, 75 bp, Artificial Sequence
  Synthetic
tggtcaacctgctcccggccatactatcgcctggggccttggtggtgggggtggtgtgcgcggcgattctgcggc

SEQ ID NO: 115712 - DNA, 75 bp, Artificial Sequence
  Synthetic
cctaggaactgcggtaaaaggcgtgatgtggactgtgtaccatggagcgggcagcaaaacccttagcggccccaa

SEQ ID NO: 115713 - DNA, 75 bp, Artificial Sequence
  Synthetic
cctaggaactgcggtaaatggcgtgatgtggactgtgtaccatggagcgggcagcaaaacccttagcggccccaa

SEQ ID NO: 115714 - DNA, 75 bp, Artificial Sequence
  Synthetic
cctaggaactgcggtaaacggcgtgatgtggactgtgtaccatggagcgggcagcaaaacccttagcggccccaa

SEQ ID NO: 115715 - DNA, 75 bp, Artificial Sequence
  Synthetic
cctaggaactgcggtaaagggcgtgatgtggactgtgtaccatggagcgggcagcaaaacccttagcggccccaa

SEQ ID NO: 115716 - DNA, 75 bp, Artificial Sequence
  Synthetic
cgtgcagtggatgaatcgcttgatcgcttttgcgtcgcgaggcaaccacgtagctcccacgcactacgtccctga

SEQ ID NO: 115717 - DNA, 75 bp, Artificial Sequence
  Synthetic
agcccttgctcagggacgaagtgactttctctgtgggtctttcaaactatgccatagggtcgcagctcccttgcg

SEQ ID NO: 115718 - DNA, 75 bp, Artificial Sequence
  Synthetic
gaggggggacacccggggcgcccttctgagccccaggccgatatccaccctcaaaggctcctccggtggcccact

SEQ ID NO: 115719 - DNA, 75 bp, Artificial Sequence
  Synthetic
cactcaggtcgcggacttcagcttggaccctacttttaccataacaacacagactgtcccccaagattctgtgtc

SEQ ID NO: 115720 - DNA, 75 bp, Artificial Sequence
  Synthetic
ccctgcgattcgtcgtggctgagggaggtctgggagtgggtctgcactgtactgactgacttcaaaacgtggctc

SEQ ID NO: 115721 - DNA, 75 bp, Artificial Sequence
  Synthetic
ggcagggggaggttgggcatatataggtatgtctcctctggtgagagggcgtcggggatgttcgataccgtagtg

SEQ ID NO: 115722 - DNA, 75 bp, Artificial Sequence
  Synthetic
cccggacatggaactcatcgaggctaacctcctttggaggcaggagatgggaggcaacatcactcgagtcgagtc

SEQ ID NO: 115723 - DNA, 75 bp, Artificial Sequence
  Synthetic
gcccctgcggagcaaacctggccgggcacgtcaaaaatggttcgatgaggatcgtcggacctaagacctgcagta

SEQ ID NO: 115724 - DNA, 75 bp, Artificial Sequence
  Synthetic
tgtgccaagatcacctggagttttgggaggccgtgttcactggcctcacacacattgatgcccatttcctctctc

SEQ ID NO: 115725 - DNA, 75 bp, Artificial Sequence
  Synthetic
cgaggagtacgtggaggtccgccgggtgggagattaccactaagtgacgggggtgacacaagacaacatcaagtg

SEQ ID NO: 115726 - DNA, 75 bp, Artificial Sequence
  Synthetic
cgaggagtacgtggaggtccgccgggtgggagattaccactatgtgacgggggtgacacaagacaacatcaagtg

SEQ ID NO: 115727 - DNA, 75 bp, Artificial Sequence
  Synthetic
cgaggagtacgtggaggtccgccgggtgggagattaccactacgtgacgggggtgacacaagacaacatcaagtg

SEQ ID NO: 115728 - DNA, 75 bp, Artificial Sequence
  Synthetic
cgaggagtacgtggaggtccgccgggtgggagattaccactaggtgacgggggtgacacaagacaacatcaagtg

SEQ ID NO: 115729 - DNA, 75 bp, Artificial Sequence
  Synthetic
tccatacctggtggcctaccaagccacggtatgcgccagggccaaggctcctcccccatcttgggatgttatgtg

SEQ ID NO: 115730 - DNA, 75 bp, Artificial Sequence
  Synthetic
cacctatgggaagttcctagcggatggaggatgctcaggaggagcgtatgacatcatcatttgtgatgagtgcca

SEQ ID NO: 115731 - DNA, 75 bp, Artificial Sequence
  Synthetic
gaacattggtactagctactacgccactaatgattgctcgaacaacagcattacctggcaactcactgacgcagt

SEQ ID NO: 115732 - DNA, 75 bp, Artificial Sequence
  Synthetic
accaagtacatcgccacgtgcatgcaagctgatcttgagatcatgacaagcacgtgggtccttgcggggggagtt

SEQ ID NO: 115733 - DNA, 75 bp, Artificial Sequence
  Synthetic
tcattcagcgtggggctcaataccttcgtggtagggtcccagctcccttgcgagcctgaacctgatgtagcagtt

SEQ ID NO: 115734 - DNA, 75 bp, Artificial Sequence
  Synthetic
tcattcagcgtggggctcaataccttcgtggttgggtcccagctcccttgcgagcctgaacctgatgtagcagtt

SEQ ID NO: 115735 - DNA, 75 bp, Artificial Sequence
  Synthetic
tcattcagcgtggggctcaataccttcgtggtcgggtcccagctcccttgcgagcctgaacctgatgtagcagtt

SEQ ID NO: 115736 - DNA, 75 bp, Artificial Sequence
  Synthetic
tcattcagcgtggggctcaataccttcgtggtggggtcccagctcccttgcgagcctgaacctgatgtagcagtt

SEQ ID NO: 115737 - DNA, 75 bp, Artificial Sequence
  Synthetic
cgtgctcgcaaccgccacgccgccagggtctgtgacaactccccatcccaacatagaggaagtcgccctgccgac

SEQ ID NO: 115738 - DNA, 75 bp, Artificial Sequence
  Synthetic
gacgcggaaacctataccaccgggggaagtgtcgcccgcggcgcgtctggacttgctaatctctttagccctggc

SEQ ID NO: 115739 - DNA, 75 bp, Artificial Sequence
  Synthetic
tgtggctgtgaaatatcgcggagcgctcactcacaacctgcgaacacacgtcgacgtgatcgtaatggcagctac

SEQ ID NO: 115740 - DNA, 75 bp, Artificial Sequence
  Synthetic
tcctttatgaagcgtttgatgaaatggaggagtgcgcttctaggacagccctcatcgaagaggggcatcggatag

SEQ ID NO: 115741 - DNA, 75 bp, Artificial Sequence
  Synthetic
tcctttatgaagcgtttgatgaaatggaggagtgcgcttctaggacagccctcatcgatgaggggcatcggatag

SEQ ID NO: 115742 - DNA, 75 bp, Artificial Sequence
  Synthetic
tcctttatgaagcgtttgatgaaatggaggagtgcgcttctaggacagccctcatcgacgaggggcatcggatag

SEQ ID NO: 115743 - DNA, 75 bp, Artificial Sequence
  Synthetic
tcctttatgaagcgtttgatgaaatggaggagtgcgcttctaggacagccctcatcgaggaggggcatcggatag

SEQ ID NO: 115744 - DNA, 75 bp, Artificial Sequence
  Synthetic
tcctttatgaagcgtttgatgaaatggaggagtgcgcttctaggactgccctcatcgaagaggggcatcggatag

SEQ ID NO: 115745 - DNA, 75 bp, Artificial Sequence
  Synthetic
tcctttatgaagcgtttgatgaaatggaggagtgcgcttctaggactgccctcatcgatgaggggcatcggatag

SEQ ID NO: 115746 - DNA, 75 bp, Artificial Sequence
  Synthetic
tcctttatgaagcgtttgatgaaatggaggagtgcgcttctaggactgccctcatcgacgaggggcatcggatag

SEQ ID NO: 115747 - DNA, 75 bp, Artificial Sequence
  Synthetic
tcctttatgaagcgtttgatgaaatggaggagtgcgcttctaggactgccctcatcgaggaggggcatcggatag

SEQ ID NO: 115748 - DNA, 75 bp, Artificial Sequence
  Synthetic
tcctttatgaagcgtttgatgaaatggaggagtgcgcttctaggaccgccctcatcgaagaggggcatcggatag

SEQ ID NO: 115749 - DNA, 75 bp, Artificial Sequence
  Synthetic
tcctttatgaagcgtttgatgaaatggaggagtgcgcttctaggaccgccctcatcgatgaggggcatcggatag

SEQ ID NO: 115750 - DNA, 75 bp, Artificial Sequence
  Synthetic
tcctttatgaagcgtttgatgaaatggaggagtgcgcttctaggaccgccctcatcgacgaggggcatcggatag

SEQ ID NO: 115751 - DNA, 75 bp, Artificial Sequence
  Synthetic
tcctttatgaagcgtttgatgaaatggaggagtgcgcttctaggaccgccctcatcgaggaggggcatcggatag

SEQ ID NO: 115752 - DNA, 75 bp, Artificial Sequence
  Synthetic
tcctttatgaagcgtttgatgaaatggaggagtgcgcttctaggacggccctcatcgaagaggggcatcggatag

SEQ ID NO: 115753 - DNA, 75 bp, Artificial Sequence
  Synthetic
tcctttatgaagcgtttgatgaaatggaggagtgcgcttctaggacggccctcatcgatgaggggcatcggatag

SEQ ID NO: 115754 - DNA, 75 bp, Artificial Sequence
  Synthetic
tcctttatgaagcgtttgatgaaatggaggagtgcgcttctaggacggccctcatcgacgaggggcatcggatag

SEQ ID NO: 115755 - DNA, 75 bp, Artificial Sequence
  Synthetic
tcctttatgaagcgtttgatgaaatggaggagtgcgcttctaggacggccctcatcgaggaggggcatcggatag

SEQ ID NO: 115756 - DNA, 75 bp, Artificial Sequence
  Synthetic
gccagctatccgctccatctctcaaggcaacttgtactgctcaccatgactcccctgacgctgacctaatcgagg

SEQ ID NO: 115757 - DNA, 75 bp, Artificial Sequence
  Synthetic
cccgtggctttgcatccctcttttcatctggggcgtctcagaagatccagctcataaacaccaacggcagctggc

SEQ ID NO: 115758 - DNA, 75 bp, Artificial Sequence
  Synthetic
ccaacctcttatggaggcaagagatgggaggcaacatcaccagggtagagtctgagaacaaggtggtagttttag

SEQ ID NO: 115759 - DNA, 75 bp, Artificial Sequence
  Synthetic
acaattttgggccaagcacatgtggaacttcatcagcggtatccaatacctcgcagggttgtccacgttgccggg

SEQ ID NO: 115760 - DNA, 75 bp, Artificial Sequence
  Synthetic
tgaagttgtcttcggcggccactggggtgtggtgtttggcttggcctacttctccatgcagggagcgtgggccaa

SEQ ID NO: 115761 - DNA, 75 bp, Artificial Sequence
  Synthetic
agttcaacgcgtccgggtgcccagagcgcttggccagctgccgccccatcgacgagttcgctcaggggtggggcc

SEQ ID NO: 115762 - DNA, 75 bp, Artificial Sequence
  Synthetic
cctcaggacgcggtttcccgctctcagcggagaggccgcaccggtagggggaggttaggtatatacagatttgtc

SEQ ID NO: 115763 - DNA, 75 bp, Artificial Sequence
  Synthetic
tctttcagtgccgctctcaccagcccgctatctaccagcactaccatcctccttaacatcatgggggggtggctg

SEQ ID NO: 115764 - DNA, 75 bp, Artificial Sequence
  Synthetic
tctttcagtgccgctctcaccagcccgctttctaccagcactaccatcctccttaacatcatgggggggtggctg

SEQ ID NO: 115765 - DNA, 75 bp, Artificial Sequence
  Synthetic
tctttcagtgccgctctcaccagcccgctctctaccagcactaccatcctccttaacatcatgggggggtggctg

SEQ ID NO: 115766 - DNA, 75 bp, Artificial Sequence
  Synthetic
tctttcagtgccgctctcaccagcccgctgtctaccagcactaccatcctccttaacatcatgggggggtggctg

SEQ ID NO: 115767 - DNA, 75 bp, Artificial Sequence
  Synthetic
agcggagaggccgcaccggtagggggaggttaggtatatacagatttgtcacaccaggggaaaggccatccggca

SEQ ID NO: 115768 - DNA, 75 bp, Artificial Sequence
  Synthetic
ctatacccgcgtcgcaggtgtgtggtccagtgtactgcttcaccccaagccctgttgtggtggggacgaccgatc

SEQ ID NO: 115769 - DNA, 75 bp, Artificial Sequence
  Synthetic
gagctggcggctaagtcttttggccggtctgaaccagacaccgattccgggaccggcctgacttacccaactgac

SEQ ID NO: 115770 - DNA, 75 bp, Artificial Sequence
  Synthetic
caaccaggttgagagcctacttcaacacgccaggcctccccgtctgccaagaccatcttgagttctgggaaagtg

SEQ ID NO: 115771 - DNA, 75 bp, Artificial Sequence
  Synthetic
ccccactacgacaatacgacgccatgtcgatttgctcgttggggcggctgctttctgctccgccatgtacgtggg

SEQ ID NO: 115772 - DNA, 75 bp, Artificial Sequence
  Synthetic
ggtctgaaccagacaccgattccgggaccggcctgacttacccaactgacacttcacagcctggcccctccccaa

SEQ ID NO: 115773 - DNA, 75 bp, Artificial Sequence
  Synthetic
aatttcgggggctctcgtcgctttcaagatcatgtctggcgagaagcccaccgtggaggacgtcgtcaacctatt

SEQ ID NO: 115774 - DNA, 75 bp, Artificial Sequence
  Synthetic
aatttcgggggctctcgtcgctttcaagatcatgtctggcgagaagcccaccgtggaggacgtcgtcaacctttt

SEQ ID NO: 115775 - DNA, 75 bp, Artificial Sequence
  Synthetic
aatttcgggggctctcgtcgctttcaagatcatgtctggcgagaagcccaccgtggaggacgtcgtcaacctctt

SEQ ID NO: 115776 - DNA, 75 bp, Artificial Sequence
  Synthetic
aatttcgggggctctcgtcgctttcaagatcatgtctggcgagaagcccaccgtggaggacgtcgtcaacctgtt

SEQ ID NO: 115777 - DNA, 75 bp, Artificial Sequence
  Synthetic
aatttcgggggctctcgtcgctttcaagatcatgtctggcgagatgcccaccgtggaggacgtcgtcaacctatt

SEQ ID NO: 115778 - DNA, 75 bp, Artificial Sequence
  Synthetic
aatttcgggggctctcgtcgctttcaagatcatgtctggcgagatgcccaccgtggaggacgtcgtcaacctttt

SEQ ID NO: 115779 - DNA, 75 bp, Artificial Sequence
  Synthetic
aatttcgggggctctcgtcgctttcaagatcatgtctggcgagatgcccaccgtggaggacgtcgtcaacctctt

SEQ ID NO: 115780 - DNA, 75 bp, Artificial Sequence
  Synthetic
aatttcgggggctctcgtcgctttcaagatcatgtctggcgagatgcccaccgtggaggacgtcgtcaacctgtt

SEQ ID NO: 115781 - DNA, 75 bp, Artificial Sequence
  Synthetic
aatttcgggggctctcgtcgctttcaagatcatgtctggcgagacgcccaccgtggaggacgtcgtcaacctatt

SEQ ID NO: 115782 - DNA, 75 bp, Artificial Sequence
  Synthetic
aatttcgggggctctcgtcgctttcaagatcatgtctggcgagacgcccaccgtggaggacgtcgtcaacctttt

SEQ ID NO: 115783 - DNA, 75 bp, Artificial Sequence
  Synthetic
aatttcgggggctctcgtcgctttcaagatcatgtctggcgagacgcccaccgtggaggacgtcgtcaacctctt

SEQ ID NO: 115784 - DNA, 75 bp, Artificial Sequence
  Synthetic
aatttcgggggctctcgtcgctttcaagatcatgtctggcgagacgcccaccgtggaggacgtcgtcaacctgtt

SEQ ID NO: 115785 - DNA, 75 bp, Artificial Sequence
  Synthetic
aatttcgggggctctcgtcgctttcaagatcatgtctggcgagaggcccaccgtggaggacgtcgtcaacctatt

SEQ ID NO: 115786 - DNA, 75 bp, Artificial Sequence
  Synthetic
aatttcgggggctctcgtcgctttcaagatcatgtctggcgagaggcccaccgtggaggacgtcgtcaacctttt

SEQ ID NO: 115787 - DNA, 75 bp, Artificial Sequence
  Synthetic
aatttcgggggctctcgtcgctttcaagatcatgtctggcgagaggcccaccgtggaggacgtcgtcaacctctt

SEQ ID NO: 115788 - DNA, 75 bp, Artificial Sequence
  Synthetic
aatttcgggggctctcgtcgctttcaagatcatgtctggcgagaggcccaccgtggaggacgtcgtcaacctgtt

SEQ ID NO: 115789 - DNA, 75 bp, Artificial Sequence
  Synthetic
tatttcgggggctctcgtcgctttcaagatcatgtctggcgagaagcccaccgtggaggacgtcgtcaacctatt

SEQ ID NO: 115790 - DNA, 75 bp, Artificial Sequence
  Synthetic
tatttcgggggctctcgtcgctttcaagatcatgtctggcgagaagcccaccgtggaggacgtcgtcaacctttt

SEQ ID NO: 115791 - DNA, 75 bp, Artificial Sequence
  Synthetic
tatttcgggggctctcgtcgctttcaagatcatgtctggcgagaagcccaccgtggaggacgtcgtcaacctctt

SEQ ID NO: 115792 - DNA, 75 bp, Artificial Sequence
  Synthetic
tatttcgggggctctcgtcgctttcaagatcatgtctggcgagaagcccaccgtggaggacgtcgtcaacctgtt

SEQ ID NO: 115793 - DNA, 75 bp, Artificial Sequence
  Synthetic
tatttcgggggctctcgtcgctttcaagatcatgtctggcgagatgcccaccgtggaggacgtcgtcaacctatt

SEQ ID NO: 115794 - DNA, 75 bp, Artificial Sequence
  Synthetic
tatttcgggggctctcgtcgctttcaagatcatgtctggcgagatgcccaccgtggaggacgtcgtcaacctttt

SEQ ID NO: 115795 - DNA, 75 bp, Artificial Sequence
  Synthetic
tatttcgggggctctcgtcgctttcaagatcatgtctggcgagatgcccaccgtggaggacgtcgtcaacctctt

SEQ ID NO: 115796 - DNA, 75 bp, Artificial Sequence
  Synthetic
tatttcgggggctctcgtcgctttcaagatcatgtctggcgagatgcccaccgtggaggacgtcgtcaacctgtt

SEQ ID NO: 115797 - DNA, 75 bp, Artificial Sequence
  Synthetic
tatttcgggggctctcgtcgctttcaagatcatgtctggcgagacgcccaccgtggaggacgtcgtcaacctatt

SEQ ID NO: 115798 - DNA, 75 bp, Artificial Sequence
  Synthetic
tatttcgggggctctcgtcgctttcaagatcatgtctggcgagacgcccaccgtggaggacgtcgtcaacctttt

SEQ ID NO: 115799 - DNA, 75 bp, Artificial Sequence
  Synthetic
tatttcgggggctctcgtcgctttcaagatcatgtctggcgagacgcccaccgtggaggacgtcgtcaacctctt

SEQ ID NO: 115800 - DNA, 75 bp, Artificial Sequence
  Synthetic
tatttcgggggctctcgtcgctttcaagatcatgtctggcgagacgcccaccgtggaggacgtcgtcaacctgtt

SEQ ID NO: 115801 - DNA, 75 bp, Artificial Sequence
  Synthetic
tatttcgggggctctcgtcgctttcaagatcatgtctggcgagaggcccaccgtggaggacgtcgtcaacctatt

SEQ ID NO: 115802 - DNA, 75 bp, Artificial Sequence
  Synthetic
tatttcgggggctctcgtcgctttcaagatcatgtctggcgagaggcccaccgtggaggacgtcgtcaacctttt

SEQ ID NO: 115803 - DNA, 75 bp, Artificial Sequence
  Synthetic
tatttcgggggctctcgtcgctttcaagatcatgtctggcgagaggcccaccgtggaggacgtcgtcaacctctt

SEQ ID NO: 115804 - DNA, 75 bp, Artificial Sequence
  Synthetic
tatttcgggggctctcgtcgctttcaagatcatgtctggcgagaggcccaccgtggaggacgtcgtcaacctgtt

SEQ ID NO: 115805 - DNA, 75 bp, Artificial Sequence
  Synthetic
catttcgggggctctcgtcgctttcaagatcatgtctggcgagaagcccaccgtggaggacgtcgtcaacctatt

SEQ ID NO: 115806 - DNA, 75 bp, Artificial Sequence
  Synthetic
catttcgggggctctcgtcgctttcaagatcatgtctggcgagaagcccaccgtggaggacgtcgtcaacctttt

SEQ ID NO: 115807 - DNA, 75 bp, Artificial Sequence
  Synthetic
catttcgggggctctcgtcgctttcaagatcatgtctggcgagaagcccaccgtggaggacgtcgtcaacctctt

SEQ ID NO: 115808 - DNA, 75 bp, Artificial Sequence
  Synthetic
catttcgggggctctcgtcgctttcaagatcatgtctggcgagaagcccaccgtggaggacgtcgtcaacctgtt

SEQ ID NO: 115809 - DNA, 75 bp, Artificial Sequence
  Synthetic
catttcgggggctctcgtcgctttcaagatcatgtctggcgagatgcccaccgtggaggacgtcgtcaacctatt

SEQ ID NO: 115810 - DNA, 75 bp, Artificial Sequence
  Synthetic
catttcgggggctctcgtcgctttcaagatcatgtctggcgagatgcccaccgtggaggacgtcgtcaacctttt

SEQ ID NO: 115811 - DNA, 75 bp, Artificial Sequence
  Synthetic
catttcgggggctctcgtcgctttcaagatcatgtctggcgagatgcccaccgtggaggacgtcgtcaacctctt

SEQ ID NO: 115812 - DNA, 75 bp, Artificial Sequence
  Synthetic
catttcgggggctctcgtcgctttcaagatcatgtctggcgagatgcccaccgtggaggacgtcgtcaacctgtt

SEQ ID NO: 115813 - DNA, 75 bp, Artificial Sequence
  Synthetic
catttcgggggctctcgtcgctttcaagatcatgtctggcgagacgcccaccgtggaggacgtcgtcaacctatt

SEQ ID NO: 115814 - DNA, 75 bp, Artificial Sequence
  Synthetic
catttcgggggctctcgtcgctttcaagatcatgtctggcgagacgcccaccgtggaggacgtcgtcaacctttt

SEQ ID NO: 115815 - DNA, 75 bp, Artificial Sequence
  Synthetic
catttcgggggctctcgtcgctttcaagatcatgtctggcgagacgcccaccgtggaggacgtcgtcaacctctt

SEQ ID NO: 115816 - DNA, 75 bp, Artificial Sequence
  Synthetic
catttcgggggctctcgtcgctttcaagatcatgtctggcgagacgcccaccgtggaggacgtcgtcaacctgtt

SEQ ID NO: 115817 - DNA, 75 bp, Artificial Sequence
  Synthetic
catttcgggggctctcgtcgctttcaagatcatgtctggcgagaggcccaccgtggaggacgtcgtcaacctatt

SEQ ID NO: 115818 - DNA, 75 bp, Artificial Sequence
  Synthetic
catttcgggggctctcgtcgctttcaagatcatgtctggcgagaggcccaccgtggaggacgtcgtcaacctttt

SEQ ID NO: 115819 - DNA, 75 bp, Artificial Sequence
  Synthetic
catttcgggggctctcgtcgctttcaagatcatgtctggcgagaggcccaccgtggaggacgtcgtcaacctctt

SEQ ID NO: 115820 - DNA, 75 bp, Artificial Sequence
  Synthetic
catttcgggggctctcgtcgctttcaagatcatgtctggcgagaggcccaccgtggaggacgtcgtcaacctgtt

SEQ ID NO: 115821 - DNA, 75 bp, Artificial Sequence
  Synthetic
gatttcgggggctctcgtcgctttcaagatcatgtctggcgagaagcccaccgtggaggacgtcgtcaacctatt

SEQ ID NO: 115822 - DNA, 75 bp, Artificial Sequence
  Synthetic
gatttcgggggctctcgtcgctttcaagatcatgtctggcgagaagcccaccgtggaggacgtcgtcaacctttt

SEQ ID NO: 115823 - DNA, 75 bp, Artificial Sequence
  Synthetic
gatttcgggggctctcgtcgctttcaagatcatgtctggcgagaagcccaccgtggaggacgtcgtcaacctctt

SEQ ID NO: 115824 - DNA, 75 bp, Artificial Sequence
  Synthetic
gatttcgggggctctcgtcgctttcaagatcatgtctggcgagaagcccaccgtggaggacgtcgtcaacctgtt

SEQ ID NO: 115825 - DNA, 75 bp, Artificial Sequence
  Synthetic
gatttcgggggctctcgtcgctttcaagatcatgtctggcgagatgcccaccgtggaggacgtcgtcaacctatt

SEQ ID NO: 115826 - DNA, 75 bp, Artificial Sequence
  Synthetic
gatttcgggggctctcgtcgctttcaagatcatgtctggcgagatgcccaccgtggaggacgtcgtcaacctttt

SEQ ID NO: 115827 - DNA, 75 bp, Artificial Sequence
  Synthetic
gatttcgggggctctcgtcgctttcaagatcatgtctggcgagatgcccaccgtggaggacgtcgtcaacctctt

SEQ ID NO: 115828 - DNA, 75 bp, Artificial Sequence
  Synthetic
gatttcgggggctctcgtcgctttcaagatcatgtctggcgagatgcccaccgtggaggacgtcgtcaacctgtt

SEQ ID NO: 115829 - DNA, 75 bp, Artificial Sequence
  Synthetic
gatttcgggggctctcgtcgctttcaagatcatgtctggcgagacgcccaccgtggaggacgtcgtcaacctatt

SEQ ID NO: 115830 - DNA, 75 bp, Artificial Sequence
  Synthetic
gatttcgggggctctcgtcgctttcaagatcatgtctggcgagacgcccaccgtggaggacgtcgtcaacctttt

SEQ ID NO: 115831 - DNA, 75 bp, Artificial Sequence
  Synthetic
gatttcgggggctctcgtcgctttcaagatcatgtctggcgagacgcccaccgtggaggacgtcgtcaacctctt

SEQ ID NO: 115832 - DNA, 75 bp, Artificial Sequence
  Synthetic
gatttcgggggctctcgtcgctttcaagatcatgtctggcgagacgcccaccgtggaggacgtcgtcaacctgtt

SEQ ID NO: 115833 - DNA, 75 bp, Artificial Sequence
  Synthetic
gatttcgggggctctcgtcgctttcaagatcatgtctggcgagaggcccaccgtggaggacgtcgtcaacctatt

SEQ ID NO: 115834 - DNA, 75 bp, Artificial Sequence
  Synthetic
gatttcgggggctctcgtcgctttcaagatcatgtctggcgagaggcccaccgtggaggacgtcgtcaacctttt

SEQ ID NO: 115835 - DNA, 75 bp, Artificial Sequence
  Synthetic
gatttcgggggctctcgtcgctttcaagatcatgtctggcgagaggcccaccgtggaggacgtcgtcaacctctt

SEQ ID NO: 115836 - DNA, 75 bp, Artificial Sequence
  Synthetic
gatttcgggggctctcgtcgctttcaagatcatgtctggcgagaggcccaccgtggaggacgtcgtcaacctgtt

SEQ ID NO: 115837 - DNA, 75 bp, Artificial Sequence
  Synthetic
ccgggtacccctggcccctgtatgggaatgagggctgcgggtgggcagggtggctcctgtccccccgcggctctc

SEQ ID NO: 115838 - DNA, 75 bp, Artificial Sequence
  Synthetic
gattgccctgtcccctgctccggctcatggcttcgagaagtgtgggactgggtatgctcaatcctaacagactta

SEQ ID NO: 115839 - DNA, 75 bp, Artificial Sequence
  Synthetic
gattgccctgtcccctgctccggctcatggcttcgagaagtgtgggactgggtatgctcaatcctaacagacttt

SEQ ID NO: 115840 - DNA, 75 bp, Artificial Sequence
  Synthetic
gattgccctgtcccctgctccggctcatggcttcgagaagtgtgggactgggtatgctcaatcctaacagacttc

SEQ ID NO: 115841 - DNA, 75 bp, Artificial Sequence
  Synthetic
gattgccctgtcccctgctccggctcatggcttcgagaagtgtgggactgggtatgctcaatcctaacagacttg

SEQ ID NO: 115842 - DNA, 75 bp, Artificial Sequence
  Synthetic
gattgccctgtcccctgctccggctcatggcttcgagaagtgtgggactgggtttgctcaatcctaacagactta

SEQ ID NO: 115843 - DNA, 75 bp, Artificial Sequence
  Synthetic
gattgccctgtcccctgctccggctcatggcttcgagaagtgtgggactgggtttgctcaatcctaacagacttt

SEQ ID NO: 115844 - DNA, 75 bp, Artificial Sequence
  Synthetic
gattgccctgtcccctgctccggctcatggcttcgagaagtgtgggactgggtttgctcaatcctaacagacttc

SEQ ID NO: 115845 - DNA, 75 bp, Artificial Sequence
  Synthetic
gattgccctgtcccctgctccggctcatggcttcgagaagtgtgggactgggtttgctcaatcctaacagacttg

SEQ ID NO: 115846 - DNA, 75 bp, Artificial Sequence
  Synthetic
gattgccctgtcccctgctccggctcatggcttcgagaagtgtgggactgggtctgctcaatcctaacagactta

SEQ ID NO: 115847 - DNA, 75 bp, Artificial Sequence
  Synthetic
gattgccctgtcccctgctccggctcatggcttcgagaagtgtgggactgggtctgctcaatcctaacagacttt

SEQ ID NO: 115848 - DNA, 75 bp, Artificial Sequence
  Synthetic
gattgccctgtcccctgctccggctcatggcttcgagaagtgtgggactgggtctgctcaatcctaacagacttc

SEQ ID NO: 115849 - DNA, 75 bp, Artificial Sequence
  Synthetic
gattgccctgtcccctgctccggctcatggcttcgagaagtgtgggactgggtctgctcaatcctaacagacttg

SEQ ID NO: 115850 - DNA, 75 bp, Artificial Sequence
  Synthetic
gattgccctgtcccctgctccggctcatggcttcgagaagtgtgggactgggtgtgctcaatcctaacagactta

SEQ ID NO: 115851 - DNA, 75 bp, Artificial Sequence
  Synthetic
gattgccctgtcccctgctccggctcatggcttcgagaagtgtgggactgggtgtgctcaatcctaacagacttt

SEQ ID NO: 115852 - DNA, 75 bp, Artificial Sequence
  Synthetic
gattgccctgtcccctgctccggctcatggcttcgagaagtgtgggactgggtgtgctcaatcctaacagacttc

SEQ ID NO: 115853 - DNA, 75 bp, Artificial Sequence
  Synthetic
gattgccctgtcccctgctccggctcatggcttcgagaagtgtgggactgggtgtgctcaatcctaacagacttg

SEQ ID NO: 115854 - DNA, 75 bp, Artificial Sequence
  Synthetic
gattgccctgtcccctgctccggctcatggcttcgagatgtgtgggactgggtatgctcaatcctaacagactta

SEQ ID NO: 115855 - DNA, 75 bp, Artificial Sequence
  Synthetic
gattgccctgtcccctgctccggctcatggcttcgagatgtgtgggactgggtatgctcaatcctaacagacttt

SEQ ID NO: 115856 - DNA, 75 bp, Artificial Sequence
  Synthetic
gattgccctgtcccctgctccggctcatggcttcgagatgtgtgggactgggtatgctcaatcctaacagacttc

SEQ ID NO: 115857 - DNA, 75 bp, Artificial Sequence
  Synthetic
gattgccctgtcccctgctccggctcatggcttcgagatgtgtgggactgggtatgctcaatcctaacagacttg

SEQ ID NO: 115858 - DNA, 75 bp, Artificial Sequence
  Synthetic
gattgccctgtcccctgctccggctcatggcttcgagatgtgtgggactgggtttgctcaatcctaacagactta

SEQ ID NO: 115859 - DNA, 75 bp, Artificial Sequence
  Synthetic
gattgccctgtcccctgctccggctcatggcttcgagatgtgtgggactgggtttgctcaatcctaacagacttt

SEQ ID NO: 115860 - DNA, 75 bp, Artificial Sequence
  Synthetic
gattgccctgtcccctgctccggctcatggcttcgagatgtgtgggactgggtttgctcaatcctaacagacttc

SEQ ID NO: 115861 - DNA, 75 bp, Artificial Sequence
  Synthetic
gattgccctgtcccctgctccggctcatggcttcgagatgtgtgggactgggtttgctcaatcctaacagacttg

SEQ ID NO: 115862 - DNA, 75 bp, Artificial Sequence
  Synthetic
gattgccctgtcccctgctccggctcatggcttcgagatgtgtgggactgggtctgctcaatcctaacagactta

SEQ ID NO: 115863 - DNA, 75 bp, Artificial Sequence
  Synthetic
gattgccctgtcccctgctccggctcatggcttcgagatgtgtgggactgggtctgctcaatcctaacagacttt

SEQ ID NO: 115864 - DNA, 75 bp, Artificial Sequence
  Synthetic
gattgccctgtcccctgctccggctcatggcttcgagatgtgtgggactgggtctgctcaatcctaacagacttc

SEQ ID NO: 115865 - DNA, 75 bp, Artificial Sequence
  Synthetic
gattgccctgtcccctgctccggctcatggcttcgagatgtgtgggactgggtctgctcaatcctaacagacttg

SEQ ID NO: 115866 - DNA, 75 bp, Artificial Sequence
  Synthetic
gattgccctgtcccctgctccggctcatggcttcgagatgtgtgggactgggtgtgctcaatcctaacagactta

SEQ ID NO: 115867 - DNA, 75 bp, Artificial Sequence
  Synthetic
gattgccctgtcccctgctccggctcatggcttcgagatgtgtgggactgggtgtgctcaatcctaacagacttt

SEQ ID NO: 115868 - DNA, 75 bp, Artificial Sequence
  Synthetic
gattgccctgtcccctgctccggctcatggcttcgagatgtgtgggactgggtgtgctcaatcctaacagacttc

SEQ ID NO: 115869 - DNA, 75 bp, Artificial Sequence
  Synthetic
gattgccctgtcccctgctccggctcatggcttcgagatgtgtgggactgggtgtgctcaatcctaacagacttg

SEQ ID NO: 115870 - DNA, 75 bp, Artificial Sequence
  Synthetic
gattgccctgtcccctgctccggctcatggcttcgagacgtgtgggactgggtatgctcaatcctaacagactta

SEQ ID NO: 115871 - DNA, 75 bp, Artificial Sequence
  Synthetic
gattgccctgtcccctgctccggctcatggcttcgagacgtgtgggactgggtatgctcaatcctaacagacttt

SEQ ID NO: 115872 - DNA, 75 bp, Artificial Sequence
  Synthetic
gattgccctgtcccctgctccggctcatggcttcgagacgtgtgggactgggtatgctcaatcctaacagacttc

SEQ ID NO: 115873 - DNA, 75 bp, Artificial Sequence
  Synthetic
gattgccctgtcccctgctccggctcatggcttcgagacgtgtgggactgggtatgctcaatcctaacagacttg

SEQ ID NO: 115874 - DNA, 75 bp, Artificial Sequence
  Synthetic
gattgccctgtcccctgctccggctcatggcttcgagacgtgtgggactgggtttgctcaatcctaacagactta

SEQ ID NO: 115875 - DNA, 75 bp, Artificial Sequence
  Synthetic
gattgccctgtcccctgctccggctcatggcttcgagacgtgtgggactgggtttgctcaatcctaacagacttt

SEQ ID NO: 115876 - DNA, 75 bp, Artificial Sequence
  Synthetic
gattgccctgtcccctgctccggctcatggcttcgagacgtgtgggactgggtttgctcaatcctaacagacttc

SEQ ID NO: 115877 - DNA, 75 bp, Artificial Sequence
  Synthetic
gattgccctgtcccctgctccggctcatggcttcgagacgtgtgggactgggtttgctcaatcctaacagacttg

SEQ ID NO: 115878 - DNA, 75 bp, Artificial Sequence
  Synthetic
gattgccctgtcccctgctccggctcatggcttcgagacgtgtgggactgggtctgctcaatcctaacagactta

SEQ ID NO: 115879 - DNA, 75 bp, Artificial Sequence
  Synthetic
gattgccctgtcccctgctccggctcatggcttcgagacgtgtgggactgggtctgctcaatcctaacagacttt

SEQ ID NO: 115880 - DNA, 75 bp, Artificial Sequence
  Synthetic
gattgccctgtcccctgctccggctcatggcttcgagacgtgtgggactgggtctgctcaatcctaacagacttc

SEQ ID NO: 115881 - DNA, 75 bp, Artificial Sequence
  Synthetic
gattgccctgtcccctgctccggctcatggcttcgagacgtgtgggactgggtctgctcaatcctaacagacttg

SEQ ID NO: 115882 - DNA, 75 bp, Artificial Sequence
  Synthetic
gattgccctgtcccctgctccggctcatggcttcgagacgtgtgggactgggtgtgctcaatcctaacagactta

SEQ ID NO: 115883 - DNA, 75 bp, Artificial Sequence
  Synthetic
gattgccctgtcccctgctccggctcatggcttcgagacgtgtgggactgggtgtgctcaatcctaacagacttt

SEQ ID NO: 115884 - DNA, 75 bp, Artificial Sequence
  Synthetic
gattgccctgtcccctgctccggctcatggcttcgagacgtgtgggactgggtgtgctcaatcctaacagacttc

SEQ ID NO: 115885 - DNA, 75 bp, Artificial Sequence
  Synthetic
gattgccctgtcccctgctccggctcatggcttcgagacgtgtgggactgggtgtgctcaatcctaacagacttg

SEQ ID NO: 115886 - DNA, 75 bp, Artificial Sequence
  Synthetic
gattgccctgtcccctgctccggctcatggcttcgagaggtgtgggactgggtatgctcaatcctaacagactta

SEQ ID NO: 115887 - DNA, 75 bp, Artificial Sequence
  Synthetic
gattgccctgtcccctgctccggctcatggcttcgagaggtgtgggactgggtatgctcaatcctaacagacttt

SEQ ID NO: 115888 - DNA, 75 bp, Artificial Sequence
  Synthetic
gattgccctgtcccctgctccggctcatggcttcgagaggtgtgggactgggtatgctcaatcctaacagacttc

SEQ ID NO: 115889 - DNA, 75 bp, Artificial Sequence
  Synthetic
gattgccctgtcccctgctccggctcatggcttcgagaggtgtgggactgggtatgctcaatcctaacagacttg

SEQ ID NO: 115890 - DNA, 75 bp, Artificial Sequence
  Synthetic
gattgccctgtcccctgctccggctcatggcttcgagaggtgtgggactgggtttgctcaatcctaacagactta

SEQ ID NO: 115891 - DNA, 75 bp, Artificial Sequence
  Synthetic
gattgccctgtcccctgctccggctcatggcttcgagaggtgtgggactgggtttgctcaatcctaacagacttt

SEQ ID NO: 115892 - DNA, 75 bp, Artificial Sequence
  Synthetic
gattgccctgtcccctgctccggctcatggcttcgagaggtgtgggactgggtttgctcaatcctaacagacttc

SEQ ID NO: 115893 - DNA, 75 bp, Artificial Sequence
  Synthetic
gattgccctgtcccctgctccggctcatggcttcgagaggtgtgggactgggtttgctcaatcctaacagacttg

SEQ ID NO: 115894 - DNA, 75 bp, Artificial Sequence
  Synthetic
gattgccctgtcccctgctccggctcatggcttcgagaggtgtgggactgggtctgctcaatcctaacagactta

SEQ ID NO: 115895 - DNA, 75 bp, Artificial Sequence
  Synthetic
gattgccctgtcccctgctccggctcatggcttcgagaggtgtgggactgggtctgctcaatcctaacagacttt

SEQ ID NO: 115896 - DNA, 75 bp, Artificial Sequence
  Synthetic
gattgccctgtcccctgctccggctcatggcttcgagaggtgtgggactgggtctgctcaatcctaacagacttc

SEQ ID NO: 115897 - DNA, 75 bp, Artificial Sequence
  Synthetic
gattgccctgtcccctgctccggctcatggcttcgagaggtgtgggactgggtctgctcaatcctaacagacttg

SEQ ID NO: 115898 - DNA, 75 bp, Artificial Sequence
  Synthetic
gattgccctgtcccctgctccggctcatggcttcgagaggtgtgggactgggtgtgctcaatcctaacagactta

SEQ ID NO: 115899 - DNA, 75 bp, Artificial Sequence
  Synthetic
gattgccctgtcccctgctccggctcatggcttcgagaggtgtgggactgggtgtgctcaatcctaacagacttt

SEQ ID NO: 115900 - DNA, 75 bp, Artificial Sequence
  Synthetic
gattgccctgtcccctgctccggctcatggcttcgagaggtgtgggactgggtgtgctcaatcctaacagacttc

SEQ ID NO: 115901 - DNA, 75 bp, Artificial Sequence
  Synthetic
gattgccctgtcccctgctccggctcatggcttcgagaggtgtgggactgggtgtgctcaatcctaacagacttg

SEQ ID NO: 115902 - DNA, 75 bp, Artificial Sequence
  Synthetic
tcgtactatcgggccaacctgccatcatcccagaccgagaggcgctctaccagcagtttgacgaaatggaggaat

SEQ ID NO: 115903 - DNA, 75 bp, Artificial Sequence
  Synthetic
ggaccaccctgggcattacggccatgtttgcgtttggcccgcatcaaaagctccaactcattaacaccaatggca

SEQ ID NO: 115904 - DNA, 75 bp, Artificial Sequence
  Synthetic
cgtttcctgtcaaaagggctacagaggggtgtgggccggaactggcatcatgactacacggtgtccgtgcggcgc

SEQ ID NO: 115905 - DNA, 75 bp, Artificial Sequence
  Synthetic
cgtttcctgtcaaaagggctacagaggggtgtgggccggtactggcatcatgactacacggtgtccgtgcggcgc

SEQ ID NO: 115906 - DNA, 75 bp, Artificial Sequence
  Synthetic
cgtttcctgtcaaaagggctacagaggggtgtgggccggcactggcatcatgactacacggtgtccgtgcggcgc

SEQ ID NO: 115907 - DNA, 75 bp, Artificial Sequence
  Synthetic
cgtttcctgtcaaaagggctacagaggggtgtgggccgggactggcatcatgactacacggtgtccgtgcggcgc

SEQ ID NO: 115908 - DNA, 75 bp, Artificial Sequence
  Synthetic
tggtagactacccttatagactgtggcattatccgtgcactgtaaatttcaccatcttcaaggtgcggatgtatg

SEQ ID NO: 115909 - DNA, 75 bp, Artificial Sequence
  Synthetic
ctccacttgccggggtgtgttccgtgtgtgaaagtgggcaataagtccaattgctggactcctgcgacgcccaca

SEQ ID NO: 115910 - DNA, 75 bp, Artificial Sequence
  Synthetic
ttatccaccttacccggcaaccccgctatagcttccctaatgtccttcaccgccgctgttaccagcccattaacc

SEQ ID NO: 115911 - DNA, 75 bp, Artificial Sequence
  Synthetic
tgggggacctgtgcgggtctgtctttcttgtcggccaactgttcaccttctctcccaggcgccactggacgacgc

SEQ ID NO: 115912 - DNA, 75 bp, Artificial Sequence
  Synthetic
ctatagcttccctaatgtccttcaccgccgctgttaccagcccattaaccacccaacaaacccttcttttcaaca

SEQ ID NO: 115913 - DNA, 75 bp, Artificial Sequence
  Synthetic
acctgtgcggaggcgccttcttgatgggccaacttttcaccattcgccctcgtcgccaccagactgtgcaggatt

SEQ ID NO: 115914 - DNA, 75 bp, Artificial Sequence
  Synthetic
tccacggttaccgaaagagacatcagggtcgaggaggagatctaccagtgctgtgacctggacgccgatgcccgc

SEQ ID NO: 115915 - DNA, 75 bp, Artificial Sequence
  Synthetic
gtctcaactcctacgtggtcgggtcacagctcccttgtgagcctgagccggacacggaggtgttggcatccatgt

SEQ ID NO: 115916 - DNA, 75 bp, Artificial Sequence
  Synthetic
gccggctacggcgccggcgtagcgggcgctgtggtcactttcaagatcatgagtggcgagatgccgtcaacagag

SEQ ID NO: 115917 - DNA, 75 bp, Artificial Sequence
  Synthetic
cctgagaattccgcaggtgctcatcgaggttttcaccggcggccactggggtatcatcggtgctgtggtgtattt

SEQ ID NO: 115918 - DNA, 75 bp, Artificial Sequence
  Synthetic
cttaaagtaccctactttgtgcgcgttcaaggcctcctccggatctgcgcgctagcgcggaaaatggccggaggt

SEQ ID NO: 115919 - DNA, 75 bp, Artificial Sequence
  Synthetic
gacttggtaaacctgctcccggccatactatcgccgggcgctctggtggtgggggtagtgtgcgccgcaatcctg

SEQ ID NO: 115920 - DNA, 75 bp, Artificial Sequence
  Synthetic
acccatgccaaaggccctgacattgacatggtggacgccaaactattcatggggggtagtgtcactcgcatagag

SEQ ID NO: 115921 - DNA, 75 bp, Artificial Sequence
  Synthetic
acccatgccaaaggccctgacattgacatggtggacgccaaacttttcatggggggtagtgtcactcgcatagag

SEQ ID NO: 115922 - DNA, 75 bp, Artificial Sequence
  Synthetic
acccatgccaaaggccctgacattgacatggtggacgccaaactcttcatggggggtagtgtcactcgcatagag

SEQ ID NO: 115923 - DNA, 75 bp, Artificial Sequence
  Synthetic
acccatgccaaaggccctgacattgacatggtggacgccaaactgttcatggggggtagtgtcactcgcatagag

SEQ ID NO: 115924 - DNA, 75 bp, Artificial Sequence
  Synthetic
acccatgccaaaggccctgacattgacatggtggacgccaatctattcatggggggtagtgtcactcgcatagag

SEQ ID NO: 115925 - DNA, 75 bp, Artificial Sequence
  Synthetic
acccatgccaaaggccctgacattgacatggtggacgccaatcttttcatggggggtagtgtcactcgcatagag

SEQ ID NO: 115926 - DNA, 75 bp, Artificial Sequence
  Synthetic
acccatgccaaaggccctgacattgacatggtggacgccaatctcttcatggggggtagtgtcactcgcatagag

SEQ ID NO: 115927 - DNA, 75 bp, Artificial Sequence
  Synthetic
acccatgccaaaggccctgacattgacatggtggacgccaatctgttcatggggggtagtgtcactcgcatagag

SEQ ID NO: 115928 - DNA, 75 bp, Artificial Sequence
  Synthetic
acccatgccaaaggccctgacattgacatggtggacgccaacctattcatggggggtagtgtcactcgcatagag

SEQ ID NO: 115929 - DNA, 75 bp, Artificial Sequence
  Synthetic
acccatgccaaaggccctgacattgacatggtggacgccaaccttttcatggggggtagtgtcactcgcatagag

SEQ ID NO: 115930 - DNA, 75 bp, Artificial Sequence
  Synthetic
acccatgccaaaggccctgacattgacatggtggacgccaacctcttcatggggggtagtgtcactcgcatagag

SEQ ID NO: 115931 - DNA, 75 bp, Artificial Sequence
  Synthetic
acccatgccaaaggccctgacattgacatggtggacgccaacctgttcatggggggtagtgtcactcgcatagag

SEQ ID NO: 115932 - DNA, 75 bp, Artificial Sequence
  Synthetic
acccatgccaaaggccctgacattgacatggtggacgccaagctattcatggggggtagtgtcactcgcatagag

SEQ ID NO: 115933 - DNA, 75 bp, Artificial Sequence
  Synthetic
acccatgccaaaggccctgacattgacatggtggacgccaagcttttcatggggggtagtgtcactcgcatagag

SEQ ID NO: 115934 - DNA, 75 bp, Artificial Sequence
  Synthetic
acccatgccaaaggccctgacattgacatggtggacgccaagctcttcatggggggtagtgtcactcgcatagag

SEQ ID NO: 115935 - DNA, 75 bp, Artificial Sequence
  Synthetic
acccatgccaaaggccctgacattgacatggtggacgccaagctgttcatggggggtagtgtcactcgcatagag

SEQ ID NO: 115936 - DNA, 75 bp, Artificial Sequence
  Synthetic
aggactgcaccatgctggtgtgcggtgacgacctggtcgtcatcgccgagagcgagggtgtagaagaggacgcgc

SEQ ID NO: 115937 - DNA, 75 bp, Artificial Sequence
  Synthetic
gtgggcagactcaccgggcttttcaccgcgggcccctctcagaagctgaaccttgttaacaccaatggcagctgg

SEQ ID NO: 115938 - DNA, 75 bp, Artificial Sequence
  Synthetic
cattgctttcgcatcgcgaggcaatcacgtgtctcccacgcactacgtccccgagtccgatgcggctgcacgcgt

SEQ ID NO: 115939 - DNA, 75 bp, Artificial Sequence
  Synthetic
cattgctttcgcatcgcgaggcaatcacgtgtctcccacgcactacgtccccgagtccgatgcggctgctcgcgt

SEQ ID NO: 115940 - DNA, 75 bp, Artificial Sequence
  Synthetic
cattgctttcgcatcgcgaggcaatcacgtgtctcccacgcactacgtccccgagtccgatgcggctgcccgcgt

SEQ ID NO: 115941 - DNA, 75 bp, Artificial Sequence
  Synthetic
cattgctttcgcatcgcgaggcaatcacgtgtctcccacgcactacgtccccgagtccgatgcggctgcgcgcgt

SEQ ID NO: 115942 - DNA, 75 bp, Artificial Sequence
  Synthetic
gcaaatttccaccggcattaccaccctgggcgcggcctgattaaaatccgccgctcctggagacatggaaaagac

SEQ ID NO: 115943 - DNA, 75 bp, Artificial Sequence
  Synthetic
gcaaatttccaccggcattaccaccctgggcgcggcctgattaaaatccgccgctcctggagacttggaaaagac

SEQ ID NO: 115944 - DNA, 75 bp, Artificial Sequence
  Synthetic
gcaaatttccaccggcattaccaccctgggcgcggcctgattaaaatccgccgctcctggagacctggaaaagac

SEQ ID NO: 115945 - DNA, 75 bp, Artificial Sequence
  Synthetic
gcaaatttccaccggcattaccaccctgggcgcggcctgattaaaatccgccgctcctggagacgtggaaaagac

SEQ ID NO: 115946 - DNA, 75 bp, Artificial Sequence
  Synthetic
gcaaatttccaccggcattaccaccctgggcgcggcctgattataatccgccgctcctggagacatggaaaagac

SEQ ID NO: 115947 - DNA, 75 bp, Artificial Sequence
  Synthetic
gcaaatttccaccggcattaccaccctgggcgcggcctgattataatccgccgctcctggagacttggaaaagac

SEQ ID NO: 115948 - DNA, 75 bp, Artificial Sequence
  Synthetic
gcaaatttccaccggcattaccaccctgggcgcggcctgattataatccgccgctcctggagacctggaaaagac

SEQ ID NO: 115949 - DNA, 75 bp, Artificial Sequence
  Synthetic
gcaaatttccaccggcattaccaccctgggcgcggcctgattataatccgccgctcctggagacgtggaaaagac

SEQ ID NO: 115950 - DNA, 75 bp, Artificial Sequence
  Synthetic
gcaaatttccaccggcattaccaccctgggcgcggcctgattacaatccgccgctcctggagacatggaaaagac

SEQ ID NO: 115951 - DNA, 75 bp, Artificial Sequence
  Synthetic
gcaaatttccaccggcattaccaccctgggcgcggcctgattacaatccgccgctcctggagacttggaaaagac

SEQ ID NO: 115952 - DNA, 75 bp, Artificial Sequence
  Synthetic
gcaaatttccaccggcattaccaccctgggcgcggcctgattacaatccgccgctcctggagacctggaaaagac

SEQ ID NO: 115953 - DNA, 75 bp, Artificial Sequence
  Synthetic
gcaaatttccaccggcattaccaccctgggcgcggcctgattacaatccgccgctcctggagacgtggaaaagac

SEQ ID NO: 115954 - DNA, 75 bp, Artificial Sequence
  Synthetic
gcaaatttccaccggcattaccaccctgggcgcggcctgattagaatccgccgctcctggagacatggaaaagac

SEQ ID NO: 115955 - DNA, 75 bp, Artificial Sequence
  Synthetic
gcaaatttccaccggcattaccaccctgggcgcggcctgattagaatccgccgctcctggagacttggaaaagac

SEQ ID NO: 115956 - DNA, 75 bp, Artificial Sequence
  Synthetic
gcaaatttccaccggcattaccaccctgggcgcggcctgattagaatccgccgctcctggagacctggaaaagac

SEQ ID NO: 115957 - DNA, 75 bp, Artificial Sequence
  Synthetic
gcaaatttccaccggcattaccaccctgggcgcggcctgattagaatccgccgctcctggagacgtggaaaagac

SEQ ID NO: 115958 - DNA, 75 bp, Artificial Sequence
  Synthetic
ctgctggcactaccccccaaaaccttgtggtatcgtgcccgcaaagagcgtgtgtggcccggtatattgcttcac

SEQ ID NO: 115959 - DNA, 75 bp, Artificial Sequence
  Synthetic
acatgcactacccgccatgactccccagacgctgacctcatcgaggccaacctcctgtggcggcaggagatgggc

SEQ ID NO: 115960 - DNA, 75 bp, Artificial Sequence
  Synthetic
tgggagatctgggactgggtctgcaccgtattgtcagactttaagcattggctaaaggcaaaattattgccccgg

SEQ ID NO: 115961 - DNA, 75 bp, Artificial Sequence
  Synthetic
tgggagatctgggactgggtctgcaccgtattgtctgactttaagcattggctaaaggcaaaattattgccccgg

SEQ ID NO: 115962 - DNA, 75 bp, Artificial Sequence
  Synthetic
tgggagatctgggactgggtctgcaccgtattgtccgactttaagcattggctaaaggcaaaattattgccccgg

SEQ ID NO: 115963 - DNA, 75 bp, Artificial Sequence
  Synthetic
tgggagatctgggactgggtctgcaccgtattgtcggactttaagcattggctaaaggcaaaattattgccccgg

SEQ ID NO: 115964 - DNA, 75 bp, Artificial Sequence
  Synthetic
tgggagatctgggactgggtctgcaccgttttgtcagactttaagcattggctaaaggcaaaattattgccccgg

SEQ ID NO: 115965 - DNA, 75 bp, Artificial Sequence
  Synthetic
tgggagatctgggactgggtctgcaccgttttgtctgactttaagcattggctaaaggcaaaattattgccccgg

SEQ ID NO: 115966 - DNA, 75 bp, Artificial Sequence
  Synthetic
tgggagatctgggactgggtctgcaccgttttgtccgactttaagcattggctaaaggcaaaattattgccccgg

SEQ ID NO: 115967 - DNA, 75 bp, Artificial Sequence
  Synthetic
tgggagatctgggactgggtctgcaccgttttgtcggactttaagcattggctaaaggcaaaattattgccccgg

SEQ ID NO: 115968 - DNA, 75 bp, Artificial Sequence
  Synthetic
tgggagatctgggactgggtctgcaccgtcttgtcagactttaagcattggctaaaggcaaaattattgccccgg

SEQ ID NO: 115969 - DNA, 75 bp, Artificial Sequence
  Synthetic
tgggagatctgggactgggtctgcaccgtcttgtctgactttaagcattggctaaaggcaaaattattgccccgg

SEQ ID NO: 115970 - DNA, 75 bp, Artificial Sequence
  Synthetic
tgggagatctgggactgggtctgcaccgtcttgtccgactttaagcattggctaaaggcaaaattattgccccgg

SEQ ID NO: 115971 - DNA, 75 bp, Artificial Sequence
  Synthetic
tgggagatctgggactgggtctgcaccgtcttgtcggactttaagcattggctaaaggcaaaattattgccccgg

SEQ ID NO: 115972 - DNA, 75 bp, Artificial Sequence
  Synthetic
tgggagatctgggactgggtctgcaccgtgttgtcagactttaagcattggctaaaggcaaaattattgccccgg

SEQ ID NO: 115973 - DNA, 75 bp, Artificial Sequence
  Synthetic
tgggagatctgggactgggtctgcaccgtgttgtctgactttaagcattggctaaaggcaaaattattgccccgg

SEQ ID NO: 115974 - DNA, 75 bp, Artificial Sequence
  Synthetic
tgggagatctgggactgggtctgcaccgtgttgtccgactttaagcattggctaaaggcaaaattattgccccgg

SEQ ID NO: 115975 - DNA, 75 bp, Artificial Sequence
  Synthetic
tgggagatctgggactgggtctgcaccgtgttgtcggactttaagcattggctaaaggcaaaattattgccccgg

SEQ ID NO: 115976 - DNA, 75 bp, Artificial Sequence
  Synthetic
agcgtttgtcccattgcaagccacttacacatttccatcaagggtggggtcccatttcttatgccaacgtgtccg

SEQ ID NO: 115977 - DNA, 75 bp, Artificial Sequence
  Synthetic
tgggtggccgtcatcctacacccgcgtcttgtgtttgagatcacaaaatggttgttggcaattctggggcctgcc

SEQ ID NO: 115978 - DNA, 75 bp, Artificial Sequence
  Synthetic
gtccgtctgaagacaagccttactgctggcactaccccccccgtccgtgcggggtggtgcaggcaaaggacgtgt

SEQ ID NO: 115979 - DNA, 75 bp, Artificial Sequence
  Synthetic
gctaaaggcaaaattattgccccggatgcctggcatccccttctattcctgtcaaaagggataaaagggggagtg

SEQ ID NO: 115980 - DNA, 75 bp, Artificial Sequence
  Synthetic
gctaaaggcaaaattattgccccggatgcctggcatccccttctattcctgtcaaaagggatataagggggagtg

SEQ ID NO: 115981 - DNA, 75 bp, Artificial Sequence
  Synthetic
gctaaaggcaaaattattgccccggatgcctggcatccccttctattcctgtcaaaagggatacaagggggagtg

SEQ ID NO: 115982 - DNA, 75 bp, Artificial Sequence
  Synthetic
gctaaaggcaaaattattgccccggatgcctggcatccccttctattcctgtcaaaagggatagaagggggagtg

SEQ ID NO: 115983 - DNA, 75 bp, Artificial Sequence
  Synthetic
atgacccatttcttctcaatactccagagccaggaagcccttgaaaaagcactcgacttcgacatgtacggagtc

SEQ ID NO: 115984 - DNA, 75 bp, Artificial Sequence
  Synthetic
gtaagacacctcgcaggagctaggtacatccagatgctgttgatcaccatgggcaggtggaccggcacttacatc

SEQ ID NO: 115985 - DNA, 75 bp, Artificial Sequence
  Synthetic
agtaacacctggcatgggaccttccccatcaatgcgtacaccacaggccccggcgtgcccatcccagcgccaaac

SEQ ID NO: 115986 - DNA, 75 bp, Artificial Sequence
  Synthetic
ctttttgttatccagccagagacctccatcaggcgggaggtacggatgcacctggatgaacgcgacggggttcgt

SEQ ID NO: 115987 - DNA, 75 bp, Artificial Sequence
  Synthetic
acgaacctgatgattcagaaacgggatctgcgtcttctatgcccccccttgagggggagcctggagacccggacc

SEQ ID NO: 115988 - DNA, 75 bp, Artificial Sequence
  Synthetic
acgaacctgatgattctgaaacgggatctgcgtcttctatgcccccccttgagggggagcctggagacccggacc

SEQ ID NO: 115989 - DNA, 75 bp, Artificial Sequence
  Synthetic
acgaacctgatgattccgaaacgggatctgcgtcttctatgcccccccttgagggggagcctggagacccggacc

SEQ ID NO: 115990 - DNA, 75 bp, Artificial Sequence
  Synthetic
acgaacctgatgattcggaaacgggatctgcgtcttctatgcccccccttgagggggagcctggagacccggacc

SEQ ID NO: 115991 - DNA, 75 bp, Artificial Sequence
  Synthetic
cgcggagacccacgtcaccgggggagctgtcgcccgtagcgcgtctttgctttcaagctttttcaacacgggccc

SEQ ID NO: 115992 - DNA, 75 bp, Artificial Sequence
  Synthetic
ccatcaggcgggaggtacggatgcacctggatgaacgcgacggggttcgtcaagacttgcggtgctccgccgtgc

SEQ ID NO: 115993 - DNA, 75 bp, Artificial Sequence
  Synthetic
cgagttcttcactgaggtggaaggtgtcaggcttcaacgccatgcgcccgcctgcaagcccttgctgacggaaga

SEQ ID NO: 115994 - DNA, 75 bp, Artificial Sequence
  Synthetic
cgagttcttcactgaggtggaaggtgtcaggcttcatcgccatgcgcccgcctgcaagcccttgctgacggaaga

SEQ ID NO: 115995 - DNA, 75 bp, Artificial Sequence
  Synthetic
cgagttcttcactgaggtggaaggtgtcaggcttcaccgccatgcgcccgcctgcaagcccttgctgacggaaga

SEQ ID NO: 115996 - DNA, 75 bp, Artificial Sequence
  Synthetic
cgagttcttcactgaggtggaaggtgtcaggcttcagcgccatgcgcccgcctgcaagcccttgctgacggaaga

SEQ ID NO: 115997 - DNA, 75 bp, Artificial Sequence
  Synthetic
cgagttcttcactgaggtggatggtgtcaggcttcaacgccatgcgcccgcctgcaagcccttgctgacggaaga

SEQ ID NO: 115998 - DNA, 75 bp, Artificial Sequence
  Synthetic
cgagttcttcactgaggtggatggtgtcaggcttcatcgccatgcgcccgcctgcaagcccttgctgacggaaga

SEQ ID NO: 115999 - DNA, 75 bp, Artificial Sequence
  Synthetic
cgagttcttcactgaggtggatggtgtcaggcttcaccgccatgcgcccgcctgcaagcccttgctgacggaaga

SEQ ID NO: 116000 - DNA, 75 bp, Artificial Sequence
  Synthetic
cgagttcttcactgaggtggatggtgtcaggcttcagcgccatgcgcccgcctgcaagcccttgctgacggaaga

SEQ ID NO: 116001 - DNA, 75 bp, Artificial Sequence
  Synthetic
cgagttcttcactgaggtggacggtgtcaggcttcaacgccatgcgcccgcctgcaagcccttgctgacggaaga

SEQ ID NO: 116002 - DNA, 75 bp, Artificial Sequence
  Synthetic
cgagttcttcactgaggtggacggtgtcaggcttcatcgccatgcgcccgcctgcaagcccttgctgacggaaga

SEQ ID NO: 116003 - DNA, 75 bp, Artificial Sequence
  Synthetic
cgagttcttcactgaggtggacggtgtcaggcttcaccgccatgcgcccgcctgcaagcccttgctgacggaaga

SEQ ID NO: 116004 - DNA, 75 bp, Artificial Sequence
  Synthetic
cgagttcttcactgaggtggacggtgtcaggcttcagcgccatgcgcccgcctgcaagcccttgctgacggaaga

SEQ ID NO: 116005 - DNA, 75 bp, Artificial Sequence
  Synthetic
cgagttcttcactgaggtggagggtgtcaggcttcaacgccatgcgcccgcctgcaagcccttgctgacggaaga

SEQ ID NO: 116006 - DNA, 75 bp, Artificial Sequence
  Synthetic
cgagttcttcactgaggtggagggtgtcaggcttcatcgccatgcgcccgcctgcaagcccttgctgacggaaga

SEQ ID NO: 116007 - DNA, 75 bp, Artificial Sequence
  Synthetic
cgagttcttcactgaggtggagggtgtcaggcttcaccgccatgcgcccgcctgcaagcccttgctgacggaaga

SEQ ID NO: 116008 - DNA, 75 bp, Artificial Sequence
  Synthetic
cgagttcttcactgaggtggagggtgtcaggcttcagcgccatgcgcccgcctgcaagcccttgctgacggaaga

SEQ ID NO: 116009 - DNA, 75 bp, Artificial Sequence
  Synthetic
cagggccttggctaactcccaggtgtttggtagactacccctacaggctatggcactatccatgcacagtcaatt

SEQ ID NO: 116010 - DNA, 75 bp, Artificial Sequence
  Synthetic
ctctgtggtgtgttgttccatgtcgtattcctggaccggggcgttgataactccctgtagtccggaagaagaaaa

SEQ ID NO: 116011 - DNA, 75 bp, Artificial Sequence
  Synthetic
acatttatcacagcgtgtcccgagcccgaccccgccatttactcctgtgcctactcctactcagcgtaggggtag

SEQ ID NO: 116012 - DNA, 75 bp, Artificial Sequence
  Synthetic
ggacaggatcgagatgcaccctctcctgttctccaccacggagcttgctattctgccatgctcgttcaccaccat

SEQ ID NO: 116013 - DNA, 75 bp, Artificial Sequence
  Synthetic
tcccggctgcatacgcagctcagggctacaaggtgctagtgctcaatccctctgttgccgcaacactgggctttg

SEQ ID NO: 116014 - DNA, 75 bp, Artificial Sequence
  Synthetic
acccccctcgctagccagctcctccgctagtcagctatccgcgccatccttgaaagccacatgtactgcccacca

SEQ ID NO: 116015 - DNA, 75 bp, Artificial Sequence
  Synthetic
acccccctcgctagccagctcctccgctagtcagctttccgcgccatccttgaaagccacatgtactgcccacca

SEQ ID NO: 116016 - DNA, 75 bp, Artificial Sequence
  Synthetic
acccccctcgctagccagctcctccgctagtcagctctccgcgccatccttgaaagccacatgtactgcccacca

SEQ ID NO: 116017 - DNA, 75 bp, Artificial Sequence
  Synthetic
acccccctcgctagccagctcctccgctagtcagctgtccgcgccatccttgaaagccacatgtactgcccacca

SEQ ID NO: 116018 - DNA, 75 bp, Artificial Sequence
  Synthetic
ttccgctagatcaaaatacggattcggggcgaaggaggttcgcagcttgtccaggagggccgttaaccacatcaa

SEQ ID NO: 116019 - DNA, 75 bp, Artificial Sequence
  Synthetic
tgggagtacatcgttctcctgtttctctacctagctgacgctcgcctctgcacctgcttgtggctgatgttctta

SEQ ID NO: 116020 - DNA, 75 bp, Artificial Sequence
  Synthetic
gtccgtgtgggaggacctcctggaagaccactgtacaccaattgacacaaccatcatggccaagaacgaggtgtt

SEQ ID NO: 116021 - DNA, 75 bp, Artificial Sequence
  Synthetic
gagccacttgcggccgaaggcgacaaggaggtctccatcgcagcagagatcttgcgccccgtcaaaaggttcccg

SEQ ID NO: 116022 - DNA, 75 bp, Artificial Sequence
  Synthetic
gtgggtaaggccgaggcagccctggagaacctcatcaatctgaatgctgcagcagctgcgggcattcacgggtgg

SEQ ID NO: 116023 - DNA, 75 bp, Artificial Sequence
  Synthetic
tgacatggagaccaagatcatcacctggggggcagacaccgcggcgtgtggggacatcatctcaggtctacccgt

SEQ ID NO: 116024 - DNA, 75 bp, Artificial Sequence
  Synthetic
aggaggtctccatcgcagcagagatcttgcgccccgtcaaaaggttcccgccggccataccaatctgggcccggc

SEQ ID NO: 116025 - DNA, 75 bp, Artificial Sequence
  Synthetic
gtgccccatcctaacatcgaggaggttgctctgtccaccaccggagagatccctttttacggcaaggctatcccc

SEQ ID NO: 116026 - DNA, 75 bp, Artificial Sequence
  Synthetic
acacagaagctccccacagcagtgatggggcgtgcataaggattccagtactctcctgcccagcgggtcgatttc

SEQ ID NO: 116027 - DNA, 75 bp, Artificial Sequence
  Synthetic
acacagaagctccccacagcagtgatggggcgtgcatatggattccagtactctcctgcccagcgggtcgatttc

SEQ ID NO: 116028 - DNA, 75 bp, Artificial Sequence
  Synthetic
acacagaagctccccacagcagtgatggggcgtgcatacggattccagtactctcctgcccagcgggtcgatttc

SEQ ID NO: 116029 - DNA, 75 bp, Artificial Sequence
  Synthetic
acacagaagctccccacagcagtgatggggcgtgcatagggattccagtactctcctgcccagcgggtcgatttc

SEQ ID NO: 116030 - DNA, 75 bp, Artificial Sequence
  Synthetic
acacagaagctccccacagcagtgatggggcgtgcttaaggattccagtactctcctgcccagcgggtcgatttc

SEQ ID NO: 116031 - DNA, 75 bp, Artificial Sequence
  Synthetic
acacagaagctccccacagcagtgatggggcgtgcttatggattccagtactctcctgcccagcgggtcgatttc

SEQ ID NO: 116032 - DNA, 75 bp, Artificial Sequence
  Synthetic
acacagaagctccccacagcagtgatggggcgtgcttacggattccagtactctcctgcccagcgggtcgatttc

SEQ ID NO: 116033 - DNA, 75 bp, Artificial Sequence
  Synthetic
acacagaagctccccacagcagtgatggggcgtgcttagggattccagtactctcctgcccagcgggtcgatttc

SEQ ID NO: 116034 - DNA, 75 bp, Artificial Sequence
  Synthetic
acacagaagctccccacagcagtgatggggcgtgcctaaggattccagtactctcctgcccagcgggtcgatttc

SEQ ID NO: 116035 - DNA, 75 bp, Artificial Sequence
  Synthetic
acacagaagctccccacagcagtgatggggcgtgcctatggattccagtactctcctgcccagcgggtcgatttc

SEQ ID NO: 116036 - DNA, 75 bp, Artificial Sequence
  Synthetic
acacagaagctccccacagcagtgatggggcgtgcctacggattccagtactctcctgcccagcgggtcgatttc

SEQ ID NO: 116037 - DNA, 75 bp, Artificial Sequence
  Synthetic
acacagaagctccccacagcagtgatggggcgtgcctagggattccagtactctcctgcccagcgggtcgatttc

SEQ ID NO: 116038 - DNA, 75 bp, Artificial Sequence
  Synthetic
acacagaagctccccacagcagtgatggggcgtgcgtaaggattccagtactctcctgcccagcgggtcgatttc

SEQ ID NO: 116039 - DNA, 75 bp, Artificial Sequence
  Synthetic
acacagaagctccccacagcagtgatggggcgtgcgtatggattccagtactctcctgcccagcgggtcgatttc

SEQ ID NO: 116040 - DNA, 75 bp, Artificial Sequence
  Synthetic
acacagaagctccccacagcagtgatggggcgtgcgtacggattccagtactctcctgcccagcgggtcgatttc

SEQ ID NO: 116041 - DNA, 75 bp, Artificial Sequence
  Synthetic
acacagaagctccccacagcagtgatggggcgtgcgtagggattccagtactctcctgcccagcgggtcgatttc

SEQ ID NO: 116042 - DNA, 75 bp, Artificial Sequence
  Synthetic
acacagaagctccccactgcagtgatggggcgtgcataaggattccagtactctcctgcccagcgggtcgatttc

SEQ ID NO: 116043 - DNA, 75 bp, Artificial Sequence
  Synthetic
acacagaagctccccactgcagtgatggggcgtgcatatggattccagtactctcctgcccagcgggtcgatttc

SEQ ID NO: 116044 - DNA, 75 bp, Artificial Sequence
  Synthetic
acacagaagctccccactgcagtgatggggcgtgcatacggattccagtactctcctgcccagcgggtcgatttc

SEQ ID NO: 116045 - DNA, 75 bp, Artificial Sequence
  Synthetic
acacagaagctccccactgcagtgatggggcgtgcatagggattccagtactctcctgcccagcgggtcgatttc

SEQ ID NO: 116046 - DNA, 75 bp, Artificial Sequence
  Synthetic
acacagaagctccccactgcagtgatggggcgtgcttaaggattccagtactctcctgcccagcgggtcgatttc

SEQ ID NO: 116047 - DNA, 75 bp, Artificial Sequence
  Synthetic
acacagaagctccccactgcagtgatggggcgtgcttatggattccagtactctcctgcccagcgggtcgatttc

SEQ ID NO: 116048 - DNA, 75 bp, Artificial Sequence
  Synthetic
acacagaagctccccactgcagtgatggggcgtgcttacggattccagtactctcctgcccagcgggtcgatttc

SEQ ID NO: 116049 - DNA, 75 bp, Artificial Sequence
  Synthetic
acacagaagctccccactgcagtgatggggcgtgcttagggattccagtactctcctgcccagcgggtcgatttc

SEQ ID NO: 116050 - DNA, 75 bp, Artificial Sequence
  Synthetic
acacagaagctccccactgcagtgatggggcgtgcctaaggattccagtactctcctgcccagcgggtcgatttc

SEQ ID NO: 116051 - DNA, 75 bp, Artificial Sequence
  Synthetic
acacagaagctccccactgcagtgatggggcgtgcctatggattccagtactctcctgcccagcgggtcgatttc

SEQ ID NO: 116052 - DNA, 75 bp, Artificial Sequence
  Synthetic
acacagaagctccccactgcagtgatggggcgtgcctacggattccagtactctcctgcccagcgggtcgatttc

SEQ ID NO: 116053 - DNA, 75 bp, Artificial Sequence
  Synthetic
acacagaagctccccactgcagtgatggggcgtgcctagggattccagtactctcctgcccagcgggtcgatttc

SEQ ID NO: 116054 - DNA, 75 bp, Artificial Sequence
  Synthetic
acacagaagctccccactgcagtgatggggcgtgcgtaaggattccagtactctcctgcccagcgggtcgatttc

SEQ ID NO: 116055 - DNA, 75 bp, Artificial Sequence
  Synthetic
acacagaagctccccactgcagtgatggggcgtgcgtatggattccagtactctcctgcccagcgggtcgatttc

SEQ ID NO: 116056 - DNA, 75 bp, Artificial Sequence
  Synthetic
acacagaagctccccactgcagtgatggggcgtgcgtacggattccagtactctcctgcccagcgggtcgatttc

SEQ ID NO: 116057 - DNA, 75 bp, Artificial Sequence
  Synthetic
acacagaagctccccactgcagtgatggggcgtgcgtagggattccagtactctcctgcccagcgggtcgatttc

SEQ ID NO: 116058 - DNA, 75 bp, Artificial Sequence
  Synthetic
acacagaagctccccaccgcagtgatggggcgtgcataaggattccagtactctcctgcccagcgggtcgatttc

SEQ ID NO: 116059 - DNA, 75 bp, Artificial Sequence
  Synthetic
acacagaagctccccaccgcagtgatggggcgtgcatatggattccagtactctcctgcccagcgggtcgatttc

SEQ ID NO: 116060 - DNA, 75 bp, Artificial Sequence
  Synthetic
acacagaagctccccaccgcagtgatggggcgtgcatacggattccagtactctcctgcccagcgggtcgatttc

SEQ ID NO: 116061 - DNA, 75 bp, Artificial Sequence
  Synthetic
acacagaagctccccaccgcagtgatggggcgtgcatagggattccagtactctcctgcccagcgggtcgatttc

SEQ ID NO: 116062 - DNA, 75 bp, Artificial Sequence
  Synthetic
acacagaagctccccaccgcagtgatggggcgtgcttaaggattccagtactctcctgcccagcgggtcgatttc

SEQ ID NO: 116063 - DNA, 75 bp, Artificial Sequence
  Synthetic
acacagaagctccccaccgcagtgatggggcgtgcttatggattccagtactctcctgcccagcgggtcgatttc

SEQ ID NO: 116064 - DNA, 75 bp, Artificial Sequence
  Synthetic
acacagaagctccccaccgcagtgatggggcgtgcttacggattccagtactctcctgcccagcgggtcgatttc

SEQ ID NO: 116065 - DNA, 75 bp, Artificial Sequence
  Synthetic
acacagaagctccccaccgcagtgatggggcgtgcttagggattccagtactctcctgcccagcgggtcgatttc

SEQ ID NO: 116066 - DNA, 75 bp, Artificial Sequence
  Synthetic
acacagaagctccccaccgcagtgatggggcgtgcctaaggattccagtactctcctgcccagcgggtcgatttc

SEQ ID NO: 116067 - DNA, 75 bp, Artificial Sequence
  Synthetic
acacagaagctccccaccgcagtgatggggcgtgcctatggattccagtactctcctgcccagcgggtcgatttc

SEQ ID NO: 116068 - DNA, 75 bp, Artificial Sequence
  Synthetic
acacagaagctccccaccgcagtgatggggcgtgcctacggattccagtactctcctgcccagcgggtcgatttc

SEQ ID NO: 116069 - DNA, 75 bp, Artificial Sequence
  Synthetic
acacagaagctccccaccgcagtgatggggcgtgcctagggattccagtactctcctgcccagcgggtcgatttc

SEQ ID NO: 116070 - DNA, 75 bp, Artificial Sequence
  Synthetic
acacagaagctccccaccgcagtgatggggcgtgcgtaaggattccagtactctcctgcccagcgggtcgatttc

SEQ ID NO: 116071 - DNA, 75 bp, Artificial Sequence
  Synthetic
acacagaagctccccaccgcagtgatggggcgtgcgtatggattccagtactctcctgcccagcgggtcgatttc

SEQ ID NO: 116072 - DNA, 75 bp, Artificial Sequence
  Synthetic
acacagaagctccccaccgcagtgatggggcgtgcgtacggattccagtactctcctgcccagcgggtcgatttc

SEQ ID NO: 116073 - DNA, 75 bp, Artificial Sequence
  Synthetic
acacagaagctccccaccgcagtgatggggcgtgcgtagggattccagtactctcctgcccagcgggtcgatttc

SEQ ID NO: 116074 - DNA, 75 bp, Artificial Sequence
  Synthetic
acacagaagctccccacggcagtgatggggcgtgcataaggattccagtactctcctgcccagcgggtcgatttc

SEQ ID NO: 116075 - DNA, 75 bp, Artificial Sequence
  Synthetic
acacagaagctccccacggcagtgatggggcgtgcatatggattccagtactctcctgcccagcgggtcgatttc

SEQ ID NO: 116076 - DNA, 75 bp, Artificial Sequence
  Synthetic
acacagaagctccccacggcagtgatggggcgtgcatacggattccagtactctcctgcccagcgggtcgatttc

SEQ ID NO: 116077 - DNA, 75 bp, Artificial Sequence
  Synthetic
acacagaagctccccacggcagtgatggggcgtgcatagggattccagtactctcctgcccagcgggtcgatttc

SEQ ID NO: 116078 - DNA, 75 bp, Artificial Sequence
  Synthetic
acacagaagctccccacggcagtgatggggcgtgcttaaggattccagtactctcctgcccagcgggtcgatttc

SEQ ID NO: 116079 - DNA, 75 bp, Artificial Sequence
  Synthetic
acacagaagctccccacggcagtgatggggcgtgcttatggattccagtactctcctgcccagcgggtcgatttc

SEQ ID NO: 116080 - DNA, 75 bp, Artificial Sequence
  Synthetic
acacagaagctccccacggcagtgatggggcgtgcttacggattccagtactctcctgcccagcgggtcgatttc

SEQ ID NO: 116081 - DNA, 75 bp, Artificial Sequence
  Synthetic
acacagaagctccccacggcagtgatggggcgtgcttagggattccagtactctcctgcccagcgggtcgatttc

SEQ ID NO: 116082 - DNA, 75 bp, Artificial Sequence
  Synthetic
acacagaagctccccacggcagtgatggggcgtgcctaaggattccagtactctcctgcccagcgggtcgatttc

SEQ ID NO: 116083 - DNA, 75 bp, Artificial Sequence
  Synthetic
acacagaagctccccacggcagtgatggggcgtgcctatggattccagtactctcctgcccagcgggtcgatttc

SEQ ID NO: 116084 - DNA, 75 bp, Artificial Sequence
  Synthetic
acacagaagctccccacggcagtgatggggcgtgcctacggattccagtactctcctgcccagcgggtcgatttc

SEQ ID NO: 116085 - DNA, 75 bp, Artificial Sequence
  Synthetic
acacagaagctccccacggcagtgatggggcgtgcctagggattccagtactctcctgcccagcgggtcgatttc

SEQ ID NO: 116086 - DNA, 75 bp, Artificial Sequence
  Synthetic
acacagaagctccccacggcagtgatggggcgtgcgtaaggattccagtactctcctgcccagcgggtcgatttc

SEQ ID NO: 116087 - DNA, 75 bp, Artificial Sequence
  Synthetic
acacagaagctccccacggcagtgatggggcgtgcgtatggattccagtactctcctgcccagcgggtcgatttc

SEQ ID NO: 116088 - DNA, 75 bp, Artificial Sequence
  Synthetic
acacagaagctccccacggcagtgatggggcgtgcgtacggattccagtactctcctgcccagcgggtcgatttc

SEQ ID NO: 116089 - DNA, 75 bp, Artificial Sequence
  Synthetic
acacagaagctccccacggcagtgatggggcgtgcgtagggattccagtactctcctgcccagcgggtcgatttc

SEQ ID NO: 116090 - DNA, 75 bp, Artificial Sequence
  Synthetic
ctccgcccgaagggggagggagatacttctgggaccggccgacagttttgaggggcgggggtggcgactccttgc

SEQ ID NO: 116091 - DNA, 75 bp, Artificial Sequence
  Synthetic
ttgtcctcgcactgccacggcgggcgtatgcctacgatggggagcaggcagcatctctaggtgcggtggtcatcg

SEQ ID NO: 116092 - DNA, 75 bp, Artificial Sequence
  Synthetic
cacccgctgttttgactctacggtcacggagagggacatcagaacagaagaatccatatacctgtcctgttcact

SEQ ID NO: 116093 - DNA, 75 bp, Artificial Sequence
  Synthetic
cacccgctgttttgactctacggtcacggagagggacatcagaacagaagaatccatttacctgtcctgttcact

SEQ ID NO: 116094 - DNA, 75 bp, Artificial Sequence
  Synthetic
cacccgctgttttgactctacggtcacggagagggacatcagaacagaagaatccatctacctgtcctgttcact

SEQ ID NO: 116095 - DNA, 75 bp, Artificial Sequence
  Synthetic
cacccgctgttttgactctacggtcacggagagggacatcagaacagaagaatccatgtacctgtcctgttcact

SEQ ID NO: 116096 - DNA, 75 bp, Artificial Sequence
  Synthetic
cacccgctgttttgactctacggtcacggagagggacatcagaactgaagaatccatatacctgtcctgttcact

SEQ ID NO: 116097 - DNA, 75 bp, Artificial Sequence
  Synthetic
cacccgctgttttgactctacggtcacggagagggacatcagaactgaagaatccatttacctgtcctgttcact

SEQ ID NO: 116098 - DNA, 75 bp, Artificial Sequence
  Synthetic
cacccgctgttttgactctacggtcacggagagggacatcagaactgaagaatccatctacctgtcctgttcact

SEQ ID NO: 116099 - DNA, 75 bp, Artificial Sequence
  Synthetic
cacccgctgttttgactctacggtcacggagagggacatcagaactgaagaatccatgtacctgtcctgttcact

SEQ ID NO: 116100 - DNA, 75 bp, Artificial Sequence
  Synthetic
cacccgctgttttgactctacggtcacggagagggacatcagaaccgaagaatccatatacctgtcctgttcact

SEQ ID NO: 116101 - DNA, 75 bp, Artificial Sequence
  Synthetic
cacccgctgttttgactctacggtcacggagagggacatcagaaccgaagaatccatttacctgtcctgttcact

SEQ ID NO: 116102 - DNA, 75 bp, Artificial Sequence
  Synthetic
cacccgctgttttgactctacggtcacggagagggacatcagaaccgaagaatccatctacctgtcctgttcact

SEQ ID NO: 116103 - DNA, 75 bp, Artificial Sequence
  Synthetic
cacccgctgttttgactctacggtcacggagagggacatcagaaccgaagaatccatgtacctgtcctgttcact

SEQ ID NO: 116104 - DNA, 75 bp, Artificial Sequence
  Synthetic
cacccgctgttttgactctacggtcacggagagggacatcagaacggaagaatccatatacctgtcctgttcact

SEQ ID NO: 116105 - DNA, 75 bp, Artificial Sequence
  Synthetic
cacccgctgttttgactctacggtcacggagagggacatcagaacggaagaatccatttacctgtcctgttcact

SEQ ID NO: 116106 - DNA, 75 bp, Artificial Sequence
  Synthetic
cacccgctgttttgactctacggtcacggagagggacatcagaacggaagaatccatctacctgtcctgttcact

SEQ ID NO: 116107 - DNA, 75 bp, Artificial Sequence
  Synthetic
cacccgctgttttgactctacggtcacggagagggacatcagaacggaagaatccatgtacctgtcctgttcact

SEQ ID NO: 116108 - DNA, 75 bp, Artificial Sequence
  Synthetic
acatgtgtgggttccacccttgtcagtccgggggggccgtgatgctgtgatactgctcacctgcttgctccatcc

SEQ ID NO: 116109 - DNA, 75 bp, Artificial Sequence
  Synthetic
taggggggcccatgacaaacagcaaagggcaatcctgcggatacaggcgttgccgcgcgagcggagtgctcacca

SEQ ID NO: 116110 - DNA, 75 bp, Artificial Sequence
  Synthetic
taggggggcccatgacaaacagcaaagggcaatcctgcggttacaggcgttgccgcgcgagcggagtgctcacca

SEQ ID NO: 116111 - DNA, 75 bp, Artificial Sequence
  Synthetic
taggggggcccatgacaaacagcaaagggcaatcctgcggctacaggcgttgccgcgcgagcggagtgctcacca

SEQ ID NO: 116112 - DNA, 75 bp, Artificial Sequence
  Synthetic
taggggggcccatgacaaacagcaaagggcaatcctgcgggtacaggcgttgccgcgcgagcggagtgctcacca

SEQ ID NO: 116113 - DNA, 75 bp, Artificial Sequence
  Synthetic
tcttggtccactgttagcggatcggaggatgtagtatgttgttcaatgtcatattcatggacgggggcgcttgtt

SEQ ID NO: 116114 - DNA, 75 bp, Artificial Sequence
  Synthetic
tcttggtccactgttagcggttcggaggatgtagtatgttgttcaatgtcatattcatggacgggggcgcttgtt

SEQ ID NO: 116115 - DNA, 75 bp, Artificial Sequence
  Synthetic
tcttggtccactgttagcggctcggaggatgtagtatgttgttcaatgtcatattcatggacgggggcgcttgtt

SEQ ID NO: 116116 - DNA, 75 bp, Artificial Sequence
  Synthetic
tcttggtccactgttagcgggtcggaggatgtagtatgttgttcaatgtcatattcatggacgggggcgcttgtt

SEQ ID NO: 116117 - DNA, 75 bp, Artificial Sequence
  Synthetic
gcgggtgccgtactacgtgcgggcgcatgcgcttttgcgcttgtgcctactcgtgcgtcggatagcagcgggcaa

SEQ ID NO: 116118 - DNA, 75 bp, Artificial Sequence
  Synthetic
gcctgtttgtggatgatgctgctgatagctcaggctgaggccgccctagagaacctggtggtcctcaacgcggcg

SEQ ID NO: 116119 - DNA, 75 bp, Artificial Sequence
  Synthetic
ccgtcactcggcagaagaaggtcaccttcgaccgcatacaggtgctggacaaccattaccatgagacacttaagg

SEQ ID NO: 116120 - DNA, 75 bp, Artificial Sequence
  Synthetic
agatcaaggcacgagcgtcgcgagtgaaggcgcggactctcccagttgaggaggcctgcgacctgacgcccccgc

SEQ ID NO: 116121 - DNA, 75 bp, Artificial Sequence
  Synthetic
gacctcgctgtcgcggttgaaccggtcgttttttcaccaatggagaagaaggtcattatctggggcgctgacact

SEQ ID NO: 116122 - DNA, 75 bp, Artificial Sequence
  Synthetic
cgccgcaggtactacctgactagagaccctaccactccactcgccagggctgcctgggagacagcaagacactcc

SEQ ID NO: 116123 - DNA, 75 bp, Artificial Sequence
  Synthetic
tggggcaaaggacgttcgcagccactcccgcaaggccattaaccacatcaactccgtgtgggaggacttgctgga

SEQ ID NO: 116124 - DNA, 75 bp, Artificial Sequence
  Synthetic
ccctcctagctcccatcacggcctatgtgcaacaaacacggggcctattgggcaccatcgtcacgagcctcactg

SEQ ID NO: 116125 - DNA, 75 bp, Artificial Sequence
  Synthetic
ggtgcgtatggtcctaatgacgcactttttctccgtcttaatggcccaggacaccctggaccgggatctccactt

SEQ ID NO: 116126 - DNA, 75 bp, Artificial Sequence
  Synthetic
ggtgcgtatggtcctaatgacgcactttttctccgtctttatggcccaggacaccctggaccgggatctccactt

SEQ ID NO: 116127 - DNA, 75 bp, Artificial Sequence
  Synthetic
ggtgcgtatggtcctaatgacgcactttttctccgtcttcatggcccaggacaccctggaccgggatctccactt

SEQ ID NO: 116128 - DNA, 75 bp, Artificial Sequence
  Synthetic
ggtgcgtatggtcctaatgacgcactttttctccgtcttgatggcccaggacaccctggaccgggatctccactt

SEQ ID NO: 116129 - DNA, 75 bp, Artificial Sequence
  Synthetic
accacgggcgcccccatcacgtattccacctatggcaagttccttgccgacggtggttgttctgggggcgcctat

SEQ ID NO: 116130 - DNA, 75 bp, Artificial Sequence
  Synthetic
tcagtcggggggggagggcggccacatgtggtcgctacctcttcaactgggctgtgaggacgaagctcaaactca

SEQ ID NO: 116131 - DNA, 75 bp, Artificial Sequence
  Synthetic
gcgcagcacttttaagcccacggccgattagcacgctaaagggttcgtcgggtgggcccgtcctttgcccctcgg

SEQ ID NO: 116132 - DNA, 75 bp, Artificial Sequence
  Synthetic
ggggagacctgtgcgggtaccgtagatgccgcgcgagcggcgtctacactacgagcttcgggaacacactgacgt

SEQ ID NO: 116133 - DNA, 75 bp, Artificial Sequence
  Synthetic
ggcacgtggtgggccttttccgcgcggctgtctgcactaggggcgtcgccaaggccattgactttgtcccggtgg

SEQ ID NO: 116134 - DNA, 75 bp, Artificial Sequence
  Synthetic
tttttttttttttttttttttttttcccttctatcttcttaacctattttctaacttggtggctccatcttagcc

SEQ ID NO: 116135 - DNA, 75 bp, Artificial Sequence
  Synthetic
ggtattcggctccccccggagacctaccgcaaccggcatatgacctagagcatattacatcatgctcatccaatg

SEQ ID NO: 116136 - DNA, 75 bp, Artificial Sequence
  Synthetic
gcacctgggtgttagtgggcggagtccttgcagctctggctgcatattgcttgacaacgggcagcgtggtcatag

SEQ ID NO: 116137 - DNA, 75 bp, Artificial Sequence
  Synthetic
gcacctgggtgttagtgggcggagtccttgcagctctggctgcatattgcttgacaacgggcagcgtggtcattg

SEQ ID NO: 116138 - DNA, 75 bp, Artificial Sequence
  Synthetic
gcacctgggtgttagtgggcggagtccttgcagctctggctgcatattgcttgacaacgggcagcgtggtcatcg

SEQ ID NO: 116139 - DNA, 75 bp, Artificial Sequence
  Synthetic
gcacctgggtgttagtgggcggagtccttgcagctctggctgcatattgcttgacaacgggcagcgtggtcatgg

SEQ ID NO: 116140 - DNA, 75 bp, Artificial Sequence
  Synthetic
tccttgccgatggcggatgtagtgggggcgcgtatgacgtaatcatctgtgatgagtgccactctacggatccta

SEQ ID NO: 116141 - DNA, 75 bp, Artificial Sequence
  Synthetic
gggcatcaatgccgtggcctactaccgcggtcttgacgtgtctgtcatcccgaccagcggcgatgttgtcgtcgt

SEQ ID NO: 116142 - DNA, 75 bp, Artificial Sequence
  Synthetic
tccacacccgaatatacaagaaattgctttgcccacgacaggggaggtccccttctacggcaaagctatacccct

SEQ ID NO: 116143 - DNA, 75 bp, Artificial Sequence
  Synthetic
ggcccgagcagtccgcgccaagctcatcgcccagggaggtagagccaaaatctgtggcgtatacctctttaactg

SEQ ID NO: 116144 - DNA, 75 bp, Artificial Sequence
  Synthetic
acggggagggggaagccgggggtgtataggtacgtatcgcagggagagcgcccatcagggacgttcgacaccgtc

SEQ ID NO: 116145 - DNA, 75 bp, Artificial Sequence
  Synthetic
gtgcgcgctcaagggctcattcgtgcatgcatgttggtgcggaaagtcgctgggggccattatgtccaaatggct

SEQ ID NO: 116146 - DNA, 75 bp, Artificial Sequence
  Synthetic
tacccgcgtcgcaggtgtgtggtccagtgtattgcttcaccccgagccctgttgtggtggggacgaccgatcgct

SEQ ID NO: 116147 - DNA, 75 bp, Artificial Sequence
  Synthetic
ctgtatgtcaggaccaccttgagttctgggaggcagtgtttaccgggctcacccacatcgatgcccacttcctct

SEQ ID NO: 116148 - DNA, 75 bp, Artificial Sequence
  Synthetic
acagggggggcgcagagccgtgccactagcgactttgcgtccttcttttctgctgggtcgaaacagaaaatccag

SEQ ID NO: 116149 - DNA, 75 bp, Artificial Sequence
  Synthetic
tgtcggcggacttagaggtcatcaccagcacgtgggtactggccggtggggtccttgccgccttggccgcctatt

SEQ ID NO: 116150 - DNA, 75 bp, Artificial Sequence
  Synthetic
tgggcgcgcccggattacaaccctccgctgctggagtcctggaaggaccctgactacgtccctccagtggtacac

SEQ ID NO: 116151 - DNA, 75 bp, Artificial Sequence
  Synthetic
ccatatctcgtcgaagggcagcatatagccgaacagttcagacaaaaggtgctgggcctgatgcagaccacggcc

SEQ ID NO: 116152 - DNA, 75 bp, Artificial Sequence
  Synthetic
acatggtggcgggggcccactggggagtcctggcgggccttgcctactattccatggtggggaactgggctaagg

SEQ ID NO: 116153 - DNA, 75 bp, Artificial Sequence
  Synthetic
cggcaatccggctgtagccgctctcatgtccttctcggcctcattgacgagcccgttagccacatccacaactct

SEQ ID NO: 116154 - DNA, 75 bp, Artificial Sequence
  Synthetic
ggtataggtctgggcaaggtcatcgtggacattctggcgggctatggagcgggcgtttccggagctctcgtagca

SEQ ID NO: 116155 - DNA, 75 bp, Artificial Sequence
  Synthetic
cgcaatttgggtaaggtcatcgataccctcacgtgcggcttcgccgacctcatggggtacatcccgctcgtcggc

SEQ ID NO: 116156 - DNA, 75 bp, Artificial Sequence
  Synthetic
ctgctatcctccggcgacatgtgggcccctctgaaggagctgcccaatggatgaaccggttgatagcttttgcat

SEQ ID NO: 116157 - DNA, 75 bp, Artificial Sequence
  Synthetic
gttccctcaccatcactagtcttctccgcaagcttcatcagtggatccacgaagactatgcctcaccttgttcaa

SEQ ID NO: 116158 - DNA, 75 bp, Artificial Sequence
  Synthetic
ctgggtgtgtaccgtactttctgacttcaagacatggctcaaggcaaagctcttcccggccctccctgggattcc

SEQ ID NO: 116159 - DNA, 75 bp, Artificial Sequence
  Synthetic
cgcggacctgcagtaacgtgtggcacggcaccttccccatcaatgcgaccacgactggtccgagcgtgccaaccc

SEQ ID NO: 116160 - DNA, 75 bp, Artificial Sequence
  Synthetic
gcagaatgtccagctgatcaacaccaacggcagttggcacatcaatcgcacggccttgaactgcaatgcgagcct

SEQ ID NO: 116161 - DNA, 75 bp, Artificial Sequence
  Synthetic
aacggcagttggcacatcaatcgcacggccttgaactgcaatgcgagcctcgacactggctggatagcggggctc

SEQ ID NO: 116162 - DNA, 75 bp, Artificial Sequence
  Synthetic
catgcacaccacctgcccatgtggagcacagatcaccggacatgtcaaaaatggttccatgaggatcgttgggcc

SEQ ID NO: 116163 - DNA, 75 bp, Artificial Sequence
  Synthetic
ccagacgtcctagtggtaacatcaatgctgacagacccagaccacatcacagcagaggcggcggggcgacgcctc

SEQ ID NO: 116164 - DNA, 75 bp, Artificial Sequence
  Synthetic
ctgactagagcagaagcgcaactgcacgtgtgggttccccccctcaacgtccgaggggggcgtgacgccgtcatc

SEQ ID NO: 116165 - DNA, 75 bp, Artificial Sequence
  Synthetic
acgtgtgggttccccccctcaacgtccgaggggggcgtgacgccgtcatcttactcatgtgtgttgtacacccga

SEQ ID NO: 116166 - DNA, 75 bp, Artificial Sequence
  Synthetic
accacgagcatacgccatggaccgggagatggctgcatcgtgcggaggcgcggttttcataggtctggcactctt

SEQ ID NO: 116167 - DNA, 75 bp, Artificial Sequence
  Synthetic
gagatggctgcatcgtgcggaggcgcggttttcataggtctggcactcttgaccttgtcaccacactataaggtg

SEQ ID NO: 116168 - DNA, 75 bp, Artificial Sequence
  Synthetic
ctgaactcatcagcgccaatctcctgtggaggcaggagatgggtggaaacatcaccagagtggagtcagaaaaca

SEQ ID NO: 116169 - DNA, 75 bp, Artificial Sequence
  Synthetic
acaacatcccgcagcgcaagccagcggcagaagaaggtcacctttgacagactgcaagtcctggacgaccactac

SEQ ID NO: 116170 - DNA, 75 bp, Artificial Sequence
  Synthetic
cggttttcataggtctggcactcttgaccttgtcaccacactataaggtgttcctcgctaggctcatatggtggt

SEQ ID NO: 116171 - DNA, 75 bp, Artificial Sequence
  Synthetic
tgctcactgatccctcccatataacagcagaggcggccgggagaaggttggcgagaggatcgcccccttctgtgg

SEQ ID NO: 116172 - DNA, 75 bp, Artificial Sequence
  Synthetic
agggaaatatcaactgcggcggagtgccatagacctcgacgacctgcatttccggccgctctccctgtgtgggcc

SEQ ID NO: 116173 - DNA, 75 bp, Artificial Sequence
  Synthetic
gctgatacggcttgatgagtcaaaagtggcacaagctctggcggagctggcaagccggacgttccaaccatctcc

SEQ ID NO: 116174 - DNA, 75 bp, Artificial Sequence
  Synthetic
cccaacagacgcggggcctacttggctgcatcatcactagcctcacaggccgggacaagaaccaggtcgaggggg

SEQ ID NO: 116175 - DNA, 75 bp, Artificial Sequence
  Synthetic
ccaaactttcctggcaacgtgcatcaatggggtatgctggactgtctatcacggggccggaacgaggaccatcgc

SEQ ID NO: 116176 - DNA, 75 bp, Artificial Sequence
  Synthetic
tgagcaacggtctattacggcatcataacctggtgtactccaccacctcccgcagcgcgcctctgcgccagaaaa

SEQ ID NO: 116177 - DNA, 75 bp, Artificial Sequence
  Synthetic
accaaggtgccggctgcgtacgcagcccaggggtacaaggtgctcgtcttgaacccgtctgttgctgccacctta

SEQ ID NO: 116178 - DNA, 75 bp, Artificial Sequence
  Synthetic
gatcctaacatcaggaccggggtgagaacaattaccactggcagccccatcacgtactccacctacggcaagttc

SEQ ID NO: 116179 - DNA, 75 bp, Artificial Sequence
  Synthetic
cgcaaagctgtcgggcctcggtcttaatgctgtagcgtattaccggggtctagacgtgtccgtcataccatctag

SEQ ID NO: 116180 - DNA, 75 bp, Artificial Sequence
  Synthetic
actggggagtcctagcgggcatagcgtatttctccatggcggggaactgggcgaaggtcttggtgataatgttgc

SEQ ID NO: 116181 - DNA, 75 bp, Artificial Sequence
  Synthetic
ttgctccttttctatcttcctcctggcactactgtcgtgcctgaccacacctgcctcagcagtacacttcaaaaa

SEQ ID NO: 116182 - DNA, 75 bp, Artificial Sequence
  Synthetic
accaaaagcgggaacatgtcatcttgctgggtgccggttgctcccacactcgctatcccaaatgctacagtgccg

SEQ ID NO: 116183 - DNA, 75 bp, Artificial Sequence
  Synthetic
gctccggctcgtggctgagggacgtttgggactggatatgcacggtgttgactgacttcaagacctggctccagt

SEQ ID NO: 116184 - DNA, 75 bp, Artificial Sequence
  Synthetic
gtcgtacagcctccaggaccccccctcccgggagagccatagtggtctgcggaaccggtgagtacaccggaattg

SEQ ID NO: 116185 - DNA, 75 bp, Artificial Sequence
  Synthetic
ttgccgacggcgggtgctcagggggtgcttatgacataataatttgcgacgagtgccactccacggatgcaacat

SEQ ID NO: 116186 - DNA, 75 bp, Artificial Sequence
  Synthetic
gtcaactcttcacctttcggcccaggatgcacaataccgtccaggagtgcaattgctccatttacaccggacaca

SEQ ID NO: 116187 - DNA, 75 bp, Artificial Sequence
  Synthetic
cccctcaacgttcgggggggccgcgatgccatcatcctcctcacatgcgtggtccacccagagctaatctttgac

SEQ ID NO: 116188 - DNA, 75 bp, Artificial Sequence
  Synthetic
aatcctttctgaggggcattggggcgtcatcggcgcgttggtgtactacagcatggtcgccaattgggccaaggt

SEQ ID NO: 116189 - DNA, 75 bp, Artificial Sequence
  Synthetic
ggtccacccagagctaatctttgacatcaccaaaattctgcttgccatactcggtccgctcatggtgctccaggc

SEQ ID NO: 116190 - DNA, 75 bp, Artificial Sequence
  Synthetic
cttgctttgctctcttgcctgacggtccccgcctccgccatcgaggtgcgcaacgcgtccgggatttaccatatc

SEQ ID NO: 116191 - DNA, 75 bp, Artificial Sequence
  Synthetic
agctgcattcgggatcgccacccttttcagtacgggtgccaagcaggacattcagctgatcaactccaacggcag

SEQ ID NO: 116192 - DNA, 75 bp, Artificial Sequence
  Synthetic
ggacctaggcagaacatccagctcatcaataccaacggcagctggcacatcaaccgcacagcgctcaactgcaat

SEQ ID NO: 116193 - DNA, 75 bp, Artificial Sequence
  Synthetic
ggacctaggcagtacatccagctcatcaataccaacggcagctggcacatcaaccgcacagcgctcaactgcaat

SEQ ID NO: 116194 - DNA, 75 bp, Artificial Sequence
  Synthetic
ggacctaggcagcacatccagctcatcaataccaacggcagctggcacatcaaccgcacagcgctcaactgcaat

SEQ ID NO: 116195 - DNA, 75 bp, Artificial Sequence
  Synthetic
ggacctaggcaggacatccagctcatcaataccaacggcagctggcacatcaaccgcacagcgctcaactgcaat

SEQ ID NO: 116196 - DNA, 75 bp, Artificial Sequence
  Synthetic
tccccgcctccgccatcgaggtgcgcaacgcgtccgggatttaccatatcacgaacgactgctccaactctagca

SEQ ID NO: 116197 - DNA, 75 bp, Artificial Sequence
  Synthetic
ggatacagtacctagcgggcttgtccactctgcctgggaaccccgcaatagcatcactgatggcattcacagcct

SEQ ID NO: 116198 - DNA, 75 bp, Artificial Sequence
  Synthetic
ttgttcggccttgtacatcggggacctttgtggtggagtcttcctggtgggacagcttttcaccttccgtcccag

SEQ ID NO: 116199 - DNA, 75 bp, Artificial Sequence
  Synthetic
ttgttcggccttgtacatcggggacctttgtggtggtgtcttcctggtgggacagcttttcaccttccgtcccag

SEQ ID NO: 116200 - DNA, 75 bp, Artificial Sequence
  Synthetic
ttgttcggccttgtacatcggggacctttgtggtggcgtcttcctggtgggacagcttttcaccttccgtcccag

SEQ ID NO: 116201 - DNA, 75 bp, Artificial Sequence
  Synthetic
ttgttcggccttgtacatcggggacctttgtggtggggtcttcctggtgggacagcttttcaccttccgtcccag

SEQ ID NO: 116202 - DNA, 75 bp, Artificial Sequence
  Synthetic
cccttgccgatttcgaccagggctggggccctatcagctatgccaacggaagcggccccgaacaccgcccctact

SEQ ID NO: 116203 - DNA, 75 bp, Artificial Sequence
  Synthetic
catttgaccaaggttggggccctctctcatacgctaacataactggctcgtcgtctgacaagccgtattgttggc

SEQ ID NO: 116204 - DNA, 75 bp, Artificial Sequence
  Synthetic
gatgttggttacagctcacccccacggttgcagccagggacatcagctcctccactgtggcgcttcgacgacatg

SEQ ID NO: 116205 - DNA, 75 bp, Artificial Sequence
  Synthetic
ggttgcagccagggacatcagctcctccactgtggcgcttcgacgacatgtcgatttgctcgttgggggggcggt

SEQ ID NO: 116206 - DNA, 75 bp, Artificial Sequence
  Synthetic
tgcaattgctccatctacccaggccatgtaacgggtcaccgtatggcgtgggatatgatgatgaactggtcacct

SEQ ID NO: 116207 - DNA, 75 bp, Artificial Sequence
  Synthetic
caagggcatccccacgtataactggggggagaatgccactgatgtgttcctgctgcaaagtgctaggcctccgcg

SEQ ID NO: 116208 - DNA, 75 bp, Artificial Sequence
  Synthetic
gcctcacaggccgggacaagaaccaggtcgagggggaggttcaagtggtttccaccgcgacgcaatctttcctgg

SEQ ID NO: 116209 - DNA, 75 bp, Artificial Sequence
  Synthetic
tcactgatatgtcctaccgattgcttccgcaaacatccggaagctacctatgcacggtgtgggtcaggaccttgg

SEQ ID NO: 116210 - DNA, 75 bp, Artificial Sequence
  Synthetic
ggtgccagccaaaacatccagctgattaacaccaacggcagttggcacattaataggactgcccttaactgcaat

SEQ ID NO: 116211 - DNA, 75 bp, Artificial Sequence
  Synthetic
gcaccgggtgcgaggcagaacattcaacttgtaaacaccaacggcagctggcacatcaataggactgccttaaac

SEQ ID NO: 116212 - DNA, 75 bp, Artificial Sequence
  Synthetic
ttgagcataggttcgatgccgcctgcaactggactcgcggagagcggtgtgagctggatgatagggacagggttg

SEQ ID NO: 116213 - DNA, 75 bp, Artificial Sequence
  Synthetic
ttacagactttgcccaggggtcgggtcccatcacgcatgctgacgtcaacggaagtgaccatcggccgtattgtt

SEQ ID NO: 116214 - DNA, 75 bp, Artificial Sequence
  Synthetic
cccgactctggtattcgacatcaccaagctgctgctggccgtcttcggccccctttggattcttcaagccagttt

SEQ ID NO: 116215 - DNA, 75 bp, Artificial Sequence
  Synthetic
ggaggtaaggcgggtgggggacttccactacgtgacgggcatgactactgacaaccttaagtgcccgtgccaggt

SEQ ID NO: 116216 - DNA, 75 bp, Artificial Sequence
  Synthetic
gaacattgtggacgtacagtacctctatggagtcagcacgaacattgtatcgtgggccgtgaagtgggagtacgt

SEQ ID NO: 116217 - DNA, 75 bp, Artificial Sequence
  Synthetic
ggcattacccgccgcaacgttgtggcatcgtccccgcaagcaaggtctgcgggccagtatactgtttcaccccca

SEQ ID NO: 116218 - DNA, 75 bp, Artificial Sequence
  Synthetic
gtcctcaacaccgcttccgccgcaagctctcaggggtgggtctggggattggttttcatctgttttgcctggtac

SEQ ID NO: 116219 - DNA, 75 bp, Artificial Sequence
  Synthetic
catcgggggggggaacggcaacaacaccttgatctgccctactgactgcttccgcaaacacccggaagccactta

SEQ ID NO: 116220 - DNA, 75 bp, Artificial Sequence
  Synthetic
gtcctagcgggcatagcgtatttctccatggtggggaactgggcgaaggtcctggtagtgctgttgctgtttgcc

SEQ ID NO: 116221 - DNA, 75 bp, Artificial Sequence
  Synthetic
atggggaggaagcaggctctttgggagcactggtaattgtcatcattaccatcttcactctcactccaggctaca

SEQ ID NO: 116222 - DNA, 75 bp, Artificial Sequence
  Synthetic
gcgggacgccatcattttggtcacttgcctactgcacccgcagctgggatttgagatcaccaagatactgctagc

SEQ ID NO: 116223 - DNA, 75 bp, Artificial Sequence
  Synthetic
ggagtcaatttaccaatgttgtgacttggcccccgaagccagacaggccataaggtcgctcacagagcggcttta

SEQ ID NO: 116224 - DNA, 75 bp, Artificial Sequence
  Synthetic
attgtgggtgggaagtacgttcaagtcttcctattaaagctgggtgcgtggacaggcacgtacatttatgaccac

SEQ ID NO: 116225 - DNA, 75 bp, Artificial Sequence
  Synthetic
acagagtggcaggtattgccctgttccttcaccaccctaccggctctgtccactggtttgatccatctccatcag

SEQ ID NO: 116226 - DNA, 75 bp, Artificial Sequence
  Synthetic
ccttcaccaccctaccggctctgtccactggtttgatccatctccatcagaacatcgtggacgtgcaatacctgt

SEQ ID NO: 116227 - DNA, 75 bp, Artificial Sequence
  Synthetic
cactggtttgatccatctccatcagaacatcgtggacgtgcaatacctgtacggtatagggtcagcggttgtctc

SEQ ID NO: 116228 - DNA, 75 bp, Artificial Sequence
  Synthetic
ggggtgccgacacagctgcctgcggggacatcatctctgggctgcccgtatctgctaggaggggtaacctcatat

SEQ ID NO: 116229 - DNA, 75 bp, Artificial Sequence
  Synthetic
tcagtagtgaggccgacgcggaggatgtcgtgtgctgctcaatgtcttactcctggacaggcgcacttatcaccc

SEQ ID NO: 116230 - DNA, 75 bp, Artificial Sequence
  Synthetic
gtcccagctgcatacgcagctcagggctacaaggtgctagtgctcaacccctctgttgctgcaacactgggcttt

SEQ ID NO: 116231 - DNA, 75 bp, Artificial Sequence
  Synthetic
gggaccccgatctcagcgacgggtcttggtctaccgtgagcgaagaggctagtgaggacgtcgtttgctgttcga

SEQ ID NO: 116232 - DNA, 75 bp, Artificial Sequence
  Synthetic
taccagcctcaccggacgtgacaaaaacgaggtggagggcgaaatccaggttgtctccacggctacgcagtcttt

SEQ ID NO: 116233 - DNA, 75 bp, Artificial Sequence
  Synthetic
tcccctcccttgaagtgcggggcggccgcgatgccatcatcctcctcgcgtgcttggtccaccctggtcttatgt

SEQ ID NO: 116234 - DNA, 75 bp, Artificial Sequence
  Synthetic
aatgttgatcaggacctagtaggctggcctgcgccgcctggagcacgatcgttgacaccgtgcagttgtggctcc

SEQ ID NO: 116235 - DNA, 75 bp, Artificial Sequence
  Synthetic
aacgtggaccaggatttggtggggtggccagcgccgcctggggcgcggtcattcacaccgtgctcttgtggcgca

SEQ ID NO: 116236 - DNA, 75 bp, Artificial Sequence
  Synthetic
aacgtggaccaggatttggtggggtggcctgcgccgcctggggcgcggtcattcacaccgtgctcttgtggcgca

SEQ ID NO: 116237 - DNA, 75 bp, Artificial Sequence
  Synthetic
aacgtggaccaggatttggtggggtggcccgcgccgcctggggcgcggtcattcacaccgtgctcttgtggcgca

SEQ ID NO: 116238 - DNA, 75 bp, Artificial Sequence
  Synthetic
aacgtggaccaggatttggtggggtggccggcgccgcctggggcgcggtcattcacaccgtgctcttgtggcgca

SEQ ID NO: 116239 - DNA, 75 bp, Artificial Sequence
  Synthetic
tgaaggggtcgtcgggcggtcccatgttatgcccgtctggccatgtcgtaggaattttccgtgcggcagtgtgta

SEQ ID NO: 116240 - DNA, 75 bp, Artificial Sequence
  Synthetic
ggggggcagacaccgccgcatgtggagacatcattgcggggctgcctgtttccgcgcgcagggggagggagctgt

SEQ ID NO: 116241 - DNA, 75 bp, Artificial Sequence
  Synthetic
caccaccatcatggcaaaaaatgaggttttctgtgtccaaccagagaagggaggccgcaagccagctcgccttat

SEQ ID NO: 116242 - DNA, 75 bp, Artificial Sequence
  Synthetic
cccacagacataccaagtgggatacctccatgcacccacgggtagcggcaagagcactaaggttcccgctgcata

SEQ ID NO: 116243 - DNA, 75 bp, Artificial Sequence
  Synthetic
atccgtactggggtgaggaccatcaataccggtggagcaatcacatattccacttatggcaaattcctcgcagac

SEQ ID NO: 116244 - DNA, 75 bp, Artificial Sequence
  Synthetic
atccgtactggggtgaggaccatcaataccggtggagcaatcacatattccacttatggcaatttcctcgcagac

SEQ ID NO: 116245 - DNA, 75 bp, Artificial Sequence
  Synthetic
atccgtactggggtgaggaccatcaataccggtggagcaatcacatattccacttatggcaacttcctcgcagac

SEQ ID NO: 116246 - DNA, 75 bp, Artificial Sequence
  Synthetic
atccgtactggggtgaggaccatcaataccggtggagcaatcacatattccacttatggcaagttcctcgcagac

SEQ ID NO: 116247 - DNA, 75 bp, Artificial Sequence
  Synthetic
ggccagcgccccccggggcgcggtcgttgacaccatgtacctgcggctccgcagacctttatctggtcacaaggc

SEQ ID NO: 116248 - DNA, 75 bp, Artificial Sequence
  Synthetic
cggagacagccgggtgcaggctcactgtgctcgcgacggcaacccctcctggatctgtcacggtcccacacccca

SEQ ID NO: 116249 - DNA, 75 bp, Artificial Sequence
  Synthetic
gctttgcccctccggccatgcggtaggcatctttagggctgccgtctgcactcggggggtcgcgaaagcggtcga

SEQ ID NO: 116250 - DNA, 75 bp, Artificial Sequence
  Synthetic
ccattccaaaaagaagtgtgatgagctcgccacgcaattgcgatctctggggctcaacgccgtagccttctatag

SEQ ID NO: 116251 - DNA, 75 bp, Artificial Sequence
  Synthetic
gattgcaacgtttcggtcatgcaggttgtcgacttcagccttgaccccacattcactattgagacaactactgtg

SEQ ID NO: 116252 - DNA, 75 bp, Artificial Sequence
  Synthetic
caaagcgcacgggatagatccaaacataaggaccggcgtgaggaccatcaccacgggctctgccatcacatattc

SEQ ID NO: 116253 - DNA, 75 bp, Artificial Sequence
  Synthetic
attttcactccacagttactctccaggtgaaatcaatagggtggccgcatgcctcagaaaacttggggtcccgcc

SEQ ID NO: 116254 - DNA, 75 bp, Artificial Sequence
  Synthetic
agtacgcaactcctcgggcctttaccatgtcaccaatgattgccccaactcgagcattgtgtacgagacggccga

SEQ ID NO: 116255 - DNA, 75 bp, Artificial Sequence
  Synthetic
tgtttgattctgccgtcctatgcgaggcatacgacacagggtgcgcgtggtacgagctgacgccagcagaaacaa

SEQ ID NO: 116256 - DNA, 75 bp, Artificial Sequence
  Synthetic
cgcccatttcctatcacagacaaagcaggggggagagaacttcgcgtaccttgttgcctatcaggcgacggtctg

SEQ ID NO: 116257 - DNA, 75 bp, Artificial Sequence
  Synthetic
ctaggcggggttcaaaatgagatcactaccacacacccaatcacgaagtacattatgacttgcatgtcagcggac

SEQ ID NO: 116258 - DNA, 75 bp, Artificial Sequence
  Synthetic
tcacttatgctgagccccctgactcagaccagaggccctactgttggcactacccgcctaagccgtgtggtgttg

SEQ ID NO: 116259 - DNA, 75 bp, Artificial Sequence
  Synthetic
tctccaccactggtaagccagtgctaattcctgatcgagaagtgctctaccaacagttcgacgagatggaagagt

SEQ ID NO: 116260 - DNA, 75 bp, Artificial Sequence
  Synthetic
gaaattccccccagcgatgcccgtatgggcacgcccggattacaaccctccactgctagagtcctggaaggaccc

SEQ ID NO: 116261 - DNA, 75 bp, Artificial Sequence
  Synthetic
gtgcgcgcgactcggaagacttcggagcggtcgcaacctcgtggaagacgccaacctatccccaaggcgcgtcga

SEQ ID NO: 116262 - DNA, 75 bp, Artificial Sequence
  Synthetic
agagctcaagcctgttgtccattctgcttggccaaaggtcgaacagttttggcagaagcacttatggaacttcgt

SEQ ID NO: 116263 - DNA, 75 bp, Artificial Sequence
  Synthetic
gaccgtcttggggcccaaatgatccccggcggaggtcccgcaatttgggtaaggtcatcgataccctaacctgcg

SEQ ID NO: 116264 - DNA, 75 bp, Artificial Sequence
  Synthetic
acctccgctaccctcctgtttaacatcttggggggctgggtcgcctcacaactggcaaaccccaccgcttcaact

SEQ ID NO: 116265 - DNA, 75 bp, Artificial Sequence
  Synthetic
catcatggcatgcatgtcggccgacctagaggttgtcaccagcacctgggtgctggtggggggcgtcctcgccgc

SEQ ID NO: 116266 - DNA, 75 bp, Artificial Sequence
  Synthetic
gagctcttgtcgcttttaagatcatgagcggcgagaccccatcggctgaggacatggtcaatctactcccagctc

SEQ ID NO: 116267 - DNA, 75 bp, Artificial Sequence
  Synthetic
caacagttcgatgagatggaggagtgtgcaacacatctcccctacattgaacaggggatgcacctcgcggagcag

SEQ ID NO: 116268 - DNA, 75 bp, Artificial Sequence
  Synthetic
gatagcgttcgcctcaaggggtaatcacgtgtcacccacgcactacgttcctgagactgacacctcacgccagat

SEQ ID NO: 116269 - DNA, 75 bp, Artificial Sequence
  Synthetic
atcatggcatgcatgtcggctgacctggaggtcgtcacgagcacctgggtgctagtaggcggagtcctcgcagct

SEQ ID NO: 116270 - DNA, 75 bp, Artificial Sequence
  Synthetic
cctatggaggcaggagatgggcggcaacatcaccagggtcgagtcagagaacaaagtggtgattctggactcctt

SEQ ID NO: 116271 - DNA, 75 bp, Artificial Sequence
  Synthetic
gggccaaacacatgtggaattttatcagtggaatacagtacttagcgggcctgtcgacgctacctgggaatccag

SEQ ID NO: 116272 - DNA, 75 bp, Artificial Sequence
  Synthetic
cgggacatttgggactgggtgtgcactgtgctctccgactttaagtgctggctcaagtccaaacttgtgccggcg

SEQ ID NO: 116273 - DNA, 75 bp, Artificial Sequence
  Synthetic
tggccagatgttttcattccgaccacggcgccactggaccacccaggattgcaattgttccatctacacagggca

SEQ ID NO: 116274 - DNA, 75 bp, Artificial Sequence
  Synthetic
ccctcaggatgcggtatcgcggagccaacgacgaggccgcacggggcggggtaaaccaggggtgtacagatttgt

SEQ ID NO: 116275 - DNA, 75 bp, Artificial Sequence
  Synthetic
agttcaactcgtccggatgcccagagcgcatggccagctgccgctccattgataagttttcccaggggtggggtc

SEQ ID NO: 116276 - DNA, 75 bp, Artificial Sequence
  Synthetic
ctggccacgtgagaaatggatccatgagaataacgggatcaaagtggtgcagcaacgtttggcatggcaccttcc

SEQ ID NO: 116277 - DNA, 75 bp, Artificial Sequence
  Synthetic
gagggtaggtgacagccatttcgtcgtaggcgctactaaccaggatcttaagtgcccttgtcaagtcccggcccc

SEQ ID NO: 116278 - DNA, 75 bp, Artificial Sequence
  Synthetic
agagtctgagaccaaagtcatcgtgctcgactcatttgatcccatcgccccggagtatgacgatagggagccctc

SEQ ID NO: 116279 - DNA, 75 bp, Artificial Sequence
  Synthetic
agagtctgagaccaaagtcatcgtgctcgactcttttgatcccatcgccccggagtatgacgatagggagccctc

SEQ ID NO: 116280 - DNA, 75 bp, Artificial Sequence
  Synthetic
agagtctgagaccaaagtcatcgtgctcgactcctttgatcccatcgccccggagtatgacgatagggagccctc

SEQ ID NO: 116281 - DNA, 75 bp, Artificial Sequence
  Synthetic
agagtctgagaccaaagtcatcgtgctcgactcgtttgatcccatcgccccggagtatgacgatagggagccctc

SEQ ID NO: 116282 - DNA, 75 bp, Artificial Sequence
  Synthetic
tggcggcgttgtccttgtcgggttaatggcgctgactctgtcaccgcattacaagcgctacatcagctggtgctt

SEQ ID NO: 116283 - DNA, 75 bp, Artificial Sequence
  Synthetic
tcctacgtgattggatctcaactcccgtgtgagcctgagccagacgtgtcagttgttacatcaatgctggttgat

SEQ ID NO: 116284 - DNA, 75 bp, Artificial Sequence
  Synthetic
tcctacgtgattggatctcaactcccgtgtgagcctgagcctgacgtgtcagttgttacatcaatgctggttgat

SEQ ID NO: 116285 - DNA, 75 bp, Artificial Sequence
  Synthetic
tcctacgtgattggatctcaactcccgtgtgagcctgagcccgacgtgtcagttgttacatcaatgctggttgat

SEQ ID NO: 116286 - DNA, 75 bp, Artificial Sequence
  Synthetic
tcctacgtgattggatctcaactcccgtgtgagcctgagccggacgtgtcagttgttacatcaatgctggttgat

SEQ ID NO: 116287 - DNA, 75 bp, Artificial Sequence
  Synthetic
tgaaagcgacgtgcacaccgcactgcaatcatcctgacgttgatctgatagaagcaaacttgctatggaggcagg

SEQ ID NO: 116288 - DNA, 75 bp, Artificial Sequence
  Synthetic
cctggggggagaatgagactgatgtcttccttttgaactcaaccagaccgccgcatggtgcgtggtttggatgag

SEQ ID NO: 116289 - DNA, 75 bp, Artificial Sequence
  Synthetic
cctggggggagaatgagactgatgtcttccttttgaactcaaccagaccgccgcatggtgcgtggtttggatgtg

SEQ ID NO: 116290 - DNA, 75 bp, Artificial Sequence
  Synthetic
cctggggggagaatgagactgatgtcttccttttgaactcaaccagaccgccgcatggtgcgtggtttggatgcg

SEQ ID NO: 116291 - DNA, 75 bp, Artificial Sequence
  Synthetic
cctggggggagaatgagactgatgtcttccttttgaactcaaccagaccgccgcatggtgcgtggtttggatggg

SEQ ID NO: 116292 - DNA, 75 bp, Artificial Sequence
  Synthetic
cctggggggagaatgagactgatgtcttccttttgaactctaccagaccgccgcatggtgcgtggtttggatgag

SEQ ID NO: 116293 - DNA, 75 bp, Artificial Sequence
  Synthetic
cctggggggagaatgagactgatgtcttccttttgaactctaccagaccgccgcatggtgcgtggtttggatgtg

SEQ ID NO: 116294 - DNA, 75 bp, Artificial Sequence
  Synthetic
cctggggggagaatgagactgatgtcttccttttgaactctaccagaccgccgcatggtgcgtggtttggatgcg

SEQ ID NO: 116295 - DNA, 75 bp, Artificial Sequence
  Synthetic
cctggggggagaatgagactgatgtcttccttttgaactctaccagaccgccgcatggtgcgtggtttggatggg

SEQ ID NO: 116296 - DNA, 75 bp, Artificial Sequence
  Synthetic
cctggggggagaatgagactgatgtcttccttttgaactccaccagaccgccgcatggtgcgtggtttggatgag

SEQ ID NO: 116297 - DNA, 75 bp, Artificial Sequence
  Synthetic
cctggggggagaatgagactgatgtcttccttttgaactccaccagaccgccgcatggtgcgtggtttggatgtg

SEQ ID NO: 116298 - DNA, 75 bp, Artificial Sequence
  Synthetic
cctggggggagaatgagactgatgtcttccttttgaactccaccagaccgccgcatggtgcgtggtttggatgcg

SEQ ID NO: 116299 - DNA, 75 bp, Artificial Sequence
  Synthetic
cctggggggagaatgagactgatgtcttccttttgaactccaccagaccgccgcatggtgcgtggtttggatggg

SEQ ID NO: 116300 - DNA, 75 bp, Artificial Sequence
  Synthetic
cctggggggagaatgagactgatgtcttccttttgaactcgaccagaccgccgcatggtgcgtggtttggatgag

SEQ ID NO: 116301 - DNA, 75 bp, Artificial Sequence
  Synthetic
cctggggggagaatgagactgatgtcttccttttgaactcgaccagaccgccgcatggtgcgtggtttggatgtg

SEQ ID NO: 116302 - DNA, 75 bp, Artificial Sequence
  Synthetic
cctggggggagaatgagactgatgtcttccttttgaactcgaccagaccgccgcatggtgcgtggtttggatgcg

SEQ ID NO: 116303 - DNA, 75 bp, Artificial Sequence
  Synthetic
cctggggggagaatgagactgatgtcttccttttgaactcgaccagaccgccgcatggtgcgtggtttggatggg

SEQ ID NO: 116304 - DNA, 75 bp, Artificial Sequence
  Synthetic
ccaggacctcgtcggctggcaggcgccccccggggcgcgttccttgacaccatgcacctgcggcagctcagacct

SEQ ID NO: 116305 - DNA, 75 bp, Artificial Sequence
  Synthetic
ggcactgccccaccgattgcttcaggaagcatccggagactacctacgccaagtgcggatcagggccttggatca

SEQ ID NO: 116306 - DNA, 75 bp, Artificial Sequence
  Synthetic
catacccgcggaatgtcacaggccaaaaagacccaaatttccaccagccctcccaatatgggcgaggcctgacta

SEQ ID NO: 116307 - DNA, 75 bp, Artificial Sequence
  Synthetic
cctaggaggaagagggttgtacgcctggacgactctaccgtgtcagaagtgctggcggagctggctcataagtct

SEQ ID NO: 116308 - DNA, 75 bp, Artificial Sequence
  Synthetic
agtattgacatccatgctcactgacccctctcacatcaccgcagaggcagccaagcgcagactggatagggggtc

SEQ ID NO: 116309 - DNA, 75 bp, Artificial Sequence
  Synthetic
ccctctcacatcaccgcagaggcagccaagcgcagactggatagggggtcacccccctccctggctagctcttcg

SEQ ID NO: 116310 - DNA, 75 bp, Artificial Sequence
  Synthetic
acgtggattcttatagctccatgccgccgcttgagggggaaccaggagacccggaccttagctcggggtcttggt

SEQ ID NO: 116311 - DNA, 75 bp, Artificial Sequence
  Synthetic
acctaggtgcatggttgactacccatacaggctctggcactacccctgcactgtcaactttaccatcttcaaggt

SEQ ID NO: 116312 - DNA, 75 bp, Artificial Sequence
  Synthetic
gatgtttatggtaagtcaagttgaggcggctctgtccaacctaattaacatcaatgctgcttcagccgctggtgc

SEQ ID NO: 116313 - DNA, 75 bp, Artificial Sequence
  Synthetic
cctctcaacgtccgggggggccgcgatgccatcatcctcctcacgtgcgcggtccaccctgagctgatctttgat

SEQ ID NO: 116314 - DNA, 75 bp, Artificial Sequence
  Synthetic
gcccatcaaccctctaagcaactccctcattcgacaccataacatggtatactccacgtcatcacggagtgccac

SEQ ID NO: 116315 - DNA, 75 bp, Artificial Sequence
  Synthetic
ggtgcgccaaaagaaagtgacctttgaccgtctgcagctacttgaccaacactataatgatgtactaaaggagat

SEQ ID NO: 116316 - DNA, 75 bp, Artificial Sequence
  Synthetic
ccatgtggagctgaaatcactggacatgtcaaaaacgggacgatgaggatcgtcggtcccaggacctgcaggaac

SEQ ID NO: 116317 - DNA, 75 bp, Artificial Sequence
  Synthetic
ctgtttctcctgcttctgatgctgcctgagagggcttatgcatacgaccaggaagtggcagggtcccttggcggc

SEQ ID NO: 116318 - DNA, 75 bp, Artificial Sequence
  Synthetic
tccccctctgctggagccatggaagagggatgactacgtaccaccggtggtccatggctgccctcttccacccag

SEQ ID NO: 116319 - DNA, 75 bp, Artificial Sequence
  Synthetic
cgacagtcctccagtgcctcccccgcggaggaagaagagaaccatcatactcacagaatccactgtgtcctctgc

SEQ ID NO: 116320 - DNA, 75 bp, Artificial Sequence
  Synthetic
gcgaaggaagttcggagccatgccagcaaggccattaaccatataaactccgtatgggaggacttgttggaagac

SEQ ID NO: 116321 - DNA, 75 bp, Artificial Sequence
  Synthetic
ttttgcctactcctgctcgctgcgggggtaggcatctacctcctccccaaccggtaaggttggggtaaacactcc

SEQ ID NO: 116322 - DNA, 75 bp, Artificial Sequence
  Synthetic
aggctgtgctgcatgtctatattccatccttcaacgtgcgcgggcctcgcgactcagtgattgttcttgcagtcc

SEQ ID NO: 116323 - DNA, 75 bp, Artificial Sequence
  Synthetic
catatgggcgcgcccggattacaaccctccactgttagagtcctggaaagacccggactacgtccctccggtggt

SEQ ID NO: 116324 - DNA, 75 bp, Artificial Sequence
  Synthetic
ctgacctcggggttcgggtgtgcgagaagagagccctcttcgacatcacgcggaaactaccaatagccataatgg

SEQ ID NO: 116325 - DNA, 75 bp, Artificial Sequence
  Synthetic
tgtgagggcacaagcgctggttaagatctgcagcttgttgcgtggggtagtttatggcaagtacttccaaatggt

SEQ ID NO: 116326 - DNA, 75 bp, Artificial Sequence
  Synthetic
caggtgctttgattcaacagtcaccgagcatgatattaggactgagcaagacatctacctatcctgcaacctgga

SEQ ID NO: 116327 - DNA, 75 bp, Artificial Sequence
  Synthetic
tatttctccatggtggggaactgggcgaaggtcctggtagtactgttgctgtttgctggcgtcgatgcggaaacc

SEQ ID NO: 116328 - DNA, 75 bp, Artificial Sequence
  Synthetic
ggcgcacttgcaagtgtgggtcccccctctcaacgttcgggggggccgcgatgccatcatcctcctcatgtgtgc

SEQ ID NO: 116329 - DNA, 75 bp, Artificial Sequence
  Synthetic
cgtgctagtggggtgctcaccactagtttaggcaacactatgacctgcttcatcaaagccaatgcagcctgccga

SEQ ID NO: 116330 - DNA, 75 bp, Artificial Sequence
  Synthetic
gcggcaggcctcaccaattgtgacatgttggtttgcggagacgatttggtagtcattgccgagagcgctggggtc

SEQ ID NO: 116331 - DNA, 75 bp, Artificial Sequence
  Synthetic
caagaccatcagcggcccgaagggacctgtcaatcaaatgtacactaatgttgaccaagacttggtggggtggcc

SEQ ID NO: 116332 - DNA, 75 bp, Artificial Sequence
  Synthetic
cctgtcaatcaaatgtacactaatgttgaccaagacttggtggggtggccagcaccccccggagtcagatctctt

SEQ ID NO: 116333 - DNA, 75 bp, Artificial Sequence
  Synthetic
acgcatggttctgatgacccatttctttggtatactgcaagcgcaggagcaactagatagagtacttgacttcga

SEQ ID NO: 116334 - DNA, 75 bp, Artificial Sequence
  Synthetic
gatgaaggttggtgtaagcactccggcctcttaggccatttctgtttttttttttttttttcccccttttttttt

SEQ ID NO: 116335 - DNA, 75 bp, Artificial Sequence
  Synthetic
cggcagcctatccccaaggcccgccgatccgagggtaggtcctggcaacagccaggatatccatggcccctctat

SEQ ID NO: 116336 - DNA, 75 bp, Artificial Sequence
  Synthetic
gtcccggttgaatctcttgagactaccatgagatcaccagtgttcactgacaactcaacacccccagcagtgccc

SEQ ID NO: 116337 - DNA, 75 bp, Artificial Sequence
  Synthetic
ggcgaactcaatcgggtgggagcatgcctcaggaagcttggggcccctccattgagagcctggcgacaccgagcc

SEQ ID NO: 116338 - DNA, 75 bp, Artificial Sequence
  Synthetic
ccaaggtgcatggtccactacccttacagactgtggcactatccgtgtaccgtcaattttaccatctttaaggtc

SEQ ID NO: 116339 - DNA, 75 bp, Artificial Sequence
  Synthetic
cgcgcggtcagagcgaagcttatcgcccaggggggtagagcagcaatctgcggcaaatacctctttaattgggcg

SEQ ID NO: 116340 - DNA, 75 bp, Artificial Sequence
  Synthetic
cgcgcggtcagagcgaagcttatcgcccaggggggtagagcagcaatctgcggcatatacctctttaattgggcg

SEQ ID NO: 116341 - DNA, 75 bp, Artificial Sequence
  Synthetic
cgcgcggtcagagcgaagcttatcgcccaggggggtagagcagcaatctgcggcacatacctctttaattgggcg

SEQ ID NO: 116342 - DNA, 75 bp, Artificial Sequence
  Synthetic
cgcgcggtcagagcgaagcttatcgcccaggggggtagagcagcaatctgcggcagatacctctttaattgggcg

SEQ ID NO: 116343 - DNA, 75 bp, Artificial Sequence
  Synthetic
cgcgcggtcagagcgaagcttatcgcccaggggggtagtgcagcaatctgcggcaaatacctctttaattgggcg

SEQ ID NO: 116344 - DNA, 75 bp, Artificial Sequence
  Synthetic
cgcgcggtcagagcgaagcttatcgcccaggggggtagtgcagcaatctgcggcatatacctctttaattgggcg

SEQ ID NO: 116345 - DNA, 75 bp, Artificial Sequence
  Synthetic
cgcgcggtcagagcgaagcttatcgcccaggggggtagtgcagcaatctgcggcacatacctctttaattgggcg

SEQ ID NO: 116346 - DNA, 75 bp, Artificial Sequence
  Synthetic
cgcgcggtcagagcgaagcttatcgcccaggggggtagtgcagcaatctgcggcagatacctctttaattgggcg

SEQ ID NO: 116347 - DNA, 75 bp, Artificial Sequence
  Synthetic
cgcgcggtcagagcgaagcttatcgcccaggggggtagcgcagcaatctgcggcaaatacctctttaattgggcg

SEQ ID NO: 116348 - DNA, 75 bp, Artificial Sequence
  Synthetic
cgcgcggtcagagcgaagcttatcgcccaggggggtagcgcagcaatctgcggcatatacctctttaattgggcg

SEQ ID NO: 116349 - DNA, 75 bp, Artificial Sequence
  Synthetic
cgcgcggtcagagcgaagcttatcgcccaggggggtagcgcagcaatctgcggcacatacctctttaattgggcg

SEQ ID NO: 116350 - DNA, 75 bp, Artificial Sequence
  Synthetic
cgcgcggtcagagcgaagcttatcgcccaggggggtagcgcagcaatctgcggcagatacctctttaattgggcg

SEQ ID NO: 116351 - DNA, 75 bp, Artificial Sequence
  Synthetic
cgcgcggtcagagcgaagcttatcgcccaggggggtagggcagcaatctgcggcaaatacctctttaattgggcg

SEQ ID NO: 116352 - DNA, 75 bp, Artificial Sequence
  Synthetic
cgcgcggtcagagcgaagcttatcgcccaggggggtagggcagcaatctgcggcatatacctctttaattgggcg

SEQ ID NO: 116353 - DNA, 75 bp, Artificial Sequence
  Synthetic
cgcgcggtcagagcgaagcttatcgcccaggggggtagggcagcaatctgcggcacatacctctttaattgggcg

SEQ ID NO: 116354 - DNA, 75 bp, Artificial Sequence
  Synthetic
cgcgcggtcagagcgaagcttatcgcccaggggggtagggcagcaatctgcggcagatacctctttaattgggcg

SEQ ID NO: 116355 - DNA, 75 bp, Artificial Sequence
  Synthetic
cgcgcggtcagagcgaagcttatcgcccaggggggttgagcagcaatctgcggcaaatacctctttaattgggcg

SEQ ID NO: 116356 - DNA, 75 bp, Artificial Sequence
  Synthetic
cgcgcggtcagagcgaagcttatcgcccaggggggttgagcagcaatctgcggcatatacctctttaattgggcg

SEQ ID NO: 116357 - DNA, 75 bp, Artificial Sequence
  Synthetic
cgcgcggtcagagcgaagcttatcgcccaggggggttgagcagcaatctgcggcacatacctctttaattgggcg

SEQ ID NO: 116358 - DNA, 75 bp, Artificial Sequence
  Synthetic
cgcgcggtcagagcgaagcttatcgcccaggggggttgagcagcaatctgcggcagatacctctttaattgggcg

SEQ ID NO: 116359 - DNA, 75 bp, Artificial Sequence
  Synthetic
cgcgcggtcagagcgaagcttatcgcccaggggggttgtgcagcaatctgcggcaaatacctctttaattgggcg

SEQ ID NO: 116360 - DNA, 75 bp, Artificial Sequence
  Synthetic
cgcgcggtcagagcgaagcttatcgcccaggggggttgtgcagcaatctgcggcatatacctctttaattgggcg

SEQ ID NO: 116361 - DNA, 75 bp, Artificial Sequence
  Synthetic
cgcgcggtcagagcgaagcttatcgcccaggggggttgtgcagcaatctgcggcacatacctctttaattgggcg

SEQ ID NO: 116362 - DNA, 75 bp, Artificial Sequence
  Synthetic
cgcgcggtcagagcgaagcttatcgcccaggggggttgtgcagcaatctgcggcagatacctctttaattgggcg

SEQ ID NO: 116363 - DNA, 75 bp, Artificial Sequence
  Synthetic
cgcgcggtcagagcgaagcttatcgcccaggggggttgcgcagcaatctgcggcaaatacctctttaattgggcg

SEQ ID NO: 116364 - DNA, 75 bp, Artificial Sequence
  Synthetic
cgcgcggtcagagcgaagcttatcgcccaggggggttgcgcagcaatctgcggcatatacctctttaattgggcg

SEQ ID NO: 116365 - DNA, 75 bp, Artificial Sequence
  Synthetic
cgcgcggtcagagcgaagcttatcgcccaggggggttgcgcagcaatctgcggcacatacctctttaattgggcg

SEQ ID NO: 116366 - DNA, 75 bp, Artificial Sequence
  Synthetic
cgcgcggtcagagcgaagcttatcgcccaggggggttgcgcagcaatctgcggcagatacctctttaattgggcg

SEQ ID NO: 116367 - DNA, 75 bp, Artificial Sequence
  Synthetic
cgcgcggtcagagcgaagcttatcgcccaggggggttgggcagcaatctgcggcaaatacctctttaattgggcg

SEQ ID NO: 116368 - DNA, 75 bp, Artificial Sequence
  Synthetic
cgcgcggtcagagcgaagcttatcgcccaggggggttgggcagcaatctgcggcatatacctctttaattgggcg

SEQ ID NO: 116369 - DNA, 75 bp, Artificial Sequence
  Synthetic
cgcgcggtcagagcgaagcttatcgcccaggggggttgggcagcaatctgcggcacatacctctttaattgggcg

SEQ ID NO: 116370 - DNA, 75 bp, Artificial Sequence
  Synthetic
cgcgcggtcagagcgaagcttatcgcccaggggggttgggcagcaatctgcggcagatacctctttaattgggcg

SEQ ID NO: 116371 - DNA, 75 bp, Artificial Sequence
  Synthetic
cgcgcggtcagagcgaagcttatcgcccaggggggtcgagcagcaatctgcggcaaatacctctttaattgggcg

SEQ ID NO: 116372 - DNA, 75 bp, Artificial Sequence
  Synthetic
cgcgcggtcagagcgaagcttatcgcccaggggggtcgagcagcaatctgcggcatatacctctttaattgggcg

SEQ ID NO: 116373 - DNA, 75 bp, Artificial Sequence
  Synthetic
cgcgcggtcagagcgaagcttatcgcccaggggggtcgagcagcaatctgcggcacatacctctttaattgggcg

SEQ ID NO: 116374 - DNA, 75 bp, Artificial Sequence
  Synthetic
cgcgcggtcagagcgaagcttatcgcccaggggggtcgagcagcaatctgcggcagatacctctttaattgggcg

SEQ ID NO: 116375 - DNA, 75 bp, Artificial Sequence
  Synthetic
cgcgcggtcagagcgaagcttatcgcccaggggggtcgtgcagcaatctgcggcaaatacctctttaattgggcg

SEQ ID NO: 116376 - DNA, 75 bp, Artificial Sequence
  Synthetic
cgcgcggtcagagcgaagcttatcgcccaggggggtcgtgcagcaatctgcggcatatacctctttaattgggcg

SEQ ID NO: 116377 - DNA, 75 bp, Artificial Sequence
  Synthetic
cgcgcggtcagagcgaagcttatcgcccaggggggtcgtgcagcaatctgcggcacatacctctttaattgggcg

SEQ ID NO: 116378 - DNA, 75 bp, Artificial Sequence
  Synthetic
cgcgcggtcagagcgaagcttatcgcccaggggggtcgtgcagcaatctgcggcagatacctctttaattgggcg

SEQ ID NO: 116379 - DNA, 75 bp, Artificial Sequence
  Synthetic
cgcgcggtcagagcgaagcttatcgcccaggggggtcgcgcagcaatctgcggcaaatacctctttaattgggcg

SEQ ID NO: 116380 - DNA, 75 bp, Artificial Sequence
  Synthetic
cgcgcggtcagagcgaagcttatcgcccaggggggtcgcgcagcaatctgcggcatatacctctttaattgggcg

SEQ ID NO: 116381 - DNA, 75 bp, Artificial Sequence
  Synthetic
cgcgcggtcagagcgaagcttatcgcccaggggggtcgcgcagcaatctgcggcacatacctctttaattgggcg

SEQ ID NO: 116382 - DNA, 75 bp, Artificial Sequence
  Synthetic
cgcgcggtcagagcgaagcttatcgcccaggggggtcgcgcagcaatctgcggcagatacctctttaattgggcg

SEQ ID NO: 116383 - DNA, 75 bp, Artificial Sequence
  Synthetic
cgcgcggtcagagcgaagcttatcgcccaggggggtcgggcagcaatctgcggcaaatacctctttaattgggcg

SEQ ID NO: 116384 - DNA, 75 bp, Artificial Sequence
  Synthetic
cgcgcggtcagagcgaagcttatcgcccaggggggtcgggcagcaatctgcggcatatacctctttaattgggcg

SEQ ID NO: 116385 - DNA, 75 bp, Artificial Sequence
  Synthetic
cgcgcggtcagagcgaagcttatcgcccaggggggtcgggcagcaatctgcggcacatacctctttaattgggcg

SEQ ID NO: 116386 - DNA, 75 bp, Artificial Sequence
  Synthetic
cgcgcggtcagagcgaagcttatcgcccaggggggtcgggcagcaatctgcggcagatacctctttaattgggcg

SEQ ID NO: 116387 - DNA, 75 bp, Artificial Sequence
  Synthetic
cgcgcggtcagagcgaagcttatcgcccaggggggtggagcagcaatctgcggcaaatacctctttaattgggcg

SEQ ID NO: 116388 - DNA, 75 bp, Artificial Sequence
  Synthetic
cgcgcggtcagagcgaagcttatcgcccaggggggtggagcagcaatctgcggcatatacctctttaattgggcg

SEQ ID NO: 116389 - DNA, 75 bp, Artificial Sequence
  Synthetic
cgcgcggtcagagcgaagcttatcgcccaggggggtggagcagcaatctgcggcacatacctctttaattgggcg

SEQ ID NO: 116390 - DNA, 75 bp, Artificial Sequence
  Synthetic
cgcgcggtcagagcgaagcttatcgcccaggggggtggagcagcaatctgcggcagatacctctttaattgggcg

SEQ ID NO: 116391 - DNA, 75 bp, Artificial Sequence
  Synthetic
cgcgcggtcagagcgaagcttatcgcccaggggggtggtgcagcaatctgcggcaaatacctctttaattgggcg

SEQ ID NO: 116392 - DNA, 75 bp, Artificial Sequence
  Synthetic
cgcgcggtcagagcgaagcttatcgcccaggggggtggtgcagcaatctgcggcatatacctctttaattgggcg

SEQ ID NO: 116393 - DNA, 75 bp, Artificial Sequence
  Synthetic
cgcgcggtcagagcgaagcttatcgcccaggggggtggtgcagcaatctgcggcacatacctctttaattgggcg

SEQ ID NO: 116394 - DNA, 75 bp, Artificial Sequence
  Synthetic
cgcgcggtcagagcgaagcttatcgcccaggggggtggtgcagcaatctgcggcagatacctctttaattgggcg

SEQ ID NO: 116395 - DNA, 75 bp, Artificial Sequence
  Synthetic
cgcgcggtcagagcgaagcttatcgcccaggggggtggcgcagcaatctgcggcaaatacctctttaattgggcg

SEQ ID NO: 116396 - DNA, 75 bp, Artificial Sequence
  Synthetic
cgcgcggtcagagcgaagcttatcgcccaggggggtggcgcagcaatctgcggcatatacctctttaattgggcg

SEQ ID NO: 116397 - DNA, 75 bp, Artificial Sequence
  Synthetic
cgcgcggtcagagcgaagcttatcgcccaggggggtggcgcagcaatctgcggcacatacctctttaattgggcg

SEQ ID NO: 116398 - DNA, 75 bp, Artificial Sequence
  Synthetic
cgcgcggtcagagcgaagcttatcgcccaggggggtggcgcagcaatctgcggcagatacctctttaattgggcg

SEQ ID NO: 116399 - DNA, 75 bp, Artificial Sequence
  Synthetic
cgcgcggtcagagcgaagcttatcgcccaggggggtggggcagcaatctgcggcaaatacctctttaattgggcg

SEQ ID NO: 116400 - DNA, 75 bp, Artificial Sequence
  Synthetic
cgcgcggtcagagcgaagcttatcgcccaggggggtggggcagcaatctgcggcatatacctctttaattgggcg

SEQ ID NO: 116401 - DNA, 75 bp, Artificial Sequence
  Synthetic
cgcgcggtcagagcgaagcttatcgcccaggggggtggggcagcaatctgcggcacatacctctttaattgggcg

SEQ ID NO: 116402 - DNA, 75 bp, Artificial Sequence
  Synthetic
cgcgcggtcagagcgaagcttatcgcccaggggggtggggcagcaatctgcggcagatacctctttaattgggcg

SEQ ID NO: 116403 - DNA, 75 bp, Artificial Sequence
  Synthetic
tgcaactgttccatctaccaaggccatatcaccggccatcgcatggcatgggacatgatgctaaactggtcacca

SEQ ID NO: 116404 - DNA, 75 bp, Artificial Sequence
  Synthetic
ggcagttggcacatcaatcgcacggccttgaactgcaatgcgagcctcgacactggctgggtagcggggctcttc

SEQ ID NO: 116405 - DNA, 75 bp, Artificial Sequence
  Synthetic
tcaatccttcggttgcggccacactgggttttggggtatacatgtccaaggcatatggcatcgacccgaacatcc

SEQ ID NO: 116406 - DNA, 75 bp, Artificial Sequence
  Synthetic
cactggctgggtagcggggctcttctattaccacaaattcaactcttcaggctgccccgagaggatggccagctg

SEQ ID NO: 116407 - DNA, 75 bp, Artificial Sequence
  Synthetic
tggctgggcaacattatcatgtatgcccccacgttgtgggtgaggatggtcctgatgacccattttttctccgtc

SEQ ID NO: 116408 - DNA, 75 bp, Artificial Sequence
  Synthetic
actgactccacaacgatccttggcataggcacagtcctggaccaagcggagaccgctggagtgcgcctcaccgtg

SEQ ID NO: 116409 - DNA, 75 bp, Artificial Sequence
  Synthetic
gttgtgtacgaggtggagggagccatcctgcatctgcccgggtgtgtcccttgcgtccgcgagggtaacacctcc

SEQ ID NO: 116410 - DNA, 75 bp, Artificial Sequence
  Synthetic
gtgacctggacccccaagcccgtgtggccatcaagtccctcactgagaggctttatgtcgggggccctcttacca

SEQ ID NO: 116411 - DNA, 75 bp, Artificial Sequence
  Synthetic
gggcagacatctcatcttctgccactcaaagaaaaagtgtgatgaactggccagacaactgacatctcttggtct

SEQ ID NO: 116412 - DNA, 75 bp, Artificial Sequence
  Synthetic
cgctctgctctgccatgtacgtgggggatgtctgcggagccgttttccttgttggccaactcttcaccttctcgc

SEQ ID NO: 116413 - DNA, 75 bp, Artificial Sequence
  Synthetic
cgctctgctctgccatgtacgtgggggatgtctgcggtgccgttttccttgttggccaactcttcaccttctcgc

SEQ ID NO: 116414 - DNA, 75 bp, Artificial Sequence
  Synthetic
cgctctgctctgccatgtacgtgggggatgtctgcggcgccgttttccttgttggccaactcttcaccttctcgc

SEQ ID NO: 116415 - DNA, 75 bp, Artificial Sequence
  Synthetic
cgctctgctctgccatgtacgtgggggatgtctgcggggccgttttccttgttggccaactcttcaccttctcgc

SEQ ID NO: 116416 - DNA, 75 bp, Artificial Sequence
  Synthetic
gaatgccgtagcctactacagaggcttagacgtttcggtgattcccacgtctggggacgtcgtggtatgcgccac

SEQ ID NO: 116417 - DNA, 75 bp, Artificial Sequence
  Synthetic
cctctttaactgggcagtaaaaaccaaaatgaaactcactccaatttcagctgctcgccggttcgacctgtctaa

SEQ ID NO: 116418 - DNA, 75 bp, Artificial Sequence
  Synthetic
aactggcgccatgatcatggcgcagctgctacggatcccacaatccatcgtggacatgatagcgggtgcccactg

SEQ ID NO: 116419 - DNA, 75 bp, Artificial Sequence
  Synthetic
aactggcgccttgatcatggcgcagctgctacggatcccacaatccatcgtggacatgatagcgggtgcccactg

SEQ ID NO: 116420 - DNA, 75 bp, Artificial Sequence
  Synthetic
aactggcgccctgatcatggcgcagctgctacggatcccacaatccatcgtggacatgatagcgggtgcccactg

SEQ ID NO: 116421 - DNA, 75 bp, Artificial Sequence
  Synthetic
aactggcgccgtgatcatggcgcagctgctacggatcccacaatccatcgtggacatgatagcgggtgcccactg

SEQ ID NO: 116422 - DNA, 75 bp, Artificial Sequence
  Synthetic
acctcagggggagcggcagcgcttcagaccagaagcttttatggcctcttcaaccctggcccaagccagaaaatc

SEQ ID NO: 116423 - DNA, 75 bp, Artificial Sequence
  Synthetic
caacgactcaggttgcccggaccgcatgagctcgtgtaagccccttacctcgtttaacaagggatggggtcctat

SEQ ID NO: 116424 - DNA, 75 bp, Artificial Sequence
  Synthetic
gggccctggttgacccccaagtgcctgatagactacccttatagactgtggcattatccgtgcactctaaatttt

SEQ ID NO: 116425 - DNA, 75 bp, Artificial Sequence
  Synthetic
aacgattcaactcatctgggtgtgtgcagagaatggctagctgtcgaccccttactgactttgatcaagggtggg

SEQ ID NO: 116426 - DNA, 75 bp, Artificial Sequence
  Synthetic
tacgattcaactcatctgggtgtgtgcagagaatggctagctgtcgaccccttactgactttgatcaagggtggg

SEQ ID NO: 116427 - DNA, 75 bp, Artificial Sequence
  Synthetic
cacgattcaactcatctgggtgtgtgcagagaatggctagctgtcgaccccttactgactttgatcaagggtggg

SEQ ID NO: 116428 - DNA, 75 bp, Artificial Sequence
  Synthetic
gacgattcaactcatctgggtgtgtgcagagaatggctagctgtcgaccccttactgactttgatcaagggtggg

SEQ ID NO: 116429 - DNA, 75 bp, Artificial Sequence
  Synthetic
tggaccagtatactgtttcactcctagccccgtggtagtagggacgaccgatcagctcggtgcgcccacatacac

SEQ ID NO: 116430 - DNA, 75 bp, Artificial Sequence
  Synthetic
tggaccagtatactgtttcactcctagccccgtggttgtagggacgaccgatcagctcggtgcgcccacatacac

SEQ ID NO: 116431 - DNA, 75 bp, Artificial Sequence
  Synthetic
tggaccagtatactgtttcactcctagccccgtggtcgtagggacgaccgatcagctcggtgcgcccacatacac

SEQ ID NO: 116432 - DNA, 75 bp, Artificial Sequence
  Synthetic
tggaccagtatactgtttcactcctagccccgtggtggtagggacgaccgatcagctcggtgcgcccacatacac

SEQ ID NO: 116433 - DNA, 75 bp, Artificial Sequence
  Synthetic
tccccatcaatgcctacaccacgggcccctgtaccccccttcctgcgccgaactatacgttcgcgctgtggaggg

SEQ ID NO: 116434 - DNA, 75 bp, Artificial Sequence
  Synthetic
aagacatgcgggggccctccgtgcaacatcggcgggagcggcaaccgttccctaatctgccccacggactgtttc

SEQ ID NO: 116435 - DNA, 75 bp, Artificial Sequence
  Synthetic
gtgcggatccggtccgtggcttacgcctaggtgtctggttgattacccctataggctgtggcactacccatgcac

SEQ ID NO: 116436 - DNA, 75 bp, Artificial Sequence
  Synthetic
gcactatcaattacaccttgtttaaagtcaggatgttcgtgggtggcattgagcacaggctcacagccgcatgca

SEQ ID NO: 116437 - DNA, 75 bp, Artificial Sequence
  Synthetic
aacaaaccctcctttttaacatcttggggggatgggtggcctcgcagattgcgactccgacggcttctaccgcat

SEQ ID NO: 116438 - DNA, 75 bp, Artificial Sequence
  Synthetic
cttcaccacattgccagcactgtccaccggcctgatccacctccaccaaaacatagtggacgtgcagtatctgta

SEQ ID NO: 116439 - DNA, 75 bp, Artificial Sequence
  Synthetic
ggcagttggcagtgtgggccttggcaaaattttggtggacattctcgccggttacggcgccggcgtagctggcgc

SEQ ID NO: 116440 - DNA, 75 bp, Artificial Sequence
  Synthetic
tacctccttaaagcgtctctgctacgggtaccatacttcgtgagggctcacgctctgctacgagtgtgcaccctg

SEQ ID NO: 116441 - DNA, 75 bp, Artificial Sequence
  Synthetic
atgatactactcatatcccaggcagaggcggcattggagaacttggtggtcctcaacgcggcatcgctggccgga

SEQ ID NO: 116442 - DNA, 75 bp, Artificial Sequence
  Synthetic
atcgcccggagcattggtagtgggggtggtatgcgcggcgattttgcgccgccacgtgggcccgggcgaaggggc

SEQ ID NO: 116443 - DNA, 75 bp, Artificial Sequence
  Synthetic
aggcaggtggaccggcacttacatctatgaccacctctcccctttatcaacttgggcagcccagggtttgcggga

SEQ ID NO: 116444 - DNA, 75 bp, Artificial Sequence
  Synthetic
gcgttcgcatcgcgaggcaatcacgtgtctcccacgcattacgtccctgagtccgacgcggcagcccgcgtgacc

SEQ ID NO: 116445 - DNA, 75 bp, Artificial Sequence
  Synthetic
ctctcctcctgctcctgttggcattgccccccagggcgtatgctttggataaggaggtcgcagcgtcgtgtgggg

SEQ ID NO: 116446 - DNA, 75 bp, Artificial Sequence
  Synthetic
accatactatcatccctcactgtgacatcccttctcagacgcctccacaagtggatcaatgaagattgctccacc

SEQ ID NO: 116447 - DNA, 75 bp, Artificial Sequence
  Synthetic
tagtcttgaagggcaggggtggcgactccttgcgcccatcacggcctacgcccaacagacgcggggcctacttgg

SEQ ID NO: 116448 - DNA, 75 bp, Artificial Sequence
  Synthetic
agaagcaatcctacaagtgtgggtgcctcccctcaaccctcggggggggcgtgatggcgtcatattacttatgtg

SEQ ID NO: 116449 - DNA, 75 bp, Artificial Sequence
  Synthetic
gagaagaaactgatcacctggggggccgacaccgccgcttgtggtgacattatagctggcctgccagtctctgcc

SEQ ID NO: 116450 - DNA, 75 bp, Artificial Sequence
  Synthetic
tcacatcaagaacggctcgatgagaatcaccgggccgaaaacctgcagcaacacatggcatggtaccttccccat

SEQ ID NO: 116451 - DNA, 75 bp, Artificial Sequence
  Synthetic
ttcgtgcgtgcccatgccctcctaaggatctgcatgttggcgcgcaagatagtgggcggccagtacgtccagatg

SEQ ID NO: 116452 - DNA, 75 bp, Artificial Sequence
  Synthetic
cgtctgtcagatgtacaccaatgtagaccaggacatggtagggtggcccgctcccccgggttctaggtcgttgac

SEQ ID NO: 116453 - DNA, 75 bp, Artificial Sequence
  Synthetic
gtgggtgatttccattatgtcaccggggtaacacaagacaacatcaagtgcccctgccaagttccggccccagag

SEQ ID NO: 116454 - DNA, 75 bp, Artificial Sequence
  Synthetic
ctgtggaaccggttgtcttctcccagatggagactaaagtcatcgtctggggggcggataccgctgcatgtgggg

SEQ ID NO: 116455 - DNA, 75 bp, Artificial Sequence
  Synthetic
acatttgcaagtgtggatcccccctctcaacgtccgggggggccgcgatgccatcatcctcctcacgtgcgcggt

SEQ ID NO: 116456 - DNA, 75 bp, Artificial Sequence
  Synthetic
cattacggcgtacgctcagcaaacgcgaggccttctagggtgcattatcaccagcctcactggccgggataagaa

SEQ ID NO: 116457 - DNA, 75 bp, Artificial Sequence
  Synthetic
aatcaagggggggagacatctcatcttctgccactcaaagaagaagtgcgacgagctcgccgcaaaactggtcgc

SEQ ID NO: 116458 - DNA, 75 bp, Artificial Sequence
  Synthetic
tcaaagacccttgccggcccgacgggccccattatccagatgtacaccaatgtggaccaagacctagtgggctgg

SEQ ID NO: 116459 - DNA, 75 bp, Artificial Sequence
  Synthetic
ctaacctcttgtgggggtctaccgctaccagggttgagacggacgagaaggtaataatactagactcttttgagt

SEQ ID NO: 116460 - DNA, 75 bp, Artificial Sequence
  Synthetic
ctttgactccacagtcactgagagcgatatccgtacggaggaggcaatctaccagtgttgtgacctggaccccca

SEQ ID NO: 116461 - DNA, 75 bp, Artificial Sequence
  Synthetic
tggaccaagcggagacggctggagcgcgacttgtcgtgctcgccaccgctacgcctccgggatcggtcaccgtgc

SEQ ID NO: 116462 - DNA, 75 bp, Artificial Sequence
  Synthetic
gtggggacacccgagggagcctactctcccctcggcccatttcatatctgaaagggtcttcgggcggtccgctgc

SEQ ID NO: 116463 - DNA, 75 bp, Artificial Sequence
  Synthetic
atcagctggtgcttgtggtggcttcagtattttctgaccagagcagaagcgcaactgcacgtgtgggttcccccc

SEQ ID NO: 116464 - DNA, 75 bp, Artificial Sequence
  Synthetic
gttcctcctcccaggaggaaacggacggtacagctcactgagtccgttgtttctaccgctttggcagagctggcc

SEQ ID NO: 116465 - DNA, 75 bp, Artificial Sequence
  Synthetic
caccatgaggtccccggtctttactgacaattccacccctcctgctgtgccccaaacctaccaggtagcccatct

SEQ ID NO: 116466 - DNA, 75 bp, Artificial Sequence
  Synthetic
atccgacgctgagtcgtactcctccatgcccccccttgagggggagccgggggatcccgatctcagcgacgggtc

SEQ ID NO: 116467 - DNA, 75 bp, Artificial Sequence
  Synthetic
agcaccaaggtgccggctgcctatgcggaccaagggtataaagtactagtactaaacccttcggttgccgccact

SEQ ID NO: 116468 - DNA, 75 bp, Artificial Sequence
  Synthetic
cctacggcaagttccttgccgatggtggatgttcggggggcgcgtatgacatcataatatgtgatgagtgtcatt

SEQ ID NO: 116469 - DNA, 75 bp, Artificial Sequence
  Synthetic
gataaaggcacgagcatccagagtgaaggcacgcttgcttaccacagaggaagcttgcgacctgacgccccccca

SEQ ID NO: 116470 - DNA, 75 bp, Artificial Sequence
  Synthetic
ctccgtcacggtgccgcatccaaacatcgaggaggttgccttgccttctacaggagaaattcccttttatggcaa

SEQ ID NO: 116471 - DNA, 75 bp, Artificial Sequence
  Synthetic
actcaaagaagaagtgtgacgagcttgccgcgaagctgagcaacctgggcgttaacgctgtggcttactaccggg

SEQ ID NO: 116472 - DNA, 75 bp, Artificial Sequence
  Synthetic
actctaagaagaagtgtgacgagcttgccgcgaagctgagcaacctgggcgttaacgctgtggcttactaccggg

SEQ ID NO: 116473 - DNA, 75 bp, Artificial Sequence
  Synthetic
actccaagaagaagtgtgacgagcttgccgcgaagctgagcaacctgggcgttaacgctgtggcttactaccggg

SEQ ID NO: 116474 - DNA, 75 bp, Artificial Sequence
  Synthetic
actcgaagaagaagtgtgacgagcttgccgcgaagctgagcaacctgggcgttaacgctgtggcttactaccggg

SEQ ID NO: 116475 - DNA, 75 bp, Artificial Sequence
  Synthetic
ccacggggccggaacaaggaccatcgcgtcatccaagggtcctgttatccagatgtataccaatgtagaccaaga

SEQ ID NO: 116476 - DNA, 75 bp, Artificial Sequence
  Synthetic
aaccaaatacatcatggcatgcatgtcggctgacctggaggtcgtcactagcacctgggtgctggtaggcggagt

SEQ ID NO: 116477 - DNA, 75 bp, Artificial Sequence
  Synthetic
ctgcaacacatgcgtcacccagacggttgacttcagccttgaccctaccttcactattgagacaaccacgctccc

SEQ ID NO: 116478 - DNA, 75 bp, Artificial Sequence
  Synthetic
tgggagccgcttatggcttccaatactccccagcgcagcgggtggaatttcttctgactgcttggaagtcgaaga

SEQ ID NO: 116479 - DNA, 75 bp, Artificial Sequence
  Synthetic
cctacgagtcttcacggaggctatgactaggtactctgccccccccggggacccgccccaaccagaatacgactt

SEQ ID NO: 116480 - DNA, 75 bp, Artificial Sequence
  Synthetic
tacccgctgctttgactccactgtaaccgaaaaggacatcagggtcgaggaagaggtctatcagtgttgtgacct

SEQ ID NO: 116481 - DNA, 75 bp, Artificial Sequence
  Synthetic
tttgactcctcggttctgtgcgagtgctatgacgcaggatgcgcatggtacgagctcacccccgccgagaccaca

SEQ ID NO: 116482 - DNA, 75 bp, Artificial Sequence
  Synthetic
tgtcgcgcaagcggcgtctacaccaccagcttcgggaacacgctgacgtgctatctcaaagccacggccgccatc

SEQ ID NO: 116483 - DNA, 75 bp, Artificial Sequence
  Synthetic
ctcattttctgtctcagacaaaacaggccggggaaaatttcccctacctggtagcataccaggctactgtgtgtg

SEQ ID NO: 116484 - DNA, 75 bp, Artificial Sequence
  Synthetic
tgagtgacttcaagacatggctcaaagcaaaaatagcaccatctctcccgggtatccccttcctctcatgccaac

SEQ ID NO: 116485 - DNA, 75 bp, Artificial Sequence
  Synthetic
gggtggtgtccaaaatgaggtcaccctgacgcacccagtgacaaaatacatcatggcttgcatgtcagcggactt

SEQ ID NO: 116486 - DNA, 75 bp, Artificial Sequence
  Synthetic
tgacgagttcgctcaggggtggggtcccatcactcatgttgtgcctaacatctcggaccagaggccctattgctg

SEQ ID NO: 116487 - DNA, 75 bp, Artificial Sequence
  Synthetic
ctgtggttttgcgcgcaacgtagcatatggcaaatacatccaactcgccttgctcaagattggagcgtggaccgg

SEQ ID NO: 116488 - DNA, 75 bp, Artificial Sequence
  Synthetic
tcagctcccttgtgagccagagcctgacgtgaccgtagtcacctcaatgctcacagaccccacgcacatcaccgc

SEQ ID NO: 116489 - DNA, 75 bp, Artificial Sequence
  Synthetic
acattgtccggcaagccagcagtcatacctgacagacaagtcctctaccaagagttcgatgaaatggaggagtgt

SEQ ID NO: 116490 - DNA, 75 bp, Artificial Sequence
  Synthetic
tcatcgtccctgctgtcccgacctactggcagaaggtcgaggctttctgggcaaagcacatgtggaacttcatca

SEQ ID NO: 116491 - DNA, 75 bp, Artificial Sequence
  Synthetic
gcccgagcagtccgcgctaagcttatcgcccagggaggtagagccaaaatatgtggcatatacctctttaactgg

SEQ ID NO: 116492 - DNA, 75 bp, Artificial Sequence
  Synthetic
ccaacagaccctcctatttaatatcttgggagggtgggtggccagtcagcttgctgccccgggcgccgccacgac

SEQ ID NO: 116493 - DNA, 75 bp, Artificial Sequence
  Synthetic
gccctcgtagctttcaagatcatgagcggcgaggtccctagtactgaagacatgctcaacctgttgcccgccatt

SEQ ID NO: 116494 - DNA, 75 bp, Artificial Sequence
  Synthetic
acactccgaccttagggtccccttgttttttttttttttttttttttttttttttttttttttttttttttcctt

SEQ ID NO: 116495 - DNA, 75 bp, Artificial Sequence
  Synthetic
tcatagaggccaacctcctgtggaggcaggagatgggcggtaacatcaccagggttgagtcagagaacaaagtgg

SEQ ID NO: 116496 - DNA, 75 bp, Artificial Sequence
  Synthetic
tagcgtttgcctcccggggcaaccacgtgtcgcccacgcactatgtgcccgagagcgacgcagcggcccgcgtca

SEQ ID NO: 116497 - DNA, 75 bp, Artificial Sequence
  Synthetic
acctttgaccgtgtccagatcctggaccagcactattctgatgttctcaaggaggtaaaagctcgagcctcccag

SEQ ID NO: 116498 - DNA, 75 bp, Artificial Sequence
  Synthetic
ggatatttgggactgggtatgtacggtgctgagcgactttaagacctggttgaaaacaaaaatcatgccccaaat

SEQ ID NO: 116499 - DNA, 75 bp, Artificial Sequence
  Synthetic
ggatatttgggactgggtatgtacggtgctgagcgactttaagacctggttgaaatcaaaaatcatgccccaaat

SEQ ID NO: 116500 - DNA, 75 bp, Artificial Sequence
  Synthetic
ggatatttgggactgggtatgtacggtgctgagcgactttaagacctggttgaaaccaaaaatcatgccccaaat

SEQ ID NO: 116501 - DNA, 75 bp, Artificial Sequence
  Synthetic
ggatatttgggactgggtatgtacggtgctgagcgactttaagacctggttgaaagcaaaaatcatgccccaaat

SEQ ID NO: 116502 - DNA, 75 bp, Artificial Sequence
  Synthetic
ggacatgtgaaaaacgggtcgatgaggattgttggccctaaaacgtgcagcaacatctggcacgggacattcccc

SEQ ID NO: 116503 - DNA, 75 bp, Artificial Sequence
  Synthetic
gtgtgggggatttccattacatcacgggcatgacctctgataacatcaagtgcccatgtcaagtcccatcgcccg

SEQ ID NO: 116504 - DNA, 75 bp, Artificial Sequence
  Synthetic
atacttggtgggctcccagctaccatgcgaacctgaaccagacgtggcggtgctaacatcaatgctcaccgaccc

SEQ ID NO: 116505 - DNA, 75 bp, Artificial Sequence
  Synthetic
aaagcgacttgcaccacccatcatgagtccccagacgccgacctcatagaagctaatctcttgtggaggcaggag

SEQ ID NO: 116506 - DNA, 75 bp, Artificial Sequence
  Synthetic
cgccggcggagatcctacggaagagaagagacttccctagggccctgcctgtgtgggcatccccggactacaatc

SEQ ID NO: 116507 - DNA, 75 bp, Artificial Sequence
  Synthetic
atccggaagccacgtactctcggtgcggctccggtccctggattacacccaggtgcctggtcgactacccgtata

SEQ ID NO: 116508 - DNA, 75 bp, Artificial Sequence
  Synthetic
gaggaagagggcgatagtgttgactgagtccacagtggctgcagcactggctgaacttgctaccaagaccttcgg

SEQ ID NO: 116509 - DNA, 75 bp, Artificial Sequence
  Synthetic
gaggaagagggcgatagtgttgactgagtccacagtggctgcagcactggctgatcttgctaccaagaccttcgg

SEQ ID NO: 116510 - DNA, 75 bp, Artificial Sequence
  Synthetic
gaggaagagggcgatagtgttgactgagtccacagtggctgcagcactggctgaccttgctaccaagaccttcgg

SEQ ID NO: 116511 - DNA, 75 bp, Artificial Sequence
  Synthetic
gaggaagagggcgatagtgttgactgagtccacagtggctgcagcactggctgagcttgctaccaagaccttcgg

SEQ ID NO: 116512 - DNA, 75 bp, Artificial Sequence
  Synthetic
tccatgccccccctcgagggggagccgggggatcctgatctcagtgacgggtcctggtctactgttagcggggaa

SEQ ID NO: 116513 - DNA, 75 bp, Artificial Sequence
  Synthetic
cgctgagcaactctttgttgcgtcaccataacctggtgtattccaccacttctcgcagcgcaagccagaggcaaa

SEQ ID NO: 116514 - DNA, 75 bp, Artificial Sequence
  Synthetic
gtgctcaaggaggctaaggctaaggcatccacagtgaaggccgacctgctgtccgtagaggaagcgtgcgacctg

SEQ ID NO: 116515 - DNA, 75 bp, Artificial Sequence
  Synthetic
accttctggaggacaatgaaacaccaatagacaccaccattatggcgaagaatgaagtcttctgtgtgaagcctg

SEQ ID NO: 116516 - DNA, 75 bp, Artificial Sequence
  Synthetic
catcgccgtaatgggagactcctacggattccagtactcaccgtcgcagcgggtcgacttcctagtaaaagcatg

SEQ ID NO: 116517 - DNA, 75 bp, Artificial Sequence
  Synthetic
cccggccctgcccatttgggcacggccggactacaaccccccgttattggagacgtggaaaaagccggactacga

SEQ ID NO: 116518 - DNA, 75 bp, Artificial Sequence
  Synthetic
tgttgtgacttggcccccgaggcacgtgttgccataaagtctctcaccgagaggctttacgtagggggccccctg

SEQ ID NO: 116519 - DNA, 75 bp, Artificial Sequence
  Synthetic
tgtcctgacgaccagctgcggtaataccctcacctgctatctcaaggcaactgcagcttgtagagctgcgaagct

SEQ ID NO: 116520 - DNA, 75 bp, Artificial Sequence
  Synthetic
gactggggtaaggaccatcaccacaggcgcccccattacatactccacctacggcaagttccttgccgacggtgg

SEQ ID NO: 116521 - DNA, 75 bp, Artificial Sequence
  Synthetic
gctaggcaacatcattatgtttgcccccacattgtgggttcggatgatcctgatgactcatttcttctccatcct

SEQ ID NO: 116522 - DNA, 75 bp, Artificial Sequence
  Synthetic
cttgccgcgctgttctacacacacaagttcaacgcgtccggatgcccagagcgcatggccagctgccgccccatc

SEQ ID NO: 116523 - DNA, 75 bp, Artificial Sequence
  Synthetic
cgctaggctaatctcccagggggggggggctgccatatgtggcaagtacctcttcaactgggcggtgaaaaccaa

SEQ ID NO: 116524 - DNA, 75 bp, Artificial Sequence
  Synthetic
ctccgtcacacaatctttcttggggacatccatttcggggatcctctggacagtatatcatggggctggtaataa

SEQ ID NO: 116525 - DNA, 75 bp, Artificial Sequence
  Synthetic
ggggtgaggacaattaccactggcagccccattacgtactccacctacggcaagtttcttgccgacggcgggtgc

SEQ ID NO: 116526 - DNA, 75 bp, Artificial Sequence
  Synthetic
cccccccgggactaagtcattagacccatgcacctgcggggcagtggatctctacctggtcacccgaaacgcaga

SEQ ID NO: 116527 - DNA, 75 bp, Artificial Sequence
  Synthetic
ggtcaacaccaacggcagctggcacatcaataggacggccttgaactgcaatgatagcctttccaccggctggat

SEQ ID NO: 116528 - DNA, 75 bp, Artificial Sequence
  Synthetic
acttcttgtcccagactaaacaggcaggagacaacttcccctacctggtagcataccaggccacagtgtgcgcca

SEQ ID NO: 116529 - DNA, 75 bp, Artificial Sequence
  Synthetic
cggcagttggcacatcaacaggacggccttgaactgcaatgatagccttaacaccggctggatagcagggctttt

SEQ ID NO: 116530 - DNA, 75 bp, Artificial Sequence
  Synthetic
tagatctggcctttaccacctgaccaatgactgccctaacagcagcatcgtatatgaggcgccagctgttattat

SEQ ID NO: 116531 - DNA, 75 bp, Artificial Sequence
  Synthetic
cgcaggtgtcaggctagtggttttagccacagccacgcctcccggcacggtgacaactccccacagtaacataga

SEQ ID NO: 116532 - DNA, 75 bp, Artificial Sequence
  Synthetic
ccgtgcggtattgtacccgcgtcggaggtgtgtggtccagtgtattgcttcaccccaagccctgttgtggtgggg

SEQ ID NO: 116533 - DNA, 75 bp, Artificial Sequence
  Synthetic
gccacagccacgcctcccggcacggtgacaactccccacagtaacatagaggaggtggccctcggtcatgagggc

SEQ ID NO: 116534 - DNA, 75 bp, Artificial Sequence
  Synthetic
aattgttccatctacacgggccgtattactggccatcgcatggcgtgggacatgatgatgaactggtccccgacc

SEQ ID NO: 116535 - DNA, 75 bp, Artificial Sequence
  Synthetic
gagacttggtggttgtcgccaccgacgccctaatgactggatacaccggtgactttgactctgttatcgactgca

SEQ ID NO: 116536 - DNA, 75 bp, Artificial Sequence
  Synthetic
atggtggggaactgggcaaaggtcctggtagtgctgttgctattcgccggcgtcgacgcagatacctataccacc

SEQ ID NO: 116537 - DNA, 75 bp, Artificial Sequence
  Synthetic
gcatggtagctaactgggccaaggttatcggtatccttctcctgttcgcaggggtggaggcggagacctatgtca

SEQ ID NO: 116538 - DNA, 75 bp, Artificial Sequence
  Synthetic
cactggtttttccggcctatttagctcaggatcccaacagaaactacagcttgtgaacaccaacggcagctggca

SEQ ID NO: 116539 - DNA, 75 bp, Artificial Sequence
  Synthetic
ttgagcccgtcatcttctctgacatggagaccaagatcatcacctggggggcagacactgcggcgtgtggggaca

SEQ ID NO: 116540 - DNA, 75 bp, Artificial Sequence
  Synthetic
tgtctcctttgcaatcaaatgggagtatgtcgtgttgctcttccttctcctggcagacgcgcgcgtctgtgcctg

SEQ ID NO: 116541 - DNA, 75 bp, Artificial Sequence
  Synthetic
aggtctcacgcatattgatgcccacttcctttcccagacgaagcaagcaggggacaactttgcatatctaacggc

SEQ ID NO: 116542 - DNA, 75 bp, Artificial Sequence
  Synthetic
ggaccagccgatggtcttgaagggcaggggtggcgactcctcgcgcctatcacggcctactcccagcagacgcgg

SEQ ID NO: 116543 - DNA, 75 bp, Artificial Sequence
  Synthetic
ggcactacccgccaagaccgtgcggggtggtgccggcctcacaagtgtgcggccctgtctactgctttacaccga

SEQ ID NO: 116544 - DNA, 75 bp, Artificial Sequence
  Synthetic
atcaacaccaacggcagttggcacatcaatagcacagccttgaactgcaatactagcattgagaccggctggttg

SEQ ID NO: 116545 - DNA, 75 bp, Artificial Sequence
  Synthetic
ccttggctgactccgcgatgcgtagtcgactatccctacaggctgtggcattatccttgcactcagaactacact

SEQ ID NO: 116546 - DNA, 75 bp, Artificial Sequence
  Synthetic
gggttgagatgagcccgctcctcttctccacaactgagctagcgattctcccctgttcattcacgacgatgccag

SEQ ID NO: 116547 - DNA, 75 bp, Artificial Sequence
  Synthetic
atcaatgatggctttcagcgccgcattgactagcccactacccaccagcaccaccatcctcttgaacatcatggg

SEQ ID NO: 116548 - DNA, 75 bp, Artificial Sequence
  Synthetic
ccgctcactgacaccctgcacctgcggctcctcggacctttacctggtcacgaggcacgccgatgtcattcccgt

SEQ ID NO: 116549 - DNA, 75 bp, Artificial Sequence
  Synthetic
ccgctacaacctatgggctcttagggctatggccactcctgctgcttgtgctggcgttgccccaacgggcgttcg

SEQ ID NO: 116550 - DNA, 75 bp, Artificial Sequence
  Synthetic
ccgctactacctatgggctcttagggctatggccactcctgctgcttgtgctggcgttgccccaacgggcgttcg

SEQ ID NO: 116551 - DNA, 75 bp, Artificial Sequence
  Synthetic
ccgctaccacctatgggctcttagggctatggccactcctgctgcttgtgctggcgttgccccaacgggcgttcg

SEQ ID NO: 116552 - DNA, 75 bp, Artificial Sequence
  Synthetic
ccgctacgacctatgggctcttagggctatggccactcctgctgcttgtgctggcgttgccccaacgggcgttcg

SEQ ID NO: 116553 - DNA, 75 bp, Artificial Sequence
  Synthetic
catccccatcgagaccatcaagggggggaggcatctcattttctgccattccaagaagaaatgtgacgagctcgc

SEQ ID NO: 116554 - DNA, 75 bp, Artificial Sequence
  Synthetic
cggcctcatccacctccaccagaacattgtggacgtgcagtacttgtacggggtggggtcaagcattgcgtcctg

SEQ ID NO: 116555 - DNA, 75 bp, Artificial Sequence
  Synthetic
gggatacaatacttggcgggcctgtcaacgttgcctggcaaccccgccattgcttcattgatggcttttacagct

SEQ ID NO: 116556 - DNA, 75 bp, Artificial Sequence
  Synthetic
tgctcggggtcttggctccaggacatttgggattgggtttgttccattctcacagactttaagaactggctgtct

SEQ ID NO: 116557 - DNA, 75 bp, Artificial Sequence
  Synthetic
atcaagttaggggcgcttactggcacctatgtctataaccatctcactcctcttcgggactgggcgcacaacggc

SEQ ID NO: 116558 - DNA, 75 bp, Artificial Sequence
  Synthetic
cttctgcaggccagcctattgcatgtgccgtactacgtgcgagcccacctcttgttgcgggcttgcttgctggtg

SEQ ID NO: 116559 - DNA, 75 bp, Artificial Sequence
  Synthetic
cttctgcaggccagccttttgcatgtgccgtactacgtgcgagcccacctcttgttgcgggcttgcttgctggtg

SEQ ID NO: 116560 - DNA, 75 bp, Artificial Sequence
  Synthetic
cttctgcaggccagcctcttgcatgtgccgtactacgtgcgagcccacctcttgttgcgggcttgcttgctggtg

SEQ ID NO: 116561 - DNA, 75 bp, Artificial Sequence
  Synthetic
cttctgcaggccagcctgttgcatgtgccgtactacgtgcgagcccacctcttgttgcgggcttgcttgctggtg

SEQ ID NO: 116562 - DNA, 75 bp, Artificial Sequence
  Synthetic
gtgcacccggggggtcgcgaaggcggtggactttgtgcccgttgagtctatggaaactactatgcggtctccggt

SEQ ID NO: 116563 - DNA, 75 bp, Artificial Sequence
  Synthetic
cttgttgcgggcttgcttgctggtgcggcggttttgtgctggcaagtatgtgcaggctgccctgttacgagttgg

SEQ ID NO: 116564 - DNA, 75 bp, Artificial Sequence
  Synthetic
aagcgcaactgcacgtgtgggttccccccctcaacgtccgaggggggcgcgatgccatcatcttactcacgtgtg

SEQ ID NO: 116565 - DNA, 75 bp, Artificial Sequence
  Synthetic
agtattttctgaccagagtagaagcgcaactgcacgagtgggttccccccctcaatgtccgaggggggcgtgatg

SEQ ID NO: 116566 - DNA, 75 bp, Artificial Sequence
  Synthetic
taactagtgacaaccttaaggtcccttgccaggtaccagctccagaattcttctcttgggtggacggggtgcaaa

SEQ ID NO: 116567 - DNA, 75 bp, Artificial Sequence
  Synthetic
agtgaaggctaacttgctatccgtagaggaagcttgcagcctgacgccccctcactcagccaaatccaagtttgg

SEQ ID NO: 116568 - DNA, 75 bp, Artificial Sequence
  Synthetic
cctcggactcaacgctgtagcgtattaccggggccttgacgtgtccgtcataccgaccagcggagacgtcgttgt

SEQ ID NO: 116569 - DNA, 75 bp, Artificial Sequence
  Synthetic
tcctgactcaggacaatgtggagggggtcctcagggagatggcggacaaagtgctcagccctctccaagaccaca

SEQ ID NO: 116570 - DNA, 75 bp, Artificial Sequence
  Synthetic
catgagcaaggcttatggggtagaccctaacatcaggaccggtgtcaggaccataacaacaggaggtcctattac

SEQ ID NO: 116571 - DNA, 75 bp, Artificial Sequence
  Synthetic
actcccggatcagtcacagttccccatccaaacatttcagaggtcgcactatccaccactggggaaatccccttc

SEQ ID NO: 116572 - DNA, 75 bp, Artificial Sequence
  Synthetic
actcccggatcagtcactgttccccatccaaacatttcagaggtcgcactatccaccactggggaaatccccttc

SEQ ID NO: 116573 - DNA, 75 bp, Artificial Sequence
  Synthetic
actcccggatcagtcaccgttccccatccaaacatttcagaggtcgcactatccaccactggggaaatccccttc

SEQ ID NO: 116574 - DNA, 75 bp, Artificial Sequence
  Synthetic
actcccggatcagtcacggttccccatccaaacatttcagaggtcgcactatccaccactggggaaatccccttc

SEQ ID NO: 116575 - DNA, 75 bp, Artificial Sequence
  Synthetic
tctcccggatcagtcacagttccccatccaaacatttcagaggtcgcactatccaccactggggaaatccccttc

SEQ ID NO: 116576 - DNA, 75 bp, Artificial Sequence
  Synthetic
tctcccggatcagtcactgttccccatccaaacatttcagaggtcgcactatccaccactggggaaatccccttc

SEQ ID NO: 116577 - DNA, 75 bp, Artificial Sequence
  Synthetic
tctcccggatcagtcaccgttccccatccaaacatttcagaggtcgcactatccaccactggggaaatccccttc

SEQ ID NO: 116578 - DNA, 75 bp, Artificial Sequence
  Synthetic
tctcccggatcagtcacggttccccatccaaacatttcagaggtcgcactatccaccactggggaaatccccttc

SEQ ID NO: 116579 - DNA, 75 bp, Artificial Sequence
  Synthetic
cctcccggatcagtcacagttccccatccaaacatttcagaggtcgcactatccaccactggggaaatccccttc

SEQ ID NO: 116580 - DNA, 75 bp, Artificial Sequence
  Synthetic
cctcccggatcagtcactgttccccatccaaacatttcagaggtcgcactatccaccactggggaaatccccttc

SEQ ID NO: 116581 - DNA, 75 bp, Artificial Sequence
  Synthetic
cctcccggatcagtcaccgttccccatccaaacatttcagaggtcgcactatccaccactggggaaatccccttc

SEQ ID NO: 116582 - DNA, 75 bp, Artificial Sequence
  Synthetic
cctcccggatcagtcacggttccccatccaaacatttcagaggtcgcactatccaccactggggaaatccccttc

SEQ ID NO: 116583 - DNA, 75 bp, Artificial Sequence
  Synthetic
gctcccggatcagtcacagttccccatccaaacatttcagaggtcgcactatccaccactggggaaatccccttc

SEQ ID NO: 116584 - DNA, 75 bp, Artificial Sequence
  Synthetic
gctcccggatcagtcactgttccccatccaaacatttcagaggtcgcactatccaccactggggaaatccccttc

SEQ ID NO: 116585 - DNA, 75 bp, Artificial Sequence
  Synthetic
gctcccggatcagtcaccgttccccatccaaacatttcagaggtcgcactatccaccactggggaaatccccttc

SEQ ID NO: 116586 - DNA, 75 bp, Artificial Sequence
  Synthetic
gctcccggatcagtcacggttccccatccaaacatttcagaggtcgcactatccaccactggggaaatccccttc

SEQ ID NO: 116587 - DNA, 75 bp, Artificial Sequence
  Synthetic
tcttgcaggacgttaagcgggccgcctctaaggttagtgcgaggctcctcacagtagaggaagcctgcgcgctga

SEQ ID NO: 116588 - DNA, 75 bp, Artificial Sequence
  Synthetic
tactattccatggtggggaactgggctaaggtcttgattgtgatgctactctttgccggcgttgacgggaccacc

SEQ ID NO: 116589 - DNA, 75 bp, Artificial Sequence
  Synthetic
tagtcatctgtgctaccgacgctctcatgactggctacacgggcgacttcgactctgttatagactgcaatgttg

SEQ ID NO: 116590 - DNA, 75 bp, Artificial Sequence
  Synthetic
caatgccgtggcttactaccgcggcctcgacgtgtctgtcatcccgaccagcggcgatgttgtcgtcgtggcaac

SEQ ID NO: 116591 - DNA, 75 bp, Artificial Sequence
  Synthetic
ttacaggcgttgccgcgcaagcggcgttttcactaccagcatggggaataccatgacatgctacatcaaagccct

SEQ ID NO: 116592 - DNA, 75 bp, Artificial Sequence
  Synthetic
ggggacttccactacgtgacgggtatgactactgacaatctcaaatgcccgtgccaggtcccatcgcccgaattt

SEQ ID NO: 116593 - DNA, 75 bp, Artificial Sequence
  Synthetic
ctctatcaacaatttgacgagatggagggatgctcgcaccatatcccctatcttgctgaaggtcaccaacttgct

SEQ ID NO: 116594 - DNA, 75 bp, Artificial Sequence
  Synthetic
atgcccccccttgagggggagccgggggaccccgacctcagcgacgggtcttggtctaccgtgagcgaggaggcc

SEQ ID NO: 116595 - DNA, 75 bp, Artificial Sequence
  Synthetic
catggtctatgctacaacatcccgcagcgcaagccagcggcagaagaaggtcacttttgacagactgcaagtcct

SEQ ID NO: 116596 - DNA, 75 bp, Artificial Sequence
  Synthetic
aggagacaacttcccctacctggtagcataccaagccacagtgtgcgccagggctcaggccccacctccatcgtg

SEQ ID NO: 116597 - DNA, 75 bp, Artificial Sequence
  Synthetic
ctcaaactcactccattgcccgaggcgagccgcctggatttatccgggtggttcaccgtgggcgccggcgggggc

SEQ ID NO: 116598 - DNA, 75 bp, Artificial Sequence
  Synthetic
gaggccgcaagccagctcgccttatcgtattcccagacttgggagttcgtgtgtgcgagaaaatggccctctacg

SEQ ID NO: 116599 - DNA, 75 bp, Artificial Sequence
  Synthetic
cagctggtgaacaccaacggcagttggcacatcaatcgcacggccctgaactgtaatgcgagcctcgacactggc

SEQ ID NO: 116600 - DNA, 75 bp, Artificial Sequence
  Synthetic
gccgcgatgccatcatccttctcacgtgcgcggtccacccagagctaatcttttccatcaccaagatcttgctcg

SEQ ID NO: 116601 - DNA, 75 bp, Artificial Sequence
  Synthetic
tggacaggcgcactcgtcaccccgtgcgccgcggaagaacaaaaactgcccatcaacgcactgagcaactcgttg

SEQ ID NO: 116602 - DNA, 75 bp, Artificial Sequence
  Synthetic
ggtttggcttaaggctaagcttgtgccctccctaccgggcgtccctttcttctcgtgtcagagggggtttagggg

SEQ ID NO: 116603 - DNA, 75 bp, Artificial Sequence
  Synthetic
tggctcctgtccccccgcggctcccggccacactggggccccaacgacccccggcgtcgatcccggaatttgggt

SEQ ID NO: 116604 - DNA, 75 bp, Artificial Sequence
  Synthetic
gcgagcccttgagaccttctgggcaaagcacatgtggaatttcatcagcgggatacaatacttagcaggcttgtc

SEQ ID NO: 116605 - DNA, 75 bp, Artificial Sequence
  Synthetic
aagcacatgtggaatttcatcagcgggatacaatacttagcaggcttgtccactctgcccggcaaccccgcaata

SEQ ID NO: 116606 - DNA, 75 bp, Artificial Sequence
  Synthetic
gccttggcggagcttgctacaaagaccttcggcagctccgaatcgtcggccgtcgacagcggcacggcgaccgcc

SEQ ID NO: 116607 - DNA, 75 bp, Artificial Sequence
  Synthetic
gggtgtccgcagaggactacgttgaggtcatccgggtaaaggactgccactacgtagtgggggcgactgctgaaa

SEQ ID NO: 116608 - DNA, 75 bp, Artificial Sequence
  Synthetic
gggtgtccgcagaggactacgttgaggtcatccgggtaaaggactgccactacgtagtgggggcgactgctgata

SEQ ID NO: 116609 - DNA, 75 bp, Artificial Sequence
  Synthetic
gggtgtccgcagaggactacgttgaggtcatccgggtaaaggactgccactacgtagtgggggcgactgctgaca

SEQ ID NO: 116610 - DNA, 75 bp, Artificial Sequence
  Synthetic
gggtgtccgcagaggactacgttgaggtcatccgggtaaaggactgccactacgtagtgggggcgactgctgaga

SEQ ID NO: 116611 - DNA, 75 bp, Artificial Sequence
  Synthetic
caattatgcaacagggaatcttcccggttgctctttctctatcttcctcttggcactactctcgtgcctcacaac

SEQ ID NO: 116612 - DNA, 75 bp, Artificial Sequence
  Synthetic
tcctcggccagtcagctttctgcaccatccctaaaagcaacatgcaccattcctgcggaccaccctgatgctgag

SEQ ID NO: 116613 - DNA, 75 bp, Artificial Sequence
  Synthetic
tggtggccgaaacggacgacagggaaatatcagtggccgcggaatgtcacaggccgcccaggcccaagtttccac

SEQ ID NO: 116614 - DNA, 75 bp, Artificial Sequence
  Synthetic
cactacgcgcctcaaccgtgcggtatcgtacccgcgtcgcaggtgtgtggtccagtgtactgcttcaccccaagc

SEQ ID NO: 116615 - DNA, 75 bp, Artificial Sequence
  Synthetic
ccccactgactgtttccgcaagcatccggaagccacatactctcggtgtggctccggtccctggatcacgcccag

SEQ ID NO: 116616 - DNA, 75 bp, Artificial Sequence
  Synthetic
cccccaccgtgtcggggtgtgcgctgcccccgaaggggctgccacccatacccccgcctcggcggaaaagggttg

SEQ ID NO: 116617 - DNA, 75 bp, Artificial Sequence
  Synthetic
actcatcaacaccaatggcagctggcatataaacaggactgctctgaactgcaatgattccctccagacggggtt

SEQ ID NO: 116618 - DNA, 75 bp, Artificial Sequence
  Synthetic
ctccgccacctcaactgacgagacaccaacctctgacgaaccagacgcacattctgatgctggttcgtacagctc

SEQ ID NO: 116619 - DNA, 75 bp, Artificial Sequence
  Synthetic
agcggatggctgcgtgtaagcccctcgcggacttccggcaggggtggggccaaataacctacaaagtcaacatct

SEQ ID NO: 116620 - DNA, 75 bp, Artificial Sequence
  Synthetic
caaataacctacaaagtcaacatctcgggcccctccgacgaccgtccctactgttggcattacgctcccaggcca

SEQ ID NO: 116621 - DNA, 75 bp, Artificial Sequence
  Synthetic
tgtgacgtggtgtcggcccgcacggtgtgcggccccgtttactgcttcacgcccagccctgtcgtagtaggaacc

SEQ ID NO: 116622 - DNA, 75 bp, Artificial Sequence
  Synthetic
agtggcagatactgccctgttccttcaccaccctgccggctctgtccactggcttgatccatctccatcagaaca

SEQ ID NO: 116623 - DNA, 75 bp, Artificial Sequence
  Synthetic
cgggggcccttataacaccgtgtgctgctgaggaagagaagttgcccatcagtccactaagcaactctctcatta

SEQ ID NO: 116624 - DNA, 75 bp, Artificial Sequence
  Synthetic
ctcatatcccaagcggaggcagccttggagaaccttgtgttactcaatgcggcgtctctggccgggacgcacggc

SEQ ID NO: 116625 - DNA, 75 bp, Artificial Sequence
  Synthetic
caaagccatccccattgagaccatcaagggggggaggcacctcatcttctgccattccaagaagaaatgtgacga

SEQ ID NO: 116626 - DNA, 75 bp, Artificial Sequence
  Synthetic
tccaactcaagcattgtgtatgaggcggcggacatgatcatgcatgcccccgggtgcgtgccttgcgttcgggag

SEQ ID NO: 116627 - DNA, 75 bp, Artificial Sequence
  Synthetic
ttcctcgctaggctcatatggtggttgcaatattttatcaccagagccgaggcgcacttgcaagtgtggatcccc

SEQ ID NO: 116628 - DNA, 75 bp, Artificial Sequence
  Synthetic
gtgtcaactgctgcccagaccttcctggcaacctgcattaacggggtgtgctggactgtctaccacggggccgga

SEQ ID NO: 116629 - DNA, 75 bp, Artificial Sequence
  Synthetic
cgtgatgggctcctcatacggattccaatactctcctggacagcgggtcgagttcctggtgaatgcctggaaatc

SEQ ID NO: 116630 - DNA, 75 bp, Artificial Sequence
  Synthetic
ggtcgagggggaggttcaagtggtctccaccgcaacacaatctttcctggcgacctgcgtcaacggcgtgtgttg

SEQ ID NO: 116631 - DNA, 75 bp, Artificial Sequence
  Synthetic
cagcttataaacaccaacggcagctggcatatcaacaggactgccctgaactgcaacgactccctcaacactggg

SEQ ID NO: 116632 - DNA, 75 bp, Artificial Sequence
  Synthetic
ggcgggctatggagcaggggtggcaggcgcactcgtggcctttaaggtcatgagcggcgagatgccctccaccga

SEQ ID NO: 116633 - DNA, 75 bp, Artificial Sequence
  Synthetic
tccatggcggggaactgggctaaggtcttaattgtgatgctactttttgccggcgttgacggggatacctatgtg

SEQ ID NO: 116634 - DNA, 75 bp, Artificial Sequence
  Synthetic
cttggaccagaggccttattgctggcactacgcacctcaaccgtgtggtatcgtacccgcgtcgcaggtgtgcgg

SEQ ID NO: 116635 - DNA, 75 bp, Artificial Sequence
  Synthetic
tggggtcccatcacctacgctgagcctggcagcttggaccagaggccctactgctggcactacgcgcctcaaccg

SEQ ID NO: 116636 - DNA, 75 bp, Artificial Sequence
  Synthetic
caacgactgttccaatagcagtatcgtgtacgaggctgacgatgtgatcctacacatgcccggctgcgtgccttg

SEQ ID NO: 116637 - DNA, 75 bp, Artificial Sequence
  Synthetic
caacgactgttccaatagcagtatcgtgtacgaggctgacgatgtgatccttcacatgcccggctgcgtgccttg

SEQ ID NO: 116638 - DNA, 75 bp, Artificial Sequence
  Synthetic
caacgactgttccaatagcagtatcgtgtacgaggctgacgatgtgatcctccacatgcccggctgcgtgccttg

SEQ ID NO: 116639 - DNA, 75 bp, Artificial Sequence
  Synthetic
caacgactgttccaatagcagtatcgtgtacgaggctgacgatgtgatcctgcacatgcccggctgcgtgccttg

SEQ ID NO: 116640 - DNA, 75 bp, Artificial Sequence
  Synthetic
gacatcaccaaactcttgctcgccatactcggcccgctcatggtgctccaggctggcataaccagagtgccgtac

SEQ ID NO: 116641 - DNA, 75 bp, Artificial Sequence
  Synthetic
tcatcatagtcctgatcatgttttcaggggtggatgcagacacatacaccacagttggccacgccgccaaggtaa

SEQ ID NO: 116642 - DNA, 75 bp, Artificial Sequence
  Synthetic
agccccgtggtggtggggacgaccgacaagtcgggcgcgcctacctacaactggggtgaaaatgatacggacgtc

SEQ ID NO: 116643 - DNA, 75 bp, Artificial Sequence
  Synthetic
taatgacaccctaaacaccgggttcattgctgggctgctgtactatcacaagatcaacgcctcagggtgtccgga

SEQ ID NO: 116644 - DNA, 75 bp, Artificial Sequence
  Synthetic
ctgaccagccctccgacgacggcgacgcagggtccgacgttgagtcgtactcctccatgcccccccttgaggggg

SEQ ID NO: 116645 - DNA, 75 bp, Artificial Sequence
  Synthetic
tggcactacccacccagaccctgcgatgttgtcccagcgaggaacatctgcggacctgtctactgttttacaccc

SEQ ID NO: 116646 - DNA, 75 bp, Artificial Sequence
  Synthetic
ccaaggggcgctggttcgggtgtgtgtggatgaattccacagggttcgtgaaaacgtgtggggcccccccttgta

SEQ ID NO: 116647 - DNA, 75 bp, Artificial Sequence
  Synthetic
agctcggagtgcaccactccatgctccggttcctggctaagggacatctgggactggatatgcgaggtgctgagc

SEQ ID NO: 116648 - DNA, 75 bp, Artificial Sequence
  Synthetic
gaccgtgatcgcagtgaacaaaacccactgctccactcaaccacagagttcgctatactgccatgctccttcaca

SEQ ID NO: 116649 - DNA, 75 bp, Artificial Sequence
  Synthetic
ctcacccctcttcgggactgggcgcacaacggcctgcgagatctggccgtggctgtggaaccagtcgtcttctcc

SEQ ID NO: 116650 - DNA, 75 bp, Artificial Sequence
  Synthetic
tgaagtgggagtttgttgtccttgtgttcctcctcttggcggacgcacgtgtgtgcgtcgctctctggatgatgt

SEQ ID NO: 116651 - DNA, 75 bp, Artificial Sequence
  Synthetic
tgaagtgggagtttgttgtccttgtgttcctcctcttggcggacgctcgtgtgtgcgtcgctctctggatgatgt

SEQ ID NO: 116652 - DNA, 75 bp, Artificial Sequence
  Synthetic
tgaagtgggagtttgttgtccttgtgttcctcctcttggcggacgcccgtgtgtgcgtcgctctctggatgatgt

SEQ ID NO: 116653 - DNA, 75 bp, Artificial Sequence
  Synthetic
tgaagtgggagtttgttgtccttgtgttcctcctcttggcggacgcgcgtgtgtgcgtcgctctctggatgatgt

SEQ ID NO: 116654 - DNA, 75 bp, Artificial Sequence
  Synthetic
tatgcggtccccggtcttcacggacaattcatctcccccggccgtaccgcagacattccaagtggcccatctaca

SEQ ID NO: 116655 - DNA, 75 bp, Artificial Sequence
  Synthetic
tttcgccgcatggcatgtgcggggaaagctcgccccgctggtgacctatgggttgacgggcctttggtcgctggc

SEQ ID NO: 116656 - DNA, 75 bp, Artificial Sequence
  Synthetic
ttatcaccatggtataaacattggattgcccgcctaatctggtggaaccagtatatgataactagatgtgaatcc

SEQ ID NO: 116657 - DNA, 75 bp, Artificial Sequence
  Synthetic
ctcaacgtccgaggggggcgcgacgctgtcatcctactcatgtgtgttgtacacccggccttggtatttgacatc

SEQ ID NO: 116658 - DNA, 75 bp, Artificial Sequence
  Synthetic
ctaaaatgctgattgctgtccttggaccactatatttgatacaagctgctttggtccatactccctacttcgtac

SEQ ID NO: 116659 - DNA, 75 bp, Artificial Sequence
  Synthetic
ctggggatccggatctcagcgacgggtcatggtcgacggtcagtagtggggctgacacggaggatgtcgtgtgct

SEQ ID NO: 116660 - DNA, 75 bp, Artificial Sequence
  Synthetic
ttacctatatgaccatctctcgccgatgtccgactgggccgctagcggtctcaaagacttagcggtggccacaga

SEQ ID NO: 116661 - DNA, 75 bp, Artificial Sequence
  Synthetic
taaccaaatacatcatgacatgcatgtcggctgacctggaggtcgtcaccagcacctgggtgctggtaggcggag

SEQ ID NO: 116662 - DNA, 75 bp, Artificial Sequence
  Synthetic
cggggacgggaggtattactgggtccagctgacaattataagacaatgggctggcgtttgctatctcccatcaca

SEQ ID NO: 116663 - DNA, 75 bp, Artificial Sequence
  Synthetic
cggctactcagaccttcttaggcacaacagtcgggggggtcatgtggaccgtctaccacggcgctggttcaagga

SEQ ID NO: 116664 - DNA, 75 bp, Artificial Sequence
  Synthetic
ctgctcgtgcggctcgaccgacgtgtatctggttacacgcgaggctgatgtcctccctgctcgccgcagaggcga

SEQ ID NO: 116665 - DNA, 75 bp, Artificial Sequence
  Synthetic
tttggggcgtatatgtccaaggcacacggtatcgaccctaacatcagaactggggtaaggaccattaccacgggc

SEQ ID NO: 116666 - DNA, 75 bp, Artificial Sequence
  Synthetic
agggcggctgtgtgcacgagaggtgttgcaaaatctctgcagttcataccagtagaggccttgagttcacagacc

SEQ ID NO: 116667 - DNA, 75 bp, Artificial Sequence
  Synthetic
aggtcaccgtcttttagtgataactccacccccccagccgtccccgagtcttatcaagtggggtatctccatgct

SEQ ID NO: 116668 - DNA, 75 bp, Artificial Sequence
  Synthetic
ctccctgccatcctctctcctggcgccctggtcgtcggggtcgtgtgcgcagcaatactgcgtcggcacgtgggc

SEQ ID NO: 116669 - DNA, 75 bp, Artificial Sequence
  Synthetic
aatcattcaaagactccatggccttagcgcgttctcactccacagttactctccaggtgaaatcaatagggtggc

SEQ ID NO: 116670 - DNA, 75 bp, Artificial Sequence
  Synthetic
actgtcccacaccccaacatagaggaggtggccctgaccaatgacggggaaatcccgttctacggtaaggccctc

SEQ ID NO: 116671 - DNA, 75 bp, Artificial Sequence
  Synthetic
tcacagcgtgtctcgtgcccggccccgctggttctggttttgcctactcctgcttgctgcaggagtaggcatcta

SEQ ID NO: 116672 - DNA, 75 bp, Artificial Sequence
  Synthetic
ctttgactctgtgatagactgtaatgtagctgtagaacagtacattgatttcagtatggaccccactttctccat

SEQ ID NO: 116673 - DNA, 75 bp, Artificial Sequence
  Synthetic
tcaattcttcaggctgtcctgagagattggcgagctgccgacctctcacccattttgcccagggctggggcccta

SEQ ID NO: 116674 - DNA, 75 bp, Artificial Sequence
  Synthetic
gtcaacgctgcctggtaaccccgccattgcttcattgatggcttttacagctgctgtcaccagcccactaaccac

SEQ ID NO: 116675 - DNA, 75 bp, Artificial Sequence
  Synthetic
gcttgtccgggagggccgttaaccacatcaagtccgtgtggaaggacctcctggaagacccacaaacaccaattc

SEQ ID NO: 116676 - DNA, 75 bp, Artificial Sequence
  Synthetic
ccatgccaggtcccggcccctgaattcttcacggaagtggatggggtgcggctgcacaggtacgctccggcgtgc

SEQ ID NO: 116677 - DNA, 75 bp, Artificial Sequence
  Synthetic
cagctgtgctttgcgagtgctacgacgcaggttgcgcttggtacgagctggcaccctctgagaccacggtaagac

SEQ ID NO: 116678 - DNA, 75 bp, Artificial Sequence
  Synthetic
tgcccatgccaggttccggcccccgaattcttcacggaagtggatggggtgcggctgcacaggtacgctccggcg

SEQ ID NO: 116679 - DNA, 75 bp, Artificial Sequence
  Synthetic
gcgtatttctccatggtggggaactgggcgaaggtcctgctagtgctgttgctgtttgccggcgtcgatgcgagc

SEQ ID NO: 116680 - DNA, 75 bp, Artificial Sequence
  Synthetic
gctgtttgccggcgtcgatgcgagcacctacgtcaccggggggagttccgctcacgccgcgttgggagtcgccag

SEQ ID NO: 116681 - DNA, 75 bp, Artificial Sequence
  Synthetic
cgattttgcccagggctggggccctatcagttatgccaacggaagcggccccgaccatcgcccctactgctggca

SEQ ID NO: 116682 - DNA, 75 bp, Artificial Sequence
  Synthetic
aaagtgcccatgccaggttccggcccccgaattcttcacggaagtggatggggtgcggctgcacaggtacgctcc

SEQ ID NO: 116683 - DNA, 75 bp, Artificial Sequence
  Synthetic
ggttgccccttttctatcttcttgctggccctactgtcctgcatcaccactccggtctcagctgcccaggtgaaa

SEQ ID NO: 116684 - DNA, 75 bp, Artificial Sequence
  Synthetic
caaacaagtgctgtaccaacaatttgacgagatggaggagtgctcccaagctgccccttacattgagcaagcaca

SEQ ID NO: 116685 - DNA, 75 bp, Artificial Sequence
  Synthetic
gtgagaaagtggggaatacatctcagtgctggacgccggtctcacccaatgtggctgtgcagcaacccggcgccc

SEQ ID NO: 116686 - DNA, 75 bp, Artificial Sequence
  Synthetic
gtggctgtgcagcaacccggcgccctcacgcggggcttgcggacgcacatcgatatcgttgtaatgtccgctacg

SEQ ID NO: 116687 - DNA, 75 bp, Artificial Sequence
  Synthetic
aaactggaagccttttggcacaagcacttgtggaactttgtcagtgggatccagtacctggctgggctctccacg

SEQ ID NO: 116688 - DNA, 75 bp, Artificial Sequence
  Synthetic
gctgggtagccacccatttggcaagccccgcggcatcctccgcctttgtggtaagcggcttggccggggctgccg

SEQ ID NO: 116689 - DNA, 75 bp, Artificial Sequence
  Synthetic
catcactggtcaccgtatggcatgggacatgatgatgaactggtcgcccacagctaccatgatcctggcgtacgc

SEQ ID NO: 116690 - DNA, 75 bp, Artificial Sequence
  Synthetic
ggggccggggtctccggtgctcttgtcgcctttaagatcatgggcggggagctccccactacagaggacatggta

SEQ ID NO: 116691 - DNA, 75 bp, Artificial Sequence
  Synthetic
ccgtcggcgctaagcagaacatccagctgatcaactccaatggcagttggcacatcaaccgcactgctctgaact

SEQ ID NO: 116692 - DNA, 75 bp, Artificial Sequence
  Synthetic
tgaggccttcaggataggatggggcactctgcaatatgagcacaatgtcaccaattcagaggatatgagaccata

SEQ ID NO: 116693 - DNA, 75 bp, Artificial Sequence
  Synthetic
cagcggcgactggctgcgtgacgtttgggattgggtctgtaatgtgcttagtgacttcaagacctggcttactgc

SEQ ID NO: 116694 - DNA, 75 bp, Artificial Sequence
  Synthetic
ctgctggcattatccacccaaaccttgtggtatagtccccgcgaggtctgtgtgtggcccggtgtactgtttcac

SEQ ID NO: 116695 - DNA, 75 bp, Artificial Sequence
  Synthetic
gtgacttcaagacctggcttactgccaagatcatgcccaaaatgccaggcatacctttcatttcttgccagaagg

SEQ ID NO: 116696 - DNA, 75 bp, Artificial Sequence
  Synthetic
caccaagacttgtggcgcaccaccttgccgcattagagctgatttcaatgccagcacggacctgttgtgccccac

SEQ ID NO: 116697 - DNA, 75 bp, Artificial Sequence
  Synthetic
acagacgacggtctgaagtgcccgtgtcaagtacctgcaccagagttcttcaccgaggtggatggagtaaggctc

SEQ ID NO: 116698 - DNA, 75 bp, Artificial Sequence
  Synthetic
ggtcgactacccctacaggctctggcactacccctgcacagtcaactatagcatcttcaagataaggatgtacgt

SEQ ID NO: 116699 - DNA, 75 bp, Artificial Sequence
  Synthetic
ctgagcccgatgtggcagtactgacatcaatgttgcaggacccctctcacattacggctcaaacggcggctagac

SEQ ID NO: 116700 - DNA, 75 bp, Artificial Sequence
  Synthetic
cactctaccacggagtgggccatcttgccctgcacttactctgacctgcccgccttgtcgaccggtctcctccac

SEQ ID NO: 116701 - DNA, 75 bp, Artificial Sequence
  Synthetic
acaccctgacgtcgaactagtggaagccaacctactttggcgtcaagagatgggtagtaatatcaccagagtgga

SEQ ID NO: 116702 - DNA, 75 bp, Artificial Sequence
  Synthetic
tcttggcggacgccagggtctgtgcctgtgtatggatgctcatcctgctgggccaagccgaggcagccctagaga

SEQ ID NO: 116703 - DNA, 75 bp, Artificial Sequence
  Synthetic
ccaaaatatccaccagcactccctatctgggctaggccagattacaatcctccactactagagctgtggaaagct

SEQ ID NO: 116704 - DNA, 75 bp, Artificial Sequence
  Synthetic
ccccttggctacctattccctcatcggcctatggtccttcttcctactgctcctagcattgcctcaacaggctta

SEQ ID NO: 116705 - DNA, 75 bp, Artificial Sequence
  Synthetic
caaataggcgtggccctgttggtgctgctcaccctctttacactcaccccggcatataagaccctcctgggccgg

SEQ ID NO: 116706 - DNA, 75 bp, Artificial Sequence
  Synthetic
agtcatctgtatctacggcgcttttggagctggcgaataaatctttcccaccgccaatgtcccaggagacagaca

SEQ ID NO: 116707 - DNA, 75 bp, Artificial Sequence
  Synthetic
ccttgagggggaaccgggtgatccagacttgagttgtgactcctggtccactgtgagtgatagcgaggaacagag

SEQ ID NO: 116708 - DNA, 75 bp, Artificial Sequence
  Synthetic
ctgtgagtgatagcgaggaacagagcgtggtttgttgctccatgtcttactcttggaccggtgctataataacac

SEQ ID NO: 116709 - DNA, 75 bp, Artificial Sequence
  Synthetic
ttgggctgccagcggcctgcgggacctggcggtcgctgtggaacctatcatcttcagtccgatggagaaaaaagt

SEQ ID NO: 116710 - DNA, 75 bp, Artificial Sequence
  Synthetic
ctggcggtcgctgtggaacctatcatcttcagtccgatggagaaaaaagtcatcgtatggggagcggagacagcc

SEQ ID NO: 116711 - DNA, 75 bp, Artificial Sequence
  Synthetic
gctgattaacaccaacggcagttggcacatcaacagcacggccttgaactgcaatgatagcctccagaccggctg

SEQ ID NO: 116712 - DNA, 75 bp, Artificial Sequence
  Synthetic
atgactgccccaactctagcatagtctttgagacagaccatcacattttacaccttccaggatgcgtcccttgtg

SEQ ID NO: 116713 - DNA, 75 bp, Artificial Sequence
  Synthetic
ttcttgcgcctatcactgcttatgcccagcagacacgaggtctcttgggcgccatagtggtgagcatgacaggcc

SEQ ID NO: 116714 - DNA, 75 bp, Artificial Sequence
  Synthetic
caggggtcttatggaccgtctaccacggagctggcaacaagaccttagccggttcgcggggcccggtcacgcaga

SEQ ID NO: 116715 - DNA, 75 bp, Artificial Sequence
  Synthetic
gatttgctcgttggggcggctgctttctgctccgctatgtacgtgggagatctttgcggatctgttttcctcgtc

SEQ ID NO: 116716 - DNA, 75 bp, Artificial Sequence
  Synthetic
tcctggctggcgtggccttcttcagcatgcaggccaactgggctaaagtcatcctgattttgttcctctttgccg

SEQ ID NO: 116717 - DNA, 75 bp, Artificial Sequence
  Synthetic
aaatataccaatgctgtgaccttgagccagaagctaggaaggcaatcagctctcttacagagcggctttacatcg

SEQ ID NO: 116718 - DNA, 75 bp, Artificial Sequence
  Synthetic
tcccagctgttcaccttctcgcctcgccggcatgagacagtacaggactgcaattgctcaatctatcccggccac

SEQ ID NO: 116719 - DNA, 75 bp, Artificial Sequence
  Synthetic
tccatagacttcatccccgttgagatgcttgacatcgtcacgcgctcccccacctttaccgacaacagcacgcca

SEQ ID NO: 116720 - DNA, 75 bp, Artificial Sequence
  Synthetic
accctcaactacaccgtgtttaaagtcaggatgtacgtggggggggtcgagcacaggctggaggctgcctgcaac

SEQ ID NO: 116721 - DNA, 75 bp, Artificial Sequence
  Synthetic
gcaattgctctatctatcccggccatataacgggtcaccgcatggcatgggatatgatgatgaactggtccccca

SEQ ID NO: 116722 - DNA, 75 bp, Artificial Sequence
  Synthetic
cattaaggcaactgcagctgctaaggcagcaggccttcaagacccatccttccttgtctgcggggacgatttagt

SEQ ID NO: 116723 - DNA, 75 bp, Artificial Sequence
  Synthetic
catcaacaccaatgggagctggcacatcaacaggacagccctcaattgcaatgacagcttgcagacgggattcct

SEQ ID NO: 116724 - DNA, 75 bp, Artificial Sequence
  Synthetic
gttgcatacgccgcccaggggtacaaagtactagtgctgaatccctcggtggcggccaccctggggttcggggca

SEQ ID NO: 116725 - DNA, 75 bp, Artificial Sequence
  Synthetic
aaacgggcggttgtgcttactgagtcgagcgtctccaacgctctggcagagttggccgcacggtccttcggtacc

SEQ ID NO: 116726 - DNA, 75 bp, Artificial Sequence
  Synthetic
atcgtggacgtgcagtacttgtacggggtggggtcaagcatcgcgtcctgggccattaagtgggagtacgtcgtt

SEQ ID NO: 116727 - DNA, 75 bp, Artificial Sequence
  Synthetic
cagcctacttatgatttggaacaaattacatcgtgttcctccaacgtctccgtggcacatgacgccgcagggaag

SEQ ID NO: 116728 - DNA, 75 bp, Artificial Sequence
  Synthetic
cttgaggccgctaacatcacgggctcctctcaggataggccttactgctggcactacgagcctcgccaatgcgga

SEQ ID NO: 116729 - DNA, 75 bp, Artificial Sequence
  Synthetic
acgtactccacgtatggcaagttcctcgccgatgggggctgtgcaggcggcgcctatgacatcatcatatgcgat

SEQ ID NO: 116730 - DNA, 75 bp, Artificial Sequence
  Synthetic
cagaggttcccctggcccgagctgcttgggaaaccgcacgccacactccagttaactcctggttgggtaacatca

SEQ ID NO: 116731 - DNA, 75 bp, Artificial Sequence
  Synthetic
cgcctatgacatcatcatatgcgatgaatgccacgccacggacgctaccacccttctcggcatcggaacagttct

SEQ ID NO: 116732 - DNA, 75 bp, Artificial Sequence
  Synthetic
gctcataaacaccaacggcagctggcacatcaacaggactgccttgaactgtaacgactccctccagactgggtt

SEQ ID NO: 116733 - DNA, 75 bp, Artificial Sequence
  Synthetic
ggggggaaaacgagacagacgtcttcatcctcaactcgaccagacctccgcaaggagcatggttcggatgtacgt

SEQ ID NO: 116734 - DNA, 75 bp, Artificial Sequence
  Synthetic
catcctcaactcgaccagacctccgcaaggagcatggttcggatgtacgtggatgaatggcactgggttcacgaa

SEQ ID NO: 116735 - DNA, 75 bp, Artificial Sequence
  Synthetic
aacaccaacggcagctggcacatcaatcgtacggccctgagctgtaatgcgagcctcgaaactggctggttagcg

SEQ ID NO: 116736 - DNA, 75 bp, Artificial Sequence
  Synthetic
aatgtacggggctacctactcagtcactccgctggacttaccagccattattgaaagactccatggcttgagcgc

SEQ ID NO: 116737 - DNA, 75 bp, Artificial Sequence
  Synthetic
actccgctggacttaccagccattattgaaagactccatggcttgagcgcgttctcgctccacagttactctcca

SEQ ID NO: 116738 - DNA, 75 bp, Artificial Sequence
  Synthetic
tgactctgtcaccatattacaagcgctacatcggctggtgcatgtggtggcttcagtatttcctgaccagagcag

SEQ ID NO: 116739 - DNA, 75 bp, Artificial Sequence
  Synthetic
accaagtgtggttcaggtccgtggctcacgccgcggtgcttggtccactacccatatcggttgtggcactaccca

SEQ ID NO: 116740 - DNA, 75 bp, Artificial Sequence
  Synthetic
taataccagctcaaggagacgtggtggttgtcgccactgacgccctcatgacagggtacactggagactttgact

SEQ ID NO: 116741 - DNA, 75 bp, Artificial Sequence
  Synthetic
cccatatcggttgtggcactacccatgcattgtcaacttcaccatcttcaaagtgcggatgtatattggcggtgt

SEQ ID NO: 116742 - DNA, 75 bp, Artificial Sequence
  Synthetic
tgtgcgcgttcaaggccttctccggatctgcgcgttagcgcggaagatggccggaggccattacgtgcaaatggt

SEQ ID NO: 116743 - DNA, 75 bp, Artificial Sequence
  Synthetic
actcaatggcaggtccttccctgctcctttgcacctctccccgccctctccaccggcctgatccatctccatcag

SEQ ID NO: 116744 - DNA, 75 bp, Artificial Sequence
  Synthetic
ggtacgtttccactggtgagcgagcttcgggaatgtttgacagcgtaacgctctgcgagtgctacgatgcagggg

SEQ ID NO: 116745 - DNA, 75 bp, Artificial Sequence
  Synthetic
atactcagcagcctcactgtaacccagctcctgaggcgactgcaccagtggataagctcggagtgtaccactcca

SEQ ID NO: 116746 - DNA, 75 bp, Artificial Sequence
  Synthetic
acgccagggtctgtgcatgtctttggatgatgctgctagtatcgcaggttgaagcagccctggccaacttgataa

SEQ ID NO: 116747 - DNA, 75 bp, Artificial Sequence
  Synthetic
acgccagggtctgtgcatgtctttggatgatgctgctagtatcgcaggttgaagcagccctggccaacttgatta

SEQ ID NO: 116748 - DNA, 75 bp, Artificial Sequence
  Synthetic
acgccagggtctgtgcatgtctttggatgatgctgctagtatcgcaggttgaagcagccctggccaacttgatca

SEQ ID NO: 116749 - DNA, 75 bp, Artificial Sequence
  Synthetic
acgccagggtctgtgcatgtctttggatgatgctgctagtatcgcaggttgaagcagccctggccaacttgatga

SEQ ID NO: 116750 - DNA, 75 bp, Artificial Sequence
  Synthetic
cttttcatctgcgtggtgtggtacataaaggggcgagccccggccgcagccgcgtatgcggcttgcggaatgtgg

SEQ ID NO: 116751 - DNA, 75 bp, Artificial Sequence
  Synthetic
acagtgtgtgccagagccaaagcccctcccccgtcttgggacgtcatgtggaagtgcctgactcgactcaaaccc

SEQ ID NO: 116752 - DNA, 75 bp, Artificial Sequence
  Synthetic
gggcctcctagggtgtataatcaccagcctaactggccgggacaaaaaccaagtggagggtgaggtccagattgt

SEQ ID NO: 116753 - DNA, 75 bp, Artificial Sequence
  Synthetic
cctttgctcctcctgctcctcgcgttgcccgaacgggcttacgcgcacgaccaggaaataccagcgacccttggc

SEQ ID NO: 116754 - DNA, 75 bp, Artificial Sequence
  Synthetic
gctgtgaccatgttctacccgggtgtggtgtttgacataaccaagtggctgttggcgatcctcggacccggctac

SEQ ID NO: 116755 - DNA, 75 bp, Artificial Sequence
  Synthetic
aagctgacctcgaggtcatgaccagcacgtgggtcctagccgggggagtcctggctgccatcgccgcgtactgct

SEQ ID NO: 116756 - DNA, 75 bp, Artificial Sequence
  Synthetic
cggaggccttgctgcatgtctatgttccatcatttgagccacgcggccctcgggactccgtgatcatcctcttgg

SEQ ID NO: 116757 - DNA, 75 bp, Artificial Sequence
  Synthetic
tagaccaagacctcgtgggctggcctgctccccaaggcgcccgctcattgacaccctgcacctgcggctcctcgg

SEQ ID NO: 116758 - DNA, 75 bp, Artificial Sequence
  Synthetic
accgtcgttgcacctgacaaggaggtcctctatgaggcttttgacgagatggaggagtgtgcttccagagcggcc

SEQ ID NO: 116759 - DNA, 75 bp, Artificial Sequence
  Synthetic
tcctgtttcggcctcatctagcctttgacatcacaaaatacctcttggcccttttggggcccctctacatattcc

SEQ ID NO: 116760 - DNA, 75 bp, Artificial Sequence
  Synthetic
tcttgctcgccatactcggtccgctcatggtgctccaggctggcataaccagagtgccgtactttgtgcgcgctc

SEQ ID NO: 116761 - DNA, 75 bp, Artificial Sequence
  Synthetic
tgcaggcttcatggcccaaggtggagcaattctgggccaaacacatgtggaacttcattagcggcatccaatatc

SEQ ID NO: 116762 - DNA, 75 bp, Artificial Sequence
  Synthetic
ggctctactgaagctaggggctctcactggtacctacatctatgaccacctttcccctttgtccgactgggccgc

SEQ ID NO: 116763 - DNA, 75 bp, Artificial Sequence
  Synthetic
tgaccttgtcaccacactacaaagcgttcctcgctaggctcatatggtggttgcaatatcttaccaccagagccg

SEQ ID NO: 116764 - DNA, 75 bp, Artificial Sequence
  Synthetic
tgacggccttaaggacttagcggtagcccttgagccggtgatattcacgcccatggagaagaaggttatagtctg

SEQ ID NO: 116765 - DNA, 75 bp, Artificial Sequence
  Synthetic
tatgtccaaatggctttcatgaagctggccgcactgacaggtacgtacgtttatgaccatcttactccactgcgg

SEQ ID NO: 116766 - DNA, 75 bp, Artificial Sequence
  Synthetic
gcccttgagccggtgatattcacgcccatggagaagaaggttatagtctggggcgcggatactgctgcatgcggc

SEQ ID NO: 116767 - DNA, 75 bp, Artificial Sequence
  Synthetic
caactcctctccaccagcagtgccccagagcttccaggtggctcacctgcatgctcccaccggcagcggtaagag

SEQ ID NO: 116768 - DNA, 75 bp, Artificial Sequence
  Synthetic
gtaggcttgggtaaggtgctggtggacatcttggcagggtacggtgcgggcatttcgggggctctcgtcgcattc

SEQ ID NO: 116769 - DNA, 75 bp, Artificial Sequence
  Synthetic
gatggagacggccccgaccaccgcccctactgctggcactaccctccaaaaccttgtggtattgtggacgcaaga

SEQ ID NO: 116770 - DNA, 75 bp, Artificial Sequence
  Synthetic
cagcaaaacccttagcggccccaagggaccagtcaatcaaatgtacaccaatgttgatcaagacctggtgggatg

SEQ ID NO: 116771 - DNA, 75 bp, Artificial Sequence
  Synthetic
cttgtgccgtgtaattgcggcgcatcggacttgtacctcgttacgaggcatgcagacgttgtgcctgtacgtagg

SEQ ID NO: 116772 - DNA, 75 bp, Artificial Sequence
  Synthetic
tgcagacgttgtgcctgtacgtaggagaggggacacccggggcgcccttctaagccccaggccaatatccaccct

SEQ ID NO: 116773 - DNA, 75 bp, Artificial Sequence
  Synthetic
ccgcaaagctggtcgcattgggcgtcaatgccgtggcctactaccgcggtctcgacgtgtctgtcatcccgacca

SEQ ID NO: 116774 - DNA, 75 bp, Artificial Sequence
  Synthetic
ggggagcttactctcccccaggcccgtctcctacttgaagggctcttcgggtggtccactgctctgcccctcggg

SEQ ID NO: 116775 - DNA, 75 bp, Artificial Sequence
  Synthetic
tttgtgccggtcgagtctcttgaaaccaccatgagatccccggtcttttctgacaactcaacgcctcctgctgtg

SEQ ID NO: 116776 - DNA, 75 bp, Artificial Sequence
  Synthetic
ggcgactgggccggcacgggcatcatggtcacgcggtgcccttgtggcgccaacatttctggcaatgtccgcttc

SEQ ID NO: 116777 - DNA, 75 bp, Artificial Sequence
  Synthetic
cccaagggtcctgttatccagatgtacaccaatgtggacaaggaccttgtgggttggcccgctcctcaaggtacc

SEQ ID NO: 116778 - DNA, 75 bp, Artificial Sequence
  Synthetic
tgacaactcaacgcctcctgctgtgccccagacataccaggtcgcgcacttgcacgcaccgacgggaagcggcaa

SEQ ID NO: 116779 - DNA, 75 bp, Artificial Sequence
  Synthetic
tgacaactcaacgcctcctgctgtgccccagacataccaggtcgcgcacttgcacgcaccgacgggtagcggcaa

SEQ ID NO: 116780 - DNA, 75 bp, Artificial Sequence
  Synthetic
tgacaactcaacgcctcctgctgtgccccagacataccaggtcgcgcacttgcacgcaccgacgggcagcggcaa

SEQ ID NO: 116781 - DNA, 75 bp, Artificial Sequence
  Synthetic
tgacaactcaacgcctcctgctgtgccccagacataccaggtcgcgcacttgcacgcaccgacggggagcggcaa

SEQ ID NO: 116782 - DNA, 75 bp, Artificial Sequence
  Synthetic
tgctcaacccctccgtcgcagcgacattgggcttcggggcatatatgtctaaggcgcatggcatcgacccgaata

SEQ ID NO: 116783 - DNA, 75 bp, Artificial Sequence
  Synthetic
tagacggagtacagatccacaggtttgctcccactccaaagccgttctttcgggatgaggtctcgttcagcgtgg

SEQ ID NO: 116784 - DNA, 75 bp, Artificial Sequence
  Synthetic
tcacgtactccacctatggcaagttccttgccgacggtggttgctctgggggcgcctacgacatcataatatgcg

SEQ ID NO: 116785 - DNA, 75 bp, Artificial Sequence
  Synthetic
ctacagagggcttgacgtctcggtaataccaacacaaggagacgtggtggtcgtcgccaccgacgccctcatgac

SEQ ID NO: 116786 - DNA, 75 bp, Artificial Sequence
  Synthetic
tcgtcgccaccgacgccctcatgacaggatatactggagacttcgactctgtgatcgactgcaacgtggcggtca

SEQ ID NO: 116787 - DNA, 75 bp, Artificial Sequence
  Synthetic
tcattttctgccattccaagaagaaatgtgatgagctcgccgcaaagctgtcgggcctcggactcaatgctgtag

SEQ ID NO: 116788 - DNA, 75 bp, Artificial Sequence
  Synthetic
tccgattccaaagtggtcgttctggactctctcgacccactggccgaagaggtgagcgacgtcgaaccctctata

SEQ ID NO: 116789 - DNA, 75 bp, Artificial Sequence
  Synthetic
ctgactaccaaccacccactgtcgcgggctgtgctctccccccccccaagaagaccccgacgccccccccaagga

SEQ ID NO: 116790 - DNA, 75 bp, Artificial Sequence
  Synthetic
ctccgggggagagaccgtccggcatgtttgacacctcagtgctctgtgagtgctatgatgccgggtgcgcttggt

SEQ ID NO: 116791 - DNA, 75 bp, Artificial Sequence
  Synthetic
acgagctgacaccggctgagacaacaaccaggttgagagcctacttcaacacaccaggcctccccgtctgccaag

SEQ ID NO: 116792 - DNA, 75 bp, Artificial Sequence
  Synthetic
cccccccacgggggcgggcgccgccggctccggcggtcagacgccccctgatgagccggctccttcggagacgga

SEQ ID NO: 116793 - DNA, 75 bp, Artificial Sequence
  Synthetic
caactcctcggggctctaccacgtcaccaacgactgcccgaattcgagcgtcgtgtacgaggcagacggtgtcat

SEQ ID NO: 116794 - DNA, 75 bp, Artificial Sequence
  Synthetic
tgggagagcgtcttcacaggcctcacccacatagatgcccatttcttgtcccagactaagcaggcaggagacaac

SEQ ID NO: 116795 - DNA, 75 bp, Artificial Sequence
  Synthetic
acatcaacaggacagccctgaactgtaacgactccctgaacaccgggttcttagctgggttgttctactatagga

SEQ ID NO: 116796 - DNA, 75 bp, Artificial Sequence
  Synthetic
taccgcctaggctcagtcaccaatgaggtcaccctcacccaccccgtaaccaaatacatcgccacatgcatgcaa

SEQ ID NO: 116797 - DNA, 75 bp, Artificial Sequence
  Synthetic
caggctcagtagctgcaaatccctcaccgccttcaggcaggggtggggtcccttgacagatgccaacatcactgg

SEQ ID NO: 116798 - DNA, 75 bp, Artificial Sequence
  Synthetic
gctcccgactcagactctgggtcgtggtctacctgctccgaggaggaggattccaccgtgtgctgctccatgtcg

SEQ ID NO: 116799 - DNA, 75 bp, Artificial Sequence
  Synthetic
cctacgacgcagcttcgacggcatgtcgatctgcttgttgggtccgccaccctatgttcggcactgtatataggg

SEQ ID NO: 116800 - DNA, 75 bp, Artificial Sequence
  Synthetic
tgggggcagtacaaaatgaagtgacactcacccatcctataaccaaatacatcatggcctgcatgtcagcagacc

SEQ ID NO: 116801 - DNA, 75 bp, Artificial Sequence
  Synthetic
gacctttgcggcggtgtctttcttgccagccagctcttctccttctctcctaggcgtcattggaccacgcaggat

SEQ ID NO: 116802 - DNA, 75 bp, Artificial Sequence
  Synthetic
tgcaggggtaggcatctacctcctccccaaccgatgaaggttggggtaaacactccggcctcttaggccatttcc

SEQ ID NO: 116803 - DNA, 75 bp, Artificial Sequence
  Synthetic
tgtactgcactacatcaagaagtgcgtcactgagggccaaaaaggtaacttttgacaggatgcaagtactcgatg

SEQ ID NO: 116804 - DNA, 75 bp, Artificial Sequence
  Synthetic
ctggggtgtgaatgagacagacgtgttcttattggagtctttgcgacctcctagtggtcggtggtttggatgcgt

SEQ ID NO: 116805 - DNA, 75 bp, Artificial Sequence
  Synthetic
atcccagaccgagaggtgctctaccagcagttcgacgaaatggaggaatgttccaaacatcttccactagtcgag

SEQ ID NO: 116806 - DNA, 75 bp, Artificial Sequence
  Synthetic
agcagttcgacgaaatggaggaatgttccaaacatcttccactagtcgagcacggactgcaattggcagagcaat

SEQ ID NO: 116807 - DNA, 75 bp, Artificial Sequence
  Synthetic
cacggactgcaattggcagagcaattcaaacagaaggccctcggtgtgctgagcgtcgccagcaagcaggccaag

SEQ ID NO: 116808 - DNA, 75 bp, Artificial Sequence
  Synthetic
cttcagtgctgccctcaccagcccactctctaccagcactaccatcctcctcaacatcatgggagggtggctggc

SEQ ID NO: 116809 - DNA, 75 bp, Artificial Sequence
  Synthetic
tgtcccaccgactgctttaggaaacatcctgaggctacttacagccggtgtgggtcaggaccctggttgacacct

SEQ ID NO: 116810 - DNA, 75 bp, Artificial Sequence
  Synthetic
ggctttcacgctcacatccttgttcacgcggggtcccacacagaagctccaactcatccataccaacggcagttg

SEQ ID NO: 116811 - DNA, 75 bp, Artificial Sequence
  Synthetic
aagaaagcagctcgcctcatcgtttaccccgaccttggtgtcagggtctgcgaaaagatggccctctatgatgtt

SEQ ID NO: 116812 - DNA, 75 bp, Artificial Sequence
  Synthetic
attaggagggtgggtggcctctcagatcgctacccccacggcttctacggctttcgtcgtcagcggtctcgcggg

SEQ ID NO: 116813 - DNA, 75 bp, Artificial Sequence
  Synthetic
gaaaggctggccagttgccgacccattaccagcttctctcagggctggggcccccttagctataccaacggcacc

SEQ ID NO: 116814 - DNA, 75 bp, Artificial Sequence
  Synthetic
gccccgttgtggtggggacgacggataagcggggtgtccccacttacacgtggggcgagaatgagacggatgttc

SEQ ID NO: 116815 - DNA, 75 bp, Artificial Sequence
  Synthetic
gccccgttgtggtggggacgacggataagcggggtgtccccacttacacgtggggcgtgaatgagacggatgttc

SEQ ID NO: 116816 - DNA, 75 bp, Artificial Sequence
  Synthetic
gccccgttgtggtggggacgacggataagcggggtgtccccacttacacgtggggcgcgaatgagacggatgttc

SEQ ID NO: 116817 - DNA, 75 bp, Artificial Sequence
  Synthetic
gccccgttgtggtggggacgacggataagcggggtgtccccacttacacgtggggcgggaatgagacggatgttc

SEQ ID NO: 116818 - DNA, 75 bp, Artificial Sequence
  Synthetic
tcatgatatcacaagcggaagcggccttggagaatctcgtcacgctgaacgccgtcgctgctgctggaacacacg

SEQ ID NO: 116819 - DNA, 75 bp, Artificial Sequence
  Synthetic
acccggtggggtcgcaattaccttgcgagcccgaaccggacgtggccgtgttgacgtccatgctcactgatccct

SEQ ID NO: 116820 - DNA, 75 bp, Artificial Sequence
  Synthetic
catcgggggagcgggcaacaacaccctgctgtgccccactgactgcttccgcaaacatccggaggctacgtacac

SEQ ID NO: 116821 - DNA, 75 bp, Artificial Sequence
  Synthetic
acagccatactctcatctctgactgtgacatccctcctgaggcgactgcacaagtggatcaatgaagactgtccc

SEQ ID NO: 116822 - DNA, 75 bp, Artificial Sequence
  Synthetic
tgcgggcgtggcgggggctctcgtagcattcaagatcatgagcggtgaggtcccctccacagaggacctggtcaa

SEQ ID NO: 116823 - DNA, 75 bp, Artificial Sequence
  Synthetic
ttgcctactttggcatggctggcaactggctaaaggtcctggctgttctgtttctgtttgcaggggtcgaagcaa

SEQ ID NO: 116824 - DNA, 75 bp, Artificial Sequence
  Synthetic
gttaggatgtacgtggggggggtcgagcacaggttgacggccgcgtgcaactggactcggggggagcgctgcgac

SEQ ID NO: 116825 - DNA, 75 bp, Artificial Sequence
  Synthetic
cgtgctgtctgactttaagacttggctgaaggctaagctattgccccggatgcccggcatccccttttactcctg

SEQ ID NO: 116826 - DNA, 75 bp, Artificial Sequence
  Synthetic
catttcccatcaactgttacacggagggcccatgcgtgcctaaacccgctcccaacttcacgactgccatctgga

SEQ ID NO: 116827 - DNA, 75 bp, Artificial Sequence
  Synthetic
agcacaggttgacggccgcgtgcaactggactcggggggagcgctgcgacctggatgacagagacaggtctgagc

SEQ ID NO: 116828 - DNA, 75 bp, Artificial Sequence
  Synthetic
catcgtggacgtgcagtacttgtacggggtaggatcgagcattgtgtcctgggctatcaagtgggagtatgttgt

SEQ ID NO: 116829 - DNA, 75 bp, Artificial Sequence
  Synthetic
atcaccactaccccctactttgtgcgtgcgcatgtattggtccgcctttgcatgcttgtgcgctctgtgatgggg

SEQ ID NO: 116830 - DNA, 75 bp, Artificial Sequence
  Synthetic
ggccttttctatcaccagaggttcaactcctcaggctgtcccgctaggttggccagctgccaaccccttactgct

SEQ ID NO: 116831 - DNA, 75 bp, Artificial Sequence
  Synthetic
ctggcgtgacgcaagataagatcaagtgtccatgccaggttcctgcccccgagttcttcactgaggtggacggtg

SEQ ID NO: 116832 - DNA, 75 bp, Artificial Sequence
  Synthetic
ctgaacgcggcatccttggccgggacgcatggcatcgcgtccttcctcatgtttttctgcttcgcctggtatctg

SEQ ID NO: 116833 - DNA, 75 bp, Artificial Sequence
  Synthetic
acctgtgatatttagtcccatggaaatcaaggtcatcacttggggcgcggacacggcggcttgcggagatattct

SEQ ID NO: 116834 - DNA, 75 bp, Artificial Sequence
  Synthetic
cgtttgtggtaggatcccagcttccctgtgaaccagaaccggacgtggccgtgttaacatccatgcttacagacc

SEQ ID NO: 116835 - DNA, 75 bp, Artificial Sequence
  Synthetic
cggaggtggccgcatcctgtggcagtgccgtccttgtatgcttggcagtgctgaccttgtcaccatactacaagc

SEQ ID NO: 116836 - DNA, 75 bp, Artificial Sequence
  Synthetic
gaccggtagggacaagaacgtagtgaccggtgaggtgcaggtgctttctacggctactcagacctttttgggtac

SEQ ID NO: 116837 - DNA, 75 bp, Artificial Sequence
  Synthetic
agttcccctggcttggacctcattgaagccaaccttctatggggtgccaatgccaccagggtcgagctgggtgat

SEQ ID NO: 116838 - DNA, 75 bp, Artificial Sequence
  Synthetic
cgacgccatcatcctgatcacgtgcgcgcttcacccacacctaatgtttgacatcaccaagatactgctggccat

SEQ ID NO: 116839 - DNA, 75 bp, Artificial Sequence
  Synthetic
caccccagtgccgccccctaggaggcgacgagctgtggtgctggaccagagtaacgtgggagaagctctcaaaga

SEQ ID NO: 116840 - DNA, 75 bp, Artificial Sequence
  Synthetic
ctccaggggccaagtctcttgaaccgtgcacatgtggatctgcagacttgtacttggttacccgcgacgctgacg

SEQ ID NO: 116841 - DNA, 75 bp, Artificial Sequence
  Synthetic
gctggaggtcagtacgcgcagatggccatcatcaagttgggggcgctcaccggcacctacatttatgaccatctt

SEQ ID NO: 116842 - DNA, 75 bp, Artificial Sequence
  Synthetic
gagctgacaccgctgcttgcggggacattgtcaatggcctacccgtctccgctcggagggggagagaaatactgc

SEQ ID NO: 116843 - DNA, 75 bp, Artificial Sequence
  Synthetic
catgcctccgcttgaaggggagccgggtgatccagacctcacatcggactcgtggtccacagtcagcggatcgga

SEQ ID NO: 116844 - DNA, 75 bp, Artificial Sequence
  Synthetic
cagcctcaccggccgggataagaaccaggtggaaggtgagatccagatcgtctccaccgcaacccaaaccttcct

SEQ ID NO: 116845 - DNA, 75 bp, Artificial Sequence
  Synthetic
tcactactgcggcaccataacatggtgtacgctaccacctccaaatcagcaaccgctcggcagaagaaggtcacc

SEQ ID NO: 116846 - DNA, 75 bp, Artificial Sequence
  Synthetic
gtggaccaagatctcgtgggctggcccgcaccccagggggcacgctccctggtgccctgcacctgcgggtcctcg

SEQ ID NO: 116847 - DNA, 75 bp, Artificial Sequence
  Synthetic
ttccgccagatccaagtttggctacggggcaaaggacgttcggagccattcccgcaaggccgttaaccacatcaa

SEQ ID NO: 116848 - DNA, 75 bp, Artificial Sequence
  Synthetic
agggatcttcgggtggtccgctgctgtgtccctcgggtcacgctgtcggcatcttcaaggccgcagtgtgtaccc

SEQ ID NO: 116849 - DNA, 75 bp, Artificial Sequence
  Synthetic
tgtgcgcgcccacatactcctgcgcgcttgcctgcttgttcgtaggctagcgggggggaagtacatgcaggcgtg

SEQ ID NO: 116850 - DNA, 75 bp, Artificial Sequence
  Synthetic
cctgatctaggtgtcagggtttgcgagaagatggccctttatgacataacacagaagcttcccgtcgcggtgatg

SEQ ID NO: 116851 - DNA, 75 bp, Artificial Sequence
  Synthetic
cacccttcctcaggccgtgatgggctcctcatacggattccagtactctcctggacagcgggtcgagttcctggt

SEQ ID NO: 116852 - DNA, 75 bp, Artificial Sequence
  Synthetic
ccagtcctttcaggtagctcacctgcatgcccccactggcagcggcaagagcaccaaggtgccagccgcgtacgc

SEQ ID NO: 116853 - DNA, 75 bp, Artificial Sequence
  Synthetic
gcaccaaggtgccagccgcgtacgcggcacaagggtacaaggtgttggtgctcaatccctctgttgctgcaactt

SEQ ID NO: 116854 - DNA, 75 bp, Artificial Sequence
  Synthetic
cactcgctgctttgactccacagtgactgaaagagacatcagggtcgaggaggaggtctaacagtgttgtgacct

SEQ ID NO: 116855 - DNA, 75 bp, Artificial Sequence
  Synthetic
cactcgctgctttgactccacagtgactgaaagagacatcagggtcgaggaggaggtctatcagtgttgtgacct

SEQ ID NO: 116856 - DNA, 75 bp, Artificial Sequence
  Synthetic
cactcgctgctttgactccacagtgactgaaagagacatcagggtcgaggaggaggtctaccagtgttgtgacct

SEQ ID NO: 116857 - DNA, 75 bp, Artificial Sequence
  Synthetic
cactcgctgctttgactccacagtgactgaaagagacatcagggtcgaggaggaggtctagcagtgttgtgacct

SEQ ID NO: 116858 - DNA, 75 bp, Artificial Sequence
  Synthetic
ctatggcaagttcctcgccgatggcggatgctcagggggcgcctatgacataataatttgtgacgagtgccactc

SEQ ID NO: 116859 - DNA, 75 bp, Artificial Sequence
  Synthetic
aggtcgaaggggaggtacaggtggtctccacggctacccagtccttcctggcgacctccattaacggtgtcatgt

SEQ ID NO: 116860 - DNA, 75 bp, Artificial Sequence
  Synthetic
aggtcgaaggggaggttcaggtggtctccacggctacccagtccttcctggcgacctccattaacggtgtcatgt

SEQ ID NO: 116861 - DNA, 75 bp, Artificial Sequence
  Synthetic
aggtcgaaggggaggtccaggtggtctccacggctacccagtccttcctggcgacctccattaacggtgtcatgt

SEQ ID NO: 116862 - DNA, 75 bp, Artificial Sequence
  Synthetic
aggtcgaaggggaggtgcaggtggtctccacggctacccagtccttcctggcgacctccattaacggtgtcatgt

SEQ ID NO: 116863 - DNA, 75 bp, Artificial Sequence
  Synthetic
tccatcacggtgcctcacgccaatatcgaggaggtcgccctgtccaacaccggggaaatcccattctatggcaag

SEQ ID NO: 116864 - DNA, 75 bp, Artificial Sequence
  Synthetic
ctcaaagaagaaatgtgatgaactcgcctcgaagttggtcgccttaggcgtcaacgctgtggcttattatcgtgg

SEQ ID NO: 116865 - DNA, 75 bp, Artificial Sequence
  Synthetic
tgtaacacgtgtgtcacccaaacggtcgatttcagccttgatcctacctttaccattgagacaaccacggtgccg

SEQ ID NO: 116866 - DNA, 75 bp, Artificial Sequence
  Synthetic
gcgcgcgacgagaaagacctcggagcggtctcagccgcgtgggaggcgccaacctatccccaaggttaggcgcac

SEQ ID NO: 116867 - DNA, 75 bp, Artificial Sequence
  Synthetic
tcgactcatctgtcctctgtgagtgctatgacgcgggttgtgcttggtacgagctcactccagccgagaccacag

SEQ ID NO: 116868 - DNA, 75 bp, Artificial Sequence
  Synthetic
gcttatggcgttgagccgaatgtccggaccggggtcaggaccataactacagggggcgctatcacgtactccaca

SEQ ID NO: 116869 - DNA, 75 bp, Artificial Sequence
  Synthetic
atgagggccttggctgggcaggatggctcctgtccccccagggttctcgcccgtcttggggccccaccgaccccc

SEQ ID NO: 116870 - DNA, 75 bp, Artificial Sequence
  Synthetic
ccacttcctgtcccagacaaaacagagtggggaaaacttcccttacttggtagcgtaccaggcaaccgtgtgcgc

SEQ ID NO: 116871 - DNA, 75 bp, Artificial Sequence
  Synthetic
ttgcccggcaaccctgctgtggcgtctcttatggcgttcactgcttcagtcaccagtcccctgacgaccaaccaa

SEQ ID NO: 116872 - DNA, 75 bp, Artificial Sequence
  Synthetic
ccgtcgttggcggcccagtgggcggccttgccagggcgctggcgcatggcgtcagggtcgtggaggacgggataa

SEQ ID NO: 116873 - DNA, 75 bp, Artificial Sequence
  Synthetic
tcaatgcagcatccttggccgggacgcacggtcttgtatccttcctcgtgttcttctgctttgcgtggtatctga

SEQ ID NO: 116874 - DNA, 75 bp, Artificial Sequence
  Synthetic
gccccagagctcctctgcatttgtggtgagcggcttggctggcgctgccatagggggtataggcctaggcagggt

SEQ ID NO: 116875 - DNA, 75 bp, Artificial Sequence
  Synthetic
ggtgctgttcagaatgaagtcatcctgacgcaccccatcaccaaatacatcatgacatgcatgtctgctgaccta

SEQ ID NO: 116876 - DNA, 75 bp, Artificial Sequence
  Synthetic
tcaaagaagaagtgcgatgagctggccgggaaactgaagtcactcggcttaaacgccgtcgcattctacagaggt

SEQ ID NO: 116877 - DNA, 75 bp, Artificial Sequence
  Synthetic
cctctcggactcatacatggtgacaaatgattgctcgaacagcagcatcacttggcagctgcaggacgcggtctt

SEQ ID NO: 116878 - DNA, 75 bp, Artificial Sequence
  Synthetic
tgctgtccgggaaaccggcggtgatacccgacagggaggtcctttaccgggagttcgatgaaatggaggagtgct

SEQ ID NO: 116879 - DNA, 75 bp, Artificial Sequence
  Synthetic
gtaacgtagccgtgacacaggtggtggatttcagcttggacccaacattttccatagagactaccaccgtccctc

SEQ ID NO: 116880 - DNA, 75 bp, Artificial Sequence
  Synthetic
accgcgggcctcaggacccacgtggacgtcatcgtaatgtccgctgcgctctgctctgcccttcatgtgggagat

SEQ ID NO: 116881 - DNA, 75 bp, Artificial Sequence
  Synthetic
tgcatctcggggcaaccacgtctcgccgacgcattatgttcctgagagcgatgcagcgacaagggtcactgcact

SEQ ID NO: 116882 - DNA, 75 bp, Artificial Sequence
  Synthetic
catcacccccagcgtccaaaccaactggcaaaagctcgagacattctgggcaaaacacatgtggaactttatcag

SEQ ID NO: 116883 - DNA, 75 bp, Artificial Sequence
  Synthetic
tgacgggtcatcgcatggcatgggacatgatgatgaactggtctcccactgccaccatgatcatggcgtatgcca

SEQ ID NO: 116884 - DNA, 75 bp, Artificial Sequence
  Synthetic
aaccaaaccctcctattcaacatcctgggaggttgggtggccgcccagctcgctgcccctggtgccgccacagcc

SEQ ID NO: 116885 - DNA, 75 bp, Artificial Sequence
  Synthetic
ggcggttgttctcctcatggtagctggagttgagagcaacacccacactaccggctctatcgcggccgggcttac

SEQ ID NO: 116886 - DNA, 75 bp, Artificial Sequence
  Synthetic
ctctcgtagccttcaagatcatgagcggcgagaccccttccgccgaggacctggtcaacttgttgcctgccatct

SEQ ID NO: 116887 - DNA, 75 bp, Artificial Sequence
  Synthetic
cggatcagaggccttattgctggcattacgcgcctcgaccgtgtggtatcgtacccgcgtcgcaggtgtgtggtc

SEQ ID NO: 116888 - DNA, 75 bp, Artificial Sequence
  Synthetic
catagcgtatttctccatggtggggaactgggcgaaggtcctggtggtgctgttgctgtttgccggcgtcgatgc

SEQ ID NO: 116889 - DNA, 75 bp, Artificial Sequence
  Synthetic
aatgactccttgcagactggctttatcacagccttattttatgccaagagtatcaactcatctggatgccctgaa

SEQ ID NO: 116890 - DNA, 75 bp, Artificial Sequence
  Synthetic
tcgggggggtcggcaacaacaccttgacctgccccacggactgcttccggaagcaccccgaggccacttacacca

SEQ ID NO: 116891 - DNA, 75 bp, Artificial Sequence
  Synthetic
agcattcgcctcacggggaaaccacgtctctcccacacactatgtgcctgagagcgacgcagcagcccgcgtcac

SEQ ID NO: 116892 - DNA, 75 bp, Artificial Sequence
  Synthetic
cctggaccagaggccctactgctggcactacgcgcctcgaccgtgcggtattgtacccgcgtcacaggtgtgtgg

SEQ ID NO: 116893 - DNA, 75 bp, Artificial Sequence
  Synthetic
gctggcattacccgcctcgccagtgcgggatagtgccggctacctctgtctgcggcccggtctattgttttaccc

SEQ ID NO: 116894 - DNA, 75 bp, Artificial Sequence
  Synthetic
gatatctgggactggatttgtgaggtgctgaccgacttcaagacctggctcaaagctaagcttgcaccacacctg

SEQ ID NO: 116895 - DNA, 75 bp, Artificial Sequence
  Synthetic
cgataaggaaggtgttcccacttacacttggggggcaaatgagaccgacgtattcctcctcaacagcactaggcc

SEQ ID NO: 116896 - DNA, 75 bp, Artificial Sequence
  Synthetic
caacaggactgctctgaattgcaatgactccctccagactgggttcattgccgcgctgttctataagtacaagtt

SEQ ID NO: 116897 - DNA, 75 bp, Artificial Sequence
  Synthetic
gatgaatagcactgggttcaccaagacgtgtgggggccccccgtgtaaaatcgggggggttggcaacaacaccct

SEQ ID NO: 116898 - DNA, 75 bp, Artificial Sequence
  Synthetic
gacatgtcaaaaacgggacgatgaggatcgttggtcccaggacttgcaggaacacctggaatggaacgttcccca

SEQ ID NO: 116899 - DNA, 75 bp, Artificial Sequence
  Synthetic
agcgccgatcttctttgccccactgattgcttccgtaaacacccgcaggcgacctacgcaaaatgtgggtcaggg

SEQ ID NO: 116900 - DNA, 75 bp, Artificial Sequence
  Synthetic
gacctacgcaaaatgtgggtcagggccctggctcacccccaggtgcatggtcgaatacccctacaggttgtggca

SEQ ID NO: 116901 - DNA, 75 bp, Artificial Sequence
  Synthetic
gtggacgtgcaatacctgtacggtgtagggtcagcgtttgtctcctttgcaatcaaatgggagtacatcctgttg

SEQ ID NO: 116902 - DNA, 75 bp, Artificial Sequence
  Synthetic
gcaacaacaccttgcactgccccactgactgcttccgcaaacatccagaagccacatactctcggtgtggctccg

SEQ ID NO: 116903 - DNA, 75 bp, Artificial Sequence
  Synthetic
agtgggggacttccattatgtgacgggcatgacgactgacaacctgaaatgcccgtgtcaggtcccatcacccga

SEQ ID NO: 116904 - DNA, 75 bp, Artificial Sequence
  Synthetic
ggcatgacgactgacaacctgaaatgcccgtgtcaggtcccatcacccgaattcttcactgagctggacggggtg

SEQ ID NO: 116905 - DNA, 75 bp, Artificial Sequence
  Synthetic
cggtgcaggctacaagatcgggacaggagtcagattagcccattacttcactccaccacggaatgggccattcta

SEQ ID NO: 116906 - DNA, 75 bp, Artificial Sequence
  Synthetic
agaacaatccagctggatggctccaatgtggctgcggcgctagctgcgctagcggaaaaatcattcccgtccccg

SEQ ID NO: 116907 - DNA, 75 bp, Artificial Sequence
  Synthetic
taaccaggtatatggtaaaatgggagtggattatactcctcttccttcttctggctgatgccagaatctgcgcgt

SEQ ID NO: 116908 - DNA, 75 bp, Artificial Sequence
  Synthetic
cgtgttcgtccatgcctcctcttgagggggagccgggcgatccagacttgagctgtgactcctggtctactgtta

SEQ ID NO: 116909 - DNA, 75 bp, Artificial Sequence
  Synthetic
ctcccccgacgccgacctcattgaggccaacctcctatggaggcaggaaatgggcgggaacatcaccagggtgga

SEQ ID NO: 116910 - DNA, 75 bp, Artificial Sequence
  Synthetic
tatgctctttatggcgtatggccgctgctcctgctcttgctggcactaccaccacgagcatacgccatggaccgg

SEQ ID NO: 116911 - DNA, 75 bp, Artificial Sequence
  Synthetic
gctgatcgccttcttcattgctgcttggcacctcaaaggacgttttgtcccagcctgcacttactcactccttgg

SEQ ID NO: 116912 - DNA, 75 bp, Artificial Sequence
  Synthetic
caagccaaacttctccctcgcctgccggggatcccctttctctcgtgccaaacgggatataggggagtctgggca

SEQ ID NO: 116913 - DNA, 75 bp, Artificial Sequence
  Synthetic
cagcctgcacttactcactccttggcctatggtctttcctcctcctagtgatggccttgccccaacaggcttacg

SEQ ID NO: 116914 - DNA, 75 bp, Artificial Sequence
  Synthetic
aaaaggttccctacaccactgcccgtttgggcacggcccgattacaaccctccgctgctagagtcatggaagagg

SEQ ID NO: 116915 - DNA, 75 bp, Artificial Sequence
  Synthetic
ctatgatcttgcatttgcctggatgcttgccttgtgtgagggtcggcaatcagtccacctgctggcatgctgtgt

SEQ ID NO: 116916 - DNA, 75 bp, Artificial Sequence
  Synthetic
accctcgcagaggcaatggtccaggagtgggcacccccgctgcaggcacgaggaggccgcgacggtgtgatatgg

SEQ ID NO: 116917 - DNA, 75 bp, Artificial Sequence
  Synthetic
atccacctccaccagaacatcgtggacgtgcaatacttgtacggggtggggtcgagcattgtgtcctgggccatc

SEQ ID NO: 116918 - DNA, 75 bp, Artificial Sequence
  Synthetic
caactgttcactttctcccccaggcgccactggacaacgcaagactgcaactgttccatctaccccggccatata

SEQ ID NO: 116919 - DNA, 75 bp, Artificial Sequence
  Synthetic
aatcaactgtgtcttctgctctggctgagctcgcccacaggtcttttccaagctcgtcgacatctggcattgtgg

SEQ ID NO: 116920 - DNA, 75 bp, Artificial Sequence
  Synthetic
cctgctcctgctggcgttaccaccacgagcatacgccatggaccgggagatggccgcatcgtgcggaggcgcggt

SEQ ID NO: 116921 - DNA, 75 bp, Artificial Sequence
  Synthetic
agtgggcacccccgctgcaggcacgaggaggccgcgacggtgtgatatggctagctgtcgttttcacgccgggcg

SEQ ID NO: 116922 - DNA, 75 bp, Artificial Sequence
  Synthetic
ccccatatttcgtgagagcgcaggccctattaaggatttgcgctctcgtgaagggggtcgtcggggggaagtacg

SEQ ID NO: 116923 - DNA, 75 bp, Artificial Sequence
  Synthetic
cctattaaggatttgcgctctcgtgaagggggtcgtcggggggaagtacgtccaagcatgcctcctaactctggg

SEQ ID NO: 116924 - DNA, 75 bp, Artificial Sequence
  Synthetic
tggggaccctgatctcagtgacggttcatggtcaacggttagcagcgaacaaggttcggaggatgttgtttgttg

SEQ ID NO: 116925 - DNA, 75 bp, Artificial Sequence
  Synthetic
aaggttcggaggatgttgtttgttgctcaatgtcctacacatggacaggcgcattggtcaccccatgcgccgcgg

SEQ ID NO: 116926 - DNA, 75 bp, Artificial Sequence
  Synthetic
tttagccccatggaaaagaaggtgataacctggggcgcggagaccgtggcctgtggtgacatcctacacggttta

SEQ ID NO: 116927 - DNA, 75 bp, Artificial Sequence
  Synthetic
ggcctactcggctgcatcatcactagcctcacaggccgggacaagaaccaggtcgagggggaggttcaggtggtt

SEQ ID NO: 116928 - DNA, 75 bp, Artificial Sequence
  Synthetic
ctgggcgcacaacggcctacgagatctggccgtggctgtagagccagtcaccttttcccagatggagaccaagct

SEQ ID NO: 116929 - DNA, 75 bp, Artificial Sequence
  Synthetic
agcagacccgaggggtgctgggtgccatcgttgtgagcctgacgggacgcgacaagaccgaccatgcgggtgaag

SEQ ID NO: 116930 - DNA, 75 bp, Artificial Sequence
  Synthetic
cccacaaattcaactcctcgggctgcccagagcggatggctgcgtgtaagcccctcgcggacttccggcaggggt

SEQ ID NO: 116931 - DNA, 75 bp, Artificial Sequence
  Synthetic
cacatggtgtcgaccctaatatcagaactggggtaaggaccatcaccacgggcgcccccatcacgtactccacct

SEQ ID NO: 116932 - DNA, 75 bp, Artificial Sequence
  Synthetic
ggggccaaataacctacaaagtcaacatctcgggcccctctgacgaccgtccctactgttggcattacgctccta

SEQ ID NO: 116933 - DNA, 75 bp, Artificial Sequence
  Synthetic
ggctgagagtgatggcgtcgatgaggatagggcagccctgagagccttcacggaggctatgaccaggtattctgc

SEQ ID NO: 116934 - DNA, 75 bp, Artificial Sequence
  Synthetic
ggagtcatgtggacagtttatcacggagctgggtccaagacccttgctggacctaagggccccgttttacagatg

SEQ ID NO: 116935 - DNA, 75 bp, Artificial Sequence
  Synthetic
gtatgaggtagtaaaaaaactcccaacagccgtgatgggagatgcctacggatttcaatactcaccactgcagcg

SEQ ID NO: 116936 - DNA, 75 bp, Artificial Sequence
  Synthetic
ctaggaacgccgacgtcttgcccgcgcggaggcgcggggacaggcgaggggccctcttgtcacctaggcctttat

SEQ ID NO: 116937 - DNA, 75 bp, Artificial Sequence
  Synthetic
cgccatgtcagatagtcccaggagattacaacagctctgccaatgagcttttgtgccccaccgactgcttccgta

SEQ ID NO: 116938 - DNA, 75 bp, Artificial Sequence
  Synthetic
gcggtgggaatcttccgggccgcggtgtgttccaggggtgtggctaaggccatagacttcgtccctatcgagtcc

SEQ ID NO: 116939 - DNA, 75 bp, Artificial Sequence
  Synthetic
gcggtaagagcacgaaggtccccgcggcatacgccgcgcaaggatataaagtgctcgtgctcaacccatcggtgg

SEQ ID NO: 116940 - DNA, 75 bp, Artificial Sequence
  Synthetic
atactcaacctatggcaaattccttgctgatgggggttgttcgggaggggcgtatgacatcattatgtgtgacga

SEQ ID NO: 116941 - DNA, 75 bp, Artificial Sequence
  Synthetic
ctatgaccaggtactctgcgccccccggggacctccctcagccagaatacgacctcgagcacataacatcatgct

SEQ ID NO: 116942 - DNA, 75 bp, Artificial Sequence
  Synthetic
atcaggcagagaccgcgggggttaggctggtagtcttagcgaccgccactccccctggttccgttaccacgcccc

SEQ ID NO: 116943 - DNA, 75 bp, Artificial Sequence
  Synthetic
cttttgccattcaaagaagaagtgtgatgagctcgccgcggcgctgcggtccttgggagtaaacgcagtagcgta

SEQ ID NO: 116944 - DNA, 75 bp, Artificial Sequence
  Synthetic
tggtcgccacagatgctcttatgacaggtttttcagggaatttcgactccgtcattgattgtaatgtcgcggtca

SEQ ID NO: 116945 - DNA, 75 bp, Artificial Sequence
  Synthetic
tggctcctgtccccccggggctctcgcccttcgtggggccccactgacccccggcataggtcacgcaatttgggt

SEQ ID NO: 116946 - DNA, 75 bp, Artificial Sequence
  Synthetic
ggagtcagagacgtggcaggactgggcgaggtaggctcggcatttacagatatgtctcccagggcgaacgccctt

SEQ ID NO: 116947 - DNA, 75 bp, Artificial Sequence
  Synthetic
gacatatatcacagcgtgtcccgtgcccggccccgctggttcatctggtgcctactcctacttagcgtaggagta

SEQ ID NO: 116948 - DNA, 75 bp, Artificial Sequence
  Synthetic
gcgtgcgggtcctggaggacgggataaactacgcaacagggaatttacccggttgctctttctctatcttcttgc

SEQ ID NO: 116949 - DNA, 75 bp, Artificial Sequence
  Synthetic
cccctctctgactgggctagcgacggactgcgcgatctggcagttgcagtcgagccggtcattttctctcccatg

SEQ ID NO: 116950 - DNA, 75 bp, Artificial Sequence
  Synthetic
agaccaccgtcagactcagagcttatttcaatactcccggccttccggtatgccaggatcacctggagttctggg

SEQ ID NO: 116951 - DNA, 75 bp, Artificial Sequence
  Synthetic
tggctcttctctcttgcatcactgtgcccgtgtcagccgtgcaggtcaagaacaccagtcagtcctacatggtta

SEQ ID NO: 116952 - DNA, 75 bp, Artificial Sequence
  Synthetic
catacttagtggcctatcaggctaccgtgtgtgcaagagctcgcgctccacccccctcttgggacatcatgtgga

SEQ ID NO: 116953 - DNA, 75 bp, Artificial Sequence
  Synthetic
atgctggatcccggtcacgcctaacgtggccgttagccagcccggcgccctcactaaaggcttgcggacacacat

SEQ ID NO: 116954 - DNA, 75 bp, Artificial Sequence
  Synthetic
gttcgatgagatggaagagtgcgcctcacacctcccttacatcgaacaggggatgcagcttgccgagcaattcaa

SEQ ID NO: 116955 - DNA, 75 bp, Artificial Sequence
  Synthetic
caaatacatagccacctgcatgcaggctgatcttgaggtcctcaccagctcctgggtaatcgcgggaggagtcat

SEQ ID NO: 116956 - DNA, 75 bp, Artificial Sequence
  Synthetic
cagcaccattggtttgtccaggagtgcaattgctccatatacccaggccacatctcaggacatcgtatggcgtgg

SEQ ID NO: 116957 - DNA, 75 bp, Artificial Sequence
  Synthetic
ggtcatcgcccctgacaaggaggtcctctatgaggcttttgatgagatggaggagtgcgcaaacacggccacact

SEQ ID NO: 116958 - DNA, 75 bp, Artificial Sequence
  Synthetic
gtgtgatgtttggcctagcctacttctccatgcagggagcatggatgaaggtcatcgtcatccttctgctgactg

SEQ ID NO: 116959 - DNA, 75 bp, Artificial Sequence
  Synthetic
cgtaggcgccggcatcgccggtgcggccgttggcagtataggccttgggaaggtgcttgtggacatcctggcggg

SEQ ID NO: 116960 - DNA, 75 bp, Artificial Sequence
  Synthetic
cactcgtcctggcctaaacttgaacagttttgggccaaacacatgtggaacttcatcagtggcctccaatacctg

SEQ ID NO: 116961 - DNA, 75 bp, Artificial Sequence
  Synthetic
caacaccaacggcagctggcacatcaacagaacagccttgaactgtaatgacagcttacaaactggcttctttgc

SEQ ID NO: 116962 - DNA, 75 bp, Artificial Sequence
  Synthetic
agttttgggccaaacacatgtggaacttcatcagtggcctccaatacctggccggcctcacaacgctaccaggga

SEQ ID NO: 116963 - DNA, 75 bp, Artificial Sequence
  Synthetic
ctcccagatcgcacctccaacggcggctactggcttcgttgtcagcggcctcgtgggggcagcggtaggcagtgt

SEQ ID NO: 116964 - DNA, 75 bp, Artificial Sequence
  Synthetic
gagtatgatgagaatgtcaccaacagtgaggatacgaggccctactgctggcactacccacccaaacagtgtggc

SEQ ID NO: 116965 - DNA, 75 bp, Artificial Sequence
  Synthetic
ggtcatcgatacccttacgtgtggctttgccgacctcatggggtacatacccgttgtaggcgccccagttggtgg

SEQ ID NO: 116966 - DNA, 75 bp, Artificial Sequence
  Synthetic
gctttgccgacctcatggggtacatacccgtcgtgggcgcaccagttggtggcgtagccagggccctggcgcaag

SEQ ID NO: 116967 - DNA, 75 bp, Artificial Sequence
  Synthetic
gctttgccgacctcatggggtacatacccgtcgtgggcgcaccagttggtggcgtagccagggccctggcgcatg

SEQ ID NO: 116968 - DNA, 75 bp, Artificial Sequence
  Synthetic
gctttgccgacctcatggggtacatacccgtcgtgggcgcaccagttggtggcgtagccagggccctggcgcacg

SEQ ID NO: 116969 - DNA, 75 bp, Artificial Sequence
  Synthetic
gctttgccgacctcatggggtacatacccgtcgtgggcgcaccagttggtggcgtagccagggccctggcgcagg

SEQ ID NO: 116970 - DNA, 75 bp, Artificial Sequence
  Synthetic
gctttgccgacctcatggggtacatacccgtcgtgggcgcaccagttggtggcgttgccagggccctggcgcaag

SEQ ID NO: 116971 - DNA, 75 bp, Artificial Sequence
  Synthetic
gctttgccgacctcatggggtacatacccgtcgtgggcgcaccagttggtggcgttgccagggccctggcgcatg

SEQ ID NO: 116972 - DNA, 75 bp, Artificial Sequence
  Synthetic
gctttgccgacctcatggggtacatacccgtcgtgggcgcaccagttggtggcgttgccagggccctggcgcacg

SEQ ID NO: 116973 - DNA, 75 bp, Artificial Sequence
  Synthetic
gctttgccgacctcatggggtacatacccgtcgtgggcgcaccagttggtggcgttgccagggccctggcgcagg

SEQ ID NO: 116974 - DNA, 75 bp, Artificial Sequence
  Synthetic
gctttgccgacctcatggggtacatacccgtcgtgggcgcaccagttggtggcgtcgccagggccctggcgcaag

SEQ ID NO: 116975 - DNA, 75 bp, Artificial Sequence
  Synthetic
gctttgccgacctcatggggtacatacccgtcgtgggcgcaccagttggtggcgtcgccagggccctggcgcatg

SEQ ID NO: 116976 - DNA, 75 bp, Artificial Sequence
  Synthetic
gctttgccgacctcatggggtacatacccgtcgtgggcgcaccagttggtggcgtcgccagggccctggcgcacg

SEQ ID NO: 116977 - DNA, 75 bp, Artificial Sequence
  Synthetic
gctttgccgacctcatggggtacatacccgtcgtgggcgcaccagttggtggcgtcgccagggccctggcgcagg

SEQ ID NO: 116978 - DNA, 75 bp, Artificial Sequence
  Synthetic
gctttgccgacctcatggggtacatacccgtcgtgggcgcaccagttggtggcgtggccagggccctggcgcaag

SEQ ID NO: 116979 - DNA, 75 bp, Artificial Sequence
  Synthetic
gctttgccgacctcatggggtacatacccgtcgtgggcgcaccagttggtggcgtggccagggccctggcgcatg

SEQ ID NO: 116980 - DNA, 75 bp, Artificial Sequence
  Synthetic
gctttgccgacctcatggggtacatacccgtcgtgggcgcaccagttggtggcgtggccagggccctggcgcacg

SEQ ID NO: 116981 - DNA, 75 bp, Artificial Sequence
  Synthetic
gctttgccgacctcatggggtacatacccgtcgtgggcgcaccagttggtggcgtggccagggccctggcgcagg

SEQ ID NO: 116982 - DNA, 75 bp, Artificial Sequence
  Synthetic
gatcatgtccggcgaaaagcccaccatggaggatgtggtcaacatgttgcccgccatcctgtctccgggcgctct

SEQ ID NO: 116983 - DNA, 75 bp, Artificial Sequence
  Synthetic
ggggggagaatgagtcggatgtttttctattgaacagcactcgccccccaaagggcgcttggttcgggtgtacat

SEQ ID NO: 116984 - DNA, 75 bp, Artificial Sequence
  Synthetic
tgtggtgggagtcatctgcgcggccatacttcgcaggcatgtagggcagggggaaggtgcggtccaatggatgaa

SEQ ID NO: 116985 - DNA, 75 bp, Artificial Sequence
  Synthetic
gccagtgtctgctgtggaagttaggaacacatcaacgtcctacatggccacaaacgattgctccaacgatagcat

SEQ ID NO: 116986 - DNA, 75 bp, Artificial Sequence
  Synthetic
tgagtccctcaacactgggtggcttgccgcgctgatctacaaacacaagctcaatgcgtccgcatgcgaagagcg

SEQ ID NO: 116987 - DNA, 75 bp, Artificial Sequence
  Synthetic
ctttaggaagcatcccgatgccacctacctgaggtgtgggtccggaccctggctgacccccaagtgcctaatcga

SEQ ID NO: 116988 - DNA, 75 bp, Artificial Sequence
  Synthetic
cgctgtaaggcagcgcggtgctctcaccagaggcctgcgggcacacatcgacatggttgtgatgtctgccacact

SEQ ID NO: 116989 - DNA, 75 bp, Artificial Sequence
  Synthetic
tggttgcgtgacatctgggattgggtttgcactgtcctctctgacttcaagacctggctgtcggccaagctcctc

SEQ ID NO: 116990 - DNA, 75 bp, Artificial Sequence
  Synthetic
gtggccgtgagggagcgcggtgccctcaccaagggtttgagaacgcacatcgataccgttgtcatgtcagctaca

SEQ ID NO: 116991 - DNA, 75 bp, Artificial Sequence
  Synthetic
ccatgccaggttccggcccccgaattcttcacggaagtggatggggtgcggttgcacaggtacgctccggcgtgc

SEQ ID NO: 116992 - DNA, 75 bp, Artificial Sequence
  Synthetic
tgcaacttcactcgcggagaccgctgcaacttggacgacagggacagaagccaactgagtccactgctgcactcc

SEQ ID NO: 116993 - DNA, 75 bp, Artificial Sequence
  Synthetic
aactgctccatctacccaggtcatgtaacgggacaccgcatggcgtgggatatgatgatgaactggtcaccaaca

SEQ ID NO: 116994 - DNA, 75 bp, Artificial Sequence
  Synthetic
gcaactgttccatataccctggccatgtcacgggccaccgtatggcctgggatatgatgatgaattggtctccta

SEQ ID NO: 116995 - DNA, 75 bp, Artificial Sequence
  Synthetic
tgtatggcctgtcaccggccatcacgaagtacattgtgaggtgggagtgggtcgttctcctcttcctactcctag

SEQ ID NO: 116996 - DNA, 75 bp, Artificial Sequence
  Synthetic
agggccctgcgctcccaggcctcctcccaactacaagaccgctatatggagggtggcagcgcgggactacgctga

SEQ ID NO: 116997 - DNA, 75 bp, Artificial Sequence
  Synthetic
gcccgaaccggacgtaacagtgcttacttccatgctcaccgatccctcccacattacagcagagacggctaagcg

SEQ ID NO: 116998 - DNA, 75 bp, Artificial Sequence
  Synthetic
ttccatgcaaggggcgtgggccaaggtcattgtcatcctcttactgatggctggagttgaaggcaccaccatgac

SEQ ID NO: 116999 - DNA, 75 bp, Artificial Sequence
  Synthetic
aagctgtcacggatttctctggtttgccgtgttcttcgtggcggcgtggtacatcaagggccgagcggttccaat

SEQ ID NO: 117000 - DNA, 75 bp, Artificial Sequence
  Synthetic
gatggggtgcaaatccatagattcgcgccccccccagggcccttctttcgtgacgaagtcaacttcagtgtgggg

SEQ ID NO: 117001 - DNA, 75 bp, Artificial Sequence
  Synthetic
ttcggacctcagcagaagcttcaactaatcaataccaatggcagttggcacataaaccgcaccgccctcaattgc

SEQ ID NO: 117002 - DNA, 75 bp, Artificial Sequence
  Synthetic
cgccccccccagggcccttctttcgtgacgaagtcaacttcagtgtggggctgcactcatacgtggtgggatcgc

SEQ ID NO: 117003 - DNA, 75 bp, Artificial Sequence
  Synthetic
cacatcaataggactgccctgaattgtaatgattccctgcacacgggcttcattgcttctctcttctatgtccaa

SEQ ID NO: 117004 - DNA, 75 bp, Artificial Sequence
  Synthetic
gacctgcatgtccgcggatttggaggttatcaccagcacatgggtcctcgtgggtggggtcctagccgcgctcgc

SEQ ID NO: 117005 - DNA, 75 bp, Artificial Sequence
  Synthetic
ggtatttcattgctgataattatatctctctttacgcttaccccagcgtataagaccctgctcagcaagagtttg

SEQ ID NO: 117006 - DNA, 75 bp, Artificial Sequence
  Synthetic
ggtccttccgggtgggatggggtgctctcacccatgaagagaatgttaccaatgatgaggacatgaggccctatt

SEQ ID NO: 117007 - DNA, 75 bp, Artificial Sequence
  Synthetic
aagctgctgctaggcgcctagcgaggggcacggctccctcagaagctagctcctcagccagtcagctgtcggctc

SEQ ID NO: 117008 - DNA, 75 bp, Artificial Sequence
  Synthetic
gggcacggctccctcagaagctagctcctcagccagtcagctgtcggctccttcactcaaggccagctgcaccca

SEQ ID NO: 117009 - DNA, 75 bp, Artificial Sequence
  Synthetic
ccaaccctgaggatatgagaccttattgctggcattaccctcctaagccgtgcggcatagtgcccgcaagcaccg

SEQ ID NO: 117010 - DNA, 75 bp, Artificial Sequence
  Synthetic
tctcacccatgaagagaatgttaccaatgatgaggacatgaggccctattgctggcactacccgcctaaaccatg

SEQ ID NO: 117011 - DNA, 75 bp, Artificial Sequence
  Synthetic
tgactatggtctggccacatgtggtttttgatgtgaccaagtggttgctggcaattctgggacctggcttcctcc

SEQ ID NO: 117012 - DNA, 75 bp, Artificial Sequence
  Synthetic
ccagcccggtggtcgtgggcacgaccgacaggcttggggtgcctacctacacctggggggagaatgagacagacg

SEQ ID NO: 117013 - DNA, 75 bp, Artificial Sequence
  Synthetic
tcctttgacccgcctagcggtgaggaggacgagcgggggccttccattccatcggaatacttgctccccaggaag

SEQ ID NO: 117014 - DNA, 75 bp, Artificial Sequence
  Synthetic
cgtgtttctgttgaacagcactagaccgccacagggcgcatggtttggttgttcctggatgaacggcaccgggtt

SEQ ID NO: 117015 - DNA, 75 bp, Artificial Sequence
  Synthetic
gatgctgctcatcacccttggtaagtggactggtacatacatttatgaccatctttcccctatgtcgggctgggc

SEQ ID NO: 117016 - DNA, 75 bp, Artificial Sequence
  Synthetic
ccgcattaggccggactttaacgccagtgtggatttactgtgccccacggactgcttcagaaaacatcctgaggc

SEQ ID NO: 117017 - DNA, 75 bp, Artificial Sequence
  Synthetic
tcctgctcctgctggcgttaccaccacgggcttatgctatggaccgagagatggccgcatcgtgcgggggcgtag

SEQ ID NO: 117018 - DNA, 75 bp, Artificial Sequence
  Synthetic
gccacttacaccaagtgtggtgctggaccctggctaactcctagatgcttggtacactacccctatcggctgtgg

SEQ ID NO: 117019 - DNA, 75 bp, Artificial Sequence
  Synthetic
ggtgacatcattcatgggctgcctgtttctgctcggctgggccgtgaagtcctattagggcccgccgatgagtac

SEQ ID NO: 117020 - DNA, 75 bp, Artificial Sequence
  Synthetic
ggtgacatcattcatgggctgcctgtttctgctcggctgggccgtgaagtccttttagggcccgccgatgagtac

SEQ ID NO: 117021 - DNA, 75 bp, Artificial Sequence
  Synthetic
ggtgacatcattcatgggctgcctgtttctgctcggctgggccgtgaagtcctcttagggcccgccgatgagtac

SEQ ID NO: 117022 - DNA, 75 bp, Artificial Sequence
  Synthetic
ggtgacatcattcatgggctgcctgtttctgctcggctgggccgtgaagtcctgttagggcccgccgatgagtac

SEQ ID NO: 117023 - DNA, 75 bp, Artificial Sequence
  Synthetic
atcttcaaggtacgcatgtacgtggggggagttgagcacaggctggaagcggcatgcaacttcacccgtggggat

SEQ ID NO: 117024 - DNA, 75 bp, Artificial Sequence
  Synthetic
caagctctccccactacagattccggactctcgtctgaggacagcaaccaggcagtgcccacagagccacgctct

SEQ ID NO: 117025 - DNA, 75 bp, Artificial Sequence
  Synthetic
accgctgcaatcttgaggacagggataggagtcagctcagtcccctacttcattccaccactgagtgggccatat

SEQ ID NO: 117026 - DNA, 75 bp, Artificial Sequence
  Synthetic
gttccgaaaccgaagactcagtcgtgtgctgttccatgtcctattcttggaccggggcgctgataacaccatgca

SEQ ID NO: 117027 - DNA, 75 bp, Artificial Sequence
  Synthetic
agacggagcaagctggggaggttcaagtcctttccacagtcacacagtccttccttggaacttctatctcagggg

SEQ ID NO: 117028 - DNA, 75 bp, Artificial Sequence
  Synthetic
agacggagcaagctggggaggttcaagtcctttccacagtcactcagtccttccttggaacttctatctcagggg

SEQ ID NO: 117029 - DNA, 75 bp, Artificial Sequence
  Synthetic
agacggagcaagctggggaggttcaagtcctttccacagtcacccagtccttccttggaacttctatctcagggg

SEQ ID NO: 117030 - DNA, 75 bp, Artificial Sequence
  Synthetic
agacggagcaagctggggaggttcaagtcctttccacagtcacgcagtccttccttggaacttctatctcagggg

SEQ ID NO: 117031 - DNA, 75 bp, Artificial Sequence
  Synthetic
cattgtcaacaggccttctgcacctccaccagaacatcgtggacgtgcagtacttgtacggcctgtcgccagcca

SEQ ID NO: 117032 - DNA, 75 bp, Artificial Sequence
  Synthetic
ttacaaaatatatggtcaaatgggagtgggtggtcctcctcttcttgctcctcgcggacgccagagtctgcgctt

SEQ ID NO: 117033 - DNA, 75 bp, Artificial Sequence
  Synthetic
catcagcaagtacatggttacgtgggagtggttggtactcctattcctgctgatagcagacgcccggatatgcgc

SEQ ID NO: 117034 - DNA, 75 bp, Artificial Sequence
  Synthetic
catcagcaagtacatggttacgtgggagtggttggtactcctattcctgctgatagctgacgcccggatatgcgc

SEQ ID NO: 117035 - DNA, 75 bp, Artificial Sequence
  Synthetic
catcagcaagtacatggttacgtgggagtggttggtactcctattcctgctgatagccgacgcccggatatgcgc

SEQ ID NO: 117036 - DNA, 75 bp, Artificial Sequence
  Synthetic
catcagcaagtacatggttacgtgggagtggttggtactcctattcctgctgatagcggacgcccggatatgcgc

SEQ ID NO: 117037 - DNA, 75 bp, Artificial Sequence
  Synthetic
catcagcaagtacatggttacgtgggagtggttggtactccttttcctgctgatagcagacgcccggatatgcgc

SEQ ID NO: 117038 - DNA, 75 bp, Artificial Sequence
  Synthetic
catcagcaagtacatggttacgtgggagtggttggtactccttttcctgctgatagctgacgcccggatatgcgc

SEQ ID NO: 117039 - DNA, 75 bp, Artificial Sequence
  Synthetic
catcagcaagtacatggttacgtgggagtggttggtactccttttcctgctgatagccgacgcccggatatgcgc

SEQ ID NO: 117040 - DNA, 75 bp, Artificial Sequence
  Synthetic
catcagcaagtacatggttacgtgggagtggttggtactccttttcctgctgatagcggacgcccggatatgcgc

SEQ ID NO: 117041 - DNA, 75 bp, Artificial Sequence
  Synthetic
catcagcaagtacatggttacgtgggagtggttggtactcctcttcctgctgatagcagacgcccggatatgcgc

SEQ ID NO: 117042 - DNA, 75 bp, Artificial Sequence
  Synthetic
catcagcaagtacatggttacgtgggagtggttggtactcctcttcctgctgatagctgacgcccggatatgcgc

SEQ ID NO: 117043 - DNA, 75 bp, Artificial Sequence
  Synthetic
catcagcaagtacatggttacgtgggagtggttggtactcctcttcctgctgatagccgacgcccggatatgcgc

SEQ ID NO: 117044 - DNA, 75 bp, Artificial Sequence
  Synthetic
catcagcaagtacatggttacgtgggagtggttggtactcctcttcctgctgatagcggacgcccggatatgcgc

SEQ ID NO: 117045 - DNA, 75 bp, Artificial Sequence
  Synthetic
catcagcaagtacatggttacgtgggagtggttggtactcctgttcctgctgatagcagacgcccggatatgcgc

SEQ ID NO: 117046 - DNA, 75 bp, Artificial Sequence
  Synthetic
catcagcaagtacatggttacgtgggagtggttggtactcctgttcctgctgatagctgacgcccggatatgcgc

SEQ ID NO: 117047 - DNA, 75 bp, Artificial Sequence
  Synthetic
catcagcaagtacatggttacgtgggagtggttggtactcctgttcctgctgatagccgacgcccggatatgcgc

SEQ ID NO: 117048 - DNA, 75 bp, Artificial Sequence
  Synthetic
catcagcaagtacatggttacgtgggagtggttggtactcctgttcctgctgatagcggacgcccggatatgcgc

SEQ ID NO: 117049 - DNA, 75 bp, Artificial Sequence
  Synthetic
catcagcaagtacatggttacgtgggagtggttggttctcctattcctgctgatagcagacgcccggatatgcgc

SEQ ID NO: 117050 - DNA, 75 bp, Artificial Sequence
  Synthetic
catcagcaagtacatggttacgtgggagtggttggttctcctattcctgctgatagctgacgcccggatatgcgc

SEQ ID NO: 117051 - DNA, 75 bp, Artificial Sequence
  Synthetic
catcagcaagtacatggttacgtgggagtggttggttctcctattcctgctgatagccgacgcccggatatgcgc

SEQ ID NO: 117052 - DNA, 75 bp, Artificial Sequence
  Synthetic
catcagcaagtacatggttacgtgggagtggttggttctcctattcctgctgatagcggacgcccggatatgcgc

SEQ ID NO: 117053 - DNA, 75 bp, Artificial Sequence
  Synthetic
catcagcaagtacatggttacgtgggagtggttggttctccttttcctgctgatagcagacgcccggatatgcgc

SEQ ID NO: 117054 - DNA, 75 bp, Artificial Sequence
  Synthetic
catcagcaagtacatggttacgtgggagtggttggttctccttttcctgctgatagctgacgcccggatatgcgc

SEQ ID NO: 117055 - DNA, 75 bp, Artificial Sequence
  Synthetic
catcagcaagtacatggttacgtgggagtggttggttctccttttcctgctgatagccgacgcccggatatgcgc

SEQ ID NO: 117056 - DNA, 75 bp, Artificial Sequence
  Synthetic
catcagcaagtacatggttacgtgggagtggttggttctccttttcctgctgatagcggacgcccggatatgcgc

SEQ ID NO: 117057 - DNA, 75 bp, Artificial Sequence
  Synthetic
catcagcaagtacatggttacgtgggagtggttggttctcctcttcctgctgatagcagacgcccggatatgcgc

SEQ ID NO: 117058 - DNA, 75 bp, Artificial Sequence
  Synthetic
catcagcaagtacatggttacgtgggagtggttggttctcctcttcctgctgatagctgacgcccggatatgcgc

SEQ ID NO: 117059 - DNA, 75 bp, Artificial Sequence
  Synthetic
catcagcaagtacatggttacgtgggagtggttggttctcctcttcctgctgatagccgacgcccggatatgcgc

SEQ ID NO: 117060 - DNA, 75 bp, Artificial Sequence
  Synthetic
catcagcaagtacatggttacgtgggagtggttggttctcctcttcctgctgatagcggacgcccggatatgcgc

SEQ ID NO: 117061 - DNA, 75 bp, Artificial Sequence
  Synthetic
catcagcaagtacatggttacgtgggagtggttggttctcctgttcctgctgatagcagacgcccggatatgcgc

SEQ ID NO: 117062 - DNA, 75 bp, Artificial Sequence
  Synthetic
catcagcaagtacatggttacgtgggagtggttggttctcctgttcctgctgatagctgacgcccggatatgcgc

SEQ ID NO: 117063 - DNA, 75 bp, Artificial Sequence
  Synthetic
catcagcaagtacatggttacgtgggagtggttggttctcctgttcctgctgatagccgacgcccggatatgcgc

SEQ ID NO: 117064 - DNA, 75 bp, Artificial Sequence
  Synthetic
catcagcaagtacatggttacgtgggagtggttggttctcctgttcctgctgatagcggacgcccggatatgcgc

SEQ ID NO: 117065 - DNA, 75 bp, Artificial Sequence
  Synthetic
catcagcaagtacatggttacgtgggagtggttggtcctcctattcctgctgatagcagacgcccggatatgcgc

SEQ ID NO: 117066 - DNA, 75 bp, Artificial Sequence
  Synthetic
catcagcaagtacatggttacgtgggagtggttggtcctcctattcctgctgatagctgacgcccggatatgcgc

SEQ ID NO: 117067 - DNA, 75 bp, Artificial Sequence
  Synthetic
catcagcaagtacatggttacgtgggagtggttggtcctcctattcctgctgatagccgacgcccggatatgcgc

SEQ ID NO: 117068 - DNA, 75 bp, Artificial Sequence
  Synthetic
catcagcaagtacatggttacgtgggagtggttggtcctcctattcctgctgatagcggacgcccggatatgcgc

SEQ ID NO: 117069 - DNA, 75 bp, Artificial Sequence
  Synthetic
catcagcaagtacatggttacgtgggagtggttggtcctccttttcctgctgatagcagacgcccggatatgcgc

SEQ ID NO: 117070 - DNA, 75 bp, Artificial Sequence
  Synthetic
catcagcaagtacatggttacgtgggagtggttggtcctccttttcctgctgatagctgacgcccggatatgcgc

SEQ ID NO: 117071 - DNA, 75 bp, Artificial Sequence
  Synthetic
catcagcaagtacatggttacgtgggagtggttggtcctccttttcctgctgatagccgacgcccggatatgcgc

SEQ ID NO: 117072 - DNA, 75 bp, Artificial Sequence
  Synthetic
catcagcaagtacatggttacgtgggagtggttggtcctccttttcctgctgatagcggacgcccggatatgcgc

SEQ ID NO: 117073 - DNA, 75 bp, Artificial Sequence
  Synthetic
catcagcaagtacatggttacgtgggagtggttggtcctcctcttcctgctgatagcagacgcccggatatgcgc

SEQ ID NO: 117074 - DNA, 75 bp, Artificial Sequence
  Synthetic
catcagcaagtacatggttacgtgggagtggttggtcctcctcttcctgctgatagctgacgcccggatatgcgc

SEQ ID NO: 117075 - DNA, 75 bp, Artificial Sequence
  Synthetic
catcagcaagtacatggttacgtgggagtggttggtcctcctcttcctgctgatagccgacgcccggatatgcgc

SEQ ID NO: 117076 - DNA, 75 bp, Artificial Sequence
  Synthetic
catcagcaagtacatggttacgtgggagtggttggtcctcctcttcctgctgatagcggacgcccggatatgcgc

SEQ ID NO: 117077 - DNA, 75 bp, Artificial Sequence
  Synthetic
catcagcaagtacatggttacgtgggagtggttggtcctcctgttcctgctgatagcagacgcccggatatgcgc

SEQ ID NO: 117078 - DNA, 75 bp, Artificial Sequence
  Synthetic
catcagcaagtacatggttacgtgggagtggttggtcctcctgttcctgctgatagctgacgcccggatatgcgc

SEQ ID NO: 117079 - DNA, 75 bp, Artificial Sequence
  Synthetic
catcagcaagtacatggttacgtgggagtggttggtcctcctgttcctgctgatagccgacgcccggatatgcgc

SEQ ID NO: 117080 - DNA, 75 bp, Artificial Sequence
  Synthetic
catcagcaagtacatggttacgtgggagtggttggtcctcctgttcctgctgatagcggacgcccggatatgcgc

SEQ ID NO: 117081 - DNA, 75 bp, Artificial Sequence
  Synthetic
catcagcaagtacatggttacgtgggagtggttggtgctcctattcctgctgatagcagacgcccggatatgcgc

SEQ ID NO: 117082 - DNA, 75 bp, Artificial Sequence
  Synthetic
catcagcaagtacatggttacgtgggagtggttggtgctcctattcctgctgatagctgacgcccggatatgcgc

SEQ ID NO: 117083 - DNA, 75 bp, Artificial Sequence
  Synthetic
catcagcaagtacatggttacgtgggagtggttggtgctcctattcctgctgatagccgacgcccggatatgcgc

SEQ ID NO: 117084 - DNA, 75 bp, Artificial Sequence
  Synthetic
catcagcaagtacatggttacgtgggagtggttggtgctcctattcctgctgatagcggacgcccggatatgcgc

SEQ ID NO: 117085 - DNA, 75 bp, Artificial Sequence
  Synthetic
catcagcaagtacatggttacgtgggagtggttggtgctccttttcctgctgatagcagacgcccggatatgcgc

SEQ ID NO: 117086 - DNA, 75 bp, Artificial Sequence
  Synthetic
catcagcaagtacatggttacgtgggagtggttggtgctccttttcctgctgatagctgacgcccggatatgcgc

SEQ ID NO: 117087 - DNA, 75 bp, Artificial Sequence
  Synthetic
catcagcaagtacatggttacgtgggagtggttggtgctccttttcctgctgatagccgacgcccggatatgcgc

SEQ ID NO: 117088 - DNA, 75 bp, Artificial Sequence
  Synthetic
catcagcaagtacatggttacgtgggagtggttggtgctccttttcctgctgatagcggacgcccggatatgcgc

SEQ ID NO: 117089 - DNA, 75 bp, Artificial Sequence
  Synthetic
catcagcaagtacatggttacgtgggagtggttggtgctcctcttcctgctgatagcagacgcccggatatgcgc

SEQ ID NO: 117090 - DNA, 75 bp, Artificial Sequence
  Synthetic
catcagcaagtacatggttacgtgggagtggttggtgctcctcttcctgctgatagctgacgcccggatatgcgc

SEQ ID NO: 117091 - DNA, 75 bp, Artificial Sequence
  Synthetic
catcagcaagtacatggttacgtgggagtggttggtgctcctcttcctgctgatagccgacgcccggatatgcgc

SEQ ID NO: 117092 - DNA, 75 bp, Artificial Sequence
  Synthetic
catcagcaagtacatggttacgtgggagtggttggtgctcctcttcctgctgatagcggacgcccggatatgcgc

SEQ ID NO: 117093 - DNA, 75 bp, Artificial Sequence
  Synthetic
catcagcaagtacatggttacgtgggagtggttggtgctcctgttcctgctgatagcagacgcccggatatgcgc

SEQ ID NO: 117094 - DNA, 75 bp, Artificial Sequence
  Synthetic
catcagcaagtacatggttacgtgggagtggttggtgctcctgttcctgctgatagctgacgcccggatatgcgc

SEQ ID NO: 117095 - DNA, 75 bp, Artificial Sequence
  Synthetic
catcagcaagtacatggttacgtgggagtggttggtgctcctgttcctgctgatagccgacgcccggatatgcgc

SEQ ID NO: 117096 - DNA, 75 bp, Artificial Sequence
  Synthetic
catcagcaagtacatggttacgtgggagtggttggtgctcctgttcctgctgatagcggacgcccggatatgcgc

SEQ ID NO: 117097 - DNA, 75 bp, Artificial Sequence
  Synthetic
atggcctagccctccggggaccaagtccctggacccctgcacctgtggagctgtcgacctctaccttgtcacccg

SEQ ID NO: 117098 - DNA, 75 bp, Artificial Sequence
  Synthetic
ggccaaaaaggtaacatttgaccgggtccagatgcttgactcacattatgagacagtcctacaggacgttacgca

SEQ ID NO: 117099 - DNA, 75 bp, Artificial Sequence
  Synthetic
gtttgttatctttttcatagccgcctggtacatcaaaggtagggcagttcccatggccacctactccctcctagg

SEQ ID NO: 117100 - DNA, 75 bp, Artificial Sequence
  Synthetic
tggttcatccttttcttcatagcggcttggtatttcaagggtagggtggtccccttgacaacttactcccttttt

SEQ ID NO: 117101 - DNA, 75 bp, Artificial Sequence
  Synthetic
gtcctctgcccccgggggcatgccgttgggattttccgtgcggcggtgtgttccaggggggtcgcgaagtccatt

SEQ ID NO: 117102 - DNA, 75 bp, Artificial Sequence
  Synthetic
gatgtccgcggcttatccaggcgggccgttaaccacatcaagtccgtgtgggaggaccttctggaagactcaagc

SEQ ID NO: 117103 - DNA, 75 bp, Artificial Sequence
  Synthetic
ataacacttttcacattgaccccggcctacaaaaatctcatctgttactgcttgtggtggctgtgctacctcctg

SEQ ID NO: 117104 - DNA, 75 bp, Artificial Sequence
  Synthetic
tcataaccgtcttcactctcactccagcttacaaggagatgctcgcccgtagtgtttggtggctctgctaccttt

SEQ ID NO: 117105 - DNA, 75 bp, Artificial Sequence
  Synthetic
ttggcgtgagggtatgcgagaagcgagccctctacgacatagcccagaagttaccccaagccatcatgggagctt

SEQ ID NO: 117106 - DNA, 75 bp, Artificial Sequence
  Synthetic
acctccacgcccccaccggtagtgggaagagcactaaggtccccgcctcatatgctgctcaggggtataaggtac

SEQ ID NO: 117107 - DNA, 75 bp, Artificial Sequence
  Synthetic
gaagagcactaaggtccccgcctcatatgctgctcaggggtataaggtactggtactgaacccctccgtggctgc

SEQ ID NO: 117108 - DNA, 75 bp, Artificial Sequence
  Synthetic
tggtgtttgacatcaccaaatggctcctggcgatccttggacctggctacctcctcaagggggttttgttgcaga

SEQ ID NO: 117109 - DNA, 75 bp, Artificial Sequence
  Synthetic
tatagtgtttgacatcactaaatggcttatagcggtgcttggacccgcctacctcctgcgagaggccttgctgca

SEQ ID NO: 117110 - DNA, 75 bp, Artificial Sequence
  Synthetic
tatagtgtttgacatcactaaatggcttattgcggtgcttggacccgcctacctcctgcgagaggccttgctgca

SEQ ID NO: 117111 - DNA, 75 bp, Artificial Sequence
  Synthetic
tatagtgtttgacatcactaaatggcttatcgcggtgcttggacccgcctacctcctgcgagaggccttgctgca

SEQ ID NO: 117112 - DNA, 75 bp, Artificial Sequence
  Synthetic
tatagtgtttgacatcactaaatggcttatggcggtgcttggacccgcctacctcctgcgagaggccttgctgca

SEQ ID NO: 117113 - DNA, 75 bp, Artificial Sequence
  Synthetic
tatagtgtttgacatcactaaatggcttttagcggtgcttggacccgcctacctcctgcgagaggccttgctgca

SEQ ID NO: 117114 - DNA, 75 bp, Artificial Sequence
  Synthetic
tatagtgtttgacatcactaaatggctttttgcggtgcttggacccgcctacctcctgcgagaggccttgctgca

SEQ ID NO: 117115 - DNA, 75 bp, Artificial Sequence
  Synthetic
tatagtgtttgacatcactaaatggcttttcgcggtgcttggacccgcctacctcctgcgagaggccttgctgca

SEQ ID NO: 117116 - DNA, 75 bp, Artificial Sequence
  Synthetic
tatagtgtttgacatcactaaatggcttttggcggtgcttggacccgcctacctcctgcgagaggccttgctgca

SEQ ID NO: 117117 - DNA, 75 bp, Artificial Sequence
  Synthetic
tatagtgtttgacatcactaaatggcttctagcggtgcttggacccgcctacctcctgcgagaggccttgctgca

SEQ ID NO: 117118 - DNA, 75 bp, Artificial Sequence
  Synthetic
tatagtgtttgacatcactaaatggcttcttgcggtgcttggacccgcctacctcctgcgagaggccttgctgca

SEQ ID NO: 117119 - DNA, 75 bp, Artificial Sequence
  Synthetic
tatagtgtttgacatcactaaatggcttctcgcggtgcttggacccgcctacctcctgcgagaggccttgctgca

SEQ ID NO: 117120 - DNA, 75 bp, Artificial Sequence
  Synthetic
tatagtgtttgacatcactaaatggcttctggcggtgcttggacccgcctacctcctgcgagaggccttgctgca

SEQ ID NO: 117121 - DNA, 75 bp, Artificial Sequence
  Synthetic
tatagtgtttgacatcactaaatggcttgtagcggtgcttggacccgcctacctcctgcgagaggccttgctgca

SEQ ID NO: 117122 - DNA, 75 bp, Artificial Sequence
  Synthetic
tatagtgtttgacatcactaaatggcttgttgcggtgcttggacccgcctacctcctgcgagaggccttgctgca

SEQ ID NO: 117123 - DNA, 75 bp, Artificial Sequence
  Synthetic
tatagtgtttgacatcactaaatggcttgtcgcggtgcttggacccgcctacctcctgcgagaggccttgctgca

SEQ ID NO: 117124 - DNA, 75 bp, Artificial Sequence
  Synthetic
tatagtgtttgacatcactaaatggcttgtggcggtgcttggacccgcctacctcctgcgagaggccttgctgca

SEQ ID NO: 117125 - DNA, 75 bp, Artificial Sequence
  Synthetic
tttagtgtttgacatcactaaatggcttatagcggtgcttggacccgcctacctcctgcgagaggccttgctgca

SEQ ID NO: 117126 - DNA, 75 bp, Artificial Sequence
  Synthetic
tttagtgtttgacatcactaaatggcttattgcggtgcttggacccgcctacctcctgcgagaggccttgctgca

SEQ ID NO: 117127 - DNA, 75 bp, Artificial Sequence
  Synthetic
tttagtgtttgacatcactaaatggcttatcgcggtgcttggacccgcctacctcctgcgagaggccttgctgca

SEQ ID NO: 117128 - DNA, 75 bp, Artificial Sequence
  Synthetic
tttagtgtttgacatcactaaatggcttatggcggtgcttggacccgcctacctcctgcgagaggccttgctgca

SEQ ID NO: 117129 - DNA, 75 bp, Artificial Sequence
  Synthetic
tttagtgtttgacatcactaaatggcttttagcggtgcttggacccgcctacctcctgcgagaggccttgctgca

SEQ ID NO: 117130 - DNA, 75 bp, Artificial Sequence
  Synthetic
tttagtgtttgacatcactaaatggctttttgcggtgcttggacccgcctacctcctgcgagaggccttgctgca

SEQ ID NO: 117131 - DNA, 75 bp, Artificial Sequence
  Synthetic
tttagtgtttgacatcactaaatggcttttcgcggtgcttggacccgcctacctcctgcgagaggccttgctgca

SEQ ID NO: 117132 - DNA, 75 bp, Artificial Sequence
  Synthetic
tttagtgtttgacatcactaaatggcttttggcggtgcttggacccgcctacctcctgcgagaggccttgctgca

SEQ ID NO: 117133 - DNA, 75 bp, Artificial Sequence
  Synthetic
tttagtgtttgacatcactaaatggcttctagcggtgcttggacccgcctacctcctgcgagaggccttgctgca

SEQ ID NO: 117134 - DNA, 75 bp, Artificial Sequence
  Synthetic
tttagtgtttgacatcactaaatggcttcttgcggtgcttggacccgcctacctcctgcgagaggccttgctgca

SEQ ID NO: 117135 - DNA, 75 bp, Artificial Sequence
  Synthetic
tttagtgtttgacatcactaaatggcttctcgcggtgcttggacccgcctacctcctgcgagaggccttgctgca

SEQ ID NO: 117136 - DNA, 75 bp, Artificial Sequence
  Synthetic
tttagtgtttgacatcactaaatggcttctggcggtgcttggacccgcctacctcctgcgagaggccttgctgca

SEQ ID NO: 117137 - DNA, 75 bp, Artificial Sequence
  Synthetic
tttagtgtttgacatcactaaatggcttgtagcggtgcttggacccgcctacctcctgcgagaggccttgctgca

SEQ ID NO: 117138 - DNA, 75 bp, Artificial Sequence
  Synthetic
tttagtgtttgacatcactaaatggcttgttgcggtgcttggacccgcctacctcctgcgagaggccttgctgca

SEQ ID NO: 117139 - DNA, 75 bp, Artificial Sequence
  Synthetic
tttagtgtttgacatcactaaatggcttgtcgcggtgcttggacccgcctacctcctgcgagaggccttgctgca

SEQ ID NO: 117140 - DNA, 75 bp, Artificial Sequence
  Synthetic
tttagtgtttgacatcactaaatggcttgtggcggtgcttggacccgcctacctcctgcgagaggccttgctgca

SEQ ID NO: 117141 - DNA, 75 bp, Artificial Sequence
  Synthetic
tctagtgtttgacatcactaaatggcttatagcggtgcttggacccgcctacctcctgcgagaggccttgctgca

SEQ ID NO: 117142 - DNA, 75 bp, Artificial Sequence
  Synthetic
tctagtgtttgacatcactaaatggcttattgcggtgcttggacccgcctacctcctgcgagaggccttgctgca

SEQ ID NO: 117143 - DNA, 75 bp, Artificial Sequence
  Synthetic
tctagtgtttgacatcactaaatggcttatcgcggtgcttggacccgcctacctcctgcgagaggccttgctgca

SEQ ID NO: 117144 - DNA, 75 bp, Artificial Sequence
  Synthetic
tctagtgtttgacatcactaaatggcttatggcggtgcttggacccgcctacctcctgcgagaggccttgctgca

SEQ ID NO: 117145 - DNA, 75 bp, Artificial Sequence
  Synthetic
tctagtgtttgacatcactaaatggcttttagcggtgcttggacccgcctacctcctgcgagaggccttgctgca

SEQ ID NO: 117146 - DNA, 75 bp, Artificial Sequence
  Synthetic
tctagtgtttgacatcactaaatggctttttgcggtgcttggacccgcctacctcctgcgagaggccttgctgca

SEQ ID NO: 117147 - DNA, 75 bp, Artificial Sequence
  Synthetic
tctagtgtttgacatcactaaatggcttttcgcggtgcttggacccgcctacctcctgcgagaggccttgctgca

SEQ ID NO: 117148 - DNA, 75 bp, Artificial Sequence
  Synthetic
tctagtgtttgacatcactaaatggcttttggcggtgcttggacccgcctacctcctgcgagaggccttgctgca

SEQ ID NO: 117149 - DNA, 75 bp, Artificial Sequence
  Synthetic
tctagtgtttgacatcactaaatggcttctagcggtgcttggacccgcctacctcctgcgagaggccttgctgca

SEQ ID NO: 117150 - DNA, 75 bp, Artificial Sequence
  Synthetic
tctagtgtttgacatcactaaatggcttcttgcggtgcttggacccgcctacctcctgcgagaggccttgctgca

SEQ ID NO: 117151 - DNA, 75 bp, Artificial Sequence
  Synthetic
tctagtgtttgacatcactaaatggcttctcgcggtgcttggacccgcctacctcctgcgagaggccttgctgca

SEQ ID NO: 117152 - DNA, 75 bp, Artificial Sequence
  Synthetic
tctagtgtttgacatcactaaatggcttctggcggtgcttggacccgcctacctcctgcgagaggccttgctgca

SEQ ID NO: 117153 - DNA, 75 bp, Artificial Sequence
  Synthetic
tctagtgtttgacatcactaaatggcttgtagcggtgcttggacccgcctacctcctgcgagaggccttgctgca

SEQ ID NO: 117154 - DNA, 75 bp, Artificial Sequence
  Synthetic
tctagtgtttgacatcactaaatggcttgttgcggtgcttggacccgcctacctcctgcgagaggccttgctgca

SEQ ID NO: 117155 - DNA, 75 bp, Artificial Sequence
  Synthetic
tctagtgtttgacatcactaaatggcttgtcgcggtgcttggacccgcctacctcctgcgagaggccttgctgca

SEQ ID NO: 117156 - DNA, 75 bp, Artificial Sequence
  Synthetic
tctagtgtttgacatcactaaatggcttgtggcggtgcttggacccgcctacctcctgcgagaggccttgctgca

SEQ ID NO: 117157 - DNA, 75 bp, Artificial Sequence
  Synthetic
tgtagtgtttgacatcactaaatggcttatagcggtgcttggacccgcctacctcctgcgagaggccttgctgca

SEQ ID NO: 117158 - DNA, 75 bp, Artificial Sequence
  Synthetic
tgtagtgtttgacatcactaaatggcttattgcggtgcttggacccgcctacctcctgcgagaggccttgctgca

SEQ ID NO: 117159 - DNA, 75 bp, Artificial Sequence
  Synthetic
tgtagtgtttgacatcactaaatggcttatcgcggtgcttggacccgcctacctcctgcgagaggccttgctgca

SEQ ID NO: 117160 - DNA, 75 bp, Artificial Sequence
  Synthetic
tgtagtgtttgacatcactaaatggcttatggcggtgcttggacccgcctacctcctgcgagaggccttgctgca

SEQ ID NO: 117161 - DNA, 75 bp, Artificial Sequence
  Synthetic
tgtagtgtttgacatcactaaatggcttttagcggtgcttggacccgcctacctcctgcgagaggccttgctgca

SEQ ID NO: 117162 - DNA, 75 bp, Artificial Sequence
  Synthetic
tgtagtgtttgacatcactaaatggctttttgcggtgcttggacccgcctacctcctgcgagaggccttgctgca

SEQ ID NO: 117163 - DNA, 75 bp, Artificial Sequence
  Synthetic
tgtagtgtttgacatcactaaatggcttttcgcggtgcttggacccgcctacctcctgcgagaggccttgctgca

SEQ ID NO: 117164 - DNA, 75 bp, Artificial Sequence
  Synthetic
tgtagtgtttgacatcactaaatggcttttggcggtgcttggacccgcctacctcctgcgagaggccttgctgca

SEQ ID NO: 117165 - DNA, 75 bp, Artificial Sequence
  Synthetic
tgtagtgtttgacatcactaaatggcttctagcggtgcttggacccgcctacctcctgcgagaggccttgctgca

SEQ ID NO: 117166 - DNA, 75 bp, Artificial Sequence
  Synthetic
tgtagtgtttgacatcactaaatggcttcttgcggtgcttggacccgcctacctcctgcgagaggccttgctgca

SEQ ID NO: 117167 - DNA, 75 bp, Artificial Sequence
  Synthetic
tgtagtgtttgacatcactaaatggcttctcgcggtgcttggacccgcctacctcctgcgagaggccttgctgca

SEQ ID NO: 117168 - DNA, 75 bp, Artificial Sequence
  Synthetic
tgtagtgtttgacatcactaaatggcttctggcggtgcttggacccgcctacctcctgcgagaggccttgctgca

SEQ ID NO: 117169 - DNA, 75 bp, Artificial Sequence
  Synthetic
tgtagtgtttgacatcactaaatggcttgtagcggtgcttggacccgcctacctcctgcgagaggccttgctgca

SEQ ID NO: 117170 - DNA, 75 bp, Artificial Sequence
  Synthetic
tgtagtgtttgacatcactaaatggcttgttgcggtgcttggacccgcctacctcctgcgagaggccttgctgca

SEQ ID NO: 117171 - DNA, 75 bp, Artificial Sequence
  Synthetic
tgtagtgtttgacatcactaaatggcttgtcgcggtgcttggacccgcctacctcctgcgagaggccttgctgca

SEQ ID NO: 117172 - DNA, 75 bp, Artificial Sequence
  Synthetic
tgtagtgtttgacatcactaaatggcttgtggcggtgcttggacccgcctacctcctgcgagaggccttgctgca

SEQ ID NO: 117173 - DNA, 75 bp, Artificial Sequence
  Synthetic
gcttggaggagcaagaagaccccaatggggttttcatatgacacccgctgctttgactctaccgtcacagagagg

SEQ ID NO: 117174 - DNA, 75 bp, Artificial Sequence
  Synthetic
ccttgaactgcaatgacagccttaacaccggctggatagcagggcttttgtatcaccacagattcaattctacag

SEQ ID NO: 117175 - DNA, 75 bp, Artificial Sequence
  Synthetic
tccacgtatggcaagttcctcgcagatggaggctgctcaggcggcgcctatgacatcataatatgcgatgagtgc

SEQ ID NO: 117176 - DNA, 75 bp, Artificial Sequence
  Synthetic
caggcccgtctcctacttgaagggctcttcgggtggtccactgctctgcccctcggggcacgctgtgggcatctt

SEQ ID NO: 117177 - DNA, 75 bp, Artificial Sequence
  Synthetic
tcttcgggtggtccactgctctgcccctcggggcacgctgtgggcatcttccgggctgctgtgtgcacccggggg

SEQ ID NO: 117178 - DNA, 75 bp, Artificial Sequence
  Synthetic
atctggcttgtcaattgcctgaagaggcccggagagccattaaatcactgacagagagactatacgtgggcggcc

SEQ ID NO: 117179 - DNA, 75 bp, Artificial Sequence
  Synthetic
cagatacactggcacgtacatctatgaccatctctcccccatgtcggactgggctgcaaagggtctgcaggacct

SEQ ID NO: 117180 - DNA, 75 bp, Artificial Sequence
  Synthetic
ggcaggtggactggcacttacatatatgatcacttatcccccatgtccagctgggccgctcagggcttgcgcgat

SEQ ID NO: 117181 - DNA, 75 bp, Artificial Sequence
  Synthetic
gtagtcctggccacggcaacgccgcccggatctgtgaccaccccccatcccaacatagaggaggtggctcttggc

SEQ ID NO: 117182 - DNA, 75 bp, Artificial Sequence
  Synthetic
ttcagccctatggagaaaagggtgattgtctgtggagcggagacgacagcctgcggggacatcctacatggtctg

SEQ ID NO: 117183 - DNA, 75 bp, Artificial Sequence
  Synthetic
acagagagactatacgtgggcggcccgatggaaaacagcaaaggccaggcttgcggatataggcgttgccgcgca

SEQ ID NO: 117184 - DNA, 75 bp, Artificial Sequence
  Synthetic
ggcattgttgacccagtgatgctcgtgtgcggcgacgacctagtggtcatctcagaaagcaagggggtggaggag

SEQ ID NO: 117185 - DNA, 75 bp, Artificial Sequence
  Synthetic
tgcccgtctccgcacggcttggacgcgaggtcttgttgggcccagccgacaagtatgtctcaaaagggtggaagc

SEQ ID NO: 117186 - DNA, 75 bp, Artificial Sequence
  Synthetic
tgtgcggcgacgacctagtggtcatctcagaaagcaagggggtggaggaggaccagcgagacctacgagtcttca

SEQ ID NO: 117187 - DNA, 75 bp, Artificial Sequence
  Synthetic
atcgggggccccctgactaattcaaaagggcagaactgcggttatcgccggtgccgcgccagcggcgtgctgacg

SEQ ID NO: 117188 - DNA, 75 bp, Artificial Sequence
  Synthetic
agcagacacgaggtcttctgggtgccatagtggtgagcctgacgggacgtgacaagacagaacaagctggggaaa

SEQ ID NO: 117189 - DNA, 75 bp, Artificial Sequence
  Synthetic
agctcgcggcggccctccggggcatgggcttgaacgcagtggcatattacagggggctcgacgtctcagtgatac

SEQ ID NO: 117190 - DNA, 75 bp, Artificial Sequence
  Synthetic
gcttgaccctcgaggtcgccgccggtactacctgactagagacccatgcactccactcgccagggcagcccggga

SEQ ID NO: 117191 - DNA, 75 bp, Artificial Sequence
  Synthetic
ggtccaggtgctgtcttccgttacacagtcttttttgggcactaacatctctggggttctatggaccgttttcca

SEQ ID NO: 117192 - DNA, 75 bp, Artificial Sequence
  Synthetic
ctcgcgagggccggtcacacaaatgtactccagcgctgagggagaccttgtggggtggcccagcccccccggtac

SEQ ID NO: 117193 - DNA, 75 bp, Artificial Sequence
  Synthetic
agtcgtagacttcagcttggaccccaccttctccataacgacacagaccgtcccacaagacgctgtctcgcgtag

SEQ ID NO: 117194 - DNA, 75 bp, Artificial Sequence
  Synthetic
tggggtggcccagcccccccggtactagatccttggacccgtgcacgtgcggggccgtagacctgtaccttgtca

SEQ ID NO: 117195 - DNA, 75 bp, Artificial Sequence
  Synthetic
gtactcaacgcccaggaagccctgggccaagatctcaatttcgagatgtacggatccacgtactcagtaagtcct

SEQ ID NO: 117196 - DNA, 75 bp, Artificial Sequence
  Synthetic
accaggtctcttgaaccatgcacctgcggggcttcggacctctaccttgtgacaagaaatgctgatgtcatccct

SEQ ID NO: 117197 - DNA, 75 bp, Artificial Sequence
  Synthetic
gaatgctacgattctggcgccgcatggtatgagctcacaccagcagagactacggtcaggctgcgagcctacttc

SEQ ID NO: 117198 - DNA, 75 bp, Artificial Sequence
  Synthetic
tccggtgctctgccctaggggacacgttgtaggaattttccgggcagctgtgtgctccaggggggttgcgaaatc

SEQ ID NO: 117199 - DNA, 75 bp, Artificial Sequence
  Synthetic
ggaaacttggggcaccgccactcagagcttggaagagtcgggcacgtgcagttagagcttcactcatcgcccaag

SEQ ID NO: 117200 - DNA, 75 bp, Artificial Sequence
  Synthetic
acgcagtcggaatcttccgagcggcagtgtgctccaggggggtagctaagtccatagatttcatccccatcgaat

SEQ ID NO: 117201 - DNA, 75 bp, Artificial Sequence
  Synthetic
agcttggaagagtcgggcacgtgcagttagagcttcactcatcgcccaaggaggaagggcagccacatgtggcat

SEQ ID NO: 117202 - DNA, 75 bp, Artificial Sequence
  Synthetic
cattcactgacaatagcacgccccccgccgtgcctcagacctaccaggtggggtacctgcatgcccctactggca

SEQ ID NO: 117203 - DNA, 75 bp, Artificial Sequence
  Synthetic
aacaggctggggagaattttccatacctagtggcctaccaggctactgtgtgtgcgagagccagagctccccccc

SEQ ID NO: 117204 - DNA, 75 bp, Artificial Sequence
  Synthetic
atcaggctggggagaattttccatacctagtggcctaccaggctactgtgtgtgcgagagccagagctccccccc

SEQ ID NO: 117205 - DNA, 75 bp, Artificial Sequence
  Synthetic
accaggctggggagaattttccatacctagtggcctaccaggctactgtgtgtgcgagagccagagctccccccc

SEQ ID NO: 117206 - DNA, 75 bp, Artificial Sequence
  Synthetic
agcaggctggggagaattttccatacctagtggcctaccaggctactgtgtgtgcgagagccagagctccccccc

SEQ ID NO: 117207 - DNA, 75 bp, Artificial Sequence
  Synthetic
gcgggaagagtaccaaagtccctgcggcgtacgccgcccaaggctataaggtactggtgctgaacccttctgtgg

SEQ ID NO: 117208 - DNA, 75 bp, Artificial Sequence
  Synthetic
cagcgggaagagcacgaaagtgccagcggcatatgcagctcaggggtttaaggtgttagtgctcaacccctctgt

SEQ ID NO: 117209 - DNA, 75 bp, Artificial Sequence
  Synthetic
caccctaacccaccccgtaaccaaatacatcgccacgtgcatgcaggccgatctggaggtcatgaccagcacgtg

SEQ ID NO: 117210 - DNA, 75 bp, Artificial Sequence
  Synthetic
ccgtaacaaccggtgaatccatcacgtactccacatatggcaaattcctcgcagatggaggctgcgctggcggag

SEQ ID NO: 117211 - DNA, 75 bp, Artificial Sequence
  Synthetic
acctattccacatacggcaagttcctcgcagacggaggtctctcaccgggggcctatgatgtcgtaatatgcgac

SEQ ID NO: 117212 - DNA, 75 bp, Artificial Sequence
  Synthetic
acctattccacatacggcaagttcctcgcagacggaggtctctcaccgggggcctatgatgtcgttatatgcgac

SEQ ID NO: 117213 - DNA, 75 bp, Artificial Sequence
  Synthetic
acctattccacatacggcaagttcctcgcagacggaggtctctcaccgggggcctatgatgtcgtcatatgcgac

SEQ ID NO: 117214 - DNA, 75 bp, Artificial Sequence
  Synthetic
acctattccacatacggcaagttcctcgcagacggaggtctctcaccgggggcctatgatgtcgtgatatgcgac

SEQ ID NO: 117215 - DNA, 75 bp, Artificial Sequence
  Synthetic
attctcggtatcggaacggtccttgaccaggccgaaaccgcaggtgctaggttggtggtcttggccacggccaca

SEQ ID NO: 117216 - DNA, 75 bp, Artificial Sequence
  Synthetic
gttgcccctgacaaggaagtcctttatgaggcgtttgacgagatggaggaatgcgcctctagggctgctcttgtt

SEQ ID NO: 117217 - DNA, 75 bp, Artificial Sequence
  Synthetic
cgccccccggatcagtaacaaccccacaccccaacatagaggaggtcgccctcggacatgagggcgagatcccat

SEQ ID NO: 117218 - DNA, 75 bp, Artificial Sequence
  Synthetic
cgccccccggatcagtaacaacccctcaccccaacatagaggaggtcgccctcggacatgagggcgagatcccat

SEQ ID NO: 117219 - DNA, 75 bp, Artificial Sequence
  Synthetic
cgccccccggatcagtaacaaccccccaccccaacatagaggaggtcgccctcggacatgagggcgagatcccat

SEQ ID NO: 117220 - DNA, 75 bp, Artificial Sequence
  Synthetic
cgccccccggatcagtaacaaccccgcaccccaacatagaggaggtcgccctcggacatgagggcgagatcccat

SEQ ID NO: 117221 - DNA, 75 bp, Artificial Sequence
  Synthetic
cgccccccggatcagtaactaccccacaccccaacatagaggaggtcgccctcggacatgagggcgagatcccat

SEQ ID NO: 117222 - DNA, 75 bp, Artificial Sequence
  Synthetic
cgccccccggatcagtaactacccctcaccccaacatagaggaggtcgccctcggacatgagggcgagatcccat

SEQ ID NO: 117223 - DNA, 75 bp, Artificial Sequence
  Synthetic
cgccccccggatcagtaactaccccccaccccaacatagaggaggtcgccctcggacatgagggcgagatcccat

SEQ ID NO: 117224 - DNA, 75 bp, Artificial Sequence
  Synthetic
cgccccccggatcagtaactaccccgcaccccaacatagaggaggtcgccctcggacatgagggcgagatcccat

SEQ ID NO: 117225 - DNA, 75 bp, Artificial Sequence
  Synthetic
cgccccccggatcagtaaccaccccacaccccaacatagaggaggtcgccctcggacatgagggcgagatcccat

SEQ ID NO: 117226 - DNA, 75 bp, Artificial Sequence
  Synthetic
cgccccccggatcagtaaccacccctcaccccaacatagaggaggtcgccctcggacatgagggcgagatcccat

SEQ ID NO: 117227 - DNA, 75 bp, Artificial Sequence
  Synthetic
cgccccccggatcagtaaccaccccccaccccaacatagaggaggtcgccctcggacatgagggcgagatcccat

SEQ ID NO: 117228 - DNA, 75 bp, Artificial Sequence
  Synthetic
cgccccccggatcagtaaccaccccgcaccccaacatagaggaggtcgccctcggacatgagggcgagatcccat

SEQ ID NO: 117229 - DNA, 75 bp, Artificial Sequence
  Synthetic
cgccccccggatcagtaacgaccccacaccccaacatagaggaggtcgccctcggacatgagggcgagatcccat

SEQ ID NO: 117230 - DNA, 75 bp, Artificial Sequence
  Synthetic
cgccccccggatcagtaacgacccctcaccccaacatagaggaggtcgccctcggacatgagggcgagatcccat

SEQ ID NO: 117231 - DNA, 75 bp, Artificial Sequence
  Synthetic
cgccccccggatcagtaacgaccccccaccccaacatagaggaggtcgccctcggacatgagggcgagatcccat

SEQ ID NO: 117232 - DNA, 75 bp, Artificial Sequence
  Synthetic
cgccccccggatcagtaacgaccccgcaccccaacatagaggaggtcgccctcggacatgagggcgagatcccat

SEQ ID NO: 117233 - DNA, 75 bp, Artificial Sequence
  Synthetic
cgccccccggatcagttacaaccccacaccccaacatagaggaggtcgccctcggacatgagggcgagatcccat

SEQ ID NO: 117234 - DNA, 75 bp, Artificial Sequence
  Synthetic
cgccccccggatcagttacaacccctcaccccaacatagaggaggtcgccctcggacatgagggcgagatcccat

SEQ ID NO: 117235 - DNA, 75 bp, Artificial Sequence
  Synthetic
cgccccccggatcagttacaaccccccaccccaacatagaggaggtcgccctcggacatgagggcgagatcccat

SEQ ID NO: 117236 - DNA, 75 bp, Artificial Sequence
  Synthetic
cgccccccggatcagttacaaccccgcaccccaacatagaggaggtcgccctcggacatgagggcgagatcccat

SEQ ID NO: 117237 - DNA, 75 bp, Artificial Sequence
  Synthetic
cgccccccggatcagttactaccccacaccccaacatagaggaggtcgccctcggacatgagggcgagatcccat

SEQ ID NO: 117238 - DNA, 75 bp, Artificial Sequence
  Synthetic
cgccccccggatcagttactacccctcaccccaacatagaggaggtcgccctcggacatgagggcgagatcccat

SEQ ID NO: 117239 - DNA, 75 bp, Artificial Sequence
  Synthetic
cgccccccggatcagttactaccccccaccccaacatagaggaggtcgccctcggacatgagggcgagatcccat

SEQ ID NO: 117240 - DNA, 75 bp, Artificial Sequence
  Synthetic
cgccccccggatcagttactaccccgcaccccaacatagaggaggtcgccctcggacatgagggcgagatcccat

SEQ ID NO: 117241 - DNA, 75 bp, Artificial Sequence
  Synthetic
cgccccccggatcagttaccaccccacaccccaacatagaggaggtcgccctcggacatgagggcgagatcccat

SEQ ID NO: 117242 - DNA, 75 bp, Artificial Sequence
  Synthetic
cgccccccggatcagttaccacccctcaccccaacatagaggaggtcgccctcggacatgagggcgagatcccat

SEQ ID NO: 117243 - DNA, 75 bp, Artificial Sequence
  Synthetic
cgccccccggatcagttaccaccccccaccccaacatagaggaggtcgccctcggacatgagggcgagatcccat

SEQ ID NO: 117244 - DNA, 75 bp, Artificial Sequence
  Synthetic
cgccccccggatcagttaccaccccgcaccccaacatagaggaggtcgccctcggacatgagggcgagatcccat

SEQ ID NO: 117245 - DNA, 75 bp, Artificial Sequence
  Synthetic
cgccccccggatcagttacgaccccacaccccaacatagaggaggtcgccctcggacatgagggcgagatcccat

SEQ ID NO: 117246 - DNA, 75 bp, Artificial Sequence
  Synthetic
cgccccccggatcagttacgacccctcaccccaacatagaggaggtcgccctcggacatgagggcgagatcccat

SEQ ID NO: 117247 - DNA, 75 bp, Artificial Sequence
  Synthetic
cgccccccggatcagttacgaccccccaccccaacatagaggaggtcgccctcggacatgagggcgagatcccat

SEQ ID NO: 117248 - DNA, 75 bp, Artificial Sequence
  Synthetic
cgccccccggatcagttacgaccccgcaccccaacatagaggaggtcgccctcggacatgagggcgagatcccat

SEQ ID NO: 117249 - DNA, 75 bp, Artificial Sequence
  Synthetic
cgccccccggatcagtcacaaccccacaccccaacatagaggaggtcgccctcggacatgagggcgagatcccat

SEQ ID NO: 117250 - DNA, 75 bp, Artificial Sequence
  Synthetic
cgccccccggatcagtcacaacccctcaccccaacatagaggaggtcgccctcggacatgagggcgagatcccat

SEQ ID NO: 117251 - DNA, 75 bp, Artificial Sequence
  Synthetic
cgccccccggatcagtcacaaccccccaccccaacatagaggaggtcgccctcggacatgagggcgagatcccat

SEQ ID NO: 117252 - DNA, 75 bp, Artificial Sequence
  Synthetic
cgccccccggatcagtcacaaccccgcaccccaacatagaggaggtcgccctcggacatgagggcgagatcccat

SEQ ID NO: 117253 - DNA, 75 bp, Artificial Sequence
  Synthetic
cgccccccggatcagtcactaccccacaccccaacatagaggaggtcgccctcggacatgagggcgagatcccat

SEQ ID NO: 117254 - DNA, 75 bp, Artificial Sequence
  Synthetic
cgccccccggatcagtcactacccctcaccccaacatagaggaggtcgccctcggacatgagggcgagatcccat

SEQ ID NO: 117255 - DNA, 75 bp, Artificial Sequence
  Synthetic
cgccccccggatcagtcactaccccccaccccaacatagaggaggtcgccctcggacatgagggcgagatcccat

SEQ ID NO: 117256 - DNA, 75 bp, Artificial Sequence
  Synthetic
cgccccccggatcagtcactaccccgcaccccaacatagaggaggtcgccctcggacatgagggcgagatcccat

SEQ ID NO: 117257 - DNA, 75 bp, Artificial Sequence
  Synthetic
cgccccccggatcagtcaccaccccacaccccaacatagaggaggtcgccctcggacatgagggcgagatcccat

SEQ ID NO: 117258 - DNA, 75 bp, Artificial Sequence
  Synthetic
cgccccccggatcagtcaccacccctcaccccaacatagaggaggtcgccctcggacatgagggcgagatcccat

SEQ ID NO: 117259 - DNA, 75 bp, Artificial Sequence
  Synthetic
cgccccccggatcagtcaccaccccccaccccaacatagaggaggtcgccctcggacatgagggcgagatcccat

SEQ ID NO: 117260 - DNA, 75 bp, Artificial Sequence
  Synthetic
cgccccccggatcagtcaccaccccgcaccccaacatagaggaggtcgccctcggacatgagggcgagatcccat

SEQ ID NO: 117261 - DNA, 75 bp, Artificial Sequence
  Synthetic
cgccccccggatcagtcacgaccccacaccccaacatagaggaggtcgccctcggacatgagggcgagatcccat

SEQ ID NO: 117262 - DNA, 75 bp, Artificial Sequence
  Synthetic
cgccccccggatcagtcacgacccctcaccccaacatagaggaggtcgccctcggacatgagggcgagatcccat

SEQ ID NO: 117263 - DNA, 75 bp, Artificial Sequence
  Synthetic
cgccccccggatcagtcacgaccccccaccccaacatagaggaggtcgccctcggacatgagggcgagatcccat

SEQ ID NO: 117264 - DNA, 75 bp, Artificial Sequence
  Synthetic
cgccccccggatcagtcacgaccccgcaccccaacatagaggaggtcgccctcggacatgagggcgagatcccat

SEQ ID NO: 117265 - DNA, 75 bp, Artificial Sequence
  Synthetic
cgccccccggatcagtgacaaccccacaccccaacatagaggaggtcgccctcggacatgagggcgagatcccat

SEQ ID NO: 117266 - DNA, 75 bp, Artificial Sequence
  Synthetic
cgccccccggatcagtgacaacccctcaccccaacatagaggaggtcgccctcggacatgagggcgagatcccat

SEQ ID NO: 117267 - DNA, 75 bp, Artificial Sequence
  Synthetic
cgccccccggatcagtgacaaccccccaccccaacatagaggaggtcgccctcggacatgagggcgagatcccat

SEQ ID NO: 117268 - DNA, 75 bp, Artificial Sequence
  Synthetic
cgccccccggatcagtgacaaccccgcaccccaacatagaggaggtcgccctcggacatgagggcgagatcccat

SEQ ID NO: 117269 - DNA, 75 bp, Artificial Sequence
  Synthetic
cgccccccggatcagtgactaccccacaccccaacatagaggaggtcgccctcggacatgagggcgagatcccat

SEQ ID NO: 117270 - DNA, 75 bp, Artificial Sequence
  Synthetic
cgccccccggatcagtgactacccctcaccccaacatagaggaggtcgccctcggacatgagggcgagatcccat

SEQ ID NO: 117271 - DNA, 75 bp, Artificial Sequence
  Synthetic
cgccccccggatcagtgactaccccccaccccaacatagaggaggtcgccctcggacatgagggcgagatcccat

SEQ ID NO: 117272 - DNA, 75 bp, Artificial Sequence
  Synthetic
cgccccccggatcagtgactaccccgcaccccaacatagaggaggtcgccctcggacatgagggcgagatcccat

SEQ ID NO: 117273 - DNA, 75 bp, Artificial Sequence
  Synthetic
cgccccccggatcagtgaccaccccacaccccaacatagaggaggtcgccctcggacatgagggcgagatcccat

SEQ ID NO: 117274 - DNA, 75 bp, Artificial Sequence
  Synthetic
cgccccccggatcagtgaccacccctcaccccaacatagaggaggtcgccctcggacatgagggcgagatcccat

SEQ ID NO: 117275 - DNA, 75 bp, Artificial Sequence
  Synthetic
cgccccccggatcagtgaccaccccccaccccaacatagaggaggtcgccctcggacatgagggcgagatcccat

SEQ ID NO: 117276 - DNA, 75 bp, Artificial Sequence
  Synthetic
cgccccccggatcagtgaccaccccgcaccccaacatagaggaggtcgccctcggacatgagggcgagatcccat

SEQ ID NO: 117277 - DNA, 75 bp, Artificial Sequence
  Synthetic
cgccccccggatcagtgacgaccccacaccccaacatagaggaggtcgccctcggacatgagggcgagatcccat

SEQ ID NO: 117278 - DNA, 75 bp, Artificial Sequence
  Synthetic
cgccccccggatcagtgacgacccctcaccccaacatagaggaggtcgccctcggacatgagggcgagatcccat

SEQ ID NO: 117279 - DNA, 75 bp, Artificial Sequence
  Synthetic
cgccccccggatcagtgacgaccccccaccccaacatagaggaggtcgccctcggacatgagggcgagatcccat

SEQ ID NO: 117280 - DNA, 75 bp, Artificial Sequence
  Synthetic
cgccccccggatcagtgacgaccccgcaccccaacatagaggaggtcgccctcggacatgagggcgagatcccat

SEQ ID NO: 117281 - DNA, 75 bp, Artificial Sequence
  Synthetic
gcgtttggccagctgccgctccatcgacaagttcgctcaggggtggggtcccatcagttatggcgagcctagcga

SEQ ID NO: 117282 - DNA, 75 bp, Artificial Sequence
  Synthetic
acatccgaggggggaggcacctgatcttctgccattcaaaaaagaagtgcgatgagctcgcggcggcccttcggg

SEQ ID NO: 117283 - DNA, 75 bp, Artificial Sequence
  Synthetic
ccgcttggcctaaattggaacaattttgggccaagcacatgtggaatttcatcagtggcatccagtaccttgcag

SEQ ID NO: 117284 - DNA, 75 bp, Artificial Sequence
  Synthetic
gagcatgggtgtcaacgcagtcgcgtactacagaggtctcgatgtctccgtgataccgactcagggggacgttgt

SEQ ID NO: 117285 - DNA, 75 bp, Artificial Sequence
  Synthetic
gtgcatgggtgtcaacgcagtcgcgtactacagaggtctcgatgtctccgtgataccgactcagggggacgttgt

SEQ ID NO: 117286 - DNA, 75 bp, Artificial Sequence
  Synthetic
gcgcatgggtgtcaacgcagtcgcgtactacagaggtctcgatgtctccgtgataccgactcagggggacgttgt

SEQ ID NO: 117287 - DNA, 75 bp, Artificial Sequence
  Synthetic
gggcatgggtgtcaacgcagtcgcgtactacagaggtctcgatgtctccgtgataccgactcagggggacgttgt

SEQ ID NO: 117288 - DNA, 75 bp, Artificial Sequence
  Synthetic
ataccagctcaaggagacgttgtagtcgtcgctacagatgccctcatgacagggttcactggagacttcgactcc

SEQ ID NO: 117289 - DNA, 75 bp, Artificial Sequence
  Synthetic
catcatgggaggttggttggcctcgcagattgcacccccggcaggagccactggcttcgtcgtcagcggcttagt

SEQ ID NO: 117290 - DNA, 75 bp, Artificial Sequence
  Synthetic
accgttccacaagacgctgtctcgcggagccagcgacgaggacggactggcaggggtaggttgggcatatatagg

SEQ ID NO: 117291 - DNA, 75 bp, Artificial Sequence
  Synthetic
gaccccaccttcacaataaccacccagaccgtgcctcaggacgctgtctcccgcagccaacgccgcggaagaact

SEQ ID NO: 117292 - DNA, 75 bp, Artificial Sequence
  Synthetic
tggccgggtatggtgcgggcatatcaggggctctcgtcgcttttaagatcatgtcgggcgagaaaccctccgtag

SEQ ID NO: 117293 - DNA, 75 bp, Artificial Sequence
  Synthetic
tggccgggtatggtgcgggcatatcaggggctctcgtcgcttttaagatcatgtcgggcgagaaaccctccgttg

SEQ ID NO: 117294 - DNA, 75 bp, Artificial Sequence
  Synthetic
tggccgggtatggtgcgggcatatcaggggctctcgtcgcttttaagatcatgtcgggcgagaaaccctccgtcg

SEQ ID NO: 117295 - DNA, 75 bp, Artificial Sequence
  Synthetic
tggccgggtatggtgcgggcatatcaggggctctcgtcgcttttaagatcatgtcgggcgagaaaccctccgtgg

SEQ ID NO: 117296 - DNA, 75 bp, Artificial Sequence
  Synthetic
gattgccctaactcgagtattgtgtacgagacggccgataccatcctacactctccggggtgtgtcccttgcgtt

SEQ ID NO: 117297 - DNA, 75 bp, Artificial Sequence
  Synthetic
agactactgtcaggcttcgggcatatttcaacacgcctggtctgcctgtgtgccaggaccacctagagttctggg

SEQ ID NO: 117298 - DNA, 75 bp, Artificial Sequence
  Synthetic
ctgcctggtacgagctcacaccgaaggaggttaccgttaagttgcgggcatatttcaacacgcccggattaccag

SEQ ID NO: 117299 - DNA, 75 bp, Artificial Sequence
  Synthetic
ctcattgcctttgcttccagaggaaaccatgtcgccccgacccattacgtggcggagtcagacgcgtcgcgcaga

SEQ ID NO: 117300 - DNA, 75 bp, Artificial Sequence
  Synthetic
cgtacttagcggcctatcaggccacagtgtgcactagggccaaagccccccctccatcttgggataccatgtgga

SEQ ID NO: 117301 - DNA, 75 bp, Artificial Sequence
  Synthetic
tgcttaccttgtggcctaccaggccacggcgtgcgccagagcgaaagctccccccccctcctgggacacgatgtg

SEQ ID NO: 117302 - DNA, 75 bp, Artificial Sequence
  Synthetic
tccgagacgtgtgggactgggtttgctccattctggcagacttcaaaaattggctatcttccaagttactcccaa

SEQ ID NO: 117303 - DNA, 75 bp, Artificial Sequence
  Synthetic
tgcatctggtatttaccatctcaccaatgattgcccaaattcaagtattgtctatgaggcggaaaccatcatcct

SEQ ID NO: 117304 - DNA, 75 bp, Artificial Sequence
  Synthetic
gttaagagtctggagacaccgagccagggcggtcagagctaggctcattgctcagggaggcaaacacgctgtatg

SEQ ID NO: 117305 - DNA, 75 bp, Artificial Sequence
  Synthetic
accaaatacatcgccacttgtatgcaagcggacctcgaaatcttgacgagctcgtgggtccttgcagggggtgtg

SEQ ID NO: 117306 - DNA, 75 bp, Artificial Sequence
  Synthetic
ttatcacagcgtgtctcgtgcccggccccgctggttctggttttgcctactcctgcttgctgcaggggtaggtat

SEQ ID NO: 117307 - DNA, 75 bp, Artificial Sequence
  Synthetic
ctctggtaatgtccgtctgggtaccatgagaataacgggacccaagacctgcatgaacacttggcaggggacttt

SEQ ID NO: 117308 - DNA, 75 bp, Artificial Sequence
  Synthetic
gggggagtgctgctcataccgcgtctgggatcgccagtctcttcacacgtggccccagccaagatatccggctga

SEQ ID NO: 117309 - DNA, 75 bp, Artificial Sequence
  Synthetic
gtaagagggttccgctctcatgtggatcttcttgtcggttcggcggcactctgttcagccctttacatcggggat

SEQ ID NO: 117310 - DNA, 75 bp, Artificial Sequence
  Synthetic
tgtagttgcccccgataaggaagtcctatatgaggcgtttgatgagatggaggagtgcgcctctagggctgccct

SEQ ID NO: 117311 - DNA, 75 bp, Artificial Sequence
  Synthetic
agatcgttggcggagtttacttgttgccgcgcaggggccctagattgggtgtgcgcgcgactaggaagacttcgg

SEQ ID NO: 117312 - DNA, 75 bp, Artificial Sequence
  Synthetic
tcctgtatgaggcgtttgatgaaatggaagaatgtgcctccagggctgccctcatcacagagagccaccgaatcg

SEQ ID NO: 117313 - DNA, 75 bp, Artificial Sequence
  Synthetic
tcctgtatgaggcgtttgatgaaatggaagaatgtgcctccagggctgccctcatctcagagagccaccgaatcg

SEQ ID NO: 117314 - DNA, 75 bp, Artificial Sequence
  Synthetic
tcctgtatgaggcgtttgatgaaatggaagaatgtgcctccagggctgccctcatcccagagagccaccgaatcg

SEQ ID NO: 117315 - DNA, 75 bp, Artificial Sequence
  Synthetic
tcctgtatgaggcgtttgatgaaatggaagaatgtgcctccagggctgccctcatcgcagagagccaccgaatcg

SEQ ID NO: 117316 - DNA, 75 bp, Artificial Sequence
  Synthetic
gccaacttttcaccatccggcccaggtatcataccatcgttcaggagtgcaactgttccatctatacggggcacg

SEQ ID NO: 117317 - DNA, 75 bp, Artificial Sequence
  Synthetic
acgcagcacggccaatacgtgtatgtgacaggattgacaactgacaacttgaaggtcccctgccaggtgccatct

SEQ ID NO: 117318 - DNA, 75 bp, Artificial Sequence
  Synthetic
caactcttcaggctgccgcgagaggatgtacagctgtagaccccttgcctatttcgaccagggctggggccccat

SEQ ID NO: 117319 - DNA, 75 bp, Artificial Sequence
  Synthetic
caggcctcctggcccaaactggaacaattttgggccaaacatatgtggaacttcatcagtggtattcagtacctc

SEQ ID NO: 117320 - DNA, 75 bp, Artificial Sequence
  Synthetic
gtatcataccatcgttcaggagtgcaactgttccatctatacggggcacgttacggggcacaggatggcgtggga

SEQ ID NO: 117321 - DNA, 75 bp, Artificial Sequence
  Synthetic
gcaattctgggccaaacacatgtggaacttcataagcggcattcaatacatcgccggcttatctaccttaccagg

SEQ ID NO: 117322 - DNA, 75 bp, Artificial Sequence
  Synthetic
tgagaataccacagttgctcctcgagatctttctcgagggacactggggtgtcatcggtgctgtgttgtattata

SEQ ID NO: 117323 - DNA, 75 bp, Artificial Sequence
  Synthetic
gatctttctcgagggacactggggtgtcatcggtgctgtgttgtattatagcatggtagcaaactgggctaaggt

SEQ ID NO: 117324 - DNA, 75 bp, Artificial Sequence
  Synthetic
tccttgtgatcctgagccagacacggaggtgttggcgtccatgttgacggacccttcccacatcacggcagaggc

SEQ ID NO: 117325 - DNA, 75 bp, Artificial Sequence
  Synthetic
gcagggctgtcgacattgccggggaaccctgctgtggcttcaatgatggcgttcagtgccgctctcaccagccca

SEQ ID NO: 117326 - DNA, 75 bp, Artificial Sequence
  Synthetic
tgacaggattgacaactgacaacttgaaggtcccctgccaggtgccatctccagagttcttctcttgggtggacg

SEQ ID NO: 117327 - DNA, 75 bp, Artificial Sequence
  Synthetic
ttgctggcactatgcgcctcgaccgtgcggtattgtacccgcgtcgacggtgtgtggtccagtgtattgctttac

SEQ ID NO: 117328 - DNA, 75 bp, Artificial Sequence
  Synthetic
gcatcccaaatagcccccccctctggggccactggcttcgtagtcagcggcttagtgggggcggctgtagggagt

SEQ ID NO: 117329 - DNA, 75 bp, Artificial Sequence
  Synthetic
tagtgggggctgctgtgggaagcataggcctagggaaaatactggtggatgtcttggctgggtacggtgcaggca

SEQ ID NO: 117330 - DNA, 75 bp, Artificial Sequence
  Synthetic
catgcatgttggtgcggaaagccgctgggggccattatgtccaaatggctttcatgaggctggccgcattgacgg

SEQ ID NO: 117331 - DNA, 75 bp, Artificial Sequence
  Synthetic
ggaagagaccccgacattgacatggtcgacgccaatctcttcatggggggcgatgtgactcggatagagtctgag

SEQ ID NO: 117332 - DNA, 75 bp, Artificial Sequence
  Synthetic
gtcttggctgggtacggtgcaggcatctcaggagctctcgtcgcgtttaagatcatgtctggcgagaagccatcc

SEQ ID NO: 117333 - DNA, 75 bp, Artificial Sequence
  Synthetic
cgtcttcgtccttaacaacaccaggccaccactgggcaattggttcggttgcacctggatgaactcaactggatt

SEQ ID NO: 117334 - DNA, 75 bp, Artificial Sequence
  Synthetic
atgctgggtgtctctcacccccaccgtggctgcgccatacctgaatgctccgcttgagtctttgagacgtcacgt

SEQ ID NO: 117335 - DNA, 75 bp, Artificial Sequence
  Synthetic
cagttgaggacatcgtcaacctgctcccagctatcttgtctcccggcgctctagtagtgggtgtcatctgcgcag

SEQ ID NO: 117336 - DNA, 75 bp, Artificial Sequence
  Synthetic
tgtaacatcgggggggtcggcaacaacaccttgacttgccccacggactgcttccggaagcaccccgaggccact

SEQ ID NO: 117337 - DNA, 75 bp, Artificial Sequence
  Synthetic
gggaaggcgcggtccaatggatgaacaggcttattgcctttgcgtccagaggtaaccacgtcgccccgacccact

SEQ ID NO: 117338 - DNA, 75 bp, Artificial Sequence
  Synthetic
ggatctgatggtgggcgccgccactctctgctccgccctttacatcggagacgtgtgtgggggtgcgttcttggt

SEQ ID NO: 117339 - DNA, 75 bp, Artificial Sequence
  Synthetic
ttccgccggcgctaccaccctgggcacggcctgattacaacccgccgcttctggagacctggaagagacctgatt

SEQ ID NO: 117340 - DNA, 75 bp, Artificial Sequence
  Synthetic
ggctttggcactatccttgtactgttaacttcactctgttcaaagtcaggatgtatgtgggaggggttgagcaca

SEQ ID NO: 117341 - DNA, 75 bp, Artificial Sequence
  Synthetic
ctacgtggctgagtctgacgcctctagccgcgtgacacaacttctcagttcactcactattactgctctgctcag

SEQ ID NO: 117342 - DNA, 75 bp, Artificial Sequence
  Synthetic
agtgggagaagcccttaaagagctggccattaaaagctttggccaactcgcccccagcggtgactcaggccactg

SEQ ID NO: 117343 - DNA, 75 bp, Artificial Sequence
  Synthetic
tgctgcaaagcaccaggccccccagtgggtcttggttcgggtgcacttggatgaactcctcggggttcgtgaaga

SEQ ID NO: 117344 - DNA, 75 bp, Artificial Sequence
  Synthetic
atgaactcctcggggttcgtgaagacatgcggcgcccccccctgcaacatcacaccagagggcggtggcaacaac

SEQ ID NO: 117345 - DNA, 75 bp, Artificial Sequence
  Synthetic
atgaactcctcggggttcgtgaagacatgcggcgcccccccctgcaacatcacaccagtgggcggtggcaacaac

SEQ ID NO: 117346 - DNA, 75 bp, Artificial Sequence
  Synthetic
atgaactcctcggggttcgtgaagacatgcggcgcccccccctgcaacatcacaccagcgggcggtggcaacaac

SEQ ID NO: 117347 - DNA, 75 bp, Artificial Sequence
  Synthetic
atgaactcctcggggttcgtgaagacatgcggcgcccccccctgcaacatcacaccagggggcggtggcaacaac

SEQ ID NO: 117348 - DNA, 75 bp, Artificial Sequence
  Synthetic
aaaaactggctatctgccaagttgttcccgaaaatgccgggcatcccctttgtctcctgccaaaaggggtatagg

SEQ ID NO: 117349 - DNA, 75 bp, Artificial Sequence
  Synthetic
aaaaactggctatctgccaagttgttcccgaatatgccgggcatcccctttgtctcctgccaaaaggggtatagg

SEQ ID NO: 117350 - DNA, 75 bp, Artificial Sequence
  Synthetic
aaaaactggctatctgccaagttgttcccgaacatgccgggcatcccctttgtctcctgccaaaaggggtatagg

SEQ ID NO: 117351 - DNA, 75 bp, Artificial Sequence
  Synthetic
aaaaactggctatctgccaagttgttcccgaagatgccgggcatcccctttgtctcctgccaaaaggggtatagg

SEQ ID NO: 117352 - DNA, 75 bp, Artificial Sequence
  Synthetic
gagcctggagatcctgacttggagcccgagacgaccgagggtcagcccccctccgtggagggatcggcacccccg

SEQ ID NO: 117353 - DNA, 75 bp, Artificial Sequence
  Synthetic
acatgcatgaacacttggcagggggctttccccatcaactcctacacggaaggccagtgcgtgccaaagccctcg

SEQ ID NO: 117354 - DNA, 75 bp, Artificial Sequence
  Synthetic
gctcattaacaccaacgggagctggcacatcaataggactgccctcaattgtaacgacagcctgaacacagggct

SEQ ID NO: 117355 - DNA, 75 bp, Artificial Sequence
  Synthetic
agacttgcatgaacacatggcagggaacctttccaatcaattgctacaccgagggtcagtgcatgccaaggcctc

SEQ ID NO: 117356 - DNA, 75 bp, Artificial Sequence
  Synthetic
gtagaccagaggaggagaagttaccaattaacccgttgagcaactcactgttgcgacaccacaacaaggtgtatt

SEQ ID NO: 117357 - DNA, 75 bp, Artificial Sequence
  Synthetic
gtagtccagaggaggagaagttaccaattaacccgttgagcaactcactgttgcgacaccacaacaaggtgtatt

SEQ ID NO: 117358 - DNA, 75 bp, Artificial Sequence
  Synthetic
gtagcccagaggaggagaagttaccaattaacccgttgagcaactcactgttgcgacaccacaacaaggtgtatt

SEQ ID NO: 117359 - DNA, 75 bp, Artificial Sequence
  Synthetic
gtaggccagaggaggagaagttaccaattaacccgttgagcaactcactgttgcgacaccacaacaaggtgtatt

SEQ ID NO: 117360 - DNA, 75 bp, Artificial Sequence
  Synthetic
aggttcaacagctccgggtgtccagagaggctagccagctgcagaagccttgacagcttccaacagggctggggc

SEQ ID NO: 117361 - DNA, 75 bp, Artificial Sequence
  Synthetic
caactggacccgcggggagcaatgtgacttagacgatagggatagggtggagatgagcccgcttttgttttcaac

SEQ ID NO: 117362 - DNA, 75 bp, Artificial Sequence
  Synthetic
caactggacccgcggggagcaatgtgactttgacgatagggatagggtggagatgagcccgcttttgttttcaac

SEQ ID NO: 117363 - DNA, 75 bp, Artificial Sequence
  Synthetic
caactggacccgcggggagcaatgtgacttcgacgatagggatagggtggagatgagcccgcttttgttttcaac

SEQ ID NO: 117364 - DNA, 75 bp, Artificial Sequence
  Synthetic
caactggacccgcggggagcaatgtgacttggacgatagggatagggtggagatgagcccgcttttgttttcaac

SEQ ID NO: 117365 - DNA, 75 bp, Artificial Sequence
  Synthetic
aacacaacttgccatcttgccctgctcattcacaaccatgccagctttgtccactggcctgatccatcttcacca

SEQ ID NO: 117366 - DNA, 75 bp, Artificial Sequence
  Synthetic
aacacaacttgccatcttgccctgctctttcacaaccatgccagctttgtccactggcctgatccatcttcacca

SEQ ID NO: 117367 - DNA, 75 bp, Artificial Sequence
  Synthetic
aacacaacttgccatcttgccctgctccttcacaaccatgccagctttgtccactggcctgatccatcttcacca

SEQ ID NO: 117368 - DNA, 75 bp, Artificial Sequence
  Synthetic
aacacaacttgccatcttgccctgctcgttcacaaccatgccagctttgtccactggcctgatccatcttcacca

SEQ ID NO: 117369 - DNA, 75 bp, Artificial Sequence
  Synthetic
taatttgaaagtcccttgccaattgcccgcaccagagttcttctcgtgggtggatggggttcaaatccatcgatt

SEQ ID NO: 117370 - DNA, 75 bp, Artificial Sequence
  Synthetic
tggccgctactcctgctcctgctggcgttaccaccacgagcatacgccatggaccgggagatggctgcatcgtgc

SEQ ID NO: 117371 - DNA, 75 bp, Artificial Sequence
  Synthetic
gctcgcagcctccaaagttagcgccaacctcctcacgatggaggaggcatgtgcgctgaccccgccccactccgc

SEQ ID NO: 117372 - DNA, 75 bp, Artificial Sequence
  Synthetic
agctcccttgtgagcccgagccggacacggaggtgttggcgtcgatgctgacagacccatcacacatcacagcgg

SEQ ID NO: 117373 - DNA, 75 bp, Artificial Sequence
  Synthetic
gacgagcggatctgtgcgtgtctgtggctaatgcttctcattggccgagtggaagctgccttggagaaccttatt

SEQ ID NO: 117374 - DNA, 75 bp, Artificial Sequence
  Synthetic
gacgtgcggatctgtgcgtgtctgtggctaatgcttctcattggccgagtggaagctgccttggagaaccttatt

SEQ ID NO: 117375 - DNA, 75 bp, Artificial Sequence
  Synthetic
gacgcgcggatctgtgcgtgtctgtggctaatgcttctcattggccgagtggaagctgccttggagaaccttatt

SEQ ID NO: 117376 - DNA, 75 bp, Artificial Sequence
  Synthetic
gacgggcggatctgtgcgtgtctgtggctaatgcttctcattggccgagtggaagctgccttggagaaccttatt

SEQ ID NO: 117377 - DNA, 75 bp, Artificial Sequence
  Synthetic
gacaccgaggtattggcgtccatgcttacagacccatcccacatcacggccgaaacggccgcgcggcgtctggcc

SEQ ID NO: 117378 - DNA, 75 bp, Artificial Sequence
  Synthetic
gagccgaggcgcatctgcaagtgtggatcccccccctcaacgttcgggggggccgcgatgccatcatcctcctca

SEQ ID NO: 117379 - DNA, 75 bp, Artificial Sequence
  Synthetic
ggctaatgcttctcattggccgagtggaagctgccttggagaaccttattgttcttaacgctacatccgctgcca

SEQ ID NO: 117380 - DNA, 75 bp, Artificial Sequence
  Synthetic
accacaccaataccaacaactatcatggccaagaacgaggtgttctgtgtggaccccgctaagggggggaagaaa

SEQ ID NO: 117381 - DNA, 75 bp, Artificial Sequence
  Synthetic
tcctcagcaagccagctttcggcgccgtcgctgcgggctacctgcaccacccatggtaagggctacgacattgac

SEQ ID NO: 117382 - DNA, 75 bp, Artificial Sequence
  Synthetic
gcccctcctcttgctggtattggttttgccgcagagggcgttcgccttccaaggggaggaggcagcctccttggg

SEQ ID NO: 117383 - DNA, 75 bp, Artificial Sequence
  Synthetic
acatggtggacgttaacctgttcatgggaagcgacgtgactcggatagaatctgagtccaaagtgcttgtcttgg

SEQ ID NO: 117384 - DNA, 75 bp, Artificial Sequence
  Synthetic
aggacgagcgcgagccctcaattccctcggaatatttgctccccggaaagaagaaatttccaccagcactaccag

SEQ ID NO: 117385 - DNA, 75 bp, Artificial Sequence
  Synthetic
cttcctatggattccaatactctcctgcacagcgggtcgaattccttctgcaagcgtggaaggaaaagaaggacc

SEQ ID NO: 117386 - DNA, 75 bp, Artificial Sequence
  Synthetic
gtggattcaatacttcattgcgcgtgcagaggccatgctgcaagtttgggtgcccccgttacatgttcgtggcgg

SEQ ID NO: 117387 - DNA, 75 bp, Artificial Sequence
  Synthetic
gtggattcaatacttcattgcgcgtgcagaggccatgctgcatgtttgggtgcccccgttacatgttcgtggcgg

SEQ ID NO: 117388 - DNA, 75 bp, Artificial Sequence
  Synthetic
gtggattcaatacttcattgcgcgtgcagaggccatgctgcacgtttgggtgcccccgttacatgttcgtggcgg

SEQ ID NO: 117389 - DNA, 75 bp, Artificial Sequence
  Synthetic
gtggattcaatacttcattgcgcgtgcagaggccatgctgcaggtttgggtgcccccgttacatgttcgtggcgg

SEQ ID NO: 117390 - DNA, 75 bp, Artificial Sequence
  Synthetic
gtggattcaatacttcattgcgcgtgctgaggccatgctgcaagtttgggtgcccccgttacatgttcgtggcgg

SEQ ID NO: 117391 - DNA, 75 bp, Artificial Sequence
  Synthetic
gtggattcaatacttcattgcgcgtgctgaggccatgctgcatgtttgggtgcccccgttacatgttcgtggcgg

SEQ ID NO: 117392 - DNA, 75 bp, Artificial Sequence
  Synthetic
gtggattcaatacttcattgcgcgtgctgaggccatgctgcacgtttgggtgcccccgttacatgttcgtggcgg

SEQ ID NO: 117393 - DNA, 75 bp, Artificial Sequence
  Synthetic
gtggattcaatacttcattgcgcgtgctgaggccatgctgcaggtttgggtgcccccgttacatgttcgtggcgg

SEQ ID NO: 117394 - DNA, 75 bp, Artificial Sequence
  Synthetic
gtggattcaatacttcattgcgcgtgccgaggccatgctgcaagtttgggtgcccccgttacatgttcgtggcgg

SEQ ID NO: 117395 - DNA, 75 bp, Artificial Sequence
  Synthetic
gtggattcaatacttcattgcgcgtgccgaggccatgctgcatgtttgggtgcccccgttacatgttcgtggcgg

SEQ ID NO: 117396 - DNA, 75 bp, Artificial Sequence
  Synthetic
gtggattcaatacttcattgcgcgtgccgaggccatgctgcacgtttgggtgcccccgttacatgttcgtggcgg

SEQ ID NO: 117397 - DNA, 75 bp, Artificial Sequence
  Synthetic
gtggattcaatacttcattgcgcgtgccgaggccatgctgcaggtttgggtgcccccgttacatgttcgtggcgg

SEQ ID NO: 117398 - DNA, 75 bp, Artificial Sequence
  Synthetic
gtggattcaatacttcattgcgcgtgcggaggccatgctgcaagtttgggtgcccccgttacatgttcgtggcgg

SEQ ID NO: 117399 - DNA, 75 bp, Artificial Sequence
  Synthetic
gtggattcaatacttcattgcgcgtgcggaggccatgctgcatgtttgggtgcccccgttacatgttcgtggcgg

SEQ ID NO: 117400 - DNA, 75 bp, Artificial Sequence
  Synthetic
gtggattcaatacttcattgcgcgtgcggaggccatgctgcacgtttgggtgcccccgttacatgttcgtggcgg

SEQ ID NO: 117401 - DNA, 75 bp, Artificial Sequence
  Synthetic
gtggattcaatacttcattgcgcgtgcggaggccatgctgcaggtttgggtgcccccgttacatgttcgtggcgg

SEQ ID NO: 117402 - DNA, 75 bp, Artificial Sequence
  Synthetic
gtggattcattacttcattgcgcgtgcagaggccatgctgcaagtttgggtgcccccgttacatgttcgtggcgg

SEQ ID NO: 117403 - DNA, 75 bp, Artificial Sequence
  Synthetic
gtggattcattacttcattgcgcgtgcagaggccatgctgcatgtttgggtgcccccgttacatgttcgtggcgg

SEQ ID NO: 117404 - DNA, 75 bp, Artificial Sequence
  Synthetic
gtggattcattacttcattgcgcgtgcagaggccatgctgcacgtttgggtgcccccgttacatgttcgtggcgg

SEQ ID NO: 117405 - DNA, 75 bp, Artificial Sequence
  Synthetic
gtggattcattacttcattgcgcgtgcagaggccatgctgcaggtttgggtgcccccgttacatgttcgtggcgg

SEQ ID NO: 117406 - DNA, 75 bp, Artificial Sequence
  Synthetic
gtggattcattacttcattgcgcgtgctgaggccatgctgcaagtttgggtgcccccgttacatgttcgtggcgg

SEQ ID NO: 117407 - DNA, 75 bp, Artificial Sequence
  Synthetic
gtggattcattacttcattgcgcgtgctgaggccatgctgcatgtttgggtgcccccgttacatgttcgtggcgg

SEQ ID NO: 117408 - DNA, 75 bp, Artificial Sequence
  Synthetic
gtggattcattacttcattgcgcgtgctgaggccatgctgcacgtttgggtgcccccgttacatgttcgtggcgg

SEQ ID NO: 117409 - DNA, 75 bp, Artificial Sequence
  Synthetic
gtggattcattacttcattgcgcgtgctgaggccatgctgcaggtttgggtgcccccgttacatgttcgtggcgg

SEQ ID NO: 117410 - DNA, 75 bp, Artificial Sequence
  Synthetic
gtggattcattacttcattgcgcgtgccgaggccatgctgcaagtttgggtgcccccgttacatgttcgtggcgg

SEQ ID NO: 117411 - DNA, 75 bp, Artificial Sequence
  Synthetic
gtggattcattacttcattgcgcgtgccgaggccatgctgcatgtttgggtgcccccgttacatgttcgtggcgg

SEQ ID NO: 117412 - DNA, 75 bp, Artificial Sequence
  Synthetic
gtggattcattacttcattgcgcgtgccgaggccatgctgcacgtttgggtgcccccgttacatgttcgtggcgg

SEQ ID NO: 117413 - DNA, 75 bp, Artificial Sequence
  Synthetic
gtggattcattacttcattgcgcgtgccgaggccatgctgcaggtttgggtgcccccgttacatgttcgtggcgg

SEQ ID NO: 117414 - DNA, 75 bp, Artificial Sequence
  Synthetic
gtggattcattacttcattgcgcgtgcggaggccatgctgcaagtttgggtgcccccgttacatgttcgtggcgg

SEQ ID NO: 117415 - DNA, 75 bp, Artificial Sequence
  Synthetic
gtggattcattacttcattgcgcgtgcggaggccatgctgcatgtttgggtgcccccgttacatgttcgtggcgg

SEQ ID NO: 117416 - DNA, 75 bp, Artificial Sequence
  Synthetic
gtggattcattacttcattgcgcgtgcggaggccatgctgcacgtttgggtgcccccgttacatgttcgtggcgg

SEQ ID NO: 117417 - DNA, 75 bp, Artificial Sequence
  Synthetic
gtggattcattacttcattgcgcgtgcggaggccatgctgcaggtttgggtgcccccgttacatgttcgtggcgg

SEQ ID NO: 117418 - DNA, 75 bp, Artificial Sequence
  Synthetic
gtggattcactacttcattgcgcgtgcagaggccatgctgcaagtttgggtgcccccgttacatgttcgtggcgg

SEQ ID NO: 117419 - DNA, 75 bp, Artificial Sequence
  Synthetic
gtggattcactacttcattgcgcgtgcagaggccatgctgcatgtttgggtgcccccgttacatgttcgtggcgg

SEQ ID NO: 117420 - DNA, 75 bp, Artificial Sequence
  Synthetic
gtggattcactacttcattgcgcgtgcagaggccatgctgcacgtttgggtgcccccgttacatgttcgtggcgg

SEQ ID NO: 117421 - DNA, 75 bp, Artificial Sequence
  Synthetic
gtggattcactacttcattgcgcgtgcagaggccatgctgcaggtttgggtgcccccgttacatgttcgtggcgg

SEQ ID NO: 117422 - DNA, 75 bp, Artificial Sequence
  Synthetic
gtggattcactacttcattgcgcgtgctgaggccatgctgcaagtttgggtgcccccgttacatgttcgtggcgg

SEQ ID NO: 117423 - DNA, 75 bp, Artificial Sequence
  Synthetic
gtggattcactacttcattgcgcgtgctgaggccatgctgcatgtttgggtgcccccgttacatgttcgtggcgg

SEQ ID NO: 117424 - DNA, 75 bp, Artificial Sequence
  Synthetic
gtggattcactacttcattgcgcgtgctgaggccatgctgcacgtttgggtgcccccgttacatgttcgtggcgg

SEQ ID NO: 117425 - DNA, 75 bp, Artificial Sequence
  Synthetic
gtggattcactacttcattgcgcgtgctgaggccatgctgcaggtttgggtgcccccgttacatgttcgtggcgg

SEQ ID NO: 117426 - DNA, 75 bp, Artificial Sequence
  Synthetic
gtggattcactacttcattgcgcgtgccgaggccatgctgcaagtttgggtgcccccgttacatgttcgtggcgg

SEQ ID NO: 117427 - DNA, 75 bp, Artificial Sequence
  Synthetic
gtggattcactacttcattgcgcgtgccgaggccatgctgcatgtttgggtgcccccgttacatgttcgtggcgg

SEQ ID NO: 117428 - DNA, 75 bp, Artificial Sequence
  Synthetic
gtggattcactacttcattgcgcgtgccgaggccatgctgcacgtttgggtgcccccgttacatgttcgtggcgg

SEQ ID NO: 117429 - DNA, 75 bp, Artificial Sequence
  Synthetic
gtggattcactacttcattgcgcgtgccgaggccatgctgcaggtttgggtgcccccgttacatgttcgtggcgg

SEQ ID NO: 117430 - DNA, 75 bp, Artificial Sequence
  Synthetic
gtggattcactacttcattgcgcgtgcggaggccatgctgcaagtttgggtgcccccgttacatgttcgtggcgg

SEQ ID NO: 117431 - DNA, 75 bp, Artificial Sequence
  Synthetic
gtggattcactacttcattgcgcgtgcggaggccatgctgcatgtttgggtgcccccgttacatgttcgtggcgg

SEQ ID NO: 117432 - DNA, 75 bp, Artificial Sequence
  Synthetic
gtggattcactacttcattgcgcgtgcggaggccatgctgcacgtttgggtgcccccgttacatgttcgtggcgg

SEQ ID NO: 117433 - DNA, 75 bp, Artificial Sequence
  Synthetic
gtggattcactacttcattgcgcgtgcggaggccatgctgcaggtttgggtgcccccgttacatgttcgtggcgg

SEQ ID NO: 117434 - DNA, 75 bp, Artificial Sequence
  Synthetic
gtggattcagtacttcattgcgcgtgcagaggccatgctgcaagtttgggtgcccccgttacatgttcgtggcgg

SEQ ID NO: 117435 - DNA, 75 bp, Artificial Sequence
  Synthetic
gtggattcagtacttcattgcgcgtgcagaggccatgctgcatgtttgggtgcccccgttacatgttcgtggcgg

SEQ ID NO: 117436 - DNA, 75 bp, Artificial Sequence
  Synthetic
gtggattcagtacttcattgcgcgtgcagaggccatgctgcacgtttgggtgcccccgttacatgttcgtggcgg

SEQ ID NO: 117437 - DNA, 75 bp, Artificial Sequence
  Synthetic
gtggattcagtacttcattgcgcgtgcagaggccatgctgcaggtttgggtgcccccgttacatgttcgtggcgg

SEQ ID NO: 117438 - DNA, 75 bp, Artificial Sequence
  Synthetic
gtggattcagtacttcattgcgcgtgctgaggccatgctgcaagtttgggtgcccccgttacatgttcgtggcgg

SEQ ID NO: 117439 - DNA, 75 bp, Artificial Sequence
  Synthetic
gtggattcagtacttcattgcgcgtgctgaggccatgctgcatgtttgggtgcccccgttacatgttcgtggcgg

SEQ ID NO: 117440 - DNA, 75 bp, Artificial Sequence
  Synthetic
gtggattcagtacttcattgcgcgtgctgaggccatgctgcacgtttgggtgcccccgttacatgttcgtggcgg

SEQ ID NO: 117441 - DNA, 75 bp, Artificial Sequence
  Synthetic
gtggattcagtacttcattgcgcgtgctgaggccatgctgcaggtttgggtgcccccgttacatgttcgtggcgg

SEQ ID NO: 117442 - DNA, 75 bp, Artificial Sequence
  Synthetic
gtggattcagtacttcattgcgcgtgccgaggccatgctgcaagtttgggtgcccccgttacatgttcgtggcgg

SEQ ID NO: 117443 - DNA, 75 bp, Artificial Sequence
  Synthetic
gtggattcagtacttcattgcgcgtgccgaggccatgctgcatgtttgggtgcccccgttacatgttcgtggcgg

SEQ ID NO: 117444 - DNA, 75 bp, Artificial Sequence
  Synthetic
gtggattcagtacttcattgcgcgtgccgaggccatgctgcacgtttgggtgcccccgttacatgttcgtggcgg

SEQ ID NO: 117445 - DNA, 75 bp, Artificial Sequence
  Synthetic
gtggattcagtacttcattgcgcgtgccgaggccatgctgcaggtttgggtgcccccgttacatgttcgtggcgg

SEQ ID NO: 117446 - DNA, 75 bp, Artificial Sequence
  Synthetic
gtggattcagtacttcattgcgcgtgcggaggccatgctgcaagtttgggtgcccccgttacatgttcgtggcgg

SEQ ID NO: 117447 - DNA, 75 bp, Artificial Sequence
  Synthetic
gtggattcagtacttcattgcgcgtgcggaggccatgctgcatgtttgggtgcccccgttacatgttcgtggcgg

SEQ ID NO: 117448 - DNA, 75 bp, Artificial Sequence
  Synthetic
gtggattcagtacttcattgcgcgtgcggaggccatgctgcacgtttgggtgcccccgttacatgttcgtggcgg

SEQ ID NO: 117449 - DNA, 75 bp, Artificial Sequence
  Synthetic
gtggattcagtacttcattgcgcgtgcggaggccatgctgcaggtttgggtgcccccgttacatgttcgtggcgg

SEQ ID NO: 117450 - DNA, 75 bp, Artificial Sequence
  Synthetic
ttgggcccggccggattaaaatccgccccttctagaaccctggaagaggcctgactaccaaccacctactgtcgc

SEQ ID NO: 117451 - DNA, 75 bp, Artificial Sequence
  Synthetic
ttgggcccggccggattataatccgccccttctagaaccctggaagaggcctgactaccaaccacctactgtcgc

SEQ ID NO: 117452 - DNA, 75 bp, Artificial Sequence
  Synthetic
ttgggcccggccggattacaatccgccccttctagaaccctggaagaggcctgactaccaaccacctactgtcgc

SEQ ID NO: 117453 - DNA, 75 bp, Artificial Sequence
  Synthetic
ttgggcccggccggattagaatccgccccttctagaaccctggaagaggcctgactaccaaccacctactgtcgc

SEQ ID NO: 117454 - DNA, 75 bp, Artificial Sequence
  Synthetic
tgcctattgcatccgcaattggggtttgatgtcactaagattgtgttggccctggcgggtcctctctacatgctt

SEQ ID NO: 117455 - DNA, 75 bp, Artificial Sequence
  Synthetic
ctggggggcagacaccgcggcgtgcggggacatcatcttgggtctgcccgtctccgcccgaagggggagggagat

SEQ ID NO: 117456 - DNA, 75 bp, Artificial Sequence
  Synthetic
gcaggctcggattgccatacactcactgactgagagactctacgtgggagggcccatgatgaacaacaaagggca

SEQ ID NO: 117457 - DNA, 75 bp, Artificial Sequence
  Synthetic
cctggcgggtcctctctacatgcttcagtatagcttgctcaaaataccatactttgtaagagcgagcatattact

SEQ ID NO: 117458 - DNA, 75 bp, Artificial Sequence
  Synthetic
cctggcgggtcctctctacatgcttcagtatagcttgctcaaaataccatactttgtaagagcgagcattttact

SEQ ID NO: 117459 - DNA, 75 bp, Artificial Sequence
  Synthetic
cctggcgggtcctctctacatgcttcagtatagcttgctcaaaataccatactttgtaagagcgagcatcttact

SEQ ID NO: 117460 - DNA, 75 bp, Artificial Sequence
  Synthetic
cctggcgggtcctctctacatgcttcagtatagcttgctcaaaataccatactttgtaagagcgagcatgttact

SEQ ID NO: 117461 - DNA, 75 bp, Artificial Sequence
  Synthetic
cctggcgggtcctctctacatgcttcagtatagcttgctcaaaataccatactttgttagagcgagcatattact

SEQ ID NO: 117462 - DNA, 75 bp, Artificial Sequence
  Synthetic
cctggcgggtcctctctacatgcttcagtatagcttgctcaaaataccatactttgttagagcgagcattttact

SEQ ID NO: 117463 - DNA, 75 bp, Artificial Sequence
  Synthetic
cctggcgggtcctctctacatgcttcagtatagcttgctcaaaataccatactttgttagagcgagcatcttact

SEQ ID NO: 117464 - DNA, 75 bp, Artificial Sequence
  Synthetic
cctggcgggtcctctctacatgcttcagtatagcttgctcaaaataccatactttgttagagcgagcatgttact

SEQ ID NO: 117465 - DNA, 75 bp, Artificial Sequence
  Synthetic
cctggcgggtcctctctacatgcttcagtatagcttgctcaaaataccatactttgtcagagcgagcatattact

SEQ ID NO: 117466 - DNA, 75 bp, Artificial Sequence
  Synthetic
cctggcgggtcctctctacatgcttcagtatagcttgctcaaaataccatactttgtcagagcgagcattttact

SEQ ID NO: 117467 - DNA, 75 bp, Artificial Sequence
  Synthetic
cctggcgggtcctctctacatgcttcagtatagcttgctcaaaataccatactttgtcagagcgagcatcttact

SEQ ID NO: 117468 - DNA, 75 bp, Artificial Sequence
  Synthetic
cctggcgggtcctctctacatgcttcagtatagcttgctcaaaataccatactttgtcagagcgagcatgttact

SEQ ID NO: 117469 - DNA, 75 bp, Artificial Sequence
  Synthetic
cctggcgggtcctctctacatgcttcagtatagcttgctcaaaataccatactttgtgagagcgagcatattact

SEQ ID NO: 117470 - DNA, 75 bp, Artificial Sequence
  Synthetic
cctggcgggtcctctctacatgcttcagtatagcttgctcaaaataccatactttgtgagagcgagcattttact

SEQ ID NO: 117471 - DNA, 75 bp, Artificial Sequence
  Synthetic
cctggcgggtcctctctacatgcttcagtatagcttgctcaaaataccatactttgtgagagcgagcatcttact

SEQ ID NO: 117472 - DNA, 75 bp, Artificial Sequence
  Synthetic
cctggcgggtcctctctacatgcttcagtatagcttgctcaaaataccatactttgtgagagcgagcatgttact

SEQ ID NO: 117473 - DNA, 75 bp, Artificial Sequence
  Synthetic
cctggcgggtcctctctacatgcttcagtatagcttgctcaaattaccatactttgtaagagcgagcatattact

SEQ ID NO: 117474 - DNA, 75 bp, Artificial Sequence
  Synthetic
cctggcgggtcctctctacatgcttcagtatagcttgctcaaattaccatactttgtaagagcgagcattttact

SEQ ID NO: 117475 - DNA, 75 bp, Artificial Sequence
  Synthetic
cctggcgggtcctctctacatgcttcagtatagcttgctcaaattaccatactttgtaagagcgagcatcttact

SEQ ID NO: 117476 - DNA, 75 bp, Artificial Sequence
  Synthetic
cctggcgggtcctctctacatgcttcagtatagcttgctcaaattaccatactttgtaagagcgagcatgttact

SEQ ID NO: 117477 - DNA, 75 bp, Artificial Sequence
  Synthetic
cctggcgggtcctctctacatgcttcagtatagcttgctcaaattaccatactttgttagagcgagcatattact

SEQ ID NO: 117478 - DNA, 75 bp, Artificial Sequence
  Synthetic
cctggcgggtcctctctacatgcttcagtatagcttgctcaaattaccatactttgttagagcgagcattttact

SEQ ID NO: 117479 - DNA, 75 bp, Artificial Sequence
  Synthetic
cctggcgggtcctctctacatgcttcagtatagcttgctcaaattaccatactttgttagagcgagcatcttact

SEQ ID NO: 117480 - DNA, 75 bp, Artificial Sequence
  Synthetic
cctggcgggtcctctctacatgcttcagtatagcttgctcaaattaccatactttgttagagcgagcatgttact

SEQ ID NO: 117481 - DNA, 75 bp, Artificial Sequence
  Synthetic
cctggcgggtcctctctacatgcttcagtatagcttgctcaaattaccatactttgtcagagcgagcatattact

SEQ ID NO: 117482 - DNA, 75 bp, Artificial Sequence
  Synthetic
cctggcgggtcctctctacatgcttcagtatagcttgctcaaattaccatactttgtcagagcgagcattttact

SEQ ID NO: 117483 - DNA, 75 bp, Artificial Sequence
  Synthetic
cctggcgggtcctctctacatgcttcagtatagcttgctcaaattaccatactttgtcagagcgagcatcttact

SEQ ID NO: 117484 - DNA, 75 bp, Artificial Sequence
  Synthetic
cctggcgggtcctctctacatgcttcagtatagcttgctcaaattaccatactttgtcagagcgagcatgttact

SEQ ID NO: 117485 - DNA, 75 bp, Artificial Sequence
  Synthetic
cctggcgggtcctctctacatgcttcagtatagcttgctcaaattaccatactttgtgagagcgagcatattact

SEQ ID NO: 117486 - DNA, 75 bp, Artificial Sequence
  Synthetic
cctggcgggtcctctctacatgcttcagtatagcttgctcaaattaccatactttgtgagagcgagcattttact

SEQ ID NO: 117487 - DNA, 75 bp, Artificial Sequence
  Synthetic
cctggcgggtcctctctacatgcttcagtatagcttgctcaaattaccatactttgtgagagcgagcatcttact

SEQ ID NO: 117488 - DNA, 75 bp, Artificial Sequence
  Synthetic
cctggcgggtcctctctacatgcttcagtatagcttgctcaaattaccatactttgtgagagcgagcatgttact

SEQ ID NO: 117489 - DNA, 75 bp, Artificial Sequence
  Synthetic
cctggcgggtcctctctacatgcttcagtatagcttgctcaaactaccatactttgtaagagcgagcatattact

SEQ ID NO: 117490 - DNA, 75 bp, Artificial Sequence
  Synthetic
cctggcgggtcctctctacatgcttcagtatagcttgctcaaactaccatactttgtaagagcgagcattttact

SEQ ID NO: 117491 - DNA, 75 bp, Artificial Sequence
  Synthetic
cctggcgggtcctctctacatgcttcagtatagcttgctcaaactaccatactttgtaagagcgagcatcttact

SEQ ID NO: 117492 - DNA, 75 bp, Artificial Sequence
  Synthetic
cctggcgggtcctctctacatgcttcagtatagcttgctcaaactaccatactttgtaagagcgagcatgttact

SEQ ID NO: 117493 - DNA, 75 bp, Artificial Sequence
  Synthetic
cctggcgggtcctctctacatgcttcagtatagcttgctcaaactaccatactttgttagagcgagcatattact

SEQ ID NO: 117494 - DNA, 75 bp, Artificial Sequence
  Synthetic
cctggcgggtcctctctacatgcttcagtatagcttgctcaaactaccatactttgttagagcgagcattttact

SEQ ID NO: 117495 - DNA, 75 bp, Artificial Sequence
  Synthetic
cctggcgggtcctctctacatgcttcagtatagcttgctcaaactaccatactttgttagagcgagcatcttact

SEQ ID NO: 117496 - DNA, 75 bp, Artificial Sequence
  Synthetic
cctggcgggtcctctctacatgcttcagtatagcttgctcaaactaccatactttgttagagcgagcatgttact

SEQ ID NO: 117497 - DNA, 75 bp, Artificial Sequence
  Synthetic
cctggcgggtcctctctacatgcttcagtatagcttgctcaaactaccatactttgtcagagcgagcatattact

SEQ ID NO: 117498 - DNA, 75 bp, Artificial Sequence
  Synthetic
cctggcgggtcctctctacatgcttcagtatagcttgctcaaactaccatactttgtcagagcgagcattttact

SEQ ID NO: 117499 - DNA, 75 bp, Artificial Sequence
  Synthetic
cctggcgggtcctctctacatgcttcagtatagcttgctcaaactaccatactttgtcagagcgagcatcttact

SEQ ID NO: 117500 - DNA, 75 bp, Artificial Sequence
  Synthetic
cctggcgggtcctctctacatgcttcagtatagcttgctcaaactaccatactttgtcagagcgagcatgttact

SEQ ID NO: 117501 - DNA, 75 bp, Artificial Sequence
  Synthetic
cctggcgggtcctctctacatgcttcagtatagcttgctcaaactaccatactttgtgagagcgagcatattact

SEQ ID NO: 117502 - DNA, 75 bp, Artificial Sequence
  Synthetic
cctggcgggtcctctctacatgcttcagtatagcttgctcaaactaccatactttgtgagagcgagcattttact

SEQ ID NO: 117503 - DNA, 75 bp, Artificial Sequence
  Synthetic
cctggcgggtcctctctacatgcttcagtatagcttgctcaaactaccatactttgtgagagcgagcatcttact

SEQ ID NO: 117504 - DNA, 75 bp, Artificial Sequence
  Synthetic
cctggcgggtcctctctacatgcttcagtatagcttgctcaaactaccatactttgtgagagcgagcatgttact

SEQ ID NO: 117505 - DNA, 75 bp, Artificial Sequence
  Synthetic
cctggcgggtcctctctacatgcttcagtatagcttgctcaaagtaccatactttgtaagagcgagcatattact

SEQ ID NO: 117506 - DNA, 75 bp, Artificial Sequence
  Synthetic
cctggcgggtcctctctacatgcttcagtatagcttgctcaaagtaccatactttgtaagagcgagcattttact

SEQ ID NO: 117507 - DNA, 75 bp, Artificial Sequence
  Synthetic
cctggcgggtcctctctacatgcttcagtatagcttgctcaaagtaccatactttgtaagagcgagcatcttact

SEQ ID NO: 117508 - DNA, 75 bp, Artificial Sequence
  Synthetic
cctggcgggtcctctctacatgcttcagtatagcttgctcaaagtaccatactttgtaagagcgagcatgttact

SEQ ID NO: 117509 - DNA, 75 bp, Artificial Sequence
  Synthetic
cctggcgggtcctctctacatgcttcagtatagcttgctcaaagtaccatactttgttagagcgagcatattact

SEQ ID NO: 117510 - DNA, 75 bp, Artificial Sequence
  Synthetic
cctggcgggtcctctctacatgcttcagtatagcttgctcaaagtaccatactttgttagagcgagcattttact

SEQ ID NO: 117511 - DNA, 75 bp, Artificial Sequence
  Synthetic
cctggcgggtcctctctacatgcttcagtatagcttgctcaaagtaccatactttgttagagcgagcatcttact

SEQ ID NO: 117512 - DNA, 75 bp, Artificial Sequence
  Synthetic
cctggcgggtcctctctacatgcttcagtatagcttgctcaaagtaccatactttgttagagcgagcatgttact

SEQ ID NO: 117513 - DNA, 75 bp, Artificial Sequence
  Synthetic
cctggcgggtcctctctacatgcttcagtatagcttgctcaaagtaccatactttgtcagagcgagcatattact

SEQ ID NO: 117514 - DNA, 75 bp, Artificial Sequence
  Synthetic
cctggcgggtcctctctacatgcttcagtatagcttgctcaaagtaccatactttgtcagagcgagcattttact

SEQ ID NO: 117515 - DNA, 75 bp, Artificial Sequence
  Synthetic
cctggcgggtcctctctacatgcttcagtatagcttgctcaaagtaccatactttgtcagagcgagcatcttact

SEQ ID NO: 117516 - DNA, 75 bp, Artificial Sequence
  Synthetic
cctggcgggtcctctctacatgcttcagtatagcttgctcaaagtaccatactttgtcagagcgagcatgttact

SEQ ID NO: 117517 - DNA, 75 bp, Artificial Sequence
  Synthetic
cctggcgggtcctctctacatgcttcagtatagcttgctcaaagtaccatactttgtgagagcgagcatattact

SEQ ID NO: 117518 - DNA, 75 bp, Artificial Sequence
  Synthetic
cctggcgggtcctctctacatgcttcagtatagcttgctcaaagtaccatactttgtgagagcgagcattttact

SEQ ID NO: 117519 - DNA, 75 bp, Artificial Sequence
  Synthetic
cctggcgggtcctctctacatgcttcagtatagcttgctcaaagtaccatactttgtgagagcgagcatcttact

SEQ ID NO: 117520 - DNA, 75 bp, Artificial Sequence
  Synthetic
cctggcgggtcctctctacatgcttcagtatagcttgctcaaagtaccatactttgtgagagcgagcatgttact

SEQ ID NO: 117521 - DNA, 75 bp, Artificial Sequence
  Synthetic
gagttggccgagaagacctttggtcagactccaccaagcggcgactctggctgctccaccggggcagaaacggcc

SEQ ID NO: 117522 - DNA, 75 bp, Artificial Sequence
  Synthetic
ggcccatgatgaacaacaaagggcagtcctgcggatacaggcgatgccgcgccagcggagtgttcaccaccagca

SEQ ID NO: 117523 - DNA, 75 bp, Artificial Sequence
  Synthetic
aggcgtcgagctgtggtcttggaccagagcaatgtgggggacgcccttatggcgctggccgttaagagcttcggc

SEQ ID NO: 117524 - DNA, 75 bp, Artificial Sequence
  Synthetic
gctccatctcctccatgccacccctcgaaggtgagccgggggatcctgacttggagcctgcgtcggtcgaccacc

SEQ ID NO: 117525 - DNA, 75 bp, Artificial Sequence
  Synthetic
catctcagagagtcaggggactgaggaggatgagcgaaacctgagagtcttcacggaggctatgaccaggtattc

SEQ ID NO: 117526 - DNA, 75 bp, Artificial Sequence
  Synthetic
ctggcgcccttgtcagactgggcgagcaacggcctacgagatctggccgtcgccgtcgagcctgtcgtcttctcc

SEQ ID NO: 117527 - DNA, 75 bp, Artificial Sequence
  Synthetic
ctggcgcccttgtcagactgggcgtgcaacggcctacgagatctggccgtcgccgtcgagcctgtcgtcttctcc

SEQ ID NO: 117528 - DNA, 75 bp, Artificial Sequence
  Synthetic
ctggcgcccttgtcagactgggcgcgcaacggcctacgagatctggccgtcgccgtcgagcctgtcgtcttctcc

SEQ ID NO: 117529 - DNA, 75 bp, Artificial Sequence
  Synthetic
ctggcgcccttgtcagactgggcgggcaacggcctacgagatctggccgtcgccgtcgagcctgtcgtcttctcc

SEQ ID NO: 117530 - DNA, 75 bp, Artificial Sequence
  Synthetic
atgctgtctcagtcgccggcatccacggattctggtacgccatctttgtcatctgcatcgcttggcatgtcaagg

SEQ ID NO: 117531 - DNA, 75 bp, Artificial Sequence
  Synthetic
cgccgtcgagcctgtcgtcttctcccctatggagaagaaagtcatcacttggggtgctgacactgctgcatgtgg

SEQ ID NO: 117532 - DNA, 75 bp, Artificial Sequence
  Synthetic
tcgagccggagtcggcagactcctcccccccccccaccggggagggggaggatcttggctccggagctggttcat

SEQ ID NO: 117533 - DNA, 75 bp, Artificial Sequence
  Synthetic
cgccgcatgcggattgtggcccctgctgctcctggtcttgatgttgcctgagagggcgtacgcctttgatcggga

SEQ ID NO: 117534 - DNA, 75 bp, Artificial Sequence
  Synthetic
gtactcctggactggggcgctcatcaccccctgcagtcgtgaggaggaaaagttaccaataaaccccttgagcaa

SEQ ID NO: 117535 - DNA, 75 bp, Artificial Sequence
  Synthetic
agatactacctgactagagaccctaccactccactcgccagggctgcctgggaaacagtcagacactcccctgtc

SEQ ID NO: 117536 - DNA, 75 bp, Artificial Sequence
  Synthetic
gagtggaggttggcacctccttgctccgatcacagcatatgcacagcagactaggggtgtggtgggtaccatcgt

SEQ ID NO: 117537 - DNA, 75 bp, Artificial Sequence
  Synthetic
gagtggaggttggcacctccttgctccgatcacagcatatgctcagcagactaggggtgtggtgggtaccatcgt

SEQ ID NO: 117538 - DNA, 75 bp, Artificial Sequence
  Synthetic
gagtggaggttggcacctccttgctccgatcacagcatatgcccagcagactaggggtgtggtgggtaccatcgt

SEQ ID NO: 117539 - DNA, 75 bp, Artificial Sequence
  Synthetic
gagtggaggttggcacctccttgctccgatcacagcatatgcgcagcagactaggggtgtggtgggtaccatcgt

SEQ ID NO: 117540 - DNA, 75 bp, Artificial Sequence
  Synthetic
gagtggaggttggctcctccttgctccgatcacagcatatgcacagcagactaggggtgtggtgggtaccatcgt

SEQ ID NO: 117541 - DNA, 75 bp, Artificial Sequence
  Synthetic
gagtggaggttggctcctccttgctccgatcacagcatatgctcagcagactaggggtgtggtgggtaccatcgt

SEQ ID NO: 117542 - DNA, 75 bp, Artificial Sequence
  Synthetic
gagtggaggttggctcctccttgctccgatcacagcatatgcccagcagactaggggtgtggtgggtaccatcgt

SEQ ID NO: 117543 - DNA, 75 bp, Artificial Sequence
  Synthetic
gagtggaggttggctcctccttgctccgatcacagcatatgcgcagcagactaggggtgtggtgggtaccatcgt

SEQ ID NO: 117544 - DNA, 75 bp, Artificial Sequence
  Synthetic
gagtggaggttggcccctccttgctccgatcacagcatatgcacagcagactaggggtgtggtgggtaccatcgt

SEQ ID NO: 117545 - DNA, 75 bp, Artificial Sequence
  Synthetic
gagtggaggttggcccctccttgctccgatcacagcatatgctcagcagactaggggtgtggtgggtaccatcgt

SEQ ID NO: 117546 - DNA, 75 bp, Artificial Sequence
  Synthetic
gagtggaggttggcccctccttgctccgatcacagcatatgcccagcagactaggggtgtggtgggtaccatcgt

SEQ ID NO: 117547 - DNA, 75 bp, Artificial Sequence
  Synthetic
gagtggaggttggcccctccttgctccgatcacagcatatgcgcagcagactaggggtgtggtgggtaccatcgt

SEQ ID NO: 117548 - DNA, 75 bp, Artificial Sequence
  Synthetic
gagtggaggttggcgcctccttgctccgatcacagcatatgcacagcagactaggggtgtggtgggtaccatcgt

SEQ ID NO: 117549 - DNA, 75 bp, Artificial Sequence
  Synthetic
gagtggaggttggcgcctccttgctccgatcacagcatatgctcagcagactaggggtgtggtgggtaccatcgt

SEQ ID NO: 117550 - DNA, 75 bp, Artificial Sequence
  Synthetic
gagtggaggttggcgcctccttgctccgatcacagcatatgcccagcagactaggggtgtggtgggtaccatcgt

SEQ ID NO: 117551 - DNA, 75 bp, Artificial Sequence
  Synthetic
gagtggaggttggcgcctccttgctccgatcacagcatatgcgcagcagactaggggtgtggtgggtaccatcgt

SEQ ID NO: 117552 - DNA, 75 bp, Artificial Sequence
  Synthetic
actgcctatcaaccctctaagcaactcactgttgcggtatcacaataaagtgtactccaccacatccaagagtgc

SEQ ID NO: 117553 - DNA, 75 bp, Artificial Sequence
  Synthetic
agttaccaataaaccccttgagcaactcgctgttgcggtatcacaacaaggtgtattgtacaacatcaagaagcg

SEQ ID NO: 117554 - DNA, 75 bp, Artificial Sequence
  Synthetic
tcggctaggagaggtaacctcgtactcctaggccccgctgatgatatgaagagtggaggttggcacctccttgct

SEQ ID NO: 117555 - DNA, 75 bp, Artificial Sequence
  Synthetic
tcggctaggagaggtaacctcgtactcctaggccccgctgatgatatgaagagtggaggttggctcctccttgct

SEQ ID NO: 117556 - DNA, 75 bp, Artificial Sequence
  Synthetic
tcggctaggagaggtaacctcgtactcctaggccccgctgatgatatgaagagtggaggttggcccctccttgct

SEQ ID NO: 117557 - DNA, 75 bp, Artificial Sequence
  Synthetic
tcggctaggagaggtaacctcgtactcctaggccccgctgatgatatgaagagtggaggttggcgcctccttgct

SEQ ID NO: 117558 - DNA, 75 bp, Artificial Sequence
  Synthetic
caatacttcattgccagagccgaggccatcacccatgtctatgtgccatctctagacgtgcgcgggcctcgcgac

SEQ ID NO: 117559 - DNA, 75 bp, Artificial Sequence
  Synthetic
ctgctctgcccctcggggcacgctgtgggcatcttccgggctgccgtgtgcacccggggggttgcgaaggcggtg

SEQ ID NO: 117560 - DNA, 75 bp, Artificial Sequence
  Synthetic
tatggtcctaatgacacatttctactccattttgctggctcaggacactctgaaccagaacctcaattttgaaat

SEQ ID NO: 117561 - DNA, 75 bp, Artificial Sequence
  Synthetic
ctctggacggtttaccatggtgcggggtcaaagacgctagccggcccgaaaggaccggtgtgtcaaatgtacacc

SEQ ID NO: 117562 - DNA, 75 bp, Artificial Sequence
  Synthetic
tttgacagagtgcaggtgttcgacgcccactatgattcagtcttaaaggacattaagcttgccgcctccaaggtc

SEQ ID NO: 117563 - DNA, 75 bp, Artificial Sequence
  Synthetic
tggggccaaggaggtacgcagcttatccaagagggccgttgaccacatccggtccgtgtggaaggacctcttgga

SEQ ID NO: 117564 - DNA, 75 bp, Artificial Sequence
  Synthetic
ccaggagggccgtcaaccacatcaagtccgtgtgggaggacctcctggaagaccagtcaacactaattcctacaa

SEQ ID NO: 117565 - DNA, 75 bp, Artificial Sequence
  Synthetic
gaaaaaggcagctcgcctcatcgtattccctgacctcagtgtcagggtttgcgagaagatggccctttatgacat

SEQ ID NO: 117566 - DNA, 75 bp, Artificial Sequence
  Synthetic
ctttatcagactgggctgctgaggggcttaatgacctagcggtggcacttgagccggtcgtgtttacagccatgg

SEQ ID NO: 117567 - DNA, 75 bp, Artificial Sequence
  Synthetic
tgaaggggtcgtcaggcggtcctatgctatgcccctccggccacgtcgcggggattttccgcgcggccgtgtgca

SEQ ID NO: 117568 - DNA, 75 bp, Artificial Sequence
  Synthetic
cgagaagatggccttatatgacattgcccagaagcttcccctggcagtgatggggccttcctatggattccaata

SEQ ID NO: 117569 - DNA, 75 bp, Artificial Sequence
  Synthetic
tgcttcaccccaagccctgttgtggtggggacgaccgatcgtttcggcgtccctacgtatagctggggggagaat

SEQ ID NO: 117570 - DNA, 75 bp, Artificial Sequence
  Synthetic
actgtgccccaccctaacatcgaggaggttgctctgtccaccaccggagagatccccttttacggcaaggctatc

SEQ ID NO: 117571 - DNA, 75 bp, Artificial Sequence
  Synthetic
ccttctgcaagcgtggaaggaaaagaaggaccccatggggctctcctatgacacccggtgcttcgactcgactgt

SEQ ID NO: 117572 - DNA, 75 bp, Artificial Sequence
  Synthetic
aaggaccccatggggctctcctatgacacccggtgcttcgactcgactgtcacggagagggacattcgagtcgag

SEQ ID NO: 117573 - DNA, 75 bp, Artificial Sequence
  Synthetic
cccacagacatatcaagtggggtacctccatgcacccacgggcagtggcaagagcactaaagtccctgcggcgta

SEQ ID NO: 117574 - DNA, 75 bp, Artificial Sequence
  Synthetic
acagagagagacatcagaactgaggagtccatatatcaggcctgcacgctgcctgaagaagccaggactgccata

SEQ ID NO: 117575 - DNA, 75 bp, Artificial Sequence
  Synthetic
acccatgtcacgaacgactgctccaactcaagcattgtgtatgaggcagcggacgtgatcatgacactccgccat

SEQ ID NO: 117576 - DNA, 75 bp, Artificial Sequence
  Synthetic
gggacaatcctgtggctaccggcgatgccgggctagtggagttttcaccaccagcatggggaacaccattacgtg

SEQ ID NO: 117577 - DNA, 75 bp, Artificial Sequence
  Synthetic
cggtttaccatggggcgggcagcaagaccatcagcggcccgaaaggaccggtcaaccagatgtacaccaatgtcg

SEQ ID NO: 117578 - DNA, 75 bp, Artificial Sequence
  Synthetic
actagcatgggaaacactcttacgtgctatgtgaaagcccaagcggcctgcagggctgcagggattgttgccccc

SEQ ID NO: 117579 - DNA, 75 bp, Artificial Sequence
  Synthetic
agcttccaggtggcccacctgcatgctcccactggcagcggtaagagcaccaaggtcccggctgcgtacgcggct

SEQ ID NO: 117580 - DNA, 75 bp, Artificial Sequence
  Synthetic
ggtggttgctcaggtggggcctatgacgtcatcatctgtgatgagtgccattcaactgatcctactactattctg

SEQ ID NO: 117581 - DNA, 75 bp, Artificial Sequence
  Synthetic
acccgaccactccacttgcccgggctgcctgggaaacagcgagacactcccccatcaattcatggctagggaaca

SEQ ID NO: 117582 - DNA, 75 bp, Artificial Sequence
  Synthetic
acccgaccactccacttgcccgggctgcctgggaaacagcgagacactcccccatcaattcatggcttgggaaca

SEQ ID NO: 117583 - DNA, 75 bp, Artificial Sequence
  Synthetic
acccgaccactccacttgcccgggctgcctgggaaacagcgagacactcccccatcaattcatggctcgggaaca

SEQ ID NO: 117584 - DNA, 75 bp, Artificial Sequence
  Synthetic
acccgaccactccacttgcccgggctgcctgggaaacagcgagacactcccccatcaattcatggctggggaaca

SEQ ID NO: 117585 - DNA, 75 bp, Artificial Sequence
  Synthetic
acccgaccactcctcttgcccgggctgcctgggaaacagcgagacactcccccatcaattcatggctagggaaca

SEQ ID NO: 117586 - DNA, 75 bp, Artificial Sequence
  Synthetic
acccgaccactcctcttgcccgggctgcctgggaaacagcgagacactcccccatcaattcatggcttgggaaca

SEQ ID NO: 117587 - DNA, 75 bp, Artificial Sequence
  Synthetic
acccgaccactcctcttgcccgggctgcctgggaaacagcgagacactcccccatcaattcatggctcgggaaca

SEQ ID NO: 117588 - DNA, 75 bp, Artificial Sequence
  Synthetic
acccgaccactcctcttgcccgggctgcctgggaaacagcgagacactcccccatcaattcatggctggggaaca

SEQ ID NO: 117589 - DNA, 75 bp, Artificial Sequence
  Synthetic
acccgaccactccccttgcccgggctgcctgggaaacagcgagacactcccccatcaattcatggctagggaaca

SEQ ID NO: 117590 - DNA, 75 bp, Artificial Sequence
  Synthetic
acccgaccactccccttgcccgggctgcctgggaaacagcgagacactcccccatcaattcatggcttgggaaca

SEQ ID NO: 117591 - DNA, 75 bp, Artificial Sequence
  Synthetic
acccgaccactccccttgcccgggctgcctgggaaacagcgagacactcccccatcaattcatggctcgggaaca

SEQ ID NO: 117592 - DNA, 75 bp, Artificial Sequence
  Synthetic
acccgaccactccccttgcccgggctgcctgggaaacagcgagacactcccccatcaattcatggctggggaaca

SEQ ID NO: 117593 - DNA, 75 bp, Artificial Sequence
  Synthetic
acccgaccactccgcttgcccgggctgcctgggaaacagcgagacactcccccatcaattcatggctagggaaca

SEQ ID NO: 117594 - DNA, 75 bp, Artificial Sequence
  Synthetic
acccgaccactccgcttgcccgggctgcctgggaaacagcgagacactcccccatcaattcatggcttgggaaca

SEQ ID NO: 117595 - DNA, 75 bp, Artificial Sequence
  Synthetic
acccgaccactccgcttgcccgggctgcctgggaaacagcgagacactcccccatcaattcatggctcgggaaca

SEQ ID NO: 117596 - DNA, 75 bp, Artificial Sequence
  Synthetic
acccgaccactccgcttgcccgggctgcctgggaaacagcgagacactcccccatcaattcatggctggggaaca

SEQ ID NO: 117597 - DNA, 75 bp, Artificial Sequence
  Synthetic
gcctcaacgctgtggctttctataggggcattgacgtggcggtcataccaacctcaggcgacgttgttgtctgcg

SEQ ID NO: 117598 - DNA, 75 bp, Artificial Sequence
  Synthetic
tcagctgttgaagagactccaccagtggattaatgaggactgctccacgccatgctccggttcgtggctaaggga

SEQ ID NO: 117599 - DNA, 75 bp, Artificial Sequence
  Synthetic
gatactctgggccaagatctcaacttcgagatgtacggagctgtgtactcagtgagtcctctggacctcccagct

SEQ ID NO: 117600 - DNA, 75 bp, Artificial Sequence
  Synthetic
cgagatgtacggggcagtatactccgtctctccactagatctcccagccataattgagagacttcacggtcttga

SEQ ID NO: 117601 - DNA, 75 bp, Artificial Sequence
  Synthetic
gactgtaatgtttcagtcactcaagttgttgacttaagccttgatcccactttaacaattgagactaccacagtg

SEQ ID NO: 117602 - DNA, 75 bp, Artificial Sequence
  Synthetic
gactgtaatgtttcagtcactcaagttgttgacttaagccttgatcccactttaacaattgagactaccactgtg

SEQ ID NO: 117603 - DNA, 75 bp, Artificial Sequence
  Synthetic
gactgtaatgtttcagtcactcaagttgttgacttaagccttgatcccactttaacaattgagactaccaccgtg

SEQ ID NO: 117604 - DNA, 75 bp, Artificial Sequence
  Synthetic
gactgtaatgtttcagtcactcaagttgttgacttaagccttgatcccactttaacaattgagactaccacggtg

SEQ ID NO: 117605 - DNA, 75 bp, Artificial Sequence
  Synthetic
gactgtaatgtttcagtcactcaagttgttgactttagccttgatcccactttaacaattgagactaccacagtg

SEQ ID NO: 117606 - DNA, 75 bp, Artificial Sequence
  Synthetic
gactgtaatgtttcagtcactcaagttgttgactttagccttgatcccactttaacaattgagactaccactgtg

SEQ ID NO: 117607 - DNA, 75 bp, Artificial Sequence
  Synthetic
gactgtaatgtttcagtcactcaagttgttgactttagccttgatcccactttaacaattgagactaccaccgtg

SEQ ID NO: 117608 - DNA, 75 bp, Artificial Sequence
  Synthetic
gactgtaatgtttcagtcactcaagttgttgactttagccttgatcccactttaacaattgagactaccacggtg

SEQ ID NO: 117609 - DNA, 75 bp, Artificial Sequence
  Synthetic
gactgtaatgtttcagtcactcaagttgttgacttcagccttgatcccactttaacaattgagactaccacagtg

SEQ ID NO: 117610 - DNA, 75 bp, Artificial Sequence
  Synthetic
gactgtaatgtttcagtcactcaagttgttgacttcagccttgatcccactttaacaattgagactaccactgtg

SEQ ID NO: 117611 - DNA, 75 bp, Artificial Sequence
  Synthetic
gactgtaatgtttcagtcactcaagttgttgacttcagccttgatcccactttaacaattgagactaccaccgtg

SEQ ID NO: 117612 - DNA, 75 bp, Artificial Sequence
  Synthetic
gactgtaatgtttcagtcactcaagttgttgacttcagccttgatcccactttaacaattgagactaccacggtg

SEQ ID NO: 117613 - DNA, 75 bp, Artificial Sequence
  Synthetic
gactgtaatgtttcagtcactcaagttgttgacttgagccttgatcccactttaacaattgagactaccacagtg

SEQ ID NO: 117614 - DNA, 75 bp, Artificial Sequence
  Synthetic
gactgtaatgtttcagtcactcaagttgttgacttgagccttgatcccactttaacaattgagactaccactgtg

SEQ ID NO: 117615 - DNA, 75 bp, Artificial Sequence
  Synthetic
gactgtaatgtttcagtcactcaagttgttgacttgagccttgatcccactttaacaattgagactaccaccgtg

SEQ ID NO: 117616 - DNA, 75 bp, Artificial Sequence
  Synthetic
gactgtaatgtttcagtcactcaagttgttgacttgagccttgatcccactttaacaattgagactaccacggtg

SEQ ID NO: 117617 - DNA, 75 bp, Artificial Sequence
  Synthetic
gactgtaatgtttcagtcactcatgttgttgacttaagccttgatcccactttaacaattgagactaccacagtg

SEQ ID NO: 117618 - DNA, 75 bp, Artificial Sequence
  Synthetic
gactgtaatgtttcagtcactcatgttgttgacttaagccttgatcccactttaacaattgagactaccactgtg

SEQ ID NO: 117619 - DNA, 75 bp, Artificial Sequence
  Synthetic
gactgtaatgtttcagtcactcatgttgttgacttaagccttgatcccactttaacaattgagactaccaccgtg

SEQ ID NO: 117620 - DNA, 75 bp, Artificial Sequence
  Synthetic
gactgtaatgtttcagtcactcatgttgttgacttaagccttgatcccactttaacaattgagactaccacggtg

SEQ ID NO: 117621 - DNA, 75 bp, Artificial Sequence
  Synthetic
gactgtaatgtttcagtcactcatgttgttgactttagccttgatcccactttaacaattgagactaccacagtg

SEQ ID NO: 117622 - DNA, 75 bp, Artificial Sequence
  Synthetic
gactgtaatgtttcagtcactcatgttgttgactttagccttgatcccactttaacaattgagactaccactgtg

SEQ ID NO: 117623 - DNA, 75 bp, Artificial Sequence
  Synthetic
gactgtaatgtttcagtcactcatgttgttgactttagccttgatcccactttaacaattgagactaccaccgtg

SEQ ID NO: 117624 - DNA, 75 bp, Artificial Sequence
  Synthetic
gactgtaatgtttcagtcactcatgttgttgactttagccttgatcccactttaacaattgagactaccacggtg

SEQ ID NO: 117625 - DNA, 75 bp, Artificial Sequence
  Synthetic
gactgtaatgtttcagtcactcatgttgttgacttcagccttgatcccactttaacaattgagactaccacagtg

SEQ ID NO: 117626 - DNA, 75 bp, Artificial Sequence
  Synthetic
gactgtaatgtttcagtcactcatgttgttgacttcagccttgatcccactttaacaattgagactaccactgtg

SEQ ID NO: 117627 - DNA, 75 bp, Artificial Sequence
  Synthetic
gactgtaatgtttcagtcactcatgttgttgacttcagccttgatcccactttaacaattgagactaccaccgtg

SEQ ID NO: 117628 - DNA, 75 bp, Artificial Sequence
  Synthetic
gactgtaatgtttcagtcactcatgttgttgacttcagccttgatcccactttaacaattgagactaccacggtg

SEQ ID NO: 117629 - DNA, 75 bp, Artificial Sequence
  Synthetic
gactgtaatgtttcagtcactcatgttgttgacttgagccttgatcccactttaacaattgagactaccacagtg

SEQ ID NO: 117630 - DNA, 75 bp, Artificial Sequence
  Synthetic
gactgtaatgtttcagtcactcatgttgttgacttgagccttgatcccactttaacaattgagactaccactgtg

SEQ ID NO: 117631 - DNA, 75 bp, Artificial Sequence
  Synthetic
gactgtaatgtttcagtcactcatgttgttgacttgagccttgatcccactttaacaattgagactaccaccgtg

SEQ ID NO: 117632 - DNA, 75 bp, Artificial Sequence
  Synthetic
gactgtaatgtttcagtcactcatgttgttgacttgagccttgatcccactttaacaattgagactaccacggtg

SEQ ID NO: 117633 - DNA, 75 bp, Artificial Sequence
  Synthetic
gactgtaatgtttcagtcactcacgttgttgacttaagccttgatcccactttaacaattgagactaccacagtg

SEQ ID NO: 117634 - DNA, 75 bp, Artificial Sequence
  Synthetic
gactgtaatgtttcagtcactcacgttgttgacttaagccttgatcccactttaacaattgagactaccactgtg

SEQ ID NO: 117635 - DNA, 75 bp, Artificial Sequence
  Synthetic
gactgtaatgtttcagtcactcacgttgttgacttaagccttgatcccactttaacaattgagactaccaccgtg

SEQ ID NO: 117636 - DNA, 75 bp, Artificial Sequence
  Synthetic
gactgtaatgtttcagtcactcacgttgttgacttaagccttgatcccactttaacaattgagactaccacggtg

SEQ ID NO: 117637 - DNA, 75 bp, Artificial Sequence
  Synthetic
gactgtaatgtttcagtcactcacgttgttgactttagccttgatcccactttaacaattgagactaccacagtg

SEQ ID NO: 117638 - DNA, 75 bp, Artificial Sequence
  Synthetic
gactgtaatgtttcagtcactcacgttgttgactttagccttgatcccactttaacaattgagactaccactgtg

SEQ ID NO: 117639 - DNA, 75 bp, Artificial Sequence
  Synthetic
gactgtaatgtttcagtcactcacgttgttgactttagccttgatcccactttaacaattgagactaccaccgtg

SEQ ID NO: 117640 - DNA, 75 bp, Artificial Sequence
  Synthetic
gactgtaatgtttcagtcactcacgttgttgactttagccttgatcccactttaacaattgagactaccacggtg

SEQ ID NO: 117641 - DNA, 75 bp, Artificial Sequence
  Synthetic
gactgtaatgtttcagtcactcacgttgttgacttcagccttgatcccactttaacaattgagactaccacagtg

SEQ ID NO: 117642 - DNA, 75 bp, Artificial Sequence
  Synthetic
gactgtaatgtttcagtcactcacgttgttgacttcagccttgatcccactttaacaattgagactaccactgtg

SEQ ID NO: 117643 - DNA, 75 bp, Artificial Sequence
  Synthetic
gactgtaatgtttcagtcactcacgttgttgacttcagccttgatcccactttaacaattgagactaccaccgtg

SEQ ID NO: 117644 - DNA, 75 bp, Artificial Sequence
  Synthetic
gactgtaatgtttcagtcactcacgttgttgacttcagccttgatcccactttaacaattgagactaccacggtg

SEQ ID NO: 117645 - DNA, 75 bp, Artificial Sequence
  Synthetic
gactgtaatgtttcagtcactcacgttgttgacttgagccttgatcccactttaacaattgagactaccacagtg

SEQ ID NO: 117646 - DNA, 75 bp, Artificial Sequence
  Synthetic
gactgtaatgtttcagtcactcacgttgttgacttgagccttgatcccactttaacaattgagactaccactgtg

SEQ ID NO: 117647 - DNA, 75 bp, Artificial Sequence
  Synthetic
gactgtaatgtttcagtcactcacgttgttgacttgagccttgatcccactttaacaattgagactaccaccgtg

SEQ ID NO: 117648 - DNA, 75 bp, Artificial Sequence
  Synthetic
gactgtaatgtttcagtcactcacgttgttgacttgagccttgatcccactttaacaattgagactaccacggtg

SEQ ID NO: 117649 - DNA, 75 bp, Artificial Sequence
  Synthetic
gactgtaatgtttcagtcactcaggttgttgacttaagccttgatcccactttaacaattgagactaccacagtg

SEQ ID NO: 117650 - DNA, 75 bp, Artificial Sequence
  Synthetic
gactgtaatgtttcagtcactcaggttgttgacttaagccttgatcccactttaacaattgagactaccactgtg

SEQ ID NO: 117651 - DNA, 75 bp, Artificial Sequence
  Synthetic
gactgtaatgtttcagtcactcaggttgttgacttaagccttgatcccactttaacaattgagactaccaccgtg

SEQ ID NO: 117652 - DNA, 75 bp, Artificial Sequence
  Synthetic
gactgtaatgtttcagtcactcaggttgttgacttaagccttgatcccactttaacaattgagactaccacggtg

SEQ ID NO: 117653 - DNA, 75 bp, Artificial Sequence
  Synthetic
gactgtaatgtttcagtcactcaggttgttgactttagccttgatcccactttaacaattgagactaccacagtg

SEQ ID NO: 117654 - DNA, 75 bp, Artificial Sequence
  Synthetic
gactgtaatgtttcagtcactcaggttgttgactttagccttgatcccactttaacaattgagactaccactgtg

SEQ ID NO: 117655 - DNA, 75 bp, Artificial Sequence
  Synthetic
gactgtaatgtttcagtcactcaggttgttgactttagccttgatcccactttaacaattgagactaccaccgtg

SEQ ID NO: 117656 - DNA, 75 bp, Artificial Sequence
  Synthetic
gactgtaatgtttcagtcactcaggttgttgactttagccttgatcccactttaacaattgagactaccacggtg

SEQ ID NO: 117657 - DNA, 75 bp, Artificial Sequence
  Synthetic
gactgtaatgtttcagtcactcaggttgttgacttcagccttgatcccactttaacaattgagactaccacagtg

SEQ ID NO: 117658 - DNA, 75 bp, Artificial Sequence
  Synthetic
gactgtaatgtttcagtcactcaggttgttgacttcagccttgatcccactttaacaattgagactaccactgtg

SEQ ID NO: 117659 - DNA, 75 bp, Artificial Sequence
  Synthetic
gactgtaatgtttcagtcactcaggttgttgacttcagccttgatcccactttaacaattgagactaccaccgtg

SEQ ID NO: 117660 - DNA, 75 bp, Artificial Sequence
  Synthetic
gactgtaatgtttcagtcactcaggttgttgacttcagccttgatcccactttaacaattgagactaccacggtg

SEQ ID NO: 117661 - DNA, 75 bp, Artificial Sequence
  Synthetic
gactgtaatgtttcagtcactcaggttgttgacttgagccttgatcccactttaacaattgagactaccacagtg

SEQ ID NO: 117662 - DNA, 75 bp, Artificial Sequence
  Synthetic
gactgtaatgtttcagtcactcaggttgttgacttgagccttgatcccactttaacaattgagactaccactgtg

SEQ ID NO: 117663 - DNA, 75 bp, Artificial Sequence
  Synthetic
gactgtaatgtttcagtcactcaggttgttgacttgagccttgatcccactttaacaattgagactaccaccgtg

SEQ ID NO: 117664 - DNA, 75 bp, Artificial Sequence
  Synthetic
gactgtaatgtttcagtcactcaggttgttgacttgagccttgatcccactttaacaattgagactaccacggtg

SEQ ID NO: 117665 - DNA, 75 bp, Artificial Sequence
  Synthetic
cagctctcagaaagcttgaagcgccgcccctcagggtgtggaagagccgggcacgtgctgtgagggcgtctctca

SEQ ID NO: 117666 - DNA, 75 bp, Artificial Sequence
  Synthetic
cactccaggtcttcctgtctgccaagaccatcttgagttttgggagggtgtctttacgggtctaacccacatcga

SEQ ID NO: 117667 - DNA, 75 bp, Artificial Sequence
  Synthetic
cactccaggtcttcctgtctgccaagaccatcttgagttttgggagggtgtctttacgggtcttacccacatcga

SEQ ID NO: 117668 - DNA, 75 bp, Artificial Sequence
  Synthetic
cactccaggtcttcctgtctgccaagaccatcttgagttttgggagggtgtctttacgggtctcacccacatcga

SEQ ID NO: 117669 - DNA, 75 bp, Artificial Sequence
  Synthetic
cactccaggtcttcctgtctgccaagaccatcttgagttttgggagggtgtctttacgggtctgacccacatcga

SEQ ID NO: 117670 - DNA, 75 bp, Artificial Sequence
  Synthetic
cacagcgtgtcgcgagcccgaccccgctacttatacctctgcctactcctactttgcgtaggagtaggcatcttt

SEQ ID NO: 117671 - DNA, 75 bp, Artificial Sequence
  Synthetic
cgctcatttcctctcgcagacaaagcaggcaggggagaacttcgcatatctcgttgcttaccaggcgacggtttg

SEQ ID NO: 117672 - DNA, 75 bp, Artificial Sequence
  Synthetic
caggcatctcatcttctgtcactcaaagaagaagtgtgatgagttggccaagcaactatcatctcttggcctcaa

SEQ ID NO: 117673 - DNA, 75 bp, Artificial Sequence
  Synthetic
ccaccacacacccgatcacgaagtacatcatcacttgcatgtcggcagacctggaagtcataaccagcacctggg

SEQ ID NO: 117674 - DNA, 75 bp, Artificial Sequence
  Synthetic
tcaccaccagtggcaaaccagtgataattccagatcgggaagtactttaccagcagttcgacgagatggaggagt

SEQ ID NO: 117675 - DNA, 75 bp, Artificial Sequence
  Synthetic
tcaccaccagtggcaaaccagtgatatttccagatcgggaagtactttaccagcagttcgacgagatggaggagt

SEQ ID NO: 117676 - DNA, 75 bp, Artificial Sequence
  Synthetic
tcaccaccagtggcaaaccagtgatacttccagatcgggaagtactttaccagcagttcgacgagatggaggagt

SEQ ID NO: 117677 - DNA, 75 bp, Artificial Sequence
  Synthetic
tcaccaccagtggcaaaccagtgatagttccagatcgggaagtactttaccagcagttcgacgagatggaggagt

SEQ ID NO: 117678 - DNA, 75 bp, Artificial Sequence
  Synthetic
acatcaacaggactgccttgaactgtaacgactctctcaacactgggttcatcgccgcactgttctacgtgcgca

SEQ ID NO: 117679 - DNA, 75 bp, Artificial Sequence
  Synthetic
ggacatcttggcgggttatggagcgggggtggcaggcgccctcgtggcctttaaggtcatgagtggcgagatgcc

SEQ ID NO: 117680 - DNA, 75 bp, Artificial Sequence
  Synthetic
agagctcaagcccgctgtccattccgcctggcccaagcttgaacaattctggcagaaacacctgtggaactttgt

SEQ ID NO: 117681 - DNA, 75 bp, Artificial Sequence
  Synthetic
aggcgcactcgtggcctttaaggttatgagtggcgagatgccctccaccgaggacctggtcaatttgctccctgc

SEQ ID NO: 117682 - DNA, 75 bp, Artificial Sequence
  Synthetic
caagtctggcctgtactatctcaccaatgactgccccaacagcagcatcgtttacgaggcggagacactgatctt

SEQ ID NO: 117683 - DNA, 75 bp, Artificial Sequence
  Synthetic
gggtctcacccatatagacggtcatttcctatcccagaccaaacaggcgggtgacaactacccttacctggtcgc

SEQ ID NO: 117684 - DNA, 75 bp, Artificial Sequence
  Synthetic
actcgtcaggatgtcccgaacgcatgtccgcctgccgcagtatcgaggccttccgggtgggatggggcgccttgc

SEQ ID NO: 117685 - DNA, 75 bp, Artificial Sequence
  Synthetic
ccagcttccgcttacgaagtgcgcaacgtgtccggggtgtaccatgtcacgaacgactgctccaactcaagcatt

SEQ ID NO: 117686 - DNA, 75 bp, Artificial Sequence
  Synthetic
ggggaaggtcctagtggacatactcgctggctatggggcgggtgtgtccggggctctcgttgcttttaagatcat

SEQ ID NO: 117687 - DNA, 75 bp, Artificial Sequence
  Synthetic
cccagtgtactgtttcacccccagcccagtggtagtgggcacgaccgacaggcttggagcgcccacttacacgtg

SEQ ID NO: 117688 - DNA, 75 bp, Artificial Sequence
  Synthetic
gacatggtcaacctacttccggccctgttatcaccaggtgcactggtagtgggcgtcgtgtgtgcgggcatacta

SEQ ID NO: 117689 - DNA, 75 bp, Artificial Sequence
  Synthetic
gttaccctggtcctgtcctacctggcacgcataccccaggtgatcgtcgatgtgttcatcggcggtcattggggc

SEQ ID NO: 117690 - DNA, 75 bp, Artificial Sequence
  Synthetic
aaggccccaagcagaacatccagctgatcaacaccaacggcagttggcatatcaataggacggccttgaactgca

SEQ ID NO: 117691 - DNA, 75 bp, Artificial Sequence
  Synthetic
ctgaaactgacacatctcgccagatcacaaccatactcagttccctcaccataaccagcctccttcgcaagctgc

SEQ ID NO: 117692 - DNA, 75 bp, Artificial Sequence
  Synthetic
gcggcggtatcgcggcccagcaaacatgcggctttgcgtggctgtttactgcgggctctcgccagaatatccaac

SEQ ID NO: 117693 - DNA, 75 bp, Artificial Sequence
  Synthetic
gcttaagactaagcttgtgccggcattgcccggagtcccctttctatcatgccagcagggattcaagggcctttg

SEQ ID NO: 117694 - DNA, 75 bp, Artificial Sequence
  Synthetic
agactctcctattcaacatcttgggaggttgggtggcctcacagatcgcgacccctacggcctctacggcttttg

SEQ ID NO: 117695 - DNA, 75 bp, Artificial Sequence
  Synthetic
gttcaattccagcgggtgccctgaacggttgagtgcttgcaaacccattacagatttctctcaggggtggggccc

SEQ ID NO: 117696 - DNA, 75 bp, Artificial Sequence
  Synthetic
acatgcccctgtggggctgatattgtgggccacgtgaagaacgggtccatgaggatctcaggctcgcggtggtgc

SEQ ID NO: 117697 - DNA, 75 bp, Artificial Sequence
  Synthetic
ggtcaccttcaagatcatgagcggcgagacaccatcaacagaagacttggtgaacttgctcccagcaatactatc

SEQ ID NO: 117698 - DNA, 75 bp, Artificial Sequence
  Synthetic
ggtcctgtttactgcttcacccccagccctgtggtcgtaggtactactgaccgtaggggtgtccccacttacacc

SEQ ID NO: 117699 - DNA, 75 bp, Artificial Sequence
  Synthetic
gagggtgggtgatagccacttcgtggtaggtgccactaatcaggacctaaaatgtccctgccaagttccggctcc

SEQ ID NO: 117700 - DNA, 75 bp, Artificial Sequence
  Synthetic
tcctgttggcaagcccgagaccccctgcagggtggtggtttggctgtacgtggatgaactccacagggtttacta

SEQ ID NO: 117701 - DNA, 75 bp, Artificial Sequence
  Synthetic
cctgcaagcccctcctgagggatgagatctccttttctgtggggcttaactcctatgcaattgggtcccaactcc

SEQ ID NO: 117702 - DNA, 75 bp, Artificial Sequence
  Synthetic
ccaacggcagctggcacatcaacaggactgccctgaactgcaatgactccctcaacactgggtggcttgctgcgc

SEQ ID NO: 117703 - DNA, 75 bp, Artificial Sequence
  Synthetic
cttgacgacagagatagggttgagatgagccctcttctgcattccacgactgagctcgcaatccttccctgcact

SEQ ID NO: 117704 - DNA, 75 bp, Artificial Sequence
  Synthetic
gaggcaaacttgctgtggaggcaggaagtggggggtaacatcactcgggtggagtctgagaacaaagtcatcgtt

SEQ ID NO: 117705 - DNA, 75 bp, Artificial Sequence
  Synthetic
ttggcggagctcgccacaaagacctttggtagctccgaatcgtcggccgtcgacagcggcacggcgaccgcccct

SEQ ID NO: 117706 - DNA, 75 bp, Artificial Sequence
  Synthetic
tacctatatgggcgcggcctgattacaacccacctttacttgagacttggaaaaaaccggactacgacccaccac

SEQ ID NO: 117707 - DNA, 75 bp, Artificial Sequence
  Synthetic
gcccatcaaccctttgagcaactctctcatccgccatcataacctggtgtactccacgacatctcggagtgccgc

SEQ ID NO: 117708 - DNA, 75 bp, Artificial Sequence
  Synthetic
ctcatccgccatcataacctggtgtactccacgacatctcggagtgccgcagcgcggcagaagaaagtgactttt

SEQ ID NO: 117709 - DNA, 75 bp, Artificial Sequence
  Synthetic
gcgagcctgttgcgcgtaccgtattacgtgcgcgctcacgctctattgcgggtgtgtttggctgtccgcaggatg

SEQ ID NO: 117710 - DNA, 75 bp, Artificial Sequence
  Synthetic
gctagactcctctcagtagaggaggcatgtgacctcactcccccgcactccgcccgttcaaaattcgggtacgga

SEQ ID NO: 117711 - DNA, 75 bp, Artificial Sequence
  Synthetic
catgtgacctcactcccccgcactccgcccgttcaaaattcgggtacggagcgaaggatgtccggagccacacca

SEQ ID NO: 117712 - DNA, 75 bp, Artificial Sequence
  Synthetic
ccccccaggaggaagcgggcagttgcgctctcggagtccaacatctcagcggcactggcgagcttggcagacaag

SEQ ID NO: 117713 - DNA, 75 bp, Artificial Sequence
  Synthetic
gactcaacggtcactgagagtgacatccgtgttgaggagtcaatctaccaatgttgtgacttggcccccgaagcc

SEQ ID NO: 117714 - DNA, 75 bp, Artificial Sequence
  Synthetic
tggagggcgaggtccagattgtgtcaactgctgcccagactttcctggcaacgtgcatcaatggggtgtgctgga

SEQ ID NO: 117715 - DNA, 75 bp, Artificial Sequence
  Synthetic
tcatggcaaagaacgaggtgttttgcgttgatacgtcgaagggggggcgcaagcctgcccgtctgatcgtgtacc

SEQ ID NO: 117716 - DNA, 75 bp, Artificial Sequence
  Synthetic
caaggggtggaagctcctcgcgcctatcacggcctacgcccagcagactcgcggtctgcttgggacgattgtcac

SEQ ID NO: 117717 - DNA, 75 bp, Artificial Sequence
  Synthetic
tccgcttgaaggggagcctggtgacccagacttgacatcagactcttggtccaccgtcagcggatcggaggacgt

SEQ ID NO: 117718 - DNA, 75 bp, Artificial Sequence
  Synthetic
acgacggatcttactcgtcaatgcctccgcttgaaggggagcctggtgacccagacttgacatcagactcttggt

SEQ ID NO: 117719 - DNA, 75 bp, Artificial Sequence
  Synthetic
cgcaaactgcccttagccataatgggagatgcttacggcttccagtattcgcccaagcaacgggtggatcgactg

SEQ ID NO: 117720 - DNA, 75 bp, Artificial Sequence
  Synthetic
cgtgaccctacaacccccctcgcgagagccgcgtgggagacagcaagacacactccagtcaattcctggctaggc

SEQ ID NO: 117721 - DNA, 75 bp, Artificial Sequence
  Synthetic
catcaaccccctgagcaactcactgctacgccatcacaacatggtgtactccacgacttctcgttccgccgccac

SEQ ID NO: 117722 - DNA, 75 bp, Artificial Sequence
  Synthetic
gcttgcagacgcgcgcgtctgctcctgcttgtggatgatgttactcatatcccaagcggaggcagctttggagaa

SEQ ID NO: 117723 - DNA, 75 bp, Artificial Sequence
  Synthetic
tccctcacagaaaggctctacgtgggtggtcccatgtacaactcacggggccaattgtgcgggatgcgcaggtgc

SEQ ID NO: 117724 - DNA, 75 bp, Artificial Sequence
  Synthetic
tacaccatgcacctgtggtgccagcgacctctacctagtgactaggaatgcagatgtgatccccgcgcggcgtag

SEQ ID NO: 117725 - DNA, 75 bp, Artificial Sequence
  Synthetic
agtcatttccgagagcgctggcgtccaggaagacatagctgccctgcgagctttcacggaagctatgaccaggta

SEQ ID NO: 117726 - DNA, 75 bp, Artificial Sequence
  Synthetic
aagggctcttcgggtggcccactgctctgcccctcggggcacgctgtgggcatcttccgggccgccgtgtgcacc

SEQ ID NO: 117727 - DNA, 75 bp, Artificial Sequence
  Synthetic
taacatcgtgctcctctaacgtctccgtagcccatgaccatactggacagagatattactacctcactcgtgatc

SEQ ID NO: 117728 - DNA, 75 bp, Artificial Sequence
  Synthetic
acgcatggttctgatgacccatttcttccaaatactccaagcccaggagcaactccataaagtgcttgacttcga

SEQ ID NO: 117729 - DNA, 75 bp, Artificial Sequence
  Synthetic
ggcgaactcaatcgggtggcagcatgcctcaggaaacttggggcacctccattgagagcctggcgacatcgagcc

SEQ ID NO: 117730 - DNA, 75 bp, Artificial Sequence
  Synthetic
gggctgcggatgggcagggtggctcctgtccccccgcggttctcgccctaattggggccccaacgacccccggcg

SEQ ID NO: 117731 - DNA, 75 bp, Artificial Sequence
  Synthetic
gcctcaggaaacttggggcacctccattgagagcctggcgacatcgagcccgcgcggtcagagcaaaactcattg

SEQ ID NO: 117732 - DNA, 75 bp, Artificial Sequence
  Synthetic
tctcagaggtggccttgcccactactggggagattcccttctatgggagggcgatccccctagagtacatcaagg

SEQ ID NO: 117733 - DNA, 75 bp, Artificial Sequence
  Synthetic
gacttcgactcagtgatagactgcaacacgtgtgtcactcagacagtcgatttcagccttgaccctaccttcacc

SEQ ID NO: 117734 - DNA, 75 bp, Artificial Sequence
  Synthetic
acagaaagcgctcgggttgttgcaaacagccaccaagcaagcggaggctgctgctcccgtggtggagtccaagtg

SEQ ID NO: 117735 - DNA, 75 bp, Artificial Sequence
  Synthetic
tgcaaccggaaaccttcctggttgctccttttctatcttcctcttggcacttctctcgtgcctcaccacgcccgc

SEQ ID NO: 117736 - DNA, 75 bp, Artificial Sequence
  Synthetic
actgccctaactcaagcattgtctatgaggcggacaatgtcatcatgcatagccctggatgcgtcccatgtgtaa

SEQ ID NO: 117737 - DNA, 75 bp, Artificial Sequence
  Synthetic
caatctggtcaacaccaacggtagttggcacatcaataggacggccttgaactgcaacagtagccttgaaaccgg

SEQ ID NO: 117738 - DNA, 75 bp, Artificial Sequence
  Synthetic
ttatcacaatacctcgggcatctatcacatcaccaacgattgccctaattccagcataatctatgagtccgacca

SEQ ID NO: 117739 - DNA, 75 bp, Artificial Sequence
  Synthetic
ggtgctccagttgagtctctacggcgacacgtggacctgatggtgggtgctgccaccctgtgctccgccctatat

SEQ ID NO: 117740 - DNA, 75 bp, Artificial Sequence
  Synthetic
ttctggttggtcagatgttcaccttccgccctcgccgccactggaccacccaggactgcaactgttcaatctact

SEQ ID NO: 117741 - DNA, 75 bp, Artificial Sequence
  Synthetic
tcgacggaactacctacgttggccgcagtgcgggtgcgcagacgcggggcttcgtcagcatcttcactccggggg

SEQ ID NO: 117742 - DNA, 75 bp, Artificial Sequence
  Synthetic
ctgggcatatcacgggacacaggatggcttgggacatgatgatgagctggagccccaccatgacgctgctccttg

SEQ ID NO: 117743 - DNA, 75 bp, Artificial Sequence
  Synthetic
tcaatctatcccggccacgtaacaggtcaccgcatggcttgggatatgatgatgaactggtcacctacaacagcc

SEQ ID NO: 117744 - DNA, 75 bp, Artificial Sequence
  Synthetic
ttctcgcctatggagaagaagatcatcacgtggggggcggacacagccgcgtgtggtgacatactggctggtttg

SEQ ID NO: 117745 - DNA, 75 bp, Artificial Sequence
  Synthetic
cttacttcagcatgcagacaaattgggccaaggtcatcctggtcctcttcctctttgctggggttgaagccgaaa

SEQ ID NO: 117746 - DNA, 75 bp, Artificial Sequence
  Synthetic
ccacgtcgcccctactcactacgtgacggagtcggatgcgtcgcagcgtgtgacccaactacttggctctcttac

SEQ ID NO: 117747 - DNA, 75 bp, Artificial Sequence
  Synthetic
aggacaggccctactgctggcactacgcgcccagaccctgtgacatcgtccctgcacgggacgtctgcggcccgg

SEQ ID NO: 117748 - DNA, 75 bp, Artificial Sequence
  Synthetic
gttgaagccggcagttcactccgcctggcctagactcgagcaattttggcaaaaacacctgtggaacttcgtcag

SEQ ID NO: 117749 - DNA, 75 bp, Artificial Sequence
  Synthetic
aagctggcacatcaacaggacggccctcaactgcaatgacagtctcaacacggggtttttagccgcactctttta

SEQ ID NO: 117750 - DNA, 75 bp, Artificial Sequence
  Synthetic
tcgtctcagaagatccagctcataaacaccaacggcagctggcacatcaacaggaccgccctgaactgcaatgac

SEQ ID NO: 117751 - DNA, 75 bp, Artificial Sequence
  Synthetic
ctcaactgcaatgacagtctcaacacggggtttttagccgcactcttttacgtcaaccgtctcaacagctccggg

SEQ ID NO: 117752 - DNA, 75 bp, Artificial Sequence
  Synthetic
catactgctggcattacgctccacggccctgtggggtcgtgccggcttccacagtgtgtggccctgtgtactgtt

SEQ ID NO: 117753 - DNA, 75 bp, Artificial Sequence
  Synthetic
acaccctgaagcaacctacgcgaagtgcgggtccgggccatggctgactcctagatgcttggtggactatcccta

SEQ ID NO: 117754 - DNA, 75 bp, Artificial Sequence
  Synthetic
cgcgtcggaggtgtgtggtccagtgtattgcttcaccccaagccccgttgtggtggggacgaccgatcgtttcgg

SEQ ID NO: 117755 - DNA, 75 bp, Artificial Sequence
  Synthetic
aatgagacggacgtgctgctcctcaacaacacgcggccgccgcaaggcaactggttcggctgtacatggatgaat

SEQ ID NO: 117756 - DNA, 75 bp, Artificial Sequence
  Synthetic
taggccgcctaacggcgcttggttcggatgcgtgtggatgaatggcaccggtttcaccaaagcttgcggcgctcc

SEQ ID NO: 117757 - DNA, 75 bp, Artificial Sequence
  Synthetic
atggtcaatttgctgccagccattctatcgcctggcgctttggtcgtgggcgttgtgtgtgctgctgtgctgcgc

SEQ ID NO: 117758 - DNA, 75 bp, Artificial Sequence
  Synthetic
caccaatggcagttggcacatcaaccgcactgccctaaattgcaatgattccttgaacaccggctttatggcggc

SEQ ID NO: 117759 - DNA, 75 bp, Artificial Sequence
  Synthetic
gcccaacagacgcggggcctgtttggctgcattgtcaccagcctcacaggccgggacaagaaccaggtcgagggg

SEQ ID NO: 117760 - DNA, 75 bp, Artificial Sequence
  Synthetic
ctacaccaagtgtggctcagggccttggctcacgccgaggtgcctggtccactatccatacaggctctggcatta

SEQ ID NO: 117761 - DNA, 75 bp, Artificial Sequence
  Synthetic
cccacggattgcttccggaagcaccccgaggccacttacaccaaatgcggttcggggccctggttgacacctagg

SEQ ID NO: 117762 - DNA, 75 bp, Artificial Sequence
  Synthetic
tacgaggatgatgttaccaatccagaagatatgagaccatactgctggcactacccaccaaaacagtgtggcata

SEQ ID NO: 117763 - DNA, 75 bp, Artificial Sequence
  Synthetic
tggctcacgccgaggtgcctggtccactatccatacaggctctggcattatccatgcactgtcaattacaccatc

SEQ ID NO: 117764 - DNA, 75 bp, Artificial Sequence
  Synthetic
agcatttgcctctaggggcaatcatgtctcaccaacgcattatgtgcctgagacggacgcctctaaaaatgtgat

SEQ ID NO: 117765 - DNA, 75 bp, Artificial Sequence
  Synthetic
tgcggcttggagcatagggaccgcacggagctgtctcccttgcttctttccaccacacaatggcaggtcctcccc

SEQ ID NO: 117766 - DNA, 75 bp, Artificial Sequence
  Synthetic
aggctggatctgtgggatagctttcatctgtgccgcttggtacatccgcggcaaatatgctcccatcactgtcta

SEQ ID NO: 117767 - DNA, 75 bp, Artificial Sequence
  Synthetic
tgtcatgggcactcaagtgggagtacattgtgctcgcgtttctgctactcgcagacgccagggtgtgcgcgtgcc

SEQ ID NO: 117768 - DNA, 75 bp, Artificial Sequence
  Synthetic
atcaaatgtggttctgggccctggctcacgccaaggtgcctggtcgactacccctacaggctctggcattacccc

SEQ ID NO: 117769 - DNA, 75 bp, Artificial Sequence
  Synthetic
catcctgctcatctgcgtggtctggcatgtcaagggcaggctgccggctgctgccacctacgcagcttgtgggat

SEQ ID NO: 117770 - DNA, 75 bp, Artificial Sequence
  Synthetic
caatacttcattgcacgagcggaagccattctgcatgtttgggtgcccccattgcaggttcgtggaggtcgcgat

SEQ ID NO: 117771 - DNA, 75 bp, Artificial Sequence
  Synthetic
agataaggatgtatgtggggggggttgagcacaggctcacggccgcgtgcaatttctctcgtggggatcgttgca

SEQ ID NO: 117772 - DNA, 75 bp, Artificial Sequence
  Synthetic
cttgtcctgacgttgtcaccacactacaagcggtggctggcctggggaatttggtggatccagtacttcatcgca

SEQ ID NO: 117773 - DNA, 75 bp, Artificial Sequence
  Synthetic
tctttgacataacaaaatacctgcttgctgtgtgtggccccctctacctgctccagagctcgctgacgcgcgtcc

SEQ ID NO: 117774 - DNA, 75 bp, Artificial Sequence
  Synthetic
ggtacaagcctgcagtctggtgcggggggtcatatatggcaagtatgttcagatggccctgctcaaggtgggagc

SEQ ID NO: 117775 - DNA, 75 bp, Artificial Sequence
  Synthetic
tgcatccgtgcacggacaggtaggcgcggctttgttaatactgattaccctcttcacacttaccccggggtataa

SEQ ID NO: 117776 - DNA, 75 bp, Artificial Sequence
  Synthetic
tcttcacacttaccccggggtataagaccctcctcagtcggtgtctgtggtggttgtgctatctcctgaccctgg

SEQ ID NO: 117777 - DNA, 75 bp, Artificial Sequence
  Synthetic
acgccaatggagaagaaggtgataacctggggtgctgacaccgccgcgtgcggcgacatcatcaaaggtctgcca

SEQ ID NO: 117778 - DNA, 75 bp, Artificial Sequence
  Synthetic
cctggggtgctgacaccgccgcgtgcggcgacatcatcaaaggtctgccagtttcggctaggctgggtaatgaaa

SEQ ID NO: 117779 - DNA, 75 bp, Artificial Sequence
  Synthetic
aggaggaagaaggttgtaaggcttgacgagtcctcagtttcaaccgcacttgcagagctcgctcgcaagtcgttt

SEQ ID NO: 117780 - DNA, 75 bp, Artificial Sequence
  Synthetic
cgcgatggcatcatatgggccgctaccatgttctgcccgggtgtagtgtttgacataaccaagtggctcttggcg

SEQ ID NO: 117781 - DNA, 75 bp, Artificial Sequence
  Synthetic
ccatgttctgcccgggtgtagtgtttgacataaccaagtggctcttggcggtgcttgggcctgcttacctcctaa

SEQ ID NO: 117782 - DNA, 75 bp, Artificial Sequence
  Synthetic
cgtgacgagcctcactggcaaagacaccaatgccaattgtggtgaggtccaggtgttgtccactgccacgcagtc

SEQ ID NO: 117783 - DNA, 75 bp, Artificial Sequence
  Synthetic
ttggctgcatcatcactagcctcacaggccgggacaagaaccaggtcgagggggaggttcaagtggtttccaccg

SEQ ID NO: 117784 - DNA, 75 bp, Artificial Sequence
  Synthetic
tttacctagtgacgaggaatgctgacgtcatccccgccagacgcaggggtgacacccgcgcagcactcctcagcc

SEQ ID NO: 117785 - DNA, 75 bp, Artificial Sequence
  Synthetic
aggtgttgtccactgccacgcagtcctttttaggtactgcgatcaacggcgtgatgtggactgtataccatgggg

SEQ ID NO: 117786 - DNA, 75 bp, Artificial Sequence
  Synthetic
tcctggacgggagctcttgtgacaccctgcgctgcggaagaggagaaattgcccatcagtcctctgagcaactct

SEQ ID NO: 117787 - DNA, 75 bp, Artificial Sequence
  Synthetic
catgcaaaccacctgcccatgtggagcgcagatcaccggacatgtcaaaaatggttccatgaggatcgttgggcc

SEQ ID NO: 117788 - DNA, 75 bp, Artificial Sequence
  Synthetic
tccgcgcggctgtgtgtaccaggggcgtggcgaagtccctcgattttgttcccgtggagagcatgcagtccacca

SEQ ID NO: 117789 - DNA, 75 bp, Artificial Sequence
  Synthetic
ggaacgcagatgtgattcccgtgcgcaggaggggtgacacccgaggcgcgctgttaagccccaggccaatttcca

SEQ ID NO: 117790 - DNA, 75 bp, Artificial Sequence
  Synthetic
actaccatgacaccctcaaggagattaaggaacgggcttccactgtgagcgctagactcctcaccacagaggagg

SEQ ID NO: 117791 - DNA, 75 bp, Artificial Sequence
  Synthetic
gtgagcatgacggggcgcgacaagacagaacaggccggggaaatccaagtcctgtccacggtcactcagtccttc

SEQ ID NO: 117792 - DNA, 75 bp, Artificial Sequence
  Synthetic
gcaaaggaggtccgtagccatgccagcaaggccattaaccacatcaactccgtgtgggaggacttgctggaagac

SEQ ID NO: 117793 - DNA, 75 bp, Artificial Sequence
  Synthetic
cgatttcgtgccagtggagtcccttgagaccaccatgaggtccccggtcttcaccgacaactctacgccccccgc

SEQ ID NO: 117794 - DNA, 75 bp, Artificial Sequence
  Synthetic
tgtggactgtttaccacggagctggcaacaagactctagccggctcacggggcccggtcacgcagatgtactcga

SEQ ID NO: 117795 - DNA, 75 bp, Artificial Sequence
  Synthetic
aatgcaactcccattccaacaaccattatggcaaagaatgaagtgttctgtgtggatgccaagaaagggggtcgg

SEQ ID NO: 117796 - DNA, 75 bp, Artificial Sequence
  Synthetic
actggcagcggcaagagcaccaaggtgccggctgcatatgcagcccaagggtacaaggtactcgtcctgaacccg

SEQ ID NO: 117797 - DNA, 75 bp, Artificial Sequence
  Synthetic
ctgggcgaaggtcctggcagtgctgctgctatttgccggcgtcgacgcgactacccacgtcactgggggaagcgc

SEQ ID NO: 117798 - DNA, 75 bp, Artificial Sequence
  Synthetic
ctggtactcaacccttcggtggctgccacgctgggtttcggggcctacatgtctaaggcgcatggcatcgacccg

SEQ ID NO: 117799 - DNA, 75 bp, Artificial Sequence
  Synthetic
cgtgtgtgcgagaaaatggccctttacgacgtggtctccacccttcctcaggccgtgatgggctcctcatacgga

SEQ ID NO: 117800 - DNA, 75 bp, Artificial Sequence
  Synthetic
gtctaaggcgcatggcatcgacccgaacatacggtcgggtgtcaggaccatcactacaggcgcgccgatcacata

SEQ ID NO: 117801 - DNA, 75 bp, Artificial Sequence
  Synthetic
aacatacggtcgggtgtcaggaccatcactacaggcgcgccgatcacatactccacctacgggaagttcctggcg

SEQ ID NO: 117802 - DNA, 75 bp, Artificial Sequence
  Synthetic
tcggggcgtggccaagtccatagattttatccccgttgagacactcgacatcgtcacgcggtcccccaccttcag

SEQ ID NO: 117803 - DNA, 75 bp, Artificial Sequence
  Synthetic
aggcggagaccgctggagtgcgactcgtcgtgctcgcgaccgccacgccaccagggtcgatcaccacaccccatt

SEQ ID NO: 117804 - DNA, 75 bp, Artificial Sequence
  Synthetic
ccagggtcgatcaccacaccccattccaacatagaagaggtcgccctgccgacgacgggtgaaatacccttctac

SEQ ID NO: 117805 - DNA, 75 bp, Artificial Sequence
  Synthetic
ccaacatagaagaggtcgccctgccgacgacgggtgaaatacccttctacggcaaggctatccccctagcttgca

SEQ ID NO: 117806 - DNA, 75 bp, Artificial Sequence
  Synthetic
cttggggtttggggcgtacctgtccaaggcacatggcatcaatcccaacatcaggactggggtcaggactgtgac

SEQ ID NO: 117807 - DNA, 75 bp, Artificial Sequence
  Synthetic
cgcccggaatacgacttggagctaataacatcatgctcatcaaacgtctccgtggcccatgacaatactggacag

SEQ ID NO: 117808 - DNA, 75 bp, Artificial Sequence
  Synthetic
ttgggaaacagcccgccacactccagtgaattcatggttgggaaacatcatcatgtacgcaccgacgatttgggt

SEQ ID NO: 117809 - DNA, 75 bp, Artificial Sequence
  Synthetic
gggaaggctaggcatataccggtacgtcaccccgggggaaaggccgtctggcatttttgacacctcggtactctg

SEQ ID NO: 117810 - DNA, 75 bp, Artificial Sequence
  Synthetic
gtcaccccgggggaaaggccgtctggcatttttgacacctcggtactctgtgagtgctacgacgccgggtgtgcc

SEQ ID NO: 117811 - DNA, 75 bp, Artificial Sequence
  Synthetic
gaacgactgctccaactcaagtattgtgtatgaggcagcggacatgatcatgcacacccccgggtgcgtgccctg

SEQ ID NO: 117812 - DNA, 75 bp, Artificial Sequence
  Synthetic
tttggaatactccagtcccaagaaacactccacaaagcactcgacttcgacatgtacggagtcacctattctatc

SEQ ID NO: 117813 - DNA, 75 bp, Artificial Sequence
  Synthetic
acactatgtggaaatgccttatccgcctcaagcctatgctcacagggcccacccccttgttgtatagacttggtg

SEQ ID NO: 117814 - DNA, 75 bp, Artificial Sequence
  Synthetic
cctcaagcctatgctcacagggcccacccccttgttgtatagacttggtgccgtacaaaatgagatcaccacaac

SEQ ID NO: 117815 - DNA, 75 bp, Artificial Sequence
  Synthetic
gtgttttcactggccttgtccacatagacggccatttcctatcccagactaaacaagcaggtgagaatttcccct

SEQ ID NO: 117816 - DNA, 75 bp, Artificial Sequence
  Synthetic
gcctactgtttatctgtgggttgcgtagtgatctgcggtaggattaccaccactggtaagccagtagtcatccct

SEQ ID NO: 117817 - DNA, 75 bp, Artificial Sequence
  Synthetic
cccagttgggatatcatgtggaaatgtctgattcgcctcaagcccacgctgcacggccctactcccctcctttac

SEQ ID NO: 117818 - DNA, 75 bp, Artificial Sequence
  Synthetic
cgtagacttcagtttggaccccaccttcaccataaccacacagactgtccctcaagacgccgtctcgcgtagcca

SEQ ID NO: 117819 - DNA, 75 bp, Artificial Sequence
  Synthetic
tattcttccatgccccccctggagggggagcctggggatccggacctcagcgacgggtcatggtcgacggttagt

SEQ ID NO: 117820 - DNA, 75 bp, Artificial Sequence
  Synthetic
ccactggtgagcgagcctcaggaatgtttgacagtgtggtgctctgtgagtgctacgacgcaggggctgcatggt

SEQ ID NO: 117821 - DNA, 75 bp, Artificial Sequence
  Synthetic
atacatcatggcctgcatgtcagcggacctcgaggtggtgaccagcacatgggtcctggtaggcggcatcctggc

SEQ ID NO: 117822 - DNA, 75 bp, Artificial Sequence
  Synthetic
cgaccccgcattttactcctgtgcctactcctacttaccgtgggggtaggcatctttttgcttcccgcccgatag

SEQ ID NO: 117823 - DNA, 75 bp, Artificial Sequence
  Synthetic
catgtcggctgacctggaggtcgtcacgagcacctgggtgctagtaggcggcgtccttgcagctctggccgcgta

SEQ ID NO: 117824 - DNA, 75 bp, Artificial Sequence
  Synthetic
caattcaaacagaaagccctcggcgtgctgaacatcgcgagcaagcaggcccaggaggcgacgccggtggtgaag

SEQ ID NO: 117825 - DNA, 75 bp, Artificial Sequence
  Synthetic
tgctgaacatcgcgagcaagcaggcccaggaggcgacgccggtggtgaagtccaactttgctaagctcgaacagt

SEQ ID NO: 117826 - DNA, 75 bp, Artificial Sequence
  Synthetic
cactgcggccgtcacgagccctctgaccacccagcaaaccctcctcttcaacatcttgggagggtgggtggcctc

SEQ ID NO: 117827 - DNA, 75 bp, Artificial Sequence
  Synthetic
accacccagcaaaccctcctcttcaacatcttgggagggtgggtggcctcgcagatcgccactcccacggcatcc

SEQ ID NO: 117828 - DNA, 75 bp, Artificial Sequence
  Synthetic
gcagcataggccttgggaaggtgcttgtggacattctggcgggttatggagcaggggtggcaggcgcactcgtgg

SEQ ID NO: 117829 - DNA, 75 bp, Artificial Sequence
  Synthetic
ctggctggttacggcgctggcgtggccggcgccgtggtcacctttaagatcatgagcggcgaggtaccaactgga

SEQ ID NO: 117830 - DNA, 75 bp, Artificial Sequence
  Synthetic
ccggcgccgtggtcacctttaagatcatgagcggcgaggtaccaactggagaagacctggtaaatctgctcccag

SEQ ID NO: 117831 - DNA, 75 bp, Artificial Sequence
  Synthetic
gaagacctggtaaatctgctcccagctatactatctcctggagctttggtagtgggggtggtttgcgccgctatt

SEQ ID NO: 117832 - DNA, 75 bp, Artificial Sequence
  Synthetic
tggaccgggagatggctgcatcgtgcggaggcgcggttttcgtgggtctggtgctcctgaccttgtcaccacact

SEQ ID NO: 117833 - DNA, 75 bp, Artificial Sequence
  Synthetic
cgtaactaccatactatcctccctcacagtgacatcccttctcagacgccttcaccagtggatcaacgaggatca

SEQ ID NO: 117834 - DNA, 75 bp, Artificial Sequence
  Synthetic
gcccgacgtggggccccaatgacccccggcgcagatcccgcaatttgggtaaagtcatcgatacctttacttgcg

SEQ ID NO: 117835 - DNA, 75 bp, Artificial Sequence
  Synthetic
tccaccggccccagccaaaatatccagctcataaactccaatggcagctggcacattaacaggactgccctgaat

SEQ ID NO: 117836 - DNA, 75 bp, Artificial Sequence
  Synthetic
accatgccaggcatccccttcctctcctgccagagagggttcaaaggggagtggcgtggagatggcgtaatgcat

SEQ ID NO: 117837 - DNA, 75 bp, Artificial Sequence
  Synthetic
taattatgcaacagggaatctacccggttgctctttctctatcttcctcttggccctcctctcatgccttactgt

SEQ ID NO: 117838 - DNA, 75 bp, Artificial Sequence
  Synthetic
gggtagcagcgctgttctactcccacaagttcaactcttcggggcgtcctgagaggatggctagttgtcggcctc

SEQ ID NO: 117839 - DNA, 75 bp, Artificial Sequence
  Synthetic
cctttcctctcatgccaacgtgggtacaagggggtctggcggggagacggcatcatgaacaccacttgcccatgt

SEQ ID NO: 117840 - DNA, 75 bp, Artificial Sequence
  Synthetic
cattcgtgcatgcatgttggtgcggaaagtcgctgggggtcattatgtccaaatggctctcatgaagctggccgc

SEQ ID NO: 117841 - DNA, 75 bp, Artificial Sequence
  Synthetic
attgcctttgcttccagaggaaaccacgtcgcccctacccactacgtgacggagtcggatgcgtcgcagcgtgtg

SEQ ID NO: 117842 - DNA, 75 bp, Artificial Sequence
  Synthetic
tgcagtaacacctggcacggaaccttccccatcaatgcttacaccacaggccccggcgtgcctatcccagcgccg

SEQ ID NO: 117843 - DNA, 75 bp, Artificial Sequence
  Synthetic
ggttgctctttctctatcttcctcttggccctcctctcatgccttactgtgcccacctctgccctcaattatgcc

SEQ ID NO: 117844 - DNA, 75 bp, Artificial Sequence
  Synthetic
ctccacttgccggggtgtgttccgtgcgtcaaggtgggcaatgagtccacgtgctgggtccccgtgacgcctacg

SEQ ID NO: 117845 - DNA, 75 bp, Artificial Sequence
  Synthetic
tatcgtgccggcgaaagaggtttgcgggcctgtatactgtttcacacccagtcccgtggtagtggggacgacgga

SEQ ID NO: 117846 - DNA, 75 bp, Artificial Sequence
  Synthetic
ttggctgtcaaggacgcttcaacaccagctattggattccgtagccacgcggacgttatggcgggcgccgcagtt

SEQ ID NO: 117847 - DNA, 75 bp, Artificial Sequence
  Synthetic
tggatgaattccactggtttcaccaagacgtgcggggctcctgcctgtaacgtcggcgggagcgagaccaacacc

SEQ ID NO: 117848 - DNA, 75 bp, Artificial Sequence
  Synthetic
ggaggtatccttctccgtgggcctcaactcgtttgtagtgggatcccagctcccctgcgagcctgaaccagacgt

SEQ ID NO: 117849 - DNA, 75 bp, Artificial Sequence
  Synthetic
gtaattgctccatctaccctggccacgtcaccggccacaggatggcttgggacatgatgatgaactggtctccta

SEQ ID NO: 117850 - DNA, 75 bp, Artificial Sequence
  Synthetic
gggtcacagctcccatgtgagcccgaaccggatgtaacagtgctcacttccatgctcaccgacccctcccacatt

SEQ ID NO: 117851 - DNA, 75 bp, Artificial Sequence
  Synthetic
cgtcggcgggagcgagaccaacaccctgtcgtgccccacagattgcttccgcagacatccggacgcaacatacgc

SEQ ID NO: 117852 - DNA, 75 bp, Artificial Sequence
  Synthetic
ggtccatccagagctaatttttgacatcaccaaactcctgctcgccatactcggtccgctcatggtgttccaggc

SEQ ID NO: 117853 - DNA, 75 bp, Artificial Sequence
  Synthetic
ctgcagcccggagactggccagggggagcccgccttccctggccagctcttcggctagtcagctatctgctccat

SEQ ID NO: 117854 - DNA, 75 bp, Artificial Sequence
  Synthetic
gagaataaggtcatcattctcgactcgttcgacccgctggtacccgaatatgatgacagagagctatccgtgcct

SEQ ID NO: 117855 - DNA, 75 bp, Artificial Sequence
  Synthetic
gtatcattggtgctgtggtgtatttctctatggtgggcagttgggtaaaagtcctcctagtcatgctccttttcg

SEQ ID NO: 117856 - DNA, 75 bp, Artificial Sequence
  Synthetic
cggactacaccccaccgctggttcatgggtgcgccctgccccccgcggggcagcctccagtcccaccgcctagga

SEQ ID NO: 117857 - DNA, 75 bp, Artificial Sequence
  Synthetic
caaggtggtgacattggactctttcgagccaattgtggccgaatcagatgacagggaggtctccgttgaggcgga

SEQ ID NO: 117858 - DNA, 75 bp, Artificial Sequence
  Synthetic
ggaagaaagtggtgcgcttggacgaatccagcgtggtggaagctctggcagacctagctaagaagtcttttccga

SEQ ID NO: 117859 - DNA, 75 bp, Artificial Sequence
  Synthetic
tgttaacaccaatggcagttggcacatcaaccgtacagctctcaattgcaatgatagtctgcagactgggttcat

SEQ ID NO: 117860 - DNA, 75 bp, Artificial Sequence
  Synthetic
ggtctgcttggctgcatcatcactagcctcacaggtcgggacaaaaaccaggtcgagggggaggttcaggtggtc

SEQ ID NO: 117861 - DNA, 75 bp, Artificial Sequence
  Synthetic
cagcccccggtcgttcacggttgcgctctcccccccagtaagccagcccccgttcctcctcctagaaggaagaga

SEQ ID NO: 117862 - DNA, 75 bp, Artificial Sequence
  Synthetic
atttcttacgccaacatatccggctcgtccaatgataagccttattgctggcactaccccccccgcccgtgtggc

SEQ ID NO: 117863 - DNA, 75 bp, Artificial Sequence
  Synthetic
acggtgatacttgacgagtctacggtctccaacgcgttggcggacctggctatgaagacctttggcaggtctgag

SEQ ID NO: 117864 - DNA, 75 bp, Artificial Sequence
  Synthetic
gcactaccccccccgcccgtgtggcgtggtaccagctaaggaagtgtgtggcccagtctactgcttcacacctag

SEQ ID NO: 117865 - DNA, 75 bp, Artificial Sequence
  Synthetic
cgatgcctccacttgaaggtgagcccggcgacccggatttgacaacagactcttggtccaccgttagtgagtcgg

SEQ ID NO: 117866 - DNA, 75 bp, Artificial Sequence
  Synthetic
tcaggcgggtggtacggatgtacctggatgaacgcgacggggttcgttaagacctgcggcgctccgccgtgtaac

SEQ ID NO: 117867 - DNA, 75 bp, Artificial Sequence
  Synthetic
ctcacttctgcgccatcacaacatggtgtatgccaccacctctcgttccgccgtcatccggcagaagaaggtgac

SEQ ID NO: 117868 - DNA, 75 bp, Artificial Sequence
  Synthetic
gaccctggctgactcccaggtgtctggtagactacccctacagactgtggcactatccgtgtacggtcaatttta

SEQ ID NO: 117869 - DNA, 75 bp, Artificial Sequence
  Synthetic
atcaagtccttcggccagccccccccaagcggcgattcaggcctttccacgggggcggacgccgccgactccggc

SEQ ID NO: 117870 - DNA, 75 bp, Artificial Sequence
  Synthetic
agatcaaggcaaaggcgtccactgtgaaggcgcgggtactcactactgaggaagcttgcagcctgacgccccccc

SEQ ID NO: 117871 - DNA, 75 bp, Artificial Sequence
  Synthetic
ctccatgccccccctcgagggggagcctggggatccagacctggagcctgagcaggtagagccccaacccccccc

SEQ ID NO: 117872 - DNA, 75 bp, Artificial Sequence
  Synthetic
atcggtgcgggtatgcgagaagagggctttgtttgacatcacccgcaagttgccaaccgctatcatgggagatgc

SEQ ID NO: 117873 - DNA, 75 bp, Artificial Sequence
  Synthetic
atcggtgcgggtttgcgagaagagggctttgtttgacatcacccgcaagttgccaaccgctatcatgggagatgc

SEQ ID NO: 117874 - DNA, 75 bp, Artificial Sequence
  Synthetic
atcggtgcgggtctgcgagaagagggctttgtttgacatcacccgcaagttgccaaccgctatcatgggagatgc

SEQ ID NO: 117875 - DNA, 75 bp, Artificial Sequence
  Synthetic
atcggtgcgggtgtgcgagaagagggctttgtttgacatcacccgcaagttgccaaccgctatcatgggagatgc

SEQ ID NO: 117876 - DNA, 75 bp, Artificial Sequence
  Synthetic
caggatcgagatgcaccctctcctgttctcgaccacggaacttgctatcttgccatgtgcttttaccactatgcc

SEQ ID NO: 117877 - DNA, 75 bp, Artificial Sequence
  Synthetic
cagcgggtggactacctgctcaagatgtggcgctccaagaagacccccatggggttttcctatgataccagctgc

SEQ ID NO: 117878 - DNA, 75 bp, Artificial Sequence
  Synthetic
caccgagcccgtcatcttctcccggatggagatcaagactatcacctggggggcagacaccgcggcctgtggaga

SEQ ID NO: 117879 - DNA, 75 bp, Artificial Sequence
  Synthetic
actatcatggccaaaaacgaggttttctccgtcaaaccggagaagggaggccgaaaacctgcgcgtcttatcgta

SEQ ID NO: 117880 - DNA, 75 bp, Artificial Sequence
  Synthetic
gagtacattgtcctcctgtttctctatctagctgatgctcgcctctgcacctgtttgtggctgatgttcttagtg

SEQ ID NO: 117881 - DNA, 75 bp, Artificial Sequence
  Synthetic
tcggactcggggtcctggtctacttgctccgaggagaatgtctccgtcgttttctgctccatttcatactcctgg

SEQ ID NO: 117882 - DNA, 75 bp, Artificial Sequence
  Synthetic
ctgtttgtggctgatgttcttagtgggtaaagccgaggcggctttggagaatctcatcaatctgaatgttgcagc

SEQ ID NO: 117883 - DNA, 75 bp, Artificial Sequence
  Synthetic
ggctaaaaaggtaacttttgataggatgcaagtgctcgacgcctattatgactcagtcttaaaggacatcaagct

SEQ ID NO: 117884 - DNA, 75 bp, Artificial Sequence
  Synthetic
cagctatggccccttcttttgcttgtcctcgcactgccaccgcgggcgtatgcctacgacggggagcaggcggca

SEQ ID NO: 117885 - DNA, 75 bp, Artificial Sequence
  Synthetic
cgatcccagcccagagggaggcgccaacctattcccaaggagcgccgaccgacgggccggcactgggctcagcct

SEQ ID NO: 117886 - DNA, 75 bp, Artificial Sequence
  Synthetic
acattataaggccctgctcacggggtgcctctggtggatccagtactttatagcacgcctagaagccgagctgta

SEQ ID NO: 117887 - DNA, 75 bp, Artificial Sequence
  Synthetic
gacgccgtgcacgtgcggtgcctcggatctgtacttggtcacgaggcacgcggatgtcatcccagtgcggcgtcg

SEQ ID NO: 117888 - DNA, 75 bp, Artificial Sequence
  Synthetic
ctgctcatccaacgtctccgtggcccacgaccacactggacagagatattactacctcacacgagaccctatcac

SEQ ID NO: 117889 - DNA, 75 bp, Artificial Sequence
  Synthetic
cacccaagaggacgcccaagccctccgagccttcacggaggctatgacgaggtactccgctcctcccggagatgc

SEQ ID NO: 117890 - DNA, 75 bp, Artificial Sequence
  Synthetic
ggcgtaggtcgcggaacttgggtaaggtcatcgataccctcacctgcggctttgccgacctcatggggtaccttc

SEQ ID NO: 117891 - DNA, 75 bp, Artificial Sequence
  Synthetic
ggtgccgtactacgtgcgggcgcacgcgcttttgcgcctgtgcttgcccgtgcgtcggatagcagcgggcaagta

SEQ ID NO: 117892 - DNA, 75 bp, Artificial Sequence
  Synthetic
ttgctctttctctatcttccttctggcactcttctcctgcctcgctgtgccaactacggccatcaactatggtaa

SEQ ID NO: 117893 - DNA, 75 bp, Artificial Sequence
  Synthetic
actccatggtatggccgcgttttcactccatgggtactctccaggcgaactcaatcgggtggcatcatgcctcag

SEQ ID NO: 117894 - DNA, 75 bp, Artificial Sequence
  Synthetic
ctgaacccgtctgttgctgccaccttagggttcggtgcttatatgtcaaaggcccatgggattgacccaaacgtc

SEQ ID NO: 117895 - DNA, 75 bp, Artificial Sequence
  Synthetic
gcctggagacatcgagcccgcgcggtccgagcaaagcttatcgcccagggagggaacgcagcaatttgcggcaag

SEQ ID NO: 117896 - DNA, 75 bp, Artificial Sequence
  Synthetic
gttaaaaccgggaacacgtcatcgtgctggtacccagtgtcgcctacattggcagctcccaacgcctccgtgcct

SEQ ID NO: 117897 - DNA, 75 bp, Artificial Sequence
  Synthetic
atcattcaaagactccacggcttaagcgcgtttacactccatggatactctccacacgaactcaatcgggtggca

SEQ ID NO: 117898 - DNA, 75 bp, Artificial Sequence
  Synthetic
cggaggctatgaccaggtactctgcccctcctggtgaccctcccagaccggaatatgacctggagctgataacat

SEQ ID NO: 117899 - DNA, 75 bp, Artificial Sequence
  Synthetic
tcctagctcccatcacggcctatgtgcagcagacacgaggcttattgggcaccatcgtcacgagcctcactggca

SEQ ID NO: 117900 - DNA, 75 bp, Artificial Sequence
  Synthetic
ggcagatgttcaccttcgctccccagcatcatatgactgtccaagagtgcaactgctccatctatactggtcata

SEQ ID NO: 117901 - DNA, 75 bp, Artificial Sequence
  Synthetic
cggggccgggtcgaagaccttagccggcccaaagaaacccgtatgccagatgtacaccaatgtagaccaagacct

SEQ ID NO: 117902 - DNA, 75 bp, Artificial Sequence
  Synthetic
gccatccccctaaactacatcaagggggggaggcatctcattttctgtcattccaagaagaagtgcgacgagctc

SEQ ID NO: 117903 - DNA, 75 bp, Artificial Sequence
  Synthetic
tcatggctgggaaacatcatccagtacgctccaaccgtatgggttcgcatggtcctgatgacacacttcttctcc

SEQ ID NO: 117904 - DNA, 75 bp, Artificial Sequence
  Synthetic
ggtcctgatgacacacttcttctccattctcatggcccaagacaccctggaccagaacctcaactttgaaatgta

SEQ ID NO: 117905 - DNA, 75 bp, Artificial Sequence
  Synthetic
ggttttcctggagggccattggggcgttttgggcgctatcctttatttttccatggtggcaaattgggctaaggt

SEQ ID NO: 117906 - DNA, 75 bp, Artificial Sequence
  Synthetic
gcggggcgagtgatacgtatctggtcacaagaaacggtgatgtcatacctgctaggcgtaggggggatagccgcg

SEQ ID NO: 117907 - DNA, 75 bp, Artificial Sequence
  Synthetic
tctgcacacatactctccccacgaactgacgcgggtggctgcagccctcagaaaacttggggcgccacccctcag

SEQ ID NO: 117908 - DNA, 75 bp, Artificial Sequence
  Synthetic
tgtctgcactaggggcgttgctaaggccattgactttgtgcctgtggagaacatggaaactaccatgcgctcccc

SEQ ID NO: 117909 - DNA, 75 bp, Artificial Sequence
  Synthetic
ccgggagctaggcagaacctgaagctcatcaacagcaatggtagctggcacatcaaccgtacagcgctgaactgc

SEQ ID NO: 117910 - DNA, 75 bp, Artificial Sequence
  Synthetic
ccgggagctaggcagaacctgtagctcatcaacagcaatggtagctggcacatcaaccgtacagcgctgaactgc

SEQ ID NO: 117911 - DNA, 75 bp, Artificial Sequence
  Synthetic
ccgggagctaggcagaacctgcagctcatcaacagcaatggtagctggcacatcaaccgtacagcgctgaactgc

SEQ ID NO: 117912 - DNA, 75 bp, Artificial Sequence
  Synthetic
ccgggagctaggcagaacctggagctcatcaacagcaatggtagctggcacatcaaccgtacagcgctgaactgc

SEQ ID NO: 117913 - DNA, 75 bp, Artificial Sequence
  Synthetic
cctgggctcagcccgggtacccttggcccctctatggtaacgagggctgcgggtgggcagggtggctcctgtccc

SEQ ID NO: 117914 - DNA, 75 bp, Artificial Sequence
  Synthetic
tggggtacctccatgctccgactggaagcgggaagagcactaaggtccccgcggcttatgccagtcagggatata

SEQ ID NO: 117915 - DNA, 75 bp, Artificial Sequence
  Synthetic
ctaagcacatgtggaacttcgttagcgggatacaatacctggcgggcctgtcaacgctgcccgggaaccccgcta

SEQ ID NO: 117916 - DNA, 75 bp, Artificial Sequence
  Synthetic
cctacttcgaacaaggttggggtcccattacagacgccaatgtatctggtagctcccaagataagccttactgtt

SEQ ID NO: 117917 - DNA, 75 bp, Artificial Sequence
  Synthetic
ctcctgtgcccccgcctcggaagaagcgtacggtagtcctcaacgcatcaaccgtatctgctgccttggccgagc

SEQ ID NO: 117918 - DNA, 75 bp, Artificial Sequence
  Synthetic
gctatggagcaggggtggcaggcgcgctcgtggcctttaaggtcatgagcggcgagatgccctctaccgaggacc

SEQ ID NO: 117919 - DNA, 75 bp, Artificial Sequence
  Synthetic
gacaatcacgacgggtggccctatcacttactcaacctacggcaaattccttgctgacggcggatgtagtggggg

SEQ ID NO: 117920 - DNA, 75 bp, Artificial Sequence
  Synthetic
cagaaagggcaaccccacatacaactggggcgagaatgagactgacgtttttatcctcagcagcctccggccccc

SEQ ID NO: 117921 - DNA, 75 bp, Artificial Sequence
  Synthetic
gagtgccactctacggaccctaccaccgtcctgggtataggtacggtcttggaccaggcggagactgcaggcgtc

SEQ ID NO: 117922 - DNA, 75 bp, Artificial Sequence
  Synthetic
ctagtcaaccttctgcctgccatcctatcgccaggagctctcgttgtcggcgtggtgtgcgcagcaatactacgc

SEQ ID NO: 117923 - DNA, 75 bp, Artificial Sequence
  Synthetic
gagggggggaacaacaccaaactggtgtgccccaccgattgcttccgcaaacatcccgacgccacctacgcgagg

SEQ ID NO: 117924 - DNA, 75 bp, Artificial Sequence
  Synthetic
gaagaagttattctgcacacacccggctgtataccttgtgttcaggacggcaatacatccacgtggtggaccgca

SEQ ID NO: 117925 - DNA, 75 bp, Artificial Sequence
  Synthetic
gaagaagttattctgcacacacccggctgtataccttgtgttcaggtcggcaatacatccacgtggtggaccgca

SEQ ID NO: 117926 - DNA, 75 bp, Artificial Sequence
  Synthetic
gaagaagttattctgcacacacccggctgtataccttgtgttcaggccggcaatacatccacgtggtggaccgca

SEQ ID NO: 117927 - DNA, 75 bp, Artificial Sequence
  Synthetic
gaagaagttattctgcacacacccggctgtataccttgtgttcagggcggcaatacatccacgtggtggaccgca

SEQ ID NO: 117928 - DNA, 75 bp, Artificial Sequence
  Synthetic
gaagaagttattctgcacacacccggctgtataccttgtgttctggacggcaatacatccacgtggtggaccgca

SEQ ID NO: 117929 - DNA, 75 bp, Artificial Sequence
  Synthetic
gaagaagttattctgcacacacccggctgtataccttgtgttctggtcggcaatacatccacgtggtggaccgca

SEQ ID NO: 117930 - DNA, 75 bp, Artificial Sequence
  Synthetic
gaagaagttattctgcacacacccggctgtataccttgtgttctggccggcaatacatccacgtggtggaccgca

SEQ ID NO: 117931 - DNA, 75 bp, Artificial Sequence
  Synthetic
gaagaagttattctgcacacacccggctgtataccttgtgttctgggcggcaatacatccacgtggtggaccgca

SEQ ID NO: 117932 - DNA, 75 bp, Artificial Sequence
  Synthetic
gaagaagttattctgcacacacccggctgtataccttgtgttccggacggcaatacatccacgtggtggaccgca

SEQ ID NO: 117933 - DNA, 75 bp, Artificial Sequence
  Synthetic
gaagaagttattctgcacacacccggctgtataccttgtgttccggtcggcaatacatccacgtggtggaccgca

SEQ ID NO: 117934 - DNA, 75 bp, Artificial Sequence
  Synthetic
gaagaagttattctgcacacacccggctgtataccttgtgttccggccggcaatacatccacgtggtggaccgca

SEQ ID NO: 117935 - DNA, 75 bp, Artificial Sequence
  Synthetic
gaagaagttattctgcacacacccggctgtataccttgtgttccgggcggcaatacatccacgtggtggaccgca

SEQ ID NO: 117936 - DNA, 75 bp, Artificial Sequence
  Synthetic
gaagaagttattctgcacacacccggctgtataccttgtgttcgggacggcaatacatccacgtggtggaccgca

SEQ ID NO: 117937 - DNA, 75 bp, Artificial Sequence
  Synthetic
gaagaagttattctgcacacacccggctgtataccttgtgttcgggtcggcaatacatccacgtggtggaccgca

SEQ ID NO: 117938 - DNA, 75 bp, Artificial Sequence
  Synthetic
gaagaagttattctgcacacacccggctgtataccttgtgttcgggccggcaatacatccacgtggtggaccgca

SEQ ID NO: 117939 - DNA, 75 bp, Artificial Sequence
  Synthetic
gaagaagttattctgcacacacccggctgtataccttgtgttcggggcggcaatacatccacgtggtggaccgca

SEQ ID NO: 117940 - DNA, 75 bp, Artificial Sequence
  Synthetic
gatgaagttattctgcacacacccggctgtataccttgtgttcaggacggcaatacatccacgtggtggaccgca

SEQ ID NO: 117941 - DNA, 75 bp, Artificial Sequence
  Synthetic
gatgaagttattctgcacacacccggctgtataccttgtgttcaggtcggcaatacatccacgtggtggaccgca

SEQ ID NO: 117942 - DNA, 75 bp, Artificial Sequence
  Synthetic
gatgaagttattctgcacacacccggctgtataccttgtgttcaggccggcaatacatccacgtggtggaccgca

SEQ ID NO: 117943 - DNA, 75 bp, Artificial Sequence
  Synthetic
gatgaagttattctgcacacacccggctgtataccttgtgttcagggcggcaatacatccacgtggtggaccgca

SEQ ID NO: 117944 - DNA, 75 bp, Artificial Sequence
  Synthetic
gatgaagttattctgcacacacccggctgtataccttgtgttctggacggcaatacatccacgtggtggaccgca

SEQ ID NO: 117945 - DNA, 75 bp, Artificial Sequence
  Synthetic
gatgaagttattctgcacacacccggctgtataccttgtgttctggtcggcaatacatccacgtggtggaccgca

SEQ ID NO: 117946 - DNA, 75 bp, Artificial Sequence
  Synthetic
gatgaagttattctgcacacacccggctgtataccttgtgttctggccggcaatacatccacgtggtggaccgca

SEQ ID NO: 117947 - DNA, 75 bp, Artificial Sequence
  Synthetic
gatgaagttattctgcacacacccggctgtataccttgtgttctgggcggcaatacatccacgtggtggaccgca

SEQ ID NO: 117948 - DNA, 75 bp, Artificial Sequence
  Synthetic
gatgaagttattctgcacacacccggctgtataccttgtgttccggacggcaatacatccacgtggtggaccgca

SEQ ID NO: 117949 - DNA, 75 bp, Artificial Sequence
  Synthetic
gatgaagttattctgcacacacccggctgtataccttgtgttccggtcggcaatacatccacgtggtggaccgca

SEQ ID NO: 117950 - DNA, 75 bp, Artificial Sequence
  Synthetic
gatgaagttattctgcacacacccggctgtataccttgtgttccggccggcaatacatccacgtggtggaccgca

SEQ ID NO: 117951 - DNA, 75 bp, Artificial Sequence
  Synthetic
gatgaagttattctgcacacacccggctgtataccttgtgttccgggcggcaatacatccacgtggtggaccgca

SEQ ID NO: 117952 - DNA, 75 bp, Artificial Sequence
  Synthetic
gatgaagttattctgcacacacccggctgtataccttgtgttcgggacggcaatacatccacgtggtggaccgca

SEQ ID NO: 117953 - DNA, 75 bp, Artificial Sequence
  Synthetic
gatgaagttattctgcacacacccggctgtataccttgtgttcgggtcggcaatacatccacgtggtggaccgca

SEQ ID NO: 117954 - DNA, 75 bp, Artificial Sequence
  Synthetic
gatgaagttattctgcacacacccggctgtataccttgtgttcgggccggcaatacatccacgtggtggaccgca

SEQ ID NO: 117955 - DNA, 75 bp, Artificial Sequence
  Synthetic
gatgaagttattctgcacacacccggctgtataccttgtgttcggggcggcaatacatccacgtggtggaccgca

SEQ ID NO: 117956 - DNA, 75 bp, Artificial Sequence
  Synthetic
gacgaagttattctgcacacacccggctgtataccttgtgttcaggacggcaatacatccacgtggtggaccgca

SEQ ID NO: 117957 - DNA, 75 bp, Artificial Sequence
  Synthetic
gacgaagttattctgcacacacccggctgtataccttgtgttcaggtcggcaatacatccacgtggtggaccgca

SEQ ID NO: 117958 - DNA, 75 bp, Artificial Sequence
  Synthetic
gacgaagttattctgcacacacccggctgtataccttgtgttcaggccggcaatacatccacgtggtggaccgca

SEQ ID NO: 117959 - DNA, 75 bp, Artificial Sequence
  Synthetic
gacgaagttattctgcacacacccggctgtataccttgtgttcagggcggcaatacatccacgtggtggaccgca

SEQ ID NO: 117960 - DNA, 75 bp, Artificial Sequence
  Synthetic
gacgaagttattctgcacacacccggctgtataccttgtgttctggacggcaatacatccacgtggtggaccgca

SEQ ID NO: 117961 - DNA, 75 bp, Artificial Sequence
  Synthetic
gacgaagttattctgcacacacccggctgtataccttgtgttctggtcggcaatacatccacgtggtggaccgca

SEQ ID NO: 117962 - DNA, 75 bp, Artificial Sequence
  Synthetic
gacgaagttattctgcacacacccggctgtataccttgtgttctggccggcaatacatccacgtggtggaccgca

SEQ ID NO: 117963 - DNA, 75 bp, Artificial Sequence
  Synthetic
gacgaagttattctgcacacacccggctgtataccttgtgttctgggcggcaatacatccacgtggtggaccgca

SEQ ID NO: 117964 - DNA, 75 bp, Artificial Sequence
  Synthetic
gacgaagttattctgcacacacccggctgtataccttgtgttccggacggcaatacatccacgtggtggaccgca

SEQ ID NO: 117965 - DNA, 75 bp, Artificial Sequence
  Synthetic
gacgaagttattctgcacacacccggctgtataccttgtgttccggtcggcaatacatccacgtggtggaccgca

SEQ ID NO: 117966 - DNA, 75 bp, Artificial Sequence
  Synthetic
gacgaagttattctgcacacacccggctgtataccttgtgttccggccggcaatacatccacgtggtggaccgca

SEQ ID NO: 117967 - DNA, 75 bp, Artificial Sequence
  Synthetic
gacgaagttattctgcacacacccggctgtataccttgtgttccgggcggcaatacatccacgtggtggaccgca

SEQ ID NO: 117968 - DNA, 75 bp, Artificial Sequence
  Synthetic
gacgaagttattctgcacacacccggctgtataccttgtgttcgggacggcaatacatccacgtggtggaccgca

SEQ ID NO: 117969 - DNA, 75 bp, Artificial Sequence
  Synthetic
gacgaagttattctgcacacacccggctgtataccttgtgttcgggtcggcaatacatccacgtggtggaccgca

SEQ ID NO: 117970 - DNA, 75 bp, Artificial Sequence
  Synthetic
gacgaagttattctgcacacacccggctgtataccttgtgttcgggccggcaatacatccacgtggtggaccgca

SEQ ID NO: 117971 - DNA, 75 bp, Artificial Sequence
  Synthetic
gacgaagttattctgcacacacccggctgtataccttgtgttcggggcggcaatacatccacgtggtggaccgca

SEQ ID NO: 117972 - DNA, 75 bp, Artificial Sequence
  Synthetic
gaggaagttattctgcacacacccggctgtataccttgtgttcaggacggcaatacatccacgtggtggaccgca

SEQ ID NO: 117973 - DNA, 75 bp, Artificial Sequence
  Synthetic
gaggaagttattctgcacacacccggctgtataccttgtgttcaggtcggcaatacatccacgtggtggaccgca

SEQ ID NO: 117974 - DNA, 75 bp, Artificial Sequence
  Synthetic
gaggaagttattctgcacacacccggctgtataccttgtgttcaggccggcaatacatccacgtggtggaccgca

SEQ ID NO: 117975 - DNA, 75 bp, Artificial Sequence
  Synthetic
gaggaagttattctgcacacacccggctgtataccttgtgttcagggcggcaatacatccacgtggtggaccgca

SEQ ID NO: 117976 - DNA, 75 bp, Artificial Sequence
  Synthetic
gaggaagttattctgcacacacccggctgtataccttgtgttctggacggcaatacatccacgtggtggaccgca

SEQ ID NO: 117977 - DNA, 75 bp, Artificial Sequence
  Synthetic
gaggaagttattctgcacacacccggctgtataccttgtgttctggtcggcaatacatccacgtggtggaccgca

SEQ ID NO: 117978 - DNA, 75 bp, Artificial Sequence
  Synthetic
gaggaagttattctgcacacacccggctgtataccttgtgttctggccggcaatacatccacgtggtggaccgca

SEQ ID NO: 117979 - DNA, 75 bp, Artificial Sequence
  Synthetic
gaggaagttattctgcacacacccggctgtataccttgtgttctgggcggcaatacatccacgtggtggaccgca

SEQ ID NO: 117980 - DNA, 75 bp, Artificial Sequence
  Synthetic
gaggaagttattctgcacacacccggctgtataccttgtgttccggacggcaatacatccacgtggtggaccgca

SEQ ID NO: 117981 - DNA, 75 bp, Artificial Sequence
  Synthetic
gaggaagttattctgcacacacccggctgtataccttgtgttccggtcggcaatacatccacgtggtggaccgca

SEQ ID NO: 117982 - DNA, 75 bp, Artificial Sequence
  Synthetic
gaggaagttattctgcacacacccggctgtataccttgtgttccggccggcaatacatccacgtggtggaccgca

SEQ ID NO: 117983 - DNA, 75 bp, Artificial Sequence
  Synthetic
gaggaagttattctgcacacacccggctgtataccttgtgttccgggcggcaatacatccacgtggtggaccgca

SEQ ID NO: 117984 - DNA, 75 bp, Artificial Sequence
  Synthetic
gaggaagttattctgcacacacccggctgtataccttgtgttcgggacggcaatacatccacgtggtggaccgca

SEQ ID NO: 117985 - DNA, 75 bp, Artificial Sequence
  Synthetic
gaggaagttattctgcacacacccggctgtataccttgtgttcgggtcggcaatacatccacgtggtggaccgca

SEQ ID NO: 117986 - DNA, 75 bp, Artificial Sequence
  Synthetic
gaggaagttattctgcacacacccggctgtataccttgtgttcgggccggcaatacatccacgtggtggaccgca

SEQ ID NO: 117987 - DNA, 75 bp, Artificial Sequence
  Synthetic
gaggaagttattctgcacacacccggctgtataccttgtgttcggggcggcaatacatccacgtggtggaccgca

SEQ ID NO: 117988 - DNA, 75 bp, Artificial Sequence
  Synthetic
tctacggcaaggctatacccctagaatacatcaaggggggtaggcatctcatcttttgtcattcaaagaagaagt

SEQ ID NO: 117989 - DNA, 75 bp, Artificial Sequence
  Synthetic
aaggaggttaaggcagcggcgtcaaaagtgaaggccaacttgctatccgtagaggaagcttgcagcctgacgccc

SEQ ID NO: 117990 - DNA, 75 bp, Artificial Sequence
  Synthetic
tcgtaccctggcgctcttactgcgggtctcaggacccatgtggacgtcatcgtaatgtctgcgacgctctgttca

SEQ ID NO: 117991 - DNA, 75 bp, Artificial Sequence
  Synthetic
gcctgttcttgggcggaattgagcacaggttcgctgcggcctgcaattggactcgaggcgagcggtgtgagcttg

SEQ ID NO: 117992 - DNA, 75 bp, Artificial Sequence
  Synthetic
cgtttgcgctacggacgccctcatgactgggtacacgggcgatttcgatagtgtgatcgactgcaacgtcgccgt

SEQ ID NO: 117993 - DNA, 75 bp, Artificial Sequence
  Synthetic
ctctctatccgggccacataacgggtcatcgtatggcgtgggatatgatgatgaactggtcgcccactgtcacca

SEQ ID NO: 117994 - DNA, 75 bp, Artificial Sequence
  Synthetic
cctcattcatttacatcagaacatcgtggatgtgcaatacctctacgggttatcctcggccgttgtgtcctgggc

SEQ ID NO: 117995 - DNA, 75 bp, Artificial Sequence
  Synthetic
cctagcctattactctatgcagggcaactgggccaaggtcgctatcatcatggtcatgttttcaggggtcgatgc

SEQ ID NO: 117996 - DNA, 75 bp, Artificial Sequence
  Synthetic
ggtacgtgtcgcagggagagcgcccatcagggacgttcgacaccgtcattctctgcgaggcctacgacaccgggt

SEQ ID NO: 117997 - DNA, 75 bp, Artificial Sequence
  Synthetic
gggcgcctggctgaaagtggtggttattctcctcatgatagcaggggttgagagcaacaccatcatcggttctaa

SEQ ID NO: 117998 - DNA, 75 bp, Artificial Sequence
  Synthetic
gctcttgagaacttagtcatgttgaacgccgcctccgctgcgagctgccaaggctgggtgtggtgcatcctcttc

SEQ ID NO: 117999 - DNA, 75 bp, Artificial Sequence
  Synthetic
tatctcaacacgcctggactccccgtatgtcaggaccatcttgagttctgggaggcagtgtttactgggctcact

SEQ ID NO: 118000 - DNA, 75 bp, Artificial Sequence
  Synthetic
ccagcctttttattttgggtaccaatcagaatttacagctaatcaacaccaacggctcgtggcacatcaacagaa

SEQ ID NO: 118001 - DNA, 75 bp, Artificial Sequence
  Synthetic
ccagcctttttattttgggtaccaatcagaatttacagcttatcaacaccaacggctcgtggcacatcaacagaa

SEQ ID NO: 118002 - DNA, 75 bp, Artificial Sequence
  Synthetic
ccagcctttttattttgggtaccaatcagaatttacagctcatcaacaccaacggctcgtggcacatcaacagaa

SEQ ID NO: 118003 - DNA, 75 bp, Artificial Sequence
  Synthetic
ccagcctttttattttgggtaccaatcagaatttacagctgatcaacaccaacggctcgtggcacatcaacagaa

SEQ ID NO: 118004 - DNA, 75 bp, Artificial Sequence
  Synthetic
ccagcctttttattttgggtaccaatcagaattttcagctaatcaacaccaacggctcgtggcacatcaacagaa

SEQ ID NO: 118005 - DNA, 75 bp, Artificial Sequence
  Synthetic
ccagcctttttattttgggtaccaatcagaattttcagcttatcaacaccaacggctcgtggcacatcaacagaa

SEQ ID NO: 118006 - DNA, 75 bp, Artificial Sequence
  Synthetic
ccagcctttttattttgggtaccaatcagaattttcagctcatcaacaccaacggctcgtggcacatcaacagaa

SEQ ID NO: 118007 - DNA, 75 bp, Artificial Sequence
  Synthetic
ccagcctttttattttgggtaccaatcagaattttcagctgatcaacaccaacggctcgtggcacatcaacagaa

SEQ ID NO: 118008 - DNA, 75 bp, Artificial Sequence
  Synthetic
ccagcctttttattttgggtaccaatcagaatttccagctaatcaacaccaacggctcgtggcacatcaacagaa

SEQ ID NO: 118009 - DNA, 75 bp, Artificial Sequence
  Synthetic
ccagcctttttattttgggtaccaatcagaatttccagcttatcaacaccaacggctcgtggcacatcaacagaa

SEQ ID NO: 118010 - DNA, 75 bp, Artificial Sequence
  Synthetic
ccagcctttttattttgggtaccaatcagaatttccagctcatcaacaccaacggctcgtggcacatcaacagaa

SEQ ID NO: 118011 - DNA, 75 bp, Artificial Sequence
  Synthetic
ccagcctttttattttgggtaccaatcagaatttccagctgatcaacaccaacggctcgtggcacatcaacagaa

SEQ ID NO: 118012 - DNA, 75 bp, Artificial Sequence
  Synthetic
ccagcctttttattttgggtaccaatcagaatttgcagctaatcaacaccaacggctcgtggcacatcaacagaa

SEQ ID NO: 118013 - DNA, 75 bp, Artificial Sequence
  Synthetic
ccagcctttttattttgggtaccaatcagaatttgcagcttatcaacaccaacggctcgtggcacatcaacagaa

SEQ ID NO: 118014 - DNA, 75 bp, Artificial Sequence
  Synthetic
ccagcctttttattttgggtaccaatcagaatttgcagctcatcaacaccaacggctcgtggcacatcaacagaa

SEQ ID NO: 118015 - DNA, 75 bp, Artificial Sequence
  Synthetic
ccagcctttttattttgggtaccaatcagaatttgcagctgatcaacaccaacggctcgtggcacatcaacagaa

SEQ ID NO: 118016 - DNA, 75 bp, Artificial Sequence
  Synthetic
ccagcctttttattttgggttccaatcagaatttacagctaatcaacaccaacggctcgtggcacatcaacagaa

SEQ ID NO: 118017 - DNA, 75 bp, Artificial Sequence
  Synthetic
ccagcctttttattttgggttccaatcagaatttacagcttatcaacaccaacggctcgtggcacatcaacagaa

SEQ ID NO: 118018 - DNA, 75 bp, Artificial Sequence
  Synthetic
ccagcctttttattttgggttccaatcagaatttacagctcatcaacaccaacggctcgtggcacatcaacagaa

SEQ ID NO: 118019 - DNA, 75 bp, Artificial Sequence
  Synthetic
ccagcctttttattttgggttccaatcagaatttacagctgatcaacaccaacggctcgtggcacatcaacagaa

SEQ ID NO: 118020 - DNA, 75 bp, Artificial Sequence
  Synthetic
ccagcctttttattttgggttccaatcagaattttcagctaatcaacaccaacggctcgtggcacatcaacagaa

SEQ ID NO: 118021 - DNA, 75 bp, Artificial Sequence
  Synthetic
ccagcctttttattttgggttccaatcagaattttcagcttatcaacaccaacggctcgtggcacatcaacagaa

SEQ ID NO: 118022 - DNA, 75 bp, Artificial Sequence
  Synthetic
ccagcctttttattttgggttccaatcagaattttcagctcatcaacaccaacggctcgtggcacatcaacagaa

SEQ ID NO: 118023 - DNA, 75 bp, Artificial Sequence
  Synthetic
ccagcctttttattttgggttccaatcagaattttcagctgatcaacaccaacggctcgtggcacatcaacagaa

SEQ ID NO: 118024 - DNA, 75 bp, Artificial Sequence
  Synthetic
ccagcctttttattttgggttccaatcagaatttccagctaatcaacaccaacggctcgtggcacatcaacagaa

SEQ ID NO: 118025 - DNA, 75 bp, Artificial Sequence
  Synthetic
ccagcctttttattttgggttccaatcagaatttccagcttatcaacaccaacggctcgtggcacatcaacagaa

SEQ ID NO: 118026 - DNA, 75 bp, Artificial Sequence
  Synthetic
ccagcctttttattttgggttccaatcagaatttccagctcatcaacaccaacggctcgtggcacatcaacagaa

SEQ ID NO: 118027 - DNA, 75 bp, Artificial Sequence
  Synthetic
ccagcctttttattttgggttccaatcagaatttccagctgatcaacaccaacggctcgtggcacatcaacagaa

SEQ ID NO: 118028 - DNA, 75 bp, Artificial Sequence
  Synthetic
ccagcctttttattttgggttccaatcagaatttgcagctaatcaacaccaacggctcgtggcacatcaacagaa

SEQ ID NO: 118029 - DNA, 75 bp, Artificial Sequence
  Synthetic
ccagcctttttattttgggttccaatcagaatttgcagcttatcaacaccaacggctcgtggcacatcaacagaa

SEQ ID NO: 118030 - DNA, 75 bp, Artificial Sequence
  Synthetic
ccagcctttttattttgggttccaatcagaatttgcagctcatcaacaccaacggctcgtggcacatcaacagaa

SEQ ID NO: 118031 - DNA, 75 bp, Artificial Sequence
  Synthetic
ccagcctttttattttgggttccaatcagaatttgcagctgatcaacaccaacggctcgtggcacatcaacagaa

SEQ ID NO: 118032 - DNA, 75 bp, Artificial Sequence
  Synthetic
ccagcctttttattttgggtcccaatcagaatttacagctaatcaacaccaacggctcgtggcacatcaacagaa

SEQ ID NO: 118033 - DNA, 75 bp, Artificial Sequence
  Synthetic
ccagcctttttattttgggtcccaatcagaatttacagcttatcaacaccaacggctcgtggcacatcaacagaa

SEQ ID NO: 118034 - DNA, 75 bp, Artificial Sequence
  Synthetic
ccagcctttttattttgggtcccaatcagaatttacagctcatcaacaccaacggctcgtggcacatcaacagaa

SEQ ID NO: 118035 - DNA, 75 bp, Artificial Sequence
  Synthetic
ccagcctttttattttgggtcccaatcagaatttacagctgatcaacaccaacggctcgtggcacatcaacagaa

SEQ ID NO: 118036 - DNA, 75 bp, Artificial Sequence
  Synthetic
ccagcctttttattttgggtcccaatcagaattttcagctaatcaacaccaacggctcgtggcacatcaacagaa

SEQ ID NO: 118037 - DNA, 75 bp, Artificial Sequence
  Synthetic
ccagcctttttattttgggtcccaatcagaattttcagcttatcaacaccaacggctcgtggcacatcaacagaa

SEQ ID NO: 118038 - DNA, 75 bp, Artificial Sequence
  Synthetic
ccagcctttttattttgggtcccaatcagaattttcagctcatcaacaccaacggctcgtggcacatcaacagaa

SEQ ID NO: 118039 - DNA, 75 bp, Artificial Sequence
  Synthetic
ccagcctttttattttgggtcccaatcagaattttcagctgatcaacaccaacggctcgtggcacatcaacagaa

SEQ ID NO: 118040 - DNA, 75 bp, Artificial Sequence
  Synthetic
ccagcctttttattttgggtcccaatcagaatttccagctaatcaacaccaacggctcgtggcacatcaacagaa

SEQ ID NO: 118041 - DNA, 75 bp, Artificial Sequence
  Synthetic
ccagcctttttattttgggtcccaatcagaatttccagcttatcaacaccaacggctcgtggcacatcaacagaa

SEQ ID NO: 118042 - DNA, 75 bp, Artificial Sequence
  Synthetic
ccagcctttttattttgggtcccaatcagaatttccagctcatcaacaccaacggctcgtggcacatcaacagaa

SEQ ID NO: 118043 - DNA, 75 bp, Artificial Sequence
  Synthetic
ccagcctttttattttgggtcccaatcagaatttccagctgatcaacaccaacggctcgtggcacatcaacagaa

SEQ ID NO: 118044 - DNA, 75 bp, Artificial Sequence
  Synthetic
ccagcctttttattttgggtcccaatcagaatttgcagctaatcaacaccaacggctcgtggcacatcaacagaa

SEQ ID NO: 118045 - DNA, 75 bp, Artificial Sequence
  Synthetic
ccagcctttttattttgggtcccaatcagaatttgcagcttatcaacaccaacggctcgtggcacatcaacagaa

SEQ ID NO: 118046 - DNA, 75 bp, Artificial Sequence
  Synthetic
ccagcctttttattttgggtcccaatcagaatttgcagctcatcaacaccaacggctcgtggcacatcaacagaa

SEQ ID NO: 118047 - DNA, 75 bp, Artificial Sequence
  Synthetic
ccagcctttttattttgggtcccaatcagaatttgcagctgatcaacaccaacggctcgtggcacatcaacagaa

SEQ ID NO: 118048 - DNA, 75 bp, Artificial Sequence
  Synthetic
ccagcctttttattttgggtgccaatcagaatttacagctaatcaacaccaacggctcgtggcacatcaacagaa

SEQ ID NO: 118049 - DNA, 75 bp, Artificial Sequence
  Synthetic
ccagcctttttattttgggtgccaatcagaatttacagcttatcaacaccaacggctcgtggcacatcaacagaa

SEQ ID NO: 118050 - DNA, 75 bp, Artificial Sequence
  Synthetic
ccagcctttttattttgggtgccaatcagaatttacagctcatcaacaccaacggctcgtggcacatcaacagaa

SEQ ID NO: 118051 - DNA, 75 bp, Artificial Sequence
  Synthetic
ccagcctttttattttgggtgccaatcagaatttacagctgatcaacaccaacggctcgtggcacatcaacagaa

SEQ ID NO: 118052 - DNA, 75 bp, Artificial Sequence
  Synthetic
ccagcctttttattttgggtgccaatcagaattttcagctaatcaacaccaacggctcgtggcacatcaacagaa

SEQ ID NO: 118053 - DNA, 75 bp, Artificial Sequence
  Synthetic
ccagcctttttattttgggtgccaatcagaattttcagcttatcaacaccaacggctcgtggcacatcaacagaa

SEQ ID NO: 118054 - DNA, 75 bp, Artificial Sequence
  Synthetic
ccagcctttttattttgggtgccaatcagaattttcagctcatcaacaccaacggctcgtggcacatcaacagaa

SEQ ID NO: 118055 - DNA, 75 bp, Artificial Sequence
  Synthetic
ccagcctttttattttgggtgccaatcagaattttcagctgatcaacaccaacggctcgtggcacatcaacagaa

SEQ ID NO: 118056 - DNA, 75 bp, Artificial Sequence
  Synthetic
ccagcctttttattttgggtgccaatcagaatttccagctaatcaacaccaacggctcgtggcacatcaacagaa

SEQ ID NO: 118057 - DNA, 75 bp, Artificial Sequence
  Synthetic
ccagcctttttattttgggtgccaatcagaatttccagcttatcaacaccaacggctcgtggcacatcaacagaa

SEQ ID NO: 118058 - DNA, 75 bp, Artificial Sequence
  Synthetic
ccagcctttttattttgggtgccaatcagaatttccagctcatcaacaccaacggctcgtggcacatcaacagaa

SEQ ID NO: 118059 - DNA, 75 bp, Artificial Sequence
  Synthetic
ccagcctttttattttgggtgccaatcagaatttccagctgatcaacaccaacggctcgtggcacatcaacagaa

SEQ ID NO: 118060 - DNA, 75 bp, Artificial Sequence
  Synthetic
ccagcctttttattttgggtgccaatcagaatttgcagctaatcaacaccaacggctcgtggcacatcaacagaa

SEQ ID NO: 118061 - DNA, 75 bp, Artificial Sequence
  Synthetic
ccagcctttttattttgggtgccaatcagaatttgcagcttatcaacaccaacggctcgtggcacatcaacagaa

SEQ ID NO: 118062 - DNA, 75 bp, Artificial Sequence
  Synthetic
ccagcctttttattttgggtgccaatcagaatttgcagctcatcaacaccaacggctcgtggcacatcaacagaa

SEQ ID NO: 118063 - DNA, 75 bp, Artificial Sequence
  Synthetic
ccagcctttttattttgggtgccaatcagaatttgcagctgatcaacaccaacggctcgtggcacatcaacagaa

SEQ ID NO: 118064 - DNA, 75 bp, Artificial Sequence
  Synthetic
tgccccatcccaacatcgaggaggttgctctgtccaccaccggggagatccccttttacggcaaggctatccccc

SEQ ID NO: 118065 - DNA, 75 bp, Artificial Sequence
  Synthetic
cacatcgacgcccatttcctttctcagacaaagcagacgggggagaactttgcgtatttagtggcttatcaagcc

SEQ ID NO: 118066 - DNA, 75 bp, Artificial Sequence
  Synthetic
tcaaggggggagaactgcggctatcgcaggtgccgcgcgagcggcgtactgacgactagctgcggtaacaccctc

SEQ ID NO: 118067 - DNA, 75 bp, Artificial Sequence
  Synthetic
acagcccttaattgcaatgattctctgcacactggtttcatctcggccttattcaattacaacagattcaactca

SEQ ID NO: 118068 - DNA, 75 bp, Artificial Sequence
  Synthetic
ctcgagctctcgctcatgactacgagcaggctgccacgttggggttgttggttaccttactggtcactgccttca

SEQ ID NO: 118069 - DNA, 75 bp, Artificial Sequence
  Synthetic
tatgggcacggccagattataatcctccccttgtggaaccgtggaagcgcccggactatgagccacccttagtcc

SEQ ID NO: 118070 - DNA, 75 bp, Artificial Sequence
  Synthetic
tgacatcacaacaacacacccagtcaccaagtacattatggcttgcatgtcggcggacttagaggtcattaccag

SEQ ID NO: 118071 - DNA, 75 bp, Artificial Sequence
  Synthetic
acatgagaccttattgctggcactacccgccttcccagtgcgggatagtgccggccgcctctgtctgtggcccgg

SEQ ID NO: 118072 - DNA, 75 bp, Artificial Sequence
  Synthetic
atggcacgtccgcggaggccgagatgctgtcatcctccttacctgcctactgcacccatcattaggctttgagat

SEQ ID NO: 118073 - DNA, 75 bp, Artificial Sequence
  Synthetic
accaagtacattatggcttgcatgtcggcggacttagaggtcattaccagcacgtgggtgctggctggtggagtc

SEQ ID NO: 118074 - DNA, 75 bp, Artificial Sequence
  Synthetic
tgaaacagatgtgttcctgctgaagtccctgcggcctcccagcggtcagtggtttgggtgtgcgtggatgaactc

SEQ ID NO: 118075 - DNA, 75 bp, Artificial Sequence
  Synthetic
ggtgttcccacttacaggtttggggaaagtaagaccgatgtattcctccttaacagcaccagacccccttcgggg

SEQ ID NO: 118076 - DNA, 75 bp, Artificial Sequence
  Synthetic
gactccgaagctgaatcttactcctccatgccccctctcgagggggagccgggggaccccgatctcagcgacggg

SEQ ID NO: 118077 - DNA, 75 bp, Artificial Sequence
  Synthetic
tcatgtaccaacagtacgatgagatggaagagtgctccagtcgcattccatatctcgtcgaagggcagcatatag

SEQ ID NO: 118078 - DNA, 75 bp, Artificial Sequence
  Synthetic
tgcatggccgttcgggggatagtgggaggcaagtatgtccaggctttattgttgagactgggggctatgactggt

SEQ ID NO: 118079 - DNA, 75 bp, Artificial Sequence
  Synthetic
ccaacggcagctggcacatcaacaggactgccctgaactgcaatgactccctcaacaccgggtttcttgccgcgc

SEQ ID NO: 118080 - DNA, 75 bp, Artificial Sequence
  Synthetic
ggaagagtgctccagtcgcattccatatctcgtcgaagggcagcatatagccgaacagttcaggcagaaggtgct

SEQ ID NO: 118081 - DNA, 75 bp, Artificial Sequence
  Synthetic
cggacgttttcgtccttaacaacaccaggccaccgctgggcaattggttcggttgcacttggatgaactcaactg

SEQ ID NO: 118082 - DNA, 75 bp, Artificial Sequence
  Synthetic
tatctcgtcgaagggcagcatatagccgaacagttcaggcagaaggtgctgggcctgatgcagactacggccaag

SEQ ID NO: 118083 - DNA, 75 bp, Artificial Sequence
  Synthetic
aaatgtggatcaggaccctggctcacccccagatgcatggtcgattacccatacaggttatggcattatccctgc

SEQ ID NO: 118084 - DNA, 75 bp, Artificial Sequence
  Synthetic
agaggaagattaacacctggggggctgatactgcagcctgcggcgacattctccagggacggcccgtctcagcga

SEQ ID NO: 118085 - DNA, 75 bp, Artificial Sequence
  Synthetic
agaggaagattaacacctggggggctgatactgcagcctgcggcgacattctccagggtcggcccgtctcagcga

SEQ ID NO: 118086 - DNA, 75 bp, Artificial Sequence
  Synthetic
agaggaagattaacacctggggggctgatactgcagcctgcggcgacattctccagggccggcccgtctcagcga

SEQ ID NO: 118087 - DNA, 75 bp, Artificial Sequence
  Synthetic
agaggaagattaacacctggggggctgatactgcagcctgcggcgacattctccaggggcggcccgtctcagcga

SEQ ID NO: 118088 - DNA, 75 bp, Artificial Sequence
  Synthetic
agaggaagattaacacctggggggctgatactgctgcctgcggcgacattctccagggacggcccgtctcagcga

SEQ ID NO: 118089 - DNA, 75 bp, Artificial Sequence
  Synthetic
agaggaagattaacacctggggggctgatactgctgcctgcggcgacattctccagggtcggcccgtctcagcga

SEQ ID NO: 118090 - DNA, 75 bp, Artificial Sequence
  Synthetic
agaggaagattaacacctggggggctgatactgctgcctgcggcgacattctccagggccggcccgtctcagcga

SEQ ID NO: 118091 - DNA, 75 bp, Artificial Sequence
  Synthetic
agaggaagattaacacctggggggctgatactgctgcctgcggcgacattctccaggggcggcccgtctcagcga

SEQ ID NO: 118092 - DNA, 75 bp, Artificial Sequence
  Synthetic
agaggaagattaacacctggggggctgatactgccgcctgcggcgacattctccagggacggcccgtctcagcga

SEQ ID NO: 118093 - DNA, 75 bp, Artificial Sequence
  Synthetic
agaggaagattaacacctggggggctgatactgccgcctgcggcgacattctccagggtcggcccgtctcagcga

SEQ ID NO: 118094 - DNA, 75 bp, Artificial Sequence
  Synthetic
agaggaagattaacacctggggggctgatactgccgcctgcggcgacattctccagggccggcccgtctcagcga

SEQ ID NO: 118095 - DNA, 75 bp, Artificial Sequence
  Synthetic
agaggaagattaacacctggggggctgatactgccgcctgcggcgacattctccaggggcggcccgtctcagcga

SEQ ID NO: 118096 - DNA, 75 bp, Artificial Sequence
  Synthetic
agaggaagattaacacctggggggctgatactgcggcctgcggcgacattctccagggacggcccgtctcagcga

SEQ ID NO: 118097 - DNA, 75 bp, Artificial Sequence
  Synthetic
agaggaagattaacacctggggggctgatactgcggcctgcggcgacattctccagggtcggcccgtctcagcga

SEQ ID NO: 118098 - DNA, 75 bp, Artificial Sequence
  Synthetic
agaggaagattaacacctggggggctgatactgcggcctgcggcgacattctccagggccggcccgtctcagcga

SEQ ID NO: 118099 - DNA, 75 bp, Artificial Sequence
  Synthetic
agaggaagattaacacctggggggctgatactgcggcctgcggcgacattctccaggggcggcccgtctcagcga

SEQ ID NO: 118100 - DNA, 75 bp, Artificial Sequence
  Synthetic
agaggaagattatcacctggggggctgatactgcagcctgcggcgacattctccagggacggcccgtctcagcga

SEQ ID NO: 118101 - DNA, 75 bp, Artificial Sequence
  Synthetic
agaggaagattatcacctggggggctgatactgcagcctgcggcgacattctccagggtcggcccgtctcagcga

SEQ ID NO: 118102 - DNA, 75 bp, Artificial Sequence
  Synthetic
agaggaagattatcacctggggggctgatactgcagcctgcggcgacattctccagggccggcccgtctcagcga

SEQ ID NO: 118103 - DNA, 75 bp, Artificial Sequence
  Synthetic
agaggaagattatcacctggggggctgatactgcagcctgcggcgacattctccaggggcggcccgtctcagcga

SEQ ID NO: 118104 - DNA, 75 bp, Artificial Sequence
  Synthetic
agaggaagattatcacctggggggctgatactgctgcctgcggcgacattctccagggacggcccgtctcagcga

SEQ ID NO: 118105 - DNA, 75 bp, Artificial Sequence
  Synthetic
agaggaagattatcacctggggggctgatactgctgcctgcggcgacattctccagggtcggcccgtctcagcga

SEQ ID NO: 118106 - DNA, 75 bp, Artificial Sequence
  Synthetic
agaggaagattatcacctggggggctgatactgctgcctgcggcgacattctccagggccggcccgtctcagcga

SEQ ID NO: 118107 - DNA, 75 bp, Artificial Sequence
  Synthetic
agaggaagattatcacctggggggctgatactgctgcctgcggcgacattctccaggggcggcccgtctcagcga

SEQ ID NO: 118108 - DNA, 75 bp, Artificial Sequence
  Synthetic
agaggaagattatcacctggggggctgatactgccgcctgcggcgacattctccagggacggcccgtctcagcga

SEQ ID NO: 118109 - DNA, 75 bp, Artificial Sequence
  Synthetic
agaggaagattatcacctggggggctgatactgccgcctgcggcgacattctccagggtcggcccgtctcagcga

SEQ ID NO: 118110 - DNA, 75 bp, Artificial Sequence
  Synthetic
agaggaagattatcacctggggggctgatactgccgcctgcggcgacattctccagggccggcccgtctcagcga

SEQ ID NO: 118111 - DNA, 75 bp, Artificial Sequence
  Synthetic
agaggaagattatcacctggggggctgatactgccgcctgcggcgacattctccaggggcggcccgtctcagcga

SEQ ID NO: 118112 - DNA, 75 bp, Artificial Sequence
  Synthetic
agaggaagattatcacctggggggctgatactgcggcctgcggcgacattctccagggacggcccgtctcagcga

SEQ ID NO: 118113 - DNA, 75 bp, Artificial Sequence
  Synthetic
agaggaagattatcacctggggggctgatactgcggcctgcggcgacattctccagggtcggcccgtctcagcga

SEQ ID NO: 118114 - DNA, 75 bp, Artificial Sequence
  Synthetic
agaggaagattatcacctggggggctgatactgcggcctgcggcgacattctccagggccggcccgtctcagcga

SEQ ID NO: 118115 - DNA, 75 bp, Artificial Sequence
  Synthetic
agaggaagattatcacctggggggctgatactgcggcctgcggcgacattctccaggggcggcccgtctcagcga

SEQ ID NO: 118116 - DNA, 75 bp, Artificial Sequence
  Synthetic
agaggaagattaccacctggggggctgatactgcagcctgcggcgacattctccagggacggcccgtctcagcga

SEQ ID NO: 118117 - DNA, 75 bp, Artificial Sequence
  Synthetic
agaggaagattaccacctggggggctgatactgcagcctgcggcgacattctccagggtcggcccgtctcagcga

SEQ ID NO: 118118 - DNA, 75 bp, Artificial Sequence
  Synthetic
agaggaagattaccacctggggggctgatactgcagcctgcggcgacattctccagggccggcccgtctcagcga

SEQ ID NO: 118119 - DNA, 75 bp, Artificial Sequence
  Synthetic
agaggaagattaccacctggggggctgatactgcagcctgcggcgacattctccaggggcggcccgtctcagcga

SEQ ID NO: 118120 - DNA, 75 bp, Artificial Sequence
  Synthetic
agaggaagattaccacctggggggctgatactgctgcctgcggcgacattctccagggacggcccgtctcagcga

SEQ ID NO: 118121 - DNA, 75 bp, Artificial Sequence
  Synthetic
agaggaagattaccacctggggggctgatactgctgcctgcggcgacattctccagggtcggcccgtctcagcga

SEQ ID NO: 118122 - DNA, 75 bp, Artificial Sequence
  Synthetic
agaggaagattaccacctggggggctgatactgctgcctgcggcgacattctccagggccggcccgtctcagcga

SEQ ID NO: 118123 - DNA, 75 bp, Artificial Sequence
  Synthetic
agaggaagattaccacctggggggctgatactgctgcctgcggcgacattctccaggggcggcccgtctcagcga

SEQ ID NO: 118124 - DNA, 75 bp, Artificial Sequence
  Synthetic
agaggaagattaccacctggggggctgatactgccgcctgcggcgacattctccagggacggcccgtctcagcga

SEQ ID NO: 118125 - DNA, 75 bp, Artificial Sequence
  Synthetic
agaggaagattaccacctggggggctgatactgccgcctgcggcgacattctccagggtcggcccgtctcagcga

SEQ ID NO: 118126 - DNA, 75 bp, Artificial Sequence
  Synthetic
agaggaagattaccacctggggggctgatactgccgcctgcggcgacattctccagggccggcccgtctcagcga

SEQ ID NO: 118127 - DNA, 75 bp, Artificial Sequence
  Synthetic
agaggaagattaccacctggggggctgatactgccgcctgcggcgacattctccaggggcggcccgtctcagcga

SEQ ID NO: 118128 - DNA, 75 bp, Artificial Sequence
  Synthetic
agaggaagattaccacctggggggctgatactgcggcctgcggcgacattctccagggacggcccgtctcagcga

SEQ ID NO: 118129 - DNA, 75 bp, Artificial Sequence
  Synthetic
agaggaagattaccacctggggggctgatactgcggcctgcggcgacattctccagggtcggcccgtctcagcga

SEQ ID NO: 118130 - DNA, 75 bp, Artificial Sequence
  Synthetic
agaggaagattaccacctggggggctgatactgcggcctgcggcgacattctccagggccggcccgtctcagcga

SEQ ID NO: 118131 - DNA, 75 bp, Artificial Sequence
  Synthetic
agaggaagattaccacctggggggctgatactgcggcctgcggcgacattctccaggggcggcccgtctcagcga

SEQ ID NO: 118132 - DNA, 75 bp, Artificial Sequence
  Synthetic
agaggaagattagcacctggggggctgatactgcagcctgcggcgacattctccagggacggcccgtctcagcga

SEQ ID NO: 118133 - DNA, 75 bp, Artificial Sequence
  Synthetic
agaggaagattagcacctggggggctgatactgcagcctgcggcgacattctccagggtcggcccgtctcagcga

SEQ ID NO: 118134 - DNA, 75 bp, Artificial Sequence
  Synthetic
agaggaagattagcacctggggggctgatactgcagcctgcggcgacattctccagggccggcccgtctcagcga

SEQ ID NO: 118135 - DNA, 75 bp, Artificial Sequence
  Synthetic
agaggaagattagcacctggggggctgatactgcagcctgcggcgacattctccaggggcggcccgtctcagcga

SEQ ID NO: 118136 - DNA, 75 bp, Artificial Sequence
  Synthetic
agaggaagattagcacctggggggctgatactgctgcctgcggcgacattctccagggacggcccgtctcagcga

SEQ ID NO: 118137 - DNA, 75 bp, Artificial Sequence
  Synthetic
agaggaagattagcacctggggggctgatactgctgcctgcggcgacattctccagggtcggcccgtctcagcga

SEQ ID NO: 118138 - DNA, 75 bp, Artificial Sequence
  Synthetic
agaggaagattagcacctggggggctgatactgctgcctgcggcgacattctccagggccggcccgtctcagcga

SEQ ID NO: 118139 - DNA, 75 bp, Artificial Sequence
  Synthetic
agaggaagattagcacctggggggctgatactgctgcctgcggcgacattctccaggggcggcccgtctcagcga

SEQ ID NO: 118140 - DNA, 75 bp, Artificial Sequence
  Synthetic
agaggaagattagcacctggggggctgatactgccgcctgcggcgacattctccagggacggcccgtctcagcga

SEQ ID NO: 118141 - DNA, 75 bp, Artificial Sequence
  Synthetic
agaggaagattagcacctggggggctgatactgccgcctgcggcgacattctccagggtcggcccgtctcagcga

SEQ ID NO: 118142 - DNA, 75 bp, Artificial Sequence
  Synthetic
agaggaagattagcacctggggggctgatactgccgcctgcggcgacattctccagggccggcccgtctcagcga

SEQ ID NO: 118143 - DNA, 75 bp, Artificial Sequence
  Synthetic
agaggaagattagcacctggggggctgatactgccgcctgcggcgacattctccaggggcggcccgtctcagcga

SEQ ID NO: 118144 - DNA, 75 bp, Artificial Sequence
  Synthetic
agaggaagattagcacctggggggctgatactgcggcctgcggcgacattctccagggacggcccgtctcagcga

SEQ ID NO: 118145 - DNA, 75 bp, Artificial Sequence
  Synthetic
agaggaagattagcacctggggggctgatactgcggcctgcggcgacattctccagggtcggcccgtctcagcga

SEQ ID NO: 118146 - DNA, 75 bp, Artificial Sequence
  Synthetic
agaggaagattagcacctggggggctgatactgcggcctgcggcgacattctccagggccggcccgtctcagcga

SEQ ID NO: 118147 - DNA, 75 bp, Artificial Sequence
  Synthetic
agaggaagattagcacctggggggctgatactgcggcctgcggcgacattctccaggggcggcccgtctcagcga

SEQ ID NO: 118148 - DNA, 75 bp, Artificial Sequence
  Synthetic
aacttcatcagtgggatacagtatttggcgggtttatccaccttacccggcaacccggctgtagctgctctcatg

SEQ ID NO: 118149 - DNA, 75 bp, Artificial Sequence
  Synthetic
ctccagggacggcccgtctcagcgaggttgggctccctcttatgtctagggccagctgatggactgcaggaccaa

SEQ ID NO: 118150 - DNA, 75 bp, Artificial Sequence
  Synthetic
ctccagggtcggcccgtctcagcgaggttgggctccctcttatgtctagggccagctgatggactgcaggaccaa

SEQ ID NO: 118151 - DNA, 75 bp, Artificial Sequence
  Synthetic
ctccagggccggcccgtctcagcgaggttgggctccctcttatgtctagggccagctgatggactgcaggaccaa

SEQ ID NO: 118152 - DNA, 75 bp, Artificial Sequence
  Synthetic
ctccaggggcggcccgtctcagcgaggttgggctccctcttatgtctagggccagctgatggactgcaggaccaa

SEQ ID NO: 118153 - DNA, 75 bp, Artificial Sequence
  Synthetic
ttgagggtgaaatacaagtgctctctacagctacccagtccttcctagccacccccgtgaacggggttctctgga

SEQ ID NO: 118154 - DNA, 75 bp, Artificial Sequence
  Synthetic
ttgagggtgaaatacaagtgctctctacagctacccagtccttcctagccacccccgtgtacggggttctctgga

SEQ ID NO: 118155 - DNA, 75 bp, Artificial Sequence
  Synthetic
ttgagggtgaaatacaagtgctctctacagctacccagtccttcctagccacccccgtgcacggggttctctgga

SEQ ID NO: 118156 - DNA, 75 bp, Artificial Sequence
  Synthetic
ttgagggtgaaatacaagtgctctctacagctacccagtccttcctagccacccccgtggacggggttctctgga

SEQ ID NO: 118157 - DNA, 75 bp, Artificial Sequence
  Synthetic
ctgccacggccttcgtggcgagcggcctagcaggcgcagccataggtggcataggcctgggtaaggtcatcgtgg

SEQ ID NO: 118158 - DNA, 75 bp, Artificial Sequence
  Synthetic
tacaagatcgggacaggagtcagcttagcccactacttcactccaccacggagtgggctattctaccgtgcactt

SEQ ID NO: 118159 - DNA, 75 bp, Artificial Sequence
  Synthetic
tgcttgcaactggacacggggcgaacgttgcgatctggaagacagggacaggtccgagctcagcccgctgctgct

SEQ ID NO: 118160 - DNA, 75 bp, Artificial Sequence
  Synthetic
catggtgaggtgggagtggatcatactcctcttccttctcttagccgatgctagagtctgcgcgtgcatgtggat

SEQ ID NO: 118161 - DNA, 75 bp, Artificial Sequence
  Synthetic
gccagctggctgtaggtccctaacgccatgcacttgcggggcgtccgacctctacctgatcactcggaatgccga

SEQ ID NO: 118162 - DNA, 75 bp, Artificial Sequence
  Synthetic
accggccctgttgagccccggcgctctcgtcgtgggcgttgtatgcgctgctatcctccggcgacatgtgggccc

SEQ ID NO: 118163 - DNA, 75 bp, Artificial Sequence
  Synthetic
aaccggttgatagctttcgcatctcggggtaaccatgtctcgcccacgcattacgttccagagaccgacgcatca

SEQ ID NO: 118164 - DNA, 75 bp, Artificial Sequence
  Synthetic
ttcttcatcattgcctggcacctcaaaggacggtttgccccagcctgcgcttactcactccttggcttatggtcc

SEQ ID NO: 118165 - DNA, 75 bp, Artificial Sequence
  Synthetic
ccgtcaggtcacatcgtcgggatcttccgcgccgccgtctgcacaaggggcgtcgcgaaggctctcgacttcgtg

SEQ ID NO: 118166 - DNA, 75 bp, Artificial Sequence
  Synthetic
aaggacggtttgccccagcctgcgcttactcactccttggcttatggtccttcctccttctagtgctggcattgc

SEQ ID NO: 118167 - DNA, 75 bp, Artificial Sequence
  Synthetic
aagcattggatcggccgtctcatgtggtggaatcagtacaccatatgtagatgcgagtccgccctgcatgtgtgg

SEQ ID NO: 118168 - DNA, 75 bp, Artificial Sequence
  Synthetic
cttggttgaaggatatttgggactgggtgtgcactgtactctctgacttcaagacatggctcaaggcaaaactct

SEQ ID NO: 118169 - DNA, 75 bp, Artificial Sequence
  Synthetic
ggtgtgcactgtactctctgacttcaagacatggctcaaggcaaaactcttcccagccctcccagggatcccctt

SEQ ID NO: 118170 - DNA, 75 bp, Artificial Sequence
  Synthetic
cccccaccggcagcggtaagagtacgaaggtccctgcagcttatgcgtcgcagggttacaaggtcctcgtactaa

SEQ ID NO: 118171 - DNA, 75 bp, Artificial Sequence
  Synthetic
aataataatgctcttcttgtggtggttgtgctacctactgaccatagcagaggcaatggtccaggagtgggcacc

SEQ ID NO: 118172 - DNA, 75 bp, Artificial Sequence
  Synthetic
ggacatagcgggccacgtaaagaacgggtctatgaagatcgttggcccgcggacctgcagtaacgtgtggcatgg

SEQ ID NO: 118173 - DNA, 75 bp, Artificial Sequence
  Synthetic
gagcgccggtgtccaggaggacgctgcgagcctgagagccttcacggaggctatgaccaggtactccgccccccc

SEQ ID NO: 118174 - DNA, 75 bp, Artificial Sequence
  Synthetic
tggggcaaatacctactccacctatggtaagttcctagcagatggcggctgcagtggaggagcctatgatatcat

SEQ ID NO: 118175 - DNA, 75 bp, Artificial Sequence
  Synthetic
tggggcaattacctactccacctatggtaagttcctagcagatggcggctgcagtggaggagcctatgatatcat

SEQ ID NO: 118176 - DNA, 75 bp, Artificial Sequence
  Synthetic
tggggcaactacctactccacctatggtaagttcctagcagatggcggctgcagtggaggagcctatgatatcat

SEQ ID NO: 118177 - DNA, 75 bp, Artificial Sequence
  Synthetic
tggggcaagtacctactccacctatggtaagttcctagcagatggcggctgcagtggaggagcctatgatatcat

SEQ ID NO: 118178 - DNA, 75 bp, Artificial Sequence
  Synthetic
cgtgagggcgcaggttctattaaggatttgcactctcgtgaggggggttgcgggggggaagtatgttcaagcatg

SEQ ID NO: 118179 - DNA, 75 bp, Artificial Sequence
  Synthetic
atttgcactctcgtgaggggggttgcgggggggaagtatgttcaagcatgcctccttactctgggtaaatggact

SEQ ID NO: 118180 - DNA, 75 bp, Artificial Sequence
  Synthetic
ctgacccgtgaccctgagactcccctcgcgcgtgccgcttgggagacagcaagacacactccagtgaactcctgg

SEQ ID NO: 118181 - DNA, 75 bp, Artificial Sequence
  Synthetic
actacgtggtgggcgttaccgctgacaacgtgaaatgcccttgtcaagtccccgctccggagttcttcactgaga

SEQ ID NO: 118182 - DNA, 75 bp, Artificial Sequence
  Synthetic
gcgaccgcaactcccccaggttcagtaactgtccctcatcccaacataactgaggttgggctgtccactactgga

SEQ ID NO: 118183 - DNA, 75 bp, Artificial Sequence
  Synthetic
gaggttctaaaggttagggacaaccactacgtggtgggcgttaccgctgacaacgtgaaatgcccttgtcaagtc

SEQ ID NO: 118184 - DNA, 75 bp, Artificial Sequence
  Synthetic
tagatggcgtgaggatacaccgctatgcaccgaggtgcaagccacttctcaaggatgaggtctcctttagcgtgg

SEQ ID NO: 118185 - DNA, 75 bp, Artificial Sequence
  Synthetic
agcaactcacctcacttggtctcaacgccgtagctttctatagaggggtcgatgtgtccgtgattccgactgcag

SEQ ID NO: 118186 - DNA, 75 bp, Artificial Sequence
  Synthetic
aatagcacggccttgaactgcaatgatagccttaacaccggctggatagcagggctcttctatcaccacaaattc

SEQ ID NO: 118187 - DNA, 75 bp, Artificial Sequence
  Synthetic
gatgtcctggtggtaacatcaatgttgacagatccagatcatatcacggcggaggcggcggggcggcgcctcgct

SEQ ID NO: 118188 - DNA, 75 bp, Artificial Sequence
  Synthetic
acctacaactggggtgaaaatgacacggacgtcttcgtccttaacaacaccaggccaccgctgggcaattggttc

SEQ ID NO: 118189 - DNA, 75 bp, Artificial Sequence
  Synthetic
ctttagtcttgaccctactttctctatagacaccacaaccgtcccgcaggacgctgtcagcagaagccagaggcg

SEQ ID NO: 118190 - DNA, 75 bp, Artificial Sequence
  Synthetic
ctttagtcttgaccctactttctctatagacaccacaaccgtcccgcaggacgctgtctgcagaagccagaggcg

SEQ ID NO: 118191 - DNA, 75 bp, Artificial Sequence
  Synthetic
ctttagtcttgaccctactttctctatagacaccacaaccgtcccgcaggacgctgtccgcagaagccagaggcg

SEQ ID NO: 118192 - DNA, 75 bp, Artificial Sequence
  Synthetic
ctttagtcttgaccctactttctctatagacaccacaaccgtcccgcaggacgctgtcggcagaagccagaggcg

SEQ ID NO: 118193 - DNA, 75 bp, Artificial Sequence
  Synthetic
ggacagtctatcatggagctgggtccaagacccttgctggacctaagggccccattttacaaatgtacaccggtg

SEQ ID NO: 118194 - DNA, 75 bp, Artificial Sequence
  Synthetic
gcccgctctccctgtgtgggcccgtccggactacaaccccccgctcttagagccatggaaggcacctgactacga

SEQ ID NO: 118195 - DNA, 75 bp, Artificial Sequence
  Synthetic
gacacagggtgcgcgtggtacgagctaagcccttcagagaccaccgtgcggctacgtgcttatctcaatacccct

SEQ ID NO: 118196 - DNA, 75 bp, Artificial Sequence
  Synthetic
tgacgtcttgcccgcgcggaggcgcggggacaggcgaggagccctcttgtcacctaggcctctatccacacttaa

SEQ ID NO: 118197 - DNA, 75 bp, Artificial Sequence
  Synthetic
gcatcacagtgccagtgtctgcagtggaagtcaggaacattagtactagctactacgccactaatgattgctcta

SEQ ID NO: 118198 - DNA, 75 bp, Artificial Sequence
  Synthetic
ctgcacttgtggctcctcggacctttacctggtcacgaggcacgccgatgtcattcccgtgcgccggcggggtga

SEQ ID NO: 118199 - DNA, 75 bp, Artificial Sequence
  Synthetic
tccctcccccgaggaggaagaagctgatacggctcgatgagtcaagcgtggcgcaagctttggcggagctggcat

SEQ ID NO: 118200 - DNA, 75 bp, Artificial Sequence
  Synthetic
gatacggctcgatgagtcaagcgtggcgcaagctttggcggagctggcatcccggacgttccaaacaactccaga

SEQ ID NO: 118201 - DNA, 75 bp, Artificial Sequence
  Synthetic
gagagaattttccatatctcgtggcttaccaagcaacagtttgcgcgagagcaaaggcgccccctccttgctggg

SEQ ID NO: 118202 - DNA, 75 bp, Artificial Sequence
  Synthetic
gagagaattttccttatctcgtggcttaccaagcaacagtttgcgcgagagcaaaggcgccccctccttgctggg

SEQ ID NO: 118203 - DNA, 75 bp, Artificial Sequence
  Synthetic
gagagaattttccctatctcgtggcttaccaagcaacagtttgcgcgagagcaaaggcgccccctccttgctggg

SEQ ID NO: 118204 - DNA, 75 bp, Artificial Sequence
  Synthetic
gagagaattttccgtatctcgtggcttaccaagcaacagtttgcgcgagagcaaaggcgccccctccttgctggg

SEQ ID NO: 118205 - DNA, 75 bp, Artificial Sequence
  Synthetic
tcttccgtgccgcggtttgttccaggggtgtggccaaggccatagacttcgtccctatcgaggccctggatgttg

SEQ ID NO: 118206 - DNA, 75 bp, Artificial Sequence
  Synthetic
tccatgcccccccttgagggtgagccaggagaccctgacttaagctcaggatcgtggtccacagtcagtgatgac

SEQ ID NO: 118207 - DNA, 75 bp, Artificial Sequence
  Synthetic
cgggggttgctccgggggagcatatgatgtgattatctgtgatgagtgtcatgcccaagacgctaccagcatatt

SEQ ID NO: 118208 - DNA, 75 bp, Artificial Sequence
  Synthetic
acatcccataaccaagtacatcatgacctgtatgtcagctgacttagaagtcatcactagcacgtggatcctggt

SEQ ID NO: 118209 - DNA, 75 bp, Artificial Sequence
  Synthetic
acatcccatatccaagtacatcatgacctgtatgtcagctgacttagaagtcatcactagcacgtggatcctggt

SEQ ID NO: 118210 - DNA, 75 bp, Artificial Sequence
  Synthetic
acatcccatacccaagtacatcatgacctgtatgtcagctgacttagaagtcatcactagcacgtggatcctggt

SEQ ID NO: 118211 - DNA, 75 bp, Artificial Sequence
  Synthetic
acatcccatagccaagtacatcatgacctgtatgtcagctgacttagaagtcatcactagcacgtggatcctggt

SEQ ID NO: 118212 - DNA, 75 bp, Artificial Sequence
  Synthetic
tcatcccataaccaagtacatcatgacctgtatgtcagctgacttagaagtcatcactagcacgtggatcctggt

SEQ ID NO: 118213 - DNA, 75 bp, Artificial Sequence
  Synthetic
tcatcccatatccaagtacatcatgacctgtatgtcagctgacttagaagtcatcactagcacgtggatcctggt

SEQ ID NO: 118214 - DNA, 75 bp, Artificial Sequence
  Synthetic
tcatcccatacccaagtacatcatgacctgtatgtcagctgacttagaagtcatcactagcacgtggatcctggt

SEQ ID NO: 118215 - DNA, 75 bp, Artificial Sequence
  Synthetic
tcatcccatagccaagtacatcatgacctgtatgtcagctgacttagaagtcatcactagcacgtggatcctggt

SEQ ID NO: 118216 - DNA, 75 bp, Artificial Sequence
  Synthetic
ccatcccataaccaagtacatcatgacctgtatgtcagctgacttagaagtcatcactagcacgtggatcctggt

SEQ ID NO: 118217 - DNA, 75 bp, Artificial Sequence
  Synthetic
ccatcccatatccaagtacatcatgacctgtatgtcagctgacttagaagtcatcactagcacgtggatcctggt

SEQ ID NO: 118218 - DNA, 75 bp, Artificial Sequence
  Synthetic
ccatcccatacccaagtacatcatgacctgtatgtcagctgacttagaagtcatcactagcacgtggatcctggt

SEQ ID NO: 118219 - DNA, 75 bp, Artificial Sequence
  Synthetic
ccatcccatagccaagtacatcatgacctgtatgtcagctgacttagaagtcatcactagcacgtggatcctggt

SEQ ID NO: 118220 - DNA, 75 bp, Artificial Sequence
  Synthetic
gcatcccataaccaagtacatcatgacctgtatgtcagctgacttagaagtcatcactagcacgtggatcctggt

SEQ ID NO: 118221 - DNA, 75 bp, Artificial Sequence
  Synthetic
gcatcccatatccaagtacatcatgacctgtatgtcagctgacttagaagtcatcactagcacgtggatcctggt

SEQ ID NO: 118222 - DNA, 75 bp, Artificial Sequence
  Synthetic
gcatcccatacccaagtacatcatgacctgtatgtcagctgacttagaagtcatcactagcacgtggatcctggt

SEQ ID NO: 118223 - DNA, 75 bp, Artificial Sequence
  Synthetic
gcatcccatagccaagtacatcatgacctgtatgtcagctgacttagaagtcatcactagcacgtggatcctggt

SEQ ID NO: 118224 - DNA, 75 bp, Artificial Sequence
  Synthetic
gcaacggtctgttgcggcaccacaacctagtgtactccaccacctcccgtagcgcgcccttgcgccagaaaaagg

SEQ ID NO: 118225 - DNA, 75 bp, Artificial Sequence
  Synthetic
gaccgggaggtattgtaccagcagttcgacgagatggaggagtgctccaggcatctctcttacctcgccgaaggc

SEQ ID NO: 118226 - DNA, 75 bp, Artificial Sequence
  Synthetic
tgaccttcgaccggatgcaggtcctggattcattttatcatgatgtagtcaaggaggtaaagaccctggcatcgg

SEQ ID NO: 118227 - DNA, 75 bp, Artificial Sequence
  Synthetic
ggcagcctatccccaaggcacgtcggagcgagggccggtcctgggctcagcccgggtacccttggcccctttacg

SEQ ID NO: 118228 - DNA, 75 bp, Artificial Sequence
  Synthetic
gaccgtaggggtcaggttggttgttctagcgactgccacaccccccggctccgttaccacgccccaccccaacat

SEQ ID NO: 118229 - DNA, 75 bp, Artificial Sequence
  Synthetic
gtgccactccacggatgccacatccatcttgggcatcggcactgtccttgaccaagcagagactgcgggggcgag

SEQ ID NO: 118230 - DNA, 75 bp, Artificial Sequence
  Synthetic
ccaagctcgagcagttctggcaaaagcacatgtggaacttcgttagcggtatacaatacctggcaggtttgtcaa

SEQ ID NO: 118231 - DNA, 75 bp, Artificial Sequence
  Synthetic
ccatgccagcaaggccgtagaccacatcagctccgtgtgggaggacttgctggaagacaactcaacacccattcc

SEQ ID NO: 118232 - DNA, 75 bp, Artificial Sequence
  Synthetic
tgggtgggttgcctcccaactggcgaccccgacagcagctacaggattcgtggtaagtggcctagctggcgccgc

SEQ ID NO: 118233 - DNA, 75 bp, Artificial Sequence
  Synthetic
cgtatacccggacctctcagtccgagtgtgcgagaagagagctctctatgacatcacgcagaagctgcccgtagc

SEQ ID NO: 118234 - DNA, 75 bp, Artificial Sequence
  Synthetic
atcgcacggccctgaactgcaatgatagccttcacaccggctgggtagcagggctcctctatcacaacaaattca

SEQ ID NO: 118235 - DNA, 75 bp, Artificial Sequence
  Synthetic
gaggcgcctgcgctcgaggacatggtcaacttgttgcctgcccttttgtcaccgggcgcactggtggtgggcgta

SEQ ID NO: 118236 - DNA, 75 bp, Artificial Sequence
  Synthetic
cagtgactgagcgcgacatccgtacagaggagtccatctaccaatgctgccagctagacccgcaggcccgcaaag

SEQ ID NO: 118237 - DNA, 75 bp, Artificial Sequence
  Synthetic
ccccaacgcactacgtgccagagacagatgcttcccgcaatgttacactcatacttagctccctcacaatcacca

SEQ ID NO: 118238 - DNA, 75 bp, Artificial Sequence
  Synthetic
aaatgagacggacgtcttcatcctcaacaacactaggccgccgctgggcaattggttcggttgcacctggatgaa

SEQ ID NO: 118239 - DNA, 75 bp, Artificial Sequence
  Synthetic
ttttgacatgctagtctgcggtgacgatctagtcgtaatttctgagagcgacggcgtccaggaggacataagtgc

SEQ ID NO: 118240 - DNA, 75 bp, Artificial Sequence
  Synthetic
tacggagccggtgtgtcgggtgctctagtcgctttcaagatcatgagcggcgagtgcccgaccacggaagacgtg

SEQ ID NO: 118241 - DNA, 75 bp, Artificial Sequence
  Synthetic
tggaggttgctggcgcccatcacggcgtacgcccagcagacgagaggcctcctagggtgtataatcaccagcctg

SEQ ID NO: 118242 - DNA, 75 bp, Artificial Sequence
  Synthetic
cgcggacttcaaggcttggcttaaggccaagcttatgcccgcactgccgggggtccccttcctctcctgccagcg

SEQ ID NO: 118243 - DNA, 75 bp, Artificial Sequence
  Synthetic
cctggaagtaaccaccagtacctgggtgttgcttgggggggtcctcgcggccgtagcagcctactgcttgtcagt

SEQ ID NO: 118244 - DNA, 75 bp, Artificial Sequence
  Synthetic
cccggtcggaggcgttgccagagctctggcacacggtgttagagtcctggaggacgggataaactacgcaacagg

SEQ ID NO: 118245 - DNA, 75 bp, Artificial Sequence
  Synthetic
gtaggcccccggatgtgcagtaacacctggcacggccgtttccccattaacgcatccaccgctggtccaagcgtc

SEQ ID NO: 118246 - DNA, 75 bp, Artificial Sequence
  Synthetic
atctgggtccgtatggtccttatgacacatttctttggaatactccagtcccaagaaacgctccatcaagcactt

SEQ ID NO: 118247 - DNA, 75 bp, Artificial Sequence
  Synthetic
cccgacaaggaggtcctctatgaggcttttgatgagatggaggagtgcgcaaacacagccacattgctagctgaa

SEQ ID NO: 118248 - DNA, 75 bp, Artificial Sequence
  Synthetic
ctactgctgacaacctgaagtgcccctgccaagtaccttctccagaattcttcaccgaggttgatggcgtacgat

SEQ ID NO: 118249 - DNA, 75 bp, Artificial Sequence
  Synthetic
agtatcaccggagcgccacaactttacccaagagtgtaactgttccgtttaccagggtgctatttccggccaccg

SEQ ID NO: 118250 - DNA, 75 bp, Artificial Sequence
  Synthetic
ggcttcatgtctcagaaaacttgggatgcccccgttgagagcttggagacatcgggcaagagcagtcagagctag

SEQ ID NO: 118251 - DNA, 75 bp, Artificial Sequence
  Synthetic
ggcctaaacttgaacagttttgggccaagcacatgtggaacttcatcagcggcctccaatacctggccggcctca

SEQ ID NO: 118252 - DNA, 75 bp, Artificial Sequence
  Synthetic
atcgggcaagagcagtcagagctaggcttatcgcccagggggggaaggccgctatatgcggcaggtacctcttta

SEQ ID NO: 118253 - DNA, 75 bp, Artificial Sequence
  Synthetic
ggcgctgccatagggggtataggcctgggcagggtcttgcttgacatcctggcaggataaggagctggtgtctca

SEQ ID NO: 118254 - DNA, 75 bp, Artificial Sequence
  Synthetic
ggcgctgccatagggggtataggcctgggcagggtcttgcttgacatcctggcaggatatggagctggtgtctca

SEQ ID NO: 118255 - DNA, 75 bp, Artificial Sequence
  Synthetic
ggcgctgccatagggggtataggcctgggcagggtcttgcttgacatcctggcaggatacggagctggtgtctca

SEQ ID NO: 118256 - DNA, 75 bp, Artificial Sequence
  Synthetic
ggcgctgccatagggggtataggcctgggcagggtcttgcttgacatcctggcaggatagggagctggtgtctca

SEQ ID NO: 118257 - DNA, 75 bp, Artificial Sequence
  Synthetic
tccagaacctgacgtggtggctctaacatcaatgttgactgaccccactcacatcacgtcggaggcagcggctag

SEQ ID NO: 118258 - DNA, 75 bp, Artificial Sequence
  Synthetic
gggaggctggttggcctcccagatcgcgcctccaacagcggctactggcttcgttgtcagcggcctcgtaggggc

SEQ ID NO: 118259 - DNA, 75 bp, Artificial Sequence
  Synthetic
ttttcacagcgtgtcctatgcccgaccccgcgtattactcctgtgcctactcctacttaccgtaggagtaggcat

SEQ ID NO: 118260 - DNA, 75 bp, Artificial Sequence
  Synthetic
ccagacgctgagctcatagaggccaacttgctatggcggcaagagatgggaggtgacattactcgagttgagtct

SEQ ID NO: 118261 - DNA, 75 bp, Artificial Sequence
  Synthetic
caaaatatccaccagccctccctatttgggcacggccggattacaatcctcccttattggagaattggaagtctc

SEQ ID NO: 118262 - DNA, 75 bp, Artificial Sequence
  Synthetic
gcctttgcgtccagaggaaaccacgtctccccgtcccactacgtagcggagtcggaagcctcaaagcaagtcacc

SEQ ID NO: 118263 - DNA, 75 bp, Artificial Sequence
  Synthetic
gtccaccgtgtcacaggcgctggccgaactcgctgagttatccttccccaagggtttggctatgactgacagcac

SEQ ID NO: 118264 - DNA, 75 bp, Artificial Sequence
  Synthetic
tgtcagaagggatacaagggcgtgtggcggggggacggcgtgatgtcgacacgctgtccttgcggggcatcaata

SEQ ID NO: 118265 - DNA, 75 bp, Artificial Sequence
  Synthetic
ttggaaggggagccgggggacccggatctgagcactggctcatggtccactgtgagtgaggaggagagcgacagt

SEQ ID NO: 118266 - DNA, 75 bp, Artificial Sequence
  Synthetic
ggcacgggcgttatgacaacaagatgcccctgtggggcttacatatcaggccacgtccggcttggcactatgagg

SEQ ID NO: 118267 - DNA, 75 bp, Artificial Sequence
  Synthetic
cagagtcctatagctcaatgccccctcttgagggggagcctggtgaccctgacctaagctcaggttcttggtcca

SEQ ID NO: 118268 - DNA, 75 bp, Artificial Sequence
  Synthetic
ttatcaggcatcataatctggtttactccaccaccacgcgcagcgcagtgctacgccagaagaaggtcaccttcg

SEQ ID NO: 118269 - DNA, 75 bp, Artificial Sequence
  Synthetic
gtccccaggccccctcccaactacaagaccgccatatggagggtggcagcgcaggattatgctgaggtgacgcgt

SEQ ID NO: 118270 - DNA, 75 bp, Artificial Sequence
  Synthetic
caaggtccctgccgcatatgccagtcaggggtataaggtactcgtactaaatccctctgtcgcggccacacttgg

SEQ ID NO: 118271 - DNA, 75 bp, Artificial Sequence
  Synthetic
atgcgatctcactccgcgccattcagcccgctccaaacacgggtacggcgctcaggacgttcggagccattctag

SEQ ID NO: 118272 - DNA, 75 bp, Artificial Sequence
  Synthetic
gtggagccgtccaagggcggccgcaaacccgcacgcttgattgtatacccggacctgtctgtccgggtgtgcgaa

SEQ ID NO: 118273 - DNA, 75 bp, Artificial Sequence
  Synthetic
tcactactaccccctactttgtgcgtgcgcatgtattggttcgcctttgcatgttcgtacgctctgtgatggggg

SEQ ID NO: 118274 - DNA, 75 bp, Artificial Sequence
  Synthetic
taggcgcttggcaaggggcacgaccccctcggaagccagctcctcagccagccagttgtcggctccttcactcaa

SEQ ID NO: 118275 - DNA, 75 bp, Artificial Sequence
  Synthetic
ccctcggaagccagctcctcagccagccagttgtcggctccttcactcaaagccagctgcacccactacaaaggc

SEQ ID NO: 118276 - DNA, 75 bp, Artificial Sequence
  Synthetic
ctctgttctcggcctgtggtcctttctcctcctggtcttggccctaccacagcaggcttacgccttggacgccgc

SEQ ID NO: 118277 - DNA, 75 bp, Artificial Sequence
  Synthetic
tgaagatgtggcgttcaaagaagtcgcccatgggcttctcctatgacaccagatgtttcgactccacagtgactg

SEQ ID NO: 118278 - DNA, 75 bp, Artificial Sequence
  Synthetic
ggggcgctccaccggtgcctccccctcggaggaaaagaacagttcagctggatggttccaatgtgtccgcggcgc

SEQ ID NO: 118279 - DNA, 75 bp, Artificial Sequence
  Synthetic
tgcctggtaaccccgccattgcttcattgatggcttttacagctgctgtcaccagcccactaaccactggccaaa

SEQ ID NO: 118280 - DNA, 75 bp, Artificial Sequence
  Synthetic
tggtcccatgtacaactccaagggtcaatcatgtggataccgcagatgccgggcgagtggcgtgttgaccaccag

SEQ ID NO: 118281 - DNA, 75 bp, Artificial Sequence
  Synthetic
ctgcgcccgtggtacacggatgtgctatcgctccacccaagccagttccggtgcccccccccaggaggcgccgta

SEQ ID NO: 118282 - DNA, 75 bp, Artificial Sequence
  Synthetic
ccccatcacctatactaagcctaacagctcggatcagaggccttattgctggcattacgcgcctcgaccgtgtgg

SEQ ID NO: 118283 - DNA, 75 bp, Artificial Sequence
  Synthetic
gtcatttccgagagtgctggcgtcccagaggatgaggccgccctgagagcgttcacggacgctatgatcaggtat

SEQ ID NO: 118284 - DNA, 75 bp, Artificial Sequence
  Synthetic
ccactacagattctggactctcatctgaggacggcaatcaggcagtgcccgcagggccacaccctgatgagactg

SEQ ID NO: 118285 - DNA, 75 bp, Artificial Sequence
  Synthetic
gcccggccccgctggttcatgttgtgcctactcctactctccgtaggggtaggcatctacctgctccccaaccga

SEQ ID NO: 118286 - DNA, 75 bp, Artificial Sequence
  Synthetic
gatattactacctcacacgtgacccgaccacaccccttgcgcgagccgcgtgggagacggctagacacactccag

SEQ ID NO: 118287 - DNA, 75 bp, Artificial Sequence
  Synthetic
tcgactcagtgatagactgcaacacgtgtgtcacccagacagtcgatttcagccttgaccctacctttaccattg

SEQ ID NO: 118288 - DNA, 75 bp, Artificial Sequence
  Synthetic
gctcgggaaagcactagacttcgacatgtacggagtcacatattcaatcactccacttgatcttccacaaatcat

SEQ ID NO: 118289 - DNA, 75 bp, Artificial Sequence
  Synthetic
gagcgctgctgtgagggctaaaaaggtaacattcgaccgggtccaagtgcttgactcacattatgagacagtcct

SEQ ID NO: 118290 - DNA, 75 bp, Artificial Sequence
  Synthetic
gggtatggcgctaaggatgtccgcagcttatccaggagggccgttaaccacatcaagtccgtgtgggaggacctt

SEQ ID NO: 118291 - DNA, 75 bp, Artificial Sequence
  Synthetic
ttgagagcctggcggcatcgagccagagcggtcggggctaagctcattgcccaaggcgggaaagccgctatatgc

SEQ ID NO: 118292 - DNA, 75 bp, Artificial Sequence
  Synthetic
gagcggtcggggctaagctcattgcccaaggcgggaaagccgctatatgcggtaagtacctctttaattgggcag

SEQ ID NO: 118293 - DNA, 75 bp, Artificial Sequence
  Synthetic
ccaggtcccatcgcccgaatttttcacagaattggacggggtgcgcctacataggtttgcgcccccttgcaagcc

SEQ ID NO: 118294 - DNA, 75 bp, Artificial Sequence
  Synthetic
ctgtaggggtaggcatcttcatgcttcccgctcggtaggcgtgaagcaaaacactccataccattagtccttttc

SEQ ID NO: 118295 - DNA, 75 bp, Artificial Sequence
  Synthetic
ttgagccggaagccaggaaagtgatctcctccctcacggagcggctttactgcgggggccctatgttcaacagca

SEQ ID NO: 118296 - DNA, 75 bp, Artificial Sequence
  Synthetic
atggtgcaggcatttcaggggccctcgtagcttttaagatcatgagcggcgagaagccctcggtagaagatgttg

SEQ ID NO: 118297 - DNA, 75 bp, Artificial Sequence
  Synthetic
cgtatgctttttatggcgtatggccgctgctcctgctcctactggcgttaccaccacgagcttacgccttggacc

SEQ ID NO: 118298 - DNA, 75 bp, Artificial Sequence
  Synthetic
catatgcgacgaatgccattcagtggacgctactaccatccttggcattggaacagtcctcgaccaggctgagac

SEQ ID NO: 118299 - DNA, 75 bp, Artificial Sequence
  Synthetic
ccggtgccgctaccgcctttgtaggcgctggcttagctggcgccgccatcggcagtgttggactggggaaggtcc

SEQ ID NO: 118300 - DNA, 75 bp, Artificial Sequence
  Synthetic
gcgattggccaggggatctcccccttcacaggccagctcttcagcgagccagctctccgccccgtccttgaaggc

SEQ ID NO: 118301 - DNA, 75 bp, Artificial Sequence
  Synthetic
accttttcatgggaggcgatgtgacccggatcgagtccgactctaaggtgatcgttctcgactccctcgattcca

SEQ ID NO: 118302 - DNA, 75 bp, Artificial Sequence
  Synthetic
tgccaccaaaagttttggcagctcctcaacttccggcatcacgggcgacaatacgacaacatcctctgagcccgc

SEQ ID NO: 118303 - DNA, 75 bp, Artificial Sequence
  Synthetic
atcgttctcgactccctcgattccatgactgaggtagaggatgatcgtgagccttctataccatcagagtacttg

SEQ ID NO: 118304 - DNA, 75 bp, Artificial Sequence
  Synthetic
ctacacacgcagtttcaacgcgtccgggtgcccagaacgcatggccagctgccgccccattgacaagttcgctca

SEQ ID NO: 118305 - DNA, 75 bp, Artificial Sequence
  Synthetic
cctactctccgtaggggtaggcatctttttactccccgctcggtagagcggcacacattagctacactccatagc

SEQ ID NO: 118306 - DNA, 75 bp, Artificial Sequence
  Synthetic
gagcctgacagctcggaccagaggccttactgctggcactacgcgcctcggcggtgtggcattgtgcccgcgtcg

SEQ ID NO: 118307 - DNA, 75 bp, Artificial Sequence
  Synthetic
cgactagctgtggtaacaccctcacctgctacatcaaggcccgagcagcctgtcgagccgcagggctccgggact

SEQ ID NO: 118308 - DNA, 75 bp, Artificial Sequence
  Synthetic
ttgcaatacgaggataatgtcaccaatccagaagatatgagaccatattgctggcactacccaccaaaacaatgt

SEQ ID NO: 118309 - DNA, 75 bp, Artificial Sequence
  Synthetic
ggcggaggtcccgcaacttgggtaaagtcatcgataccctgacctgcggcttcgccgacctcatggggtacatcc

SEQ ID NO: 118310 - DNA, 75 bp, Artificial Sequence
  Synthetic
tcataatatgtgatgagtgccactcaactgactcgactaccatcttgggcatcggcacagtcctggaccaagcgg

SEQ ID NO: 118311 - DNA, 75 bp, Artificial Sequence
  Synthetic
gcggcccagtgtactgtttcacccccagcccagtagtggtgggcacgaccgatagacttggagtgcctacttaca

SEQ ID NO: 118312 - DNA, 75 bp, Artificial Sequence
  Synthetic
gtcagggccatcgaagacgggatcaattatgcaacagggaatctccccggttgctccttttctatcttccttttg

SEQ ID NO: 118313 - DNA, 75 bp, Artificial Sequence
  Synthetic
atacggatttggggcgaaggaggtgcgcagcttgtccaggagggccgtcaaccacatccggtccgtgtgggagga

SEQ ID NO: 118314 - DNA, 75 bp, Artificial Sequence
  Synthetic
atacagtacctggcaggactctccaccctaccgggaaaccccgcagtggcatcgctgatggctttcagtgcatca

SEQ ID NO: 118315 - DNA, 75 bp, Artificial Sequence
  Synthetic
aggccgctgtcctccacgtccccgggtgcgtcccgtgcgagatgacggaaagtaaaccccggtgctggatacctg

SEQ ID NO: 118316 - DNA, 75 bp, Artificial Sequence
  Synthetic
ctgttttaggaagcatcctgaagctacttacatcaaatgtggttctgggccctggctcacgccgaggtgcctggt

SEQ ID NO: 118317 - DNA, 75 bp, Artificial Sequence
  Synthetic
acctgatggtgggcgctgctgcgttttgttcagctatgtatataggtgatttgtgtggtagtgtctttctagtcg

SEQ ID NO: 118318 - DNA, 75 bp, Artificial Sequence
  Synthetic
cgaacacacatcgacatggttgtgatgtccgccacactctgctccgctctctacgtgggggacctctgcggcggg

SEQ ID NO: 118319 - DNA, 75 bp, Artificial Sequence
  Synthetic
ctacgtgggggacctctgcggcggggtgatgctcgcagcccaaatgttcatcgtctcgccgcagtaccactggtt

SEQ ID NO: 118320 - DNA, 75 bp, Artificial Sequence
  Synthetic
ccaacggcagctggcacatcaacaggactgctctgaactgcaatgactccctcaacaccgggttccttgccgcgc

SEQ ID NO: 118321 - DNA, 75 bp, Artificial Sequence
  Synthetic
gcaactcctcggggctctaccatgtcaccaatgattgccctaactcgagtattgtgtacgaggcggccgacgcca

SEQ ID NO: 118322 - DNA, 75 bp, Artificial Sequence
  Synthetic
cttgtcgactggtcttctccacctccaccaaaatatcgtggacgtgcaatacatgtatggcctgtcacctgccct

SEQ ID NO: 118323 - DNA, 75 bp, Artificial Sequence
  Synthetic
cacaaaatatgtcgttcgatgggagtgggtagtactcttattcctgctcctagcggacgccagggtctgcgcctg

SEQ ID NO: 118324 - DNA, 75 bp, Artificial Sequence
  Synthetic
ggagctaaacagcacttgcagctcattaatagcaatggcagctggcatatcaacaggaccgcgctgaactgcaac

SEQ ID NO: 118325 - DNA, 75 bp, Artificial Sequence
  Synthetic
ttaccctctttacactcaccccggggtacaagacccttctcagccggtgtctgtggtggttgtgctatatcctga

SEQ ID NO: 118326 - DNA, 75 bp, Artificial Sequence
  Synthetic
gggccaaatgttctccttccaaccccgccgacattggactacccaagactgcaattgttccatctacaccggaca

SEQ ID NO: 118327 - DNA, 75 bp, Artificial Sequence
  Synthetic
gggccaaatgttctccttcctaccccgccgacattggactacccaagactgcaattgttccatctacaccggaca

SEQ ID NO: 118328 - DNA, 75 bp, Artificial Sequence
  Synthetic
gggccaaatgttctccttcccaccccgccgacattggactacccaagactgcaattgttccatctacaccggaca

SEQ ID NO: 118329 - DNA, 75 bp, Artificial Sequence
  Synthetic
gggccaaatgttctccttccgaccccgccgacattggactacccaagactgcaattgttccatctacaccggaca

SEQ ID NO: 118330 - DNA, 75 bp, Artificial Sequence
  Synthetic
ggcggccgtgatggcatcatatgggccgccaccatattctgcccgggtatagtgtttgacataaccaagtggctc

SEQ ID NO: 118331 - DNA, 75 bp, Artificial Sequence
  Synthetic
cagaacatccagctgatcaacaccaacggcagttggcacatcaatagcacggccttgaactgcaatgatagcctt

SEQ ID NO: 118332 - DNA, 75 bp, Artificial Sequence
  Synthetic
acggcagttggcacatcaatagcacggccttgaactgcaatgatagccttcacaccggctggatagcagggctct

SEQ ID NO: 118333 - DNA, 75 bp, Artificial Sequence
  Synthetic
aatgagacagatgtcttcctactgaacagcacccgaccgccgcagggctcatggttcggctgcacgtggatgaac

SEQ ID NO: 118334 - DNA, 75 bp, Artificial Sequence
  Synthetic
taggccagactacaaccctccgctgttggatcgctggaaagaaccggattatgtaccaccaactgtccatggatg

SEQ ID NO: 118335 - DNA, 75 bp, Artificial Sequence
  Synthetic
aactatgcaacagggaatttacccggttgctctttctctatctttatccttgcacttctctcgtgcctgaccgtc

SEQ ID NO: 118336 - DNA, 75 bp, Artificial Sequence
  Synthetic
atcgagggcccagccagaatatccagctcattaacaccaacgggagctggcacgtcaacaggaccgcactcaatt

SEQ ID NO: 118337 - DNA, 75 bp, Artificial Sequence
  Synthetic
atcgagggcccagccagtatatccagctcattaacaccaacgggagctggcacgtcaacaggaccgcactcaatt

SEQ ID NO: 118338 - DNA, 75 bp, Artificial Sequence
  Synthetic
atcgagggcccagccagcatatccagctcattaacaccaacgggagctggcacgtcaacaggaccgcactcaatt

SEQ ID NO: 118339 - DNA, 75 bp, Artificial Sequence
  Synthetic
atcgagggcccagccaggatatccagctcattaacaccaacgggagctggcacgtcaacaggaccgcactcaatt

SEQ ID NO: 118340 - DNA, 75 bp, Artificial Sequence
  Synthetic
atcgtgggcccagccagaatatccagctcattaacaccaacgggagctggcacgtcaacaggaccgcactcaatt

SEQ ID NO: 118341 - DNA, 75 bp, Artificial Sequence
  Synthetic
atcgtgggcccagccagtatatccagctcattaacaccaacgggagctggcacgtcaacaggaccgcactcaatt

SEQ ID NO: 118342 - DNA, 75 bp, Artificial Sequence
  Synthetic
atcgtgggcccagccagcatatccagctcattaacaccaacgggagctggcacgtcaacaggaccgcactcaatt

SEQ ID NO: 118343 - DNA, 75 bp, Artificial Sequence
  Synthetic
atcgtgggcccagccaggatatccagctcattaacaccaacgggagctggcacgtcaacaggaccgcactcaatt

SEQ ID NO: 118344 - DNA, 75 bp, Artificial Sequence
  Synthetic
atcgcgggcccagccagaatatccagctcattaacaccaacgggagctggcacgtcaacaggaccgcactcaatt

SEQ ID NO: 118345 - DNA, 75 bp, Artificial Sequence
  Synthetic
atcgcgggcccagccagtatatccagctcattaacaccaacgggagctggcacgtcaacaggaccgcactcaatt

SEQ ID NO: 118346 - DNA, 75 bp, Artificial Sequence
  Synthetic
atcgcgggcccagccagcatatccagctcattaacaccaacgggagctggcacgtcaacaggaccgcactcaatt

SEQ ID NO: 118347 - DNA, 75 bp, Artificial Sequence
  Synthetic
atcgcgggcccagccaggatatccagctcattaacaccaacgggagctggcacgtcaacaggaccgcactcaatt

SEQ ID NO: 118348 - DNA, 75 bp, Artificial Sequence
  Synthetic
atcgggggcccagccagaatatccagctcattaacaccaacgggagctggcacgtcaacaggaccgcactcaatt

SEQ ID NO: 118349 - DNA, 75 bp, Artificial Sequence
  Synthetic
atcgggggcccagccagtatatccagctcattaacaccaacgggagctggcacgtcaacaggaccgcactcaatt

SEQ ID NO: 118350 - DNA, 75 bp, Artificial Sequence
  Synthetic
atcgggggcccagccagcatatccagctcattaacaccaacgggagctggcacgtcaacaggaccgcactcaatt

SEQ ID NO: 118351 - DNA, 75 bp, Artificial Sequence
  Synthetic
atcgggggcccagccaggatatccagctcattaacaccaacgggagctggcacgtcaacaggaccgcactcaatt

SEQ ID NO: 118352 - DNA, 75 bp, Artificial Sequence
  Synthetic
ttcgagggcccagccagaatatccagctcattaacaccaacgggagctggcacgtcaacaggaccgcactcaatt

SEQ ID NO: 118353 - DNA, 75 bp, Artificial Sequence
  Synthetic
ttcgagggcccagccagtatatccagctcattaacaccaacgggagctggcacgtcaacaggaccgcactcaatt

SEQ ID NO: 118354 - DNA, 75 bp, Artificial Sequence
  Synthetic
ttcgagggcccagccagcatatccagctcattaacaccaacgggagctggcacgtcaacaggaccgcactcaatt

SEQ ID NO: 118355 - DNA, 75 bp, Artificial Sequence
  Synthetic
ttcgagggcccagccaggatatccagctcattaacaccaacgggagctggcacgtcaacaggaccgcactcaatt

SEQ ID NO: 118356 - DNA, 75 bp, Artificial Sequence
  Synthetic
ttcgtgggcccagccagaatatccagctcattaacaccaacgggagctggcacgtcaacaggaccgcactcaatt

SEQ ID NO: 118357 - DNA, 75 bp, Artificial Sequence
  Synthetic
ttcgtgggcccagccagtatatccagctcattaacaccaacgggagctggcacgtcaacaggaccgcactcaatt

SEQ ID NO: 118358 - DNA, 75 bp, Artificial Sequence
  Synthetic
ttcgtgggcccagccagcatatccagctcattaacaccaacgggagctggcacgtcaacaggaccgcactcaatt

SEQ ID NO: 118359 - DNA, 75 bp, Artificial Sequence
  Synthetic
ttcgtgggcccagccaggatatccagctcattaacaccaacgggagctggcacgtcaacaggaccgcactcaatt

SEQ ID NO: 118360 - DNA, 75 bp, Artificial Sequence
  Synthetic
ttcgcgggcccagccagaatatccagctcattaacaccaacgggagctggcacgtcaacaggaccgcactcaatt

SEQ ID NO: 118361 - DNA, 75 bp, Artificial Sequence
  Synthetic
ttcgcgggcccagccagtatatccagctcattaacaccaacgggagctggcacgtcaacaggaccgcactcaatt

SEQ ID NO: 118362 - DNA, 75 bp, Artificial Sequence
  Synthetic
ttcgcgggcccagccagcatatccagctcattaacaccaacgggagctggcacgtcaacaggaccgcactcaatt

SEQ ID NO: 118363 - DNA, 75 bp, Artificial Sequence
  Synthetic
ttcgcgggcccagccaggatatccagctcattaacaccaacgggagctggcacgtcaacaggaccgcactcaatt

SEQ ID NO: 118364 - DNA, 75 bp, Artificial Sequence
  Synthetic
ttcgggggcccagccagaatatccagctcattaacaccaacgggagctggcacgtcaacaggaccgcactcaatt

SEQ ID NO: 118365 - DNA, 75 bp, Artificial Sequence
  Synthetic
ttcgggggcccagccagtatatccagctcattaacaccaacgggagctggcacgtcaacaggaccgcactcaatt

SEQ ID NO: 118366 - DNA, 75 bp, Artificial Sequence
  Synthetic
ttcgggggcccagccagcatatccagctcattaacaccaacgggagctggcacgtcaacaggaccgcactcaatt

SEQ ID NO: 118367 - DNA, 75 bp, Artificial Sequence
  Synthetic
ttcgggggcccagccaggatatccagctcattaacaccaacgggagctggcacgtcaacaggaccgcactcaatt

SEQ ID NO: 118368 - DNA, 75 bp, Artificial Sequence
  Synthetic
ctcgagggcccagccagaatatccagctcattaacaccaacgggagctggcacgtcaacaggaccgcactcaatt

SEQ ID NO: 118369 - DNA, 75 bp, Artificial Sequence
  Synthetic
ctcgagggcccagccagtatatccagctcattaacaccaacgggagctggcacgtcaacaggaccgcactcaatt

SEQ ID NO: 118370 - DNA, 75 bp, Artificial Sequence
  Synthetic
ctcgagggcccagccagcatatccagctcattaacaccaacgggagctggcacgtcaacaggaccgcactcaatt

SEQ ID NO: 118371 - DNA, 75 bp, Artificial Sequence
  Synthetic
ctcgagggcccagccaggatatccagctcattaacaccaacgggagctggcacgtcaacaggaccgcactcaatt

SEQ ID NO: 118372 - DNA, 75 bp, Artificial Sequence
  Synthetic
ctcgtgggcccagccagaatatccagctcattaacaccaacgggagctggcacgtcaacaggaccgcactcaatt

SEQ ID NO: 118373 - DNA, 75 bp, Artificial Sequence
  Synthetic
ctcgtgggcccagccagtatatccagctcattaacaccaacgggagctggcacgtcaacaggaccgcactcaatt

SEQ ID NO: 118374 - DNA, 75 bp, Artificial Sequence
  Synthetic
ctcgtgggcccagccagcatatccagctcattaacaccaacgggagctggcacgtcaacaggaccgcactcaatt

SEQ ID NO: 118375 - DNA, 75 bp, Artificial Sequence
  Synthetic
ctcgtgggcccagccaggatatccagctcattaacaccaacgggagctggcacgtcaacaggaccgcactcaatt

SEQ ID NO: 118376 - DNA, 75 bp, Artificial Sequence
  Synthetic
ctcgcgggcccagccagaatatccagctcattaacaccaacgggagctggcacgtcaacaggaccgcactcaatt

SEQ ID NO: 118377 - DNA, 75 bp, Artificial Sequence
  Synthetic
ctcgcgggcccagccagtatatccagctcattaacaccaacgggagctggcacgtcaacaggaccgcactcaatt

SEQ ID NO: 118378 - DNA, 75 bp, Artificial Sequence
  Synthetic
ctcgcgggcccagccagcatatccagctcattaacaccaacgggagctggcacgtcaacaggaccgcactcaatt

SEQ ID NO: 118379 - DNA, 75 bp, Artificial Sequence
  Synthetic
ctcgcgggcccagccaggatatccagctcattaacaccaacgggagctggcacgtcaacaggaccgcactcaatt

SEQ ID NO: 118380 - DNA, 75 bp, Artificial Sequence
  Synthetic
ctcgggggcccagccagaatatccagctcattaacaccaacgggagctggcacgtcaacaggaccgcactcaatt

SEQ ID NO: 118381 - DNA, 75 bp, Artificial Sequence
  Synthetic
ctcgggggcccagccagtatatccagctcattaacaccaacgggagctggcacgtcaacaggaccgcactcaatt

SEQ ID NO: 118382 - DNA, 75 bp, Artificial Sequence
  Synthetic
ctcgggggcccagccagcatatccagctcattaacaccaacgggagctggcacgtcaacaggaccgcactcaatt

SEQ ID NO: 118383 - DNA, 75 bp, Artificial Sequence
  Synthetic
ctcgggggcccagccaggatatccagctcattaacaccaacgggagctggcacgtcaacaggaccgcactcaatt

SEQ ID NO: 118384 - DNA, 75 bp, Artificial Sequence
  Synthetic
gtcgagggcccagccagaatatccagctcattaacaccaacgggagctggcacgtcaacaggaccgcactcaatt

SEQ ID NO: 118385 - DNA, 75 bp, Artificial Sequence
  Synthetic
gtcgagggcccagccagtatatccagctcattaacaccaacgggagctggcacgtcaacaggaccgcactcaatt

SEQ ID NO: 118386 - DNA, 75 bp, Artificial Sequence
  Synthetic
gtcgagggcccagccagcatatccagctcattaacaccaacgggagctggcacgtcaacaggaccgcactcaatt

SEQ ID NO: 118387 - DNA, 75 bp, Artificial Sequence
  Synthetic
gtcgagggcccagccaggatatccagctcattaacaccaacgggagctggcacgtcaacaggaccgcactcaatt

SEQ ID NO: 118388 - DNA, 75 bp, Artificial Sequence
  Synthetic
gtcgtgggcccagccagaatatccagctcattaacaccaacgggagctggcacgtcaacaggaccgcactcaatt

SEQ ID NO: 118389 - DNA, 75 bp, Artificial Sequence
  Synthetic
gtcgtgggcccagccagtatatccagctcattaacaccaacgggagctggcacgtcaacaggaccgcactcaatt

SEQ ID NO: 118390 - DNA, 75 bp, Artificial Sequence
  Synthetic
gtcgtgggcccagccagcatatccagctcattaacaccaacgggagctggcacgtcaacaggaccgcactcaatt

SEQ ID NO: 118391 - DNA, 75 bp, Artificial Sequence
  Synthetic
gtcgtgggcccagccaggatatccagctcattaacaccaacgggagctggcacgtcaacaggaccgcactcaatt

SEQ ID NO: 118392 - DNA, 75 bp, Artificial Sequence
  Synthetic
gtcgcgggcccagccagaatatccagctcattaacaccaacgggagctggcacgtcaacaggaccgcactcaatt

SEQ ID NO: 118393 - DNA, 75 bp, Artificial Sequence
  Synthetic
gtcgcgggcccagccagtatatccagctcattaacaccaacgggagctggcacgtcaacaggaccgcactcaatt

SEQ ID NO: 118394 - DNA, 75 bp, Artificial Sequence
  Synthetic
gtcgcgggcccagccagcatatccagctcattaacaccaacgggagctggcacgtcaacaggaccgcactcaatt

SEQ ID NO: 118395 - DNA, 75 bp, Artificial Sequence
  Synthetic
gtcgcgggcccagccaggatatccagctcattaacaccaacgggagctggcacgtcaacaggaccgcactcaatt

SEQ ID NO: 118396 - DNA, 75 bp, Artificial Sequence
  Synthetic
gtcgggggcccagccagaatatccagctcattaacaccaacgggagctggcacgtcaacaggaccgcactcaatt

SEQ ID NO: 118397 - DNA, 75 bp, Artificial Sequence
  Synthetic
gtcgggggcccagccagtatatccagctcattaacaccaacgggagctggcacgtcaacaggaccgcactcaatt

SEQ ID NO: 118398 - DNA, 75 bp, Artificial Sequence
  Synthetic
gtcgggggcccagccagcatatccagctcattaacaccaacgggagctggcacgtcaacaggaccgcactcaatt

SEQ ID NO: 118399 - DNA, 75 bp, Artificial Sequence
  Synthetic
gtcgggggcccagccaggatatccagctcattaacaccaacgggagctggcacgtcaacaggaccgcactcaatt

SEQ ID NO: 118400 - DNA, 75 bp, Artificial Sequence
  Synthetic
gctcattaacaccaacgggagctggcacgtcaacaggaccgcactcaattgtaatgacagcatcaacaccgggtt

SEQ ID NO: 118401 - DNA, 75 bp, Artificial Sequence
  Synthetic
atgcctccggagtttatcatgtcaccaatgattgcccaaactcctccatagtctacgaggctaaggacctgatct

SEQ ID NO: 118402 - DNA, 75 bp, Artificial Sequence
  Synthetic
tacgactgtgacatgattgatgccaaccttttcatgggaggcgacgtgacccggattgagtctgactccaaggtg

SEQ ID NO: 118403 - DNA, 75 bp, Artificial Sequence
  Synthetic
atagtggtgagcatgacggggcgcgacaagacagaacaggccggggaaatccaagtcctgtccacagtcactcag

SEQ ID NO: 118404 - DNA, 75 bp, Artificial Sequence
  Synthetic
gatcgcttagggctccccacgtacacctggggggaaaatgagactgacgtcttcctgctgaactccaccaggcct

SEQ ID NO: 118405 - DNA, 75 bp, Artificial Sequence
  Synthetic
gatcgcttagggctccccacgtacacctggggggtaaatgagactgacgtcttcctgctgaactccaccaggcct

SEQ ID NO: 118406 - DNA, 75 bp, Artificial Sequence
  Synthetic
gatcgcttagggctccccacgtacacctggggggcaaatgagactgacgtcttcctgctgaactccaccaggcct

SEQ ID NO: 118407 - DNA, 75 bp, Artificial Sequence
  Synthetic
gatcgcttagggctccccacgtacacctgggggggaaatgagactgacgtcttcctgctgaactccaccaggcct

SEQ ID NO: 118408 - DNA, 75 bp, Artificial Sequence
  Synthetic
cgcgtgcggggcagtgttcttggtaggccaaatgttcacctataggcctcgccagcacactacggtgcaggactg

SEQ ID NO: 118409 - DNA, 75 bp, Artificial Sequence
  Synthetic
ggccaaatgttcacctataggcctcgccagcacactacggtgcaggactgcaactgttccatttacagtggccat

SEQ ID NO: 118410 - DNA, 75 bp, Artificial Sequence
  Synthetic
ggtcttgtttgccgccgcatactttgcgtcagcggctaactgggctaaggttgtgctggtcttgcttatgtttgc

SEQ ID NO: 118411 - DNA, 75 bp, Artificial Sequence
  Synthetic
tgtggtccggtgtattgcttcactcccagccccgtggtagtgggaacgaccgacgcgttgggcgtccctacctac

SEQ ID NO: 118412 - DNA, 75 bp, Artificial Sequence
  Synthetic
tgcttgtggatgatgttactcatatcccaagcggaggcggctttggagaacctcgtaatactcaatgcagcatcc

SEQ ID NO: 118413 - DNA, 75 bp, Artificial Sequence
  Synthetic
ccccagtgatgacaagccatattgctggcactatcccccaagaccatgtggagtggtgccagcccgagatgtctg

SEQ ID NO: 118414 - DNA, 75 bp, Artificial Sequence
  Synthetic
cgaggagtgcttctctgagggcaaagaaggtgacctttgacagggtgcaggtgctggacgcacactatgactcag

SEQ ID NO: 118415 - DNA, 75 bp, Artificial Sequence
  Synthetic
tcaacgccatgtcagctgctgggacgtatgggctcccctacgctctcctcttcttttgcgtagcttggtatgtca

SEQ ID NO: 118416 - DNA, 75 bp, Artificial Sequence
  Synthetic
gcactggacacggaggtggccgcgtcgtgtggcggcgttgttcttgtcgggttaatggcgctgactctgtcacca

SEQ ID NO: 118417 - DNA, 75 bp, Artificial Sequence
  Synthetic
ctactggcaattggtttggctgcacctggatgaactccacagggtttgtgaagacttgcggagccccgccctgca

SEQ ID NO: 118418 - DNA, 75 bp, Artificial Sequence
  Synthetic
tcccaccttcaccattgagacgacgaccgtgccccaggacgcagtgtcgcgctcgcagcggcgaggcaggactgg

SEQ ID NO: 118419 - DNA, 75 bp, Artificial Sequence
  Synthetic
ccaagtgtgggtcagggccctggctcaccccccggtgtttggtgcactacccctaccggttgtggcattacccgt

SEQ ID NO: 118420 - DNA, 75 bp, Artificial Sequence
  Synthetic
tctcgaagacagagatagggccgagctgagcccgctccttcacaccaccacacagtgggccatattgccgtgctc

SEQ ID NO: 118421 - DNA, 75 bp, Artificial Sequence
  Synthetic
atttacacctacgcccgcccttagcactggtctcatacacttacatcagaacatagtggacacccagtatcttta

SEQ ID NO: 118422 - DNA, 75 bp, Artificial Sequence
  Synthetic
ttttacacctacgcccgcccttagcactggtctcatacacttacatcagaacatagtggacacccagtatcttta

SEQ ID NO: 118423 - DNA, 75 bp, Artificial Sequence
  Synthetic
ctttacacctacgcccgcccttagcactggtctcatacacttacatcagaacatagtggacacccagtatcttta

SEQ ID NO: 118424 - DNA, 75 bp, Artificial Sequence
  Synthetic
gtttacacctacgcccgcccttagcactggtctcatacacttacatcagaacatagtggacacccagtatcttta

SEQ ID NO: 118425 - DNA, 75 bp, Artificial Sequence
  Synthetic
aactgtcatacacgcgctcactgagagactctacgtaggggggcccatgaccaacagcaaagggcaactctgcgg

SEQ ID NO: 118426 - DNA, 75 bp, Artificial Sequence
  Synthetic
agcactatatcagctggtgcttatggtggcttcagtattttctgaccagagtggaggcgcaactacacgtgtggg

SEQ ID NO: 118427 - DNA, 75 bp, Artificial Sequence
  Synthetic
ggataccagggcaggcttgcttagccctagacccctgagcactttaaagggctcgtcgggagggccgatcctgtg

SEQ ID NO: 118428 - DNA, 75 bp, Artificial Sequence
  Synthetic
atcatgctcctagtttgtcaggctgaggcagccctggagaacgtcattgtcctaaacgcggctgcggccgcgggg

SEQ ID NO: 118429 - DNA, 75 bp, Artificial Sequence
  Synthetic
ctttacaatcacccctgggtacaaaaagatggtggtgctggtcatgtggtggcttcagtattttatagcccggtt

SEQ ID NO: 118430 - DNA, 75 bp, Artificial Sequence
  Synthetic
atgcgtgccctgtgtgaagaccgagggcactccgcgctgctgggtagccttgacacctactgtggccgctcccca

SEQ ID NO: 118431 - DNA, 75 bp, Artificial Sequence
  Synthetic
gtcccgtgctcttgcggggcttcggacttattcctggtgaccaggaatgcggatgtaatacctgtaaggaggagg

SEQ ID NO: 118432 - DNA, 75 bp, Artificial Sequence
  Synthetic
ttcgtcagggcgcgcgccctgctgaggctgtgcctgttggtgaagcacctcgctggtggcaagtacgtgcaggcg

SEQ ID NO: 118433 - DNA, 75 bp, Artificial Sequence
  Synthetic
ggagtgtgcctctagagcggctctcattgaagaggggcagcggatagccgagatgctgaagtccaagatccaagg

SEQ ID NO: 118434 - DNA, 75 bp, Artificial Sequence
  Synthetic
ccacagagcccatcatattctccaccatggagacgaaggtcatcacgtggggggctgacacggccgcgtgtgggg

SEQ ID NO: 118435 - DNA, 75 bp, Artificial Sequence
  Synthetic
caaccttttcagccccgggtctcggcagaacatcatgctgatcaacaccaatgggagctggcatgtcaacaggac

SEQ ID NO: 118436 - DNA, 75 bp, Artificial Sequence
  Synthetic
tgacacagggtgcgcgtggtatgagctcacgccgtctgagaccaccgtcagattacgggcataccttaacactcc

SEQ ID NO: 118437 - DNA, 75 bp, Artificial Sequence
  Synthetic
tgcaagaggttagaagctttccaacagggctggggcaagcttggggtcgccaacatcaatggatcatctgatgat

SEQ ID NO: 118438 - DNA, 75 bp, Artificial Sequence
  Synthetic
agaacatccagttagtgaacaccaatggcagctggcacataaaccggaccgccctcaattgcaatgacagcttaa

SEQ ID NO: 118439 - DNA, 75 bp, Artificial Sequence
  Synthetic
gaaaccacgtcgcccccacccactacgtgacggagtcggatgcgtcgcagcgtgtgacccaactgcttggctccc

SEQ ID NO: 118440 - DNA, 75 bp, Artificial Sequence
  Synthetic
ttggcacgaccgaccggcttggagcccccacctacacctggggggagaatgaaactgatgtattcattctgaact

SEQ ID NO: 118441 - DNA, 75 bp, Artificial Sequence
  Synthetic
actccacaattggattactgaggactgccccatcccatgcgccggctcgtggctccgcgatgtgtgggactgggt

SEQ ID NO: 118442 - DNA, 75 bp, Artificial Sequence
  Synthetic
gtttgggtgcgtctggatgaacggcactgggttcacaaagacctgcggggcccccccttgcttggtgcaaactgc

SEQ ID NO: 118443 - DNA, 75 bp, Artificial Sequence
  Synthetic
agccaaagctcctcccccgtcttgggacgtcatgtggaagtgcttgacccgactcaaacccacgcttgtaggccc

SEQ ID NO: 118444 - DNA, 75 bp, Artificial Sequence
  Synthetic
ctcatgagttccaagtggggcacctccatgcgcccaccgggagtgggaagagcacgaaggtacccgctgcttacg

SEQ ID NO: 118445 - DNA, 75 bp, Artificial Sequence
  Synthetic
actgtttcactcccagccctgttgtcgtgggcaccactgacaggcagggcgtgcctacctatacctggggggaaa

SEQ ID NO: 118446 - DNA, 75 bp, Artificial Sequence
  Synthetic
tgctccgctatgtacgtgggggacctctgcggatctgttttccttgtctcccagctgttcaccttctcgccccgc

SEQ ID NO: 118447 - DNA, 75 bp, Artificial Sequence
  Synthetic
atcatgactagtacctgggtcctagctgggggagtcttggcagccgttgctgcgtattgcctggccactgggtgt

SEQ ID NO: 118448 - DNA, 75 bp, Artificial Sequence
  Synthetic
ccttacctggtagcgtaccaagccaccgtgtgcgctagggctcaagcccctcccccatcgtgggaccagatgtgg

SEQ ID NO: 118449 - DNA, 75 bp, Artificial Sequence
  Synthetic
cagaactggagtcaggactatcaccaccggagctgctatcacatactctacttacggcaagttcctcgctgacgg

SEQ ID NO: 118450 - DNA, 75 bp, Artificial Sequence
  Synthetic
catcaaatctgacaacatatcgcgttgctggatccctgtgacacctaccgttgccgtacgcgccccaggcgttat

SEQ ID NO: 118451 - DNA, 75 bp, Artificial Sequence
  Synthetic
cggcgtgcaactggactaggggggaaccgtgtagcttagagcatagagatcgcaccgagctttcaccgctgctgc

SEQ ID NO: 118452 - DNA, 75 bp, Artificial Sequence
  Synthetic
ctagagcggctctcattgaggaggggcagcggatagccgagatgctgaagtccaagatccaaggcttattgcagc

SEQ ID NO: 118453 - DNA, 75 bp, Artificial Sequence
  Synthetic
ccaaatacatcatgacatgcatgtcggctgacctggaggtcgtcacgagcacctgggtgctcgttggcggcgtcc

SEQ ID NO: 118454 - DNA, 75 bp, Artificial Sequence
  Synthetic
tccaccgcaacgcaatctttcctggcgacctgtgtcaacggcgtgtgttggactgtctatcatggtgccggctca

SEQ ID NO: 118455 - DNA, 75 bp, Artificial Sequence
  Synthetic
catggcggggaactgggctaaggtcttgattgtgatgctactctttgccggcgttgatggggagacccgcgtgtc

SEQ ID NO: 118456 - DNA, 75 bp, Artificial Sequence
  Synthetic
tccactgctgcattccaccactgagtgggcagtgttaccatgcacctactctgacctaccggcactatctactgg

SEQ ID NO: 118457 - DNA, 75 bp, Artificial Sequence
  Synthetic
gctgccagtacccacggtctcccctgggccatgattttcatctgtgtggcttggtatgttaagggcaggcttcca

SEQ ID NO: 118458 - DNA, 75 bp, Artificial Sequence
  Synthetic
attaataggactgccctgaattgcaacgactccctccagactgggttccttgccgcgctgttctatgtgaatagg

SEQ ID NO: 118459 - DNA, 75 bp, Artificial Sequence
  Synthetic
gtgaacgccgtggcatattatagaggtctggacgtcgccgtcatacccgcggcaggagacgtggtcgtgtgcagc

SEQ ID NO: 118460 - DNA, 75 bp, Artificial Sequence
  Synthetic
acctgcttgttgggtcccactggggtgtcctcgctggtctcgcttacttttccatgcagggcaattgggccaaag

SEQ ID NO: 118461 - DNA, 75 bp, Artificial Sequence
  Synthetic
tatggcgcgggcatttcgggggctctcgtcgccttcaagatcatgtctggtgagaagccctccatggaggacgtt

SEQ ID NO: 118462 - DNA, 75 bp, Artificial Sequence
  Synthetic
ccctaggctgtggtgccttgcttgtgataaccatcttgacattgtccccctggtacaaacactggttggcgcgca

SEQ ID NO: 118463 - DNA, 75 bp, Artificial Sequence
  Synthetic
tccaggtgcccaacagaaaatccagcttatcaacagcaacgggtcttggcacatcaaccgaacggcactcaactg

SEQ ID NO: 118464 - DNA, 75 bp, Artificial Sequence
  Synthetic
tacttgtctaaggcacatggcatcaatcccaacattaggactggagtcaggactgtgacgaccggggcgcccatc

SEQ ID NO: 118465 - DNA, 75 bp, Artificial Sequence
  Synthetic
cggatcagaggccctattgctggcactacgcaccccaaccgtgcggtatcgtacccgcgtcgcaggtgtgtggtc

SEQ ID NO: 118466 - DNA, 75 bp, Artificial Sequence
  Synthetic
gagcgaccgcgagccttcgataccatcggagtatatgcttcccagaaacaggttcccaccagccttaccggcctg

SEQ ID NO: 118467 - DNA, 75 bp, Artificial Sequence
  Synthetic
agtccaagctcctgccgcggctgccgggagtccctttcttctcatgccaacgtgggtacaagggaatctggcggg

SEQ ID NO: 118468 - DNA, 75 bp, Artificial Sequence
  Synthetic
tccaatggatgaataggctcattgcctttgcttccagaggaaaccacgtcgcccccacccactacgtgacggagt

SEQ ID NO: 118469 - DNA, 75 bp, Artificial Sequence
  Synthetic
ccttacagctctcttccatccccacttagcctttgacattactaaacacctcctggctgtgttaggttcacttta

SEQ ID NO: 118470 - DNA, 75 bp, Artificial Sequence
  Synthetic
cttatcaacagcaacgggtcttggcacatcaaccgaacggcactcaactgcaacgattcccttcacaccgggttc

SEQ ID NO: 118471 - DNA, 75 bp, Artificial Sequence
  Synthetic
ccatctggaattttgggagggggtgttcacagggcttactaacatcgatgcccacatgctgtcacagaccaaaca

SEQ ID NO: 118472 - DNA, 75 bp, Artificial Sequence
  Synthetic
gtgtgggactgggtctgcaccatcctaacggactttaaaaactggctgacctccaagctattcccaaagatgccc

SEQ ID NO: 118473 - DNA, 75 bp, Artificial Sequence
  Synthetic
tgcggtcggcagcgtgggactggggaagatcctggtcgacatactagctggctacggtgccggtgtagccggcgc

SEQ ID NO: 118474 - DNA, 75 bp, Artificial Sequence
  Synthetic
tgcggtcggcagcgtgggactggggaagatcctggtcgacatacttgctggctacggtgccggtgtagccggcgc

SEQ ID NO: 118475 - DNA, 75 bp, Artificial Sequence
  Synthetic
tgcggtcggcagcgtgggactggggaagatcctggtcgacatactcgctggctacggtgccggtgtagccggcgc

SEQ ID NO: 118476 - DNA, 75 bp, Artificial Sequence
  Synthetic
tgcggtcggcagcgtgggactggggaagatcctggtcgacatactggctggctacggtgccggtgtagccggcgc

SEQ ID NO: 118477 - DNA, 75 bp, Artificial Sequence
  Synthetic
tgcggtcggcagcgtgggactggggaagatcctggtcgacattctagctggctacggtgccggtgtagccggcgc

SEQ ID NO: 118478 - DNA, 75 bp, Artificial Sequence
  Synthetic
tgcggtcggcagcgtgggactggggaagatcctggtcgacattcttgctggctacggtgccggtgtagccggcgc

SEQ ID NO: 118479 - DNA, 75 bp, Artificial Sequence
  Synthetic
tgcggtcggcagcgtgggactggggaagatcctggtcgacattctcgctggctacggtgccggtgtagccggcgc

SEQ ID NO: 118480 - DNA, 75 bp, Artificial Sequence
  Synthetic
tgcggtcggcagcgtgggactggggaagatcctggtcgacattctggctggctacggtgccggtgtagccggcgc

SEQ ID NO: 118481 - DNA, 75 bp, Artificial Sequence
  Synthetic
tgcggtcggcagcgtgggactggggaagatcctggtcgacatcctagctggctacggtgccggtgtagccggcgc

SEQ ID NO: 118482 - DNA, 75 bp, Artificial Sequence
  Synthetic
tgcggtcggcagcgtgggactggggaagatcctggtcgacatccttgctggctacggtgccggtgtagccggcgc

SEQ ID NO: 118483 - DNA, 75 bp, Artificial Sequence
  Synthetic
tgcggtcggcagcgtgggactggggaagatcctggtcgacatcctcgctggctacggtgccggtgtagccggcgc

SEQ ID NO: 118484 - DNA, 75 bp, Artificial Sequence
  Synthetic
tgcggtcggcagcgtgggactggggaagatcctggtcgacatcctggctggctacggtgccggtgtagccggcgc

SEQ ID NO: 118485 - DNA, 75 bp, Artificial Sequence
  Synthetic
tgcggtcggcagcgtgggactggggaagatcctggtcgacatgctagctggctacggtgccggtgtagccggcgc

SEQ ID NO: 118486 - DNA, 75 bp, Artificial Sequence
  Synthetic
tgcggtcggcagcgtgggactggggaagatcctggtcgacatgcttgctggctacggtgccggtgtagccggcgc

SEQ ID NO: 118487 - DNA, 75 bp, Artificial Sequence
  Synthetic
tgcggtcggcagcgtgggactggggaagatcctggtcgacatgctcgctggctacggtgccggtgtagccggcgc

SEQ ID NO: 118488 - DNA, 75 bp, Artificial Sequence
  Synthetic
tgcggtcggcagcgtgggactggggaagatcctggtcgacatgctggctggctacggtgccggtgtagccggcgc

SEQ ID NO: 118489 - DNA, 75 bp, Artificial Sequence
  Synthetic
tgcggtcggcagcgtgggtctggggaagatcctggtcgacatactagctggctacggtgccggtgtagccggcgc

SEQ ID NO: 118490 - DNA, 75 bp, Artificial Sequence
  Synthetic
tgcggtcggcagcgtgggtctggggaagatcctggtcgacatacttgctggctacggtgccggtgtagccggcgc

SEQ ID NO: 118491 - DNA, 75 bp, Artificial Sequence
  Synthetic
tgcggtcggcagcgtgggtctggggaagatcctggtcgacatactcgctggctacggtgccggtgtagccggcgc

SEQ ID NO: 118492 - DNA, 75 bp, Artificial Sequence
  Synthetic
tgcggtcggcagcgtgggtctggggaagatcctggtcgacatactggctggctacggtgccggtgtagccggcgc

SEQ ID NO: 118493 - DNA, 75 bp, Artificial Sequence
  Synthetic
tgcggtcggcagcgtgggtctggggaagatcctggtcgacattctagctggctacggtgccggtgtagccggcgc

SEQ ID NO: 118494 - DNA, 75 bp, Artificial Sequence
  Synthetic
tgcggtcggcagcgtgggtctggggaagatcctggtcgacattcttgctggctacggtgccggtgtagccggcgc

SEQ ID NO: 118495 - DNA, 75 bp, Artificial Sequence
  Synthetic
tgcggtcggcagcgtgggtctggggaagatcctggtcgacattctcgctggctacggtgccggtgtagccggcgc

SEQ ID NO: 118496 - DNA, 75 bp, Artificial Sequence
  Synthetic
tgcggtcggcagcgtgggtctggggaagatcctggtcgacattctggctggctacggtgccggtgtagccggcgc

SEQ ID NO: 118497 - DNA, 75 bp, Artificial Sequence
  Synthetic
tgcggtcggcagcgtgggtctggggaagatcctggtcgacatcctagctggctacggtgccggtgtagccggcgc

SEQ ID NO: 118498 - DNA, 75 bp, Artificial Sequence
  Synthetic
tgcggtcggcagcgtgggtctggggaagatcctggtcgacatccttgctggctacggtgccggtgtagccggcgc

SEQ ID NO: 118499 - DNA, 75 bp, Artificial Sequence
  Synthetic
tgcggtcggcagcgtgggtctggggaagatcctggtcgacatcctcgctggctacggtgccggtgtagccggcgc

SEQ ID NO: 118500 - DNA, 75 bp, Artificial Sequence
  Synthetic
tgcggtcggcagcgtgggtctggggaagatcctggtcgacatcctggctggctacggtgccggtgtagccggcgc

SEQ ID NO: 118501 - DNA, 75 bp, Artificial Sequence
  Synthetic
tgcggtcggcagcgtgggtctggggaagatcctggtcgacatgctagctggctacggtgccggtgtagccggcgc

SEQ ID NO: 118502 - DNA, 75 bp, Artificial Sequence
  Synthetic
tgcggtcggcagcgtgggtctggggaagatcctggtcgacatgcttgctggctacggtgccggtgtagccggcgc

SEQ ID NO: 118503 - DNA, 75 bp, Artificial Sequence
  Synthetic
tgcggtcggcagcgtgggtctggggaagatcctggtcgacatgctcgctggctacggtgccggtgtagccggcgc

SEQ ID NO: 118504 - DNA, 75 bp, Artificial Sequence
  Synthetic
tgcggtcggcagcgtgggtctggggaagatcctggtcgacatgctggctggctacggtgccggtgtagccggcgc

SEQ ID NO: 118505 - DNA, 75 bp, Artificial Sequence
  Synthetic
tgcggtcggcagcgtgggcctggggaagatcctggtcgacatactagctggctacggtgccggtgtagccggcgc

SEQ ID NO: 118506 - DNA, 75 bp, Artificial Sequence
  Synthetic
tgcggtcggcagcgtgggcctggggaagatcctggtcgacatacttgctggctacggtgccggtgtagccggcgc

SEQ ID NO: 118507 - DNA, 75 bp, Artificial Sequence
  Synthetic
tgcggtcggcagcgtgggcctggggaagatcctggtcgacatactcgctggctacggtgccggtgtagccggcgc

SEQ ID NO: 118508 - DNA, 75 bp, Artificial Sequence
  Synthetic
tgcggtcggcagcgtgggcctggggaagatcctggtcgacatactggctggctacggtgccggtgtagccggcgc

SEQ ID NO: 118509 - DNA, 75 bp, Artificial Sequence
  Synthetic
tgcggtcggcagcgtgggcctggggaagatcctggtcgacattctagctggctacggtgccggtgtagccggcgc

SEQ ID NO: 118510 - DNA, 75 bp, Artificial Sequence
  Synthetic
tgcggtcggcagcgtgggcctggggaagatcctggtcgacattcttgctggctacggtgccggtgtagccggcgc

SEQ ID NO: 118511 - DNA, 75 bp, Artificial Sequence
  Synthetic
tgcggtcggcagcgtgggcctggggaagatcctggtcgacattctcgctggctacggtgccggtgtagccggcgc

SEQ ID NO: 118512 - DNA, 75 bp, Artificial Sequence
  Synthetic
tgcggtcggcagcgtgggcctggggaagatcctggtcgacattctggctggctacggtgccggtgtagccggcgc

SEQ ID NO: 118513 - DNA, 75 bp, Artificial Sequence
  Synthetic
tgcggtcggcagcgtgggcctggggaagatcctggtcgacatcctagctggctacggtgccggtgtagccggcgc

SEQ ID NO: 118514 - DNA, 75 bp, Artificial Sequence
  Synthetic
tgcggtcggcagcgtgggcctggggaagatcctggtcgacatccttgctggctacggtgccggtgtagccggcgc

SEQ ID NO: 118515 - DNA, 75 bp, Artificial Sequence
  Synthetic
tgcggtcggcagcgtgggcctggggaagatcctggtcgacatcctcgctggctacggtgccggtgtagccggcgc

SEQ ID NO: 118516 - DNA, 75 bp, Artificial Sequence
  Synthetic
tgcggtcggcagcgtgggcctggggaagatcctggtcgacatcctggctggctacggtgccggtgtagccggcgc

SEQ ID NO: 118517 - DNA, 75 bp, Artificial Sequence
  Synthetic
tgcggtcggcagcgtgggcctggggaagatcctggtcgacatgctagctggctacggtgccggtgtagccggcgc

SEQ ID NO: 118518 - DNA, 75 bp, Artificial Sequence
  Synthetic
tgcggtcggcagcgtgggcctggggaagatcctggtcgacatgcttgctggctacggtgccggtgtagccggcgc

SEQ ID NO: 118519 - DNA, 75 bp, Artificial Sequence
  Synthetic
tgcggtcggcagcgtgggcctggggaagatcctggtcgacatgctcgctggctacggtgccggtgtagccggcgc

SEQ ID NO: 118520 - DNA, 75 bp, Artificial Sequence
  Synthetic
tgcggtcggcagcgtgggcctggggaagatcctggtcgacatgctggctggctacggtgccggtgtagccggcgc

SEQ ID NO: 118521 - DNA, 75 bp, Artificial Sequence
  Synthetic
tgcggtcggcagcgtggggctggggaagatcctggtcgacatactagctggctacggtgccggtgtagccggcgc

SEQ ID NO: 118522 - DNA, 75 bp, Artificial Sequence
  Synthetic
tgcggtcggcagcgtggggctggggaagatcctggtcgacatacttgctggctacggtgccggtgtagccggcgc

SEQ ID NO: 118523 - DNA, 75 bp, Artificial Sequence
  Synthetic
tgcggtcggcagcgtggggctggggaagatcctggtcgacatactcgctggctacggtgccggtgtagccggcgc

SEQ ID NO: 118524 - DNA, 75 bp, Artificial Sequence
  Synthetic
tgcggtcggcagcgtggggctggggaagatcctggtcgacatactggctggctacggtgccggtgtagccggcgc

SEQ ID NO: 118525 - DNA, 75 bp, Artificial Sequence
  Synthetic
tgcggtcggcagcgtggggctggggaagatcctggtcgacattctagctggctacggtgccggtgtagccggcgc

SEQ ID NO: 118526 - DNA, 75 bp, Artificial Sequence
  Synthetic
tgcggtcggcagcgtggggctggggaagatcctggtcgacattcttgctggctacggtgccggtgtagccggcgc

SEQ ID NO: 118527 - DNA, 75 bp, Artificial Sequence
  Synthetic
tgcggtcggcagcgtggggctggggaagatcctggtcgacattctcgctggctacggtgccggtgtagccggcgc

SEQ ID NO: 118528 - DNA, 75 bp, Artificial Sequence
  Synthetic
tgcggtcggcagcgtggggctggggaagatcctggtcgacattctggctggctacggtgccggtgtagccggcgc

SEQ ID NO: 118529 - DNA, 75 bp, Artificial Sequence
  Synthetic
tgcggtcggcagcgtggggctggggaagatcctggtcgacatcctagctggctacggtgccggtgtagccggcgc

SEQ ID NO: 118530 - DNA, 75 bp, Artificial Sequence
  Synthetic
tgcggtcggcagcgtggggctggggaagatcctggtcgacatccttgctggctacggtgccggtgtagccggcgc

SEQ ID NO: 118531 - DNA, 75 bp, Artificial Sequence
  Synthetic
tgcggtcggcagcgtggggctggggaagatcctggtcgacatcctcgctggctacggtgccggtgtagccggcgc

SEQ ID NO: 118532 - DNA, 75 bp, Artificial Sequence
  Synthetic
tgcggtcggcagcgtggggctggggaagatcctggtcgacatcctggctggctacggtgccggtgtagccggcgc

SEQ ID NO: 118533 - DNA, 75 bp, Artificial Sequence
  Synthetic
tgcggtcggcagcgtggggctggggaagatcctggtcgacatgctagctggctacggtgccggtgtagccggcgc

SEQ ID NO: 118534 - DNA, 75 bp, Artificial Sequence
  Synthetic
tgcggtcggcagcgtggggctggggaagatcctggtcgacatgcttgctggctacggtgccggtgtagccggcgc

SEQ ID NO: 118535 - DNA, 75 bp, Artificial Sequence
  Synthetic
tgcggtcggcagcgtggggctggggaagatcctggtcgacatgctcgctggctacggtgccggtgtagccggcgc

SEQ ID NO: 118536 - DNA, 75 bp, Artificial Sequence
  Synthetic
tgcggtcggcagcgtggggctggggaagatcctggtcgacatgctggctggctacggtgccggtgtagccggcgc

SEQ ID NO: 118537 - DNA, 75 bp, Artificial Sequence
  Synthetic
ctggggagagaacgagactgacgtcttccttctcaagtccccaagacccccagctgggctgtggtttggctgcac

SEQ ID NO: 118538 - DNA, 75 bp, Artificial Sequence
  Synthetic
tagcggcctactgcttgacagtgggctcggtggccatagtcggtagaatcatcctatctgggagacctgccatca

SEQ ID NO: 118539 - DNA, 75 bp, Artificial Sequence
  Synthetic
gcaatttgatgagatggaggagtgctcggcctcgctgccctacatggacgaggcacgtgctattgccgggcaatt

SEQ ID NO: 118540 - DNA, 75 bp, Artificial Sequence
  Synthetic
cgtcgtgtgctgctccatgtcatactcctggaccggggctctaataactccttgtagccccgaagaggaaaagtt

SEQ ID NO: 118541 - DNA, 75 bp, Artificial Sequence
  Synthetic
ccttgcccccatcacagcatacgcgcagcagacacgaggcttgttgggcaccatcgtgaccagcctcaccggcag

SEQ ID NO: 118542 - DNA, 75 bp, Artificial Sequence
  Synthetic
accgccatctggagggtggcagcctctgagtatgcggaagtgacgcggcatgggtcatactcttatataacagga

SEQ ID NO: 118543 - DNA, 75 bp, Artificial Sequence
  Synthetic
atgcggcatgcaattggactcgtggggagcgttgtgatctctcagaccgagaccgctcagagatacagccactgc

SEQ ID NO: 118544 - DNA, 75 bp, Artificial Sequence
  Synthetic
ggggccggcagcaagaccatctgcggcccaaagggccccgtctgccaaatgtacaccaatgttgaccaagaccta

SEQ ID NO: 118545 - DNA, 75 bp, Artificial Sequence
  Synthetic
tacactctaccactgagcttgctattctaccttgctccttcacatccatgccggccctgtctactggacttatac

SEQ ID NO: 118546 - DNA, 75 bp, Artificial Sequence
  Synthetic
agccgttttttcgggatgaggtctcgttttgcgttgggctcaattcatttgtggtcgggtctcagcttccctgcg

SEQ ID NO: 118547 - DNA, 75 bp, Artificial Sequence
  Synthetic
cacgagcatacgccatggaccgggagatggctgcatcgtgtggaggcgcggttttcgtaggtctggtactcctga

SEQ ID NO: 118548 - DNA, 75 bp, Artificial Sequence
  Synthetic
atctgaagcaagttcctcggcgagccagttatcggcaccatcgctgcgcgctacctgcaccacctacggtaagac

SEQ ID NO: 118549 - DNA, 75 bp, Artificial Sequence
  Synthetic
gccgtgcagtggatgaataggctgattgcgttcgcttcccggggcaatcatgtgtctccgacacactacgtgccc

SEQ ID NO: 118550 - DNA, 75 bp, Artificial Sequence
  Synthetic
tgcaggcttcatggcccaaggtagaacaattctgggccaaacacatgtggaacttcattagcggcatccaatacc

SEQ ID NO: 118551 - DNA, 75 bp, Artificial Sequence
  Synthetic
tgcgccgaaggggggacactcgtggggcgctcatcagccccagaccaatcgccacgctcaagggatcctctggcg

SEQ ID NO: 118552 - DNA, 75 bp, Artificial Sequence
  Synthetic
tgccgtaggcattttccgcgccgcggtatgcacacggggcgtggcaaaggcggttgacttcgtgccggtggaatc

SEQ ID NO: 118553 - DNA, 75 bp, Artificial Sequence
  Synthetic
accgctgttagagacctggaagaagccagattacgaccctcccacagtggcgggctgtgcgttgccccctatggg

SEQ ID NO: 118554 - DNA, 75 bp, Artificial Sequence
  Synthetic
accgctgtttgagacctggaagaagccagattacgaccctcccacagtggcgggctgtgcgttgccccctatggg

SEQ ID NO: 118555 - DNA, 75 bp, Artificial Sequence
  Synthetic
accgctgttcgagacctggaagaagccagattacgaccctcccacagtggcgggctgtgcgttgccccctatggg

SEQ ID NO: 118556 - DNA, 75 bp, Artificial Sequence
  Synthetic
accgctgttggagacctggaagaagccagattacgaccctcccacagtggcgggctgtgcgttgccccctatggg

SEQ ID NO: 118557 - DNA, 75 bp, Artificial Sequence
  Synthetic
gcaaccgccggtcccccctcctaggaggaaaagaacggtgttgcttgatagctccactgtctcacaggcgctggc

SEQ ID NO: 118558 - DNA, 75 bp, Artificial Sequence
  Synthetic
gctccccaagaacaggttcccaccagccttaccggcctgggcgcggcctgattacaaccctccgctcgtggaaac

SEQ ID NO: 118559 - DNA, 75 bp, Artificial Sequence
  Synthetic
atcaacgccacaacaacagggcccagcgtacccgctccggctcccaactacaagttcgccttgtggagggtaggc

SEQ ID NO: 118560 - DNA, 75 bp, Artificial Sequence
  Synthetic
cgaggaggcccgcactgccatacactcgctgactgagagactctacgtgggagggcccatgttcaacagcaaggg

SEQ ID NO: 118561 - DNA, 75 bp, Artificial Sequence
  Synthetic
gtgtcatctggtggaaccaatatgccattgcacgatgtgaggctgccctgcaggtttgggttccccccctcctcg

SEQ ID NO: 118562 - DNA, 75 bp, Artificial Sequence
  Synthetic
ccagtcctgcgggtacaggcgttgccgcgccagcggggtgctcaccactagcatggggaacaccatcacatgcta

SEQ ID NO: 118563 - DNA, 75 bp, Artificial Sequence
  Synthetic
ggtctaagcgagagcactatagcagacgccctccaacagctggccactaagacctttggccagccccccccgagt

SEQ ID NO: 118564 - DNA, 75 bp, Artificial Sequence
  Synthetic
agaccaagatcatcacctggggggcagacaccgcggcgtgtggggacatcatctcgggtctgcccgtctccgccc

SEQ ID NO: 118565 - DNA, 75 bp, Artificial Sequence
  Synthetic
gacaccccctgatgagttggctctttcggagacggattccatctcctccatgcctcccctcgaaggggagcctgg

SEQ ID NO: 118566 - DNA, 75 bp, Artificial Sequence
  Synthetic
tcatattcatggacgggagcactcattacaccgtgtgctgcggaagaggagaagttgcctatcagtccgctaagc

SEQ ID NO: 118567 - DNA, 75 bp, Artificial Sequence
  Synthetic
gtacctcctccaggctgccctgacacgcacgccctattttgtgcgtgcccatgcgcttgtccgcttgtgcattct

SEQ ID NO: 118568 - DNA, 75 bp, Artificial Sequence
  Synthetic
gccaccagggtccgtaaccacaccccatgctaacatcgaggaagtcgcattgccgcaaacgggagagataccctt

SEQ ID NO: 118569 - DNA, 75 bp, Artificial Sequence
  Synthetic
acaccaatggcagctggcatatcaacaggactgccttgaactgcaacgactccctccagactgggttccttgccg

SEQ ID NO: 118570 - DNA, 75 bp, Artificial Sequence
  Synthetic
caggactgccttgaactgcaacgactccctccagactgggttccttgccgcgctgttctacacgcacaagttcaa

SEQ ID NO: 118571 - DNA, 75 bp, Artificial Sequence
  Synthetic
gactgggcggctgaaggccttgcagatcttgctatggccacagaaccagtggtcttctcacagatggagacgaag

SEQ ID NO: 118572 - DNA, 75 bp, Artificial Sequence
  Synthetic
aaggccacctgcactacccgaggtcaccatccagatgcggacctcatagaggctaacctgctatggaggcagtgc

SEQ ID NO: 118573 - DNA, 75 bp, Artificial Sequence
  Synthetic
cagaggccttattgctggcactacgcacctcgaccgtgtggtaccatacccgcgtcgcaggtgtgcggtccggtg

SEQ ID NO: 118574 - DNA, 75 bp, Artificial Sequence
  Synthetic
tcttctgtcattccaggaaaaagtgtgacgaactagccaagcagttgtcatctcttggcctcaatgccgttgcat

SEQ ID NO: 118575 - DNA, 75 bp, Artificial Sequence
  Synthetic
cgcgtcgcaggtgtgcggtccggtgtattgcttcaccccaagccctgttgtggtggggacgaccgatcgtttcgg

SEQ ID NO: 118576 - DNA, 75 bp, Artificial Sequence
  Synthetic
actcccagtgtctgctcggctgggtaaggaggtgttgttaggacccgccgacaattacaagcacatgggatggcg

SEQ ID NO: 118577 - DNA, 75 bp, Artificial Sequence
  Synthetic
gtctaaagtctccagcgccctggctgacctggcagcaaaggtcctcagccagccggacgctgacgtcgactctgg

SEQ ID NO: 118578 - DNA, 75 bp, Artificial Sequence
  Synthetic
gtctaatgtctccagcgccctggctgacctggcagcaaaggtcctcagccagccggacgctgacgtcgactctgg

SEQ ID NO: 118579 - DNA, 75 bp, Artificial Sequence
  Synthetic
gtctaacgtctccagcgccctggctgacctggcagcaaaggtcctcagccagccggacgctgacgtcgactctgg

SEQ ID NO: 118580 - DNA, 75 bp, Artificial Sequence
  Synthetic
gtctaaggtctccagcgccctggctgacctggcagcaaaggtcctcagccagccggacgctgacgtcgactctgg

SEQ ID NO: 118581 - DNA, 75 bp, Artificial Sequence
  Synthetic
gtcttaaaggacatcaagctggcggcctccaaggtcagtgcaagactcctctctttggaggaggcgtgccaactg

SEQ ID NO: 118582 - DNA, 75 bp, Artificial Sequence
  Synthetic
ctggacaggcgcactcatcaccccgtgcgccgcggaagaacagaaactgcccatcaacgcactgagcaactcgtt

SEQ ID NO: 118583 - DNA, 75 bp, Artificial Sequence
  Synthetic
gcagagggaggttggggatataccggtatgtcacgcctggggagagaccgtcgggcatgtttgacacttcagtgc

SEQ ID NO: 118584 - DNA, 75 bp, Artificial Sequence
  Synthetic
acctcctggaagactcacaaacaccaattcctacaaccatcatggccaaaaatgaggtgttctgcgtggacccca

SEQ ID NO: 118585 - DNA, 75 bp, Artificial Sequence
  Synthetic
tgcggtccccggtcttcacggacaactcgtcccccccggccgtaccgcagacattccaagtggcccatctacacg

SEQ ID NO: 118586 - DNA, 75 bp, Artificial Sequence
  Synthetic
gcagccaacctgattcagggcctgaggaaaagcgtgatgatgactcggacgcggcttcatattcttccatgcctc

SEQ ID NO: 118587 - DNA, 75 bp, Artificial Sequence
  Synthetic
attactccttagcctactcctacttttcgtaggggtaggcctctttttactccccgctcggtagagcggcacaca

SEQ ID NO: 118588 - DNA, 75 bp, Artificial Sequence
  Synthetic
actgccctgctccttcaccaccttaccggccctgtccactggcttgatccatctccatcagaacatcgtggacgt

SEQ ID NO: 118589 - DNA, 75 bp, Artificial Sequence
  Synthetic
ttagctacactccatagctaactgttccttttttttttttttttttttttttttttttttttttttttttttttt

SEQ ID NO: 118590 - DNA, 75 bp, Artificial Sequence
  Synthetic
gcgccaccacaatcttgtgtactccacttcctctcgaactgcggctcagaggcagaagaaggtcactttcgaccg

SEQ ID NO: 118591 - DNA, 75 bp, Artificial Sequence
  Synthetic
ccaaatacatcatggcctgcatgtcggcggatctagaagtggtgaccagcacgtgggtcctggtggggggcatca

SEQ ID NO: 118592 - DNA, 75 bp, Artificial Sequence
  Synthetic
ccgcagcatatgttgctcaagggtacagtgtcctggtattgaacccatctgtggccgcgacgttggggtttggtg

SEQ ID NO: 118593 - DNA, 75 bp, Artificial Sequence
  Synthetic
gtggccgcgacgttggggtttggtgcttacatgtctaaagcatgcggcatcgacccaaatatacgtactggcacc

SEQ ID NO: 118594 - DNA, 75 bp, Artificial Sequence
  Synthetic
tggttgagcacggcttgcaattggcagagcagttcaaacaaaaggctctgggtgtcctacaatctgccggcaaac

SEQ ID NO: 118595 - DNA, 75 bp, Artificial Sequence
  Synthetic
gcaccccgtgacgaaatatatcgccacgtgcatgcaagccgaccttgagatcatgacgagcacatgggtcctggc

SEQ ID NO: 118596 - DNA, 75 bp, Artificial Sequence
  Synthetic
ccacactacaaagtgttcctcgctaggctcatatggtggttacaatatcttatcaccagagccgaggcgcacttg

SEQ ID NO: 118597 - DNA, 75 bp, Artificial Sequence
  Synthetic
cttggagtccgtgtctgcgagaagcgggcattgtatgacatcgctcaaaaactgccgacagcccttatgggcccc

SEQ ID NO: 118598 - DNA, 75 bp, Artificial Sequence
  Synthetic
ttcgggggggccgcgatgccatcatcctcctcacgtgtgcagtccatccagagctaatctttgacatcaccaaac

SEQ ID NO: 118599 - DNA, 75 bp, Artificial Sequence
  Synthetic
attctatggtaaggccatcccgctctcagccatcaagggcgggcgtcacctcattttctgccactccaagaagaa

SEQ ID NO: 118600 - DNA, 75 bp, Artificial Sequence
  Synthetic
ttcaatatcttgggggggtgggtcgcttcccaaattgcgacccccacggcctctacggctttcgtcgtgagcggc

SEQ ID NO: 118601 - DNA, 75 bp, Artificial Sequence
  Synthetic
agagtgccgtactttgtgcgcgctcaagggcttattcgtgcatgcatgctggtgcggaaagtcgctgggggccat

SEQ ID NO: 118602 - DNA, 75 bp, Artificial Sequence
  Synthetic
aagggcttattcgtgcatgcatgctggtgcggaaagtcgctgggggccattatgtccaaatggctttcatgaaac

SEQ ID NO: 118603 - DNA, 75 bp, Artificial Sequence
  Synthetic
cctactatcgcggtttggatgtctccgtgattccaacaactggggacgtcgtggtctgttcaactgacgcgttaa

SEQ ID NO: 118604 - DNA, 75 bp, Artificial Sequence
  Synthetic
ctatgaccaccttactccactgcgggactgggcccacgagggcctacgagaccttgcggtggcagttgagcccgt

SEQ ID NO: 118605 - DNA, 75 bp, Artificial Sequence
  Synthetic
caattcctggctaggcaacataatcatgtttgcccccacactgtgggcgaggatgatactgatgacccatttctt

SEQ ID NO: 118606 - DNA, 75 bp, Artificial Sequence
  Synthetic
ctacttgcggtgggagtaggcatctttctgcttcctgctcgatagacagggagcataaataacactccatttttg

SEQ ID NO: 118607 - DNA, 75 bp, Artificial Sequence
  Synthetic
ggcgagggggctgtgcagtggatgaaccgtctcattgccttcgcatcgcgaggcaatcacgtgtcccccacgcac

SEQ ID NO: 118608 - DNA, 75 bp, Artificial Sequence
  Synthetic
gcagagaccaccactcgacttcgagcatactttaacacccctggcctcccagtatgtcaagaccatttagagttc

SEQ ID NO: 118609 - DNA, 75 bp, Artificial Sequence
  Synthetic
agcaagacacactccagttaattcctggctaggcaacataatcatgtttgctcccacattgtgggcgaggatgat

SEQ ID NO: 118610 - DNA, 75 bp, Artificial Sequence
  Synthetic
gaggttcaagtggtctctaccgcaacgcaatctttcctggcgacctgcgtcaacggcgtgtgttggactgtctac

SEQ ID NO: 118611 - DNA, 75 bp, Artificial Sequence
  Synthetic
gcggctctcggccgtcttggggcccaaatgatccccggcggaggtcccgcaatttgggtaaggtcatcgataccc

SEQ ID NO: 118612 - DNA, 75 bp, Artificial Sequence
  Synthetic
agacatggctcaaagctaagctgctacctcgcctgcccggcgtccccttcctctcttgccagaaggggtttaagg

SEQ ID NO: 118613 - DNA, 75 bp, Artificial Sequence
  Synthetic
aatgtacaccaatgtagaccaggacctcgtcggctggcaggcgccccccggggcgcgttccttgacaccatgcac

SEQ ID NO: 118614 - DNA, 75 bp, Artificial Sequence
  Synthetic
ctcgtcggctggcaggcgccccccggggcgcgttccttgacaccatgcacctgcggcagctcggacctttacttg

SEQ ID NO: 118615 - DNA, 75 bp, Artificial Sequence
  Synthetic
ttgtgagggctcacgccctactacgagtgtgcaccctggtgagacacctcgcaggagctaagtacatccagatgc

SEQ ID NO: 118616 - DNA, 75 bp, Artificial Sequence
  Synthetic
gctggatcttccggctatcattcagagactccatgggcttagcgcgttttcactccattcatactctccgagcga

SEQ ID NO: 118617 - DNA, 75 bp, Artificial Sequence
  Synthetic
cactccggcctcttaggccatttcctgttttttttttttttttttttttttttttttttcccccccccttttttt

SEQ ID NO: 118618 - DNA, 75 bp, Artificial Sequence
  Synthetic
cttgactgttcccgcctcggctgtgcattatcacaacacatcgggcgtctatcacatcaccaacgactgccctaa

SEQ ID NO: 118619 - DNA, 75 bp, Artificial Sequence
  Synthetic
atcaaggctgggggggtcttggcagctccaacatctctggtccgtctgatgacaagccttactgctggcactacg

SEQ ID NO: 118620 - DNA, 75 bp, Artificial Sequence
  Synthetic
agtacctgggtgctcgtgggtggcgtcctcgcagcactagctgcgtactgtctgtccgtgggttctgtcgtcatc

SEQ ID NO: 118621 - DNA, 75 bp, Artificial Sequence
  Synthetic
gagcttggagacatcgggcccgcgctgtacgcgctaagctcatcgcccagggaggtagggccgctatttgcggca

SEQ ID NO: 118622 - DNA, 75 bp, Artificial Sequence
  Synthetic
aacatcaagtgtccctgccaggttccttccccagaattcttcacttcagtggacggggtccaactgcatcgctac

SEQ ID NO: 118623 - DNA, 75 bp, Artificial Sequence
  Synthetic
ggacggggtccaactgcatcgctacgctccgccttgcaagcccctgctaagggacgaggtgaccttcagcgtggg

SEQ ID NO: 118624 - DNA, 75 bp, Artificial Sequence
  Synthetic
gctgcggctgggcagggtggctcctgtccccccgtggttctcgtccgcattggggccccaatgacccccggcgaa

SEQ ID NO: 118625 - DNA, 75 bp, Artificial Sequence
  Synthetic
tcatcatatgcgatgaatgccatgcagtggactccaccaccatccttggcattgggacagtcctcgaccaggccg

SEQ ID NO: 118626 - DNA, 75 bp, Artificial Sequence
  Synthetic
ggctgctctagcacatggtgttagggcaatcgaagacgggatcaactatgcaaccgggaatcttccgggttgctc

SEQ ID NO: 118627 - DNA, 75 bp, Artificial Sequence
  Synthetic
cctggccggcctttccaccttgcccggcaatccagcgatcgcttctttgatggccttcaccgcttcagtcaccag

SEQ ID NO: 118628 - DNA, 75 bp, Artificial Sequence
  Synthetic
tggccttcaccgcttcagtcaccagcccccttagtactcatcaaaccctgctgttcaacattctaggtggatggg

SEQ ID NO: 118629 - DNA, 75 bp, Artificial Sequence
  Synthetic
acagtgacaactccccatagtaacatagaggaggtggctcttggtcatgaaggcgagatccctttttacggcaag

SEQ ID NO: 118630 - DNA, 75 bp, Artificial Sequence
  Synthetic
ttatcttgccttacggtcccagcttccgctgtccaccatagcaacaagtctgggctgtactatctcacaaatgac

SEQ ID NO: 118631 - DNA, 75 bp, Artificial Sequence
  Synthetic
ttatcttgccttacggtcccagcttccgctgtccaccattgcaacaagtctgggctgtactatctcacaaatgac

SEQ ID NO: 118632 - DNA, 75 bp, Artificial Sequence
  Synthetic
ttatcttgccttacggtcccagcttccgctgtccaccatcgcaacaagtctgggctgtactatctcacaaatgac

SEQ ID NO: 118633 - DNA, 75 bp, Artificial Sequence
  Synthetic
ttatcttgccttacggtcccagcttccgctgtccaccatggcaacaagtctgggctgtactatctcacaaatgac

SEQ ID NO: 118634 - DNA, 75 bp, Artificial Sequence
  Synthetic
agacaggagatggggagcaacatcactagggttgagtcagaaaccaaggtggtggtgctggattcatttgacccg

SEQ ID NO: 118635 - DNA, 75 bp, Artificial Sequence
  Synthetic
tgggctaaagtcatcctgattctgttcgtcttcgccggggtcgacgcaagtacgcacatcactggtagtgttgct

SEQ ID NO: 118636 - DNA, 75 bp, Artificial Sequence
  Synthetic
tgggctgtactatctcacaaatgactgccccaatgccagtatcgtgtaccaggcgcatgatgtcatcttgcacct

SEQ ID NO: 118637 - DNA, 75 bp, Artificial Sequence
  Synthetic
tagaggaggtggctcttggtcatgaaggcgagatccctttttacggcaaggctattcctctagctttcatcaaag

SEQ ID NO: 118638 - DNA, 75 bp, Artificial Sequence
  Synthetic
ggtggtgctggattcatttgacccgatcgtggccgaacccgacgatggggaggtctctgtgcccgcagagtgcct

SEQ ID NO: 118639 - DNA, 75 bp, Artificial Sequence
  Synthetic
gggttccgccgccacgtggacctcatggtgggagccgcggcgttctgttcatccatgtatgtgggtgatttgtgc

SEQ ID NO: 118640 - DNA, 75 bp, Artificial Sequence
  Synthetic
gggttccgccgccacgtggacctcttggtgggagccgcggcgttctgttcatccatgtatgtgggtgatttgtgc

SEQ ID NO: 118641 - DNA, 75 bp, Artificial Sequence
  Synthetic
gggttccgccgccacgtggacctcctggtgggagccgcggcgttctgttcatccatgtatgtgggtgatttgtgc

SEQ ID NO: 118642 - DNA, 75 bp, Artificial Sequence
  Synthetic
gggttccgccgccacgtggacctcgtggtgggagccgcggcgttctgttcatccatgtatgtgggtgatttgtgc

SEQ ID NO: 118643 - DNA, 75 bp, Artificial Sequence
  Synthetic
gattaacgaggactgctccacgccatgctccggctcgtggctgagggatgtttgggactggatatgcacggtgtt

SEQ ID NO: 118644 - DNA, 75 bp, Artificial Sequence
  Synthetic
ccctcaattgcaatgacagcttggagactggattcatggtcggcttgttctacaggagtaagttcaacagctccg

SEQ ID NO: 118645 - DNA, 75 bp, Artificial Sequence
  Synthetic
gtgctcaccgagtcgagcgtttccagcgctctggcagagttggctgcgcggtccttcggtaccaccgaaccaagc

SEQ ID NO: 118646 - DNA, 75 bp, Artificial Sequence
  Synthetic
gtcacaggatggcctgggacatgatgatgaactggtcgcccacagttgggtatgtggtctctagcttgctaagag

SEQ ID NO: 118647 - DNA, 75 bp, Artificial Sequence
  Synthetic
gccttactgctggcactacgcgcctcgccagtgcggggtggtacccgcatccacagtgtgtggccccgtctactg

SEQ ID NO: 118648 - DNA, 75 bp, Artificial Sequence
  Synthetic
gcggaaagttgctgggggtcattatctccaaatggtcttcatgaggctggccgcgctgacaggtacgtacgttta

SEQ ID NO: 118649 - DNA, 75 bp, Artificial Sequence
  Synthetic
ggcgctctcctgtacttctctatggtcgcaaattgggcgaaggtggccgctgttctcattctctttgctggtgtg

SEQ ID NO: 118650 - DNA, 75 bp, Artificial Sequence
  Synthetic
ccctccccggcgccaaactattccagggcgctgtggcgggtggctgctgaggagtacgtggaggtcacgcgggtg

SEQ ID NO: 118651 - DNA, 75 bp, Artificial Sequence
  Synthetic
ccacgtacacctggggggcgaacgaaacggacgtcatcatccttaactcgaccaggcctccacaaggctcgtggt

SEQ ID NO: 118652 - DNA, 75 bp, Artificial Sequence
  Synthetic
tcaagacttggctatcagccaagctcatgccagccctccctggcataccctttttgtcatgccaaaagggattca

SEQ ID NO: 118653 - DNA, 75 bp, Artificial Sequence
  Synthetic
tgcacttggatgaatgggactgggttcactaagacatgcggtgcaccaccctgccgcattaggagggatcacaac

SEQ ID NO: 118654 - DNA, 75 bp, Artificial Sequence
  Synthetic
acaccaatggcagctggcacatcaatcggacggctctaaattgtaatgacagtcttcagaccggcttcctcgccg

SEQ ID NO: 118655 - DNA, 75 bp, Artificial Sequence
  Synthetic
ggcacatcaaccgcacggccttgaactgtaatgagagcctcgacactggctgggtagcggggctcctctattacc

SEQ ID NO: 118656 - DNA, 75 bp, Artificial Sequence
  Synthetic
cagctaatcaacaccaacggcagctggcacatcaaccgcacggccttgaactgtaatgagagcctcgacactggc

SEQ ID NO: 118657 - DNA, 75 bp, Artificial Sequence
  Synthetic
acttccatgcttaccgacccctcccacattacagcagagacggctaagcgtaggctggccagggggtctcccccc

SEQ ID NO: 118658 - DNA, 75 bp, Artificial Sequence
  Synthetic
gatgggttgaaatgtccatgccaagtgcctacagctgagttcttcacagaggtggacggtgttaggctgcacagg

SEQ ID NO: 118659 - DNA, 75 bp, Artificial Sequence
  Synthetic
gaaaataagggagacgtctttctcttggagagcatgcggccccccgcggggggatggtacggatgcacctggatg

SEQ ID NO: 118660 - DNA, 75 bp, Artificial Sequence
  Synthetic
gaaaataagggtgacgtctttctcttggagagcatgcggccccccgcggggggatggtacggatgcacctggatg

SEQ ID NO: 118661 - DNA, 75 bp, Artificial Sequence
  Synthetic
gaaaataagggcgacgtctttctcttggagagcatgcggccccccgcggggggatggtacggatgcacctggatg

SEQ ID NO: 118662 - DNA, 75 bp, Artificial Sequence
  Synthetic
gaaaataagggggacgtctttctcttggagagcatgcggccccccgcggggggatggtacggatgcacctggatg

SEQ ID NO: 118663 - DNA, 75 bp, Artificial Sequence
  Synthetic
tccttccctgctcctttacaccccttcctgccctgtccactggcctgatccatctccatcaaaacatagtagatg

SEQ ID NO: 118664 - DNA, 75 bp, Artificial Sequence
  Synthetic
ctgacgtgactgtcctgacatccatgctcagagacccctctcacattactgctgaggctgcggcgcgtcgccttg

SEQ ID NO: 118665 - DNA, 75 bp, Artificial Sequence
  Synthetic
tcagtagaggaggcctgtgcgctgaccccgccccactccgccaaatcgcggtatggatttggggcgaaggaggtg

SEQ ID NO: 118666 - DNA, 75 bp, Artificial Sequence
  Synthetic
agaccgctgcagattggaggatagagataggggtcagcagagtccactgctgcattccaccactgagtgggcggt

SEQ ID NO: 118667 - DNA, 75 bp, Artificial Sequence
  Synthetic
cagactgcttccgcaaacatccagacgccacatacgggaagtgcggatctggcccgtggctgacaccccgctgcc

SEQ ID NO: 118668 - DNA, 75 bp, Artificial Sequence
  Synthetic
cagactgcttccgcaaacatccagacgccacatacgggaagtgcggttctggcccgtggctgacaccccgctgcc

SEQ ID NO: 118669 - DNA, 75 bp, Artificial Sequence
  Synthetic
cagactgcttccgcaaacatccagacgccacatacgggaagtgcggctctggcccgtggctgacaccccgctgcc

SEQ ID NO: 118670 - DNA, 75 bp, Artificial Sequence
  Synthetic
cagactgcttccgcaaacatccagacgccacatacgggaagtgcgggtctggcccgtggctgacaccccgctgcc

SEQ ID NO: 118671 - DNA, 75 bp, Artificial Sequence
  Synthetic
tgcatgtctttggatgatgttgctagtgtcgcaggtagaagcagccatggctaacttgattaccatcaatgctac

SEQ ID NO: 118672 - DNA, 75 bp, Artificial Sequence
  Synthetic
ggagttggtagacgccaacttgctgtggaggcaagagatggggagtaatatcaccagggtggagtctgagacaaa

SEQ ID NO: 118673 - DNA, 75 bp, Artificial Sequence
  Synthetic
tgccgcctgcaattggacgcggggggagcgctgcgagcttgacgacagggataggattgagatgagtcctctcct

SEQ ID NO: 118674 - DNA, 75 bp, Artificial Sequence
  Synthetic
tgcggaatgtggcccctgctcctcctgctcctcgcgatgcccgaacgggcttacgcgtatgaccaggaagtagcg

SEQ ID NO: 118675 - DNA, 75 bp, Artificial Sequence
  Synthetic
tgcggaatgtggcccctgctcctcctgctcctcgcgttgcccgaacgggcttacgcgtatgaccaggaagtagcg

SEQ ID NO: 118676 - DNA, 75 bp, Artificial Sequence
  Synthetic
tgcggaatgtggcccctgctcctcctgctcctcgcgctgcccgaacgggcttacgcgtatgaccaggaagtagcg

SEQ ID NO: 118677 - DNA, 75 bp, Artificial Sequence
  Synthetic
tgcggaatgtggcccctgctcctcctgctcctcgcggtgcccgaacgggcttacgcgtatgaccaggaagtagcg

SEQ ID NO: 118678 - DNA, 75 bp, Artificial Sequence
  Synthetic
ccggcgctaccaatttgggccagacctgattataacccccccctgcatgagccgtggaaggacccggggtataag

SEQ ID NO: 118679 - DNA, 75 bp, Artificial Sequence
  Synthetic
cgcaagcggagtgtacaccacaagcttcgggaatacagtgacctgctatcttaaggctgtcgcagccaccagggc

SEQ ID NO: 118680 - DNA, 75 bp, Artificial Sequence
  Synthetic
agcgctgctagtgccaatgggccgctatggttcttcatcttctttatagcggcctggtacctaaagggcagggtg

SEQ ID NO: 118681 - DNA, 75 bp, Artificial Sequence
  Synthetic
ctagtcttggccgaagcccagatccagcaatgggttccccccctggaggcccggggggggcgtgacggggtcatt

SEQ ID NO: 118682 - DNA, 75 bp, Artificial Sequence
  Synthetic
cagtacctctacggagtgtcctcgaacatcgtgtcttgggctgtgaggtgggagtacctcgtcctcgcattcctg

SEQ ID NO: 118683 - DNA, 75 bp, Artificial Sequence
  Synthetic
ttcacggaggctatgacgaggtactcggctccccccggagacgccccgcagccagcatatgatctcgagctaata

SEQ ID NO: 118684 - DNA, 75 bp, Artificial Sequence
  Synthetic
ctctggaactagctcgcctcgccgacaaaaccttcggaggggctagcagttcgagcgaagcaccatctacctcgg

SEQ ID NO: 118685 - DNA, 75 bp, Artificial Sequence
  Synthetic
tcatagctagagtggaggccacgctgcatgtctatgttccatcatttgaaccacgtggcccccgggactctgtga

SEQ ID NO: 118686 - DNA, 75 bp, Artificial Sequence
  Synthetic
cagccgctagcaaacaaggctgggtatggtgtttgctgtttttgtgctgcgcctggtacatcaaggggcgcgcag

SEQ ID NO: 118687 - DNA, 75 bp, Artificial Sequence
  Synthetic
cagccgctagcaatcaaggctgggtatggtgtttgctgtttttgtgctgcgcctggtacatcaaggggcgcgcag

SEQ ID NO: 118688 - DNA, 75 bp, Artificial Sequence
  Synthetic
cagccgctagcaaccaaggctgggtatggtgtttgctgtttttgtgctgcgcctggtacatcaaggggcgcgcag

SEQ ID NO: 118689 - DNA, 75 bp, Artificial Sequence
  Synthetic
cagccgctagcaagcaaggctgggtatggtgtttgctgtttttgtgctgcgcctggtacatcaaggggcgcgcag

SEQ ID NO: 118690 - DNA, 75 bp, Artificial Sequence
  Synthetic
gggtgccgtactttgtgagggctcacgctctgctacgagtgtgcaccctggtgagacatctcgcaggagctaggt

SEQ ID NO: 118691 - DNA, 75 bp, Artificial Sequence
  Synthetic
gcctggcgacccagacctaagctcgggctcttggtccacggtgagcggaaaagaggatggcgtagtgtgctgctc

SEQ ID NO: 118692 - DNA, 75 bp, Artificial Sequence
  Synthetic
gcctggcgacccagacctaagctcgggctcttggtccacggtgagcggataagaggatggcgtagtgtgctgctc

SEQ ID NO: 118693 - DNA, 75 bp, Artificial Sequence
  Synthetic
gcctggcgacccagacctaagctcgggctcttggtccacggtgagcggacaagaggatggcgtagtgtgctgctc

SEQ ID NO: 118694 - DNA, 75 bp, Artificial Sequence
  Synthetic
gcctggcgacccagacctaagctcgggctcttggtccacggtgagcggagaagaggatggcgtagtgtgctgctc

SEQ ID NO: 118695 - DNA, 75 bp, Artificial Sequence
  Synthetic
gcgcacgccttacttcgtgagggctcatgtgctgatcaagatctgtagcctagtacgaggggtcgcacatggcaa

SEQ ID NO: 118696 - DNA, 75 bp, Artificial Sequence
  Synthetic
ccccgagcatacgctatggacaatgagcaggcggcatccctcggagctgttggcctattgattatcaccatcttc

SEQ ID NO: 118697 - DNA, 75 bp, Artificial Sequence
  Synthetic
ccgcggaggccgagacggagtgatcgtcttggtgacgctgctgcatccatcactaggcttcgaggttacaaagat

SEQ ID NO: 118698 - DNA, 75 bp, Artificial Sequence
  Synthetic
acttggcagtcgccgtagagcctgtggtgttcagcccaatggagaagaaggtcattgtgtggggggctgagacag

SEQ ID NO: 118699 - DNA, 75 bp, Artificial Sequence
  Synthetic
gtgcgtggggaccttgggggcaaatacattcaagccctaatgcttaaactcggagctcttacaggcacctacatc

SEQ ID NO: 118700 - DNA, 75 bp, Artificial Sequence
  Synthetic
gtgcgtggggtccttgggggcaaatacattcaagccctaatgcttaaactcggagctcttacaggcacctacatc

SEQ ID NO: 118701 - DNA, 75 bp, Artificial Sequence
  Synthetic
gtgcgtggggcccttgggggcaaatacattcaagccctaatgcttaaactcggagctcttacaggcacctacatc

SEQ ID NO: 118702 - DNA, 75 bp, Artificial Sequence
  Synthetic
gtgcgtgggggccttgggggcaaatacattcaagccctaatgcttaaactcggagctcttacaggcacctacatc

SEQ ID NO: 118703 - DNA, 75 bp, Artificial Sequence
  Synthetic
tgaatggcgtgatgtggactgtgtaccatggagcgggcagcaagacccttagcggccccaaaggaccagtcaacc

SEQ ID NO: 118704 - DNA, 75 bp, Artificial Sequence
  Synthetic
agcggccccaaaggaccagtcaaccaaatgtacaccaatgttgatcaagacctagtgggatggccagcacctcct

SEQ ID NO: 118705 - DNA, 75 bp, Artificial Sequence
  Synthetic
tgccccagcgggcatacgcgctggacacggaggtggccgcgtcgtgtggcggcgttgtccttgtcgggttaatgg

SEQ ID NO: 118706 - DNA, 75 bp, Artificial Sequence
  Synthetic
atcgtgttccctgacttgtccgtgcgtgtttgtgaaaaacgcgcattgtatgacgtgacacagaagctgcctact

SEQ ID NO: 118707 - DNA, 75 bp, Artificial Sequence
  Synthetic
tcatcacctggggtgcagatacagccgcatgcggggacattttgcatggcctaccagtgtcagcccggaaaggct

SEQ ID NO: 118708 - DNA, 75 bp, Artificial Sequence
  Synthetic
tcatcacctggggtgcagatacagccgcatgcggggacattttgcatggcctacctgtgtcagcccggaaaggct

SEQ ID NO: 118709 - DNA, 75 bp, Artificial Sequence
  Synthetic
tcatcacctggggtgcagatacagccgcatgcggggacattttgcatggcctacccgtgtcagcccggaaaggct

SEQ ID NO: 118710 - DNA, 75 bp, Artificial Sequence
  Synthetic
tcatcacctggggtgcagatacagccgcatgcggggacattttgcatggcctaccggtgtcagcccggaaaggct

SEQ ID NO: 118711 - DNA, 75 bp, Artificial Sequence
  Synthetic
tcatcacctggggtgcagatactgccgcatgcggggacattttgcatggcctaccagtgtcagcccggaaaggct

SEQ ID NO: 118712 - DNA, 75 bp, Artificial Sequence
  Synthetic
tcatcacctggggtgcagatactgccgcatgcggggacattttgcatggcctacctgtgtcagcccggaaaggct

SEQ ID NO: 118713 - DNA, 75 bp, Artificial Sequence
  Synthetic
tcatcacctggggtgcagatactgccgcatgcggggacattttgcatggcctacccgtgtcagcccggaaaggct

SEQ ID NO: 118714 - DNA, 75 bp, Artificial Sequence
  Synthetic
tcatcacctggggtgcagatactgccgcatgcggggacattttgcatggcctaccggtgtcagcccggaaaggct

SEQ ID NO: 118715 - DNA, 75 bp, Artificial Sequence
  Synthetic
tcatcacctggggtgcagataccgccgcatgcggggacattttgcatggcctaccagtgtcagcccggaaaggct

SEQ ID NO: 118716 - DNA, 75 bp, Artificial Sequence
  Synthetic
tcatcacctggggtgcagataccgccgcatgcggggacattttgcatggcctacctgtgtcagcccggaaaggct

SEQ ID NO: 118717 - DNA, 75 bp, Artificial Sequence
  Synthetic
tcatcacctggggtgcagataccgccgcatgcggggacattttgcatggcctacccgtgtcagcccggaaaggct

SEQ ID NO: 118718 - DNA, 75 bp, Artificial Sequence
  Synthetic
tcatcacctggggtgcagataccgccgcatgcggggacattttgcatggcctaccggtgtcagcccggaaaggct

SEQ ID NO: 118719 - DNA, 75 bp, Artificial Sequence
  Synthetic
tcatcacctggggtgcagatacggccgcatgcggggacattttgcatggcctaccagtgtcagcccggaaaggct

SEQ ID NO: 118720 - DNA, 75 bp, Artificial Sequence
  Synthetic
tcatcacctggggtgcagatacggccgcatgcggggacattttgcatggcctacctgtgtcagcccggaaaggct

SEQ ID NO: 118721 - DNA, 75 bp, Artificial Sequence
  Synthetic
tcatcacctggggtgcagatacggccgcatgcggggacattttgcatggcctacccgtgtcagcccggaaaggct

SEQ ID NO: 118722 - DNA, 75 bp, Artificial Sequence
  Synthetic
tcatcacctggggtgcagatacggccgcatgcggggacattttgcatggcctaccggtgtcagcccggaaaggct

SEQ ID NO: 118723 - DNA, 75 bp, Artificial Sequence
  Synthetic
tcatcacctggggtgctgatacagccgcatgcggggacattttgcatggcctaccagtgtcagcccggaaaggct

SEQ ID NO: 118724 - DNA, 75 bp, Artificial Sequence
  Synthetic
tcatcacctggggtgctgatacagccgcatgcggggacattttgcatggcctacctgtgtcagcccggaaaggct

SEQ ID NO: 118725 - DNA, 75 bp, Artificial Sequence
  Synthetic
tcatcacctggggtgctgatacagccgcatgcggggacattttgcatggcctacccgtgtcagcccggaaaggct

SEQ ID NO: 118726 - DNA, 75 bp, Artificial Sequence
  Synthetic
tcatcacctggggtgctgatacagccgcatgcggggacattttgcatggcctaccggtgtcagcccggaaaggct

SEQ ID NO: 118727 - DNA, 75 bp, Artificial Sequence
  Synthetic
tcatcacctggggtgctgatactgccgcatgcggggacattttgcatggcctaccagtgtcagcccggaaaggct

SEQ ID NO: 118728 - DNA, 75 bp, Artificial Sequence
  Synthetic
tcatcacctggggtgctgatactgccgcatgcggggacattttgcatggcctacctgtgtcagcccggaaaggct

SEQ ID NO: 118729 - DNA, 75 bp, Artificial Sequence
  Synthetic
tcatcacctggggtgctgatactgccgcatgcggggacattttgcatggcctacccgtgtcagcccggaaaggct

SEQ ID NO: 118730 - DNA, 75 bp, Artificial Sequence
  Synthetic
tcatcacctggggtgctgatactgccgcatgcggggacattttgcatggcctaccggtgtcagcccggaaaggct

SEQ ID NO: 118731 - DNA, 75 bp, Artificial Sequence
  Synthetic
tcatcacctggggtgctgataccgccgcatgcggggacattttgcatggcctaccagtgtcagcccggaaaggct

SEQ ID NO: 118732 - DNA, 75 bp, Artificial Sequence
  Synthetic
tcatcacctggggtgctgataccgccgcatgcggggacattttgcatggcctacctgtgtcagcccggaaaggct

SEQ ID NO: 118733 - DNA, 75 bp, Artificial Sequence
  Synthetic
tcatcacctggggtgctgataccgccgcatgcggggacattttgcatggcctacccgtgtcagcccggaaaggct

SEQ ID NO: 118734 - DNA, 75 bp, Artificial Sequence
  Synthetic
tcatcacctggggtgctgataccgccgcatgcggggacattttgcatggcctaccggtgtcagcccggaaaggct

SEQ ID NO: 118735 - DNA, 75 bp, Artificial Sequence
  Synthetic
tcatcacctggggtgctgatacggccgcatgcggggacattttgcatggcctaccagtgtcagcccggaaaggct

SEQ ID NO: 118736 - DNA, 75 bp, Artificial Sequence
  Synthetic
tcatcacctggggtgctgatacggccgcatgcggggacattttgcatggcctacctgtgtcagcccggaaaggct

SEQ ID NO: 118737 - DNA, 75 bp, Artificial Sequence
  Synthetic
tcatcacctggggtgctgatacggccgcatgcggggacattttgcatggcctacccgtgtcagcccggaaaggct

SEQ ID NO: 118738 - DNA, 75 bp, Artificial Sequence
  Synthetic
tcatcacctggggtgctgatacggccgcatgcggggacattttgcatggcctaccggtgtcagcccggaaaggct

SEQ ID NO: 118739 - DNA, 75 bp, Artificial Sequence
  Synthetic
tcatcacctggggtgccgatacagccgcatgcggggacattttgcatggcctaccagtgtcagcccggaaaggct

SEQ ID NO: 118740 - DNA, 75 bp, Artificial Sequence
  Synthetic
tcatcacctggggtgccgatacagccgcatgcggggacattttgcatggcctacctgtgtcagcccggaaaggct

SEQ ID NO: 118741 - DNA, 75 bp, Artificial Sequence
  Synthetic
tcatcacctggggtgccgatacagccgcatgcggggacattttgcatggcctacccgtgtcagcccggaaaggct

SEQ ID NO: 118742 - DNA, 75 bp, Artificial Sequence
  Synthetic
tcatcacctggggtgccgatacagccgcatgcggggacattttgcatggcctaccggtgtcagcccggaaaggct

SEQ ID NO: 118743 - DNA, 75 bp, Artificial Sequence
  Synthetic
tcatcacctggggtgccgatactgccgcatgcggggacattttgcatggcctaccagtgtcagcccggaaaggct

SEQ ID NO: 118744 - DNA, 75 bp, Artificial Sequence
  Synthetic
tcatcacctggggtgccgatactgccgcatgcggggacattttgcatggcctacctgtgtcagcccggaaaggct

SEQ ID NO: 118745 - DNA, 75 bp, Artificial Sequence
  Synthetic
tcatcacctggggtgccgatactgccgcatgcggggacattttgcatggcctacccgtgtcagcccggaaaggct

SEQ ID NO: 118746 - DNA, 75 bp, Artificial Sequence
  Synthetic
tcatcacctggggtgccgatactgccgcatgcggggacattttgcatggcctaccggtgtcagcccggaaaggct

SEQ ID NO: 118747 - DNA, 75 bp, Artificial Sequence
  Synthetic
tcatcacctggggtgccgataccgccgcatgcggggacattttgcatggcctaccagtgtcagcccggaaaggct

SEQ ID NO: 118748 - DNA, 75 bp, Artificial Sequence
  Synthetic
tcatcacctggggtgccgataccgccgcatgcggggacattttgcatggcctacctgtgtcagcccggaaaggct

SEQ ID NO: 118749 - DNA, 75 bp, Artificial Sequence
  Synthetic
tcatcacctggggtgccgataccgccgcatgcggggacattttgcatggcctacccgtgtcagcccggaaaggct

SEQ ID NO: 118750 - DNA, 75 bp, Artificial Sequence
  Synthetic
tcatcacctggggtgccgataccgccgcatgcggggacattttgcatggcctaccggtgtcagcccggaaaggct

SEQ ID NO: 118751 - DNA, 75 bp, Artificial Sequence
  Synthetic
tcatcacctggggtgccgatacggccgcatgcggggacattttgcatggcctaccagtgtcagcccggaaaggct

SEQ ID NO: 118752 - DNA, 75 bp, Artificial Sequence
  Synthetic
tcatcacctggggtgccgatacggccgcatgcggggacattttgcatggcctacctgtgtcagcccggaaaggct

SEQ ID NO: 118753 - DNA, 75 bp, Artificial Sequence
  Synthetic
tcatcacctggggtgccgatacggccgcatgcggggacattttgcatggcctacccgtgtcagcccggaaaggct

SEQ ID NO: 118754 - DNA, 75 bp, Artificial Sequence
  Synthetic
tcatcacctggggtgccgatacggccgcatgcggggacattttgcatggcctaccggtgtcagcccggaaaggct

SEQ ID NO: 118755 - DNA, 75 bp, Artificial Sequence
  Synthetic
tcatcacctggggtgcggatacagccgcatgcggggacattttgcatggcctaccagtgtcagcccggaaaggct

SEQ ID NO: 118756 - DNA, 75 bp, Artificial Sequence
  Synthetic
tcatcacctggggtgcggatacagccgcatgcggggacattttgcatggcctacctgtgtcagcccggaaaggct

SEQ ID NO: 118757 - DNA, 75 bp, Artificial Sequence
  Synthetic
tcatcacctggggtgcggatacagccgcatgcggggacattttgcatggcctacccgtgtcagcccggaaaggct

SEQ ID NO: 118758 - DNA, 75 bp, Artificial Sequence
  Synthetic
tcatcacctggggtgcggatacagccgcatgcggggacattttgcatggcctaccggtgtcagcccggaaaggct

SEQ ID NO: 118759 - DNA, 75 bp, Artificial Sequence
  Synthetic
tcatcacctggggtgcggatactgccgcatgcggggacattttgcatggcctaccagtgtcagcccggaaaggct

SEQ ID NO: 118760 - DNA, 75 bp, Artificial Sequence
  Synthetic
tcatcacctggggtgcggatactgccgcatgcggggacattttgcatggcctacctgtgtcagcccggaaaggct

SEQ ID NO: 118761 - DNA, 75 bp, Artificial Sequence
  Synthetic
tcatcacctggggtgcggatactgccgcatgcggggacattttgcatggcctacccgtgtcagcccggaaaggct

SEQ ID NO: 118762 - DNA, 75 bp, Artificial Sequence
  Synthetic
tcatcacctggggtgcggatactgccgcatgcggggacattttgcatggcctaccggtgtcagcccggaaaggct

SEQ ID NO: 118763 - DNA, 75 bp, Artificial Sequence
  Synthetic
tcatcacctggggtgcggataccgccgcatgcggggacattttgcatggcctaccagtgtcagcccggaaaggct

SEQ ID NO: 118764 - DNA, 75 bp, Artificial Sequence
  Synthetic
tcatcacctggggtgcggataccgccgcatgcggggacattttgcatggcctacctgtgtcagcccggaaaggct

SEQ ID NO: 118765 - DNA, 75 bp, Artificial Sequence
  Synthetic
tcatcacctggggtgcggataccgccgcatgcggggacattttgcatggcctacccgtgtcagcccggaaaggct

SEQ ID NO: 118766 - DNA, 75 bp, Artificial Sequence
  Synthetic
tcatcacctggggtgcggataccgccgcatgcggggacattttgcatggcctaccggtgtcagcccggaaaggct

SEQ ID NO: 118767 - DNA, 75 bp, Artificial Sequence
  Synthetic
tcatcacctggggtgcggatacggccgcatgcggggacattttgcatggcctaccagtgtcagcccggaaaggct

SEQ ID NO: 118768 - DNA, 75 bp, Artificial Sequence
  Synthetic
tcatcacctggggtgcggatacggccgcatgcggggacattttgcatggcctacctgtgtcagcccggaaaggct

SEQ ID NO: 118769 - DNA, 75 bp, Artificial Sequence
  Synthetic
tcatcacctggggtgcggatacggccgcatgcggggacattttgcatggcctacccgtgtcagcccggaaaggct

SEQ ID NO: 118770 - DNA, 75 bp, Artificial Sequence
  Synthetic
tcatcacctggggtgcggatacggccgcatgcggggacattttgcatggcctaccggtgtcagcccggaaaggct

SEQ ID NO: 118771 - DNA, 75 bp, Artificial Sequence
  Synthetic
cctgtacgtaggaggggagacaccaggggcgcccttttgagccctagaccaatatctactcttaagggctcctct

SEQ ID NO: 118772 - DNA, 75 bp, Artificial Sequence
  Synthetic
ggactaagtctttagacccctgtacttgtggagccgtggacctctacctggtcactcgaaacgctgatgtcattc

SEQ ID NO: 118773 - DNA, 75 bp, Artificial Sequence
  Synthetic
caccatagtcaccagcttaaccggccgagacaagaacgaggtagagggcgaggtgcaggtggtatccactgcaac

SEQ ID NO: 118774 - DNA, 75 bp, Artificial Sequence
  Synthetic
gtcactcgaaacgctgatgtcattccagtccgaaggaaaaatgaccggcggggagcactactctcgccaaggccc

SEQ ID NO: 118775 - DNA, 75 bp, Artificial Sequence
  Synthetic
gtcactcgaaacgctgatgtcattccagtccgaaggaaaaatgaccggcggggtgcactactctcgccaaggccc

SEQ ID NO: 118776 - DNA, 75 bp, Artificial Sequence
  Synthetic
gtcactcgaaacgctgatgtcattccagtccgaaggaaaaatgaccggcggggcgcactactctcgccaaggccc

SEQ ID NO: 118777 - DNA, 75 bp, Artificial Sequence
  Synthetic
gtcactcgaaacgctgatgtcattccagtccgaaggaaaaatgaccggcggggggcactactctcgccaaggccc

SEQ ID NO: 118778 - DNA, 75 bp, Artificial Sequence
  Synthetic
gtcactcgaaacgctgatgtcattccagtccgaaggaaatatgaccggcggggagcactactctcgccaaggccc

SEQ ID NO: 118779 - DNA, 75 bp, Artificial Sequence
  Synthetic
gtcactcgaaacgctgatgtcattccagtccgaaggaaatatgaccggcggggtgcactactctcgccaaggccc

SEQ ID NO: 118780 - DNA, 75 bp, Artificial Sequence
  Synthetic
gtcactcgaaacgctgatgtcattccagtccgaaggaaatatgaccggcggggcgcactactctcgccaaggccc

SEQ ID NO: 118781 - DNA, 75 bp, Artificial Sequence
  Synthetic
gtcactcgaaacgctgatgtcattccagtccgaaggaaatatgaccggcggggggcactactctcgccaaggccc

SEQ ID NO: 118782 - DNA, 75 bp, Artificial Sequence
  Synthetic
gtcactcgaaacgctgatgtcattccagtccgaaggaaacatgaccggcggggagcactactctcgccaaggccc

SEQ ID NO: 118783 - DNA, 75 bp, Artificial Sequence
  Synthetic
gtcactcgaaacgctgatgtcattccagtccgaaggaaacatgaccggcggggtgcactactctcgccaaggccc

SEQ ID NO: 118784 - DNA, 75 bp, Artificial Sequence
  Synthetic
gtcactcgaaacgctgatgtcattccagtccgaaggaaacatgaccggcggggcgcactactctcgccaaggccc

SEQ ID NO: 118785 - DNA, 75 bp, Artificial Sequence
  Synthetic
gtcactcgaaacgctgatgtcattccagtccgaaggaaacatgaccggcggggggcactactctcgccaaggccc

SEQ ID NO: 118786 - DNA, 75 bp, Artificial Sequence
  Synthetic
gtcactcgaaacgctgatgtcattccagtccgaaggaaagatgaccggcggggagcactactctcgccaaggccc

SEQ ID NO: 118787 - DNA, 75 bp, Artificial Sequence
  Synthetic
gtcactcgaaacgctgatgtcattccagtccgaaggaaagatgaccggcggggtgcactactctcgccaaggccc

SEQ ID NO: 118788 - DNA, 75 bp, Artificial Sequence
  Synthetic
gtcactcgaaacgctgatgtcattccagtccgaaggaaagatgaccggcggggcgcactactctcgccaaggccc

SEQ ID NO: 118789 - DNA, 75 bp, Artificial Sequence
  Synthetic
gtcactcgaaacgctgatgtcattccagtccgaaggaaagatgaccggcggggggcactactctcgccaaggccc

SEQ ID NO: 118790 - DNA, 75 bp, Artificial Sequence
  Synthetic
gtcactcgaaacgctgatgtcattcctgtccgaaggaaaaatgaccggcggggagcactactctcgccaaggccc

SEQ ID NO: 118791 - DNA, 75 bp, Artificial Sequence
  Synthetic
gtcactcgaaacgctgatgtcattcctgtccgaaggaaaaatgaccggcggggtgcactactctcgccaaggccc

SEQ ID NO: 118792 - DNA, 75 bp, Artificial Sequence
  Synthetic
gtcactcgaaacgctgatgtcattcctgtccgaaggaaaaatgaccggcggggcgcactactctcgccaaggccc

SEQ ID NO: 118793 - DNA, 75 bp, Artificial Sequence
  Synthetic
gtcactcgaaacgctgatgtcattcctgtccgaaggaaaaatgaccggcggggggcactactctcgccaaggccc

SEQ ID NO: 118794 - DNA, 75 bp, Artificial Sequence
  Synthetic
gtcactcgaaacgctgatgtcattcctgtccgaaggaaatatgaccggcggggagcactactctcgccaaggccc

SEQ ID NO: 118795 - DNA, 75 bp, Artificial Sequence
  Synthetic
gtcactcgaaacgctgatgtcattcctgtccgaaggaaatatgaccggcggggtgcactactctcgccaaggccc

SEQ ID NO: 118796 - DNA, 75 bp, Artificial Sequence
  Synthetic
gtcactcgaaacgctgatgtcattcctgtccgaaggaaatatgaccggcggggcgcactactctcgccaaggccc

SEQ ID NO: 118797 - DNA, 75 bp, Artificial Sequence
  Synthetic
gtcactcgaaacgctgatgtcattcctgtccgaaggaaatatgaccggcggggggcactactctcgccaaggccc

SEQ ID NO: 118798 - DNA, 75 bp, Artificial Sequence
  Synthetic
gtcactcgaaacgctgatgtcattcctgtccgaaggaaacatgaccggcggggagcactactctcgccaaggccc

SEQ ID NO: 118799 - DNA, 75 bp, Artificial Sequence
  Synthetic
gtcactcgaaacgctgatgtcattcctgtccgaaggaaacatgaccggcggggtgcactactctcgccaaggccc

SEQ ID NO: 118800 - DNA, 75 bp, Artificial Sequence
  Synthetic
gtcactcgaaacgctgatgtcattcctgtccgaaggaaacatgaccggcggggcgcactactctcgccaaggccc

SEQ ID NO: 118801 - DNA, 75 bp, Artificial Sequence
  Synthetic
gtcactcgaaacgctgatgtcattcctgtccgaaggaaacatgaccggcggggggcactactctcgccaaggccc

SEQ ID NO: 118802 - DNA, 75 bp, Artificial Sequence
  Synthetic
gtcactcgaaacgctgatgtcattcctgtccgaaggaaagatgaccggcggggagcactactctcgccaaggccc

SEQ ID NO: 118803 - DNA, 75 bp, Artificial Sequence
  Synthetic
gtcactcgaaacgctgatgtcattcctgtccgaaggaaagatgaccggcggggtgcactactctcgccaaggccc

SEQ ID NO: 118804 - DNA, 75 bp, Artificial Sequence
  Synthetic
gtcactcgaaacgctgatgtcattcctgtccgaaggaaagatgaccggcggggcgcactactctcgccaaggccc

SEQ ID NO: 118805 - DNA, 75 bp, Artificial Sequence
  Synthetic
gtcactcgaaacgctgatgtcattcctgtccgaaggaaagatgaccggcggggggcactactctcgccaaggccc

SEQ ID NO: 118806 - DNA, 75 bp, Artificial Sequence
  Synthetic
gtcactcgaaacgctgatgtcattcccgtccgaaggaaaaatgaccggcggggagcactactctcgccaaggccc

SEQ ID NO: 118807 - DNA, 75 bp, Artificial Sequence
  Synthetic
gtcactcgaaacgctgatgtcattcccgtccgaaggaaaaatgaccggcggggtgcactactctcgccaaggccc

SEQ ID NO: 118808 - DNA, 75 bp, Artificial Sequence
  Synthetic
gtcactcgaaacgctgatgtcattcccgtccgaaggaaaaatgaccggcggggcgcactactctcgccaaggccc

SEQ ID NO: 118809 - DNA, 75 bp, Artificial Sequence
  Synthetic
gtcactcgaaacgctgatgtcattcccgtccgaaggaaaaatgaccggcggggggcactactctcgccaaggccc

SEQ ID NO: 118810 - DNA, 75 bp, Artificial Sequence
  Synthetic
gtcactcgaaacgctgatgtcattcccgtccgaaggaaatatgaccggcggggagcactactctcgccaaggccc

SEQ ID NO: 118811 - DNA, 75 bp, Artificial Sequence
  Synthetic
gtcactcgaaacgctgatgtcattcccgtccgaaggaaatatgaccggcggggtgcactactctcgccaaggccc

SEQ ID NO: 118812 - DNA, 75 bp, Artificial Sequence
  Synthetic
gtcactcgaaacgctgatgtcattcccgtccgaaggaaatatgaccggcggggcgcactactctcgccaaggccc

SEQ ID NO: 118813 - DNA, 75 bp, Artificial Sequence
  Synthetic
gtcactcgaaacgctgatgtcattcccgtccgaaggaaatatgaccggcggggggcactactctcgccaaggccc

SEQ ID NO: 118814 - DNA, 75 bp, Artificial Sequence
  Synthetic
gtcactcgaaacgctgatgtcattcccgtccgaaggaaacatgaccggcggggagcactactctcgccaaggccc

SEQ ID NO: 118815 - DNA, 75 bp, Artificial Sequence
  Synthetic
gtcactcgaaacgctgatgtcattcccgtccgaaggaaacatgaccggcggggtgcactactctcgccaaggccc

SEQ ID NO: 118816 - DNA, 75 bp, Artificial Sequence
  Synthetic
gtcactcgaaacgctgatgtcattcccgtccgaaggaaacatgaccggcggggcgcactactctcgccaaggccc

SEQ ID NO: 118817 - DNA, 75 bp, Artificial Sequence
  Synthetic
gtcactcgaaacgctgatgtcattcccgtccgaaggaaacatgaccggcggggggcactactctcgccaaggccc

SEQ ID NO: 118818 - DNA, 75 bp, Artificial Sequence
  Synthetic
gtcactcgaaacgctgatgtcattcccgtccgaaggaaagatgaccggcggggagcactactctcgccaaggccc

SEQ ID NO: 118819 - DNA, 75 bp, Artificial Sequence
  Synthetic
gtcactcgaaacgctgatgtcattcccgtccgaaggaaagatgaccggcggggtgcactactctcgccaaggccc

SEQ ID NO: 118820 - DNA, 75 bp, Artificial Sequence
  Synthetic
gtcactcgaaacgctgatgtcattcccgtccgaaggaaagatgaccggcggggcgcactactctcgccaaggccc

SEQ ID NO: 118821 - DNA, 75 bp, Artificial Sequence
  Synthetic
gtcactcgaaacgctgatgtcattcccgtccgaaggaaagatgaccggcggggggcactactctcgccaaggccc

SEQ ID NO: 118822 - DNA, 75 bp, Artificial Sequence
  Synthetic
gtcactcgaaacgctgatgtcattccggtccgaaggaaaaatgaccggcggggagcactactctcgccaaggccc

SEQ ID NO: 118823 - DNA, 75 bp, Artificial Sequence
  Synthetic
gtcactcgaaacgctgatgtcattccggtccgaaggaaaaatgaccggcggggtgcactactctcgccaaggccc

SEQ ID NO: 118824 - DNA, 75 bp, Artificial Sequence
  Synthetic
gtcactcgaaacgctgatgtcattccggtccgaaggaaaaatgaccggcggggcgcactactctcgccaaggccc

SEQ ID NO: 118825 - DNA, 75 bp, Artificial Sequence
  Synthetic
gtcactcgaaacgctgatgtcattccggtccgaaggaaaaatgaccggcggggggcactactctcgccaaggccc

SEQ ID NO: 118826 - DNA, 75 bp, Artificial Sequence
  Synthetic
gtcactcgaaacgctgatgtcattccggtccgaaggaaatatgaccggcggggagcactactctcgccaaggccc

SEQ ID NO: 118827 - DNA, 75 bp, Artificial Sequence
  Synthetic
gtcactcgaaacgctgatgtcattccggtccgaaggaaatatgaccggcggggtgcactactctcgccaaggccc

SEQ ID NO: 118828 - DNA, 75 bp, Artificial Sequence
  Synthetic
gtcactcgaaacgctgatgtcattccggtccgaaggaaatatgaccggcggggcgcactactctcgccaaggccc

SEQ ID NO: 118829 - DNA, 75 bp, Artificial Sequence
  Synthetic
gtcactcgaaacgctgatgtcattccggtccgaaggaaatatgaccggcggggggcactactctcgccaaggccc

SEQ ID NO: 118830 - DNA, 75 bp, Artificial Sequence
  Synthetic
gtcactcgaaacgctgatgtcattccggtccgaaggaaacatgaccggcggggagcactactctcgccaaggccc

SEQ ID NO: 118831 - DNA, 75 bp, Artificial Sequence
  Synthetic
gtcactcgaaacgctgatgtcattccggtccgaaggaaacatgaccggcggggtgcactactctcgccaaggccc

SEQ ID NO: 118832 - DNA, 75 bp, Artificial Sequence
  Synthetic
gtcactcgaaacgctgatgtcattccggtccgaaggaaacatgaccggcggggcgcactactctcgccaaggccc

SEQ ID NO: 118833 - DNA, 75 bp, Artificial Sequence
  Synthetic
gtcactcgaaacgctgatgtcattccggtccgaaggaaacatgaccggcggggggcactactctcgccaaggccc

SEQ ID NO: 118834 - DNA, 75 bp, Artificial Sequence
  Synthetic
gtcactcgaaacgctgatgtcattccggtccgaaggaaagatgaccggcggggagcactactctcgccaaggccc

SEQ ID NO: 118835 - DNA, 75 bp, Artificial Sequence
  Synthetic
gtcactcgaaacgctgatgtcattccggtccgaaggaaagatgaccggcggggtgcactactctcgccaaggccc

SEQ ID NO: 118836 - DNA, 75 bp, Artificial Sequence
  Synthetic
gtcactcgaaacgctgatgtcattccggtccgaaggaaagatgaccggcggggcgcactactctcgccaaggccc

SEQ ID NO: 118837 - DNA, 75 bp, Artificial Sequence
  Synthetic
gtcactcgaaacgctgatgtcattccggtccgaaggaaagatgaccggcggggggcactactctcgccaaggccc

SEQ ID NO: 118838 - DNA, 75 bp, Artificial Sequence
  Synthetic
aggtgcaggtggtatccactgcaactcagactttcctcgccaccgccataaatggggtactctggacagttttcc

SEQ ID NO: 118839 - DNA, 75 bp, Artificial Sequence
  Synthetic
attccgctagcgccgctagtgccaatgggctgtcatggttcttcatcttctttgtagcggcctggtacttaaagg

SEQ ID NO: 118840 - DNA, 75 bp, Artificial Sequence
  Synthetic
ggtcatgatcaaggtaggggcgcttaccggcacctatatttataaccatcttacccctcttcgggactgggcgca

SEQ ID NO: 118841 - DNA, 75 bp, Artificial Sequence
  Synthetic
tgacaccctgcacttgcggctcctcggacctttacctggtcacgaggcatgccgatgtcattcccgtgcgccggc

SEQ ID NO: 118842 - DNA, 75 bp, Artificial Sequence
  Synthetic
aatccattgacttcatccctgttgaatctcttgacatcgccacacggtcacccagtttctctgacaacagaacgc

SEQ ID NO: 118843 - DNA, 75 bp, Artificial Sequence
  Synthetic
aatccattgacttcatccctgttgaatctcttgacatcgccacacggtcacccagtttctctgacaacagtacgc

SEQ ID NO: 118844 - DNA, 75 bp, Artificial Sequence
  Synthetic
aatccattgacttcatccctgttgaatctcttgacatcgccacacggtcacccagtttctctgacaacagcacgc

SEQ ID NO: 118845 - DNA, 75 bp, Artificial Sequence
  Synthetic
aatccattgacttcatccctgttgaatctcttgacatcgccacacggtcacccagtttctctgacaacaggacgc

SEQ ID NO: 118846 - DNA, 75 bp, Artificial Sequence
  Synthetic
aatccattgacttcatccctgttgaatctcttgacatcgccacacggtctcccagtttctctgacaacagaacgc

SEQ ID NO: 118847 - DNA, 75 bp, Artificial Sequence
  Synthetic
aatccattgacttcatccctgttgaatctcttgacatcgccacacggtctcccagtttctctgacaacagtacgc

SEQ ID NO: 118848 - DNA, 75 bp, Artificial Sequence
  Synthetic
aatccattgacttcatccctgttgaatctcttgacatcgccacacggtctcccagtttctctgacaacagcacgc

SEQ ID NO: 118849 - DNA, 75 bp, Artificial Sequence
  Synthetic
aatccattgacttcatccctgttgaatctcttgacatcgccacacggtctcccagtttctctgacaacaggacgc

SEQ ID NO: 118850 - DNA, 75 bp, Artificial Sequence
  Synthetic
aatccattgacttcatccctgttgaatctcttgacatcgccacacggtcccccagtttctctgacaacagaacgc

SEQ ID NO: 118851 - DNA, 75 bp, Artificial Sequence
  Synthetic
aatccattgacttcatccctgttgaatctcttgacatcgccacacggtcccccagtttctctgacaacagtacgc

SEQ ID NO: 118852 - DNA, 75 bp, Artificial Sequence
  Synthetic
aatccattgacttcatccctgttgaatctcttgacatcgccacacggtcccccagtttctctgacaacagcacgc

SEQ ID NO: 118853 - DNA, 75 bp, Artificial Sequence
  Synthetic
aatccattgacttcatccctgttgaatctcttgacatcgccacacggtcccccagtttctctgacaacaggacgc

SEQ ID NO: 118854 - DNA, 75 bp, Artificial Sequence
  Synthetic
aatccattgacttcatccctgttgaatctcttgacatcgccacacggtcgcccagtttctctgacaacagaacgc

SEQ ID NO: 118855 - DNA, 75 bp, Artificial Sequence
  Synthetic
aatccattgacttcatccctgttgaatctcttgacatcgccacacggtcgcccagtttctctgacaacagtacgc

SEQ ID NO: 118856 - DNA, 75 bp, Artificial Sequence
  Synthetic
aatccattgacttcatccctgttgaatctcttgacatcgccacacggtcgcccagtttctctgacaacagcacgc

SEQ ID NO: 118857 - DNA, 75 bp, Artificial Sequence
  Synthetic
aatccattgacttcatccctgttgaatctcttgacatcgccacacggtcgcccagtttctctgacaacaggacgc

SEQ ID NO: 118858 - DNA, 75 bp, Artificial Sequence
  Synthetic
aatccattgacttcttccctgttgaatctcttgacatcgccacacggtcacccagtttctctgacaacagaacgc

SEQ ID NO: 118859 - DNA, 75 bp, Artificial Sequence
  Synthetic
aatccattgacttcttccctgttgaatctcttgacatcgccacacggtcacccagtttctctgacaacagtacgc

SEQ ID NO: 118860 - DNA, 75 bp, Artificial Sequence
  Synthetic
aatccattgacttcttccctgttgaatctcttgacatcgccacacggtcacccagtttctctgacaacagcacgc

SEQ ID NO: 118861 - DNA, 75 bp, Artificial Sequence
  Synthetic
aatccattgacttcttccctgttgaatctcttgacatcgccacacggtcacccagtttctctgacaacaggacgc

SEQ ID NO: 118862 - DNA, 75 bp, Artificial Sequence
  Synthetic
aatccattgacttcttccctgttgaatctcttgacatcgccacacggtctcccagtttctctgacaacagaacgc

SEQ ID NO: 118863 - DNA, 75 bp, Artificial Sequence
  Synthetic
aatccattgacttcttccctgttgaatctcttgacatcgccacacggtctcccagtttctctgacaacagtacgc

SEQ ID NO: 118864 - DNA, 75 bp, Artificial Sequence
  Synthetic
aatccattgacttcttccctgttgaatctcttgacatcgccacacggtctcccagtttctctgacaacagcacgc

SEQ ID NO: 118865 - DNA, 75 bp, Artificial Sequence
  Synthetic
aatccattgacttcttccctgttgaatctcttgacatcgccacacggtctcccagtttctctgacaacaggacgc

SEQ ID NO: 118866 - DNA, 75 bp, Artificial Sequence
  Synthetic
aatccattgacttcttccctgttgaatctcttgacatcgccacacggtcccccagtttctctgacaacagaacgc

SEQ ID NO: 118867 - DNA, 75 bp, Artificial Sequence
  Synthetic
aatccattgacttcttccctgttgaatctcttgacatcgccacacggtcccccagtttctctgacaacagtacgc

SEQ ID NO: 118868 - DNA, 75 bp, Artificial Sequence
  Synthetic
aatccattgacttcttccctgttgaatctcttgacatcgccacacggtcccccagtttctctgacaacagcacgc

SEQ ID NO: 118869 - DNA, 75 bp, Artificial Sequence
  Synthetic
aatccattgacttcttccctgttgaatctcttgacatcgccacacggtcccccagtttctctgacaacaggacgc

SEQ ID NO: 118870 - DNA, 75 bp, Artificial Sequence
  Synthetic
aatccattgacttcttccctgttgaatctcttgacatcgccacacggtcgcccagtttctctgacaacagaacgc

SEQ ID NO: 118871 - DNA, 75 bp, Artificial Sequence
  Synthetic
aatccattgacttcttccctgttgaatctcttgacatcgccacacggtcgcccagtttctctgacaacagtacgc

SEQ ID NO: 118872 - DNA, 75 bp, Artificial Sequence
  Synthetic
aatccattgacttcttccctgttgaatctcttgacatcgccacacggtcgcccagtttctctgacaacagcacgc

SEQ ID NO: 118873 - DNA, 75 bp, Artificial Sequence
  Synthetic
aatccattgacttcttccctgttgaatctcttgacatcgccacacggtcgcccagtttctctgacaacaggacgc

SEQ ID NO: 118874 - DNA, 75 bp, Artificial Sequence
  Synthetic
aatccattgacttcctccctgttgaatctcttgacatcgccacacggtcacccagtttctctgacaacagaacgc

SEQ ID NO: 118875 - DNA, 75 bp, Artificial Sequence
  Synthetic
aatccattgacttcctccctgttgaatctcttgacatcgccacacggtcacccagtttctctgacaacagtacgc

SEQ ID NO: 118876 - DNA, 75 bp, Artificial Sequence
  Synthetic
aatccattgacttcctccctgttgaatctcttgacatcgccacacggtcacccagtttctctgacaacagcacgc

SEQ ID NO: 118877 - DNA, 75 bp, Artificial Sequence
  Synthetic
aatccattgacttcctccctgttgaatctcttgacatcgccacacggtcacccagtttctctgacaacaggacgc

SEQ ID NO: 118878 - DNA, 75 bp, Artificial Sequence
  Synthetic
aatccattgacttcctccctgttgaatctcttgacatcgccacacggtctcccagtttctctgacaacagaacgc

SEQ ID NO: 118879 - DNA, 75 bp, Artificial Sequence
  Synthetic
aatccattgacttcctccctgttgaatctcttgacatcgccacacggtctcccagtttctctgacaacagtacgc

SEQ ID NO: 118880 - DNA, 75 bp, Artificial Sequence
  Synthetic
aatccattgacttcctccctgttgaatctcttgacatcgccacacggtctcccagtttctctgacaacagcacgc

SEQ ID NO: 118881 - DNA, 75 bp, Artificial Sequence
  Synthetic
aatccattgacttcctccctgttgaatctcttgacatcgccacacggtctcccagtttctctgacaacaggacgc

SEQ ID NO: 118882 - DNA, 75 bp, Artificial Sequence
  Synthetic
aatccattgacttcctccctgttgaatctcttgacatcgccacacggtcccccagtttctctgacaacagaacgc

SEQ ID NO: 118883 - DNA, 75 bp, Artificial Sequence
  Synthetic
aatccattgacttcctccctgttgaatctcttgacatcgccacacggtcccccagtttctctgacaacagtacgc

SEQ ID NO: 118884 - DNA, 75 bp, Artificial Sequence
  Synthetic
aatccattgacttcctccctgttgaatctcttgacatcgccacacggtcccccagtttctctgacaacagcacgc

SEQ ID NO: 118885 - DNA, 75 bp, Artificial Sequence
  Synthetic
aatccattgacttcctccctgttgaatctcttgacatcgccacacggtcccccagtttctctgacaacaggacgc

SEQ ID NO: 118886 - DNA, 75 bp, Artificial Sequence
  Synthetic
aatccattgacttcctccctgttgaatctcttgacatcgccacacggtcgcccagtttctctgacaacagaacgc

SEQ ID NO: 118887 - DNA, 75 bp, Artificial Sequence
  Synthetic
aatccattgacttcctccctgttgaatctcttgacatcgccacacggtcgcccagtttctctgacaacagtacgc

SEQ ID NO: 118888 - DNA, 75 bp, Artificial Sequence
  Synthetic
aatccattgacttcctccctgttgaatctcttgacatcgccacacggtcgcccagtttctctgacaacagcacgc

SEQ ID NO: 118889 - DNA, 75 bp, Artificial Sequence
  Synthetic
aatccattgacttcctccctgttgaatctcttgacatcgccacacggtcgcccagtttctctgacaacaggacgc

SEQ ID NO: 118890 - DNA, 75 bp, Artificial Sequence
  Synthetic
aatccattgacttcgtccctgttgaatctcttgacatcgccacacggtcacccagtttctctgacaacagaacgc

SEQ ID NO: 118891 - DNA, 75 bp, Artificial Sequence
  Synthetic
aatccattgacttcgtccctgttgaatctcttgacatcgccacacggtcacccagtttctctgacaacagtacgc

SEQ ID NO: 118892 - DNA, 75 bp, Artificial Sequence
  Synthetic
aatccattgacttcgtccctgttgaatctcttgacatcgccacacggtcacccagtttctctgacaacagcacgc

SEQ ID NO: 118893 - DNA, 75 bp, Artificial Sequence
  Synthetic
aatccattgacttcgtccctgttgaatctcttgacatcgccacacggtcacccagtttctctgacaacaggacgc

SEQ ID NO: 118894 - DNA, 75 bp, Artificial Sequence
  Synthetic
aatccattgacttcgtccctgttgaatctcttgacatcgccacacggtctcccagtttctctgacaacagaacgc

SEQ ID NO: 118895 - DNA, 75 bp, Artificial Sequence
  Synthetic
aatccattgacttcgtccctgttgaatctcttgacatcgccacacggtctcccagtttctctgacaacagtacgc

SEQ ID NO: 118896 - DNA, 75 bp, Artificial Sequence
  Synthetic
aatccattgacttcgtccctgttgaatctcttgacatcgccacacggtctcccagtttctctgacaacagcacgc

SEQ ID NO: 118897 - DNA, 75 bp, Artificial Sequence
  Synthetic
aatccattgacttcgtccctgttgaatctcttgacatcgccacacggtctcccagtttctctgacaacaggacgc

SEQ ID NO: 118898 - DNA, 75 bp, Artificial Sequence
  Synthetic
aatccattgacttcgtccctgttgaatctcttgacatcgccacacggtcccccagtttctctgacaacagaacgc

SEQ ID NO: 118899 - DNA, 75 bp, Artificial Sequence
  Synthetic
aatccattgacttcgtccctgttgaatctcttgacatcgccacacggtcccccagtttctctgacaacagtacgc

SEQ ID NO: 118900 - DNA, 75 bp, Artificial Sequence
  Synthetic
aatccattgacttcgtccctgttgaatctcttgacatcgccacacggtcccccagtttctctgacaacagcacgc

SEQ ID NO: 118901 - DNA, 75 bp, Artificial Sequence
  Synthetic
aatccattgacttcgtccctgttgaatctcttgacatcgccacacggtcccccagtttctctgacaacaggacgc

SEQ ID NO: 118902 - DNA, 75 bp, Artificial Sequence
  Synthetic
aatccattgacttcgtccctgttgaatctcttgacatcgccacacggtcgcccagtttctctgacaacagaacgc

SEQ ID NO: 118903 - DNA, 75 bp, Artificial Sequence
  Synthetic
aatccattgacttcgtccctgttgaatctcttgacatcgccacacggtcgcccagtttctctgacaacagtacgc

SEQ ID NO: 118904 - DNA, 75 bp, Artificial Sequence
  Synthetic
aatccattgacttcgtccctgttgaatctcttgacatcgccacacggtcgcccagtttctctgacaacagcacgc

SEQ ID NO: 118905 - DNA, 75 bp, Artificial Sequence
  Synthetic
aatccattgacttcgtccctgttgaatctcttgacatcgccacacggtcgcccagtttctctgacaacaggacgc

SEQ ID NO: 118906 - DNA, 75 bp, Artificial Sequence
  Synthetic
gtgcaggtccctcgccccatgcacgtgcggtgcgagcgacctgtacctggtcacccggaatgccgatgtcatccc

SEQ ID NO: 118907 - DNA, 75 bp, Artificial Sequence
  Synthetic
cagcggcgtcgaggaggacaaagccgccctgcgagctttcacggaagctatgaccaggtactctgccccccccgg

SEQ ID NO: 118908 - DNA, 75 bp, Artificial Sequence
  Synthetic
gccgcgcaggggcccacgattgggtgtgcgcgcgacgcgtaaaacttctgaacggtcacagcctcgcggacgacg

SEQ ID NO: 118909 - DNA, 75 bp, Artificial Sequence
  Synthetic
aaggtcatcgatacccttacttgcggactcgccgacctcatggggtacatccccgtcctaggaggccctctaggg

SEQ ID NO: 118910 - DNA, 75 bp, Artificial Sequence
  Synthetic
ccgggaagctagaggggggcgtgatgggatcatctggcaggcagtcattctacacccccgccttgtgttcgatgt

SEQ ID NO: 118911 - DNA, 75 bp, Artificial Sequence
  Synthetic
cacgctgtggggctcttccgcgccgcggtatgcacgaggggagtggcaaaagctcttgactttgtccccgtggag

SEQ ID NO: 118912 - DNA, 75 bp, Artificial Sequence
  Synthetic
ggccctctatgtgggggacttgtgcgggtctgtctttcttgtcggtcaactgttcactttctcccccaggcgcca

SEQ ID NO: 118913 - DNA, 75 bp, Artificial Sequence
  Synthetic
ccacaccaccagggtccgtgacaaccccccatcccaacatagaggaagtcgccttgccgacgacgggagagatac

SEQ ID NO: 118914 - DNA, 75 bp, Artificial Sequence
  Synthetic
tagcacttctctcgtgcttaactgtcccggcctcggcagtcaatttcgccaacaagagcggcgtctatcatctta

SEQ ID NO: 118915 - DNA, 75 bp, Artificial Sequence
  Synthetic
gtagcggaaagagcacgaaggtgcccgctgcgtatgctgctcagggatacaaggtcctagtgctcaacccctcgg

SEQ ID NO: 118916 - DNA, 75 bp, Artificial Sequence
  Synthetic
gacctatcaggtagggtacctgcacgcaccaacaggcagcggaaagagcacccgtgttccggcggcgtacgctaa

SEQ ID NO: 118917 - DNA, 75 bp, Artificial Sequence
  Synthetic
cgctgcgtatgctgctcagggatacaaggtcctagtgctcaacccctcggtggcagccactttggggtttggtgc

SEQ ID NO: 118918 - DNA, 75 bp, Artificial Sequence
  Synthetic
aactcttcaggctgtcccgagaggatggccagctgccgaccccttaccgattttgcccagggctggggccctatc

SEQ ID NO: 118919 - DNA, 75 bp, Artificial Sequence
  Synthetic
gtgctggacggcagccacagccacgcttgcggtcccgaactcatcgacccctatccatgggttccggcgccacct

SEQ ID NO: 118920 - DNA, 75 bp, Artificial Sequence
  Synthetic
cgcgtgcatcagaccgtgcaagattgcaattgttccatctactctggccacgtcagcggccacagaatggcgtgg

SEQ ID NO: 118921 - DNA, 75 bp, Artificial Sequence
  Synthetic
cgcatcctaacattacagagacagccctgcctacaactggagaggtgcctttttacggtagggcaatcccacttg

SEQ ID NO: 118922 - DNA, 75 bp, Artificial Sequence
  Synthetic
actcctactcaccgtaggggtaggcatctttttgctccccgctcggtagacgggcggccttagcaacactccatc

SEQ ID NO: 118923 - DNA, 75 bp, Artificial Sequence
  Synthetic
gtattattgccgctgtgctgtattacagcatggctgccaattgggcgaaggtcctcctagtgttgctcctgttcg

SEQ ID NO: 118924 - DNA, 75 bp, Artificial Sequence
  Synthetic
gcctacttcaatacaccaggccttcccgtctgccaagatcatcttgaattctgggagagcgtctttacaggatta

SEQ ID NO: 118925 - DNA, 75 bp, Artificial Sequence
  Synthetic
tttctacaggggtctggatgtgtcggttataccaacgtcaggcgacgtggtcgtatgtgccacggacgccttgat

SEQ ID NO: 118926 - DNA, 75 bp, Artificial Sequence
  Synthetic
ctcagactaaacaggcgggggacaactatccctacctggtagcatatcaggccacggtctgcgcgagggcgctcg

SEQ ID NO: 118927 - DNA, 75 bp, Artificial Sequence
  Synthetic
tgtcaattccaatggaagctggcacatcaataggactgctttgaactgcaacgactcattgcacaccgggtttct

SEQ ID NO: 118928 - DNA, 75 bp, Artificial Sequence
  Synthetic
acaactgtcccgcaggacgccgtttctaggagtcaaaggcggggcaggacaggtcggggtaaaccgggcatttac

SEQ ID NO: 118929 - DNA, 75 bp, Artificial Sequence
  Synthetic
ccaatcacctatgccaacattagtggtccttctgccgagaagccctactgctggcattatgcccccaggccctgt

SEQ ID NO: 118930 - DNA, 75 bp, Artificial Sequence
  Synthetic
actcatatcccaagcggaggcggctttggagaacctcgtagtactcaatgcagcatccctggccgggacgcacgg

SEQ ID NO: 118931 - DNA, 75 bp, Artificial Sequence
  Synthetic
ccgagactactgtcagactaagagcctaccttaacacgccggggctcccagtatgtcaagaccaccttgagtttt

SEQ ID NO: 118932 - DNA, 75 bp, Artificial Sequence
  Synthetic
gtccttctgatgatagaccgtactgctggcactacgcacctagactttgtgaaaccgtcccagcatcaagtgtct

SEQ ID NO: 118933 - DNA, 75 bp, Artificial Sequence
  Synthetic
tgacgaaatatatcgccacgtgcatgcaagctgaccttgagatcatgacaagtacatgggttctggcaggggggg

SEQ ID NO: 118934 - DNA, 75 bp, Artificial Sequence
  Synthetic
catggggggagaatgagtctgacgtcttcctgatgacaagcttgcgacccccggcgggcgggtggtatggctgca

SEQ ID NO: 118935 - DNA, 75 bp, Artificial Sequence
  Synthetic
taccgtgtgtgcaagggcgaaggctccccctccctgttgggatgttatgtggaagtgcctgagccggctaaagcc

SEQ ID NO: 118936 - DNA, 75 bp, Artificial Sequence
  Synthetic
gttcctgctggagtcccagcggcctcccggtggtcggtggtttgggtgtgtgtggatgaactccacggggtttac

SEQ ID NO: 118937 - DNA, 75 bp, Artificial Sequence
  Synthetic
taccgactgcttccgaaaacatccgggagccagttacgccaagtgtgggtcaggcccctggctcactcctaggtg

SEQ ID NO: 118938 - DNA, 75 bp, Artificial Sequence
  Synthetic
tcagctgatttggaggttatcaccagtacctgggtcctggtggggggcgtcctggcggctctcgcagcatactgc

SEQ ID NO: 118939 - DNA, 75 bp, Artificial Sequence
  Synthetic
ggaacttcatcagtggcatacagtacctggcgggactctccaccctaccgggaaatcccgcagtggcatcaatga

SEQ ID NO: 118940 - DNA, 75 bp, Artificial Sequence
  Synthetic
gatgtcgcgtgcaattggacccgcggcgaccgctgtgagttggaggaccgcgacagagtcgagatgagcccattg

SEQ ID NO: 118941 - DNA, 75 bp, Artificial Sequence
  Synthetic
tggaagagtgctccaggcacctcccatatctcgcagaagggcaacagctcgcagagcagttcaaacagaaggtcc

SEQ ID NO: 118942 - DNA, 75 bp, Artificial Sequence
  Synthetic
tgcagtatttgtacgggctgtcaacatccgttgtcaattgggccattaagtgggaatacattgttctcgctttct

SEQ ID NO: 118943 - DNA, 75 bp, Artificial Sequence
  Synthetic
gaattttgtcagtggcattcagtacctggcagggttgtctaccctgcccgggaaccctgccatagcatctctcat

SEQ ID NO: 118944 - DNA, 75 bp, Artificial Sequence
  Synthetic
atcatgacatgcatgtcggctgacctggaggtcgtcacgagtacctgggtgctcgttggcggcgttctggctgct

SEQ ID NO: 118945 - DNA, 75 bp, Artificial Sequence
  Synthetic
ctcggccgtgggacaccatggactagggtggcttctgctcttcatttgctgggcgtggtacgtacggggtaggat

SEQ ID NO: 118946 - DNA, 75 bp, Artificial Sequence
  Synthetic
ggatctacaagctttgtggtatgcggcatggcgggcgctgctgtgggcagtgtcggactgggaagagtcctgatt

SEQ ID NO: 118947 - DNA, 75 bp, Artificial Sequence
  Synthetic
tgtcggactgggaagagtcctgattgacatcttagcgggctatggtgcaggagtgtcaggggcgctcgtgtgctt

SEQ ID NO: 118948 - DNA, 75 bp, Artificial Sequence
  Synthetic
gcctcagttggtctcctggtagtcggtgccctgaccatcttcacgctcacccccgcctacaagaccttgctagcg

SEQ ID NO: 118949 - DNA, 75 bp, Artificial Sequence
  Synthetic
gctatcctgcgacgccacgtgggcccctccgagggagccgcccagtggatgaacaggttaatagcatttgcctcg

SEQ ID NO: 118950 - DNA, 75 bp, Artificial Sequence
  Synthetic
tcttgtgcacgtgcttattccatccagctttggggttcgaaatcacaaagatactgctagcactaataggcccta

SEQ ID NO: 118951 - DNA, 75 bp, Artificial Sequence
  Synthetic
agtgggatacaatatctggcgggcctgtcgacgttgcctggtaaccctgctattgcatcgttgatggcttttaca

SEQ ID NO: 118952 - DNA, 75 bp, Artificial Sequence
  Synthetic
gcaggctccatcagtggattagtgaggactgctccatgccatgttccacctcatggctacgggacatatgggact

SEQ ID NO: 118953 - DNA, 75 bp, Artificial Sequence
  Synthetic
gtatgtgcaagctgctctcctgcgggttggggcctggactggcacttacatctatgaccacttgagccctctatc

SEQ ID NO: 118954 - DNA, 75 bp, Artificial Sequence
  Synthetic
ggactgctccatgccatgttccacctcatggctacgggacatatgggactgggtgtgcaccgtactctcggactt

SEQ ID NO: 118955 - DNA, 75 bp, Artificial Sequence
  Synthetic
gttcctgcccccgagttcttcactgaggtggatggcgtcagaattcatcgccacgcgcctgagtgtaagcccttg

SEQ ID NO: 118956 - DNA, 75 bp, Artificial Sequence
  Synthetic
aaccataccacctgcccatgcggagctaacatcacaggacatgtgaagaacgggtcaatgaggctcgtcggccct

SEQ ID NO: 118957 - DNA, 75 bp, Artificial Sequence
  Synthetic
gccgcctgtggtgacatcctttcaggcctccccgtctcggctaggaggggaaaccttatcttccttggccctgcc

SEQ ID NO: 118958 - DNA, 75 bp, Artificial Sequence
  Synthetic
atacaccgttacgcgccaccttgcaagcccttgctcagggacgaagtgactttctctgtgggtctttcaaactat

SEQ ID NO: 118959 - DNA, 75 bp, Artificial Sequence
  Synthetic
ggaggatcgcggcagaggaatacgcggaggtgaagcgggtgggtgaataccattacatcataggactcactacag

SEQ ID NO: 118960 - DNA, 75 bp, Artificial Sequence
  Synthetic
ggaggatcgcggcagaggaatacgcggaggtgaagcgggtgggtgaataccattacatcttaggactcactacag

SEQ ID NO: 118961 - DNA, 75 bp, Artificial Sequence
  Synthetic
ggaggatcgcggcagaggaatacgcggaggtgaagcgggtgggtgaataccattacatcctaggactcactacag

SEQ ID NO: 118962 - DNA, 75 bp, Artificial Sequence
  Synthetic
ggaggatcgcggcagaggaatacgcggaggtgaagcgggtgggtgaataccattacatcgtaggactcactacag

SEQ ID NO: 118963 - DNA, 75 bp, Artificial Sequence
  Synthetic
gccgcgacaggaacgaggtcactggtgagatccaggtcatttcaacagccacccagtcctttctggggaccacca

SEQ ID NO: 118964 - DNA, 75 bp, Artificial Sequence
  Synthetic
ttgactccttcgagccgcttgcagccgaagaggacagggaggtttctgttccagcagagattttgcggcctgcta

SEQ ID NO: 118965 - DNA, 75 bp, Artificial Sequence
  Synthetic
cgaagaggacagggaggtttctgttccagcagagattttgcggcctgctaaaaaattcccgccggccatacccat

SEQ ID NO: 118966 - DNA, 75 bp, Artificial Sequence
  Synthetic
acgggacgaagtcaccttcacagttgggctcaatagctacgtggtagggtcacaactgccatgtgagcccgagcc

SEQ ID NO: 118967 - DNA, 75 bp, Artificial Sequence
  Synthetic
tatggtcggatggcctgcgcccgcagggtcgcgatcgtacacgccctgctcgtgcggagctgctgacctctatct

SEQ ID NO: 118968 - DNA, 75 bp, Artificial Sequence
  Synthetic
cagcctccagttcctccccccaggaggaagaagaagacggtcgtactctccgagtccaccgtttcagaagccttg

SEQ ID NO: 118969 - DNA, 75 bp, Artificial Sequence
  Synthetic
agttcatcagcgagccaactgtcggccccgtcgttgaaggccacatgcacagcacgtcatgacagccccgacgcg

SEQ ID NO: 118970 - DNA, 75 bp, Artificial Sequence
  Synthetic
ggaggtcctatcctttgcccgtcaggacacgtggttgggctcttccgcgcagccctttgcacacggggtgtcgcc

SEQ ID NO: 118971 - DNA, 75 bp, Artificial Sequence
  Synthetic
ccccgtcgttgaaggccacatgcacagcacgtcatgacagccccgacgcggacctgatagaggccaatctcctgt

SEQ ID NO: 118972 - DNA, 75 bp, Artificial Sequence
  Synthetic
ttgtggatgacaaatccgacgacgggtcctactcgtccatgcctccacttgaaggggagcccggcgatccagacc

SEQ ID NO: 118973 - DNA, 75 bp, Artificial Sequence
  Synthetic
gccgcgcaggggccctagattgggtgtgcgcgcgacgaggaagacctccgaacggtcccagcccagaggtaggcg

SEQ ID NO: 118974 - DNA, 75 bp, Artificial Sequence
  Synthetic
cggaagaggctagtgcacttggatgagtccacggtctcgcacgccttggcgcagctcgccgacaaggtatttgtg

SEQ ID NO: 118975 - DNA, 75 bp, Artificial Sequence
  Synthetic
aggttgggtacctccatgcgcctacgggcagcggaaagagcacgaaagttcctgtggcctatgcttctcagggct

SEQ ID NO: 118976 - DNA, 75 bp, Artificial Sequence
  Synthetic
aggttgggtacctccatgcgcctacgggcagcggtaagagcacgaaagttcctgtggcctatgcttctcagggct

SEQ ID NO: 118977 - DNA, 75 bp, Artificial Sequence
  Synthetic
aggttgggtacctccatgcgcctacgggcagcggcaagagcacgaaagttcctgtggcctatgcttctcagggct

SEQ ID NO: 118978 - DNA, 75 bp, Artificial Sequence
  Synthetic
aggttgggtacctccatgcgcctacgggcagcgggaagagcacgaaagttcctgtggcctatgcttctcagggct

SEQ ID NO: 118979 - DNA, 75 bp, Artificial Sequence
  Synthetic
ggagccctcagtgccggcggaatgccacagaccaccgcggcccaagtttccacctgcccttcctgtgtgggcgag

SEQ ID NO: 118980 - DNA, 75 bp, Artificial Sequence
  Synthetic
cagtggatcggaggatgtagtatgttgctcaatgtcatattcatggacaggggcgctcataacacctattgcagc

SEQ ID NO: 118981 - DNA, 75 bp, Artificial Sequence
  Synthetic
tcggacaattaccacaggagctcccattacatattccacctatggcaagttcttggcagacggaggctgctcggg

SEQ ID NO: 118982 - DNA, 75 bp, Artificial Sequence
  Synthetic
attcccccgcccaggaggaagcggcttgtgagactcgatgagtccactgttgcggccgcgttatctgaactggca

SEQ ID NO: 118983 - DNA, 75 bp, Artificial Sequence
  Synthetic
attcccccgcccaggaggaagcggcttgtgagactcgatgagtccactgttgcggccgcgttatctgatctggca

SEQ ID NO: 118984 - DNA, 75 bp, Artificial Sequence
  Synthetic
attcccccgcccaggaggaagcggcttgtgagactcgatgagtccactgttgcggccgcgttatctgacctggca

SEQ ID NO: 118985 - DNA, 75 bp, Artificial Sequence
  Synthetic
attcccccgcccaggaggaagcggcttgtgagactcgatgagtccactgttgcggccgcgttatctgagctggca

SEQ ID NO: 118986 - DNA, 75 bp, Artificial Sequence
  Synthetic
ttggcctattttgccatgcagggagcatgggccaaagtcattgccatccttctccttgtagcgggagtggatgca

SEQ ID NO: 118987 - DNA, 75 bp, Artificial Sequence
  Synthetic
aaacagcatctgatgctgggtcctatagctccatgccccctctagagggagagccaggagatcctgatctcagct

SEQ ID NO: 118988 - DNA, 75 bp, Artificial Sequence
  Synthetic
tgccgtctcacggttctcgccactgctacgccccctggctcagtcacggtcccccaccctaacatacaagaggag

SEQ ID NO: 118989 - DNA, 75 bp, Artificial Sequence
  Synthetic
aatgcgacgagcttgctgtccaacttaggtccctgggcctaaatgctgtcgcatactacagaggcatagacgtgg

SEQ ID NO: 118990 - DNA, 75 bp, Artificial Sequence
  Synthetic
ggaggagaagctgcccatcagccctctgagcaattcgctcattagacatcacaacctagtttactccaccacctc

SEQ ID NO: 118991 - DNA, 75 bp, Artificial Sequence
  Synthetic
agttcgggtgtgcgagaagagagcgctttatgacgccgtaaagaaactctctgaggccgtgatgggagccgctta

SEQ ID NO: 118992 - DNA, 75 bp, Artificial Sequence
  Synthetic
agttcgggtgtgcgagaagagagcgctttatgacgccgtaaagaaactctctgaggccgtgatgggtgccgctta

SEQ ID NO: 118993 - DNA, 75 bp, Artificial Sequence
  Synthetic
agttcgggtgtgcgagaagagagcgctttatgacgccgtaaagaaactctctgaggccgtgatgggcgccgctta

SEQ ID NO: 118994 - DNA, 75 bp, Artificial Sequence
  Synthetic
agttcgggtgtgcgagaagagagcgctttatgacgccgtaaagaaactctctgaggccgtgatgggggccgctta

SEQ ID NO: 118995 - DNA, 75 bp, Artificial Sequence
  Synthetic
cgtaacgcaagcagtcgatttcagcctagaccccaccttttcgattgagaccacaaccgttccccaggacgcagt

SEQ ID NO: 118996 - DNA, 75 bp, Artificial Sequence
  Synthetic
tctaaggtgagtgcaggcctcctatcagtagaggaggcatgcgaccttactccacctcactcggcccggtctaag

SEQ ID NO: 118997 - DNA, 75 bp, Artificial Sequence
  Synthetic
tgcgaaaagatggccctctatgacattgcacaaaagcttcccaaggcaataatgggggcatcctatgggttccaa

SEQ ID NO: 118998 - DNA, 75 bp, Artificial Sequence
  Synthetic
gtcctctgcaaggcgtatgacaccggagcagcgtggtacgagctaacaccgtccgagaccacagttaggctccgt

SEQ ID NO: 118999 - DNA, 75 bp, Artificial Sequence
  Synthetic
gtcctctgctaggcgtatgacaccggagcagcgtggtacgagctaacaccgtccgagaccacagttaggctccgt

SEQ ID NO: 119000 - DNA, 75 bp, Artificial Sequence
  Synthetic
gtcctctgccaggcgtatgacaccggagcagcgtggtacgagctaacaccgtccgagaccacagttaggctccgt

SEQ ID NO: 119001 - DNA, 75 bp, Artificial Sequence
  Synthetic
gtcctctgcgaggcgtatgacaccggagcagcgtggtacgagctaacaccgtccgagaccacagttaggctccgt

SEQ ID NO: 119002 - DNA, 75 bp, Artificial Sequence
  Synthetic
ttccaaccaccatcatggcaaagaacgaggtcttttgcgtggagccgtcgaaaggtggccgcaaaccagcgcgcc

SEQ ID NO: 119003 - DNA, 75 bp, Artificial Sequence
  Synthetic
cccaaacgaaacagggaggcgaaaacttcgcatacctggttgcctaccaggctacggtgtgtgcgagggctaaag

SEQ ID NO: 119004 - DNA, 75 bp, Artificial Sequence
  Synthetic
cccaaacgaaacagggtggcgaaaacttcgcatacctggttgcctaccaggctacggtgtgtgcgagggctaaag

SEQ ID NO: 119005 - DNA, 75 bp, Artificial Sequence
  Synthetic
cccaaacgaaacagggcggcgaaaacttcgcatacctggttgcctaccaggctacggtgtgtgcgagggctaaag

SEQ ID NO: 119006 - DNA, 75 bp, Artificial Sequence
  Synthetic
cccaaacgaaacaggggggcgaaaacttcgcatacctggttgcctaccaggctacggtgtgtgcgagggctaaag

SEQ ID NO: 119007 - DNA, 75 bp, Artificial Sequence
  Synthetic
cttccagtactcgcctaaagacagggtagaccacctgctgaagttgtggcgctccaagaaaacgcctatgggctt

SEQ ID NO: 119008 - DNA, 75 bp, Artificial Sequence
  Synthetic
aaatgaaataacaacaacccaccccatcaccaagtacatcatgacttgcatggcggcagacctggaggtcatcac

SEQ ID NO: 119009 - DNA, 75 bp, Artificial Sequence
  Synthetic
gatgccatcacgtccctgaccgaacggctatactgcggtggccccatgtttaactcgaaagggcaatcatgtggg

SEQ ID NO: 119010 - DNA, 75 bp, Artificial Sequence
  Synthetic
aaaccagcgccggtgcctgaccgggaggtgatgtaccagcaataagacgagatggaagagtgctctcgacacctc

SEQ ID NO: 119011 - DNA, 75 bp, Artificial Sequence
  Synthetic
aaaccagcgccggtgcctgaccgggaggtgatgtaccagcaatatgacgagatggaagagtgctctcgacacctc

SEQ ID NO: 119012 - DNA, 75 bp, Artificial Sequence
  Synthetic
aaaccagcgccggtgcctgaccgggaggtgatgtaccagcaatacgacgagatggaagagtgctctcgacacctc

SEQ ID NO: 119013 - DNA, 75 bp, Artificial Sequence
  Synthetic
aaaccagcgccggtgcctgaccgggaggtgatgtaccagcaataggacgagatggaagagtgctctcgacacctc

SEQ ID NO: 119014 - DNA, 75 bp, Artificial Sequence
  Synthetic
aagactttgacatgttggtatgcggagacgaccttgtagtcatctgcgagagtgccggcgttcaggaggacgttg

SEQ ID NO: 119015 - DNA, 75 bp, Artificial Sequence
  Synthetic
acatcaaccgcaccgctctgaactgcaatgactccctccagactggatttattgctgcgctgttctacgcgcaca

SEQ ID NO: 119016 - DNA, 75 bp, Artificial Sequence
  Synthetic
tatgaccaggtattcagctccccctggagacgacccgcacccagagtatgacttggagctgataacatcatgctc

SEQ ID NO: 119017 - DNA, 75 bp, Artificial Sequence
  Synthetic
ccgttcattcagcgtggccaaagctcgagcagttctggcacaagcacatgtggaacttcatcagcggcatacagt

SEQ ID NO: 119018 - DNA, 75 bp, Artificial Sequence
  Synthetic
ctcggaccagaggccctattgctggcactacgcgcctcaaccgtgcggcattgtgcccgcgtcacaggtgtgtgg

SEQ ID NO: 119019 - DNA, 75 bp, Artificial Sequence
  Synthetic
ccgggttctggaggacggcgtgaactatgcaacagggaatctgcccggttgctctttctctatcttcctcttggc

SEQ ID NO: 119020 - DNA, 75 bp, Artificial Sequence
  Synthetic
cgccacactccagtgaattcatggttgggcaacatcattatgtacgcgcctaccatatgggtgcgcatggtgatg

SEQ ID NO: 119021 - DNA, 75 bp, Artificial Sequence
  Synthetic
gggacatttatcacagcgtgtcccgcgcccgaccccgctatttactcctgtgcctactcctactttcagtagggg

SEQ ID NO: 119022 - DNA, 75 bp, Artificial Sequence
  Synthetic
atgacacatttcttctccatactccaggcccaggaagtgctgggcaaccctttggacttcgacatgtacggagtc

SEQ ID NO: 119023 - DNA, 75 bp, Artificial Sequence
  Synthetic
cctcttgaatgtcctggggggatggctagcatcccagttatctgcccctggcccagctactgccttcgtggtcag

SEQ ID NO: 119024 - DNA, 75 bp, Artificial Sequence
  Synthetic
tttaagatcatgagcggcgagaccccgacagtagaggacatggttaaaacgctgcccgcactactttcgcccggg

SEQ ID NO: 119025 - DNA, 75 bp, Artificial Sequence
  Synthetic
tttaagatcatgagcggcgagaccccgacagtagaggacatggttaatacgctgcccgcactactttcgcccggg

SEQ ID NO: 119026 - DNA, 75 bp, Artificial Sequence
  Synthetic
tttaagatcatgagcggcgagaccccgacagtagaggacatggttaacacgctgcccgcactactttcgcccggg

SEQ ID NO: 119027 - DNA, 75 bp, Artificial Sequence
  Synthetic
tttaagatcatgagcggcgagaccccgacagtagaggacatggttaagacgctgcccgcactactttcgcccggg

SEQ ID NO: 119028 - DNA, 75 bp, Artificial Sequence
  Synthetic
tttaagatcatgagcggcgagaccccgactgtagaggacatggttaaaacgctgcccgcactactttcgcccggg

SEQ ID NO: 119029 - DNA, 75 bp, Artificial Sequence
  Synthetic
tttaagatcatgagcggcgagaccccgactgtagaggacatggttaatacgctgcccgcactactttcgcccggg

SEQ ID NO: 119030 - DNA, 75 bp, Artificial Sequence
  Synthetic
tttaagatcatgagcggcgagaccccgactgtagaggacatggttaacacgctgcccgcactactttcgcccggg

SEQ ID NO: 119031 - DNA, 75 bp, Artificial Sequence
  Synthetic
tttaagatcatgagcggcgagaccccgactgtagaggacatggttaagacgctgcccgcactactttcgcccggg

SEQ ID NO: 119032 - DNA, 75 bp, Artificial Sequence
  Synthetic
tttaagatcatgagcggcgagaccccgaccgtagaggacatggttaaaacgctgcccgcactactttcgcccggg

SEQ ID NO: 119033 - DNA, 75 bp, Artificial Sequence
  Synthetic
tttaagatcatgagcggcgagaccccgaccgtagaggacatggttaatacgctgcccgcactactttcgcccggg

SEQ ID NO: 119034 - DNA, 75 bp, Artificial Sequence
  Synthetic
tttaagatcatgagcggcgagaccccgaccgtagaggacatggttaacacgctgcccgcactactttcgcccggg

SEQ ID NO: 119035 - DNA, 75 bp, Artificial Sequence
  Synthetic
tttaagatcatgagcggcgagaccccgaccgtagaggacatggttaagacgctgcccgcactactttcgcccggg

SEQ ID NO: 119036 - DNA, 75 bp, Artificial Sequence
  Synthetic
tttaagatcatgagcggcgagaccccgacggtagaggacatggttaaaacgctgcccgcactactttcgcccggg

SEQ ID NO: 119037 - DNA, 75 bp, Artificial Sequence
  Synthetic
tttaagatcatgagcggcgagaccccgacggtagaggacatggttaatacgctgcccgcactactttcgcccggg

SEQ ID NO: 119038 - DNA, 75 bp, Artificial Sequence
  Synthetic
tttaagatcatgagcggcgagaccccgacggtagaggacatggttaacacgctgcccgcactactttcgcccggg

SEQ ID NO: 119039 - DNA, 75 bp, Artificial Sequence
  Synthetic
tttaagatcatgagcggcgagaccccgacggtagaggacatggttaagacgctgcccgcactactttcgcccggg

SEQ ID NO: 119040 - DNA, 75 bp, Artificial Sequence
  Synthetic
gttggcgaggggatcacccccctctgaggccagctcctcggctagccagctgtctgctccatctctcaaggcaac

SEQ ID NO: 119041 - DNA, 75 bp, Artificial Sequence
  Synthetic
cgcgaggcaaccatgtgtcgcccacccactacgtgcccgagacagatgcgtcccgagcagtgaccaacatactca

SEQ ID NO: 119042 - DNA, 75 bp, Artificial Sequence
  Synthetic
ctactcctactcaccgtaggggtaggcatctttctccttcccgcccggtaggcgggaacaataaagctacactcc

SEQ ID NO: 119043 - DNA, 75 bp, Artificial Sequence
  Synthetic
ctgggtgtgtacggttctctctgatttcaagacctggctgaaggctaagctcctgccgcatctcccgggaatccc

SEQ ID NO: 119044 - DNA, 75 bp, Artificial Sequence
  Synthetic
ccactacgacaatacgacgccatgtcgatttgctcgttggggcagctgctttctgttccgctatgtacgtggggg

SEQ ID NO: 119045 - DNA, 75 bp, Artificial Sequence
  Synthetic
aacgggactatgaaaatagtcggcccccgcacttgcagcaacacatggcaaggcactttcccgatcaatgcgacg

SEQ ID NO: 119046 - DNA, 75 bp, Artificial Sequence
  Synthetic
gtcactatgtcgtgggggttactgctgataacatcaagtgcccctgccaggtgcctgcccctgagttcttcacag

SEQ ID NO: 119047 - DNA, 75 bp, Artificial Sequence
  Synthetic
ttactgtcttcacgcagaaagcgtctagccatggcgttagtatgagtgtcgtgcagcctccaggaccccccctcc

SEQ ID NO: 119048 - DNA, 75 bp, Artificial Sequence
  Synthetic
ggaccagaggccctattgctggcactacgcgcctcgaccgtgcggtattgtacccgcgtcggaggtgtgtggtcc

SEQ ID NO: 119049 - DNA, 75 bp, Artificial Sequence
  Synthetic
ctcccagctaccttgcgagcctgaaccggatgagctggtagtaacatctctactaagggaccctgatcacatcac

SEQ ID NO: 119050 - DNA, 75 bp, Artificial Sequence
  Synthetic
cgcacatggtgtgagggcaatcgaggacgggatcaattatgcaacagggaatcttcccggttgctctttctctat

SEQ ID NO: 119051 - DNA, 75 bp, Artificial Sequence
  Synthetic
acagaatggcctgggacatgatgatgaactggagtccaacaaccaccttagttctcgcccaggtcatgaggatcc

SEQ ID NO: 119052 - DNA, 75 bp, Artificial Sequence
  Synthetic
acgccacatggcttccaccctgatgtagagctcatagaggcaaatctcttatggagacaggaaatgggcggcaac

SEQ ID NO: 119053 - DNA, 75 bp, Artificial Sequence
  Synthetic
cccatcacttacgctgagcctagaagctcggatcagaggccctactgctggcattacgcgccccgaccgtgtggc

SEQ ID NO: 119054 - DNA, 75 bp, Artificial Sequence
  Synthetic
ttccacgcccgcaacgggattccgcaggcatgtggatcttcttgcgggcgccgcagtggtttgctcatccctgta

SEQ ID NO: 119055 - DNA, 75 bp, Artificial Sequence
  Synthetic
gcaatgggagctggcatataaataggactgcccttaactgcaatgacagcttaaacactgggttcttggctagct

SEQ ID NO: 119056 - DNA, 75 bp, Artificial Sequence
  Synthetic
gccacaggcccccgaggccgaagtatcctcccgcgctgcctgtctgggcacgccctgactacaacccgcccctgc

SEQ ID NO: 119057 - DNA, 75 bp, Artificial Sequence
  Synthetic
gccaaggctggggcccactcggggtcgctaacatcagcggctcgtctgatgacaggccttattgctggcactacg

SEQ ID NO: 119058 - DNA, 75 bp, Artificial Sequence
  Synthetic
ggtcgtacagcttagcgagagcgccgtagctcaggcgctggctcagctagccgaacgaaccttcccaacaacgtc

SEQ ID NO: 119059 - DNA, 75 bp, Artificial Sequence
  Synthetic
atcaaatgggagtatgtcctgttgctcttccttctcctggcggacgcgcgcgtctgcgcctgcttgtggatgatg

SEQ ID NO: 119060 - DNA, 75 bp, Artificial Sequence
  Synthetic
agaccaggacctcgtcggctggccggcgccccccggggcgcgctccttgacaccatgcacctgcggcagctcgga

SEQ ID NO: 119061 - DNA, 75 bp, Artificial Sequence
  Synthetic
agctccatgccgcctctcgagggcgagcctggagaccccgacctttccgaaggggaggacacggggtcttggtca

SEQ ID NO: 119062 - DNA, 75 bp, Artificial Sequence
  Synthetic
gccccacagactgttttagaaagcacccagacactacctatctcaagtgcggagcagggccttggttgactccca

SEQ ID NO: 119063 - DNA, 75 bp, Artificial Sequence
  Synthetic
gctctttatggcgtatggccgctgctcctgctcctgctggcgctgccaccacgagcatacgccatggaccgggag

SEQ ID NO: 119064 - DNA, 75 bp, Artificial Sequence
  Synthetic
caataagccccctgagcaacacgctcattcggcaccacaacttggtatactccactacctctcgtagcgctgcgc

SEQ ID NO: 119065 - DNA, 75 bp, Artificial Sequence
  Synthetic
ctagccaaactctcctcttcaacattctgggggggtgggtggctgcccagctcgcagcccccggtgctgctaccg

SEQ ID NO: 119066 - DNA, 75 bp, Artificial Sequence
  Synthetic
gagactcctcacaacagaggaagcttgttcccttacaccgcctcactcggcccgttccaagttcggttacggtgc

SEQ ID NO: 119067 - DNA, 75 bp, Artificial Sequence
  Synthetic
ctccggctatcacgaagtacatcgtgaagtgggagtgggtgatcctccttttcttgatgttggccgacgccaggg

SEQ ID NO: 119068 - DNA, 75 bp, Artificial Sequence
  Synthetic
ctccggctatcacgaagtacatcgtgaagtgggagtgggtgatcctccttttcttgttgttggccgacgccaggg

SEQ ID NO: 119069 - DNA, 75 bp, Artificial Sequence
  Synthetic
ctccggctatcacgaagtacatcgtgaagtgggagtgggtgatcctccttttcttgctgttggccgacgccaggg

SEQ ID NO: 119070 - DNA, 75 bp, Artificial Sequence
  Synthetic
ctccggctatcacgaagtacatcgtgaagtgggagtgggtgatcctccttttcttggtgttggccgacgccaggg

SEQ ID NO: 119071 - DNA, 75 bp, Artificial Sequence
  Synthetic
cctgccctctccaccggcttgatccacctccaccaaaatatcgtggacgtccagtacctctatggtgttggatct

SEQ ID NO: 119072 - DNA, 75 bp, Artificial Sequence
  Synthetic
gccggctacagcgggggagacatttatcacagcgtgtctcatgcccggccccgctggttttggttttgcctactc

SEQ ID NO: 119073 - DNA, 75 bp, Artificial Sequence
  Synthetic
cctcccctgctctttcaccactttacctgccctctccaccggcttgatccacctccaccaaaatatcgtggacgt

SEQ ID NO: 119074 - DNA, 75 bp, Artificial Sequence
  Synthetic
atggtggcgggggcccactggggaatcctggcgggccttgcctactattccatggtggggaactgggctaaggtc

SEQ ID NO: 119075 - DNA, 75 bp, Artificial Sequence
  Synthetic
atggcaaaaaatgaagtgttttgcgtggacccttccaaggggggccgtaagccggcccggctgatcgtatacccg

SEQ ID NO: 119076 - DNA, 75 bp, Artificial Sequence
  Synthetic
gttttgcctactcctgcttgctgcaggggtaggcatctacctcctccccaaccgatgaaggttggggtaaacact

SEQ ID NO: 119077 - DNA, 75 bp, Artificial Sequence
  Synthetic
gccggcccggctgatcgtatacccggaccttggtgtgcgggtgtgcgagaagaaagccttgtatgacatcacacg

SEQ ID NO: 119078 - DNA, 75 bp, Artificial Sequence
  Synthetic
ggtgttttgattcaacagtgactgagcgtgatatccgcacagaggagtccatttaccagtgctgcaaattggacc

SEQ ID NO: 119079 - DNA, 75 bp, Artificial Sequence
  Synthetic
gaccaggggcgagcggtgcgagctatatgacagagacaggattgaaatgagcccgctgcttttctcaactacgca

SEQ ID NO: 119080 - DNA, 75 bp, Artificial Sequence
  Synthetic
atgcggttcggggccttggttgacacctaggtgcatggttgactacccatacaggctttggcactacccctgcac

SEQ ID NO: 119081 - DNA, 75 bp, Artificial Sequence
  Synthetic
acaggctttggcactacccctgcactgtcaactttaccatctttaaggttaggatgtatgtggggggcgtggagc

SEQ ID NO: 119082 - DNA, 75 bp, Artificial Sequence
  Synthetic
ggctagcggagtccttcccactagcatgggcaacaccataacctgctacttaaaggcaatggctgcctgccgggc

SEQ ID NO: 119083 - DNA, 75 bp, Artificial Sequence
  Synthetic
gttgagcccgtcatcttttctgacatggagaccaagatcatcacttggggagcggacaccgcggcgtgtggggac

SEQ ID NO: 119084 - DNA, 75 bp, Artificial Sequence
  Synthetic
gcccgctgctgctgtctacaacagagtggcagatactgccctgttccttcaccaccctaccggctctgtccactg

SEQ ID NO: 119085 - DNA, 75 bp, Artificial Sequence
  Synthetic
tttacggacgctatgaccaggtactcagctcctcccggggatgaaccgcacccagtatatgacctggagcttatt

SEQ ID NO: 119086 - DNA, 75 bp, Artificial Sequence
  Synthetic
atactactacctcacacgtgacccaaccactgttttggcacgagcggcctgggaaaccgctcgccacactccagt

SEQ ID NO: 119087 - DNA, 75 bp, Artificial Sequence
  Synthetic
atttggcggtggccctagagccagttgtgttcacgcccatggagaagaaagtcatcgtctggggcgctgacaccg

SEQ ID NO: 119088 - DNA, 75 bp, Artificial Sequence
  Synthetic
aaaaaccctagccggcccgaaaggcccagtcacccagatgtacaccaatgtggaccaggacctcgtcggttggcc

SEQ ID NO: 119089 - DNA, 75 bp, Artificial Sequence
  Synthetic
gcatggtactgatgacacatttctttggaatactccagtcccaagaacaactccataaagcacttgacttcgata

SEQ ID NO: 119090 - DNA, 75 bp, Artificial Sequence
  Synthetic
ccagccagctgtctgcaccatctctcaaggcaacttgcaccaccaaccacgactcccctgacgccgagctcatag

SEQ ID NO: 119091 - DNA, 75 bp, Artificial Sequence
  Synthetic
acctacgggttaggggtggtagggactccatcatcttacttacctgcttgttacatccacagctggggtttgagg

SEQ ID NO: 119092 - DNA, 75 bp, Artificial Sequence
  Synthetic
tgaactcaatagggttggagcgtgcctcaggaaacttggggcccctcccttgcgagcctggagacatcgggcaag

SEQ ID NO: 119093 - DNA, 75 bp, Artificial Sequence
  Synthetic
ggcagtcagagctaagcttatcgcccagggtgggaaagccgctatatgtggcaagtacctcttcaactgggccgt

SEQ ID NO: 119094 - DNA, 75 bp, Artificial Sequence
  Synthetic
ttgcctactcgttcgtaggctagcagggggtaagtacgtgcaggcgtgccttctgaggttgggtgcttggactgg

SEQ ID NO: 119095 - DNA, 75 bp, Artificial Sequence
  Synthetic
ttcctgctcctattggcgttgccaccacgggcgtacgccatggaccgggaggtagctgcatcgtgcggaggcgcg

SEQ ID NO: 119096 - DNA, 75 bp, Artificial Sequence
  Synthetic
cactgcgggactgggcccatgcgggcctacgagaccttgcagtggcagttgagcccgtcgtcttctccgacatgg

SEQ ID NO: 119097 - DNA, 75 bp, Artificial Sequence
  Synthetic
gcacctccctggctgtgtaccttgtgtcaaaactggcaacatcagcaagtgttggacgccggcctcgcccacgtt

SEQ ID NO: 119098 - DNA, 75 bp, Artificial Sequence
  Synthetic
cccagtggaaaacatggagacgactatgcgctctccctcattcacagacaactccacgccgcctgcagtgcccca

SEQ ID NO: 119099 - DNA, 75 bp, Artificial Sequence
  Synthetic
ttgtgcggtggtatcttcctgctcggccagttggtcacttttagaccacggatgcaccaggtcgtgcaggactgc

SEQ ID NO: 119100 - DNA, 75 bp, Artificial Sequence
  Synthetic
catgatgatgaattggtcacctaccgccacgttgattacatcctacgtgctgcgcattccccaagtgatcatcga

SEQ ID NO: 119101 - DNA, 75 bp, Artificial Sequence
  Synthetic
ccctgcccgtttgggcgcggccggactacaaccccccgctgctggagacgtggaaaaagcctgactacgaaccac

SEQ ID NO: 119102 - DNA, 75 bp, Artificial Sequence
  Synthetic
ggtgtcgacgcatacacccataccatcggggggactacgggccagcaagcatacgggctcgcatccctttttaat

SEQ ID NO: 119103 - DNA, 75 bp, Artificial Sequence
  Synthetic
tggcagcgttgttctacacccataggttcaactcctctggttgccctgctcgcctatcatcttgcaaaccgctca

SEQ ID NO: 119104 - DNA, 75 bp, Artificial Sequence
  Synthetic
gtcaccgtgccacatcccaatatcgaggaggtggccctgtccaacattggagagatccccttctacggcaaagcc

SEQ ID NO: 119105 - DNA, 75 bp, Artificial Sequence
  Synthetic
gacaagttcgatcaggggtggggtcctatcacctatgctgagggtcaaggcccggaccagaggccctactgctgg

SEQ ID NO: 119106 - DNA, 75 bp, Artificial Sequence
  Synthetic
cgctccaccaagctgggacaccatgtggaagtgcctaattcgccttaagcccaccctgcacgggcccacgcccct

SEQ ID NO: 119107 - DNA, 75 bp, Artificial Sequence
  Synthetic
caccatacccgcaagtgaggtctgtggtcccgtctactgcttcaccccgagtccggttgtggtagggaccactga

SEQ ID NO: 119108 - DNA, 75 bp, Artificial Sequence
  Synthetic
tgacaagtacatgggttctggcagggggggtgctagccgccgtggcagcttactgcctggcaaccggctgcattt

SEQ ID NO: 119109 - DNA, 75 bp, Artificial Sequence
  Synthetic
ggagacgtcgttgtcgtggcaacagacgctctaatgacgggctttaccggcgactttgactcagtgatcgactgt

SEQ ID NO: 119110 - DNA, 75 bp, Artificial Sequence
  Synthetic
tggatgaattctacggggttcaccaagacatgtggggcgcccccctgtatcatcgggccaaaagacaacaactcc

SEQ ID NO: 119111 - DNA, 75 bp, Artificial Sequence
  Synthetic
acaccgtcgtcctgtgtgaggcttatgacacgggatgcgcgtggtacgaactaaccccttctgaaacaactgtca

SEQ ID NO: 119112 - DNA, 75 bp, Artificial Sequence
  Synthetic
ccccacgcactatgtgcctgagagcgacgctgcagcgcgtgtcactcagatcctctccagccttaccatcactca

SEQ ID NO: 119113 - DNA, 75 bp, Artificial Sequence
  Synthetic
ctggaattttgggaaggcgtgtttactggcttgactcacatagacgcccactttctgtcccagacgaagcagggg

SEQ ID NO: 119114 - DNA, 75 bp, Artificial Sequence
  Synthetic
cctacaggctatggcactatccgtgcaccgtcaattttaccatccacaaggtgcgcattttcctcggagggctcg

SEQ ID NO: 119115 - DNA, 75 bp, Artificial Sequence
  Synthetic
gttgggtggcgatgacccccacggtggccaccagggacggcaaactccccacaacgcagcttcgacgtcacatcg

SEQ ID NO: 119116 - DNA, 75 bp, Artificial Sequence
  Synthetic
ggtgagaacttcgcgtacctcgtggcataccaggctacagtgtgcgccagggccaaagcccccccgccttcttgg

SEQ ID NO: 119117 - DNA, 75 bp, Artificial Sequence
  Synthetic
cgagctttcgatcttaccgtgcacgttttccactatgccagctctgtcgactggtttgatacatctccaccagaa

SEQ ID NO: 119118 - DNA, 75 bp, Artificial Sequence
  Synthetic
gcaactccttgctgcgtcaccacaacatggtctatgccacaacatcccgcagcgcaagccagcggcagaagaagg

SEQ ID NO: 119119 - DNA, 75 bp, Artificial Sequence
  Synthetic
aagggtaggctcgtgcccgcggctacttatggactgctgcagctgtggccgctcctgctccttatattggcgttg

SEQ ID NO: 119120 - DNA, 75 bp, Artificial Sequence
  Synthetic
ccgggcgaaggggccgtgcagtggatgaaccgtctaattgcgttcgcatcgcgaggcaatcacgtgtctcccacg

SEQ ID NO: 119121 - DNA, 75 bp, Artificial Sequence
  Synthetic
agcacatgtggaacttcatcagcgggatacagtacttagcaggcttgtccactctgcctgggaaccccgcaatag

SEQ ID NO: 119122 - DNA, 75 bp, Artificial Sequence
  Synthetic
tgggtcttgcacgtgctgagtgacttcaagacgtgcttaaaagcaaagttcgtgcccttaatgccaggcatcccc

SEQ ID NO: 119123 - DNA, 75 bp, Artificial Sequence
  Synthetic
tgacgcggtcatcttgctcacctgcctgcttcacccttccctcgggttcgacgtcacaaaagtgctcttggccct

SEQ ID NO: 119124 - DNA, 75 bp, Artificial Sequence
  Synthetic
cctagggccactgtaccttttccaagccagcgtattccgcataccgtattacgtgcgagctcatgttcttctacg

SEQ ID NO: 119125 - DNA, 75 bp, Artificial Sequence
  Synthetic
cgccaggggctctcgtggtgggggtcgtgtgtgctgccatcttaagacgccacgttggccctgctgagggtgcta

SEQ ID NO: 119126 - DNA, 75 bp, Artificial Sequence
  Synthetic
gtgggcgctggcattgccggtgcagctgttggcagcataggccttgggaaggtgcttgtggacatcttggcgggc

SEQ ID NO: 119127 - DNA, 75 bp, Artificial Sequence
  Synthetic
cggcgttgacggccataccaccgtgtcggggggggtggaaggccgcaccaccagcaggcttacgtctctctttac

SEQ ID NO: 119128 - DNA, 75 bp, Artificial Sequence
  Synthetic
tgagccggacaccgaggtattggcctccatgttgacagacccgtcccacattacagcggaggcggcagctaggcg

SEQ ID NO: 119129 - DNA, 75 bp, Artificial Sequence
  Synthetic
gagcggacacggctgcttgtggcgacatcttggcgggcctaccagtctctgcccggcgaggccgcttattactag

SEQ ID NO: 119130 - DNA, 75 bp, Artificial Sequence
  Synthetic
gggcgggaacatcacccgcgtggagtcagagaataaggtggtgattctggactcttttgatccgcttcgagcgga

SEQ ID NO: 119131 - DNA, 75 bp, Artificial Sequence
  Synthetic
acttggcacgggacttttccaatcaacgccaccactaccggccctagcacaccacgaccagcccccaactatcag

SEQ ID NO: 119132 - DNA, 75 bp, Artificial Sequence
  Synthetic
atccactccaactcccagccattattcaaagactccatggcatggccgcgttttcactccatgggtactctccag

SEQ ID NO: 119133 - DNA, 75 bp, Artificial Sequence
  Synthetic
aggggtcgtcgggcggaccagtcttgtgttcatctggccatgttgtcggcttgttccgagcggctgtgtgcactc

SEQ ID NO: 119134 - DNA, 75 bp, Artificial Sequence
  Synthetic
caccgggggagacagcgtccagcaaccctctgacgagattgccgcttcggaagcgggatcactgtcctccatgcc

SEQ ID NO: 119135 - DNA, 75 bp, Artificial Sequence
  Synthetic
caccgggggagacagcgtccagcaaccctctgacgagattgccgcttcggaagcgggatctctgtcctccatgcc

SEQ ID NO: 119136 - DNA, 75 bp, Artificial Sequence
  Synthetic
caccgggggagacagcgtccagcaaccctctgacgagattgccgcttcggaagcgggatccctgtcctccatgcc

SEQ ID NO: 119137 - DNA, 75 bp, Artificial Sequence
  Synthetic
caccgggggagacagcgtccagcaaccctctgacgagattgccgcttcggaagcgggatcgctgtcctccatgcc

SEQ ID NO: 119138 - DNA, 75 bp, Artificial Sequence
  Synthetic
caccgggggagacagcgtccagcatccctctgacgagattgccgcttcggaagcgggatcactgtcctccatgcc

SEQ ID NO: 119139 - DNA, 75 bp, Artificial Sequence
  Synthetic
caccgggggagacagcgtccagcatccctctgacgagattgccgcttcggaagcgggatctctgtcctccatgcc

SEQ ID NO: 119140 - DNA, 75 bp, Artificial Sequence
  Synthetic
caccgggggagacagcgtccagcatccctctgacgagattgccgcttcggaagcgggatccctgtcctccatgcc

SEQ ID NO: 119141 - DNA, 75 bp, Artificial Sequence
  Synthetic
caccgggggagacagcgtccagcatccctctgacgagattgccgcttcggaagcgggatcgctgtcctccatgcc

SEQ ID NO: 119142 - DNA, 75 bp, Artificial Sequence
  Synthetic
caccgggggagacagcgtccagcacccctctgacgagattgccgcttcggaagcgggatcactgtcctccatgcc

SEQ ID NO: 119143 - DNA, 75 bp, Artificial Sequence
  Synthetic
caccgggggagacagcgtccagcacccctctgacgagattgccgcttcggaagcgggatctctgtcctccatgcc

SEQ ID NO: 119144 - DNA, 75 bp, Artificial Sequence
  Synthetic
caccgggggagacagcgtccagcacccctctgacgagattgccgcttcggaagcgggatccctgtcctccatgcc

SEQ ID NO: 119145 - DNA, 75 bp, Artificial Sequence
  Synthetic
caccgggggagacagcgtccagcacccctctgacgagattgccgcttcggaagcgggatcgctgtcctccatgcc

SEQ ID NO: 119146 - DNA, 75 bp, Artificial Sequence
  Synthetic
caccgggggagacagcgtccagcagccctctgacgagattgccgcttcggaagcgggatcactgtcctccatgcc

SEQ ID NO: 119147 - DNA, 75 bp, Artificial Sequence
  Synthetic
caccgggggagacagcgtccagcagccctctgacgagattgccgcttcggaagcgggatctctgtcctccatgcc

SEQ ID NO: 119148 - DNA, 75 bp, Artificial Sequence
  Synthetic
caccgggggagacagcgtccagcagccctctgacgagattgccgcttcggaagcgggatccctgtcctccatgcc

SEQ ID NO: 119149 - DNA, 75 bp, Artificial Sequence
  Synthetic
caccgggggagacagcgtccagcagccctctgacgagattgccgcttcggaagcgggatcgctgtcctccatgcc

SEQ ID NO: 119150 - DNA, 75 bp, Artificial Sequence
  Synthetic
ttcctctggtgcctactcctactttccgtgggagtaggcatcttcctgctgcctgctcggtagacgggtagctta

SEQ ID NO: 119151 - DNA, 75 bp, Artificial Sequence
  Synthetic
gcaaacataccaagtggggtatttacatgctccgactggtagtgggaagagcacgaaagtgccagcagcgtatgc

SEQ ID NO: 119152 - DNA, 75 bp, Artificial Sequence
  Synthetic
gcacgaaagtgccagcagcgtatgcctctcagggctacaaggtgctggtgctcaatccatctgtggccgccaccc

SEQ ID NO: 119153 - DNA, 75 bp, Artificial Sequence
  Synthetic
agagaacaaagttgtagtacttgactcctttgagcctctaaccgctgagtatgacgagagggaaatctcagtatc

SEQ ID NO: 119154 - DNA, 75 bp, Artificial Sequence
  Synthetic
ccgtcgttggcgccccggttggcggagttgccagagctctcgcacatggtgtgagagtcctggaggacgggaata

SEQ ID NO: 119155 - DNA, 75 bp, Artificial Sequence
  Synthetic
tatgccttctacggcgtatggccgctgctcctgctcctgctggcgttaccaccacgagcatacgccatggaccgg

SEQ ID NO: 119156 - DNA, 75 bp, Artificial Sequence
  Synthetic
gggggagattcccttctatgggaaggccatccccttggactgcatcaaggggggcaggcatctgatcttctgcca

SEQ ID NO: 119157 - DNA, 75 bp, Artificial Sequence
  Synthetic
ttcacgcccagccctgttgtggtaggaaccactgacaggcggggcaaccccacatacacctggggggagaatgag

SEQ ID NO: 119158 - DNA, 75 bp, Artificial Sequence
  Synthetic
tgctcctgctcctgctggcgttaccaccacgagcatacgccatggaccgggagatggctgcatcatgtggaggcg

SEQ ID NO: 119159 - DNA, 75 bp, Artificial Sequence
  Synthetic
cacggtgtgcggccctgtctactgcttcacgcccagccctgttgtggtaggaaccactgacaggcggggcaaccc

SEQ ID NO: 119160 - DNA, 75 bp, Artificial Sequence
  Synthetic
tcacgttccaggatgtgttccatgcgagcagacgggcaatgcgtcccggtgttggataccggtcacacccaacgt

SEQ ID NO: 119161 - DNA, 75 bp, Artificial Sequence
  Synthetic
ggccattagccagcccggtgtcctcaccaaggggctacggacgcacatcgacaccatcgtgatgtctgctacgct

SEQ ID NO: 119162 - DNA, 75 bp, Artificial Sequence
  Synthetic
aactgctccatgtacccaggccacatcacaggacaccgcatggcgtgggatatgatgatgaatcggtcgccatca

SEQ ID NO: 119163 - DNA, 75 bp, Artificial Sequence
  Synthetic
acccgggatatacaggtacgtctcgcagggcgagcgaccgtctggcatgtttgactccattgtcctctgcgaggc

SEQ ID NO: 119164 - DNA, 75 bp, Artificial Sequence
  Synthetic
ggcctacgagaccttgcggtggcagttgagcccgttgttttctctgacatggagaccaagatcatcacctggggg

SEQ ID NO: 119165 - DNA, 75 bp, Artificial Sequence
  Synthetic
ccatgcaaggggcatgggcgaaggtccttgtcattttgctcctgaccgcgggggtagaggccactacaaatgttg

SEQ ID NO: 119166 - DNA, 75 bp, Artificial Sequence
  Synthetic
ttgagcccgttgttttctctgacatggagaccaagatcatcacctggggggcagacaccgcggcgtgtggggaca

SEQ ID NO: 119167 - DNA, 75 bp, Artificial Sequence
  Synthetic
gggggggaaaattttgcgtacctggttgcttaccaggcgaccgtgtgtgctcgggcgaaagcccctcccccctca

SEQ ID NO: 119168 - DNA, 75 bp, Artificial Sequence
  Synthetic
caaccgtacagctctgaattgcaacgacagtgtgaacactggcttcatcgcgtccttgttctacgcgcataaatt

SEQ ID NO: 119169 - DNA, 75 bp, Artificial Sequence
  Synthetic
tgggcttttcttatgacaccaggtgttttgattcaaccgtcaccgagcgggatatccggactgagaacgatatct

SEQ ID NO: 119170 - DNA, 75 bp, Artificial Sequence
  Synthetic
actgaggacatgaggccctattgctggcattatccgcctagaccatgcggtatagtgcccgcgcagtctgtctgt

SEQ ID NO: 119171 - DNA, 75 bp, Artificial Sequence
  Synthetic
gaccagggctggggccctatcagttatgccaacggaagtggctccgaccaacgcccttactgctggcactacccc

SEQ ID NO: 119172 - DNA, 75 bp, Artificial Sequence
  Synthetic
acagaacggctctacgtaggcggccccatggtgaactccaaggggcagtcatgtggctaccgtagatgccgcgcc

SEQ ID NO: 119173 - DNA, 75 bp, Artificial Sequence
  Synthetic
tggtttatgccacaacatcccgcagcgcgagccagcggcagaagaaggtcacctttgacagacagcaagtcctgg

SEQ ID NO: 119174 - DNA, 75 bp, Artificial Sequence
  Synthetic
tggatgaatgccactgggttcactaagacctgcggcgcgccaccctgccgcattaggggggacttcaatgccagc

SEQ ID NO: 119175 - DNA, 75 bp, Artificial Sequence
  Synthetic
actacccctacagactgtggcactacccgtgcacgatcaactacaccatcttcaagatacggatgtacgtagggg

SEQ ID NO: 119176 - DNA, 75 bp, Artificial Sequence
  Synthetic
ggccttgactagcccactggcgacctcaacgaccctcctccttaacatcttaggaggatgggtggcgtctcagct

SEQ ID NO: 119177 - DNA, 75 bp, Artificial Sequence
  Synthetic
ggctacggggcgggtgtctctggtgctttggtggccttcaagatcatgagtggagaggcgccagcaatcgaagac

SEQ ID NO: 119178 - DNA, 75 bp, Artificial Sequence
  Synthetic
atggcaagttccttgccgacggtggttgctctgggggcgcctatgacatcataatatgtgatgagtgccactcaa

SEQ ID NO: 119179 - DNA, 75 bp, Artificial Sequence
  Synthetic
cgaagtacgtcgtcaagtgggagtgggtagtcctcttgttcctgctgctagcagacgctagggtctgtgcttgtt

SEQ ID NO: 119180 - DNA, 75 bp, Artificial Sequence
  Synthetic
gaggaggtggccctgtccaacactggagagatccccttctatggcaaagccatccccatcgagaccatcaagggg

SEQ ID NO: 119181 - DNA, 75 bp, Artificial Sequence
  Synthetic
cctattgttctttgtgacggcctggtacatcaaaggccgggtggttccttttgctacctattctttactaggtat

SEQ ID NO: 119182 - DNA, 75 bp, Artificial Sequence
  Synthetic
ctgcaactgttctatctatcccggccatataacgggtcaccgcatggcatgggatatgatgatgaactggtcccc

SEQ ID NO: 119183 - DNA, 75 bp, Artificial Sequence
  Synthetic
tcgatgcagctgagcagggccagattggccttgtgcttttggtggtcatctctgtcatcacgcttaccccggcgt

SEQ ID NO: 119184 - DNA, 75 bp, Artificial Sequence
  Synthetic
ggcgatgtcgtcgtctgcgcaacagacgcccttatgaccggctacacaggcgatttcgattccgtcatcgactgt

SEQ ID NO: 119185 - DNA, 75 bp, Artificial Sequence
  Synthetic
acgcagttctccaccttcccggatgcgtcccatgtgagaatgacaatggcactttgcgctgctggatacaagtaa

SEQ ID NO: 119186 - DNA, 75 bp, Artificial Sequence
  Synthetic
actttgcgctgctggatacaagtaacacccaatgtggctgtgaaacaccgtggcgcactcacccacaacctgcga

SEQ ID NO: 119187 - DNA, 75 bp, Artificial Sequence
  Synthetic
attacgcaacagggaatcttcctggttgctccttttctatcttccttttggcacttctttcgtgcctcaccacac

SEQ ID NO: 119188 - DNA, 75 bp, Artificial Sequence
  Synthetic
attacgcaacagggaatcttcctggttgctccttttctatcttccttttggcacttctttcgtgcctcaccactc

SEQ ID NO: 119189 - DNA, 75 bp, Artificial Sequence
  Synthetic
attacgcaacagggaatcttcctggttgctccttttctatcttccttttggcacttctttcgtgcctcaccaccc

SEQ ID NO: 119190 - DNA, 75 bp, Artificial Sequence
  Synthetic
attacgcaacagggaatcttcctggttgctccttttctatcttccttttggcacttctttcgtgcctcaccacgc

SEQ ID NO: 119191 - DNA, 75 bp, Artificial Sequence
  Synthetic
ctcaggcatgtcttgacgactgtgccatattttgtcagggcgcgagccctgctcagaatatgtgccgtggtgaaa

SEQ ID NO: 119192 - DNA, 75 bp, Artificial Sequence
  Synthetic
gctcagaatatgtgccgtggtgaaacaccttgccggaggtaaatacatccagatggcattgatcgccattggcaa

SEQ ID NO: 119193 - DNA, 75 bp, Artificial Sequence
  Synthetic
gcaccttcctggatgtgtaccttgtgttagggtcggtaatcagtccagatgctggttgacggcttcgcccacgct

SEQ ID NO: 119194 - DNA, 75 bp, Artificial Sequence
  Synthetic
gcaccttcctggatgtgtaccttgtgttagggtcggtaatcagtccagatgctggttgtcggcttcgcccacgct

SEQ ID NO: 119195 - DNA, 75 bp, Artificial Sequence
  Synthetic
gcaccttcctggatgtgtaccttgtgttagggtcggtaatcagtccagatgctggttgccggcttcgcccacgct

SEQ ID NO: 119196 - DNA, 75 bp, Artificial Sequence
  Synthetic
gcaccttcctggatgtgtaccttgtgttagggtcggtaatcagtccagatgctggttggcggcttcgcccacgct

SEQ ID NO: 119197 - DNA, 75 bp, Artificial Sequence
  Synthetic
gcaccttcctggatgtgttccttgtgttagggtcggtaatcagtccagatgctggttgacggcttcgcccacgct

SEQ ID NO: 119198 - DNA, 75 bp, Artificial Sequence
  Synthetic
gcaccttcctggatgtgttccttgtgttagggtcggtaatcagtccagatgctggttgtcggcttcgcccacgct

SEQ ID NO: 119199 - DNA, 75 bp, Artificial Sequence
  Synthetic
gcaccttcctggatgtgttccttgtgttagggtcggtaatcagtccagatgctggttgccggcttcgcccacgct

SEQ ID NO: 119200 - DNA, 75 bp, Artificial Sequence
  Synthetic
gcaccttcctggatgtgttccttgtgttagggtcggtaatcagtccagatgctggttggcggcttcgcccacgct

SEQ ID NO: 119201 - DNA, 75 bp, Artificial Sequence
  Synthetic
gcaccttcctggatgtgtcccttgtgttagggtcggtaatcagtccagatgctggttgacggcttcgcccacgct

SEQ ID NO: 119202 - DNA, 75 bp, Artificial Sequence
  Synthetic
gcaccttcctggatgtgtcccttgtgttagggtcggtaatcagtccagatgctggttgtcggcttcgcccacgct

SEQ ID NO: 119203 - DNA, 75 bp, Artificial Sequence
  Synthetic
gcaccttcctggatgtgtcccttgtgttagggtcggtaatcagtccagatgctggttgccggcttcgcccacgct

SEQ ID NO: 119204 - DNA, 75 bp, Artificial Sequence
  Synthetic
gcaccttcctggatgtgtcccttgtgttagggtcggtaatcagtccagatgctggttggcggcttcgcccacgct

SEQ ID NO: 119205 - DNA, 75 bp, Artificial Sequence
  Synthetic
gcaccttcctggatgtgtgccttgtgttagggtcggtaatcagtccagatgctggttgacggcttcgcccacgct

SEQ ID NO: 119206 - DNA, 75 bp, Artificial Sequence
  Synthetic
gcaccttcctggatgtgtgccttgtgttagggtcggtaatcagtccagatgctggttgtcggcttcgcccacgct

SEQ ID NO: 119207 - DNA, 75 bp, Artificial Sequence
  Synthetic
gcaccttcctggatgtgtgccttgtgttagggtcggtaatcagtccagatgctggttgccggcttcgcccacgct

SEQ ID NO: 119208 - DNA, 75 bp, Artificial Sequence
  Synthetic
gcaccttcctggatgtgtgccttgtgttagggtcggtaatcagtccagatgctggttggcggcttcgcccacgct

SEQ ID NO: 119209 - DNA, 75 bp, Artificial Sequence
  Synthetic
agcccgatggagaagaaagtcatcatctggggagcggagacggcagcctgcggtgacatcatacacgggctcccc

SEQ ID NO: 119210 - DNA, 75 bp, Artificial Sequence
  Synthetic
tctggggagcggagacggcagcctgcggtgacatcatacacgggctccccgtgtccgcccggttgggccgagaag

SEQ ID NO: 119211 - DNA, 75 bp, Artificial Sequence
  Synthetic
ggatcaaatgtggaagtgtctcatacggctaaagcctacgctgcacgggccaacacccctgctgtataggctagg

SEQ ID NO: 119212 - DNA, 75 bp, Artificial Sequence
  Synthetic
ttgtgcggtggcctgttcctggttggacaacttttcactttcaggcctcgtatccaccaaaccgtccaggactgc

SEQ ID NO: 119213 - DNA, 75 bp, Artificial Sequence
  Synthetic
cgtctccaaggggtggaagctccttgcccccatcaccgcttacgctcagcagacccgtggcctggtgggtaccat

SEQ ID NO: 119214 - DNA, 75 bp, Artificial Sequence
  Synthetic
gctggacttgtccggctggttcgttgctggttacagcgggggagacatatatcacagcctgtctcgtgcccgacc

SEQ ID NO: 119215 - DNA, 75 bp, Artificial Sequence
  Synthetic
tgcgcgtgccccaattggtggtcgacgtatttgtcggtggccattggggcgtgctggctggcctggcgtattaca

SEQ ID NO: 119216 - DNA, 75 bp, Artificial Sequence
  Synthetic
ggttgctccttttctatcttcttgctggctctactgtcctgcatcactgttccggtctctgccgcccaagtgaag

SEQ ID NO: 119217 - DNA, 75 bp, Artificial Sequence
  Synthetic
gtcctctggactgtcttccacggtgctgggaacaagacgctggctggctcgcgagggccagtcacgcagatgtac

SEQ ID NO: 119218 - DNA, 75 bp, Artificial Sequence
  Synthetic
ggcggccgagtgccacaggccgcctagacctaaataaccaccagcgttgcccatatgggcaaggcctgactacaa

SEQ ID NO: 119219 - DNA, 75 bp, Artificial Sequence
  Synthetic
ggcggccgagtgccacaggccgcctagacctaaataaccacctgcgttgcccatatgggcaaggcctgactacaa

SEQ ID NO: 119220 - DNA, 75 bp, Artificial Sequence
  Synthetic
ggcggccgagtgccacaggccgcctagacctaaataaccacccgcgttgcccatatgggcaaggcctgactacaa

SEQ ID NO: 119221 - DNA, 75 bp, Artificial Sequence
  Synthetic
ggcggccgagtgccacaggccgcctagacctaaataaccaccggcgttgcccatatgggcaaggcctgactacaa

SEQ ID NO: 119222 - DNA, 75 bp, Artificial Sequence
  Synthetic
ggcggccgagtgccacaggccgcctagacctaaatatccaccagcgttgcccatatgggcaaggcctgactacaa

SEQ ID NO: 119223 - DNA, 75 bp, Artificial Sequence
  Synthetic
ggcggccgagtgccacaggccgcctagacctaaatatccacctgcgttgcccatatgggcaaggcctgactacaa

SEQ ID NO: 119224 - DNA, 75 bp, Artificial Sequence
  Synthetic
ggcggccgagtgccacaggccgcctagacctaaatatccacccgcgttgcccatatgggcaaggcctgactacaa

SEQ ID NO: 119225 - DNA, 75 bp, Artificial Sequence
  Synthetic
ggcggccgagtgccacaggccgcctagacctaaatatccaccggcgttgcccatatgggcaaggcctgactacaa

SEQ ID NO: 119226 - DNA, 75 bp, Artificial Sequence
  Synthetic
ggcggccgagtgccacaggccgcctagacctaaatacccaccagcgttgcccatatgggcaaggcctgactacaa

SEQ ID NO: 119227 - DNA, 75 bp, Artificial Sequence
  Synthetic
ggcggccgagtgccacaggccgcctagacctaaatacccacctgcgttgcccatatgggcaaggcctgactacaa

SEQ ID NO: 119228 - DNA, 75 bp, Artificial Sequence
  Synthetic
ggcggccgagtgccacaggccgcctagacctaaatacccacccgcgttgcccatatgggcaaggcctgactacaa

SEQ ID NO: 119229 - DNA, 75 bp, Artificial Sequence
  Synthetic
ggcggccgagtgccacaggccgcctagacctaaatacccaccggcgttgcccatatgggcaaggcctgactacaa

SEQ ID NO: 119230 - DNA, 75 bp, Artificial Sequence
  Synthetic
ggcggccgagtgccacaggccgcctagacctaaatagccaccagcgttgcccatatgggcaaggcctgactacaa

SEQ ID NO: 119231 - DNA, 75 bp, Artificial Sequence
  Synthetic
ggcggccgagtgccacaggccgcctagacctaaatagccacctgcgttgcccatatgggcaaggcctgactacaa

SEQ ID NO: 119232 - DNA, 75 bp, Artificial Sequence
  Synthetic
ggcggccgagtgccacaggccgcctagacctaaatagccacccgcgttgcccatatgggcaaggcctgactacaa

SEQ ID NO: 119233 - DNA, 75 bp, Artificial Sequence
  Synthetic
ggcggccgagtgccacaggccgcctagacctaaatagccaccggcgttgcccatatgggcaaggcctgactacaa

SEQ ID NO: 119234 - DNA, 75 bp, Artificial Sequence
  Synthetic
ggtggggaaccctggaatatgagactaatgtcactaatgatgaggacatgcggtcatactgctggcattaccctc

SEQ ID NO: 119235 - DNA, 75 bp, Artificial Sequence
  Synthetic
tggtgggattgcaggtcttttcatgccgggtgctaagcagaacatccagctcattaattcgaatggcagctggca

SEQ ID NO: 119236 - DNA, 75 bp, Artificial Sequence
  Synthetic
gcgagaaagtggggaacacatctcagtgctggataccggtctcgccaaacgtagccgtccggcagcccggcgccc

SEQ ID NO: 119237 - DNA, 75 bp, Artificial Sequence
  Synthetic
atagcgtatttctccatggtggggaactgggcgaaggtcctggtagtgctgctgctatttgccggcgtcgacgcg

SEQ ID NO: 119238 - DNA, 75 bp, Artificial Sequence
  Synthetic
gtaatgccgatgtcatcccggctcggaggcggggagaccgccggggagcactgctctctccacggcccctgtcat

SEQ ID NO: 119239 - DNA, 75 bp, Artificial Sequence
  Synthetic
cgaaggaagaaggtcgtgcaacttgatgactcagctgctgcagctgcgctcgcagagcttgctcgcaagagcttt

SEQ ID NO: 119240 - DNA, 75 bp, Artificial Sequence
  Synthetic
cgtaggaagaaggtcgtgcaacttgatgactcagctgctgcagctgcgctcgcagagcttgctcgcaagagcttt

SEQ ID NO: 119241 - DNA, 75 bp, Artificial Sequence
  Synthetic
cgcaggaagaaggtcgtgcaacttgatgactcagctgctgcagctgcgctcgcagagcttgctcgcaagagcttt

SEQ ID NO: 119242 - DNA, 75 bp, Artificial Sequence
  Synthetic
cggaggaagaaggtcgtgcaacttgatgactcagctgctgcagctgcgctcgcagagcttgctcgcaagagcttt

SEQ ID NO: 119243 - DNA, 75 bp, Artificial Sequence
  Synthetic
ctgctctctccacggcccctgtcatctcttaaggggtcatcgggaggaccggtcctctgtcccagggggcatgca

SEQ ID NO: 119244 - DNA, 75 bp, Artificial Sequence
  Synthetic
cggatgtcctcatgcaagcatcttactcattttgatcagggttggggccctatcacctatgcaaacataagtggg

SEQ ID NO: 119245 - DNA, 75 bp, Artificial Sequence
  Synthetic
cggatgtcctcatgcaagcatcttactcattttgatcagggttggggccctatcacctatgctaacataagtggg

SEQ ID NO: 119246 - DNA, 75 bp, Artificial Sequence
  Synthetic
cggatgtcctcatgcaagcatcttactcattttgatcagggttggggccctatcacctatgccaacataagtggg

SEQ ID NO: 119247 - DNA, 75 bp, Artificial Sequence
  Synthetic
cggatgtcctcatgcaagcatcttactcattttgatcagggttggggccctatcacctatgcgaacataagtggg

SEQ ID NO: 119248 - DNA, 75 bp, Artificial Sequence
  Synthetic
cggatgtcctcatgcaagcatctttctcattttgatcagggttggggccctatcacctatgcaaacataagtggg

SEQ ID NO: 119249 - DNA, 75 bp, Artificial Sequence
  Synthetic
cggatgtcctcatgcaagcatctttctcattttgatcagggttggggccctatcacctatgctaacataagtggg

SEQ ID NO: 119250 - DNA, 75 bp, Artificial Sequence
  Synthetic
cggatgtcctcatgcaagcatctttctcattttgatcagggttggggccctatcacctatgccaacataagtggg

SEQ ID NO: 119251 - DNA, 75 bp, Artificial Sequence
  Synthetic
cggatgtcctcatgcaagcatctttctcattttgatcagggttggggccctatcacctatgcgaacataagtggg

SEQ ID NO: 119252 - DNA, 75 bp, Artificial Sequence
  Synthetic
cggatgtcctcatgcaagcatcttcctcattttgatcagggttggggccctatcacctatgcaaacataagtggg

SEQ ID NO: 119253 - DNA, 75 bp, Artificial Sequence
  Synthetic
cggatgtcctcatgcaagcatcttcctcattttgatcagggttggggccctatcacctatgctaacataagtggg

SEQ ID NO: 119254 - DNA, 75 bp, Artificial Sequence
  Synthetic
cggatgtcctcatgcaagcatcttcctcattttgatcagggttggggccctatcacctatgccaacataagtggg

SEQ ID NO: 119255 - DNA, 75 bp, Artificial Sequence
  Synthetic
cggatgtcctcatgcaagcatcttcctcattttgatcagggttggggccctatcacctatgcgaacataagtggg

SEQ ID NO: 119256 - DNA, 75 bp, Artificial Sequence
  Synthetic
cggatgtcctcatgcaagcatcttgctcattttgatcagggttggggccctatcacctatgcaaacataagtggg

SEQ ID NO: 119257 - DNA, 75 bp, Artificial Sequence
  Synthetic
cggatgtcctcatgcaagcatcttgctcattttgatcagggttggggccctatcacctatgctaacataagtggg

SEQ ID NO: 119258 - DNA, 75 bp, Artificial Sequence
  Synthetic
cggatgtcctcatgcaagcatcttgctcattttgatcagggttggggccctatcacctatgccaacataagtggg

SEQ ID NO: 119259 - DNA, 75 bp, Artificial Sequence
  Synthetic
cggatgtcctcatgcaagcatcttgctcattttgatcagggttggggccctatcacctatgcgaacataagtggg

SEQ ID NO: 119260 - DNA, 75 bp, Artificial Sequence
  Synthetic
cggatgtcctcatgcaagcttcttactcattttgatcagggttggggccctatcacctatgcaaacataagtggg

SEQ ID NO: 119261 - DNA, 75 bp, Artificial Sequence
  Synthetic
cggatgtcctcatgcaagcttcttactcattttgatcagggttggggccctatcacctatgctaacataagtggg

SEQ ID NO: 119262 - DNA, 75 bp, Artificial Sequence
  Synthetic
cggatgtcctcatgcaagcttcttactcattttgatcagggttggggccctatcacctatgccaacataagtggg

SEQ ID NO: 119263 - DNA, 75 bp, Artificial Sequence
  Synthetic
cggatgtcctcatgcaagcttcttactcattttgatcagggttggggccctatcacctatgcgaacataagtggg

SEQ ID NO: 119264 - DNA, 75 bp, Artificial Sequence
  Synthetic
cggatgtcctcatgcaagcttctttctcattttgatcagggttggggccctatcacctatgcaaacataagtggg

SEQ ID NO: 119265 - DNA, 75 bp, Artificial Sequence
  Synthetic
cggatgtcctcatgcaagcttctttctcattttgatcagggttggggccctatcacctatgctaacataagtggg

SEQ ID NO: 119266 - DNA, 75 bp, Artificial Sequence
  Synthetic
cggatgtcctcatgcaagcttctttctcattttgatcagggttggggccctatcacctatgccaacataagtggg

SEQ ID NO: 119267 - DNA, 75 bp, Artificial Sequence
  Synthetic
cggatgtcctcatgcaagcttctttctcattttgatcagggttggggccctatcacctatgcgaacataagtggg

SEQ ID NO: 119268 - DNA, 75 bp, Artificial Sequence
  Synthetic
cggatgtcctcatgcaagcttcttcctcattttgatcagggttggggccctatcacctatgcaaacataagtggg

SEQ ID NO: 119269 - DNA, 75 bp, Artificial Sequence
  Synthetic
cggatgtcctcatgcaagcttcttcctcattttgatcagggttggggccctatcacctatgctaacataagtggg

SEQ ID NO: 119270 - DNA, 75 bp, Artificial Sequence
  Synthetic
cggatgtcctcatgcaagcttcttcctcattttgatcagggttggggccctatcacctatgccaacataagtggg

SEQ ID NO: 119271 - DNA, 75 bp, Artificial Sequence
  Synthetic
cggatgtcctcatgcaagcttcttcctcattttgatcagggttggggccctatcacctatgcgaacataagtggg

SEQ ID NO: 119272 - DNA, 75 bp, Artificial Sequence
  Synthetic
cggatgtcctcatgcaagcttcttgctcattttgatcagggttggggccctatcacctatgcaaacataagtggg

SEQ ID NO: 119273 - DNA, 75 bp, Artificial Sequence
  Synthetic
cggatgtcctcatgcaagcttcttgctcattttgatcagggttggggccctatcacctatgctaacataagtggg

SEQ ID NO: 119274 - DNA, 75 bp, Artificial Sequence
  Synthetic
cggatgtcctcatgcaagcttcttgctcattttgatcagggttggggccctatcacctatgccaacataagtggg

SEQ ID NO: 119275 - DNA, 75 bp, Artificial Sequence
  Synthetic
cggatgtcctcatgcaagcttcttgctcattttgatcagggttggggccctatcacctatgcgaacataagtggg

SEQ ID NO: 119276 - DNA, 75 bp, Artificial Sequence
  Synthetic
cggatgtcctcatgcaagcctcttactcattttgatcagggttggggccctatcacctatgcaaacataagtggg

SEQ ID NO: 119277 - DNA, 75 bp, Artificial Sequence
  Synthetic
cggatgtcctcatgcaagcctcttactcattttgatcagggttggggccctatcacctatgctaacataagtggg

SEQ ID NO: 119278 - DNA, 75 bp, Artificial Sequence
  Synthetic
cggatgtcctcatgcaagcctcttactcattttgatcagggttggggccctatcacctatgccaacataagtggg

SEQ ID NO: 119279 - DNA, 75 bp, Artificial Sequence
  Synthetic
cggatgtcctcatgcaagcctcttactcattttgatcagggttggggccctatcacctatgcgaacataagtggg

SEQ ID NO: 119280 - DNA, 75 bp, Artificial Sequence
  Synthetic
cggatgtcctcatgcaagcctctttctcattttgatcagggttggggccctatcacctatgcaaacataagtggg

SEQ ID NO: 119281 - DNA, 75 bp, Artificial Sequence
  Synthetic
cggatgtcctcatgcaagcctctttctcattttgatcagggttggggccctatcacctatgctaacataagtggg

SEQ ID NO: 119282 - DNA, 75 bp, Artificial Sequence
  Synthetic
cggatgtcctcatgcaagcctctttctcattttgatcagggttggggccctatcacctatgccaacataagtggg

SEQ ID NO: 119283 - DNA, 75 bp, Artificial Sequence
  Synthetic
cggatgtcctcatgcaagcctctttctcattttgatcagggttggggccctatcacctatgcgaacataagtggg

SEQ ID NO: 119284 - DNA, 75 bp, Artificial Sequence
  Synthetic
cggatgtcctcatgcaagcctcttcctcattttgatcagggttggggccctatcacctatgcaaacataagtggg

SEQ ID NO: 119285 - DNA, 75 bp, Artificial Sequence
  Synthetic
cggatgtcctcatgcaagcctcttcctcattttgatcagggttggggccctatcacctatgctaacataagtggg

SEQ ID NO: 119286 - DNA, 75 bp, Artificial Sequence
  Synthetic
cggatgtcctcatgcaagcctcttcctcattttgatcagggttggggccctatcacctatgccaacataagtggg

SEQ ID NO: 119287 - DNA, 75 bp, Artificial Sequence
  Synthetic
cggatgtcctcatgcaagcctcttcctcattttgatcagggttggggccctatcacctatgcgaacataagtggg

SEQ ID NO: 119288 - DNA, 75 bp, Artificial Sequence
  Synthetic
cggatgtcctcatgcaagcctcttgctcattttgatcagggttggggccctatcacctatgcaaacataagtggg

SEQ ID NO: 119289 - DNA, 75 bp, Artificial Sequence
  Synthetic
cggatgtcctcatgcaagcctcttgctcattttgatcagggttggggccctatcacctatgctaacataagtggg

SEQ ID NO: 119290 - DNA, 75 bp, Artificial Sequence
  Synthetic
cggatgtcctcatgcaagcctcttgctcattttgatcagggttggggccctatcacctatgccaacataagtggg

SEQ ID NO: 119291 - DNA, 75 bp, Artificial Sequence
  Synthetic
cggatgtcctcatgcaagcctcttgctcattttgatcagggttggggccctatcacctatgcgaacataagtggg

SEQ ID NO: 119292 - DNA, 75 bp, Artificial Sequence
  Synthetic
cggatgtcctcatgcaagcgtcttactcattttgatcagggttggggccctatcacctatgcaaacataagtggg

SEQ ID NO: 119293 - DNA, 75 bp, Artificial Sequence
  Synthetic
cggatgtcctcatgcaagcgtcttactcattttgatcagggttggggccctatcacctatgctaacataagtggg

SEQ ID NO: 119294 - DNA, 75 bp, Artificial Sequence
  Synthetic
cggatgtcctcatgcaagcgtcttactcattttgatcagggttggggccctatcacctatgccaacataagtggg

SEQ ID NO: 119295 - DNA, 75 bp, Artificial Sequence
  Synthetic
cggatgtcctcatgcaagcgtcttactcattttgatcagggttggggccctatcacctatgcgaacataagtggg

SEQ ID NO: 119296 - DNA, 75 bp, Artificial Sequence
  Synthetic
cggatgtcctcatgcaagcgtctttctcattttgatcagggttggggccctatcacctatgcaaacataagtggg

SEQ ID NO: 119297 - DNA, 75 bp, Artificial Sequence
  Synthetic
cggatgtcctcatgcaagcgtctttctcattttgatcagggttggggccctatcacctatgctaacataagtggg

SEQ ID NO: 119298 - DNA, 75 bp, Artificial Sequence
  Synthetic
cggatgtcctcatgcaagcgtctttctcattttgatcagggttggggccctatcacctatgccaacataagtggg

SEQ ID NO: 119299 - DNA, 75 bp, Artificial Sequence
  Synthetic
cggatgtcctcatgcaagcgtctttctcattttgatcagggttggggccctatcacctatgcgaacataagtggg

SEQ ID NO: 119300 - DNA, 75 bp, Artificial Sequence
  Synthetic
cggatgtcctcatgcaagcgtcttcctcattttgatcagggttggggccctatcacctatgcaaacataagtggg

SEQ ID NO: 119301 - DNA, 75 bp, Artificial Sequence
  Synthetic
cggatgtcctcatgcaagcgtcttcctcattttgatcagggttggggccctatcacctatgctaacataagtggg

SEQ ID NO: 119302 - DNA, 75 bp, Artificial Sequence
  Synthetic
cggatgtcctcatgcaagcgtcttcctcattttgatcagggttggggccctatcacctatgccaacataagtggg

SEQ ID NO: 119303 - DNA, 75 bp, Artificial Sequence
  Synthetic
cggatgtcctcatgcaagcgtcttcctcattttgatcagggttggggccctatcacctatgcgaacataagtggg

SEQ ID NO: 119304 - DNA, 75 bp, Artificial Sequence
  Synthetic
cggatgtcctcatgcaagcgtcttgctcattttgatcagggttggggccctatcacctatgcaaacataagtggg

SEQ ID NO: 119305 - DNA, 75 bp, Artificial Sequence
  Synthetic
cggatgtcctcatgcaagcgtcttgctcattttgatcagggttggggccctatcacctatgctaacataagtggg

SEQ ID NO: 119306 - DNA, 75 bp, Artificial Sequence
  Synthetic
cggatgtcctcatgcaagcgtcttgctcattttgatcagggttggggccctatcacctatgccaacataagtggg

SEQ ID NO: 119307 - DNA, 75 bp, Artificial Sequence
  Synthetic
cggatgtcctcatgcaagcgtcttgctcattttgatcagggttggggccctatcacctatgcgaacataagtggg

SEQ ID NO: 119308 - DNA, 75 bp, Artificial Sequence
  Synthetic
agcccagatgttcattgtctcaccgcaaacccattggtttgttcaggagtgcaattgctccatctatcctggtgc

SEQ ID NO: 119309 - DNA, 75 bp, Artificial Sequence
  Synthetic
ggtgcccgctcattgacaccctgcacctgcggctcctcggacctttatctggtcacgaggcacgccgatgtcatt

SEQ ID NO: 119310 - DNA, 75 bp, Artificial Sequence
  Synthetic
gcccacctatacctggggggaaaatgagaccgatgtcttcctgctaaatagcacaagacccccgcaaggagcttg

SEQ ID NO: 119311 - DNA, 75 bp, Artificial Sequence
  Synthetic
gggggacttccactacgtgacgggtatgactactgacaatcttaaatgcccgtgccaggtcccatcgcccgaatt

SEQ ID NO: 119312 - DNA, 75 bp, Artificial Sequence
  Synthetic
gccctgtggtggtaggaactacagacaggaagggagtgcccacctacaactggggtgggaatgagtctgatgtgt

SEQ ID NO: 119313 - DNA, 75 bp, Artificial Sequence
  Synthetic
ggaaaagcaccaaggtccccgcggcgtacgcagcccaggggtacaaggtgctagtgctgaacccctctgtagctg

SEQ ID NO: 119314 - DNA, 75 bp, Artificial Sequence
  Synthetic
ccggtggggtcgcaactaccttgcgaacccgaaccggacgtgtccgtgttgacgtccatgctcactgatccctcc

SEQ ID NO: 119315 - DNA, 75 bp, Artificial Sequence
  Synthetic
acccatcagtccgatgagtaactctctcatacgccaccacaatctggtgtatgccaccacctcacgtagtgctcc

SEQ ID NO: 119316 - DNA, 75 bp, Artificial Sequence
  Synthetic
ctttagtagcgccgcgcacaacgcctacagccttgccagagtatttactgctggcgccaagcagaacatccagct

SEQ ID NO: 119317 - DNA, 75 bp, Artificial Sequence
  Synthetic
aatcaggccagcaggcgaccacaactcaaataccaccttaacctgccccactgactgcttcaggaaacatccagg

SEQ ID NO: 119318 - DNA, 75 bp, Artificial Sequence
  Synthetic
aatcaggccagcaggcgaccacaactcaaataccaccttaacctgccccactgactgcttcaggaaacatcctgg

SEQ ID NO: 119319 - DNA, 75 bp, Artificial Sequence
  Synthetic
aatcaggccagcaggcgaccacaactcaaataccaccttaacctgccccactgactgcttcaggaaacatcccgg

SEQ ID NO: 119320 - DNA, 75 bp, Artificial Sequence
  Synthetic
aatcaggccagcaggcgaccacaactcaaataccaccttaacctgccccactgactgcttcaggaaacatccggg

SEQ ID NO: 119321 - DNA, 75 bp, Artificial Sequence
  Synthetic
aatcaggccagcaggcgaccacaactcaaataccaccttaacctgccccactgactgcttctggaaacatccagg

SEQ ID NO: 119322 - DNA, 75 bp, Artificial Sequence
  Synthetic
aatcaggccagcaggcgaccacaactcaaataccaccttaacctgccccactgactgcttctggaaacatcctgg

SEQ ID NO: 119323 - DNA, 75 bp, Artificial Sequence
  Synthetic
aatcaggccagcaggcgaccacaactcaaataccaccttaacctgccccactgactgcttctggaaacatcccgg

SEQ ID NO: 119324 - DNA, 75 bp, Artificial Sequence
  Synthetic
aatcaggccagcaggcgaccacaactcaaataccaccttaacctgccccactgactgcttctggaaacatccggg

SEQ ID NO: 119325 - DNA, 75 bp, Artificial Sequence
  Synthetic
aatcaggccagcaggcgaccacaactcaaataccaccttaacctgccccactgactgcttccggaaacatccagg

SEQ ID NO: 119326 - DNA, 75 bp, Artificial Sequence
  Synthetic
aatcaggccagcaggcgaccacaactcaaataccaccttaacctgccccactgactgcttccggaaacatcctgg

SEQ ID NO: 119327 - DNA, 75 bp, Artificial Sequence
  Synthetic
aatcaggccagcaggcgaccacaactcaaataccaccttaacctgccccactgactgcttccggaaacatcccgg

SEQ ID NO: 119328 - DNA, 75 bp, Artificial Sequence
  Synthetic
aatcaggccagcaggcgaccacaactcaaataccaccttaacctgccccactgactgcttccggaaacatccggg

SEQ ID NO: 119329 - DNA, 75 bp, Artificial Sequence
  Synthetic
aatcaggccagcaggcgaccacaactcaaataccaccttaacctgccccactgactgcttcgggaaacatccagg

SEQ ID NO: 119330 - DNA, 75 bp, Artificial Sequence
  Synthetic
aatcaggccagcaggcgaccacaactcaaataccaccttaacctgccccactgactgcttcgggaaacatcctgg

SEQ ID NO: 119331 - DNA, 75 bp, Artificial Sequence
  Synthetic
aatcaggccagcaggcgaccacaactcaaataccaccttaacctgccccactgactgcttcgggaaacatcccgg

SEQ ID NO: 119332 - DNA, 75 bp, Artificial Sequence
  Synthetic
aatcaggccagcaggcgaccacaactcaaataccaccttaacctgccccactgactgcttcgggaaacatccggg

SEQ ID NO: 119333 - DNA, 75 bp, Artificial Sequence
  Synthetic
atgacatcataatgtgcgatgagtgccactcagtggattctacaaccatccttggcatcgggactgtccttgatc

SEQ ID NO: 119334 - DNA, 75 bp, Artificial Sequence
  Synthetic
ttgcgctacctcatggttgcgcgacgtgtgggactgggtgtgcacagtgttatctgattttaaagtatggctgca

SEQ ID NO: 119335 - DNA, 75 bp, Artificial Sequence
  Synthetic
accatccacaaggtccgtatgttcgtagggggacttgagcatcggtttgaagccgcgtgtaattggacccgtgga

SEQ ID NO: 119336 - DNA, 75 bp, Artificial Sequence
  Synthetic
ctgcgttgtccacgggactgatacacttgcaccaaaacatcgtggatgttcagtacctctatggcatatccccat

SEQ ID NO: 119337 - DNA, 75 bp, Artificial Sequence
  Synthetic
ctgcgttgtccacgggactgatacacttgcaccaaaacatcgtggatgttcagtacctctatggcatatcccctt

SEQ ID NO: 119338 - DNA, 75 bp, Artificial Sequence
  Synthetic
ctgcgttgtccacgggactgatacacttgcaccaaaacatcgtggatgttcagtacctctatggcatatccccct

SEQ ID NO: 119339 - DNA, 75 bp, Artificial Sequence
  Synthetic
ctgcgttgtccacgggactgatacacttgcaccaaaacatcgtggatgttcagtacctctatggcatatccccgt

SEQ ID NO: 119340 - DNA, 75 bp, Artificial Sequence
  Synthetic
ctgtcattcaaaaaagaaatgcgatgagctcgcgtctgccttacgcggcatgggtctcaacgcagtggcatacta

SEQ ID NO: 119341 - DNA, 75 bp, Artificial Sequence
  Synthetic
tgggtctcaacgcagtggcatactacagggggctagacgtctccgtaatcccaactcaaggagacgtggtggttg

SEQ ID NO: 119342 - DNA, 75 bp, Artificial Sequence
  Synthetic
aggccaggcagaggccgcattagagaatttgattattctcaacgctgcttctgctgctagcgtgcatggatgggg

SEQ ID NO: 119343 - DNA, 75 bp, Artificial Sequence
  Synthetic
cgtatcagagctgactttaatgccagcgcggacctgctgtgccccacggactgttttaggaaacatcctgaggcc

SEQ ID NO: 119344 - DNA, 75 bp, Artificial Sequence
  Synthetic
cacctttgccataaccacacagactgttcctcaagacgcggtgtcgcgcagccaacggcgagggaggacgggcag

SEQ ID NO: 119345 - DNA, 75 bp, Artificial Sequence
  Synthetic
gtactggcattgccccaaagagcttttgcttatgatcgagagcaagcggcttccattggcatagttgtcatcgtt

SEQ ID NO: 119346 - DNA, 75 bp, Artificial Sequence
  Synthetic
gaatgtttgactccgtggtgctctgcgaatgctacgatgctggcgctgcgtggtatgaactcacaccagcggaga

SEQ ID NO: 119347 - DNA, 75 bp, Artificial Sequence
  Synthetic
agatgcccacttcctctctcagacaaagcaatcgggggagaacttcccgtatctagtggcctaccaagccactgt

SEQ ID NO: 119348 - DNA, 75 bp, Artificial Sequence
  Synthetic
atgtgtgggttccaagtcttaaagtgagggggggtcgtgacgccatcatcctgatcacatgtttattacacccct

SEQ ID NO: 119349 - DNA, 75 bp, Artificial Sequence
  Synthetic
atgtgtgggttccaagtcttaaagtgagggggggtcgtgacgccatcatcctgatcacatgttttttacacccct

SEQ ID NO: 119350 - DNA, 75 bp, Artificial Sequence
  Synthetic
atgtgtgggttccaagtcttaaagtgagggggggtcgtgacgccatcatcctgatcacatgtttcttacacccct

SEQ ID NO: 119351 - DNA, 75 bp, Artificial Sequence
  Synthetic
atgtgtgggttccaagtcttaaagtgagggggggtcgtgacgccatcatcctgatcacatgtttgttacacccct

SEQ ID NO: 119352 - DNA, 75 bp, Artificial Sequence
  Synthetic
atgtgtgggttcctagtcttaaagtgagggggggtcgtgacgccatcatcctgatcacatgtttattacacccct

SEQ ID NO: 119353 - DNA, 75 bp, Artificial Sequence
  Synthetic
atgtgtgggttcctagtcttaaagtgagggggggtcgtgacgccatcatcctgatcacatgttttttacacccct

SEQ ID NO: 119354 - DNA, 75 bp, Artificial Sequence
  Synthetic
atgtgtgggttcctagtcttaaagtgagggggggtcgtgacgccatcatcctgatcacatgtttcttacacccct

SEQ ID NO: 119355 - DNA, 75 bp, Artificial Sequence
  Synthetic
atgtgtgggttcctagtcttaaagtgagggggggtcgtgacgccatcatcctgatcacatgtttgttacacccct

SEQ ID NO: 119356 - DNA, 75 bp, Artificial Sequence
  Synthetic
atgtgtgggttcccagtcttaaagtgagggggggtcgtgacgccatcatcctgatcacatgtttattacacccct

SEQ ID NO: 119357 - DNA, 75 bp, Artificial Sequence
  Synthetic
atgtgtgggttcccagtcttaaagtgagggggggtcgtgacgccatcatcctgatcacatgttttttacacccct

SEQ ID NO: 119358 - DNA, 75 bp, Artificial Sequence
  Synthetic
atgtgtgggttcccagtcttaaagtgagggggggtcgtgacgccatcatcctgatcacatgtttcttacacccct

SEQ ID NO: 119359 - DNA, 75 bp, Artificial Sequence
  Synthetic
atgtgtgggttcccagtcttaaagtgagggggggtcgtgacgccatcatcctgatcacatgtttgttacacccct

SEQ ID NO: 119360 - DNA, 75 bp, Artificial Sequence
  Synthetic
atgtgtgggttccgagtcttaaagtgagggggggtcgtgacgccatcatcctgatcacatgtttattacacccct

SEQ ID NO: 119361 - DNA, 75 bp, Artificial Sequence
  Synthetic
atgtgtgggttccgagtcttaaagtgagggggggtcgtgacgccatcatcctgatcacatgttttttacacccct

SEQ ID NO: 119362 - DNA, 75 bp, Artificial Sequence
  Synthetic
atgtgtgggttccgagtcttaaagtgagggggggtcgtgacgccatcatcctgatcacatgtttcttacacccct

SEQ ID NO: 119363 - DNA, 75 bp, Artificial Sequence
  Synthetic
atgtgtgggttccgagtcttaaagtgagggggggtcgtgacgccatcatcctgatcacatgtttgttacacccct

SEQ ID NO: 119364 - DNA, 75 bp, Artificial Sequence
  Synthetic
aagcaatcgggggagaacttcccgtatctagtggcctaccaagccactgtgtgtgctagggcgaaggctccccct

SEQ ID NO: 119365 - DNA, 75 bp, Artificial Sequence
  Synthetic
cgtcttggagcggtcagcaatgaggttacccttacccaccccgtgactaaatacatcgccacgtgcatgcaggcc

SEQ ID NO: 119366 - DNA, 75 bp, Artificial Sequence
  Synthetic
tgctctgctacaggcgtgcctgatggtacggcgcctgacctgtggcaaatacgcgcaggccttattgttgaggat

SEQ ID NO: 119367 - DNA, 75 bp, Artificial Sequence
  Synthetic
tgggcgcgcccggactacaaccctccactgctagagtcctggaaggacccggactacgtccctccagtggtacac

SEQ ID NO: 119368 - DNA, 75 bp, Artificial Sequence
  Synthetic
tgctccacaaggccctggactttgacatgtacggggtcacatactccatcactccattagatctgccgcaaatca

SEQ ID NO: 119369 - DNA, 75 bp, Artificial Sequence
  Synthetic
gcgtgtgtgttaatcaaaggacagttgttgcccccgataaagaagtcctctacgaggcgtttgacgagatggagg

SEQ ID NO: 119370 - DNA, 75 bp, Artificial Sequence
  Synthetic
atattctcacccatggagaagaaggtcatcacctggggggcggacacagctgcttgtggcgacatactcgccggc

SEQ ID NO: 119371 - DNA, 75 bp, Artificial Sequence
  Synthetic
tagcattgccccaacaggcttatgcttatgacgcacctatgcatggacagctgggcgcagctttgttggcgttga

SEQ ID NO: 119372 - DNA, 75 bp, Artificial Sequence
  Synthetic
cccctccaataccacctccacggaggaagaggacggtcgtcctgacagaatccaccgtgtcttctgccctggcgg

SEQ ID NO: 119373 - DNA, 75 bp, Artificial Sequence
  Synthetic
agcttgccacaaagaccttcggcagctccgaatcgtcggccgtcgacagcggcacggcgactgcccctcctgacc

SEQ ID NO: 119374 - DNA, 75 bp, Artificial Sequence
  Synthetic
taataacaccaggccaccgttgggcaattggttcggctgcacctggatgaactcatctggatttaccaaagtgtg

SEQ ID NO: 119375 - DNA, 75 bp, Artificial Sequence
  Synthetic
tgctacagcaggcctcgaagcaggcccaagacatacaaccagccgtccagtcagcctggcccaaactagaacaat

SEQ ID NO: 119376 - DNA, 75 bp, Artificial Sequence
  Synthetic
accagcagactcgcggtctgttggggacaattgtcacgagcctgactggcagggacaagaacgaggttgagggcg

SEQ ID NO: 119377 - DNA, 75 bp, Artificial Sequence
  Synthetic
ggtggccgcgatggcatcatatgggccgccaccatattctgcccgggtgtggtgtttgacataaccaagtggctt

SEQ ID NO: 119378 - DNA, 75 bp, Artificial Sequence
  Synthetic
actggatatgcacggtgttgactgacttcaagacctggctccagtccaagctcctgccgcgattgccgggagtcc

SEQ ID NO: 119379 - DNA, 75 bp, Artificial Sequence
  Synthetic
cagcgcagcccttaccagcccgctttccaccagtactaccatcctcctgaacatcatgggggggtggcttgcctc

SEQ ID NO: 119380 - DNA, 75 bp, Artificial Sequence
  Synthetic
tggcccaaagggtcctgtttgccagatgtacaccaatgttgaccaggatatggtgggatggccggcaccccctgg

SEQ ID NO: 119381 - DNA, 75 bp, Artificial Sequence
  Synthetic
tggcccaaagggtcctgtttgccagatgtacaccaatgttgaccaggatatggtgggatggccggctccccctgg

SEQ ID NO: 119382 - DNA, 75 bp, Artificial Sequence
  Synthetic
tggcccaaagggtcctgtttgccagatgtacaccaatgttgaccaggatatggtgggatggccggccccccctgg

SEQ ID NO: 119383 - DNA, 75 bp, Artificial Sequence
  Synthetic
tggcccaaagggtcctgtttgccagatgtacaccaatgttgaccaggatatggtgggatggccggcgccccctgg

SEQ ID NO: 119384 - DNA, 75 bp, Artificial Sequence
  Synthetic
tgggggccgctgtaggtagcataggcctaggcaaaatattggtggatgttttggccggatatggcgctggaatct

SEQ ID NO: 119385 - DNA, 75 bp, Artificial Sequence
  Synthetic
caacgactgttctaatagcagtattgtgtatgaggccgatgacgtcattctgcacacacccggctgtataccttg

SEQ ID NO: 119386 - DNA, 75 bp, Artificial Sequence
  Synthetic
gccgggcttcttagtcccagacctctgtcaacactcaagggctcatctggaggtccagtcatgtgctcttccgga

SEQ ID NO: 119387 - DNA, 75 bp, Artificial Sequence
  Synthetic
gacgtgcaatacttgtacggggtggggtcaagcattgtgtcctgggccatcaagtgggagtacgtcatcctcttg

SEQ ID NO: 119388 - DNA, 75 bp, Artificial Sequence
  Synthetic
ggtgggggtcatctgcgcggccatcttgcgccgccacgtagggcaaggggaaggcgcggtccagtggatgaatag

SEQ ID NO: 119389 - DNA, 75 bp, Artificial Sequence
  Synthetic
tcgcccctatcaccgcttacgctcaacagacacgaggtctcttgggtactatagtggtgagcatgacggggcgcg

SEQ ID NO: 119390 - DNA, 75 bp, Artificial Sequence
  Synthetic
cagtgttcactgacaactcatcaccgcctgccgttccacagacatatcaagtcgggtatctccatgctccaacag

SEQ ID NO: 119391 - DNA, 75 bp, Artificial Sequence
  Synthetic
gatagactgcaacacgtgtgtcacccagacagtcgacttcagccttgaccctaccttcactattgagacaaccac

SEQ ID NO: 119392 - DNA, 75 bp, Artificial Sequence
  Synthetic
tcccgtcccatgtagtggctcttggcttcgcgacatatgggactggatctgcaccatcttgactgactttaagaa

SEQ ID NO: 119393 - DNA, 75 bp, Artificial Sequence
  Synthetic
ttatatgagcaaggcgtacggggtggaacccaacatcaggactggtgttaggaccataacaacaggcggccctat

SEQ ID NO: 119394 - DNA, 75 bp, Artificial Sequence
  Synthetic
ttatatgagcaaggcgtacggggtggatcccaacatcaggactggtgttaggaccataacaacaggcggccctat

SEQ ID NO: 119395 - DNA, 75 bp, Artificial Sequence
  Synthetic
ttatatgagcaaggcgtacggggtggaccccaacatcaggactggtgttaggaccataacaacaggcggccctat

SEQ ID NO: 119396 - DNA, 75 bp, Artificial Sequence
  Synthetic
ttatatgagcaaggcgtacggggtggagcccaacatcaggactggtgttaggaccataacaacaggcggccctat

SEQ ID NO: 119397 - DNA, 75 bp, Artificial Sequence
  Synthetic
ttatatgagctaggcgtacggggtggaacccaacatcaggactggtgttaggaccataacaacaggcggccctat

SEQ ID NO: 119398 - DNA, 75 bp, Artificial Sequence
  Synthetic
ttatatgagctaggcgtacggggtggatcccaacatcaggactggtgttaggaccataacaacaggcggccctat

SEQ ID NO: 119399 - DNA, 75 bp, Artificial Sequence
  Synthetic
ttatatgagctaggcgtacggggtggaccccaacatcaggactggtgttaggaccataacaacaggcggccctat

SEQ ID NO: 119400 - DNA, 75 bp, Artificial Sequence
  Synthetic
ttatatgagctaggcgtacggggtggagcccaacatcaggactggtgttaggaccataacaacaggcggccctat

SEQ ID NO: 119401 - DNA, 75 bp, Artificial Sequence
  Synthetic
ttatatgagccaggcgtacggggtggaacccaacatcaggactggtgttaggaccataacaacaggcggccctat

SEQ ID NO: 119402 - DNA, 75 bp, Artificial Sequence
  Synthetic
ttatatgagccaggcgtacggggtggatcccaacatcaggactggtgttaggaccataacaacaggcggccctat

SEQ ID NO: 119403 - DNA, 75 bp, Artificial Sequence
  Synthetic
ttatatgagccaggcgtacggggtggaccccaacatcaggactggtgttaggaccataacaacaggcggccctat

SEQ ID NO: 119404 - DNA, 75 bp, Artificial Sequence
  Synthetic
ttatatgagccaggcgtacggggtggagcccaacatcaggactggtgttaggaccataacaacaggcggccctat

SEQ ID NO: 119405 - DNA, 75 bp, Artificial Sequence
  Synthetic
ttatatgagcgaggcgtacggggtggaacccaacatcaggactggtgttaggaccataacaacaggcggccctat

SEQ ID NO: 119406 - DNA, 75 bp, Artificial Sequence
  Synthetic
ttatatgagcgaggcgtacggggtggatcccaacatcaggactggtgttaggaccataacaacaggcggccctat

SEQ ID NO: 119407 - DNA, 75 bp, Artificial Sequence
  Synthetic
ttatatgagcgaggcgtacggggtggaccccaacatcaggactggtgttaggaccataacaacaggcggccctat

SEQ ID NO: 119408 - DNA, 75 bp, Artificial Sequence
  Synthetic
ttatatgagcgaggcgtacggggtggagcccaacatcaggactggtgttaggaccataacaacaggcggccctat

SEQ ID NO: 119409 - DNA, 75 bp, Artificial Sequence
  Synthetic
cttcgcgacatatgggactggatctgcaccatcttgactgactttaagaattggctatcatccaaattgttccta

SEQ ID NO: 119410 - DNA, 75 bp, Artificial Sequence
  Synthetic
tatctggcaacgtccgcttgggctccatgcgcatcacgggacccaaaacctgcatgaacacctggcaggggacat

SEQ ID NO: 119411 - DNA, 75 bp, Artificial Sequence
  Synthetic
acggtcttagggataggcaccgtcctggaccaagcggagacagctggcgttcgcctcactgttttggctacagca

SEQ ID NO: 119412 - DNA, 75 bp, Artificial Sequence
  Synthetic
catgcgcatcacgggacccaaaacctgcatgaacacctggcaggggacattccctatcaactgctacacagaggg

SEQ ID NO: 119413 - DNA, 75 bp, Artificial Sequence
  Synthetic
tggcggcgtcggagtatgtggaggtgacgcagcacggcgctcatgcatatgtgacagggttgacaactgacaacc

SEQ ID NO: 119414 - DNA, 75 bp, Artificial Sequence
  Synthetic
aatacatcaagggtggtaggcatctaatattttgtcattcaaagaaaaagtgcgacgagttggctaagcagctgc

SEQ ID NO: 119415 - DNA, 75 bp, Artificial Sequence
  Synthetic
aatacatcaagggtggtaggcatcttatattttgtcattcaaagaaaaagtgcgacgagttggctaagcagctgc

SEQ ID NO: 119416 - DNA, 75 bp, Artificial Sequence
  Synthetic
aatacatcaagggtggtaggcatctcatattttgtcattcaaagaaaaagtgcgacgagttggctaagcagctgc

SEQ ID NO: 119417 - DNA, 75 bp, Artificial Sequence
  Synthetic
aatacatcaagggtggtaggcatctgatattttgtcattcaaagaaaaagtgcgacgagttggctaagcagctgc

SEQ ID NO: 119418 - DNA, 75 bp, Artificial Sequence
  Synthetic
ccttgacagatgctaacatcaccggtccctctgatgacaaaccgtactgctggcactacgcacctagaccttgtg

SEQ ID NO: 119419 - DNA, 75 bp, Artificial Sequence
  Synthetic
gactggttatacaggtgactttgactctgtaatagactgcaatgtggcagtaacacagattgtagacttcagtct

SEQ ID NO: 119420 - DNA, 75 bp, Artificial Sequence
  Synthetic
gactggttatacaggtgactttgactctgtaatagactgcaatgtggcagtaacacagattgttgacttcagtct

SEQ ID NO: 119421 - DNA, 75 bp, Artificial Sequence
  Synthetic
gactggttatacaggtgactttgactctgtaatagactgcaatgtggcagtaacacagattgtcgacttcagtct

SEQ ID NO: 119422 - DNA, 75 bp, Artificial Sequence
  Synthetic
gactggttatacaggtgactttgactctgtaatagactgcaatgtggcagtaacacagattgtggacttcagtct

SEQ ID NO: 119423 - DNA, 75 bp, Artificial Sequence
  Synthetic
gactggttatacaggtgactttgactctgttatagactgcaatgtggcagtaacacagattgtagacttcagtct

SEQ ID NO: 119424 - DNA, 75 bp, Artificial Sequence
  Synthetic
gactggttatacaggtgactttgactctgttatagactgcaatgtggcagtaacacagattgttgacttcagtct

SEQ ID NO: 119425 - DNA, 75 bp, Artificial Sequence
  Synthetic
gactggttatacaggtgactttgactctgttatagactgcaatgtggcagtaacacagattgtcgacttcagtct

SEQ ID NO: 119426 - DNA, 75 bp, Artificial Sequence
  Synthetic
gactggttatacaggtgactttgactctgttatagactgcaatgtggcagtaacacagattgtggacttcagtct

SEQ ID NO: 119427 - DNA, 75 bp, Artificial Sequence
  Synthetic
gactggttatacaggtgactttgactctgtcatagactgcaatgtggcagtaacacagattgtagacttcagtct

SEQ ID NO: 119428 - DNA, 75 bp, Artificial Sequence
  Synthetic
gactggttatacaggtgactttgactctgtcatagactgcaatgtggcagtaacacagattgttgacttcagtct

SEQ ID NO: 119429 - DNA, 75 bp, Artificial Sequence
  Synthetic
gactggttatacaggtgactttgactctgtcatagactgcaatgtggcagtaacacagattgtcgacttcagtct

SEQ ID NO: 119430 - DNA, 75 bp, Artificial Sequence
  Synthetic
gactggttatacaggtgactttgactctgtcatagactgcaatgtggcagtaacacagattgtggacttcagtct

SEQ ID NO: 119431 - DNA, 75 bp, Artificial Sequence
  Synthetic
gactggttatacaggtgactttgactctgtgatagactgcaatgtggcagtaacacagattgtagacttcagtct

SEQ ID NO: 119432 - DNA, 75 bp, Artificial Sequence
  Synthetic
gactggttatacaggtgactttgactctgtgatagactgcaatgtggcagtaacacagattgttgacttcagtct

SEQ ID NO: 119433 - DNA, 75 bp, Artificial Sequence
  Synthetic
gactggttatacaggtgactttgactctgtgatagactgcaatgtggcagtaacacagattgtcgacttcagtct

SEQ ID NO: 119434 - DNA, 75 bp, Artificial Sequence
  Synthetic
gactggttatacaggtgactttgactctgtgatagactgcaatgtggcagtaacacagattgtggacttcagtct

SEQ ID NO: 119435 - DNA, 75 bp, Artificial Sequence
  Synthetic
tactccacgtatggcaaattcctcgccgatgggggctgcgcaggcggcgcctatgacatcatcatatgcgatgaa

SEQ ID NO: 119436 - DNA, 75 bp, Artificial Sequence
  Synthetic
cggcagcgaggcgcctggcgcgggggtcgcctccatcggaggcgagctcctcggcaagccagctgtctgccccgt

SEQ ID NO: 119437 - DNA, 75 bp, Artificial Sequence
  Synthetic
ccagtggtcggtggtttgggtgcgcgtggatgaactccacggggtttctcaagacgtgcggagctcccccctgta

SEQ ID NO: 119438 - DNA, 75 bp, Artificial Sequence
  Synthetic
aggtacgtatcgcagggggaacgaccatcgggtatatttgataccgtcgtcctttgcgaggcgtacgacacgggt

SEQ ID NO: 119439 - DNA, 75 bp, Artificial Sequence
  Synthetic
aggtacgtttcgcagggggaacgaccatcgggtatatttgataccgtcgtcctttgcgaggcgtacgacacgggt

SEQ ID NO: 119440 - DNA, 75 bp, Artificial Sequence
  Synthetic
aggtacgtctcgcagggggaacgaccatcgggtatatttgataccgtcgtcctttgcgaggcgtacgacacgggt

SEQ ID NO: 119441 - DNA, 75 bp, Artificial Sequence
  Synthetic
aggtacgtgtcgcagggggaacgaccatcgggtatatttgataccgtcgtcctttgcgaggcgtacgacacgggt

SEQ ID NO: 119442 - DNA, 75 bp, Artificial Sequence
  Synthetic
tcaggcagagacagccggggtcaggctaactgtgctggccacggccacgccccccgggtcggtgactactcccca

SEQ ID NO: 119443 - DNA, 75 bp, Artificial Sequence
  Synthetic
tgctaaagtgctcgtcctagactcccttgacccaatggtcgaggaggaggacgagcgcgagccttcggtgccatc

SEQ ID NO: 119444 - DNA, 75 bp, Artificial Sequence
  Synthetic
tgcatggtcgactatccataccggctttggcattacccatgtacagtcaattttacattgttcaaggtgaggatg

SEQ ID NO: 119445 - DNA, 75 bp, Artificial Sequence
  Synthetic
gggagggagtcttcaccgggcttacccacattgatgcacacttcctctcacagaccaaacaggcgggggaaaacc

SEQ ID NO: 119446 - DNA, 75 bp, Artificial Sequence
  Synthetic
taccaaccaccgacagtggcggggtgtgcccttcctccctcgcagcaggctccggtgccgcctccacggagacgg

SEQ ID NO: 119447 - DNA, 75 bp, Artificial Sequence
  Synthetic
atgcctgcattgtcaacaggtctaatacacctccaccaaaacatcgtggatgtccaatacctttatggtgttgga

SEQ ID NO: 119448 - DNA, 75 bp, Artificial Sequence
  Synthetic
tatgctcacaggtccaacacctctgttgtacaggctgggagccgtgcaaaacgaaatcaccaccacacacccaat

SEQ ID NO: 119449 - DNA, 75 bp, Artificial Sequence
  Synthetic
tatgctcacaggtcctacacctctgttgtacaggctgggagccgtgcaaaacgaaatcaccaccacacacccaat

SEQ ID NO: 119450 - DNA, 75 bp, Artificial Sequence
  Synthetic
tatgctcacaggtcccacacctctgttgtacaggctgggagccgtgcaaaacgaaatcaccaccacacacccaat

SEQ ID NO: 119451 - DNA, 75 bp, Artificial Sequence
  Synthetic
tatgctcacaggtccgacacctctgttgtacaggctgggagccgtgcaaaacgaaatcaccaccacacacccaat

SEQ ID NO: 119452 - DNA, 75 bp, Artificial Sequence
  Synthetic
ccacaggggcacccatcactggcagtgccaaccagacaattccggaagagtccgttgattcagagacggactccc

SEQ ID NO: 119453 - DNA, 75 bp, Artificial Sequence
  Synthetic
ttaacagtaggtagtgcagtcatctgcggtaggattattacctcgggtaaacccgcagtaatgcctgacagggag

SEQ ID NO: 119454 - DNA, 75 bp, Artificial Sequence
  Synthetic
ttaacagtaggtagtgcagtcatctgcggtaggatttttacctcgggtaaacccgcagtaatgcctgacagggag

SEQ ID NO: 119455 - DNA, 75 bp, Artificial Sequence
  Synthetic
ttaacagtaggtagtgcagtcatctgcggtaggattcttacctcgggtaaacccgcagtaatgcctgacagggag

SEQ ID NO: 119456 - DNA, 75 bp, Artificial Sequence
  Synthetic
ttaacagtaggtagtgcagtcatctgcggtaggattgttacctcgggtaaacccgcagtaatgcctgacagggag

SEQ ID NO: 119457 - DNA, 75 bp, Artificial Sequence
  Synthetic
ttaacagtaggtagtgctgtcatctgcggtaggattattacctcgggtaaacccgcagtaatgcctgacagggag

SEQ ID NO: 119458 - DNA, 75 bp, Artificial Sequence
  Synthetic
ttaacagtaggtagtgctgtcatctgcggtaggatttttacctcgggtaaacccgcagtaatgcctgacagggag

SEQ ID NO: 119459 - DNA, 75 bp, Artificial Sequence
  Synthetic
ttaacagtaggtagtgctgtcatctgcggtaggattcttacctcgggtaaacccgcagtaatgcctgacagggag

SEQ ID NO: 119460 - DNA, 75 bp, Artificial Sequence
  Synthetic
ttaacagtaggtagtgctgtcatctgcggtaggattgttacctcgggtaaacccgcagtaatgcctgacagggag

SEQ ID NO: 119461 - DNA, 75 bp, Artificial Sequence
  Synthetic
ttaacagtaggtagtgccgtcatctgcggtaggattattacctcgggtaaacccgcagtaatgcctgacagggag

SEQ ID NO: 119462 - DNA, 75 bp, Artificial Sequence
  Synthetic
ttaacagtaggtagtgccgtcatctgcggtaggatttttacctcgggtaaacccgcagtaatgcctgacagggag

SEQ ID NO: 119463 - DNA, 75 bp, Artificial Sequence
  Synthetic
ttaacagtaggtagtgccgtcatctgcggtaggattcttacctcgggtaaacccgcagtaatgcctgacagggag

SEQ ID NO: 119464 - DNA, 75 bp, Artificial Sequence
  Synthetic
ttaacagtaggtagtgccgtcatctgcggtaggattgttacctcgggtaaacccgcagtaatgcctgacagggag

SEQ ID NO: 119465 - DNA, 75 bp, Artificial Sequence
  Synthetic
ttaacagtaggtagtgcggtcatctgcggtaggattattacctcgggtaaacccgcagtaatgcctgacagggag

SEQ ID NO: 119466 - DNA, 75 bp, Artificial Sequence
  Synthetic
ttaacagtaggtagtgcggtcatctgcggtaggatttttacctcgggtaaacccgcagtaatgcctgacagggag

SEQ ID NO: 119467 - DNA, 75 bp, Artificial Sequence
  Synthetic
ttaacagtaggtagtgcggtcatctgcggtaggattcttacctcgggtaaacccgcagtaatgcctgacagggag

SEQ ID NO: 119468 - DNA, 75 bp, Artificial Sequence
  Synthetic
ttaacagtaggtagtgcggtcatctgcggtaggattgttacctcgggtaaacccgcagtaatgcctgacagggag

SEQ ID NO: 119469 - DNA, 75 bp, Artificial Sequence
  Synthetic
ttaacagttggtagtgcagtcatctgcggtaggattattacctcgggtaaacccgcagtaatgcctgacagggag

SEQ ID NO: 119470 - DNA, 75 bp, Artificial Sequence
  Synthetic
ttaacagttggtagtgcagtcatctgcggtaggatttttacctcgggtaaacccgcagtaatgcctgacagggag

SEQ ID NO: 119471 - DNA, 75 bp, Artificial Sequence
  Synthetic
ttaacagttggtagtgcagtcatctgcggtaggattcttacctcgggtaaacccgcagtaatgcctgacagggag

SEQ ID NO: 119472 - DNA, 75 bp, Artificial Sequence
  Synthetic
ttaacagttggtagtgcagtcatctgcggtaggattgttacctcgggtaaacccgcagtaatgcctgacagggag

SEQ ID NO: 119473 - DNA, 75 bp, Artificial Sequence
  Synthetic
ttaacagttggtagtgctgtcatctgcggtaggattattacctcgggtaaacccgcagtaatgcctgacagggag

SEQ ID NO: 119474 - DNA, 75 bp, Artificial Sequence
  Synthetic
ttaacagttggtagtgctgtcatctgcggtaggatttttacctcgggtaaacccgcagtaatgcctgacagggag

SEQ ID NO: 119475 - DNA, 75 bp, Artificial Sequence
  Synthetic
ttaacagttggtagtgctgtcatctgcggtaggattcttacctcgggtaaacccgcagtaatgcctgacagggag

SEQ ID NO: 119476 - DNA, 75 bp, Artificial Sequence
  Synthetic
ttaacagttggtagtgctgtcatctgcggtaggattgttacctcgggtaaacccgcagtaatgcctgacagggag

SEQ ID NO: 119477 - DNA, 75 bp, Artificial Sequence
  Synthetic
ttaacagttggtagtgccgtcatctgcggtaggattattacctcgggtaaacccgcagtaatgcctgacagggag

SEQ ID NO: 119478 - DNA, 75 bp, Artificial Sequence
  Synthetic
ttaacagttggtagtgccgtcatctgcggtaggatttttacctcgggtaaacccgcagtaatgcctgacagggag

SEQ ID NO: 119479 - DNA, 75 bp, Artificial Sequence
  Synthetic
ttaacagttggtagtgccgtcatctgcggtaggattcttacctcgggtaaacccgcagtaatgcctgacagggag

SEQ ID NO: 119480 - DNA, 75 bp, Artificial Sequence
  Synthetic
ttaacagttggtagtgccgtcatctgcggtaggattgttacctcgggtaaacccgcagtaatgcctgacagggag

SEQ ID NO: 119481 - DNA, 75 bp, Artificial Sequence
  Synthetic
ttaacagttggtagtgcggtcatctgcggtaggattattacctcgggtaaacccgcagtaatgcctgacagggag

SEQ ID NO: 119482 - DNA, 75 bp, Artificial Sequence
  Synthetic
ttaacagttggtagtgcggtcatctgcggtaggatttttacctcgggtaaacccgcagtaatgcctgacagggag

SEQ ID NO: 119483 - DNA, 75 bp, Artificial Sequence
  Synthetic
ttaacagttggtagtgcggtcatctgcggtaggattcttacctcgggtaaacccgcagtaatgcctgacagggag

SEQ ID NO: 119484 - DNA, 75 bp, Artificial Sequence
  Synthetic
ttaacagttggtagtgcggtcatctgcggtaggattgttacctcgggtaaacccgcagtaatgcctgacagggag

SEQ ID NO: 119485 - DNA, 75 bp, Artificial Sequence
  Synthetic
ttaacagtcggtagtgcagtcatctgcggtaggattattacctcgggtaaacccgcagtaatgcctgacagggag

SEQ ID NO: 119486 - DNA, 75 bp, Artificial Sequence
  Synthetic
ttaacagtcggtagtgcagtcatctgcggtaggatttttacctcgggtaaacccgcagtaatgcctgacagggag

SEQ ID NO: 119487 - DNA, 75 bp, Artificial Sequence
  Synthetic
ttaacagtcggtagtgcagtcatctgcggtaggattcttacctcgggtaaacccgcagtaatgcctgacagggag

SEQ ID NO: 119488 - DNA, 75 bp, Artificial Sequence
  Synthetic
ttaacagtcggtagtgcagtcatctgcggtaggattgttacctcgggtaaacccgcagtaatgcctgacagggag

SEQ ID NO: 119489 - DNA, 75 bp, Artificial Sequence
  Synthetic
ttaacagtcggtagtgctgtcatctgcggtaggattattacctcgggtaaacccgcagtaatgcctgacagggag

SEQ ID NO: 119490 - DNA, 75 bp, Artificial Sequence
  Synthetic
ttaacagtcggtagtgctgtcatctgcggtaggatttttacctcgggtaaacccgcagtaatgcctgacagggag

SEQ ID NO: 119491 - DNA, 75 bp, Artificial Sequence
  Synthetic
ttaacagtcggtagtgctgtcatctgcggtaggattcttacctcgggtaaacccgcagtaatgcctgacagggag

SEQ ID NO: 119492 - DNA, 75 bp, Artificial Sequence
  Synthetic
ttaacagtcggtagtgctgtcatctgcggtaggattgttacctcgggtaaacccgcagtaatgcctgacagggag

SEQ ID NO: 119493 - DNA, 75 bp, Artificial Sequence
  Synthetic
ttaacagtcggtagtgccgtcatctgcggtaggattattacctcgggtaaacccgcagtaatgcctgacagggag

SEQ ID NO: 119494 - DNA, 75 bp, Artificial Sequence
  Synthetic
ttaacagtcggtagtgccgtcatctgcggtaggatttttacctcgggtaaacccgcagtaatgcctgacagggag

SEQ ID NO: 119495 - DNA, 75 bp, Artificial Sequence
  Synthetic
ttaacagtcggtagtgccgtcatctgcggtaggattcttacctcgggtaaacccgcagtaatgcctgacagggag

SEQ ID NO: 119496 - DNA, 75 bp, Artificial Sequence
  Synthetic
ttaacagtcggtagtgccgtcatctgcggtaggattgttacctcgggtaaacccgcagtaatgcctgacagggag

SEQ ID NO: 119497 - DNA, 75 bp, Artificial Sequence
  Synthetic
ttaacagtcggtagtgcggtcatctgcggtaggattattacctcgggtaaacccgcagtaatgcctgacagggag

SEQ ID NO: 119498 - DNA, 75 bp, Artificial Sequence
  Synthetic
ttaacagtcggtagtgcggtcatctgcggtaggatttttacctcgggtaaacccgcagtaatgcctgacagggag

SEQ ID NO: 119499 - DNA, 75 bp, Artificial Sequence
  Synthetic
ttaacagtcggtagtgcggtcatctgcggtaggattcttacctcgggtaaacccgcagtaatgcctgacagggag

SEQ ID NO: 119500 - DNA, 75 bp, Artificial Sequence
  Synthetic
ttaacagtcggtagtgcggtcatctgcggtaggattgttacctcgggtaaacccgcagtaatgcctgacagggag

SEQ ID NO: 119501 - DNA, 75 bp, Artificial Sequence
  Synthetic
ttaacagtgggtagtgcagtcatctgcggtaggattattacctcgggtaaacccgcagtaatgcctgacagggag

SEQ ID NO: 119502 - DNA, 75 bp, Artificial Sequence
  Synthetic
ttaacagtgggtagtgcagtcatctgcggtaggatttttacctcgggtaaacccgcagtaatgcctgacagggag

SEQ ID NO: 119503 - DNA, 75 bp, Artificial Sequence
  Synthetic
ttaacagtgggtagtgcagtcatctgcggtaggattcttacctcgggtaaacccgcagtaatgcctgacagggag

SEQ ID NO: 119504 - DNA, 75 bp, Artificial Sequence
  Synthetic
ttaacagtgggtagtgcagtcatctgcggtaggattgttacctcgggtaaacccgcagtaatgcctgacagggag

SEQ ID NO: 119505 - DNA, 75 bp, Artificial Sequence
  Synthetic
ttaacagtgggtagtgctgtcatctgcggtaggattattacctcgggtaaacccgcagtaatgcctgacagggag

SEQ ID NO: 119506 - DNA, 75 bp, Artificial Sequence
  Synthetic
ttaacagtgggtagtgctgtcatctgcggtaggatttttacctcgggtaaacccgcagtaatgcctgacagggag

SEQ ID NO: 119507 - DNA, 75 bp, Artificial Sequence
  Synthetic
ttaacagtgggtagtgctgtcatctgcggtaggattcttacctcgggtaaacccgcagtaatgcctgacagggag

SEQ ID NO: 119508 - DNA, 75 bp, Artificial Sequence
  Synthetic
ttaacagtgggtagtgctgtcatctgcggtaggattgttacctcgggtaaacccgcagtaatgcctgacagggag

SEQ ID NO: 119509 - DNA, 75 bp, Artificial Sequence
  Synthetic
ttaacagtgggtagtgccgtcatctgcggtaggattattacctcgggtaaacccgcagtaatgcctgacagggag

SEQ ID NO: 119510 - DNA, 75 bp, Artificial Sequence
  Synthetic
ttaacagtgggtagtgccgtcatctgcggtaggatttttacctcgggtaaacccgcagtaatgcctgacagggag

SEQ ID NO: 119511 - DNA, 75 bp, Artificial Sequence
  Synthetic
ttaacagtgggtagtgccgtcatctgcggtaggattcttacctcgggtaaacccgcagtaatgcctgacagggag

SEQ ID NO: 119512 - DNA, 75 bp, Artificial Sequence
  Synthetic
ttaacagtgggtagtgccgtcatctgcggtaggattgttacctcgggtaaacccgcagtaatgcctgacagggag

SEQ ID NO: 119513 - DNA, 75 bp, Artificial Sequence
  Synthetic
ttaacagtgggtagtgcggtcatctgcggtaggattattacctcgggtaaacccgcagtaatgcctgacagggag

SEQ ID NO: 119514 - DNA, 75 bp, Artificial Sequence
  Synthetic
ttaacagtgggtagtgcggtcatctgcggtaggatttttacctcgggtaaacccgcagtaatgcctgacagggag

SEQ ID NO: 119515 - DNA, 75 bp, Artificial Sequence
  Synthetic
ttaacagtgggtagtgcggtcatctgcggtaggattcttacctcgggtaaacccgcagtaatgcctgacagggag

SEQ ID NO: 119516 - DNA, 75 bp, Artificial Sequence
  Synthetic
ttaacagtgggtagtgcggtcatctgcggtaggattgttacctcgggtaaacccgcagtaatgcctgacagggag

SEQ ID NO: 119517 - DNA, 75 bp, Artificial Sequence
  Synthetic
caagaggcggtcgagcgccaatccctctcgcaggagggggaagcagctcccgcctcggactccggttcctggtcc

SEQ ID NO: 119518 - DNA, 75 bp, Artificial Sequence
  Synthetic
tgggtttgttgcagaccaccgccaagcaggcagaggatttgaaaccagccgttacatcagcatggccaaggcttg

SEQ ID NO: 119519 - DNA, 75 bp, Artificial Sequence
  Synthetic
ctatcaatcccttaagtaactcgctattgcgatttcacaacaaggtgtattgcacaacatctaaaagcgcctcat

SEQ ID NO: 119520 - DNA, 75 bp, Artificial Sequence
  Synthetic
gtgtgtgctagagccaaggcccctcccccgtcctgggacgtcatgtggaagtgtttgactcgactcaagcccacg

SEQ ID NO: 119521 - DNA, 75 bp, Artificial Sequence
  Synthetic
tgcacaacatctaaaagcgcctcattgagggcgaagaaggtgacttttgacagagtacagctactagactcacac

SEQ ID NO: 119522 - DNA, 75 bp, Artificial Sequence
  Synthetic
cagctgatcaacaccaacggcagttggcacatcaataggacggccttgaactgcaatgatagccttaacaccggc

SEQ ID NO: 119523 - DNA, 75 bp, Artificial Sequence
  Synthetic
ctccatgtgtgggtcccccccctaattgcgcgcgggggtagggacggtgccatcctgctaacaagcctgttatat

SEQ ID NO: 119524 - DNA, 75 bp, Artificial Sequence
  Synthetic
gtccttctctgctgcccttaccagtccactgtcgacctccaccaccctccttctcaacatcttaggggggtgggt

SEQ ID NO: 119525 - DNA, 75 bp, Artificial Sequence
  Synthetic
gcttcgccgatctcatgggatacatcccgctcgtgggcgcccccgtgggtggcgtcgccagagccctggcgcatg

SEQ ID NO: 119526 - DNA, 75 bp, Artificial Sequence
  Synthetic
ctagatcaaaatacgggtttggggcaaaggaggttcgcagcttagccaagagggccgttaaccacatccagtccg

SEQ ID NO: 119527 - DNA, 75 bp, Artificial Sequence
  Synthetic
taactacgcaacagggaatcttcctggttgctctttctctatcttccttctggcacttctctcgtgcctaaccgt

SEQ ID NO: 119528 - DNA, 75 bp, Artificial Sequence
  Synthetic
gacatattggcaggatatggggcaggtgtgtctggcgccctcgtcgcctttaagatcatgtgcggcgaggctccc

SEQ ID NO: 119529 - DNA, 75 bp, Artificial Sequence
  Synthetic
gccggcccggctcatcgtgtaccctgaccttggtgtcagggtttgcgagaagatagccctttatgacatcacgca

SEQ ID NO: 119530 - DNA, 75 bp, Artificial Sequence
  Synthetic
ttcgacgccacatcgatctgcttgtcgggagcgccaccctctgctcggccctctatgtgggggacttgtgcgggt

SEQ ID NO: 119531 - DNA, 75 bp, Artificial Sequence
  Synthetic
ttacatcttccagggtgcgtaccctgtgtgaggacggggaaccggtcgcaatgctggacacccctgacccccact

SEQ ID NO: 119532 - DNA, 75 bp, Artificial Sequence
  Synthetic
cctctgaaggcgccactcagtggatgaacagacttatagcatttgcctcacggggcaatcatgtgtcacccacgc

SEQ ID NO: 119533 - DNA, 75 bp, Artificial Sequence
  Synthetic
cccatgggtttttcgtatgacacccgctgctttgactcaacagtgacggagagggacatcagaactgaggagtcc

SEQ ID NO: 119534 - DNA, 75 bp, Artificial Sequence
  Synthetic
acctgtgcggggctgtgtttttggcaggtcaactgttcaccttccagccgcgccgccattggaccactcaggagt

SEQ ID NO: 119535 - DNA, 75 bp, Artificial Sequence
  Synthetic
ggactggacaacaccatgtgctacaagctggcttagggatgtatgggactgggtctgcacagtcttgtctgactt

SEQ ID NO: 119536 - DNA, 75 bp, Artificial Sequence
  Synthetic
ggtgcccactggggagtcctagcgggcatagcgtatttctccatggtggggaactgggcgaaggtcctggtggtg

SEQ ID NO: 119537 - DNA, 75 bp, Artificial Sequence
  Synthetic
ttgcgggcgtcaaacatcctgcgctccaaatgtacacaaatgtagatcaggacctcgttgggtggccagcccctc

SEQ ID NO: 119538 - DNA, 75 bp, Artificial Sequence
  Synthetic
tgctataccacatgcccctgcggggggcaaattacaggacatgtaaaaaacgggacaatgaagatcataggtccc

SEQ ID NO: 119539 - DNA, 75 bp, Artificial Sequence
  Synthetic
catgaggatcccttccaccctgttggacttgatgtctggagggcattggggtgtcatagcaggcttagcgtactt

SEQ ID NO: 119540 - DNA, 75 bp, Artificial Sequence
  Synthetic
gcgtccgggatctacagtatcttcacctctggagcaaaacaacccttgcagctcatcaacaccaacggtagctgg

SEQ ID NO: 119541 - DNA, 75 bp, Artificial Sequence
  Synthetic
tcaggctgccccgagaggatggccagctgtagaccccttgccgatttcgaccagggctggggccctatcagctac

SEQ ID NO: 119542 - DNA, 75 bp, Artificial Sequence
  Synthetic
agcagaatatgacctggagctgataacatcttgctcctccaatgtatctgtggcgttggacgcacatggccgccg

SEQ ID NO: 119543 - DNA, 75 bp, Artificial Sequence
  Synthetic
ggagggtttccgcggaggactacgttgaggtcgttcgcgttaaggattgccattatgtggtgggggccacagctg

SEQ ID NO: 119544 - DNA, 75 bp, Artificial Sequence
  Synthetic
aacggatgtcacgttgcaagcgcctggacgatctagggcagggctggggatcactcggggtcagcaatgcgccaa

SEQ ID NO: 119545 - DNA, 75 bp, Artificial Sequence
  Synthetic
cagtacgctccaacaatatgggcccgtatggtcttaatgacacatttcttctccattctaatggcccaggatatc

SEQ ID NO: 119546 - DNA, 75 bp, Artificial Sequence
  Synthetic
cagggatgaagtgtcatttaccgtcggtctccacagctatgtgctggggtctcagcttccatgtgaaccggagcc

SEQ ID NO: 119547 - DNA, 75 bp, Artificial Sequence
  Synthetic
accggcagcggtaagagcacaaaggtcccggccgcctatgtagcacaaggatataatgtcctcgtgttgaatcca

SEQ ID NO: 119548 - DNA, 75 bp, Artificial Sequence
  Synthetic
ctggaccaagatctcaattttgaaatgtacggggccgtatactcagtcactccactggatcttccggccatcatt

SEQ ID NO: 119549 - DNA, 75 bp, Artificial Sequence
  Synthetic
caaagatgcccggcctcccctttatctcttgccaaaagggatataagggtgtgtgggctggcactggcatcatga

SEQ ID NO: 119550 - DNA, 75 bp, Artificial Sequence
  Synthetic
ccctgtagtggttgggactaccgaccgcctgggagcccccacatacacctggggggaaaatgagactgatgtctt

SEQ ID NO: 119551 - DNA, 75 bp, Artificial Sequence
  Synthetic
tttcactgcatacatactctccccatgaactcacacgggtggcagccgctctcagaaaacttggagcgccggcct

SEQ ID NO: 119552 - DNA, 75 bp, Artificial Sequence
  Synthetic
agctcatcagctagccagctgtccgcgccgtccttgaaggcaacatgcactgtcgctgctgatcaccctgatgct

SEQ ID NO: 119553 - DNA, 75 bp, Artificial Sequence
  Synthetic
gtcccagcaggaaacagctcatggccgtgccctaccgattgcttcaggaaacatccaggagcgacatatgccaag

SEQ ID NO: 119554 - DNA, 75 bp, Artificial Sequence
  Synthetic
cgttagtggctgaaactgatgacagggaaatctccacagcagctgagtgtcaccgaccacgcaggccgaagttcc

SEQ ID NO: 119555 - DNA, 75 bp, Artificial Sequence
  Synthetic
cgttagtggctgaaactgatgacagggatatctccacagcagctgagtgtcaccgaccacgcaggccgaagttcc

SEQ ID NO: 119556 - DNA, 75 bp, Artificial Sequence
  Synthetic
cgttagtggctgaaactgatgacagggacatctccacagcagctgagtgtcaccgaccacgcaggccgaagttcc

SEQ ID NO: 119557 - DNA, 75 bp, Artificial Sequence
  Synthetic
cgttagtggctgaaactgatgacagggagatctccacagcagctgagtgtcaccgaccacgcaggccgaagttcc

SEQ ID NO: 119558 - DNA, 75 bp, Artificial Sequence
  Synthetic
gccgctactccttcaccggggcagtgaggactaagctcaaactcactccattgccggaggcgagccggctggacc

SEQ ID NO: 119559 - DNA, 75 bp, Artificial Sequence
  Synthetic
gtgccacattccaacatcgaagaagtggctctgggctctgaaggtgagatccctttctacggtagggctataccg

SEQ ID NO: 119560 - DNA, 75 bp, Artificial Sequence
  Synthetic
tcctactccttgtaggggtaggcatctttttactccccgctcggtagagcggcacacttagctacactccatagc

SEQ ID NO: 119561 - DNA, 75 bp, Artificial Sequence
  Synthetic
gctcccccctaaggggttgccacctattcccccacctaggaggaatagggtcatccagcttgacgagtcaactgc

SEQ ID NO: 119562 - DNA, 75 bp, Artificial Sequence
  Synthetic
gctcccccctaaggggttgccacctattcccccacctaggtggaatagggtcatccagcttgacgagtcaactgc

SEQ ID NO: 119563 - DNA, 75 bp, Artificial Sequence
  Synthetic
gctcccccctaaggggttgccacctattcccccacctaggcggaatagggtcatccagcttgacgagtcaactgc

SEQ ID NO: 119564 - DNA, 75 bp, Artificial Sequence
  Synthetic
gctcccccctaaggggttgccacctattcccccacctagggggaatagggtcatccagcttgacgagtcaactgc

SEQ ID NO: 119565 - DNA, 75 bp, Artificial Sequence
  Synthetic
gctcccccctaaggggttgccacctattccccctcctaggaggaatagggtcatccagcttgacgagtcaactgc

SEQ ID NO: 119566 - DNA, 75 bp, Artificial Sequence
  Synthetic
gctcccccctaaggggttgccacctattccccctcctaggtggaatagggtcatccagcttgacgagtcaactgc

SEQ ID NO: 119567 - DNA, 75 bp, Artificial Sequence
  Synthetic
gctcccccctaaggggttgccacctattccccctcctaggcggaatagggtcatccagcttgacgagtcaactgc

SEQ ID NO: 119568 - DNA, 75 bp, Artificial Sequence
  Synthetic
gctcccccctaaggggttgccacctattccccctcctagggggaatagggtcatccagcttgacgagtcaactgc

SEQ ID NO: 119569 - DNA, 75 bp, Artificial Sequence
  Synthetic
gctcccccctaaggggttgccacctattcccccccctaggaggaatagggtcatccagcttgacgagtcaactgc

SEQ ID NO: 119570 - DNA, 75 bp, Artificial Sequence
  Synthetic
gctcccccctaaggggttgccacctattcccccccctaggtggaatagggtcatccagcttgacgagtcaactgc

SEQ ID NO: 119571 - DNA, 75 bp, Artificial Sequence
  Synthetic
gctcccccctaaggggttgccacctattcccccccctaggcggaatagggtcatccagcttgacgagtcaactgc

SEQ ID NO: 119572 - DNA, 75 bp, Artificial Sequence
  Synthetic
gctcccccctaaggggttgccacctattcccccccctagggggaatagggtcatccagcttgacgagtcaactgc

SEQ ID NO: 119573 - DNA, 75 bp, Artificial Sequence
  Synthetic
gctcccccctaaggggttgccacctattcccccgcctaggaggaatagggtcatccagcttgacgagtcaactgc

SEQ ID NO: 119574 - DNA, 75 bp, Artificial Sequence
  Synthetic
gctcccccctaaggggttgccacctattcccccgcctaggtggaatagggtcatccagcttgacgagtcaactgc

SEQ ID NO: 119575 - DNA, 75 bp, Artificial Sequence
  Synthetic
gctcccccctaaggggttgccacctattcccccgcctaggcggaatagggtcatccagcttgacgagtcaactgc

SEQ ID NO: 119576 - DNA, 75 bp, Artificial Sequence
  Synthetic
gctcccccctaaggggttgccacctattcccccgcctagggggaatagggtcatccagcttgacgagtcaactgc

SEQ ID NO: 119577 - DNA, 75 bp, Artificial Sequence
  Synthetic
gctcccccctaaggggttgcctcctattcccccacctaggaggaatagggtcatccagcttgacgagtcaactgc

SEQ ID NO: 119578 - DNA, 75 bp, Artificial Sequence
  Synthetic
gctcccccctaaggggttgcctcctattcccccacctaggtggaatagggtcatccagcttgacgagtcaactgc

SEQ ID NO: 119579 - DNA, 75 bp, Artificial Sequence
  Synthetic
gctcccccctaaggggttgcctcctattcccccacctaggcggaatagggtcatccagcttgacgagtcaactgc

SEQ ID NO: 119580 - DNA, 75 bp, Artificial Sequence
  Synthetic
gctcccccctaaggggttgcctcctattcccccacctagggggaatagggtcatccagcttgacgagtcaactgc

SEQ ID NO: 119581 - DNA, 75 bp, Artificial Sequence
  Synthetic
gctcccccctaaggggttgcctcctattccccctcctaggaggaatagggtcatccagcttgacgagtcaactgc

SEQ ID NO: 119582 - DNA, 75 bp, Artificial Sequence
  Synthetic
gctcccccctaaggggttgcctcctattccccctcctaggtggaatagggtcatccagcttgacgagtcaactgc

SEQ ID NO: 119583 - DNA, 75 bp, Artificial Sequence
  Synthetic
gctcccccctaaggggttgcctcctattccccctcctaggcggaatagggtcatccagcttgacgagtcaactgc

SEQ ID NO: 119584 - DNA, 75 bp, Artificial Sequence
  Synthetic
gctcccccctaaggggttgcctcctattccccctcctagggggaatagggtcatccagcttgacgagtcaactgc

SEQ ID NO: 119585 - DNA, 75 bp, Artificial Sequence
  Synthetic
gctcccccctaaggggttgcctcctattcccccccctaggaggaatagggtcatccagcttgacgagtcaactgc

SEQ ID NO: 119586 - DNA, 75 bp, Artificial Sequence
  Synthetic
gctcccccctaaggggttgcctcctattcccccccctaggtggaatagggtcatccagcttgacgagtcaactgc

SEQ ID NO: 119587 - DNA, 75 bp, Artificial Sequence
  Synthetic
gctcccccctaaggggttgcctcctattcccccccctaggcggaatagggtcatccagcttgacgagtcaactgc

SEQ ID NO: 119588 - DNA, 75 bp, Artificial Sequence
  Synthetic
gctcccccctaaggggttgcctcctattcccccccctagggggaatagggtcatccagcttgacgagtcaactgc

SEQ ID NO: 119589 - DNA, 75 bp, Artificial Sequence
  Synthetic
gctcccccctaaggggttgcctcctattcccccgcctaggaggaatagggtcatccagcttgacgagtcaactgc

SEQ ID NO: 119590 - DNA, 75 bp, Artificial Sequence
  Synthetic
gctcccccctaaggggttgcctcctattcccccgcctaggtggaatagggtcatccagcttgacgagtcaactgc

SEQ ID NO: 119591 - DNA, 75 bp, Artificial Sequence
  Synthetic
gctcccccctaaggggttgcctcctattcccccgcctaggcggaatagggtcatccagcttgacgagtcaactgc

SEQ ID NO: 119592 - DNA, 75 bp, Artificial Sequence
  Synthetic
gctcccccctaaggggttgcctcctattcccccgcctagggggaatagggtcatccagcttgacgagtcaactgc

SEQ ID NO: 119593 - DNA, 75 bp, Artificial Sequence
  Synthetic
gctcccccctaaggggttgccccctattcccccacctaggaggaatagggtcatccagcttgacgagtcaactgc

SEQ ID NO: 119594 - DNA, 75 bp, Artificial Sequence
  Synthetic
gctcccccctaaggggttgccccctattcccccacctaggtggaatagggtcatccagcttgacgagtcaactgc

SEQ ID NO: 119595 - DNA, 75 bp, Artificial Sequence
  Synthetic
gctcccccctaaggggttgccccctattcccccacctaggcggaatagggtcatccagcttgacgagtcaactgc

SEQ ID NO: 119596 - DNA, 75 bp, Artificial Sequence
  Synthetic
gctcccccctaaggggttgccccctattcccccacctagggggaatagggtcatccagcttgacgagtcaactgc

SEQ ID NO: 119597 - DNA, 75 bp, Artificial Sequence
  Synthetic
gctcccccctaaggggttgccccctattccccctcctaggaggaatagggtcatccagcttgacgagtcaactgc

SEQ ID NO: 119598 - DNA, 75 bp, Artificial Sequence
  Synthetic
gctcccccctaaggggttgccccctattccccctcctaggtggaatagggtcatccagcttgacgagtcaactgc

SEQ ID NO: 119599 - DNA, 75 bp, Artificial Sequence
  Synthetic
gctcccccctaaggggttgccccctattccccctcctaggcggaatagggtcatccagcttgacgagtcaactgc

SEQ ID NO: 119600 - DNA, 75 bp, Artificial Sequence
  Synthetic
gctcccccctaaggggttgccccctattccccctcctagggggaatagggtcatccagcttgacgagtcaactgc

SEQ ID NO: 119601 - DNA, 75 bp, Artificial Sequence
  Synthetic
gctcccccctaaggggttgccccctattcccccccctaggaggaatagggtcatccagcttgacgagtcaactgc

SEQ ID NO: 119602 - DNA, 75 bp, Artificial Sequence
  Synthetic
gctcccccctaaggggttgccccctattcccccccctaggtggaatagggtcatccagcttgacgagtcaactgc

SEQ ID NO: 119603 - DNA, 75 bp, Artificial Sequence
  Synthetic
gctcccccctaaggggttgccccctattcccccccctaggcggaatagggtcatccagcttgacgagtcaactgc

SEQ ID NO: 119604 - DNA, 75 bp, Artificial Sequence
  Synthetic
gctcccccctaaggggttgccccctattcccccccctagggggaatagggtcatccagcttgacgagtcaactgc

SEQ ID NO: 119605 - DNA, 75 bp, Artificial Sequence
  Synthetic
gctcccccctaaggggttgccccctattcccccgcctaggaggaatagggtcatccagcttgacgagtcaactgc

SEQ ID NO: 119606 - DNA, 75 bp, Artificial Sequence
  Synthetic
gctcccccctaaggggttgccccctattcccccgcctaggtggaatagggtcatccagcttgacgagtcaactgc

SEQ ID NO: 119607 - DNA, 75 bp, Artificial Sequence
  Synthetic
gctcccccctaaggggttgccccctattcccccgcctaggcggaatagggtcatccagcttgacgagtcaactgc

SEQ ID NO: 119608 - DNA, 75 bp, Artificial Sequence
  Synthetic
gctcccccctaaggggttgccccctattcccccgcctagggggaatagggtcatccagcttgacgagtcaactgc

SEQ ID NO: 119609 - DNA, 75 bp, Artificial Sequence
  Synthetic
gctcccccctaaggggttgccgcctattcccccacctaggaggaatagggtcatccagcttgacgagtcaactgc

SEQ ID NO: 119610 - DNA, 75 bp, Artificial Sequence
  Synthetic
gctcccccctaaggggttgccgcctattcccccacctaggtggaatagggtcatccagcttgacgagtcaactgc

SEQ ID NO: 119611 - DNA, 75 bp, Artificial Sequence
  Synthetic
gctcccccctaaggggttgccgcctattcccccacctaggcggaatagggtcatccagcttgacgagtcaactgc

SEQ ID NO: 119612 - DNA, 75 bp, Artificial Sequence
  Synthetic
gctcccccctaaggggttgccgcctattcccccacctagggggaatagggtcatccagcttgacgagtcaactgc

SEQ ID NO: 119613 - DNA, 75 bp, Artificial Sequence
  Synthetic
gctcccccctaaggggttgccgcctattccccctcctaggaggaatagggtcatccagcttgacgagtcaactgc

SEQ ID NO: 119614 - DNA, 75 bp, Artificial Sequence
  Synthetic
gctcccccctaaggggttgccgcctattccccctcctaggtggaatagggtcatccagcttgacgagtcaactgc

SEQ ID NO: 119615 - DNA, 75 bp, Artificial Sequence
  Synthetic
gctcccccctaaggggttgccgcctattccccctcctaggcggaatagggtcatccagcttgacgagtcaactgc

SEQ ID NO: 119616 - DNA, 75 bp, Artificial Sequence
  Synthetic
gctcccccctaaggggttgccgcctattccccctcctagggggaatagggtcatccagcttgacgagtcaactgc

SEQ ID NO: 119617 - DNA, 75 bp, Artificial Sequence
  Synthetic
gctcccccctaaggggttgccgcctattcccccccctaggaggaatagggtcatccagcttgacgagtcaactgc

SEQ ID NO: 119618 - DNA, 75 bp, Artificial Sequence
  Synthetic
gctcccccctaaggggttgccgcctattcccccccctaggtggaatagggtcatccagcttgacgagtcaactgc

SEQ ID NO: 119619 - DNA, 75 bp, Artificial Sequence
  Synthetic
gctcccccctaaggggttgccgcctattcccccccctaggcggaatagggtcatccagcttgacgagtcaactgc

SEQ ID NO: 119620 - DNA, 75 bp, Artificial Sequence
  Synthetic
gctcccccctaaggggttgccgcctattcccccccctagggggaatagggtcatccagcttgacgagtcaactgc

SEQ ID NO: 119621 - DNA, 75 bp, Artificial Sequence
  Synthetic
gctcccccctaaggggttgccgcctattcccccgcctaggaggaatagggtcatccagcttgacgagtcaactgc

SEQ ID NO: 119622 - DNA, 75 bp, Artificial Sequence
  Synthetic
gctcccccctaaggggttgccgcctattcccccgcctaggtggaatagggtcatccagcttgacgagtcaactgc

SEQ ID NO: 119623 - DNA, 75 bp, Artificial Sequence
  Synthetic
gctcccccctaaggggttgccgcctattcccccgcctaggcggaatagggtcatccagcttgacgagtcaactgc

SEQ ID NO: 119624 - DNA, 75 bp, Artificial Sequence
  Synthetic
gctcccccctaaggggttgccgcctattcccccgcctagggggaatagggtcatccagcttgacgagtcaactgc

SEQ ID NO: 119625 - DNA, 75 bp, Artificial Sequence
  Synthetic
gaatgtacatcggtggaatagaacatcggctagaggcagcgtgcaactggactagaggagggccctgtgggttgg

SEQ ID NO: 119626 - DNA, 75 bp, Artificial Sequence
  Synthetic
ctgcccctcggggcacgccgtgggcatcttccgggccgctgtgtgcacccggggggttgcgaaggcggtggactt

SEQ ID NO: 119627 - DNA, 75 bp, Artificial Sequence
  Synthetic
attgatccacctccaccagaatattgttgatgtccagtatctctatggcgttagctcctccgtagtgtcgtgggc

SEQ ID NO: 119628 - DNA, 75 bp, Artificial Sequence
  Synthetic
acaacaccaccatctgatgaggctgacgcattgtccgacgctgagtcttacagttccatgccccctcttgagggg

SEQ ID NO: 119629 - DNA, 75 bp, Artificial Sequence
  Synthetic
gtcgctgcgagccacctgcgccacccatggcgaggcctatgacgtggatatggtggatgccaacctgttcatgag

SEQ ID NO: 119630 - DNA, 75 bp, Artificial Sequence
  Synthetic
gccctagccaatttgattaccatcaatgctgtctctgtctctggccattatggtcctggttacgctattgccttc

SEQ ID NO: 119631 - DNA, 75 bp, Artificial Sequence
  Synthetic
ctggactgtctaccacggggccgggacgaggaccatcgcatcacccaagggtcctgttatccagatgtataccaa

SEQ ID NO: 119632 - DNA, 75 bp, Artificial Sequence
  Synthetic
cgcttatcacaccatgagctgccgaggaggagaagttgcccattagtcctctgagcaactctcttataaggcatc

SEQ ID NO: 119633 - DNA, 75 bp, Artificial Sequence
  Synthetic
cgcttatcacaccatgtgctgccgaggaggagaagttgcccattagtcctctgagcaactctcttataaggcatc

SEQ ID NO: 119634 - DNA, 75 bp, Artificial Sequence
  Synthetic
cgcttatcacaccatgcgctgccgaggaggagaagttgcccattagtcctctgagcaactctcttataaggcatc

SEQ ID NO: 119635 - DNA, 75 bp, Artificial Sequence
  Synthetic
cgcttatcacaccatgggctgccgaggaggagaagttgcccattagtcctctgagcaactctcttataaggcatc

SEQ ID NO: 119636 - DNA, 75 bp, Artificial Sequence
  Synthetic
cgcttatcactccatgagctgccgaggaggagaagttgcccattagtcctctgagcaactctcttataaggcatc

SEQ ID NO: 119637 - DNA, 75 bp, Artificial Sequence
  Synthetic
cgcttatcactccatgtgctgccgaggaggagaagttgcccattagtcctctgagcaactctcttataaggcatc

SEQ ID NO: 119638 - DNA, 75 bp, Artificial Sequence
  Synthetic
cgcttatcactccatgcgctgccgaggaggagaagttgcccattagtcctctgagcaactctcttataaggcatc

SEQ ID NO: 119639 - DNA, 75 bp, Artificial Sequence
  Synthetic
cgcttatcactccatgggctgccgaggaggagaagttgcccattagtcctctgagcaactctcttataaggcatc

SEQ ID NO: 119640 - DNA, 75 bp, Artificial Sequence
  Synthetic
cgcttatcaccccatgagctgccgaggaggagaagttgcccattagtcctctgagcaactctcttataaggcatc

SEQ ID NO: 119641 - DNA, 75 bp, Artificial Sequence
  Synthetic
cgcttatcaccccatgtgctgccgaggaggagaagttgcccattagtcctctgagcaactctcttataaggcatc

SEQ ID NO: 119642 - DNA, 75 bp, Artificial Sequence
  Synthetic
cgcttatcaccccatgcgctgccgaggaggagaagttgcccattagtcctctgagcaactctcttataaggcatc

SEQ ID NO: 119643 - DNA, 75 bp, Artificial Sequence
  Synthetic
cgcttatcaccccatgggctgccgaggaggagaagttgcccattagtcctctgagcaactctcttataaggcatc

SEQ ID NO: 119644 - DNA, 75 bp, Artificial Sequence
  Synthetic
cgcttatcacgccatgagctgccgaggaggagaagttgcccattagtcctctgagcaactctcttataaggcatc

SEQ ID NO: 119645 - DNA, 75 bp, Artificial Sequence
  Synthetic
cgcttatcacgccatgtgctgccgaggaggagaagttgcccattagtcctctgagcaactctcttataaggcatc

SEQ ID NO: 119646 - DNA, 75 bp, Artificial Sequence
  Synthetic
cgcttatcacgccatgcgctgccgaggaggagaagttgcccattagtcctctgagcaactctcttataaggcatc

SEQ ID NO: 119647 - DNA, 75 bp, Artificial Sequence
  Synthetic
cgcttatcacgccatgggctgccgaggaggagaagttgcccattagtcctctgagcaactctcttataaggcatc

SEQ ID NO: 119648 - DNA, 75 bp, Artificial Sequence
  Synthetic
gtaccgatatgtcacccccggtgaaagaccatctggaatgtttgactcggttgtcctctgtgagtgctatgacgc

SEQ ID NO: 119649 - DNA, 75 bp, Artificial Sequence
  Synthetic
ctacggcaagttccttgctgacggtggttgctccgggggtgcctatgacatcataatatgtgatgagtgccactc

SEQ ID NO: 119650 - DNA, 75 bp, Artificial Sequence
  Synthetic
agagggcatacgcttttgaccaggaggtggcggcctccattggcggtggcgtcttggttttcttggcaattttaa

SEQ ID NO: 119651 - DNA, 75 bp, Artificial Sequence
  Synthetic
agagggcatacgcttttgaccaggaggtggcggcctccattggcggtggcgtcttggttttcttggctattttaa

SEQ ID NO: 119652 - DNA, 75 bp, Artificial Sequence
  Synthetic
agagggcatacgcttttgaccaggaggtggcggcctccattggcggtggcgtcttggttttcttggccattttaa

SEQ ID NO: 119653 - DNA, 75 bp, Artificial Sequence
  Synthetic
agagggcatacgcttttgaccaggaggtggcggcctccattggcggtggcgtcttggttttcttggcgattttaa

SEQ ID NO: 119654 - DNA, 75 bp, Artificial Sequence
  Synthetic
tgctggatcagcattaccatgacacccttaaggagataaaggaccgggcctctaaggtgagcgctaggcttctct

SEQ ID NO: 119655 - DNA, 75 bp, Artificial Sequence
  Synthetic
atcccgacgcctcccccaaggagacgccggacggtgggtctgaatgagagcatcataggagatgtcctccaacag

SEQ ID NO: 119656 - DNA, 75 bp, Artificial Sequence
  Synthetic
aagccactgtgtgcgcccgcgcgcaggctcctcccccaagttgggacgagatgtggaagtgtctcgtgcggctta

SEQ ID NO: 119657 - DNA, 75 bp, Artificial Sequence
  Synthetic
cttggtagtgcgtgggccacgggattctatcatcatccttatggctatcatccacccccaactagtctttgaaat

SEQ ID NO: 119658 - DNA, 75 bp, Artificial Sequence
  Synthetic
ccacatcaactccgtgtgggaggacttgctagaagacacatctacacctatccctacaaccattatggccaagaa

SEQ ID NO: 119659 - DNA, 75 bp, Artificial Sequence
  Synthetic
tacgacatcacgcgcaagcttccaacagaggtgatggggcctgcttatggcttccaatactctccaaagcagcgt

SEQ ID NO: 119660 - DNA, 75 bp, Artificial Sequence
  Synthetic
tgcagcttagtccgtggggtggtgtacggcaagtactgccagatggctttacttaaaatgggcgctttaaccggg

SEQ ID NO: 119661 - DNA, 75 bp, Artificial Sequence
  Synthetic
attatgcccagggctggggccccatcagttatgccaacggaagcggccccgacgaacgcccctactgctggcact

SEQ ID NO: 119662 - DNA, 75 bp, Artificial Sequence
  Synthetic
agacagagcattccatatatcaatgctgtcagctggagcccgcagcacggaaggccatcacagcactcactgacc

SEQ ID NO: 119663 - DNA, 75 bp, Artificial Sequence
  Synthetic
agacagagcattccatatatcattgctgtcagctggagcccgcagcacggaaggccatcacagcactcactgacc

SEQ ID NO: 119664 - DNA, 75 bp, Artificial Sequence
  Synthetic
agacagagcattccatatatcactgctgtcagctggagcccgcagcacggaaggccatcacagcactcactgacc

SEQ ID NO: 119665 - DNA, 75 bp, Artificial Sequence
  Synthetic
agacagagcattccatatatcagtgctgtcagctggagcccgcagcacggaaggccatcacagcactcactgacc

SEQ ID NO: 119666 - DNA, 75 bp, Artificial Sequence
  Synthetic
agacagagcattccatttatcaatgctgtcagctggagcccgcagcacggaaggccatcacagcactcactgacc

SEQ ID NO: 119667 - DNA, 75 bp, Artificial Sequence
  Synthetic
agacagagcattccatttatcattgctgtcagctggagcccgcagcacggaaggccatcacagcactcactgacc

SEQ ID NO: 119668 - DNA, 75 bp, Artificial Sequence
  Synthetic
agacagagcattccatttatcactgctgtcagctggagcccgcagcacggaaggccatcacagcactcactgacc

SEQ ID NO: 119669 - DNA, 75 bp, Artificial Sequence
  Synthetic
agacagagcattccatttatcagtgctgtcagctggagcccgcagcacggaaggccatcacagcactcactgacc

SEQ ID NO: 119670 - DNA, 75 bp, Artificial Sequence
  Synthetic
agacagagcattccatctatcaatgctgtcagctggagcccgcagcacggaaggccatcacagcactcactgacc

SEQ ID NO: 119671 - DNA, 75 bp, Artificial Sequence
  Synthetic
agacagagcattccatctatcattgctgtcagctggagcccgcagcacggaaggccatcacagcactcactgacc

SEQ ID NO: 119672 - DNA, 75 bp, Artificial Sequence
  Synthetic
agacagagcattccatctatcactgctgtcagctggagcccgcagcacggaaggccatcacagcactcactgacc

SEQ ID NO: 119673 - DNA, 75 bp, Artificial Sequence
  Synthetic
agacagagcattccatctatcagtgctgtcagctggagcccgcagcacggaaggccatcacagcactcactgacc

SEQ ID NO: 119674 - DNA, 75 bp, Artificial Sequence
  Synthetic
agacagagcattccatgtatcaatgctgtcagctggagcccgcagcacggaaggccatcacagcactcactgacc

SEQ ID NO: 119675 - DNA, 75 bp, Artificial Sequence
  Synthetic
agacagagcattccatgtatcattgctgtcagctggagcccgcagcacggaaggccatcacagcactcactgacc

SEQ ID NO: 119676 - DNA, 75 bp, Artificial Sequence
  Synthetic
agacagagcattccatgtatcactgctgtcagctggagcccgcagcacggaaggccatcacagcactcactgacc

SEQ ID NO: 119677 - DNA, 75 bp, Artificial Sequence
  Synthetic
agacagagcattccatgtatcagtgctgtcagctggagcccgcagcacggaaggccatcacagcactcactgacc

SEQ ID NO: 119678 - DNA, 75 bp, Artificial Sequence
  Synthetic
agaagaaagtgatcgtctggggtgctgatactgctgcctgcggcgatatcattgatgggttgcccgtgtcggcta

SEQ ID NO: 119679 - DNA, 75 bp, Artificial Sequence
  Synthetic
gactatactgcggcggccccatgtttaactcaaaaggtgaatcatgtgggtaccgcaggtgcagggccagtggag

SEQ ID NO: 119680 - DNA, 75 bp, Artificial Sequence
  Synthetic
gactatactgcggcggccccatgtttaactcaaaaggtgaatcatgtgggtaccgcaggtgcagggccagtggtg

SEQ ID NO: 119681 - DNA, 75 bp, Artificial Sequence
  Synthetic
gactatactgcggcggccccatgtttaactcaaaaggtgaatcatgtgggtaccgcaggtgcagggccagtggcg

SEQ ID NO: 119682 - DNA, 75 bp, Artificial Sequence
  Synthetic
gactatactgcggcggccccatgtttaactcaaaaggtgaatcatgtgggtaccgcaggtgcagggccagtgggg

SEQ ID NO: 119683 - DNA, 75 bp, Artificial Sequence
  Synthetic
cttgttgggtaccatcgtgacaagcctcaccggcagggacaccaatgagaactgtggtgaggtccaggtactgtc

SEQ ID NO: 119684 - DNA, 75 bp, Artificial Sequence
  Synthetic
gtatattgcttcactcccagccccgtggtggtggggacgaccgacagggcgggcgcgcctacctacaactggggt

SEQ ID NO: 119685 - DNA, 75 bp, Artificial Sequence
  Synthetic
gtcaaccagatgtacaccaatgttgaccaggacctggtggggtggccggcgcccccgggagtgaagtcgctcaca

SEQ ID NO: 119686 - DNA, 75 bp, Artificial Sequence
  Synthetic
cacagcctgtctcgtgcccgaccccgctggttcatgtggtgcctactcctactttctgtaggggtaggcatctac

SEQ ID NO: 119687 - DNA, 75 bp, Artificial Sequence
  Synthetic
ccaggcccttatctaccttgaagggctcctcgggcggcccactgctgtgcccctcgggccacgctgtcggtatat

SEQ ID NO: 119688 - DNA, 75 bp, Artificial Sequence
  Synthetic
atgacacatttttttggaatactccagtcccaagagacactccacaaagtacttgacttcgacatgtacggggtc

SEQ ID NO: 119689 - DNA, 75 bp, Artificial Sequence
  Synthetic
cgaggaggcccgcactgccatacactcgctaactgagagactttacgtaggagggcccatgtttaacagcaaggg

SEQ ID NO: 119690 - DNA, 75 bp, Artificial Sequence
  Synthetic
agtcccaagagacactccacaaagtacttgacttcgacatgtacggggtcacatactccatcagtccactggatc

SEQ ID NO: 119691 - DNA, 75 bp, Artificial Sequence
  Synthetic
ctctacacctcccgccgtgccacagacttaccaggtagcccacttacacgcgcctacggggagcggcaagagcac

SEQ ID NO: 119692 - DNA, 75 bp, Artificial Sequence
  Synthetic
agacatcgggccagggcggtcagagctaagctcatcgctcaagggggtaaagctgctatttgcggcaaatacctc

SEQ ID NO: 119693 - DNA, 75 bp, Artificial Sequence
  Synthetic
tacttgttgccgcgcaggggccccaggttgggtgtgcgcgcgacgaggaaaacttccgaacggtcccagccacgt

SEQ ID NO: 119694 - DNA, 75 bp, Artificial Sequence
  Synthetic
cacggcatcgacccgaacatacggtcaggtgttagaaccatctctacaggcgcacccatcacgtattccacctac

SEQ ID NO: 119695 - DNA, 75 bp, Artificial Sequence
  Synthetic
cctgcaccttccggggtgcgtgccctgtgtgaggaccggcaacgattcgcggtgctgggtggcgctaacccccac

SEQ ID NO: 119696 - DNA, 75 bp, Artificial Sequence
  Synthetic
gcacagtactcgatcaagcagagaccgctggagctcgccttgttgtgctcgcgactgctacgccgccagggtcgg

SEQ ID NO: 119697 - DNA, 75 bp, Artificial Sequence
  Synthetic
gcgccgccattggaccacccaagactgcaactgttccatctacgctggacacatcacgggccacaggatggcctg

SEQ ID NO: 119698 - DNA, 75 bp, Artificial Sequence
  Synthetic
gagacacctcatcttctgtcattctaagaaaaaatgtggcgaggtggcaaaacaactgtcatctcttggtctcaa

SEQ ID NO: 119699 - DNA, 75 bp, Artificial Sequence
  Synthetic
ggcgtgctcgcagggctggcatactttagcatgcaggccaactgggcaaaagttctcctggtcctgttccttttc

SEQ ID NO: 119700 - DNA, 75 bp, Artificial Sequence
  Synthetic
gattttgactcggtcattgactgcaacacctctgttatacagactgtcgacttcagcctggaccccaccttcact

SEQ ID NO: 119701 - DNA, 75 bp, Artificial Sequence
  Synthetic
atgctgtgctgcacgttcctggatgcatcccctgtgagcgaggggacgacaacaggtcccggtgttggataccag

SEQ ID NO: 119702 - DNA, 75 bp, Artificial Sequence
  Synthetic
acctggtgccctaaccgagggcttgcgagcgcacattgataccgttgtagcgtcagcaacattttgttctgccct

SEQ ID NO: 119703 - DNA, 75 bp, Artificial Sequence
  Synthetic
agcttattaacaccaatggaagttggcacatcaataggactgctctcaactgcaatgacagccttaacgcggggt

SEQ ID NO: 119704 - DNA, 75 bp, Artificial Sequence
  Synthetic
gggagagaccgtctggcatgtttgacacctcaacgctctgtgaatgctacgatgctggatgcgcctggtatgaac

SEQ ID NO: 119705 - DNA, 75 bp, Artificial Sequence
  Synthetic
tgcaatgacagccttaacgcggggtggttcgctgccttgttctacgcccgtaagttcaacagctccgggtgtcct

SEQ ID NO: 119706 - DNA, 75 bp, Artificial Sequence
  Synthetic
ggggctagtcaacatagatgcccatttcttgtcccaaactaagcaggcgggtgataattatccctatctggttgc

SEQ ID NO: 119707 - DNA, 75 bp, Artificial Sequence
  Synthetic
gtgataattatccctatctggttgcttatcaagccacagtctgcgctagggcgcttgctccaccgccttgctggg

SEQ ID NO: 119708 - DNA, 75 bp, Artificial Sequence
  Synthetic
cttgcctatttctccatgcaaggagcgtgggcaaaggtcgtcgtcatcctcctcctgtcagccggggtggacgcg

SEQ ID NO: 119709 - DNA, 75 bp, Artificial Sequence
  Synthetic
ccgcaggaagagaatagctcatcctcaggagtcgacacacagtccagcactgcttccaaagtgccccccccgccg

SEQ ID NO: 119710 - DNA, 75 bp, Artificial Sequence
  Synthetic
ccgccgaggggtccccacgtacaactggggggagaatgagacggacgtgttcgtcctcaactcgactaggcctcc

SEQ ID NO: 119711 - DNA, 75 bp, Artificial Sequence
  Synthetic
tttgcccagggctggggccctattgggtacgccaatggaagcggccccgaccatcgcccctactgctggcactac

SEQ ID NO: 119712 - DNA, 75 bp, Artificial Sequence
  Synthetic
attcttcacagaagtggatggggtacggctgcacaggtacgctccagcgtgcaaacctctcctacgggaggaggt

SEQ ID NO: 119713 - DNA, 75 bp, Artificial Sequence
  Synthetic
gcaaacctctcctacgggaggaggtcacattccaggtcgggctcaaccaatacctggttgggtcacagctcccat

SEQ ID NO: 119714 - DNA, 75 bp, Artificial Sequence
  Synthetic
acatccaatcacaaaatacatcatggcctgtatgtcagcagacctcgaagtggtgaccagcacgtgggtcctggt

SEQ ID NO: 119715 - DNA, 75 bp, Artificial Sequence
  Synthetic
atggcagctggcacattaaccgcacagccctcaactgtaatgactccctgaacaccgggtttcttgcatctttgt

SEQ ID NO: 119716 - DNA, 75 bp, Artificial Sequence
  Synthetic
cattgccctacggattgcttcaggaaacatccagatgcgacctatgcaaagtgtggggcggggccctggctcacg

SEQ ID NO: 119717 - DNA, 75 bp, Artificial Sequence
  Synthetic
aaccgagagatgctttaccaacagttcgacgagatggaagagtgctcagcgcacctcccgctagtcgagcacggc

SEQ ID NO: 119718 - DNA, 75 bp, Artificial Sequence
  Synthetic
ggaagatgtcaccaatggggaggacatgaggccctactgctggcactatccgcctaagccatgcggtctggtctc

SEQ ID NO: 119719 - DNA, 75 bp, Artificial Sequence
  Synthetic
tcgacgagatggaagagtgctcagcgcacctcccgctagtcgagcacggcttacagctggcacatcaattcaagg

SEQ ID NO: 119720 - DNA, 75 bp, Artificial Sequence
  Synthetic
gtacccggtagggtcgcaattaccttgcgagcccgaaccggacgtggccgtgttgacgtccatgctcactgatcc

SEQ ID NO: 119721 - DNA, 75 bp, Artificial Sequence
  Synthetic
aatgtgacggacttcttcctcctgaacagcactcggccccctaggggagcctggtttgggtgtacatggatgaac

SEQ ID NO: 119722 - DNA, 75 bp, Artificial Sequence
  Synthetic
gcacatgtggaacttcattagcgggatccaatatcttgctggcttatccaccttgcctggcaatcccgccattgc

SEQ ID NO: 119723 - DNA, 75 bp, Artificial Sequence
  Synthetic
gctaccggattcaccaaaacatgtggcgcaccaccgtgccgcattcggcaggaccccggagcaaagaatagtagc

SEQ ID NO: 119724 - DNA, 75 bp, Artificial Sequence
  Synthetic
actcccctgacgccgaactcatagaggctaacctcctgtggaggcaggagatgggcggcaacatcaccagggttg

SEQ ID NO: 119725 - DNA, 75 bp, Artificial Sequence
  Synthetic
acccccactgcctccacggcttttgtcgtgagcggcatggcaggggcagcggtcggtagcgtgggccttggcaag

SEQ ID NO: 119726 - DNA, 75 bp, Artificial Sequence
  Synthetic
atggctggtattacgccatgctcttcatctgtgttgcttggtatgtcaagggcaaagccccagctgctgccgctt

SEQ ID NO: 119727 - DNA, 75 bp, Artificial Sequence
  Synthetic
tggacctcaaagaaaacccccttggggttctcgtatgacacccgctgctttgactcgactgtcactgaacaggac

SEQ ID NO: 119728 - DNA, 75 bp, Artificial Sequence
  Synthetic
acccctataggctgtggcactacccgtgcactgtcaactattccatctttaagataaggatgtttgtagggggaa

SEQ ID NO: 119729 - DNA, 75 bp, Artificial Sequence
  Synthetic
tgaatttgctcccggccatactatcgccaggagctctagtggtgggaatggtgtgcgctgcgatcctacgacgcc

SEQ ID NO: 119730 - DNA, 75 bp, Artificial Sequence
  Synthetic
agtcctagcgggcatagcgtacttctccatggcggggaactgggcgaaggtcctggtggtgctgttgctgtttgc

SEQ ID NO: 119731 - DNA, 75 bp, Artificial Sequence
  Synthetic
cactgagtgggccatcttgccctgcactttttcagatctgccagccctttccacgggacttatccacctccacca

SEQ ID NO: 119732 - DNA, 75 bp, Artificial Sequence
  Synthetic
gcaatacttcattgccagagttgaggctgatttgttcgtgtacattccaccactggaagtacgcggacagcgaga

SEQ ID NO: 119733 - DNA, 75 bp, Artificial Sequence
  Synthetic
cgacgcagccgctcgcgtaacacagatactatcatccctcactgtgacatccctgcttaggcgactccacaaatg

SEQ ID NO: 119734 - DNA, 75 bp, Artificial Sequence
  Synthetic
gatgccagagtctgtgcctgtctatggatgcttatcctgctgggccaggccgaagcagcactggaaaggctggtt

SEQ ID NO: 119735 - DNA, 75 bp, Artificial Sequence
  Synthetic
gctaagctcctgcctcgcatgccaggcattcccttcctctcgtgccagaaggggtacaagggagagtggaggggt

SEQ ID NO: 119736 - DNA, 75 bp, Artificial Sequence
  Synthetic
ccacctactccctcattggcctatggcccttcgtcctgcttcttttggtgttgccccaacaggcctacgcctttg

SEQ ID NO: 119737 - DNA, 75 bp, Artificial Sequence
  Synthetic
gcctcaaggacctagcgacggcacttgaaccagtcacattcacgccgatggagaaaaaggtgatagtctggggcg

SEQ ID NO: 119738 - DNA, 75 bp, Artificial Sequence
  Synthetic
cctggcatggtactttccccatcaatgcgtctaccactggacctggcatacccgtcccggcgccaaactacgagt

SEQ ID NO: 119739 - DNA, 75 bp, Artificial Sequence
  Synthetic
ccttgtgctgctggtgattatatctatcttcacactcaccccggcatataagatgcttctcggtcggtgcctgtg

SEQ ID NO: 119740 - DNA, 75 bp, Artificial Sequence
  Synthetic
agaagcgcaactgcacgtgtgggttccccccctcaacgtccgaggggggcgcgacgccgtcatcttactcatgtg

SEQ ID NO: 119741 - DNA, 75 bp, Artificial Sequence
  Synthetic
aatagggttgcggggacactcaggaagcttgggtgcccccccctacgagcttggagacatcgggcacgagcagtg

SEQ ID NO: 119742 - DNA, 75 bp, Artificial Sequence
  Synthetic
ctgccaggttcctgcccctgagtttttcactgaggtggatggtgtcaggctccaccgctacgctcctccatgcaa

SEQ ID NO: 119743 - DNA, 75 bp, Artificial Sequence
  Synthetic
accatgttctgcccgggtatagtgtttgacataaccaagtggctcctggcgatcctcgggcctggttacctcttg

SEQ ID NO: 119744 - DNA, 75 bp, Artificial Sequence
  Synthetic
acatctatgctgacagacccatctcatgtgactgcagagatggctcgtcgtaggctggccagagggtcgtcacct

SEQ ID NO: 119745 - DNA, 75 bp, Artificial Sequence
  Synthetic
tggcattgctggcccttggtagatggtttggtacatacatctatgaccacctcacccctatgtcagactgggctg

SEQ ID NO: 119746 - DNA, 75 bp, Artificial Sequence
  Synthetic
ttgcctactcctactaacgttaggggtaggcatcttcctcccaccagctcgatgagctggtaggataacactcca

SEQ ID NO: 119747 - DNA, 75 bp, Artificial Sequence
  Synthetic
ccgatggagaagagagtcatcacttggggggcagagacagcagcgtgcggagacattatacatggattgcctgtt

SEQ ID NO: 119748 - DNA, 75 bp, Artificial Sequence
  Synthetic
ggggccccaagcaacacatccagctggtcaacgccaatggcagttggcacatcaataggacggccttgaactgca

SEQ ID NO: 119749 - DNA, 75 bp, Artificial Sequence
  Synthetic
acctcttatggggcgccaaggctaccaggatcgagacggaggacaaggtggtggtgctagactctttcgagcccc

SEQ ID NO: 119750 - DNA, 75 bp, Artificial Sequence
  Synthetic
ctcgcggcctacttgggacaattgtcaccagtctcacaggtcgcgacaaaaatgaggtcgagggcgagatacaag

SEQ ID NO: 119751 - DNA, 75 bp, Artificial Sequence
  Synthetic
gcccgttgaatccctggaaactaccatgagatccccagtgtttactgacaactctacgccccctgccgtgcccca

SEQ ID NO: 119752 - DNA, 75 bp, Artificial Sequence
  Synthetic
tagttacaacccccccttcgtcgagacatggaagcggcaagattacgacccaccggttgtacacggctgcgcatt

SEQ ID NO: 119753 - DNA, 75 bp, Artificial Sequence
  Synthetic
actctacgccccctgccgtgccccaaacttaccaagtcgcccatttgcacgcaccgacggggagtggcaagagca

SEQ ID NO: 119754 - DNA, 75 bp, Artificial Sequence
  Synthetic
aggccctgtttgccaaatgtacaccaatgtggaccaggacatggtgggatggccagcacctccaggtgctagatc

SEQ ID NO: 119755 - DNA, 75 bp, Artificial Sequence
  Synthetic
aagaccttcggccggccaaagccagactctgactccggggcggggcttgctactccaactagcactcctgatcag

SEQ ID NO: 119756 - DNA, 75 bp, Artificial Sequence
  Synthetic
agtgatgtctatctagtcaccaggaatgcggacgtgatccccgcaaggcgcaggggggacacccgcgctggactc

SEQ ID NO: 119757 - DNA, 75 bp, Artificial Sequence
  Synthetic
ggtccactgttagcaactcggaagatgtggagtgctgctccatgtcctactcttggacgggggcacttgtgacac

SEQ ID NO: 119758 - DNA, 75 bp, Artificial Sequence
  Synthetic
caagaggagttgctaaggcgatagacttcgtgcccgtcgagaacatggagactaccatgcggtctccggtcttca

SEQ ID NO: 119759 - DNA, 75 bp, Artificial Sequence
  Synthetic
cactcggcagaagaaggtcaccttcgaccgtctacaagtagtggacagtcattatgacaatacactcaaggagat

SEQ ID NO: 119760 - DNA, 75 bp, Artificial Sequence
  Synthetic
agagcacaaaggtaccggcagcgtacgctagccagggttacaaggtgctggtgctcaatccatctgtagcagcca

SEQ ID NO: 119761 - DNA, 75 bp, Artificial Sequence
  Synthetic
agcaagctccctcaggccgtgatgggaagctcctacggattccaatactcaccaggacagcgggttgaattcctc

SEQ ID NO: 119762 - DNA, 75 bp, Artificial Sequence
  Synthetic
cggacctgggggtcagaatatgcgagaaaagagcgcttcatgacgtcgtcaagaacctccctcaagccgtgatgg

SEQ ID NO: 119763 - DNA, 75 bp, Artificial Sequence
  Synthetic
aaggcggcaggcaccttattttctgtcactcaaagaagaaatgcgacgagctggccaagcaattaagatcacttg

SEQ ID NO: 119764 - DNA, 75 bp, Artificial Sequence
  Synthetic
caggtttaacaaacatagatgctcatttcttgtcccagaccaaacaagcgggtgataattatccctacctggttg

SEQ ID NO: 119765 - DNA, 75 bp, Artificial Sequence
  Synthetic
ggtgataattatccctacctggttgcttatcaggctacggtctgtgctagagcgctggcccctccaccgagctgg

SEQ ID NO: 119766 - DNA, 75 bp, Artificial Sequence
  Synthetic
tacgggtgatttcgactccgttatagactgcaatgttgcggtcacacaggtagttgatttcagcctagaccccac

SEQ ID NO: 119767 - DNA, 75 bp, Artificial Sequence
  Synthetic
gactgcaatgttgcggtcacacaggtagttgatttcagcctagaccccaccttcacgattgagaccaccaccgtt

SEQ ID NO: 119768 - DNA, 75 bp, Artificial Sequence
  Synthetic
cgcgccagcggcgtatacactaccagcttcggaaacacactgacgtgctaccttaaggccatggccgctaccaag

SEQ ID NO: 119769 - DNA, 75 bp, Artificial Sequence
  Synthetic
ccttcacggaggctatgacgagatactcggctcctccgggagaccccccccagccagcttacgacctcgagcaaa

SEQ ID NO: 119770 - DNA, 75 bp, Artificial Sequence
  Synthetic
cacgcctgggctgcccgtgtgccaagatcatcttgaattctgggagggagtgttcacggggctcacgcacatcga

SEQ ID NO: 119771 - DNA, 75 bp, Artificial Sequence
  Synthetic
cgggtctactatctgacccgagaccctgaaactcccctagcacgcgctgcttgggagacagcccgacacactcca

SEQ ID NO: 119772 - DNA, 75 bp, Artificial Sequence
  Synthetic
catcatgacttgcatgtcagccgacctcgaggtgatcactagcgcctgggtgctcacggggggaattcttgctgc

SEQ ID NO: 119773 - DNA, 75 bp, Artificial Sequence
  Synthetic
cagcagttcgatgagatggaggagtgctcacaccggatcccctacttagtcgagggccaacaaattgccgagcaa

SEQ ID NO: 119774 - DNA, 75 bp, Artificial Sequence
  Synthetic
agagctgaaaccggcggttcagtctgcgtggcccaagctcgagcagttctggcagaaacatctgtggaattttgt

SEQ ID NO: 119775 - DNA, 75 bp, Artificial Sequence
  Synthetic
tccgtaggagtaggcatcttcctgctgccagctcgctaggcagcctaacactccgaccttagggtcatcctgatt

SEQ ID NO: 119776 - DNA, 75 bp, Artificial Sequence
  Synthetic
tccgtaggagtaggcatcttcctgctgccagctcgctaggcagcctaacactccgaccttagggtcatcctgttt

SEQ ID NO: 119777 - DNA, 75 bp, Artificial Sequence
  Synthetic
tccgtaggagtaggcatcttcctgctgccagctcgctaggcagcctaacactccgaccttagggtcatcctgctt

SEQ ID NO: 119778 - DNA, 75 bp, Artificial Sequence
  Synthetic
tccgtaggagtaggcatcttcctgctgccagctcgctaggcagcctaacactccgaccttagggtcatcctggtt

SEQ ID NO: 119779 - DNA, 75 bp, Artificial Sequence
  Synthetic
tccgtaggagtaggcatcttcctgctgccagctcgctaggcagcctaacactccgaccttagggtcttcctgatt

SEQ ID NO: 119780 - DNA, 75 bp, Artificial Sequence
  Synthetic
tccgtaggagtaggcatcttcctgctgccagctcgctaggcagcctaacactccgaccttagggtcttcctgttt

SEQ ID NO: 119781 - DNA, 75 bp, Artificial Sequence
  Synthetic
tccgtaggagtaggcatcttcctgctgccagctcgctaggcagcctaacactccgaccttagggtcttcctgctt

SEQ ID NO: 119782 - DNA, 75 bp, Artificial Sequence
  Synthetic
tccgtaggagtaggcatcttcctgctgccagctcgctaggcagcctaacactccgaccttagggtcttcctggtt

SEQ ID NO: 119783 - DNA, 75 bp, Artificial Sequence
  Synthetic
tccgtaggagtaggcatcttcctgctgccagctcgctaggcagcctaacactccgaccttagggtcctcctgatt

SEQ ID NO: 119784 - DNA, 75 bp, Artificial Sequence
  Synthetic
tccgtaggagtaggcatcttcctgctgccagctcgctaggcagcctaacactccgaccttagggtcctcctgttt

SEQ ID NO: 119785 - DNA, 75 bp, Artificial Sequence
  Synthetic
tccgtaggagtaggcatcttcctgctgccagctcgctaggcagcctaacactccgaccttagggtcctcctgctt

SEQ ID NO: 119786 - DNA, 75 bp, Artificial Sequence
  Synthetic
tccgtaggagtaggcatcttcctgctgccagctcgctaggcagcctaacactccgaccttagggtcctcctggtt

SEQ ID NO: 119787 - DNA, 75 bp, Artificial Sequence
  Synthetic
tccgtaggagtaggcatcttcctgctgccagctcgctaggcagcctaacactccgaccttagggtcgtcctgatt

SEQ ID NO: 119788 - DNA, 75 bp, Artificial Sequence
  Synthetic
tccgtaggagtaggcatcttcctgctgccagctcgctaggcagcctaacactccgaccttagggtcgtcctgttt

SEQ ID NO: 119789 - DNA, 75 bp, Artificial Sequence
  Synthetic
tccgtaggagtaggcatcttcctgctgccagctcgctaggcagcctaacactccgaccttagggtcgtcctgctt

SEQ ID NO: 119790 - DNA, 75 bp, Artificial Sequence
  Synthetic
tccgtaggagtaggcatcttcctgctgccagctcgctaggcagcctaacactccgaccttagggtcgtcctggtt

SEQ ID NO: 119791 - DNA, 75 bp, Artificial Sequence
  Synthetic
tccgtaggagtaggcatcttcctgctgcctgctcgctaggcagcctaacactccgaccttagggtcatcctgatt

SEQ ID NO: 119792 - DNA, 75 bp, Artificial Sequence
  Synthetic
tccgtaggagtaggcatcttcctgctgcctgctcgctaggcagcctaacactccgaccttagggtcatcctgttt

SEQ ID NO: 119793 - DNA, 75 bp, Artificial Sequence
  Synthetic
tccgtaggagtaggcatcttcctgctgcctgctcgctaggcagcctaacactccgaccttagggtcatcctgctt

SEQ ID NO: 119794 - DNA, 75 bp, Artificial Sequence
  Synthetic
tccgtaggagtaggcatcttcctgctgcctgctcgctaggcagcctaacactccgaccttagggtcatcctggtt

SEQ ID NO: 119795 - DNA, 75 bp, Artificial Sequence
  Synthetic
tccgtaggagtaggcatcttcctgctgcctgctcgctaggcagcctaacactccgaccttagggtcttcctgatt

SEQ ID NO: 119796 - DNA, 75 bp, Artificial Sequence
  Synthetic
tccgtaggagtaggcatcttcctgctgcctgctcgctaggcagcctaacactccgaccttagggtcttcctgttt

SEQ ID NO: 119797 - DNA, 75 bp, Artificial Sequence
  Synthetic
tccgtaggagtaggcatcttcctgctgcctgctcgctaggcagcctaacactccgaccttagggtcttcctgctt

SEQ ID NO: 119798 - DNA, 75 bp, Artificial Sequence
  Synthetic
tccgtaggagtaggcatcttcctgctgcctgctcgctaggcagcctaacactccgaccttagggtcttcctggtt

SEQ ID NO: 119799 - DNA, 75 bp, Artificial Sequence
  Synthetic
tccgtaggagtaggcatcttcctgctgcctgctcgctaggcagcctaacactccgaccttagggtcctcctgatt

SEQ ID NO: 119800 - DNA, 75 bp, Artificial Sequence
  Synthetic
tccgtaggagtaggcatcttcctgctgcctgctcgctaggcagcctaacactccgaccttagggtcctcctgttt

SEQ ID NO: 119801 - DNA, 75 bp, Artificial Sequence
  Synthetic
tccgtaggagtaggcatcttcctgctgcctgctcgctaggcagcctaacactccgaccttagggtcctcctgctt

SEQ ID NO: 119802 - DNA, 75 bp, Artificial Sequence
  Synthetic
tccgtaggagtaggcatcttcctgctgcctgctcgctaggcagcctaacactccgaccttagggtcctcctggtt

SEQ ID NO: 119803 - DNA, 75 bp, Artificial Sequence
  Synthetic
tccgtaggagtaggcatcttcctgctgcctgctcgctaggcagcctaacactccgaccttagggtcgtcctgatt

SEQ ID NO: 119804 - DNA, 75 bp, Artificial Sequence
  Synthetic
tccgtaggagtaggcatcttcctgctgcctgctcgctaggcagcctaacactccgaccttagggtcgtcctgttt

SEQ ID NO: 119805 - DNA, 75 bp, Artificial Sequence
  Synthetic
tccgtaggagtaggcatcttcctgctgcctgctcgctaggcagcctaacactccgaccttagggtcgtcctgctt

SEQ ID NO: 119806 - DNA, 75 bp, Artificial Sequence
  Synthetic
tccgtaggagtaggcatcttcctgctgcctgctcgctaggcagcctaacactccgaccttagggtcgtcctggtt

SEQ ID NO: 119807 - DNA, 75 bp, Artificial Sequence
  Synthetic
tccgtaggagtaggcatcttcctgctgcccgctcgctaggcagcctaacactccgaccttagggtcatcctgatt

SEQ ID NO: 119808 - DNA, 75 bp, Artificial Sequence
  Synthetic
tccgtaggagtaggcatcttcctgctgcccgctcgctaggcagcctaacactccgaccttagggtcatcctgttt

SEQ ID NO: 119809 - DNA, 75 bp, Artificial Sequence
  Synthetic
tccgtaggagtaggcatcttcctgctgcccgctcgctaggcagcctaacactccgaccttagggtcatcctgctt

SEQ ID NO: 119810 - DNA, 75 bp, Artificial Sequence
  Synthetic
tccgtaggagtaggcatcttcctgctgcccgctcgctaggcagcctaacactccgaccttagggtcatcctggtt

SEQ ID NO: 119811 - DNA, 75 bp, Artificial Sequence
  Synthetic
tccgtaggagtaggcatcttcctgctgcccgctcgctaggcagcctaacactccgaccttagggtcttcctgatt

SEQ ID NO: 119812 - DNA, 75 bp, Artificial Sequence
  Synthetic
tccgtaggagtaggcatcttcctgctgcccgctcgctaggcagcctaacactccgaccttagggtcttcctgttt

SEQ ID NO: 119813 - DNA, 75 bp, Artificial Sequence
  Synthetic
tccgtaggagtaggcatcttcctgctgcccgctcgctaggcagcctaacactccgaccttagggtcttcctgctt

SEQ ID NO: 119814 - DNA, 75 bp, Artificial Sequence
  Synthetic
tccgtaggagtaggcatcttcctgctgcccgctcgctaggcagcctaacactccgaccttagggtcttcctggtt

SEQ ID NO: 119815 - DNA, 75 bp, Artificial Sequence
  Synthetic
tccgtaggagtaggcatcttcctgctgcccgctcgctaggcagcctaacactccgaccttagggtcctcctgatt

SEQ ID NO: 119816 - DNA, 75 bp, Artificial Sequence
  Synthetic
tccgtaggagtaggcatcttcctgctgcccgctcgctaggcagcctaacactccgaccttagggtcctcctgttt

SEQ ID NO: 119817 - DNA, 75 bp, Artificial Sequence
  Synthetic
tccgtaggagtaggcatcttcctgctgcccgctcgctaggcagcctaacactccgaccttagggtcctcctgctt

SEQ ID NO: 119818 - DNA, 75 bp, Artificial Sequence
  Synthetic
tccgtaggagtaggcatcttcctgctgcccgctcgctaggcagcctaacactccgaccttagggtcctcctggtt

SEQ ID NO: 119819 - DNA, 75 bp, Artificial Sequence
  Synthetic
tccgtaggagtaggcatcttcctgctgcccgctcgctaggcagcctaacactccgaccttagggtcgtcctgatt

SEQ ID NO: 119820 - DNA, 75 bp, Artificial Sequence
  Synthetic
tccgtaggagtaggcatcttcctgctgcccgctcgctaggcagcctaacactccgaccttagggtcgtcctgttt

SEQ ID NO: 119821 - DNA, 75 bp, Artificial Sequence
  Synthetic
tccgtaggagtaggcatcttcctgctgcccgctcgctaggcagcctaacactccgaccttagggtcgtcctgctt

SEQ ID NO: 119822 - DNA, 75 bp, Artificial Sequence
  Synthetic
tccgtaggagtaggcatcttcctgctgcccgctcgctaggcagcctaacactccgaccttagggtcgtcctggtt

SEQ ID NO: 119823 - DNA, 75 bp, Artificial Sequence
  Synthetic
tccgtaggagtaggcatcttcctgctgccggctcgctaggcagcctaacactccgaccttagggtcatcctgatt

SEQ ID NO: 119824 - DNA, 75 bp, Artificial Sequence
  Synthetic
tccgtaggagtaggcatcttcctgctgccggctcgctaggcagcctaacactccgaccttagggtcatcctgttt

SEQ ID NO: 119825 - DNA, 75 bp, Artificial Sequence
  Synthetic
tccgtaggagtaggcatcttcctgctgccggctcgctaggcagcctaacactccgaccttagggtcatcctgctt

SEQ ID NO: 119826 - DNA, 75 bp, Artificial Sequence
  Synthetic
tccgtaggagtaggcatcttcctgctgccggctcgctaggcagcctaacactccgaccttagggtcatcctggtt

SEQ ID NO: 119827 - DNA, 75 bp, Artificial Sequence
  Synthetic
tccgtaggagtaggcatcttcctgctgccggctcgctaggcagcctaacactccgaccttagggtcttcctgatt

SEQ ID NO: 119828 - DNA, 75 bp, Artificial Sequence
  Synthetic
tccgtaggagtaggcatcttcctgctgccggctcgctaggcagcctaacactccgaccttagggtcttcctgttt

SEQ ID NO: 119829 - DNA, 75 bp, Artificial Sequence
  Synthetic
tccgtaggagtaggcatcttcctgctgccggctcgctaggcagcctaacactccgaccttagggtcttcctgctt

SEQ ID NO: 119830 - DNA, 75 bp, Artificial Sequence
  Synthetic
tccgtaggagtaggcatcttcctgctgccggctcgctaggcagcctaacactccgaccttagggtcttcctggtt

SEQ ID NO: 119831 - DNA, 75 bp, Artificial Sequence
  Synthetic
tccgtaggagtaggcatcttcctgctgccggctcgctaggcagcctaacactccgaccttagggtcctcctgatt

SEQ ID NO: 119832 - DNA, 75 bp, Artificial Sequence
  Synthetic
tccgtaggagtaggcatcttcctgctgccggctcgctaggcagcctaacactccgaccttagggtcctcctgttt

SEQ ID NO: 119833 - DNA, 75 bp, Artificial Sequence
  Synthetic
tccgtaggagtaggcatcttcctgctgccggctcgctaggcagcctaacactccgaccttagggtcctcctgctt

SEQ ID NO: 119834 - DNA, 75 bp, Artificial Sequence
  Synthetic
tccgtaggagtaggcatcttcctgctgccggctcgctaggcagcctaacactccgaccttagggtcctcctggtt

SEQ ID NO: 119835 - DNA, 75 bp, Artificial Sequence
  Synthetic
tccgtaggagtaggcatcttcctgctgccggctcgctaggcagcctaacactccgaccttagggtcgtcctgatt

SEQ ID NO: 119836 - DNA, 75 bp, Artificial Sequence
  Synthetic
tccgtaggagtaggcatcttcctgctgccggctcgctaggcagcctaacactccgaccttagggtcgtcctgttt

SEQ ID NO: 119837 - DNA, 75 bp, Artificial Sequence
  Synthetic
tccgtaggagtaggcatcttcctgctgccggctcgctaggcagcctaacactccgaccttagggtcgtcctgctt

SEQ ID NO: 119838 - DNA, 75 bp, Artificial Sequence
  Synthetic
tccgtaggagtaggcatcttcctgctgccggctcgctaggcagcctaacactccgaccttagggtcgtcctggtt

SEQ ID NO: 119839 - DNA, 75 bp, Artificial Sequence
  Synthetic
gagtggtgagccacctgctatggaggacatggtcaaccttctacctgctcttttgtcacctggcgctctggtcgt

SEQ ID NO: 119840 - DNA, 75 bp, Artificial Sequence
  Synthetic
gtaacgcaggacaacatcaaatgcccctgccaggttcccgctcctgaatttttcaccgaggtggacggtgtcagg

SEQ ID NO: 119841 - DNA, 75 bp, Artificial Sequence
  Synthetic
cctgccaggttcccgctcctgaatttttcaccgaggtggacggtgtcaggctgcatcgccacgctccctcatgta

SEQ ID NO: 119842 - DNA, 75 bp, Artificial Sequence
  Synthetic
agagacatctgggactgggtttgcaccgtgctgtcagacttcaagacctggcttaaggccaagcttgtgccgtcc

SEQ ID NO: 119843 - DNA, 75 bp, Artificial Sequence
  Synthetic
ccgtgctgtcagacttcaagacctggcttaaggccaagcttgtgccgtccctgccgggcatcccctttctctcct

SEQ ID NO: 119844 - DNA, 75 bp, Artificial Sequence
  Synthetic
cataggttcgctagtctcttttcattaggccccagccagaagatcgagctggttgacaccagcggcagttggcac

SEQ ID NO: 119845 - DNA, 75 bp, Artificial Sequence
  Synthetic
agcttgtaaacaccaatggcagctggcacatcaataggactgccctgaactgcaacgactccctccaaactggat

SEQ ID NO: 119846 - DNA, 75 bp, Artificial Sequence
  Synthetic
catgcccccccttgagggagagccgggggaccccgatctcagcgacgggtcttggtctaccgtgagcgaggaggc

SEQ ID NO: 119847 - DNA, 75 bp, Artificial Sequence
  Synthetic
atcaggctgcacagatacgcgcctacgtgtcggccacttctccgcgatgagctgacattctcagtagggctcaat

SEQ ID NO: 119848 - DNA, 75 bp, Artificial Sequence
  Synthetic
gtcgtcctcaccgagtccaatgtctcccaagccttgcttgacctggccgggacaacctttggccggggaccgtcg

SEQ ID NO: 119849 - DNA, 75 bp, Artificial Sequence
  Synthetic
ccccggtgttcacagacaactcctccccaccagcagtgccccagagcttccaggtggcccacctgcatgctccca

SEQ ID NO: 119850 - DNA, 75 bp, Artificial Sequence
  Synthetic
gcatgttcgattcgtccgtcctctgtgagtgctatgacgcgggctgtgcttggtatgagctcacgcccgccgaga

SEQ ID NO: 119851 - DNA, 75 bp, Artificial Sequence
  Synthetic
gaagggtataccacccgtgccaccacctaggaggaagaaagttgtacagctcgatgagtcttctgtttcacaggc

SEQ ID NO: 119852 - DNA, 75 bp, Artificial Sequence
  Synthetic
ggcttgggatatgatgatgaactggtcacctacagcagccctagtggtgtcgcagttactccggatcccacaagc

SEQ ID NO: 119853 - DNA, 75 bp, Artificial Sequence
  Synthetic
tcctccgacggtgtggagacggcgtcagacgccggttcatacagctctatgccaccgttggagggggaacccggg

SEQ ID NO: 119854 - DNA, 75 bp, Artificial Sequence
  Synthetic
cagacgccggttcatacagctctatgccaccgttggagggggaacccggggacccagatctcagctcggggtcct

SEQ ID NO: 119855 - DNA, 75 bp, Artificial Sequence
  Synthetic
aaagtctgcgcgtctgatcgtgtacccggacctgggggtccgggtgtgcgagaagagagcgctgtatgacgccgt

SEQ ID NO: 119856 - DNA, 75 bp, Artificial Sequence
  Synthetic
ctctctccgccaaaagaaagtgaccttcgatcgggtccaggtgctggaccaacactacaatgacattcttaagga

SEQ ID NO: 119857 - DNA, 75 bp, Artificial Sequence
  Synthetic
gtatttctccatggtggggaactgggcgaaggtcctggtagtgctgctgctattcgccggcgttgacgcggaaac

SEQ ID NO: 119858 - DNA, 75 bp, Artificial Sequence
  Synthetic
gtggggttccatcacttacgccgagcctgacagatcggaacaaaggctttattgctggcactacgcaacccggcc

SEQ ID NO: 119859 - DNA, 75 bp, Artificial Sequence
  Synthetic
ttcgcctcccgggggaaccatgtttcccccacgcactacgtgccggagagcgatgcagctgcccgcgtcactgcc

SEQ ID NO: 119860 - DNA, 75 bp, Artificial Sequence
  Synthetic
ggagcaaaagaagttcgcagccattctagtaaagccgttaaccacatcaactccgtgtgggaggacttgctagag

SEQ ID NO: 119861 - DNA, 75 bp, Artificial Sequence
  Synthetic
ctgtgtagaccctcaaaaaggcggccgtaagccggcgcgcttgatcgtataccctgatcttggggtaagggtgtg

SEQ ID NO: 119862 - DNA, 75 bp, Artificial Sequence
  Synthetic
gaagcggccccgaccaccgcccctactgctggcactatcctccaaaaccctgtggcattgtgtctgcacgaactg

SEQ ID NO: 119863 - DNA, 75 bp, Artificial Sequence
  Synthetic
ctgcttaagatctggcgctcgaagaaaactcccatgggattctcttacgacaccagatgctttgactcctctgtc

SEQ ID NO: 119864 - DNA, 75 bp, Artificial Sequence
  Synthetic
aaactcccatgggattctcttacgacaccagatgctttgactcctctgtcacggaacgtgacatccgcactgaac

SEQ ID NO: 119865 - DNA, 75 bp, Artificial Sequence
  Synthetic
gcggtggccccatgtataactctcgaggccaatcatgtgggtaccgtaggtgccgtgctagcggtgtcttcacca

SEQ ID NO: 119866 - DNA, 75 bp, Artificial Sequence
  Synthetic
atcacggcctattcccaacagacgcggggcctacttggctgcatcatcaccagcctcaccggccgggacaagaac

SEQ ID NO: 119867 - DNA, 75 bp, Artificial Sequence
  Synthetic
caagcttaggcaacaccatgacatgctacctgaaggcccaggcggcttgtagggcagcgaagctcaaaaactttg

SEQ ID NO: 119868 - DNA, 75 bp, Artificial Sequence
  Synthetic
cgcccccggtgccgctaccgcctttgtgggcgctggcttggctggcgccgccatcggcagtgttggactggggaa

SEQ ID NO: 119869 - DNA, 75 bp, Artificial Sequence
  Synthetic
gtattcggcccccccaggagatgaaccacgcccagagtacgacctggagctgataacatcatgctcatcgaatgt

SEQ ID NO: 119870 - DNA, 75 bp, Artificial Sequence
  Synthetic
ccagtgaactcatggttgggcaacatcatcatgttcgcgcccacaatttgggtgcgcatggtgttgatgacacat

SEQ ID NO: 119871 - DNA, 75 bp, Artificial Sequence
  Synthetic
ttctttggaatactccagtcccaagaaacactccacagggtgcttgacttcgacatgtacggagtcacctactct

SEQ ID NO: 119872 - DNA, 75 bp, Artificial Sequence
  Synthetic
ggatgagcgggagatctccgtacccgcagaaatcctgcggaagtccaggagattcgcccaggccctgcccgtttg

SEQ ID NO: 119873 - DNA, 75 bp, Artificial Sequence
  Synthetic
agaactggggtaaggaccatcaccacgggcgcccccatcacgtactccacctacggcaagttccttgccgacggt

SEQ ID NO: 119874 - DNA, 75 bp, Artificial Sequence
  Synthetic
acggtcccagcccagaggtaggcgccagcccatcccaaaggtgcgccgccaaacgggccgtacctggggacaacc

SEQ ID NO: 119875 - DNA, 75 bp, Artificial Sequence
  Synthetic
ggcggacgcgggggggacatatttcacagcgtgtcccgggcccgaccccgcactttactcctgtgcctactccta

SEQ ID NO: 119876 - DNA, 75 bp, Artificial Sequence
  Synthetic
cggcgtaggtcccgcaacttgggtaaggtcatcgataccctaacatgtggcttcgccgacctcatggggtacgtc

SEQ ID NO: 119877 - DNA, 75 bp, Artificial Sequence
  Synthetic
ggggaaggcatctcattttctgccattccaagaagaagtgtgacgagctcgccgcaaagctgtcaggcctcggac

SEQ ID NO: 119878 - DNA, 75 bp, Artificial Sequence
  Synthetic
tggggacatcatcttgggcctgcccgtctccgcccgaagggggaaggagatacttctgggaccggccgatagttt

SEQ ID NO: 119879 - DNA, 75 bp, Artificial Sequence
  Synthetic
gttgctccttttctatcttcctcctggcactcctctcgtgcctcactgtccccgcctcggccgtcaattatgcta

SEQ ID NO: 119880 - DNA, 75 bp, Artificial Sequence
  Synthetic
gaacaccgcccctactgctggcactaccccccaaagccttgtggtatcgtgccagcacagagcgtatgtggccca

SEQ ID NO: 119881 - DNA, 75 bp, Artificial Sequence
  Synthetic
tgttaggacggggaacatgtcccggtgctgggtgccggccacgcctaccttagcaattccaaacgcgagcgcacc

SEQ ID NO: 119882 - DNA, 75 bp, Artificial Sequence
  Synthetic
ggccaaatgttcaccttccggccccgtgtgcacgaaaccgtccaggagtgcaattgttccatctactctggtcac

SEQ ID NO: 119883 - DNA, 75 bp, Artificial Sequence
  Synthetic
acatccttgctgggggccactggggtgtcatcggtgcgttgatgtactacagcatggtggctaattgggccaagg

SEQ ID NO: 119884 - DNA, 75 bp, Artificial Sequence
  Synthetic
tactcctgcttgctgcaggggtaggcatatacctcctccccaaccgatgaagatgggtaaacactccggctctta

SEQ ID NO: 119885 - DNA, 75 bp, Artificial Sequence
  Synthetic
tccgacgttgagtcctattcttccatgccccccctggagggggagcctggggatccggacctcagcgacgggtca

SEQ ID NO: 119886 - DNA, 75 bp, Artificial Sequence
  Synthetic
gggaccgcaacagaacctgcagctcgttaacaccaatggtagctggcacataaacagaacagctctcaattgcaa

SEQ ID NO: 119887 - DNA, 75 bp, Artificial Sequence
  Synthetic
ctccacctacggcaagttccttgccgacggtggttgctccgggggcgcctatgacatcataatatgtgatgagtg

SEQ ID NO: 119888 - DNA, 75 bp, Artificial Sequence
  Synthetic
gacttcgaccagggatggggtccaatcacatacgccaacgtgactggctccttaactgagaggccatactgctgg

SEQ ID NO: 119889 - DNA, 75 bp, Artificial Sequence
  Synthetic
gttaacacccggggatgggaacacttcgcttacatgccctacagattgcttccgtaagcatcctgaggctacgta

SEQ ID NO: 119890 - DNA, 75 bp, Artificial Sequence
  Synthetic
ggcagggagcccccactttcacctggggggcaaatgagtctgatgtcttcctgatgagcagcttgcgaccaccgg

SEQ ID NO: 119891 - DNA, 75 bp, Artificial Sequence
  Synthetic
cagggaatcttcccggttgctctttttctatcttccttttggcacttctctcgtgcctgactgtccccgcttcgg

SEQ ID NO: 119892 - DNA, 75 bp, Artificial Sequence
  Synthetic
ggtgtgtcccaccgactgcttcaggaagcacccagatgcgacatatgggaagtgcgggtcaggaccgtggctaac

SEQ ID NO: 119893 - DNA, 75 bp, Artificial Sequence
  Synthetic
cataggttcatagccgcctgcaattggaccagaggggagcgttgcaatttggaggatagggacagggtcgaaatg

SEQ ID NO: 119894 - DNA, 75 bp, Artificial Sequence
  Synthetic
cctgaaatgctcagcagctgtaagcccatcacttccttcaagcaggggtggggccccttgacagatgctaacatc

SEQ ID NO: 119895 - DNA, 75 bp, Artificial Sequence
  Synthetic
agcctgagagccttcacggaggctatgaccaggtattctgccccccccggggaccccccacaaccagaatacgac

SEQ ID NO: 119896 - DNA, 75 bp, Artificial Sequence
  Synthetic
tggtcgatgtgcaatacctctatggcattagcacgtcgatcgtgtcatgggccataaagtgggagtatgttgtcc

SEQ ID NO: 119897 - DNA, 75 bp, Artificial Sequence
  Synthetic
caggaccatctggagttttgggagagcgtcttcacaggcctcacccacatagatgcccacttcttgtcccagact

SEQ ID NO: 119898 - DNA, 75 bp, Artificial Sequence
  Synthetic
caccatcgccagtggtcgtaggcactactgatgctaagggcgtcccaacttacacctggggtgagaatgagacag

SEQ ID NO: 119899 - DNA, 75 bp, Artificial Sequence
  Synthetic
tacacctggggtgagaatgagacagatgtgttcctgctgaagtccttgcggcctcccggaggtcggtggtttggg

SEQ ID NO: 119900 - DNA, 75 bp, Artificial Sequence
  Synthetic
agaccctgcttgttggactgatttggtggaaccaatacttcatagccaggatggaggccatgcttaacgagtggg

SEQ ID NO: 119901 - DNA, 75 bp, Artificial Sequence
  Synthetic
agaccctgcttgttggactgatttggtggaaccaatacttcatagccaggatggaggccttgcttaacgagtggg

SEQ ID NO: 119902 - DNA, 75 bp, Artificial Sequence
  Synthetic
agaccctgcttgttggactgatttggtggaaccaatacttcatagccaggatggaggccctgcttaacgagtggg

SEQ ID NO: 119903 - DNA, 75 bp, Artificial Sequence
  Synthetic
agaccctgcttgttggactgatttggtggaaccaatacttcatagccaggatggaggccgtgcttaacgagtggg

SEQ ID NO: 119904 - DNA, 75 bp, Artificial Sequence
  Synthetic
agaccctgcttgttggactgatttggtggaaccaatacttcatagccaggttggaggccatgcttaacgagtggg

SEQ ID NO: 119905 - DNA, 75 bp, Artificial Sequence
  Synthetic
agaccctgcttgttggactgatttggtggaaccaatacttcatagccaggttggaggccttgcttaacgagtggg

SEQ ID NO: 119906 - DNA, 75 bp, Artificial Sequence
  Synthetic
agaccctgcttgttggactgatttggtggaaccaatacttcatagccaggttggaggccctgcttaacgagtggg

SEQ ID NO: 119907 - DNA, 75 bp, Artificial Sequence
  Synthetic
agaccctgcttgttggactgatttggtggaaccaatacttcatagccaggttggaggccgtgcttaacgagtggg

SEQ ID NO: 119908 - DNA, 75 bp, Artificial Sequence
  Synthetic
agaccctgcttgttggactgatttggtggaaccaatacttcatagccaggctggaggccatgcttaacgagtggg

SEQ ID NO: 119909 - DNA, 75 bp, Artificial Sequence
  Synthetic
agaccctgcttgttggactgatttggtggaaccaatacttcatagccaggctggaggccttgcttaacgagtggg

SEQ ID NO: 119910 - DNA, 75 bp, Artificial Sequence
  Synthetic
agaccctgcttgttggactgatttggtggaaccaatacttcatagccaggctggaggccctgcttaacgagtggg

SEQ ID NO: 119911 - DNA, 75 bp, Artificial Sequence
  Synthetic
agaccctgcttgttggactgatttggtggaaccaatacttcatagccaggctggaggccgtgcttaacgagtggg

SEQ ID NO: 119912 - DNA, 75 bp, Artificial Sequence
  Synthetic
agaccctgcttgttggactgatttggtggaaccaatacttcatagccagggtggaggccatgcttaacgagtggg

SEQ ID NO: 119913 - DNA, 75 bp, Artificial Sequence
  Synthetic
agaccctgcttgttggactgatttggtggaaccaatacttcatagccagggtggaggccttgcttaacgagtggg

SEQ ID NO: 119914 - DNA, 75 bp, Artificial Sequence
  Synthetic
agaccctgcttgttggactgatttggtggaaccaatacttcatagccagggtggaggccctgcttaacgagtggg

SEQ ID NO: 119915 - DNA, 75 bp, Artificial Sequence
  Synthetic
agaccctgcttgttggactgatttggtggaaccaatacttcatagccagggtggaggccgtgcttaacgagtggg

SEQ ID NO: 119916 - DNA, 75 bp, Artificial Sequence
  Synthetic
agaccctgcttgttggactgttttggtggaaccaatacttcatagccaggatggaggccatgcttaacgagtggg

SEQ ID NO: 119917 - DNA, 75 bp, Artificial Sequence
  Synthetic
agaccctgcttgttggactgttttggtggaaccaatacttcatagccaggatggaggccttgcttaacgagtggg

SEQ ID NO: 119918 - DNA, 75 bp, Artificial Sequence
  Synthetic
agaccctgcttgttggactgttttggtggaaccaatacttcatagccaggatggaggccctgcttaacgagtggg

SEQ ID NO: 119919 - DNA, 75 bp, Artificial Sequence
  Synthetic
agaccctgcttgttggactgttttggtggaaccaatacttcatagccaggatggaggccgtgcttaacgagtggg

SEQ ID NO: 119920 - DNA, 75 bp, Artificial Sequence
  Synthetic
agaccctgcttgttggactgttttggtggaaccaatacttcatagccaggttggaggccatgcttaacgagtggg

SEQ ID NO: 119921 - DNA, 75 bp, Artificial Sequence
  Synthetic
agaccctgcttgttggactgttttggtggaaccaatacttcatagccaggttggaggccttgcttaacgagtggg

SEQ ID NO: 119922 - DNA, 75 bp, Artificial Sequence
  Synthetic
agaccctgcttgttggactgttttggtggaaccaatacttcatagccaggttggaggccctgcttaacgagtggg

SEQ ID NO: 119923 - DNA, 75 bp, Artificial Sequence
  Synthetic
agaccctgcttgttggactgttttggtggaaccaatacttcatagccaggttggaggccgtgcttaacgagtggg

SEQ ID NO: 119924 - DNA, 75 bp, Artificial Sequence
  Synthetic
agaccctgcttgttggactgttttggtggaaccaatacttcatagccaggctggaggccatgcttaacgagtggg

SEQ ID NO: 119925 - DNA, 75 bp, Artificial Sequence
  Synthetic
agaccctgcttgttggactgttttggtggaaccaatacttcatagccaggctggaggccttgcttaacgagtggg

SEQ ID NO: 119926 - DNA, 75 bp, Artificial Sequence
  Synthetic
agaccctgcttgttggactgttttggtggaaccaatacttcatagccaggctggaggccctgcttaacgagtggg

SEQ ID NO: 119927 - DNA, 75 bp, Artificial Sequence
  Synthetic
agaccctgcttgttggactgttttggtggaaccaatacttcatagccaggctggaggccgtgcttaacgagtggg

SEQ ID NO: 119928 - DNA, 75 bp, Artificial Sequence
  Synthetic
agaccctgcttgttggactgttttggtggaaccaatacttcatagccagggtggaggccatgcttaacgagtggg

SEQ ID NO: 119929 - DNA, 75 bp, Artificial Sequence
  Synthetic
agaccctgcttgttggactgttttggtggaaccaatacttcatagccagggtggaggccttgcttaacgagtggg

SEQ ID NO: 119930 - DNA, 75 bp, Artificial Sequence
  Synthetic
agaccctgcttgttggactgttttggtggaaccaatacttcatagccagggtggaggccctgcttaacgagtggg

SEQ ID NO: 119931 - DNA, 75 bp, Artificial Sequence
  Synthetic
agaccctgcttgttggactgttttggtggaaccaatacttcatagccagggtggaggccgtgcttaacgagtggg

SEQ ID NO: 119932 - DNA, 75 bp, Artificial Sequence
  Synthetic
agaccctgcttgttggactgctttggtggaaccaatacttcatagccaggatggaggccatgcttaacgagtggg

SEQ ID NO: 119933 - DNA, 75 bp, Artificial Sequence
  Synthetic
agaccctgcttgttggactgctttggtggaaccaatacttcatagccaggatggaggccttgcttaacgagtggg

SEQ ID NO: 119934 - DNA, 75 bp, Artificial Sequence
  Synthetic
agaccctgcttgttggactgctttggtggaaccaatacttcatagccaggatggaggccctgcttaacgagtggg

SEQ ID NO: 119935 - DNA, 75 bp, Artificial Sequence
  Synthetic
agaccctgcttgttggactgctttggtggaaccaatacttcatagccaggatggaggccgtgcttaacgagtggg

SEQ ID NO: 119936 - DNA, 75 bp, Artificial Sequence
  Synthetic
agaccctgcttgttggactgctttggtggaaccaatacttcatagccaggttggaggccatgcttaacgagtggg

SEQ ID NO: 119937 - DNA, 75 bp, Artificial Sequence
  Synthetic
agaccctgcttgttggactgctttggtggaaccaatacttcatagccaggttggaggccttgcttaacgagtggg

SEQ ID NO: 119938 - DNA, 75 bp, Artificial Sequence
  Synthetic
agaccctgcttgttggactgctttggtggaaccaatacttcatagccaggttggaggccctgcttaacgagtggg

SEQ ID NO: 119939 - DNA, 75 bp, Artificial Sequence
  Synthetic
agaccctgcttgttggactgctttggtggaaccaatacttcatagccaggttggaggccgtgcttaacgagtggg

SEQ ID NO: 119940 - DNA, 75 bp, Artificial Sequence
  Synthetic
agaccctgcttgttggactgctttggtggaaccaatacttcatagccaggctggaggccatgcttaacgagtggg

SEQ ID NO: 119941 - DNA, 75 bp, Artificial Sequence
  Synthetic
agaccctgcttgttggactgctttggtggaaccaatacttcatagccaggctggaggccttgcttaacgagtggg

SEQ ID NO: 119942 - DNA, 75 bp, Artificial Sequence
  Synthetic
agaccctgcttgttggactgctttggtggaaccaatacttcatagccaggctggaggccctgcttaacgagtggg

SEQ ID NO: 119943 - DNA, 75 bp, Artificial Sequence
  Synthetic
agaccctgcttgttggactgctttggtggaaccaatacttcatagccaggctggaggccgtgcttaacgagtggg

SEQ ID NO: 119944 - DNA, 75 bp, Artificial Sequence
  Synthetic
agaccctgcttgttggactgctttggtggaaccaatacttcatagccagggtggaggccatgcttaacgagtggg

SEQ ID NO: 119945 - DNA, 75 bp, Artificial Sequence
  Synthetic
agaccctgcttgttggactgctttggtggaaccaatacttcatagccagggtggaggccttgcttaacgagtggg

SEQ ID NO: 119946 - DNA, 75 bp, Artificial Sequence
  Synthetic
agaccctgcttgttggactgctttggtggaaccaatacttcatagccagggtggaggccctgcttaacgagtggg

SEQ ID NO: 119947 - DNA, 75 bp, Artificial Sequence
  Synthetic
agaccctgcttgttggactgctttggtggaaccaatacttcatagccagggtggaggccgtgcttaacgagtggg

SEQ ID NO: 119948 - DNA, 75 bp, Artificial Sequence
  Synthetic
agaccctgcttgttggactggtttggtggaaccaatacttcatagccaggatggaggccatgcttaacgagtggg

SEQ ID NO: 119949 - DNA, 75 bp, Artificial Sequence
  Synthetic
agaccctgcttgttggactggtttggtggaaccaatacttcatagccaggatggaggccttgcttaacgagtggg

SEQ ID NO: 119950 - DNA, 75 bp, Artificial Sequence
  Synthetic
agaccctgcttgttggactggtttggtggaaccaatacttcatagccaggatggaggccctgcttaacgagtggg

SEQ ID NO: 119951 - DNA, 75 bp, Artificial Sequence
  Synthetic
agaccctgcttgttggactggtttggtggaaccaatacttcatagccaggatggaggccgtgcttaacgagtggg

SEQ ID NO: 119952 - DNA, 75 bp, Artificial Sequence
  Synthetic
agaccctgcttgttggactggtttggtggaaccaatacttcatagccaggttggaggccatgcttaacgagtggg

SEQ ID NO: 119953 - DNA, 75 bp, Artificial Sequence
  Synthetic
agaccctgcttgttggactggtttggtggaaccaatacttcatagccaggttggaggccttgcttaacgagtggg

SEQ ID NO: 119954 - DNA, 75 bp, Artificial Sequence
  Synthetic
agaccctgcttgttggactggtttggtggaaccaatacttcatagccaggttggaggccctgcttaacgagtggg

SEQ ID NO: 119955 - DNA, 75 bp, Artificial Sequence
  Synthetic
agaccctgcttgttggactggtttggtggaaccaatacttcatagccaggttggaggccgtgcttaacgagtggg

SEQ ID NO: 119956 - DNA, 75 bp, Artificial Sequence
  Synthetic
agaccctgcttgttggactggtttggtggaaccaatacttcatagccaggctggaggccatgcttaacgagtggg

SEQ ID NO: 119957 - DNA, 75 bp, Artificial Sequence
  Synthetic
agaccctgcttgttggactggtttggtggaaccaatacttcatagccaggctggaggccttgcttaacgagtggg

SEQ ID NO: 119958 - DNA, 75 bp, Artificial Sequence
  Synthetic
agaccctgcttgttggactggtttggtggaaccaatacttcatagccaggctggaggccctgcttaacgagtggg

SEQ ID NO: 119959 - DNA, 75 bp, Artificial Sequence
  Synthetic
agaccctgcttgttggactggtttggtggaaccaatacttcatagccaggctggaggccgtgcttaacgagtggg

SEQ ID NO: 119960 - DNA, 75 bp, Artificial Sequence
  Synthetic
agaccctgcttgttggactggtttggtggaaccaatacttcatagccagggtggaggccatgcttaacgagtggg

SEQ ID NO: 119961 - DNA, 75 bp, Artificial Sequence
  Synthetic
agaccctgcttgttggactggtttggtggaaccaatacttcatagccagggtggaggccttgcttaacgagtggg

SEQ ID NO: 119962 - DNA, 75 bp, Artificial Sequence
  Synthetic
agaccctgcttgttggactggtttggtggaaccaatacttcatagccagggtggaggccctgcttaacgagtggg

SEQ ID NO: 119963 - DNA, 75 bp, Artificial Sequence
  Synthetic
agaccctgcttgttggactggtttggtggaaccaatacttcatagccagggtggaggccgtgcttaacgagtggg

SEQ ID NO: 119964 - DNA, 75 bp, Artificial Sequence
  Synthetic
taacgcggcttctgccgcggcctcccagggctggtggtggtgtcttgttttcatctgctgtgcctggtatgtgcg

SEQ ID NO: 119965 - DNA, 75 bp, Artificial Sequence
  Synthetic
ggagtggcctatttcagcatgcaggctaattgggccaaagtcatcttggtcctattcctctttgcaggggttgat

SEQ ID NO: 119966 - DNA, 75 bp, Artificial Sequence
  Synthetic
tcaatgcctggagatttgggcgtgcccccgcaagactgctagccgagtagtgttgggtcgcgaaaggccttgtgg

SEQ ID NO: 119967 - DNA, 75 bp, Artificial Sequence
  Synthetic
tgcctcttccatccatctcttggctttgaggttacaaaggtgttgctggccgtcgtaggatccatgtatctcctc

SEQ ID NO: 119968 - DNA, 75 bp, Artificial Sequence
  Synthetic
tgcctcttccatccatctcttggctttgaggttactaaggtgttgctggccgtcgtaggatccatgtatctcctc

SEQ ID NO: 119969 - DNA, 75 bp, Artificial Sequence
  Synthetic
tgcctcttccatccatctcttggctttgaggttaccaaggtgttgctggccgtcgtaggatccatgtatctcctc

SEQ ID NO: 119970 - DNA, 75 bp, Artificial Sequence
  Synthetic
tgcctcttccatccatctcttggctttgaggttacgaaggtgttgctggccgtcgtaggatccatgtatctcctc

SEQ ID NO: 119971 - DNA, 75 bp, Artificial Sequence
  Synthetic
tctgtcccaccgactgcttcaggaaacatcctgaggccacatacagccggtgtggtgcggggccctggttgacac

SEQ ID NO: 119972 - DNA, 75 bp, Artificial Sequence
  Synthetic
actgaagctgcatcaataggcctcgcagttgttacagccttaaccatccttactctcaccccgacctacaagcgg

SEQ ID NO: 119973 - DNA, 75 bp, Artificial Sequence
  Synthetic
gcaacgggagctggcatataaacaggactgccctcaactgtaatgatagtttaaccactgggttcttagccagct

SEQ ID NO: 119974 - DNA, 75 bp, Artificial Sequence
  Synthetic
catacgctttctatggcgtatggccgctgctcctgctcttgatggcgctaccgccacgggcgtacgccatggacc

SEQ ID NO: 119975 - DNA, 75 bp, Artificial Sequence
  Synthetic
tgttctatgtcaacaaattcaacagctcagggtgccccgaacgactcggaagctgtaagacccttgattcgtttc

SEQ ID NO: 119976 - DNA, 75 bp, Artificial Sequence
  Synthetic
tggaggtacctatatttatgaccatctaagccctcttaccgactgggctgccaacggcttgcgcgatctggctgt

SEQ ID NO: 119977 - DNA, 75 bp, Artificial Sequence
  Synthetic
taccgagagttcgatgaaatggaggagtgcgcctcacacctcccttacatcgaacagggaatgcagctcgccgag

SEQ ID NO: 119978 - DNA, 75 bp, Artificial Sequence
  Synthetic
acgctgtcgtcctgctcacgtgcctccttcacccatccctggggtttgagatcaccaaagtcctgttggcaatca

SEQ ID NO: 119979 - DNA, 75 bp, Artificial Sequence
  Synthetic
ggcagtagaacctgtcgtgttttcccccatggagaagaaaatcatcacgtggggggcagacactgccgcctgtgg

SEQ ID NO: 119980 - DNA, 75 bp, Artificial Sequence
  Synthetic
ggcagttgaacctgtcgtgttttcccccatggagaagaaaatcatcacgtggggggcagacactgccgcctgtgg

SEQ ID NO: 119981 - DNA, 75 bp, Artificial Sequence
  Synthetic
ggcagtcgaacctgtcgtgttttcccccatggagaagaaaatcatcacgtggggggcagacactgccgcctgtgg

SEQ ID NO: 119982 - DNA, 75 bp, Artificial Sequence
  Synthetic
ggcagtggaacctgtcgtgttttcccccatggagaagaaaatcatcacgtggggggcagacactgccgcctgtgg

SEQ ID NO: 119983 - DNA, 75 bp, Artificial Sequence
  Synthetic
tgggggaaaatacgtccaagcactgttcctaaaagtgggggcgtggaccggcacctacatctatgaccatctggc

SEQ ID NO: 119984 - DNA, 75 bp, Artificial Sequence
  Synthetic
gtgcccctccatgcgaggttaaggccaataatggttcatcctggcgctgccccaccgattgtttcaggaagcatc

SEQ ID NO: 119985 - DNA, 75 bp, Artificial Sequence
  Synthetic
gccgacacagctgcttgtggtgacatcattgctggattgccagtatctgcaaggaggggaaacctcattttccta

SEQ ID NO: 119986 - DNA, 75 bp, Artificial Sequence
  Synthetic
ggagcttgccataaagacctttggcgactccggatcatcagccgccgacagcggcacagcgactgcccctcctgg

SEQ ID NO: 119987 - DNA, 75 bp, Artificial Sequence
  Synthetic
ggatccgacgttgagtcgtactcctccatgcccccccttgagggggagccgggggaccccgatctcagcgacggg

SEQ ID NO: 119988 - DNA, 75 bp, Artificial Sequence
  Synthetic
gtctgacaggccgggacaggaatgaggtgacgggcgaggtgcaggttatgtccaccgccacacagtccttcttgg

SEQ ID NO: 119989 - DNA, 75 bp, Artificial Sequence
  Synthetic
ggatcaagacctggttggctggcccgcgcctcccggcgcacgatcatacacaccatgcacatgtggggccagcga

SEQ ID NO: 119990 - DNA, 75 bp, Artificial Sequence
  Synthetic
gggtcctccggaggacccctattgtgtggctccggccatgtagttggtctgttccgtgcggccgtctgcacccga

SEQ ID NO: 119991 - DNA, 75 bp, Artificial Sequence
  Synthetic
cctcaaagacctagcagtggccactgaacctgtaatatttagtcccatggaaatcaaggtcatcacttggggcgc

SEQ ID NO: 119992 - DNA, 75 bp, Artificial Sequence
  Synthetic
cctgcgggatgtggcccctgcttctcctactcctaatgctgcccgaaagggcttacgcatttgaccaggaggtgg

SEQ ID NO: 119993 - DNA, 75 bp, Artificial Sequence
  Synthetic
ggacacagcggcttgcggagatattctttgcgggctgcccgtctctgcgcggttgggccgtgaggtgttgttggg

SEQ ID NO: 119994 - DNA, 75 bp, Artificial Sequence
  Synthetic
agacttaccaagtgggctaccttcacgcgcccacgggtagcgggaagagcaccaaggttccggtggcctacgcca

SEQ ID NO: 119995 - DNA, 75 bp, Artificial Sequence
  Synthetic
ccttcttgggactattgtgaccagcttgactggcagggataagaatgtggtgaccggtgaagtgcaggtgctctc

SEQ ID NO: 119996 - DNA, 75 bp, Artificial Sequence
  Synthetic
ctgcatgtctatgttccatccttcgacgtgcgcgggtctcgcgactcactgatcatccttgctgtcctggcttgc

SEQ ID NO: 119997 - DNA, 75 bp, Artificial Sequence
  Synthetic
gacaggggtcagaactatcacaaccggggcgcccatcacttattccacctatgggaagtttctggcagatggcgg

SEQ ID NO: 119998 - DNA, 75 bp, Artificial Sequence
  Synthetic
gacaggggtcagaactatcacaaccggggcgcccatcacttattccacctatgggaagtttctggctgatggcgg

SEQ ID NO: 119999 - DNA, 75 bp, Artificial Sequence
  Synthetic
gacaggggtcagaactatcacaaccggggcgcccatcacttattccacctatgggaagtttctggccgatggcgg

SEQ ID NO: 120000 - DNA, 75 bp, Artificial Sequence
  Synthetic
gacaggggtcagaactatcacaaccggggcgcccatcacttattccacctatgggaagtttctggcggatggcgg

SEQ ID NO: 120001 - DNA, 75 bp, Artificial Sequence
  Synthetic
ccggcgctgggctcagcccggctatccctggcctctttatgggaacgagggctgcgggtgggcaggatggctcct

SEQ ID NO: 120002 - DNA, 75 bp, Artificial Sequence
  Synthetic
catctttaaggtcaggatgtatgtggggggtgtggagcacaggctcaacgccgcatgcaattggactcgaggaga

SEQ ID NO: 120003 - DNA, 75 bp, Artificial Sequence
  Synthetic
gttcagaatgaaatcaccctgacgcacccaatcaccaagtacatcatgacatgcatgtcggctgacctggaggtc

SEQ ID NO: 120004 - DNA, 75 bp, Artificial Sequence
  Synthetic
cgatacctttacgtgtggctttgccgatctcatggggtacattcccgtcgtcggcgccccgttgggcggcgtagc

SEQ ID NO: 120005 - DNA, 75 bp, Artificial Sequence
  Synthetic
acggcaggctgtcgtctcactgtcctcgccacagccacacctcccggatcaaccactgtcccacacccaaacata

SEQ ID NO: 120006 - DNA, 75 bp, Artificial Sequence
  Synthetic
cgaagaagaagtgcgatgaactggccagccagctgcggcagctgggcctcaatgccgtcgccttctaccggggca

SEQ ID NO: 120007 - DNA, 75 bp, Artificial Sequence
  Synthetic
ttgtcctgcctcacaacgcccgcctctgccgtgcaccatcgcaacgtgtcgggcatataccacctcacgaatgac

SEQ ID NO: 120008 - DNA, 75 bp, Artificial Sequence
  Synthetic
cctggtccactacccgtataggctttggcattatccttgtaccgtcaactacaccatatttaaagtcaggatgta

SEQ ID NO: 120009 - DNA, 75 bp, Artificial Sequence
  Synthetic
aggagcgggcaacaacaccttgcactgccccactgactgcttccgcaagcatccggaagctacatactctcggtg

SEQ ID NO: 120010 - DNA, 75 bp, Artificial Sequence
  Synthetic
caacgttgcagtgacgcaagtcgtcgattttagcctagaccccaccttctctattgagataacaacagtccccca

SEQ ID NO: 120011 - DNA, 75 bp, Artificial Sequence
  Synthetic
caacgttgcagtgacgcaagtcgtcgattttagcctagaccccaccttctctattgagattacaacagtccccca

SEQ ID NO: 120012 - DNA, 75 bp, Artificial Sequence
  Synthetic
caacgttgcagtgacgcaagtcgtcgattttagcctagaccccaccttctctattgagatcacaacagtccccca

SEQ ID NO: 120013 - DNA, 75 bp, Artificial Sequence
  Synthetic
caacgttgcagtgacgcaagtcgtcgattttagcctagaccccaccttctctattgagatgacaacagtccccca

SEQ ID NO: 120014 - DNA, 75 bp, Artificial Sequence
  Synthetic
atccagtgtcacctaccctcgcggtaccgaacaccagtgtgcccataacgggtttccggcgtcacgtagacctta

SEQ ID NO: 120015 - DNA, 75 bp, Artificial Sequence
  Synthetic
ggtttccggcgtcacgtagaccttatggtcggcgctgcagcgctgtgctcagctctctatgtcggagacctttgt

SEQ ID NO: 120016 - DNA, 75 bp, Artificial Sequence
  Synthetic
gataccgccgttctctgcgaggcctatgacacaggagccgcgtggtatgagctaacacctgccgagaccacggtc

SEQ ID NO: 120017 - DNA, 75 bp, Artificial Sequence
  Synthetic
tgcccgtgcgcaggagaggggacaccaggggagctctcttgagccccaggcccatatccactcttaaggggtctt

SEQ ID NO: 120018 - DNA, 75 bp, Artificial Sequence
  Synthetic
ggcacagaatggcgtgggacatgatgatgaactggtcgcctaccgtaggatatgtcatctctagcgtcctgcgag

SEQ ID NO: 120019 - DNA, 75 bp, Artificial Sequence
  Synthetic
acttcttgtcccaaacgaagcaggggggggaaaacttagcgtatctagtagcataccaggcaacagtctgcgcta

SEQ ID NO: 120020 - DNA, 75 bp, Artificial Sequence
  Synthetic
acttcttgtcccaaacgaagcaggggggggaaaactttgcgtatctagtagcataccaggcaacagtctgcgcta

SEQ ID NO: 120021 - DNA, 75 bp, Artificial Sequence
  Synthetic
acttcttgtcccaaacgaagcaggggggggaaaacttcgcgtatctagtagcataccaggcaacagtctgcgcta

SEQ ID NO: 120022 - DNA, 75 bp, Artificial Sequence
  Synthetic
acttcttgtcccaaacgaagcaggggggggaaaacttggcgtatctagtagcataccaggcaacagtctgcgcta

SEQ ID NO: 120023 - DNA, 75 bp, Artificial Sequence
  Synthetic
ctggtggtccgctgctgtgccccatgggacacgctgccggcttgttccgcgcggcggtgtgtactcgaggggtag

SEQ ID NO: 120024 - DNA, 75 bp, Artificial Sequence
  Synthetic
gtgcggcgggcagaaccgcccatagcctcgttagcctattcaagcctgggtcagctcaaaaactgcagcttatta

SEQ ID NO: 120025 - DNA, 75 bp, Artificial Sequence
  Synthetic
ggctgtccagaacgagatagtgacaacccaccccatcaccaagtacattatgacatgcatggctgctgaccttga

SEQ ID NO: 120026 - DNA, 75 bp, Artificial Sequence
  Synthetic
ttctagtgggtgccctgaacgcctcagtgcttgcaaaccaatcacccactttgaccagggttgggggccactcac

SEQ ID NO: 120027 - DNA, 75 bp, Artificial Sequence
  Synthetic
accaatggacgacctgcggtcgtgcctgaccgcgaggtaatgtaccagcaatacgatgagatggaagagtgtgca

SEQ ID NO: 120028 - DNA, 75 bp, Artificial Sequence
  Synthetic
accaatggacgtcctgcggtcgtgcctgaccgcgaggtaatgtaccagcaatacgatgagatggaagagtgtgca

SEQ ID NO: 120029 - DNA, 75 bp, Artificial Sequence
  Synthetic
accaatggacgccctgcggtcgtgcctgaccgcgaggtaatgtaccagcaatacgatgagatggaagagtgtgca

SEQ ID NO: 120030 - DNA, 75 bp, Artificial Sequence
  Synthetic
accaatggacggcctgcggtcgtgcctgaccgcgaggtaatgtaccagcaatacgatgagatggaagagtgtgca

SEQ ID NO: 120031 - DNA, 75 bp, Artificial Sequence
  Synthetic
accaatggtcgacctgcggtcgtgcctgaccgcgaggtaatgtaccagcaatacgatgagatggaagagtgtgca

SEQ ID NO: 120032 - DNA, 75 bp, Artificial Sequence
  Synthetic
accaatggtcgtcctgcggtcgtgcctgaccgcgaggtaatgtaccagcaatacgatgagatggaagagtgtgca

SEQ ID NO: 120033 - DNA, 75 bp, Artificial Sequence
  Synthetic
accaatggtcgccctgcggtcgtgcctgaccgcgaggtaatgtaccagcaatacgatgagatggaagagtgtgca

SEQ ID NO: 120034 - DNA, 75 bp, Artificial Sequence
  Synthetic
accaatggtcggcctgcggtcgtgcctgaccgcgaggtaatgtaccagcaatacgatgagatggaagagtgtgca

SEQ ID NO: 120035 - DNA, 75 bp, Artificial Sequence
  Synthetic
accaatggccgacctgcggtcgtgcctgaccgcgaggtaatgtaccagcaatacgatgagatggaagagtgtgca

SEQ ID NO: 120036 - DNA, 75 bp, Artificial Sequence
  Synthetic
accaatggccgtcctgcggtcgtgcctgaccgcgaggtaatgtaccagcaatacgatgagatggaagagtgtgca

SEQ ID NO: 120037 - DNA, 75 bp, Artificial Sequence
  Synthetic
accaatggccgccctgcggtcgtgcctgaccgcgaggtaatgtaccagcaatacgatgagatggaagagtgtgca

SEQ ID NO: 120038 - DNA, 75 bp, Artificial Sequence
  Synthetic
accaatggccggcctgcggtcgtgcctgaccgcgaggtaatgtaccagcaatacgatgagatggaagagtgtgca

SEQ ID NO: 120039 - DNA, 75 bp, Artificial Sequence
  Synthetic
accaatgggcgacctgcggtcgtgcctgaccgcgaggtaatgtaccagcaatacgatgagatggaagagtgtgca

SEQ ID NO: 120040 - DNA, 75 bp, Artificial Sequence
  Synthetic
accaatgggcgtcctgcggtcgtgcctgaccgcgaggtaatgtaccagcaatacgatgagatggaagagtgtgca

SEQ ID NO: 120041 - DNA, 75 bp, Artificial Sequence
  Synthetic
accaatgggcgccctgcggtcgtgcctgaccgcgaggtaatgtaccagcaatacgatgagatggaagagtgtgca

SEQ ID NO: 120042 - DNA, 75 bp, Artificial Sequence
  Synthetic
accaatgggcggcctgcggtcgtgcctgaccgcgaggtaatgtaccagcaatacgatgagatggaagagtgtgca

SEQ ID NO: 120043 - DNA, 75 bp, Artificial Sequence
  Synthetic
atatgctaatatcagtggcccttcaaacgataggccgtattgttggcattatgcacccaggccctgcaagagcct

SEQ ID NO: 120044 - DNA, 75 bp, Artificial Sequence
  Synthetic
ggtacgtaccgatacgtcgcccccggtgaaagaccgtctggaatgtttgactcggttgttctctgtgagtgctat

SEQ ID NO: 120045 - DNA, 75 bp, Artificial Sequence
  Synthetic
aacgcggctagcgccgccggcactgctggctggtggtgggcggtgcttttcctgtgctgtgcttggtatgtgaaa

SEQ ID NO: 120046 - DNA, 75 bp, Artificial Sequence
  Synthetic
aacgataggccgtattgttggcattatgcacccaggccctgcaagagcctgcgtgcagaggaagtatgtggcccc

SEQ ID NO: 120047 - DNA, 75 bp, Artificial Sequence
  Synthetic
ggctgctcagctggcgcctatgacgtcatcatatgcgatgaatgccattcagtggacgctactaccatccttggc

SEQ ID NO: 120048 - DNA, 75 bp, Artificial Sequence
  Synthetic
tcaaaccggccgttgagtcatcttggcccaagctggagcagttctggcataagcacatgtggaacttcatcagtg

SEQ ID NO: 120049 - DNA, 75 bp, Artificial Sequence
  Synthetic
tggaaagccagaggccccctgtgggtgcttggttcgggtgcgtgtggatgaacagcactggatttgtcaaaacat

SEQ ID NO: 120050 - DNA, 75 bp, Artificial Sequence
  Synthetic
tgagactccgggcttatttcaacacgcccggtctacccgtgtgtcaagaccacctggagttctgggaagcggtct

SEQ ID NO: 120051 - DNA, 75 bp, Artificial Sequence
  Synthetic
acaaacactgctgttcaacgtgctaggggggtggctggcaacacagcttgccccccccagctcatccactgcctt

SEQ ID NO: 120052 - DNA, 75 bp, Artificial Sequence
  Synthetic
ttcggtgattcccacatctggggacgtcgtggtatgcgccacagacgccctcatgacggggtttaccggcgactt

SEQ ID NO: 120053 - DNA, 75 bp, Artificial Sequence
  Synthetic
ccaagatgcatggtagactatccatacaggctgtggcactatccatgcacagtcaacttcacaaaacacaaggtt

SEQ ID NO: 120054 - DNA, 75 bp, Artificial Sequence
  Synthetic
ctcgtagcctttaagatcatgagcggcgagtctccttccatggaggacgttgtcaacctgctgcctgcattgtta

SEQ ID NO: 120055 - DNA, 75 bp, Artificial Sequence
  Synthetic
gtcccctcctcttttctaccacagagctgtcaatcttgccctgcagttttacacctatgcccgctctttctacag

SEQ ID NO: 120056 - DNA, 75 bp, Artificial Sequence
  Synthetic
cctttgcttcacgtggtaaccatgtatcccccacccattacgtgcctgagacggatgcgtctcgcgcggtcacca

SEQ ID NO: 120057 - DNA, 75 bp, Artificial Sequence
  Synthetic
gagcttcttagtgttggcagacgctcgcatttgtgcaatactttggctcatgctgctcattacccaagctgaagc

SEQ ID NO: 120058 - DNA, 75 bp, Artificial Sequence
  Synthetic
tgtctgggactgggtgtgcaccgtcctctctgactttaaggtctggctcaaggccaagttgatcccagctttgcc

SEQ ID NO: 120059 - DNA, 75 bp, Artificial Sequence
  Synthetic
ggcagggctgttccagcctttacctatggcatcttacagttgtggccactcctgctattgctcctagtgttacct

SEQ ID NO: 120060 - DNA, 75 bp, Artificial Sequence
  Synthetic
cacgtcaggaacgggaccatgagggtggtagggccccgtacctgcagcaacatgtggcacggcacatttcccatc

SEQ ID NO: 120061 - DNA, 75 bp, Artificial Sequence
  Synthetic
catagggggtataggcctgggcaaggtcttacttgacatcctagcaggatacggagctggtgtctcaggcgcctt

SEQ ID NO: 120062 - DNA, 75 bp, Artificial Sequence
  Synthetic
acactttcacctttttacaagaccctgcttgctggactgctttggtggaaccagtacttcatagccaggtttgag

SEQ ID NO: 120063 - DNA, 75 bp, Artificial Sequence
  Synthetic
gtggtgggaatgttaatcgggatgcctgtctttccctagtcttggtgtcaggcaagtgctcaaagtcaggataag

SEQ ID NO: 120064 - DNA, 75 bp, Artificial Sequence
  Synthetic
accacgacttccactatgtgacgggagttactactgacaacatcaagtgcccatgccaggtcccggcgccggaat

SEQ ID NO: 120065 - DNA, 75 bp, Artificial Sequence
  Synthetic
caacaggactgccctgaactgcaatgactccctccacaccgggttccttgcctcgctgttctacgtacacaagtt

SEQ ID NO: 120066 - DNA, 75 bp, Artificial Sequence
  Synthetic
ggagggagtggattcactccagctcagctccgggacaagatggccatggagctcctgctacataaatgtcaggga

SEQ ID NO: 120067 - DNA, 75 bp, Artificial Sequence
  Synthetic
gcgaaggacgttaggagccattctagcaaggccattaaccacatcaactccgtgtgggaggacttgttagaggac

SEQ ID NO: 120068 - DNA, 75 bp, Artificial Sequence
  Synthetic
agggtccatgtatctcctccaagaaagccttctgcgggtcccgtactttgtgcgtgcacatgcactattgcgggt

SEQ ID NO: 120069 - DNA, 75 bp, Artificial Sequence
  Synthetic
cctcgctgttctacgtacacaagttcaactcgtcggggtgcccagagcgtatggccagctgtcgctccattgatc

SEQ ID NO: 120070 - DNA, 75 bp, Artificial Sequence
  Synthetic
gaagcgcgcactttacgacatctcacgcaaattaccacaagccatcatgggaggagcctatggcttccagtattc

SEQ ID NO: 120071 - DNA, 75 bp, Artificial Sequence
  Synthetic
cgcggtgggatctcagctgccttgtgagcccgagcctgatgagatggtactaagatctatgcttagggacccgga

SEQ ID NO: 120072 - DNA, 75 bp, Artificial Sequence
  Synthetic
gccatgtgtaccacacactgggagcacccggacgaggagcttctggaagcaaaccttctgtggaggcaggagatg

SEQ ID NO: 120073 - DNA, 75 bp, Artificial Sequence
  Synthetic
agtggtctggcgggggcagcagtcggtagtgtgggccttggtaagattctagtggacatcctcgctggctacggc

SEQ ID NO: 120074 - DNA, 75 bp, Artificial Sequence
  Synthetic
tctgaaagcaacggcagcatgcaaagctgccggcctcaaggacgtcgacatgttggtatgcggagacgatttggt

SEQ ID NO: 120075 - DNA, 75 bp, Artificial Sequence
  Synthetic
agtggacatcctcgctggctacggcgccggcgtagctggcgctgtggtcactttcaagatcatgagcggcgagat

SEQ ID NO: 120076 - DNA, 75 bp, Artificial Sequence
  Synthetic
tgccccacggactgcttccggaagcaccccgaggccacttacacaaaatgtggttcggggccttggttgacacct

SEQ ID NO: 120077 - DNA, 75 bp, Artificial Sequence
  Synthetic
ggctcctcggcaccattgtgacaagcctcactggtcgggacagaaatgaggttgaaggggagatacagattgtgt

SEQ ID NO: 120078 - DNA, 75 bp, Artificial Sequence
  Synthetic
ctgctgagtgtcatagaccaccaagacctaagtttcctccggcacttccaatatgggctcggcctgactacaacc

SEQ ID NO: 120079 - DNA, 75 bp, Artificial Sequence
  Synthetic
ctgctgagtgtcatagaccaccaagacctaagtttcctccggcacttccattatgggctcggcctgactacaacc

SEQ ID NO: 120080 - DNA, 75 bp, Artificial Sequence
  Synthetic
ctgctgagtgtcatagaccaccaagacctaagtttcctccggcacttccactatgggctcggcctgactacaacc

SEQ ID NO: 120081 - DNA, 75 bp, Artificial Sequence
  Synthetic
ctgctgagtgtcatagaccaccaagacctaagtttcctccggcacttccagtatgggctcggcctgactacaacc

SEQ ID NO: 120082 - DNA, 75 bp, Artificial Sequence
  Synthetic
gttgaaggggagatacagattgtgtccaccgcaacacagactttccttgcgactgcagtgaacggtgtgctatgg

SEQ ID NO: 120083 - DNA, 75 bp, Artificial Sequence
  Synthetic
gaagaagaagctcatacgcctcaacaactcggtcgtagcgcaagctctggccgagcttgcacagaagagcttccc

SEQ ID NO: 120084 - DNA, 75 bp, Artificial Sequence
  Synthetic
agacgggccgtacctggggtcaacctgggtacccttggcctctgtatgggaacgagggctgcggatgggcagggt

SEQ ID NO: 120085 - DNA, 75 bp, Artificial Sequence
  Synthetic
agacgggccgtacctggggtcaacctgggtacccttggcctctgtatgggaacgagggctgcggttgggcagggt

SEQ ID NO: 120086 - DNA, 75 bp, Artificial Sequence
  Synthetic
agacgggccgtacctggggtcaacctgggtacccttggcctctgtatgggaacgagggctgcggctgggcagggt

SEQ ID NO: 120087 - DNA, 75 bp, Artificial Sequence
  Synthetic
agacgggccgtacctggggtcaacctgggtacccttggcctctgtatgggaacgagggctgcgggtgggcagggt

SEQ ID NO: 120088 - DNA, 75 bp, Artificial Sequence
  Synthetic
tgatccatctccatcagaacatcgtggacgtgcaatacctgtacggtatagggtcggcggttgtctcctttgcaa

SEQ ID NO: 120089 - DNA, 75 bp, Artificial Sequence
  Synthetic
ccctaattggggcacaaacgacccccggcggagatcacgcaacctgggaaaggtcatcgacaccctgacttgcgg

SEQ ID NO: 120090 - DNA, 75 bp, Artificial Sequence
  Synthetic
ccctaattggggcacaaacgacccccggcggagatcacgcaacctgggtaaggtcatcgacaccctgacttgcgg

SEQ ID NO: 120091 - DNA, 75 bp, Artificial Sequence
  Synthetic
ccctaattggggcacaaacgacccccggcggagatcacgcaacctgggcaaggtcatcgacaccctgacttgcgg

SEQ ID NO: 120092 - DNA, 75 bp, Artificial Sequence
  Synthetic
ccctaattggggcacaaacgacccccggcggagatcacgcaacctggggaaggtcatcgacaccctgacttgcgg

SEQ ID NO: 120093 - DNA, 75 bp, Artificial Sequence
  Synthetic
ccctaattggggctcaaacgacccccggcggagatcacgcaacctgggaaaggtcatcgacaccctgacttgcgg

SEQ ID NO: 120094 - DNA, 75 bp, Artificial Sequence
  Synthetic
ccctaattggggctcaaacgacccccggcggagatcacgcaacctgggtaaggtcatcgacaccctgacttgcgg

SEQ ID NO: 120095 - DNA, 75 bp, Artificial Sequence
  Synthetic
ccctaattggggctcaaacgacccccggcggagatcacgcaacctgggcaaggtcatcgacaccctgacttgcgg

SEQ ID NO: 120096 - DNA, 75 bp, Artificial Sequence
  Synthetic
ccctaattggggctcaaacgacccccggcggagatcacgcaacctggggaaggtcatcgacaccctgacttgcgg

SEQ ID NO: 120097 - DNA, 75 bp, Artificial Sequence
  Synthetic
ccctaattggggcccaaacgacccccggcggagatcacgcaacctgggaaaggtcatcgacaccctgacttgcgg

SEQ ID NO: 120098 - DNA, 75 bp, Artificial Sequence
  Synthetic
ccctaattggggcccaaacgacccccggcggagatcacgcaacctgggtaaggtcatcgacaccctgacttgcgg

SEQ ID NO: 120099 - DNA, 75 bp, Artificial Sequence
  Synthetic
ccctaattggggcccaaacgacccccggcggagatcacgcaacctgggcaaggtcatcgacaccctgacttgcgg

SEQ ID NO: 120100 - DNA, 75 bp, Artificial Sequence
  Synthetic
ccctaattggggcccaaacgacccccggcggagatcacgcaacctggggaaggtcatcgacaccctgacttgcgg

SEQ ID NO: 120101 - DNA, 75 bp, Artificial Sequence
  Synthetic
ccctaattggggcgcaaacgacccccggcggagatcacgcaacctgggaaaggtcatcgacaccctgacttgcgg

SEQ ID NO: 120102 - DNA, 75 bp, Artificial Sequence
  Synthetic
ccctaattggggcgcaaacgacccccggcggagatcacgcaacctgggtaaggtcatcgacaccctgacttgcgg

SEQ ID NO: 120103 - DNA, 75 bp, Artificial Sequence
  Synthetic
ccctaattggggcgcaaacgacccccggcggagatcacgcaacctgggcaaggtcatcgacaccctgacttgcgg

SEQ ID NO: 120104 - DNA, 75 bp, Artificial Sequence
  Synthetic
ccctaattggggcgcaaacgacccccggcggagatcacgcaacctggggaaggtcatcgacaccctgacttgcgg

SEQ ID NO: 120105 - DNA, 75 bp, Artificial Sequence
  Synthetic
ccctatttggggcacaaacgacccccggcggagatcacgcaacctgggaaaggtcatcgacaccctgacttgcgg

SEQ ID NO: 120106 - DNA, 75 bp, Artificial Sequence
  Synthetic
ccctatttggggcacaaacgacccccggcggagatcacgcaacctgggtaaggtcatcgacaccctgacttgcgg

SEQ ID NO: 120107 - DNA, 75 bp, Artificial Sequence
  Synthetic
ccctatttggggcacaaacgacccccggcggagatcacgcaacctgggcaaggtcatcgacaccctgacttgcgg

SEQ ID NO: 120108 - DNA, 75 bp, Artificial Sequence
  Synthetic
ccctatttggggcacaaacgacccccggcggagatcacgcaacctggggaaggtcatcgacaccctgacttgcgg

SEQ ID NO: 120109 - DNA, 75 bp, Artificial Sequence
  Synthetic
ccctatttggggctcaaacgacccccggcggagatcacgcaacctgggaaaggtcatcgacaccctgacttgcgg

SEQ ID NO: 120110 - DNA, 75 bp, Artificial Sequence
  Synthetic
ccctatttggggctcaaacgacccccggcggagatcacgcaacctgggtaaggtcatcgacaccctgacttgcgg

SEQ ID NO: 120111 - DNA, 75 bp, Artificial Sequence
  Synthetic
ccctatttggggctcaaacgacccccggcggagatcacgcaacctgggcaaggtcatcgacaccctgacttgcgg

SEQ ID NO: 120112 - DNA, 75 bp, Artificial Sequence
  Synthetic
ccctatttggggctcaaacgacccccggcggagatcacgcaacctggggaaggtcatcgacaccctgacttgcgg

SEQ ID NO: 120113 - DNA, 75 bp, Artificial Sequence
  Synthetic
ccctatttggggcccaaacgacccccggcggagatcacgcaacctgggaaaggtcatcgacaccctgacttgcgg

SEQ ID NO: 120114 - DNA, 75 bp, Artificial Sequence
  Synthetic
ccctatttggggcccaaacgacccccggcggagatcacgcaacctgggtaaggtcatcgacaccctgacttgcgg

SEQ ID NO: 120115 - DNA, 75 bp, Artificial Sequence
  Synthetic
ccctatttggggcccaaacgacccccggcggagatcacgcaacctgggcaaggtcatcgacaccctgacttgcgg

SEQ ID NO: 120116 - DNA, 75 bp, Artificial Sequence
  Synthetic
ccctatttggggcccaaacgacccccggcggagatcacgcaacctggggaaggtcatcgacaccctgacttgcgg

SEQ ID NO: 120117 - DNA, 75 bp, Artificial Sequence
  Synthetic
ccctatttggggcgcaaacgacccccggcggagatcacgcaacctgggaaaggtcatcgacaccctgacttgcgg

SEQ ID NO: 120118 - DNA, 75 bp, Artificial Sequence
  Synthetic
ccctatttggggcgcaaacgacccccggcggagatcacgcaacctgggtaaggtcatcgacaccctgacttgcgg

SEQ ID NO: 120119 - DNA, 75 bp, Artificial Sequence
  Synthetic
ccctatttggggcgcaaacgacccccggcggagatcacgcaacctgggcaaggtcatcgacaccctgacttgcgg

SEQ ID NO: 120120 - DNA, 75 bp, Artificial Sequence
  Synthetic
ccctatttggggcgcaaacgacccccggcggagatcacgcaacctggggaaggtcatcgacaccctgacttgcgg

SEQ ID NO: 120121 - DNA, 75 bp, Artificial Sequence
  Synthetic
ccctacttggggcacaaacgacccccggcggagatcacgcaacctgggaaaggtcatcgacaccctgacttgcgg

SEQ ID NO: 120122 - DNA, 75 bp, Artificial Sequence
  Synthetic
ccctacttggggcacaaacgacccccggcggagatcacgcaacctgggtaaggtcatcgacaccctgacttgcgg

SEQ ID NO: 120123 - DNA, 75 bp, Artificial Sequence
  Synthetic
ccctacttggggcacaaacgacccccggcggagatcacgcaacctgggcaaggtcatcgacaccctgacttgcgg

SEQ ID NO: 120124 - DNA, 75 bp, Artificial Sequence
  Synthetic
ccctacttggggcacaaacgacccccggcggagatcacgcaacctggggaaggtcatcgacaccctgacttgcgg

SEQ ID NO: 120125 - DNA, 75 bp, Artificial Sequence
  Synthetic
ccctacttggggctcaaacgacccccggcggagatcacgcaacctgggaaaggtcatcgacaccctgacttgcgg

SEQ ID NO: 120126 - DNA, 75 bp, Artificial Sequence
  Synthetic
ccctacttggggctcaaacgacccccggcggagatcacgcaacctgggtaaggtcatcgacaccctgacttgcgg

SEQ ID NO: 120127 - DNA, 75 bp, Artificial Sequence
  Synthetic
ccctacttggggctcaaacgacccccggcggagatcacgcaacctgggcaaggtcatcgacaccctgacttgcgg

SEQ ID NO: 120128 - DNA, 75 bp, Artificial Sequence
  Synthetic
ccctacttggggctcaaacgacccccggcggagatcacgcaacctggggaaggtcatcgacaccctgacttgcgg

SEQ ID NO: 120129 - DNA, 75 bp, Artificial Sequence
  Synthetic
ccctacttggggcccaaacgacccccggcggagatcacgcaacctgggaaaggtcatcgacaccctgacttgcgg

SEQ ID NO: 120130 - DNA, 75 bp, Artificial Sequence
  Synthetic
ccctacttggggcccaaacgacccccggcggagatcacgcaacctgggtaaggtcatcgacaccctgacttgcgg

SEQ ID NO: 120131 - DNA, 75 bp, Artificial Sequence
  Synthetic
ccctacttggggcccaaacgacccccggcggagatcacgcaacctgggcaaggtcatcgacaccctgacttgcgg

SEQ ID NO: 120132 - DNA, 75 bp, Artificial Sequence
  Synthetic
ccctacttggggcccaaacgacccccggcggagatcacgcaacctggggaaggtcatcgacaccctgacttgcgg

SEQ ID NO: 120133 - DNA, 75 bp, Artificial Sequence
  Synthetic
ccctacttggggcgcaaacgacccccggcggagatcacgcaacctgggaaaggtcatcgacaccctgacttgcgg

SEQ ID NO: 120134 - DNA, 75 bp, Artificial Sequence
  Synthetic
ccctacttggggcgcaaacgacccccggcggagatcacgcaacctgggtaaggtcatcgacaccctgacttgcgg

SEQ ID NO: 120135 - DNA, 75 bp, Artificial Sequence
  Synthetic
ccctacttggggcgcaaacgacccccggcggagatcacgcaacctgggcaaggtcatcgacaccctgacttgcgg

SEQ ID NO: 120136 - DNA, 75 bp, Artificial Sequence
  Synthetic
ccctacttggggcgcaaacgacccccggcggagatcacgcaacctggggaaggtcatcgacaccctgacttgcgg

SEQ ID NO: 120137 - DNA, 75 bp, Artificial Sequence
  Synthetic
ccctagttggggcacaaacgacccccggcggagatcacgcaacctgggaaaggtcatcgacaccctgacttgcgg

SEQ ID NO: 120138 - DNA, 75 bp, Artificial Sequence
  Synthetic
ccctagttggggcacaaacgacccccggcggagatcacgcaacctgggtaaggtcatcgacaccctgacttgcgg

SEQ ID NO: 120139 - DNA, 75 bp, Artificial Sequence
  Synthetic
ccctagttggggcacaaacgacccccggcggagatcacgcaacctgggcaaggtcatcgacaccctgacttgcgg

SEQ ID NO: 120140 - DNA, 75 bp, Artificial Sequence
  Synthetic
ccctagttggggcacaaacgacccccggcggagatcacgcaacctggggaaggtcatcgacaccctgacttgcgg

SEQ ID NO: 120141 - DNA, 75 bp, Artificial Sequence
  Synthetic
ccctagttggggctcaaacgacccccggcggagatcacgcaacctgggaaaggtcatcgacaccctgacttgcgg

SEQ ID NO: 120142 - DNA, 75 bp, Artificial Sequence
  Synthetic
ccctagttggggctcaaacgacccccggcggagatcacgcaacctgggtaaggtcatcgacaccctgacttgcgg

SEQ ID NO: 120143 - DNA, 75 bp, Artificial Sequence
  Synthetic
ccctagttggggctcaaacgacccccggcggagatcacgcaacctgggcaaggtcatcgacaccctgacttgcgg

SEQ ID NO: 120144 - DNA, 75 bp, Artificial Sequence
  Synthetic
ccctagttggggctcaaacgacccccggcggagatcacgcaacctggggaaggtcatcgacaccctgacttgcgg

SEQ ID NO: 120145 - DNA, 75 bp, Artificial Sequence
  Synthetic
ccctagttggggcccaaacgacccccggcggagatcacgcaacctgggaaaggtcatcgacaccctgacttgcgg

SEQ ID NO: 120146 - DNA, 75 bp, Artificial Sequence
  Synthetic
ccctagttggggcccaaacgacccccggcggagatcacgcaacctgggtaaggtcatcgacaccctgacttgcgg

SEQ ID NO: 120147 - DNA, 75 bp, Artificial Sequence
  Synthetic
ccctagttggggcccaaacgacccccggcggagatcacgcaacctgggcaaggtcatcgacaccctgacttgcgg

SEQ ID NO: 120148 - DNA, 75 bp, Artificial Sequence
  Synthetic
ccctagttggggcccaaacgacccccggcggagatcacgcaacctggggaaggtcatcgacaccctgacttgcgg

SEQ ID NO: 120149 - DNA, 75 bp, Artificial Sequence
  Synthetic
ccctagttggggcgcaaacgacccccggcggagatcacgcaacctgggaaaggtcatcgacaccctgacttgcgg

SEQ ID NO: 120150 - DNA, 75 bp, Artificial Sequence
  Synthetic
ccctagttggggcgcaaacgacccccggcggagatcacgcaacctgggtaaggtcatcgacaccctgacttgcgg

SEQ ID NO: 120151 - DNA, 75 bp, Artificial Sequence
  Synthetic
ccctagttggggcgcaaacgacccccggcggagatcacgcaacctgggcaaggtcatcgacaccctgacttgcgg

SEQ ID NO: 120152 - DNA, 75 bp, Artificial Sequence
  Synthetic
ccctagttggggcgcaaacgacccccggcggagatcacgcaacctggggaaggtcatcgacaccctgacttgcgg

SEQ ID NO: 120153 - DNA, 75 bp, Artificial Sequence
  Synthetic
ggatcctgcagttcgatgccacctctcgagggcgaaccaggcgacccggatctccttgaggaggggagcgctggg

SEQ ID NO: 120154 - DNA, 75 bp, Artificial Sequence
  Synthetic
ggatcctgcagttcgatgccacctctcgagggcgatccaggcgacccggatctccttgaggaggggagcgctggg

SEQ ID NO: 120155 - DNA, 75 bp, Artificial Sequence
  Synthetic
ggatcctgcagttcgatgccacctctcgagggcgacccaggcgacccggatctccttgaggaggggagcgctggg

SEQ ID NO: 120156 - DNA, 75 bp, Artificial Sequence
  Synthetic
ggatcctgcagttcgatgccacctctcgagggcgagccaggcgacccggatctccttgaggaggggagcgctggg

SEQ ID NO: 120157 - DNA, 75 bp, Artificial Sequence
  Synthetic
tcgtgtatgaggtgcagggcttgatcatgcatctccccgggtgcgtgccctgcgttcgggagggtaatgcctctc

SEQ ID NO: 120158 - DNA, 75 bp, Artificial Sequence
  Synthetic
tccatcaggccatgcagtagggctgtttcgtgccgcagtctgcactcgtggggtggcgaaagcacttgatttcgt

SEQ ID NO: 120159 - DNA, 75 bp, Artificial Sequence
  Synthetic
agcgtatttctccatggtggggaactgggcgaaggtcctggtagtgctgctgctatttgccggcgtcgacgcgga

SEQ ID NO: 120160 - DNA, 75 bp, Artificial Sequence
  Synthetic
gggtggcgaaagcacttgatttcgtgccagtggaaaacatggaaactagcatgagatctcccacgtttacggaca

SEQ ID NO: 120161 - DNA, 75 bp, Artificial Sequence
  Synthetic
gctcgcagccagggatgctggagtccccactcaagcgattcggcgtcatgtcgacttgctcgtcggggcggccac

SEQ ID NO: 120162 - DNA, 75 bp, Artificial Sequence
  Synthetic
aattatgcaacagggaaccttcctggttgctctttctctatcttcctcttggcacttctctcgtgtcttactgtg

SEQ ID NO: 120163 - DNA, 75 bp, Artificial Sequence
  Synthetic
aagagaagctgcccataagtcctttgagcaactctctcgtacgccaccacaatctggtgtactccacctcatcac

SEQ ID NO: 120164 - DNA, 75 bp, Artificial Sequence
  Synthetic
cccactggggtgtcctagcgggcctggcgtattattccatggtggggaactgggctaaggttgtggttgtgctgc

SEQ ID NO: 120165 - DNA, 75 bp, Artificial Sequence
  Synthetic
ggcagttggcacatcaacagcacagccttgaactgcaacgatagccttaacaccggctgggtagcagggcttttc

SEQ ID NO: 120166 - DNA, 75 bp, Artificial Sequence
  Synthetic
gcaaggctataaggttttggtactcaatccatcagtggcagccactcttggcttcggggcctacatgcgtacagc

SEQ ID NO: 120167 - DNA, 75 bp, Artificial Sequence
  Synthetic
tgcaccttcccggatgcgtcccctgtgtcgccgcaaacaacgcgacccagtgctgggtgcctgcctcacccacgt

SEQ ID NO: 120168 - DNA, 75 bp, Artificial Sequence
  Synthetic
cggtgtgaaggcaaggctcctcagcgttgaggaagcatgcgacctcacgccaagacactcggcccgttccaagtt

SEQ ID NO: 120169 - DNA, 75 bp, Artificial Sequence
  Synthetic
aaatatccagctcataaattccaacggcagctggcacatcaaccgcaccgccttgaactgcaatgacagcctgaa

SEQ ID NO: 120170 - DNA, 75 bp, Artificial Sequence
  Synthetic
ggctggggccctatcagttatgccaacggaagcggccccgaccaacgcccctactgctggcactaccccccaaaa

SEQ ID NO: 120171 - DNA, 75 bp, Artificial Sequence
  Synthetic
caccggcttcctagcatcgctgttctacacccacaagttcaactcttcagggtgtcctgagaggatggctagttg

SEQ ID NO: 120172 - DNA, 75 bp, Artificial Sequence
  Synthetic
tgttccgggggcgcctatgatatcatcatctgtgacgagtgccattcaactgatcccactactgtactaggcata

SEQ ID NO: 120173 - DNA, 75 bp, Artificial Sequence
  Synthetic
tcaacgttcggggaggccgcgatgccatcatcctcctcacgtgtgcggtccacccagagctaatctttgacatca

SEQ ID NO: 120174 - DNA, 75 bp, Artificial Sequence
  Synthetic
cctgtgcggaggcgccttcttagttgggcagctcttcgccttcaggccccgcatgcaccgaacagtccagagctg

SEQ ID NO: 120175 - DNA, 75 bp, Artificial Sequence
  Synthetic
ggatcgcaactcccatgcgagccggagccggacgtggccgtgctgacatccatgttgacagacccatcacacata

SEQ ID NO: 120176 - DNA, 75 bp, Artificial Sequence
  Synthetic
cccactacaatcatggcaaagaacgaagtgttctgcgtggacacttcgaagggggggcgcaaacctgcccgactg

SEQ ID NO: 120177 - DNA, 75 bp, Artificial Sequence
  Synthetic
ctaaaccgcaggaagaggatagctcatcctcaggggtcgacacgcagtccagcactacttctaaggtaccccctc

SEQ ID NO: 120178 - DNA, 75 bp, Artificial Sequence
  Synthetic
ccgtgcggcattgtgccggcgaaagaggtttgcgggcctgtatactgtttcacacccagtcccgtggtagtgggg

SEQ ID NO: 120179 - DNA, 75 bp, Artificial Sequence
  Synthetic
ctgagacagccctacctaccacaggagaggtccccttttatggtaaggctatccccctggagtacatcaaagggg

SEQ ID NO: 120180 - DNA, 75 bp, Artificial Sequence
  Synthetic
agctcattaacaccaacggcagttggcacatcaatagaacagcattgaactgtaacgactccctccagactgggt

SEQ ID NO: 120181 - DNA, 75 bp, Artificial Sequence
  Synthetic
agctcattaacaccaacggcagttggcacatcaatagaacagctttgaactgtaacgactccctccagactgggt

SEQ ID NO: 120182 - DNA, 75 bp, Artificial Sequence
  Synthetic
agctcattaacaccaacggcagttggcacatcaatagaacagccttgaactgtaacgactccctccagactgggt

SEQ ID NO: 120183 - DNA, 75 bp, Artificial Sequence
  Synthetic
agctcattaacaccaacggcagttggcacatcaatagaacagcgttgaactgtaacgactccctccagactgggt

SEQ ID NO: 120184 - DNA, 75 bp, Artificial Sequence
  Synthetic
ctcagggagccccagctaatcatagacatcttcgctggcggtcactggggtgtggccgccggcctactctactat

SEQ ID NO: 120185 - DNA, 75 bp, Artificial Sequence
  Synthetic
ctcagggagccccagctaatcatagacatcttcgctggcggtcactggggtgtggccgccggccttctctactat

SEQ ID NO: 120186 - DNA, 75 bp, Artificial Sequence
  Synthetic
ctcagggagccccagctaatcatagacatcttcgctggcggtcactggggtgtggccgccggcctcctctactat

SEQ ID NO: 120187 - DNA, 75 bp, Artificial Sequence
  Synthetic
ctcagggagccccagctaatcatagacatcttcgctggcggtcactggggtgtggccgccggcctgctctactat

SEQ ID NO: 120188 - DNA, 75 bp, Artificial Sequence
  Synthetic
ctcagggtgccccagctaatcatagacatcttcgctggcggtcactggggtgtggccgccggcctactctactat

SEQ ID NO: 120189 - DNA, 75 bp, Artificial Sequence
  Synthetic
ctcagggtgccccagctaatcatagacatcttcgctggcggtcactggggtgtggccgccggccttctctactat

SEQ ID NO: 120190 - DNA, 75 bp, Artificial Sequence
  Synthetic
ctcagggtgccccagctaatcatagacatcttcgctggcggtcactggggtgtggccgccggcctcctctactat

SEQ ID NO: 120191 - DNA, 75 bp, Artificial Sequence
  Synthetic
ctcagggtgccccagctaatcatagacatcttcgctggcggtcactggggtgtggccgccggcctgctctactat

SEQ ID NO: 120192 - DNA, 75 bp, Artificial Sequence
  Synthetic
ctcagggcgccccagctaatcatagacatcttcgctggcggtcactggggtgtggccgccggcctactctactat

SEQ ID NO: 120193 - DNA, 75 bp, Artificial Sequence
  Synthetic
ctcagggcgccccagctaatcatagacatcttcgctggcggtcactggggtgtggccgccggccttctctactat

SEQ ID NO: 120194 - DNA, 75 bp, Artificial Sequence
  Synthetic
ctcagggcgccccagctaatcatagacatcttcgctggcggtcactggggtgtggccgccggcctcctctactat

SEQ ID NO: 120195 - DNA, 75 bp, Artificial Sequence
  Synthetic
ctcagggcgccccagctaatcatagacatcttcgctggcggtcactggggtgtggccgccggcctgctctactat

SEQ ID NO: 120196 - DNA, 75 bp, Artificial Sequence
  Synthetic
ctcagggggccccagctaatcatagacatcttcgctggcggtcactggggtgtggccgccggcctactctactat

SEQ ID NO: 120197 - DNA, 75 bp, Artificial Sequence
  Synthetic
ctcagggggccccagctaatcatagacatcttcgctggcggtcactggggtgtggccgccggccttctctactat

SEQ ID NO: 120198 - DNA, 75 bp, Artificial Sequence
  Synthetic
ctcagggggccccagctaatcatagacatcttcgctggcggtcactggggtgtggccgccggcctcctctactat

SEQ ID NO: 120199 - DNA, 75 bp, Artificial Sequence
  Synthetic
ctcagggggccccagctaatcatagacatcttcgctggcggtcactggggtgtggccgccggcctgctctactat

SEQ ID NO: 120200 - DNA, 75 bp, Artificial Sequence
  Synthetic
tccaatactcacccagtcagagggtggaacgcctcctgaagatgtggcgctcgaagaaaacacctatggggttct

SEQ ID NO: 120201 - DNA, 75 bp, Artificial Sequence
  Synthetic
cctacacatggggcgagaatgagacggatatattgctcctcaacaactctaggccgccactggggaactggttcg

SEQ ID NO: 120202 - DNA, 75 bp, Artificial Sequence
  Synthetic
ggatgtttccgtcatcccaacatctggtgacgtggtggtctgcgcgaccgacgcactcatgactggctacactgg

SEQ ID NO: 120203 - DNA, 75 bp, Artificial Sequence
  Synthetic
ccccatcacctatgccaacaccagtctagaagggtctagaccagaccggaggccctactgctggcactacgcacc

SEQ ID NO: 120204 - DNA, 75 bp, Artificial Sequence
  Synthetic
acgcactcatgactggctacactggggactttgactcggtcattgactgtaacgttaccgttacccaaacggttg

SEQ ID NO: 120205 - DNA, 75 bp, Artificial Sequence
  Synthetic
agctataagctcattgaccgagagactgtacgtggggggacccatgttcaactctcgtggtgagcgttgtggcta

SEQ ID NO: 120206 - DNA, 75 bp, Artificial Sequence
  Synthetic
acccccggcgtaggtcgcgcaatttgggtaaggtcatcgataccctcacgtgcggcttcgccgacctcatggggt

SEQ ID NO: 120207 - DNA, 75 bp, Artificial Sequence
  Synthetic
tacgtgggcttacgggcctctttacccctggagctgcccagcagctccagctggtgaacagcaatgggagttggc

SEQ ID NO: 120208 - DNA, 75 bp, Artificial Sequence
  Synthetic
ttcgtgggcttacgggcctctttacccctggagctgcccagcagctccagctggtgaacagcaatgggagttggc

SEQ ID NO: 120209 - DNA, 75 bp, Artificial Sequence
  Synthetic
tccgtgggcttacgggcctctttacccctggagctgcccagcagctccagctggtgaacagcaatgggagttggc

SEQ ID NO: 120210 - DNA, 75 bp, Artificial Sequence
  Synthetic
tgcgtgggcttacgggcctctttacccctggagctgcccagcagctccagctggtgaacagcaatgggagttggc

SEQ ID NO: 120211 - DNA, 75 bp, Artificial Sequence
  Synthetic
gaagcaacaagactacaagcctccgaccgtccacgggtgcgccttgcctcccagcaagcaacctcccgtccctcc

SEQ ID NO: 120212 - DNA, 75 bp, Artificial Sequence
  Synthetic
cccacatataattggggagagaatgagacggacgtgctgctccttaacaactcgcggccgccgctcggcaactgg

SEQ ID NO: 120213 - DNA, 75 bp, Artificial Sequence
  Synthetic
cgaccgcttgagcgcttgcaggccactctcttacttcgaccaagggtggggccctctttcgtatgccaatatatc

SEQ ID NO: 120214 - DNA, 75 bp, Artificial Sequence
  Synthetic
cggtgtctataggttcgtcgctcaaggcgaaagaccatctgggatgtttgacactgtcgtcctctgcgaggccta

SEQ ID NO: 120215 - DNA, 75 bp, Artificial Sequence
  Synthetic
gatcctgacatgctggtctgcggagacgacttggtgatcatctctgagagtttgggggtctcggaagatgcgggt

SEQ ID NO: 120216 - DNA, 75 bp, Artificial Sequence
  Synthetic
tctttaaggtcaggatgttcttgggcggggttgagcacaggctcgaagccgcgtgcaattggacgcgaggagagc

SEQ ID NO: 120217 - DNA, 75 bp, Artificial Sequence
  Synthetic
ctcgcggccgccgctcggcaactggtttggctgtacctggatgaacagcaccgggtttaccaagacatgtggtgc

SEQ ID NO: 120218 - DNA, 75 bp, Artificial Sequence
  Synthetic
cctgtcaactggcctgatacaactccaccagaacatcgtggacgtgcagtacctctacgggttgagctcggtagt

SEQ ID NO: 120219 - DNA, 75 bp, Artificial Sequence
  Synthetic
cctgtcaactggcctgatacatctccaccagaacatcgtggacgtgcagtacctctacgggttgagctcggtagt

SEQ ID NO: 120220 - DNA, 75 bp, Artificial Sequence
  Synthetic
cctgtcaactggcctgatacacctccaccagaacatcgtggacgtgcagtacctctacgggttgagctcggtagt

SEQ ID NO: 120221 - DNA, 75 bp, Artificial Sequence
  Synthetic
cctgtcaactggcctgatacagctccaccagaacatcgtggacgtgcagtacctctacgggttgagctcggtagt

SEQ ID NO: 120222 - DNA, 75 bp, Artificial Sequence
  Synthetic
ctggagttttgggaaggcgtgttcacaggcttgacccacattgatgcccacttcttgtctcagacaaagcaggca

SEQ ID NO: 120223 - DNA, 75 bp, Artificial Sequence
  Synthetic
ccgagccctgtggtggtgggaactaccgaccgcaagggcctacccacctacaactggggcgagaacgagacagac

SEQ ID NO: 120224 - DNA, 75 bp, Artificial Sequence
  Synthetic
ccgagccctgtggtggtgggaactaccgaccgcaagggcctacccacctacaactggggcgagaacgagtcagac

SEQ ID NO: 120225 - DNA, 75 bp, Artificial Sequence
  Synthetic
ccgagccctgtggtggtgggaactaccgaccgcaagggcctacccacctacaactggggcgagaacgagccagac

SEQ ID NO: 120226 - DNA, 75 bp, Artificial Sequence
  Synthetic
ccgagccctgtggtggtgggaactaccgaccgcaagggcctacccacctacaactggggcgagaacgaggcagac

SEQ ID NO: 120227 - DNA, 75 bp, Artificial Sequence
  Synthetic
agacgcaccgcaccctgagtatgatctggaattaatcacatcctgttcctccaacgtcaccgtagcccacgacaa

SEQ ID NO: 120228 - DNA, 75 bp, Artificial Sequence
  Synthetic
tggttgactatccatacaggctttggcactacccctgcactgtgaattataccatctttaagatcagaatgtatg

SEQ ID NO: 120229 - DNA, 75 bp, Artificial Sequence
  Synthetic
ggcgaaagcccctcccccctcttgggacgtcatgtggaagtgcctcacccgcttaaagcctatgttgacgggtcc

SEQ ID NO: 120230 - DNA, 75 bp, Artificial Sequence
  Synthetic
ggtaacatcatcatgtacgcgcctaccatatgggtgcgtatggtgctgatgacgcatttcttttcaatactccag

SEQ ID NO: 120231 - DNA, 75 bp, Artificial Sequence
  Synthetic
gtaatatcgggcccacaggcaacaaatctctaacgtgccctacggactgtttccggaagcatcctgaggcaacgt

SEQ ID NO: 120232 - DNA, 75 bp, Artificial Sequence
  Synthetic
caggtagaggcggcgttagagaacttgatagtcctcaacgccgcttccctagccgggatacatggtatcgtccct

SEQ ID NO: 120233 - DNA, 75 bp, Artificial Sequence
  Synthetic
gctgtctacaacagagtggcagatactcccctgttccttcaccaccctgccggccttgtccactggtctaatcca

SEQ ID NO: 120234 - DNA, 75 bp, Artificial Sequence
  Synthetic
cacatccaatcaccaaatacatcatgacatgcatggcagctgaccttgaggtcgtgaccagctcgtgggtcttgc

SEQ ID NO: 120235 - DNA, 75 bp, Artificial Sequence
  Synthetic
gtatagcatcactccacttgacctacctcaaatcattcaacgcctacacggcatggctgccttttctttgcatgg

SEQ ID NO: 120236 - DNA, 75 bp, Artificial Sequence
  Synthetic
tggactcgcctattccatctacggaatgtggccattgctcctgcttcttttggcgttgccccaacgggcgtacgc

SEQ ID NO: 120237 - DNA, 75 bp, Artificial Sequence
  Synthetic
caaggtccgcatgtacgtagggggggtggaacacaggttccaggctgcgtgcaactggacgcgaggagagcgatg

SEQ ID NO: 120238 - DNA, 75 bp, Artificial Sequence
  Synthetic
caaggtccgcatgtacgtagggggggtggaacacaggttccaggctgcgtgcaactggacgcgaggagagcgttg

SEQ ID NO: 120239 - DNA, 75 bp, Artificial Sequence
  Synthetic
caaggtccgcatgtacgtagggggggtggaacacaggttccaggctgcgtgcaactggacgcgaggagagcgctg

SEQ ID NO: 120240 - DNA, 75 bp, Artificial Sequence
  Synthetic
caaggtccgcatgtacgtagggggggtggaacacaggttccaggctgcgtgcaactggacgcgaggagagcggtg

SEQ ID NO: 120241 - DNA, 75 bp, Artificial Sequence
  Synthetic
caaggtccgcatgtacgtagggggggtggatcacaggttccaggctgcgtgcaactggacgcgaggagagcgatg

SEQ ID NO: 120242 - DNA, 75 bp, Artificial Sequence
  Synthetic
caaggtccgcatgtacgtagggggggtggatcacaggttccaggctgcgtgcaactggacgcgaggagagcgttg

SEQ ID NO: 120243 - DNA, 75 bp, Artificial Sequence
  Synthetic
caaggtccgcatgtacgtagggggggtggatcacaggttccaggctgcgtgcaactggacgcgaggagagcgctg

SEQ ID NO: 120244 - DNA, 75 bp, Artificial Sequence
  Synthetic
caaggtccgcatgtacgtagggggggtggatcacaggttccaggctgcgtgcaactggacgcgaggagagcggtg

SEQ ID NO: 120245 - DNA, 75 bp, Artificial Sequence
  Synthetic
caaggtccgcatgtacgtagggggggtggaccacaggttccaggctgcgtgcaactggacgcgaggagagcgatg

SEQ ID NO: 120246 - DNA, 75 bp, Artificial Sequence
  Synthetic
caaggtccgcatgtacgtagggggggtggaccacaggttccaggctgcgtgcaactggacgcgaggagagcgttg

SEQ ID NO: 120247 - DNA, 75 bp, Artificial Sequence
  Synthetic
caaggtccgcatgtacgtagggggggtggaccacaggttccaggctgcgtgcaactggacgcgaggagagcgctg

SEQ ID NO: 120248 - DNA, 75 bp, Artificial Sequence
  Synthetic
caaggtccgcatgtacgtagggggggtggaccacaggttccaggctgcgtgcaactggacgcgaggagagcggtg

SEQ ID NO: 120249 - DNA, 75 bp, Artificial Sequence
  Synthetic
caaggtccgcatgtacgtagggggggtggagcacaggttccaggctgcgtgcaactggacgcgaggagagcgatg

SEQ ID NO: 120250 - DNA, 75 bp, Artificial Sequence
  Synthetic
caaggtccgcatgtacgtagggggggtggagcacaggttccaggctgcgtgcaactggacgcgaggagagcgttg

SEQ ID NO: 120251 - DNA, 75 bp, Artificial Sequence
  Synthetic
caaggtccgcatgtacgtagggggggtggagcacaggttccaggctgcgtgcaactggacgcgaggagagcgctg

SEQ ID NO: 120252 - DNA, 75 bp, Artificial Sequence
  Synthetic
caaggtccgcatgtacgtagggggggtggagcacaggttccaggctgcgtgcaactggacgcgaggagagcggtg

SEQ ID NO: 120253 - DNA, 75 bp, Artificial Sequence
  Synthetic
ctcctggcggacgctcgcgtctgcgcctgtttgtggatgatgctgctagtagctcaggcagaggccgccctggag

SEQ ID NO: 120254 - DNA, 75 bp, Artificial Sequence
  Synthetic
tcaacagggctgatccacctccatcagaacatcgtggacgtccaatacctttacggtataggcccggccatcaca

SEQ ID NO: 120255 - DNA, 75 bp, Artificial Sequence
  Synthetic
tcaactgggctgatccacctccatcagaacatcgtggacgtccaatacctttacggtataggcccggccatcaca

SEQ ID NO: 120256 - DNA, 75 bp, Artificial Sequence
  Synthetic
tcaaccgggctgatccacctccatcagaacatcgtggacgtccaatacctttacggtataggcccggccatcaca

SEQ ID NO: 120257 - DNA, 75 bp, Artificial Sequence
  Synthetic
tcaacggggctgatccacctccatcagaacatcgtggacgtccaatacctttacggtataggcccggccatcaca

SEQ ID NO: 120258 - DNA, 75 bp, Artificial Sequence
  Synthetic
tctacagggctgatccacctccatcagaacatcgtggacgtccaatacctttacggtataggcccggccatcaca

SEQ ID NO: 120259 - DNA, 75 bp, Artificial Sequence
  Synthetic
tctactgggctgatccacctccatcagaacatcgtggacgtccaatacctttacggtataggcccggccatcaca

SEQ ID NO: 120260 - DNA, 75 bp, Artificial Sequence
  Synthetic
tctaccgggctgatccacctccatcagaacatcgtggacgtccaatacctttacggtataggcccggccatcaca

SEQ ID NO: 120261 - DNA, 75 bp, Artificial Sequence
  Synthetic
tctacggggctgatccacctccatcagaacatcgtggacgtccaatacctttacggtataggcccggccatcaca

SEQ ID NO: 120262 - DNA, 75 bp, Artificial Sequence
  Synthetic
tccacagggctgatccacctccatcagaacatcgtggacgtccaatacctttacggtataggcccggccatcaca

SEQ ID NO: 120263 - DNA, 75 bp, Artificial Sequence
  Synthetic
tccactgggctgatccacctccatcagaacatcgtggacgtccaatacctttacggtataggcccggccatcaca

SEQ ID NO: 120264 - DNA, 75 bp, Artificial Sequence
  Synthetic
tccaccgggctgatccacctccatcagaacatcgtggacgtccaatacctttacggtataggcccggccatcaca

SEQ ID NO: 120265 - DNA, 75 bp, Artificial Sequence
  Synthetic
tccacggggctgatccacctccatcagaacatcgtggacgtccaatacctttacggtataggcccggccatcaca

SEQ ID NO: 120266 - DNA, 75 bp, Artificial Sequence
  Synthetic
tcgacagggctgatccacctccatcagaacatcgtggacgtccaatacctttacggtataggcccggccatcaca

SEQ ID NO: 120267 - DNA, 75 bp, Artificial Sequence
  Synthetic
tcgactgggctgatccacctccatcagaacatcgtggacgtccaatacctttacggtataggcccggccatcaca

SEQ ID NO: 120268 - DNA, 75 bp, Artificial Sequence
  Synthetic
tcgaccgggctgatccacctccatcagaacatcgtggacgtccaatacctttacggtataggcccggccatcaca

SEQ ID NO: 120269 - DNA, 75 bp, Artificial Sequence
  Synthetic
tcgacggggctgatccacctccatcagaacatcgtggacgtccaatacctttacggtataggcccggccatcaca

SEQ ID NO: 120270 - DNA, 75 bp, Artificial Sequence
  Synthetic
ttggcacatcaataggacggccttgaactgcaatgacagccttaacaccggctggatagcagggcttttctatca

SEQ ID NO: 120271 - DNA, 75 bp, Artificial Sequence
  Synthetic
ctgctactagacaggctgaagagctcaagcctgcagtccactcagcttggcctaaacttgagcagttttggcata

SEQ ID NO: 120272 - DNA, 75 bp, Artificial Sequence
  Synthetic
tgcctggggtagcttatgcgctctacggcgtgtggccgctgctcctgctcctgctggcgttgcccccccgggctt

SEQ ID NO: 120273 - DNA, 75 bp, Artificial Sequence
  Synthetic
caagcctgcagtccactcagcttggcctaaacttgagcagttttggcataagcacatgtggaattttgttagtgg

SEQ ID NO: 120274 - DNA, 75 bp, Artificial Sequence
  Synthetic
cggaggcggccctggaaaacctcatagttctcaatgctgcttccgccgccagccatcagggttggtggtgttgcc

SEQ ID NO: 120275 - DNA, 75 bp, Artificial Sequence
  Synthetic
attattacctcacccgtgatgccactactcccctggcccgtgcggcttgggagacagctcgtcacactccagtta

SEQ ID NO: 120276 - DNA, 75 bp, Artificial Sequence
  Synthetic
gctcatatggtggttgcagtatttcatcacaatgaccgaggcgtgcttgcaggtgtgggtcccccccctcaatgt

SEQ ID NO: 120277 - DNA, 75 bp, Artificial Sequence
  Synthetic
cagaccttattcttaaacattttggggggctggctcgcatcacaactggcgggccccgtgccatccactgccttc

SEQ ID NO: 120278 - DNA, 75 bp, Artificial Sequence
  Synthetic
atggggttctcttatgatacccgctgttttgactctactgtaactgaaaaggacatcagggccgaggaagaggtc

SEQ ID NO: 120279 - DNA, 75 bp, Artificial Sequence
  Synthetic
ctcattaggctctgcatgctggtgcgcaatacaacgggcggtcagtacgtgcagatgggcctgttgaagctgggg

SEQ ID NO: 120280 - DNA, 75 bp, Artificial Sequence
  Synthetic
gttttgactctactgtaactgaaaaggacatcagggccgaggaagaggtctatcagtgttgtgacctggagcccg

SEQ ID NO: 120281 - DNA, 75 bp, Artificial Sequence
  Synthetic
attgccccagcgggcatatgcctacgatcaggagcaagcagcctcaattggggcgctcgtgctcgtggccatcac

SEQ ID NO: 120282 - DNA, 75 bp, Artificial Sequence
  Synthetic
gctggcactacgccccaaggccttgtggtatcgtgcccgcaaagagcgtgtgtggcccagtatattgcttcactc

SEQ ID NO: 120283 - DNA, 75 bp, Artificial Sequence
  Synthetic
cccatgcacaacagcaagggagacctttgtgggtatcggagatgccgcgcaagcggcgtctacacgaccagcttc

SEQ ID NO: 120284 - DNA, 75 bp, Artificial Sequence
  Synthetic
tcatcgcgttcaagatcatgagcggagaggtgccgacaatggaggatgctgtcaaccttctgccggcactcttgt

SEQ ID NO: 120285 - DNA, 75 bp, Artificial Sequence
  Synthetic
atggtgctccaagccagcctcatcagggtcccgtacttcgtgcgtgctcaggggctcattcggctctgcatgctg

SEQ ID NO: 120286 - DNA, 75 bp, Artificial Sequence
  Synthetic
aagtggtgattctggattccttcgatccgctcgtggcggaggaggacgagcgggagatctccgtggccgcagaaa

SEQ ID NO: 120287 - DNA, 75 bp, Artificial Sequence
  Synthetic
tagcccctatcacggcttatgcccaacagacgcggggcctcttgggctgtatcatcaccagcctcactggtcggg

SEQ ID NO: 120288 - DNA, 75 bp, Artificial Sequence
  Synthetic
atccccagcatgtcagtgcgaggtggtcgcgacgccataatactgcttacctgcttattccatccttctcttggc

SEQ ID NO: 120289 - DNA, 75 bp, Artificial Sequence
  Synthetic
tcgctgagagcgatggcgtggaggaggataaccgagccctccgagccttcacggaggctatgacgagatactcgg

SEQ ID NO: 120290 - DNA, 75 bp, Artificial Sequence
  Synthetic
ctttgcctctaggggcaatcacgtgtcacctacccactatgtgcccgagacagatgcctccaggaacgtgataac

SEQ ID NO: 120291 - DNA, 75 bp, Artificial Sequence
  Synthetic
actgggcccacgcgagcctgcgcgacctcgcggtcgcggtcgagcccgtcgttttctccgaaatggaaaccaaga

SEQ ID NO: 120292 - DNA, 75 bp, Artificial Sequence
  Synthetic
tgcgcttgtgcatgctagtacgtcgcgcatgcggtggcaagtacatgcagatgtgtcttctgaaggagggggcct

SEQ ID NO: 120293 - DNA, 75 bp, Artificial Sequence
  Synthetic
tgcgcttgtgcatgctagtacgtcgcgcatgcggtggcaagtacatgcagatgtgtcttctgaaggtgggggcct

SEQ ID NO: 120294 - DNA, 75 bp, Artificial Sequence
  Synthetic
tgcgcttgtgcatgctagtacgtcgcgcatgcggtggcaagtacatgcagatgtgtcttctgaaggcgggggcct

SEQ ID NO: 120295 - DNA, 75 bp, Artificial Sequence
  Synthetic
tgcgcttgtgcatgctagtacgtcgcgcatgcggtggcaagtacatgcagatgtgtcttctgaaggggggggcct

SEQ ID NO: 120296 - DNA, 75 bp, Artificial Sequence
  Synthetic
cgggttggaccagcaagggtggcggctccttgcacctattacggcctatgcacaacaaacgcgaggcctgttagg

SEQ ID NO: 120297 - DNA, 75 bp, Artificial Sequence
  Synthetic
atttgggactgggtttgcactgtcctgtctgacttcaaagtctggctcaagtccaggctggttccatctctgcct

SEQ ID NO: 120298 - DNA, 75 bp, Artificial Sequence
  Synthetic
cggaggacgtcgtgtgctgctcaatgtcttattcctggacaggcgcactcgtcaccccgtgcgccgcggaagaac

SEQ ID NO: 120299 - DNA, 75 bp, Artificial Sequence
  Synthetic
gcctcacccacatagatgcccacttcttgtcccagactaagcaggcaggagacaacttcccctacctggtagcat

SEQ ID NO: 120300 - DNA, 75 bp, Artificial Sequence
  Synthetic
gcctatggagaagaaggtcatcacgtggggagcggataccgcagcttgtggcgacattctggccggcctgcccgt

SEQ ID NO: 120301 - DNA, 75 bp, Artificial Sequence
  Synthetic
aatggtgtgtgctggaccgtctaccacggtgccggctcgagaactttggctggacccaaaggccccgtcatccag

SEQ ID NO: 120302 - DNA, 75 bp, Artificial Sequence
  Synthetic
atgtcaaaaatgggactatgaagttgcacggtccacggacatgcagcaacatctggcacggtacgttccccatca

SEQ ID NO: 120303 - DNA, 75 bp, Artificial Sequence
  Synthetic
ccgtgggtattttcagggccgcggtgtgcacccgtggggttgagaaggcagtggacttcgtgcccgttgagtccc

SEQ ID NO: 120304 - DNA, 75 bp, Artificial Sequence
  Synthetic
ccgtgggtattttcagggccgcggtgtgcacccgtggggttgtgaaggcagtggacttcgtgcccgttgagtccc

SEQ ID NO: 120305 - DNA, 75 bp, Artificial Sequence
  Synthetic
ccgtgggtattttcagggccgcggtgtgcacccgtggggttgcgaaggcagtggacttcgtgcccgttgagtccc

SEQ ID NO: 120306 - DNA, 75 bp, Artificial Sequence
  Synthetic
ccgtgggtattttcagggccgcggtgtgcacccgtggggttgggaaggcagtggacttcgtgcccgttgagtccc

SEQ ID NO: 120307 - DNA, 75 bp, Artificial Sequence
  Synthetic
caactcgttgctacgtcaccacaatctggtgtattccaccacttcacgcagtgcttgccaaaggcagaagaaagt

SEQ ID NO: 120308 - DNA, 75 bp, Artificial Sequence
  Synthetic
acataatggccggggcccattggggcatcttggcgggcctggcctattactccatgcagggcaactgggccaagg

SEQ ID NO: 120309 - DNA, 75 bp, Artificial Sequence
  Synthetic
acacgtggcttgatgggtaccatagtcaccagcctcaccggccgcgacaagaacgaggtcgagggtgaaatacaa

SEQ ID NO: 120310 - DNA, 75 bp, Artificial Sequence
  Synthetic
acacgtggcttgatgggtaccatagtcaccagcctcaccggccgcgacaagaacgaggtcgagggtgaaattcaa

SEQ ID NO: 120311 - DNA, 75 bp, Artificial Sequence
  Synthetic
acacgtggcttgatgggtaccatagtcaccagcctcaccggccgcgacaagaacgaggtcgagggtgaaatccaa

SEQ ID NO: 120312 - DNA, 75 bp, Artificial Sequence
  Synthetic
acacgtggcttgatgggtaccatagtcaccagcctcaccggccgcgacaagaacgaggtcgagggtgaaatgcaa

SEQ ID NO: 120313 - DNA, 75 bp, Artificial Sequence
  Synthetic
tcacgaggcatgcggatgttgttccagtgcgccggcggggcgatagcaggggagccttactctcccctcggccta

SEQ ID NO: 120314 - DNA, 75 bp, Artificial Sequence
  Synthetic
atgcatgtcggctgacctggaggtcgtcactagcacctgggtgctagtaggcggggtccttgcagctctggccgc

SEQ ID NO: 120315 - DNA, 75 bp, Artificial Sequence
  Synthetic
aggcgacagccatttcgtggtgggcttaacaaatgacaatctgaaatgcccatgccaggtgccagctcctgagtt

SEQ ID NO: 120316 - DNA, 75 bp, Artificial Sequence
  Synthetic
aagggccggtctgccaaatgtacaccaatgtggagcaggatctggtaggttggcctgcgccaggcggcgcgaggt

SEQ ID NO: 120317 - DNA, 75 bp, Artificial Sequence
  Synthetic
ggcggtggacttcgtgcccgtggagtccatggaaactaccatgcggtccccggttttcacagacaactcatctcc

SEQ ID NO: 120318 - DNA, 75 bp, Artificial Sequence
  Synthetic
gcttagcccgaggcccctgagcacgctcaaagggtcatcaggagggcccgtaatgtgcccgtcagggcacgtcgt

SEQ ID NO: 120319 - DNA, 75 bp, Artificial Sequence
  Synthetic
gcttagcccgaggcccctgagcacgctcaaagggtcatcaggagggcccgttatgtgcccgtcagggcacgtcgt

SEQ ID NO: 120320 - DNA, 75 bp, Artificial Sequence
  Synthetic
gcttagcccgaggcccctgagcacgctcaaagggtcatcaggagggcccgtcatgtgcccgtcagggcacgtcgt

SEQ ID NO: 120321 - DNA, 75 bp, Artificial Sequence
  Synthetic
gcttagcccgaggcccctgagcacgctcaaagggtcatcaggagggcccgtgatgtgcccgtcagggcacgtcgt

SEQ ID NO: 120322 - DNA, 75 bp, Artificial Sequence
  Synthetic
agccgcgtatgcggatcaggggtacaaggtcctcgtcttgaacccatctgttgctgccactctgggcttcggggc

SEQ ID NO: 120323 - DNA, 75 bp, Artificial Sequence
  Synthetic
tgatagactgcaacacgtgtgtcacccagacagtcgatttcagccttgaccccaccttcaccattgagacaacca

SEQ ID NO: 120324 - DNA, 75 bp, Artificial Sequence
  Synthetic
ggacatgtacaacgcaccgtccccatccggatgcggaactgcttgaggccaatctcttatggaggcaggaggtgg

SEQ ID NO: 120325 - DNA, 75 bp, Artificial Sequence
  Synthetic
aatctcttatggaggcaggaggtgggcggcaacatcacgagagtggagtctgagaacaaggtcatcgttctcgac

SEQ ID NO: 120326 - DNA, 75 bp, Artificial Sequence
  Synthetic
ctcaggggtggggtcccatcactcatgttgtgcctaacatctcggatcagaggccttattgttggcactacgcac

SEQ ID NO: 120327 - DNA, 75 bp, Artificial Sequence
  Synthetic
tctgacaactcatccccgccggccgtgccgcagacatatcaggtggggtaccttcacgcccccacgggtagcggg

SEQ ID NO: 120328 - DNA, 75 bp, Artificial Sequence
  Synthetic
tcctttgaccccatcacaccagaatacgatgagcgggagatatcagttgctgcctcttgccaccgacctcctcgg

SEQ ID NO: 120329 - DNA, 75 bp, Artificial Sequence
  Synthetic
ccaagatttccaccggccctccccatttgggcacggccagactacaatccaccactgatagagagttggaagtcg

SEQ ID NO: 120330 - DNA, 75 bp, Artificial Sequence
  Synthetic
tttgggcacggccagactacaatccaccactgatagagagttggaagtcgcctgagtatgagccccccatggtgg

SEQ ID NO: 120331 - DNA, 75 bp, Artificial Sequence
  Synthetic
ccccacgtataattggggggagaatgagacggacgtgctagtccttaacaacactcggcctccgctgggcaactg

SEQ ID NO: 120332 - DNA, 75 bp, Artificial Sequence
  Synthetic
gtaccgcctatggtgtggaaccaaacatcaggacaggggtgaggaccattacaacggggggacccatcacctact

SEQ ID NO: 120333 - DNA, 75 bp, Artificial Sequence
  Synthetic
gtaccgcctatggtgtggaaccaaacatcaggacaggggtgaggaccattacaacggggggtcccatcacctact

SEQ ID NO: 120334 - DNA, 75 bp, Artificial Sequence
  Synthetic
gtaccgcctatggtgtggaaccaaacatcaggacaggggtgaggaccattacaacggggggccccatcacctact

SEQ ID NO: 120335 - DNA, 75 bp, Artificial Sequence
  Synthetic
gtaccgcctatggtgtggaaccaaacatcaggacaggggtgaggaccattacaacgggggggcccatcacctact

SEQ ID NO: 120336 - DNA, 75 bp, Artificial Sequence
  Synthetic
cgcaccccaacattgaggaggtcgcactgtccaacaccggtgaaattcccttttatgggaaggccatccccctgg

SEQ ID NO: 120337 - DNA, 75 bp, Artificial Sequence
  Synthetic
ccacggttagtgaagagggcgacagcgtagtatgctgttcgtactcctatagctggacaggagcactcattacac

SEQ ID NO: 120338 - DNA, 75 bp, Artificial Sequence
  Synthetic
agaaatggcaaagaaacccttctctcatgactcagacacccccgacagcggtcctgactcaggagtgcctaccac

SEQ ID NO: 120339 - DNA, 75 bp, Artificial Sequence
  Synthetic
catgactcagacacccccgacagcggtcctgactcaggagtgcctaccaccagtacagtggcctccgaacccgac

SEQ ID NO: 120340 - DNA, 75 bp, Artificial Sequence
  Synthetic
ggggataggcaccgtgctcgaccaagccgaaactgccggcgtgcgcctcaccgttttggctaccgcaacaccccc

SEQ ID NO: 120341 - DNA, 75 bp, Artificial Sequence
  Synthetic
gtactaccgaggcctcgacgtgtccgtcataccaactagcggggacgtcgttgttgtggcaacagatgccttgat

SEQ ID NO: 120342 - DNA, 75 bp, Artificial Sequence
  Synthetic
gcgtgggagacagcaagacacactccagtcaattcctggctaggcaacataatcatgtttgcccccacactgtgg

SEQ ID NO: 120343 - DNA, 75 bp, Artificial Sequence
  Synthetic
ctgtcagcgaagaggagagcgtggtttgctgttcctactcatactcctggactggcaatgttatcacgccatgcg

SEQ ID NO: 120344 - DNA, 75 bp, Artificial Sequence
  Synthetic
aagggaggcaggcatctaatcttttgtcattcaaggaagaagtgcgacgaactggctaagcaattgacatcgctt

SEQ ID NO: 120345 - DNA, 75 bp, Artificial Sequence
  Synthetic
atgcttccggagtttatcatgttaccaatgactgcccggactcttccatcgtctatgaggctgataacctgatcc

SEQ ID NO: 120346 - DNA, 75 bp, Artificial Sequence
  Synthetic
ccagaaaaaggtaacctttgaccgcttgcaagtcttagaccaacattatcatgatactcttaaggagatcaagct

SEQ ID NO: 120347 - DNA, 75 bp, Artificial Sequence
  Synthetic
acacaggtgacttcgattccgtcattgactgcaacgtggcagtcacacagatggtagatttcagcctggatccta

SEQ ID NO: 120348 - DNA, 75 bp, Artificial Sequence
  Synthetic
gtgcgcgcagtgcgtaagacttccgagcggtcgcaacctcgcggacggcggcagcctatccccaaggcgcgccag

SEQ ID NO: 120349 - DNA, 75 bp, Artificial Sequence
  Synthetic
gtgtgccaggaccacttggagttttgggagagcgtcttcacaggcctcacccacatagatgcccatttcctatcc

SEQ ID NO: 120350 - DNA, 75 bp, Artificial Sequence
  Synthetic
ctcaccaggtgagcggccgtcgggaatgttcgacagtgtcgttctctgtgaggcgtacgacgtaggatgcgcgtg

SEQ ID NO: 120351 - DNA, 75 bp, Artificial Sequence
  Synthetic
ccattaaccacatcaactccgtgtgggaggacttgttagaggacacttcaactcccattcccacgaccatcatgg

SEQ ID NO: 120352 - DNA, 75 bp, Artificial Sequence
  Synthetic
ctcgccagcttaatctaacgcagggatgcaactgttccatctacagcggccatattaccggccaccggatggctt

SEQ ID NO: 120353 - DNA, 75 bp, Artificial Sequence
  Synthetic
ctcgccagcttaatctaacgcagggttgcaactgttccatctacagcggccatattaccggccaccggatggctt

SEQ ID NO: 120354 - DNA, 75 bp, Artificial Sequence
  Synthetic
ctcgccagcttaatctaacgcagggctgcaactgttccatctacagcggccatattaccggccaccggatggctt

SEQ ID NO: 120355 - DNA, 75 bp, Artificial Sequence
  Synthetic
ctcgccagcttaatctaacgcaggggtgcaactgttccatctacagcggccatattaccggccaccggatggctt

SEQ ID NO: 120356 - DNA, 75 bp, Artificial Sequence
  Synthetic
tctaccgggagtttgatgagatggaagagtgcgccgcccacatcccctacctcgagcaggggatgcatttggcgg

SEQ ID NO: 120357 - DNA, 75 bp, Artificial Sequence
  Synthetic
ggaggtgtctcatacggttgaagcccacactgcatgggcccacgcccctgctttataggctgggagccgtccaaa

SEQ ID NO: 120358 - DNA, 75 bp, Artificial Sequence
  Synthetic
ctctcttacgggatgaggtcacattccaggtcgggctcaaccaatacctggttgggtcacagctcccatgtgagc

SEQ ID NO: 120359 - DNA, 75 bp, Artificial Sequence
  Synthetic
gtgttcacaggtcttacacacattgatgcccacttcctctcacagactaaacagggaggggagaacttcgcgtac

SEQ ID NO: 120360 - DNA, 75 bp, Artificial Sequence
  Synthetic
gacaaaatacatcatggcatgcatgtcggccgacctagaggtcgtcaccagcacttgggtgttggtgggcggaat

SEQ ID NO: 120361 - DNA, 75 bp, Artificial Sequence
  Synthetic
tttgcgtcagcggctaactgggccaaggttgcgctggtcttgttcctgtttgctggggtcgacgccgggacccac

SEQ ID NO: 120362 - DNA, 75 bp, Artificial Sequence
  Synthetic
tttcgactctacagttacagagcgggacataaagactgaggagtccatttaccaatcttgccagattgaacctga

SEQ ID NO: 120363 - DNA, 75 bp, Artificial Sequence
  Synthetic
ggcaaatcaacagaaccgccctaaactgcaatgacagcctccaaactgggttcttcgccggcctcttctatgtca

SEQ ID NO: 120364 - DNA, 75 bp, Artificial Sequence
  Synthetic
ggcaaatcaacagaaccgccctaaactgcaatgacagcctccaaactgggttcttcgccggcctcttctatgtct

SEQ ID NO: 120365 - DNA, 75 bp, Artificial Sequence
  Synthetic
ggcaaatcaacagaaccgccctaaactgcaatgacagcctccaaactgggttcttcgccggcctcttctatgtcc

SEQ ID NO: 120366 - DNA, 75 bp, Artificial Sequence
  Synthetic
ggcaaatcaacagaaccgccctaaactgcaatgacagcctccaaactgggttcttcgccggcctcttctatgtcg

SEQ ID NO: 120367 - DNA, 75 bp, Artificial Sequence
  Synthetic
ggcaaatcaacagaaccgcccttaactgcaatgacagcctccaaactgggttcttcgccggcctcttctatgtca

SEQ ID NO: 120368 - DNA, 75 bp, Artificial Sequence
  Synthetic
ggcaaatcaacagaaccgcccttaactgcaatgacagcctccaaactgggttcttcgccggcctcttctatgtct

SEQ ID NO: 120369 - DNA, 75 bp, Artificial Sequence
  Synthetic
ggcaaatcaacagaaccgcccttaactgcaatgacagcctccaaactgggttcttcgccggcctcttctatgtcc

SEQ ID NO: 120370 - DNA, 75 bp, Artificial Sequence
  Synthetic
ggcaaatcaacagaaccgcccttaactgcaatgacagcctccaaactgggttcttcgccggcctcttctatgtcg

SEQ ID NO: 120371 - DNA, 75 bp, Artificial Sequence
  Synthetic
ggcaaatcaacagaaccgccctcaactgcaatgacagcctccaaactgggttcttcgccggcctcttctatgtca

SEQ ID NO: 120372 - DNA, 75 bp, Artificial Sequence
  Synthetic
ggcaaatcaacagaaccgccctcaactgcaatgacagcctccaaactgggttcttcgccggcctcttctatgtct

SEQ ID NO: 120373 - DNA, 75 bp, Artificial Sequence
  Synthetic
ggcaaatcaacagaaccgccctcaactgcaatgacagcctccaaactgggttcttcgccggcctcttctatgtcc

SEQ ID NO: 120374 - DNA, 75 bp, Artificial Sequence
  Synthetic
ggcaaatcaacagaaccgccctcaactgcaatgacagcctccaaactgggttcttcgccggcctcttctatgtcg

SEQ ID NO: 120375 - DNA, 75 bp, Artificial Sequence
  Synthetic
ggcaaatcaacagaaccgccctgaactgcaatgacagcctccaaactgggttcttcgccggcctcttctatgtca

SEQ ID NO: 120376 - DNA, 75 bp, Artificial Sequence
  Synthetic
ggcaaatcaacagaaccgccctgaactgcaatgacagcctccaaactgggttcttcgccggcctcttctatgtct

SEQ ID NO: 120377 - DNA, 75 bp, Artificial Sequence
  Synthetic
ggcaaatcaacagaaccgccctgaactgcaatgacagcctccaaactgggttcttcgccggcctcttctatgtcc

SEQ ID NO: 120378 - DNA, 75 bp, Artificial Sequence
  Synthetic
ggcaaatcaacagaaccgccctgaactgcaatgacagcctccaaactgggttcttcgccggcctcttctatgtcg

SEQ ID NO: 120379 - DNA, 75 bp, Artificial Sequence
  Synthetic
ggcatatcaacagaaccgccctaaactgcaatgacagcctccaaactgggttcttcgccggcctcttctatgtca

SEQ ID NO: 120380 - DNA, 75 bp, Artificial Sequence
  Synthetic
ggcatatcaacagaaccgccctaaactgcaatgacagcctccaaactgggttcttcgccggcctcttctatgtct

SEQ ID NO: 120381 - DNA, 75 bp, Artificial Sequence
  Synthetic
ggcatatcaacagaaccgccctaaactgcaatgacagcctccaaactgggttcttcgccggcctcttctatgtcc

SEQ ID NO: 120382 - DNA, 75 bp, Artificial Sequence
  Synthetic
ggcatatcaacagaaccgccctaaactgcaatgacagcctccaaactgggttcttcgccggcctcttctatgtcg

SEQ ID NO: 120383 - DNA, 75 bp, Artificial Sequence
  Synthetic
ggcatatcaacagaaccgcccttaactgcaatgacagcctccaaactgggttcttcgccggcctcttctatgtca

SEQ ID NO: 120384 - DNA, 75 bp, Artificial Sequence
  Synthetic
ggcatatcaacagaaccgcccttaactgcaatgacagcctccaaactgggttcttcgccggcctcttctatgtct

SEQ ID NO: 120385 - DNA, 75 bp, Artificial Sequence
  Synthetic
ggcatatcaacagaaccgcccttaactgcaatgacagcctccaaactgggttcttcgccggcctcttctatgtcc

SEQ ID NO: 120386 - DNA, 75 bp, Artificial Sequence
  Synthetic
ggcatatcaacagaaccgcccttaactgcaatgacagcctccaaactgggttcttcgccggcctcttctatgtcg

SEQ ID NO: 120387 - DNA, 75 bp, Artificial Sequence
  Synthetic
ggcatatcaacagaaccgccctcaactgcaatgacagcctccaaactgggttcttcgccggcctcttctatgtca

SEQ ID NO: 120388 - DNA, 75 bp, Artificial Sequence
  Synthetic
ggcatatcaacagaaccgccctcaactgcaatgacagcctccaaactgggttcttcgccggcctcttctatgtct

SEQ ID NO: 120389 - DNA, 75 bp, Artificial Sequence
  Synthetic
ggcatatcaacagaaccgccctcaactgcaatgacagcctccaaactgggttcttcgccggcctcttctatgtcc

SEQ ID NO: 120390 - DNA, 75 bp, Artificial Sequence
  Synthetic
ggcatatcaacagaaccgccctcaactgcaatgacagcctccaaactgggttcttcgccggcctcttctatgtcg

SEQ ID NO: 120391 - DNA, 75 bp, Artificial Sequence
  Synthetic
ggcatatcaacagaaccgccctgaactgcaatgacagcctccaaactgggttcttcgccggcctcttctatgtca

SEQ ID NO: 120392 - DNA, 75 bp, Artificial Sequence
  Synthetic
ggcatatcaacagaaccgccctgaactgcaatgacagcctccaaactgggttcttcgccggcctcttctatgtct

SEQ ID NO: 120393 - DNA, 75 bp, Artificial Sequence
  Synthetic
ggcatatcaacagaaccgccctgaactgcaatgacagcctccaaactgggttcttcgccggcctcttctatgtcc

SEQ ID NO: 120394 - DNA, 75 bp, Artificial Sequence
  Synthetic
ggcatatcaacagaaccgccctgaactgcaatgacagcctccaaactgggttcttcgccggcctcttctatgtcg

SEQ ID NO: 120395 - DNA, 75 bp, Artificial Sequence
  Synthetic
ggcacatcaacagaaccgccctaaactgcaatgacagcctccaaactgggttcttcgccggcctcttctatgtca

SEQ ID NO: 120396 - DNA, 75 bp, Artificial Sequence
  Synthetic
ggcacatcaacagaaccgccctaaactgcaatgacagcctccaaactgggttcttcgccggcctcttctatgtct

SEQ ID NO: 120397 - DNA, 75 bp, Artificial Sequence
  Synthetic
ggcacatcaacagaaccgccctaaactgcaatgacagcctccaaactgggttcttcgccggcctcttctatgtcc

SEQ ID NO: 120398 - DNA, 75 bp, Artificial Sequence
  Synthetic
ggcacatcaacagaaccgccctaaactgcaatgacagcctccaaactgggttcttcgccggcctcttctatgtcg

SEQ ID NO: 120399 - DNA, 75 bp, Artificial Sequence
  Synthetic
ggcacatcaacagaaccgcccttaactgcaatgacagcctccaaactgggttcttcgccggcctcttctatgtca

SEQ ID NO: 120400 - DNA, 75 bp, Artificial Sequence
  Synthetic
ggcacatcaacagaaccgcccttaactgcaatgacagcctccaaactgggttcttcgccggcctcttctatgtct

SEQ ID NO: 120401 - DNA, 75 bp, Artificial Sequence
  Synthetic
ggcacatcaacagaaccgcccttaactgcaatgacagcctccaaactgggttcttcgccggcctcttctatgtcc

SEQ ID NO: 120402 - DNA, 75 bp, Artificial Sequence
  Synthetic
ggcacatcaacagaaccgcccttaactgcaatgacagcctccaaactgggttcttcgccggcctcttctatgtcg

SEQ ID NO: 120403 - DNA, 75 bp, Artificial Sequence
  Synthetic
ggcacatcaacagaaccgccctcaactgcaatgacagcctccaaactgggttcttcgccggcctcttctatgtca

SEQ ID NO: 120404 - DNA, 75 bp, Artificial Sequence
  Synthetic
ggcacatcaacagaaccgccctcaactgcaatgacagcctccaaactgggttcttcgccggcctcttctatgtct

SEQ ID NO: 120405 - DNA, 75 bp, Artificial Sequence
  Synthetic
ggcacatcaacagaaccgccctcaactgcaatgacagcctccaaactgggttcttcgccggcctcttctatgtcc

SEQ ID NO: 120406 - DNA, 75 bp, Artificial Sequence
  Synthetic
ggcacatcaacagaaccgccctcaactgcaatgacagcctccaaactgggttcttcgccggcctcttctatgtcg

SEQ ID NO: 120407 - DNA, 75 bp, Artificial Sequence
  Synthetic
ggcacatcaacagaaccgccctgaactgcaatgacagcctccaaactgggttcttcgccggcctcttctatgtca

SEQ ID NO: 120408 - DNA, 75 bp, Artificial Sequence
  Synthetic
ggcacatcaacagaaccgccctgaactgcaatgacagcctccaaactgggttcttcgccggcctcttctatgtct

SEQ ID NO: 120409 - DNA, 75 bp, Artificial Sequence
  Synthetic
ggcacatcaacagaaccgccctgaactgcaatgacagcctccaaactgggttcttcgccggcctcttctatgtcc

SEQ ID NO: 120410 - DNA, 75 bp, Artificial Sequence
  Synthetic
ggcacatcaacagaaccgccctgaactgcaatgacagcctccaaactgggttcttcgccggcctcttctatgtcg

SEQ ID NO: 120411 - DNA, 75 bp, Artificial Sequence
  Synthetic
ggcagatcaacagaaccgccctaaactgcaatgacagcctccaaactgggttcttcgccggcctcttctatgtca

SEQ ID NO: 120412 - DNA, 75 bp, Artificial Sequence
  Synthetic
ggcagatcaacagaaccgccctaaactgcaatgacagcctccaaactgggttcttcgccggcctcttctatgtct

SEQ ID NO: 120413 - DNA, 75 bp, Artificial Sequence
  Synthetic
ggcagatcaacagaaccgccctaaactgcaatgacagcctccaaactgggttcttcgccggcctcttctatgtcc

SEQ ID NO: 120414 - DNA, 75 bp, Artificial Sequence
  Synthetic
ggcagatcaacagaaccgccctaaactgcaatgacagcctccaaactgggttcttcgccggcctcttctatgtcg

SEQ ID NO: 120415 - DNA, 75 bp, Artificial Sequence
  Synthetic
ggcagatcaacagaaccgcccttaactgcaatgacagcctccaaactgggttcttcgccggcctcttctatgtca

SEQ ID NO: 120416 - DNA, 75 bp, Artificial Sequence
  Synthetic
ggcagatcaacagaaccgcccttaactgcaatgacagcctccaaactgggttcttcgccggcctcttctatgtct

SEQ ID NO: 120417 - DNA, 75 bp, Artificial Sequence
  Synthetic
ggcagatcaacagaaccgcccttaactgcaatgacagcctccaaactgggttcttcgccggcctcttctatgtcc

SEQ ID NO: 120418 - DNA, 75 bp, Artificial Sequence
  Synthetic
ggcagatcaacagaaccgcccttaactgcaatgacagcctccaaactgggttcttcgccggcctcttctatgtcg

SEQ ID NO: 120419 - DNA, 75 bp, Artificial Sequence
  Synthetic
ggcagatcaacagaaccgccctcaactgcaatgacagcctccaaactgggttcttcgccggcctcttctatgtca

SEQ ID NO: 120420 - DNA, 75 bp, Artificial Sequence
  Synthetic
ggcagatcaacagaaccgccctcaactgcaatgacagcctccaaactgggttcttcgccggcctcttctatgtct

SEQ ID NO: 120421 - DNA, 75 bp, Artificial Sequence
  Synthetic
ggcagatcaacagaaccgccctcaactgcaatgacagcctccaaactgggttcttcgccggcctcttctatgtcc

SEQ ID NO: 120422 - DNA, 75 bp, Artificial Sequence
  Synthetic
ggcagatcaacagaaccgccctcaactgcaatgacagcctccaaactgggttcttcgccggcctcttctatgtcg

SEQ ID NO: 120423 - DNA, 75 bp, Artificial Sequence
  Synthetic
ggcagatcaacagaaccgccctgaactgcaatgacagcctccaaactgggttcttcgccggcctcttctatgtca

SEQ ID NO: 120424 - DNA, 75 bp, Artificial Sequence
  Synthetic
ggcagatcaacagaaccgccctgaactgcaatgacagcctccaaactgggttcttcgccggcctcttctatgtct

SEQ ID NO: 120425 - DNA, 75 bp, Artificial Sequence
  Synthetic
ggcagatcaacagaaccgccctgaactgcaatgacagcctccaaactgggttcttcgccggcctcttctatgtcc

SEQ ID NO: 120426 - DNA, 75 bp, Artificial Sequence
  Synthetic
ggcagatcaacagaaccgccctgaactgcaatgacagcctccaaactgggttcttcgccggcctcttctatgtcg

SEQ ID NO: 120427 - DNA, 75 bp, Artificial Sequence
  Synthetic
cggggcccacacccctactgtacaggctgggggcagtgcaaaacgagatcactaccactcaccccatcaccaaat

SEQ ID NO: 120428 - DNA, 75 bp, Artificial Sequence
  Synthetic
ggcaaagaaagtaatagcctccctcacggaaaggctttactgtgggggccctatgttcaactcgcgcggccaaaa

SEQ ID NO: 120429 - DNA, 75 bp, Artificial Sequence
  Synthetic
ccaacgactgcgccaacagcagtatcgtgtatgaggccgatgatgttatcctacatttacccggctgagtgccct

SEQ ID NO: 120430 - DNA, 75 bp, Artificial Sequence
  Synthetic
ccaacgactgcgccaacagcagtatcgtgtatgaggccgatgatgttatcctacatttacccggctgtgtgccct

SEQ ID NO: 120431 - DNA, 75 bp, Artificial Sequence
  Synthetic
ccaacgactgcgccaacagcagtatcgtgtatgaggccgatgatgttatcctacatttacccggctgcgtgccct

SEQ ID NO: 120432 - DNA, 75 bp, Artificial Sequence
  Synthetic
ccaacgactgcgccaacagcagtatcgtgtatgaggccgatgatgttatcctacatttacccggctgggtgccct

SEQ ID NO: 120433 - DNA, 75 bp, Artificial Sequence
  Synthetic
ctactgctttcgtcggcgcgggtattaccggcgccgttgttggcagtgtgggcctgggaagagtcctagtggaca

SEQ ID NO: 120434 - DNA, 75 bp, Artificial Sequence
  Synthetic
gccaccctctgctcggccctctacgtgggagacctgtgcgggtctgtctttcttgtcggtcagctgtttaccttc

SEQ ID NO: 120435 - DNA, 75 bp, Artificial Sequence
  Synthetic
tggaggagtgtgcctcacacctcccttacatcgagcaagggatgcagcttgccgagcagttcaagcagaaagcac

SEQ ID NO: 120436 - DNA, 75 bp, Artificial Sequence
  Synthetic
gggctccagtaatgacaagccatactgctggcactatcccccacgaccgtgaggggtggtgtcagctcaaaaagt

SEQ ID NO: 120437 - DNA, 75 bp, Artificial Sequence
  Synthetic
gggctccagtaatgacaagccatactgctggcactatcccccacgaccgtgtggggtggtgtcagctcaaaaagt

SEQ ID NO: 120438 - DNA, 75 bp, Artificial Sequence
  Synthetic
gggctccagtaatgacaagccatactgctggcactatcccccacgaccgtgcggggtggtgtcagctcaaaaagt

SEQ ID NO: 120439 - DNA, 75 bp, Artificial Sequence
  Synthetic
gggctccagtaatgacaagccatactgctggcactatcccccacgaccgtggggggtggtgtcagctcaaaaagt

SEQ ID NO: 120440 - DNA, 75 bp, Artificial Sequence
  Synthetic
gggctccagtaatgacaagccatactgctggcactatcccccacgtccgtgaggggtggtgtcagctcaaaaagt

SEQ ID NO: 120441 - DNA, 75 bp, Artificial Sequence
  Synthetic
gggctccagtaatgacaagccatactgctggcactatcccccacgtccgtgtggggtggtgtcagctcaaaaagt

SEQ ID NO: 120442 - DNA, 75 bp, Artificial Sequence
  Synthetic
gggctccagtaatgacaagccatactgctggcactatcccccacgtccgtgcggggtggtgtcagctcaaaaagt

SEQ ID NO: 120443 - DNA, 75 bp, Artificial Sequence
  Synthetic
gggctccagtaatgacaagccatactgctggcactatcccccacgtccgtggggggtggtgtcagctcaaaaagt

SEQ ID NO: 120444 - DNA, 75 bp, Artificial Sequence
  Synthetic
gggctccagtaatgacaagccatactgctggcactatcccccacgcccgtgaggggtggtgtcagctcaaaaagt

SEQ ID NO: 120445 - DNA, 75 bp, Artificial Sequence
  Synthetic
gggctccagtaatgacaagccatactgctggcactatcccccacgcccgtgtggggtggtgtcagctcaaaaagt

SEQ ID NO: 120446 - DNA, 75 bp, Artificial Sequence
  Synthetic
gggctccagtaatgacaagccatactgctggcactatcccccacgcccgtgcggggtggtgtcagctcaaaaagt

SEQ ID NO: 120447 - DNA, 75 bp, Artificial Sequence
  Synthetic
gggctccagtaatgacaagccatactgctggcactatcccccacgcccgtggggggtggtgtcagctcaaaaagt

SEQ ID NO: 120448 - DNA, 75 bp, Artificial Sequence
  Synthetic
gggctccagtaatgacaagccatactgctggcactatcccccacggccgtgaggggtggtgtcagctcaaaaagt

SEQ ID NO: 120449 - DNA, 75 bp, Artificial Sequence
  Synthetic
gggctccagtaatgacaagccatactgctggcactatcccccacggccgtgtggggtggtgtcagctcaaaaagt

SEQ ID NO: 120450 - DNA, 75 bp, Artificial Sequence
  Synthetic
gggctccagtaatgacaagccatactgctggcactatcccccacggccgtgcggggtggtgtcagctcaaaaagt

SEQ ID NO: 120451 - DNA, 75 bp, Artificial Sequence
  Synthetic
gggctccagtaatgacaagccatactgctggcactatcccccacggccgtggggggtggtgtcagctcaaaaagt

SEQ ID NO: 120452 - DNA, 75 bp, Artificial Sequence
  Synthetic
ctgtgttcagcactatatgttggagatctatgtggaggcgtgttccttgtgggacaagcctttaatttcaggtct

SEQ ID NO: 120453 - DNA, 75 bp, Artificial Sequence
  Synthetic
ctgtgttcagcactttatgttggagatctatgtggaggcgtgttccttgtgggacaagcctttaatttcaggtct

SEQ ID NO: 120454 - DNA, 75 bp, Artificial Sequence
  Synthetic
ctgtgttcagcactctatgttggagatctatgtggaggcgtgttccttgtgggacaagcctttaatttcaggtct

SEQ ID NO: 120455 - DNA, 75 bp, Artificial Sequence
  Synthetic
ctgtgttcagcactgtatgttggagatctatgtggaggcgtgttccttgtgggacaagcctttaatttcaggtct

SEQ ID NO: 120456 - DNA, 75 bp, Artificial Sequence
  Synthetic
tggcagcgcagttatatgcggcaggattgttacatcggggaagcccgtagtagtacccgatcgtgaggtgcttta

SEQ ID NO: 120457 - DNA, 75 bp, Artificial Sequence
  Synthetic
tggcagcgcagttatttgcggcaggattgttacatcggggaagcccgtagtagtacccgatcgtgaggtgcttta

SEQ ID NO: 120458 - DNA, 75 bp, Artificial Sequence
  Synthetic
tggcagcgcagttatctgcggcaggattgttacatcggggaagcccgtagtagtacccgatcgtgaggtgcttta

SEQ ID NO: 120459 - DNA, 75 bp, Artificial Sequence
  Synthetic
tggcagcgcagttatgtgcggcaggattgttacatcggggaagcccgtagtagtacccgatcgtgaggtgcttta

SEQ ID NO: 120460 - DNA, 75 bp, Artificial Sequence
  Synthetic
atctatgtggaggcgtgttccttgtgggacaagcctttaatttcaggtctcgtcagcactggactgtccaagagt

SEQ ID NO: 120461 - DNA, 75 bp, Artificial Sequence
  Synthetic
cggcgtgtggggacatcatcttgggactgcccgtctccgctcgaagggggagggagatactcctgggaccggccg

SEQ ID NO: 120462 - DNA, 75 bp, Artificial Sequence
  Synthetic
ccggcataggtcacgcaatttgggtaaggtcatcgatacccttacgtgtggctttgccgacctcatggggtacat

SEQ ID NO: 120463 - DNA, 75 bp, Artificial Sequence
  Synthetic
gaatttcattagcgggatacagtacttagcaggcttgtccacactacctgggaaccccgctatagcatcgctgat

SEQ ID NO: 120464 - DNA, 75 bp, Artificial Sequence
  Synthetic
tccaataccacctccacggagaaagaggacggttgtcctgacagagtccaccgtgtcttctgccttggcggagct

SEQ ID NO: 120465 - DNA, 75 bp, Artificial Sequence
  Synthetic
gcagcctcagccttcgtggcctctggcatggtcggcgcggccattggcagcataggaattgggaaggtgctcatt

SEQ ID NO: 120466 - DNA, 75 bp, Artificial Sequence
  Synthetic
gttgcgtctcccacagaccgtgttcgacctgatcgcaggagctcactggggtgtgatggcaggtctggcctactt

SEQ ID NO: 120467 - DNA, 75 bp, Artificial Sequence
  Synthetic
ccaaatgtacacaaatgtagatcaggacctcgttgggtggccagcccctccaggggccaagtctcttgaaccgtg

SEQ ID NO: 120468 - DNA, 75 bp, Artificial Sequence
  Synthetic
ccttgacgacactggcaaaagatactactacctcacgcgtgacccaactactccacttgcccgagccgcttggga

SEQ ID NO: 120469 - DNA, 75 bp, Artificial Sequence
  Synthetic
cggctgggtagcagggcttttctattaccacaaattcaactcttcaggctgtcccgagaggttggccagctgccg

SEQ ID NO: 120470 - DNA, 75 bp, Artificial Sequence
  Synthetic
gtcatcatcctgaacaatacaaggccccctactggcaattggtttggctgcacctggatgaatgccacagggtat

SEQ ID NO: 120471 - DNA, 75 bp, Artificial Sequence
  Synthetic
gtcttcatcctgaacaatacaaggccccctactggcaattggtttggctgcacctggatgaatgccacagggtat

SEQ ID NO: 120472 - DNA, 75 bp, Artificial Sequence
  Synthetic
gtcctcatcctgaacaatacaaggccccctactggcaattggtttggctgcacctggatgaatgccacagggtat

SEQ ID NO: 120473 - DNA, 75 bp, Artificial Sequence
  Synthetic
gtcgtcatcctgaacaatacaaggccccctactggcaattggtttggctgcacctggatgaatgccacagggtat

SEQ ID NO: 120474 - DNA, 75 bp, Artificial Sequence
  Synthetic
gcctgtctctgccgtgcaagtcaagaacaccagcacaatgtaccaggtgactaatgactgtcctaactccagtat

SEQ ID NO: 120475 - DNA, 75 bp, Artificial Sequence
  Synthetic
gttggtcaacaccaatgggtcatggcacataaaccgcacggccctaaactgcaacgattctttacagactgggtt

SEQ ID NO: 120476 - DNA, 75 bp, Artificial Sequence
  Synthetic
ttacagaacacagctaaacaggccgacgaccttaagccggcagcctatgccgcctggccaaagctcgagcaattc

SEQ ID NO: 120477 - DNA, 75 bp, Artificial Sequence
  Synthetic
atactccaggcccaggaaacgctagatagggtgcttgacttcgacatgtacggagttacgtattctgtcgctcca

SEQ ID NO: 120478 - DNA, 75 bp, Artificial Sequence
  Synthetic
ctgctggcactaccctccaaaaccttgtggtattgtgcccgcaaagagcgtgtgtggcccggtatattgtttcac

SEQ ID NO: 120479 - DNA, 75 bp, Artificial Sequence
  Synthetic
ccgccgccttgaccagccccctgacgacttccacgaccctcttactgaacattctcggagggtggttcgcgtctc

SEQ ID NO: 120480 - DNA, 75 bp, Artificial Sequence
  Synthetic
atagggtgcttgacttcgacatgtacggagttacgtattctgtcgctccactggacctaccagcaatcattcaac

SEQ ID NO: 120481 - DNA, 75 bp, Artificial Sequence
  Synthetic
gtggccatcagccaacctggggccctcactaggggcttgcggacgcacattgacattattgtgatgtccgccact

SEQ ID NO: 120482 - DNA, 75 bp, Artificial Sequence
  Synthetic
ccgttgaggtatgcaaaaatctctaaatcctccgcagacaaaccgtattgctggcactacgcccctgggccttgt

SEQ ID NO: 120483 - DNA, 75 bp, Artificial Sequence
  Synthetic
ccgttgaggtatgcaaaaatctctaaatcctccgcagacataccgtattgctggcactacgcccctgggccttgt

SEQ ID NO: 120484 - DNA, 75 bp, Artificial Sequence
  Synthetic
ccgttgaggtatgcaaaaatctctaaatcctccgcagacacaccgtattgctggcactacgcccctgggccttgt

SEQ ID NO: 120485 - DNA, 75 bp, Artificial Sequence
  Synthetic
ccgttgaggtatgcaaaaatctctaaatcctccgcagacagaccgtattgctggcactacgcccctgggccttgt

SEQ ID NO: 120486 - DNA, 75 bp, Artificial Sequence
  Synthetic
ccgttgaggtatgcaaaaatctctaattcctccgcagacaaaccgtattgctggcactacgcccctgggccttgt

SEQ ID NO: 120487 - DNA, 75 bp, Artificial Sequence
  Synthetic
ccgttgaggtatgcaaaaatctctaattcctccgcagacataccgtattgctggcactacgcccctgggccttgt

SEQ ID NO: 120488 - DNA, 75 bp, Artificial Sequence
  Synthetic
ccgttgaggtatgcaaaaatctctaattcctccgcagacacaccgtattgctggcactacgcccctgggccttgt

SEQ ID NO: 120489 - DNA, 75 bp, Artificial Sequence
  Synthetic
ccgttgaggtatgcaaaaatctctaattcctccgcagacagaccgtattgctggcactacgcccctgggccttgt

SEQ ID NO: 120490 - DNA, 75 bp, Artificial Sequence
  Synthetic
ccgttgaggtatgcaaaaatctctaactcctccgcagacaaaccgtattgctggcactacgcccctgggccttgt

SEQ ID NO: 120491 - DNA, 75 bp, Artificial Sequence
  Synthetic
ccgttgaggtatgcaaaaatctctaactcctccgcagacataccgtattgctggcactacgcccctgggccttgt

SEQ ID NO: 120492 - DNA, 75 bp, Artificial Sequence
  Synthetic
ccgttgaggtatgcaaaaatctctaactcctccgcagacacaccgtattgctggcactacgcccctgggccttgt

SEQ ID NO: 120493 - DNA, 75 bp, Artificial Sequence
  Synthetic
ccgttgaggtatgcaaaaatctctaactcctccgcagacagaccgtattgctggcactacgcccctgggccttgt

SEQ ID NO: 120494 - DNA, 75 bp, Artificial Sequence
  Synthetic
ccgttgaggtatgcaaaaatctctaagtcctccgcagacaaaccgtattgctggcactacgcccctgggccttgt

SEQ ID NO: 120495 - DNA, 75 bp, Artificial Sequence
  Synthetic
ccgttgaggtatgcaaaaatctctaagtcctccgcagacataccgtattgctggcactacgcccctgggccttgt

SEQ ID NO: 120496 - DNA, 75 bp, Artificial Sequence
  Synthetic
ccgttgaggtatgcaaaaatctctaagtcctccgcagacacaccgtattgctggcactacgcccctgggccttgt

SEQ ID NO: 120497 - DNA, 75 bp, Artificial Sequence
  Synthetic
ccgttgaggtatgcaaaaatctctaagtcctccgcagacagaccgtattgctggcactacgcccctgggccttgt

SEQ ID NO: 120498 - DNA, 75 bp, Artificial Sequence
  Synthetic
ccgttgaggtatgcaaatatctctaaatcctccgcagacaaaccgtattgctggcactacgcccctgggccttgt

SEQ ID NO: 120499 - DNA, 75 bp, Artificial Sequence
  Synthetic
ccgttgaggtatgcaaatatctctaaatcctccgcagacataccgtattgctggcactacgcccctgggccttgt

SEQ ID NO: 120500 - DNA, 75 bp, Artificial Sequence
  Synthetic
ccgttgaggtatgcaaatatctctaaatcctccgcagacacaccgtattgctggcactacgcccctgggccttgt

SEQ ID NO: 120501 - DNA, 75 bp, Artificial Sequence
  Synthetic
ccgttgaggtatgcaaatatctctaaatcctccgcagacagaccgtattgctggcactacgcccctgggccttgt

SEQ ID NO: 120502 - DNA, 75 bp, Artificial Sequence
  Synthetic
ccgttgaggtatgcaaatatctctaattcctccgcagacaaaccgtattgctggcactacgcccctgggccttgt

SEQ ID NO: 120503 - DNA, 75 bp, Artificial Sequence
  Synthetic
ccgttgaggtatgcaaatatctctaattcctccgcagacataccgtattgctggcactacgcccctgggccttgt

SEQ ID NO: 120504 - DNA, 75 bp, Artificial Sequence
  Synthetic
ccgttgaggtatgcaaatatctctaattcctccgcagacacaccgtattgctggcactacgcccctgggccttgt

SEQ ID NO: 120505 - DNA, 75 bp, Artificial Sequence
  Synthetic
ccgttgaggtatgcaaatatctctaattcctccgcagacagaccgtattgctggcactacgcccctgggccttgt

SEQ ID NO: 120506 - DNA, 75 bp, Artificial Sequence
  Synthetic
ccgttgaggtatgcaaatatctctaactcctccgcagacaaaccgtattgctggcactacgcccctgggccttgt

SEQ ID NO: 120507 - DNA, 75 bp, Artificial Sequence
  Synthetic
ccgttgaggtatgcaaatatctctaactcctccgcagacataccgtattgctggcactacgcccctgggccttgt

SEQ ID NO: 120508 - DNA, 75 bp, Artificial Sequence
  Synthetic
ccgttgaggtatgcaaatatctctaactcctccgcagacacaccgtattgctggcactacgcccctgggccttgt

SEQ ID NO: 120509 - DNA, 75 bp, Artificial Sequence
  Synthetic
ccgttgaggtatgcaaatatctctaactcctccgcagacagaccgtattgctggcactacgcccctgggccttgt

SEQ ID NO: 120510 - DNA, 75 bp, Artificial Sequence
  Synthetic
ccgttgaggtatgcaaatatctctaagtcctccgcagacaaaccgtattgctggcactacgcccctgggccttgt

SEQ ID NO: 120511 - DNA, 75 bp, Artificial Sequence
  Synthetic
ccgttgaggtatgcaaatatctctaagtcctccgcagacataccgtattgctggcactacgcccctgggccttgt

SEQ ID NO: 120512 - DNA, 75 bp, Artificial Sequence
  Synthetic
ccgttgaggtatgcaaatatctctaagtcctccgcagacacaccgtattgctggcactacgcccctgggccttgt

SEQ ID NO: 120513 - DNA, 75 bp, Artificial Sequence
  Synthetic
ccgttgaggtatgcaaatatctctaagtcctccgcagacagaccgtattgctggcactacgcccctgggccttgt

SEQ ID NO: 120514 - DNA, 75 bp, Artificial Sequence
  Synthetic
ccgttgaggtatgcaaacatctctaaatcctccgcagacaaaccgtattgctggcactacgcccctgggccttgt

SEQ ID NO: 120515 - DNA, 75 bp, Artificial Sequence
  Synthetic
ccgttgaggtatgcaaacatctctaaatcctccgcagacataccgtattgctggcactacgcccctgggccttgt

SEQ ID NO: 120516 - DNA, 75 bp, Artificial Sequence
  Synthetic
ccgttgaggtatgcaaacatctctaaatcctccgcagacacaccgtattgctggcactacgcccctgggccttgt

SEQ ID NO: 120517 - DNA, 75 bp, Artificial Sequence
  Synthetic
ccgttgaggtatgcaaacatctctaaatcctccgcagacagaccgtattgctggcactacgcccctgggccttgt

SEQ ID NO: 120518 - DNA, 75 bp, Artificial Sequence
  Synthetic
ccgttgaggtatgcaaacatctctaattcctccgcagacaaaccgtattgctggcactacgcccctgggccttgt

SEQ ID NO: 120519 - DNA, 75 bp, Artificial Sequence
  Synthetic
ccgttgaggtatgcaaacatctctaattcctccgcagacataccgtattgctggcactacgcccctgggccttgt

SEQ ID NO: 120520 - DNA, 75 bp, Artificial Sequence
  Synthetic
ccgttgaggtatgcaaacatctctaattcctccgcagacacaccgtattgctggcactacgcccctgggccttgt

SEQ ID NO: 120521 - DNA, 75 bp, Artificial Sequence
  Synthetic
ccgttgaggtatgcaaacatctctaattcctccgcagacagaccgtattgctggcactacgcccctgggccttgt

SEQ ID NO: 120522 - DNA, 75 bp, Artificial Sequence
  Synthetic
ccgttgaggtatgcaaacatctctaactcctccgcagacaaaccgtattgctggcactacgcccctgggccttgt

SEQ ID NO: 120523 - DNA, 75 bp, Artificial Sequence
  Synthetic
ccgttgaggtatgcaaacatctctaactcctccgcagacataccgtattgctggcactacgcccctgggccttgt

SEQ ID NO: 120524 - DNA, 75 bp, Artificial Sequence
  Synthetic
ccgttgaggtatgcaaacatctctaactcctccgcagacacaccgtattgctggcactacgcccctgggccttgt

SEQ ID NO: 120525 - DNA, 75 bp, Artificial Sequence
  Synthetic
ccgttgaggtatgcaaacatctctaactcctccgcagacagaccgtattgctggcactacgcccctgggccttgt

SEQ ID NO: 120526 - DNA, 75 bp, Artificial Sequence
  Synthetic
ccgttgaggtatgcaaacatctctaagtcctccgcagacaaaccgtattgctggcactacgcccctgggccttgt

SEQ ID NO: 120527 - DNA, 75 bp, Artificial Sequence
  Synthetic
ccgttgaggtatgcaaacatctctaagtcctccgcagacataccgtattgctggcactacgcccctgggccttgt

SEQ ID NO: 120528 - DNA, 75 bp, Artificial Sequence
  Synthetic
ccgttgaggtatgcaaacatctctaagtcctccgcagacacaccgtattgctggcactacgcccctgggccttgt

SEQ ID NO: 120529 - DNA, 75 bp, Artificial Sequence
  Synthetic
ccgttgaggtatgcaaacatctctaagtcctccgcagacagaccgtattgctggcactacgcccctgggccttgt

SEQ ID NO: 120530 - DNA, 75 bp, Artificial Sequence
  Synthetic
ccgttgaggtatgcaaagatctctaaatcctccgcagacaaaccgtattgctggcactacgcccctgggccttgt

SEQ ID NO: 120531 - DNA, 75 bp, Artificial Sequence
  Synthetic
ccgttgaggtatgcaaagatctctaaatcctccgcagacataccgtattgctggcactacgcccctgggccttgt

SEQ ID NO: 120532 - DNA, 75 bp, Artificial Sequence
  Synthetic
ccgttgaggtatgcaaagatctctaaatcctccgcagacacaccgtattgctggcactacgcccctgggccttgt

SEQ ID NO: 120533 - DNA, 75 bp, Artificial Sequence
  Synthetic
ccgttgaggtatgcaaagatctctaaatcctccgcagacagaccgtattgctggcactacgcccctgggccttgt

SEQ ID NO: 120534 - DNA, 75 bp, Artificial Sequence
  Synthetic
ccgttgaggtatgcaaagatctctaattcctccgcagacaaaccgtattgctggcactacgcccctgggccttgt

SEQ ID NO: 120535 - DNA, 75 bp, Artificial Sequence
  Synthetic
ccgttgaggtatgcaaagatctctaattcctccgcagacataccgtattgctggcactacgcccctgggccttgt

SEQ ID NO: 120536 - DNA, 75 bp, Artificial Sequence
  Synthetic
ccgttgaggtatgcaaagatctctaattcctccgcagacacaccgtattgctggcactacgcccctgggccttgt

SEQ ID NO: 120537 - DNA, 75 bp, Artificial Sequence
  Synthetic
ccgttgaggtatgcaaagatctctaattcctccgcagacagaccgtattgctggcactacgcccctgggccttgt

SEQ ID NO: 120538 - DNA, 75 bp, Artificial Sequence
  Synthetic
ccgttgaggtatgcaaagatctctaactcctccgcagacaaaccgtattgctggcactacgcccctgggccttgt

SEQ ID NO: 120539 - DNA, 75 bp, Artificial Sequence
  Synthetic
ccgttgaggtatgcaaagatctctaactcctccgcagacataccgtattgctggcactacgcccctgggccttgt

SEQ ID NO: 120540 - DNA, 75 bp, Artificial Sequence
  Synthetic
ccgttgaggtatgcaaagatctctaactcctccgcagacacaccgtattgctggcactacgcccctgggccttgt

SEQ ID NO: 120541 - DNA, 75 bp, Artificial Sequence
  Synthetic
ccgttgaggtatgcaaagatctctaactcctccgcagacagaccgtattgctggcactacgcccctgggccttgt

SEQ ID NO: 120542 - DNA, 75 bp, Artificial Sequence
  Synthetic
ccgttgaggtatgcaaagatctctaagtcctccgcagacaaaccgtattgctggcactacgcccctgggccttgt

SEQ ID NO: 120543 - DNA, 75 bp, Artificial Sequence
  Synthetic
ccgttgaggtatgcaaagatctctaagtcctccgcagacataccgtattgctggcactacgcccctgggccttgt

SEQ ID NO: 120544 - DNA, 75 bp, Artificial Sequence
  Synthetic
ccgttgaggtatgcaaagatctctaagtcctccgcagacacaccgtattgctggcactacgcccctgggccttgt

SEQ ID NO: 120545 - DNA, 75 bp, Artificial Sequence
  Synthetic
ccgttgaggtatgcaaagatctctaagtcctccgcagacagaccgtattgctggcactacgcccctgggccttgt

SEQ ID NO: 120546 - DNA, 75 bp, Artificial Sequence
  Synthetic
gagctgagcccgctcctacattccaccacacagtgggccatattgccatgctctttcacacccacgcccgctctg

SEQ ID NO: 120547 - DNA, 75 bp, Artificial Sequence
  Synthetic
gagctgagcccgctcctacattccaccacacagtgggccatattgccttgctctttcacacccacgcccgctctg

SEQ ID NO: 120548 - DNA, 75 bp, Artificial Sequence
  Synthetic
gagctgagcccgctcctacattccaccacacagtgggccatattgccctgctctttcacacccacgcccgctctg

SEQ ID NO: 120549 - DNA, 75 bp, Artificial Sequence
  Synthetic
gagctgagcccgctcctacattccaccacacagtgggccatattgccgtgctctttcacacccacgcccgctctg

SEQ ID NO: 120550 - DNA, 75 bp, Artificial Sequence
  Synthetic
ggcaggctatggagcgggcgtcgcaggagccctcacggcttttaagatcatgagcggcgaatgcccgactggaga

SEQ ID NO: 120551 - DNA, 75 bp, Artificial Sequence
  Synthetic
ggcaggctatggagcgggcgtcgcaggagccctcacggcttttaagatcatgagcggcgaatgcccgactggtga

SEQ ID NO: 120552 - DNA, 75 bp, Artificial Sequence
  Synthetic
ggcaggctatggagcgggcgtcgcaggagccctcacggcttttaagatcatgagcggcgaatgcccgactggcga

SEQ ID NO: 120553 - DNA, 75 bp, Artificial Sequence
  Synthetic
ggcaggctatggagcgggcgtcgcaggagccctcacggcttttaagatcatgagcggcgaatgcccgactgggga

SEQ ID NO: 120554 - DNA, 75 bp, Artificial Sequence
  Synthetic
ggcaggctatggagcgggcgtcgcaggtgccctcacggcttttaagatcatgagcggcgaatgcccgactggaga

SEQ ID NO: 120555 - DNA, 75 bp, Artificial Sequence
  Synthetic
ggcaggctatggagcgggcgtcgcaggtgccctcacggcttttaagatcatgagcggcgaatgcccgactggtga

SEQ ID NO: 120556 - DNA, 75 bp, Artificial Sequence
  Synthetic
ggcaggctatggagcgggcgtcgcaggtgccctcacggcttttaagatcatgagcggcgaatgcccgactggcga

SEQ ID NO: 120557 - DNA, 75 bp, Artificial Sequence
  Synthetic
ggcaggctatggagcgggcgtcgcaggtgccctcacggcttttaagatcatgagcggcgaatgcccgactgggga

SEQ ID NO: 120558 - DNA, 75 bp, Artificial Sequence
  Synthetic
ggcaggctatggagcgggcgtcgcaggcgccctcacggcttttaagatcatgagcggcgaatgcccgactggaga

SEQ ID NO: 120559 - DNA, 75 bp, Artificial Sequence
  Synthetic
ggcaggctatggagcgggcgtcgcaggcgccctcacggcttttaagatcatgagcggcgaatgcccgactggtga

SEQ ID NO: 120560 - DNA, 75 bp, Artificial Sequence
  Synthetic
ggcaggctatggagcgggcgtcgcaggcgccctcacggcttttaagatcatgagcggcgaatgcccgactggcga

SEQ ID NO: 120561 - DNA, 75 bp, Artificial Sequence
  Synthetic
ggcaggctatggagcgggcgtcgcaggcgccctcacggcttttaagatcatgagcggcgaatgcccgactgggga

SEQ ID NO: 120562 - DNA, 75 bp, Artificial Sequence
  Synthetic
ggcaggctatggagcgggcgtcgcaggggccctcacggcttttaagatcatgagcggcgaatgcccgactggaga

SEQ ID NO: 120563 - DNA, 75 bp, Artificial Sequence
  Synthetic
ggcaggctatggagcgggcgtcgcaggggccctcacggcttttaagatcatgagcggcgaatgcccgactggtga

SEQ ID NO: 120564 - DNA, 75 bp, Artificial Sequence
  Synthetic
ggcaggctatggagcgggcgtcgcaggggccctcacggcttttaagatcatgagcggcgaatgcccgactggcga

SEQ ID NO: 120565 - DNA, 75 bp, Artificial Sequence
  Synthetic
ggcaggctatggagcgggcgtcgcaggggccctcacggcttttaagatcatgagcggcgaatgcccgactgggga

SEQ ID NO: 120566 - DNA, 75 bp, Artificial Sequence
  Synthetic
aaccttaccatcacccagctcctgagaaggctccatcaatggattaatgaggactgctccaccccgtgctctggc

SEQ ID NO: 120567 - DNA, 75 bp, Artificial Sequence
  Synthetic
gtcagagcaaagctcattgctcagggggggaaagctgctatctgcggtaagtacctcttcaactgggctgttaag

SEQ ID NO: 120568 - DNA, 75 bp, Artificial Sequence
  Synthetic
agtaccggccttatacacttacatcaaaaaatagtagacacccagtacctttacggtctgagttccagcattgtc

SEQ ID NO: 120569 - DNA, 75 bp, Artificial Sequence
  Synthetic
agtaccggccttatacacttacatcaaaatatagtagacacccagtacctttacggtctgagttccagcattgtc

SEQ ID NO: 120570 - DNA, 75 bp, Artificial Sequence
  Synthetic
agtaccggccttatacacttacatcaaaacatagtagacacccagtacctttacggtctgagttccagcattgtc

SEQ ID NO: 120571 - DNA, 75 bp, Artificial Sequence
  Synthetic
agtaccggccttatacacttacatcaaaagatagtagacacccagtacctttacggtctgagttccagcattgtc

SEQ ID NO: 120572 - DNA, 75 bp, Artificial Sequence
  Synthetic
agtaccggccttatacacttacatcataaaatagtagacacccagtacctttacggtctgagttccagcattgtc

SEQ ID NO: 120573 - DNA, 75 bp, Artificial Sequence
  Synthetic
agtaccggccttatacacttacatcataatatagtagacacccagtacctttacggtctgagttccagcattgtc

SEQ ID NO: 120574 - DNA, 75 bp, Artificial Sequence
  Synthetic
agtaccggccttatacacttacatcataacatagtagacacccagtacctttacggtctgagttccagcattgtc

SEQ ID NO: 120575 - DNA, 75 bp, Artificial Sequence
  Synthetic
agtaccggccttatacacttacatcataagatagtagacacccagtacctttacggtctgagttccagcattgtc

SEQ ID NO: 120576 - DNA, 75 bp, Artificial Sequence
  Synthetic
agtaccggccttatacacttacatcacaaaatagtagacacccagtacctttacggtctgagttccagcattgtc

SEQ ID NO: 120577 - DNA, 75 bp, Artificial Sequence
  Synthetic
agtaccggccttatacacttacatcacaatatagtagacacccagtacctttacggtctgagttccagcattgtc

SEQ ID NO: 120578 - DNA, 75 bp, Artificial Sequence
  Synthetic
agtaccggccttatacacttacatcacaacatagtagacacccagtacctttacggtctgagttccagcattgtc

SEQ ID NO: 120579 - DNA, 75 bp, Artificial Sequence
  Synthetic
agtaccggccttatacacttacatcacaagatagtagacacccagtacctttacggtctgagttccagcattgtc

SEQ ID NO: 120580 - DNA, 75 bp, Artificial Sequence
  Synthetic
agtaccggccttatacacttacatcagaaaatagtagacacccagtacctttacggtctgagttccagcattgtc

SEQ ID NO: 120581 - DNA, 75 bp, Artificial Sequence
  Synthetic
agtaccggccttatacacttacatcagaatatagtagacacccagtacctttacggtctgagttccagcattgtc

SEQ ID NO: 120582 - DNA, 75 bp, Artificial Sequence
  Synthetic
agtaccggccttatacacttacatcagaacatagtagacacccagtacctttacggtctgagttccagcattgtc

SEQ ID NO: 120583 - DNA, 75 bp, Artificial Sequence
  Synthetic
agtaccggccttatacacttacatcagaagatagtagacacccagtacctttacggtctgagttccagcattgtc

SEQ ID NO: 120584 - DNA, 75 bp, Artificial Sequence
  Synthetic
gcaactgttccatctatccgggccatgtcacgggacatcgtatggcatgggatatgatgatgaattggtcgccga

SEQ ID NO: 120585 - DNA, 75 bp, Artificial Sequence
  Synthetic
attttggtgagaatgacacggacgtgtttatgctgtcgtctgcgcgacctcccaaagggcggtggtttggttgca

SEQ ID NO: 120586 - DNA, 75 bp, Artificial Sequence
  Synthetic
attttggtgagaatgtcacggacgtgtttatgctgtcgtctgcgcgacctcccaaagggcggtggtttggttgca

SEQ ID NO: 120587 - DNA, 75 bp, Artificial Sequence
  Synthetic
attttggtgagaatgccacggacgtgtttatgctgtcgtctgcgcgacctcccaaagggcggtggtttggttgca

SEQ ID NO: 120588 - DNA, 75 bp, Artificial Sequence
  Synthetic
attttggtgagaatggcacggacgtgtttatgctgtcgtctgcgcgacctcccaaagggcggtggtttggttgca

SEQ ID NO: 120589 - DNA, 75 bp, Artificial Sequence
  Synthetic
attttggtgtgaatgacacggacgtgtttatgctgtcgtctgcgcgacctcccaaagggcggtggtttggttgca

SEQ ID NO: 120590 - DNA, 75 bp, Artificial Sequence
  Synthetic
attttggtgtgaatgtcacggacgtgtttatgctgtcgtctgcgcgacctcccaaagggcggtggtttggttgca

SEQ ID NO: 120591 - DNA, 75 bp, Artificial Sequence
  Synthetic
attttggtgtgaatgccacggacgtgtttatgctgtcgtctgcgcgacctcccaaagggcggtggtttggttgca

SEQ ID NO: 120592 - DNA, 75 bp, Artificial Sequence
  Synthetic
attttggtgtgaatggcacggacgtgtttatgctgtcgtctgcgcgacctcccaaagggcggtggtttggttgca

SEQ ID NO: 120593 - DNA, 75 bp, Artificial Sequence
  Synthetic
attttggtgcgaatgacacggacgtgtttatgctgtcgtctgcgcgacctcccaaagggcggtggtttggttgca

SEQ ID NO: 120594 - DNA, 75 bp, Artificial Sequence
  Synthetic
attttggtgcgaatgtcacggacgtgtttatgctgtcgtctgcgcgacctcccaaagggcggtggtttggttgca

SEQ ID NO: 120595 - DNA, 75 bp, Artificial Sequence
  Synthetic
attttggtgcgaatgccacggacgtgtttatgctgtcgtctgcgcgacctcccaaagggcggtggtttggttgca

SEQ ID NO: 120596 - DNA, 75 bp, Artificial Sequence
  Synthetic
attttggtgcgaatggcacggacgtgtttatgctgtcgtctgcgcgacctcccaaagggcggtggtttggttgca

SEQ ID NO: 120597 - DNA, 75 bp, Artificial Sequence
  Synthetic
attttggtgggaatgacacggacgtgtttatgctgtcgtctgcgcgacctcccaaagggcggtggtttggttgca

SEQ ID NO: 120598 - DNA, 75 bp, Artificial Sequence
  Synthetic
attttggtgggaatgtcacggacgtgtttatgctgtcgtctgcgcgacctcccaaagggcggtggtttggttgca

SEQ ID NO: 120599 - DNA, 75 bp, Artificial Sequence
  Synthetic
attttggtgggaatgccacggacgtgtttatgctgtcgtctgcgcgacctcccaaagggcggtggtttggttgca

SEQ ID NO: 120600 - DNA, 75 bp, Artificial Sequence
  Synthetic
attttggtgggaatggcacggacgtgtttatgctgtcgtctgcgcgacctcccaaagggcggtggtttggttgca

SEQ ID NO: 120601 - DNA, 75 bp, Artificial Sequence
  Synthetic
ggggctgctcagtggatgaataggctgatagcgtttgcctcaaggggcaaccacgtgtcgcctacccactacgtg

SEQ ID NO: 120602 - DNA, 75 bp, Artificial Sequence
  Synthetic
gtcttagatcaggctgagacggctggggtgaggctgacggttttagcgacagcaactcccccaggcagcatcact

SEQ ID NO: 120603 - DNA, 75 bp, Artificial Sequence
  Synthetic
ctccttgcaaggagcgtgggcgaaggtcgtcgtcatcctcctgctgtttgcaggagtggaggcgcatacccacgt

SEQ ID NO: 120604 - DNA, 75 bp, Artificial Sequence
  Synthetic
ccctacagactgtttcaggaaacatccagaagctacatacagtcggtgcggatccggcccctggcttacaccgag

SEQ ID NO: 120605 - DNA, 75 bp, Artificial Sequence
  Synthetic
gctgccctgcgagcccgagccagacgtagctgtgctgacatcgatgcttacagacccatcccacatcactgcaga

SEQ ID NO: 120606 - DNA, 75 bp, Artificial Sequence
  Synthetic
caacgccatgtgccacctcgtggctcagggacatctgggattgggtctgcacggtgcttgcggacttcagggcgt

SEQ ID NO: 120607 - DNA, 75 bp, Artificial Sequence
  Synthetic
tgctcgtcatctgcttcgcctggcatttcaagggaaggttggtccctggggccacctacctttacttgggcattt

SEQ ID NO: 120608 - DNA, 75 bp, Artificial Sequence
  Synthetic
gatccggcccctggcttacaccgaggtgcttggttaactacccgtaccggctgtggcactatccatgtactgtaa

SEQ ID NO: 120609 - DNA, 75 bp, Artificial Sequence
  Synthetic
gatccggcccctggcttacaccgaggtgcttggtttactacccgtaccggctgtggcactatccatgtactgtaa

SEQ ID NO: 120610 - DNA, 75 bp, Artificial Sequence
  Synthetic
gatccggcccctggcttacaccgaggtgcttggttcactacccgtaccggctgtggcactatccatgtactgtaa

SEQ ID NO: 120611 - DNA, 75 bp, Artificial Sequence
  Synthetic
gatccggcccctggcttacaccgaggtgcttggttgactacccgtaccggctgtggcactatccatgtactgtaa

SEQ ID NO: 120612 - DNA, 75 bp, Artificial Sequence
  Synthetic
cagacccatcccacatcactgcagagacggcggcgcgtagactaaaccgggggtctcccccctctctggctagct

SEQ ID NO: 120613 - DNA, 75 bp, Artificial Sequence
  Synthetic
cacattaaccgcacggccctcaattgcaatgatagccttaacaccggcttccttgcttctctgttctacacccat

SEQ ID NO: 120614 - DNA, 75 bp, Artificial Sequence
  Synthetic
aatctttacactcacccctgggtacaagaagatgatagtgctggccatgtggtggctccagtatttcatagcccg

SEQ ID NO: 120615 - DNA, 75 bp, Artificial Sequence
  Synthetic
cacatgctcctgcggagcggccattgcaggccacgtgaggaacggctccatgaggataacgggtcccaggacgtg

SEQ ID NO: 120616 - DNA, 75 bp, Artificial Sequence
  Synthetic
tcgagaccgcagtgagcaaaatccgctgctccattccacaacagagctcgccatactcccgtgctcattcacgcc

SEQ ID NO: 120617 - DNA, 75 bp, Artificial Sequence
  Synthetic
tcgagaccgcagtgagctaaatccgctgctccattccacaacagagctcgccatactcccgtgctcattcacgcc

SEQ ID NO: 120618 - DNA, 75 bp, Artificial Sequence
  Synthetic
tcgagaccgcagtgagccaaatccgctgctccattccacaacagagctcgccatactcccgtgctcattcacgcc

SEQ ID NO: 120619 - DNA, 75 bp, Artificial Sequence
  Synthetic
tcgagaccgcagtgagcgaaatccgctgctccattccacaacagagctcgccatactcccgtgctcattcacgcc

SEQ ID NO: 120620 - DNA, 75 bp, Artificial Sequence
  Synthetic
gagctcttgtggcattcaagatcatgagcggtgaggtcccctccacggaggacctggtcaatctactgcccgcca

SEQ ID NO: 120621 - DNA, 75 bp, Artificial Sequence
  Synthetic
tcatagaagccaacctcctgtggaggcaggagatgggggggaacatcaccagagtggagtcggagaacaagatcg

SEQ ID NO: 120622 - DNA, 75 bp, Artificial Sequence
  Synthetic
gacctggtcaatctactgcccgccatcctctcgcctggagcccttgtagtcggtgtggtctgcgcagcaatactg

SEQ ID NO: 120623 - DNA, 75 bp, Artificial Sequence
  Synthetic
ccaacgatgaggacatgaggccctactgctggcactacccgcctaaaccttgtggtatcgttccagctcgaacgg

SEQ ID NO: 120624 - DNA, 75 bp, Artificial Sequence
  Synthetic
gcgggaagaggtttcattccaagttgggcttaaccactacgtggtcgggtcacagctcccttgtgaacctgagcc

SEQ ID NO: 120625 - DNA, 75 bp, Artificial Sequence
  Synthetic
tttgaggtcacaaaaatcctcctcgggatactgggccccttgtacttgttgcagcattcgctcatcaagatacct

SEQ ID NO: 120626 - DNA, 75 bp, Artificial Sequence
  Synthetic
tttgaggtcacaaaaatcctcctcgggatactgggccccttgtacttgttgcagcattcgctcatcaagattcct

SEQ ID NO: 120627 - DNA, 75 bp, Artificial Sequence
  Synthetic
tttgaggtcacaaaaatcctcctcgggatactgggccccttgtacttgttgcagcattcgctcatcaagatccct

SEQ ID NO: 120628 - DNA, 75 bp, Artificial Sequence
  Synthetic
tttgaggtcacaaaaatcctcctcgggatactgggccccttgtacttgttgcagcattcgctcatcaagatgcct

SEQ ID NO: 120629 - DNA, 75 bp, Artificial Sequence
  Synthetic
tttgaggtcacaaaaatcctcctcgggatactgggccccttgtacttgttgcagcattcgctcatcaagttacct

SEQ ID NO: 120630 - DNA, 75 bp, Artificial Sequence
  Synthetic
tttgaggtcacaaaaatcctcctcgggatactgggccccttgtacttgttgcagcattcgctcatcaagtttcct

SEQ ID NO: 120631 - DNA, 75 bp, Artificial Sequence
  Synthetic
tttgaggtcacaaaaatcctcctcgggatactgggccccttgtacttgttgcagcattcgctcatcaagttccct

SEQ ID NO: 120632 - DNA, 75 bp, Artificial Sequence
  Synthetic
tttgaggtcacaaaaatcctcctcgggatactgggccccttgtacttgttgcagcattcgctcatcaagttgcct

SEQ ID NO: 120633 - DNA, 75 bp, Artificial Sequence
  Synthetic
tttgaggtcacaaaaatcctcctcgggatactgggccccttgtacttgttgcagcattcgctcatcaagctacct

SEQ ID NO: 120634 - DNA, 75 bp, Artificial Sequence
  Synthetic
tttgaggtcacaaaaatcctcctcgggatactgggccccttgtacttgttgcagcattcgctcatcaagcttcct

SEQ ID NO: 120635 - DNA, 75 bp, Artificial Sequence
  Synthetic
tttgaggtcacaaaaatcctcctcgggatactgggccccttgtacttgttgcagcattcgctcatcaagctccct

SEQ ID NO: 120636 - DNA, 75 bp, Artificial Sequence
  Synthetic
tttgaggtcacaaaaatcctcctcgggatactgggccccttgtacttgttgcagcattcgctcatcaagctgcct

SEQ ID NO: 120637 - DNA, 75 bp, Artificial Sequence
  Synthetic
tttgaggtcacaaaaatcctcctcgggatactgggccccttgtacttgttgcagcattcgctcatcaaggtacct

SEQ ID NO: 120638 - DNA, 75 bp, Artificial Sequence
  Synthetic
tttgaggtcacaaaaatcctcctcgggatactgggccccttgtacttgttgcagcattcgctcatcaaggttcct

SEQ ID NO: 120639 - DNA, 75 bp, Artificial Sequence
  Synthetic
tttgaggtcacaaaaatcctcctcgggatactgggccccttgtacttgttgcagcattcgctcatcaaggtccct

SEQ ID NO: 120640 - DNA, 75 bp, Artificial Sequence
  Synthetic
tttgaggtcacaaaaatcctcctcgggatactgggccccttgtacttgttgcagcattcgctcatcaaggtgcct

SEQ ID NO: 120641 - DNA, 75 bp, Artificial Sequence
  Synthetic
gcagctgaggagtacgtagaggttgtgcgcataaaggactgccattaagtggtaggggccacatctgacaactta

SEQ ID NO: 120642 - DNA, 75 bp, Artificial Sequence
  Synthetic
gcagctgaggagtacgtagaggttgtgcgcataaaggactgccattatgtggtaggggccacatctgacaactta

SEQ ID NO: 120643 - DNA, 75 bp, Artificial Sequence
  Synthetic
gcagctgaggagtacgtagaggttgtgcgcataaaggactgccattacgtggtaggggccacatctgacaactta

SEQ ID NO: 120644 - DNA, 75 bp, Artificial Sequence
  Synthetic
gcagctgaggagtacgtagaggttgtgcgcataaaggactgccattaggtggtaggggccacatctgacaactta

SEQ ID NO: 120645 - DNA, 75 bp, Artificial Sequence
  Synthetic
tacaatcctccccttgtggagccatggaagcgcccggactatgaaccacccttagttcacgggtgccccctacca

SEQ ID NO: 120646 - DNA, 75 bp, Artificial Sequence
  Synthetic
gtgcgttgccctctggatgatgctgatgatctcccaggcagaagcagcgatggagaatttgatcatgttaaacgc

SEQ ID NO: 120647 - DNA, 75 bp, Artificial Sequence
  Synthetic
agctcttcagctagccaactgtctgcgccttccctcaaagcgacgtgcaccacccgtcacgagtccccagacgct

SEQ ID NO: 120648 - DNA, 75 bp, Artificial Sequence
  Synthetic
tgtctttctgctcaacagcacccgcccccctgggggcagttggtttgggtgcacgtggatgaactccactggcta

SEQ ID NO: 120649 - DNA, 75 bp, Artificial Sequence
  Synthetic
aggtgtccttcagtgtaggactctcctcatacgcaatcgggtcccaacttccatgcgagcccgagccggacgtca

SEQ ID NO: 120650 - DNA, 75 bp, Artificial Sequence
  Synthetic
aggtgtccttcagtgtaggactctcctcatacgctatcgggtcccaacttccatgcgagcccgagccggacgtca

SEQ ID NO: 120651 - DNA, 75 bp, Artificial Sequence
  Synthetic
aggtgtccttcagtgtaggactctcctcatacgccatcgggtcccaacttccatgcgagcccgagccggacgtca

SEQ ID NO: 120652 - DNA, 75 bp, Artificial Sequence
  Synthetic
aggtgtccttcagtgtaggactctcctcatacgcgatcgggtcccaacttccatgcgagcccgagccggacgtca

SEQ ID NO: 120653 - DNA, 75 bp, Artificial Sequence
  Synthetic
cacctcggagaaagaggatggtggtactggatgagtccacagtatcatctgctctggctgagcttgccgttaaaa

SEQ ID NO: 120654 - DNA, 75 bp, Artificial Sequence
  Synthetic
tgaggttgtgcatgctagcgaagcacctggtatgcggcaagtacgtgcaggcggccttactccaccttggaaggc

SEQ ID NO: 120655 - DNA, 75 bp, Artificial Sequence
  Synthetic
tgaggttgtgcatgctagcgaagcacctggtatgcggcaagtacgtgcaggcggccttactccaccttggtaggc

SEQ ID NO: 120656 - DNA, 75 bp, Artificial Sequence
  Synthetic
tgaggttgtgcatgctagcgaagcacctggtatgcggcaagtacgtgcaggcggccttactccaccttggcaggc

SEQ ID NO: 120657 - DNA, 75 bp, Artificial Sequence
  Synthetic
tgaggttgtgcatgctagcgaagcacctggtatgcggcaagtacgtgcaggcggccttactccaccttgggaggc

SEQ ID NO: 120658 - DNA, 75 bp, Artificial Sequence
  Synthetic
cgcttcgagcggaggaagacgagagggaaatgtccgtaccagcggaaatcttgcggaaatccaagaagttccctc

SEQ ID NO: 120659 - DNA, 75 bp, Artificial Sequence
  Synthetic
ctgacaggcctctggtccctagccctgctcgtcctcctgcttccccagcgcgcctacgcatggacgggcgaggat

SEQ ID NO: 120660 - DNA, 75 bp, Artificial Sequence
  Synthetic
tccagaccatatcactgcagagacggcggcccggcgcctcaggagggggtctcctccatcgttggctagctcatc

SEQ ID NO: 120661 - DNA, 75 bp, Artificial Sequence
  Synthetic
gcgacctatggcaagtgtggggctggaccctggttaactccaaaatgtctggttgactacccctacaggctgtgg

SEQ ID NO: 120662 - DNA, 75 bp, Artificial Sequence
  Synthetic
cactatggagacaaaggtcatcacgtggggggcagacacagccgcgtgtggggacatacttgcaggccttccagt

SEQ ID NO: 120663 - DNA, 75 bp, Artificial Sequence
  Synthetic
cactatggagacaaaggtcatcacgtggggggcagacactgccgcgtgtggggacatacttgcaggccttccagt

SEQ ID NO: 120664 - DNA, 75 bp, Artificial Sequence
  Synthetic
cactatggagacaaaggtcatcacgtggggggcagacaccgccgcgtgtggggacatacttgcaggccttccagt

SEQ ID NO: 120665 - DNA, 75 bp, Artificial Sequence
  Synthetic
cactatggagacaaaggtcatcacgtggggggcagacacggccgcgtgtggggacatacttgcaggccttccagt

SEQ ID NO: 120666 - DNA, 75 bp, Artificial Sequence
  Synthetic
cactatggagacaaaggtcatcacgtggggggctgacacagccgcgtgtggggacatacttgcaggccttccagt

SEQ ID NO: 120667 - DNA, 75 bp, Artificial Sequence
  Synthetic
cactatggagacaaaggtcatcacgtggggggctgacactgccgcgtgtggggacatacttgcaggccttccagt

SEQ ID NO: 120668 - DNA, 75 bp, Artificial Sequence
  Synthetic
cactatggagacaaaggtcatcacgtggggggctgacaccgccgcgtgtggggacatacttgcaggccttccagt

SEQ ID NO: 120669 - DNA, 75 bp, Artificial Sequence
  Synthetic
cactatggagacaaaggtcatcacgtggggggctgacacggccgcgtgtggggacatacttgcaggccttccagt

SEQ ID NO: 120670 - DNA, 75 bp, Artificial Sequence
  Synthetic
cactatggagacaaaggtcatcacgtggggggccgacacagccgcgtgtggggacatacttgcaggccttccagt

SEQ ID NO: 120671 - DNA, 75 bp, Artificial Sequence
  Synthetic
cactatggagacaaaggtcatcacgtggggggccgacactgccgcgtgtggggacatacttgcaggccttccagt

SEQ ID NO: 120672 - DNA, 75 bp, Artificial Sequence
  Synthetic
cactatggagacaaaggtcatcacgtggggggccgacaccgccgcgtgtggggacatacttgcaggccttccagt

SEQ ID NO: 120673 - DNA, 75 bp, Artificial Sequence
  Synthetic
cactatggagacaaaggtcatcacgtggggggccgacacggccgcgtgtggggacatacttgcaggccttccagt

SEQ ID NO: 120674 - DNA, 75 bp, Artificial Sequence
  Synthetic
cactatggagacaaaggtcatcacgtggggggcggacacagccgcgtgtggggacatacttgcaggccttccagt

SEQ ID NO: 120675 - DNA, 75 bp, Artificial Sequence
  Synthetic
cactatggagacaaaggtcatcacgtggggggcggacactgccgcgtgtggggacatacttgcaggccttccagt

SEQ ID NO: 120676 - DNA, 75 bp, Artificial Sequence
  Synthetic
cactatggagacaaaggtcatcacgtggggggcggacaccgccgcgtgtggggacatacttgcaggccttccagt

SEQ ID NO: 120677 - DNA, 75 bp, Artificial Sequence
  Synthetic
cactatggagacaaaggtcatcacgtggggggcggacacggccgcgtgtggggacatacttgcaggccttccagt

SEQ ID NO: 120678 - DNA, 75 bp, Artificial Sequence
  Synthetic
ctctatggagacaaaggtcatcacgtggggggcagacacagccgcgtgtggggacatacttgcaggccttccagt

SEQ ID NO: 120679 - DNA, 75 bp, Artificial Sequence
  Synthetic
ctctatggagacaaaggtcatcacgtggggggcagacactgccgcgtgtggggacatacttgcaggccttccagt

SEQ ID NO: 120680 - DNA, 75 bp, Artificial Sequence
  Synthetic
ctctatggagacaaaggtcatcacgtggggggcagacaccgccgcgtgtggggacatacttgcaggccttccagt

SEQ ID NO: 120681 - DNA, 75 bp, Artificial Sequence
  Synthetic
ctctatggagacaaaggtcatcacgtggggggcagacacggccgcgtgtggggacatacttgcaggccttccagt

SEQ ID NO: 120682 - DNA, 75 bp, Artificial Sequence
  Synthetic
ctctatggagacaaaggtcatcacgtggggggctgacacagccgcgtgtggggacatacttgcaggccttccagt

SEQ ID NO: 120683 - DNA, 75 bp, Artificial Sequence
  Synthetic
ctctatggagacaaaggtcatcacgtggggggctgacactgccgcgtgtggggacatacttgcaggccttccagt

SEQ ID NO: 120684 - DNA, 75 bp, Artificial Sequence
  Synthetic
ctctatggagacaaaggtcatcacgtggggggctgacaccgccgcgtgtggggacatacttgcaggccttccagt

SEQ ID NO: 120685 - DNA, 75 bp, Artificial Sequence
  Synthetic
ctctatggagacaaaggtcatcacgtggggggctgacacggccgcgtgtggggacatacttgcaggccttccagt

SEQ ID NO: 120686 - DNA, 75 bp, Artificial Sequence
  Synthetic
ctctatggagacaaaggtcatcacgtggggggccgacacagccgcgtgtggggacatacttgcaggccttccagt

SEQ ID NO: 120687 - DNA, 75 bp, Artificial Sequence
  Synthetic
ctctatggagacaaaggtcatcacgtggggggccgacactgccgcgtgtggggacatacttgcaggccttccagt

SEQ ID NO: 120688 - DNA, 75 bp, Artificial Sequence
  Synthetic
ctctatggagacaaaggtcatcacgtggggggccgacaccgccgcgtgtggggacatacttgcaggccttccagt

SEQ ID NO: 120689 - DNA, 75 bp, Artificial Sequence
  Synthetic
ctctatggagacaaaggtcatcacgtggggggccgacacggccgcgtgtggggacatacttgcaggccttccagt

SEQ ID NO: 120690 - DNA, 75 bp, Artificial Sequence
  Synthetic
ctctatggagacaaaggtcatcacgtggggggcggacacagccgcgtgtggggacatacttgcaggccttccagt

SEQ ID NO: 120691 - DNA, 75 bp, Artificial Sequence
  Synthetic
ctctatggagacaaaggtcatcacgtggggggcggacactgccgcgtgtggggacatacttgcaggccttccagt

SEQ ID NO: 120692 - DNA, 75 bp, Artificial Sequence
  Synthetic
ctctatggagacaaaggtcatcacgtggggggcggacaccgccgcgtgtggggacatacttgcaggccttccagt

SEQ ID NO: 120693 - DNA, 75 bp, Artificial Sequence
  Synthetic
ctctatggagacaaaggtcatcacgtggggggcggacacggccgcgtgtggggacatacttgcaggccttccagt

SEQ ID NO: 120694 - DNA, 75 bp, Artificial Sequence
  Synthetic
ccctatggagacaaaggtcatcacgtggggggcagacacagccgcgtgtggggacatacttgcaggccttccagt

SEQ ID NO: 120695 - DNA, 75 bp, Artificial Sequence
  Synthetic
ccctatggagacaaaggtcatcacgtggggggcagacactgccgcgtgtggggacatacttgcaggccttccagt

SEQ ID NO: 120696 - DNA, 75 bp, Artificial Sequence
  Synthetic
ccctatggagacaaaggtcatcacgtggggggcagacaccgccgcgtgtggggacatacttgcaggccttccagt

SEQ ID NO: 120697 - DNA, 75 bp, Artificial Sequence
  Synthetic
ccctatggagacaaaggtcatcacgtggggggcagacacggccgcgtgtggggacatacttgcaggccttccagt

SEQ ID NO: 120698 - DNA, 75 bp, Artificial Sequence
  Synthetic
ccctatggagacaaaggtcatcacgtggggggctgacacagccgcgtgtggggacatacttgcaggccttccagt

SEQ ID NO: 120699 - DNA, 75 bp, Artificial Sequence
  Synthetic
ccctatggagacaaaggtcatcacgtggggggctgacactgccgcgtgtggggacatacttgcaggccttccagt

SEQ ID NO: 120700 - DNA, 75 bp, Artificial Sequence
  Synthetic
ccctatggagacaaaggtcatcacgtggggggctgacaccgccgcgtgtggggacatacttgcaggccttccagt

SEQ ID NO: 120701 - DNA, 75 bp, Artificial Sequence
  Synthetic
ccctatggagacaaaggtcatcacgtggggggctgacacggccgcgtgtggggacatacttgcaggccttccagt

SEQ ID NO: 120702 - DNA, 75 bp, Artificial Sequence
  Synthetic
ccctatggagacaaaggtcatcacgtggggggccgacacagccgcgtgtggggacatacttgcaggccttccagt

SEQ ID NO: 120703 - DNA, 75 bp, Artificial Sequence
  Synthetic
ccctatggagacaaaggtcatcacgtggggggccgacactgccgcgtgtggggacatacttgcaggccttccagt

SEQ ID NO: 120704 - DNA, 75 bp, Artificial Sequence
  Synthetic
ccctatggagacaaaggtcatcacgtggggggccgacaccgccgcgtgtggggacatacttgcaggccttccagt

SEQ ID NO: 120705 - DNA, 75 bp, Artificial Sequence
  Synthetic
ccctatggagacaaaggtcatcacgtggggggccgacacggccgcgtgtggggacatacttgcaggccttccagt

SEQ ID NO: 120706 - DNA, 75 bp, Artificial Sequence
  Synthetic
ccctatggagacaaaggtcatcacgtggggggcggacacagccgcgtgtggggacatacttgcaggccttccagt

SEQ ID NO: 120707 - DNA, 75 bp, Artificial Sequence
  Synthetic
ccctatggagacaaaggtcatcacgtggggggcggacactgccgcgtgtggggacatacttgcaggccttccagt

SEQ ID NO: 120708 - DNA, 75 bp, Artificial Sequence
  Synthetic
ccctatggagacaaaggtcatcacgtggggggcggacaccgccgcgtgtggggacatacttgcaggccttccagt

SEQ ID NO: 120709 - DNA, 75 bp, Artificial Sequence
  Synthetic
ccctatggagacaaaggtcatcacgtggggggcggacacggccgcgtgtggggacatacttgcaggccttccagt

SEQ ID NO: 120710 - DNA, 75 bp, Artificial Sequence
  Synthetic
cgctatggagacaaaggtcatcacgtggggggcagacacagccgcgtgtggggacatacttgcaggccttccagt

SEQ ID NO: 120711 - DNA, 75 bp, Artificial Sequence
  Synthetic
cgctatggagacaaaggtcatcacgtggggggcagacactgccgcgtgtggggacatacttgcaggccttccagt

SEQ ID NO: 120712 - DNA, 75 bp, Artificial Sequence
  Synthetic
cgctatggagacaaaggtcatcacgtggggggcagacaccgccgcgtgtggggacatacttgcaggccttccagt

SEQ ID NO: 120713 - DNA, 75 bp, Artificial Sequence
  Synthetic
cgctatggagacaaaggtcatcacgtggggggcagacacggccgcgtgtggggacatacttgcaggccttccagt

SEQ ID NO: 120714 - DNA, 75 bp, Artificial Sequence
  Synthetic
cgctatggagacaaaggtcatcacgtggggggctgacacagccgcgtgtggggacatacttgcaggccttccagt

SEQ ID NO: 120715 - DNA, 75 bp, Artificial Sequence
  Synthetic
cgctatggagacaaaggtcatcacgtggggggctgacactgccgcgtgtggggacatacttgcaggccttccagt

SEQ ID NO: 120716 - DNA, 75 bp, Artificial Sequence
  Synthetic
cgctatggagacaaaggtcatcacgtggggggctgacaccgccgcgtgtggggacatacttgcaggccttccagt

SEQ ID NO: 120717 - DNA, 75 bp, Artificial Sequence
  Synthetic
cgctatggagacaaaggtcatcacgtggggggctgacacggccgcgtgtggggacatacttgcaggccttccagt

SEQ ID NO: 120718 - DNA, 75 bp, Artificial Sequence
  Synthetic
cgctatggagacaaaggtcatcacgtggggggccgacacagccgcgtgtggggacatacttgcaggccttccagt

SEQ ID NO: 120719 - DNA, 75 bp, Artificial Sequence
  Synthetic
cgctatggagacaaaggtcatcacgtggggggccgacactgccgcgtgtggggacatacttgcaggccttccagt

SEQ ID NO: 120720 - DNA, 75 bp, Artificial Sequence
  Synthetic
cgctatggagacaaaggtcatcacgtggggggccgacaccgccgcgtgtggggacatacttgcaggccttccagt

SEQ ID NO: 120721 - DNA, 75 bp, Artificial Sequence
  Synthetic
cgctatggagacaaaggtcatcacgtggggggccgacacggccgcgtgtggggacatacttgcaggccttccagt

SEQ ID NO: 120722 - DNA, 75 bp, Artificial Sequence
  Synthetic
cgctatggagacaaaggtcatcacgtggggggcggacacagccgcgtgtggggacatacttgcaggccttccagt

SEQ ID NO: 120723 - DNA, 75 bp, Artificial Sequence
  Synthetic
cgctatggagacaaaggtcatcacgtggggggcggacactgccgcgtgtggggacatacttgcaggccttccagt

SEQ ID NO: 120724 - DNA, 75 bp, Artificial Sequence
  Synthetic
cgctatggagacaaaggtcatcacgtggggggcggacaccgccgcgtgtggggacatacttgcaggccttccagt

SEQ ID NO: 120725 - DNA, 75 bp, Artificial Sequence
  Synthetic
cgctatggagacaaaggtcatcacgtggggggcggacacggccgcgtgtggggacatacttgcaggccttccagt

SEQ ID NO: 120726 - DNA, 75 bp, Artificial Sequence
  Synthetic
cccggcctccgctgttgaggtgaagaacaccagcaccggttacatggtgactaatgactgtgccaatagcagcat

SEQ ID NO: 120727 - DNA, 75 bp, Artificial Sequence
  Synthetic
ggccgtcttatttggtggaatcagtacgccataagcaggtgtgaggcctccttgcatgtgtgggtcccctcccta

SEQ ID NO: 120728 - DNA, 75 bp, Artificial Sequence
  Synthetic
acgcgaggggtactgggcgccatagttgtcagcctaactggccgagacaaaaatgaagccgagggtgaggtgcag

SEQ ID NO: 120729 - DNA, 75 bp, Artificial Sequence
  Synthetic
accacctacgaaggcgcccccaataccacctccgcggaggaagaggacggttgtcctaacagaatccactgtgtc

SEQ ID NO: 120730 - DNA, 75 bp, Artificial Sequence
  Synthetic
accgctgtaatctggaggacagggataggagccaattaagcccacttctgcattccaccactgagtgggccatcc

SEQ ID NO: 120731 - DNA, 75 bp, Artificial Sequence
  Synthetic
atcaacgcactgagcaactcgctgctgcgtcaccacaatttggtgtattccaccacctctcgcagtgctggtcag

SEQ ID NO: 120732 - DNA, 75 bp, Artificial Sequence
  Synthetic
gaggtgggtggcaacatcacgcgagtcgagtctgagaacaaggtcatcgttctcgactcttttgacccactggtc

SEQ ID NO: 120733 - DNA, 75 bp, Artificial Sequence
  Synthetic
agacagaaaaaagtcacattagacagactgcaagtcctggacgatcattaccgggacgtgctcaaggaggctaag

SEQ ID NO: 120734 - DNA, 75 bp, Artificial Sequence
  Synthetic
agacagaaaaaagtcacatttgacagactgcaagtcctggacgatcattaccgggacgtgctcaaggaggctaag

SEQ ID NO: 120735 - DNA, 75 bp, Artificial Sequence
  Synthetic
agacagaaaaaagtcacattcgacagactgcaagtcctggacgatcattaccgggacgtgctcaaggaggctaag

SEQ ID NO: 120736 - DNA, 75 bp, Artificial Sequence
  Synthetic
agacagaaaaaagtcacattggacagactgcaagtcctggacgatcattaccgggacgtgctcaaggaggctaag

SEQ ID NO: 120737 - DNA, 75 bp, Artificial Sequence
  Synthetic
acaacccgcctctgatagagacgtggaaagccccggactacgaccctcccaccgtgtcagggtgcgccctccctc

SEQ ID NO: 120738 - DNA, 75 bp, Artificial Sequence
  Synthetic
caatgtacctagtgcaggccgccctcactgggaccccttactttgtgcgcgcccacgctttgattcgtctctgca

SEQ ID NO: 120739 - DNA, 75 bp, Artificial Sequence
  Synthetic
cctcacaaaatacatggtcaaatgggaatgggtggtcctgctcttcctgctcttagcagatgctaggatctgcgc

SEQ ID NO: 120740 - DNA, 75 bp, Artificial Sequence
  Synthetic
aggatgtccgaagccactccagtaaggccatacgccacatcaactccgtgtggcaagaccttctggaggacagta

SEQ ID NO: 120741 - DNA, 75 bp, Artificial Sequence
  Synthetic
catcaatgcgttgagcaactctctactgcgtcatcacaacatggtctatgccaccacgtctcgtagcgcaagcca

SEQ ID NO: 120742 - DNA, 75 bp, Artificial Sequence
  Synthetic
attcccaccagacaccacgtcctcgcaaggagactccggggtggccccctcacaggagggctctggggatacacc

SEQ ID NO: 120743 - DNA, 75 bp, Artificial Sequence
  Synthetic
attcccaccagacaccacgtcctcgcaaggagactccggggtggccccctcacaggagggctctggggattcacc

SEQ ID NO: 120744 - DNA, 75 bp, Artificial Sequence
  Synthetic
attcccaccagacaccacgtcctcgcaaggagactccggggtggccccctcacaggagggctctggggatccacc

SEQ ID NO: 120745 - DNA, 75 bp, Artificial Sequence
  Synthetic
attcccaccagacaccacgtcctcgcaaggagactccggggtggccccctcacaggagggctctggggatgcacc

SEQ ID NO: 120746 - DNA, 75 bp, Artificial Sequence
  Synthetic
attccctccagacaccacgtcctcgcaaggagactccggggtggccccctcacaggagggctctggggatacacc

SEQ ID NO: 120747 - DNA, 75 bp, Artificial Sequence
  Synthetic
attccctccagacaccacgtcctcgcaaggagactccggggtggccccctcacaggagggctctggggattcacc

SEQ ID NO: 120748 - DNA, 75 bp, Artificial Sequence
  Synthetic
attccctccagacaccacgtcctcgcaaggagactccggggtggccccctcacaggagggctctggggatccacc

SEQ ID NO: 120749 - DNA, 75 bp, Artificial Sequence
  Synthetic
attccctccagacaccacgtcctcgcaaggagactccggggtggccccctcacaggagggctctggggatgcacc

SEQ ID NO: 120750 - DNA, 75 bp, Artificial Sequence
  Synthetic
attccccccagacaccacgtcctcgcaaggagactccggggtggccccctcacaggagggctctggggatacacc

SEQ ID NO: 120751 - DNA, 75 bp, Artificial Sequence
  Synthetic
attccccccagacaccacgtcctcgcaaggagactccggggtggccccctcacaggagggctctggggattcacc

SEQ ID NO: 120752 - DNA, 75 bp, Artificial Sequence
  Synthetic
attccccccagacaccacgtcctcgcaaggagactccggggtggccccctcacaggagggctctggggatccacc

SEQ ID NO: 120753 - DNA, 75 bp, Artificial Sequence
  Synthetic
attccccccagacaccacgtcctcgcaaggagactccggggtggccccctcacaggagggctctggggatgcacc

SEQ ID NO: 120754 - DNA, 75 bp, Artificial Sequence
  Synthetic
attcccgccagacaccacgtcctcgcaaggagactccggggtggccccctcacaggagggctctggggatacacc

SEQ ID NO: 120755 - DNA, 75 bp, Artificial Sequence
  Synthetic
attcccgccagacaccacgtcctcgcaaggagactccggggtggccccctcacaggagggctctggggattcacc

SEQ ID NO: 120756 - DNA, 75 bp, Artificial Sequence
  Synthetic
attcccgccagacaccacgtcctcgcaaggagactccggggtggccccctcacaggagggctctggggatccacc

SEQ ID NO: 120757 - DNA, 75 bp, Artificial Sequence
  Synthetic
attcccgccagacaccacgtcctcgcaaggagactccggggtggccccctcacaggagggctctggggatgcacc

SEQ ID NO: 120758 - DNA, 75 bp, Artificial Sequence
  Synthetic
tttcccaccagacaccacgtcctcgcaaggagactccggggtggccccctcacaggagggctctggggatacacc

SEQ ID NO: 120759 - DNA, 75 bp, Artificial Sequence
  Synthetic
tttcccaccagacaccacgtcctcgcaaggagactccggggtggccccctcacaggagggctctggggattcacc

SEQ ID NO: 120760 - DNA, 75 bp, Artificial Sequence
  Synthetic
tttcccaccagacaccacgtcctcgcaaggagactccggggtggccccctcacaggagggctctggggatccacc

SEQ ID NO: 120761 - DNA, 75 bp, Artificial Sequence
  Synthetic
tttcccaccagacaccacgtcctcgcaaggagactccggggtggccccctcacaggagggctctggggatgcacc

SEQ ID NO: 120762 - DNA, 75 bp, Artificial Sequence
  Synthetic
tttccctccagacaccacgtcctcgcaaggagactccggggtggccccctcacaggagggctctggggatacacc

SEQ ID NO: 120763 - DNA, 75 bp, Artificial Sequence
  Synthetic
tttccctccagacaccacgtcctcgcaaggagactccggggtggccccctcacaggagggctctggggattcacc

SEQ ID NO: 120764 - DNA, 75 bp, Artificial Sequence
  Synthetic
tttccctccagacaccacgtcctcgcaaggagactccggggtggccccctcacaggagggctctggggatccacc

SEQ ID NO: 120765 - DNA, 75 bp, Artificial Sequence
  Synthetic
tttccctccagacaccacgtcctcgcaaggagactccggggtggccccctcacaggagggctctggggatgcacc

SEQ ID NO: 120766 - DNA, 75 bp, Artificial Sequence
  Synthetic
tttccccccagacaccacgtcctcgcaaggagactccggggtggccccctcacaggagggctctggggatacacc

SEQ ID NO: 120767 - DNA, 75 bp, Artificial Sequence
  Synthetic
tttccccccagacaccacgtcctcgcaaggagactccggggtggccccctcacaggagggctctggggattcacc

SEQ ID NO: 120768 - DNA, 75 bp, Artificial Sequence
  Synthetic
tttccccccagacaccacgtcctcgcaaggagactccggggtggccccctcacaggagggctctggggatccacc

SEQ ID NO: 120769 - DNA, 75 bp, Artificial Sequence
  Synthetic
tttccccccagacaccacgtcctcgcaaggagactccggggtggccccctcacaggagggctctggggatgcacc

SEQ ID NO: 120770 - DNA, 75 bp, Artificial Sequence
  Synthetic
tttcccgccagacaccacgtcctcgcaaggagactccggggtggccccctcacaggagggctctggggatacacc

SEQ ID NO: 120771 - DNA, 75 bp, Artificial Sequence
  Synthetic
tttcccgccagacaccacgtcctcgcaaggagactccggggtggccccctcacaggagggctctggggattcacc

SEQ ID NO: 120772 - DNA, 75 bp, Artificial Sequence
  Synthetic
tttcccgccagacaccacgtcctcgcaaggagactccggggtggccccctcacaggagggctctggggatccacc

SEQ ID NO: 120773 - DNA, 75 bp, Artificial Sequence
  Synthetic
tttcccgccagacaccacgtcctcgcaaggagactccggggtggccccctcacaggagggctctggggatgcacc

SEQ ID NO: 120774 - DNA, 75 bp, Artificial Sequence
  Synthetic
cttcccaccagacaccacgtcctcgcaaggagactccggggtggccccctcacaggagggctctggggatacacc

SEQ ID NO: 120775 - DNA, 75 bp, Artificial Sequence
  Synthetic
cttcccaccagacaccacgtcctcgcaaggagactccggggtggccccctcacaggagggctctggggattcacc

SEQ ID NO: 120776 - DNA, 75 bp, Artificial Sequence
  Synthetic
cttcccaccagacaccacgtcctcgcaaggagactccggggtggccccctcacaggagggctctggggatccacc

SEQ ID NO: 120777 - DNA, 75 bp, Artificial Sequence
  Synthetic
cttcccaccagacaccacgtcctcgcaaggagactccggggtggccccctcacaggagggctctggggatgcacc

SEQ ID NO: 120778 - DNA, 75 bp, Artificial Sequence
  Synthetic
cttccctccagacaccacgtcctcgcaaggagactccggggtggccccctcacaggagggctctggggatacacc

SEQ ID NO: 120779 - DNA, 75 bp, Artificial Sequence
  Synthetic
cttccctccagacaccacgtcctcgcaaggagactccggggtggccccctcacaggagggctctggggattcacc

SEQ ID NO: 120780 - DNA, 75 bp, Artificial Sequence
  Synthetic
cttccctccagacaccacgtcctcgcaaggagactccggggtggccccctcacaggagggctctggggatccacc

SEQ ID NO: 120781 - DNA, 75 bp, Artificial Sequence
  Synthetic
cttccctccagacaccacgtcctcgcaaggagactccggggtggccccctcacaggagggctctggggatgcacc

SEQ ID NO: 120782 - DNA, 75 bp, Artificial Sequence
  Synthetic
cttccccccagacaccacgtcctcgcaaggagactccggggtggccccctcacaggagggctctggggatacacc

SEQ ID NO: 120783 - DNA, 75 bp, Artificial Sequence
  Synthetic
cttccccccagacaccacgtcctcgcaaggagactccggggtggccccctcacaggagggctctggggattcacc

SEQ ID NO: 120784 - DNA, 75 bp, Artificial Sequence
  Synthetic
cttccccccagacaccacgtcctcgcaaggagactccggggtggccccctcacaggagggctctggggatccacc

SEQ ID NO: 120785 - DNA, 75 bp, Artificial Sequence
  Synthetic
cttccccccagacaccacgtcctcgcaaggagactccggggtggccccctcacaggagggctctggggatgcacc

SEQ ID NO: 120786 - DNA, 75 bp, Artificial Sequence
  Synthetic
cttcccgccagacaccacgtcctcgcaaggagactccggggtggccccctcacaggagggctctggggatacacc

SEQ ID NO: 120787 - DNA, 75 bp, Artificial Sequence
  Synthetic
cttcccgccagacaccacgtcctcgcaaggagactccggggtggccccctcacaggagggctctggggattcacc

SEQ ID NO: 120788 - DNA, 75 bp, Artificial Sequence
  Synthetic
cttcccgccagacaccacgtcctcgcaaggagactccggggtggccccctcacaggagggctctggggatccacc

SEQ ID NO: 120789 - DNA, 75 bp, Artificial Sequence
  Synthetic
cttcccgccagacaccacgtcctcgcaaggagactccggggtggccccctcacaggagggctctggggatgcacc

SEQ ID NO: 120790 - DNA, 75 bp, Artificial Sequence
  Synthetic
gttcccaccagacaccacgtcctcgcaaggagactccggggtggccccctcacaggagggctctggggatacacc

SEQ ID NO: 120791 - DNA, 75 bp, Artificial Sequence
  Synthetic
gttcccaccagacaccacgtcctcgcaaggagactccggggtggccccctcacaggagggctctggggattcacc

SEQ ID NO: 120792 - DNA, 75 bp, Artificial Sequence
  Synthetic
gttcccaccagacaccacgtcctcgcaaggagactccggggtggccccctcacaggagggctctggggatccacc

SEQ ID NO: 120793 - DNA, 75 bp, Artificial Sequence
  Synthetic
gttcccaccagacaccacgtcctcgcaaggagactccggggtggccccctcacaggagggctctggggatgcacc

SEQ ID NO: 120794 - DNA, 75 bp, Artificial Sequence
  Synthetic
gttccctccagacaccacgtcctcgcaaggagactccggggtggccccctcacaggagggctctggggatacacc

SEQ ID NO: 120795 - DNA, 75 bp, Artificial Sequence
  Synthetic
gttccctccagacaccacgtcctcgcaaggagactccggggtggccccctcacaggagggctctggggattcacc

SEQ ID NO: 120796 - DNA, 75 bp, Artificial Sequence
  Synthetic
gttccctccagacaccacgtcctcgcaaggagactccggggtggccccctcacaggagggctctggggatccacc

SEQ ID NO: 120797 - DNA, 75 bp, Artificial Sequence
  Synthetic
gttccctccagacaccacgtcctcgcaaggagactccggggtggccccctcacaggagggctctggggatgcacc

SEQ ID NO: 120798 - DNA, 75 bp, Artificial Sequence
  Synthetic
gttccccccagacaccacgtcctcgcaaggagactccggggtggccccctcacaggagggctctggggatacacc

SEQ ID NO: 120799 - DNA, 75 bp, Artificial Sequence
  Synthetic
gttccccccagacaccacgtcctcgcaaggagactccggggtggccccctcacaggagggctctggggattcacc

SEQ ID NO: 120800 - DNA, 75 bp, Artificial Sequence
  Synthetic
gttccccccagacaccacgtcctcgcaaggagactccggggtggccccctcacaggagggctctggggatccacc

SEQ ID NO: 120801 - DNA, 75 bp, Artificial Sequence
  Synthetic
gttccccccagacaccacgtcctcgcaaggagactccggggtggccccctcacaggagggctctggggatgcacc

SEQ ID NO: 120802 - DNA, 75 bp, Artificial Sequence
  Synthetic
gttcccgccagacaccacgtcctcgcaaggagactccggggtggccccctcacaggagggctctggggatacacc

SEQ ID NO: 120803 - DNA, 75 bp, Artificial Sequence
  Synthetic
gttcccgccagacaccacgtcctcgcaaggagactccggggtggccccctcacaggagggctctggggattcacc

SEQ ID NO: 120804 - DNA, 75 bp, Artificial Sequence
  Synthetic
gttcccgccagacaccacgtcctcgcaaggagactccggggtggccccctcacaggagggctctggggatccacc

SEQ ID NO: 120805 - DNA, 75 bp, Artificial Sequence
  Synthetic
gttcccgccagacaccacgtcctcgcaaggagactccggggtggccccctcacaggagggctctggggatgcacc

SEQ ID NO: 120806 - DNA, 75 bp, Artificial Sequence
  Synthetic
tacttcgtcctcttcttcattgcagcctggcacatcaaaggccgcgcgatcccactaaccacctactctctcctg

SEQ ID NO: 120807 - DNA, 75 bp, Artificial Sequence
  Synthetic
acgcggggcgttgcaaaagcgctcgacttcgtaccggttgaaaatctggagaccacaatgcgctcgcccgtgttc

SEQ ID NO: 120808 - DNA, 75 bp, Artificial Sequence
  Synthetic
acgcggggcgttgcaaaagcgctcgacttcgtaccggttgataatctggagaccacaatgcgctcgcccgtgttc

SEQ ID NO: 120809 - DNA, 75 bp, Artificial Sequence
  Synthetic
acgcggggcgttgcaaaagcgctcgacttcgtaccggttgacaatctggagaccacaatgcgctcgcccgtgttc

SEQ ID NO: 120810 - DNA, 75 bp, Artificial Sequence
  Synthetic
acgcggggcgttgcaaaagcgctcgacttcgtaccggttgagaatctggagaccacaatgcgctcgcccgtgttc

SEQ ID NO: 120811 - DNA, 75 bp, Artificial Sequence
  Synthetic
acgcggggcgttgcaaaagcgctcgacttcgttccggttgaaaatctggagaccacaatgcgctcgcccgtgttc

SEQ ID NO: 120812 - DNA, 75 bp, Artificial Sequence
  Synthetic
acgcggggcgttgcaaaagcgctcgacttcgttccggttgataatctggagaccacaatgcgctcgcccgtgttc

SEQ ID NO: 120813 - DNA, 75 bp, Artificial Sequence
  Synthetic
acgcggggcgttgcaaaagcgctcgacttcgttccggttgacaatctggagaccacaatgcgctcgcccgtgttc

SEQ ID NO: 120814 - DNA, 75 bp, Artificial Sequence
  Synthetic
acgcggggcgttgcaaaagcgctcgacttcgttccggttgagaatctggagaccacaatgcgctcgcccgtgttc

SEQ ID NO: 120815 - DNA, 75 bp, Artificial Sequence
  Synthetic
acgcggggcgttgcaaaagcgctcgacttcgtcccggttgaaaatctggagaccacaatgcgctcgcccgtgttc

SEQ ID NO: 120816 - DNA, 75 bp, Artificial Sequence
  Synthetic
acgcggggcgttgcaaaagcgctcgacttcgtcccggttgataatctggagaccacaatgcgctcgcccgtgttc

SEQ ID NO: 120817 - DNA, 75 bp, Artificial Sequence
  Synthetic
acgcggggcgttgcaaaagcgctcgacttcgtcccggttgacaatctggagaccacaatgcgctcgcccgtgttc

SEQ ID NO: 120818 - DNA, 75 bp, Artificial Sequence
  Synthetic
acgcggggcgttgcaaaagcgctcgacttcgtcccggttgagaatctggagaccacaatgcgctcgcccgtgttc

SEQ ID NO: 120819 - DNA, 75 bp, Artificial Sequence
  Synthetic
acgcggggcgttgcaaaagcgctcgacttcgtgccggttgaaaatctggagaccacaatgcgctcgcccgtgttc

SEQ ID NO: 120820 - DNA, 75 bp, Artificial Sequence
  Synthetic
acgcggggcgttgcaaaagcgctcgacttcgtgccggttgataatctggagaccacaatgcgctcgcccgtgttc

SEQ ID NO: 120821 - DNA, 75 bp, Artificial Sequence
  Synthetic
acgcggggcgttgcaaaagcgctcgacttcgtgccggttgacaatctggagaccacaatgcgctcgcccgtgttc

SEQ ID NO: 120822 - DNA, 75 bp, Artificial Sequence
  Synthetic
acgcggggcgttgcaaaagcgctcgacttcgtgccggttgagaatctggagaccacaatgcgctcgcccgtgttc

SEQ ID NO: 120823 - DNA, 75 bp, Artificial Sequence
  Synthetic
acgcggggcgttgctaaagcgctcgacttcgtaccggttgaaaatctggagaccacaatgcgctcgcccgtgttc

SEQ ID NO: 120824 - DNA, 75 bp, Artificial Sequence
  Synthetic
acgcggggcgttgctaaagcgctcgacttcgtaccggttgataatctggagaccacaatgcgctcgcccgtgttc

SEQ ID NO: 120825 - DNA, 75 bp, Artificial Sequence
  Synthetic
acgcggggcgttgctaaagcgctcgacttcgtaccggttgacaatctggagaccacaatgcgctcgcccgtgttc

SEQ ID NO: 120826 - DNA, 75 bp, Artificial Sequence
  Synthetic
acgcggggcgttgctaaagcgctcgacttcgtaccggttgagaatctggagaccacaatgcgctcgcccgtgttc

SEQ ID NO: 120827 - DNA, 75 bp, Artificial Sequence
  Synthetic
acgcggggcgttgctaaagcgctcgacttcgttccggttgaaaatctggagaccacaatgcgctcgcccgtgttc

SEQ ID NO: 120828 - DNA, 75 bp, Artificial Sequence
  Synthetic
acgcggggcgttgctaaagcgctcgacttcgttccggttgataatctggagaccacaatgcgctcgcccgtgttc

SEQ ID NO: 120829 - DNA, 75 bp, Artificial Sequence
  Synthetic
acgcggggcgttgctaaagcgctcgacttcgttccggttgacaatctggagaccacaatgcgctcgcccgtgttc

SEQ ID NO: 120830 - DNA, 75 bp, Artificial Sequence
  Synthetic
acgcggggcgttgctaaagcgctcgacttcgttccggttgagaatctggagaccacaatgcgctcgcccgtgttc

SEQ ID NO: 120831 - DNA, 75 bp, Artificial Sequence
  Synthetic
acgcggggcgttgctaaagcgctcgacttcgtcccggttgaaaatctggagaccacaatgcgctcgcccgtgttc

SEQ ID NO: 120832 - DNA, 75 bp, Artificial Sequence
  Synthetic
acgcggggcgttgctaaagcgctcgacttcgtcccggttgataatctggagaccacaatgcgctcgcccgtgttc

SEQ ID NO: 120833 - DNA, 75 bp, Artificial Sequence
  Synthetic
acgcggggcgttgctaaagcgctcgacttcgtcccggttgacaatctggagaccacaatgcgctcgcccgtgttc

SEQ ID NO: 120834 - DNA, 75 bp, Artificial Sequence
  Synthetic
acgcggggcgttgctaaagcgctcgacttcgtcccggttgagaatctggagaccacaatgcgctcgcccgtgttc

SEQ ID NO: 120835 - DNA, 75 bp, Artificial Sequence
  Synthetic
acgcggggcgttgctaaagcgctcgacttcgtgccggttgaaaatctggagaccacaatgcgctcgcccgtgttc

SEQ ID NO: 120836 - DNA, 75 bp, Artificial Sequence
  Synthetic
acgcggggcgttgctaaagcgctcgacttcgtgccggttgataatctggagaccacaatgcgctcgcccgtgttc

SEQ ID NO: 120837 - DNA, 75 bp, Artificial Sequence
  Synthetic
acgcggggcgttgctaaagcgctcgacttcgtgccggttgacaatctggagaccacaatgcgctcgcccgtgttc

SEQ ID NO: 120838 - DNA, 75 bp, Artificial Sequence
  Synthetic
acgcggggcgttgctaaagcgctcgacttcgtgccggttgagaatctggagaccacaatgcgctcgcccgtgttc

SEQ ID NO: 120839 - DNA, 75 bp, Artificial Sequence
  Synthetic
acgcggggcgttgccaaagcgctcgacttcgtaccggttgaaaatctggagaccacaatgcgctcgcccgtgttc

SEQ ID NO: 120840 - DNA, 75 bp, Artificial Sequence
  Synthetic
acgcggggcgttgccaaagcgctcgacttcgtaccggttgataatctggagaccacaatgcgctcgcccgtgttc

SEQ ID NO: 120841 - DNA, 75 bp, Artificial Sequence
  Synthetic
acgcggggcgttgccaaagcgctcgacttcgtaccggttgacaatctggagaccacaatgcgctcgcccgtgttc

SEQ ID NO: 120842 - DNA, 75 bp, Artificial Sequence
  Synthetic
acgcggggcgttgccaaagcgctcgacttcgtaccggttgagaatctggagaccacaatgcgctcgcccgtgttc

SEQ ID NO: 120843 - DNA, 75 bp, Artificial Sequence
  Synthetic
acgcggggcgttgccaaagcgctcgacttcgttccggttgaaaatctggagaccacaatgcgctcgcccgtgttc

SEQ ID NO: 120844 - DNA, 75 bp, Artificial Sequence
  Synthetic
acgcggggcgttgccaaagcgctcgacttcgttccggttgataatctggagaccacaatgcgctcgcccgtgttc

SEQ ID NO: 120845 - DNA, 75 bp, Artificial Sequence
  Synthetic
acgcggggcgttgccaaagcgctcgacttcgttccggttgacaatctggagaccacaatgcgctcgcccgtgttc

SEQ ID NO: 120846 - DNA, 75 bp, Artificial Sequence
  Synthetic
acgcggggcgttgccaaagcgctcgacttcgttccggttgagaatctggagaccacaatgcgctcgcccgtgttc

SEQ ID NO: 120847 - DNA, 75 bp, Artificial Sequence
  Synthetic
acgcggggcgttgccaaagcgctcgacttcgtcccggttgaaaatctggagaccacaatgcgctcgcccgtgttc

SEQ ID NO: 120848 - DNA, 75 bp, Artificial Sequence
  Synthetic
acgcggggcgttgccaaagcgctcgacttcgtcccggttgataatctggagaccacaatgcgctcgcccgtgttc

SEQ ID NO: 120849 - DNA, 75 bp, Artificial Sequence
  Synthetic
acgcggggcgttgccaaagcgctcgacttcgtcccggttgacaatctggagaccacaatgcgctcgcccgtgttc

SEQ ID NO: 120850 - DNA, 75 bp, Artificial Sequence
  Synthetic
acgcggggcgttgccaaagcgctcgacttcgtcccggttgagaatctggagaccacaatgcgctcgcccgtgttc

SEQ ID NO: 120851 - DNA, 75 bp, Artificial Sequence
  Synthetic
acgcggggcgttgccaaagcgctcgacttcgtgccggttgaaaatctggagaccacaatgcgctcgcccgtgttc

SEQ ID NO: 120852 - DNA, 75 bp, Artificial Sequence
  Synthetic
acgcggggcgttgccaaagcgctcgacttcgtgccggttgataatctggagaccacaatgcgctcgcccgtgttc

SEQ ID NO: 120853 - DNA, 75 bp, Artificial Sequence
  Synthetic
acgcggggcgttgccaaagcgctcgacttcgtgccggttgacaatctggagaccacaatgcgctcgcccgtgttc

SEQ ID NO: 120854 - DNA, 75 bp, Artificial Sequence
  Synthetic
acgcggggcgttgccaaagcgctcgacttcgtgccggttgagaatctggagaccacaatgcgctcgcccgtgttc

SEQ ID NO: 120855 - DNA, 75 bp, Artificial Sequence
  Synthetic
acgcggggcgttgcgaaagcgctcgacttcgtaccggttgaaaatctggagaccacaatgcgctcgcccgtgttc

SEQ ID NO: 120856 - DNA, 75 bp, Artificial Sequence
  Synthetic
acgcggggcgttgcgaaagcgctcgacttcgtaccggttgataatctggagaccacaatgcgctcgcccgtgttc

SEQ ID NO: 120857 - DNA, 75 bp, Artificial Sequence
  Synthetic
acgcggggcgttgcgaaagcgctcgacttcgtaccggttgacaatctggagaccacaatgcgctcgcccgtgttc

SEQ ID NO: 120858 - DNA, 75 bp, Artificial Sequence
  Synthetic
acgcggggcgttgcgaaagcgctcgacttcgtaccggttgagaatctggagaccacaatgcgctcgcccgtgttc

SEQ ID NO: 120859 - DNA, 75 bp, Artificial Sequence
  Synthetic
acgcggggcgttgcgaaagcgctcgacttcgttccggttgaaaatctggagaccacaatgcgctcgcccgtgttc

SEQ ID NO: 120860 - DNA, 75 bp, Artificial Sequence
  Synthetic
acgcggggcgttgcgaaagcgctcgacttcgttccggttgataatctggagaccacaatgcgctcgcccgtgttc

SEQ ID NO: 120861 - DNA, 75 bp, Artificial Sequence
  Synthetic
acgcggggcgttgcgaaagcgctcgacttcgttccggttgacaatctggagaccacaatgcgctcgcccgtgttc

SEQ ID NO: 120862 - DNA, 75 bp, Artificial Sequence
  Synthetic
acgcggggcgttgcgaaagcgctcgacttcgttccggttgagaatctggagaccacaatgcgctcgcccgtgttc

SEQ ID NO: 120863 - DNA, 75 bp, Artificial Sequence
  Synthetic
acgcggggcgttgcgaaagcgctcgacttcgtcccggttgaaaatctggagaccacaatgcgctcgcccgtgttc

SEQ ID NO: 120864 - DNA, 75 bp, Artificial Sequence
  Synthetic
acgcggggcgttgcgaaagcgctcgacttcgtcccggttgataatctggagaccacaatgcgctcgcccgtgttc

SEQ ID NO: 120865 - DNA, 75 bp, Artificial Sequence
  Synthetic
acgcggggcgttgcgaaagcgctcgacttcgtcccggttgacaatctggagaccacaatgcgctcgcccgtgttc

SEQ ID NO: 120866 - DNA, 75 bp, Artificial Sequence
  Synthetic
acgcggggcgttgcgaaagcgctcgacttcgtcccggttgagaatctggagaccacaatgcgctcgcccgtgttc

SEQ ID NO: 120867 - DNA, 75 bp, Artificial Sequence
  Synthetic
acgcggggcgttgcgaaagcgctcgacttcgtgccggttgaaaatctggagaccacaatgcgctcgcccgtgttc

SEQ ID NO: 120868 - DNA, 75 bp, Artificial Sequence
  Synthetic
acgcggggcgttgcgaaagcgctcgacttcgtgccggttgataatctggagaccacaatgcgctcgcccgtgttc

SEQ ID NO: 120869 - DNA, 75 bp, Artificial Sequence
  Synthetic
acgcggggcgttgcgaaagcgctcgacttcgtgccggttgacaatctggagaccacaatgcgctcgcccgtgttc

SEQ ID NO: 120870 - DNA, 75 bp, Artificial Sequence
  Synthetic
acgcggggcgttgcgaaagcgctcgacttcgtgccggttgagaatctggagaccacaatgcgctcgcccgtgttc

SEQ ID NO: 120871 - DNA, 75 bp, Artificial Sequence
  Synthetic
gaggcaaaagaaagtcacatttgacaggcagcaggtcctggacgaccattaccgggacgtgctgaaggagatcaa

SEQ ID NO: 120872 - DNA, 75 bp, Artificial Sequence
  Synthetic
gggacgggaggtactattgggcccggccgatgattataaaacaatgggatggcggttgttatccccaatcacggc

SEQ ID NO: 120873 - DNA, 75 bp, Artificial Sequence
  Synthetic
tggtcaacagttagcgaggagggcgacagcgtcgtgtgctgctccatgtcctattcatggactggggcgcttgtc

SEQ ID NO: 120874 - DNA, 75 bp, Artificial Sequence
  Synthetic
tggtctacagttagcgaggagggcgacagcgtcgtgtgctgctccatgtcctattcatggactggggcgcttgtc

SEQ ID NO: 120875 - DNA, 75 bp, Artificial Sequence
  Synthetic
tggtccacagttagcgaggagggcgacagcgtcgtgtgctgctccatgtcctattcatggactggggcgcttgtc

SEQ ID NO: 120876 - DNA, 75 bp, Artificial Sequence
  Synthetic
tggtcgacagttagcgaggagggcgacagcgtcgtgtgctgctccatgtcctattcatggactggggcgcttgtc

SEQ ID NO: 120877 - DNA, 75 bp, Artificial Sequence
  Synthetic
acttcgtaccggttgaaaatctggagaccacaatgcgctcgcccgtgttcaccgacaacagcacaccccctgcgg

SEQ ID NO: 120878 - DNA, 75 bp, Artificial Sequence
  Synthetic
acttcgtaccggttgataatctggagaccacaatgcgctcgcccgtgttcaccgacaacagcacaccccctgcgg

SEQ ID NO: 120879 - DNA, 75 bp, Artificial Sequence
  Synthetic
acttcgtaccggttgacaatctggagaccacaatgcgctcgcccgtgttcaccgacaacagcacaccccctgcgg

SEQ ID NO: 120880 - DNA, 75 bp, Artificial Sequence
  Synthetic
acttcgtaccggttgagaatctggagaccacaatgcgctcgcccgtgttcaccgacaacagcacaccccctgcgg

SEQ ID NO: 120881 - DNA, 75 bp, Artificial Sequence
  Synthetic
acttcgttccggttgaaaatctggagaccacaatgcgctcgcccgtgttcaccgacaacagcacaccccctgcgg

SEQ ID NO: 120882 - DNA, 75 bp, Artificial Sequence
  Synthetic
acttcgttccggttgataatctggagaccacaatgcgctcgcccgtgttcaccgacaacagcacaccccctgcgg

SEQ ID NO: 120883 - DNA, 75 bp, Artificial Sequence
  Synthetic
acttcgttccggttgacaatctggagaccacaatgcgctcgcccgtgttcaccgacaacagcacaccccctgcgg

SEQ ID NO: 120884 - DNA, 75 bp, Artificial Sequence
  Synthetic
acttcgttccggttgagaatctggagaccacaatgcgctcgcccgtgttcaccgacaacagcacaccccctgcgg

SEQ ID NO: 120885 - DNA, 75 bp, Artificial Sequence
  Synthetic
acttcgtcccggttgaaaatctggagaccacaatgcgctcgcccgtgttcaccgacaacagcacaccccctgcgg

SEQ ID NO: 120886 - DNA, 75 bp, Artificial Sequence
  Synthetic
acttcgtcccggttgataatctggagaccacaatgcgctcgcccgtgttcaccgacaacagcacaccccctgcgg

SEQ ID NO: 120887 - DNA, 75 bp, Artificial Sequence
  Synthetic
acttcgtcccggttgacaatctggagaccacaatgcgctcgcccgtgttcaccgacaacagcacaccccctgcgg

SEQ ID NO: 120888 - DNA, 75 bp, Artificial Sequence
  Synthetic
acttcgtcccggttgagaatctggagaccacaatgcgctcgcccgtgttcaccgacaacagcacaccccctgcgg

SEQ ID NO: 120889 - DNA, 75 bp, Artificial Sequence
  Synthetic
acttcgtgccggttgaaaatctggagaccacaatgcgctcgcccgtgttcaccgacaacagcacaccccctgcgg

SEQ ID NO: 120890 - DNA, 75 bp, Artificial Sequence
  Synthetic
acttcgtgccggttgataatctggagaccacaatgcgctcgcccgtgttcaccgacaacagcacaccccctgcgg

SEQ ID NO: 120891 - DNA, 75 bp, Artificial Sequence
  Synthetic
acttcgtgccggttgacaatctggagaccacaatgcgctcgcccgtgttcaccgacaacagcacaccccctgcgg

SEQ ID NO: 120892 - DNA, 75 bp, Artificial Sequence
  Synthetic
acttcgtgccggttgagaatctggagaccacaatgcgctcgcccgtgttcaccgacaacagcacaccccctgcgg

SEQ ID NO: 120893 - DNA, 75 bp, Artificial Sequence
  Synthetic
cggggagctaaacactccaggccaataggccatcccctttttttttttttttttttttttttttttttttttttt

SEQ ID NO: 120894 - DNA, 75 bp, Artificial Sequence
  Synthetic
tcatatcaatcatgacacttaccccggcctataagatcttgctctgccgctgtctgtggtggctatgctacatgc

SEQ ID NO: 120895 - DNA, 75 bp, Artificial Sequence
  Synthetic
tcagctcattaactccaatggcagttggcacatcaaccgcactgctctgaactgccatgactccttgcaaactgg

SEQ ID NO: 120896 - DNA, 75 bp, Artificial Sequence
  Synthetic
aaggatgtccggagcctatccaggaaggccgttaaccacatccgctccgtgtgggaggacctcctggaagacaat

SEQ ID NO: 120897 - DNA, 75 bp, Artificial Sequence
  Synthetic
accactcagacctttctaggtacaactgtggggggggtcatgtggactgtctatcatggtgccgggtcaaggtcg

SEQ ID NO: 120898 - DNA, 75 bp, Artificial Sequence
  Synthetic
ctggcttgcgccagaagaaggtgacatttgaccgtctgcaagtcgtggaccagcattaccacgatgtcctcaagg

SEQ ID NO: 120899 - DNA, 75 bp, Artificial Sequence
  Synthetic
tggcacatcaaccgcactgctctgaactgccatgactccttgcaaactggcttcatcacggcactgttctacgcc

SEQ ID NO: 120900 - DNA, 75 bp, Artificial Sequence
  Synthetic
cgtggtgtttgagataaccaagtggctcttagctgttctcggatctgcctacctcctcaaggctgctttaacgcg

SEQ ID NO: 120901 - DNA, 75 bp, Artificial Sequence
  Synthetic
gattatgccagcgctccctgggctgcccttcatttcctgtcaaaagggatacaagggcgtgtggcggggggacgg

SEQ ID NO: 120902 - DNA, 75 bp, Artificial Sequence
  Synthetic
acctgggagtgcgcgtatgcgagaaagtggctctttatgacgtggtctctaccttgcctcaggccgtgatgggaa

SEQ ID NO: 120903 - DNA, 75 bp, Artificial Sequence
  Synthetic
gcacgtgcggctcctccgacttgtatctggtgacacgtgaagctgatgttataccggcgcgccgcagaggagaat

SEQ ID NO: 120904 - DNA, 75 bp, Artificial Sequence
  Synthetic
gcacgtgcggctcctccgacttgtatctggtgacacgtgaagctgatgttataccggcgcgccgcagaggagatt

SEQ ID NO: 120905 - DNA, 75 bp, Artificial Sequence
  Synthetic
gcacgtgcggctcctccgacttgtatctggtgacacgtgaagctgatgttataccggcgcgccgcagaggagact

SEQ ID NO: 120906 - DNA, 75 bp, Artificial Sequence
  Synthetic
gcacgtgcggctcctccgacttgtatctggtgacacgtgaagctgatgttataccggcgcgccgcagaggagagt

SEQ ID NO: 120907 - DNA, 75 bp, Artificial Sequence
  Synthetic
gcacgtgcggctcctccgacttgtatctggtgacacgtgaagctgatgttataccggcgcgccgcagaggtgaat

SEQ ID NO: 120908 - DNA, 75 bp, Artificial Sequence
  Synthetic
gcacgtgcggctcctccgacttgtatctggtgacacgtgaagctgatgttataccggcgcgccgcagaggtgatt

SEQ ID NO: 120909 - DNA, 75 bp, Artificial Sequence
  Synthetic
gcacgtgcggctcctccgacttgtatctggtgacacgtgaagctgatgttataccggcgcgccgcagaggtgact

SEQ ID NO: 120910 - DNA, 75 bp, Artificial Sequence
  Synthetic
gcacgtgcggctcctccgacttgtatctggtgacacgtgaagctgatgttataccggcgcgccgcagaggtgagt

SEQ ID NO: 120911 - DNA, 75 bp, Artificial Sequence
  Synthetic
gcacgtgcggctcctccgacttgtatctggtgacacgtgaagctgatgttataccggcgcgccgcagaggcgaat

SEQ ID NO: 120912 - DNA, 75 bp, Artificial Sequence
  Synthetic
gcacgtgcggctcctccgacttgtatctggtgacacgtgaagctgatgttataccggcgcgccgcagaggcgatt

SEQ ID NO: 120913 - DNA, 75 bp, Artificial Sequence
  Synthetic
gcacgtgcggctcctccgacttgtatctggtgacacgtgaagctgatgttataccggcgcgccgcagaggcgact

SEQ ID NO: 120914 - DNA, 75 bp, Artificial Sequence
  Synthetic
gcacgtgcggctcctccgacttgtatctggtgacacgtgaagctgatgttataccggcgcgccgcagaggcgagt

SEQ ID NO: 120915 - DNA, 75 bp, Artificial Sequence
  Synthetic
gcacgtgcggctcctccgacttgtatctggtgacacgtgaagctgatgttataccggcgcgccgcagaggggaat

SEQ ID NO: 120916 - DNA, 75 bp, Artificial Sequence
  Synthetic
gcacgtgcggctcctccgacttgtatctggtgacacgtgaagctgatgttataccggcgcgccgcagaggggatt

SEQ ID NO: 120917 - DNA, 75 bp, Artificial Sequence
  Synthetic
gcacgtgcggctcctccgacttgtatctggtgacacgtgaagctgatgttataccggcgcgccgcagaggggact

SEQ ID NO: 120918 - DNA, 75 bp, Artificial Sequence
  Synthetic
gcacgtgcggctcctccgacttgtatctggtgacacgtgaagctgatgttataccggcgcgccgcagaggggagt

SEQ ID NO: 120919 - DNA, 75 bp, Artificial Sequence
  Synthetic
cccttcatttcctgtcaaaagggatacaagggcgtgtggcggggggacggtgtgatgtcaacacgctgtccttgc

SEQ ID NO: 120920 - DNA, 75 bp, Artificial Sequence
  Synthetic
gccagcaaggccattaaccacatcaactccgtgtgggaggacttgctggaagacaattctacacccatccctaca

SEQ ID NO: 120921 - DNA, 75 bp, Artificial Sequence
  Synthetic
ggcagatacaccggcacgtacatctatgaccacctctcccccatgtctgactgggcagctgctggactgcgggac

SEQ ID NO: 120922 - DNA, 75 bp, Artificial Sequence
  Synthetic
ggcttcccgtgtgccaggaccatcttgaattttgggagggcgtcttcacgggtctcacccatatagacgcccact

SEQ ID NO: 120923 - DNA, 75 bp, Artificial Sequence
  Synthetic
ctgctttgactccacagtcactgagaatgatatccgtgttgaggagtccatttaccaatgctgtgacttggcccc

SEQ ID NO: 120924 - DNA, 75 bp, Artificial Sequence
  Synthetic
agcagctgtctgcaccagaggtgtcgcgaaggccctgcagtttgtgccagtagaggctttggcctctcaggtcag

SEQ ID NO: 120925 - DNA, 75 bp, Artificial Sequence
  Synthetic
cacacgcaagctgcctgaggcggttatggggtccgcttacggattccagtactcgcctaaagcgcgagtggatta

SEQ ID NO: 120926 - DNA, 75 bp, Artificial Sequence
  Synthetic
tacccgtttccgcacggttgggccgggaggtcctacttggccccgccgatgggtacacctccaaaggatggaagc

SEQ ID NO: 120927 - DNA, 75 bp, Artificial Sequence
  Synthetic
gggcgctgccagagctctggcacatggtgttagagtcctggaagacggcgtgaattacgcaacagggaacctccc

SEQ ID NO: 120928 - DNA, 75 bp, Artificial Sequence
  Synthetic
gtttgcccccactctgtgggtacggatggtcctcatgacccatttcttctccatactcatagcccaggagcacct

SEQ ID NO: 120929 - DNA, 75 bp, Artificial Sequence
  Synthetic
agttcaagtcctgtccacggtcacccagtctttcctcggaacaacaatatcaggggttctctggactgttttcca

SEQ ID NO: 120930 - DNA, 75 bp, Artificial Sequence
  Synthetic
gaacgactgttccaactcaagcattgtgtatgagacagcggacatgatcatgcacacccccgggtgcgtgccctg

SEQ ID NO: 120931 - DNA, 75 bp, Artificial Sequence
  Synthetic
catgcatctgcccgggtgtgtgccctacgtacgcgagggcaacgcctcgaggtgttgggtctcccttagtcccac

SEQ ID NO: 120932 - DNA, 75 bp, Artificial Sequence
  Synthetic
tcagctccgtcgttgaaggccacttgccagacgcataggcctcatccagacgctgagctagtggacgccaacttg

SEQ ID NO: 120933 - DNA, 75 bp, Artificial Sequence
  Synthetic
catgacatttaccagtgttgccagctagaccccacagcccgcaaggtcattacgtccctcacagagcgactgtat

SEQ ID NO: 120934 - DNA, 75 bp, Artificial Sequence
  Synthetic
tgtgatgagtgccacgctcaggatgccacctctatattgggcataggcacggtgctggaccaggcagagaccgct

SEQ ID NO: 120935 - DNA, 75 bp, Artificial Sequence
  Synthetic
gttttttaaaagcccaagctgcctgtcgggcagctaagcttaaagactatgacatgctggtctgcggagacgatt

SEQ ID NO: 120936 - DNA, 75 bp, Artificial Sequence
  Synthetic
tcgactcgattgtcggggccgctgcgttctgttcggctatgtatgtaggggacctatgcggctccatcttccttg

SEQ ID NO: 120937 - DNA, 75 bp, Artificial Sequence
  Synthetic
actgtgaggttgcgtgcttacctgaacacccccgggctccctgtctgtcaagaccatctggaattttgggagggg

SEQ ID NO: 120938 - DNA, 75 bp, Artificial Sequence
  Synthetic
accagatcctttgaaccttgcacctgtggggcagttgacctttaccttgtcaccaggaatgctgacgtcatccca

SEQ ID NO: 120939 - DNA, 75 bp, Artificial Sequence
  Synthetic
tcacggaggctatgactaggtattctgctcctccgggtgacccgcctcagccagagtacgacttggagctgataa

SEQ ID NO: 120940 - DNA, 75 bp, Artificial Sequence
  Synthetic
cgtgccgcactctaacattgaagaagtggccttaactaatgaaggagagatccccttttatggcaaggccctccc

SEQ ID NO: 120941 - DNA, 75 bp, Artificial Sequence
  Synthetic
tgcaattgctccatctacccaggccatgtgacaggtcatcgaatggcttgggacatgatgatgaattggtcaccc

SEQ ID NO: 120942 - DNA, 75 bp, Artificial Sequence
  Synthetic
cccacgcccggagtacgaccttgagctgatcacatcctgctcatcaaacgtatccgtagcctttgaccatactgg

SEQ ID NO: 120943 - DNA, 75 bp, Artificial Sequence
  Synthetic
acgccgtcgggattttccgggcggccgtgtgctccagaggggtggcaaagtccatcgacttcatccccatcgaat

SEQ ID NO: 120944 - DNA, 75 bp, Artificial Sequence
  Synthetic
ccactacgtgacgggcatgaccactgacaacgtaaaatgcccatgccaggttccggcccccgaattcttcacgga

SEQ ID NO: 120945 - DNA, 75 bp, Artificial Sequence
  Synthetic
gatgatcctaatgactcacttcttttctatcctcatggcccaggagcagcttgaacaggctctggactgtcagat

SEQ ID NO: 120946 - DNA, 75 bp, Artificial Sequence
  Synthetic
ggatatgatagctggtgcccactggggtgtcctagcgggcctggcatactactccatggtggggaactgggctaa

SEQ ID NO: 120947 - DNA, 75 bp, Artificial Sequence
  Synthetic
ggttcccttggctgcctattccctcaccggcctatgggccttctgcctactgctcctagcattgccccaacaggc

SEQ ID NO: 120948 - DNA, 75 bp, Artificial Sequence
  Synthetic
ctctggtgcctactcctactttcagtaggggtaggcatctatctccttcccaaccgataaacggttggatagcca

SEQ ID NO: 120949 - DNA, 75 bp, Artificial Sequence
  Synthetic
acagagatactactacctcacaagagacccaaccacaccaatagcgcgggcagcatgggaaactgcccgccacac

SEQ ID NO: 120950 - DNA, 75 bp, Artificial Sequence
  Synthetic
acagagatactactacctcacaagagacccaaccacaccaatagcgcgggcagcttgggaaactgcccgccacac

SEQ ID NO: 120951 - DNA, 75 bp, Artificial Sequence
  Synthetic
acagagatactactacctcacaagagacccaaccacaccaatagcgcgggcagcctgggaaactgcccgccacac

SEQ ID NO: 120952 - DNA, 75 bp, Artificial Sequence
  Synthetic
acagagatactactacctcacaagagacccaaccacaccaatagcgcgggcagcgtgggaaactgcccgccacac

SEQ ID NO: 120953 - DNA, 75 bp, Artificial Sequence
  Synthetic
tagtggaaagagcaccaaagtccccgcggcgtacgcggctcaggggtacaaagtgttggtacttaacccttctgt

SEQ ID NO: 120954 - DNA, 75 bp, Artificial Sequence
  Synthetic
gggcagataggtgcgactctgttgatattgatcaccctttttacactcaccccggggtataagaccctcctcagc

SEQ ID NO: 120955 - DNA, 75 bp, Artificial Sequence
  Synthetic
ttgattctgtaatagactgcaacgtagctgtagaacagtacgttgattttagtctggatcctaccttttccatcg

SEQ ID NO: 120956 - DNA, 75 bp, Artificial Sequence
  Synthetic
gccccaggcgctaagcaaaagatccagctcataaataccaacggcagctggcacatcaacagaactgccttgaac

SEQ ID NO: 120957 - DNA, 75 bp, Artificial Sequence
  Synthetic
tcagaaaacttggggtaccgcccttgcgagcctggagacatcgggccagaagtgttcgcgctaagctgctagccc

SEQ ID NO: 120958 - DNA, 75 bp, Artificial Sequence
  Synthetic
gaaacactccacagggtgcttgacttcgacatgtacggggtcacttactctgttgctcccttggatttgccagtg

SEQ ID NO: 120959 - DNA, 75 bp, Artificial Sequence
  Synthetic
acctactccacctatggcaaattcctcgcagacggaggctgctccggcggagcctatgacgtcataatatgcgac

SEQ ID NO: 120960 - DNA, 75 bp, Artificial Sequence
  Synthetic
ggctagcagggctgctctactaccacaagttcaactcctcagggtgtcccgagaggatggctagttgccaacctc

SEQ ID NO: 120961 - DNA, 75 bp, Artificial Sequence
  Synthetic
acgaggcacgtgccattgccggacaattcaaggagaaagtgctcggcctcattggcacggctggccagaaagctg

SEQ ID NO: 120962 - DNA, 75 bp, Artificial Sequence
  Synthetic
cacccttgagagcctggagacaaagggccagggcagtcagagctaagcttattgctcaaggagggaaagccgcta

SEQ ID NO: 120963 - DNA, 75 bp, Artificial Sequence
  Synthetic
cacccttgagagcctggagacaaagggccagggcagtcagagctaagcttattgctcaaggtgggaaagccgcta

SEQ ID NO: 120964 - DNA, 75 bp, Artificial Sequence
  Synthetic
cacccttgagagcctggagacaaagggccagggcagtcagagctaagcttattgctcaaggcgggaaagccgcta

SEQ ID NO: 120965 - DNA, 75 bp, Artificial Sequence
  Synthetic
cacccttgagagcctggagacaaagggccagggcagtcagagctaagcttattgctcaaggggggaaagccgcta

SEQ ID NO: 120966 - DNA, 75 bp, Artificial Sequence
  Synthetic
cacccttgagagcctggagacatagggccagggcagtcagagctaagcttattgctcaaggagggaaagccgcta

SEQ ID NO: 120967 - DNA, 75 bp, Artificial Sequence
  Synthetic
cacccttgagagcctggagacatagggccagggcagtcagagctaagcttattgctcaaggtgggaaagccgcta

SEQ ID NO: 120968 - DNA, 75 bp, Artificial Sequence
  Synthetic
cacccttgagagcctggagacatagggccagggcagtcagagctaagcttattgctcaaggcgggaaagccgcta

SEQ ID NO: 120969 - DNA, 75 bp, Artificial Sequence
  Synthetic
cacccttgagagcctggagacatagggccagggcagtcagagctaagcttattgctcaaggggggaaagccgcta

SEQ ID NO: 120970 - DNA, 75 bp, Artificial Sequence
  Synthetic
cacccttgagagcctggagacacagggccagggcagtcagagctaagcttattgctcaaggagggaaagccgcta

SEQ ID NO: 120971 - DNA, 75 bp, Artificial Sequence
  Synthetic
cacccttgagagcctggagacacagggccagggcagtcagagctaagcttattgctcaaggtgggaaagccgcta

SEQ ID NO: 120972 - DNA, 75 bp, Artificial Sequence
  Synthetic
cacccttgagagcctggagacacagggccagggcagtcagagctaagcttattgctcaaggcgggaaagccgcta

SEQ ID NO: 120973 - DNA, 75 bp, Artificial Sequence
  Synthetic
cacccttgagagcctggagacacagggccagggcagtcagagctaagcttattgctcaaggggggaaagccgcta

SEQ ID NO: 120974 - DNA, 75 bp, Artificial Sequence
  Synthetic
cacccttgagagcctggagacagagggccagggcagtcagagctaagcttattgctcaaggagggaaagccgcta

SEQ ID NO: 120975 - DNA, 75 bp, Artificial Sequence
  Synthetic
cacccttgagagcctggagacagagggccagggcagtcagagctaagcttattgctcaaggtgggaaagccgcta

SEQ ID NO: 120976 - DNA, 75 bp, Artificial Sequence
  Synthetic
cacccttgagagcctggagacagagggccagggcagtcagagctaagcttattgctcaaggcgggaaagccgcta

SEQ ID NO: 120977 - DNA, 75 bp, Artificial Sequence
  Synthetic
cacccttgagagcctggagacagagggccagggcagtcagagctaagcttattgctcaaggggggaaagccgcta

SEQ ID NO: 120978 - DNA, 75 bp, Artificial Sequence
  Synthetic
attgctcaaggagggaaagccgctacctgcggcaagtacctcttcaactgggcagtaaagacgaagctcaaactc

SEQ ID NO: 120979 - DNA, 75 bp, Artificial Sequence
  Synthetic
attgctcaaggtgggaaagccgctacctgcggcaagtacctcttcaactgggcagtaaagacgaagctcaaactc

SEQ ID NO: 120980 - DNA, 75 bp, Artificial Sequence
  Synthetic
attgctcaaggcgggaaagccgctacctgcggcaagtacctcttcaactgggcagtaaagacgaagctcaaactc

SEQ ID NO: 120981 - DNA, 75 bp, Artificial Sequence
  Synthetic
attgctcaaggggggaaagccgctacctgcggcaagtacctcttcaactgggcagtaaagacgaagctcaaactc

SEQ ID NO: 120982 - DNA, 75 bp, Artificial Sequence
  Synthetic
tgcccgtctgccaagaccatctggacttctgggagggcgtgttcactggattgacacacatagatgcccacttct

SEQ ID NO: 120983 - DNA, 75 bp, Artificial Sequence
  Synthetic
gatgcagctgctcgcgtcactgccatacttagcagcctcactgtgacccagctcctgaggcgactacaccagtgg

SEQ ID NO: 120984 - DNA, 75 bp, Artificial Sequence
  Synthetic
aaactctgaagccggcagccacgtctatgtggaacagggctgagcagttctgggcaaaacatatgtggaactttg

SEQ ID NO: 120985 - DNA, 75 bp, Artificial Sequence
  Synthetic
aaactctgaagccggcagccacgtctatgtggatcagggctgagcagttctgggcaaaacatatgtggaactttg

SEQ ID NO: 120986 - DNA, 75 bp, Artificial Sequence
  Synthetic
aaactctgaagccggcagccacgtctatgtggaccagggctgagcagttctgggcaaaacatatgtggaactttg

SEQ ID NO: 120987 - DNA, 75 bp, Artificial Sequence
  Synthetic
aaactctgaagccggcagccacgtctatgtggagcagggctgagcagttctgggcaaaacatatgtggaactttg

SEQ ID NO: 120988 - DNA, 75 bp, Artificial Sequence
  Synthetic
tgtcacaaacaaaacaacaaggtctcaacttcgcatacttggtagcgtatcaggccactgtctgtgcccgcgcgc

SEQ ID NO: 120989 - DNA, 75 bp, Artificial Sequence
  Synthetic
aggttggtggtcctggccacagcgaccccgccgggatcagtaacgactcctcacccaaacattgaagaggtggcc

SEQ ID NO: 120990 - DNA, 75 bp, Artificial Sequence
  Synthetic
cagagccggcgttcctacctacagatggggtgccaatgagacggatgtactgctcctcaacaactctaggccgcc

SEQ ID NO: 120991 - DNA, 75 bp, Artificial Sequence
  Synthetic
gccgtggccacgctaatgtccttcaccgctgcagtgacctccccccttacgacacaacagaccctcctctttaac

SEQ ID NO: 120992 - DNA, 75 bp, Artificial Sequence
  Synthetic
tcatcttcagtccgatggagaagaaagtcatcgtctggggggcggagacggccgcatgcggggacatcctacacg

SEQ ID NO: 120993 - DNA, 75 bp, Artificial Sequence
  Synthetic
atcttaggagggtgggtggcctcacaaatcgcgccacccacggccgccaccgcgttagtcgttagtggaatggcc

SEQ ID NO: 120994 - DNA, 75 bp, Artificial Sequence
  Synthetic
atcttaggagggtgggtggcctcacaaatcgcgccacccacggccgccaccgcgtttgtcgttagtggaatggcc

SEQ ID NO: 120995 - DNA, 75 bp, Artificial Sequence
  Synthetic
atcttaggagggtgggtggcctcacaaatcgcgccacccacggccgccaccgcgttcgtcgttagtggaatggcc

SEQ ID NO: 120996 - DNA, 75 bp, Artificial Sequence
  Synthetic
atcttaggagggtgggtggcctcacaaatcgcgccacccacggccgccaccgcgttggtcgttagtggaatggcc

SEQ ID NO: 120997 - DNA, 75 bp, Artificial Sequence
  Synthetic
atcttaggagggtgggtggcctcacatatcgcgccacccacggccgccaccgcgttagtcgttagtggaatggcc

SEQ ID NO: 120998 - DNA, 75 bp, Artificial Sequence
  Synthetic
atcttaggagggtgggtggcctcacatatcgcgccacccacggccgccaccgcgtttgtcgttagtggaatggcc

SEQ ID NO: 120999 - DNA, 75 bp, Artificial Sequence
  Synthetic
atcttaggagggtgggtggcctcacatatcgcgccacccacggccgccaccgcgttcgtcgttagtggaatggcc

SEQ ID NO: 121000 - DNA, 75 bp, Artificial Sequence
  Synthetic
atcttaggagggtgggtggcctcacatatcgcgccacccacggccgccaccgcgttggtcgttagtggaatggcc

SEQ ID NO: 121001 - DNA, 75 bp, Artificial Sequence
  Synthetic
atcttaggagggtgggtggcctcacacatcgcgccacccacggccgccaccgcgttagtcgttagtggaatggcc

SEQ ID NO: 121002 - DNA, 75 bp, Artificial Sequence
  Synthetic
atcttaggagggtgggtggcctcacacatcgcgccacccacggccgccaccgcgtttgtcgttagtggaatggcc

SEQ ID NO: 121003 - DNA, 75 bp, Artificial Sequence
  Synthetic
atcttaggagggtgggtggcctcacacatcgcgccacccacggccgccaccgcgttcgtcgttagtggaatggcc

SEQ ID NO: 121004 - DNA, 75 bp, Artificial Sequence
  Synthetic
atcttaggagggtgggtggcctcacacatcgcgccacccacggccgccaccgcgttggtcgttagtggaatggcc

SEQ ID NO: 121005 - DNA, 75 bp, Artificial Sequence
  Synthetic
atcttaggagggtgggtggcctcacagatcgcgccacccacggccgccaccgcgttagtcgttagtggaatggcc

SEQ ID NO: 121006 - DNA, 75 bp, Artificial Sequence
  Synthetic
atcttaggagggtgggtggcctcacagatcgcgccacccacggccgccaccgcgtttgtcgttagtggaatggcc

SEQ ID NO: 121007 - DNA, 75 bp, Artificial Sequence
  Synthetic
atcttaggagggtgggtggcctcacagatcgcgccacccacggccgccaccgcgttcgtcgttagtggaatggcc

SEQ ID NO: 121008 - DNA, 75 bp, Artificial Sequence
  Synthetic
atcttaggagggtgggtggcctcacagatcgcgccacccacggccgccaccgcgttggtcgttagtggaatggcc

SEQ ID NO: 121009 - DNA, 75 bp, Artificial Sequence
  Synthetic
atcttaggagggtgggtggcctctcaaatcgcgccacccacggccgccaccgcgttagtcgttagtggaatggcc

SEQ ID NO: 121010 - DNA, 75 bp, Artificial Sequence
  Synthetic
atcttaggagggtgggtggcctctcaaatcgcgccacccacggccgccaccgcgtttgtcgttagtggaatggcc

SEQ ID NO: 121011 - DNA, 75 bp, Artificial Sequence
  Synthetic
atcttaggagggtgggtggcctctcaaatcgcgccacccacggccgccaccgcgttcgtcgttagtggaatggcc

SEQ ID NO: 121012 - DNA, 75 bp, Artificial Sequence
  Synthetic
atcttaggagggtgggtggcctctcaaatcgcgccacccacggccgccaccgcgttggtcgttagtggaatggcc

SEQ ID NO: 121013 - DNA, 75 bp, Artificial Sequence
  Synthetic
atcttaggagggtgggtggcctctcatatcgcgccacccacggccgccaccgcgttagtcgttagtggaatggcc

SEQ ID NO: 121014 - DNA, 75 bp, Artificial Sequence
  Synthetic
atcttaggagggtgggtggcctctcatatcgcgccacccacggccgccaccgcgtttgtcgttagtggaatggcc

SEQ ID NO: 121015 - DNA, 75 bp, Artificial Sequence
  Synthetic
atcttaggagggtgggtggcctctcatatcgcgccacccacggccgccaccgcgttcgtcgttagtggaatggcc

SEQ ID NO: 121016 - DNA, 75 bp, Artificial Sequence
  Synthetic
atcttaggagggtgggtggcctctcatatcgcgccacccacggccgccaccgcgttggtcgttagtggaatggcc

SEQ ID NO: 121017 - DNA, 75 bp, Artificial Sequence
  Synthetic
atcttaggagggtgggtggcctctcacatcgcgccacccacggccgccaccgcgttagtcgttagtggaatggcc

SEQ ID NO: 121018 - DNA, 75 bp, Artificial Sequence
  Synthetic
atcttaggagggtgggtggcctctcacatcgcgccacccacggccgccaccgcgtttgtcgttagtggaatggcc

SEQ ID NO: 121019 - DNA, 75 bp, Artificial Sequence
  Synthetic
atcttaggagggtgggtggcctctcacatcgcgccacccacggccgccaccgcgttcgtcgttagtggaatggcc

SEQ ID NO: 121020 - DNA, 75 bp, Artificial Sequence
  Synthetic
atcttaggagggtgggtggcctctcacatcgcgccacccacggccgccaccgcgttggtcgttagtggaatggcc

SEQ ID NO: 121021 - DNA, 75 bp, Artificial Sequence
  Synthetic
atcttaggagggtgggtggcctctcagatcgcgccacccacggccgccaccgcgttagtcgttagtggaatggcc

SEQ ID NO: 121022 - DNA, 75 bp, Artificial Sequence
  Synthetic
atcttaggagggtgggtggcctctcagatcgcgccacccacggccgccaccgcgtttgtcgttagtggaatggcc

SEQ ID NO: 121023 - DNA, 75 bp, Artificial Sequence
  Synthetic
atcttaggagggtgggtggcctctcagatcgcgccacccacggccgccaccgcgttcgtcgttagtggaatggcc

SEQ ID NO: 121024 - DNA, 75 bp, Artificial Sequence
  Synthetic
atcttaggagggtgggtggcctctcagatcgcgccacccacggccgccaccgcgttggtcgttagtggaatggcc

SEQ ID NO: 121025 - DNA, 75 bp, Artificial Sequence
  Synthetic
atcttaggagggtgggtggcctcccaaatcgcgccacccacggccgccaccgcgttagtcgttagtggaatggcc

SEQ ID NO: 121026 - DNA, 75 bp, Artificial Sequence
  Synthetic
atcttaggagggtgggtggcctcccaaatcgcgccacccacggccgccaccgcgtttgtcgttagtggaatggcc

SEQ ID NO: 121027 - DNA, 75 bp, Artificial Sequence
  Synthetic
atcttaggagggtgggtggcctcccaaatcgcgccacccacggccgccaccgcgttcgtcgttagtggaatggcc

SEQ ID NO: 121028 - DNA, 75 bp, Artificial Sequence
  Synthetic
atcttaggagggtgggtggcctcccaaatcgcgccacccacggccgccaccgcgttggtcgttagtggaatggcc

SEQ ID NO: 121029 - DNA, 75 bp, Artificial Sequence
  Synthetic
atcttaggagggtgggtggcctcccatatcgcgccacccacggccgccaccgcgttagtcgttagtggaatggcc

SEQ ID NO: 121030 - DNA, 75 bp, Artificial Sequence
  Synthetic
atcttaggagggtgggtggcctcccatatcgcgccacccacggccgccaccgcgtttgtcgttagtggaatggcc

SEQ ID NO: 121031 - DNA, 75 bp, Artificial Sequence
  Synthetic
atcttaggagggtgggtggcctcccatatcgcgccacccacggccgccaccgcgttcgtcgttagtggaatggcc

SEQ ID NO: 121032 - DNA, 75 bp, Artificial Sequence
  Synthetic
atcttaggagggtgggtggcctcccatatcgcgccacccacggccgccaccgcgttggtcgttagtggaatggcc

SEQ ID NO: 121033 - DNA, 75 bp, Artificial Sequence
  Synthetic
atcttaggagggtgggtggcctcccacatcgcgccacccacggccgccaccgcgttagtcgttagtggaatggcc

SEQ ID NO: 121034 - DNA, 75 bp, Artificial Sequence
  Synthetic
atcttaggagggtgggtggcctcccacatcgcgccacccacggccgccaccgcgtttgtcgttagtggaatggcc

SEQ ID NO: 121035 - DNA, 75 bp, Artificial Sequence
  Synthetic
atcttaggagggtgggtggcctcccacatcgcgccacccacggccgccaccgcgttcgtcgttagtggaatggcc

SEQ ID NO: 121036 - DNA, 75 bp, Artificial Sequence
  Synthetic
atcttaggagggtgggtggcctcccacatcgcgccacccacggccgccaccgcgttggtcgttagtggaatggcc

SEQ ID NO: 121037 - DNA, 75 bp, Artificial Sequence
  Synthetic
atcttaggagggtgggtggcctcccagatcgcgccacccacggccgccaccgcgttagtcgttagtggaatggcc

SEQ ID NO: 121038 - DNA, 75 bp, Artificial Sequence
  Synthetic
atcttaggagggtgggtggcctcccagatcgcgccacccacggccgccaccgcgtttgtcgttagtggaatggcc

SEQ ID NO: 121039 - DNA, 75 bp, Artificial Sequence
  Synthetic
atcttaggagggtgggtggcctcccagatcgcgccacccacggccgccaccgcgttcgtcgttagtggaatggcc

SEQ ID NO: 121040 - DNA, 75 bp, Artificial Sequence
  Synthetic
atcttaggagggtgggtggcctcccagatcgcgccacccacggccgccaccgcgttggtcgttagtggaatggcc

SEQ ID NO: 121041 - DNA, 75 bp, Artificial Sequence
  Synthetic
atcttaggagggtgggtggcctcgcaaatcgcgccacccacggccgccaccgcgttagtcgttagtggaatggcc

SEQ ID NO: 121042 - DNA, 75 bp, Artificial Sequence
  Synthetic
atcttaggagggtgggtggcctcgcaaatcgcgccacccacggccgccaccgcgtttgtcgttagtggaatggcc

SEQ ID NO: 121043 - DNA, 75 bp, Artificial Sequence
  Synthetic
atcttaggagggtgggtggcctcgcaaatcgcgccacccacggccgccaccgcgttcgtcgttagtggaatggcc

SEQ ID NO: 121044 - DNA, 75 bp, Artificial Sequence
  Synthetic
atcttaggagggtgggtggcctcgcaaatcgcgccacccacggccgccaccgcgttggtcgttagtggaatggcc

SEQ ID NO: 121045 - DNA, 75 bp, Artificial Sequence
  Synthetic
atcttaggagggtgggtggcctcgcatatcgcgccacccacggccgccaccgcgttagtcgttagtggaatggcc

SEQ ID NO: 121046 - DNA, 75 bp, Artificial Sequence
  Synthetic
atcttaggagggtgggtggcctcgcatatcgcgccacccacggccgccaccgcgtttgtcgttagtggaatggcc

SEQ ID NO: 121047 - DNA, 75 bp, Artificial Sequence
  Synthetic
atcttaggagggtgggtggcctcgcatatcgcgccacccacggccgccaccgcgttcgtcgttagtggaatggcc

SEQ ID NO: 121048 - DNA, 75 bp, Artificial Sequence
  Synthetic
atcttaggagggtgggtggcctcgcatatcgcgccacccacggccgccaccgcgttggtcgttagtggaatggcc

SEQ ID NO: 121049 - DNA, 75 bp, Artificial Sequence
  Synthetic
atcttaggagggtgggtggcctcgcacatcgcgccacccacggccgccaccgcgttagtcgttagtggaatggcc

SEQ ID NO: 121050 - DNA, 75 bp, Artificial Sequence
  Synthetic
atcttaggagggtgggtggcctcgcacatcgcgccacccacggccgccaccgcgtttgtcgttagtggaatggcc

SEQ ID NO: 121051 - DNA, 75 bp, Artificial Sequence
  Synthetic
atcttaggagggtgggtggcctcgcacatcgcgccacccacggccgccaccgcgttcgtcgttagtggaatggcc

SEQ ID NO: 121052 - DNA, 75 bp, Artificial Sequence
  Synthetic
atcttaggagggtgggtggcctcgcacatcgcgccacccacggccgccaccgcgttggtcgttagtggaatggcc

SEQ ID NO: 121053 - DNA, 75 bp, Artificial Sequence
  Synthetic
atcttaggagggtgggtggcctcgcagatcgcgccacccacggccgccaccgcgttagtcgttagtggaatggcc

SEQ ID NO: 121054 - DNA, 75 bp, Artificial Sequence
  Synthetic
atcttaggagggtgggtggcctcgcagatcgcgccacccacggccgccaccgcgtttgtcgttagtggaatggcc

SEQ ID NO: 121055 - DNA, 75 bp, Artificial Sequence
  Synthetic
atcttaggagggtgggtggcctcgcagatcgcgccacccacggccgccaccgcgttcgtcgttagtggaatggcc

SEQ ID NO: 121056 - DNA, 75 bp, Artificial Sequence
  Synthetic
atcttaggagggtgggtggcctcgcagatcgcgccacccacggccgccaccgcgttggtcgttagtggaatggcc

SEQ ID NO: 121057 - DNA, 75 bp, Artificial Sequence
  Synthetic
tcaaaatgatgtctgcacctctcaccccgtcactaaatacatcatgacctgcatgtcagctgacttggaagtcac

SEQ ID NO: 121058 - DNA, 75 bp, Artificial Sequence
  Synthetic
ctgctgtgcccaacagattgcttccgtaaacatccggatgccacatacagcaggtgcggctctggtccctggctt

SEQ ID NO: 121059 - DNA, 75 bp, Artificial Sequence
  Synthetic
gactcaagtcgtagacttcagtttagaccccaccttcaccataaccactcaaactgtccctcaggacgccgtctc

SEQ ID NO: 121060 - DNA, 75 bp, Artificial Sequence
  Synthetic
tgtgcggggagaagccaacagccgaagacctagtaaacctcctaccatcaatactctgccctggggccttagtgg

SEQ ID NO: 121061 - DNA, 75 bp, Artificial Sequence
  Synthetic
tgtgcggggagaagccaacagccgaagacctagtaaacctccttccatcaatactctgccctggggccttagtgg

SEQ ID NO: 121062 - DNA, 75 bp, Artificial Sequence
  Synthetic
tgtgcggggagaagccaacagccgaagacctagtaaacctcctcccatcaatactctgccctggggccttagtgg

SEQ ID NO: 121063 - DNA, 75 bp, Artificial Sequence
  Synthetic
tgtgcggggagaagccaacagccgaagacctagtaaacctcctgccatcaatactctgccctggggccttagtgg

SEQ ID NO: 121064 - DNA, 75 bp, Artificial Sequence
  Synthetic
tgtgcggggagaagcctacagccgaagacctagtaaacctcctaccatcaatactctgccctggggccttagtgg

SEQ ID NO: 121065 - DNA, 75 bp, Artificial Sequence
  Synthetic
tgtgcggggagaagcctacagccgaagacctagtaaacctccttccatcaatactctgccctggggccttagtgg

SEQ ID NO: 121066 - DNA, 75 bp, Artificial Sequence
  Synthetic
tgtgcggggagaagcctacagccgaagacctagtaaacctcctcccatcaatactctgccctggggccttagtgg

SEQ ID NO: 121067 - DNA, 75 bp, Artificial Sequence
  Synthetic
tgtgcggggagaagcctacagccgaagacctagtaaacctcctgccatcaatactctgccctggggccttagtgg

SEQ ID NO: 121068 - DNA, 75 bp, Artificial Sequence
  Synthetic
tgtgcggggagaagcccacagccgaagacctagtaaacctcctaccatcaatactctgccctggggccttagtgg

SEQ ID NO: 121069 - DNA, 75 bp, Artificial Sequence
  Synthetic
tgtgcggggagaagcccacagccgaagacctagtaaacctccttccatcaatactctgccctggggccttagtgg

SEQ ID NO: 121070 - DNA, 75 bp, Artificial Sequence
  Synthetic
tgtgcggggagaagcccacagccgaagacctagtaaacctcctcccatcaatactctgccctggggccttagtgg

SEQ ID NO: 121071 - DNA, 75 bp, Artificial Sequence
  Synthetic
tgtgcggggagaagcccacagccgaagacctagtaaacctcctgccatcaatactctgccctggggccttagtgg

SEQ ID NO: 121072 - DNA, 75 bp, Artificial Sequence
  Synthetic
tgtgcggggagaagccgacagccgaagacctagtaaacctcctaccatcaatactctgccctggggccttagtgg

SEQ ID NO: 121073 - DNA, 75 bp, Artificial Sequence
  Synthetic
tgtgcggggagaagccgacagccgaagacctagtaaacctccttccatcaatactctgccctggggccttagtgg

SEQ ID NO: 121074 - DNA, 75 bp, Artificial Sequence
  Synthetic
tgtgcggggagaagccgacagccgaagacctagtaaacctcctcccatcaatactctgccctggggccttagtgg

SEQ ID NO: 121075 - DNA, 75 bp, Artificial Sequence
  Synthetic
tgtgcggggagaagccgacagccgaagacctagtaaacctcctgccatcaatactctgccctggggccttagtgg

SEQ ID NO: 121076 - DNA, 75 bp, Artificial Sequence
  Synthetic
ggcaagccagttcttgtccccgatagacaagtattgtaccaacaatatgatgagatggaagagtgctcccaagct

SEQ ID NO: 121077 - DNA, 75 bp, Artificial Sequence
  Synthetic
ggcgcgacaagacggaacaggccggggaaatccaggtcctgtccacggtcactcagtccttcctcggaacatcca

SEQ ID NO: 121078 - DNA, 75 bp, Artificial Sequence
  Synthetic
agacctagtaaacctcctaccatcaatactctgccctggggccttagtggttggggtcatatgcgccgcggttct

SEQ ID NO: 121079 - DNA, 75 bp, Artificial Sequence
  Synthetic
agacctagtaaacctccttccatcaatactctgccctggggccttagtggttggggtcatatgcgccgcggttct

SEQ ID NO: 121080 - DNA, 75 bp, Artificial Sequence
  Synthetic
agacctagtaaacctcctcccatcaatactctgccctggggccttagtggttggggtcatatgcgccgcggttct

SEQ ID NO: 121081 - DNA, 75 bp, Artificial Sequence
  Synthetic
agacctagtaaacctcctgccatcaatactctgccctggggccttagtggttggggtcatatgcgccgcggttct

SEQ ID NO: 121082 - DNA, 75 bp, Artificial Sequence
  Synthetic
ctctgtgagtgctacgatgctggcgcagcatggttcgagctcacgccggcggagaccaccgtaaggctacgggcg

SEQ ID NO: 121083 - DNA, 75 bp, Artificial Sequence
  Synthetic
aaccaacaacaagctgacatccagcccctgatgatgtccaattggcagaagctggaaggtttctggcacaagcat

SEQ ID NO: 121084 - DNA, 75 bp, Artificial Sequence
  Synthetic
caagtctggtctttaccacctgaccaatgattgccctaacagcagcatcgtgtatgaagcatcaactgttattat

SEQ ID NO: 121085 - DNA, 75 bp, Artificial Sequence
  Synthetic
agacaaaacaggcgggggagaattttccatacttgacggcctatcaagccactgtgtgcgctagggccaaagctc

SEQ ID NO: 121086 - DNA, 75 bp, Artificial Sequence
  Synthetic
gctcgcatttgtgcctgcttgtggatgatgcttctcatatctcaggtagaggcggcgctggagaacttgatagtt

SEQ ID NO: 121087 - DNA, 75 bp, Artificial Sequence
  Synthetic
tgatgcttctcatatctcaggtagaggcggcgctggagaacttgatagttctcaacgctgcttccctagtcggga

SEQ ID NO: 121088 - DNA, 75 bp, Artificial Sequence
  Synthetic
gagcggactagctggtgccgccgtgggtggcataggcttgggcagggtgctgcttgacatacttgcagggtacgg

SEQ ID NO: 121089 - DNA, 75 bp, Artificial Sequence
  Synthetic
tgcttgacatacttgcagggtacggggccggagtttctggtgctctagttgccttcaaaatcatgggcggggagg

SEQ ID NO: 121090 - DNA, 75 bp, Artificial Sequence
  Synthetic
tgcttgacatacttgcagggtacggggccggagtttctggtgctcttgttgccttcaaaatcatgggcggggagg

SEQ ID NO: 121091 - DNA, 75 bp, Artificial Sequence
  Synthetic
tgcttgacatacttgcagggtacggggccggagtttctggtgctctcgttgccttcaaaatcatgggcggggagg

SEQ ID NO: 121092 - DNA, 75 bp, Artificial Sequence
  Synthetic
tgcttgacatacttgcagggtacggggccggagtttctggtgctctggttgccttcaaaatcatgggcggggagg

SEQ ID NO: 121093 - DNA, 75 bp, Artificial Sequence
  Synthetic
tgaggtcacactcactcaccctgtgaccaaatacattgctacatgcatgcaagctgaccttgagatcatgaccag

SEQ ID NO: 121094 - DNA, 75 bp, Artificial Sequence
  Synthetic
actgctcctgcttctcctggcgttgccccaacgggcatacgccttggatcaggagttggccgcgtcgtgtggggc

SEQ ID NO: 121095 - DNA, 75 bp, Artificial Sequence
  Synthetic
acggtcattgctcccgacaaggagattctctacgaggcatttgatgagatggaggagtgcgcctctagagcagct

SEQ ID NO: 121096 - DNA, 75 bp, Artificial Sequence
  Synthetic
agtacatggcccgcggcatctggtggctgcagtacatgctgaccagagcagaggcgctcctacaggtttgggtcc

SEQ ID NO: 121097 - DNA, 75 bp, Artificial Sequence
  Synthetic
aggaccaggggagggtgcggtgcagtggatgaacaggctcatagcattcgcgtctcggggcaaccatgtatcacc

SEQ ID NO: 121098 - DNA, 75 bp, Artificial Sequence
  Synthetic
ggacctgatggttggcgccgctaccgtgtgttcagccctctacgttggagacctgtgcggggctgtgttcttggc

SEQ ID NO: 121099 - DNA, 75 bp, Artificial Sequence
  Synthetic
gtggcggcaccgtacctcaatgctccagttgactccctacggaggcacgtggacctgatggttggcgccgctacc

SEQ ID NO: 121100 - DNA, 75 bp, Artificial Sequence
  Synthetic
cgacggagtcgtactgctcacgtgtgtgctccacccgcacttgctctttgaaatcaccaagatcatgctggccat

SEQ ID NO: 121101 - DNA, 75 bp, Artificial Sequence
  Synthetic
agtgaggatccaccgtttcgcgccaccctgcagccccctcctaagggaggaggtctgcttctctgtggggttaca

SEQ ID NO: 121102 - DNA, 75 bp, Artificial Sequence
  Synthetic
agtgaggatccaccgtttcgcgccaccctgcagccccctcctaagggaggaggtctgcttctctgtggggtttca

SEQ ID NO: 121103 - DNA, 75 bp, Artificial Sequence
  Synthetic
agtgaggatccaccgtttcgcgccaccctgcagccccctcctaagggaggaggtctgcttctctgtggggttcca

SEQ ID NO: 121104 - DNA, 75 bp, Artificial Sequence
  Synthetic
agtgaggatccaccgtttcgcgccaccctgcagccccctcctaagggaggaggtctgcttctctgtggggttgca

SEQ ID NO: 121105 - DNA, 75 bp, Artificial Sequence
  Synthetic
tgtgaggatccaccgtttcgcgccaccctgcagccccctcctaagggaggaggtctgcttctctgtggggttaca

SEQ ID NO: 121106 - DNA, 75 bp, Artificial Sequence
  Synthetic
tgtgaggatccaccgtttcgcgccaccctgcagccccctcctaagggaggaggtctgcttctctgtggggtttca

SEQ ID NO: 121107 - DNA, 75 bp, Artificial Sequence
  Synthetic
tgtgaggatccaccgtttcgcgccaccctgcagccccctcctaagggaggaggtctgcttctctgtggggttcca

SEQ ID NO: 121108 - DNA, 75 bp, Artificial Sequence
  Synthetic
tgtgaggatccaccgtttcgcgccaccctgcagccccctcctaagggaggaggtctgcttctctgtggggttgca

SEQ ID NO: 121109 - DNA, 75 bp, Artificial Sequence
  Synthetic
cgtgaggatccaccgtttcgcgccaccctgcagccccctcctaagggaggaggtctgcttctctgtggggttaca

SEQ ID NO: 121110 - DNA, 75 bp, Artificial Sequence
  Synthetic
cgtgaggatccaccgtttcgcgccaccctgcagccccctcctaagggaggaggtctgcttctctgtggggtttca

SEQ ID NO: 121111 - DNA, 75 bp, Artificial Sequence
  Synthetic
cgtgaggatccaccgtttcgcgccaccctgcagccccctcctaagggaggaggtctgcttctctgtggggttcca

SEQ ID NO: 121112 - DNA, 75 bp, Artificial Sequence
  Synthetic
cgtgaggatccaccgtttcgcgccaccctgcagccccctcctaagggaggaggtctgcttctctgtggggttgca

SEQ ID NO: 121113 - DNA, 75 bp, Artificial Sequence
  Synthetic
ggtgaggatccaccgtttcgcgccaccctgcagccccctcctaagggaggaggtctgcttctctgtggggttaca

SEQ ID NO: 121114 - DNA, 75 bp, Artificial Sequence
  Synthetic
ggtgaggatccaccgtttcgcgccaccctgcagccccctcctaagggaggaggtctgcttctctgtggggtttca

SEQ ID NO: 121115 - DNA, 75 bp, Artificial Sequence
  Synthetic
ggtgaggatccaccgtttcgcgccaccctgcagccccctcctaagggaggaggtctgcttctctgtggggttcca

SEQ ID NO: 121116 - DNA, 75 bp, Artificial Sequence
  Synthetic
ggtgaggatccaccgtttcgcgccaccctgcagccccctcctaagggaggaggtctgcttctctgtggggttgca

SEQ ID NO: 121117 - DNA, 75 bp, Artificial Sequence
  Synthetic
tccaaacaacttggcccaagcttgaacaattctgggccaagcacatgtggaacttcatcagcggcattcagtacc

SEQ ID NO: 121118 - DNA, 75 bp, Artificial Sequence
  Synthetic
aggggctctcagcagaacctacagcttgtgaacaccaacggaagctggcatatcaacaggaccgccctaaactgt

SEQ ID NO: 121119 - DNA, 75 bp, Artificial Sequence
  Synthetic
tcgtgcgtgcccacggtctcattaggctctgcatgctggtgcgcaagacagcgggcggtcagtatgtgcagatgg

SEQ ID NO: 121120 - DNA, 75 bp, Artificial Sequence
  Synthetic
gaactggatctgcactgtgctcagtgatttcaaaaactggctttcatctaagatcatgcccaagctgccgggagt

SEQ ID NO: 121121 - DNA, 75 bp, Artificial Sequence
  Synthetic
gaactggatctgcactgtgctcagtgatttcaaaatctggctttcatctaagatcatgcccaagctgccgggagt

SEQ ID NO: 121122 - DNA, 75 bp, Artificial Sequence
  Synthetic
gaactggatctgcactgtgctcagtgatttcaaaacctggctttcatctaagatcatgcccaagctgccgggagt

SEQ ID NO: 121123 - DNA, 75 bp, Artificial Sequence
  Synthetic
gaactggatctgcactgtgctcagtgatttcaaaagctggctttcatctaagatcatgcccaagctgccgggagt

SEQ ID NO: 121124 - DNA, 75 bp, Artificial Sequence
  Synthetic
ccacgccccctgggtcggtgacaaccccccaccccaatatagaggaggtagccctcgggcaggagggtgagatcc

SEQ ID NO: 121125 - DNA, 75 bp, Artificial Sequence
  Synthetic
gacatgatgatgaactggagtcccaccgcgacgctgatcctcgcccagatcatgaggattcctgcagtcgtggta

SEQ ID NO: 121126 - DNA, 75 bp, Artificial Sequence
  Synthetic
gacatgatgatgaactggagtcccaccgcgacgctgatcctcgcccagatcatgaggattcctgcagtcgtggtt

SEQ ID NO: 121127 - DNA, 75 bp, Artificial Sequence
  Synthetic
gacatgatgatgaactggagtcccaccgcgacgctgatcctcgcccagatcatgaggattcctgcagtcgtggtc

SEQ ID NO: 121128 - DNA, 75 bp, Artificial Sequence
  Synthetic
gacatgatgatgaactggagtcccaccgcgacgctgatcctcgcccagatcatgaggattcctgcagtcgtggtg

SEQ ID NO: 121129 - DNA, 75 bp, Artificial Sequence
  Synthetic
tatcaacaggaccgccctaaactgtaatgacagcttacagacaggcttcattgcttccttgttttattacaacaa

SEQ ID NO: 121130 - DNA, 75 bp, Artificial Sequence
  Synthetic
cctgaacatcatggggggttggctggcttcacagattgctcccccagcgggggccactggcttcgttgtcagcgg

SEQ ID NO: 121131 - DNA, 75 bp, Artificial Sequence
  Synthetic
cgacgccactggaccactcaggagtgcaattgttccatctacgctgggcacatcacaggtcacagaatggcttgg

SEQ ID NO: 121132 - DNA, 75 bp, Artificial Sequence
  Synthetic
agtgcgacgagctcgcggcggcccttcggggcatgggcttgaacgcagtggcatattacagagggctggacgtct

SEQ ID NO: 121133 - DNA, 75 bp, Artificial Sequence
  Synthetic
cactgaacccgtcatcttctcccggatggaaatcaagactatcacctggggggcggatactgcggcttgtggaga

SEQ ID NO: 121134 - DNA, 75 bp, Artificial Sequence
  Synthetic
ctggagtggacgccgatacccacaccgtcgggggggccgcaggtcactccgtcgcaacctttgccaacctgttca

SEQ ID NO: 121135 - DNA, 75 bp, Artificial Sequence
  Synthetic
catcatcaacgggctgcctgtttccgcccggagagggagagaggtgttgctgggaccagccgatgccctgactga

SEQ ID NO: 121136 - DNA, 75 bp, Artificial Sequence
  Synthetic
gggagacagccagacacactccagttaactcctggctaggcaacatcatcatgtacgcgcccactttgtgggcaa

SEQ ID NO: 121137 - DNA, 75 bp, Artificial Sequence
  Synthetic
aagatcatgtctggcgaaaaacccaccatggaggatgtagtcaacctactgcccgccatcctttctcccggcgcc

SEQ ID NO: 121138 - DNA, 75 bp, Artificial Sequence
  Synthetic
tcctgctggagagcttacgaccgcccaagggtggttggtatggttgcacctggatgaatgccaccgggttcgtaa

SEQ ID NO: 121139 - DNA, 75 bp, Artificial Sequence
  Synthetic
catagctggcttgctctacgcccacaagtttaacagctctgggtgccccgaaagactcgccagctgcaaaaaact

SEQ ID NO: 121140 - DNA, 75 bp, Artificial Sequence
  Synthetic
cagcctcaccggtcgggacaaaaatcaagtggagggggaagtccagattgtgtctaccgcaacccagacgttctt

SEQ ID NO: 121141 - DNA, 75 bp, Artificial Sequence
  Synthetic
cgggccttccgcctgtcccacctccgcggaggaagaagaagccaatagaactatctgactctaccgtgtcccaag

SEQ ID NO: 121142 - DNA, 75 bp, Artificial Sequence
  Synthetic
cgggccttccgcctgtcccacctccgcggaggaagatgaagccaatagaactatctgactctaccgtgtcccaag

SEQ ID NO: 121143 - DNA, 75 bp, Artificial Sequence
  Synthetic
cgggccttccgcctgtcccacctccgcggaggaagacgaagccaatagaactatctgactctaccgtgtcccaag

SEQ ID NO: 121144 - DNA, 75 bp, Artificial Sequence
  Synthetic
cgggccttccgcctgtcccacctccgcggaggaagaggaagccaatagaactatctgactctaccgtgtcccaag

SEQ ID NO: 121145 - DNA, 75 bp, Artificial Sequence
  Synthetic
acgggtaggggacgattgggcatttataggtatgtttctactggtgagcgagcctcaggaatgtttgatagtgta

SEQ ID NO: 121146 - DNA, 75 bp, Artificial Sequence
  Synthetic
gaggaaaccacgttgccccgacccactacgtgactgaatcggacgcatcgcagcgtgtcacacagctgcttggct

SEQ ID NO: 121147 - DNA, 75 bp, Artificial Sequence
  Synthetic
aacaccactttgacatgtcccaccgattgcttccgaaaacatccggaggcaacgtatgctaggtgtggttcgggc

SEQ ID NO: 121148 - DNA, 75 bp, Artificial Sequence
  Synthetic
aggatcccaactgccatgcgagcctgagccagacgtctcggtgctgacctcaatgttgcgagacccctcccacat

SEQ ID NO: 121149 - DNA, 75 bp, Artificial Sequence
  Synthetic
gtggtgtcggcatccaaggtgtgcggccccgtgtactgcttcacgcctagccctgtggttgtcgggacgaccaac

SEQ ID NO: 121150 - DNA, 75 bp, Artificial Sequence
  Synthetic
ccctgtgatccagatgtacactaatgtggaccaggatttggtgggctggccagcgcctcagggagcgcgctccct

SEQ ID NO: 121151 - DNA, 75 bp, Artificial Sequence
  Synthetic
cacggcctattcccaacagacgcggggcctgcttggctgtatcatcactagcctcacaggccgggacaagaacca

SEQ ID NO: 121152 - DNA, 75 bp, Artificial Sequence
  Synthetic
ggtttgctcgatcctgacagattttaagaactggctgtcctccaaactgttcccaaagatgccgggcatcccctt

SEQ ID NO: 121153 - DNA, 75 bp, Artificial Sequence
  Synthetic
tgctccgctgaggaggagaaactacctatcaatcctttaagcaacaccctattgcgccaccacaaacttgtgtac

SEQ ID NO: 121154 - DNA, 75 bp, Artificial Sequence
  Synthetic
tgctccgctgaggaggagaaactacctatcaatcctttaagcaacaccctattgcgccaccacaatcttgtgtac

SEQ ID NO: 121155 - DNA, 75 bp, Artificial Sequence
  Synthetic
tgctccgctgaggaggagaaactacctatcaatcctttaagcaacaccctattgcgccaccacaaccttgtgtac

SEQ ID NO: 121156 - DNA, 75 bp, Artificial Sequence
  Synthetic
tgctccgctgaggaggagaaactacctatcaatcctttaagcaacaccctattgcgccaccacaagcttgtgtac

SEQ ID NO: 121157 - DNA, 75 bp, Artificial Sequence
  Synthetic
ggatgaacgggactgggttcacgaagacgtgcggcggccctccatgtggtgtgcgcaccagcaaccaaacatggt

SEQ ID NO: 121158 - DNA, 75 bp, Artificial Sequence
  Synthetic
gctttggcggcaggaaatgggcagcaacatcacccgggtggagtctgagacaaaggtggtaattcttgattcatt

SEQ ID NO: 121159 - DNA, 75 bp, Artificial Sequence
  Synthetic
cccctcccccgtcctgggacgtcatgtggaagtgcttgactcgactcaagcccacgctcgtgggccccacgcctc

SEQ ID NO: 121160 - DNA, 75 bp, Artificial Sequence
  Synthetic
gggttgagatgagtccgctcctcttctccacaacggagctatcaatcctcccatgttcattcacgacgatgccag

SEQ ID NO: 121161 - DNA, 75 bp, Artificial Sequence
  Synthetic
ggcaccatgagaataacaggtcccaagacctgcatgaacacctggcaggggaccttccccatcaactgctacact

SEQ ID NO: 121162 - DNA, 75 bp, Artificial Sequence
  Synthetic
gacgtgcggcggccctccatgtggtgtgcgcaccagcaaccaaacatggtactgccccaccgattgcttcaggaa

SEQ ID NO: 121163 - DNA, 75 bp, Artificial Sequence
  Synthetic
attgcttcaagaaaccgcccaagtatcctcctgcccttcctatctgggctagacctgactataacccaccattga

SEQ ID NO: 121164 - DNA, 75 bp, Artificial Sequence
  Synthetic
gacgattggcttccaaggtcaaggctggactactgtccctagaggaagcttgcaagttaacaccaccccattccg

SEQ ID NO: 121165 - DNA, 75 bp, Artificial Sequence
  Synthetic
tctccccggccaatttcatatctaaagggatcctcgggaggccccctgctctgtcccatgggacatgccgtgggc

SEQ ID NO: 121166 - DNA, 75 bp, Artificial Sequence
  Synthetic
catacgtgacggggttgacaacagacaatctaaaagtcccctgtcaggtgccattacctgaattcttctcttggg

SEQ ID NO: 121167 - DNA, 75 bp, Artificial Sequence
  Synthetic
ccctctgctactttccaccactcagtggcaggtgctcccctgctccttcacgaccatgccagctctctcaacagg

SEQ ID NO: 121168 - DNA, 75 bp, Artificial Sequence
  Synthetic
gtgctttgtgttcgtgtgttgtgcctggtacatcaaaggccgcttggtccccgccgctacctatggacttctggg

SEQ ID NO: 121169 - DNA, 75 bp, Artificial Sequence
  Synthetic
gacaattcagcttgatggatcgaacgtatctgcagcgctccgagcgcttgcagagaaatcctttccgtcatctgg

SEQ ID NO: 121170 - DNA, 75 bp, Artificial Sequence
  Synthetic
gacatttcagcttgatggatcgaacgtatctgcagcgctccgagcgcttgcagagaaatcctttccgtcatctgg

SEQ ID NO: 121171 - DNA, 75 bp, Artificial Sequence
  Synthetic
gacacttcagcttgatggatcgaacgtatctgcagcgctccgagcgcttgcagagaaatcctttccgtcatctgg

SEQ ID NO: 121172 - DNA, 75 bp, Artificial Sequence
  Synthetic
gacagttcagcttgatggatcgaacgtatctgcagcgctccgagcgcttgcagagaaatcctttccgtcatctgg

SEQ ID NO: 121173 - DNA, 75 bp, Artificial Sequence
  Synthetic
tggcaggtgctcccctgctccttcacgaccatgccagctctctcaacaggcctgatccatcttcaccagaacatc

SEQ ID NO: 121174 - DNA, 75 bp, Artificial Sequence
  Synthetic
tcggctcccatgtgagcccgagccggacgcggaggttctggcgtccatgctaactgacccctcccaaatcacggc

SEQ ID NO: 121175 - DNA, 75 bp, Artificial Sequence
  Synthetic
tcggctcccatgtgagcccgagccggacgcggaggttctggcgtccatgctaactgacccctcccatatcacggc

SEQ ID NO: 121176 - DNA, 75 bp, Artificial Sequence
  Synthetic
tcggctcccatgtgagcccgagccggacgcggaggttctggcgtccatgctaactgacccctcccacatcacggc

SEQ ID NO: 121177 - DNA, 75 bp, Artificial Sequence
  Synthetic
tcggctcccatgtgagcccgagccggacgcggaggttctggcgtccatgctaactgacccctcccagatcacggc

SEQ ID NO: 121178 - DNA, 75 bp, Artificial Sequence
  Synthetic
tcataatatgtgacgaatgtcactcagtggacgccacctcgattctaggcatagggactgtcttggaccaagcgg

SEQ ID NO: 121179 - DNA, 75 bp, Artificial Sequence
  Synthetic
tgctcgtccatgccccccctcgagggggagccaggcgacccggacttgagttgtgactcctggtccaccgtcagc

SEQ ID NO: 121180 - DNA, 75 bp, Artificial Sequence
  Synthetic
gcatttttgctgctcgcagatgccaggatctgtgcgtgcctctggatgatgctgctggtctcgcaagtcgaggca

SEQ ID NO: 121181 - DNA, 75 bp, Artificial Sequence
  Synthetic
ggcccattggggcatcttggcgggcctagcctattactccatgcagggcaactgggccaaggtcgctatcatcat

SEQ ID NO: 121182 - DNA, 75 bp, Artificial Sequence
  Synthetic
acccacgctagagactacaacattgacatggtggatgctaatctcttcatgggtagcagtgtgactcggatagag

SEQ ID NO: 121183 - DNA, 75 bp, Artificial Sequence
  Synthetic
gaggccattacgtgcagatggtcatcatcaagttaggggcgcttactggcacctatgtttataaccatctcactc

SEQ ID NO: 121184 - DNA, 75 bp, Artificial Sequence
  Synthetic
ctagcctattactccatgcagggcaactgggccaaggtcgctatcatcatggttatgttttcaggggtcgatgcc

SEQ ID NO: 121185 - DNA, 75 bp, Artificial Sequence
  Synthetic
gcagactccctgccgctgccgcttatgtggcttgtggaatgtggcccctgctcctcctgctccttgcattgcccg

SEQ ID NO: 121186 - DNA, 75 bp, Artificial Sequence
  Synthetic
cgggggccaccggcttcgtcgtcagcggcctggtgggggctgccgtgggcagcataggcttgggtaaggtgctgg

SEQ ID NO: 121187 - DNA, 75 bp, Artificial Sequence
  Synthetic
ttggattcgacgtcactaaagtgcttctggcaatcattggccccctctaccttctgcaggccagcctcttgcatg

SEQ ID NO: 121188 - DNA, 75 bp, Artificial Sequence
  Synthetic
aaaggtttcccgcacccctgccagtctgggcgcagcctcagtacaatccgccgctcatgccggcatggcaaagcc

SEQ ID NO: 121189 - DNA, 75 bp, Artificial Sequence
  Synthetic
ggcatggacaggtacctacatttatgatcatctagcacctcttaagacctgggccagcgacggcttacgtgacct

SEQ ID NO: 121190 - DNA, 75 bp, Artificial Sequence
  Synthetic
gttggcatgggggttgtggtggatgcagtatttcattgccagagcggaagcacttctccacgtatatattccatc

SEQ ID NO: 121191 - DNA, 75 bp, Artificial Sequence
  Synthetic
gttggcatgggggttgtggtggatgcagtatttcattgccagagcggaagctcttctccacgtatatattccatc

SEQ ID NO: 121192 - DNA, 75 bp, Artificial Sequence
  Synthetic
gttggcatgggggttgtggtggatgcagtatttcattgccagagcggaagcccttctccacgtatatattccatc

SEQ ID NO: 121193 - DNA, 75 bp, Artificial Sequence
  Synthetic
gttggcatgggggttgtggtggatgcagtatttcattgccagagcggaagcgcttctccacgtatatattccatc

SEQ ID NO: 121194 - DNA, 75 bp, Artificial Sequence
  Synthetic
ccattgagacgacgactgtgccccaagacgcggtgtcgcgctcgcagcggcgaggcaggactggcaggggcagga

SEQ ID NO: 121195 - DNA, 75 bp, Artificial Sequence
  Synthetic
ttctcgcctatggagaagaaggtcatcacatggggggcagacacggctgcgtgtggcgacatactggccggcttg

SEQ ID NO: 121196 - DNA, 75 bp, Artificial Sequence
  Synthetic
gagtaatgtgggagaggcgctcatggagctagctgtcaaaagctttggtcaggcacccaccagcggtgattctgg

SEQ ID NO: 121197 - DNA, 75 bp, Artificial Sequence
  Synthetic
aggacttgctggaagacactattacaccaattcctactaccatcatggcgaagaacgaggtgtttagcgtgaacc

SEQ ID NO: 121198 - DNA, 75 bp, Artificial Sequence
  Synthetic
ggagaggtagaaccggtcgggggaagcatggtatctacagatatgtgtcacccggggagcggccgtctggcatgt

SEQ ID NO: 121199 - DNA, 75 bp, Artificial Sequence
  Synthetic
gcatggtatctacagatatgtgtcacccggggagcggccgtctggcatgtttgactccgtggtcctctgtgagtg

SEQ ID NO: 121200 - DNA, 75 bp, Artificial Sequence
  Synthetic
tcgcctaattgtctaccctgacctgggggtacgagtctgtgagaaacgtgccctgtatgacgtgatacagaaact

SEQ ID NO: 121201 - DNA, 75 bp, Artificial Sequence
  Synthetic
ggccccctctatgtgctccaagcttcgctcttgcgagtcccttactttgtgagggcacacgctctgatcaagctc

SEQ ID NO: 121202 - DNA, 75 bp, Artificial Sequence
  Synthetic
tcacatggggggcagacacggctgcgtgtggcgacatactggccggcttgcccgtctccgctcggcggggtaaat

SEQ ID NO: 121203 - DNA, 75 bp, Artificial Sequence
  Synthetic
gagggggaggcgggggacccggacctggagctcgtgccagtcgaagcccagccccctccttcggaggaggaggtg

SEQ ID NO: 121204 - DNA, 75 bp, Artificial Sequence
  Synthetic
gagacagatgtgttcctgctggagtccctgcggcctcccagtggtcggtggtttgggtgcgcgtggatgaactcc

SEQ ID NO: 121205 - DNA, 75 bp, Artificial Sequence
  Synthetic
cacttggagttttgggagagcgtcttcaccggcctcacccacatagatgcccacttcctgtctcagacgaaacag

SEQ ID NO: 121206 - DNA, 75 bp, Artificial Sequence
  Synthetic
cagcgtactgcagagccaggagcaactggaaaaagccctagcatttgaaatgtatgggtcagtctactctgtcac

SEQ ID NO: 121207 - DNA, 75 bp, Artificial Sequence
  Synthetic
gtttgggtgcgcgtggatgaactccacggggttcctcaagacgtgcggagctcccccttgtaacatctatggggg

SEQ ID NO: 121208 - DNA, 75 bp, Artificial Sequence
  Synthetic
cgctgtcggactgggccgccgacggccttagcgatttagcggtggcgctcgagccagtcatatttacaccaatgg

SEQ ID NO: 121209 - DNA, 75 bp, Artificial Sequence
  Synthetic
tcgcataccaagccaccgtgtgcgctagagctaaagctcctcccccgtcatgggaccaaatgtggaagtgcttga

SEQ ID NO: 121210 - DNA, 75 bp, Artificial Sequence
  Synthetic
cacctaactgccccgaggaggaaaagttaccaatcaatcccttgagcaattcgctgctgcgataccacaacaaag

SEQ ID NO: 121211 - DNA, 75 bp, Artificial Sequence
  Synthetic
cagccggtgtggtgcagggccctggttgacaccccgttgcatggtcgactacccataccggctttggcactaccc

SEQ ID NO: 121212 - DNA, 75 bp, Artificial Sequence
  Synthetic
cccagctgatacggaggtagagaaggggtggagactccttgcccccattaccgcatacgcgcagcagactcgagg

SEQ ID NO: 121213 - DNA, 75 bp, Artificial Sequence
  Synthetic
ctaaaacctgtatgaacacctggcaggggacctttcctatcaattgttacacggagggccagtgcgtgccgaaac

SEQ ID NO: 121214 - DNA, 75 bp, Artificial Sequence
  Synthetic
gtggatatcgccgatgccgtgccagtggcgtgttgcctaccagcttcggtaatacaatcacctgttacatcaagg

SEQ ID NO: 121215 - DNA, 75 bp, Artificial Sequence
  Synthetic
gtggatatcgccgttgccgtgccagtggcgtgttgcctaccagcttcggtaatacaatcacctgttacatcaagg

SEQ ID NO: 121216 - DNA, 75 bp, Artificial Sequence
  Synthetic
gtggatatcgccgctgccgtgccagtggcgtgttgcctaccagcttcggtaatacaatcacctgttacatcaagg

SEQ ID NO: 121217 - DNA, 75 bp, Artificial Sequence
  Synthetic
gtggatatcgccggtgccgtgccagtggcgtgttgcctaccagcttcggtaatacaatcacctgttacatcaagg

SEQ ID NO: 121218 - DNA, 75 bp, Artificial Sequence
  Synthetic
actccacctacggcaagtttcttgccgacggtgggtgctcggggggcgcttatgacataataatttgtgacgagt

SEQ ID NO: 121219 - DNA, 75 bp, Artificial Sequence
  Synthetic
catggcttgtatgtcggctgacctggaggtcgtcactagcacgtgggtgctggtgggcggcgtcctggccgcttt

SEQ ID NO: 121220 - DNA, 75 bp, Artificial Sequence
  Synthetic
ggggacctttcctatcaattgttacacggagggccagtgcgtgccgaaacccgcgccaaacttcaagaccgccat

SEQ ID NO: 121221 - DNA, 75 bp, Artificial Sequence
  Synthetic
tataccaatgttgaccaggatctggtaggatggccagctcccccgggtgccaggtctctgacgccgtgcacgtgt

SEQ ID NO: 121222 - DNA, 75 bp, Artificial Sequence
  Synthetic
ccactctcaagggctcatccggcggaccgctaatgtgttcggcaggtcacgttgtcggactattccgcgccgccg

SEQ ID NO: 121223 - DNA, 75 bp, Artificial Sequence
  Synthetic
ttcgcagcgggccaaaaaggtgactttcgacagggtgcaatcactcgactctcactatgactcagtgctaaagga

SEQ ID NO: 121224 - DNA, 75 bp, Artificial Sequence
  Synthetic
caaagtagccctgagagccttcacggaggctatgaccaggtactctgccccccccggtgacgcgccacagcccac

SEQ ID NO: 121225 - DNA, 75 bp, Artificial Sequence
  Synthetic
actgcgatcaacggtgtcatgtggacggtttatcatggggctggcagtaagaccatcagcggccccaagggacca

SEQ ID NO: 121226 - DNA, 75 bp, Artificial Sequence
  Synthetic
gagtttgatgagatggaagagtgcgccgcccacatcccctaccttgagcaggggatgcatttggctgaacagttc

SEQ ID NO: 121227 - DNA, 75 bp, Artificial Sequence
  Synthetic
cgccgtaccacaaacctatcaggttggatacctccatgctccaacaggcagtgggaagagcacgaaagtgccggc

SEQ ID NO: 121228 - DNA, 75 bp, Artificial Sequence
  Synthetic
ttgggcttaattcatttgtcgtcgggtctcagcttccttgtgatcctgaacccgacgtggatgtattggcgtcca

SEQ ID NO: 121229 - DNA, 75 bp, Artificial Sequence
  Synthetic
tattcctggttaccaggcacgcagacgtgatccctgtccgcaggcgtggtgacacccggggtgctcttttgagcc

SEQ ID NO: 121230 - DNA, 75 bp, Artificial Sequence
  Synthetic
ttttgcctactcctgcttgctgcaggggtaggcatctacctcctccccaaccgatgaacctagtcacggctagct

SEQ ID NO: 121231 - DNA, 75 bp, Artificial Sequence
  Synthetic
tcccggacctaggagtcagggtctgcgagaaaatggccctctatgacattgcccagaagctccccactgcggtga

SEQ ID NO: 121232 - DNA, 75 bp, Artificial Sequence
  Synthetic
ggggcaaaggaggttcggagcttgtccaggagggccgtcaaccacatccagtccgtgtggaaggacctcttggaa

SEQ ID NO: 121233 - DNA, 75 bp, Artificial Sequence
  Synthetic
catgagcaaggcgtatggggtggaccccaacatcaggactggtgtcaggacaataacaacaggaggccctattac

SEQ ID NO: 121234 - DNA, 75 bp, Artificial Sequence
  Synthetic
agcgccttcgctgcgagccacctgcaccacctatggcagggcccatgatgtggacatggtggatgcaaacctgtt

SEQ ID NO: 121235 - DNA, 75 bp, Artificial Sequence
  Synthetic
tagcgtcgctgatgtcgtttacagccgcggtgacgagtccactaaccacccagcaaaccctcctctttaacatcc

SEQ ID NO: 121236 - DNA, 75 bp, Artificial Sequence
  Synthetic
tgtggctaaagcggtggacttcgtgcctgtcgagtccctagaaactaccatgaggtctccagttttcactgacaa

SEQ ID NO: 121237 - DNA, 75 bp, Artificial Sequence
  Synthetic
cacccgctgttttgactcaactgtcacggagagagacatcagaactgaagaatccatataccaggcctgctcgtt

SEQ ID NO: 121238 - DNA, 75 bp, Artificial Sequence
  Synthetic
cacccgctgttttgactcaactgtcacggagagagacatcagaactgaagattccatataccaggcctgctcgtt

SEQ ID NO: 121239 - DNA, 75 bp, Artificial Sequence
  Synthetic
cacccgctgttttgactcaactgtcacggagagagacatcagaactgaagactccatataccaggcctgctcgtt

SEQ ID NO: 121240 - DNA, 75 bp, Artificial Sequence
  Synthetic
cacccgctgttttgactcaactgtcacggagagagacatcagaactgaagagtccatataccaggcctgctcgtt

SEQ ID NO: 121241 - DNA, 75 bp, Artificial Sequence
  Synthetic
aaggccctcgactttgaaatgtacggggctacctattcagtcactccgctggacttaccagctatcattgaaaga

SEQ ID NO: 121242 - DNA, 75 bp, Artificial Sequence
  Synthetic
ggaaaagagcgacctcgagccttccataccatcggaatacatgctccccaagaagaggtttccaccagccttacc

SEQ ID NO: 121243 - DNA, 75 bp, Artificial Sequence
  Synthetic
gaaggtcctagtggacattcttgctggctacggggctggtgtggcgggggcccttgtggctttcaagatcatgag

SEQ ID NO: 121244 - DNA, 75 bp, Artificial Sequence
  Synthetic
cagggctataaggtgctggtgcttaacccctctgttgcggccactttgggttttggggcgtacatgtccaaagca

SEQ ID NO: 121245 - DNA, 75 bp, Artificial Sequence
  Synthetic
gggacagacctgcggatacaggcgttgccgtgccagcggcgtgtttaccactagcatgggaaacaccatcacatg

SEQ ID NO: 121246 - DNA, 75 bp, Artificial Sequence
  Synthetic
tacggcatcgacccaaacatacggtcaggtgtcagaaccatcaacacgggtgcgccaatcacgtactccacctac

SEQ ID NO: 121247 - DNA, 75 bp, Artificial Sequence
  Synthetic
gcgcgccaaacttatcgcccagggagggaaggccaaaatatgtggtctatacctcttcaactgggcggtacgcac

SEQ ID NO: 121248 - DNA, 75 bp, Artificial Sequence
  Synthetic
tctcgccaggagctctcgttgtaggcgtggtgtgcgcagcaatactacgccggcacgtgggccctggcgagggcg

SEQ ID NO: 121249 - DNA, 75 bp, Artificial Sequence
  Synthetic
cggtgcagtggatgaaccgactgatagcgtttgcttctcggggtaaccacgtctcccctacacactatgtgccag

SEQ ID NO: 121250 - DNA, 75 bp, Artificial Sequence
  Synthetic
gatgctaccacgatccttggcatcggcacggtccttgaccaggcagagaccgctggagcgcgccttgtcgtgctc

SEQ ID NO: 121251 - DNA, 75 bp, Artificial Sequence
  Synthetic
tgatcacatcgtgctcctccaacgtatctgtggctttggacccacgcggtcgccgcaggtactacctgaccagag

SEQ ID NO: 121252 - DNA, 75 bp, Artificial Sequence
  Synthetic
taacactccattttttttttttttttttttttttttttttttttttttttttttttttttttttttttttttttt

SEQ ID NO: 121253 - DNA, 75 bp, Artificial Sequence
  Synthetic
ggaagttgccttgccgacaacgggagagatacccttttacggcagagcgatccctcttgacttgattaaaggggg

SEQ ID NO: 121254 - DNA, 75 bp, Artificial Sequence
  Synthetic
cccgtgtgctggttcttggctcaaagatgtctgggactggatatgcgaggtgctgagcgacttcaagagttggct

SEQ ID NO: 121255 - DNA, 75 bp, Artificial Sequence
  Synthetic
tgcacgtgtgggttccccccctcaacgtccgaggggggcgcgatgccgtcatcttactcatgtgtgttgtacacc

SEQ ID NO: 121256 - DNA, 75 bp, Artificial Sequence
  Synthetic
cagagggaagccggggatatatagatatgtctcacaaggagaacgaccatctgggttattcgatactgtcgtgct

SEQ ID NO: 121257 - DNA, 75 bp, Artificial Sequence
  Synthetic
gatgtctgggactggatatgcgaggtgctgagcgacttcaagagttggctgaaggccaaacttatgccgcaactg

SEQ ID NO: 121258 - DNA, 75 bp, Artificial Sequence
  Synthetic
gacgtctcagtaataccaacctctggagacgttgtggtttgcgccacagacgccctcatgactggctataccggt

SEQ ID NO: 121259 - DNA, 75 bp, Artificial Sequence
  Synthetic
gtcatgtcaaaaacggttcgatgagaatcgtcggccctaagacttgcagcaacacctggcgtgggtcgttcccca

SEQ ID NO: 121260 - DNA, 75 bp, Artificial Sequence
  Synthetic
tgtcaagaccatctcgagttctgggagggggtattcacagggctcacccacatcgatgcccatttcctctcgcag

SEQ ID NO: 121261 - DNA, 75 bp, Artificial Sequence
  Synthetic
taattgaaaggatacacgggcttgacgccttttcactccacacttactctccacatgagctcacccgagtggcgg

SEQ ID NO: 121262 - DNA, 75 bp, Artificial Sequence
  Synthetic
acgttcgcgttatggagggtgtcggcagaggagtatgtggaggtaaggcggctgggggatttccattacatcacg

SEQ ID NO: 121263 - DNA, 75 bp, Artificial Sequence
  Synthetic
atgcggtatcccgaagccaacggagaggccgcactgggaggggtaagctgggcacatatcggttcgtcaccccag

SEQ ID NO: 121264 - DNA, 75 bp, Artificial Sequence
  Synthetic
cccccatcatgggacaatatgtggaagtgtctcatacggctaaagcccgtactaacgggccctacccctctgttg

SEQ ID NO: 121265 - DNA, 75 bp, Artificial Sequence
  Synthetic
cgcctacataggtacgcccccccctgcaaacccctgctacgggatgaggtgacgtttagcatcgggctcaatgaa

SEQ ID NO: 121266 - DNA, 75 bp, Artificial Sequence
  Synthetic
tgacaccggctgagacaacgacgaggttgagggcctactacaacacaccaggcctccccgtctgccaagaccacc

SEQ ID NO: 121267 - DNA, 75 bp, Artificial Sequence
  Synthetic
aaaatacatcatgacctgcatgtcggcagacctagaggtaatcaccggcacgtgggtaatcgcaggggggattct

SEQ ID NO: 121268 - DNA, 75 bp, Artificial Sequence
  Synthetic
ttcttatctcagaccaagcagtcgggtgagaacttcccttacttggtggcctaccaggcgacggtctgcgctaga

SEQ ID NO: 121269 - DNA, 75 bp, Artificial Sequence
  Synthetic
aacaggactgccctgaactgcaatgactccctccagactgggttccttgccgcgctgttctacacacataagttc

SEQ ID NO: 121270 - DNA, 75 bp, Artificial Sequence
  Synthetic
gggatctttagggccgctgtgtgcaccagaggtgtagcaaaagccctacagttcataccagtggaaacccttagt

SEQ ID NO: 121271 - DNA, 75 bp, Artificial Sequence
  Synthetic
gtcacacaaaagcttcctcaggcggtgatgggggcttcttatggattccagtactcccccgctcagcgggtggag

SEQ ID NO: 121272 - DNA, 75 bp, Artificial Sequence
  Synthetic
ctctaccaacagtttgacgagatggaggagtgctcacaccacatcccctatcttgctgaaggtcaacaacttgct

SEQ ID NO: 121273 - DNA, 75 bp, Artificial Sequence
  Synthetic
cttctgctttgcgtggtatctgaagggtaggtgggtgcccggagcggtctacgccgtctacgggatgtggcctct

SEQ ID NO: 121274 - DNA, 75 bp, Artificial Sequence
  Synthetic
gttcgctcaggggtggggtcccatcacttacgacgggcagcgcagctcggatcagaggccctattgctggcacta

SEQ ID NO: 121275 - DNA, 75 bp, Artificial Sequence
  Synthetic
ccgtgcagaacgaggtaacactcacacatcccataaccaaatacatcatggcatgcatgtcggcggacctagagg

SEQ ID NO: 121276 - DNA, 75 bp, Artificial Sequence
  Synthetic
acatcaacaggaccgccctgaactgcaatgactccctccagaccgggttccttgccgcgctgttctacacacaca

SEQ ID NO: 121277 - DNA, 75 bp, Artificial Sequence
  Synthetic
gtcggagaataagatcgtcatcctggattctttcgacccgctcgtggcggaggaggatgatcgggagatttctgt

SEQ ID NO: 121278 - DNA, 75 bp, Artificial Sequence
  Synthetic
cattctggcagaaacatctgtggaattttgttagcgggatacagtatctcgctggcctttccacgttgcctggga

SEQ ID NO: 121279 - DNA, 75 bp, Artificial Sequence
  Synthetic
gttcataccagtggaaacccttagtacacaggctaggtctccatccttctctgacaattcaactcctcctgctgt

SEQ ID NO: 121280 - DNA, 75 bp, Artificial Sequence
  Synthetic
tggtgattgtcgggagggtcgtcctatcgggccagcctgctgttatccccaaccgagaggcgctctatcagcagt

SEQ ID NO: 121281 - DNA, 75 bp, Artificial Sequence
  Synthetic
ttgacgagatggaagagtgctcaaagcacctaccattagtcgaacaaggcctgcagcttgccggccagtttaaag

SEQ ID NO: 121282 - DNA, 75 bp, Artificial Sequence
  Synthetic
gtacacccgactttggtatttgacatcaccaaactgctgctggccgtcttcggacccctttgggttcttcaagcc

SEQ ID NO: 121283 - DNA, 75 bp, Artificial Sequence
  Synthetic
accaactccggtgccgccaccccggagaaagaggacagtggtgctggatgagtctacagtatcatctgctctggc

SEQ ID NO: 121284 - DNA, 75 bp, Artificial Sequence
  Synthetic
atgagggctgcggttgggcagggtggctcctgtccccccgtggctctcggcctaattggggccccaatgaccccc

SEQ ID NO: 121285 - DNA, 75 bp, Artificial Sequence
  Synthetic
agaaagaggacagtggtgctggatgagtctacagtatcatctgctctggctgagcttgccactaagacctttggc

SEQ ID NO: 121286 - DNA, 75 bp, Artificial Sequence
  Synthetic
cctaattggggccccaatgacccccggcgtaggtcccgcaatctgggtaaggtcatcgataccctgacttgcggc

SEQ ID NO: 121287 - DNA, 75 bp, Artificial Sequence
  Synthetic
tgtccggcgcacttgtcgcttttaagatcatgagcggcgaggctcctgctctagaggacatggttaatctcctgc

SEQ ID NO: 121288 - DNA, 75 bp, Artificial Sequence
  Synthetic
ggcagcatcactgtgccacattctaacatcgaagaagtggccctgggctctgaaggtgagatccctttctacggt

SEQ ID NO: 121289 - DNA, 75 bp, Artificial Sequence
  Synthetic
gcacatgtggaatttcatcagcggtatccaataccttgctgggctgtccaccttgcccggcaaccctgctattgc

SEQ ID NO: 121290 - DNA, 75 bp, Artificial Sequence
  Synthetic
ggcgtaggtcccgcaatctgggtaaggtcatcgataccctgacttgcggcctcgccgacctcatggggtacattc

SEQ ID NO: 121291 - DNA, 75 bp, Artificial Sequence
  Synthetic
ccatgccccctctcgagggggaaccgggggaccccgatctcagcgacgggtcttggtctaccgtaagcagtgatg

SEQ ID NO: 121292 - DNA, 75 bp, Artificial Sequence
  Synthetic
tcttggtctaccgtaagcagtgatggcggtacggaggacgtcgtgtgctgctcgatgtcctactcgtggacgggc

SEQ ID NO: 121293 - DNA, 75 bp, Artificial Sequence
  Synthetic
gggttgggttgcctcgcagattgcaacccctaccgcctccacggcttttgtcgtgagcggccttgcaggggctgc

SEQ ID NO: 121294 - DNA, 75 bp, Artificial Sequence
  Synthetic
actgagtaactcgctgctgcgccaccacaatttggtgtattccaccacctctcgcagcgctggccagaggcagaa

SEQ ID NO: 121295 - DNA, 75 bp, Artificial Sequence
  Synthetic
gagcacaggctcaacgccgcgtgcaattggacccgaggagagcgttgtgatctggaggacagggatagatcagag

SEQ ID NO: 121296 - DNA, 75 bp, Artificial Sequence
  Synthetic
gttaagagaggtaacacctcccgttgctggataccagtggcccccaccctcgctgtagcggatgcctccatcccg

SEQ ID NO: 121297 - DNA, 75 bp, Artificial Sequence
  Synthetic
cagagtggcagatactgccctgttccttcaccaccctaccggctctgtccactggtttgatccatctccatcaga

SEQ ID NO: 121298 - DNA, 75 bp, Artificial Sequence
  Synthetic
gacctggcttaagtctaagcttgtgccctccctcccaggtgtccctttcttctcatgtcagagggggtttagggg

SEQ ID NO: 121299 - DNA, 75 bp, Artificial Sequence
  Synthetic
cgctgtagcggatgcctccatcccggtgagagggttccgccgccacgtggaccttctcgttggttcagcagcgtt

SEQ ID NO: 121300 - DNA, 75 bp, Artificial Sequence
  Synthetic
cgcccccgcactccgccagatcaaaatttggctatggggcgaaggatgtccgaagccattccagtaaggccatac

SEQ ID NO: 121301 - DNA, 75 bp, Artificial Sequence
  Synthetic
atttggctatggggcgaaggatgtccgaagccattccagtaaggccatacgccacattaactccgtgtggcaaga

SEQ ID NO: 121302 - DNA, 75 bp, Artificial Sequence
  Synthetic
aattgctccatttacaccggtcacgtcacgggccataggatggcatgggacatgatgatgaattggtctccagcc

SEQ ID NO: 121303 - DNA, 75 bp, Artificial Sequence
  Synthetic
gatcaacgaggattgttccactccatgtgacaccagttggttgtgggaagtctggagctgggtctgcaccgtact

SEQ ID NO: 121304 - DNA, 75 bp, Artificial Sequence
  Synthetic
cttatcgtgtaccccgacctgggagtgcgcgtatgcgagaagagggctttgtatgacgtagtcaaacagctcccc

SEQ ID NO: 121305 - DNA, 75 bp, Artificial Sequence
  Synthetic
gctcctcggggggtccgctgttgtgccccgcggggcacgccgtaggcatattcagggccgcggtgtgcacccgtg

SEQ ID NO: 121306 - DNA, 75 bp, Artificial Sequence
  Synthetic
gcatggttgccaattgggctaaagtcattgccgtcctactcctcttttctggagttgaggggactaccctcattg

SEQ ID NO: 121307 - DNA, 75 bp, Artificial Sequence
  Synthetic
cctggcacgggaccttccccatcaatgcttacaccactggccccggcgtacccatcccagcgccaaactacaagt

SEQ ID NO: 121308 - DNA, 75 bp, Artificial Sequence
  Synthetic
caacaggacagcactcaattgtaatgacactctccagactggcttcattgccggtctgtttgctgtccgcgggtt

SEQ ID NO: 121309 - DNA, 75 bp, Artificial Sequence
  Synthetic
gaagctggccgcgctgacaggtacgtacgtttatgaccatcttactccactgcgggactgggcccacgcgggcct

SEQ ID NO: 121310 - DNA, 75 bp, Artificial Sequence
  Synthetic
tacgtttatgaccatcttactccactgcgggactgggcccacgcgggcctacgagaccttgcggtggcagttgag

SEQ ID NO: 121311 - DNA, 75 bp, Artificial Sequence
  Synthetic
ttgagctggggggcaagccggcactcgttccagacaaagaggtgttgtatcaacaatacgatgagatggaggagt

SEQ ID NO: 121312 - DNA, 75 bp, Artificial Sequence
  Synthetic
tcctctgacaaaccctactgttggcattacccgcctagaccttgcactaccgttcaggcacaaacggtttgtggc

SEQ ID NO: 121313 - DNA, 75 bp, Artificial Sequence
  Synthetic
tcttcggctagtcagctttctgcaccttctcttaaagcaacatgcaccactcgcgcggaccaccctgacgccgag

SEQ ID NO: 121314 - DNA, 75 bp, Artificial Sequence
  Synthetic
tggttgggtcccagctcccttgtgagccagagcctgacgtagcagtattaacatccatgctaacagatccatctc

SEQ ID NO: 121315 - DNA, 75 bp, Artificial Sequence
  Synthetic
gccagagcctgacgtagcagtattaacatccatgctaacagatccatctcacttgacagcggagacggcccgccg

SEQ ID NO: 121316 - DNA, 75 bp, Artificial Sequence
  Synthetic
ggcacaagcacatgtggaattttgtgagtgggatccagtacctagcaggcctctccactttgcctggcaaccctg

SEQ ID NO: 121317 - DNA, 75 bp, Artificial Sequence
  Synthetic
tgctggagtctcccaggccccctattggggggtggttcgggtgcacgtggatgaacgccacagggttcgtcaaaa

SEQ ID NO: 121318 - DNA, 75 bp, Artificial Sequence
  Synthetic
atgaacgccacagggttcgtcaaaacctgcggtgcccccccctgcaagactcagccagtcggcgaaggcaatgac

SEQ ID NO: 121319 - DNA, 75 bp, Artificial Sequence
  Synthetic
cacgtgcgctgcccaccacgactcccctggtaacgacctcattgaggccaatctcttgtggggcaccaaagctac

SEQ ID NO: 121320 - DNA, 75 bp, Artificial Sequence
  Synthetic
cccccgcctcggcggaggagggttgtgcagcttgacgagtcagctgctgctgaggcgctcgccgagctggcccgg

SEQ ID NO: 121321 - DNA, 75 bp, Artificial Sequence
  Synthetic
tgcagcttgacgagtcagctgctgctgaggcgctcgccgagctggcccggaagacatttccattgaatccatcag

SEQ ID NO: 121322 - DNA, 75 bp, Artificial Sequence
  Synthetic
tgcagcttgacgagtcagctgctgctgaggcgctcgccgagctggcccggaagtcatttccattgaatccatcag

SEQ ID NO: 121323 - DNA, 75 bp, Artificial Sequence
  Synthetic
tgcagcttgacgagtcagctgctgctgaggcgctcgccgagctggcccggaagccatttccattgaatccatcag

SEQ ID NO: 121324 - DNA, 75 bp, Artificial Sequence
  Synthetic
tgcagcttgacgagtcagctgctgctgaggcgctcgccgagctggcccggaaggcatttccattgaatccatcag

SEQ ID NO: 121325 - DNA, 75 bp, Artificial Sequence
  Synthetic
cctggtaacgacctcattgaggccaatctcttgtggggcaccaaagctaccagggtcgagacggaggataaggtt

SEQ ID NO: 121326 - DNA, 75 bp, Artificial Sequence
  Synthetic
acccttacaggctgtggcactatccttgcaccgtcaactacaccctccataaggtgcgcatgtatgtagccggcg

SEQ ID NO: 121327 - DNA, 75 bp, Artificial Sequence
  Synthetic
tgcacctgcggcagctcggacctctacttggtcacgaggcatgccgatgtcatcccggtgcgccggcggggtgac

SEQ ID NO: 121328 - DNA, 75 bp, Artificial Sequence
  Synthetic
cagcccaggaagaggttcccgccagctttgccagtttgggctcggcccgaatacaatccacctttggtagagaca

SEQ ID NO: 121329 - DNA, 75 bp, Artificial Sequence
  Synthetic
gacatggtcaacctgttgcccgccatactatctccgggtgctctcgtcgtcggtgtgatatgcgctgccatacta

SEQ ID NO: 121330 - DNA, 75 bp, Artificial Sequence
  Synthetic
tggaaacagcaagactacagcccaccggctgttcatggctgcgccctgcctcccaacaagccgacccccgttcct

SEQ ID NO: 121331 - DNA, 75 bp, Artificial Sequence
  Synthetic
tacagagctggctatcttgccctgttccttcacaactatgcctgcgctatccaccgggttgatccatcttcacca

SEQ ID NO: 121332 - DNA, 75 bp, Artificial Sequence
  Synthetic
catcgcattcgcatcccggggcaaccacgtctcaccgacgcactatgttcccgagagcgatgctgcagcgagggt

SEQ ID NO: 121333 - DNA, 75 bp, Artificial Sequence
  Synthetic
gacgcgcgggtctgcgcctgtttgtggttaatgttcctagttggccaagcggaggcagcgttggacaaactcatc

SEQ ID NO: 121334 - DNA, 75 bp, Artificial Sequence
  Synthetic
cgtctcagttggacttgtccaattggttcacgggcggttacagcgggggagacatttatcacagcgtgtctcatg

SEQ ID NO: 121335 - DNA, 75 bp, Artificial Sequence
  Synthetic
cagaagaaggtgacttttgacagggtccagctgctggatcaacactaccaagatgtactcaaggaggtgaaggat

SEQ ID NO: 121336 - DNA, 75 bp, Artificial Sequence
  Synthetic
ccacttatgctatactgcagatgtggcctcttctcttgctggtgttagctctgccacgcagggcgtacgctagta

SEQ ID NO: 121337 - DNA, 75 bp, Artificial Sequence
  Synthetic
cctcccgggagagccatagtggtctgcggaaccggtgagtacaccggaattgccaggatgaccgggtcctttctt

SEQ ID NO: 121338 - DNA, 75 bp, Artificial Sequence
  Synthetic
ctgccacgcagggcgtacgctagtaacagtgaggaggctgcgtctctgggattgttggtgattgccatcatcacc

SEQ ID NO: 121339 - DNA, 75 bp, Artificial Sequence
  Synthetic
tcggcagaagaaggtgaccttcgaccgcttacaggtggtggacgaccactacaatgcagtactaaaggagatcaa

SEQ ID NO: 121340 - DNA, 75 bp, Artificial Sequence
  Synthetic
tgcctccgctgcaagttcgcggcggtcgcgacgcggtcatactgctcacttgcttgttgcacccgcagttggggt

SEQ ID NO: 121341 - DNA, 75 bp, Artificial Sequence
  Synthetic
atccccttctatggcaaagccatccccatcgaggccatcaagggggggaggcacctcattttctgccattccaag

SEQ ID NO: 121342 - DNA, 75 bp, Artificial Sequence
  Synthetic
aaggatgttcgaagccactcccgcagggccattaaccacatcaactccgtgtgggaggacctgctggaagacaac

SEQ ID NO: 121343 - DNA, 75 bp, Artificial Sequence
  Synthetic
tgtggcgctctaagaagacccctatggggttttcttatgacaccagatgttttgattcaacggtcacagagcgcg

SEQ ID NO: 121344 - DNA, 75 bp, Artificial Sequence
  Synthetic
atttcgtgcgagctcacatccttttgcgcgcttgcatgtttttccgcggtgtagtaggcgggaagtacttccagg

SEQ ID NO: 121345 - DNA, 75 bp, Artificial Sequence
  Synthetic
caaatcagagaagggcggccgaaaaccagcgcgcctaatcgtgtacccggacctaggggtccgggtgtgcgagaa

SEQ ID NO: 121346 - DNA, 75 bp, Artificial Sequence
  Synthetic
caggggtaggcatctacctctaccccaaccgatgaaggttgggataaacactccggcctcttaggccatttcctg

SEQ ID NO: 121347 - DNA, 75 bp, Artificial Sequence
  Synthetic
aaacttcctgaagccgtgatgggagccgcttatggcttccaatactcaccagcgcagcgggtcgaatatcttttg

SEQ ID NO: 121348 - DNA, 75 bp, Artificial Sequence
  Synthetic
cgccgttgagcccgtcatcttttctcctatggagaagaaagtcatcacctggggcgcagatacagccgcgtgcgg

SEQ ID NO: 121349 - DNA, 75 bp, Artificial Sequence
  Synthetic
caatactctgacttgctacatgaaggctcaagcggcatgcagggctgctgggctgaaggactttgacatgttggt

SEQ ID NO: 121350 - DNA, 75 bp, Artificial Sequence
  Synthetic
gctcaagcggcatgcagggctgctgggctgaaggactttgacatgttggtctgcggagacgatctcgtcgttatt

SEQ ID NO: 121351 - DNA, 75 bp, Artificial Sequence
  Synthetic
ccgcttatggcttccaatactcaccagcgcagcgggtcgaatatcttttgaccgcatggaaacaaaagaagagcc

SEQ ID NO: 121352 - DNA, 75 bp, Artificial Sequence
  Synthetic
ccatcacctacgctgaacatcacggccgtgaccagaggccttactgctggcactacgcgcccaagccgtgcggta

SEQ ID NO: 121353 - DNA, 75 bp, Artificial Sequence
  Synthetic
ccgatcacagcttatgcccagcagaccagaggcctagtaggcacaattgtcaccagccttactggccgcgacaag

SEQ ID NO: 121354 - DNA, 75 bp, Artificial Sequence
  Synthetic
caccagccttactggccgcgacaagaatgaggtggaaggtgaaattcaggtcgtgtccactgccacacagtcctt

SEQ ID NO: 121355 - DNA, 75 bp, Artificial Sequence
  Synthetic
cctatgcggtgtccgcaggtgccgcgccagtggcgtgttcaccaccagcttcggaaacacactgacgtgctacct

SEQ ID NO: 121356 - DNA, 75 bp, Artificial Sequence
  Synthetic
attgccgcgttgttctacacacacaagttcaattcgtccggatgcctggagcgcatggccagctgccgccccatc

SEQ ID NO: 121357 - DNA, 75 bp, Artificial Sequence
  Synthetic
aatgttgaccaagacctggtaggttggcccgcaccacctgggtctcgttcacttactccgtgctcctgtggctca

SEQ ID NO: 121358 - DNA, 75 bp, Artificial Sequence
  Synthetic
caactcctcagggctctaccacgtcaccaacgactgccccaattcgagcgttgtgtacgaggcggacgacgttat

SEQ ID NO: 121359 - DNA, 75 bp, Artificial Sequence
  Synthetic
ggcccctccaggggacgccccgcaaccggcatacgacctcgagcacataacatcctgctcatccaatgtgtcggt

SEQ ID NO: 121360 - DNA, 75 bp, Artificial Sequence
  Synthetic
taacatctcgggcatctatcacatcaccaatgactgcccaaattccagcatagtctatgagtccgatcatcacat

SEQ ID NO: 121361 - DNA, 75 bp, Artificial Sequence
  Synthetic
cttagtccgaggcctatcagtaccttgaagggatcgtcggggggtcctatgttgtgcccttctggtcacgttgcg

SEQ ID NO: 121362 - DNA, 75 bp, Artificial Sequence
  Synthetic
aattcctggctagggaacatcatactttatgcgcccacaatttgggtgcgtatggtattgatgacccacttcttc

SEQ ID NO: 121363 - DNA, 75 bp, Artificial Sequence
  Synthetic
cctatgacgcagcttcgacggcatatcgatctgctcgttgggtccgccacactctgctcggctctgtacgtgggg

SEQ ID NO: 121364 - DNA, 75 bp, Artificial Sequence
  Synthetic
ggggaaagccgctatatgcggcaagtacctcttcaactgggcagtgaagaccaagctcaaactcactccaatacc

SEQ ID NO: 121365 - DNA, 75 bp, Artificial Sequence
  Synthetic
cagacaatacttctccaccagcagttccacaaacatatcaagtagggtaccttcacgcccctacaggtagtggta

SEQ ID NO: 121366 - DNA, 75 bp, Artificial Sequence
  Synthetic
tccacaaacatatcaagtagggtaccttcacgcccctacaggtagtggtaagagcaccaaagtcccggctgcgta

SEQ ID NO: 121367 - DNA, 75 bp, Artificial Sequence
  Synthetic
tcaatactccaaagccaggaagcccttgaaagggcgctggacttcgacatgtacggagtcacatactcaatcact

SEQ ID NO: 121368 - DNA, 75 bp, Artificial Sequence
  Synthetic
ggggggacatatttcacagcgtgtcccgggcccgaccccgcatgttactcctgtgcctactcctactttccgtag

SEQ ID NO: 121369 - DNA, 75 bp, Artificial Sequence
  Synthetic
acataacggggcaccgtatggcctgggatatgatgatgaactggtctcccaccctggcgttagtaacaagccagc

SEQ ID NO: 121370 - DNA, 75 bp, Artificial Sequence
  Synthetic
tgtaactgctcaatctactctggacatgtcacgggacacaggatggcttgggatatgatgatgaattggagaccc

SEQ ID NO: 121371 - DNA, 75 bp, Artificial Sequence
  Synthetic
tgtaactgctcaatctactctggacatgtcacgggacacaggatggcttgggatatgatgatgaattggagtccc

SEQ ID NO: 121372 - DNA, 75 bp, Artificial Sequence
  Synthetic
tgtaactgctcaatctactctggacatgtcacgggacacaggatggcttgggatatgatgatgaattggagcccc

SEQ ID NO: 121373 - DNA, 75 bp, Artificial Sequence
  Synthetic
tgtaactgctcaatctactctggacatgtcacgggacacaggatggcttgggatatgatgatgaattggaggccc

SEQ ID NO: 121374 - DNA, 75 bp, Artificial Sequence
  Synthetic
atccgcaccggagtgaggaccatcactacggggggggcgattacttactctacttatggcaagttccttgcagac

SEQ ID NO: 121375 - DNA, 75 bp, Artificial Sequence
  Synthetic
ggtgttggttgtgatgttgctctttgcgggcgttgacgccagcaccaccaccacggggggatctgcagcccatgc

SEQ ID NO: 121376 - DNA, 75 bp, Artificial Sequence
  Synthetic
tctgcatgcaggctaattgggccaaggtcatcctggtcctcttcctctttgctggggttgaagctgaaaccagtg

SEQ ID NO: 121377 - DNA, 75 bp, Artificial Sequence
  Synthetic
tacgctttctatggtgtatggccgttatttctgctcttgctggcgttaccaccacgggcatacgccatggaccgg

SEQ ID NO: 121378 - DNA, 75 bp, Artificial Sequence
  Synthetic
cggagacagccggagtgaggcttacagtgcttgcaacggcgactccccctggctcagttacagtccctcatccaa

SEQ ID NO: 121379 - DNA, 75 bp, Artificial Sequence
  Synthetic
tgcaatgacagcctcaacactgggttcttggcggggcttttctactacaacaaattcaattcatcaggttgcccc

SEQ ID NO: 121380 - DNA, 75 bp, Artificial Sequence
  Synthetic
gcacatcaacaggacggccctcaactgcaacgacagtctgtctacggggttttttgccgcactcttttacaccca

SEQ ID NO: 121381 - DNA, 75 bp, Artificial Sequence
  Synthetic
tacaatacttcatcaccagagccgaggcgcatctgcaggtgtggatcccccctctcaacgtccgggggggccgcg

SEQ ID NO: 121382 - DNA, 75 bp, Artificial Sequence
  Synthetic
tgcaacgacagtctgtctacggggttttttgccgcactcttttacacccacgcgttcaacagcaccgggtgtgtc

SEQ ID NO: 121383 - DNA, 75 bp, Artificial Sequence
  Synthetic
ccattccaaaaagaagtgcgatgagctggctaaacaactcacatctcttgggctcaacgcagtagcattctatag

SEQ ID NO: 121384 - DNA, 75 bp, Artificial Sequence
  Synthetic
ggcactaccccccaaaaccgtgtggtatggtgcccgcgcggagtgtgtgcggcccagtgtattgtttcactccca

SEQ ID NO: 121385 - DNA, 75 bp, Artificial Sequence
  Synthetic
gactgcaatacttcagtcactcaagtcgttgatttcagcctggaccccacatttaccatagaaaccaccactgtg

SEQ ID NO: 121386 - DNA, 75 bp, Artificial Sequence
  Synthetic
tcgttgatttcagcctggaccccacatttaccatagaaaccaccactgtgccccaagatgccgtttcacggagtc

SEQ ID NO: 121387 - DNA, 75 bp, Artificial Sequence
  Synthetic
agtgggcaattggtttggctgcacctggatgaacaccaccagatttaccaagacatgtggaggacctccctgccg

SEQ ID NO: 121388 - DNA, 75 bp, Artificial Sequence
  Synthetic
agtgggcaattggtttggctgcacctggatgaacaccacctgatttaccaagacatgtggaggacctccctgccg

SEQ ID NO: 121389 - DNA, 75 bp, Artificial Sequence
  Synthetic
agtgggcaattggtttggctgcacctggatgaacaccacccgatttaccaagacatgtggaggacctccctgccg

SEQ ID NO: 121390 - DNA, 75 bp, Artificial Sequence
  Synthetic
agtgggcaattggtttggctgcacctggatgaacaccaccggatttaccaagacatgtggaggacctccctgccg

SEQ ID NO: 121391 - DNA, 75 bp, Artificial Sequence
  Synthetic
actgagagcgacatccgtacggaggaggcaatttaccaatgttgtgacctggacccccaggcccgcgtggccatc

SEQ ID NO: 121392 - DNA, 75 bp, Artificial Sequence
  Synthetic
ggcatacgacacaggttgcgcgtggtatgagctgactccagccgagaccaccgtcagactgcgcgcttacctcaa

SEQ ID NO: 121393 - DNA, 75 bp, Artificial Sequence
  Synthetic
tatgagctgactccagccgagaccaccgtcagactgcgcgcttacctcaataccccagggcttcccgtctgtcag

SEQ ID NO: 121394 - DNA, 75 bp, Artificial Sequence
  Synthetic
acccccaggtgcatggttgactatccctacaggctttggcactacccctgcacactcaactacactctgttcaag

SEQ ID NO: 121395 - DNA, 75 bp, Artificial Sequence
  Synthetic
cactgtcaattacaccatctttaaggtcagaatgtatgtgggagggatagagcaccgcctggaggcggcgtgaaa

SEQ ID NO: 121396 - DNA, 75 bp, Artificial Sequence
  Synthetic
cactgtcaattacaccatctttaaggtcagaatgtatgtgggagggatagagcaccgcctggaggcggcgtgtaa

SEQ ID NO: 121397 - DNA, 75 bp, Artificial Sequence
  Synthetic
cactgtcaattacaccatctttaaggtcagaatgtatgtgggagggatagagcaccgcctggaggcggcgtgcaa

SEQ ID NO: 121398 - DNA, 75 bp, Artificial Sequence
  Synthetic
cactgtcaattacaccatctttaaggtcagaatgtatgtgggagggatagagcaccgcctggaggcggcgtggaa

SEQ ID NO: 121399 - DNA, 75 bp, Artificial Sequence
  Synthetic
tcgttgcctaccaggcaacagtctgcgcaagagccaaggccccccccccctcgtgggacacaatgtggaaatgtc

SEQ ID NO: 121400 - DNA, 75 bp, Artificial Sequence
  Synthetic
ttagcccactgctgctgagtaccacccagtggcaggtcctcccgtgctcctttacaaccctgccagccttgtcca

SEQ ID NO: 121401 - DNA, 75 bp, Artificial Sequence
  Synthetic
acaatggcaggtacttccctgttcttttacaacccttcccgctctctctactggcctaatccacctccaccaaaa

SEQ ID NO: 121402 - DNA, 75 bp, Artificial Sequence
  Synthetic
tgactttgaaatgtacggggccacttactctgtcactccgctggatttaccagcaatcattgaaagactccatgg

SEQ ID NO: 121403 - DNA, 75 bp, Artificial Sequence
  Synthetic
catcatgacttgcatgtcagcagacttggaagtaataactagcacttgggtacttgtaggtggggttctcgcagc

SEQ ID NO: 121404 - DNA, 75 bp, Artificial Sequence
  Synthetic
cctcctcttcctgctgcttgcagatgcgcgcatctgcgcctgcctttggatgatgttactcatatcccaggtgga

SEQ ID NO: 121405 - DNA, 75 bp, Artificial Sequence
  Synthetic
gtcagagagtaaggtggtaatcctagactcatttgaaccgcttcgagcggaggaggatgagagggaagtatccgt

SEQ ID NO: 121406 - DNA, 75 bp, Artificial Sequence
  Synthetic
cgctatattagctggtgcttatggtggctccaatattttttgaccagagtagaagcacaactgcacatgtgggtt

SEQ ID NO: 121407 - DNA, 75 bp, Artificial Sequence
  Synthetic
cagcaattcgatgagatggaggagtgttctagacacattccttacctcgttgagggtcaacacctggctgagcaa

SEQ ID NO: 121408 - DNA, 75 bp, Artificial Sequence
  Synthetic
aaaggcagatgggtgcccggggccgcttacgccttgtacggggcgtggccactcctcatgctcctgctggcgttg

SEQ ID NO: 121409 - DNA, 75 bp, Artificial Sequence
  Synthetic
gttctagacacattccttacctcgttgagggtcaacacctggctgagcaattcaggcaaaaggtcctcggcctta

SEQ ID NO: 121410 - DNA, 75 bp, Artificial Sequence
  Synthetic
cctacgcggcttgtgggatgtggcccttgctcttcctgctcctggcgttacccgaaagggcttacgcttttgacc

SEQ ID NO: 121411 - DNA, 75 bp, Artificial Sequence
  Synthetic
gagtggcatacaatacctagccggtctatccaccctgccgggcaatcctgcagtagcgtcgctgatgtcattctc

SEQ ID NO: 121412 - DNA, 75 bp, Artificial Sequence
  Synthetic
agcgcatcggcttgttcatatggtggctccaatattttctgaccaggacagaggcattggtgcaagtgtgggtcc

SEQ ID NO: 121413 - DNA, 75 bp, Artificial Sequence
  Synthetic
actgccctgaactgcaatgactccctcaacaccgggttccttgccgcgctgttctacacacacaagttcaacgcg

SEQ ID NO: 121414 - DNA, 75 bp, Artificial Sequence
  Synthetic
gatccaatacttcatcgcgaggatcgaggcccttttgcacgtgtatgttccatcattcaacgtgcgcggcccacg

SEQ ID NO: 121415 - DNA, 75 bp, Artificial Sequence
  Synthetic
tccggatgcccagagcgcatggctagctgccgccccattgacaagttcgatcaggggtggggtcccatcacttac

SEQ ID NO: 121416 - DNA, 75 bp, Artificial Sequence
  Synthetic
tcttgggggggtgggttgcttcacaacttgcaaaccccacggcttccactgctttcgtagtgagcggtctggcag

SEQ ID NO: 121417 - DNA, 75 bp, Artificial Sequence
  Synthetic
gctgccgccccattgacaagttcgatcaggggtggggtcccatcacttacgccgagcctggcagctcagaccaga

SEQ ID NO: 121418 - DNA, 75 bp, Artificial Sequence
  Synthetic
catcgggcccctttgggtcctccaggccagcctgctcagggtgccatacttcgtgcgcgctcagggactcctccg

SEQ ID NO: 121419 - DNA, 75 bp, Artificial Sequence
  Synthetic
catcgggcccctttgggtcctccaggccagcctgctcagggtgccatacttcgtgcgcgctcagggtctcctccg

SEQ ID NO: 121420 - DNA, 75 bp, Artificial Sequence
  Synthetic
catcgggcccctttgggtcctccaggccagcctgctcagggtgccatacttcgtgcgcgctcagggcctcctccg

SEQ ID NO: 121421 - DNA, 75 bp, Artificial Sequence
  Synthetic
catcgggcccctttgggtcctccaggccagcctgctcagggtgccatacttcgtgcgcgctcaggggctcctccg

SEQ ID NO: 121422 - DNA, 75 bp, Artificial Sequence
  Synthetic
gtcccatcacttacactgagcctcatgatttggatcagaggccctattgctggcactacgcgcctcaaccgtgtg

SEQ ID NO: 121423 - DNA, 75 bp, Artificial Sequence
  Synthetic
tcgcaggtgtgtggtccagtgtattgcttcaccccaagccctgttgtggtggggacgaccgatcgtttcggcgtc

SEQ ID NO: 121424 - DNA, 75 bp, Artificial Sequence
  Synthetic
acataacaaaatatcttcttgctatggttggtcccctctacctactccagagctcgctgatgagcgtcccttact

SEQ ID NO: 121425 - DNA, 75 bp, Artificial Sequence
  Synthetic
acataacaaaatatcttcttgctatggttggtcccctctacctactccagagctcgctgatgtgcgtcccttact

SEQ ID NO: 121426 - DNA, 75 bp, Artificial Sequence
  Synthetic
acataacaaaatatcttcttgctatggttggtcccctctacctactccagagctcgctgatgcgcgtcccttact

SEQ ID NO: 121427 - DNA, 75 bp, Artificial Sequence
  Synthetic
acataacaaaatatcttcttgctatggttggtcccctctacctactccagagctcgctgatgggcgtcccttact

SEQ ID NO: 121428 - DNA, 75 bp, Artificial Sequence
  Synthetic
ggggacgaccgatcgtttcggcgtccctacgtacagctggggggagaatgagacggacgtgctgctccttaacaa

SEQ ID NO: 121429 - DNA, 75 bp, Artificial Sequence
  Synthetic
gagcggtgagaccccctcggccgaggatatggtcaatctgcttccggcgctactgtcccctggagcactggtggt

SEQ ID NO: 121430 - DNA, 75 bp, Artificial Sequence
  Synthetic
tgatttggatcagaggccctattgctggcactacgcgcctcaaccgtgtggtattgtgcccacgttgcaggtgtg

SEQ ID NO: 121431 - DNA, 75 bp, Artificial Sequence
  Synthetic
tccccactgcgggactgggcccacaacggcctgcgagatctcgcggtagccgtcgagcctgtggtcttctcccca

SEQ ID NO: 121432 - DNA, 75 bp, Artificial Sequence
  Synthetic
catgtgtcgcccacacattatgtgccagagactgacacctctcggcagattatgaccatactcagctccctcacc

SEQ ID NO: 121433 - DNA, 75 bp, Artificial Sequence
  Synthetic
catgtgtcgcccacacattatgtgcctgagactgacacctctcggcagattatgaccatactcagctccctcacc

SEQ ID NO: 121434 - DNA, 75 bp, Artificial Sequence
  Synthetic
catgtgtcgcccacacattatgtgcccgagactgacacctctcggcagattatgaccatactcagctccctcacc

SEQ ID NO: 121435 - DNA, 75 bp, Artificial Sequence
  Synthetic
catgtgtcgcccacacattatgtgccggagactgacacctctcggcagattatgaccatactcagctccctcacc

SEQ ID NO: 121436 - DNA, 75 bp, Artificial Sequence
  Synthetic
tgggtcctgctgacaagatggtttccaagggctggaggcttctggcccctattacagcatatgcccaacaaacaa

SEQ ID NO: 121437 - DNA, 75 bp, Artificial Sequence
  Synthetic
acgaatggatcaacagtgattggtccaccccgtgtagtgggtcgtggctgcgggacatctgggactgggtgtgta

SEQ ID NO: 121438 - DNA, 75 bp, Artificial Sequence
  Synthetic
aaaggctcctcggggggtccactgctgtgccccgcgggacacgccgtaggcatattcagggctgcggtgtgcacc

SEQ ID NO: 121439 - DNA, 75 bp, Artificial Sequence
  Synthetic
atcactgcgtacgcgcagcagacccgaggcctgttaagcaccatcgtaacgagcctcactggcagagacaccaat

SEQ ID NO: 121440 - DNA, 75 bp, Artificial Sequence
  Synthetic
atcactgcgtacgcgcagcagacccgaggcctgtttagcaccatcgtaacgagcctcactggcagagacaccaat

SEQ ID NO: 121441 - DNA, 75 bp, Artificial Sequence
  Synthetic
atcactgcgtacgcgcagcagacccgaggcctgttcagcaccatcgtaacgagcctcactggcagagacaccaat

SEQ ID NO: 121442 - DNA, 75 bp, Artificial Sequence
  Synthetic
atcactgcgtacgcgcagcagacccgaggcctgttgagcaccatcgtaacgagcctcactggcagagacaccaat

SEQ ID NO: 121443 - DNA, 75 bp, Artificial Sequence
  Synthetic
gtgggacaagccttcacgttcagaccccgtcgccatcaaacggtccagacctgtaactgctcgctgtacccaggc

SEQ ID NO: 121444 - DNA, 75 bp, Artificial Sequence
  Synthetic
ggccacatgtatcaacggggtgtgctggaccgtctatcatggggccggaccaaggacccttgcctcgtctagggg

SEQ ID NO: 121445 - DNA, 75 bp, Artificial Sequence
  Synthetic
gaggggtgatggcatatgccgcaccatctgcccatgtggggccgatatagtcggccacgtcaagaatgggtccat

SEQ ID NO: 121446 - DNA, 75 bp, Artificial Sequence
  Synthetic
gacctgtacctggtcacgaggcatgccgacgtcattccggtgcgccggcgaggggacactagaggtagcctgctc

SEQ ID NO: 121447 - DNA, 75 bp, Artificial Sequence
  Synthetic
tacaaaagggctctttggagggtggccgctgaggaatacgtcgaagtagtgaggatgggtgacagccactttgtg

SEQ ID NO: 121448 - DNA, 75 bp, Artificial Sequence
  Synthetic
gtggggtcgccaaggcggtggacttcatccccgtggaggctctagcaacatccatgaggtccccggtgttctcag

SEQ ID NO: 121449 - DNA, 75 bp, Artificial Sequence
  Synthetic
aatgcccctgccaagtaccggctccggagtttttcactgaggtagacggtgtgcgactacaccgatacgcacccg

SEQ ID NO: 121450 - DNA, 75 bp, Artificial Sequence
  Synthetic
cagctggtcaacaccaatggctcgtggcacatcaacagcactgccctgaactgtgatgattccataaacaccggg

SEQ ID NO: 121451 - DNA, 75 bp, Artificial Sequence
  Synthetic
gcccactggggagtcctggcgggcatagcgtatttttccatggtggggaactgggcgaaggtcctggtagtgctg

SEQ ID NO: 121452 - DNA, 75 bp, Artificial Sequence
  Synthetic
gatctccttttccgtgggcctcaactcctacgcaattggatctcagctaccatgtgaacccgagccggatgtgac

SEQ ID NO: 121453 - DNA, 75 bp, Artificial Sequence
  Synthetic
gtgtgagggctcttgaggacggaataaattttgcaacagggaatttgcctggttgcgccttttctatctttctcc

SEQ ID NO: 121454 - DNA, 75 bp, Artificial Sequence
  Synthetic
gcaccaaggttccggccgcatacgcatcacaggggtacaaggtgttggtgcttaatccctctgttgctgcgacgc

SEQ ID NO: 121455 - DNA, 75 bp, Artificial Sequence
  Synthetic
acaattctacgccccccgcagtaccccaaacttaccaggtggcccacttgcatgcaccgacaggaagcggcaaga

SEQ ID NO: 121456 - DNA, 75 bp, Artificial Sequence
  Synthetic
ggggggagacatctcatcttctgccattcaaagaagaagtgtgatgagctcgccgcaaaactggtcgcattgggc

SEQ ID NO: 121457 - DNA, 75 bp, Artificial Sequence
  Synthetic
ctagctgcggtaataccctcacatgttacttgaaggcctctgcggcctgtcgagctgcaaagctccaggactgca

SEQ ID NO: 121458 - DNA, 75 bp, Artificial Sequence
  Synthetic
gcaagtcagctctcagcaccatcgctgaaggcgacatgcacgacgcatggcgcgcaccccgatgcagacctgata

SEQ ID NO: 121459 - DNA, 75 bp, Artificial Sequence
  Synthetic
cacagatgctacttcaatcctgggcattggcaccgtcctggaccaggcagaaactgccggggcaaggctcgtcgt

SEQ ID NO: 121460 - DNA, 75 bp, Artificial Sequence
  Synthetic
cacctggggcgcgaatgagacagatgtgttcctgctggagtccctgcggcctcccagtggtcggtggtttgggtg

SEQ ID NO: 121461 - DNA, 75 bp, Artificial Sequence
  Synthetic
ctgaatatgacgacagagagccatccatacctgcggagtgccacaggccgaagaggcccaagtttccaccagcac

SEQ ID NO: 121462 - DNA, 75 bp, Artificial Sequence
  Synthetic
gtcttagcgcattttcactccatagttactctccaggtgagatcaatagggtggcttcatgcctcagaaaacttg

SEQ ID NO: 121463 - DNA, 75 bp, Artificial Sequence
  Synthetic
ttcgtgcgcgcacaagggctcattcgtgcatgcatgttggcgcggaaagtcgtggggggtcattacgtccaaatg

SEQ ID NO: 121464 - DNA, 75 bp, Artificial Sequence
  Synthetic
ggggaagacacctcatcttctgccactcaaagaagaaatgtgacgagctcgccgcaaagttggttgccttaggcg

SEQ ID NO: 121465 - DNA, 75 bp, Artificial Sequence
  Synthetic
tcaatcaccacacctcattccaacatagaggaggttgctctgccgacgacgggagaaatccctttctacggcaag

SEQ ID NO: 121466 - DNA, 75 bp, Artificial Sequence
  Synthetic
cggacgtcttcgtccttaacaacaccaggccaccgctgggcaattggttcggttgtacctggatgaactcaactg

SEQ ID NO: 121467 - DNA, 75 bp, Artificial Sequence
  Synthetic
ctccgggcagcctccagttccgccgcctaggaagaagaggacagtgcgcctggatgagtccgttgtagcagaggc

SEQ ID NO: 121468 - DNA, 75 bp, Artificial Sequence
  Synthetic
gtgtgatggcaggtctggcctacttctccatgcagggcaattgggccaaggtctttatcaccttgctgctgtttt

SEQ ID NO: 121469 - DNA, 75 bp, Artificial Sequence
  Synthetic
tcaatgccgtcgcctattacaggggcctggacgtctcggtgataccagcatccggggacgtcgtggtttgcgcca

SEQ ID NO: 121470 - DNA, 75 bp, Artificial Sequence
  Synthetic
gatggcgaagctgacgccgcttctgacgcagagtcttacagctctatgccgcctcttgagggcgagccaggcgac

SEQ ID NO: 121471 - DNA, 75 bp, Artificial Sequence
  Synthetic
acgcagagtcttacagctctatgccgcctcttgagggcgagccaggcgacccagacctcagctcaggatcttggt

SEQ ID NO: 121472 - DNA, 75 bp, Artificial Sequence
  Synthetic
gcaggtgggggacttccactacgtgacgggtatgactactgacaatctcaaatgcccgtgccaggtcccatcgcc

SEQ ID NO: 121473 - DNA, 75 bp, Artificial Sequence
  Synthetic
gttactctccaggtgaaatcaatagggtggcttcatgcctcaggaaacttggggtaccgcccttgcgagcctgga

SEQ ID NO: 121474 - DNA, 75 bp, Artificial Sequence
  Synthetic
catgcctcaggaaacttggggtaccacccttgcgagtctggagacatcgggccagaagtgtccgcgctaagctac

SEQ ID NO: 121475 - DNA, 75 bp, Artificial Sequence
  Synthetic
gttagtcaactccaatgggtcatggcacataaaccgtacagccctaaactgcaatgattctttacagactggctt

SEQ ID NO: 121476 - DNA, 75 bp, Artificial Sequence
  Synthetic
ccaggggagcgaccatctggcatgtttgactcatctgttctctgtgagtgctatgacgcgggttgtgcctggtat

SEQ ID NO: 121477 - DNA, 75 bp, Artificial Sequence
  Synthetic
ctagccttacaggccgggacaagaaccaggttgagggggaggttcaagtggtttccaccgcaacacaatctttcc

SEQ ID NO: 121478 - DNA, 75 bp, Artificial Sequence
  Synthetic
gcccataaatcccttgagcaattctctcatccgacaccacaaactggtgtactccacaacatcccggagtgccgc

SEQ ID NO: 121479 - DNA, 75 bp, Artificial Sequence
  Synthetic
gcccataaatcccttgagcaattctctcatccgacaccacaatctggtgtactccacaacatcccggagtgccgc

SEQ ID NO: 121480 - DNA, 75 bp, Artificial Sequence
  Synthetic
gcccataaatcccttgagcaattctctcatccgacaccacaacctggtgtactccacaacatcccggagtgccgc

SEQ ID NO: 121481 - DNA, 75 bp, Artificial Sequence
  Synthetic
gcccataaatcccttgagcaattctctcatccgacaccacaagctggtgtactccacaacatcccggagtgccgc

SEQ ID NO: 121482 - DNA, 75 bp, Artificial Sequence
  Synthetic
ttgatttcagcttggaccctaccttctccattgagacaaccaccgtacctcaggatgcagtgtcccgaagtcaac

SEQ ID NO: 121483 - DNA, 75 bp, Artificial Sequence
  Synthetic
ttgatttcagcttggaccctaccttctccattgagactaccaccgtacctcaggatgcagtgtcccgaagtcaac

SEQ ID NO: 121484 - DNA, 75 bp, Artificial Sequence
  Synthetic
ttgatttcagcttggaccctaccttctccattgagaccaccaccgtacctcaggatgcagtgtcccgaagtcaac

SEQ ID NO: 121485 - DNA, 75 bp, Artificial Sequence
  Synthetic
ttgatttcagcttggaccctaccttctccattgagacgaccaccgtacctcaggatgcagtgtcccgaagtcaac

SEQ ID NO: 121486 - DNA, 75 bp, Artificial Sequence
  Synthetic
ccgttgaggtatgcaaatatctccggcccctccgaggacagaccgtattgctggcactacccccctaggccttgt

SEQ ID NO: 121487 - DNA, 75 bp, Artificial Sequence
  Synthetic
tcacaggcctcacccaaatagatgcacactttctgtcccagacaaagcagagcggggaaaactttccataccttg

SEQ ID NO: 121488 - DNA, 75 bp, Artificial Sequence
  Synthetic
tcacaggcctcacccaaatagatgctcactttctgtcccagacaaagcagagcggggaaaactttccataccttg

SEQ ID NO: 121489 - DNA, 75 bp, Artificial Sequence
  Synthetic
tcacaggcctcacccaaatagatgcccactttctgtcccagacaaagcagagcggggaaaactttccataccttg

SEQ ID NO: 121490 - DNA, 75 bp, Artificial Sequence
  Synthetic
tcacaggcctcacccaaatagatgcgcactttctgtcccagacaaagcagagcggggaaaactttccataccttg

SEQ ID NO: 121491 - DNA, 75 bp, Artificial Sequence
  Synthetic
tcacaggcctcacccatatagatgcacactttctgtcccagacaaagcagagcggggaaaactttccataccttg

SEQ ID NO: 121492 - DNA, 75 bp, Artificial Sequence
  Synthetic
tcacaggcctcacccatatagatgctcactttctgtcccagacaaagcagagcggggaaaactttccataccttg

SEQ ID NO: 121493 - DNA, 75 bp, Artificial Sequence
  Synthetic
tcacaggcctcacccatatagatgcccactttctgtcccagacaaagcagagcggggaaaactttccataccttg

SEQ ID NO: 121494 - DNA, 75 bp, Artificial Sequence
  Synthetic
tcacaggcctcacccatatagatgcgcactttctgtcccagacaaagcagagcggggaaaactttccataccttg

SEQ ID NO: 121495 - DNA, 75 bp, Artificial Sequence
  Synthetic
tcacaggcctcacccacatagatgcacactttctgtcccagacaaagcagagcggggaaaactttccataccttg

SEQ ID NO: 121496 - DNA, 75 bp, Artificial Sequence
  Synthetic
tcacaggcctcacccacatagatgctcactttctgtcccagacaaagcagagcggggaaaactttccataccttg

SEQ ID NO: 121497 - DNA, 75 bp, Artificial Sequence
  Synthetic
tcacaggcctcacccacatagatgcccactttctgtcccagacaaagcagagcggggaaaactttccataccttg

SEQ ID NO: 121498 - DNA, 75 bp, Artificial Sequence
  Synthetic
tcacaggcctcacccacatagatgcgcactttctgtcccagacaaagcagagcggggaaaactttccataccttg

SEQ ID NO: 121499 - DNA, 75 bp, Artificial Sequence
  Synthetic
tcacaggcctcacccagatagatgcacactttctgtcccagacaaagcagagcggggaaaactttccataccttg

SEQ ID NO: 121500 - DNA, 75 bp, Artificial Sequence
  Synthetic
tcacaggcctcacccagatagatgctcactttctgtcccagacaaagcagagcggggaaaactttccataccttg

SEQ ID NO: 121501 - DNA, 75 bp, Artificial Sequence
  Synthetic
tcacaggcctcacccagatagatgcccactttctgtcccagacaaagcagagcggggaaaactttccataccttg

SEQ ID NO: 121502 - DNA, 75 bp, Artificial Sequence
  Synthetic
tcacaggcctcacccagatagatgcgcactttctgtcccagacaaagcagagcggggaaaactttccataccttg

SEQ ID NO: 121503 - DNA, 75 bp, Artificial Sequence
  Synthetic
catgcggcaaaagaaggttaccttcgaccgcacacaggtcttggatcaatactacaatgatgtagtcaaggagac

SEQ ID NO: 121504 - DNA, 75 bp, Artificial Sequence
  Synthetic
tgcctactcctactttccgtaggggtaggcatctacctgctccccaaccgatgaacggggagctaaacactccag

SEQ ID NO: 121505 - DNA, 75 bp, Artificial Sequence
  Synthetic
tggcgtaccaggccactgtgtgcgccagggcgcaagcccctcccccgtcatgggaccagatgtggaaatgcctgt

SEQ ID NO: 121506 - DNA, 75 bp, Artificial Sequence
  Synthetic
ctggcactacccccctaggccttgtgacatcatcccagcacaatccgtctgtggaccagtctactgcttcacacc

SEQ ID NO: 121507 - DNA, 75 bp, Artificial Sequence
  Synthetic
gctaaagatgtccggagccatgctagcaaggccattaaccatatcaactccgtatggaaggacttgttagaagac

SEQ ID NO: 121508 - DNA, 75 bp, Artificial Sequence
  Synthetic
ccccaaggtcggtggtttggttgcacgtggatgaatggtacggggtttgtgaaaacgtgcggagcccccccctgc

SEQ ID NO: 121509 - DNA, 75 bp, Artificial Sequence
  Synthetic
ctggactccttcgatccgctcgtggcggaggaggatgagcgggagatctccgtgcccgcagaaattctgcggaag

SEQ ID NO: 121510 - DNA, 75 bp, Artificial Sequence
  Synthetic
ccccaaacaccaattcctacaaccatcatggcaaagaacgaggttttttgcgtggatgcctcgaagggagggcgt

SEQ ID NO: 121511 - DNA, 75 bp, Artificial Sequence
  Synthetic
tgggacaccatgtggaagtgtctgttgcgcctcaagcccacgctacacggccccactcccctcctttataggcgg

SEQ ID NO: 121512 - DNA, 75 bp, Artificial Sequence
  Synthetic
gcccttcaagtgtgggtcccccccttacttgcacgcgggagtagggacggtgtcatcctgctaacaagcctgctt

SEQ ID NO: 121513 - DNA, 75 bp, Artificial Sequence
  Synthetic
ggccccgaccagcgcccctactgctggcactaccccccaaaaccttgcggtattgtgcccgcgaagagtgtgtgt

SEQ ID NO: 121514 - DNA, 75 bp, Artificial Sequence
  Synthetic
acccgacaggacggtcctgtaccaggagttcgatgaaatggaggagtgctcgtcgcaccttccgtacatcgagca

SEQ ID NO: 121515 - DNA, 75 bp, Artificial Sequence
  Synthetic
gtgcttggttgactacccatatcggctgtggcactacccatgtactgtaaacttcaccatccacaaggtcagaat

SEQ ID NO: 121516 - DNA, 75 bp, Artificial Sequence
  Synthetic
gagaagcttatggctttcagtattcgcccaagcagcgggtggactacctgctcaagatgtggcgttctaagagga

SEQ ID NO: 121517 - DNA, 75 bp, Artificial Sequence
  Synthetic
tagtaggcggcatcctggcggctctggctgcatactgcttgtcagtcggcagcgtggtgatcgtcgggagggtcg

SEQ ID NO: 121518 - DNA, 75 bp, Artificial Sequence
  Synthetic
caggtgcttcgactctacagtcacggagcatgacatcaaaactgagcgggacgtctacctatcctgcaacttgga

SEQ ID NO: 121519 - DNA, 75 bp, Artificial Sequence
  Synthetic
atcaaggtcatcacctggggcgcggacacagcggcttgcggagatattctttgcgggctgcccgtctctgcgcga

SEQ ID NO: 121520 - DNA, 75 bp, Artificial Sequence
  Synthetic
tttgctaagctcgaacagttttgggcaaagcatatgtggaacttcatcagcggcatccaatatctcgccggcttg

SEQ ID NO: 121521 - DNA, 75 bp, Artificial Sequence
  Synthetic
cgagcaagcggcgtgcttaccacgagtctgggcaacactatgacctgctacataaaagccaaggcagcctgccgc

SEQ ID NO: 121522 - DNA, 75 bp, Artificial Sequence
  Synthetic
cgtgcaagcggcgtgcttaccacgagtctgggcaacactatgacctgctacataaaagccaaggcagcctgccgc

SEQ ID NO: 121523 - DNA, 75 bp, Artificial Sequence
  Synthetic
cgcgcaagcggcgtgcttaccacgagtctgggcaacactatgacctgctacataaaagccaaggcagcctgccgc

SEQ ID NO: 121524 - DNA, 75 bp, Artificial Sequence
  Synthetic
cgggcaagcggcgtgcttaccacgagtctgggcaacactatgacctgctacataaaagccaaggcagcctgccgc

SEQ ID NO: 121525 - DNA, 75 bp, Artificial Sequence
  Synthetic
gcagcaggcctcaccaattatgacatgttggtctgcggagacgacctggtagtcatcgccgagagcgctggggtc

SEQ ID NO: 121526 - DNA, 75 bp, Artificial Sequence
  Synthetic
gtccgggttctggaggacggcgttaactacgcaacagggaatcttcccggttgctccttttctatcttccttctg

SEQ ID NO: 121527 - DNA, 75 bp, Artificial Sequence
  Synthetic
tcctcgccgcgctgttctacacacacaggttcaacgcgtccggatgcccagagcgcatggccagctgccgcccca

SEQ ID NO: 121528 - DNA, 75 bp, Artificial Sequence
  Synthetic
ggatatggcgcgggcgtggcgggagctctcgtcgcattcaagatcatgagcggcgagaccccatctgctgaagac

SEQ ID NO: 121529 - DNA, 75 bp, Artificial Sequence
  Synthetic
ggatatggcgcgggcgtggcgggagctctcgtcgcattcaagatcatgagcggcgagaccccttctgctgaagac

SEQ ID NO: 121530 - DNA, 75 bp, Artificial Sequence
  Synthetic
ggatatggcgcgggcgtggcgggagctctcgtcgcattcaagatcatgagcggcgagaccccctctgctgaagac

SEQ ID NO: 121531 - DNA, 75 bp, Artificial Sequence
  Synthetic
ggatatggcgcgggcgtggcgggagctctcgtcgcattcaagatcatgagcggcgagaccccgtctgctgaagac

SEQ ID NO: 121532 - DNA, 75 bp, Artificial Sequence
  Synthetic
cgccgcaaagctgtcaggcctcggactcaatgccgtagcgtattaccggggtcttgacgtgtccgtcataccgac

SEQ ID NO: 121533 - DNA, 75 bp, Artificial Sequence
  Synthetic
tatacgagatggaggacgcgatcctgcatttgccggggtgcgtgccctgcgttcgcgagggcaacacctcccgat

SEQ ID NO: 121534 - DNA, 75 bp, Artificial Sequence
  Synthetic
cgtggcccacgaccacactggacagagatattactacctcactcgtgaccccgtcataccactatcccgggctgc

SEQ ID NO: 121535 - DNA, 75 bp, Artificial Sequence
  Synthetic
gttcgcgagggcaacacctcccgatgttggatggcgctctcccccactctcgcggcgcgggacctaagcttctcc

SEQ ID NO: 121536 - DNA, 75 bp, Artificial Sequence
  Synthetic
ccgtgcagtggatgaaccggctgatcgcgtttgcctcgcggggaaaccacgtatcccccacgcactacgtgcctg

SEQ ID NO: 121537 - DNA, 75 bp, Artificial Sequence
  Synthetic
ttccagatactccagtcccaggaacagcttgataaggtgcttgacttcgacatatacggggtcacttactcaatt

SEQ ID NO: 121538 - DNA, 75 bp, Artificial Sequence
  Synthetic
agcttgataaggtgcttgacttcgacatatacggggtcacttactcaattaatccactccaactccctgctataa

SEQ ID NO: 121539 - DNA, 75 bp, Artificial Sequence
  Synthetic
cgcttttgcgtcgcggggcaatcatgtgtcccctactcactatgttccagaatccgacgcagcggcccgcgtaac

SEQ ID NO: 121540 - DNA, 75 bp, Artificial Sequence
  Synthetic
agtgggtgagctcagactgcaccaccccatgttccggttcctggttaagggaaatctgggactggatatgtgagg

SEQ ID NO: 121541 - DNA, 75 bp, Artificial Sequence
  Synthetic
ttcggggcatgttgcggggatctttagggccgctgtgtgcaccagaggtgtagcaaaagccctacagttcatacc

SEQ ID NO: 121542 - DNA, 75 bp, Artificial Sequence
  Synthetic
attgagggcttggaggcatcgagcccgcgcggtccgagcaaagctcatcgcccaggggggaaacgccgcaatttg

SEQ ID NO: 121543 - DNA, 75 bp, Artificial Sequence
  Synthetic
gttctagcggggttggcttactattccatggctggcaactgggctaaggtggtggttgtgttgctgctcttcgcg

SEQ ID NO: 121544 - DNA, 75 bp, Artificial Sequence
  Synthetic
acctttatgaccacctttctccaatgcgggattgggccgcagacggtcttaaagacctggctgtagctactgaac

SEQ ID NO: 121545 - DNA, 75 bp, Artificial Sequence
  Synthetic
gacatgtcaaaaacgggtcgatgaggattgttggctccaagacctgcaggaacacctggaacgggacgttcccca

SEQ ID NO: 121546 - DNA, 75 bp, Artificial Sequence
  Synthetic
ttgtcaacagtaatggcagttggcatatcaaccgcactgccttgaattgcaacgacagccttaacaccggctttc

SEQ ID NO: 121547 - DNA, 75 bp, Artificial Sequence
  Synthetic
ggccttgtggtactgcctgatagggtgcttgcgagtgccccgggaggtctcgtagaccgtgcaccatgagcacaa

SEQ ID NO: 121548 - DNA, 75 bp, Artificial Sequence
  Synthetic
aatcaccttcaacgcgtctgatcgtggacagaacatcgaggaccagcggccatactgctggcactaccctccgcg

SEQ ID NO: 121549 - DNA, 75 bp, Artificial Sequence
  Synthetic
ccgaggaatacgtggaaattcgcagggtgggggagtcgcattatgtcaccgggatgactcaagacaacatcaagt

SEQ ID NO: 121550 - DNA, 75 bp, Artificial Sequence
  Synthetic
tacctggtggggtcgcagcttccctgcgagcctgaaccagatgtatccgtgttgacgtccatgctcacggacccc

SEQ ID NO: 121551 - DNA, 75 bp, Artificial Sequence
  Synthetic
gacaccttatcttttgccattccaagaaaaaatgtgatgagatagcatccaaactcagaggcatggggctcaacg

SEQ ID NO: 121552 - DNA, 75 bp, Artificial Sequence
  Synthetic
acgtacacctggggggcaaacgactcagacgttgtcgtcctgaacagcaccagaccgcccggcggggcatggttt

SEQ ID NO: 121553 - DNA, 75 bp, Artificial Sequence
  Synthetic
gccaacctcctgtggaggcaggagatgggcggaaacatcaccagggtagagtcagagaacaaggtggtaatcctg

SEQ ID NO: 121554 - DNA, 75 bp, Artificial Sequence
  Synthetic
cagctgtctgctccatccttgaaagccacgtgtgccgcccacgacacgccgggttccgacctcattgaagcaaac

SEQ ID NO: 121555 - DNA, 75 bp, Artificial Sequence
  Synthetic
actgcttccgcaagcatccgggagcgtcctacaccaagtgtggctccggcccctggctcacccccaggtgcctgg

SEQ ID NO: 121556 - DNA, 75 bp, Artificial Sequence
  Synthetic
tttgggcatcgccagattataaccctccactgctagagtcatggaaaagacctgactacgaaccacctgtcgtcc

SEQ ID NO: 121557 - DNA, 75 bp, Artificial Sequence
  Synthetic
atcttcaagatcaggatgtatgtgggaggggtcgagcacaggttggacgcggcgtgtaactggacgcggggcgag

SEQ ID NO: 121558 - DNA, 75 bp, Artificial Sequence
  Synthetic
ggaaggtgcttgtggacattctggcaggttatggagcaggggtggcgggcgcacttgtggcctttaagatcatga

SEQ ID NO: 121559 - DNA, 75 bp, Artificial Sequence
  Synthetic
tccctgccatcctctctcctggtgccctggtcgtcggggtcgtgtgcgcagcaatactgcgtcggcatgtgggcc

SEQ ID NO: 121560 - DNA, 75 bp, Artificial Sequence
  Synthetic
tctccgttgaagcggagattctgcgcaccaccaagaagtttcctacggccatcccaattttggctcggccggagt

SEQ ID NO: 121561 - DNA, 75 bp, Artificial Sequence
  Synthetic
aagaagaggacggtggtgctgagcgagtcaactgtttcttccgccctggctgagctcgccaccaagagctttggc

SEQ ID NO: 121562 - DNA, 75 bp, Artificial Sequence
  Synthetic
caccaccaagaagtttcctacggccatcccaattttggctcggccggagtacaatcctcccctagttgacacttg

SEQ ID NO: 121563 - DNA, 75 bp, Artificial Sequence
  Synthetic
ccatatcgaccggcctgatccacctgcaccaaaacatcgtggacgtgcagtacctatacgggatagggtcggccg

SEQ ID NO: 121564 - DNA, 75 bp, Artificial Sequence
  Synthetic
gacgcgaaccgttacgactggagcaaaactcacgtactccacgtacggcaagttccttgctgacgggggctgttc

SEQ ID NO: 121565 - DNA, 75 bp, Artificial Sequence
  Synthetic
atggagaccaagatcatcacctggggggcagacaccgcggcatgcggggacatcatcttgggtctgcccgtctcc

SEQ ID NO: 121566 - DNA, 75 bp, Artificial Sequence
  Synthetic
ccatgcccccccttgagggggagcctggggatcctgatcttagcgacggctcgtggtcgacggtcagtagcgagg

SEQ ID NO: 121567 - DNA, 75 bp, Artificial Sequence
  Synthetic
tcaggcggaggcagccttggagaacctgattgtgcttaacgcggcatcactggccggggtgcacggcaccatggc

SEQ ID NO: 121568 - DNA, 75 bp, Artificial Sequence
  Synthetic
gatgggtcttactcatcgatgcctccacttgaaggcgagcccggcgacccggacttgacaacagactcttggtcc

SEQ ID NO: 121569 - DNA, 75 bp, Artificial Sequence
  Synthetic
ggtgctggaccaggcggagaccgctggagtaaggctgacagtcttggctactgcaactccccctgggagcgttac

SEQ ID NO: 121570 - DNA, 75 bp, Artificial Sequence
  Synthetic
tctaagcaattccctgctgcgccaccataacctggtttactccaccacctcgcgcagcgccagccaaaggcagaa

SEQ ID NO: 121571 - DNA, 75 bp, Artificial Sequence
  Synthetic
atggcactgccccaccgggcatatgccttcaaccaggagatggctgcgtcatgtggaggcgtcgtccttgtctgc

SEQ ID NO: 121572 - DNA, 75 bp, Artificial Sequence
  Synthetic
gcagcggaagaatccaagctgccaattagccccctgagtaactcgcttctgcgccatcacaacatggtgtatgcc

SEQ ID NO: 121573 - DNA, 75 bp, Artificial Sequence
  Synthetic
ccttcaaccaggagatggctgcgtcatgtggaggcgtcgtccttgtctgcctgacccttctctccctgacaccaa

SEQ ID NO: 121574 - DNA, 75 bp, Artificial Sequence
  Synthetic
cttatgactgggtatacaggggattttgactctgtaatagactgcaacgtagctgtagaacagtacgttgatttc

SEQ ID NO: 121575 - DNA, 75 bp, Artificial Sequence
  Synthetic
ggatgtccgaagccattcccgcaaggccattaaccacatcaactccgtgtgggaggacttgctggaagacgcagt

SEQ ID NO: 121576 - DNA, 75 bp, Artificial Sequence
  Synthetic
cagagggttgcgggcggccagtatgtgcagatggcactcatcaaacttggggcatggacgggcacctacatatat

SEQ ID NO: 121577 - DNA, 75 bp, Artificial Sequence
  Synthetic
tgcgcgtgtgcgagaagatggccttgtacgaggtagtaaagaaactccctccagccgtgatgggaagtgcctacg

SEQ ID NO: 121578 - DNA, 75 bp, Artificial Sequence
  Synthetic
tacacctattccaaccactatcatggcaaaaaatgaggttttctccgtcaaaccggagaaagggggccgaaagcc

SEQ ID NO: 121579 - DNA, 75 bp, Artificial Sequence
  Synthetic
tcatcactggggcggatgcagcggcgtgtggcgacatcatccaaggcctgcccgtctctgcccgcaggggtaggg

SEQ ID NO: 121580 - DNA, 75 bp, Artificial Sequence
  Synthetic
ttcaacagttactgagagtgacatccgtacggaagaggcgatctaccaatgctgtgacctggaccctcaggcccg

SEQ ID NO: 121581 - DNA, 75 bp, Artificial Sequence
  Synthetic
acacgtggggggagaatgagacagatgtcttcctattgaacagcactcgaccaccgctggggtcatggttcggct

SEQ ID NO: 121582 - DNA, 75 bp, Artificial Sequence
  Synthetic
cgtacggaagaggcgatctaccaatgctgtgacctggaccctcaggcccgagtggccatcaagtctctcacagag

SEQ ID NO: 121583 - DNA, 75 bp, Artificial Sequence
  Synthetic
cgtacggaagaggcgatctaccaatgctgtgacctggaccctcaggcccgtgtggccatcaagtctctcacagag

SEQ ID NO: 121584 - DNA, 75 bp, Artificial Sequence
  Synthetic
cgtacggaagaggcgatctaccaatgctgtgacctggaccctcaggcccgcgtggccatcaagtctctcacagag

SEQ ID NO: 121585 - DNA, 75 bp, Artificial Sequence
  Synthetic
cgtacggaagaggcgatctaccaatgctgtgacctggaccctcaggcccgggtggccatcaagtctctcacagag

SEQ ID NO: 121586 - DNA, 75 bp, Artificial Sequence
  Synthetic
tatcgtcaccagcctcactggccgcgacaacaacacggtggagggggaggtgcaaattgtgtcgactgcgaacca

SEQ ID NO: 121587 - DNA, 75 bp, Artificial Sequence
  Synthetic
ggaaacacactgacgtgctatcttaaggccacagccgccacaagggcggctggcctaaaggactgcaccatgctg

SEQ ID NO: 121588 - DNA, 75 bp, Artificial Sequence
  Synthetic
tacaccaacgtcgaccaagacctcgtagggtggcaagccccagccggggcgcgctctcttacgccctgcacatgt

SEQ ID NO: 121589 - DNA, 75 bp, Artificial Sequence
  Synthetic
ggccttgcctactattccatggtggggaactgggctaaggttttgattgtgatgctactttttgccggcgttgac

SEQ ID NO: 121590 - DNA, 75 bp, Artificial Sequence
  Synthetic
cctacttcaaaggttcgtccggcggcccactgctctgctcctccggacacgtcgcgggtctctttagggccgcgg

SEQ ID NO: 121591 - DNA, 75 bp, Artificial Sequence
  Synthetic
cccatgacgggaacgggaaaagggtctactacctgacccgtgatcccgagatccccctggcacgagctgcctggg

SEQ ID NO: 121592 - DNA, 75 bp, Artificial Sequence
  Synthetic
ggccaacaacaagctgacattcagcccctgttagagtccaagtggcaaaagctggaagttttctggcgcaaacat

SEQ ID NO: 121593 - DNA, 75 bp, Artificial Sequence
  Synthetic
cctcacaaaatacatcgtccgatgggagtgggtaatactcttattcctgctcttagcggacgccagggtttgcgc

SEQ ID NO: 121594 - DNA, 75 bp, Artificial Sequence
  Synthetic
cccactgctctgctcctccggacacgtcgcgggtctctttagggccgcggtgtgcacgcgtggggttgcaaaggc

SEQ ID NO: 121595 - DNA, 75 bp, Artificial Sequence
  Synthetic
acaccaggccaccgttgggcaattggttcggttgcacctggatgaactcgtctggatttaccaaagtgtgcggag

SEQ ID NO: 121596 - DNA, 75 bp, Artificial Sequence
  Synthetic
cctaacatcaggaccggggtgcggaccattaccacaggggcccccattacatactccacctacggcaagttcctt

SEQ ID NO: 121597 - DNA, 75 bp, Artificial Sequence
  Synthetic
gggctgccacgtgtggcaaatacctcttcaactgggcagtgagaaccaagctcaaactcactccaatcccggccg

SEQ ID NO: 121598 - DNA, 75 bp, Artificial Sequence
  Synthetic
tgatcactctctttactctcacccccgggtataagacccttctcagccggtttttgtggtggttgtgctatcttc

SEQ ID NO: 121599 - DNA, 75 bp, Artificial Sequence
  Synthetic
tgaccctgggggaagctatggtccaggagtgggcaccacctatgcaggtgcgcggtggccgtgatggcatcatat

SEQ ID NO: 121600 - DNA, 75 bp, Artificial Sequence
  Synthetic
ggagtgggcaccacctatgcaggtgcgcggtggccgtgatggcatcatatgggccgtcgccatattctacccagg

SEQ ID NO: 121601 - DNA, 75 bp, Artificial Sequence
  Synthetic
accaggcggagacggctggagctcgacttgtcgtgctcgccaccgccacaccaccaggatcagtcaccgtgcccc

SEQ ID NO: 121602 - DNA, 75 bp, Artificial Sequence
  Synthetic
acccgaacatagaggaggtggcgttgaccaatgagggggaaatccccttctacggcaaggccattcctcttgcta

SEQ ID NO: 121603 - DNA, 75 bp, Artificial Sequence
  Synthetic
tggaccctaccttcaccattgagacgacgaccgtgcctcaagacgcggtgtcgcgctcgcagcggcgaggcagga

SEQ ID NO: 121604 - DNA, 75 bp, Artificial Sequence
  Synthetic
aacgaggactatccaagcccttgtgctggtgactggctatatgacatctggaactggatctgcactgtgctcagt

SEQ ID NO: 121605 - DNA, 75 bp, Artificial Sequence
  Synthetic
gggtgatgacaacgcgctgcccctgcgggaagatgttgaccggacatgtcaagaacgggtccatgaggatggtgg

SEQ ID NO: 121606 - DNA, 75 bp, Artificial Sequence
  Synthetic
acgcccactacattgtgggggccacagatgacaacttgaaatgcccatgtcaggtgccagcaccagagttcttca

SEQ ID NO: 121607 - DNA, 75 bp, Artificial Sequence
  Synthetic
aggcgccaagcagaacatccaactgatcaacaccaacggcagttggcacatcaatagcacggccttgaactgcaa

SEQ ID NO: 121608 - DNA, 75 bp, Artificial Sequence
  Synthetic
tcaactcttcaggctgtcccgagaggttggccagctgccgacgccttaccgattttgcccagggctggggcccta

SEQ ID NO: 121609 - DNA, 75 bp, Artificial Sequence
  Synthetic
catgcaaaccacctgcccatgtggagcacagatcaccggacatgtcaaaaacggttccatgaggatcgttgggcc

SEQ ID NO: 121610 - DNA, 75 bp, Artificial Sequence
  Synthetic
ccagtcagacctacatggccaccaatgactgttccaacagcagcatcacgtggcaacttgagggcgcggtactac

SEQ ID NO: 121611 - DNA, 75 bp, Artificial Sequence
  Synthetic
ggccgctctggccgcgtactgcctggcgacgggcagcgtggtcatagtgggcagggtagtcctttccaacaaacc

SEQ ID NO: 121612 - DNA, 75 bp, Artificial Sequence
  Synthetic
cgcggtcatacctgacagagaagtcctctaccaggagtttgatgagatggaagaatgtgccgcccacttgcctta

SEQ ID NO: 121613 - DNA, 75 bp, Artificial Sequence
  Synthetic
cggtgcctcccccccgcaagaagcggacagttcagcttgatgggtcgaacgtatctgcagcgctccgagcgcttg

SEQ ID NO: 121614 - DNA, 75 bp, Artificial Sequence
  Synthetic
gcggtgtgcacccgtggagtggctaaggcggtggactttatccccgtggagagcctagagacaaccatgaggtcc

SEQ ID NO: 121615 - DNA, 75 bp, Artificial Sequence
  Synthetic
acatcctggcaggatatggtgcgggcatttcgggggccctcgtcgcattcaagatcatgtctggcgagaagccct

SEQ ID NO: 121616 - DNA, 75 bp, Artificial Sequence
  Synthetic
tcatctcgaagcgccgctctacgccagaagaaggtcaccttcgacaggctgcaggtgctcgatgaccattacaaa

SEQ ID NO: 121617 - DNA, 75 bp, Artificial Sequence
  Synthetic
ctccccagacgctgacctcatcgaggccaatctcctgtggcggcaggagatgggcgggaacatcacccgcgtgga

SEQ ID NO: 121618 - DNA, 75 bp, Artificial Sequence
  Synthetic
gacttcacacatggatcaatgaggactgcaccacgccgtgctccggttcctggctcagtgagatctgggactgga

SEQ ID NO: 121619 - DNA, 75 bp, Artificial Sequence
  Synthetic
ccccgactaccaggggttcccttcttgtcctgccaacgcgggtacaggggggtttggcggggggacggtattatg

SEQ ID NO: 121620 - DNA, 75 bp, Artificial Sequence
  Synthetic
aaggcagaagaaagtcacatttgacagactgcaagtcctggacagccactaccaggacgtgctcaaggaggttaa

SEQ ID NO: 121621 - DNA, 75 bp, Artificial Sequence
  Synthetic
ggggcgtctcagaaaatccaacttataaacaccaacggcagctggcacatcaacagaaccgctctgaattgcaac

SEQ ID NO: 121622 - DNA, 75 bp, Artificial Sequence
  Synthetic
tgttggtgcggaaagtcgctggggatcactatgtccaaatggctctcatgaagctggccgcattgacgggtacgt

SEQ ID NO: 121623 - DNA, 75 bp, Artificial Sequence
  Synthetic
ccaacggcagctggcatatcaacagaactgccctgaactgcaacgagtctatcaacactgggtggcttgccgcgc

SEQ ID NO: 121624 - DNA, 75 bp, Artificial Sequence
  Synthetic
ttggccacctactcgtacctcggcttgtggtctttcagcctcctgctcctggcacttccccaacaggcctatgcc

SEQ ID NO: 121625 - DNA, 75 bp, Artificial Sequence
  Synthetic
aactgccctgaactgcaacgagtctatcaacactgggtggcttgccgcgctgttctacacacacaagttcaacgc

SEQ ID NO: 121626 - DNA, 75 bp, Artificial Sequence
  Synthetic
tcaacaacacgcggccgccgcagggcaactggttcggctgtacatggatgaatggcaccgggttcaccaagacgt

SEQ ID NO: 121627 - DNA, 75 bp, Artificial Sequence
  Synthetic
tggtgcctgaccgtccccgcttccgcagttccttaccgtaatgcttctggggtttatcatgtcactaatgattgc

SEQ ID NO: 121628 - DNA, 75 bp, Artificial Sequence
  Synthetic
tggctcggggccttggttgacacctaggtgcatagttgactatccatacagactttggcactacccctgcactgt

SEQ ID NO: 121629 - DNA, 75 bp, Artificial Sequence
  Synthetic
aagcttgggtgccctcccctacgagcgtggagacatcgggcacgagcggtgcgcgccaaacttatcgcccaggga

SEQ ID NO: 121630 - DNA, 75 bp, Artificial Sequence
  Synthetic
gcttgcccgtctgggcttcacccagctacaacccaccattgctcgagtcatggaaaaaacccgactacgagccgc

SEQ ID NO: 121631 - DNA, 75 bp, Artificial Sequence
  Synthetic
gataatgtcagtaggtgctgggtccaaatcacccccacgctgtcagccccgagcttcggagcagtcacggccctt

SEQ ID NO: 121632 - DNA, 75 bp, Artificial Sequence
  Synthetic
cgccgccatactttgcccgggtatagtgtttgacataactaagtggctcttggcaatcttgggaccttgccacct

SEQ ID NO: 121633 - DNA, 75 bp, Artificial Sequence
  Synthetic
ccaccgagacggaggaagcaggtcatcctaacagagtccactgtgtccgcagctcttgctgagcttgcggagaag

SEQ ID NO: 121634 - DNA, 75 bp, Artificial Sequence
  Synthetic
ccacaaatagttttgttagcttcttccgacagggcccccagcagaacatccagctgatcaaatccaacggcagtt

SEQ ID NO: 121635 - DNA, 75 bp, Artificial Sequence
  Synthetic
cttggcccgggaaagggcccaattacccaaatgtacaccaatgtagaccaggacctcgttggctggcagcggcct

SEQ ID NO: 121636 - DNA, 75 bp, Artificial Sequence
  Synthetic
gaacgacatttatcacagcgtgtcacgtgcccggtcccgccatttgctgctttgcctactcctactcaccgtagg

SEQ ID NO: 121637 - DNA, 75 bp, Artificial Sequence
  Synthetic
cgtactcctccatgccccccctagagggggagcctggggatcccgaccttagcgacgggtcctggtcgaccgtga

SEQ ID NO: 121638 - DNA, 75 bp, Artificial Sequence
  Synthetic
gggggagcctggggatcccgaccttagcgacgggtcctggtcgaccgtgagctccaccagcggtactgaagatgt

SEQ ID NO: 121639 - DNA, 75 bp, Artificial Sequence
  Synthetic
tttttttttttttttttttttttttttttttttttaaactttcctatctgtctatcttctagacttctttcttgg

SEQ ID NO: 121640 - DNA, 75 bp, Artificial Sequence
  Synthetic
ctaactgggccaaggttatactggtcttgtttctgtttgcaggagttgatggccgcacccatactgtgggcggta

SEQ ID NO: 121641 - DNA, 75 bp, Artificial Sequence
  Synthetic
tactgcccttaactgtaatgacagcctccagaccgggtttatagccggcctcatgtatgcccataaattcaactc

SEQ ID NO: 121642 - DNA, 75 bp, Artificial Sequence
  Synthetic
ctccagaccgggtttatagccggcctcatgtatgcccataaattcaactcttctgggtgtccagaacggatgtct

SEQ ID NO: 121643 - DNA, 75 bp, Artificial Sequence
  Synthetic
cggtcccagcccagaggtaggcgccagcccataccaaaggcgcgccgccagacgggccgtacctgggctcaacct

SEQ ID NO: 121644 - DNA, 75 bp, Artificial Sequence
  Synthetic
gtgtcccacttataactggggcagcaacgagactgacatccttctcttgaataacattaggccccccgctggcaa

SEQ ID NO: 121645 - DNA, 75 bp, Artificial Sequence
  Synthetic
ggcggaggtcccgcaacttgggtaaagtcatcgacaccctcacttgcggcttcgccgacctcatggggtacatcc

SEQ ID NO: 121646 - DNA, 75 bp, Artificial Sequence
  Synthetic
gtggccttgtccaacaccggagagattcccttctatggcaaagccatccccctcgagaccatcaagggggggagg

SEQ ID NO: 121647 - DNA, 75 bp, Artificial Sequence
  Synthetic
attgtgtatgagatggacggcatgatcctccacctgccggggtgcgtgccctgcgttcgggaaggaaactcctcg

SEQ ID NO: 121648 - DNA, 75 bp, Artificial Sequence
  Synthetic
cggagtgcaccactccgtgctccgattcctggctaagggacatctgggactggatatgcgaggtgctgagcgatt

SEQ ID NO: 121649 - DNA, 75 bp, Artificial Sequence
  Synthetic
ctgctttgactcaacagtcactgaggctgacatccgaacagaggagtccatataccaatgttgtgacctgcaccc

SEQ ID NO: 121650 - DNA, 75 bp, Artificial Sequence
  Synthetic
tcccacccagacggtcagaaagcacgtcgacttgttggttggggctgccacgctctgttcggccatgtacgtggg

SEQ ID NO: 121651 - DNA, 75 bp, Artificial Sequence
  Synthetic
tatatgaggcagacgatttcatcatgcatctccctggatgcatcccatgtgtcaggtcaggcaatgtgtctaagt

SEQ ID NO: 121652 - DNA, 75 bp, Artificial Sequence
  Synthetic
agagatagggccgagttgagcccgctcctgcacaccaccacacagtgggccatattgccgtgctccttcacacct

SEQ ID NO: 121653 - DNA, 75 bp, Artificial Sequence
  Synthetic
ctgctccgccatgtatgtgggcgatctgtgcggcggtgttttcctgctcgggcagctcttcaccttcagaccccg

SEQ ID NO: 121654 - DNA, 75 bp, Artificial Sequence
  Synthetic
agtgggaatacataatgctggtctttttactacttgctgatgcccgtatctgcacttgcctgttgatcttgctcc

SEQ ID NO: 121655 - DNA, 75 bp, Artificial Sequence
  Synthetic
gtctactacctgactcgtgaccctaccactcctctcgcgcgcgctgcgtgggaaacagctagacacactcctgtt

SEQ ID NO: 121656 - DNA, 75 bp, Artificial Sequence
  Synthetic
caccctcggcgctcagcagcggctccaacttgtaaacagcaatggctcctggcacatcaacaggacggccttaaa

SEQ ID NO: 121657 - DNA, 75 bp, Artificial Sequence
  Synthetic
gcaaccttggtcctgtcatacgctatgcgagtacctcaaatggtcatcgatatttttgtcggtggtcattggggc

SEQ ID NO: 121658 - DNA, 75 bp, Artificial Sequence
  Synthetic
ggaaacagctagacacactcctgttaactcctggcttggcaacatcataatgtttgcccccacactgtgggtgag

SEQ ID NO: 121659 - DNA, 75 bp, Artificial Sequence
  Synthetic
caagaacgtcattgtcctaaacgcggctgcggccgcagggaatcatgggttcttctggggcctgctcgttgtgtg

SEQ ID NO: 121660 - DNA, 75 bp, Artificial Sequence
  Synthetic
ccgatcacccacttcgatcaggggtatggtcgcatcacctactactcgccccatgacgagacgcaggagaattcc

SEQ ID NO: 121661 - DNA, 75 bp, Artificial Sequence
  Synthetic
ccattagacctacctccaataattgaaagactccatggcttaggcgcgttttcactccacagttactctccaagt

SEQ ID NO: 121662 - DNA, 75 bp, Artificial Sequence
  Synthetic
gccctggccctggactcaagcgatggcgggactgtgggttgtcttgtgctaattgttcttacaatctttacactt

SEQ ID NO: 121663 - DNA, 75 bp, Artificial Sequence
  Synthetic
tcggagcacaggcggggcggagtgcccaaggactcacgagcctgtttgcttcgggggctaagcagaacatccaac

SEQ ID NO: 121664 - DNA, 75 bp, Artificial Sequence
  Synthetic
aattgttcttacaatctttacacttacccctgggtacaaaaagaaggtagtgctggtcatgtggtggcttcagta

SEQ ID NO: 121665 - DNA, 75 bp, Artificial Sequence
  Synthetic
aggcgccaagcagaacatccagctgatcaacaccaacggcagttggcacatcaacagcacggccttgaactgcaa

SEQ ID NO: 121666 - DNA, 75 bp, Artificial Sequence
  Synthetic
tagtggtgggcacaacggacatcactggtgcccccaccttcacctcgggggccaatgacactgacttcctcctgc

SEQ ID NO: 121667 - DNA, 75 bp, Artificial Sequence
  Synthetic
aaggggggaaagccgccatctgcggcaagtaccttttcaactgggcggtaaaaaccaagctcaaactcactccat

SEQ ID NO: 121668 - DNA, 75 bp, Artificial Sequence
  Synthetic
cttcaactcttcaggatgtccacagcgccttagttcgtgcaaacccctttctgattacgatcaggggtggggtcc

SEQ ID NO: 121669 - DNA, 75 bp, Artificial Sequence
  Synthetic
aggcagtggcaacaagaccttgcactgccccacggactgtttccgcaagcatcctgaagccacctatgctaagtg

SEQ ID NO: 121670 - DNA, 75 bp, Artificial Sequence
  Synthetic
ctggttctgcctactcctactttccgtaggggtaggcgtctttttgctccccaaccgataggtggggagttaaac

SEQ ID NO: 121671 - DNA, 75 bp, Artificial Sequence
  Synthetic
ggcccggtatattgtttcacacctagccccgtggttgtcggcactactgacaggaagggagcaccgacttacagc

SEQ ID NO: 121672 - DNA, 75 bp, Artificial Sequence
  Synthetic
ggcccggtttattgtttcacacctagccccgtggttgtcggcactactgacaggaagggagcaccgacttacagc

SEQ ID NO: 121673 - DNA, 75 bp, Artificial Sequence
  Synthetic
ggcccggtctattgtttcacacctagccccgtggttgtcggcactactgacaggaagggagcaccgacttacagc

SEQ ID NO: 121674 - DNA, 75 bp, Artificial Sequence
  Synthetic
ggcccggtgtattgtttcacacctagccccgtggttgtcggcactactgacaggaagggagcaccgacttacagc

SEQ ID NO: 121675 - DNA, 75 bp, Artificial Sequence
  Synthetic
cgtatatgtctaaggcacatggtgtcgaccctaacatcagaaccggggtaaggaccatcaccacgggcgccccca

SEQ ID NO: 121676 - DNA, 75 bp, Artificial Sequence
  Synthetic
actccagcctcataggctaatcctgttttttttttttttttttttttttttttttttccttttccttttcttttc

SEQ ID NO: 121677 - DNA, 75 bp, Artificial Sequence
  Synthetic
gcctgggaaccccgcgatagcatcactaatggcattcacagcctctatcaccagcccgtttaccacccaacaaac

SEQ ID NO: 121678 - DNA, 75 bp, Artificial Sequence
  Synthetic
atgttcgtaggggggatagaacataggttcgaagctgcctgcaactggacgcggggcgagccctgcgctctagag

SEQ ID NO: 121679 - DNA, 75 bp, Artificial Sequence
  Synthetic
tgtccagctggttcgttgctggttacagcgggggagacatatatcacagcgtgtctcgtgcccgaccccgctggt

SEQ ID NO: 121680 - DNA, 75 bp, Artificial Sequence
  Synthetic
agacatgtggagccccgccgtgcaaactccagtctactgggaacaattcactgatctgcccctccgactgcttcc

SEQ ID NO: 121681 - DNA, 75 bp, Artificial Sequence
  Synthetic
aaggtcatcacgtggggggctgacacggccgcgtgtgggaacatacttgctgttcttccggtatcagctagacgg

SEQ ID NO: 121682 - DNA, 75 bp, Artificial Sequence
  Synthetic
ctgtagcgtattaccggggtcttgatgtgtccgtcataccgaccagcggagacgtcgttgtcgtggcaacagacg

SEQ ID NO: 121683 - DNA, 75 bp, Artificial Sequence
  Synthetic
ggcagcataggccttggaaaggtgctcgtggacatcttggcgggatatggggcgggggtggcaggcgcactcgtg

SEQ ID NO: 121684 - DNA, 75 bp, Artificial Sequence
  Synthetic
tgatccatctccaccaaaacatcgtggatgtacagtacttgtacggggtgggctctgttgtcacctcctgggtca

SEQ ID NO: 121685 - DNA, 75 bp, Artificial Sequence
  Synthetic
tactatgaactataccatccacaaggtccgcctcttcatcaatggtttggaacacaggtttgaagttgcatgcaa

SEQ ID NO: 121686 - DNA, 75 bp, Artificial Sequence
  Synthetic
tgcacacccctgggtgcgtgccctgcgttcgggaggccaacatctcccgctgctgggtagcgctcactcccacgc

SEQ ID NO: 121687 - DNA, 75 bp, Artificial Sequence
  Synthetic
cttggagaacttggttgtactcaatgccgcatccctcgctgggacgcatggcatagggtcctttatcatcttctt

SEQ ID NO: 121688 - DNA, 75 bp, Artificial Sequence
  Synthetic
ttcaccaccatgccagccttgtcaaccgggctgatacacctacaccaaaacatagtggacatccagtacctgtat

SEQ ID NO: 121689 - DNA, 75 bp, Artificial Sequence
  Synthetic
cgggcatacgctatggaccaggaggtggcggcgtcgtgcggaggccttgtactcgtttccctggtgctcttgacc

SEQ ID NO: 121690 - DNA, 75 bp, Artificial Sequence
  Synthetic
tgatgctactcgtctcacaagtagaggccgcgctggagaacttgatcgtcctcaacgccgcctccgcagccagcg

SEQ ID NO: 121691 - DNA, 75 bp, Artificial Sequence
  Synthetic
ttccgctcgtcggcgcccccctcgggggcgctgccaaggccttggcgcatggcgtccgggtcttggaagacggcg

SEQ ID NO: 121692 - DNA, 75 bp, Artificial Sequence
  Synthetic
cgaaggcgctcgagttcgtcccggtcgaaaacctggagaccacgatgcgctcacctgtgttcactgacaacagta

SEQ ID NO: 121693 - DNA, 75 bp, Artificial Sequence
  Synthetic
caactcctcggggctctatcatgtcaccaatgattgtcccaatgcgagtattgtgtacgaagcaggcgatgccat

SEQ ID NO: 121694 - DNA, 75 bp, Artificial Sequence
  Synthetic
tgaacgtccgaggagggcgggatgccatcatcctgcttgcgtgcgtggtccatccccacctcatgtttgacatca

SEQ ID NO: 121695 - DNA, 75 bp, Artificial Sequence
  Synthetic
actcttgcttctggtcctggcactgcctgagcgggcttatgcctttgaccgggagcaggcagcgtccattggggt

SEQ ID NO: 121696 - DNA, 75 bp, Artificial Sequence
  Synthetic
acctatactttcagggatcatttctatagtgtgttactagagaagtttctctgaacgtgtagagcaccgattgaa

SEQ ID NO: 121697 - DNA, 75 bp, Artificial Sequence
  Synthetic
acattaacaggactgctctgaattgcaatgactccctcaacaccgggttcattgccgcgctgatttacaaccaca

SEQ ID NO: 121698 - DNA, 75 bp, Artificial Sequence
  Synthetic
cctacgacgcaacttcggcgccacgtcgatttgctcgtggggagtgccacgctctgttcggcactgtacgtgggg

SEQ ID NO: 121699 - DNA, 75 bp, Artificial Sequence
  Synthetic
cttgctcgtgcggagggtggtggggggccagtacgtgcaaatggtgcttctcaaggcgggagcggccaccggcac

SEQ ID NO: 121700 - DNA, 75 bp, Artificial Sequence
  Synthetic
gaggcaataatccaacagtgggttcccagcctgcatgtccgtgggggtcgcgacgccgtgatcttactcacgtgc

SEQ ID NO: 121701 - DNA, 75 bp, Artificial Sequence
  Synthetic
acgtgaccggccaccggatggcctgggacatgatgatgaattggtctcccacagtggcgctggtgacggcccagg

SEQ ID NO: 121702 - DNA, 75 bp, Artificial Sequence
  Synthetic
acaaaggtcatcgtccacggggcggatgtggcggcgtgcggggacatccttcacggcctgccggtttccgctcga

SEQ ID NO: 121703 - DNA, 75 bp, Artificial Sequence
  Synthetic
acgtgcgcgcgcatgccctgctgcgggtgtgcctcctcttccgacgcctcgctggcggcaagtacgtccaggctg

SEQ ID NO: 121704 - DNA, 75 bp, Artificial Sequence
  Synthetic
acagtacttagcaggcttgtccactctgcctgggaaccccgcgatagcatcactgatggcattcacagcctctat

SEQ ID NO: 121705 - DNA, 75 bp, Artificial Sequence
  Synthetic
ggtactggtggtgctgctcctcttctctggtgtcgacgcggtgacgaccaccacggggggggctgcagcccacac

SEQ ID NO: 121706 - DNA, 75 bp, Artificial Sequence
  Synthetic
ggtggagccggtcgtcttttcgcctatggagaagaaggtcatcacttggggtgcggacactgcagcatgtggcga

SEQ ID NO: 121707 - DNA, 75 bp, Artificial Sequence
  Synthetic
tcctgggatgcatcatcaccagcctcacgggccgagacaaaaaccaggtggagggggaggtccagatcgtgtcca

SEQ ID NO: 121708 - DNA, 75 bp, Artificial Sequence
  Synthetic
ggcgccggcatcgccggcgcggctgttggcagcataggccttgggaaggtgcttgtggacatcctggcgggttat

SEQ ID NO: 121709 - DNA, 75 bp, Artificial Sequence
  Synthetic
tgtaatgacagccttaacaccgggtttattgctgcattgttctacacccacaaattcaactcctcggggtgtgtt

SEQ ID NO: 121710 - DNA, 75 bp, Artificial Sequence
  Synthetic
atcaccgcgtactgtcaacaaacccgtggtctagtggggacaattgttaccagcttaactggccgggacaggaat

SEQ ID NO: 121711 - DNA, 75 bp, Artificial Sequence
  Synthetic
catccagatgtacaccaatgtggacctagacctcgtcggctggcaggccccgcaaggggcccgctccctggttcc

SEQ ID NO: 121712 - DNA, 75 bp, Artificial Sequence
  Synthetic
ggcactaccctccccggaggtgtggcattgtgccggcgcagagcgtgtgcggccctgtgtactgcttcaccccta

SEQ ID NO: 121713 - DNA, 75 bp, Artificial Sequence
  Synthetic
agacccctctcgtacttgaaggggtcctcgggcgggccactgctatgcccctccgggcacgtcgtgggcttgttc

SEQ ID NO: 121714 - DNA, 75 bp, Artificial Sequence
  Synthetic
ctaagactttggccggccctaagggcccagtatgccagatgtataccaatgtggaccaggatatggtaggctggc

SEQ ID NO: 121715 - DNA, 75 bp, Artificial Sequence
  Synthetic
agcgggcaattggttcggttgcacctggatgaacagcaccgggttcaccaagacgtgtggcgcacctccatgcag

SEQ ID NO: 121716 - DNA, 75 bp, Artificial Sequence
  Synthetic
ccacgccgcctgctgtgcctcagacattccaagtggcgcatttgcacgcccccacggggagcggcaagagtacca

SEQ ID NO: 121717 - DNA, 75 bp, Artificial Sequence
  Synthetic
gagtgacacccgcgccggtctacttagtcccaggcctctggccacgcttaaggggtcgtcgggagggcctcttct

SEQ ID NO: 121718 - DNA, 75 bp, Artificial Sequence
  Synthetic
gtgtgacacccgcgccggtctacttagtcccaggcctctggccacgcttaaggggtcgtcgggagggcctcttct

SEQ ID NO: 121719 - DNA, 75 bp, Artificial Sequence
  Synthetic
gcgtgacacccgcgccggtctacttagtcccaggcctctggccacgcttaaggggtcgtcgggagggcctcttct

SEQ ID NO: 121720 - DNA, 75 bp, Artificial Sequence
  Synthetic
gggtgacacccgcgccggtctacttagtcccaggcctctggccacgcttaaggggtcgtcgggagggcctcttct

SEQ ID NO: 121721 - DNA, 75 bp, Artificial Sequence
  Synthetic
accccgcggtgcctggttgactatccctacaggctttggcactacccgtgtactgtcaactacaccttgtttaag

SEQ ID NO: 121722 - DNA, 75 bp, Artificial Sequence
  Synthetic
cgggatagaccctaacatcaggaccggtgtgaggaccatcaccaccggtgccgctataacgtactccacctacgg

SEQ ID NO: 121723 - DNA, 75 bp, Artificial Sequence
  Synthetic
accatgagagcccctgttttcactgacaactcgaccccacctgctgtgcctcagacttaccaagtggggtattta

SEQ ID NO: 121724 - DNA, 75 bp, Artificial Sequence
  Synthetic
tggcgggtggctgctgaggagtacgtggaggttacgcgggtgggggacttccactacgtgacgggcatgaccact

SEQ ID NO: 121725 - DNA, 75 bp, Artificial Sequence
  Synthetic
tcagcccgttgctgctatccaccacccagtggcaaattctcccatgctctttcacgaccctaccggccctgtcca

SEQ ID NO: 121726 - DNA, 75 bp, Artificial Sequence
  Synthetic
actgtgttagaccaagcggaaacgagcggggctcgacttgtcgtgctcgccaccgccacaccaccaggatcgatc

SEQ ID NO: 121727 - DNA, 75 bp, Artificial Sequence
  Synthetic
tagggttcggcagctacatgagcacagcccacgggatcgaacctaacatcaggactggtgccaggaccatcacga

SEQ ID NO: 121728 - DNA, 75 bp, Artificial Sequence
  Synthetic
tagggttcggcagctacatgagcacagcccacgggatcgatcctaacatcaggactggtgccaggaccatcacga

SEQ ID NO: 121729 - DNA, 75 bp, Artificial Sequence
  Synthetic
tagggttcggcagctacatgagcacagcccacgggatcgaccctaacatcaggactggtgccaggaccatcacga

SEQ ID NO: 121730 - DNA, 75 bp, Artificial Sequence
  Synthetic
tagggttcggcagctacatgagcacagcccacgggatcgagcctaacatcaggactggtgccaggaccatcacga

SEQ ID NO: 121731 - DNA, 75 bp, Artificial Sequence
  Synthetic
tctcctgttcttgctgctggcagacgctcgggtctgtgcctgcttgtggatgatgatgctcgtggcccaggcaga

SEQ ID NO: 121732 - DNA, 75 bp, Artificial Sequence
  Synthetic
tactcctccatgcccccccttgagggggagccgggggaccccgatctcagcgacgggtcttggtctaccgtgagc

SEQ ID NO: 121733 - DNA, 75 bp, Artificial Sequence
  Synthetic
gacacctgatcttctgccactcaaagaaaaaatgtgatgagcttgccgcaaaattgaccagcatgggcatcaatg

SEQ ID NO: 121734 - DNA, 75 bp, Artificial Sequence
  Synthetic
tacggacccaaccacggtcctagggatcggcaccgtcttggaccaggcggaaacggctggtgcgcgcctcactgt

SEQ ID NO: 121735 - DNA, 75 bp, Artificial Sequence
  Synthetic
gaaaaaatgtgatgagcttgccgcaaaattgaccagcatgggcatcaatgcagtagcttattaccgaggccttga

SEQ ID NO: 121736 - DNA, 75 bp, Artificial Sequence
  Synthetic
ataccttgctggcctttcgaccttgccgggtaatcccgccgtggccacgttgatgtctttcaccgccgcggtgac

SEQ ID NO: 121737 - DNA, 75 bp, Artificial Sequence
  Synthetic
aagggtagatgggcccctggcgccgcctatgccttctacggggtgtggccccttctcttgcttcttttggcgttg

SEQ ID NO: 121738 - DNA, 75 bp, Artificial Sequence
  Synthetic
gctattcctctagaatacatcaaaggtggcagacacctgatcttttgtcattcaaagaagaaatgcgacgaattg

SEQ ID NO: 121739 - DNA, 75 bp, Artificial Sequence
  Synthetic
acctgtgtcacccaaacagtggacttcagccttgaccccaccttcaccattgagacaaccacattgccccaagac

SEQ ID NO: 121740 - DNA, 75 bp, Artificial Sequence
  Synthetic
gggtggcctcacagatcgcgccacccacggccgccaccgcgttcgtcgttagtggaatggccggggccgcagtcg

SEQ ID NO: 121741 - DNA, 75 bp, Artificial Sequence
  Synthetic
ctccatgctccggttcctggctaagagacatctgggactggatatgcgaggtgctgagcgactttaagacctggc

SEQ ID NO: 121742 - DNA, 75 bp, Artificial Sequence
  Synthetic
gttgcatctttctctgtctgtggtggctccagtactttttggccagggccgaggcagcgttgcatacatgggtcc

SEQ ID NO: 121743 - DNA, 75 bp, Artificial Sequence
  Synthetic
cttcggtcctgtgtgagtgctacgatgcgggatgcgcgtggtacgaactcactccttctgagaccaccgtgagac

SEQ ID NO: 121744 - DNA, 75 bp, Artificial Sequence
  Synthetic
cggatgccctcatgactggatatacaggtgacttcgaccctgttattgactgtaacgtagcagttactcagatag

SEQ ID NO: 121745 - DNA, 75 bp, Artificial Sequence
  Synthetic
acaggggtggctggggcgctcgtcgccttcaagatcatgtgtggggaaaggccgacagccgaagaactggtaaac

SEQ ID NO: 121746 - DNA, 75 bp, Artificial Sequence
  Synthetic
tccaataccacctccacggaggaagaggacggttgtcctgacagaatccaccgtgtcttctgccttggcggagct

SEQ ID NO: 121747 - DNA, 75 bp, Artificial Sequence
  Synthetic
tctcgggcccctatgggtcttccaagccagtctactcagagtgccctactttgtgcgcgctcacgccctccttag

SEQ ID NO: 121748 - DNA, 75 bp, Artificial Sequence
  Synthetic
cctatctcagacaaaacaggcaggggaaaattttccttatcttgtagcataccaggccaccgtgtgtgctagggc

SEQ ID NO: 121749 - DNA, 75 bp, Artificial Sequence
  Synthetic
gccgggggtgtaccggtacgtctcgcagggtgaacggccatcaggcatgtttgataccgtcgttctttgcgaggc

SEQ ID NO: 121750 - DNA, 75 bp, Artificial Sequence
  Synthetic
gaaaattttccttatcttgtagcataccaggccaccgtgtgtgctagggcccaggccccacctccttcatgggac

SEQ ID NO: 121751 - DNA, 75 bp, Artificial Sequence
  Synthetic
accccgctgcaggattgggctcacagcggtttgcgagacttcgctaccgctgtagaaccggtcaccttctcccaa

SEQ ID NO: 121752 - DNA, 75 bp, Artificial Sequence
  Synthetic
catcttgaattctgggagggagtgttcactggcctaacacacatcgatgcccacttcctatcccaaactaagcag

SEQ ID NO: 121753 - DNA, 75 bp, Artificial Sequence
  Synthetic
gactgggtctgcacggcactgacagacttcaaagcctggctgcaggcaaaactcctcccgcaactccccggagtg

SEQ ID NO: 121754 - DNA, 75 bp, Artificial Sequence
  Synthetic
tgggtcctgccgacgggatggtctccaaggggtggaggctcctcgcaccaatcacagcctacgcccagcagacga

SEQ ID NO: 121755 - DNA, 75 bp, Artificial Sequence
  Synthetic
cacggctaaagcctatgcttacgggaccaacacctctcctgtacaggctcggcgccgttcaaaatgagattgtta

SEQ ID NO: 121756 - DNA, 75 bp, Artificial Sequence
  Synthetic
cagacaggtcctttaccaggagtttgatgagatggaagagtgtgcgacgcagttgccctatattgaacatgggct

SEQ ID NO: 121757 - DNA, 75 bp, Artificial Sequence
  Synthetic
gtctatgccacaacatcccgcagcgcaagccaacggcagaagaaggtcacctttgacagactgcaagtcctggac

SEQ ID NO: 121758 - DNA, 75 bp, Artificial Sequence
  Synthetic
ggcgacaaccatcaatggggttctctggaccgtctaccacggggccgggtcaaagacccttgctacagcaagagg

SEQ ID NO: 121759 - DNA, 75 bp, Artificial Sequence
  Synthetic
ggcagcttactgcttgactttgggcagtgttgtggtctgcggcagggttataacatcagggaagcccgtgccgtt

SEQ ID NO: 121760 - DNA, 75 bp, Artificial Sequence
  Synthetic
aagcttgagagcttctgggccaagcatatgtggaatttcatcagtgggatacagtacctggccggcttgtccacc

SEQ ID NO: 121761 - DNA, 75 bp, Artificial Sequence
  Synthetic
gacctgtacctggtcacgaggcacgctgacgtcatcccagtgcgccgccgcggggacggcagaggcagcctcttg

SEQ ID NO: 121762 - DNA, 75 bp, Artificial Sequence
  Synthetic
agacagaagatcataggactgctacaaaacactgccaagcaagcagaagagctgaagccagcagtgcattctgca

SEQ ID NO: 121763 - DNA, 75 bp, Artificial Sequence
  Synthetic
ggtgggtggctgctcaactggcaaccccgagcgccgcttcggccttcgtgggcgctggcattgtcggcgcagcgg

SEQ ID NO: 121764 - DNA, 75 bp, Artificial Sequence
  Synthetic
gtggggttgcaaaagcggtggattttattcccgtcgaggctttggagacagctcagaggtccccggtgttcacag

SEQ ID NO: 121765 - DNA, 75 bp, Artificial Sequence
  Synthetic
tggcttccttaatgtccttctccgcagccctaactagtcctctgactacatcaacaactctcttgctcaatatat

SEQ ID NO: 121766 - DNA, 75 bp, Artificial Sequence
  Synthetic
ggttccgactaccgaggatctggtaaacctgcttcccgccatcctgtcgccaggggctctcgtggtgggcgtagt

SEQ ID NO: 121767 - DNA, 75 bp, Artificial Sequence
  Synthetic
ctatggagacagtgcatgggaggcaatatcacgcgagtagaggctgagaacaaggtcgagatccttgactgcttc

SEQ ID NO: 121768 - DNA, 75 bp, Artificial Sequence
  Synthetic
ggcacaggggtacaaggtgctggtgctcaatccttccgtcgccgcgacgctgggtttcggagcgtacatgtccag

SEQ ID NO: 121769 - DNA, 75 bp, Artificial Sequence
  Synthetic
gagagtcattgttgacattctagcaggatacggagcaggcgtgtcaggggccctcgtagcttttaagatcatgag

SEQ ID NO: 121770 - DNA, 75 bp, Artificial Sequence
  Synthetic
ccgacgcactacgtgcccgagagcgacgcggcggcacgagtcactcaggtcctcgcctccctcactgtcactcaa

SEQ ID NO: 121771 - DNA, 75 bp, Artificial Sequence
  Synthetic
ctggcacttacatctatgaccacctcacccctatgtcggattgggctgctagtggcctgcgggacctggcggtcg

SEQ ID NO: 121772 - DNA, 75 bp, Artificial Sequence
  Synthetic
ggccggggtatgacccgcccctcttggagacttggaagcgaccggattatgacccccctcaggtgtggggctgcc

SEQ ID NO: 121773 - DNA, 75 bp, Artificial Sequence
  Synthetic
ggatgcggggggggcgcctatgatataataatctgtgatgagtgtcactccacagacgccaccacgatcttgggc

SEQ ID NO: 121774 - DNA, 75 bp, Artificial Sequence
  Synthetic
cgacacgttggcccgtctgaaggggccacccagtggatgaacaggctcatagcctttgcgtcgaggggcaaccac

SEQ ID NO: 121775 - DNA, 75 bp, Artificial Sequence
  Synthetic
gcgacttcaaaaggtggctcgcagccaagctcatgcccaaaatgccgggtctccccttcctctcgtgtcagcgag

SEQ ID NO: 121776 - DNA, 75 bp, Artificial Sequence
  Synthetic
tgtcccgcttccgcggaggaaaaggaagccaatggaactatctgattctaccgtgtcccaagtcatggccgactt

SEQ ID NO: 121777 - DNA, 75 bp, Artificial Sequence
  Synthetic
cacagacgccaccacgatcttgggcataggcactgttcttgaccaggcggagactgccggagcgcggctcacagt

SEQ ID NO: 121778 - DNA, 75 bp, Artificial Sequence
  Synthetic
agtggatcagtggagactggtcatcgccgtgctccacctcctggctgagagacgtttgggactgggtctgcacag

SEQ ID NO: 121779 - DNA, 75 bp, Artificial Sequence
  Synthetic
cgctagcgcggaagatggttggaggccattacgtgcaaatggccatcatcaagttgggggcgcttactggcacct

SEQ ID NO: 121780 - DNA, 75 bp, Artificial Sequence
  Synthetic
cggtccaaaagcatgcagtaacacctggcatggaactttccccatcaacgcctacacgacaggtccctgcatgcc

SEQ ID NO: 121781 - DNA, 75 bp, Artificial Sequence
  Synthetic
attcttccatgcctccgctagagggcgaacctggggaccctgacctttcgtcagggtcatggtcaaccgtcagcg

SEQ ID NO: 121782 - DNA, 75 bp, Artificial Sequence
  Synthetic
ttcaaagaagaaatgcgatgagcttgctgcgaagttagtcggcttgggcgttaacgccgtagcctactaccgcgg

SEQ ID NO: 121783 - DNA, 75 bp, Artificial Sequence
  Synthetic
cacccttgcgagtctggagacatcgggccagaagtgtccgcgctaagctactgtcccagggggggagggccgcca

SEQ ID NO: 121784 - DNA, 75 bp, Artificial Sequence
  Synthetic
aggggatggcatatgctacaccaaatgcccttgcggtgcggacatcactggccacgtaaagaatgggaccatgaa

SEQ ID NO: 121785 - DNA, 75 bp, Artificial Sequence
  Synthetic
accactgacaatctcaaatgcccatgccaagtcccatctccagaatttttcacagaggttgatggggtacgccta

SEQ ID NO: 121786 - DNA, 75 bp, Artificial Sequence
  Synthetic
aagcaacaccttattacgccaccacaatcttgtgtactccacctcctctcggagtgcgggtctgaggcagaaaaa

SEQ ID NO: 121787 - DNA, 75 bp, Artificial Sequence
  Synthetic
tgcaacacgtgtgtcactcaaacagtcgatttcagcctcgaccctaccttcaccattgagacaaccacactgccc

SEQ ID NO: 121788 - DNA, 75 bp, Artificial Sequence
  Synthetic
taaggtcatcgataccctaacctgcggcttcgccgacctcatgggatacatcccgctcgtgggcgcccccgtggg

SEQ ID NO: 121789 - DNA, 75 bp, Artificial Sequence
  Synthetic
tcctcccgtgcctccgccccggaagaagcggacggtggtcctcaccgaatcaaaactatctatcgccttggccga

SEQ ID NO: 121790 - DNA, 75 bp, Artificial Sequence
  Synthetic
cacaaggcattgtggagggtttctgcggaggactacgttgaggtcgtgcgcgtgaaggactgccattacatagtg

SEQ ID NO: 121791 - DNA, 75 bp, Artificial Sequence
  Synthetic
cacaaggctttgtggagggtttctgcggaggactacgttgaggtcgtgcgcgtgaaggactgccattacatagtg

SEQ ID NO: 121792 - DNA, 75 bp, Artificial Sequence
  Synthetic
cacaaggccttgtggagggtttctgcggaggactacgttgaggtcgtgcgcgtgaaggactgccattacatagtg

SEQ ID NO: 121793 - DNA, 75 bp, Artificial Sequence
  Synthetic
cacaaggcgttgtggagggtttctgcggaggactacgttgaggtcgtgcgcgtgaaggactgccattacatagtg

SEQ ID NO: 121794 - DNA, 75 bp, Artificial Sequence
  Synthetic
cagagcccgacgtggcagtgttgacatcaatgcttacagacccctcccacatcacggctgatgctgcccggcgcc

SEQ ID NO: 121795 - DNA, 75 bp, Artificial Sequence
  Synthetic
ttggcacttctctcgtgcctgacggtccccgcctcagctgtgcactatcgcaacgcttctggcgtctatcacatc

SEQ ID NO: 121796 - DNA, 75 bp, Artificial Sequence
  Synthetic
gccgtccgcttatcagagatgaaatcaccttttcggtaggactttccacctatgcactgggctcccagctcccct

SEQ ID NO: 121797 - DNA, 75 bp, Artificial Sequence
  Synthetic
agacgccgagctcattgaggcgaatctcctgtggagacaggagatgggcagcaacatcactcgggtagagtcgga

SEQ ID NO: 121798 - DNA, 75 bp, Artificial Sequence
  Synthetic
ccatttcctgtcccagacgaagcaggcaggggagaacttcccctacctggtggcgtaccaggcaactgtgtgcgc

SEQ ID NO: 121799 - DNA, 75 bp, Artificial Sequence
  Synthetic
ggtgctgggtggcgctaacccccactgtggcggctccttacctcaacgctccggttgactccttgcgacgtcacg

SEQ ID NO: 121800 - DNA, 75 bp, Artificial Sequence
  Synthetic
tggcgtaccaggcaactgtgtgcgcccgggctcaggccccccccccgtcatgggaccagatgtggaaatgcttga

SEQ ID NO: 121801 - DNA, 75 bp, Artificial Sequence
  Synthetic
accgtcacttgctagttcatcagcaagtcagctctctgcaccatccctgaaagctacgtgcacgacgggtggtgt

SEQ ID NO: 121802 - DNA, 75 bp, Artificial Sequence
  Synthetic
cggtcccgaacaccgcccctattgctggcactacccccccaagccttgtggtatcgtaccggcacagaatgtgtg

SEQ ID NO: 121803 - DNA, 75 bp, Artificial Sequence
  Synthetic
ttcccccccgccctgccagtctgggcttcgccttcatacaatcctcctttgctggaggcgtggaagagaccaggc

SEQ ID NO: 121804 - DNA, 75 bp, Artificial Sequence
  Synthetic
actgaagagtccatttaccaatcatgtgacttgcagcctgaggcgcgcgtggcaatacggtcactcacccaacgc

SEQ ID NO: 121805 - DNA, 75 bp, Artificial Sequence
  Synthetic
gactcatttgaccccctcgtcgctgaaacagacgacagggagatgtctgtgagtgccgagtgctttgtccctcct

SEQ ID NO: 121806 - DNA, 75 bp, Artificial Sequence
  Synthetic
gtgtctctgatgccctggctgagctcgctgctaagaccttcagcgactcggacacctctggcgtcgttagtggcg

SEQ ID NO: 121807 - DNA, 75 bp, Artificial Sequence
  Synthetic
tgacctcctagccgggggtcattggggcgtactcgcagggctagcatactacagcatgcaggcaaactgggctaa

SEQ ID NO: 121808 - DNA, 75 bp, Artificial Sequence
  Synthetic
acctgacagagaggtcctctaccgagagttcgacgaaatggaggagtgctccacacacctcccatacatcgaaca

SEQ ID NO: 121809 - DNA, 75 bp, Artificial Sequence
  Synthetic
cgggtgcgtgccctgcgttcgggagggtaactcctcccgttgctgggtggcgcttgctcccacgctagcggccag

SEQ ID NO: 121810 - DNA, 75 bp, Artificial Sequence
  Synthetic
tgcgcgggtgcgccttgcctcctaagggcttacctccagtaccaccacccaggaggaagagggtcgtgcagctca

SEQ ID NO: 121811 - DNA, 75 bp, Artificial Sequence
  Synthetic
tcctgacctcagcgatggatcctggtcaaccgtgagtagcgaggagactggggaggacgtcgtgtgctgctcgat

SEQ ID NO: 121812 - DNA, 75 bp, Artificial Sequence
  Synthetic
agccctgggccacaacaaagattgcagcttattaacaccaacggaagctggcacatcaataggactgctcttaat

SEQ ID NO: 121813 - DNA, 75 bp, Artificial Sequence
  Synthetic
tggcagaagctcgagaccttctgggcgaagcatatgtggaacttcatcagcgggatacaatatctggcgggcttg

SEQ ID NO: 121814 - DNA, 75 bp, Artificial Sequence
  Synthetic
tgcaagctccgatatgacaccttctactgaggaggtcgacggggcctcagatgatggttcctacagttccatgcc

SEQ ID NO: 121815 - DNA, 75 bp, Artificial Sequence
  Synthetic
tgcaagctccgatatgtcaccttctactgaggaggtcgacggggcctcagatgatggttcctacagttccatgcc

SEQ ID NO: 121816 - DNA, 75 bp, Artificial Sequence
  Synthetic
tgcaagctccgatatgccaccttctactgaggaggtcgacggggcctcagatgatggttcctacagttccatgcc

SEQ ID NO: 121817 - DNA, 75 bp, Artificial Sequence
  Synthetic
tgcaagctccgatatggcaccttctactgaggaggtcgacggggcctcagatgatggttcctacagttccatgcc

SEQ ID NO: 121818 - DNA, 75 bp, Artificial Sequence
  Synthetic
tgcaatgacagccttaacacagggtggctagctagcttgttctacgcccacaagttcaacagctccgggtgtgct

SEQ ID NO: 121819 - DNA, 75 bp, Artificial Sequence
  Synthetic
ctggtatactctacaacttcccgcagtgcagggcagagacagaagaaagtcacctttgagaggacacaggtctta

SEQ ID NO: 121820 - DNA, 75 bp, Artificial Sequence
  Synthetic
tggggggttgggtggccgcccagctcgccgcccccggcgccgcaacaaccttcgtgggtgctggcctagccggcg

SEQ ID NO: 121821 - DNA, 75 bp, Artificial Sequence
  Synthetic
ggcactatccaccccgcccgtgcggggtagtgccggcaactacagtgtgtggtcctgtgtactgtttcactccca

SEQ ID NO: 121822 - DNA, 75 bp, Artificial Sequence
  Synthetic
tcctggacgggagcactgatcactccctgcgctgctgaggaagagaagttgcctattagctcgctcagcaactct

SEQ ID NO: 121823 - DNA, 75 bp, Artificial Sequence
  Synthetic
cccactcggccagatctaaatttggctatggggcgaaagatgtccgcagccatgctccaaaagccatccgccaca

SEQ ID NO: 121824 - DNA, 75 bp, Artificial Sequence
  Synthetic
gggtacggtgcgggggttgccggggctctcgtggcttttaagatcatgagcggcgaggtcccctcaactgaggac

SEQ ID NO: 121825 - DNA, 75 bp, Artificial Sequence
  Synthetic
tgagggttggggtaaccactccggccttttaggccattttctttttttttttcccttcccggttttttttttttt

SEQ ID NO: 121826 - DNA, 75 bp, Artificial Sequence
  Synthetic
agtgctgctgctatttgctggcgtcgacgcaacaacctatgtcaccgggggaagtgccgctaagaccgcgtctgg

SEQ ID NO: 121827 - DNA, 75 bp, Artificial Sequence
  Synthetic
ggtagtgccggcaactacagtgtgtggtcctgtgtactgtttcactcccagccccgtggtagtcggtacgactga

SEQ ID NO: 121828 - DNA, 75 bp, Artificial Sequence
  Synthetic
actactatgatgttcttaaggagattaaggccaaagcctccggggttagtgcaaagcttctgtctgtcgaagagg

SEQ ID NO: 121829 - DNA, 75 bp, Artificial Sequence
  Synthetic
gtggctagttgcctcaggaagcttggggtaccccctttgagagcttggagacatcgggctcgagctgtacgcgct

SEQ ID NO: 121830 - DNA, 75 bp, Artificial Sequence
  Synthetic
gggcaagaagccagctcgcctcatcgtatacccagacctgggtgtgcgggtttgcgagaaaatggccttgtatga

SEQ ID NO: 121831 - DNA, 75 bp, Artificial Sequence
  Synthetic
tattgccctacagattgcttcaggaaacacccagacacgacctacgccaagtgcgggtcagggccttggctaacg

SEQ ID NO: 121832 - DNA, 75 bp, Artificial Sequence
  Synthetic
gctgactctgtcaccgtattataagcgctatatcagctggtgcttatggtggcttcagtatttcctgaccagagt

SEQ ID NO: 121833 - DNA, 75 bp, Artificial Sequence
  Synthetic
agagcgacgcatcggcccgtgtcactgcaatcctcagcagtctcactgtcacccaactcctaaaacggctccacc

SEQ ID NO: 121834 - DNA, 75 bp, Artificial Sequence
  Synthetic
cgtgtgggaggacttgctggaagacaactctacaccaattcctactaccatcatggccaagaatgaagtcttttg

SEQ ID NO: 121835 - DNA, 75 bp, Artificial Sequence
  Synthetic
accggctggacttgtccagctggttcaccgttggcgctggcgggggggacatttatcacagcatgtcccgtgccc

SEQ ID NO: 121836 - DNA, 75 bp, Artificial Sequence
  Synthetic
aaaaaggcccctatgggtttttcttatgacacccgctgctttgactcaacagtcaccgagaatgacatccgtacg

SEQ ID NO: 121837 - DNA, 75 bp, Artificial Sequence
  Synthetic
gaaggccaagatcttaccacaaatgcctggaatccccctgctgtcctgccaacgcgggtaccgggggatatggcg

SEQ ID NO: 121838 - DNA, 75 bp, Artificial Sequence
  Synthetic
accgactggaggcagcgtgcaactggaccaggggagaggcctgcgctctggaggacagagatcgctcggagctgt

SEQ ID NO: 121839 - DNA, 75 bp, Artificial Sequence
  Synthetic
gaccaggggagaggcctgcgctctggaggacagagatcgctcggagctgtcgcccttgcttctctccaccacaca

SEQ ID NO: 121840 - DNA, 75 bp, Artificial Sequence
  Synthetic
ctcggaccagaggccctattgctggcactacgcgcctcaaccgtgcggtattgtacccgcgtcgcaggtgtgtgg

SEQ ID NO: 121841 - DNA, 75 bp, Artificial Sequence
  Synthetic
cactacgcgcctcaaccgtgcggtattgtacccgcgtcgcaggtgtgtggtccagtgtactgcttcaccccaagc

SEQ ID NO: 121842 - DNA, 75 bp, Artificial Sequence
  Synthetic
cagaagctccctgtggcgacaatggggccagcatatggcttccaatactcgcccaagcagcgggtcgactacctc

SEQ ID NO: 121843 - DNA, 75 bp, Artificial Sequence
  Synthetic
caaaaggggaaaactgtggctatcgtcggtgtcgcgcaagcggcgtcctgactaccagctgcggcaacaccctta

SEQ ID NO: 121844 - DNA, 75 bp, Artificial Sequence
  Synthetic
aacacctggcgtgggtcgttcccaatcaatgcttacaccacgggcccctgcaccccccttcccgccccgaactac

SEQ ID NO: 121845 - DNA, 75 bp, Artificial Sequence
  Synthetic
ctcaagttgtggaagtcgaagaagacccctatggggttctcctacgacaccaggtgctttgactccacggtcact

SEQ ID NO: 121846 - DNA, 75 bp, Artificial Sequence
  Synthetic
gtgggttcagcggtggtctcgtgggcgctcaagtgggagtacgtagtgctcgcattcttgctgcttgcggatgcc

SEQ ID NO: 121847 - DNA, 75 bp, Artificial Sequence
  Synthetic
cgctcaagtgggagtacgtagtgctcgcattcttgctgcttgcggatgccaggatctgcgcgtgcctctggatga

SEQ ID NO: 121848 - DNA, 75 bp, Artificial Sequence
  Synthetic
gcccgtgccaggtcccagcacccgaattcttcacagagctggacggtgtgcgcctacataggtacgcaccaccat

SEQ ID NO: 121849 - DNA, 75 bp, Artificial Sequence
  Synthetic
acgactggtactacgccattctcttcatctgtgttgcttggcacattaaggggaaattcccagccgctgccgcct

SEQ ID NO: 121850 - DNA, 75 bp, Artificial Sequence
  Synthetic
gctggcttatgtctccccgcggctctcgcccttcttggggcccaaacgacccccggcgtcggtcccgtaatttgg

SEQ ID NO: 121851 - DNA, 75 bp, Artificial Sequence
  Synthetic
cgtcatctccgaaagcgtgggggtcaatgaggatgctagtgcactgagagccttcacggaggctatgaccaggta

SEQ ID NO: 121852 - DNA, 75 bp, Artificial Sequence
  Synthetic
ggtaacatcaatgctcactgacccttcccacataacggcggaagccgctggccggaggctgaggaggggatctcc

SEQ ID NO: 121853 - DNA, 75 bp, Artificial Sequence
  Synthetic
tgtcttaatcttgttgaccatcttgacgctatccccacactacaagcagtggctggcacgaggagtttggtggct

SEQ ID NO: 121854 - DNA, 75 bp, Artificial Sequence
  Synthetic
aacatcatcatgtatgcccccacattgtgggcgaggatggtactgatgacacacttcttttccatcctcattgct

SEQ ID NO: 121855 - DNA, 75 bp, Artificial Sequence
  Synthetic
gcaatacttcattgctagagttgaggccgctctgttcgtgtacgttccaccactggaagtacgcggaccgcggga

SEQ ID NO: 121856 - DNA, 75 bp, Artificial Sequence
  Synthetic
cgttgctcatgacaacaatggacagagatactactacctcacacgggacccagctatcccactgtctcgggctgc

SEQ ID NO: 121857 - DNA, 75 bp, Artificial Sequence
  Synthetic
gccaacctcctgtggtggcaggagatgggcggaaacatcaccagggtggagtcggagaacaaggtggtgatactg

SEQ ID NO: 121858 - DNA, 75 bp, Artificial Sequence
  Synthetic
gccaacctcctgtggtggcaggagatgggcggaaacatcaccagggtggagtcggagaacaaggtggtgattctg

SEQ ID NO: 121859 - DNA, 75 bp, Artificial Sequence
  Synthetic
gccaacctcctgtggtggcaggagatgggcggaaacatcaccagggtggagtcggagaacaaggtggtgatcctg

SEQ ID NO: 121860 - DNA, 75 bp, Artificial Sequence
  Synthetic
gccaacctcctgtggtggcaggagatgggcggaaacatcaccagggtggagtcggagaacaaggtggtgatgctg

SEQ ID NO: 121861 - DNA, 75 bp, Artificial Sequence
  Synthetic
tcactcctacgtgtcccttactttgtgagggctcacgtgttggttaagatctgcagcttggtacgcggggtggca

SEQ ID NO: 121862 - DNA, 75 bp, Artificial Sequence
  Synthetic
tttggaatactccagtcccaagaaacactccataaagtgcttgacttcgatatgtacggagtcacgtactctgtc

SEQ ID NO: 121863 - DNA, 75 bp, Artificial Sequence
  Synthetic
tatgggcgtcaccggactacaaccccccgcttctggagacgtggaagaggcctgactacgaaccgcccgtggtcc

SEQ ID NO: 121864 - DNA, 75 bp, Artificial Sequence
  Synthetic
tatgggcgtctccggactacaaccccccgcttctggagacgtggaagaggcctgactacgaaccgcccgtggtcc

SEQ ID NO: 121865 - DNA, 75 bp, Artificial Sequence
  Synthetic
tatgggcgtccccggactacaaccccccgcttctggagacgtggaagaggcctgactacgaaccgcccgtggtcc

SEQ ID NO: 121866 - DNA, 75 bp, Artificial Sequence
  Synthetic
tatgggcgtcgccggactacaaccccccgcttctggagacgtggaagaggcctgactacgaaccgcccgtggtcc

SEQ ID NO: 121867 - DNA, 75 bp, Artificial Sequence
  Synthetic
tcctacacctagctggttgtgtgccttgcgtgagagccggaaacatttcacgctgctggcatcctgtttcaccca

SEQ ID NO: 121868 - DNA, 75 bp, Artificial Sequence
  Synthetic
tgtggcaaatactaccaaatggcattgctcaagctgggtgccctcacaggcacctatgtttatgaccatctcact

SEQ ID NO: 121869 - DNA, 75 bp, Artificial Sequence
  Synthetic
gtctggacttgtccaactggttcactgccggttacagcgggggagacatatatcacagcgtgtctcgtgcccggc

SEQ ID NO: 121870 - DNA, 75 bp, Artificial Sequence
  Synthetic
gcctcaggaagcttggggcaccaccgttaagagtctggagacaccgagccagggcggtcagagctaggctcattg

SEQ ID NO: 121871 - DNA, 75 bp, Artificial Sequence
  Synthetic
tgagctcgccacaaagacctttggtggccctacgtcctctggcgtcgccagtgacgccacaccctcgtcctctga

SEQ ID NO: 121872 - DNA, 75 bp, Artificial Sequence
  Synthetic
tgagctcgccacaaagacctttggtggcccttcgtcctctggcgtcgccagtgacgccacaccctcgtcctctga

SEQ ID NO: 121873 - DNA, 75 bp, Artificial Sequence
  Synthetic
tgagctcgccacaaagacctttggtggccctccgtcctctggcgtcgccagtgacgccacaccctcgtcctctga

SEQ ID NO: 121874 - DNA, 75 bp, Artificial Sequence
  Synthetic
tgagctcgccacaaagacctttggtggccctgcgtcctctggcgtcgccagtgacgccacaccctcgtcctctga

SEQ ID NO: 121875 - DNA, 75 bp, Artificial Sequence
  Synthetic
cacactccggggtgtgtcccttgcgttcgcgagggtaacgcctcgaggtgttgggtggcgatgacccccacggtg

SEQ ID NO: 121876 - DNA, 75 bp, Artificial Sequence
  Synthetic
agacctctgcggtgccgtatttttggcaggacagttggctaccttcagtcctcgcatccacgacataacgcagga

SEQ ID NO: 121877 - DNA, 75 bp, Artificial Sequence
  Synthetic
gaccttgtcaccacactataaggtgttcctcgctaagctcatatggtggttgcaatatttcatcaccagagccga

SEQ ID NO: 121878 - DNA, 75 bp, Artificial Sequence
  Synthetic
ttgaccttgtcaccacactacaaagtgttcctcgctaagctcatatggtggttacaataccttatcaccagagct

SEQ ID NO: 121879 - DNA, 75 bp, Artificial Sequence
  Synthetic
ggggtggagactcctcgcccccatcaccgcgtatgcgcagcagactcgaggcttggtgagtacgatcgtcacgag

SEQ ID NO: 121880 - DNA, 75 bp, Artificial Sequence
  Synthetic
accgcgtatgcgcagcagactcgaggcttggtgagtacgatcgtcacgagcctcactggtagggacaccaatgaa

SEQ ID NO: 121881 - DNA, 75 bp, Artificial Sequence
  Synthetic
tcatggtcaacggtcagtggcgagtctaacgcggaggatgttgtgtgttgctcaatgtcctacacctggacgggc

SEQ ID NO: 121882 - DNA, 75 bp, Artificial Sequence
  Synthetic
attctgagagtgcccgaaatagtgctcgaggtgttcgccggcggtcactggggtgtcctgatcgccatcgcctac

SEQ ID NO: 121883 - DNA, 75 bp, Artificial Sequence
  Synthetic
cctactttccgtaggagtaggcatctacttgctccccaaccgatgaaggggagcttaaacactccggccatttag

SEQ ID NO: 121884 - DNA, 75 bp, Artificial Sequence
  Synthetic
gcggtccacccagagctaatttttgagatcaccaaaatcttgctcgccatacttggtccgctcatggtgctccag

SEQ ID NO: 121885 - DNA, 75 bp, Artificial Sequence
  Synthetic
agaccatctgtggcccgaagggacccgtcaatcagatgtacaccaacgtcgaccaagacctggtggggtggccag

SEQ ID NO: 121886 - DNA, 75 bp, Artificial Sequence
  Synthetic
cttatctcttcacctccattttctcgtctggtccaaatcagaagatacagcttattaacaccaatggtagctggc

SEQ ID NO: 121887 - DNA, 75 bp, Artificial Sequence
  Synthetic
acggcttggcgcatgcaagcccttggaacacttccagcagggatggggccctataacccacaagtccaacatcac

SEQ ID NO: 121888 - DNA, 75 bp, Artificial Sequence
  Synthetic
cgggggaactgccgctcacaccgcgcagggactcgtcggcctcttctcacggggccctacgcagaacatccagtt

SEQ ID NO: 121889 - DNA, 75 bp, Artificial Sequence
  Synthetic
accacatccgctccgtgtggcaagaccttctggaagacaatgaaacaccaatagacaccaccatcatggcaaaga

SEQ ID NO: 121890 - DNA, 75 bp, Artificial Sequence
  Synthetic
gatcctcgggcggtcctctgctatgccccctgggacacgctgtcggaatattccgtgcagcagtgtgtacccggg

SEQ ID NO: 121891 - DNA, 75 bp, Artificial Sequence
  Synthetic
gatcctcgggcggtcctctgctatgccccctgggtcacgctgtcggaatattccgtgcagcagtgtgtacccggg

SEQ ID NO: 121892 - DNA, 75 bp, Artificial Sequence
  Synthetic
gatcctcgggcggtcctctgctatgccccctgggccacgctgtcggaatattccgtgcagcagtgtgtacccggg

SEQ ID NO: 121893 - DNA, 75 bp, Artificial Sequence
  Synthetic
gatcctcgggcggtcctctgctatgccccctggggcacgctgtcggaatattccgtgcagcagtgtgtacccggg

SEQ ID NO: 121894 - DNA, 75 bp, Artificial Sequence
  Synthetic
gttcctcgggcggtcctctgctatgccccctgggacacgctgtcggaatattccgtgcagcagtgtgtacccggg

SEQ ID NO: 121895 - DNA, 75 bp, Artificial Sequence
  Synthetic
gttcctcgggcggtcctctgctatgccccctgggtcacgctgtcggaatattccgtgcagcagtgtgtacccggg

SEQ ID NO: 121896 - DNA, 75 bp, Artificial Sequence
  Synthetic
gttcctcgggcggtcctctgctatgccccctgggccacgctgtcggaatattccgtgcagcagtgtgtacccggg

SEQ ID NO: 121897 - DNA, 75 bp, Artificial Sequence
  Synthetic
gttcctcgggcggtcctctgctatgccccctggggcacgctgtcggaatattccgtgcagcagtgtgtacccggg

SEQ ID NO: 121898 - DNA, 75 bp, Artificial Sequence
  Synthetic
gctcctcgggcggtcctctgctatgccccctgggacacgctgtcggaatattccgtgcagcagtgtgtacccggg

SEQ ID NO: 121899 - DNA, 75 bp, Artificial Sequence
  Synthetic
gctcctcgggcggtcctctgctatgccccctgggtcacgctgtcggaatattccgtgcagcagtgtgtacccggg

SEQ ID NO: 121900 - DNA, 75 bp, Artificial Sequence
  Synthetic
gctcctcgggcggtcctctgctatgccccctgggccacgctgtcggaatattccgtgcagcagtgtgtacccggg

SEQ ID NO: 121901 - DNA, 75 bp, Artificial Sequence
  Synthetic
gctcctcgggcggtcctctgctatgccccctggggcacgctgtcggaatattccgtgcagcagtgtgtacccggg

SEQ ID NO: 121902 - DNA, 75 bp, Artificial Sequence
  Synthetic
ggtcctcgggcggtcctctgctatgccccctgggacacgctgtcggaatattccgtgcagcagtgtgtacccggg

SEQ ID NO: 121903 - DNA, 75 bp, Artificial Sequence
  Synthetic
ggtcctcgggcggtcctctgctatgccccctgggtcacgctgtcggaatattccgtgcagcagtgtgtacccggg

SEQ ID NO: 121904 - DNA, 75 bp, Artificial Sequence
  Synthetic
ggtcctcgggcggtcctctgctatgccccctgggccacgctgtcggaatattccgtgcagcagtgtgtacccggg

SEQ ID NO: 121905 - DNA, 75 bp, Artificial Sequence
  Synthetic
ggtcctcgggcggtcctctgctatgccccctggggcacgctgtcggaatattccgtgcagcagtgtgtacccggg

SEQ ID NO: 121906 - DNA, 75 bp, Artificial Sequence
  Synthetic
ttcaactcttcaggctgtcccgagagaatggccagctgtcgaccccttaccgcttttgcccagggctggggccct

SEQ ID NO: 121907 - DNA, 75 bp, Artificial Sequence
  Synthetic
cctagccctgtcgtggtgggcaccaccgacaggctgggcaaccctacttacaactggggagaaaacgagacggat

SEQ ID NO: 121908 - DNA, 75 bp, Artificial Sequence
  Synthetic
tacgcgtatgtgagaagatggccttgtatgatgtggtgaagaccctccccaccaaagtgatgggggaagcctacg

SEQ ID NO: 121909 - DNA, 75 bp, Artificial Sequence
  Synthetic
gccagttaatcccaggagactataatagttcttctaaccagctcctgtgccctactgactgcttccggaaacatc

SEQ ID NO: 121910 - DNA, 75 bp, Artificial Sequence
  Synthetic
ctacacaatacacaaggttcgcatgttcattgggggcgttgagcacaggttcgatgccgcctgtaattggacgcg

SEQ ID NO: 121911 - DNA, 75 bp, Artificial Sequence
  Synthetic
caggcgccaagcagaacgtccagctaattaacaccaacggcagttggcacatcaatagcacggctttgaactgca

SEQ ID NO: 121912 - DNA, 75 bp, Artificial Sequence
  Synthetic
atccctatagcgctggttaaggggggcagacacctcatcttctgtcactcgaagaaaaaatgtgatgaattggcc

SEQ ID NO: 121913 - DNA, 75 bp, Artificial Sequence
  Synthetic
atgcccgccttgtcaacaggacttatacatctccatcaaaacattgtagatgtgcaatacctctacggagtctcc

SEQ ID NO: 121914 - DNA, 75 bp, Artificial Sequence
  Synthetic
ctcgttggcggcgttctggctgctttggccgcgtattgcctatccacaggctgcgtggtcatagtaggcaggatt

SEQ ID NO: 121915 - DNA, 75 bp, Artificial Sequence
  Synthetic
cccaagggtacaaggtactcgtcctgaacccgtccgttgccgccaccttaggttttggggcgtatatgtctaagg

SEQ ID NO: 121916 - DNA, 75 bp, Artificial Sequence
  Synthetic
tcgtcggcaaggtcgaagcagcattggagcggctcgtcgtcctcaatgcagccagcgccgcgggtaccgccggtt

SEQ ID NO: 121917 - DNA, 75 bp, Artificial Sequence
  Synthetic
agactttgactcagtcatcgactgcaatacctctgtaatacaaactgtggatttcagcctggatccaaccttctc

SEQ ID NO: 121918 - DNA, 75 bp, Artificial Sequence
  Synthetic
tgactcagtgatcgactgtaacacatgtgtcacccagacagtcgacttcagcttggatcccaccttcaccattga

SEQ ID NO: 121919 - DNA, 75 bp, Artificial Sequence
  Synthetic
agacggctggagcgcggcttgtcgtgctcgccaccgctacgcctccgggatcggtcaccgtgccacaccccaata

SEQ ID NO: 121920 - DNA, 75 bp, Artificial Sequence
  Synthetic
ggagagaggccgtccggcatatttgacacctcagtgctctgcgagtgctacgatgctgggtgcgcttggtacgaa

SEQ ID NO: 121921 - DNA, 75 bp, Artificial Sequence
  Synthetic
ggtgattctggccctgccccaacgggcatatgcctgggacaatagtcaggctgcatcacttggggtcgttgccct

SEQ ID NO: 121922 - DNA, 75 bp, Artificial Sequence
  Synthetic
cagttactctccgggcgagatcaacagggtggctgcatgcctcaggaagcttggggttccacccttgagagcctg

SEQ ID NO: 121923 - DNA, 75 bp, Artificial Sequence
  Synthetic
caggtttaaccaacatagatgctcatttcctatcccagaccaaacaagcgggcgacaattatccctacttggttg

SEQ ID NO: 121924 - DNA, 75 bp, Artificial Sequence
  Synthetic
atacatgattgggtgccagatttgcgggtcaggggcggtagggatgccatcattctgctcacctgcttgttacac

SEQ ID NO: 121925 - DNA, 75 bp, Artificial Sequence
  Synthetic
ggcgacaattatccctacttggttgcttatcaggccacggtctgcgctcgagcgctagcccccccaccaagctgg

SEQ ID NO: 121926 - DNA, 75 bp, Artificial Sequence
  Synthetic
tactctcggtgcggctctggtccctggattacacccaggtgcctagtcaactacccgtataggctttggcattat

SEQ ID NO: 121927 - DNA, 75 bp, Artificial Sequence
  Synthetic
gacatttatcacagcgtgtctcgtgcccgaccccgctggttgtactgtagcctactcctactagtcgtaggggta

SEQ ID NO: 121928 - DNA, 75 bp, Artificial Sequence
  Synthetic
cccacatcctcctgcgggcttgtatgttcttccgcaaagtggcggccggtaaatatgtgcaagcttgcctcttga

SEQ ID NO: 121929 - DNA, 75 bp, Artificial Sequence
  Synthetic
ggcgcctatgacatcataatatgtgatgagtgccactcaactgactcgactaccatcttgggcatcggcacagtc

SEQ ID NO: 121930 - DNA, 75 bp, Artificial Sequence
  Synthetic
taccatcttgggcatcggcacagtcctggaccaagcggagacggctggagcgcgactcgtcgtactcgccaccgc

SEQ ID NO: 121931 - DNA, 75 bp, Artificial Sequence
  Synthetic
agtcatcttttcccccatggagaaaaagatcattacgtggggtgcagacaccgctgcgtgtggcgacatcttgag

SEQ ID NO: 121932 - DNA, 75 bp, Artificial Sequence
  Synthetic
tgtcagggcagccggctattatcccagaccgagaagctctttaccaacagttcgatgaaatggaagaatgttcaa

SEQ ID NO: 121933 - DNA, 75 bp, Artificial Sequence
  Synthetic
gagtccaggaggacgcggcgagcctgagagccttcacggaggctatgaccaggtactccgccccccccggggacc

SEQ ID NO: 121934 - DNA, 75 bp, Artificial Sequence
  Synthetic
ggcgccagtggttaaaaccaacctcgagaaactcgagcagttctgggccaagcacatgtggaacttcattagcgg

SEQ ID NO: 121935 - DNA, 75 bp, Artificial Sequence
  Synthetic
tacgcccaacagacgcggggactggttggcactatagtgactagtttgaccggccgcgacaagaatgaagctgag

SEQ ID NO: 121936 - DNA, 75 bp, Artificial Sequence
  Synthetic
aatgagggcctcgggtgggcagggtggttgctctccccccgaggctctcggcctaattggggccccaatgacccc

SEQ ID NO: 121937 - DNA, 75 bp, Artificial Sequence
  Synthetic
ctcagtgatcgactgtaatacatgtgtcacccagacagtcgacttcagcttggaccctaccttcaccattgagac

SEQ ID NO: 121938 - DNA, 75 bp, Artificial Sequence
  Synthetic
gatccaatacctagctgggctttccacactgcccggcaatcctgctattgcttccctcatgtcattcactgcggc

SEQ ID NO: 121939 - DNA, 75 bp, Artificial Sequence
  Synthetic
ttctgctttgcatggtatctgaagggtaagtgggcgcccggagcggcctacgccgtctacgggatgtggcctctc

SEQ ID NO: 121940 - DNA, 75 bp, Artificial Sequence
  Synthetic
ttgccggaccaaaagggcccgtatgccagatgtatacaaatgttgaccaagacctggtgggctggccagcccccc

SEQ ID NO: 121941 - DNA, 75 bp, Artificial Sequence
  Synthetic
agaccaagctcatcacgtggggggcagacaccgccgcgtgcggtgatatcatcaacggcttgcccgtctctgccc

SEQ ID NO: 121942 - DNA, 75 bp, Artificial Sequence
  Synthetic
tcgcgctgctcttttgtcccccagacccataagcaccctcaaaggctcttcaggaggcccccttatgtgcccatc

SEQ ID NO: 121943 - DNA, 75 bp, Artificial Sequence
  Synthetic
gtcaacctgctcccggccatactatcgccgggggctctggtagtgggggtggtgtgcgcagcaattctgcgacgc

SEQ ID NO: 121944 - DNA, 75 bp, Artificial Sequence
  Synthetic
catgtggggccaggtgaaggggctgtgcagtggatgaaccgtctcattgccttcgcttcgcgaggcaatcacgtg

SEQ ID NO: 121945 - DNA, 75 bp, Artificial Sequence
  Synthetic
tctcctgtgtttaccgacaactcctcgccgcctgcggtgcctcagacctaccaggtggggtacctgcacgctccg

SEQ ID NO: 121946 - DNA, 75 bp, Artificial Sequence
  Synthetic
tctcccacacactatgtccctgaatctgacgcggcagcccgcgtaacagccatactgtcatccctcaccgtgacc

SEQ ID NO: 121947 - DNA, 75 bp, Artificial Sequence
  Synthetic
agcgtgggtacaagggagtctggcggggagatggcgtcatgcaaaccacctgcccatgtggagcacaaattgccg

SEQ ID NO: 121948 - DNA, 75 bp, Artificial Sequence
  Synthetic
gggcatacatgagcaaagctcatggtatagacccgaatatccggacgggtgtcaggaccatcaccacagggggtc

SEQ ID NO: 121949 - DNA, 75 bp, Artificial Sequence
  Synthetic
tgagtgacttcaagacatggcttaaagccaaattactgccccgcatgcctggagtaccctttctctcctgtcaaa

SEQ ID NO: 121950 - DNA, 75 bp, Artificial Sequence
  Synthetic
aacgacggtgcttggcatcggcactgtcctagaccaggcagaaaccgcgggggtccgcctcacggtgctcgctac

SEQ ID NO: 121951 - DNA, 75 bp, Artificial Sequence
  Synthetic
ctcataaataccaacgggagctggcacatcaacagaactgcccttaactgtaatgacagcctccagactgggttt

SEQ ID NO: 121952 - DNA, 75 bp, Artificial Sequence
  Synthetic
ctcgaatttatcaaggggggaagacatctcatcttctgtcactcaaagaagaaatgcgacgaactgtctaaacaa

SEQ ID NO: 121953 - DNA, 75 bp, Artificial Sequence
  Synthetic
gactcttttgacccgctccgagcggaggaggatgagagggaagtgtccgttgcggcggagatcctgcggaaaacc

SEQ ID NO: 121954 - DNA, 75 bp, Artificial Sequence
  Synthetic
ttatgaccggctacacgggcgactttgactctgtcattgattgtaacgtagccgtgacgcaggtggtagacttca

SEQ ID NO: 121955 - DNA, 75 bp, Artificial Sequence
  Synthetic
aacatctatgctaacagatccatctcatataacagcggagacagcccgccgcagattggctaggggatctccacc

SEQ ID NO: 121956 - DNA, 75 bp, Artificial Sequence
  Synthetic
acgggtgcccattgccgcccaccaaggtccctccgatacctcctccacggagaaagaagacagttatcctgacag

SEQ ID NO: 121957 - DNA, 75 bp, Artificial Sequence
  Synthetic
gtataggtttgtctcgcagggggaaagaccttcaggtatgtttgatagcgtcgtgctctgtgaagcttatgacac

SEQ ID NO: 121958 - DNA, 75 bp, Artificial Sequence
  Synthetic
ttggggcgaaaatgagactgacatctttctcttgaacaacacgaggccccctactggcaactggtttggctgcac

SEQ ID NO: 121959 - DNA, 75 bp, Artificial Sequence
  Synthetic
tcctggcgtagacctcatagaggctaacctcatgtggggtgcatccgctactaggattgagactgagaataaggt

SEQ ID NO: 121960 - DNA, 75 bp, Artificial Sequence
  Synthetic
gcgacatgcactacccatcatgactccccggacgctgacctcatcgaggccaacctcctgtggcggcaggagatg

SEQ ID NO: 121961 - DNA, 75 bp, Artificial Sequence
  Synthetic
ttttgggagggggtattcacaggattgactcacatagatgcccacttcttgtcccagacgaagcaggggggcgag

SEQ ID NO: 121962 - DNA, 75 bp, Artificial Sequence
  Synthetic
acggggatacctatgtgacaggagggacgagcggccgcgccaccgccgggttcgtgtccctctttgcatccggac

SEQ ID NO: 121963 - DNA, 75 bp, Artificial Sequence
  Synthetic
agccgaccctcacaggtcctacccccctcctatatcgtctgggggctgtccaaaatgagatagtaacaacacatc

SEQ ID NO: 121964 - DNA, 75 bp, Artificial Sequence
  Synthetic
gtcgttctcaccgagtccaacgttgcccaagctctgtctgacttggccgaagtaacctttagccggggaccgcca

SEQ ID NO: 121965 - DNA, 75 bp, Artificial Sequence
  Synthetic
ccgtacggaggaggcaatctaccagtgttgtgacctggacccccaggcccgcgtggccatcaagtccctcaccga

SEQ ID NO: 121966 - DNA, 75 bp, Artificial Sequence
  Synthetic
ctgtttgacagtgggctgtgttgtcatctgtggcaggatcgtgacaagcggcaagcctgcggttgtccctgatcg

SEQ ID NO: 121967 - DNA, 75 bp, Artificial Sequence
  Synthetic
tgcctccacttgaaggggaacctggcgaccctgacttgacatctgactcctggtccaccgttagcggctcggagg

SEQ ID NO: 121968 - DNA, 75 bp, Artificial Sequence
  Synthetic
tacaccgagcccgaggacctggaccagaggccttactgctggcactacgcacctagaaagtgcggcatcataccc

SEQ ID NO: 121969 - DNA, 75 bp, Artificial Sequence
  Synthetic
cgaccctgacttgacatctgactcctggtccaccgttagcggctcggaggacgtcgtgtgttgctcgatgtctta

SEQ ID NO: 121970 - DNA, 75 bp, Artificial Sequence
  Synthetic
ctcatggacgggggctcttgtgacaccctgtgcggctgaggaaacaaagctgccgattagccccctgagcaactc

SEQ ID NO: 121971 - DNA, 75 bp, Artificial Sequence
  Synthetic
gtccttgggctgctccaggccggcaccaaacatgcagaagaactgaaacccgctatccattccacgtggcccagg

SEQ ID NO: 121972 - DNA, 75 bp, Artificial Sequence
  Synthetic
tactccacgacttcccgctctgccgttactcggcagaagaaggtcaccttcgaccgcatgcaggtggtagacagt

SEQ ID NO: 121973 - DNA, 75 bp, Artificial Sequence
  Synthetic
cgaccgcatgcaggtggtagacagtcactacaatgaagtactcaaggagattaaggtacgagcatccactgtgac

SEQ ID NO: 121974 - DNA, 75 bp, Artificial Sequence
  Synthetic
taatgtcattcacagcgtccttgactagtcctctaaggacctcccagaccctgttgctcaacatattgggcggct

SEQ ID NO: 121975 - DNA, 75 bp, Artificial Sequence
  Synthetic
tgccacctactaaggcccctccaataccacctccacggaggaaaaggacggttgtcctgacagaatccaccgtgt

SEQ ID NO: 121976 - DNA, 75 bp, Artificial Sequence
  Synthetic
tgttgacatccttgccgggtacggggccggtgtggcgggtgcactggtcgcctttaagatcatgagcggcgagtg

SEQ ID NO: 121977 - DNA, 75 bp, Artificial Sequence
  Synthetic
gccttgctccaccttggtaggctgaccggaacgtacatttatgaccaccttgcccccatgaaggattgggcagcg

SEQ ID NO: 121978 - DNA, 75 bp, Artificial Sequence
  Synthetic
caccagcacagcgggtcgaataccttctggccgcatggcggtcgaagaagagccccatggggttctcatatgaca

SEQ ID NO: 121979 - DNA, 75 bp, Artificial Sequence
  Synthetic
ggcccctctgaaggcgctaaccagtggatgaacaggctaatagcctttgcctccaggggcaaccatgtctctcct

SEQ ID NO: 121980 - DNA, 75 bp, Artificial Sequence
  Synthetic
cgcgctcacggagagactctacgtgggcggccccatgtacaacagcaagggggacctttgcggtgtccgcaggtg

SEQ ID NO: 121981 - DNA, 75 bp, Artificial Sequence
  Synthetic
acgaggatacgtccacgccttgcgcgtcctcatggctgcgagacgtgtgggactgggtgtgtacagtgctatctg

SEQ ID NO: 121982 - DNA, 75 bp, Artificial Sequence
  Synthetic
ggcggccccatgtacaacagcaagggggacctttgcggtgtccgcaggtgccgcgctagcggcgtattcaccacc

SEQ ID NO: 121983 - DNA, 75 bp, Artificial Sequence
  Synthetic
catatgccatggaccgggagatggctgcatcatgtggaggcgcggttttcataggtctggcaattttgaccttgt

SEQ ID NO: 121984 - DNA, 75 bp, Artificial Sequence
  Synthetic
ggtgtgtcacaccacttgctcatgcggggctcaaattgctggacacgtgaagaacgggtctatgaagatcacagg

SEQ ID NO: 121985 - DNA, 75 bp, Artificial Sequence
  Synthetic
atggcaaaaaatgaggttttctgcgtccaaccagagaaaggaggccgcaagccagctcgccttatcgtattccca

SEQ ID NO: 121986 - DNA, 75 bp, Artificial Sequence
  Synthetic
tcgtcatcgctgagagcgggggcgtcgaggaggacaagcgagctctcggagccttcacggaggctatgacgagat

SEQ ID NO: 121987 - DNA, 75 bp, Artificial Sequence
  Synthetic
cgaggaggacaagcgagctctcggagccttcacggaggctatgacgagatactcagctcccccaggagacgctcc

SEQ ID NO: 121988 - DNA, 75 bp, Artificial Sequence
  Synthetic
gcagccagcctacgacctcgagctcataacatcatgctcatccaatgtctcggtagcgcacgatgccacgggcaa

SEQ ID NO: 121989 - DNA, 75 bp, Artificial Sequence
  Synthetic
ctctggcgagtttccgctgaggagtacgttgaagtagagaggcacggcgaccgtcactatgtggtgggagtcact

SEQ ID NO: 121990 - DNA, 75 bp, Artificial Sequence
  Synthetic
gctgatggccttaaatgcccttgccaagttcccggacctgagttcttcactgaggtggatggcgtaaggatacat

SEQ ID NO: 121991 - DNA, 75 bp, Artificial Sequence
  Synthetic
atactttacgcgcctacaatttgggtgcgcatggtattgatgacccacttcttttcaatactccaaagccaggaa

SEQ ID NO: 121992 - DNA, 75 bp, Artificial Sequence
  Synthetic
cagcctaccaagtgcgcaactcctcggggctttaccatgtcaccaatgattgccctaactcgagcattgtgtacg

SEQ ID NO: 121993 - DNA, 75 bp, Artificial Sequence
  Synthetic
agcctgacgtgaccgtagtcacgtcaatgctcactgacccctcacacatcaccgcagagacagcctctcggcgct

SEQ ID NO: 121994 - DNA, 75 bp, Artificial Sequence
  Synthetic
aggtcatcacctggggggcagacaccgcggcgtgtggggacatcatctcgggcctacccgtctccgcccgaaggg

SEQ ID NO: 121995 - DNA, 75 bp, Artificial Sequence
  Synthetic
cgccgagctgatcgaggccaatctcctatggagacaggagatgggaagcaacatcacccgggttgagtcggagac

SEQ ID NO: 121996 - DNA, 75 bp, Artificial Sequence
  Synthetic
ttccctcctgctctcccgatttgggccagacctgactacaatccacctctcctacagaaatggcaaatgcccgga

SEQ ID NO: 121997 - DNA, 75 bp, Artificial Sequence
  Synthetic
ctgtatcgcaagctctacaacagctggctgataaggtgtttgtggaggacactagcacctcagagccgagctccg

SEQ ID NO: 121998 - DNA, 75 bp, Artificial Sequence
  Synthetic
actggggagtcctggcgggcatagcgtatttctccatggtggggaactgggcaaaggtcctggtggtgctgctgc

SEQ ID NO: 121999 - DNA, 75 bp, Artificial Sequence
  Synthetic
ctcttcgggctgtcccgagaggttggccagctgccgacgccttaccgactttgcccagggctggggccctatcag

SEQ ID NO: 122000 - DNA, 75 bp, Artificial Sequence
  Synthetic
gggggaacctggagacccagacttgagcactggttcctggtccactgttagtgaagaggacgatgtcgtctgttg

SEQ ID NO: 122001 - DNA, 75 bp, Artificial Sequence
  Synthetic
ctctatgtcatacacttggacgggggccttgatcacaccatgcgctgctgaggaggagaaattgccaataaaccc

SEQ ID NO: 122002 - DNA, 75 bp, Artificial Sequence
  Synthetic
ggatcaattatgcaacagggaatcttcctggttgctctttctctatcttcctcttggcacttctctcgtgcctga

SEQ ID NO: 122003 - DNA, 75 bp, Artificial Sequence
  Synthetic
aatgatacggacgttttcgtccttaacaacaccaggccaccgctgggcaactggttcggttgcacctggatgaac

SEQ ID NO: 122004 - DNA, 75 bp, Artificial Sequence
  Synthetic
aggagccatactagcaaggccgttaaacacatcgactccgtgtgggaggacttgctagaagacaatgccacccca

SEQ ID NO: 122005 - DNA, 75 bp, Artificial Sequence
  Synthetic
atgtggatctgatggtgggggctgccactgtttgctcagccctttacatcggggatttgtgtggcggcttattct

SEQ ID NO: 122006 - DNA, 75 bp, Artificial Sequence
  Synthetic
tgcgggtttgcgagaagatggcactctacgatgtgacgcagaagttgcctaagaccgtgatgggatctgcatacg

SEQ ID NO: 122007 - DNA, 75 bp, Artificial Sequence
  Synthetic
ttcgaccgtcaccgagcgggatatccgaactgaagaggacatctaccaatcttgccaactagaccctaccgcgag

SEQ ID NO: 122008 - DNA, 75 bp, Artificial Sequence
  Synthetic
acttcagcatgcaagccaattgggccaaagtcatcttggtcctattcctctttgcaggggttgatgctagaactg

SEQ ID NO: 122009 - DNA, 75 bp, Artificial Sequence
  Synthetic
agttcaactcgtccggatgcccagagcgcatggccagctgccgccccatcgacaagttcgctcaagggtggggtc

SEQ ID NO: 122010 - DNA, 75 bp, Artificial Sequence
  Synthetic
ggctgtcccgagaggttggccagctgccgaccccttaccgattttgaccagggctggggccctatcagtcatgcc

SEQ ID NO: 122011 - DNA, 75 bp, Artificial Sequence
  Synthetic
gtgctcactaccagtttggggaacaccctcacttgttatcttaaggcacaggcggcgtgtagggcagccaacatc

SEQ ID NO: 122012 - DNA, 75 bp, Artificial Sequence
  Synthetic
ctggcacataaacaggactgccctcaactgcaatgacagattaaacactggattcttggctagcttgttctacac

SEQ ID NO: 122013 - DNA, 75 bp, Artificial Sequence
  Synthetic
ctggcacataaacaggactgccctcaactgcaatgacagattaaacactggtttcttggctagcttgttctacac

SEQ ID NO: 122014 - DNA, 75 bp, Artificial Sequence
  Synthetic
ctggcacataaacaggactgccctcaactgcaatgacagattaaacactggcttcttggctagcttgttctacac

SEQ ID NO: 122015 - DNA, 75 bp, Artificial Sequence
  Synthetic
ctggcacataaacaggactgccctcaactgcaatgacagattaaacactgggttcttggctagcttgttctacac

SEQ ID NO: 122016 - DNA, 75 bp, Artificial Sequence
  Synthetic
ctggcacataaacaggactgccctcaactgcaatgacagtttaaacactggattcttggctagcttgttctacac

SEQ ID NO: 122017 - DNA, 75 bp, Artificial Sequence
  Synthetic
ctggcacataaacaggactgccctcaactgcaatgacagtttaaacactggtttcttggctagcttgttctacac

SEQ ID NO: 122018 - DNA, 75 bp, Artificial Sequence
  Synthetic
ctggcacataaacaggactgccctcaactgcaatgacagtttaaacactggcttcttggctagcttgttctacac

SEQ ID NO: 122019 - DNA, 75 bp, Artificial Sequence
  Synthetic
ctggcacataaacaggactgccctcaactgcaatgacagtttaaacactgggttcttggctagcttgttctacac

SEQ ID NO: 122020 - DNA, 75 bp, Artificial Sequence
  Synthetic
ctggcacataaacaggactgccctcaactgcaatgacagcttaaacactggattcttggctagcttgttctacac

SEQ ID NO: 122021 - DNA, 75 bp, Artificial Sequence
  Synthetic
ctggcacataaacaggactgccctcaactgcaatgacagcttaaacactggtttcttggctagcttgttctacac

SEQ ID NO: 122022 - DNA, 75 bp, Artificial Sequence
  Synthetic
ctggcacataaacaggactgccctcaactgcaatgacagcttaaacactggcttcttggctagcttgttctacac

SEQ ID NO: 122023 - DNA, 75 bp, Artificial Sequence
  Synthetic
ctggcacataaacaggactgccctcaactgcaatgacagcttaaacactgggttcttggctagcttgttctacac

SEQ ID NO: 122024 - DNA, 75 bp, Artificial Sequence
  Synthetic
ctggcacataaacaggactgccctcaactgcaatgacaggttaaacactggattcttggctagcttgttctacac

SEQ ID NO: 122025 - DNA, 75 bp, Artificial Sequence
  Synthetic
ctggcacataaacaggactgccctcaactgcaatgacaggttaaacactggtttcttggctagcttgttctacac

SEQ ID NO: 122026 - DNA, 75 bp, Artificial Sequence
  Synthetic
ctggcacataaacaggactgccctcaactgcaatgacaggttaaacactggcttcttggctagcttgttctacac

SEQ ID NO: 122027 - DNA, 75 bp, Artificial Sequence
  Synthetic
ctggcacataaacaggactgccctcaactgcaatgacaggttaaacactgggttcttggctagcttgttctacac

SEQ ID NO: 122028 - DNA, 75 bp, Artificial Sequence
  Synthetic
ccagcttgtgaattccaacggcagctggcatgtgaacaggaccgccctcaactgcaatgatagcctccacaccgg

SEQ ID NO: 122029 - DNA, 75 bp, Artificial Sequence
  Synthetic
ccacagtttcaacagctcagggtgtcccggacgactcgcaagctgcaaaagccttgaaacatttaaccaaggctg

SEQ ID NO: 122030 - DNA, 75 bp, Artificial Sequence
  Synthetic
ccacagtttcaacagctcagggtgtcccggacgactcgcaagctgcaaaagccttgatacatttaaccaaggctg

SEQ ID NO: 122031 - DNA, 75 bp, Artificial Sequence
  Synthetic
ccacagtttcaacagctcagggtgtcccggacgactcgcaagctgcaaaagccttgacacatttaaccaaggctg

SEQ ID NO: 122032 - DNA, 75 bp, Artificial Sequence
  Synthetic
ccacagtttcaacagctcagggtgtcccggacgactcgcaagctgcaaaagccttgagacatttaaccaaggctg

SEQ ID NO: 122033 - DNA, 75 bp, Artificial Sequence
  Synthetic
ccacagtttcaacagctcagggtgtcccggacgactcgcaagctgcataagccttgaaacatttaaccaaggctg

SEQ ID NO: 122034 - DNA, 75 bp, Artificial Sequence
  Synthetic
ccacagtttcaacagctcagggtgtcccggacgactcgcaagctgcataagccttgatacatttaaccaaggctg

SEQ ID NO: 122035 - DNA, 75 bp, Artificial Sequence
  Synthetic
ccacagtttcaacagctcagggtgtcccggacgactcgcaagctgcataagccttgacacatttaaccaaggctg

SEQ ID NO: 122036 - DNA, 75 bp, Artificial Sequence
  Synthetic
ccacagtttcaacagctcagggtgtcccggacgactcgcaagctgcataagccttgagacatttaaccaaggctg

SEQ ID NO: 122037 - DNA, 75 bp, Artificial Sequence
  Synthetic
ccacagtttcaacagctcagggtgtcccggacgactcgcaagctgcacaagccttgaaacatttaaccaaggctg

SEQ ID NO: 122038 - DNA, 75 bp, Artificial Sequence
  Synthetic
ccacagtttcaacagctcagggtgtcccggacgactcgcaagctgcacaagccttgatacatttaaccaaggctg

SEQ ID NO: 122039 - DNA, 75 bp, Artificial Sequence
  Synthetic
ccacagtttcaacagctcagggtgtcccggacgactcgcaagctgcacaagccttgacacatttaaccaaggctg

SEQ ID NO: 122040 - DNA, 75 bp, Artificial Sequence
  Synthetic
ccacagtttcaacagctcagggtgtcccggacgactcgcaagctgcacaagccttgagacatttaaccaaggctg

SEQ ID NO: 122041 - DNA, 75 bp, Artificial Sequence
  Synthetic
ccacagtttcaacagctcagggtgtcccggacgactcgcaagctgcagaagccttgaaacatttaaccaaggctg

SEQ ID NO: 122042 - DNA, 75 bp, Artificial Sequence
  Synthetic
ccacagtttcaacagctcagggtgtcccggacgactcgcaagctgcagaagccttgatacatttaaccaaggctg

SEQ ID NO: 122043 - DNA, 75 bp, Artificial Sequence
  Synthetic
ccacagtttcaacagctcagggtgtcccggacgactcgcaagctgcagaagccttgacacatttaaccaaggctg

SEQ ID NO: 122044 - DNA, 75 bp, Artificial Sequence
  Synthetic
ccacagtttcaacagctcagggtgtcccggacgactcgcaagctgcagaagccttgagacatttaaccaaggctg

SEQ ID NO: 122045 - DNA, 75 bp, Artificial Sequence
  Synthetic
gagcgccggcgtacaggaggatgtcgtagcactgagagcgtttacagacgctatgatcagatactcagctccccc

SEQ ID NO: 122046 - DNA, 75 bp, Artificial Sequence
  Synthetic
ctcccagccctgtcgtggtcggaacaactgatcgcctcggggtccctacttacacctggggggagaatgagtctg

SEQ ID NO: 122047 - DNA, 75 bp, Artificial Sequence
  Synthetic
aactgatcgcctcggggtccctacttacacctggggggagaatgagtctgatgtcttccttttgaactcgaccag

SEQ ID NO: 122048 - DNA, 75 bp, Artificial Sequence
  Synthetic
tacacctggggggagaatgagtctgatgtcttccttttgaactcgaccagaccgccacaaggtgcgtggttcggg

SEQ ID NO: 122049 - DNA, 75 bp, Artificial Sequence
  Synthetic
accgccacaaggtgcgtggttcgggtgcgtgtggatgaacagcaccgggtttacaaaagcctgtggtgctcctcc

SEQ ID NO: 122050 - DNA, 75 bp, Artificial Sequence
  Synthetic
caatgccaggagcagttggaggcggcacttaattttgacatgtatggggtaacctactccgtcactccactcgat

SEQ ID NO: 122051 - DNA, 75 bp, Artificial Sequence
  Synthetic
cacttaattttgacatgtatggggtaacctactccgtcactccactcgatctccctgcaatcattcaacgactcc

SEQ ID NO: 122052 - DNA, 75 bp, Artificial Sequence
  Synthetic
atgtggcccagtgtattgcttcactcccagccccgtggtagtggggacgaccaacaagttgggcgcgcctaccta

SEQ ID NO: 122053 - DNA, 75 bp, Artificial Sequence
  Synthetic
gcaacgtactcaaggtgcgggtcggggccttggctcactccccggtgtttggtagactacccataccggctgtgg

SEQ ID NO: 122054 - DNA, 75 bp, Artificial Sequence
  Synthetic
ctccggatctgcgcgctagcgcggaagatggccggaggccattacgtgcaaatggtcatcatcaagttaggggcg

SEQ ID NO: 122055 - DNA, 75 bp, Artificial Sequence
  Synthetic
tatccttataggctttggcattatccttgtactgtcaactacaccctgttcaaagtcaggatgtacgtgggaggg

SEQ ID NO: 122056 - DNA, 75 bp, Artificial Sequence
  Synthetic
cttgggccctcaagtgggaatatgtggtgctcgtgttcctgcttcttgcagacgcgagagtctctgcttgcctat

SEQ ID NO: 122057 - DNA, 75 bp, Artificial Sequence
  Synthetic
gacgcgagagtctctgcttgcctatggatgatgtttatggtatcccaggtcgaggcggctctgtccaacctaatt

SEQ ID NO: 122058 - DNA, 75 bp, Artificial Sequence
  Synthetic
tctttggtggctccatcttagccctagtcacggctagctgtgaaaggtccgtgagccgcatgactgcagagagtg

SEQ ID NO: 122059 - DNA, 75 bp, Artificial Sequence
  Synthetic
atttgatcgtcctaaacgccacctctgccgttagcaatcagggcctgctatttgggttggttttcatctgcatcg

SEQ ID NO: 122060 - DNA, 75 bp, Artificial Sequence
  Synthetic
tcggtccgctcatggtgctccaggctggcataactagagtgccgtactttgtgcgcgctcaagggctcattcgtg

SEQ ID NO: 122061 - DNA, 75 bp, Artificial Sequence
  Synthetic
tgttatgcttaccccgtagggctgccgctcacactaatgaggaggcagcttctttggggtttcttgcgcttgcta

SEQ ID NO: 122062 - DNA, 75 bp, Artificial Sequence
  Synthetic
agtcatggctggctaagggaatgtggtggatacagtattttatagctagggctgaggccttggtgcatgtctatg

SEQ ID NO: 122063 - DNA, 75 bp, Artificial Sequence
  Synthetic
agtcatggctggctaagggtatgtggtggatacagtattttatagctagggctgaggccttggtgcatgtctatg

SEQ ID NO: 122064 - DNA, 75 bp, Artificial Sequence
  Synthetic
agtcatggctggctaagggcatgtggtggatacagtattttatagctagggctgaggccttggtgcatgtctatg

SEQ ID NO: 122065 - DNA, 75 bp, Artificial Sequence
  Synthetic
agtcatggctggctaaggggatgtggtggatacagtattttatagctagggctgaggccttggtgcatgtctatg

SEQ ID NO: 122066 - DNA, 75 bp, Artificial Sequence
  Synthetic
gggtccatctttcttgtcggccaactattcaccttctcccccaggcgccactggacgaagcaagactgcaattgt

SEQ ID NO: 122067 - DNA, 75 bp, Artificial Sequence
  Synthetic
gtcctggcttgcccacacctgacatttgacatcacaaagcatctcctggccatcttggggcccctctacatactc

SEQ ID NO: 122068 - DNA, 75 bp, Artificial Sequence
  Synthetic
tcgagcccgtcgtcttttctgacatggagaccaagatcatcacttggggggcggacaccgcggcgtgcggggaca

SEQ ID NO: 122069 - DNA, 75 bp, Artificial Sequence
  Synthetic
ggagcctggactgggacatacatatatgaccacttgacccctctttctgactgggcctgcgacggcttgcgagac

SEQ ID NO: 122070 - DNA, 75 bp, Artificial Sequence
  Synthetic
gatggccggaggccattacgtgcagatggccatcatcaaggtgggggcgcttaccggcacctatgtttataacca

SEQ ID NO: 122071 - DNA, 75 bp, Artificial Sequence
  Synthetic
caatcacccaaatgtacaccaatgtggaccaggacctcgtcggctggccggcgccccccggggcgcgctccttaa

SEQ ID NO: 122072 - DNA, 75 bp, Artificial Sequence
  Synthetic
caccatgcacctgcggcagctcggacctttacctggtcacgagacatgctgatgtcatcccggtgcgccggcggg

SEQ ID NO: 122073 - DNA, 75 bp, Artificial Sequence
  Synthetic
atgtggaccgtctaccacggggcgggtagcaagaccatcagcggcccgaagggacctgtcaatcaaatgtacacc

SEQ ID NO: 122074 - DNA, 75 bp, Artificial Sequence
  Synthetic
ctcgaggggtagctaaagcggtggactttgtcccggtcgaatctcttgagaccactatgaggtcaccagtgttca

SEQ ID NO: 122075 - DNA, 75 bp, Artificial Sequence
  Synthetic
gtatgctgctcaagggtacaaggtcctagtgctgaatccatcagtagcagctacacttgggtttggggcatatat

SEQ ID NO: 122076 - DNA, 75 bp, Artificial Sequence
  Synthetic
gtgcttaacccctcggttgcggccacactgggatttggggcgtacatgtccaaggcatacggcatcgacccaaac

SEQ ID NO: 122077 - DNA, 75 bp, Artificial Sequence
  Synthetic
agcggcagttggcacatcaatcgcacggccttgaactgtaatgcgagcctcgacactggctgggtagcggggctc

SEQ ID NO: 122078 - DNA, 75 bp, Artificial Sequence
  Synthetic
ctgttctatacacacaggttcaacgcgtccggatgcgcagagcgcatggccagctgccgccccattgatacattc

SEQ ID NO: 122079 - DNA, 75 bp, Artificial Sequence
  Synthetic
cctggtagcgtaccaagccaccgtgtgcgctagggctcaagccccccccccatcgtgggaccagatgtggaagtg

SEQ ID NO: 122080 - DNA, 75 bp, Artificial Sequence
  Synthetic
tgtgctcgcaaccgctaccccgccagggtcggtgactacaccccattccaacatagaggaggtcgccctgccgac

SEQ ID NO: 122081 - DNA, 75 bp, Artificial Sequence
  Synthetic
cgtcggaggtgtgcggtccagtgtattgtttcaccccaagccctgtcgtcgtggggacgaccgatcgtttcggtg

SEQ ID NO: 122082 - DNA, 75 bp, Artificial Sequence
  Synthetic
aaggcaatccccctagagctaatcaaggggggcagacacctcatcttctgccactcaaagaaaaagtgtgatgaa

SEQ ID NO: 122083 - DNA, 75 bp, Artificial Sequence
  Synthetic
aggggggcagacacctcatcttctgccactcaaagaaaaagtgtgatgaactggccaaacaactaacatctctcg

SEQ ID NO: 122084 - DNA, 75 bp, Artificial Sequence
  Synthetic
aacacgcggccgccgcaaggcaactggtttggctgtacatggatgaatggcactgggttcaccaagacgtgcggg

SEQ ID NO: 122085 - DNA, 75 bp, Artificial Sequence
  Synthetic
ccatcttcaagataagaatgtatgtgggaggggttgagcacaggctcacggccgcatgcaatttcattcgtgggg

SEQ ID NO: 122086 - DNA, 75 bp, Artificial Sequence
  Synthetic
aatacatgtatggcctatcacctgccctcacaagatacatcgtccgatgggagtgggtagtactcttattcctgc

SEQ ID NO: 122087 - DNA, 75 bp, Artificial Sequence
  Synthetic
ggtacgtctcgcaaggggagcgaccgtcaggcatgtttgactccgtcgtcctatgcgaggcgtacgatacaggct

SEQ ID NO: 122088 - DNA, 75 bp, Artificial Sequence
  Synthetic
tattttctcatcttttttgtggctgcttggtacatcaagggtcgggcggtccccttagctgcctattccctcacc

SEQ ID NO: 122089 - DNA, 75 bp, Artificial Sequence
  Synthetic
tgattaccctcttcacactcaccccgggatataagaccctcctaagccggtgtctgtggtggttgtgttatctcc

SEQ ID NO: 122090 - DNA, 75 bp, Artificial Sequence
  Synthetic
tgattaccctcttcacactcaccccgggttataagaccctcctaagccggtgtctgtggtggttgtgttatctcc

SEQ ID NO: 122091 - DNA, 75 bp, Artificial Sequence
  Synthetic
tgattaccctcttcacactcaccccgggctataagaccctcctaagccggtgtctgtggtggttgtgttatctcc

SEQ ID NO: 122092 - DNA, 75 bp, Artificial Sequence
  Synthetic
tgattaccctcttcacactcaccccggggtataagaccctcctaagccggtgtctgtggtggttgtgttatctcc

SEQ ID NO: 122093 - DNA, 75 bp, Artificial Sequence
  Synthetic
tagagtgccgtactttgtgcgcgctcatgggctcattcgcgcgtgcatgctattgcggaaagttgctgggggtca

SEQ ID NO: 122094 - DNA, 75 bp, Artificial Sequence
  Synthetic
actcaacaaacccttcttttcaacatcttggggggatgggtggcctcacagattgcaactccgacggcttctaca

SEQ ID NO: 122095 - DNA, 75 bp, Artificial Sequence
  Synthetic
ttcccgtgtccgcccgacttggtcgggagatcctccttggcccagctgatggctacacctctaaggggtggaggc

SEQ ID NO: 122096 - DNA, 75 bp, Artificial Sequence
  Synthetic
gctggctacggcgccggcgtagctggcgctgtggttacttttaagatcatgagcggcgagatgccatccacggag

SEQ ID NO: 122097 - DNA, 75 bp, Artificial Sequence
  Synthetic
cgggggttttatggaccgtctaccatggagctggcaataagaccctagccggctcacggggtccggtcacacaga

SEQ ID NO: 122098 - DNA, 75 bp, Artificial Sequence
  Synthetic
atgccaggtatccccttcctctcgtgccagaggggttataagggagagtggcgtggagatggcgtaatgcacacc

SEQ ID NO: 122099 - DNA, 75 bp, Artificial Sequence
  Synthetic
atgccaggtatccccttcctctcgtgccagaggggttatatgggagagtggcgtggagatggcgtaatgcacacc

SEQ ID NO: 122100 - DNA, 75 bp, Artificial Sequence
  Synthetic
atgccaggtatccccttcctctcgtgccagaggggttatacgggagagtggcgtggagatggcgtaatgcacacc

SEQ ID NO: 122101 - DNA, 75 bp, Artificial Sequence
  Synthetic
atgccaggtatccccttcctctcgtgccagaggggttataggggagagtggcgtggagatggcgtaatgcacacc

SEQ ID NO: 122102 - DNA, 75 bp, Artificial Sequence
  Synthetic
aacagctacatggtgaccaatgactgttccaatgacagcatcacctggcagcttcaggcggcggtcctccacgtc

SEQ ID NO: 122103 - DNA, 75 bp, Artificial Sequence
  Synthetic
tgtggctgccccctttgtcggcgcgccgctcgaatctatgcgacggcacgtggatctaatggtgggcgcggccac

SEQ ID NO: 122104 - DNA, 75 bp, Artificial Sequence
  Synthetic
accaccctcgttagctagttcctcggctagccagttgtccgccccgtctctcaaggccacatgcaccggtcgcca

SEQ ID NO: 122105 - DNA, 75 bp, Artificial Sequence
  Synthetic
ggtgttttggcgggactcgcgttcttcagcatgcaagccaattgggccaaagtgatcctgatcctgttcttgttt

SEQ ID NO: 122106 - DNA, 75 bp, Artificial Sequence
  Synthetic
tcagcatgcaagccaattgggccaaagtgatcctgatcctgttcttgtttgccggggttgacgccagcacgcatg

SEQ ID NO: 122107 - DNA, 75 bp, Artificial Sequence
  Synthetic
atgacagggaggtctcggtcgccgcggaaatcctgcgtccgactaagaagtttcccccagctctaccgatctggg

SEQ ID NO: 122108 - DNA, 75 bp, Artificial Sequence
  Synthetic
tttcccccagctctaccgatctgggctcgaccagattacaatccacctctcaccgagacatggaagcaacaggac

SEQ ID NO: 122109 - DNA, 75 bp, Artificial Sequence
  Synthetic
gagaggctcgcgtcgtgcaaacgcctagaggactttcctcaaggctggggcccactcaccgccgctaacatcagc

SEQ ID NO: 122110 - DNA, 75 bp, Artificial Sequence
  Synthetic
aggccttattgctggcactacgcacctcgaccgtgtggtatcgtacccgcgtcgcaggtgtgtggtccagtgtat

SEQ ID NO: 122111 - DNA, 75 bp, Artificial Sequence
  Synthetic
ctagccccgtggtagttggcacaactgacttgtccgggtcccccacttacaactggggggaaaacgtgaccgatg

SEQ ID NO: 122112 - DNA, 75 bp, Artificial Sequence
  Synthetic
gacgcatctgatgacggatcttattcgtcaatgcctccactagagggggagcccggtgacccggacttgacatca

SEQ ID NO: 122113 - DNA, 75 bp, Artificial Sequence
  Synthetic
ctcaatcaacagcaactggtcgtgccccactgactgcttcaggaagcatccggacaccacctacctcaggtgcgg

SEQ ID NO: 122114 - DNA, 75 bp, Artificial Sequence
  Synthetic
catatagacgcccacttcctatcccagacaaagcagagtggggaaaaccttccttacctggtagcgtaccaagcc

SEQ ID NO: 122115 - DNA, 75 bp, Artificial Sequence
  Synthetic
cccactgactgcttcaggaagcatccggacaccacctacctcaggtgcggttcaggcccatggatcacgccgagg

SEQ ID NO: 122116 - DNA, 75 bp, Artificial Sequence
  Synthetic
atggtgtatgccacgactacccgttctgccgtaactcggcagaagaaggtgaccttcgaccgcctgcaggtggtg

SEQ ID NO: 122117 - DNA, 75 bp, Artificial Sequence
  Synthetic
ggcgacagcgttgtttgctgctcgatgtcctacagttggacgggagcgatcgtcacaccatgtgcaccagaggag

SEQ ID NO: 122118 - DNA, 75 bp, Artificial Sequence
  Synthetic
gaggaagcttgcgacctgacgcccccccactctgccaaatcaaaatttggctatggggcgaaggatgttcgtagc

SEQ ID NO: 122119 - DNA, 75 bp, Artificial Sequence
  Synthetic
tgaccttcgatcgcatgcaagtgctagaccaacattatcatgatgtccttaaggaggttaaactccgggcgtcac

SEQ ID NO: 122120 - DNA, 75 bp, Artificial Sequence
  Synthetic
aggtgacagcaaagctcctctcgattgaggatgcctgcgacctcacccccccacactcagctcgctcaaagtttg

SEQ ID NO: 122121 - DNA, 75 bp, Artificial Sequence
  Synthetic
tgcgcgtgcctctggatgatgatgctcgtagcgcaggttgaagccgccttggccgatctagtcaccctcaatgcc

SEQ ID NO: 122122 - DNA, 75 bp, Artificial Sequence
  Synthetic
tttgcgagaagagagcgcttcacgacgtcgtcaaccaactacctaaggccgtgatgggagccgcttacggcttcc

SEQ ID NO: 122123 - DNA, 75 bp, Artificial Sequence
  Synthetic
ggtatggggcaaaggatgtccggagtcatactagcaaggccattaaccacatcagctccgtgtgggaggacttgt

SEQ ID NO: 122124 - DNA, 75 bp, Artificial Sequence
  Synthetic
gggggcggaagccagctcgtctgatcgtttacccggatctaggggtccgggtgtgcgagaagagagcccttttcg

SEQ ID NO: 122125 - DNA, 75 bp, Artificial Sequence
  Synthetic
cttgcgggatgtggcccctgctcctcctcctcatcatgctcccccacagggcgtatgcttttgacggagaggtcg

SEQ ID NO: 122126 - DNA, 75 bp, Artificial Sequence
  Synthetic
cttcatagctaggtgtgaggccgtagtgcatgtttacatcccgtctttggtggttagggggccacgggattccgt

SEQ ID NO: 122127 - DNA, 75 bp, Artificial Sequence
  Synthetic
cttcatagctaggtgtgaggccgttgtgcatgtttacatcccgtctttggtggttagggggccacgggattccgt

SEQ ID NO: 122128 - DNA, 75 bp, Artificial Sequence
  Synthetic
cttcatagctaggtgtgaggccgtcgtgcatgtttacatcccgtctttggtggttagggggccacgggattccgt

SEQ ID NO: 122129 - DNA, 75 bp, Artificial Sequence
  Synthetic
cttcatagctaggtgtgaggccgtggtgcatgtttacatcccgtctttggtggttagggggccacgggattccgt

SEQ ID NO: 122130 - DNA, 75 bp, Artificial Sequence
  Synthetic
ctgtgcatcccttactacgtgagggctcacgcactggtcagaatttgtggcctcgtgcgcgggctggcgcatggc

SEQ ID NO: 122131 - DNA, 75 bp, Artificial Sequence
  Synthetic
aggtctcgtagaccgtgcaccatgagcacgaatcctaaacctcaaagaaaaaccaaaagaaacaccaaccgtcgc

SEQ ID NO: 122132 - DNA, 75 bp, Artificial Sequence
  Synthetic
acgaaccacagcccacctatgacttggagctgataacatcatgctcctcgaacgtctccgtagcccacgatggga

SEQ ID NO: 122133 - DNA, 75 bp, Artificial Sequence
  Synthetic
ccctccgtaggggtaggcatcttcttactccccgcccgataggcggggagcataacactccacactcctaagtgt

SEQ ID NO: 122134 - DNA, 75 bp, Artificial Sequence
  Synthetic
ccaaatgtacaccaatgttgaccaggacctggtaggttggccagcccccccaggagttaaatcattgacaccgtg

SEQ ID NO: 122135 - DNA, 75 bp, Artificial Sequence
  Synthetic
cccgctatttactcctgtgcctactcctactttccgtaggggtaggcatcttcctgctgcctgctcgataggcag

SEQ ID NO: 122136 - DNA, 75 bp, Artificial Sequence
  Synthetic
tccactacgtgacgggcatgaccaccgacaacgtgaaatgcccatgccaagtcccggcccctgaattcttcacgg

SEQ ID NO: 122137 - DNA, 75 bp, Artificial Sequence
  Synthetic
cccatcgccattctcaaaggatcttctggcgggccgctactatgctccaaaggacacgccgtaggcatattccgt

SEQ ID NO: 122138 - DNA, 75 bp, Artificial Sequence
  Synthetic
ttatccttgctcttctttcatgcctgactgtcccagcctctgcagttccctaccgaaatgcctctgggctttatc

SEQ ID NO: 122139 - DNA, 75 bp, Artificial Sequence
  Synthetic
gactgtcccagcctctgcagttccctaccgaaatgcctctgggctttatcatgttaccaatgactgcccgaactc

SEQ ID NO: 122140 - DNA, 75 bp, Artificial Sequence
  Synthetic
ccggtcttcacagacaactcatcccccccggccgtaccgcagacattccaagtggcccatctacacgctcccact

SEQ ID NO: 122141 - DNA, 75 bp, Artificial Sequence
  Synthetic
ccggacgtaacagtgctcacttccatgcttaccgacccctcccacatcacagcagagacggccaagcgtaggctg

SEQ ID NO: 122142 - DNA, 75 bp, Artificial Sequence
  Synthetic
cccccccggctgtgccccaaacataccaagtagcccacttgcatgctcccacggggagcggcaagagcaccaaag

SEQ ID NO: 122143 - DNA, 75 bp, Artificial Sequence
  Synthetic
gagcggtcacggctcctcttcggagggccgttgactacttagcgggaggggctgccctctgctccgcgctatacg

SEQ ID NO: 122144 - DNA, 75 bp, Artificial Sequence
  Synthetic
tgcggggcagggccttggttgacccccaaatgcctggtagactacccttatagattgtggcattatccgtgcact

SEQ ID NO: 122145 - DNA, 75 bp, Artificial Sequence
  Synthetic
ggctctgacagtcggacgccccctgatgagtcggccccctcggagacaggttctacctcctccatgccccccctt

SEQ ID NO: 122146 - DNA, 75 bp, Artificial Sequence
  Synthetic
catcgacccgaacatccggtcaggtgtcaggaccatcaccacaggtgcgccaatcacatactccacgtacgggaa

SEQ ID NO: 122147 - DNA, 75 bp, Artificial Sequence
  Synthetic
ggaatatgtcatcctcttgtttctcctgcttgcagatgcgcgcatttgctcctgcttgtggatgatgttacttat

SEQ ID NO: 122148 - DNA, 75 bp, Artificial Sequence
  Synthetic
caatcacatactccacgtacgggaaattcctggccgatggaggctgtggggggggagcttatgacatcatcattt

SEQ ID NO: 122149 - DNA, 75 bp, Artificial Sequence
  Synthetic
tggccatattaccggccaccgtatggcatgggacatgatgatgaattggtcacctacgacggccctggtgatggc

SEQ ID NO: 122150 - DNA, 75 bp, Artificial Sequence
  Synthetic
catggtgctccaggctggcataactaaagtgccgtacttcgtacgcgcacaagggctcattcgtgcatgcatgtt

SEQ ID NO: 122151 - DNA, 75 bp, Artificial Sequence
  Synthetic
gtcaggaccatcaccacaggtgcgccaatcacatactccacgtacgggaaattcctggccgatggaggctgtggg

SEQ ID NO: 122152 - DNA, 75 bp, Artificial Sequence
  Synthetic
ccagactacaaccctccactgctagagtcctggaaggacccagattatgtccctccggtggtacacgggtgcccg

SEQ ID NO: 122153 - DNA, 75 bp, Artificial Sequence
  Synthetic
actggggggtcttgttcgccgccgcgtacttcgcgatgatatccaactgggctaaagttgtgttggtcttgttcc

SEQ ID NO: 122154 - DNA, 75 bp, Artificial Sequence
  Synthetic
ccccacctcggctgcgcattatcgtaatgcgtcgggcgtctatcacatcaccaatgactgcccgaattccagcat

SEQ ID NO: 122155 - DNA, 75 bp, Artificial Sequence
  Synthetic
gttgcagctcataaataccaacgggagctggcacatcaacagaactgccctcaattgtaatgacagcctccagac

SEQ ID NO: 122156 - DNA, 75 bp, Artificial Sequence
  Synthetic
agctggcacatcaacagaactgccctcaattgtaatgacagcctccagactgggtttatagccggcctcatctac

SEQ ID NO: 122157 - DNA, 75 bp, Artificial Sequence
  Synthetic
gtggcggtggcctacgccaatgctccacttgattccatgcggggtcacgtggacttaatggtgggcgccgctacg

SEQ ID NO: 122158 - DNA, 75 bp, Artificial Sequence
  Synthetic
gccccccgtgtaacatcgggggggccggcaacaacaccttgacctgccccacggattgcttccggaagcaccccg

SEQ ID NO: 122159 - DNA, 75 bp, Artificial Sequence
  Synthetic
gcagggcggtccctgcggccacgtactctgctctcggcttatggtcctttctcctcctggtcttggctttaccac

SEQ ID NO: 122160 - DNA, 75 bp, Artificial Sequence
  Synthetic
tatctggccccagtgatgacaagccatattgttggcactaccccccacgaccttgtggagtggtgccagccaaag

SEQ ID NO: 122161 - DNA, 75 bp, Artificial Sequence
  Synthetic
gcaactgctctatctatactggacacatcacgggccacaggatggcttgggacatgatgatgaactggagcccca

SEQ ID NO: 122162 - DNA, 75 bp, Artificial Sequence
  Synthetic
ctaccggtatgtcacgccaggagagagaccgtcaggcatgtttgacacttcggtgctctgtgagtgctatgacgc

SEQ ID NO: 122163 - DNA, 75 bp, Artificial Sequence
  Synthetic
cgacgtcttcctcttgaacaacacaaggccccctactggcaactggtttgggtgcacctggatgaattccacagg

SEQ ID NO: 122164 - DNA, 75 bp, Artificial Sequence
  Synthetic
ctgcatgcaagcaaattgggccaaagtcatcctggtcctgttcctttttgccggagttgacgccgagacccacgt

SEQ ID NO: 122165 - DNA, 75 bp, Artificial Sequence
  Synthetic
tctccttccttgtgttcttctgtgccgcctggtacatcaagggcaggctggtccctggggcggcatatgctctct

SEQ ID NO: 122166 - DNA, 75 bp, Artificial Sequence
  Synthetic
ttctgggagggtgtctttacggggttgacccatatagacgcccacttcctgtcccaaacaaaacaagcgggggac

SEQ ID NO: 122167 - DNA, 75 bp, Artificial Sequence
  Synthetic
acctatgctaggtgcgggtcaggaccttggctcaccccccggtgtttggtggactatccctaccggctgtggcat

SEQ ID NO: 122168 - DNA, 75 bp, Artificial Sequence
  Synthetic
catatcaacaggacagctctgaactgcaacgactcccaggagaccggcttcctcgctggcttgttctactatcat

SEQ ID NO: 122169 - DNA, 75 bp, Artificial Sequence
  Synthetic
aaggccgcagggatagttgcacccacgatgctggtatgcggcgacgacttggttgtcatctcagaaagccagggg

SEQ ID NO: 122170 - DNA, 75 bp, Artificial Sequence
  Synthetic
agcctaccttacacgggcccacccctctcctctaccggctcgggtccgtgcagaatgaggagactctgacccacc

SEQ ID NO: 122171 - DNA, 75 bp, Artificial Sequence
  Synthetic
agcctaccttacacgggcccacccctctcctctaccggctcgggtccgtgcagaatgaggtgactctgacccacc

SEQ ID NO: 122172 - DNA, 75 bp, Artificial Sequence
  Synthetic
agcctaccttacacgggcccacccctctcctctaccggctcgggtccgtgcagaatgaggcgactctgacccacc

SEQ ID NO: 122173 - DNA, 75 bp, Artificial Sequence
  Synthetic
agcctaccttacacgggcccacccctctcctctaccggctcgggtccgtgcagaatgaggggactctgacccacc

SEQ ID NO: 122174 - DNA, 75 bp, Artificial Sequence
  Synthetic
tctcctctaccggctcgggtccgtgcagaatgaggagactctgacccaccctgtgaccaaatacatcatggcctg

SEQ ID NO: 122175 - DNA, 75 bp, Artificial Sequence
  Synthetic
tctcctctaccggctcgggtccgtgcagaatgaggtgactctgacccaccctgtgaccaaatacatcatggcctg

SEQ ID NO: 122176 - DNA, 75 bp, Artificial Sequence
  Synthetic
tctcctctaccggctcgggtccgtgcagaatgaggcgactctgacccaccctgtgaccaaatacatcatggcctg

SEQ ID NO: 122177 - DNA, 75 bp, Artificial Sequence
  Synthetic
tctcctctaccggctcgggtccgtgcagaatgaggggactctgacccaccctgtgaccaaatacatcatggcctg

SEQ ID NO: 122178 - DNA, 75 bp, Artificial Sequence
  Synthetic
gatgtgacctcgaagacagagataggtccgagctgagcccgctcctacacaccaccacgcagtgggccatattgc

SEQ ID NO: 122179 - DNA, 75 bp, Artificial Sequence
  Synthetic
gtccatctgaagccaggccctactgctggcactacgcgcctcggccatgcgaggtggtctcggcgcgtaccgtgt

SEQ ID NO: 122180 - DNA, 75 bp, Artificial Sequence
  Synthetic
ataaccgggagagtcatactctcaggacaacctgccgtcatacccgaccgagaagtgctctaccaacagtttgac

SEQ ID NO: 122181 - DNA, 75 bp, Artificial Sequence
  Synthetic
cgtctcgtgggccattaagtgggagtacatagtactggcctttttactacttgctgatgcccgtgtttgtacttg

SEQ ID NO: 122182 - DNA, 75 bp, Artificial Sequence
  Synthetic
gttcatcatgaactcaacgcggcctccgggcggcgcttggttcgggtgcacatggatgaattccactggctttac

SEQ ID NO: 122183 - DNA, 75 bp, Artificial Sequence
  Synthetic
gttcatcttgaactcaacgcggcctccgggcggcgcttggttcgggtgcacatggatgaattccactggctttac

SEQ ID NO: 122184 - DNA, 75 bp, Artificial Sequence
  Synthetic
gttcatcctgaactcaacgcggcctccgggcggcgcttggttcgggtgcacatggatgaattccactggctttac

SEQ ID NO: 122185 - DNA, 75 bp, Artificial Sequence
  Synthetic
gttcatcgtgaactcaacgcggcctccgggcggcgcttggttcgggtgcacatggatgaattccactggctttac

SEQ ID NO: 122186 - DNA, 75 bp, Artificial Sequence
  Synthetic
cgctcacagagcggctctatatcgggggtcccctgactaattcaaaagggcagaactgcggttatcgccggtgcc

SEQ ID NO: 122187 - DNA, 75 bp, Artificial Sequence
  Synthetic
cctggcagagcagttcaaacaaaaagccctgggagttctacagtccgccggcaagcacgcacaagatgcggcgcc

SEQ ID NO: 122188 - DNA, 75 bp, Artificial Sequence
  Synthetic
ggcatttcaagggcaggttggtccccggggccacctacctatgcttgggcatttggccactactcctactccttc

SEQ ID NO: 122189 - DNA, 75 bp, Artificial Sequence
  Synthetic
aagtgcgggtcgggtccctggctcacgccaaggtgtatggttgattacccatatcggttgtggcactaaccctgc

SEQ ID NO: 122190 - DNA, 75 bp, Artificial Sequence
  Synthetic
aagtgcgggtcgggtccctggctcacgccaaggtgtatggttgattacccatatcggttgtggcactatccctgc

SEQ ID NO: 122191 - DNA, 75 bp, Artificial Sequence
  Synthetic
aagtgcgggtcgggtccctggctcacgccaaggtgtatggttgattacccatatcggttgtggcactacccctgc

SEQ ID NO: 122192 - DNA, 75 bp, Artificial Sequence
  Synthetic
aagtgcgggtcgggtccctggctcacgccaaggtgtatggttgattacccatatcggttgtggcactagccctgc

SEQ ID NO: 122193 - DNA, 75 bp, Artificial Sequence
  Synthetic
cccggcaaccctgccattgcatcgctcatgtcattcacagcagcagtcactagccccctgaccacccagcaaacc

SEQ ID NO: 122194 - DNA, 75 bp, Artificial Sequence
  Synthetic
cccggcaaccctgccattgcatcgctcatgtcattcacagctgcagtcactagccccctgaccacccagcaaacc

SEQ ID NO: 122195 - DNA, 75 bp, Artificial Sequence
  Synthetic
cccggcaaccctgccattgcatcgctcatgtcattcacagccgcagtcactagccccctgaccacccagcaaacc

SEQ ID NO: 122196 - DNA, 75 bp, Artificial Sequence
  Synthetic
cccggcaaccctgccattgcatcgctcatgtcattcacagcggcagtcactagccccctgaccacccagcaaacc

SEQ ID NO: 122197 - DNA, 75 bp, Artificial Sequence
  Synthetic
tcatgtcattcacagcagcagtcactagccccctgaccacccagcaaaccctcctcttcaacatcctaggggggt

SEQ ID NO: 122198 - DNA, 75 bp, Artificial Sequence
  Synthetic
tcatgtcattcacagctgcagtcactagccccctgaccacccagcaaaccctcctcttcaacatcctaggggggt

SEQ ID NO: 122199 - DNA, 75 bp, Artificial Sequence
  Synthetic
tcatgtcattcacagccgcagtcactagccccctgaccacccagcaaaccctcctcttcaacatcctaggggggt

SEQ ID NO: 122200 - DNA, 75 bp, Artificial Sequence
  Synthetic
tcatgtcattcacagcggcagtcactagccccctgaccacccagcaaaccctcctcttcaacatcctaggggggt

SEQ ID NO: 122201 - DNA, 75 bp, Artificial Sequence
  Synthetic
cgttgggtggccagcccctccaggggctaagtctcttgaaccgtgcgcctgcgggtctgcagacttatacttggt

SEQ ID NO: 122202 - DNA, 75 bp, Artificial Sequence
  Synthetic
gtaggttgtctcgtgttaatcatcctcacaatcttcacacttacccccgggtataagaggatggtagtgctagtc

SEQ ID NO: 122203 - DNA, 75 bp, Artificial Sequence
  Synthetic
ttgagcatagagaccgcgcggacctatcgcccttgcttctctccaccacgcagtggcaagtactcccttgtacct

SEQ ID NO: 122204 - DNA, 75 bp, Artificial Sequence
  Synthetic
cgttgacattctcgctggctacggcgctggcgtggccggtgctgtggtcacctttaagatcatgagtggcgaggt

SEQ ID NO: 122205 - DNA, 75 bp, Artificial Sequence
  Synthetic
ggagaccaagatcatcacctggggggcggacactgcggcgtgtggggacatcatcttgggtctgcccgtctccgc

SEQ ID NO: 122206 - DNA, 75 bp, Artificial Sequence
  Synthetic
tcacatgcctcctccaccccgccttggggtttgagatcacaaaaatcctcctcgggatactgggccctttgtacc

SEQ ID NO: 122207 - DNA, 75 bp, Artificial Sequence
  Synthetic
ggggtttgagatcacaaaaatcctcctcgggatactgggccctttgtacctgctgcagcactcgctcatcaagct

SEQ ID NO: 122208 - DNA, 75 bp, Artificial Sequence
  Synthetic
ggcgcttaagtgggagtatgtagtgcttgctttcttgttgctcgcagatgccagggtctgcgcgtgcatttggat

SEQ ID NO: 122209 - DNA, 75 bp, Artificial Sequence
  Synthetic
ggcgcttaagtgggagtatgtagtgcttgctttcttgttgctcgcagatgccagggtctgcgcgtgcttttggat

SEQ ID NO: 122210 - DNA, 75 bp, Artificial Sequence
  Synthetic
ggcgcttaagtgggagtatgtagtgcttgctttcttgttgctcgcagatgccagggtctgcgcgtgcctttggat

SEQ ID NO: 122211 - DNA, 75 bp, Artificial Sequence
  Synthetic
ggcgcttaagtgggagtatgtagtgcttgctttcttgttgctcgcagatgccagggtctgcgcgtgcgtttggat

SEQ ID NO: 122212 - DNA, 75 bp, Artificial Sequence
  Synthetic
ggcaagtttctcgcagacggaggctgctcagctggagcctatgacatcatcatatgcgatgaatgccatgcagtg

SEQ ID NO: 122213 - DNA, 75 bp, Artificial Sequence
  Synthetic
ttcatctgtgtggcttggcacataaaaggcagacttccagccgccgccacttacgcagcttgcgggatgtggccc

SEQ ID NO: 122214 - DNA, 75 bp, Artificial Sequence
  Synthetic
acgaggattgttccactccctgtgattcatcatggttgagggaggtctgggattgggtttgcaccgtactatctg

SEQ ID NO: 122215 - DNA, 75 bp, Artificial Sequence
  Synthetic
cacgtggggggctgacacggccgcgtgtggggacatacttgctggtcttccggtatcagctaggcggggccatga

SEQ ID NO: 122216 - DNA, 75 bp, Artificial Sequence
  Synthetic
tgacactctccccatattacaagtgcttcctggctcgtgggatatggtggctccagtacttcatagccaggattg

SEQ ID NO: 122217 - DNA, 75 bp, Artificial Sequence
  Synthetic
agtcctctaccgggagttcgatgagatggaggagtgcgcctcacacctcccttacatcgaacagggaatgcagct

SEQ ID NO: 122218 - DNA, 75 bp, Artificial Sequence
  Synthetic
agtgatgcatacaacatgcccatgcggcgcaagcatagccggccatatcaaaaacggctcaatgagaatcactgg

SEQ ID NO: 122219 - DNA, 75 bp, Artificial Sequence
  Synthetic
ctgtaggggtaggcatctacctgctccccaaccgatgaacggggagataaacactccaggccaataggccatccc

SEQ ID NO: 122220 - DNA, 75 bp, Artificial Sequence
  Synthetic
catcacaaaataccttctggccctcataggacctctttgcctgctccaagcatcactgctgcgcgtcccttactt

SEQ ID NO: 122221 - DNA, 75 bp, Artificial Sequence
  Synthetic
acatttcttggtacttccatcaacggggtgatgtggacagttttccatggggccggctctaagactcttgctggc

SEQ ID NO: 122222 - DNA, 75 bp, Artificial Sequence
  Synthetic
ctgtggcgggtgtctgccgaagaatatgtggaggttcgcagggtgggtgactaccactatgtagtgggagttacg

SEQ ID NO: 122223 - DNA, 75 bp, Artificial Sequence
  Synthetic
gggacttacatttacaaccatctggctccattgtcagactgggccgcagacggtctcgacgacctggctgtggca

SEQ ID NO: 122224 - DNA, 75 bp, Artificial Sequence
  Synthetic
gggcccaaatgacccccggcggaggtcccgcaacttgggtaaggtcatcgataccctaacctgcggcttcgccga

SEQ ID NO: 122225 - DNA, 75 bp, Artificial Sequence
  Synthetic
tgctgcgggatgaagtgtccttcagcgtggggctcaacacattcgtggtggggtctcagctcccttgtgaaccgg

SEQ ID NO: 122226 - DNA, 75 bp, Artificial Sequence
  Synthetic
cagcgtagtgctctgcgagtgctatgatgccggggcagcctggtatgagctcacgcctgctgagaccacagtgag

SEQ ID NO: 122227 - DNA, 75 bp, Artificial Sequence
  Synthetic
gttcggctgtacatggatgaatagcactgggttcaccaagacgtgcgggggccccccgtgtaacatcgggggggt

SEQ ID NO: 122228 - DNA, 75 bp, Artificial Sequence
  Synthetic
gtgtacgcggggtgttgcgaaggcgctcgagttcatcccggtcgaaaacctggagaccacgatgcgctcgcccgt

SEQ ID NO: 122229 - DNA, 75 bp, Artificial Sequence
  Synthetic
ccaggctgggcaatgagatcctgctcggcccggctgactcggaggtcgttggggggtggagactcctcgccccca

SEQ ID NO: 122230 - DNA, 75 bp, Artificial Sequence
  Synthetic
ggggggtggagactcctcgcccccattaccgcctacgcgcagcagacccgaggcttgctaagcaccatcgtgaca

SEQ ID NO: 122231 - DNA, 75 bp, Artificial Sequence
  Synthetic
ggctagctcctcagcaagccaactttccgctccgtctcttaaagccacgtgcactgcccaccaagactcccctga

SEQ ID NO: 122232 - DNA, 75 bp, Artificial Sequence
  Synthetic
ggcatctccatgcgcccaccgggagcgggaagagcacgaaggtacccgctgcttatgctgctcaggggtacaagg

SEQ ID NO: 122233 - DNA, 75 bp, Artificial Sequence
  Synthetic
gatccactcgtggccgaagctgatgacaaggaggtctccgtggcggcggaaattctacgcaagaccaagaagttc

SEQ ID NO: 122234 - DNA, 75 bp, Artificial Sequence
  Synthetic
actgccctgttccttcaccaccctaccggctctgtccaccggtctgatccatctccaccagaacatcgtggacgt

SEQ ID NO: 122235 - DNA, 75 bp, Artificial Sequence
  Synthetic
ggacgtcgtgccggtacgcaggaggggggacacacgtggctcccttctaagtccgcggcctatctccacactcaa

SEQ ID NO: 122236 - DNA, 75 bp, Artificial Sequence
  Synthetic
ccttgcccgccggcggcctgcctcccgttcctcctccacggaggaagcggacggtggtgctcacagagtccagcg

SEQ ID NO: 122237 - DNA, 75 bp, Artificial Sequence
  Synthetic
cagtggaagtcaggaacatcagttctagctactacgccactaatgattgctcgaacaacagcatcacctggcagc

SEQ ID NO: 122238 - DNA, 75 bp, Artificial Sequence
  Synthetic
gtgcccgtcgagtcccttgaaaccactatgaggtcccaggtcttcactgacaattcaactccccccgcggtgccc

SEQ ID NO: 122239 - DNA, 75 bp, Artificial Sequence
  Synthetic
cgatgcctccactcgagggggagccaggcgaccctgatttgacttcagactcgtggtccactgtgagtagcagtg

SEQ ID NO: 122240 - DNA, 75 bp, Artificial Sequence
  Synthetic
tcctattcctcttagcaggagttgacgctgagactcacatatctgggggtacgtatggccgcaacatccaaggcc

SEQ ID NO: 122241 - DNA, 75 bp, Artificial Sequence
  Synthetic
tcctattcctcttagcaggagttgacgctgagactcacatatctgggggtacgtatggccgcaacatccatggcc

SEQ ID NO: 122242 - DNA, 75 bp, Artificial Sequence
  Synthetic
tcctattcctcttagcaggagttgacgctgagactcacatatctgggggtacgtatggccgcaacatccacggcc

SEQ ID NO: 122243 - DNA, 75 bp, Artificial Sequence
  Synthetic
tcctattcctcttagcaggagttgacgctgagactcacatatctgggggtacgtatggccgcaacatccagggcc

SEQ ID NO: 122244 - DNA, 75 bp, Artificial Sequence
  Synthetic
tcctattcctcttagcaggtgttgacgctgagactcacatatctgggggtacgtatggccgcaacatccaaggcc

SEQ ID NO: 122245 - DNA, 75 bp, Artificial Sequence
  Synthetic
tcctattcctcttagcaggtgttgacgctgagactcacatatctgggggtacgtatggccgcaacatccatggcc

SEQ ID NO: 122246 - DNA, 75 bp, Artificial Sequence
  Synthetic
tcctattcctcttagcaggtgttgacgctgagactcacatatctgggggtacgtatggccgcaacatccacggcc

SEQ ID NO: 122247 - DNA, 75 bp, Artificial Sequence
  Synthetic
tcctattcctcttagcaggtgttgacgctgagactcacatatctgggggtacgtatggccgcaacatccagggcc

SEQ ID NO: 122248 - DNA, 75 bp, Artificial Sequence
  Synthetic
tcctattcctcttagcaggcgttgacgctgagactcacatatctgggggtacgtatggccgcaacatccaaggcc

SEQ ID NO: 122249 - DNA, 75 bp, Artificial Sequence
  Synthetic
tcctattcctcttagcaggcgttgacgctgagactcacatatctgggggtacgtatggccgcaacatccatggcc

SEQ ID NO: 122250 - DNA, 75 bp, Artificial Sequence
  Synthetic
tcctattcctcttagcaggcgttgacgctgagactcacatatctgggggtacgtatggccgcaacatccacggcc

SEQ ID NO: 122251 - DNA, 75 bp, Artificial Sequence
  Synthetic
tcctattcctcttagcaggcgttgacgctgagactcacatatctgggggtacgtatggccgcaacatccagggcc

SEQ ID NO: 122252 - DNA, 75 bp, Artificial Sequence
  Synthetic
tcctattcctcttagcaggggttgacgctgagactcacatatctgggggtacgtatggccgcaacatccaaggcc

SEQ ID NO: 122253 - DNA, 75 bp, Artificial Sequence
  Synthetic
tcctattcctcttagcaggggttgacgctgagactcacatatctgggggtacgtatggccgcaacatccatggcc

SEQ ID NO: 122254 - DNA, 75 bp, Artificial Sequence
  Synthetic
tcctattcctcttagcaggggttgacgctgagactcacatatctgggggtacgtatggccgcaacatccacggcc

SEQ ID NO: 122255 - DNA, 75 bp, Artificial Sequence
  Synthetic
tcctattcctcttagcaggggttgacgctgagactcacatatctgggggtacgtatggccgcaacatccagggcc

SEQ ID NO: 122256 - DNA, 75 bp, Artificial Sequence
  Synthetic
tcctattcctctttgcaggagttgacgctgagactcacatatctgggggtacgtatggccgcaacatccaaggcc

SEQ ID NO: 122257 - DNA, 75 bp, Artificial Sequence
  Synthetic
tcctattcctctttgcaggagttgacgctgagactcacatatctgggggtacgtatggccgcaacatccatggcc

SEQ ID NO: 122258 - DNA, 75 bp, Artificial Sequence
  Synthetic
tcctattcctctttgcaggagttgacgctgagactcacatatctgggggtacgtatggccgcaacatccacggcc

SEQ ID NO: 122259 - DNA, 75 bp, Artificial Sequence
  Synthetic
tcctattcctctttgcaggagttgacgctgagactcacatatctgggggtacgtatggccgcaacatccagggcc

SEQ ID NO: 122260 - DNA, 75 bp, Artificial Sequence
  Synthetic
tcctattcctctttgcaggtgttgacgctgagactcacatatctgggggtacgtatggccgcaacatccaaggcc

SEQ ID NO: 122261 - DNA, 75 bp, Artificial Sequence
  Synthetic
tcctattcctctttgcaggtgttgacgctgagactcacatatctgggggtacgtatggccgcaacatccatggcc

SEQ ID NO: 122262 - DNA, 75 bp, Artificial Sequence
  Synthetic
tcctattcctctttgcaggtgttgacgctgagactcacatatctgggggtacgtatggccgcaacatccacggcc

SEQ ID NO: 122263 - DNA, 75 bp, Artificial Sequence
  Synthetic
tcctattcctctttgcaggtgttgacgctgagactcacatatctgggggtacgtatggccgcaacatccagggcc

SEQ ID NO: 122264 - DNA, 75 bp, Artificial Sequence
  Synthetic
tcctattcctctttgcaggcgttgacgctgagactcacatatctgggggtacgtatggccgcaacatccaaggcc

SEQ ID NO: 122265 - DNA, 75 bp, Artificial Sequence
  Synthetic
tcctattcctctttgcaggcgttgacgctgagactcacatatctgggggtacgtatggccgcaacatccatggcc

SEQ ID NO: 122266 - DNA, 75 bp, Artificial Sequence
  Synthetic
tcctattcctctttgcaggcgttgacgctgagactcacatatctgggggtacgtatggccgcaacatccacggcc

SEQ ID NO: 122267 - DNA, 75 bp, Artificial Sequence
  Synthetic
tcctattcctctttgcaggcgttgacgctgagactcacatatctgggggtacgtatggccgcaacatccagggcc

SEQ ID NO: 122268 - DNA, 75 bp, Artificial Sequence
  Synthetic
tcctattcctctttgcaggggttgacgctgagactcacatatctgggggtacgtatggccgcaacatccaaggcc

SEQ ID NO: 122269 - DNA, 75 bp, Artificial Sequence
  Synthetic
tcctattcctctttgcaggggttgacgctgagactcacatatctgggggtacgtatggccgcaacatccatggcc

SEQ ID NO: 122270 - DNA, 75 bp, Artificial Sequence
  Synthetic
tcctattcctctttgcaggggttgacgctgagactcacatatctgggggtacgtatggccgcaacatccacggcc

SEQ ID NO: 122271 - DNA, 75 bp, Artificial Sequence
  Synthetic
tcctattcctctttgcaggggttgacgctgagactcacatatctgggggtacgtatggccgcaacatccagggcc

SEQ ID NO: 122272 - DNA, 75 bp, Artificial Sequence
  Synthetic
tcctattcctcttcgcaggagttgacgctgagactcacatatctgggggtacgtatggccgcaacatccaaggcc

SEQ ID NO: 122273 - DNA, 75 bp, Artificial Sequence
  Synthetic
tcctattcctcttcgcaggagttgacgctgagactcacatatctgggggtacgtatggccgcaacatccatggcc

SEQ ID NO: 122274 - DNA, 75 bp, Artificial Sequence
  Synthetic
tcctattcctcttcgcaggagttgacgctgagactcacatatctgggggtacgtatggccgcaacatccacggcc

SEQ ID NO: 122275 - DNA, 75 bp, Artificial Sequence
  Synthetic
tcctattcctcttcgcaggagttgacgctgagactcacatatctgggggtacgtatggccgcaacatccagggcc

SEQ ID NO: 122276 - DNA, 75 bp, Artificial Sequence
  Synthetic
tcctattcctcttcgcaggtgttgacgctgagactcacatatctgggggtacgtatggccgcaacatccaaggcc

SEQ ID NO: 122277 - DNA, 75 bp, Artificial Sequence
  Synthetic
tcctattcctcttcgcaggtgttgacgctgagactcacatatctgggggtacgtatggccgcaacatccatggcc

SEQ ID NO: 122278 - DNA, 75 bp, Artificial Sequence
  Synthetic
tcctattcctcttcgcaggtgttgacgctgagactcacatatctgggggtacgtatggccgcaacatccacggcc

SEQ ID NO: 122279 - DNA, 75 bp, Artificial Sequence
  Synthetic
tcctattcctcttcgcaggtgttgacgctgagactcacatatctgggggtacgtatggccgcaacatccagggcc

SEQ ID NO: 122280 - DNA, 75 bp, Artificial Sequence
  Synthetic
tcctattcctcttcgcaggcgttgacgctgagactcacatatctgggggtacgtatggccgcaacatccaaggcc

SEQ ID NO: 122281 - DNA, 75 bp, Artificial Sequence
  Synthetic
tcctattcctcttcgcaggcgttgacgctgagactcacatatctgggggtacgtatggccgcaacatccatggcc

SEQ ID NO: 122282 - DNA, 75 bp, Artificial Sequence
  Synthetic
tcctattcctcttcgcaggcgttgacgctgagactcacatatctgggggtacgtatggccgcaacatccacggcc

SEQ ID NO: 122283 - DNA, 75 bp, Artificial Sequence
  Synthetic
tcctattcctcttcgcaggcgttgacgctgagactcacatatctgggggtacgtatggccgcaacatccagggcc

SEQ ID NO: 122284 - DNA, 75 bp, Artificial Sequence
  Synthetic
tcctattcctcttcgcaggggttgacgctgagactcacatatctgggggtacgtatggccgcaacatccaaggcc

SEQ ID NO: 122285 - DNA, 75 bp, Artificial Sequence
  Synthetic
tcctattcctcttcgcaggggttgacgctgagactcacatatctgggggtacgtatggccgcaacatccatggcc

SEQ ID NO: 122286 - DNA, 75 bp, Artificial Sequence
  Synthetic
tcctattcctcttcgcaggggttgacgctgagactcacatatctgggggtacgtatggccgcaacatccacggcc

SEQ ID NO: 122287 - DNA, 75 bp, Artificial Sequence
  Synthetic
tcctattcctcttcgcaggggttgacgctgagactcacatatctgggggtacgtatggccgcaacatccagggcc

SEQ ID NO: 122288 - DNA, 75 bp, Artificial Sequence
  Synthetic
tcctattcctcttggcaggagttgacgctgagactcacatatctgggggtacgtatggccgcaacatccaaggcc

SEQ ID NO: 122289 - DNA, 75 bp, Artificial Sequence
  Synthetic
tcctattcctcttggcaggagttgacgctgagactcacatatctgggggtacgtatggccgcaacatccatggcc

SEQ ID NO: 122290 - DNA, 75 bp, Artificial Sequence
  Synthetic
tcctattcctcttggcaggagttgacgctgagactcacatatctgggggtacgtatggccgcaacatccacggcc

SEQ ID NO: 122291 - DNA, 75 bp, Artificial Sequence
  Synthetic
tcctattcctcttggcaggagttgacgctgagactcacatatctgggggtacgtatggccgcaacatccagggcc

SEQ ID NO: 122292 - DNA, 75 bp, Artificial Sequence
  Synthetic
tcctattcctcttggcaggtgttgacgctgagactcacatatctgggggtacgtatggccgcaacatccaaggcc

SEQ ID NO: 122293 - DNA, 75 bp, Artificial Sequence
  Synthetic
tcctattcctcttggcaggtgttgacgctgagactcacatatctgggggtacgtatggccgcaacatccatggcc

SEQ ID NO: 122294 - DNA, 75 bp, Artificial Sequence
  Synthetic
tcctattcctcttggcaggtgttgacgctgagactcacatatctgggggtacgtatggccgcaacatccacggcc

SEQ ID NO: 122295 - DNA, 75 bp, Artificial Sequence
  Synthetic
tcctattcctcttggcaggtgttgacgctgagactcacatatctgggggtacgtatggccgcaacatccagggcc

SEQ ID NO: 122296 - DNA, 75 bp, Artificial Sequence
  Synthetic
tcctattcctcttggcaggcgttgacgctgagactcacatatctgggggtacgtatggccgcaacatccaaggcc

SEQ ID NO: 122297 - DNA, 75 bp, Artificial Sequence
  Synthetic
tcctattcctcttggcaggcgttgacgctgagactcacatatctgggggtacgtatggccgcaacatccatggcc

SEQ ID NO: 122298 - DNA, 75 bp, Artificial Sequence
  Synthetic
tcctattcctcttggcaggcgttgacgctgagactcacatatctgggggtacgtatggccgcaacatccacggcc

SEQ ID NO: 122299 - DNA, 75 bp, Artificial Sequence
  Synthetic
tcctattcctcttggcaggcgttgacgctgagactcacatatctgggggtacgtatggccgcaacatccagggcc

SEQ ID NO: 122300 - DNA, 75 bp, Artificial Sequence
  Synthetic
tcctattcctcttggcaggggttgacgctgagactcacatatctgggggtacgtatggccgcaacatccaaggcc

SEQ ID NO: 122301 - DNA, 75 bp, Artificial Sequence
  Synthetic
tcctattcctcttggcaggggttgacgctgagactcacatatctgggggtacgtatggccgcaacatccatggcc

SEQ ID NO: 122302 - DNA, 75 bp, Artificial Sequence
  Synthetic
tcctattcctcttggcaggggttgacgctgagactcacatatctgggggtacgtatggccgcaacatccacggcc

SEQ ID NO: 122303 - DNA, 75 bp, Artificial Sequence
  Synthetic
tcctattcctcttggcaggggttgacgctgagactcacatatctgggggtacgtatggccgcaacatccagggcc

SEQ ID NO: 122304 - DNA, 75 bp, Artificial Sequence
  Synthetic
ctggggccctatcagttatgctaatggaagcggccccgaccaacgcccctactgctggcactaccccccaaaacc

SEQ ID NO: 122305 - DNA, 75 bp, Artificial Sequence
  Synthetic
tcgtctgctgctcaatgtcctacacatggacaggcgccctgatcacgccatgcgctgcggaggaaagcaagttgc

SEQ ID NO: 122306 - DNA, 75 bp, Artificial Sequence
  Synthetic
tcaacccctcggtcgcggctacactgggcttcggggcatacatgtcgaaggcgcatggcatcgacccgaacattc

SEQ ID NO: 122307 - DNA, 75 bp, Artificial Sequence
  Synthetic
tacagaggtctagacgtcgccgtcatacccgcggcaggagacgtggtcgtgtgcagcactgacgcgctcatgacg

SEQ ID NO: 122308 - DNA, 75 bp, Artificial Sequence
  Synthetic
gcgcatggcatcgacccgaacattcggtcgggtgtcagaaccatcacaacgggagcgcctatcacatactccacc

SEQ ID NO: 122309 - DNA, 75 bp, Artificial Sequence
  Synthetic
cttaaacactgggttcttggctggcttgttctacgcccacaagtttaacagctcggggtgtcccgaacggctcgc

SEQ ID NO: 122310 - DNA, 75 bp, Artificial Sequence
  Synthetic
cagtgccccaggacgcagtgtccagaagccagcgtaggggccgcacgggaagagggaggcacggcatataccggt

SEQ ID NO: 122311 - DNA, 75 bp, Artificial Sequence
  Synthetic
aagggctcattcgtgcatgcatgttggtgcggaaagccgctgggggtcattacatccaaatggccctcatgaggc

SEQ ID NO: 122312 - DNA, 75 bp, Artificial Sequence
  Synthetic
cagccacccgtcagaagaaggtcacttttgaccgtctccaggtggttgactctcactaccacgaagtccttaagg

SEQ ID NO: 122313 - DNA, 75 bp, Artificial Sequence
  Synthetic
aagctgcaaggttcttgacagcttccgccaaggctggggcccgctcggagtcgctaacatcagtggcccatccga

SEQ ID NO: 122314 - DNA, 75 bp, Artificial Sequence
  Synthetic
taggcacggtcttagaccaagcggagaccgctggagtgcgacttgtcgtgctcgcgaccgctacgccgccaggat

SEQ ID NO: 122315 - DNA, 75 bp, Artificial Sequence
  Synthetic
acgtttcgtccggggagagaccgtctggcattttcgattccgtggtgctctgcgagtgctacgacgccggatgtg

SEQ ID NO: 122316 - DNA, 75 bp, Artificial Sequence
  Synthetic
ttatctgtgaaagcgcgggaacccaagaggatgcggcgagcctacgagtcttcacggaggctatgactaggtact

SEQ ID NO: 122317 - DNA, 75 bp, Artificial Sequence
  Synthetic
gggtccctacttacacctggggggagaatgtgtctgatgtcttactcttgaactccaccagaccgccacgtggtg

SEQ ID NO: 122318 - DNA, 75 bp, Artificial Sequence
  Synthetic
gggtccctacttacacctggggggagaatgtgtctgatgtctttctcttgaactccaccagaccgccacgtggtg

SEQ ID NO: 122319 - DNA, 75 bp, Artificial Sequence
  Synthetic
gggtccctacttacacctggggggagaatgtgtctgatgtcttcctcttgaactccaccagaccgccacgtggtg

SEQ ID NO: 122320 - DNA, 75 bp, Artificial Sequence
  Synthetic
gggtccctacttacacctggggggagaatgtgtctgatgtcttgctcttgaactccaccagaccgccacgtggtg

SEQ ID NO: 122321 - DNA, 75 bp, Artificial Sequence
  Synthetic
gggaagacaccttatcttttgtcactcaaagaaaaagtgcgacgagctggcccaacaactagcagctcagggtgt

SEQ ID NO: 122322 - DNA, 75 bp, Artificial Sequence
  Synthetic
ccaatggtagttggcacataaatcggaccgccctcaattgcaatgacagcttgcagacgggcttcatagcctccc

SEQ ID NO: 122323 - DNA, 75 bp, Artificial Sequence
  Synthetic
ctaccttgtggcgtaccaagcaacagtctgcgttcgtgcgaaagcgcccccccccagttgggacacaatgtggaa

SEQ ID NO: 122324 - DNA, 75 bp, Artificial Sequence
  Synthetic
ggcgacttcgactcggtgatagactgcaatacgtctgtcatccaaacagtcgacttcagcctagatcccaccttc

SEQ ID NO: 122325 - DNA, 75 bp, Artificial Sequence
  Synthetic
cttgattcattatccgtaccggctgtggcattacccatgcaccgtcaactttaccgtctttaagatcaggacgtt

SEQ ID NO: 122326 - DNA, 75 bp, Artificial Sequence
  Synthetic
acacccgctgttttgactccacggtgactgaaagggacatcagggtcgaggaagagatctaccagtgctgcgacc

SEQ ID NO: 122327 - DNA, 75 bp, Artificial Sequence
  Synthetic
cggacttggaggtcattaccagtacttgggttatagtgggaggtgtcgtggcggccctaacagcctactgtttga

SEQ ID NO: 122328 - DNA, 75 bp, Artificial Sequence
  Synthetic
gtctactgttttacccctagccctgttgtcgtgggcaccactgacaggcagggcgtacccacctatagttggggg

SEQ ID NO: 122329 - DNA, 75 bp, Artificial Sequence
  Synthetic
gacatgaggccgtactgctggcattaccctccgaagccttgcggcattgtcccggctaggacggtttgcgggccg

SEQ ID NO: 122330 - DNA, 75 bp, Artificial Sequence
  Synthetic
cgggggaaagaccgtctggcatgtttgacacctcagtgctctgtgagtgctatgacgctgggtgcgcttggtatg

SEQ ID NO: 122331 - DNA, 75 bp, Artificial Sequence
  Synthetic
gaaaacgagaccgatgtcttcttgctgaatagcacaagacccccgcgaggagcttggttcggctgcacttggatg

SEQ ID NO: 122332 - DNA, 75 bp, Artificial Sequence
  Synthetic
ctcctctccactacaacgtggcaaatcctcccttgctctttcaccactctacctgccctctctaccggcttgatc

SEQ ID NO: 122333 - DNA, 75 bp, Artificial Sequence
  Synthetic
cactgggttaaccaatatagacgctcatttcctgtcccagactaaacaggcgggtgacaactacccttacctagt

SEQ ID NO: 122334 - DNA, 75 bp, Artificial Sequence
  Synthetic
cgtctatgtggagcaaggctgagcagttttgggcaaaacatatgtggaactttgtcagtggaatccaatacctag

SEQ ID NO: 122335 - DNA, 75 bp, Artificial Sequence
  Synthetic
gtatctcaggttgaggcggctctatccaacctaattaaaatcaatgctgcttcagccgctggcacccacggcttt

SEQ ID NO: 122336 - DNA, 75 bp, Artificial Sequence
  Synthetic
gtatctcaggttgaggcggctctatccaacctaattaatatcaatgctgcttcagccgctggcacccacggcttt

SEQ ID NO: 122337 - DNA, 75 bp, Artificial Sequence
  Synthetic
gtatctcaggttgaggcggctctatccaacctaattaacatcaatgctgcttcagccgctggcacccacggcttt

SEQ ID NO: 122338 - DNA, 75 bp, Artificial Sequence
  Synthetic
gtatctcaggttgaggcggctctatccaacctaattaagatcaatgctgcttcagccgctggcacccacggcttt

SEQ ID NO: 122339 - DNA, 75 bp, Artificial Sequence
  Synthetic
gtatctcaggttgaggcggctctttccaacctaattaaaatcaatgctgcttcagccgctggcacccacggcttt

SEQ ID NO: 122340 - DNA, 75 bp, Artificial Sequence
  Synthetic
gtatctcaggttgaggcggctctttccaacctaattaatatcaatgctgcttcagccgctggcacccacggcttt

SEQ ID NO: 122341 - DNA, 75 bp, Artificial Sequence
  Synthetic
gtatctcaggttgaggcggctctttccaacctaattaacatcaatgctgcttcagccgctggcacccacggcttt

SEQ ID NO: 122342 - DNA, 75 bp, Artificial Sequence
  Synthetic
gtatctcaggttgaggcggctctttccaacctaattaagatcaatgctgcttcagccgctggcacccacggcttt

SEQ ID NO: 122343 - DNA, 75 bp, Artificial Sequence
  Synthetic
gtatctcaggttgaggcggctctctccaacctaattaaaatcaatgctgcttcagccgctggcacccacggcttt

SEQ ID NO: 122344 - DNA, 75 bp, Artificial Sequence
  Synthetic
gtatctcaggttgaggcggctctctccaacctaattaatatcaatgctgcttcagccgctggcacccacggcttt

SEQ ID NO: 122345 - DNA, 75 bp, Artificial Sequence
  Synthetic
gtatctcaggttgaggcggctctctccaacctaattaacatcaatgctgcttcagccgctggcacccacggcttt

SEQ ID NO: 122346 - DNA, 75 bp, Artificial Sequence
  Synthetic
gtatctcaggttgaggcggctctctccaacctaattaagatcaatgctgcttcagccgctggcacccacggcttt

SEQ ID NO: 122347 - DNA, 75 bp, Artificial Sequence
  Synthetic
gtatctcaggttgaggcggctctgtccaacctaattaaaatcaatgctgcttcagccgctggcacccacggcttt

SEQ ID NO: 122348 - DNA, 75 bp, Artificial Sequence
  Synthetic
gtatctcaggttgaggcggctctgtccaacctaattaatatcaatgctgcttcagccgctggcacccacggcttt

SEQ ID NO: 122349 - DNA, 75 bp, Artificial Sequence
  Synthetic
gtatctcaggttgaggcggctctgtccaacctaattaacatcaatgctgcttcagccgctggcacccacggcttt

SEQ ID NO: 122350 - DNA, 75 bp, Artificial Sequence
  Synthetic
gtatctcaggttgaggcggctctgtccaacctaattaagatcaatgctgcttcagccgctggcacccacggcttt

SEQ ID NO: 122351 - DNA, 75 bp, Artificial Sequence
  Synthetic
cccacccccctcctttataggctgggggctgtacaaaatgaagtgacactcactcaccccattacaaaatacatc

SEQ ID NO: 122352 - DNA, 75 bp, Artificial Sequence
  Synthetic
taatattctaggagggtgggtggcctcgcagatcgcgccacccacggccgccactgcgttcgtcgttagcggaat

SEQ ID NO: 122353 - DNA, 75 bp, Artificial Sequence
  Synthetic
ttggaagatagggataggggtcagcagagtccactgctgcattccaccactgagtgggcggtgttgccatgctcc

SEQ ID NO: 122354 - DNA, 75 bp, Artificial Sequence
  Synthetic
agagtccactgctgcattccaccactgagtgggcggtgttgccatgctccttctccgacctaccggcactatcta

SEQ ID NO: 122355 - DNA, 75 bp, Artificial Sequence
  Synthetic
tcacaggccagctcttcagcaagccagctctccgccccgtctttgaaggccacctgtaccacccacaagatggca

SEQ ID NO: 122356 - DNA, 75 bp, Artificial Sequence
  Synthetic
tacttctaatgctgcccgaaagggcatatgcatatgaccgggaggtggcggggacctttggtggcgccgtcgtag

SEQ ID NO: 122357 - DNA, 75 bp, Artificial Sequence
  Synthetic
tacttctaatgctgcccgaaagggcatatgcatatgaccgggaggtggcggggacctttggtggcgccgtcgttg

SEQ ID NO: 122358 - DNA, 75 bp, Artificial Sequence
  Synthetic
tacttctaatgctgcccgaaagggcatatgcatatgaccgggaggtggcggggacctttggtggcgccgtcgtcg

SEQ ID NO: 122359 - DNA, 75 bp, Artificial Sequence
  Synthetic
tacttctaatgctgcccgaaagggcatatgcatatgaccgggaggtggcggggacctttggtggcgccgtcgtgg

SEQ ID NO: 122360 - DNA, 75 bp, Artificial Sequence
  Synthetic
tacttctaatgctgcccgaaagggcttatgcatatgaccgggaggtggcggggacctttggtggcgccgtcgtag

SEQ ID NO: 122361 - DNA, 75 bp, Artificial Sequence
  Synthetic
tacttctaatgctgcccgaaagggcttatgcatatgaccgggaggtggcggggacctttggtggcgccgtcgttg

SEQ ID NO: 122362 - DNA, 75 bp, Artificial Sequence
  Synthetic
tacttctaatgctgcccgaaagggcttatgcatatgaccgggaggtggcggggacctttggtggcgccgtcgtcg

SEQ ID NO: 122363 - DNA, 75 bp, Artificial Sequence
  Synthetic
tacttctaatgctgcccgaaagggcttatgcatatgaccgggaggtggcggggacctttggtggcgccgtcgtgg

SEQ ID NO: 122364 - DNA, 75 bp, Artificial Sequence
  Synthetic
tacttctaatgctgcccgaaagggcctatgcatatgaccgggaggtggcggggacctttggtggcgccgtcgtag

SEQ ID NO: 122365 - DNA, 75 bp, Artificial Sequence
  Synthetic
tacttctaatgctgcccgaaagggcctatgcatatgaccgggaggtggcggggacctttggtggcgccgtcgttg

SEQ ID NO: 122366 - DNA, 75 bp, Artificial Sequence
  Synthetic
tacttctaatgctgcccgaaagggcctatgcatatgaccgggaggtggcggggacctttggtggcgccgtcgtcg

SEQ ID NO: 122367 - DNA, 75 bp, Artificial Sequence
  Synthetic
tacttctaatgctgcccgaaagggcctatgcatatgaccgggaggtggcggggacctttggtggcgccgtcgtgg

SEQ ID NO: 122368 - DNA, 75 bp, Artificial Sequence
  Synthetic
tacttctaatgctgcccgaaagggcgtatgcatatgaccgggaggtggcggggacctttggtggcgccgtcgtag

SEQ ID NO: 122369 - DNA, 75 bp, Artificial Sequence
  Synthetic
tacttctaatgctgcccgaaagggcgtatgcatatgaccgggaggtggcggggacctttggtggcgccgtcgttg

SEQ ID NO: 122370 - DNA, 75 bp, Artificial Sequence
  Synthetic
tacttctaatgctgcccgaaagggcgtatgcatatgaccgggaggtggcggggacctttggtggcgccgtcgtcg

SEQ ID NO: 122371 - DNA, 75 bp, Artificial Sequence
  Synthetic
tacttctaatgctgcccgaaagggcgtatgcatatgaccgggaggtggcggggacctttggtggcgccgtcgtgg

SEQ ID NO: 122372 - DNA, 75 bp, Artificial Sequence
  Synthetic
gcgttgtgattgtcgggagagtcgttctgtcaggccagcctgctgtcatccccaaccgagaggcgctctaccagc

SEQ ID NO: 122373 - DNA, 75 bp, Artificial Sequence
  Synthetic
ccgaagatctagtaaacctcctgccttcaatactctgccctggagccctggtggtcggggtcatatgcgccgcag

SEQ ID NO: 122374 - DNA, 75 bp, Artificial Sequence
  Synthetic
gcatgtctatgttccatcctttgacgtgcgtggtcctcgcgactcattggtcattctcgcggtcctggcttgccc

SEQ ID NO: 122375 - DNA, 75 bp, Artificial Sequence
  Synthetic
tgactgagccagaggacgatcgcgagccttctataccatcagagtacttaattaggaggaaaaaattcccaccgg

SEQ ID NO: 122376 - DNA, 75 bp, Artificial Sequence
  Synthetic
cactgctggcaaccaagcaaaggaagctgcacctgtggtgcaatccactttcagcaagctcgaacagttttgggc

SEQ ID NO: 122377 - DNA, 75 bp, Artificial Sequence
  Synthetic
cgtgcccgagacggacgcgtcggccaaagtcacgcagctgctcagctccctcacagtgacagctctcctaaagag

SEQ ID NO: 122378 - DNA, 75 bp, Artificial Sequence
  Synthetic
cacgcgctgattaagatctgcagcttgttgcgaggggtggtctgtggcaagtattgccaaatggccgtgcttaag

SEQ ID NO: 122379 - DNA, 75 bp, Artificial Sequence
  Synthetic
cacgcgctgattaagatctgcagcttgttgcgtggggtggtctgtggcaagtattgccaaatggccgtgcttaag

SEQ ID NO: 122380 - DNA, 75 bp, Artificial Sequence
  Synthetic
cacgcgctgattaagatctgcagcttgttgcgcggggtggtctgtggcaagtattgccaaatggccgtgcttaag

SEQ ID NO: 122381 - DNA, 75 bp, Artificial Sequence
  Synthetic
cacgcgctgattaagatctgcagcttgttgcggggggtggtctgtggcaagtattgccaaatggccgtgcttaag

SEQ ID NO: 122382 - DNA, 75 bp, Artificial Sequence
  Synthetic
ccgctgaacaaggggagctggggctagtcatattagtaatcatatccatctttactcttaccccagcatacaaga

SEQ ID NO: 122383 - DNA, 75 bp, Artificial Sequence
  Synthetic
gcagtaacaagtcccttgaccacccaacaaaccctcctctttaacatcttaggggggtgggtagcctcgcagatt

SEQ ID NO: 122384 - DNA, 75 bp, Artificial Sequence
  Synthetic
gcttggctgcaggcaaagctcctcccgcaactccccggggtgccctttctctcatgtcagagagggtacaagggt

SEQ ID NO: 122385 - DNA, 75 bp, Artificial Sequence
  Synthetic
tttactcttaccccagcatacaagatcctcctgagccgttcggtgtggtggctgtcctacatgctggtcttggcc

SEQ ID NO: 122386 - DNA, 75 bp, Artificial Sequence
  Synthetic
actttctgtaggggtaggcatcttcctgctgcctgcccgataggcaggctaacactccgaccttagggtcataac

SEQ ID NO: 122387 - DNA, 75 bp, Artificial Sequence
  Synthetic
tcgacttgtcgagttggtttacagtgggcgccggcgggggggacatttatcacagcgtgtcccgtgcccgacccc

SEQ ID NO: 122388 - DNA, 75 bp, Artificial Sequence
  Synthetic
aagcaggatatccagctggtcaacaccaacggcagttggcacatcaatcgcacagccttgaactgtaatgcgagc

SEQ ID NO: 122389 - DNA, 75 bp, Artificial Sequence
  Synthetic
gctacggtgccggcgtagccggcgcagtagtcacttttaaaatcatgagtggcgaggtaccatcaacagaggacc

SEQ ID NO: 122390 - DNA, 75 bp, Artificial Sequence
  Synthetic
gtacgccgcgtaggggactaccactacattacgggggtgacacaggacaatctgaagtgtccctgtcaggtacca

SEQ ID NO: 122391 - DNA, 75 bp, Artificial Sequence
  Synthetic
cttggtaggatggccagcgccccctggggtcaggtctcttgctccgtgcacctgtggcacatctgacttgtatct

SEQ ID NO: 122392 - DNA, 75 bp, Artificial Sequence
  Synthetic
cttggtaggatggccagcgccccctggggtcaggtctcttgctccgtgcacctgtggctcatctgacttgtatct

SEQ ID NO: 122393 - DNA, 75 bp, Artificial Sequence
  Synthetic
cttggtaggatggccagcgccccctggggtcaggtctcttgctccgtgcacctgtggcccatctgacttgtatct

SEQ ID NO: 122394 - DNA, 75 bp, Artificial Sequence
  Synthetic
cttggtaggatggccagcgccccctggggtcaggtctcttgctccgtgcacctgtggcgcatctgacttgtatct

SEQ ID NO: 122395 - DNA, 75 bp, Artificial Sequence
  Synthetic
cttggttggatggccagcgccccctggggtcaggtctcttgctccgtgcacctgtggcacatctgacttgtatct

SEQ ID NO: 122396 - DNA, 75 bp, Artificial Sequence
  Synthetic
cttggttggatggccagcgccccctggggtcaggtctcttgctccgtgcacctgtggctcatctgacttgtatct

SEQ ID NO: 122397 - DNA, 75 bp, Artificial Sequence
  Synthetic
cttggttggatggccagcgccccctggggtcaggtctcttgctccgtgcacctgtggcccatctgacttgtatct

SEQ ID NO: 122398 - DNA, 75 bp, Artificial Sequence
  Synthetic
cttggttggatggccagcgccccctggggtcaggtctcttgctccgtgcacctgtggcgcatctgacttgtatct

SEQ ID NO: 122399 - DNA, 75 bp, Artificial Sequence
  Synthetic
cttggtcggatggccagcgccccctggggtcaggtctcttgctccgtgcacctgtggcacatctgacttgtatct

SEQ ID NO: 122400 - DNA, 75 bp, Artificial Sequence
  Synthetic
cttggtcggatggccagcgccccctggggtcaggtctcttgctccgtgcacctgtggctcatctgacttgtatct

SEQ ID NO: 122401 - DNA, 75 bp, Artificial Sequence
  Synthetic
cttggtcggatggccagcgccccctggggtcaggtctcttgctccgtgcacctgtggcccatctgacttgtatct

SEQ ID NO: 122402 - DNA, 75 bp, Artificial Sequence
  Synthetic
cttggtcggatggccagcgccccctggggtcaggtctcttgctccgtgcacctgtggcgcatctgacttgtatct

SEQ ID NO: 122403 - DNA, 75 bp, Artificial Sequence
  Synthetic
cttggtgggatggccagcgccccctggggtcaggtctcttgctccgtgcacctgtggcacatctgacttgtatct

SEQ ID NO: 122404 - DNA, 75 bp, Artificial Sequence
  Synthetic
cttggtgggatggccagcgccccctggggtcaggtctcttgctccgtgcacctgtggctcatctgacttgtatct

SEQ ID NO: 122405 - DNA, 75 bp, Artificial Sequence
  Synthetic
cttggtgggatggccagcgccccctggggtcaggtctcttgctccgtgcacctgtggcccatctgacttgtatct

SEQ ID NO: 122406 - DNA, 75 bp, Artificial Sequence
  Synthetic
cttggtgggatggccagcgccccctggggtcaggtctcttgctccgtgcacctgtggcgcatctgacttgtatct

SEQ ID NO: 122407 - DNA, 75 bp, Artificial Sequence
  Synthetic
gcttataaacaccaacggcagctggcacatcaacaggactgccctgaactgcaatgattccctccaaactgggtt

SEQ ID NO: 122408 - DNA, 75 bp, Artificial Sequence
  Synthetic
tgcactcctatgtggtggggtcccaattaccctgtgagccagaacccgatgtgactgtcctgacgtcgatgctgt

SEQ ID NO: 122409 - DNA, 75 bp, Artificial Sequence
  Synthetic
aagtctgggactgggtctgcacagtattaagtgacttcaaaacgtggctcaaggctaagctgttgccccgcatgc

SEQ ID NO: 122410 - DNA, 75 bp, Artificial Sequence
  Synthetic
gcaatgattccctccaaactgggtttcttgccgcgctgttctacgcacacaaattcaatgcgtccgggtgcccag

SEQ ID NO: 122411 - DNA, 75 bp, Artificial Sequence
  Synthetic
ggcggtccgctgctgtgccctatgggacacgctgccggcttattccgagcggcggtgtgtacacgaggggtagct

SEQ ID NO: 122412 - DNA, 75 bp, Artificial Sequence
  Synthetic
ggcggtccgctgctgtgccctatgggacacgctgccggcttattccgagcggcggtgtgtactcgaggggtagct

SEQ ID NO: 122413 - DNA, 75 bp, Artificial Sequence
  Synthetic
ggcggtccgctgctgtgccctatgggacacgctgccggcttattccgagcggcggtgtgtacccgaggggtagct

SEQ ID NO: 122414 - DNA, 75 bp, Artificial Sequence
  Synthetic
ggcggtccgctgctgtgccctatgggacacgctgccggcttattccgagcggcggtgtgtacgcgaggggtagct

SEQ ID NO: 122415 - DNA, 75 bp, Artificial Sequence
  Synthetic
ggcggtccgctgctgtgccctatgggacacgctgccggcttattccgtgcggcggtgtgtacacgaggggtagct

SEQ ID NO: 122416 - DNA, 75 bp, Artificial Sequence
  Synthetic
ggcggtccgctgctgtgccctatgggacacgctgccggcttattccgtgcggcggtgtgtactcgaggggtagct

SEQ ID NO: 122417 - DNA, 75 bp, Artificial Sequence
  Synthetic
ggcggtccgctgctgtgccctatgggacacgctgccggcttattccgtgcggcggtgtgtacccgaggggtagct

SEQ ID NO: 122418 - DNA, 75 bp, Artificial Sequence
  Synthetic
ggcggtccgctgctgtgccctatgggacacgctgccggcttattccgtgcggcggtgtgtacgcgaggggtagct

SEQ ID NO: 122419 - DNA, 75 bp, Artificial Sequence
  Synthetic
ggcggtccgctgctgtgccctatgggacacgctgccggcttattccgcgcggcggtgtgtacacgaggggtagct

SEQ ID NO: 122420 - DNA, 75 bp, Artificial Sequence
  Synthetic
ggcggtccgctgctgtgccctatgggacacgctgccggcttattccgcgcggcggtgtgtactcgaggggtagct

SEQ ID NO: 122421 - DNA, 75 bp, Artificial Sequence
  Synthetic
ggcggtccgctgctgtgccctatgggacacgctgccggcttattccgcgcggcggtgtgtacccgaggggtagct

SEQ ID NO: 122422 - DNA, 75 bp, Artificial Sequence
  Synthetic
ggcggtccgctgctgtgccctatgggacacgctgccggcttattccgcgcggcggtgtgtacgcgaggggtagct

SEQ ID NO: 122423 - DNA, 75 bp, Artificial Sequence
  Synthetic
ggcggtccgctgctgtgccctatgggacacgctgccggcttattccgggcggcggtgtgtacacgaggggtagct

SEQ ID NO: 122424 - DNA, 75 bp, Artificial Sequence
  Synthetic
ggcggtccgctgctgtgccctatgggacacgctgccggcttattccgggcggcggtgtgtactcgaggggtagct

SEQ ID NO: 122425 - DNA, 75 bp, Artificial Sequence
  Synthetic
ggcggtccgctgctgtgccctatgggacacgctgccggcttattccgggcggcggtgtgtacccgaggggtagct

SEQ ID NO: 122426 - DNA, 75 bp, Artificial Sequence
  Synthetic
ggcggtccgctgctgtgccctatgggacacgctgccggcttattccgggcggcggtgtgtacgcgaggggtagct

SEQ ID NO: 122427 - DNA, 75 bp, Artificial Sequence
  Synthetic
ggcggtccgctgctgtgccctatgggacacgctgccggctttttccgagcggcggtgtgtacacgaggggtagct

SEQ ID NO: 122428 - DNA, 75 bp, Artificial Sequence
  Synthetic
ggcggtccgctgctgtgccctatgggacacgctgccggctttttccgagcggcggtgtgtactcgaggggtagct

SEQ ID NO: 122429 - DNA, 75 bp, Artificial Sequence
  Synthetic
ggcggtccgctgctgtgccctatgggacacgctgccggctttttccgagcggcggtgtgtacccgaggggtagct

SEQ ID NO: 122430 - DNA, 75 bp, Artificial Sequence
  Synthetic
ggcggtccgctgctgtgccctatgggacacgctgccggctttttccgagcggcggtgtgtacgcgaggggtagct

SEQ ID NO: 122431 - DNA, 75 bp, Artificial Sequence
  Synthetic
ggcggtccgctgctgtgccctatgggacacgctgccggctttttccgtgcggcggtgtgtacacgaggggtagct

SEQ ID NO: 122432 - DNA, 75 bp, Artificial Sequence
  Synthetic
ggcggtccgctgctgtgccctatgggacacgctgccggctttttccgtgcggcggtgtgtactcgaggggtagct

SEQ ID NO: 122433 - DNA, 75 bp, Artificial Sequence
  Synthetic
ggcggtccgctgctgtgccctatgggacacgctgccggctttttccgtgcggcggtgtgtacccgaggggtagct

SEQ ID NO: 122434 - DNA, 75 bp, Artificial Sequence
  Synthetic
ggcggtccgctgctgtgccctatgggacacgctgccggctttttccgtgcggcggtgtgtacgcgaggggtagct

SEQ ID NO: 122435 - DNA, 75 bp, Artificial Sequence
  Synthetic
ggcggtccgctgctgtgccctatgggacacgctgccggctttttccgcgcggcggtgtgtacacgaggggtagct

SEQ ID NO: 122436 - DNA, 75 bp, Artificial Sequence
  Synthetic
ggcggtccgctgctgtgccctatgggacacgctgccggctttttccgcgcggcggtgtgtactcgaggggtagct

SEQ ID NO: 122437 - DNA, 75 bp, Artificial Sequence
  Synthetic
ggcggtccgctgctgtgccctatgggacacgctgccggctttttccgcgcggcggtgtgtacccgaggggtagct

SEQ ID NO: 122438 - DNA, 75 bp, Artificial Sequence
  Synthetic
ggcggtccgctgctgtgccctatgggacacgctgccggctttttccgcgcggcggtgtgtacgcgaggggtagct

SEQ ID NO: 122439 - DNA, 75 bp, Artificial Sequence
  Synthetic
ggcggtccgctgctgtgccctatgggacacgctgccggctttttccgggcggcggtgtgtacacgaggggtagct

SEQ ID NO: 122440 - DNA, 75 bp, Artificial Sequence
  Synthetic
ggcggtccgctgctgtgccctatgggacacgctgccggctttttccgggcggcggtgtgtactcgaggggtagct

SEQ ID NO: 122441 - DNA, 75 bp, Artificial Sequence
  Synthetic
ggcggtccgctgctgtgccctatgggacacgctgccggctttttccgggcggcggtgtgtacccgaggggtagct

SEQ ID NO: 122442 - DNA, 75 bp, Artificial Sequence
  Synthetic
ggcggtccgctgctgtgccctatgggacacgctgccggctttttccgggcggcggtgtgtacgcgaggggtagct

SEQ ID NO: 122443 - DNA, 75 bp, Artificial Sequence
  Synthetic
ggcggtccgctgctgtgccctatgggacacgctgccggcttcttccgagcggcggtgtgtacacgaggggtagct

SEQ ID NO: 122444 - DNA, 75 bp, Artificial Sequence
  Synthetic
ggcggtccgctgctgtgccctatgggacacgctgccggcttcttccgagcggcggtgtgtactcgaggggtagct

SEQ ID NO: 122445 - DNA, 75 bp, Artificial Sequence
  Synthetic
ggcggtccgctgctgtgccctatgggacacgctgccggcttcttccgagcggcggtgtgtacccgaggggtagct

SEQ ID NO: 122446 - DNA, 75 bp, Artificial Sequence
  Synthetic
ggcggtccgctgctgtgccctatgggacacgctgccggcttcttccgagcggcggtgtgtacgcgaggggtagct

SEQ ID NO: 122447 - DNA, 75 bp, Artificial Sequence
  Synthetic
ggcggtccgctgctgtgccctatgggacacgctgccggcttcttccgtgcggcggtgtgtacacgaggggtagct

SEQ ID NO: 122448 - DNA, 75 bp, Artificial Sequence
  Synthetic
ggcggtccgctgctgtgccctatgggacacgctgccggcttcttccgtgcggcggtgtgtactcgaggggtagct

SEQ ID NO: 122449 - DNA, 75 bp, Artificial Sequence
  Synthetic
ggcggtccgctgctgtgccctatgggacacgctgccggcttcttccgtgcggcggtgtgtacccgaggggtagct

SEQ ID NO: 122450 - DNA, 75 bp, Artificial Sequence
  Synthetic
ggcggtccgctgctgtgccctatgggacacgctgccggcttcttccgtgcggcggtgtgtacgcgaggggtagct

SEQ ID NO: 122451 - DNA, 75 bp, Artificial Sequence
  Synthetic
ggcggtccgctgctgtgccctatgggacacgctgccggcttcttccgcgcggcggtgtgtacacgaggggtagct

SEQ ID NO: 122452 - DNA, 75 bp, Artificial Sequence
  Synthetic
ggcggtccgctgctgtgccctatgggacacgctgccggcttcttccgcgcggcggtgtgtactcgaggggtagct

SEQ ID NO: 122453 - DNA, 75 bp, Artificial Sequence
  Synthetic
ggcggtccgctgctgtgccctatgggacacgctgccggcttcttccgcgcggcggtgtgtacccgaggggtagct

SEQ ID NO: 122454 - DNA, 75 bp, Artificial Sequence
  Synthetic
ggcggtccgctgctgtgccctatgggacacgctgccggcttcttccgcgcggcggtgtgtacgcgaggggtagct

SEQ ID NO: 122455 - DNA, 75 bp, Artificial Sequence
  Synthetic
ggcggtccgctgctgtgccctatgggacacgctgccggcttcttccgggcggcggtgtgtacacgaggggtagct

SEQ ID NO: 122456 - DNA, 75 bp, Artificial Sequence
  Synthetic
ggcggtccgctgctgtgccctatgggacacgctgccggcttcttccgggcggcggtgtgtactcgaggggtagct

SEQ ID NO: 122457 - DNA, 75 bp, Artificial Sequence
  Synthetic
ggcggtccgctgctgtgccctatgggacacgctgccggcttcttccgggcggcggtgtgtacccgaggggtagct

SEQ ID NO: 122458 - DNA, 75 bp, Artificial Sequence
  Synthetic
ggcggtccgctgctgtgccctatgggacacgctgccggcttcttccgggcggcggtgtgtacgcgaggggtagct

SEQ ID NO: 122459 - DNA, 75 bp, Artificial Sequence
  Synthetic
ggcggtccgctgctgtgccctatgggacacgctgccggcttgttccgagcggcggtgtgtacacgaggggtagct

SEQ ID NO: 122460 - DNA, 75 bp, Artificial Sequence
  Synthetic
ggcggtccgctgctgtgccctatgggacacgctgccggcttgttccgagcggcggtgtgtactcgaggggtagct

SEQ ID NO: 122461 - DNA, 75 bp, Artificial Sequence
  Synthetic
ggcggtccgctgctgtgccctatgggacacgctgccggcttgttccgagcggcggtgtgtacccgaggggtagct

SEQ ID NO: 122462 - DNA, 75 bp, Artificial Sequence
  Synthetic
ggcggtccgctgctgtgccctatgggacacgctgccggcttgttccgagcggcggtgtgtacgcgaggggtagct

SEQ ID NO: 122463 - DNA, 75 bp, Artificial Sequence
  Synthetic
ggcggtccgctgctgtgccctatgggacacgctgccggcttgttccgtgcggcggtgtgtacacgaggggtagct

SEQ ID NO: 122464 - DNA, 75 bp, Artificial Sequence
  Synthetic
ggcggtccgctgctgtgccctatgggacacgctgccggcttgttccgtgcggcggtgtgtactcgaggggtagct

SEQ ID NO: 122465 - DNA, 75 bp, Artificial Sequence
  Synthetic
ggcggtccgctgctgtgccctatgggacacgctgccggcttgttccgtgcggcggtgtgtacccgaggggtagct

SEQ ID NO: 122466 - DNA, 75 bp, Artificial Sequence
  Synthetic
ggcggtccgctgctgtgccctatgggacacgctgccggcttgttccgtgcggcggtgtgtacgcgaggggtagct

SEQ ID NO: 122467 - DNA, 75 bp, Artificial Sequence
  Synthetic
ggcggtccgctgctgtgccctatgggacacgctgccggcttgttccgcgcggcggtgtgtacacgaggggtagct

SEQ ID NO: 122468 - DNA, 75 bp, Artificial Sequence
  Synthetic
ggcggtccgctgctgtgccctatgggacacgctgccggcttgttccgcgcggcggtgtgtactcgaggggtagct

SEQ ID NO: 122469 - DNA, 75 bp, Artificial Sequence
  Synthetic
ggcggtccgctgctgtgccctatgggacacgctgccggcttgttccgcgcggcggtgtgtacccgaggggtagct

SEQ ID NO: 122470 - DNA, 75 bp, Artificial Sequence
  Synthetic
ggcggtccgctgctgtgccctatgggacacgctgccggcttgttccgcgcggcggtgtgtacgcgaggggtagct

SEQ ID NO: 122471 - DNA, 75 bp, Artificial Sequence
  Synthetic
ggcggtccgctgctgtgccctatgggacacgctgccggcttgttccgggcggcggtgtgtacacgaggggtagct

SEQ ID NO: 122472 - DNA, 75 bp, Artificial Sequence
  Synthetic
ggcggtccgctgctgtgccctatgggacacgctgccggcttgttccgggcggcggtgtgtactcgaggggtagct

SEQ ID NO: 122473 - DNA, 75 bp, Artificial Sequence
  Synthetic
ggcggtccgctgctgtgccctatgggacacgctgccggcttgttccgggcggcggtgtgtacccgaggggtagct

SEQ ID NO: 122474 - DNA, 75 bp, Artificial Sequence
  Synthetic
ggcggtccgctgctgtgccctatgggacacgctgccggcttgttccgggcggcggtgtgtacgcgaggggtagct

SEQ ID NO: 122475 - DNA, 75 bp, Artificial Sequence
  Synthetic
ccacatcaagaacggctcaatgaggatcactgggccgaagacctgcagtaacacctggcatggcaccttccccat

SEQ ID NO: 122476 - DNA, 75 bp, Artificial Sequence
  Synthetic
aatctcttgagacttccatgagatcaccagtgttcactgacaactcgacgcccccagcagtgccccaggtctatc

SEQ ID NO: 122477 - DNA, 75 bp, Artificial Sequence
  Synthetic
attctcttgagacttccatgagatcaccagtgttcactgacaactcgacgcccccagcagtgccccaggtctatc

SEQ ID NO: 122478 - DNA, 75 bp, Artificial Sequence
  Synthetic
actctcttgagacttccatgagatcaccagtgttcactgacaactcgacgcccccagcagtgccccaggtctatc

SEQ ID NO: 122479 - DNA, 75 bp, Artificial Sequence
  Synthetic
agtctcttgagacttccatgagatcaccagtgttcactgacaactcgacgcccccagcagtgccccaggtctatc

SEQ ID NO: 122480 - DNA, 75 bp, Artificial Sequence
  Synthetic
caattgctcaatctatcccggccatgtatcaggtcatcgcatggcttgggatatgatgatgaactggtcacctac

SEQ ID NO: 122481 - DNA, 75 bp, Artificial Sequence
  Synthetic
gtgggtgactcccactatgtcaccggggtgactcaggataacatcaaatgcccttgccaggtcccctctccagaa

SEQ ID NO: 122482 - DNA, 75 bp, Artificial Sequence
  Synthetic
ccggcagcgtatgctgcccagggatataaagtgctagtgctcaatccctcggttgcggccacactgggatttggg

SEQ ID NO: 122483 - DNA, 75 bp, Artificial Sequence
  Synthetic
ccggcagcgtatgctgcccagggttataaagtgctagtgctcaatccctcggttgcggccacactgggatttggg

SEQ ID NO: 122484 - DNA, 75 bp, Artificial Sequence
  Synthetic
ccggcagcgtatgctgcccagggctataaagtgctagtgctcaatccctcggttgcggccacactgggatttggg

SEQ ID NO: 122485 - DNA, 75 bp, Artificial Sequence
  Synthetic
ccggcagcgtatgctgcccaggggtataaagtgctagtgctcaatccctcggttgcggccacactgggatttggg

SEQ ID NO: 122486 - DNA, 75 bp, Artificial Sequence
  Synthetic
caggaccatcaccacgggtgcgccaatcacgtactccacgtatggtaagttcctggctgatggagggtgcagtgg

SEQ ID NO: 122487 - DNA, 75 bp, Artificial Sequence
  Synthetic
ccccacggaggaagaggaagccaatggaactatctgattctaccgtgtcccaggtcctagctgacttggcgcacg

SEQ ID NO: 122488 - DNA, 75 bp, Artificial Sequence
  Synthetic
tcgtggtggggtcccagctcccttgcgagccagagcccgacgtgtctgtgttaacatccatgttgacagacccat

SEQ ID NO: 122489 - DNA, 75 bp, Artificial Sequence
  Synthetic
ggctgggccagctcagaagatccaccttataaacaccaacggcagctggcacatcaacagaacggccctaaattg

SEQ ID NO: 122490 - DNA, 75 bp, Artificial Sequence
  Synthetic
gccacacggacgcccagtttctctgacaacagcgcgccaccagctgtgccccagacttaccaggtgggctacttg

SEQ ID NO: 122491 - DNA, 75 bp, Artificial Sequence
  Synthetic
agccacctgccctgctaatcatgactcccccggtactgacctcatagaagccaaccttctgtggggtaacagtgt

SEQ ID NO: 122492 - DNA, 75 bp, Artificial Sequence
  Synthetic
accccattccaacatagaggaggtcgccctgccgacaacgggagaagtgcccttttacggcaaagcgattcccct

SEQ ID NO: 122493 - DNA, 75 bp, Artificial Sequence
  Synthetic
ttggttttggggcctacatgtccaaagcccacgggatcaaccctaacatcagaaccggagtgcggactgtgacca

SEQ ID NO: 122494 - DNA, 75 bp, Artificial Sequence
  Synthetic
cccattggtgagtttgctcagggatggggtcccatcactcacgcttcggtaacaccacttgaccagagaccatat

SEQ ID NO: 122495 - DNA, 75 bp, Artificial Sequence
  Synthetic
acagctggaccggggcactcatcaccccttgctctgctgaggaggaaaaattacctatcaatcccttaagtaaca

SEQ ID NO: 122496 - DNA, 75 bp, Artificial Sequence
  Synthetic
ctctgtcctaccaagaaatttccaatcgctctgccagtttgggcgcgggctgactataatccaccattggttgaa

SEQ ID NO: 122497 - DNA, 75 bp, Artificial Sequence
  Synthetic
gcggtattgaacccgcgtcacgggtgtgtggtccggtgtattgtttcactccaagccctgtcgtggtgggaacga

SEQ ID NO: 122498 - DNA, 75 bp, Artificial Sequence
  Synthetic
cacctcccaggatgcgtgccctgtgtgaggatcgggaacgtgtcgcgatgctgggtgtccttaacccccaccgtg

SEQ ID NO: 122499 - DNA, 75 bp, Artificial Sequence
  Synthetic
ccactacagagaagttgtggatgagatgaagcgatcggcttccaaggttaaggccagactactgcccctagagga

SEQ ID NO: 122500 - DNA, 75 bp, Artificial Sequence
  Synthetic
atgaagcgatcggcttccaaggttaaggccagactactgcccctagaggaagcttgtaagttaacaccaccccat

SEQ ID NO: 122501 - DNA, 75 bp, Artificial Sequence
  Synthetic
tcgcgctctccgagtctgttatctctaacgccttggcagacttggcagcgaagtcctttggccaaccccaggctg

SEQ ID NO: 122502 - DNA, 75 bp, Artificial Sequence
  Synthetic
acggtgacaactccccacagtaacatagaggaggtggcccttggtcatgagggcgagatccctttttatggcaag

SEQ ID NO: 122503 - DNA, 75 bp, Artificial Sequence
  Synthetic
tgtgtgggggcttgtttctgataggtcaggcctttactttccagccacgccgccactggacgactcaggattgca

SEQ ID NO: 122504 - DNA, 75 bp, Artificial Sequence
  Synthetic
gccaccactcgaaggggagcctggcgacccagacttgacatcagactcatggtccaccgtcagcggatcggaaga

SEQ ID NO: 122505 - DNA, 75 bp, Artificial Sequence
  Synthetic
gaggatccctcaagtcatcctcgacctcctttctggaggccattggggcgttctcgtcggagtggcttacttcag

SEQ ID NO: 122506 - DNA, 75 bp, Artificial Sequence
  Synthetic
ctgctacgccaccacaacatggtgtatgctacgacctcccgctccgctgtggcgcggcagaagaaagtcactttt

SEQ ID NO: 122507 - DNA, 75 bp, Artificial Sequence
  Synthetic
ggcgcggcagaagaaagtcacttttgaccgcatgcaggtggtagacagtcactataatgctgtactcaaggagat

SEQ ID NO: 122508 - DNA, 75 bp, Artificial Sequence
  Synthetic
ccgaacatgacataatgaccgaagagtctatttaccaatcatgtgacttgcagcctgaggcgcgcgcggtaatac

SEQ ID NO: 122509 - DNA, 75 bp, Artificial Sequence
  Synthetic
cggcatgttacagggctcttcaccccaggggccaggcagaacctgcagcttgtaaattccaacggaagctggcac

SEQ ID NO: 122510 - DNA, 75 bp, Artificial Sequence
  Synthetic
ggcttgccagttgcaagcccctcggtggctttccccagggctggggtacgcttggggttgccaataacaacggct

SEQ ID NO: 122511 - DNA, 75 bp, Artificial Sequence
  Synthetic
gctggttcatgttgtgcctactcctactttctgtaggggtaggcatctacctgctccccaaccgatgaacgggga

SEQ ID NO: 122512 - DNA, 75 bp, Artificial Sequence
  Synthetic
aaacctgcgcgcttgatcgtatatccagacctaggggtccgggtgtgcgagaaaagggcgctacatgacgccgtc

SEQ ID NO: 122513 - DNA, 75 bp, Artificial Sequence
  Synthetic
gtggccatttgcgagagccaggggacgcacgaggatgaagcgagcctgagagccttcacggaggctatgaccagg

SEQ ID NO: 122514 - DNA, 75 bp, Artificial Sequence
  Synthetic
ccctgtagtggtcggaaccacggatcgccgcggagtccccacttacacctggggggagaatgagactgatgtctt

SEQ ID NO: 122515 - DNA, 75 bp, Artificial Sequence
  Synthetic
aagcaagcccaagaggcaacaccagtgatccagtccaacttcgccaaacttgaacagttctgggcgaagcacatg

SEQ ID NO: 122516 - DNA, 75 bp, Artificial Sequence
  Synthetic
ggggggagaatgagactgatgtcttcatcctcaattcgaccagacccccggggggggcttggtttgggtgtgttt

SEQ ID NO: 122517 - DNA, 75 bp, Artificial Sequence
  Synthetic
aggcaatcctgccatcgcttccctcatgtctttcactgcagctgtcacaagccctctgaccacccagcaaaccct

SEQ ID NO: 122518 - DNA, 75 bp, Artificial Sequence
  Synthetic
aggcaatcctgccatcgcttccctcatgtctttcactgctgctgtcacaagccctctgaccacccagcaaaccct

SEQ ID NO: 122519 - DNA, 75 bp, Artificial Sequence
  Synthetic
aggcaatcctgccatcgcttccctcatgtctttcactgccgctgtcacaagccctctgaccacccagcaaaccct

SEQ ID NO: 122520 - DNA, 75 bp, Artificial Sequence
  Synthetic
aggcaatcctgccatcgcttccctcatgtctttcactgcggctgtcacaagccctctgaccacccagcaaaccct

SEQ ID NO: 122521 - DNA, 75 bp, Artificial Sequence
  Synthetic
tacatgtccaaggcccatgggattgatcctaacatcaggactggggtgaggacaattactactggcagccccatc

SEQ ID NO: 122522 - DNA, 75 bp, Artificial Sequence
  Synthetic
gccctctgaccacccagcaaaccctcctctttaatattctaggggggtgggtggcctcgcagattgcgacaccga

SEQ ID NO: 122523 - DNA, 75 bp, Artificial Sequence
  Synthetic
gcatccagagaccacctatctcaaatgtggttctgggccctggcttacgccgcggtgcctagtcgattacccata

SEQ ID NO: 122524 - DNA, 75 bp, Artificial Sequence
  Synthetic
cctccaaagccgccctcattgaggaagggcagcggatagcggagatgctcaagtctaagatacaaggcctcctac

SEQ ID NO: 122525 - DNA, 75 bp, Artificial Sequence
  Synthetic
accaggggggaagcgtgtgacctagaacatagggatcgcgcagaaatatctcccttgcttctgtctaccacgcag

SEQ ID NO: 122526 - DNA, 75 bp, Artificial Sequence
  Synthetic
catacagccagccatacagtcatcatggcccaagcttgaacaattttgggccaaacacatgtggaacttcatcag

SEQ ID NO: 122527 - DNA, 75 bp, Artificial Sequence
  Synthetic
agctcataaacaccaacggcagttggcacatcaacaggactgccctgaactgcaatgactccctcaacactgggt

SEQ ID NO: 122528 - DNA, 75 bp, Artificial Sequence
  Synthetic
tcgggtcagcggtggtgtcatgggctctcaagtgggagtatgttgtgctagcgttcctgctcttggcagacgcca

SEQ ID NO: 122529 - DNA, 75 bp, Artificial Sequence
  Synthetic
agtcgcacatgacgcggcaggcaagaaagtgtactacctgacccgcgacccagaaactcccctggcgagagccgc

SEQ ID NO: 122530 - DNA, 75 bp, Artificial Sequence
  Synthetic
tggggggatggttggcctcccagattgccccccctgccggagccactggcttcgttgtcagtggtctagtggggg

SEQ ID NO: 122531 - DNA, 75 bp, Artificial Sequence
  Synthetic
aatcttggctgtgggaggtatggaattgggtctgcaccgtgctgagtgacttcaagacgtggctcaaagcaaagc

SEQ ID NO: 122532 - DNA, 75 bp, Artificial Sequence
  Synthetic
aatcttggctgtgggaggtatggaattgggtctgcaccgtgctgagtgacttcaagacgtggctcaaagctaagc

SEQ ID NO: 122533 - DNA, 75 bp, Artificial Sequence
  Synthetic
aatcttggctgtgggaggtatggaattgggtctgcaccgtgctgagtgacttcaagacgtggctcaaagccaagc

SEQ ID NO: 122534 - DNA, 75 bp, Artificial Sequence
  Synthetic
aatcttggctgtgggaggtatggaattgggtctgcaccgtgctgagtgacttcaagacgtggctcaaagcgaagc

SEQ ID NO: 122535 - DNA, 75 bp, Artificial Sequence
  Synthetic
aatcttggctgtgggaggtttggaattgggtctgcaccgtgctgagtgacttcaagacgtggctcaaagcaaagc

SEQ ID NO: 122536 - DNA, 75 bp, Artificial Sequence
  Synthetic
aatcttggctgtgggaggtttggaattgggtctgcaccgtgctgagtgacttcaagacgtggctcaaagctaagc

SEQ ID NO: 122537 - DNA, 75 bp, Artificial Sequence
  Synthetic
aatcttggctgtgggaggtttggaattgggtctgcaccgtgctgagtgacttcaagacgtggctcaaagccaagc

SEQ ID NO: 122538 - DNA, 75 bp, Artificial Sequence
  Synthetic
aatcttggctgtgggaggtttggaattgggtctgcaccgtgctgagtgacttcaagacgtggctcaaagcgaagc

SEQ ID NO: 122539 - DNA, 75 bp, Artificial Sequence
  Synthetic
aatcttggctgtgggaggtctggaattgggtctgcaccgtgctgagtgacttcaagacgtggctcaaagcaaagc

SEQ ID NO: 122540 - DNA, 75 bp, Artificial Sequence
  Synthetic
aatcttggctgtgggaggtctggaattgggtctgcaccgtgctgagtgacttcaagacgtggctcaaagctaagc

SEQ ID NO: 122541 - DNA, 75 bp, Artificial Sequence
  Synthetic
aatcttggctgtgggaggtctggaattgggtctgcaccgtgctgagtgacttcaagacgtggctcaaagccaagc

SEQ ID NO: 122542 - DNA, 75 bp, Artificial Sequence
  Synthetic
aatcttggctgtgggaggtctggaattgggtctgcaccgtgctgagtgacttcaagacgtggctcaaagcgaagc

SEQ ID NO: 122543 - DNA, 75 bp, Artificial Sequence
  Synthetic
aatcttggctgtgggaggtgtggaattgggtctgcaccgtgctgagtgacttcaagacgtggctcaaagcaaagc

SEQ ID NO: 122544 - DNA, 75 bp, Artificial Sequence
  Synthetic
aatcttggctgtgggaggtgtggaattgggtctgcaccgtgctgagtgacttcaagacgtggctcaaagctaagc

SEQ ID NO: 122545 - DNA, 75 bp, Artificial Sequence
  Synthetic
aatcttggctgtgggaggtgtggaattgggtctgcaccgtgctgagtgacttcaagacgtggctcaaagccaagc

SEQ ID NO: 122546 - DNA, 75 bp, Artificial Sequence
  Synthetic
aatcttggctgtgggaggtgtggaattgggtctgcaccgtgctgagtgacttcaagacgtggctcaaagcgaagc

SEQ ID NO: 122547 - DNA, 75 bp, Artificial Sequence
  Synthetic
tggtatcgtctatgcggttctttttgtctgcgtggcgtggcacatcaagggaagattgtcagctgccttcactta

SEQ ID NO: 122548 - DNA, 75 bp, Artificial Sequence
  Synthetic
tcctggcgacctgtatcaacggcgtgtgttggactgtctaccatggcgccggctcaaagaccctagccggcccaa

SEQ ID NO: 122549 - DNA, 75 bp, Artificial Sequence
  Synthetic
ttcacttaccagggtgcgtgccgtgtgtcaaagtggccaataggtccaaatgctgggtccctgcgacgcccacgt

SEQ ID NO: 122550 - DNA, 75 bp, Artificial Sequence
  Synthetic
atggtcatcttgctggccgtcctaaccctgtcaccgtattacaagcggtggttggctcgggtggtttggtggtta

SEQ ID NO: 122551 - DNA, 75 bp, Artificial Sequence
  Synthetic
aacggctcaatgagaatcactgggccgaaaacttgcagcaacacatggcatggtaccttccccatcaatgcttac

SEQ ID NO: 122552 - DNA, 75 bp, Artificial Sequence
  Synthetic
tggctgtccaggacgagtcaacaccagctattgggttccgtggccacgtggatgtcatggcaggcgccgcaacta

SEQ ID NO: 122553 - DNA, 75 bp, Artificial Sequence
  Synthetic
tccacccccatctggcttttgaggttacgaaacacctcctcgccattgttggccccctttacttgctccagacct

SEQ ID NO: 122554 - DNA, 75 bp, Artificial Sequence
  Synthetic
tgcctgctcggtaggcagccaacactccgaccttagggtctcattactcgaacactccgttccacagtattaaca

SEQ ID NO: 122555 - DNA, 75 bp, Artificial Sequence
  Synthetic
aggtttttaccggtggtcactggggtgtcattggtgctgtggtgtatttctctatggtaggcagttgggtaaaag

SEQ ID NO: 122556 - DNA, 75 bp, Artificial Sequence
  Synthetic
gctcaggcttggtgccctaaccggcacctacatctatgaccacctaacaccaatatcgtcctgggccgcaggcgg

SEQ ID NO: 122557 - DNA, 75 bp, Artificial Sequence
  Synthetic
gagccagtcatattcacacccatggagaagaaggtgatagtttggggagctgacactgcggcatgcggtgacatc

SEQ ID NO: 122558 - DNA, 75 bp, Artificial Sequence
  Synthetic
ctggcttgatccacctccatcagaacatcgtggacgtgcagtatctgtacggtatagggtcagtggttgtctccc

SEQ ID NO: 122559 - DNA, 75 bp, Artificial Sequence
  Synthetic
cccgggagcttctcagcacctccagcttatcaacaccaacggcagctggcacatcaatcgtacagctctcaattg

SEQ ID NO: 122560 - DNA, 75 bp, Artificial Sequence
  Synthetic
ccgcgtacgcgcagcagactcgaggcgtgtgtagcaccatcgtgacgagcctcactggcagggacaccaatgaca

SEQ ID NO: 122561 - DNA, 75 bp, Artificial Sequence
  Synthetic
tgaaccagatgatgacagggaggtctcagtcgccgcggaaattctgcgtccgaccaagaagtttcccccagcttt

SEQ ID NO: 122562 - DNA, 75 bp, Artificial Sequence
  Synthetic
acacatttccatcaagggtggggctccatctcttatgccaacctatccggcccatctgatgacaagccttactgc

SEQ ID NO: 122563 - DNA, 75 bp, Artificial Sequence
  Synthetic
ggcgaaggtcccgcaacttgggtaaggtcatcgatacccttacttgcggcctagccgacctcatggggtacatcc

SEQ ID NO: 122564 - DNA, 75 bp, Artificial Sequence
  Synthetic
cccatctgatgacaagccttactgctggcactaccccccccgcccgtgtgaagtggtaccggctgagacagtgtg

SEQ ID NO: 122565 - DNA, 75 bp, Artificial Sequence
  Synthetic
gaccctttgcgggccaaagggacctgtctgtcaaatgtacaccaacgtggaccaggacctcgtggggtggccatc

SEQ ID NO: 122566 - DNA, 75 bp, Artificial Sequence
  Synthetic
tcctcctggagttaagtccctctcgccgtgcacttgcggagcatcagatctgttcctagttactcggcatgcaga

SEQ ID NO: 122567 - DNA, 75 bp, Artificial Sequence
  Synthetic
ggcatatgactgtgacatggtggatgctaaccttttcatgggaggcgatgtgacccggattgaatccgactccaa

SEQ ID NO: 122568 - DNA, 75 bp, Artificial Sequence
  Synthetic
tgatgccgtcattctcctcacgtgcgcggtccacccagacctaatctttgacatcaccaaactcttgctcgctgt

SEQ ID NO: 122569 - DNA, 75 bp, Artificial Sequence
  Synthetic
gcggtccacccagacctaatctttgacatcaccaaactcttgctcgctgtgctcggtccgctcatggtgtttctg

SEQ ID NO: 122570 - DNA, 75 bp, Artificial Sequence
  Synthetic
acatcttccagggtgtgtcccgtgcattaagtcaggcaatagatcgcaatgttggttgcccgttacaccgacctt

SEQ ID NO: 122571 - DNA, 75 bp, Artificial Sequence
  Synthetic
agggccctggctaacccccaggtgtttggtggactatccctacaggctatggcactatccatgcacagtcaatta

SEQ ID NO: 122572 - DNA, 75 bp, Artificial Sequence
  Synthetic
atgttcgactcctcggtcctgtgtgagtgctatgacgcgggctgtgcttggtatgagctcacgcccgccgagacc

SEQ ID NO: 122573 - DNA, 75 bp, Artificial Sequence
  Synthetic
ctctgtggcggcgtcttccttgtggggcaggcgttcgcccttagacccagtgtgcatcaagccgtccaggaatgt

SEQ ID NO: 122574 - DNA, 75 bp, Artificial Sequence
  Synthetic
acaggaccgccttgaactgcaatgactccctccacactgggttccttgccgcgctgttctatgtaaacaggttca

SEQ ID NO: 122575 - DNA, 75 bp, Artificial Sequence
  Synthetic
gacaggatcgagatgcaccccctcctgttttccaccacagagctcgcggtcctgccatgctcctttagcaccatg

SEQ ID NO: 122576 - DNA, 75 bp, Artificial Sequence
  Synthetic
tgagagtaccacagttgctcctcgagatttttctcggagcacactggggtgtcctcggagccgtggtgtattaca

SEQ ID NO: 122577 - DNA, 75 bp, Artificial Sequence
  Synthetic
gggagtacatcgttctcctgtttctctacctggctgatgcccgtctctgcacctgtttgtggctgatgttcttag

SEQ ID NO: 122578 - DNA, 75 bp, Artificial Sequence
  Synthetic
tgggtaaggccgaggcagctttggaaaacctcatcagtctgaatgctgccgcggctgcgggtacccacaggtggg

SEQ ID NO: 122579 - DNA, 75 bp, Artificial Sequence
  Synthetic
ccggtagcagcgcggcgtccagtacgagcgcgttcgccaaattgtttcaaccaggagcccagcagaaactaatgc

SEQ ID NO: 122580 - DNA, 75 bp, Artificial Sequence
  Synthetic
gcaaccgccacgccaccaggatctgtgactacgccccattctaacatagaggaagtcgccttgccaacgacggga

SEQ ID NO: 122581 - DNA, 75 bp, Artificial Sequence
  Synthetic
gttcaattcgtcagggtgccctgagcgcatgagcagttgcaagcctttgcacgcgttcgaccagggttgggggcc

SEQ ID NO: 122582 - DNA, 75 bp, Artificial Sequence
  Synthetic
ccacattataaggctctgctcactgggtgcctctggtggatccagtatttcatagcacggctagaagctgagctg

SEQ ID NO: 122583 - DNA, 75 bp, Artificial Sequence
  Synthetic
gggcctgtctactgttttacacccagcccagtagttgttggtaccaccgacagaagagggaatcctacgtatact

SEQ ID NO: 122584 - DNA, 75 bp, Artificial Sequence
  Synthetic
tttcagcctggaccccaccttcaccatagagaccacaaccctgcctcaggacgcggtatctcgcagccaacggag

SEQ ID NO: 122585 - DNA, 75 bp, Artificial Sequence
  Synthetic
gcggcgtctacacgacaagcttcgggaacacactgacgtgctatctcaaagcaacagctgctcttagagcagcag

SEQ ID NO: 122586 - DNA, 75 bp, Artificial Sequence
  Synthetic
gcggcgtctacacgacaagcttcgggaacacactgacgtgctatctcaaagcaacagctgctcttagagctgcag

SEQ ID NO: 122587 - DNA, 75 bp, Artificial Sequence
  Synthetic
gcggcgtctacacgacaagcttcgggaacacactgacgtgctatctcaaagcaacagctgctcttagagccgcag

SEQ ID NO: 122588 - DNA, 75 bp, Artificial Sequence
  Synthetic
gcggcgtctacacgacaagcttcgggaacacactgacgtgctatctcaaagcaacagctgctcttagagcggcag

SEQ ID NO: 122589 - DNA, 75 bp, Artificial Sequence
  Synthetic
gcggcgtctacacgacaagcttcgggaacacactgacgtgctatctcaaagctacagctgctcttagagcagcag

SEQ ID NO: 122590 - DNA, 75 bp, Artificial Sequence
  Synthetic
gcggcgtctacacgacaagcttcgggaacacactgacgtgctatctcaaagctacagctgctcttagagctgcag

SEQ ID NO: 122591 - DNA, 75 bp, Artificial Sequence
  Synthetic
gcggcgtctacacgacaagcttcgggaacacactgacgtgctatctcaaagctacagctgctcttagagccgcag

SEQ ID NO: 122592 - DNA, 75 bp, Artificial Sequence
  Synthetic
gcggcgtctacacgacaagcttcgggaacacactgacgtgctatctcaaagctacagctgctcttagagcggcag

SEQ ID NO: 122593 - DNA, 75 bp, Artificial Sequence
  Synthetic
gcggcgtctacacgacaagcttcgggaacacactgacgtgctatctcaaagccacagctgctcttagagcagcag

SEQ ID NO: 122594 - DNA, 75 bp, Artificial Sequence
  Synthetic
gcggcgtctacacgacaagcttcgggaacacactgacgtgctatctcaaagccacagctgctcttagagctgcag

SEQ ID NO: 122595 - DNA, 75 bp, Artificial Sequence
  Synthetic
gcggcgtctacacgacaagcttcgggaacacactgacgtgctatctcaaagccacagctgctcttagagccgcag

SEQ ID NO: 122596 - DNA, 75 bp, Artificial Sequence
  Synthetic
gcggcgtctacacgacaagcttcgggaacacactgacgtgctatctcaaagccacagctgctcttagagcggcag

SEQ ID NO: 122597 - DNA, 75 bp, Artificial Sequence
  Synthetic
gcggcgtctacacgacaagcttcgggaacacactgacgtgctatctcaaagcgacagctgctcttagagcagcag

SEQ ID NO: 122598 - DNA, 75 bp, Artificial Sequence
  Synthetic
gcggcgtctacacgacaagcttcgggaacacactgacgtgctatctcaaagcgacagctgctcttagagctgcag

SEQ ID NO: 122599 - DNA, 75 bp, Artificial Sequence
  Synthetic
gcggcgtctacacgacaagcttcgggaacacactgacgtgctatctcaaagcgacagctgctcttagagccgcag

SEQ ID NO: 122600 - DNA, 75 bp, Artificial Sequence
  Synthetic
gcggcgtctacacgacaagcttcgggaacacactgacgtgctatctcaaagcgacagctgctcttagagcggcag

SEQ ID NO: 122601 - DNA, 75 bp, Artificial Sequence
  Synthetic
gcggcgtctacacgactagcttcgggaacacactgacgtgctatctcaaagcaacagctgctcttagagcagcag

SEQ ID NO: 122602 - DNA, 75 bp, Artificial Sequence
  Synthetic
gcggcgtctacacgactagcttcgggaacacactgacgtgctatctcaaagcaacagctgctcttagagctgcag

SEQ ID NO: 122603 - DNA, 75 bp, Artificial Sequence
  Synthetic
gcggcgtctacacgactagcttcgggaacacactgacgtgctatctcaaagcaacagctgctcttagagccgcag

SEQ ID NO: 122604 - DNA, 75 bp, Artificial Sequence
  Synthetic
gcggcgtctacacgactagcttcgggaacacactgacgtgctatctcaaagcaacagctgctcttagagcggcag

SEQ ID NO: 122605 - DNA, 75 bp, Artificial Sequence
  Synthetic
gcggcgtctacacgactagcttcgggaacacactgacgtgctatctcaaagctacagctgctcttagagcagcag

SEQ ID NO: 122606 - DNA, 75 bp, Artificial Sequence
  Synthetic
gcggcgtctacacgactagcttcgggaacacactgacgtgctatctcaaagctacagctgctcttagagctgcag

SEQ ID NO: 122607 - DNA, 75 bp, Artificial Sequence
  Synthetic
gcggcgtctacacgactagcttcgggaacacactgacgtgctatctcaaagctacagctgctcttagagccgcag

SEQ ID NO: 122608 - DNA, 75 bp, Artificial Sequence
  Synthetic
gcggcgtctacacgactagcttcgggaacacactgacgtgctatctcaaagctacagctgctcttagagcggcag

SEQ ID NO: 122609 - DNA, 75 bp, Artificial Sequence
  Synthetic
gcggcgtctacacgactagcttcgggaacacactgacgtgctatctcaaagccacagctgctcttagagcagcag

SEQ ID NO: 122610 - DNA, 75 bp, Artificial Sequence
  Synthetic
gcggcgtctacacgactagcttcgggaacacactgacgtgctatctcaaagccacagctgctcttagagctgcag

SEQ ID NO: 122611 - DNA, 75 bp, Artificial Sequence
  Synthetic
gcggcgtctacacgactagcttcgggaacacactgacgtgctatctcaaagccacagctgctcttagagccgcag

SEQ ID NO: 122612 - DNA, 75 bp, Artificial Sequence
  Synthetic
gcggcgtctacacgactagcttcgggaacacactgacgtgctatctcaaagccacagctgctcttagagcggcag

SEQ ID NO: 122613 - DNA, 75 bp, Artificial Sequence
  Synthetic
gcggcgtctacacgactagcttcgggaacacactgacgtgctatctcaaagcgacagctgctcttagagcagcag

SEQ ID NO: 122614 - DNA, 75 bp, Artificial Sequence
  Synthetic
gcggcgtctacacgactagcttcgggaacacactgacgtgctatctcaaagcgacagctgctcttagagctgcag

SEQ ID NO: 122615 - DNA, 75 bp, Artificial Sequence
  Synthetic
gcggcgtctacacgactagcttcgggaacacactgacgtgctatctcaaagcgacagctgctcttagagccgcag

SEQ ID NO: 122616 - DNA, 75 bp, Artificial Sequence
  Synthetic
gcggcgtctacacgactagcttcgggaacacactgacgtgctatctcaaagcgacagctgctcttagagcggcag

SEQ ID NO: 122617 - DNA, 75 bp, Artificial Sequence
  Synthetic
gcggcgtctacacgaccagcttcgggaacacactgacgtgctatctcaaagcaacagctgctcttagagcagcag

SEQ ID NO: 122618 - DNA, 75 bp, Artificial Sequence
  Synthetic
gcggcgtctacacgaccagcttcgggaacacactgacgtgctatctcaaagcaacagctgctcttagagctgcag

SEQ ID NO: 122619 - DNA, 75 bp, Artificial Sequence
  Synthetic
gcggcgtctacacgaccagcttcgggaacacactgacgtgctatctcaaagcaacagctgctcttagagccgcag

SEQ ID NO: 122620 - DNA, 75 bp, Artificial Sequence
  Synthetic
gcggcgtctacacgaccagcttcgggaacacactgacgtgctatctcaaagcaacagctgctcttagagcggcag

SEQ ID NO: 122621 - DNA, 75 bp, Artificial Sequence
  Synthetic
gcggcgtctacacgaccagcttcgggaacacactgacgtgctatctcaaagctacagctgctcttagagcagcag

SEQ ID NO: 122622 - DNA, 75 bp, Artificial Sequence
  Synthetic
gcggcgtctacacgaccagcttcgggaacacactgacgtgctatctcaaagctacagctgctcttagagctgcag

SEQ ID NO: 122623 - DNA, 75 bp, Artificial Sequence
  Synthetic
gcggcgtctacacgaccagcttcgggaacacactgacgtgctatctcaaagctacagctgctcttagagccgcag

SEQ ID NO: 122624 - DNA, 75 bp, Artificial Sequence
  Synthetic
gcggcgtctacacgaccagcttcgggaacacactgacgtgctatctcaaagctacagctgctcttagagcggcag

SEQ ID NO: 122625 - DNA, 75 bp, Artificial Sequence
  Synthetic
gcggcgtctacacgaccagcttcgggaacacactgacgtgctatctcaaagccacagctgctcttagagcagcag

SEQ ID NO: 122626 - DNA, 75 bp, Artificial Sequence
  Synthetic
gcggcgtctacacgaccagcttcgggaacacactgacgtgctatctcaaagccacagctgctcttagagctgcag

SEQ ID NO: 122627 - DNA, 75 bp, Artificial Sequence
  Synthetic
gcggcgtctacacgaccagcttcgggaacacactgacgtgctatctcaaagccacagctgctcttagagccgcag

SEQ ID NO: 122628 - DNA, 75 bp, Artificial Sequence
  Synthetic
gcggcgtctacacgaccagcttcgggaacacactgacgtgctatctcaaagccacagctgctcttagagcggcag

SEQ ID NO: 122629 - DNA, 75 bp, Artificial Sequence
  Synthetic
gcggcgtctacacgaccagcttcgggaacacactgacgtgctatctcaaagcgacagctgctcttagagcagcag

SEQ ID NO: 122630 - DNA, 75 bp, Artificial Sequence
  Synthetic
gcggcgtctacacgaccagcttcgggaacacactgacgtgctatctcaaagcgacagctgctcttagagctgcag

SEQ ID NO: 122631 - DNA, 75 bp, Artificial Sequence
  Synthetic
gcggcgtctacacgaccagcttcgggaacacactgacgtgctatctcaaagcgacagctgctcttagagccgcag

SEQ ID NO: 122632 - DNA, 75 bp, Artificial Sequence
  Synthetic
gcggcgtctacacgaccagcttcgggaacacactgacgtgctatctcaaagcgacagctgctcttagagcggcag

SEQ ID NO: 122633 - DNA, 75 bp, Artificial Sequence
  Synthetic
gcggcgtctacacgacgagcttcgggaacacactgacgtgctatctcaaagcaacagctgctcttagagcagcag

SEQ ID NO: 122634 - DNA, 75 bp, Artificial Sequence
  Synthetic
gcggcgtctacacgacgagcttcgggaacacactgacgtgctatctcaaagcaacagctgctcttagagctgcag

SEQ ID NO: 122635 - DNA, 75 bp, Artificial Sequence
  Synthetic
gcggcgtctacacgacgagcttcgggaacacactgacgtgctatctcaaagcaacagctgctcttagagccgcag

SEQ ID NO: 122636 - DNA, 75 bp, Artificial Sequence
  Synthetic
gcggcgtctacacgacgagcttcgggaacacactgacgtgctatctcaaagcaacagctgctcttagagcggcag

SEQ ID NO: 122637 - DNA, 75 bp, Artificial Sequence
  Synthetic
gcggcgtctacacgacgagcttcgggaacacactgacgtgctatctcaaagctacagctgctcttagagcagcag

SEQ ID NO: 122638 - DNA, 75 bp, Artificial Sequence
  Synthetic
gcggcgtctacacgacgagcttcgggaacacactgacgtgctatctcaaagctacagctgctcttagagctgcag

SEQ ID NO: 122639 - DNA, 75 bp, Artificial Sequence
  Synthetic
gcggcgtctacacgacgagcttcgggaacacactgacgtgctatctcaaagctacagctgctcttagagccgcag

SEQ ID NO: 122640 - DNA, 75 bp, Artificial Sequence
  Synthetic
gcggcgtctacacgacgagcttcgggaacacactgacgtgctatctcaaagctacagctgctcttagagcggcag

SEQ ID NO: 122641 - DNA, 75 bp, Artificial Sequence
  Synthetic
gcggcgtctacacgacgagcttcgggaacacactgacgtgctatctcaaagccacagctgctcttagagcagcag

SEQ ID NO: 122642 - DNA, 75 bp, Artificial Sequence
  Synthetic
gcggcgtctacacgacgagcttcgggaacacactgacgtgctatctcaaagccacagctgctcttagagctgcag

SEQ ID NO: 122643 - DNA, 75 bp, Artificial Sequence
  Synthetic
gcggcgtctacacgacgagcttcgggaacacactgacgtgctatctcaaagccacagctgctcttagagccgcag

SEQ ID NO: 122644 - DNA, 75 bp, Artificial Sequence
  Synthetic
gcggcgtctacacgacgagcttcgggaacacactgacgtgctatctcaaagccacagctgctcttagagcggcag

SEQ ID NO: 122645 - DNA, 75 bp, Artificial Sequence
  Synthetic
gcggcgtctacacgacgagcttcgggaacacactgacgtgctatctcaaagcgacagctgctcttagagcagcag

SEQ ID NO: 122646 - DNA, 75 bp, Artificial Sequence
  Synthetic
gcggcgtctacacgacgagcttcgggaacacactgacgtgctatctcaaagcgacagctgctcttagagctgcag

SEQ ID NO: 122647 - DNA, 75 bp, Artificial Sequence
  Synthetic
gcggcgtctacacgacgagcttcgggaacacactgacgtgctatctcaaagcgacagctgctcttagagccgcag

SEQ ID NO: 122648 - DNA, 75 bp, Artificial Sequence
  Synthetic
gcggcgtctacacgacgagcttcgggaacacactgacgtgctatctcaaagcgacagctgctcttagagcggcag

SEQ ID NO: 122649 - DNA, 75 bp, Artificial Sequence
  Synthetic
tacttcttgccttaattggcccgttgtacttgctccaagaaggtctgctgcgggtgccgtactacgtgcgggcac

SEQ ID NO: 122650 - DNA, 75 bp, Artificial Sequence
  Synthetic
cgggtgccgtactacgtgcgggcacatgcgcttttgcgcgtgtgcttgctcgtgcgtcggatagcagcgggtaag

SEQ ID NO: 122651 - DNA, 75 bp, Artificial Sequence
  Synthetic
aaacatgtggggctcccccctgtctgactcgacccagtgaggagaacaacaccttggtgtgtcccaccgactgct

SEQ ID NO: 122652 - DNA, 75 bp, Artificial Sequence
  Synthetic
gatgcgggatgcgcctggtacgaactgactccagcagagacgaccgttaggttgagggcttattttaacacccca

SEQ ID NO: 122653 - DNA, 75 bp, Artificial Sequence
  Synthetic
ggaggctatgacgaggtactcggctcccccaggagacgccccgcagccagcatatgacctggaactaataacatc

SEQ ID NO: 122654 - DNA, 75 bp, Artificial Sequence
  Synthetic
gttgagggcttattttaacaccccaggtctccctgtgtgccaagatcatcttgagttctgggaaggcgtctttac

SEQ ID NO: 122655 - DNA, 75 bp, Artificial Sequence
  Synthetic
acctcgctgtcgcggttgaaccggtcgttttttcaccgatggagaagagggtcattgtttggggcgctgacacta

SEQ ID NO: 122656 - DNA, 75 bp, Artificial Sequence
  Synthetic
ttgcactgtgaacttcaccatacacaaggtcagaacgtatgtgggtggcgttgagcataggtttgaagctgcatg

SEQ ID NO: 122657 - DNA, 75 bp, Artificial Sequence
  Synthetic
cctcctagctcccatcacggcttatgctcagcaaacacggggcctactgggcaccatcgtcacaagcctcactgg

SEQ ID NO: 122658 - DNA, 75 bp, Artificial Sequence
  Synthetic
ggggctgtgcagtggatgaaccggctgatagcgttcgcttctcggggtaaccatgtttcccccacgcactatgtg

SEQ ID NO: 122659 - DNA, 75 bp, Artificial Sequence
  Synthetic
tcgttcaccaacatgcctgcactgtcaaccggcctaatccatctccaccagaacatagtggacgtgcaatacatc

SEQ ID NO: 122660 - DNA, 75 bp, Artificial Sequence
  Synthetic
tggtgactagcacatgggttctggtaggcggcctcctagcagccctagctgcgtactgcttgtcagtgggcagcg

SEQ ID NO: 122661 - DNA, 75 bp, Artificial Sequence
  Synthetic
cacggagccgggtcgaagaccctggccggtccaaagaagcctttgtgccaaatgtacaccaatgtggaccaagac

SEQ ID NO: 122662 - DNA, 75 bp, Artificial Sequence
  Synthetic
aacgttcgggggggccgcgatgccatcatcctcctcacgtgcgcgatccacccagagctaatctttaccatcacc

SEQ ID NO: 122663 - DNA, 75 bp, Artificial Sequence
  Synthetic
ggctcatgttcttagttggccaagcggaggcagcgttggagaacctggttgtcctcaacgctgcctctgctgcca

SEQ ID NO: 122664 - DNA, 75 bp, Artificial Sequence
  Synthetic
tcgacgagatggaagagtgctctaagcaccttccactggtcgagcatgggttattgctagcagagcagttcaagc

SEQ ID NO: 122665 - DNA, 75 bp, Artificial Sequence
  Synthetic
acccggcactccgccatgaactcacgcagaaagcgtctagccatggcgttagccgacactccgccatgaatcact

SEQ ID NO: 122666 - DNA, 75 bp, Artificial Sequence
  Synthetic
gtcacaagaaatggtgatgtcatacctgccaggcgaaagggggatagtcgcgcagcactcctaagcccacgacct

SEQ ID NO: 122667 - DNA, 75 bp, Artificial Sequence
  Synthetic
gcctctcttgttgctagtgctcactctaccccggagggcttacgcccaagacactgatcaggcggtgacggcagg

SEQ ID NO: 122668 - DNA, 75 bp, Artificial Sequence
  Synthetic
attcttcaggctgtcccgagagattggcgagctgccgaccccttaccgattttgaccagggctggggccctatca

SEQ ID NO: 122669 - DNA, 75 bp, Artificial Sequence
  Synthetic
gcagaggccatgctccatgactgggcgccctctctccgggttaggggcggtcgtgatgcagtcattctactcacc

SEQ ID NO: 122670 - DNA, 75 bp, Artificial Sequence
  Synthetic
tgcacacatactctccccacgaactctcacgggtggcagcaactctcagaaaacttggagcgcctccccttagag

SEQ ID NO: 122671 - DNA, 75 bp, Artificial Sequence
  Synthetic
acccctacagcgtccacggctttcgtcgtgagcggcctcgcaggagcagcggttggcagcgtgggtttaggcaag

SEQ ID NO: 122672 - DNA, 75 bp, Artificial Sequence
  Synthetic
atactggttgacatcctcgccggctacggtgctggtgtagctggcgctgtggtcacctttaaaatcatgagtggc

SEQ ID NO: 122673 - DNA, 75 bp, Artificial Sequence
  Synthetic
actttgtgcgggcacacattttgttgcgcgcctgcatgttcttccgcggcatagcttgcggcaaatatgctcaag

SEQ ID NO: 122674 - DNA, 75 bp, Artificial Sequence
  Synthetic
ccttgccgacggcgggtgtagtgggggcgcgtatgacataatcatttgtgatgagtgccactccacggaccctac

SEQ ID NO: 122675 - DNA, 75 bp, Artificial Sequence
  Synthetic
gcagtggatgaaccgtctcattgccttcgcatcgcgaggcaatcacgtgtctcccacgcactacgtcccagagtc

SEQ ID NO: 122676 - DNA, 75 bp, Artificial Sequence
  Synthetic
tgcggtggagccggttgttttctctccaatggagaagaaggtcattacctggggtgctgatacagctgcttgtgg

SEQ ID NO: 122677 - DNA, 75 bp, Artificial Sequence
  Synthetic
gggcaaagggtggaggctcctcgctcccatcacggcatacgcccagcagactcggggcttggtaggaactatcgt

SEQ ID NO: 122678 - DNA, 75 bp, Artificial Sequence
  Synthetic
gagtgacttcaagacgtggctcaaagcaaaattactgcctcgcatgcctggcgtccccttcctttcttgtcagaa

SEQ ID NO: 122679 - DNA, 75 bp, Artificial Sequence
  Synthetic
atgacagcattacctggcagctccaggctgctgtcctccacgtccccgggtgcgtcccgtgcgagaaagtgggga

SEQ ID NO: 122680 - DNA, 75 bp, Artificial Sequence
  Synthetic
agtcatccctacctccggcgatgtcgtcgtttgcgctacggacgcccttatgactggttatacgggcgatttcga

SEQ ID NO: 122681 - DNA, 75 bp, Artificial Sequence
  Synthetic
cctgcggggcggaaatagctggccacatcaagaacggctccatgagaatcgttgggccgagcacctgcagcaaca

SEQ ID NO: 122682 - DNA, 75 bp, Artificial Sequence
  Synthetic
acggaggaagaggacgattgtcctgacagaatccatcgcgtcttctgccctggcggagctcgctaggaagacctt

SEQ ID NO: 122683 - DNA, 75 bp, Artificial Sequence
  Synthetic
aatgttgaccaggaccttgtgggttggcctgcgcctcccgggtcgcgctccctaacaccatgcagttgcggctcg

SEQ ID NO: 122684 - DNA, 75 bp, Artificial Sequence
  Synthetic
agcccataccaaaggcacgccagccgacgggccggcactgggctcagcctggttacccttggcccctttatggca

SEQ ID NO: 122685 - DNA, 75 bp, Artificial Sequence
  Synthetic
agcccataccaaaggctcgccagccgacgggccggcactgggctcagcctggttacccttggcccctttatggca

SEQ ID NO: 122686 - DNA, 75 bp, Artificial Sequence
  Synthetic
agcccataccaaaggcccgccagccgacgggccggcactgggctcagcctggttacccttggcccctttatggca

SEQ ID NO: 122687 - DNA, 75 bp, Artificial Sequence
  Synthetic
agcccataccaaaggcgcgccagccgacgggccggcactgggctcagcctggttacccttggcccctttatggca

SEQ ID NO: 122688 - DNA, 75 bp, Artificial Sequence
  Synthetic
ggagtacgtggaagtgcgtagggtgggcgactaccattatatcactggggtgacgcaagataacatcaagtgccc

SEQ ID NO: 122689 - DNA, 75 bp, Artificial Sequence
  Synthetic
ttaaagggtcttctggtggccctgtactgtgcccctctggccacgtcgcagggattttccgtgcggcagtgtgaa

SEQ ID NO: 122690 - DNA, 75 bp, Artificial Sequence
  Synthetic
ttaaagggtcttctggtggccctgtactgtgcccctctggccacgtcgcagggattttccgtgcggcagtgtgta

SEQ ID NO: 122691 - DNA, 75 bp, Artificial Sequence
  Synthetic
ttaaagggtcttctggtggccctgtactgtgcccctctggccacgtcgcagggattttccgtgcggcagtgtgca

SEQ ID NO: 122692 - DNA, 75 bp, Artificial Sequence
  Synthetic
ttaaagggtcttctggtggccctgtactgtgcccctctggccacgtcgcagggattttccgtgcggcagtgtgga

SEQ ID NO: 122693 - DNA, 75 bp, Artificial Sequence
  Synthetic
tccatcggtacgctcccccatgcaagcccttgctaagggacgaggtaacattctcagtaggtctcaacacatacg

SEQ ID NO: 122694 - DNA, 75 bp, Artificial Sequence
  Synthetic
cgtatgccaggatcatcttgagttctgggaggcagtgttcactgggctcacccacattgatgcccattttctctc

SEQ ID NO: 122695 - DNA, 75 bp, Artificial Sequence
  Synthetic
cccacattgatgcccattttctctctcagacaaagcaggcgggggaaaactttgcgtatctggtggcttaccaag

SEQ ID NO: 122696 - DNA, 75 bp, Artificial Sequence
  Synthetic
accacagacctaccaggtagggtatctccacgctcccacagggagcgggaagagcaccaaggtcccggcggccta

SEQ ID NO: 122697 - DNA, 75 bp, Artificial Sequence
  Synthetic
aatgactgccctaattctagcattgtttatgaggcgggtgatatcattctacaccttcctgggtgtgttccatgc

SEQ ID NO: 122698 - DNA, 75 bp, Artificial Sequence
  Synthetic
gttgtacaggcttggagcggtgcagaatgacatcacaacaacacacccaatcaccaagtacatcatggcttgcat

SEQ ID NO: 122699 - DNA, 75 bp, Artificial Sequence
  Synthetic
ccaggctcatggcatagatcccaatatccgcactggggtgagaaccatcaccactggcggaaaaatcacatactc

SEQ ID NO: 122700 - DNA, 75 bp, Artificial Sequence
  Synthetic
ttctcttttggggcactggtactaccagggttgagtctgaagggaaagtgatggtgctcgattctttcgagccgc

SEQ ID NO: 122701 - DNA, 75 bp, Artificial Sequence
  Synthetic
gtcggcagatttagaggtcatcaccagcacatgggtgctagccggcgggatccttgccgccttggctgcctattg

SEQ ID NO: 122702 - DNA, 75 bp, Artificial Sequence
  Synthetic
acaccttcctgggtgtgttccatgcgtcaccactggaaacacatcgcagtgttgggtcccggtttcccccacctt

SEQ ID NO: 122703 - DNA, 75 bp, Artificial Sequence
  Synthetic
agcacatgggtgctagccggcgggatccttgccgccttggctgcctattgcctcacgatgggcagcgttgtcatc

SEQ ID NO: 122704 - DNA, 75 bp, Artificial Sequence
  Synthetic
gggatagggaccgtcctcgatcaggcggagaccagcggagtgagacttacggtcctcgcaaccgctactccccct

SEQ ID NO: 122705 - DNA, 75 bp, Artificial Sequence
  Synthetic
gcccgagaagccgacccccgtccccccccctaggaggaagcggacggtcgtgctttctgagtcgacggtttccag

SEQ ID NO: 122706 - DNA, 75 bp, Artificial Sequence
  Synthetic
atgagacagatgtcttcctattgaacagcactcgaccaccgctggggtcatggttcggctgcacgtggatgaact

SEQ ID NO: 122707 - DNA, 75 bp, Artificial Sequence
  Synthetic
agggggggaggcatttgatcttctgccactctaaaaagaagtgcgacgagcttgccaaacagctcacaacgctcg

SEQ ID NO: 122708 - DNA, 75 bp, Artificial Sequence
  Synthetic
tattttccttgagggtcattggggcgttatcggtgctatactgtattacagtatggtaggcaactgggccaaggt

SEQ ID NO: 122709 - DNA, 75 bp, Artificial Sequence
  Synthetic
gttatcggtgctatactgtattacagtatggtaggcaactgggccaaggttcttgctgtccttctcctctttgcg

SEQ ID NO: 122710 - DNA, 75 bp, Artificial Sequence
  Synthetic
tctggcggggttatccactttacccggcaatccggctgtagctgccctcatgtctttctcggcctcattgacgag

SEQ ID NO: 122711 - DNA, 75 bp, Artificial Sequence
  Synthetic
ctactgatgctttaatgactggctatacaggcaacttcgacagcgtgatagactgtaatgtgtctgttacgcagg

SEQ ID NO: 122712 - DNA, 75 bp, Artificial Sequence
  Synthetic
ggcctagcaggcgcggccataggcggcgtaggcctgggcaaggtcatcgtagacatcttagccggctatggagca

SEQ ID NO: 122713 - DNA, 75 bp, Artificial Sequence
  Synthetic
ggcctagcaggcgcggccataggcggcgttggcctgggcaaggtcatcgtagacatcttagccggctatggagca

SEQ ID NO: 122714 - DNA, 75 bp, Artificial Sequence
  Synthetic
ggcctagcaggcgcggccataggcggcgtcggcctgggcaaggtcatcgtagacatcttagccggctatggagca

SEQ ID NO: 122715 - DNA, 75 bp, Artificial Sequence
  Synthetic
ggcctagcaggcgcggccataggcggcgtgggcctgggcaaggtcatcgtagacatcttagccggctatggagca

SEQ ID NO: 122716 - DNA, 75 bp, Artificial Sequence
  Synthetic
gtgcagctgaggaaaccaagctgccaattagccccttgagcaactcgttgctgcgccatcacaacatggtgtacg

SEQ ID NO: 122717 - DNA, 75 bp, Artificial Sequence
  Synthetic
gcgtaggcctgggcaaggtcatcgtagacatcttagccggctatggagcaggcgtatccggggctctcgtagcat

SEQ ID NO: 122718 - DNA, 75 bp, Artificial Sequence
  Synthetic
gcgtaggcctgggcaaggtcatcgtagacatcttagccggctatggagcaggcgtatccggggctctcgtagctt

SEQ ID NO: 122719 - DNA, 75 bp, Artificial Sequence
  Synthetic
gcgtaggcctgggcaaggtcatcgtagacatcttagccggctatggagcaggcgtatccggggctctcgtagcct

SEQ ID NO: 122720 - DNA, 75 bp, Artificial Sequence
  Synthetic
gcgtaggcctgggcaaggtcatcgtagacatcttagccggctatggagcaggcgtatccggggctctcgtagcgt

SEQ ID NO: 122721 - DNA, 75 bp, Artificial Sequence
  Synthetic
gcgtaggcctgggcaaggtcatcgtagacatcttagccggctatggagcaggcgtatccggggctctcgttgcat

SEQ ID NO: 122722 - DNA, 75 bp, Artificial Sequence
  Synthetic
gcgtaggcctgggcaaggtcatcgtagacatcttagccggctatggagcaggcgtatccggggctctcgttgctt

SEQ ID NO: 122723 - DNA, 75 bp, Artificial Sequence
  Synthetic
gcgtaggcctgggcaaggtcatcgtagacatcttagccggctatggagcaggcgtatccggggctctcgttgcct

SEQ ID NO: 122724 - DNA, 75 bp, Artificial Sequence
  Synthetic
gcgtaggcctgggcaaggtcatcgtagacatcttagccggctatggagcaggcgtatccggggctctcgttgcgt

SEQ ID NO: 122725 - DNA, 75 bp, Artificial Sequence
  Synthetic
gcgtaggcctgggcaaggtcatcgtagacatcttagccggctatggagcaggcgtatccggggctctcgtcgcat

SEQ ID NO: 122726 - DNA, 75 bp, Artificial Sequence
  Synthetic
gcgtaggcctgggcaaggtcatcgtagacatcttagccggctatggagcaggcgtatccggggctctcgtcgctt

SEQ ID NO: 122727 - DNA, 75 bp, Artificial Sequence
  Synthetic
gcgtaggcctgggcaaggtcatcgtagacatcttagccggctatggagcaggcgtatccggggctctcgtcgcct

SEQ ID NO: 122728 - DNA, 75 bp, Artificial Sequence
  Synthetic
gcgtaggcctgggcaaggtcatcgtagacatcttagccggctatggagcaggcgtatccggggctctcgtcgcgt

SEQ ID NO: 122729 - DNA, 75 bp, Artificial Sequence
  Synthetic
gcgtaggcctgggcaaggtcatcgtagacatcttagccggctatggagcaggcgtatccggggctctcgtggcat

SEQ ID NO: 122730 - DNA, 75 bp, Artificial Sequence
  Synthetic
gcgtaggcctgggcaaggtcatcgtagacatcttagccggctatggagcaggcgtatccggggctctcgtggctt

SEQ ID NO: 122731 - DNA, 75 bp, Artificial Sequence
  Synthetic
gcgtaggcctgggcaaggtcatcgtagacatcttagccggctatggagcaggcgtatccggggctctcgtggcct

SEQ ID NO: 122732 - DNA, 75 bp, Artificial Sequence
  Synthetic
gcgtaggcctgggcaaggtcatcgtagacatcttagccggctatggagcaggcgtatccggggctctcgtggcgt

SEQ ID NO: 122733 - DNA, 75 bp, Artificial Sequence
  Synthetic
gcgttggcctgggcaaggtcatcgtagacatcttagccggctatggagcaggcgtatccggggctctcgtagcat

SEQ ID NO: 122734 - DNA, 75 bp, Artificial Sequence
  Synthetic
gcgttggcctgggcaaggtcatcgtagacatcttagccggctatggagcaggcgtatccggggctctcgtagctt

SEQ ID NO: 122735 - DNA, 75 bp, Artificial Sequence
  Synthetic
gcgttggcctgggcaaggtcatcgtagacatcttagccggctatggagcaggcgtatccggggctctcgtagcct

SEQ ID NO: 122736 - DNA, 75 bp, Artificial Sequence
  Synthetic
gcgttggcctgggcaaggtcatcgtagacatcttagccggctatggagcaggcgtatccggggctctcgtagcgt

SEQ ID NO: 122737 - DNA, 75 bp, Artificial Sequence
  Synthetic
gcgttggcctgggcaaggtcatcgtagacatcttagccggctatggagcaggcgtatccggggctctcgttgcat

SEQ ID NO: 122738 - DNA, 75 bp, Artificial Sequence
  Synthetic
gcgttggcctgggcaaggtcatcgtagacatcttagccggctatggagcaggcgtatccggggctctcgttgctt

SEQ ID NO: 122739 - DNA, 75 bp, Artificial Sequence
  Synthetic
gcgttggcctgggcaaggtcatcgtagacatcttagccggctatggagcaggcgtatccggggctctcgttgcct

SEQ ID NO: 122740 - DNA, 75 bp, Artificial Sequence
  Synthetic
gcgttggcctgggcaaggtcatcgtagacatcttagccggctatggagcaggcgtatccggggctctcgttgcgt

SEQ ID NO: 122741 - DNA, 75 bp, Artificial Sequence
  Synthetic
gcgttggcctgggcaaggtcatcgtagacatcttagccggctatggagcaggcgtatccggggctctcgtcgcat

SEQ ID NO: 122742 - DNA, 75 bp, Artificial Sequence
  Synthetic
gcgttggcctgggcaaggtcatcgtagacatcttagccggctatggagcaggcgtatccggggctctcgtcgctt

SEQ ID NO: 122743 - DNA, 75 bp, Artificial Sequence
  Synthetic
gcgttggcctgggcaaggtcatcgtagacatcttagccggctatggagcaggcgtatccggggctctcgtcgcct

SEQ ID NO: 122744 - DNA, 75 bp, Artificial Sequence
  Synthetic
gcgttggcctgggcaaggtcatcgtagacatcttagccggctatggagcaggcgtatccggggctctcgtcgcgt

SEQ ID NO: 122745 - DNA, 75 bp, Artificial Sequence
  Synthetic
gcgttggcctgggcaaggtcatcgtagacatcttagccggctatggagcaggcgtatccggggctctcgtggcat

SEQ ID NO: 122746 - DNA, 75 bp, Artificial Sequence
  Synthetic
gcgttggcctgggcaaggtcatcgtagacatcttagccggctatggagcaggcgtatccggggctctcgtggctt

SEQ ID NO: 122747 - DNA, 75 bp, Artificial Sequence
  Synthetic
gcgttggcctgggcaaggtcatcgtagacatcttagccggctatggagcaggcgtatccggggctctcgtggcct

SEQ ID NO: 122748 - DNA, 75 bp, Artificial Sequence
  Synthetic
gcgttggcctgggcaaggtcatcgtagacatcttagccggctatggagcaggcgtatccggggctctcgtggcgt

SEQ ID NO: 122749 - DNA, 75 bp, Artificial Sequence
  Synthetic
gcgtcggcctgggcaaggtcatcgtagacatcttagccggctatggagcaggcgtatccggggctctcgtagcat

SEQ ID NO: 122750 - DNA, 75 bp, Artificial Sequence
  Synthetic
gcgtcggcctgggcaaggtcatcgtagacatcttagccggctatggagcaggcgtatccggggctctcgtagctt

SEQ ID NO: 122751 - DNA, 75 bp, Artificial Sequence
  Synthetic
gcgtcggcctgggcaaggtcatcgtagacatcttagccggctatggagcaggcgtatccggggctctcgtagcct

SEQ ID NO: 122752 - DNA, 75 bp, Artificial Sequence
  Synthetic
gcgtcggcctgggcaaggtcatcgtagacatcttagccggctatggagcaggcgtatccggggctctcgtagcgt

SEQ ID NO: 122753 - DNA, 75 bp, Artificial Sequence
  Synthetic
gcgtcggcctgggcaaggtcatcgtagacatcttagccggctatggagcaggcgtatccggggctctcgttgcat

SEQ ID NO: 122754 - DNA, 75 bp, Artificial Sequence
  Synthetic
gcgtcggcctgggcaaggtcatcgtagacatcttagccggctatggagcaggcgtatccggggctctcgttgctt

SEQ ID NO: 122755 - DNA, 75 bp, Artificial Sequence
  Synthetic
gcgtcggcctgggcaaggtcatcgtagacatcttagccggctatggagcaggcgtatccggggctctcgttgcct

SEQ ID NO: 122756 - DNA, 75 bp, Artificial Sequence
  Synthetic
gcgtcggcctgggcaaggtcatcgtagacatcttagccggctatggagcaggcgtatccggggctctcgttgcgt

SEQ ID NO: 122757 - DNA, 75 bp, Artificial Sequence
  Synthetic
gcgtcggcctgggcaaggtcatcgtagacatcttagccggctatggagcaggcgtatccggggctctcgtcgcat

SEQ ID NO: 122758 - DNA, 75 bp, Artificial Sequence
  Synthetic
gcgtcggcctgggcaaggtcatcgtagacatcttagccggctatggagcaggcgtatccggggctctcgtcgctt

SEQ ID NO: 122759 - DNA, 75 bp, Artificial Sequence
  Synthetic
gcgtcggcctgggcaaggtcatcgtagacatcttagccggctatggagcaggcgtatccggggctctcgtcgcct

SEQ ID NO: 122760 - DNA, 75 bp, Artificial Sequence
  Synthetic
gcgtcggcctgggcaaggtcatcgtagacatcttagccggctatggagcaggcgtatccggggctctcgtcgcgt

SEQ ID NO: 122761 - DNA, 75 bp, Artificial Sequence
  Synthetic
gcgtcggcctgggcaaggtcatcgtagacatcttagccggctatggagcaggcgtatccggggctctcgtggcat

SEQ ID NO: 122762 - DNA, 75 bp, Artificial Sequence
  Synthetic
gcgtcggcctgggcaaggtcatcgtagacatcttagccggctatggagcaggcgtatccggggctctcgtggctt

SEQ ID NO: 122763 - DNA, 75 bp, Artificial Sequence
  Synthetic
gcgtcggcctgggcaaggtcatcgtagacatcttagccggctatggagcaggcgtatccggggctctcgtggcct

SEQ ID NO: 122764 - DNA, 75 bp, Artificial Sequence
  Synthetic
gcgtcggcctgggcaaggtcatcgtagacatcttagccggctatggagcaggcgtatccggggctctcgtggcgt

SEQ ID NO: 122765 - DNA, 75 bp, Artificial Sequence
  Synthetic
gcgtgggcctgggcaaggtcatcgtagacatcttagccggctatggagcaggcgtatccggggctctcgtagcat

SEQ ID NO: 122766 - DNA, 75 bp, Artificial Sequence
  Synthetic
gcgtgggcctgggcaaggtcatcgtagacatcttagccggctatggagcaggcgtatccggggctctcgtagctt

SEQ ID NO: 122767 - DNA, 75 bp, Artificial Sequence
  Synthetic
gcgtgggcctgggcaaggtcatcgtagacatcttagccggctatggagcaggcgtatccggggctctcgtagcct

SEQ ID NO: 122768 - DNA, 75 bp, Artificial Sequence
  Synthetic
gcgtgggcctgggcaaggtcatcgtagacatcttagccggctatggagcaggcgtatccggggctctcgtagcgt

SEQ ID NO: 122769 - DNA, 75 bp, Artificial Sequence
  Synthetic
gcgtgggcctgggcaaggtcatcgtagacatcttagccggctatggagcaggcgtatccggggctctcgttgcat

SEQ ID NO: 122770 - DNA, 75 bp, Artificial Sequence
  Synthetic
gcgtgggcctgggcaaggtcatcgtagacatcttagccggctatggagcaggcgtatccggggctctcgttgctt

SEQ ID NO: 122771 - DNA, 75 bp, Artificial Sequence
  Synthetic
gcgtgggcctgggcaaggtcatcgtagacatcttagccggctatggagcaggcgtatccggggctctcgttgcct

SEQ ID NO: 122772 - DNA, 75 bp, Artificial Sequence
  Synthetic
gcgtgggcctgggcaaggtcatcgtagacatcttagccggctatggagcaggcgtatccggggctctcgttgcgt

SEQ ID NO: 122773 - DNA, 75 bp, Artificial Sequence
  Synthetic
gcgtgggcctgggcaaggtcatcgtagacatcttagccggctatggagcaggcgtatccggggctctcgtcgcat

SEQ ID NO: 122774 - DNA, 75 bp, Artificial Sequence
  Synthetic
gcgtgggcctgggcaaggtcatcgtagacatcttagccggctatggagcaggcgtatccggggctctcgtcgctt

SEQ ID NO: 122775 - DNA, 75 bp, Artificial Sequence
  Synthetic
gcgtgggcctgggcaaggtcatcgtagacatcttagccggctatggagcaggcgtatccggggctctcgtcgcct

SEQ ID NO: 122776 - DNA, 75 bp, Artificial Sequence
  Synthetic
gcgtgggcctgggcaaggtcatcgtagacatcttagccggctatggagcaggcgtatccggggctctcgtcgcgt

SEQ ID NO: 122777 - DNA, 75 bp, Artificial Sequence
  Synthetic
gcgtgggcctgggcaaggtcatcgtagacatcttagccggctatggagcaggcgtatccggggctctcgtggcat

SEQ ID NO: 122778 - DNA, 75 bp, Artificial Sequence
  Synthetic
gcgtgggcctgggcaaggtcatcgtagacatcttagccggctatggagcaggcgtatccggggctctcgtggctt

SEQ ID NO: 122779 - DNA, 75 bp, Artificial Sequence
  Synthetic
gcgtgggcctgggcaaggtcatcgtagacatcttagccggctatggagcaggcgtatccggggctctcgtggcct

SEQ ID NO: 122780 - DNA, 75 bp, Artificial Sequence
  Synthetic
gcgtgggcctgggcaaggtcatcgtagacatcttagccggctatggagcaggcgtatccggggctctcgtggcgt

SEQ ID NO: 122781 - DNA, 75 bp, Artificial Sequence
  Synthetic
gaagcatggggtgtataggtacgtctcgctaggggaacgaccgtcgggcttgttcgacacagttgtcctatgcga

SEQ ID NO: 122782 - DNA, 75 bp, Artificial Sequence
  Synthetic
ccacgacctccaggtctgccactatgcggcagaagaaggttaccttcgaccgactccaggtggtcgacagtcatt

SEQ ID NO: 122783 - DNA, 75 bp, Artificial Sequence
  Synthetic
cacatatgccaatgtgagtggatcatctgatgataggccatattgctggcactatgcgccccggccctgtaccgt

SEQ ID NO: 122784 - DNA, 75 bp, Artificial Sequence
  Synthetic
tctgatgataggccatattgctggcactatgcgccccggccctgtaccgttgtcccagccagctcggtctgtggg

SEQ ID NO: 122785 - DNA, 75 bp, Artificial Sequence
  Synthetic
ccggcgtaggtctcgcaatctgggtaaggtcatcgataccctgacgtgcggcttcgccgacctcatgggatacat

SEQ ID NO: 122786 - DNA, 75 bp, Artificial Sequence
  Synthetic
gaccatcttgagttctgggagggagtgttcactggactaacccacattgacgcccacttcctatcccagacaaaa

SEQ ID NO: 122787 - DNA, 75 bp, Artificial Sequence
  Synthetic
caaatccaagtttggctacggggcaaaggacgttcggagtcattctagcaaggccgttaaccacatcaactccgt

SEQ ID NO: 122788 - DNA, 75 bp, Artificial Sequence
  Synthetic
tatgggcacgcccggattacaatcctccactgctagagtcctggaagaacccggactacgtccctccggtggtac

SEQ ID NO: 122789 - DNA, 75 bp, Artificial Sequence
  Synthetic
tgttgcaaagtgccaggcctcctcgtggcgcctggttcggatgcacatggatgaattccaccggatttgtcaaga

SEQ ID NO: 122790 - DNA, 75 bp, Artificial Sequence
  Synthetic
ggcgtcgccagggccctggcgcatggcgtcagggcactggaggacggaattaattacgcaacagggaatcttccc

SEQ ID NO: 122791 - DNA, 75 bp, Artificial Sequence
  Synthetic
ggcgtcgccagggccctggcgcatggcgtcagggctctggaggacggaattaattacgcaacagggaatcttccc

SEQ ID NO: 122792 - DNA, 75 bp, Artificial Sequence
  Synthetic
ggcgtcgccagggccctggcgcatggcgtcagggccctggaggacggaattaattacgcaacagggaatcttccc

SEQ ID NO: 122793 - DNA, 75 bp, Artificial Sequence
  Synthetic
ggcgtcgccagggccctggcgcatggcgtcagggcgctggaggacggaattaattacgcaacagggaatcttccc

SEQ ID NO: 122794 - DNA, 75 bp, Artificial Sequence
  Synthetic
ggcgtaggtcccgcaatttgggtaaggtcatcgataccctcacttgcggcctcgccgacctcttggggtacgtcc

SEQ ID NO: 122795 - DNA, 75 bp, Artificial Sequence
  Synthetic
tcatacggctcaagcccatgctcacggggccaacccccttgttgtacaggatagggccggtacaaaatgagatca

SEQ ID NO: 122796 - DNA, 75 bp, Artificial Sequence
  Synthetic
ccagcgcgtctaatcgtatatccggacctaggggtccgggtttgcgagaagagagcgctttatgaccccgtccga

SEQ ID NO: 122797 - DNA, 75 bp, Artificial Sequence
  Synthetic
tgcaacactgggccgcagccggtctcaaagacctaacagtagctactgaacctgtaatattcagtcccatggaaa

SEQ ID NO: 122798 - DNA, 75 bp, Artificial Sequence
  Synthetic
tgcaaagtgtgggtctgggccttggctcactccccgctgcttggtggactacccgtatcggttgtggcaataccc

SEQ ID NO: 122799 - DNA, 75 bp, Artificial Sequence
  Synthetic
tgcaaagtgtgggtctgggccttggctcactccccgctgcttggtggactacccgtatcggttgtggcattaccc

SEQ ID NO: 122800 - DNA, 75 bp, Artificial Sequence
  Synthetic
tgcaaagtgtgggtctgggccttggctcactccccgctgcttggtggactacccgtatcggttgtggcactaccc

SEQ ID NO: 122801 - DNA, 75 bp, Artificial Sequence
  Synthetic
tgcaaagtgtgggtctgggccttggctcactccccgctgcttggtggactacccgtatcggttgtggcagtaccc

SEQ ID NO: 122802 - DNA, 75 bp, Artificial Sequence
  Synthetic
caaatgactgccctaattccagcatagtgtatgagacacgccaccatatcatgcacctgccggggtgcgtaccct

SEQ ID NO: 122803 - DNA, 75 bp, Artificial Sequence
  Synthetic
ttgctctttctctatcttcctcttagccctattctcctgcttgaccgtcccgacatcggccctgacatatggtaa

SEQ ID NO: 122804 - DNA, 75 bp, Artificial Sequence
  Synthetic
tgctagtggggggggtccttgcagccttagcagcctactgcttgtcggtgggctgcgttgttatctgcggcagga

SEQ ID NO: 122805 - DNA, 75 bp, Artificial Sequence
  Synthetic
acgggtctatgaagatcgtgggcccccggacctgcagcaacgtgtggtttggcacctttcccatcaatgcgacca

SEQ ID NO: 122806 - DNA, 75 bp, Artificial Sequence
  Synthetic
tcgagcacaggttcaatgccgcttgtaattggactcgtggggagcggtgtgagctggatgaaagagacagaatag

SEQ ID NO: 122807 - DNA, 75 bp, Artificial Sequence
  Synthetic
tcgagcacaggttcaatgccgcttgtaattggactcgtggggagcggtgtgagctggatgatagagacagaatag

SEQ ID NO: 122808 - DNA, 75 bp, Artificial Sequence
  Synthetic
tcgagcacaggttcaatgccgcttgtaattggactcgtggggagcggtgtgagctggatgacagagacagaatag

SEQ ID NO: 122809 - DNA, 75 bp, Artificial Sequence
  Synthetic
tcgagcacaggttcaatgccgcttgtaattggactcgtggggagcggtgtgagctggatgagagagacagaatag

SEQ ID NO: 122810 - DNA, 75 bp, Artificial Sequence
  Synthetic
cgctaagctactgtcccggggggggagggccgccacttgtggcaggtacctcttcaactgggcggtaaaaaccaa

SEQ ID NO: 122811 - DNA, 75 bp, Artificial Sequence
  Synthetic
tgaggctcgcaaggtcataaccgccctcacagagagactctatgtgggcggccccatgtataacagcaaggggga

SEQ ID NO: 122812 - DNA, 75 bp, Artificial Sequence
  Synthetic
agacctgatggtgggcgcggccaccctctgctcagccctctacatcggagatctgtgtgggggtgtcttcttagt

SEQ ID NO: 122813 - DNA, 75 bp, Artificial Sequence
  Synthetic
tgaggctcaggccattgctgagcagttcagacagaaggtcctcggccttctccagacctcagccaagcaggcgga

SEQ ID NO: 122814 - DNA, 75 bp, Artificial Sequence
  Synthetic
tcctttacaaccacgcctgcgctatcgactggcctaatccatctacaccagaatgttgtggacgtgcagtacctc

SEQ ID NO: 122815 - DNA, 75 bp, Artificial Sequence
  Synthetic
gtgcgtgttgggaataaatctcactgctggtatcccgccacgcccacgttggctattcctaacgccacagtcccc

SEQ ID NO: 122816 - DNA, 75 bp, Artificial Sequence
  Synthetic
gcgagcggggtttttaccaccagcttcggaaacacactgacgtgcttccttaaagcctcagccgccatcagggcg

SEQ ID NO: 122817 - DNA, 75 bp, Artificial Sequence
  Synthetic
agacatatatcacagcctgtctcgtgcccgaccccgctggtttatgtggtgcctactcctactttctgtaggggt

SEQ ID NO: 122818 - DNA, 75 bp, Artificial Sequence
  Synthetic
ggcaaaagcacttgtggaacttcgtcagcggcatacagtacttagccggcttgtcaacgttgccgggcaacccag

SEQ ID NO: 122819 - DNA, 75 bp, Artificial Sequence
  Synthetic
gatatgatgatgaattggagccctaccaccacgttggttttggcccagttcatgcggattccctccaccctaggc

SEQ ID NO: 122820 - DNA, 75 bp, Artificial Sequence
  Synthetic
gccagctctttacattcagaccccgacatcaccagacggttcaggactgtaattgctccatctatgcaggacacg

SEQ ID NO: 122821 - DNA, 75 bp, Artificial Sequence
  Synthetic
cagatgtcttcgtggtaacatcaatgctgacagacccagatcacatcacagcagaggcggctaggcggcgcctcg

SEQ ID NO: 122822 - DNA, 75 bp, Artificial Sequence
  Synthetic
cgggggtcgagggaaccaccgtggtcacgggtggctcagcaggccacagtaccaccgggctcgttcatcttttcg

SEQ ID NO: 122823 - DNA, 75 bp, Artificial Sequence
  Synthetic
gtccggggcagggctatccccgggcttacatatgctttgcttcaattgtggccgcttttgcttttgctgttgtgc

SEQ ID NO: 122824 - DNA, 75 bp, Artificial Sequence
  Synthetic
actagccacgccgacagcctctaccagctttgtaataagcggtttagcaggcgcagcagtgggaagtattgggct

SEQ ID NO: 122825 - DNA, 75 bp, Artificial Sequence
  Synthetic
catagtcttggaggctcactggggcgtcctgggcgccgtgctatattatagtatggttgccaactgggccaaggt

SEQ ID NO: 122826 - DNA, 75 bp, Artificial Sequence
  Synthetic
gagcacttgttgggtttaagatcatgtgcggtgagaccccgtctgctgaagacatggtcaacttgctccctgctc

SEQ ID NO: 122827 - DNA, 75 bp, Artificial Sequence
  Synthetic
catagccggcctgttttaccaccgcaggtttaatagctccggatgccctgagaggttagcctcgtgcaggagtct

SEQ ID NO: 122828 - DNA, 75 bp, Artificial Sequence
  Synthetic
agagtctgctcataagctcgctttggtggatccaatatttcatcgcacgtgctgaggcccagctacatgtttgga

SEQ ID NO: 122829 - DNA, 75 bp, Artificial Sequence
  Synthetic
ggcgcccggcagaatttgcagctgatcaacacaaacgggagctggcacatcaacagaactgctctcaactgcaac

SEQ ID NO: 122830 - DNA, 75 bp, Artificial Sequence
  Synthetic
tggagcacagatcaccggacatgtcaaaaacggttccatgaggatcgttgggcctaagacctgtagcaacacgtg

SEQ ID NO: 122831 - DNA, 75 bp, Artificial Sequence
  Synthetic
ccataggccccgacggcctgcgtttccggccgctcttcctgtgtgggcccgtccggactacaaccccccactctt

SEQ ID NO: 122832 - DNA, 75 bp, Artificial Sequence
  Synthetic
cacgtgtctccaacgcactacattcctgaaactgacacctctcagaaaatcaccaacatactcagttccttaacc

SEQ ID NO: 122833 - DNA, 75 bp, Artificial Sequence
  Synthetic
gggatagtacccggatcgaccgtgtgtgggcccgtgtactgtttcacacccagccccgtggtggtcggtactact

SEQ ID NO: 122834 - DNA, 75 bp, Artificial Sequence
  Synthetic
cctgcttggccctctctatctactccagtacagcttgctccgaacgccttattttgtgcgcgcacacatcctttt

SEQ ID NO: 122835 - DNA, 75 bp, Artificial Sequence
  Synthetic
ccctaccacctacaccatcacctcctgtccctcccccaaggaggaagaagctgatacggctcgatgagtcaagag

SEQ ID NO: 122836 - DNA, 75 bp, Artificial Sequence
  Synthetic
acttccagcaaggctggggccctcttgagtaccacaacgtgagcgaaccagccgaccagagaccgtattgctggc

SEQ ID NO: 122837 - DNA, 75 bp, Artificial Sequence
  Synthetic
caagtctggtctttactacctgaccaacgactgccctaacagcagcatcgtgtatgaggcgccaactgttataat

SEQ ID NO: 122838 - DNA, 75 bp, Artificial Sequence
  Synthetic
tggtgttatcagacttcaagtgttggctcaagacaaaactcgtcccggcgctgcctggtgtccccttcctctcgt

SEQ ID NO: 122839 - DNA, 75 bp, Artificial Sequence
  Synthetic
cgtggatgaatggcactgggtttgtgaagacatgcggggcccccgcctgcttagtgacaaccagcaaccgcacct

SEQ ID NO: 122840 - DNA, 75 bp, Artificial Sequence
  Synthetic
ctaacccccctttctgactgggcgtgtgacggcttgcgagatcttgccgtcgctgttgaacctgtcatcttctcg

SEQ ID NO: 122841 - DNA, 75 bp, Artificial Sequence
  Synthetic
ctcactgggttccgcaaacatgtggacctcatggtgggcgcagccgctttctgttcagctatgtacgtgggtgac

SEQ ID NO: 122842 - DNA, 75 bp, Artificial Sequence
  Synthetic
ggctgtcccgaacgcgtcaacgcctctcactgggttccgcaaacatgtggacctcatggtgggcgcagccgcttt

SEQ ID NO: 122843 - DNA, 75 bp, Artificial Sequence
  Synthetic
gaagggcttgccaacctacaattggggggataatgacaccgatgtctttatactgagtagcagccgacccccccg

SEQ ID NO: 122844 - DNA, 75 bp, Artificial Sequence
  Synthetic
gaagggcttgccaacctacaattggggggataatgacaccgatgtctttatactgagttgcagccgacccccccg

SEQ ID NO: 122845 - DNA, 75 bp, Artificial Sequence
  Synthetic
gaagggcttgccaacctacaattggggggataatgacaccgatgtctttatactgagtcgcagccgacccccccg

SEQ ID NO: 122846 - DNA, 75 bp, Artificial Sequence
  Synthetic
gaagggcttgccaacctacaattggggggataatgacaccgatgtctttatactgagtggcagccgacccccccg

SEQ ID NO: 122847 - DNA, 75 bp, Artificial Sequence
  Synthetic
ggggcgctgatactgttgcatgcggggacatcctcgccggcttaccagtgtctgcccggaaaggcaacctcgtct

SEQ ID NO: 122848 - DNA, 75 bp, Artificial Sequence
  Synthetic
gaaggtgtccggctccagttggtgcagcaatatctggcacggtactttccccatcaatgcaaccacgactggtcc

SEQ ID NO: 122849 - DNA, 75 bp, Artificial Sequence
  Synthetic
gatggtgtccggctccagttggtgcagcaatatctggcacggtactttccccatcaatgcaaccacgactggtcc

SEQ ID NO: 122850 - DNA, 75 bp, Artificial Sequence
  Synthetic
gacggtgtccggctccagttggtgcagcaatatctggcacggtactttccccatcaatgcaaccacgactggtcc

SEQ ID NO: 122851 - DNA, 75 bp, Artificial Sequence
  Synthetic
gagggtgtccggctccagttggtgcagcaatatctggcacggtactttccccatcaatgcaaccacgactggtcc

SEQ ID NO: 122852 - DNA, 75 bp, Artificial Sequence
  Synthetic
ataccgactgtggcactacccgtgtaccgtcaacttcactgtcttcaaggtcaggatgtacgtcggggggatcga

SEQ ID NO: 122853 - DNA, 75 bp, Artificial Sequence
  Synthetic
aatcacttgctctgtccaacagactgctttcggaagcatccgggggctacttacagcaagtgtgggtccgggccc

SEQ ID NO: 122854 - DNA, 75 bp, Artificial Sequence
  Synthetic
ttactgggcatcgcatggcgtgggatatgatgatgaattggtctccgaccgcgactatcatcgtgtcctacgtca

SEQ ID NO: 122855 - DNA, 75 bp, Artificial Sequence
  Synthetic
gaaacatcagatgtggactcgtatagctccatgccaccccttgagggtgagccaggagaccctgacctaagctca

SEQ ID NO: 122856 - DNA, 75 bp, Artificial Sequence
  Synthetic
ccagaggcctcttaggcaccattgttaccagccttacaggccgcgataagaacgtggtagaaggcgagatccagg

SEQ ID NO: 122857 - DNA, 75 bp, Artificial Sequence
  Synthetic
caacggcctattacggcaccacaacctggtgtactccaccacctcccgcagcgcccctttgcgccagaaaaaagt

SEQ ID NO: 122858 - DNA, 75 bp, Artificial Sequence
  Synthetic
aagggtaggggatagtcacttcgtggtgggcgccactggggacaacctgaaatgcccatgccaggtccccgctcc

SEQ ID NO: 122859 - DNA, 75 bp, Artificial Sequence
  Synthetic
caatggcaggtgctcccctgctcctttacaaccctcccggccttgtcgactggactaatccatcttcatcagaac

SEQ ID NO: 122860 - DNA, 75 bp, Artificial Sequence
  Synthetic
gcatagagcataggttcgaagctgcctgcaactggactaggggagagcgctgtgagctcgatgacagagacagga

SEQ ID NO: 122861 - DNA, 75 bp, Artificial Sequence
  Synthetic
gcatagagcataggttcgaagctgcctgcaactggactaggggagagcgctgtgagctcgatgacagtgacagga

SEQ ID NO: 122862 - DNA, 75 bp, Artificial Sequence
  Synthetic
gcatagagcataggttcgaagctgcctgcaactggactaggggagagcgctgtgagctcgatgacagcgacagga

SEQ ID NO: 122863 - DNA, 75 bp, Artificial Sequence
  Synthetic
gcatagagcataggttcgaagctgcctgcaactggactaggggagagcgctgtgagctcgatgacagggacagga

SEQ ID NO: 122864 - DNA, 75 bp, Artificial Sequence
  Synthetic
catcggcatccttctcctattcgcaggggtggaggcgaaaacataagccgttggcgccgccaccggcagaactct

SEQ ID NO: 122865 - DNA, 75 bp, Artificial Sequence
  Synthetic
catcggcatccttctcctattcgcaggggtggaggcgaaaacatatgccgttggcgccgccaccggcagaactct

SEQ ID NO: 122866 - DNA, 75 bp, Artificial Sequence
  Synthetic
catcggcatccttctcctattcgcaggggtggaggcgaaaacatacgccgttggcgccgccaccggcagaactct

SEQ ID NO: 122867 - DNA, 75 bp, Artificial Sequence
  Synthetic
catcggcatccttctcctattcgcaggggtggaggcgaaaacataggccgttggcgccgccaccggcagaactct

SEQ ID NO: 122868 - DNA, 75 bp, Artificial Sequence
  Synthetic
ttgtttccaccgccacgcagtccttccttgctactgctgtcaatggggttctttggacagtttaccatggtgctg

SEQ ID NO: 122869 - DNA, 75 bp, Artificial Sequence
  Synthetic
acctacaccatggggtcccaactcccgtgcgagcctgaaccggacgtcgtggtcgtgacatccatgttgaccgac

SEQ ID NO: 122870 - DNA, 75 bp, Artificial Sequence
  Synthetic
ccaggatctgtgcgtgcctttggatgatgatgcttgtagcacaggttgaggcagcgatggccaacctaatcaaca

SEQ ID NO: 122871 - DNA, 75 bp, Artificial Sequence
  Synthetic
ccagaacatagtggatgtccagtacctctacggagtgtccacgaacattatatcgtgggcggtaaagtgggagta

SEQ ID NO: 122872 - DNA, 75 bp, Artificial Sequence
  Synthetic
ccagaacatagtggatgtccagtacctctacggagtgtccacgaacattatatcgtgggcggttaagtgggagta

SEQ ID NO: 122873 - DNA, 75 bp, Artificial Sequence
  Synthetic
ccagaacatagtggatgtccagtacctctacggagtgtccacgaacattatatcgtgggcggtcaagtgggagta

SEQ ID NO: 122874 - DNA, 75 bp, Artificial Sequence
  Synthetic
ccagaacatagtggatgtccagtacctctacggagtgtccacgaacattatatcgtgggcggtgaagtgggagta

SEQ ID NO: 122875 - DNA, 75 bp, Artificial Sequence
  Synthetic
aatgacagcttaaatacaggtttcattagtgccctgttttatgcccacaagttcaactcctcagggtgtccggcc

SEQ ID NO: 122876 - DNA, 75 bp, Artificial Sequence
  Synthetic
gacggttgtcctgacagaatccaccgtgtcttctgccttggcggagctcgccacaaagacctttggcagctccga

SEQ ID NO: 122877 - DNA, 75 bp, Artificial Sequence
  Synthetic
ggtcgtgacatccatgttgaccgacccgtcacatgtgactgctgagaccgcggcacggcgcctgaggcgcgggtc

SEQ ID NO: 122878 - DNA, 75 bp, Artificial Sequence
  Synthetic
ctatgcgacttgcagcatgtggccgttgttcttcctgcttctcgctttgcctgaaagggcatatgcgtttgacgg

SEQ ID NO: 122879 - DNA, 75 bp, Artificial Sequence
  Synthetic
ataacactcaatgcggtatccgccgctggttctcatgggttgttctggggcttgctagtcatctgttgcgcttgg

SEQ ID NO: 122880 - DNA, 75 bp, Artificial Sequence
  Synthetic
ggcactacccaccaagaccatgcggggtggtgccggcctcacaagtgtgcggccccgtttattgctttacaccaa

SEQ ID NO: 122881 - DNA, 75 bp, Artificial Sequence
  Synthetic
tctaccgctcgctctccgtccttttcagacaacacatcaccccccgctgtgccgcagacgtaccaggtggggtac

SEQ ID NO: 122882 - DNA, 75 bp, Artificial Sequence
  Synthetic
tctaccgctcgctctccgtccttttcagacaacacatctccccccgctgtgccgcagacgtaccaggtggggtac

SEQ ID NO: 122883 - DNA, 75 bp, Artificial Sequence
  Synthetic
tctaccgctcgctctccgtccttttcagacaacacatccccccccgctgtgccgcagacgtaccaggtggggtac

SEQ ID NO: 122884 - DNA, 75 bp, Artificial Sequence
  Synthetic
tctaccgctcgctctccgtccttttcagacaacacatcgccccccgctgtgccgcagacgtaccaggtggggtac

SEQ ID NO: 122885 - DNA, 75 bp, Artificial Sequence
  Synthetic
ctacaatacttcctcacccgggctgaggccttgctgcacgtctacgtgccgcctctggaagtcaggggtggccgg

SEQ ID NO: 122886 - DNA, 75 bp, Artificial Sequence
  Synthetic
tgcccgtatgggccaggcctgactacaatccgcccctcctggagtcttggaagtctccggactacgatcctccag

SEQ ID NO: 122887 - DNA, 75 bp, Artificial Sequence
  Synthetic
caagggtggttggtatgggtgcacctggatgaattccactgggtttgtaaaaacatgtggtgcacccccatgcaa

SEQ ID NO: 122888 - DNA, 75 bp, Artificial Sequence
  Synthetic
cgttggggtttggctcatatatgtcaacagctcatggcattgacccgaatgtgcgcactggtgtgaggaccatca

SEQ ID NO: 122889 - DNA, 75 bp, Artificial Sequence
  Synthetic
tggacaatgagcaggctgcctctgttgggggggccgttattctaataatcactgtcttcactctcaccccggctt

SEQ ID NO: 122890 - DNA, 75 bp, Artificial Sequence
  Synthetic
cctccctgctgcaaatcccttactttgtgagggctcacgctctcataaagatttgtggcctgctacggggagtga

SEQ ID NO: 122891 - DNA, 75 bp, Artificial Sequence
  Synthetic
gcttgctcagctggccgaaaagacctttccgcaacctgcgtcctcgacgacaggatacggatcaggccaggcagc

SEQ ID NO: 122892 - DNA, 75 bp, Artificial Sequence
  Synthetic
agggcgtgacgcagtgatattgctcacctgcctgctgcatccatcccttggctttgaggtcacgaagactcttct

SEQ ID NO: 122893 - DNA, 75 bp, Artificial Sequence
  Synthetic
ttcaacagaccccaccacagttttgggcatagggaccgtcttggaccaggcggagactgcaggagtaaggcttgt

SEQ ID NO: 122894 - DNA, 75 bp, Artificial Sequence
  Synthetic
tccgtgtggaaggacttgctggaagacactgagacaccaattgacaccaccatcatggcaaaaaatgaggttttc

SEQ ID NO: 122895 - DNA, 75 bp, Artificial Sequence
  Synthetic
tggcctcagggagctagcggtagctacagagccggtcatattcacacctatggagaggaaggtgatagtctgggg

SEQ ID NO: 122896 - DNA, 75 bp, Artificial Sequence
  Synthetic
cctgatcttagttcaggatcatggtccacggttagtgaagagggcgacagcgtagtatgctgttcgtactcctat

SEQ ID NO: 122897 - DNA, 75 bp, Artificial Sequence
  Synthetic
gagcggataacatcttgctccgcaaacgtctccgtagcccatgaccaaaatggacgtaggtactactacctcaca

SEQ ID NO: 122898 - DNA, 75 bp, Artificial Sequence
  Synthetic
aaggcaatcccacttgaattcatcaaggggggtaggcacctaatcttttgccattccaagaagaagtgcgatgag

SEQ ID NO: 122899 - DNA, 75 bp, Artificial Sequence
  Synthetic
ttgattacccatacaggctctggcactacccctgcactgtcaacttcaccatcttcaaggttaggatgtatgtag

SEQ ID NO: 122900 - DNA, 75 bp, Artificial Sequence
  Synthetic
aacattgccggcggcaagtacgtacaggctgtgttattaaaagttggcgcttggacaggcacttacctgtacaat

SEQ ID NO: 122901 - DNA, 75 bp, Artificial Sequence
  Synthetic
ccctgcaaccttgaggatcgtgacagggttgagatgagcccgctcttgttttctacaactgagctgtctattctc

SEQ ID NO: 122902 - DNA, 75 bp, Artificial Sequence
  Synthetic
gcagggtggagactccttgcccccatcaccgcatacgcgcaacagactcggggtctactaggtaccatcgtgacc

SEQ ID NO: 122903 - DNA, 75 bp, Artificial Sequence
  Synthetic
actgcgccagaagaaggtgacttttgaccgagtccagcttgtggaccaacactactatgacacattgaaggagat

SEQ ID NO: 122904 - DNA, 75 bp, Artificial Sequence
  Synthetic
catggggtgcagacaccgctgcttgcggggacattttggcagggttgcctgtgtcggctaggaaggggaacctca

SEQ ID NO: 122905 - DNA, 75 bp, Artificial Sequence
  Synthetic
ctaccgacgcccttatgactggttacacgggcgattttgactccgtgatagactgtaatgtttctgtaacacagg

SEQ ID NO: 122906 - DNA, 75 bp, Artificial Sequence
  Synthetic
tctgggtccgcatggttctcatgacacatttcttcggaatgctccagtcccaagaaacactccatcaagcactcg

SEQ ID NO: 122907 - DNA, 75 bp, Artificial Sequence
  Synthetic
ccaagccgaggccgcattagagaacttgatcgtactcaatgctgcctcggctgctagcatccacggatggggatg

SEQ ID NO: 122908 - DNA, 75 bp, Artificial Sequence
  Synthetic
cactttccactgggctgatacatctgcaccagaacatagtggacgttcagtacctctatggcatatctccatcaa

SEQ ID NO: 122909 - DNA, 75 bp, Artificial Sequence
  Synthetic
ggacggtgttccatggggccggcagcaaaaccatctgcggaccgaaaggtcctgtcaaccagatgtacaccaacg

SEQ ID NO: 122910 - DNA, 75 bp, Artificial Sequence
  Synthetic
tgtcaccagccttactggtagggacaggaacgaggtcgagggagagatacaagtggtctcaacggctactcagac

SEQ ID NO: 122911 - DNA, 75 bp, Artificial Sequence
  Synthetic
ccggcacggggactatagatatgtctcgcagggtgagcggccgtcaggcatttttgacaccgtcgttctatgtga

SEQ ID NO: 122912 - DNA, 75 bp, Artificial Sequence
  Synthetic
ttggcgctgccccaacgggcgttcgcgtacgatcaagagcaagcagcctctattggtgcagcagtgctggtggcc

SEQ ID NO: 122913 - DNA, 75 bp, Artificial Sequence
  Synthetic
cgatgtgatacctgtaaggaggaggggcgacacccggggggctttattgagccccagacccatctctgtgcttaa

SEQ ID NO: 122914 - DNA, 75 bp, Artificial Sequence
  Synthetic
acaaatgtagacaatgacttggtagggtggcccgcccccccgggatccaggtgtctaaccgcttgcacctgcggg

SEQ ID NO: 122915 - DNA, 75 bp, Artificial Sequence
  Synthetic
acaaatgttgacaatgacttggtagggtggcccgcccccccgggatccaggtgtctaaccgcttgcacctgcggg

SEQ ID NO: 122916 - DNA, 75 bp, Artificial Sequence
  Synthetic
acaaatgtcgacaatgacttggtagggtggcccgcccccccgggatccaggtgtctaaccgcttgcacctgcggg

SEQ ID NO: 122917 - DNA, 75 bp, Artificial Sequence
  Synthetic
acaaatgtggacaatgacttggtagggtggcccgcccccccgggatccaggtgtctaaccgcttgcacctgcggg

SEQ ID NO: 122918 - DNA, 75 bp, Artificial Sequence
  Synthetic
actaatgtagacaatgacttggtagggtggcccgcccccccgggatccaggtgtctaaccgcttgcacctgcggg

SEQ ID NO: 122919 - DNA, 75 bp, Artificial Sequence
  Synthetic
actaatgttgacaatgacttggtagggtggcccgcccccccgggatccaggtgtctaaccgcttgcacctgcggg

SEQ ID NO: 122920 - DNA, 75 bp, Artificial Sequence
  Synthetic
actaatgtcgacaatgacttggtagggtggcccgcccccccgggatccaggtgtctaaccgcttgcacctgcggg

SEQ ID NO: 122921 - DNA, 75 bp, Artificial Sequence
  Synthetic
actaatgtggacaatgacttggtagggtggcccgcccccccgggatccaggtgtctaaccgcttgcacctgcggg

SEQ ID NO: 122922 - DNA, 75 bp, Artificial Sequence
  Synthetic
accaatgtagacaatgacttggtagggtggcccgcccccccgggatccaggtgtctaaccgcttgcacctgcggg

SEQ ID NO: 122923 - DNA, 75 bp, Artificial Sequence
  Synthetic
accaatgttgacaatgacttggtagggtggcccgcccccccgggatccaggtgtctaaccgcttgcacctgcggg

SEQ ID NO: 122924 - DNA, 75 bp, Artificial Sequence
  Synthetic
accaatgtcgacaatgacttggtagggtggcccgcccccccgggatccaggtgtctaaccgcttgcacctgcggg

SEQ ID NO: 122925 - DNA, 75 bp, Artificial Sequence
  Synthetic
accaatgtggacaatgacttggtagggtggcccgcccccccgggatccaggtgtctaaccgcttgcacctgcggg

SEQ ID NO: 122926 - DNA, 75 bp, Artificial Sequence
  Synthetic
acgaatgtagacaatgacttggtagggtggcccgcccccccgggatccaggtgtctaaccgcttgcacctgcggg

SEQ ID NO: 122927 - DNA, 75 bp, Artificial Sequence
  Synthetic
acgaatgttgacaatgacttggtagggtggcccgcccccccgggatccaggtgtctaaccgcttgcacctgcggg

SEQ ID NO: 122928 - DNA, 75 bp, Artificial Sequence
  Synthetic
acgaatgtcgacaatgacttggtagggtggcccgcccccccgggatccaggtgtctaaccgcttgcacctgcggg

SEQ ID NO: 122929 - DNA, 75 bp, Artificial Sequence
  Synthetic
acgaatgtggacaatgacttggtagggtggcccgcccccccgggatccaggtgtctaaccgcttgcacctgcggg

SEQ ID NO: 122930 - DNA, 75 bp, Artificial Sequence
  Synthetic
aaagaaggcccttttcgatgtcacccgcaagctgccggcggctgttatgggagatgcatacggtttccaatattc

SEQ ID NO: 122931 - DNA, 75 bp, Artificial Sequence
  Synthetic
gatcatcttgagttctgggagggggttttcactggactgacccatatcgatgcccactttctctcccagacgaag

SEQ ID NO: 122932 - DNA, 75 bp, Artificial Sequence
  Synthetic
gctcgcgtggaggctttgctgcagatgtgggtcccaagcctctcggcccggggaggtcgtgatgccatcatccta

SEQ ID NO: 122933 - DNA, 75 bp, Artificial Sequence
  Synthetic
gctcgcgtggaggctttgctgcagatgtgggtcccatgcctctcggcccggggaggtcgtgatgccatcatccta

SEQ ID NO: 122934 - DNA, 75 bp, Artificial Sequence
  Synthetic
gctcgcgtggaggctttgctgcagatgtgggtcccacgcctctcggcccggggaggtcgtgatgccatcatccta

SEQ ID NO: 122935 - DNA, 75 bp, Artificial Sequence
  Synthetic
gctcgcgtggaggctttgctgcagatgtgggtcccaggcctctcggcccggggaggtcgtgatgccatcatccta

SEQ ID NO: 122936 - DNA, 75 bp, Artificial Sequence
  Synthetic
gctcgcgtggaggctttgctgcagttgtgggtcccaagcctctcggcccggggaggtcgtgatgccatcatccta

SEQ ID NO: 122937 - DNA, 75 bp, Artificial Sequence
  Synthetic
gctcgcgtggaggctttgctgcagttgtgggtcccatgcctctcggcccggggaggtcgtgatgccatcatccta

SEQ ID NO: 122938 - DNA, 75 bp, Artificial Sequence
  Synthetic
gctcgcgtggaggctttgctgcagttgtgggtcccacgcctctcggcccggggaggtcgtgatgccatcatccta

SEQ ID NO: 122939 - DNA, 75 bp, Artificial Sequence
  Synthetic
gctcgcgtggaggctttgctgcagttgtgggtcccaggcctctcggcccggggaggtcgtgatgccatcatccta

SEQ ID NO: 122940 - DNA, 75 bp, Artificial Sequence
  Synthetic
gctcgcgtggaggctttgctgcagctgtgggtcccaagcctctcggcccggggaggtcgtgatgccatcatccta

SEQ ID NO: 122941 - DNA, 75 bp, Artificial Sequence
  Synthetic
gctcgcgtggaggctttgctgcagctgtgggtcccatgcctctcggcccggggaggtcgtgatgccatcatccta

SEQ ID NO: 122942 - DNA, 75 bp, Artificial Sequence
  Synthetic
gctcgcgtggaggctttgctgcagctgtgggtcccacgcctctcggcccggggaggtcgtgatgccatcatccta

SEQ ID NO: 122943 - DNA, 75 bp, Artificial Sequence
  Synthetic
gctcgcgtggaggctttgctgcagctgtgggtcccaggcctctcggcccggggaggtcgtgatgccatcatccta

SEQ ID NO: 122944 - DNA, 75 bp, Artificial Sequence
  Synthetic
gctcgcgtggaggctttgctgcaggtgtgggtcccaagcctctcggcccggggaggtcgtgatgccatcatccta

SEQ ID NO: 122945 - DNA, 75 bp, Artificial Sequence
  Synthetic
gctcgcgtggaggctttgctgcaggtgtgggtcccatgcctctcggcccggggaggtcgtgatgccatcatccta

SEQ ID NO: 122946 - DNA, 75 bp, Artificial Sequence
  Synthetic
gctcgcgtggaggctttgctgcaggtgtgggtcccacgcctctcggcccggggaggtcgtgatgccatcatccta

SEQ ID NO: 122947 - DNA, 75 bp, Artificial Sequence
  Synthetic
gctcgcgtggaggctttgctgcaggtgtgggtcccaggcctctcggcccggggaggtcgtgatgccatcatccta

SEQ ID NO: 122948 - DNA, 75 bp, Artificial Sequence
  Synthetic
gtgcccgtcgagtccctcgagacgactatgcggtctccggtgttcacagacaactccacacctccggctgtccct

SEQ ID NO: 122949 - DNA, 75 bp, Artificial Sequence
  Synthetic
ccttgaaaggctcctcaggaggcccccttatgtgcccttcgggacacgtggtggggctgttccgtgctgccgtgt

SEQ ID NO: 122950 - DNA, 75 bp, Artificial Sequence
  Synthetic
gagcgagacatacgcgccgagcgagacatctacctgtcttgccagctggacccagaggctcaacaggccatcgag

SEQ ID NO: 122951 - DNA, 75 bp, Artificial Sequence
  Synthetic
tcatacggcttaagcctgtacttacagggcccacacccctgttgtataggctcgggtcggttcaaaatgaaatca

SEQ ID NO: 122952 - DNA, 75 bp, Artificial Sequence
  Synthetic
tgccgtactatgtgcgagcccacattttgttgcgggcttgcttgctagtgcgacgactctgcgctggcaagtacg

SEQ ID NO: 122953 - DNA, 75 bp, Artificial Sequence
  Synthetic
cccactacgacaatacgacgtcacgtcgacttgctcgttggggcggctgctctctgctccgctatgtacgtgggg

SEQ ID NO: 122954 - DNA, 75 bp, Artificial Sequence
  Synthetic
gctcgccatactcggtccgctcatggtgctccaggctggcatagttagaatgccgtactttgtacgcgctcaggg

SEQ ID NO: 122955 - DNA, 75 bp, Artificial Sequence
  Synthetic
gaagaacgggtccatgcgacttgcaggaccgcggacatgtgctaacatgtggcacggcacctttcccatcaatga

SEQ ID NO: 122956 - DNA, 75 bp, Artificial Sequence
  Synthetic
tcaacccctcggttgcggcgacgttaggctttggcgcctacatgtccaaggcgtacggcattgacccgaacatac

SEQ ID NO: 122957 - DNA, 75 bp, Artificial Sequence
  Synthetic
tgtgccccaaacataccaggtaggatacctccatgctccaactggaagcgggaagagcacaaaggtcccggctgc

SEQ ID NO: 122958 - DNA, 75 bp, Artificial Sequence
  Synthetic
tgtgccccaaacataccaggtaggttacctccatgctccaactggaagcgggaagagcacaaaggtcccggctgc

SEQ ID NO: 122959 - DNA, 75 bp, Artificial Sequence
  Synthetic
tgtgccccaaacataccaggtaggctacctccatgctccaactggaagcgggaagagcacaaaggtcccggctgc

SEQ ID NO: 122960 - DNA, 75 bp, Artificial Sequence
  Synthetic
tgtgccccaaacataccaggtagggtacctccatgctccaactggaagcgggaagagcacaaaggtcccggctgc

SEQ ID NO: 122961 - DNA, 75 bp, Artificial Sequence
  Synthetic
tgtgccccaaacataccaggttggatacctccatgctccaactggaagcgggaagagcacaaaggtcccggctgc

SEQ ID NO: 122962 - DNA, 75 bp, Artificial Sequence
  Synthetic
tgtgccccaaacataccaggttggttacctccatgctccaactggaagcgggaagagcacaaaggtcccggctgc

SEQ ID NO: 122963 - DNA, 75 bp, Artificial Sequence
  Synthetic
tgtgccccaaacataccaggttggctacctccatgctccaactggaagcgggaagagcacaaaggtcccggctgc

SEQ ID NO: 122964 - DNA, 75 bp, Artificial Sequence
  Synthetic
tgtgccccaaacataccaggttgggtacctccatgctccaactggaagcgggaagagcacaaaggtcccggctgc

SEQ ID NO: 122965 - DNA, 75 bp, Artificial Sequence
  Synthetic
tgtgccccaaacataccaggtcggatacctccatgctccaactggaagcgggaagagcacaaaggtcccggctgc

SEQ ID NO: 122966 - DNA, 75 bp, Artificial Sequence
  Synthetic
tgtgccccaaacataccaggtcggttacctccatgctccaactggaagcgggaagagcacaaaggtcccggctgc

SEQ ID NO: 122967 - DNA, 75 bp, Artificial Sequence
  Synthetic
tgtgccccaaacataccaggtcggctacctccatgctccaactggaagcgggaagagcacaaaggtcccggctgc

SEQ ID NO: 122968 - DNA, 75 bp, Artificial Sequence
  Synthetic
tgtgccccaaacataccaggtcgggtacctccatgctccaactggaagcgggaagagcacaaaggtcccggctgc

SEQ ID NO: 122969 - DNA, 75 bp, Artificial Sequence
  Synthetic
tgtgccccaaacataccaggtgggatacctccatgctccaactggaagcgggaagagcacaaaggtcccggctgc

SEQ ID NO: 122970 - DNA, 75 bp, Artificial Sequence
  Synthetic
tgtgccccaaacataccaggtgggttacctccatgctccaactggaagcgggaagagcacaaaggtcccggctgc

SEQ ID NO: 122971 - DNA, 75 bp, Artificial Sequence
  Synthetic
tgtgccccaaacataccaggtgggctacctccatgctccaactggaagcgggaagagcacaaaggtcccggctgc

SEQ ID NO: 122972 - DNA, 75 bp, Artificial Sequence
  Synthetic
tgtgccccaaacataccaggtggggtacctccatgctccaactggaagcgggaagagcacaaaggtcccggctgc

SEQ ID NO: 122973 - DNA, 75 bp, Artificial Sequence
  Synthetic
cctcgcagcttactgcttgtcagtgggctgcgtagtgatatgcggtagagtctctaccactggcaagcccgtgct

SEQ ID NO: 122974 - DNA, 75 bp, Artificial Sequence
  Synthetic
tgccgtcgctgtagagccggttgtgttctcgcctatggagaagaagatcatcacgtggggggcggacacagccgc

SEQ ID NO: 122975 - DNA, 75 bp, Artificial Sequence
  Synthetic
ccaactctgtggtcaacgcaggtgccgggcaagcggggtgcttcccactagcatgggcaacaccctgacgtgctt

SEQ ID NO: 122976 - DNA, 75 bp, Artificial Sequence
  Synthetic
ggctgcgtagtgatatgcggtagagtctctaccactggcaagcccgtgctaataccagatcgggaagtcatgtac

SEQ ID NO: 122977 - DNA, 75 bp, Artificial Sequence
  Synthetic
catcatttgtgacgagtgccactccacagattctacgacgatcctcggcataggcacggtcctagaccaagccga

SEQ ID NO: 122978 - DNA, 75 bp, Artificial Sequence
  Synthetic
aacatcaggacgggggttaggactatcaccactgggggtgctatcacctactcaacctatggtaaattcttggcc

SEQ ID NO: 122979 - DNA, 75 bp, Artificial Sequence
  Synthetic
tgttggtctgcggagacgatttggtggtcgtagctgagagcgcgggcgtcaacgaggatatcgccaaccttcgag

SEQ ID NO: 122980 - DNA, 75 bp, Artificial Sequence
  Synthetic
aagcccagttgtggtggggacgaccgatcggtccggcgtccctacgtatagctggggggagaatgagacggacgt

SEQ ID NO: 122981 - DNA, 75 bp, Artificial Sequence
  Synthetic
tccagactaccacaaaacaggcagaagatctcaagccagccgtccacgctgcttggccgaagcttgaacagtttt

SEQ ID NO: 122982 - DNA, 75 bp, Artificial Sequence
  Synthetic
aacagacccgcggtctgctggggacaattgttaccagcttgaccggcagggataagaatgaagttgagggcgaag

SEQ ID NO: 122983 - DNA, 75 bp, Artificial Sequence
  Synthetic
agccttgtccaccggcctcatccacctccaccaaaacattgtggacgtgcagtacttgtacggggtagggtcaag

SEQ ID NO: 122984 - DNA, 75 bp, Artificial Sequence
  Synthetic
ggggaggtacccttttatgggaaagccatccctctggaggttattaagggaggtagacatctcatcttctgccat

SEQ ID NO: 122985 - DNA, 75 bp, Artificial Sequence
  Synthetic
aagcccaaacggcaggtgtccggttgactgtactcgccaccgccactcccccgggctccgtcacggtgccgcacc

SEQ ID NO: 122986 - DNA, 75 bp, Artificial Sequence
  Synthetic
ccttcacggaggctatgaccaggtattcggcgacccccggagatccgcctagcccatcatatgacctggagctaa

SEQ ID NO: 122987 - DNA, 75 bp, Artificial Sequence
  Synthetic
ggagtactgtggactgtttaccatggtgccggctctaagaccttagccggcccaaagggtccagtgtgtcagatg

SEQ ID NO: 122988 - DNA, 75 bp, Artificial Sequence
  Synthetic
ctttcaaccttaccaggcaacccggcggttgcctccctaatgtctttttatgcttctctcaccagcccactatcg

SEQ ID NO: 122989 - DNA, 75 bp, Artificial Sequence
  Synthetic
ctttcaaccttaccaggcaacccggcggttgcctccctaatgtctttttttgcttctctcaccagcccactatcg

SEQ ID NO: 122990 - DNA, 75 bp, Artificial Sequence
  Synthetic
ctttcaaccttaccaggcaacccggcggttgcctccctaatgtctttttctgcttctctcaccagcccactatcg

SEQ ID NO: 122991 - DNA, 75 bp, Artificial Sequence
  Synthetic
ctttcaaccttaccaggcaacccggcggttgcctccctaatgtctttttgtgcttctctcaccagcccactatcg

SEQ ID NO: 122992 - DNA, 75 bp, Artificial Sequence
  Synthetic
cgggggacgtcgtggtttgctccacagacgccctcatgactgggttcactggggacttcgactccgtaatagact

SEQ ID NO: 122993 - DNA, 75 bp, Artificial Sequence
  Synthetic
ttgccattcaaagaagaaatgcgatgagctcgccaagcaacttacgtcgctcggcttgaacgccgtcgcatacta

SEQ ID NO: 122994 - DNA, 75 bp, Artificial Sequence
  Synthetic
gcgcggcggttgggagcattggccttgggagagtcttagtggacatcattgctggatacggtgcgggtgtgtcgg

SEQ ID NO: 122995 - DNA, 75 bp, Artificial Sequence
  Synthetic
ctcggaatgccgatgtcgtccccgccagacgcaggggcgacactcgtgcagggctcctaagtcccagacccttgt

SEQ ID NO: 122996 - DNA, 75 bp, Artificial Sequence
  Synthetic
ctcggaatgccgatgtcgtccccgccagacgcaggggcgacactcgtgcagggctccttagtcccagacccttgt

SEQ ID NO: 122997 - DNA, 75 bp, Artificial Sequence
  Synthetic
ctcggaatgccgatgtcgtccccgccagacgcaggggcgacactcgtgcagggctcctcagtcccagacccttgt

SEQ ID NO: 122998 - DNA, 75 bp, Artificial Sequence
  Synthetic
ctcggaatgccgatgtcgtccccgccagacgcaggggcgacactcgtgcagggctcctgagtcccagacccttgt

SEQ ID NO: 122999 - DNA, 75 bp, Artificial Sequence
  Synthetic
ggcgaactcaatcgcgtggcatcatgcctcagaaaacttggggctccccctttgagagcctggagacaccgagcc

SEQ ID NO: 123000 - DNA, 75 bp, Artificial Sequence
  Synthetic
tgacacctaggtgcttggttgactacccatataggctttggcactacccctgcactgtcaactttaccatcttca

SEQ ID NO: 123001 - DNA, 75 bp, Artificial Sequence
  Synthetic
gctggatacggtgcgggtgtgtcgggggcactcgtcgcttttaagatcatgagcggggagaccccggcatttgaa

SEQ ID NO: 123002 - DNA, 75 bp, Artificial Sequence
  Synthetic
aagggggcgcactggaagggggaggttgggaatttacaggtatgttaatcctggagaaagaccgtctggcacgtt

SEQ ID NO: 123003 - DNA, 75 bp, Artificial Sequence
  Synthetic
atcgactgcaatgttgccgtgacacaagtggtggacttcagcctagatcctactttcacaattgagacaaccaca

SEQ ID NO: 123004 - DNA, 75 bp, Artificial Sequence
  Synthetic
tttgtaccaggggagtcgctaaggcaatagacttcgtgcctgtagagaatatggagaccacgatgcggtccccag

SEQ ID NO: 123005 - DNA, 75 bp, Artificial Sequence
  Synthetic
cgccgcaacgttggtcccactgagggggctacccagtggatgaacaggctaatcgcttttgcctctaggggcaac

SEQ ID NO: 123006 - DNA, 75 bp, Artificial Sequence
  Synthetic
tcttctctgacaactcatcaccgcccgctgtaccacagacctatcaggttggatacctccatgctccaacgggca

SEQ ID NO: 123007 - DNA, 75 bp, Artificial Sequence
  Synthetic
ttcagcgggggggacgtttatcacagcgcgtcccgggctcgaccccgcatgttactcctgtgcctactcctactt

SEQ ID NO: 123008 - DNA, 75 bp, Artificial Sequence
  Synthetic
ccaggtctcccggtttgccaggaccacctcgagttttgggagggcgtctttacgggcttaacccatatagacgct

SEQ ID NO: 123009 - DNA, 75 bp, Artificial Sequence
  Synthetic
gaatgtttgactccgttgtcctatgcgaggcgtatgatatcgggtgcgcctggtatgaactcaccccggctgaga

SEQ ID NO: 123010 - DNA, 75 bp, Artificial Sequence
  Synthetic
gtatgtttgactccgttgtcctatgcgaggcgtatgatatcgggtgcgcctggtatgaactcaccccggctgaga

SEQ ID NO: 123011 - DNA, 75 bp, Artificial Sequence
  Synthetic
gcatgtttgactccgttgtcctatgcgaggcgtatgatatcgggtgcgcctggtatgaactcaccccggctgaga

SEQ ID NO: 123012 - DNA, 75 bp, Artificial Sequence
  Synthetic
ggatgtttgactccgttgtcctatgcgaggcgtatgatatcgggtgcgcctggtatgaactcaccccggctgaga

SEQ ID NO: 123013 - DNA, 75 bp, Artificial Sequence
  Synthetic
tagtgaagtgggagtacattgtcctgatgttcctggttctggcagatgctcggatttgtacgtgtctctggttaa

SEQ ID NO: 123014 - DNA, 75 bp, Artificial Sequence
  Synthetic
atgagtggatcaacactgattggactaccccatgctccggttcgtggttgagggatatctgggactgggtttgta

SEQ ID NO: 123015 - DNA, 75 bp, Artificial Sequence
  Synthetic
atgagtggatcaacactgattggtctaccccatgctccggttcgtggttgagggatatctgggactgggtttgta

SEQ ID NO: 123016 - DNA, 75 bp, Artificial Sequence
  Synthetic
atgagtggatcaacactgattggcctaccccatgctccggttcgtggttgagggatatctgggactgggtttgta

SEQ ID NO: 123017 - DNA, 75 bp, Artificial Sequence
  Synthetic
atgagtggatcaacactgattgggctaccccatgctccggttcgtggttgagggatatctgggactgggtttgta

SEQ ID NO: 123018 - DNA, 75 bp, Artificial Sequence
  Synthetic
taccccatgctccggttcgtggttgagggatatctgggactgggtttgtactgtgctatctgatttcaagacctg

SEQ ID NO: 123019 - DNA, 75 bp, Artificial Sequence
  Synthetic
catgagcaaagcatatgggatagaccctaacatcaggaccggcgtcaggactgtaacaacaggaggccccatcac

SEQ ID NO: 123020 - DNA, 75 bp, Artificial Sequence
  Synthetic
ctgtgcctactcctactttctgtaggggtaggcatctttttgctcccagcccgataggctgagagtcgtacactc

SEQ ID NO: 123021 - DNA, 75 bp, Artificial Sequence
  Synthetic
gggattcaatgtggaaatgcctgatacggctcgagcccaccttgcaaggacccacacctctcctctataggttgg

SEQ ID NO: 123022 - DNA, 75 bp, Artificial Sequence
  Synthetic
gggattcaatgtggaaatgcctgatacggctcgagcccaccttgcaaggacccactcctctcctctataggttgg

SEQ ID NO: 123023 - DNA, 75 bp, Artificial Sequence
  Synthetic
gggattcaatgtggaaatgcctgatacggctcgagcccaccttgcaaggacccacccctctcctctataggttgg

SEQ ID NO: 123024 - DNA, 75 bp, Artificial Sequence
  Synthetic
gggattcaatgtggaaatgcctgatacggctcgagcccaccttgcaaggacccacgcctctcctctataggttgg

SEQ ID NO: 123025 - DNA, 75 bp, Artificial Sequence
  Synthetic
gggattcaatgtggaaatgcctgatacggctcgagcccaccttgcaaggtcccacacctctcctctataggttgg

SEQ ID NO: 123026 - DNA, 75 bp, Artificial Sequence
  Synthetic
gggattcaatgtggaaatgcctgatacggctcgagcccaccttgcaaggtcccactcctctcctctataggttgg

SEQ ID NO: 123027 - DNA, 75 bp, Artificial Sequence
  Synthetic
gggattcaatgtggaaatgcctgatacggctcgagcccaccttgcaaggtcccacccctctcctctataggttgg

SEQ ID NO: 123028 - DNA, 75 bp, Artificial Sequence
  Synthetic
gggattcaatgtggaaatgcctgatacggctcgagcccaccttgcaaggtcccacgcctctcctctataggttgg

SEQ ID NO: 123029 - DNA, 75 bp, Artificial Sequence
  Synthetic
gggattcaatgtggaaatgcctgatacggctcgagcccaccttgcaaggccccacacctctcctctataggttgg

SEQ ID NO: 123030 - DNA, 75 bp, Artificial Sequence
  Synthetic
gggattcaatgtggaaatgcctgatacggctcgagcccaccttgcaaggccccactcctctcctctataggttgg

SEQ ID NO: 123031 - DNA, 75 bp, Artificial Sequence
  Synthetic
gggattcaatgtggaaatgcctgatacggctcgagcccaccttgcaaggccccacccctctcctctataggttgg

SEQ ID NO: 123032 - DNA, 75 bp, Artificial Sequence
  Synthetic
gggattcaatgtggaaatgcctgatacggctcgagcccaccttgcaaggccccacgcctctcctctataggttgg

SEQ ID NO: 123033 - DNA, 75 bp, Artificial Sequence
  Synthetic
gggattcaatgtggaaatgcctgatacggctcgagcccaccttgcaagggcccacacctctcctctataggttgg

SEQ ID NO: 123034 - DNA, 75 bp, Artificial Sequence
  Synthetic
gggattcaatgtggaaatgcctgatacggctcgagcccaccttgcaagggcccactcctctcctctataggttgg

SEQ ID NO: 123035 - DNA, 75 bp, Artificial Sequence
  Synthetic
gggattcaatgtggaaatgcctgatacggctcgagcccaccttgcaagggcccacccctctcctctataggttgg

SEQ ID NO: 123036 - DNA, 75 bp, Artificial Sequence
  Synthetic
gggattcaatgtggaaatgcctgatacggctcgagcccaccttgcaagggcccacgcctctcctctataggttgg

SEQ ID NO: 123037 - DNA, 75 bp, Artificial Sequence
  Synthetic
gggattcaatgtggaaatgcctgatacggctcgagcccaccttgcatggacccacacctctcctctataggttgg

SEQ ID NO: 123038 - DNA, 75 bp, Artificial Sequence
  Synthetic
gggattcaatgtggaaatgcctgatacggctcgagcccaccttgcatggacccactcctctcctctataggttgg

SEQ ID NO: 123039 - DNA, 75 bp, Artificial Sequence
  Synthetic
gggattcaatgtggaaatgcctgatacggctcgagcccaccttgcatggacccacccctctcctctataggttgg

SEQ ID NO: 123040 - DNA, 75 bp, Artificial Sequence
  Synthetic
gggattcaatgtggaaatgcctgatacggctcgagcccaccttgcatggacccacgcctctcctctataggttgg

SEQ ID NO: 123041 - DNA, 75 bp, Artificial Sequence
  Synthetic
gggattcaatgtggaaatgcctgatacggctcgagcccaccttgcatggtcccacacctctcctctataggttgg

SEQ ID NO: 123042 - DNA, 75 bp, Artificial Sequence
  Synthetic
gggattcaatgtggaaatgcctgatacggctcgagcccaccttgcatggtcccactcctctcctctataggttgg

SEQ ID NO: 123043 - DNA, 75 bp, Artificial Sequence
  Synthetic
gggattcaatgtggaaatgcctgatacggctcgagcccaccttgcatggtcccacccctctcctctataggttgg

SEQ ID NO: 123044 - DNA, 75 bp, Artificial Sequence
  Synthetic
gggattcaatgtggaaatgcctgatacggctcgagcccaccttgcatggtcccacgcctctcctctataggttgg

SEQ ID NO: 123045 - DNA, 75 bp, Artificial Sequence
  Synthetic
gggattcaatgtggaaatgcctgatacggctcgagcccaccttgcatggccccacacctctcctctataggttgg

SEQ ID NO: 123046 - DNA, 75 bp, Artificial Sequence
  Synthetic
gggattcaatgtggaaatgcctgatacggctcgagcccaccttgcatggccccactcctctcctctataggttgg

SEQ ID NO: 123047 - DNA, 75 bp, Artificial Sequence
  Synthetic
gggattcaatgtggaaatgcctgatacggctcgagcccaccttgcatggccccacccctctcctctataggttgg

SEQ ID NO: 123048 - DNA, 75 bp, Artificial Sequence
  Synthetic
gggattcaatgtggaaatgcctgatacggctcgagcccaccttgcatggccccacgcctctcctctataggttgg

SEQ ID NO: 123049 - DNA, 75 bp, Artificial Sequence
  Synthetic
gggattcaatgtggaaatgcctgatacggctcgagcccaccttgcatgggcccacacctctcctctataggttgg

SEQ ID NO: 123050 - DNA, 75 bp, Artificial Sequence
  Synthetic
gggattcaatgtggaaatgcctgatacggctcgagcccaccttgcatgggcccactcctctcctctataggttgg

SEQ ID NO: 123051 - DNA, 75 bp, Artificial Sequence
  Synthetic
gggattcaatgtggaaatgcctgatacggctcgagcccaccttgcatgggcccacccctctcctctataggttgg

SEQ ID NO: 123052 - DNA, 75 bp, Artificial Sequence
  Synthetic
gggattcaatgtggaaatgcctgatacggctcgagcccaccttgcatgggcccacgcctctcctctataggttgg

SEQ ID NO: 123053 - DNA, 75 bp, Artificial Sequence
  Synthetic
gggattcaatgtggaaatgcctgatacggctcgagcccaccttgcacggacccacacctctcctctataggttgg

SEQ ID NO: 123054 - DNA, 75 bp, Artificial Sequence
  Synthetic
gggattcaatgtggaaatgcctgatacggctcgagcccaccttgcacggacccactcctctcctctataggttgg

SEQ ID NO: 123055 - DNA, 75 bp, Artificial Sequence
  Synthetic
gggattcaatgtggaaatgcctgatacggctcgagcccaccttgcacggacccacccctctcctctataggttgg

SEQ ID NO: 123056 - DNA, 75 bp, Artificial Sequence
  Synthetic
gggattcaatgtggaaatgcctgatacggctcgagcccaccttgcacggacccacgcctctcctctataggttgg

SEQ ID NO: 123057 - DNA, 75 bp, Artificial Sequence
  Synthetic
gggattcaatgtggaaatgcctgatacggctcgagcccaccttgcacggtcccacacctctcctctataggttgg

SEQ ID NO: 123058 - DNA, 75 bp, Artificial Sequence
  Synthetic
gggattcaatgtggaaatgcctgatacggctcgagcccaccttgcacggtcccactcctctcctctataggttgg

SEQ ID NO: 123059 - DNA, 75 bp, Artificial Sequence
  Synthetic
gggattcaatgtggaaatgcctgatacggctcgagcccaccttgcacggtcccacccctctcctctataggttgg

SEQ ID NO: 123060 - DNA, 75 bp, Artificial Sequence
  Synthetic
gggattcaatgtggaaatgcctgatacggctcgagcccaccttgcacggtcccacgcctctcctctataggttgg

SEQ ID NO: 123061 - DNA, 75 bp, Artificial Sequence
  Synthetic
gggattcaatgtggaaatgcctgatacggctcgagcccaccttgcacggccccacacctctcctctataggttgg

SEQ ID NO: 123062 - DNA, 75 bp, Artificial Sequence
  Synthetic
gggattcaatgtggaaatgcctgatacggctcgagcccaccttgcacggccccactcctctcctctataggttgg

SEQ ID NO: 123063 - DNA, 75 bp, Artificial Sequence
  Synthetic
gggattcaatgtggaaatgcctgatacggctcgagcccaccttgcacggccccacccctctcctctataggttgg

SEQ ID NO: 123064 - DNA, 75 bp, Artificial Sequence
  Synthetic
gggattcaatgtggaaatgcctgatacggctcgagcccaccttgcacggccccacgcctctcctctataggttgg

SEQ ID NO: 123065 - DNA, 75 bp, Artificial Sequence
  Synthetic
gggattcaatgtggaaatgcctgatacggctcgagcccaccttgcacgggcccacacctctcctctataggttgg

SEQ ID NO: 123066 - DNA, 75 bp, Artificial Sequence
  Synthetic
gggattcaatgtggaaatgcctgatacggctcgagcccaccttgcacgggcccactcctctcctctataggttgg

SEQ ID NO: 123067 - DNA, 75 bp, Artificial Sequence
  Synthetic
gggattcaatgtggaaatgcctgatacggctcgagcccaccttgcacgggcccacccctctcctctataggttgg

SEQ ID NO: 123068 - DNA, 75 bp, Artificial Sequence
  Synthetic
gggattcaatgtggaaatgcctgatacggctcgagcccaccttgcacgggcccacgcctctcctctataggttgg

SEQ ID NO: 123069 - DNA, 75 bp, Artificial Sequence
  Synthetic
gggattcaatgtggaaatgcctgatacggctcgagcccaccttgcagggacccacacctctcctctataggttgg

SEQ ID NO: 123070 - DNA, 75 bp, Artificial Sequence
  Synthetic
gggattcaatgtggaaatgcctgatacggctcgagcccaccttgcagggacccactcctctcctctataggttgg

SEQ ID NO: 123071 - DNA, 75 bp, Artificial Sequence
  Synthetic
gggattcaatgtggaaatgcctgatacggctcgagcccaccttgcagggacccacccctctcctctataggttgg

SEQ ID NO: 123072 - DNA, 75 bp, Artificial Sequence
  Synthetic
gggattcaatgtggaaatgcctgatacggctcgagcccaccttgcagggacccacgcctctcctctataggttgg

SEQ ID NO: 123073 - DNA, 75 bp, Artificial Sequence
  Synthetic
gggattcaatgtggaaatgcctgatacggctcgagcccaccttgcagggtcccacacctctcctctataggttgg

SEQ ID NO: 123074 - DNA, 75 bp, Artificial Sequence
  Synthetic
gggattcaatgtggaaatgcctgatacggctcgagcccaccttgcagggtcccactcctctcctctataggttgg

SEQ ID NO: 123075 - DNA, 75 bp, Artificial Sequence
  Synthetic
gggattcaatgtggaaatgcctgatacggctcgagcccaccttgcagggtcccacccctctcctctataggttgg

SEQ ID NO: 123076 - DNA, 75 bp, Artificial Sequence
  Synthetic
gggattcaatgtggaaatgcctgatacggctcgagcccaccttgcagggtcccacgcctctcctctataggttgg

SEQ ID NO: 123077 - DNA, 75 bp, Artificial Sequence
  Synthetic
gggattcaatgtggaaatgcctgatacggctcgagcccaccttgcagggccccacacctctcctctataggttgg

SEQ ID NO: 123078 - DNA, 75 bp, Artificial Sequence
  Synthetic
gggattcaatgtggaaatgcctgatacggctcgagcccaccttgcagggccccactcctctcctctataggttgg

SEQ ID NO: 123079 - DNA, 75 bp, Artificial Sequence
  Synthetic
gggattcaatgtggaaatgcctgatacggctcgagcccaccttgcagggccccacccctctcctctataggttgg

SEQ ID NO: 123080 - DNA, 75 bp, Artificial Sequence
  Synthetic
gggattcaatgtggaaatgcctgatacggctcgagcccaccttgcagggccccacgcctctcctctataggttgg

SEQ ID NO: 123081 - DNA, 75 bp, Artificial Sequence
  Synthetic
gggattcaatgtggaaatgcctgatacggctcgagcccaccttgcaggggcccacacctctcctctataggttgg

SEQ ID NO: 123082 - DNA, 75 bp, Artificial Sequence
  Synthetic
gggattcaatgtggaaatgcctgatacggctcgagcccaccttgcaggggcccactcctctcctctataggttgg

SEQ ID NO: 123083 - DNA, 75 bp, Artificial Sequence
  Synthetic
gggattcaatgtggaaatgcctgatacggctcgagcccaccttgcaggggcccacccctctcctctataggttgg

SEQ ID NO: 123084 - DNA, 75 bp, Artificial Sequence
  Synthetic
gggattcaatgtggaaatgcctgatacggctcgagcccaccttgcaggggcccacgcctctcctctataggttgg

SEQ ID NO: 123085 - DNA, 75 bp, Artificial Sequence
  Synthetic
agacgcccactttctgtcccagaccaaacaatcaggggagaatttcccttacctcgtggcttaccaagctacagt

SEQ ID NO: 123086 - DNA, 75 bp, Artificial Sequence
  Synthetic
agacgcccactttctgtcccagaccaaacattcaggggagaatttcccttacctcgtggcttaccaagctacagt

SEQ ID NO: 123087 - DNA, 75 bp, Artificial Sequence
  Synthetic
agacgcccactttctgtcccagaccaaacactcaggggagaatttcccttacctcgtggcttaccaagctacagt

SEQ ID NO: 123088 - DNA, 75 bp, Artificial Sequence
  Synthetic
agacgcccactttctgtcccagaccaaacagtcaggggagaatttcccttacctcgtggcttaccaagctacagt

SEQ ID NO: 123089 - DNA, 75 bp, Artificial Sequence
  Synthetic
acctgtacctgcggtgccgtgattgctggccatgtacgtaacgggaccatgaagatctcggggtctcgatggtgc

SEQ ID NO: 123090 - DNA, 75 bp, Artificial Sequence
  Synthetic
gttttgggaataggtaccgttttagaccaggctgagacggctggcgtacgccttactgtcctagccacagccaca

SEQ ID NO: 123091 - DNA, 75 bp, Artificial Sequence
  Synthetic
ggtggggggagttatggctgccctagctgcctactgtatgtctgtgggcagtgtggtagtgatagggagggtcat

SEQ ID NO: 123092 - DNA, 75 bp, Artificial Sequence
  Synthetic
ggtggggggagttatggctgccctagctgcctactgtttgtctgtgggcagtgtggtagtgatagggagggtcat

SEQ ID NO: 123093 - DNA, 75 bp, Artificial Sequence
  Synthetic
ggtggggggagttatggctgccctagctgcctactgtctgtctgtgggcagtgtggtagtgatagggagggtcat

SEQ ID NO: 123094 - DNA, 75 bp, Artificial Sequence
  Synthetic
ggtggggggagttatggctgccctagctgcctactgtgtgtctgtgggcagtgtggtagtgatagggagggtcat

SEQ ID NO: 123095 - DNA, 75 bp, Artificial Sequence
  Synthetic
aggctgggagccgtgcagaacgagataatcacaacacatccaattaccaaatacatcatgacctgcatgtcagcg

SEQ ID NO: 123096 - DNA, 75 bp, Artificial Sequence
  Synthetic
acctaccacaggggagatcccattctacgggaagggtattccccttgagtacatcaagggtggtagacacctgat

SEQ ID NO: 123097 - DNA, 75 bp, Artificial Sequence
  Synthetic
cagcagaggaatacgtggaggttgtaagggtaggggactgccactttgtggtgggcgcaaccaatcaggacttaa

SEQ ID NO: 123098 - DNA, 75 bp, Artificial Sequence
  Synthetic
ggtgtgcagctcgccgagcagttcaagcagaaagctctcggcgtgttgcagtccgccaacaaacaagcacaggca

SEQ ID NO: 123099 - DNA, 75 bp, Artificial Sequence
  Synthetic
gctcgtccccccccactctgcccggtcgaagttcgggtatagtgcgaaggatgttcgctccttgtccagcaaggc

SEQ ID NO: 123100 - DNA, 75 bp, Artificial Sequence
  Synthetic
ggataacaactactggaaggcccgctgttgtgccagaccgggaggtactttaccaacaatttgatgagatggagg

SEQ ID NO: 123101 - DNA, 75 bp, Artificial Sequence
  Synthetic
ggattacaactactggaaggcccgctgttgtgccagaccgggaggtactttaccaacaatttgatgagatggagg

SEQ ID NO: 123102 - DNA, 75 bp, Artificial Sequence
  Synthetic
ggatcacaactactggaaggcccgctgttgtgccagaccgggaggtactttaccaacaatttgatgagatggagg

SEQ ID NO: 123103 - DNA, 75 bp, Artificial Sequence
  Synthetic
ggatgacaactactggaaggcccgctgttgtgccagaccgggaggtactttaccaacaatttgatgagatggagg

SEQ ID NO: 123104 - DNA, 75 bp, Artificial Sequence
  Synthetic
atccccacgcaaggggatgtggtcatctgtgccactgacgccctcatgactggctacacaggcgatttcgactcc

SEQ ID NO: 123105 - DNA, 75 bp, Artificial Sequence
  Synthetic
ggtatccttttccgtaggtctctcctcctacgccattggatcccagcttccttgtgagcccgagccagacgtcat

SEQ ID NO: 123106 - DNA, 75 bp, Artificial Sequence
  Synthetic
ggtatccttttccgttggtctctcctcctacgccattggatcccagcttccttgtgagcccgagccagacgtcat

SEQ ID NO: 123107 - DNA, 75 bp, Artificial Sequence
  Synthetic
ggtatccttttccgtcggtctctcctcctacgccattggatcccagcttccttgtgagcccgagccagacgtcat

SEQ ID NO: 123108 - DNA, 75 bp, Artificial Sequence
  Synthetic
ggtatccttttccgtgggtctctcctcctacgccattggatcccagcttccttgtgagcccgagccagacgtcat

SEQ ID NO: 123109 - DNA, 75 bp, Artificial Sequence
  Synthetic
tcctacgccattggatcccagcttccttgtgagcccgagccagacgtcatggttgttacatcaatgctgacagac

SEQ ID NO: 123110 - DNA, 75 bp, Artificial Sequence
  Synthetic
gggagatggctgcatcgtgcggaggcgcggtttttgtaggtctggcactcttgaccttgtcaccatactataagg

SEQ ID NO: 123111 - DNA, 75 bp, Artificial Sequence
  Synthetic
ccacattacctgggaaccctgccatagcctctcttatgtccttcacggccgcagtcacgagccccctcacaacac

SEQ ID NO: 123112 - DNA, 75 bp, Artificial Sequence
  Synthetic
ggggccttggttgacacccaggtgcttagttgactacccatacaggctctggcactacccctgcactgtcaactt

SEQ ID NO: 123113 - DNA, 75 bp, Artificial Sequence
  Synthetic
actgtcccgcaagacgctgtggccagaagccagcggcgcggacgtacgggtagggggaaacccgggatatacagg

SEQ ID NO: 123114 - DNA, 75 bp, Artificial Sequence
  Synthetic
actgtcccgcaagacgctgtggccagaagccagcggcgcggacgtacgggtagggggaatcccgggatatacagg

SEQ ID NO: 123115 - DNA, 75 bp, Artificial Sequence
  Synthetic
actgtcccgcaagacgctgtggccagaagccagcggcgcggacgtacgggtagggggaaccccgggatatacagg

SEQ ID NO: 123116 - DNA, 75 bp, Artificial Sequence
  Synthetic
actgtcccgcaagacgctgtggccagaagccagcggcgcggacgtacgggtagggggaagcccgggatatacagg

SEQ ID NO: 123117 - DNA, 75 bp, Artificial Sequence
  Synthetic
agaagagatcaagcctgccgtaacttctatgtggcccaagctcgagcagttctggcataaacacatgtggaactt

SEQ ID NO: 123118 - DNA, 75 bp, Artificial Sequence
  Synthetic
tctgtgccactgacgccctcatgactggctacacaggcgatttcgactccgtcatagactgcaacgtggctgtga

SEQ ID NO: 123119 - DNA, 75 bp, Artificial Sequence
  Synthetic
tgaaggccacgtgcaccacgcatggcccacaccctgacgctgagttgattgaagcgaacttgctgtggaggcagg

SEQ ID NO: 123120 - DNA, 75 bp, Artificial Sequence
  Synthetic
ggcagtcggcagcgtgggtctggggaagatcctggtcgacattctcgccggttacggtgctggcgtcgccggcgc

SEQ ID NO: 123121 - DNA, 75 bp, Artificial Sequence
  Synthetic
actacatctcagaccctcttgcttaacatcttgggtggatgggtggcctcccaggtggcacccccctcggcctct

SEQ ID NO: 123122 - DNA, 75 bp, Artificial Sequence
  Synthetic
actgccctgttccttcaccaccctaccggccctgtccactggtctaattcatctccatcagaacatcgtggacgt

SEQ ID NO: 123123 - DNA, 75 bp, Artificial Sequence
  Synthetic
aacgggactgggttcactaagacgtgcggagcaccaccttgccgcattaggagggacttcaacagcactctcgac

SEQ ID NO: 123124 - DNA, 75 bp, Artificial Sequence
  Synthetic
gttgtgtgcgcggccatactgaggcgccacgtggggcctggcgaaggggccgtgcaatggatgaatcgcctcatt

SEQ ID NO: 123125 - DNA, 75 bp, Artificial Sequence
  Synthetic
caggagccctggtggcctttaagatcatgagtggcgaaacgccctccatggaggacatggccaatctgctgccgg

SEQ ID NO: 123126 - DNA, 75 bp, Artificial Sequence
  Synthetic
caggagccctggtggcctttaagatcatgagtggcgatacgccctccatggaggacatggccaatctgctgccgg

SEQ ID NO: 123127 - DNA, 75 bp, Artificial Sequence
  Synthetic
caggagccctggtggcctttaagatcatgagtggcgacacgccctccatggaggacatggccaatctgctgccgg

SEQ ID NO: 123128 - DNA, 75 bp, Artificial Sequence
  Synthetic
caggagccctggtggcctttaagatcatgagtggcgagacgccctccatggaggacatggccaatctgctgccgg

SEQ ID NO: 123129 - DNA, 75 bp, Artificial Sequence
  Synthetic
tggtagctggcacataaaccggactgccctcaattgcaatgacagcctaaacacgggtttcattgcctccctgtt

SEQ ID NO: 123130 - DNA, 75 bp, Artificial Sequence
  Synthetic
cctacctagtggcttatcaagctacagtgtgtgctcgagctaaagctccccccccatcatgggacaacatgtgga

SEQ ID NO: 123131 - DNA, 75 bp, Artificial Sequence
  Synthetic
gtggagttttgcctaccagcttcggcaatacaatcacttgctacatcaaggcctcagcggctgcaaaggccgcag

SEQ ID NO: 123132 - DNA, 75 bp, Artificial Sequence
  Synthetic
cactgtgaatttcaccatcttcaaggtgcggatgtatgtgggaggggtggagcatcgattgtccgcagcatgtaa

SEQ ID NO: 123133 - DNA, 75 bp, Artificial Sequence
  Synthetic
ggctgccccgagcgcttgtcttcctgccgcgggctggacgattttcgcatcgggtggggaaccttggaatacgag

SEQ ID NO: 123134 - DNA, 75 bp, Artificial Sequence
  Synthetic
catctctcctgagacggctccacaagtggatcaatgaagattgttctactccgtgtgacacgagctggctacgag

SEQ ID NO: 123135 - DNA, 75 bp, Artificial Sequence
  Synthetic
gctgatagcgtttgcctcgcggggcaaccatgtgtcacccacgcactatgtacccgagactgatgcatcccggaa

SEQ ID NO: 123136 - DNA, 75 bp, Artificial Sequence
  Synthetic
gctgatagcgtttgcctcgcggggcaaccatgtgtctcccacgcactatgtacccgagactgatgcatcccggaa

SEQ ID NO: 123137 - DNA, 75 bp, Artificial Sequence
  Synthetic
gctgatagcgtttgcctcgcggggcaaccatgtgtcccccacgcactatgtacccgagactgatgcatcccggaa

SEQ ID NO: 123138 - DNA, 75 bp, Artificial Sequence
  Synthetic
gctgatagcgtttgcctcgcggggcaaccatgtgtcgcccacgcactatgtacccgagactgatgcatcccggaa

SEQ ID NO: 123139 - DNA, 75 bp, Artificial Sequence
  Synthetic
cgggtggggaaccttggaatacgagaccaatgtcaccaacgatgaggacatgagaccgtactgctggcattaccc

SEQ ID NO: 123140 - DNA, 75 bp, Artificial Sequence
  Synthetic
cgcgctggtgcctgacagagaagtgctttaccaacaattcgacgagatggaagagtgctcacatcgcattcccta

SEQ ID NO: 123141 - DNA, 75 bp, Artificial Sequence
  Synthetic
accacttgagggcgaacccggagaccctgatcttagttctgggtcttggtccacggtcagtgaggaagaagacag

SEQ ID NO: 123142 - DNA, 75 bp, Artificial Sequence
  Synthetic
aaaaggatacaaaggggtgtggcggggggatggcgtgatgcacaccaaatgcccatgtggagcggatctggccgg

SEQ ID NO: 123143 - DNA, 75 bp, Artificial Sequence
  Synthetic
ttgtgggacatctggaactgggtatgcaccgtactggccgactttaaagtctggcttaaggctaagctcctgccg

SEQ ID NO: 123144 - DNA, 75 bp, Artificial Sequence
  Synthetic
cctgatcttagttctgggtcttggtccacggtcagtgaggaagaagacagcataatctgctgctcatactcatac

SEQ ID NO: 123145 - DNA, 75 bp, Artificial Sequence
  Synthetic
cccccctggaggcccggggggggcgtgacgggatcatttgggtggctgtcattctacacccacgcctggtgtttg

SEQ ID NO: 123146 - DNA, 75 bp, Artificial Sequence
  Synthetic
caatcggcatggccaaagcttgaggcgttctggcagaaacacctgtggaatttcgttagcgggatacaatatctc

SEQ ID NO: 123147 - DNA, 75 bp, Artificial Sequence
  Synthetic
actccacaacatcacggagtgccgcaatgcgtcagaagaaagtgacgtttgaccgtatgcagatgctggaccaac

SEQ ID NO: 123148 - DNA, 75 bp, Artificial Sequence
  Synthetic
gtgcccaccccggcgccaaactaccagttcgcgctgtggagggtggccgctgaggagtacgtggaggtcaggaga

SEQ ID NO: 123149 - DNA, 75 bp, Artificial Sequence
  Synthetic
tcacaggacatgtaaaaaacggatccatgaaaatcttgggtcctaagatgtgcagcaatacctggcatggcactt

SEQ ID NO: 123150 - DNA, 75 bp, Artificial Sequence
  Synthetic
tcacaggacatgtaaataacggatccatgaaaatcttgggtcctaagatgtgcagcaatacctggcatggcactt

SEQ ID NO: 123151 - DNA, 75 bp, Artificial Sequence
  Synthetic
tcacaggacatgtaaacaacggatccatgaaaatcttgggtcctaagatgtgcagcaatacctggcatggcactt

SEQ ID NO: 123152 - DNA, 75 bp, Artificial Sequence
  Synthetic
tcacaggacatgtaaagaacggatccatgaaaatcttgggtcctaagatgtgcagcaatacctggcatggcactt

SEQ ID NO: 123153 - DNA, 75 bp, Artificial Sequence
  Synthetic
tcacaggacatgttaaaaacggatccatgaaaatcttgggtcctaagatgtgcagcaatacctggcatggcactt

SEQ ID NO: 123154 - DNA, 75 bp, Artificial Sequence
  Synthetic
tcacaggacatgttaataacggatccatgaaaatcttgggtcctaagatgtgcagcaatacctggcatggcactt

SEQ ID NO: 123155 - DNA, 75 bp, Artificial Sequence
  Synthetic
tcacaggacatgttaacaacggatccatgaaaatcttgggtcctaagatgtgcagcaatacctggcatggcactt

SEQ ID NO: 123156 - DNA, 75 bp, Artificial Sequence
  Synthetic
tcacaggacatgttaagaacggatccatgaaaatcttgggtcctaagatgtgcagcaatacctggcatggcactt

SEQ ID NO: 123157 - DNA, 75 bp, Artificial Sequence
  Synthetic
tcacaggacatgtcaaaaacggatccatgaaaatcttgggtcctaagatgtgcagcaatacctggcatggcactt

SEQ ID NO: 123158 - DNA, 75 bp, Artificial Sequence
  Synthetic
tcacaggacatgtcaataacggatccatgaaaatcttgggtcctaagatgtgcagcaatacctggcatggcactt

SEQ ID NO: 123159 - DNA, 75 bp, Artificial Sequence
  Synthetic
tcacaggacatgtcaacaacggatccatgaaaatcttgggtcctaagatgtgcagcaatacctggcatggcactt

SEQ ID NO: 123160 - DNA, 75 bp, Artificial Sequence
  Synthetic
tcacaggacatgtcaagaacggatccatgaaaatcttgggtcctaagatgtgcagcaatacctggcatggcactt

SEQ ID NO: 123161 - DNA, 75 bp, Artificial Sequence
  Synthetic
tcacaggacatgtgaaaaacggatccatgaaaatcttgggtcctaagatgtgcagcaatacctggcatggcactt

SEQ ID NO: 123162 - DNA, 75 bp, Artificial Sequence
  Synthetic
tcacaggacatgtgaataacggatccatgaaaatcttgggtcctaagatgtgcagcaatacctggcatggcactt

SEQ ID NO: 123163 - DNA, 75 bp, Artificial Sequence
  Synthetic
tcacaggacatgtgaacaacggatccatgaaaatcttgggtcctaagatgtgcagcaatacctggcatggcactt

SEQ ID NO: 123164 - DNA, 75 bp, Artificial Sequence
  Synthetic
tcacaggacatgtgaagaacggatccatgaaaatcttgggtcctaagatgtgcagcaatacctggcatggcactt

SEQ ID NO: 123165 - DNA, 75 bp, Artificial Sequence
  Synthetic
ctttcgacctctaccaccctccttcttaacatactgggggggtgggtagcatcccaactagcgccgcccacagca

SEQ ID NO: 123166 - DNA, 75 bp, Artificial Sequence
  Synthetic
gaccgtatgcagatgctggaccaacattattatgatgtccttaaggagattaagctccgggcgtcccaggtgaag

SEQ ID NO: 123167 - DNA, 75 bp, Artificial Sequence
  Synthetic
atcccaactagcgccgcccacagcatcgacagcatttgtcgtaagcggcattgctggtgccactgtgggtagcat

SEQ ID NO: 123168 - DNA, 75 bp, Artificial Sequence
  Synthetic
gactacaacagcactctcgatctattgtgccccacagactgctttaggaagcacccaagtgctacctatgctaag

SEQ ID NO: 123169 - DNA, 75 bp, Artificial Sequence
  Synthetic
ggctgcaccgatatgccccaccatgcaagcccctgcttagggaggaggtaagctacagcgtggggcttaattcct

SEQ ID NO: 123170 - DNA, 75 bp, Artificial Sequence
  Synthetic
ggtgcgagtgggggacgctcactacgtggtgggcgttaccgcagaaggcttaaagtgcccctgccaggtccctgc

SEQ ID NO: 123171 - DNA, 75 bp, Artificial Sequence
  Synthetic
gtaaggccattaaccacatcaactccgtgtgggaggacttgctggaagacaatcaaacaccaattcctacaacca

SEQ ID NO: 123172 - DNA, 75 bp, Artificial Sequence
  Synthetic
gatcatgagcggcgaggcccctgcgttggaggacatggtcaatcttctgccagcccttctttcgcctggagctct

SEQ ID NO: 123173 - DNA, 75 bp, Artificial Sequence
  Synthetic
cagcccttctttcgcctggagctctggtagtgggcgtggtatgcgctgctgtcctgaggcgccacataggaccat

SEQ ID NO: 123174 - DNA, 75 bp, Artificial Sequence
  Synthetic
tcgcagactggctagggggtctccgccctctcaggccagttcatcagcgagtcagctatctgctccatctcttaa

SEQ ID NO: 123175 - DNA, 75 bp, Artificial Sequence
  Synthetic
aacaactacgccgtgggctcgcagctcccttgcgagcccgagccagacgtggttgtcttaacaaccatgctcacc

SEQ ID NO: 123176 - DNA, 75 bp, Artificial Sequence
  Synthetic
gaagagggccctcttcgacatcactcgcaaattgccggtggcagtgatggggaaagcctacgggttccagtactc

SEQ ID NO: 123177 - DNA, 75 bp, Artificial Sequence
  Synthetic
ttcctcgctaggctcatatggtggttacaatatcttatcaccagagtcgaggcgcatctacaagtgtgggtcccc

SEQ ID NO: 123178 - DNA, 75 bp, Artificial Sequence
  Synthetic
tggctgagagacgtgtgggactgggtgtgcacagttatatctgacttcaagacttggctcaaggtgaagctcatg

SEQ ID NO: 123179 - DNA, 75 bp, Artificial Sequence
  Synthetic
tggctgagagacgtgtgggactgggtgtgcacagttttatctgacttcaagacttggctcaaggtgaagctcatg

SEQ ID NO: 123180 - DNA, 75 bp, Artificial Sequence
  Synthetic
tggctgagagacgtgtgggactgggtgtgcacagttctatctgacttcaagacttggctcaaggtgaagctcatg

SEQ ID NO: 123181 - DNA, 75 bp, Artificial Sequence
  Synthetic
tggctgagagacgtgtgggactgggtgtgcacagttgtatctgacttcaagacttggctcaaggtgaagctcatg

SEQ ID NO: 123182 - DNA, 75 bp, Artificial Sequence
  Synthetic
tccaagaacaaggtggtgatactggactcttttgatcccattgtggctgagccggatgaccgcgagatttccaca

SEQ ID NO: 123183 - DNA, 75 bp, Artificial Sequence
  Synthetic
cactcaaagcaacctgcaccgtccacgctgacgatccggatgccgaattgatcagcgcaaaccttttgtggaggc

SEQ ID NO: 123184 - DNA, 75 bp, Artificial Sequence
  Synthetic
gagcgcgacatacgcaacgagcacgacatctaccaatgttgtcaactggacccagaggccaggaaagccataaca

SEQ ID NO: 123185 - DNA, 75 bp, Artificial Sequence
  Synthetic
gacttggctcaaggtgaagctcatgccctccctaccaggcatccccttcctctcatgtcagaggggttttagggg

SEQ ID NO: 123186 - DNA, 75 bp, Artificial Sequence
  Synthetic
ataactacacccccccggtcgtccatgggtgcgccctgcccccgtgcaagccgacccccgtccctcctcctagga

SEQ ID NO: 123187 - DNA, 75 bp, Artificial Sequence
  Synthetic
acatgcagcaatgtatggcatggcacgttccccataaacgccacaacaactggccctagcatacccatcccggag

SEQ ID NO: 123188 - DNA, 75 bp, Artificial Sequence
  Synthetic
atccatccctgctgagtgccatcgccctcctcgtccaaagtttccaccagcgcttcctatttgggcaagaccaga

SEQ ID NO: 123189 - DNA, 75 bp, Artificial Sequence
  Synthetic
ctcatgaagctggccgcgctgacaggtacgtacgtttatgaccatcttactccactgcgggattgggcccacgag

SEQ ID NO: 123190 - DNA, 75 bp, Artificial Sequence
  Synthetic
gagctggcatcaaagaccttcactcggcccgacgcggacgccgattccgggacggggcttacctccccgaccgag

SEQ ID NO: 123191 - DNA, 75 bp, Artificial Sequence
  Synthetic
ggagaccaagattatcacctggggagcggacaccgcggcgtgcggggacatcctctctggtctgcccgtctccgc

SEQ ID NO: 123192 - DNA, 75 bp, Artificial Sequence
  Synthetic
ccacctaggaagaagaagctcatccgccttgatgaggcctctgcgatggaggcactcacgaaaatgcggaaggca

SEQ ID NO: 123193 - DNA, 75 bp, Artificial Sequence
  Synthetic
agtggcccatctacacgctcccactggcagcggcaagagcactaaagtgccggctgcatatgcagcccaagggta

SEQ ID NO: 123194 - DNA, 75 bp, Artificial Sequence
  Synthetic
tcggccctctacgtgggggacttgtgcgggtctgtcttccttgtcggtcagctgttcaccttctctcccaggcgc

SEQ ID NO: 123195 - DNA, 75 bp, Artificial Sequence
  Synthetic
ggacgaagtatcgttctcagttggcctccatagatatgctatggggtcccaacttccgtgtgagcccgagcctga

SEQ ID NO: 123196 - DNA, 75 bp, Artificial Sequence
  Synthetic
ggacgaagtatcgttctcagttggcctccatagttatgctatggggtcccaacttccgtgtgagcccgagcctga

SEQ ID NO: 123197 - DNA, 75 bp, Artificial Sequence
  Synthetic
ggacgaagtatcgttctcagttggcctccatagctatgctatggggtcccaacttccgtgtgagcccgagcctga

SEQ ID NO: 123198 - DNA, 75 bp, Artificial Sequence
  Synthetic
ggacgaagtatcgttctcagttggcctccataggtatgctatggggtcccaacttccgtgtgagcccgagcctga

SEQ ID NO: 123199 - DNA, 75 bp, Artificial Sequence
  Synthetic
catcagactcgtggtccactgttagcggatcggaggacgtcgtgtgttgctcaatgtcatactcttggacagggg

SEQ ID NO: 123200 - DNA, 75 bp, Artificial Sequence
  Synthetic
tatccgatgccgagtcctatagctctatgcctccgcttgagggggagcctggcgaccctgatctcagttcgggct

SEQ ID NO: 123201 - DNA, 75 bp, Artificial Sequence
  Synthetic
tatcaacttgggcagcccagggtttgcgggacctggcagtcgccgtggagcctgtggtgttcagcccaatggaga

SEQ ID NO: 123202 - DNA, 75 bp, Artificial Sequence
  Synthetic
gcgcatggtactgtgcacccatttcttccaaatactgcaagcgcaggagcagctccacaaagcacttgacttcga

SEQ ID NO: 123203 - DNA, 75 bp, Artificial Sequence
  Synthetic
gggctcccctccgtcgctggctagctcctcggctagtcagctctccgcgccatccctaaaagcaacatgcaccac

SEQ ID NO: 123204 - DNA, 75 bp, Artificial Sequence
  Synthetic
ccggtcagctacggcccggcagaagaaggtcacttttgatcgtcttcaagtcgtcgatgaccactaccaggctgt

SEQ ID NO: 123205 - DNA, 75 bp, Artificial Sequence
  Synthetic
attgcctatcagccctctcagcaactctatgataaggcaccacaacatggtatactccaccacctcgcgcagcgc

SEQ ID NO: 123206 - DNA, 75 bp, Artificial Sequence
  Synthetic
catggcctcccggtttccgcgaggctaggtagggaagttctgctcggccccgccgatagctacacctcgaagggg

SEQ ID NO: 123207 - DNA, 75 bp, Artificial Sequence
  Synthetic
ttgattgaggccaaccttctgtggagacaggaggtcgggggcaacatcacgagggtcgagtctgagaataaaatc

SEQ ID NO: 123208 - DNA, 75 bp, Artificial Sequence
  Synthetic
ttgattgaggccaaccttctgtggagacaggaggtcgggggcaacatcacgagggtcgagtctgagaataatatc

SEQ ID NO: 123209 - DNA, 75 bp, Artificial Sequence
  Synthetic
ttgattgaggccaaccttctgtggagacaggaggtcgggggcaacatcacgagggtcgagtctgagaataacatc

SEQ ID NO: 123210 - DNA, 75 bp, Artificial Sequence
  Synthetic
ttgattgaggccaaccttctgtggagacaggaggtcgggggcaacatcacgagggtcgagtctgagaataagatc

SEQ ID NO: 123211 - DNA, 75 bp, Artificial Sequence
  Synthetic
agctccacaaagcacttgacttcgacatgtacggagtcacatactcaatcactccattggatctcccagaaatca

SEQ ID NO: 123212 - DNA, 75 bp, Artificial Sequence
  Synthetic
atgatgactcttgcagctcaatgccgcccttggaaggcgagcccggcgatcccgacttcgattcgggctcgtggg

SEQ ID NO: 123213 - DNA, 75 bp, Artificial Sequence
  Synthetic
gttgagagcctggaggcacagagctcgagcggtcagagcaaagcttatcgcccaaggggggaaagcagcaatatg

SEQ ID NO: 123214 - DNA, 75 bp, Artificial Sequence
  Synthetic
ccacatcaactccgtgtgggaggacttgctggaagactctgtcacccccattccgaccaccatcatggcaaagaa

SEQ ID NO: 123215 - DNA, 75 bp, Artificial Sequence
  Synthetic
cagcactacccatatgggcaaggccggattatagtcctcccttgctggagacttggaaagcaccggattacgacc

SEQ ID NO: 123216 - DNA, 75 bp, Artificial Sequence
  Synthetic
ggagcctatcccgcaaggccgttaaccacatcaactccgtgtgggaggacttgctggaagactctgtcaccccca

SEQ ID NO: 123217 - DNA, 75 bp, Artificial Sequence
  Synthetic
gaagcgaggctactcacagttgaggaagcctgcgatttaacccctccgcactctgcccgttccaagtacgggtaa

SEQ ID NO: 123218 - DNA, 75 bp, Artificial Sequence
  Synthetic
gaagcgaggctactcacagttgaggaagcctgcgatttaacccctccgcactctgcccgttccaagtacgggtat

SEQ ID NO: 123219 - DNA, 75 bp, Artificial Sequence
  Synthetic
gaagcgaggctactcacagttgaggaagcctgcgatttaacccctccgcactctgcccgttccaagtacgggtac

SEQ ID NO: 123220 - DNA, 75 bp, Artificial Sequence
  Synthetic
gaagcgaggctactcacagttgaggaagcctgcgatttaacccctccgcactctgcccgttccaagtacgggtag

SEQ ID NO: 123221 - DNA, 75 bp, Artificial Sequence
  Synthetic
tctatttcaggggtcctctggacagtatatcatggggctggtaataagaccttggccggccccaaaggaccagtc

SEQ ID NO: 123222 - DNA, 75 bp, Artificial Sequence
  Synthetic
gcccctcggggcacgctgtaggcatcttccgggctgctgtgtgcacccggggggttgcgaaggcggtggacttca

SEQ ID NO: 123223 - DNA, 75 bp, Artificial Sequence
  Synthetic
tacagcgggggggacatttatcacagcgtgtcccgagctcgaccccgcattttactcctgtgcctactcctactc

SEQ ID NO: 123224 - DNA, 75 bp, Artificial Sequence
  Synthetic
tacaacgttgtccaaaagcttccccaagctataatgggggacgcttacggcttccaatactctccagcgcagcgg

SEQ ID NO: 123225 - DNA, 75 bp, Artificial Sequence
  Synthetic
caatcatggcaaagaatgaggtgttttgcgtggatccatcaaaagggggccgcaagcctgctaggctaatagtct

SEQ ID NO: 123226 - DNA, 75 bp, Artificial Sequence
  Synthetic
tttactcctgtgcctactcctactctccgtaggggtaggcattttcctgctccctgctcggtagacagggggctt

SEQ ID NO: 123227 - DNA, 75 bp, Artificial Sequence
  Synthetic
ttccactacctccactgacgaatcaccagtttctgatgagccagacacacattctgatgctggttcatatagttc

SEQ ID NO: 123228 - DNA, 75 bp, Artificial Sequence
  Synthetic
ttccactacctccactgacgaatcaccagtttctgatgagccagacacacattctgatgctggttcttatagttc

SEQ ID NO: 123229 - DNA, 75 bp, Artificial Sequence
  Synthetic
ttccactacctccactgacgaatcaccagtttctgatgagccagacacacattctgatgctggttcctatagttc

SEQ ID NO: 123230 - DNA, 75 bp, Artificial Sequence
  Synthetic
ttccactacctccactgacgaatcaccagtttctgatgagccagacacacattctgatgctggttcgtatagttc

SEQ ID NO: 123231 - DNA, 75 bp, Artificial Sequence
  Synthetic
ttccactacctccactgacgattcaccagtttctgatgagccagacacacattctgatgctggttcatatagttc

SEQ ID NO: 123232 - DNA, 75 bp, Artificial Sequence
  Synthetic
ttccactacctccactgacgattcaccagtttctgatgagccagacacacattctgatgctggttcttatagttc

SEQ ID NO: 123233 - DNA, 75 bp, Artificial Sequence
  Synthetic
ttccactacctccactgacgattcaccagtttctgatgagccagacacacattctgatgctggttcctatagttc

SEQ ID NO: 123234 - DNA, 75 bp, Artificial Sequence
  Synthetic
ttccactacctccactgacgattcaccagtttctgatgagccagacacacattctgatgctggttcgtatagttc

SEQ ID NO: 123235 - DNA, 75 bp, Artificial Sequence
  Synthetic
ttccactacctccactgacgactcaccagtttctgatgagccagacacacattctgatgctggttcatatagttc

SEQ ID NO: 123236 - DNA, 75 bp, Artificial Sequence
  Synthetic
ttccactacctccactgacgactcaccagtttctgatgagccagacacacattctgatgctggttcttatagttc

SEQ ID NO: 123237 - DNA, 75 bp, Artificial Sequence
  Synthetic
ttccactacctccactgacgactcaccagtttctgatgagccagacacacattctgatgctggttcctatagttc

SEQ ID NO: 123238 - DNA, 75 bp, Artificial Sequence
  Synthetic
ttccactacctccactgacgactcaccagtttctgatgagccagacacacattctgatgctggttcgtatagttc

SEQ ID NO: 123239 - DNA, 75 bp, Artificial Sequence
  Synthetic
ttccactacctccactgacgagtcaccagtttctgatgagccagacacacattctgatgctggttcatatagttc

SEQ ID NO: 123240 - DNA, 75 bp, Artificial Sequence
  Synthetic
ttccactacctccactgacgagtcaccagtttctgatgagccagacacacattctgatgctggttcttatagttc

SEQ ID NO: 123241 - DNA, 75 bp, Artificial Sequence
  Synthetic
ttccactacctccactgacgagtcaccagtttctgatgagccagacacacattctgatgctggttcctatagttc

SEQ ID NO: 123242 - DNA, 75 bp, Artificial Sequence
  Synthetic
ttccactacctccactgacgagtcaccagtttctgatgagccagacacacattctgatgctggttcgtatagttc

SEQ ID NO: 123243 - DNA, 75 bp, Artificial Sequence
  Synthetic
aggctgaagaagaggtttaccagtgttgtgacctagatcccgacacccgcaaggtgatatccgcccttacagaga

SEQ ID NO: 123244 - DNA, 75 bp, Artificial Sequence
  Synthetic
gctctcggcctagttggggccccacggacccccggcgtaggtcgcgcaatttgggtaaggtcatcgataccctca

SEQ ID NO: 123245 - DNA, 75 bp, Artificial Sequence
  Synthetic
ttcacctaaggagagagttgaatacctccttaaggtctggcgtggaaagaagactcctatggggttctcctatga

SEQ ID NO: 123246 - DNA, 75 bp, Artificial Sequence
  Synthetic
gaagctgcccatcaatccactaagcaactctctcatcagacaccacaacatggtgtattcaaccaccactcgcag

SEQ ID NO: 123247 - DNA, 75 bp, Artificial Sequence
  Synthetic
cgcagcactccgccaaaagaaagtgacatttgacagggtccaggtgctggatcagcactaccatgatgtacttaa

SEQ ID NO: 123248 - DNA, 75 bp, Artificial Sequence
  Synthetic
actgacgtgttacctcaaggccacggcagcagcccgggccgccggcctgaaagaccacagaatgatggtttgcgg

SEQ ID NO: 123249 - DNA, 75 bp, Artificial Sequence
  Synthetic
actgacgtgttacctcaaggccacggcagcagcccgggccgccggcctgaaagaccacagaatgttggtttgcgg

SEQ ID NO: 123250 - DNA, 75 bp, Artificial Sequence
  Synthetic
actgacgtgttacctcaaggccacggcagcagcccgggccgccggcctgaaagaccacagaatgctggtttgcgg

SEQ ID NO: 123251 - DNA, 75 bp, Artificial Sequence
  Synthetic
actgacgtgttacctcaaggccacggcagcagcccgggccgccggcctgaaagaccacagaatggtggtttgcgg

SEQ ID NO: 123252 - DNA, 75 bp, Artificial Sequence
  Synthetic
actgacgtgttacctcaaggccacggcagcagcccgggccgccggcctgaaagaccacagtatgatggtttgcgg

SEQ ID NO: 123253 - DNA, 75 bp, Artificial Sequence
  Synthetic
actgacgtgttacctcaaggccacggcagcagcccgggccgccggcctgaaagaccacagtatgttggtttgcgg

SEQ ID NO: 123254 - DNA, 75 bp, Artificial Sequence
  Synthetic
actgacgtgttacctcaaggccacggcagcagcccgggccgccggcctgaaagaccacagtatgctggtttgcgg

SEQ ID NO: 123255 - DNA, 75 bp, Artificial Sequence
  Synthetic
actgacgtgttacctcaaggccacggcagcagcccgggccgccggcctgaaagaccacagtatggtggtttgcgg

SEQ ID NO: 123256 - DNA, 75 bp, Artificial Sequence
  Synthetic
actgacgtgttacctcaaggccacggcagcagcccgggccgccggcctgaaagaccacagcatgatggtttgcgg

SEQ ID NO: 123257 - DNA, 75 bp, Artificial Sequence
  Synthetic
actgacgtgttacctcaaggccacggcagcagcccgggccgccggcctgaaagaccacagcatgttggtttgcgg

SEQ ID NO: 123258 - DNA, 75 bp, Artificial Sequence
  Synthetic
actgacgtgttacctcaaggccacggcagcagcccgggccgccggcctgaaagaccacagcatgctggtttgcgg

SEQ ID NO: 123259 - DNA, 75 bp, Artificial Sequence
  Synthetic
actgacgtgttacctcaaggccacggcagcagcccgggccgccggcctgaaagaccacagcatggtggtttgcgg

SEQ ID NO: 123260 - DNA, 75 bp, Artificial Sequence
  Synthetic
actgacgtgttacctcaaggccacggcagcagcccgggccgccggcctgaaagaccacaggatgatggtttgcgg

SEQ ID NO: 123261 - DNA, 75 bp, Artificial Sequence
  Synthetic
actgacgtgttacctcaaggccacggcagcagcccgggccgccggcctgaaagaccacaggatgttggtttgcgg

SEQ ID NO: 123262 - DNA, 75 bp, Artificial Sequence
  Synthetic
actgacgtgttacctcaaggccacggcagcagcccgggccgccggcctgaaagaccacaggatgctggtttgcgg

SEQ ID NO: 123263 - DNA, 75 bp, Artificial Sequence
  Synthetic
actgacgtgttacctcaaggccacggcagcagcccgggccgccggcctgaaagaccacaggatggtggtttgcgg

SEQ ID NO: 123264 - DNA, 75 bp, Artificial Sequence
  Synthetic
tacatcaggcatataccatgtcaccaacgactgtcccaacgcgagcattgtgtatgaagctgagtctgtcattct

SEQ ID NO: 123265 - DNA, 75 bp, Artificial Sequence
  Synthetic
acacacctcaccgaacggctgtactgtggtggccccatgtacaattcacgaggccaatcatgcgggtatcggaga

SEQ ID NO: 123266 - DNA, 75 bp, Artificial Sequence
  Synthetic
ggtgacgcaccgcagccagcgtatgacctggagctgataacatcgtgctcctccaatgtctcggtcgcgcatgac

SEQ ID NO: 123267 - DNA, 75 bp, Artificial Sequence
  Synthetic
acatgttggtctgcggagatgatctggtcgtgatctcagagagcgcaggcgtacccgaggacgaggccgccctgc

SEQ ID NO: 123268 - DNA, 75 bp, Artificial Sequence
  Synthetic
agccaaacttctccctcgcctgccggggatccccttcctctcgtgccaaacgggatataggggagtctgggcagg

SEQ ID NO: 123269 - DNA, 75 bp, Artificial Sequence
  Synthetic
ggccgtccccaacgcctccgtacagttccagggcttccgtggccacgtcgacctcatggttggcgctgccgcgtt

SEQ ID NO: 123270 - DNA, 75 bp, Artificial Sequence
  Synthetic
caaccattatggctaagaatgaagtgttctgtgtggacgtccggaagggtggtcggaaaccagcccggctcatcg

SEQ ID NO: 123271 - DNA, 75 bp, Artificial Sequence
  Synthetic
ggacggagtgtgccacaccacttgcacctgtggggccgtgatagctggacacgtcaaaaatggcaccatgaaaat

SEQ ID NO: 123272 - DNA, 75 bp, Artificial Sequence
  Synthetic
ggggggggaaaaagggtgtactacctcacacgagaccctgaaacccccatcgcgcgagccgcgtgggaaacagtc

SEQ ID NO: 123273 - DNA, 75 bp, Artificial Sequence
  Synthetic
ctccgtagcccacgatggaacaggacagagatattactacctcacacgtgacccaaccacacccattgctcgagc

SEQ ID NO: 123274 - DNA, 75 bp, Artificial Sequence
  Synthetic
cctggatcactgaagattgcccagtcccatgttcggggtcttggctccgggacatttgggattgggtttgttcca

SEQ ID NO: 123275 - DNA, 75 bp, Artificial Sequence
  Synthetic
cgaggcaggactggtaggggcaggatgggcatctataggtttgtgactccaggagaacggccctcgggcatgttc

SEQ ID NO: 123276 - DNA, 75 bp, Artificial Sequence
  Synthetic
gccatgtccgcatgggcaccatgaaaataacaggcccgaagacctgcttgaacctgtggcagggaaccttcccca

SEQ ID NO: 123277 - DNA, 75 bp, Artificial Sequence
  Synthetic
gtatggtgggcaattggctgaaggtggtggggatcttggtcctagttgctggcacggatgcgaccacccacatcg

SEQ ID NO: 123278 - DNA, 75 bp, Artificial Sequence
  Synthetic
ttcttcgggatattacagtcccaagagcagttggagaaagcactggacttcgacatatacggagtcacatactct

SEQ ID NO: 123279 - DNA, 75 bp, Artificial Sequence
  Synthetic
gttagagcctgcagcacggacagccattacatcgctcactgaccgattgtactgcggtggtcccatgtccaactc

SEQ ID NO: 123280 - DNA, 75 bp, Artificial Sequence
  Synthetic
agccaaaatatgtggcatctacctcttcaactgggcggtgaaaaccaagctcaaactcactccattgcccgcagc

SEQ ID NO: 123281 - DNA, 75 bp, Artificial Sequence
  Synthetic
tatcaaccgcacagcgctcaactgcaatgattcccttcagacggggtttttggccggcctgttctattatcacaa

SEQ ID NO: 123282 - DNA, 75 bp, Artificial Sequence
  Synthetic
cgagcctcaggaagctcggggcgcccccattgagagcctggagacatagggcccgagcagtcagagccaagttaa

SEQ ID NO: 123283 - DNA, 75 bp, Artificial Sequence
  Synthetic
tgggttcattactgcgctgttctacaggcacaatatcaactcgataggatgccctgagcgcatggccagctgccg

SEQ ID NO: 123284 - DNA, 75 bp, Artificial Sequence
  Synthetic
ctccaccgaggacctggttaatttactccctgccatcctctctcccggcgccctggtcgtcggggtcgtgtgtgc

SEQ ID NO: 123285 - DNA, 75 bp, Artificial Sequence
  Synthetic
cccctttggattcttcaagccagtttgcttaaagtaccctactttgtgcgcgttcaaggccttctccggatctgc

SEQ ID NO: 123286 - DNA, 75 bp, Artificial Sequence
  Synthetic
ccatcgaacgacaagccctactgctggcattacgcccccagaccctgcgagacggtgccagcgaaggaagtctgc

SEQ ID NO: 123287 - DNA, 75 bp, Artificial Sequence
  Synthetic
tgacttgtcaaattggttcacggctggctacggcgggggggacatatatcacagcgtgtcctgggcccgaccccg

SEQ ID NO: 123288 - DNA, 75 bp, Artificial Sequence
  Synthetic
ctactcctactctcagtaggggtaggcatcttcttactgcccgcccggtaggcgggtaacactccgaccttagcg

SEQ ID NO: 123289 - DNA, 75 bp, Artificial Sequence
  Synthetic
cttattactcctgtgcctgctcctacttaccgtaggggtaggcatctttctgcttcccgcccggtaggcggttag

SEQ ID NO: 123290 - DNA, 75 bp, Artificial Sequence
  Synthetic
caggtactcagctcctcctggagacgaaccacggccggagtacgaccttgagctgattacatcttgctcttcaaa

SEQ ID NO: 123291 - DNA, 75 bp, Artificial Sequence
  Synthetic
tcttgctgatgagcttgcggccccctagtggggggtggttcgggtgtacttggatgaactccagtggattcctca

SEQ ID NO: 123292 - DNA, 75 bp, Artificial Sequence
  Synthetic
ggaggaggatgagagggaagtatccgttccggcggagatcctgcggaaatccaggaaattccccccagcgatgcc

SEQ ID NO: 123293 - DNA, 75 bp, Artificial Sequence
  Synthetic
aagaaacactccataaagcgcttgacttcgacatgtacggagtcacatattctatcactccattggatttacctc

SEQ ID NO: 123294 - DNA, 75 bp, Artificial Sequence
  Synthetic
acccggactacgtccctccggtggtacacgggtgcccattgccacctgctaaggcccctccaataccacctccac

SEQ ID NO: 123295 - DNA, 75 bp, Artificial Sequence
  Synthetic
ctctcgctgcggctcagggccttggctcacgccgcggtgccttgtggactatccgtacaggctgtggcattaccc

SEQ ID NO: 123296 - DNA, 75 bp, Artificial Sequence
  Synthetic
ctatccatacaggctttggcactacccctgcactgtcaactttaccatcttcaaggtcaggatgtatgtgggggg

SEQ ID NO: 123297 - DNA, 75 bp, Artificial Sequence
  Synthetic
gagttagacgacagagacagggttgaaatgagcccactgttgttttctaccactgagctttcaatattgccttgc

SEQ ID NO: 123298 - DNA, 75 bp, Artificial Sequence
  Synthetic
gagtttgacgacagagacagggttgaaatgagcccactgttgttttctaccactgagctttcaatattgccttgc

SEQ ID NO: 123299 - DNA, 75 bp, Artificial Sequence
  Synthetic
gagttcgacgacagagacagggttgaaatgagcccactgttgttttctaccactgagctttcaatattgccttgc

SEQ ID NO: 123300 - DNA, 75 bp, Artificial Sequence
  Synthetic
gagttggacgacagagacagggttgaaatgagcccactgttgttttctaccactgagctttcaatattgccttgc

SEQ ID NO: 123301 - DNA, 75 bp, Artificial Sequence
  Synthetic
ggtcttggtctaccgtgagcgaggaggccagtgaggacgtcgtctgctgctcgatgtcctacacatggacaggcg

SEQ ID NO: 123302 - DNA, 75 bp, Artificial Sequence
  Synthetic
cgtgggccgtgaagtgggagtacgtggtcctggccttcttggtgcttgctgatgcgcgtatttgcgcctgcctgt

SEQ ID NO: 123303 - DNA, 75 bp, Artificial Sequence
  Synthetic
agacatcacaacatggtgtactccaccacatcacgcagcgccagcctccgccagaagaaggtcacatttgacaga

SEQ ID NO: 123304 - DNA, 75 bp, Artificial Sequence
  Synthetic
ctactttccgtaggggtaggcatcttcctgcttcccgctcggtaggcgggaagtttaaagctacactccactaat

SEQ ID NO: 123305 - DNA, 75 bp, Artificial Sequence
  Synthetic
tacagtgtgtgctcgagctaaagctccccccccatcatgggacaacatgtggaagtgcctcatacggctcaagcc

SEQ ID NO: 123306 - DNA, 75 bp, Artificial Sequence
  Synthetic
ttgacgagacagccgccacggaggcgctcgcagagctagcccggaaatcatttccaccagatccaccaaaatccg

SEQ ID NO: 123307 - DNA, 75 bp, Artificial Sequence
  Synthetic
ttgacgagacagccgccacggaggcgctcgctgagctagcccggaaatcatttccaccagatccaccaaaatccg

SEQ ID NO: 123308 - DNA, 75 bp, Artificial Sequence
  Synthetic
ttgacgagacagccgccacggaggcgctcgccgagctagcccggaaatcatttccaccagatccaccaaaatccg

SEQ ID NO: 123309 - DNA, 75 bp, Artificial Sequence
  Synthetic
ttgacgagacagccgccacggaggcgctcgcggagctagcccggaaatcatttccaccagatccaccaaaatccg

SEQ ID NO: 123310 - DNA, 75 bp, Artificial Sequence
  Synthetic
ttgacgagactgccgccacggaggcgctcgcagagctagcccggaaatcatttccaccagatccaccaaaatccg

SEQ ID NO: 123311 - DNA, 75 bp, Artificial Sequence
  Synthetic
ttgacgagactgccgccacggaggcgctcgctgagctagcccggaaatcatttccaccagatccaccaaaatccg

SEQ ID NO: 123312 - DNA, 75 bp, Artificial Sequence
  Synthetic
ttgacgagactgccgccacggaggcgctcgccgagctagcccggaaatcatttccaccagatccaccaaaatccg

SEQ ID NO: 123313 - DNA, 75 bp, Artificial Sequence
  Synthetic
ttgacgagactgccgccacggaggcgctcgcggagctagcccggaaatcatttccaccagatccaccaaaatccg

SEQ ID NO: 123314 - DNA, 75 bp, Artificial Sequence
  Synthetic
ttgacgagaccgccgccacggaggcgctcgcagagctagcccggaaatcatttccaccagatccaccaaaatccg

SEQ ID NO: 123315 - DNA, 75 bp, Artificial Sequence
  Synthetic
ttgacgagaccgccgccacggaggcgctcgctgagctagcccggaaatcatttccaccagatccaccaaaatccg

SEQ ID NO: 123316 - DNA, 75 bp, Artificial Sequence
  Synthetic
ttgacgagaccgccgccacggaggcgctcgccgagctagcccggaaatcatttccaccagatccaccaaaatccg

SEQ ID NO: 123317 - DNA, 75 bp, Artificial Sequence
  Synthetic
ttgacgagaccgccgccacggaggcgctcgcggagctagcccggaaatcatttccaccagatccaccaaaatccg

SEQ ID NO: 123318 - DNA, 75 bp, Artificial Sequence
  Synthetic
ttgacgagacggccgccacggaggcgctcgcagagctagcccggaaatcatttccaccagatccaccaaaatccg

SEQ ID NO: 123319 - DNA, 75 bp, Artificial Sequence
  Synthetic
ttgacgagacggccgccacggaggcgctcgctgagctagcccggaaatcatttccaccagatccaccaaaatccg

SEQ ID NO: 123320 - DNA, 75 bp, Artificial Sequence
  Synthetic
ttgacgagacggccgccacggaggcgctcgccgagctagcccggaaatcatttccaccagatccaccaaaatccg

SEQ ID NO: 123321 - DNA, 75 bp, Artificial Sequence
  Synthetic
ttgacgagacggccgccacggaggcgctcgcggagctagcccggaaatcatttccaccagatccaccaaaatccg

SEQ ID NO: 123322 - DNA, 75 bp, Artificial Sequence
  Synthetic
ttgacgagtcagccgccacggaggcgctcgcagagctagcccggaaatcatttccaccagatccaccaaaatccg

SEQ ID NO: 123323 - DNA, 75 bp, Artificial Sequence
  Synthetic
ttgacgagtcagccgccacggaggcgctcgctgagctagcccggaaatcatttccaccagatccaccaaaatccg

SEQ ID NO: 123324 - DNA, 75 bp, Artificial Sequence
  Synthetic
ttgacgagtcagccgccacggaggcgctcgccgagctagcccggaaatcatttccaccagatccaccaaaatccg

SEQ ID NO: 123325 - DNA, 75 bp, Artificial Sequence
  Synthetic
ttgacgagtcagccgccacggaggcgctcgcggagctagcccggaaatcatttccaccagatccaccaaaatccg

SEQ ID NO: 123326 - DNA, 75 bp, Artificial Sequence
  Synthetic
ttgacgagtctgccgccacggaggcgctcgcagagctagcccggaaatcatttccaccagatccaccaaaatccg

SEQ ID NO: 123327 - DNA, 75 bp, Artificial Sequence
  Synthetic
ttgacgagtctgccgccacggaggcgctcgctgagctagcccggaaatcatttccaccagatccaccaaaatccg

SEQ ID NO: 123328 - DNA, 75 bp, Artificial Sequence
  Synthetic
ttgacgagtctgccgccacggaggcgctcgccgagctagcccggaaatcatttccaccagatccaccaaaatccg

SEQ ID NO: 123329 - DNA, 75 bp, Artificial Sequence
  Synthetic
ttgacgagtctgccgccacggaggcgctcgcggagctagcccggaaatcatttccaccagatccaccaaaatccg

SEQ ID NO: 123330 - DNA, 75 bp, Artificial Sequence
  Synthetic
ttgacgagtccgccgccacggaggcgctcgcagagctagcccggaaatcatttccaccagatccaccaaaatccg

SEQ ID NO: 123331 - DNA, 75 bp, Artificial Sequence
  Synthetic
ttgacgagtccgccgccacggaggcgctcgctgagctagcccggaaatcatttccaccagatccaccaaaatccg

SEQ ID NO: 123332 - DNA, 75 bp, Artificial Sequence
  Synthetic
ttgacgagtccgccgccacggaggcgctcgccgagctagcccggaaatcatttccaccagatccaccaaaatccg

SEQ ID NO: 123333 - DNA, 75 bp, Artificial Sequence
  Synthetic
ttgacgagtccgccgccacggaggcgctcgcggagctagcccggaaatcatttccaccagatccaccaaaatccg

SEQ ID NO: 123334 - DNA, 75 bp, Artificial Sequence
  Synthetic
ttgacgagtcggccgccacggaggcgctcgcagagctagcccggaaatcatttccaccagatccaccaaaatccg

SEQ ID NO: 123335 - DNA, 75 bp, Artificial Sequence
  Synthetic
ttgacgagtcggccgccacggaggcgctcgctgagctagcccggaaatcatttccaccagatccaccaaaatccg

SEQ ID NO: 123336 - DNA, 75 bp, Artificial Sequence
  Synthetic
ttgacgagtcggccgccacggaggcgctcgccgagctagcccggaaatcatttccaccagatccaccaaaatccg

SEQ ID NO: 123337 - DNA, 75 bp, Artificial Sequence
  Synthetic
ttgacgagtcggccgccacggaggcgctcgcggagctagcccggaaatcatttccaccagatccaccaaaatccg

SEQ ID NO: 123338 - DNA, 75 bp, Artificial Sequence
  Synthetic
ttgacgagccagccgccacggaggcgctcgcagagctagcccggaaatcatttccaccagatccaccaaaatccg

SEQ ID NO: 123339 - DNA, 75 bp, Artificial Sequence
  Synthetic
ttgacgagccagccgccacggaggcgctcgctgagctagcccggaaatcatttccaccagatccaccaaaatccg

SEQ ID NO: 123340 - DNA, 75 bp, Artificial Sequence
  Synthetic
ttgacgagccagccgccacggaggcgctcgccgagctagcccggaaatcatttccaccagatccaccaaaatccg

SEQ ID NO: 123341 - DNA, 75 bp, Artificial Sequence
  Synthetic
ttgacgagccagccgccacggaggcgctcgcggagctagcccggaaatcatttccaccagatccaccaaaatccg

SEQ ID NO: 123342 - DNA, 75 bp, Artificial Sequence
  Synthetic
ttgacgagcctgccgccacggaggcgctcgcagagctagcccggaaatcatttccaccagatccaccaaaatccg

SEQ ID NO: 123343 - DNA, 75 bp, Artificial Sequence
  Synthetic
ttgacgagcctgccgccacggaggcgctcgctgagctagcccggaaatcatttccaccagatccaccaaaatccg

SEQ ID NO: 123344 - DNA, 75 bp, Artificial Sequence
  Synthetic
ttgacgagcctgccgccacggaggcgctcgccgagctagcccggaaatcatttccaccagatccaccaaaatccg

SEQ ID NO: 123345 - DNA, 75 bp, Artificial Sequence
  Synthetic
ttgacgagcctgccgccacggaggcgctcgcggagctagcccggaaatcatttccaccagatccaccaaaatccg

SEQ ID NO: 123346 - DNA, 75 bp, Artificial Sequence
  Synthetic
ttgacgagcccgccgccacggaggcgctcgcagagctagcccggaaatcatttccaccagatccaccaaaatccg

SEQ ID NO: 123347 - DNA, 75 bp, Artificial Sequence
  Synthetic
ttgacgagcccgccgccacggaggcgctcgctgagctagcccggaaatcatttccaccagatccaccaaaatccg

SEQ ID NO: 123348 - DNA, 75 bp, Artificial Sequence
  Synthetic
ttgacgagcccgccgccacggaggcgctcgccgagctagcccggaaatcatttccaccagatccaccaaaatccg

SEQ ID NO: 123349 - DNA, 75 bp, Artificial Sequence
  Synthetic
ttgacgagcccgccgccacggaggcgctcgcggagctagcccggaaatcatttccaccagatccaccaaaatccg

SEQ ID NO: 123350 - DNA, 75 bp, Artificial Sequence
  Synthetic
ttgacgagccggccgccacggaggcgctcgcagagctagcccggaaatcatttccaccagatccaccaaaatccg

SEQ ID NO: 123351 - DNA, 75 bp, Artificial Sequence
  Synthetic
ttgacgagccggccgccacggaggcgctcgctgagctagcccggaaatcatttccaccagatccaccaaaatccg

SEQ ID NO: 123352 - DNA, 75 bp, Artificial Sequence
  Synthetic
ttgacgagccggccgccacggaggcgctcgccgagctagcccggaaatcatttccaccagatccaccaaaatccg

SEQ ID NO: 123353 - DNA, 75 bp, Artificial Sequence
  Synthetic
ttgacgagccggccgccacggaggcgctcgcggagctagcccggaaatcatttccaccagatccaccaaaatccg

SEQ ID NO: 123354 - DNA, 75 bp, Artificial Sequence
  Synthetic
ttgacgaggcagccgccacggaggcgctcgcagagctagcccggaaatcatttccaccagatccaccaaaatccg

SEQ ID NO: 123355 - DNA, 75 bp, Artificial Sequence
  Synthetic
ttgacgaggcagccgccacggaggcgctcgctgagctagcccggaaatcatttccaccagatccaccaaaatccg

SEQ ID NO: 123356 - DNA, 75 bp, Artificial Sequence
  Synthetic
ttgacgaggcagccgccacggaggcgctcgccgagctagcccggaaatcatttccaccagatccaccaaaatccg

SEQ ID NO: 123357 - DNA, 75 bp, Artificial Sequence
  Synthetic
ttgacgaggcagccgccacggaggcgctcgcggagctagcccggaaatcatttccaccagatccaccaaaatccg

SEQ ID NO: 123358 - DNA, 75 bp, Artificial Sequence
  Synthetic
ttgacgaggctgccgccacggaggcgctcgcagagctagcccggaaatcatttccaccagatccaccaaaatccg

SEQ ID NO: 123359 - DNA, 75 bp, Artificial Sequence
  Synthetic
ttgacgaggctgccgccacggaggcgctcgctgagctagcccggaaatcatttccaccagatccaccaaaatccg

SEQ ID NO: 123360 - DNA, 75 bp, Artificial Sequence
  Synthetic
ttgacgaggctgccgccacggaggcgctcgccgagctagcccggaaatcatttccaccagatccaccaaaatccg

SEQ ID NO: 123361 - DNA, 75 bp, Artificial Sequence
  Synthetic
ttgacgaggctgccgccacggaggcgctcgcggagctagcccggaaatcatttccaccagatccaccaaaatccg

SEQ ID NO: 123362 - DNA, 75 bp, Artificial Sequence
  Synthetic
ttgacgaggccgccgccacggaggcgctcgcagagctagcccggaaatcatttccaccagatccaccaaaatccg

SEQ ID NO: 123363 - DNA, 75 bp, Artificial Sequence
  Synthetic
ttgacgaggccgccgccacggaggcgctcgctgagctagcccggaaatcatttccaccagatccaccaaaatccg

SEQ ID NO: 123364 - DNA, 75 bp, Artificial Sequence
  Synthetic
ttgacgaggccgccgccacggaggcgctcgccgagctagcccggaaatcatttccaccagatccaccaaaatccg

SEQ ID NO: 123365 - DNA, 75 bp, Artificial Sequence
  Synthetic
ttgacgaggccgccgccacggaggcgctcgcggagctagcccggaaatcatttccaccagatccaccaaaatccg

SEQ ID NO: 123366 - DNA, 75 bp, Artificial Sequence
  Synthetic
ttgacgaggcggccgccacggaggcgctcgcagagctagcccggaaatcatttccaccagatccaccaaaatccg

SEQ ID NO: 123367 - DNA, 75 bp, Artificial Sequence
  Synthetic
ttgacgaggcggccgccacggaggcgctcgctgagctagcccggaaatcatttccaccagatccaccaaaatccg

SEQ ID NO: 123368 - DNA, 75 bp, Artificial Sequence
  Synthetic
ttgacgaggcggccgccacggaggcgctcgccgagctagcccggaaatcatttccaccagatccaccaaaatccg

SEQ ID NO: 123369 - DNA, 75 bp, Artificial Sequence
  Synthetic
ttgacgaggcggccgccacggaggcgctcgcggagctagcccggaaatcatttccaccagatccaccaaaatccg

SEQ ID NO: 123370 - DNA, 75 bp, Artificial Sequence
  Synthetic
tgtgtgaagaccgggaaccgctcgcgatgctggacggccttgacacccactatggctgccccctacctttcggcc

SEQ ID NO: 123371 - DNA, 75 bp, Artificial Sequence
  Synthetic
tactcttgaccttgtcaccacactataaagtgttcctcgctaggctcatatggtggttacaatattttatcacca

SEQ ID NO: 123372 - DNA, 75 bp, Artificial Sequence
  Synthetic
atcttcaccataacgcccctctacaaggaaatgcttgcccgcctgatatggtggaaccagtattttattgcgagg

SEQ ID NO: 123373 - DNA, 75 bp, Artificial Sequence
  Synthetic
atcttcaccataacgcccctctacaaggtaatgcttgcccgcctgatatggtggaaccagtattttattgcgagg

SEQ ID NO: 123374 - DNA, 75 bp, Artificial Sequence
  Synthetic
atcttcaccataacgcccctctacaaggcaatgcttgcccgcctgatatggtggaaccagtattttattgcgagg

SEQ ID NO: 123375 - DNA, 75 bp, Artificial Sequence
  Synthetic
atcttcaccataacgcccctctacaagggaatgcttgcccgcctgatatggtggaaccagtattttattgcgagg

SEQ ID NO: 123376 - DNA, 75 bp, Artificial Sequence
  Synthetic
atcttcaccataacgcccctctactaggaaatgcttgcccgcctgatatggtggaaccagtattttattgcgagg

SEQ ID NO: 123377 - DNA, 75 bp, Artificial Sequence
  Synthetic
atcttcaccataacgcccctctactaggtaatgcttgcccgcctgatatggtggaaccagtattttattgcgagg

SEQ ID NO: 123378 - DNA, 75 bp, Artificial Sequence
  Synthetic
atcttcaccataacgcccctctactaggcaatgcttgcccgcctgatatggtggaaccagtattttattgcgagg

SEQ ID NO: 123379 - DNA, 75 bp, Artificial Sequence
  Synthetic
atcttcaccataacgcccctctactagggaatgcttgcccgcctgatatggtggaaccagtattttattgcgagg

SEQ ID NO: 123380 - DNA, 75 bp, Artificial Sequence
  Synthetic
atcttcaccataacgcccctctaccaggaaatgcttgcccgcctgatatggtggaaccagtattttattgcgagg

SEQ ID NO: 123381 - DNA, 75 bp, Artificial Sequence
  Synthetic
atcttcaccataacgcccctctaccaggtaatgcttgcccgcctgatatggtggaaccagtattttattgcgagg

SEQ ID NO: 123382 - DNA, 75 bp, Artificial Sequence
  Synthetic
atcttcaccataacgcccctctaccaggcaatgcttgcccgcctgatatggtggaaccagtattttattgcgagg

SEQ ID NO: 123383 - DNA, 75 bp, Artificial Sequence
  Synthetic
atcttcaccataacgcccctctaccagggaatgcttgcccgcctgatatggtggaaccagtattttattgcgagg

SEQ ID NO: 123384 - DNA, 75 bp, Artificial Sequence
  Synthetic
atcttcaccataacgcccctctacgaggaaatgcttgcccgcctgatatggtggaaccagtattttattgcgagg

SEQ ID NO: 123385 - DNA, 75 bp, Artificial Sequence
  Synthetic
atcttcaccataacgcccctctacgaggtaatgcttgcccgcctgatatggtggaaccagtattttattgcgagg

SEQ ID NO: 123386 - DNA, 75 bp, Artificial Sequence
  Synthetic
atcttcaccataacgcccctctacgaggcaatgcttgcccgcctgatatggtggaaccagtattttattgcgagg

SEQ ID NO: 123387 - DNA, 75 bp, Artificial Sequence
  Synthetic
atcttcaccataacgcccctctacgagggaatgcttgcccgcctgatatggtggaaccagtattttattgcgagg

SEQ ID NO: 123388 - DNA, 75 bp, Artificial Sequence
  Synthetic
atcttcaccataacgcccctcttcaaggaaatgcttgcccgcctgatatggtggaaccagtattttattgcgagg

SEQ ID NO: 123389 - DNA, 75 bp, Artificial Sequence
  Synthetic
atcttcaccataacgcccctcttcaaggtaatgcttgcccgcctgatatggtggaaccagtattttattgcgagg

SEQ ID NO: 123390 - DNA, 75 bp, Artificial Sequence
  Synthetic
atcttcaccataacgcccctcttcaaggcaatgcttgcccgcctgatatggtggaaccagtattttattgcgagg

SEQ ID NO: 123391 - DNA, 75 bp, Artificial Sequence
  Synthetic
atcttcaccataacgcccctcttcaagggaatgcttgcccgcctgatatggtggaaccagtattttattgcgagg

SEQ ID NO: 123392 - DNA, 75 bp, Artificial Sequence
  Synthetic
atcttcaccataacgcccctcttctaggaaatgcttgcccgcctgatatggtggaaccagtattttattgcgagg

SEQ ID NO: 123393 - DNA, 75 bp, Artificial Sequence
  Synthetic
atcttcaccataacgcccctcttctaggtaatgcttgcccgcctgatatggtggaaccagtattttattgcgagg

SEQ ID NO: 123394 - DNA, 75 bp, Artificial Sequence
  Synthetic
atcttcaccataacgcccctcttctaggcaatgcttgcccgcctgatatggtggaaccagtattttattgcgagg

SEQ ID NO: 123395 - DNA, 75 bp, Artificial Sequence
  Synthetic
atcttcaccataacgcccctcttctagggaatgcttgcccgcctgatatggtggaaccagtattttattgcgagg

SEQ ID NO: 123396 - DNA, 75 bp, Artificial Sequence
  Synthetic
atcttcaccataacgcccctcttccaggaaatgcttgcccgcctgatatggtggaaccagtattttattgcgagg

SEQ ID NO: 123397 - DNA, 75 bp, Artificial Sequence
  Synthetic
atcttcaccataacgcccctcttccaggtaatgcttgcccgcctgatatggtggaaccagtattttattgcgagg

SEQ ID NO: 123398 - DNA, 75 bp, Artificial Sequence
  Synthetic
atcttcaccataacgcccctcttccaggcaatgcttgcccgcctgatatggtggaaccagtattttattgcgagg

SEQ ID NO: 123399 - DNA, 75 bp, Artificial Sequence
  Synthetic
atcttcaccataacgcccctcttccagggaatgcttgcccgcctgatatggtggaaccagtattttattgcgagg

SEQ ID NO: 123400 - DNA, 75 bp, Artificial Sequence
  Synthetic
atcttcaccataacgcccctcttcgaggaaatgcttgcccgcctgatatggtggaaccagtattttattgcgagg

SEQ ID NO: 123401 - DNA, 75 bp, Artificial Sequence
  Synthetic
atcttcaccataacgcccctcttcgaggtaatgcttgcccgcctgatatggtggaaccagtattttattgcgagg

SEQ ID NO: 123402 - DNA, 75 bp, Artificial Sequence
  Synthetic
atcttcaccataacgcccctcttcgaggcaatgcttgcccgcctgatatggtggaaccagtattttattgcgagg

SEQ ID NO: 123403 - DNA, 75 bp, Artificial Sequence
  Synthetic
atcttcaccataacgcccctcttcgagggaatgcttgcccgcctgatatggtggaaccagtattttattgcgagg

SEQ ID NO: 123404 - DNA, 75 bp, Artificial Sequence
  Synthetic
atcttcaccataacgcccctctccaaggaaatgcttgcccgcctgatatggtggaaccagtattttattgcgagg

SEQ ID NO: 123405 - DNA, 75 bp, Artificial Sequence
  Synthetic
atcttcaccataacgcccctctccaaggtaatgcttgcccgcctgatatggtggaaccagtattttattgcgagg

SEQ ID NO: 123406 - DNA, 75 bp, Artificial Sequence
  Synthetic
atcttcaccataacgcccctctccaaggcaatgcttgcccgcctgatatggtggaaccagtattttattgcgagg

SEQ ID NO: 123407 - DNA, 75 bp, Artificial Sequence
  Synthetic
atcttcaccataacgcccctctccaagggaatgcttgcccgcctgatatggtggaaccagtattttattgcgagg

SEQ ID NO: 123408 - DNA, 75 bp, Artificial Sequence
  Synthetic
atcttcaccataacgcccctctcctaggaaatgcttgcccgcctgatatggtggaaccagtattttattgcgagg

SEQ ID NO: 123409 - DNA, 75 bp, Artificial Sequence
  Synthetic
atcttcaccataacgcccctctcctaggtaatgcttgcccgcctgatatggtggaaccagtattttattgcgagg

SEQ ID NO: 123410 - DNA, 75 bp, Artificial Sequence
  Synthetic
atcttcaccataacgcccctctcctaggcaatgcttgcccgcctgatatggtggaaccagtattttattgcgagg

SEQ ID NO: 123411 - DNA, 75 bp, Artificial Sequence
  Synthetic
atcttcaccataacgcccctctcctagggaatgcttgcccgcctgatatggtggaaccagtattttattgcgagg

SEQ ID NO: 123412 - DNA, 75 bp, Artificial Sequence
  Synthetic
atcttcaccataacgcccctctcccaggaaatgcttgcccgcctgatatggtggaaccagtattttattgcgagg

SEQ ID NO: 123413 - DNA, 75 bp, Artificial Sequence
  Synthetic
atcttcaccataacgcccctctcccaggtaatgcttgcccgcctgatatggtggaaccagtattttattgcgagg

SEQ ID NO: 123414 - DNA, 75 bp, Artificial Sequence
  Synthetic
atcttcaccataacgcccctctcccaggcaatgcttgcccgcctgatatggtggaaccagtattttattgcgagg

SEQ ID NO: 123415 - DNA, 75 bp, Artificial Sequence
  Synthetic
atcttcaccataacgcccctctcccagggaatgcttgcccgcctgatatggtggaaccagtattttattgcgagg

SEQ ID NO: 123416 - DNA, 75 bp, Artificial Sequence
  Synthetic
atcttcaccataacgcccctctccgaggaaatgcttgcccgcctgatatggtggaaccagtattttattgcgagg

SEQ ID NO: 123417 - DNA, 75 bp, Artificial Sequence
  Synthetic
atcttcaccataacgcccctctccgaggtaatgcttgcccgcctgatatggtggaaccagtattttattgcgagg

SEQ ID NO: 123418 - DNA, 75 bp, Artificial Sequence
  Synthetic
atcttcaccataacgcccctctccgaggcaatgcttgcccgcctgatatggtggaaccagtattttattgcgagg

SEQ ID NO: 123419 - DNA, 75 bp, Artificial Sequence
  Synthetic
atcttcaccataacgcccctctccgagggaatgcttgcccgcctgatatggtggaaccagtattttattgcgagg

SEQ ID NO: 123420 - DNA, 75 bp, Artificial Sequence
  Synthetic
atcttcaccataacgcccctctgcaaggaaatgcttgcccgcctgatatggtggaaccagtattttattgcgagg

SEQ ID NO: 123421 - DNA, 75 bp, Artificial Sequence
  Synthetic
atcttcaccataacgcccctctgcaaggtaatgcttgcccgcctgatatggtggaaccagtattttattgcgagg

SEQ ID NO: 123422 - DNA, 75 bp, Artificial Sequence
  Synthetic
atcttcaccataacgcccctctgcaaggcaatgcttgcccgcctgatatggtggaaccagtattttattgcgagg

SEQ ID NO: 123423 - DNA, 75 bp, Artificial Sequence
  Synthetic
atcttcaccataacgcccctctgcaagggaatgcttgcccgcctgatatggtggaaccagtattttattgcgagg

SEQ ID NO: 123424 - DNA, 75 bp, Artificial Sequence
  Synthetic
atcttcaccataacgcccctctgctaggaaatgcttgcccgcctgatatggtggaaccagtattttattgcgagg

SEQ ID NO: 123425 - DNA, 75 bp, Artificial Sequence
  Synthetic
atcttcaccataacgcccctctgctaggtaatgcttgcccgcctgatatggtggaaccagtattttattgcgagg

SEQ ID NO: 123426 - DNA, 75 bp, Artificial Sequence
  Synthetic
atcttcaccataacgcccctctgctaggcaatgcttgcccgcctgatatggtggaaccagtattttattgcgagg

SEQ ID NO: 123427 - DNA, 75 bp, Artificial Sequence
  Synthetic
atcttcaccataacgcccctctgctagggaatgcttgcccgcctgatatggtggaaccagtattttattgcgagg

SEQ ID NO: 123428 - DNA, 75 bp, Artificial Sequence
  Synthetic
atcttcaccataacgcccctctgccaggaaatgcttgcccgcctgatatggtggaaccagtattttattgcgagg

SEQ ID NO: 123429 - DNA, 75 bp, Artificial Sequence
  Synthetic
atcttcaccataacgcccctctgccaggtaatgcttgcccgcctgatatggtggaaccagtattttattgcgagg

SEQ ID NO: 123430 - DNA, 75 bp, Artificial Sequence
  Synthetic
atcttcaccataacgcccctctgccaggcaatgcttgcccgcctgatatggtggaaccagtattttattgcgagg

SEQ ID NO: 123431 - DNA, 75 bp, Artificial Sequence
  Synthetic
atcttcaccataacgcccctctgccagggaatgcttgcccgcctgatatggtggaaccagtattttattgcgagg

SEQ ID NO: 123432 - DNA, 75 bp, Artificial Sequence
  Synthetic
atcttcaccataacgcccctctgcgaggaaatgcttgcccgcctgatatggtggaaccagtattttattgcgagg

SEQ ID NO: 123433 - DNA, 75 bp, Artificial Sequence
  Synthetic
atcttcaccataacgcccctctgcgaggtaatgcttgcccgcctgatatggtggaaccagtattttattgcgagg

SEQ ID NO: 123434 - DNA, 75 bp, Artificial Sequence
  Synthetic
atcttcaccataacgcccctctgcgaggcaatgcttgcccgcctgatatggtggaaccagtattttattgcgagg

SEQ ID NO: 123435 - DNA, 75 bp, Artificial Sequence
  Synthetic
atcttcaccataacgcccctctgcgagggaatgcttgcccgcctgatatggtggaaccagtattttattgcgagg

SEQ ID NO: 123436 - DNA, 75 bp, Artificial Sequence
  Synthetic
tgggacagatgttcaccttccagccgcgtcgccactggactgtacaagaatgcaattgttccatctataccggcc

SEQ ID NO: 123437 - DNA, 75 bp, Artificial Sequence
  Synthetic
tgggacagatgttcaccttccagccgcgtcgccactggactgttcaagaatgcaattgttccatctataccggcc

SEQ ID NO: 123438 - DNA, 75 bp, Artificial Sequence
  Synthetic
tgggacagatgttcaccttccagccgcgtcgccactggactgtccaagaatgcaattgttccatctataccggcc

SEQ ID NO: 123439 - DNA, 75 bp, Artificial Sequence
  Synthetic
tgggacagatgttcaccttccagccgcgtcgccactggactgtgcaagaatgcaattgttccatctataccggcc

SEQ ID NO: 123440 - DNA, 75 bp, Artificial Sequence
  Synthetic
tgggtcagatgttcaccttccagccgcgtcgccactggactgtacaagaatgcaattgttccatctataccggcc

SEQ ID NO: 123441 - DNA, 75 bp, Artificial Sequence
  Synthetic
tgggtcagatgttcaccttccagccgcgtcgccactggactgttcaagaatgcaattgttccatctataccggcc

SEQ ID NO: 123442 - DNA, 75 bp, Artificial Sequence
  Synthetic
tgggtcagatgttcaccttccagccgcgtcgccactggactgtccaagaatgcaattgttccatctataccggcc

SEQ ID NO: 123443 - DNA, 75 bp, Artificial Sequence
  Synthetic
tgggtcagatgttcaccttccagccgcgtcgccactggactgtgcaagaatgcaattgttccatctataccggcc

SEQ ID NO: 123444 - DNA, 75 bp, Artificial Sequence
  Synthetic
tgggccagatgttcaccttccagccgcgtcgccactggactgtacaagaatgcaattgttccatctataccggcc

SEQ ID NO: 123445 - DNA, 75 bp, Artificial Sequence
  Synthetic
tgggccagatgttcaccttccagccgcgtcgccactggactgttcaagaatgcaattgttccatctataccggcc

SEQ ID NO: 123446 - DNA, 75 bp, Artificial Sequence
  Synthetic
tgggccagatgttcaccttccagccgcgtcgccactggactgtccaagaatgcaattgttccatctataccggcc

SEQ ID NO: 123447 - DNA, 75 bp, Artificial Sequence
  Synthetic
tgggccagatgttcaccttccagccgcgtcgccactggactgtgcaagaatgcaattgttccatctataccggcc

SEQ ID NO: 123448 - DNA, 75 bp, Artificial Sequence
  Synthetic
tggggcagatgttcaccttccagccgcgtcgccactggactgtacaagaatgcaattgttccatctataccggcc

SEQ ID NO: 123449 - DNA, 75 bp, Artificial Sequence
  Synthetic
tggggcagatgttcaccttccagccgcgtcgccactggactgttcaagaatgcaattgttccatctataccggcc

SEQ ID NO: 123450 - DNA, 75 bp, Artificial Sequence
  Synthetic
tggggcagatgttcaccttccagccgcgtcgccactggactgtccaagaatgcaattgttccatctataccggcc

SEQ ID NO: 123451 - DNA, 75 bp, Artificial Sequence
  Synthetic
tggggcagatgttcaccttccagccgcgtcgccactggactgtgcaagaatgcaattgttccatctataccggcc

SEQ ID NO: 123452 - DNA, 75 bp, Artificial Sequence
  Synthetic
tccccccactacaggtgcggggggctcgagattcaatcatcctgctagcatgtctcctccatccacggctggtct

SEQ ID NO: 123453 - DNA, 75 bp, Artificial Sequence
  Synthetic
tccccccactacaggtgcggggggctcgagattctatcatcctgctagcatgtctcctccatccacggctggtct

SEQ ID NO: 123454 - DNA, 75 bp, Artificial Sequence
  Synthetic
tccccccactacaggtgcggggggctcgagattccatcatcctgctagcatgtctcctccatccacggctggtct

SEQ ID NO: 123455 - DNA, 75 bp, Artificial Sequence
  Synthetic
tccccccactacaggtgcggggggctcgagattcgatcatcctgctagcatgtctcctccatccacggctggtct

SEQ ID NO: 123456 - DNA, 75 bp, Artificial Sequence
  Synthetic
tccccccacttcaggtgcggggggctcgagattcaatcatcctgctagcatgtctcctccatccacggctggtct

SEQ ID NO: 123457 - DNA, 75 bp, Artificial Sequence
  Synthetic
tccccccacttcaggtgcggggggctcgagattctatcatcctgctagcatgtctcctccatccacggctggtct

SEQ ID NO: 123458 - DNA, 75 bp, Artificial Sequence
  Synthetic
tccccccacttcaggtgcggggggctcgagattccatcatcctgctagcatgtctcctccatccacggctggtct

SEQ ID NO: 123459 - DNA, 75 bp, Artificial Sequence
  Synthetic
tccccccacttcaggtgcggggggctcgagattcgatcatcctgctagcatgtctcctccatccacggctggtct

SEQ ID NO: 123460 - DNA, 75 bp, Artificial Sequence
  Synthetic
tccccccactccaggtgcggggggctcgagattcaatcatcctgctagcatgtctcctccatccacggctggtct

SEQ ID NO: 123461 - DNA, 75 bp, Artificial Sequence
  Synthetic
tccccccactccaggtgcggggggctcgagattctatcatcctgctagcatgtctcctccatccacggctggtct

SEQ ID NO: 123462 - DNA, 75 bp, Artificial Sequence
  Synthetic
tccccccactccaggtgcggggggctcgagattccatcatcctgctagcatgtctcctccatccacggctggtct

SEQ ID NO: 123463 - DNA, 75 bp, Artificial Sequence
  Synthetic
tccccccactccaggtgcggggggctcgagattcgatcatcctgctagcatgtctcctccatccacggctggtct

SEQ ID NO: 123464 - DNA, 75 bp, Artificial Sequence
  Synthetic
tccccccactgcaggtgcggggggctcgagattcaatcatcctgctagcatgtctcctccatccacggctggtct

SEQ ID NO: 123465 - DNA, 75 bp, Artificial Sequence
  Synthetic
tccccccactgcaggtgcggggggctcgagattctatcatcctgctagcatgtctcctccatccacggctggtct

SEQ ID NO: 123466 - DNA, 75 bp, Artificial Sequence
  Synthetic
tccccccactgcaggtgcggggggctcgagattccatcatcctgctagcatgtctcctccatccacggctggtct

SEQ ID NO: 123467 - DNA, 75 bp, Artificial Sequence
  Synthetic
tccccccactgcaggtgcggggggctcgagattcgatcatcctgctagcatgtctcctccatccacggctggtct

SEQ ID NO: 123468 - DNA, 75 bp, Artificial Sequence
  Synthetic
cgccataatcactcccctgtgaggaactactgtcttcacgcagaaagcgtctagccatggcgttagtatgagtgt

SEQ ID NO: 123469 - DNA, 75 bp, Artificial Sequence
  Synthetic
tgacatgctcagcggaggccactggggcgtcctagcggggctcgcgttctttgggatgcaggccaactgggccaa

SEQ ID NO: 123470 - DNA, 75 bp, Artificial Sequence
  Synthetic
gcgcgcgacgaggaagacttctgaacgatcccagcccagaggtaggcgccaaccaatacctaaggcgcgccacca

SEQ ID NO: 123471 - DNA, 75 bp, Artificial Sequence
  Synthetic
agctccgggtcccggcagaacatacagctaattaacaccaacgggagctggcacatcaacaggactgccctcaac

SEQ ID NO: 123472 - DNA, 75 bp, Artificial Sequence
  Synthetic
cgccgttgagcctgttatcttctcgcccatggagaagaaggtcatcacttggggggctgaaacagctgcttgtgg

SEQ ID NO: 123473 - DNA, 75 bp, Artificial Sequence
  Synthetic
cgccgttgagcctgttatcttctcgcccatggagaagaaggtcatcacttggggggctgaaactgctgcttgtgg

SEQ ID NO: 123474 - DNA, 75 bp, Artificial Sequence
  Synthetic
cgccgttgagcctgttatcttctcgcccatggagaagaaggtcatcacttggggggctgaaaccgctgcttgtgg

SEQ ID NO: 123475 - DNA, 75 bp, Artificial Sequence
  Synthetic
cgccgttgagcctgttatcttctcgcccatggagaagaaggtcatcacttggggggctgaaacggctgcttgtgg

SEQ ID NO: 123476 - DNA, 75 bp, Artificial Sequence
  Synthetic
cgccgttgagcctgttatcttctcgcccatggagaagaaggtcatcacttggggggctgatacagctgcttgtgg

SEQ ID NO: 123477 - DNA, 75 bp, Artificial Sequence
  Synthetic
cgccgttgagcctgttatcttctcgcccatggagaagaaggtcatcacttggggggctgatactgctgcttgtgg

SEQ ID NO: 123478 - DNA, 75 bp, Artificial Sequence
  Synthetic
cgccgttgagcctgttatcttctcgcccatggagaagaaggtcatcacttggggggctgataccgctgcttgtgg

SEQ ID NO: 123479 - DNA, 75 bp, Artificial Sequence
  Synthetic
cgccgttgagcctgttatcttctcgcccatggagaagaaggtcatcacttggggggctgatacggctgcttgtgg

SEQ ID NO: 123480 - DNA, 75 bp, Artificial Sequence
  Synthetic
cgccgttgagcctgttatcttctcgcccatggagaagaaggtcatcacttggggggctgacacagctgcttgtgg

SEQ ID NO: 123481 - DNA, 75 bp, Artificial Sequence
  Synthetic
cgccgttgagcctgttatcttctcgcccatggagaagaaggtcatcacttggggggctgacactgctgcttgtgg

SEQ ID NO: 123482 - DNA, 75 bp, Artificial Sequence
  Synthetic
cgccgttgagcctgttatcttctcgcccatggagaagaaggtcatcacttggggggctgacaccgctgcttgtgg

SEQ ID NO: 123483 - DNA, 75 bp, Artificial Sequence
  Synthetic
cgccgttgagcctgttatcttctcgcccatggagaagaaggtcatcacttggggggctgacacggctgcttgtgg

SEQ ID NO: 123484 - DNA, 75 bp, Artificial Sequence
  Synthetic
cgccgttgagcctgttatcttctcgcccatggagaagaaggtcatcacttggggggctgagacagctgcttgtgg

SEQ ID NO: 123485 - DNA, 75 bp, Artificial Sequence
  Synthetic
cgccgttgagcctgttatcttctcgcccatggagaagaaggtcatcacttggggggctgagactgctgcttgtgg

SEQ ID NO: 123486 - DNA, 75 bp, Artificial Sequence
  Synthetic
cgccgttgagcctgttatcttctcgcccatggagaagaaggtcatcacttggggggctgagaccgctgcttgtgg

SEQ ID NO: 123487 - DNA, 75 bp, Artificial Sequence
  Synthetic
cgccgttgagcctgttatcttctcgcccatggagaagaaggtcatcacttggggggctgagacggctgcttgtgg

SEQ ID NO: 123488 - DNA, 75 bp, Artificial Sequence
  Synthetic
ctggggggcagacaccgcggcgtgtggggacatcatcttgggcctgcccgtctccgcccgcagggggagggagat

SEQ ID NO: 123489 - DNA, 75 bp, Artificial Sequence
  Synthetic
ctccgctatgtacgtgggggatctctgcggatctgtcttcctcgtctcccagctgttcaccttctcgcctcgccg

SEQ ID NO: 123490 - DNA, 75 bp, Artificial Sequence
  Synthetic
tagagaccttcgcacagggctggggcaagcttggggctgctaacatcagtggaccatctgacgaaaggccctact

SEQ ID NO: 123491 - DNA, 75 bp, Artificial Sequence
  Synthetic
ggcggagatcccgcaacttgggtaaagtcatcgataccctcacttgcggcttcgccgacctcatggggtacatcc

SEQ ID NO: 123492 - DNA, 75 bp, Artificial Sequence
  Synthetic
caacctcctgtggcaggagatgggcggaaccatcacccgcatagagtcaaaaaacaaggtggtaattctggactc

SEQ ID NO: 123493 - DNA, 75 bp, Artificial Sequence
  Synthetic
cgaccggctcggagcccccacctacgcttggggggagaatgagaccgatgtgatcatcctaaaatccaccagacc

SEQ ID NO: 123494 - DNA, 75 bp, Artificial Sequence
  Synthetic
cgaccggctcggagcccccacctacgcttggggggagaatgagaccgatgtgatcatcctaaattccaccagacc

SEQ ID NO: 123495 - DNA, 75 bp, Artificial Sequence
  Synthetic
cgaccggctcggagcccccacctacgcttggggggagaatgagaccgatgtgatcatcctaaactccaccagacc

SEQ ID NO: 123496 - DNA, 75 bp, Artificial Sequence
  Synthetic
cgaccggctcggagcccccacctacgcttggggggagaatgagaccgatgtgatcatcctaaagtccaccagacc

SEQ ID NO: 123497 - DNA, 75 bp, Artificial Sequence
  Synthetic
cgtctgctcctgcttgtggatgatgttactcatatcccaagcggaggcggctttggagaacctcgtaatactcaa

SEQ ID NO: 123498 - DNA, 75 bp, Artificial Sequence
  Synthetic
actacgcaacagggaatctccccggttgctccttttctatcttcctcttggcacttctttcgtgcctcaccactc

SEQ ID NO: 123499 - DNA, 75 bp, Artificial Sequence
  Synthetic
ccctggcggcgggtggttcggatgcgtctggatgaacagcaccgggtttacaaaaacctgcggggctccgccctg

SEQ ID NO: 123500 - DNA, 75 bp, Artificial Sequence
  Synthetic
actgtaggcctcaattcctttgtggtcggctctcagctcccttgcgatcctgagccggacaccgaggtattggcc

SEQ ID NO: 123501 - DNA, 75 bp, Artificial Sequence
  Synthetic
ttgctccttttctatcttcctcttggcacttctttcgtgcctcaccactcctgcctcagcggcgcactatgccaa

SEQ ID NO: 123502 - DNA, 75 bp, Artificial Sequence
  Synthetic
gcacttctttcgtgcctcaccactcctgcctcagcggcgcactatgccaacaagtccggcatctaccatctgact

SEQ ID NO: 123503 - DNA, 75 bp, Artificial Sequence
  Synthetic
tggtggggaactgggctaaggttttgattgtgatgctactctttgccggcgttgacgggcaaacccacgtgacag

SEQ ID NO: 123504 - DNA, 75 bp, Artificial Sequence
  Synthetic
gcacggccggattacaaccctccactgctagagtcctggaaggacccggactacgtccctccggtggtacatggg

SEQ ID NO: 123505 - DNA, 75 bp, Artificial Sequence
  Synthetic
gctgggtaccagccacgcctacgctggcggttccgaacgcctcggcgcccttcaccggattccgcggacatgtgg

SEQ ID NO: 123506 - DNA, 75 bp, Artificial Sequence
  Synthetic
acgccaaggtgcatggtccactacccttacagactgtggcactatccgtgcaccgtcaactatactatctttaag

SEQ ID NO: 123507 - DNA, 75 bp, Artificial Sequence
  Synthetic
accaccatgaggtccccaaccttcactgacaattcatctcccccggccgtgcctcaaacataccaggtagggtac

SEQ ID NO: 123508 - DNA, 75 bp, Artificial Sequence
  Synthetic
agcaccgcttggaggcagcgtgcaactggactaggggggagcagtgtggcttggagcacagagatcgcactgagc

SEQ ID NO: 123509 - DNA, 75 bp, Artificial Sequence
  Synthetic
agcaccgcttggaggcagcgtgcaactggactaggggggagctgtgtggcttggagcacagagatcgcactgagc

SEQ ID NO: 123510 - DNA, 75 bp, Artificial Sequence
  Synthetic
agcaccgcttggaggcagcgtgcaactggactaggggggagccgtgtggcttggagcacagagatcgcactgagc

SEQ ID NO: 123511 - DNA, 75 bp, Artificial Sequence
  Synthetic
agcaccgcttggaggcagcgtgcaactggactaggggggagcggtgtggcttggagcacagagatcgcactgagc

SEQ ID NO: 123512 - DNA, 75 bp, Artificial Sequence
  Synthetic
gcctcaaacataccaggtagggtaccttcacgctcctacgggtagtgggaagagtactaaagtcccagcagctta

SEQ ID NO: 123513 - DNA, 75 bp, Artificial Sequence
  Synthetic
accccgatctcagcgacgggtcctggtctaccgtgagcgaggaggccagtgaggacgtcgtctgctgctcgatgt

SEQ ID NO: 123514 - DNA, 75 bp, Artificial Sequence
  Synthetic
cttacacaacacggtccaggattgcaactgctccatatatgtgggccatataacggggcataggatggcatggga

SEQ ID NO: 123515 - DNA, 75 bp, Artificial Sequence
  Synthetic
cattgtggatgtccaatacctttatggcgttgggtccgccgttgtgtcatgggcacttaagtgggagtacgtagt

SEQ ID NO: 123516 - DNA, 75 bp, Artificial Sequence
  Synthetic
ggcgttgggtccgccgttgtgtcatgggcacttaagtgggagtacgtagtacttgccttcctgctactcgcagac

SEQ ID NO: 123517 - DNA, 75 bp, Artificial Sequence
  Synthetic
gtgctgggggcgttactatattattccatggtggccaactgggccaaagtcctttccgtcctcctcttgtttgca

SEQ ID NO: 123518 - DNA, 75 bp, Artificial Sequence
  Synthetic
gggaaacagctaggcacactccagtcaactcctggctaggcaacatcatcatgtatgcacccaccttgtgggcga

SEQ ID NO: 123519 - DNA, 75 bp, Artificial Sequence
  Synthetic
gctcgggtctgcgcgtgcctgtggatgataatgctggtagcgcaggttgaagccgcactggccaatttagtcacc

SEQ ID NO: 123520 - DNA, 75 bp, Artificial Sequence
  Synthetic
tcgtcaacaccaatggtagctggcacattaacaggactgctttgagctgcaatgacagcctccaaactgggtttt

SEQ ID NO: 123521 - DNA, 75 bp, Artificial Sequence
  Synthetic
gggacgatgaggatcgtcggtcctaggacctgcaggaacatgtggagtgggaccttccccattaatgcctacacc

SEQ ID NO: 123522 - DNA, 75 bp, Artificial Sequence
  Synthetic
tgtacgcagcttgcgggatgtggcccctgctcttcctcctcctcgcgctcccatccagggcatatgcgtttgatg

SEQ ID NO: 123523 - DNA, 75 bp, Artificial Sequence
  Synthetic
tggctggtctgttttaccataacaaatttaatgcctctggttgtccggcgcgcatgagtgcgtgcaggcctatca

SEQ ID NO: 123524 - DNA, 75 bp, Artificial Sequence
  Synthetic
cctgctcttcctcctcctcgcgctcccatccagggcatatgcgtttgatggcgggacggcagggtccctaggttg

SEQ ID NO: 123525 - DNA, 75 bp, Artificial Sequence
  Synthetic
gttgcaatacttcatagctagggccgaggccctgctacatgtgtatgctccatcattggaggtcagaggccctcg

SEQ ID NO: 123526 - DNA, 75 bp, Artificial Sequence
  Synthetic
tgttgtgccagctagagaagtctgcggtcctgtttattgttttacaccttcccccgtagtcgtgggcaccacaga

SEQ ID NO: 123527 - DNA, 75 bp, Artificial Sequence
  Synthetic
agatgccgtcatcatccttacggctctcatccatccccgcttgacctttgacatcaccaagtaccttctggctac

SEQ ID NO: 123528 - DNA, 75 bp, Artificial Sequence
  Synthetic
tccagccccgccgtcattggactgtgcaagactgcaactgctccatctatacaggccacgtcaccggccacagga

SEQ ID NO: 123529 - DNA, 75 bp, Artificial Sequence
  Synthetic
tcctcctggcaagcttgcgcccaccgcaaggtgggtggttcggctgcacctggatgaactctacgggcttcgtca

SEQ ID NO: 123530 - DNA, 75 bp, Artificial Sequence
  Synthetic
cctgcacctgcggctcctcggacctttacttggtcacgaggcacgccgatgtcatccccgtgcgccggcggggtg

SEQ ID NO: 123531 - DNA, 75 bp, Artificial Sequence
  Synthetic
gcgcacggcaaatacatccaacttgccctgcttaaggttggagcgtggaccggcacttatctatatgaccatctc

SEQ ID NO: 123532 - DNA, 75 bp, Artificial Sequence
  Synthetic
ctgacctgccccacggactgtttccggaaacacccggaggccacgtacaataagtgtggttctggtccctggctt

SEQ ID NO: 123533 - DNA, 75 bp, Artificial Sequence
  Synthetic
agcttatccaggagggccgtcaaccacatccggtccgtgtgggaggacctcctggaagaccaacatactccaatt

SEQ ID NO: 123534 - DNA, 75 bp, Artificial Sequence
  Synthetic
atggagaagaaggtgatagtttggggtgctgacacggctgcgtgcggtgacatcatcaacggccttccggtgtct

SEQ ID NO: 123535 - DNA, 75 bp, Artificial Sequence
  Synthetic
agcacaggttcgatgctgcgtgcaactggactaggggggccccctgtgcacttgaagaccgagacagggccgaga

SEQ ID NO: 123536 - DNA, 75 bp, Artificial Sequence
  Synthetic
ggggggctggagactccttgcccccatcacagcatacgcacagcaaacgcgaggcctgttgggcaccatcgtgac

SEQ ID NO: 123537 - DNA, 75 bp, Artificial Sequence
  Synthetic
agggctacaaggtgctagtgctcaacccctctgttgctgcaacactgggctttggtgcttacatgtccaaggccc

SEQ ID NO: 123538 - DNA, 75 bp, Artificial Sequence
  Synthetic
ttgggggccgtacaaaatgagatcaccactacacacccgatcaccaaatacatttccacctgtatggcagctgac

SEQ ID NO: 123539 - DNA, 75 bp, Artificial Sequence
  Synthetic
catcgtagacgtacagtacctctacgggttgaccccgtccattgtggcgtggtcgatcaagtgggagtacctcgt

SEQ ID NO: 123540 - DNA, 75 bp, Artificial Sequence
  Synthetic
ccaagatcttgctcgccatactcggtccgctcatggtgctccaggctggcctaaccaaagtgccgtactttgtgc

SEQ ID NO: 123541 - DNA, 75 bp, Artificial Sequence
  Synthetic
cccctcgcggacttccggcaggggtggggtcaaataacctacaaagacaacatctcgggcccctctgacgaccgt

SEQ ID NO: 123542 - DNA, 75 bp, Artificial Sequence
  Synthetic
tggaccgtataccacggggccggcagcaagaccatctgcggcccgaagggccccgtctgccaaatgtacaccaat

SEQ ID NO: 123543 - DNA, 75 bp, Artificial Sequence
  Synthetic
tgaggccgtactgctggcattaccctccgaagccttgtggcatcgtcccggctaggacggtttgcggaccggtct

SEQ ID NO: 123544 - DNA, 75 bp, Artificial Sequence
  Synthetic
catgttggtgcggaaagccgctgggggtcattacgtccaaatggctttcatgaagctggccgcgctgacgggtac

SEQ ID NO: 123545 - DNA, 75 bp, Artificial Sequence
  Synthetic
ctcaatgccgcgtccgccgctagcaaccaaggctggctttggtgtcttgtgtttgtgtgttctgcctggtacatc

SEQ ID NO: 123546 - DNA, 75 bp, Artificial Sequence
  Synthetic
cagatgtcatccctgtgcgccgaaggggggacactcgtggagcactccttagccctaggccgatctccacgctca

SEQ ID NO: 123547 - DNA, 75 bp, Artificial Sequence
  Synthetic
cttacggtctgctacaactgtggccactcctcctgctcgtgctcgcgctcccacagcgggcgtacgcgtatgacc

SEQ ID NO: 123548 - DNA, 75 bp, Artificial Sequence
  Synthetic
tggttcggctgcacttggatgaatgggactgggtttactaagacatgcggcgcaccaccttgccgcattaggagg

SEQ ID NO: 123549 - DNA, 75 bp, Artificial Sequence
  Synthetic
agggatcctccgggggtccgttgctatgcgcaaaggggcatgccgtaggcatattccgtgccgcggtatgcacac

SEQ ID NO: 123550 - DNA, 75 bp, Artificial Sequence
  Synthetic
ccacagcgggcgtacgcgtatgaccgggagcaagcagcttccattgggctcgcggtagtcatcgttgttacggtg

SEQ ID NO: 123551 - DNA, 75 bp, Artificial Sequence
  Synthetic
gcggccggactacaaccccccgctactggagacgtggaaaaagcctgactatgaaccacctgtggtccatggctg

SEQ ID NO: 123552 - DNA, 75 bp, Artificial Sequence
  Synthetic
ccacccaacacaccctcctgtttaacatcttggggggatgggtggccgcccaactcgctccccccagcgctgctt

SEQ ID NO: 123553 - DNA, 75 bp, Artificial Sequence
  Synthetic
cacgcaccgacgggaagtggcaagagcaccaaggttccggcggcgtacgctgctcagggatacaaggtgctcgtg

SEQ ID NO: 123554 - DNA, 75 bp, Artificial Sequence
  Synthetic
cgagtatgtccgcgcggggcgggcgggatgcagtgattctactcacctgtctccttcacccctcgctcgggtttg

SEQ ID NO: 123555 - DNA, 75 bp, Artificial Sequence
  Synthetic
gcgagcttgacgcgcgtgccatactatgtgcgtgcgcacgctctgttacgagcctgcctgcttttccgccgggta

SEQ ID NO: 123556 - DNA, 75 bp, Artificial Sequence
  Synthetic
gggccctcgtggcatttaaaatcatgagcggcgagaccccggcgatagaagacatggttaatcttcttcctgcca

SEQ ID NO: 123557 - DNA, 75 bp, Artificial Sequence
  Synthetic
gggccctcgtggcatttaaaatcatgagcggcgagtccccggcgatagaagacatggttaatcttcttcctgcca

SEQ ID NO: 123558 - DNA, 75 bp, Artificial Sequence
  Synthetic
gggccctcgtggcatttaaaatcatgagcggcgagcccccggcgatagaagacatggttaatcttcttcctgcca

SEQ ID NO: 123559 - DNA, 75 bp, Artificial Sequence
  Synthetic
gggccctcgtggcatttaaaatcatgagcggcgaggccccggcgatagaagacatggttaatcttcttcctgcca

SEQ ID NO: 123560 - DNA, 75 bp, Artificial Sequence
  Synthetic
gggccctcgtggcatttaatatcatgagcggcgagaccccggcgatagaagacatggttaatcttcttcctgcca

SEQ ID NO: 123561 - DNA, 75 bp, Artificial Sequence
  Synthetic
gggccctcgtggcatttaatatcatgagcggcgagtccccggcgatagaagacatggttaatcttcttcctgcca

SEQ ID NO: 123562 - DNA, 75 bp, Artificial Sequence
  Synthetic
gggccctcgtggcatttaatatcatgagcggcgagcccccggcgatagaagacatggttaatcttcttcctgcca

SEQ ID NO: 123563 - DNA, 75 bp, Artificial Sequence
  Synthetic
gggccctcgtggcatttaatatcatgagcggcgaggccccggcgatagaagacatggttaatcttcttcctgcca

SEQ ID NO: 123564 - DNA, 75 bp, Artificial Sequence
  Synthetic
gggccctcgtggcatttaacatcatgagcggcgagaccccggcgatagaagacatggttaatcttcttcctgcca

SEQ ID NO: 123565 - DNA, 75 bp, Artificial Sequence
  Synthetic
gggccctcgtggcatttaacatcatgagcggcgagtccccggcgatagaagacatggttaatcttcttcctgcca

SEQ ID NO: 123566 - DNA, 75 bp, Artificial Sequence
  Synthetic
gggccctcgtggcatttaacatcatgagcggcgagcccccggcgatagaagacatggttaatcttcttcctgcca

SEQ ID NO: 123567 - DNA, 75 bp, Artificial Sequence
  Synthetic
gggccctcgtggcatttaacatcatgagcggcgaggccccggcgatagaagacatggttaatcttcttcctgcca

SEQ ID NO: 123568 - DNA, 75 bp, Artificial Sequence
  Synthetic
gggccctcgtggcatttaagatcatgagcggcgagaccccggcgatagaagacatggttaatcttcttcctgcca

SEQ ID NO: 123569 - DNA, 75 bp, Artificial Sequence
  Synthetic
gggccctcgtggcatttaagatcatgagcggcgagtccccggcgatagaagacatggttaatcttcttcctgcca

SEQ ID NO: 123570 - DNA, 75 bp, Artificial Sequence
  Synthetic
gggccctcgtggcatttaagatcatgagcggcgagcccccggcgatagaagacatggttaatcttcttcctgcca

SEQ ID NO: 123571 - DNA, 75 bp, Artificial Sequence
  Synthetic
gggccctcgtggcatttaagatcatgagcggcgaggccccggcgatagaagacatggttaatcttcttcctgcca

SEQ ID NO: 123572 - DNA, 75 bp, Artificial Sequence
  Synthetic
ggctcatggcattgacccgaacatccggtcaggcgtcaggaccattaccacgggcgcaccaatcacatactccac

SEQ ID NO: 123573 - DNA, 75 bp, Artificial Sequence
  Synthetic
aatcgcgtttgcctcacgcggcaatcacgtatcgcctacccaatacgtacccgagacggacgcatcgcgtacagt

SEQ ID NO: 123574 - DNA, 75 bp, Artificial Sequence
  Synthetic
aatcgcgtttgcctcacgcggcaatcacgtatcgcctacccattacgtacccgagacggacgcatcgcgtacagt

SEQ ID NO: 123575 - DNA, 75 bp, Artificial Sequence
  Synthetic
aatcgcgtttgcctcacgcggcaatcacgtatcgcctacccactacgtacccgagacggacgcatcgcgtacagt

SEQ ID NO: 123576 - DNA, 75 bp, Artificial Sequence
  Synthetic
aatcgcgtttgcctcacgcggcaatcacgtatcgcctacccagtacgtacccgagacggacgcatcgcgtacagt

SEQ ID NO: 123577 - DNA, 75 bp, Artificial Sequence
  Synthetic
acggcctgcgtgaccttgctgttgcagtggaacccattatattctcacccatggagaagaagctgatcacctggg

SEQ ID NO: 123578 - DNA, 75 bp, Artificial Sequence
  Synthetic
agacggctggcgtacgccttaccatacttgcaaccgccacgccaccagggtctgtaaccacgccacatgccaata

SEQ ID NO: 123579 - DNA, 75 bp, Artificial Sequence
  Synthetic
gtggcagcgactctcagaaaacttggagcgcctccccttagagcgtggaagagtcgggcgcgtgctgtgagggcc

SEQ ID NO: 123580 - DNA, 75 bp, Artificial Sequence
  Synthetic
cacaaacattctaagctcactcaccataaccagcctcctccgtaagctccatgagtggatcaaaagcgattggtc

SEQ ID NO: 123581 - DNA, 75 bp, Artificial Sequence
  Synthetic
cacaaacattctaagctcactcaccataaccagcctcctccgtaagctccatgagtggatcaatagcgattggtc

SEQ ID NO: 123582 - DNA, 75 bp, Artificial Sequence
  Synthetic
cacaaacattctaagctcactcaccataaccagcctcctccgtaagctccatgagtggatcaacagcgattggtc

SEQ ID NO: 123583 - DNA, 75 bp, Artificial Sequence
  Synthetic
cacaaacattctaagctcactcaccataaccagcctcctccgtaagctccatgagtggatcaagagcgattggtc

SEQ ID NO: 123584 - DNA, 75 bp, Artificial Sequence
  Synthetic
cacaaacattctaagctcactcaccattaccagcctcctccgtaagctccatgagtggatcaaaagcgattggtc

SEQ ID NO: 123585 - DNA, 75 bp, Artificial Sequence
  Synthetic
cacaaacattctaagctcactcaccattaccagcctcctccgtaagctccatgagtggatcaatagcgattggtc

SEQ ID NO: 123586 - DNA, 75 bp, Artificial Sequence
  Synthetic
cacaaacattctaagctcactcaccattaccagcctcctccgtaagctccatgagtggatcaacagcgattggtc

SEQ ID NO: 123587 - DNA, 75 bp, Artificial Sequence
  Synthetic
cacaaacattctaagctcactcaccattaccagcctcctccgtaagctccatgagtggatcaagagcgattggtc

SEQ ID NO: 123588 - DNA, 75 bp, Artificial Sequence
  Synthetic
cacaaacattctaagctcactcaccatcaccagcctcctccgtaagctccatgagtggatcaaaagcgattggtc

SEQ ID NO: 123589 - DNA, 75 bp, Artificial Sequence
  Synthetic
cacaaacattctaagctcactcaccatcaccagcctcctccgtaagctccatgagtggatcaatagcgattggtc

SEQ ID NO: 123590 - DNA, 75 bp, Artificial Sequence
  Synthetic
cacaaacattctaagctcactcaccatcaccagcctcctccgtaagctccatgagtggatcaacagcgattggtc

SEQ ID NO: 123591 - DNA, 75 bp, Artificial Sequence
  Synthetic
cacaaacattctaagctcactcaccatcaccagcctcctccgtaagctccatgagtggatcaagagcgattggtc

SEQ ID NO: 123592 - DNA, 75 bp, Artificial Sequence
  Synthetic
cacaaacattctaagctcactcaccatgaccagcctcctccgtaagctccatgagtggatcaaaagcgattggtc

SEQ ID NO: 123593 - DNA, 75 bp, Artificial Sequence
  Synthetic
cacaaacattctaagctcactcaccatgaccagcctcctccgtaagctccatgagtggatcaatagcgattggtc

SEQ ID NO: 123594 - DNA, 75 bp, Artificial Sequence
  Synthetic
cacaaacattctaagctcactcaccatgaccagcctcctccgtaagctccatgagtggatcaacagcgattggtc

SEQ ID NO: 123595 - DNA, 75 bp, Artificial Sequence
  Synthetic
cacaaacattctaagctcactcaccatgaccagcctcctccgtaagctccatgagtggatcaagagcgattggtc

SEQ ID NO: 123596 - DNA, 75 bp, Artificial Sequence
  Synthetic
cacaaacattctaagctctctcaccataaccagcctcctccgtaagctccatgagtggatcaaaagcgattggtc

SEQ ID NO: 123597 - DNA, 75 bp, Artificial Sequence
  Synthetic
cacaaacattctaagctctctcaccataaccagcctcctccgtaagctccatgagtggatcaatagcgattggtc

SEQ ID NO: 123598 - DNA, 75 bp, Artificial Sequence
  Synthetic
cacaaacattctaagctctctcaccataaccagcctcctccgtaagctccatgagtggatcaacagcgattggtc

SEQ ID NO: 123599 - DNA, 75 bp, Artificial Sequence
  Synthetic
cacaaacattctaagctctctcaccataaccagcctcctccgtaagctccatgagtggatcaagagcgattggtc

SEQ ID NO: 123600 - DNA, 75 bp, Artificial Sequence
  Synthetic
cacaaacattctaagctctctcaccattaccagcctcctccgtaagctccatgagtggatcaaaagcgattggtc

SEQ ID NO: 123601 - DNA, 75 bp, Artificial Sequence
  Synthetic
cacaaacattctaagctctctcaccattaccagcctcctccgtaagctccatgagtggatcaatagcgattggtc

SEQ ID NO: 123602 - DNA, 75 bp, Artificial Sequence
  Synthetic
cacaaacattctaagctctctcaccattaccagcctcctccgtaagctccatgagtggatcaacagcgattggtc

SEQ ID NO: 123603 - DNA, 75 bp, Artificial Sequence
  Synthetic
cacaaacattctaagctctctcaccattaccagcctcctccgtaagctccatgagtggatcaagagcgattggtc

SEQ ID NO: 123604 - DNA, 75 bp, Artificial Sequence
  Synthetic
cacaaacattctaagctctctcaccatcaccagcctcctccgtaagctccatgagtggatcaaaagcgattggtc

SEQ ID NO: 123605 - DNA, 75 bp, Artificial Sequence
  Synthetic
cacaaacattctaagctctctcaccatcaccagcctcctccgtaagctccatgagtggatcaatagcgattggtc

SEQ ID NO: 123606 - DNA, 75 bp, Artificial Sequence
  Synthetic
cacaaacattctaagctctctcaccatcaccagcctcctccgtaagctccatgagtggatcaacagcgattggtc

SEQ ID NO: 123607 - DNA, 75 bp, Artificial Sequence
  Synthetic
cacaaacattctaagctctctcaccatcaccagcctcctccgtaagctccatgagtggatcaagagcgattggtc

SEQ ID NO: 123608 - DNA, 75 bp, Artificial Sequence
  Synthetic
cacaaacattctaagctctctcaccatgaccagcctcctccgtaagctccatgagtggatcaaaagcgattggtc

SEQ ID NO: 123609 - DNA, 75 bp, Artificial Sequence
  Synthetic
cacaaacattctaagctctctcaccatgaccagcctcctccgtaagctccatgagtggatcaatagcgattggtc

SEQ ID NO: 123610 - DNA, 75 bp, Artificial Sequence
  Synthetic
cacaaacattctaagctctctcaccatgaccagcctcctccgtaagctccatgagtggatcaacagcgattggtc

SEQ ID NO: 123611 - DNA, 75 bp, Artificial Sequence
  Synthetic
cacaaacattctaagctctctcaccatgaccagcctcctccgtaagctccatgagtggatcaagagcgattggtc

SEQ ID NO: 123612 - DNA, 75 bp, Artificial Sequence
  Synthetic
cacaaacattctaagctccctcaccataaccagcctcctccgtaagctccatgagtggatcaaaagcgattggtc

SEQ ID NO: 123613 - DNA, 75 bp, Artificial Sequence
  Synthetic
cacaaacattctaagctccctcaccataaccagcctcctccgtaagctccatgagtggatcaatagcgattggtc

SEQ ID NO: 123614 - DNA, 75 bp, Artificial Sequence
  Synthetic
cacaaacattctaagctccctcaccataaccagcctcctccgtaagctccatgagtggatcaacagcgattggtc

SEQ ID NO: 123615 - DNA, 75 bp, Artificial Sequence
  Synthetic
cacaaacattctaagctccctcaccataaccagcctcctccgtaagctccatgagtggatcaagagcgattggtc

SEQ ID NO: 123616 - DNA, 75 bp, Artificial Sequence
  Synthetic
cacaaacattctaagctccctcaccattaccagcctcctccgtaagctccatgagtggatcaaaagcgattggtc

SEQ ID NO: 123617 - DNA, 75 bp, Artificial Sequence
  Synthetic
cacaaacattctaagctccctcaccattaccagcctcctccgtaagctccatgagtggatcaatagcgattggtc

SEQ ID NO: 123618 - DNA, 75 bp, Artificial Sequence
  Synthetic
cacaaacattctaagctccctcaccattaccagcctcctccgtaagctccatgagtggatcaacagcgattggtc

SEQ ID NO: 123619 - DNA, 75 bp, Artificial Sequence
  Synthetic
cacaaacattctaagctccctcaccattaccagcctcctccgtaagctccatgagtggatcaagagcgattggtc

SEQ ID NO: 123620 - DNA, 75 bp, Artificial Sequence
  Synthetic
cacaaacattctaagctccctcaccatcaccagcctcctccgtaagctccatgagtggatcaaaagcgattggtc

SEQ ID NO: 123621 - DNA, 75 bp, Artificial Sequence
  Synthetic
cacaaacattctaagctccctcaccatcaccagcctcctccgtaagctccatgagtggatcaatagcgattggtc

SEQ ID NO: 123622 - DNA, 75 bp, Artificial Sequence
  Synthetic
cacaaacattctaagctccctcaccatcaccagcctcctccgtaagctccatgagtggatcaacagcgattggtc

SEQ ID NO: 123623 - DNA, 75 bp, Artificial Sequence
  Synthetic
cacaaacattctaagctccctcaccatcaccagcctcctccgtaagctccatgagtggatcaagagcgattggtc

SEQ ID NO: 123624 - DNA, 75 bp, Artificial Sequence
  Synthetic
cacaaacattctaagctccctcaccatgaccagcctcctccgtaagctccatgagtggatcaaaagcgattggtc

SEQ ID NO: 123625 - DNA, 75 bp, Artificial Sequence
  Synthetic
cacaaacattctaagctccctcaccatgaccagcctcctccgtaagctccatgagtggatcaatagcgattggtc

SEQ ID NO: 123626 - DNA, 75 bp, Artificial Sequence
  Synthetic
cacaaacattctaagctccctcaccatgaccagcctcctccgtaagctccatgagtggatcaacagcgattggtc

SEQ ID NO: 123627 - DNA, 75 bp, Artificial Sequence
  Synthetic
cacaaacattctaagctccctcaccatgaccagcctcctccgtaagctccatgagtggatcaagagcgattggtc

SEQ ID NO: 123628 - DNA, 75 bp, Artificial Sequence
  Synthetic
cacaaacattctaagctcgctcaccataaccagcctcctccgtaagctccatgagtggatcaaaagcgattggtc

SEQ ID NO: 123629 - DNA, 75 bp, Artificial Sequence
  Synthetic
cacaaacattctaagctcgctcaccataaccagcctcctccgtaagctccatgagtggatcaatagcgattggtc

SEQ ID NO: 123630 - DNA, 75 bp, Artificial Sequence
  Synthetic
cacaaacattctaagctcgctcaccataaccagcctcctccgtaagctccatgagtggatcaacagcgattggtc

SEQ ID NO: 123631 - DNA, 75 bp, Artificial Sequence
  Synthetic
cacaaacattctaagctcgctcaccataaccagcctcctccgtaagctccatgagtggatcaagagcgattggtc

SEQ ID NO: 123632 - DNA, 75 bp, Artificial Sequence
  Synthetic
cacaaacattctaagctcgctcaccattaccagcctcctccgtaagctccatgagtggatcaaaagcgattggtc

SEQ ID NO: 123633 - DNA, 75 bp, Artificial Sequence
  Synthetic
cacaaacattctaagctcgctcaccattaccagcctcctccgtaagctccatgagtggatcaatagcgattggtc

SEQ ID NO: 123634 - DNA, 75 bp, Artificial Sequence
  Synthetic
cacaaacattctaagctcgctcaccattaccagcctcctccgtaagctccatgagtggatcaacagcgattggtc

SEQ ID NO: 123635 - DNA, 75 bp, Artificial Sequence
  Synthetic
cacaaacattctaagctcgctcaccattaccagcctcctccgtaagctccatgagtggatcaagagcgattggtc

SEQ ID NO: 123636 - DNA, 75 bp, Artificial Sequence
  Synthetic
cacaaacattctaagctcgctcaccatcaccagcctcctccgtaagctccatgagtggatcaaaagcgattggtc

SEQ ID NO: 123637 - DNA, 75 bp, Artificial Sequence
  Synthetic
cacaaacattctaagctcgctcaccatcaccagcctcctccgtaagctccatgagtggatcaatagcgattggtc

SEQ ID NO: 123638 - DNA, 75 bp, Artificial Sequence
  Synthetic
cacaaacattctaagctcgctcaccatcaccagcctcctccgtaagctccatgagtggatcaacagcgattggtc

SEQ ID NO: 123639 - DNA, 75 bp, Artificial Sequence
  Synthetic
cacaaacattctaagctcgctcaccatcaccagcctcctccgtaagctccatgagtggatcaagagcgattggtc

SEQ ID NO: 123640 - DNA, 75 bp, Artificial Sequence
  Synthetic
cacaaacattctaagctcgctcaccatgaccagcctcctccgtaagctccatgagtggatcaaaagcgattggtc

SEQ ID NO: 123641 - DNA, 75 bp, Artificial Sequence
  Synthetic
cacaaacattctaagctcgctcaccatgaccagcctcctccgtaagctccatgagtggatcaatagcgattggtc

SEQ ID NO: 123642 - DNA, 75 bp, Artificial Sequence
  Synthetic
cacaaacattctaagctcgctcaccatgaccagcctcctccgtaagctccatgagtggatcaacagcgattggtc

SEQ ID NO: 123643 - DNA, 75 bp, Artificial Sequence
  Synthetic
cacaaacattctaagctcgctcaccatgaccagcctcctccgtaagctccatgagtggatcaagagcgattggtc

SEQ ID NO: 123644 - DNA, 75 bp, Artificial Sequence
  Synthetic
gcgcttgaaaagctcatcatcttgcactctgctagcgccgctagtgccaatgggccgctgtggttcttcatcttc

SEQ ID NO: 123645 - DNA, 75 bp, Artificial Sequence
  Synthetic
caagggctggaggttgttggcccccatcacagcctattgccaacagacccgtggcctgctcggtacgatcgtcac

SEQ ID NO: 123646 - DNA, 75 bp, Artificial Sequence
  Synthetic
atcacagcctattgccaacagacccgtggcctgctcggtacgatcgtcaccagtttgactgggcgggataagaat

SEQ ID NO: 123647 - DNA, 75 bp, Artificial Sequence
  Synthetic
ttccaggaaaaagtgtgacgaactggccaagcagctgtcatcccttggcctcaacgctgtggcatactatagggg

SEQ ID NO: 123648 - DNA, 75 bp, Artificial Sequence
  Synthetic
ctgacgccctcatgacaggttacaccggcgacttagactccgtaatagactgcaacacatctgtcatacagactg

SEQ ID NO: 123649 - DNA, 75 bp, Artificial Sequence
  Synthetic
ctgacgccctcatgacaggttacaccggcgactttgactccgtaatagactgcaacacatctgtcatacagactg

SEQ ID NO: 123650 - DNA, 75 bp, Artificial Sequence
  Synthetic
ctgacgccctcatgacaggttacaccggcgacttcgactccgtaatagactgcaacacatctgtcatacagactg

SEQ ID NO: 123651 - DNA, 75 bp, Artificial Sequence
  Synthetic
ctgacgccctcatgacaggttacaccggcgacttggactccgtaatagactgcaacacatctgtcatacagactg

SEQ ID NO: 123652 - DNA, 75 bp, Artificial Sequence
  Synthetic
caaagacccttgctggccccaaaggacctatctgccagatgtacaccaatgtggatcaagatatggtaggctggc

SEQ ID NO: 123653 - DNA, 75 bp, Artificial Sequence
  Synthetic
cccaggttcagcaatgggttccccccctggaggtccgaggggggcgtgacgggatcatctgggtggctgtcattc

SEQ ID NO: 123654 - DNA, 75 bp, Artificial Sequence
  Synthetic
aggggacacccgggcaggcttactcagccctaggccgcttagtacgctaaaagggtcgtcgggagggcccgtcat

SEQ ID NO: 123655 - DNA, 75 bp, Artificial Sequence
  Synthetic
ataggtgtcacagctgaccatctgaaatgtccttgccaagtgccagcccctgaatttttcaccgaggttgacggc

SEQ ID NO: 123656 - DNA, 75 bp, Artificial Sequence
  Synthetic
ccttgctacgggtaccatactttgtgagggcccacgccctgctacgagtgtgtaccctggtgagacacctcgcag

SEQ ID NO: 123657 - DNA, 75 bp, Artificial Sequence
  Synthetic
cttttccgtgcggccgtctgcactcgtggtgtcgccaaagccatagactttgtgcctgtggagagtatggagact

SEQ ID NO: 123658 - DNA, 75 bp, Artificial Sequence
  Synthetic
accagggctccccgtttgccaagaccatcttgagttctgggaaagcgtctttacggggttaactcatatagacgc

SEQ ID NO: 123659 - DNA, 75 bp, Artificial Sequence
  Synthetic
cacgctccgaccggcagcggtaagagcaccaaggtgcccgcggcatacgcttcccaaggctacaaggttctggta

SEQ ID NO: 123660 - DNA, 75 bp, Artificial Sequence
  Synthetic
ttgcctaccaggctacggtctgtgctagggcccaggcccccccaccatcatgggacactatgtggaagcgcttga

SEQ ID NO: 123661 - DNA, 75 bp, Artificial Sequence
  Synthetic
agactcttgctggaccgaaaggaccagtgtgtcaaatgtacaccaatgtggacaaggacctagtaggatggccat

SEQ ID NO: 123662 - DNA, 75 bp, Artificial Sequence
  Synthetic
cgtacaccctgatgatgagctgatcgaggctaatttgctatggaggcaagagatgggcggcaacattacaagagt

SEQ ID NO: 123663 - DNA, 75 bp, Artificial Sequence
  Synthetic
ctggaggtgctatcacctattccacatatggcaagttcctggcggacggcggctgctcggggggcgcgtatgaca

SEQ ID NO: 123664 - DNA, 75 bp, Artificial Sequence
  Synthetic
agagtcagagaacaaaatagtagttctcgactcatttgaacctctggttgccgaaaccgatgatagggagatatc

SEQ ID NO: 123665 - DNA, 75 bp, Artificial Sequence
  Synthetic
catggcctgtatgtcggcggatctagaggtggtgaccagcacgtgggtcctggtggggggcatcatggcagccct

SEQ ID NO: 123666 - DNA, 75 bp, Artificial Sequence
  Synthetic
gcagttggcacatcaaccgcactgccttgaactgcaatgcgagcctcgacactggctggttagcggggctcttct

SEQ ID NO: 123667 - DNA, 75 bp, Artificial Sequence
  Synthetic
cttagccaccgcgactccccccgggtcggtgactgtcccgcaccccaacattacagagacagccttaccccttac

SEQ ID NO: 123668 - DNA, 75 bp, Artificial Sequence
  Synthetic
cagttcgacgagatggaggaatgttccaaccatatcccgctgattgaacacggcttacaactggcagagcagttc

SEQ ID NO: 123669 - DNA, 75 bp, Artificial Sequence
  Synthetic
ccaggggttgccgcccgtccctccgcctcggcggaaagggatggtgcagcttgacgactccaccgtctcggctgc

SEQ ID NO: 123670 - DNA, 75 bp, Artificial Sequence
  Synthetic
ccaaccatatcccgctgattgaacacggcttacaactggcagagcagttcaagcaaaaggctctaggtgtcttac

SEQ ID NO: 123671 - DNA, 75 bp, Artificial Sequence
  Synthetic
gcaagccagctacgtgcacttggcctgaatgccgtcgctttctatcggggcgtggatgtggcagttattccaact

SEQ ID NO: 123672 - DNA, 75 bp, Artificial Sequence
  Synthetic
tggcatccaatacctggccgggttatccaccctacctggcaatccagccattgcttcactcatgtcattcaccgc

SEQ ID NO: 123673 - DNA, 75 bp, Artificial Sequence
  Synthetic
tgaatgccgtcgctttctatcggggcgtggatgtggcagttattccaactgcaggcgacgtcgtcgtctgcgcca

SEQ ID NO: 123674 - DNA, 75 bp, Artificial Sequence
  Synthetic
accggacgtggccgtgttgacgtccatgctcactgatccctcccatataacagcagaggcggctgggagaaggtt

SEQ ID NO: 123675 - DNA, 75 bp, Artificial Sequence
  Synthetic
cgcatggcttgactgctatcttccagaccggtgccaagcagaacatccagctgatcaatagcaacggcagttggc

SEQ ID NO: 123676 - DNA, 75 bp, Artificial Sequence
  Synthetic
ttgcttcactcatgtcattcaccgccgctgtcacgagcccccttaccacccaacagaccctcctcttcaacattt

SEQ ID NO: 123677 - DNA, 75 bp, Artificial Sequence
  Synthetic
atgacgactcttgcagctcaatgccgcccttggaaggcgagcccggtgatcctgacctcgattcgggctcctggg

SEQ ID NO: 123678 - DNA, 75 bp, Artificial Sequence
  Synthetic
tgggaaattcttggccgatgggggatgttccggaggagcgtacgacatcatcatctgtgatgagtgccactctac

SEQ ID NO: 123679 - DNA, 75 bp, Artificial Sequence
  Synthetic
caccattgagacaaccacagttccgcaggacgctgtagccaggagccagcggcgtgggcggacagggcgggggaa

SEQ ID NO: 123680 - DNA, 75 bp, Artificial Sequence
  Synthetic
gaaaatcctcgttgacatccttgctggttatggtgccggtgtagctggcgccgtagtcactttcaagatcatgag

SEQ ID NO: 123681 - DNA, 75 bp, Artificial Sequence
  Synthetic
gtacgacactgggtgcgcgtggtatgagcttacaccatcagagaccaccgtcaggttgcgcgcgtaccttaatac

SEQ ID NO: 123682 - DNA, 75 bp, Artificial Sequence
  Synthetic
ccgcagcgcaagccagcggcagaagaaggtcacctttgacagactgcaagtcctggacgaccactaccgggacgt

SEQ ID NO: 123683 - DNA, 75 bp, Artificial Sequence
  Synthetic
gagcttacaccatcagagaccaccgtcaggttgcgcgcgtaccttaatacccctggcctgcccgtctgtcaggac

SEQ ID NO: 123684 - DNA, 75 bp, Artificial Sequence
  Synthetic
cgccacgtgggccccggcgagggggctgtgcagtggatgaaccgcctcattgccttcgcatcgcgaggcaatcac

SEQ ID NO: 123685 - DNA, 75 bp, Artificial Sequence
  Synthetic
tgccttcgcatcgcgaggcaatcacgtttcccccacgcactacgtcccagagaccgatgccgcggcccgcgtgac

SEQ ID NO: 123686 - DNA, 75 bp, Artificial Sequence
  Synthetic
gcccttgaggccttctgggcgaagcacatgtggaatttcatcagcgggatacaatacttagcaggcttgtccact

SEQ ID NO: 123687 - DNA, 75 bp, Artificial Sequence
  Synthetic
cggcataccaagctacggtgtgcgctcgagcgaaggctccccctccctcatgggacactatgtggaaatgtctcc

SEQ ID NO: 123688 - DNA, 75 bp, Artificial Sequence
  Synthetic
accaagtcttttggcagctcctcaacttccggtattacgggcgacaacacgacaacatcctctgagcccgtctcc

SEQ ID NO: 123689 - DNA, 75 bp, Artificial Sequence
  Synthetic
gaagtgtgggagtgggtctgcactgtcctatctgactttaagacgtggctcaaggcaaagctgctacctcgcatg

SEQ ID NO: 123690 - DNA, 75 bp, Artificial Sequence
  Synthetic
tcctatctgactttaagacgtggctcaaggcaaagctgctacctcgcatgcccggcatccccttcctgtcttgcc

SEQ ID NO: 123691 - DNA, 75 bp, Artificial Sequence
  Synthetic
tccaccgcaacacaatctttcctggcgacctgcgtcaacggcgtgtgttggactgtctaccatggcgccggctca

SEQ ID NO: 123692 - DNA, 75 bp, Artificial Sequence
  Synthetic
catgacctgtatgtcagcagacctggaagtcatcaccagcacttgggtggtagctggggggatccttgccgcgct

SEQ ID NO: 123693 - DNA, 75 bp, Artificial Sequence
  Synthetic
gatcgtcggacctaagacttgcagcaacacctggcacggaacctttcccatcaatgcttacaccagtggacccag

SEQ ID NO: 123694 - DNA, 75 bp, Artificial Sequence
  Synthetic
aacacctggcacggaacctttcccatcaatgcttacaccagtggacccagcatacctatcccggcgccgaactat

SEQ ID NO: 123695 - DNA, 75 bp, Artificial Sequence
  Synthetic
caatacgacgagatggaggagtgttctcgacacatcccctacctcgtcgagggacaacacttagccgaacagttc

SEQ ID NO: 123696 - DNA, 75 bp, Artificial Sequence
  Synthetic
ctcgacacatcccctacctcgtcgagggacaacacttagccgaacagttcaagcagaaggtccttgggctgatcc

SEQ ID NO: 123697 - DNA, 75 bp, Artificial Sequence
  Synthetic
ctcgacacatcccctacctcgtcgagggacaacacttagccgaacagttcaagcagaaggtccttgggctgttcc

SEQ ID NO: 123698 - DNA, 75 bp, Artificial Sequence
  Synthetic
ctcgacacatcccctacctcgtcgagggacaacacttagccgaacagttcaagcagaaggtccttgggctgctcc

SEQ ID NO: 123699 - DNA, 75 bp, Artificial Sequence
  Synthetic
ctcgacacatcccctacctcgtcgagggacaacacttagccgaacagttcaagcagaaggtccttgggctggtcc

SEQ ID NO: 123700 - DNA, 75 bp, Artificial Sequence
  Synthetic
ggagtcacacaggataacatcaagtgcccctgccaggttccttctccagaatttttcactgaagtggacggggtc

SEQ ID NO: 123701 - DNA, 75 bp, Artificial Sequence
  Synthetic
atttttcactgaagtggacggggtcaacttacatcgctacgctccgccttgcaagcctctgctaagagacgaagt

SEQ ID NO: 123702 - DNA, 75 bp, Artificial Sequence
  Synthetic
atttttcactgaagtggacggggtcaacttacatcgctacgctccgccttgcaagcctctgctaagtgacgaagt

SEQ ID NO: 123703 - DNA, 75 bp, Artificial Sequence
  Synthetic
atttttcactgaagtggacggggtcaacttacatcgctacgctccgccttgcaagcctctgctaagcgacgaagt

SEQ ID NO: 123704 - DNA, 75 bp, Artificial Sequence
  Synthetic
atttttcactgaagtggacggggtcaacttacatcgctacgctccgccttgcaagcctctgctaagggacgaagt

SEQ ID NO: 123705 - DNA, 75 bp, Artificial Sequence
  Synthetic
cgggatacagtatctggcgggtctttcgaccctgccgggcaatcccgctgttgcgtccatgatgtcattcactgc

SEQ ID NO: 123706 - DNA, 75 bp, Artificial Sequence
  Synthetic
ggggcaaaagacgtccgttgccatgccagaaaggccgtaaaccacatcaactccgtgtggaaagaccttctggaa

SEQ ID NO: 123707 - DNA, 75 bp, Artificial Sequence
  Synthetic
ccagaaaggccgtaaaccacatcaactccgtgtggaaagaccttctggaagacagtgtaacaccaatagacacta

SEQ ID NO: 123708 - DNA, 75 bp, Artificial Sequence
  Synthetic
ttgcgtccatgatgtcattcactgccgccctaaccagtcctctgtccacatctacgaccctcctccttaacatcc

SEQ ID NO: 123709 - DNA, 75 bp, Artificial Sequence
  Synthetic
tcccacatcaccgcggcaacggccgctcgtaggttggcacgagggtctccgccctcattggccagctcttcagca

SEQ ID NO: 123710 - DNA, 75 bp, Artificial Sequence
  Synthetic
tcccacatcaccgcggcaacggccgctcgtaggttggctcgagggtctccgccctcattggccagctcttcagca

SEQ ID NO: 123711 - DNA, 75 bp, Artificial Sequence
  Synthetic
tcccacatcaccgcggcaacggccgctcgtaggttggcccgagggtctccgccctcattggccagctcttcagca

SEQ ID NO: 123712 - DNA, 75 bp, Artificial Sequence
  Synthetic
tcccacatcaccgcggcaacggccgctcgtaggttggcgcgagggtctccgccctcattggccagctcttcagca

SEQ ID NO: 123713 - DNA, 75 bp, Artificial Sequence
  Synthetic
taaggtcattgttgacatcctggcaggctacggagcgggcgtatcgggtgccctcgtagctttcaagatcatgag

SEQ ID NO: 123714 - DNA, 75 bp, Artificial Sequence
  Synthetic
aggctacatgcacaacccatcatgagtcccccgacgctgatctcatcgaggcgaatcttctgtggagacaggaga

SEQ ID NO: 123715 - DNA, 75 bp, Artificial Sequence
  Synthetic
ggctacggagcgggcgtatcgggtgccctcgtagctttcaagatcatgagcggcgagaccccctccatggaggac

SEQ ID NO: 123716 - DNA, 75 bp, Artificial Sequence
  Synthetic
gtcccccgacgctgatctcatcgaggcgaatcttctgtggagacaggagatggggagcaacatcaccagggttga

SEQ ID NO: 123717 - DNA, 75 bp, Artificial Sequence
  Synthetic
gtcagagaccaaggtggtggtgctggattcatttgacccgcttgtggccgagcctgacgatggggaggtctctgt

SEQ ID NO: 123718 - DNA, 75 bp, Artificial Sequence
  Synthetic
gtctgagaccaaggtggtggtgctggattcatttgacccgcttgtggccgagcctgacgatggggaggtctctgt

SEQ ID NO: 123719 - DNA, 75 bp, Artificial Sequence
  Synthetic
gtccgagaccaaggtggtggtgctggattcatttgacccgcttgtggccgagcctgacgatggggaggtctctgt

SEQ ID NO: 123720 - DNA, 75 bp, Artificial Sequence
  Synthetic
gtcggagaccaaggtggtggtgctggattcatttgacccgcttgtggccgagcctgacgatggggaggtctctgt

SEQ ID NO: 123721 - DNA, 75 bp, Artificial Sequence
  Synthetic
ccaatcagtggaagaaccgactgatagccttcgcctccaggggcaaccacgtttcgcccacgcactatgtgcctg

SEQ ID NO: 123722 - DNA, 75 bp, Artificial Sequence
  Synthetic
catcggaggggtgggcaacaacaccttgcactgccccactgattgtttccgcaagcatccggaagccacatactc

SEQ ID NO: 123723 - DNA, 75 bp, Artificial Sequence
  Synthetic
ccggaatacgatcctccggccgtgcacgggtgcgcccttcctccaggtggcctgcctcccattcctcctcccagg

SEQ ID NO: 123724 - DNA, 75 bp, Artificial Sequence
  Synthetic
gtcgtgagcggtctagcaggagccacggttggaagcatcgggctcgggagggtgttggttgatgtgctcgccgga

SEQ ID NO: 123725 - DNA, 75 bp, Artificial Sequence
  Synthetic
ggtgtgttggactgtctaccacggggccggaacaaggaccatcgcgtcatctaagggtcctgttatccagatgta

SEQ ID NO: 123726 - DNA, 75 bp, Artificial Sequence
  Synthetic
aggaaacgggcggttgtgcttactgagtcgagcgtttctagcgctctggcagagttggccgcgcggtccttcggt

SEQ ID NO: 123727 - DNA, 75 bp, Artificial Sequence
  Synthetic
aaaaatactcagctctctcaccatcacagccatgctccggaaactccacgagtggattaacggagactggacaac

SEQ ID NO: 123728 - DNA, 75 bp, Artificial Sequence
  Synthetic
cccatgcgctacttcctggttgagggatatctgggattgggtttgcatcgtcctgagcgacttcaaggggtggct

SEQ ID NO: 123729 - DNA, 75 bp, Artificial Sequence
  Synthetic
tctcacacacattgatgcccacttcctctcccagacgaagcaaggaggagacaactttgcgtatctaacggccta

SEQ ID NO: 123730 - DNA, 75 bp, Artificial Sequence
  Synthetic
cgtactcatcaatgcctccgcttgagggagagccgggtgatcctgacttgacttcggactcgtggtccacagtca

SEQ ID NO: 123731 - DNA, 75 bp, Artificial Sequence
  Synthetic
ctcctgtggcggcaggagatgggcgggaacatcacccgcgtggagtcagagaataaggtggtaattctggactct

SEQ ID NO: 123732 - DNA, 75 bp, Artificial Sequence
  Synthetic
tgcccctgcggagccgcaatcactggtcatgtcaagaatgggtcgatgagaattgtgggttcaaagtggtgcagc

SEQ ID NO: 123733 - DNA, 75 bp, Artificial Sequence
  Synthetic
ctttgcatcaagaggcaaccatgtgtccccgacgcactacgtgcctgagactgacgcgtcaaaaaatgtgactca

SEQ ID NO: 123734 - DNA, 75 bp, Artificial Sequence
  Synthetic
cctactgtccgtaggggtaggcgtcatcttgctccctaaccggtgagcgagagactaaggcaacactccactgtt

SEQ ID NO: 123735 - DNA, 75 bp, Artificial Sequence
  Synthetic
cacggcgtacgcccagcagacaaggggcctcctggggtgtataatcaccagcctaactggccgggacaaaaacca

SEQ ID NO: 123736 - DNA, 75 bp, Artificial Sequence
  Synthetic
gggagagccgggtgatcctgacttgacttcggactcgtggtccacagtcagcagctcagaggatgtggtctgttg

SEQ ID NO: 123737 - DNA, 75 bp, Artificial Sequence
  Synthetic
ccgaggaatatgtagaggttttgaaacatcaggataaccactacattgtgggagtcacatcagaaaacctgaaat

SEQ ID NO: 123738 - DNA, 75 bp, Artificial Sequence
  Synthetic
cataacatggtgtacgcaacgacttctcgctcggcaaccgcccggcagaagaaagtcacctttgaccgcctccag

SEQ ID NO: 123739 - DNA, 75 bp, Artificial Sequence
  Synthetic
ggagtcacatcagaaaacctgaaatgcccttgccaggtgccggcccccgagtttttcactgaggtggacggcgtc

SEQ ID NO: 123740 - DNA, 75 bp, Artificial Sequence
  Synthetic
gcccttgccaggtgccggcccccgagtttttcactgaggtggacggcgtcagactgcataggtacgcgccgtcat

SEQ ID NO: 123741 - DNA, 75 bp, Artificial Sequence
  Synthetic
tccaataccacctccacggaggaagaggacggttgtcctaacagagtccactgtgtcttctgccttggcggagct

SEQ ID NO: 123742 - DNA, 75 bp, Artificial Sequence
  Synthetic
tcctaaaggagattaaggcgcgagcgaccaaagtgaaggcgcggctcctctcaacagaggaagcttgcgacctga

SEQ ID NO: 123743 - DNA, 75 bp, Artificial Sequence
  Synthetic
cacagactttaagaactggctgtcttcaaaactgctccccaaactgcctggccttccctttatctcttgccaaaa

SEQ ID NO: 123744 - DNA, 75 bp, Artificial Sequence
  Synthetic
agccaaacttctccctcgcctgccggggatcccctttctctcgtgccaaacgggatataggggagtctgggcagg

SEQ ID NO: 123745 - DNA, 75 bp, Artificial Sequence
  Synthetic
gctcacgtccatgctcactgatcctgcccacatcactgcagagacggcgcgtcgacgcctcggaagaggctcccc

SEQ ID NO: 123746 - DNA, 75 bp, Artificial Sequence
  Synthetic
tgaactatgcaacagggaatcttcccggttgctctttctctatcttcctcttagctttactgtcctgcctgacgg

SEQ ID NO: 123747 - DNA, 75 bp, Artificial Sequence
  Synthetic
gctaaccttctctggagacaggaggtgggtggaaacatcactagggtcgagtccgagaacaaaataatcgtcctc

SEQ ID NO: 123748 - DNA, 75 bp, Artificial Sequence
  Synthetic
tacgagtctgcgagaaaagagctctctaagaccccattcaacaactgcctaaggcggtgatgggagatgcttacg

SEQ ID NO: 123749 - DNA, 75 bp, Artificial Sequence
  Synthetic
tacgagtctgcgagaaaagagctctctaagaccccattcaacaactgcctaaggcggtgatgggtgatgcttacg

SEQ ID NO: 123750 - DNA, 75 bp, Artificial Sequence
  Synthetic
tacgagtctgcgagaaaagagctctctaagaccccattcaacaactgcctaaggcggtgatgggcgatgcttacg

SEQ ID NO: 123751 - DNA, 75 bp, Artificial Sequence
  Synthetic
tacgagtctgcgagaaaagagctctctaagaccccattcaacaactgcctaaggcggtgatgggggatgcttacg

SEQ ID NO: 123752 - DNA, 75 bp, Artificial Sequence
  Synthetic
tacgagtctgcgagaaaagagctctctatgaccccattcaacaactgcctaaggcggtgatgggagatgcttacg

SEQ ID NO: 123753 - DNA, 75 bp, Artificial Sequence
  Synthetic
tacgagtctgcgagaaaagagctctctatgaccccattcaacaactgcctaaggcggtgatgggtgatgcttacg

SEQ ID NO: 123754 - DNA, 75 bp, Artificial Sequence
  Synthetic
tacgagtctgcgagaaaagagctctctatgaccccattcaacaactgcctaaggcggtgatgggcgatgcttacg

SEQ ID NO: 123755 - DNA, 75 bp, Artificial Sequence
  Synthetic
tacgagtctgcgagaaaagagctctctatgaccccattcaacaactgcctaaggcggtgatgggggatgcttacg

SEQ ID NO: 123756 - DNA, 75 bp, Artificial Sequence
  Synthetic
tacgagtctgcgagaaaagagctctctacgaccccattcaacaactgcctaaggcggtgatgggagatgcttacg

SEQ ID NO: 123757 - DNA, 75 bp, Artificial Sequence
  Synthetic
tacgagtctgcgagaaaagagctctctacgaccccattcaacaactgcctaaggcggtgatgggtgatgcttacg

SEQ ID NO: 123758 - DNA, 75 bp, Artificial Sequence
  Synthetic
tacgagtctgcgagaaaagagctctctacgaccccattcaacaactgcctaaggcggtgatgggcgatgcttacg

SEQ ID NO: 123759 - DNA, 75 bp, Artificial Sequence
  Synthetic
tacgagtctgcgagaaaagagctctctacgaccccattcaacaactgcctaaggcggtgatgggggatgcttacg

SEQ ID NO: 123760 - DNA, 75 bp, Artificial Sequence
  Synthetic
tacgagtctgcgagaaaagagctctctaggaccccattcaacaactgcctaaggcggtgatgggagatgcttacg

SEQ ID NO: 123761 - DNA, 75 bp, Artificial Sequence
  Synthetic
tacgagtctgcgagaaaagagctctctaggaccccattcaacaactgcctaaggcggtgatgggtgatgcttacg

SEQ ID NO: 123762 - DNA, 75 bp, Artificial Sequence
  Synthetic
tacgagtctgcgagaaaagagctctctaggaccccattcaacaactgcctaaggcggtgatgggcgatgcttacg

SEQ ID NO: 123763 - DNA, 75 bp, Artificial Sequence
  Synthetic
tacgagtctgcgagaaaagagctctctaggaccccattcaacaactgcctaaggcggtgatgggggatgcttacg

SEQ ID NO: 123764 - DNA, 75 bp, Artificial Sequence
  Synthetic
tctgcacaccgcaggatgtgtgccctgcgttagggagggcagcacgtcgcagtgctgggtagcgctctctcccac

SEQ ID NO: 123765 - DNA, 75 bp, Artificial Sequence
  Synthetic
ggtggcttccaaggacggcaagctccctacgtcgcagcttcgacgtcacatcgatctgcttgtggggggcgccgc

SEQ ID NO: 123766 - DNA, 75 bp, Artificial Sequence
  Synthetic
ccatctgggcgaggccggactacaatccccctctactggaaagctggaaagccccagattatgacccacctgtgg

SEQ ID NO: 123767 - DNA, 75 bp, Artificial Sequence
  Synthetic
ctccacggtgactgaaagggacatcagggtcgaggaagagatctatcagtgctgtgacctggagcccgaggcccg

SEQ ID NO: 123768 - DNA, 75 bp, Artificial Sequence
  Synthetic
gccccagattatgacccacctgtggtggcaggctgtgcactgcctcccccggggcgaccacctgtccctcctccc

SEQ ID NO: 123769 - DNA, 75 bp, Artificial Sequence
  Synthetic
ccctgagccggacaccgaggtattggcctccatgttgacagacccatcccacattacagcggaggcggcagctag

SEQ ID NO: 123770 - DNA, 75 bp, Artificial Sequence
  Synthetic
tgcaactgttccatctaccccgggcacatcaccggacatcgtatggcctgggatatgatgatgaactggtccccc

SEQ ID NO: 123771 - DNA, 75 bp, Artificial Sequence
  Synthetic
gtatacaccacaagcttcgggaacacggtgacctgctatcttaaggccgtcgcagccaccagggctgcaggctta

SEQ ID NO: 123772 - DNA, 75 bp, Artificial Sequence
  Synthetic
cggtgacctgctatcttaaggccgtcgcagccaccagggctgcaggcttaaagaattgcagcatgctggtttgcg

SEQ ID NO: 123773 - DNA, 75 bp, Artificial Sequence
  Synthetic
aagagtcgggaagaggtgactctctcccgagctctgacgcggtgctctctcctggggaagacgatgctggctctg

SEQ ID NO: 123774 - DNA, 75 bp, Artificial Sequence
  Synthetic
actctatggtggggaactgggcgaaagttgtgatagtgttgctgctcttcgctggcgttgacgcggaaacctaca

SEQ ID NO: 123775 - DNA, 75 bp, Artificial Sequence
  Synthetic
cataaattccctccagctctcccaatatgggccaggcctgactacaatccacctctcctacaagcatggcaaatg

SEQ ID NO: 123776 - DNA, 75 bp, Artificial Sequence
  Synthetic
cgttgtctgttgctccatgtcctactcatggacgggggctctcgtcacaccttgcgctgcagaggaagagaaatt

SEQ ID NO: 123777 - DNA, 75 bp, Artificial Sequence
  Synthetic
tcatggacgggggctctcgtcacaccttgcgctgcagaggaagagaaattgccgatcagcccgctgagcaattct

SEQ ID NO: 123778 - DNA, 75 bp, Artificial Sequence
  Synthetic
gagacagtgcaggactgcaactgctcaatctatcccggccatgtatcaggtcaccgcatggcttgggatatgatg

SEQ ID NO: 123779 - DNA, 75 bp, Artificial Sequence
  Synthetic
gcacatcaacagcaccgccctgaattgcaatgccagtttggagaccgggtggttagcagcactcttttacagccg

SEQ ID NO: 123780 - DNA, 75 bp, Artificial Sequence
  Synthetic
gatctcgagctaataacatcttgctcatccaatgtctcggtcgcacacgatgcagccgggaagagggtttactac

SEQ ID NO: 123781 - DNA, 75 bp, Artificial Sequence
  Synthetic
actaccatgatgtccttaaggagataaaagctcgagcctccaaagtgagcgccaggctcctctccacggaggaag

SEQ ID NO: 123782 - DNA, 75 bp, Artificial Sequence
  Synthetic
atgactctggtcactccactggggtggataccggaggagacagcgtccaacaaccctttgacgaggctgctgttt

SEQ ID NO: 123783 - DNA, 75 bp, Artificial Sequence
  Synthetic
ggcacagaacaacgcccctactgctggcactaccctccaaggccgtgcgggattgtgcccgccagaaacgtgtgc

SEQ ID NO: 123784 - DNA, 75 bp, Artificial Sequence
  Synthetic
gcaaggccattaaccacatcaactccgtgtgggaggacttgctagaagacaactctacacctatacctacaacca

SEQ ID NO: 123785 - DNA, 75 bp, Artificial Sequence
  Synthetic
cggtgagtacaccggaattgccaggacgaccgggtcctttcttggatcaaacccgctcaatgcctggagatttgg
